United States Patent 7,777,022 (BIOINFORMATICALLY DETECTABLE GROUP OF NOVEL REGULATORY VIRAL AND VIRAL ASSOCIATED OLIGONUCLEOTIDES AND USES THEREOF) - sequence listing, part 58

SEQ ID NO: 2626347 - RNA, 16 nt, Human
uauuuugaaugugaag

SEQ ID NO: 2626348 - RNA, 16 nt, Human
uauuuucuuuuguaaa

SEQ ID NO: 2626349 - RNA, 14 nt, Human
uauuuucuguucua

SEQ ID NO: 2626350 - RNA, 21 nt, Human
uauuuucaugacuuuuccaug

SEQ ID NO: 2626351 - RNA, 14 nt, Human
uauuuucuuuaaug

SEQ ID NO: 2626352 - RNA, 14 nt, Human
uauuuucuuugaaa

SEQ ID NO: 2626353 - RNA, 12 nt, Human
uauuuuuuaauu

SEQ ID NO: 2626354 - RNA, 15 nt, Human
uauuuuuuaauuauu

SEQ ID NO: 2626355 - RNA, 15 nt, Human
uauuuuuuaaguauu

SEQ ID NO: 2626356 - RNA, 21 nt, Human
uauuuuuuaaguauuuauaua

SEQ ID NO: 2626357 - RNA, 16 nt, Human
uauuuuuuauauauac

SEQ ID NO: 2626358 - RNA, 12 nt, Human
uauuuuuucaga

SEQ ID NO: 2626359 - RNA, 17 nt, Human
uauuuuuuauuguuuuc

SEQ ID NO: 2626360 - RNA, 13 nt, Human
uauuuuuuauugu

SEQ ID NO: 2626361 - RNA, 13 nt, Human
uauuuuuuaagua

SEQ ID NO: 2626362 - RNA, 20 nt, Human
uauuuuuguuucuuccaaag

SEQ ID NO: 2626363 - RNA, 15 nt, Human
uauuugggaagugaa

SEQ ID NO: 2626364 - RNA, 14 nt, Human
uauuugggaaguga

SEQ ID NO: 2626365 - RNA, 21 nt, Human
uauuuggaauuuauauacaac

SEQ ID NO: 2626366 - RNA, 20 nt, Human
uauuuggaauuuauauacaa

SEQ ID NO: 2626367 - RNA, 11 nt, Human
uauuugcuuuu

SEQ ID NO: 2626368 - RNA, 11 nt, Human
uauuuggaauu

SEQ ID NO: 2626369 - RNA, 15 nt, Human
uauuugcuuuuugcu

SEQ ID NO: 2626370 - RNA, 14 nt, Human
uauuuggaauuuau

SEQ ID NO: 2626371 - RNA, 21 nt, Human
uauuuuaguuucuguucugug

SEQ ID NO: 2626372 - RNA, 20 nt, Human
uauuuuaguuucuguucugu

SEQ ID NO: 2626373 - RNA, 18 nt, Human
uauuuuaguuucuguucu

SEQ ID NO: 2626374 - RNA, 16 nt, Human
uauuuuaguuucuguu

SEQ ID NO: 2626375 - RNA, 14 nt, Human
uauuuuaguuucug

SEQ ID NO: 2626376 - RNA, 22 nt, Human
uauuuuaggcagggauuugagg

SEQ ID NO: 2626377 - RNA, 21 nt, Human
uauuuuaggcagggauuugag

SEQ ID NO: 2626378 - RNA, 14 nt, Human
uauuuuacuuuuau

SEQ ID NO: 2626379 - RNA, 13 nt, Human
uauuuuacuuuua

SEQ ID NO: 2626380 - RNA, 18 nt, Human
uauuuuaggcagggauuu

SEQ ID NO: 2626381 - RNA, 19 nt, Human
uauuugagaguucuaaauu

SEQ ID NO: 2626382 - RNA, 18 nt, Human
uauuugagaguucuaaau

SEQ ID NO: 2626383 - RNA, 19 nt, Human
uauuucuuauauaugugaa

SEQ ID NO: 2626384 - RNA, 16 nt, Human
uauuugagacuaguuu

SEQ ID NO: 2626385 - RNA, 16 nt, Human
uauuugagaguucuaa

SEQ ID NO: 2626386 - RNA, 15 nt, Human
uauuugagaguucua

SEQ ID NO: 2626387 - RNA, 21 nt, Human
uauuucugcugaauuuucaca

SEQ ID NO: 2626388 - RNA, 19 nt, Human
uauuucuuaaaucuaguaa

SEQ ID NO: 2626389 - RNA, 16 nt, Human
uauuucuuauauaugu

SEQ ID NO: 2626390 - RNA, 23 nt, Human
uauuucuuacaggcacaaaauga

SEQ ID NO: 2626391 - RNA, 14 nt, Human
uauuugagaauaua

SEQ ID NO: 2626392 - RNA, 16 nt, Human
uauuucugcugaauuu

SEQ ID NO: 2626393 - RNA, 13 nt, Human
uauuucugcugaa

SEQ ID NO: 2626394 - RNA, 17 nt, Human
uauuucugcauauguug

SEQ ID NO: 2626395 - RNA, 22 nt, Human
uauuucugcugaauuuucacau

SEQ ID NO: 2626396 - RNA, 20 nt, Human
uauuucuuaaacaaauguau

SEQ ID NO: 2626397 - RNA, 19 nt, Human
uauuucucaacaaagcaca

SEQ ID NO: 2626398 - RNA, 18 nt, Human
uauuucuauuuccuggaa

SEQ ID NO: 2626399 - RNA, 21 nt, Human
uauuucucaacaaagcacagu

SEQ ID NO: 2626400 - RNA, 22 nt, Human
uauuucucagacuuuggaaaau

SEQ ID NO: 2626401 - RNA, 16 nt, Human
uauuucugagaagguc

SEQ ID NO: 2626402 - RNA, 21 nt, Human
uauuucugagaagguccuuaa

SEQ ID NO: 2626403 - RNA, 11 nt, Human
uauuucugaga

SEQ ID NO: 2626404 - RNA, 19 nt, Human
uauuucucugauuugcaaa

SEQ ID NO: 2626405 - RNA, 21 nt, Human
uauuucuaugaaauauuaugu

SEQ ID NO: 2626406 - RNA, 14 nt, Human
uauuuauugcuuua

SEQ ID NO: 2626407 - RNA, 13 nt, Human
uauuuauugcuuu

SEQ ID NO: 2626408 - RNA, 16 nt, Human
uauuuauuguuuauuu

SEQ ID NO: 2626409 - RNA, 22 nt, Human
uauuucuaugaaauauuauguu

SEQ ID NO: 2626410 - RNA, 16 nt, Human
uauuucuaugagaaaa

SEQ ID NO: 2626411 - RNA, 16 nt, Human
uauuuauuuaaaagau

SEQ ID NO: 2626412 - RNA, 15 nt, Human
uauuuauuuaaaaga

SEQ ID NO: 2626413 - RNA, 11 nt, Human
uauuuauuuaa

SEQ ID NO: 2626414 - RNA, 13 nt, Human
uauuuauuuaaaa

SEQ ID NO: 2626415 - RNA, 22 nt, Human
uauuuauuguuuauuuaucagu

SEQ ID NO: 2626416 - RNA, 14 nt, Human
uauuuauuacuaug

SEQ ID NO: 2626417 - RNA, 20 nt, Human
uauuuauuccauauucaugu

SEQ ID NO: 2626418 - RNA, 24 nt, Human
uauuuauucagcuucauuuguguc

SEQ ID NO: 2626419 - RNA, 13 nt, Human
uauuuauuaagau

SEQ ID NO: 2626420 - RNA, 13 nt, Human
uauuuauuaccuc

SEQ ID NO: 2626421 - RNA, 21 nt, Human
uauuuauucagcuucauuugu

SEQ ID NO: 2626422 - RNA, 16 nt, Human
uauuuauuaccucuga

SEQ ID NO: 2626423 - RNA, 15 nt, Human
uauuuauuaccucug

SEQ ID NO: 2626424 - RNA, 14 nt, Human
uaucugaaaaugua

SEQ ID NO: 2626425 - RNA, 15 nt, Human
uaucugaaaauguau

SEQ ID NO: 2626426 - RNA, 21 nt, Human
uaucugaaggagauuuuccuu

SEQ ID NO: 2626427 - RNA, 23 nt, Human
uaucucuuuugaauccaugcuug

SEQ ID NO: 2626428 - RNA, 20 nt, Human
uaucugaaaauguaugugua

SEQ ID NO: 2626429 - RNA, 18 nt, Human
uaucugacaucucugcaa

SEQ ID NO: 2626430 - RNA, 23 nt, Human
uauuuauuaaaugcccagccccu

SEQ ID NO: 2626431 - RNA, 14 nt, Human
ucaauaggaaaaac

SEQ ID NO: 2626432 - RNA, 12 nt, Human
ucaaugaucuag

SEQ ID NO: 2626433 - RNA, 22 nt, Human
ucaaugaucuagguuuaacuca

SEQ ID NO: 2626434 - RNA, 21 nt, Human
ucaaugaucuagguuuaacuc

SEQ ID NO: 2626435 - RNA, 19 nt, Human
ucaaugaucuagguuuaac

SEQ ID NO: 2626436 - RNA, 17 nt, Human
ucaaugaucuagguuua

SEQ ID NO: 2626437 - RNA, 15 nt, Human
ucaaugaucuagguu

SEQ ID NO: 2626438 - RNA, 13 nt, Human
ucaaugaucuagg

SEQ ID NO: 2626439 - RNA, 14 nt, Human
ucaaugcacugaca

SEQ ID NO: 2626440 - RNA, 12 nt, Human
ucaagugccuua

SEQ ID NO: 2626441 - RNA, 23 nt, Human
ucaagugcccucuccgagcuggu

SEQ ID NO: 2626442 - RNA, 18 nt, Human
ucaaguggggcucgccau

SEQ ID NO: 2626443 - RNA, 16 nt, Human
ucaaguggggcucgcc

SEQ ID NO: 2626444 - RNA, 18 nt, Human
ucaagugggaucugucac

SEQ ID NO: 2626445 - RNA, 15 nt, Human
ucaaguuagcucagg

SEQ ID NO: 2626446 - RNA, 15 nt, Human
ucaagugucauaugu

SEQ ID NO: 2626447 - RNA, 16 nt, Human
ucaagugucucagucc

SEQ ID NO: 2626448 - RNA, 21 nt, Human
ucaagugucucaguccaccug

SEQ ID NO: 2626449 - RNA, 14 nt, Human
ucaaguuaaaguga

SEQ ID NO: 2626450 - RNA, 13 nt, Human
ucaauaggaaaaa

SEQ ID NO: 2626451 - RNA, 17 nt, Human
ucaauacaguacaggca

SEQ ID NO: 2626452 - RNA, 18 nt, Human
ucaauacaguacaggcag

SEQ ID NO: 2626453 - RNA, 19 nt, Human
ucaauacaguacaggcagc

SEQ ID NO: 2626454 - RNA, 20 nt, Human
ucaauacaguacaggcagca

SEQ ID NO: 2626455 - RNA, 19 nt, Human
ucaaugcagccagaccuau

SEQ ID NO: 2626456 - RNA, 15 nt, Human
ucaaugcagccagac

SEQ ID NO: 2626457 - RNA, 13 nt, Human
ucaaugcagccag

SEQ ID NO: 2626458 - RNA, 13 nt, Human
ucaaugcucauaa

SEQ ID NO: 2626459 - RNA, 12 nt, Human
ucaaugcucaua

SEQ ID NO: 2626460 - RNA, 20 nt, Human
ucaauggauuugaugcuguu

SEQ ID NO: 2626461 - RNA, 14 nt, Human
ucaaugcucauaac

SEQ ID NO: 2626462 - RNA, 17 nt, Human
ucaaugcuauaacuaug

SEQ ID NO: 2626463 - RNA, 18 nt, Human
ucaaugcacugacauugu

SEQ ID NO: 2626464 - RNA, 18 nt, Human
ucaauuacaggaaguacu

SEQ ID NO: 2626465 - RNA, 13 nt, Human
ucaauuacaggaa

SEQ ID NO: 2626466 - RNA, 17 nt, Human
ucaaugggcaaugacag

SEQ ID NO: 2626467 - RNA, 22 nt, Human
ucaaugggaaauacuacuccug

SEQ ID NO: 2626468 - RNA, 14 nt, Human
ucaaugggaaauac

SEQ ID NO: 2626469 - RNA, 12 nt, Human
ucaauggcuuuu

SEQ ID NO: 2626470 - RNA, 22 nt, Human
ucaauggcugcugaagcugccu

SEQ ID NO: 2626471 - RNA, 18 nt, Human
ucaauggcgcagugccuc

SEQ ID NO: 2626472 - RNA, 14 nt, Human
ucaaugggcaauga

SEQ ID NO: 2626473 - RNA, 16 nt, Human
ucaauuaaauguaggu

SEQ ID NO: 2626474 - RNA, 11 nt, Human
ucaauuaauaa

SEQ ID NO: 2626475 - RNA, 19 nt, Human
ucaaugguuuaacauauaa

SEQ ID NO: 2626476 - RNA, 22 nt, Human
ucacaaugaaaugcucuccuuu

SEQ ID NO: 2626477 - RNA, 14 nt, Human
ucacaauagaaacu

SEQ ID NO: 2626478 - RNA, 16 nt, Human
ucacaauaauuuucua

SEQ ID NO: 2626479 - RNA, 15 nt, Human
ucacaauaauuuucu

SEQ ID NO: 2626480 - RNA, 13 nt, Human
ucacaauacuguu

SEQ ID NO: 2626481 - RNA, 19 nt, Human
ucaauuacaggaaguacug

SEQ ID NO: 2626482 - RNA, 20 nt, Human
ucacaaguuguguuugauau

SEQ ID NO: 2626483 - RNA, 20 nt, Human
ucacaauaaaaauggcucag

SEQ ID NO: 2626484 - RNA, 13 nt, Human
ucacacagugagu

SEQ ID NO: 2626485 - RNA, 22 nt, Human
ucacacaguauuacuucugcua

SEQ ID NO: 2626486 - RNA, 21 nt, Human
ucacacaguauuacuucugcu

SEQ ID NO: 2626487 - RNA, 16 nt, Human
ucacaauagaaacuca

SEQ ID NO: 2626488 - RNA, 23 nt, Human
ucacaaugaaaugcucuccuuuc

SEQ ID NO: 2626489 - RNA, 10 nt, Human
ucacacacac

SEQ ID NO: 2626490 - RNA, 19 nt, Human
ucacacaauacaauaaguu

SEQ ID NO: 2626491 - RNA, 14 nt, Human
ucacaggaaguaga

SEQ ID NO: 2626492 - RNA, 19 nt, Human
ucacaggaaguagaggagg

SEQ ID NO: 2626493 - RNA, 23 nt, Human
ucacaggacagcccuucuuucca

SEQ ID NO: 2626494 - RNA, 11 nt, Human
ucacaggcagg

SEQ ID NO: 2626495 - RNA, 23 nt, Human
ucacacagugagucgaggacagg

SEQ ID NO: 2626496 - RNA, 22 nt, Human
ucacacagugagucgaggacag

SEQ ID NO: 2626497 - RNA, 21 nt, Human
ucacacaugagcaucaggcca

SEQ ID NO: 2626498 - RNA, 23 nt, Human
ucacacagugggugguggaucug

SEQ ID NO: 2626499 - RNA, 15 nt, Human
ucaaacuuuacuaug

SEQ ID NO: 2626500 - RNA, 13 nt, Human
ucaaacuuuacua

SEQ ID NO: 2626501 - RNA, 16 nt, Human
ucaaacugaagccaga

SEQ ID NO: 2626502 - RNA, 22 nt, Human
ucaaacucuugaccucagguga

SEQ ID NO: 2626503 - RNA, 23 nt, Human
ucaaacugaaugaaacccccaca

SEQ ID NO: 2626504 - RNA, 15 nt, Human
ucaaacugaggaauu

SEQ ID NO: 2626505 - RNA, 16 nt, Human
ucaaacuuuacuaugg

SEQ ID NO: 2626506 - RNA, 23 nt, Human
ucaaccuaccaccccuuccuguc

SEQ ID NO: 2626507 - RNA, 22 nt, Human
ucaaccuaccaccccuuccugu

SEQ ID NO: 2626508 - RNA, 21 nt, Human
ucaaccuaccaccccuuccug

SEQ ID NO: 2626509 - RNA, 20 nt, Human
ucaaccuaccaccccuuccu

SEQ ID NO: 2626510 - RNA, 18 nt, Human
ucaaccuaccaccccuuc

SEQ ID NO: 2626511 - RNA, 15 nt, Human
ucaaccuaccacccc

SEQ ID NO: 2626512 - RNA, 13 nt, Human
ucaaccuaaccac

SEQ ID NO: 2626513 - RNA, 21 nt, Human
ucaacccuuuugucugccucu

SEQ ID NO: 2626514 - RNA, 20 nt, Human
ucaacccuuuugucugccuc

SEQ ID NO: 2626515 - RNA, 18 nt, Human
ucaacccuuuugucugcc

SEQ ID NO: 2626516 - RNA, 19 nt, Human
ucaacuccaaacugacucu

SEQ ID NO: 2626517 - RNA, 16 nt, Human
ucaacucaccuaaugu

SEQ ID NO: 2626518 - RNA, 18 nt, Human
ucaagcagucgugccugu

SEQ ID NO: 2626519 - RNA, 17 nt, Human
ucaagcagucgugccug

SEQ ID NO: 2626520 - RNA, 16 nt, Human
ucaagcagucgugccu

SEQ ID NO: 2626521 - RNA, 15 nt, Human
ucaacucauggagau

SEQ ID NO: 2626522 - RNA, 23 nt, Human
ucaagcagcgaccgcccccuccu

SEQ ID NO: 2626523 - RNA, 19 nt, Human
ucaacucauaagacuuugg

SEQ ID NO: 2626524 - RNA, 20 nt, Human
ucaacucagacuaguuuagu

SEQ ID NO: 2626525 - RNA, 16 nt, Human
ucaacucagacuaguu

SEQ ID NO: 2626526 - RNA, 19 nt, Human
ucaacucaccuaauguuua

SEQ ID NO: 2626527 - RNA, 14 nt, Human
ucaaccuccugggc

SEQ ID NO: 2626528 - RNA, 13 nt, Human
ucaaccuccuggg

SEQ ID NO: 2626529 - RNA, 13 nt, Human
ucaaccuccugga

SEQ ID NO: 2626530 - RNA, 20 nt, Human
ucaaccuacuuucauacuga

SEQ ID NO: 2626531 - RNA, 23 nt, Human
ucaacgcuuaaaggugucuuccu

SEQ ID NO: 2626532 - RNA, 12 nt, Human
ucaaccuccugg

SEQ ID NO: 2626533 - RNA, 19 nt, Human
ucaacuaaaaaaaaaaaag

SEQ ID NO: 2626534 - RNA, 20 nt, Human
ucaacuaaaaaaaaaaaagu

SEQ ID NO: 2626535 - RNA, 15 nt, Human
ucaacguauuguuuc

SEQ ID NO: 2626536 - RNA, 15 nt, Human
ucaagcuccuccucc

SEQ ID NO: 2626537 - RNA, 16 nt, Human
ucaagcuccuccuccc

SEQ ID NO: 2626538 - RNA, 18 nt, Human
ucaagcuccuccucccug

SEQ ID NO: 2626539 - RNA, 20 nt, Human
ucaagcuccuccucccugca

SEQ ID NO: 2626540 - RNA, 13 nt, Human
ucaagcuccuccu

SEQ ID NO: 2626541 - RNA, 14 nt, Human
ucaagcuccuccuc

SEQ ID NO: 2626542 - RNA, 20 nt, Human
ucaagcuagaaggccacaug

SEQ ID NO: 2626543 - RNA, 19 nt, Human
ucaaggauccugagccaga

SEQ ID NO: 2626544 - RNA, 18 nt, Human
ucaaggauccugagccag

SEQ ID NO: 2626545 - RNA, 22 nt, Human
ucaagugauucuccugccucag

SEQ ID NO: 2626546 - RNA, 19 nt, Human
ucaagugcaugcucucugc

SEQ ID NO: 2626547 - RNA, 20 nt, Human
ucaagugcaugcucucugca

SEQ ID NO: 2626548 - RNA, 21 nt, Human
ucaagugcaugcucucugcag

SEQ ID NO: 2626549 - RNA, 22 nt, Human
ucaagugcaugcucucugcagc

SEQ ID NO: 2626550 - RNA, 20 nt, Human
ucaaggauccugagccagau

SEQ ID NO: 2626551 - RNA, 21 nt, Human
ucaagcugugagacaguggga

SEQ ID NO: 2626552 - RNA, 19 nt, Human
ucaagcuagaaggccacau

SEQ ID NO: 2626553 - RNA, 18 nt, Human
ucaagcuagaaggccaca

SEQ ID NO: 2626554 - RNA, 16 nt, Human
ucaagcuagaaggcca

SEQ ID NO: 2626555 - RNA, 16 nt, Human
ucaagcgauucuucug

SEQ ID NO: 2626556 - RNA, 15 nt, Human
ucaagcgauucuccu

SEQ ID NO: 2626557 - RNA, 15 nt, Human
ucaagcgauucuucu

SEQ ID NO: 2626558 - RNA, 14 nt, Human
ucaagccugccuag

SEQ ID NO: 2626559 - RNA, 22 nt, Human
ucaagcagucgugccugugucc

SEQ ID NO: 2626560 - RNA, 21 nt, Human
ucaagcagucgugccuguguc

SEQ ID NO: 2626561 - RNA, 20 nt, Human
ucaagcagucgugccugugu

SEQ ID NO: 2626562 - RNA, 19 nt, Human
ucaagcagucgugccugug

SEQ ID NO: 2626563 - RNA, 23 nt, Human
ucaagcagucgugccugugucca

SEQ ID NO: 2626564 - RNA, 19 nt, Human
ucaagcagucuacccaccu

SEQ ID NO: 2626565 - RNA, 20 nt, Human
ucaagcagucuacccaccuc

SEQ ID NO: 2626566 - RNA, 14 nt, Human
ucaagccaagcagc

SEQ ID NO: 2626567 - RNA, 17 nt, Human
ucaagccaagcagccaa

SEQ ID NO: 2626568 - RNA, 12 nt, Human
ucaagcccugca

SEQ ID NO: 2626569 - RNA, 14 nt, Human
ucaagccucugguc

SEQ ID NO: 2626570 - RNA, 13 nt, Human
ucaagcccugcag

SEQ ID NO: 2626571 - RNA, 15 nt, Human
ucaagccaagcagcc

SEQ ID NO: 2626572 - RNA, 16 nt, Human
ucaagccaagcagcca

SEQ ID NO: 2626573 - RNA, 19 nt, Human
ucaagcccaggaggacugc

SEQ ID NO: 2626574 - RNA, 16 nt, Human
ucaagcccgcggggac

SEQ ID NO: 2626575 - RNA, 18 nt, Human
ucaccuuuguccccaccg

SEQ ID NO: 2626576 - RNA, 17 nt, Human
ucaccuuuguccccacc

SEQ ID NO: 2626577 - RNA, 15 nt, Human
ucaccuuugucccca

SEQ ID NO: 2626578 - RNA, 14 nt, Human
ucaccuuugucccc

SEQ ID NO: 2626579 - RNA, 22 nt, Human
ucacgaaguguugcauggaugu

SEQ ID NO: 2626580 - RNA, 16 nt, Human
ucacgaaguguugcau

SEQ ID NO: 2626581 - RNA, 20 nt, Human
ucacgaauauuaugcccagu

SEQ ID NO: 2626582 - RNA, 21 nt, Human
ucacgauugucaucaggagaa

SEQ ID NO: 2626583 - RNA, 18 nt, Human
ucacgauugucaucagga

SEQ ID NO: 2626584 - RNA, 19 nt, Human
ucacgaauauuaugcccag

SEQ ID NO: 2626585 - RNA, 14 nt, Human
ucacgcaccugggu

SEQ ID NO: 2626586 - RNA, 15 nt, Human
ucacgcaccucccau

SEQ ID NO: 2626587 - RNA, 16 nt, Human
ucacgcaccucccauc

SEQ ID NO: 2626588 - RNA, 22 nt, Human
ucaccuuuguccccaccgcaga

SEQ ID NO: 2626589 - RNA, 14 nt, Human
ucacgccacugcac

SEQ ID NO: 2626590 - RNA, 13 nt, Human
ucacgccacugca

SEQ ID NO: 2626591 - RNA, 16 nt, Human
ucacgccacugcacua

SEQ ID NO: 2626592 - RNA, 17 nt, Human
ucacgcaccucccaucc

SEQ ID NO: 2626593 - RNA, 22 nt, Human
ucacgccacugcacuccagccu

SEQ ID NO: 2626594 - RNA, 19 nt, Human
ucacgccuguaauccuagc

SEQ ID NO: 2626595 - RNA, 19 nt, Human
ucacgccuguaaucccagc

SEQ ID NO: 2626596 - RNA, 21 nt, Human
ucacgccuguaaucccagcac

SEQ ID NO: 2626597 - RNA, 20 nt, Human
ucacgccuguaaucccagca

SEQ ID NO: 2626598 - RNA, 19 nt, Human
ucacgccuaugaucccagc

SEQ ID NO: 2626599 - RNA, 21 nt, Human
ucacgccuaugaucccagcac

SEQ ID NO: 2626600 - RNA, 21 nt, Human
ucacgcuccccgccuguuccc

SEQ ID NO: 2626601 - RNA, 16 nt, Human
ucacgcuccccgccug

SEQ ID NO: 2626602 - RNA, 12 nt, Human
ucacgcuccccg

SEQ ID NO: 2626603 - RNA, 23 nt, Human
ucacgccuguaaucccagcacuu

SEQ ID NO: 2626604 - RNA, 21 nt, Human
ucacgccuguaaucccagcag

SEQ ID NO: 2626605 - RNA, 13 nt, Human
ucacgccugugca

SEQ ID NO: 2626606 - RNA, 16 nt, Human
ucacgccugugcagug

SEQ ID NO: 2626607 - RNA, 20 nt, Human
ucacgccuguaauccuagca

SEQ ID NO: 2626608 - RNA, 23 nt, Human
ucaccuuggcaccagacacccag

SEQ ID NO: 2626609 - RNA, 13 nt, Human
ucaccuuuauucu

SEQ ID NO: 2626610 - RNA, 18 nt, Human
ucaccuuggcaccagaca

SEQ ID NO: 2626611 - RNA, 19 nt, Human
ucaccuuggcaccagacac

SEQ ID NO: 2626612 - RNA, 18 nt, Human
ucaccuugcaacacacag

SEQ ID NO: 2626613 - RNA, 19 nt, Human
ucaccuugcaacacacaga

SEQ ID NO: 2626614 - RNA, 21 nt, Human
ucaccuugcaacacacagaca

SEQ ID NO: 2626615 - RNA, 12 nt, Human
ucaccuuugucc

SEQ ID NO: 2626616 - RNA, 14 nt, Human
ucaccuuucccauc

SEQ ID NO: 2626617 - RNA, 20 nt, Human
ucaccuauuuccauucaaca

SEQ ID NO: 2626618 - RNA, 13 nt, Human
ucaccucaugccc

SEQ ID NO: 2626619 - RNA, 22 nt, Human
ucaccuucguuuacuaugccug

SEQ ID NO: 2626620 - RNA, 18 nt, Human
ucaccucaggccaggugc

SEQ ID NO: 2626621 - RNA, 19 nt, Human
ucacaggcagguccagggu

SEQ ID NO: 2626622 - RNA, 18 nt, Human
ucacaggcgaggccugga

SEQ ID NO: 2626623 - RNA, 19 nt, Human
ucacaggccccaggaaagg

SEQ ID NO: 2626624 - RNA, 15 nt, Human
ucacaggcaggucca

SEQ ID NO: 2626625 - RNA, 12 nt, Human
ucacaggcaggu

SEQ ID NO: 2626626 - RNA, 15 nt, Human
ucaccuagaaauuga

SEQ ID NO: 2626627 - RNA, 12 nt, Human
ucacagggccaa

SEQ ID NO: 2626628 - RNA, 20 nt, Human
ucacagggcaugccccggcc

SEQ ID NO: 2626629 - RNA, 22 nt, Human
ucacagggccaacuugagggcc

SEQ ID NO: 2626630 - RNA, 14 nt, Human
ucacagggccaacu

SEQ ID NO: 2626631 - RNA, 16 nt, Human
ucacagggccccagaa

SEQ ID NO: 2626632 - RNA, 18 nt, Human
ucacagggcagagccggg

SEQ ID NO: 2626633 - RNA, 19 nt, Human
ucacagggcagagccggga

SEQ ID NO: 2626634 - RNA, 20 nt, Human
ucacaggcgaggccuggagu

SEQ ID NO: 2626635 - RNA, 15 nt, Human
ucacagggcagagcc

SEQ ID NO: 2626636 - RNA, 23 nt, Human
ucacagggacugaaaaccucucc

SEQ ID NO: 2626637 - RNA, 22 nt, Human
ucacucuggcagcucagagagg

SEQ ID NO: 2626638 - RNA, 20 nt, Human
ucacucuggcagcucagaga

SEQ ID NO: 2626639 - RNA, 19 nt, Human
ucacucuggcagcucagag

SEQ ID NO: 2626640 - RNA, 18 nt, Human
ucacucuggcagcucaga

SEQ ID NO: 2626641 - RNA, 17 nt, Human
ucacucuggcagcucag

SEQ ID NO: 2626642 - RNA, 16 nt, Human
ucacucuggcagcuca

SEQ ID NO: 2626643 - RNA, 15 nt, Human
ucacucuggcagcuc

SEQ ID NO: 2626644 - RNA, 14 nt, Human
ucacucuggcagcu

SEQ ID NO: 2626645 - RNA, 13 nt, Human
ucacucuggcagc

SEQ ID NO: 2626646 - RNA, 12 nt, Human
ucacucuggcag

SEQ ID NO: 2626647 - RNA, 23 nt, Human
ucacucuccuuggugucgggcau

SEQ ID NO: 2626648 - RNA, 15 nt, Human
ucacucucugaagau

SEQ ID NO: 2626649 - RNA, 14 nt, Human
ucacucuccuuggu

SEQ ID NO: 2626650 - RNA, 12 nt, Human
ucacucuccuug

SEQ ID NO: 2626651 - RNA, 20 nt, Human
ucacucuacuuagcaugucc

SEQ ID NO: 2626652 - RNA, 19 nt, Human
ucacucuacuuagcauguc

SEQ ID NO: 2626653 - RNA, 20 nt, Human
ucacggcucacugcagccuc

SEQ ID NO: 2626654 - RNA, 15 nt, Human
ucacggcucacugca

SEQ ID NO: 2626655 - RNA, 13 nt, Human
ucacggcucacug

SEQ ID NO: 2626656 - RNA, 17 nt, Human
ucacgcuuuccugaauc

SEQ ID NO: 2626657 - RNA, 22 nt, Human
ucacgcuuuccugaauccaaac

SEQ ID NO: 2626658 - RNA, 15 nt, Human
ucacggaaguuuuca

SEQ ID NO: 2626659 - RNA, 16 nt, Human
ucacggaaguuuucaa

SEQ ID NO: 2626660 - RNA, 22 nt, Human
ucacggcaggacaacgaggaag

SEQ ID NO: 2626661 - RNA, 14 nt, Human
ucacgcuucuucuu

SEQ ID NO: 2626662 - RNA, 14 nt, Human
ucacgcuuuccuga

SEQ ID NO: 2626663 - RNA, 15 nt, Human
ucacgcuuuccugaa

SEQ ID NO: 2626664 - RNA, 16 nt, Human
ucacgcuuuccugaau

SEQ ID NO: 2626665 - RNA, 14 nt, Human
ucacggaagagccu

SEQ ID NO: 2626666 - RNA, 16 nt, Human
ucacggaagagccuug

SEQ ID NO: 2626667 - RNA, 17 nt, Human
ucacggaagagccuugc

SEQ ID NO: 2626668 - RNA, 17 nt, Human
ucacucggcacccugca

SEQ ID NO: 2626669 - RNA, 14 nt, Human
ucacucggcacccu

SEQ ID NO: 2626670 - RNA, 15 nt, Human
ucacucgcccccggg

SEQ ID NO: 2626671 - RNA, 13 nt, Human
ucacuccuugaaa

SEQ ID NO: 2626672 - RNA, 20 nt, Human
ucacuccuguuacuuaccua

SEQ ID NO: 2626673 - RNA, 10 nt, Human
ucacuccugu

SEQ ID NO: 2626674 - RNA, 20 nt, Human
ucacuccuggggccucuugg

SEQ ID NO: 2626675 - RNA, 18 nt, Human
ucacuccuaccugguaau

SEQ ID NO: 2626676 - RNA, 22 nt, Human
ucacgggagauuucuuguugcu

SEQ ID NO: 2626677 - RNA, 19 nt, Human
ucacgggcaugggcacucc

SEQ ID NO: 2626678 - RNA, 18 nt, Human
ucacgggcaguagcugug

SEQ ID NO: 2626679 - RNA, 17 nt, Human
ucacgggacuauuucca

SEQ ID NO: 2626680 - RNA, 23 nt, Human
ucacggcaggacaacgaggaagc

SEQ ID NO: 2626681 - RNA, 12 nt, Human
ucacuccugggg

SEQ ID NO: 2626682 - RNA, 13 nt, Human
ucacuccuggggc

SEQ ID NO: 2626683 - RNA, 11 nt, Human
ucacuccuggg

SEQ ID NO: 2626684 - RNA, 20 nt, Human
ucacgggcaugggcacuccc

SEQ ID NO: 2626685 - RNA, 20 nt, Human
ucacuccugagaccccuggc

SEQ ID NO: 2626686 - RNA, 19 nt, Human
ucacuccugagaccccugg

SEQ ID NO: 2626687 - RNA, 22 nt, Human
ucacuccugagaccccuggccu

SEQ ID NO: 2626688 - RNA, 21 nt, Human
ucacuccugagaccccuggcc

SEQ ID NO: 2626689 - RNA, 23 nt, Human
ucacuccugagaccccuggccuc

SEQ ID NO: 2626690 - RNA, 16 nt, Human
ucacuuuucagugaug

SEQ ID NO: 2626691 - RNA, 14 nt, Human
ucacuuuucaguga

SEQ ID NO: 2626692 - RNA, 13 nt, Human
ucacuuuucagug

SEQ ID NO: 2626693 - RNA, 22 nt, Human
ucacuuuuagggagagucauau

SEQ ID NO: 2626694 - RNA, 12 nt, Human
ucacuuuuccuc

SEQ ID NO: 2626695 - RNA, 12 nt, Human
ucacuuuuauuu

SEQ ID NO: 2626696 - RNA, 22 nt, Human
ucacuuuuauuuagcaccaggg

SEQ ID NO: 2626697 - RNA, 16 nt, Human
ucacuuugcucugggu

SEQ ID NO: 2626698 - RNA, 13 nt, Human
ucacuuuuaggga

SEQ ID NO: 2626699 - RNA, 17 nt, Human
ucacuuugcucugggug

SEQ ID NO: 2626700 - RNA, 15 nt, Human
ucacuuugcucuggg

SEQ ID NO: 2626701 - RNA, 14 nt, Human
ucacuuucuagauu

SEQ ID NO: 2626702 - RNA, 19 nt, Human
ucacuuucacauagauguc

SEQ ID NO: 2626703 - RNA, 14 nt, Human
ucacuuucucaguu

SEQ ID NO: 2626704 - RNA, 14 nt, Human
ucacuuugcucugg

SEQ ID NO: 2626705 - RNA, 13 nt, Human
ucacuuuuuucca

SEQ ID NO: 2626706 - RNA, 15 nt, Human
ucacuuuuuuccaca

SEQ ID NO: 2626707 - RNA, 15 nt, Human
ucacuuuuuuuuucc

SEQ ID NO: 2626708 - RNA, 16 nt, Human
ucacuuuuuuccacau

SEQ ID NO: 2626709 - RNA, 13 nt, Human
ucacuuuuccucc

SEQ ID NO: 2626710 - RNA, 18 nt, Human
ucacuuuuccucccucag

SEQ ID NO: 2626711 - RNA, 18 nt, Human
ucacuuuugacaaaggca

SEQ ID NO: 2626712 - RNA, 17 nt, Human
ucagaaaauauuaugug

SEQ ID NO: 2626713 - RNA, 21 nt, Human
ucacuuuuuuuuuccaaaaaa

SEQ ID NO: 2626714 - RNA, 19 nt, Human
ucacuuuuuuuuuccaaaa

SEQ ID NO: 2626715 - RNA, 17 nt, Human
ucacuuuuuuuuuccaa

SEQ ID NO: 2626716 - RNA, 17 nt, Human
ucagaaaaaaauaaaug

SEQ ID NO: 2626717 - RNA, 20 nt, Human
ucagaaaauauuauguguuu

SEQ ID NO: 2626718 - RNA, 19 nt, Human
ucagaaaauauuauguguu

SEQ ID NO: 2626719 - RNA, 14 nt, Human
ucagaaaagggaag

SEQ ID NO: 2626720 - RNA, 14 nt, Human
ucagaaagagcaag

SEQ ID NO: 2626721 - RNA, 12 nt, Human
ucagaaaggaau

SEQ ID NO: 2626722 - RNA, 17 nt, Human
ucagaaagcauuacauu

SEQ ID NO: 2626723 - RNA, 23 nt, Human
ucagaaagagcaagucuggaucu

SEQ ID NO: 2626724 - RNA, 20 nt, Human
ucagaaauacagauuuugau

SEQ ID NO: 2626725 - RNA, 16 nt, Human
ucagaaauacagauuu

SEQ ID NO: 2626726 - RNA, 13 nt, Human
ucagaaauacaga

SEQ ID NO: 2626727 - RNA, 23 nt, Human
ucagaaagugugcuuuaugcuga

SEQ ID NO: 2626728 - RNA, 20 nt, Human
ucacuggcucuccaagugcc

SEQ ID NO: 2626729 - RNA, 19 nt, Human
ucacuggcucuccaagugc

SEQ ID NO: 2626730 - RNA, 22 nt, Human
ucacuggcucuccaagugccag

SEQ ID NO: 2626731 - RNA, 17 nt, Human
ucacuggcucuccaagu

SEQ ID NO: 2626732 - RNA, 16 nt, Human
ucacuggcucuccaag

SEQ ID NO: 2626733 - RNA, 15 nt, Human
ucacuggcucuccaa

SEQ ID NO: 2626734 - RNA, 11 nt, Human
ucacuggcucu

SEQ ID NO: 2626735 - RNA, 15 nt, Human
ucacuggccaucccu

SEQ ID NO: 2626736 - RNA, 14 nt, Human
ucacuggcucucca

SEQ ID NO: 2626737 - RNA, 20 nt, Human
ucacuggcgacacguagcag

SEQ ID NO: 2626738 - RNA, 22 nt, Human
ucacuggcgacacguagcagcu

SEQ ID NO: 2626739 - RNA, 13 nt, Human
ucacuggaugaaa

SEQ ID NO: 2626740 - RNA, 22 nt, Human
ucacuggaguuacauuaauguu

SEQ ID NO: 2626741 - RNA, 21 nt, Human
ucacuggaguuacauuaaugu

SEQ ID NO: 2626742 - RNA, 19 nt, Human
ucacuggaguuacauuaau

SEQ ID NO: 2626743 - RNA, 17 nt, Human
ucacuggagcccaggag

SEQ ID NO: 2626744 - RNA, 14 nt, Human
ucacucuggccuca

SEQ ID NO: 2626745 - RNA, 21 nt, Human
ucacuggccacaguuguuuga

SEQ ID NO: 2626746 - RNA, 16 nt, Human
ucacuggcaaugaaaa

SEQ ID NO: 2626747 - RNA, 19 nt, Human
ucacuggaugaagauucuc

SEQ ID NO: 2626748 - RNA, 14 nt, Human
ucacuggaugaaga

SEQ ID NO: 2626749 - RNA, 20 nt, Human
ucacuuggugauauguccua

SEQ ID NO: 2626750 - RNA, 16 nt, Human
ucacuuguacaaaaua

SEQ ID NO: 2626751 - RNA, 17 nt, Human
ucacuuguacaaaauaa

SEQ ID NO: 2626752 - RNA, 17 nt, Human
ucacuugucaauaaaau

SEQ ID NO: 2626753 - RNA, 20 nt, Human
ucacuugaugugccauuuua

SEQ ID NO: 2626754 - RNA, 20 nt, Human
ucacuggcugccuccacucc

SEQ ID NO: 2626755 - RNA, 18 nt, Human
ucacuggcugccuccacu

SEQ ID NO: 2626756 - RNA, 17 nt, Human
ucacuggcugccuccac

SEQ ID NO: 2626757 - RNA, 15 nt, Human
ucacuggcugccucc

SEQ ID NO: 2626758 - RNA, 14 nt, Human
ucacuggcugccuc

SEQ ID NO: 2626759 - RNA, 14 nt, Human
ucacuuguacaaaa

SEQ ID NO: 2626760 - RNA, 15 nt, Human
ucacuuguacaaaau

SEQ ID NO: 2626761 - RNA, 13 nt, Human
ucacuuguacaaa

SEQ ID NO: 2626762 - RNA, 15 nt, Human
ucacugcuuaacuuc

SEQ ID NO: 2626763 - RNA, 17 nt, Human
ucacugcuuaacuucac

SEQ ID NO: 2626764 - RNA, 18 nt, Human
ucacugcuuaacuucaca

SEQ ID NO: 2626765 - RNA, 20 nt, Human
ucacugcuuaacuucacaua

SEQ ID NO: 2626766 - RNA, 16 nt, Human
ucacucugucgcccag

SEQ ID NO: 2626767 - RNA, 12 nt, Human
ucacucugucgc

SEQ ID NO: 2626768 - RNA, 19 nt, Human
ucacucugucgcccagucu

SEQ ID NO: 2626769 - RNA, 13 nt, Human
ucacucuggccuc

SEQ ID NO: 2626770 - RNA, 14 nt, Human
ucacucugcugcuu

SEQ ID NO: 2626771 - RNA, 13 nt, Human
ucacucugcugcu

SEQ ID NO: 2626772 - RNA, 22 nt, Human
ucacucugucgcccagucugga

SEQ ID NO: 2626773 - RNA, 18 nt, Human
ucagacagcugccuggga

SEQ ID NO: 2626774 - RNA, 17 nt, Human
ucagacagcugccuggg

SEQ ID NO: 2626775 - RNA, 16 nt, Human
ucagacagcugccugg

SEQ ID NO: 2626776 - RNA, 15 nt, Human
ucagacagcugccug

SEQ ID NO: 2626777 - RNA, 20 nt, Human
ucagacagcugccugggauc

SEQ ID NO: 2626778 - RNA, 19 nt, Human
ucagacagcugccugggau

SEQ ID NO: 2626779 - RNA, 19 nt, Human
ucagacauagaauuaacac

SEQ ID NO: 2626780 - RNA, 15 nt, Human
ucagaaaugcugccu

SEQ ID NO: 2626781 - RNA, 12 nt, Human
ucagaaauaugu

SEQ ID NO: 2626782 - RNA, 14 nt, Human
ucagacugaacaug

SEQ ID NO: 2626783 - RNA, 14 nt, Human
ucagacugcaugua

SEQ ID NO: 2626784 - RNA, 19 nt, Human
ucagacugaacauguacac

SEQ ID NO: 2626785 - RNA, 13 nt, Human
ucagacugcuggg

SEQ ID NO: 2626786 - RNA, 14 nt, Human
ucagacugcuggga

SEQ ID NO: 2626787 - RNA, 15 nt, Human
ucagacugcugggac

SEQ ID NO: 2626788 - RNA, 16 nt, Human
ucagacugcugggacu

SEQ ID NO: 2626789 - RNA, 17 nt, Human
ucagacugcugggacug

SEQ ID NO: 2626790 - RNA, 21 nt, Human
ucagacugcugggacuggcca

SEQ ID NO: 2626791 - RNA, 21 nt, Human
ucagacauccauguuuguaaa

SEQ ID NO: 2626792 - RNA, 14 nt, Human
ucagaaaugcugcc

SEQ ID NO: 2626793 - RNA, 22 nt, Human
ucagacauccauguuuguaaaa

SEQ ID NO: 2626794 - RNA, 14 nt, Human
ucagacauguuuuc

SEQ ID NO: 2626795 - RNA, 15 nt, Human
ucagacauguuuucc

SEQ ID NO: 2626796 - RNA, 22 nt, Human
ucagacauagaauuaacacaug

SEQ ID NO: 2626797 - RNA, 21 nt, Human
ucagacucccauuccugaaga

SEQ ID NO: 2626798 - RNA, 22 nt, Human
ucagacucccauuccugaagaa

SEQ ID NO: 2626799 - RNA, 19 nt, Human
ucagacucccauuccugaa

SEQ ID NO: 2626800 - RNA, 14 nt, Human
ucagacuagugaca

SEQ ID NO: 2626801 - RNA, 20 nt, Human
ucagacauguuuuccgugaa

SEQ ID NO: 2626802 - RNA, 14 nt, Human
ucagaccacggcuc

SEQ ID NO: 2626803 - RNA, 14 nt, Human
ucagaccagcucuu

SEQ ID NO: 2626804 - RNA, 17 nt, Human
ucagcacugauuucaca

SEQ ID NO: 2626805 - RNA, 13 nt, Human
ucagcacaaggcc

SEQ ID NO: 2626806 - RNA, 19 nt, Human
ucagcacgauuucuguuua

SEQ ID NO: 2626807 - RNA, 13 nt, Human
ucagcacuguccc

SEQ ID NO: 2626808 - RNA, 12 nt, Human
ucagcacugucc

SEQ ID NO: 2626809 - RNA, 20 nt, Human
ucagcacugauuucacaaca

SEQ ID NO: 2626810 - RNA, 21 nt, Human
ucagcacugucccuugccuca

SEQ ID NO: 2626811 - RNA, 14 nt, Human
ucagcacugucccu

SEQ ID NO: 2626812 - RNA, 23 nt, Human
ucagcacuugggggaucuguugu

SEQ ID NO: 2626813 - RNA, 16 nt, Human
ucagcaacucgcuuua

SEQ ID NO: 2626814 - RNA, 21 nt, Human
ucagcaaauuaauuggcagca

SEQ ID NO: 2626815 - RNA, 23 nt, Human
ucagcaaauuaauuggcagcaga

SEQ ID NO: 2626816 - RNA, 18 nt, Human
ucagcacgauuucuguuu

SEQ ID NO: 2626817 - RNA, 18 nt, Human
ucagaggcccucgcugcc

SEQ ID NO: 2626818 - RNA, 21 nt, Human
ucagaggcccucgcugccagc

SEQ ID NO: 2626819 - RNA, 20 nt, Human
ucagaggccuauaaugaagc

SEQ ID NO: 2626820 - RNA, 15 nt, Human
ucagaggccuauaau

SEQ ID NO: 2626821 - RNA, 22 nt, Human
ucagaggcccucgcugccagcu

SEQ ID NO: 2626822 - RNA, 20 nt, Human
ucagaggauggccagugucu

SEQ ID NO: 2626823 - RNA, 18 nt, Human
ucagaggcacaaaagggu

SEQ ID NO: 2626824 - RNA, 19 nt, Human
ucagaggauggccaguguc

SEQ ID NO: 2626825 - RNA, 18 nt, Human
ucagaggauggccagugu

SEQ ID NO: 2626826 - RNA, 14 nt, Human
ucagaggauggcca

SEQ ID NO: 2626827 - RNA, 15 nt, Human
ucagagcugggaggg

SEQ ID NO: 2626828 - RNA, 13 nt, Human
ucagaguccaggc

SEQ ID NO: 2626829 - RNA, 16 nt, Human
ucagaggcgcacugug

SEQ ID NO: 2626830 - RNA, 21 nt, Human
ucagagggaaaguaaauauuu

SEQ ID NO: 2626831 - RNA, 17 nt, Human
ucagaguccaggcccca

SEQ ID NO: 2626832 - RNA, 14 nt, Human
ucagagggaggaau

SEQ ID NO: 2626833 - RNA, 14 nt, Human
ucagaguccaggcc

SEQ ID NO: 2626834 - RNA, 16 nt, Human
ucagaguccaggcccc

SEQ ID NO: 2626835 - RNA, 15 nt, Human
ucagauaacuguuau

SEQ ID NO: 2626836 - RNA, 21 nt, Human
ucagaguugcugcaaaccuga

SEQ ID NO: 2626837 - RNA, 13 nt, Human
ucagauaacuguu

SEQ ID NO: 2626838 - RNA, 15 nt, Human
ucagcaaacucuuuu

SEQ ID NO: 2626839 - RNA, 22 nt, Human
ucagaguugaugguuguacaua

SEQ ID NO: 2626840 - RNA, 17 nt, Human
ucagaguggaaugcuuc

SEQ ID NO: 2626841 - RNA, 23 nt, Human
ucagagugcaagccccugcucca

SEQ ID NO: 2626842 - RNA, 23 nt, Human
ucccccuggccaccaccccccac

SEQ ID NO: 2626843 - RNA, 21 nt, Human
ucccccuggccaccacccccc

SEQ ID NO: 2626844 - RNA, 17 nt, Human
ucccccugcuuccaccu

SEQ ID NO: 2626845 - RNA, 23 nt, Human
ucccccugcccucguggccagcc

SEQ ID NO: 2626846 - RNA, 19 nt, Human
ucccccugcuuccaccuca

SEQ ID NO: 2626847 - RNA, 21 nt, Human
ucccccuuccauggacuuugu

SEQ ID NO: 2626848 - RNA, 16 nt, Human
ucccccuugccacccc

SEQ ID NO: 2626849 - RNA, 14 nt, Human
ucccccuugccacc

SEQ ID NO: 2626850 - RNA, 13 nt, Human
ucccccuugccac

SEQ ID NO: 2626851 - RNA, 12 nt, Human
ucccccuugcca

SEQ ID NO: 2626852 - RNA, 15 nt, Human
ucccccuucucccac

SEQ ID NO: 2626853 - RNA, 13 nt, Human
ucccccuucuccc

SEQ ID NO: 2626854 - RNA, 12 nt, Human
ucccccuucucc

SEQ ID NO: 2626855 - RNA, 10 nt, Human
ucccccuucu

SEQ ID NO: 2626856 - RNA, 23 nt, Human
ucccccuugccaccccacccucc

SEQ ID NO: 2626857 - RNA, 17 nt, Human
ucccccuugccacccca

SEQ ID NO: 2626858 - RNA, 19 nt, Human
ucccccuuuucugcauuuu

SEQ ID NO: 2626859 - RNA, 15 nt, Human
uccccgcccuuuuuu

SEQ ID NO: 2626860 - RNA, 13 nt, Human
uccccgcccuuuu

SEQ ID NO: 2626861 - RNA, 21 nt, Human
uccccgcagugugcacuaagg

SEQ ID NO: 2626862 - RNA, 22 nt, Human
uccccgcagugugcacuaaggg

SEQ ID NO: 2626863 - RNA, 14 nt, Human
uccccgcacccccc

SEQ ID NO: 2626864 - RNA, 21 nt, Human
uccccgcaccccccaagcugu

SEQ ID NO: 2626865 - RNA, 19 nt, Human
uccccgcagugugcacuaa

SEQ ID NO: 2626866 - RNA, 20 nt, Human
uccccgcagugugcacuaag

SEQ ID NO: 2626867 - RNA, 18 nt, Human
uccccgaguuuccccaga

SEQ ID NO: 2626868 - RNA, 22 nt, Human
uccccgagggaugaugccacac

SEQ ID NO: 2626869 - RNA, 21 nt, Human
uccccgagggaugaugccaca

SEQ ID NO: 2626870 - RNA, 19 nt, Human
uccccgaaggugcuggagg

SEQ ID NO: 2626871 - RNA, 24 nt, Human
uccccgaaacaggcuacucuccuc

SEQ ID NO: 2626872 - RNA, 20 nt, Human
uccccgagggaugaugccac

SEQ ID NO: 2626873 - RNA, 20 nt, Human
uccccgcacugggcuugggg

SEQ ID NO: 2626874 - RNA, 19 nt, Human
uccccugcccccaggacug

SEQ ID NO: 2626875 - RNA, 18 nt, Human
uccccugcccccaggacu

SEQ ID NO: 2626876 - RNA, 17 nt, Human
uccccugcccccaggac

SEQ ID NO: 2626877 - RNA, 16 nt, Human
uccccugcccccagga

SEQ ID NO: 2626878 - RNA, 22 nt, Human
uccccugcccccaggacugggc

SEQ ID NO: 2626879 - RNA, 20 nt, Human
uccccugcccccaggacugg

SEQ ID NO: 2626880 - RNA, 14 nt, Human
uccccugcccccag

SEQ ID NO: 2626881 - RNA, 13 nt, Human
uccccugccccca

SEQ ID NO: 2626882 - RNA, 15 nt, Human
uccccugcccccagg

SEQ ID NO: 2626883 - RNA, 23 nt, Human
uccccugcccccagaccuuuuau

SEQ ID NO: 2626884 - RNA, 20 nt, Human
uccccugccagggcagggcc

SEQ ID NO: 2626885 - RNA, 13 nt, Human
uccccugccauuu

SEQ ID NO: 2626886 - RNA, 17 nt, Human
uccccugccaccaggcc

SEQ ID NO: 2626887 - RNA, 16 nt, Human
uccccugccaccaggc

SEQ ID NO: 2626888 - RNA, 14 nt, Human
uccccugccaccag

SEQ ID NO: 2626889 - RNA, 13 nt, Human
uccccugccacca

SEQ ID NO: 2626890 - RNA, 19 nt, Human
uccccugccaccaggccac

SEQ ID NO: 2626891 - RNA, 12 nt, Human
uccccugccagg

SEQ ID NO: 2626892 - RNA, 14 nt, Human
uccccugccagggc

SEQ ID NO: 2626893 - RNA, 15 nt, Human
uccccugccagggca

SEQ ID NO: 2626894 - RNA, 14 nt, Human
uccccgccuguucc

SEQ ID NO: 2626895 - RNA, 13 nt, Human
uccccgccuguuc

SEQ ID NO: 2626896 - RNA, 12 nt, Human
ucccccauagcc

SEQ ID NO: 2626897 - RNA, 18 nt, Human
ucccccagcucuggugag

SEQ ID NO: 2626898 - RNA, 12 nt, Human
ucccccagccuc

SEQ ID NO: 2626899 - RNA, 16 nt, Human
ucccccagcccugugg

SEQ ID NO: 2626900 - RNA, 17 nt, Human
ucccccagcccugugga

SEQ ID NO: 2626901 - RNA, 14 nt, Human
ucccccauagccac

SEQ ID NO: 2626902 - RNA, 15 nt, Human
ucccccauagccacc

SEQ ID NO: 2626903 - RNA, 17 nt, Human
ucccccauccuccccuu

SEQ ID NO: 2626904 - RNA, 18 nt, Human
ucccccauccuccccuuc

SEQ ID NO: 2626905 - RNA, 21 nt, Human
ucccccauccuccccuucccu

SEQ ID NO: 2626906 - RNA, 13 nt, Human
uccccaggaggcc

SEQ ID NO: 2626907 - RNA, 12 nt, Human
ucccccagcccu

SEQ ID NO: 2626908 - RNA, 13 nt, Human
ucccccagcccug

SEQ ID NO: 2626909 - RNA, 14 nt, Human
ucccccagcccugu

SEQ ID NO: 2626910 - RNA, 15 nt, Human
ucccccagcccugug

SEQ ID NO: 2626911 - RNA, 15 nt, Human
uccccagcuguuuau

SEQ ID NO: 2626912 - RNA, 22 nt, Human
uccccagcgucccagucucugg

SEQ ID NO: 2626913 - RNA, 17 nt, Human
uccccagcucaccccug

SEQ ID NO: 2626914 - RNA, 23 nt, Human
uccccagccuuugaucagguggg

SEQ ID NO: 2626915 - RNA, 22 nt, Human
uccccagcucaccccuggagga

SEQ ID NO: 2626916 - RNA, 14 nt, Human
uccccagcuguuua

SEQ ID NO: 2626917 - RNA, 12 nt, Human
uccccagccucu

SEQ ID NO: 2626918 - RNA, 10 nt, Human
uccccagaga

SEQ ID NO: 2626919 - RNA, 11 nt, Human
uccccagagaa

SEQ ID NO: 2626920 - RNA, 17 nt, Human
ucccccaucucuucugg

SEQ ID NO: 2626921 - RNA, 12 nt, Human
uccccccucacc

SEQ ID NO: 2626922 - RNA, 19 nt, Human
ucccccauccuccccuucc

SEQ ID NO: 2626923 - RNA, 14 nt, Human
ucccccgccacucc

SEQ ID NO: 2626924 - RNA, 14 nt, Human
uccccccucaccag

SEQ ID NO: 2626925 - RNA, 21 nt, Human
ucccccgcaaugugcccccag

SEQ ID NO: 2626926 - RNA, 20 nt, Human
ucccccgcaaugugccccca

SEQ ID NO: 2626927 - RNA, 18 nt, Human
ucccccucccagggccag

SEQ ID NO: 2626928 - RNA, 19 nt, Human
ucccccucccagggccagg

SEQ ID NO: 2626929 - RNA, 17 nt, Human
ucccccucccagggcca

SEQ ID NO: 2626930 - RNA, 16 nt, Human
ucccccuccaccugcu

SEQ ID NO: 2626931 - RNA, 22 nt, Human
ucccccgggaggggcccgcuug

SEQ ID NO: 2626932 - RNA, 19 nt, Human
ucccccgccgcuuuucucc

SEQ ID NO: 2626933 - RNA, 22 nt, Human
ucccccugcccucguggccagc

SEQ ID NO: 2626934 - RNA, 20 nt, Human
ucccccugcccucguggcca

SEQ ID NO: 2626935 - RNA, 15 nt, Human
ucccccugcccucgu

SEQ ID NO: 2626936 - RNA, 12 nt, Human
ucccccugcccu

SEQ ID NO: 2626937 - RNA, 13 nt, Human
ucccccugcccca

SEQ ID NO: 2626938 - RNA, 15 nt, Human
ucccccucuguccag

SEQ ID NO: 2626939 - RNA, 16 nt, Human
ucccccugccagugcc

SEQ ID NO: 2626940 - RNA, 17 nt, Human
ucccccugccagugccu

SEQ ID NO: 2626941 - RNA, 18 nt, Human
ucccccugccagugccuu

SEQ ID NO: 2626942 - RNA, 20 nt, Human
ucccccucccccuucuccca

SEQ ID NO: 2626943 - RNA, 18 nt, Human
ucccccucccccuucucc

SEQ ID NO: 2626944 - RNA, 12 nt, Human
ucccccucuguc

SEQ ID NO: 2626945 - RNA, 13 nt, Human
ucccccucuggcu

SEQ ID NO: 2626946 - RNA, 20 nt, Human
ucccccucccccacugccau

SEQ ID NO: 2626947 - RNA, 13 nt, Human
ucccuaauaaagc

SEQ ID NO: 2626948 - RNA, 13 nt, Human
ucccuaccucagg

SEQ ID NO: 2626949 - RNA, 15 nt, Human
ucccuacuguaauuu

SEQ ID NO: 2626950 - RNA, 15 nt, Human
ucccuaccucaggca

SEQ ID NO: 2626951 - RNA, 17 nt, Human
ucccuaccucaggcagg

SEQ ID NO: 2626952 - RNA, 17 nt, Human
ucccucccucuuucccu

SEQ ID NO: 2626953 - RNA, 16 nt, Human
ucccuacuuccuguga

SEQ ID NO: 2626954 - RNA, 15 nt, Human
ucccuacuuccugug

SEQ ID NO: 2626955 - RNA, 15 nt, Human
ucccucccucuuucc

SEQ ID NO: 2626956 - RNA, 12 nt, Human
ucccuaauaaag

SEQ ID NO: 2626957 - RNA, 11 nt, Human
ucccuaauaaa

SEQ ID NO: 2626958 - RNA, 13 nt, Human
ucccuaaacugua

SEQ ID NO: 2626959 - RNA, 19 nt, Human
uccccuucucaucacuccc

SEQ ID NO: 2626960 - RNA, 16 nt, Human
uccccuuccucacugc

SEQ ID NO: 2626961 - RNA, 15 nt, Human
uccccuucucaucac

SEQ ID NO: 2626962 - RNA, 18 nt, Human
ucccuaaagaaaaaaaau

SEQ ID NO: 2626963 - RNA, 15 nt, Human
ucccuaagccaaggg

SEQ ID NO: 2626964 - RNA, 20 nt, Human
ucccuaagccaagggccucu

SEQ ID NO: 2626965 - RNA, 21 nt, Human
uccccuuccuaauuccacagc

SEQ ID NO: 2626966 - RNA, 22 nt, Human
uccccuuccuaauuccacagcu

SEQ ID NO: 2626967 - RNA, 15 nt, Human
uccccuucccugcaa

SEQ ID NO: 2626968 - RNA, 13 nt, Human
uccccuucccugc

SEQ ID NO: 2626969 - RNA, 13 nt, Human
uccccuuccacug

SEQ ID NO: 2626970 - RNA, 17 nt, Human
uccccuuccacugaggg

SEQ ID NO: 2626971 - RNA, 18 nt, Human
uccccuuccacugagggc

SEQ ID NO: 2626972 - RNA, 19 nt, Human
uccccuuccaucccagagg

SEQ ID NO: 2626973 - RNA, 13 nt, Human
uccccuucacucc

SEQ ID NO: 2626974 - RNA, 24 nt, Human
uccccugcuggguguggcgcagca

SEQ ID NO: 2626975 - RNA, 20 nt, Human
uccccuggaacugucucuca

SEQ ID NO: 2626976 - RNA, 18 nt, Human
uccccuggaacugucucu

SEQ ID NO: 2626977 - RNA, 16 nt, Human
uccccuggacugggag

SEQ ID NO: 2626978 - RNA, 15 nt, Human
uccccuggacuggga

SEQ ID NO: 2626979 - RNA, 19 nt, Human
uccccuguagagugggagc

SEQ ID NO: 2626980 - RNA, 19 nt, Human
uccccuggggacagcaagg

SEQ ID NO: 2626981 - RNA, 15 nt, Human
uccccugggcccuga

SEQ ID NO: 2626982 - RNA, 17 nt, Human
uccccuggacugggagg

SEQ ID NO: 2626983 - RNA, 14 nt, Human
uccccugugcaguc

SEQ ID NO: 2626984 - RNA, 20 nt, Human
uccccuguggggaucucagg

SEQ ID NO: 2626985 - RNA, 12 nt, Human
uccccugugggg

SEQ ID NO: 2626986 - RNA, 15 nt, Human
uccccuguucacucu

SEQ ID NO: 2626987 - RNA, 23 nt, Human
uccccuguccccgcacugggcuu

SEQ ID NO: 2626988 - RNA, 22 nt, Human
uccccuguagagugggagcuga

SEQ ID NO: 2626989 - RNA, 21 nt, Human
uccccugcuggguguggcgca

SEQ ID NO: 2626990 - RNA, 20 nt, Human
uccccugcuggguguggcgc

SEQ ID NO: 2626991 - RNA, 15 nt, Human
uccccugcugggugu

SEQ ID NO: 2626992 - RNA, 14 nt, Human
uccccugcugggug

SEQ ID NO: 2626993 - RNA, 16 nt, Human
uccccugcccugcugc

SEQ ID NO: 2626994 - RNA, 23 nt, Human
uccccugcccugcugccgccucc

SEQ ID NO: 2626995 - RNA, 13 nt, Human
uccccugcccugg

SEQ ID NO: 2626996 - RNA, 15 nt, Human
uccccugcccugguc

SEQ ID NO: 2626997 - RNA, 12 nt, Human
uccccugcccug

SEQ ID NO: 2626998 - RNA, 15 nt, Human
uccccugcccugcug

SEQ ID NO: 2626999 - RNA, 22 nt, Human
uccccugccccuuuacggacac

SEQ ID NO: 2627000 - RNA, 23 nt, Human
uccccugcugcaggggcucugga

SEQ ID NO: 2627001 - RNA, 21 nt, Human
uccccugcugcaggggcucug

SEQ ID NO: 2627002 - RNA, 18 nt, Human
uccccugcugcaggggcu

SEQ ID NO: 2627003 - RNA, 17 nt, Human
uccccugcugcaggggc

SEQ ID NO: 2627004 - RNA, 15 nt, Human
uccccugcugcaggg

SEQ ID NO: 2627005 - RNA, 17 nt, Human
uccccugcccuggucca

SEQ ID NO: 2627006 - RNA, 24 nt, Human
uccccugcccugguccagggaagc

SEQ ID NO: 2627007 - RNA, 15 nt, Human
uccaucaugucccca

SEQ ID NO: 2627008 - RNA, 23 nt, Human
uccagcuccucauccagggcucu

SEQ ID NO: 2627009 - RNA, 14 nt, Human
uccaucaugucccc

SEQ ID NO: 2627010 - RNA, 13 nt, Human
uccauccaaggcc

SEQ ID NO: 2627011 - RNA, 21 nt, Human
uccauccaaggccagguucuc

SEQ ID NO: 2627012 - RNA, 15 nt, Human
uccauccacauggga

SEQ ID NO: 2627013 - RNA, 16 nt, Human
uccaucauguccccaa

SEQ ID NO: 2627014 - RNA, 16 nt, Human
uccauccaggccauuc

SEQ ID NO: 2627015 - RNA, 13 nt, Human
uccaucccagagg

SEQ ID NO: 2627016 - RNA, 12 nt, Human
uccaucccagag

SEQ ID NO: 2627017 - RNA, 22 nt, Human
uccaucccaggacaccacaccc

SEQ ID NO: 2627018 - RNA, 21 nt, Human
uccaucccaggacaccacacc

SEQ ID NO: 2627019 - RNA, 15 nt, Human
uccaucccaggacac

SEQ ID NO: 2627020 - RNA, 20 nt, Human
uccaucccgaaaaucucucg

SEQ ID NO: 2627021 - RNA, 14 nt, Human
uccaucccaucauc

SEQ ID NO: 2627022 - RNA, 14 nt, Human
uccaucccuacccc

SEQ ID NO: 2627023 - RNA, 21 nt, Human
uccagcucaccccccacacuc

SEQ ID NO: 2627024 - RNA, 20 nt, Human
uccagcucaccccccacacu

SEQ ID NO: 2627025 - RNA, 23 nt, Human
uccagcucaccagccccagugcc

SEQ ID NO: 2627026 - RNA, 18 nt, Human
uccagcuccucauccagg

SEQ ID NO: 2627027 - RNA, 22 nt, Human
uccagcuccaagaccuguuggu

SEQ ID NO: 2627028 - RNA, 19 nt, Human
uccagcuccaaccugcaaa

SEQ ID NO: 2627029 - RNA, 16 nt, Human
uccagcuccaaccugc

SEQ ID NO: 2627030 - RNA, 18 nt, Human
uccagcuccaaccugcaa

SEQ ID NO: 2627031 - RNA, 12 nt, Human
uccagcuccaac

SEQ ID NO: 2627032 - RNA, 13 nt, Human
uccauguacugua

SEQ ID NO: 2627033 - RNA, 15 nt, Human
uccaugggguaggag

SEQ ID NO: 2627034 - RNA, 16 nt, Human
uccauggggaagggau

SEQ ID NO: 2627035 - RNA, 15 nt, Human
uccaugggggcaggg

SEQ ID NO: 2627036 - RNA, 17 nt, Human
uccaugggggcagggca

SEQ ID NO: 2627037 - RNA, 14 nt, Human
uccauguacuguag

SEQ ID NO: 2627038 - RNA, 16 nt, Human
uccauguacuguaguu

SEQ ID NO: 2627039 - RNA, 20 nt, Human
uccauguacuguaguuuuuc

SEQ ID NO: 2627040 - RNA, 21 nt, Human
uccauguacuguaguuuuucu

SEQ ID NO: 2627041 - RNA, 14 nt, Human
uccauguagcagga

SEQ ID NO: 2627042 - RNA, 15 nt, Human
uccauguagcaggac

SEQ ID NO: 2627043 - RNA, 21 nt, Human
ucccaaagugcugggauuaca

SEQ ID NO: 2627044 - RNA, 15 nt, Human
uccauggacuuuguu

SEQ ID NO: 2627045 - RNA, 14 nt, Human
uccauggacuuugu

SEQ ID NO: 2627046 - RNA, 13 nt, Human
uccauggacuuug

SEQ ID NO: 2627047 - RNA, 14 nt, Human
uccauggauuuugg

SEQ ID NO: 2627048 - RNA, 20 nt, Human
uccauggcccugcaaaagga

SEQ ID NO: 2627049 - RNA, 15 nt, Human
ucccaagcucugcuc

SEQ ID NO: 2627050 - RNA, 14 nt, Human
ucccaagcucugcu

SEQ ID NO: 2627051 - RNA, 13 nt, Human
ucccaagcucugc

SEQ ID NO: 2627052 - RNA, 12 nt, Human
ucccaagcucug

SEQ ID NO: 2627053 - RNA, 18 nt, Human
ucccaaggcucugagcaa

SEQ ID NO: 2627054 - RNA, 22 nt, Human
ucccaaggaaagccccagcacu

SEQ ID NO: 2627055 - RNA, 21 nt, Human
ucccaagcugggccccagccc

SEQ ID NO: 2627056 - RNA, 19 nt, Human
ucccaagcugggccccagc

SEQ ID NO: 2627057 - RNA, 18 nt, Human
ucccaagcugggccccag

SEQ ID NO: 2627058 - RNA, 17 nt, Human
ucccaagcugggcccca

SEQ ID NO: 2627059 - RNA, 12 nt, Human
ucccaaggaaag

SEQ ID NO: 2627060 - RNA, 13 nt, Human
ucccaaggaaagc

SEQ ID NO: 2627061 - RNA, 17 nt, Human
ucccaagcucugcuccu

SEQ ID NO: 2627062 - RNA, 16 nt, Human
ucccaagcugggcccc

SEQ ID NO: 2627063 - RNA, 15 nt, Human
ucccaagcugggccc

SEQ ID NO: 2627064 - RNA, 14 nt, Human
ucccaagcugggcc

SEQ ID NO: 2627065 - RNA, 13 nt, Human
ucccaagcugggc

SEQ ID NO: 2627066 - RNA, 12 nt, Human
ucccaagcuggg

SEQ ID NO: 2627067 - RNA, 17 nt, Human
ucccaaauuugauugau

SEQ ID NO: 2627068 - RNA, 19 nt, Human
ucccaaauuugauugauuu

SEQ ID NO: 2627069 - RNA, 14 nt, Human
ucccaaaugagcca

SEQ ID NO: 2627070 - RNA, 13 nt, Human
ucccaacucaccc

SEQ ID NO: 2627071 - RNA, 16 nt, Human
ucccaaauuucauacc

SEQ ID NO: 2627072 - RNA, 17 nt, Human
uccauguagcaggacug

SEQ ID NO: 2627073 - RNA, 15 nt, Human
ucccaacucacccca

SEQ ID NO: 2627074 - RNA, 14 nt, Human
ucccaacucacccc

SEQ ID NO: 2627075 - RNA, 16 nt, Human
ucccaacucaccccag

SEQ ID NO: 2627076 - RNA, 20 nt, Human
ucccaaauuugauugauuug

SEQ ID NO: 2627077 - RNA, 22 nt, Human
ucccaaauuugauugauuugaa

SEQ ID NO: 2627078 - RNA, 16 nt, Human
ucccaagcucagaggc

SEQ ID NO: 2627079 - RNA, 15 nt, Human
ucccaccucagccuc

SEQ ID NO: 2627080 - RNA, 14 nt, Human
ucccaccucagccu

SEQ ID NO: 2627081 - RNA, 15 nt, Human
ucccaggagacaguu

SEQ ID NO: 2627082 - RNA, 19 nt, Human
ucccaggacccugaagggg

SEQ ID NO: 2627083 - RNA, 14 nt, Human
ucccaggacccuga

SEQ ID NO: 2627084 - RNA, 16 nt, Human
ucccaggacccugaag

SEQ ID NO: 2627085 - RNA, 16 nt, Human
ucccaccuagcagcac

SEQ ID NO: 2627086 - RNA, 17 nt, Human
ucccaccuagcagcacc

SEQ ID NO: 2627087 - RNA, 13 nt, Human
ucccaggacccug

SEQ ID NO: 2627088 - RNA, 21 nt, Human
ucccaagggauggugcccugu

SEQ ID NO: 2627089 - RNA, 18 nt, Human
ucccaagggauggugccc

SEQ ID NO: 2627090 - RNA, 22 nt, Human
ucccaaggcucugagcaaaugu

SEQ ID NO: 2627091 - RNA, 20 nt, Human
ucccaaggcugcgucuggag

SEQ ID NO: 2627092 - RNA, 22 nt, Human
ucccaagcugggccccagccca

SEQ ID NO: 2627093 - RNA, 18 nt, Human
ucccaaggaaagccccag

SEQ ID NO: 2627094 - RNA, 13 nt, Human
ucccaccucagcc

SEQ ID NO: 2627095 - RNA, 24 nt, Human
ucccaggaugagcaucccaggauc

SEQ ID NO: 2627096 - RNA, 22 nt, Human
ucccaggcauuccccaggaggc

SEQ ID NO: 2627097 - RNA, 15 nt, Human
ucccaggcugagccu

SEQ ID NO: 2627098 - RNA, 21 nt, Human
ucccaggcgccccuucccccu

SEQ ID NO: 2627099 - RNA, 18 nt, Human
ucccaggcgccccuuccc

SEQ ID NO: 2627100 - RNA, 20 nt, Human
ucccaggcgccccuuccccc

SEQ ID NO: 2627101 - RNA, 21 nt, Human
ucccaggcauuccccaggagg

SEQ ID NO: 2627102 - RNA, 20 nt, Human
ucccaggcauuccccaggag

SEQ ID NO: 2627103 - RNA, 16 nt, Human
ucccaggagacaguuc

SEQ ID NO: 2627104 - RNA, 22 nt, Human
ucccaggagacaguucaagaaa

SEQ ID NO: 2627105 - RNA, 22 nt, Human
ucccaggaguggaggaggccug

SEQ ID NO: 2627106 - RNA, 23 nt, Human
ucccaggagcugcccagaguugc

SEQ ID NO: 2627107 - RNA, 18 nt, Human
ucccaggagcugcccaga

SEQ ID NO: 2627108 - RNA, 17 nt, Human
ucccaggagcugcccag

SEQ ID NO: 2627109 - RNA, 16 nt, Human
ucccaggaugagcauc

SEQ ID NO: 2627110 - RNA, 19 nt, Human
ucccauggagccccagccc

SEQ ID NO: 2627111 - RNA, 18 nt, Human
ucccauggagccccagcc

SEQ ID NO: 2627112 - RNA, 17 nt, Human
ucccauggagccccagc

SEQ ID NO: 2627113 - RNA, 16 nt, Human
ucccauggagccccag

SEQ ID NO: 2627114 - RNA, 15 nt, Human
ucccauggagcccca

SEQ ID NO: 2627115 - RNA, 13 nt, Human
ucccauggagccc

SEQ ID NO: 2627116 - RNA, 22 nt, Human
ucccauggacacuccagugcca

SEQ ID NO: 2627117 - RNA, 21 nt, Human
ucccauggacacuccagugcc

SEQ ID NO: 2627118 - RNA, 18 nt, Human
ucccauggcuuaaugcuu

SEQ ID NO: 2627119 - RNA, 21 nt, Human
ucccauggagccccagccccc

SEQ ID NO: 2627120 - RNA, 14 nt, Human
ucccauggggaggg

SEQ ID NO: 2627121 - RNA, 16 nt, Human
ucccauguaacagaaa

SEQ ID NO: 2627122 - RNA, 15 nt, Human
ucccauguaacagaa

SEQ ID NO: 2627123 - RNA, 17 nt, Human
ucccaucugggaguccc

SEQ ID NO: 2627124 - RNA, 14 nt, Human
ucccaucugggagu

SEQ ID NO: 2627125 - RNA, 13 nt, Human
ucccaucugggag

SEQ ID NO: 2627126 - RNA, 23 nt, Human
ucccaucugggaguccccuuuuc

SEQ ID NO: 2627127 - RNA, 19 nt, Human
ucccaucugggaguccccu

SEQ ID NO: 2627128 - RNA, 20 nt, Human
ucccauggacacuccagugc

SEQ ID NO: 2627129 - RNA, 15 nt, Human
ucccauggacacucc

SEQ ID NO: 2627130 - RNA, 14 nt, Human
ucccauggacacuc

SEQ ID NO: 2627131 - RNA, 12 nt, Human
ucccaugcccug

SEQ ID NO: 2627132 - RNA, 20 nt, Human
ucccaucucacacaugagca

SEQ ID NO: 2627133 - RNA, 16 nt, Human
ucccaggcugagccuc

SEQ ID NO: 2627134 - RNA, 23 nt, Human
ucccaucucacacaugagcauca

SEQ ID NO: 2627135 - RNA, 19 nt, Human
ucccaucugcaccccuucu

SEQ ID NO: 2627136 - RNA, 14 nt, Human
ucccaucucuuccu

SEQ ID NO: 2627137 - RNA, 13 nt, Human
ucccaucugcacc

SEQ ID NO: 2627138 - RNA, 16 nt, Human
ucccaucuccacuguu

SEQ ID NO: 2627139 - RNA, 22 nt, Human
ucccaggaugagcaucccagga

SEQ ID NO: 2627140 - RNA, 21 nt, Human
ucccaggcucucaacagggga

SEQ ID NO: 2627141 - RNA, 19 nt, Human
uccccacuuguccgcuggg

SEQ ID NO: 2627142 - RNA, 22 nt, Human
uccccacuugagaauuacccuu

SEQ ID NO: 2627143 - RNA, 13 nt, Human
ucccauugucccu

SEQ ID NO: 2627144 - RNA, 16 nt, Human
ucccauugucccucug

SEQ ID NO: 2627145 - RNA, 14 nt, Human
ucccauugcccugg

SEQ ID NO: 2627146 - RNA, 15 nt, Human
ucccauugcccuggu

SEQ ID NO: 2627147 - RNA, 13 nt, Human
ucccauugcccug

SEQ ID NO: 2627148 - RNA, 13 nt, Human
uccccagaccuga

SEQ ID NO: 2627149 - RNA, 21 nt, Human
uccccacuuguccgcugggug

SEQ ID NO: 2627150 - RNA, 17 nt, Human
uccccagaaaggagacu

SEQ ID NO: 2627151 - RNA, 22 nt, Human
uccccagacuccaccaagccug

SEQ ID NO: 2627152 - RNA, 16 nt, Human
uccccagaccugagcu

SEQ ID NO: 2627153 - RNA, 19 nt, Human
ucccauucacucuuccaga

SEQ ID NO: 2627154 - RNA, 19 nt, Human
ucccauguaacagaaaggg

SEQ ID NO: 2627155 - RNA, 17 nt, Human
ucccauucacucuucca

SEQ ID NO: 2627156 - RNA, 18 nt, Human
ucccauguaacagaaagg

SEQ ID NO: 2627157 - RNA, 17 nt, Human
ucccauguaacagaaag

SEQ ID NO: 2627158 - RNA, 13 nt, Human
ucccauguagccc

SEQ ID NO: 2627159 - RNA, 15 nt, Human
ucccauguagccccc

SEQ ID NO: 2627160 - RNA, 21 nt, Human
ucccauguagcccccuggccu

SEQ ID NO: 2627161 - RNA, 13 nt, Human
ucccauuccugaa

SEQ ID NO: 2627162 - RNA, 14 nt, Human
ucccauuccugaag

SEQ ID NO: 2627163 - RNA, 17 nt, Human
ucccauuccugaagaac

SEQ ID NO: 2627164 - RNA, 15 nt, Human
ucccauuccugaaga

SEQ ID NO: 2627165 - RNA, 16 nt, Human
ucauuucugcaucagc

SEQ ID NO: 2627166 - RNA, 22 nt, Human
ucauuucugcaucagcugcuga

SEQ ID NO: 2627167 - RNA, 14 nt, Human
ucauuucuuugagu

SEQ ID NO: 2627168 - RNA, 13 nt, Human
ucauuucuugggc

SEQ ID NO: 2627169 - RNA, 16 nt, Human
uccaaaagauugcuga

SEQ ID NO: 2627170 - RNA, 16 nt, Human
ucauucauuuauucau

SEQ ID NO: 2627171 - RNA, 15 nt, Human
ucauucauucuuagc

SEQ ID NO: 2627172 - RNA, 15 nt, Human
ucauucaugcuacug

SEQ ID NO: 2627173 - RNA, 13 nt, Human
ucauucagaaaaa

SEQ ID NO: 2627174 - RNA, 12 nt, Human
ucauucaggaaa

SEQ ID NO: 2627175 - RNA, 13 nt, Human
ucauucaggaaaa

SEQ ID NO: 2627176 - RNA, 23 nt, Human
ucauguaaauuuuguaugaaaaa

SEQ ID NO: 2627177 - RNA, 14 nt, Human
ucauucagaaaaaa

SEQ ID NO: 2627178 - RNA, 19 nt, Human
uccaaaagauugcugaaau

SEQ ID NO: 2627179 - RNA, 20 nt, Human
uccaaaagauugcugaaauu

SEQ ID NO: 2627180 - RNA, 22 nt, Human
uccaaaagauugcugaaauuuu

SEQ ID NO: 2627181 - RNA, 13 nt, Human
uccaaaagcuuuu

SEQ ID NO: 2627182 - RNA, 16 nt, Human
uccaaaauaaaacuuu

SEQ ID NO: 2627183 - RNA, 17 nt, Human
uccaaaauaaaacuuuu

SEQ ID NO: 2627184 - RNA, 16 nt, Human
uccaaaagcuuuuuau

SEQ ID NO: 2627185 - RNA, 19 nt, Human
uccaaaaguggccucuuug

SEQ ID NO: 2627186 - RNA, 19 nt, Human
uccaaacuaccuuccaguu

SEQ ID NO: 2627187 - RNA, 23 nt, Human
uccaaacugacucuuaagaagac

SEQ ID NO: 2627188 - RNA, 19 nt, Human
uccaaacugaagcagccuc

SEQ ID NO: 2627189 - RNA, 23 nt, Human
uccaaaaguggccucuuugucua

SEQ ID NO: 2627190 - RNA, 20 nt, Human
uccaaacugccuaagcccuc

SEQ ID NO: 2627191 - RNA, 12 nt, Human
uccaaagaaaug

SEQ ID NO: 2627192 - RNA, 22 nt, Human
uccaaagaguagaauugcauug

SEQ ID NO: 2627193 - RNA, 22 nt, Human
uccaaacuuggauuuuugacuc

SEQ ID NO: 2627194 - RNA, 23 nt, Human
uccaaagaguagaauugcauuga

SEQ ID NO: 2627195 - RNA, 19 nt, Human
uccaaagcacauugaaaga

SEQ ID NO: 2627196 - RNA, 23 nt, Human
uccaagcauaccaacacgagcag

SEQ ID NO: 2627197 - RNA, 17 nt, Human
uccaagcauuuagaugu

SEQ ID NO: 2627198 - RNA, 13 nt, Human
uccaagcaaaugu

SEQ ID NO: 2627199 - RNA, 18 nt, Human
uccaagauaccuaaaaga

SEQ ID NO: 2627200 - RNA, 17 nt, Human
uccaagagucugaugau

SEQ ID NO: 2627201 - RNA, 16 nt, Human
uccaagagucugauga

SEQ ID NO: 2627202 - RNA, 18 nt, Human
uccaagauauuuuaaaau

SEQ ID NO: 2627203 - RNA, 22 nt, Human
uccaagauauuuuaaaaucugu

SEQ ID NO: 2627204 - RNA, 19 nt, Human
uccaagaccuucuccuuca

SEQ ID NO: 2627205 - RNA, 19 nt, Human
uccaagaccuguugguucc

SEQ ID NO: 2627206 - RNA, 16 nt, Human
uccaagacauugucaa

SEQ ID NO: 2627207 - RNA, 20 nt, Human
uccaagacaugucuguucua

SEQ ID NO: 2627208 - RNA, 22 nt, Human
uccaagacaugucuguucuaca

SEQ ID NO: 2627209 - RNA, 11 nt, Human
uccaagacauu

SEQ ID NO: 2627210 - RNA, 15 nt, Human
uccaagacauuguca

SEQ ID NO: 2627211 - RNA, 17 nt, Human
uccaagacauugucaau

SEQ ID NO: 2627212 - RNA, 15 nt, Human
uccaagacacugugg

SEQ ID NO: 2627213 - RNA, 17 nt, Human
uccaagaaugcugaaac

SEQ ID NO: 2627214 - RNA, 16 nt, Human
uccaagaaugcugaaa

SEQ ID NO: 2627215 - RNA, 15 nt, Human
uccaagaaugcugaa

SEQ ID NO: 2627216 - RNA, 17 nt, Human
uccaagacaugucuguu

SEQ ID NO: 2627217 - RNA, 18 nt, Human
uccaagacaguauacagu

SEQ ID NO: 2627218 - RNA, 18 nt, Human
uccaagacagaauaauga

SEQ ID NO: 2627219 - RNA, 18 nt, Human
uccaagaaucuaucugcu

SEQ ID NO: 2627220 - RNA, 12 nt, Human
uccaagaaucua

SEQ ID NO: 2627221 - RNA, 14 nt, Human
uccaagaaugcuga

SEQ ID NO: 2627222 - RNA, 13 nt, Human
uccaagaaugcug

SEQ ID NO: 2627223 - RNA, 12 nt, Human
uccaagaaugcu

SEQ ID NO: 2627224 - RNA, 19 nt, Human
uccaagaaucuaucugcuu

SEQ ID NO: 2627225 - RNA, 22 nt, Human
uccaagaagcccaggaaaggcu

SEQ ID NO: 2627226 - RNA, 21 nt, Human
uccaaaggccauggagagcug

SEQ ID NO: 2627227 - RNA, 21 nt, Human
uccaaaggcauuuuauugcuu

SEQ ID NO: 2627228 - RNA, 23 nt, Human
uccaaaggaaucuccaguuuuca

SEQ ID NO: 2627229 - RNA, 20 nt, Human
uccaagaagcccaggaaagg

SEQ ID NO: 2627230 - RNA, 13 nt, Human
uccaaaggaggcu

SEQ ID NO: 2627231 - RNA, 15 nt, Human
uccaaaggaggcugg

SEQ ID NO: 2627232 - RNA, 19 nt, Human
uccaaaggaggcuggcagg

SEQ ID NO: 2627233 - RNA, 14 nt, Human
uccaaagcagacag

SEQ ID NO: 2627234 - RNA, 15 nt, Human
uccaaagcagacagc

SEQ ID NO: 2627235 - RNA, 18 nt, Human
uccaaacuuggauuuuug

SEQ ID NO: 2627236 - RNA, 13 nt, Human
uccaaagcagggu

SEQ ID NO: 2627237 - RNA, 17 nt, Human
uccaaagccaaugugaa

SEQ ID NO: 2627238 - RNA, 23 nt, Human
uccaaaggaagucuaggagcugg

SEQ ID NO: 2627239 - RNA, 22 nt, Human
uccaauuuucuggaauacauga

SEQ ID NO: 2627240 - RNA, 12 nt, Human
uccacaaaauaa

SEQ ID NO: 2627241 - RNA, 20 nt, Human
uccacaaaauaaccaauccu

SEQ ID NO: 2627242 - RNA, 20 nt, Human
uccacaaauuauuaaugaaa

SEQ ID NO: 2627243 - RNA, 14 nt, Human
uccacaaauuauua

SEQ ID NO: 2627244 - RNA, 14 nt, Human
uccacaacacacag

SEQ ID NO: 2627245 - RNA, 20 nt, Human
uccaagcauuuagauguaua

SEQ ID NO: 2627246 - RNA, 11 nt, Human
uccaagcaaag

SEQ ID NO: 2627247 - RNA, 18 nt, Human
uccaauuuucuggaauac

SEQ ID NO: 2627248 - RNA, 21 nt, Human
uccacaaauuauuaaugaaaa

SEQ ID NO: 2627249 - RNA, 21 nt, Human
uccacaagacagaagcugaag

SEQ ID NO: 2627250 - RNA, 16 nt, Human
uccacccuguccccca

SEQ ID NO: 2627251 - RNA, 14 nt, Human
uccacaagagccca

SEQ ID NO: 2627252 - RNA, 21 nt, Human
uccacccugucccccagcucu

SEQ ID NO: 2627253 - RNA, 20 nt, Human
uccacccugucccccagcuc

SEQ ID NO: 2627254 - RNA, 18 nt, Human
uccacccugucccccagc

SEQ ID NO: 2627255 - RNA, 17 nt, Human
uccacccugucccccag

SEQ ID NO: 2627256 - RNA, 13 nt, Human
uccacccuuggcc

SEQ ID NO: 2627257 - RNA, 14 nt, Human
uccacccuuggccu

SEQ ID NO: 2627258 - RNA, 15 nt, Human
uccacccuuggccug

SEQ ID NO: 2627259 - RNA, 16 nt, Human
uccacccuuggccugu

SEQ ID NO: 2627260 - RNA, 17 nt, Human
uccacccuuggccuguc

SEQ ID NO: 2627261 - RNA, 19 nt, Human
uccacccuuggccugucuc

SEQ ID NO: 2627262 - RNA, 14 nt, Human
uccaccuacaugag

SEQ ID NO: 2627263 - RNA, 20 nt, Human
uccaccuaguggcuguccag

SEQ ID NO: 2627264 - RNA, 17 nt, Human
uccaccuaguggcuguc

SEQ ID NO: 2627265 - RNA, 12 nt, Human
uccaccucaccc

SEQ ID NO: 2627266 - RNA, 15 nt, Human
uccaccgcugccuaa

SEQ ID NO: 2627267 - RNA, 13 nt, Human
uccaccgcugccu

SEQ ID NO: 2627268 - RNA, 22 nt, Human
uccacccugucccccagcucug

SEQ ID NO: 2627269 - RNA, 14 nt, Human
uccaccgcugccua

SEQ ID NO: 2627270 - RNA, 19 nt, Human
uccaccgcugccuaagugg

SEQ ID NO: 2627271 - RNA, 20 nt, Human
uccacccuuggccugucuca

SEQ ID NO: 2627272 - RNA, 13 nt, Human
uccaccucccucc

SEQ ID NO: 2627273 - RNA, 14 nt, Human
uccaccuccaucuu

SEQ ID NO: 2627274 - RNA, 13 nt, Human
uccaccuccaucu

SEQ ID NO: 2627275 - RNA, 17 nt, Human
uccaccucagccuugga

SEQ ID NO: 2627276 - RNA, 14 nt, Human
uccaccucacccca

SEQ ID NO: 2627277 - RNA, 21 nt, Human
uccaccuaguggcuguccagu

SEQ ID NO: 2627278 - RNA, 16 nt, Human
uccaccucaccccacu

SEQ ID NO: 2627279 - RNA, 11 nt, Human
uccaccucagc

SEQ ID NO: 2627280 - RNA, 12 nt, Human
uccaccucagcc

SEQ ID NO: 2627281 - RNA, 13 nt, Human
uccaccucagccu

SEQ ID NO: 2627282 - RNA, 14 nt, Human
uccaccucagccuu

SEQ ID NO: 2627283 - RNA, 16 nt, Human
uccaccucagccuugg

SEQ ID NO: 2627284 - RNA, 12 nt, Human
uccaccugccag

SEQ ID NO: 2627285 - RNA, 13 nt, Human
uccaccuccuucu

SEQ ID NO: 2627286 - RNA, 12 nt, Human
uccaccuccuuc

SEQ ID NO: 2627287 - RNA, 18 nt, Human
uccaccucgacguuuaca

SEQ ID NO: 2627288 - RNA, 17 nt, Human
uccagauccuggaaauc

SEQ ID NO: 2627289 - RNA, 16 nt, Human
uccagauccuggaaau

SEQ ID NO: 2627290 - RNA, 14 nt, Human
uccagauccuggaa

SEQ ID NO: 2627291 - RNA, 17 nt, Human
uccagaagccucuggcu

SEQ ID NO: 2627292 - RNA, 18 nt, Human
uccagaagccucuggcua

SEQ ID NO: 2627293 - RNA, 19 nt, Human
uccagaagccucuggcuag

SEQ ID NO: 2627294 - RNA, 12 nt, Human
uccagcagggaa

SEQ ID NO: 2627295 - RNA, 14 nt, Human
uccagcaguuuuca

SEQ ID NO: 2627296 - RNA, 23 nt, Human
uccagccaaagccuccuccagcc

SEQ ID NO: 2627297 - RNA, 22 nt, Human
uccagaagaauauucaggacuu

SEQ ID NO: 2627298 - RNA, 18 nt, Human
uccagaucugcagucacu

SEQ ID NO: 2627299 - RNA, 21 nt, Human
uccagaagggguuuggucugg

SEQ ID NO: 2627300 - RNA, 12 nt, Human
uccacuuggucu

SEQ ID NO: 2627301 - RNA, 13 nt, Human
uccacuuggucug

SEQ ID NO: 2627302 - RNA, 13 nt, Human
uccaccugccagg

SEQ ID NO: 2627303 - RNA, 16 nt, Human
uccaccuccuucucug

SEQ ID NO: 2627304 - RNA, 18 nt, Human
uccaccucuucacccccc

SEQ ID NO: 2627305 - RNA, 14 nt, Human
uccaccugagcugc

SEQ ID NO: 2627306 - RNA, 22 nt, Human
uccagaacucacuggggccuac

SEQ ID NO: 2627307 - RNA, 19 nt, Human
uccagaagaauauucagga

SEQ ID NO: 2627308 - RNA, 18 nt, Human
uccagaagaauauucagg

SEQ ID NO: 2627309 - RNA, 17 nt, Human
uccagaagaauauucag

SEQ ID NO: 2627310 - RNA, 16 nt, Human
uccagaagaauauuca

SEQ ID NO: 2627311 - RNA, 21 nt, Human
uccagaagaauauucaggacu

SEQ ID NO: 2627312 - RNA, 20 nt, Human
uccagaagaauauucaggac

SEQ ID NO: 2627313 - RNA, 16 nt, Human
uccagaagccucuggc

SEQ ID NO: 2627314 - RNA, 23 nt, Human
uccagaaaugucuaaaugcugaa

SEQ ID NO: 2627315 - RNA, 17 nt, Human
uccaccugagcugccau

SEQ ID NO: 2627316 - RNA, 15 nt, Human
ucauguaauccucaa

SEQ ID NO: 2627317 - RNA, 18 nt, Human
ucauuaggugugacugaa

SEQ ID NO: 2627318 - RNA, 21 nt, Human
ucauuaggugugacugaauuu

SEQ ID NO: 2627319 - RNA, 22 nt, Human
ucauuaggugugacugaauuuc

SEQ ID NO: 2627320 - RNA, 19 nt, Human
ucauguaagcugaaaauau

SEQ ID NO: 2627321 - RNA, 18 nt, Human
ucauguaagcugaaaaua

SEQ ID NO: 2627322 - RNA, 16 nt, Human
ucauuauuugcagaga

SEQ ID NO: 2627323 - RNA, 16 nt, Human
ucauuaggugugacug

SEQ ID NO: 2627324 - RNA, 17 nt, Human
ucauguaaauuuuguau

SEQ ID NO: 2627325 - RNA, 16 nt, Human
ucauguaaauuuugua

SEQ ID NO: 2627326 - RNA, 22 nt, Human
ucaugguguaauaagacauaac

SEQ ID NO: 2627327 - RNA, 13 nt, Human
ucauguaaacugu

SEQ ID NO: 2627328 - RNA, 14 nt, Human
ucauguaaacugug

SEQ ID NO: 2627329 - RNA, 17 nt, Human
ucauguaaacugugcac

SEQ ID NO: 2627330 - RNA, 16 nt, Human
ucauguaaacugugca

SEQ ID NO: 2627331 - RNA, 21 nt, Human
ucaugcccccuuucagauguc

SEQ ID NO: 2627332 - RNA, 18 nt, Human
ucaugcccccuuucagau

SEQ ID NO: 2627333 - RNA, 15 nt, Human
ucaugcccccuuuca

SEQ ID NO: 2627334 - RNA, 22 nt, Human
ucaugccccccucaaaccuccu

SEQ ID NO: 2627335 - RNA, 16 nt, Human
ucaugccccuggcugg

SEQ ID NO: 2627336 - RNA, 13 nt, Human
ucaugcccuccuc

SEQ ID NO: 2627337 - RNA, 14 nt, Human
ucaugcccuccucu

SEQ ID NO: 2627338 - RNA, 15 nt, Human
ucaugcccugugcaa

SEQ ID NO: 2627339 - RNA, 15 nt, Human
ucaugcccuccucuc

SEQ ID NO: 2627340 - RNA, 15 nt, Human
ucaugcuaucucugu

SEQ ID NO: 2627341 - RNA, 22 nt, Human
ucaugcuaauuauauaauauuu

SEQ ID NO: 2627342 - RNA, 21 nt, Human
ucaugguguaauaagacauaa

SEQ ID NO: 2627343 - RNA, 15 nt, Human
ucaugccuguaaucc

SEQ ID NO: 2627344 - RNA, 20 nt, Human
ucaugguguaauaagacaua

SEQ ID NO: 2627345 - RNA, 17 nt, Human
ucaugccuggcuucgca

SEQ ID NO: 2627346 - RNA, 15 nt, Human
ucaugccuggcuucg

SEQ ID NO: 2627347 - RNA, 13 nt, Human
ucaugccuggcuu

SEQ ID NO: 2627348 - RNA, 14 nt, Human
ucaugccuguaauc

SEQ ID NO: 2627349 - RNA, 18 nt, Human
ucaugccuggcuucgcaa

SEQ ID NO: 2627350 - RNA, 15 nt, Human
ucauacccaccccca

SEQ ID NO: 2627351 - RNA, 14 nt, Human
ucauacccaccccc

SEQ ID NO: 2627352 - RNA, 20 nt, Human
ucauacccacccccacccaa

SEQ ID NO: 2627353 - RNA, 19 nt, Human
ucauagggaagaccugcug

SEQ ID NO: 2627354 - RNA, 15 nt, Human
ucauaccaaugaaaa

SEQ ID NO: 2627355 - RNA, 14 nt, Human
ucauaguaacuucu

SEQ ID NO: 2627356 - RNA, 15 nt, Human
ucauaguaacuucuu

SEQ ID NO: 2627357 - RNA, 16 nt, Human
ucauaguaacuucuua

SEQ ID NO: 2627358 - RNA, 18 nt, Human
ucauaguaacuucuuaug

SEQ ID NO: 2627359 - RNA, 21 nt, Human
ucaucuccugccuuccuccug

SEQ ID NO: 2627360 - RNA, 22 nt, Human
ucaucuccugccuuccuccugg

SEQ ID NO: 2627361 - RNA, 21 nt, Human
ucauaguaacuucuuauggaa

SEQ ID NO: 2627362 - RNA, 20 nt, Human
ucauaguacucuuuguagca

SEQ ID NO: 2627363 - RNA, 20 nt, Human
ucauagguugccaauaauac

SEQ ID NO: 2627364 - RNA, 16 nt, Human
ucauagguugccaaua

SEQ ID NO: 2627365 - RNA, 22 nt, Human
ucauaccaggccgccccagccu

SEQ ID NO: 2627366 - RNA, 17 nt, Human
ucauagggucucuucag

SEQ ID NO: 2627367 - RNA, 18 nt, Human
ucauagggucucuucagg

SEQ ID NO: 2627368 - RNA, 20 nt, Human
ucauagggucucuucagguu

SEQ ID NO: 2627369 - RNA, 23 nt, Human
ucauaggucacuggcucuccaag

SEQ ID NO: 2627370 - RNA, 18 nt, Human
ucauaggucacuggcucu

SEQ ID NO: 2627371 - RNA, 16 nt, Human
ucauagguauuucaaa

SEQ ID NO: 2627372 - RNA, 21 nt, Human
ucauagggucucuucagguuc

SEQ ID NO: 2627373 - RNA, 19 nt, Human
ucaucugugugaaaauggg

SEQ ID NO: 2627374 - RNA, 13 nt, Human
ucaugccccccuc

SEQ ID NO: 2627375 - RNA, 23 nt, Human
ucaugcccacccccugcccugca

SEQ ID NO: 2627376 - RNA, 17 nt, Human
ucaucuguuuuucuuuu

SEQ ID NO: 2627377 - RNA, 18 nt, Human
ucaucugucccuccggga

SEQ ID NO: 2627378 - RNA, 12 nt, Human
ucaucugugcac

SEQ ID NO: 2627379 - RNA, 17 nt, Human
ucaucugugugaaaaug

SEQ ID NO: 2627380 - RNA, 14 nt, Human
ucaucugugugaaa

SEQ ID NO: 2627381 - RNA, 12 nt, Human
ucaucuguguga

SEQ ID NO: 2627382 - RNA, 20 nt, Human
ucaucugggggaguggaaua

SEQ ID NO: 2627383 - RNA, 19 nt, Human
ucaucugggggaguggaau

SEQ ID NO: 2627384 - RNA, 13 nt, Human
ucaucuguaacuc

SEQ ID NO: 2627385 - RNA, 18 nt, Human
ucaucugggggaguggaa

SEQ ID NO: 2627386 - RNA, 16 nt, Human
ucaucugggggagugg

SEQ ID NO: 2627387 - RNA, 12 nt, Human
ucaucugucccu

SEQ ID NO: 2627388 - RNA, 17 nt, Human
ucaucugucccuccggg

SEQ ID NO: 2627389 - RNA, 15 nt, Human
ucaucugucaagugg

SEQ ID NO: 2627390 - RNA, 21 nt, Human
ucaucucuuagcuccccucca

SEQ ID NO: 2627391 - RNA, 20 nt, Human
ucaucucuuagcuccccucc

SEQ ID NO: 2627392 - RNA, 19 nt, Human
ucaucucuuagcuccccuc

SEQ ID NO: 2627393 - RNA, 14 nt, Human
ucaucucuuagcuc

SEQ ID NO: 2627394 - RNA, 14 nt, Human
ucaucucuucuuuu

SEQ ID NO: 2627395 - RNA, 14 nt, Human
ucaucucuguccca

SEQ ID NO: 2627396 - RNA, 18 nt, Human
ucaucugggaaagacauc

SEQ ID NO: 2627397 - RNA, 23 nt, Human
ucaucucuccuccaagacacugu

SEQ ID NO: 2627398 - RNA, 15 nt, Human
ucaucucuccuccaa

SEQ ID NO: 2627399 - RNA, 11 nt, Human
ucaucucuccu

SEQ ID NO: 2627400 - RNA, 23 nt, Human
ucaucuccugccuuccuccuggg

SEQ ID NO: 2627401 - RNA, 18 nt, Human
ucaucuccugccuuccuc

SEQ ID NO: 2627402 - RNA, 14 nt, Human
ucaucucucugccc

SEQ ID NO: 2627403 - RNA, 16 nt, Human
ucaucucucugcccaa

SEQ ID NO: 2627404 - RNA, 13 nt, Human
ucaucucuuagcu

SEQ ID NO: 2627405 - RNA, 16 nt, Human
ucaucucucuuuaaua

SEQ ID NO: 2627406 - RNA, 12 nt, Human
ucauaauucuaa

SEQ ID NO: 2627407 - RNA, 19 nt, Human
ucauaaugugaaguguuaa

SEQ ID NO: 2627408 - RNA, 18 nt, Human
ucauaaugugaaguguua

SEQ ID NO: 2627409 - RNA, 17 nt, Human
ucauaaugugaaguguu

SEQ ID NO: 2627410 - RNA, 15 nt, Human
ucauaaugugaagug

SEQ ID NO: 2627411 - RNA, 14 nt, Human
ucauaaugugaagu

SEQ ID NO: 2627412 - RNA, 13 nt, Human
ucauaaugugaag

SEQ ID NO: 2627413 - RNA, 22 nt, Human
ucauacaaggcccaggaggcuu

SEQ ID NO: 2627414 - RNA, 12 nt, Human
ucauaaugugaa

SEQ ID NO: 2627415 - RNA, 17 nt, Human
ucaguuguuaguguguc

SEQ ID NO: 2627416 - RNA, 15 nt, Human
ucauaauuauuauuu

SEQ ID NO: 2627417 - RNA, 13 nt, Human
ucauacccacccc

SEQ ID NO: 2627418 - RNA, 14 nt, Human
ucauacacuuccuu

SEQ ID NO: 2627419 - RNA, 20 nt, Human
ucaguucagaaucacuucug

SEQ ID NO: 2627420 - RNA, 18 nt, Human
ucaguucccagaaucaaa

SEQ ID NO: 2627421 - RNA, 17 nt, Human
ucaguucccagaaucaa

SEQ ID NO: 2627422 - RNA, 16 nt, Human
ucaguucccagaauca

SEQ ID NO: 2627423 - RNA, 14 nt, Human
ucaguucccagaau

SEQ ID NO: 2627424 - RNA, 19 nt, Human
ucaguucucuugauuuuca

SEQ ID NO: 2627425 - RNA, 23 nt, Human
ucaguugagcuucauauaccagc

SEQ ID NO: 2627426 - RNA, 22 nt, Human
ucaguuagagcugacacaaacc

SEQ ID NO: 2627427 - RNA, 18 nt, Human
ucaguuagagcugacaca

SEQ ID NO: 2627428 - RNA, 19 nt, Human
ucaguuacucagcccuggg

SEQ ID NO: 2627429 - RNA, 15 nt, Human
ucaguuacucuucag

SEQ ID NO: 2627430 - RNA, 16 nt, Human
ucaguuacucugaagg

SEQ ID NO: 2627431 - RNA, 17 nt, Human
ucaguuacucugaaggg

SEQ ID NO: 2627432 - RNA, 13 nt, Human
ucauaaugacuua

SEQ ID NO: 2627433 - RNA, 21 nt, Human
ucaguuguagaauguauugua

SEQ ID NO: 2627434 - RNA, 18 nt, Human
ucaguuguagaauguauu

SEQ ID NO: 2627435 - RNA, 17 nt, Human
ucaguugcaauaauacu

SEQ ID NO: 2627436 - RNA, 14 nt, Human
ucaguuggcugacu

SEQ ID NO: 2627437 - RNA, 16 nt, Human
ucaguugcaauaauac

SEQ ID NO: 2627438 - RNA, 23 nt, Human
ucagugguuggcaauuguuucaa

SEQ ID NO: 2627439 - RNA, 15 nt, Human
ucaguguaauuucuu

SEQ ID NO: 2627440 - RNA, 14 nt, Human
ucaguguaauuucu

SEQ ID NO: 2627441 - RNA, 16 nt, Human
ucaguguaagcccugc

SEQ ID NO: 2627442 - RNA, 23 nt, Human
ucaguguaaauaguuacuccagu

SEQ ID NO: 2627443 - RNA, 21 nt, Human
ucagugguccacaucccggga

SEQ ID NO: 2627444 - RNA, 20 nt, Human
ucagugguuauuuagggaac

SEQ ID NO: 2627445 - RNA, 17 nt, Human
ucagugucaaauaaaca

SEQ ID NO: 2627446 - RNA, 15 nt, Human
ucagugucaaauaaa

SEQ ID NO: 2627447 - RNA, 14 nt, Human
ucagugucaaauaa

SEQ ID NO: 2627448 - RNA, 16 nt, Human
ucaguguauuuguauu

SEQ ID NO: 2627449 - RNA, 19 nt, Human
ucaguguaauuucuuugcc

SEQ ID NO: 2627450 - RNA, 18 nt, Human
ucaguguaauuucuuugc

SEQ ID NO: 2627451 - RNA, 15 nt, Human
ucaguguauuuguau

SEQ ID NO: 2627452 - RNA, 11 nt, Human
ucaguguacau

SEQ ID NO: 2627453 - RNA, 13 nt, Human
ucagugugacuga

SEQ ID NO: 2627454 - RNA, 19 nt, Human
ucaguguccucuugcucaa

SEQ ID NO: 2627455 - RNA, 17 nt, Human
ucagugucccgggcccg

SEQ ID NO: 2627456 - RNA, 13 nt, Human
ucagugucccggg

SEQ ID NO: 2627457 - RNA, 16 nt, Human
ucaguguccaaagcag

SEQ ID NO: 2627458 - RNA, 21 nt, Human
ucagugucaaauaaacacugu

SEQ ID NO: 2627459 - RNA, 19 nt, Human
ucagugucaaauaaacacu

SEQ ID NO: 2627460 - RNA, 22 nt, Human
ucagugucaaauaaacacugug

SEQ ID NO: 2627461 - RNA, 20 nt, Human
ucagugucauuuaugaaaag

SEQ ID NO: 2627462 - RNA, 17 nt, Human
ucagugugacugaucuc

SEQ ID NO: 2627463 - RNA, 21 nt, Human
ucagugucucacacuggcgua

SEQ ID NO: 2627464 - RNA, 15 nt, Human
ucagugucucacacu

SEQ ID NO: 2627465 - RNA, 14 nt, Human
ucagugucucacac

SEQ ID NO: 2627466 - RNA, 13 nt, Human
ucagugucucaca

SEQ ID NO: 2627467 - RNA, 15 nt, Human
ucaguuacucagccc

SEQ ID NO: 2627468 - RNA, 16 nt, Human
ucaguuacucagcccu

SEQ ID NO: 2627469 - RNA, 17 nt, Human
ucaguuacucagcccug

SEQ ID NO: 2627470 - RNA, 18 nt, Human
ucaguuacucagcccugg

SEQ ID NO: 2627471 - RNA, 15 nt, Human
ucagucuggcccuuc

SEQ ID NO: 2627472 - RNA, 23 nt, Human
ucagcagcgaccaccccugccuc

SEQ ID NO: 2627473 - RNA, 14 nt, Human
ucagcaggaagcaa

SEQ ID NO: 2627474 - RNA, 19 nt, Human
ucagucuggugggaggacg

SEQ ID NO: 2627475 - RNA, 20 nt, Human
ucaguggggcccauggaugu

SEQ ID NO: 2627476 - RNA, 17 nt, Human
ucagucuggugggagga

SEQ ID NO: 2627477 - RNA, 16 nt, Human
ucagucuggugggagg

SEQ ID NO: 2627478 - RNA, 13 nt, Human
ucagucugguggg

SEQ ID NO: 2627479 - RNA, 24 nt, Human
ucagucugauucccaagcucugcu

SEQ ID NO: 2627480 - RNA, 22 nt, Human
ucagcagcgaccaccccugccu

SEQ ID NO: 2627481 - RNA, 20 nt, Human
ucagcagcgaccaccccugc

SEQ ID NO: 2627482 - RNA, 17 nt, Human
ucagcagccucccugaa

SEQ ID NO: 2627483 - RNA, 16 nt, Human
ucagcagcccuccuca

SEQ ID NO: 2627484 - RNA, 17 nt, Human
ucagcagcccuccucac

SEQ ID NO: 2627485 - RNA, 18 nt, Human
ucagcagcccuccucacc

SEQ ID NO: 2627486 - RNA, 12 nt, Human
ucagcagcccuc

SEQ ID NO: 2627487 - RNA, 14 nt, Human
ucagcagcccuccu

SEQ ID NO: 2627488 - RNA, 15 nt, Human
ucagcagcccuccuc

SEQ ID NO: 2627489 - RNA, 18 nt, Human
ucucuuuuugcuuucgaa

SEQ ID NO: 2627490 - RNA, 13 nt, Human
ucucuuuuuggag

SEQ ID NO: 2627491 - RNA, 21 nt, Human
ucucuuuuugacucuugcaau

SEQ ID NO: 2627492 - RNA, 14 nt, Human
ucucuuuuugacuc

SEQ ID NO: 2627493 - RNA, 13 nt, Human
ucucuuuuucagu

SEQ ID NO: 2627494 - RNA, 16 nt, Human
ucugaaaauguaugug

SEQ ID NO: 2627495 - RNA, 12 nt, Human
ucucuuuucucu

SEQ ID NO: 2627496 - RNA, 13 nt, Human
ucucuuuucuuua

SEQ ID NO: 2627497 - RNA, 16 nt, Human
ucucuuuucucuuucu

SEQ ID NO: 2627498 - RNA, 17 nt, Human
ucucuuuugaaacaaua

SEQ ID NO: 2627499 - RNA, 20 nt, Human
ucucuuuucuuuagagcauu

SEQ ID NO: 2627500 - RNA, 19 nt, Human
ucucuuuucuuuagagcau

SEQ ID NO: 2627501 - RNA, 18 nt, Human
ucucuuuucuuuagagca

SEQ ID NO: 2627502 - RNA, 20 nt, Human
ucucuuuugaaacaauacuc

SEQ ID NO: 2627503 - RNA, 20 nt, Human
ucucuuuugaauccaugcuu

SEQ ID NO: 2627504 - RNA, 22 nt, Human
ucucuuuugaauccaugcuugg

SEQ ID NO: 2627505 - RNA, 23 nt, Human
ucucuuuugaauccaugcuuggg

SEQ ID NO: 2627506 - RNA, 19 nt, Human
ucucuuuguucucagcucc

SEQ ID NO: 2627507 - RNA, 17 nt, Human
ucucuuuguucucagcu

SEQ ID NO: 2627508 - RNA, 14 nt, Human
ucucuuuguucuca

SEQ ID NO: 2627509 - RNA, 13 nt, Human
ucucuuuguucuc

SEQ ID NO: 2627510 - RNA, 23 nt, Human
ucucuuuguucucagcucccccu

SEQ ID NO: 2627511 - RNA, 21 nt, Human
ucucuuuguucucagcucccc

SEQ ID NO: 2627512 - RNA, 16 nt, Human
ucucuuuucaaaacau

SEQ ID NO: 2627513 - RNA, 15 nt, Human
ucucuuuucaaaaca

SEQ ID NO: 2627514 - RNA, 16 nt, Human
ucucuuugggaauguu

SEQ ID NO: 2627515 - RNA, 17 nt, Human
ucucuuuguucuaaaga

SEQ ID NO: 2627516 - RNA, 14 nt, Human
ucugaaaugugaua

SEQ ID NO: 2627517 - RNA, 15 nt, Human
ucugaaaucugaaga

SEQ ID NO: 2627518 - RNA, 13 nt, Human
ucugaaaugaaga

SEQ ID NO: 2627519 - RNA, 16 nt, Human
ucugaaaucugaagac

SEQ ID NO: 2627520 - RNA, 12 nt, Human
ucugaaaucuga

SEQ ID NO: 2627521 - RNA, 12 nt, Human
ucugaacucaaa

SEQ ID NO: 2627522 - RNA, 14 nt, Human
ucugaacucaaacu

SEQ ID NO: 2627523 - RNA, 16 nt, Human
ucugaacucaaacuga

SEQ ID NO: 2627524 - RNA, 17 nt, Human
ucugaacucaaacugag

SEQ ID NO: 2627525 - RNA, 21 nt, Human
ucugaacucaaacugaggaau

SEQ ID NO: 2627526 - RNA, 21 nt, Human
ucugaaaugugauaaguucuu

SEQ ID NO: 2627527 - RNA, 13 nt, Human
ucugaaagggacg

SEQ ID NO: 2627528 - RNA, 14 nt, Human
ucugaaagccacgu

SEQ ID NO: 2627529 - RNA, 12 nt, Human
ucugaaagccac

SEQ ID NO: 2627530 - RNA, 19 nt, Human
ucugaaaauuaacacugcu

SEQ ID NO: 2627531 - RNA, 18 nt, Human
ucugaaaauuaacacugc

SEQ ID NO: 2627532 - RNA, 23 nt, Human
ucugaaaauguauguguaaguau

SEQ ID NO: 2627533 - RNA, 14 nt, Human
ucugaaaauguaug

SEQ ID NO: 2627534 - RNA, 13 nt, Human
ucugaaaauguga

SEQ ID NO: 2627535 - RNA, 17 nt, Human
ucugaaaauuaacacug

SEQ ID NO: 2627536 - RNA, 17 nt, Human
ucucuuccccucucaga

SEQ ID NO: 2627537 - RNA, 15 nt, Human
ucucuuccccucuca

SEQ ID NO: 2627538 - RNA, 14 nt, Human
ucucuuccccucuc

SEQ ID NO: 2627539 - RNA, 13 nt, Human
ucucuuccccucu

SEQ ID NO: 2627540 - RNA, 21 nt, Human
ucucuuccauaugaccucaug

SEQ ID NO: 2627541 - RNA, 17 nt, Human
ucucuuccauaugaccu

SEQ ID NO: 2627542 - RNA, 14 nt, Human
ucucuucauacuuu

SEQ ID NO: 2627543 - RNA, 23 nt, Human
ucucuucagguucuuagugucac

SEQ ID NO: 2627544 - RNA, 18 nt, Human
ucucuucacagucacauu

SEQ ID NO: 2627545 - RNA, 15 nt, Human
ucucuucagguucuu

SEQ ID NO: 2627546 - RNA, 16 nt, Human
ucucuucagguucuua

SEQ ID NO: 2627547 - RNA, 13 nt, Human
ucucuucagguuc

SEQ ID NO: 2627548 - RNA, 14 nt, Human
ucucuucagguucu

SEQ ID NO: 2627549 - RNA, 11 nt, Human
ucucugcaggu

SEQ ID NO: 2627550 - RNA, 20 nt, Human
ucucugcagccagcccagcc

SEQ ID NO: 2627551 - RNA, 11 nt, Human
ucucugcagcc

SEQ ID NO: 2627552 - RNA, 15 nt, Human
ucucugcagccagcc

SEQ ID NO: 2627553 - RNA, 16 nt, Human
ucucugcagccagccc

SEQ ID NO: 2627554 - RNA, 17 nt, Human
ucucugcagccagccca

SEQ ID NO: 2627555 - RNA, 18 nt, Human
ucucugcagccagcccag

SEQ ID NO: 2627556 - RNA, 19 nt, Human
ucucugcagccagcccagc

SEQ ID NO: 2627557 - RNA, 19 nt, Human
ucucugcaaucuucucaga

SEQ ID NO: 2627558 - RNA, 11 nt, Human
ucucugcaccc

SEQ ID NO: 2627559 - RNA, 18 nt, Human
ucucugcaccguacugug

SEQ ID NO: 2627560 - RNA, 20 nt, Human
ucucuuccuuuuaucaguag

SEQ ID NO: 2627561 - RNA, 11 nt, Human
ucucuucucca

SEQ ID NO: 2627562 - RNA, 11 nt, Human
ucucuuccugu

SEQ ID NO: 2627563 - RNA, 11 nt, Human
ucucuuccuac

SEQ ID NO: 2627564 - RNA, 19 nt, Human
ucucuuccuccgaggccag

SEQ ID NO: 2627565 - RNA, 16 nt, Human
ucucuucuccacugga

SEQ ID NO: 2627566 - RNA, 15 nt, Human
ucucuucuccacugg

SEQ ID NO: 2627567 - RNA, 14 nt, Human
ucucuucuccacug

SEQ ID NO: 2627568 - RNA, 13 nt, Human
ucucuucuccacu

SEQ ID NO: 2627569 - RNA, 12 nt, Human
ucucuuccugua

SEQ ID NO: 2627570 - RNA, 20 nt, Human
ucucuuugaauuuucugugu

SEQ ID NO: 2627571 - RNA, 13 nt, Human
ucucuucucuguu

SEQ ID NO: 2627572 - RNA, 18 nt, Human
ucugacccaugcugcccu

SEQ ID NO: 2627573 - RNA, 17 nt, Human
ucugacccaugcugccc

SEQ ID NO: 2627574 - RNA, 16 nt, Human
ucugacccaugcugcc

SEQ ID NO: 2627575 - RNA, 15 nt, Human
ucugacccaugcugc

SEQ ID NO: 2627576 - RNA, 20 nt, Human
ucugagcauuagauuucuca

SEQ ID NO: 2627577 - RNA, 15 nt, Human
ucugagcacacuuua

SEQ ID NO: 2627578 - RNA, 16 nt, Human
ucugagcaagagcugg

SEQ ID NO: 2627579 - RNA, 15 nt, Human
ucugagcaagagcug

SEQ ID NO: 2627580 - RNA, 17 nt, Human
ucugagcaagagcuggc

SEQ ID NO: 2627581 - RNA, 19 nt, Human
ucugacccagugcccccac

SEQ ID NO: 2627582 - RNA, 22 nt, Human
ucugacccagugcccccacuga

SEQ ID NO: 2627583 - RNA, 21 nt, Human
ucugacccagugagauuacag

SEQ ID NO: 2627584 - RNA, 23 nt, Human
ucugacccagugcccccacugac

SEQ ID NO: 2627585 - RNA, 20 nt, Human
ucugagauuauuuuaaucua

SEQ ID NO: 2627586 - RNA, 15 nt, Human
ucugacccagugaga

SEQ ID NO: 2627587 - RNA, 14 nt, Human
ucugacccagugag

SEQ ID NO: 2627588 - RNA, 13 nt, Human
ucugacccagugc

SEQ ID NO: 2627589 - RNA, 14 nt, Human
ucugacccagugcc

SEQ ID NO: 2627590 - RNA, 15 nt, Human
ucugacccagugccc

SEQ ID NO: 2627591 - RNA, 14 nt, Human
ucugacccaugcug

SEQ ID NO: 2627592 - RNA, 16 nt, Human
ucugaccagcagcgcc

SEQ ID NO: 2627593 - RNA, 11 nt, Human
ucugacccagu

SEQ ID NO: 2627594 - RNA, 13 nt, Human
ucugaccagcagc

SEQ ID NO: 2627595 - RNA, 22 nt, Human
ucugaccacacuuccuguccag

SEQ ID NO: 2627596 - RNA, 22 nt, Human
ucugacauucucaggaagcccc

SEQ ID NO: 2627597 - RNA, 21 nt, Human
ucugacauucucaggaagccc

SEQ ID NO: 2627598 - RNA, 12 nt, Human
ucugaccacacu

SEQ ID NO: 2627599 - RNA, 13 nt, Human
ucugaccacgugc

SEQ ID NO: 2627600 - RNA, 13 nt, Human
ucugaccacacuu

SEQ ID NO: 2627601 - RNA, 18 nt, Human
ucugaccacacuuccugu

SEQ ID NO: 2627602 - RNA, 16 nt, Human
ucugacaucucugcaa

SEQ ID NO: 2627603 - RNA, 18 nt, Human
ucugacaugauuccuucc

SEQ ID NO: 2627604 - RNA, 19 nt, Human
ucugacaugauuccuuccu

SEQ ID NO: 2627605 - RNA, 22 nt, Human
ucugacaugauuccuuccuguu

SEQ ID NO: 2627606 - RNA, 15 nt, Human
ucugacauuaacagu

SEQ ID NO: 2627607 - RNA, 16 nt, Human
ucugacauuaacaguu

SEQ ID NO: 2627608 - RNA, 13 nt, Human
ucugacauucuca

SEQ ID NO: 2627609 - RNA, 23 nt, Human
ucugacauuaacaguuuuccaug

SEQ ID NO: 2627610 - RNA, 18 nt, Human
ucugacauuaacaguuuu

SEQ ID NO: 2627611 - RNA, 19 nt, Human
ucugacauuaacaguuuuc

SEQ ID NO: 2627612 - RNA, 21 nt, Human
ucugacauuaacaguuuucca

SEQ ID NO: 2627613 - RNA, 22 nt, Human
ucugacauuaacaguuuuccau

SEQ ID NO: 2627614 - RNA, 20 nt, Human
ucugaacuuggcgcugcccc

SEQ ID NO: 2627615 - RNA, 21 nt, Human
ucugaacuuggcgcugccccu

SEQ ID NO: 2627616 - RNA, 22 nt, Human
ucugcaauuccccucugcugcu

SEQ ID NO: 2627617 - RNA, 21 nt, Human
ucugcaauuccccucugcugc

SEQ ID NO: 2627618 - RNA, 20 nt, Human
ucugcacaugucuuguacau

SEQ ID NO: 2627619 - RNA, 19 nt, Human
ucugcacaagcugcacccu

SEQ ID NO: 2627620 - RNA, 20 nt, Human
ucugcaauuccccucugcug

SEQ ID NO: 2627621 - RNA, 18 nt, Human
ucugcaauuccccucugc

SEQ ID NO: 2627622 - RNA, 16 nt, Human
ucugcaauuccccucu

SEQ ID NO: 2627623 - RNA, 14 nt, Human
ucugcacaagcugc

SEQ ID NO: 2627624 - RNA, 23 nt, Human
ucugauuguaacguugcuguggg

SEQ ID NO: 2627625 - RNA, 22 nt, Human
ucugauuguaacguugcugugg

SEQ ID NO: 2627626 - RNA, 21 nt, Human
ucugauuguaacguugcugug

SEQ ID NO: 2627627 - RNA, 20 nt, Human
ucugauuguaacguugcugu

SEQ ID NO: 2627628 - RNA, 18 nt, Human
ucugauuggcucacccaa

SEQ ID NO: 2627629 - RNA, 17 nt, Human
ucugauuggcucaccca

SEQ ID NO: 2627630 - RNA, 13 nt, Human
ucugauuggcuca

SEQ ID NO: 2627631 - RNA, 23 nt, Human
ucugauuggacauuuucuucaga

SEQ ID NO: 2627632 - RNA, 21 nt, Human
ucugauuggacauuuucuuca

SEQ ID NO: 2627633 - RNA, 20 nt, Human
ucugauuggacauuuucuuc

SEQ ID NO: 2627634 - RNA, 19 nt, Human
ucugauuggacauuuucuu

SEQ ID NO: 2627635 - RNA, 16 nt, Human
ucugauuggacauuuu

SEQ ID NO: 2627636 - RNA, 15 nt, Human
ucugauuggacauuu

SEQ ID NO: 2627637 - RNA, 15 nt, Human
ucugacaucucugca

SEQ ID NO: 2627638 - RNA, 23 nt, Human
ucugauucccaagcucugcuccu

SEQ ID NO: 2627639 - RNA, 23 nt, Human
ucugaggacacuaaccacgcugg

SEQ ID NO: 2627640 - RNA, 20 nt, Human
ucugaggacacuaaccacgc

SEQ ID NO: 2627641 - RNA, 17 nt, Human
ucugaggaauccagacc

SEQ ID NO: 2627642 - RNA, 16 nt, Human
ucugaggaauccagac

SEQ ID NO: 2627643 - RNA, 22 nt, Human
ucugagcauuagauuucucauu

SEQ ID NO: 2627644 - RNA, 19 nt, Human
ucugagcagugaaugauuc

SEQ ID NO: 2627645 - RNA, 17 nt, Human
ucugagcugcucugaau

SEQ ID NO: 2627646 - RNA, 15 nt, Human
ucugagcugcucuga

SEQ ID NO: 2627647 - RNA, 18 nt, Human
ucugagcucugcauuugu

SEQ ID NO: 2627648 - RNA, 19 nt, Human
ucucuaggaaauauuuauu

SEQ ID NO: 2627649 - RNA, 13 nt, Human
ucucuaggaaaua

SEQ ID NO: 2627650 - RNA, 18 nt, Human
ucucuaguuugauuaaau

SEQ ID NO: 2627651 - RNA, 19 nt, Human
ucucuaguuugauuaaauu

SEQ ID NO: 2627652 - RNA, 17 nt, Human
ucucuaucauuuaauaa

SEQ ID NO: 2627653 - RNA, 16 nt, Human
ucucuaucauuuaaua

SEQ ID NO: 2627654 - RNA, 15 nt, Human
ucucuaucauuuaau

SEQ ID NO: 2627655 - RNA, 14 nt, Human
ucucuaucauuuaa

SEQ ID NO: 2627656 - RNA, 17 nt, Human
ucucuaucauuaaaguu

SEQ ID NO: 2627657 - RNA, 16 nt, Human
ucucuaucauuaaagu

SEQ ID NO: 2627658 - RNA, 15 nt, Human
ucucuaucauuaaag

SEQ ID NO: 2627659 - RNA, 14 nt, Human
ucucuaucauuaaa

SEQ ID NO: 2627660 - RNA, 13 nt, Human
ucucuaucauuua

SEQ ID NO: 2627661 - RNA, 12 nt, Human
ucucuaucauuu

SEQ ID NO: 2627662 - RNA, 13 nt, Human
ucucuaucauuaa

SEQ ID NO: 2627663 - RNA, 22 nt, Human
ucucuauagcaccagggcucac

SEQ ID NO: 2627664 - RNA, 16 nt, Human
ucucuauagcaccagg

SEQ ID NO: 2627665 - RNA, 24 nt, Human
ucucuagcuggugguuucacggug

SEQ ID NO: 2627666 - RNA, 23 nt, Human
ucucuagcuggugguuucacggu

SEQ ID NO: 2627667 - RNA, 12 nt, Human
ucucuagccacu

SEQ ID NO: 2627668 - RNA, 22 nt, Human
ucucuagaauuuuaagugcuuu

SEQ ID NO: 2627669 - RNA, 13 nt, Human
ucuccuguaccuc

SEQ ID NO: 2627670 - RNA, 20 nt, Human
ucucuacagacuucuccaga

SEQ ID NO: 2627671 - RNA, 15 nt, Human
ucucuacaaaaagca

SEQ ID NO: 2627672 - RNA, 19 nt, Human
ucucuacuccuaccucagc

SEQ ID NO: 2627673 - RNA, 20 nt, Human
ucucuacuccuaccucagcc

SEQ ID NO: 2627674 - RNA, 21 nt, Human
ucucuacuccuaccucagccu

SEQ ID NO: 2627675 - RNA, 13 nt, Human
ucucuagaauuuu

SEQ ID NO: 2627676 - RNA, 17 nt, Human
ucucuagaauuuuaagu

SEQ ID NO: 2627677 - RNA, 17 nt, Human
ucucuauuuaauauuua

SEQ ID NO: 2627678 - RNA, 14 nt, Human
ucucuccuuugcug

SEQ ID NO: 2627679 - RNA, 20 nt, Human
ucucucggcuccccaugugu

SEQ ID NO: 2627680 - RNA, 15 nt, Human
ucucucggcucccca

SEQ ID NO: 2627681 - RNA, 23 nt, Human
ucucucggcuccccauguguccu

SEQ ID NO: 2627682 - RNA, 15 nt, Human
ucucucgguuccacg

SEQ ID NO: 2627683 - RNA, 23 nt, Human
ucucucggaguaucugggaacug

SEQ ID NO: 2627684 - RNA, 18 nt, Human
ucucuaucauuaaaguuc

SEQ ID NO: 2627685 - RNA, 22 nt, Human
ucucuaucauuuaauaauauac

SEQ ID NO: 2627686 - RNA, 20 nt, Human
ucucuaucauuuaauaauau

SEQ ID NO: 2627687 - RNA, 15 nt, Human
ucucuauuuaauauu

SEQ ID NO: 2627688 - RNA, 14 nt, Human
ucucuauuuaauau

SEQ ID NO: 2627689 - RNA, 17 nt, Human
ucucucucaauuuuugg

SEQ ID NO: 2627690 - RNA, 11 nt, Human
ucucucucacc

SEQ ID NO: 2627691 - RNA, 22 nt, Human
ucucucuacuccuaccucagcc

SEQ ID NO: 2627692 - RNA, 21 nt, Human
ucucucugugcuguggaagca

SEQ ID NO: 2627693 - RNA, 17 nt, Human
ucucucugugcugugga

SEQ ID NO: 2627694 - RNA, 20 nt, Human
ucucucuggggccacacaga

SEQ ID NO: 2627695 - RNA, 11 nt, Human
ucucucugugg

SEQ ID NO: 2627696 - RNA, 15 nt, Human
ucucucgugaguaua

SEQ ID NO: 2627697 - RNA, 23 nt, Human
ucucucgguuccacgucccccug

SEQ ID NO: 2627698 - RNA, 18 nt, Human
ucucucgguuccacgucc

SEQ ID NO: 2627699 - RNA, 20 nt, Human
ucucucguaacugguuucau

SEQ ID NO: 2627700 - RNA, 19 nt, Human
ucucucuacuccuaccuca

SEQ ID NO: 2627701 - RNA, 20 nt, Human
ucucucuacuccuaccucag

SEQ ID NO: 2627702 - RNA, 11 nt, Human
ucucucuuucc

SEQ ID NO: 2627703 - RNA, 14 nt, Human
ucucucuucugccu

SEQ ID NO: 2627704 - RNA, 16 nt, Human
ucucugacuucugccu

SEQ ID NO: 2627705 - RNA, 14 nt, Human
ucucugacuucugc

SEQ ID NO: 2627706 - RNA, 13 nt, Human
ucucugacuucug

SEQ ID NO: 2627707 - RNA, 11 nt, Human
ucucucuucug

SEQ ID NO: 2627708 - RNA, 14 nt, Human
ucucucuucugcuc

SEQ ID NO: 2627709 - RNA, 16 nt, Human
ucucucuucugcucca

SEQ ID NO: 2627710 - RNA, 17 nt, Human
ucucucuucugcuccac

SEQ ID NO: 2627711 - RNA, 19 nt, Human
ucucucuucugcuccaccc

SEQ ID NO: 2627712 - RNA, 20 nt, Human
ucucucuucugcuccacccu

SEQ ID NO: 2627713 - RNA, 19 nt, Human
ucucugauuuucaaagcuu

SEQ ID NO: 2627714 - RNA, 20 nt, Human
ucucugauuuucaaagcuuu

SEQ ID NO: 2627715 - RNA, 13 nt, Human
ucucugaggacac

SEQ ID NO: 2627716 - RNA, 18 nt, Human
ucucugacuucugccugg

SEQ ID NO: 2627717 - RNA, 17 nt, Human
ucucugacuucugccug

SEQ ID NO: 2627718 - RNA, 19 nt, Human
ucucugacuucugccugga

SEQ ID NO: 2627719 - RNA, 14 nt, Human
ucucugagcaguga

SEQ ID NO: 2627720 - RNA, 15 nt, Human
ucucugagcugugca

SEQ ID NO: 2627721 - RNA, 16 nt, Human
ucucugagcucugcau

SEQ ID NO: 2627722 - RNA, 16 nt, Human
ucucugagcugugcag

SEQ ID NO: 2627723 - RNA, 20 nt, Human
ucucccccagccccauccuc

SEQ ID NO: 2627724 - RNA, 18 nt, Human
ucucccccagccccaucc

SEQ ID NO: 2627725 - RNA, 13 nt, Human
ucucccccagccc

SEQ ID NO: 2627726 - RNA, 13 nt, Human
ucucccccccggg

SEQ ID NO: 2627727 - RNA, 16 nt, Human
ucuccccccccccucc

SEQ ID NO: 2627728 - RNA, 22 nt, Human
ucucccccagccccauccucug

SEQ ID NO: 2627729 - RNA, 16 nt, Human
ucucccgcugcugcug

SEQ ID NO: 2627730 - RNA, 15 nt, Human
ucucccgcugcugcu

SEQ ID NO: 2627731 - RNA, 20 nt, Human
ucucccggagguuggguggg

SEQ ID NO: 2627732 - RNA, 14 nt, Human
ucucccgcugcugc

SEQ ID NO: 2627733 - RNA, 13 nt, Human
ucucccgcugcug

SEQ ID NO: 2627734 - RNA, 16 nt, Human
ucuccccugcccccag

SEQ ID NO: 2627735 - RNA, 14 nt, Human
ucuccccugcccug

SEQ ID NO: 2627736 - RNA, 15 nt, Human
ucuccccugcccugc

SEQ ID NO: 2627737 - RNA, 17 nt, Human
ucuccccugcccugcug

SEQ ID NO: 2627738 - RNA, 23 nt, Human
ucuccccugcccccaggacuggg

SEQ ID NO: 2627739 - RNA, 22 nt, Human
ucuccccugcccccaggacugg

SEQ ID NO: 2627740 - RNA, 21 nt, Human
ucuccccugcccccaggacug

SEQ ID NO: 2627741 - RNA, 20 nt, Human
ucuccccugcccccaggacu

SEQ ID NO: 2627742 - RNA, 21 nt, Human
ucucccccccggggcuggguu

SEQ ID NO: 2627743 - RNA, 20 nt, Human
ucucccccccggggcugggu

SEQ ID NO: 2627744 - RNA, 12 nt, Human
ucucccccuggg

SEQ ID NO: 2627745 - RNA, 13 nt, Human
ucucccccugggc

SEQ ID NO: 2627746 - RNA, 14 nt, Human
ucucccccugggcu

SEQ ID NO: 2627747 - RNA, 17 nt, Human
ucucccccagccccauc

SEQ ID NO: 2627748 - RNA, 15 nt, Human
ucucccccagcccca

SEQ ID NO: 2627749 - RNA, 21 nt, Human
ucucaguuccgauuucccagg

SEQ ID NO: 2627750 - RNA, 20 nt, Human
ucucaguggcuucaucuguc

SEQ ID NO: 2627751 - RNA, 22 nt, Human
ucucaguguugagccuuuuccc

SEQ ID NO: 2627752 - RNA, 18 nt, Human
ucucaguguugagccuuu

SEQ ID NO: 2627753 - RNA, 14 nt, Human
ucucccccagcccc

SEQ ID NO: 2627754 - RNA, 21 nt, Human
ucucagugucaaugcagcccc

SEQ ID NO: 2627755 - RNA, 22 nt, Human
ucucagugguuaagauuccuaa

SEQ ID NO: 2627756 - RNA, 17 nt, Human
ucucaguacuuuggagg

SEQ ID NO: 2627757 - RNA, 16 nt, Human
ucucagucaugcauaa

SEQ ID NO: 2627758 - RNA, 14 nt, Human
ucucagucaugcau

SEQ ID NO: 2627759 - RNA, 15 nt, Human
ucucagucaguaauu

SEQ ID NO: 2627760 - RNA, 15 nt, Human
ucucaggucccugca

SEQ ID NO: 2627761 - RNA, 19 nt, Human
ucucagggucucugcugcc

SEQ ID NO: 2627762 - RNA, 12 nt, Human
ucucagguucuc

SEQ ID NO: 2627763 - RNA, 22 nt, Human
ucuccugccucagccucccaaa

SEQ ID NO: 2627764 - RNA, 17 nt, Human
ucuccugacccaguccc

SEQ ID NO: 2627765 - RNA, 11 nt, Human
ucuccugccua

SEQ ID NO: 2627766 - RNA, 12 nt, Human
ucuccugccuac

SEQ ID NO: 2627767 - RNA, 14 nt, Human
ucuccugccuacuc

SEQ ID NO: 2627768 - RNA, 15 nt, Human
ucuccugccuacuca

SEQ ID NO: 2627769 - RNA, 16 nt, Human
ucuccugccuuccucc

SEQ ID NO: 2627770 - RNA, 17 nt, Human
ucuccugccuuccuccu

SEQ ID NO: 2627771 - RNA, 18 nt, Human
ucuccugccuuccuccug

SEQ ID NO: 2627772 - RNA, 20 nt, Human
ucuccugccuuccuccuggg

SEQ ID NO: 2627773 - RNA, 19 nt, Human
ucuccugccucagccuccc

SEQ ID NO: 2627774 - RNA, 22 nt, Human
ucuccugccuguagcagugaga

SEQ ID NO: 2627775 - RNA, 20 nt, Human
ucuccugccuguagcaguga

SEQ ID NO: 2627776 - RNA, 13 nt, Human
ucuccugccugua

SEQ ID NO: 2627777 - RNA, 17 nt, Human
ucuccugccuacucacg

SEQ ID NO: 2627778 - RNA, 22 nt, Human
ucucccgucagggcccaagucc

SEQ ID NO: 2627779 - RNA, 20 nt, Human
ucucccgucagggcccaagu

SEQ ID NO: 2627780 - RNA, 13 nt, Human
ucucccgucaggg

SEQ ID NO: 2627781 - RNA, 16 nt, Human
ucucccgguucuucca

SEQ ID NO: 2627782 - RNA, 15 nt, Human
ucucccgguucuucc

SEQ ID NO: 2627783 - RNA, 17 nt, Human
ucucccucucacugucu

SEQ ID NO: 2627784 - RNA, 12 nt, Human
ucucccucucac

SEQ ID NO: 2627785 - RNA, 23 nt, Human
ucucccucucacugucugagagu

SEQ ID NO: 2627786 - RNA, 14 nt, Human
ucucccucuccugc

SEQ ID NO: 2627787 - RNA, 15 nt, Human
ucucccucuccugcc

SEQ ID NO: 2627788 - RNA, 16 nt, Human
ucucccucuccugccu

SEQ ID NO: 2627789 - RNA, 17 nt, Human
ucucccucuccugccua

SEQ ID NO: 2627790 - RNA, 18 nt, Human
ucucccucuccugccuac

SEQ ID NO: 2627791 - RNA, 16 nt, Human
ucucccucuggaucaa

SEQ ID NO: 2627792 - RNA, 21 nt, Human
ucucccucuccugccuacuca

SEQ ID NO: 2627793 - RNA, 12 nt, Human
ucucccucuggc

SEQ ID NO: 2627794 - RNA, 14 nt, Human
ucucccucuggccc

SEQ ID NO: 2627795 - RNA, 15 nt, Human
ucucccucuggcccu

SEQ ID NO: 2627796 - RNA, 16 nt, Human
ucucccucuggcccug

SEQ ID NO: 2627797 - RNA, 17 nt, Human
ucucccucuggcccugc

SEQ ID NO: 2627798 - RNA, 18 nt, Human
ucucccucuggcccugcc

SEQ ID NO: 2627799 - RNA, 20 nt, Human
ucucccucuggcccugccuu

SEQ ID NO: 2627800 - RNA, 16 nt, Human
ucuccucuuuuaucuu

SEQ ID NO: 2627801 - RNA, 21 nt, Human
ucuccucuuguaaauaaagcc

SEQ ID NO: 2627802 - RNA, 23 nt, Human
ucuccucuuguaaauaaagcccu

SEQ ID NO: 2627803 - RNA, 16 nt, Human
ucuccugacccagucc

SEQ ID NO: 2627804 - RNA, 22 nt, Human
ucucccucuucucaagugccuu

SEQ ID NO: 2627805 - RNA, 21 nt, Human
ucucccucuucucaagugccu

SEQ ID NO: 2627806 - RNA, 15 nt, Human
ucucccucuucucaa

SEQ ID NO: 2627807 - RNA, 19 nt, Human
ucucccucuggcccugccu

SEQ ID NO: 2627808 - RNA, 15 nt, Human
ucucccugacccugu

SEQ ID NO: 2627809 - RNA, 22 nt, Human
ucuccucuugccacugccucuu

SEQ ID NO: 2627810 - RNA, 13 nt, Human
ucuccucuuguaa

SEQ ID NO: 2627811 - RNA, 15 nt, Human
ucuccucuuguaaau

SEQ ID NO: 2627812 - RNA, 14 nt, Human
ucuccucuuguaaa

SEQ ID NO: 2627813 - RNA, 22 nt, Human
ucuaaaucuccaaaauaaaacu

SEQ ID NO: 2627814 - RNA, 13 nt, Human
ucuaaaugaagug

SEQ ID NO: 2627815 - RNA, 17 nt, Human
ucuaaauuugaauguua

SEQ ID NO: 2627816 - RNA, 13 nt, Human
ucuaaauuugaau

SEQ ID NO: 2627817 - RNA, 13 nt, Human
ucuaaauugaaua

SEQ ID NO: 2627818 - RNA, 23 nt, Human
ucuaaaugggaaaguauucugua

SEQ ID NO: 2627819 - RNA, 14 nt, Human
ucuaaaugcauauc

SEQ ID NO: 2627820 - RNA, 23 nt, Human
ucuaaaugcauauccugagccau

SEQ ID NO: 2627821 - RNA, 23 nt, Human
ucuaaauuugaauguuaagcaga

SEQ ID NO: 2627822 - RNA, 22 nt, Human
ucuaaauuugaauguuaagcag

SEQ ID NO: 2627823 - RNA, 21 nt, Human
ucuaacccucccauggcaccu

SEQ ID NO: 2627824 - RNA, 20 nt, Human
ucuaacccucccauggcacc

SEQ ID NO: 2627825 - RNA, 15 nt, Human
ucuaacccucccaug

SEQ ID NO: 2627826 - RNA, 14 nt, Human
ucuaacccucccau

SEQ ID NO: 2627827 - RNA, 17 nt, Human
ucuaaccccaggccccg

SEQ ID NO: 2627828 - RNA, 17 nt, Human
ucuaaauugaauaaugg

SEQ ID NO: 2627829 - RNA, 23 nt, Human
ucuaacccuaggcaucacaugcu

SEQ ID NO: 2627830 - RNA, 19 nt, Human
ucuaacaaaaaaauauauu

SEQ ID NO: 2627831 - RNA, 15 nt, Human
ucuaaauugaauaau

SEQ ID NO: 2627832 - RNA, 14 nt, Human
ucuaaauugaauaa

SEQ ID NO: 2627833 - RNA, 16 nt, Human
ucuaaccccaggcccc

SEQ ID NO: 2627834 - RNA, 21 nt, Human
ucuacacuaagagagaaugag

SEQ ID NO: 2627835 - RNA, 22 nt, Human
ucuaacuucaccauauuaccac

SEQ ID NO: 2627836 - RNA, 15 nt, Human
ucuaacuucaccaua

SEQ ID NO: 2627837 - RNA, 16 nt, Human
ucuaacuucaccauau

SEQ ID NO: 2627838 - RNA, 15 nt, Human
ucuaaccugauggca

SEQ ID NO: 2627839 - RNA, 14 nt, Human
ucuaaccugugacc

SEQ ID NO: 2627840 - RNA, 13 nt, Human
ucuaaccucaucu

SEQ ID NO: 2627841 - RNA, 18 nt, Human
ucuaaccucaucuucuuc

SEQ ID NO: 2627842 - RNA, 20 nt, Human
ucuaaccucaucuucuucac

SEQ ID NO: 2627843 - RNA, 13 nt, Human
ucuaacucagcaa

SEQ ID NO: 2627844 - RNA, 19 nt, Human
ucuaacuagaaaucugcca

SEQ ID NO: 2627845 - RNA, 15 nt, Human
ucuaacucagaaaca

SEQ ID NO: 2627846 - RNA, 17 nt, Human
ucuagaacacaggcaaa

SEQ ID NO: 2627847 - RNA, 15 nt, Human
ucuacucuuuuuguu

SEQ ID NO: 2627848 - RNA, 22 nt, Human
ucuacucuuaaguuucucagcu

SEQ ID NO: 2627849 - RNA, 21 nt, Human
ucuacucuuaaguuucucagc

SEQ ID NO: 2627850 - RNA, 13 nt, Human
ucuacacugugaa

SEQ ID NO: 2627851 - RNA, 14 nt, Human
ucuacacugugaac

SEQ ID NO: 2627852 - RNA, 22 nt, Human
ucuacugaggugcuauguucuu

SEQ ID NO: 2627853 - RNA, 19 nt, Human
ucuagaacaucccugccag

SEQ ID NO: 2627854 - RNA, 20 nt, Human
ucuagaacaucccugccagc

SEQ ID NO: 2627855 - RNA, 18 nt, Human
ucuagaacuugacccccu

SEQ ID NO: 2627856 - RNA, 20 nt, Human
ucuagaagacugucagcuuc

SEQ ID NO: 2627857 - RNA, 21 nt, Human
ucuagaagacugucagcuucc

SEQ ID NO: 2627858 - RNA, 21 nt, Human
ucuagaagccaagggaaaggg

SEQ ID NO: 2627859 - RNA, 20 nt, Human
ucuagaagccaagggaaagg

SEQ ID NO: 2627860 - RNA, 17 nt, Human
ucuagaagccaagggaa

SEQ ID NO: 2627861 - RNA, 21 nt, Human
ucuagaacaucccugccagcu

SEQ ID NO: 2627862 - RNA, 16 nt, Human
ucuagggaccccuccu

SEQ ID NO: 2627863 - RNA, 15 nt, Human
ucuagggaccccucc

SEQ ID NO: 2627864 - RNA, 17 nt, Human
ucuagggaaaugaaaga

SEQ ID NO: 2627865 - RNA, 19 nt, Human
ucuagggaaaaaccagcgu

SEQ ID NO: 2627866 - RNA, 19 nt, Human
ucuagaauuuaucacacuu

SEQ ID NO: 2627867 - RNA, 13 nt, Human
ucuagggaaauga

SEQ ID NO: 2627868 - RNA, 20 nt, Human
ucuagaaguuguuugucauc

SEQ ID NO: 2627869 - RNA, 16 nt, Human
ucuagaaguuguuugu

SEQ ID NO: 2627870 - RNA, 23 nt, Human
ucuagaagccaagggaaaggggu

SEQ ID NO: 2627871 - RNA, 20 nt, Human
ucuagaauguguuuucugaa

SEQ ID NO: 2627872 - RNA, 22 nt, Human
ucuagggaaaaaccagcgugug

SEQ ID NO: 2627873 - RNA, 15 nt, Human
ucuacacugugcuga

SEQ ID NO: 2627874 - RNA, 21 nt, Human
ucuacacugugcugagucuga

SEQ ID NO: 2627875 - RNA, 18 nt, Human
ucuacugaggugcuaugu

SEQ ID NO: 2627876 - RNA, 19 nt, Human
ucuacugaggugcuauguu

SEQ ID NO: 2627877 - RNA, 14 nt, Human
ucuacacugugcug

SEQ ID NO: 2627878 - RNA, 12 nt, Human
ucuacacugugc

SEQ ID NO: 2627879 - RNA, 17 nt, Human
ucuacacuccagugaga

SEQ ID NO: 2627880 - RNA, 15 nt, Human
ucuacacucaucuua

SEQ ID NO: 2627881 - RNA, 17 nt, Human
ucucacucugucgccca

SEQ ID NO: 2627882 - RNA, 16 nt, Human
ucucacucugucgccc

SEQ ID NO: 2627883 - RNA, 22 nt, Human
ucucacucugucgcccagucug

SEQ ID NO: 2627884 - RNA, 18 nt, Human
ucucacucugucgcccag

SEQ ID NO: 2627885 - RNA, 21 nt, Human
ucucacuguugcccaggcugg

SEQ ID NO: 2627886 - RNA, 20 nt, Human
ucucacuguugcccaggcug

SEQ ID NO: 2627887 - RNA, 19 nt, Human
ucucacuguugcccaggcu

SEQ ID NO: 2627888 - RNA, 18 nt, Human
ucucacuguugcccaggc

SEQ ID NO: 2627889 - RNA, 20 nt, Human
ucucagggucucugcugccg

SEQ ID NO: 2627890 - RNA, 18 nt, Human
ucucagggucucugcugc

SEQ ID NO: 2627891 - RNA, 17 nt, Human
ucucagggucucugcug

SEQ ID NO: 2627892 - RNA, 16 nt, Human
ucucagggucucugcu

SEQ ID NO: 2627893 - RNA, 15 nt, Human
ucucagggucucugc

SEQ ID NO: 2627894 - RNA, 17 nt, Human
ucucaggggcuguuuga

SEQ ID NO: 2627895 - RNA, 16 nt, Human
ucucaggggcuguuug

SEQ ID NO: 2627896 - RNA, 20 nt, Human
ucucaggggccagaggaacu

SEQ ID NO: 2627897 - RNA, 17 nt, Human
ucucaggggccagagga

SEQ ID NO: 2627898 - RNA, 23 nt, Human
ucucagggcuccugccuucuguc

SEQ ID NO: 2627899 - RNA, 17 nt, Human
ucucagggcuccugccu

SEQ ID NO: 2627900 - RNA, 20 nt, Human
ucucagaaucuacccaaagg

SEQ ID NO: 2627901 - RNA, 19 nt, Human
ucucagaaucuacccaaag

SEQ ID NO: 2627902 - RNA, 16 nt, Human
ucucagggcuccugcc

SEQ ID NO: 2627903 - RNA, 13 nt, Human
ucucagggcuccu

SEQ ID NO: 2627904 - RNA, 17 nt, Human
ucucagaaucucaaaua

SEQ ID NO: 2627905 - RNA, 21 nt, Human
ucucagaaucucaaauaacua

SEQ ID NO: 2627906 - RNA, 19 nt, Human
ucucagaaggcaaaugacu

SEQ ID NO: 2627907 - RNA, 20 nt, Human
ucucagaaggcaaaugacuu

SEQ ID NO: 2627908 - RNA, 21 nt, Human
ucucagaaggcaaaugacuuu

SEQ ID NO: 2627909 - RNA, 22 nt, Human
ucucagaaggcaaaugacuuug

SEQ ID NO: 2627910 - RNA, 18 nt, Human
ucucagaagggaggcugg

SEQ ID NO: 2627911 - RNA, 15 nt, Human
ucucagaagggaggc

SEQ ID NO: 2627912 - RNA, 14 nt, Human
ucucagaagggagg

SEQ ID NO: 2627913 - RNA, 13 nt, Human
ucucagaagggag

SEQ ID NO: 2627914 - RNA, 12 nt, Human
ucucagaaucua

SEQ ID NO: 2627915 - RNA, 19 nt, Human
ucucagaagguauuccuuu

SEQ ID NO: 2627916 - RNA, 20 nt, Human
ucucacuuuucuccaugagu

SEQ ID NO: 2627917 - RNA, 15 nt, Human
ucucacuuuucucca

SEQ ID NO: 2627918 - RNA, 17 nt, Human
ucucacuuuucuccaug

SEQ ID NO: 2627919 - RNA, 13 nt, Human
ucucacuuguuuc

SEQ ID NO: 2627920 - RNA, 13 nt, Human
ucucacuugugcc

SEQ ID NO: 2627921 - RNA, 23 nt, Human
ucucaaccuaccaccccuuccug

SEQ ID NO: 2627922 - RNA, 17 nt, Human
ucucacuguugcccagg

SEQ ID NO: 2627923 - RNA, 21 nt, Human
ucucaaauuuggauugcuaau

SEQ ID NO: 2627924 - RNA, 14 nt, Human
ucucaaacuggggc

SEQ ID NO: 2627925 - RNA, 19 nt, Human
ucucaacaaagcacagugu

SEQ ID NO: 2627926 - RNA, 21 nt, Human
ucucaacaaagcacaguguua

SEQ ID NO: 2627927 - RNA, 22 nt, Human
ucucaaccuaccaccccuuccu

SEQ ID NO: 2627928 - RNA, 21 nt, Human
ucucaaccuaccaccccuucc

SEQ ID NO: 2627929 - RNA, 23 nt, Human
ucucaacccuuuugucugccucu

SEQ ID NO: 2627930 - RNA, 21 nt, Human
ucucaacccuuuugucugccu

SEQ ID NO: 2627931 - RNA, 17 nt, Human
ucucaaccaccuuucag

SEQ ID NO: 2627932 - RNA, 17 nt, Human
ucucaacccaggagcau

SEQ ID NO: 2627933 - RNA, 13 nt, Human
ucucaaccauccc

SEQ ID NO: 2627934 - RNA, 21 nt, Human
ucucaaacucuugaccucagg

SEQ ID NO: 2627935 - RNA, 13 nt, Human
ucucaaacucuug

SEQ ID NO: 2627936 - RNA, 22 nt, Human
ucucaaacucuugaccucaggu

SEQ ID NO: 2627937 - RNA, 22 nt, Human
ucuaguacuugggagaccugua

SEQ ID NO: 2627938 - RNA, 18 nt, Human
ucuaggguuauugcauuu

SEQ ID NO: 2627939 - RNA, 19 nt, Human
ucuaggggucaggcuccau

SEQ ID NO: 2627940 - RNA, 18 nt, Human
ucuagggaccccuccucc

SEQ ID NO: 2627941 - RNA, 17 nt, Human
ucuagggaccccuccuc

SEQ ID NO: 2627942 - RNA, 20 nt, Human
ucuagggaccccuccucccu

SEQ ID NO: 2627943 - RNA, 17 nt, Human
ucuagggagagacccuu

SEQ ID NO: 2627944 - RNA, 22 nt, Human
ucucaaacacaguuacacuugu

SEQ ID NO: 2627945 - RNA, 19 nt, Human
ucucaaacacaguuacacu

SEQ ID NO: 2627946 - RNA, 13 nt, Human
ucucaaacacagu

SEQ ID NO: 2627947 - RNA, 19 nt, Human
ucuaguccuauucuauugc

SEQ ID NO: 2627948 - RNA, 16 nt, Human
ucuaguccuauucuau

SEQ ID NO: 2627949 - RNA, 24 nt, Human
ucuaguauuccagaccugaagaau

SEQ ID NO: 2627950 - RNA, 20 nt, Human
ucucaaaccaagcaaaggaa

SEQ ID NO: 2627951 - RNA, 23 nt, Human
ucucaaacacaguuacacuugug

SEQ ID NO: 2627952 - RNA, 19 nt, Human
ucucaaaccuguuuaaaua

SEQ ID NO: 2627953 - RNA, 23 nt, Human
ucucaaaccuugaugugccugug

SEQ ID NO: 2627954 - RNA, 23 nt, Human
ucucaaaccuguuuaaauauuuc

SEQ ID NO: 2627955 - RNA, 14 nt, Human
ucucaaacuccuga

SEQ ID NO: 2627956 - RNA, 19 nt, Human
uccugguggguccaggggc

SEQ ID NO: 2627957 - RNA, 17 nt, Human
uccugguggguccaggg

SEQ ID NO: 2627958 - RNA, 22 nt, Human
uccugguggguccaggggcccc

SEQ ID NO: 2627959 - RNA, 16 nt, Human
uccugguggguccagg

SEQ ID NO: 2627960 - RNA, 20 nt, Human
uccuggugcucucugccacu

SEQ ID NO: 2627961 - RNA, 19 nt, Human
uccuggugcucucugccac

SEQ ID NO: 2627962 - RNA, 18 nt, Human
uccuggugcucucugcca

SEQ ID NO: 2627963 - RNA, 16 nt, Human
uccuggugcucucugc

SEQ ID NO: 2627964 - RNA, 21 nt, Human
uccuggugucacuuacuguuu

SEQ ID NO: 2627965 - RNA, 14 nt, Human
uccuggugucacuu

SEQ ID NO: 2627966 - RNA, 15 nt, Human
uccugguguggaaga

SEQ ID NO: 2627967 - RNA, 15 nt, Human
uccuguauucacccg

SEQ ID NO: 2627968 - RNA, 13 nt, Human
uccuguauguugu

SEQ ID NO: 2627969 - RNA, 23 nt, Human
uccuguaguugcguggacucugc

SEQ ID NO: 2627970 - RNA, 22 nt, Human
uccuguaguugcguggacucug

SEQ ID NO: 2627971 - RNA, 21 nt, Human
uccuguaguugcguggacucu

SEQ ID NO: 2627972 - RNA, 14 nt, Human
uccuggugugaagg

SEQ ID NO: 2627973 - RNA, 23 nt, Human
uccugguucccguuucuccaccu

SEQ ID NO: 2627974 - RNA, 21 nt, Human
uccugguucccguuucuccac

SEQ ID NO: 2627975 - RNA, 15 nt, Human
uccugguucccguuu

SEQ ID NO: 2627976 - RNA, 22 nt, Human
uccuguaaaaaaaaaaaaguua

SEQ ID NO: 2627977 - RNA, 19 nt, Human
uccuguaaagguuacaagc

SEQ ID NO: 2627978 - RNA, 22 nt, Human
uccuggcaugggaaugaauguc

SEQ ID NO: 2627979 - RNA, 10 nt, Human
ucccucccuu

SEQ ID NO: 2627980 - RNA, 17 nt, Human
uccuggcaguuuaaaaa

SEQ ID NO: 2627981 - RNA, 20 nt, Human
uccuggcaguuuaaaaaaau

SEQ ID NO: 2627982 - RNA, 11 nt, Human
uccuggccauc

SEQ ID NO: 2627983 - RNA, 14 nt, Human
uccuggccauccca

SEQ ID NO: 2627984 - RNA, 17 nt, Human
uccuggcccacugcauc

SEQ ID NO: 2627985 - RNA, 20 nt, Human
uccuggccaucccacaagug

SEQ ID NO: 2627986 - RNA, 15 nt, Human
uccuggccaucccac

SEQ ID NO: 2627987 - RNA, 16 nt, Human
uccuggccaucccaca

SEQ ID NO: 2627988 - RNA, 20 nt, Human
uccuggugccaauuucaagu

SEQ ID NO: 2627989 - RNA, 17 nt, Human
uccuggucuugagaugu

SEQ ID NO: 2627990 - RNA, 14 nt, Human
uccuggugcucucu

SEQ ID NO: 2627991 - RNA, 15 nt, Human
uccuggugcucucug

SEQ ID NO: 2627992 - RNA, 21 nt, Human
uccuggugccaauuucaaguu

SEQ ID NO: 2627993 - RNA, 20 nt, Human
uccuggucuugagaugucuu

SEQ ID NO: 2627994 - RNA, 16 nt, Human
uccuucuuguaguagu

SEQ ID NO: 2627995 - RNA, 17 nt, Human
uccuucuugccuucaga

SEQ ID NO: 2627996 - RNA, 12 nt, Human
uccuucugccuu

SEQ ID NO: 2627997 - RNA, 16 nt, Human
uccuugaucuguauau

SEQ ID NO: 2627998 - RNA, 22 nt, Human
uccuugaucuguauauacaaua

SEQ ID NO: 2627999 - RNA, 23 nt, Human
uccuugauuuuagccuucucugu

SEQ ID NO: 2628000 - RNA, 21 nt, Human
uccuugcacacuccccugcac

SEQ ID NO: 2628001 - RNA, 22 nt, Human
uccuugauuuuagccuucucug

SEQ ID NO: 2628002 - RNA, 15 nt, Human
uccuugcaucaauuu

SEQ ID NO: 2628003 - RNA, 20 nt, Human
uccuugcaccccucacucug

SEQ ID NO: 2628004 - RNA, 15 nt, Human
uccuugcaccccuca

SEQ ID NO: 2628005 - RNA, 14 nt, Human
uccuugcaccccuc

SEQ ID NO: 2628006 - RNA, 22 nt, Human
uccuugcacacuccccugcacu

SEQ ID NO: 2628007 - RNA, 22 nt, Human
uccuugcaccccucacucuggc

SEQ ID NO: 2628008 - RNA, 21 nt, Human
uccuugcaccccucacucugg

SEQ ID NO: 2628009 - RNA, 24 nt, Human
uccuugcaccccucacucuggccu

SEQ ID NO: 2628010 - RNA, 14 nt, Human
uccuugcaccugca

SEQ ID NO: 2628011 - RNA, 15 nt, Human
uccuucugccuuuuu

SEQ ID NO: 2628012 - RNA, 20 nt, Human
uccuucaagaucauguaccc

SEQ ID NO: 2628013 - RNA, 18 nt, Human
uccuucugccugagcuuc

SEQ ID NO: 2628014 - RNA, 20 nt, Human
uccuucugugaaaguacauu

SEQ ID NO: 2628015 - RNA, 19 nt, Human
uccuucuguccuacucugu

SEQ ID NO: 2628016 - RNA, 12 nt, Human
uccuucuguccu

SEQ ID NO: 2628017 - RNA, 18 nt, Human
uccuucaaguuagcucag

SEQ ID NO: 2628018 - RNA, 19 nt, Human
uccuucaaguuagcucagg

SEQ ID NO: 2628019 - RNA, 20 nt, Human
uccuucaaguuagcucagga

SEQ ID NO: 2628020 - RNA, 23 nt, Human
uccuucaaguuagcucaggaggc

SEQ ID NO: 2628021 - RNA, 19 nt, Human
uccuucaagaacucugggc

SEQ ID NO: 2628022 - RNA, 20 nt, Human
uccuucaagaacucugggcu

SEQ ID NO: 2628023 - RNA, 21 nt, Human
uccuucaagaacucugggcug

SEQ ID NO: 2628024 - RNA, 23 nt, Human
uccuucaagaacucugggcugcu

SEQ ID NO: 2628025 - RNA, 21 nt, Human
uccuuacaaguuagaaaacau

SEQ ID NO: 2628026 - RNA, 22 nt, Human
uccuuacaaguuagaaaacaua

SEQ ID NO: 2628027 - RNA, 14 nt, Human
uccuuaccagcaga

SEQ ID NO: 2628028 - RNA, 16 nt, Human
uccuucaaagcaaaug

SEQ ID NO: 2628029 - RNA, 22 nt, Human
uccuuauguauauuuaaaagaa

SEQ ID NO: 2628030 - RNA, 12 nt, Human
uccugucagugc

SEQ ID NO: 2628031 - RNA, 14 nt, Human
uccugucagugccg

SEQ ID NO: 2628032 - RNA, 13 nt, Human
uccugucagugcc

SEQ ID NO: 2628033 - RNA, 17 nt, Human
uccuuaauccagcugau

SEQ ID NO: 2628034 - RNA, 19 nt, Human
uccuuaauucacucccaca

SEQ ID NO: 2628035 - RNA, 18 nt, Human
uccuuaauucacucccac

SEQ ID NO: 2628036 - RNA, 17 nt, Human
uccuuaauucacuccca

SEQ ID NO: 2628037 - RNA, 14 nt, Human
uccuuaaugauccg

SEQ ID NO: 2628038 - RNA, 13 nt, Human
ucgccaugccggg

SEQ ID NO: 2628039 - RNA, 21 nt, Human
ucgcagagaggccaggugcag

SEQ ID NO: 2628040 - RNA, 19 nt, Human
ucgcagagaggccaggugc

SEQ ID NO: 2628041 - RNA, 14 nt, Human
ucgcagagaggcca

SEQ ID NO: 2628042 - RNA, 12 nt, Human
ucgcagagaggc

SEQ ID NO: 2628043 - RNA, 17 nt, Human
ucgcaccauucugacuc

SEQ ID NO: 2628044 - RNA, 12 nt, Human
ucgcaccuacca

SEQ ID NO: 2628045 - RNA, 18 nt, Human
ucgcaccuaccaucaggg

SEQ ID NO: 2628046 - RNA, 17 nt, Human
ucgauuuuguaucugca

SEQ ID NO: 2628047 - RNA, 13 nt, Human
ucgauuuuguauc

SEQ ID NO: 2628048 - RNA, 15 nt, Human
ucgauuucuccagga

SEQ ID NO: 2628049 - RNA, 17 nt, Human
ucgcaauguaagacucg

SEQ ID NO: 2628050 - RNA, 16 nt, Human
ucgcaccauucugacu

SEQ ID NO: 2628051 - RNA, 16 nt, Human
ucgcacagucucucuc

SEQ ID NO: 2628052 - RNA, 21 nt, Human
ucgcaccacuguguauuuaac

SEQ ID NO: 2628053 - RNA, 14 nt, Human
ucgcacagucucuc

SEQ ID NO: 2628054 - RNA, 13 nt, Human
ucgcacagucucu

SEQ ID NO: 2628055 - RNA, 13 nt, Human
ucgcaagcugggu

SEQ ID NO: 2628056 - RNA, 12 nt, Human
ucgcccaggcug

SEQ ID NO: 2628057 - RNA, 14 nt, Human
ucgcccaggcugga

SEQ ID NO: 2628058 - RNA, 21 nt, Human
ucgcccaccgcaugcccccuc

SEQ ID NO: 2628059 - RNA, 16 nt, Human
ucgcccaccgcaugcc

SEQ ID NO: 2628060 - RNA, 11 nt, Human
ucgcccaggag

SEQ ID NO: 2628061 - RNA, 14 nt, Human
ucgccaugccgggg

SEQ ID NO: 2628062 - RNA, 17 nt, Human
ucgcccaaagccagaca

SEQ ID NO: 2628063 - RNA, 14 nt, Human
ucgcccaccgcaug

SEQ ID NO: 2628064 - RNA, 18 nt, Human
ucgcccaaagccagacag

SEQ ID NO: 2628065 - RNA, 19 nt, Human
ucgcccaggcuggagugca

SEQ ID NO: 2628066 - RNA, 22 nt, Human
ucgcccaccgcaugcccccucg

SEQ ID NO: 2628067 - RNA, 12 nt, Human
ucgcccaggaga

SEQ ID NO: 2628068 - RNA, 17 nt, Human
ucgcuucuugccucugu

SEQ ID NO: 2628069 - RNA, 20 nt, Human
ucggaacccaagcuuagaac

SEQ ID NO: 2628070 - RNA, 19 nt, Human
ucggaacccaagcuuagaa

SEQ ID NO: 2628071 - RNA, 18 nt, Human
ucggaacugcaugcugcu

SEQ ID NO: 2628072 - RNA, 22 nt, Human
ucggaacugcaugcugcuggac

SEQ ID NO: 2628073 - RNA, 13 nt, Human
ucggaagcagugc

SEQ ID NO: 2628074 - RNA, 23 nt, Human
ucggacuaagccuaccugcucuc

SEQ ID NO: 2628075 - RNA, 22 nt, Human
ucggacuaagccuaccugcucu

SEQ ID NO: 2628076 - RNA, 19 nt, Human
ucggacuaagccuaccugc

SEQ ID NO: 2628077 - RNA, 17 nt, Human
ucggaccuuucagcugu

SEQ ID NO: 2628078 - RNA, 10 nt, Human
ucggaccagc

SEQ ID NO: 2628079 - RNA, 19 nt, Human
ucggaaggcuggcugggca

SEQ ID NO: 2628080 - RNA, 15 nt, Human
ucggaagcagugccu

SEQ ID NO: 2628081 - RNA, 16 nt, Human
ucggaagcagugccuu

SEQ ID NO: 2628082 - RNA, 22 nt, Human
ucggaagcagugccuuccauaa

SEQ ID NO: 2628083 - RNA, 23 nt, Human
ucggaagcagugccuuccauaau

SEQ ID NO: 2628084 - RNA, 16 nt, Human
ucgcuucuugccucug

SEQ ID NO: 2628085 - RNA, 15 nt, Human
ucgcuucuugccucu

SEQ ID NO: 2628086 - RNA, 14 nt, Human
ucgcuucuugccuc

SEQ ID NO: 2628087 - RNA, 15 nt, Human
ucgcuuccgcauccu

SEQ ID NO: 2628088 - RNA, 15 nt, Human
ucgcuucccccauag

SEQ ID NO: 2628089 - RNA, 16 nt, Human
ucgcuucccccauagc

SEQ ID NO: 2628090 - RNA, 17 nt, Human
ucgcuucccccauagcc

SEQ ID NO: 2628091 - RNA, 19 nt, Human
ucgcuucccccauagccac

SEQ ID NO: 2628092 - RNA, 21 nt, Human
ucgcuguguguuaguucccaa

SEQ ID NO: 2628093 - RNA, 13 nt, Human
ucgcuguguguua

SEQ ID NO: 2628094 - RNA, 14 nt, Human
ucgcuguugcugaa

SEQ ID NO: 2628095 - RNA, 12 nt, Human
ucgcuguugcug

SEQ ID NO: 2628096 - RNA, 17 nt, Human
ucgcuguugcugaauag

SEQ ID NO: 2628097 - RNA, 15 nt, Human
ucgcuguugcugaau

SEQ ID NO: 2628098 - RNA, 16 nt, Human
ucgcuucauguaacua

SEQ ID NO: 2628099 - RNA, 14 nt, Human
ucgcuucccccaua

SEQ ID NO: 2628100 - RNA, 20 nt, Human
uccuuuuuaaauucaguccu

SEQ ID NO: 2628101 - RNA, 18 nt, Human
uccuuuuguguacagugu

SEQ ID NO: 2628102 - RNA, 13 nt, Human
uccuuuugcuuga

SEQ ID NO: 2628103 - RNA, 17 nt, Human
uccuuuuguguacagug

SEQ ID NO: 2628104 - RNA, 23 nt, Human
uccuuuuggagucagacagaugu

SEQ ID NO: 2628105 - RNA, 14 nt, Human
uccuuuuggaguca

SEQ ID NO: 2628106 - RNA, 14 nt, Human
uccuuggggcaggc

SEQ ID NO: 2628107 - RNA, 15 nt, Human
uccuuggggcaggca

SEQ ID NO: 2628108 - RNA, 17 nt, Human
uccuugggcacuuuuua

SEQ ID NO: 2628109 - RNA, 13 nt, Human
uccuugggcacuu

SEQ ID NO: 2628110 - RNA, 13 nt, Human
uccuugggcccuu

SEQ ID NO: 2628111 - RNA, 14 nt, Human
uccuugggcccuuu

SEQ ID NO: 2628112 - RNA, 16 nt, Human
uccuugggcccuuuga

SEQ ID NO: 2628113 - RNA, 22 nt, Human
uccuugggaggaagcagaauaa

SEQ ID NO: 2628114 - RNA, 21 nt, Human
uccuugggaggaagcagaaua

SEQ ID NO: 2628115 - RNA, 20 nt, Human
uccuugggaggaagcagaau

SEQ ID NO: 2628116 - RNA, 19 nt, Human
uccuugggaggaagcagaa

SEQ ID NO: 2628117 - RNA, 23 nt, Human
uccuugggaggaagcagaauaaa

SEQ ID NO: 2628118 - RNA, 20 nt, Human
uccuugggaggccccacugg

SEQ ID NO: 2628119 - RNA, 21 nt, Human
uccuugggaggccccacuggg

SEQ ID NO: 2628120 - RNA, 22 nt, Human
uccuugggaggccccacugggg

SEQ ID NO: 2628121 - RNA, 18 nt, Human
uccuugggaggaagcaga

SEQ ID NO: 2628122 - RNA, 17 nt, Human
uccuugggaggaagcag

SEQ ID NO: 2628123 - RNA, 16 nt, Human
uccuugggaggaagca

SEQ ID NO: 2628124 - RNA, 15 nt, Human
uccuugggaggaagc

SEQ ID NO: 2628125 - RNA, 15 nt, Human
uccuuggcuggugca

SEQ ID NO: 2628126 - RNA, 14 nt, Human
uccuugggaggaag

SEQ ID NO: 2628127 - RNA, 20 nt, Human
uccuuggcucccauucacuc

SEQ ID NO: 2628128 - RNA, 17 nt, Human
uccuugcaccugcaucc

SEQ ID NO: 2628129 - RNA, 17 nt, Human
ucgaguuacagacaaag

SEQ ID NO: 2628130 - RNA, 17 nt, Human
ucgauucauauugaaua

SEQ ID NO: 2628131 - RNA, 14 nt, Human
ucgauacugcgacu

SEQ ID NO: 2628132 - RNA, 15 nt, Human
ucgaguuacagacaa

SEQ ID NO: 2628133 - RNA, 14 nt, Human
uccuuuuucucccu

SEQ ID NO: 2628134 - RNA, 13 nt, Human
uccuuuuuguuau

SEQ ID NO: 2628135 - RNA, 19 nt, Human
uccuuuuucuuuauaaacu

SEQ ID NO: 2628136 - RNA, 20 nt, Human
uccuuuuucucccucuggau

SEQ ID NO: 2628137 - RNA, 14 nt, Human
uccuuuuucuuuau

SEQ ID NO: 2628138 - RNA, 21 nt, Human
uccuuuuuuuccaucuuuaca

SEQ ID NO: 2628139 - RNA, 18 nt, Human
uccuuuuuuauacacaua

SEQ ID NO: 2628140 - RNA, 14 nt, Human
uccuuuuuguuauu

SEQ ID NO: 2628141 - RNA, 16 nt, Human
uccuuuuuuauacaca

SEQ ID NO: 2628142 - RNA, 14 nt, Human
ugaacauuccagag

SEQ ID NO: 2628143 - RNA, 20 nt, Human
ugaacauccuuccuucccac

SEQ ID NO: 2628144 - RNA, 18 nt, Human
ugaacauccuuccuuccc

SEQ ID NO: 2628145 - RNA, 14 nt, Human
ugaacauggacucu

SEQ ID NO: 2628146 - RNA, 17 nt, Human
ugaacauccuuccuucc

SEQ ID NO: 2628147 - RNA, 17 nt, Human
ugaacauauuguugaaa

SEQ ID NO: 2628148 - RNA, 13 nt, Human
ugaacauguacug

SEQ ID NO: 2628149 - RNA, 13 nt, Human
ugaacauuccaga

SEQ ID NO: 2628150 - RNA, 18 nt, Human
ugaacacucaugcugaaa

SEQ ID NO: 2628151 - RNA, 17 nt, Human
ugaacacucaugcugaa

SEQ ID NO: 2628152 - RNA, 18 nt, Human
ugaacacuccaauuaagg

SEQ ID NO: 2628153 - RNA, 19 nt, Human
ugaacacuccaauuaagga

SEQ ID NO: 2628154 - RNA, 22 nt, Human
ugaacacuccaauuaaggauuu

SEQ ID NO: 2628155 - RNA, 23 nt, Human
ugaacacuccaauuaaggauuuu

SEQ ID NO: 2628156 - RNA, 14 nt, Human
ugaacacuggggga

SEQ ID NO: 2628157 - RNA, 16 nt, Human
ugaacacugggggagg

SEQ ID NO: 2628158 - RNA, 17 nt, Human
ugaacacugggggaggg

SEQ ID NO: 2628159 - RNA, 22 nt, Human
ugaacacugggggaggggacau

SEQ ID NO: 2628160 - RNA, 20 nt, Human
ugaacagaaaacauucugau

SEQ ID NO: 2628161 - RNA, 18 nt, Human
ugaacacuggcaacaaca

SEQ ID NO: 2628162 - RNA, 19 nt, Human
ugaacauacuggcugguga

SEQ ID NO: 2628163 - RNA, 17 nt, Human
ugaaaugcucuccuuuc

SEQ ID NO: 2628164 - RNA, 16 nt, Human
ugaaaugcucuccuuu

SEQ ID NO: 2628165 - RNA, 18 nt, Human
ugaaaugcaucauucuug

SEQ ID NO: 2628166 - RNA, 19 nt, Human
ugaaauggacuuuuguaca

SEQ ID NO: 2628167 - RNA, 13 nt, Human
ugaaaugcugcau

SEQ ID NO: 2628168 - RNA, 17 nt, Human
ugaaaugcugcauuuua

SEQ ID NO: 2628169 - RNA, 15 nt, Human
ugaaaugcugcauuu

SEQ ID NO: 2628170 - RNA, 16 nt, Human
ugaaaugcuggcauuu

SEQ ID NO: 2628171 - RNA, 19 nt, Human
ugaacacaaacuguaaaua

SEQ ID NO: 2628172 - RNA, 18 nt, Human
ugaacacacuguguccug

SEQ ID NO: 2628173 - RNA, 15 nt, Human
ugaacacacuguguc

SEQ ID NO: 2628174 - RNA, 14 nt, Human
ugaacacacugugu

SEQ ID NO: 2628175 - RNA, 14 nt, Human
ugaacacaucagcu

SEQ ID NO: 2628176 - RNA, 23 nt, Human
ugaacacacuguguccuggugcu

SEQ ID NO: 2628177 - RNA, 16 nt, Human
ugaacacucaugcuga

SEQ ID NO: 2628178 - RNA, 14 nt, Human
ugaacacucaugcu

SEQ ID NO: 2628179 - RNA, 19 nt, Human
ugaacugauaguuacuguu

SEQ ID NO: 2628180 - RNA, 18 nt, Human
ugaacugauaguuacugu

SEQ ID NO: 2628181 - RNA, 23 nt, Human
ugaacugacaggcagccuggaca

SEQ ID NO: 2628182 - RNA, 21 nt, Human
ugaacugacaggcagccugga

SEQ ID NO: 2628183 - RNA, 16 nt, Human
ugaacugagcuuggaa

SEQ ID NO: 2628184 - RNA, 15 nt, Human
ugaacugauaaagau

SEQ ID NO: 2628185 - RNA, 20 nt, Human
ugaacuggacccuguugcua

SEQ ID NO: 2628186 - RNA, 19 nt, Human
ugaacuggacccuguugcu

SEQ ID NO: 2628187 - RNA, 18 nt, Human
ugaacuggacccuguugc

SEQ ID NO: 2628188 - RNA, 17 nt, Human
ugaacuggacccuguug

SEQ ID NO: 2628189 - RNA, 23 nt, Human
ugaacugauaguuacuguuguga

SEQ ID NO: 2628190 - RNA, 21 nt, Human
ugaacugauaguuacuguugu

SEQ ID NO: 2628191 - RNA, 12 nt, Human
ugaacugagcuu

SEQ ID NO: 2628192 - RNA, 15 nt, Human
ugaacugagcuugga

SEQ ID NO: 2628193 - RNA, 13 nt, Human
ugaacugauaaag

SEQ ID NO: 2628194 - RNA, 17 nt, Human
ugaacugaacucugaca

SEQ ID NO: 2628195 - RNA, 19 nt, Human
ugaacugaacucugacaac

SEQ ID NO: 2628196 - RNA, 13 nt, Human
ugaacugacaggc

SEQ ID NO: 2628197 - RNA, 17 nt, Human
ugaacugaaguuucaca

SEQ ID NO: 2628198 - RNA, 15 nt, Human
ugaacugaaguuuca

SEQ ID NO: 2628199 - RNA, 13 nt, Human
ugaacugaaguuu

SEQ ID NO: 2628200 - RNA, 12 nt, Human
ugaacugaaguu

SEQ ID NO: 2628201 - RNA, 22 nt, Human
ugaaccacaucuugcucugcug

SEQ ID NO: 2628202 - RNA, 15 nt, Human
ugaacucuucaaucu

SEQ ID NO: 2628203 - RNA, 21 nt, Human
ugaaccacaucuugcucugcu

SEQ ID NO: 2628204 - RNA, 20 nt, Human
ugaaccacaucuugcucugc

SEQ ID NO: 2628205 - RNA, 19 nt, Human
ugaacucuuagaaaugaag

SEQ ID NO: 2628206 - RNA, 12 nt, Human
ugaacucuuaga

SEQ ID NO: 2628207 - RNA, 21 nt, Human
ugaacucuuaaucaaauagca

SEQ ID NO: 2628208 - RNA, 18 nt, Human
ugaacucuucaaucucuu

SEQ ID NO: 2628209 - RNA, 20 nt, Human
ugaacucuuugaaugacaaa

SEQ ID NO: 2628210 - RNA, 19 nt, Human
ugaacucuuugaaugacaa

SEQ ID NO: 2628211 - RNA, 17 nt, Human
ugaacucuuugaaugac

SEQ ID NO: 2628212 - RNA, 14 nt, Human
ugaacugaacucug

SEQ ID NO: 2628213 - RNA, 16 nt, Human
ugaagacagagcuaca

SEQ ID NO: 2628214 - RNA, 14 nt, Human
ugaagacagagcua

SEQ ID NO: 2628215 - RNA, 22 nt, Human
ugaacuuguaaaggaauuuaaa

SEQ ID NO: 2628216 - RNA, 12 nt, Human
ugaacuugguuc

SEQ ID NO: 2628217 - RNA, 14 nt, Human
ugaacuuggcgcug

SEQ ID NO: 2628218 - RNA, 19 nt, Human
ugaacuggguacuugugga

SEQ ID NO: 2628219 - RNA, 22 nt, Human
ugaacuggacccuguugcuaag

SEQ ID NO: 2628220 - RNA, 21 nt, Human
ugaacuggacccuguugcuaa

SEQ ID NO: 2628221 - RNA, 23 nt, Human
ugaacuggacccuguugcuaagc

SEQ ID NO: 2628222 - RNA, 14 nt, Human
ugaacugggaccuu

SEQ ID NO: 2628223 - RNA, 18 nt, Human
ugaagacuggaagcuaau

SEQ ID NO: 2628224 - RNA, 17 nt, Human
ugaagacuggaagcuaa

SEQ ID NO: 2628225 - RNA, 14 nt, Human
ugaagacuuuucuu

SEQ ID NO: 2628226 - RNA, 12 nt, Human
ugaagacauaaa

SEQ ID NO: 2628227 - RNA, 20 nt, Human
ugaagaccacauccacacac

SEQ ID NO: 2628228 - RNA, 14 nt, Human
ugaagacaggaugg

SEQ ID NO: 2628229 - RNA, 14 nt, Human
ugaagacaggacag

SEQ ID NO: 2628230 - RNA, 14 nt, Human
ugaagacagaggga

SEQ ID NO: 2628231 - RNA, 22 nt, Human
ugaagacuuuucuuucagccaa

SEQ ID NO: 2628232 - RNA, 17 nt, Human
ugaagacuuuucuuuca

SEQ ID NO: 2628233 - RNA, 23 nt, Human
ugaagagaaccgagcaaagauca

SEQ ID NO: 2628234 - RNA, 20 nt, Human
ugaagaggaaaaugaauaau

SEQ ID NO: 2628235 - RNA, 19 nt, Human
ugaagaggaaaaugaauaa

SEQ ID NO: 2628236 - RNA, 13 nt, Human
ugaagaggaaggg

SEQ ID NO: 2628237 - RNA, 22 nt, Human
ugaagaggaaaaugaauaauac

SEQ ID NO: 2628238 - RNA, 18 nt, Human
ugaagaggaucggaggcu

SEQ ID NO: 2628239 - RNA, 17 nt, Human
ugaagaggcgggccagc

SEQ ID NO: 2628240 - RNA, 16 nt, Human
ugaagaggcgggccag

SEQ ID NO: 2628241 - RNA, 15 nt, Human
ugaagaggcgggcca

SEQ ID NO: 2628242 - RNA, 22 nt, Human
ugaaggagccccauuccuggga

SEQ ID NO: 2628243 - RNA, 23 nt, Human
ugaaggagccccauuccugggaa

SEQ ID NO: 2628244 - RNA, 11 nt, Human
ugaaggagccc

SEQ ID NO: 2628245 - RNA, 22 nt, Human
ugaaggagaggcaacauccaaa

SEQ ID NO: 2628246 - RNA, 22 nt, Human
ugaagauggcauccugugaagu

SEQ ID NO: 2628247 - RNA, 20 nt, Human
ugaaggagagcccuucauuu

SEQ ID NO: 2628248 - RNA, 15 nt, Human
ugaagaugcagcuca

SEQ ID NO: 2628249 - RNA, 13 nt, Human
ugaagaugaucau

SEQ ID NO: 2628250 - RNA, 12 nt, Human
ugaagaugaaca

SEQ ID NO: 2628251 - RNA, 18 nt, Human
ugaagauggcauccugug

SEQ ID NO: 2628252 - RNA, 17 nt, Human
ugaagauggcauccugu

SEQ ID NO: 2628253 - RNA, 21 nt, Human
ugaagaugcagcaaaauguga

SEQ ID NO: 2628254 - RNA, 21 nt, Human
ugaagaugcugaaacaggaga

SEQ ID NO: 2628255 - RNA, 21 nt, Human
ugaagauggcauccugugaag

SEQ ID NO: 2628256 - RNA, 19 nt, Human
ugaagauggcauccuguga

SEQ ID NO: 2628257 - RNA, 16 nt, Human
ugaagaugggaacgca

SEQ ID NO: 2628258 - RNA, 15 nt, Human
ugaagaggugagcac

SEQ ID NO: 2628259 - RNA, 16 nt, Human
ugaagaggugagagua

SEQ ID NO: 2628260 - RNA, 20 nt, Human
ugaagaggggcagcccuugc

SEQ ID NO: 2628261 - RNA, 19 nt, Human
ugaagaggggcagcccuug

SEQ ID NO: 2628262 - RNA, 23 nt, Human
ugaagauauaacuauugcccagg

SEQ ID NO: 2628263 - RNA, 15 nt, Human
ugaagauauuuuucc

SEQ ID NO: 2628264 - RNA, 16 nt, Human
ugaagauaucuugaaa

SEQ ID NO: 2628265 - RNA, 21 nt, Human
ugaagauaucuugaaaugaaa

SEQ ID NO: 2628266 - RNA, 22 nt, Human
ugaagaucauauacgugaaaau

SEQ ID NO: 2628267 - RNA, 22 nt, Human
ugaagauaucuugaaaugaaag

SEQ ID NO: 2628268 - RNA, 19 nt, Human
ugaagaucguuaguaucua

SEQ ID NO: 2628269 - RNA, 21 nt, Human
ugaagaggcgggccagccagg

SEQ ID NO: 2628270 - RNA, 20 nt, Human
ugaagaggcgggccagccag

SEQ ID NO: 2628271 - RNA, 19 nt, Human
ugaagaggcgggccagcca

SEQ ID NO: 2628272 - RNA, 18 nt, Human
ugaagaggcgggccagcc

SEQ ID NO: 2628273 - RNA, 23 nt, Human
ugaagaggcgggccagccaggcg

SEQ ID NO: 2628274 - RNA, 18 nt, Human
ugaagagggagaagcaug

SEQ ID NO: 2628275 - RNA, 17 nt, Human
ugaagagggagaaggga

SEQ ID NO: 2628276 - RNA, 18 nt, Human
ugaagaggggcagcccuu

SEQ ID NO: 2628277 - RNA, 17 nt, Human
ugaagaggggcagcccu

SEQ ID NO: 2628278 - RNA, 16 nt, Human
ugaagaggggcagccc

SEQ ID NO: 2628279 - RNA, 15 nt, Human
ugaagaggggcagcc

SEQ ID NO: 2628280 - RNA, 14 nt, Human
ugaagaggggcagc

SEQ ID NO: 2628281 - RNA, 13 nt, Human
ugaagaggggcag

SEQ ID NO: 2628282 - RNA, 12 nt, Human
ugaagaggggca

SEQ ID NO: 2628283 - RNA, 21 nt, Human
ugaagagggagaagcaugaaa

SEQ ID NO: 2628284 - RNA, 14 nt, Human
ugaaggcaaaauug

SEQ ID NO: 2628285 - RNA, 15 nt, Human
ugaaggaugccaaga

SEQ ID NO: 2628286 - RNA, 13 nt, Human
ugaaggaggugag

SEQ ID NO: 2628287 - RNA, 20 nt, Human
ugaaggagauuuuccuuccu

SEQ ID NO: 2628288 - RNA, 17 nt, Human
ugaaggaggugagggau

SEQ ID NO: 2628289 - RNA, 18 nt, Human
ugaaggccuggcccacag

SEQ ID NO: 2628290 - RNA, 16 nt, Human
ugaaggcaaaauugca

SEQ ID NO: 2628291 - RNA, 17 nt, Human
ugaaggcaaaauugcaa

SEQ ID NO: 2628292 - RNA, 20 nt, Human
ugaaggcucgagcaugccug

SEQ ID NO: 2628293 - RNA, 22 nt, Human
ugaaguccaagcauuuagaugu

SEQ ID NO: 2628294 - RNA, 21 nt, Human
ugaaguccaagcauuuagaug

SEQ ID NO: 2628295 - RNA, 21 nt, Human
ugaaggcucgagcaugccugg

SEQ ID NO: 2628296 - RNA, 17 nt, Human
ucuuuugccguuauuaa

SEQ ID NO: 2628297 - RNA, 19 nt, Human
ucuuuugccguuauuaaaa

SEQ ID NO: 2628298 - RNA, 15 nt, Human
ucuuuugaaacaaua

SEQ ID NO: 2628299 - RNA, 14 nt, Human
ucuuuugaaacaau

SEQ ID NO: 2628300 - RNA, 23 nt, Human
ucuuuugaauauucccaagccca

SEQ ID NO: 2628301 - RNA, 19 nt, Human
ucuuuugaauccaugcuug

SEQ ID NO: 2628302 - RNA, 20 nt, Human
ucuuuugaauccaugcuugg

SEQ ID NO: 2628303 - RNA, 13 nt, Human
ucuuuugacaugu

SEQ ID NO: 2628304 - RNA, 14 nt, Human
ucuuuugacaugug

SEQ ID NO: 2628305 - RNA, 15 nt, Human
ucuuuugacaugugg

SEQ ID NO: 2628306 - RNA, 17 nt, Human
ucuuuugacauguggaa

SEQ ID NO: 2628307 - RNA, 13 nt, Human
ucuuuuggcuucc

SEQ ID NO: 2628308 - RNA, 18 nt, Human
ucuuuugcuuuuggcaaa

SEQ ID NO: 2628309 - RNA, 17 nt, Human
ucuuuugcaugaugauc

SEQ ID NO: 2628310 - RNA, 13 nt, Human
ucuuuugcuuuug

SEQ ID NO: 2628311 - RNA, 16 nt, Human
ucuuuugauuauguuu

SEQ ID NO: 2628312 - RNA, 11 nt, Human
ucuuuugaccu

SEQ ID NO: 2628313 - RNA, 20 nt, Human
ucuuuugacauguggaaagu

SEQ ID NO: 2628314 - RNA, 21 nt, Human
ucuuuugcccuucacaguguu

SEQ ID NO: 2628315 - RNA, 20 nt, Human
ucuuuuggggaagugaggaa

SEQ ID NO: 2628316 - RNA, 16 nt, Human
ucuuuuggggaaguga

SEQ ID NO: 2628317 - RNA, 22 nt, Human
ucuuuugguaaagacuggcuuu

SEQ ID NO: 2628318 - RNA, 16 nt, Human
ucuuuuuauacuauua

SEQ ID NO: 2628319 - RNA, 19 nt, Human
ucuuuucuggaauguaauc

SEQ ID NO: 2628320 - RNA, 13 nt, Human
ucuuuucucugug

SEQ ID NO: 2628321 - RNA, 17 nt, Human
ucuuuucucugugcuuc

SEQ ID NO: 2628322 - RNA, 23 nt, Human
ucuuucacacuuccaccagccug

SEQ ID NO: 2628323 - RNA, 16 nt, Human
ucuuuucuuuagagca

SEQ ID NO: 2628324 - RNA, 23 nt, Human
ucuuuucuuuagagcauugccau

SEQ ID NO: 2628325 - RNA, 20 nt, Human
ucuuuucuugccucuguccc

SEQ ID NO: 2628326 - RNA, 16 nt, Human
ucuuuucuugccucug

SEQ ID NO: 2628327 - RNA, 19 nt, Human
ucuuucacagcuccuccca

SEQ ID NO: 2628328 - RNA, 18 nt, Human
ucuuucacagcuccuccc

SEQ ID NO: 2628329 - RNA, 20 nt, Human
ucuuucacagcuccucccac

SEQ ID NO: 2628330 - RNA, 10 nt, Human
ucuuucacau

SEQ ID NO: 2628331 - RNA, 18 nt, Human
ucuuuucuauuuucccuc

SEQ ID NO: 2628332 - RNA, 21 nt, Human
ucuuucaagugaaucuaaaag

SEQ ID NO: 2628333 - RNA, 15 nt, Human
ucuuucacagcuccu

SEQ ID NO: 2628334 - RNA, 14 nt, Human
ucuuucacagcucc

SEQ ID NO: 2628335 - RNA, 20 nt, Human
ucuuucacacuuccaccagc

SEQ ID NO: 2628336 - RNA, 21 nt, Human
ucuuucacacuuccaccagcc

SEQ ID NO: 2628337 - RNA, 15 nt, Human
ugaaaagacuccaaa

SEQ ID NO: 2628338 - RNA, 16 nt, Human
ugaaaagacuccaaag

SEQ ID NO: 2628339 - RNA, 17 nt, Human
ugaaaagacuccaaaga

SEQ ID NO: 2628340 - RNA, 19 nt, Human
ugaaaagacuccaaagaaa

SEQ ID NO: 2628341 - RNA, 17 nt, Human
ugaaaagacaucaagca

SEQ ID NO: 2628342 - RNA, 18 nt, Human
ugaaaagacaucaagcac

SEQ ID NO: 2628343 - RNA, 17 nt, Human
ugaaaacuuuucucaga

SEQ ID NO: 2628344 - RNA, 19 nt, Human
ugaaaacuuuaugcuaagu

SEQ ID NO: 2628345 - RNA, 19 nt, Human
ugaaaacucauuacuuuuc

SEQ ID NO: 2628346 - RNA, 19 nt, Human
ugaaaacguuuuauugugu

SEQ ID NO: 2628347 - RNA, 13 nt, Human
ucuuuuuucaaaa

SEQ ID NO: 2628348 - RNA, 20 nt, Human
ucuuuuuuagcauaaaauuu

SEQ ID NO: 2628349 - RNA, 13 nt, Human
ucuuuuuuaugug

SEQ ID NO: 2628350 - RNA, 15 nt, Human
ucuuuuuuagcauaa

SEQ ID NO: 2628351 - RNA, 16 nt, Human
ucuuuuuuagcauaaa

SEQ ID NO: 2628352 - RNA, 13 nt, Human
ucuuuuugcuguu

SEQ ID NO: 2628353 - RNA, 19 nt, Human
ucuuuuugacucuugcaau

SEQ ID NO: 2628354 - RNA, 19 nt, Human
ucuuuuuuaaaugaagaaa

SEQ ID NO: 2628355 - RNA, 16 nt, Human
ucuuuuugcuuugcuu

SEQ ID NO: 2628356 - RNA, 17 nt, Human
ucuuuuucuucuucccu

SEQ ID NO: 2628357 - RNA, 15 nt, Human
ucuuuuucuucuucc

SEQ ID NO: 2628358 - RNA, 12 nt, Human
ucuuuuucuucu

SEQ ID NO: 2628359 - RNA, 14 nt, Human
ucuuuuucuggacu

SEQ ID NO: 2628360 - RNA, 12 nt, Human
ucuuuuucaguu

SEQ ID NO: 2628361 - RNA, 15 nt, Human
ucuuuuuauugaauc

SEQ ID NO: 2628362 - RNA, 14 nt, Human
ucuuuuuauugaau

SEQ ID NO: 2628363 - RNA, 13 nt, Human
ucuuuuuauugaa

SEQ ID NO: 2628364 - RNA, 14 nt, Human
ucuuuuuaugcauu

SEQ ID NO: 2628365 - RNA, 15 nt, Human
ucuuuuguaauuuaa

SEQ ID NO: 2628366 - RNA, 21 nt, Human
ugaaagauucagguauguugc

SEQ ID NO: 2628367 - RNA, 18 nt, Human
ugaaagcagggacuugaa

SEQ ID NO: 2628368 - RNA, 19 nt, Human
ugaaagcagggacuugaac

SEQ ID NO: 2628369 - RNA, 23 nt, Human
ugaaagcagggacuugaacccau

SEQ ID NO: 2628370 - RNA, 17 nt, Human
ugaaaggaaagaggcuc

SEQ ID NO: 2628371 - RNA, 18 nt, Human
ugaaaggaagcuccacug

SEQ ID NO: 2628372 - RNA, 12 nt, Human
ugaaaggaaaga

SEQ ID NO: 2628373 - RNA, 11 nt, Human
ugaaagcugug

SEQ ID NO: 2628374 - RNA, 20 nt, Human
ugaaaccuuuuuuaagauuu

SEQ ID NO: 2628375 - RNA, 19 nt, Human
ugaaaccuuuuuuaagauu

SEQ ID NO: 2628376 - RNA, 18 nt, Human
ugaaaccuuuuuuaagau

SEQ ID NO: 2628377 - RNA, 17 nt, Human
ugaaaccuuuuuuaaga

SEQ ID NO: 2628378 - RNA, 16 nt, Human
ugaaaccuuuuuuaag

SEQ ID NO: 2628379 - RNA, 22 nt, Human
ugaaaccuuuagggcagcuugc

SEQ ID NO: 2628380 - RNA, 21 nt, Human
ugaaaccuuuagggcagcuug

SEQ ID NO: 2628381 - RNA, 20 nt, Human
ugaaaccuuuagggcagcuu

SEQ ID NO: 2628382 - RNA, 18 nt, Human
ugaaaccuuuagggcagc

SEQ ID NO: 2628383 - RNA, 20 nt, Human
ugaaaccuuauuuuuuccca

SEQ ID NO: 2628384 - RNA, 18 nt, Human
ugaaaccuuauuuuuucc

SEQ ID NO: 2628385 - RNA, 17 nt, Human
ugaaaccuuauuuuuuc

SEQ ID NO: 2628386 - RNA, 23 nt, Human
ugaaaccuuuuuuaagauuuuuc

SEQ ID NO: 2628387 - RNA, 21 nt, Human
ugaaaccuuuuuuaagauuuu

SEQ ID NO: 2628388 - RNA, 21 nt, Human
ugaaagauggcugugccucug

SEQ ID NO: 2628389 - RNA, 23 nt, Human
ugaaagauggcugugccucugcc

SEQ ID NO: 2628390 - RNA, 22 nt, Human
ugaaagauggcugugccucugc

SEQ ID NO: 2628391 - RNA, 23 nt, Human
ugaaacccugucucuacuaaaaa

SEQ ID NO: 2628392 - RNA, 16 nt, Human
ugaaaagauaaauuau

SEQ ID NO: 2628393 - RNA, 22 nt, Human
ugaaaagaggugugcaagagag

SEQ ID NO: 2628394 - RNA, 18 nt, Human
ugaaacccugucucuacu

SEQ ID NO: 2628395 - RNA, 22 nt, Human
ugaaaagacuccaaagaaaugu

SEQ ID NO: 2628396 - RNA, 13 nt, Human
ugaaaagaggugu

SEQ ID NO: 2628397 - RNA, 23 nt, Human
ugaaaagaggggaccagaagcca

SEQ ID NO: 2628398 - RNA, 18 nt, Human
ugaaagggcccagagagg

SEQ ID NO: 2628399 - RNA, 17 nt, Human
ugaaagggcccagagag

SEQ ID NO: 2628400 - RNA, 16 nt, Human
ugaaagggcccagaga

SEQ ID NO: 2628401 - RNA, 15 nt, Human
ugaaagggcccagag

SEQ ID NO: 2628402 - RNA, 14 nt, Human
ugaaaggagcccuu

SEQ ID NO: 2628403 - RNA, 15 nt, Human
ugaaaucauucauuu

SEQ ID NO: 2628404 - RNA, 14 nt, Human
ugaaauccugcuuc

SEQ ID NO: 2628405 - RNA, 22 nt, Human
ugaaauccuggguuuucuuaac

SEQ ID NO: 2628406 - RNA, 17 nt, Human
ugaaaucuuuuugcuuu

SEQ ID NO: 2628407 - RNA, 19 nt, Human
ugaaaucucagaauuccuu

SEQ ID NO: 2628408 - RNA, 19 nt, Human
ugaaaucuuacagcugggu

SEQ ID NO: 2628409 - RNA, 16 nt, Human
ugaaaucucagaauuc

SEQ ID NO: 2628410 - RNA, 16 nt, Human
ugaaaugaauauuuaa

SEQ ID NO: 2628411 - RNA, 19 nt, Human
ugaaaugaccucaagaugu

SEQ ID NO: 2628412 - RNA, 13 nt, Human
ugaaaugaaaaca

SEQ ID NO: 2628413 - RNA, 14 nt, Human
ugaaaugaaaacau

SEQ ID NO: 2628414 - RNA, 19 nt, Human
ugaaaugaaaacauguaau

SEQ ID NO: 2628415 - RNA, 20 nt, Human
ugaaaugaaaacauguaaua

SEQ ID NO: 2628416 - RNA, 20 nt, Human
ugaaaugaggucagagccug

SEQ ID NO: 2628417 - RNA, 19 nt, Human
ugaaaugaggucagagccu

SEQ ID NO: 2628418 - RNA, 22 nt, Human
ugaaaugaggucagagccugca

SEQ ID NO: 2628419 - RNA, 21 nt, Human
ugaaaugaggucagagccugc

SEQ ID NO: 2628420 - RNA, 23 nt, Human
ugaaaugaggucagagccugcag

SEQ ID NO: 2628421 - RNA, 19 nt, Human
ugaaaugcagagucaauga

SEQ ID NO: 2628422 - RNA, 14 nt, Human
ucuuagugugugca

SEQ ID NO: 2628423 - RNA, 16 nt, Human
ucuuaguggauguucu

SEQ ID NO: 2628424 - RNA, 21 nt, Human
ucuuaaaauaacuuauaucau

SEQ ID NO: 2628425 - RNA, 15 nt, Human
ucuuaaaauaacuua

SEQ ID NO: 2628426 - RNA, 14 nt, Human
ucuuaaaauaacuu

SEQ ID NO: 2628427 - RNA, 23 nt, Human
ucuuaaaaguugugauuccagau

SEQ ID NO: 2628428 - RNA, 13 nt, Human
ucuuaaaaagugg

SEQ ID NO: 2628429 - RNA, 20 nt, Human
ucuuaaaacauuaugaguuu

SEQ ID NO: 2628430 - RNA, 12 nt, Human
ucuuauaaauau

SEQ ID NO: 2628431 - RNA, 11 nt, Human
ucuuauaaaua

SEQ ID NO: 2628432 - RNA, 23 nt, Human
ucuuaguuuggauucuuauguag

SEQ ID NO: 2628433 - RNA, 21 nt, Human
ucuuaguuuggauucuuaugu

SEQ ID NO: 2628434 - RNA, 16 nt, Human
ucuuaguuuggauucu

SEQ ID NO: 2628435 - RNA, 16 nt, Human
ucuuaguucucacugu

SEQ ID NO: 2628436 - RNA, 15 nt, Human
ucuuaguucucacug

SEQ ID NO: 2628437 - RNA, 19 nt, Human
ucuuaaaauauauuucaga

SEQ ID NO: 2628438 - RNA, 20 nt, Human
ucuuaaaauauauuucagau

SEQ ID NO: 2628439 - RNA, 15 nt, Human
ucuuauacauuugau

SEQ ID NO: 2628440 - RNA, 14 nt, Human
ucuuauacauuuga

SEQ ID NO: 2628441 - RNA, 14 nt, Human
ucuuauggaauuga

SEQ ID NO: 2628442 - RNA, 15 nt, Human
ucuuauggaauugau

SEQ ID NO: 2628443 - RNA, 17 nt, Human
ucuuauggaauugauuu

SEQ ID NO: 2628444 - RNA, 18 nt, Human
ucuuauggaauugauuug

SEQ ID NO: 2628445 - RNA, 21 nt, Human
ucuuauggaauugauuugcau

SEQ ID NO: 2628446 - RNA, 22 nt, Human
ucuuauggaauugauuugcauu

SEQ ID NO: 2628447 - RNA, 13 nt, Human
ucuuaugggcugg

SEQ ID NO: 2628448 - RNA, 13 nt, Human
ucuucagggcacu

SEQ ID NO: 2628449 - RNA, 15 nt, Human
ucuucagggcacugc

SEQ ID NO: 2628450 - RNA, 15 nt, Human
ucuucaguaagccgu

SEQ ID NO: 2628451 - RNA, 17 nt, Human
ucuuaugcuuauaauau

SEQ ID NO: 2628452 - RNA, 14 nt, Human
ucuuaugcaauuuc

SEQ ID NO: 2628453 - RNA, 20 nt, Human
ucuuauauauauuucuuugu

SEQ ID NO: 2628454 - RNA, 22 nt, Human
ucuuauagucaauguuucuuuu

SEQ ID NO: 2628455 - RNA, 21 nt, Human
ucuuauaaauaugaagcucac

SEQ ID NO: 2628456 - RNA, 14 nt, Human
ucuuauaaauauga

SEQ ID NO: 2628457 - RNA, 13 nt, Human
ucuuauaaauaug

SEQ ID NO: 2628458 - RNA, 20 nt, Human
ucuuauagaauauuuauuac

SEQ ID NO: 2628459 - RNA, 19 nt, Human
ucuuauagaauauuuauua

SEQ ID NO: 2628460 - RNA, 13 nt, Human
ucuuauagaaagu

SEQ ID NO: 2628461 - RNA, 17 nt, Human
ucuucuagguucuaaaa

SEQ ID NO: 2628462 - RNA, 17 nt, Human
ucuucucaagugccuua

SEQ ID NO: 2628463 - RNA, 16 nt, Human
ucuucucaagugccuu

SEQ ID NO: 2628464 - RNA, 15 nt, Human
ucuucucaagugccu

SEQ ID NO: 2628465 - RNA, 13 nt, Human
ucuucucaagugc

SEQ ID NO: 2628466 - RNA, 13 nt, Human
ucuucuauuuugu

SEQ ID NO: 2628467 - RNA, 15 nt, Human
ucuucuauuuuauuc

SEQ ID NO: 2628468 - RNA, 16 nt, Human
ucuucuauuuuauucc

SEQ ID NO: 2628469 - RNA, 21 nt, Human
ucuucuccacuuucuagccag

SEQ ID NO: 2628470 - RNA, 19 nt, Human
ucuucuccacuuucuagcc

SEQ ID NO: 2628471 - RNA, 23 nt, Human
ucuucucagaaggcaaaugacuu

SEQ ID NO: 2628472 - RNA, 13 nt, Human
ucuucuccacugg

SEQ ID NO: 2628473 - RNA, 14 nt, Human
ucuuccaggcuggg

SEQ ID NO: 2628474 - RNA, 13 nt, Human
ucuuccagaaucc

SEQ ID NO: 2628475 - RNA, 20 nt, Human
ucuuccagaagugugauugg

SEQ ID NO: 2628476 - RNA, 19 nt, Human
ucuuccagaagugugauug

SEQ ID NO: 2628477 - RNA, 18 nt, Human
ucuuccagaagugugauu

SEQ ID NO: 2628478 - RNA, 17 nt, Human
ucuuccagaagugugau

SEQ ID NO: 2628479 - RNA, 16 nt, Human
ucuuccagaaguguga

SEQ ID NO: 2628480 - RNA, 11 nt, Human
ucuuccagaag

SEQ ID NO: 2628481 - RNA, 13 nt, Human
ucuucuaaacuuc

SEQ ID NO: 2628482 - RNA, 22 nt, Human
ucuucuaaacuuccccaucuuc

SEQ ID NO: 2628483 - RNA, 20 nt, Human
ucuucuaauuucaaaaauau

SEQ ID NO: 2628484 - RNA, 15 nt, Human
ucuucuaauuucaaa

SEQ ID NO: 2628485 - RNA, 12 nt, Human
ucuucuaaaugg

SEQ ID NO: 2628486 - RNA, 23 nt, Human
ucuucuagagccgugaugccucc

SEQ ID NO: 2628487 - RNA, 21 nt, Human
ucuuccacaagagcccaggcc

SEQ ID NO: 2628488 - RNA, 18 nt, Human
ucuuccaagcaaagguga

SEQ ID NO: 2628489 - RNA, 24 nt, Human
ucuuccaagcaaaggugaagagac

SEQ ID NO: 2628490 - RNA, 16 nt, Human
ucuucaguaagccgug

SEQ ID NO: 2628491 - RNA, 23 nt, Human
ucuucagguggaaaaacaucuga

SEQ ID NO: 2628492 - RNA, 14 nt, Human
ucuucagguucuua

SEQ ID NO: 2628493 - RNA, 19 nt, Human
ucuucagugggagaaaaca

SEQ ID NO: 2628494 - RNA, 21 nt, Human
ucuucaggguccugagauuua

SEQ ID NO: 2628495 - RNA, 16 nt, Human
ucuucagguggaaaaa

SEQ ID NO: 2628496 - RNA, 15 nt, Human
ucuucagggggccag

SEQ ID NO: 2628497 - RNA, 15 nt, Human
ucuugugaaggcagg

SEQ ID NO: 2628498 - RNA, 21 nt, Human
ucuugugacauauuaugucuu

SEQ ID NO: 2628499 - RNA, 15 nt, Human
ucuugucucugggcu

SEQ ID NO: 2628500 - RNA, 14 nt, Human
ucuugucucugggc

SEQ ID NO: 2628501 - RNA, 13 nt, Human
ucuugucucuggg

SEQ ID NO: 2628502 - RNA, 12 nt, Human
ucuugucucugg

SEQ ID NO: 2628503 - RNA, 22 nt, Human
ucuuguuuuuccacuacugcua

SEQ ID NO: 2628504 - RNA, 20 nt, Human
ucuuucaagugaaucuaaaa

SEQ ID NO: 2628505 - RNA, 21 nt, Human
ucuuguuuuuuuuuuccacuu

SEQ ID NO: 2628506 - RNA, 18 nt, Human
ucuuguuuuuuuuuucca

SEQ ID NO: 2628507 - RNA, 11 nt, Human
ucuugcucugc

SEQ ID NO: 2628508 - RNA, 18 nt, Human
ucuugcucaaaaaucugu

SEQ ID NO: 2628509 - RNA, 13 nt, Human
ucuugcucugcug

SEQ ID NO: 2628510 - RNA, 12 nt, Human
ucuugcucugcu

SEQ ID NO: 2628511 - RNA, 22 nt, Human
ucuuguauuaagaaugaaauac

SEQ ID NO: 2628512 - RNA, 23 nt, Human
ucuuguccaugugguucuucaaa

SEQ ID NO: 2628513 - RNA, 22 nt, Human
ucuuguccaugugguucuucaa

SEQ ID NO: 2628514 - RNA, 22 nt, Human
ucuuguauuaaguuguuaauaa

SEQ ID NO: 2628515 - RNA, 18 nt, Human
ucuuguauuaaguuguua

SEQ ID NO: 2628516 - RNA, 12 nt, Human
ucuugccuucag

SEQ ID NO: 2628517 - RNA, 16 nt, Human
ucuuguauuaaguugu

SEQ ID NO: 2628518 - RNA, 21 nt, Human
ucuucucagaaggcaaaugac

SEQ ID NO: 2628519 - RNA, 16 nt, Human
ucuucuccacuggaug

SEQ ID NO: 2628520 - RNA, 12 nt, Human
ucuucuccaggc

SEQ ID NO: 2628521 - RNA, 14 nt, Human
ucuucuccaggcug

SEQ ID NO: 2628522 - RNA, 13 nt, Human
ucuucuccaggcu

SEQ ID NO: 2628523 - RNA, 18 nt, Human
ucuugaacuccuggccuc

SEQ ID NO: 2628524 - RNA, 17 nt, Human
ucuugaacuccuggccu

SEQ ID NO: 2628525 - RNA, 16 nt, Human
ucuugaacuccuggcc

SEQ ID NO: 2628526 - RNA, 15 nt, Human
ucuucuccaggcugu

SEQ ID NO: 2628527 - RNA, 15 nt, Human
ucuugaacugagcuu

SEQ ID NO: 2628528 - RNA, 13 nt, Human
ucuugaauuuaau

SEQ ID NO: 2628529 - RNA, 14 nt, Human
ucuucuccaggaug

SEQ ID NO: 2628530 - RNA, 21 nt, Human
ucuugaauuguaaggaaugau

SEQ ID NO: 2628531 - RNA, 22 nt, Human
ucuugacaccagcuguucuguc

SEQ ID NO: 2628532 - RNA, 19 nt, Human
ucuugacauucaaggcauu

SEQ ID NO: 2628533 - RNA, 19 nt, Human
ucuugaccaagcaggaagc

SEQ ID NO: 2628534 - RNA, 21 nt, Human
ucuugaauuuaauaaucugua

SEQ ID NO: 2628535 - RNA, 23 nt, Human
ucuugaauuuaauaaucuguagg

SEQ ID NO: 2628536 - RNA, 21 nt, Human
ucuugacaccagcuguucugu

SEQ ID NO: 2628537 - RNA, 20 nt, Human
ucuugacaccagcuguucug

SEQ ID NO: 2628538 - RNA, 18 nt, Human
ucuugaauuucuaaaaaa

SEQ ID NO: 2628539 - RNA, 19 nt, Human
ucuugccucugugcugugu

SEQ ID NO: 2628540 - RNA, 16 nt, Human
ucuugccucugugcug

SEQ ID NO: 2628541 - RNA, 15 nt, Human
ucuugccucugugcu

SEQ ID NO: 2628542 - RNA, 14 nt, Human
ucuugccucugugc

SEQ ID NO: 2628543 - RNA, 21 nt, Human
ucuugccucuguccccuucuc

SEQ ID NO: 2628544 - RNA, 16 nt, Human
ucuugccucugucccc

SEQ ID NO: 2628545 - RNA, 13 nt, Human
ucuugccucugug

SEQ ID NO: 2628546 - RNA, 22 nt, Human
ucuugccucuguccccuucucu

SEQ ID NO: 2628547 - RNA, 12 nt, Human
ucuugccucugu

SEQ ID NO: 2628548 - RNA, 11 nt, Human
ucuugacccua

SEQ ID NO: 2628549 - RNA, 21 nt, Human
ucuugaccaagcaggaagcuc

SEQ ID NO: 2628550 - RNA, 20 nt, Human
ucuugacgagugugaagcuu

SEQ ID NO: 2628551 - RNA, 24 nt, Human
ucuggagacagccccagagcaggg

SEQ ID NO: 2628552 - RNA, 22 nt, Human
ucuggagacagccccagagcag

SEQ ID NO: 2628553 - RNA, 20 nt, Human
ucuggagacagccccagagc

SEQ ID NO: 2628554 - RNA, 18 nt, Human
ucuggagacagccccaga

SEQ ID NO: 2628555 - RNA, 17 nt, Human
ucuggagacagccccag

SEQ ID NO: 2628556 - RNA, 16 nt, Human
ucuggagacagcccca

SEQ ID NO: 2628557 - RNA, 15 nt, Human
ucuggagacagcccc

SEQ ID NO: 2628558 - RNA, 23 nt, Human
ucuggagaagcucccaggaacaa

SEQ ID NO: 2628559 - RNA, 15 nt, Human
ucuggagaccaggga

SEQ ID NO: 2628560 - RNA, 19 nt, Human
ucuggagaccagggagccu

SEQ ID NO: 2628561 - RNA, 20 nt, Human
ucuggagaccagggagccuu

SEQ ID NO: 2628562 - RNA, 15 nt, Human
ucuggagagaaacaa

SEQ ID NO: 2628563 - RNA, 12 nt, Human
ucuggagagaaa

SEQ ID NO: 2628564 - RNA, 21 nt, Human
ucuggagaccagggagccuuu

SEQ ID NO: 2628565 - RNA, 14 nt, Human
ucuggagagcuaga

SEQ ID NO: 2628566 - RNA, 13 nt, Human
ucuggagagcuag

SEQ ID NO: 2628567 - RNA, 23 nt, Human
ucuggagcccacuguacuugcuc

SEQ ID NO: 2628568 - RNA, 22 nt, Human
ucugcacaugucuuguacaugu

SEQ ID NO: 2628569 - RNA, 21 nt, Human
ucugcacaugucuuguacaug

SEQ ID NO: 2628570 - RNA, 13 nt, Human
ucugcacccaggg

SEQ ID NO: 2628571 - RNA, 15 nt, Human
ucugcacccaggggu

SEQ ID NO: 2628572 - RNA, 15 nt, Human
ucugcaccccccugg

SEQ ID NO: 2628573 - RNA, 20 nt, Human
ucugcaccccuucucuccuc

SEQ ID NO: 2628574 - RNA, 19 nt, Human
ucugcaccccuucucuccu

SEQ ID NO: 2628575 - RNA, 18 nt, Human
ucugcaccccuucucucc

SEQ ID NO: 2628576 - RNA, 15 nt, Human
ucugcaccccuucuc

SEQ ID NO: 2628577 - RNA, 16 nt, Human
ucugcaccccccuggg

SEQ ID NO: 2628578 - RNA, 17 nt, Human
ucugcaccccccugggc

SEQ ID NO: 2628579 - RNA, 18 nt, Human
ucugcaccccccugggcu

SEQ ID NO: 2628580 - RNA, 17 nt, Human
ucugcacccuccacccu

SEQ ID NO: 2628581 - RNA, 16 nt, Human
ucugcacccuccaccc

SEQ ID NO: 2628582 - RNA, 15 nt, Human
ucugcacccuccacc

SEQ ID NO: 2628583 - RNA, 14 nt, Human
ucugcacccuccac

SEQ ID NO: 2628584 - RNA, 13 nt, Human
ucugcacccucca

SEQ ID NO: 2628585 - RNA, 12 nt, Human
ucugcacccucc

SEQ ID NO: 2628586 - RNA, 22 nt, Human
ucugcaccccuucucuccuccc

SEQ ID NO: 2628587 - RNA, 21 nt, Human
ucugcaccccuucucuccucc

SEQ ID NO: 2628588 - RNA, 19 nt, Human
ucuggagaagcucccagga

SEQ ID NO: 2628589 - RNA, 21 nt, Human
ucugcacccuccacccugucc

SEQ ID NO: 2628590 - RNA, 19 nt, Human
ucugcacccuccacccugu

SEQ ID NO: 2628591 - RNA, 18 nt, Human
ucugcacccuccacccug

SEQ ID NO: 2628592 - RNA, 22 nt, Human
ucuggagaagcucccaggaaca

SEQ ID NO: 2628593 - RNA, 20 nt, Human
ucuggagaagcucccaggaa

SEQ ID NO: 2628594 - RNA, 12 nt, Human
ucuggagacagc

SEQ ID NO: 2628595 - RNA, 16 nt, Human
ucuggagcccuugggu

SEQ ID NO: 2628596 - RNA, 12 nt, Human
ucuggagcccuu

SEQ ID NO: 2628597 - RNA, 13 nt, Human
ucuggagcccuug

SEQ ID NO: 2628598 - RNA, 21 nt, Human
ucuggaggggagggggauccg

SEQ ID NO: 2628599 - RNA, 14 nt, Human
ucuggaggggaggg

SEQ ID NO: 2628600 - RNA, 23 nt, Human
ucuggaggggccccugcuucucc

SEQ ID NO: 2628601 - RNA, 17 nt, Human
ucuggaggggccccugc

SEQ ID NO: 2628602 - RNA, 15 nt, Human
ucuggaggggccccu

SEQ ID NO: 2628603 - RNA, 23 nt, Human
ucuggccuucggccuccauccug

SEQ ID NO: 2628604 - RNA, 13 nt, Human
ucuggcucugucu

SEQ ID NO: 2628605 - RNA, 22 nt, Human
ucuggcuagaggccagccccac

SEQ ID NO: 2628606 - RNA, 17 nt, Human
ucuggcuaugcauuuga

SEQ ID NO: 2628607 - RNA, 17 nt, Human
ucuggcuagaggccagc

SEQ ID NO: 2628608 - RNA, 21 nt, Human
ucuggcuagaggccagcccca

SEQ ID NO: 2628609 - RNA, 14 nt, Human
ucuggcuaugcauu

SEQ ID NO: 2628610 - RNA, 14 nt, Human
ucuggccuuuuccu

SEQ ID NO: 2628611 - RNA, 18 nt, Human
ucuggcgacaguuuuccu

SEQ ID NO: 2628612 - RNA, 22 nt, Human
ucuggcgacaguuuuccuucuc

SEQ ID NO: 2628613 - RNA, 16 nt, Human
ucuggcuagaggccag

SEQ ID NO: 2628614 - RNA, 15 nt, Human
ucugguuuugcuauu

SEQ ID NO: 2628615 - RNA, 15 nt, Human
ucugguuuuaacaau

SEQ ID NO: 2628616 - RNA, 13 nt, Human
ucugguuuuaaca

SEQ ID NO: 2628617 - RNA, 23 nt, Human
ucugguuuggggcgaggcagagg

SEQ ID NO: 2628618 - RNA, 13 nt, Human
ucugguuuggggc

SEQ ID NO: 2628619 - RNA, 22 nt, Human
ucugguuugacuccgcuggagg

SEQ ID NO: 2628620 - RNA, 18 nt, Human
ucugguuugacuccgcug

SEQ ID NO: 2628621 - RNA, 15 nt, Human
ucugguuucaccgag

SEQ ID NO: 2628622 - RNA, 12 nt, Human
ucuguaaaaucu

SEQ ID NO: 2628623 - RNA, 11 nt, Human
ucuguaaaauc

SEQ ID NO: 2628624 - RNA, 17 nt, Human
ucuguaaaaucuuucuu

SEQ ID NO: 2628625 - RNA, 14 nt, Human
ucuguaaaaucuuu

SEQ ID NO: 2628626 - RNA, 13 nt, Human
ucuguaaaaucuu

SEQ ID NO: 2628627 - RNA, 14 nt, Human
ucugguuuugcuau

SEQ ID NO: 2628628 - RNA, 15 nt, Human
ucuguaagcugaagu

SEQ ID NO: 2628629 - RNA, 23 nt, Human
ucuguacagagcccacgccccca

SEQ ID NO: 2628630 - RNA, 20 nt, Human
ucuguaaucucguuucaaaa

SEQ ID NO: 2628631 - RNA, 15 nt, Human
ucuguaaucucguuu

SEQ ID NO: 2628632 - RNA, 12 nt, Human
ucugggacacag

SEQ ID NO: 2628633 - RNA, 14 nt, Human
ucugggaagggaag

SEQ ID NO: 2628634 - RNA, 18 nt, Human
ucugggaacugugccuuu

SEQ ID NO: 2628635 - RNA, 22 nt, Human
ucugggaaauggcuugaagcca

SEQ ID NO: 2628636 - RNA, 22 nt, Human
ucugggaaaugagaaggcagcc

SEQ ID NO: 2628637 - RNA, 13 nt, Human
ucugggacacagu

SEQ ID NO: 2628638 - RNA, 16 nt, Human
ucuggcucuuccaggc

SEQ ID NO: 2628639 - RNA, 15 nt, Human
ucuggcucuuccagg

SEQ ID NO: 2628640 - RNA, 17 nt, Human
ucuggcucuuccaggcu

SEQ ID NO: 2628641 - RNA, 23 nt, Human
ucuggcuuucuccgacugcuagg

SEQ ID NO: 2628642 - RNA, 17 nt, Human
ucugggaaaauacccca

SEQ ID NO: 2628643 - RNA, 18 nt, Human
ucugggaaauaagagaga

SEQ ID NO: 2628644 - RNA, 17 nt, Human
ucuguuaugcugugaca

SEQ ID NO: 2628645 - RNA, 18 nt, Human
ucuguuauuuagacucau

SEQ ID NO: 2628646 - RNA, 15 nt, Human
ucuguuauuaacaaa

SEQ ID NO: 2628647 - RNA, 15 nt, Human
ucuguuauauaaaug

SEQ ID NO: 2628648 - RNA, 18 nt, Human
ucuguuauauaaaugguu

SEQ ID NO: 2628649 - RNA, 21 nt, Human
ucuguucacuuuuccucccuc

SEQ ID NO: 2628650 - RNA, 22 nt, Human
ucuguucacuuuuccucccuca

SEQ ID NO: 2628651 - RNA, 19 nt, Human
ucuguucacuuuuccuccc

SEQ ID NO: 2628652 - RNA, 13 nt, Human
ucuguucaccuuc

SEQ ID NO: 2628653 - RNA, 20 nt, Human
ucuguuuuauaauuuuguga

SEQ ID NO: 2628654 - RNA, 22 nt, Human
ucuguuuuauaauuuugugaag

SEQ ID NO: 2628655 - RNA, 15 nt, Human
ucuguuuuaugacuu

SEQ ID NO: 2628656 - RNA, 16 nt, Human
ucuguuuuaugacuuc

SEQ ID NO: 2628657 - RNA, 13 nt, Human
ucuguuuuaugac

SEQ ID NO: 2628658 - RNA, 17 nt, Human
ucuguuuuaugacuuca

SEQ ID NO: 2628659 - RNA, 12 nt, Human
ucuguucagugu

SEQ ID NO: 2628660 - RNA, 17 nt, Human
ucuguuuuccuuucuca

SEQ ID NO: 2628661 - RNA, 16 nt, Human
ucuguuuuccuuucuc

SEQ ID NO: 2628662 - RNA, 13 nt, Human
ucuguuuuccuuu

SEQ ID NO: 2628663 - RNA, 18 nt, Human
ucuuaaaaaguggaaaaa

SEQ ID NO: 2628664 - RNA, 15 nt, Human
ucuguguguuuaugu

SEQ ID NO: 2628665 - RNA, 16 nt, Human
ucuguguguuuaugug

SEQ ID NO: 2628666 - RNA, 11 nt, Human
ucugugucuuu

SEQ ID NO: 2628667 - RNA, 22 nt, Human
ucuguguguguguauguggggg

SEQ ID NO: 2628668 - RNA, 23 nt, Human
ucuguguuggcccaagcucuugu

SEQ ID NO: 2628669 - RNA, 21 nt, Human
ucuguguuggcccaagcucuu

SEQ ID NO: 2628670 - RNA, 16 nt, Human
ucuguguugccaagcu

SEQ ID NO: 2628671 - RNA, 14 nt, Human
ucuguguugccaag

SEQ ID NO: 2628672 - RNA, 19 nt, Human
ucuguguguuuaugugugu

SEQ ID NO: 2628673 - RNA, 20 nt, Human
ucuguguguuuaugugugug

SEQ ID NO: 2628674 - RNA, 21 nt, Human
ucuguuaccaugucacugugg

SEQ ID NO: 2628675 - RNA, 19 nt, Human
ucuguuaccaugucacugu

SEQ ID NO: 2628676 - RNA, 16 nt, Human
ucuguguuuuugaaau

SEQ ID NO: 2628677 - RNA, 13 nt, Human
ucuguguuuuaau

SEQ ID NO: 2628678 - RNA, 14 nt, Human
ucuguguuuugaau

SEQ ID NO: 2628679 - RNA, 15 nt, Human
ucuguguuuuugaaa

SEQ ID NO: 2628680 - RNA, 22 nt, Human
ucuguggguuucuaaagcugcc

SEQ ID NO: 2628681 - RNA, 15 nt, Human
ucugucccuuggagc

SEQ ID NO: 2628682 - RNA, 20 nt, Human
ucuguccguuuacuccaagg

SEQ ID NO: 2628683 - RNA, 22 nt, Human
ucugucccuucugucccucaca

SEQ ID NO: 2628684 - RNA, 23 nt, Human
ucugucccuucugucccucacag

SEQ ID NO: 2628685 - RNA, 19 nt, Human
ucuguccgagcuuugaaaa

SEQ ID NO: 2628686 - RNA, 14 nt, Human
ucuguacauagccu

SEQ ID NO: 2628687 - RNA, 18 nt, Human
ucuguacauagccuauau

SEQ ID NO: 2628688 - RNA, 17 nt, Human
ucuguacgucugacagg

SEQ ID NO: 2628689 - RNA, 14 nt, Human
ucugucccucacag

SEQ ID NO: 2628690 - RNA, 15 nt, Human
ucugucccucacagc

SEQ ID NO: 2628691 - RNA, 19 nt, Human
ucugucccuucugucccuc

SEQ ID NO: 2628692 - RNA, 20 nt, Human
ucugucccuucugucccuca

SEQ ID NO: 2628693 - RNA, 23 nt, Human
ucuguggguuucuaaagcugcca

SEQ ID NO: 2628694 - RNA, 19 nt, Human
ucugugguuuuccccuccc

SEQ ID NO: 2628695 - RNA, 17 nt, Human
ucuguguccuucccugc

SEQ ID NO: 2628696 - RNA, 15 nt, Human
ucuguguccuucccu

SEQ ID NO: 2628697 - RNA, 11 nt, Human
ucuguguccuu

SEQ ID NO: 2628698 - RNA, 14 nt, Human
ucuguguacaaaga

SEQ ID NO: 2628699 - RNA, 18 nt, Human
ucuguguccuucccugca

SEQ ID NO: 2628700 - RNA, 23 nt, Human
ucugugguuuuccccucccuggg

SEQ ID NO: 2628701 - RNA, 22 nt, Human
ucugugguuuuccccucccugg

SEQ ID NO: 2628702 - RNA, 21 nt, Human
ucugugguuuuccccucccug

SEQ ID NO: 2628703 - RNA, 20 nt, Human
ucugugguuuuccccucccu

SEQ ID NO: 2628704 - RNA, 22 nt, Human
ucugugucagguggggcagcuu

SEQ ID NO: 2628705 - RNA, 15 nt, Human
ucuguguguguguau

SEQ ID NO: 2628706 - RNA, 18 nt, Human
ucuguguguguguaugug

SEQ ID NO: 2628707 - RNA, 19 nt, Human
ucuguguguguguaugugg

SEQ ID NO: 2628708 - RNA, 21 nt, Human
ucuguguguguguaugugggg

SEQ ID NO: 2628709 - RNA, 21 nt, Human
ucugugucuuucacagcuccu

SEQ ID NO: 2628710 - RNA, 12 nt, Human
ucugugucuugu

SEQ ID NO: 2628711 - RNA, 13 nt, Human
ucugugucugugu

SEQ ID NO: 2628712 - RNA, 15 nt, Human
ucugugucuguguuu

SEQ ID NO: 2628713 - RNA, 11 nt, Human
ucugugucucu

SEQ ID NO: 2628714 - RNA, 12 nt, Human
ucugugucucuu

SEQ ID NO: 2628715 - RNA, 12 nt, Human
ucugugucugug

SEQ ID NO: 2628716 - RNA, 18 nt, Human
uggccacuccgagaggug

SEQ ID NO: 2628717 - RNA, 14 nt, Human
uggccacuccgaga

SEQ ID NO: 2628718 - RNA, 22 nt, Human
uggccacuccagaccccuggcu

SEQ ID NO: 2628719 - RNA, 20 nt, Human
uggccacuccagaccccugg

SEQ ID NO: 2628720 - RNA, 12 nt, Human
uggcagugguuu

SEQ ID NO: 2628721 - RNA, 20 nt, Human
uggcagugggagcugccugu

SEQ ID NO: 2628722 - RNA, 16 nt, Human
uggccagaagucaagc

SEQ ID NO: 2628723 - RNA, 20 nt, Human
uggccacugcacagagcucu

SEQ ID NO: 2628724 - RNA, 21 nt, Human
uggccacuugggucuucccug

SEQ ID NO: 2628725 - RNA, 23 nt, Human
uggccacuccgagaggugggcca

SEQ ID NO: 2628726 - RNA, 20 nt, Human
uggccacuccgagagguggg

SEQ ID NO: 2628727 - RNA, 18 nt, Human
uggccacugcacagagcu

SEQ ID NO: 2628728 - RNA, 17 nt, Human
uggccacugcacagagc

SEQ ID NO: 2628729 - RNA, 14 nt, Human
uggccacugcacag

SEQ ID NO: 2628730 - RNA, 13 nt, Human
uggccagacacag

SEQ ID NO: 2628731 - RNA, 18 nt, Human
uggccagacacaggcccu

SEQ ID NO: 2628732 - RNA, 12 nt, Human
uggccagacaca

SEQ ID NO: 2628733 - RNA, 19 nt, Human
uggccacugcacagagcuc

SEQ ID NO: 2628734 - RNA, 20 nt, Human
uggccagaagggggccauga

SEQ ID NO: 2628735 - RNA, 13 nt, Human
uggccagagagcc

SEQ ID NO: 2628736 - RNA, 23 nt, Human
uggccagagagccuggugcugcu

SEQ ID NO: 2628737 - RNA, 18 nt, Human
uggcaggcuggccagucc

SEQ ID NO: 2628738 - RNA, 15 nt, Human
uggcaggcuggccag

SEQ ID NO: 2628739 - RNA, 19 nt, Human
uggcaggcagcgccaagca

SEQ ID NO: 2628740 - RNA, 15 nt, Human
uggcaggcagcgcca

SEQ ID NO: 2628741 - RNA, 23 nt, Human
uggcaggcagcgccaagcaaccu

SEQ ID NO: 2628742 - RNA, 14 nt, Human
uggcaggcuggcca

SEQ ID NO: 2628743 - RNA, 13 nt, Human
uggcaggcuggcc

SEQ ID NO: 2628744 - RNA, 12 nt, Human
uggcaggcuggc

SEQ ID NO: 2628745 - RNA, 19 nt, Human
uggcagugggagcugccug

SEQ ID NO: 2628746 - RNA, 16 nt, Human
uggcagugggagcugc

SEQ ID NO: 2628747 - RNA, 15 nt, Human
uggcagugggagcug

SEQ ID NO: 2628748 - RNA, 14 nt, Human
uggcagugggagcu

SEQ ID NO: 2628749 - RNA, 13 nt, Human
uggaugccugauu

SEQ ID NO: 2628750 - RNA, 16 nt, Human
uggcacugagcccccc

SEQ ID NO: 2628751 - RNA, 14 nt, Human
uggaugccuggugg

SEQ ID NO: 2628752 - RNA, 21 nt, Human
uggaugccaauauuaaaucug

SEQ ID NO: 2628753 - RNA, 15 nt, Human
uggaugcauuucucu

SEQ ID NO: 2628754 - RNA, 22 nt, Human
uggaugcauguuuuccagcucc

SEQ ID NO: 2628755 - RNA, 20 nt, Human
uggaugcauguuuuccagcu

SEQ ID NO: 2628756 - RNA, 20 nt, Human
uggaugccaauauuaaaucu

SEQ ID NO: 2628757 - RNA, 23 nt, Human
uggaugcagugcucgcuguugcu

SEQ ID NO: 2628758 - RNA, 15 nt, Human
uggaugcagugcucg

SEQ ID NO: 2628759 - RNA, 16 nt, Human
uggcacugcuuccagu

SEQ ID NO: 2628760 - RNA, 14 nt, Human
uggcacugcuucca

SEQ ID NO: 2628761 - RNA, 18 nt, Human
uggcacugcuuccaguga

SEQ ID NO: 2628762 - RNA, 21 nt, Human
uggcacuuagcuaucagaaga

SEQ ID NO: 2628763 - RNA, 12 nt, Human
uggcacugcugu

SEQ ID NO: 2628764 - RNA, 13 nt, Human
uggcacugccaug

SEQ ID NO: 2628765 - RNA, 18 nt, Human
uggcacugagccccccca

SEQ ID NO: 2628766 - RNA, 17 nt, Human
uggcacugagccccccc

SEQ ID NO: 2628767 - RNA, 19 nt, Human
uggcacugcauacaaucug

SEQ ID NO: 2628768 - RNA, 22 nt, Human
uggcagcugcgguccacccagg

SEQ ID NO: 2628769 - RNA, 21 nt, Human
uggcagcugcgguccacccag

SEQ ID NO: 2628770 - RNA, 20 nt, Human
uggcaggauggccuggccag

SEQ ID NO: 2628771 - RNA, 21 nt, Human
uggcagaagacaccagagcag

SEQ ID NO: 2628772 - RNA, 23 nt, Human
uggcagcugcgguccacccagga

SEQ ID NO: 2628773 - RNA, 17 nt, Human
uggcacuugcaucugug

SEQ ID NO: 2628774 - RNA, 16 nt, Human
uggcacuugcaucugu

SEQ ID NO: 2628775 - RNA, 14 nt, Human
uggcacuugcaucu

SEQ ID NO: 2628776 - RNA, 21 nt, Human
uggcacuuuuucauuugccua

SEQ ID NO: 2628777 - RNA, 16 nt, Human
uggcacuuuuucauuu

SEQ ID NO: 2628778 - RNA, 16 nt, Human
uggcacuuugaagggg

SEQ ID NO: 2628779 - RNA, 11 nt, Human
uggcacuuuga

SEQ ID NO: 2628780 - RNA, 20 nt, Human
uggcagaagacaccagagca

SEQ ID NO: 2628781 - RNA, 18 nt, Human
uggcagaagacaccagag

SEQ ID NO: 2628782 - RNA, 14 nt, Human
uggcagaagacacc

SEQ ID NO: 2628783 - RNA, 13 nt, Human
uggcagaagacac

SEQ ID NO: 2628784 - RNA, 14 nt, Human
uggcagaacugagc

SEQ ID NO: 2628785 - RNA, 23 nt, Human
uggcagaaagcaaaugugaccug

SEQ ID NO: 2628786 - RNA, 16 nt, Human
uggcagaacugagcuc

SEQ ID NO: 2628787 - RNA, 20 nt, Human
uggcagaacugagcuccucu

SEQ ID NO: 2628788 - RNA, 21 nt, Human
uggcagaacugagcuccucug

SEQ ID NO: 2628789 - RNA, 16 nt, Human
uggagacuuagggcac

SEQ ID NO: 2628790 - RNA, 17 nt, Human
uggagacugucucaaga

SEQ ID NO: 2628791 - RNA, 21 nt, Human
uggagacuuagggcaccaggg

SEQ ID NO: 2628792 - RNA, 12 nt, Human
uggagagaaaac

SEQ ID NO: 2628793 - RNA, 22 nt, Human
uggagagaaacaauaaagagau

SEQ ID NO: 2628794 - RNA, 21 nt, Human
uggagagaaacaauaaagaga

SEQ ID NO: 2628795 - RNA, 12 nt, Human
uggagagaaggc

SEQ ID NO: 2628796 - RNA, 13 nt, Human
uggagagaaguuu

SEQ ID NO: 2628797 - RNA, 11 nt, Human
uggagagaagu

SEQ ID NO: 2628798 - RNA, 21 nt, Human
uggagagaaggccucccuagc

SEQ ID NO: 2628799 - RNA, 15 nt, Human
uggagagaaggccuc

SEQ ID NO: 2628800 - RNA, 23 nt, Human
uggagagaaguuucuggcccugg

SEQ ID NO: 2628801 - RNA, 12 nt, Human
uggagagagggg

SEQ ID NO: 2628802 - RNA, 13 nt, Human
uggagagagggga

SEQ ID NO: 2628803 - RNA, 17 nt, Human
uggaauuauuuuaaaag

SEQ ID NO: 2628804 - RNA, 14 nt, Human
uggacagccccacc

SEQ ID NO: 2628805 - RNA, 16 nt, Human
uggacaggcauguucu

SEQ ID NO: 2628806 - RNA, 12 nt, Human
uggacaggcaug

SEQ ID NO: 2628807 - RNA, 21 nt, Human
uggagagcccggcgccccugc

SEQ ID NO: 2628808 - RNA, 22 nt, Human
uggagaggagggaugcugccug

SEQ ID NO: 2628809 - RNA, 20 nt, Human
uggagagccagaaccuggag

SEQ ID NO: 2628810 - RNA, 19 nt, Human
uggagagccagaaccugga

SEQ ID NO: 2628811 - RNA, 18 nt, Human
uggagagccagaaccugg

SEQ ID NO: 2628812 - RNA, 20 nt, Human
uggagaggcccggccucuca

SEQ ID NO: 2628813 - RNA, 21 nt, Human
uggagaggagggaugcugccu

SEQ ID NO: 2628814 - RNA, 16 nt, Human
uggagaggcccucugg

SEQ ID NO: 2628815 - RNA, 23 nt, Human
uggagaggagggaugcugccuga

SEQ ID NO: 2628816 - RNA, 18 nt, Human
uggagaggcccucuggag

SEQ ID NO: 2628817 - RNA, 19 nt, Human
uggagagggaugaggugcu

SEQ ID NO: 2628818 - RNA, 13 nt, Human
uggagagggauga

SEQ ID NO: 2628819 - RNA, 22 nt, Human
uggagagguuauaggucacucc

SEQ ID NO: 2628820 - RNA, 21 nt, Human
uggagagggaugaggugcugg

SEQ ID NO: 2628821 - RNA, 15 nt, Human
uggagaguaaaaacu

SEQ ID NO: 2628822 - RNA, 17 nt, Human
uggagagugcaacagua

SEQ ID NO: 2628823 - RNA, 20 nt, Human
uggagagugcaacaguagca

SEQ ID NO: 2628824 - RNA, 19 nt, Human
uggagauguuuuagaguua

SEQ ID NO: 2628825 - RNA, 23 nt, Human
uggagaugucuucguacaguucu

SEQ ID NO: 2628826 - RNA, 22 nt, Human
uggagaugucuucguacaguuc

SEQ ID NO: 2628827 - RNA, 19 nt, Human
uggagauuugaaggucugc

SEQ ID NO: 2628828 - RNA, 11 nt, Human
uggagauguuu

SEQ ID NO: 2628829 - RNA, 13 nt, Human
uggagauguuuag

SEQ ID NO: 2628830 - RNA, 21 nt, Human
uggagaguucaauggcugcug

SEQ ID NO: 2628831 - RNA, 19 nt, Human
uggagaguucaauggcugc

SEQ ID NO: 2628832 - RNA, 23 nt, Human
uggagaguucaauggcugcugaa

SEQ ID NO: 2628833 - RNA, 13 nt, Human
uggagaugcagag

SEQ ID NO: 2628834 - RNA, 14 nt, Human
uggagaugcagagg

SEQ ID NO: 2628835 - RNA, 16 nt, Human
uggagaugggaugcuu

SEQ ID NO: 2628836 - RNA, 13 nt, Human
uggagaugucuuc

SEQ ID NO: 2628837 - RNA, 18 nt, Human
uggagaugggaugcuugc

SEQ ID NO: 2628838 - RNA, 13 nt, Human
uggaggcugucuu

SEQ ID NO: 2628839 - RNA, 17 nt, Human
uggaggcuuccugcguc

SEQ ID NO: 2628840 - RNA, 16 nt, Human
uggaggcuuccugcgu

SEQ ID NO: 2628841 - RNA, 15 nt, Human
uggaggcuuccugcg

SEQ ID NO: 2628842 - RNA, 14 nt, Human
uggaggcugucuuc

SEQ ID NO: 2628843 - RNA, 22 nt, Human
uggaggcugucuucucaggcuc

SEQ ID NO: 2628844 - RNA, 13 nt, Human
uggaggcuuccug

SEQ ID NO: 2628845 - RNA, 23 nt, Human
uggaggcugucuucucaggcucu

SEQ ID NO: 2628846 - RNA, 15 nt, Human
uggaggcccaguuca

SEQ ID NO: 2628847 - RNA, 19 nt, Human
uggaggccgggugcucagg

SEQ ID NO: 2628848 - RNA, 21 nt, Human
uggaggccgggugcucagggc

SEQ ID NO: 2628849 - RNA, 12 nt, Human
uggaggcccagu

SEQ ID NO: 2628850 - RNA, 22 nt, Human
uggaggccauugugugagccua

SEQ ID NO: 2628851 - RNA, 22 nt, Human
uggaggcaugugaugagaggaa

SEQ ID NO: 2628852 - RNA, 14 nt, Human
uggaggccagccag

SEQ ID NO: 2628853 - RNA, 15 nt, Human
uggaggccagccagu

SEQ ID NO: 2628854 - RNA, 22 nt, Human
uggagauuugaaggucugcaag

SEQ ID NO: 2628855 - RNA, 17 nt, Human
uggaggcacacagcugc

SEQ ID NO: 2628856 - RNA, 15 nt, Human
uggagcaaagcugau

SEQ ID NO: 2628857 - RNA, 19 nt, Human
uggaggcacacagcugcag

SEQ ID NO: 2628858 - RNA, 18 nt, Human
uggaggcacacagcugca

SEQ ID NO: 2628859 - RNA, 13 nt, Human
uggaggcacuuua

SEQ ID NO: 2628860 - RNA, 14 nt, Human
uggaggcagggccu

SEQ ID NO: 2628861 - RNA, 22 nt, Human
uggaggcagggccuugcccaga

SEQ ID NO: 2628862 - RNA, 14 nt, Human
uggaggcacuuuag

SEQ ID NO: 2628863 - RNA, 22 nt, Human
uggaggcacacagcugcagaga

SEQ ID NO: 2628864 - RNA, 19 nt, Human
uggaugaagauucuccugu

SEQ ID NO: 2628865 - RNA, 18 nt, Human
uggaugaaauuuucuaga

SEQ ID NO: 2628866 - RNA, 17 nt, Human
uggaugaaauuuucuag

SEQ ID NO: 2628867 - RNA, 15 nt, Human
uggaugaaauuuucu

SEQ ID NO: 2628868 - RNA, 14 nt, Human
uggauauaaauaua

SEQ ID NO: 2628869 - RNA, 14 nt, Human
uggaugaaauuuuc

SEQ ID NO: 2628870 - RNA, 23 nt, Human
uggaugaagauucuccugugcua

SEQ ID NO: 2628871 - RNA, 22 nt, Human
uggaugaagauucuccugugcu

SEQ ID NO: 2628872 - RNA, 13 nt, Human
uggaugaccagaa

SEQ ID NO: 2628873 - RNA, 15 nt, Human
uggaugagcccucag

SEQ ID NO: 2628874 - RNA, 20 nt, Human
uggaugaccagaacaagguu

SEQ ID NO: 2628875 - RNA, 20 nt, Human
uggaugagacuuccaaaccu

SEQ ID NO: 2628876 - RNA, 17 nt, Human
uggaugagcccucagaa

SEQ ID NO: 2628877 - RNA, 20 nt, Human
uggaugauggucuucagccu

SEQ ID NO: 2628878 - RNA, 21 nt, Human
uggaugauggucuucagccuc

SEQ ID NO: 2628879 - RNA, 12 nt, Human
uggaugauguuu

SEQ ID NO: 2628880 - RNA, 17 nt, Human
uggauauaaauauauau

SEQ ID NO: 2628881 - RNA, 13 nt, Human
uggauauaaauau

SEQ ID NO: 2628882 - RNA, 12 nt, Human
uggauauaaaua

SEQ ID NO: 2628883 - RNA, 18 nt, Human
uggaucuucaauggcuuu

SEQ ID NO: 2628884 - RNA, 16 nt, Human
uggauaggagccugcu

SEQ ID NO: 2628885 - RNA, 18 nt, Human
uggauacauacaccagca

SEQ ID NO: 2628886 - RNA, 18 nt, Human
uggauaaugcuguugccu

SEQ ID NO: 2628887 - RNA, 17 nt, Human
uggauacugcccggggc

SEQ ID NO: 2628888 - RNA, 22 nt, Human
uggauacugcccggggcagcug

SEQ ID NO: 2628889 - RNA, 15 nt, Human
uggaauuauuuuaaa

SEQ ID NO: 2628890 - RNA, 21 nt, Human
uggaauuaaccuggugcugga

SEQ ID NO: 2628891 - RNA, 23 nt, Human
uggaauguggccccugaacaaga

SEQ ID NO: 2628892 - RNA, 16 nt, Human
uggaauuaaccuggug

SEQ ID NO: 2628893 - RNA, 17 nt, Human
uggaauuaaccuggugc

SEQ ID NO: 2628894 - RNA, 18 nt, Human
uggaauuaaccuggugcu

SEQ ID NO: 2628895 - RNA, 19 nt, Human
uggaauuaaccuggugcug

SEQ ID NO: 2628896 - RNA, 20 nt, Human
uggaauuaaccuggugcugg

SEQ ID NO: 2628897 - RNA, 17 nt, Human
uggaaucuggagaccag

SEQ ID NO: 2628898 - RNA, 18 nt, Human
uggaaucuggagaccagg

SEQ ID NO: 2628899 - RNA, 21 nt, Human
uggaaugguuauaaaagugau

SEQ ID NO: 2628900 - RNA, 15 nt, Human
uggaaucuggagagc

SEQ ID NO: 2628901 - RNA, 21 nt, Human
uggaauguggccccugaacaa

SEQ ID NO: 2628902 - RNA, 14 nt, Human
uggaauguaaucaa

SEQ ID NO: 2628903 - RNA, 22 nt, Human
uggaaucaggaauauuuuccaa

SEQ ID NO: 2628904 - RNA, 21 nt, Human
uggaaucaggaauauuuucca

SEQ ID NO: 2628905 - RNA, 23 nt, Human
uggaaucaggaauauuuuccaaa

SEQ ID NO: 2628906 - RNA, 13 nt, Human
uggaaucuggaga

SEQ ID NO: 2628907 - RNA, 19 nt, Human
uggaaucuaccaacuguuu

SEQ ID NO: 2628908 - RNA, 12 nt, Human
uggaaucuggag

SEQ ID NO: 2628909 - RNA, 20 nt, Human
uggaauaguauccuccaggu

SEQ ID NO: 2628910 - RNA, 19 nt, Human
uggaauaguauccuccagg

SEQ ID NO: 2628911 - RNA, 18 nt, Human
uggaauaguauccuccag

SEQ ID NO: 2628912 - RNA, 17 nt, Human
uggaauaguauccucca

SEQ ID NO: 2628913 - RNA, 21 nt, Human
uggaauaguauccuccagguu

SEQ ID NO: 2628914 - RNA, 15 nt, Human
uggaauauuguccau

SEQ ID NO: 2628915 - RNA, 20 nt, Human
uggaauauuguccauugucc

SEQ ID NO: 2628916 - RNA, 23 nt, Human
uggaauauuccccuaucucuaga

SEQ ID NO: 2628917 - RNA, 21 nt, Human
uggaagugugggucugugugu

SEQ ID NO: 2628918 - RNA, 14 nt, Human
uggaagacagcucu

SEQ ID NO: 2628919 - RNA, 18 nt, Human
uggaaguugcauggcauc

SEQ ID NO: 2628920 - RNA, 16 nt, Human
uggaaguugcauggca

SEQ ID NO: 2628921 - RNA, 11 nt, Human
uggaaguugca

SEQ ID NO: 2628922 - RNA, 23 nt, Human
uggaagacagagaccuccugccu

SEQ ID NO: 2628923 - RNA, 20 nt, Human
uggaagacagagaccuccug

SEQ ID NO: 2628924 - RNA, 23 nt, Human
uggaagugugggucugugugugu

SEQ ID NO: 2628925 - RNA, 21 nt, Human
uggaagugugugaucuguggg

SEQ ID NO: 2628926 - RNA, 12 nt, Human
uggaauacuuuu

SEQ ID NO: 2628927 - RNA, 13 nt, Human
uggaauacuuuuu

SEQ ID NO: 2628928 - RNA, 18 nt, Human
uggaauacuuuuuguuau

SEQ ID NO: 2628929 - RNA, 20 nt, Human
uggaauacuaaaaaucauga

SEQ ID NO: 2628930 - RNA, 22 nt, Human
uggaauacuaaaaaucaugaga

SEQ ID NO: 2628931 - RNA, 15 nt, Human
uggaauacaugaaau

SEQ ID NO: 2628932 - RNA, 14 nt, Human
uggaauacauuucu

SEQ ID NO: 2628933 - RNA, 22 nt, Human
uggaauacaguguuauuuucuu

SEQ ID NO: 2628934 - RNA, 14 nt, Human
uggaauacaugaaa

SEQ ID NO: 2628935 - RNA, 14 nt, Human
uggaauacaguguu

SEQ ID NO: 2628936 - RNA, 15 nt, Human
uggaauacaguguua

SEQ ID NO: 2628937 - RNA, 13 nt, Human
uggaaguuuucag

SEQ ID NO: 2628938 - RNA, 15 nt, Human
uggaaguuuucagga

SEQ ID NO: 2628939 - RNA, 14 nt, Human
uggaauaauguaaa

SEQ ID NO: 2628940 - RNA, 13 nt, Human
uggaagacagaga

SEQ ID NO: 2628941 - RNA, 23 nt, Human
uggaacugucucucaugaaccuc

SEQ ID NO: 2628942 - RNA, 16 nt, Human
uggaacuuacauuguu

SEQ ID NO: 2628943 - RNA, 12 nt, Human
uggaagacagcu

SEQ ID NO: 2628944 - RNA, 11 nt, Human
uggaagacagc

SEQ ID NO: 2628945 - RNA, 14 nt, Human
uggaacucucgagc

SEQ ID NO: 2628946 - RNA, 18 nt, Human
uggaacccuuuuggcccc

SEQ ID NO: 2628947 - RNA, 19 nt, Human
uggaacccuuuuggccccc

SEQ ID NO: 2628948 - RNA, 21 nt, Human
uggaacccuuuuggcccccga

SEQ ID NO: 2628949 - RNA, 16 nt, Human
uggaaccgcaggaagc

SEQ ID NO: 2628950 - RNA, 17 nt, Human
uggaaccgcaggaagcu

SEQ ID NO: 2628951 - RNA, 19 nt, Human
uggaaccgcaggaagcugc

SEQ ID NO: 2628952 - RNA, 23 nt, Human
uggaaccgcaggaagcugcuccg

SEQ ID NO: 2628953 - RNA, 13 nt, Human
uggaacucugcuu

SEQ ID NO: 2628954 - RNA, 15 nt, Human
uggaaccucagccug

SEQ ID NO: 2628955 - RNA, 16 nt, Human
uggaaccucagccugg

SEQ ID NO: 2628956 - RNA, 20 nt, Human
uggaaccgcaggaagcugcu

SEQ ID NO: 2628957 - RNA, 17 nt, Human
uggaaaaagugauggag

SEQ ID NO: 2628958 - RNA, 12 nt, Human
uggaaaaaguga

SEQ ID NO: 2628959 - RNA, 22 nt, Human
uggaaaaaaugauguucauuua

SEQ ID NO: 2628960 - RNA, 15 nt, Human
uggaaaauaaaucaa

SEQ ID NO: 2628961 - RNA, 11 nt, Human
uggaaaauaaa

SEQ ID NO: 2628962 - RNA, 20 nt, Human
uggaaaaaccacccccaaau

SEQ ID NO: 2628963 - RNA, 23 nt, Human
uggaaaaacaucugaaagccacg

SEQ ID NO: 2628964 - RNA, 15 nt, Human
uggaaaauaaauuau

SEQ ID NO: 2628965 - RNA, 16 nt, Human
uggaaaauaaauuauu

SEQ ID NO: 2628966 - RNA, 22 nt, Human
uggaacccagacucagacauug

SEQ ID NO: 2628967 - RNA, 16 nt, Human
uggaacccagacucag

SEQ ID NO: 2628968 - RNA, 17 nt, Human
uggaacccagacucaga

SEQ ID NO: 2628969 - RNA, 14 nt, Human
uggaacccagacuc

SEQ ID NO: 2628970 - RNA, 15 nt, Human
uggaacccagacuca

SEQ ID NO: 2628971 - RNA, 12 nt, Human
uggaacccagac

SEQ ID NO: 2628972 - RNA, 14 nt, Human
ugcuucuguuuuau

SEQ ID NO: 2628973 - RNA, 22 nt, Human
ugcuucucugacuucugccugg

SEQ ID NO: 2628974 - RNA, 21 nt, Human
ugcuucucugacuucugccug

SEQ ID NO: 2628975 - RNA, 23 nt, Human
ugcuucucugacuucugccugga

SEQ ID NO: 2628976 - RNA, 16 nt, Human
ugcuucuucagagacu

SEQ ID NO: 2628977 - RNA, 13 nt, Human
ugcuucugggaga

SEQ ID NO: 2628978 - RNA, 14 nt, Human
ugcuucuucucagg

SEQ ID NO: 2628979 - RNA, 20 nt, Human
ugcuucucugacuucugccu

SEQ ID NO: 2628980 - RNA, 19 nt, Human
ugcuucucugacuucugcc

SEQ ID NO: 2628981 - RNA, 17 nt, Human
ugcuucucugacuucug

SEQ ID NO: 2628982 - RNA, 14 nt, Human
ugcuucucugacuu

SEQ ID NO: 2628983 - RNA, 22 nt, Human
ugcuucuaauauuuauugcuuu

SEQ ID NO: 2628984 - RNA, 20 nt, Human
ugcuuccagugaggcucugc

SEQ ID NO: 2628985 - RNA, 19 nt, Human
ugcuuccagugaggcucug

SEQ ID NO: 2628986 - RNA, 21 nt, Human
ugcuuccagugaggcucugcc

SEQ ID NO: 2628987 - RNA, 12 nt, Human
ugcugccucccc

SEQ ID NO: 2628988 - RNA, 13 nt, Human
ugcugccucccca

SEQ ID NO: 2628989 - RNA, 14 nt, Human
ugcugccuccccaa

SEQ ID NO: 2628990 - RNA, 17 nt, Human
ugcugccuccccaaccc

SEQ ID NO: 2628991 - RNA, 18 nt, Human
ugcuucgggcccuuccca

SEQ ID NO: 2628992 - RNA, 19 nt, Human
ugcugccuccccaacccug

SEQ ID NO: 2628993 - RNA, 15 nt, Human
ugcuucgggcccuuc

SEQ ID NO: 2628994 - RNA, 13 nt, Human
ugcugccuaggcu

SEQ ID NO: 2628995 - RNA, 18 nt, Human
ugcugccuaggcugaccu

SEQ ID NO: 2628996 - RNA, 20 nt, Human
ugcugccgccucccagccug

SEQ ID NO: 2628997 - RNA, 21 nt, Human
ugcugccgccucccagccugg

SEQ ID NO: 2628998 - RNA, 23 nt, Human
ugcugccgccccacccagauggg

SEQ ID NO: 2628999 - RNA, 21 nt, Human
ugcugccgccccacccagaug

SEQ ID NO: 2629000 - RNA, 16 nt, Human
ugcugccgccucccag

SEQ ID NO: 2629001 - RNA, 17 nt, Human
ugcugccgccucccagc

SEQ ID NO: 2629002 - RNA, 19 nt, Human
ugcugccgccucccagccu

SEQ ID NO: 2629003 - RNA, 18 nt, Human
ugcuuccagugaggcucu

SEQ ID NO: 2629004 - RNA, 13 nt, Human
ugcugccucaugc

SEQ ID NO: 2629005 - RNA, 14 nt, Human
ugcugccuccagaa

SEQ ID NO: 2629006 - RNA, 15 nt, Human
ugcuuuauuccagaa

SEQ ID NO: 2629007 - RNA, 17 nt, Human
ugcuuuauuccagaaug

SEQ ID NO: 2629008 - RNA, 14 nt, Human
ugcuuuauuccaga

SEQ ID NO: 2629009 - RNA, 14 nt, Human
ugcuuuaugcugaa

SEQ ID NO: 2629010 - RNA, 15 nt, Human
ugcuuuaugcugaaa

SEQ ID NO: 2629011 - RNA, 17 nt, Human
ugcuuuaugcugaaaca

SEQ ID NO: 2629012 - RNA, 17 nt, Human
ugcuuuuuuguuuuggc

SEQ ID NO: 2629013 - RNA, 14 nt, Human
ugcuuuccagcuca

SEQ ID NO: 2629014 - RNA, 13 nt, Human
ugcuuuccagcuc

SEQ ID NO: 2629015 - RNA, 12 nt, Human
ugcuuuccagcu

SEQ ID NO: 2629016 - RNA, 20 nt, Human
ugcuuuccacaccuggcacu

SEQ ID NO: 2629017 - RNA, 14 nt, Human
ugcuuuccaaagcc

SEQ ID NO: 2629018 - RNA, 20 nt, Human
ugcuuucagauuaaaauugu

SEQ ID NO: 2629019 - RNA, 19 nt, Human
ugcuuucaucuuggucaca

SEQ ID NO: 2629020 - RNA, 14 nt, Human
ugcuuuauaaauaa

SEQ ID NO: 2629021 - RNA, 12 nt, Human
ugcuuuauaaau

SEQ ID NO: 2629022 - RNA, 15 nt, Human
ugcuuuaugccuucu

SEQ ID NO: 2629023 - RNA, 13 nt, Human
ugcuuuaugcuga

SEQ ID NO: 2629024 - RNA, 17 nt, Human
ugcuuuaggcucacggc

SEQ ID NO: 2629025 - RNA, 22 nt, Human
ugcuuuagcuugaaaaggugac

SEQ ID NO: 2629026 - RNA, 13 nt, Human
ugcuuuagcuuga

SEQ ID NO: 2629027 - RNA, 12 nt, Human
ugcuuuaaacau

SEQ ID NO: 2629028 - RNA, 16 nt, Human
ugcuuuaaaaacuauu

SEQ ID NO: 2629029 - RNA, 13 nt, Human
ugcuuuaaaaacu

SEQ ID NO: 2629030 - RNA, 23 nt, Human
ugcuuuaaaaacuauuuaacuug

SEQ ID NO: 2629031 - RNA, 14 nt, Human
ugcuuguuuccuag

SEQ ID NO: 2629032 - RNA, 14 nt, Human
ugcuuguuuacagc

SEQ ID NO: 2629033 - RNA, 23 nt, Human
ugcuuguugggauuccugaccca

SEQ ID NO: 2629034 - RNA, 23 nt, Human
ugcuuguuugcucaccuggggug

SEQ ID NO: 2629035 - RNA, 22 nt, Human
ugcuuguugggauuccugaccc

SEQ ID NO: 2629036 - RNA, 19 nt, Human
ugcuuguugggauuccuga

SEQ ID NO: 2629037 - RNA, 15 nt, Human
ugcuuguugggauuc

SEQ ID NO: 2629038 - RNA, 14 nt, Human
ugcuuguuggauuu

SEQ ID NO: 2629039 - RNA, 14 nt, Human
ugcuucuuggaguc

SEQ ID NO: 2629040 - RNA, 21 nt, Human
ugcuucuucuccuauguguaa

SEQ ID NO: 2629041 - RNA, 16 nt, Human
ugcuucuucucaggca

SEQ ID NO: 2629042 - RNA, 15 nt, Human
ugcuucuuucauuuu

SEQ ID NO: 2629043 - RNA, 23 nt, Human
ugcuucuucuccuauguguaagg

SEQ ID NO: 2629044 - RNA, 22 nt, Human
ugcuugaaaaaugugcaaaaca

SEQ ID NO: 2629045 - RNA, 17 nt, Human
ugcuugaaaaaugugca

SEQ ID NO: 2629046 - RNA, 16 nt, Human
ugcuugaaaaaugugc

SEQ ID NO: 2629047 - RNA, 17 nt, Human
ugcuucuuucauuuucu

SEQ ID NO: 2629048 - RNA, 19 nt, Human
ugcuucuuucuuugggaau

SEQ ID NO: 2629049 - RNA, 18 nt, Human
ugcuuguuaacugagugc

SEQ ID NO: 2629050 - RNA, 14 nt, Human
ugcuugaaagaaaa

SEQ ID NO: 2629051 - RNA, 21 nt, Human
ugcuugaaagaaaauaugcau

SEQ ID NO: 2629052 - RNA, 16 nt, Human
ugcuuguucccucucc

SEQ ID NO: 2629053 - RNA, 19 nt, Human
ugcuuguucccucucccug

SEQ ID NO: 2629054 - RNA, 17 nt, Human
ugcuugaacccaggaga

SEQ ID NO: 2629055 - RNA, 16 nt, Human
ugggcauacuaauaaa

SEQ ID NO: 2629056 - RNA, 22 nt, Human
ugggcaguuuuucuguauuuua

SEQ ID NO: 2629057 - RNA, 18 nt, Human
ugggcaguuuuucuguau

SEQ ID NO: 2629058 - RNA, 17 nt, Human
ugggcaguuacaugcau

SEQ ID NO: 2629059 - RNA, 13 nt, Human
ugggaggagggag

SEQ ID NO: 2629060 - RNA, 20 nt, Human
ugggaggacggugcaaccca

SEQ ID NO: 2629061 - RNA, 14 nt, Human
ugggaggagggaga

SEQ ID NO: 2629062 - RNA, 21 nt, Human
ugggcaggugguggcacugag

SEQ ID NO: 2629063 - RNA, 15 nt, Human
ugggcaguuacaugc

SEQ ID NO: 2629064 - RNA, 23 nt, Human
ugggaggaagcagaauaaagcaa

SEQ ID NO: 2629065 - RNA, 22 nt, Human
ugggaggaagcagaauaaagca

SEQ ID NO: 2629066 - RNA, 21 nt, Human
ugggaggaagcagaauaaagc

SEQ ID NO: 2629067 - RNA, 20 nt, Human
ugggaggaagcagaauaaag

SEQ ID NO: 2629068 - RNA, 19 nt, Human
ugggaggacggugcaaccc

SEQ ID NO: 2629069 - RNA, 24 nt, Human
ugggaggaagcagguugaggggcu

SEQ ID NO: 2629070 - RNA, 19 nt, Human
ugggaggaagcagaauaaa

SEQ ID NO: 2629071 - RNA, 18 nt, Human
ugggaggaagcagaauaa

SEQ ID NO: 2629072 - RNA, 17 nt, Human
ugggaggaagcagaaua

SEQ ID NO: 2629073 - RNA, 16 nt, Human
ugggaggaagcagaau

SEQ ID NO: 2629074 - RNA, 15 nt, Human
ugggaggaagcagaa

SEQ ID NO: 2629075 - RNA, 14 nt, Human
ugggaggaagcaga

SEQ ID NO: 2629076 - RNA, 13 nt, Human
ugggaggaagcag

SEQ ID NO: 2629077 - RNA, 20 nt, Human
ugggagcugguuagaaaugc

SEQ ID NO: 2629078 - RNA, 18 nt, Human
ugggagcugguuagaaau

SEQ ID NO: 2629079 - RNA, 17 nt, Human
ugggagcugaaaaauca

SEQ ID NO: 2629080 - RNA, 24 nt, Human
ugggagcugccuguucagcuccag

SEQ ID NO: 2629081 - RNA, 19 nt, Human
ugggagcugguuagaaaug

SEQ ID NO: 2629082 - RNA, 16 nt, Human
ugggagcuugggaaug

SEQ ID NO: 2629083 - RNA, 20 nt, Human
ugggagcuugauucucagca

SEQ ID NO: 2629084 - RNA, 12 nt, Human
ugggaggaaaag

SEQ ID NO: 2629085 - RNA, 20 nt, Human
ugggaggaaaagaaaagagg

SEQ ID NO: 2629086 - RNA, 11 nt, Human
ugggaggaagc

SEQ ID NO: 2629087 - RNA, 12 nt, Human
ugggaggaagca

SEQ ID NO: 2629088 - RNA, 15 nt, Human
ugggaggaaauuuga

SEQ ID NO: 2629089 - RNA, 14 nt, Human
ugggccuugcuggg

SEQ ID NO: 2629090 - RNA, 15 nt, Human
ugggccuucagggag

SEQ ID NO: 2629091 - RNA, 12 nt, Human
ugggccuugcug

SEQ ID NO: 2629092 - RNA, 13 nt, Human
ugggccuugcuac

SEQ ID NO: 2629093 - RNA, 18 nt, Human
ugggccuucagggaguga

SEQ ID NO: 2629094 - RNA, 18 nt, Human
ugggccuccucuguccag

SEQ ID NO: 2629095 - RNA, 20 nt, Human
ugggccuccucuguccaggg

SEQ ID NO: 2629096 - RNA, 22 nt, Human
ugggccuccugugugugcgccu

SEQ ID NO: 2629097 - RNA, 16 nt, Human
ugggccuccugugugu

SEQ ID NO: 2629098 - RNA, 21 nt, Human
ugggcauggggugggccucug

SEQ ID NO: 2629099 - RNA, 20 nt, Human
ugggcauggggugggccucu

SEQ ID NO: 2629100 - RNA, 15 nt, Human
ugggcaugggguggg

SEQ ID NO: 2629101 - RNA, 13 nt, Human
ugggcauggggug

SEQ ID NO: 2629102 - RNA, 15 nt, Human
ugggcaucuguucug

SEQ ID NO: 2629103 - RNA, 22 nt, Human
ugggcauagaugcaggugagcc

SEQ ID NO: 2629104 - RNA, 16 nt, Human
ugggcauagaugcagg

SEQ ID NO: 2629105 - RNA, 21 nt, Human
ugggcauacuaauaaaguaug

SEQ ID NO: 2629106 - RNA, 17 nt, Human
ugggcaucuguucuggu

SEQ ID NO: 2629107 - RNA, 16 nt, Human
ugggcaucuguucugg

SEQ ID NO: 2629108 - RNA, 22 nt, Human
ugggcauggggugggccucugg

SEQ ID NO: 2629109 - RNA, 14 nt, Human
ugggccuccugugu

SEQ ID NO: 2629110 - RNA, 21 nt, Human
ugggcuuggggaccagagcug

SEQ ID NO: 2629111 - RNA, 16 nt, Human
uggggcagcuugaggg

SEQ ID NO: 2629112 - RNA, 18 nt, Human
ugggcuuggccugcugug

SEQ ID NO: 2629113 - RNA, 17 nt, Human
ugggcuuggccugcugu

SEQ ID NO: 2629114 - RNA, 19 nt, Human
ugggcuuggccugcuguga

SEQ ID NO: 2629115 - RNA, 19 nt, Human
ugggcuuggggaccagagc

SEQ ID NO: 2629116 - RNA, 16 nt, Human
ugggcggggccuugcg

SEQ ID NO: 2629117 - RNA, 16 nt, Human
ugggcuuggccugcug

SEQ ID NO: 2629118 - RNA, 15 nt, Human
ugggcuuggccugcu

SEQ ID NO: 2629119 - RNA, 20 nt, Human
ugggcuucaguggcagcugc

SEQ ID NO: 2629120 - RNA, 20 nt, Human
ugggcgcccuggaagccggc

SEQ ID NO: 2629121 - RNA, 16 nt, Human
ugggcgcccuggaagc

SEQ ID NO: 2629122 - RNA, 15 nt, Human
ugggcgcccuggaag

SEQ ID NO: 2629123 - RNA, 15 nt, Human
ugggcggcacagccu

SEQ ID NO: 2629124 - RNA, 17 nt, Human
ugggcgcccuggaagcc

SEQ ID NO: 2629125 - RNA, 19 nt, Human
ugggcgggcagcacagcaa

SEQ ID NO: 2629126 - RNA, 18 nt, Human
ugggcgggcagcacagca

SEQ ID NO: 2629127 - RNA, 13 nt, Human
ugggcgggcagca

SEQ ID NO: 2629128 - RNA, 21 nt, Human
ugggcggcugagagccccagc

SEQ ID NO: 2629129 - RNA, 18 nt, Human
ugggcggcugagagcccc

SEQ ID NO: 2629130 - RNA, 16 nt, Human
ugggcggcugagagcc

SEQ ID NO: 2629131 - RNA, 15 nt, Human
ugggcggcugagagc

SEQ ID NO: 2629132 - RNA, 14 nt, Human
ugggcggcugagag

SEQ ID NO: 2629133 - RNA, 12 nt, Human
ugggcggcugag

SEQ ID NO: 2629134 - RNA, 19 nt, Human
ugggcggcagagaggacug

SEQ ID NO: 2629135 - RNA, 15 nt, Human
ugggcggcagagagg

SEQ ID NO: 2629136 - RNA, 13 nt, Human
ugggcggcagaga

SEQ ID NO: 2629137 - RNA, 19 nt, Human
ugggcuucaguggcagcug

SEQ ID NO: 2629138 - RNA, 18 nt, Human
ugggcuucaguggcagcu

SEQ ID NO: 2629139 - RNA, 18 nt, Human
ugggcgugagaccugccc

SEQ ID NO: 2629140 - RNA, 19 nt, Human
ugggcgugagaccugcccc

SEQ ID NO: 2629141 - RNA, 17 nt, Human
ugggcgugagaccugcc

SEQ ID NO: 2629142 - RNA, 15 nt, Human
ugggcggggccuugc

SEQ ID NO: 2629143 - RNA, 14 nt, Human
ugggcggggccuug

SEQ ID NO: 2629144 - RNA, 16 nt, Human
uggguucacugcaacc

SEQ ID NO: 2629145 - RNA, 17 nt, Human
uggguuauucuggaguu

SEQ ID NO: 2629146 - RNA, 16 nt, Human
uggguuauucuggagu

SEQ ID NO: 2629147 - RNA, 15 nt, Human
uggguuauucuggag

SEQ ID NO: 2629148 - RNA, 15 nt, Human
uggguuaugaauauu

SEQ ID NO: 2629149 - RNA, 21 nt, Human
uggguucagaaaugcugccug

SEQ ID NO: 2629150 - RNA, 20 nt, Human
uggguucagaaaugcugccu

SEQ ID NO: 2629151 - RNA, 24 nt, Human
uggguucaggggacucagcccuga

SEQ ID NO: 2629152 - RNA, 18 nt, Human
uggguguccaaaggaaga

SEQ ID NO: 2629153 - RNA, 14 nt, Human
uggguguggcgcag

SEQ ID NO: 2629154 - RNA, 23 nt, Human
uggguucaagcgauucuucugcu

SEQ ID NO: 2629155 - RNA, 15 nt, Human
uggguccaggggaug

SEQ ID NO: 2629156 - RNA, 20 nt, Human
uggguccaggggaugggagg

SEQ ID NO: 2629157 - RNA, 21 nt, Human
uggguccaggggaugggaggu

SEQ ID NO: 2629158 - RNA, 19 nt, Human
uggguccaggggccccucc

SEQ ID NO: 2629159 - RNA, 18 nt, Human
uggguccaggggccccuc

SEQ ID NO: 2629160 - RNA, 14 nt, Human
uggguccaugggca

SEQ ID NO: 2629161 - RNA, 17 nt, Human
uggguccaugggcagag

SEQ ID NO: 2629162 - RNA, 20 nt, Human
uggguguauuuauuuuccuc

SEQ ID NO: 2629163 - RNA, 21 nt, Human
uggguccaggggccccuccag

SEQ ID NO: 2629164 - RNA, 22 nt, Human
uggguguauuuauuuuccuccc

SEQ ID NO: 2629165 - RNA, 23 nt, Human
ugggugucaagagggucugagga

SEQ ID NO: 2629166 - RNA, 21 nt, Human
ugggugucaagagggucugag

SEQ ID NO: 2629167 - RNA, 17 nt, Human
uggguuggaaaacagua

SEQ ID NO: 2629168 - RNA, 23 nt, Human
uggguucuuuggaaggagugaga

SEQ ID NO: 2629169 - RNA, 21 nt, Human
uggguucugccugccagcugc

SEQ ID NO: 2629170 - RNA, 22 nt, Human
uggguucugccugccagcugca

SEQ ID NO: 2629171 - RNA, 17 nt, Human
uggguucuuuggaagga

SEQ ID NO: 2629172 - RNA, 14 nt, Human
uggguugacuuuca

SEQ ID NO: 2629173 - RNA, 23 nt, Human
uggguuggcgcacccuccccucc

SEQ ID NO: 2629174 - RNA, 22 nt, Human
uggguuggcgcacccuccccuc

SEQ ID NO: 2629175 - RNA, 17 nt, Human
uggguuggcgcacccuc

SEQ ID NO: 2629176 - RNA, 15 nt, Human
uggguuggcgcaccc

SEQ ID NO: 2629177 - RNA, 20 nt, Human
uggguuggugcacagugauu

SEQ ID NO: 2629178 - RNA, 19 nt, Human
uggguuggugcacagugau

SEQ ID NO: 2629179 - RNA, 15 nt, Human
uggguuggugcacag

SEQ ID NO: 2629180 - RNA, 16 nt, Human
uggguuucauauuucu

SEQ ID NO: 2629181 - RNA, 16 nt, Human
uggguuggugcuucua

SEQ ID NO: 2629182 - RNA, 22 nt, Human
uggguuucacaagugaaaaaca

SEQ ID NO: 2629183 - RNA, 21 nt, Human
uggguuccuuccucugagccu

SEQ ID NO: 2629184 - RNA, 22 nt, Human
uggguuccuuccucugagccuu

SEQ ID NO: 2629185 - RNA, 13 nt, Human
uggguuccucuuc

SEQ ID NO: 2629186 - RNA, 21 nt, Human
uggguuccucuuccccacucc

SEQ ID NO: 2629187 - RNA, 20 nt, Human
uggguucccuuuccuuccau

SEQ ID NO: 2629188 - RNA, 21 nt, Human
uggguuccagcaauucuccug

SEQ ID NO: 2629189 - RNA, 13 nt, Human
uggguucauuauu

SEQ ID NO: 2629190 - RNA, 16 nt, Human
uggguucauuauugga

SEQ ID NO: 2629191 - RNA, 18 nt, Human
uggguucauuauuggaau

SEQ ID NO: 2629192 - RNA, 20 nt, Human
uggguucauuauuggaauua

SEQ ID NO: 2629193 - RNA, 22 nt, Human
uggguucagaaaugcugccugc

SEQ ID NO: 2629194 - RNA, 11 nt, Human
uggguucauua

SEQ ID NO: 2629195 - RNA, 17 nt, Human
ugggguggggaccucag

SEQ ID NO: 2629196 - RNA, 19 nt, Human
ugggguggggggggugcug

SEQ ID NO: 2629197 - RNA, 11 nt, Human
uggggcagugg

SEQ ID NO: 2629198 - RNA, 17 nt, Human
uggggcaguagaagguc

SEQ ID NO: 2629199 - RNA, 22 nt, Human
uggggcagucaccugcccagau

SEQ ID NO: 2629200 - RNA, 12 nt, Human
uggggcaggcag

SEQ ID NO: 2629201 - RNA, 14 nt, Human
uggggcaggcagug

SEQ ID NO: 2629202 - RNA, 17 nt, Human
uggggcaggcuggcugg

SEQ ID NO: 2629203 - RNA, 16 nt, Human
uggguagacacacaug

SEQ ID NO: 2629204 - RNA, 17 nt, Human
uggguagacacacauga

SEQ ID NO: 2629205 - RNA, 22 nt, Human
ugggguggggggggugcugggc

SEQ ID NO: 2629206 - RNA, 21 nt, Human
ugggguggggggggugcuggg

SEQ ID NO: 2629207 - RNA, 18 nt, Human
ugggucaccccuccagga

SEQ ID NO: 2629208 - RNA, 12 nt, Human
uggguauaaaag

SEQ ID NO: 2629209 - RNA, 22 nt, Human
uggguagcuguaaggcaugaag

SEQ ID NO: 2629210 - RNA, 20 nt, Human
uggggugggccucugguuug

SEQ ID NO: 2629211 - RNA, 13 nt, Human
uggguagcuguaa

SEQ ID NO: 2629212 - RNA, 13 nt, Human
ugggucaggcagg

SEQ ID NO: 2629213 - RNA, 23 nt, Human
ugggucaguguccaaagcagggu

SEQ ID NO: 2629214 - RNA, 12 nt, Human
ugggucagucug

SEQ ID NO: 2629215 - RNA, 18 nt, Human
uggguccaaauaaaaacu

SEQ ID NO: 2629216 - RNA, 16 nt, Human
uggguccaaauaaaaa

SEQ ID NO: 2629217 - RNA, 14 nt, Human
uggguccaaauaaa

SEQ ID NO: 2629218 - RNA, 13 nt, Human
uggguccaaauaa

SEQ ID NO: 2629219 - RNA, 22 nt, Human
uggguccaaauaaaaacuaaau

SEQ ID NO: 2629220 - RNA, 21 nt, Human
uggcuuuuauuaaugcacuuu

SEQ ID NO: 2629221 - RNA, 20 nt, Human
uggcuuuuauuaaugcacuu

SEQ ID NO: 2629222 - RNA, 16 nt, Human
uggcuuuuagacagau

SEQ ID NO: 2629223 - RNA, 15 nt, Human
uggcuuuuagacaga

SEQ ID NO: 2629224 - RNA, 17 nt, Human
uggcuuuuauuaaugca

SEQ ID NO: 2629225 - RNA, 20 nt, Human
uggcuuugugauucaaucug

SEQ ID NO: 2629226 - RNA, 17 nt, Human
uggcuguccagugccca

SEQ ID NO: 2629227 - RNA, 15 nt, Human
uggcuguccagugcc

SEQ ID NO: 2629228 - RNA, 20 nt, Human
uggcuguagaaggagacaga

SEQ ID NO: 2629229 - RNA, 17 nt, Human
uggcuguaucuuguuuu

SEQ ID NO: 2629230 - RNA, 14 nt, Human
uggcugucagcagg

SEQ ID NO: 2629231 - RNA, 12 nt, Human
uggcuguccagu

SEQ ID NO: 2629232 - RNA, 17 nt, Human
uggcugucagcaggaag

SEQ ID NO: 2629233 - RNA, 22 nt, Human
uggcugguuagagguucccuuu

SEQ ID NO: 2629234 - RNA, 14 nt, Human
uggcugggggccuc

SEQ ID NO: 2629235 - RNA, 21 nt, Human
ugggacagucaccucauggaa

SEQ ID NO: 2629236 - RNA, 20 nt, Human
ugggacagucaccucaugga

SEQ ID NO: 2629237 - RNA, 18 nt, Human
ugggacagucaccucaug

SEQ ID NO: 2629238 - RNA, 21 nt, Human
ugggaauguauuauucugcag

SEQ ID NO: 2629239 - RNA, 16 nt, Human
ugggaaugcggcaaga

SEQ ID NO: 2629240 - RNA, 17 nt, Human
ugggaaugaggugggag

SEQ ID NO: 2629241 - RNA, 14 nt, Human
ugggaaugaggugg

SEQ ID NO: 2629242 - RNA, 22 nt, Human
ugggaaugaggcuugcugagag

SEQ ID NO: 2629243 - RNA, 18 nt, Human
ugggaaugaggcuugcug

SEQ ID NO: 2629244 - RNA, 17 nt, Human
ugggaaugaggcuugcu

SEQ ID NO: 2629245 - RNA, 15 nt, Human
ugggaaugagacaua

SEQ ID NO: 2629246 - RNA, 22 nt, Human
uggcuuuuauuaaugcacuuuc

SEQ ID NO: 2629247 - RNA, 14 nt, Human
uggcuuuucacugc

SEQ ID NO: 2629248 - RNA, 22 nt, Human
ugggaaugaaugucagugugac

SEQ ID NO: 2629249 - RNA, 16 nt, Human
ugggaccaaaccuagc

SEQ ID NO: 2629250 - RNA, 17 nt, Human
ugggaccaaaccuagcc

SEQ ID NO: 2629251 - RNA, 19 nt, Human
ugggaccacgugagaucau

SEQ ID NO: 2629252 - RNA, 23 nt, Human
ugggagcacuggagugcagggag

SEQ ID NO: 2629253 - RNA, 13 nt, Human
ugggagcacugga

SEQ ID NO: 2629254 - RNA, 12 nt, Human
ugggagcacugg

SEQ ID NO: 2629255 - RNA, 21 nt, Human
ugggaccgccagauggggccu

SEQ ID NO: 2629256 - RNA, 19 nt, Human
ugggaccgccagauggggc

SEQ ID NO: 2629257 - RNA, 13 nt, Human
ugggacccuuucc

SEQ ID NO: 2629258 - RNA, 14 nt, Human
ugggacccuuuccu

SEQ ID NO: 2629259 - RNA, 17 nt, Human
ugggacccuuuccuucc

SEQ ID NO: 2629260 - RNA, 18 nt, Human
ugggacccuuuccuuccu

SEQ ID NO: 2629261 - RNA, 20 nt, Human
ugggacauuugcucauggaa

SEQ ID NO: 2629262 - RNA, 19 nt, Human
ugggacauuugcucaugga

SEQ ID NO: 2629263 - RNA, 16 nt, Human
ugggacaugggaaagg

SEQ ID NO: 2629264 - RNA, 22 nt, Human
ugggaauguauuauucugcagc

SEQ ID NO: 2629265 - RNA, 16 nt, Human
ugggacagggcauggc

SEQ ID NO: 2629266 - RNA, 14 nt, Human
ugggagccgggucu

SEQ ID NO: 2629267 - RNA, 18 nt, Human
ugggagccgggucugccu

SEQ ID NO: 2629268 - RNA, 22 nt, Human
ugggagccccagggucuucccu

SEQ ID NO: 2629269 - RNA, 23 nt, Human
ugggagccccagggucuucccua

SEQ ID NO: 2629270 - RNA, 12 nt, Human
ugggagccaggg

SEQ ID NO: 2629271 - RNA, 13 nt, Human
ugggagccccagg

SEQ ID NO: 2629272 - RNA, 14 nt, Human
ugggagccccaggg

SEQ ID NO: 2629273 - RNA, 16 nt, Human
ugggagccccaggguc

SEQ ID NO: 2629274 - RNA, 23 nt, Human
ugggagcaggagauugagaagga

SEQ ID NO: 2629275 - RNA, 22 nt, Human
ugggagcaggagauugagaagg

SEQ ID NO: 2629276 - RNA, 14 nt, Human
ugggagcaggagau

SEQ ID NO: 2629277 - RNA, 13 nt, Human
ugggagcaggaga

SEQ ID NO: 2629278 - RNA, 23 nt, Human
ugggagcagcccgcugaguggac

SEQ ID NO: 2629279 - RNA, 21 nt, Human
ugggagcagcgguuuggggag

SEQ ID NO: 2629280 - RNA, 17 nt, Human
ugggagcuccucuccug

SEQ ID NO: 2629281 - RNA, 16 nt, Human
ugggagcuccucuccu

SEQ ID NO: 2629282 - RNA, 15 nt, Human
ugggagcuccucucc

SEQ ID NO: 2629283 - RNA, 14 nt, Human
ugggagcuccucuc

SEQ ID NO: 2629284 - RNA, 13 nt, Human
ugggagcuccucu

SEQ ID NO: 2629285 - RNA, 20 nt, Human
ugggagcgugggaggcggga

SEQ ID NO: 2629286 - RNA, 22 nt, Human
ugggagcuccacucugcuucuc

SEQ ID NO: 2629287 - RNA, 19 nt, Human
ugggagcuccacucugcuu

SEQ ID NO: 2629288 - RNA, 16 nt, Human
ugggagcuccacucug

SEQ ID NO: 2629289 - RNA, 22 nt, Human
ugggagccugcaaacucacugc

SEQ ID NO: 2629290 - RNA, 20 nt, Human
ugggagccugcaaacucacu

SEQ ID NO: 2629291 - RNA, 23 nt, Human
ugggagccgggucugccucuucu

SEQ ID NO: 2629292 - RNA, 21 nt, Human
ugggagcuccucuccuggagg

SEQ ID NO: 2629293 - RNA, 20 nt, Human
ugggagcuccucuccuggag

SEQ ID NO: 2629294 - RNA, 19 nt, Human
ugggagcuccucuccugga

SEQ ID NO: 2629295 - RNA, 18 nt, Human
ugggagcuccucuccugg

SEQ ID NO: 2629296 - RNA, 23 nt, Human
ugggagcuccucuccuggaggau

SEQ ID NO: 2629297 - RNA, 22 nt, Human
ugggagcuccucuccuggagga

SEQ ID NO: 2629298 - RNA, 23 nt, Human
ugggagcugccuguucagcucca

SEQ ID NO: 2629299 - RNA, 12 nt, Human
uggcugggggcc

SEQ ID NO: 2629300 - RNA, 22 nt, Human
uggcuggggccuaucagugugc

SEQ ID NO: 2629301 - RNA, 21 nt, Human
uggcuggggccuaucagugug

SEQ ID NO: 2629302 - RNA, 20 nt, Human
uggcuggggccuaucagugu

SEQ ID NO: 2629303 - RNA, 16 nt, Human
uggcugggggcaggag

SEQ ID NO: 2629304 - RNA, 17 nt, Human
uggcugggggcaggagg

SEQ ID NO: 2629305 - RNA, 16 nt, Human
uggcucuuccaggcug

SEQ ID NO: 2629306 - RNA, 16 nt, Human
uggcugggcccagaag

SEQ ID NO: 2629307 - RNA, 22 nt, Human
uggcucuggagacagccccaga

SEQ ID NO: 2629308 - RNA, 15 nt, Human
uggcucuuccaggcu

SEQ ID NO: 2629309 - RNA, 13 nt, Human
uggcucuuccagg

SEQ ID NO: 2629310 - RNA, 21 nt, Human
uggcucgaaucucugugccuu

SEQ ID NO: 2629311 - RNA, 21 nt, Human
uggcucuggagacagccccag

SEQ ID NO: 2629312 - RNA, 19 nt, Human
uggcucucauugacuuccu

SEQ ID NO: 2629313 - RNA, 14 nt, Human
uggcucuggagaca

SEQ ID NO: 2629314 - RNA, 16 nt, Human
uggcucucagaaggua

SEQ ID NO: 2629315 - RNA, 20 nt, Human
uggcucgaaucucugugccu

SEQ ID NO: 2629316 - RNA, 19 nt, Human
uggcucgaaucucugugcc

SEQ ID NO: 2629317 - RNA, 18 nt, Human
uggcucgaaucucugugc

SEQ ID NO: 2629318 - RNA, 17 nt, Human
uggcuccuucccaucgc

SEQ ID NO: 2629319 - RNA, 19 nt, Human
uggcuccuucccaucgcug

SEQ ID NO: 2629320 - RNA, 16 nt, Human
uggcuccaaacccucg

SEQ ID NO: 2629321 - RNA, 18 nt, Human
uggcuccaaacccucgag

SEQ ID NO: 2629322 - RNA, 20 nt, Human
uggcuccaaacccucgaggc

SEQ ID NO: 2629323 - RNA, 21 nt, Human
uggcuccugaggggcaucugc

SEQ ID NO: 2629324 - RNA, 23 nt, Human
uggcuccugaggggcaucugccc

SEQ ID NO: 2629325 - RNA, 22 nt, Human
uggcucagguggggucacucug

SEQ ID NO: 2629326 - RNA, 19 nt, Human
uggcucauauuccugcagc

SEQ ID NO: 2629327 - RNA, 21 nt, Human
uggcucauauuccugcagccu

SEQ ID NO: 2629328 - RNA, 22 nt, Human
uggcucauauuccugcagccug

SEQ ID NO: 2629329 - RNA, 20 nt, Human
uggcucagguggggucacuc

SEQ ID NO: 2629330 - RNA, 18 nt, Human
uggcgugucccucucgga

SEQ ID NO: 2629331 - RNA, 16 nt, Human
uggccuuuuccuauuu

SEQ ID NO: 2629332 - RNA, 13 nt, Human
uggccuuuuccua

SEQ ID NO: 2629333 - RNA, 17 nt, Human
uggcgagaggaggggcc

SEQ ID NO: 2629334 - RNA, 13 nt, Human
uggcgcagugccu

SEQ ID NO: 2629335 - RNA, 18 nt, Human
uggcgcagugccucuggu

SEQ ID NO: 2629336 - RNA, 17 nt, Human
uggcgcagugccucugg

SEQ ID NO: 2629337 - RNA, 15 nt, Human
uggcgcagugccucu

SEQ ID NO: 2629338 - RNA, 17 nt, Human
uggcgccgucuccaggg

SEQ ID NO: 2629339 - RNA, 15 nt, Human
uggcgccgucuccag

SEQ ID NO: 2629340 - RNA, 18 nt, Human
uggcgccgucuccagggg

SEQ ID NO: 2629341 - RNA, 13 nt, Human
uggcgcuaggcau

SEQ ID NO: 2629342 - RNA, 14 nt, Human
uggcgcugccccug

SEQ ID NO: 2629343 - RNA, 15 nt, Human
uggcgcugccccugg

SEQ ID NO: 2629344 - RNA, 22 nt, Human
uggcgugcaguggugcgaucug

SEQ ID NO: 2629345 - RNA, 13 nt, Human
uggcgucugucuu

SEQ ID NO: 2629346 - RNA, 15 nt, Human
uggcgucugucuuca

SEQ ID NO: 2629347 - RNA, 17 nt, Human
uggcgucugucuucaag

SEQ ID NO: 2629348 - RNA, 20 nt, Human
uggcgucugucuucaagggc

SEQ ID NO: 2629349 - RNA, 22 nt, Human
uggcgucugucuucaagggcuu

SEQ ID NO: 2629350 - RNA, 17 nt, Human
uggccuucggccuccau

SEQ ID NO: 2629351 - RNA, 18 nt, Human
uggccuucggccuccauc

SEQ ID NO: 2629352 - RNA, 15 nt, Human
uggccagaugcacca

SEQ ID NO: 2629353 - RNA, 18 nt, Human
uggccagagcugggaggc

SEQ ID NO: 2629354 - RNA, 17 nt, Human
uggccagagcugggagg

SEQ ID NO: 2629355 - RNA, 15 nt, Human
uggccagagcuggga

SEQ ID NO: 2629356 - RNA, 14 nt, Human
uggccagagcuggg

SEQ ID NO: 2629357 - RNA, 23 nt, Human
uggccagagcugggaggcauggc

SEQ ID NO: 2629358 - RNA, 20 nt, Human
uggccagagcugggaggcau

SEQ ID NO: 2629359 - RNA, 14 nt, Human
uggccagaggcuug

SEQ ID NO: 2629360 - RNA, 20 nt, Human
uggccuuucauauuuuagcu

SEQ ID NO: 2629361 - RNA, 23 nt, Human
uggccuugcagcacucacacagg

SEQ ID NO: 2629362 - RNA, 24 nt, Human
uggccagagcugggaggcauggcc

SEQ ID NO: 2629363 - RNA, 20 nt, Human
ugcccacccccugcccugca

SEQ ID NO: 2629364 - RNA, 19 nt, Human
ugcccacccccugcccugc

SEQ ID NO: 2629365 - RNA, 18 nt, Human
ugcccacccccugcccug

SEQ ID NO: 2629366 - RNA, 16 nt, Human
ugcccacccccugccc

SEQ ID NO: 2629367 - RNA, 15 nt, Human
ugcccacccccugcc

SEQ ID NO: 2629368 - RNA, 14 nt, Human
ugcccacccccugc

SEQ ID NO: 2629369 - RNA, 13 nt, Human
ugcccacccccug

SEQ ID NO: 2629370 - RNA, 24 nt, Human
ugcccacccccucaagccaauccc

SEQ ID NO: 2629371 - RNA, 18 nt, Human
ugcccacccccucaagcc

SEQ ID NO: 2629372 - RNA, 15 nt, Human
ugcccacccccucaa

SEQ ID NO: 2629373 - RNA, 14 nt, Human
ugcccacccccuca

SEQ ID NO: 2629374 - RNA, 13 nt, Human
ugcccacccccuc

SEQ ID NO: 2629375 - RNA, 11 nt, Human
ugcccaccccc

SEQ ID NO: 2629376 - RNA, 19 nt, Human
ugcccaccccacccccacc

SEQ ID NO: 2629377 - RNA, 17 nt, Human
ugcccaccccaccccca

SEQ ID NO: 2629378 - RNA, 16 nt, Human
ugcccaccccaccccc

SEQ ID NO: 2629379 - RNA, 17 nt, Human
ugcccaccuggccucug

SEQ ID NO: 2629380 - RNA, 15 nt, Human
ugcccaccuggccuc

SEQ ID NO: 2629381 - RNA, 18 nt, Human
ugcccaccuggccucugc

SEQ ID NO: 2629382 - RNA, 20 nt, Human
ugcccacccguggagauggg

SEQ ID NO: 2629383 - RNA, 14 nt, Human
ugcccaccuggccu

SEQ ID NO: 2629384 - RNA, 19 nt, Human
ugcccagagggcccaggca

SEQ ID NO: 2629385 - RNA, 10 nt, Human
ugcccagccc

SEQ ID NO: 2629386 - RNA, 20 nt, Human
ugcccagagggcccaggcag

SEQ ID NO: 2629387 - RNA, 21 nt, Human
ugcccagagggcccaggcagg

SEQ ID NO: 2629388 - RNA, 23 nt, Human
ugcccagagggcccaggcaggcc

SEQ ID NO: 2629389 - RNA, 15 nt, Human
ugcccagaguugcug

SEQ ID NO: 2629390 - RNA, 19 nt, Human
ugcccacccguggagaugg

SEQ ID NO: 2629391 - RNA, 16 nt, Human
ugcccacaucccaggc

SEQ ID NO: 2629392 - RNA, 23 nt, Human
ugccaugggcuucacuguauaaa

SEQ ID NO: 2629393 - RNA, 22 nt, Human
ugccaugggcuucacuguauaa

SEQ ID NO: 2629394 - RNA, 21 nt, Human
ugcccacaggccgcccugcgg

SEQ ID NO: 2629395 - RNA, 23 nt, Human
ugcccacaucccaggcuucaccc

SEQ ID NO: 2629396 - RNA, 13 nt, Human
ugcccaccccacc

SEQ ID NO: 2629397 - RNA, 12 nt, Human
ugcccaccccac

SEQ ID NO: 2629398 - RNA, 17 nt, Human
ugcccaccaacauccca

SEQ ID NO: 2629399 - RNA, 23 nt, Human
ugcccaccaacaucccauugccc

SEQ ID NO: 2629400 - RNA, 20 nt, Human
ugccaugggcuucacuguau

SEQ ID NO: 2629401 - RNA, 19 nt, Human
ugccaugggcuucacugua

SEQ ID NO: 2629402 - RNA, 18 nt, Human
ugccaugggcuucacugu

SEQ ID NO: 2629403 - RNA, 17 nt, Human
ugccauggcgugucccu

SEQ ID NO: 2629404 - RNA, 23 nt, Human
ugccauggaggcacacagcugca

SEQ ID NO: 2629405 - RNA, 18 nt, Human
ugccauggaggcacacag

SEQ ID NO: 2629406 - RNA, 17 nt, Human
ugccauggaggcacaca

SEQ ID NO: 2629407 - RNA, 16 nt, Human
ugccauggaggcacac

SEQ ID NO: 2629408 - RNA, 23 nt, Human
ugccauggacagaagaaggcagc

SEQ ID NO: 2629409 - RNA, 22 nt, Human
ugccaucugcgugacaauaaaa

SEQ ID NO: 2629410 - RNA, 16 nt, Human
ugccaucugugggcac

SEQ ID NO: 2629411 - RNA, 18 nt, Human
ugccaucugugggcacgc

SEQ ID NO: 2629412 - RNA, 13 nt, Human
ugccaucuuccca

SEQ ID NO: 2629413 - RNA, 16 nt, Human
ugccaugcagggccuc

SEQ ID NO: 2629414 - RNA, 20 nt, Human
ugccauggacagaagaaggc

SEQ ID NO: 2629415 - RNA, 18 nt, Human
ugccauggacagaagaag

SEQ ID NO: 2629416 - RNA, 22 nt, Human
ugccagggacagaggggguggc

SEQ ID NO: 2629417 - RNA, 11 nt, Human
ugccagggaca

SEQ ID NO: 2629418 - RNA, 11 nt, Human
ugccagggcag

SEQ ID NO: 2629419 - RNA, 17 nt, Human
ugccagggcaaugauga

SEQ ID NO: 2629420 - RNA, 22 nt, Human
ugccagggcaaugaugaaugag

SEQ ID NO: 2629421 - RNA, 18 nt, Human
ugccagggagacagagcu

SEQ ID NO: 2629422 - RNA, 15 nt, Human
ugccagggagacaga

SEQ ID NO: 2629423 - RNA, 11 nt, Human
ugccagggagc

SEQ ID NO: 2629424 - RNA, 12 nt, Human
ugccagggagcu

SEQ ID NO: 2629425 - RNA, 22 nt, Human
ugccaccccacccucccuggag

SEQ ID NO: 2629426 - RNA, 21 nt, Human
ugccaccccacccucccugga

SEQ ID NO: 2629427 - RNA, 20 nt, Human
ugccaccccacccucccugg

SEQ ID NO: 2629428 - RNA, 19 nt, Human
ugccaccccacccucccug

SEQ ID NO: 2629429 - RNA, 17 nt, Human
ugccaccccacccuccc

SEQ ID NO: 2629430 - RNA, 16 nt, Human
ugccaccccacccucc

SEQ ID NO: 2629431 - RNA, 15 nt, Human
ugccaccccacccuc

SEQ ID NO: 2629432 - RNA, 14 nt, Human
ugccaccccacccu

SEQ ID NO: 2629433 - RNA, 23 nt, Human
ugccaccccacccucccuggagu

SEQ ID NO: 2629434 - RNA, 22 nt, Human
ugccacccaccucccugccucc

SEQ ID NO: 2629435 - RNA, 20 nt, Human
ugccacccaccucccugccu

SEQ ID NO: 2629436 - RNA, 21 nt, Human
ugccacccaccucccugccuc

SEQ ID NO: 2629437 - RNA, 18 nt, Human
ugccacccaccucccugc

SEQ ID NO: 2629438 - RNA, 19 nt, Human
ugccacccaccucccugcc

SEQ ID NO: 2629439 - RNA, 17 nt, Human
ugccacccaccucccug

SEQ ID NO: 2629440 - RNA, 16 nt, Human
ugccacccaccucccu

SEQ ID NO: 2629441 - RNA, 23 nt, Human
ugccauccucaaacacugcaggc

SEQ ID NO: 2629442 - RNA, 19 nt, Human
ugccauccucaaacacugc

SEQ ID NO: 2629443 - RNA, 11 nt, Human
ugccauccuca

SEQ ID NO: 2629444 - RNA, 14 nt, Human
ugccagucaccccg

SEQ ID NO: 2629445 - RNA, 23 nt, Human
ugccaguaacgcgucuuccugag

SEQ ID NO: 2629446 - RNA, 22 nt, Human
ugccaguaacgcgucuuccuga

SEQ ID NO: 2629447 - RNA, 22 nt, Human
ugccaguaggcucaacuaggga

SEQ ID NO: 2629448 - RNA, 24 nt, Human
ugccagguuuuuggucugacccac

SEQ ID NO: 2629449 - RNA, 21 nt, Human
ugccaguaacgcgucuuccug

SEQ ID NO: 2629450 - RNA, 18 nt, Human
ugccaguaacgcgucuuc

SEQ ID NO: 2629451 - RNA, 22 nt, Human
ugcaucagcugcugaaacaaca

SEQ ID NO: 2629452 - RNA, 19 nt, Human
ugcaggcagccaggccaca

SEQ ID NO: 2629453 - RNA, 18 nt, Human
ugcaggcagccaggccac

SEQ ID NO: 2629454 - RNA, 17 nt, Human
ugcaggcagccaggcca

SEQ ID NO: 2629455 - RNA, 16 nt, Human
ugcaggaccugccugu

SEQ ID NO: 2629456 - RNA, 17 nt, Human
ugcaggaccugccugua

SEQ ID NO: 2629457 - RNA, 18 nt, Human
ugcaggaccugccuguag

SEQ ID NO: 2629458 - RNA, 19 nt, Human
ugcaggaccugccuguagc

SEQ ID NO: 2629459 - RNA, 13 nt, Human
ugcaggacuugag

SEQ ID NO: 2629460 - RNA, 15 nt, Human
ugcaggacuugagaa

SEQ ID NO: 2629461 - RNA, 18 nt, Human
ugcaggacuugagaagac

SEQ ID NO: 2629462 - RNA, 22 nt, Human
ugcaggagcaguaucaugaagc

SEQ ID NO: 2629463 - RNA, 16 nt, Human
ugcaggcagccaggcc

SEQ ID NO: 2629464 - RNA, 23 nt, Human
ugcaggaguuaaaaagggcaggg

SEQ ID NO: 2629465 - RNA, 17 nt, Human
ugcauccaacuccagga

SEQ ID NO: 2629466 - RNA, 16 nt, Human
ugcauccaacuccagg

SEQ ID NO: 2629467 - RNA, 13 nt, Human
ugcauccaacucc

SEQ ID NO: 2629468 - RNA, 18 nt, Human
ugcauccaaaggugcuca

SEQ ID NO: 2629469 - RNA, 16 nt, Human
ugcauccaaaggugcu

SEQ ID NO: 2629470 - RNA, 21 nt, Human
ugcauccuccgccucccgggu

SEQ ID NO: 2629471 - RNA, 15 nt, Human
ugcauccuccgccuc

SEQ ID NO: 2629472 - RNA, 18 nt, Human
ugcauccuccgccucccg

SEQ ID NO: 2629473 - RNA, 14 nt, Human
ugcauccauuccuc

SEQ ID NO: 2629474 - RNA, 16 nt, Human
ugcauccauuccucag

SEQ ID NO: 2629475 - RNA, 17 nt, Human
ugcauccauuccucagg

SEQ ID NO: 2629476 - RNA, 18 nt, Human
ugcauccauuccucaggg

SEQ ID NO: 2629477 - RNA, 16 nt, Human
ugcaugugaagaaagg

SEQ ID NO: 2629478 - RNA, 12 nt, Human
ugcaugugaaga

SEQ ID NO: 2629479 - RNA, 21 nt, Human
ugcaugucgugaccaacuaga

SEQ ID NO: 2629480 - RNA, 15 nt, Human
ugcaucguggagaca

SEQ ID NO: 2629481 - RNA, 14 nt, Human
ugcaucguggagac

SEQ ID NO: 2629482 - RNA, 16 nt, Human
ugcauguccuguaaag

SEQ ID NO: 2629483 - RNA, 13 nt, Human
ugcaugugacucu

SEQ ID NO: 2629484 - RNA, 14 nt, Human
ugcaugugacucug

SEQ ID NO: 2629485 - RNA, 15 nt, Human
ugcaugugacucuga

SEQ ID NO: 2629486 - RNA, 16 nt, Human
ugcaugugacucugaa

SEQ ID NO: 2629487 - RNA, 20 nt, Human
ugcaugugacucugaagcug

SEQ ID NO: 2629488 - RNA, 17 nt, Human
ugcaugugacucugaag

SEQ ID NO: 2629489 - RNA, 22 nt, Human
ugcaucgagucaaaacucaaau

SEQ ID NO: 2629490 - RNA, 18 nt, Human
ugcaucgagucaaaacuc

SEQ ID NO: 2629491 - RNA, 16 nt, Human
ugcauguaugucuugg

SEQ ID NO: 2629492 - RNA, 15 nt, Human
ugcaucguuucaucu

SEQ ID NO: 2629493 - RNA, 13 nt, Human
ugcauuaaauuca

SEQ ID NO: 2629494 - RNA, 14 nt, Human
ugcauuaaauucac

SEQ ID NO: 2629495 - RNA, 19 nt, Human
ugcauuaaaagaaaauaaa

SEQ ID NO: 2629496 - RNA, 15 nt, Human
ugcauuaaauucaca

SEQ ID NO: 2629497 - RNA, 16 nt, Human
ugcauuaaauucacaa

SEQ ID NO: 2629498 - RNA, 17 nt, Human
ugcauuaaauucacaaa

SEQ ID NO: 2629499 - RNA, 19 nt, Human
ugcauuaaauucacaaacu

SEQ ID NO: 2629500 - RNA, 19 nt, Human
ugcauguuacauaagauaa

SEQ ID NO: 2629501 - RNA, 11 nt, Human
ugcaugugugu

SEQ ID NO: 2629502 - RNA, 12 nt, Human
ugcaugugugcg

SEQ ID NO: 2629503 - RNA, 13 nt, Human
ugcaugugugugc

SEQ ID NO: 2629504 - RNA, 14 nt, Human
ugcaugugugugcu

SEQ ID NO: 2629505 - RNA, 15 nt, Human
ugcauuauauuuauu

SEQ ID NO: 2629506 - RNA, 20 nt, Human
ugcauuaaauucacaaacuu

SEQ ID NO: 2629507 - RNA, 21 nt, Human
ugcauuaaauucacaaacuuu

SEQ ID NO: 2629508 - RNA, 11 nt, Human
ugcauuacaga

SEQ ID NO: 2629509 - RNA, 12 nt, Human
ugcauuacagag

SEQ ID NO: 2629510 - RNA, 15 nt, Human
ugcauuacagagagg

SEQ ID NO: 2629511 - RNA, 20 nt, Human
ugcauuauauuuauuacugu

SEQ ID NO: 2629512 - RNA, 21 nt, Human
ugcauuauauuuauuacugua

SEQ ID NO: 2629513 - RNA, 22 nt, Human
ugcauuuuguuugguauuguau

SEQ ID NO: 2629514 - RNA, 14 nt, Human
ugccaagacaugau

SEQ ID NO: 2629515 - RNA, 23 nt, Human
ugccaacuguuguaacuaggcuc

SEQ ID NO: 2629516 - RNA, 21 nt, Human
ugccaacuucuucagagcuga

SEQ ID NO: 2629517 - RNA, 20 nt, Human
ugccaaccuguaauaaauau

SEQ ID NO: 2629518 - RNA, 19 nt, Human
ugccaaccuguaauaaaua

SEQ ID NO: 2629519 - RNA, 18 nt, Human
ugccaaccuguaauaaau

SEQ ID NO: 2629520 - RNA, 16 nt, Human
ugccaaccucuggagc

SEQ ID NO: 2629521 - RNA, 22 nt, Human
ugccaaccuguaauaaauauga

SEQ ID NO: 2629522 - RNA, 21 nt, Human
ugccaaccuguaauaaauaug

SEQ ID NO: 2629523 - RNA, 23 nt, Human
ugccaaccuguaauaaauaugag

SEQ ID NO: 2629524 - RNA, 19 nt, Human
ugcauuuuugugaaaugaa

SEQ ID NO: 2629525 - RNA, 18 nt, Human
ugcauuacagagaggaga

SEQ ID NO: 2629526 - RNA, 14 nt, Human
ugcauuuuugugaa

SEQ ID NO: 2629527 - RNA, 16 nt, Human
ugcauuuuugugaaau

SEQ ID NO: 2629528 - RNA, 17 nt, Human
ugcauuuuugugaaaug

SEQ ID NO: 2629529 - RNA, 23 nt, Human
ugcauuuuguuugguauuguauu

SEQ ID NO: 2629530 - RNA, 16 nt, Human
ugcauuacagagagga

SEQ ID NO: 2629531 - RNA, 17 nt, Human
ugcauuacagagaggag

SEQ ID NO: 2629532 - RNA, 20 nt, Human
ugccaaaaaaagacagggcu

SEQ ID NO: 2629533 - RNA, 14 nt, Human
ugcaccucccccca

SEQ ID NO: 2629534 - RNA, 15 nt, Human
ugcaccuccccccac

SEQ ID NO: 2629535 - RNA, 16 nt, Human
ugcaccuccccccacu

SEQ ID NO: 2629536 - RNA, 17 nt, Human
ugcaccuccccccacug

SEQ ID NO: 2629537 - RNA, 18 nt, Human
ugcaccuccccccacugc

SEQ ID NO: 2629538 - RNA, 19 nt, Human
ugcaccuccccccacugca

SEQ ID NO: 2629539 - RNA, 20 nt, Human
ugcaccuccccccacugcag

SEQ ID NO: 2629540 - RNA, 11 nt, Human
ugcaccugcau

SEQ ID NO: 2629541 - RNA, 15 nt, Human
ugcaccugccagccu

SEQ ID NO: 2629542 - RNA, 16 nt, Human
ugcaccugccagccug

SEQ ID NO: 2629543 - RNA, 17 nt, Human
ugcaccugccagccugg

SEQ ID NO: 2629544 - RNA, 18 nt, Human
ugcaccugccagccuggc

SEQ ID NO: 2629545 - RNA, 19 nt, Human
ugcaccugccagccuggcu

SEQ ID NO: 2629546 - RNA, 20 nt, Human
ugcaccugccagccuggcuu

SEQ ID NO: 2629547 - RNA, 15 nt, Human
ugcacaucaaaauau

SEQ ID NO: 2629548 - RNA, 18 nt, Human
ugcacauauggacucugc

SEQ ID NO: 2629549 - RNA, 17 nt, Human
ugcacauauggacucug

SEQ ID NO: 2629550 - RNA, 15 nt, Human
ugcacauauggacuc

SEQ ID NO: 2629551 - RNA, 14 nt, Human
ugcacauauggacu

SEQ ID NO: 2629552 - RNA, 15 nt, Human
ugcacaucugugucu

SEQ ID NO: 2629553 - RNA, 16 nt, Human
ugcacaucugugucuu

SEQ ID NO: 2629554 - RNA, 18 nt, Human
ugcacaucugugucuugu

SEQ ID NO: 2629555 - RNA, 19 nt, Human
ugcacaucugugucuuguu

SEQ ID NO: 2629556 - RNA, 15 nt, Human
ugcacaucucugcuu

SEQ ID NO: 2629557 - RNA, 14 nt, Human
ugcacaucucugcu

SEQ ID NO: 2629558 - RNA, 19 nt, Human
ugcacauauggacucugca

SEQ ID NO: 2629559 - RNA, 23 nt, Human
ugcacaguuuucuggcuggagcc

SEQ ID NO: 2629560 - RNA, 22 nt, Human
ugcacaguuagcaaacuuugua

SEQ ID NO: 2629561 - RNA, 24 nt, Human
ugcacaguuuucuggcuggagccu

SEQ ID NO: 2629562 - RNA, 21 nt, Human
ugcacauacgcaccacaucuc

SEQ ID NO: 2629563 - RNA, 22 nt, Human
ugcacauagcuaucaagugugc

SEQ ID NO: 2629564 - RNA, 15 nt, Human
ugcacauacuugaga

SEQ ID NO: 2629565 - RNA, 20 nt, Human
ugcacagugcaucucagccc

SEQ ID NO: 2629566 - RNA, 19 nt, Human
ugcacagugcaucucagcc

SEQ ID NO: 2629567 - RNA, 16 nt, Human
ugcacagggagacgua

SEQ ID NO: 2629568 - RNA, 14 nt, Human
ugcacagggagacg

SEQ ID NO: 2629569 - RNA, 12 nt, Human
ugcacagggcag

SEQ ID NO: 2629570 - RNA, 18 nt, Human
ugcacagggcagcugggc

SEQ ID NO: 2629571 - RNA, 17 nt, Human
ugcacagggcagcuggg

SEQ ID NO: 2629572 - RNA, 16 nt, Human
ugcacagggcagcugg

SEQ ID NO: 2629573 - RNA, 15 nt, Human
ugcacagggcagcug

SEQ ID NO: 2629574 - RNA, 18 nt, Human
ugcacagugcaucucagc

SEQ ID NO: 2629575 - RNA, 20 nt, Human
ugcacagcuaacauggaagu

SEQ ID NO: 2629576 - RNA, 18 nt, Human
ugcacagcuaacauggaa

SEQ ID NO: 2629577 - RNA, 23 nt, Human
ugcacagcuaacauggaaguacu

SEQ ID NO: 2629578 - RNA, 17 nt, Human
ugcacagcguccugucc

SEQ ID NO: 2629579 - RNA, 18 nt, Human
ugcacagcggccccugca

SEQ ID NO: 2629580 - RNA, 16 nt, Human
ugcacagcggccccug

SEQ ID NO: 2629581 - RNA, 17 nt, Human
ugcacagcuaacaugga

SEQ ID NO: 2629582 - RNA, 23 nt, Human
ugcacagaguuguuacauuuuua

SEQ ID NO: 2629583 - RNA, 19 nt, Human
ugcacagagcucuccagcu

SEQ ID NO: 2629584 - RNA, 19 nt, Human
ugcacagauggauuugccu

SEQ ID NO: 2629585 - RNA, 23 nt, Human
ugcacagauggauuugccugugc

SEQ ID NO: 2629586 - RNA, 21 nt, Human
ugcacagaguuguuacauuuu

SEQ ID NO: 2629587 - RNA, 22 nt, Human
ugcacagaguuguuacauuuuu

SEQ ID NO: 2629588 - RNA, 20 nt, Human
ugcacagagcucuccagcuc

SEQ ID NO: 2629589 - RNA, 18 nt, Human
ugcacagagcucuccagc

SEQ ID NO: 2629590 - RNA, 16 nt, Human
ugcacagagcucucca

SEQ ID NO: 2629591 - RNA, 14 nt, Human
ugcacagagcucuc

SEQ ID NO: 2629592 - RNA, 13 nt, Human
ugcacagagcucu

SEQ ID NO: 2629593 - RNA, 12 nt, Human
ugcacagagcuc

SEQ ID NO: 2629594 - RNA, 19 nt, Human
ugcacagacgucccuccac

SEQ ID NO: 2629595 - RNA, 22 nt, Human
ugaagucuuuguacagacaaca

SEQ ID NO: 2629596 - RNA, 14 nt, Human
ugaagucugaaauu

SEQ ID NO: 2629597 - RNA, 21 nt, Human
ugcacacuugugugugggcug

SEQ ID NO: 2629598 - RNA, 22 nt, Human
ugcacacuuugccauauuuuca

SEQ ID NO: 2629599 - RNA, 14 nt, Human
ugcacacuuugcca

SEQ ID NO: 2629600 - RNA, 23 nt, Human
ugcacacuugugugugggcugug

SEQ ID NO: 2629601 - RNA, 20 nt, Human
ugaagucuuuguacagacaa

SEQ ID NO: 2629602 - RNA, 17 nt, Human
ugaagucuuuguacaga

SEQ ID NO: 2629603 - RNA, 13 nt, Human
ugaagucugaaau

SEQ ID NO: 2629604 - RNA, 12 nt, Human
ugaagucugaaa

SEQ ID NO: 2629605 - RNA, 11 nt, Human
ugaagucugaa

SEQ ID NO: 2629606 - RNA, 17 nt, Human
ugaagucguugugaggg

SEQ ID NO: 2629607 - RNA, 16 nt, Human
ugaagucguugugagg

SEQ ID NO: 2629608 - RNA, 21 nt, Human
ugaagucgucuuaacucacca

SEQ ID NO: 2629609 - RNA, 19 nt, Human
ugaagucucugaagugaaa

SEQ ID NO: 2629610 - RNA, 16 nt, Human
ugcacguacacacaca

SEQ ID NO: 2629611 - RNA, 21 nt, Human
ugcacggugggccuugcuggg

SEQ ID NO: 2629612 - RNA, 23 nt, Human
ugcacggugggccuugcugggga

SEQ ID NO: 2629613 - RNA, 22 nt, Human
ugcaccugccagccuggcuucu

SEQ ID NO: 2629614 - RNA, 18 nt, Human
ugcacggugggccuugcu

SEQ ID NO: 2629615 - RNA, 18 nt, Human
ugcaccugcauccguagu

SEQ ID NO: 2629616 - RNA, 16 nt, Human
ugcacuugcagacucu

SEQ ID NO: 2629617 - RNA, 21 nt, Human
ugcacuugcagacucuacaga

SEQ ID NO: 2629618 - RNA, 20 nt, Human
ugcacuugugauuauuuauu

SEQ ID NO: 2629619 - RNA, 17 nt, Human
ugcacuugugauuauuu

SEQ ID NO: 2629620 - RNA, 16 nt, Human
ugcacuuggcugcaua

SEQ ID NO: 2629621 - RNA, 14 nt, Human
ugcacuuggccucu

SEQ ID NO: 2629622 - RNA, 15 nt, Human
ugcacuuggccucug

SEQ ID NO: 2629623 - RNA, 17 nt, Human
ugcacuuggccucugga

SEQ ID NO: 2629624 - RNA, 20 nt, Human
ugcacuuuguucuggcucuu

SEQ ID NO: 2629625 - RNA, 19 nt, Human
ugcacuuuguucuggcucu

SEQ ID NO: 2629626 - RNA, 18 nt, Human
ugcacuuuguucuggcuc

SEQ ID NO: 2629627 - RNA, 15 nt, Human
ugcacuuuguucugg

SEQ ID NO: 2629628 - RNA, 17 nt, Human
ugcagauaaacaguagu

SEQ ID NO: 2629629 - RNA, 18 nt, Human
ugcagagugcccagaacu

SEQ ID NO: 2629630 - RNA, 16 nt, Human
ugcagauaaacaguag

SEQ ID NO: 2629631 - RNA, 13 nt, Human
ugcagagucagca

SEQ ID NO: 2629632 - RNA, 14 nt, Human
ugcagagucagcag

SEQ ID NO: 2629633 - RNA, 15 nt, Human
ugcagagucagcaga

SEQ ID NO: 2629634 - RNA, 17 nt, Human
ugcagaguccugcacag

SEQ ID NO: 2629635 - RNA, 17 nt, Human
ugcagagucagcagaac

SEQ ID NO: 2629636 - RNA, 14 nt, Human
ugcagagugcccag

SEQ ID NO: 2629637 - RNA, 15 nt, Human
ugcagagugcccaga

SEQ ID NO: 2629638 - RNA, 18 nt, Human
ugcaggaccucaggugag

SEQ ID NO: 2629639 - RNA, 15 nt, Human
ugcaggaccugccug

SEQ ID NO: 2629640 - RNA, 16 nt, Human
ugcaggaauaaggccu

SEQ ID NO: 2629641 - RNA, 17 nt, Human
ugcaggaauaaggccuu

SEQ ID NO: 2629642 - RNA, 15 nt, Human
ugcaggaccucaggu

SEQ ID NO: 2629643 - RNA, 16 nt, Human
ugcaggaccucaggug

SEQ ID NO: 2629644 - RNA, 15 nt, Human
ugcagcuuuacaugc

SEQ ID NO: 2629645 - RNA, 17 nt, Human
ugcaggaaauggcugug

SEQ ID NO: 2629646 - RNA, 22 nt, Human
ugcagcuuuaaaaaauuaaucu

SEQ ID NO: 2629647 - RNA, 16 nt, Human
ugcagcuuuacaugca

SEQ ID NO: 2629648 - RNA, 14 nt, Human
ugcaggaccucagg

SEQ ID NO: 2629649 - RNA, 14 nt, Human
ugcagcaauaaagc

SEQ ID NO: 2629650 - RNA, 15 nt, Human
ugcagcaauaaagca

SEQ ID NO: 2629651 - RNA, 23 nt, Human
ugcagcauguugcugaggaguga

SEQ ID NO: 2629652 - RNA, 21 nt, Human
ugcagcauguugcugaggagu

SEQ ID NO: 2629653 - RNA, 20 nt, Human
ugcagcauguugcugaggag

SEQ ID NO: 2629654 - RNA, 18 nt, Human
ugcagcauguugcugagg

SEQ ID NO: 2629655 - RNA, 20 nt, Human
ugcagaguuuccaaaaccag

SEQ ID NO: 2629656 - RNA, 17 nt, Human
ugcagcauguugcugag

SEQ ID NO: 2629657 - RNA, 16 nt, Human
ugcagcaauaaagcag

SEQ ID NO: 2629658 - RNA, 13 nt, Human
ugcagcuuuaaaa

SEQ ID NO: 2629659 - RNA, 12 nt, Human
ugcagcccaugc

SEQ ID NO: 2629660 - RNA, 22 nt, Human
ugcagccagcccagcccagcug

SEQ ID NO: 2629661 - RNA, 14 nt, Human
ugcagccagcccag

SEQ ID NO: 2629662 - RNA, 15 nt, Human
ugcagccagcccagc

SEQ ID NO: 2629663 - RNA, 16 nt, Human
ugcagccagcccagcc

SEQ ID NO: 2629664 - RNA, 17 nt, Human
ugcagccagcccagccc

SEQ ID NO: 2629665 - RNA, 19 nt, Human
ugcagccagcccagcccag

SEQ ID NO: 2629666 - RNA, 21 nt, Human
ugcagccagcccagcccagcu

SEQ ID NO: 2629667 - RNA, 23 nt, Human
ugcagccagcccagcccagcugg

SEQ ID NO: 2629668 - RNA, 23 nt, Human
ugcagccagaccuauuccuccug

SEQ ID NO: 2629669 - RNA, 21 nt, Human
ugcagccagaccuauuccucc

SEQ ID NO: 2629670 - RNA, 14 nt, Human
ugcagccagaccua

SEQ ID NO: 2629671 - RNA, 13 nt, Human
ugcagccagaccu

SEQ ID NO: 2629672 - RNA, 12 nt, Human
ugcagccagccc

SEQ ID NO: 2629673 - RNA, 13 nt, Human
ugcagccagccca

SEQ ID NO: 2629674 - RNA, 18 nt, Human
ugccuccuuugugaggaa

SEQ ID NO: 2629675 - RNA, 17 nt, Human
ugccuccuuugugagga

SEQ ID NO: 2629676 - RNA, 19 nt, Human
ugccuccuuccaccucccu

SEQ ID NO: 2629677 - RNA, 17 nt, Human
ugccuccuuccaccucc

SEQ ID NO: 2629678 - RNA, 18 nt, Human
ugccuccccucuccuucc

SEQ ID NO: 2629679 - RNA, 16 nt, Human
ugccuccuuugugagg

SEQ ID NO: 2629680 - RNA, 21 nt, Human
ugccucuguccccuucucuca

SEQ ID NO: 2629681 - RNA, 20 nt, Human
ugccucuguccccuucucuc

SEQ ID NO: 2629682 - RNA, 17 nt, Human
ugccucuguccccuucu

SEQ ID NO: 2629683 - RNA, 16 nt, Human
ugccucuguccccuuc

SEQ ID NO: 2629684 - RNA, 13 nt, Human
ugccucugugcug

SEQ ID NO: 2629685 - RNA, 12 nt, Human
ugccucugugcu

SEQ ID NO: 2629686 - RNA, 11 nt, Human
ugccucugugc

SEQ ID NO: 2629687 - RNA, 15 nt, Human
ugccucuguccccuu

SEQ ID NO: 2629688 - RNA, 14 nt, Human
ugccucuguccccu

SEQ ID NO: 2629689 - RNA, 13 nt, Human
ugccucugucccc

SEQ ID NO: 2629690 - RNA, 14 nt, Human
ugccucugggacug

SEQ ID NO: 2629691 - RNA, 17 nt, Human
ugccugaagucacacag

SEQ ID NO: 2629692 - RNA, 18 nt, Human
ugccugaagucacacagu

SEQ ID NO: 2629693 - RNA, 22 nt, Human
ugccugaagucacacagugagu

SEQ ID NO: 2629694 - RNA, 16 nt, Human
ugccucugugcugugu

SEQ ID NO: 2629695 - RNA, 14 nt, Human
ugccucugugcugu

SEQ ID NO: 2629696 - RNA, 15 nt, Human
ugccugaauauuugu

SEQ ID NO: 2629697 - RNA, 19 nt, Human
ugccugaaguuggagugag

SEQ ID NO: 2629698 - RNA, 18 nt, Human
ugccugaggucuguacgu

SEQ ID NO: 2629699 - RNA, 16 nt, Human
ugccugaggucuguac

SEQ ID NO: 2629700 - RNA, 15 nt, Human
ugccugaggucugua

SEQ ID NO: 2629701 - RNA, 18 nt, Human
ugccugaggguggagacu

SEQ ID NO: 2629702 - RNA, 11 nt, Human
ugccugagggu

SEQ ID NO: 2629703 - RNA, 14 nt, Human
ugccugagggugga

SEQ ID NO: 2629704 - RNA, 14 nt, Human
ugccugauauaaau

SEQ ID NO: 2629705 - RNA, 16 nt, Human
ugccugagugccuggc

SEQ ID NO: 2629706 - RNA, 19 nt, Human
ugccugagucacccaugaa

SEQ ID NO: 2629707 - RNA, 20 nt, Human
ugccugauucggcugucuca

SEQ ID NO: 2629708 - RNA, 19 nt, Human
ugccugauucggcugucuc

SEQ ID NO: 2629709 - RNA, 18 nt, Human
ugccugauucggcugucu

SEQ ID NO: 2629710 - RNA, 15 nt, Human
ugccugauggaccug

SEQ ID NO: 2629711 - RNA, 18 nt, Human
ugccugauccagccucuc

SEQ ID NO: 2629712 - RNA, 22 nt, Human
ugccugauauuucccuccccug

SEQ ID NO: 2629713 - RNA, 15 nt, Human
ugccugauauaaaug

SEQ ID NO: 2629714 - RNA, 17 nt, Human
ugccugcacaaacucac

SEQ ID NO: 2629715 - RNA, 20 nt, Human
ugccugauugccaagcucag

SEQ ID NO: 2629716 - RNA, 15 nt, Human
ugccugauugccaag

SEQ ID NO: 2629717 - RNA, 21 nt, Human
ugccugauucggcugucucag

SEQ ID NO: 2629718 - RNA, 14 nt, Human
ugccugcagagaga

SEQ ID NO: 2629719 - RNA, 19 nt, Human
ugccuaaggcugaacuugu

SEQ ID NO: 2629720 - RNA, 19 nt, Human
ugcccagggcucagccugg

SEQ ID NO: 2629721 - RNA, 17 nt, Human
ugcccagggcucagccu

SEQ ID NO: 2629722 - RNA, 18 nt, Human
ugcccagggcucagccug

SEQ ID NO: 2629723 - RNA, 11 nt, Human
ugcccagggcu

SEQ ID NO: 2629724 - RNA, 14 nt, Human
ugcccagggcucag

SEQ ID NO: 2629725 - RNA, 15 nt, Human
ugcccagggcucagc

SEQ ID NO: 2629726 - RNA, 16 nt, Human
ugcccagggcucagcc

SEQ ID NO: 2629727 - RNA, 17 nt, Human
ugcccaggcuggucuca

SEQ ID NO: 2629728 - RNA, 19 nt, Human
ugcccagggccacucugcc

SEQ ID NO: 2629729 - RNA, 21 nt, Human
ugcccagggccacucugccuc

SEQ ID NO: 2629730 - RNA, 22 nt, Human
ugcccagggccacucugccucu

SEQ ID NO: 2629731 - RNA, 23 nt, Human
ugcccaggcuggcgugcaguggu

SEQ ID NO: 2629732 - RNA, 11 nt, Human
ugcccagcccc

SEQ ID NO: 2629733 - RNA, 16 nt, Human
ugcccagaucccagaa

SEQ ID NO: 2629734 - RNA, 17 nt, Human
ugcccagaucccagaag

SEQ ID NO: 2629735 - RNA, 22 nt, Human
ugcccagaucccagaaggaccu

SEQ ID NO: 2629736 - RNA, 17 nt, Human
ugccuccccucuccuuc

SEQ ID NO: 2629737 - RNA, 18 nt, Human
ugccuaggauugugccug

SEQ ID NO: 2629738 - RNA, 14 nt, Human
ugccuaggcugacc

SEQ ID NO: 2629739 - RNA, 18 nt, Human
ugccuaggcugaccuuga

SEQ ID NO: 2629740 - RNA, 17 nt, Human
ugccuagggccuggucc

SEQ ID NO: 2629741 - RNA, 18 nt, Human
ugccuagggccuggucca

SEQ ID NO: 2629742 - RNA, 14 nt, Human
ugccuaaguggcug

SEQ ID NO: 2629743 - RNA, 15 nt, Human
ugccuaaguggcugc

SEQ ID NO: 2629744 - RNA, 17 nt, Human
ugccuaaguggcugcug

SEQ ID NO: 2629745 - RNA, 18 nt, Human
ugccuaauaaacauccuu

SEQ ID NO: 2629746 - RNA, 21 nt, Human
ugccuaauaaacauccuucaa

SEQ ID NO: 2629747 - RNA, 12 nt, Human
ugccuacugcau

SEQ ID NO: 2629748 - RNA, 17 nt, Human
ugccuaggaauucccag

SEQ ID NO: 2629749 - RNA, 22 nt, Human
ugccuuauggaacacucugaga

SEQ ID NO: 2629750 - RNA, 21 nt, Human
ugccuuauggaacacucugag

SEQ ID NO: 2629751 - RNA, 20 nt, Human
ugccuuauggaacacucuga

SEQ ID NO: 2629752 - RNA, 18 nt, Human
ugccuuauggaacacucu

SEQ ID NO: 2629753 - RNA, 20 nt, Human
ugccuggccuggcacacauc

SEQ ID NO: 2629754 - RNA, 17 nt, Human
ugccuggccuggcacac

SEQ ID NO: 2629755 - RNA, 19 nt, Human
ugccuggcccccuguccuc

SEQ ID NO: 2629756 - RNA, 16 nt, Human
ugccuggccuggcaca

SEQ ID NO: 2629757 - RNA, 17 nt, Human
ugccuggcccccugucc

SEQ ID NO: 2629758 - RNA, 16 nt, Human
ugccuggcccccagcu

SEQ ID NO: 2629759 - RNA, 16 nt, Human
ugccugcagagagaag

SEQ ID NO: 2629760 - RNA, 15 nt, Human
ugccugcagagagaa

SEQ ID NO: 2629761 - RNA, 19 nt, Human
ugccugcacaaacucacca

SEQ ID NO: 2629762 - RNA, 23 nt, Human
ugccuggcaggcugucuggccag

SEQ ID NO: 2629763 - RNA, 12 nt, Human
ugccuggccagg

SEQ ID NO: 2629764 - RNA, 14 nt, Human
ugccuggccaggca

SEQ ID NO: 2629765 - RNA, 16 nt, Human
ugccuggccaggcaga

SEQ ID NO: 2629766 - RNA, 15 nt, Human
ugccuggcaggcugu

SEQ ID NO: 2629767 - RNA, 20 nt, Human
ugccuggccaggcagaucug

SEQ ID NO: 2629768 - RNA, 18 nt, Human
ugccuucagcucuacagc

SEQ ID NO: 2629769 - RNA, 17 nt, Human
ugccuucagcucuacag

SEQ ID NO: 2629770 - RNA, 17 nt, Human
ugccuucauuaccuuuu

SEQ ID NO: 2629771 - RNA, 16 nt, Human
ugccuucagauguucu

SEQ ID NO: 2629772 - RNA, 12 nt, Human
ugccuucauuug

SEQ ID NO: 2629773 - RNA, 19 nt, Human
ugccuucauuaccuuuuuu

SEQ ID NO: 2629774 - RNA, 13 nt, Human
ugccuuccacgcu

SEQ ID NO: 2629775 - RNA, 21 nt, Human
ugccuuauuagagugucuuuc

SEQ ID NO: 2629776 - RNA, 23 nt, Human
ugccuuauuagagugucuuucca

SEQ ID NO: 2629777 - RNA, 16 nt, Human
ugccuuauuaaaguuc

SEQ ID NO: 2629778 - RNA, 22 nt, Human
ugccuggccuggcacacaucag

SEQ ID NO: 2629779 - RNA, 14 nt, Human
ugccuucaauaaau

SEQ ID NO: 2629780 - RNA, 20 nt, Human
ugccuucaacuaaaaacaaa

SEQ ID NO: 2629781 - RNA, 13 nt, Human
ugccuucagcucu

SEQ ID NO: 2629782 - RNA, 17 nt, Human
ugccuucccuagcuuua

SEQ ID NO: 2629783 - RNA, 20 nt, Human
ugccuuccccugggcccuga

SEQ ID NO: 2629784 - RNA, 15 nt, Human
ugccuuccccugggc

SEQ ID NO: 2629785 - RNA, 21 nt, Human
ugccuuccaugucggccucua

SEQ ID NO: 2629786 - RNA, 20 nt, Human
ugccuuccaugucggccucu

SEQ ID NO: 2629787 - RNA, 14 nt, Human
ugccuucccuagcu

SEQ ID NO: 2629788 - RNA, 13 nt, Human
ugccuucccuagc

SEQ ID NO: 2629789 - RNA, 14 nt, Human
ugccuuccuccugg

SEQ ID NO: 2629790 - RNA, 15 nt, Human
ugccuuccuccuggg

SEQ ID NO: 2629791 - RNA, 16 nt, Human
ugccuuccuccugggc

SEQ ID NO: 2629792 - RNA, 18 nt, Human
ugccuuccagcacccugc

SEQ ID NO: 2629793 - RNA, 13 nt, Human
ugccuuccauaau

SEQ ID NO: 2629794 - RNA, 14 nt, Human
ugccuuccauaauu

SEQ ID NO: 2629795 - RNA, 17 nt, Human
ugccuuccauaauuaug

SEQ ID NO: 2629796 - RNA, 21 nt, Human
ugccuuccauaauuaugacag

SEQ ID NO: 2629797 - RNA, 23 nt, Human
ugccuuccacgcugucuccagac

SEQ ID NO: 2629798 - RNA, 21 nt, Human
ugccuuccacgcugucuccag

SEQ ID NO: 2629799 - RNA, 22 nt, Human
ugccuuccacgcugucuccaga

SEQ ID NO: 2629800 - RNA, 14 nt, Human
ugccuuccacgcug

SEQ ID NO: 2629801 - RNA, 17 nt, Human
ugccuuccacgcugucu

SEQ ID NO: 2629802 - RNA, 19 nt, Human
ugccuuccacgcugucucc

SEQ ID NO: 2629803 - RNA, 20 nt, Human
ugccuuccacgcugucucca

SEQ ID NO: 2629804 - RNA, 17 nt, Human
ugccuucgcuucuugcc

SEQ ID NO: 2629805 - RNA, 16 nt, Human
ugccuucgcuucuugc

SEQ ID NO: 2629806 - RNA, 14 nt, Human
ugccuucgcuucuu

SEQ ID NO: 2629807 - RNA, 13 nt, Human
ugccuucgcuucu

SEQ ID NO: 2629808 - RNA, 17 nt, Human
ugccuucucaacuccaa

SEQ ID NO: 2629809 - RNA, 12 nt, Human
ugccuuccuugc

SEQ ID NO: 2629810 - RNA, 20 nt, Human
ugccuucgcgguggaaggcc

SEQ ID NO: 2629811 - RNA, 16 nt, Human
ugccuucccuagcuuu

SEQ ID NO: 2629812 - RNA, 19 nt, Human
ugccuuccuguuuuucaca

SEQ ID NO: 2629813 - RNA, 15 nt, Human
ugccuuccuguuuuu

SEQ ID NO: 2629814 - RNA, 20 nt, Human
ugccuuccuccugggcccuc

SEQ ID NO: 2629815 - RNA, 17 nt, Human
ugccuuccuccugggcc

SEQ ID NO: 2629816 - RNA, 19 nt, Human
ugccuuccuccugggcccu

SEQ ID NO: 2629817 - RNA, 12 nt, Human
ugcgauucugga

SEQ ID NO: 2629818 - RNA, 22 nt, Human
ugcgauggcgugggcugcguga

SEQ ID NO: 2629819 - RNA, 18 nt, Human
ugcgaucuucagagcagg

SEQ ID NO: 2629820 - RNA, 17 nt, Human
ugcgaucuucagagcag

SEQ ID NO: 2629821 - RNA, 20 nt, Human
ugccuucuguccugguguca

SEQ ID NO: 2629822 - RNA, 18 nt, Human
ugccuucuguccuggugu

SEQ ID NO: 2629823 - RNA, 21 nt, Human
ugccuucuuauucucacucca

SEQ ID NO: 2629824 - RNA, 23 nt, Human
ugcgauucuggauaaagccacug

SEQ ID NO: 2629825 - RNA, 15 nt, Human
ugcgauucuggauaa

SEQ ID NO: 2629826 - RNA, 13 nt, Human
ugcgauucuggau

SEQ ID NO: 2629827 - RNA, 22 nt, Human
ugcgcacaaggcugaccaagag

SEQ ID NO: 2629828 - RNA, 22 nt, Human
ugccuucucaacuccaaacuga

SEQ ID NO: 2629829 - RNA, 17 nt, Human
ugccuucuguccuggug

SEQ ID NO: 2629830 - RNA, 12 nt, Human
ugccuucugucc

SEQ ID NO: 2629831 - RNA, 23 nt, Human
ugccuucuccagacaaaccagaa

SEQ ID NO: 2629832 - RNA, 21 nt, Human
ugcgguggcucacgccuguaa

SEQ ID NO: 2629833 - RNA, 24 nt, Human
ugcgccgagucugucucugucaug

SEQ ID NO: 2629834 - RNA, 17 nt, Human
ugcgccgagucugucuc

SEQ ID NO: 2629835 - RNA, 23 nt, Human
ugcggugcuaucucccccagccc

SEQ ID NO: 2629836 - RNA, 15 nt, Human
ugcgccgagucuguc

SEQ ID NO: 2629837 - RNA, 16 nt, Human
ugcgcccuuaccuucc

SEQ ID NO: 2629838 - RNA, 15 nt, Human
ugcgcccuuaccuuc

SEQ ID NO: 2629839 - RNA, 14 nt, Human
ugcgcccugggcuc

SEQ ID NO: 2629840 - RNA, 23 nt, Human
ugcgcccccuccgcccugccacu

SEQ ID NO: 2629841 - RNA, 13 nt, Human
ugcgccuacagga

SEQ ID NO: 2629842 - RNA, 13 nt, Human
ugcgcaggcuggc

SEQ ID NO: 2629843 - RNA, 16 nt, Human
ugcgcaggcuggcccu

SEQ ID NO: 2629844 - RNA, 17 nt, Human
ugcgcaggcuggcccug

SEQ ID NO: 2629845 - RNA, 17 nt, Human
ugcgccauugcacucca

SEQ ID NO: 2629846 - RNA, 19 nt, Human
ugcgauuuugccugugucu

SEQ ID NO: 2629847 - RNA, 21 nt, Human
ugcgauucuggauaaagccac

SEQ ID NO: 2629848 - RNA, 18 nt, Human
ugcgccauugcacuccag

SEQ ID NO: 2629849 - RNA, 20 nt, Human
ugcgcccaccccgcucugca

SEQ ID NO: 2629850 - RNA, 17 nt, Human
ugcgcccaccccgcucu

SEQ ID NO: 2629851 - RNA, 13 nt, Human
ugcgcccaccccg

SEQ ID NO: 2629852 - RNA, 21 nt, Human
ugcgccauugcacuccagccu

SEQ ID NO: 2629853 - RNA, 21 nt, Human
ugcgcccccuccgcccugcca

SEQ ID NO: 2629854 - RNA, 18 nt, Human
ugcgcccaguccuuccac

SEQ ID NO: 2629855 - RNA, 17 nt, Human
ugcgcccaguccuucca

SEQ ID NO: 2629856 - RNA, 21 nt, Human
ugcugaauaggcgaucacaac

SEQ ID NO: 2629857 - RNA, 18 nt, Human
ugcugaauaggcgaucac

SEQ ID NO: 2629858 - RNA, 11 nt, Human
ugcugaauagg

SEQ ID NO: 2629859 - RNA, 22 nt, Human
ugcugaagguggggauugccca

SEQ ID NO: 2629860 - RNA, 17 nt, Human
ugcugaaugguuuucaa

SEQ ID NO: 2629861 - RNA, 18 nt, Human
ugcugaaugguuuucaaa

SEQ ID NO: 2629862 - RNA, 22 nt, Human
ugcugaaugguuuucaaaauaa

SEQ ID NO: 2629863 - RNA, 22 nt, Human
ugcugaagggaccuugaagggu

SEQ ID NO: 2629864 - RNA, 13 nt, Human
ugcugaagggacc

SEQ ID NO: 2629865 - RNA, 19 nt, Human
ugcugaaaacuagcucgug

SEQ ID NO: 2629866 - RNA, 14 nt, Human
ugcugaaaauggua

SEQ ID NO: 2629867 - RNA, 18 nt, Human
ugcugaauacagaggcaa

SEQ ID NO: 2629868 - RNA, 23 nt, Human
ugcugaauacagaggcaacugca

SEQ ID NO: 2629869 - RNA, 22 nt, Human
ugcucuuucucugccagugaca

SEQ ID NO: 2629870 - RNA, 21 nt, Human
ugcucuuucucugccagugac

SEQ ID NO: 2629871 - RNA, 18 nt, Human
ugcucuuucucugccagu

SEQ ID NO: 2629872 - RNA, 17 nt, Human
ugcucuuucucugccag

SEQ ID NO: 2629873 - RNA, 21 nt, Human
ugcuccuugggcccuuugagu

SEQ ID NO: 2629874 - RNA, 14 nt, Human
ugcuccuuguuccu

SEQ ID NO: 2629875 - RNA, 16 nt, Human
ugcucuuucucugcca

SEQ ID NO: 2629876 - RNA, 15 nt, Human
ugcuccuuguuccua

SEQ ID NO: 2629877 - RNA, 15 nt, Human
ugcucuuucucugcc

SEQ ID NO: 2629878 - RNA, 15 nt, Human
ugcuccuugggcccu

SEQ ID NO: 2629879 - RNA, 16 nt, Human
ugcuccuugggcccuu

SEQ ID NO: 2629880 - RNA, 18 nt, Human
ugcuccuugggcccuuug

SEQ ID NO: 2629881 - RNA, 19 nt, Human
ugcuccuugggcccuuuga

SEQ ID NO: 2629882 - RNA, 12 nt, Human
ugcuccuugggc

SEQ ID NO: 2629883 - RNA, 14 nt, Human
ugcuccuugggccc

SEQ ID NO: 2629884 - RNA, 19 nt, Human
ugcuccuggcccacugcau

SEQ ID NO: 2629885 - RNA, 19 nt, Human
ugcuccuuccaacaggagc

SEQ ID NO: 2629886 - RNA, 20 nt, Human
ugcuccugggcuacaaggac

SEQ ID NO: 2629887 - RNA, 21 nt, Human
ugcuccuuccaacaggagcug

SEQ ID NO: 2629888 - RNA, 19 nt, Human
ugcugcaggggcucuggag

SEQ ID NO: 2629889 - RNA, 18 nt, Human
ugcugcaggggcucugga

SEQ ID NO: 2629890 - RNA, 17 nt, Human
ugcugcaggggcucugg

SEQ ID NO: 2629891 - RNA, 13 nt, Human
ugcugcaggggcu

SEQ ID NO: 2629892 - RNA, 16 nt, Human
ugcugcaguugccagu

SEQ ID NO: 2629893 - RNA, 15 nt, Human
ugcugcaguugccag

SEQ ID NO: 2629894 - RNA, 21 nt, Human
ugcugcaggacuugagaagac

SEQ ID NO: 2629895 - RNA, 23 nt, Human
ugcugcagaggggcaggcccugc

SEQ ID NO: 2629896 - RNA, 22 nt, Human
ugcugcaccaacccagccgcug

SEQ ID NO: 2629897 - RNA, 22 nt, Human
ugcugcagaggggcaggcccug

SEQ ID NO: 2629898 - RNA, 21 nt, Human
ugcugcagaggggcaggcccu

SEQ ID NO: 2629899 - RNA, 23 nt, Human
ugcugauguucaguguaauuucu

SEQ ID NO: 2629900 - RNA, 20 nt, Human
ugcugcaccaacccagccgc

SEQ ID NO: 2629901 - RNA, 17 nt, Human
ugcugauucucccguuc

SEQ ID NO: 2629902 - RNA, 23 nt, Human
ugcugauggugcaaugaccuuuc

SEQ ID NO: 2629903 - RNA, 20 nt, Human
ugcugauggugcaaugaccu

SEQ ID NO: 2629904 - RNA, 21 nt, Human
ugcugauguucaguguaauuu

SEQ ID NO: 2629905 - RNA, 20 nt, Human
ugcugauguucaguguaauu

SEQ ID NO: 2629906 - RNA, 18 nt, Human
ugcugauguucaguguaa

SEQ ID NO: 2629907 - RNA, 17 nt, Human
ugcugauguucagugua

SEQ ID NO: 2629908 - RNA, 16 nt, Human
ugcugauguucagugu

SEQ ID NO: 2629909 - RNA, 15 nt, Human
ugcugauguucagug

SEQ ID NO: 2629910 - RNA, 14 nt, Human
ugcugauguucagu

SEQ ID NO: 2629911 - RNA, 17 nt, Human
ugcugauguccucacca

SEQ ID NO: 2629912 - RNA, 13 nt, Human
ugcugauguucag

SEQ ID NO: 2629913 - RNA, 19 nt, Human
ugcugacagacacaggccc

SEQ ID NO: 2629914 - RNA, 16 nt, Human
ugcugacagacacagg

SEQ ID NO: 2629915 - RNA, 15 nt, Human
ugcugacagacacag

SEQ ID NO: 2629916 - RNA, 18 nt, Human
ugcugaauguugggacug

SEQ ID NO: 2629917 - RNA, 18 nt, Human
ugcugaauauacagcagg

SEQ ID NO: 2629918 - RNA, 20 nt, Human
ugcugaauguugggacugcu

SEQ ID NO: 2629919 - RNA, 14 nt, Human
ugcugaauuuucac

SEQ ID NO: 2629920 - RNA, 23 nt, Human
ugcugaauuuucacaugaacaua

SEQ ID NO: 2629921 - RNA, 22 nt, Human
ugcugaauuuucacaugaacau

SEQ ID NO: 2629922 - RNA, 17 nt, Human
ugcugaauuuucacaug

SEQ ID NO: 2629923 - RNA, 16 nt, Human
ugcugaauuuucacau

SEQ ID NO: 2629924 - RNA, 21 nt, Human
ugcugaugaacucuuaaucaa

SEQ ID NO: 2629925 - RNA, 15 nt, Human
ugcugaguugguguu

SEQ ID NO: 2629926 - RNA, 21 nt, Human
ugcuccuggagccuuugaaua

SEQ ID NO: 2629927 - RNA, 20 nt, Human
ugcuccuggagccuuugaau

SEQ ID NO: 2629928 - RNA, 14 nt, Human
ugcuccuggagccu

SEQ ID NO: 2629929 - RNA, 18 nt, Human
ugcucaucugcugguccg

SEQ ID NO: 2629930 - RNA, 16 nt, Human
ugcucaucugcugguc

SEQ ID NO: 2629931 - RNA, 18 nt, Human
ugcuccucuccccagcaa

SEQ ID NO: 2629932 - RNA, 19 nt, Human
ugcuccucuccccagcaag

SEQ ID NO: 2629933 - RNA, 15 nt, Human
ugcucaucugcuggu

SEQ ID NO: 2629934 - RNA, 14 nt, Human
ugcucaucugcugg

SEQ ID NO: 2629935 - RNA, 13 nt, Human
ugcucaucugcug

SEQ ID NO: 2629936 - RNA, 11 nt, Human
ugcucauggaa

SEQ ID NO: 2629937 - RNA, 19 nt, Human
ugcucaucauucucugucu

SEQ ID NO: 2629938 - RNA, 20 nt, Human
ugcucaucauucucugucuc

SEQ ID NO: 2629939 - RNA, 21 nt, Human
ugcucaucauucucugucuca

SEQ ID NO: 2629940 - RNA, 23 nt, Human
ugcucaucauucucugucucauc

SEQ ID NO: 2629941 - RNA, 15 nt, Human
ugcucaucauucucu

SEQ ID NO: 2629942 - RNA, 17 nt, Human
ugcucaucauucucugu

SEQ ID NO: 2629943 - RNA, 22 nt, Human
ugcucaucauuccuugagaaaa

SEQ ID NO: 2629944 - RNA, 17 nt, Human
ugcuagggaaacuuccc

SEQ ID NO: 2629945 - RNA, 22 nt, Human
ugcuaggcgagugccaggacuc

SEQ ID NO: 2629946 - RNA, 18 nt, Human
ugcuagcucugagccagu

SEQ ID NO: 2629947 - RNA, 16 nt, Human
ugcuagcucugagcca

SEQ ID NO: 2629948 - RNA, 21 nt, Human
ugcuaggcgagugccaggacu

SEQ ID NO: 2629949 - RNA, 20 nt, Human
ugcuagggguuuuaggucuc

SEQ ID NO: 2629950 - RNA, 22 nt, Human
ugcuagggaaacuucccguccc

SEQ ID NO: 2629951 - RNA, 21 nt, Human
ugcuagggguuuuaggucucu

SEQ ID NO: 2629952 - RNA, 14 nt, Human
ugcuaggucucgga

SEQ ID NO: 2629953 - RNA, 22 nt, Human
ugcuaggucucggacuaagccu

SEQ ID NO: 2629954 - RNA, 14 nt, Human
ugcuaggugggcca

SEQ ID NO: 2629955 - RNA, 23 nt, Human
ugcuagguuaauuccaauuauau

SEQ ID NO: 2629956 - RNA, 21 nt, Human
ugcuaggugggccagccccuc

SEQ ID NO: 2629957 - RNA, 23 nt, Human
ugcuaggugggccagccccuccc

SEQ ID NO: 2629958 - RNA, 16 nt, Human
ugcuagguuaauucca

SEQ ID NO: 2629959 - RNA, 15 nt, Human
ugcuaggugggccag

SEQ ID NO: 2629960 - RNA, 17 nt, Human
ugcuaggugggccagcc

SEQ ID NO: 2629961 - RNA, 19 nt, Human
ugcuaggugggccagcccc

SEQ ID NO: 2629962 - RNA, 20 nt, Human
ugcuaggugggccagccccu

SEQ ID NO: 2629963 - RNA, 18 nt, Human
ugcucagcucugggccau

SEQ ID NO: 2629964 - RNA, 20 nt, Human
ugcucagcucugggccauuc

SEQ ID NO: 2629965 - RNA, 12 nt, Human
ugcucagcuucu

SEQ ID NO: 2629966 - RNA, 17 nt, Human
ugcucagcucugggcca

SEQ ID NO: 2629967 - RNA, 15 nt, Human
ugcucagcuucuccu

SEQ ID NO: 2629968 - RNA, 20 nt, Human
ugcucagcuucuccugugug

SEQ ID NO: 2629969 - RNA, 14 nt, Human
ugcucaggagcccu

SEQ ID NO: 2629970 - RNA, 14 nt, Human
ugcucaggacucag

SEQ ID NO: 2629971 - RNA, 17 nt, Human
ugcucaggacucagaag

SEQ ID NO: 2629972 - RNA, 23 nt, Human
ugcucaggacucagaagccucug

SEQ ID NO: 2629973 - RNA, 21 nt, Human
ugcucagcuucuccuguguga

SEQ ID NO: 2629974 - RNA, 20 nt, Human
ugcuagaacucccuuucaac

SEQ ID NO: 2629975 - RNA, 21 nt, Human
ugcuagaacucccuuucaaca

SEQ ID NO: 2629976 - RNA, 17 nt, Human
ugcuagacacauuuuua

SEQ ID NO: 2629977 - RNA, 20 nt, Human
ugcuagaugugcaaaugcaa

SEQ ID NO: 2629978 - RNA, 19 nt, Human
ugcuagaugugcaaaugca

SEQ ID NO: 2629979 - RNA, 18 nt, Human
ugcuagcacuuggagcca

SEQ ID NO: 2629980 - RNA, 19 nt, Human
ugcuaggaacacuccuuca

SEQ ID NO: 2629981 - RNA, 17 nt, Human
ugcuaggaacacuccuu

SEQ ID NO: 2629982 - RNA, 16 nt, Human
ugcuaggaacacuccu

SEQ ID NO: 2629983 - RNA, 20 nt, Human
ugcuagcacuuggagccaag

SEQ ID NO: 2629984 - RNA, 19 nt, Human
ugcuagaacucccuuucaa

SEQ ID NO: 2629985 - RNA, 18 nt, Human
ugcuagaacucccuuuca

SEQ ID NO: 2629986 - RNA, 13 nt, Human
ugcgugucguggg

SEQ ID NO: 2629987 - RNA, 22 nt, Human
ugcguggacucugcacaugucu

SEQ ID NO: 2629988 - RNA, 18 nt, Human
ugcguggacucugcacau

SEQ ID NO: 2629989 - RNA, 19 nt, Human
ugcguggcauagcccagac

SEQ ID NO: 2629990 - RNA, 17 nt, Human
ugcguggacucugcaca

SEQ ID NO: 2629991 - RNA, 16 nt, Human
ugcguggacucugcac

SEQ ID NO: 2629992 - RNA, 15 nt, Human
ugcgugcauaccacu

SEQ ID NO: 2629993 - RNA, 21 nt, Human
ugcgguuuguuggaucuucaa

SEQ ID NO: 2629994 - RNA, 16 nt, Human
ugcguaacuggcugug

SEQ ID NO: 2629995 - RNA, 15 nt, Human
ugcguacguuuccug

SEQ ID NO: 2629996 - RNA, 20 nt, Human
ugcguacguuuccugagaag

SEQ ID NO: 2629997 - RNA, 23 nt, Human
ugcguacguuuccugagaagugu

SEQ ID NO: 2629998 - RNA, 17 nt, Human
ugcguaacuggcugugu

SEQ ID NO: 2629999 - RNA, 14 nt, Human
ugcguaugucuguu

SEQ ID NO: 2630000 - RNA, 19 nt, Human
ugcguaugucuguuaccau

SEQ ID NO: 2630001 - RNA, 17 nt, Human
uuaaggaugcuuguaca

SEQ ID NO: 2630002 - RNA, 18 nt, Human
uuaaggaugcuuguacau

SEQ ID NO: 2630003 - RNA, 19 nt, Human
uuaaggaugcuuguacaua

SEQ ID NO: 2630004 - RNA, 20 nt, Human
uuaaggaugcuuguacauaa

SEQ ID NO: 2630005 - RNA, 16 nt, Human
uuaaggaaacucuuau

SEQ ID NO: 2630006 - RNA, 14 nt, Human
uuaaggaaacucuu

SEQ ID NO: 2630007 - RNA, 14 nt, Human
uuaaggaaacaaua

SEQ ID NO: 2630008 - RNA, 12 nt, Human
uuaaggaaacaa

SEQ ID NO: 2630009 - RNA, 20 nt, Human
uuaaggaaacucuuaucuca

SEQ ID NO: 2630010 - RNA, 19 nt, Human
uuaaggacaaaaaugaacu

SEQ ID NO: 2630011 - RNA, 21 nt, Human
uuaaggaagacaaugugaaaa

SEQ ID NO: 2630012 - RNA, 14 nt, Human
uuaacauucuguaa

SEQ ID NO: 2630013 - RNA, 14 nt, Human
uuaagcuguuucca

SEQ ID NO: 2630014 - RNA, 12 nt, Human
uuaagcuuauuu

SEQ ID NO: 2630015 - RNA, 16 nt, Human
uuaauaauguuucaaa

SEQ ID NO: 2630016 - RNA, 18 nt, Human
uuaaggauuuuaugcuuu

SEQ ID NO: 2630017 - RNA, 20 nt, Human
uuaaggauuuuaugcuuuaa

SEQ ID NO: 2630018 - RNA, 23 nt, Human
uuaaggcugaggaaaggccagcu

SEQ ID NO: 2630019 - RNA, 22 nt, Human
uuaaggaugcuuguacauaaug

SEQ ID NO: 2630020 - RNA, 13 nt, Human
uuaaggauuuuau

SEQ ID NO: 2630021 - RNA, 15 nt, Human
uuaaggauuuuaugc

SEQ ID NO: 2630022 - RNA, 20 nt, Human
uuaaggauugugauauuuuu

SEQ ID NO: 2630023 - RNA, 18 nt, Human
uuaauaauguuucaaaca

SEQ ID NO: 2630024 - RNA, 18 nt, Human
uuaauagcuuuuauugua

SEQ ID NO: 2630025 - RNA, 22 nt, Human
uuaauuaugccuuuuuugauca

SEQ ID NO: 2630026 - RNA, 15 nt, Human
uuaauuaucuuuucu

SEQ ID NO: 2630027 - RNA, 23 nt, Human
uuaauuauaccauggugaauuaa

SEQ ID NO: 2630028 - RNA, 21 nt, Human
uuaauuagugcuaagugugaa

SEQ ID NO: 2630029 - RNA, 14 nt, Human
uuaauuauuauuug

SEQ ID NO: 2630030 - RNA, 14 nt, Human
uuaauuauuauuua

SEQ ID NO: 2630031 - RNA, 17 nt, Human
uuaauuauuauucuuca

SEQ ID NO: 2630032 - RNA, 14 nt, Human
uuaauuauuauucu

SEQ ID NO: 2630033 - RNA, 20 nt, Human
uuaauuagugcuaaguguga

SEQ ID NO: 2630034 - RNA, 18 nt, Human
uuaauuagugcuaagugu

SEQ ID NO: 2630035 - RNA, 16 nt, Human
uuaauuagugcuaagu

SEQ ID NO: 2630036 - RNA, 18 nt, Human
uuaaugucacaggcaggu

SEQ ID NO: 2630037 - RNA, 19 nt, Human
uuaauggacaugagauaau

SEQ ID NO: 2630038 - RNA, 15 nt, Human
uuaaugcuucuuuca

SEQ ID NO: 2630039 - RNA, 18 nt, Human
uuaaugcuuuuauauuuu

SEQ ID NO: 2630040 - RNA, 14 nt, Human
uuaauggaaauguu

SEQ ID NO: 2630041 - RNA, 22 nt, Human
uuaauggccggcuggaaaugcu

SEQ ID NO: 2630042 - RNA, 23 nt, Human
uuaauggcaaggcagcccugucu

SEQ ID NO: 2630043 - RNA, 22 nt, Human
uuaauggacaugagauaauguu

SEQ ID NO: 2630044 - RNA, 22 nt, Human
uuaaugucaauucuugccaaau

SEQ ID NO: 2630045 - RNA, 17 nt, Human
uuaaugucacaggcagg

SEQ ID NO: 2630046 - RNA, 20 nt, Human
uuaauaucccuacauguauu

SEQ ID NO: 2630047 - RNA, 19 nt, Human
uuaauaucccuacauguau

SEQ ID NO: 2630048 - RNA, 23 nt, Human
uuaauauaaaguaguccugugaa

SEQ ID NO: 2630049 - RNA, 22 nt, Human
uuaauauaaaguaguccuguga

SEQ ID NO: 2630050 - RNA, 18 nt, Human
uuaauaucaucaguauug

SEQ ID NO: 2630051 - RNA, 19 nt, Human
uuaauaguguuaaucaauu

SEQ ID NO: 2630052 - RNA, 15 nt, Human
uuaauaucaucagua

SEQ ID NO: 2630053 - RNA, 22 nt, Human
uuaauagcuuuuauuguauaaa

SEQ ID NO: 2630054 - RNA, 20 nt, Human
uuaauagcuuuuauuguaua

SEQ ID NO: 2630055 - RNA, 21 nt, Human
uuaauaguguuaaucaauuua

SEQ ID NO: 2630056 - RNA, 18 nt, Human
uuaauaguguuaaucaau

SEQ ID NO: 2630057 - RNA, 17 nt, Human
uuaauaguguuaaucaa

SEQ ID NO: 2630058 - RNA, 16 nt, Human
uuaauaguguuaauca

SEQ ID NO: 2630059 - RNA, 15 nt, Human
uuaauaguguuaauc

SEQ ID NO: 2630060 - RNA, 14 nt, Human
uuaauaguguuaau

SEQ ID NO: 2630061 - RNA, 18 nt, Human
uuaaugccuuuaaaguau

SEQ ID NO: 2630062 - RNA, 15 nt, Human
uuaaugccuuuaaag

SEQ ID NO: 2630063 - RNA, 23 nt, Human
uuaauauguuaaccucaguguca

SEQ ID NO: 2630064 - RNA, 23 nt, Human
uuaaugccgauauacucuagaug

SEQ ID NO: 2630065 - RNA, 12 nt, Human
uuaauaugaaaa

SEQ ID NO: 2630066 - RNA, 14 nt, Human
uuaauaugaaaacu

SEQ ID NO: 2630067 - RNA, 15 nt, Human
uuaauaugaaaacuu

SEQ ID NO: 2630068 - RNA, 16 nt, Human
uuaauaugaaaacuua

SEQ ID NO: 2630069 - RNA, 17 nt, Human
uuaauaugaaaacuuau

SEQ ID NO: 2630070 - RNA, 13 nt, Human
uuaauauggcucu

SEQ ID NO: 2630071 - RNA, 22 nt, Human
uuaauauggggaugcagcauua

SEQ ID NO: 2630072 - RNA, 16 nt, Human
uuaauauggggaugca

SEQ ID NO: 2630073 - RNA, 20 nt, Human
uuacagaugaauguauuuau

SEQ ID NO: 2630074 - RNA, 12 nt, Human
uuacauggcucu

SEQ ID NO: 2630075 - RNA, 23 nt, Human
uuacagauaguaucuagcaauca

SEQ ID NO: 2630076 - RNA, 22 nt, Human
uuacaugguuaagguaaaguaa

SEQ ID NO: 2630077 - RNA, 17 nt, Human
uuacauguauuauuuca

SEQ ID NO: 2630078 - RNA, 12 nt, Human
uuacauguuuuc

SEQ ID NO: 2630079 - RNA, 18 nt, Human
uuacauguuuucuuugcu

SEQ ID NO: 2630080 - RNA, 15 nt, Human
uuacauuuguauaaa

SEQ ID NO: 2630081 - RNA, 14 nt, Human
uuacauuuguauaa

SEQ ID NO: 2630082 - RNA, 14 nt, Human
uuacauuuccuaaa

SEQ ID NO: 2630083 - RNA, 16 nt, Human
uuacauuaauguuaau

SEQ ID NO: 2630084 - RNA, 14 nt, Human
uuacauuaauguua

SEQ ID NO: 2630085 - RNA, 22 nt, Human
uuacauguuuucuuugcuuuaa

SEQ ID NO: 2630086 - RNA, 12 nt, Human
uuacaaucaaag

SEQ ID NO: 2630087 - RNA, 23 nt, Human
uuacaauaaaaucuugaaaaugc

SEQ ID NO: 2630088 - RNA, 21 nt, Human
uuaauuauuauuuguguuuua

SEQ ID NO: 2630089 - RNA, 14 nt, Human
uuaauuauuguaca

SEQ ID NO: 2630090 - RNA, 22 nt, Human
uuaauucagcacugauuucaca

SEQ ID NO: 2630091 - RNA, 16 nt, Human
uuaauucaccaaagua

SEQ ID NO: 2630092 - RNA, 14 nt, Human
uuacaaguguauau

SEQ ID NO: 2630093 - RNA, 15 nt, Human
uuaauucacucccac

SEQ ID NO: 2630094 - RNA, 13 nt, Human
uuaauucauguuu

SEQ ID NO: 2630095 - RNA, 16 nt, Human
uuacaaguguauauca

SEQ ID NO: 2630096 - RNA, 21 nt, Human
uuacaauaaaacuuugcugcc

SEQ ID NO: 2630097 - RNA, 20 nt, Human
uuacagagacagaaagcaga

SEQ ID NO: 2630098 - RNA, 23 nt, Human
uuacaaucauugcugaaaauggu

SEQ ID NO: 2630099 - RNA, 22 nt, Human
uuacaaucauugcugaaaaugg

SEQ ID NO: 2630100 - RNA, 17 nt, Human
uuacaaucauugcugaa

SEQ ID NO: 2630101 - RNA, 15 nt, Human
uuacagaggacagua

SEQ ID NO: 2630102 - RNA, 16 nt, Human
uuacagaggaaguuau

SEQ ID NO: 2630103 - RNA, 20 nt, Human
uuacagagaggagaaacaca

SEQ ID NO: 2630104 - RNA, 22 nt, Human
uuacagagaggagaaacacauc

SEQ ID NO: 2630105 - RNA, 14 nt, Human
uuacagagaggaga

SEQ ID NO: 2630106 - RNA, 17 nt, Human
uuacagagaggagaaac

SEQ ID NO: 2630107 - RNA, 18 nt, Human
uuacagagaggagaaaca

SEQ ID NO: 2630108 - RNA, 20 nt, Human
uuacauuuuuaagugcugca

SEQ ID NO: 2630109 - RNA, 21 nt, Human
uuacauuuuuaagugcugcau

SEQ ID NO: 2630110 - RNA, 22 nt, Human
uuacauuuuuaagugcugcauu

SEQ ID NO: 2630111 - RNA, 23 nt, Human
uuacauuuuuaagugcugcauuu

SEQ ID NO: 2630112 - RNA, 19 nt, Human
uuaccagauaaugcuacuu

SEQ ID NO: 2630113 - RNA, 18 nt, Human
uuaccagauaaugcuacu

SEQ ID NO: 2630114 - RNA, 21 nt, Human
uuaccagauuuuuacacaugu

SEQ ID NO: 2630115 - RNA, 24 nt, Human
uuaccagauuuuuacacauguauc

SEQ ID NO: 2630116 - RNA, 15 nt, Human
uuaccuuuuuauuug

SEQ ID NO: 2630117 - RNA, 18 nt, Human
uuaccuuuuuauuugcau

SEQ ID NO: 2630118 - RNA, 14 nt, Human
uuaccagcagagca

SEQ ID NO: 2630119 - RNA, 21 nt, Human
uuaccacuuguguuuugcaag

SEQ ID NO: 2630120 - RNA, 12 nt, Human
uuaccacucagg

SEQ ID NO: 2630121 - RNA, 14 nt, Human
uuaccacucaggca

SEQ ID NO: 2630122 - RNA, 17 nt, Human
uuaccagaagcuuccau

SEQ ID NO: 2630123 - RNA, 21 nt, Human
uuaccagacgguucaccagcc

SEQ ID NO: 2630124 - RNA, 22 nt, Human
uuaccagacgguucaccagccu

SEQ ID NO: 2630125 - RNA, 15 nt, Human
uuacgcuuugauuca

SEQ ID NO: 2630126 - RNA, 16 nt, Human
uuacgcuuugauucau

SEQ ID NO: 2630127 - RNA, 13 nt, Human
uuacgcuuugauu

SEQ ID NO: 2630128 - RNA, 18 nt, Human
uuacgcccaacccuuccc

SEQ ID NO: 2630129 - RNA, 20 nt, Human
uuacgcacacguacuuaaau

SEQ ID NO: 2630130 - RNA, 20 nt, Human
uuacgguuuuccagguuuaa

SEQ ID NO: 2630131 - RNA, 12 nt, Human
uuacgugagcca

SEQ ID NO: 2630132 - RNA, 16 nt, Human
uuacggacacccccuc

SEQ ID NO: 2630133 - RNA, 19 nt, Human
uuaccuuuuuuauacauaa

SEQ ID NO: 2630134 - RNA, 20 nt, Human
uuaccuuuuuuauacauaaa

SEQ ID NO: 2630135 - RNA, 22 nt, Human
uuaccuuuuuuauacauaaaca

SEQ ID NO: 2630136 - RNA, 23 nt, Human
uuaccuuuuuugauaaaguuucu

SEQ ID NO: 2630137 - RNA, 17 nt, Human
uuaccuuuuuugauaaa

SEQ ID NO: 2630138 - RNA, 15 nt, Human
uuaccuuuuuugaua

SEQ ID NO: 2630139 - RNA, 20 nt, Human
uuaccuuuuuauuugcaugu

SEQ ID NO: 2630140 - RNA, 19 nt, Human
uuaccuuuuaauuaaugaa

SEQ ID NO: 2630141 - RNA, 19 nt, Human
uuaaaagaaugauuaugaa

SEQ ID NO: 2630142 - RNA, 20 nt, Human
uuaaaagaaugggcaguuac

SEQ ID NO: 2630143 - RNA, 13 nt, Human
uuaaaagaauggg

SEQ ID NO: 2630144 - RNA, 14 nt, Human
uuaaaaccaaagag

SEQ ID NO: 2630145 - RNA, 14 nt, Human
uuaaaacauguaau

SEQ ID NO: 2630146 - RNA, 13 nt, Human
uuaaaacauguaa

SEQ ID NO: 2630147 - RNA, 13 nt, Human
uuaaaagaaugau

SEQ ID NO: 2630148 - RNA, 21 nt, Human
uuaaaacagacacuggcaugg

SEQ ID NO: 2630149 - RNA, 14 nt, Human
uuaaaacagacacu

SEQ ID NO: 2630150 - RNA, 16 nt, Human
uuaaacuuaaucuaaa

SEQ ID NO: 2630151 - RNA, 18 nt, Human
uuaaacuuaaucuaaaug

SEQ ID NO: 2630152 - RNA, 18 nt, Human
uuaaaagauaaauauuau

SEQ ID NO: 2630153 - RNA, 15 nt, Human
uuaaaagacaagacu

SEQ ID NO: 2630154 - RNA, 12 nt, Human
uuaaaagacaag

SEQ ID NO: 2630155 - RNA, 22 nt, Human
uuaaaagaaugggcaguuacau

SEQ ID NO: 2630156 - RNA, 21 nt, Human
uuaaaagaaugggcaguuaca

SEQ ID NO: 2630157 - RNA, 17 nt, Human
uuaaaagacaagacuuc

SEQ ID NO: 2630158 - RNA, 16 nt, Human
uuaaaagacaagacuu

SEQ ID NO: 2630159 - RNA, 14 nt, Human
uuaaaagacacugu

SEQ ID NO: 2630160 - RNA, 13 nt, Human
uuaaagagagguu

SEQ ID NO: 2630161 - RNA, 20 nt, Human
uuaaagagagguuauagagu

SEQ ID NO: 2630162 - RNA, 14 nt, Human
uuaaagagagguua

SEQ ID NO: 2630163 - RNA, 20 nt, Human
uuaaacuuaaucuaaaugga

SEQ ID NO: 2630164 - RNA, 14 nt, Human
uuaaagacuuuuau

SEQ ID NO: 2630165 - RNA, 20 nt, Human
uuaaagcuuauuaaaacuca

SEQ ID NO: 2630166 - RNA, 14 nt, Human
uuaaagcugccugu

SEQ ID NO: 2630167 - RNA, 15 nt, Human
uuaaagcugccugua

SEQ ID NO: 2630168 - RNA, 17 nt, Human
uuaaagcugccuguagu

SEQ ID NO: 2630169 - RNA, 18 nt, Human
uuaaagcugccuguaguu

SEQ ID NO: 2630170 - RNA, 17 nt, Human
uuaaagauuuaucaaau

SEQ ID NO: 2630171 - RNA, 14 nt, Human
uuaaagauuuauca

SEQ ID NO: 2630172 - RNA, 13 nt, Human
uuaaagauguucc

SEQ ID NO: 2630173 - RNA, 14 nt, Human
uuaaagccuccuca

SEQ ID NO: 2630174 - RNA, 19 nt, Human
uuaaagcuaaaguaucugu

SEQ ID NO: 2630175 - RNA, 21 nt, Human
uuaaagauuuaucaaaucagu

SEQ ID NO: 2630176 - RNA, 14 nt, Human
uuaaagcaaaggag

SEQ ID NO: 2630177 - RNA, 17 nt, Human
uuaaaugcaccuggaau

SEQ ID NO: 2630178 - RNA, 18 nt, Human
uuaaaugcaccuggaaua

SEQ ID NO: 2630179 - RNA, 16 nt, Human
uuaaaugcaccuggaa

SEQ ID NO: 2630180 - RNA, 20 nt, Human
uuaaauauaauucuguaaau

SEQ ID NO: 2630181 - RNA, 19 nt, Human
uuaaauauaauucuguaaa

SEQ ID NO: 2630182 - RNA, 18 nt, Human
uuaaauauaauucuguaa

SEQ ID NO: 2630183 - RNA, 17 nt, Human
uuaaauauaauucugua

SEQ ID NO: 2630184 - RNA, 16 nt, Human
uuaaauauaauucugu

SEQ ID NO: 2630185 - RNA, 14 nt, Human
uuaaauauaauucu

SEQ ID NO: 2630186 - RNA, 13 nt, Human
uuaaauauaauuc

SEQ ID NO: 2630187 - RNA, 12 nt, Human
uuaaauauaauu

SEQ ID NO: 2630188 - RNA, 18 nt, Human
uuaaauaguaaaaauaaa

SEQ ID NO: 2630189 - RNA, 18 nt, Human
uuaaauaggauauuaaca

SEQ ID NO: 2630190 - RNA, 15 nt, Human
uuaaauauaauaugc

SEQ ID NO: 2630191 - RNA, 14 nt, Human
uuaaagcuguuauu

SEQ ID NO: 2630192 - RNA, 23 nt, Human
uuaaagcaacugucuauuucugc

SEQ ID NO: 2630193 - RNA, 16 nt, Human
uuaaauguaaauaauc

SEQ ID NO: 2630194 - RNA, 17 nt, Human
uuaacauauuuacuaag

SEQ ID NO: 2630195 - RNA, 15 nt, Human
uuaacauucauagag

SEQ ID NO: 2630196 - RNA, 18 nt, Human
uuaaaugcccagccccuu

SEQ ID NO: 2630197 - RNA, 17 nt, Human
uuaaaugcccagccccu

SEQ ID NO: 2630198 - RNA, 13 nt, Human
uuaaauguaaaga

SEQ ID NO: 2630199 - RNA, 17 nt, Human
uuaaauguaaagauauu

SEQ ID NO: 2630200 - RNA, 23 nt, Human
uuaaaugggcuacuuuguccuuu

SEQ ID NO: 2630201 - RNA, 21 nt, Human
uuaaauggguagagaaacacu

SEQ ID NO: 2630202 - RNA, 20 nt, Human
uuaaauggaaaaaaugaugu

SEQ ID NO: 2630203 - RNA, 13 nt, Human
uuaaauggacaga

SEQ ID NO: 2630204 - RNA, 22 nt, Human
uguuuccuggcacugcuuccag

SEQ ID NO: 2630205 - RNA, 21 nt, Human
uguuuccuggcacugcuucca

SEQ ID NO: 2630206 - RNA, 17 nt, Human
uguuuacagggagccuc

SEQ ID NO: 2630207 - RNA, 23 nt, Human
uguuuacagcacuacucugugcc

SEQ ID NO: 2630208 - RNA, 22 nt, Human
uguuuacagcacuacucugugc

SEQ ID NO: 2630209 - RNA, 21 nt, Human
uguuuacagcacuacucugug

SEQ ID NO: 2630210 - RNA, 20 nt, Human
uguuuacagcacuacucugu

SEQ ID NO: 2630211 - RNA, 20 nt, Human
uguuuccuggcacugcuucc

SEQ ID NO: 2630212 - RNA, 17 nt, Human
uguuucuccuucugaaa

SEQ ID NO: 2630213 - RNA, 15 nt, Human
uguuucucccucuca

SEQ ID NO: 2630214 - RNA, 17 nt, Human
uguuucucccccugggc

SEQ ID NO: 2630215 - RNA, 23 nt, Human
uguuucucccccugggcucugcc

SEQ ID NO: 2630216 - RNA, 22 nt, Human
uguuuacagggagccuccugcc

SEQ ID NO: 2630217 - RNA, 15 nt, Human
uguuucucccccugg

SEQ ID NO: 2630218 - RNA, 16 nt, Human
uguuucucccccuggg

SEQ ID NO: 2630219 - RNA, 23 nt, Human
uguuuacagggagccuccugccc

SEQ ID NO: 2630220 - RNA, 15 nt, Human
uguuucuagggaaau

SEQ ID NO: 2630221 - RNA, 19 nt, Human
uguuucuauugacuucaau

SEQ ID NO: 2630222 - RNA, 21 nt, Human
uguuuacagggagccuccugc

SEQ ID NO: 2630223 - RNA, 20 nt, Human
uguuuacagggagccuccug

SEQ ID NO: 2630224 - RNA, 14 nt, Human
uguuucucuuuccu

SEQ ID NO: 2630225 - RNA, 17 nt, Human
uguuuguugucagcuga

SEQ ID NO: 2630226 - RNA, 16 nt, Human
uguuuguugucagcug

SEQ ID NO: 2630227 - RNA, 13 nt, Human
uguuucucugcug

SEQ ID NO: 2630228 - RNA, 14 nt, Human
uguuucucugcugu

SEQ ID NO: 2630229 - RNA, 15 nt, Human
uguuucucugcuguu

SEQ ID NO: 2630230 - RNA, 18 nt, Human
uguuuuaaaaugagaaau

SEQ ID NO: 2630231 - RNA, 17 nt, Human
uguuuguuuccuuuguu

SEQ ID NO: 2630232 - RNA, 12 nt, Human
uguuuuaaaaag

SEQ ID NO: 2630233 - RNA, 20 nt, Human
uguuuuaaaaagaaacaaga

SEQ ID NO: 2630234 - RNA, 23 nt, Human
uguuuuaaaauaaaaauucugaa

SEQ ID NO: 2630235 - RNA, 12 nt, Human
uguuuuaaaaaa

SEQ ID NO: 2630236 - RNA, 22 nt, Human
uguuuguuucucccccugggcu

SEQ ID NO: 2630237 - RNA, 17 nt, Human
uguuuuuuagaucaaau

SEQ ID NO: 2630238 - RNA, 17 nt, Human
uguuuuuuccugagcuu

SEQ ID NO: 2630239 - RNA, 15 nt, Human
uguuuuuucugccac

SEQ ID NO: 2630240 - RNA, 21 nt, Human
uguuuuuuagaucaaauacuu

SEQ ID NO: 2630241 - RNA, 12 nt, Human
uguuuuuucuaa

SEQ ID NO: 2630242 - RNA, 14 nt, Human
uguuuuuugaaaac

SEQ ID NO: 2630243 - RNA, 16 nt, Human
uguuuuuugaaaacau

SEQ ID NO: 2630244 - RNA, 19 nt, Human
uguuuuuugaaaacauggu

SEQ ID NO: 2630245 - RNA, 20 nt, Human
uuaaaacaauauuguuucua

SEQ ID NO: 2630246 - RNA, 14 nt, Human
uguuuuucaugaaa

SEQ ID NO: 2630247 - RNA, 11 nt, Human
uguuuuucauu

SEQ ID NO: 2630248 - RNA, 20 nt, Human
uguuuuuccuuguauuuaaa

SEQ ID NO: 2630249 - RNA, 13 nt, Human
uguuuuugucuua

SEQ ID NO: 2630250 - RNA, 18 nt, Human
uguuuugcuuuuucugac

SEQ ID NO: 2630251 - RNA, 17 nt, Human
uguuuugcuuuuucuga

SEQ ID NO: 2630252 - RNA, 16 nt, Human
uguuuugcuuuuucug

SEQ ID NO: 2630253 - RNA, 23 nt, Human
uguuuuggcugaaauucuccugg

SEQ ID NO: 2630254 - RNA, 18 nt, Human
uguuuuggcugaaauucu

SEQ ID NO: 2630255 - RNA, 20 nt, Human
uguuuugcuuuuucugacuc

SEQ ID NO: 2630256 - RNA, 23 nt, Human
uguuuuaaaaugagaaaucuaaa

SEQ ID NO: 2630257 - RNA, 22 nt, Human
uguuuuaaauacgcacuacaug

SEQ ID NO: 2630258 - RNA, 20 nt, Human
uguuuuaaacauagaaaguu

SEQ ID NO: 2630259 - RNA, 13 nt, Human
uguuuuucaugaa

SEQ ID NO: 2630260 - RNA, 13 nt, Human
uguuuuucacauu

SEQ ID NO: 2630261 - RNA, 20 nt, Human
uguuuuuaugaagaaaaaau

SEQ ID NO: 2630262 - RNA, 22 nt, Human
uguuuugguaucuguucuuuaa

SEQ ID NO: 2630263 - RNA, 16 nt, Human
uguuuugguaucuguu

SEQ ID NO: 2630264 - RNA, 20 nt, Human
uguuuuggggaugagagggu

SEQ ID NO: 2630265 - RNA, 15 nt, Human
uguuuugguuugcua

SEQ ID NO: 2630266 - RNA, 23 nt, Human
uguugcugaauaggcgaucacaa

SEQ ID NO: 2630267 - RNA, 14 nt, Human
uguugcugaauagg

SEQ ID NO: 2630268 - RNA, 13 nt, Human
uguugcugccuca

SEQ ID NO: 2630269 - RNA, 14 nt, Human
uguugcugccaacc

SEQ ID NO: 2630270 - RNA, 13 nt, Human
uguugcugccaac

SEQ ID NO: 2630271 - RNA, 18 nt, Human
uguugagccuuuucccuc

SEQ ID NO: 2630272 - RNA, 16 nt, Human
uguugagccuuuuccc

SEQ ID NO: 2630273 - RNA, 19 nt, Human
uguugagguggucugaaug

SEQ ID NO: 2630274 - RNA, 13 nt, Human
uguugagcuguuu

SEQ ID NO: 2630275 - RNA, 23 nt, Human
uguugagguggucugaauguucu

SEQ ID NO: 2630276 - RNA, 20 nt, Human
uguugagguggucugaaugu

SEQ ID NO: 2630277 - RNA, 21 nt, Human
uguugagguggucugaauguu

SEQ ID NO: 2630278 - RNA, 19 nt, Human
uguugauaaauuccacugg

SEQ ID NO: 2630279 - RNA, 22 nt, Human
uguugauaaauuccacuggacu

SEQ ID NO: 2630280 - RNA, 22 nt, Human
uguugaaauuauguauguuuac

SEQ ID NO: 2630281 - RNA, 21 nt, Human
uguugaaauuauguauguuua

SEQ ID NO: 2630282 - RNA, 23 nt, Human
uguugagaaucccaaauuugauu

SEQ ID NO: 2630283 - RNA, 18 nt, Human
uguugagaauugugcuca

SEQ ID NO: 2630284 - RNA, 17 nt, Human
uguugagccaggccugg

SEQ ID NO: 2630285 - RNA, 14 nt, Human
uguugcuuacaauu

SEQ ID NO: 2630286 - RNA, 13 nt, Human
uguugcuuacaau

SEQ ID NO: 2630287 - RNA, 16 nt, Human
uguugcuguugauguu

SEQ ID NO: 2630288 - RNA, 14 nt, Human
uguugcugccucau

SEQ ID NO: 2630289 - RNA, 20 nt, Human
uguugcuuagucacuuauuu

SEQ ID NO: 2630290 - RNA, 16 nt, Human
uguugcuuagucacuu

SEQ ID NO: 2630291 - RNA, 16 nt, Human
uguugcuuacaauuuu

SEQ ID NO: 2630292 - RNA, 15 nt, Human
uguugcuuacaauuu

SEQ ID NO: 2630293 - RNA, 14 nt, Human
uguugcuuggacua

SEQ ID NO: 2630294 - RNA, 21 nt, Human
uguuggagaagaacugaaauc

SEQ ID NO: 2630295 - RNA, 21 nt, Human
uguugcuuuugugaacuuuuu

SEQ ID NO: 2630296 - RNA, 14 nt, Human
uguuggagccugca

SEQ ID NO: 2630297 - RNA, 13 nt, Human
uguuggaaaagaa

SEQ ID NO: 2630298 - RNA, 11 nt, Human
uguuggccagg

SEQ ID NO: 2630299 - RNA, 21 nt, Human
uguuggaucuucaauggcuuu

SEQ ID NO: 2630300 - RNA, 14 nt, Human
uguuggaucuucaa

SEQ ID NO: 2630301 - RNA, 11 nt, Human
uguuggaucuu

SEQ ID NO: 2630302 - RNA, 19 nt, Human
uguuggauaaaucaguggu

SEQ ID NO: 2630303 - RNA, 20 nt, Human
uguuggauaaaucagugguu

SEQ ID NO: 2630304 - RNA, 20 nt, Human
uguuggauuuguuuaaaagg

SEQ ID NO: 2630305 - RNA, 23 nt, Human
uguuggauuuauaaaugcuauuu

SEQ ID NO: 2630306 - RNA, 19 nt, Human
uguuggauuuauaaaugcu

SEQ ID NO: 2630307 - RNA, 17 nt, Human
uguuggauuuauaaaug

SEQ ID NO: 2630308 - RNA, 17 nt, Human
uguuggauuuuugucuu

SEQ ID NO: 2630309 - RNA, 14 nt, Human
uguuuaaaaggauu

SEQ ID NO: 2630310 - RNA, 14 nt, Human
uguuuaaaaucauu

SEQ ID NO: 2630311 - RNA, 13 nt, Human
uguuuaaaaucau

SEQ ID NO: 2630312 - RNA, 15 nt, Human
uguuuaauauuuaaa

SEQ ID NO: 2630313 - RNA, 14 nt, Human
uguuuaauauuuaa

SEQ ID NO: 2630314 - RNA, 17 nt, Human
uguuuaauauuuaaaca

SEQ ID NO: 2630315 - RNA, 18 nt, Human
uguuuacacucuuuguaa

SEQ ID NO: 2630316 - RNA, 16 nt, Human
uguuuacacucuuugu

SEQ ID NO: 2630317 - RNA, 15 nt, Human
uguuuacaagaaaaa

SEQ ID NO: 2630318 - RNA, 21 nt, Human
uguuuacagaggacaguauuu

SEQ ID NO: 2630319 - RNA, 17 nt, Human
uguuuacagauccccaa

SEQ ID NO: 2630320 - RNA, 14 nt, Human
uguuuacagaggac

SEQ ID NO: 2630321 - RNA, 19 nt, Human
uguuuacacucuuuguaag

SEQ ID NO: 2630322 - RNA, 16 nt, Human
uguuuacacacgugca

SEQ ID NO: 2630323 - RNA, 20 nt, Human
uguuguuuuguuuuaaauac

SEQ ID NO: 2630324 - RNA, 11 nt, Human
uguuguuuugu

SEQ ID NO: 2630325 - RNA, 12 nt, Human
uguuguuuguau

SEQ ID NO: 2630326 - RNA, 14 nt, Human
uguuguuucuuucu

SEQ ID NO: 2630327 - RNA, 13 nt, Human
uguuguuucuuuc

SEQ ID NO: 2630328 - RNA, 12 nt, Human
uguuguuugcca

SEQ ID NO: 2630329 - RNA, 18 nt, Human
uguuguuuuacuaaagaa

SEQ ID NO: 2630330 - RNA, 13 nt, Human
uguuguuuuacua

SEQ ID NO: 2630331 - RNA, 15 nt, Human
uguuguuucuuucua

SEQ ID NO: 2630332 - RNA, 12 nt, Human
uguuguuucuuu

SEQ ID NO: 2630333 - RNA, 13 nt, Human
uguuggccaggcu

SEQ ID NO: 2630334 - RNA, 18 nt, Human
uguuggccaggcugcucu

SEQ ID NO: 2630335 - RNA, 14 nt, Human
uguuggccaggcug

SEQ ID NO: 2630336 - RNA, 12 nt, Human
uguucucugccc

SEQ ID NO: 2630337 - RNA, 18 nt, Human
uguucucugaggacacua

SEQ ID NO: 2630338 - RNA, 16 nt, Human
uguucucugaggacac

SEQ ID NO: 2630339 - RNA, 13 nt, Human
uguucucugagga

SEQ ID NO: 2630340 - RNA, 16 nt, Human
uguucuauucaucuca

SEQ ID NO: 2630341 - RNA, 22 nt, Human
uguucuaguuuucaguuuguau

SEQ ID NO: 2630342 - RNA, 12 nt, Human
uguucuauagcu

SEQ ID NO: 2630343 - RNA, 15 nt, Human
uguucucagcucccc

SEQ ID NO: 2630344 - RNA, 14 nt, Human
uguucucagcuccc

SEQ ID NO: 2630345 - RNA, 21 nt, Human
uguucuauuucagugccaaua

SEQ ID NO: 2630346 - RNA, 18 nt, Human
uguucucagcucccccug

SEQ ID NO: 2630347 - RNA, 17 nt, Human
uguucucagcucccccu

SEQ ID NO: 2630348 - RNA, 20 nt, Human
uguucucagcucccccuguc

SEQ ID NO: 2630349 - RNA, 16 nt, Human
uguucuccgucccugc

SEQ ID NO: 2630350 - RNA, 22 nt, Human
uguucuccuagacugacccuga

SEQ ID NO: 2630351 - RNA, 13 nt, Human
uguucauaaauaa

SEQ ID NO: 2630352 - RNA, 18 nt, Human
uguucaguuacagaaagu

SEQ ID NO: 2630353 - RNA, 17 nt, Human
uguucaguuacagaaag

SEQ ID NO: 2630354 - RNA, 16 nt, Human
uguucaguuacagaaa

SEQ ID NO: 2630355 - RNA, 15 nt, Human
uguucaguuacagaa

SEQ ID NO: 2630356 - RNA, 22 nt, Human
uguucaguguaauuucuuugcc

SEQ ID NO: 2630357 - RNA, 21 nt, Human
uguucaguguaauuucuuugc

SEQ ID NO: 2630358 - RNA, 17 nt, Human
uguucagugucccgggc

SEQ ID NO: 2630359 - RNA, 17 nt, Human
uguucaguguaauuucu

SEQ ID NO: 2630360 - RNA, 15 nt, Human
uguucaguguaauuu

SEQ ID NO: 2630361 - RNA, 13 nt, Human
uguucaguguaau

SEQ ID NO: 2630362 - RNA, 15 nt, Human
uguucaguguaaaua

SEQ ID NO: 2630363 - RNA, 22 nt, Human
uguucauuaaagcaugaauggu

SEQ ID NO: 2630364 - RNA, 12 nt, Human
uguucauuguaa

SEQ ID NO: 2630365 - RNA, 22 nt, Human
uguucauuuagauugaaaacuu

SEQ ID NO: 2630366 - RNA, 16 nt, Human
uguucuaguuuucagu

SEQ ID NO: 2630367 - RNA, 13 nt, Human
uguucauuuccuc

SEQ ID NO: 2630368 - RNA, 11 nt, Human
uguucauuucc

SEQ ID NO: 2630369 - RNA, 22 nt, Human
uguucauuguaauguuacugau

SEQ ID NO: 2630370 - RNA, 23 nt, Human
uguucauuguaauguuacugauc

SEQ ID NO: 2630371 - RNA, 13 nt, Human
uguucauuguaau

SEQ ID NO: 2630372 - RNA, 14 nt, Human
uguucauuguaaug

SEQ ID NO: 2630373 - RNA, 16 nt, Human
uguucauuguaauguu

SEQ ID NO: 2630374 - RNA, 18 nt, Human
uguucauuguaauguuac

SEQ ID NO: 2630375 - RNA, 19 nt, Human
uguucauuguaauguuacu

SEQ ID NO: 2630376 - RNA, 20 nt, Human
uguucauuguaauguuacug

SEQ ID NO: 2630377 - RNA, 21 nt, Human
uguucauuguaauguuacuga

SEQ ID NO: 2630378 - RNA, 23 nt, Human
uguucucuugggaacugaacuca

SEQ ID NO: 2630379 - RNA, 19 nt, Human
uguucucugcccuccaaga

SEQ ID NO: 2630380 - RNA, 15 nt, Human
uguucugacccugcu

SEQ ID NO: 2630381 - RNA, 13 nt, Human
uguucugaacugu

SEQ ID NO: 2630382 - RNA, 18 nt, Human
uguucugaauaauuucuu

SEQ ID NO: 2630383 - RNA, 15 nt, Human
uguucugaacugugg

SEQ ID NO: 2630384 - RNA, 13 nt, Human
uguucugacauua

SEQ ID NO: 2630385 - RNA, 15 nt, Human
uguucugacauuaac

SEQ ID NO: 2630386 - RNA, 16 nt, Human
uguucugacauuaaca

SEQ ID NO: 2630387 - RNA, 17 nt, Human
uguucugacauuaacag

SEQ ID NO: 2630388 - RNA, 18 nt, Human
uguucugacccugcuuca

SEQ ID NO: 2630389 - RNA, 15 nt, Human
uguucugauaaugaa

SEQ ID NO: 2630390 - RNA, 19 nt, Human
uguucugacauuaacaguu

SEQ ID NO: 2630391 - RNA, 20 nt, Human
uguucugacauuaacaguuu

SEQ ID NO: 2630392 - RNA, 22 nt, Human
uguucugacauuaacaguuuuc

SEQ ID NO: 2630393 - RNA, 14 nt, Human
uguucugauuagaa

SEQ ID NO: 2630394 - RNA, 16 nt, Human
uguucugauuagaaau

SEQ ID NO: 2630395 - RNA, 19 nt, Human
uguucugauuagaaaugac

SEQ ID NO: 2630396 - RNA, 14 nt, Human
uguucuuucuggcu

SEQ ID NO: 2630397 - RNA, 17 nt, Human
uguucugcacacagcac

SEQ ID NO: 2630398 - RNA, 23 nt, Human
uguucugcaaaaauauuuauaaa

SEQ ID NO: 2630399 - RNA, 22 nt, Human
uguucugauuagaaaugaccaa

SEQ ID NO: 2630400 - RNA, 21 nt, Human
uguugaaaauuauuuuaaaca

SEQ ID NO: 2630401 - RNA, 16 nt, Human
uguucuuucuggaguc

SEQ ID NO: 2630402 - RNA, 15 nt, Human
uguugaaauuaugua

SEQ ID NO: 2630403 - RNA, 22 nt, Human
uguugaaaauuauuuuaaacaa

SEQ ID NO: 2630404 - RNA, 14 nt, Human
uguugaaauuaugu

SEQ ID NO: 2630405 - RNA, 24 nt, Human
uguugaaagguaauuugagagaaa

SEQ ID NO: 2630406 - RNA, 11 nt, Human
uguugaaagau

SEQ ID NO: 2630407 - RNA, 20 nt, Human
uguucuuucuggcuaugcau

SEQ ID NO: 2630408 - RNA, 22 nt, Human
uguucuuucuggcuaugcauuu

SEQ ID NO: 2630409 - RNA, 14 nt, Human
uguugaaaauguuc

SEQ ID NO: 2630410 - RNA, 17 nt, Human
uguugaaaauguucaga

SEQ ID NO: 2630411 - RNA, 20 nt, Human
uguucuuuccaaaguacacu

SEQ ID NO: 2630412 - RNA, 16 nt, Human
uguucaccaucggcag

SEQ ID NO: 2630413 - RNA, 22 nt, Human
uguucacacucucacauguuua

SEQ ID NO: 2630414 - RNA, 19 nt, Human
uguucacacucucacaugu

SEQ ID NO: 2630415 - RNA, 16 nt, Human
uguucacacucucaca

SEQ ID NO: 2630416 - RNA, 15 nt, Human
uguucacacucucac

SEQ ID NO: 2630417 - RNA, 22 nt, Human
uguucacaccuagcgucaguau

SEQ ID NO: 2630418 - RNA, 14 nt, Human
uguucagcuccagc

SEQ ID NO: 2630419 - RNA, 16 nt, Human
uguucacagccagacu

SEQ ID NO: 2630420 - RNA, 16 nt, Human
uguucaauguuuaaug

SEQ ID NO: 2630421 - RNA, 23 nt, Human
uguucaagaccagccugaccaac

SEQ ID NO: 2630422 - RNA, 11 nt, Human
uguucagcugg

SEQ ID NO: 2630423 - RNA, 16 nt, Human
uguucagcuccagcuc

SEQ ID NO: 2630424 - RNA, 15 nt, Human
uguucagcuccagcu

SEQ ID NO: 2630425 - RNA, 12 nt, Human
uguuauaaucuu

SEQ ID NO: 2630426 - RNA, 17 nt, Human
uguuauaacucugcacu

SEQ ID NO: 2630427 - RNA, 15 nt, Human
uguuauaacucugca

SEQ ID NO: 2630428 - RNA, 14 nt, Human
uguuauaacucugc

SEQ ID NO: 2630429 - RNA, 14 nt, Human
uguuauaacuacuc

SEQ ID NO: 2630430 - RNA, 23 nt, Human
uguuauaacucugcacuacuccu

SEQ ID NO: 2630431 - RNA, 18 nt, Human
uguuauaacucugcacua

SEQ ID NO: 2630432 - RNA, 14 nt, Human
uguuaguucccaac

SEQ ID NO: 2630433 - RNA, 13 nt, Human
uguuaguucccaa

SEQ ID NO: 2630434 - RNA, 12 nt, Human
uguuaguuccca

SEQ ID NO: 2630435 - RNA, 17 nt, Human
uguuaguuauagauguc

SEQ ID NO: 2630436 - RNA, 15 nt, Human
uguuaguucccaaca

SEQ ID NO: 2630437 - RNA, 21 nt, Human
uguuagauagaauuuccaaua

SEQ ID NO: 2630438 - RNA, 23 nt, Human
uguuagaguccaacguggggcag

SEQ ID NO: 2630439 - RNA, 14 nt, Human
uguuagugcaaauu

SEQ ID NO: 2630440 - RNA, 19 nt, Human
uguuagaaaauggacacug

SEQ ID NO: 2630441 - RNA, 20 nt, Human
uguuagagguuuuaaaguga

SEQ ID NO: 2630442 - RNA, 22 nt, Human
uguuagaggaucccucucugga

SEQ ID NO: 2630443 - RNA, 18 nt, Human
uguuagacucuuacuuuu

SEQ ID NO: 2630444 - RNA, 22 nt, Human
uguuagagguuuuaaagugauu

SEQ ID NO: 2630445 - RNA, 21 nt, Human
uguuagagguuuuaaagugau

SEQ ID NO: 2630446 - RNA, 18 nt, Human
uguuagaguccaacgugg

SEQ ID NO: 2630447 - RNA, 22 nt, Human
uguuacauuuuuaagugcugca

SEQ ID NO: 2630448 - RNA, 19 nt, Human
uguuaccaugucacugugg

SEQ ID NO: 2630449 - RNA, 18 nt, Human
uguuaccaugucacugug

SEQ ID NO: 2630450 - RNA, 13 nt, Human
uguuacauuuuua

SEQ ID NO: 2630451 - RNA, 15 nt, Human
uguuacauuauuauc

SEQ ID NO: 2630452 - RNA, 12 nt, Human
uguuacaucaca

SEQ ID NO: 2630453 - RNA, 18 nt, Human
uguuacuuaccuaaacag

SEQ ID NO: 2630454 - RNA, 14 nt, Human
uguuacuuaccuaa

SEQ ID NO: 2630455 - RNA, 15 nt, Human
uguuacuguaauucc

SEQ ID NO: 2630456 - RNA, 12 nt, Human
uguuacuuaccu

SEQ ID NO: 2630457 - RNA, 15 nt, Human
uguuacugucuucag

SEQ ID NO: 2630458 - RNA, 16 nt, Human
uguuacugucuucagu

SEQ ID NO: 2630459 - RNA, 23 nt, Human
uguguuuucugaauaacauuugu

SEQ ID NO: 2630460 - RNA, 14 nt, Human
uguguuuucugaau

SEQ ID NO: 2630461 - RNA, 19 nt, Human
uguuaaacuagcauaucug

SEQ ID NO: 2630462 - RNA, 18 nt, Human
uguuaaacuagcauaucu

SEQ ID NO: 2630463 - RNA, 23 nt, Human
uguuaaacuagcauaucugccuu

SEQ ID NO: 2630464 - RNA, 22 nt, Human
uguuaaacuagcauaucugccu

SEQ ID NO: 2630465 - RNA, 20 nt, Human
uguuaaacuagcauaucugc

SEQ ID NO: 2630466 - RNA, 17 nt, Human
uguguuugucauuagcc

SEQ ID NO: 2630467 - RNA, 14 nt, Human
uguguuugucauua

SEQ ID NO: 2630468 - RNA, 18 nt, Human
uguguuugguucuggggc

SEQ ID NO: 2630469 - RNA, 19 nt, Human
uguguuugucauuagccug

SEQ ID NO: 2630470 - RNA, 15 nt, Human
uguguuuguguauuu

SEQ ID NO: 2630471 - RNA, 11 nt, Human
uguguuugugu

SEQ ID NO: 2630472 - RNA, 13 nt, Human
uguguuuguguga

SEQ ID NO: 2630473 - RNA, 10 nt, Human
uguguuuguu

SEQ ID NO: 2630474 - RNA, 13 nt, Human
uguguuuucugaa

SEQ ID NO: 2630475 - RNA, 17 nt, Human
uguguuuucauaauaaa

SEQ ID NO: 2630476 - RNA, 14 nt, Human
uguguuuguuccua

SEQ ID NO: 2630477 - RNA, 20 nt, Human
uguguuuguucuuuuuauug

SEQ ID NO: 2630478 - RNA, 24 nt, Human
ugugugccauagaguuuaacacaa

SEQ ID NO: 2630479 - RNA, 14 nt, Human
ugugugcaugugug

SEQ ID NO: 2630480 - RNA, 23 nt, Human
ugugugccauagaguuuaacaca

SEQ ID NO: 2630481 - RNA, 21 nt, Human
ugugugccauagaguuuaaca

SEQ ID NO: 2630482 - RNA, 20 nt, Human
ugugugcaugugugugcuca

SEQ ID NO: 2630483 - RNA, 19 nt, Human
ugugugcagacucaauaaa

SEQ ID NO: 2630484 - RNA, 13 nt, Human
ugugugcagugaa

SEQ ID NO: 2630485 - RNA, 20 nt, Human
ugugugaggagcugcuggcu

SEQ ID NO: 2630486 - RNA, 16 nt, Human
uguguguccaaaacug

SEQ ID NO: 2630487 - RNA, 19 nt, Human
uguguguccaaaacugccu

SEQ ID NO: 2630488 - RNA, 20 nt, Human
ugugugguggguucuuugga

SEQ ID NO: 2630489 - RNA, 14 nt, Human
uguguguaugugua

SEQ ID NO: 2630490 - RNA, 19 nt, Human
uguguguauguuugcacac

SEQ ID NO: 2630491 - RNA, 18 nt, Human
ugugugcgagugugugca

SEQ ID NO: 2630492 - RNA, 14 nt, Human
uguguguauacaug

SEQ ID NO: 2630493 - RNA, 20 nt, Human
ugugugguuugguguguucc

SEQ ID NO: 2630494 - RNA, 11 nt, Human
uguguguaugu

SEQ ID NO: 2630495 - RNA, 13 nt, Human
uguguguaugcua

SEQ ID NO: 2630496 - RNA, 14 nt, Human
uguguugugugugg

SEQ ID NO: 2630497 - RNA, 23 nt, Human
uguguugugugugggagugugua

SEQ ID NO: 2630498 - RNA, 22 nt, Human
uguguguccacgacugucucca

SEQ ID NO: 2630499 - RNA, 13 nt, Human
uguguugugauag

SEQ ID NO: 2630500 - RNA, 22 nt, Human
uguguuuaaauaaaguaucaug

SEQ ID NO: 2630501 - RNA, 18 nt, Human
uguguuuaaauaaaguau

SEQ ID NO: 2630502 - RNA, 20 nt, Human
uguguuuacuuuauguuacu

SEQ ID NO: 2630503 - RNA, 15 nt, Human
uguguuuaaauaaag

SEQ ID NO: 2630504 - RNA, 14 nt, Human
uguguuuaaauaaa

SEQ ID NO: 2630505 - RNA, 13 nt, Human
uguguuuaaauaa

SEQ ID NO: 2630506 - RNA, 14 nt, Human
uguguuguugcuuu

SEQ ID NO: 2630507 - RNA, 13 nt, Human
uguguuguugcuu

SEQ ID NO: 2630508 - RNA, 12 nt, Human
uguguuuaaaua

SEQ ID NO: 2630509 - RNA, 15 nt, Human
uguguuuaugugugu

SEQ ID NO: 2630510 - RNA, 13 nt, Human
uguguuuauuguc

SEQ ID NO: 2630511 - RNA, 22 nt, Human
uguguuuaggaacuacugagga

SEQ ID NO: 2630512 - RNA, 13 nt, Human
uguguuuaugugu

SEQ ID NO: 2630513 - RNA, 14 nt, Human
uguguauguggggg

SEQ ID NO: 2630514 - RNA, 13 nt, Human
uguguaugugggg

SEQ ID NO: 2630515 - RNA, 19 nt, Human
uguguauccauuaucaugu

SEQ ID NO: 2630516 - RNA, 18 nt, Human
uguguauccauuaucaug

SEQ ID NO: 2630517 - RNA, 16 nt, Human
uguguauccauuauca

SEQ ID NO: 2630518 - RNA, 19 nt, Human
uguguauucauugaaguca

SEQ ID NO: 2630519 - RNA, 21 nt, Human
uguguauuaaaaaaaacaaaa

SEQ ID NO: 2630520 - RNA, 19 nt, Human
uguguauuaaaaaaaacaa

SEQ ID NO: 2630521 - RNA, 21 nt, Human
uguguauccauuaucaugugu

SEQ ID NO: 2630522 - RNA, 14 nt, Human
uguguauuccaaga

SEQ ID NO: 2630523 - RNA, 22 nt, Human
uguguauguguacgugugugug

SEQ ID NO: 2630524 - RNA, 14 nt, Human
uguguauuaaaaaa

SEQ ID NO: 2630525 - RNA, 23 nt, Human
uguguaugugggggucugugugu

SEQ ID NO: 2630526 - RNA, 21 nt, Human
uguguauagaugcaagauauu

SEQ ID NO: 2630527 - RNA, 15 nt, Human
uguguauacaugcca

SEQ ID NO: 2630528 - RNA, 21 nt, Human
uguguagaguuaagaagcugu

SEQ ID NO: 2630529 - RNA, 16 nt, Human
uguguagggcgggagg

SEQ ID NO: 2630530 - RNA, 19 nt, Human
uguguagaguuaagaagcu

SEQ ID NO: 2630531 - RNA, 18 nt, Human
uguguagaguuaagaagc

SEQ ID NO: 2630532 - RNA, 16 nt, Human
uguguagaguuaagaa

SEQ ID NO: 2630533 - RNA, 21 nt, Human
uguguagacaaauauuuggag

SEQ ID NO: 2630534 - RNA, 16 nt, Human
uguguagacaaauauu

SEQ ID NO: 2630535 - RNA, 17 nt, Human
uguguacauaacugaaa

SEQ ID NO: 2630536 - RNA, 13 nt, Human
uguguagaguuaa

SEQ ID NO: 2630537 - RNA, 23 nt, Human
ugugucacuggcugccuccacuc

SEQ ID NO: 2630538 - RNA, 22 nt, Human
ugugucacuggcugccuccacu

SEQ ID NO: 2630539 - RNA, 12 nt, Human
ugugugaaugaa

SEQ ID NO: 2630540 - RNA, 16 nt, Human
ugugugaaugaacacu

SEQ ID NO: 2630541 - RNA, 17 nt, Human
ugugugaaugaacacuc

SEQ ID NO: 2630542 - RNA, 18 nt, Human
ugugugaaugaacacucu

SEQ ID NO: 2630543 - RNA, 22 nt, Human
ugugugaaugaacacucuuuug

SEQ ID NO: 2630544 - RNA, 17 nt, Human
ugugugagcaagcauuu

SEQ ID NO: 2630545 - RNA, 17 nt, Human
ugugugaggagcugcug

SEQ ID NO: 2630546 - RNA, 15 nt, Human
uguguauuuacgcuu

SEQ ID NO: 2630547 - RNA, 19 nt, Human
uguguauuuccagugcaau

SEQ ID NO: 2630548 - RNA, 16 nt, Human
ugugucaaugggcaau

SEQ ID NO: 2630549 - RNA, 13 nt, Human
ugugucacuggcu

SEQ ID NO: 2630550 - RNA, 18 nt, Human
ugugucacuggcugccuc

SEQ ID NO: 2630551 - RNA, 17 nt, Human
ugugucacuggcugccu

SEQ ID NO: 2630552 - RNA, 15 nt, Human
ugugucacuggcugc

SEQ ID NO: 2630553 - RNA, 22 nt, Human
uguguauuuaacagggagggga

SEQ ID NO: 2630554 - RNA, 20 nt, Human
uguguauuuaacagggaggg

SEQ ID NO: 2630555 - RNA, 18 nt, Human
uguguauuuaacagggag

SEQ ID NO: 2630556 - RNA, 12 nt, Human
uguguauuguuc

SEQ ID NO: 2630557 - RNA, 13 nt, Human
uguguauuguucc

SEQ ID NO: 2630558 - RNA, 14 nt, Human
uguguauuguuccc

SEQ ID NO: 2630559 - RNA, 15 nt, Human
uguguauuguuccca

SEQ ID NO: 2630560 - RNA, 13 nt, Human
uguguauuuaaca

SEQ ID NO: 2630561 - RNA, 18 nt, Human
uguauccuggggcucccu

SEQ ID NO: 2630562 - RNA, 15 nt, Human
uguauccuggggcuc

SEQ ID NO: 2630563 - RNA, 19 nt, Human
uguauccuggggcucccuu

SEQ ID NO: 2630564 - RNA, 15 nt, Human
uguaucggagacagu

SEQ ID NO: 2630565 - RNA, 17 nt, Human
uguaucggagacaguga

SEQ ID NO: 2630566 - RNA, 15 nt, Human
uguaucggaugcuuu

SEQ ID NO: 2630567 - RNA, 19 nt, Human
uguaucguauagcuguauu

SEQ ID NO: 2630568 - RNA, 18 nt, Human
uguaucguauagcuguau

SEQ ID NO: 2630569 - RNA, 17 nt, Human
uguaucguauagcugua

SEQ ID NO: 2630570 - RNA, 16 nt, Human
uguaucguauagcugu

SEQ ID NO: 2630571 - RNA, 15 nt, Human
uguaucguauagcug

SEQ ID NO: 2630572 - RNA, 19 nt, Human
uguaucguaaccagccaga

SEQ ID NO: 2630573 - RNA, 18 nt, Human
uguaucggagacagugau

SEQ ID NO: 2630574 - RNA, 16 nt, Human
uguaugauucccagcc

SEQ ID NO: 2630575 - RNA, 20 nt, Human
uguaucuacaucuuuuuuca

SEQ ID NO: 2630576 - RNA, 21 nt, Human
uguaucguauagcuguauuga

SEQ ID NO: 2630577 - RNA, 22 nt, Human
uguaucguauagcuguauugaa

SEQ ID NO: 2630578 - RNA, 15 nt, Human
uguaucuaccucacu

SEQ ID NO: 2630579 - RNA, 17 nt, Human
uguaucuagugcagcug

SEQ ID NO: 2630580 - RNA, 19 nt, Human
uguaucuagugcagcugau

SEQ ID NO: 2630581 - RNA, 21 nt, Human
uguaucuagugcagcugauuu

SEQ ID NO: 2630582 - RNA, 18 nt, Human
uguaucuaugcauuuucu

SEQ ID NO: 2630583 - RNA, 17 nt, Human
uguaugcaacaggcacu

SEQ ID NO: 2630584 - RNA, 18 nt, Human
uguaugcagcuaucuggu

SEQ ID NO: 2630585 - RNA, 23 nt, Human
uguauucuuugauguuaacacau

SEQ ID NO: 2630586 - RNA, 22 nt, Human
uguauugaacuuggaaagaaau

SEQ ID NO: 2630587 - RNA, 14 nt, Human
uguaugcacuuugu

SEQ ID NO: 2630588 - RNA, 17 nt, Human
uguaugcagcuaucugg

SEQ ID NO: 2630589 - RNA, 12 nt, Human
uguaugcagcua

SEQ ID NO: 2630590 - RNA, 18 nt, Human
uguaugcacgugugcaca

SEQ ID NO: 2630591 - RNA, 14 nt, Human
uguauuggccugga

SEQ ID NO: 2630592 - RNA, 15 nt, Human
uguauuguaaacaug

SEQ ID NO: 2630593 - RNA, 13 nt, Human
uguauuggccugg

SEQ ID NO: 2630594 - RNA, 19 nt, Human
uguauuguaaacauguguu

SEQ ID NO: 2630595 - RNA, 19 nt, Human
uguauuguaccuuuuaaca

SEQ ID NO: 2630596 - RNA, 11 nt, Human
uguauuguacc

SEQ ID NO: 2630597 - RNA, 23 nt, Human
uguauugaugacaguaguaccaa

SEQ ID NO: 2630598 - RNA, 16 nt, Human
uguauugaaucaugua

SEQ ID NO: 2630599 - RNA, 14 nt, Human
uguauugcacauug

SEQ ID NO: 2630600 - RNA, 20 nt, Human
uguauugaaucauguaguau

SEQ ID NO: 2630601 - RNA, 15 nt, Human
uguauugaaucaugu

SEQ ID NO: 2630602 - RNA, 19 nt, Human
uguauugcacauuguaaaa

SEQ ID NO: 2630603 - RNA, 15 nt, Human
uguauugcacauugu

SEQ ID NO: 2630604 - RNA, 19 nt, Human
uguauugcauauauacaua

SEQ ID NO: 2630605 - RNA, 21 nt, Human
uguauuuauaaauauauuuaa

SEQ ID NO: 2630606 - RNA, 14 nt, Human
uguauuuauaaaua

SEQ ID NO: 2630607 - RNA, 21 nt, Human
uguauuuacgcuuugauucau

SEQ ID NO: 2630608 - RNA, 23 nt, Human
uguauuuacgcuuugauucauag

SEQ ID NO: 2630609 - RNA, 21 nt, Human
uguauuuauauuuugugcuau

SEQ ID NO: 2630610 - RNA, 16 nt, Human
uguauuuaugugugag

SEQ ID NO: 2630611 - RNA, 20 nt, Human
uguauuuacgcuuugauuca

SEQ ID NO: 2630612 - RNA, 15 nt, Human
uguauuuaauuuuga

SEQ ID NO: 2630613 - RNA, 21 nt, Human
uguauuguaccuuuuaacacc

SEQ ID NO: 2630614 - RNA, 18 nt, Human
uguauuuaacagggaggg

SEQ ID NO: 2630615 - RNA, 16 nt, Human
uguauacaacccuggc

SEQ ID NO: 2630616 - RNA, 15 nt, Human
uguauaauuguaucg

SEQ ID NO: 2630617 - RNA, 13 nt, Human
uguauacaugcca

SEQ ID NO: 2630618 - RNA, 13 nt, Human
uguauaauuguau

SEQ ID NO: 2630619 - RNA, 15 nt, Human
uguauacaugccagu

SEQ ID NO: 2630620 - RNA, 14 nt, Human
uguauccuggggcu

SEQ ID NO: 2630621 - RNA, 13 nt, Human
uguauccuggggc

SEQ ID NO: 2630622 - RNA, 12 nt, Human
uguauccugggg

SEQ ID NO: 2630623 - RNA, 20 nt, Human
uguauccugaggcugagaga

SEQ ID NO: 2630624 - RNA, 22 nt, Human
uguauccccccccuguauaguu

SEQ ID NO: 2630625 - RNA, 16 nt, Human
uguaucccaugagccu

SEQ ID NO: 2630626 - RNA, 21 nt, Human
uguauccccccccuguauagu

SEQ ID NO: 2630627 - RNA, 20 nt, Human
uguauccccccccuguauag

SEQ ID NO: 2630628 - RNA, 23 nt, Human
uguaucccaugagccucagcauc

SEQ ID NO: 2630629 - RNA, 19 nt, Human
uguaucccaugagccucag

SEQ ID NO: 2630630 - RNA, 22 nt, Human
uguagcaaaauucuuaaguaug

SEQ ID NO: 2630631 - RNA, 20 nt, Human
uguagcaaaacgcauggagu

SEQ ID NO: 2630632 - RNA, 15 nt, Human
uguagcacuuacugg

SEQ ID NO: 2630633 - RNA, 19 nt, Human
uguagcacuuacugguagg

SEQ ID NO: 2630634 - RNA, 20 nt, Human
uguagcaaccuucugcauuc

SEQ ID NO: 2630635 - RNA, 20 nt, Human
uguauaaguaagaaaauauu

SEQ ID NO: 2630636 - RNA, 18 nt, Human
uguauaaguaagaaaaua

SEQ ID NO: 2630637 - RNA, 17 nt, Human
uguauaaguaagaaaau

SEQ ID NO: 2630638 - RNA, 14 nt, Human
uguauaaguaagaa

SEQ ID NO: 2630639 - RNA, 19 nt, Human
uguauaaguccuugcaaga

SEQ ID NO: 2630640 - RNA, 19 nt, Human
uguauaaguggaggcacuu

SEQ ID NO: 2630641 - RNA, 20 nt, Human
uguauaaguggaggcacuuu

SEQ ID NO: 2630642 - RNA, 16 nt, Human
uguauaaguggaggca

SEQ ID NO: 2630643 - RNA, 16 nt, Human
uguauaaguccuugca

SEQ ID NO: 2630644 - RNA, 21 nt, Human
uguauaaguggaggcacuuua

SEQ ID NO: 2630645 - RNA, 23 nt, Human
uguauaaguggaggcacuuuagg

SEQ ID NO: 2630646 - RNA, 20 nt, Human
uguauaauucaaagcaccaa

SEQ ID NO: 2630647 - RNA, 15 nt, Human
uguauaauauuuuua

SEQ ID NO: 2630648 - RNA, 17 nt, Human
ugucccagguccucacu

SEQ ID NO: 2630649 - RNA, 14 nt, Human
ugucccaugaccca

SEQ ID NO: 2630650 - RNA, 16 nt, Human
ugucccaugacccacc

SEQ ID NO: 2630651 - RNA, 14 nt, Human
ugucccagguccuc

SEQ ID NO: 2630652 - RNA, 16 nt, Human
ugucccagguccucac

SEQ ID NO: 2630653 - RNA, 20 nt, Human
ugucccagaggcugccccac

SEQ ID NO: 2630654 - RNA, 20 nt, Human
ugucccaugacccaccccug

SEQ ID NO: 2630655 - RNA, 19 nt, Human
ugucccaugacccaccccu

SEQ ID NO: 2630656 - RNA, 18 nt, Human
ugucccaugacccacccc

SEQ ID NO: 2630657 - RNA, 17 nt, Human
ugucccaugacccaccc

SEQ ID NO: 2630658 - RNA, 17 nt, Human
ugucccaugaucccugu

SEQ ID NO: 2630659 - RNA, 16 nt, Human
ugucccaugaucccug

SEQ ID NO: 2630660 - RNA, 17 nt, Human
ugucccauggacacucc

SEQ ID NO: 2630661 - RNA, 21 nt, Human
ugucccaugacccaccccugu

SEQ ID NO: 2630662 - RNA, 18 nt, Human
ugucccaugaucccugug

SEQ ID NO: 2630663 - RNA, 19 nt, Human
ugucccauggacacuccag

SEQ ID NO: 2630664 - RNA, 18 nt, Human
ugucccauggacacucca

SEQ ID NO: 2630665 - RNA, 22 nt, Human
ugucccauggacacuccagugc

SEQ ID NO: 2630666 - RNA, 23 nt, Human
ugucccaaaaagaaaggagggga

SEQ ID NO: 2630667 - RNA, 16 nt, Human
ugucccacuaucuggg

SEQ ID NO: 2630668 - RNA, 15 nt, Human
ugucccacuaucugg

SEQ ID NO: 2630669 - RNA, 17 nt, Human
ugucccacucaagccaa

SEQ ID NO: 2630670 - RNA, 20 nt, Human
ugucccacucaagccaagca

SEQ ID NO: 2630671 - RNA, 22 nt, Human
uguccauugacauguacagaga

SEQ ID NO: 2630672 - RNA, 20 nt, Human
uguccauugacauguacaga

SEQ ID NO: 2630673 - RNA, 19 nt, Human
uguccauugacauguacag

SEQ ID NO: 2630674 - RNA, 18 nt, Human
uguccauugacauguaca

SEQ ID NO: 2630675 - RNA, 14 nt, Human
uguccauuguccaa

SEQ ID NO: 2630676 - RNA, 17 nt, Human
uguccauuguccaaucc

SEQ ID NO: 2630677 - RNA, 20 nt, Human
uguccaugugguucuucaaa

SEQ ID NO: 2630678 - RNA, 12 nt, Human
uguccaugugug

SEQ ID NO: 2630679 - RNA, 13 nt, Human
uguccaugugugu

SEQ ID NO: 2630680 - RNA, 15 nt, Human
uguccaugugugugc

SEQ ID NO: 2630681 - RNA, 16 nt, Human
uguccauugacaugua

SEQ ID NO: 2630682 - RNA, 15 nt, Human
uguccauugacaugu

SEQ ID NO: 2630683 - RNA, 14 nt, Human
uguccauugacaug

SEQ ID NO: 2630684 - RNA, 16 nt, Human
uguccaugugugugca

SEQ ID NO: 2630685 - RNA, 20 nt, Human
ugucauuagccugaguagaa

SEQ ID NO: 2630686 - RNA, 17 nt, Human
ugucauuagccugagua

SEQ ID NO: 2630687 - RNA, 14 nt, Human
ugucauuagccuga

SEQ ID NO: 2630688 - RNA, 13 nt, Human
ugucauuagccug

SEQ ID NO: 2630689 - RNA, 15 nt, Human
ugucauucagaaaaa

SEQ ID NO: 2630690 - RNA, 21 nt, Human
ugucauuagccugaguagaaa

SEQ ID NO: 2630691 - RNA, 19 nt, Human
ugucauuaccagacgguuc

SEQ ID NO: 2630692 - RNA, 18 nt, Human
ugucauugcuguuguccc

SEQ ID NO: 2630693 - RNA, 22 nt, Human
uguccaugcgcucagggccaug

SEQ ID NO: 2630694 - RNA, 20 nt, Human
uguccaugcgcucagggcca

SEQ ID NO: 2630695 - RNA, 16 nt, Human
ugucaucagaagauaa

SEQ ID NO: 2630696 - RNA, 15 nt, Human
ugucaucagaagaua

SEQ ID NO: 2630697 - RNA, 13 nt, Human
ugucaucagaacu

SEQ ID NO: 2630698 - RNA, 15 nt, Human
ugucaucaauugaau

SEQ ID NO: 2630699 - RNA, 22 nt, Human
ugucaucaauugaauggucagc

SEQ ID NO: 2630700 - RNA, 23 nt, Human
ugucauuaaauggggcucacaaa

SEQ ID NO: 2630701 - RNA, 17 nt, Human
ugucaucagaagauaac

SEQ ID NO: 2630702 - RNA, 19 nt, Human
ugucauuaaaauaaauaaa

SEQ ID NO: 2630703 - RNA, 17 nt, Human
ugucauuaaagguauca

SEQ ID NO: 2630704 - RNA, 13 nt, Human
ugucauuaaaggu

SEQ ID NO: 2630705 - RNA, 18 nt, Human
ugucauauauuacuagca

SEQ ID NO: 2630706 - RNA, 21 nt, Human
ugucauauguaggugucugca

SEQ ID NO: 2630707 - RNA, 19 nt, Human
ugucauauauuacuagcau

SEQ ID NO: 2630708 - RNA, 20 nt, Human
ugucauauauggggggccaa

SEQ ID NO: 2630709 - RNA, 22 nt, Human
ugucauauauggggggccaaca

SEQ ID NO: 2630710 - RNA, 15 nt, Human
ugucauagaaauuac

SEQ ID NO: 2630711 - RNA, 16 nt, Human
ugucauagaaauuaca

SEQ ID NO: 2630712 - RNA, 21 nt, Human
ugucacucauugcugagccuc

SEQ ID NO: 2630713 - RNA, 22 nt, Human
ugucacucauugcugagccucu

SEQ ID NO: 2630714 - RNA, 23 nt, Human
ugucacucauugcugagccucug

SEQ ID NO: 2630715 - RNA, 14 nt, Human
ugucagucacagcc

SEQ ID NO: 2630716 - RNA, 15 nt, Human
ugucagucacagcca

SEQ ID NO: 2630717 - RNA, 15 nt, Human
ugucacugcaggcac

SEQ ID NO: 2630718 - RNA, 15 nt, Human
ugucacucauugcug

SEQ ID NO: 2630719 - RNA, 16 nt, Human
ugucacucauugcuga

SEQ ID NO: 2630720 - RNA, 22 nt, Human
ugucacuacucacagucucuuu

SEQ ID NO: 2630721 - RNA, 16 nt, Human
ugucacuacucacagu

SEQ ID NO: 2630722 - RNA, 22 nt, Human
uguauuugugacuaauuguaua

SEQ ID NO: 2630723 - RNA, 16 nt, Human
uguauuugugacuaau

SEQ ID NO: 2630724 - RNA, 15 nt, Human
uguauuugugacuaa

SEQ ID NO: 2630725 - RNA, 14 nt, Human
uguauuugugacua

SEQ ID NO: 2630726 - RNA, 13 nt, Human
uguauuugugacu

SEQ ID NO: 2630727 - RNA, 12 nt, Human
uguauuugugac

SEQ ID NO: 2630728 - RNA, 14 nt, Human
uguauuugcuuuuu

SEQ ID NO: 2630729 - RNA, 20 nt, Human
uguauuuguuaaugguuuga

SEQ ID NO: 2630730 - RNA, 20 nt, Human
uguauuugugacuaauugua

SEQ ID NO: 2630731 - RNA, 18 nt, Human
uguauuugugacuaauug

SEQ ID NO: 2630732 - RNA, 18 nt, Human
uguauuuguuaaugguuu

SEQ ID NO: 2630733 - RNA, 20 nt, Human
ugucagugugacugaucucu

SEQ ID NO: 2630734 - RNA, 12 nt, Human
ugucagugugac

SEQ ID NO: 2630735 - RNA, 16 nt, Human
ugucagucacagccac

SEQ ID NO: 2630736 - RNA, 17 nt, Human
ugucagucacagccacc

SEQ ID NO: 2630737 - RNA, 18 nt, Human
ugucagucacagccaccc

SEQ ID NO: 2630738 - RNA, 22 nt, Human
ugucagucacagccaccccuga

SEQ ID NO: 2630739 - RNA, 14 nt, Human
ugucagugcagccc

SEQ ID NO: 2630740 - RNA, 23 nt, Human
ugucagugccgccgccucgccca

SEQ ID NO: 2630741 - RNA, 16 nt, Human
ugucagugccgccgcc

SEQ ID NO: 2630742 - RNA, 13 nt, Human
ugucagugccgcc

SEQ ID NO: 2630743 - RNA, 16 nt, Human
ugucagugcagcccgu

SEQ ID NO: 2630744 - RNA, 15 nt, Human
ugucaguggaagaag

SEQ ID NO: 2630745 - RNA, 16 nt, Human
ugucauaagaaugaau

SEQ ID NO: 2630746 - RNA, 17 nt, Human
ugucauaagaaugaaua

SEQ ID NO: 2630747 - RNA, 14 nt, Human
ugucauaagaauga

SEQ ID NO: 2630748 - RNA, 15 nt, Human
ugucauaagaaugaa

SEQ ID NO: 2630749 - RNA, 23 nt, Human
ugucauaccaggccgccccagcc

SEQ ID NO: 2630750 - RNA, 22 nt, Human
uguaccucuugagccuugaacu

SEQ ID NO: 2630751 - RNA, 14 nt, Human
uguaccucuugagc

SEQ ID NO: 2630752 - RNA, 23 nt, Human
uguaccucuugagccuugaacuu

SEQ ID NO: 2630753 - RNA, 18 nt, Human
uguaccuggugaccccuu

SEQ ID NO: 2630754 - RNA, 18 nt, Human
uguaccugcccccaaucc

SEQ ID NO: 2630755 - RNA, 16 nt, Human
uguacccuuccuacag

SEQ ID NO: 2630756 - RNA, 22 nt, Human
uguacccccgcccaggcuggcc

SEQ ID NO: 2630757 - RNA, 19 nt, Human
uguacccccgcccaggcug

SEQ ID NO: 2630758 - RNA, 17 nt, Human
uguacccccgcccaggc

SEQ ID NO: 2630759 - RNA, 16 nt, Human
uguacccccgcccagg

SEQ ID NO: 2630760 - RNA, 15 nt, Human
uguacccccgcccag

SEQ ID NO: 2630761 - RNA, 14 nt, Human
uguacccccgccca

SEQ ID NO: 2630762 - RNA, 23 nt, Human
uguaccccccaaccccugaggaa

SEQ ID NO: 2630763 - RNA, 20 nt, Human
uguaccccccaaccccugag

SEQ ID NO: 2630764 - RNA, 15 nt, Human
uguaccgcaauguga

SEQ ID NO: 2630765 - RNA, 14 nt, Human
uguaccauuugccu

SEQ ID NO: 2630766 - RNA, 16 nt, Human
uguaccccccaacccc

SEQ ID NO: 2630767 - RNA, 14 nt, Human
uguaccccccaacc

SEQ ID NO: 2630768 - RNA, 21 nt, Human
uguacccaguauucuagguag

SEQ ID NO: 2630769 - RNA, 18 nt, Human
uguacaguagauuuucca

SEQ ID NO: 2630770 - RNA, 17 nt, Human
uguacaguagauuuucc

SEQ ID NO: 2630771 - RNA, 20 nt, Human
uguacaguagauuuuccaaa

SEQ ID NO: 2630772 - RNA, 18 nt, Human
uguacagucugucaugaa

SEQ ID NO: 2630773 - RNA, 16 nt, Human
uguacagucugucaug

SEQ ID NO: 2630774 - RNA, 15 nt, Human
uguacagucugucau

SEQ ID NO: 2630775 - RNA, 14 nt, Human
uguacagucuguca

SEQ ID NO: 2630776 - RNA, 12 nt, Human
uguacagucuug

SEQ ID NO: 2630777 - RNA, 15 nt, Human
uguacagucuuguau

SEQ ID NO: 2630778 - RNA, 14 nt, Human
uguacagucuugua

SEQ ID NO: 2630779 - RNA, 23 nt, Human
uguacagucugucaugaacaugu

SEQ ID NO: 2630780 - RNA, 13 nt, Human
uguaaugaucaua

SEQ ID NO: 2630781 - RNA, 20 nt, Human
uguaaugaaucuaagcagca

SEQ ID NO: 2630782 - RNA, 21 nt, Human
uguaaugaaucuaagcagcau

SEQ ID NO: 2630783 - RNA, 20 nt, Human
uguaaugguaucuuaaagug

SEQ ID NO: 2630784 - RNA, 13 nt, Human
uguaaugucacca

SEQ ID NO: 2630785 - RNA, 16 nt, Human
uguaaugucaccaccu

SEQ ID NO: 2630786 - RNA, 19 nt, Human
uguaaugucaccaccuucc

SEQ ID NO: 2630787 - RNA, 14 nt, Human
uguacaguagauuu

SEQ ID NO: 2630788 - RNA, 20 nt, Human
uguaaugucaccaccuuccc

SEQ ID NO: 2630789 - RNA, 16 nt, Human
uguacgucugacaggc

SEQ ID NO: 2630790 - RNA, 17 nt, Human
uguacgucugacaggca

SEQ ID NO: 2630791 - RNA, 20 nt, Human
uguacguuuguaugugugua

SEQ ID NO: 2630792 - RNA, 19 nt, Human
uguacguuuguaugugugu

SEQ ID NO: 2630793 - RNA, 14 nt, Human
uguacguggagagg

SEQ ID NO: 2630794 - RNA, 17 nt, Human
uguaccuguuccuuaga

SEQ ID NO: 2630795 - RNA, 17 nt, Human
uguaccuggugaccccu

SEQ ID NO: 2630796 - RNA, 12 nt, Human
uguacguggaga

SEQ ID NO: 2630797 - RNA, 15 nt, Human
uguacguggagaggg

SEQ ID NO: 2630798 - RNA, 16 nt, Human
uguacguuuguaugug

SEQ ID NO: 2630799 - RNA, 13 nt, Human
uguacuccuccca

SEQ ID NO: 2630800 - RNA, 12 nt, Human
uguacuccuccc

SEQ ID NO: 2630801 - RNA, 18 nt, Human
uguacucaggaggcugag

SEQ ID NO: 2630802 - RNA, 19 nt, Human
uguacuagagaucugguuu

SEQ ID NO: 2630803 - RNA, 12 nt, Human
uguacuacaauu

SEQ ID NO: 2630804 - RNA, 19 nt, Human
uguagaguuaagaagcugu

SEQ ID NO: 2630805 - RNA, 18 nt, Human
uguagaguuaagaagcug

SEQ ID NO: 2630806 - RNA, 17 nt, Human
uguagaguuaagaagcu

SEQ ID NO: 2630807 - RNA, 16 nt, Human
uguagaguuaagaagc

SEQ ID NO: 2630808 - RNA, 15 nt, Human
uguagaguuaagaag

SEQ ID NO: 2630809 - RNA, 14 nt, Human
uguagaguuaagaa

SEQ ID NO: 2630810 - RNA, 13 nt, Human
uguagaguuaaga

SEQ ID NO: 2630811 - RNA, 12 nt, Human
uguagaguuaag

SEQ ID NO: 2630812 - RNA, 21 nt, Human
uguagaguuaagaagcuguug

SEQ ID NO: 2630813 - RNA, 17 nt, Human
uguagauaauacaguuc

SEQ ID NO: 2630814 - RNA, 22 nt, Human
uguacugauuuuuguaagacaa

SEQ ID NO: 2630815 - RNA, 20 nt, Human
uguacugagccuuguaauuc

SEQ ID NO: 2630816 - RNA, 19 nt, Human
uguacugagccuuguaauu

SEQ ID NO: 2630817 - RNA, 22 nt, Human
uguacugagccuuguaauucua

SEQ ID NO: 2630818 - RNA, 20 nt, Human
uguacugaaaaaugguaauu

SEQ ID NO: 2630819 - RNA, 14 nt, Human
uguacucuuccgaa

SEQ ID NO: 2630820 - RNA, 17 nt, Human
uguacugagccuuguaa

SEQ ID NO: 2630821 - RNA, 13 nt, Human
uguacucuuccga

SEQ ID NO: 2630822 - RNA, 23 nt, Human
uguacucgcuugugcagaaaaca

SEQ ID NO: 2630823 - RNA, 12 nt, Human
uguacugaaaaa

SEQ ID NO: 2630824 - RNA, 20 nt, Human
uguacucgcuugugcagaaa

SEQ ID NO: 2630825 - RNA, 12 nt, Human
uguaaaccaaag

SEQ ID NO: 2630826 - RNA, 22 nt, Human
uguaaacauguguuuuaauucc

SEQ ID NO: 2630827 - RNA, 14 nt, Human
uguaaacauguguu

SEQ ID NO: 2630828 - RNA, 14 nt, Human
uguaaaccaaagcc

SEQ ID NO: 2630829 - RNA, 13 nt, Human
uguaaaccaaagc

SEQ ID NO: 2630830 - RNA, 20 nt, Human
uguaaacaggagacaggaag

SEQ ID NO: 2630831 - RNA, 12 nt, Human
uguaaacagugc

SEQ ID NO: 2630832 - RNA, 14 nt, Human
uguaaacagugccu

SEQ ID NO: 2630833 - RNA, 16 nt, Human
uguaaacagugccugc

SEQ ID NO: 2630834 - RNA, 17 nt, Human
uguaaacagugccugcu

SEQ ID NO: 2630835 - RNA, 19 nt, Human
uguaaacagugccugcuga

SEQ ID NO: 2630836 - RNA, 20 nt, Human
uguaaaaugugaagugaaug

SEQ ID NO: 2630837 - RNA, 14 nt, Human
uguaaaauuguaua

SEQ ID NO: 2630838 - RNA, 17 nt, Human
uguaaaauguugaauaa

SEQ ID NO: 2630839 - RNA, 17 nt, Human
uguaaaauuucacuuaa

SEQ ID NO: 2630840 - RNA, 21 nt, Human
uguaaacaaaauuuaguuuuu

SEQ ID NO: 2630841 - RNA, 20 nt, Human
ugguaguuaguagcauguug

SEQ ID NO: 2630842 - RNA, 17 nt, Human
ugguaguuaguagcaug

SEQ ID NO: 2630843 - RNA, 18 nt, Human
ugguaguuaguagcaugu

SEQ ID NO: 2630844 - RNA, 17 nt, Human
ugguagggacuuaaaaa

SEQ ID NO: 2630845 - RNA, 22 nt, Human
ugguaguaaucacaguuggccu

SEQ ID NO: 2630846 - RNA, 22 nt, Human
ugguaguacuccugcaaaauuu

SEQ ID NO: 2630847 - RNA, 16 nt, Human
ugguaggcauuuccua

SEQ ID NO: 2630848 - RNA, 22 nt, Human
ugguaggaucagcccucauuuu

SEQ ID NO: 2630849 - RNA, 19 nt, Human
ugguagggggaaaaugugu

SEQ ID NO: 2630850 - RNA, 18 nt, Human
ugguaggacuguagaaaa

SEQ ID NO: 2630851 - RNA, 17 nt, Human
ugguaggacuguagaaa

SEQ ID NO: 2630852 - RNA, 14 nt, Human
uguaaauuaacuuu

SEQ ID NO: 2630853 - RNA, 15 nt, Human
uguaaauuaacuuuu

SEQ ID NO: 2630854 - RNA, 16 nt, Human
uguaaauuaacuuuua

SEQ ID NO: 2630855 - RNA, 17 nt, Human
uguaaauuaacuuuuau

SEQ ID NO: 2630856 - RNA, 13 nt, Human
uguaaauuaacuu

SEQ ID NO: 2630857 - RNA, 18 nt, Human
uguaaaugguguacauaa

SEQ ID NO: 2630858 - RNA, 16 nt, Human
uguaaaugguguacau

SEQ ID NO: 2630859 - RNA, 15 nt, Human
uguaaaugguguaca

SEQ ID NO: 2630860 - RNA, 11 nt, Human
uguaaauguau

SEQ ID NO: 2630861 - RNA, 17 nt, Human
uguaaaugguguacaua

SEQ ID NO: 2630862 - RNA, 18 nt, Human
uguaaaugcaucuguccu

SEQ ID NO: 2630863 - RNA, 22 nt, Human
uguaaaugcugucaacuaugau

SEQ ID NO: 2630864 - RNA, 15 nt, Human
uguaaaugcaucugu

SEQ ID NO: 2630865 - RNA, 21 nt, Human
uguaacuaggcucagagaugu

SEQ ID NO: 2630866 - RNA, 18 nt, Human
uguaacuaggcucagaga

SEQ ID NO: 2630867 - RNA, 20 nt, Human
uguaacguugcugugggaac

SEQ ID NO: 2630868 - RNA, 21 nt, Human
uguaacuauaguccagcuuug

SEQ ID NO: 2630869 - RNA, 19 nt, Human
uguaacuauaguccagcuu

SEQ ID NO: 2630870 - RNA, 18 nt, Human
uguaacguugcuguggga

SEQ ID NO: 2630871 - RNA, 17 nt, Human
uguaacguugcuguggg

SEQ ID NO: 2630872 - RNA, 16 nt, Human
uguaacguugcugugg

SEQ ID NO: 2630873 - RNA, 17 nt, Human
uguaaauugaaucagua

SEQ ID NO: 2630874 - RNA, 22 nt, Human
uguaaauugaaucaguauaaac

SEQ ID NO: 2630875 - RNA, 15 nt, Human
uguaaauuuauguga

SEQ ID NO: 2630876 - RNA, 19 nt, Human
uguaaccucuucagaggcc

SEQ ID NO: 2630877 - RNA, 16 nt, Human
uguaaauuuaugugau

SEQ ID NO: 2630878 - RNA, 23 nt, Human
uguaacugucagccgggcccuga

SEQ ID NO: 2630879 - RNA, 12 nt, Human
uguaacugcuga

SEQ ID NO: 2630880 - RNA, 21 nt, Human
uguaacuggcaguuuuccauu

SEQ ID NO: 2630881 - RNA, 12 nt, Human
uguaacuccacc

SEQ ID NO: 2630882 - RNA, 17 nt, Human
uguaacucuaaaagauc

SEQ ID NO: 2630883 - RNA, 16 nt, Human
uguaacucuaaaagau

SEQ ID NO: 2630884 - RNA, 12 nt, Human
uguaacucuaaa

SEQ ID NO: 2630885 - RNA, 13 nt, Human
uguaacuccacca

SEQ ID NO: 2630886 - RNA, 20 nt, Human
uguaacucuaaaagauccuu

SEQ ID NO: 2630887 - RNA, 19 nt, Human
uguaacucuaaaagauccu

SEQ ID NO: 2630888 - RNA, 18 nt, Human
uguaacucuaaaagaucc

SEQ ID NO: 2630889 - RNA, 23 nt, Human
uguaacugcauugagaacugcau

SEQ ID NO: 2630890 - RNA, 15 nt, Human
uguaaucacagcuac

SEQ ID NO: 2630891 - RNA, 14 nt, Human
uguaaucaguuuua

SEQ ID NO: 2630892 - RNA, 19 nt, Human
uguaaugaaccgcugaaua

SEQ ID NO: 2630893 - RNA, 20 nt, Human
uguaaugaaacaccuucucu

SEQ ID NO: 2630894 - RNA, 16 nt, Human
uguaaucccagcuacu

SEQ ID NO: 2630895 - RNA, 22 nt, Human
uguaaucccagcacuuugggag

SEQ ID NO: 2630896 - RNA, 23 nt, Human
uguaaucccagcacuuugggagg

SEQ ID NO: 2630897 - RNA, 16 nt, Human
uguaaucccagcacuu

SEQ ID NO: 2630898 - RNA, 17 nt, Human
uguaaucauauaauaaa

SEQ ID NO: 2630899 - RNA, 21 nt, Human
uguaaucauuucuugggcccu

SEQ ID NO: 2630900 - RNA, 13 nt, Human
uguaaucccagca

SEQ ID NO: 2630901 - RNA, 15 nt, Human
uguaaucccagcacu

SEQ ID NO: 2630902 - RNA, 23 nt, Human
ugugaauuucuucacuguugaaa

SEQ ID NO: 2630903 - RNA, 15 nt, Human
ugugaauggauugga

SEQ ID NO: 2630904 - RNA, 13 nt, Human
ugugaauggauug

SEQ ID NO: 2630905 - RNA, 21 nt, Human
ugugacaaggauugcuacugu

SEQ ID NO: 2630906 - RNA, 17 nt, Human
ugugaaugccacugccu

SEQ ID NO: 2630907 - RNA, 17 nt, Human
ugugaaugaacacucuu

SEQ ID NO: 2630908 - RNA, 23 nt, Human
ugugaaugaacacucuuuugcuu

SEQ ID NO: 2630909 - RNA, 14 nt, Human
ugugaaugaacacu

SEQ ID NO: 2630910 - RNA, 15 nt, Human
ugugaaucagacccu

SEQ ID NO: 2630911 - RNA, 18 nt, Human
ugugaaucagacccuacc

SEQ ID NO: 2630912 - RNA, 22 nt, Human
ugugaauagaacucugaaauga

SEQ ID NO: 2630913 - RNA, 20 nt, Human
ugugaauauggacucaguuu

SEQ ID NO: 2630914 - RNA, 12 nt, Human
ugugaauaaauu

SEQ ID NO: 2630915 - RNA, 16 nt, Human
ugugaaucauuuuacc

SEQ ID NO: 2630916 - RNA, 23 nt, Human
ugugaauauuuccauauggauuu

SEQ ID NO: 2630917 - RNA, 21 nt, Human
ugugaauauuuccauauggau

SEQ ID NO: 2630918 - RNA, 14 nt, Human
ugugaaucagaccc

SEQ ID NO: 2630919 - RNA, 22 nt, Human
ugugaccacugcagaagacagu

SEQ ID NO: 2630920 - RNA, 20 nt, Human
ugugacccagcacugcccaa

SEQ ID NO: 2630921 - RNA, 17 nt, Human
ugugacccagcacugcc

SEQ ID NO: 2630922 - RNA, 21 nt, Human
ugugacccagauccucacaac

SEQ ID NO: 2630923 - RNA, 15 nt, Human
ugugaccagggguga

SEQ ID NO: 2630924 - RNA, 19 nt, Human
ugugaccagucugacccuu

SEQ ID NO: 2630925 - RNA, 14 nt, Human
ugugaccagcacug

SEQ ID NO: 2630926 - RNA, 17 nt, Human
ugugaccagcacugucu

SEQ ID NO: 2630927 - RNA, 12 nt, Human
ugugacauguaa

SEQ ID NO: 2630928 - RNA, 22 nt, Human
ugugacauggugccugagaggc

SEQ ID NO: 2630929 - RNA, 14 nt, Human
ugugacauguaaca

SEQ ID NO: 2630930 - RNA, 20 nt, Human
ugugacauggugccugagag

SEQ ID NO: 2630931 - RNA, 18 nt, Human
ugugacauggugccugag

SEQ ID NO: 2630932 - RNA, 17 nt, Human
ugugacauggugccuga

SEQ ID NO: 2630933 - RNA, 16 nt, Human
ugugacauggugccug

SEQ ID NO: 2630934 - RNA, 21 nt, Human
ugugacaugcgggcugggcag

SEQ ID NO: 2630935 - RNA, 19 nt, Human
ugugacaugcgggcugggc

SEQ ID NO: 2630936 - RNA, 16 nt, Human
ugugaauggauuggau

SEQ ID NO: 2630937 - RNA, 22 nt, Human
ugugaauugccugcagagagaa

SEQ ID NO: 2630938 - RNA, 22 nt, Human
ugugacacauaugcaccuugug

SEQ ID NO: 2630939 - RNA, 17 nt, Human
ugugacacauaugcacc

SEQ ID NO: 2630940 - RNA, 19 nt, Human
ugugacaauuuuguacaaa

SEQ ID NO: 2630941 - RNA, 17 nt, Human
ugugacaggcagcagag

SEQ ID NO: 2630942 - RNA, 15 nt, Human
ugugacaggcagcag

SEQ ID NO: 2630943 - RNA, 18 nt, Human
ugugacagauuauacaga

SEQ ID NO: 2630944 - RNA, 16 nt, Human
ugugacaggcagcaga

SEQ ID NO: 2630945 - RNA, 18 nt, Human
ugugacauauuaugucuu

SEQ ID NO: 2630946 - RNA, 17 nt, Human
ugugacaugcgggcugg

SEQ ID NO: 2630947 - RNA, 15 nt, Human
ugugacccccagcuc

SEQ ID NO: 2630948 - RNA, 16 nt, Human
ugugacccccagcucc

SEQ ID NO: 2630949 - RNA, 20 nt, Human
ugugacccccagcuccggcc

SEQ ID NO: 2630950 - RNA, 17 nt, Human
ugugacccccagcuccg

SEQ ID NO: 2630951 - RNA, 22 nt, Human
ugugacccagcacugcccaaag

SEQ ID NO: 2630952 - RNA, 18 nt, Human
ugugaguacuacaguccu

SEQ ID NO: 2630953 - RNA, 18 nt, Human
ugugaggggcucucucau

SEQ ID NO: 2630954 - RNA, 21 nt, Human
ugugaggugcagagugcccag

SEQ ID NO: 2630955 - RNA, 20 nt, Human
ugugaguacuacaguccucc

SEQ ID NO: 2630956 - RNA, 19 nt, Human
ugugaguacuacaguccuc

SEQ ID NO: 2630957 - RNA, 23 nt, Human
ugugaguacuacaguccucccau

SEQ ID NO: 2630958 - RNA, 15 nt, Human
ugugaguaagagcug

SEQ ID NO: 2630959 - RNA, 19 nt, Human
ugugaguaagagcuggugu

SEQ ID NO: 2630960 - RNA, 22 nt, Human
ugugaguuuaccuuguauacug

SEQ ID NO: 2630961 - RNA, 21 nt, Human
ugugaguuuaguaaggcugug

SEQ ID NO: 2630962 - RNA, 23 nt, Human
ugugaguuuaccuuguauacugu

SEQ ID NO: 2630963 - RNA, 21 nt, Human
ugugauacaaugcugugcccu

SEQ ID NO: 2630964 - RNA, 15 nt, Human
ugugauagcacuuuc

SEQ ID NO: 2630965 - RNA, 17 nt, Human
ugugauagcacuuucua

SEQ ID NO: 2630966 - RNA, 14 nt, Human
ugugauagcacuuu

SEQ ID NO: 2630967 - RNA, 22 nt, Human
ugugauacccauagcuuccaug

SEQ ID NO: 2630968 - RNA, 18 nt, Human
ugugauaaggaucagaac

SEQ ID NO: 2630969 - RNA, 14 nt, Human
ugugaggcuguccu

SEQ ID NO: 2630970 - RNA, 14 nt, Human
ugugcaagagaggg

SEQ ID NO: 2630971 - RNA, 13 nt, Human
ugugauauaagug

SEQ ID NO: 2630972 - RNA, 17 nt, Human
ugugcaaguaugugagu

SEQ ID NO: 2630973 - RNA, 18 nt, Human
ugugcaaguaugugagug

SEQ ID NO: 2630974 - RNA, 16 nt, Human
ugugcaaguguaugca

SEQ ID NO: 2630975 - RNA, 15 nt, Human
ugugcaagugucugu

SEQ ID NO: 2630976 - RNA, 19 nt, Human
ugugcaagugucugugugc

SEQ ID NO: 2630977 - RNA, 20 nt, Human
ugugcaagugucugugugca

SEQ ID NO: 2630978 - RNA, 12 nt, Human
ugugcaagugug

SEQ ID NO: 2630979 - RNA, 21 nt, Human
ugugcaagugugugcaugugu

SEQ ID NO: 2630980 - RNA, 14 nt, Human
ugugaaguuuacau

SEQ ID NO: 2630981 - RNA, 20 nt, Human
ugugaaguuuacauuguaaa

SEQ ID NO: 2630982 - RNA, 14 nt, Human
ugugaaaggaaaga

SEQ ID NO: 2630983 - RNA, 13 nt, Human
ugugaaaggaaag

SEQ ID NO: 2630984 - RNA, 19 nt, Human
ugugaaacuggcacugaau

SEQ ID NO: 2630985 - RNA, 22 nt, Human
ugugaaaccuuuuuuaagauuu

SEQ ID NO: 2630986 - RNA, 20 nt, Human
ugugaaaccuuuuuuaagau

SEQ ID NO: 2630987 - RNA, 13 nt, Human
ugugaaacauguu

SEQ ID NO: 2630988 - RNA, 21 nt, Human
ugucuggugguggcaccaucu

SEQ ID NO: 2630989 - RNA, 21 nt, Human
ugucuuuuuuuuaaugugcug

SEQ ID NO: 2630990 - RNA, 18 nt, Human
ugucuuuuuuuuaaugug

SEQ ID NO: 2630991 - RNA, 17 nt, Human
ugugaaaaaaaaaaugc

SEQ ID NO: 2630992 - RNA, 20 nt, Human
ugugaaaaaaaaaaugcuga

SEQ ID NO: 2630993 - RNA, 22 nt, Human
ugucuuuggacccugaggccca

SEQ ID NO: 2630994 - RNA, 19 nt, Human
ugucuuuggacccugaggc

SEQ ID NO: 2630995 - RNA, 14 nt, Human
ugucuuuuuucuaa

SEQ ID NO: 2630996 - RNA, 16 nt, Human
ugucuuuuuucacuac

SEQ ID NO: 2630997 - RNA, 18 nt, Human
ugucuuuggacccugagg

SEQ ID NO: 2630998 - RNA, 17 nt, Human
ugucuuuggacccugag

SEQ ID NO: 2630999 - RNA, 16 nt, Human
ugucugguggccccgu

SEQ ID NO: 2631000 - RNA, 14 nt, Human
ugucugguggcccc

SEQ ID NO: 2631001 - RNA, 13 nt, Human
ugucugguggccc

SEQ ID NO: 2631002 - RNA, 12 nt, Human
ugucugggcuga

SEQ ID NO: 2631003 - RNA, 11 nt, Human
ugucugggcug

SEQ ID NO: 2631004 - RNA, 23 nt, Human
ugucuggcugaggauuucaagcc

SEQ ID NO: 2631005 - RNA, 22 nt, Human
ugucucaaugcucauaacggau

SEQ ID NO: 2631006 - RNA, 19 nt, Human
ugucucaaugcucauaacg

SEQ ID NO: 2631007 - RNA, 17 nt, Human
ugucucaaugcucauaa

SEQ ID NO: 2631008 - RNA, 16 nt, Human
ugucucaaugcucaua

SEQ ID NO: 2631009 - RNA, 17 nt, Human
ugucucaggucccugca

SEQ ID NO: 2631010 - RNA, 16 nt, Human
ugucucaggucccugc

SEQ ID NO: 2631011 - RNA, 21 nt, Human
ugucucaagagggcacuggug

SEQ ID NO: 2631012 - RNA, 20 nt, Human
ugucucaagagggcacuggu

SEQ ID NO: 2631013 - RNA, 15 nt, Human
ugucucaaugcucau

SEQ ID NO: 2631014 - RNA, 14 nt, Human
ugucucaaugcuca

SEQ ID NO: 2631015 - RNA, 23 nt, Human
ugucucaagagggcacugguggc

SEQ ID NO: 2631016 - RNA, 14 nt, Human
uguccccacacucc

SEQ ID NO: 2631017 - RNA, 12 nt, Human
uguccccacacu

SEQ ID NO: 2631018 - RNA, 11 nt, Human
uguccccacac

SEQ ID NO: 2631019 - RNA, 21 nt, Human
uguccccaaauccgaaccucc

SEQ ID NO: 2631020 - RNA, 22 nt, Human
uguccccaaauccgaaccuccu

SEQ ID NO: 2631021 - RNA, 14 nt, Human
uguccccaaauccg

SEQ ID NO: 2631022 - RNA, 19 nt, Human
uguccccaaauccgaaccu

SEQ ID NO: 2631023 - RNA, 20 nt, Human
ugucccauuucuaaaggccu

SEQ ID NO: 2631024 - RNA, 18 nt, Human
uguccccaaaccugcaag

SEQ ID NO: 2631025 - RNA, 16 nt, Human
uguccccacacuccua

SEQ ID NO: 2631026 - RNA, 15 nt, Human
uguccccacacuccu

SEQ ID NO: 2631027 - RNA, 19 nt, Human
ugucucaagagggcacugg

SEQ ID NO: 2631028 - RNA, 21 nt, Human
ugucucaguccaugaagaugu

SEQ ID NO: 2631029 - RNA, 22 nt, Human
ugucucaguccaugaagaugua

SEQ ID NO: 2631030 - RNA, 16 nt, Human
ugucugccaauuuuug

SEQ ID NO: 2631031 - RNA, 15 nt, Human
ugucugccagccagc

SEQ ID NO: 2631032 - RNA, 16 nt, Human
ugucugccagccagca

SEQ ID NO: 2631033 - RNA, 13 nt, Human
ugucugcauuucg

SEQ ID NO: 2631034 - RNA, 21 nt, Human
ugucugcauuucgguggcuag

SEQ ID NO: 2631035 - RNA, 18 nt, Human
ugucugcaggauugauua

SEQ ID NO: 2631036 - RNA, 17 nt, Human
ugucucaguccaccuga

SEQ ID NO: 2631037 - RNA, 14 nt, Human
ugucucacacuggc

SEQ ID NO: 2631038 - RNA, 16 nt, Human
ugucuggcugcagagc

SEQ ID NO: 2631039 - RNA, 17 nt, Human
ugucuggcugcagagca

SEQ ID NO: 2631040 - RNA, 14 nt, Human
ugucuggcugcaga

SEQ ID NO: 2631041 - RNA, 19 nt, Human
ugucuggcugaggauuuca

SEQ ID NO: 2631042 - RNA, 21 nt, Human
ugucugcgugguuccuuucuc

SEQ ID NO: 2631043 - RNA, 15 nt, Human
ugucugccucuuaga

SEQ ID NO: 2631044 - RNA, 14 nt, Human
ugucugccucuuag

SEQ ID NO: 2631045 - RNA, 16 nt, Human
ugucugcccuucaccc

SEQ ID NO: 2631046 - RNA, 11 nt, Human
ugucugcccuu

SEQ ID NO: 2631047 - RNA, 18 nt, Human
ugucugccagccagcagc

SEQ ID NO: 2631048 - RNA, 19 nt, Human
ugucugccagccagcagcc

SEQ ID NO: 2631049 - RNA, 13 nt, Human
ugucugccagggc

SEQ ID NO: 2631050 - RNA, 15 nt, Human
ugugccuggcucaga

SEQ ID NO: 2631051 - RNA, 13 nt, Human
ugugccuggcuca

SEQ ID NO: 2631052 - RNA, 15 nt, Human
ugugccugacccuac

SEQ ID NO: 2631053 - RNA, 13 nt, Human
ugugccugcagcc

SEQ ID NO: 2631054 - RNA, 15 nt, Human
ugugccucugccugu

SEQ ID NO: 2631055 - RNA, 12 nt, Human
ugugccugcagc

SEQ ID NO: 2631056 - RNA, 17 nt, Human
ugugccucugggacugg

SEQ ID NO: 2631057 - RNA, 20 nt, Human
ugugccuggguggacauggc

SEQ ID NO: 2631058 - RNA, 20 nt, Human
ugugcgugcauguguguuca

SEQ ID NO: 2631059 - RNA, 13 nt, Human
ugugcgugaaaca

SEQ ID NO: 2631060 - RNA, 14 nt, Human
ugugcgugaaacac

SEQ ID NO: 2631061 - RNA, 23 nt, Human
ugugcuucuaauauuuauugcuu

SEQ ID NO: 2631062 - RNA, 21 nt, Human
ugugcuucuaauauuuauugc

SEQ ID NO: 2631063 - RNA, 21 nt, Human
ugugcuucuuucuuugggaau

SEQ ID NO: 2631064 - RNA, 14 nt, Human
ugugcuucuuucuu

SEQ ID NO: 2631065 - RNA, 15 nt, Human
ugugcuuuucuccaa

SEQ ID NO: 2631066 - RNA, 14 nt, Human
ugugcuuuuccuau

SEQ ID NO: 2631067 - RNA, 16 nt, Human
ugugcuuuuccuauuu

SEQ ID NO: 2631068 - RNA, 16 nt, Human
ugugcuuuuaaaugca

SEQ ID NO: 2631069 - RNA, 22 nt, Human
ugugcuuauguaugagguacaa

SEQ ID NO: 2631070 - RNA, 19 nt, Human
ugugcuucgggcccuuccc

SEQ ID NO: 2631071 - RNA, 13 nt, Human
ugugcuuauguuu

SEQ ID NO: 2631072 - RNA, 20 nt, Human
ugugcgugcuugaguguguu

SEQ ID NO: 2631073 - RNA, 15 nt, Human
ugugcgugaaacaca

SEQ ID NO: 2631074 - RNA, 16 nt, Human
ugugcgugaaacacac

SEQ ID NO: 2631075 - RNA, 22 nt, Human
ugugcgugaaacacaccaggcu

SEQ ID NO: 2631076 - RNA, 15 nt, Human
ugugcgugcaugugc

SEQ ID NO: 2631077 - RNA, 21 nt, Human
ugugcguguguccaugugugu

SEQ ID NO: 2631078 - RNA, 20 nt, Human
ugugcguguguccaugugug

SEQ ID NO: 2631079 - RNA, 17 nt, Human
ugugcuacugauuguuu

SEQ ID NO: 2631080 - RNA, 14 nt, Human
ugugcuacuuugcc

SEQ ID NO: 2631081 - RNA, 21 nt, Human
ugugcuaccuggguccuuuuc

SEQ ID NO: 2631082 - RNA, 23 nt, Human
ugugcuaaccacgucugucuuca

SEQ ID NO: 2631083 - RNA, 22 nt, Human
ugugcagccuguccugggcugg

SEQ ID NO: 2631084 - RNA, 16 nt, Human
ugugcagguggggaga

SEQ ID NO: 2631085 - RNA, 23 nt, Human
ugugcagguggggagacugggcu

SEQ ID NO: 2631086 - RNA, 17 nt, Human
ugugcagucacuggagg

SEQ ID NO: 2631087 - RNA, 17 nt, Human
ugugcagguuuguuaca

SEQ ID NO: 2631088 - RNA, 23 nt, Human
ugugcagccccgccuccaggcca

SEQ ID NO: 2631089 - RNA, 19 nt, Human
ugugcagccgcugagcgag

SEQ ID NO: 2631090 - RNA, 22 nt, Human
ugugcagccccgccuccaggcc

SEQ ID NO: 2631091 - RNA, 22 nt, Human
ugugcaccuuaccaacuuucug

SEQ ID NO: 2631092 - RNA, 21 nt, Human
ugugcaccuuaccaacuuucu

SEQ ID NO: 2631093 - RNA, 23 nt, Human
ugugcagacucaauaaaaucaug

SEQ ID NO: 2631094 - RNA, 22 nt, Human
ugugcacaugcacgugugugca

SEQ ID NO: 2631095 - RNA, 16 nt, Human
ugugcacaugcacgug

SEQ ID NO: 2631096 - RNA, 18 nt, Human
ugugcacccucuauccca

SEQ ID NO: 2631097 - RNA, 14 nt, Human
ugugcacccauggg

SEQ ID NO: 2631098 - RNA, 13 nt, Human
ugugcaccagggu

SEQ ID NO: 2631099 - RNA, 14 nt, Human
ugugcaccaggguu

SEQ ID NO: 2631100 - RNA, 18 nt, Human
ugugcacaugugugcgug

SEQ ID NO: 2631101 - RNA, 15 nt, Human
ugugcacaauucugu

SEQ ID NO: 2631102 - RNA, 14 nt, Human
ugugccucugccug

SEQ ID NO: 2631103 - RNA, 22 nt, Human
ugugcauguguguaagugugug

SEQ ID NO: 2631104 - RNA, 13 nt, Human
ugugccucugccu

SEQ ID NO: 2631105 - RNA, 13 nt, Human
ugugccucuggga

SEQ ID NO: 2631106 - RNA, 15 nt, Human
ugugccucugggacu

SEQ ID NO: 2631107 - RNA, 16 nt, Human
ugugccucugggacug

SEQ ID NO: 2631108 - RNA, 20 nt, Human
ugugcauguaugucuuggac

SEQ ID NO: 2631109 - RNA, 15 nt, Human
ugugcaugguggcac

SEQ ID NO: 2631110 - RNA, 19 nt, Human
ugugcaugggugaagggag

SEQ ID NO: 2631111 - RNA, 23 nt, Human
ugugcauguaugucuuggacacu

SEQ ID NO: 2631112 - RNA, 22 nt, Human
ugugcaugugugcgagugugug

SEQ ID NO: 2631113 - RNA, 19 nt, Human
ugugcauauuguacacuuu

SEQ ID NO: 2631114 - RNA, 17 nt, Human
ugugcauauuguacacu

SEQ ID NO: 2631115 - RNA, 15 nt, Human
ugugcauauuguaca

SEQ ID NO: 2631116 - RNA, 13 nt, Human
ugugcauauugua

SEQ ID NO: 2631117 - RNA, 15 nt, Human
ugugcaugggagcaa

SEQ ID NO: 2631118 - RNA, 13 nt, Human
ugugcauggguga

SEQ ID NO: 2631119 - RNA, 20 nt, Human
ugugcagugaagguugcuga

SEQ ID NO: 2631120 - RNA, 20 nt, Human
ugugcaguccugggaugugg

SEQ ID NO: 2631121 - RNA, 17 nt, Human
ugugcaguccugggaug

SEQ ID NO: 2631122 - RNA, 18 nt, Human
ugugcagucacuggaggu

SEQ ID NO: 2631123 - RNA, 13 nt, Human
ugugcaguucuag

SEQ ID NO: 2631124 - RNA, 14 nt, Human
ugugcaguguagcc

SEQ ID NO: 2631125 - RNA, 12 nt, Human
ugugcaguguug

SEQ ID NO: 2631126 - RNA, 19 nt, Human
ugugcaguucuaguuugca

SEQ ID NO: 2631127 - RNA, 22 nt, Human
ugugcaguucuaguuugcauuc

SEQ ID NO: 2631128 - RNA, 19 nt, Human
ugugcauagagccacguau

SEQ ID NO: 2631129 - RNA, 17 nt, Human
uguggaaaguguaaagc

SEQ ID NO: 2631130 - RNA, 16 nt, Human
uguggaaaguguaaag

SEQ ID NO: 2631131 - RNA, 15 nt, Human
uguggaaaguguaaa

SEQ ID NO: 2631132 - RNA, 14 nt, Human
uguggaaaguguaa

SEQ ID NO: 2631133 - RNA, 20 nt, Human
uguggaaaguguaaagcauu

SEQ ID NO: 2631134 - RNA, 19 nt, Human
uguggaaaguguaaagcau

SEQ ID NO: 2631135 - RNA, 21 nt, Human
uguggacuaaaagauauaagu

SEQ ID NO: 2631136 - RNA, 21 nt, Human
uguggaaaguguaaagcauuc

SEQ ID NO: 2631137 - RNA, 14 nt, Human
uguggacugugaug

SEQ ID NO: 2631138 - RNA, 15 nt, Human
uguggacugugaugc

SEQ ID NO: 2631139 - RNA, 16 nt, Human
uguggacacagcucuu

SEQ ID NO: 2631140 - RNA, 15 nt, Human
uguggacacagcucu

SEQ ID NO: 2631141 - RNA, 21 nt, Human
uguggcuccuggggguucuuu

SEQ ID NO: 2631142 - RNA, 19 nt, Human
uguggcuccuaucuguguu

SEQ ID NO: 2631143 - RNA, 18 nt, Human
uguggcuccuaucugugu

SEQ ID NO: 2631144 - RNA, 17 nt, Human
uguggcuccuaucugug

SEQ ID NO: 2631145 - RNA, 23 nt, Human
uguggcuccccucuauuuagcau

SEQ ID NO: 2631146 - RNA, 19 nt, Human
uguggagaagccacaggcc

SEQ ID NO: 2631147 - RNA, 15 nt, Human
uguggcuccccucua

SEQ ID NO: 2631148 - RNA, 19 nt, Human
uguggacuaaaagauauaa

SEQ ID NO: 2631149 - RNA, 14 nt, Human
uguggcuccccucu

SEQ ID NO: 2631150 - RNA, 23 nt, Human
uguggagaaauaaaaauaccucu

SEQ ID NO: 2631151 - RNA, 13 nt, Human
uguggagaaagga

SEQ ID NO: 2631152 - RNA, 16 nt, Human
uguggacuuuguucac

SEQ ID NO: 2631153 - RNA, 23 nt, Human
uguggagaaacuguagucucagg

SEQ ID NO: 2631154 - RNA, 12 nt, Human
uguggagaagcg

SEQ ID NO: 2631155 - RNA, 21 nt, Human
uguggagaagcggcuggcagc

SEQ ID NO: 2631156 - RNA, 13 nt, Human
uguggacacagcu

SEQ ID NO: 2631157 - RNA, 14 nt, Human
uguggacacagcuc

SEQ ID NO: 2631158 - RNA, 14 nt, Human
uguggaaagccucu

SEQ ID NO: 2631159 - RNA, 15 nt, Human
uguggaaagccucug

SEQ ID NO: 2631160 - RNA, 17 nt, Human
uguggaaagccucugcu

SEQ ID NO: 2631161 - RNA, 19 nt, Human
uguggaaagccucugcugc

SEQ ID NO: 2631162 - RNA, 20 nt, Human
uguggaaagccucugcugcc

SEQ ID NO: 2631163 - RNA, 21 nt, Human
uguggaaagucacaggucaca

SEQ ID NO: 2631164 - RNA, 16 nt, Human
uguggaaagugaauuu

SEQ ID NO: 2631165 - RNA, 19 nt, Human
uguggaaagugaauuugaa

SEQ ID NO: 2631166 - RNA, 22 nt, Human
uguggaaagugaauuugaauga

SEQ ID NO: 2631167 - RNA, 12 nt, Human
uguggaaagugu

SEQ ID NO: 2631168 - RNA, 23 nt, Human
uguggaaagugaauuugaaugaa

SEQ ID NO: 2631169 - RNA, 21 nt, Human
uguggaaaagccaagaggcug

SEQ ID NO: 2631170 - RNA, 23 nt, Human
uguggaaaagccaagaggcugca

SEQ ID NO: 2631171 - RNA, 17 nt, Human
uguggaaaaugaaaauu

SEQ ID NO: 2631172 - RNA, 12 nt, Human
uguggaaagccu

SEQ ID NO: 2631173 - RNA, 13 nt, Human
uguggaaaacaga

SEQ ID NO: 2631174 - RNA, 20 nt, Human
uguggaaaaaugagagaagg

SEQ ID NO: 2631175 - RNA, 19 nt, Human
uguggaaaaaugagagaag

SEQ ID NO: 2631176 - RNA, 16 nt, Human
uguggaaaaaugagag

SEQ ID NO: 2631177 - RNA, 14 nt, Human
uguggaaaaauauu

SEQ ID NO: 2631178 - RNA, 16 nt, Human
uguggaaaaauauuua

SEQ ID NO: 2631179 - RNA, 19 nt, Human
uguggaaaagccaagaggc

SEQ ID NO: 2631180 - RNA, 20 nt, Human
uguggaaaagaaacacgcac

SEQ ID NO: 2631181 - RNA, 15 nt, Human
uguggaaaagaaaca

SEQ ID NO: 2631182 - RNA, 19 nt, Human
uguguacauggcagaguuu

SEQ ID NO: 2631183 - RNA, 24 nt, Human
uguguacaucccauguaacagaaa

SEQ ID NO: 2631184 - RNA, 15 nt, Human
uguguacccaaacgu

SEQ ID NO: 2631185 - RNA, 15 nt, Human
uguguacguggagag

SEQ ID NO: 2631186 - RNA, 16 nt, Human
uguguacguggagagg

SEQ ID NO: 2631187 - RNA, 14 nt, Human
ugugggucugugug

SEQ ID NO: 2631188 - RNA, 16 nt, Human
ugugggucugugugug

SEQ ID NO: 2631189 - RNA, 20 nt, Human
ugugggucugugugugugua

SEQ ID NO: 2631190 - RNA, 23 nt, Human
uguguacaucccauguaacagaa

SEQ ID NO: 2631191 - RNA, 20 nt, Human
uguguacaucccauguaaca

SEQ ID NO: 2631192 - RNA, 15 nt, Human
uguggguaccuguau

SEQ ID NO: 2631193 - RNA, 23 nt, Human
ugugggggaagagcacagcccuc

SEQ ID NO: 2631194 - RNA, 20 nt, Human
uguggggcugguagcucagg

SEQ ID NO: 2631195 - RNA, 13 nt, Human
ugugggggcugca

SEQ ID NO: 2631196 - RNA, 12 nt, Human
uguggggccuug

SEQ ID NO: 2631197 - RNA, 15 nt, Human
uguggggccagguca

SEQ ID NO: 2631198 - RNA, 16 nt, Human
uguggggauuucuccc

SEQ ID NO: 2631199 - RNA, 16 nt, Human
ugugggggucugugug

SEQ ID NO: 2631200 - RNA, 15 nt, Human
uguggggugaaaagu

SEQ ID NO: 2631201 - RNA, 22 nt, Human
uguggggugugcacaucucugc

SEQ ID NO: 2631202 - RNA, 21 nt, Human
ugugggguuuuuggagaaggu

SEQ ID NO: 2631203 - RNA, 21 nt, Human
uguggguacagagaggucaag

SEQ ID NO: 2631204 - RNA, 15 nt, Human
ugugggucaaggaau

SEQ ID NO: 2631205 - RNA, 17 nt, Human
uguggcuuucagccucu

SEQ ID NO: 2631206 - RNA, 19 nt, Human
uguggcuuucagccucugg

SEQ ID NO: 2631207 - RNA, 17 nt, Human
uguggcuuucuuucuuu

SEQ ID NO: 2631208 - RNA, 22 nt, Human
uguggcuucuuaaucuuuucac

SEQ ID NO: 2631209 - RNA, 19 nt, Human
uguggcugucagcaggaag

SEQ ID NO: 2631210 - RNA, 21 nt, Human
uguggcugucagcaggaagca

SEQ ID NO: 2631211 - RNA, 21 nt, Human
uguggcugggggcaggagggc

SEQ ID NO: 2631212 - RNA, 16 nt, Human
uguggcugcagcagcg

SEQ ID NO: 2631213 - RNA, 15 nt, Human
uguggcugucagcag

SEQ ID NO: 2631214 - RNA, 21 nt, Human
uguggcugaggaggccuccau

SEQ ID NO: 2631215 - RNA, 16 nt, Human
uguggcugaggaggcc

SEQ ID NO: 2631216 - RNA, 13 nt, Human
uguggcugaggag

SEQ ID NO: 2631217 - RNA, 20 nt, Human
uguggcuccuaucuguguuu

SEQ ID NO: 2631218 - RNA, 15 nt, Human
uguggcuccuuccca

SEQ ID NO: 2631219 - RNA, 14 nt, Human
uguggcuccuuccc

SEQ ID NO: 2631220 - RNA, 14 nt, Human
uguggcugcagcag

SEQ ID NO: 2631221 - RNA, 22 nt, Human
uguggcugaggaggccuccauc

SEQ ID NO: 2631222 - RNA, 14 nt, Human
uguggcugcuagca

SEQ ID NO: 2631223 - RNA, 15 nt, Human
uguggcugggggcag

SEQ ID NO: 2631224 - RNA, 18 nt, Human
uguggcugggggcaggag

SEQ ID NO: 2631225 - RNA, 12 nt, Human
ugugggaagggg

SEQ ID NO: 2631226 - RNA, 23 nt, Human
ugugggaacgagaggggaagagu

SEQ ID NO: 2631227 - RNA, 12 nt, Human
ugugggaacaga

SEQ ID NO: 2631228 - RNA, 15 nt, Human
ugugggaaggccagc

SEQ ID NO: 2631229 - RNA, 15 nt, Human
ugugggaagggagag

SEQ ID NO: 2631230 - RNA, 18 nt, Human
ugugggaaugcggcaaga

SEQ ID NO: 2631231 - RNA, 19 nt, Human
ugugggaaugcggcaagaa

SEQ ID NO: 2631232 - RNA, 16 nt, Human
ugugggcugcacucug

SEQ ID NO: 2631233 - RNA, 14 nt, Human
ugugggcugcacuc

SEQ ID NO: 2631234 - RNA, 13 nt, Human
ugugggcugcacu

SEQ ID NO: 2631235 - RNA, 21 nt, Human
ugugggcugcacucugugccc

SEQ ID NO: 2631236 - RNA, 20 nt, Human
ugugggcugcacucugugcc

SEQ ID NO: 2631237 - RNA, 22 nt, Human
ugugggcugcacucugugccca

SEQ ID NO: 2631238 - RNA, 13 nt, Human
ugugggcugugag

SEQ ID NO: 2631239 - RNA, 14 nt, Human
ugugggcugugagu

SEQ ID NO: 2631240 - RNA, 20 nt, Human
uguggggaucucaggggcug

SEQ ID NO: 2631241 - RNA, 19 nt, Human
uuguagaugaaaaagcaug

SEQ ID NO: 2631242 - RNA, 12 nt, Human
uuguagaugaaa

SEQ ID NO: 2631243 - RNA, 21 nt, Human
uuguagaugaaaaagcaugua

SEQ ID NO: 2631244 - RNA, 15 nt, Human
uuguaucagaggccu

SEQ ID NO: 2631245 - RNA, 17 nt, Human
uuguaucguauagcugu

SEQ ID NO: 2631246 - RNA, 15 nt, Human
uuguaucguauagcu

SEQ ID NO: 2631247 - RNA, 21 nt, Human
uuguaucgauguuauguaaaa

SEQ ID NO: 2631248 - RNA, 18 nt, Human
uuguaucgauguuaugua

SEQ ID NO: 2631249 - RNA, 22 nt, Human
uuguaucagaggccuauaauga

SEQ ID NO: 2631250 - RNA, 19 nt, Human
uuguaucauuugaacaacu

SEQ ID NO: 2631251 - RNA, 14 nt, Human
uuguauuacaaauc

SEQ ID NO: 2631252 - RNA, 20 nt, Human
uuguaucguauagcuguauu

SEQ ID NO: 2631253 - RNA, 18 nt, Human
uuguaucguauagcugua

SEQ ID NO: 2631254 - RNA, 22 nt, Human
uuguaucguauagcuguauuga

SEQ ID NO: 2631255 - RNA, 13 nt, Human
uuguaucuagugc

SEQ ID NO: 2631256 - RNA, 17 nt, Human
uuguaucuagugcagcu

SEQ ID NO: 2631257 - RNA, 18 nt, Human
uuguaucuagugcagcug

SEQ ID NO: 2631258 - RNA, 20 nt, Human
uuguaucuagugcagcugau

SEQ ID NO: 2631259 - RNA, 21 nt, Human
uuguaucuagugcagcugauu

SEQ ID NO: 2631260 - RNA, 21 nt, Human
uuguauucucuccuguaccuc

SEQ ID NO: 2631261 - RNA, 14 nt, Human
uuguauucagaguu

SEQ ID NO: 2631262 - RNA, 17 nt, Human
uuguauuagauguucuc

SEQ ID NO: 2631263 - RNA, 16 nt, Human
uuguauuagauguucu

SEQ ID NO: 2631264 - RNA, 15 nt, Human
uuguauuagauguuc

SEQ ID NO: 2631265 - RNA, 13 nt, Human
uuguauuagaugu

SEQ ID NO: 2631266 - RNA, 21 nt, Human
uuguaucucugaagcauguuu

SEQ ID NO: 2631267 - RNA, 20 nt, Human
uuguaucucugaagcauguu

SEQ ID NO: 2631268 - RNA, 13 nt, Human
uuguaucucuuuu

SEQ ID NO: 2631269 - RNA, 14 nt, Human
uuguaucucuuuug

SEQ ID NO: 2631270 - RNA, 19 nt, Human
uuguaucacaaaucuuaac

SEQ ID NO: 2631271 - RNA, 22 nt, Human
uuguagaauguauuguaccuuu

SEQ ID NO: 2631272 - RNA, 20 nt, Human
uuguagaauguauuguaccu

SEQ ID NO: 2631273 - RNA, 15 nt, Human
uuguagagccagggu

SEQ ID NO: 2631274 - RNA, 14 nt, Human
uuguagagccaggg

SEQ ID NO: 2631275 - RNA, 20 nt, Human
uuguacaguuuguuuacaca

SEQ ID NO: 2631276 - RNA, 18 nt, Human
uuguacaguuuguuuaca

SEQ ID NO: 2631277 - RNA, 20 nt, Human
uuguacaguuugcuguacua

SEQ ID NO: 2631278 - RNA, 17 nt, Human
uuguacaguuugcugua

SEQ ID NO: 2631279 - RNA, 16 nt, Human
uuguacaguuugcugu

SEQ ID NO: 2631280 - RNA, 15 nt, Human
uuguacaguuugcug

SEQ ID NO: 2631281 - RNA, 11 nt, Human
uuguacaguuu

SEQ ID NO: 2631282 - RNA, 16 nt, Human
uuguacaguucaguuc

SEQ ID NO: 2631283 - RNA, 15 nt, Human
uuguacaguucaguu

SEQ ID NO: 2631284 - RNA, 11 nt, Human
uuguacaguuc

SEQ ID NO: 2631285 - RNA, 16 nt, Human
uuguacagcuguuuaa

SEQ ID NO: 2631286 - RNA, 21 nt, Human
uuguacagacguaugcuuauu

SEQ ID NO: 2631287 - RNA, 18 nt, Human
uuguacagacguaugcuu

SEQ ID NO: 2631288 - RNA, 19 nt, Human
uuguacagacguaugcuua

SEQ ID NO: 2631289 - RNA, 13 nt, Human
uuguacaguuuuu

SEQ ID NO: 2631290 - RNA, 12 nt, Human
uuguacaguuuu

SEQ ID NO: 2631291 - RNA, 19 nt, Human
uuguagaauguauuguacc

SEQ ID NO: 2631292 - RNA, 16 nt, Human
uuguacaguuuuuauu

SEQ ID NO: 2631293 - RNA, 14 nt, Human
uuguaaaugugcuu

SEQ ID NO: 2631294 - RNA, 18 nt, Human
uuguaaaugugcuuuuaa

SEQ ID NO: 2631295 - RNA, 11 nt, Human
uuguaaaugug

SEQ ID NO: 2631296 - RNA, 12 nt, Human
uuguaaauauuu

SEQ ID NO: 2631297 - RNA, 13 nt, Human
uuguaaauauuua

SEQ ID NO: 2631298 - RNA, 16 nt, Human
uuguaaauauuuaugu

SEQ ID NO: 2631299 - RNA, 13 nt, Human
uuguacagacaac

SEQ ID NO: 2631300 - RNA, 12 nt, Human
uuguacagacaa

SEQ ID NO: 2631301 - RNA, 11 nt, Human
uuguacacuuu

SEQ ID NO: 2631302 - RNA, 15 nt, Human
uuguacacuuuuuug

SEQ ID NO: 2631303 - RNA, 13 nt, Human
uuguacacuuuuu

SEQ ID NO: 2631304 - RNA, 19 nt, Human
uuguaaauauuuauguaaa

SEQ ID NO: 2631305 - RNA, 14 nt, Human
uuguacaaauaaag

SEQ ID NO: 2631306 - RNA, 23 nt, Human
uuguacaauugaacuuaaauaaa

SEQ ID NO: 2631307 - RNA, 19 nt, Human
uuguacacaccuuauauuu

SEQ ID NO: 2631308 - RNA, 16 nt, Human
uuggucccccuuccau

SEQ ID NO: 2631309 - RNA, 22 nt, Human
uuggucccccuuccauggacuu

SEQ ID NO: 2631310 - RNA, 12 nt, Human
uugguccugcug

SEQ ID NO: 2631311 - RNA, 13 nt, Human
uugguccugcugc

SEQ ID NO: 2631312 - RNA, 23 nt, Human
uuggucccgugcagcuucugucc

SEQ ID NO: 2631313 - RNA, 22 nt, Human
uugguaaauuuccccaacagug

SEQ ID NO: 2631314 - RNA, 15 nt, Human
uugguccucuugccu

SEQ ID NO: 2631315 - RNA, 16 nt, Human
uuguaaaggaauuuaa

SEQ ID NO: 2631316 - RNA, 13 nt, Human
uuggucccugggg

SEQ ID NO: 2631317 - RNA, 18 nt, Human
uuguaaauaaaggaacca

SEQ ID NO: 2631318 - RNA, 23 nt, Human
uuguaaaguguggucccaacagg

SEQ ID NO: 2631319 - RNA, 22 nt, Human
uuguaaaguguggucccaacag

SEQ ID NO: 2631320 - RNA, 22 nt, Human
uuggcugggggccucagugcca

SEQ ID NO: 2631321 - RNA, 21 nt, Human
uuggcugggggccucagugcc

SEQ ID NO: 2631322 - RNA, 21 nt, Human
uuggcugugucuaaacugcau

SEQ ID NO: 2631323 - RNA, 20 nt, Human
uuggcugugucuaaacugca

SEQ ID NO: 2631324 - RNA, 18 nt, Human
uuggcugugucuaaacug

SEQ ID NO: 2631325 - RNA, 17 nt, Human
uuggcugugucuaaacu

SEQ ID NO: 2631326 - RNA, 15 nt, Human
uuggcugugucuaaa

SEQ ID NO: 2631327 - RNA, 14 nt, Human
uuggcugugucuaa

SEQ ID NO: 2631328 - RNA, 17 nt, Human
uuggcugugaggccccu

SEQ ID NO: 2631329 - RNA, 21 nt, Human
uuggcuguagaaggagacaga

SEQ ID NO: 2631330 - RNA, 16 nt, Human
uuggcugggcccagaa

SEQ ID NO: 2631331 - RNA, 17 nt, Human
uuggcugggcccagaag

SEQ ID NO: 2631332 - RNA, 18 nt, Human
uuggcugggcccagaagg

SEQ ID NO: 2631333 - RNA, 16 nt, Human
uuggcugcugaaggcu

SEQ ID NO: 2631334 - RNA, 15 nt, Human
uuggcugcuuggccu

SEQ ID NO: 2631335 - RNA, 18 nt, Human
uuggcugggggccucagu

SEQ ID NO: 2631336 - RNA, 20 nt, Human
uuggcuggaugaaauuuucu

SEQ ID NO: 2631337 - RNA, 16 nt, Human
uuggcugcuuggccuu

SEQ ID NO: 2631338 - RNA, 21 nt, Human
uuggcuggaugaaauuuucua

SEQ ID NO: 2631339 - RNA, 23 nt, Human
uuggcuggaugaaauuuucuaga

SEQ ID NO: 2631340 - RNA, 13 nt, Human
uuggcugggccca

SEQ ID NO: 2631341 - RNA, 16 nt, Human
uuggcauguguauguu

SEQ ID NO: 2631342 - RNA, 13 nt, Human
uuggcauucccca

SEQ ID NO: 2631343 - RNA, 14 nt, Human
uuggcaacagaagc

SEQ ID NO: 2631344 - RNA, 16 nt, Human
uuggcaaauuccuagu

SEQ ID NO: 2631345 - RNA, 16 nt, Human
uuggauuuuugacucu

SEQ ID NO: 2631346 - RNA, 23 nt, Human
uuggcaaacucuccaccacacgu

SEQ ID NO: 2631347 - RNA, 15 nt, Human
uuggcaucagcuggc

SEQ ID NO: 2631348 - RNA, 15 nt, Human
uuggcaacagaagca

SEQ ID NO: 2631349 - RNA, 21 nt, Human
uuggcaucacagggcagagcc

SEQ ID NO: 2631350 - RNA, 22 nt, Human
uuggccacuccgagaggugggc

SEQ ID NO: 2631351 - RNA, 21 nt, Human
uuggccacuccgagagguggg

SEQ ID NO: 2631352 - RNA, 14 nt, Human
uuggccacuccgag

SEQ ID NO: 2631353 - RNA, 14 nt, Human
uuggccaggcuggu

SEQ ID NO: 2631354 - RNA, 24 nt, Human
uuggccaaagccaaagcuaggccu

SEQ ID NO: 2631355 - RNA, 16 nt, Human
uuggccaagcagggag

SEQ ID NO: 2631356 - RNA, 15 nt, Human
uuggccaagcaggga

SEQ ID NO: 2631357 - RNA, 15 nt, Human
uuggccaaaguguua

SEQ ID NO: 2631358 - RNA, 18 nt, Human
uugggaggaagcagaaua

SEQ ID NO: 2631359 - RNA, 17 nt, Human
uugggaggaagcagaau

SEQ ID NO: 2631360 - RNA, 15 nt, Human
uugggaggaagcaga

SEQ ID NO: 2631361 - RNA, 14 nt, Human
uugggaggaagcag

SEQ ID NO: 2631362 - RNA, 13 nt, Human
uugggaggaagca

SEQ ID NO: 2631363 - RNA, 19 nt, Human
uugggagcuugggaaugga

SEQ ID NO: 2631364 - RNA, 18 nt, Human
uugggaacugaacucacu

SEQ ID NO: 2631365 - RNA, 16 nt, Human
uugggaggccauuugu

SEQ ID NO: 2631366 - RNA, 12 nt, Human
uugggaggcuga

SEQ ID NO: 2631367 - RNA, 22 nt, Human
uugggaggaagcagaauaaagc

SEQ ID NO: 2631368 - RNA, 21 nt, Human
uugggaggaagcagaauaaag

SEQ ID NO: 2631369 - RNA, 20 nt, Human
uugggaggaagcagaauaaa

SEQ ID NO: 2631370 - RNA, 19 nt, Human
uugggaggaagcagaauaa

SEQ ID NO: 2631371 - RNA, 23 nt, Human
uugggaggaagcagaauaaagca

SEQ ID NO: 2631372 - RNA, 17 nt, Human
uugggaggccccacugg

SEQ ID NO: 2631373 - RNA, 22 nt, Human
uuggcuuuggguugcaggaccu

SEQ ID NO: 2631374 - RNA, 23 nt, Human
uuggcugugucuaaacugcauua

SEQ ID NO: 2631375 - RNA, 16 nt, Human
uugggaaacuuggcuc

SEQ ID NO: 2631376 - RNA, 17 nt, Human
uuggguggggggcuuca

SEQ ID NO: 2631377 - RNA, 19 nt, Human
uuggguggggggcuucaua

SEQ ID NO: 2631378 - RNA, 16 nt, Human
uuggguggaugccugg

SEQ ID NO: 2631379 - RNA, 20 nt, Human
uuggguggggggcuucauac

SEQ ID NO: 2631380 - RNA, 21 nt, Human
uuggguggggggcuucauaca

SEQ ID NO: 2631381 - RNA, 22 nt, Human
uuggguggggggcuucauacac

SEQ ID NO: 2631382 - RNA, 17 nt, Human
uugggugggcaggaaaa

SEQ ID NO: 2631383 - RNA, 19 nt, Human
uuggguguaacaggucucc

SEQ ID NO: 2631384 - RNA, 20 nt, Human
uuggguguaacaggucuccu

SEQ ID NO: 2631385 - RNA, 14 nt, Human
uugguaaaccuuuu

SEQ ID NO: 2631386 - RNA, 19 nt, Human
uugguaaagacuggcuuuu

SEQ ID NO: 2631387 - RNA, 16 nt, Human
uugguaaagacuggcu

SEQ ID NO: 2631388 - RNA, 21 nt, Human
uugguaaauuuccccaacagu

SEQ ID NO: 2631389 - RNA, 16 nt, Human
uugguaaauuucccca

SEQ ID NO: 2631390 - RNA, 17 nt, Human
uuggguucauuauugga

SEQ ID NO: 2631391 - RNA, 12 nt, Human
uugguaaaccuu

SEQ ID NO: 2631392 - RNA, 13 nt, Human
uuggaaauauuca

SEQ ID NO: 2631393 - RNA, 14 nt, Human
uuggaacagaaugu

SEQ ID NO: 2631394 - RNA, 13 nt, Human
uuggaacagaaug

SEQ ID NO: 2631395 - RNA, 23 nt, Human
uuggaaagaguaggaagacuuug

SEQ ID NO: 2631396 - RNA, 20 nt, Human
uugcuuaggaugugugcaug

SEQ ID NO: 2631397 - RNA, 23 nt, Human
uugcuuacuuuggaauacauuuc

SEQ ID NO: 2631398 - RNA, 12 nt, Human
uugcuuacuaag

SEQ ID NO: 2631399 - RNA, 22 nt, Human
uuggaaagcuccuagcagagag

SEQ ID NO: 2631400 - RNA, 21 nt, Human
uuggaaagcagguggcaucuc

SEQ ID NO: 2631401 - RNA, 20 nt, Human
uuggaaagcaucaccucagg

SEQ ID NO: 2631402 - RNA, 23 nt, Human
uuggaaauagaaauuuccagaga

SEQ ID NO: 2631403 - RNA, 22 nt, Human
uuggaaauagaaauuuccagag

SEQ ID NO: 2631404 - RNA, 24 nt, Human
uugcuuaggauguuuuucaugaaa

SEQ ID NO: 2631405 - RNA, 14 nt, Human
uuggaaaggaccag

SEQ ID NO: 2631406 - RNA, 22 nt, Human
uuggaaagcaucaccucaggcc

SEQ ID NO: 2631407 - RNA, 14 nt, Human
uugcuguacuagag

SEQ ID NO: 2631408 - RNA, 23 nt, Human
uugcuguaccagcccagauguuu

SEQ ID NO: 2631409 - RNA, 11 nt, Human
uugcuguauau

SEQ ID NO: 2631410 - RNA, 14 nt, Human
uugcuguuuuccuc

SEQ ID NO: 2631411 - RNA, 16 nt, Human
uugcuguuuuccuccc

SEQ ID NO: 2631412 - RNA, 18 nt, Human
uugcuguuuuccucccuu

SEQ ID NO: 2631413 - RNA, 13 nt, Human
uugcuguuuugau

SEQ ID NO: 2631414 - RNA, 19 nt, Human
uugcuguuuuccucccuuc

SEQ ID NO: 2631415 - RNA, 20 nt, Human
uugcuguuuuccucccuucu

SEQ ID NO: 2631416 - RNA, 16 nt, Human
uugcuguuuuguucug

SEQ ID NO: 2631417 - RNA, 22 nt, Human
uugcuguuuuccucccuucugc

SEQ ID NO: 2631418 - RNA, 21 nt, Human
uugcuguuuuguucugugguu

SEQ ID NO: 2631419 - RNA, 18 nt, Human
uugcuuacauuuuuacaa

SEQ ID NO: 2631420 - RNA, 13 nt, Human
uugcuuacauuuu

SEQ ID NO: 2631421 - RNA, 23 nt, Human
uugcuuacaauuuuuuuaauuuu

SEQ ID NO: 2631422 - RNA, 22 nt, Human
uugcuuacaauuuuuuuaauuu

SEQ ID NO: 2631423 - RNA, 15 nt, Human
uugcuuacaauuuuu

SEQ ID NO: 2631424 - RNA, 14 nt, Human
uugcuuacaauuuu

SEQ ID NO: 2631425 - RNA, 13 nt, Human
uugcuuacaauuu

SEQ ID NO: 2631426 - RNA, 20 nt, Human
uugcuggggccgaaagaaca

SEQ ID NO: 2631427 - RNA, 20 nt, Human
uugcugccacuuuuuaacua

SEQ ID NO: 2631428 - RNA, 21 nt, Human
uugcugccugaagaacaguaa

SEQ ID NO: 2631429 - RNA, 22 nt, Human
uugcugguugcugugugguuug

SEQ ID NO: 2631430 - RNA, 15 nt, Human
uugcugguugcugug

SEQ ID NO: 2631431 - RNA, 14 nt, Human
uugcugguugcugu

SEQ ID NO: 2631432 - RNA, 15 nt, Human
uugcuggucacugcc

SEQ ID NO: 2631433 - RNA, 21 nt, Human
uugcuguaccagcccagaugu

SEQ ID NO: 2631434 - RNA, 16 nt, Human
uugcugguugcugugu

SEQ ID NO: 2631435 - RNA, 20 nt, Human
uugcuguagaagauggcacu

SEQ ID NO: 2631436 - RNA, 22 nt, Human
uuggaccccagcugggaggcaa

SEQ ID NO: 2631437 - RNA, 20 nt, Human
uuggaccccagcugggaggc

SEQ ID NO: 2631438 - RNA, 19 nt, Human
uuggaccccagcugggagg

SEQ ID NO: 2631439 - RNA, 17 nt, Human
uuggaccccagcuggga

SEQ ID NO: 2631440 - RNA, 16 nt, Human
uuggaccccagcuggg

SEQ ID NO: 2631441 - RNA, 15 nt, Human
uuggaccccagcugg

SEQ ID NO: 2631442 - RNA, 14 nt, Human
uuggaccccagcug

SEQ ID NO: 2631443 - RNA, 13 nt, Human
uuggaccccagcu

SEQ ID NO: 2631444 - RNA, 21 nt, Human
uuggauuauuuaauaacauua

SEQ ID NO: 2631445 - RNA, 19 nt, Human
uuggauuauuuaauaacau

SEQ ID NO: 2631446 - RNA, 17 nt, Human
uuggacccgcucuggac

SEQ ID NO: 2631447 - RNA, 16 nt, Human
uuggacccgcucugga

SEQ ID NO: 2631448 - RNA, 15 nt, Human
uuggacccgcucugg

SEQ ID NO: 2631449 - RNA, 18 nt, Human
uuggauuauuuaauaaca

SEQ ID NO: 2631450 - RNA, 15 nt, Human
uuggauucugagagc

SEQ ID NO: 2631451 - RNA, 17 nt, Human
uuggauucugagagcug

SEQ ID NO: 2631452 - RNA, 15 nt, Human
uuggauucuuaugua

SEQ ID NO: 2631453 - RNA, 14 nt, Human
uuggauuggggucc

SEQ ID NO: 2631454 - RNA, 20 nt, Human
uuggauuauuuaauaacauu

SEQ ID NO: 2631455 - RNA, 16 nt, Human
uuggcaaacucuccac

SEQ ID NO: 2631456 - RNA, 20 nt, Human
uuggcaaacucuccaccaca

SEQ ID NO: 2631457 - RNA, 17 nt, Human
uuggcaaaaaggcagga

SEQ ID NO: 2631458 - RNA, 14 nt, Human
uuggauuguccccg

SEQ ID NO: 2631459 - RNA, 14 nt, Human
uuggauuguauauu

SEQ ID NO: 2631460 - RNA, 18 nt, Human
uuggauuguauauugugu

SEQ ID NO: 2631461 - RNA, 18 nt, Human
uuggauuuuugucuugug

SEQ ID NO: 2631462 - RNA, 18 nt, Human
uuggacauuuucuucaga

SEQ ID NO: 2631463 - RNA, 16 nt, Human
uuggaaguugcauggc

SEQ ID NO: 2631464 - RNA, 13 nt, Human
uuggaaguuucau

SEQ ID NO: 2631465 - RNA, 16 nt, Human
uuggaaguuuucagga

SEQ ID NO: 2631466 - RNA, 16 nt, Human
uuggaacucugcuuga

SEQ ID NO: 2631467 - RNA, 11 nt, Human
uuggaaggaac

SEQ ID NO: 2631468 - RNA, 19 nt, Human
uuggaaggaacguccccug

SEQ ID NO: 2631469 - RNA, 15 nt, Human
uuggaagaccccacc

SEQ ID NO: 2631470 - RNA, 12 nt, Human
uugcccagagau

SEQ ID NO: 2631471 - RNA, 16 nt, Human
uugcccagagaugccu

SEQ ID NO: 2631472 - RNA, 17 nt, Human
uugcccagagaugccuc

SEQ ID NO: 2631473 - RNA, 18 nt, Human
uugcccagagaugccucc

SEQ ID NO: 2631474 - RNA, 19 nt, Human
uugcccagagaugccucca

SEQ ID NO: 2631475 - RNA, 22 nt, Human
uugcccagcauuuuacugauuc

SEQ ID NO: 2631476 - RNA, 22 nt, Human
uugcccagagaugccuccaccg

SEQ ID NO: 2631477 - RNA, 11 nt, Human
uugcccaggca

SEQ ID NO: 2631478 - RNA, 22 nt, Human
uugccauauugcacaugucuua

SEQ ID NO: 2631479 - RNA, 23 nt, Human
uugcccacgcuggagugcaguga

SEQ ID NO: 2631480 - RNA, 17 nt, Human
uugccauauugcacaug

SEQ ID NO: 2631481 - RNA, 15 nt, Human
uugccauauugcaca

SEQ ID NO: 2631482 - RNA, 13 nt, Human
uugccauauugca

SEQ ID NO: 2631483 - RNA, 22 nt, Human
uugccauacuuugucugaaaaa

SEQ ID NO: 2631484 - RNA, 18 nt, Human
uugccauacuuugucuga

SEQ ID NO: 2631485 - RNA, 18 nt, Human
uugccagucaccccggcc

SEQ ID NO: 2631486 - RNA, 13 nt, Human
uugccagucaccc

SEQ ID NO: 2631487 - RNA, 18 nt, Human
uugccacugccucuuccu

SEQ ID NO: 2631488 - RNA, 20 nt, Human
uugccucggcuccugcugca

SEQ ID NO: 2631489 - RNA, 19 nt, Human
uugccucggcuccugcugc

SEQ ID NO: 2631490 - RNA, 18 nt, Human
uugccucggcuccugcug

SEQ ID NO: 2631491 - RNA, 17 nt, Human
uugccucggcuccugcu

SEQ ID NO: 2631492 - RNA, 16 nt, Human
uugccucggcuccugc

SEQ ID NO: 2631493 - RNA, 15 nt, Human
uugccucggcuccug

SEQ ID NO: 2631494 - RNA, 14 nt, Human
uugccucggcuccu

SEQ ID NO: 2631495 - RNA, 22 nt, Human
uugccuccccauuucccaucug

SEQ ID NO: 2631496 - RNA, 15 nt, Human
uugccuccuguguaa

SEQ ID NO: 2631497 - RNA, 14 nt, Human
uugccucugccucu

SEQ ID NO: 2631498 - RNA, 11 nt, Human
uugccucugcc

SEQ ID NO: 2631499 - RNA, 13 nt, Human
uugccucugugcu

SEQ ID NO: 2631500 - RNA, 12 nt, Human
uugccucugugc

SEQ ID NO: 2631501 - RNA, 20 nt, Human
uugccucuguccccuucucu

SEQ ID NO: 2631502 - RNA, 19 nt, Human
uugccucuguccccuucuc

SEQ ID NO: 2631503 - RNA, 22 nt, Human
uugccucggcuccugcugcacc

SEQ ID NO: 2631504 - RNA, 15 nt, Human
uugccucucuguuug

SEQ ID NO: 2631505 - RNA, 18 nt, Human
uugccucuguccccuucu

SEQ ID NO: 2631506 - RNA, 17 nt, Human
uugccucuguccccuuc

SEQ ID NO: 2631507 - RNA, 18 nt, Human
uugccucugccucugaca

SEQ ID NO: 2631508 - RNA, 16 nt, Human
uugccucugccucuga

SEQ ID NO: 2631509 - RNA, 19 nt, Human
uugcugccccaucagugcu

SEQ ID NO: 2631510 - RNA, 20 nt, Human
uugcugccccaucagugcuc

SEQ ID NO: 2631511 - RNA, 11 nt, Human
uugcugccuca

SEQ ID NO: 2631512 - RNA, 12 nt, Human
uugcugccucau

SEQ ID NO: 2631513 - RNA, 15 nt, Human
uugcugccucaugcu

SEQ ID NO: 2631514 - RNA, 21 nt, Human
uugcugccaaccauaccuucc

SEQ ID NO: 2631515 - RNA, 18 nt, Human
uugcugccaaccauaccu

SEQ ID NO: 2631516 - RNA, 18 nt, Human
uugcugcaguaugaaaau

SEQ ID NO: 2631517 - RNA, 13 nt, Human
uugcugcaaaccu

SEQ ID NO: 2631518 - RNA, 15 nt, Human
uugcugcaaaccuga

SEQ ID NO: 2631519 - RNA, 20 nt, Human
uugcugauggugcaaugacc

SEQ ID NO: 2631520 - RNA, 12 nt, Human
uugcuaaaugua

SEQ ID NO: 2631521 - RNA, 19 nt, Human
uugcugauggugcaaugac

SEQ ID NO: 2631522 - RNA, 22 nt, Human
uugcugauggugcaaugaccuu

SEQ ID NO: 2631523 - RNA, 19 nt, Human
uugcguuagaaugaggagg

SEQ ID NO: 2631524 - RNA, 15 nt, Human
uugcugauucuugag

SEQ ID NO: 2631525 - RNA, 18 nt, Human
uugcguaugucuguuacc

SEQ ID NO: 2631526 - RNA, 16 nt, Human
uugcguaugucuguua

SEQ ID NO: 2631527 - RNA, 14 nt, Human
uugcguaugucugu

SEQ ID NO: 2631528 - RNA, 18 nt, Human
uugcguaacuggcugugu

SEQ ID NO: 2631529 - RNA, 15 nt, Human
uugcggggggaggga

SEQ ID NO: 2631530 - RNA, 14 nt, Human
uugcggggggaggg

SEQ ID NO: 2631531 - RNA, 17 nt, Human
uugcguaacuggcugug

SEQ ID NO: 2631532 - RNA, 15 nt, Human
uugcuaaauguaaca

SEQ ID NO: 2631533 - RNA, 22 nt, Human
uugcguuccaugaugcugggau

SEQ ID NO: 2631534 - RNA, 18 nt, Human
uugcguggacucugcaca

SEQ ID NO: 2631535 - RNA, 15 nt, Human
uugcguggacucugc

SEQ ID NO: 2631536 - RNA, 20 nt, Human
uugcguaugucuguuaccau

SEQ ID NO: 2631537 - RNA, 21 nt, Human
uugcguggaauugugcugagu

SEQ ID NO: 2631538 - RNA, 19 nt, Human
uugccucugugcugugugu

SEQ ID NO: 2631539 - RNA, 14 nt, Human
uugccucugugcug

SEQ ID NO: 2631540 - RNA, 17 nt, Human
uugccucuuccagucuu

SEQ ID NO: 2631541 - RNA, 19 nt, Human
uugccucuuccagucuucc

SEQ ID NO: 2631542 - RNA, 22 nt, Human
uugccugaacauccuuccuucc

SEQ ID NO: 2631543 - RNA, 19 nt, Human
uugccugaacauccuuccu

SEQ ID NO: 2631544 - RNA, 16 nt, Human
uugccugauauaaaug

SEQ ID NO: 2631545 - RNA, 23 nt, Human
uugccugaacauccuuccuuccc

SEQ ID NO: 2631546 - RNA, 20 nt, Human
uugccugaaguuggagugag

SEQ ID NO: 2631547 - RNA, 22 nt, Human
uugccugcguuuuggaagcucu

SEQ ID NO: 2631548 - RNA, 20 nt, Human
uugccugcagagagaagccu

SEQ ID NO: 2631549 - RNA, 19 nt, Human
uugccugcagagagaagcc

SEQ ID NO: 2631550 - RNA, 15 nt, Human
uugccugcagagaga

SEQ ID NO: 2631551 - RNA, 13 nt, Human
uugccugcagaga

SEQ ID NO: 2631552 - RNA, 12 nt, Human
uugccugcaggc

SEQ ID NO: 2631553 - RNA, 23 nt, Human
uugaccugccucccuucaugcau

SEQ ID NO: 2631554 - RNA, 22 nt, Human
uugaccugccucccuucaugca

SEQ ID NO: 2631555 - RNA, 14 nt, Human
uugacgccauccca

SEQ ID NO: 2631556 - RNA, 22 nt, Human
uugacgccaucccagccccaau

SEQ ID NO: 2631557 - RNA, 16 nt, Human
uugacgaagucucuuu

SEQ ID NO: 2631558 - RNA, 21 nt, Human
uugaccuuuuauguaguaauu

SEQ ID NO: 2631559 - RNA, 15 nt, Human
uugacgccaucccag

SEQ ID NO: 2631560 - RNA, 19 nt, Human
uugaccugaggcccuucuc

SEQ ID NO: 2631561 - RNA, 12 nt, Human
uugaccugaggc

SEQ ID NO: 2631562 - RNA, 22 nt, Human
uugaccugaggcccuucucucc

SEQ ID NO: 2631563 - RNA, 19 nt, Human
uugaccugaggcugugguc

SEQ ID NO: 2631564 - RNA, 21 nt, Human
uugaccugccucccuucaugc

SEQ ID NO: 2631565 - RNA, 13 nt, Human
uugaccugaggcu

SEQ ID NO: 2631566 - RNA, 21 nt, Human
uugaccgugaggccagagaca

SEQ ID NO: 2631567 - RNA, 20 nt, Human
uugaccgugaggccagagac

SEQ ID NO: 2631568 - RNA, 16 nt, Human
uugaaugucuuuugaa

SEQ ID NO: 2631569 - RNA, 12 nt, Human
uugaaugucuuu

SEQ ID NO: 2631570 - RNA, 20 nt, Human
uugaaugguguuguaugccu

SEQ ID NO: 2631571 - RNA, 15 nt, Human
uugaccucaggugau

SEQ ID NO: 2631572 - RNA, 23 nt, Human
uugaaugcuuuuugaauguuauu

SEQ ID NO: 2631573 - RNA, 20 nt, Human
uugaaugcuuuuugaauguu

SEQ ID NO: 2631574 - RNA, 17 nt, Human
uugaaugcuuuuugaau

SEQ ID NO: 2631575 - RNA, 15 nt, Human
uugaaugcuuuuuga

SEQ ID NO: 2631576 - RNA, 18 nt, Human
uugaauggccugccuuga

SEQ ID NO: 2631577 - RNA, 18 nt, Human
uugaauguaugcuucaua

SEQ ID NO: 2631578 - RNA, 16 nt, Human
uugaaugguguuguau

SEQ ID NO: 2631579 - RNA, 23 nt, Human
uugaauggucagcguugcauguc

SEQ ID NO: 2631580 - RNA, 15 nt, Human
uugaauggguccauu

SEQ ID NO: 2631581 - RNA, 13 nt, Human
uugaaugcauuuu

SEQ ID NO: 2631582 - RNA, 12 nt, Human
uugaaugcauuu

SEQ ID NO: 2631583 - RNA, 18 nt, Human
uugaaugaaaaauuuaag

SEQ ID NO: 2631584 - RNA, 12 nt, Human
uugaaugaaaaa

SEQ ID NO: 2631585 - RNA, 15 nt, Human
uugaaugaaaaauuu

SEQ ID NO: 2631586 - RNA, 23 nt, Human
uugaaugcauuuuguuugguauu

SEQ ID NO: 2631587 - RNA, 16 nt, Human
uugaaugcauuuuguu

SEQ ID NO: 2631588 - RNA, 16 nt, Human
uugaaugcuuccugac

SEQ ID NO: 2631589 - RNA, 19 nt, Human
uugagcugccuucccuagc

SEQ ID NO: 2631590 - RNA, 16 nt, Human
uugagcugccuucccu

SEQ ID NO: 2631591 - RNA, 15 nt, Human
uugagcugccuuccc

SEQ ID NO: 2631592 - RNA, 14 nt, Human
uugagcugccuucc

SEQ ID NO: 2631593 - RNA, 13 nt, Human
uugagcugccuuc

SEQ ID NO: 2631594 - RNA, 12 nt, Human
uugagcugccuu

SEQ ID NO: 2631595 - RNA, 11 nt, Human
uugagcugccu

SEQ ID NO: 2631596 - RNA, 19 nt, Human
uugacuagggauucaggcu

SEQ ID NO: 2631597 - RNA, 21 nt, Human
uugacuagggauucaggcugc

SEQ ID NO: 2631598 - RNA, 17 nt, Human
uugacuaucaaacugaa

SEQ ID NO: 2631599 - RNA, 20 nt, Human
uugacggaugauuggauuau

SEQ ID NO: 2631600 - RNA, 23 nt, Human
uugacuagaugauggaugccaau

SEQ ID NO: 2631601 - RNA, 20 nt, Human
uugacgccaucccagcccca

SEQ ID NO: 2631602 - RNA, 15 nt, Human
uugacggaugauugg

SEQ ID NO: 2631603 - RNA, 23 nt, Human
uugacgaagucucuuuucuuuag

SEQ ID NO: 2631604 - RNA, 23 nt, Human
uugacgagugugaagcuuccuug

SEQ ID NO: 2631605 - RNA, 12 nt, Human
uugagcuguuuu

SEQ ID NO: 2631606 - RNA, 21 nt, Human
uugagcuguugccucaguccc

SEQ ID NO: 2631607 - RNA, 18 nt, Human
uugagcuguuuucccuga

SEQ ID NO: 2631608 - RNA, 21 nt, Human
uugagcuuuccauguugcugc

SEQ ID NO: 2631609 - RNA, 14 nt, Human
uugagcuuuccaug

SEQ ID NO: 2631610 - RNA, 18 nt, Human
uugagcuuagugaaauua

SEQ ID NO: 2631611 - RNA, 13 nt, Human
uugaggaaaacaa

SEQ ID NO: 2631612 - RNA, 23 nt, Human
uugaggaaaacaagcauucacaa

SEQ ID NO: 2631613 - RNA, 18 nt, Human
uugaggaaacaacagcuu

SEQ ID NO: 2631614 - RNA, 14 nt, Human
uugaggacacugau

SEQ ID NO: 2631615 - RNA, 15 nt, Human
uugaggacacugaua

SEQ ID NO: 2631616 - RNA, 19 nt, Human
uugagggcccagagcagga

SEQ ID NO: 2631617 - RNA, 16 nt, Human
uugagggcccagagca

SEQ ID NO: 2631618 - RNA, 15 nt, Human
uugagggcccagagc

SEQ ID NO: 2631619 - RNA, 14 nt, Human
uugagggcccagag

SEQ ID NO: 2631620 - RNA, 15 nt, Human
uugaggcuuucaggu

SEQ ID NO: 2631621 - RNA, 20 nt, Human
uugauagcacagacccugcc

SEQ ID NO: 2631622 - RNA, 19 nt, Human
uugauagcacagacccugc

SEQ ID NO: 2631623 - RNA, 22 nt, Human
uugaggggcuggccuuccugcc

SEQ ID NO: 2631624 - RNA, 22 nt, Human
uugaggggauuaauaugaaaac

SEQ ID NO: 2631625 - RNA, 16 nt, Human
uugaggggcuccugga

SEQ ID NO: 2631626 - RNA, 16 nt, Human
uugaggggauuaauau

SEQ ID NO: 2631627 - RNA, 20 nt, Human
uugaggggauuaauaugaaa

SEQ ID NO: 2631628 - RNA, 15 nt, Human
uugaggggcuccugg

SEQ ID NO: 2631629 - RNA, 23 nt, Human
uugagggcccagagcaggaagca

SEQ ID NO: 2631630 - RNA, 21 nt, Human
uugagggcccagagcaggaag

SEQ ID NO: 2631631 - RNA, 15 nt, Human
uugaggggauuaaua

SEQ ID NO: 2631632 - RNA, 18 nt, Human
uugcauagauucccugag

SEQ ID NO: 2631633 - RNA, 22 nt, Human
uugccaccccacccucccugga

SEQ ID NO: 2631634 - RNA, 21 nt, Human
uugccaccccacccucccugg

SEQ ID NO: 2631635 - RNA, 13 nt, Human
uugccacccucau

SEQ ID NO: 2631636 - RNA, 22 nt, Human
uugcauaguaccaaucauuuua

SEQ ID NO: 2631637 - RNA, 19 nt, Human
uugccaccccacccucccu

SEQ ID NO: 2631638 - RNA, 15 nt, Human
uugccacugccucuu

SEQ ID NO: 2631639 - RNA, 14 nt, Human
uugccacugccucu

SEQ ID NO: 2631640 - RNA, 23 nt, Human
uugccaccccacccucccuggag

SEQ ID NO: 2631641 - RNA, 16 nt, Human
uugccacccucaugcu

SEQ ID NO: 2631642 - RNA, 14 nt, Human
uugcauagaauaaa

SEQ ID NO: 2631643 - RNA, 21 nt, Human
uugcauaauaagcuaaagagg

SEQ ID NO: 2631644 - RNA, 13 nt, Human
uugcagugagcca

SEQ ID NO: 2631645 - RNA, 21 nt, Human
uugcaggcaugcaugugcuug

SEQ ID NO: 2631646 - RNA, 23 nt, Human
uugcaggagcaguaucaugaagc

SEQ ID NO: 2631647 - RNA, 22 nt, Human
uugcagacaggcaagcaccucc

SEQ ID NO: 2631648 - RNA, 20 nt, Human
uugcagguggaacucaguca

SEQ ID NO: 2631649 - RNA, 19 nt, Human
uugcagguggaacucaguc

SEQ ID NO: 2631650 - RNA, 18 nt, Human
uugcagggagcauggcug

SEQ ID NO: 2631651 - RNA, 18 nt, Human
uugcagguggaacucagu

SEQ ID NO: 2631652 - RNA, 22 nt, Human
uugcaguaaacuuuuaauuaaa

SEQ ID NO: 2631653 - RNA, 15 nt, Human
uugcagguugcuuug

SEQ ID NO: 2631654 - RNA, 17 nt, Human
uugcaguagauuuucuu

SEQ ID NO: 2631655 - RNA, 20 nt, Human
uugcaguagagucaucucca

SEQ ID NO: 2631656 - RNA, 16 nt, Human
uugcagacaggcaagc

SEQ ID NO: 2631657 - RNA, 14 nt, Human
uugcaaccgucugu

SEQ ID NO: 2631658 - RNA, 13 nt, Human
uugcaacacacag

SEQ ID NO: 2631659 - RNA, 12 nt, Human
uugcaaccacug

SEQ ID NO: 2631660 - RNA, 15 nt, Human
uugcaacacacagac

SEQ ID NO: 2631661 - RNA, 21 nt, Human
uugcagaacuaaacucauuua

SEQ ID NO: 2631662 - RNA, 14 nt, Human
uugcaaccucgcug

SEQ ID NO: 2631663 - RNA, 19 nt, Human
uugcagaacuaaacucauu

SEQ ID NO: 2631664 - RNA, 22 nt, Human
uugcagaaacauuuugugguca

SEQ ID NO: 2631665 - RNA, 12 nt, Human
uugaugaagaag

SEQ ID NO: 2631666 - RNA, 19 nt, Human
uugauuuaugcauggaaac

SEQ ID NO: 2631667 - RNA, 12 nt, Human
uugauuuaugca

SEQ ID NO: 2631668 - RNA, 20 nt, Human
uugauuguucgggugugcaa

SEQ ID NO: 2631669 - RNA, 17 nt, Human
uugauugucagcuacua

SEQ ID NO: 2631670 - RNA, 21 nt, Human
uugauugucagcuacuaauga

SEQ ID NO: 2631671 - RNA, 15 nt, Human
uugauugucagcuac

SEQ ID NO: 2631672 - RNA, 13 nt, Human
uugaggguaggag

SEQ ID NO: 2631673 - RNA, 14 nt, Human
uugaucuggaaccc

SEQ ID NO: 2631674 - RNA, 21 nt, Human
uugauagcacagacccugccc

SEQ ID NO: 2631675 - RNA, 15 nt, Human
uugaucuggaaccca

SEQ ID NO: 2631676 - RNA, 16 nt, Human
uugaucuggaacccag

SEQ ID NO: 2631677 - RNA, 17 nt, Human
uugaucuggaacccaga

SEQ ID NO: 2631678 - RNA, 19 nt, Human
uugaucuggaacccagacu

SEQ ID NO: 2631679 - RNA, 18 nt, Human
uugaggguaauaaacuua

SEQ ID NO: 2631680 - RNA, 12 nt, Human
uugcaaacuuua

SEQ ID NO: 2631681 - RNA, 16 nt, Human
uugcaaaauuuccagu

SEQ ID NO: 2631682 - RNA, 21 nt, Human
uugcaaaauuuccaguaccuu

SEQ ID NO: 2631683 - RNA, 22 nt, Human
uugcaaaauuuccaguaccuuu

SEQ ID NO: 2631684 - RNA, 23 nt, Human
uugcaaaauuuccaguaccuuug

SEQ ID NO: 2631685 - RNA, 19 nt, Human
uugcaaaauagcauuuguu

SEQ ID NO: 2631686 - RNA, 15 nt, Human
uugcaaaauuuccag

SEQ ID NO: 2631687 - RNA, 11 nt, Human
uugcaaaauuu

SEQ ID NO: 2631688 - RNA, 17 nt, Human
uugcaacaggcugggcu

SEQ ID NO: 2631689 - RNA, 14 nt, Human
uugcaacaggcugg

SEQ ID NO: 2631690 - RNA, 18 nt, Human
uugauuuccguuaaaaua

SEQ ID NO: 2631691 - RNA, 17 nt, Human
uugcaaaagacuaauuu

SEQ ID NO: 2631692 - RNA, 18 nt, Human
uugauuuuuaccguuucu

SEQ ID NO: 2631693 - RNA, 16 nt, Human
uugauuuucuguugua

SEQ ID NO: 2631694 - RNA, 14 nt, Human
uugauuuucuguug

SEQ ID NO: 2631695 - RNA, 20 nt, Human
uugauuuuugccucuuccag

SEQ ID NO: 2631696 - RNA, 21 nt, Human
uugaaaacacuguucucugcc

SEQ ID NO: 2631697 - RNA, 19 nt, Human
uugaaaacacuguucucug

SEQ ID NO: 2631698 - RNA, 15 nt, Human
uugaaaaaugcaugu

SEQ ID NO: 2631699 - RNA, 15 nt, Human
uucuuuauacuguaa

SEQ ID NO: 2631700 - RNA, 10 nt, Human
uucuuucaag

SEQ ID NO: 2631701 - RNA, 20 nt, Human
uugaaaaauuccuauuguga

SEQ ID NO: 2631702 - RNA, 16 nt, Human
uugaaaaauuccuauu

SEQ ID NO: 2631703 - RNA, 15 nt, Human
uugaaaaauuccuau

SEQ ID NO: 2631704 - RNA, 13 nt, Human
uugaaaaauuccu

SEQ ID NO: 2631705 - RNA, 21 nt, Human
uugaaaaaugugcaaaacagc

SEQ ID NO: 2631706 - RNA, 20 nt, Human
uucuuucaagugaaucuaaa

SEQ ID NO: 2631707 - RNA, 22 nt, Human
uucuuucaagugaaucuaaaag

SEQ ID NO: 2631708 - RNA, 13 nt, Human
uucuuguaguagu

SEQ ID NO: 2631709 - RNA, 23 nt, Human
uucuuguaauuuaaacaggccca

SEQ ID NO: 2631710 - RNA, 12 nt, Human
uucuuguauuaa

SEQ ID NO: 2631711 - RNA, 13 nt, Human
uucuuguauuaag

SEQ ID NO: 2631712 - RNA, 15 nt, Human
uucuuuaggagauuu

SEQ ID NO: 2631713 - RNA, 14 nt, Human
uucuuuaggagauu

SEQ ID NO: 2631714 - RNA, 18 nt, Human
uucuuuagagcauugcca

SEQ ID NO: 2631715 - RNA, 22 nt, Human
uucuuuaggagauuuuaggugu

SEQ ID NO: 2631716 - RNA, 13 nt, Human
uucuuuauaaacu

SEQ ID NO: 2631717 - RNA, 14 nt, Human
uucuuuauaaacuu

SEQ ID NO: 2631718 - RNA, 16 nt, Human
uucuuuauacuguaau

SEQ ID NO: 2631719 - RNA, 22 nt, Human
uucuuuauacaacagugcuaaa

SEQ ID NO: 2631720 - RNA, 19 nt, Human
uucuuuauacaacagugcu

SEQ ID NO: 2631721 - RNA, 18 nt, Human
uucuuuauacaacagugc

SEQ ID NO: 2631722 - RNA, 16 nt, Human
uucuuuauacaacagu

SEQ ID NO: 2631723 - RNA, 18 nt, Human
uucuuuauaauucuacuu

SEQ ID NO: 2631724 - RNA, 16 nt, Human
uugaaaagacuccaaa

SEQ ID NO: 2631725 - RNA, 18 nt, Human
uugaaaagacuccaaaga

SEQ ID NO: 2631726 - RNA, 22 nt, Human
uugaaaagacuccaaagaaaug

SEQ ID NO: 2631727 - RNA, 23 nt, Human
uugaaaagacuccaaagaaaugu

SEQ ID NO: 2631728 - RNA, 23 nt, Human
uugaaaaauuccuauugugauuu

SEQ ID NO: 2631729 - RNA, 22 nt, Human
uugaaaacacuguucucugccc

SEQ ID NO: 2631730 - RNA, 23 nt, Human
uugaaacugagaugugaacacau

SEQ ID NO: 2631731 - RNA, 15 nt, Human
uugaaagaaaauaug

SEQ ID NO: 2631732 - RNA, 20 nt, Human
uugaagaacugcaggcccug

SEQ ID NO: 2631733 - RNA, 22 nt, Human
uugaacuuuuuuccacugaagu

SEQ ID NO: 2631734 - RNA, 16 nt, Human
uugaagaacugcaggc

SEQ ID NO: 2631735 - RNA, 13 nt, Human
uugaagaaugaac

SEQ ID NO: 2631736 - RNA, 16 nt, Human
uugaacuuuuuuccac

SEQ ID NO: 2631737 - RNA, 19 nt, Human
uugaagaacugcaggcccu

SEQ ID NO: 2631738 - RNA, 16 nt, Human
uugaagaaugaacaaa

SEQ ID NO: 2631739 - RNA, 15 nt, Human
uugaagaaugaacaa

SEQ ID NO: 2631740 - RNA, 22 nt, Human
uugaacuuugaccucugcagca

SEQ ID NO: 2631741 - RNA, 15 nt, Human
uugaacugauaguua

SEQ ID NO: 2631742 - RNA, 15 nt, Human
uugaacugagcuugg

SEQ ID NO: 2631743 - RNA, 16 nt, Human
uugaacugagcuugga

SEQ ID NO: 2631744 - RNA, 16 nt, Human
uugaacugauaaagau

SEQ ID NO: 2631745 - RNA, 17 nt, Human
uugaaagaaaggacucu

SEQ ID NO: 2631746 - RNA, 19 nt, Human
uugaacucuucaaucucuu

SEQ ID NO: 2631747 - RNA, 17 nt, Human
uugaagacagagcuaca

SEQ ID NO: 2631748 - RNA, 13 nt, Human
uugaagacacuga

SEQ ID NO: 2631749 - RNA, 15 nt, Human
uugaagacacugaaa

SEQ ID NO: 2631750 - RNA, 19 nt, Human
uugaagacuuuucuuucag

SEQ ID NO: 2631751 - RNA, 22 nt, Human
uugaagacacugaaauauacac

SEQ ID NO: 2631752 - RNA, 20 nt, Human
uugaaucuugucucaaugcu

SEQ ID NO: 2631753 - RNA, 17 nt, Human
uugaaucuugucucaau

SEQ ID NO: 2631754 - RNA, 16 nt, Human
uugaaucuugucucaa

SEQ ID NO: 2631755 - RNA, 15 nt, Human
uugaaucuugucuca

SEQ ID NO: 2631756 - RNA, 23 nt, Human
uugaaucuugucucaaugcucau

SEQ ID NO: 2631757 - RNA, 22 nt, Human
uugaaucuugucucaaugcuca

SEQ ID NO: 2631758 - RNA, 24 nt, Human
uugaaucugauuggacauuuucuu

SEQ ID NO: 2631759 - RNA, 15 nt, Human
uugaaucuuuccaau

SEQ ID NO: 2631760 - RNA, 20 nt, Human
uugaaucuauuuaaguaaaa

SEQ ID NO: 2631761 - RNA, 14 nt, Human
uugaaucuugucuc

SEQ ID NO: 2631762 - RNA, 23 nt, Human
uugaaucugauuggacauuuucu

SEQ ID NO: 2631763 - RNA, 14 nt, Human
uucugagcauuuaa

SEQ ID NO: 2631764 - RNA, 15 nt, Human
uucugagaaagacua

SEQ ID NO: 2631765 - RNA, 15 nt, Human
uucugacuccagugg

SEQ ID NO: 2631766 - RNA, 13 nt, Human
uucugacugcuga

SEQ ID NO: 2631767 - RNA, 12 nt, Human
uucugacuugac

SEQ ID NO: 2631768 - RNA, 22 nt, Human
uucugacuucauagauuuccuu

SEQ ID NO: 2631769 - RNA, 20 nt, Human
uucugagcccgggcugccug

SEQ ID NO: 2631770 - RNA, 19 nt, Human
uucugagcccgggcugccu

SEQ ID NO: 2631771 - RNA, 21 nt, Human
uucugagcccgggcugccugg

SEQ ID NO: 2631772 - RNA, 16 nt, Human
uucugagcuauuucau

SEQ ID NO: 2631773 - RNA, 23 nt, Human
uucugagcuauuucaucuauuuu

SEQ ID NO: 2631774 - RNA, 17 nt, Human
uucuguccgagcuuuga

SEQ ID NO: 2631775 - RNA, 21 nt, Human
uucuguccgagcuuugaaaau

SEQ ID NO: 2631776 - RNA, 23 nt, Human
uucuguggaaaguguaaagcauu

SEQ ID NO: 2631777 - RNA, 22 nt, Human
uucuguggaaaguguaaagcau

SEQ ID NO: 2631778 - RNA, 22 nt, Human
uucugugggagaauucuuacau

SEQ ID NO: 2631779 - RNA, 21 nt, Human
uucuguggaaaguguaaagca

SEQ ID NO: 2631780 - RNA, 17 nt, Human
uucuguccuacucugug

SEQ ID NO: 2631781 - RNA, 23 nt, Human
uucuguggguuucuaaagcugcc

SEQ ID NO: 2631782 - RNA, 16 nt, Human
uucuguggcucacaga

SEQ ID NO: 2631783 - RNA, 12 nt, Human
uucuguggcuca

SEQ ID NO: 2631784 - RNA, 15 nt, Human
uucuuauuucauuuc

SEQ ID NO: 2631785 - RNA, 21 nt, Human
uucuguucuguggaaagugua

SEQ ID NO: 2631786 - RNA, 20 nt, Human
uucuguucuguggaaagugu

SEQ ID NO: 2631787 - RNA, 14 nt, Human
uucuuauuucauga

SEQ ID NO: 2631788 - RNA, 16 nt, Human
uucuuauuucaugaaa

SEQ ID NO: 2631789 - RNA, 19 nt, Human
uucuucaacaggagaauuu

SEQ ID NO: 2631790 - RNA, 17 nt, Human
uucuucaacaucaaugu

SEQ ID NO: 2631791 - RNA, 14 nt, Human
uucuucaacucccu

SEQ ID NO: 2631792 - RNA, 21 nt, Human
uucuucaacaucaauguucau

SEQ ID NO: 2631793 - RNA, 22 nt, Human
uucuucaacaucaauguucauu

SEQ ID NO: 2631794 - RNA, 16 nt, Human
uucuguucuguggaaa

SEQ ID NO: 2631795 - RNA, 13 nt, Human
uucuguucugugg

SEQ ID NO: 2631796 - RNA, 11 nt, Human
uucuguucuuu

SEQ ID NO: 2631797 - RNA, 15 nt, Human
uucuuauugcuuuua

SEQ ID NO: 2631798 - RNA, 19 nt, Human
uucuuauuuaaugaaagac

SEQ ID NO: 2631799 - RNA, 23 nt, Human
uucuuauuuaaugaaagacugua

SEQ ID NO: 2631800 - RNA, 17 nt, Human
uucuugguuuguaaauu

SEQ ID NO: 2631801 - RNA, 18 nt, Human
uucuugguuuguaaauua

SEQ ID NO: 2631802 - RNA, 11 nt, Human
uucuuguaauu

SEQ ID NO: 2631803 - RNA, 20 nt, Human
uucuugguuggcuggccuuc

SEQ ID NO: 2631804 - RNA, 21 nt, Human
uucuuguaauuuaaacaggcc

SEQ ID NO: 2631805 - RNA, 16 nt, Human
uucuugguuggcuggc

SEQ ID NO: 2631806 - RNA, 16 nt, Human
uucuugguugaggaaa

SEQ ID NO: 2631807 - RNA, 23 nt, Human
uucuugguuuguaaauuaacuuu

SEQ ID NO: 2631808 - RNA, 13 nt, Human
uucuugguuugua

SEQ ID NO: 2631809 - RNA, 16 nt, Human
uucuugguuuguaaau

SEQ ID NO: 2631810 - RNA, 14 nt, Human
uucuucacccagcu

SEQ ID NO: 2631811 - RNA, 21 nt, Human
uucuucacccagcuaaucugu

SEQ ID NO: 2631812 - RNA, 22 nt, Human
uucuugguugaggaaacaaaca

SEQ ID NO: 2631813 - RNA, 14 nt, Human
uucuucagaagaca

SEQ ID NO: 2631814 - RNA, 22 nt, Human
uucuucacuguccuccaagcca

SEQ ID NO: 2631815 - RNA, 12 nt, Human
uucuauuuggaa

SEQ ID NO: 2631816 - RNA, 18 nt, Human
uucuauuugcugggcuuu

SEQ ID NO: 2631817 - RNA, 17 nt, Human
uucuauuugcugggcuu

SEQ ID NO: 2631818 - RNA, 16 nt, Human
uucuauuugcugggcu

SEQ ID NO: 2631819 - RNA, 15 nt, Human
uucuauuugcugggc

SEQ ID NO: 2631820 - RNA, 20 nt, Human
uucuauuuucauuuucugca

SEQ ID NO: 2631821 - RNA, 17 nt, Human
uucuauuuucauuuucu

SEQ ID NO: 2631822 - RNA, 13 nt, Human
uucuauuuuguaa

SEQ ID NO: 2631823 - RNA, 16 nt, Human
uucuauuuuguaaacu

SEQ ID NO: 2631824 - RNA, 23 nt, Human
uucuauuuucauuuucugcaagc

SEQ ID NO: 2631825 - RNA, 21 nt, Human
uucuauuuucauuuucugcaa

SEQ ID NO: 2631826 - RNA, 13 nt, Human
uucucaaacacag

SEQ ID NO: 2631827 - RNA, 15 nt, Human
uucuauuuuuguaga

SEQ ID NO: 2631828 - RNA, 14 nt, Human
uucuauuguuucuu

SEQ ID NO: 2631829 - RNA, 22 nt, Human
uucuauuguuacucugguucuu

SEQ ID NO: 2631830 - RNA, 19 nt, Human
uucuauuguuacucugguu

SEQ ID NO: 2631831 - RNA, 15 nt, Human
uucuauuguuguaca

SEQ ID NO: 2631832 - RNA, 14 nt, Human
uucuauuuaaugga

SEQ ID NO: 2631833 - RNA, 17 nt, Human
uucuauuguuuauucuu

SEQ ID NO: 2631834 - RNA, 13 nt, Human
uucuauuuaaugg

SEQ ID NO: 2631835 - RNA, 19 nt, Human
uucuauuucagugccaaua

SEQ ID NO: 2631836 - RNA, 17 nt, Human
uucuauuucuccuccau

SEQ ID NO: 2631837 - RNA, 19 nt, Human
uucuauuucuccuccaugg

SEQ ID NO: 2631838 - RNA, 18 nt, Human
uucuauuuauauguacau

SEQ ID NO: 2631839 - RNA, 19 nt, Human
uucuauuuauauguacaug

SEQ ID NO: 2631840 - RNA, 15 nt, Human
uucuauuuauuuacu

SEQ ID NO: 2631841 - RNA, 22 nt, Human
uucucaaaccuguuuaaauauu

SEQ ID NO: 2631842 - RNA, 23 nt, Human
uucucaaacacaguuacacuugu

SEQ ID NO: 2631843 - RNA, 18 nt, Human
uucucaaaguuuugaaaa

SEQ ID NO: 2631844 - RNA, 17 nt, Human
uucucaaaguuuugaaa

SEQ ID NO: 2631845 - RNA, 15 nt, Human
uucucaaaguuuuga

SEQ ID NO: 2631846 - RNA, 21 nt, Human
uucucaacaaagcacaguguu

SEQ ID NO: 2631847 - RNA, 12 nt, Human
uucucaaauaaa

SEQ ID NO: 2631848 - RNA, 22 nt, Human
uucucaaaguuuugaaaagcua

SEQ ID NO: 2631849 - RNA, 21 nt, Human
uucucaaaguuuugaaaagcu

SEQ ID NO: 2631850 - RNA, 15 nt, Human
uucucauccugcagg

SEQ ID NO: 2631851 - RNA, 14 nt, Human
uucucaugauccaa

SEQ ID NO: 2631852 - RNA, 18 nt, Human
uucucaucuuucuugauc

SEQ ID NO: 2631853 - RNA, 15 nt, Human
uucucaucuuucuug

SEQ ID NO: 2631854 - RNA, 11 nt, Human
uucucaugccu

SEQ ID NO: 2631855 - RNA, 12 nt, Human
uucucaugccuc

SEQ ID NO: 2631856 - RNA, 14 nt, Human
uucucaugccucag

SEQ ID NO: 2631857 - RNA, 14 nt, Human
uucuccaaaugaga

SEQ ID NO: 2631858 - RNA, 20 nt, Human
uucuccaaacugaagcagcc

SEQ ID NO: 2631859 - RNA, 17 nt, Human
uucuauuguuacucugg

SEQ ID NO: 2631860 - RNA, 14 nt, Human
uucuauuguuacuc

SEQ ID NO: 2631861 - RNA, 15 nt, Human
uucuauuguacagaa

SEQ ID NO: 2631862 - RNA, 14 nt, Human
uucuauuguacaga

SEQ ID NO: 2631863 - RNA, 18 nt, Human
uucuauugcaguuauaga

SEQ ID NO: 2631864 - RNA, 23 nt, Human
uucuauugacuucaaugauagua

SEQ ID NO: 2631865 - RNA, 14 nt, Human
uucuauugaaaaau

SEQ ID NO: 2631866 - RNA, 17 nt, Human
uucuauugacuucaaug

SEQ ID NO: 2631867 - RNA, 17 nt, Human
uucuauuaacuuuaauu

SEQ ID NO: 2631868 - RNA, 20 nt, Human
uucuauuagccagucuuuac

SEQ ID NO: 2631869 - RNA, 22 nt, Human
uucuauucaagguggccaaauu

SEQ ID NO: 2631870 - RNA, 13 nt, Human
uucuauugaaaaa

SEQ ID NO: 2631871 - RNA, 13 nt, Human
uucuaugagaaaa

SEQ ID NO: 2631872 - RNA, 17 nt, Human
uucuaucauuuuuguac

SEQ ID NO: 2631873 - RNA, 13 nt, Human
uucuaucauuuuu

SEQ ID NO: 2631874 - RNA, 17 nt, Human
uucuaucacauauuuga

SEQ ID NO: 2631875 - RNA, 14 nt, Human
uucuaucacauauu

SEQ ID NO: 2631876 - RNA, 15 nt, Human
uucuauguaguuuau

SEQ ID NO: 2631877 - RNA, 22 nt, Human
uucuaugugacaauuuuguaca

SEQ ID NO: 2631878 - RNA, 16 nt, Human
uucuaugacacaugca

SEQ ID NO: 2631879 - RNA, 17 nt, Human
uucuaugacacaugcaa

SEQ ID NO: 2631880 - RNA, 14 nt, Human
uucuaauagaacuc

SEQ ID NO: 2631881 - RNA, 12 nt, Human
uucuaauagaac

SEQ ID NO: 2631882 - RNA, 14 nt, Human
uucuaauaguuuua

SEQ ID NO: 2631883 - RNA, 18 nt, Human
uucuaauagaacucaguu

SEQ ID NO: 2631884 - RNA, 22 nt, Human
uucuaauauauuuuuauauuua

SEQ ID NO: 2631885 - RNA, 18 nt, Human
uucuaauauuuauugcuu

SEQ ID NO: 2631886 - RNA, 21 nt, Human
uucuaauauuuauugcuuuau

SEQ ID NO: 2631887 - RNA, 19 nt, Human
uucuaauauuuauugcuuu

SEQ ID NO: 2631888 - RNA, 23 nt, Human
uucuauaugaauuuaaauauaau

SEQ ID NO: 2631889 - RNA, 13 nt, Human
uucuaaugucuuc

SEQ ID NO: 2631890 - RNA, 20 nt, Human
uucugacccaugcugcccug

SEQ ID NO: 2631891 - RNA, 18 nt, Human
uucugacccaugcugccc

SEQ ID NO: 2631892 - RNA, 16 nt, Human
uucugacccaugcugc

SEQ ID NO: 2631893 - RNA, 19 nt, Human
uucucugguaauauugacu

SEQ ID NO: 2631894 - RNA, 21 nt, Human
uucugacccaugcugcccugu

SEQ ID NO: 2631895 - RNA, 14 nt, Human
uucucuguauagua

SEQ ID NO: 2631896 - RNA, 19 nt, Human
uucugacucgguuucucca

SEQ ID NO: 2631897 - RNA, 18 nt, Human
uucugacucgguuucucc

SEQ ID NO: 2631898 - RNA, 15 nt, Human
uucugacucugagcu

SEQ ID NO: 2631899 - RNA, 16 nt, Human
uucugacucugagcua

SEQ ID NO: 2631900 - RNA, 20 nt, Human
uucugacgugccuuuugcac

SEQ ID NO: 2631901 - RNA, 17 nt, Human
uucucuguagggaacuc

SEQ ID NO: 2631902 - RNA, 12 nt, Human
uucucugucuca

SEQ ID NO: 2631903 - RNA, 12 nt, Human
uucucugccagu

SEQ ID NO: 2631904 - RNA, 10 nt, Human
uucucugcca

SEQ ID NO: 2631905 - RNA, 13 nt, Human
uucucugccagug

SEQ ID NO: 2631906 - RNA, 22 nt, Human
uucucugaguaucuccucgcaa

SEQ ID NO: 2631907 - RNA, 15 nt, Human
uucucuggagccaag

SEQ ID NO: 2631908 - RNA, 17 nt, Human
uucucuggagccaaguc

SEQ ID NO: 2631909 - RNA, 15 nt, Human
uucucugcuccacca

SEQ ID NO: 2631910 - RNA, 22 nt, Human
uucucuggaaaggggggagcug

SEQ ID NO: 2631911 - RNA, 11 nt, Human
uucucugcucc

SEQ ID NO: 2631912 - RNA, 13 nt, Human
uucucugcuccac

SEQ ID NO: 2631913 - RNA, 14 nt, Human
uucucugcuccacc

SEQ ID NO: 2631914 - RNA, 17 nt, Human
uucucugacuucugccu

SEQ ID NO: 2631915 - RNA, 16 nt, Human
uucucugacuucugcc

SEQ ID NO: 2631916 - RNA, 12 nt, Human
uucucugacuuc

SEQ ID NO: 2631917 - RNA, 16 nt, Human
uucucugaagggaggu

SEQ ID NO: 2631918 - RNA, 15 nt, Human
uucucugaagggagg

SEQ ID NO: 2631919 - RNA, 11 nt, Human
uucucugacuu

SEQ ID NO: 2631920 - RNA, 23 nt, Human
uucucugaagaguggguuucaca

SEQ ID NO: 2631921 - RNA, 23 nt, Human
uucucuccucuccccaugauguu

SEQ ID NO: 2631922 - RNA, 14 nt, Human
uucucuccucccca

SEQ ID NO: 2631923 - RNA, 12 nt, Human
uucucuccuccc

SEQ ID NO: 2631924 - RNA, 23 nt, Human
uucucucccaggggcuggcuuca

SEQ ID NO: 2631925 - RNA, 21 nt, Human
uucucucccaggggcuggcuu

SEQ ID NO: 2631926 - RNA, 16 nt, Human
uucucucuccugucca

SEQ ID NO: 2631927 - RNA, 17 nt, Human
uucucucggcuccccau

SEQ ID NO: 2631928 - RNA, 12 nt, Human
uucucucucacc

SEQ ID NO: 2631929 - RNA, 22 nt, Human
uucucuccuguaccucuugagc

SEQ ID NO: 2631930 - RNA, 17 nt, Human
uucucuccuccccaaau

SEQ ID NO: 2631931 - RNA, 15 nt, Human
uucucuccuccccaa

SEQ ID NO: 2631932 - RNA, 20 nt, Human
uucucucggaguaucuggga

SEQ ID NO: 2631933 - RNA, 23 nt, Human
uucucccccccggggcuggguug

SEQ ID NO: 2631934 - RNA, 18 nt, Human
uucucuccagccccugga

SEQ ID NO: 2631935 - RNA, 17 nt, Human
uucucccccccggggcu

SEQ ID NO: 2631936 - RNA, 20 nt, Human
uucucccagguaccagcugc

SEQ ID NO: 2631937 - RNA, 19 nt, Human
uucucccagguaccagcug

SEQ ID NO: 2631938 - RNA, 21 nt, Human
uucucccccccggggcugggu

SEQ ID NO: 2631939 - RNA, 20 nt, Human
uucucccccccggggcuggg

SEQ ID NO: 2631940 - RNA, 14 nt, Human
uucucccccugggc

SEQ ID NO: 2631941 - RNA, 17 nt, Human
uucucccccugggcucu

SEQ ID NO: 2631942 - RNA, 18 nt, Human
uucucccccugggcucug

SEQ ID NO: 2631943 - RNA, 16 nt, Human
uucuccaagcaggaca

SEQ ID NO: 2631944 - RNA, 13 nt, Human
uucuccacccugc

SEQ ID NO: 2631945 - RNA, 22 nt, Human
uucuccacagcaaccccaggcu

SEQ ID NO: 2631946 - RNA, 21 nt, Human
uucuccaauaucagugcucga

SEQ ID NO: 2631947 - RNA, 19 nt, Human
uucuccaauaucagugcuc

SEQ ID NO: 2631948 - RNA, 15 nt, Human
uucuccacagcaacc

SEQ ID NO: 2631949 - RNA, 11 nt, Human
uucuccaggcu

SEQ ID NO: 2631950 - RNA, 22 nt, Human
uucuccauggccaccuuuucag

SEQ ID NO: 2631951 - RNA, 14 nt, Human
uucuccauuguaaa

SEQ ID NO: 2631952 - RNA, 13 nt, Human
uucucccacacug

SEQ ID NO: 2631953 - RNA, 13 nt, Human
uucucccaggaag

SEQ ID NO: 2631954 - RNA, 12 nt, Human
uucucccaggaa

SEQ ID NO: 2631955 - RNA, 17 nt, Human
uucucccacuuggccaa

SEQ ID NO: 2631956 - RNA, 15 nt, Human
uucucccaggaagcu

SEQ ID NO: 2631957 - RNA, 14 nt, Human
uucucccaggaagc

SEQ ID NO: 2631958 - RNA, 23 nt, Human
uucucccaggccaggcuccuucc

SEQ ID NO: 2631959 - RNA, 15 nt, Human
uucuccaucucucug

SEQ ID NO: 2631960 - RNA, 18 nt, Human
uucuccaggcucuuuggg

SEQ ID NO: 2631961 - RNA, 21 nt, Human
uucuccauccuuucugccucu

SEQ ID NO: 2631962 - RNA, 19 nt, Human
uucuccaucucucuggccc

SEQ ID NO: 2631963 - RNA, 18 nt, Human
uucuccaucuggcagggu

SEQ ID NO: 2631964 - RNA, 23 nt, Human
uucuccaugagacacaucuccuc

SEQ ID NO: 2631965 - RNA, 20 nt, Human
uucuccauccacaugggagc

SEQ ID NO: 2631966 - RNA, 20 nt, Human
uucuccaggucucacgggca

SEQ ID NO: 2631967 - RNA, 14 nt, Human
uuccccagcccagg

SEQ ID NO: 2631968 - RNA, 13 nt, Human
uuccccagcccag

SEQ ID NO: 2631969 - RNA, 22 nt, Human
uuccccagcagggucuuuucau

SEQ ID NO: 2631970 - RNA, 12 nt, Human
uuccccagccca

SEQ ID NO: 2631971 - RNA, 16 nt, Human
uucccuguauuuucuu

SEQ ID NO: 2631972 - RNA, 12 nt, Human
uucccugugcug

SEQ ID NO: 2631973 - RNA, 11 nt, Human
uucccugugcu

SEQ ID NO: 2631974 - RNA, 20 nt, Human
uucccuguauuuucuuucuc

SEQ ID NO: 2631975 - RNA, 23 nt, Human
uucccuucaguacccucucagcu

SEQ ID NO: 2631976 - RNA, 22 nt, Human
uucccuucaguacccucucagc

SEQ ID NO: 2631977 - RNA, 19 nt, Human
uucccuucaguacccucuc

SEQ ID NO: 2631978 - RNA, 17 nt, Human
uuccccacugcacacac

SEQ ID NO: 2631979 - RNA, 14 nt, Human
uuccccacugccug

SEQ ID NO: 2631980 - RNA, 18 nt, Human
uuccccacugccugccca

SEQ ID NO: 2631981 - RNA, 21 nt, Human
uuccccacugacagccuccca

SEQ ID NO: 2631982 - RNA, 23 nt, Human
uuccccacugacagccucccacc

SEQ ID NO: 2631983 - RNA, 17 nt, Human
uuccccacugacagccu

SEQ ID NO: 2631984 - RNA, 22 nt, Human
uuccccaccccagcucaugccc

SEQ ID NO: 2631985 - RNA, 11 nt, Human
uuccccagaga

SEQ ID NO: 2631986 - RNA, 12 nt, Human
uuccccagagaa

SEQ ID NO: 2631987 - RNA, 22 nt, Human
uuccccacuugagaauuacccu

SEQ ID NO: 2631988 - RNA, 14 nt, Human
uucccuucaucugg

SEQ ID NO: 2631989 - RNA, 15 nt, Human
uucccuucaucugga

SEQ ID NO: 2631990 - RNA, 16 nt, Human
uucccuucaucuggaa

SEQ ID NO: 2631991 - RNA, 18 nt, Human
uucccuugaugaagaagu

SEQ ID NO: 2631992 - RNA, 16 nt, Human
uucccuuggccucaga

SEQ ID NO: 2631993 - RNA, 11 nt, Human
uucccuuggcc

SEQ ID NO: 2631994 - RNA, 12 nt, Human
uucccuuggccu

SEQ ID NO: 2631995 - RNA, 14 nt, Human
uucccuuggccuca

SEQ ID NO: 2631996 - RNA, 15 nt, Human
uucccuuggccucag

SEQ ID NO: 2631997 - RNA, 15 nt, Human
uuccuagccaccgcc

SEQ ID NO: 2631998 - RNA, 21 nt, Human
uuccuagccaccgccuccuac

SEQ ID NO: 2631999 - RNA, 17 nt, Human
uuccuagcacacacuuu

SEQ ID NO: 2632000 - RNA, 19 nt, Human
uuccuagauggcagucacu

SEQ ID NO: 2632001 - RNA, 22 nt, Human
uuccuagauggcagucacugaa

SEQ ID NO: 2632002 - RNA, 14 nt, Human
uuccuagccaccgc

SEQ ID NO: 2632003 - RNA, 19 nt, Human
uucccuuugacgccauccc

SEQ ID NO: 2632004 - RNA, 22 nt, Human
uuccuagaaguuacugaaugca

SEQ ID NO: 2632005 - RNA, 15 nt, Human
uucccuuuccuucca

SEQ ID NO: 2632006 - RNA, 14 nt, Human
uuccuagcccucuc

SEQ ID NO: 2632007 - RNA, 19 nt, Human
uuccuagcacacacuuuug

SEQ ID NO: 2632008 - RNA, 22 nt, Human
uuccuagccaccgccuccuaca

SEQ ID NO: 2632009 - RNA, 20 nt, Human
uuccuagguauaauucacau

SEQ ID NO: 2632010 - RNA, 12 nt, Human
uuccuagugaaa

SEQ ID NO: 2632011 - RNA, 18 nt, Human
uuccuagcccucucacau

SEQ ID NO: 2632012 - RNA, 20 nt, Human
uuccuaguucuguagaaaug

SEQ ID NO: 2632013 - RNA, 17 nt, Human
uuccuaguucuguagaa

SEQ ID NO: 2632014 - RNA, 16 nt, Human
uuccuaguucuguaga

SEQ ID NO: 2632015 - RNA, 15 nt, Human
uuccuaguuuucucc

SEQ ID NO: 2632016 - RNA, 18 nt, Human
uuccuaguuuucuccucc

SEQ ID NO: 2632017 - RNA, 22 nt, Human
uuccucaggcaaggucuggccu

SEQ ID NO: 2632018 - RNA, 23 nt, Human
uuccucaguuuaauccuucuagu

SEQ ID NO: 2632019 - RNA, 17 nt, Human
uuccucaguuacacaaa

SEQ ID NO: 2632020 - RNA, 23 nt, Human
uuccucaguucauccauucuauu

SEQ ID NO: 2632021 - RNA, 23 nt, Human
uuccucauaguaugguggcuggg

SEQ ID NO: 2632022 - RNA, 14 nt, Human
uuccuccuccccac

SEQ ID NO: 2632023 - RNA, 14 nt, Human
uuccucccuucugc

SEQ ID NO: 2632024 - RNA, 15 nt, Human
uuccucccuucugcu

SEQ ID NO: 2632025 - RNA, 16 nt, Human
uuccucccuucugcua

SEQ ID NO: 2632026 - RNA, 18 nt, Human
uuccucccuucugcuacu

SEQ ID NO: 2632027 - RNA, 15 nt, Human
uuccuccucccuccu

SEQ ID NO: 2632028 - RNA, 16 nt, Human
uuccuccuccccacuu

SEQ ID NO: 2632029 - RNA, 17 nt, Human
uuccuccucccuccugc

SEQ ID NO: 2632030 - RNA, 11 nt, Human
uuccucccuuc

SEQ ID NO: 2632031 - RNA, 12 nt, Human
uuccucccuucu

SEQ ID NO: 2632032 - RNA, 22 nt, Human
uuccucccucccucuuucccuc

SEQ ID NO: 2632033 - RNA, 19 nt, Human
uuccucauccaccccaucc

SEQ ID NO: 2632034 - RNA, 18 nt, Human
uuccucauccaccccauc

SEQ ID NO: 2632035 - RNA, 15 nt, Human
uuccucaucugucca

SEQ ID NO: 2632036 - RNA, 12 nt, Human
uuccucccuccc

SEQ ID NO: 2632037 - RNA, 19 nt, Human
uuccucccucccucuuucc

SEQ ID NO: 2632038 - RNA, 21 nt, Human
uuccucccucccucuuucccu

SEQ ID NO: 2632039 - RNA, 17 nt, Human
uucuaaaggcuaccuuu

SEQ ID NO: 2632040 - RNA, 18 nt, Human
uucuaaaggcuaccuuug

SEQ ID NO: 2632041 - RNA, 20 nt, Human
uucuaaaggccucuuccuug

SEQ ID NO: 2632042 - RNA, 15 nt, Human
uucuaauaaaacaaa

SEQ ID NO: 2632043 - RNA, 16 nt, Human
uucuaaaggcuaccuu

SEQ ID NO: 2632044 - RNA, 16 nt, Human
uucuaaacaagauuuu

SEQ ID NO: 2632045 - RNA, 22 nt, Human
uucuaaacaagaaucagucuau

SEQ ID NO: 2632046 - RNA, 18 nt, Human
uucuaaacccaauccaaa

SEQ ID NO: 2632047 - RNA, 19 nt, Human
uucuaaacccaauccaaau

SEQ ID NO: 2632048 - RNA, 23 nt, Human
uucuaaacccaauccaaauggcg

SEQ ID NO: 2632049 - RNA, 19 nt, Human
uucuaaaauauaaucaacc

SEQ ID NO: 2632050 - RNA, 22 nt, Human
uucggccuccauccugaggcuc

SEQ ID NO: 2632051 - RNA, 18 nt, Human
uucggccuccauccugag

SEQ ID NO: 2632052 - RNA, 19 nt, Human
uucggccuccauccugagg

SEQ ID NO: 2632053 - RNA, 22 nt, Human
uuccuuugaauccucucucugu

SEQ ID NO: 2632054 - RNA, 15 nt, Human
uuccuuugaagagga

SEQ ID NO: 2632055 - RNA, 14 nt, Human
uuccuuugaagagg

SEQ ID NO: 2632056 - RNA, 20 nt, Human
uuccuuucuugguucauaaa

SEQ ID NO: 2632057 - RNA, 12 nt, Human
uuccuuucucag

SEQ ID NO: 2632058 - RNA, 14 nt, Human
uuccuuucucaccg

SEQ ID NO: 2632059 - RNA, 13 nt, Human
uuccuuucucacc

SEQ ID NO: 2632060 - RNA, 12 nt, Human
uuccuuucucac

SEQ ID NO: 2632061 - RNA, 10 nt, Human
uuccuuucuc

SEQ ID NO: 2632062 - RNA, 16 nt, Human
uuccuuuccccagccc

SEQ ID NO: 2632063 - RNA, 15 nt, Human
uuccuuuccccagcc

SEQ ID NO: 2632064 - RNA, 17 nt, Human
uuccuuuccccagccca

SEQ ID NO: 2632065 - RNA, 14 nt, Human
uuccuuuccccagc

SEQ ID NO: 2632066 - RNA, 20 nt, Human
uuccuuucauuuacuguggc

SEQ ID NO: 2632067 - RNA, 13 nt, Human
uuccugcccuggg

SEQ ID NO: 2632068 - RNA, 16 nt, Human
uuccugcccugggagg

SEQ ID NO: 2632069 - RNA, 22 nt, Human
uuccugcccugggaggcaguga

SEQ ID NO: 2632070 - RNA, 17 nt, Human
uuccugcccuuccucag

SEQ ID NO: 2632071 - RNA, 16 nt, Human
uuccugcccuuccuca

SEQ ID NO: 2632072 - RNA, 13 nt, Human
uuccuccuggaaa

SEQ ID NO: 2632073 - RNA, 11 nt, Human
uuccuccugga

SEQ ID NO: 2632074 - RNA, 13 nt, Human
uuccuccugcuca

SEQ ID NO: 2632075 - RNA, 15 nt, Human
uuccuccugcucaua

SEQ ID NO: 2632076 - RNA, 18 nt, Human
uuccugccccaggccuga

SEQ ID NO: 2632077 - RNA, 11 nt, Human
uuccugcccug

SEQ ID NO: 2632078 - RNA, 19 nt, Human
uuccuucagugccuuaugg

SEQ ID NO: 2632079 - RNA, 16 nt, Human
uuccuucagugccuua

SEQ ID NO: 2632080 - RNA, 23 nt, Human
uuccuucagugccuuauggaaca

SEQ ID NO: 2632081 - RNA, 19 nt, Human
uuccuucauucaacccacc

SEQ ID NO: 2632082 - RNA, 13 nt, Human
uuccuuccucuga

SEQ ID NO: 2632083 - RNA, 17 nt, Human
uuccuuccucugagccu

SEQ ID NO: 2632084 - RNA, 15 nt, Human
uuccuuccuguucug

SEQ ID NO: 2632085 - RNA, 14 nt, Human
uuccuuccuucccu

SEQ ID NO: 2632086 - RNA, 14 nt, Human
uuccuucucaucug

SEQ ID NO: 2632087 - RNA, 16 nt, Human
uuccuucucaucugug

SEQ ID NO: 2632088 - RNA, 20 nt, Human
uuccuucugugaaaguacau

SEQ ID NO: 2632089 - RNA, 17 nt, Human
uuccuucugccugagcu

SEQ ID NO: 2632090 - RNA, 21 nt, Human
uuccuuucauuuacuguggcu

SEQ ID NO: 2632091 - RNA, 17 nt, Human
uuccuucugugaaagua

SEQ ID NO: 2632092 - RNA, 13 nt, Human
uuccuucugaagu

SEQ ID NO: 2632093 - RNA, 16 nt, Human
uuccuuccuucccugg

SEQ ID NO: 2632094 - RNA, 12 nt, Human
uuccuucccugg

SEQ ID NO: 2632095 - RNA, 21 nt, Human
uuccuucccugggcugugcua

SEQ ID NO: 2632096 - RNA, 20 nt, Human
uuccuucccugggcugugcu

SEQ ID NO: 2632097 - RNA, 13 nt, Human
uuccuucccuggc

SEQ ID NO: 2632098 - RNA, 16 nt, Human
uuccuucccugggcug

SEQ ID NO: 2632099 - RNA, 14 nt, Human
uuccuucccuggcu

SEQ ID NO: 2632100 - RNA, 17 nt, Human
uuccuucauuuccuccg

SEQ ID NO: 2632101 - RNA, 18 nt, Human
uuccugccgcaacaguuu

SEQ ID NO: 2632102 - RNA, 15 nt, Human
uuccuucagugccuu

SEQ ID NO: 2632103 - RNA, 21 nt, Human
uuccuucccacccaucgcugu

SEQ ID NO: 2632104 - RNA, 12 nt, Human
uuccuucccacc

SEQ ID NO: 2632105 - RNA, 20 nt, Human
uuccuuccaucccuaccccc

SEQ ID NO: 2632106 - RNA, 18 nt, Human
uuccugcccuuccucagu

SEQ ID NO: 2632107 - RNA, 13 nt, Human
uucaguggcagcu

SEQ ID NO: 2632108 - RNA, 19 nt, Human
uucagugcuguggccuggg

SEQ ID NO: 2632109 - RNA, 21 nt, Human
uucagugcuguggccugggca

SEQ ID NO: 2632110 - RNA, 18 nt, Human
uucagggaauuucaggaa

SEQ ID NO: 2632111 - RNA, 13 nt, Human
uucagugcugugg

SEQ ID NO: 2632112 - RNA, 19 nt, Human
uucaguuggcugacuucca

SEQ ID NO: 2632113 - RNA, 24 nt, Human
uucaguggcacgucaucuaguuuu

SEQ ID NO: 2632114 - RNA, 12 nt, Human
uucaguggagaa

SEQ ID NO: 2632115 - RNA, 16 nt, Human
uucaguugauuuuaca

SEQ ID NO: 2632116 - RNA, 21 nt, Human
uucagugccuuauggaacacu

SEQ ID NO: 2632117 - RNA, 19 nt, Human
uucagugccuuauggaaca

SEQ ID NO: 2632118 - RNA, 23 nt, Human
uucagggaaccguuauuauaauu

SEQ ID NO: 2632119 - RNA, 16 nt, Human
uucaggcucuucuccu

SEQ ID NO: 2632120 - RNA, 13 nt, Human
uucaggcugcuug

SEQ ID NO: 2632121 - RNA, 16 nt, Human
uucaggcugcuuggga

SEQ ID NO: 2632122 - RNA, 23 nt, Human
uucauaaugacuuaagcacacuu

SEQ ID NO: 2632123 - RNA, 13 nt, Human
uucauaaugacuu

SEQ ID NO: 2632124 - RNA, 15 nt, Human
uucaucuaggauuuu

SEQ ID NO: 2632125 - RNA, 23 nt, Human
uucaucuauuuuuggcagucuga

SEQ ID NO: 2632126 - RNA, 23 nt, Human
uucauaagccaauuuuucugcac

SEQ ID NO: 2632127 - RNA, 23 nt, Human
uucaucgaaucuacuaauuccac

SEQ ID NO: 2632128 - RNA, 19 nt, Human
uucaguuucaauucagugc

SEQ ID NO: 2632129 - RNA, 13 nt, Human
uucaguuuguaua

SEQ ID NO: 2632130 - RNA, 19 nt, Human
uucaguuuuaccagaugau

SEQ ID NO: 2632131 - RNA, 17 nt, Human
uucaguuuuaucuuuaa

SEQ ID NO: 2632132 - RNA, 12 nt, Human
uucaguuuucag

SEQ ID NO: 2632133 - RNA, 22 nt, Human
uucauaagccaauuuuucugca

SEQ ID NO: 2632134 - RNA, 14 nt, Human
uucauaagccaauu

SEQ ID NO: 2632135 - RNA, 12 nt, Human
uucauaaguauu

SEQ ID NO: 2632136 - RNA, 21 nt, Human
uucaguuuucauuugguucau

SEQ ID NO: 2632137 - RNA, 17 nt, Human
uucauaacuuucauuaa

SEQ ID NO: 2632138 - RNA, 19 nt, Human
uucauaaguauuaugucuc

SEQ ID NO: 2632139 - RNA, 20 nt, Human
uucauaaguauuaugucucu

SEQ ID NO: 2632140 - RNA, 17 nt, Human
uucauaaguauuucaaa

SEQ ID NO: 2632141 - RNA, 14 nt, Human
uucauaaucuuugc

SEQ ID NO: 2632142 - RNA, 13 nt, Human
uucaugaaauccu

SEQ ID NO: 2632143 - RNA, 22 nt, Human
uucaugaacuucgcaucaaaag

SEQ ID NO: 2632144 - RNA, 21 nt, Human
uucaugaacuucgcaucaaaa

SEQ ID NO: 2632145 - RNA, 12 nt, Human
uucaucuugaau

SEQ ID NO: 2632146 - RNA, 11 nt, Human
uucaucuugaa

SEQ ID NO: 2632147 - RNA, 20 nt, Human
uucaucuuccaacucaaacu

SEQ ID NO: 2632148 - RNA, 21 nt, Human
uucaucucucagaagggaggc

SEQ ID NO: 2632149 - RNA, 17 nt, Human
uucaucucucagaaggg

SEQ ID NO: 2632150 - RNA, 14 nt, Human
uucaucucucagaa

SEQ ID NO: 2632151 - RNA, 22 nt, Human
uucaucuccagggaguccccuc

SEQ ID NO: 2632152 - RNA, 15 nt, Human
uucaucuccagggag

SEQ ID NO: 2632153 - RNA, 22 nt, Human
uucaucucccaccuagcagcac

SEQ ID NO: 2632154 - RNA, 16 nt, Human
uucaucuauuucugag

SEQ ID NO: 2632155 - RNA, 17 nt, Human
uucaucuauuucugaga

SEQ ID NO: 2632156 - RNA, 14 nt, Human
uucaucuccaggga

SEQ ID NO: 2632157 - RNA, 18 nt, Human
uucaucuauuucugagaa

SEQ ID NO: 2632158 - RNA, 15 nt, Human
uucauuucauuguau

SEQ ID NO: 2632159 - RNA, 13 nt, Human
uucauuucauugu

SEQ ID NO: 2632160 - RNA, 12 nt, Human
uucauuucauug

SEQ ID NO: 2632161 - RNA, 13 nt, Human
uucauuuccucaa

SEQ ID NO: 2632162 - RNA, 16 nt, Human
uucauuuccucaaaaa

SEQ ID NO: 2632163 - RNA, 15 nt, Human
uucauuucaacuguu

SEQ ID NO: 2632164 - RNA, 22 nt, Human
uucauuugguucauuaauucua

SEQ ID NO: 2632165 - RNA, 16 nt, Human
uucauuuccuccguca

SEQ ID NO: 2632166 - RNA, 19 nt, Human
uucauuuggaaauaagcug

SEQ ID NO: 2632167 - RNA, 18 nt, Human
uucauuuuaacaucugag

SEQ ID NO: 2632168 - RNA, 21 nt, Human
uucauuuuaacaucugagaaa

SEQ ID NO: 2632169 - RNA, 15 nt, Human
uucauuugugucaau

SEQ ID NO: 2632170 - RNA, 13 nt, Human
uucauuuguguca

SEQ ID NO: 2632171 - RNA, 19 nt, Human
uucauuuagucaugugacc

SEQ ID NO: 2632172 - RNA, 19 nt, Human
uucauuuaggugaggaagc

SEQ ID NO: 2632173 - RNA, 17 nt, Human
uucaugauuucauuuca

SEQ ID NO: 2632174 - RNA, 23 nt, Human
uucaugacuuuuccauguaucua

SEQ ID NO: 2632175 - RNA, 16 nt, Human
uucaugaguuuuuccc

SEQ ID NO: 2632176 - RNA, 19 nt, Human
uuccauuuaucuuucuaca

SEQ ID NO: 2632177 - RNA, 13 nt, Human
uuccauuugcaag

SEQ ID NO: 2632178 - RNA, 21 nt, Human
uuccauuguuuggagacauuc

SEQ ID NO: 2632179 - RNA, 20 nt, Human
uuccauuguuuggagacauu

SEQ ID NO: 2632180 - RNA, 17 nt, Human
uuccauuugcaagggaa

SEQ ID NO: 2632181 - RNA, 14 nt, Human
uuccauuugugugu

SEQ ID NO: 2632182 - RNA, 21 nt, Human
uuccaugucgccucugcauuc

SEQ ID NO: 2632183 - RNA, 20 nt, Human
uuccaugucgccucugcauu

SEQ ID NO: 2632184 - RNA, 18 nt, Human
uuccauuguuuggagaca

SEQ ID NO: 2632185 - RNA, 22 nt, Human
uuccauuguuugaaacaaagaa

SEQ ID NO: 2632186 - RNA, 17 nt, Human
uuccauuguuugaaaca

SEQ ID NO: 2632187 - RNA, 15 nt, Human
uuccauuguuugaaa

SEQ ID NO: 2632188 - RNA, 16 nt, Human
uuccaugucggccucu

SEQ ID NO: 2632189 - RNA, 15 nt, Human
uuccaugucggccuc

SEQ ID NO: 2632190 - RNA, 13 nt, Human
uuccauuguguga

SEQ ID NO: 2632191 - RNA, 14 nt, Human
uuccccaagacauu

SEQ ID NO: 2632192 - RNA, 23 nt, Human
uuccccaacagugugaaguuaga

SEQ ID NO: 2632193 - RNA, 16 nt, Human
uuccccaacaguguga

SEQ ID NO: 2632194 - RNA, 15 nt, Human
uuccccaacagugug

SEQ ID NO: 2632195 - RNA, 13 nt, Human
uuccccaacagug

SEQ ID NO: 2632196 - RNA, 15 nt, Human
uuccccaaagucuua

SEQ ID NO: 2632197 - RNA, 20 nt, Human
uuccccaacagugugaaguu

SEQ ID NO: 2632198 - RNA, 19 nt, Human
uuccccaacagugugaagu

SEQ ID NO: 2632199 - RNA, 18 nt, Human
uuccccaaccacuucauu

SEQ ID NO: 2632200 - RNA, 11 nt, Human
uucccaaaagc

SEQ ID NO: 2632201 - RNA, 21 nt, Human
uucccaaaagcccauucauuc

SEQ ID NO: 2632202 - RNA, 16 nt, Human
uucccaaacgccuccc

SEQ ID NO: 2632203 - RNA, 14 nt, Human
uucccauuuugcaa

SEQ ID NO: 2632204 - RNA, 17 nt, Human
uucccauuuugcaaaau

SEQ ID NO: 2632205 - RNA, 19 nt, Human
uucccauuuugcaaaauuu

SEQ ID NO: 2632206 - RNA, 13 nt, Human
uucccauuuugga

SEQ ID NO: 2632207 - RNA, 13 nt, Human
uuccaugaugcug

SEQ ID NO: 2632208 - RNA, 17 nt, Human
uuccaugauucuauuua

SEQ ID NO: 2632209 - RNA, 13 nt, Human
uuccaugccugag

SEQ ID NO: 2632210 - RNA, 18 nt, Human
uuccaugaugcugggauu

SEQ ID NO: 2632211 - RNA, 18 nt, Human
uuccaugauucuauuuau

SEQ ID NO: 2632212 - RNA, 17 nt, Human
uuccaugaguccccugu

SEQ ID NO: 2632213 - RNA, 19 nt, Human
uuccaugucgccucugcau

SEQ ID NO: 2632214 - RNA, 18 nt, Human
uuccaugucgccucugca

SEQ ID NO: 2632215 - RNA, 14 nt, Human
uuccaugccugagg

SEQ ID NO: 2632216 - RNA, 16 nt, Human
uuccaugucgccucug

SEQ ID NO: 2632217 - RNA, 17 nt, Human
uuccaugucgccucugc

SEQ ID NO: 2632218 - RNA, 20 nt, Human
uuccaugaaucgcuucucuu

SEQ ID NO: 2632219 - RNA, 15 nt, Human
uuccaugaaucgcuu

SEQ ID NO: 2632220 - RNA, 12 nt, Human
uuccaugaaugu

SEQ ID NO: 2632221 - RNA, 20 nt, Human
uuccaugaaguuugaacuuc

SEQ ID NO: 2632222 - RNA, 18 nt, Human
uuccaugaagaccacauc

SEQ ID NO: 2632223 - RNA, 16 nt, Human
uuccaugaaggcagag

SEQ ID NO: 2632224 - RNA, 15 nt, Human
uuccaugaauguauc

SEQ ID NO: 2632225 - RNA, 20 nt, Human
uuccaugaauguaucaggaa

SEQ ID NO: 2632226 - RNA, 18 nt, Human
uuccaugagaacagcagg

SEQ ID NO: 2632227 - RNA, 13 nt, Human
uuccaucuuuaca

SEQ ID NO: 2632228 - RNA, 18 nt, Human
uuccaucuuuacaaaacu

SEQ ID NO: 2632229 - RNA, 12 nt, Human
uuccaucugauu

SEQ ID NO: 2632230 - RNA, 13 nt, Human
uuccaugaaaacg

SEQ ID NO: 2632231 - RNA, 15 nt, Human
uuccaugaaaacguu

SEQ ID NO: 2632232 - RNA, 22 nt, Human
uuccaugaaaacguuuuauugu

SEQ ID NO: 2632233 - RNA, 24 nt, Human
uuccaugaaaaugcaacaacaugu

SEQ ID NO: 2632234 - RNA, 15 nt, Human
uuccaugaaaaugca

SEQ ID NO: 2632235 - RNA, 17 nt, Human
uuccagccccucugguc

SEQ ID NO: 2632236 - RNA, 16 nt, Human
uuccagccccucuggu

SEQ ID NO: 2632237 - RNA, 20 nt, Human
uuccagccccucuggucgcu

SEQ ID NO: 2632238 - RNA, 21 nt, Human
uuccagccggcauggcuggga

SEQ ID NO: 2632239 - RNA, 12 nt, Human
uuccagccugcc

SEQ ID NO: 2632240 - RNA, 14 nt, Human
uuccagccugccac

SEQ ID NO: 2632241 - RNA, 14 nt, Human
uuccaucccagagg

SEQ ID NO: 2632242 - RNA, 23 nt, Human
uuccaucucgccaccccuccuuc

SEQ ID NO: 2632243 - RNA, 16 nt, Human
uuccagccugccacuc

SEQ ID NO: 2632244 - RNA, 15 nt, Human
uuccaucccuacccc

SEQ ID NO: 2632245 - RNA, 21 nt, Human
uuccaucccuacccccuaaga

SEQ ID NO: 2632246 - RNA, 16 nt, Human
uuccagccagggcugc

SEQ ID NO: 2632247 - RNA, 15 nt, Human
uuccagccagggcug

SEQ ID NO: 2632248 - RNA, 14 nt, Human
uuccagccccucug

SEQ ID NO: 2632249 - RNA, 12 nt, Human
uuccagccaggg

SEQ ID NO: 2632250 - RNA, 23 nt, Human
uuccacuuuguucuuuaggagau

SEQ ID NO: 2632251 - RNA, 23 nt, Human
uuccagcaauucuccugccucag

SEQ ID NO: 2632252 - RNA, 18 nt, Human
uuccagaaaaccccagca

SEQ ID NO: 2632253 - RNA, 21 nt, Human
uuccagaaaaccccagcaucc

SEQ ID NO: 2632254 - RNA, 15 nt, Human
uuccacuuuguucuu

SEQ ID NO: 2632255 - RNA, 19 nt, Human
uuccacuuggcuacacagg

SEQ ID NO: 2632256 - RNA, 12 nt, Human
uuccacuuggcu

SEQ ID NO: 2632257 - RNA, 18 nt, Human
uuccacuugauuuugcaa

SEQ ID NO: 2632258 - RNA, 17 nt, Human
uuccagaaaaccccagc

SEQ ID NO: 2632259 - RNA, 20 nt, Human
uuccacuuuuuuuuguaugu

SEQ ID NO: 2632260 - RNA, 19 nt, Human
uuccacuuauaggaauuga

SEQ ID NO: 2632261 - RNA, 21 nt, Human
uuccacuuagaaauugcauuu

SEQ ID NO: 2632262 - RNA, 20 nt, Human
uuccacugucaagaaagagc

SEQ ID NO: 2632263 - RNA, 17 nt, Human
uuccacugcguugucca

SEQ ID NO: 2632264 - RNA, 23 nt, Human
uuccacugccugggaugaugcag

SEQ ID NO: 2632265 - RNA, 16 nt, Human
uuccacugagggcagu

SEQ ID NO: 2632266 - RNA, 12 nt, Human
uuccacuggacu

SEQ ID NO: 2632267 - RNA, 22 nt, Human
uuccacuggacuugagcuuggc

SEQ ID NO: 2632268 - RNA, 14 nt, Human
uuccacugagcucc

SEQ ID NO: 2632269 - RNA, 13 nt, Human
uuccacugagcuc

SEQ ID NO: 2632270 - RNA, 12 nt, Human
uuccacugagcu

SEQ ID NO: 2632271 - RNA, 14 nt, Human
uucauuuuuaauca

SEQ ID NO: 2632272 - RNA, 20 nt, Human
uuccacugagcuccaugugc

SEQ ID NO: 2632273 - RNA, 15 nt, Human
uuccacugagcucca

SEQ ID NO: 2632274 - RNA, 15 nt, Human
uuccacugagggcag

SEQ ID NO: 2632275 - RNA, 17 nt, Human
uucauuuugagcugaaa

SEQ ID NO: 2632276 - RNA, 13 nt, Human
uucauuuugagcu

SEQ ID NO: 2632277 - RNA, 17 nt, Human
uucauuuugaaaaacac

SEQ ID NO: 2632278 - RNA, 18 nt, Human
uucauuuucugcaagccu

SEQ ID NO: 2632279 - RNA, 20 nt, Human
uucauuuugagcugaaaugc

SEQ ID NO: 2632280 - RNA, 19 nt, Human
uucauuuugagcugaaaug

SEQ ID NO: 2632281 - RNA, 14 nt, Human
uucauuuucugcaa

SEQ ID NO: 2632282 - RNA, 23 nt, Human
uucagcuccagcucaccagcccc

SEQ ID NO: 2632283 - RNA, 17 nt, Human
uucagagggaaaguaaa

SEQ ID NO: 2632284 - RNA, 17 nt, Human
uucagcucugcaagaau

SEQ ID NO: 2632285 - RNA, 24 nt, Human
uucagcucugcaagaauugaagca

SEQ ID NO: 2632286 - RNA, 16 nt, Human
uucaggaagcucaggg

SEQ ID NO: 2632287 - RNA, 13 nt, Human
uucagcugcccca

SEQ ID NO: 2632288 - RNA, 18 nt, Human
uucagcugcauacaguuu

SEQ ID NO: 2632289 - RNA, 17 nt, Human
uucagcugacuuuucug

SEQ ID NO: 2632290 - RNA, 20 nt, Human
uucaggcgauucuccugccu

SEQ ID NO: 2632291 - RNA, 15 nt, Human
uucaggcucuucucc

SEQ ID NO: 2632292 - RNA, 21 nt, Human
uucaggauacucugucagaug

SEQ ID NO: 2632293 - RNA, 17 nt, Human
uucaggagucccaagga

SEQ ID NO: 2632294 - RNA, 16 nt, Human
uucaggauacaugugc

SEQ ID NO: 2632295 - RNA, 17 nt, Human
uucaggauacucuguca

SEQ ID NO: 2632296 - RNA, 20 nt, Human
uucaggagagaguugaaccu

SEQ ID NO: 2632297 - RNA, 21 nt, Human
uucaggagagaguugaaccua

SEQ ID NO: 2632298 - RNA, 19 nt, Human
uucaggaauguguggccug

SEQ ID NO: 2632299 - RNA, 21 nt, Human
uucaggacuuaacggcuccag

SEQ ID NO: 2632300 - RNA, 22 nt, Human
uucaggagcagccucagaacaa

SEQ ID NO: 2632301 - RNA, 20 nt, Human
uucaggagcagccucagaac

SEQ ID NO: 2632302 - RNA, 16 nt, Human
uucaggagcagccuca

SEQ ID NO: 2632303 - RNA, 12 nt, Human
uucaggagggau

SEQ ID NO: 2632304 - RNA, 19 nt, Human
uucaggaagcucagggccu

SEQ ID NO: 2632305 - RNA, 17 nt, Human
uucaggaagcucagggc

SEQ ID NO: 2632306 - RNA, 20 nt, Human
uucaggaagcucagggccug

SEQ ID NO: 2632307 - RNA, 15 nt, Human
uucaggaagcucagg

SEQ ID NO: 2632308 - RNA, 22 nt, Human
uucagaggcccucgcugccagc

SEQ ID NO: 2632309 - RNA, 23 nt, Human
uucagaggcccucgcugccagcu

SEQ ID NO: 2632310 - RNA, 21 nt, Human
uucagagacucagggccccag

SEQ ID NO: 2632311 - RNA, 15 nt, Human
uucagagacuccugc

SEQ ID NO: 2632312 - RNA, 19 nt, Human
uucagacuuugcuucccau

SEQ ID NO: 2632313 - RNA, 14 nt, Human
uucagacucagacu

SEQ ID NO: 2632314 - RNA, 15 nt, Human
uucagagacucaggg

SEQ ID NO: 2632315 - RNA, 20 nt, Human
uucagagacucagggcccca

SEQ ID NO: 2632316 - RNA, 20 nt, Human
uucagacucccauuccugaa

SEQ ID NO: 2632317 - RNA, 21 nt, Human
uucagacucccauuccugaag

SEQ ID NO: 2632318 - RNA, 13 nt, Human
uucagaccccagc

SEQ ID NO: 2632319 - RNA, 15 nt, Human
uucagaccccagcgg

SEQ ID NO: 2632320 - RNA, 12 nt, Human
uucagacucaga

SEQ ID NO: 2632321 - RNA, 13 nt, Human
uucagacucagac

SEQ ID NO: 2632322 - RNA, 22 nt, Human
uucacugaagaaaccuucagau

SEQ ID NO: 2632323 - RNA, 16 nt, Human
uucacucuuccagaau

SEQ ID NO: 2632324 - RNA, 10 nt, Human
uucagacccc

SEQ ID NO: 2632325 - RNA, 18 nt, Human
uucacucuuggagccugc

SEQ ID NO: 2632326 - RNA, 19 nt, Human
uucacucuuggagccugca

SEQ ID NO: 2632327 - RNA, 15 nt, Human
uucacucuuccagaa

SEQ ID NO: 2632328 - RNA, 12 nt, Human
uucacucucuga

SEQ ID NO: 2632329 - RNA, 14 nt, Human
uucacucuuccaga

SEQ ID NO: 2632330 - RNA, 14 nt, Human
uucacucuuggagc

SEQ ID NO: 2632331 - RNA, 14 nt, Human
uucacucuccuugg

SEQ ID NO: 2632332 - RNA, 16 nt, Human
uucacccccuuuccug

SEQ ID NO: 2632333 - RNA, 12 nt, Human
uucaccccuccc

SEQ ID NO: 2632334 - RNA, 13 nt, Human
uucacucucugaa

SEQ ID NO: 2632335 - RNA, 22 nt, Human
uucaccccccacucaccagugu

SEQ ID NO: 2632336 - RNA, 23 nt, Human
uucaccccccacucaccaguguc

SEQ ID NO: 2632337 - RNA, 17 nt, Human
uucaccccccacucacc

SEQ ID NO: 2632338 - RNA, 21 nt, Human
uucaccccaguggccacucag

SEQ ID NO: 2632339 - RNA, 19 nt, Human
uucacccccuuuccuggac

SEQ ID NO: 2632340 - RNA, 17 nt, Human
uucaccccagggccuga

SEQ ID NO: 2632341 - RNA, 20 nt, Human
uucaccccagggccugagcc

SEQ ID NO: 2632342 - RNA, 22 nt, Human
uucaccccaguggccacucagc

SEQ ID NO: 2632343 - RNA, 22 nt, Human
uucaccccagggccugagccug

SEQ ID NO: 2632344 - RNA, 14 nt, Human
uucaauuccugggc

SEQ ID NO: 2632345 - RNA, 16 nt, Human
uucaauuccugggccc

SEQ ID NO: 2632346 - RNA, 13 nt, Human
uucaauucucaaa

SEQ ID NO: 2632347 - RNA, 15 nt, Human
uucacccagacagcu

SEQ ID NO: 2632348 - RNA, 13 nt, Human
uucaccccacccu

SEQ ID NO: 2632349 - RNA, 14 nt, Human
uucaccccacccuu

SEQ ID NO: 2632350 - RNA, 18 nt, Human
uucacccagcuaaucugu

SEQ ID NO: 2632351 - RNA, 17 nt, Human
uucaccccaaucccagc

SEQ ID NO: 2632352 - RNA, 15 nt, Human
uuacgugagccaggu

SEQ ID NO: 2632353 - RNA, 14 nt, Human
uuacgugaguccug

SEQ ID NO: 2632354 - RNA, 13 nt, Human
uuacgugaguccu

SEQ ID NO: 2632355 - RNA, 21 nt, Human
uuacuaaacauuuuguuauug

SEQ ID NO: 2632356 - RNA, 16 nt, Human
uuacuaaacauuuugu

SEQ ID NO: 2632357 - RNA, 13 nt, Human
uuacuaaacauuu

SEQ ID NO: 2632358 - RNA, 14 nt, Human
uuauuuucaguauu

SEQ ID NO: 2632359 - RNA, 12 nt, Human
uuauuuucagua

SEQ ID NO: 2632360 - RNA, 14 nt, Human
uuauuuucaccugu

SEQ ID NO: 2632361 - RNA, 18 nt, Human
uuacuaaagaaaauaucu

SEQ ID NO: 2632362 - RNA, 11 nt, Human
uuacuaaagaa

SEQ ID NO: 2632363 - RNA, 12 nt, Human
uuauuuucacug

SEQ ID NO: 2632364 - RNA, 12 nt, Human
uuauuuucuaca

SEQ ID NO: 2632365 - RNA, 16 nt, Human
uuauuuuccuccccag

SEQ ID NO: 2632366 - RNA, 13 nt, Human
uuauuuuccaaaa

SEQ ID NO: 2632367 - RNA, 14 nt, Human
uuauuuuccucccc

SEQ ID NO: 2632368 - RNA, 15 nt, Human
uuauuuuccucccca

SEQ ID NO: 2632369 - RNA, 13 nt, Human
uucaaagauauuu

SEQ ID NO: 2632370 - RNA, 15 nt, Human
uucaaagcaaauguc

SEQ ID NO: 2632371 - RNA, 11 nt, Human
uuauuuugaug

SEQ ID NO: 2632372 - RNA, 17 nt, Human
uuauuuucuuugaaauu

SEQ ID NO: 2632373 - RNA, 21 nt, Human
uuauuuucugguagauagaaa

SEQ ID NO: 2632374 - RNA, 19 nt, Human
uucaaagcaccaaaauaag

SEQ ID NO: 2632375 - RNA, 21 nt, Human
uucaaagcaccaaaauaagaa

SEQ ID NO: 2632376 - RNA, 23 nt, Human
uucaaagcaccaaaauaagaaaa

SEQ ID NO: 2632377 - RNA, 13 nt, Human
uucaaagccagcg

SEQ ID NO: 2632378 - RNA, 23 nt, Human
uucaaagccaaguuuauauacaa

SEQ ID NO: 2632379 - RNA, 13 nt, Human
uucaaauuucaca

SEQ ID NO: 2632380 - RNA, 23 nt, Human
uucaaauuguaagcaugcacaaa

SEQ ID NO: 2632381 - RNA, 17 nt, Human
uucaaagauucaaaauu

SEQ ID NO: 2632382 - RNA, 20 nt, Human
uucaaucucccgcugcugcu

SEQ ID NO: 2632383 - RNA, 14 nt, Human
uucaaucuguaaac

SEQ ID NO: 2632384 - RNA, 15 nt, Human
uucaaucuguaaacu

SEQ ID NO: 2632385 - RNA, 16 nt, Human
uucaaucccaggaugu

SEQ ID NO: 2632386 - RNA, 15 nt, Human
uucaacccuggagag

SEQ ID NO: 2632387 - RNA, 14 nt, Human
uucaacgcagcccu

SEQ ID NO: 2632388 - RNA, 13 nt, Human
uucaacccuggag

SEQ ID NO: 2632389 - RNA, 13 nt, Human
uucaacgcagccc

SEQ ID NO: 2632390 - RNA, 20 nt, Human
uucaaccauuccccauggga

SEQ ID NO: 2632391 - RNA, 17 nt, Human
uucaaccauuccccaug

SEQ ID NO: 2632392 - RNA, 16 nt, Human
uucaacaggagaauuu

SEQ ID NO: 2632393 - RNA, 23 nt, Human
uucaacagacccccucuagaaau

SEQ ID NO: 2632394 - RNA, 16 nt, Human
uucaaucuguaaacug

SEQ ID NO: 2632395 - RNA, 17 nt, Human
uucaaucuguaaacugu

SEQ ID NO: 2632396 - RNA, 18 nt, Human
uucaaucuguaaacugug

SEQ ID NO: 2632397 - RNA, 20 nt, Human
uucaaucuguaaacugugua

SEQ ID NO: 2632398 - RNA, 15 nt, Human
uucaaugaucuaggu

SEQ ID NO: 2632399 - RNA, 12 nt, Human
uucaaugaucua

SEQ ID NO: 2632400 - RNA, 16 nt, Human
uucaaugauaguaaga

SEQ ID NO: 2632401 - RNA, 16 nt, Human
uucaauggcugcugaa

SEQ ID NO: 2632402 - RNA, 22 nt, Human
uucaaugaucuagguuuaacuc

SEQ ID NO: 2632403 - RNA, 19 nt, Human
uucaaugaucuagguuuaa

SEQ ID NO: 2632404 - RNA, 22 nt, Human
uucaaugguuugcaaggaagcc

SEQ ID NO: 2632405 - RNA, 20 nt, Human
uucaaugguuugcaaggaag

SEQ ID NO: 2632406 - RNA, 21 nt, Human
uucaaugugauucuaaugucu

SEQ ID NO: 2632407 - RNA, 23 nt, Human
uucaaugaucuagguuuaacuca

SEQ ID NO: 2632408 - RNA, 23 nt, Human
uucaaugguuugcaaggaagcca

SEQ ID NO: 2632409 - RNA, 18 nt, Human
uucaauucucauuuguca

SEQ ID NO: 2632410 - RNA, 16 nt, Human
uucaauuccucuggga

SEQ ID NO: 2632411 - RNA, 13 nt, Human
uucaauuccuggg

SEQ ID NO: 2632412 - RNA, 12 nt, Human
uucaauuccucu

SEQ ID NO: 2632413 - RNA, 19 nt, Human
uucaauucagugcuguacu

SEQ ID NO: 2632414 - RNA, 17 nt, Human
uucaauucaacacuccc

SEQ ID NO: 2632415 - RNA, 13 nt, Human
uucaauucagugc

SEQ ID NO: 2632416 - RNA, 19 nt, Human
uucaauuaaacggauuauu

SEQ ID NO: 2632417 - RNA, 18 nt, Human
uucaauuaaacggauuau

SEQ ID NO: 2632418 - RNA, 16 nt, Human
uucaauuaaacggauu

SEQ ID NO: 2632419 - RNA, 15 nt, Human
uucaauuaaacggau

SEQ ID NO: 2632420 - RNA, 14 nt, Human
uucaauuaaacgga

SEQ ID NO: 2632421 - RNA, 12 nt, Human
uucaauuaaacg

SEQ ID NO: 2632422 - RNA, 11 nt, Human
uucaauuaaac

SEQ ID NO: 2632423 - RNA, 11 nt, Human
uuuuuucugag

SEQ ID NO: 2632424 - RNA, 12 nt, Human
uuuuuucugaau

SEQ ID NO: 2632425 - RNA, 11 nt, Human
uuuuuucuacc

SEQ ID NO: 2632426 - RNA, 16 nt, Human
uuuuuuaugcuaauca

SEQ ID NO: 2632427 - RNA, 20 nt, Human
uuuuuuauacacuguaauga

SEQ ID NO: 2632428 - RNA, 12 nt, Human
uuuuuucuaaga

SEQ ID NO: 2632429 - RNA, 15 nt, Human
uuuuuucuaagagaa

SEQ ID NO: 2632430 - RNA, 17 nt, Human
uuuuuuccuucagugcc

SEQ ID NO: 2632431 - RNA, 13 nt, Human
uuuuuuaugcuaa

SEQ ID NO: 2632432 - RNA, 16 nt, Human
uuuuuuagaucaaaua

SEQ ID NO: 2632433 - RNA, 15 nt, Human
uuuuuuauacacaua

SEQ ID NO: 2632434 - RNA, 12 nt, Human
uuuuuuacuaau

SEQ ID NO: 2632435 - RNA, 14 nt, Human
uuuuucuguuauau

SEQ ID NO: 2632436 - RNA, 23 nt, Human
uuuuucuuaaauaauaaagauca

SEQ ID NO: 2632437 - RNA, 20 nt, Human
uuuuuuauacaggaugauga

SEQ ID NO: 2632438 - RNA, 16 nt, Human
uuuuucuucuguauuu

SEQ ID NO: 2632439 - RNA, 23 nt, Human
uuuuuuagaaagcauuugaaugc

SEQ ID NO: 2632440 - RNA, 15 nt, Human
uuuuuuagaucaaau

SEQ ID NO: 2632441 - RNA, 14 nt, Human
uuuuucugcacuga

SEQ ID NO: 2632442 - RNA, 17 nt, Human
uuuuucugcacugagca

SEQ ID NO: 2632443 - RNA, 13 nt, Human
uuuuucugauugu

SEQ ID NO: 2632444 - RNA, 20 nt, Human
uuuugaaaucuguaucugua

SEQ ID NO: 2632445 - RNA, 23 nt, Human
uuuuucugcacugagcagagucu

SEQ ID NO: 2632446 - RNA, 22 nt, Human
uuuuucugcacugagcagaguc

SEQ ID NO: 2632447 - RNA, 14 nt, Human
uuuuucugcuuuug

SEQ ID NO: 2632448 - RNA, 17 nt, Human
uuuuucugcuuuugaaa

SEQ ID NO: 2632449 - RNA, 21 nt, Human
uuuuucuggagguugauaacu

SEQ ID NO: 2632450 - RNA, 21 nt, Human
uuuugaaaccaugaagagauu

SEQ ID NO: 2632451 - RNA, 22 nt, Human
uuuugaaauauuaaacccugga

SEQ ID NO: 2632452 - RNA, 23 nt, Human
uuuugaaaagcuauuagccagga

SEQ ID NO: 2632453 - RNA, 16 nt, Human
uuuugaaaagcuauua

SEQ ID NO: 2632454 - RNA, 15 nt, Human
uuuugaaaagcuauu

SEQ ID NO: 2632455 - RNA, 22 nt, Human
uuuugaaaaauuccuauuguga

SEQ ID NO: 2632456 - RNA, 21 nt, Human
uuuucuugccucuguccccuu

SEQ ID NO: 2632457 - RNA, 19 nt, Human
uuuucuugccucugucccc

SEQ ID NO: 2632458 - RNA, 18 nt, Human
uuuucuugccucuguccc

SEQ ID NO: 2632459 - RNA, 13 nt, Human
uuuugaaaaacug

SEQ ID NO: 2632460 - RNA, 18 nt, Human
uuuugaaaaauuccuauu

SEQ ID NO: 2632461 - RNA, 13 nt, Human
uuuucuuguaauu

SEQ ID NO: 2632462 - RNA, 21 nt, Human
uuuucuugccaaugaggucug

SEQ ID NO: 2632463 - RNA, 16 nt, Human
uuuaucgucacugcuu

SEQ ID NO: 2632464 - RNA, 16 nt, Human
uuuauaaacuuuaccu

SEQ ID NO: 2632465 - RNA, 21 nt, Human
uuuaucgucacugcuuaacuu

SEQ ID NO: 2632466 - RNA, 17 nt, Human
uuuauaaaccucuaauu

SEQ ID NO: 2632467 - RNA, 16 nt, Human
uuuauaaaccucuaau

SEQ ID NO: 2632468 - RNA, 20 nt, Human
uuuaucuaauaccucugugu

SEQ ID NO: 2632469 - RNA, 14 nt, Human
uuuauaaacuuuac

SEQ ID NO: 2632470 - RNA, 18 nt, Human
uuuagaguuagacuguug

SEQ ID NO: 2632471 - RNA, 13 nt, Human
uuuauaaaacuuc

SEQ ID NO: 2632472 - RNA, 23 nt, Human
uuuauaaaagaauaaaauugcac

SEQ ID NO: 2632473 - RNA, 14 nt, Human
uuuauaaaacuucu

SEQ ID NO: 2632474 - RNA, 17 nt, Human
uuuagaguuagacuguu

SEQ ID NO: 2632475 - RNA, 16 nt, Human
uuuagaguuagacugu

SEQ ID NO: 2632476 - RNA, 16 nt, Human
uuuagagcauugccau

SEQ ID NO: 2632477 - RNA, 18 nt, Human
uuuagaguagcaugagag

SEQ ID NO: 2632478 - RNA, 21 nt, Human
uuuaugaaaugguuaagaauu

SEQ ID NO: 2632479 - RNA, 18 nt, Human
uuuaugaagaaaaaauac

SEQ ID NO: 2632480 - RNA, 19 nt, Human
uuuaugaagaaaaaauaca

SEQ ID NO: 2632481 - RNA, 12 nt, Human
uuuaugaagaaa

SEQ ID NO: 2632482 - RNA, 22 nt, Human
uuuaugaagaaaaaauacauuu

SEQ ID NO: 2632483 - RNA, 22 nt, Human
uuuaugauacuugaaaauuaac

SEQ ID NO: 2632484 - RNA, 17 nt, Human
uuuaugaaggcaaaaaa

SEQ ID NO: 2632485 - RNA, 18 nt, Human
uuuaugauuuaauaaaau

SEQ ID NO: 2632486 - RNA, 14 nt, Human
uuuaugauuuaaua

SEQ ID NO: 2632487 - RNA, 12 nt, Human
uuuaugauuuaa

SEQ ID NO: 2632488 - RNA, 14 nt, Human
uuuaugauguauau

SEQ ID NO: 2632489 - RNA, 16 nt, Human
uuuaugcaaauauuuu

SEQ ID NO: 2632490 - RNA, 18 nt, Human
uuuaucuuuauaugaaga

SEQ ID NO: 2632491 - RNA, 12 nt, Human
uuuaucuuuaua

SEQ ID NO: 2632492 - RNA, 19 nt, Human
uuuaucuuugauucuccuu

SEQ ID NO: 2632493 - RNA, 18 nt, Human
uuuaucuuugauucuccu

SEQ ID NO: 2632494 - RNA, 19 nt, Human
uuuaugaaagguuuacauu

SEQ ID NO: 2632495 - RNA, 18 nt, Human
uuuaugaaagguuuacau

SEQ ID NO: 2632496 - RNA, 13 nt, Human
uuuaugaaaagag

SEQ ID NO: 2632497 - RNA, 22 nt, Human
uuuauuguaacagacauuguuu

SEQ ID NO: 2632498 - RNA, 20 nt, Human
uuuauuguaacagacauugu

SEQ ID NO: 2632499 - RNA, 13 nt, Human
uuuauuguauaaa

SEQ ID NO: 2632500 - RNA, 16 nt, Human
uuuauuguaacagaca

SEQ ID NO: 2632501 - RNA, 16 nt, Human
uuuauugucaaagugg

SEQ ID NO: 2632502 - RNA, 14 nt, Human
uuuauugucaaagu

SEQ ID NO: 2632503 - RNA, 19 nt, Human
uuuauuuaguuccuugagu

SEQ ID NO: 2632504 - RNA, 13 nt, Human
uuuauugugaucu

SEQ ID NO: 2632505 - RNA, 17 nt, Human
uuuauuguguuugucau

SEQ ID NO: 2632506 - RNA, 16 nt, Human
uuuauuguguuuguca

SEQ ID NO: 2632507 - RNA, 15 nt, Human
uuuauuuaucaguga

SEQ ID NO: 2632508 - RNA, 15 nt, Human
uuuauuuauacuauu

SEQ ID NO: 2632509 - RNA, 22 nt, Human
uuuauuguguuugucauuagcc

SEQ ID NO: 2632510 - RNA, 21 nt, Human
uuuauuguguuugucauuagc

SEQ ID NO: 2632511 - RNA, 17 nt, Human
uuuauuuauacacuguc

SEQ ID NO: 2632512 - RNA, 20 nt, Human
uuuauuguuaacucuugucu

SEQ ID NO: 2632513 - RNA, 17 nt, Human
uuuauuguguuuuuaau

SEQ ID NO: 2632514 - RNA, 14 nt, Human
uuuaugcauauuau

SEQ ID NO: 2632515 - RNA, 15 nt, Human
uuuaugcaaggaagg

SEQ ID NO: 2632516 - RNA, 17 nt, Human
uuuaugcaaggaaggaa

SEQ ID NO: 2632517 - RNA, 18 nt, Human
uuuaugcaaggaaggaaa

SEQ ID NO: 2632518 - RNA, 17 nt, Human
uuuauucaaguuauugu

SEQ ID NO: 2632519 - RNA, 17 nt, Human
uuuauuauuuucaccug

SEQ ID NO: 2632520 - RNA, 22 nt, Human
uuuauucagcuucauuuguguc

SEQ ID NO: 2632521 - RNA, 21 nt, Human
uuuauucagcuucauuugugu

SEQ ID NO: 2632522 - RNA, 19 nt, Human
uuuauucagcuucauuugu

SEQ ID NO: 2632523 - RNA, 17 nt, Human
uuuauucagcuucauuu

SEQ ID NO: 2632524 - RNA, 13 nt, Human
uuuauucaauaaa

SEQ ID NO: 2632525 - RNA, 17 nt, Human
uuuauucaauuccucug

SEQ ID NO: 2632526 - RNA, 18 nt, Human
uuuauuccagaaugcugu

SEQ ID NO: 2632527 - RNA, 19 nt, Human
uuuauuccagaaugcugua

SEQ ID NO: 2632528 - RNA, 22 nt, Human
uuuauuccagaaugcuguacau

SEQ ID NO: 2632529 - RNA, 23 nt, Human
uuuauuccagaaugcuguacauc

SEQ ID NO: 2632530 - RNA, 23 nt, Human
uuuauugcaucuggguagcugua

SEQ ID NO: 2632531 - RNA, 24 nt, Human
uuuauugcaucuggguagcuguaa

SEQ ID NO: 2632532 - RNA, 17 nt, Human
uuuauugcuugauacuu

SEQ ID NO: 2632533 - RNA, 16 nt, Human
uuuauuggcugagaua

SEQ ID NO: 2632534 - RNA, 14 nt, Human
uuuauugcuuuaua

SEQ ID NO: 2632535 - RNA, 13 nt, Human
uuuauugcuuguu

SEQ ID NO: 2632536 - RNA, 12 nt, Human
uuuagaaacaca

SEQ ID NO: 2632537 - RNA, 16 nt, Human
uuuacuuuuaaacugu

SEQ ID NO: 2632538 - RNA, 16 nt, Human
uuuacuuuuaaauguc

SEQ ID NO: 2632539 - RNA, 19 nt, Human
uuuacaugggguuuucaau

SEQ ID NO: 2632540 - RNA, 18 nt, Human
uuuacuuuuaaacaguga

SEQ ID NO: 2632541 - RNA, 15 nt, Human
uuuacuuuuaaacug

SEQ ID NO: 2632542 - RNA, 15 nt, Human
uuuacuuuuaaacag

SEQ ID NO: 2632543 - RNA, 13 nt, Human
uuuacuuugaauu

SEQ ID NO: 2632544 - RNA, 15 nt, Human
uuuacauuguaaaua

SEQ ID NO: 2632545 - RNA, 20 nt, Human
uuuacauuguaaauaguauu

SEQ ID NO: 2632546 - RNA, 15 nt, Human
uuuacuuuguguuca

SEQ ID NO: 2632547 - RNA, 13 nt, Human
uuuacauuguaaa

SEQ ID NO: 2632548 - RNA, 15 nt, Human
uuuacauguaguagu

SEQ ID NO: 2632549 - RNA, 19 nt, Human
uuuacaauuuacaaagugu

SEQ ID NO: 2632550 - RNA, 18 nt, Human
uuuacaugggguuuucaa

SEQ ID NO: 2632551 - RNA, 20 nt, Human
uuuagacuuaauagaaacau

SEQ ID NO: 2632552 - RNA, 18 nt, Human
uuuagagaacuguggccg

SEQ ID NO: 2632553 - RNA, 15 nt, Human
uuuagagaggaaaag

SEQ ID NO: 2632554 - RNA, 21 nt, Human
uuuagagaugaauuaaauuua

SEQ ID NO: 2632555 - RNA, 19 nt, Human
uuuagaagaagugugucac

SEQ ID NO: 2632556 - RNA, 15 nt, Human
uuuagaagacucuac

SEQ ID NO: 2632557 - RNA, 14 nt, Human
uuuagaagacucua

SEQ ID NO: 2632558 - RNA, 17 nt, Human
uuuagaagaaguguguc

SEQ ID NO: 2632559 - RNA, 20 nt, Human
uuuagaaacacaacuauauu

SEQ ID NO: 2632560 - RNA, 20 nt, Human
uuguauuuauucaauaaagu

SEQ ID NO: 2632561 - RNA, 16 nt, Human
uuguauuuauucaaua

SEQ ID NO: 2632562 - RNA, 15 nt, Human
uuguauuuauucaau

SEQ ID NO: 2632563 - RNA, 14 nt, Human
uuguauuuauucaa

SEQ ID NO: 2632564 - RNA, 16 nt, Human
uuguauuguuucaauu

SEQ ID NO: 2632565 - RNA, 12 nt, Human
uuuaaucaugaa

SEQ ID NO: 2632566 - RNA, 20 nt, Human
uuguauuuuacuaauaaaau

SEQ ID NO: 2632567 - RNA, 15 nt, Human
uuguauuuauuuagu

SEQ ID NO: 2632568 - RNA, 18 nt, Human
uuguauuuauuccauauu

SEQ ID NO: 2632569 - RNA, 14 nt, Human
uuguauuuuaacuc

SEQ ID NO: 2632570 - RNA, 20 nt, Human
uuguauucucugagcugugc

SEQ ID NO: 2632571 - RNA, 22 nt, Human
uuguauucucugagcugugcag

SEQ ID NO: 2632572 - RNA, 17 nt, Human
uuguauucuuugauguu

SEQ ID NO: 2632573 - RNA, 13 nt, Human
uuguauucuuuga

SEQ ID NO: 2632574 - RNA, 15 nt, Human
uuguauucucugagc

SEQ ID NO: 2632575 - RNA, 16 nt, Human
uuguauucucugagcu

SEQ ID NO: 2632576 - RNA, 14 nt, Human
uuguauucucugag

SEQ ID NO: 2632577 - RNA, 19 nt, Human
uuguauucuuugauguuaa

SEQ ID NO: 2632578 - RNA, 18 nt, Human
uuguauucuuugauguua

SEQ ID NO: 2632579 - RNA, 15 nt, Human
uuguauuguuucaau

SEQ ID NO: 2632580 - RNA, 19 nt, Human
uuuacaauuuuuuaucaug

SEQ ID NO: 2632581 - RNA, 15 nt, Human
uuuacaauugaaaug

SEQ ID NO: 2632582 - RNA, 16 nt, Human
uuuacaauugaaauga

SEQ ID NO: 2632583 - RNA, 18 nt, Human
uuuacaauuuacaaagug

SEQ ID NO: 2632584 - RNA, 23 nt, Human
uuuacaauuguaaaacugaggca

SEQ ID NO: 2632585 - RNA, 16 nt, Human
uuuacaauaaauaauc

SEQ ID NO: 2632586 - RNA, 21 nt, Human
uuuacaaucagccacauucua

SEQ ID NO: 2632587 - RNA, 21 nt, Human
uuuacaaguguauaucagaaa

SEQ ID NO: 2632588 - RNA, 15 nt, Human
uuuacaaguguauau

SEQ ID NO: 2632589 - RNA, 21 nt, Human
uuuacaagcccccccuuccac

SEQ ID NO: 2632590 - RNA, 15 nt, Human
uuuacaagccccccc

SEQ ID NO: 2632591 - RNA, 15 nt, Human
uuuaaucauugccug

SEQ ID NO: 2632592 - RNA, 14 nt, Human
uuuaaucauugccu

SEQ ID NO: 2632593 - RNA, 24 nt, Human
uuuaaucaugaaauuacuuaucau

SEQ ID NO: 2632594 - RNA, 19 nt, Human
uuuaaucaugaaauuacuu

SEQ ID NO: 2632595 - RNA, 14 nt, Human
uuuaaucaugaaau

SEQ ID NO: 2632596 - RNA, 13 nt, Human
uuuaaucaugaaa

SEQ ID NO: 2632597 - RNA, 22 nt, Human
uuuaauccccaguaaaauugcc

SEQ ID NO: 2632598 - RNA, 16 nt, Human
uuuaauccccaguaaa

SEQ ID NO: 2632599 - RNA, 15 nt, Human
uuuaauccccaguaa

SEQ ID NO: 2632600 - RNA, 21 nt, Human
uuuaauccagaauugaccuuu

SEQ ID NO: 2632601 - RNA, 19 nt, Human
uuuacaagaaaaaaugaau

SEQ ID NO: 2632602 - RNA, 21 nt, Human
uuuacaagaaaaaaugaauuu

SEQ ID NO: 2632603 - RNA, 12 nt, Human
uuuacaagaaaa

SEQ ID NO: 2632604 - RNA, 13 nt, Human
uuuaaucuucagu

SEQ ID NO: 2632605 - RNA, 23 nt, Human
uuuaauccuucuaguuucccaca

SEQ ID NO: 2632606 - RNA, 21 nt, Human
uuuaauccuucuaguuuccca

SEQ ID NO: 2632607 - RNA, 14 nt, Human
uuuaauccagaauu

SEQ ID NO: 2632608 - RNA, 24 nt, Human
uuucuccccugcccccaggacugg

SEQ ID NO: 2632609 - RNA, 23 nt, Human
uuucuccccugcccccaggacug

SEQ ID NO: 2632610 - RNA, 20 nt, Human
uuucuccccugcccccagga

SEQ ID NO: 2632611 - RNA, 22 nt, Human
uuucuccccugcccccaggacu

SEQ ID NO: 2632612 - RNA, 22 nt, Human
uuucuaggaagaauuuuaaaaa

SEQ ID NO: 2632613 - RNA, 21 nt, Human
uuucuaggaagaauuuuaaaa

SEQ ID NO: 2632614 - RNA, 16 nt, Human
uuucuaggaagaauuu

SEQ ID NO: 2632615 - RNA, 14 nt, Human
uuucuaggaagaau

SEQ ID NO: 2632616 - RNA, 21 nt, Human
uuucucccucucacugucuga

SEQ ID NO: 2632617 - RNA, 20 nt, Human
uuucucccucucacugucug

SEQ ID NO: 2632618 - RNA, 13 nt, Human
uuucucccucuca

SEQ ID NO: 2632619 - RNA, 17 nt, Human
uuucucccuaaacugua

SEQ ID NO: 2632620 - RNA, 13 nt, Human
uuucucccucugg

SEQ ID NO: 2632621 - RNA, 22 nt, Human
uuucucccucucacugucugag

SEQ ID NO: 2632622 - RNA, 15 nt, Human
uuucuccucccagga

SEQ ID NO: 2632623 - RNA, 14 nt, Human
uuucuccuccaugg

SEQ ID NO: 2632624 - RNA, 15 nt, Human
uuucuagccagagga

SEQ ID NO: 2632625 - RNA, 14 nt, Human
uuucuaaugagaua

SEQ ID NO: 2632626 - RNA, 13 nt, Human
uuucuaauguggu

SEQ ID NO: 2632627 - RNA, 16 nt, Human
uuucuagauuaagaua

SEQ ID NO: 2632628 - RNA, 19 nt, Human
uuucuagcccgaauacaaa

SEQ ID NO: 2632629 - RNA, 21 nt, Human
uuucuagcuguugagcuguuu

SEQ ID NO: 2632630 - RNA, 19 nt, Human
uuucuagcuguugagcugu

SEQ ID NO: 2632631 - RNA, 22 nt, Human
uuucuagcuagaaauaugauuu

SEQ ID NO: 2632632 - RNA, 20 nt, Human
uuucuagcuagaaauaugau

SEQ ID NO: 2632633 - RNA, 20 nt, Human
uuucuagcccgaauacaaac

SEQ ID NO: 2632634 - RNA, 19 nt, Human
uuucuagcuagaaauauga

SEQ ID NO: 2632635 - RNA, 16 nt, Human
uuucucuucauacuuu

SEQ ID NO: 2632636 - RNA, 13 nt, Human
uuucucuugggcu

SEQ ID NO: 2632637 - RNA, 21 nt, Human
uuucucuugggcugagacugg

SEQ ID NO: 2632638 - RNA, 12 nt, Human
uuucucuugggc

SEQ ID NO: 2632639 - RNA, 18 nt, Human
uuucucuguguuuguucc

SEQ ID NO: 2632640 - RNA, 17 nt, Human
uuucucuguguuuguuc

SEQ ID NO: 2632641 - RNA, 17 nt, Human
uuucucuuacugcaaau

SEQ ID NO: 2632642 - RNA, 17 nt, Human
uuucucuguauaguacu

SEQ ID NO: 2632643 - RNA, 16 nt, Human
uuucuccucccuuccu

SEQ ID NO: 2632644 - RNA, 15 nt, Human
uuucuccucccuucc

SEQ ID NO: 2632645 - RNA, 19 nt, Human
uuucuccuuagucuucuca

SEQ ID NO: 2632646 - RNA, 20 nt, Human
uuucuccuuagucuucucau

SEQ ID NO: 2632647 - RNA, 22 nt, Human
uuucugagaaagacuauucaaa

SEQ ID NO: 2632648 - RNA, 15 nt, Human
uuucugagcccgggc

SEQ ID NO: 2632649 - RNA, 12 nt, Human
uuucugagcccg

SEQ ID NO: 2632650 - RNA, 11 nt, Human
uuucugagccc

SEQ ID NO: 2632651 - RNA, 16 nt, Human
uuucugagcacacuuu

SEQ ID NO: 2632652 - RNA, 16 nt, Human
uuucugagaagguccu

SEQ ID NO: 2632653 - RNA, 19 nt, Human
uuucugagaagguccuuaa

SEQ ID NO: 2632654 - RNA, 14 nt, Human
uuucucuuucuccu

SEQ ID NO: 2632655 - RNA, 16 nt, Human
uuucucuuucucuccu

SEQ ID NO: 2632656 - RNA, 12 nt, Human
uuucucuuucuc

SEQ ID NO: 2632657 - RNA, 17 nt, Human
uuucuaaagcugccagc

SEQ ID NO: 2632658 - RNA, 14 nt, Human
uuucuaaagcugcc

SEQ ID NO: 2632659 - RNA, 14 nt, Human
uuucuaaaggcuac

SEQ ID NO: 2632660 - RNA, 20 nt, Human
uuuccugagaccacagagag

SEQ ID NO: 2632661 - RNA, 13 nt, Human
uuuccugagcuug

SEQ ID NO: 2632662 - RNA, 18 nt, Human
uuuccugagcuuggccag

SEQ ID NO: 2632663 - RNA, 18 nt, Human
uuucuaaaggcuaccuuu

SEQ ID NO: 2632664 - RNA, 19 nt, Human
uuucuaaaggccucuuccu

SEQ ID NO: 2632665 - RNA, 16 nt, Human
uuucuaagagaaguua

SEQ ID NO: 2632666 - RNA, 11 nt, Human
uuucuaagaga

SEQ ID NO: 2632667 - RNA, 13 nt, Human
uuucuaagagaag

SEQ ID NO: 2632668 - RNA, 17 nt, Human
uuuccuagcccucucac

SEQ ID NO: 2632669 - RNA, 21 nt, Human
uuuccuagcacacacuuuugg

SEQ ID NO: 2632670 - RNA, 23 nt, Human
uuuccuagcccucucacauuuau

SEQ ID NO: 2632671 - RNA, 21 nt, Human
uuuccuaguucuguagaaaug

SEQ ID NO: 2632672 - RNA, 23 nt, Human
uuuccuagauggcagucacugaa

SEQ ID NO: 2632673 - RNA, 15 nt, Human
uuuccaggcugguuc

SEQ ID NO: 2632674 - RNA, 22 nt, Human
uuuccaggcugguucggauuug

SEQ ID NO: 2632675 - RNA, 24 nt, Human
uuuccuacucucaggaucaagaaa

SEQ ID NO: 2632676 - RNA, 18 nt, Human
uuuccuagcacacacuuu

SEQ ID NO: 2632677 - RNA, 21 nt, Human
uuuccucuuuggucuacacug

SEQ ID NO: 2632678 - RNA, 21 nt, Human
uuuccugaaacaacuuggaaa

SEQ ID NO: 2632679 - RNA, 23 nt, Human
uuuccugacagaaggacucaggu

SEQ ID NO: 2632680 - RNA, 22 nt, Human
uuuccucaaaacuucagacaua

SEQ ID NO: 2632681 - RNA, 21 nt, Human
uuuccucuucuauuuuguaaa

SEQ ID NO: 2632682 - RNA, 22 nt, Human
uuuccucuucuauuuuguaaac

SEQ ID NO: 2632683 - RNA, 22 nt, Human
uuucagggcuaacgaccacagg

SEQ ID NO: 2632684 - RNA, 21 nt, Human
uuucaggggucgucaccaccu

SEQ ID NO: 2632685 - RNA, 22 nt, Human
uuucagggagguggcuggguuu

SEQ ID NO: 2632686 - RNA, 19 nt, Human
uuucagggagguggcuggg

SEQ ID NO: 2632687 - RNA, 22 nt, Human
uuucauugcugggcuugucugu

SEQ ID NO: 2632688 - RNA, 13 nt, Human
uuucauucuucuc

SEQ ID NO: 2632689 - RNA, 15 nt, Human
uuucauucuccugcc

SEQ ID NO: 2632690 - RNA, 22 nt, Human
uuucauugacuaucaaacugaa

SEQ ID NO: 2632691 - RNA, 21 nt, Human
uuucauugauaugaaaaauau

SEQ ID NO: 2632692 - RNA, 22 nt, Human
uuucauugauaugaaaaauaug

SEQ ID NO: 2632693 - RNA, 17 nt, Human
uuucaggagcagccuca

SEQ ID NO: 2632694 - RNA, 16 nt, Human
uuucaggaccuuuuga

SEQ ID NO: 2632695 - RNA, 20 nt, Human
uuucagcuucugcugggcug

SEQ ID NO: 2632696 - RNA, 19 nt, Human
uuucagcuucugcugggcu

SEQ ID NO: 2632697 - RNA, 22 nt, Human
uuucaggagagaguugaaccua

SEQ ID NO: 2632698 - RNA, 13 nt, Human
uuucaggauacuc

SEQ ID NO: 2632699 - RNA, 16 nt, Human
uuucaggauacucugu

SEQ ID NO: 2632700 - RNA, 19 nt, Human
uuucaggauacucugucag

SEQ ID NO: 2632701 - RNA, 20 nt, Human
uuucaggauacucugucaga

SEQ ID NO: 2632702 - RNA, 21 nt, Human
uuucaggauacucugucagau

SEQ ID NO: 2632703 - RNA, 15 nt, Human
uuucagccaagaauu

SEQ ID NO: 2632704 - RNA, 16 nt, Human
uuucagccaagaauuc

SEQ ID NO: 2632705 - RNA, 21 nt, Human
uuucagcugugaacauggacu

SEQ ID NO: 2632706 - RNA, 14 nt, Human
uuucagcuucugcu

SEQ ID NO: 2632707 - RNA, 13 nt, Human
uuuccaggaaggc

SEQ ID NO: 2632708 - RNA, 19 nt, Human
uuuccagaggcuauuauuu

SEQ ID NO: 2632709 - RNA, 18 nt, Human
uuuccagacuuccuugag

SEQ ID NO: 2632710 - RNA, 19 nt, Human
uuuccagacuuccuugaga

SEQ ID NO: 2632711 - RNA, 23 nt, Human
uuuccacuuuguucuuuaggaga

SEQ ID NO: 2632712 - RNA, 13 nt, Human
uuuccaaaggcau

SEQ ID NO: 2632713 - RNA, 15 nt, Human
uuuccaaauaaaaug

SEQ ID NO: 2632714 - RNA, 14 nt, Human
uuuccaaaggcauu

SEQ ID NO: 2632715 - RNA, 15 nt, Human
uuuccaaauucacaa

SEQ ID NO: 2632716 - RNA, 12 nt, Human
uuuccaaaguac

SEQ ID NO: 2632717 - RNA, 15 nt, Human
uuuccaaaguacacu

SEQ ID NO: 2632718 - RNA, 14 nt, Human
uuuccaaaauaauu

SEQ ID NO: 2632719 - RNA, 17 nt, Human
uuucauuguaugaugug

SEQ ID NO: 2632720 - RNA, 24 nt, Human
uuuccaaaaguggccucuuugucu

SEQ ID NO: 2632721 - RNA, 16 nt, Human
uuucauuguaugaugu

SEQ ID NO: 2632722 - RNA, 15 nt, Human
uuucauuguaugaug

SEQ ID NO: 2632723 - RNA, 14 nt, Human
uuucauuguaaaac

SEQ ID NO: 2632724 - RNA, 15 nt, Human
uuucagcagcugcag

SEQ ID NO: 2632725 - RNA, 21 nt, Human
uuucagauaaucacaauacau

SEQ ID NO: 2632726 - RNA, 18 nt, Human
uuucagauaacuguuauu

SEQ ID NO: 2632727 - RNA, 21 nt, Human
uuucagacucccauuccugaa

SEQ ID NO: 2632728 - RNA, 17 nt, Human
uuucaauauuuuccuuc

SEQ ID NO: 2632729 - RNA, 15 nt, Human
uuucagauaaucaca

SEQ ID NO: 2632730 - RNA, 17 nt, Human
uuucagagaccauugca

SEQ ID NO: 2632731 - RNA, 16 nt, Human
uuucagagaccauugc

SEQ ID NO: 2632732 - RNA, 16 nt, Human
uuuauuucugcauaug

SEQ ID NO: 2632733 - RNA, 13 nt, Human
uuuauuuccagug

SEQ ID NO: 2632734 - RNA, 15 nt, Human
uuuauuuauuuuauc

SEQ ID NO: 2632735 - RNA, 13 nt, Human
uuuauuuauuuau

SEQ ID NO: 2632736 - RNA, 14 nt, Human
uuuauuuauuuaca

SEQ ID NO: 2632737 - RNA, 14 nt, Human
uuuauuuaucagug

SEQ ID NO: 2632738 - RNA, 14 nt, Human
uuuauuuauuaaga

SEQ ID NO: 2632739 - RNA, 22 nt, Human
uuucaauaggaaaaacugauuu

SEQ ID NO: 2632740 - RNA, 20 nt, Human
uuucaauaggaaaaacugau

SEQ ID NO: 2632741 - RNA, 21 nt, Human
uuuauuuuaaaacagaagaau

SEQ ID NO: 2632742 - RNA, 20 nt, Human
uuuauuuguuugugcauuug

SEQ ID NO: 2632743 - RNA, 13 nt, Human
uuuauuucuuaaa

SEQ ID NO: 2632744 - RNA, 22 nt, Human
uuugucagaacuagaauuugau

SEQ ID NO: 2632745 - RNA, 20 nt, Human
uuugucagaacuagaauuug

SEQ ID NO: 2632746 - RNA, 14 nt, Human
uuugucagacuuua

SEQ ID NO: 2632747 - RNA, 23 nt, Human
uuugucacaauccuaacacauua

SEQ ID NO: 2632748 - RNA, 17 nt, Human
uuugucaaugacaguuu

SEQ ID NO: 2632749 - RNA, 14 nt, Human
uuugucaaacugua

SEQ ID NO: 2632750 - RNA, 16 nt, Human
uuugucaaacuguaga

SEQ ID NO: 2632751 - RNA, 17 nt, Human
uuugucaaacuguagaa

SEQ ID NO: 2632752 - RNA, 23 nt, Human
uuugucaaacuguagaaaugaug

SEQ ID NO: 2632753 - RNA, 11 nt, Human
uuugucaauga

SEQ ID NO: 2632754 - RNA, 21 nt, Human
uuuguauaaaauaauuuuuau

SEQ ID NO: 2632755 - RNA, 22 nt, Human
uuuguaaauuaacuuuuauaaa

SEQ ID NO: 2632756 - RNA, 20 nt, Human
uuuguauaauuguaucguau

SEQ ID NO: 2632757 - RNA, 18 nt, Human
uuuguauaauuguaucgu

SEQ ID NO: 2632758 - RNA, 17 nt, Human
uuuguauaauuguaucg

SEQ ID NO: 2632759 - RNA, 16 nt, Human
uuuguauaauuguauc

SEQ ID NO: 2632760 - RNA, 13 nt, Human
uuuguauaauugu

SEQ ID NO: 2632761 - RNA, 19 nt, Human
uuuguauaacuucuuaaaa

SEQ ID NO: 2632762 - RNA, 18 nt, Human
uuuguauaacuucuuaaa

SEQ ID NO: 2632763 - RNA, 16 nt, Human
uuuguaaauuaacuuu

SEQ ID NO: 2632764 - RNA, 17 nt, Human
uuuguaaauuaacuuuu

SEQ ID NO: 2632765 - RNA, 15 nt, Human
uuuguaaauuaacuu

SEQ ID NO: 2632766 - RNA, 22 nt, Human
uuugguuaagucuguuuuauga

SEQ ID NO: 2632767 - RNA, 15 nt, Human
uuuggaauacuuuuu

SEQ ID NO: 2632768 - RNA, 17 nt, Human
uuuggaauacuuuuugu

SEQ ID NO: 2632769 - RNA, 19 nt, Human
uuuggugguuucagaaaug

SEQ ID NO: 2632770 - RNA, 16 nt, Human
uuuggaauacauuucu

SEQ ID NO: 2632771 - RNA, 13 nt, Human
uuuggaauacuuu

SEQ ID NO: 2632772 - RNA, 13 nt, Human
uuuggaauaaagu

SEQ ID NO: 2632773 - RNA, 14 nt, Human
uuuggaaguuuuca

SEQ ID NO: 2632774 - RNA, 13 nt, Human
uuugguguguucc

SEQ ID NO: 2632775 - RNA, 12 nt, Human
uuugguguguuc

SEQ ID NO: 2632776 - RNA, 19 nt, Human
uuugguguguggagaugca

SEQ ID NO: 2632777 - RNA, 19 nt, Human
uuugguuaagucuguuuua

SEQ ID NO: 2632778 - RNA, 20 nt, Human
uuugguuaagucuguuuuau

SEQ ID NO: 2632779 - RNA, 18 nt, Human
uuugguuaagucuguuuu

SEQ ID NO: 2632780 - RNA, 14 nt, Human
uuugguguguuccc

SEQ ID NO: 2632781 - RNA, 21 nt, Human
uuuguccccaccgcagacagg

SEQ ID NO: 2632782 - RNA, 13 nt, Human
uuuguccccaccg

SEQ ID NO: 2632783 - RNA, 23 nt, Human
uuugucauuagccugaguagaaa

SEQ ID NO: 2632784 - RNA, 20 nt, Human
uuugucauuagccugaguag

SEQ ID NO: 2632785 - RNA, 21 nt, Human
uuugucaugaauucuuaugcu

SEQ ID NO: 2632786 - RNA, 17 nt, Human
uuugucaucagccacca

SEQ ID NO: 2632787 - RNA, 17 nt, Human
uuuguccuaaaacaccu

SEQ ID NO: 2632788 - RNA, 12 nt, Human
uuugucccaggu

SEQ ID NO: 2632789 - RNA, 19 nt, Human
uuuguguguugucuugaaa

SEQ ID NO: 2632790 - RNA, 22 nt, Human
uuuguguuucagccauguauuu

SEQ ID NO: 2632791 - RNA, 21 nt, Human
uuuguguuguuggaaaaaguc

SEQ ID NO: 2632792 - RNA, 20 nt, Human
uuuguguuguuggaaaaagu

SEQ ID NO: 2632793 - RNA, 16 nt, Human
uuuguuauuuugcaac

SEQ ID NO: 2632794 - RNA, 18 nt, Human
uuuguuaaauauuuacau

SEQ ID NO: 2632795 - RNA, 22 nt, Human
uuuguuaaauauuuacauauga

SEQ ID NO: 2632796 - RNA, 17 nt, Human
uuuguuaaauauuuaca

SEQ ID NO: 2632797 - RNA, 15 nt, Human
uuuguuauuuugcaa

SEQ ID NO: 2632798 - RNA, 13 nt, Human
uuuguucaucugu

SEQ ID NO: 2632799 - RNA, 12 nt, Human
uuuguucaucug

SEQ ID NO: 2632800 - RNA, 18 nt, Human
uuuguuccccuccuccac

SEQ ID NO: 2632801 - RNA, 16 nt, Human
uuuguuccccuccucc

SEQ ID NO: 2632802 - RNA, 16 nt, Human
uuuguugucagcugaa

SEQ ID NO: 2632803 - RNA, 15 nt, Human
uuuguuccccuccuc

SEQ ID NO: 2632804 - RNA, 13 nt, Human
uuuguuccccucc

SEQ ID NO: 2632805 - RNA, 12 nt, Human
uuuguuccccuc

SEQ ID NO: 2632806 - RNA, 17 nt, Human
uuugaggucuguucuuu

SEQ ID NO: 2632807 - RNA, 22 nt, Human
uuugaggucuguucuuuccaaa

SEQ ID NO: 2632808 - RNA, 14 nt, Human
uuugagcucagccc

SEQ ID NO: 2632809 - RNA, 20 nt, Human
uuugagcucugcagcccagg

SEQ ID NO: 2632810 - RNA, 14 nt, Human
uuugagcugccuuc

SEQ ID NO: 2632811 - RNA, 12 nt, Human
uuugagcugccu

SEQ ID NO: 2632812 - RNA, 21 nt, Human
uuugagcugaaaugcugcauu

SEQ ID NO: 2632813 - RNA, 19 nt, Human
uuugagcugaaaugcugca

SEQ ID NO: 2632814 - RNA, 17 nt, Human
uuugagcugccuucccu

SEQ ID NO: 2632815 - RNA, 19 nt, Human
uuugagcuuagugaaauua

SEQ ID NO: 2632816 - RNA, 20 nt, Human
uuugagguuuuuaagccuua

SEQ ID NO: 2632817 - RNA, 16 nt, Human
uuugagguggaagagg

SEQ ID NO: 2632818 - RNA, 17 nt, Human
uuugauaauguuaaauu

SEQ ID NO: 2632819 - RNA, 19 nt, Human
uuugauaauguuaaauuug

SEQ ID NO: 2632820 - RNA, 19 nt, Human
uuugauacauaugugaaua

SEQ ID NO: 2632821 - RNA, 23 nt, Human
uuugauaauguuaaauuuguaag

SEQ ID NO: 2632822 - RNA, 16 nt, Human
uuugagugauuauuug

SEQ ID NO: 2632823 - RNA, 16 nt, Human
uuugagugaggguuuc

SEQ ID NO: 2632824 - RNA, 16 nt, Human
uuugauacauauguga

SEQ ID NO: 2632825 - RNA, 17 nt, Human
uuucuuacauaauuuuu

SEQ ID NO: 2632826 - RNA, 16 nt, Human
uuucugaguuccugca

SEQ ID NO: 2632827 - RNA, 15 nt, Human
uuucugagcugcucu

SEQ ID NO: 2632828 - RNA, 14 nt, Human
uuucugagcgauua

SEQ ID NO: 2632829 - RNA, 10 nt, Human
uuucugagcg

SEQ ID NO: 2632830 - RNA, 21 nt, Human
uuucugagcccgggcugccug

SEQ ID NO: 2632831 - RNA, 16 nt, Human
uuucugaggagaaaca

SEQ ID NO: 2632832 - RNA, 18 nt, Human
uuucugaggagaaacaaa

SEQ ID NO: 2632833 - RNA, 22 nt, Human
uuucuuacugucuuuuuucuaa

SEQ ID NO: 2632834 - RNA, 20 nt, Human
uuucuuacugauuuuuaagu

SEQ ID NO: 2632835 - RNA, 14 nt, Human
uuucuuagaaauuu

SEQ ID NO: 2632836 - RNA, 22 nt, Human
uuucuuagaaauuuauuuccua

SEQ ID NO: 2632837 - RNA, 22 nt, Human
uuucuuacaggcacaaaaugau

SEQ ID NO: 2632838 - RNA, 15 nt, Human
uuugagcagggcuca

SEQ ID NO: 2632839 - RNA, 16 nt, Human
uuucuuagcuuuuuaa

SEQ ID NO: 2632840 - RNA, 13 nt, Human
uuucuuagcuuuu

SEQ ID NO: 2632841 - RNA, 12 nt, Human
uuucuuagcuuu

SEQ ID NO: 2632842 - RNA, 15 nt, Human
uuugagcaauuuucg

SEQ ID NO: 2632843 - RNA, 15 nt, Human
uuugagcaacuuucu

SEQ ID NO: 2632844 - RNA, 23 nt, Human
uuugcauaacguauaaaagccug

SEQ ID NO: 2632845 - RNA, 19 nt, Human
uuugcauaacguauaaaag

SEQ ID NO: 2632846 - RNA, 15 nt, Human
uuugcagaugacaaa

SEQ ID NO: 2632847 - RNA, 19 nt, Human
uuugcagaaaagcaccugc

SEQ ID NO: 2632848 - RNA, 20 nt, Human
uuugcagaaaagcaccugcc

SEQ ID NO: 2632849 - RNA, 22 nt, Human
uuugcagaaaagcaccugccga

SEQ ID NO: 2632850 - RNA, 21 nt, Human
uuugcagcugagagaaaauaa

SEQ ID NO: 2632851 - RNA, 16 nt, Human
uuugcagaugacaaaa

SEQ ID NO: 2632852 - RNA, 21 nt, Human
uuugcagcagugagucucuuc

SEQ ID NO: 2632853 - RNA, 14 nt, Human
uuugcagacaggca

SEQ ID NO: 2632854 - RNA, 21 nt, Human
uuugcacuugugauuauuuau

SEQ ID NO: 2632855 - RNA, 17 nt, Human
uuugcacuguaugcugg

SEQ ID NO: 2632856 - RNA, 20 nt, Human
uuugauaucacagucuaauu

SEQ ID NO: 2632857 - RNA, 17 nt, Human
uuugauaucacagucua

SEQ ID NO: 2632858 - RNA, 19 nt, Human
uuugauaucacagucuaau

SEQ ID NO: 2632859 - RNA, 15 nt, Human
uuugauacuuguuca

SEQ ID NO: 2632860 - RNA, 18 nt, Human
uuugauaguauugugcau

SEQ ID NO: 2632861 - RNA, 18 nt, Human
uuugccauguuggccagg

SEQ ID NO: 2632862 - RNA, 20 nt, Human
uuugccaugggcuucacugu

SEQ ID NO: 2632863 - RNA, 14 nt, Human
uuugccaugggcuu

SEQ ID NO: 2632864 - RNA, 16 nt, Human
uuugccagugggaacu

SEQ ID NO: 2632865 - RNA, 15 nt, Human
uuugccagugggaac

SEQ ID NO: 2632866 - RNA, 21 nt, Human
uuugcauagauucccugagca

SEQ ID NO: 2632867 - RNA, 22 nt, Human
uuugcauaggugaucucauuua

SEQ ID NO: 2632868 - RNA, 15 nt, Human
uuuuaaaaugagaaa

SEQ ID NO: 2632869 - RNA, 18 nt, Human
uuuuaaaaucuuuucuau

SEQ ID NO: 2632870 - RNA, 17 nt, Human
uuuuaaaaucuuuucua

SEQ ID NO: 2632871 - RNA, 14 nt, Human
uuuguuuaaaagga

SEQ ID NO: 2632872 - RNA, 12 nt, Human
uuuguuuacaca

SEQ ID NO: 2632873 - RNA, 10 nt, Human
uuuguuguua

SEQ ID NO: 2632874 - RNA, 22 nt, Human
uuuuaaaaugagaaaucuaaaa

SEQ ID NO: 2632875 - RNA, 19 nt, Human
uuuuaaaaugagagucacu

SEQ ID NO: 2632876 - RNA, 12 nt, Human
uuuuaaaaugag

SEQ ID NO: 2632877 - RNA, 16 nt, Human
uuuuaaacaaaauaga

SEQ ID NO: 2632878 - RNA, 20 nt, Human
uuuuaaacaaaauagaagcu

SEQ ID NO: 2632879 - RNA, 17 nt, Human
uuuuaauuuacaaaaau

SEQ ID NO: 2632880 - RNA, 23 nt, Human
uuuuaauuuaugaguuuuugaua

SEQ ID NO: 2632881 - RNA, 21 nt, Human
uuuuaauuuauuuauacuauu

SEQ ID NO: 2632882 - RNA, 13 nt, Human
uuuuaccaaguuu

SEQ ID NO: 2632883 - RNA, 14 nt, Human
uuuuacccauaucc

SEQ ID NO: 2632884 - RNA, 22 nt, Human
uuuuaccaugccccugagcaau

SEQ ID NO: 2632885 - RNA, 15 nt, Human
uuuuacuacugugga

SEQ ID NO: 2632886 - RNA, 15 nt, Human
uuuuacuagaacaca

SEQ ID NO: 2632887 - RNA, 18 nt, Human
uuuuacccauauccccuc

SEQ ID NO: 2632888 - RNA, 15 nt, Human
uuuuacuccaguggu

SEQ ID NO: 2632889 - RNA, 13 nt, Human
uuuuacuccccuu

SEQ ID NO: 2632890 - RNA, 15 nt, Human
uuuuacauucugaau

SEQ ID NO: 2632891 - RNA, 15 nt, Human
uuuuacauacugcug

SEQ ID NO: 2632892 - RNA, 16 nt, Human
uuuuacauacugcugu

SEQ ID NO: 2632893 - RNA, 16 nt, Human
uuuuacagcugccugc

SEQ ID NO: 2632894 - RNA, 15 nt, Human
uuuuaauuuuguauu

SEQ ID NO: 2632895 - RNA, 16 nt, Human
uuuuaauuuuguauuu

SEQ ID NO: 2632896 - RNA, 13 nt, Human
uuuuaauuuugua

SEQ ID NO: 2632897 - RNA, 14 nt, Human
uuuuaauuuuaacc

SEQ ID NO: 2632898 - RNA, 12 nt, Human
uuuuaauuuugu

SEQ ID NO: 2632899 - RNA, 22 nt, Human
uuuuaauuuauuuauuaagaug

SEQ ID NO: 2632900 - RNA, 13 nt, Human
uuuuaauuugaua

SEQ ID NO: 2632901 - RNA, 10 nt, Human
uuuuauauuu

SEQ ID NO: 2632902 - RNA, 23 nt, Human
uuuuauauuaaaauaagcacugu

SEQ ID NO: 2632903 - RNA, 14 nt, Human
uuuuauaugucaaa

SEQ ID NO: 2632904 - RNA, 17 nt, Human
uuuuauauuaaaauaag

SEQ ID NO: 2632905 - RNA, 17 nt, Human
uuuuaucacauguaugu

SEQ ID NO: 2632906 - RNA, 15 nt, Human
uuuuaucacauguau

SEQ ID NO: 2632907 - RNA, 22 nt, Human
uuuuauauugauaacagcacug

SEQ ID NO: 2632908 - RNA, 19 nt, Human
uuuuaucaugacauguuau

SEQ ID NO: 2632909 - RNA, 17 nt, Human
uuuuaucaugacauguu

SEQ ID NO: 2632910 - RNA, 16 nt, Human
uuuuaucaugcauguc

SEQ ID NO: 2632911 - RNA, 12 nt, Human
uuuuaucaguag

SEQ ID NO: 2632912 - RNA, 15 nt, Human
uuuuaucaugacaug

SEQ ID NO: 2632913 - RNA, 20 nt, Human
uuuuaugauacuugaaaauu

SEQ ID NO: 2632914 - RNA, 16 nt, Human
uuuuaugauacuugaa

SEQ ID NO: 2632915 - RNA, 18 nt, Human
uuuuaucgucacugcuua

SEQ ID NO: 2632916 - RNA, 19 nt, Human
uuuuaucauuuucaaaaug

SEQ ID NO: 2632917 - RNA, 20 nt, Human
uuuuauaugcuucuguuuua

SEQ ID NO: 2632918 - RNA, 15 nt, Human
uuuuauaugcuucug

SEQ ID NO: 2632919 - RNA, 22 nt, Human
uuuuauaugaagauaaguguau

SEQ ID NO: 2632920 - RNA, 20 nt, Human
uuuuauaucaauuuaaaaaa

SEQ ID NO: 2632921 - RNA, 14 nt, Human
uuuuacuguacaga

SEQ ID NO: 2632922 - RNA, 15 nt, Human
uuuuauauauacagu

SEQ ID NO: 2632923 - RNA, 17 nt, Human
uuuuacugccacucuuu

SEQ ID NO: 2632924 - RNA, 14 nt, Human
uuuuacugccacuc

SEQ ID NO: 2632925 - RNA, 14 nt, Human
uuuuacugaacaau

SEQ ID NO: 2632926 - RNA, 19 nt, Human
uuuuacugaagccuuucuu

SEQ ID NO: 2632927 - RNA, 11 nt, Human
uuuuacugaac

SEQ ID NO: 2632928 - RNA, 13 nt, Human
uuuuacugaacaa

SEQ ID NO: 2632929 - RNA, 15 nt, Human
uuuuacugaagccuu

SEQ ID NO: 2632930 - RNA, 15 nt, Human
uuuuccuucagugcc

SEQ ID NO: 2632931 - RNA, 14 nt, Human
uuuuccuugaagcc

SEQ ID NO: 2632932 - RNA, 18 nt, Human
uuuuccucuucuauuuug

SEQ ID NO: 2632933 - RNA, 23 nt, Human
uuuucgaacauucuuugccuggu

SEQ ID NO: 2632934 - RNA, 16 nt, Human
uuuuccuuugucauca

SEQ ID NO: 2632935 - RNA, 21 nt, Human
uuuuccuuuaaaaaaauuuaa

SEQ ID NO: 2632936 - RNA, 19 nt, Human
uuuuccuuuuuuauacaca

SEQ ID NO: 2632937 - RNA, 12 nt, Human
uuuuccuuuaaa

SEQ ID NO: 2632938 - RNA, 16 nt, Human
uuuuccuuguccccac

SEQ ID NO: 2632939 - RNA, 17 nt, Human
uuuuccuuugaauccuc

SEQ ID NO: 2632940 - RNA, 15 nt, Human
uuuuccuugaagccg

SEQ ID NO: 2632941 - RNA, 17 nt, Human
uuuucuugcaugaggcu

SEQ ID NO: 2632942 - RNA, 15 nt, Human
uuuucuucuucccuc

SEQ ID NO: 2632943 - RNA, 14 nt, Human
uuuucuucuucccu

SEQ ID NO: 2632944 - RNA, 18 nt, Human
uuuucuucuucccucccu

SEQ ID NO: 2632945 - RNA, 14 nt, Human
uuuucuucucccuc

SEQ ID NO: 2632946 - RNA, 19 nt, Human
uuuucgaagcucagcccac

SEQ ID NO: 2632947 - RNA, 19 nt, Human
uuuuccaugaguccccugu

SEQ ID NO: 2632948 - RNA, 18 nt, Human
uuuuccaugaguccccug

SEQ ID NO: 2632949 - RNA, 16 nt, Human
uuuucagaaaauauua

SEQ ID NO: 2632950 - RNA, 20 nt, Human
uuuuccaugcguguuucuga

SEQ ID NO: 2632951 - RNA, 17 nt, Human
uuuuccauuguuugaaa

SEQ ID NO: 2632952 - RNA, 14 nt, Human
uuuuccauguaucu

SEQ ID NO: 2632953 - RNA, 16 nt, Human
uuuuccauugguuuac

SEQ ID NO: 2632954 - RNA, 18 nt, Human
uuuuccuauuuucagccc

SEQ ID NO: 2632955 - RNA, 13 nt, Human
uuuuccuauuugu

SEQ ID NO: 2632956 - RNA, 13 nt, Human
uuuuccucccuca

SEQ ID NO: 2632957 - RNA, 14 nt, Human
uuuuccucccuucu

SEQ ID NO: 2632958 - RNA, 17 nt, Human
uuuuccucccuucugcu

SEQ ID NO: 2632959 - RNA, 13 nt, Human
uuuucccaaagcc

SEQ ID NO: 2632960 - RNA, 17 nt, Human
uuuuccuagcccucuca

SEQ ID NO: 2632961 - RNA, 13 nt, Human
uuuuccugaaaac

SEQ ID NO: 2632962 - RNA, 22 nt, Human
uuuuccucccuuggguucugau

SEQ ID NO: 2632963 - RNA, 21 nt, Human
uuuuccucccuuggguucuga

SEQ ID NO: 2632964 - RNA, 20 nt, Human
uuuuccucccuucugcuacu

SEQ ID NO: 2632965 - RNA, 21 nt, Human
uuuuccucccuucugcuacug

SEQ ID NO: 2632966 - RNA, 19 nt, Human
uuuuccuccgggagagggg

SEQ ID NO: 2632967 - RNA, 17 nt, Human
uuuuaucccucaccugu

SEQ ID NO: 2632968 - RNA, 22 nt, Human
uuuucaacgcagcccugcuuug

SEQ ID NO: 2632969 - RNA, 21 nt, Human
uuuucaacgcagcccugcuuu

SEQ ID NO: 2632970 - RNA, 23 nt, Human
uuuuaugcaaauauuuuuuugua

SEQ ID NO: 2632971 - RNA, 15 nt, Human
uuuuaugcaaauauu

SEQ ID NO: 2632972 - RNA, 17 nt, Human
uuuucaacgcagcccug

SEQ ID NO: 2632973 - RNA, 14 nt, Human
uuuucaagaaacug

SEQ ID NO: 2632974 - RNA, 15 nt, Human
uuuucaagaaacuga

SEQ ID NO: 2632975 - RNA, 13 nt, Human
uuuucaacugcca

SEQ ID NO: 2632976 - RNA, 23 nt, Human
uuuucaacugccaaaaugcucua

SEQ ID NO: 2632977 - RNA, 16 nt, Human
uuuucaaggcccucag

SEQ ID NO: 2632978 - RNA, 16 nt, Human
uuuucaagaauaauca

SEQ ID NO: 2632979 - RNA, 15 nt, Human
uuuucacaguucucu

SEQ ID NO: 2632980 - RNA, 13 nt, Human
uuuucacaaauaa

SEQ ID NO: 2632981 - RNA, 22 nt, Human
uuuucaauuaaacggauuauuu

SEQ ID NO: 2632982 - RNA, 14 nt, Human
uuuucaauuuugca

SEQ ID NO: 2632983 - RNA, 21 nt, Human
uuuucaauuaaacggauuauu

SEQ ID NO: 2632984 - RNA, 18 nt, Human
uuuucaauuaaacggauu

SEQ ID NO: 2632985 - RNA, 17 nt, Human
uuuucaauuaaacggau

SEQ ID NO: 2632986 - RNA, 16 nt, Human
uuuucaauuaaacgga

SEQ ID NO: 2632987 - RNA, 15 nt, Human
uuuucaauuaaacgg

SEQ ID NO: 2632988 - RNA, 14 nt, Human
uuuucaauuaaacg

SEQ ID NO: 2632989 - RNA, 13 nt, Human
uuuucaauuaaac

SEQ ID NO: 2632990 - RNA, 12 nt, Human
uuuucaauuaaa

SEQ ID NO: 2632991 - RNA, 10 nt, Human
uuuucaauua

SEQ ID NO: 2632992 - RNA, 16 nt, Human
uuuucaauauuuauua

SEQ ID NO: 2632993 - RNA, 14 nt, Human
uuuucaauauuuau

SEQ ID NO: 2632994 - RNA, 18 nt, Human
uuuucacuuugugauuau

SEQ ID NO: 2632995 - RNA, 16 nt, Human
uuuucacuguagaaug

SEQ ID NO: 2632996 - RNA, 15 nt, Human
uuuucagaaaauauu

SEQ ID NO: 2632997 - RNA, 21 nt, Human
uuuucacuggaguuacauuaa

SEQ ID NO: 2632998 - RNA, 19 nt, Human
uuuucacggaaguuuucaa

SEQ ID NO: 2632999 - RNA, 20 nt, Human
uuuucacggaaguuuucaau

SEQ ID NO: 2633000 - RNA, 20 nt, Human
uuuucacugcuggcugccuu

SEQ ID NO: 2633001 - RNA, 19 nt, Human
uuuucacugcuggcugccu

SEQ ID NO: 2633002 - RNA, 18 nt, Human
uuuucaauuuugcaugcu

SEQ ID NO: 2633003 - RNA, 14 nt, Human
uuuucacaaauaaa

SEQ ID NO: 2633004 - RNA, 23 nt, Human
uuuucacacaauacaauaaguua

SEQ ID NO: 2633005 - RNA, 21 nt, Human immunodeficiency virus 2 [HIV-2]
uaguacacccagcacaaacaa

SEQ ID NO: 2633006 - RNA, 16 nt, Human immunodeficiency virus 2 [HIV-2]
agcacaaacaagcaga

SEQ ID NO: 2633007 - RNA, 14 nt, Human immunodeficiency virus 2 [HIV-2]
ucgguguucaucug

SEQ ID NO: 2633008 - RNA, 14 nt, Human immunodeficiency virus 2 [HIV-2]
agacgaagaaggac

SEQ ID NO: 2633009 - RNA, 20 nt, Human immunodeficiency virus 2 [HIV-2]
ccagcaacagaaagacagaa

SEQ ID NO: 2633010 - RNA, 21 nt, Human immunodeficiency virus 2 [HIV-2]
aaggacacaugguauuuagaa

SEQ ID NO: 2633011 - RNA, 15 nt, Human immunodeficiency virus 2 [HIV-2]
gaguaccacggagag

SEQ ID NO: 2633012 - RNA, 23 nt, Human immunodeficiency virus 2 [HIV-2]
cuggaaaaauaugacauggcagg

SEQ ID NO: 2633013 - RNA, 17 nt, Human immunodeficiency virus 2 [HIV-2]
ggaccggggacagccag

SEQ ID NO: 2633014 - RNA, 15 nt, Human immunodeficiency virus 2 [HIV-2]
acuggguaauagaaa

SEQ ID NO: 2633015 - RNA, 17 nt, Human immunodeficiency virus 2 [HIV-2]
aguguuucacucucagc

SEQ ID NO: 2633016 - RNA, 19 nt, Human immunodeficiency virus 2 [HIV-2]
auaagcacuauugggaugc

SEQ ID NO: 2633017 - RNA, 15 nt, Human immunodeficiency virus 2 [HIV-2]
gggacugcaagggau

SEQ ID NO: 2633018 - RNA, 18 nt, Human immunodeficiency virus 2 [HIV-2]
cagauggagggaagccau

SEQ ID NO: 2633019 - RNA, 22 nt, Human immunodeficiency virus 2 [HIV-2]
gcaggcucagacccggaagugg

SEQ ID NO: 2633020 - RNA, 22 nt, Human immunodeficiency virus 2 [HIV-2]
acagcaguaucagcagggagag

SEQ ID NO: 2633021 - RNA, 16 nt, Human immunodeficiency virus 2 [HIV-2]
ccgccgacugaucucc

SEQ ID NO: 2633022 - RNA, 18 nt, Human immunodeficiency virus 2 [HIV-2]
auggagggaagccaugca

SEQ ID NO: 2633023 - RNA, 15 nt, Human immunodeficiency virus 2 [HIV-2]
gaacaaccauacuug

SEQ ID NO: 2633024 - RNA, 23 nt, Human immunodeficiency virus 2 [HIV-2]
ucagcagggagaguacaugaaca

SEQ ID NO: 2633025 - RNA, 13 nt, Human immunodeficiency virus 2 [HIV-2]
augacauggcagg

SEQ ID NO: 2633026 - RNA, 19 nt, Human immunodeficiency virus 2 [HIV-2]
gcagcaacagcaacagcug

SEQ ID NO: 2633027 - RNA, 23 nt, Human immunodeficiency virus 2 [HIV-2]
gaaauaauuuuaaaugugacaga

SEQ ID NO: 2633028 - RNA, 18 nt, Human immunodeficiency virus 2 [HIV-2]
gagacuuacuauccaaga

SEQ ID NO: 2633029 - RNA, 13 nt, Human immunodeficiency virus 2 [HIV-2]
aggagugggagaa

SEQ ID NO: 2633030 - RNA, 20 nt, Human immunodeficiency virus 2 [HIV-2]
aaggcgccagagagcucauu

SEQ ID NO: 2633031 - RNA, 15 nt, Human immunodeficiency virus 2 [HIV-2]
cuaaauucaugggga

SEQ ID NO: 2633032 - RNA, 22 nt, Human immunodeficiency virus 2 [HIV-2]
ggaaaaauaugacauggcagga

SEQ ID NO: 2633033 - RNA, 23 nt, Human immunodeficiency virus 2 [HIV-2]
guuccaagaagaaucaggcaggg

SEQ ID NO: 2633034 - RNA, 17 nt, Human immunodeficiency virus 2 [HIV-2]
gaugauuaucaggaaau

SEQ ID NO: 2633035 - RNA, 16 nt, Human immunodeficiency virus 2 [HIV-2]
cgaaggaacagaagaa

SEQ ID NO: 2633036 - RNA, 14 nt, Human immunodeficiency virus 2 [HIV-2]
agauguaaugauac

SEQ ID NO: 2633037 - RNA, 13 nt, Human immunodeficiency virus 2 [HIV-2]
cugugagggacag

SEQ ID NO: 2633038 - RNA, 12 nt, Human immunodeficiency virus 2 [HIV-2]
cagaagaagacg

SEQ ID NO: 2633039 - RNA, 13 nt, Human immunodeficiency virus 2 [HIV-2]
uggacuaacugca

SEQ ID NO: 2633040 - RNA, 16 nt, Human immunodeficiency virus 2 [HIV-2]
caguaaccagcauaau

SEQ ID NO: 2633041 - RNA, 17 nt, Human immunodeficiency virus 2 [HIV-2]
caugcacuaacaaaugc

SEQ ID NO: 2633042 - RNA, 13 nt, Human immunodeficiency virus 2 [HIV-2]
cagucgcucugcg

SEQ ID NO: 2633043 - RNA, 16 nt, Human immunodeficiency virus 2 [HIV-2]
cagaaagacagaaaga

SEQ ID NO: 2633044 - RNA, 23 nt, Human immunodeficiency virus 2 [HIV-2]
gagugcauauaguagugggaaua

SEQ ID NO: 2633045 - RNA, 18 nt, Human immunodeficiency virus 2 [HIV-2]
gaggacuacgagagagac

SEQ ID NO: 2633046 - RNA, 14 nt, Human immunodeficiency virus 2 [HIV-2]
gcaggagugggaga

SEQ ID NO: 2633047 - RNA, 14 nt, Human immunodeficiency virus 2 [HIV-2]
gggacagccagcca

SEQ ID NO: 2633048 - RNA, 15 nt, Human immunodeficiency virus 2 [HIV-2]
ccagugaggaacaaa

SEQ ID NO: 2633049 - RNA, 17 nt, Human immunodeficiency virus 2 [HIV-2]
agccuuaaacagggagg

SEQ ID NO: 2633050 - RNA, 16 nt, Human immunodeficiency virus 2 [HIV-2]
gaacagcccauggaga

SEQ ID NO: 2633051 - RNA, 18 nt, Human immunodeficiency virus 2 [HIV-2]
cccagcaacagaaagaca

SEQ ID NO: 2633052 - RNA, 17 nt, Human immunodeficiency virus 2 [HIV-2]
uuagaagcaaguuaagu

SEQ ID NO: 2633053 - RNA, 12 nt, Human immunodeficiency virus 2 [HIV-2]
caagaggcagag

SEQ ID NO: 2633054 - RNA, 21 nt, Human immunodeficiency virus 2 [HIV-2]
caggagugggagaaacaaguc

SEQ ID NO: 2633055 - RNA, 18 nt, Human immunodeficiency virus 2 [HIV-2]
cagcugaggcugcaggga

SEQ ID NO: 2633056 - RNA, 21 nt, Human immunodeficiency virus 2 [HIV-2]
gcucugcggagaggcuggcag

SEQ ID NO: 2633057 - RNA, 14 nt, Human immunodeficiency virus 2 [HIV-2]
guacacccagcaca

SEQ ID NO: 2633058 - RNA, 19 nt, Human immunodeficiency virus 2 [HIV-2]
acugaucucccagagucua

SEQ ID NO: 2633059 - RNA, 12 nt, Human immunodeficiency virus 2 [HIV-2]
guacacccagca

SEQ ID NO: 2633060 - RNA, 16 nt, Human immunodeficiency virus 2 [HIV-2]
ccuagaaaaagaggaa

SEQ ID NO: 2633061 - RNA, 22 nt, Human immunodeficiency virus 2 [HIV-2]
gagggauaccauauagugaaua

SEQ ID NO: 2633062 - RNA, 18 nt, Human immunodeficiency virus 2 [HIV-2]
gcagcaacagcaacagcu

SEQ ID NO: 2633063 - RNA, 19 nt, Human immunodeficiency virus 2 [HIV-2]
ggcaugaugaacaagggau

SEQ ID NO: 2633064 - RNA, 16 nt, Human immunodeficiency virus 2 [HIV-2]
gaggaccauagaagcc

SEQ ID NO: 2633065 - RNA, 16 nt, Human immunodeficiency virus 2 [HIV-2]
agcaguaucagcaggg

SEQ ID NO: 2633066 - RNA, 19 nt, Human immunodeficiency virus 2 [HIV-2]
acucugagggaaauaaagg

SEQ ID NO: 2633067 - RNA, 14 nt, Human immunodeficiency virus 2 [HIV-2]
gagguauaaggaca

SEQ ID NO: 2633068 - RNA, 12 nt, Human immunodeficiency virus 2 [HIV-2]
aucaggcaggga

SEQ ID NO: 2633069 - RNA, 14 nt, Human immunodeficiency virus 2 [HIV-2]
cuuaaacagggagg

SEQ ID NO: 2633070 - RNA, 14 nt, Human immunodeficiency virus 2 [HIV-2]
cauauaaagcagau

SEQ ID NO: 2633071 - RNA, 15 nt, Human immunodeficiency virus 2 [HIV-2]
gaaucaggcagggag

SEQ ID NO: 2633072 - RNA, 16 nt, Human immunodeficiency virus 2 [HIV-2]
uuuacaguaggaggag

SEQ ID NO: 2633073 - RNA, 20 nt, Human immunodeficiency virus 2 [HIV-2]
gaaaauagaacauauaucua

SEQ ID NO: 2633074 - RNA, 13 nt, Human immunodeficiency virus 2 [HIV-2]
uauucccuuauuu

SEQ ID NO: 2633075 - RNA, 22 nt, Human immunodeficiency virus 2 [HIV-2]
gagccuggguguucccugcugg

SEQ ID NO: 2633076 - RNA, 23 nt, Human immunodeficiency virus 2 [HIV-2]
gagccuggguguucccugcugga

SEQ ID NO: 2633077 - RNA, 19 nt, Human immunodeficiency virus 2 [HIV-2]
gcagacaugaugaugagca

SEQ ID NO: 2633078 - RNA, 14 nt, Human immunodeficiency virus 2 [HIV-2]
cagacgaagaagga

SEQ ID NO: 2633079 - RNA, 17 nt, Human immunodeficiency virus 2 [HIV-2]
aucagcagggagaguac

SEQ ID NO: 2633080 - RNA, 21 nt, Human immunodeficiency virus 2 [HIV-2]
uuccaagaagaaucaggcagg

SEQ ID NO: 2633081 - RNA, 16 nt, Human immunodeficiency virus 2 [HIV-2]
agaaucaggcagggag

SEQ ID NO: 2633082 - RNA, 17 nt, Human immunodeficiency virus 2 [HIV-2]
gcaauagauaugucaca

SEQ ID NO: 2633083 - RNA, 21 nt, Human immunodeficiency virus 2 [HIV-2]
guggggaugguuaugggaagc

SEQ ID NO: 2633084 - RNA, 22 nt, Human immunodeficiency virus 2 [HIV-2]
agucgcucugcggagaggcugg

SEQ ID NO: 2633085 - RNA, 17 nt, Human immunodeficiency virus 2 [HIV-2]
gacagaccccagagaaa

SEQ ID NO: 2633086 - RNA, 21 nt, Human immunodeficiency virus 2 [HIV-2]
acagcaguaucagcagggaga

SEQ ID NO: 2633087 - RNA, 23 nt, Human immunodeficiency virus 2 [HIV-2]
aaauauggaugauguagauucug

SEQ ID NO: 2633088 - RNA, 16 nt, Human immunodeficiency virus 2 [HIV-2]
cagcaaucagggacug

SEQ ID NO: 2633089 - RNA, 13 nt, Human immunodeficiency virus 2 [HIV-2]
gacaagaaccaaa

SEQ ID NO: 2633090 - RNA, 22 nt, Human immunodeficiency virus 2 [HIV-2]
ugugcaacuaaaaauagagaca

SEQ ID NO: 2633091 - RNA, 21 nt, Human immunodeficiency virus 2 [HIV-2]
uggcuaaacaaggagaagaac

SEQ ID NO: 2633092 - RNA, 18 nt, Human immunodeficiency virus 2 [HIV-2]
cauuagcuuaaacaagua

SEQ ID NO: 2633093 - RNA, 15 nt, Human immunodeficiency virus 2 [HIV-2]
gaauccaaggcagga

SEQ ID NO: 2633094 - RNA, 20 nt, Human immunodeficiency virus 2 [HIV-2]
ugaaccaucugccccgagag

SEQ ID NO: 2633095 - RNA, 14 nt, Human immunodeficiency virus 2 [HIV-2]
ugcuggacucucac

SEQ ID NO: 2633096 - RNA, 17 nt, Human immunodeficiency virus 2 [HIV-2]
agugaguauggagccug

SEQ ID NO: 2633097 - RNA, 21 nt, Human immunodeficiency virus 2 [HIV-2]
agagaaaggguaccgccagga

SEQ ID NO: 2633098 - RNA, 22 nt, Human immunodeficiency virus 2 [HIV-2]
gaguaccacggagagaaaugac

SEQ ID NO: 2633099 - RNA, 20 nt, Human immunodeficiency virus 2 [HIV-2]
acuccagugaggaacaaaag

SEQ ID NO: 2633100 - RNA, 15 nt, Human immunodeficiency virus 2 [HIV-2]
gagaccauuggagag

SEQ ID NO: 2633101 - RNA, 22 nt, Human immunodeficiency virus 2 [HIV-2]
ucaauaccuagcccuaguagua

SEQ ID NO: 2633102 - RNA, 17 nt, Human immunodeficiency virus 2 [HIV-2]
aaacaguggagaagaga

SEQ ID NO: 2633103 - RNA, 21 nt, Human immunodeficiency virus 2 [HIV-2]
cuaagaaacagcugaggcugc

SEQ ID NO: 2633104 - RNA, 18 nt, Human immunodeficiency virus 2 [HIV-2]
cauuuuacuaacaagugc

SEQ ID NO: 2633105 - RNA, 13 nt, Human immunodeficiency virus 2 [HIV-2]
acauugacauaga

SEQ ID NO: 2633106 - RNA, 13 nt, Human immunodeficiency virus 2 [HIV-2]
ggcccaacugcaa

SEQ ID NO: 2633107 - RNA, 18 nt, Human immunodeficiency virus 2 [HIV-2]
ggagacauuaguguggca

SEQ ID NO: 2633108 - RNA, 14 nt, Human immunodeficiency virus 2 [HIV-2]
agaaaaagggggac

SEQ ID NO: 2633109 - RNA, 14 nt, Human immunodeficiency virus 2 [HIV-2]
ugaggagaugaugc

SEQ ID NO: 2633110 - RNA, 17 nt, Human immunodeficiency virus 2 [HIV-2]
accagcauaauugcuaa

SEQ ID NO: 2633111 - RNA, 23 nt, Human immunodeficiency virus 2 [HIV-2]
cucuccagcacuagcagguagag

SEQ ID NO: 2633112 - RNA, 12 nt, Human immunodeficiency virus 2 [HIV-2]
gcugcagggacu

SEQ ID NO: 2633113 - RNA, 18 nt, Human immunodeficiency virus 2 [HIV-2]
caggugaaguaagaagag

SEQ ID NO: 2633114 - RNA, 13 nt, Human immunodeficiency virus 2 [HIV-2]
agguagagccugg

SEQ ID NO: 2633115 - RNA, 21 nt, Human immunodeficiency virus 2 [HIV-2]
gugcaacuaaaaauagagaca

SEQ ID NO: 2633116 - RNA, 14 nt, Human immunodeficiency virus 2 [HIV-2]
ggguaccgccagga

SEQ ID NO: 2633117 - RNA, 19 nt, Human immunodeficiency virus 2 [HIV-2]
ugaucgggcuauacaacau

SEQ ID NO: 2633118 - RNA, 14 nt, Human immunodeficiency virus 2 [HIV-2]
ucaacuccagugag

SEQ ID NO: 2633119 - RNA, 12 nt, Human immunodeficiency virus 2 [HIV-2]
caaggcaggaaa

SEQ ID NO: 2633120 - RNA, 21 nt, Human immunodeficiency virus 2 [HIV-2]
auagcaaucuauguagugcaa

SEQ ID NO: 2633121 - RNA, 17 nt, Human immunodeficiency virus 2 [HIV-2]
acucuguacccagaaga

SEQ ID NO: 2633122 - RNA, 14 nt, Human immunodeficiency virus 2 [HIV-2]
caacaucugcagag

SEQ ID NO: 2633123 - RNA, 13 nt, Human immunodeficiency virus 2 [HIV-2]
augggccaggagu

SEQ ID NO: 2633124 - RNA, 13 nt, Human immunodeficiency virus 2 [HIV-2]
guuuggaggcaga

SEQ ID NO: 2633125 - RNA, 16 nt, Human immunodeficiency virus 2 [HIV-2]
ucuugcuuuacggcag

SEQ ID NO: 2633126 - RNA, 21 nt, Human immunodeficiency virus 2 [HIV-2]
cagacaagugaguauggagcc

SEQ ID NO: 2633127 - RNA, 19 nt, Human immunodeficiency virus 2 [HIV-2]
aaagcuauauuuacacauu

SEQ ID NO: 2633128 - RNA, 20 nt, Human immunodeficiency virus 2 [HIV-2]
aagaauggaaggcaaaacug

SEQ ID NO: 2633129 - RNA, 13 nt, Human immunodeficiency virus 2 [HIV-2]
gggcgcgugggga

SEQ ID NO: 2633130 - RNA, 21 nt, Human immunodeficiency virus 2 [HIV-2]
cgggcuauacaacaucugcag

SEQ ID NO: 2633131 - RNA, 22 nt, Human immunodeficiency virus 2 [HIV-2]
ggauaauaccagauuggcagaa

SEQ ID NO: 2633132 - RNA, 16 nt, Human immunodeficiency virus 2 [HIV-2]
agaaaaagaggaaggg

SEQ ID NO: 2633133 - RNA, 13 nt, Human immunodeficiency virus 2 [HIV-2]
agaaucaggcagg

SEQ ID NO: 2633134 - RNA, 22 nt, Human immunodeficiency virus 2 [HIV-2]
acucugagggaaauaaaggaag

SEQ ID NO: 2633135 - RNA, 17 nt, Human immunodeficiency virus 2 [HIV-2]
agugcagaaguggcaga

SEQ ID NO: 2633136 - RNA, 13 nt, Human immunodeficiency virus 2 [HIV-2]
agaagaugucugg

SEQ ID NO: 2633137 - RNA, 14 nt, Human immunodeficiency virus 2 [HIV-2]
uaucagcagggaga

SEQ ID NO: 2633138 - RNA, 17 nt, Human immunodeficiency virus 2 [HIV-2]
ccagcacaaacaagcag

SEQ ID NO: 2633139 - RNA, 14 nt, Human immunodeficiency virus 2 [HIV-2]
cagaggaagaugag

SEQ ID NO: 2633140 - RNA, 17 nt, Human immunodeficiency virus 2 [HIV-2]
gaacaagauaagaaaag

SEQ ID NO: 2633141 - RNA, 21 nt, Human immunodeficiency virus 2 [HIV-2]
agcuacuaagaaacagcugag

SEQ ID NO: 2633142 - RNA, 16 nt, Human immunodeficiency virus 2 [HIV-2]
cuuuccagaaggggcu

SEQ ID NO: 2633143 - RNA, 21 nt, Human immunodeficiency virus 2 [HIV-2]
ccauauagugaauaacaggaa

SEQ ID NO: 2633144 - RNA, 15 nt, Human immunodeficiency virus 2 [HIV-2]
cacaagaggcagagg

SEQ ID NO: 2633145 - RNA, 13 nt, Human immunodeficiency virus 2 [HIV-2]
aagagaccaggaa

SEQ ID NO: 2633146 - RNA, 12 nt, Human immunodeficiency virus 2 [HIV-2]
cggagaggcugg

SEQ ID NO: 2633147 - RNA, 14 nt, Human immunodeficiency virus 2 [HIV-2]
uaugugacuguuuu

SEQ ID NO: 2633148 - RNA, 17 nt, Human immunodeficiency virus 2 [HIV-2]
acaaggccuaggcaggc

SEQ ID NO: 2633149 - RNA, 15 nt, Human immunodeficiency virus 2 [HIV-2]
cacuagcagguagag

SEQ ID NO: 2633150 - RNA, 12 nt, Human immunodeficiency virus 2 [HIV-2]
caaggcaggaag

SEQ ID NO: 2633151 - RNA, 20 nt, Human immunodeficiency virus 2 [HIV-2]
cuguuacaccaagaguacca

SEQ ID NO: 2633152 - RNA, 19 nt, Human immunodeficiency virus 2 [HIV-2]
auagagacacuugggggac

SEQ ID NO: 2633153 - RNA, 13 nt, Human immunodeficiency virus 2 [HIV-2]
ggcagggagcaga

SEQ ID NO: 2633154 - RNA, 17 nt, Human immunodeficiency virus 2 [HIV-2]
gcuaguaucaguagaac

SEQ ID NO: 2633155 - RNA, 22 nt, Human immunodeficiency virus 2 [HIV-2]
acgaagaaggacuccaaggaaa

SEQ ID NO: 2633156 - RNA, 22 nt, Human immunodeficiency virus 2 [HIV-2]
auuaacuuuacgaaaccgggag

SEQ ID NO: 2633157 - RNA, 20 nt, Human immunodeficiency virus 2 [HIV-2]
aaaaagggggacugcaaggg

SEQ ID NO: 2633158 - RNA, 13 nt, Human immunodeficiency virus 2 [HIV-2]
cauugccagcugu

SEQ ID NO: 2633159 - RNA, 18 nt, Human immunodeficiency virus 2 [HIV-2]
cauggaauaauacaguga

SEQ ID NO: 2633160 - RNA, 14 nt, Human immunodeficiency virus 2 [HIV-2]
acagcugaggcugc

SEQ ID NO: 2633161 - RNA, 20 nt, Human immunodeficiency virus 2 [HIV-2]
cagucaaaguuuagaagaag

SEQ ID NO: 2633162 - RNA, 16 nt, Human immunodeficiency virus 2 [HIV-2]
ccgucuggggaacgaa

SEQ ID NO: 2633163 - RNA, 17 nt, Human immunodeficiency virus 2 [HIV-2]
caguggagaagagacca

SEQ ID NO: 2633164 - RNA, 18 nt, Human immunodeficiency virus 2 [HIV-2]
caggaggugaagcaaacc

SEQ ID NO: 2633165 - RNA, 20 nt, Human immunodeficiency virus 2 [HIV-2]
auuggcaugaugaacaaggg

SEQ ID NO: 2633166 - RNA, 19 nt, Human immunodeficiency virus 2 [HIV-2]
aaaaaccuccaggcaagag

SEQ ID NO: 2633167 - RNA, 16 nt, Human immunodeficiency virus 2 [HIV-2]
ggcagaucgagcccug

SEQ ID NO: 2633168 - RNA, 21 nt, Human immunodeficiency virus 2 [HIV-2]
agucaaaguuuagaagaagcc

SEQ ID NO: 2633169 - RNA, 21 nt, Human immunodeficiency virus 2 [HIV-2]
gauaauaccagauuggcagaa

SEQ ID NO: 2633170 - RNA, 18 nt, Human immunodeficiency virus 2 [HIV-2]
acuacaaauuaauagaaa

SEQ ID NO: 2633171 - RNA, 20 nt, Human immunodeficiency virus 2 [HIV-2]
aucugaguaacaagacccug

SEQ ID NO: 2633172 - RNA, 16 nt, Human immunodeficiency virus 2 [HIV-2]
aaaauaugacauggca

SEQ ID NO: 2633173 - RNA, 16 nt, Human immunodeficiency virus 2 [HIV-2]
aauaaaggaagaagcc

SEQ ID NO: 2633174 - RNA, 14 nt, Human immunodeficiency virus 2 [HIV-2]
cucacaagaggcag

SEQ ID NO: 2633175 - RNA, 19 nt, Human immunodeficiency virus 2 [HIV-2]
cauauagugaauaacagga

SEQ ID NO: 2633176 - RNA, 17 nt, Human immunodeficiency virus 2 [HIV-2]
ccuagaaaaagaggaag

SEQ ID NO: 2633177 - RNA, 22 nt, Human immunodeficiency virus 2 [HIV-2]
gggaacgaaaaaccuccaggca

SEQ ID NO: 2633178 - RNA, 18 nt, Human immunodeficiency virus 2 [HIV-2]
ccuaaagcaucaggcaca

SEQ ID NO: 2633179 - RNA, 20 nt, Human immunodeficiency virus 2 [HIV-2]
caaggaccggggacagccag

SEQ ID NO: 2633180 - RNA, 15 nt, Human immunodeficiency virus 2 [HIV-2]
caaggccuaggcagg

SEQ ID NO: 2633181 - RNA, 16 nt, Human immunodeficiency virus 2 [HIV-2]
acacauuucaagagag

SEQ ID NO: 2633182 - RNA, 16 nt, Human immunodeficiency virus 2 [HIV-2]
acaugagacauugcaa

SEQ ID NO: 2633183 - RNA, 18 nt, Human immunodeficiency virus 2 [HIV-2]
cgggauagugcagcaaca

SEQ ID NO: 2633184 - RNA, 19 nt, Human immunodeficiency virus 2 [HIV-2]
ggaugguuaugggaagcag

SEQ ID NO: 2633185 - RNA, 15 nt, Human immunodeficiency virus 2 [HIV-2]
caggauugccagaga

SEQ ID NO: 2633186 - RNA, 17 nt, Human immunodeficiency virus 2 [HIV-2]
aauugcuaacauugaca

SEQ ID NO: 2633187 - RNA, 20 nt, Human immunodeficiency virus 2 [HIV-2]
cauaauaaaugaaacuucua

SEQ ID NO: 2633188 - RNA, 22 nt, Human immunodeficiency virus 2 [HIV-2]
cauauaucuauuggcauggcag

SEQ ID NO: 2633189 - RNA, 18 nt, Human immunodeficiency virus 2 [HIV-2]
auccauaauagacaugga

SEQ ID NO: 2633190 - RNA, 21 nt, Human immunodeficiency virus 2 [HIV-2]
guacuucggguggcuguggaa

SEQ ID NO: 2633191 - RNA, 14 nt, Human immunodeficiency virus 2 [HIV-2]
aaggauuggaagac

SEQ ID NO: 2633192 - RNA, 15 nt, Human immunodeficiency virus 2 [HIV-2]
gaguauggagccugg

SEQ ID NO: 2633193 - RNA, 17 nt, Human immunodeficiency virus 2 [HIV-2]
ccgguuuggaggcagau

SEQ ID NO: 2633194 - RNA, 16 nt, Human immunodeficiency virus 2 [HIV-2]
uacaaggccuucacuc

SEQ ID NO: 2633195 - RNA, 11 nt, Human immunodeficiency virus 2 [HIV-2]
gaucagagaag

SEQ ID NO: 2633196 - RNA, 18 nt, Human immunodeficiency virus 2 [HIV-2]
gagaccauuggagaggcc

SEQ ID NO: 2633197 - RNA, 17 nt, Human immunodeficiency virus 2 [HIV-2]
aagaaucaggcagggag

SEQ ID NO: 2633198 - RNA, 21 nt, Human immunodeficiency virus 2 [HIV-2]
aucaacacaaggccuaggcag

SEQ ID NO: 2633199 - RNA, 22 nt, Human immunodeficiency virus 2 [HIV-2]
agaaguaccuaaagcaucaggc

SEQ ID NO: 2633200 - RNA, 16 nt, Human immunodeficiency virus 2 [HIV-2]
acguagucaagagaca

SEQ ID NO: 2633201 - RNA, 22 nt, Human immunodeficiency virus 2 [HIV-2]
uuguauucagucgcucugcgga

SEQ ID NO: 2633202 - RNA, 15 nt, Human immunodeficiency virus 2 [HIV-2]
ucaucugaguaacaa

SEQ ID NO: 2633203 - RNA, 17 nt, Human immunodeficiency virus 2 [HIV-2]
acaugggaggagcuggu

SEQ ID NO: 2633204 - RNA, 18 nt, Human immunodeficiency virus 2 [HIV-2]
aaaguagggaaaaaugua

SEQ ID NO: 2633205 - RNA, 14 nt, Human immunodeficiency virus 2 [HIV-2]
gaagcuuuccaagc

SEQ ID NO: 2633206 - RNA, 22 nt, Human immunodeficiency virus 2 [HIV-2]
accgccaggaaacaguggagaa

SEQ ID NO: 2633207 - RNA, 20 nt, Human immunodeficiency virus 2 [HIV-2]
gagagguucucuccagcacu

SEQ ID NO: 2633208 - RNA, 14 nt, Human immunodeficiency virus 2 [HIV-2]
aguggauccaagaa

SEQ ID NO: 2633209 - RNA, 15 nt, Human immunodeficiency virus 2 [HIV-2]
auaccauauagugaa

SEQ ID NO: 2633210 - RNA, 20 nt, Human immunodeficiency virus 2 [HIV-2]
ucgggcuauacaacaucugc

SEQ ID NO: 2633211 - RNA, 22 nt, Human immunodeficiency virus 2 [HIV-2]
aagauuuguauaggcagcaaaa

SEQ ID NO: 2633212 - RNA, 22 nt, Human immunodeficiency virus 2 [HIV-2]
accauacuuggucaaggcagga

SEQ ID NO: 2633213 - RNA, 13 nt, Human immunodeficiency virus 2 [HIV-2]
ggaggcagugaac

SEQ ID NO: 2633214 - RNA, 16 nt, Human immunodeficiency virus 2 [HIV-2]
caggcaagagucacug

SEQ ID NO: 2633215 - RNA, 19 nt, Human immunodeficiency virus 2 [HIV-2]
aucuauuggcauggcagag

SEQ ID NO: 2633216 - RNA, 20 nt, Human immunodeficiency virus 2 [HIV-2]
cuaagugcacuaaaguagua

SEQ ID NO: 2633217 - RNA, 14 nt, Human immunodeficiency virus 2 [HIV-2]
gaaggcgccagaga

SEQ ID NO: 2633218 - RNA, 18 nt, Human immunodeficiency virus 2 [HIV-2]
cucgcaguuccaagaaga

SEQ ID NO: 2633219 - RNA, 14 nt, Human immunodeficiency virus 2 [HIV-2]
cuagaggcaaauau

SEQ ID NO: 2633220 - RNA, 13 nt, Human immunodeficiency virus 2 [HIV-2]
cgguuaucuccaa

SEQ ID NO: 2633221 - RNA, 17 nt, Human immunodeficiency virus 2 [HIV-2]
gccgguacugggcagac

SEQ ID NO: 2633222 - RNA, 19 nt, Human immunodeficiency virus 2 [HIV-2]
uauaaauuggcaauagaua

SEQ ID NO: 2633223 - RNA, 23 nt, Human immunodeficiency virus 2 [HIV-2]
agcgcgacgcaucgggaggggaa

SEQ ID NO: 2633224 - RNA, 16 nt, Human immunodeficiency virus 2 [HIV-2]
uggccuauaacuacaa

SEQ ID NO: 2633225 - RNA, 20 nt, Human immunodeficiency virus 2 [HIV-2]
ccaucacuucaauaccuagc

SEQ ID NO: 2633226 - RNA, 18 nt, Human immunodeficiency virus 2 [HIV-2]
ccagcaacagaaagacag

SEQ ID NO: 2633227 - RNA, 20 nt, Human immunodeficiency virus 2 [HIV-2]
gacaugggaggagcuggugg

SEQ ID NO: 2633228 - RNA, 14 nt, Human immunodeficiency virus 2 [HIV-2]
uaggcagcaaaaua

SEQ ID NO: 2633229 - RNA, 19 nt, Human immunodeficiency virus 2 [HIV-2]
gcugccaguuagaagcaag

SEQ ID NO: 2633230 - RNA, 23 nt, Human immunodeficiency virus 2 [HIV-2]
ccaagaguaccacggagagaaau

SEQ ID NO: 2633231 - RNA, 14 nt, Human immunodeficiency virus 2 [HIV-2]
auccuagacauaua

SEQ ID NO: 2633232 - RNA, 19 nt, Human immunodeficiency virus 2 [HIV-2]
gcuuaguacacccagcaca

SEQ ID NO: 2633233 - RNA, 17 nt, Human immunodeficiency virus 2 [HIV-2]
gugcagaaguggcagaa

SEQ ID NO: 2633234 - RNA, 13 nt, Human immunodeficiency virus 2 [HIV-2]
cagaaguggcaga

SEQ ID NO: 2633235 - RNA, 23 nt, Human immunodeficiency virus 2 [HIV-2]
guuugugacaacacaacagcugg

SEQ ID NO: 2633236 - RNA, 20 nt, Human immunodeficiency virus 2 [HIV-2]
gcccauggagaaacccagca

SEQ ID NO: 2633237 - RNA, 12 nt, Human immunodeficiency virus 2 [HIV-2]
agaaucaggcag

SEQ ID NO: 2633238 - RNA, 15 nt, Human immunodeficiency virus 2 [HIV-2]
ucucacaagaggcag

SEQ ID NO: 2633239 - RNA, 16 nt, Human immunodeficiency virus 2 [HIV-2]
caaggccuaggcaggc

SEQ ID NO: 2633240 - RNA, 14 nt, Human immunodeficiency virus 2 [HIV-2]
ccaaggcaggaaaa

SEQ ID NO: 2633241 - RNA, 14 nt, Human immunodeficiency virus 2 [HIV-2]
cagaaagacagaaa

SEQ ID NO: 2633242 - RNA, 23 nt, Human immunodeficiency virus 2 [HIV-2]
aagccuuaaacagggaggcagug

SEQ ID NO: 2633243 - RNA, 21 nt, Human immunodeficiency virus 2 [HIV-2]
cauauaucuauuggcauggca

SEQ ID NO: 2633244 - RNA, 12 nt, Human immunodeficiency virus 2 [HIV-2]
aggacaugggcc

SEQ ID NO: 2633245 - RNA, 14 nt, Human immunodeficiency virus 2 [HIV-2]
ugacuccaugcugg

SEQ ID NO: 2633246 - RNA, 22 nt, Human immunodeficiency virus 2 [HIV-2]
caggugaaguaagaagagccau

SEQ ID NO: 2633247 - RNA, 20 nt, Human immunodeficiency virus 2 [HIV-2]
cacgaccccgaaucccagga

SEQ ID NO: 2633248 - RNA, 17 nt, Human immunodeficiency virus 2 [HIV-2]
agaaucaggcagggagc

SEQ ID NO: 2633249 - RNA, 13 nt, Human immunodeficiency virus 2 [HIV-2]
gaauccaaggcag

SEQ ID NO: 2633250 - RNA, 22 nt, Human immunodeficiency virus 2 [HIV-2]
aguuagaagcaaguuaagugug

SEQ ID NO: 2633251 - RNA, 14 nt, Human immunodeficiency virus 2 [HIV-2]
cagaucgagcccug

SEQ ID NO: 2633252 - RNA, 16 nt, Human immunodeficiency virus 2 [HIV-2]
gaaucaggcagggagc

SEQ ID NO: 2633253 - RNA, 19 nt, Human immunodeficiency virus 2 [HIV-2]
gaaucaacaguaaccagca

SEQ ID NO: 2633254 - RNA, 17 nt, Human immunodeficiency virus 2 [HIV-2]
gucuaaugacugaagca

SEQ ID NO: 2633255 - RNA, 13 nt, Human immunodeficiency virus 2 [HIV-2]
gaggcuggcagau

SEQ ID NO: 2633256 - RNA, 22 nt, Human immunodeficiency virus 2 [HIV-2]
gaugcuaugagguuuagauacu

SEQ ID NO: 2633257 - RNA, 18 nt, Human immunodeficiency virus 2 [HIV-2]
agcccucuucgugcacuu

SEQ ID NO: 2633258 - RNA, 13 nt, Human immunodeficiency virus 2 [HIV-2]
cggagaggcuggc

SEQ ID NO: 2633259 - RNA, 13 nt, Human immunodeficiency virus 2 [HIV-2]
gcuggacucucac

SEQ ID NO: 2633260 - RNA, 23 nt, Human immunodeficiency virus 2 [HIV-2]
agaggcuggcagaucgagcccug

SEQ ID NO: 2633261 - RNA, 21 nt, Human immunodeficiency virus 2 [HIV-2]
agcacuagcagguagagccug

SEQ ID NO: 2633262 - RNA, 24 nt, Human immunodeficiency virus 2 [HIV-2]
gagccuggguguucccugcuggac

SEQ ID NO: 2633263 - RNA, 17 nt, Human immunodeficiency virus 2 [HIV-2]
gucaggauugccagaga

SEQ ID NO: 2633264 - RNA, 15 nt, Human immunodeficiency virus 2 [HIV-2]
cugggagacuacaaa

SEQ ID NO: 2633265 - RNA, 19 nt, Human immunodeficiency virus 2 [HIV-2]
agaagccuuaaacagggag

SEQ ID NO: 2633266 - RNA, 22 nt, Human immunodeficiency virus 2 [HIV-2]
cagcacaaacaagcagacauga

SEQ ID NO: 2633267 - RNA, 21 nt, Human immunodeficiency virus 2 [HIV-2]
guagcuacuaagaaacagcug

SEQ ID NO: 2633268 - RNA, 13 nt, Human immunodeficiency virus 2 [HIV-2]
cagauacaaagga

SEQ ID NO: 2633269 - RNA, 23 nt, Human immunodeficiency virus 2 [HIV-2]
cuguguuucucgaaaaaggggcu

SEQ ID NO: 2633270 - RNA, 21 nt, Human immunodeficiency virus 2 [HIV-2]
cauggaauaauacagugacag

SEQ ID NO: 2633271 - RNA, 12 nt, Human immunodeficiency virus 2 [HIV-2]
uccaaggcagga

SEQ ID NO: 2633272 - RNA, 19 nt, Human immunodeficiency virus 2 [HIV-2]
guuggacguagucaagaga

SEQ ID NO: 2633273 - RNA, 23 nt, Human immunodeficiency virus 2 [HIV-2]
aagugcuugcuuaguauauugua

SEQ ID NO: 2633274 - RNA, 18 nt, Human immunodeficiency virus 2 [HIV-2]
cagcaguaucagcaggga

SEQ ID NO: 2633275 - RNA, 21 nt, Human immunodeficiency virus 2 [HIV-2]
uaguaucaguagaacucucac

SEQ ID NO: 2633276 - RNA, 12 nt, Human immunodeficiency virus 2 [HIV-2]
caaugaauugua

SEQ ID NO: 2633277 - RNA, 13 nt, Human immunodeficiency virus 2 [HIV-2]
ggcaauagauaug

SEQ ID NO: 2633278 - RNA, 20 nt, Human immunodeficiency virus 2 [HIV-2]
aacacaucaaucaucaaaga

SEQ ID NO: 2633279 - RNA, 20 nt, Human immunodeficiency virus 2 [HIV-2]
gccgguuuggaggcagaugg

SEQ ID NO: 2633280 - RNA, 14 nt, Human immunodeficiency virus 2 [HIV-2]
agggacaugggagg

SEQ ID NO: 2633281 - RNA, 16 nt, Human immunodeficiency virus 2 [HIV-2]
gaaggcgccagagagc

SEQ ID NO: 2633282 - RNA, 12 nt, Human immunodeficiency virus 2 [HIV-2]
ggaggacauggg

SEQ ID NO: 2633283 - RNA, 15 nt, Human immunodeficiency virus 2 [HIV-2]
aggguaugaggagau

SEQ ID NO: 2633284 - RNA, 19 nt, Human immunodeficiency virus 2 [HIV-2]
agcugaggcugcagggacu

SEQ ID NO: 2633285 - RNA, 20 nt, Human immunodeficiency virus 2 [HIV-2]
agucaaaguuuagaagaagc

SEQ ID NO: 2633286 - RNA, 17 nt, Human immunodeficiency virus 2 [HIV-2]
aauauguaugaauuaca

SEQ ID NO: 2633287 - RNA, 19 nt, Human immunodeficiency virus 2 [HIV-2]
caugaacagcccauggaga

SEQ ID NO: 2633288 - RNA, 15 nt, Human immunodeficiency virus 2 [HIV-2]
ggucaaggcaggaag

SEQ ID NO: 2633289 - RNA, 18 nt, Human immunodeficiency virus 2 [HIV-2]
gccgggauagugcagcaa

SEQ ID NO: 2633290 - RNA, 15 nt, Human immunodeficiency virus 2 [HIV-2]
cugcggagaggcugg

SEQ ID NO: 2633291 - RNA, 22 nt, Human immunodeficiency virus 2 [HIV-2]
uauaccuagaaaaagaggaagg

SEQ ID NO: 2633292 - RNA, 17 nt, Human immunodeficiency virus 2 [HIV-2]
cugcaccagacaaguga

SEQ ID NO: 2633293 - RNA, 13 nt, Human immunodeficiency virus 2 [HIV-2]
agcaagcuacaca

SEQ ID NO: 2633294 - RNA, 17 nt, Human immunodeficiency virus 2 [HIV-2]
aggacuacgagagagac

SEQ ID NO: 2633295 - RNA, 14 nt, Human immunodeficiency virus 2 [HIV-2]
ucucgcgacagcag

SEQ ID NO: 2633296 - RNA, 15 nt, Human immunodeficiency virus 2 [HIV-2]
ggacuaacugcagag

SEQ ID NO: 2633297 - RNA, 16 nt, Human immunodeficiency virus 2 [HIV-2]
auuuuacuaacaagug

SEQ ID NO: 2633298 - RNA, 17 nt, Human immunodeficiency virus 2 [HIV-2]
acggcuccacgcuugcu

SEQ ID NO: 2633299 - RNA, 20 nt, Human immunodeficiency virus 2 [HIV-2]
ugaauaacaggaacaaccau

SEQ ID NO: 2633300 - RNA, 16 nt, Human immunodeficiency virus 2 [HIV-2]
caaaaagcuauauuua

SEQ ID NO: 2633301 - RNA, 13 nt, Human immunodeficiency virus 2 [HIV-2]
acuacgagagaga

SEQ ID NO: 2633302 - RNA, 15 nt, Human immunodeficiency virus 2 [HIV-2]
acccagcaacagaaa

SEQ ID NO: 2633303 - RNA, 17 nt, Human immunodeficiency virus 2 [HIV-2]
gacagaacaagcaguag

SEQ ID NO: 2633304 - RNA, 16 nt, Human immunodeficiency virus 2 [HIV-2]
caggcagggagcagaa

SEQ ID NO: 2633305 - RNA, 14 nt, Human immunodeficiency virus 2 [HIV-2]
uauaaagcagauaa

SEQ ID NO: 2633306 - RNA, 22 nt, Human immunodeficiency virus 2 [HIV-2]
cgcaggauuaggguaugaggag

SEQ ID NO: 2633307 - RNA, 23 nt, Human immunodeficiency virus 2 [HIV-2]
guagaacucucacaagaggcaga

SEQ ID NO: 2633308 - RNA, 23 nt, Human immunodeficiency virus 2 [HIV-2]
ugaugcauggaauaauacaguga

SEQ ID NO: 2633309 - RNA, 19 nt, Human immunodeficiency virus 2 [HIV-2]
gaguuucccccagaagaug

SEQ ID NO: 2633310 - RNA, 12 nt, Human immunodeficiency virus 2 [HIV-2]
agaggcuggcag

SEQ ID NO: 2633311 - RNA, 20 nt, Human immunodeficiency virus 2 [HIV-2]
ccaagaagaaucaggcaggg

SEQ ID NO: 2633312 - RNA, 21 nt, Human immunodeficiency virus 2 [HIV-2]
aagaauuggcuaaacaaggag

SEQ ID NO: 2633313 - RNA, 23 nt, Human immunodeficiency virus 2 [HIV-2]
uuauacucaugggccaggaguaa

SEQ ID NO: 2633314 - RNA, 18 nt, Human immunodeficiency virus 2 [HIV-2]
cagaccccagagaaaggg

SEQ ID NO: 2633315 - RNA, 14 nt, Human immunodeficiency virus 2 [HIV-2]
gagaggcuggcaga

SEQ ID NO: 2633316 - RNA, 14 nt, Human immunodeficiency virus 2 [HIV-2]
ggagcuggugggga

SEQ ID NO: 2633317 - RNA, 11 nt, Human immunodeficiency virus 2 [HIV-2]
gugagggacag

SEQ ID NO: 2633318 - RNA, 16 nt, Human immunodeficiency virus 2 [HIV-2]
gcaggaggugaagcaa

SEQ ID NO: 2633319 - RNA, 23 nt, Human immunodeficiency virus 2 [HIV-2]
cacaaggaugauggaaacgcaaa

SEQ ID NO: 2633320 - RNA, 17 nt, Human immunodeficiency virus 2 [HIV-2]
caaaacugaaagcaaga

SEQ ID NO: 2633321 - RNA, 14 nt, Human immunodeficiency virus 2 [HIV-2]
aaucaggcagggag

SEQ ID NO: 2633322 - RNA, 20 nt, Human immunodeficiency virus 2 [HIV-2]
ucagucaaaguuuagaagaa

SEQ ID NO: 2633323 - RNA, 21 nt, Human immunodeficiency virus 2 [HIV-2]
cauacuuacuguauaaaugua

SEQ ID NO: 2633324 - RNA, 15 nt, Human immunodeficiency virus 2 [HIV-2]
guaccacggagagaa

SEQ ID NO: 2633325 - RNA, 23 nt, Human immunodeficiency virus 2 [HIV-2]
acucucacaagaggcagaggaag

SEQ ID NO: 2633326 - RNA, 16 nt, Human immunodeficiency virus 2 [HIV-2]
acauguuacaugagac

SEQ ID NO: 2633327 - RNA, 14 nt, Human immunodeficiency virus 2 [HIV-2]
aucugcagagacuu

SEQ ID NO: 2633328 - RNA, 17 nt, Human immunodeficiency virus 2 [HIV-2]
auggcaggagugggaga

SEQ ID NO: 2633329 - RNA, 18 nt, Human immunodeficiency virus 2 [HIV-2]
acagcugaggcugcaggg

SEQ ID NO: 2633330 - RNA, 17 nt, Human immunodeficiency virus 2 [HIV-2]
gacauuaguguggcagu

SEQ ID NO: 2633331 - RNA, 15 nt, Human immunodeficiency virus 2 [HIV-2]
gacaacacaacagcu

SEQ ID NO: 2633332 - RNA, 12 nt, Human immunodeficiency virus 2 [HIV-2]
auaauaggacua

SEQ ID NO: 2633333 - RNA, 15 nt, Human immunodeficiency virus 2 [HIV-2]
gcagaaguggcagaa

SEQ ID NO: 2633334 - RNA, 20 nt, Human immunodeficiency virus 2 [HIV-2]
accauacagugcuugccaga

SEQ ID NO: 2633335 - RNA, 12 nt, Human immunodeficiency virus 2 [HIV-2]
ccagagaaagaa

SEQ ID NO: 2633336 - RNA, 12 nt, Human immunodeficiency virus 2 [HIV-2]
uagaacaagaua

SEQ ID NO: 2633337 - RNA, 14 nt, Human immunodeficiency virus 2 [HIV-2]
gcaguagaagaugu

SEQ ID NO: 2633338 - RNA, 15 nt, Human immunodeficiency virus 2 [HIV-2]
aaccaagggagggac

SEQ ID NO: 2633339 - RNA, 19 nt, Human immunodeficiency virus 2 [HIV-2]
caaucaucaaagagucaug

SEQ ID NO: 2633340 - RNA, 14 nt, Human immunodeficiency virus 2 [HIV-2]
gccaaucaacacaa

SEQ ID NO: 2633341 - RNA, 19 nt, Human immunodeficiency virus 2 [HIV-2]
uuguaagagaccaggaaau

SEQ ID NO: 2633342 - RNA, 13 nt, Human immunodeficiency virus 2 [HIV-2]
ggcauggcagaga

SEQ ID NO: 2633343 - RNA, 19 nt, Human immunodeficiency virus 2 [HIV-2]
cucuucaauaaagcugcca

SEQ ID NO: 2633344 - RNA, 16 nt, Human immunodeficiency virus 2 [HIV-2]
uaaacagggaggcagu

SEQ ID NO: 2633345 - RNA, 22 nt, Human immunodeficiency virus 2 [HIV-2]
cuggucauucgguguucaucug

SEQ ID NO: 2633346 - RNA, 17 nt, Human immunodeficiency virus 2 [HIV-2]
acaagaggcagaggaag

SEQ ID NO: 2633347 - RNA, 17 nt, Human immunodeficiency virus 2 [HIV-2]
acuaacugcagaggaga

SEQ ID NO: 2633348 - RNA, 22 nt, Human immunodeficiency virus 2 [HIV-2]
agaguaccacggagagaaauga

SEQ ID NO: 2633349 - RNA, 22 nt, Human immunodeficiency virus 2 [HIV-2]
ggcagcaaaauauggaugaugu

SEQ ID NO: 2633350 - RNA, 14 nt, Human immunodeficiency virus 2 [HIV-2]
ugaauuacaaaaau

SEQ ID NO: 2633351 - RNA, 13 nt, Human immunodeficiency virus 2 [HIV-2]
uuccaagaagaau

SEQ ID NO: 2633352 - RNA, 23 nt, Human immunodeficiency virus 2 [HIV-2]
ucaaggcaggaaguagcuacuaa

SEQ ID NO: 2633353 - RNA, 17 nt, Human immunodeficiency virus 2 [HIV-2]
auacuuggucaaggcag

SEQ ID NO: 2633354 - RNA, 23 nt, Human immunodeficiency virus 2 [HIV-2]
uuuccagaaggggcuguaaccaa

SEQ ID NO: 2633355 - RNA, 17 nt, Human immunodeficiency virus 2 [HIV-2]
cuuguacaacaucccag

SEQ ID NO: 2633356 - RNA, 13 nt, Human immunodeficiency virus 2 [HIV-2]
caggcagggagca

SEQ ID NO: 2633357 - RNA, 19 nt, Human immunodeficiency virus 2 [HIV-2]
uguggaagcuaguaucagu

SEQ ID NO: 2633358 - RNA, 18 nt, Human immunodeficiency virus 2 [HIV-2]
ugcuuaguacacccagca

SEQ ID NO: 2633359 - RNA, 20 nt, Human immunodeficiency virus 2 [HIV-2]
agucaggauugccagagaaa

SEQ ID NO: 2633360 - RNA, 20 nt, Human immunodeficiency virus 2 [HIV-2]
gcuggacucucaccaguacu

SEQ ID NO: 2633361 - RNA, 19 nt, Human immunodeficiency virus 2 [HIV-2]
cuagcagguagagccuggg

SEQ ID NO: 2633362 - RNA, 14 nt, Human immunodeficiency virus 2 [HIV-2]
agcaaucagggacu

SEQ ID NO: 2633363 - RNA, 16 nt, Human immunodeficiency virus 2 [HIV-2]
gcuauacaacaucugc

SEQ ID NO: 2633364 - RNA, 13 nt, Human immunodeficiency virus 2 [HIV-2]
acuaacugcagag

SEQ ID NO: 2633365 - RNA, 14 nt, Human immunodeficiency virus 2 [HIV-2]
guacccaauguacu

SEQ ID NO: 2633366 - RNA, 20 nt, Human immunodeficiency virus 2 [HIV-2]
uaaugcaaaaagcuauauuu

SEQ ID NO: 2633367 - RNA, 20 nt, Human immunodeficiency virus 2 [HIV-2]
gucaggauugccagagaaag

SEQ ID NO: 2633368 - RNA, 15 nt, Human immunodeficiency virus 2 [HIV-2]
aguacacccagcaca

SEQ ID NO: 2633369 - RNA, 19 nt, Human immunodeficiency virus 2 [HIV-2]
augacagaccccagagaaa

SEQ ID NO: 2633370 - RNA, 23 nt, Human immunodeficiency virus 2 [HIV-2]
cauauaucuauuggcauggcaga

SEQ ID NO: 2633371 - RNA, 19 nt, Human immunodeficiency virus 2 [HIV-2]
ccauggagaaacccagcaa

SEQ ID NO: 2633372 - RNA, 20 nt, Human immunodeficiency virus 2 [HIV-2]
uggacguagucaagagacaa

SEQ ID NO: 2633373 - RNA, 23 nt, Human immunodeficiency virus 2 [HIV-2]
gaccucuucaauaaagcugccag

SEQ ID NO: 2633374 - RNA, 15 nt, Human immunodeficiency virus 2 [HIV-2]
agggcuauaggccug

SEQ ID NO: 2633375 - RNA, 19 nt, Human immunodeficiency virus 2 [HIV-2]
acggcgcaacuauugccau

SEQ ID NO: 2633376 - RNA, 14 nt, Human immunodeficiency virus 2 [HIV-2]
agggagggacaugg

SEQ ID NO: 2633377 - RNA, 15 nt, Human immunodeficiency virus 2 [HIV-2]
uugugccuaaugcaa

SEQ ID NO: 2633378 - RNA, 13 nt, Human immunodeficiency virus 2 [HIV-2]
uggguagaagaca

SEQ ID NO: 2633379 - RNA, 18 nt, Human immunodeficiency virus 2 [HIV-2]
acuuacuguauaaaugua

SEQ ID NO: 2633380 - RNA, 22 nt, Human immunodeficiency virus 2 [HIV-2]
ccaacagaguuucccccagaag

SEQ ID NO: 2633381 - RNA, 13 nt, Human immunodeficiency virus 2 [HIV-2]
uguacccagaaga

SEQ ID NO: 2633382 - RNA, 13 nt, Human immunodeficiency virus 2 [HIV-2]
gggaagccaugca

SEQ ID NO: 2633383 - RNA, 17 nt, Human immunodeficiency virus 2 [HIV-2]
gcaacagcaacagcugu

SEQ ID NO: 2633384 - RNA, 15 nt, Human immunodeficiency virus 2 [HIV-2]
agcagguagagccug

SEQ ID NO: 2633385 - RNA, 14 nt, Human immunodeficiency virus 2 [HIV-2]
aggauugccagaga

SEQ ID NO: 2633386 - RNA, 19 nt, Human immunodeficiency virus 2 [HIV-2]
aaaauauggaugauguaga

SEQ ID NO: 2633387 - RNA, 16 nt, Human immunodeficiency virus 2 [HIV-2]
aagaguaccacggaga

SEQ ID NO: 2633388 - RNA, 19 nt, Human immunodeficiency virus 2 [HIV-2]
augaacagcccauggagaa

SEQ ID NO: 2633389 - RNA, 23 nt, Human immunodeficiency virus 2 [HIV-2]
augcaaaaagcuauauuuacaca

SEQ ID NO: 2633390 - RNA, 20 nt, Human immunodeficiency virus 2 [HIV-2]
agaguacaugaacagcccau

SEQ ID NO: 2633391 - RNA, 16 nt, Human immunodeficiency virus 2 [HIV-2]
gcgaaagggcagacga

SEQ ID NO: 2633392 - RNA, 14 nt, Human immunodeficiency virus 2 [HIV-2]
agucaggauugcca

SEQ ID NO: 2633393 - RNA, 19 nt, Human immunodeficiency virus 2 [HIV-2]
guuugggcacaagucagga

SEQ ID NO: 2633394 - RNA, 13 nt, Human immunodeficiency virus 2 [HIV-2]
gcgaaagggcaga

SEQ ID NO: 2633395 - RNA, 21 nt, Human immunodeficiency virus 2 [HIV-2]
caauauggagugcauauagua

SEQ ID NO: 2633396 - RNA, 17 nt, Human immunodeficiency virus 2 [HIV-2]
uggguguucccugcugg

SEQ ID NO: 2633397 - RNA, 19 nt, Human immunodeficiency virus 2 [HIV-2]
auacagugcuugccagaca

SEQ ID NO: 2633398 - RNA, 19 nt, Human immunodeficiency virus 2 [HIV-2]
ugcauagaaaacaacacau

SEQ ID NO: 2633399 - RNA, 13 nt, Human immunodeficiency virus 2 [HIV-2]
uaucagcagggag

SEQ ID NO: 2633400 - RNA, 19 nt, Human immunodeficiency virus 2 [HIV-2]
ggagacauuaguguggcag

SEQ ID NO: 2633401 - RNA, 15 nt, Human immunodeficiency virus 2 [HIV-2]
ugccuaaugcaaaaa

SEQ ID NO: 2633402 - RNA, 19 nt, Human immunodeficiency virus 2 [HIV-2]
aucaacaguaaccagcaua

SEQ ID NO: 2633403 - RNA, 18 nt, Human immunodeficiency virus 2 [HIV-2]
ugggggaccauacagugc

SEQ ID NO: 2633404 - RNA, 14 nt, Human immunodeficiency virus 2 [HIV-2]
agauaagaaaagga

SEQ ID NO: 2633405 - RNA, 14 nt, Human immunodeficiency virus 2 [HIV-2]
ccaccuacugacuc

SEQ ID NO: 2633406 - RNA, 21 nt, Human immunodeficiency virus 2 [HIV-2]
cauaugagcgaaagggcagac

SEQ ID NO: 2633407 - RNA, 17 nt, Human immunodeficiency virus 2 [HIV-2]
aguggauccaagaagcu

SEQ ID NO: 2633408 - RNA, 13 nt, Human immunodeficiency virus 2 [HIV-2]
gagucaugugaua

SEQ ID NO: 2633409 - RNA, 20 nt, Human immunodeficiency virus 2 [HIV-2]
ggcuggcagaucgagcccug

SEQ ID NO: 2633410 - RNA, 17 nt, Human immunodeficiency virus 2 [HIV-2]
cgaguggcuagagagga

SEQ ID NO: 2633411 - RNA, 13 nt, Human immunodeficiency virus 2 [HIV-2]
gacaacaagaaau

SEQ ID NO: 2633412 - RNA, 19 nt, Human immunodeficiency virus 2 [HIV-2]
aacagcaaucagggacugg

SEQ ID NO: 2633413 - RNA, 19 nt, Human immunodeficiency virus 2 [HIV-2]
caggauugccagagaaaga

SEQ ID NO: 2633414 - RNA, 20 nt, Human immunodeficiency virus 2 [HIV-2]
ugcgggcgcguggggauggu

SEQ ID NO: 2633415 - RNA, 18 nt, Human immunodeficiency virus 2 [HIV-2]
cugagagguucucuccag

SEQ ID NO: 2633416 - RNA, 14 nt, Human immunodeficiency virus 2 [HIV-2]
gcagaaguggcaga

SEQ ID NO: 2633417 - RNA, 14 nt, Human immunodeficiency virus 2 [HIV-2]
aggaaucaaugaua

SEQ ID NO: 2633418 - RNA, 16 nt, Human immunodeficiency virus 2 [HIV-2]
auuaccuuuagugcag

SEQ ID NO: 2633419 - RNA, 16 nt, Human immunodeficiency virus 2 [HIV-2]
aacgcccucauacuua

SEQ ID NO: 2633420 - RNA, 22 nt, Human immunodeficiency virus 2 [HIV-2]
gggaauacucgcaguuccaaga

SEQ ID NO: 2633421 - RNA, 15 nt, Human immunodeficiency virus 2 [HIV-2]
agcaacagaaagaca

SEQ ID NO: 2633422 - RNA, 20 nt, Human immunodeficiency virus 2 [HIV-2]
gcuacacaaaguauagauau

SEQ ID NO: 2633423 - RNA, 21 nt, Human immunodeficiency virus 2 [HIV-2]
cgaagaaggacuccaaggaaa

SEQ ID NO: 2633424 - RNA, 17 nt, Human immunodeficiency virus 2 [HIV-2]
ugaguaacaagacccug

SEQ ID NO: 2633425 - RNA, 23 nt, Human immunodeficiency virus 2 [HIV-2]
gaaacagcugaggcugcagggac

SEQ ID NO: 2633426 - RNA, 17 nt, Human immunodeficiency virus 2 [HIV-2]
caucccagauacaaagg

SEQ ID NO: 2633427 - RNA, 15 nt, Human immunodeficiency virus 2 [HIV-2]
caguuagaagcaagu

SEQ ID NO: 2633428 - RNA, 23 nt, Human immunodeficiency virus 2 [HIV-2]
aguacuuggccgguacugggcag

SEQ ID NO: 2633429 - RNA, 20 nt, Human immunodeficiency virus 2 [HIV-2]
ggagggacaugggaggagcu

SEQ ID NO: 2633430 - RNA, 19 nt, Human immunodeficiency virus 2 [HIV-2]
acuggccgggauagugcag

SEQ ID NO: 2633431 - RNA, 13 nt, Human immunodeficiency virus 2 [HIV-2]
aggaaauaagaca

SEQ ID NO: 2633432 - RNA, 11 nt, Human immunodeficiency virus 2 [HIV-2]
aaagcugccag

SEQ ID NO: 2633433 - RNA, 22 nt, Human immunodeficiency virus 2 [HIV-2]
cuggggaacgaaaaaccuccag

SEQ ID NO: 2633434 - RNA, 13 nt, Human immunodeficiency virus 2 [HIV-2]
gaugcauggaaua

SEQ ID NO: 2633435 - RNA, 17 nt, Human immunodeficiency virus 2 [HIV-2]
gaguuggccugugaauc

SEQ ID NO: 2633436 - RNA, 11 nt, Human immunodeficiency virus 2 [HIV-2]
gacaacacaac

SEQ ID NO: 2633437 - RNA, 17 nt, Human immunodeficiency virus 2 [HIV-2]
caagagacaacaagaaa

SEQ ID NO: 2633438 - RNA, 14 nt, Human immunodeficiency virus 2 [HIV-2]
gcgaaagggcagac

SEQ ID NO: 2633439 - RNA, 17 nt, Human immunodeficiency virus 2 [HIV-2]
gugacagaacaagcagu

SEQ ID NO: 2633440 - RNA, 21 nt, Human immunodeficiency virus 2 [HIV-2]
auaauaccagauuggcagaau

SEQ ID NO: 2633441 - RNA, 16 nt, Human immunodeficiency virus 2 [HIV-2]
ugaaggcgccagagag

SEQ ID NO: 2633442 - RNA, 14 nt, Human immunodeficiency virus 2 [HIV-2]
ccuugcccagcugc

SEQ ID NO: 2633443 - RNA, 17 nt, Human immunodeficiency virus 2 [HIV-2]
gcugccaguuagaagca

SEQ ID NO: 2633444 - RNA, 16 nt, Human immunodeficiency virus 2 [HIV-2]
ggaauccaaggcagga

SEQ ID NO: 2633445 - RNA, 20 nt, Human immunodeficiency virus 2 [HIV-2]
ucuaacugcauagaaaacaa

SEQ ID NO: 2633446 - RNA, 17 nt, Human immunodeficiency virus 2 [HIV-2]
cagaaagacagaaagau

SEQ ID NO: 2633447 - RNA, 14 nt, Human immunodeficiency virus 2 [HIV-2]
agcugaggcugcag

SEQ ID NO: 2633448 - RNA, 19 nt, Human immunodeficiency virus 2 [HIV-2]
gcuacuaagaaacagcuga

SEQ ID NO: 2633449 - RNA, 14 nt, Human immunodeficiency virus 2 [HIV-2]
agaaucaggcaggg

SEQ ID NO: 2633450 - RNA, 17 nt, Human immunodeficiency virus 2 [HIV-2]
cacaaacaagcagacau

SEQ ID NO: 2633451 - RNA, 21 nt, Human immunodeficiency virus 2 [HIV-2]
cuuaaggcggcccaacugcaa

SEQ ID NO: 2633452 - RNA, 17 nt, Human immunodeficiency virus 2 [HIV-2]
uccauaauagacaugga

SEQ ID NO: 2633453 - RNA, 13 nt, Human immunodeficiency virus 2 [HIV-2]
gggaggcagugaa

SEQ ID NO: 2633454 - RNA, 14 nt, Human immunodeficiency virus 2 [HIV-2]
ccauugccagcugu

SEQ ID NO: 2633455 - RNA, 17 nt, Human immunodeficiency virus 2 [HIV-2]
accuagaaaaagaggaa

SEQ ID NO: 2633456 - RNA, 19 nt, Human immunodeficiency virus 2 [HIV-2]
agaacuguaccgauuagaa

SEQ ID NO: 2633457 - RNA, 15 nt, Human immunodeficiency virus 2 [HIV-2]
gcacaaggaugaugg

SEQ ID NO: 2633458 - RNA, 22 nt, Human immunodeficiency virus 2 [HIV-2]
agcccauggagaaacccagcaa

SEQ ID NO: 2633459 - RNA, 20 nt, Human immunodeficiency virus 2 [HIV-2]
aucaacacaaggccuaggca

SEQ ID NO: 2633460 - RNA, 22 nt, Human immunodeficiency virus 2 [HIV-2]
gccaacgaaggaacagaagaag

SEQ ID NO: 2633461 - RNA, 13 nt, Human immunodeficiency virus 2 [HIV-2]
ucucuccagcacu

SEQ ID NO: 2633462 - RNA, 17 nt, Human immunodeficiency virus 2 [HIV-2]
acucaugggccaggagu

SEQ ID NO: 2633463 - RNA, 24 nt, Human immunodeficiency virus 2 [HIV-2]
uaaccaagggagggacaugggagg

SEQ ID NO: 2633464 - RNA, 13 nt, Human immunodeficiency virus 2 [HIV-2]
ggccuaggcaggc

SEQ ID NO: 2633465 - RNA, 14 nt, Human immunodeficiency virus 2 [HIV-2]
acugaaagcaagag

SEQ ID NO: 2633466 - RNA, 22 nt, Human immunodeficiency virus 2 [HIV-2]
agaacucucacaagaggcagag

SEQ ID NO: 2633467 - RNA, 13 nt, Human immunodeficiency virus 2 [HIV-2]
agacaaugaugau

SEQ ID NO: 2633468 - RNA, 15 nt, Human immunodeficiency virus 2 [HIV-2]
ggcuguggaagcuag

SEQ ID NO: 2633469 - RNA, 22 nt, Human immunodeficiency virus 2 [HIV-2]
aaucagggacuggcugagacuu

SEQ ID NO: 2633470 - RNA, 17 nt, Human immunodeficiency virus 2 [HIV-2]
uguaugaauuacaaaaa

SEQ ID NO: 2633471 - RNA, 13 nt, Human immunodeficiency virus 2 [HIV-2]
ccaaggcaggaaa

SEQ ID NO: 2633472 - RNA, 20 nt, Human immunodeficiency virus 2 [HIV-2]
cuagagccaugcacuaacaa

SEQ ID NO: 2633473 - RNA, 19 nt, Human immunodeficiency virus 2 [HIV-2]
cggacuuuacuggccggga

SEQ ID NO: 2633474 - RNA, 24 nt, Human immunodeficiency virus 2 [HIV-2]
cacucucagccaaucaacacaagg

SEQ ID NO: 2633475 - RNA, 21 nt, Human immunodeficiency virus 2 [HIV-2]
gucuaacagcaaucagggacu

SEQ ID NO: 2633476 - RNA, 16 nt, Human immunodeficiency virus 2 [HIV-2]
ucugcggagaggcugg

SEQ ID NO: 2633477 - RNA, 19 nt, Human immunodeficiency virus 2 [HIV-2]
agaaaacaacacaugcgca

SEQ ID NO: 2633478 - RNA, 22 nt, Human immunodeficiency virus 2 [HIV-2]
gcuuugggaauccaaggcagga

SEQ ID NO: 2633479 - RNA, 15 nt, Human immunodeficiency virus 2 [HIV-2]
cauaccaacauuacc

SEQ ID NO: 2633480 - RNA, 20 nt, Human immunodeficiency virus 2 [HIV-2]
acaguaggaggagacauaga

SEQ ID NO: 2633481 - RNA, 14 nt, Human immunodeficiency virus 2 [HIV-2]
gcaagcuacacaaa

SEQ ID NO: 2633482 - RNA, 19 nt, Human immunodeficiency virus 2 [HIV-2]
agacuuacuauccaagaac

SEQ ID NO: 2633483 - RNA, 16 nt, Human immunodeficiency virus 2 [HIV-2]
gucaggauugccagag

SEQ ID NO: 2633484 - RNA, 12 nt, Human immunodeficiency virus 2 [HIV-2]
gguagagccugg

SEQ ID NO: 2633485 - RNA, 20 nt, Human immunodeficiency virus 2 [HIV-2]
caggauuaguguuucacucu

SEQ ID NO: 2633486 - RNA, 16 nt, Human immunodeficiency virus 2 [HIV-2]
cugcagggacuuucca

SEQ ID NO: 2633487 - RNA, 13 nt, Human immunodeficiency virus 2 [HIV-2]
gcaugaugaacaa

SEQ ID NO: 2633488 - RNA, 13 nt, Human immunodeficiency virus 2 [HIV-2]
cuugcccagcugc

SEQ ID NO: 2633489 - RNA, 20 nt, Human immunodeficiency virus 2 [HIV-2]
caaaauauggaugauguaga

SEQ ID NO: 2633490 - RNA, 14 nt, Human immunodeficiency virus 2 [HIV-2]
uauaggccuguuuu

SEQ ID NO: 2633491 - RNA, 21 nt, Human immunodeficiency virus 2 [HIV-2]
uagaacucucacaagaggcag

SEQ ID NO: 2633492 - RNA, 17 nt, Human immunodeficiency virus 2 [HIV-2]
guaagagaccaggaaau

SEQ ID NO: 2633493 - RNA, 22 nt, Human immunodeficiency virus 2 [HIV-2]
uuaguacacccagcacaaacaa

SEQ ID NO: 2633494 - RNA, 17 nt, Human immunodeficiency virus 2 [HIV-2]
gaggggaauacucgcag

SEQ ID NO: 2633495 - RNA, 16 nt, Human immunodeficiency virus 2 [HIV-2]
auuggcuaaacaagga

SEQ ID NO: 2633496 - RNA, 23 nt, Human immunodeficiency virus 2 [HIV-2]
gcuauacaacaucugcagagacu

SEQ ID NO: 2633497 - RNA, 21 nt, Human immunodeficiency virus 2 [HIV-2]
cugagggaaauaaaggaagaa

SEQ ID NO: 2633498 - RNA, 21 nt, Human immunodeficiency virus 2 [HIV-2]
aggaccggggacagccagcca

SEQ ID NO: 2633499 - RNA, 16 nt, Human immunodeficiency virus 2 [HIV-2]
gcaacagaaagacaga

SEQ ID NO: 2633500 - RNA, 14 nt, Human immunodeficiency virus 2 [HIV-2]
ggagaaacccagca

SEQ ID NO: 2633501 - RNA, 20 nt, Human immunodeficiency virus 2 [HIV-2]
guggcaaagguccuggagau

SEQ ID NO: 2633502 - RNA, 16 nt, Human immunodeficiency virus 2 [HIV-2]
cuccuugcccagcugc

SEQ ID NO: 2633503 - RNA, 20 nt, Human immunodeficiency virus 2 [HIV-2]
cacaagucaggauugccaga

SEQ ID NO: 2633504 - RNA, 13 nt, Human immunodeficiency virus 2 [HIV-2]
aauagaacauaua

SEQ ID NO: 2633505 - RNA, 17 nt, Human immunodeficiency virus 2 [HIV-2]
gaggcagaggaagauga

SEQ ID NO: 2633506 - RNA, 17 nt, Human immunodeficiency virus 2 [HIV-2]
cuagacauauaccuaga

SEQ ID NO: 2633507 - RNA, 14 nt, Human immunodeficiency virus 2 [HIV-2]
caaaugcuauugua

SEQ ID NO: 2633508 - RNA, 15 nt, Human immunodeficiency virus 2 [HIV-2]
ugggaauccaaggca

SEQ ID NO: 2633509 - RNA, 18 nt, Human immunodeficiency virus 2 [HIV-2]
augcaguuuccauugcca

SEQ ID NO: 2633510 - RNA, 17 nt, Human immunodeficiency virus 2 [HIV-2]
acaaguauuauaaucuc

SEQ ID NO: 2633511 - RNA, 22 nt, Human immunodeficiency virus 2 [HIV-2]
auaguagugggaauaauagcuu

SEQ ID NO: 2633512 - RNA, 13 nt, Human immunodeficiency virus 2 [HIV-2]
gagaggcuggcag

SEQ ID NO: 2633513 - RNA, 20 nt, Human immunodeficiency virus 2 [HIV-2]
acagaguuucccccagaaga

SEQ ID NO: 2633514 - RNA, 17 nt, Human immunodeficiency virus 2 [HIV-2]
gggaauccaaggcagga

SEQ ID NO: 2633515 - RNA, 19 nt, Human immunodeficiency virus 2 [HIV-2]
caagaagaaucaggcaggg

SEQ ID NO: 2633516 - RNA, 18 nt, Human immunodeficiency virus 2 [HIV-2]
acuagcagguagagccug

SEQ ID NO: 2633517 - RNA, 16 nt, Human immunodeficiency virus 2 [HIV-2]
agaacaagcaguagaa

SEQ ID NO: 2633518 - RNA, 16 nt, Human immunodeficiency virus 2 [HIV-2]
auggcacuagagcaga

SEQ ID NO: 2633519 - RNA, 17 nt, Human immunodeficiency virus 2 [HIV-2]
gaagaaucaggcaggga

SEQ ID NO: 2633520 - RNA, 13 nt, Human immunodeficiency virus 2 [HIV-2]
gaauggaaggcaa

SEQ ID NO: 2633521 - RNA, 20 nt, Human immunodeficiency virus 2 [HIV-2]
aagcugccaguuagaagcaa

SEQ ID NO: 2633522 - RNA, 15 nt, Human immunodeficiency virus 2 [HIV-2]
cuccugugagggaca

SEQ ID NO: 2633523 - RNA, 18 nt, Human immunodeficiency virus 2 [HIV-2]
gaauaauacagugacaga

SEQ ID NO: 2633524 - RNA, 20 nt, Human immunodeficiency virus 2 [HIV-2]
cagcaguaucagcagggaga

SEQ ID NO: 2633525 - RNA, 19 nt, Human immunodeficiency virus 2 [HIV-2]
cagcagggagaguacauga

SEQ ID NO: 2633526 - RNA, 18 nt, Human immunodeficiency virus 2 [HIV-2]
gugacaacacaacagcug

SEQ ID NO: 2633527 - RNA, 22 nt, Human immunodeficiency virus 2 [HIV-2]
aaaagggggacugcaagggaug

SEQ ID NO: 2633528 - RNA, 12 nt, Human immunodeficiency virus 2 [HIV-2]
uauaaggacaca

SEQ ID NO: 2633529 - RNA, 18 nt, Human immunodeficiency virus 2 [HIV-2]
gcugagacuuaaggcggc

SEQ ID NO: 2633530 - RNA, 14 nt, Human immunodeficiency virus 2 [HIV-2]
caaucuauguagug

SEQ ID NO: 2633531 - RNA, 21 nt, Human immunodeficiency virus 2 [HIV-2]
aguaucaguagaacucucaca

SEQ ID NO: 2633532 - RNA, 17 nt, Human immunodeficiency virus 2 [HIV-2]
caguaucagcagggaga

SEQ ID NO: 2633533 - RNA, 22 nt, Human immunodeficiency virus 2 [HIV-2]
agaaucaggcagggagcagaac

SEQ ID NO: 2633534 - RNA, 20 nt, Human immunodeficiency virus 2 [HIV-2]
aacagcaaucagggacuggc

SEQ ID NO: 2633535 - RNA, 17 nt, Human immunodeficiency virus 2 [HIV-2]
cugccaguuagaagcaa

SEQ ID NO: 2633536 - RNA, 20 nt, Human immunodeficiency virus 2 [HIV-2]
agaauuggcuaaacaaggag

SEQ ID NO: 2633537 - RNA, 22 nt, Human immunodeficiency virus 2 [HIV-2]
aucucccagagucuaacagcaa

SEQ ID NO: 2633538 - RNA, 17 nt, Human immunodeficiency virus 2 [HIV-2]
cucuucaauaaagcugc

SEQ ID NO: 2633539 - RNA, 14 nt, Human immunodeficiency virus 2 [HIV-2]
agcaacagaaagac

SEQ ID NO: 2633540 - RNA, 22 nt, Human immunodeficiency virus 2 [HIV-2]
cucgcccuccugugagggacag

SEQ ID NO: 2633541 - RNA, 21 nt, Human immunodeficiency virus 2 [HIV-2]
uaacaggaacaaccauacuug

SEQ ID NO: 2633542 - RNA, 19 nt, Human immunodeficiency virus 2 [HIV-2]
uccugugagggacagcagu

SEQ ID NO: 2633543 - RNA, 18 nt, Human immunodeficiency virus 2 [HIV-2]
agauauuggcaugaugaa

SEQ ID NO: 2633544 - RNA, 12 nt, Human immunodeficiency virus 2 [HIV-2]
gucaaggcagga

SEQ ID NO: 2633545 - RNA, 18 nt, Human immunodeficiency virus 2 [HIV-2]
cagggaggcagugaacca

SEQ ID NO: 2633546 - RNA, 21 nt, Human immunodeficiency virus 2 [HIV-2]
gcaaguuaaguguguguuccc

SEQ ID NO: 2633547 - RNA, 16 nt, Human immunodeficiency virus 2 [HIV-2]
cggagaggcuggcaga

SEQ ID NO: 2633548 - RNA, 24 nt, Human immunodeficiency virus 2 [HIV-2]
gaagggguuagaacaagauaagaa

SEQ ID NO: 2633549 - RNA, 20 nt, Human immunodeficiency virus 2 [HIV-2]
augcauggaauaauacagug

SEQ ID NO: 2633550 - RNA, 16 nt, Human immunodeficiency virus 2 [HIV-2]
agauucugaugaugau

SEQ ID NO: 2633551 - RNA, 21 nt, Human immunodeficiency virus 2 [HIV-2]
acaagcaguagaagaugucug

SEQ ID NO: 2633552 - RNA, 17 nt, Human immunodeficiency virus 2 [HIV-2]
ugcgaguggauccaaga

SEQ ID NO: 2633553 - RNA, 13 nt, Human immunodeficiency virus 2 [HIV-2]
gcccucauacuua

SEQ ID NO: 2633554 - RNA, 21 nt, Human immunodeficiency virus 2 [HIV-2]
auuacaaaaauuaaauagcug

SEQ ID NO: 2633555 - RNA, 16 nt, Human immunodeficiency virus 2 [HIV-2]
acaagaggcagaggaa

SEQ ID NO: 2633556 - RNA, 22 nt, Human immunodeficiency virus 2 [HIV-2]
acacuugggggaccauacagug

SEQ ID NO: 2633557 - RNA, 12 nt, Human immunodeficiency virus 2 [HIV-2]
agggagggacau

SEQ ID NO: 2633558 - RNA, 17 nt, Human immunodeficiency virus 2 [HIV-2]
guauaaauguacccgcu

SEQ ID NO: 2633559 - RNA, 18 nt, Human immunodeficiency virus 2 [HIV-2]
ucuugcauuguauucagu

SEQ ID NO: 2633560 - RNA, 15 nt, Human immunodeficiency virus 2 [HIV-2]
uccauugccagcugu

SEQ ID NO: 2633561 - RNA, 16 nt, Human immunodeficiency virus 2 [HIV-2]
aguaccacggagagaa

SEQ ID NO: 2633562 - RNA, 12 nt, Human immunodeficiency virus 2 [HIV-2]
gccuaggcaggc

SEQ ID NO: 2633563 - RNA, 17 nt, Human immunodeficiency virus 2 [HIV-2]
aacaagacccuggucug

SEQ ID NO: 2633564 - RNA, 20 nt, Human immunodeficiency virus 2 [HIV-2]
uguaagagaccaggaaauaa

SEQ ID NO: 2633565 - RNA, 14 nt, Human immunodeficiency virus 2 [HIV-2]
cagcaaucagggac

SEQ ID NO: 2633566 - RNA, 20 nt, Human immunodeficiency virus 2 [HIV-2]
cagaauuauacucaugggcc

SEQ ID NO: 2633567 - RNA, 12 nt, Human immunodeficiency virus 2 [HIV-2]
aaccaagggagg

SEQ ID NO: 2633568 - RNA, 21 nt, Human immunodeficiency virus 2 [HIV-2]
gcacagcuaaauucaugggga

SEQ ID NO: 2633569 - RNA, 17 nt, Human immunodeficiency virus 2 [HIV-2]
acuucuaacugcauaga

SEQ ID NO: 2633570 - RNA, 14 nt, Human immunodeficiency virus 2 [HIV-2]
ccagaaggggcugu

SEQ ID NO: 2633571 - RNA, 23 nt, Human immunodeficiency virus 2 [HIV-2]
aggcucagacccggaaguggcau

SEQ ID NO: 2633572 - RNA, 15 nt, Human immunodeficiency virus 2 [HIV-2]
gacagaccccagaga

SEQ ID NO: 2633573 - RNA, 24 nt, Human immunodeficiency virus 2 [HIV-2]
aagagucaugugauaagcacuauu

SEQ ID NO: 2633574 - RNA, 20 nt, Human immunodeficiency virus 2 [HIV-2]
gaagaugugguuugugacaa

SEQ ID NO: 2633575 - RNA, 16 nt, Human immunodeficiency virus 2 [HIV-2]
gcagacaugaugauga

SEQ ID NO: 2633576 - RNA, 13 nt, Human immunodeficiency virus 2 [HIV-2]
aguaggaggagac

SEQ ID NO: 2633577 - RNA, 23 nt, Human immunodeficiency virus 2 [HIV-2]
ggaaauaauuuuaaaugugacag

SEQ ID NO: 2633578 - RNA, 17 nt, Human immunodeficiency virus 2 [HIV-2]
ggcacuagagcagaaaa

SEQ ID NO: 2633579 - RNA, 14 nt, Human immunodeficiency virus 2 [HIV-2]
ggcaggaaguagcu

SEQ ID NO: 2633580 - RNA, 21 nt, Human immunodeficiency virus 2 [HIV-2]
uacuccucaacuccagugagg

SEQ ID NO: 2633581 - RNA, 18 nt, Human immunodeficiency virus 2 [HIV-2]
aagaagccuuaagacauu

SEQ ID NO: 2633582 - RNA, 15 nt, Human immunodeficiency virus 2 [HIV-2]
ggaagccaugcagga

SEQ ID NO: 2633583 - RNA, 14 nt, Human immunodeficiency virus 2 [HIV-2]
ggacuccaaggaaa

SEQ ID NO: 2633584 - RNA, 18 nt, Human immunodeficiency virus 2 [HIV-2]
aacaucugcagagacuua

SEQ ID NO: 2633585 - RNA, 12 nt, Human immunodeficiency virus 2 [HIV-2]
agacaugaugau

SEQ ID NO: 2633586 - RNA, 21 nt, Human immunodeficiency virus 2 [HIV-2]
cacccuugaaggcgccagaga

SEQ ID NO: 2633587 - RNA, 20 nt, Human immunodeficiency virus 2 [HIV-2]
caauaacacuuaugucagga

SEQ ID NO: 2633588 - RNA, 17 nt, Human immunodeficiency virus 2 [HIV-2]
caagagagggugcacuu

SEQ ID NO: 2633589 - RNA, 23 nt, Human immunodeficiency virus 2 [HIV-2]
agguacuccucaacuccagugag

SEQ ID NO: 2633590 - RNA, 15 nt, Human immunodeficiency virus 2 [HIV-2]
uggagaaacccagca

SEQ ID NO: 2633591 - RNA, 23 nt, Human immunodeficiency virus 2 [HIV-2]
gccagccaacgaaggaacagaag

SEQ ID NO: 2633592 - RNA, 19 nt, Human immunodeficiency virus 2 [HIV-2]
cucugcggagaggcuggca

SEQ ID NO: 2633593 - RNA, 17 nt, Human immunodeficiency virus 2 [HIV-2]
ugacagaccccagagaa

SEQ ID NO: 2633594 - RNA, 14 nt, Human immunodeficiency virus 2 [HIV-2]
aaguaagaagagcc

SEQ ID NO: 2633595 - RNA, 23 nt, Human immunodeficiency virus 2 [HIV-2]
ggggaauacucgcaguuccaaga

SEQ ID NO: 2633596 - RNA, 16 nt, Human immunodeficiency virus 2 [HIV-2]
agaagagccaucagag

SEQ ID NO: 2633597 - RNA, 21 nt, Human immunodeficiency virus 2 [HIV-2]
agaagccuuaaacagggaggc

SEQ ID NO: 2633598 - RNA, 13 nt, Human immunodeficiency virus 2 [HIV-2]
caagaaccaaaca

SEQ ID NO: 2633599 - RNA, 17 nt, Human immunodeficiency virus 2 [HIV-2]
gaagaagccuuaagaca

SEQ ID NO: 2633600 - RNA, 19 nt, Human immunodeficiency virus 2 [HIV-2]
agcuacuaagaaacagcug

SEQ ID NO: 2633601 - RNA, 18 nt, Human immunodeficiency virus 2 [HIV-2]
cggcaggugaaguaagaa

SEQ ID NO: 2633602 - RNA, 23 nt, Human immunodeficiency virus 2 [HIV-2]
agacaugaugaugagcaugggga

SEQ ID NO: 2633603 - RNA, 18 nt, Human immunodeficiency virus 2 [HIV-2]
agagccaucagaggggaa

SEQ ID NO: 2633604 - RNA, 17 nt, Human immunodeficiency virus 2 [HIV-2]
gggaagccaugcaggag

SEQ ID NO: 2633605 - RNA, 13 nt, Human immunodeficiency virus 2 [HIV-2]
agaggcuggcaga

SEQ ID NO: 2633606 - RNA, 14 nt, Human immunodeficiency virus 2 [HIV-2]
agccaugcaggagg

SEQ ID NO: 2633607 - RNA, 20 nt, Human immunodeficiency virus 2 [HIV-2]
acagcaguaucagcagggag

SEQ ID NO: 2633608 - RNA, 20 nt, Human immunodeficiency virus 2 [HIV-2]
ggaaucaaugauacagggaa

SEQ ID NO: 2633609 - RNA, 12 nt, Human immunodeficiency virus 2 [HIV-2]
uuuggaggcaga

SEQ ID NO: 2633610 - RNA, 20 nt, Human immunodeficiency virus 2 [HIV-2]
ugcagggacuuuccagaagg

SEQ ID NO: 2633611 - RNA, 18 nt, Human immunodeficiency virus 2 [HIV-2]
aagcuaguaucaguagaa

SEQ ID NO: 2633612 - RNA, 15 nt, Human immunodeficiency virus 2 [HIV-2]
gcacaaacaagcaga

SEQ ID NO: 2633613 - RNA, 23 nt, Human immunodeficiency virus 2 [HIV-2]
agggagugacuggguaauagaaa

SEQ ID NO: 2633614 - RNA, 21 nt, Human immunodeficiency virus 2 [HIV-2]
uaaccaagggagggacauggg

SEQ ID NO: 2633615 - RNA, 19 nt, Human immunodeficiency virus 2 [HIV-2]
auaucuauuggcauggcag

SEQ ID NO: 2633616 - RNA, 14 nt, Human immunodeficiency virus 2 [HIV-2]
ucaagagacaacaa

SEQ ID NO: 2633617 - RNA, 18 nt, Human immunodeficiency virus 2 [HIV-2]
acaaguccgcuaccuaga

SEQ ID NO: 2633618 - RNA, 15 nt, Human immunodeficiency virus 2 [HIV-2]
ccgccgacugaucuc

SEQ ID NO: 2633619 - RNA, 21 nt, Human immunodeficiency virus 2 [HIV-2]
ugauggaaacgcaaacuucua

SEQ ID NO: 2633620 - RNA, 18 nt, Human immunodeficiency virus 2 [HIV-2]
cuacaaggccuucacucu

SEQ ID NO: 2633621 - RNA, 16 nt, Human immunodeficiency virus 2 [HIV-2]
gguagaagacaagaac

SEQ ID NO: 2633622 - RNA, 21 nt, Human immunodeficiency virus 2 [HIV-2]
gugcaauuguuaaguagauuu

SEQ ID NO: 2633623 - RNA, 21 nt, Human immunodeficiency virus 2 [HIV-2]
acagcaaucagggacuggcug

SEQ ID NO: 2633624 - RNA, 17 nt, Human immunodeficiency virus 2 [HIV-2]
ccaaauucaacaagaaa

SEQ ID NO: 2633625 - RNA, 12 nt, Human immunodeficiency virus 2 [HIV-2]
augacauggcag

SEQ ID NO: 2633626 - RNA, 22 nt, Human immunodeficiency virus 2 [HIV-2]
ggacagcaguaucagcagggag

SEQ ID NO: 2633627 - RNA, 14 nt, Human immunodeficiency virus 2 [HIV-2]
ugugccuaaugcaa

SEQ ID NO: 2633628 - RNA, 17 nt, Human immunodeficiency virus 2 [HIV-2]
caaacaagcagacauga

SEQ ID NO: 2633629 - RNA, 14 nt, Human immunodeficiency virus 2 [HIV-2]
uguucccugcugga

SEQ ID NO: 2633630 - RNA, 18 nt, Human immunodeficiency virus 2 [HIV-2]
ggccgguacugggcagac

SEQ ID NO: 2633631 - RNA, 19 nt, Human immunodeficiency virus 2 [HIV-2]
cagaaguggcagaacugua

SEQ ID NO: 2633632 - RNA, 18 nt, Human immunodeficiency virus 2 [HIV-2]
uggccgguacugggcaga

SEQ ID NO: 2633633 - RNA, 21 nt, Human immunodeficiency virus 2 [HIV-2]
caggaaguagcuacuaagaaa

SEQ ID NO: 2633634 - RNA, 17 nt, Human immunodeficiency virus 2 [HIV-2]
guagauucugaugauga

SEQ ID NO: 2633635 - RNA, 19 nt, Human immunodeficiency virus 2 [HIV-2]
augaugagcauggggagac

SEQ ID NO: 2633636 - RNA, 18 nt, Human immunodeficiency virus 2 [HIV-2]
agaucgagcccugagagg

SEQ ID NO: 2633637 - RNA, 20 nt, Human immunodeficiency virus 2 [HIV-2]
accgauuagaacugggagac

SEQ ID NO: 2633638 - RNA, 15 nt, Human immunodeficiency virus 2 [HIV-2]
aagaauauguaugaa

SEQ ID NO: 2633639 - RNA, 13 nt, Human immunodeficiency virus 2 [HIV-2]
caguaugugacug

SEQ ID NO: 2633640 - RNA, 18 nt, Human immunodeficiency virus 2 [HIV-2]
cuaacugcagaggagaau

SEQ ID NO: 2633641 - RNA, 23 nt, Human immunodeficiency virus 2 [HIV-2]
ggaggcagauggagggaagccau

SEQ ID NO: 2633642 - RNA, 14 nt, Human immunodeficiency virus 2 [HIV-2]
aguagaacucucac

SEQ ID NO: 2633643 - RNA, 21 nt, Human immunodeficiency virus 2 [HIV-2]
aacaacacaugcgcaggauua

SEQ ID NO: 2633644 - RNA, 23 nt, Human immunodeficiency virus 2 [HIV-2]
ugugcaacuaaaaauagagacac

SEQ ID NO: 2633645 - RNA, 13 nt, Human immunodeficiency virus 2 [HIV-2]
ucuccagcacuag

SEQ ID NO: 2633646 - RNA, 21 nt, Human immunodeficiency virus 2 [HIV-2]
aguuccuguuacaccaagagu

SEQ ID NO: 2633647 - RNA, 14 nt, Human immunodeficiency virus 2 [HIV-2]
caaacaagcagaca

SEQ ID NO: 2633648 - RNA, 15 nt, Human immunodeficiency virus 2 [HIV-2]
agaaauaacaccaau

SEQ ID NO: 2633649 - RNA, 16 nt, Human immunodeficiency virus 2 [HIV-2]
cuuggucaaggcagga

SEQ ID NO: 2633650 - RNA, 15 nt, Human immunodeficiency virus 2 [HIV-2]
aguaacaagacccug

SEQ ID NO: 2633651 - RNA, 20 nt, Human immunodeficiency virus 2 [HIV-2]
ccagccaacgaaggaacaga

SEQ ID NO: 2633652 - RNA, 15 nt, Human immunodeficiency virus 2 [HIV-2]
acaccaauuggcuuc

SEQ ID NO: 2633653 - RNA, 15 nt, Human immunodeficiency virus 2 [HIV-2]
guucucuccagcacu

SEQ ID NO: 2633654 - RNA, 23 nt, Human immunodeficiency virus 2 [HIV-2]
cuuuaauggcacuagagcagaaa

SEQ ID NO: 2633655 - RNA, 19 nt, Human immunodeficiency virus 2 [HIV-2]
agaggcuuuugaugcaugg

SEQ ID NO: 2633656 - RNA, 16 nt, Human immunodeficiency virus 2 [HIV-2]
caagcagacaugauga

SEQ ID NO: 2633657 - RNA, 22 nt, Human immunodeficiency virus 2 [HIV-2]
gacagcaguaucagcagggaga

SEQ ID NO: 2633658 - RNA, 22 nt, Human immunodeficiency virus 2 [HIV-2]
ugcaguuuccauugccagcugu

SEQ ID NO: 2633659 - RNA, 22 nt, Human immunodeficiency virus 2 [HIV-2]
gaagcccaaauucaacaagaaa

SEQ ID NO: 2633660 - RNA, 21 nt, Human immunodeficiency virus 2 [HIV-2]
cauguuacaugagacauugca

SEQ ID NO: 2633661 - RNA, 14 nt, Human immunodeficiency virus 2 [HIV-2]
auuggcauggcaga

SEQ ID NO: 2633662 - RNA, 22 nt, Human immunodeficiency virus 2 [HIV-2]
aaagcagauaauuaauaccugg

SEQ ID NO: 2633663 - RNA, 21 nt, Human immunodeficiency virus 2 [HIV-2]
cagugaggaacaaaagaggug

SEQ ID NO: 2633664 - RNA, 11 nt, Human immunodeficiency virus 2 [HIV-2]
ccauacagugc

SEQ ID NO: 2633665 - RNA, 14 nt, Human immunodeficiency virus 2 [HIV-2]
auaauacagugaca

SEQ ID NO: 2633666 - RNA, 20 nt, Human immunodeficiency virus 2 [HIV-2]
aaaauaugacauggcaggag

SEQ ID NO: 2633667 - RNA, 23 nt, Human immunodeficiency virus 2 [HIV-2]
aaagaauggaaggcaaaacugaa

SEQ ID NO: 2633668 - RNA, 17 nt, Human immunodeficiency virus 2 [HIV-2]
cagagucuaacagcaau

SEQ ID NO: 2633669 - RNA, 17 nt, Human immunodeficiency virus 2 [HIV-2]
gagaaguaccuaaagca

SEQ ID NO: 2633670 - RNA, 15 nt, Human immunodeficiency virus 2 [HIV-2]
cugaggcugcaggga

SEQ ID NO: 2633671 - RNA, 13 nt, Human immunodeficiency virus 2 [HIV-2]
ucagcagggagag

SEQ ID NO: 2633672 - RNA, 15 nt, Human immunodeficiency virus 2 [HIV-2]
uagaagccuuaaaca

SEQ ID NO: 2633673 - RNA, 20 nt, Human immunodeficiency virus 2 [HIV-2]
caagggagggacaugggagg

SEQ ID NO: 2633674 - RNA, 22 nt, Human immunodeficiency virus 2 [HIV-2]
ucaauauggagugcauauagua

SEQ ID NO: 2633675 - RNA, 21 nt, Human immunodeficiency virus 2 [HIV-2]
aggcuggcagaucgagcccug

SEQ ID NO: 2633676 - RNA, 16 nt, Human immunodeficiency virus 2 [HIV-2]
uguggacuaacugcag

SEQ ID NO: 2633677 - RNA, 12 nt, Human immunodeficiency virus 2 [HIV-2]
uucuaacugcau

SEQ ID NO: 2633678 - RNA, 18 nt, Human immunodeficiency virus 2 [HIV-2]
agcaguaucagcagggag

SEQ ID NO: 2633679 - RNA, 15 nt, Human immunodeficiency virus 2 [HIV-2]
guauuuagaagaugu

SEQ ID NO: 2633680 - RNA, 23 nt, Human immunodeficiency virus 2 [HIV-2]
cuucgaguggcuagagaggacca

SEQ ID NO: 2633681 - RNA, 16 nt, Human immunodeficiency virus 2 [HIV-2]
caacacaugcgcagga

SEQ ID NO: 2633682 - RNA, 19 nt, Human immunodeficiency virus 2 [HIV-2]
guagagccuggguguuccc

SEQ ID NO: 2633683 - RNA, 14 nt, Human immunodeficiency virus 2 [HIV-2]
aauaaagcugccag

SEQ ID NO: 2633684 - RNA, 18 nt, Human immunodeficiency virus 2 [HIV-2]
uaagguacccaauguacu

SEQ ID NO: 2633685 - RNA, 23 nt, Human immunodeficiency virus 2 [HIV-2]
gaacucgcccuccugugagggac

SEQ ID NO: 2633686 - RNA, 22 nt, Human immunodeficiency virus 2 [HIV-2]
aauaacacuuaugucaggauua

SEQ ID NO: 2633687 - RNA, 16 nt, Human immunodeficiency virus 2 [HIV-2]
ccagcaacagaaagac

SEQ ID NO: 2633688 - RNA, 21 nt, Human immunodeficiency virus 2 [HIV-2]
gcccaaauucaacaagaaaag

SEQ ID NO: 2633689 - RNA, 18 nt, Human immunodeficiency virus 2 [HIV-2]
ggacuuagggagugacug

SEQ ID NO: 2633690 - RNA, 18 nt, Human immunodeficiency virus 2 [HIV-2]
gccaggaaacaguggaga

SEQ ID NO: 2633691 - RNA, 17 nt, Human immunodeficiency virus 2 [HIV-2]
agucgccgccuggucau

SEQ ID NO: 2633692 - RNA, 12 nt, Human immunodeficiency virus 2 [HIV-2]
caaggagaagaa

SEQ ID NO: 2633693 - RNA, 16 nt, Human immunodeficiency virus 2 [HIV-2]
agagggauaccauaua

SEQ ID NO: 2633694 - RNA, 23 nt, Human immunodeficiency virus 2 [HIV-2]
aggcuuugaaccuaagugcacua

SEQ ID NO: 2633695 - RNA, 19 nt, Human immunodeficiency virus 2 [HIV-2]
uacaaauuaauagaaauaa

SEQ ID NO: 2633696 - RNA, 17 nt, Human immunodeficiency virus 2 [HIV-2]
cugagagguucucucca

SEQ ID NO: 2633697 - RNA, 14 nt, Human immunodeficiency virus 2 [HIV-2]
aucaggcagggagc

SEQ ID NO: 2633698 - RNA, 19 nt, Human immunodeficiency virus 2 [HIV-2]
gaugugcguuuagacaggu

SEQ ID NO: 2633699 - RNA, 24 nt, Human immunodeficiency virus 2 [HIV-2]
caguagaacucucacaagaggcag

SEQ ID NO: 2633700 - RNA, 13 nt, Human immunodeficiency virus 2 [HIV-2]
ccagcaacagaaa

SEQ ID NO: 2633701 - RNA, 14 nt, Human immunodeficiency virus 2 [HIV-2]
accacggagagaaa

SEQ ID NO: 2633702 - RNA, 21 nt, Human immunodeficiency virus 2 [HIV-2]
agaagaugggaccccacggag

SEQ ID NO: 2633703 - RNA, 12 nt, Human immunodeficiency virus 2 [HIV-2]
ucugcggagagg

SEQ ID NO: 2633704 - RNA, 23 nt, Human immunodeficiency virus 2 [HIV-2]
cccaauguacuucggguggcugu

SEQ ID NO: 2633705 - RNA, 19 nt, Human immunodeficiency virus 2 [HIV-2]
cuuacuguauaaauguacc

SEQ ID NO: 2633706 - RNA, 12 nt, Human immunodeficiency virus 2 [HIV-2]
aucucccagagu

SEQ ID NO: 2633707 - RNA, 16 nt, Human immunodeficiency virus 2 [HIV-2]
agcgcgacgcaucggg

SEQ ID NO: 2633708 - RNA, 14 nt, Human immunodeficiency virus 2 [HIV-2]
aggcaaaacugaaa

SEQ ID NO: 2633709 - RNA, 19 nt, Human immunodeficiency virus 2 [HIV-2]
acagcaguaucagcaggga

SEQ ID NO: 2633710 - RNA, 17 nt, Human immunodeficiency virus 2 [HIV-2]
agcagguagagccuggg

SEQ ID NO: 2633711 - RNA, 19 nt, Human immunodeficiency virus 2 [HIV-2]
ccaacgaaggaacagaaga

SEQ ID NO: 2633712 - RNA, 13 nt, Human immunodeficiency virus 2 [HIV-2]
caggaacaaccau

SEQ ID NO: 2633713 - RNA, 13 nt, Human immunodeficiency virus 2 [HIV-2]
ggucaaggcagga

SEQ ID NO: 2633714 - RNA, 21 nt, Human immunodeficiency virus 2 [HIV-2]
acgcuugcuugcuuaaagacc

SEQ ID NO: 2633715 - RNA, 21 nt, Human immunodeficiency virus 2 [HIV-2]
cccagcacaaacaagcagaca

SEQ ID NO: 2633716 - RNA, 16 nt, Human immunodeficiency virus 2 [HIV-2]
cugcggagaggcuggc

SEQ ID NO: 2633717 - RNA, 12 nt, Human immunodeficiency virus 2 [HIV-2]
uuaucaggaaau

SEQ ID NO: 2633718 - RNA, 19 nt, Human immunodeficiency virus 2 [HIV-2]
gggaauccaaggcaggaaa

SEQ ID NO: 2633719 - RNA, 19 nt, Human immunodeficiency virus 2 [HIV-2]
aaguagcuacuaagaaaca

SEQ ID NO: 2633720 - RNA, 15 nt, Human immunodeficiency virus 2 [HIV-2]
ucucgcgacagcagg

SEQ ID NO: 2633721 - RNA, 16 nt, Human immunodeficiency virus 2 [HIV-2]
gcuugcuuaguauauu

SEQ ID NO: 2633722 - RNA, 23 nt, Human immunodeficiency virus 2 [HIV-2]
guguucccugcuggacucucacc

SEQ ID NO: 2633723 - RNA, 13 nt, Human immunodeficiency virus 2 [HIV-2]
acaacgagcccuc

SEQ ID NO: 2633724 - RNA, 22 nt, Human immunodeficiency virus 2 [HIV-2]
cagaagaguuugggcacaaguc

SEQ ID NO: 2633725 - RNA, 13 nt, Human immunodeficiency virus 2 [HIV-2]
gccugugaaucaa

SEQ ID NO: 2633726 - RNA, 17 nt, Human immunodeficiency virus 2 [HIV-2]
guggacuaacugcagag

SEQ ID NO: 2633727 - RNA, 21 nt, Human immunodeficiency virus 2 [HIV-2]
aagaaacagcugaggcugcag

SEQ ID NO: 2633728 - RNA, 18 nt, Human immunodeficiency virus 2 [HIV-2]
gaagccuuaaacagggag

SEQ ID NO: 2633729 - RNA, 14 nt, Human immunodeficiency virus 2 [HIV-2]
cagauggagggaag

SEQ ID NO: 2633730 - RNA, 20 nt, Human immunodeficiency virus 2 [HIV-2]
gcaccuacagaucagagaag

SEQ ID NO: 2633731 - RNA, 18 nt, Human immunodeficiency virus 2 [HIV-2]
aaguagauuuagaaaggg

SEQ ID NO: 2633732 - RNA, 15 nt, Human immunodeficiency virus 2 [HIV-2]
acagcaaucagggac

SEQ ID NO: 2633733 - RNA, 18 nt, Human immunodeficiency virus 2 [HIV-2]
aaauucauggggaugugc

SEQ ID NO: 2633734 - RNA, 15 nt, Human immunodeficiency virus 2 [HIV-2]
caacaaaaugacaga

SEQ ID NO: 2633735 - RNA, 18 nt, Human immunodeficiency virus 2 [HIV-2]
auacuuggucaaggcagg

SEQ ID NO: 2633736 - RNA, 19 nt, Human immunodeficiency virus 2 [HIV-2]
cuugcgggcgcguggggau

SEQ ID NO: 2633737 - RNA, 13 nt, Human immunodeficiency virus 2 [HIV-2]
acugcagaggaga

SEQ ID NO: 2633738 - RNA, 11 nt, Human immunodeficiency virus 2 [HIV-2]
ugcccagcugc

SEQ ID NO: 2633739 - RNA, 21 nt, Human immunodeficiency virus 2 [HIV-2]
cagcaguaucagcagggagag

SEQ ID NO: 2633740 - RNA, 18 nt, Human immunodeficiency virus 2 [HIV-2]
acucgcaguuccaagaag

SEQ ID NO: 2633741 - RNA, 13 nt, Human immunodeficiency virus 2 [HIV-2]
cuagagaggacca

SEQ ID NO: 2633742 - RNA, 17 nt, Human immunodeficiency virus 2 [HIV-2]
uaucauuagcuuaaaca

SEQ ID NO: 2633743 - RNA, 21 nt, Human immunodeficiency virus 2 [HIV-2]
gaacucucacaagaggcagag

SEQ ID NO: 2633744 - RNA, 14 nt, Human immunodeficiency virus 2 [HIV-2]
accagauuggcaga

SEQ ID NO: 2633745 - RNA, 16 nt, Human immunodeficiency virus 2 [HIV-2]
auugccagcuguguuu

SEQ ID NO: 2633746 - RNA, 11 nt, Human immunodeficiency virus 2 [HIV-2]
cugguggggaa

SEQ ID NO: 2633747 - RNA, 14 nt, Human immunodeficiency virus 2 [HIV-2]
aaagcaagagggau

SEQ ID NO: 2633748 - RNA, 19 nt, Human immunodeficiency virus 2 [HIV-2]
uggaaaaauaugacauggc

SEQ ID NO: 2633749 - RNA, 24 nt, Human immunodeficiency virus 2 [HIV-2]
gccaaucaacacaaggccuaggca

SEQ ID NO: 2633750 - RNA, 19 nt, Human immunodeficiency virus 2 [HIV-2]
ggaauccaaggcaggaaaa

SEQ ID NO: 2633751 - RNA, 21 nt, Human immunodeficiency virus 2 [HIV-2]
agaauuggcuaaacaaggaga

SEQ ID NO: 2633752 - RNA, 22 nt, Human immunodeficiency virus 2 [HIV-2]
uuccucaauuggguagaagaca

SEQ ID NO: 2633753 - RNA, 17 nt, Human immunodeficiency virus 2 [HIV-2]
cuuaguacacccagcac

SEQ ID NO: 2633754 - RNA, 12 nt, Human
aaaaacacagca

SEQ ID NO: 2633755 - RNA, 17 nt, Human
aaaacaaggaugaauua

SEQ ID NO: 2633756 - RNA, 18 nt, Human
aaaacacagcaaggguga

SEQ ID NO: 2633757 - RNA, 13 nt, Human
aaaacacagcaag

SEQ ID NO: 2633758 - RNA, 12 nt, Human
aaaacacagcaa

SEQ ID NO: 2633759 - RNA, 14 nt, Human
aaaacaaggaugaa

SEQ ID NO: 2633760 - RNA, 17 nt, Human
aggauguugaaaaaguu

SEQ ID NO: 2633761 - RNA, 14 nt, Human
aggauguugaaaaa

SEQ ID NO: 2633762 - RNA, 14 nt, Human
agcuguaugauucc

SEQ ID NO: 2633763 - RNA, 21 nt, Human
agauaggucagugcaaauacu

SEQ ID NO: 2633764 - RNA, 17 nt, Human
agacugcauuauauuua

SEQ ID NO: 2633765 - RNA, 12 nt, Human
agcaugaagaca

SEQ ID NO: 2633766 - RNA, 15 nt, Human
agcaugaagacagag

SEQ ID NO: 2633767 - RNA, 15 nt, Human
agccagauuuuccug

SEQ ID NO: 2633768 - RNA, 19 nt, Human
agccagauuuuccugaaaa

SEQ ID NO: 2633769 - RNA, 20 nt, Human
agcaguucagagcugcccuc

SEQ ID NO: 2633770 - RNA, 19 nt, Human
agcaguucagagcugcccu

SEQ ID NO: 2633771 - RNA, 21 nt, Human
agaugggagaaucacuugaac

SEQ ID NO: 2633772 - RNA, 14 nt, Human
agauguagaggaga

SEQ ID NO: 2633773 - RNA, 21 nt, Human
agcaguugaaaagacuccaaa

SEQ ID NO: 2633774 - RNA, 23 nt, Human
agcaguugaaaagacuccaaaga

SEQ ID NO: 2633775 - RNA, 16 nt, Human
agcaguucagagcugc

SEQ ID NO: 2633776 - RNA, 15 nt, Human
agcaguucagagcug

SEQ ID NO: 2633777 - RNA, 17 nt, Human
agcaguucagagcugcc

SEQ ID NO: 2633778 - RNA, 18 nt, Human
agcaguucagagcugccc

SEQ ID NO: 2633779 - RNA, 19 nt, Human
agccccacccucagaugca

SEQ ID NO: 2633780 - RNA, 21 nt, Human
agccgggcgugguggugagug

SEQ ID NO: 2633781 - RNA, 16 nt, Human
augucaaucagccuag

SEQ ID NO: 2633782 - RNA, 20 nt, Human
auguaagggaaacugccagc

SEQ ID NO: 2633783 - RNA, 22 nt, Human
auguaagggaaacugccagcaa

SEQ ID NO: 2633784 - RNA, 21 nt, Human
auguaagggaaacugccagca

SEQ ID NO: 2633785 - RNA, 17 nt, Human
aucagcugcugaaacaa

SEQ ID NO: 2633786 - RNA, 22 nt, Human
aucuuauaauuuaaaauaugcu

SEQ ID NO: 2633787 - RNA, 16 nt, Human
aguccaagcauuuaga

SEQ ID NO: 2633788 - RNA, 21 nt, Human
aguccaagcauuuagauguau

SEQ ID NO: 2633789 - RNA, 15 nt, Human
agucaaauuguguga

SEQ ID NO: 2633790 - RNA, 17 nt, Human
agucaaauugugugaaa

SEQ ID NO: 2633791 - RNA, 13 nt, Human
agucaaauugugu

SEQ ID NO: 2633792 - RNA, 15 nt, Human
agugauuaccaggga

SEQ ID NO: 2633793 - RNA, 18 nt, Human
agugauuaccagggacug

SEQ ID NO: 2633794 - RNA, 19 nt, Human
aguuguaccgcaaugugac

SEQ ID NO: 2633795 - RNA, 18 nt, Human
aguuguaccgcaauguga

SEQ ID NO: 2633796 - RNA, 14 nt, Human
auaauuacuauguc

SEQ ID NO: 2633797 - RNA, 18 nt, Human
auauuuauuuuaauaaug

SEQ ID NO: 2633798 - RNA, 14 nt, Human
auauuuauuacugu

SEQ ID NO: 2633799 - RNA, 19 nt, Human
auauuuauuacuguaagaa

SEQ ID NO: 2633800 - RNA, 23 nt, Human
auauuucagauaaucacaauaca

SEQ ID NO: 2633801 - RNA, 23 nt, Human
auaugcuucuguuuuauaauuuu

SEQ ID NO: 2633802 - RNA, 18 nt, Human
auaucacuugucaauaaa

SEQ ID NO: 2633803 - RNA, 15 nt, Human
auaucaauuuaaaaa

SEQ ID NO: 2633804 - RNA, 18 nt, Human
acagcaguugaaaagacu

SEQ ID NO: 2633805 - RNA, 15 nt, Human
acagcaguugaaaag

SEQ ID NO: 2633806 - RNA, 16 nt, Human
acagccagacuggcac

SEQ ID NO: 2633807 - RNA, 15 nt, Human
acagccagacuggca

SEQ ID NO: 2633808 - RNA, 13 nt, Human
acagccagacugg

SEQ ID NO: 2633809 - RNA, 20 nt, Human
acagcucugcauacucauua

SEQ ID NO: 2633810 - RNA, 13 nt, Human
acaacuauauugu

SEQ ID NO: 2633811 - RNA, 15 nt, Human
acccacaagaaauga

SEQ ID NO: 2633812 - RNA, 16 nt, Human
acccaaguccaagcau

SEQ ID NO: 2633813 - RNA, 14 nt, Human
acauuuguauaaaa

SEQ ID NO: 2633814 - RNA, 18 nt, Human
acauuugcucauggaauu

SEQ ID NO: 2633815 - RNA, 13 nt, Human
acauguuacaaca

SEQ ID NO: 2633816 - RNA, 18 nt, Human
acuuguaaaggaauuuaa

SEQ ID NO: 2633817 - RNA, 15 nt, Human
acuuggucugugaga

SEQ ID NO: 2633818 - RNA, 14 nt, Human
acuuggucugugag

SEQ ID NO: 2633819 - RNA, 20 nt, Human
acuuguaaaggaauuuaaaa

SEQ ID NO: 2633820 - RNA, 19 nt, Human
acuuguaaaggaauuuaaa

SEQ ID NO: 2633821 - RNA, 14 nt, Human
acuagcuauggugu

SEQ ID NO: 2633822 - RNA, 14 nt, Human
acucaaaucaagaa

SEQ ID NO: 2633823 - RNA, 13 nt, Human
acucccuuucaac

SEQ ID NO: 2633824 - RNA, 12 nt, Human
acucccuuucaa

SEQ ID NO: 2633825 - RNA, 16 nt, Human
acgugcacgcacacug

SEQ ID NO: 2633826 - RNA, 15 nt, Human
acuaagagagaauga

SEQ ID NO: 2633827 - RNA, 16 nt, Human
acuaagagagaaugag

SEQ ID NO: 2633828 - RNA, 15 nt, Human
aacacgagcaggcua

SEQ ID NO: 2633829 - RNA, 23 nt, Human
aacugacacaugcugaacaucac

SEQ ID NO: 2633830 - RNA, 14 nt, Human
aagaaauguaaggg

SEQ ID NO: 2633831 - RNA, 13 nt, Human
aagaaauguaagg

SEQ ID NO: 2633832 - RNA, 17 nt, Human
aaacugacucuuaagaa

SEQ ID NO: 2633833 - RNA, 15 nt, Human
aaacugccagcaacg

SEQ ID NO: 2633834 - RNA, 14 nt, Human
aaacugccagcaac

SEQ ID NO: 2633835 - RNA, 16 nt, Human
aaacugacucuuaaga

SEQ ID NO: 2633836 - RNA, 19 nt, Human
aaacugccagcaacgcagg

SEQ ID NO: 2633837 - RNA, 17 nt, Human
aaagaugaaaauauuug

SEQ ID NO: 2633838 - RNA, 16 nt, Human
aaagaugaaaauauuu

SEQ ID NO: 2633839 - RNA, 13 nt, Human
aaagaugaaaaua

SEQ ID NO: 2633840 - RNA, 18 nt, Human
aaauggcuuccuggcaau

SEQ ID NO: 2633841 - RNA, 19 nt, Human
aaaucaaauaugcaaagca

SEQ ID NO: 2633842 - RNA, 18 nt, Human
aaaucaaauaugcaaagc

SEQ ID NO: 2633843 - RNA, 12 nt, Human
aaauaacaauga

SEQ ID NO: 2633844 - RNA, 14 nt, Human
aauuaguuuuauau

SEQ ID NO: 2633845 - RNA, 17 nt, Human
aauuaguuuuauaugcu

SEQ ID NO: 2633846 - RNA, 20 nt, Human
aauuaguuuuauaugcuucu

SEQ ID NO: 2633847 - RNA, 17 nt, Human
aaugauaacuggaaacu

SEQ ID NO: 2633848 - RNA, 20 nt, Human
aaugauaacuggaaacuuca

SEQ ID NO: 2633849 - RNA, 13 nt, Human
aauccauacauuu

SEQ ID NO: 2633850 - RNA, 14 nt, Human
aauccauacauuug

SEQ ID NO: 2633851 - RNA, 16 nt, Human
aauauuauguuaaaac

SEQ ID NO: 2633852 - RNA, 15 nt, Human
aaucaagaaacuuaa

SEQ ID NO: 2633853 - RNA, 13 nt, Human
aaucacaauacau

SEQ ID NO: 2633854 - RNA, 13 nt, Human
aagccagauuuuc

SEQ ID NO: 2633855 - RNA, 16 nt, Human
aagauuuaccacuugu

SEQ ID NO: 2633856 - RNA, 19 nt, Human
aauaaaauggguuuuacug

SEQ ID NO: 2633857 - RNA, 14 nt, Human
aauaaaauggguuu

SEQ ID NO: 2633858 - RNA, 21 nt, Human
aauaauccuaaacauaugaau

SEQ ID NO: 2633859 - RNA, 20 nt, Human
ggcuaagcuucacuguaaaa

SEQ ID NO: 2633860 - RNA, 16 nt, Human
ggccuucggccuccau

SEQ ID NO: 2633861 - RNA, 22 nt, Human
ggccuucggccuccauccugag

SEQ ID NO: 2633862 - RNA, 18 nt, Human
ggccuucggccuccaucc

SEQ ID NO: 2633863 - RNA, 13 nt, Human
aaaaauacaaaaa

SEQ ID NO: 2633864 - RNA, 17 nt, Human
aaaguauguuagugcaa

SEQ ID NO: 2633865 - RNA, 12 nt, Human
gguuucuagcau

SEQ ID NO: 2633866 - RNA, 19 nt, Human
gguuuuauuguuuaaaauc

SEQ ID NO: 2633867 - RNA, 20 nt, Human
aaagggcuguuauaaucuuu

SEQ ID NO: 2633868 - RNA, 22 nt, Human
aaagggcuguuauaaucuuuca

SEQ ID NO: 2633869 - RNA, 13 nt, Human
aaagcuuauuaaa

SEQ ID NO: 2633870 - RNA, 19 nt, Human
aaacuuuaugcuaagugaa

SEQ ID NO: 2633871 - RNA, 12 nt, Human
aaacuuuaugcu

SEQ ID NO: 2633872 - RNA, 16 nt, Human
aaagcagaacagugau

SEQ ID NO: 2633873 - RNA, 17 nt, Human
aaauaugcaaagcacug

SEQ ID NO: 2633874 - RNA, 16 nt, Human
aaauaugcaaagcacu

SEQ ID NO: 2633875 - RNA, 15 nt, Human
aaauaugcaaagcac

SEQ ID NO: 2633876 - RNA, 13 nt, Human
aaauaugcaaagc

SEQ ID NO: 2633877 - RNA, 21 nt, Human
aaauaccaugccauuuaaagc

SEQ ID NO: 2633878 - RNA, 18 nt, Human
aaauauaugcuaagucuu

SEQ ID NO: 2633879 - RNA, 22 nt, Human
aaauaucacuugucaauaaaau

SEQ ID NO: 2633880 - RNA, 13 nt, Human
guaauaaacucau

SEQ ID NO: 2633881 - RNA, 20 nt, Human
ggguuuuauuguuuaaaauc

SEQ ID NO: 2633882 - RNA, 14 nt, Human
ggucagugcaaaua

SEQ ID NO: 2633883 - RNA, 18 nt, Human
aaaaugguuuaaaugguc

SEQ ID NO: 2633884 - RNA, 16 nt, Human
aaaaugguuuaaaugg

SEQ ID NO: 2633885 - RNA, 16 nt, Human
aaaauggguuuuacug

SEQ ID NO: 2633886 - RNA, 17 nt, Human
aaaaucucaauauuuca

SEQ ID NO: 2633887 - RNA, 11 nt, Human
aaaauaauuuu

SEQ ID NO: 2633888 - RNA, 14 nt, Human
aaaauacacacuca

SEQ ID NO: 2633889 - RNA, 16 nt, Human
aaaauaauuuuuauau

SEQ ID NO: 2633890 - RNA, 17 nt, Human
aaaauaauuuuuauauu

SEQ ID NO: 2633891 - RNA, 14 nt, Human
gcugccuccccucc

SEQ ID NO: 2633892 - RNA, 13 nt, Human
gcugcugaaacaa

SEQ ID NO: 2633893 - RNA, 21 nt, Human
gcuguauuuuaaaagaaugau

SEQ ID NO: 2633894 - RNA, 20 nt, Human
gcuguauuuuaaaagaauga

SEQ ID NO: 2633895 - RNA, 18 nt, Human
gcuguauuuuaaaagaau

SEQ ID NO: 2633896 - RNA, 19 nt, Human
ggaaaucaggguuaguauu

SEQ ID NO: 2633897 - RNA, 21 nt, Human
ggacagucaccucauggaauu

SEQ ID NO: 2633898 - RNA, 17 nt, Human
ggacagucaccucaugg

SEQ ID NO: 2633899 - RNA, 18 nt, Human
ggacagucaccucaugga

SEQ ID NO: 2633900 - RNA, 16 nt, Human
ggaaaaaauaacaaug

SEQ ID NO: 2633901 - RNA, 13 nt, Human
ggaaacugccagc

SEQ ID NO: 2633902 - RNA, 22 nt, Human
gccucauguccacugguucuuc

SEQ ID NO: 2633903 - RNA, 15 nt, Human
gccuccauccugagg

SEQ ID NO: 2633904 - RNA, 14 nt, Human
gccuccauccugag

SEQ ID NO: 2633905 - RNA, 13 nt, Human
gccuccauccuga

SEQ ID NO: 2633906 - RNA, 12 nt, Human
gcauuuagaugu

SEQ ID NO: 2633907 - RNA, 19 nt, Human
gcauuuaggccaugggaca

SEQ ID NO: 2633908 - RNA, 13 nt, Human
gcauuuagaugua

SEQ ID NO: 2633909 - RNA, 11 nt, Human
gccccaaaagg

SEQ ID NO: 2633910 - RNA, 15 nt, Human
gcagcucuccccuuc

SEQ ID NO: 2633911 - RNA, 22 nt, Human
gcagaacagugauuaccaggga

SEQ ID NO: 2633912 - RNA, 18 nt, Human
gcagaacagugauuacca

SEQ ID NO: 2633913 - RNA, 13 nt, Human
gcagaacagugau

SEQ ID NO: 2633914 - RNA, 12 nt, Human
gcagaacaguga

SEQ ID NO: 2633915 - RNA, 20 nt, Human
gcaucuagcaugucgucaaa

SEQ ID NO: 2633916 - RNA, 22 nt, Human
gcaguuguugcccacagcugua

SEQ ID NO: 2633917 - RNA, 13 nt, Human
gcagugaugucac

SEQ ID NO: 2633918 - RNA, 14 nt, Human
gaaugaauggcuaa

SEQ ID NO: 2633919 - RNA, 13 nt, Human
gaauuacauuugu

SEQ ID NO: 2633920 - RNA, 20 nt, Human
gaauuacauuuguauaaaau

SEQ ID NO: 2633921 - RNA, 15 nt, Human
gaauuacauuuguau

SEQ ID NO: 2633922 - RNA, 18 nt, Human
gaauuacauuuguauaaa

SEQ ID NO: 2633923 - RNA, 15 nt, Human
gaauuaacacaugau

SEQ ID NO: 2633924 - RNA, 14 nt, Human
gaauuaacacauga

SEQ ID NO: 2633925 - RNA, 22 nt, Human
gaaugauuaugaauuacauuug

SEQ ID NO: 2633926 - RNA, 14 nt, Human
gaaugauuaugaau

SEQ ID NO: 2633927 - RNA, 20 nt, Human
gaaugaauggcuaagcaaaa

SEQ ID NO: 2633928 - RNA, 15 nt, Human
gaaugaauggcuaag

SEQ ID NO: 2633929 - RNA, 12 nt, Human
gacagcucugca

SEQ ID NO: 2633930 - RNA, 18 nt, Human
gacagucaccucauggaa

SEQ ID NO: 2633931 - RNA, 14 nt, Human
gacgcucucuggcc

SEQ ID NO: 2633932 - RNA, 22 nt, Human
gacuuuuuauggcacuaguauu

SEQ ID NO: 2633933 - RNA, 16 nt, Human
gagaugcuagaacucc

SEQ ID NO: 2633934 - RNA, 20 nt, Human
gagaugcuagaacucccuuu

SEQ ID NO: 2633935 - RNA, 21 nt, Human
gagauugugccccugcacucc

SEQ ID NO: 2633936 - RNA, 14 nt, Human
gaggagaaacugga

SEQ ID NO: 2633937 - RNA, 12 nt, Human
gaggagaaacug

SEQ ID NO: 2633938 - RNA, 20 nt, Human
gaggacgcucucuggccuuc

SEQ ID NO: 2633939 - RNA, 21 nt, Human
gaggacgcucucuggccuucg

SEQ ID NO: 2633940 - RNA, 18 nt, Human
gaggcugagaugggagaa

SEQ ID NO: 2633941 - RNA, 17 nt, Human
gaggcuccacuuggucu

SEQ ID NO: 2633942 - RNA, 12 nt, Human
gaggcuccacuu

SEQ ID NO: 2633943 - RNA, 15 nt, Human
gaggcuccacuuggu

SEQ ID NO: 2633944 - RNA, 16 nt, Human
gagccccacccucaga

SEQ ID NO: 2633945 - RNA, 17 nt, Human
gagccccacccucagau

SEQ ID NO: 2633946 - RNA, 14 nt, Human
gagcagucaggaaa

SEQ ID NO: 2633947 - RNA, 22 nt, Human
gagcuguucacagccagacugg

SEQ ID NO: 2633948 - RNA, 17 nt, Human
gagcuguucacagccag

SEQ ID NO: 2633949 - RNA, 20 nt, Human
gagcuguucacagccagacu

SEQ ID NO: 2633950 - RNA, 22 nt, Human
cuucucuguauuccuagaaacu

SEQ ID NO: 2633951 - RNA, 23 nt, Human
cuuggucucagugucaaugcagc

SEQ ID NO: 2633952 - RNA, 21 nt, Human
gaaaagacuccaaagaaaugu

SEQ ID NO: 2633953 - RNA, 18 nt, Human
gaaaagacuccaaagaaa

SEQ ID NO: 2633954 - RNA, 20 nt, Human
gaaaagacuccaaagaaaug

SEQ ID NO: 2633955 - RNA, 23 nt, Human
gaaacuucagcgguuuauauaag

SEQ ID NO: 2633956 - RNA, 23 nt, Human
gaacaaauuuacagagacagaaa

SEQ ID NO: 2633957 - RNA, 18 nt, Human
gaacaaauuuacagagac

SEQ ID NO: 2633958 - RNA, 17 nt, Human
gaacaaauuuacagaga

SEQ ID NO: 2633959 - RNA, 18 nt, Human
gaaaugaaagcagggacu

SEQ ID NO: 2633960 - RNA, 23 nt, Human
gaaaucaaauaugcaaagcacug

SEQ ID NO: 2633961 - RNA, 17 nt, Human
gaaaugaaagcagggac

SEQ ID NO: 2633962 - RNA, 17 nt, Human
gaaaucaaauaugcaaa

SEQ ID NO: 2633963 - RNA, 21 nt, Human
gaaaucaaauaugcaaagcac

SEQ ID NO: 2633964 - RNA, 16 nt, Human
gaaaucaaauaugcaa

SEQ ID NO: 2633965 - RNA, 23 nt, Human
cuggaaaaguauguuagugcaaa

SEQ ID NO: 2633966 - RNA, 17 nt, Human
cugccuccccuccucug

SEQ ID NO: 2633967 - RNA, 18 nt, Human
cugccuccccuccucugc

SEQ ID NO: 2633968 - RNA, 21 nt, Human
cugccuccccuccucugcuug

SEQ ID NO: 2633969 - RNA, 19 nt, Human
cugccuccccuccucugcu

SEQ ID NO: 2633970 - RNA, 20 nt, Human
cugccuccccuccucugcuu

SEQ ID NO: 2633971 - RNA, 21 nt, Human
cugugagaugcuagaacuccc

SEQ ID NO: 2633972 - RNA, 23 nt, Human
cugugagaugcuagaacucccuu

SEQ ID NO: 2633973 - RNA, 22 nt, Human
cuguucacagccagacuggcac

SEQ ID NO: 2633974 - RNA, 19 nt, Human
cuguucacagccagacugg

SEQ ID NO: 2633975 - RNA, 12 nt, Human
cuguucacagcc

SEQ ID NO: 2633976 - RNA, 12 nt, Human
cuuaaaaauggu

SEQ ID NO: 2633977 - RNA, 20 nt, Human
cuuaaaaaugguuuaaaugg

SEQ ID NO: 2633978 - RNA, 13 nt, Human
cuuaaaaaugguu

SEQ ID NO: 2633979 - RNA, 20 nt, Human
cuguaagaaaauaucacuug

SEQ ID NO: 2633980 - RNA, 15 nt, Human
cugaaacaacaaaua

SEQ ID NO: 2633981 - RNA, 16 nt, Human
cucuccccuucucugu

SEQ ID NO: 2633982 - RNA, 21 nt, Human
cucuuagaugcaguucugaag

SEQ ID NO: 2633983 - RNA, 22 nt, Human
cucuuagaugcaguucugaaga

SEQ ID NO: 2633984 - RNA, 15 nt, Human
cuccacuuggucugu

SEQ ID NO: 2633985 - RNA, 13 nt, Human
cuccacuuggucu

SEQ ID NO: 2633986 - RNA, 22 nt, Human
cuccacuuggucugugagaugc

SEQ ID NO: 2633987 - RNA, 21 nt, Human
cuccacuuggucugugagaug

SEQ ID NO: 2633988 - RNA, 17 nt, Human
cuccacuuggucuguga

SEQ ID NO: 2633989 - RNA, 16 nt, Human
cuccacuuggucugug

SEQ ID NO: 2633990 - RNA, 18 nt, Human
cucaguagucagacugga

SEQ ID NO: 2633991 - RNA, 19 nt, Human
cuccccaugauguuuagaa

SEQ ID NO: 2633992 - RNA, 23 nt, Human
cuccacuuggucugugagaugcu

SEQ ID NO: 2633993 - RNA, 14 nt, Human
cucguuaauuugua

SEQ ID NO: 2633994 - RNA, 12 nt, Human
cuccucugcuug

SEQ ID NO: 2633995 - RNA, 14 nt, Human
cuccucugcuugcc

SEQ ID NO: 2633996 - RNA, 22 nt, Human
cuccugggcagcugccuccccu

SEQ ID NO: 2633997 - RNA, 18 nt, Human
cuccugggcagcugccuc

SEQ ID NO: 2633998 - RNA, 19 nt, Human
cuccugggcagcugccucc

SEQ ID NO: 2633999 - RNA, 14 nt, Human
cuccugggcagcug

SEQ ID NO: 2634000 - RNA, 15 nt, Human
cuccugggcagcugc

SEQ ID NO: 2634001 - RNA, 16 nt, Human
cuccugggcagcugcc

SEQ ID NO: 2634002 - RNA, 17 nt, Human
cuccugggcagcugccu

SEQ ID NO: 2634003 - RNA, 12 nt, Human
cuccugggcagc

SEQ ID NO: 2634004 - RNA, 21 nt, Human
cuccucugcuugccaucccuc

SEQ ID NO: 2634005 - RNA, 22 nt, Human
cuccucugcuugccaucccucc

SEQ ID NO: 2634006 - RNA, 15 nt, Human
cuccucugcuugcca

SEQ ID NO: 2634007 - RNA, 16 nt, Human
cuccucugcuugccau

SEQ ID NO: 2634008 - RNA, 17 nt, Human
cuccucugcuugccauc

SEQ ID NO: 2634009 - RNA, 20 nt, Human
cuccucugcuugccaucccu

SEQ ID NO: 2634010 - RNA, 17 nt, Human
cucaaaacugcacuguc

SEQ ID NO: 2634011 - RNA, 23 nt, Human
cucaaaauaccaugccauuuaaa

SEQ ID NO: 2634012 - RNA, 16 nt, Human
cuagcaugaagacaga

SEQ ID NO: 2634013 - RNA, 13 nt, Human
cuagaacucccuu

SEQ ID NO: 2634014 - RNA, 12 nt, Human
cuagaacucccu

SEQ ID NO: 2634015 - RNA, 23 nt, Human
cuaaguaaaaccacagcaguuga

SEQ ID NO: 2634016 - RNA, 22 nt, Human
cuaaguaaaaccacagcaguug

SEQ ID NO: 2634017 - RNA, 20 nt, Human
cgugugugugcguccugucg

SEQ ID NO: 2634018 - RNA, 20 nt, Human
cuaaguaaaaccacagcagu

SEQ ID NO: 2634019 - RNA, 15 nt, Human
cuacaaaaacacagc

SEQ ID NO: 2634020 - RNA, 18 nt, Human
cuacaaaaacacagcaag

SEQ ID NO: 2634021 - RNA, 17 nt, Human
cuacaaaaacacagcaa

SEQ ID NO: 2634022 - RNA, 16 nt, Human
cuacaaaaacacagca

SEQ ID NO: 2634023 - RNA, 18 nt, Human
cuacauacuauggaauuu

SEQ ID NO: 2634024 - RNA, 18 nt, Human
cuacaugagguacugaga

SEQ ID NO: 2634025 - RNA, 20 nt, Human
cuacaugagguacugagagu

SEQ ID NO: 2634026 - RNA, 18 nt, Human
cgcaggcccccaggugcc

SEQ ID NO: 2634027 - RNA, 22 nt, Human
cguggugauuuagcaggaagcu

SEQ ID NO: 2634028 - RNA, 22 nt, Human
ccauuuaaagcuuauuaaaacu

SEQ ID NO: 2634029 - RNA, 13 nt, Human
ccauacauuugug

SEQ ID NO: 2634030 - RNA, 14 nt, Human
ccauacauuugugu

SEQ ID NO: 2634031 - RNA, 18 nt, Human
ccccugcacuccagccug

SEQ ID NO: 2634032 - RNA, 22 nt, Human
ccugucggagcccugucuccuc

SEQ ID NO: 2634033 - RNA, 15 nt, Human
ccuguaaucacagcu

SEQ ID NO: 2634034 - RNA, 16 nt, Human
ccugucggagcccugu

SEQ ID NO: 2634035 - RNA, 17 nt, Human
ccugucggagcccuguc

SEQ ID NO: 2634036 - RNA, 21 nt, Human
ccugucggagcccugucuccu

SEQ ID NO: 2634037 - RNA, 19 nt, Human
cccugucuccucucucugu

SEQ ID NO: 2634038 - RNA, 23 nt, Human
ccucauggaauuggagcucgugg

SEQ ID NO: 2634039 - RNA, 17 nt, Human
ccaaauguucaucaaug

SEQ ID NO: 2634040 - RNA, 19 nt, Human
cauuuguauaaaauaauuu

SEQ ID NO: 2634041 - RNA, 20 nt, Human
cauuuguauaaaauaauuuu

SEQ ID NO: 2634042 - RNA, 17 nt, Human
cauuuguauaaaauaau

SEQ ID NO: 2634043 - RNA, 23 nt, Human
ccacagcaguugaaaagacucca

SEQ ID NO: 2634044 - RNA, 18 nt, Human
ccacagcaguugaaaaga

SEQ ID NO: 2634045 - RNA, 17 nt, Human
ccacagcaguugaaaag

SEQ ID NO: 2634046 - RNA, 12 nt, Human
ccacagcaguug

SEQ ID NO: 2634047 - RNA, 14 nt, Human
caugauguuuagaa

SEQ ID NO: 2634048 - RNA, 19 nt, Human
caggugccaguuauggcua

SEQ ID NO: 2634049 - RNA, 19 nt, Human
cagucaccucauggaauug

SEQ ID NO: 2634050 - RNA, 15 nt, Human
cagucacauuccaag

SEQ ID NO: 2634051 - RNA, 16 nt, Human
cagucaccucauggaa

SEQ ID NO: 2634052 - RNA, 20 nt, Human
cagucugacuguuuccauca

SEQ ID NO: 2634053 - RNA, 13 nt, Human
cagcaguucagag

SEQ ID NO: 2634054 - RNA, 16 nt, Human
cagagguugcagugag

SEQ ID NO: 2634055 - RNA, 17 nt, Human
cagagguugcagugagc

SEQ ID NO: 2634056 - RNA, 12 nt, Human
cagauccuggaa

SEQ ID NO: 2634057 - RNA, 22 nt, Human
cagcuccccucggagaagagcu

SEQ ID NO: 2634058 - RNA, 21 nt, Human
cagcuccccucggagaagagc

SEQ ID NO: 2634059 - RNA, 20 nt, Human
cacuuggucugugagaugcu

SEQ ID NO: 2634060 - RNA, 17 nt, Human
cacuuggucugugagau

SEQ ID NO: 2634061 - RNA, 23 nt, Human
caccucaaaauaccaugccauuu

SEQ ID NO: 2634062 - RNA, 21 nt, Human
caccuacaugagguacugaga

SEQ ID NO: 2634063 - RNA, 13 nt, Human
caccuugcagcuc

SEQ ID NO: 2634064 - RNA, 15 nt, Human
caccuugcagcucuc

SEQ ID NO: 2634065 - RNA, 22 nt, Human
caccuugcagcucuccccuucu

SEQ ID NO: 2634066 - RNA, 16 nt, Human
cacaagacugcacauc

SEQ ID NO: 2634067 - RNA, 12 nt, Human
caauuuaaaaaa

SEQ ID NO: 2634068 - RNA, 12 nt, Human
caauauuucaga

SEQ ID NO: 2634069 - RNA, 20 nt, Human
caauauuucagauaaucaca

SEQ ID NO: 2634070 - RNA, 21 nt, Human
caauauuucagauaaucacaa

SEQ ID NO: 2634071 - RNA, 14 nt, Human
caaugcuguauuuu

SEQ ID NO: 2634072 - RNA, 23 nt, Human
caaugcuguauuuuaaaagaaug

SEQ ID NO: 2634073 - RNA, 20 nt, Human
caaguauuagaauaccacag

SEQ ID NO: 2634074 - RNA, 14 nt, Human
caaguauuagaaua

SEQ ID NO: 2634075 - RNA, 15 nt, Human
caacacgagcaggcu

SEQ ID NO: 2634076 - RNA, 19 nt, Human
caacccaaauguucaucaa

SEQ ID NO: 2634077 - RNA, 21 nt, Human
caacuaucucauuuccaagca

SEQ ID NO: 2634078 - RNA, 17 nt, Human
auucuugccaaauauaa

SEQ ID NO: 2634079 - RNA, 18 nt, Human
auugacuuuuuauggcac

SEQ ID NO: 2634080 - RNA, 18 nt, Human
auucacaagacccaaaag

SEQ ID NO: 2634081 - RNA, 13 nt, Human
auuguaaaauggu

SEQ ID NO: 2634082 - RNA, 17 nt, Human
auuguaaaugugcuuuu

SEQ ID NO: 2634083 - RNA, 15 nt, Human
auuguaaaugugcuu

SEQ ID NO: 2634084 - RNA, 14 nt, Human
auuguaaaugugcu

SEQ ID NO: 2634085 - RNA, 19 nt, Human
auuguuuaaaaucauuucu

SEQ ID NO: 2634086 - RNA, 15 nt, Human
auuucuaugaaauau

SEQ ID NO: 2634087 - RNA, 18 nt, Human
auuucuaugaaauauuau

SEQ ID NO: 2634088 - RNA, 20 nt, Human
auuucuaugaaauauuaugu

SEQ ID NO: 2634089 - RNA, 19 nt, Human
uuuuuauauuugaaauauu

SEQ ID NO: 2634090 - RNA, 21 nt, Human
auuaaguaaugauaacuggaa

SEQ ID NO: 2634091 - RNA, 23 nt, Human
auuaaguaaugauaacuggaaac

SEQ ID NO: 2634092 - RNA, 19 nt, Human
uuuuugugaaaagcuccau

SEQ ID NO: 2634093 - RNA, 17 nt, Human
auuacauuuguauaaaa

SEQ ID NO: 2634094 - RNA, 18 nt, Human
auuacauuuguauaaaau

SEQ ID NO: 2634095 - RNA, 20 nt, Human
auuacauuuguauaaaauaa

SEQ ID NO: 2634096 - RNA, 12 nt, Human
auuaccagggac

SEQ ID NO: 2634097 - RNA, 18 nt, Human
auguucaucaaugaauga

SEQ ID NO: 2634098 - RNA, 19 nt, Human
augugcuaguaauuggaaa

SEQ ID NO: 2634099 - RNA, 16 nt, Human
uuuuaauaauguuuca

SEQ ID NO: 2634100 - RNA, 12 nt, Human
uuuuaauaaugu

SEQ ID NO: 2634101 - RNA, 13 nt, Human
uuuuaauaauguu

SEQ ID NO: 2634102 - RNA, 14 nt, Human
uuuuaauaauguuu

SEQ ID NO: 2634103 - RNA, 15 nt, Human
auuaaaagaauauuu

SEQ ID NO: 2634104 - RNA, 15 nt, Human
auguuuucaggcuag

SEQ ID NO: 2634105 - RNA, 17 nt, Human
auguuuucaggcuagau

SEQ ID NO: 2634106 - RNA, 21 nt, Human
auguuuucaggcuagauguau

SEQ ID NO: 2634107 - RNA, 14 nt, Human
uuuucucuaggaaa

SEQ ID NO: 2634108 - RNA, 16 nt, Human
uuuucucuaggaaaua

SEQ ID NO: 2634109 - RNA, 18 nt, Human
uuuucugagaaagacuau

SEQ ID NO: 2634110 - RNA, 15 nt, Human
uuuucugagaaagac

SEQ ID NO: 2634111 - RNA, 18 nt, Human
auugacccacaagaaaug

SEQ ID NO: 2634112 - RNA, 13 nt, Human
auuuagauguaua

SEQ ID NO: 2634113 - RNA, 14 nt, Human
auuugaaauauuga

SEQ ID NO: 2634114 - RNA, 19 nt, Human
auuuauuuuaauaauguuu

SEQ ID NO: 2634115 - RNA, 20 nt, Human
auuuauuuuaauaauguuuc

SEQ ID NO: 2634116 - RNA, 12 nt, Human
auuucauuucuu

SEQ ID NO: 2634117 - RNA, 17 nt, Human
auuuauuuuaauaaugu

SEQ ID NO: 2634118 - RNA, 22 nt, Human
auuuucaguuauuauauuuaca

SEQ ID NO: 2634119 - RNA, 18 nt, Human
auuuuaaaagaaugauua

SEQ ID NO: 2634120 - RNA, 22 nt, Human
auuuuaaaagaaugauuaugaa

SEQ ID NO: 2634121 - RNA, 17 nt, Human
auuuuaaaagaaugauu

SEQ ID NO: 2634122 - RNA, 19 nt, Human
auuuguauaaaauaauuuu

SEQ ID NO: 2634123 - RNA, 15 nt, Human
auuuguauaaaauaa

SEQ ID NO: 2634124 - RNA, 18 nt, Human
auuuguauaaaauaauuu

SEQ ID NO: 2634125 - RNA, 21 nt, Human
augaaauauuauguuaaaacu

SEQ ID NO: 2634126 - RNA, 20 nt, Human
augaaauauuauguuaaaac

SEQ ID NO: 2634127 - RNA, 12 nt, Human
uugcucauggaa

SEQ ID NO: 2634128 - RNA, 11 nt, Human
uugcucaugga

SEQ ID NO: 2634129 - RNA, 23 nt, Human
augaauuaguuuuauaugcuucu

SEQ ID NO: 2634130 - RNA, 22 nt, Human
augaauuacauuuguauaaaau

SEQ ID NO: 2634131 - RNA, 21 nt, Human
augaauuaguuuuauaugcuu

SEQ ID NO: 2634132 - RNA, 23 nt, Human
uuguaguguuggagaagaacuga

SEQ ID NO: 2634133 - RNA, 19 nt, Human
uuguauaaaauaauuuuua

SEQ ID NO: 2634134 - RNA, 13 nt, Human
uuguauaaaauaa

SEQ ID NO: 2634135 - RNA, 17 nt, Human
augaauuacauuuguau

SEQ ID NO: 2634136 - RNA, 18 nt, Human
augaauuacauuuguaua

SEQ ID NO: 2634137 - RNA, 19 nt, Human
augaauuacauuuguauaa

SEQ ID NO: 2634138 - RNA, 18 nt, Human
uugugaagcaaaauuuuu

SEQ ID NO: 2634139 - RNA, 20 nt, Human
uuuaaaaaagaaacauuugg

SEQ ID NO: 2634140 - RNA, 14 nt, Human
augauaacuggaaa

SEQ ID NO: 2634141 - RNA, 13 nt, Human
uuucuaugaaaua

SEQ ID NO: 2634142 - RNA, 14 nt, Human
uuucuaugaaauau

SEQ ID NO: 2634143 - RNA, 20 nt, Human
uuucuaugaaauauuauguu

SEQ ID NO: 2634144 - RNA, 14 nt, Human
uuucugcaucagcu

SEQ ID NO: 2634145 - RNA, 14 nt, Human
uuugaaauauugac

SEQ ID NO: 2634146 - RNA, 17 nt, Human
auggaauuucucccagu

SEQ ID NO: 2634147 - RNA, 19 nt, Human
auggcuauaggugcuacaa

SEQ ID NO: 2634148 - RNA, 16 nt, Human
auggcuauaggugcua

SEQ ID NO: 2634149 - RNA, 22 nt, Human
augggacauuugcucauggaau

SEQ ID NO: 2634150 - RNA, 21 nt, Human
augggacauuugcucauggaa

SEQ ID NO: 2634151 - RNA, 23 nt, Human
auggcuauaggugcuacaaaaac

SEQ ID NO: 2634152 - RNA, 21 nt, Human
auggcuauaggugcuacaaaa

SEQ ID NO: 2634153 - RNA, 13 nt, Human
augcuaagugaaa

SEQ ID NO: 2634154 - RNA, 24 nt, Human
uuuaaagcuuauuaaaacucauuu

SEQ ID NO: 2634155 - RNA, 17 nt, Human
uuuauaugcuucuguuu

SEQ ID NO: 2634156 - RNA, 16 nt, Human
uuuauuacuguaagaa

SEQ ID NO: 2634157 - RNA, 16 nt, Human
auggaacauaaaauac

SEQ ID NO: 2634158 - RNA, 16 nt, Human
uuuauuuuaauaaugu

SEQ ID NO: 2634159 - RNA, 14 nt, Human
augcuguauuuuaa

SEQ ID NO: 2634160 - RNA, 23 nt, Human
augcugucuacacuaagagagaa

SEQ ID NO: 2634161 - RNA, 19 nt, Human
uuuauuacuguaagaaaau

SEQ ID NO: 2634162 - RNA, 23 nt, Human
auggaauuggagcucgugggaca

SEQ ID NO: 2634163 - RNA, 23 nt, Human
auauguaccuaacgaaguauccu

SEQ ID NO: 2634164 - RNA, 15 nt, Human
auaugcaaagcacug

SEQ ID NO: 2634165 - RNA, 14 nt, Human
auaugcaaagcacu

SEQ ID NO: 2634166 - RNA, 13 nt, Human
auaugcaaagcac

SEQ ID NO: 2634167 - RNA, 14 nt, Human
uucauuaucucaaa

SEQ ID NO: 2634168 - RNA, 17 nt, Human
uucagcgguuuauauaa

SEQ ID NO: 2634169 - RNA, 15 nt, Human
uucaucaaugaauga

SEQ ID NO: 2634170 - RNA, 13 nt, Human
auauaugcuaagu

SEQ ID NO: 2634171 - RNA, 15 nt, Human
aucaaauaugcaaag

SEQ ID NO: 2634172 - RNA, 18 nt, Human
aucaaauaugcaaagcac

SEQ ID NO: 2634173 - RNA, 17 nt, Human
aucaaauaugcaaagca

SEQ ID NO: 2634174 - RNA, 16 nt, Human
aucaaauaugcaaagc

SEQ ID NO: 2634175 - RNA, 16 nt, Human
aucaaggguacacugc

SEQ ID NO: 2634176 - RNA, 19 nt, Human
aucaauuuuucuuauuuca

SEQ ID NO: 2634177 - RNA, 14 nt, Human
aucaauuuuucuua

SEQ ID NO: 2634178 - RNA, 21 nt, Human
aucaaggguacacugccuucu

SEQ ID NO: 2634179 - RNA, 13 nt, Human
aucaauuuaaaaa

SEQ ID NO: 2634180 - RNA, 14 nt, Human
auauuguuugcuaa

SEQ ID NO: 2634181 - RNA, 13 nt, Human
auauuuacaaaug

SEQ ID NO: 2634182 - RNA, 19 nt, Human
uugacacuuaaaaaugguu

SEQ ID NO: 2634183 - RNA, 17 nt, Human
uugacacuuaaaaaugg

SEQ ID NO: 2634184 - RNA, 21 nt, Human
uugaaggaugcugucuucgua

SEQ ID NO: 2634185 - RNA, 14 nt, Human
uugaaggaugcugu

SEQ ID NO: 2634186 - RNA, 16 nt, Human
uugaaggaugcugucu

SEQ ID NO: 2634187 - RNA, 16 nt, Human
auccugcaauuccacu

SEQ ID NO: 2634188 - RNA, 22 nt, Human
auccugaggcuccacuuggucu

SEQ ID NO: 2634189 - RNA, 13 nt, Human
auccugccccuga

SEQ ID NO: 2634190 - RNA, 18 nt, Human
auccugaggcuccacuug

SEQ ID NO: 2634191 - RNA, 16 nt, Human
auccugaggcuccacu

SEQ ID NO: 2634192 - RNA, 13 nt, Human
auccugaggcucc

SEQ ID NO: 2634193 - RNA, 11 nt, Human
auccugaggcu

SEQ ID NO: 2634194 - RNA, 23 nt, Human
aucacuugaacccgggaggcaga

SEQ ID NO: 2634195 - RNA, 16 nt, Human
uucuguuuuauaauuu

SEQ ID NO: 2634196 - RNA, 17 nt, Human
uucuguuuuauaauuuu

SEQ ID NO: 2634197 - RNA, 20 nt, Human
aucccucccuccaccucccu

SEQ ID NO: 2634198 - RNA, 21 nt, Human
aucccucccuccaccucccug

SEQ ID NO: 2634199 - RNA, 16 nt, Human
aucccucccuccaccu

SEQ ID NO: 2634200 - RNA, 17 nt, Human
aucccucccuccaccuc

SEQ ID NO: 2634201 - RNA, 18 nt, Human
aucccucccuccaccucc

SEQ ID NO: 2634202 - RNA, 11 nt, Human
aggagaaacug

SEQ ID NO: 2634203 - RNA, 13 nt, Human
uggaaaggcagcu

SEQ ID NO: 2634204 - RNA, 16 nt, Human
ugcuugccaucccucc

SEQ ID NO: 2634205 - RNA, 15 nt, Human
ugcuugccaucccuc

SEQ ID NO: 2634206 - RNA, 18 nt, Human
uggaauuggagcucgugg

SEQ ID NO: 2634207 - RNA, 22 nt, Human
uggaauuucucccagucauuua

SEQ ID NO: 2634208 - RNA, 18 nt, Human
aggaagcugugagagcag

SEQ ID NO: 2634209 - RNA, 11 nt, Human
aggaauuuaaa

SEQ ID NO: 2634210 - RNA, 23 nt, Human
aggaauugacccacaagaaauga

SEQ ID NO: 2634211 - RNA, 23 nt, Human
aggacagcccuucuuuccacaga

SEQ ID NO: 2634212 - RNA, 14 nt, Human
aggacacugauaug

SEQ ID NO: 2634213 - RNA, 14 nt, Human
ugcuggagcucugc

SEQ ID NO: 2634214 - RNA, 13 nt, Human
ugcuggagcucug

SEQ ID NO: 2634215 - RNA, 20 nt, Human
ugggaaagggauuuucagcc

SEQ ID NO: 2634216 - RNA, 22 nt, Human
uggcacaguuuucugagaaaga

SEQ ID NO: 2634217 - RNA, 20 nt, Human
uggcacaguuuucugagaaa

SEQ ID NO: 2634218 - RNA, 18 nt, Human
uggacgagaaaacaauaa

SEQ ID NO: 2634219 - RNA, 20 nt, Human
ugcagcucuccccuucucug

SEQ ID NO: 2634220 - RNA, 22 nt, Human
ugcagcucuccccuucucugua

SEQ ID NO: 2634221 - RNA, 16 nt, Human
ugccccauucaacauc

SEQ ID NO: 2634222 - RNA, 22 nt, Human
ugccauuuaaagcuuauuaaaa

SEQ ID NO: 2634223 - RNA, 12 nt, Human
ugcccucuccug

SEQ ID NO: 2634224 - RNA, 13 nt, Human
ugcccucuccugg

SEQ ID NO: 2634225 - RNA, 14 nt, Human
ugcccucuccuggg

SEQ ID NO: 2634226 - RNA, 15 nt, Human
ugcccucuccugggc

SEQ ID NO: 2634227 - RNA, 22 nt, Human
ugcccucuccugggcagcugcc

SEQ ID NO: 2634228 - RNA, 23 nt, Human
ugcccucuccugggcagcugccu

SEQ ID NO: 2634229 - RNA, 16 nt, Human
ugcccucuccugggca

SEQ ID NO: 2634230 - RNA, 17 nt, Human
ugcccucuccugggcag

SEQ ID NO: 2634231 - RNA, 18 nt, Human
ugcccucuccugggcagc

SEQ ID NO: 2634232 - RNA, 20 nt, Human
ugcccucuccugggcagcug

SEQ ID NO: 2634233 - RNA, 23 nt, Human
agcucugcccauccugccccuga

SEQ ID NO: 2634234 - RNA, 18 nt, Human
ugccucagaaaacaagga

SEQ ID NO: 2634235 - RNA, 11 nt, Human
ugccuccccuc

SEQ ID NO: 2634236 - RNA, 12 nt, Human
ugccuccccucc

SEQ ID NO: 2634237 - RNA, 13 nt, Human
ugccuccccuccu

SEQ ID NO: 2634238 - RNA, 14 nt, Human
ugccuccccuccuc

SEQ ID NO: 2634239 - RNA, 15 nt, Human
ugccuccccuccucu

SEQ ID NO: 2634240 - RNA, 16 nt, Human
ugccuccccuccucug

SEQ ID NO: 2634241 - RNA, 19 nt, Human
ugcccuguuaaaagaugaa

SEQ ID NO: 2634242 - RNA, 15 nt, Human
ugccucaccccuugc

SEQ ID NO: 2634243 - RNA, 21 nt, Human
agcugcccucuccugggcagc

SEQ ID NO: 2634244 - RNA, 19 nt, Human
agcugcccucuccugggca

SEQ ID NO: 2634245 - RNA, 20 nt, Human
agcugcccucuccugggcag

SEQ ID NO: 2634246 - RNA, 17 nt, Human
agcugcccucuccuggg

SEQ ID NO: 2634247 - RNA, 18 nt, Human
agcugcccucuccugggc

SEQ ID NO: 2634248 - RNA, 14 nt, Human
ugcagaagacagua

SEQ ID NO: 2634249 - RNA, 15 nt, Human
ugcagaagacaguau

SEQ ID NO: 2634250 - RNA, 11 nt, Human
agcccugucuc

SEQ ID NO: 2634251 - RNA, 18 nt, Human
agcccugucuccucucuc

SEQ ID NO: 2634252 - RNA, 22 nt, Human
agccagcaguucagagcugccc

SEQ ID NO: 2634253 - RNA, 20 nt, Human
agccagcaguucagagcugc

SEQ ID NO: 2634254 - RNA, 21 nt, Human
agccagcaguucagagcugcc

SEQ ID NO: 2634255 - RNA, 15 nt, Human
agccagcaguucaga

SEQ ID NO: 2634256 - RNA, 17 nt, Human
agccagcaguucagagc

SEQ ID NO: 2634257 - RNA, 19 nt, Human
agccagcaguucagagcug

SEQ ID NO: 2634258 - RNA, 18 nt, Human
ugauuaaguaaugauaac

SEQ ID NO: 2634259 - RNA, 23 nt, Human
ugauuaaguaaugauaacuggaa

SEQ ID NO: 2634260 - RNA, 11 nt, Human
ugaugaagaag

SEQ ID NO: 2634261 - RNA, 12 nt, Human
ugaugaagaagu

SEQ ID NO: 2634262 - RNA, 14 nt, Human
ugaugggaaagcau

SEQ ID NO: 2634263 - RNA, 19 nt, Human
ugaugggaaagcauuguaa

SEQ ID NO: 2634264 - RNA, 17 nt, Human
ugauuuagcaggaagcu

SEQ ID NO: 2634265 - RNA, 20 nt, Human
ugauuuagcaggaagcugug

SEQ ID NO: 2634266 - RNA, 19 nt, Human
uguuugcuaagcauuccaa

SEQ ID NO: 2634267 - RNA, 15 nt, Human
uguuugcuaagcauu

SEQ ID NO: 2634268 - RNA, 14 nt, Human
uguuuuaggagcau

SEQ ID NO: 2634269 - RNA, 13 nt, Human
uguuuuauaauuu

SEQ ID NO: 2634270 - RNA, 20 nt, Human
uguuuuauaauuuugugaag

SEQ ID NO: 2634271 - RNA, 21 nt, Human
aguugauaugccuuuucccaa

SEQ ID NO: 2634272 - RNA, 15 nt, Human
aguucugaagaagau

SEQ ID NO: 2634273 - RNA, 13 nt, Human
aguucugaagaag

SEQ ID NO: 2634274 - RNA, 14 nt, Human
aguucugaagaaga

SEQ ID NO: 2634275 - RNA, 16 nt, Human
aguuugguuucuagca

SEQ ID NO: 2634276 - RNA, 20 nt, Human
uuaaaaaugguuuaaauggu

SEQ ID NO: 2634277 - RNA, 22 nt, Human
aguugcauagguuuaauaauuu

SEQ ID NO: 2634278 - RNA, 15 nt, Human
uuaaaaaagaaacau

SEQ ID NO: 2634279 - RNA, 18 nt, Human
uuaaaaaagaaacauuug

SEQ ID NO: 2634280 - RNA, 20 nt, Human
aguucggugagcuacaaaug

SEQ ID NO: 2634281 - RNA, 14 nt, Human
aguucagagcugcc

SEQ ID NO: 2634282 - RNA, 15 nt, Human
aguucagagcugccc

SEQ ID NO: 2634283 - RNA, 16 nt, Human
aguucagagcugcccu

SEQ ID NO: 2634284 - RNA, 17 nt, Human
aguucagagcugcccuc

SEQ ID NO: 2634285 - RNA, 18 nt, Human
aguucagagcugcccucu

SEQ ID NO: 2634286 - RNA, 19 nt, Human
aguucagagcugcccucuc

SEQ ID NO: 2634287 - RNA, 19 nt, Human
aguuauggcuauaggugcu

SEQ ID NO: 2634288 - RNA, 20 nt, Human
aguuauuauauuuacaaaug

SEQ ID NO: 2634289 - RNA, 21 nt, Human
uuagccguggugauuuagcag

SEQ ID NO: 2634290 - RNA, 21 nt, Human
auaauuuuuauauuugaaaua

SEQ ID NO: 2634291 - RNA, 22 nt, Human
auaauuuuuauauuugaaauau

SEQ ID NO: 2634292 - RNA, 22 nt, Human
auacaaaaaaaaaaaaaaauua

SEQ ID NO: 2634293 - RNA, 14 nt, Human
auaauuuuuauauu

SEQ ID NO: 2634294 - RNA, 16 nt, Human
auaauuuuuauauuug

SEQ ID NO: 2634295 - RNA, 19 nt, Human
auaauuuuuauauuugaaa

SEQ ID NO: 2634296 - RNA, 13 nt, Human
auaauuuugugaa

SEQ ID NO: 2634297 - RNA, 14 nt, Human
auaauuuugugaag

SEQ ID NO: 2634298 - RNA, 15 nt, Human
auaauuuugugaagc

SEQ ID NO: 2634299 - RNA, 20 nt, Human
auaauuuugugaagcaaaau

SEQ ID NO: 2634300 - RNA, 18 nt, Human
uuauauaagcuuguauuc

SEQ ID NO: 2634301 - RNA, 21 nt, Human
auacaguucggugagcuacaa

SEQ ID NO: 2634302 - RNA, 20 nt, Human
auacaucccuuaccugggaa

SEQ ID NO: 2634303 - RNA, 22 nt, Human
auaccacaggaaccacaagacu

SEQ ID NO: 2634304 - RNA, 21 nt, Human
auaaucuuucacaggggacag

SEQ ID NO: 2634305 - RNA, 14 nt, Human
auaaugaauacuuu

SEQ ID NO: 2634306 - RNA, 23 nt, Human
uuagaugcaguucugaagaagau

SEQ ID NO: 2634307 - RNA, 22 nt, Human
uuagaugcaguucugaagaaga

SEQ ID NO: 2634308 - RNA, 18 nt, Human
uuagcaggaagcugugag

SEQ ID NO: 2634309 - RNA, 15 nt, Human
auaaacucauuucua

SEQ ID NO: 2634310 - RNA, 17 nt, Human
aguuuucugagaaagac

SEQ ID NO: 2634311 - RNA, 14 nt, Human
aguuuucugagaaa

SEQ ID NO: 2634312 - RNA, 13 nt, Human
aguuuucugagaa

SEQ ID NO: 2634313 - RNA, 12 nt, Human
aguuuucugaga

SEQ ID NO: 2634314 - RNA, 19 nt, Human
auaaaugugccuucauuuu

SEQ ID NO: 2634315 - RNA, 12 nt, Human
auaacuggaaac

SEQ ID NO: 2634316 - RNA, 17 nt, Human
uguaagaaaauaucacu

SEQ ID NO: 2634317 - RNA, 18 nt, Human
uguaagaaaauaucacuu

SEQ ID NO: 2634318 - RNA, 15 nt, Human
ugguuucuagcauga

SEQ ID NO: 2634319 - RNA, 22 nt, Human
agggugaugggaaagcauugua

SEQ ID NO: 2634320 - RNA, 21 nt, Human
agggugaugggaaagcauugu

SEQ ID NO: 2634321 - RNA, 15 nt, Human
aggucagugcaaaua

SEQ ID NO: 2634322 - RNA, 20 nt, Human
aggguuuauguuuaggaugu

SEQ ID NO: 2634323 - RNA, 22 nt, Human
uggucugugagaugcuagaacu

SEQ ID NO: 2634324 - RNA, 22 nt, Human
ugguccaugggccauaugaaaa

SEQ ID NO: 2634325 - RNA, 16 nt, Human
agugagccgagauugu

SEQ ID NO: 2634326 - RNA, 21 nt, Human
agugagcagucaggaaagaga

SEQ ID NO: 2634327 - RNA, 20 nt, Human
agugaaacucguuaauuugu

SEQ ID NO: 2634328 - RNA, 17 nt, Human
agugaaagaaaauaaca

SEQ ID NO: 2634329 - RNA, 16 nt, Human
agugaaagaggcagcu

SEQ ID NO: 2634330 - RNA, 14 nt, Human
agugagacagcucu

SEQ ID NO: 2634331 - RNA, 22 nt, Human
agugaaagaggcagcuugaaac

SEQ ID NO: 2634332 - RNA, 22 nt, Human
ugugagaugcuagaacucccuu

SEQ ID NO: 2634333 - RNA, 14 nt, Human
ugugaagcaaaauu

SEQ ID NO: 2634334 - RNA, 14 nt, Human
ugucuuaauuaaaa

SEQ ID NO: 2634335 - RNA, 15 nt, Human
ugucuccucucucug

SEQ ID NO: 2634336 - RNA, 17 nt, Human
ugucucuacuaaaaaua

SEQ ID NO: 2634337 - RNA, 14 nt, Human
ugucuucacaacag

SEQ ID NO: 2634338 - RNA, 23 nt, Human
ugucagcuccccucggagaagag

SEQ ID NO: 2634339 - RNA, 21 nt, Human
ugucagcuccccucggagaag

SEQ ID NO: 2634340 - RNA, 20 nt, Human
ugucagcuccccucggagaa

SEQ ID NO: 2634341 - RNA, 21 nt, Human
aguauuagaauaccacaggaa

SEQ ID NO: 2634342 - RNA, 18 nt, Human
aguauguuagugcaaauu

SEQ ID NO: 2634343 - RNA, 21 nt, Human
aguauguuagugcaaauuguc

SEQ ID NO: 2634344 - RNA, 15 nt, Human
aguauuguccagguc

SEQ ID NO: 2634345 - RNA, 16 nt, Human
aguauuguccaggucu

SEQ ID NO: 2634346 - RNA, 20 nt, Human
agucacauuccaagccucau

SEQ ID NO: 2634347 - RNA, 14 nt, Human
ugaaauaagccaga

SEQ ID NO: 2634348 - RNA, 19 nt, Human
agagcugcccucuccuggg

SEQ ID NO: 2634349 - RNA, 20 nt, Human
agagcugcccucuccugggc

SEQ ID NO: 2634350 - RNA, 16 nt, Human
agagcugcccucuccu

SEQ ID NO: 2634351 - RNA, 17 nt, Human
agagcugcccucuccug

SEQ ID NO: 2634352 - RNA, 18 nt, Human
agagcugcccucuccugg

SEQ ID NO: 2634353 - RNA, 13 nt, Human
ugaacaaauuuac

SEQ ID NO: 2634354 - RNA, 18 nt, Human
ugaacccgggaggcagag

SEQ ID NO: 2634355 - RNA, 22 nt, Human
ugaacccauauuuguacaccaa

SEQ ID NO: 2634356 - RNA, 22 nt, Human
ugaagaagcaccaaucaugaau

SEQ ID NO: 2634357 - RNA, 17 nt, Human
ugaaguacucauacaug

SEQ ID NO: 2634358 - RNA, 17 nt, Human
ugaagauuuaccacuug

SEQ ID NO: 2634359 - RNA, 20 nt, Human
ugaagauuuaccacuugugu

SEQ ID NO: 2634360 - RNA, 19 nt, Human
agagcuguucacagccaga

SEQ ID NO: 2634361 - RNA, 18 nt, Human
agagcuguucacagccag

SEQ ID NO: 2634362 - RNA, 21 nt, Human
agacuggcacaguuuucugag

SEQ ID NO: 2634363 - RNA, 20 nt, Human
agacuggcacaguuuucuga

SEQ ID NO: 2634364 - RNA, 23 nt, Human
agacuggcacaguuuucugagaa

SEQ ID NO: 2634365 - RNA, 22 nt, Human
agacuccaaagaaauguaaggg

SEQ ID NO: 2634366 - RNA, 16 nt, Human
agagacacacugaaga

SEQ ID NO: 2634367 - RNA, 15 nt, Human
agagacagaaagcag

SEQ ID NO: 2634368 - RNA, 14 nt, Human
agagacagaaagca

SEQ ID NO: 2634369 - RNA, 13 nt, Human
ugaaagaaaauaa

SEQ ID NO: 2634370 - RNA, 20 nt, Human
ugaaaaucuuauaauuuaaa

SEQ ID NO: 2634371 - RNA, 22 nt, Human
ugaaaauauuuguaucacaaau

SEQ ID NO: 2634372 - RNA, 21 nt, Human
ugaaaauauuuguaucacaaa

SEQ ID NO: 2634373 - RNA, 17 nt, Human
ugaaaauauuuguauca

SEQ ID NO: 2634374 - RNA, 17 nt, Human
ugaaagaggaaugaagu

SEQ ID NO: 2634375 - RNA, 18 nt, Human
ugaaagaggaaugaagua

SEQ ID NO: 2634376 - RNA, 24 nt, Human
ugagaugugaacacaucagcuugc

SEQ ID NO: 2634377 - RNA, 19 nt, Human
ugagaugugaacacaucag

SEQ ID NO: 2634378 - RNA, 18 nt, Human
ugagaugugaacacauca

SEQ ID NO: 2634379 - RNA, 13 nt, Human
ugagaugugaaca

SEQ ID NO: 2634380 - RNA, 21 nt, Human
ugagagacacacugaagaagc

SEQ ID NO: 2634381 - RNA, 22 nt, Human
ugagagacacacugaagaagca

SEQ ID NO: 2634382 - RNA, 21 nt, Human
ugagagcaguuugguuucuag

SEQ ID NO: 2634383 - RNA, 23 nt, Human
ugagagcaguuugguuucuagca

SEQ ID NO: 2634384 - RNA, 16 nt, Human
ugagagacacacugaa

SEQ ID NO: 2634385 - RNA, 17 nt, Human
ugagagacacacugaag

SEQ ID NO: 2634386 - RNA, 19 nt, Human
ugagagacacacugaagaa

SEQ ID NO: 2634387 - RNA, 20 nt, Human
ugagagacacacugaagaag

SEQ ID NO: 2634388 - RNA, 20 nt, Human
ugagacucugucucagucca

SEQ ID NO: 2634389 - RNA, 12 nt, Human
ugagacagcucu

SEQ ID NO: 2634390 - RNA, 16 nt, Human
agauuuuccugaaaac

SEQ ID NO: 2634391 - RNA, 15 nt, Human
agauuuuccugaaaa

SEQ ID NO: 2634392 - RNA, 14 nt, Human
agauuuuccugaaa

SEQ ID NO: 2634393 - RNA, 22 nt, Human
agcaagggugaugggaaagcau

SEQ ID NO: 2634394 - RNA, 20 nt, Human
agcaagggugaugggaaagc

SEQ ID NO: 2634395 - RNA, 16 nt, Human
agcaagggugauggga

SEQ ID NO: 2634396 - RNA, 15 nt, Human
ugacacuuaaaaaug

SEQ ID NO: 2634397 - RNA, 13 nt, Human
agaugcacaugag

SEQ ID NO: 2634398 - RNA, 16 nt, Human
agaugcacaugagcug

SEQ ID NO: 2634399 - RNA, 20 nt, Human
agaugcaguucugaagaaga

SEQ ID NO: 2634400 - RNA, 19 nt, Human
agaugcuagaacucccuuu

SEQ ID NO: 2634401 - RNA, 21 nt, Human
agaugcaguucugaagaagau

SEQ ID NO: 2634402 - RNA, 21 nt, Human
agaugcuagaacucccuuuca

SEQ ID NO: 2634403 - RNA, 14 nt, Human
agauccuggaaauc

SEQ ID NO: 2634404 - RNA, 13 nt, Human
agauccuggaaau

SEQ ID NO: 2634405 - RNA, 21 nt, Human
agauugugccccugcacucca

SEQ ID NO: 2634406 - RNA, 22 nt, Human
agaugugaacacaucagcuugc

SEQ ID NO: 2634407 - RNA, 17 nt, Human
agaugugaacacaucag

SEQ ID NO: 2634408 - RNA, 22 nt, Human
agauguauguacuucaugcugu

SEQ ID NO: 2634409 - RNA, 16 nt, Human
ucuaggaaauauuuau

SEQ ID NO: 2634410 - RNA, 17 nt, Human
ucuaggaaauauuuauu

SEQ ID NO: 2634411 - RNA, 12 nt, Human
uccugggcagcu

SEQ ID NO: 2634412 - RNA, 13 nt, Human
uccugggcagcug

SEQ ID NO: 2634413 - RNA, 14 nt, Human
uccugggcagcugc

SEQ ID NO: 2634414 - RNA, 20 nt, Human
ucuaaguaaaaccacagcag

SEQ ID NO: 2634415 - RNA, 19 nt, Human
ucuaaguaaaaccacagca

SEQ ID NO: 2634416 - RNA, 15 nt, Human
ucuaaguaaaaccac

SEQ ID NO: 2634417 - RNA, 14 nt, Human
ucuaaguaaaacca

SEQ ID NO: 2634418 - RNA, 15 nt, Human
ucucauuuccaagca

SEQ ID NO: 2634419 - RNA, 23 nt, Human
ucucaggaaaucaaauaugcaaa

SEQ ID NO: 2634420 - RNA, 21 nt, Human
ucucaggaaaucaaauaugca

SEQ ID NO: 2634421 - RNA, 14 nt, Human
ucucaggaaaucaa

SEQ ID NO: 2634422 - RNA, 15 nt, Human
acuugucaauaaaau

SEQ ID NO: 2634423 - RNA, 23 nt, Human
agaauuaacacaugauccugcaa

SEQ ID NO: 2634424 - RNA, 15 nt, Human
agaauuaacacauga

SEQ ID NO: 2634425 - RNA, 12 nt, Human
agacacacauga

SEQ ID NO: 2634426 - RNA, 15 nt, Human
agacacacaugaagu

SEQ ID NO: 2634427 - RNA, 24 nt, Human
agacagagccccacccucagaugc

SEQ ID NO: 2634428 - RNA, 22 nt, Human
agacagagccccacccucagau

SEQ ID NO: 2634429 - RNA, 14 nt, Human
ucugugagaugcua

SEQ ID NO: 2634430 - RNA, 22 nt, Human
ucugugagaugcuagaacuccc

SEQ ID NO: 2634431 - RNA, 17 nt, Human
ucugugagaugcuagaa

SEQ ID NO: 2634432 - RNA, 23 nt, Human
ucugugagaugcuagaacucccu

SEQ ID NO: 2634433 - RNA, 23 nt, Human
ucugcuugccaucccucccucca

SEQ ID NO: 2634434 - RNA, 17 nt, Human
ucugcuugccaucccuc

SEQ ID NO: 2634435 - RNA, 20 nt, Human
ucugcuugccaucccucccu

SEQ ID NO: 2634436 - RNA, 16 nt, Human
ucugcuugccaucccu

SEQ ID NO: 2634437 - RNA, 13 nt, Human
agaagaacugaaa

SEQ ID NO: 2634438 - RNA, 14 nt, Human
agaagaacugaaau

SEQ ID NO: 2634439 - RNA, 18 nt, Human
agaagaugguaccaccag

SEQ ID NO: 2634440 - RNA, 15 nt, Human
ucugcagauaaacag

SEQ ID NO: 2634441 - RNA, 18 nt, Human
ucugcagauaaacaguag

SEQ ID NO: 2634442 - RNA, 21 nt, Human
acucuuaagaagacugcauua

SEQ ID NO: 2634443 - RNA, 19 nt, Human
acuccagugagacagcucu

SEQ ID NO: 2634444 - RNA, 12 nt, Human
acugaagaagca

SEQ ID NO: 2634445 - RNA, 13 nt, Human
acugacucuuaag

SEQ ID NO: 2634446 - RNA, 14 nt, Human
acugacucuuaaga

SEQ ID NO: 2634447 - RNA, 15 nt, Human
acugacucuuaagaa

SEQ ID NO: 2634448 - RNA, 16 nt, Human
acugacucuuaagaag

SEQ ID NO: 2634449 - RNA, 20 nt, Human
acugacucuuaagaagacug

SEQ ID NO: 2634450 - RNA, 17 nt, Human
acugacucuuaagaaga

SEQ ID NO: 2634451 - RNA, 18 nt, Human
acugacucuuaagaagac

SEQ ID NO: 2634452 - RNA, 22 nt, Human
acugacuucuaaguaaaaccac

SEQ ID NO: 2634453 - RNA, 16 nt, Human
acugacuucuaaguaa

SEQ ID NO: 2634454 - RNA, 15 nt, Human
acugacuucuaagua

SEQ ID NO: 2634455 - RNA, 13 nt, Human
acugacuucuaag

SEQ ID NO: 2634456 - RNA, 17 nt, Human
acugagaugugaacaca

SEQ ID NO: 2634457 - RNA, 22 nt, Human
acugagaugugaacacaucagc

SEQ ID NO: 2634458 - RNA, 18 nt, Human
acugagagugaacaaauu

SEQ ID NO: 2634459 - RNA, 16 nt, Human
uccuggaaaucagggu

SEQ ID NO: 2634460 - RNA, 19 nt, Human
accuugaaaacuuuaugcu

SEQ ID NO: 2634461 - RNA, 20 nt, Human
accuuuuggucuggagggaa

SEQ ID NO: 2634462 - RNA, 22 nt, Human
uccacugguucuucuuggucuc

SEQ ID NO: 2634463 - RNA, 14 nt, Human
acgcucucuggccu

SEQ ID NO: 2634464 - RNA, 11 nt, Human
acgcucucugg

SEQ ID NO: 2634465 - RNA, 18 nt, Human
uccagugagacagcucug

SEQ ID NO: 2634466 - RNA, 15 nt, Human
acuaauuuuaaaaug

SEQ ID NO: 2634467 - RNA, 15 nt, Human
uccauccugaggcuc

SEQ ID NO: 2634468 - RNA, 12 nt, Human
uccauccugagg

SEQ ID NO: 2634469 - RNA, 17 nt, Human
acuauauuguuugcuaa

SEQ ID NO: 2634470 - RNA, 22 nt, Human
acuauauuguuugcuaagcauu

SEQ ID NO: 2634471 - RNA, 15 nt, Human
acuaucucauuucca

SEQ ID NO: 2634472 - RNA, 16 nt, Human
acuaucucauuuccaa

SEQ ID NO: 2634473 - RNA, 17 nt, Human
acuaucucauuuccaag

SEQ ID NO: 2634474 - RNA, 16 nt, Human
accuagggugauauua

SEQ ID NO: 2634475 - RNA, 17 nt, Human
ucaguuuuugugaaaag

SEQ ID NO: 2634476 - RNA, 15 nt, Human
ucaguuuuugugaaa

SEQ ID NO: 2634477 - RNA, 14 nt, Human
ucagcccucagaau

SEQ ID NO: 2634478 - RNA, 17 nt, Human
acccgggaggcagaggu

SEQ ID NO: 2634479 - RNA, 15 nt, Human
acccgggaggcagag

SEQ ID NO: 2634480 - RNA, 11 nt, Human
acaugggacau

SEQ ID NO: 2634481 - RNA, 14 nt, Human
acaugggacauuug

SEQ ID NO: 2634482 - RNA, 21 nt, Human
acaugggacauuugcucaugg

SEQ ID NO: 2634483 - RNA, 15 nt, Human
acaugggacauuugc

SEQ ID NO: 2634484 - RNA, 20 nt, Human
acaugggacauuugcucaug

SEQ ID NO: 2634485 - RNA, 16 nt, Human
acaugaaguccaagca

SEQ ID NO: 2634486 - RNA, 20 nt, Human
acaugagguacugagaguga

SEQ ID NO: 2634487 - RNA, 16 nt, Human
acaugagguacugaga

SEQ ID NO: 2634488 - RNA, 23 nt, Human
acaugagguacugagagugaaca

SEQ ID NO: 2634489 - RNA, 18 nt, Human
ucaaauugugugaaaggu

SEQ ID NO: 2634490 - RNA, 15 nt, Human
ucaaauugugugaaa

SEQ ID NO: 2634491 - RNA, 22 nt, Human
ucaauaucuuuuuuuuaauaaa

SEQ ID NO: 2634492 - RNA, 15 nt, Human
ucaauauuucagaua

SEQ ID NO: 2634493 - RNA, 19 nt, Human
ucaauauuucagauaauca

SEQ ID NO: 2634494 - RNA, 23 nt, Human
ucaaugaaugaaugaauggcuaa

SEQ ID NO: 2634495 - RNA, 23 nt, Human
accaaaaaucucaauauuucaga

SEQ ID NO: 2634496 - RNA, 14 nt, Human
accagucugacugu

SEQ ID NO: 2634497 - RNA, 23 nt, Human
ucacuugaacccgggaggcagag

SEQ ID NO: 2634498 - RNA, 14 nt, Human
ucaccucauggaau

SEQ ID NO: 2634499 - RNA, 12 nt, Human
ucaccucaugga

SEQ ID NO: 2634500 - RNA, 13 nt, Human
ucaccucauggaa

SEQ ID NO: 2634501 - RNA, 21 nt, Human
ucacaacagauuauuaccuua

SEQ ID NO: 2634502 - RNA, 16 nt, Human
ucaauucuugccaaau

SEQ ID NO: 2634503 - RNA, 16 nt, Human
aaucaggguuaguauu

SEQ ID NO: 2634504 - RNA, 21 nt, Human
aaucaggguuaguauugucca

SEQ ID NO: 2634505 - RNA, 22 nt, Human
aaucaggguuaguauuguccag

SEQ ID NO: 2634506 - RNA, 18 nt, Human
aauauuuauuuuaauaau

SEQ ID NO: 2634507 - RNA, 19 nt, Human
aauauuuauuuuaauaaug

SEQ ID NO: 2634508 - RNA, 21 nt, Human
aauaugccccauucaacaucu

SEQ ID NO: 2634509 - RNA, 24 nt, Human
aauaugccccauucaacaucuagu

SEQ ID NO: 2634510 - RNA, 20 nt, Human
aauaucacuugucaauaaaa

SEQ ID NO: 2634511 - RNA, 22 nt, Human
aauaucacuugucaauaaaauc

SEQ ID NO: 2634512 - RNA, 16 nt, Human
aauagucaaauugugu

SEQ ID NO: 2634513 - RNA, 20 nt, Human
uaacgauaaaagacagugaa

SEQ ID NO: 2634514 - RNA, 18 nt, Human
uaagaagugaaaaucuac

SEQ ID NO: 2634515 - RNA, 12 nt, Human
aaucaugaauua

SEQ ID NO: 2634516 - RNA, 15 nt, Human
aaucaugaauuaguu

SEQ ID NO: 2634517 - RNA, 12 nt, Human
uaauaaacucau

SEQ ID NO: 2634518 - RNA, 16 nt, Human
uaagcuuguauuccuu

SEQ ID NO: 2634519 - RNA, 19 nt, Human
uaaguaaugauaacuggaa

SEQ ID NO: 2634520 - RNA, 23 nt, Human
aaucgcuccaccuugcagcucuc

SEQ ID NO: 2634521 - RNA, 19 nt, Human
aaucuacacuccagugaga

SEQ ID NO: 2634522 - RNA, 19 nt, Human
aaucuuauaauuuaaaaua

SEQ ID NO: 2634523 - RNA, 22 nt, Human
aaugaauggcuaagcaaaaugu

SEQ ID NO: 2634524 - RNA, 14 nt, Human
uacacuaagagaga

SEQ ID NO: 2634525 - RNA, 18 nt, Human
uacacuaagagagaauga

SEQ ID NO: 2634526 - RNA, 16 nt, Human
aaugcuguauuuuaaa

SEQ ID NO: 2634527 - RNA, 20 nt, Human
uacaucccuuaccugggaaa

SEQ ID NO: 2634528 - RNA, 18 nt, Human
uaccaccagucugacugu

SEQ ID NO: 2634529 - RNA, 18 nt, Human
aauuccaagugauugaaa

SEQ ID NO: 2634530 - RNA, 22 nt, Human
aauuccacuuauaggaauugac

SEQ ID NO: 2634531 - RNA, 14 nt, Human
uacuguaagaaaau

SEQ ID NO: 2634532 - RNA, 22 nt, Human
aauugacccacaagaaaugaaa

SEQ ID NO: 2634533 - RNA, 21 nt, Human
aauugacccacaagaaaugaa

SEQ ID NO: 2634534 - RNA, 19 nt, Human
uaugccccauucaacaucu

SEQ ID NO: 2634535 - RNA, 16 nt, Human
uaugauuaaguaauga

SEQ ID NO: 2634536 - RNA, 20 nt, Human
uaugauuaaguaaugauaac

SEQ ID NO: 2634537 - RNA, 21 nt, Human
uaugauuaaguaaugauaacu

SEQ ID NO: 2634538 - RNA, 16 nt, Human
acagccucuuagaugc

SEQ ID NO: 2634539 - RNA, 17 nt, Human
uaucucaaaacugcacu

SEQ ID NO: 2634540 - RNA, 15 nt, Human
uauauuguuugcuaa

SEQ ID NO: 2634541 - RNA, 16 nt, Human
uauuaaaacucauuuu

SEQ ID NO: 2634542 - RNA, 21 nt, Human
uauguuuucaggcuagaugua

SEQ ID NO: 2634543 - RNA, 17 nt, Human
acaggaaguagaggagg

SEQ ID NO: 2634544 - RNA, 15 nt, Human
uauucaaacagucuc

SEQ ID NO: 2634545 - RNA, 23 nt, Human
uauucaaacagucucaggaaauc

SEQ ID NO: 2634546 - RNA, 14 nt, Human
uauuacuguaagaa

SEQ ID NO: 2634547 - RNA, 21 nt, Human
acagggaggacgcucucuggc

SEQ ID NO: 2634548 - RNA, 20 nt, Human
acagggaggacgcucucugg

SEQ ID NO: 2634549 - RNA, 17 nt, Human
acagucaccucauggaa

SEQ ID NO: 2634550 - RNA, 18 nt, Human
acagucaccucauggaau

SEQ ID NO: 2634551 - RNA, 16 nt, Human
acagucaccucaugga

SEQ ID NO: 2634552 - RNA, 18 nt, Human
acacaugauccugcaauu

SEQ ID NO: 2634553 - RNA, 15 nt, Human
acacaugaaguccaa

SEQ ID NO: 2634554 - RNA, 15 nt, Human
acacaucagcuugcc

SEQ ID NO: 2634555 - RNA, 14 nt, Human
acacuaagagagaa

SEQ ID NO: 2634556 - RNA, 13 nt, Human
acacuaagagaga

SEQ ID NO: 2634557 - RNA, 19 nt, Human
acacucaaaucaagaaacu

SEQ ID NO: 2634558 - RNA, 18 nt, Human
acaaugcuguauuuuaaa

SEQ ID NO: 2634559 - RNA, 22 nt, Human
acaaugcuguauuuuaaaagaa

SEQ ID NO: 2634560 - RNA, 15 nt, Human
acacacucaaaucaa

SEQ ID NO: 2634561 - RNA, 23 nt, Human
uaguguuggagaagaacugaaau

SEQ ID NO: 2634562 - RNA, 22 nt, Human
uagugaaacucguuaauuugua

SEQ ID NO: 2634563 - RNA, 18 nt, Human
acaaaaggauaaugaaua

SEQ ID NO: 2634564 - RNA, 22 nt, Human
uagaggagaaacuggaacucuc

SEQ ID NO: 2634565 - RNA, 19 nt, Human
uagaggagaaacuggaacu

SEQ ID NO: 2634566 - RNA, 19 nt, Human
acaaauuuacagagacaga

SEQ ID NO: 2634567 - RNA, 18 nt, Human
acaaauuuacagagacag

SEQ ID NO: 2634568 - RNA, 20 nt, Human
acaagacccaaaaggcagaa

SEQ ID NO: 2634569 - RNA, 15 nt, Human
uagaugcaguucuga

SEQ ID NO: 2634570 - RNA, 23 nt, Human
acaauacaucccuuaccugggaa

SEQ ID NO: 2634571 - RNA, 13 nt, Human
acaagacugcaca

SEQ ID NO: 2634572 - RNA, 14 nt, Human
acaagacugcacau

SEQ ID NO: 2634573 - RNA, 15 nt, Human
uagggagagaagaua

SEQ ID NO: 2634574 - RNA, 14 nt, Human
uagggagagaagau

SEQ ID NO: 2634575 - RNA, 12 nt, Human
uaggagcaugag

SEQ ID NO: 2634576 - RNA, 19 nt, Human
uaggaaauauuuauuuuaa

SEQ ID NO: 2634577 - RNA, 18 nt, Human
uaggaaauauuuauuuua

SEQ ID NO: 2634578 - RNA, 17 nt, Human
gugauuaccagggacug

SEQ ID NO: 2634579 - RNA, 16 nt, Human
gugauuaccagggacu

SEQ ID NO: 2634580 - RNA, 11 nt, Human
gugauuaccag

SEQ ID NO: 2634581 - RNA, 18 nt, Human
gugcacgcacacugucug

SEQ ID NO: 2634582 - RNA, 13 nt, Human
aacuucagacaua

SEQ ID NO: 2634583 - RNA, 18 nt, Human
aacuucagcgguuuauau

SEQ ID NO: 2634584 - RNA, 22 nt, Human
aacuuccuuggacucauuuuaa

SEQ ID NO: 2634585 - RNA, 23 nt, Human
aacuuccuuggacucauuuuaaa

SEQ ID NO: 2634586 - RNA, 22 nt, Human
gugcuacaaaaacacagcaagg

SEQ ID NO: 2634587 - RNA, 16 nt, Human
aagaaagaaaaucagg

SEQ ID NO: 2634588 - RNA, 13 nt, Human
aagaaagaaaauc

SEQ ID NO: 2634589 - RNA, 14 nt, Human
aagaaagaaaauca

SEQ ID NO: 2634590 - RNA, 11 nt, Human
aagaaacauuu

SEQ ID NO: 2634591 - RNA, 21 nt, Human
aacucauuuuuguuuucauua

SEQ ID NO: 2634592 - RNA, 24 nt, Human
aacucauuuuuguuuucauuaucu

SEQ ID NO: 2634593 - RNA, 19 nt, Human
gucuuauauauuguagaua

SEQ ID NO: 2634594 - RNA, 14 nt, Human
gucuuaauuaaaag

SEQ ID NO: 2634595 - RNA, 11 nt, Human
aaaucauuucu

SEQ ID NO: 2634596 - RNA, 17 nt, Human
aaauuccaagugauuga

SEQ ID NO: 2634597 - RNA, 17 nt, Human
aaauuguauuacaaauc

SEQ ID NO: 2634598 - RNA, 15 nt, Human
aaaugugcuuuuaaa

SEQ ID NO: 2634599 - RNA, 18 nt, Human
aaaugugccuucauuuuu

SEQ ID NO: 2634600 - RNA, 14 nt, Human
gucaggaaagagaa

SEQ ID NO: 2634601 - RNA, 13 nt, Human
gucaggaaagaga

SEQ ID NO: 2634602 - RNA, 21 nt, Human
gucaauuuuguuauguauauu

SEQ ID NO: 2634603 - RNA, 15 nt, Human
gucacaggaaguaga

SEQ ID NO: 2634604 - RNA, 13 nt, Human
gucacaggaagua

SEQ ID NO: 2634605 - RNA, 20 nt, Human
gucacaggaaguagaggagg

SEQ ID NO: 2634606 - RNA, 23 nt, Human
guccaugaagauguagaggagaa

SEQ ID NO: 2634607 - RNA, 22 nt, Human
guccaugaagauguagaggaga

SEQ ID NO: 2634608 - RNA, 17 nt, Human
aacacaacuauauuguu

SEQ ID NO: 2634609 - RNA, 20 nt, Human
aacacagcaagggugauggg

SEQ ID NO: 2634610 - RNA, 18 nt, Human
aacacagcaagggugaug

SEQ ID NO: 2634611 - RNA, 12 nt, Human
aacauauauaac

SEQ ID NO: 2634612 - RNA, 14 nt, Human
aacagucucaggaa

SEQ ID NO: 2634613 - RNA, 14 nt, Human
aacauaaaauacaa

SEQ ID NO: 2634614 - RNA, 13 nt, Human
aacagucucagga

SEQ ID NO: 2634615 - RNA, 18 nt, Human
aaguauguuagugcaaau

SEQ ID NO: 2634616 - RNA, 19 nt, Human
aaguauguuagugcaaauu

SEQ ID NO: 2634617 - RNA, 15 nt, Human
aagggcuguuauaau

SEQ ID NO: 2634618 - RNA, 17 nt, Human
aagggcuguuauaaucu

SEQ ID NO: 2634619 - RNA, 17 nt, Human
aaggggaauugaggaca

SEQ ID NO: 2634620 - RNA, 14 nt, Human
guuuaugauuccac

SEQ ID NO: 2634621 - RNA, 15 nt, Human
uaaaaccacagcagu

SEQ ID NO: 2634622 - RNA, 14 nt, Human
uaaaaccacagcag

SEQ ID NO: 2634623 - RNA, 21 nt, Human
uaaaaaaaaaccugagcccca

SEQ ID NO: 2634624 - RNA, 13 nt, Human
uaaaagaauauuu

SEQ ID NO: 2634625 - RNA, 22 nt, Human
uaaaauaauuuuuauauuugaa

SEQ ID NO: 2634626 - RNA, 21 nt, Human
uaaaauacacacucaaaucaa

SEQ ID NO: 2634627 - RNA, 9 nt, Human
uaaaauggu

SEQ ID NO: 2634628 - RNA, 18 nt, Human
aagcuuauuaaaacucau

SEQ ID NO: 2634629 - RNA, 18 nt, Human
guucccuugaugaagaag

SEQ ID NO: 2634630 - RNA, 21 nt, Human
aagccuuggggcugaugcagu

SEQ ID NO: 2634631 - RNA, 17 nt, Human
guuauuauauuuacaaa

SEQ ID NO: 2634632 - RNA, 19 nt, Human
guuauuauauuuacaaaug

SEQ ID NO: 2634633 - RNA, 18 nt, Human
aagcauuguaaaugugcu

SEQ ID NO: 2634634 - RNA, 20 nt, Human
aagcacugacuucuaaguaa

SEQ ID NO: 2634635 - RNA, 19 nt, Human
aagcacugacuucuaagua

SEQ ID NO: 2634636 - RNA, 19 nt, Human
aagcauuguaaaugugcuu

SEQ ID NO: 2634637 - RNA, 17 nt, Human
aagcacugacuucuaag

SEQ ID NO: 2634638 - RNA, 16 nt, Human
aagcacugacuucuaa

SEQ ID NO: 2634639 - RNA, 16 nt, Human
aagcacuaaacaaaga

SEQ ID NO: 2634640 - RNA, 15 nt, Human
aagauagcagggcau

SEQ ID NO: 2634641 - RNA, 22 nt, Human
gugucuuaauuaaaagaauauu

SEQ ID NO: 2634642 - RNA, 17 nt, Human
aagcaacccaaauguuc

SEQ ID NO: 2634643 - RNA, 20 nt, Human
cacaguuuucugagaaagac

SEQ ID NO: 2634644 - RNA, 19 nt, Human
cacaguuuucugagaaaga

SEQ ID NO: 2634645 - RNA, 17 nt, Human
cacaguuuucugagaaa

SEQ ID NO: 2634646 - RNA, 16 nt, Human
cacaguuuucugagaa

SEQ ID NO: 2634647 - RNA, 14 nt, Human
caaaaacacagcaa

SEQ ID NO: 2634648 - RNA, 13 nt, Human
caaaaacacagca

SEQ ID NO: 2634649 - RNA, 17 nt, Human
caaaaacacagcaaggg

SEQ ID NO: 2634650 - RNA, 15 nt, Human
caaaaacacagcaag

SEQ ID NO: 2634651 - RNA, 13 nt, Human
auuuuccugaaaa

SEQ ID NO: 2634652 - RNA, 23 nt, Human
caaaacuucagacauagaauuaa

SEQ ID NO: 2634653 - RNA, 19 nt, Human
caaaaaucucaauauuuca

SEQ ID NO: 2634654 - RNA, 16 nt, Human
caaaauuuuuucucua

SEQ ID NO: 2634655 - RNA, 21 nt, Human
caaaauuuuuucucuaggaaa

SEQ ID NO: 2634656 - RNA, 22 nt, Human
caaaauuuuuucucuaggaaau

SEQ ID NO: 2634657 - RNA, 21 nt, Human
caaauaugcaaagcacugacu

SEQ ID NO: 2634658 - RNA, 19 nt, Human
caaauaugcaaagcacuga

SEQ ID NO: 2634659 - RNA, 15 nt, Human
caaauugugugaaag

SEQ ID NO: 2634660 - RNA, 21 nt, Human
caagccagauuuuccugaaaa

SEQ ID NO: 2634661 - RNA, 17 nt, Human
caaggcugauuaaacca

SEQ ID NO: 2634662 - RNA, 22 nt, Human
caaugugacuuaaugccacuaa

SEQ ID NO: 2634663 - RNA, 23 nt, Human
caauacaucccuuaccugggaaa

SEQ ID NO: 2634664 - RNA, 13 nt, Human
uuauauuugaaau

SEQ ID NO: 2634665 - RNA, 15 nt, Human
uuauauuugaaauau

SEQ ID NO: 2634666 - RNA, 16 nt, Human
uuauauuuacaaaugg

SEQ ID NO: 2634667 - RNA, 12 nt, Human
uuauauuugaaa

SEQ ID NO: 2634668 - RNA, 20 nt, Human
uuauauuuauuacuguaaga

SEQ ID NO: 2634669 - RNA, 22 nt, Human
uuaugauuaaguaaugauaacu

SEQ ID NO: 2634670 - RNA, 11 nt, Human
uuaucucaaaa

SEQ ID NO: 2634671 - RNA, 18 nt, Human
uuauggcuauaggugcua

SEQ ID NO: 2634672 - RNA, 18 nt, Human
uuauaauuuugugaagca

SEQ ID NO: 2634673 - RNA, 16 nt, Human
uuauaauuuugugaag

SEQ ID NO: 2634674 - RNA, 17 nt, Human
uuauaauuuugugaagc

SEQ ID NO: 2634675 - RNA, 11 nt, Human
uuauaaucuuu

SEQ ID NO: 2634676 - RNA, 12 nt, Human
uuauaauuuaaa

SEQ ID NO: 2634677 - RNA, 14 nt, Human
uuauaauuuuguga

SEQ ID NO: 2634678 - RNA, 15 nt, Human
uuauaauuuugugaa

SEQ ID NO: 2634679 - RNA, 23 nt, Human
uucaguuauuauauuuacaaaug

SEQ ID NO: 2634680 - RNA, 18 nt, Human
uuccagauccuggaaauc

SEQ ID NO: 2634681 - RNA, 20 nt, Human
uuauuuuaauaauguuucaa

SEQ ID NO: 2634682 - RNA, 19 nt, Human
uuauuuuaauaauguuuca

SEQ ID NO: 2634683 - RNA, 22 nt, Human
uucacaagacccaaaaggcaga

SEQ ID NO: 2634684 - RNA, 15 nt, Human
uucagagcugcccuc

SEQ ID NO: 2634685 - RNA, 17 nt, Human
uucagagcugcccucuc

SEQ ID NO: 2634686 - RNA, 18 nt, Human
uucagagcugcccucucc

SEQ ID NO: 2634687 - RNA, 19 nt, Human
uucagagcugcccucuccu

SEQ ID NO: 2634688 - RNA, 20 nt, Human
uucagagcugcccucuccug

SEQ ID NO: 2634689 - RNA, 20 nt, Human
uucagauaaucacaauacau

SEQ ID NO: 2634690 - RNA, 14 nt, Human
uugacccacaagaa

SEQ ID NO: 2634691 - RNA, 17 nt, Human
uugacccacaagaaaug

SEQ ID NO: 2634692 - RNA, 23 nt, Human
uugaugaagaaguugauaugccu

SEQ ID NO: 2634693 - RNA, 13 nt, Human
uugaugaagaagu

SEQ ID NO: 2634694 - RNA, 14 nt, Human
uugaugaagaaguu

SEQ ID NO: 2634695 - RNA, 17 nt, Human
uucugucuucacaacag

SEQ ID NO: 2634696 - RNA, 18 nt, Human
uucggugagcuacaaaug

SEQ ID NO: 2634697 - RNA, 15 nt, Human
uucuacauacuaugg

SEQ ID NO: 2634698 - RNA, 14 nt, Human
uucuaugaaauauu

SEQ ID NO: 2634699 - RNA, 21 nt, Human
uucuaugaaauauuauguuaa

SEQ ID NO: 2634700 - RNA, 21 nt, Human
uucugagaaagacuauucaaa

SEQ ID NO: 2634701 - RNA, 16 nt, Human
uucugagaaagacuau

SEQ ID NO: 2634702 - RNA, 22 nt, Human
uuuauuguuuaaaaucauuucu

SEQ ID NO: 2634703 - RNA, 22 nt, Human
uuuauaauuuugugaagcaaaa

SEQ ID NO: 2634704 - RNA, 17 nt, Human
uuuauggcacuaguauu

SEQ ID NO: 2634705 - RNA, 13 nt, Human
uuuaccacuugug

SEQ ID NO: 2634706 - RNA, 19 nt, Human
uuuaacucuauaauguguu

SEQ ID NO: 2634707 - RNA, 13 nt, Human
uuuaauaauguuu

SEQ ID NO: 2634708 - RNA, 12 nt, Human
uugugccccugc

SEQ ID NO: 2634709 - RNA, 14 nt, Human
uuguuuaaaaucau

SEQ ID NO: 2634710 - RNA, 18 nt, Human
uuguguuuugcaagccag

SEQ ID NO: 2634711 - RNA, 16 nt, Human
uuggucugugagaugc

SEQ ID NO: 2634712 - RNA, 15 nt, Human
uugucuagugaaacu

SEQ ID NO: 2634713 - RNA, 15 nt, Human
uuuccacagaagcuc

SEQ ID NO: 2634714 - RNA, 17 nt, Human
uuuguauaaaauaauuu

SEQ ID NO: 2634715 - RNA, 18 nt, Human
uuuguauaaaauaauuuu

SEQ ID NO: 2634716 - RNA, 19 nt, Human
uuuguauaaaauaauuuuu

SEQ ID NO: 2634717 - RNA, 23 nt, Human
uuuuauaauuuugugaagcaaaa

SEQ ID NO: 2634718 - RNA, 21 nt, Human
uuuuauaauuuugugaagcaa

SEQ ID NO: 2634719 - RNA, 21 nt, Human
uuuuaaaguaacccuacaaaa

SEQ ID NO: 2634720 - RNA, 13 nt, Human
uuuuauauuugaa

SEQ ID NO: 2634721 - RNA, 18 nt, Human
uuuuauauuugaaauauu

SEQ ID NO: 2634722 - RNA, 13 nt, Human
uuuucuuauuuca

SEQ ID NO: 2634723 - RNA, 17 nt, Human
ugcaugguuuagaaagc

SEQ ID NO: 2634724 - RNA, 19 nt, Human
ugcagauaaacaguaguga

SEQ ID NO: 2634725 - RNA, 21 nt, Human
ugcauuauauuuauuacugua

SEQ ID NO: 2634726 - RNA, 16 nt, Human
ugcacgcacacugucu

SEQ ID NO: 2634727 - RNA, 17 nt, Human
ugcacgcacacugucug

SEQ ID NO: 2634728 - RNA, 16 nt, Human
ugcacugucaagauga

SEQ ID NO: 2634729 - RNA, 20 nt, Human
ugagaugcuagaacucccuu

SEQ ID NO: 2634730 - RNA, 16 nt, Human
ugagaugcuagaacuc

SEQ ID NO: 2634731 - RNA, 14 nt, Human
ugagaugcuagaac

SEQ ID NO: 2634732 - RNA, 20 nt, Human
ugagcagucaggaaagagaa

SEQ ID NO: 2634733 - RNA, 17 nt, Human
ugagcagucaggaaaga

SEQ ID NO: 2634734 - RNA, 15 nt, Human
ugagcagucaggaaa

SEQ ID NO: 2634735 - RNA, 16 nt, Human
ugagacagcucugcau

SEQ ID NO: 2634736 - RNA, 14 nt, Human
ugagacagcucugc

SEQ ID NO: 2634737 - RNA, 20 nt, Human
ugagaaagacuauucaaaca

SEQ ID NO: 2634738 - RNA, 18 nt, Human
ugagaaagacuauucaaa

SEQ ID NO: 2634739 - RNA, 17 nt, Human
ugagaaagacuauucaa

SEQ ID NO: 2634740 - RNA, 16 nt, Human
ugagaaagacuauuca

SEQ ID NO: 2634741 - RNA, 12 nt, Human
ugacucuuaaga

SEQ ID NO: 2634742 - RNA, 24 nt, Human
ugauaguuguaccgcaaugugacu

SEQ ID NO: 2634743 - RNA, 17 nt, Human
ugcuucuguuuuauaau

SEQ ID NO: 2634744 - RNA, 22 nt, Human
ugcuucuguuuuauaauuuugu

SEQ ID NO: 2634745 - RNA, 22 nt, Human
uggaaaaguauguuagugcaaa

SEQ ID NO: 2634746 - RNA, 23 nt, Human
uggccuucggccuccauccugag

SEQ ID NO: 2634747 - RNA, 20 nt, Human
uggccuucggccuccauccu

SEQ ID NO: 2634748 - RNA, 22 nt, Human
uggccuucggccuccauccuga

SEQ ID NO: 2634749 - RNA, 23 nt, Human
ugggcagcugccuccccuccucu

SEQ ID NO: 2634750 - RNA, 12 nt, Human
ugggcagcugcc

SEQ ID NO: 2634751 - RNA, 20 nt, Human
ugggcagcugccuccccucc

SEQ ID NO: 2634752 - RNA, 22 nt, Human
ugggcagcugccuccccuccuc

SEQ ID NO: 2634753 - RNA, 14 nt, Human
ugggacagggagga

SEQ ID NO: 2634754 - RNA, 18 nt, Human
uguauuuuaaaagaauga

SEQ ID NO: 2634755 - RNA, 19 nt, Human
uguauuuuaaaagaaugau

SEQ ID NO: 2634756 - RNA, 19 nt, Human
uguaguguuggagaagaac

SEQ ID NO: 2634757 - RNA, 20 nt, Human
uguaguguuggagaagaacu

SEQ ID NO: 2634758 - RNA, 21 nt, Human
uguaguguuggagaagaacug

SEQ ID NO: 2634759 - RNA, 14 nt, Human
uguauaaaauaauu

SEQ ID NO: 2634760 - RNA, 13 nt, Human
uguauaaaauaau

SEQ ID NO: 2634761 - RNA, 22 nt, Human
ugucuacacuaagagagaauga

SEQ ID NO: 2634762 - RNA, 17 nt, Human
ugucuacacuaagagag

SEQ ID NO: 2634763 - RNA, 12 nt, Human
ugucuuaauuaa

SEQ ID NO: 2634764 - RNA, 14 nt, Human
uggguagacacaca

SEQ ID NO: 2634765 - RNA, 16 nt, Human
ugguucccuugaugaa

SEQ ID NO: 2634766 - RNA, 17 nt, Human
ugguucccuugaugaag

SEQ ID NO: 2634767 - RNA, 20 nt, Human
ugguucccuugaugaagaag

SEQ ID NO: 2634768 - RNA, 12 nt, Human
uguaaaauggug

SEQ ID NO: 2634769 - RNA, 11 nt, Human
uguaaaauggu

SEQ ID NO: 2634770 - RNA, 21 nt, Human
uccucugcuugccaucccucc

SEQ ID NO: 2634771 - RNA, 22 nt, Human
uccucugcuugccaucccuccc

SEQ ID NO: 2634772 - RNA, 20 nt, Human
uccucugcuugccaucccuc

SEQ ID NO: 2634773 - RNA, 16 nt, Human
ucccugcaauaaaaug

SEQ ID NO: 2634774 - RNA, 16 nt, Human
ucccuugaugaagaag

SEQ ID NO: 2634775 - RNA, 15 nt, Human
ucccuugaugaagaa

SEQ ID NO: 2634776 - RNA, 16 nt, Human
uccuuggacucauuuu

SEQ ID NO: 2634777 - RNA, 20 nt, Human
uccugccuaagugcagcccc

SEQ ID NO: 2634778 - RNA, 22 nt, Human
uccugucggagcccugucuccu

SEQ ID NO: 2634779 - RNA, 19 nt, Human
uccugucggagcccugucu

SEQ ID NO: 2634780 - RNA, 19 nt, Human
ucuagugagcagucaggaa

SEQ ID NO: 2634781 - RNA, 22 nt, Human
ucuagugagcagucaggaaaga

SEQ ID NO: 2634782 - RNA, 13 nt, Human
ucuaugaaauauu

SEQ ID NO: 2634783 - RNA, 14 nt, Human
ucuaugaaauauua

SEQ ID NO: 2634784 - RNA, 17 nt, Human
ucuaugaaauauuaugu

SEQ ID NO: 2634785 - RNA, 15 nt, Human
ucucaacuccaaacu

SEQ ID NO: 2634786 - RNA, 13 nt, Human
ucguuaauuugua

SEQ ID NO: 2634787 - RNA, 17 nt, Human
ucggccuccauccugag

SEQ ID NO: 2634788 - RNA, 18 nt, Human
ucggccuccauccugagg

SEQ ID NO: 2634789 - RNA, 22 nt, Human
ucgugggacagucaccucaugg

SEQ ID NO: 2634790 - RNA, 21 nt, Human
ucguggaacaguuaccucugc

SEQ ID NO: 2634791 - RNA, 18 nt, Human
ucucuguaauaaacucau

SEQ ID NO: 2634792 - RNA, 22 nt, Human
ucucuguaauaaacucauuucu

SEQ ID NO: 2634793 - RNA, 14 nt, Human
ucugcaucagcugc

SEQ ID NO: 2634794 - RNA, 21 nt, Human
ucugcaucagcugcugaaaca

SEQ ID NO: 2634795 - RNA, 19 nt, Human
ucugcaucagcugcugaaa

SEQ ID NO: 2634796 - RNA, 18 nt, Human
ucuggccuucggccucca

SEQ ID NO: 2634797 - RNA, 17 nt, Human
ucuggccuucggccucc

SEQ ID NO: 2634798 - RNA, 15 nt, Human
ucugucuucacaaca

SEQ ID NO: 2634799 - RNA, 18 nt, Human
ucuuaagaagacugcauu

SEQ ID NO: 2634800 - RNA, 12 nt, Human
ucuuaagaagac

SEQ ID NO: 2634801 - RNA, 20 nt, Human
ucaaaucaagaaacuuaagg

SEQ ID NO: 2634802 - RNA, 14 nt, Human
ucaaauaugcaaag

SEQ ID NO: 2634803 - RNA, 14 nt, Human
ucaaauugugugaa

SEQ ID NO: 2634804 - RNA, 13 nt, Human
ucacaagacccaa

SEQ ID NO: 2634805 - RNA, 18 nt, Human
ucacaagacccaaaaggc

SEQ ID NO: 2634806 - RNA, 17 nt, Human
ucacaagacccaaaagg

SEQ ID NO: 2634807 - RNA, 16 nt, Human
ucacagucacauucca

SEQ ID NO: 2634808 - RNA, 14 nt, Human
ucaccaaggcugau

SEQ ID NO: 2634809 - RNA, 13 nt, Human
ucaaugcagcccc

SEQ ID NO: 2634810 - RNA, 21 nt, Human
ucaauaaaauccauacauuug

SEQ ID NO: 2634811 - RNA, 13 nt, Human
uauguacuucaug

SEQ ID NO: 2634812 - RNA, 17 nt, Human
uauguacuucaugcugu

SEQ ID NO: 2634813 - RNA, 16 nt, Human
uauuauucccauucua

SEQ ID NO: 2634814 - RNA, 17 nt, Human
uccaccucccugcaaua

SEQ ID NO: 2634815 - RNA, 15 nt, Human
uccaccucccugcaa

SEQ ID NO: 2634816 - RNA, 16 nt, Human
uccaccucccugcaau

SEQ ID NO: 2634817 - RNA, 19 nt, Human
uccacagaagcuccaggua

SEQ ID NO: 2634818 - RNA, 13 nt, Human
uccaccucccugc

SEQ ID NO: 2634819 - RNA, 14 nt, Human
uccaccucccugca

SEQ ID NO: 2634820 - RNA, 14 nt, Human
uccacuuggucugu

SEQ ID NO: 2634821 - RNA, 16 nt, Human
uccacuuggucuguga

SEQ ID NO: 2634822 - RNA, 15 nt, Human
uccacuuggucugug

SEQ ID NO: 2634823 - RNA, 18 nt, Human
ucauaccuaucaucuuaa

SEQ ID NO: 2634824 - RNA, 13 nt, Human
ucauuuccaagca

SEQ ID NO: 2634825 - RNA, 16 nt, Human
ucauuuccaagcaagu

SEQ ID NO: 2634826 - RNA, 20 nt, Human
ucauuaucucaaaacugcac

SEQ ID NO: 2634827 - RNA, 19 nt, Human
ucauuaucucaaaacugca

SEQ ID NO: 2634828 - RNA, 13 nt, Human
ucauuaucucaaa

SEQ ID NO: 2634829 - RNA, 19 nt, Human
ucagagcugcccucuccug

SEQ ID NO: 2634830 - RNA, 20 nt, Human
ucagagcugcccucuccugg

SEQ ID NO: 2634831 - RNA, 21 nt, Human
ucagagcugcccucuccuggg

SEQ ID NO: 2634832 - RNA, 22 nt, Human
ucagagcugcccucuccugggc

SEQ ID NO: 2634833 - RNA, 23 nt, Human
ucagagcugcccucuccugggca

SEQ ID NO: 2634834 - RNA, 13 nt, Human
ucaggcuagaugu

SEQ ID NO: 2634835 - RNA, 17 nt, Human
ucaggcuagauguaugu

SEQ ID NO: 2634836 - RNA, 17 nt, Human
ucagcuccccucggaga

SEQ ID NO: 2634837 - RNA, 18 nt, Human
ucagcuccccucggagaa

SEQ ID NO: 2634838 - RNA, 20 nt, Human
gggaggacgcucucuggccu

SEQ ID NO: 2634839 - RNA, 17 nt, Human
gggaggacgcucucugg

SEQ ID NO: 2634840 - RNA, 14 nt, Human
gggaauugaggaca

SEQ ID NO: 2634841 - RNA, 21 nt, Human
gggacugaggggaggggagca

SEQ ID NO: 2634842 - RNA, 23 nt, Human
ggcuauaggugcuacaaaaacac

SEQ ID NO: 2634843 - RNA, 20 nt, Human
ggcuaguaucaaaagaaaga

SEQ ID NO: 2634844 - RNA, 16 nt, Human
ggcuccacuuggucug

SEQ ID NO: 2634845 - RNA, 11 nt, Human
ggcagcugccu

SEQ ID NO: 2634846 - RNA, 12 nt, Human
ggcagcugccuc

SEQ ID NO: 2634847 - RNA, 13 nt, Human
ggcagcugccucc

SEQ ID NO: 2634848 - RNA, 16 nt, Human
ggcagcugccuccccu

SEQ ID NO: 2634849 - RNA, 21 nt, Human
ggcagagguugcagugagccg

SEQ ID NO: 2634850 - RNA, 19 nt, Human
ggauugaaggaugcugucu

SEQ ID NO: 2634851 - RNA, 19 nt, Human
ggacgcucucuggccuucg

SEQ ID NO: 2634852 - RNA, 16 nt, Human
ggacgcucucuggccu

SEQ ID NO: 2634853 - RNA, 15 nt, Human
ggacgcucucuggcc

SEQ ID NO: 2634854 - RNA, 23 nt, Human
ggagaagagcuguucacagccag

SEQ ID NO: 2634855 - RNA, 15 nt, Human
ggagaagagcuguuc

SEQ ID NO: 2634856 - RNA, 11 nt, Human
ggagaagaacu

SEQ ID NO: 2634857 - RNA, 14 nt, Human
ggagaagaacugaa

SEQ ID NO: 2634858 - RNA, 17 nt, Human
ggacauuugcucaugga

SEQ ID NO: 2634859 - RNA, 20 nt, Human
ggacauuugcucauggaauu

SEQ ID NO: 2634860 - RNA, 23 nt, Human
ggagcccugucuccucucucugu

SEQ ID NO: 2634861 - RNA, 18 nt, Human
ggagcccugucuccucuc

SEQ ID NO: 2634862 - RNA, 16 nt, Human
ggaggacgcucucugg

SEQ ID NO: 2634863 - RNA, 19 nt, Human
ggaggggagcaugggaagu

SEQ ID NO: 2634864 - RNA, 13 nt, Human
gcuagauguaugu

SEQ ID NO: 2634865 - RNA, 14 nt, Human
gcuagauguaugua

SEQ ID NO: 2634866 - RNA, 16 nt, Human
gcuagauguauguacu

SEQ ID NO: 2634867 - RNA, 19 nt, Human
gcuauaggugcuacaaaaa

SEQ ID NO: 2634868 - RNA, 21 nt, Human
gcuauaggugcuacaaaaaca

SEQ ID NO: 2634869 - RNA, 20 nt, Human
gccugagcgacagugagacu

SEQ ID NO: 2634870 - RNA, 17 nt, Human
gccugagcgacagugag

SEQ ID NO: 2634871 - RNA, 12 nt, Human
gcugcccucucc

SEQ ID NO: 2634872 - RNA, 21 nt, Human
gcugauuaaaccaaggcuaga

SEQ ID NO: 2634873 - RNA, 23 nt, Human
gcuggaaaaguauguuagugcaa

SEQ ID NO: 2634874 - RNA, 21 nt, Human
gcuggaaaaguauguuagugc

SEQ ID NO: 2634875 - RNA, 23 nt, Human
gcugcccucuccugggcagcugc

SEQ ID NO: 2634876 - RNA, 13 nt, Human
gcugcccucuccu

SEQ ID NO: 2634877 - RNA, 14 nt, Human
gcugcccucuccug

SEQ ID NO: 2634878 - RNA, 15 nt, Human
gcugcccucuccugg

SEQ ID NO: 2634879 - RNA, 16 nt, Human
gcugcccucuccuggg

SEQ ID NO: 2634880 - RNA, 17 nt, Human
gcugcccucuccugggc

SEQ ID NO: 2634881 - RNA, 18 nt, Human
gcugcccucuccugggca

SEQ ID NO: 2634882 - RNA, 20 nt, Human
gcugcccucuccugggcagc

SEQ ID NO: 2634883 - RNA, 22 nt, Human
gcugcccucuccugggcagcug

SEQ ID NO: 2634884 - RNA, 23 nt, Human
gcuggucccagccagcaguucag

SEQ ID NO: 2634885 - RNA, 19 nt, Human
gcuucuguuuuauaauuuu

SEQ ID NO: 2634886 - RNA, 15 nt, Human
gcaguugaaaagacu

SEQ ID NO: 2634887 - RNA, 19 nt, Human
gcaguugaaaagacuccaa

SEQ ID NO: 2634888 - RNA, 16 nt, Human
gcaguugaaaagacuc

SEQ ID NO: 2634889 - RNA, 21 nt, Human
gcaguugaaaagacuccaaag

SEQ ID NO: 2634890 - RNA, 19 nt, Human
gcaguucagagcugcccuc

SEQ ID NO: 2634891 - RNA, 20 nt, Human
gcaguucagagcugcccucu

SEQ ID NO: 2634892 - RNA, 22 nt, Human
gcaguucagagcugcccucucc

SEQ ID NO: 2634893 - RNA, 23 nt, Human
gcaguucagagcugcccucuccu

SEQ ID NO: 2634894 - RNA, 22 nt, Human
gcaucagcugcugaaacaacaa

SEQ ID NO: 2634895 - RNA, 23 nt, Human
gcaucagcugcugaaacaacaaa

SEQ ID NO: 2634896 - RNA, 15 nt, Human
gcacagccucuuaga

SEQ ID NO: 2634897 - RNA, 18 nt, Human
gcacagccucuuagaugc

SEQ ID NO: 2634898 - RNA, 15 nt, Human
gcacgcacacugucu

SEQ ID NO: 2634899 - RNA, 16 nt, Human
gcacgcacacugucug

SEQ ID NO: 2634900 - RNA, 16 nt, Human
gcaggaagcugugaga

SEQ ID NO: 2634901 - RNA, 23 nt, Human
gcagagguugcagugagccgaga

SEQ ID NO: 2634902 - RNA, 18 nt, Human
gcagagguugcagugagc

SEQ ID NO: 2634903 - RNA, 23 nt, Human
gccaugggacagggaggacgcuc

SEQ ID NO: 2634904 - RNA, 22 nt, Human
gccaugggacagggaggacgcu

SEQ ID NO: 2634905 - RNA, 18 nt, Human
gccagacuggcacaguuu

SEQ ID NO: 2634906 - RNA, 15 nt, Human
gccagacuggcacag

SEQ ID NO: 2634907 - RNA, 19 nt, Human
gccagacuggcacaguuuu

SEQ ID NO: 2634908 - RNA, 13 nt, Human
gauugugccccug

SEQ ID NO: 2634909 - RNA, 19 nt, Human
gauguugaaaaaguucugc

SEQ ID NO: 2634910 - RNA, 14 nt, Human
gaucuuuaaaauac

SEQ ID NO: 2634911 - RNA, 18 nt, Human
gaugcaguucugaagaag

SEQ ID NO: 2634912 - RNA, 16 nt, Human
gaugggaaagcauugu

SEQ ID NO: 2634913 - RNA, 21 nt, Human
gaguugaaaaucuuauaauuu

SEQ ID NO: 2634914 - RNA, 19 nt, Human
gagugaacaaauuuacaga

SEQ ID NO: 2634915 - RNA, 23 nt, Human
gagugaacaaauuuacagagaca

SEQ ID NO: 2634916 - RNA, 22 nt, Human
gagugaacaaauuuacagagac

SEQ ID NO: 2634917 - RNA, 13 nt, Human
gagcuacaaaugc

SEQ ID NO: 2634918 - RNA, 12 nt, Human
gagcuacaaaug

SEQ ID NO: 2634919 - RNA, 17 nt, Human
gagcugcccucuccugg

SEQ ID NO: 2634920 - RNA, 15 nt, Human
gagcugcccucuccu

SEQ ID NO: 2634921 - RNA, 16 nt, Human
gagcugcccucuccug

SEQ ID NO: 2634922 - RNA, 14 nt, Human
gagcugcccucucc

SEQ ID NO: 2634923 - RNA, 14 nt, Human
gagcuacaaaugca

SEQ ID NO: 2634924 - RNA, 21 nt, Human
gagcaggcuacugucagcucc

SEQ ID NO: 2634925 - RNA, 19 nt, Human
gaggcagagguugcaguga

SEQ ID NO: 2634926 - RNA, 23 nt, Human
cuauucaaacagucucaggaaau

SEQ ID NO: 2634927 - RNA, 16 nt, Human
cuauucaaacagucuc

SEQ ID NO: 2634928 - RNA, 18 nt, Human
cuauucaaacagucucag

SEQ ID NO: 2634929 - RNA, 18 nt, Human
cuauauuguuugcuaagc

SEQ ID NO: 2634930 - RNA, 20 nt, Human
cuauaggugcuacaaaaaca

SEQ ID NO: 2634931 - RNA, 22 nt, Human
cuauaggugcuacaaaaacaca

SEQ ID NO: 2634932 - RNA, 21 nt, Human
cuauaggugcuacaaaaacac

SEQ ID NO: 2634933 - RNA, 16 nt, Human
cuaguaauuggaaagg

SEQ ID NO: 2634934 - RNA, 20 nt, Human
cuagugaaacucguuaauuu

SEQ ID NO: 2634935 - RNA, 19 nt, Human
cuagugaaagaggcagcuu

SEQ ID NO: 2634936 - RNA, 18 nt, Human
cuagugaaagaggcagcu

SEQ ID NO: 2634937 - RNA, 21 nt, Human
cuagugagcagucaggaaaga

SEQ ID NO: 2634938 - RNA, 21 nt, Human
cucauuuccaagcaaguauua

SEQ ID NO: 2634939 - RNA, 14 nt, Human
cucauuucuagcag

SEQ ID NO: 2634940 - RNA, 13 nt, Human
cuccaaagaaaug

SEQ ID NO: 2634941 - RNA, 21 nt, Human
cuccaaacugacucuuaagaa

SEQ ID NO: 2634942 - RNA, 12 nt, Human
cuccaaagaaau

SEQ ID NO: 2634943 - RNA, 17 nt, Human
cuccaccuugcagcucu

SEQ ID NO: 2634944 - RNA, 12 nt, Human
cuccauccugag

SEQ ID NO: 2634945 - RNA, 20 nt, Human
cuccccuccucugcuugcca

SEQ ID NO: 2634946 - RNA, 13 nt, Human
cuccauccugagg

SEQ ID NO: 2634947 - RNA, 13 nt, Human
cuccccuccucug

SEQ ID NO: 2634948 - RNA, 11 nt, Human
cuccccuccuc

SEQ ID NO: 2634949 - RNA, 15 nt, Human
cugaggcuccacuug

SEQ ID NO: 2634950 - RNA, 21 nt, Human
cugaggcuccacuuggucugu

SEQ ID NO: 2634951 - RNA, 15 nt, Human
cugcaauaaaauggg

SEQ ID NO: 2634952 - RNA, 22 nt, Human
cugcaauaaaauggguuuuacu

SEQ ID NO: 2634953 - RNA, 20 nt, Human
cugcaucagcugcugaaaca

SEQ ID NO: 2634954 - RNA, 14 nt, Human
cugaagaagauggu

SEQ ID NO: 2634955 - RNA, 23 nt, Human
cugacgacuugagugcucaguag

SEQ ID NO: 2634956 - RNA, 18 nt, Human
cugagaaagacuauucaa

SEQ ID NO: 2634957 - RNA, 15 nt, Human
cugagaaagacuauu

SEQ ID NO: 2634958 - RNA, 13 nt, Human
cugagaaagacua

SEQ ID NO: 2634959 - RNA, 12 nt, Human
cugagaaagacu

SEQ ID NO: 2634960 - RNA, 21 nt, Human
cugagaugugaacacaucagc

SEQ ID NO: 2634961 - RNA, 20 nt, Human
cugagaaagacuauucaaac

SEQ ID NO: 2634962 - RNA, 19 nt, Human
cugagaaagacuauucaaa

SEQ ID NO: 2634963 - RNA, 20 nt, Human
cugagaugugaacacaucag

SEQ ID NO: 2634964 - RNA, 16 nt, Human
cugagaugugaacaca

SEQ ID NO: 2634965 - RNA, 16 nt, Human
cugagcaggauuuuaa

SEQ ID NO: 2634966 - RNA, 19 nt, Human
cucuuaagaagacugcauu

SEQ ID NO: 2634967 - RNA, 21 nt, Human
cucuggccuucggccuccauc

SEQ ID NO: 2634968 - RNA, 22 nt, Human
cucuggccuucggccuccaucc

SEQ ID NO: 2634969 - RNA, 21 nt, Human
gaacuagaguuuagcuggaaa

SEQ ID NO: 2634970 - RNA, 22 nt, Human
gaacuagaguuuagcuggaaaa

SEQ ID NO: 2634971 - RNA, 21 nt, Human
gaagaagcaccaaucaugaau

SEQ ID NO: 2634972 - RNA, 21 nt, Human
gaacuuguaaaggaauuuaaa

SEQ ID NO: 2634973 - RNA, 22 nt, Human
gaacuuccagauccuggaaauc

SEQ ID NO: 2634974 - RNA, 15 nt, Human
gaacucccuuucaac

SEQ ID NO: 2634975 - RNA, 14 nt, Human
gaacucccuuucaa

SEQ ID NO: 2634976 - RNA, 13 nt, Human
gaaauauuauguu

SEQ ID NO: 2634977 - RNA, 16 nt, Human
gaaauauuauguuaaa

SEQ ID NO: 2634978 - RNA, 22 nt, Human
gaaauguaagggaaacugccag

SEQ ID NO: 2634979 - RNA, 17 nt, Human
gaagacugcauuauauu

SEQ ID NO: 2634980 - RNA, 21 nt, Human
gaagccuuggggcugaugcag

SEQ ID NO: 2634981 - RNA, 20 nt, Human
gaauaauccuaaacauauga

SEQ ID NO: 2634982 - RNA, 14 nt, Human
gaauacuuuauaaa

SEQ ID NO: 2634983 - RNA, 20 nt, Human
gaaaaucuuauaauuuaaaa

SEQ ID NO: 2634984 - RNA, 12 nt, Human
gaaaauaucacu

SEQ ID NO: 2634985 - RNA, 19 nt, Human
gaaaaucuuauaauuuaaa

SEQ ID NO: 2634986 - RNA, 19 nt, Human
gaaaauaacgauaaaagac

SEQ ID NO: 2634987 - RNA, 22 nt, Human
gaaaacaauaacgauaaaagac

SEQ ID NO: 2634988 - RNA, 22 nt, Human
cuugccaucccucccuccaccu

SEQ ID NO: 2634989 - RNA, 21 nt, Human
cuugccaucccucccuccacc

SEQ ID NO: 2634990 - RNA, 19 nt, Human
cuuguaaaggaauuuaaaa

SEQ ID NO: 2634991 - RNA, 20 nt, Human
cuuuaaagggauggcaagau

SEQ ID NO: 2634992 - RNA, 18 nt, Human
cuuuaaagggauggcaag

SEQ ID NO: 2634993 - RNA, 13 nt, Human
cuuuccacagaag

SEQ ID NO: 2634994 - RNA, 21 nt, Human
cuuuauuuucuauaauuuaaa

SEQ ID NO: 2634995 - RNA, 16 nt, Human
cuguuaaaagaugaaa

SEQ ID NO: 2634996 - RNA, 15 nt, Human
cuguuaaaagaugaa

SEQ ID NO: 2634997 - RNA, 19 nt, Human
cuguuaaaagaugaaaaua

SEQ ID NO: 2634998 - RNA, 18 nt, Human
cugucuucacaacagauu

SEQ ID NO: 2634999 - RNA, 14 nt, Human
cuucacaacagauu

SEQ ID NO: 2635000 - RNA, 12 nt, Human
cuucacaacaga

SEQ ID NO: 2635001 - RNA, 17 nt, Human
cuucaaauccuugaaga

SEQ ID NO: 2635002 - RNA, 16 nt, Human
cuucagcgguuuauau

SEQ ID NO: 2635003 - RNA, 15 nt, Human
cuucagccugaaaga

SEQ ID NO: 2635004 - RNA, 20 nt, Human
cuucggccuccauccugagg

SEQ ID NO: 2635005 - RNA, 20 nt, Human
cuuccuuggacucauuuuaa

SEQ ID NO: 2635006 - RNA, 14 nt, Human
cuguuuuauaauuu

SEQ ID NO: 2635007 - RNA, 15 nt, Human
cuguuuuauaauuuu

SEQ ID NO: 2635008 - RNA, 21 nt, Human
cuuaagaagacugcauuauau

SEQ ID NO: 2635009 - RNA, 23 nt, Human
cuuaagaagacugcauuauauuu

SEQ ID NO: 2635010 - RNA, 20 nt, Human
cuuaauuaaaagaauauuuu

SEQ ID NO: 2635011 - RNA, 19 nt, Human
cuuaauuaaaagaauauuu

SEQ ID NO: 2635012 - RNA, 17 nt, Human
cuuaauuaaaagaauau

SEQ ID NO: 2635013 - RNA, 16 nt, Human
cuuaauuaaaagaaua

SEQ ID NO: 2635014 - RNA, 16 nt, Human
ccgggcguggugguga

SEQ ID NO: 2635015 - RNA, 17 nt, Human
ccucccuccaccucccu

SEQ ID NO: 2635016 - RNA, 20 nt, Human
ccucccuccaccucccugca

SEQ ID NO: 2635017 - RNA, 18 nt, Human
ccuccucugcuugccauc

SEQ ID NO: 2635018 - RNA, 16 nt, Human
ccuccucugcuugcca

SEQ ID NO: 2635019 - RNA, 13 nt, Human
ccuccucugcuug

SEQ ID NO: 2635020 - RNA, 17 nt, Human
ccuccaccucccugcaa

SEQ ID NO: 2635021 - RNA, 22 nt, Human
ccuccaccucccugcaauaaaa

SEQ ID NO: 2635022 - RNA, 13 nt, Human
ccuccaccucccu

SEQ ID NO: 2635023 - RNA, 14 nt, Human
ccuccaccucccug

SEQ ID NO: 2635024 - RNA, 15 nt, Human
ccuccaccucccugc

SEQ ID NO: 2635025 - RNA, 14 nt, Human
ccuccauccugagg

SEQ ID NO: 2635026 - RNA, 20 nt, Human
cccacaagaaaugaaagcag

SEQ ID NO: 2635027 - RNA, 13 nt, Human
cccacaagaaaug

SEQ ID NO: 2635028 - RNA, 14 nt, Human
cccuccaccucccu

SEQ ID NO: 2635029 - RNA, 12 nt, Human
cccuccaccucc

SEQ ID NO: 2635030 - RNA, 19 nt, Human
cccuccaccucccugcaau

SEQ ID NO: 2635031 - RNA, 15 nt, Human
cccuccaccucccug

SEQ ID NO: 2635032 - RNA, 17 nt, Human
cccuccaccucccugca

SEQ ID NO: 2635033 - RNA, 14 nt, Human
cccucuccugggca

SEQ ID NO: 2635034 - RNA, 15 nt, Human
cccucuccugggcag

SEQ ID NO: 2635035 - RNA, 11 nt, Human
cccucuccugg

SEQ ID NO: 2635036 - RNA, 12 nt, Human
cccucuccuggg

SEQ ID NO: 2635037 - RNA, 13 nt, Human
cccucuccugggc

SEQ ID NO: 2635038 - RNA, 15 nt, Human
cccgugggguuccuc

SEQ ID NO: 2635039 - RNA, 22 nt, Human
ccugggcagcugccuccccucc

SEQ ID NO: 2635040 - RNA, 23 nt, Human
ccuggaaaucaggguuaguauug

SEQ ID NO: 2635041 - RNA, 16 nt, Human
ccugcaauaaaauggg

SEQ ID NO: 2635042 - RNA, 11 nt, Human
ccugagcccca

SEQ ID NO: 2635043 - RNA, 18 nt, Human
cgagcaggcuacugucag

SEQ ID NO: 2635044 - RNA, 20 nt, Human
ccuucggccuccauccugag

SEQ ID NO: 2635045 - RNA, 19 nt, Human
ccuucggccuccauccuga

SEQ ID NO: 2635046 - RNA, 14 nt, Human
ccuucggccuccau

SEQ ID NO: 2635047 - RNA, 12 nt, Human
ccuucagccuga

SEQ ID NO: 2635048 - RNA, 14 nt, Human
ccuugaugaagaag

SEQ ID NO: 2635049 - RNA, 19 nt, Human
ccuuggggcugaugcaguu

SEQ ID NO: 2635050 - RNA, 20 nt, Human
ccuugaaaacuuuaugcuaa

SEQ ID NO: 2635051 - RNA, 21 nt, Human
ccuguuaaaagaugaaaauau

SEQ ID NO: 2635052 - RNA, 20 nt, Human
ccuguuaaaagaugaaaaua

SEQ ID NO: 2635053 - RNA, 14 nt, Human
ccaccucccugcaa

SEQ ID NO: 2635054 - RNA, 22 nt, Human
ccagccagcaguucagagcugc

SEQ ID NO: 2635055 - RNA, 13 nt, Human
ccagcaguucaga

SEQ ID NO: 2635056 - RNA, 18 nt, Human
ccagcaguucagagcugc

SEQ ID NO: 2635057 - RNA, 19 nt, Human
ccagcaguucagagcugcc

SEQ ID NO: 2635058 - RNA, 20 nt, Human
ccagcaguucagagcugccc

SEQ ID NO: 2635059 - RNA, 21 nt, Human
ccagcaguucagagcugcccu

SEQ ID NO: 2635060 - RNA, 22 nt, Human
ccagcaguucagagcugcccuc

SEQ ID NO: 2635061 - RNA, 23 nt, Human
ccagcaguucagagcugcccucu

SEQ ID NO: 2635062 - RNA, 19 nt, Human
ccaguguuuuaggagcaug

SEQ ID NO: 2635063 - RNA, 21 nt, Human
ccaguuauggcuauaggugcu

SEQ ID NO: 2635064 - RNA, 14 nt, Human
ccaguuauggcuau

SEQ ID NO: 2635065 - RNA, 19 nt, Human
ccaugggacagggaggacg

SEQ ID NO: 2635066 - RNA, 16 nt, Human
ccaugggacagggagg

SEQ ID NO: 2635067 - RNA, 19 nt, Human
caugagguacugagaguga

SEQ ID NO: 2635068 - RNA, 16 nt, Human
caugagguacugagag

SEQ ID NO: 2635069 - RNA, 18 nt, Human
caugaagauguagaggag

SEQ ID NO: 2635070 - RNA, 19 nt, Human
caugaagauguagaggaga

SEQ ID NO: 2635071 - RNA, 15 nt, Human
cauauauaacaaugc

SEQ ID NO: 2635072 - RNA, 13 nt, Human
cauauauaacaau

SEQ ID NO: 2635073 - RNA, 20 nt, Human
caucccucccuccaccuccc

SEQ ID NO: 2635074 - RNA, 22 nt, Human
caucccucccuccaccucccug

SEQ ID NO: 2635075 - RNA, 23 nt, Human
caucccucccuccaccucccugc

SEQ ID NO: 2635076 - RNA, 18 nt, Human
caucccuuaccugggaaa

SEQ ID NO: 2635077 - RNA, 22 nt, Human
cauuccaacuaucucauuucca

SEQ ID NO: 2635078 - RNA, 13 nt, Human
cauucuggaauaa

SEQ ID NO: 2635079 - RNA, 21 nt, Human
cauuguaaaugugcuuuuaaa

SEQ ID NO: 2635080 - RNA, 23 nt, Human
caugggacagggaggacgcucuc

SEQ ID NO: 2635081 - RNA, 20 nt, Human
cauggaauuggagcucgugg

SEQ ID NO: 2635082 - RNA, 20 nt, Human
caugugcuaguaauuggaaa

SEQ ID NO: 2635083 - RNA, 18 nt, Human
cagggacaggauaagagg

SEQ ID NO: 2635084 - RNA, 17 nt, Human
cagggcauggcugggaa

SEQ ID NO: 2635085 - RNA, 11 nt, Human
caggggacagg

SEQ ID NO: 2635086 - RNA, 16 nt, Human
caggggacaggauggu

SEQ ID NO: 2635087 - RNA, 14 nt, Human
caggcuacugucag

SEQ ID NO: 2635088 - RNA, 13 nt, Human
caggcuagaugua

SEQ ID NO: 2635089 - RNA, 19 nt, Human
caggcuagauguauguacu

SEQ ID NO: 2635090 - RNA, 19 nt, Human
caggcccccaggugccagu

SEQ ID NO: 2635091 - RNA, 14 nt, Human
caggcccccaggug

SEQ ID NO: 2635092 - RNA, 20 nt, Human
caggcccccaggugccaguu

SEQ ID NO: 2635093 - RNA, 16 nt, Human
caggauuuuaaucuuu

SEQ ID NO: 2635094 - RNA, 21 nt, Human
caggaugguucccuugaugaa

SEQ ID NO: 2635095 - RNA, 23 nt, Human
caggaugguucccuugaugaaga

SEQ ID NO: 2635096 - RNA, 13 nt, Human
caguccaugaaga

SEQ ID NO: 2635097 - RNA, 22 nt, Human
cagucaggaaagagaacuucca

SEQ ID NO: 2635098 - RNA, 15 nt, Human
cagucaggaaagaga

SEQ ID NO: 2635099 - RNA, 18 nt, Human
cagucaggaaagagaacu

SEQ ID NO: 2635100 - RNA, 12 nt, Human
caguagugauag

SEQ ID NO: 2635101 - RNA, 12 nt, Human
caguauggcagc

SEQ ID NO: 2635102 - RNA, 15 nt, Human
cagugagacagcucu

SEQ ID NO: 2635103 - RNA, 20 nt, Human
cagugaaagaaaauaacaau

SEQ ID NO: 2635104 - RNA, 16 nt, Human
cagugaaagaaaauaa

SEQ ID NO: 2635105 - RNA, 17 nt, Human
cagugauuaccagggac

SEQ ID NO: 2635106 - RNA, 18 nt, Human
cagugauuaccagggacu

SEQ ID NO: 2635107 - RNA, 23 nt, Human
cagcaagggugaugggaaagcau

SEQ ID NO: 2635108 - RNA, 22 nt, Human
cagcaagggugaugggaaagca

SEQ ID NO: 2635109 - RNA, 19 nt, Human
cagcaagggugaugggaaa

SEQ ID NO: 2635110 - RNA, 14 nt, Human
cagauuuuccugaa

SEQ ID NO: 2635111 - RNA, 15 nt, Human
cagauuuuccugaaa

SEQ ID NO: 2635112 - RNA, 23 nt, Human
cagcaacgcaggcccccaggugc

SEQ ID NO: 2635113 - RNA, 18 nt, Human
caggaaccacaagacugc

SEQ ID NO: 2635114 - RNA, 23 nt, Human
cagcuuuccucaaaacuucagac

SEQ ID NO: 2635115 - RNA, 18 nt, Human
cagcuugaaacugagaug

SEQ ID NO: 2635116 - RNA, 19 nt, Human
cagcuguaugauucccagc

SEQ ID NO: 2635117 - RNA, 22 nt, Human
caggaagcugugagagcaguuu

SEQ ID NO: 2635118 - RNA, 13 nt, Human
caggaagcuguga

SEQ ID NO: 2635119 - RNA, 14 nt, Human
caggaagcugugag

SEQ ID NO: 2635120 - RNA, 16 nt, Human
caggaaguagaggagg

SEQ ID NO: 2635121 - RNA, 15 nt, Human
caggaaguagaggag

SEQ ID NO: 2635122 - RNA, 16 nt, Human
cagcucuccccuucuc

SEQ ID NO: 2635123 - RNA, 20 nt, Human
cagcucugcauacucauuag

SEQ ID NO: 2635124 - RNA, 21 nt, Human
cagcugcugaaacaacaaaua

SEQ ID NO: 2635125 - RNA, 20 nt, Human
cagcugcugaaacaacaaau

SEQ ID NO: 2635126 - RNA, 18 nt, Human
cagcuguaugauucccag

SEQ ID NO: 2635127 - RNA, 16 nt, Human
cagccuaguugaucag

SEQ ID NO: 2635128 - RNA, 13 nt, Human
cagcccucagaau

SEQ ID NO: 2635129 - RNA, 19 nt, Human
cagcuacuugggaggcuga

SEQ ID NO: 2635130 - RNA, 19 nt, Human
cagacauagaauuaacaca

SEQ ID NO: 2635131 - RNA, 17 nt, Human
cagacauagaauuaaca

SEQ ID NO: 2635132 - RNA, 21 nt, Human
cagaaucgcuccaccuugcag

SEQ ID NO: 2635133 - RNA, 23 nt, Human
cagaaucgcuccaccuugcagcu

SEQ ID NO: 2635134 - RNA, 20 nt, Human
cagaagcaacccaaauguuc

SEQ ID NO: 2635135 - RNA, 19 nt, Human
cagaagcaacccaaauguu

SEQ ID NO: 2635136 - RNA, 18 nt, Human
cagaaagcagaacaguga

SEQ ID NO: 2635137 - RNA, 23 nt, Human
cagaacagugauuaccagggacu

SEQ ID NO: 2635138 - RNA, 19 nt, Human
cagaaagcagaacagugau

SEQ ID NO: 2635139 - RNA, 20 nt, Human
cagagccccacccucagaug

SEQ ID NO: 2635140 - RNA, 17 nt, Human
cagaugcacaugagcug

SEQ ID NO: 2635141 - RNA, 14 nt, Human
cagauccuggaaau

SEQ ID NO: 2635142 - RNA, 13 nt, Human
cagauccuggaaa

SEQ ID NO: 2635143 - RNA, 14 nt, Human
cagauaaacaguag

SEQ ID NO: 2635144 - RNA, 23 nt, Human
cagauaaauaguuuaugauucca

SEQ ID NO: 2635145 - RNA, 14 nt, Human
cagauaaucacaau

SEQ ID NO: 2635146 - RNA, 20 nt, Human
cacccucagaugcacaugag

SEQ ID NO: 2635147 - RNA, 13 nt, Human
caccucccugcaa

SEQ ID NO: 2635148 - RNA, 14 nt, Human
caccucccugcaau

SEQ ID NO: 2635149 - RNA, 10 nt, Human
caccucccug

SEQ ID NO: 2635150 - RNA, 11 nt, Human
caccucaugga

SEQ ID NO: 2635151 - RNA, 12 nt, Human
caccucauggaa

SEQ ID NO: 2635152 - RNA, 14 nt, Human
caccucauggaauu

SEQ ID NO: 2635153 - RNA, 15 nt, Human
cacgcacacugucug

SEQ ID NO: 2635154 - RNA, 22 nt, Human
cacgagcaggcuacugucagcu

SEQ ID NO: 2635155 - RNA, 17 nt, Human
cacgagcaggcuacugu

SEQ ID NO: 2635156 - RNA, 20 nt, Human
cacgagcaggcuacugucag

SEQ ID NO: 2635157 - RNA, 19 nt, Human
cacgagcaggcuacuguca

SEQ ID NO: 2635158 - RNA, 13 nt, Human
cacuaaacaaaga

SEQ ID NO: 2635159 - RNA, 22 nt, Human
cacguucuuacuaguuucccuu

SEQ ID NO: 2635160 - RNA, 16 nt, Human
cacucaaaucaagaaa

SEQ ID NO: 2635161 - RNA, 14 nt, Human
cacuaguauuucua

SEQ ID NO: 2635162 - RNA, 19 nt, Human
cacuaguauuucuaugaaa

SEQ ID NO: 2635163 - RNA, 21 nt, Human
cacuaaauugacacuuaaaaa

SEQ ID NO: 2635164 - RNA, 17 nt, Human
cacuaagagagaaugag

SEQ ID NO: 2635165 - RNA, 14 nt, Human
cacugucaagauga

SEQ ID NO: 2635166 - RNA, 22 nt, Human
cacuguggguagacacacauga

SEQ ID NO: 2635167 - RNA, 24 nt, Human
cacuguggguagacacacaugaag

SEQ ID NO: 2635168 - RNA, 19 nt, Human
cacuguggguagacacaca

SEQ ID NO: 2635169 - RNA, 15 nt, Human
cacuuggucugugag

SEQ ID NO: 2635170 - RNA, 23 nt, Human
cacuugaacccgggaggcagagg

SEQ ID NO: 2635171 - RNA, 21 nt, Human
cacuugaacccgggaggcaga

SEQ ID NO: 2635172 - RNA, 20 nt, Human
cacuugaacccgggaggcag

SEQ ID NO: 2635173 - RNA, 20 nt, Human
cacugccuucucaacuccaa

SEQ ID NO: 2635174 - RNA, 20 nt, Human
cacugacuucuaaguaaaac

SEQ ID NO: 2635175 - RNA, 16 nt, Human
cacugacuucuaagua

SEQ ID NO: 2635176 - RNA, 15 nt, Human
cacugacuucuaagu

SEQ ID NO: 2635177 - RNA, 14 nt, Human
cacugacuucuaag

SEQ ID NO: 2635178 - RNA, 21 nt, Human
cacugacuucuaaguaaaacc

SEQ ID NO: 2635179 - RNA, 13 nt, Human
aaaaacacagcaa

SEQ ID NO: 2635180 - RNA, 18 nt, Human
aaaaacacagcaagggug

SEQ ID NO: 2635181 - RNA, 23 nt, Human
aucagcugcugaaacaacaaaua

SEQ ID NO: 2635182 - RNA, 22 nt, Human
aucagcugcugaaacaacaaau

SEQ ID NO: 2635183 - RNA, 21 nt, Human
aucagcugcugaaacaacaaa

SEQ ID NO: 2635184 - RNA, 17 nt, Human
auauuuauuuuaauaau

SEQ ID NO: 2635185 - RNA, 14 nt, Human
auauuuauuuuaau

SEQ ID NO: 2635186 - RNA, 15 nt, Human
auauuuauuuuaaua

SEQ ID NO: 2635187 - RNA, 19 nt, Human
auguaagggaaacugccag

SEQ ID NO: 2635188 - RNA, 16 nt, Human
auguaagggaaacugc

SEQ ID NO: 2635189 - RNA, 14 nt, Human
auguaagggaaacu

SEQ ID NO: 2635190 - RNA, 17 nt, Human
auguucuaagaagugaa

SEQ ID NO: 2635191 - RNA, 18 nt, Human
augugggcagugauguca

SEQ ID NO: 2635192 - RNA, 12 nt, Human
aguccuguaaug

SEQ ID NO: 2635193 - RNA, 23 nt, Human
agucaaauugugugaaagguacu

SEQ ID NO: 2635194 - RNA, 19 nt, Human
agucaaauugugugaaagg

SEQ ID NO: 2635195 - RNA, 15 nt, Human
agugucuuaauuaaa

SEQ ID NO: 2635196 - RNA, 21 nt, Human
agugucuuaauuaaaagaaua

SEQ ID NO: 2635197 - RNA, 18 nt, Human
agugucuuaauuaaaaga

SEQ ID NO: 2635198 - RNA, 17 nt, Human
agugucuuaauuaaaag

SEQ ID NO: 2635199 - RNA, 21 nt, Human
aguugaaaagacuccaaagaa

SEQ ID NO: 2635200 - RNA, 22 nt, Human
aguugaaaaucuuauaauuuaa

SEQ ID NO: 2635201 - RNA, 22 nt, Human
aguugaaaagacuccaaagaaa

SEQ ID NO: 2635202 - RNA, 23 nt, Human
aguugaaaaucuuauaauuuaaa

SEQ ID NO: 2635203 - RNA, 22 nt, Human
auauuuauuacuguaagaaaau

SEQ ID NO: 2635204 - RNA, 13 nt, Human
auauuuauuuuaa

SEQ ID NO: 2635205 - RNA, 16 nt, Human
auauuauguuaaaacu

SEQ ID NO: 2635206 - RNA, 20 nt, Human
auaugcuucuguuuuauaau

SEQ ID NO: 2635207 - RNA, 22 nt, Human
auaugcuucuguuuuauaauuu

SEQ ID NO: 2635208 - RNA, 18 nt, Human
auagcagcuuauucacaa

SEQ ID NO: 2635209 - RNA, 15 nt, Human
auagguuuaauaauu

SEQ ID NO: 2635210 - RNA, 14 nt, Human
auaggugcuacaaa

SEQ ID NO: 2635211 - RNA, 23 nt, Human
auaggugcuacaaaaacacagca

SEQ ID NO: 2635212 - RNA, 21 nt, Human
auaggugcuacaaaaacacag

SEQ ID NO: 2635213 - RNA, 15 nt, Human
auaggugcuacaaaa

SEQ ID NO: 2635214 - RNA, 14 nt, Human
auagucaaauugug

SEQ ID NO: 2635215 - RNA, 18 nt, Human
auaaaggauuaaugucaa

SEQ ID NO: 2635216 - RNA, 15 nt, Human
auaaugucccuucac

SEQ ID NO: 2635217 - RNA, 23 nt, Human
auaauguuucaaacauauauaac

SEQ ID NO: 2635218 - RNA, 20 nt, Human
auacacacucaaaucaagaa

SEQ ID NO: 2635219 - RNA, 18 nt, Human
auacacacucaaaucaag

SEQ ID NO: 2635220 - RNA, 17 nt, Human
auacacacucaaaucaa

SEQ ID NO: 2635221 - RNA, 17 nt, Human
aggcuagauguauguac

SEQ ID NO: 2635222 - RNA, 15 nt, Human
aggcuagauguaugu

SEQ ID NO: 2635223 - RNA, 16 nt, Human
aggcuagauguaugua

SEQ ID NO: 2635224 - RNA, 17 nt, Human
aggcuacugucagcucc

SEQ ID NO: 2635225 - RNA, 21 nt, Human
aggcuagaaccaccugccuau

SEQ ID NO: 2635226 - RNA, 24 nt, Human
aggugcuacaaaaacacagcaagg

SEQ ID NO: 2635227 - RNA, 23 nt, Human
aggugcuacaaaaacacagcaag

SEQ ID NO: 2635228 - RNA, 18 nt, Human
aggugcuacaaaaacaca

SEQ ID NO: 2635229 - RNA, 22 nt, Human
aggugcuacaaaaacacagcaa

SEQ ID NO: 2635230 - RNA, 21 nt, Human
aggugcuacaaaaacacagca

SEQ ID NO: 2635231 - RNA, 20 nt, Human
aggugcuacaaaaacacagc

SEQ ID NO: 2635232 - RNA, 19 nt, Human
aggugcuacaaaaacacag

SEQ ID NO: 2635233 - RNA, 20 nt, Human
agguaaaagcaucacaugaa

SEQ ID NO: 2635234 - RNA, 22 nt, Human
agcuccccucggagaagagcug

SEQ ID NO: 2635235 - RNA, 23 nt, Human
aggaugguucccuugaugaagaa

SEQ ID NO: 2635236 - RNA, 16 nt, Human
agcaguugaaaagacu

SEQ ID NO: 2635237 - RNA, 13 nt, Human
agcaguugaaaag

SEQ ID NO: 2635238 - RNA, 23 nt, Human
agcaguucagagcugcccucucc

SEQ ID NO: 2635239 - RNA, 16 nt, Human
agcacugacuucuaag

SEQ ID NO: 2635240 - RNA, 21 nt, Human
agacugcauuauauuuauuac

SEQ ID NO: 2635241 - RNA, 17 nt, Human
agagaacuuccagaucc

SEQ ID NO: 2635242 - RNA, 21 nt, Human
agacgugcacgcacacugucu

SEQ ID NO: 2635243 - RNA, 22 nt, Human
agacgugcacgcacacugucug

SEQ ID NO: 2635244 - RNA, 15 nt, Human
aaugauuaugaauua

SEQ ID NO: 2635245 - RNA, 23 nt, Human
aaugauuaugaauuacauuugua

SEQ ID NO: 2635246 - RNA, 21 nt, Human
aaugauuaugaauuacauuug

SEQ ID NO: 2635247 - RNA, 15 nt, Human
aauccaaugaaauga

SEQ ID NO: 2635248 - RNA, 23 nt, Human
aauguuucaaacauauauaacaa

SEQ ID NO: 2635249 - RNA, 20 nt, Human
aaggcagcucuaaaugucaa

SEQ ID NO: 2635250 - RNA, 23 nt, Human
aagggaaacugccagcaacgcag

SEQ ID NO: 2635251 - RNA, 17 nt, Human
aagggaaacugccagca

SEQ ID NO: 2635252 - RNA, 16 nt, Human
aagggaaacugccagc

SEQ ID NO: 2635253 - RNA, 17 nt, Human
aaguccaagcauaccaa

SEQ ID NO: 2635254 - RNA, 18 nt, Human
aaguccaagcauuuagau

SEQ ID NO: 2635255 - RNA, 21 nt, Human
aaguagggacuucugucuuca

SEQ ID NO: 2635256 - RNA, 23 nt, Human
aaacugagaugugaacacaucag

SEQ ID NO: 2635257 - RNA, 21 nt, Human
aaacugagaugugaacacauc

SEQ ID NO: 2635258 - RNA, 15 nt, Human
aaagaaauguaaggg

SEQ ID NO: 2635259 - RNA, 16 nt, Human
aaaaucucaauauuuc

SEQ ID NO: 2635260 - RNA, 16 nt, Human
aaaaagaaacauuugg

SEQ ID NO: 2635261 - RNA, 18 nt, Human
aaaaguucugcagauaaa

SEQ ID NO: 2635262 - RNA, 21 nt, Human
aaaaucuacacuccagugaga

SEQ ID NO: 2635263 - RNA, 16 nt, Human
aaaucaaauaugcaaa

SEQ ID NO: 2635264 - RNA, 15 nt, Human
aaaucaaauaugcaa

SEQ ID NO: 2635265 - RNA, 14 nt, Human
aaaucaaauaugca

SEQ ID NO: 2635266 - RNA, 12 nt, Human
aaaucaaauaug

SEQ ID NO: 2635267 - RNA, 20 nt, Human
aaauauuuauuuuaauaaug

SEQ ID NO: 2635268 - RNA, 15 nt, Human
aaauauuuauuuuaa

SEQ ID NO: 2635269 - RNA, 13 nt, Human
aaauauuuauuuu

SEQ ID NO: 2635270 - RNA, 14 nt, Human
aaaggcagaagcaa

SEQ ID NO: 2635271 - RNA, 20 nt, Human
aacugagaugugaacacauc

SEQ ID NO: 2635272 - RNA, 19 nt, Human
aacugacucuuaagaagac

SEQ ID NO: 2635273 - RNA, 20 nt, Human
aacugacucuuaagaagacu

SEQ ID NO: 2635274 - RNA, 15 nt, Human
aacugacucuuaaga

SEQ ID NO: 2635275 - RNA, 18 nt, Human
aacugacucuuaagaaga

SEQ ID NO: 2635276 - RNA, 21 nt, Human
aacuuuaugcuaagugaaaua

SEQ ID NO: 2635277 - RNA, 20 nt, Human
aacuuuaugcuaagugaaau

SEQ ID NO: 2635278 - RNA, 17 nt, Human
aaccuagggugauauua

SEQ ID NO: 2635279 - RNA, 22 nt, Human
aaccacuggaaaguuuaugguu

SEQ ID NO: 2635280 - RNA, 19 nt, Human
aaauugacacuuaaaaaug

SEQ ID NO: 2635281 - RNA, 17 nt, Human
aaaucuuauaauuuaaa

SEQ ID NO: 2635282 - RNA, 22 nt, Human
aaauguuguucucuucuuuaaa

SEQ ID NO: 2635283 - RNA, 18 nt, Human
aacaaauuuacagagaca

SEQ ID NO: 2635284 - RNA, 16 nt, Human
aacacaucagcuugcc

SEQ ID NO: 2635285 - RNA, 21 nt, Human
acccacaagaaaugaaagcag

SEQ ID NO: 2635286 - RNA, 17 nt, Human
acccacaagaaaugaaa

SEQ ID NO: 2635287 - RNA, 22 nt, Human
acccaguguuuuaggagcauga

SEQ ID NO: 2635288 - RNA, 19 nt, Human
acccaguguuuuaggagca

SEQ ID NO: 2635289 - RNA, 21 nt, Human
acagcaguugaaaagacucca

SEQ ID NO: 2635290 - RNA, 23 nt, Human
acagcaguugaaaagacuccaaa

SEQ ID NO: 2635291 - RNA, 22 nt, Human
acagcaguugaaaagacuccaa

SEQ ID NO: 2635292 - RNA, 13 nt, Human
aauuuugugaagc

SEQ ID NO: 2635293 - RNA, 21 nt, Human
acacgagcaggcuacugucag

SEQ ID NO: 2635294 - RNA, 19 nt, Human
acacgagcaggcuacuguc

SEQ ID NO: 2635295 - RNA, 14 nt, Human
acacgagcaggcua

SEQ ID NO: 2635296 - RNA, 22 nt, Human
acuuuauuuucuauaauuuaaa

SEQ ID NO: 2635297 - RNA, 14 nt, Human
agaaaauaacaaua

SEQ ID NO: 2635298 - RNA, 16 nt, Human
agaaaaucaggcuggc

SEQ ID NO: 2635299 - RNA, 18 nt, Human
acucugucucaguccaug

SEQ ID NO: 2635300 - RNA, 20 nt, Human
acucugucucaguccaugaa

SEQ ID NO: 2635301 - RNA, 13 nt, Human
acugccagcaacg

SEQ ID NO: 2635302 - RNA, 22 nt, Human
acuguaagaaaauaucacuugu

SEQ ID NO: 2635303 - RNA, 19 nt, Human
acuguaagaaaauaucacu

SEQ ID NO: 2635304 - RNA, 13 nt, Human
acuguaagaaaau

SEQ ID NO: 2635305 - RNA, 12 nt, Human
acuucagacaua

SEQ ID NO: 2635306 - RNA, 21 nt, Human
acuucugucuucacaacagau

SEQ ID NO: 2635307 - RNA, 21 nt, Human
acuuggucugugagaugcuag

SEQ ID NO: 2635308 - RNA, 22 nt, Human
acuucugucuucacaacagauu

SEQ ID NO: 2635309 - RNA, 22 nt, Human
acgcaggcccccaggugccagu

SEQ ID NO: 2635310 - RNA, 19 nt, Human
acgcaggcccccaggugcc

SEQ ID NO: 2635311 - RNA, 13 nt, Human
acuaagagagaau

SEQ ID NO: 2635312 - RNA, 17 nt, Human
acucuauguucuaagaa

SEQ ID NO: 2635313 - RNA, 21 nt, Human
acuauucaaacagucucagga

SEQ ID NO: 2635314 - RNA, 20 nt, Human
acuaguauuucuaugaaaua

SEQ ID NO: 2635315 - RNA, 18 nt, Human
cuggauaguccgucucug

SEQ ID NO: 2635316 - RNA, 19 nt, Human
cuggauaguccgucucugc

SEQ ID NO: 2635317 - RNA, 13 nt, Human
cuguuauaaucuu

SEQ ID NO: 2635318 - RNA, 19 nt, Human
cuguuauaaucuuucacag

SEQ ID NO: 2635319 - RNA, 17 nt, Human
cugucggagcccugucu

SEQ ID NO: 2635320 - RNA, 23 nt, Human
cugucggagcccugucuccucuc

SEQ ID NO: 2635321 - RNA, 21 nt, Human
cuuaaaaaugguuuaaauggu

SEQ ID NO: 2635322 - RNA, 21 nt, Human
gaaaacuuuaugcuaagugaa

SEQ ID NO: 2635323 - RNA, 17 nt, Human
gaaaagacuccaaagaa

SEQ ID NO: 2635324 - RNA, 16 nt, Human
gaaaagacuccaaaga

SEQ ID NO: 2635325 - RNA, 14 nt, Human
gaaaagacuccaaa

SEQ ID NO: 2635326 - RNA, 18 nt, Human
gaaagaaaaucaggcugg

SEQ ID NO: 2635327 - RNA, 12 nt, Human
gaaagggauuuu

SEQ ID NO: 2635328 - RNA, 20 nt, Human
gaaagggauuuucagcccuc

SEQ ID NO: 2635329 - RNA, 17 nt, Human
gaacccaaguccaagca

SEQ ID NO: 2635330 - RNA, 16 nt, Human
gaacccaaguccaagc

SEQ ID NO: 2635331 - RNA, 19 nt, Human
gaacccgggaggcagaggu

SEQ ID NO: 2635332 - RNA, 17 nt, Human
gaacccgggaggcagag

SEQ ID NO: 2635333 - RNA, 19 nt, Human
cuuggucugugagaugcua

SEQ ID NO: 2635334 - RNA, 16 nt, Human
cuuggucugugagaug

SEQ ID NO: 2635335 - RNA, 20 nt, Human
cuucucacauuuauauuuuu

SEQ ID NO: 2635336 - RNA, 13 nt, Human
cuucucacauuua

SEQ ID NO: 2635337 - RNA, 21 nt, Human
cuucuaaguaaaaccacagca

SEQ ID NO: 2635338 - RNA, 17 nt, Human
cuucuaaguaaaaccac

SEQ ID NO: 2635339 - RNA, 13 nt, Human
cuucuaaguaaaa

SEQ ID NO: 2635340 - RNA, 21 nt, Human
gaugcugucuucguacuggga

SEQ ID NO: 2635341 - RNA, 16 nt, Human
gcaauaaaauggguuu

SEQ ID NO: 2635342 - RNA, 18 nt, Human
gcaauagucaaauugugu

SEQ ID NO: 2635343 - RNA, 16 nt, Human
gcauuguaaaugugcu

SEQ ID NO: 2635344 - RNA, 15 nt, Human
gcagcuuauucacaa

SEQ ID NO: 2635345 - RNA, 22 nt, Human
gcaguugaaaagacuccaaaga

SEQ ID NO: 2635346 - RNA, 16 nt, Human
gacuauucaaacaguc

SEQ ID NO: 2635347 - RNA, 15 nt, Human
gacuauucaaacagu

SEQ ID NO: 2635348 - RNA, 22 nt, Human
gacuauucaaacagucucagga

SEQ ID NO: 2635349 - RNA, 21 nt, Human
gacagcccuucuuuccacaga

SEQ ID NO: 2635350 - RNA, 20 nt, Human
gacagaaagcagaacaguga

SEQ ID NO: 2635351 - RNA, 14 nt, Human
gacagaaagcagaa

SEQ ID NO: 2635352 - RNA, 20 nt, Human
gacaguauggcagcuuuccu

SEQ ID NO: 2635353 - RNA, 15 nt, Human
gagcgacagugagac

SEQ ID NO: 2635354 - RNA, 13 nt, Human
gagcgacagugag

SEQ ID NO: 2635355 - RNA, 15 nt, Human
ggccuccauccugag

SEQ ID NO: 2635356 - RNA, 14 nt, Human
ggccuccauccuga

SEQ ID NO: 2635357 - RNA, 21 nt, Human
ggcacaguuuucugagaaaga

SEQ ID NO: 2635358 - RNA, 14 nt, Human
ggcuccacuugguc

SEQ ID NO: 2635359 - RNA, 14 nt, Human
aaaaauaacaauga

SEQ ID NO: 2635360 - RNA, 20 nt, Human
gggaacccaaguccaagcau

SEQ ID NO: 2635361 - RNA, 22 nt, Human
gggacagucaccucauggaauu

SEQ ID NO: 2635362 - RNA, 20 nt, Human
gggacagucaccucauggaa

SEQ ID NO: 2635363 - RNA, 21 nt, Human
gggacagucaccucauggaau

SEQ ID NO: 2635364 - RNA, 17 nt, Human
aaaaaugguuuaaaugg

SEQ ID NO: 2635365 - RNA, 15 nt, Human
aaaacuucagacaua

SEQ ID NO: 2635366 - RNA, 15 nt, Human
aaauccauacauuug

SEQ ID NO: 2635367 - RNA, 18 nt, Human
aaauccauacauuugugu

SEQ ID NO: 2635368 - RNA, 17 nt, Human
aaauauuauguuaaaac

SEQ ID NO: 2635369 - RNA, 12 nt, Human
aaaucauuucug

SEQ ID NO: 2635370 - RNA, 23 nt, Human
aaaucauuucugcaucagcugcu

SEQ ID NO: 2635371 - RNA, 22 nt, Human
aaaucauuucugcaucagcugc

SEQ ID NO: 2635372 - RNA, 21 nt, Human
aaaucauuucugcaucagcug

SEQ ID NO: 2635373 - RNA, 19 nt, Human
aaaucauuucugcaucagc

SEQ ID NO: 2635374 - RNA, 23 nt, Human
guagacgugcacgcacacugucu

SEQ ID NO: 2635375 - RNA, 20 nt, Human
guagacgugcacgcacacug

SEQ ID NO: 2635376 - RNA, 15 nt, Human
guacuucaugcuguc

SEQ ID NO: 2635377 - RNA, 21 nt, Human
guacuucaaauccuugaagau

SEQ ID NO: 2635378 - RNA, 22 nt, Human
guacuucaaauccuugaagauu

SEQ ID NO: 2635379 - RNA, 23 nt, Human
aaaguucugcagauaaacaguag

SEQ ID NO: 2635380 - RNA, 20 nt, Human
aaagguauuuuaaucaccaa

SEQ ID NO: 2635381 - RNA, 18 nt, Human
aaaguauguuagugcaaa

SEQ ID NO: 2635382 - RNA, 19 nt, Human
aaauacacacucaaaucaa

SEQ ID NO: 2635383 - RNA, 22 nt, Human
aaauaauuuuuauauuugaaau

SEQ ID NO: 2635384 - RNA, 23 nt, Human
aaauaauuuuuauauuugaaaua

SEQ ID NO: 2635385 - RNA, 15 nt, Human
aaauacacacucaaa

SEQ ID NO: 2635386 - RNA, 23 nt, Human
guacacugccuucucaacuccaa

SEQ ID NO: 2635387 - RNA, 21 nt, Human
aaauaauuuuuauauuugaaa

SEQ ID NO: 2635388 - RNA, 20 nt, Human
guaauaggcguaacuaauuu

SEQ ID NO: 2635389 - RNA, 11 nt, Human
aaacacagcaa

SEQ ID NO: 2635390 - RNA, 14 nt, Human
aaacacagcaaggg

SEQ ID NO: 2635391 - RNA, 12 nt, Human
aaacacagcaag

SEQ ID NO: 2635392 - RNA, 19 nt, Human
ggggaauugaggacacuga

SEQ ID NO: 2635393 - RNA, 14 nt, Human
aaacaguagugaua

SEQ ID NO: 2635394 - RNA, 15 nt, Human
aaacagucucaggaa

SEQ ID NO: 2635395 - RNA, 12 nt, Human
aaaccacagcag

SEQ ID NO: 2635396 - RNA, 15 nt, Human
aaacucguuaauuug

SEQ ID NO: 2635397 - RNA, 21 nt, Human
aaagcacugacuucuaaguaa

SEQ ID NO: 2635398 - RNA, 17 nt, Human
aaagcacugacuucuaa

SEQ ID NO: 2635399 - RNA, 20 nt, Human
aaagggauggcaagaugugg

SEQ ID NO: 2635400 - RNA, 14 nt, Human
aaagguacuucaaa

SEQ ID NO: 2635401 - RNA, 23 nt, Human
aaacuucagcgguuuauauaagc

SEQ ID NO: 2635402 - RNA, 19 nt, Human
aaacuucagacauagaauu

SEQ ID NO: 2635403 - RNA, 13 nt, Human
aaagacagugaaa

SEQ ID NO: 2635404 - RNA, 14 nt, Human
aaagacuccaaaga

SEQ ID NO: 2635405 - RNA, 21 nt, Human
aaagacuccaaagaaauguaa

SEQ ID NO: 2635406 - RNA, 15 nt, Human
aaagacuccaaagaa

SEQ ID NO: 2635407 - RNA, 21 nt, Human
aaagacuauucaaacagucuc

SEQ ID NO: 2635408 - RNA, 17 nt, Human
aaagacuauucaaacag

SEQ ID NO: 2635409 - RNA, 19 nt, Human
aaagacuauucaaacaguc

SEQ ID NO: 2635410 - RNA, 18 nt, Human
aaagacuauucaaacagu

SEQ ID NO: 2635411 - RNA, 15 nt, Human
aaagaggaaugaagu

SEQ ID NO: 2635412 - RNA, 15 nt, Human
aaagaggcagcuuga

SEQ ID NO: 2635413 - RNA, 19 nt, Human
gcuccaccuugcagcucuc

SEQ ID NO: 2635414 - RNA, 15 nt, Human
gcuccacuuggucug

SEQ ID NO: 2635415 - RNA, 21 nt, Human
gcuccccucggagaagagcug

SEQ ID NO: 2635416 - RNA, 19 nt, Human
gcuccacuuggucugugag

SEQ ID NO: 2635417 - RNA, 18 nt, Human
gcuccacuuggucuguga

SEQ ID NO: 2635418 - RNA, 18 nt, Human
gcuagaacucccuuucaa

SEQ ID NO: 2635419 - RNA, 16 nt, Human
gcuagaacucccuuuc

SEQ ID NO: 2635420 - RNA, 15 nt, Human
gcuagaacucccuuu

SEQ ID NO: 2635421 - RNA, 14 nt, Human
gcuagaacucccuu

SEQ ID NO: 2635422 - RNA, 13 nt, Human
gcuagaacucccu

SEQ ID NO: 2635423 - RNA, 12 nt, Human
gcuagaacuccc

SEQ ID NO: 2635424 - RNA, 20 nt, Human
gccuucggccuccauccuga

SEQ ID NO: 2635425 - RNA, 23 nt, Human
gccuucggccuccauccugaggc

SEQ ID NO: 2635426 - RNA, 21 nt, Human
gccuucggccuccauccugag

SEQ ID NO: 2635427 - RNA, 12 nt, Human
gccuccauccug

SEQ ID NO: 2635428 - RNA, 15 nt, Human
gccucuuagaugcag

SEQ ID NO: 2635429 - RNA, 22 nt, Human
ggacucauuuuaaaaaauggaa

SEQ ID NO: 2635430 - RNA, 13 nt, Human
ggagaaacuggaa

SEQ ID NO: 2635431 - RNA, 21 nt, Human
cugacacaugcugaacaucac

SEQ ID NO: 2635432 - RNA, 17 nt, Human
cugaaagaggaaugaag

SEQ ID NO: 2635433 - RNA, 13 nt, Human
cugaaagaggaau

SEQ ID NO: 2635434 - RNA, 17 nt, Human
cucucuggccuucggcc

SEQ ID NO: 2635435 - RNA, 22 nt, Human
cucucuggccuucggccuccau

SEQ ID NO: 2635436 - RNA, 19 nt, Human
cucucuggccuucggccuc

SEQ ID NO: 2635437 - RNA, 14 nt, Human
cuaacuggacuggu

SEQ ID NO: 2635438 - RNA, 15 nt, Human
cgguuuauauaagcu

SEQ ID NO: 2635439 - RNA, 24 nt, Human
cggagaagagcuguucacagccag

SEQ ID NO: 2635440 - RNA, 23 nt, Human
cggagaagagcuguucacagcca

SEQ ID NO: 2635441 - RNA, 19 nt, Human
cucagaaaacaaggaugaa

SEQ ID NO: 2635442 - RNA, 23 nt, Human
cucagaaaacaaggaugaauuaa

SEQ ID NO: 2635443 - RNA, 23 nt, Human
cuaugucauuugcuggagcucug

SEQ ID NO: 2635444 - RNA, 13 nt, Human
cucaaaacugcac

SEQ ID NO: 2635445 - RNA, 17 nt, Human
ccugucucuacuaaaaa

SEQ ID NO: 2635446 - RNA, 21 nt, Human
ccucauuuuuauaaugucccu

SEQ ID NO: 2635447 - RNA, 16 nt, Human
ccucccuucucuucac

SEQ ID NO: 2635448 - RNA, 14 nt, Human
ccucggagaagagc

SEQ ID NO: 2635449 - RNA, 12 nt, Human
ccucggagaaga

SEQ ID NO: 2635450 - RNA, 13 nt, Human
cccaacuccagaa

SEQ ID NO: 2635451 - RNA, 14 nt, Human
ccaucccucccucc

SEQ ID NO: 2635452 - RNA, 15 nt, Human
ccaucccucccucca

SEQ ID NO: 2635453 - RNA, 13 nt, Human
ccaucccucccuc

SEQ ID NO: 2635454 - RNA, 13 nt, Human
ccccugcacucca

SEQ ID NO: 2635455 - RNA, 13 nt, Human
cccuccucugcuu

SEQ ID NO: 2635456 - RNA, 22 nt, Human
cccuccucugcuugccaucccu

SEQ ID NO: 2635457 - RNA, 24 nt, Human
cccagccagcaguucagagcugcc

SEQ ID NO: 2635458 - RNA, 20 nt, Human
caauaaaauccauacauuug

SEQ ID NO: 2635459 - RNA, 23 nt, Human
caauaaaauccauacauuugugu

SEQ ID NO: 2635460 - RNA, 15 nt, Human
caauaaaauggguuu

SEQ ID NO: 2635461 - RNA, 23 nt, Human
cacuccagccugagcgacaguga

SEQ ID NO: 2635462 - RNA, 13 nt, Human
cacuccagccuga

SEQ ID NO: 2635463 - RNA, 12 nt, Human
cacuccagccug

SEQ ID NO: 2635464 - RNA, 15 nt, Human
cacuuaaaaaugguu

SEQ ID NO: 2635465 - RNA, 17 nt, Human
cacuuguguuuugcaag

SEQ ID NO: 2635466 - RNA, 18 nt, Human
cagaacagugauuaccag

SEQ ID NO: 2635467 - RNA, 11 nt, Human
cagaacaguga

SEQ ID NO: 2635468 - RNA, 17 nt, Human
cagaacagugauuacca

SEQ ID NO: 2635469 - RNA, 12 nt, Human
cagaacagugau

SEQ ID NO: 2635470 - RNA, 17 nt, Human
caaacauauauaacaau

SEQ ID NO: 2635471 - RNA, 17 nt, Human
caaacagucucaggaaa

SEQ ID NO: 2635472 - RNA, 16 nt, Human
caaacagucucaggaa

SEQ ID NO: 2635473 - RNA, 15 nt, Human
caaacagucucagga

SEQ ID NO: 2635474 - RNA, 21 nt, Human
caaaaggauaaugaauacuuu

SEQ ID NO: 2635475 - RNA, 15 nt, Human
auuuuuauauuugaa

SEQ ID NO: 2635476 - RNA, 21 nt, Human
auuuuauaucaauuuaaaaaa

SEQ ID NO: 2635477 - RNA, 19 nt, Human
caagacccaaaaggcagaa

SEQ ID NO: 2635478 - RNA, 21 nt, Human
caaaucuuaacuugaaggagu

SEQ ID NO: 2635479 - RNA, 22 nt, Human
auuaugaauuacauuuguauaa

SEQ ID NO: 2635480 - RNA, 19 nt, Human
auuaugaauuacauuugua

SEQ ID NO: 2635481 - RNA, 20 nt, Human
auuaugaauuacauuuguau

SEQ ID NO: 2635482 - RNA, 20 nt, Human
auuucauaccuaucaucuua

SEQ ID NO: 2635483 - RNA, 14 nt, Human
auuucuaugaaaua

SEQ ID NO: 2635484 - RNA, 16 nt, Human
auuuaauaaaugugcc

SEQ ID NO: 2635485 - RNA, 15 nt, Human
auuguuuaaaaucau

SEQ ID NO: 2635486 - RNA, 18 nt, Human
cagggaggacgcucucug

SEQ ID NO: 2635487 - RNA, 17 nt, Human
cagggaggacgcucucu

SEQ ID NO: 2635488 - RNA, 15 nt, Human
cagucucaggaaauc

SEQ ID NO: 2635489 - RNA, 15 nt, Human
cagucaccucaugga

SEQ ID NO: 2635490 - RNA, 18 nt, Human
cagccugagcgacaguga

SEQ ID NO: 2635491 - RNA, 22 nt, Human
cagccugagcgacagugagacu

SEQ ID NO: 2635492 - RNA, 19 nt, Human
cagccugagcgacagugag

SEQ ID NO: 2635493 - RNA, 15 nt, Human
cagcccuucuuucca

SEQ ID NO: 2635494 - RNA, 19 nt, Human
cagcccuucuuuccacaga

SEQ ID NO: 2635495 - RNA, 20 nt, Human
cagcccuucuuuccacagaa

SEQ ID NO: 2635496 - RNA, 21 nt, Human
cagcugccuccccuccucugc

SEQ ID NO: 2635497 - RNA, 22 nt, Human
cagcugccuccccuccucugcu

SEQ ID NO: 2635498 - RNA, 23 nt, Human
cagcugccuccccuccucugcuu

SEQ ID NO: 2635499 - RNA, 24 nt, Human
cagcugccuccccuccucugcuug

SEQ ID NO: 2635500 - RNA, 16 nt, Human
cagcuccccucggaga

SEQ ID NO: 2635501 - RNA, 18 nt, Human
cagcuccccucggagaag

SEQ ID NO: 2635502 - RNA, 17 nt, Human
cagcuccccucggagaa

SEQ ID NO: 2635503 - RNA, 20 nt, Human
cagcuccccucggagaagag

SEQ ID NO: 2635504 - RNA, 23 nt, Human
caggaaaucaaauaugcaaagca

SEQ ID NO: 2635505 - RNA, 17 nt, Human
cagagcugcccucuccu

SEQ ID NO: 2635506 - RNA, 13 nt, Human
cagagcugcccuc

SEQ ID NO: 2635507 - RNA, 15 nt, Human
cagagcugcccucuc

SEQ ID NO: 2635508 - RNA, 22 nt, Human
cagcacagccucuuagaugcag

SEQ ID NO: 2635509 - RNA, 22 nt, Human
cagcaguugaaaagacuccaaa

SEQ ID NO: 2635510 - RNA, 17 nt, Human
cagcaguugaaaagacu

SEQ ID NO: 2635511 - RNA, 21 nt, Human
cagcaguugaaaagacuccaa

SEQ ID NO: 2635512 - RNA, 20 nt, Human
cagcaguugaaaagacucca

SEQ ID NO: 2635513 - RNA, 14 nt, Human
cagccagcaguuca

SEQ ID NO: 2635514 - RNA, 22 nt, Human
cagccagcaguucagagcugcc

SEQ ID NO: 2635515 - RNA, 15 nt, Human
cagccagcaguucag

SEQ ID NO: 2635516 - RNA, 21 nt, Human
cagccagcaguucagagcugc

SEQ ID NO: 2635517 - RNA, 16 nt, Human
ccacagaagcuccagg

SEQ ID NO: 2635518 - RNA, 18 nt, Human
ccacagaagcuccaggua

SEQ ID NO: 2635519 - RNA, 18 nt, Human
ccaccagucugacuguuu

SEQ ID NO: 2635520 - RNA, 13 nt, Human
cauuaucucaaaa

SEQ ID NO: 2635521 - RNA, 12 nt, Human
cauuaucucaaa

SEQ ID NO: 2635522 - RNA, 16 nt, Human
auuuuaaaagaaugau

SEQ ID NO: 2635523 - RNA, 23 nt, Human
auuuuaaaagaaugauuaugaau

SEQ ID NO: 2635524 - RNA, 19 nt, Human
auuuguaguguuggagaag

SEQ ID NO: 2635525 - RNA, 22 nt, Human
auuuguaguguuggagaagaac

SEQ ID NO: 2635526 - RNA, 14 nt, Human
auuuguauaaaaua

SEQ ID NO: 2635527 - RNA, 14 nt, Human
auuuauuuuaauaa

SEQ ID NO: 2635528 - RNA, 13 nt, Human
auugacuuuuuau

SEQ ID NO: 2635529 - RNA, 19 nt, Human
auuggacaguaaaauccac

SEQ ID NO: 2635530 - RNA, 19 nt, Human
auuggagcucgugggacag

SEQ ID NO: 2635531 - RNA, 13 nt, Human
auugucuagugaa

SEQ ID NO: 2635532 - RNA, 12 nt, Human
auuuuaauaaug

SEQ ID NO: 2635533 - RNA, 14 nt, Human
auuuuccugaaaac

SEQ ID NO: 2635534 - RNA, 15 nt, Human
auuuucuauaauuua

SEQ ID NO: 2635535 - RNA, 14 nt, Human
auuuucuauaauuu

SEQ ID NO: 2635536 - RNA, 15 nt, Human
auuuuucuuauuuca

SEQ ID NO: 2635537 - RNA, 20 nt, Human
auuuuucuuauuucauuucu

SEQ ID NO: 2635538 - RNA, 19 nt, Human
auuuuucuuauuucauuuc

SEQ ID NO: 2635539 - RNA, 18 nt, Human
auuuuuuguuaaaugauu

SEQ ID NO: 2635540 - RNA, 20 nt, Human
auuuuuucucuaggaaauau

SEQ ID NO: 2635541 - RNA, 23 nt, Human
auuuuuucucuaggaaauauuua

SEQ ID NO: 2635542 - RNA, 21 nt, Human
auuuuuguuuucauuaucuca

SEQ ID NO: 2635543 - RNA, 22 nt, Human
auuuuugugauuuugugauuga

SEQ ID NO: 2635544 - RNA, 19 nt, Human
auugacacuuaaaaauggu

SEQ ID NO: 2635545 - RNA, 17 nt, Human
auugacacuuaaaaaug

SEQ ID NO: 2635546 - RNA, 15 nt, Human
auugacacuuaaaaa

SEQ ID NO: 2635547 - RNA, 21 nt, Human
auuauguuaaaacugggacag

SEQ ID NO: 2635548 - RNA, 15 nt, Human
auuauauuuauuacu

SEQ ID NO: 2635549 - RNA, 18 nt, Human
auuauauuuauuacugua

SEQ ID NO: 2635550 - RNA, 20 nt, Human
auucaaacagucucaggaaa

SEQ ID NO: 2635551 - RNA, 19 nt, Human
auucaaacagucucaggaa

SEQ ID NO: 2635552 - RNA, 18 nt, Human
auucaaacagucucagga

SEQ ID NO: 2635553 - RNA, 16 nt, Human
auucaaacagucucag

SEQ ID NO: 2635554 - RNA, 15 nt, Human
auuauauuuacaaau

SEQ ID NO: 2635555 - RNA, 14 nt, Human
auggcacuaguauu

SEQ ID NO: 2635556 - RNA, 16 nt, Human
auggcacuaguauuuc

SEQ ID NO: 2635557 - RNA, 19 nt, Human
auggcuaagcaaaauguga

SEQ ID NO: 2635558 - RNA, 22 nt, Human
augcuagaacucccuuucaaca

SEQ ID NO: 2635559 - RNA, 21 nt, Human
augcuagaacucccuuucaac

SEQ ID NO: 2635560 - RNA, 20 nt, Human
augcuagaacucccuuucaa

SEQ ID NO: 2635561 - RNA, 16 nt, Human
uuucaaacauauauaa

SEQ ID NO: 2635562 - RNA, 17 nt, Human
uuucaaacauauauaac

SEQ ID NO: 2635563 - RNA, 18 nt, Human
augauuaaguaaugauaa

SEQ ID NO: 2635564 - RNA, 14 nt, Human
augauuaaguaaug

SEQ ID NO: 2635565 - RNA, 15 nt, Human
augauaacuggaaac

SEQ ID NO: 2635566 - RNA, 18 nt, Human
uuuaaauauaugcuaagu

SEQ ID NO: 2635567 - RNA, 21 nt, Human
augccauuuaaagcuuauuaa

SEQ ID NO: 2635568 - RNA, 17 nt, Human
augccauuuaaagcuua

SEQ ID NO: 2635569 - RNA, 13 nt, Human
augcaguucugaa

SEQ ID NO: 2635570 - RNA, 15 nt, Human
uuugaaauauugacu

SEQ ID NO: 2635571 - RNA, 18 nt, Human
uuucucccagucauuuaa

SEQ ID NO: 2635572 - RNA, 17 nt, Human
uuucucccagucauuua

SEQ ID NO: 2635573 - RNA, 21 nt, Human
augguucccuugaugaagaag

SEQ ID NO: 2635574 - RNA, 14 nt, Human
uuugcaagccagau

SEQ ID NO: 2635575 - RNA, 16 nt, Human
auguacuucaugcugu

SEQ ID NO: 2635576 - RNA, 19 nt, Human
auguagaggagaaacugga

SEQ ID NO: 2635577 - RNA, 17 nt, Human
auguagaggagaaacug

SEQ ID NO: 2635578 - RNA, 13 nt, Human
auguagaggagaa

SEQ ID NO: 2635579 - RNA, 12 nt, Human
auguagaggaga

SEQ ID NO: 2635580 - RNA, 17 nt, Human
uuugugaagcaaaauuu

SEQ ID NO: 2635581 - RNA, 19 nt, Human
uuuguaguguuggagaaga

SEQ ID NO: 2635582 - RNA, 21 nt, Human
uuuguaguguuggagaagaac

SEQ ID NO: 2635583 - RNA, 17 nt, Human
auguccacugguucuuc

SEQ ID NO: 2635584 - RNA, 16 nt, Human
auguccacugguucuu

SEQ ID NO: 2635585 - RNA, 12 nt, Human
uucucuaggaaa

SEQ ID NO: 2635586 - RNA, 19 nt, Human
uugaacccgggaggcagag

SEQ ID NO: 2635587 - RNA, 17 nt, Human
uugaaauuguauuacaa

SEQ ID NO: 2635588 - RNA, 14 nt, Human
uucggccuccaucc

SEQ ID NO: 2635589 - RNA, 15 nt, Human
uucggccuccauccu

SEQ ID NO: 2635590 - RNA, 13 nt, Human
uucuaagaaguga

SEQ ID NO: 2635591 - RNA, 23 nt, Human
uucuaagaagugaaaaucuacac

SEQ ID NO: 2635592 - RNA, 16 nt, Human
uucuaaguaaaaccac

SEQ ID NO: 2635593 - RNA, 15 nt, Human
uucuaaguaaaacca

SEQ ID NO: 2635594 - RNA, 19 nt, Human
uucuagcaugaagacagag

SEQ ID NO: 2635595 - RNA, 22 nt, Human
aucacuugucaauaaaauccau

SEQ ID NO: 2635596 - RNA, 17 nt, Human
aucaggguuaguauugu

SEQ ID NO: 2635597 - RNA, 20 nt, Human
auauuuuuuguuaaaugauu

SEQ ID NO: 2635598 - RNA, 18 nt, Human
auauuuuuuguuaaauga

SEQ ID NO: 2635599 - RNA, 14 nt, Human
aucaacagauaaau

SEQ ID NO: 2635600 - RNA, 19 nt, Human
uuccguagguuauuuucag

SEQ ID NO: 2635601 - RNA, 13 nt, Human
uugcaucaauuuu

SEQ ID NO: 2635602 - RNA, 22 nt, Human
uugcaagccagauuuuccugaa

SEQ ID NO: 2635603 - RNA, 14 nt, Human
aucucauuuccaag

SEQ ID NO: 2635604 - RNA, 18 nt, Human
aucuacacuccagugaga

SEQ ID NO: 2635605 - RNA, 19 nt, Human
aucuacacuccagugagac

SEQ ID NO: 2635606 - RNA, 17 nt, Human
uugaagggaaauuucag

SEQ ID NO: 2635607 - RNA, 14 nt, Human
aucuuauaauuuaa

SEQ ID NO: 2635608 - RNA, 16 nt, Human
augaauuacauuugua

SEQ ID NO: 2635609 - RNA, 15 nt, Human
augaauuaaguuuuu

SEQ ID NO: 2635610 - RNA, 15 nt, Human
augaauuacauuugu

SEQ ID NO: 2635611 - RNA, 23 nt, Human
augaauggcuaagcaaaauguga

SEQ ID NO: 2635612 - RNA, 14 nt, Human
auaagccagacauc

SEQ ID NO: 2635613 - RNA, 14 nt, Human
auaaucuuucacag

SEQ ID NO: 2635614 - RNA, 15 nt, Human
uuagggagagaagau

SEQ ID NO: 2635615 - RNA, 14 nt, Human
uuaggguuaugauu

SEQ ID NO: 2635616 - RNA, 16 nt, Human
uuaggguuaugauuaa

SEQ ID NO: 2635617 - RNA, 14 nt, Human
uuaaaaucauuucu

SEQ ID NO: 2635618 - RNA, 22 nt, Human
uuaaaaucauuucugcaucagc

SEQ ID NO: 2635619 - RNA, 16 nt, Human
uuaaaaaauggaacau

SEQ ID NO: 2635620 - RNA, 20 nt, Human
aguuuaaauuguaauaggcg

SEQ ID NO: 2635621 - RNA, 17 nt, Human
aguuuaaauuguaauag

SEQ ID NO: 2635622 - RNA, 16 nt, Human
aguuuagcuggaaaag

SEQ ID NO: 2635623 - RNA, 19 nt, Human
uuaaaaaagaaacauuugg

SEQ ID NO: 2635624 - RNA, 15 nt, Human
aguuuagcuggaaaa

SEQ ID NO: 2635625 - RNA, 16 nt, Human
aguuuuauaugcuucu

SEQ ID NO: 2635626 - RNA, 19 nt, Human
uuaugauuaaguaaugaua

SEQ ID NO: 2635627 - RNA, 21 nt, Human
uuaugaauuacauuuguauaa

SEQ ID NO: 2635628 - RNA, 14 nt, Human
uuaugaauuacauu

SEQ ID NO: 2635629 - RNA, 16 nt, Human
uuaugaauuacauuug

SEQ ID NO: 2635630 - RNA, 17 nt, Human
uuaugaauuacauuugu

SEQ ID NO: 2635631 - RNA, 19 nt, Human
uuauauuugaaauauugac

SEQ ID NO: 2635632 - RNA, 17 nt, Human
auacuauggaauuucuc

SEQ ID NO: 2635633 - RNA, 15 nt, Human
uuauuauauuuacaa

SEQ ID NO: 2635634 - RNA, 19 nt, Human
uuauguuaaaacugggaca

SEQ ID NO: 2635635 - RNA, 14 nt, Human
uuauuauauuuaca

SEQ ID NO: 2635636 - RNA, 16 nt, Human
auacucauuaggaugg

SEQ ID NO: 2635637 - RNA, 18 nt, Human
auagauaggucagugcaa

SEQ ID NO: 2635638 - RNA, 17 nt, Human
auagaauuaacacauga

SEQ ID NO: 2635639 - RNA, 13 nt, Human
auagaaguaaaaa

SEQ ID NO: 2635640 - RNA, 14 nt, Human
agugcaaauuguca

SEQ ID NO: 2635641 - RNA, 23 nt, Human
agugaacaaauuuacagagacag

SEQ ID NO: 2635642 - RNA, 22 nt, Human
agugaacaaauuuacagagaca

SEQ ID NO: 2635643 - RNA, 16 nt, Human
agucuuucacauuuaa

SEQ ID NO: 2635644 - RNA, 18 nt, Human
agucuuucacauuuaaau

SEQ ID NO: 2635645 - RNA, 21 nt, Human
agugaacaaauuuacagagac

SEQ ID NO: 2635646 - RNA, 22 nt, Human
uguugcccacagcuguaugauu

SEQ ID NO: 2635647 - RNA, 15 nt, Human
uguucuaagaaguga

SEQ ID NO: 2635648 - RNA, 14 nt, Human
agucaggaaagaga

SEQ ID NO: 2635649 - RNA, 13 nt, Human
agucucaggaaau

SEQ ID NO: 2635650 - RNA, 16 nt, Human
agucucaggaaaucaa

SEQ ID NO: 2635651 - RNA, 20 nt, Human
uguccagccccguagacgug

SEQ ID NO: 2635652 - RNA, 13 nt, Human
aguaaugauaacu

SEQ ID NO: 2635653 - RNA, 12 nt, Human
aguaauuggaaa

SEQ ID NO: 2635654 - RNA, 13 nt, Human
aguaauuggaaag

SEQ ID NO: 2635655 - RNA, 20 nt, Human
aguaaaaccacagcaguuga

SEQ ID NO: 2635656 - RNA, 19 nt, Human
aguaaaaccacagcaguug

SEQ ID NO: 2635657 - RNA, 17 nt, Human
aguaaaaccacagcagu

SEQ ID NO: 2635658 - RNA, 16 nt, Human
aguaaaaccacagcag

SEQ ID NO: 2635659 - RNA, 16 nt, Human
uguaguguuggagaag

SEQ ID NO: 2635660 - RNA, 17 nt, Human
uguaguguuggagaaga

SEQ ID NO: 2635661 - RNA, 18 nt, Human
uguaguguuggagaagaa

SEQ ID NO: 2635662 - RNA, 14 nt, Human
agguugcagugagc

SEQ ID NO: 2635663 - RNA, 16 nt, Human
aggugcuacaaaaaca

SEQ ID NO: 2635664 - RNA, 18 nt, Human
uguaagggaaacugccag

SEQ ID NO: 2635665 - RNA, 13 nt, Human
uguaagggaaacu

SEQ ID NO: 2635666 - RNA, 19 nt, Human
uguaagggaaacugccagc

SEQ ID NO: 2635667 - RNA, 19 nt, Human
ugggaggcugagaugggag

SEQ ID NO: 2635668 - RNA, 14 nt, Human
agggagagaagaua

SEQ ID NO: 2635669 - RNA, 13 nt, Human
agggagagaagau

SEQ ID NO: 2635670 - RNA, 23 nt, Human
agggacuucugucuucacaacag

SEQ ID NO: 2635671 - RNA, 22 nt, Human
agggcuguuauaaucuuucaca

SEQ ID NO: 2635672 - RNA, 20 nt, Human
ugggaacccaaguccaagca

SEQ ID NO: 2635673 - RNA, 15 nt, Human
agggaaacugccagc

SEQ ID NO: 2635674 - RNA, 14 nt, Human
agggaaacugccag

SEQ ID NO: 2635675 - RNA, 23 nt, Human
agggaaacugccagcaacgcagg

SEQ ID NO: 2635676 - RNA, 21 nt, Human
agggaaacugccagcaacgca

SEQ ID NO: 2635677 - RNA, 19 nt, Human
agggaaacugccagcaacg

SEQ ID NO: 2635678 - RNA, 16 nt, Human
agggaaacugccagca

SEQ ID NO: 2635679 - RNA, 16 nt, Human
ugggaaagcauuguaa

SEQ ID NO: 2635680 - RNA, 14 nt, Human
ugggaaagcauugu

SEQ ID NO: 2635681 - RNA, 21 nt, Human
ugggaaagcauuguaaaugug

SEQ ID NO: 2635682 - RNA, 18 nt, Human
ugggaaagcauuguaaau

SEQ ID NO: 2635683 - RNA, 17 nt, Human
ugggaaagcauuguaaa

SEQ ID NO: 2635684 - RNA, 18 nt, Human
ugggaaacaaaaggauaa

SEQ ID NO: 2635685 - RNA, 23 nt, Human
uggcuauaggugcuacaaaaaca

SEQ ID NO: 2635686 - RNA, 19 nt, Human
uggcuauaggugcuacaaa

SEQ ID NO: 2635687 - RNA, 15 nt, Human
uggcuauaggugcua

SEQ ID NO: 2635688 - RNA, 18 nt, Human
uggcuaagcaaaauguga

SEQ ID NO: 2635689 - RNA, 22 nt, Human
aggcuccacuuggucugugaga

SEQ ID NO: 2635690 - RNA, 21 nt, Human
aggcuccacuuggucugugag

SEQ ID NO: 2635691 - RNA, 17 nt, Human
aggcuccacuuggucug

SEQ ID NO: 2635692 - RNA, 11 nt, Human
aggcuccacuu

SEQ ID NO: 2635693 - RNA, 20 nt, Human
aggcagcucuaaaugucaau

SEQ ID NO: 2635694 - RNA, 16 nt, Human
uggagaagaacugaaa

SEQ ID NO: 2635695 - RNA, 16 nt, Human
ugcuaguaauuggaaa

SEQ ID NO: 2635696 - RNA, 14 nt, Human
ugcuaguaauugga

SEQ ID NO: 2635697 - RNA, 13 nt, Human
aggaaagagaacu

SEQ ID NO: 2635698 - RNA, 19 nt, Human
aggaaagagaacuuccaga

SEQ ID NO: 2635699 - RNA, 21 nt, Human
agcuuauugucuagugaaacu

SEQ ID NO: 2635700 - RNA, 15 nt, Human
agcuuauuaaaacuc

SEQ ID NO: 2635701 - RNA, 20 nt, Human
agcuuauuaaaacucauuuu

SEQ ID NO: 2635702 - RNA, 14 nt, Human
aggaaauauuuauu

SEQ ID NO: 2635703 - RNA, 18 nt, Human
aggaaauauuuauuuuaa

SEQ ID NO: 2635704 - RNA, 19 nt, Human
aggaaaucaaauaugcaaa

SEQ ID NO: 2635705 - RNA, 19 nt, Human
aggaauugacccacaagaa

SEQ ID NO: 2635706 - RNA, 13 nt, Human
agcuggaaaagua

SEQ ID NO: 2635707 - RNA, 18 nt, Human
agcugccuccccuccucu

SEQ ID NO: 2635708 - RNA, 19 nt, Human
agcugccuccccuccucug

SEQ ID NO: 2635709 - RNA, 20 nt, Human
agcugccuccccuccucugc

SEQ ID NO: 2635710 - RNA, 23 nt, Human
agcugccuccccuccucugcuug

SEQ ID NO: 2635711 - RNA, 21 nt, Human
agcugccuccccuccucugcu

SEQ ID NO: 2635712 - RNA, 22 nt, Human
agcugccuccccuccucugcuu

SEQ ID NO: 2635713 - RNA, 19 nt, Human
agcuauggugucauaggcu

SEQ ID NO: 2635714 - RNA, 18 nt, Human
agcccuucuuuccacaga

SEQ ID NO: 2635715 - RNA, 19 nt, Human
agcccuucuuuccacagaa

SEQ ID NO: 2635716 - RNA, 17 nt, Human
agcccuucuuuccacag

SEQ ID NO: 2635717 - RNA, 14 nt, Human
ugcagugagccgag

SEQ ID NO: 2635718 - RNA, 18 nt, Human
agccugagcgacagugag

SEQ ID NO: 2635719 - RNA, 19 nt, Human
agccugagcgacagugaga

SEQ ID NO: 2635720 - RNA, 22 nt, Human
acuuuuuauggcacuaguauuu

SEQ ID NO: 2635721 - RNA, 15 nt, Human
ucucccagucauuua

SEQ ID NO: 2635722 - RNA, 15 nt, Human
ucuccucucucugua

SEQ ID NO: 2635723 - RNA, 13 nt, Human
ucucuucuuuaaa

SEQ ID NO: 2635724 - RNA, 12 nt, Human
ucucuucuuuaa

SEQ ID NO: 2635725 - RNA, 13 nt, Human
ucucuggccuucg

SEQ ID NO: 2635726 - RNA, 17 nt, Human
ucucuggccuucggccu

SEQ ID NO: 2635727 - RNA, 16 nt, Human
ucucuggccuucggcc

SEQ ID NO: 2635728 - RNA, 19 nt, Human
agaaaacaaggaugaauua

SEQ ID NO: 2635729 - RNA, 14 nt, Human
agaaagaaaaucag

SEQ ID NO: 2635730 - RNA, 15 nt, Human
agaaacuggaacucu

SEQ ID NO: 2635731 - RNA, 13 nt, Human
agaaacuggaacu

SEQ ID NO: 2635732 - RNA, 21 nt, Human
agaagaacugaaaucauacuu

SEQ ID NO: 2635733 - RNA, 11 nt, Human
ucugcuugcca

SEQ ID NO: 2635734 - RNA, 12 nt, Human
ucugcuugccau

SEQ ID NO: 2635735 - RNA, 14 nt, Human
ucugcuugccaucc

SEQ ID NO: 2635736 - RNA, 14 nt, Human
agaagcuccaggua

SEQ ID NO: 2635737 - RNA, 23 nt, Human
agaaagacuauucaaacagucuc

SEQ ID NO: 2635738 - RNA, 20 nt, Human
agaaagacuauucaaacagu

SEQ ID NO: 2635739 - RNA, 18 nt, Human
agaaagacuauucaaaca

SEQ ID NO: 2635740 - RNA, 19 nt, Human
agaaagacuauucaaacag

SEQ ID NO: 2635741 - RNA, 21 nt, Human
ucugacuguuuccaucaaggg

SEQ ID NO: 2635742 - RNA, 20 nt, Human
ucugagaaagacuauucaaa

SEQ ID NO: 2635743 - RNA, 19 nt, Human
ucugagaaagacuauucaa

SEQ ID NO: 2635744 - RNA, 15 nt, Human
ucugagaaagacuau

SEQ ID NO: 2635745 - RNA, 14 nt, Human
ucugagaaagacua

SEQ ID NO: 2635746 - RNA, 23 nt, Human
ucugagaaagacuauucaaacag

SEQ ID NO: 2635747 - RNA, 22 nt, Human
ucugagaaagacuauucaaaca

SEQ ID NO: 2635748 - RNA, 21 nt, Human
ucugagaaagacuauucaaac

SEQ ID NO: 2635749 - RNA, 14 nt, Human
agaacucccuuuca

SEQ ID NO: 2635750 - RNA, 18 nt, Human
ucuguuuuauaauuuugu

SEQ ID NO: 2635751 - RNA, 14 nt, Human
ucuuaauuaaaaga

SEQ ID NO: 2635752 - RNA, 21 nt, Human
ucuuaauuaaaagaauauuuu

SEQ ID NO: 2635753 - RNA, 18 nt, Human
ucuuaauuaaaagaauau

SEQ ID NO: 2635754 - RNA, 18 nt, Human
agacuggcacaguuuucu

SEQ ID NO: 2635755 - RNA, 21 nt, Human
agacuggauaguccgucucug

SEQ ID NO: 2635756 - RNA, 15 nt, Human
agacuggcacaguuu

SEQ ID NO: 2635757 - RNA, 14 nt, Human
agacuggcacaguu

SEQ ID NO: 2635758 - RNA, 17 nt, Human
agagacacacugaagaa

SEQ ID NO: 2635759 - RNA, 15 nt, Human
agagaaugagagaca

SEQ ID NO: 2635760 - RNA, 18 nt, Human
agagacacacugaagaag

SEQ ID NO: 2635761 - RNA, 20 nt, Human
agagacacacugaagaagca

SEQ ID NO: 2635762 - RNA, 21 nt, Human
ucuuuaaagggauggcaagau

SEQ ID NO: 2635763 - RNA, 17 nt, Human
ucuuuaaaauacacacu

SEQ ID NO: 2635764 - RNA, 19 nt, Human
agacuccaaagaaauguaa

SEQ ID NO: 2635765 - RNA, 16 nt, Human
agacuccaaagaaaug

SEQ ID NO: 2635766 - RNA, 21 nt, Human
agacuauucaaacagucucag

SEQ ID NO: 2635767 - RNA, 20 nt, Human
agacuauucaaacagucuca

SEQ ID NO: 2635768 - RNA, 18 nt, Human
agacuauucaaacagucu

SEQ ID NO: 2635769 - RNA, 12 nt, Human
agacuccaaaga

SEQ ID NO: 2635770 - RNA, 14 nt, Human
agacuccaaagaaa

SEQ ID NO: 2635771 - RNA, 13 nt, Human
agacuccaaagaa

SEQ ID NO: 2635772 - RNA, 20 nt, Human
ugagcgacagugagacucug

SEQ ID NO: 2635773 - RNA, 16 nt, Human
ugagcgacagugagac

SEQ ID NO: 2635774 - RNA, 14 nt, Human
ugagcgacagugag

SEQ ID NO: 2635775 - RNA, 13 nt, Human
ugagcgacaguga

SEQ ID NO: 2635776 - RNA, 14 nt, Human
agcagaacagugau

SEQ ID NO: 2635777 - RNA, 14 nt, Human
agcaacgcaggccc

SEQ ID NO: 2635778 - RNA, 16 nt, Human
agcaccaaucaugaau

SEQ ID NO: 2635779 - RNA, 22 nt, Human
agcacagccucuuagaugcagu

SEQ ID NO: 2635780 - RNA, 16 nt, Human
ugagcuacaaaugcau

SEQ ID NO: 2635781 - RNA, 14 nt, Human
ugagcuacaaaugc

SEQ ID NO: 2635782 - RNA, 13 nt, Human
ugagcuacaaaug

SEQ ID NO: 2635783 - RNA, 15 nt, Human
ugaggacacugauau

SEQ ID NO: 2635784 - RNA, 22 nt, Human
ugagguacugagagugaacaaa

SEQ ID NO: 2635785 - RNA, 17 nt, Human
ugagguacugagaguga

SEQ ID NO: 2635786 - RNA, 18 nt, Human
ugaagauguagaggagaa

SEQ ID NO: 2635787 - RNA, 17 nt, Human
ugaagauguagaggaga

SEQ ID NO: 2635788 - RNA, 14 nt, Human
ugaagaagauggua

SEQ ID NO: 2635789 - RNA, 20 nt, Human
ugaagaagcaccaaucauga

SEQ ID NO: 2635790 - RNA, 22 nt, Human
agagugaacaaauuuacagaga

SEQ ID NO: 2635791 - RNA, 14 nt, Human
agagugaacaaauu

SEQ ID NO: 2635792 - RNA, 19 nt, Human
agaugaugaugaucuuuaa

SEQ ID NO: 2635793 - RNA, 22 nt, Human
agaugcuagaacucccuuucaa

SEQ ID NO: 2635794 - RNA, 23 nt, Human
agaugcuagaacucccuuucaac

SEQ ID NO: 2635795 - RNA, 16 nt, Human
agauuuaccacuugug

SEQ ID NO: 2635796 - RNA, 16 nt, Human
agauugugccccugca

SEQ ID NO: 2635797 - RNA, 15 nt, Human
ugacuguuuccauca

SEQ ID NO: 2635798 - RNA, 18 nt, Human
ucagaugcacaugagcug

SEQ ID NO: 2635799 - RNA, 21 nt, Human
acccaaauguucaucaaugaa

SEQ ID NO: 2635800 - RNA, 18 nt, Human
acccaaaaggcagaagca

SEQ ID NO: 2635801 - RNA, 15 nt, Human
acccaaaaggcagaa

SEQ ID NO: 2635802 - RNA, 13 nt, Human
acccaaaaggcag

SEQ ID NO: 2635803 - RNA, 12 nt, Human
uauuucauuucu

SEQ ID NO: 2635804 - RNA, 11 nt, Human
accacagcagu

SEQ ID NO: 2635805 - RNA, 13 nt, Human
accacugcagaag

SEQ ID NO: 2635806 - RNA, 19 nt, Human
accacugcagaagacagua

SEQ ID NO: 2635807 - RNA, 14 nt, Human
accacugcagaaga

SEQ ID NO: 2635808 - RNA, 19 nt, Human
accacuuguguuuugcaag

SEQ ID NO: 2635809 - RNA, 23 nt, Human
accacuuguguuuugcaagccag

SEQ ID NO: 2635810 - RNA, 22 nt, Human
ucaugaauuaguuuuauaugcu

SEQ ID NO: 2635811 - RNA, 21 nt, Human
uccagccugagcgacagugag

SEQ ID NO: 2635812 - RNA, 20 nt, Human
uccagccugagcgacaguga

SEQ ID NO: 2635813 - RNA, 21 nt, Human
uccaacuaucucauuuccaag

SEQ ID NO: 2635814 - RNA, 22 nt, Human
acugaggggaggggagcauggg

SEQ ID NO: 2635815 - RNA, 17 nt, Human
acugaggggaggggagc

SEQ ID NO: 2635816 - RNA, 18 nt, Human
uccugggcagcugccucc

SEQ ID NO: 2635817 - RNA, 19 nt, Human
uccugggcagcugccuccc

SEQ ID NO: 2635818 - RNA, 22 nt, Human
uccugggcagcugccuccccuc

SEQ ID NO: 2635819 - RNA, 23 nt, Human
uccugggcagcugccuccccucc

SEQ ID NO: 2635820 - RNA, 15 nt, Human
uccugggcagcugcc

SEQ ID NO: 2635821 - RNA, 16 nt, Human
uccugggcagcugccu

SEQ ID NO: 2635822 - RNA, 17 nt, Human
uccugggcagcugccuc

SEQ ID NO: 2635823 - RNA, 22 nt, Human
acuggcacaguuuucugagaaa

SEQ ID NO: 2635824 - RNA, 21 nt, Human
acuggcacaguuuucugagaa

SEQ ID NO: 2635825 - RNA, 13 nt, Human
uccuucagccuga

SEQ ID NO: 2635826 - RNA, 22 nt, Human
acugccuucucaacuccaaacu

SEQ ID NO: 2635827 - RNA, 13 nt, Human
acuaaaaauacaa

SEQ ID NO: 2635828 - RNA, 12 nt, Human
uccccuccucug

SEQ ID NO: 2635829 - RNA, 20 nt, Human
acucauuuuaaaaaauggaa

SEQ ID NO: 2635830 - RNA, 23 nt, Human
uauaaaauaauuuuuauauuuga

SEQ ID NO: 2635831 - RNA, 22 nt, Human
acacaucagcuugcccuguuaa

SEQ ID NO: 2635832 - RNA, 21 nt, Human
uauaaaauaauuuuuauauuu

SEQ ID NO: 2635833 - RNA, 22 nt, Human
uauaaaauaauuuuuauauuug

SEQ ID NO: 2635834 - RNA, 22 nt, Human
uagugagcagucaggaaagaga

SEQ ID NO: 2635835 - RNA, 15 nt, Human
uaguuuuauaugcuu

SEQ ID NO: 2635836 - RNA, 16 nt, Human
uaguuuuauaugcuuc

SEQ ID NO: 2635837 - RNA, 23 nt, Human
uauaggugcuacaaaaacacagc

SEQ ID NO: 2635838 - RNA, 20 nt, Human
uauaggugcuacaaaaacac

SEQ ID NO: 2635839 - RNA, 21 nt, Human
uauaggugcuacaaaaacaca

SEQ ID NO: 2635840 - RNA, 13 nt, Human
uauaggaauugac

SEQ ID NO: 2635841 - RNA, 19 nt, Human
uauaggaauugacccacaa

SEQ ID NO: 2635842 - RNA, 14 nt, Human
uauaggaauugacc

SEQ ID NO: 2635843 - RNA, 19 nt, Human
uauaauuuugugaagcaaa

SEQ ID NO: 2635844 - RNA, 14 nt, Human
uauaauuuugugaa

SEQ ID NO: 2635845 - RNA, 18 nt, Human
uauaacaaugcuguauuu

SEQ ID NO: 2635846 - RNA, 16 nt, Human
uauggcuauaggugcu

SEQ ID NO: 2635847 - RNA, 17 nt, Human
uauggcuauaggugcua

SEQ ID NO: 2635848 - RNA, 15 nt, Human
uauauuuacaaaugg

SEQ ID NO: 2635849 - RNA, 14 nt, Human
uauauuuacaaaug

SEQ ID NO: 2635850 - RNA, 23 nt, Human
acaguucggugagcuacaaaugc

SEQ ID NO: 2635851 - RNA, 22 nt, Human
acaguucggugagcuacaaaug

SEQ ID NO: 2635852 - RNA, 19 nt, Human
acaguucggugagcuacaa

SEQ ID NO: 2635853 - RNA, 18 nt, Human
uauuuauuuuaauaaugu

SEQ ID NO: 2635854 - RNA, 14 nt, Human
uauuuauuuuaaua

SEQ ID NO: 2635855 - RNA, 16 nt, Human
uauuuauuuuaauaau

SEQ ID NO: 2635856 - RNA, 17 nt, Human
uauugucuagugaaacu

SEQ ID NO: 2635857 - RNA, 23 nt, Human
uauucauagcagcuuauucacaa

SEQ ID NO: 2635858 - RNA, 15 nt, Human
uauuagaauaccaca

SEQ ID NO: 2635859 - RNA, 12 nt, Human
uauuaaaacuca

SEQ ID NO: 2635860 - RNA, 21 nt, Human
acaguauggcagcuuuccuca

SEQ ID NO: 2635861 - RNA, 18 nt, Human
acagugagacucugucuc

SEQ ID NO: 2635862 - RNA, 14 nt, Human
acagugagacucug

SEQ ID NO: 2635863 - RNA, 21 nt, Human
acaguuaccucugccucagaa

SEQ ID NO: 2635864 - RNA, 16 nt, Human
acagucucaggaaauc

SEQ ID NO: 2635865 - RNA, 15 nt, Human
acagucucaggaaau

SEQ ID NO: 2635866 - RNA, 14 nt, Human
acagucucaggaaa

SEQ ID NO: 2635867 - RNA, 13 nt, Human
acagucucaggaa

SEQ ID NO: 2635868 - RNA, 20 nt, Human
acagugaaagaaaauaacaa

SEQ ID NO: 2635869 - RNA, 17 nt, Human
acagucucaggaaauca

SEQ ID NO: 2635870 - RNA, 21 nt, Human
aauucuugccaaauauaaaua

SEQ ID NO: 2635871 - RNA, 13 nt, Human
aauugacccacaa

SEQ ID NO: 2635872 - RNA, 19 nt, Human
aauugacccacaagaaaug

SEQ ID NO: 2635873 - RNA, 16 nt, Human
aauugacccacaagaa

SEQ ID NO: 2635874 - RNA, 13 nt, Human
uacuguaagaaaa

SEQ ID NO: 2635875 - RNA, 23 nt, Human
aauugugugaaagguacuucaaa

SEQ ID NO: 2635876 - RNA, 14 nt, Human
uacuucaaauccuu

SEQ ID NO: 2635877 - RNA, 19 nt, Human
uacuucaaauccuugaaga

SEQ ID NO: 2635878 - RNA, 20 nt, Human
aauuucucccagucauuuaa

SEQ ID NO: 2635879 - RNA, 16 nt, Human
acaaaaacacagcaag

SEQ ID NO: 2635880 - RNA, 19 nt, Human
aauuuuuucucuaggaaau

SEQ ID NO: 2635881 - RNA, 19 nt, Human
aauuuuuauauuugaaaua

SEQ ID NO: 2635882 - RNA, 15 nt, Human
uagaacucccuuuca

SEQ ID NO: 2635883 - RNA, 16 nt, Human
uacuucaugcugucua

SEQ ID NO: 2635884 - RNA, 21 nt, Human
uacuucaaauccuugaagauu

SEQ ID NO: 2635885 - RNA, 16 nt, Human
uagaugcaguucugaa

SEQ ID NO: 2635886 - RNA, 17 nt, Human
uagaugcaguucugaag

SEQ ID NO: 2635887 - RNA, 19 nt, Human
uagaugcaguucugaagaa

SEQ ID NO: 2635888 - RNA, 18 nt, Human
uagcaugucgucaaagcu

SEQ ID NO: 2635889 - RNA, 21 nt, Human
uagcaugucgucaaagcugaa

SEQ ID NO: 2635890 - RNA, 22 nt, Human
acaagaaaugaaagcagggacu

SEQ ID NO: 2635891 - RNA, 18 nt, Human
acaagcacuaaacaaaga

SEQ ID NO: 2635892 - RNA, 15 nt, Human
aaugaaugaaugaau

SEQ ID NO: 2635893 - RNA, 19 nt, Human
uaacaaugcuguauuuuaa

SEQ ID NO: 2635894 - RNA, 13 nt, Human
uaaucuuucacag

SEQ ID NO: 2635895 - RNA, 18 nt, Human
uacaaaaacacagcaagg

SEQ ID NO: 2635896 - RNA, 17 nt, Human
uacaaaaacacagcaag

SEQ ID NO: 2635897 - RNA, 18 nt, Human
aauguugacaugggacau

SEQ ID NO: 2635898 - RNA, 16 nt, Human
aaugguuuaaaugguc

SEQ ID NO: 2635899 - RNA, 14 nt, Human
aaguaaaaccacag

SEQ ID NO: 2635900 - RNA, 16 nt, Human
aaguaaaaccacagca

SEQ ID NO: 2635901 - RNA, 15 nt, Human
aaguaaaaccacagc

SEQ ID NO: 2635902 - RNA, 21 nt, Human
aagggugaugggaaagcauug

SEQ ID NO: 2635903 - RNA, 18 nt, Human
aaguaaaaccacagcagu

SEQ ID NO: 2635904 - RNA, 17 nt, Human
aaguaaaaccacagcag

SEQ ID NO: 2635905 - RNA, 21 nt, Human
guuucuagcaugaagacagag

SEQ ID NO: 2635906 - RNA, 15 nt, Human
guuuucugagaaaga

SEQ ID NO: 2635907 - RNA, 15 nt, Human
guuuuauaauuuugu

SEQ ID NO: 2635908 - RNA, 22 nt, Human
guuuuauaauuuugugaagcaa

SEQ ID NO: 2635909 - RNA, 23 nt, Human
guuuuuuuuuaaaaaagaaacau

SEQ ID NO: 2635910 - RNA, 22 nt, Human
guuuucugagaaagacuauuca

SEQ ID NO: 2635911 - RNA, 17 nt, Human
guuuucugagaaagacu

SEQ ID NO: 2635912 - RNA, 16 nt, Human
guuuucugagaaagac

SEQ ID NO: 2635913 - RNA, 23 nt, Human
aaguauguuagugcaaauuguca

SEQ ID NO: 2635914 - RNA, 21 nt, Human
aaguauguuagugcaaauugu

SEQ ID NO: 2635915 - RNA, 13 nt, Human
aaggauaaugaau

SEQ ID NO: 2635916 - RNA, 19 nt, Human
aaggaaaaaauaacaauga

SEQ ID NO: 2635917 - RNA, 16 nt, Human
aaggaaaaaauaacaa

SEQ ID NO: 2635918 - RNA, 19 nt, Human
uaaaccaaggcuagaacca

SEQ ID NO: 2635919 - RNA, 12 nt, Human
uaaacucauuuc

SEQ ID NO: 2635920 - RNA, 17 nt, Human
uaaacucauuucuagca

SEQ ID NO: 2635921 - RNA, 22 nt, Human
aauaaaauccauacauuugugu

SEQ ID NO: 2635922 - RNA, 12 nt, Human
aauaaaaauaau

SEQ ID NO: 2635923 - RNA, 21 nt, Human
aauaaaugugccuucauuuuu

SEQ ID NO: 2635924 - RNA, 12 nt, Human
aauaaaugugcc

SEQ ID NO: 2635925 - RNA, 15 nt, Human
aauaacaauaaaaga

SEQ ID NO: 2635926 - RNA, 14 nt, Human
aauacacacucaaa

SEQ ID NO: 2635927 - RNA, 15 nt, Human
uaacaaugcuguauu

SEQ ID NO: 2635928 - RNA, 17 nt, Human
uaacaaugcuguauuuu

SEQ ID NO: 2635929 - RNA, 17 nt, Human
uaaaugauuucauucaa

SEQ ID NO: 2635930 - RNA, 15 nt, Human
uaaauguugacaugg

SEQ ID NO: 2635931 - RNA, 13 nt, Human
aagacccaaaagg

SEQ ID NO: 2635932 - RNA, 13 nt, Human
aagaauauuuuaa

SEQ ID NO: 2635933 - RNA, 22 nt, Human
aagaagcaccaaucaugaauua

SEQ ID NO: 2635934 - RNA, 13 nt, Human
aagaaaauaucac

SEQ ID NO: 2635935 - RNA, 14 nt, Human
guggguagacacac

SEQ ID NO: 2635936 - RNA, 18 nt, Human
aagagcuguucacagcca

SEQ ID NO: 2635937 - RNA, 19 nt, Human
aagagcuguucacagccag

SEQ ID NO: 2635938 - RNA, 14 nt, Human
aagacuauucaaac

SEQ ID NO: 2635939 - RNA, 14 nt, Human
aagacuccaaagaa

SEQ ID NO: 2635940 - RNA, 17 nt, Human
aagacuccaaagaaaug

SEQ ID NO: 2635941 - RNA, 16 nt, Human
aagacuccaaagaaau

SEQ ID NO: 2635942 - RNA, 16 nt, Human
aagcaaguauuagaau

SEQ ID NO: 2635943 - RNA, 19 nt, Human
aagcaaaauuuuuucucua

SEQ ID NO: 2635944 - RNA, 19 nt, Human
aagauguagaggagaaacu

SEQ ID NO: 2635945 - RNA, 22 nt, Human
aagauguagaggagaaacugga

SEQ ID NO: 2635946 - RNA, 13 nt, Human
aagcaaaauguga

SEQ ID NO: 2635947 - RNA, 16 nt, Human
aacauauauaacaaug

SEQ ID NO: 2635948 - RNA, 19 nt, Human
aacagauuauuaccuuaca

SEQ ID NO: 2635949 - RNA, 19 nt, Human
aacagucucaggaaaucaa

SEQ ID NO: 2635950 - RNA, 17 nt, Human
aacagucucaggaaauc

SEQ ID NO: 2635951 - RNA, 23 nt, Human
gucucaguccaugaagauguaga

SEQ ID NO: 2635952 - RNA, 13 nt, Human
gucuucacaacag

SEQ ID NO: 2635953 - RNA, 13 nt, Human
aacuauauuguuu

SEQ ID NO: 2635954 - RNA, 20 nt, Human
aacuaucucauuuccaagca

SEQ ID NO: 2635955 - RNA, 23 nt, Human
aacuaucucauuuccaagcaagu

SEQ ID NO: 2635956 - RNA, 13 nt, Human
aacugaaaucaua

SEQ ID NO: 2635957 - RNA, 20 nt, Human
aacugaaaucauacuucuua

SEQ ID NO: 2635958 - RNA, 14 nt, Human
caaauaugcaaagc

SEQ ID NO: 2635959 - RNA, 17 nt, Human
caaauaugcaaagcacu

SEQ ID NO: 2635960 - RNA, 16 nt, Human
caaauaugcaaagcac

SEQ ID NO: 2635961 - RNA, 18 nt, Human
caaauaugcaaagcacug

SEQ ID NO: 2635962 - RNA, 20 nt, Human
caaauguucaucaaugaaug

SEQ ID NO: 2635963 - RNA, 21 nt, Human
caaauguucaucaaugaauga

SEQ ID NO: 2635964 - RNA, 14 nt, Human
caaauuuacagaga

SEQ ID NO: 2635965 - RNA, 15 nt, Human
caaauuuacagagac

SEQ ID NO: 2635966 - RNA, 17 nt, Human
caagcacuaaacaaaga

SEQ ID NO: 2635967 - RNA, 14 nt, Human
cacaguuuucugag

SEQ ID NO: 2635968 - RNA, 15 nt, Human
cacaguuuucugaga

SEQ ID NO: 2635969 - RNA, 15 nt, Human
cacaggaaguagagg

SEQ ID NO: 2635970 - RNA, 20 nt, Human
cacaggaaccacaagacugc

SEQ ID NO: 2635971 - RNA, 19 nt, Human
cacaggaaccacaagacug

SEQ ID NO: 2635972 - RNA, 22 nt, Human
cacagcaguugaaaagacucca

SEQ ID NO: 2635973 - RNA, 13 nt, Human
cacaacuauauug

SEQ ID NO: 2635974 - RNA, 19 nt, Human
cacacucaaaucaagaaac

SEQ ID NO: 2635975 - RNA, 14 nt, Human
cacacugaagaagc

SEQ ID NO: 2635976 - RNA, 11 nt, Human
cacaacagauu

SEQ ID NO: 2635977 - RNA, 22 nt, Human
caaugaaugaaugaauggcuaa

SEQ ID NO: 2635978 - RNA, 20 nt, Human
uugguaaggggaauugagga

SEQ ID NO: 2635979 - RNA, 13 nt, Human
uuguaaaauggug

SEQ ID NO: 2635980 - RNA, 12 nt, Human
uuguaaaauggu

SEQ ID NO: 2635981 - RNA, 15 nt, Human
uuggucugugagaug

SEQ ID NO: 2635982 - RNA, 20 nt, Human
uuguaaaauggugugaccac

SEQ ID NO: 2635983 - RNA, 16 nt, Human
uuguaccgcaauguga

SEQ ID NO: 2635984 - RNA, 18 nt, Human
uugcuaagcauuccaacu

SEQ ID NO: 2635985 - RNA, 16 nt, Human
uugcuaagcauuccaa

SEQ ID NO: 2635986 - RNA, 21 nt, Human
uugaaaaucuuauaauuuaaa

SEQ ID NO: 2635987 - RNA, 18 nt, Human
uucuuuccacagaagcuc

SEQ ID NO: 2635988 - RNA, 19 nt, Human
uucuuaggguuaugauuaa

SEQ ID NO: 2635989 - RNA, 24 nt, Human
uucuaaguaaaaccacagcaguug

SEQ ID NO: 2635990 - RNA, 20 nt, Human
uugauaugccuuuucccaac

SEQ ID NO: 2635991 - RNA, 13 nt, Human
uugccaucccucc

SEQ ID NO: 2635992 - RNA, 22 nt, Human
uugccaucccucccuccaccuc

SEQ ID NO: 2635993 - RNA, 23 nt, Human
uugccaucccucccuccaccucc

SEQ ID NO: 2635994 - RNA, 14 nt, Human
uugccaucccuccc

SEQ ID NO: 2635995 - RNA, 16 nt, Human
uugccaucccucccuc

SEQ ID NO: 2635996 - RNA, 17 nt, Human
uugccaucccucccucc

SEQ ID NO: 2635997 - RNA, 18 nt, Human
uugccaucccucccucca

SEQ ID NO: 2635998 - RNA, 23 nt, Human
uugcagcucuccccuucucugua

SEQ ID NO: 2635999 - RNA, 13 nt, Human
uuuacagagacag

SEQ ID NO: 2636000 - RNA, 19 nt, Human
uuuaauaauguuucaaaca

SEQ ID NO: 2636001 - RNA, 13 nt, Human
uuuaauaaaccau

SEQ ID NO: 2636002 - RNA, 14 nt, Human
uuuaauaauguuuc

SEQ ID NO: 2636003 - RNA, 15 nt, Human
uuuaauaauguuuca

SEQ ID NO: 2636004 - RNA, 19 nt, Human
uuuaaaauacacacucaaa

SEQ ID NO: 2636005 - RNA, 16 nt, Human
uuuaaaaucauuucug

SEQ ID NO: 2636006 - RNA, 14 nt, Human
uuuaaaagaaugau

SEQ ID NO: 2636007 - RNA, 17 nt, Human
uuuaaaagaaugauuau

SEQ ID NO: 2636008 - RNA, 12 nt, Human
uuuaaaaugucu

SEQ ID NO: 2636009 - RNA, 17 nt, Human
uuguuuaaaaucauuuc

SEQ ID NO: 2636010 - RNA, 18 nt, Human
uuguuuaaaaucauuucu

SEQ ID NO: 2636011 - RNA, 12 nt, Human
uuucucuaggaa

SEQ ID NO: 2636012 - RNA, 18 nt, Human
uuugguaaggggaauuga

SEQ ID NO: 2636013 - RNA, 21 nt, Human
uuugaaauuguauuacaaauc

SEQ ID NO: 2636014 - RNA, 20 nt, Human
uucagacauagaauuaacac

SEQ ID NO: 2636015 - RNA, 16 nt, Human
uucagacauagaauua

SEQ ID NO: 2636016 - RNA, 13 nt, Human
uucagagcugccc

SEQ ID NO: 2636017 - RNA, 14 nt, Human
uucagagcugcccu

SEQ ID NO: 2636018 - RNA, 17 nt, Human
uuauuuuaauaauguuu

SEQ ID NO: 2636019 - RNA, 17 nt, Human
uucaaauccuugaagau

SEQ ID NO: 2636020 - RNA, 15 nt, Human
uuauuuuaauaaugu

SEQ ID NO: 2636021 - RNA, 16 nt, Human
uuauuuuaauaauguu

SEQ ID NO: 2636022 - RNA, 15 nt, Human
uuauugucuagugaa

SEQ ID NO: 2636023 - RNA, 21 nt, Human
uuauggcacuaguauuucuau

SEQ ID NO: 2636024 - RNA, 17 nt, Human
uuauggcuauaggugcu

SEQ ID NO: 2636025 - RNA, 16 nt, Human
uuauuacuguaagaaa

SEQ ID NO: 2636026 - RNA, 17 nt, Human
uuauuacuguaagaaaa

SEQ ID NO: 2636027 - RNA, 18 nt, Human
uuauuacuguaagaaaau

SEQ ID NO: 2636028 - RNA, 19 nt, Human
uuccagauccuggaaauca

SEQ ID NO: 2636029 - RNA, 17 nt, Human
uucccuugaugaagaag

SEQ ID NO: 2636030 - RNA, 17 nt, Human
uuccuuggacucauuuu

SEQ ID NO: 2636031 - RNA, 20 nt, Human
uuccuuggacucauuuuaaa

SEQ ID NO: 2636032 - RNA, 19 nt, Human
uuagaaacacaacuauauu

SEQ ID NO: 2636033 - RNA, 17 nt, Human
uuacuaguuucccuugc

SEQ ID NO: 2636034 - RNA, 12 nt, Human
uuagcuggaaaa

SEQ ID NO: 2636035 - RNA, 13 nt, Human
uuagcuggaaaag

SEQ ID NO: 2636036 - RNA, 20 nt, Human
uuagaugcaguucugaagaa

SEQ ID NO: 2636037 - RNA, 21 nt, Human
uuagaugcaguucugaagaag

SEQ ID NO: 2636038 - RNA, 18 nt, Human
uuaggauguugaaaaagu

SEQ ID NO: 2636039 - RNA, 22 nt, Human
uuaaaagaauauuuuaacuucc

SEQ ID NO: 2636040 - RNA, 21 nt, Human
uuaaaagaauauuuuaacuuc

SEQ ID NO: 2636041 - RNA, 19 nt, Human
uuaaaauacacacucaaau

SEQ ID NO: 2636042 - RNA, 18 nt, Human
uuaaaagaugaaaauauu

SEQ ID NO: 2636043 - RNA, 15 nt, Human
uuaaaagaugaaaau

SEQ ID NO: 2636044 - RNA, 21 nt, Human
uguuucaaacauauauaacaa

SEQ ID NO: 2636045 - RNA, 22 nt, Human
uguuucaaacauauauaacaau

SEQ ID NO: 2636046 - RNA, 19 nt, Human
uguuucaaacauauauaac

SEQ ID NO: 2636047 - RNA, 13 nt, Human
ugggcagcugccu

SEQ ID NO: 2636048 - RNA, 14 nt, Human
ugggcagcugccuc

SEQ ID NO: 2636049 - RNA, 15 nt, Human
ugggcagcugccucc

SEQ ID NO: 2636050 - RNA, 17 nt, Human
ugggcagcugccucccc

SEQ ID NO: 2636051 - RNA, 19 nt, Human
ugggcagcugccuccccuc

SEQ ID NO: 2636052 - RNA, 16 nt, Human
uggugauuuagcagga

SEQ ID NO: 2636053 - RNA, 22 nt, Human
uggugauuuagcaggaagcugu

SEQ ID NO: 2636054 - RNA, 17 nt, Human
uggucacaggaaguaga

SEQ ID NO: 2636055 - RNA, 22 nt, Human
uggucacaggaaguagaggagg

SEQ ID NO: 2636056 - RNA, 16 nt, Human
uggucccagccagcag

SEQ ID NO: 2636057 - RNA, 13 nt, Human
ugguauguuuuca

SEQ ID NO: 2636058 - RNA, 20 nt, Human
uggcaauagucaaauugugu

SEQ ID NO: 2636059 - RNA, 15 nt, Human
uggcacuaguauuuc

SEQ ID NO: 2636060 - RNA, 12 nt, Human
ugcaguucugaa

SEQ ID NO: 2636061 - RNA, 14 nt, Human
ugcaguucugaaga

SEQ ID NO: 2636062 - RNA, 22 nt, Human
ugcaucaauuuuucuuauuuca

SEQ ID NO: 2636063 - RNA, 13 nt, Human
ugcaucagcugcu

SEQ ID NO: 2636064 - RNA, 19 nt, Human
ugcaucagcugcugaaaca

SEQ ID NO: 2636065 - RNA, 16 nt, Human
ugccacuaaauugaca

SEQ ID NO: 2636066 - RNA, 17 nt, Human
ugcuagaacucccuuuc

SEQ ID NO: 2636067 - RNA, 15 nt, Human
ugcuagaacucccuu

SEQ ID NO: 2636068 - RNA, 14 nt, Human
ugcuagaacucccu

SEQ ID NO: 2636069 - RNA, 13 nt, Human
ugcuagaacuccc

SEQ ID NO: 2636070 - RNA, 20 nt, Human
ugcugggggggauuguaaaa

SEQ ID NO: 2636071 - RNA, 20 nt, Human
ugaggcuccacuuggucugu

SEQ ID NO: 2636072 - RNA, 18 nt, Human
ugaggcuccacuuggucu

SEQ ID NO: 2636073 - RNA, 16 nt, Human
ugauaacuggaaacuu

SEQ ID NO: 2636074 - RNA, 13 nt, Human
ugagccccaaaag

SEQ ID NO: 2636075 - RNA, 16 nt, Human
ugagagugaacaaauu

SEQ ID NO: 2636076 - RNA, 24 nt, Human
ugaucagcuuauugucuagugaaa

SEQ ID NO: 2636077 - RNA, 17 nt, Human
ugaucagcuuauugucu

SEQ ID NO: 2636078 - RNA, 14 nt, Human
ugaucuuuaaaaua

SEQ ID NO: 2636079 - RNA, 17 nt, Human
ugaucuuuaaaauacac

SEQ ID NO: 2636080 - RNA, 23 nt, Human
ugaugcuacaggauuugaaauug

SEQ ID NO: 2636081 - RNA, 20 nt, Human
ugaugcuacaggauuugaaa

SEQ ID NO: 2636082 - RNA, 15 nt, Human
ugauggugguauguu

SEQ ID NO: 2636083 - RNA, 21 nt, Human
ugauuaugaauuacauuugua

SEQ ID NO: 2636084 - RNA, 22 nt, Human
ugauuaugaauuacauuuguau

SEQ ID NO: 2636085 - RNA, 16 nt, Human
ugauuaccagggacug

SEQ ID NO: 2636086 - RNA, 22 nt, Human
ugauguuuagaaacacaacuau

SEQ ID NO: 2636087 - RNA, 13 nt, Human
ugauuauauguca

SEQ ID NO: 2636088 - RNA, 17 nt, Human
ugauuaugaauuacauu

SEQ ID NO: 2636089 - RNA, 19 nt, Human
ugauuaugaauuacauuug

SEQ ID NO: 2636090 - RNA, 15 nt, Human
ugaauuacauuugua

SEQ ID NO: 2636091 - RNA, 16 nt, Human
ugaauuacauuuguau

SEQ ID NO: 2636092 - RNA, 18 nt, Human
ugaauuacauuuguauaa

SEQ ID NO: 2636093 - RNA, 13 nt, Human
ugaaguccaagca

SEQ ID NO: 2636094 - RNA, 11 nt, Human
ugaaguccaag

SEQ ID NO: 2636095 - RNA, 20 nt, Human
ugaccacugcagaagacagu

SEQ ID NO: 2636096 - RNA, 16 nt, Human
ugacaugggacauuug

SEQ ID NO: 2636097 - RNA, 17 nt, Human
ugacaugggacauuugc

SEQ ID NO: 2636098 - RNA, 18 nt, Human
ugacaugggacauuugcu

SEQ ID NO: 2636099 - RNA, 15 nt, Human
ugacaagcucacaga

SEQ ID NO: 2636100 - RNA, 20 nt, Human
ugacaagcucacagaccuuu

SEQ ID NO: 2636101 - RNA, 12 nt, Human
ugacaagcucac

SEQ ID NO: 2636102 - RNA, 22 nt, Human
ugaaacaacaaauaggaauugu

SEQ ID NO: 2636103 - RNA, 18 nt, Human
ugaaagaggcagcuugaa

SEQ ID NO: 2636104 - RNA, 15 nt, Human
ugaaagguacuucaa

SEQ ID NO: 2636105 - RNA, 16 nt, Human
ugaaagguacuucaaa

SEQ ID NO: 2636106 - RNA, 16 nt, Human
ugaaauauugacuuuu

SEQ ID NO: 2636107 - RNA, 12 nt, Human
ucuuugccaagu

SEQ ID NO: 2636108 - RNA, 19 nt, Human
ucuuuccacagaagcucca

SEQ ID NO: 2636109 - RNA, 17 nt, Human
ucuuucacauuuaaaua

SEQ ID NO: 2636110 - RNA, 16 nt, Human
ucauuaggauggcuag

SEQ ID NO: 2636111 - RNA, 17 nt, Human
uccaaagaaauguaagg

SEQ ID NO: 2636112 - RNA, 14 nt, Human
uccaaagaaaugua

SEQ ID NO: 2636113 - RNA, 12 nt, Human
ucauagcagcuu

SEQ ID NO: 2636114 - RNA, 11 nt, Human
ucauagcagcu

SEQ ID NO: 2636115 - RNA, 17 nt, Human
ucaucaaugaaugaaug

SEQ ID NO: 2636116 - RNA, 23 nt, Human
uccacuuggucugugagaugcua

SEQ ID NO: 2636117 - RNA, 17 nt, Human
uccacuuggucugugag

SEQ ID NO: 2636118 - RNA, 21 nt, Human
uccacuuggucugugagaugc

SEQ ID NO: 2636119 - RNA, 15 nt, Human
uccauacauuugugu

SEQ ID NO: 2636120 - RNA, 20 nt, Human
uccaugggccauaugaaaag

SEQ ID NO: 2636121 - RNA, 19 nt, Human
uccagguagagggugugua

SEQ ID NO: 2636122 - RNA, 18 nt, Human
uccugccccugagcccau

SEQ ID NO: 2636123 - RNA, 17 nt, Human
uccugccccugagccca

SEQ ID NO: 2636124 - RNA, 20 nt, Human
uccugaggcuccacuugguc

SEQ ID NO: 2636125 - RNA, 19 nt, Human
uccugaggcuccacuuggu

SEQ ID NO: 2636126 - RNA, 17 nt, Human
uccuggcaauagucaaa

SEQ ID NO: 2636127 - RNA, 23 nt, Human
uccuagugaaagaggcagcuuga

SEQ ID NO: 2636128 - RNA, 14 nt, Human
uccuagugaaagag

SEQ ID NO: 2636129 - RNA, 22 nt, Human
uccucauuuuuauaaugucccu

SEQ ID NO: 2636130 - RNA, 20 nt, Human
ucccuucacaaacccagugu

SEQ ID NO: 2636131 - RNA, 23 nt, Human
ucucaguccaugaagauguagag

SEQ ID NO: 2636132 - RNA, 18 nt, Human
ucuaugaaauauuauguu

SEQ ID NO: 2636133 - RNA, 17 nt, Human
ucuacacuaagagagaa

SEQ ID NO: 2636134 - RNA, 12 nt, Human
ucggagaagagc

SEQ ID NO: 2636135 - RNA, 16 nt, Human
ucggagaagagcuguu

SEQ ID NO: 2636136 - RNA, 14 nt, Human
ucggagaagagcug

SEQ ID NO: 2636137 - RNA, 17 nt, Human
ucaaacauauauaacaa

SEQ ID NO: 2636138 - RNA, 22 nt, Human
ucaaacagucucaggaaaucaa

SEQ ID NO: 2636139 - RNA, 17 nt, Human
ucaaauaugcaaagcac

SEQ ID NO: 2636140 - RNA, 16 nt, Human
ucaaauaugcaaagca

SEQ ID NO: 2636141 - RNA, 16 nt, Human
ucaaauccuugaagau

SEQ ID NO: 2636142 - RNA, 15 nt, Human
ucaaauccuugaaga

SEQ ID NO: 2636143 - RNA, 19 nt, Human
ucaaauaugcaaagcacug

SEQ ID NO: 2636144 - RNA, 18 nt, Human
ucaaauaugcaaagcacu

SEQ ID NO: 2636145 - RNA, 22 nt, Human
ucaacuccaaacugacucuuaa

SEQ ID NO: 2636146 - RNA, 14 nt, Human
ucaauaaaauccau

SEQ ID NO: 2636147 - RNA, 22 nt, Human
ucacaagacccaaaaggcagaa

SEQ ID NO: 2636148 - RNA, 12 nt, Human
ucacauuuaaau

SEQ ID NO: 2636149 - RNA, 20 nt, Human
uauuguuuaaaaucauuucu

SEQ ID NO: 2636150 - RNA, 14 nt, Human
uauuucuaugaaau

SEQ ID NO: 2636151 - RNA, 15 nt, Human
uauuucuaugaaaua

SEQ ID NO: 2636152 - RNA, 13 nt, Human
uauuuauuacugu

SEQ ID NO: 2636153 - RNA, 13 nt, Human
uauuucuaugaaa

SEQ ID NO: 2636154 - RNA, 14 nt, Human
uauuuauuacugua

SEQ ID NO: 2636155 - RNA, 17 nt, Human
uauuguuuaaaaucauu

SEQ ID NO: 2636156 - RNA, 16 nt, Human
uauuguuuaaaaucau

SEQ ID NO: 2636157 - RNA, 15 nt, Human
uauuguuuaaaauca

SEQ ID NO: 2636158 - RNA, 17 nt, Human
uauguucuaagaaguga

SEQ ID NO: 2636159 - RNA, 19 nt, Human
uauggaggcuuugcauaga

SEQ ID NO: 2636160 - RNA, 19 nt, Human
uauguuagugcaaauuguc

SEQ ID NO: 2636161 - RNA, 12 nt, Human
uauguuaaaacu

SEQ ID NO: 2636162 - RNA, 17 nt, Human
uauuauauuuacaaaug

SEQ ID NO: 2636163 - RNA, 16 nt, Human
uauuauguuaaaacug

SEQ ID NO: 2636164 - RNA, 18 nt, Human
uaggugcuacaaaaacac

SEQ ID NO: 2636165 - RNA, 13 nt, Human
uaguaucaaaaga

SEQ ID NO: 2636166 - RNA, 16 nt, Human
uaguauuucuaugaaa

SEQ ID NO: 2636167 - RNA, 18 nt, Human
uaguauuucuaugaaaua

SEQ ID NO: 2636168 - RNA, 19 nt, Human
uaguauuucuaugaaauau

SEQ ID NO: 2636169 - RNA, 13 nt, Human
uagucaaauugug

SEQ ID NO: 2636170 - RNA, 14 nt, Human
uagucaaauugugu

SEQ ID NO: 2636171 - RNA, 14 nt, Human
uagugcaaauuguc

SEQ ID NO: 2636172 - RNA, 15 nt, Human
uagugcaaauuguca

SEQ ID NO: 2636173 - RNA, 16 nt, Human
uaggucagugcaaaua

SEQ ID NO: 2636174 - RNA, 18 nt, Human
uaggccaugggacaggga

SEQ ID NO: 2636175 - RNA, 16 nt, Human
uaggccaugggacagg

SEQ ID NO: 2636176 - RNA, 12 nt, Human
uaggaauugacc

SEQ ID NO: 2636177 - RNA, 13 nt, Human
uauaugcuucugu

SEQ ID NO: 2636178 - RNA, 13 nt, Human
uauauaacaaugc

SEQ ID NO: 2636179 - RNA, 15 nt, Human
uaugcuucuguuuua

SEQ ID NO: 2636180 - RNA, 16 nt, Human
uaugcuucuguuuuau

SEQ ID NO: 2636181 - RNA, 16 nt, Human
uaugauucccagccag

SEQ ID NO: 2636182 - RNA, 12 nt, Human
uaugcaaagcac

SEQ ID NO: 2636183 - RNA, 14 nt, Human
uaugcaaagcacug

SEQ ID NO: 2636184 - RNA, 13 nt, Human
uaugcaaagcacu

SEQ ID NO: 2636185 - RNA, 15 nt, Human
uaugcaaagcacuga

SEQ ID NO: 2636186 - RNA, 14 nt, Human
uauccuucagccug

SEQ ID NO: 2636187 - RNA, 15 nt, Human
uauccuucagccuga

SEQ ID NO: 2636188 - RNA, 23 nt, Human
uaugaauuacauuuguauaaaau

SEQ ID NO: 2636189 - RNA, 17 nt, Human
uaugaauuacauuugua

SEQ ID NO: 2636190 - RNA, 14 nt, Human
gugagcuacaaaug

SEQ ID NO: 2636191 - RNA, 16 nt, Human
gugagcagucaggaaa

SEQ ID NO: 2636192 - RNA, 19 nt, Human
gugaaagaaaauaacaaua

SEQ ID NO: 2636193 - RNA, 20 nt, Human
gugaaacucguuaauuugua

SEQ ID NO: 2636194 - RNA, 18 nt, Human
gugcaaauugucacagga

SEQ ID NO: 2636195 - RNA, 20 nt, Human
guccugucggagcccugucu

SEQ ID NO: 2636196 - RNA, 21 nt, Human
guccugucggagcccugucuc

SEQ ID NO: 2636197 - RNA, 18 nt, Human
guccugucggagcccugu

SEQ ID NO: 2636198 - RNA, 23 nt, Human
gucuacacuaagagagaaugaga

SEQ ID NO: 2636199 - RNA, 17 nt, Human
gucuacacuaagagaga

SEQ ID NO: 2636200 - RNA, 17 nt, Human
guauuucuaugaaauau

SEQ ID NO: 2636201 - RNA, 22 nt, Human
guauuucuaugaaauauuaugu

SEQ ID NO: 2636202 - RNA, 21 nt, Human
gucaauaaaauccauacauuu

SEQ ID NO: 2636203 - RNA, 15 nt, Human
gucaauaaaauccau

SEQ ID NO: 2636204 - RNA, 14 nt, Human
gucaccucauggaa

SEQ ID NO: 2636205 - RNA, 16 nt, Human
guauuuuaaaagaaug

SEQ ID NO: 2636206 - RNA, 17 nt, Human
guauuuuaaaagaauga

SEQ ID NO: 2636207 - RNA, 20 nt, Human
gucccagccagcaguucaga

SEQ ID NO: 2636208 - RNA, 22 nt, Human
gguagacacacaugaaguccaa

SEQ ID NO: 2636209 - RNA, 15 nt, Human
gguagacacacauga

SEQ ID NO: 2636210 - RNA, 22 nt, Human
gguacuucaaauccuugaagau

SEQ ID NO: 2636211 - RNA, 21 nt, Human
ggguagccacuggacugacga

SEQ ID NO: 2636212 - RNA, 19 nt, Human
ggugcuacaaaaacacagc

SEQ ID NO: 2636213 - RNA, 17 nt, Human
guaagggaaacugccag

SEQ ID NO: 2636214 - RNA, 18 nt, Human
guaagggaaacugccagc

SEQ ID NO: 2636215 - RNA, 23 nt, Human
guaaaaccacagcaguugaaaag

SEQ ID NO: 2636216 - RNA, 18 nt, Human
guaaaaccacagcaguug

SEQ ID NO: 2636217 - RNA, 16 nt, Human
guaaaaccacagcagu

SEQ ID NO: 2636218 - RNA, 15 nt, Human
guaaaaccacagcag

SEQ ID NO: 2636219 - RNA, 14 nt, Human
guaaaaccacagca

SEQ ID NO: 2636220 - RNA, 15 nt, Human
guaauuggaaaggca

SEQ ID NO: 2636221 - RNA, 19 nt, Human
guaaugauaacuggaaacu

SEQ ID NO: 2636222 - RNA, 15 nt, Human
guaccgcaaugugac

SEQ ID NO: 2636223 - RNA, 23 nt, Human
guacuuuauuuucuauaauuuaa

SEQ ID NO: 2636224 - RNA, 15 nt, Human
guagaggagaaacug

SEQ ID NO: 2636225 - RNA, 20 nt, Human
gcucucuggccuucggccuc

SEQ ID NO: 2636226 - RNA, 19 nt, Human
gcucucuggccuucggccu

SEQ ID NO: 2636227 - RNA, 15 nt, Human
gcucucuggccuucg

SEQ ID NO: 2636228 - RNA, 14 nt, Human
gcucucuggccuuc

SEQ ID NO: 2636229 - RNA, 11 nt, Human
gcucucuggcc

SEQ ID NO: 2636230 - RNA, 13 nt, Human
gcucucuggccuu

SEQ ID NO: 2636231 - RNA, 12 nt, Human
gcucucuggccu

SEQ ID NO: 2636232 - RNA, 20 nt, Human
gcuccauuuuuagugaaaua

SEQ ID NO: 2636233 - RNA, 14 nt, Human
gcuaagcauuccaa

SEQ ID NO: 2636234 - RNA, 17 nt, Human
gcuaagcaaaaugugau

SEQ ID NO: 2636235 - RNA, 22 nt, Human
gcccucuccugggcagcugccu

SEQ ID NO: 2636236 - RNA, 23 nt, Human
gcccucuccugggcagcugccuc

SEQ ID NO: 2636237 - RNA, 12 nt, Human
gcccucuccugg

SEQ ID NO: 2636238 - RNA, 13 nt, Human
gcccucuccuggg

SEQ ID NO: 2636239 - RNA, 14 nt, Human
gcccucuccugggc

SEQ ID NO: 2636240 - RNA, 22 nt, Human
gccuauauuuuuuguuaaauga

SEQ ID NO: 2636241 - RNA, 17 nt, Human
gccuaagugcagccccg

SEQ ID NO: 2636242 - RNA, 20 nt, Human
gcugucuacacuaagagaga

SEQ ID NO: 2636243 - RNA, 17 nt, Human
ggaaaucaaauaugcaa

SEQ ID NO: 2636244 - RNA, 23 nt, Human
ggaaagggauuuucagcccucag

SEQ ID NO: 2636245 - RNA, 19 nt, Human
ggagaaucacuugaacccg

SEQ ID NO: 2636246 - RNA, 15 nt, Human
ggagaaucacuugaa

SEQ ID NO: 2636247 - RNA, 14 nt, Human
ggacgcucucuggc

SEQ ID NO: 2636248 - RNA, 13 nt, Human
ggacgcucucugg

SEQ ID NO: 2636249 - RNA, 16 nt, Human
ggacauuugcucaugg

SEQ ID NO: 2636250 - RNA, 20 nt, Human
ggaagugacgguuuaauggg

SEQ ID NO: 2636251 - RNA, 23 nt, Human
ggaauuucucccagucauuuaau

SEQ ID NO: 2636252 - RNA, 16 nt, Human
ggaauuggagcucgug

SEQ ID NO: 2636253 - RNA, 22 nt, Human
ggaauuggagcucgugggacag

SEQ ID NO: 2636254 - RNA, 14 nt, Human
ggcauggcugggaa

SEQ ID NO: 2636255 - RNA, 15 nt, Human
ggauuguaaaauggu

SEQ ID NO: 2636256 - RNA, 17 nt, Human
ggauuagggagagaaga

SEQ ID NO: 2636257 - RNA, 12 nt, Human
gagcccugucuc

SEQ ID NO: 2636258 - RNA, 22 nt, Human
gauaaauggcuuccuggcaaua

SEQ ID NO: 2636259 - RNA, 19 nt, Human
gagugucuuaauuaaaaga

SEQ ID NO: 2636260 - RNA, 19 nt, Human
gcacuguggguagacacac

SEQ ID NO: 2636261 - RNA, 18 nt, Human
gcacugacuucuaaguaa

SEQ ID NO: 2636262 - RNA, 15 nt, Human
gcacugacuucuaag

SEQ ID NO: 2636263 - RNA, 13 nt, Human
gcacacugucugc

SEQ ID NO: 2636264 - RNA, 18 nt, Human
gaugcuagaacucccuuu

SEQ ID NO: 2636265 - RNA, 22 nt, Human
gaugcuagaacucccuuucaac

SEQ ID NO: 2636266 - RNA, 20 nt, Human
gaugcuagaacucccuuuca

SEQ ID NO: 2636267 - RNA, 16 nt, Human
gcaaauugucacagga

SEQ ID NO: 2636268 - RNA, 16 nt, Human
gaauuggagcucgugg

SEQ ID NO: 2636269 - RNA, 21 nt, Human
gaauugacccacaagaaauga

SEQ ID NO: 2636270 - RNA, 16 nt, Human
gaauugacccacaaga

SEQ ID NO: 2636271 - RNA, 16 nt, Human
gacaaggaaaaaauaa

SEQ ID NO: 2636272 - RNA, 18 nt, Human
gacagggaggacgcucuc

SEQ ID NO: 2636273 - RNA, 17 nt, Human
gacagggaggacgcucu

SEQ ID NO: 2636274 - RNA, 20 nt, Human
gacauagaauuaacacauga

SEQ ID NO: 2636275 - RNA, 19 nt, Human
gacagagccccacccucag

SEQ ID NO: 2636276 - RNA, 16 nt, Human
gacaugggacauuugc

SEQ ID NO: 2636277 - RNA, 21 nt, Human
gaccacugcagaagacaguau

SEQ ID NO: 2636278 - RNA, 22 nt, Human
gacccacaagaaaugaaagcag

SEQ ID NO: 2636279 - RNA, 15 nt, Human
gacccacaagaaaug

SEQ ID NO: 2636280 - RNA, 16 nt, Human
gacccaaaaggcagaa

SEQ ID NO: 2636281 - RNA, 18 nt, Human
gacuccaaagaaauguaa

SEQ ID NO: 2636282 - RNA, 16 nt, Human
gacuccaaagaaaugu

SEQ ID NO: 2636283 - RNA, 15 nt, Human
gacuccaaagaaaug

SEQ ID NO: 2636284 - RNA, 12 nt, Human
gacuccaaagaa

SEQ ID NO: 2636285 - RNA, 11 nt, Human
gacuccaaaga

SEQ ID NO: 2636286 - RNA, 21 nt, Human
gacucauuuuaaaaaauggaa

SEQ ID NO: 2636287 - RNA, 16 nt, Human
gacuggauaguccguc

SEQ ID NO: 2636288 - RNA, 14 nt, Human
gacugcauuauauu

SEQ ID NO: 2636289 - RNA, 16 nt, Human
gacugcauuauauuua

SEQ ID NO: 2636290 - RNA, 16 nt, Human
gacuucuaaguaaaac

SEQ ID NO: 2636291 - RNA, 18 nt, Human
gacuucuaaguaaaacca

SEQ ID NO: 2636292 - RNA, 17 nt, Human
gacuucuaaguaaaacc

SEQ ID NO: 2636293 - RNA, 24 nt, Human
gacuucuaaguaaaaccacagcag

SEQ ID NO: 2636294 - RNA, 23 nt, Human
gacuucuaaguaaaaccacagca

SEQ ID NO: 2636295 - RNA, 19 nt, Human
gacuucuaaguaaaaccac

SEQ ID NO: 2636296 - RNA, 23 nt, Human
gacuucugucuucacaacagauu

SEQ ID NO: 2636297 - RNA, 20 nt, Human
gacuucugucuucacaacag

SEQ ID NO: 2636298 - RNA, 21 nt, Human
gagaaccuagggugauauuaa

SEQ ID NO: 2636299 - RNA, 22 nt, Human
gagaaccuagggugauauuaac

SEQ ID NO: 2636300 - RNA, 22 nt, Human
gagaacuuccagauccuggaaa

SEQ ID NO: 2636301 - RNA, 23 nt, Human
gagaacuuccagauccuggaaau

SEQ ID NO: 2636302 - RNA, 17 nt, Human
gagaaugagagacacac

SEQ ID NO: 2636303 - RNA, 13 nt, Human
gagaagagcuguu

SEQ ID NO: 2636304 - RNA, 20 nt, Human
gagacagcucugcauacuca

SEQ ID NO: 2636305 - RNA, 20 nt, Human
gagaaugagagacacacuga

SEQ ID NO: 2636306 - RNA, 21 nt, Human
gagaaugagagacacacugaa

SEQ ID NO: 2636307 - RNA, 13 nt, Human
cugccuccccucc

SEQ ID NO: 2636308 - RNA, 14 nt, Human
cugccuccccuccu

SEQ ID NO: 2636309 - RNA, 20 nt, Human
cugcccucuccugggcagcu

SEQ ID NO: 2636310 - RNA, 21 nt, Human
cugcccucuccugggcagcug

SEQ ID NO: 2636311 - RNA, 16 nt, Human
cugcccucuccugggc

SEQ ID NO: 2636312 - RNA, 18 nt, Human
cugcccucuccugggcag

SEQ ID NO: 2636313 - RNA, 19 nt, Human
cugcccucuccugggcagc

SEQ ID NO: 2636314 - RNA, 18 nt, Human
cugcugaaacaacaaaua

SEQ ID NO: 2636315 - RNA, 16 nt, Human
cuggagcucugcccau

SEQ ID NO: 2636316 - RNA, 13 nt, Human
cuggagcucugcc

SEQ ID NO: 2636317 - RNA, 12 nt, Human
cuggagcucugc

SEQ ID NO: 2636318 - RNA, 23 nt, Human
cuggccuucggccuccauccuga

SEQ ID NO: 2636319 - RNA, 22 nt, Human
cuggccuucggccuccauccug

SEQ ID NO: 2636320 - RNA, 20 nt, Human
cuggcacaguuuucugagaa

SEQ ID NO: 2636321 - RNA, 22 nt, Human
cuggcacaguuuucugagaaag

SEQ ID NO: 2636322 - RNA, 21 nt, Human
cuggcacaguuuucugagaaa

SEQ ID NO: 2636323 - RNA, 22 nt, Human
cugggggggauuguaaaauggu

SEQ ID NO: 2636324 - RNA, 23 nt, Human
cuguaaucacagcuacuugggag

SEQ ID NO: 2636325 - RNA, 22 nt, Human
cuguauuuuaaaagaaugauua

SEQ ID NO: 2636326 - RNA, 20 nt, Human
cuguauuuuaaaagaaugau

SEQ ID NO: 2636327 - RNA, 19 nt, Human
cuguauuuuaaaagaauga

SEQ ID NO: 2636328 - RNA, 20 nt, Human
cugucuacacuaagagagaa

SEQ ID NO: 2636329 - RNA, 20 nt, Human
cuguuaaaagaugaaaauau

SEQ ID NO: 2636330 - RNA, 23 nt, Human
cuguuaaaagaugaaaauauuug

SEQ ID NO: 2636331 - RNA, 21 nt, Human
cuguuaaaagaugaaaauauu

SEQ ID NO: 2636332 - RNA, 15 nt, Human
cuuauuuccucauuu

SEQ ID NO: 2636333 - RNA, 15 nt, Human
cuuauuucauuucuu

SEQ ID NO: 2636334 - RNA, 14 nt, Human
cuuauuucauuucu

SEQ ID NO: 2636335 - RNA, 22 nt, Human
cuuagaugcaguucugaagaag

SEQ ID NO: 2636336 - RNA, 20 nt, Human
cuuagaugcaguucugaaga

SEQ ID NO: 2636337 - RNA, 18 nt, Human
cuucugucuucacaacag

SEQ ID NO: 2636338 - RNA, 22 nt, Human
cuucugucuucacaacagauua

SEQ ID NO: 2636339 - RNA, 21 nt, Human
cuucugucuucacaacagauu

SEQ ID NO: 2636340 - RNA, 23 nt, Human
cuugucaauaaaauccauacauu

SEQ ID NO: 2636341 - RNA, 19 nt, Human
cuugaguuuaaauuguaau

SEQ ID NO: 2636342 - RNA, 14 nt, Human
gaaacccugucucu

SEQ ID NO: 2636343 - RNA, 23 nt, Human
gaaacucguuaauuuguaguguu

SEQ ID NO: 2636344 - RNA, 16 nt, Human
gaaacacaacuauauu

SEQ ID NO: 2636345 - RNA, 11 nt, Human
gaaacauuugg

SEQ ID NO: 2636346 - RNA, 14 nt, Human
gaaagcagggacuu

SEQ ID NO: 2636347 - RNA, 22 nt, Human
gaaagcagaacagugauuacca

SEQ ID NO: 2636348 - RNA, 17 nt, Human
gaaagcagaacagugau

SEQ ID NO: 2636349 - RNA, 17 nt, Human
gaaagagaacuuccaga

SEQ ID NO: 2636350 - RNA, 20 nt, Human
gaaagaggcagcuugaaacu

SEQ ID NO: 2636351 - RNA, 21 nt, Human
gaaagaggaaugaaguacuca

SEQ ID NO: 2636352 - RNA, 18 nt, Human
gaaaauauuuguaucaca

SEQ ID NO: 2636353 - RNA, 22 nt, Human
gaaaaucuacacuccagugaga

SEQ ID NO: 2636354 - RNA, 18 nt, Human
gaaaaucuuauaauuuaa

SEQ ID NO: 2636355 - RNA, 15 nt, Human
ccuuggacucauuuu

SEQ ID NO: 2636356 - RNA, 17 nt, Human
ccuucggccuccauccu

SEQ ID NO: 2636357 - RNA, 16 nt, Human
ccuucggccuccaucc

SEQ ID NO: 2636358 - RNA, 18 nt, Human
ccuucggccuccauccug

SEQ ID NO: 2636359 - RNA, 13 nt, Human
ccugggcagcugc

SEQ ID NO: 2636360 - RNA, 14 nt, Human
ccugggcagcugcc

SEQ ID NO: 2636361 - RNA, 17 nt, Human
ccugaggcuccacuugg

SEQ ID NO: 2636362 - RNA, 14 nt, Human
ccugaggcuccacu

SEQ ID NO: 2636363 - RNA, 13 nt, Human
ccugaggcuccac

SEQ ID NO: 2636364 - RNA, 13 nt, Human
ccugaaagaggaa

SEQ ID NO: 2636365 - RNA, 17 nt, Human
ccugccccugagcccau

SEQ ID NO: 2636366 - RNA, 22 nt, Human
cuaggaaauauuuauuuuaaua

SEQ ID NO: 2636367 - RNA, 20 nt, Human
cgggaggcagagguugcagu

SEQ ID NO: 2636368 - RNA, 14 nt, Human
cuaagagagaauga

SEQ ID NO: 2636369 - RNA, 15 nt, Human
cuaagagagaaugag

SEQ ID NO: 2636370 - RNA, 19 nt, Human
cuaaauugacacuuaaaaa

SEQ ID NO: 2636371 - RNA, 19 nt, Human
cuaaguaaaaccacagcag

SEQ ID NO: 2636372 - RNA, 18 nt, Human
cuaaguaaaaccacagca

SEQ ID NO: 2636373 - RNA, 14 nt, Human
cuaaguaaaaccac

SEQ ID NO: 2636374 - RNA, 21 nt, Human
cuaagcuucacuguaaaauaa

SEQ ID NO: 2636375 - RNA, 14 nt, Human
cuacacuaagagag

SEQ ID NO: 2636376 - RNA, 23 nt, Human
cuacacgagauacagaauuuuau

SEQ ID NO: 2636377 - RNA, 18 nt, Human
cuagaguuuagcuggaaa

SEQ ID NO: 2636378 - RNA, 19 nt, Human
cuagaguuuagcuggaaaa

SEQ ID NO: 2636379 - RNA, 14 nt, Human
cuaggaaauauuua

SEQ ID NO: 2636380 - RNA, 15 nt, Human
cuaggaaauauuuau

SEQ ID NO: 2636381 - RNA, 19 nt, Human
cuaggaaauauuuauuuua

SEQ ID NO: 2636382 - RNA, 20 nt, Human
cuaggaaauauuuauuuuaa

SEQ ID NO: 2636383 - RNA, 15 nt, Human
cuauaggugcuacaa

SEQ ID NO: 2636384 - RNA, 19 nt, Human
cuaugaaauauuauguuaa

SEQ ID NO: 2636385 - RNA, 13 nt, Human
cuauaauuuaaau

SEQ ID NO: 2636386 - RNA, 12 nt, Human
cuauaauuuaaa

SEQ ID NO: 2636387 - RNA, 22 nt, Human
cucaggaaaucaaauaugcaaa

SEQ ID NO: 2636388 - RNA, 21 nt, Human
cucagaugcacaugagcuggc

SEQ ID NO: 2636389 - RNA, 14 nt, Human
cuccccucggagaa

SEQ ID NO: 2636390 - RNA, 23 nt, Human
cucauuuuuauaaugucccuuca

SEQ ID NO: 2636391 - RNA, 17 nt, Human
cucauuuccaagcaagu

SEQ ID NO: 2636392 - RNA, 12 nt, Human
cucauuuccaag

SEQ ID NO: 2636393 - RNA, 13 nt, Human
cucauuuccaagc

SEQ ID NO: 2636394 - RNA, 14 nt, Human
cucauuuccaagca

SEQ ID NO: 2636395 - RNA, 15 nt, Human
ccccucggagaagag

SEQ ID NO: 2636396 - RNA, 13 nt, Human
ccccuccucugcu

SEQ ID NO: 2636397 - RNA, 14 nt, Human
ccccuccucugcuu

SEQ ID NO: 2636398 - RNA, 17 nt, Human
ccccuccucugcuugcc

SEQ ID NO: 2636399 - RNA, 20 nt, Human
cccucuccugggcagcugcc

SEQ ID NO: 2636400 - RNA, 21 nt, Human
cccucuccugggcagcugccu

SEQ ID NO: 2636401 - RNA, 22 nt, Human
cccucuccugggcagcugccuc

SEQ ID NO: 2636402 - RNA, 23 nt, Human
cccucuccugggcagcugccucc

SEQ ID NO: 2636403 - RNA, 15 nt, Human
ccuaacgaaguaucc

SEQ ID NO: 2636404 - RNA, 15 nt, Human
ccacugguucuucuu

SEQ ID NO: 2636405 - RNA, 14 nt, Human
ccagacaucaacag

SEQ ID NO: 2636406 - RNA, 15 nt, Human
ccaccucccugcaau

SEQ ID NO: 2636407 - RNA, 19 nt, Human
ccaccucccugcaauaaaa

SEQ ID NO: 2636408 - RNA, 21 nt, Human
ccaccucccugcaauaaaaug

SEQ ID NO: 2636409 - RNA, 19 nt, Human
ccagccugagcgacaguga

SEQ ID NO: 2636410 - RNA, 13 nt, Human
ccaggugccaguu

SEQ ID NO: 2636411 - RNA, 12 nt, Human
ccaggugccagu

SEQ ID NO: 2636412 - RNA, 20 nt, Human
ccauccugaggcuccacuug

SEQ ID NO: 2636413 - RNA, 18 nt, Human
ccauccugaggcuccacu

SEQ ID NO: 2636414 - RNA, 20 nt, Human
ccagguagaggguguguaag

SEQ ID NO: 2636415 - RNA, 17 nt, Human
accucugccucagaaaa

SEQ ID NO: 2636416 - RNA, 18 nt, Human
accucugccucagaaaac

SEQ ID NO: 2636417 - RNA, 19 nt, Human
acggacgaaccuugaaaac

SEQ ID NO: 2636418 - RNA, 19 nt, Human
acuaguauuucuaugaaau

SEQ ID NO: 2636419 - RNA, 18 nt, Human
acuaguauuucuaugaaa

SEQ ID NO: 2636420 - RNA, 22 nt, Human
acuugggaggcugagaugggag

SEQ ID NO: 2636421 - RNA, 17 nt, Human
acuuuaugcuaagugaa

SEQ ID NO: 2636422 - RNA, 12 nt, Human
acuuuaugcuaa

SEQ ID NO: 2636423 - RNA, 20 nt, Human
acuucaaauccuugaagauu

SEQ ID NO: 2636424 - RNA, 17 nt, Human
acuucagcgguuuauau

SEQ ID NO: 2636425 - RNA, 18 nt, Human
acuucagcgguuuauaua

SEQ ID NO: 2636426 - RNA, 19 nt, Human
acuucagcgguuuauauaa

SEQ ID NO: 2636427 - RNA, 19 nt, Human
acuucaaauccuugaagau

SEQ ID NO: 2636428 - RNA, 21 nt, Human
acuuaaaaaugguuuaaaugg

SEQ ID NO: 2636429 - RNA, 14 nt, Human
acuuaaaaaugguu

SEQ ID NO: 2636430 - RNA, 13 nt, Human
acuuaaaaauggu

SEQ ID NO: 2636431 - RNA, 14 nt, Human
acucuuaagaagac

SEQ ID NO: 2636432 - RNA, 15 nt, Human
acucuuaagaagacu

SEQ ID NO: 2636433 - RNA, 20 nt, Human
acucuuaagaagacugcauu

SEQ ID NO: 2636434 - RNA, 17 nt, Human
acucugucucaguccau

SEQ ID NO: 2636435 - RNA, 15 nt, Human
acucugucucagucc

SEQ ID NO: 2636436 - RNA, 16 nt, Human
acagaagcuccaggua

SEQ ID NO: 2636437 - RNA, 13 nt, Human
acaagaaaugaaa

SEQ ID NO: 2636438 - RNA, 21 nt, Human
acaaggaugaauuaaguuuuu

SEQ ID NO: 2636439 - RNA, 16 nt, Human
acaagaaaugaaagca

SEQ ID NO: 2636440 - RNA, 15 nt, Human
acaagaaaugaaagc

SEQ ID NO: 2636441 - RNA, 17 nt, Human
aauuuugugaagcaaaa

SEQ ID NO: 2636442 - RNA, 18 nt, Human
aauuuugugaagcaaaau

SEQ ID NO: 2636443 - RNA, 19 nt, Human
accaaggcugauuaaacca

SEQ ID NO: 2636444 - RNA, 20 nt, Human
accaaggcugauuaaaccaa

SEQ ID NO: 2636445 - RNA, 20 nt, Human
acaucccuuaccugggaaag

SEQ ID NO: 2636446 - RNA, 21 nt, Human
acagugauuaccagggacuga

SEQ ID NO: 2636447 - RNA, 20 nt, Human
acagugauuaccagggacug

SEQ ID NO: 2636448 - RNA, 19 nt, Human
aagccagauuuuccugaaa

SEQ ID NO: 2636449 - RNA, 15 nt, Human
aagggauuuucagcc

SEQ ID NO: 2636450 - RNA, 17 nt, Human
aagggauggcaagaugu

SEQ ID NO: 2636451 - RNA, 14 nt, Human
aagggauggcaaga

SEQ ID NO: 2636452 - RNA, 21 nt, Human
aagggauuuucagcccucaga

SEQ ID NO: 2636453 - RNA, 23 nt, Human
aagggauuuucagcccucagaau

SEQ ID NO: 2636454 - RNA, 12 nt, Human
aaguagaggagg

SEQ ID NO: 2636455 - RNA, 14 nt, Human
aagauagcagggca

SEQ ID NO: 2636456 - RNA, 15 nt, Human
aagcagggacuugaa

SEQ ID NO: 2636457 - RNA, 15 nt, Human
aagagaacuuccaga

SEQ ID NO: 2636458 - RNA, 23 nt, Human
aagacagugaaagaaaauaacaa

SEQ ID NO: 2636459 - RNA, 17 nt, Human
aauccauacauuugugu

SEQ ID NO: 2636460 - RNA, 16 nt, Human
aauccauacauuugug

SEQ ID NO: 2636461 - RNA, 15 nt, Human
aaugauaacuggaaa

SEQ ID NO: 2636462 - RNA, 16 nt, Human
aaugauaacuggaaac

SEQ ID NO: 2636463 - RNA, 14 nt, Human
aaugauaacuggaa

SEQ ID NO: 2636464 - RNA, 22 nt, Human
aaucauuucugcaucagcugcu

SEQ ID NO: 2636465 - RNA, 22 nt, Human
aaucaaauaugcaaagcacuga

SEQ ID NO: 2636466 - RNA, 16 nt, Human
aaucaaauaugcaaag

SEQ ID NO: 2636467 - RNA, 15 nt, Human
aaucaaauaugcaaa

SEQ ID NO: 2636468 - RNA, 12 nt, Human
aauaauguuuca

SEQ ID NO: 2636469 - RNA, 14 nt, Human
aauaauguuucaaa

SEQ ID NO: 2636470 - RNA, 19 nt, Human
aauaauguuucaaacauau

SEQ ID NO: 2636471 - RNA, 10 nt, Human
aauaaaccau

SEQ ID NO: 2636472 - RNA, 22 nt, Human
aaguugauaugccuuuucccaa

SEQ ID NO: 2636473 - RNA, 17 nt, Human
aaguucugcagauaaac

SEQ ID NO: 2636474 - RNA, 12 nt, Human
aacacaucagcu

SEQ ID NO: 2636475 - RNA, 22 nt, Human
aaauugacacuuaaaaaugguu

SEQ ID NO: 2636476 - RNA, 20 nt, Human
aaauguucaucaaugaauga

SEQ ID NO: 2636477 - RNA, 14 nt, Human
aaaucuuaacuuga

SEQ ID NO: 2636478 - RNA, 23 nt, Human
aacugagaugugaacacaucagc

SEQ ID NO: 2636479 - RNA, 19 nt, Human
aaaauccauacauuugugu

SEQ ID NO: 2636480 - RNA, 21 nt, Human
aaacccugucucuacuaaaaa

SEQ ID NO: 2636481 - RNA, 19 nt, Human
aaacccuugccaugugcua

SEQ ID NO: 2636482 - RNA, 13 nt, Human
aaagaaacauuug

SEQ ID NO: 2636483 - RNA, 19 nt, Human
aaaggcagaagcaacccaa

SEQ ID NO: 2636484 - RNA, 20 nt, Human
aaagcauuguaaaugugcuu

SEQ ID NO: 2636485 - RNA, 19 nt, Human
aaagcauuguaaaugugcu

SEQ ID NO: 2636486 - RNA, 19 nt, Human
agcuccccucggagaagag

SEQ ID NO: 2636487 - RNA, 17 nt, Human
agcuccccucggagaag

SEQ ID NO: 2636488 - RNA, 20 nt, Human
agcuccccucggagaagagc

SEQ ID NO: 2636489 - RNA, 17 nt, Human
agcgacagugagacucu

SEQ ID NO: 2636490 - RNA, 18 nt, Human
agcuucacuguaaaauaa

SEQ ID NO: 2636491 - RNA, 20 nt, Human
agcuuauuuccucauuuuua

SEQ ID NO: 2636492 - RNA, 15 nt, Human
agggauuagggagag

SEQ ID NO: 2636493 - RNA, 17 nt, Human
agggauuuucagcccuc

SEQ ID NO: 2636494 - RNA, 22 nt, Human
agggauuuucagcccucagaau

SEQ ID NO: 2636495 - RNA, 21 nt, Human
aggccaugggcacugugggua

SEQ ID NO: 2636496 - RNA, 15 nt, Human
agggacugaggggag

SEQ ID NO: 2636497 - RNA, 24 nt, Human
agcaaaauuuuuucucuaggaaau

SEQ ID NO: 2636498 - RNA, 16 nt, Human
agauguagaggagaaa

SEQ ID NO: 2636499 - RNA, 19 nt, Human
agauguagaggagaaacug

SEQ ID NO: 2636500 - RNA, 21 nt, Human
agaagagcuguucacagccag

SEQ ID NO: 2636501 - RNA, 22 nt, Human
agaagagcuguucacagccaga

SEQ ID NO: 2636502 - RNA, 18 nt, Human
agaagacugcauuauauu

SEQ ID NO: 2636503 - RNA, 13 nt, Human
agaagauagcagg

SEQ ID NO: 2636504 - RNA, 21 nt, Human
agaagugaaaaucuacacucc

SEQ ID NO: 2636505 - RNA, 17 nt, Human
agaaugauuaugaauua

SEQ ID NO: 2636506 - RNA, 17 nt, Human
agaaugagagacacacu

SEQ ID NO: 2636507 - RNA, 22 nt, Human
agaaugagagacacacugaaga

SEQ ID NO: 2636508 - RNA, 19 nt, Human
agacccaaaaggcagaagc

SEQ ID NO: 2636509 - RNA, 17 nt, Human
agacccaaaaggcagaa

SEQ ID NO: 2636510 - RNA, 16 nt, Human
agacuggauaguccgu

SEQ ID NO: 2636511 - RNA, 20 nt, Human
agacuggauaguccgucucu

SEQ ID NO: 2636512 - RNA, 18 nt, Human
agacucugucucagucca

SEQ ID NO: 2636513 - RNA, 13 nt, Human
agaggaaugaagu

SEQ ID NO: 2636514 - RNA, 17 nt, Human
aucgcuccaccuugcag

SEQ ID NO: 2636515 - RNA, 21 nt, Human
aucgcuccaccuugcagcucu

SEQ ID NO: 2636516 - RNA, 19 nt, Human
auccucaguuuuugugaaa

SEQ ID NO: 2636517 - RNA, 13 nt, Human
aucagcuuauugu

SEQ ID NO: 2636518 - RNA, 22 nt, Human
aucagcuugcccuguuaaaaga

SEQ ID NO: 2636519 - RNA, 17 nt, Human
aucaugaauuaguuuua

SEQ ID NO: 2636520 - RNA, 14 nt, Human
aucaaauaugcaaa

SEQ ID NO: 2636521 - RNA, 21 nt, Human
augaaguacucauacauguua

SEQ ID NO: 2636522 - RNA, 13 nt, Human
augaaguacucau

SEQ ID NO: 2636523 - RNA, 20 nt, Human
augaaguccaagcauuuaga

SEQ ID NO: 2636524 - RNA, 23 nt, Human
augaaguccaagcauuuagaugu

SEQ ID NO: 2636525 - RNA, 21 nt, Human
augucaaucagccuaguugau

SEQ ID NO: 2636526 - RNA, 15 nt, Human
augugaacacaucag

SEQ ID NO: 2636527 - RNA, 16 nt, Human
auguuccuagugaaag

SEQ ID NO: 2636528 - RNA, 15 nt, Human
auguuccuagugaaa

SEQ ID NO: 2636529 - RNA, 17 nt, Human
auguuccuagugaaaga

SEQ ID NO: 2636530 - RNA, 18 nt, Human
augaugaucuuuaaaaua

SEQ ID NO: 2636531 - RNA, 21 nt, Human
augaugaucuuuaaaauacac

SEQ ID NO: 2636532 - RNA, 16 nt, Human
augaucuuuaaaauac

SEQ ID NO: 2636533 - RNA, 19 nt, Human
agugucaaugcagccccca

SEQ ID NO: 2636534 - RNA, 23 nt, Human
aguucagagcugcccucuccugg

SEQ ID NO: 2636535 - RNA, 21 nt, Human
aguucagagcugcccucuccu

SEQ ID NO: 2636536 - RNA, 22 nt, Human
aguucagagcugcccucuccug

SEQ ID NO: 2636537 - RNA, 20 nt, Human
aguucagagcugcccucucc

SEQ ID NO: 2636538 - RNA, 18 nt, Human
aguugaaaagacuccaaa

SEQ ID NO: 2636539 - RNA, 20 nt, Human
aguugaaaagacuccaaaga

SEQ ID NO: 2636540 - RNA, 19 nt, Human
aguugaaaagacuccaaag

SEQ ID NO: 2636541 - RNA, 11 nt, Human
aguccaagcau

SEQ ID NO: 2636542 - RNA, 14 nt, Human
auaacaaugaaagu

SEQ ID NO: 2636543 - RNA, 15 nt, Human
auaacaaugcuguau

SEQ ID NO: 2636544 - RNA, 17 nt, Human
auaacaaugcuguauuu

SEQ ID NO: 2636545 - RNA, 19 nt, Human
auaacaaugcuguauuuua

SEQ ID NO: 2636546 - RNA, 20 nt, Human
auaacaaugcuguauuuuaa

SEQ ID NO: 2636547 - RNA, 21 nt, Human
auaacaaugcuguauuuuaaa

SEQ ID NO: 2636548 - RNA, 18 nt, Human
auaauguuucaaacauau

SEQ ID NO: 2636549 - RNA, 13 nt, Human
auaauguuucaaa

SEQ ID NO: 2636550 - RNA, 22 nt, Human
auaagccagacaucaacagaua

SEQ ID NO: 2636551 - RNA, 21 nt, Human
auaagccagacaucaacagau

SEQ ID NO: 2636552 - RNA, 15 nt, Human
auagcagcuuauuca

SEQ ID NO: 2636553 - RNA, 14 nt, Human
auauuauguuaaaa

SEQ ID NO: 2636554 - RNA, 13 nt, Human
auauuauguuaaa

SEQ ID NO: 2636555 - RNA, 21 nt, Human
cuggaaaucaggguuaguauu

SEQ ID NO: 2636556 - RNA, 21 nt, Human
cugucagcuccccucggagaa

SEQ ID NO: 2636557 - RNA, 23 nt, Human
cugucagcuccccucggagaaga

SEQ ID NO: 2636558 - RNA, 16 nt, Human
cugugagaugcuagaa

SEQ ID NO: 2636559 - RNA, 10 nt, Human
cugggacagg

SEQ ID NO: 2636560 - RNA, 22 nt, Human
cugggcagcugccuccccuccu

SEQ ID NO: 2636561 - RNA, 20 nt, Human
cugggcagcugccuccccuc

SEQ ID NO: 2636562 - RNA, 21 nt, Human
cugggcagcugccuccccucc

SEQ ID NO: 2636563 - RNA, 16 nt, Human
cugggcagcugccucc

SEQ ID NO: 2636564 - RNA, 19 nt, Human
cugggcagcugccuccccu

SEQ ID NO: 2636565 - RNA, 17 nt, Human
gaaagacuauucaaaca

SEQ ID NO: 2636566 - RNA, 15 nt, Human
gaaagacuauucaaa

SEQ ID NO: 2636567 - RNA, 14 nt, Human
gaaagacuauucaa

SEQ ID NO: 2636568 - RNA, 18 nt, Human
gaaaucaaauaugcaaag

SEQ ID NO: 2636569 - RNA, 18 nt, Human
gaaauauuuauuuuaaua

SEQ ID NO: 2636570 - RNA, 22 nt, Human
gaaauauuuauuuuaauaaugu

SEQ ID NO: 2636571 - RNA, 20 nt, Human
gaaaucaaauaugcaaagca

SEQ ID NO: 2636572 - RNA, 19 nt, Human
gaaaucaaauaugcaaagc

SEQ ID NO: 2636573 - RNA, 17 nt, Human
gaaauauuuauuuuaau

SEQ ID NO: 2636574 - RNA, 15 nt, Human
cuucacuguaaaaua

SEQ ID NO: 2636575 - RNA, 23 nt, Human
cuucuaaguaaaaccacagcagu

SEQ ID NO: 2636576 - RNA, 22 nt, Human
cuucuaaguaaaaccacagcag

SEQ ID NO: 2636577 - RNA, 12 nt, Human
cuugaugaagaa

SEQ ID NO: 2636578 - RNA, 13 nt, Human
cuugaugaagaag

SEQ ID NO: 2636579 - RNA, 19 nt, Human
gcagggacuugaacccaua

SEQ ID NO: 2636580 - RNA, 11 nt, Human
gcagcugccuc

SEQ ID NO: 2636581 - RNA, 12 nt, Human
gcagcugccucc

SEQ ID NO: 2636582 - RNA, 13 nt, Human
gcagcugccuccc

SEQ ID NO: 2636583 - RNA, 15 nt, Human
gcagcugccuccccu

SEQ ID NO: 2636584 - RNA, 16 nt, Human
gcagcugccuccccuc

SEQ ID NO: 2636585 - RNA, 17 nt, Human
gcagcugccuccccucc

SEQ ID NO: 2636586 - RNA, 18 nt, Human
gcagcugccuccccuccu

SEQ ID NO: 2636587 - RNA, 22 nt, Human
gcagcugccuccccuccucugc

SEQ ID NO: 2636588 - RNA, 21 nt, Human
gcacaugagcuggcgggauug

SEQ ID NO: 2636589 - RNA, 18 nt, Human
gcacaguuuucugagaaa

SEQ ID NO: 2636590 - RNA, 17 nt, Human
gcacaguuuucugagaa

SEQ ID NO: 2636591 - RNA, 14 nt, Human
gcacaguuuucuga

SEQ ID NO: 2636592 - RNA, 17 nt, Human
gauuagggagagaagau

SEQ ID NO: 2636593 - RNA, 16 nt, Human
gaugugaacacaucag

SEQ ID NO: 2636594 - RNA, 14 nt, Human
gaugugaacacauc

SEQ ID NO: 2636595 - RNA, 14 nt, Human
gauuaccagggacu

SEQ ID NO: 2636596 - RNA, 16 nt, Human
gaguuuagcuggaaaa

SEQ ID NO: 2636597 - RNA, 21 nt, Human
gagugcucaguagucagacug

SEQ ID NO: 2636598 - RNA, 20 nt, Human
gauauguaccuaacgaagua

SEQ ID NO: 2636599 - RNA, 14 nt, Human
gagaaucacuugaa

SEQ ID NO: 2636600 - RNA, 15 nt, Human
gagaaucacuugaac

SEQ ID NO: 2636601 - RNA, 17 nt, Human
gacucuuaagaagacug

SEQ ID NO: 2636602 - RNA, 18 nt, Human
gacucuuaagaagacugc

SEQ ID NO: 2636603 - RNA, 16 nt, Human
gacucuuaagaagacu

SEQ ID NO: 2636604 - RNA, 22 nt, Human
gaaugagagacacacugaagaa

SEQ ID NO: 2636605 - RNA, 23 nt, Human
gaaugagagacacacugaagaag

SEQ ID NO: 2636606 - RNA, 20 nt, Human
gaaugagagacacacugaag

SEQ ID NO: 2636607 - RNA, 16 nt, Human
gacacuuaaaaauggu

SEQ ID NO: 2636608 - RNA, 17 nt, Human
gacagucaccucaugga

SEQ ID NO: 2636609 - RNA, 14 nt, Human
gacagugaaagaaa

SEQ ID NO: 2636610 - RNA, 14 nt, Human
gacacacugaagaa

SEQ ID NO: 2636611 - RNA, 13 nt, Human
gacacacugaaga

SEQ ID NO: 2636612 - RNA, 12 nt, Human
gacacacaugaa

SEQ ID NO: 2636613 - RNA, 11 nt, Human
gaauuaguuuu

SEQ ID NO: 2636614 - RNA, 12 nt, Human
ggauggcaagau

SEQ ID NO: 2636615 - RNA, 22 nt, Human
ggauguugaaaaaguucugcag

SEQ ID NO: 2636616 - RNA, 13 nt, Human
ggccuccauccug

SEQ ID NO: 2636617 - RNA, 23 nt, Human
ggccuucggccuccauccugagg

SEQ ID NO: 2636618 - RNA, 12 nt, Human
gggcagcugccu

SEQ ID NO: 2636619 - RNA, 17 nt, Human
gggauuguaaaauggug

SEQ ID NO: 2636620 - RNA, 16 nt, Human
gggauuguaaaauggu

SEQ ID NO: 2636621 - RNA, 22 nt, Human
aaaaauggaacauaaaauacaa

SEQ ID NO: 2636622 - RNA, 12 nt, Human
aaaaccacagca

SEQ ID NO: 2636623 - RNA, 14 nt, Human
aaaaccacagcagu

SEQ ID NO: 2636624 - RNA, 13 nt, Human
aaaaccacagcag

SEQ ID NO: 2636625 - RNA, 17 nt, Human
aaaagaugaaaauauuu

SEQ ID NO: 2636626 - RNA, 13 nt, Human
aaaacucauuuuu

SEQ ID NO: 2636627 - RNA, 19 nt, Human
gggacauuugcucauggaa

SEQ ID NO: 2636628 - RNA, 20 nt, Human
gggacauuugcucauggaau

SEQ ID NO: 2636629 - RNA, 21 nt, Human
gggacauuugcucauggaauu

SEQ ID NO: 2636630 - RNA, 19 nt, Human
aaaaguauguuagugcaaa

SEQ ID NO: 2636631 - RNA, 15 nt, Human
gggcgugguggugag

SEQ ID NO: 2636632 - RNA, 20 nt, Human
aaacaagcacuaaacaaaga

SEQ ID NO: 2636633 - RNA, 20 nt, Human
aaacagucucaggaaaucaa

SEQ ID NO: 2636634 - RNA, 15 nt, Human
aaaaugugauaugua

SEQ ID NO: 2636635 - RNA, 22 nt, Human
aaaauuuuuucucuaggaaaua

SEQ ID NO: 2636636 - RNA, 14 nt, Human
aaagacuauucaaa

SEQ ID NO: 2636637 - RNA, 17 nt, Human
aaagcagggacuugaac

SEQ ID NO: 2636638 - RNA, 15 nt, Human
aaagacuauucaaac

SEQ ID NO: 2636639 - RNA, 15 nt, Human
aaauaauuuuuauau

SEQ ID NO: 2636640 - RNA, 18 nt, Human
aaauaauuuuuauauuug

SEQ ID NO: 2636641 - RNA, 20 nt, Human
aaauaauuuuuauauuugaa

SEQ ID NO: 2636642 - RNA, 16 nt, Human
ggugugaccacugcag

SEQ ID NO: 2636643 - RNA, 16 nt, Human
gguuuagaaagcuugc

SEQ ID NO: 2636644 - RNA, 19 nt, Human
gcuuccuggcaauagucaa

SEQ ID NO: 2636645 - RNA, 13 nt, Human
gcuguauuuuaaa

SEQ ID NO: 2636646 - RNA, 12 nt, Human
gcuguauuuuaa

SEQ ID NO: 2636647 - RNA, 17 nt, Human
gcuuauuuccucauuuu

SEQ ID NO: 2636648 - RNA, 20 nt, Human
gcuccacuuggucugugaga

SEQ ID NO: 2636649 - RNA, 16 nt, Human
gcugaaacaacaaaua

SEQ ID NO: 2636650 - RNA, 12 nt, Human
gcugaacaucac

SEQ ID NO: 2636651 - RNA, 21 nt, Human
gcucugcccauccugccccug

SEQ ID NO: 2636652 - RNA, 15 nt, Human
gcucugcccauccug

SEQ ID NO: 2636653 - RNA, 13 nt, Human
gccagcaguucag

SEQ ID NO: 2636654 - RNA, 14 nt, Human
gccagcaguucaga

SEQ ID NO: 2636655 - RNA, 19 nt, Human
gccagcaguucagagcugc

SEQ ID NO: 2636656 - RNA, 20 nt, Human
gccagcaguucagagcugcc

SEQ ID NO: 2636657 - RNA, 21 nt, Human
gccagcaguucagagcugccc

SEQ ID NO: 2636658 - RNA, 22 nt, Human
gccaguuauggcuauaggugcu

SEQ ID NO: 2636659 - RNA, 16 nt, Human
gccauaugaaaaggcu

SEQ ID NO: 2636660 - RNA, 15 nt, Human
gccccacccucagau

SEQ ID NO: 2636661 - RNA, 18 nt, Human
gccccacccucagaugca

SEQ ID NO: 2636662 - RNA, 22 nt, Human
gccaugugcuaguaauuggaaa

SEQ ID NO: 2636663 - RNA, 20 nt, Human
gccuccauccugaggcucca

SEQ ID NO: 2636664 - RNA, 16 nt, Human
gccuccauccugaggc

SEQ ID NO: 2636665 - RNA, 17 nt, Human
gcuacuugggaggcuga

SEQ ID NO: 2636666 - RNA, 15 nt, Human
gcuacugucagcucc

SEQ ID NO: 2636667 - RNA, 17 nt, Human
gcuacaaaaacacagca

SEQ ID NO: 2636668 - RNA, 19 nt, Human
gcuacaaaaacacagcaag

SEQ ID NO: 2636669 - RNA, 18 nt, Human
gcuacaaaaacacagcaa

SEQ ID NO: 2636670 - RNA, 20 nt, Human
cucuuagaugcaguucugaa

SEQ ID NO: 2636671 - RNA, 15 nt, Human
cucuuagaugcaguu

SEQ ID NO: 2636672 - RNA, 11 nt, Human
cucucuggccu

SEQ ID NO: 2636673 - RNA, 12 nt, Human
cucucuggccuu

SEQ ID NO: 2636674 - RNA, 14 nt, Human
cucccugcaauaaa

SEQ ID NO: 2636675 - RNA, 16 nt, Human
cucccugcaauaaaau

SEQ ID NO: 2636676 - RNA, 21 nt, Human
cuccagugagacagcucugca

SEQ ID NO: 2636677 - RNA, 15 nt, Human
cguggugauuuagca

SEQ ID NO: 2636678 - RNA, 15 nt, Human
cuacaugagguacug

SEQ ID NO: 2636679 - RNA, 23 nt, Human
cuaagugaaauaagccagacauc

SEQ ID NO: 2636680 - RNA, 20 nt, Human
cuaagugaaauaagccagac

SEQ ID NO: 2636681 - RNA, 23 nt, Human
cuaguugaucagcuuauugucua

SEQ ID NO: 2636682 - RNA, 19 nt, Human
cuagaacucccuuucaaca

SEQ ID NO: 2636683 - RNA, 18 nt, Human
cuagaacucccuuucaac

SEQ ID NO: 2636684 - RNA, 17 nt, Human
cuagaacucccuuucaa

SEQ ID NO: 2636685 - RNA, 16 nt, Human
cuagaacucccuuuca

SEQ ID NO: 2636686 - RNA, 16 nt, Human
cgacagugagacucug

SEQ ID NO: 2636687 - RNA, 15 nt, Human
cgacagugagacucu

SEQ ID NO: 2636688 - RNA, 15 nt, Human
ccagauccuggaaau

SEQ ID NO: 2636689 - RNA, 20 nt, Human
cccauauuuguacaccaaua

SEQ ID NO: 2636690 - RNA, 16 nt, Human
cccagccagcaguuca

SEQ ID NO: 2636691 - RNA, 17 nt, Human
cccagccagcaguucag

SEQ ID NO: 2636692 - RNA, 20 nt, Human
cccagccagcaguucagagc

SEQ ID NO: 2636693 - RNA, 23 nt, Human
cccauuguggucacaggaaguag

SEQ ID NO: 2636694 - RNA, 22 nt, Human
cccauuguggucacaggaagua

SEQ ID NO: 2636695 - RNA, 23 nt, Human
cccgggaggcagagguugcagug

SEQ ID NO: 2636696 - RNA, 17 nt, Human
cccuucuuuccacagaa

SEQ ID NO: 2636697 - RNA, 13 nt, Human
cccuucucuguau

SEQ ID NO: 2636698 - RNA, 24 nt, Human
ccguagacgugcacgcacacuguc

SEQ ID NO: 2636699 - RNA, 16 nt, Human
ccguagguuauuuuca

SEQ ID NO: 2636700 - RNA, 20 nt, Human
ccucauguccacugguucuu

SEQ ID NO: 2636701 - RNA, 15 nt, Human
ccucauguccacugg

SEQ ID NO: 2636702 - RNA, 13 nt, Human
ccucugcuugcca

SEQ ID NO: 2636703 - RNA, 17 nt, Human
ccucugcuugccauccc

SEQ ID NO: 2636704 - RNA, 19 nt, Human
cagggaggacgcucucugg

SEQ ID NO: 2636705 - RNA, 22 nt, Human
cagggaggacgcucucuggccu

SEQ ID NO: 2636706 - RNA, 23 nt, Human
caggacagcccuucuuuccacag

SEQ ID NO: 2636707 - RNA, 24 nt, Human
caggacagcccuucuuuccacaga

SEQ ID NO: 2636708 - RNA, 17 nt, Human
cagcuuauucacaagac

SEQ ID NO: 2636709 - RNA, 16 nt, Human
cagcuuauucacaaga

SEQ ID NO: 2636710 - RNA, 22 nt, Human
caggaaaucaaauaugcaaagc

SEQ ID NO: 2636711 - RNA, 21 nt, Human
caggaaaucaaauaugcaaag

SEQ ID NO: 2636712 - RNA, 19 nt, Human
caggaaaucaaauaugcaa

SEQ ID NO: 2636713 - RNA, 18 nt, Human
cagcaguucagagcugcc

SEQ ID NO: 2636714 - RNA, 19 nt, Human
cagcaguucagagcugccc

SEQ ID NO: 2636715 - RNA, 20 nt, Human
cagcaguucagagcugcccu

SEQ ID NO: 2636716 - RNA, 21 nt, Human
cagcaguucagagcugcccuc

SEQ ID NO: 2636717 - RNA, 22 nt, Human
cagcaguucagagcugcccucu

SEQ ID NO: 2636718 - RNA, 19 nt, Human
cagccccgugggguuccuc

SEQ ID NO: 2636719 - RNA, 23 nt, Human
cagccugagcgacagugagacuc

SEQ ID NO: 2636720 - RNA, 18 nt, Human
cauagauucccugagcag

SEQ ID NO: 2636721 - RNA, 17 nt, Human
cauagauucccugagca

SEQ ID NO: 2636722 - RNA, 20 nt, Human
cauagcagcuuauucacaag

SEQ ID NO: 2636723 - RNA, 20 nt, Human
caucagcuugcccuguuaaa

SEQ ID NO: 2636724 - RNA, 15 nt, Human
caucagcugcugaaa

SEQ ID NO: 2636725 - RNA, 18 nt, Human
caucagcugcugaaacaa

SEQ ID NO: 2636726 - RNA, 17 nt, Human
caucagcugcugaaaca

SEQ ID NO: 2636727 - RNA, 16 nt, Human
caugaauuaguuuuau

SEQ ID NO: 2636728 - RNA, 12 nt, Human
cauuuccaagca

SEQ ID NO: 2636729 - RNA, 15 nt, Human
cauuaggauggcuag

SEQ ID NO: 2636730 - RNA, 18 nt, Human
ccaaauguucaucaauga

SEQ ID NO: 2636731 - RNA, 15 nt, Human
caauucuugccaaau

SEQ ID NO: 2636732 - RNA, 16 nt, Human
caaugcuguauuuuaa

SEQ ID NO: 2636733 - RNA, 17 nt, Human
caaugcuguauuuuaaa

SEQ ID NO: 2636734 - RNA, 15 nt, Human
caaugcuguauuuua

SEQ ID NO: 2636735 - RNA, 18 nt, Human
cacaagacugcacaucaa

SEQ ID NO: 2636736 - RNA, 17 nt, Human
cacacaugaaguccaag

SEQ ID NO: 2636737 - RNA, 22 nt, Human
cacacaugaaguccaagcauuu

SEQ ID NO: 2636738 - RNA, 17 nt, Human
cacagccucuuagaugc

SEQ ID NO: 2636739 - RNA, 21 nt, Human
cacagccucuuagaugcaguu

SEQ ID NO: 2636740 - RNA, 14 nt, Human
caaguccaagcaua

SEQ ID NO: 2636741 - RNA, 22 nt, Human
cacugguucuucuuggucucag

SEQ ID NO: 2636742 - RNA, 16 nt, Human
cacuugucaauaaaau

SEQ ID NO: 2636743 - RNA, 19 nt, Human
cacuuguguuuugcaagcc

SEQ ID NO: 2636744 - RNA, 22 nt, Human
cacuuguguuuugcaagccaga

SEQ ID NO: 2636745 - RNA, 21 nt, Human
cacugcagaagacaguauggc

SEQ ID NO: 2636746 - RNA, 21 nt, Human
cacuagggcagggacaggaua

SEQ ID NO: 2636747 - RNA, 20 nt, Human
cacuagggcagggacaggau

SEQ ID NO: 2636748 - RNA, 19 nt, Human
auuuuauagcuacuaauuu

SEQ ID NO: 2636749 - RNA, 17 nt, Human
auuuuauagcuacuaau

SEQ ID NO: 2636750 - RNA, 14 nt, Human
auuugcucauggaa

SEQ ID NO: 2636751 - RNA, 17 nt, Human
auuugcucauggaauug

SEQ ID NO: 2636752 - RNA, 22 nt, Human
caaagcacugacuucuaaguaa

SEQ ID NO: 2636753 - RNA, 20 nt, Human
caaagcacugacuucuaagu

SEQ ID NO: 2636754 - RNA, 23 nt, Human
caacacgagcaggcuacugucag

SEQ ID NO: 2636755 - RNA, 15 nt, Human
caaauccuugaagau

SEQ ID NO: 2636756 - RNA, 13 nt, Human
caaacccaguguu

SEQ ID NO: 2636757 - RNA, 24 nt, Human
caaacccaguguuuuaggagcaug

SEQ ID NO: 2636758 - RNA, 15 nt, Human
caaaaggcagaagca

SEQ ID NO: 2636759 - RNA, 20 nt, Human
caaaaaaaaaaaaaaauuag

SEQ ID NO: 2636760 - RNA, 14 nt, Human
auuguaaaauggug

SEQ ID NO: 2636761 - RNA, 23 nt, Human
auuguaauaggcguaacuaauuu

SEQ ID NO: 2636762 - RNA, 16 nt, Human
auuagggagagaagau

SEQ ID NO: 2636763 - RNA, 14 nt, Human
auuaugaauuacau

SEQ ID NO: 2636764 - RNA, 17 nt, Human
auuaugaauuacauuug

SEQ ID NO: 2636765 - RNA, 18 nt, Human
auuaugaauuacauuugu

SEQ ID NO: 2636766 - RNA, 19 nt, Human
auucacaagacccaaaagg

SEQ ID NO: 2636767 - RNA, 22 nt, Human
auucauagcagcuuauucacaa

SEQ ID NO: 2636768 - RNA, 19 nt, Human
auucauagcagcuuauuca

SEQ ID NO: 2636769 - RNA, 13 nt, Human
uugcccuguuaaa

SEQ ID NO: 2636770 - RNA, 18 nt, Human
uugauggugguauguuuu

SEQ ID NO: 2636771 - RNA, 19 nt, Human
uugauggugguauguuuuc

SEQ ID NO: 2636772 - RNA, 21 nt, Human
aucucauuuccaagcaaguau

SEQ ID NO: 2636773 - RNA, 23 nt, Human
aucucauuuccaagcaaguauua

SEQ ID NO: 2636774 - RNA, 13 nt, Human
aucucaauauuuc

SEQ ID NO: 2636775 - RNA, 18 nt, Human
augaaauauuauguuaaa

SEQ ID NO: 2636776 - RNA, 13 nt, Human
augaaauauuaug

SEQ ID NO: 2636777 - RNA, 17 nt, Human
augaaauauuauguuaa

SEQ ID NO: 2636778 - RNA, 13 nt, Human
augaaugaauggc

SEQ ID NO: 2636779 - RNA, 18 nt, Human
augaagauguagaggaga

SEQ ID NO: 2636780 - RNA, 13 nt, Human
aucuuuuucuaac

SEQ ID NO: 2636781 - RNA, 15 nt, Human
augaaagcagggacu

SEQ ID NO: 2636782 - RNA, 16 nt, Human
uuguauaaaauaauuu

SEQ ID NO: 2636783 - RNA, 15 nt, Human
uuguauaaaauaauu

SEQ ID NO: 2636784 - RNA, 17 nt, Human
uuguauaaaauaauuuu

SEQ ID NO: 2636785 - RNA, 16 nt, Human
uuguaucacaaaucuu

SEQ ID NO: 2636786 - RNA, 13 nt, Human
augagagacacac

SEQ ID NO: 2636787 - RNA, 14 nt, Human
augagagacacacu

SEQ ID NO: 2636788 - RNA, 17 nt, Human
augagagacacacugaa

SEQ ID NO: 2636789 - RNA, 19 nt, Human
augagagacacacugaaga

SEQ ID NO: 2636790 - RNA, 20 nt, Human
auggcuaguaucaaaagaaa

SEQ ID NO: 2636791 - RNA, 22 nt, Human
uuuagcuggaaaaguauguuag

SEQ ID NO: 2636792 - RNA, 20 nt, Human
uuuagcuggaaaaguauguu

SEQ ID NO: 2636793 - RNA, 13 nt, Human
uuuauauaagcuu

SEQ ID NO: 2636794 - RNA, 15 nt, Human
augcuagaacucccu

SEQ ID NO: 2636795 - RNA, 19 nt, Human
augcuagaacucccuuuca

SEQ ID NO: 2636796 - RNA, 16 nt, Human
augcuagaacucccuu

SEQ ID NO: 2636797 - RNA, 22 nt, Human
augcugucuacacuaagagaga

SEQ ID NO: 2636798 - RNA, 15 nt, Human
augcaguucugaaga

SEQ ID NO: 2636799 - RNA, 17 nt, Human
augcaguucugaagaag

SEQ ID NO: 2636800 - RNA, 18 nt, Human
augcaguucugaagaaga

SEQ ID NO: 2636801 - RNA, 19 nt, Human
augcaguucugaagaagau

SEQ ID NO: 2636802 - RNA, 17 nt, Human
augccacuaaauugaca

SEQ ID NO: 2636803 - RNA, 15 nt, Human
augccacuaaauuga

SEQ ID NO: 2636804 - RNA, 14 nt, Human
uuguuuucauuauc

SEQ ID NO: 2636805 - RNA, 23 nt, Human
augagagacacacugaagaagca

SEQ ID NO: 2636806 - RNA, 20 nt, Human
augagagacacacugaagaa

SEQ ID NO: 2636807 - RNA, 21 nt, Human
augagagacacacugaagaag

SEQ ID NO: 2636808 - RNA, 23 nt, Human
uugugugaaagguacuucaaauc

SEQ ID NO: 2636809 - RNA, 15 nt, Human
augcaaagcacugac

SEQ ID NO: 2636810 - RNA, 22 nt, Human
augauuaugaauuacauuugua

SEQ ID NO: 2636811 - RNA, 12 nt, Human
augauucccagc

SEQ ID NO: 2636812 - RNA, 20 nt, Human
aucaaauaugcaaagcacug

SEQ ID NO: 2636813 - RNA, 17 nt, Human
uucuaaguaaaaccaca

SEQ ID NO: 2636814 - RNA, 20 nt, Human
uucuaaguaaaaccacagca

SEQ ID NO: 2636815 - RNA, 19 nt, Human
uucuaaguaaaaccacagc

SEQ ID NO: 2636816 - RNA, 14 nt, Human
uucuauaauuuaaa

SEQ ID NO: 2636817 - RNA, 13 nt, Human
uucuauaauuuaa

SEQ ID NO: 2636818 - RNA, 21 nt, Human
uucuaaguaaaaccacagcag

SEQ ID NO: 2636819 - RNA, 20 nt, Human
aucauuucugcaucagcugc

SEQ ID NO: 2636820 - RNA, 14 nt, Human
auccauacauuugu

SEQ ID NO: 2636821 - RNA, 18 nt, Human
uugaacccgggaggcaga

SEQ ID NO: 2636822 - RNA, 19 nt, Human
uugaaauauugacuuuuua

SEQ ID NO: 2636823 - RNA, 18 nt, Human
uucccaacuccagaaagu

SEQ ID NO: 2636824 - RNA, 12 nt, Human
uucccaaauuuc

SEQ ID NO: 2636825 - RNA, 22 nt, Human
auaggaauugacccacaagaaa

SEQ ID NO: 2636826 - RNA, 17 nt, Human
auaggcguaacuaauuu

SEQ ID NO: 2636827 - RNA, 23 nt, Human
uucacaagacccaaaaggcagaa

SEQ ID NO: 2636828 - RNA, 14 nt, Human
uucaaacauauaua

SEQ ID NO: 2636829 - RNA, 18 nt, Human
uucaaacagucucaggaa

SEQ ID NO: 2636830 - RNA, 20 nt, Human
auaguuguaccgcaauguga

SEQ ID NO: 2636831 - RNA, 17 nt, Human
auauaacaaugcuguau

SEQ ID NO: 2636832 - RNA, 14 nt, Human
auauauaacaaugc

SEQ ID NO: 2636833 - RNA, 18 nt, Human
auuuguaguguuggagaa

SEQ ID NO: 2636834 - RNA, 23 nt, Human
auuugguaaggggaauugaggac

SEQ ID NO: 2636835 - RNA, 22 nt, Human
auuuauuacuguaagaaaauau

SEQ ID NO: 2636836 - RNA, 21 nt, Human
auuuguauaaaauaauuuuua

SEQ ID NO: 2636837 - RNA, 15 nt, Human
auuuguaucacaaau

SEQ ID NO: 2636838 - RNA, 14 nt, Human
auuuuaauaauguu

SEQ ID NO: 2636839 - RNA, 15 nt, Human
auuuuaauaauguuu

SEQ ID NO: 2636840 - RNA, 16 nt, Human
auuuuaauaauguuuc

SEQ ID NO: 2636841 - RNA, 20 nt, Human
auugacacuuaaaaaugguu

SEQ ID NO: 2636842 - RNA, 21 nt, Human
auugacccacaagaaaugaaa

SEQ ID NO: 2636843 - RNA, 13 nt, Human
auugugccccugc

SEQ ID NO: 2636844 - RNA, 15 nt, Human
auuguauuacaaauc

SEQ ID NO: 2636845 - RNA, 14 nt, Human
auuguauuacaaau

SEQ ID NO: 2636846 - RNA, 19 nt, Human
auuuaaagcuuauuaaaac

SEQ ID NO: 2636847 - RNA, 16 nt, Human
auuuacaaaugggaaa

SEQ ID NO: 2636848 - RNA, 20 nt, Human
auuccacuuauaggaauuga

SEQ ID NO: 2636849 - RNA, 15 nt, Human
auucaaacagucuca

SEQ ID NO: 2636850 - RNA, 14 nt, Human
auucaaacagucuc

SEQ ID NO: 2636851 - RNA, 23 nt, Human
uuuuuuaaaaaagaaacauuugg

SEQ ID NO: 2636852 - RNA, 13 nt, Human
auuaaguaaugau

SEQ ID NO: 2636853 - RNA, 15 nt, Human
auuaaguaaugauaa

SEQ ID NO: 2636854 - RNA, 13 nt, Human
auuacauuuguau

SEQ ID NO: 2636855 - RNA, 15 nt, Human
auuacauuuguauaa

SEQ ID NO: 2636856 - RNA, 16 nt, Human
auuacauuuguauaaa

SEQ ID NO: 2636857 - RNA, 16 nt, Human
auuauauuuacaaaug

SEQ ID NO: 2636858 - RNA, 17 nt, Human
auuauauuuacaaaugg

SEQ ID NO: 2636859 - RNA, 23 nt, Human
auuaucucaaaacugcacuguca

SEQ ID NO: 2636860 - RNA, 18 nt, Human
auuaucucaaaacugcac

SEQ ID NO: 2636861 - RNA, 20 nt, Human
auuauuaccuuacagaaguu

SEQ ID NO: 2636862 - RNA, 18 nt, Human
auguuucaaacauauaua

SEQ ID NO: 2636863 - RNA, 21 nt, Human
auguuucaaacauauauaaca

SEQ ID NO: 2636864 - RNA, 16 nt, Human
auuaaaagaauauuuu

SEQ ID NO: 2636865 - RNA, 14 nt, Human
uuuuauaauuuugu

SEQ ID NO: 2636866 - RNA, 19 nt, Human
uuuuauggcacuaguauuu

SEQ ID NO: 2636867 - RNA, 23 nt, Human
uuuuauggaggcuuugcauagau

SEQ ID NO: 2636868 - RNA, 15 nt, Human
auguugacaugggac

SEQ ID NO: 2636869 - RNA, 19 nt, Human
auguucaucaaugaaugaa

SEQ ID NO: 2636870 - RNA, 13 nt, Human
uuuuaaaaaagaa

SEQ ID NO: 2636871 - RNA, 14 nt, Human
uuuuaaaagaauga

SEQ ID NO: 2636872 - RNA, 15 nt, Human
uuuuaaaagaaugau

SEQ ID NO: 2636873 - RNA, 13 nt, Human
uuugcucauggaa

SEQ ID NO: 2636874 - RNA, 11 nt, Human
uuugcucaugg

SEQ ID NO: 2636875 - RNA, 12 nt, Human
uuugcucaugga

SEQ ID NO: 2636876 - RNA, 15 nt, Human
auggcuauaggugcu

SEQ ID NO: 2636877 - RNA, 15 nt, Human
auaaauaguuuauga

SEQ ID NO: 2636878 - RNA, 14 nt, Human
auaaauaaaaauaa

SEQ ID NO: 2636879 - RNA, 13 nt, Human
auaaauaaaaaua

SEQ ID NO: 2636880 - RNA, 22 nt, Human
auaacgauaaaagacagugaaa

SEQ ID NO: 2636881 - RNA, 18 nt, Human
auaauccuaaacauauga

SEQ ID NO: 2636882 - RNA, 14 nt, Human
uuagggagagaaga

SEQ ID NO: 2636883 - RNA, 14 nt, Human
aguuuaaauuguaa

SEQ ID NO: 2636884 - RNA, 13 nt, Human
uguuucaaacaua

SEQ ID NO: 2636885 - RNA, 20 nt, Human
uuaagaagacugcauuauau

SEQ ID NO: 2636886 - RNA, 12 nt, Human
auaaaauaauuu

SEQ ID NO: 2636887 - RNA, 15 nt, Human
auaaaauaauuuuua

SEQ ID NO: 2636888 - RNA, 18 nt, Human
aguuuucugagaaagacu

SEQ ID NO: 2636889 - RNA, 19 nt, Human
aguuuucugagaaagacua

SEQ ID NO: 2636890 - RNA, 23 nt, Human
aguuuucugagaaagacuauuca

SEQ ID NO: 2636891 - RNA, 19 nt, Human
aguucggugagcuacaaau

SEQ ID NO: 2636892 - RNA, 23 nt, Human
aguguuggagaagaacugaaauc

SEQ ID NO: 2636893 - RNA, 17 nt, Human
aguguuggagaagaacu

SEQ ID NO: 2636894 - RNA, 18 nt, Human
aguguuggagaagaacug

SEQ ID NO: 2636895 - RNA, 14 nt, Human
aguguuggagaaga

SEQ ID NO: 2636896 - RNA, 16 nt, Human
aguguuggagaagaac

SEQ ID NO: 2636897 - RNA, 22 nt, Human
agugcaaauugucacaggacag

SEQ ID NO: 2636898 - RNA, 18 nt, Human
agugcaaauugucacagg

SEQ ID NO: 2636899 - RNA, 21 nt, Human
agugcaaauugucacaggaca

SEQ ID NO: 2636900 - RNA, 21 nt, Human
agugccuguaaucacagcuac

SEQ ID NO: 2636901 - RNA, 23 nt, Human
agucagacuggauaguccgucuc

SEQ ID NO: 2636902 - RNA, 16 nt, Human
agucaggaaagagaac

SEQ ID NO: 2636903 - RNA, 15 nt, Human
agucaggaaagagaa

SEQ ID NO: 2636904 - RNA, 21 nt, Human
ugucaauaaaauccauacauu

SEQ ID NO: 2636905 - RNA, 20 nt, Human
ugucaaucagccuaguugau

SEQ ID NO: 2636906 - RNA, 23 nt, Human
ugucauuugcuggagcucugccc

SEQ ID NO: 2636907 - RNA, 22 nt, Human
aguauuucuaugaaauauuaug

SEQ ID NO: 2636908 - RNA, 13 nt, Human
aguauuucuauga

SEQ ID NO: 2636909 - RNA, 15 nt, Human
aguauuucuaugaaa

SEQ ID NO: 2636910 - RNA, 18 nt, Human
uguagaggagaaacugga

SEQ ID NO: 2636911 - RNA, 15 nt, Human
aguaaaaccacagca

SEQ ID NO: 2636912 - RNA, 19 nt, Human
aguagauaggccaugggca

SEQ ID NO: 2636913 - RNA, 17 nt, Human
agggcagggacaggaua

SEQ ID NO: 2636914 - RNA, 20 nt, Human
ugguaaggggaauugaggac

SEQ ID NO: 2636915 - RNA, 23 nt, Human
agguacuucaaauccuugaagau

SEQ ID NO: 2636916 - RNA, 17 nt, Human
aggguuaugauuaagua

SEQ ID NO: 2636917 - RNA, 22 nt, Human
agcugcccucuccugggcagcu

SEQ ID NO: 2636918 - RNA, 15 nt, Human
agcugccuccccucc

SEQ ID NO: 2636919 - RNA, 17 nt, Human
agcugccuccccuccuc

SEQ ID NO: 2636920 - RNA, 16 nt, Human
agcugccuccccuccu

SEQ ID NO: 2636921 - RNA, 19 nt, Human
agcuguucacagccagacu

SEQ ID NO: 2636922 - RNA, 16 nt, Human
agcuguucacagccag

SEQ ID NO: 2636923 - RNA, 17 nt, Human
agcuugaaacugagaug

SEQ ID NO: 2636924 - RNA, 20 nt, Human
ugcuacaaaaacacagcaag

SEQ ID NO: 2636925 - RNA, 19 nt, Human
ugcuacaaaaacacagcaa

SEQ ID NO: 2636926 - RNA, 18 nt, Human
ugcuacaaaaacacagca

SEQ ID NO: 2636927 - RNA, 17 nt, Human
ugcuacaaaaacacagc

SEQ ID NO: 2636928 - RNA, 16 nt, Human
ugcuacaaaaacacag

SEQ ID NO: 2636929 - RNA, 14 nt, Human
ugcucauggaauug

SEQ ID NO: 2636930 - RNA, 13 nt, Human
aggaaauauuuau

SEQ ID NO: 2636931 - RNA, 23 nt, Human
aggaaaucaaauaugcaaagcac

SEQ ID NO: 2636932 - RNA, 12 nt, Human
aggaaauauuua

SEQ ID NO: 2636933 - RNA, 23 nt, Human
ugcuguauuuuaaaagaaugauu

SEQ ID NO: 2636934 - RNA, 17 nt, Human
aggacacugauaugggu

SEQ ID NO: 2636935 - RNA, 13 nt, Human
ugcuguauuuuaa

SEQ ID NO: 2636936 - RNA, 21 nt, Human
ugcuguauuuuaaaagaauga

SEQ ID NO: 2636937 - RNA, 22 nt, Human
ugcuguauuuuaaaagaaugau

SEQ ID NO: 2636938 - RNA, 14 nt, Human
uggagcucguggaa

SEQ ID NO: 2636939 - RNA, 13 nt, Human
uggagaagaacug

SEQ ID NO: 2636940 - RNA, 14 nt, Human
uggagaagaacuga

SEQ ID NO: 2636941 - RNA, 14 nt, Human
uggccuucggccuc

SEQ ID NO: 2636942 - RNA, 18 nt, Human
uggcacaguuuucugaga

SEQ ID NO: 2636943 - RNA, 19 nt, Human
uggcacaguuuucugagaa

SEQ ID NO: 2636944 - RNA, 18 nt, Human
agcccauggcacucuaug

SEQ ID NO: 2636945 - RNA, 15 nt, Human
agccucauguccacu

SEQ ID NO: 2636946 - RNA, 20 nt, Human
agccucauguccacugguuc

SEQ ID NO: 2636947 - RNA, 22 nt, Human
agccugaaagaggaaugaagua

SEQ ID NO: 2636948 - RNA, 20 nt, Human
agccuuggggcugaugcagu

SEQ ID NO: 2636949 - RNA, 19 nt, Human
agcuacuaauuuuaaaaug

SEQ ID NO: 2636950 - RNA, 17 nt, Human
agcuacuugggaggcug

SEQ ID NO: 2636951 - RNA, 18 nt, Human
agcuacuugggaggcuga

SEQ ID NO: 2636952 - RNA, 17 nt, Human
ugaugaagaaguugaua

SEQ ID NO: 2636953 - RNA, 14 nt, Human
ugauuaccagggac

SEQ ID NO: 2636954 - RNA, 12 nt, Human
ugauuaaaccaa

SEQ ID NO: 2636955 - RNA, 14 nt, Human
ugaugaucuuuaaa

SEQ ID NO: 2636956 - RNA, 17 nt, Human
ugaugaucuuuaaaaua

SEQ ID NO: 2636957 - RNA, 19 nt, Human
agccagacuggcacaguuu

SEQ ID NO: 2636958 - RNA, 14 nt, Human
agccagacuggcac

SEQ ID NO: 2636959 - RNA, 18 nt, Human
ugagugucuuaauuaaaa

SEQ ID NO: 2636960 - RNA, 23 nt, Human
agcauaaauguugacaugggaca

SEQ ID NO: 2636961 - RNA, 22 nt, Human
ugaguaacugauuuguaacaag

SEQ ID NO: 2636962 - RNA, 18 nt, Human
agcauuguaaaugugcuu

SEQ ID NO: 2636963 - RNA, 17 nt, Human
agcauuguaaaugugcu

SEQ ID NO: 2636964 - RNA, 20 nt, Human
agcaugucgucaaagcugaa

SEQ ID NO: 2636965 - RNA, 17 nt, Human
agcaugucgucaaagcu

SEQ ID NO: 2636966 - RNA, 12 nt, Human
ugauaugggucu

SEQ ID NO: 2636967 - RNA, 16 nt, Human
agaugcaguucugaag

SEQ ID NO: 2636968 - RNA, 16 nt, Human
ugacacuuaaaaaugg

SEQ ID NO: 2636969 - RNA, 17 nt, Human
ugacacuuaaaaauggu

SEQ ID NO: 2636970 - RNA, 15 nt, Human
agauucccugagcag

SEQ ID NO: 2636971 - RNA, 24 nt, Human
ugacuucuaaguaaaaccacagca

SEQ ID NO: 2636972 - RNA, 15 nt, Human
ugacuucuaaguaaa

SEQ ID NO: 2636973 - RNA, 23 nt, Human
ugacuucuaaguaaaaccacagc

SEQ ID NO: 2636974 - RNA, 22 nt, Human
ugacuucuaaguaaaaccacag

SEQ ID NO: 2636975 - RNA, 23 nt, Human
agcaacgcaggcccccaggugcc

SEQ ID NO: 2636976 - RNA, 15 nt, Human
ugaauacuuuauaaa

SEQ ID NO: 2636977 - RNA, 21 nt, Human
agacauagaauuaacacauga

SEQ ID NO: 2636978 - RNA, 14 nt, Human
agacauagaauuaa

SEQ ID NO: 2636979 - RNA, 18 nt, Human
agacaucaacagauaaau

SEQ ID NO: 2636980 - RNA, 17 nt, Human
agacaucaacagauaaa

SEQ ID NO: 2636981 - RNA, 14 nt, Human
agaaucacuugaac

SEQ ID NO: 2636982 - RNA, 15 nt, Human
ucuucacaacagauu

SEQ ID NO: 2636983 - RNA, 14 nt, Human
agacuauucaaaca

SEQ ID NO: 2636984 - RNA, 12 nt, Human
agacuauucaaa

SEQ ID NO: 2636985 - RNA, 15 nt, Human
agacuauucaaacag

SEQ ID NO: 2636986 - RNA, 16 nt, Human
agacuauucaaacagu

SEQ ID NO: 2636987 - RNA, 21 nt, Human
agagcaguuugguuucuagca

SEQ ID NO: 2636988 - RNA, 23 nt, Human
agagcaguuugguuucuagcaug

SEQ ID NO: 2636989 - RNA, 22 nt, Human
ugaaaaaguucugcagauaaac

SEQ ID NO: 2636990 - RNA, 20 nt, Human
ugaaaagcuccauuuuuagu

SEQ ID NO: 2636991 - RNA, 22 nt, Human
ugaaacugagaugugaacacau

SEQ ID NO: 2636992 - RNA, 19 nt, Human
ugaaacucguuaauuugua

SEQ ID NO: 2636993 - RNA, 13 nt, Human
agaaguugauaug

SEQ ID NO: 2636994 - RNA, 10 nt, Human
ucuggccuuc

SEQ ID NO: 2636995 - RNA, 19 nt, Human
agaagcaccaaucaugaau

SEQ ID NO: 2636996 - RNA, 19 nt, Human
agaagcaacccaaauguuc

SEQ ID NO: 2636997 - RNA, 20 nt, Human
ucugcccauccugccccuga

SEQ ID NO: 2636998 - RNA, 17 nt, Human
agaacucccuuucaaca

SEQ ID NO: 2636999 - RNA, 16 nt, Human
agaacucccuuucaac

SEQ ID NO: 2637000 - RNA, 15 nt, Human
agaacucccuuucaa

SEQ ID NO: 2637001 - RNA, 23 nt, Human
agaaacuuaagguuaccuuuguu

SEQ ID NO: 2637002 - RNA, 15 nt, Human
agaaacauuugguaa

SEQ ID NO: 2637003 - RNA, 16 nt, Human
agaaaacaaggaugaa

SEQ ID NO: 2637004 - RNA, 16 nt, Human
agaaacacaacuauau

SEQ ID NO: 2637005 - RNA, 16 nt, Human
agaaagacuauucaaa

SEQ ID NO: 2637006 - RNA, 18 nt, Human
agaaagcagaacagugau

SEQ ID NO: 2637007 - RNA, 17 nt, Human
agaaagcagaacaguga

SEQ ID NO: 2637008 - RNA, 20 nt, Human
agaaagcagaacagugauua

SEQ ID NO: 2637009 - RNA, 21 nt, Human
acuugaacccgggaggcagag

SEQ ID NO: 2637010 - RNA, 23 nt, Human
acuugaacccgggaggcagaggu

SEQ ID NO: 2637011 - RNA, 21 nt, Human
acuucuaaguaaaaccacagc

SEQ ID NO: 2637012 - RNA, 13 nt, Human
acuucuaaguaaa

SEQ ID NO: 2637013 - RNA, 19 nt, Human
acuucuaaguaaaaccaca

SEQ ID NO: 2637014 - RNA, 18 nt, Human
acuucuaaguaaaaccac

SEQ ID NO: 2637015 - RNA, 17 nt, Human
ucucaaaacugcacugu

SEQ ID NO: 2637016 - RNA, 13 nt, Human
ucuauaauuuaaa

SEQ ID NO: 2637017 - RNA, 12 nt, Human
ucuagcaugaag

SEQ ID NO: 2637018 - RNA, 20 nt, Human
acuuccagauccuggaaauc

SEQ ID NO: 2637019 - RNA, 23 nt, Human
acugucagcuccccucggagaag

SEQ ID NO: 2637020 - RNA, 22 nt, Human
acugucagcuccccucggagaa

SEQ ID NO: 2637021 - RNA, 22 nt, Human
acugaagaagcaccaaucauga

SEQ ID NO: 2637022 - RNA, 17 nt, Human
ucuaccaaaaaucucaa

SEQ ID NO: 2637023 - RNA, 13 nt, Human
acuguggguagac

SEQ ID NO: 2637024 - RNA, 13 nt, Human
ucagagcugcccu

SEQ ID NO: 2637025 - RNA, 14 nt, Human
ucagagcugcccuc

SEQ ID NO: 2637026 - RNA, 18 nt, Human
ucagagcugcccucuccu

SEQ ID NO: 2637027 - RNA, 17 nt, Human
ucagagcugcccucucc

SEQ ID NO: 2637028 - RNA, 15 nt, Human
ucagagcugcccucu

SEQ ID NO: 2637029 - RNA, 16 nt, Human
ucagagcugcccucuc

SEQ ID NO: 2637030 - RNA, 12 nt, Human
ucagcccucaga

SEQ ID NO: 2637031 - RNA, 13 nt, Human
ucagcccucagaa

SEQ ID NO: 2637032 - RNA, 20 nt, Human
acccaaauguucaucaauga

SEQ ID NO: 2637033 - RNA, 16 nt, Human
acccaaauguucauca

SEQ ID NO: 2637034 - RNA, 13 nt, Human
ucaguagucagac

SEQ ID NO: 2637035 - RNA, 13 nt, Human
ucaaacagucuca

SEQ ID NO: 2637036 - RNA, 21 nt, Human
ucaaacagucucaggaaauca

SEQ ID NO: 2637037 - RNA, 20 nt, Human
ucaaacagucucaggaaauc

SEQ ID NO: 2637038 - RNA, 18 nt, Human
uauuuuaaaagaaugauu

SEQ ID NO: 2637039 - RNA, 14 nt, Human
uauuuuaaaagaau

SEQ ID NO: 2637040 - RNA, 22 nt, Human
uauuuuaauaauguuucaaaca

SEQ ID NO: 2637041 - RNA, 19 nt, Human
uauuuuaauaauguuucaa

SEQ ID NO: 2637042 - RNA, 23 nt, Human
ucaauauuucagauaaucacaau

SEQ ID NO: 2637043 - RNA, 19 nt, Human
accaacacgagcaggcuac

SEQ ID NO: 2637044 - RNA, 14 nt, Human
accaacacgagcag

SEQ ID NO: 2637045 - RNA, 16 nt, Human
accacaagacugcaca

SEQ ID NO: 2637046 - RNA, 22 nt, Human
ucacagcuuauuuccucauuuu

SEQ ID NO: 2637047 - RNA, 23 nt, Human
ucacagccagacuggcacaguuu

SEQ ID NO: 2637048 - RNA, 17 nt, Human
ucacagccagacuggca

SEQ ID NO: 2637049 - RNA, 13 nt, Human
ucaauuuaaaaaa

SEQ ID NO: 2637050 - RNA, 12 nt, Human
ucaauuuaaaaa

SEQ ID NO: 2637051 - RNA, 16 nt, Human
ucacagaccuuugaac

SEQ ID NO: 2637052 - RNA, 16 nt, Human
ucauaauaaguugcau

SEQ ID NO: 2637053 - RNA, 17 nt, Human
accugagccccaaaagg

SEQ ID NO: 2637054 - RNA, 12 nt, Human
accugagcccca

SEQ ID NO: 2637055 - RNA, 16 nt, Human
acgcucucuggccuuc

SEQ ID NO: 2637056 - RNA, 15 nt, Human
acgcucucuggccuu

SEQ ID NO: 2637057 - RNA, 17 nt, Human
acgcucucuggccuucg

SEQ ID NO: 2637058 - RNA, 22 nt, Human
uccaugaagauguagaggagaa

SEQ ID NO: 2637059 - RNA, 11 nt, Human
uccauccugag

SEQ ID NO: 2637060 - RNA, 14 nt, Human
uccagugagacagc

SEQ ID NO: 2637061 - RNA, 14 nt, Human
acuccagaaaguga

SEQ ID NO: 2637062 - RNA, 18 nt, Human
acuccagaaagugacaag

SEQ ID NO: 2637063 - RNA, 21 nt, Human
uccugaaaacccuugccaugu

SEQ ID NO: 2637064 - RNA, 22 nt, Human
uccugaaaacccuugccaugug

SEQ ID NO: 2637065 - RNA, 17 nt, Human
uccucuccccaugaugu

SEQ ID NO: 2637066 - RNA, 21 nt, Human
acuccaaacugacucuuaaga

SEQ ID NO: 2637067 - RNA, 19 nt, Human
ucccuccaccucccugcaa

SEQ ID NO: 2637068 - RNA, 14 nt, Human
ucccuccaccuccc

SEQ ID NO: 2637069 - RNA, 15 nt, Human
ucccuccaccucccu

SEQ ID NO: 2637070 - RNA, 17 nt, Human
ucccuccaccucccugc

SEQ ID NO: 2637071 - RNA, 14 nt, Human
uccccuccucugcu

SEQ ID NO: 2637072 - RNA, 15 nt, Human
uccccuccucugcuu

SEQ ID NO: 2637073 - RNA, 18 nt, Human
uccccuccucugcuugcc

SEQ ID NO: 2637074 - RNA, 24 nt, Human
uccccuccucugcuugccaucccu

SEQ ID NO: 2637075 - RNA, 18 nt, Human
acuauucaaacagucuca

SEQ ID NO: 2637076 - RNA, 16 nt, Human
acuauucaaacagucu

SEQ ID NO: 2637077 - RNA, 14 nt, Human
acuauucaaacagu

SEQ ID NO: 2637078 - RNA, 13 nt, Human
acuauucaaacag

SEQ ID NO: 2637079 - RNA, 20 nt, Human
acuagaguuuagcuggaaaa

SEQ ID NO: 2637080 - RNA, 16 nt, Human
uagaacucccuuucaa

SEQ ID NO: 2637081 - RNA, 18 nt, Human
uagaacucccuuucaaca

SEQ ID NO: 2637082 - RNA, 17 nt, Human
uagaacucccuuucaac

SEQ ID NO: 2637083 - RNA, 15 nt, Human
uagaaacacaacuau

SEQ ID NO: 2637084 - RNA, 13 nt, Human
uagacacacauga

SEQ ID NO: 2637085 - RNA, 14 nt, Human
uagaggguguguaa

SEQ ID NO: 2637086 - RNA, 15 nt, Human
acaaaaacacagcaa

SEQ ID NO: 2637087 - RNA, 14 nt, Human
acaaaaacacagca

SEQ ID NO: 2637088 - RNA, 13 nt, Human
acaaaaacacagc

SEQ ID NO: 2637089 - RNA, 13 nt, Human
acacaacuauauu

SEQ ID NO: 2637090 - RNA, 13 nt, Human
uaggauguugaaa

SEQ ID NO: 2637091 - RNA, 12 nt, Human
uauaggaauuga

SEQ ID NO: 2637092 - RNA, 16 nt, Human
uauaggugcuacaaaa

SEQ ID NO: 2637093 - RNA, 17 nt, Human
acacucaaaucaagaaa

SEQ ID NO: 2637094 - RNA, 18 nt, Human
acacucaaaucaagaaac

SEQ ID NO: 2637095 - RNA, 13 nt, Human
acacucaaaucaa

SEQ ID NO: 2637096 - RNA, 14 nt, Human
uaucacaaaucuua

SEQ ID NO: 2637097 - RNA, 20 nt, Human
uaucacaaaucuuaacuuga

SEQ ID NO: 2637098 - RNA, 16 nt, Human
uaucacaaaucuuaac

SEQ ID NO: 2637099 - RNA, 14 nt, Human
acagaccuuugaac

SEQ ID NO: 2637100 - RNA, 19 nt, Human
acagaaagcagaacaguga

SEQ ID NO: 2637101 - RNA, 15 nt, Human
uaugccccauucaac

SEQ ID NO: 2637102 - RNA, 18 nt, Human
acagcaagggugauggga

SEQ ID NO: 2637103 - RNA, 19 nt, Human
acagcccuucuuuccacag

SEQ ID NO: 2637104 - RNA, 14 nt, Human
acagcuguaugauu

SEQ ID NO: 2637105 - RNA, 19 nt, Human
acagcuguaugauucccag

SEQ ID NO: 2637106 - RNA, 20 nt, Human
acagcuguaugauucccagc

SEQ ID NO: 2637107 - RNA, 23 nt, Human
acagcuguaugauucccagccag

SEQ ID NO: 2637108 - RNA, 22 nt, Human
acaggaaccacaagacugcaca

SEQ ID NO: 2637109 - RNA, 16 nt, Human
uaccaugccauuuaaa

SEQ ID NO: 2637110 - RNA, 19 nt, Human
uaccagggacugaggggag

SEQ ID NO: 2637111 - RNA, 13 nt, Human
aauguucaucaau

SEQ ID NO: 2637112 - RNA, 20 nt, Human
aauguucaucaaugaaugaa

SEQ ID NO: 2637113 - RNA, 16 nt, Human
aauguucaucaaugaa

SEQ ID NO: 2637114 - RNA, 14 nt, Human
aauuacauuuguau

SEQ ID NO: 2637115 - RNA, 13 nt, Human
aauuacauuugua

SEQ ID NO: 2637116 - RNA, 22 nt, Human
aaugcuguauuuuaaaagaaug

SEQ ID NO: 2637117 - RNA, 20 nt, Human
aaugcuguauuuuaaaagaa

SEQ ID NO: 2637118 - RNA, 21 nt, Human
aaugcuguauuuuaaaagaau

SEQ ID NO: 2637119 - RNA, 21 nt, Human
uacaaaaaaaaaaaaaaauua

SEQ ID NO: 2637120 - RNA, 17 nt, Human
uacagagacagaaagca

SEQ ID NO: 2637121 - RNA, 20 nt, Human
aauguaagggaaacugccag

SEQ ID NO: 2637122 - RNA, 16 nt, Human
aaugauuucauucaau

SEQ ID NO: 2637123 - RNA, 18 nt, Human
uaauuuuuauauuugaaa

SEQ ID NO: 2637124 - RNA, 19 nt, Human
uaauuuuuauauuugaaau

SEQ ID NO: 2637125 - RNA, 21 nt, Human
uaauuuuuauauuugaaauau

SEQ ID NO: 2637126 - RNA, 22 nt, Human
uaauuccguagguuauuuucag

SEQ ID NO: 2637127 - RNA, 22 nt, Human
aaugagagacacacugaagaag

SEQ ID NO: 2637128 - RNA, 20 nt, Human
aauccucaguuuuugugaaa

SEQ ID NO: 2637129 - RNA, 20 nt, Human
uaaguaaugauaacuggaaa

SEQ ID NO: 2637130 - RNA, 19 nt, Human
uaaguaaaaccacagcagu

SEQ ID NO: 2637131 - RNA, 18 nt, Human
uaaguaaaaccacagcag

SEQ ID NO: 2637132 - RNA, 17 nt, Human
uaaguaaaaccacagca

SEQ ID NO: 2637133 - RNA, 16 nt, Human
uaaguaaaaccacagc

SEQ ID NO: 2637134 - RNA, 18 nt, Human
uaagguuaccuuuguucc

SEQ ID NO: 2637135 - RNA, 15 nt, Human
uaaguaaaaccacag

SEQ ID NO: 2637136 - RNA, 13 nt, Human
uaaguaaaaccac

SEQ ID NO: 2637137 - RNA, 15 nt, Human
aauauuuauuuuaau

SEQ ID NO: 2637138 - RNA, 16 nt, Human
aaucagccuaguugau

SEQ ID NO: 2637139 - RNA, 14 nt, Human
uaagcaaaauguga

SEQ ID NO: 2637140 - RNA, 21 nt, Human
uaagcaaaaugugauauguac

SEQ ID NO: 2637141 - RNA, 15 nt, Human
uaagcaaaaugugau

SEQ ID NO: 2637142 - RNA, 21 nt, Human
uaacuuccuuggacucauuuu

SEQ ID NO: 2637143 - RNA, 13 nt, Human
uaagaagugaaaa

SEQ ID NO: 2637144 - RNA, 19 nt, Human
aauagucaaauugugugaa

SEQ ID NO: 2637145 - RNA, 13 nt, Human
uaacaaugcugua

SEQ ID NO: 2637146 - RNA, 18 nt, Human
aauaccaugccauuuaaa

SEQ ID NO: 2637147 - RNA, 23 nt, Human
aauaccacaggaaccacaagacu

SEQ ID NO: 2637148 - RNA, 23 nt, Human
aauacaucccuuaccugggaaag

SEQ ID NO: 2637149 - RNA, 20 nt, Human
guuauuauauuuacaaaugg

SEQ ID NO: 2637150 - RNA, 20 nt, Human
aagcucacagaccuuugaac

SEQ ID NO: 2637151 - RNA, 13 nt, Human
aagcuccagguag

SEQ ID NO: 2637152 - RNA, 14 nt, Human
aagcuccagguaga

SEQ ID NO: 2637153 - RNA, 16 nt, Human
aagcauuuagauguau

SEQ ID NO: 2637154 - RNA, 13 nt, Human
aagcauuguaaau

SEQ ID NO: 2637155 - RNA, 23 nt, Human
aagaggaaugaaguacucauaca

SEQ ID NO: 2637156 - RNA, 16 nt, Human
aagacugcacaucaaa

SEQ ID NO: 2637157 - RNA, 17 nt, Human
aagacugcauuauauuu

SEQ ID NO: 2637158 - RNA, 13 nt, Human
aagauguagagga

SEQ ID NO: 2637159 - RNA, 14 nt, Human
aagaugaaaauauu

SEQ ID NO: 2637160 - RNA, 13 nt, Human
aagaugaaaauau

SEQ ID NO: 2637161 - RNA, 20 nt, Human
uaaaauaauuuuuauauuug

SEQ ID NO: 2637162 - RNA, 20 nt, Human
uaaaagacagugaaagaaaa

SEQ ID NO: 2637163 - RNA, 16 nt, Human
uaaaagaauauuuuaa

SEQ ID NO: 2637164 - RNA, 12 nt, Human
uaaaagaaugau

SEQ ID NO: 2637165 - RNA, 23 nt, Human
uaaaagaauauuuuaacuuccuu

SEQ ID NO: 2637166 - RNA, 22 nt, Human
aagucuuauauauuguagauaa

SEQ ID NO: 2637167 - RNA, 16 nt, Human
aagucuuucacauuua

SEQ ID NO: 2637168 - RNA, 14 nt, Human
aaguaaugauaacu

SEQ ID NO: 2637169 - RNA, 19 nt, Human
aaguaaugauaacuggaaa

SEQ ID NO: 2637170 - RNA, 13 nt, Human
aaguauuagaaua

SEQ ID NO: 2637171 - RNA, 14 nt, Human
aagguacuucaaau

SEQ ID NO: 2637172 - RNA, 19 nt, Human
aagggugaugggaaagcau

SEQ ID NO: 2637173 - RNA, 22 nt, Human
aacagugauuaccagggacuga

SEQ ID NO: 2637174 - RNA, 15 nt, Human
aacagugauuaccag

SEQ ID NO: 2637175 - RNA, 16 nt, Human
aacagauaaauaguuu

SEQ ID NO: 2637176 - RNA, 15 nt, Human
aacacagcaagggug

SEQ ID NO: 2637177 - RNA, 15 nt, Human
aacacaacuauauug

SEQ ID NO: 2637178 - RNA, 16 nt, Human
aacacaacuauauugu

SEQ ID NO: 2637179 - RNA, 17 nt, Human
aacaaugcuguauuuua

SEQ ID NO: 2637180 - RNA, 22 nt, Human
aacaaugcuguauuuuaaaaga

SEQ ID NO: 2637181 - RNA, 12 nt, Human
aacaauaaaaga

SEQ ID NO: 2637182 - RNA, 14 nt, Human
aacaaugcuguauu

SEQ ID NO: 2637183 - RNA, 15 nt, Human
aacaaugcuguauuu

SEQ ID NO: 2637184 - RNA, 20 nt, Human
aaauuuuuucucuaggaaau

SEQ ID NO: 2637185 - RNA, 18 nt, Human
guauguacuucaugcugu

SEQ ID NO: 2637186 - RNA, 16 nt, Human
gucaaauugugugaaa

SEQ ID NO: 2637187 - RNA, 15 nt, Human
guauaaaauaauuuu

SEQ ID NO: 2637188 - RNA, 21 nt, Human
guauaaaauaauuuuuauauu

SEQ ID NO: 2637189 - RNA, 16 nt, Human
guauauuuuauaucaa

SEQ ID NO: 2637190 - RNA, 17 nt, Human
guaguguuggagaagaa

SEQ ID NO: 2637191 - RNA, 16 nt, Human
aaauguaagggaaacu

SEQ ID NO: 2637192 - RNA, 20 nt, Human
guaguguuggagaagaacug

SEQ ID NO: 2637193 - RNA, 14 nt, Human
aaauggguuuuacu

SEQ ID NO: 2637194 - RNA, 15 nt, Human
aaauggguuuuacug

SEQ ID NO: 2637195 - RNA, 21 nt, Human
aacuagaguuuagcuggaaaa

SEQ ID NO: 2637196 - RNA, 18 nt, Human
aaccuugaaaacuuuaug

SEQ ID NO: 2637197 - RNA, 12 nt, Human
aacucauuucua

SEQ ID NO: 2637198 - RNA, 20 nt, Human
aaccugagccccaaaaggua

SEQ ID NO: 2637199 - RNA, 16 nt, Human
gucuuucacauuuaaa

SEQ ID NO: 2637200 - RNA, 18 nt, Human
aacccaaguccaagcaua

SEQ ID NO: 2637201 - RNA, 23 nt, Human
aacccaaauguucaucaaugaau

SEQ ID NO: 2637202 - RNA, 18 nt, Human
aaccugagccccaaaagg

SEQ ID NO: 2637203 - RNA, 16 nt, Human
aacccgggaggcagag

SEQ ID NO: 2637204 - RNA, 21 nt, Human
gugagaugcuagaacucccuu

SEQ ID NO: 2637205 - RNA, 12 nt, Human
aacugaaaucau

SEQ ID NO: 2637206 - RNA, 19 nt, Human
aacugcacugucaagauga

SEQ ID NO: 2637207 - RNA, 19 nt, Human
aacuggacugguucaaaug

SEQ ID NO: 2637208 - RNA, 17 nt, Human
aacugggacaggggaga

SEQ ID NO: 2637209 - RNA, 17 nt, Human
gugaugggaaagcauug

SEQ ID NO: 2637210 - RNA, 21 nt, Human
aacuucagcgguuuauauaag

SEQ ID NO: 2637211 - RNA, 18 nt, Human
aacuuccagauccuggaa

SEQ ID NO: 2637212 - RNA, 18 nt, Human
cacaagaaaugaaagcag

SEQ ID NO: 2637213 - RNA, 21 nt, Human
cacaagaaaugaaagcaggga

SEQ ID NO: 2637214 - RNA, 20 nt, Human
cacaagaaaugaaagcaggg

SEQ ID NO: 2637215 - RNA, 22 nt, Human
caauuuuucuuauuucauuucu

SEQ ID NO: 2637216 - RNA, 21 nt, Human
caauaucuuuuuuuuaauaaa

SEQ ID NO: 2637217 - RNA, 18 nt, Human
cacagccagacuggcaca

SEQ ID NO: 2637218 - RNA, 17 nt, Human
cacagccagacuggcac

SEQ ID NO: 2637219 - RNA, 19 nt, Human
cacagcaguugaaaagacu

SEQ ID NO: 2637220 - RNA, 21 nt, Human
cacagcaguugaaaagacucc

SEQ ID NO: 2637221 - RNA, 13 nt, Human
cacacugaagaag

SEQ ID NO: 2637222 - RNA, 18 nt, Human
caaggaaaaaauaacaau

SEQ ID NO: 2637223 - RNA, 20 nt, Human
caaggaaaaaauaacaauga

SEQ ID NO: 2637224 - RNA, 17 nt, Human
caauagucaaauugugu

SEQ ID NO: 2637225 - RNA, 19 nt, Human
caauagucaaauuguguga

SEQ ID NO: 2637226 - RNA, 21 nt, Human
caagggugaugggaaagcauu

SEQ ID NO: 2637227 - RNA, 23 nt, Human
caagggugaugggaaagcauugu

SEQ ID NO: 2637228 - RNA, 18 nt, Human
caaauguucaucaaugaa

SEQ ID NO: 2637229 - RNA, 14 nt, Human
caaauguucaucaa

SEQ ID NO: 2637230 - RNA, 12 nt, Human
caaauaugcaaa

SEQ ID NO: 2637231 - RNA, 13 nt, Human
caaauaugcaaag

SEQ ID NO: 2637232 - RNA, 15 nt, Human
caagaaaugaaagca

SEQ ID NO: 2637233 - RNA, 19 nt, Human
caagaaaugaaagcaggga

SEQ ID NO: 2637234 - RNA, 17 nt, Human
caagaaaugaaagcagg

SEQ ID NO: 2637235 - RNA, 17 nt, Human
caaacugacucuuaaga

SEQ ID NO: 2637236 - RNA, 21 nt, Human
caaacugacucuuaagaagac

SEQ ID NO: 2637237 - RNA, 16 nt, Human
caaacugacucuuaag

SEQ ID NO: 2637238 - RNA, 14 nt, Human
caaaacugcacugu

SEQ ID NO: 2637239 - RNA, 18 nt, Human
caaaacugcacugucaag

SEQ ID NO: 2637240 - RNA, 17 nt, Human
caaaacugcacugucaa

SEQ ID NO: 2637241 - RNA, 18 nt, Human
uguuuaaaaucauuucug

SEQ ID NO: 2637242 - RNA, 17 nt, Human
uguuuaaaaucauuucu

SEQ ID NO: 2637243 - RNA, 19 nt, Human
uguuggagaagaacugaaa

SEQ ID NO: 2637244 - RNA, 20 nt, Human
uguuggagaagaacugaaau

SEQ ID NO: 2637245 - RNA, 14 nt, Human
uguuggagaagaac

SEQ ID NO: 2637246 - RNA, 16 nt, Human
uguuggagaagaacug

SEQ ID NO: 2637247 - RNA, 17 nt, Human
uguuggagaagaacuga

SEQ ID NO: 2637248 - RNA, 20 nt, Human
uguugacaugggacauuugc

SEQ ID NO: 2637249 - RNA, 21 nt, Human
uguuaaaagaugaaaauauuu

SEQ ID NO: 2637250 - RNA, 21 nt, Human
ugugugaaagguacuucaaau

SEQ ID NO: 2637251 - RNA, 22 nt, Human
ugugugaaagguacuucaaauc

SEQ ID NO: 2637252 - RNA, 20 nt, Human
ugugugaaagguacuucaaa

SEQ ID NO: 2637253 - RNA, 13 nt, Human
uguguuuugcaag

SEQ ID NO: 2637254 - RNA, 19 nt, Human
uguguuuugcaagccagau

SEQ ID NO: 2637255 - RNA, 22 nt, Human
uuaaaaaaaaaccugagcccca

SEQ ID NO: 2637256 - RNA, 18 nt, Human
uuaaaauacacacucaaa

SEQ ID NO: 2637257 - RNA, 20 nt, Human
uuacauuuguauaaaauaau

SEQ ID NO: 2637258 - RNA, 19 nt, Human
ugugcuaguaauuggaaag

SEQ ID NO: 2637259 - RNA, 15 nt, Human
uguaugauucccagc

SEQ ID NO: 2637260 - RNA, 22 nt, Human
uguaguguuggagaagaacuga

SEQ ID NO: 2637261 - RNA, 20 nt, Human
uguaauaaacucauuucuag

SEQ ID NO: 2637262 - RNA, 16 nt, Human
uguaccgcaaugugac

SEQ ID NO: 2637263 - RNA, 15 nt, Human
ugccuucucaacucc

SEQ ID NO: 2637264 - RNA, 18 nt, Human
ugccuguaaucacagcua

SEQ ID NO: 2637265 - RNA, 16 nt, Human
ugcucaguagucagac

SEQ ID NO: 2637266 - RNA, 15 nt, Human
ugcuaagcauuccaa

SEQ ID NO: 2637267 - RNA, 19 nt, Human
ugcuaagcauuccaacuau

SEQ ID NO: 2637268 - RNA, 17 nt, Human
ugcugaaacaacaaaua

SEQ ID NO: 2637269 - RNA, 19 nt, Human
ugcaguucugaagaagaug

SEQ ID NO: 2637270 - RNA, 22 nt, Human
ugcaguucugaagaagauggua

SEQ ID NO: 2637271 - RNA, 15 nt, Human
ugcaguucugaagaa

SEQ ID NO: 2637272 - RNA, 16 nt, Human
ugcaguucugaagaag

SEQ ID NO: 2637273 - RNA, 17 nt, Human
ugcaguucugaagaaga

SEQ ID NO: 2637274 - RNA, 18 nt, Human
ugcaguucugaagaagau

SEQ ID NO: 2637275 - RNA, 19 nt, Human
ugcagugagccgagauugu

SEQ ID NO: 2637276 - RNA, 19 nt, Human
ugcacgcacacugucugcc

SEQ ID NO: 2637277 - RNA, 18 nt, Human
ugccaaauauaaauaaaa

SEQ ID NO: 2637278 - RNA, 17 nt, Human
ugccaaauauaaauaaa

SEQ ID NO: 2637279 - RNA, 22 nt, Human
ugccaaauauaaauaaaaauaa

SEQ ID NO: 2637280 - RNA, 19 nt, Human
ugccaaauauaaauaaaaa

SEQ ID NO: 2637281 - RNA, 20 nt, Human
ugccacuaaauugacacuua

SEQ ID NO: 2637282 - RNA, 14 nt, Human
ugccaucccucccu

SEQ ID NO: 2637283 - RNA, 11 nt, Human
ugccaucccuc

SEQ ID NO: 2637284 - RNA, 12 nt, Human
ugccaucccucc

SEQ ID NO: 2637285 - RNA, 21 nt, Human
uggcuugaguuuaaauuguaa

SEQ ID NO: 2637286 - RNA, 16 nt, Human
uggcuuccuggcaaua

SEQ ID NO: 2637287 - RNA, 14 nt, Human
ugggaguacaaaag

SEQ ID NO: 2637288 - RNA, 21 nt, Human
ugguauguuuucaggcuagau

SEQ ID NO: 2637289 - RNA, 11 nt, Human
uggagggaagc

SEQ ID NO: 2637290 - RNA, 23 nt, Human
uggaaacuucagcgguuuauaua

SEQ ID NO: 2637291 - RNA, 21 nt, Human
uggaacauaaaauacaauguu

SEQ ID NO: 2637292 - RNA, 20 nt, Human
uggaacauaaaauacaaugu

SEQ ID NO: 2637293 - RNA, 22 nt, Human
uggaauaauccuaaacauauga

SEQ ID NO: 2637294 - RNA, 12 nt, Human
ucuacuaaaaau

SEQ ID NO: 2637295 - RNA, 15 nt, Human
ucuacuaaaaauaca

SEQ ID NO: 2637296 - RNA, 19 nt, Human
ucuacuaaaaauacaaaaa

SEQ ID NO: 2637297 - RNA, 17 nt, Human
uccuugcaucaauuuuu

SEQ ID NO: 2637298 - RNA, 14 nt, Human
ucggagcccugucu

SEQ ID NO: 2637299 - RNA, 15 nt, Human
ucggagcccugucuc

SEQ ID NO: 2637300 - RNA, 16 nt, Human
ucggccuccauccuga

SEQ ID NO: 2637301 - RNA, 15 nt, Human
ucggccuccauccug

SEQ ID NO: 2637302 - RNA, 20 nt, Human
uccucaaaacuucagacaua

SEQ ID NO: 2637303 - RNA, 15 nt, Human
uccugaggcuccacu

SEQ ID NO: 2637304 - RNA, 21 nt, Human
uccugaggcuccacuuggucu

SEQ ID NO: 2637305 - RNA, 17 nt, Human
uccugaggcuccacuug

SEQ ID NO: 2637306 - RNA, 16 nt, Human
uccugaggcuccacuu

SEQ ID NO: 2637307 - RNA, 19 nt, Human
uccucugcuugccaucccu

SEQ ID NO: 2637308 - RNA, 14 nt, Human
uccucugcuugcca

SEQ ID NO: 2637309 - RNA, 15 nt, Human
uccucugcuugccau

SEQ ID NO: 2637310 - RNA, 16 nt, Human
uccucugcuugccauc

SEQ ID NO: 2637311 - RNA, 17 nt, Human
uccucugcuugccaucc

SEQ ID NO: 2637312 - RNA, 12 nt, Human
uccauacauuug

SEQ ID NO: 2637313 - RNA, 19 nt, Human
ucauggaauuggagcucgu

SEQ ID NO: 2637314 - RNA, 21 nt, Human
ucauggaauuggagcucgugg

SEQ ID NO: 2637315 - RNA, 18 nt, Human
ucaguccaugaagaugua

SEQ ID NO: 2637316 - RNA, 16 nt, Human
ucagcugcugaaacaa

SEQ ID NO: 2637317 - RNA, 21 nt, Human
ucagcuccccucggagaagag

SEQ ID NO: 2637318 - RNA, 22 nt, Human
ucagcuccccucggagaagagc

SEQ ID NO: 2637319 - RNA, 16 nt, Human
ucuucuuggucucagu

SEQ ID NO: 2637320 - RNA, 19 nt, Human
ucuugccaaauauaaauaa

SEQ ID NO: 2637321 - RNA, 22 nt, Human
ucuuaggguuaugauuaaguaa

SEQ ID NO: 2637322 - RNA, 14 nt, Human
ucuuauaauuuaaa

SEQ ID NO: 2637323 - RNA, 13 nt, Human
ucuuauaauuuaa

SEQ ID NO: 2637324 - RNA, 17 nt, Human
ucuuuccacagaagcuc

SEQ ID NO: 2637325 - RNA, 14 nt, Human
ucugucucagucca

SEQ ID NO: 2637326 - RNA, 20 nt, Human
ugagcaggauuuuaaucuuu

SEQ ID NO: 2637327 - RNA, 15 nt, Human
ugagcaggauuuuaa

SEQ ID NO: 2637328 - RNA, 15 nt, Human
ugagaaagacuauuc

SEQ ID NO: 2637329 - RNA, 13 nt, Human
ugacucuuaagaa

SEQ ID NO: 2637330 - RNA, 16 nt, Human
ugacucuuaagaagac

SEQ ID NO: 2637331 - RNA, 14 nt, Human
ugacucuuaagaag

SEQ ID NO: 2637332 - RNA, 15 nt, Human
ugacucuuaagaaga

SEQ ID NO: 2637333 - RNA, 14 nt, Human
ugaauuaaguuuuu

SEQ ID NO: 2637334 - RNA, 13 nt, Human
ugaauuacauuug

SEQ ID NO: 2637335 - RNA, 14 nt, Human
ugaauuacauuugu

SEQ ID NO: 2637336 - RNA, 18 nt, Human
ugaccacugcagaagaca

SEQ ID NO: 2637337 - RNA, 17 nt, Human
ugaccacugcagaagac

SEQ ID NO: 2637338 - RNA, 16 nt, Human
ugaccacugcagaaga

SEQ ID NO: 2637339 - RNA, 20 nt, Human
ugaaugaauggcuaagcaaa

SEQ ID NO: 2637340 - RNA, 15 nt, Human
ugaaugaauggcuaa

SEQ ID NO: 2637341 - RNA, 14 nt, Human
uacacuccagugag

SEQ ID NO: 2637342 - RNA, 16 nt, Human
uacacacucaaaucaa

SEQ ID NO: 2637343 - RNA, 17 nt, Human
uacacacucaaaucaag

SEQ ID NO: 2637344 - RNA, 13 nt, Human
uaauuuugugaag

SEQ ID NO: 2637345 - RNA, 16 nt, Human
uaauuuuuauauuuga

SEQ ID NO: 2637346 - RNA, 17 nt, Human
uaauuuuuauauuugaa

SEQ ID NO: 2637347 - RNA, 12 nt, Human
uaauuuuuauau

SEQ ID NO: 2637348 - RNA, 18 nt, Human
uaauuuugugaagcaaaa

SEQ ID NO: 2637349 - RNA, 23 nt, Human
uacaguucggugagcuacaaaug

SEQ ID NO: 2637350 - RNA, 23 nt, Human
uacugucagcuccccucggagaa

SEQ ID NO: 2637351 - RNA, 16 nt, Human
uaccuaucaucuuaag

SEQ ID NO: 2637352 - RNA, 22 nt, Human
uaccaaaaaucucaauauuuca

SEQ ID NO: 2637353 - RNA, 22 nt, Human
uaccuaacgaaguauccuucag

SEQ ID NO: 2637354 - RNA, 23 nt, Human
uagaauaccacaggaaccacaag

SEQ ID NO: 2637355 - RNA, 18 nt, Human
uagaauuaacacaugauc

SEQ ID NO: 2637356 - RNA, 16 nt, Human
uagaauuaacacauga

SEQ ID NO: 2637357 - RNA, 15 nt, Human
uagaauuaacacaug

SEQ ID NO: 2637358 - RNA, 16 nt, Human
uagcaugaagacagag

SEQ ID NO: 2637359 - RNA, 14 nt, Human
uagauaggccaugg

SEQ ID NO: 2637360 - RNA, 23 nt, Human
uaggugcuacaaaaacacagcaa

SEQ ID NO: 2637361 - RNA, 22 nt, Human
uaggugcuacaaaaacacagca

SEQ ID NO: 2637362 - RNA, 20 nt, Human
uaggugcuacaaaaacacag

SEQ ID NO: 2637363 - RNA, 17 nt, Human
uaguauuguccaggucu

SEQ ID NO: 2637364 - RNA, 17 nt, Human
uauauaacaaugcugua

SEQ ID NO: 2637365 - RNA, 19 nt, Human
uauauaacaaugcuguauu

SEQ ID NO: 2637366 - RNA, 14 nt, Human
uauaugcuucuguu

SEQ ID NO: 2637367 - RNA, 16 nt, Human
uauaugcuucuguuuu

SEQ ID NO: 2637368 - RNA, 20 nt, Human
uauauuugaaauauugacuu

SEQ ID NO: 2637369 - RNA, 21 nt, Human
uauauuuuuuguuaaaugauu

SEQ ID NO: 2637370 - RNA, 14 nt, Human
uaucaaaagaaaga

SEQ ID NO: 2637371 - RNA, 13 nt, Human
uaagugaaauaag

SEQ ID NO: 2637372 - RNA, 22 nt, Human
uaauguuucaaacauauauaac

SEQ ID NO: 2637373 - RNA, 23 nt, Human
uaaugauaacuggaaacuucagc

SEQ ID NO: 2637374 - RNA, 17 nt, Human
uaaugauaacuggaaac

SEQ ID NO: 2637375 - RNA, 22 nt, Human
uaaugauaacuggaaacuucag

SEQ ID NO: 2637376 - RNA, 14 nt, Human
uaauaauguuucaa

SEQ ID NO: 2637377 - RNA, 17 nt, Human
uaaccaggggccaugaa

SEQ ID NO: 2637378 - RNA, 21 nt, Human
uaagaaaauaucacuugucaa

SEQ ID NO: 2637379 - RNA, 14 nt, Human
uaagagagaaugag

SEQ ID NO: 2637380 - RNA, 23 nt, Human
uaagagagaaugagagacacacu

SEQ ID NO: 2637381 - RNA, 13 nt, Human
uaagagagaauga

SEQ ID NO: 2637382 - RNA, 15 nt, Human
uaacuggaaacuuca

SEQ ID NO: 2637383 - RNA, 20 nt, Human
uaaauugacacuuaaaaaug

SEQ ID NO: 2637384 - RNA, 16 nt, Human
uaaaugugcuuuuaaa

SEQ ID NO: 2637385 - RNA, 16 nt, Human
uaaaugugccuucauu

SEQ ID NO: 2637386 - RNA, 20 nt, Human
uaaauggcuuccuggcaaua

SEQ ID NO: 2637387 - RNA, 14 nt, Human
uaaaguguuugaaa

SEQ ID NO: 2637388 - RNA, 13 nt, Human
uaaaaccacagca

SEQ ID NO: 2637389 - RNA, 13 nt, Human
uaaaaucauuucu

SEQ ID NO: 2637390 - RNA, 10 nt, Human
uaaaaucauu

SEQ ID NO: 2637391 - RNA, 15 nt, Human
uaaaauccauacauu

SEQ ID NO: 2637392 - RNA, 17 nt, Human
uaaaauccauacauuug

SEQ ID NO: 2637393 - RNA, 22 nt, Human
uaaaaucauuucugcaucagcu

SEQ ID NO: 2637394 - RNA, 18 nt, Human
uaaaaucauuucugcauc

SEQ ID NO: 2637395 - RNA, 22 nt, Human
uaaaacaagcacuaaacaaaga

SEQ ID NO: 2637396 - RNA, 19 nt, Human
uaaaaaugguuuaaauggu

SEQ ID NO: 2637397 - RNA, 18 nt, Human
uaaaaaugguuuaaaugg

SEQ ID NO: 2637398 - RNA, 15 nt, Human
uaaaaaugguuuaaa

SEQ ID NO: 2637399 - RNA, 20 nt, Human
guuuauauaagcuuguauuc

SEQ ID NO: 2637400 - RNA, 20 nt, Human
guuuagcuggaaaaguaugu

SEQ ID NO: 2637401 - RNA, 21 nt, Human
guuuagcuggaaaaguauguu

SEQ ID NO: 2637402 - RNA, 16 nt, Human
guucaucaaugaauga

SEQ ID NO: 2637403 - RNA, 13 nt, Human
guucagagcugcc

SEQ ID NO: 2637404 - RNA, 14 nt, Human
guucagagcugccc

SEQ ID NO: 2637405 - RNA, 23 nt, Human
guucagagcugcccucuccuggg

SEQ ID NO: 2637406 - RNA, 20 nt, Human
guucagagcugcccucuccu

SEQ ID NO: 2637407 - RNA, 22 nt, Human
guucagagcugcccucuccugg

SEQ ID NO: 2637408 - RNA, 15 nt, Human
guucagagcugcccu

SEQ ID NO: 2637409 - RNA, 16 nt, Human
guucagagcugcccuc

SEQ ID NO: 2637410 - RNA, 17 nt, Human
guucagagcugcccucu

SEQ ID NO: 2637411 - RNA, 19 nt, Human
guucagagcugcccucucc

SEQ ID NO: 2637412 - RNA, 23 nt, Human
guuaccucugccucagaaaacaa

SEQ ID NO: 2637413 - RNA, 21 nt, Human
guugauggugguauguuuuca

SEQ ID NO: 2637414 - RNA, 20 nt, Human
guugauggugguauguuuuc

SEQ ID NO: 2637415 - RNA, 14 nt, Human
guucugaagaagau

SEQ ID NO: 2637416 - RNA, 15 nt, Human
guucugaagaagaug

SEQ ID NO: 2637417 - RNA, 12 nt, Human
guucugaagaag

SEQ ID NO: 2637418 - RNA, 13 nt, Human
guucugaagaaga

SEQ ID NO: 2637419 - RNA, 23 nt, Human
guugaaaagacuccaaagaaaug

SEQ ID NO: 2637420 - RNA, 22 nt, Human
guugaaaagacuccaaagaaau

SEQ ID NO: 2637421 - RNA, 17 nt, Human
guugaaaagacuccaaa

SEQ ID NO: 2637422 - RNA, 21 nt, Human
gugcuacaaaaacacagcaag

SEQ ID NO: 2637423 - RNA, 20 nt, Human
gugcuacaaaaacacagcaa

SEQ ID NO: 2637424 - RNA, 15 nt, Human
gugcuacaaaaacac

SEQ ID NO: 2637425 - RNA, 21 nt, Human
guguaaguagauaggccaugg

SEQ ID NO: 2637426 - RNA, 16 nt, Human
guuaaaagaugaaaau

SEQ ID NO: 2637427 - RNA, 14 nt, Human
guuaaaagaugaaa

SEQ ID NO: 2637428 - RNA, 20 nt, Human
guuaaaagaugaaaauauuu

SEQ ID NO: 2637429 - RNA, 16 nt, Human
gugugcguccugucgg

SEQ ID NO: 2637430 - RNA, 14 nt, Human
gugugcguccuguc

SEQ ID NO: 2637431 - RNA, 16 nt, Human
gugacaagcucacaga

SEQ ID NO: 2637432 - RNA, 21 nt, Human
gugaacaaauuuacagagaca

SEQ ID NO: 2637433 - RNA, 13 nt, Human
gugaacacaucag

SEQ ID NO: 2637434 - RNA, 13 nt, Human
gugcguccugucg

SEQ ID NO: 2637435 - RNA, 23 nt, Human
gucugugagaugcuagaacuccc

SEQ ID NO: 2637436 - RNA, 22 nt, Human
gucugugagaugcuagaacucc

SEQ ID NO: 2637437 - RNA, 21 nt, Human
gucugugagaugcuagaacuc

SEQ ID NO: 2637438 - RNA, 17 nt, Human
gucugugagaugcuaga

SEQ ID NO: 2637439 - RNA, 16 nt, Human
gucugugagaugcuag

SEQ ID NO: 2637440 - RNA, 15 nt, Human
gucugugagaugcua

SEQ ID NO: 2637441 - RNA, 13 nt, Human
gucugacuguuuc

SEQ ID NO: 2637442 - RNA, 23 nt, Human
gucggguuuuauuguuuaaaauc

SEQ ID NO: 2637443 - RNA, 16 nt, Human
gucggagcccugucuc

SEQ ID NO: 2637444 - RNA, 12 nt, Human
gucggagcccug

SEQ ID NO: 2637445 - RNA, 18 nt, Human
gucgucaaagcugaaaug

SEQ ID NO: 2637446 - RNA, 18 nt, Human
guauuuuaaaagaaugau

SEQ ID NO: 2637447 - RNA, 13 nt, Human
guauuuuaaucac

SEQ ID NO: 2637448 - RNA, 20 nt, Human
guauuuuaaaagaaugauua

SEQ ID NO: 2637449 - RNA, 22 nt, Human
gucaauaaaauccauacauuug

SEQ ID NO: 2637450 - RNA, 23 nt, Human
gucaauaaaauccauacauuugu

SEQ ID NO: 2637451 - RNA, 15 nt, Human
gucaaugcagccccc

SEQ ID NO: 2637452 - RNA, 19 nt, Human
gucagcuccccucggagaa

SEQ ID NO: 2637453 - RNA, 23 nt, Human
gucagcuccccucggagaagagc

SEQ ID NO: 2637454 - RNA, 22 nt, Human
gucagcuccccucggagaagag

SEQ ID NO: 2637455 - RNA, 21 nt, Human
gucagcuccccucggagaaga

SEQ ID NO: 2637456 - RNA, 18 nt, Human
gcuauaggugcuacaaaa

SEQ ID NO: 2637457 - RNA, 14 nt, Human
guaguguuggagaa

SEQ ID NO: 2637458 - RNA, 15 nt, Human
guaguguuggagaag

SEQ ID NO: 2637459 - RNA, 17 nt, Human
guauguuagugcaaauu

SEQ ID NO: 2637460 - RNA, 17 nt, Human
uuucuuauuucauuucu

SEQ ID NO: 2637461 - RNA, 18 nt, Human
uuugaaucaucaagucuu

SEQ ID NO: 2637462 - RNA, 18 nt, Human
uuuccucauuuuuauaau

SEQ ID NO: 2637463 - RNA, 15 nt, Human
uuucugagaaagacu

SEQ ID NO: 2637464 - RNA, 13 nt, Human
uuucugagaaaga

SEQ ID NO: 2637465 - RNA, 20 nt, Human
uuuuaauaauguuucaaaca

SEQ ID NO: 2637466 - RNA, 21 nt, Human
uuuuaaaagaaugauuaugaa

SEQ ID NO: 2637467 - RNA, 13 nt, Human
uuuguauaaaaua

SEQ ID NO: 2637468 - RNA, 14 nt, Human
uuuguauaaaauaa

SEQ ID NO: 2637469 - RNA, 16 nt, Human
uuuguauaaaauaauu

SEQ ID NO: 2637470 - RNA, 13 nt, Human
uuugguuucuagc

SEQ ID NO: 2637471 - RNA, 19 nt, Human
uuuuucucuaggaaauauu

SEQ ID NO: 2637472 - RNA, 18 nt, Human
uuuuuaaaaaagaaacau

SEQ ID NO: 2637473 - RNA, 18 nt, Human
uuuuggucuggagggaag

SEQ ID NO: 2637474 - RNA, 14 nt, Human
uuuuccugaaaacc

SEQ ID NO: 2637475 - RNA, 17 nt, Human
gccuccccuccucugcu

SEQ ID NO: 2637476 - RNA, 19 nt, Human
gccuccccuccucugcuug

SEQ ID NO: 2637477 - RNA, 23 nt, Human
gccuccccuccucugcuugccau

SEQ ID NO: 2637478 - RNA, 20 nt, Human
gccuccccuccucugcuugc

SEQ ID NO: 2637479 - RNA, 22 nt, Human
gccuccccuccucugcuugcca

SEQ ID NO: 2637480 - RNA, 23 nt, Human
gccguggugauuuagcaggaagc

SEQ ID NO: 2637481 - RNA, 22 nt, Human
gccgugugugugcguccugucg

SEQ ID NO: 2637482 - RNA, 20 nt, Human
gccgggcgugguggugagug

SEQ ID NO: 2637483 - RNA, 12 nt, Human
gcgacagugaga

SEQ ID NO: 2637484 - RNA, 19 nt, Human
gcuagaacucccuuucaac

SEQ ID NO: 2637485 - RNA, 13 nt, Human
gcuauaggugcua

SEQ ID NO: 2637486 - RNA, 18 nt, Human
gccaucccucccuccacc

SEQ ID NO: 2637487 - RNA, 23 nt, Human
gccaucccucccuccaccucccu

SEQ ID NO: 2637488 - RNA, 19 nt, Human
gccaugggcacugugggua

SEQ ID NO: 2637489 - RNA, 10 nt, Human
gcaagccaga

SEQ ID NO: 2637490 - RNA, 14 nt, Human
gcaagggugauggg

SEQ ID NO: 2637491 - RNA, 23 nt, Human
gcaaagcacugacuucuaaguaa

SEQ ID NO: 2637492 - RNA, 15 nt, Human
gauuuuccugaaaac

SEQ ID NO: 2637493 - RNA, 11 nt, Human
gauuuucagcc

SEQ ID NO: 2637494 - RNA, 15 nt, Human
gauuuucagcccuca

SEQ ID NO: 2637495 - RNA, 19 nt, Human
gauuuucagcccucagaau

SEQ ID NO: 2637496 - RNA, 21 nt, Human
gauggcuaguaucaaaagaaa

SEQ ID NO: 2637497 - RNA, 14 nt, Human
gaugaaaauauuug

SEQ ID NO: 2637498 - RNA, 13 nt, Human
gauccuggaaauc

SEQ ID NO: 2637499 - RNA, 22 nt, Human
gauaaauaguuuaugauuccac

SEQ ID NO: 2637500 - RNA, 13 nt, Human
gauagcagggcau

SEQ ID NO: 2637501 - RNA, 23 nt, Human
gauagauaggucagugcaaauac

SEQ ID NO: 2637502 - RNA, 17 nt, Human
gcauagguuuaauaauu

SEQ ID NO: 2637503 - RNA, 16 nt, Human
gcaguucagagcugcc

SEQ ID NO: 2637504 - RNA, 15 nt, Human
gcaguucugaagaag

SEQ ID NO: 2637505 - RNA, 17 nt, Human
gcaguucagagcugccc

SEQ ID NO: 2637506 - RNA, 18 nt, Human
gcaguucagagcugcccu

SEQ ID NO: 2637507 - RNA, 17 nt, Human
gcaguucugaagaagau

SEQ ID NO: 2637508 - RNA, 13 nt, Human
gcauagaaguaaa

SEQ ID NO: 2637509 - RNA, 12 nt, Human
gcaucagcugcu

SEQ ID NO: 2637510 - RNA, 13 nt, Human
gcauuauauuuau

SEQ ID NO: 2637511 - RNA, 18 nt, Human
gcagauaaacaguaguga

SEQ ID NO: 2637512 - RNA, 20 nt, Human
gcagccccgugggguuccuc

SEQ ID NO: 2637513 - RNA, 15 nt, Human
gacaagcucacagac

SEQ ID NO: 2637514 - RNA, 14 nt, Human
gacaucaacagaua

SEQ ID NO: 2637515 - RNA, 17 nt, Human
gacaugggacauuugcu

SEQ ID NO: 2637516 - RNA, 22 nt, Human
gacaugggacauuugcucaugg

SEQ ID NO: 2637517 - RNA, 23 nt, Human
gaccugauuucugagcauuuaau

SEQ ID NO: 2637518 - RNA, 16 nt, Human
gagcucgugggacagu

SEQ ID NO: 2637519 - RNA, 18 nt, Human
gagcugcccucuccuggg

SEQ ID NO: 2637520 - RNA, 19 nt, Human
gagcugcccucuccugggc

SEQ ID NO: 2637521 - RNA, 21 nt, Human
gagcugcccucuccugggcag

SEQ ID NO: 2637522 - RNA, 23 nt, Human
gagcugcccucuccugggcagcu

SEQ ID NO: 2637523 - RNA, 15 nt, Human
gagagugaacaaauu

SEQ ID NO: 2637524 - RNA, 17 nt, Human
gagauacagaauuuuau

SEQ ID NO: 2637525 - RNA, 19 nt, Human
gagagugaacaaauuuaca

SEQ ID NO: 2637526 - RNA, 19 nt, Human
gagagacacacugaagaag

SEQ ID NO: 2637527 - RNA, 13 nt, Human
gagacagcucugc

SEQ ID NO: 2637528 - RNA, 18 nt, Human
gagacagcucugcauacu

SEQ ID NO: 2637529 - RNA, 15 nt, Human
gagacagcucugcau

SEQ ID NO: 2637530 - RNA, 18 nt, Human
gagaaagacuauucaaac

SEQ ID NO: 2637531 - RNA, 17 nt, Human
gagaaagacuauucaaa

SEQ ID NO: 2637532 - RNA, 15 nt, Human
gagaaagacuauuca

SEQ ID NO: 2637533 - RNA, 13 nt, Human
gagaaagacuauu

SEQ ID NO: 2637534 - RNA, 22 nt, Human
gagaagagcuguucacagccag

SEQ ID NO: 2637535 - RNA, 15 nt, Human
gagaagagcuguuca

SEQ ID NO: 2637536 - RNA, 13 nt, Human
gagaagaacugaa

SEQ ID NO: 2637537 - RNA, 14 nt, Human
gagaagaacugaaa

SEQ ID NO: 2637538 - RNA, 16 nt, Human
gagaagaacugaaauc

SEQ ID NO: 2637539 - RNA, 18 nt, Human
gagacacacugaagaagc

SEQ ID NO: 2637540 - RNA, 22 nt, Human
gaacuuguaaaggaauuuaaaa

SEQ ID NO: 2637541 - RNA, 16 nt, Human
gaacucccuuucaaca

SEQ ID NO: 2637542 - RNA, 14 nt, Human
gaaccacaagacug

SEQ ID NO: 2637543 - RNA, 15 nt, Human
gaaccacaagacugc

SEQ ID NO: 2637544 - RNA, 17 nt, Human
gaagauguagaggagaa

SEQ ID NO: 2637545 - RNA, 23 nt, Human
gaagagcuguucacagccagacu

SEQ ID NO: 2637546 - RNA, 13 nt, Human
gaagagcuguuca

SEQ ID NO: 2637547 - RNA, 20 nt, Human
gaagagcuguucacagccag

SEQ ID NO: 2637548 - RNA, 15 nt, Human
gaagagcuguucaca

SEQ ID NO: 2637549 - RNA, 23 nt, Human
gaaguccaagcauuuagauguau

SEQ ID NO: 2637550 - RNA, 14 nt, Human
gaaggaugcugucu

SEQ ID NO: 2637551 - RNA, 21 nt, Human
gaaagcuugcccuggugccuc

SEQ ID NO: 2637552 - RNA, 16 nt, Human
gaaacugacacaugcu

SEQ ID NO: 2637553 - RNA, 15 nt, Human
gaaacugccagcaac

SEQ ID NO: 2637554 - RNA, 13 nt, Human
gaaacugccagca

SEQ ID NO: 2637555 - RNA, 14 nt, Human
gaaagcagaacagu

SEQ ID NO: 2637556 - RNA, 13 nt, Human
gaaagcagaacag

SEQ ID NO: 2637557 - RNA, 19 nt, Human
gaaagacuauucaaacagu

SEQ ID NO: 2637558 - RNA, 23 nt, Human
gaaagacuauucaaacagucuca

SEQ ID NO: 2637559 - RNA, 22 nt, Human
gaaagacuauucaaacagucuc

SEQ ID NO: 2637560 - RNA, 15 nt, Human
gaaauauuuauuuua

SEQ ID NO: 2637561 - RNA, 16 nt, Human
gaaauauuuauuuuaa

SEQ ID NO: 2637562 - RNA, 13 nt, Human
gaaauauuuauuu

SEQ ID NO: 2637563 - RNA, 24 nt, Human
gaacaguuaccucugccucagaaa

SEQ ID NO: 2637564 - RNA, 17 nt, Human
cuugccaaauauaaaua

SEQ ID NO: 2637565 - RNA, 18 nt, Human
cuuguaaaggaauuuaaa

SEQ ID NO: 2637566 - RNA, 13 nt, Human
cuucuuuccacag

SEQ ID NO: 2637567 - RNA, 19 nt, Human
cuucuuuccacagaagcuc

SEQ ID NO: 2637568 - RNA, 20 nt, Human
cuugaacccgggaggcagag

SEQ ID NO: 2637569 - RNA, 19 nt, Human
cuugaacccgggaggcaga

SEQ ID NO: 2637570 - RNA, 14 nt, Human
cuugaacccgggag

SEQ ID NO: 2637571 - RNA, 21 nt, Human
cuugcaugguuuagaaagcuu

SEQ ID NO: 2637572 - RNA, 23 nt, Human
cuugcaucaauuuuucuuauuuc

SEQ ID NO: 2637573 - RNA, 16 nt, Human
cuugagugcucaguag

SEQ ID NO: 2637574 - RNA, 15 nt, Human
cugcccucuccuggg

SEQ ID NO: 2637575 - RNA, 12 nt, Human
cugcccucuccu

SEQ ID NO: 2637576 - RNA, 13 nt, Human
cugcccucuccug

SEQ ID NO: 2637577 - RNA, 14 nt, Human
cugcccucuccugg

SEQ ID NO: 2637578 - RNA, 18 nt, Human
cugcuugccaucccuccc

SEQ ID NO: 2637579 - RNA, 19 nt, Human
cugcuugccaucccucccu

SEQ ID NO: 2637580 - RNA, 20 nt, Human
cugcuugccaucccucccuc

SEQ ID NO: 2637581 - RNA, 22 nt, Human
cugcuugccaucccucccucca

SEQ ID NO: 2637582 - RNA, 16 nt, Human
cugcuugccaucccuc

SEQ ID NO: 2637583 - RNA, 15 nt, Human
cugcuugccaucccu

SEQ ID NO: 2637584 - RNA, 12 nt, Human
cugcacugucaa

SEQ ID NO: 2637585 - RNA, 15 nt, Human
cugccagcaacgcag

SEQ ID NO: 2637586 - RNA, 15 nt, Human
cuggccuucggccuc

SEQ ID NO: 2637587 - RNA, 21 nt, Human
cuggccuucggccuccauccu

SEQ ID NO: 2637588 - RNA, 18 nt, Human
cuggccuucggccuccau

SEQ ID NO: 2637589 - RNA, 17 nt, Human
cuggccuucggccucca

SEQ ID NO: 2637590 - RNA, 16 nt, Human
cuggccuucggccucc

SEQ ID NO: 2637591 - RNA, 20 nt, Human
cugggaaagggauuuucagc

SEQ ID NO: 2637592 - RNA, 22 nt, Human
cuguaauaaacucauuucuagc

SEQ ID NO: 2637593 - RNA, 20 nt, Human
cugucuccucucucuguaau

SEQ ID NO: 2637594 - RNA, 17 nt, Human
cugucuccucucucugu

SEQ ID NO: 2637595 - RNA, 18 nt, Human
cugucucuacuaaaaaua

SEQ ID NO: 2637596 - RNA, 15 nt, Human
cuguaugauucccag

SEQ ID NO: 2637597 - RNA, 13 nt, Human
cuguauuuuaaaa

SEQ ID NO: 2637598 - RNA, 16 nt, Human
cuguauuuuaaaagaa

SEQ ID NO: 2637599 - RNA, 12 nt, Human
cucugcuugcca

SEQ ID NO: 2637600 - RNA, 14 nt, Human
cucugcuugccauc

SEQ ID NO: 2637601 - RNA, 17 nt, Human
cucugcuugccaucccu

SEQ ID NO: 2637602 - RNA, 20 nt, Human
cucugcuugccaucccuccc

SEQ ID NO: 2637603 - RNA, 12 nt, Human
cucuggccuucg

SEQ ID NO: 2637604 - RNA, 19 nt, Human
cucuggccuucggccucca

SEQ ID NO: 2637605 - RNA, 23 nt, Human
cugaagaagcaccaaucaugaau

SEQ ID NO: 2637606 - RNA, 17 nt, Human
cugaacaucacagcuua

SEQ ID NO: 2637607 - RNA, 22 nt, Human
cucuucuuuaaagggauggcaa

SEQ ID NO: 2637608 - RNA, 20 nt, Human
cugagcgacagugagacucu

SEQ ID NO: 2637609 - RNA, 16 nt, Human
cugagcgacagugaga

SEQ ID NO: 2637610 - RNA, 23 nt, Human
cugagaaagacuauucaaacagu

SEQ ID NO: 2637611 - RNA, 22 nt, Human
cugagaaagacuauucaaacag

SEQ ID NO: 2637612 - RNA, 17 nt, Human
cugacucuuaagaagac

SEQ ID NO: 2637613 - RNA, 16 nt, Human
cugacuucuaaguaaa

SEQ ID NO: 2637614 - RNA, 15 nt, Human
cugacuucuaaguaa

SEQ ID NO: 2637615 - RNA, 13 nt, Human
cugacuucuaagu

SEQ ID NO: 2637616 - RNA, 12 nt, Human
cucuccugggca

SEQ ID NO: 2637617 - RNA, 15 nt, Human
cucuccugggcagcu

SEQ ID NO: 2637618 - RNA, 16 nt, Human
cucuccugggcagcug

SEQ ID NO: 2637619 - RNA, 18 nt, Human
cucuccugggcagcugcc

SEQ ID NO: 2637620 - RNA, 19 nt, Human
cucuccugggcagcugccu

SEQ ID NO: 2637621 - RNA, 20 nt, Human
cucuccugggcagcugccuc

SEQ ID NO: 2637622 - RNA, 15 nt, Human
cucuaggaaauauuu

SEQ ID NO: 2637623 - RNA, 17 nt, Human
cucuaggaaauauuuau

SEQ ID NO: 2637624 - RNA, 18 nt, Human
cuccauccugaggcucca

SEQ ID NO: 2637625 - RNA, 16 nt, Human
cuccauccugaggcuc

SEQ ID NO: 2637626 - RNA, 11 nt, Human
cuccauccuga

SEQ ID NO: 2637627 - RNA, 14 nt, Human
cuccauccugaggc

SEQ ID NO: 2637628 - RNA, 17 nt, Human
cucccuccaccucccug

SEQ ID NO: 2637629 - RNA, 15 nt, Human
cucccuccaccuccc

SEQ ID NO: 2637630 - RNA, 15 nt, Human
cgcucucuggccuuc

SEQ ID NO: 2637631 - RNA, 14 nt, Human
cgcucucuggccuu

SEQ ID NO: 2637632 - RNA, 18 nt, Human
cgcucucuggccuucggc

SEQ ID NO: 2637633 - RNA, 17 nt, Human
cggugagcuacaaaugc

SEQ ID NO: 2637634 - RNA, 22 nt, Human
cggucggguuuuauuguuuaaa

SEQ ID NO: 2637635 - RNA, 21 nt, Human
cggguuuuauuguuuaaaauc

SEQ ID NO: 2637636 - RNA, 14 nt, Human
cggccuccauccug

SEQ ID NO: 2637637 - RNA, 12 nt, Human
cggccuccaucc

SEQ ID NO: 2637638 - RNA, 23 nt, Human
cuaaauugacacuuaaaaauggu

SEQ ID NO: 2637639 - RNA, 17 nt, Human
cucaccccuugccauaa

SEQ ID NO: 2637640 - RNA, 13 nt, Human
cucacauuuauau

SEQ ID NO: 2637641 - RNA, 23 nt, Human
cuaguaucaaaagaaagaaaauc

SEQ ID NO: 2637642 - RNA, 17 nt, Human
cuaguaucaaaagaaag

SEQ ID NO: 2637643 - RNA, 15 nt, Human
cuaguaucaaaagaa

SEQ ID NO: 2637644 - RNA, 22 nt, Human
cuaguauuucuaugaaauauua

SEQ ID NO: 2637645 - RNA, 19 nt, Human
cuaguauuucuaugaaaua

SEQ ID NO: 2637646 - RNA, 20 nt, Human
cuaguauuucuaugaaauau

SEQ ID NO: 2637647 - RNA, 13 nt, Human
cuaugaaauauua

SEQ ID NO: 2637648 - RNA, 18 nt, Human
cuaugaaauauuauguua

SEQ ID NO: 2637649 - RNA, 22 nt, Human
cuauauuuuuuguuaaaugauu

SEQ ID NO: 2637650 - RNA, 19 nt, Human
cuauauuguuugcuaagca

SEQ ID NO: 2637651 - RNA, 20 nt, Human
cuauauuuuuuguuaaauga

SEQ ID NO: 2637652 - RNA, 19 nt, Human
cuacuugggaggcugagau

SEQ ID NO: 2637653 - RNA, 18 nt, Human
cuacuugggaggcugaga

SEQ ID NO: 2637654 - RNA, 15 nt, Human
cuacuugggaggcug

SEQ ID NO: 2637655 - RNA, 16 nt, Human
cuacacuccagugaga

SEQ ID NO: 2637656 - RNA, 17 nt, Human
cuacacuccagugagac

SEQ ID NO: 2637657 - RNA, 18 nt, Human
cuaagcaaaaugugauau

SEQ ID NO: 2637658 - RNA, 15 nt, Human
cuaagcaaaauguga

SEQ ID NO: 2637659 - RNA, 14 nt, Human
cuaagcaaaaugug

SEQ ID NO: 2637660 - RNA, 20 nt, Human
cccucccuccaccucccugc

SEQ ID NO: 2637661 - RNA, 13 nt, Human
cccucccuccacc

SEQ ID NO: 2637662 - RNA, 12 nt, Human
cccucccuccac

SEQ ID NO: 2637663 - RNA, 14 nt, Human
ccccaggugccagu

SEQ ID NO: 2637664 - RNA, 14 nt, Human
cccugcaauaaaau

SEQ ID NO: 2637665 - RNA, 15 nt, Human
cccugcaauaaaaug

SEQ ID NO: 2637666 - RNA, 20 nt, Human
ccucagaugcacaugagcug

SEQ ID NO: 2637667 - RNA, 13 nt, Human
ccuaaacauauga

SEQ ID NO: 2637668 - RNA, 13 nt, Human
ccuccauccugag

SEQ ID NO: 2637669 - RNA, 12 nt, Human
ccuccauccuga

SEQ ID NO: 2637670 - RNA, 12 nt, Human
ccuccccuccuc

SEQ ID NO: 2637671 - RNA, 13 nt, Human
ccuccccuccucu

SEQ ID NO: 2637672 - RNA, 16 nt, Human
cccaguguuuuaggag

SEQ ID NO: 2637673 - RNA, 17 nt, Human
cccaguguuuuaggagc

SEQ ID NO: 2637674 - RNA, 23 nt, Human
ccauggcacucuauguucuaaga

SEQ ID NO: 2637675 - RNA, 16 nt, Human
ccauccugaggcucca

SEQ ID NO: 2637676 - RNA, 15 nt, Human
ccauccugaggcucc

SEQ ID NO: 2637677 - RNA, 23 nt, Human
caugcugucuacacuaagagaga

SEQ ID NO: 2637678 - RNA, 17 nt, Human
caugggacagggaggac

SEQ ID NO: 2637679 - RNA, 14 nt, Human
ccaacacgagcagg

SEQ ID NO: 2637680 - RNA, 21 nt, Human
ccaacacgagcaggcuacugu

SEQ ID NO: 2637681 - RNA, 18 nt, Human
ccaaggcuagaaccaccu

SEQ ID NO: 2637682 - RNA, 19 nt, Human
ccaaggcugauuaaaccaa

SEQ ID NO: 2637683 - RNA, 20 nt, Human
ccaauauucauagcagcuua

SEQ ID NO: 2637684 - RNA, 22 nt, Human
ccacaagaaaugaaagcaggga

SEQ ID NO: 2637685 - RNA, 16 nt, Human
ccacaagaaaugaaag

SEQ ID NO: 2637686 - RNA, 16 nt, Human
cauuugcucauggaau

SEQ ID NO: 2637687 - RNA, 15 nt, Human
cauuugcucauggaa

SEQ ID NO: 2637688 - RNA, 14 nt, Human
cauuugcucaugga

SEQ ID NO: 2637689 - RNA, 17 nt, Human
ccaaagaaauguaaggg

SEQ ID NO: 2637690 - RNA, 23 nt, Human
cauuucugcaucagcugcugaaa

SEQ ID NO: 2637691 - RNA, 19 nt, Human
cauuuaaagcuuauuaaaa

SEQ ID NO: 2637692 - RNA, 18 nt, Human
caucaaugaaugaaugaa

SEQ ID NO: 2637693 - RNA, 22 nt, Human
caucaagucuuucacauuuaaa

SEQ ID NO: 2637694 - RNA, 20 nt, Human
cauauauaacaaugcuguau

SEQ ID NO: 2637695 - RNA, 22 nt, Human
caucuagugagcagucaggaaa

SEQ ID NO: 2637696 - RNA, 14 nt, Human
caucuagugagcag

SEQ ID NO: 2637697 - RNA, 12 nt, Human
caucccucccuc

SEQ ID NO: 2637698 - RNA, 13 nt, Human
caucccucccucc

SEQ ID NO: 2637699 - RNA, 14 nt, Human
caucccucccucca

SEQ ID NO: 2637700 - RNA, 20 nt, Human
caguguuuuaggagcaugag

SEQ ID NO: 2637701 - RNA, 16 nt, Human
caguguuuuaggagca

SEQ ID NO: 2637702 - RNA, 21 nt, Human
caguuaccucugccucagaaa

SEQ ID NO: 2637703 - RNA, 22 nt, Human
caguucggugagcuacaaaugc

SEQ ID NO: 2637704 - RNA, 12 nt, Human
caguucugaaga

SEQ ID NO: 2637705 - RNA, 13 nt, Human
caguucugaagaa

SEQ ID NO: 2637706 - RNA, 14 nt, Human
caguucugaagaag

SEQ ID NO: 2637707 - RNA, 22 nt, Human
caguucugaagaagaugguacc

SEQ ID NO: 2637708 - RNA, 15 nt, Human
caguucugaagaaga

SEQ ID NO: 2637709 - RNA, 16 nt, Human
caguucugaagaagau

SEQ ID NO: 2637710 - RNA, 14 nt, Human
cagugucaaugcag

SEQ ID NO: 2637711 - RNA, 15 nt, Human
caguuuucugagaaa

SEQ ID NO: 2637712 - RNA, 14 nt, Human
caguuuucugagaa

SEQ ID NO: 2637713 - RNA, 20 nt, Human
caguuuucugagaaagacua

SEQ ID NO: 2637714 - RNA, 19 nt, Human
caguuuucugagaaagacu

SEQ ID NO: 2637715 - RNA, 18 nt, Human
caguugaaaagacuccaa

SEQ ID NO: 2637716 - RNA, 14 nt, Human
caguugaaaagacu

SEQ ID NO: 2637717 - RNA, 23 nt, Human
caguugaaaagacuccaaagaaa

SEQ ID NO: 2637718 - RNA, 22 nt, Human
caguugaaaagacuccaaagaa

SEQ ID NO: 2637719 - RNA, 21 nt, Human
caguugaaaagacuccaaaga

SEQ ID NO: 2637720 - RNA, 17 nt, Human
cauaccaacacgagcag

SEQ ID NO: 2637721 - RNA, 13 nt, Human
aaaagacuccaaa

SEQ ID NO: 2637722 - RNA, 11 nt, Human
aaaagaaugau

SEQ ID NO: 2637723 - RNA, 13 nt, Human
aaaagaauauuuu

SEQ ID NO: 2637724 - RNA, 20 nt, Human
aaaagacaaggaaaaaauaa

SEQ ID NO: 2637725 - RNA, 12 nt, Human
aaaagaauauuu

SEQ ID NO: 2637726 - RNA, 17 nt, Human
aaaagaaagaaaaucag

SEQ ID NO: 2637727 - RNA, 10 nt, Human
aaaaucauuu

SEQ ID NO: 2637728 - RNA, 12 nt, Human
aaaaucauuucu

SEQ ID NO: 2637729 - RNA, 11 nt, Human
aaaaucauuuc

SEQ ID NO: 2637730 - RNA, 21 nt, Human
aaaaucauuucugcaucagcu

SEQ ID NO: 2637731 - RNA, 15 nt, Human
aaacugcacugucaa

SEQ ID NO: 2637732 - RNA, 17 nt, Human
aaagcauuguaaaugug

SEQ ID NO: 2637733 - RNA, 15 nt, Human
aaagcauuguaaaug

SEQ ID NO: 2637734 - RNA, 21 nt, Human
aaauauuuauuuuaauaaugu

SEQ ID NO: 2637735 - RNA, 18 nt, Human
aaaucucaauauuucaga

SEQ ID NO: 2637736 - RNA, 23 nt, Human
aaauguugacaugggacauuugc

SEQ ID NO: 2637737 - RNA, 13 nt, Human
aaauguucaucaa

SEQ ID NO: 2637738 - RNA, 17 nt, Human
aaauguucaucaaugaa

SEQ ID NO: 2637739 - RNA, 22 nt, Human
aaauguugacaugggacauuug

SEQ ID NO: 2637740 - RNA, 15 nt, Human
aagaagacugcauua

SEQ ID NO: 2637741 - RNA, 21 nt, Human
aagacaaggaaaaaauaacaa

SEQ ID NO: 2637742 - RNA, 20 nt, Human
aagaagacugcauuauauuu

SEQ ID NO: 2637743 - RNA, 15 nt, Human
aagaacugaaaucau

SEQ ID NO: 2637744 - RNA, 11 nt, Human
aagaacugaaa

SEQ ID NO: 2637745 - RNA, 12 nt, Human
aagaacugaaau

SEQ ID NO: 2637746 - RNA, 13 nt, Human
aagaacugaaauc

SEQ ID NO: 2637747 - RNA, 20 nt, Human
aacgcaggcccccaggugcc

SEQ ID NO: 2637748 - RNA, 22 nt, Human
aagacagagccccacccucaga

SEQ ID NO: 2637749 - RNA, 20 nt, Human
aaugaauacuuuauaaagga

SEQ ID NO: 2637750 - RNA, 16 nt, Human
aaucucaauauuucag

SEQ ID NO: 2637751 - RNA, 15 nt, Human
acaccaauauucaua

SEQ ID NO: 2637752 - RNA, 22 nt, Human
aauuucauaccuaucaucuuaa

SEQ ID NO: 2637753 - RNA, 11 nt, Human
aauuguaauag

SEQ ID NO: 2637754 - RNA, 21 nt, Human
acauuuguauaaaauaauuuu

SEQ ID NO: 2637755 - RNA, 15 nt, Human
acauuugcucaugga

SEQ ID NO: 2637756 - RNA, 16 nt, Human
acauuugcucauggaa

SEQ ID NO: 2637757 - RNA, 16 nt, Human
acauuuguauaaaaua

SEQ ID NO: 2637758 - RNA, 19 nt, Human
acauuuguauaaaauaauu

SEQ ID NO: 2637759 - RNA, 19 nt, Human
acagugauuaccagggacu

SEQ ID NO: 2637760 - RNA, 24 nt, Human
acaggaugguucccuugaugaaga

SEQ ID NO: 2637761 - RNA, 22 nt, Human
acaggaugguucccuugaugaa

SEQ ID NO: 2637762 - RNA, 21 nt, Human
acccugucucuacuaaaaaua

SEQ ID NO: 2637763 - RNA, 20 nt, Human
acccucagaugcacaugagc

SEQ ID NO: 2637764 - RNA, 14 nt, Human
acgcacacugucug

SEQ ID NO: 2637765 - RNA, 20 nt, Human
accucugccucagaaaacaa

SEQ ID NO: 2637766 - RNA, 21 nt, Human
acuucagacauagaauuaaca

SEQ ID NO: 2637767 - RNA, 13 nt, Human
acuuggucuguga

SEQ ID NO: 2637768 - RNA, 22 nt, Human
acuuaaaaaugguuuaaauggu

SEQ ID NO: 2637769 - RNA, 17 nt, Human
acuucaaauccuugaag

SEQ ID NO: 2637770 - RNA, 18 nt, Human
acuucaaauccuugaaga

SEQ ID NO: 2637771 - RNA, 12 nt, Human
acuggaacucuc

SEQ ID NO: 2637772 - RNA, 17 nt, Human
acuguaaaauaauaacu

SEQ ID NO: 2637773 - RNA, 14 nt, Human
acucccuuucaaca

SEQ ID NO: 2637774 - RNA, 14 nt, Human
acucguuaauuugu

SEQ ID NO: 2637775 - RNA, 19 nt, Human
acucguuaauuuguagugu

SEQ ID NO: 2637776 - RNA, 19 nt, Human
acugauaugggucuugaua

SEQ ID NO: 2637777 - RNA, 13 nt, Human
acugacacaugcu

SEQ ID NO: 2637778 - RNA, 18 nt, Human
aggaaaaaauaacaauga

SEQ ID NO: 2637779 - RNA, 17 nt, Human
agcuguaugauucccag

SEQ ID NO: 2637780 - RNA, 18 nt, Human
agcuguaugauucccagc

SEQ ID NO: 2637781 - RNA, 20 nt, Human
agcugcugaaacaacaaaua

SEQ ID NO: 2637782 - RNA, 16 nt, Human
agcugcugaaacaaca

SEQ ID NO: 2637783 - RNA, 15 nt, Human
agcugcugaaacaac

SEQ ID NO: 2637784 - RNA, 14 nt, Human
agcugcugaaacaa

SEQ ID NO: 2637785 - RNA, 13 nt, Human
agcuacaaaugca

SEQ ID NO: 2637786 - RNA, 12 nt, Human
agcuacaaaugc

SEQ ID NO: 2637787 - RNA, 15 nt, Human
agcgacagugagacu

SEQ ID NO: 2637788 - RNA, 13 nt, Human
agcgacagugaga

SEQ ID NO: 2637789 - RNA, 17 nt, Human
agggacaggauaagagg

SEQ ID NO: 2637790 - RNA, 20 nt, Human
agggauuagggagagaagau

SEQ ID NO: 2637791 - RNA, 13 nt, Human
aggaaguagagga

SEQ ID NO: 2637792 - RNA, 23 nt, Human
aggccaugggcacuguggguaga

SEQ ID NO: 2637793 - RNA, 20 nt, Human
aggcagagguugcagugagc

SEQ ID NO: 2637794 - RNA, 19 nt, Human
agacaaggaaaaaauaaca

SEQ ID NO: 2637795 - RNA, 22 nt, Human
agaacagugauuaccagggacu

SEQ ID NO: 2637796 - RNA, 21 nt, Human
agaagacugcauuauauuuau

SEQ ID NO: 2637797 - RNA, 13 nt, Human
agaagagcuguuc

SEQ ID NO: 2637798 - RNA, 20 nt, Human
agaagagcuguucacagcca

SEQ ID NO: 2637799 - RNA, 14 nt, Human
agccagcaguucag

SEQ ID NO: 2637800 - RNA, 17 nt, Human
agcacugacuucuaagu

SEQ ID NO: 2637801 - RNA, 19 nt, Human
agcacugacuucuaaguaa

SEQ ID NO: 2637802 - RNA, 23 nt, Human
agcaaaauuuuuucucuaggaaa

SEQ ID NO: 2637803 - RNA, 20 nt, Human
agauagauaggucagugcaa

SEQ ID NO: 2637804 - RNA, 21 nt, Human
aucaugaauuaguuuuauaug

SEQ ID NO: 2637805 - RNA, 12 nt, Human
auccuugaagau

SEQ ID NO: 2637806 - RNA, 14 nt, Human
aucaaaagaaagaa

SEQ ID NO: 2637807 - RNA, 15 nt, Human
augggacagggagga

SEQ ID NO: 2637808 - RNA, 20 nt, Human
augggacauuugcucaugga

SEQ ID NO: 2637809 - RNA, 20 nt, Human
augggaaagcauuguaaaug

SEQ ID NO: 2637810 - RNA, 14 nt, Human
augggaaagcauug

SEQ ID NO: 2637811 - RNA, 23 nt, Human
auggcuuccuggcaauagucaaa

SEQ ID NO: 2637812 - RNA, 15 nt, Human
auaaaagacagugaa

SEQ ID NO: 2637813 - RNA, 16 nt, Human
auaaaagacagugaaa

SEQ ID NO: 2637814 - RNA, 14 nt, Human
aguugaaaagacuc

SEQ ID NO: 2637815 - RNA, 13 nt, Human
aguacucauacau

SEQ ID NO: 2637816 - RNA, 13 nt, Human
agucauuuaauaa

SEQ ID NO: 2637817 - RNA, 19 nt, Human
agugaugucacuagggcag

SEQ ID NO: 2637818 - RNA, 13 nt, Human
agugauuaccagg

SEQ ID NO: 2637819 - RNA, 16 nt, Human
cugcacuccagccuga

SEQ ID NO: 2637820 - RNA, 20 nt, Human
cugcacuccagccugagcga

SEQ ID NO: 2637821 - RNA, 17 nt, Human
cugcacuccagccugag

SEQ ID NO: 2637822 - RNA, 13 nt, Human
cugggcagcugcc

SEQ ID NO: 2637823 - RNA, 14 nt, Human
cugggcagcugccu

SEQ ID NO: 2637824 - RNA, 15 nt, Human
cugggcagcugccuc

SEQ ID NO: 2637825 - RNA, 12 nt, Human
cuggugccucac

SEQ ID NO: 2637826 - RNA, 21 nt, Human
cuggugccucaccccuugcca

SEQ ID NO: 2637827 - RNA, 20 nt, Human
cugcuuauccguuagccgug

SEQ ID NO: 2637828 - RNA, 11 nt, Human
cuucagacaua

SEQ ID NO: 2637829 - RNA, 23 nt, Human
cuucaugcugucuacacuaagag

SEQ ID NO: 2637830 - RNA, 15 nt, Human
cuucuguuuuauaau

SEQ ID NO: 2637831 - RNA, 20 nt, Human
cuucuguuuuauaauuuugu

SEQ ID NO: 2637832 - RNA, 21 nt, Human
cuuugagugucuuaauuaaaa

SEQ ID NO: 2637833 - RNA, 20 nt, Human
gcaaguauuagaauaccaca

SEQ ID NO: 2637834 - RNA, 22 nt, Human
gcaauagucaaauugugugaaa

SEQ ID NO: 2637835 - RNA, 23 nt, Human
gcacaguuuucugagaaagacua

SEQ ID NO: 2637836 - RNA, 22 nt, Human
gcacaguuuucugagaaagacu

SEQ ID NO: 2637837 - RNA, 20 nt, Human
gcacaguuuucugagaaaga

SEQ ID NO: 2637838 - RNA, 16 nt, Human
gauuuaccacuugugu

SEQ ID NO: 2637839 - RNA, 15 nt, Human
gauuuaccacuugug

SEQ ID NO: 2637840 - RNA, 22 nt, Human
gaugguucccuugaugaagaag

SEQ ID NO: 2637841 - RNA, 18 nt, Human
gauguagaggagaaacug

SEQ ID NO: 2637842 - RNA, 17 nt, Human
gauguagaggagaaacu

SEQ ID NO: 2637843 - RNA, 16 nt, Human
gaugaucuuuaaaaua

SEQ ID NO: 2637844 - RNA, 15 nt, Human
gaggacgcucucugg

SEQ ID NO: 2637845 - RNA, 23 nt, Human
gaggcuccacuuggucugugaga

SEQ ID NO: 2637846 - RNA, 18 nt, Human
gaggcuccacuuggucug

SEQ ID NO: 2637847 - RNA, 19 nt, Human
gaggcuccacuuggucugu

SEQ ID NO: 2637848 - RNA, 16 nt, Human
gaguuuaaauuguaau

SEQ ID NO: 2637849 - RNA, 14 nt, Human
gaacugaaaucaua

SEQ ID NO: 2637850 - RNA, 13 nt, Human
gaacugaaaucau

SEQ ID NO: 2637851 - RNA, 23 nt, Human
gaagcaacccaaauguucaucaa

SEQ ID NO: 2637852 - RNA, 14 nt, Human
gaagcaaaauuuuu

SEQ ID NO: 2637853 - RNA, 21 nt, Human
gacagaaagcagaacagugau

SEQ ID NO: 2637854 - RNA, 15 nt, Human
gacacacugaagaag

SEQ ID NO: 2637855 - RNA, 16 nt, Human
gacacacugaagaagc

SEQ ID NO: 2637856 - RNA, 16 nt, Human
gacauuugcucaugga

SEQ ID NO: 2637857 - RNA, 17 nt, Human
gacauuugcucauggaa

SEQ ID NO: 2637858 - RNA, 21 nt, Human
gacagugagacucugucucag

SEQ ID NO: 2637859 - RNA, 17 nt, Human
gacgcucucuggccuuc

SEQ ID NO: 2637860 - RNA, 16 nt, Human
gacgcucucuggccuu

SEQ ID NO: 2637861 - RNA, 15 nt, Human
gacgcucucuggccu

SEQ ID NO: 2637862 - RNA, 14 nt, Human
gacucuuaagaaga

SEQ ID NO: 2637863 - RNA, 15 nt, Human
gacucuuaagaagac

SEQ ID NO: 2637864 - RNA, 21 nt, Human
gacucuuaagaagacugcauu

SEQ ID NO: 2637865 - RNA, 12 nt, Human
ggauuuucagcc

SEQ ID NO: 2637866 - RNA, 22 nt, Human
ggaugguucccuugaugaagaa

SEQ ID NO: 2637867 - RNA, 23 nt, Human
ggaugguucccuugaugaagaag

SEQ ID NO: 2637868 - RNA, 16 nt, Human
ggccuccauccugagg

SEQ ID NO: 2637869 - RNA, 19 nt, Human
ggaggcugagaugggagaa

SEQ ID NO: 2637870 - RNA, 15 nt, Human
ggaggcugagauggg

SEQ ID NO: 2637871 - RNA, 11 nt, Human
gggaggcagag

SEQ ID NO: 2637872 - RNA, 20 nt, Human
gggaggcagagguugcagug

SEQ ID NO: 2637873 - RNA, 22 nt, Human
aaaagcuccauuuuuagugaaa

SEQ ID NO: 2637874 - RNA, 21 nt, Human
aaaacuuuaugcuaagugaaa

SEQ ID NO: 2637875 - RNA, 21 nt, Human
aaaauaauuuuuauauuugaa

SEQ ID NO: 2637876 - RNA, 23 nt, Human
aaaauaauuuuuauauuugaaau

SEQ ID NO: 2637877 - RNA, 20 nt, Human
aaaauaauuuuuauauuuga

SEQ ID NO: 2637878 - RNA, 21 nt, Human
gggauuuucagcccucagaau

SEQ ID NO: 2637879 - RNA, 17 nt, Human
gggauugaaggaugcug

SEQ ID NO: 2637880 - RNA, 20 nt, Human
gggcagcugccuccccuccu

SEQ ID NO: 2637881 - RNA, 23 nt, Human
gggcagcugccuccccuccucug

SEQ ID NO: 2637882 - RNA, 13 nt, Human
gggcagcugccuc

SEQ ID NO: 2637883 - RNA, 14 nt, Human
gggcagcugccucc

SEQ ID NO: 2637884 - RNA, 19 nt, Human
gggcagcugccuccccucc

SEQ ID NO: 2637885 - RNA, 16 nt, Human
aaagaaugauuaugaa

SEQ ID NO: 2637886 - RNA, 20 nt, Human
aaagaggcagcuugaaacug

SEQ ID NO: 2637887 - RNA, 18 nt, Human
aaagagaacuuccagauc

SEQ ID NO: 2637888 - RNA, 23 nt, Human
aaagacuauucaaacagucucag

SEQ ID NO: 2637889 - RNA, 13 nt, Human
aaagacuccaaag

SEQ ID NO: 2637890 - RNA, 22 nt, Human
aaagacuauucaaacagucuca

SEQ ID NO: 2637891 - RNA, 24 nt, Human
ggucugugagaugcuagaacuccc

SEQ ID NO: 2637892 - RNA, 14 nt, Human
ggucugugagaugc

SEQ ID NO: 2637893 - RNA, 15 nt, Human
ggugccaguuauggc

SEQ ID NO: 2637894 - RNA, 20 nt, Human
ggugauuuagcaggaagcug

SEQ ID NO: 2637895 - RNA, 13 nt, Human
aaaggaauuuaaa

SEQ ID NO: 2637896 - RNA, 14 nt, Human
aaacacaacuauau

SEQ ID NO: 2637897 - RNA, 13 nt, Human
aaacauauauaac

SEQ ID NO: 2637898 - RNA, 16 nt, Human
aaacauauauaacaau

SEQ ID NO: 2637899 - RNA, 19 nt, Human
aaacauauauaacaaugcu

SEQ ID NO: 2637900 - RNA, 21 nt, Human
aaacauauauaacaaugcugu

SEQ ID NO: 2637901 - RNA, 19 nt, Human
aaaauuuuuucucuaggaa

SEQ ID NO: 2637902 - RNA, 17 nt, Human
aaacaaggaugaauuaa

SEQ ID NO: 2637903 - RNA, 15 nt, Human
aaaccacagcaguug

SEQ ID NO: 2637904 - RNA, 16 nt, Human
aaaccacagcaguuga

SEQ ID NO: 2637905 - RNA, 16 nt, Human
aaacucauuucuagca

SEQ ID NO: 2637906 - RNA, 14 nt, Human
gcuggagcucugcc

SEQ ID NO: 2637907 - RNA, 17 nt, Human
gcuggagcucugcccau

SEQ ID NO: 2637908 - RNA, 21 nt, Human
gcugccuccccuccucugcuu

SEQ ID NO: 2637909 - RNA, 22 nt, Human
gcugccuccccuccucugcuug

SEQ ID NO: 2637910 - RNA, 16 nt, Human
gcugccuccccuccuc

SEQ ID NO: 2637911 - RNA, 17 nt, Human
gcugccuccccuccucu

SEQ ID NO: 2637912 - RNA, 20 nt, Human
gcugccuccccuccucugcu

SEQ ID NO: 2637913 - RNA, 16 nt, Human
gcuaguaucaaaagaa

SEQ ID NO: 2637914 - RNA, 21 nt, Human
gcuaguaauuggaaaggcagc

SEQ ID NO: 2637915 - RNA, 18 nt, Human
gcuccccucggagaagag

SEQ ID NO: 2637916 - RNA, 15 nt, Human
gcuccccucggagaa

SEQ ID NO: 2637917 - RNA, 22 nt, Human
gccagacaucaacagauaaaua

SEQ ID NO: 2637918 - RNA, 19 nt, Human
gccagauuuuccugaaaac

SEQ ID NO: 2637919 - RNA, 22 nt, Human
gccagcaguucagagcugcccu

SEQ ID NO: 2637920 - RNA, 23 nt, Human
gccagcaguucagagcugcccuc

SEQ ID NO: 2637921 - RNA, 17 nt, Human
gcccuguuaaaagauga

SEQ ID NO: 2637922 - RNA, 14 nt, Human
gcccuguuaaaaga

SEQ ID NO: 2637923 - RNA, 13 nt, Human
gcccuguuaaaag

SEQ ID NO: 2637924 - RNA, 16 nt, Human
gcccccaggugccagu

SEQ ID NO: 2637925 - RNA, 18 nt, Human
cuaucucauuuccaagca

SEQ ID NO: 2637926 - RNA, 18 nt, Human
cuauguucuaagaaguga

SEQ ID NO: 2637927 - RNA, 16 nt, Human
cucaguccaugaagau

SEQ ID NO: 2637928 - RNA, 13 nt, Human
cucucuggccuuc

SEQ ID NO: 2637929 - RNA, 16 nt, Human
cucucuggccuucggc

SEQ ID NO: 2637930 - RNA, 14 nt, Human
cucucuggccuucg

SEQ ID NO: 2637931 - RNA, 19 nt, Human
cucuauguucuaagaagug

SEQ ID NO: 2637932 - RNA, 16 nt, Human
cucuccccaugauguu

SEQ ID NO: 2637933 - RNA, 15 nt, Human
cucuccccaugaugu

SEQ ID NO: 2637934 - RNA, 16 nt, Human
cucucuguaauaaacu

SEQ ID NO: 2637935 - RNA, 21 nt, Human
cucucuguaauaaacucauuu

SEQ ID NO: 2637936 - RNA, 19 nt, Human
cucccuccaccucccugca

SEQ ID NO: 2637937 - RNA, 22 nt, Human
cucccuccaccucccugcaaua

SEQ ID NO: 2637938 - RNA, 20 nt, Human
cucccuccaccucccugcaa

SEQ ID NO: 2637939 - RNA, 21 nt, Human
cucccuccaccucccugcaau

SEQ ID NO: 2637940 - RNA, 17 nt, Human
ccuucucuucacaguca

SEQ ID NO: 2637941 - RNA, 20 nt, Human
cuaacgaaguauccuucagc

SEQ ID NO: 2637942 - RNA, 20 nt, Human
cuacaaaaacacagcaaggg

SEQ ID NO: 2637943 - RNA, 12 nt, Human
ccuuuucccaac

SEQ ID NO: 2637944 - RNA, 15 nt, Human
ccccauuguggucac

SEQ ID NO: 2637945 - RNA, 13 nt, Human
ccauuuaaagcuu

SEQ ID NO: 2637946 - RNA, 22 nt, Human
ccauuguggucacaggaaguag

SEQ ID NO: 2637947 - RNA, 18 nt, Human
ccaugggcacugugggua

SEQ ID NO: 2637948 - RNA, 15 nt, Human
ccaggggccaugaau

SEQ ID NO: 2637949 - RNA, 19 nt, Human
ccacuuggucugugagaug

SEQ ID NO: 2637950 - RNA, 17 nt, Human
ccacuuggucugugaga

SEQ ID NO: 2637951 - RNA, 16 nt, Human
ccacuuggucugugag

SEQ ID NO: 2637952 - RNA, 15 nt, Human
ccacuuggucuguga

SEQ ID NO: 2637953 - RNA, 22 nt, Human
ccacuuggucugugagaugcua

SEQ ID NO: 2637954 - RNA, 20 nt, Human
ccacuuggucugugagaugc

SEQ ID NO: 2637955 - RNA, 12 nt, Human
ccacuuggucug

SEQ ID NO: 2637956 - RNA, 13 nt, Human
cccucggagaaga

SEQ ID NO: 2637957 - RNA, 14 nt, Human
cccugagcaggauu

SEQ ID NO: 2637958 - RNA, 20 nt, Human
ccuaacgaaguauccuucag

SEQ ID NO: 2637959 - RNA, 15 nt, Human
ccucuccugggcagc

SEQ ID NO: 2637960 - RNA, 16 nt, Human
ccucuccugggcagcu

SEQ ID NO: 2637961 - RNA, 17 nt, Human
ccucuccugggcagcug

SEQ ID NO: 2637962 - RNA, 18 nt, Human
ccucuccugggcagcugc

SEQ ID NO: 2637963 - RNA, 19 nt, Human
ccucuccugggcagcugcc

SEQ ID NO: 2637964 - RNA, 20 nt, Human
ccucuccugggcagcugccu

SEQ ID NO: 2637965 - RNA, 21 nt, Human
ccucuccugggcagcugccuc

SEQ ID NO: 2637966 - RNA, 22 nt, Human
ccucuccugggcagcugccucc

SEQ ID NO: 2637967 - RNA, 19 nt, Human
cauuauauuuauuacugua

SEQ ID NO: 2637968 - RNA, 21 nt, Human
ccaacuccagaaagugacaag

SEQ ID NO: 2637969 - RNA, 14 nt, Human
ccaaaaggcagaag

SEQ ID NO: 2637970 - RNA, 14 nt, Human
cauuuguauaaaau

SEQ ID NO: 2637971 - RNA, 16 nt, Human
cauuuguauaaaauaa

SEQ ID NO: 2637972 - RNA, 23 nt, Human
caguucagagcugcccucuccug

SEQ ID NO: 2637973 - RNA, 24 nt, Human
caguucagagcugcccucuccugg

SEQ ID NO: 2637974 - RNA, 18 nt, Human
caguucagagcugcccuc

SEQ ID NO: 2637975 - RNA, 19 nt, Human
caguucagagcugcccucu

SEQ ID NO: 2637976 - RNA, 21 nt, Human
caguucagagcugcccucucc

SEQ ID NO: 2637977 - RNA, 22 nt, Human
caguucagagcugcccucuccu

SEQ ID NO: 2637978 - RNA, 15 nt, Human
caguucagagcugcc

SEQ ID NO: 2637979 - RNA, 16 nt, Human
caguucagagcugccc

SEQ ID NO: 2637980 - RNA, 17 nt, Human
caguucagagcugcccu

SEQ ID NO: 2637981 - RNA, 22 nt, Human
caguuauuauauuuacaaaugg

SEQ ID NO: 2637982 - RNA, 22 nt, Human
cagugauuaccagggacugagg

SEQ ID NO: 2637983 - RNA, 21 nt, Human
caguuauuauauuuacaaaug

SEQ ID NO: 2637984 - RNA, 17 nt, Human
caguuauuauauuuaca

SEQ ID NO: 2637985 - RNA, 20 nt, Human
caguuauggcuauaggugcu

SEQ ID NO: 2637986 - RNA, 19 nt, Human
caguuauggcuauaggugc

SEQ ID NO: 2637987 - RNA, 13 nt, Human
caguuauggcuau

SEQ ID NO: 2637988 - RNA, 19 nt, Human
cauccugaggcuccacuug

SEQ ID NO: 2637989 - RNA, 18 nt, Human
cauccugaggcuccacuu

SEQ ID NO: 2637990 - RNA, 13 nt, Human
caucagcugcuga

SEQ ID NO: 2637991 - RNA, 19 nt, Human
cauagcagcuuauucacaa

SEQ ID NO: 2637992 - RNA, 16 nt, Human
cauagguuuaauaauu

SEQ ID NO: 2637993 - RNA, 11 nt, Human
caggcuacugu

SEQ ID NO: 2637994 - RNA, 11 nt, Human
cagcugccucc

SEQ ID NO: 2637995 - RNA, 10 nt, Human
cagcugccuc

SEQ ID NO: 2637996 - RNA, 9 nt, Human
cagcugccu

SEQ ID NO: 2637997 - RNA, 14 nt, Human
cagcugccuccccu

SEQ ID NO: 2637998 - RNA, 15 nt, Human
cagcugccuccccuc

SEQ ID NO: 2637999 - RNA, 16 nt, Human
cagcugccuccccucc

SEQ ID NO: 2638000 - RNA, 17 nt, Human
cagcugccuccccuccu

SEQ ID NO: 2638001 - RNA, 18 nt, Human
cagcugccuccccuccuc

SEQ ID NO: 2638002 - RNA, 19 nt, Human
cagcugccuccccuccucu

SEQ ID NO: 2638003 - RNA, 20 nt, Human
cagcugccuccccuccucug

SEQ ID NO: 2638004 - RNA, 14 nt, Human
cagcuuauugucua

SEQ ID NO: 2638005 - RNA, 20 nt, Human
cagcuguaugauucccagcc

SEQ ID NO: 2638006 - RNA, 20 nt, Human
cagcuuauugucuagugaaa

SEQ ID NO: 2638007 - RNA, 16 nt, Human
caggaaagagaacuuc

SEQ ID NO: 2638008 - RNA, 20 nt, Human
caggaaagagaacuuccaga

SEQ ID NO: 2638009 - RNA, 19 nt, Human
cagacuggauaguccgucu

SEQ ID NO: 2638010 - RNA, 23 nt, Human
cagacuggcacaguuuucugaga

SEQ ID NO: 2638011 - RNA, 22 nt, Human
cagacuggcacaguuuucugag

SEQ ID NO: 2638012 - RNA, 18 nt, Human
cagacuggcacaguuuuc

SEQ ID NO: 2638013 - RNA, 17 nt, Human
cagacuggcacaguuuu

SEQ ID NO: 2638014 - RNA, 20 nt, Human
cagccagacuggcacaguuu

SEQ ID NO: 2638015 - RNA, 23 nt, Human
cagccagcaguucagagcugccc

SEQ ID NO: 2638016 - RNA, 18 nt, Human
cagccagacuggcacagu

SEQ ID NO: 2638017 - RNA, 15 nt, Human
cagccagacuggcac

SEQ ID NO: 2638018 - RNA, 14 nt, Human
cagccagacuggca

SEQ ID NO: 2638019 - RNA, 23 nt, Human
cagagcugcccucuccugggcag

SEQ ID NO: 2638020 - RNA, 18 nt, Human
cagagcugcccucuccug

SEQ ID NO: 2638021 - RNA, 19 nt, Human
cagagcugcccucuccugg

SEQ ID NO: 2638022 - RNA, 20 nt, Human
cagagcugcccucuccuggg

SEQ ID NO: 2638023 - RNA, 21 nt, Human
cagagcugcccucuccugggc

SEQ ID NO: 2638024 - RNA, 22 nt, Human
auugaggacacugauauggguc

SEQ ID NO: 2638025 - RNA, 19 nt, Human
auuuucuauaauuuaaaua

SEQ ID NO: 2638026 - RNA, 18 nt, Human
auuuucuauaauuuaaau

SEQ ID NO: 2638027 - RNA, 17 nt, Human
auuuucuauaauuuaaa

SEQ ID NO: 2638028 - RNA, 19 nt, Human
auuuuuauauuugaaauau

SEQ ID NO: 2638029 - RNA, 16 nt, Human
auuuuuauauuugaaa

SEQ ID NO: 2638030 - RNA, 21 nt, Human
caaaagguauuuuaaucacca

SEQ ID NO: 2638031 - RNA, 16 nt, Human
auuucagcagcugcag

SEQ ID NO: 2638032 - RNA, 21 nt, Human
cacuccagugagacagcucug

SEQ ID NO: 2638033 - RNA, 16 nt, Human
cacuccagugagacag

SEQ ID NO: 2638034 - RNA, 11 nt, Human
cacugaagaag

SEQ ID NO: 2638035 - RNA, 23 nt, Human
cacugaagaagcaccaaucauga

SEQ ID NO: 2638036 - RNA, 23 nt, Human
cacaucagcuugcccuguuaaaa

SEQ ID NO: 2638037 - RNA, 13 nt, Human
cacaucagcuugc

SEQ ID NO: 2638038 - RNA, 14 nt, Human
caagcaaguauuag

SEQ ID NO: 2638039 - RNA, 12 nt, Human
caacuccagaaa

SEQ ID NO: 2638040 - RNA, 19 nt, Human
caacuauauuguuugcuaa

SEQ ID NO: 2638041 - RNA, 19 nt, Human
caacuaucucauuuccaag

SEQ ID NO: 2638042 - RNA, 17 nt, Human
caaucagccuaguugau

SEQ ID NO: 2638043 - RNA, 21 nt, Human
auuuauuuuaauaauguuuca

SEQ ID NO: 2638044 - RNA, 19 nt, Human
auuuauuacuguaagaaaa

SEQ ID NO: 2638045 - RNA, 20 nt, Human
auuuauuacuguaagaaaau

SEQ ID NO: 2638046 - RNA, 22 nt, Human
auuuaccacuuguguuuugcaa

SEQ ID NO: 2638047 - RNA, 15 nt, Human
auuuaccacuugugu

SEQ ID NO: 2638048 - RNA, 17 nt, Human
auuuaaaaaaaaaccug

SEQ ID NO: 2638049 - RNA, 16 nt, Human
auuguaguccuguaau

SEQ ID NO: 2638050 - RNA, 20 nt, Human
auuucuugagguaaaagcau

SEQ ID NO: 2638051 - RNA, 16 nt, Human
auuggagcucguggaa

SEQ ID NO: 2638052 - RNA, 17 nt, Human
auuggagcucgugggac

SEQ ID NO: 2638053 - RNA, 17 nt, Human
auugaaggaugcugucu

SEQ ID NO: 2638054 - RNA, 24 nt, Human
auuccuagaaacugacacaugcug

SEQ ID NO: 2638055 - RNA, 16 nt, Human
uuuucuauaauuuaaa

SEQ ID NO: 2638056 - RNA, 20 nt, Human
uuuucaggcuagauguaugu

SEQ ID NO: 2638057 - RNA, 22 nt, Human
uuuuauggcacuaguauuucua

SEQ ID NO: 2638058 - RNA, 20 nt, Human
augugcuaguaauuggaaag

SEQ ID NO: 2638059 - RNA, 21 nt, Human
augugcuaguaauuggaaagg

SEQ ID NO: 2638060 - RNA, 20 nt, Human
uuugcuggagcucugcccau

SEQ ID NO: 2638061 - RNA, 19 nt, Human
uuugcuaagcauuccaacu

SEQ ID NO: 2638062 - RNA, 19 nt, Human
auguauauuuuauaucaau

SEQ ID NO: 2638063 - RNA, 23 nt, Human
augucgucaaagcugaaauggac

SEQ ID NO: 2638064 - RNA, 17 nt, Human
uuuguaguguuggagaa

SEQ ID NO: 2638065 - RNA, 17 nt, Human
auuccaagugauugaaa

SEQ ID NO: 2638066 - RNA, 20 nt, Human
auuauauggcuugaguuuaa

SEQ ID NO: 2638067 - RNA, 22 nt, Human
auucaaacagucucaggaaauc

SEQ ID NO: 2638068 - RNA, 17 nt, Human
uuuuuauauuugaaaua

SEQ ID NO: 2638069 - RNA, 15 nt, Human
uuuuugaagcuguau

SEQ ID NO: 2638070 - RNA, 15 nt, Human
uuuuguuuucauuau

SEQ ID NO: 2638071 - RNA, 14 nt, Human
uuuugugaagcaaa

SEQ ID NO: 2638072 - RNA, 15 nt, Human
auuacuguaagaaaa

SEQ ID NO: 2638073 - RNA, 16 nt, Human
auuacuguaagaaaau

SEQ ID NO: 2638074 - RNA, 20 nt, Human
uugucaauaaaauccauaca

SEQ ID NO: 2638075 - RNA, 15 nt, Human
augagguacugagag

SEQ ID NO: 2638076 - RNA, 18 nt, Human
augagguacugagaguga

SEQ ID NO: 2638077 - RNA, 17 nt, Human
augagguacugagagug

SEQ ID NO: 2638078 - RNA, 13 nt, Human
augauuucauuca

SEQ ID NO: 2638079 - RNA, 14 nt, Human
augcaaagcacuga

SEQ ID NO: 2638080 - RNA, 13 nt, Human
augcaaagcacug

SEQ ID NO: 2638081 - RNA, 12 nt, Human
augcaaagcacu

SEQ ID NO: 2638082 - RNA, 18 nt, Human
uuuaaaaaaauuccaagu

SEQ ID NO: 2638083 - RNA, 21 nt, Human
uuuaaauauaugcuaagucuu

SEQ ID NO: 2638084 - RNA, 23 nt, Human
augcuguauuuuaaaagaaugau

SEQ ID NO: 2638085 - RNA, 19 nt, Human
augcuguauuuuaaaagaa

SEQ ID NO: 2638086 - RNA, 22 nt, Human
augcuguauuuuaaaagaauga

SEQ ID NO: 2638087 - RNA, 21 nt, Human
augcuucuguuuuauaauuuu

SEQ ID NO: 2638088 - RNA, 19 nt, Human
uuucaaacauauauaacaa

SEQ ID NO: 2638089 - RNA, 19 nt, Human
uuuauaugcuucuguuuua

SEQ ID NO: 2638090 - RNA, 21 nt, Human
uuuauaugcuucuguuuuaua

SEQ ID NO: 2638091 - RNA, 14 nt, Human
augccuuuucccaa

SEQ ID NO: 2638092 - RNA, 20 nt, Human
augccuuuucccaacuccag

SEQ ID NO: 2638093 - RNA, 22 nt, Human
augccuuuucccaacuccagaa

SEQ ID NO: 2638094 - RNA, 18 nt, Human
augcuacaggauuugaaa

SEQ ID NO: 2638095 - RNA, 12 nt, Human
uugacuuuuuau

SEQ ID NO: 2638096 - RNA, 13 nt, Human
uugacaugggaca

SEQ ID NO: 2638097 - RNA, 15 nt, Human
aucucaaaacugcac

SEQ ID NO: 2638098 - RNA, 20 nt, Human
aucucaaaacugcacuguca

SEQ ID NO: 2638099 - RNA, 19 nt, Human
aucucaaaacugcacuguc

SEQ ID NO: 2638100 - RNA, 16 nt, Human
aucuuauaauuuaaaa

SEQ ID NO: 2638101 - RNA, 15 nt, Human
aucuuauaauuuaaa

SEQ ID NO: 2638102 - RNA, 15 nt, Human
uuggagaagaacuga

SEQ ID NO: 2638103 - RNA, 17 nt, Human
uuggagaagaacugaaa

SEQ ID NO: 2638104 - RNA, 22 nt, Human
uuggagaagaacugaaaucaua

SEQ ID NO: 2638105 - RNA, 15 nt, Human
aucuuuaaaauacac

SEQ ID NO: 2638106 - RNA, 12 nt, Human
aucuuuaaaaua

SEQ ID NO: 2638107 - RNA, 18 nt, Human
augaacuuguaaaggaau

SEQ ID NO: 2638108 - RNA, 23 nt, Human
auaugcaaagcacugacuucuaa

SEQ ID NO: 2638109 - RNA, 16 nt, Human
auaugcaaagcacuga

SEQ ID NO: 2638110 - RNA, 17 nt, Human
auagucaaauuguguga

SEQ ID NO: 2638111 - RNA, 18 nt, Human
auagucaaauugugugaa

SEQ ID NO: 2638112 - RNA, 12 nt, Human
auauaacaaugc

SEQ ID NO: 2638113 - RNA, 15 nt, Human
auauaacaaugcugu

SEQ ID NO: 2638114 - RNA, 19 nt, Human
auauaagcuuguauuccuu

SEQ ID NO: 2638115 - RNA, 19 nt, Human
auauauaacaaugcuguau

SEQ ID NO: 2638116 - RNA, 17 nt, Human
auauauaacaaugcugu

SEQ ID NO: 2638117 - RNA, 18 nt, Human
auauauaacaaugcugua

SEQ ID NO: 2638118 - RNA, 15 nt, Human
uucagcccucagaau

SEQ ID NO: 2638119 - RNA, 21 nt, Human
auaggaauugacccacaagaa

SEQ ID NO: 2638120 - RNA, 15 nt, Human
uucaaacauauauaa

SEQ ID NO: 2638121 - RNA, 17 nt, Human
auagcuacuaauuuuaa

SEQ ID NO: 2638122 - RNA, 14 nt, Human
auagcuacuaauuu

SEQ ID NO: 2638123 - RNA, 18 nt, Human
auagcuacuaauuuuaaa

SEQ ID NO: 2638124 - RNA, 17 nt, Human
uuauuguuuaaaaucau

SEQ ID NO: 2638125 - RNA, 14 nt, Human
uucucaacuccaaa

SEQ ID NO: 2638126 - RNA, 18 nt, Human
uucucaacuccaaacuga

SEQ ID NO: 2638127 - RNA, 12 nt, Human
uucugaagaaga

SEQ ID NO: 2638128 - RNA, 13 nt, Human
uucugaagaagau

SEQ ID NO: 2638129 - RNA, 16 nt, Human
uucugcaucagcugcu

SEQ ID NO: 2638130 - RNA, 14 nt, Human
uucugaagaagaug

SEQ ID NO: 2638131 - RNA, 23 nt, Human
uucugcaucagcugcugaaacaa

SEQ ID NO: 2638132 - RNA, 11 nt, Human
aucccucccuc

SEQ ID NO: 2638133 - RNA, 13 nt, Human
aucccucccucca

SEQ ID NO: 2638134 - RNA, 14 nt, Human
aucccucccuccac

SEQ ID NO: 2638135 - RNA, 23 nt, Human
aucccucccuccaccucccugca

SEQ ID NO: 2638136 - RNA, 23 nt, Human
auauuugaaauauugacuuuuua

SEQ ID NO: 2638137 - RNA, 14 nt, Human
auauuugaaauauu

SEQ ID NO: 2638138 - RNA, 19 nt, Human
auauuugaaauauugacuu

SEQ ID NO: 2638139 - RNA, 22 nt, Human
auauuuguaucacaaaucuuaa

SEQ ID NO: 2638140 - RNA, 12 nt, Human
auauuuuaacuu

SEQ ID NO: 2638141 - RNA, 13 nt, Human
auauuugaaauau

SEQ ID NO: 2638142 - RNA, 20 nt, Human
agugaacaaauuuacagaga

SEQ ID NO: 2638143 - RNA, 16 nt, Human
agugaacaaauuuaca

SEQ ID NO: 2638144 - RNA, 15 nt, Human
agugaaagaaaauaa

SEQ ID NO: 2638145 - RNA, 19 nt, Human
ugugagaugcuagaacucc

SEQ ID NO: 2638146 - RNA, 15 nt, Human
ugugagaugcuagaa

SEQ ID NO: 2638147 - RNA, 22 nt, Human
agucucaggaaaucaaauaugc

SEQ ID NO: 2638148 - RNA, 20 nt, Human
uguggucacaggaaguagag

SEQ ID NO: 2638149 - RNA, 13 nt, Human
uguguaaguagau

SEQ ID NO: 2638150 - RNA, 18 nt, Human
uguuccuagugaaagagg

SEQ ID NO: 2638151 - RNA, 14 nt, Human
uguuccuagugaaa

SEQ ID NO: 2638152 - RNA, 15 nt, Human
uguuauaaucuuuca

SEQ ID NO: 2638153 - RNA, 19 nt, Human
uguuuucauuaucucaaaa

SEQ ID NO: 2638154 - RNA, 21 nt, Human
aguucugcagauaaacaguag

SEQ ID NO: 2638155 - RNA, 16 nt, Human
aguucugcagauaaac

SEQ ID NO: 2638156 - RNA, 14 nt, Human
uguuuugcaagcca

SEQ ID NO: 2638157 - RNA, 16 nt, Human
aguucugaagaagaug

SEQ ID NO: 2638158 - RNA, 14 nt, Human
uuaccuuacagaag

SEQ ID NO: 2638159 - RNA, 12 nt, Human
uuaccugggaaa

SEQ ID NO: 2638160 - RNA, 15 nt, Human
uuacuguaagaaaau

SEQ ID NO: 2638161 - RNA, 18 nt, Human
auaaaauccauacauuug

SEQ ID NO: 2638162 - RNA, 19 nt, Human
auaaaauccauacauuugu

SEQ ID NO: 2638163 - RNA, 16 nt, Human
auaaaauaauuuuuau

SEQ ID NO: 2638164 - RNA, 21 nt, Human
auaaaauaauuuuuauauuug

SEQ ID NO: 2638165 - RNA, 22 nt, Human
auaaaauaauuuuuauauuuga

SEQ ID NO: 2638166 - RNA, 18 nt, Human
uuaaguaaugauaacugg

SEQ ID NO: 2638167 - RNA, 22 nt, Human
uuaagaagacugcauuauauuu

SEQ ID NO: 2638168 - RNA, 23 nt, Human
agggaggacgcucucuggccuuc

SEQ ID NO: 2638169 - RNA, 22 nt, Human
agggaggacgcucucuggccuu

SEQ ID NO: 2638170 - RNA, 21 nt, Human
agggaggacgcucucuggccu

SEQ ID NO: 2638171 - RNA, 13 nt, Human
agggaaauuucag

SEQ ID NO: 2638172 - RNA, 16 nt, Human
aggggaauugaggaca

SEQ ID NO: 2638173 - RNA, 18 nt, Human
aggggagcaugggaagug

SEQ ID NO: 2638174 - RNA, 16 nt, Human
uguaaaggaauuuaaa

SEQ ID NO: 2638175 - RNA, 23 nt, Human
uggugugaccacugcagaagaca

SEQ ID NO: 2638176 - RNA, 17 nt, Human
aguaaugauaacuggaa

SEQ ID NO: 2638177 - RNA, 18 nt, Human
aguaaugauaacuggaaa

SEQ ID NO: 2638178 - RNA, 20 nt, Human
aguaaugauaacuggaaacu

SEQ ID NO: 2638179 - RNA, 13 nt, Human
aguaaaauccaca

SEQ ID NO: 2638180 - RNA, 16 nt, Human
uguagaggagaaacug

SEQ ID NO: 2638181 - RNA, 13 nt, Human
uguauuacaaauc

SEQ ID NO: 2638182 - RNA, 22 nt, Human
uguauuacaaauccaaugaaau

SEQ ID NO: 2638183 - RNA, 14 nt, Human
uguaguguuggaga

SEQ ID NO: 2638184 - RNA, 15 nt, Human
uguaguguuggagaa

SEQ ID NO: 2638185 - RNA, 18 nt, Human
uguaucacaaaucuuaac

SEQ ID NO: 2638186 - RNA, 15 nt, Human
uguaucacaaaucuu

SEQ ID NO: 2638187 - RNA, 13 nt, Human
aguagucagacug

SEQ ID NO: 2638188 - RNA, 18 nt, Human
aguauuagaauaccacag

SEQ ID NO: 2638189 - RNA, 18 nt, Human
aguauuucuaugaaauau

SEQ ID NO: 2638190 - RNA, 17 nt, Human
aguauuucuaugaaaua

SEQ ID NO: 2638191 - RNA, 16 nt, Human
aguauuucuaugaaau

SEQ ID NO: 2638192 - RNA, 14 nt, Human
agucaccucaugga

SEQ ID NO: 2638193 - RNA, 15 nt, Human
agucaccucauggaa

SEQ ID NO: 2638194 - RNA, 17 nt, Human
agucaccucauggaauu

SEQ ID NO: 2638195 - RNA, 14 nt, Human
agcuguucacagcc

SEQ ID NO: 2638196 - RNA, 20 nt, Human
ugcccuguuaaaagaugaaa

SEQ ID NO: 2638197 - RNA, 13 nt, Human
agcugcccucucc

SEQ ID NO: 2638198 - RNA, 14 nt, Human
agcugcccucuccu

SEQ ID NO: 2638199 - RNA, 15 nt, Human
agcugcccucuccug

SEQ ID NO: 2638200 - RNA, 16 nt, Human
agcugcccucuccugg

SEQ ID NO: 2638201 - RNA, 22 nt, Human
aggaaaucaaauaugcaaagca

SEQ ID NO: 2638202 - RNA, 21 nt, Human
aggaaaucaaauaugcaaagc

SEQ ID NO: 2638203 - RNA, 20 nt, Human
aggaaaucaaauaugcaaag

SEQ ID NO: 2638204 - RNA, 20 nt, Human
agcuugcccuggugccucac

SEQ ID NO: 2638205 - RNA, 19 nt, Human
agcuugcccuguuaaaaga

SEQ ID NO: 2638206 - RNA, 18 nt, Human
agcuugcccuguuaaaag

SEQ ID NO: 2638207 - RNA, 16 nt, Human
agcuugcccuguuaaa

SEQ ID NO: 2638208 - RNA, 17 nt, Human
ugccuuuucccaacucc

SEQ ID NO: 2638209 - RNA, 19 nt, Human
ugccuuuucccaacuccag

SEQ ID NO: 2638210 - RNA, 15 nt, Human
ugcuacaaaaacaca

SEQ ID NO: 2638211 - RNA, 14 nt, Human
ugcuacaaaaacac

SEQ ID NO: 2638212 - RNA, 20 nt, Human
aggcauuuaggccaugggac

SEQ ID NO: 2638213 - RNA, 15 nt, Human
aggcagcuugaaacu

SEQ ID NO: 2638214 - RNA, 21 nt, Human
uggagcucgugggacagucac

SEQ ID NO: 2638215 - RNA, 17 nt, Human
uggagcucguggaacag

SEQ ID NO: 2638216 - RNA, 21 nt, Human
uggagcucguggaacaguuac

SEQ ID NO: 2638217 - RNA, 15 nt, Human
aggcccccaggugcc

SEQ ID NO: 2638218 - RNA, 14 nt, Human
uggaguugaaaauc

SEQ ID NO: 2638219 - RNA, 17 nt, Human
ugcuuuuaaaaaaaaau

SEQ ID NO: 2638220 - RNA, 17 nt, Human
aggagaaacuggaacuc

SEQ ID NO: 2638221 - RNA, 19 nt, Human
aggagaaacuggaacucuc

SEQ ID NO: 2638222 - RNA, 18 nt, Human
aggagaaacuggaacucu

SEQ ID NO: 2638223 - RNA, 14 nt, Human
aggacgcucucugg

SEQ ID NO: 2638224 - RNA, 13 nt, Human
aggacgcucucug

SEQ ID NO: 2638225 - RNA, 20 nt, Human
aggacgcucucuggccuucg

SEQ ID NO: 2638226 - RNA, 19 nt, Human
aggacgcucucuggccuuc

SEQ ID NO: 2638227 - RNA, 17 nt, Human
aggacgcucucuggccu

SEQ ID NO: 2638228 - RNA, 16 nt, Human
aggacgcucucuggcc

SEQ ID NO: 2638229 - RNA, 15 nt, Human
ugcacuccagccuga

SEQ ID NO: 2638230 - RNA, 17 nt, Human
ugcacuccagccugagc

SEQ ID NO: 2638231 - RNA, 22 nt, Human
ugcagaagacaguauggcagcu

SEQ ID NO: 2638232 - RNA, 18 nt, Human
agccccgugggguuccuc

SEQ ID NO: 2638233 - RNA, 15 nt, Human
ugcaagccagauuuu

SEQ ID NO: 2638234 - RNA, 21 nt, Human
ugcaagccagauuuuccugaa

SEQ ID NO: 2638235 - RNA, 17 nt, Human
ugcaauaaaauggguuu

SEQ ID NO: 2638236 - RNA, 21 nt, Human
ugcaauaaaauggguuuuacu

SEQ ID NO: 2638237 - RNA, 13 nt, Human
ugauuucauucaa

SEQ ID NO: 2638238 - RNA, 18 nt, Human
ugcaaagcacugacuucu

SEQ ID NO: 2638239 - RNA, 22 nt, Human
ugcaaagcacugacuucuaagu

SEQ ID NO: 2638240 - RNA, 20 nt, Human
ugcaaagcacugacuucuaa

SEQ ID NO: 2638241 - RNA, 17 nt, Human
ugccaguuauggcuaua

SEQ ID NO: 2638242 - RNA, 13 nt, Human
ugccauaauuacu

SEQ ID NO: 2638243 - RNA, 20 nt, Human
ugcauagauucccugagcag

SEQ ID NO: 2638244 - RNA, 13 nt, Human
ugcauacucauua

SEQ ID NO: 2638245 - RNA, 19 nt, Human
ugcauacucauuaggaugg

SEQ ID NO: 2638246 - RNA, 17 nt, Human
agcagucaggaaagaga

SEQ ID NO: 2638247 - RNA, 18 nt, Human
agcagucaggaaagagaa

SEQ ID NO: 2638248 - RNA, 22 nt, Human
agcaguuugguuucuagcauga

SEQ ID NO: 2638249 - RNA, 23 nt, Human
agcaguuugguuucuagcaugaa

SEQ ID NO: 2638250 - RNA, 20 nt, Human
agcaguuugguuucuagcau

SEQ ID NO: 2638251 - RNA, 19 nt, Human
agcagucaggaaagagaac

SEQ ID NO: 2638252 - RNA, 13 nt, Human
agcauaccaacac

SEQ ID NO: 2638253 - RNA, 22 nt, Human
agcauaccaacacgagcaggcu

SEQ ID NO: 2638254 - RNA, 19 nt, Human
agcauaccaacacgagcag

SEQ ID NO: 2638255 - RNA, 19 nt, Human
agcagggcauggcugggaa

SEQ ID NO: 2638256 - RNA, 20 nt, Human
agcaggaagcugugagagca

SEQ ID NO: 2638257 - RNA, 14 nt, Human
agcaggcuacuguc

SEQ ID NO: 2638258 - RNA, 20 nt, Human
agcaggcuacugucagcucc

SEQ ID NO: 2638259 - RNA, 19 nt, Human
agcaggcuacugucagcuc

SEQ ID NO: 2638260 - RNA, 17 nt, Human
agcaggcuacugucagc

SEQ ID NO: 2638261 - RNA, 16 nt, Human
agcaggcuacugucag

SEQ ID NO: 2638262 - RNA, 16 nt, Human
ugauuaaguaaugaua

SEQ ID NO: 2638263 - RNA, 15 nt, Human
ugauuaaguaaugau

SEQ ID NO: 2638264 - RNA, 20 nt, Human
agcaucacaugaacuuguaa

SEQ ID NO: 2638265 - RNA, 22 nt, Human
agcauuuagauguauagguuga

SEQ ID NO: 2638266 - RNA, 23 nt, Human
ugaacuagaguuuagcuggaaaa

SEQ ID NO: 2638267 - RNA, 18 nt, Human
ugaacaaauuuacagaga

SEQ ID NO: 2638268 - RNA, 20 nt, Human
ugaacaaauuuacagagaca

SEQ ID NO: 2638269 - RNA, 19 nt, Human
ugaacaaauuuacagagac

SEQ ID NO: 2638270 - RNA, 22 nt, Human
agagcugcccucuccugggcag

SEQ ID NO: 2638271 - RNA, 21 nt, Human
agagcuguucacagccagacu

SEQ ID NO: 2638272 - RNA, 15 nt, Human
agagguugcagugag

SEQ ID NO: 2638273 - RNA, 18 nt, Human
ugaaauauuauguuaaaa

SEQ ID NO: 2638274 - RNA, 15 nt, Human
ugaaauuguauuaca

SEQ ID NO: 2638275 - RNA, 15 nt, Human
agagcugcccucucc

SEQ ID NO: 2638276 - RNA, 13 nt, Human
agagcugcccucu

SEQ ID NO: 2638277 - RNA, 14 nt, Human
agagcugcccucuc

SEQ ID NO: 2638278 - RNA, 23 nt, Human
ugaaauaagccagacaucaacag

SEQ ID NO: 2638279 - RNA, 20 nt, Human
ugaaauaagccagacaucaa

SEQ ID NO: 2638280 - RNA, 18 nt, Human
ugaaauaagccagacauc

SEQ ID NO: 2638281 - RNA, 17 nt, Human
ugaaauaagccagacau

SEQ ID NO: 2638282 - RNA, 16 nt, Human
agaguuuagcuggaaa

SEQ ID NO: 2638283 - RNA, 17 nt, Human
agaguuuagcuggaaaa

SEQ ID NO: 2638284 - RNA, 17 nt, Human
ugacccacaagaaauga

SEQ ID NO: 2638285 - RNA, 17 nt, Human
agaugcaguucugaaga

SEQ ID NO: 2638286 - RNA, 18 nt, Human
agaugcaguucugaagaa

SEQ ID NO: 2638287 - RNA, 19 nt, Human
agaugcaguucugaagaag

SEQ ID NO: 2638288 - RNA, 15 nt, Human
agaugcuagaacucc

SEQ ID NO: 2638289 - RNA, 14 nt, Human
agaugcuagaacuc

SEQ ID NO: 2638290 - RNA, 23 nt, Human
agacuauucaaacagucucagga

SEQ ID NO: 2638291 - RNA, 16 nt, Human
ucuuauuucauuucuu

SEQ ID NO: 2638292 - RNA, 15 nt, Human
ucuuauuucauuucu

SEQ ID NO: 2638293 - RNA, 24 nt, Human
agagacagaaagcagaacagugau

SEQ ID NO: 2638294 - RNA, 23 nt, Human
ucuuagaugcaguucugaagaag

SEQ ID NO: 2638295 - RNA, 22 nt, Human
ucuuagaugcaguucugaagaa

SEQ ID NO: 2638296 - RNA, 16 nt, Human
agacacacugaagaag

SEQ ID NO: 2638297 - RNA, 17 nt, Human
agacacacugaagaagc

SEQ ID NO: 2638298 - RNA, 23 nt, Human
ucucuggccuucggccuccaucc

SEQ ID NO: 2638299 - RNA, 22 nt, Human
ucucuggccuucggccuccauc

SEQ ID NO: 2638300 - RNA, 21 nt, Human
ucucuggccuucggccuccau

SEQ ID NO: 2638301 - RNA, 12 nt, Human
ucucuggccuuc

SEQ ID NO: 2638302 - RNA, 12 nt, Human
ucugaagaagau

SEQ ID NO: 2638303 - RNA, 14 nt, Human
agaaaugaaagcag

SEQ ID NO: 2638304 - RNA, 23 nt, Human
acuucuaaguaaaaccacagcag

SEQ ID NO: 2638305 - RNA, 16 nt, Human
acuugucaauaaaauc

SEQ ID NO: 2638306 - RNA, 20 nt, Human
acuugaacccgggaggcaga

SEQ ID NO: 2638307 - RNA, 19 nt, Human
acuugaacccgggaggcag

SEQ ID NO: 2638308 - RNA, 21 nt, Human
acuugaacccauauuuguaca

SEQ ID NO: 2638309 - RNA, 12 nt, Human
ucucaggaaauc

SEQ ID NO: 2638310 - RNA, 16 nt, Human
acuuguguuuugcaag

SEQ ID NO: 2638311 - RNA, 20 nt, Human
ucuaaagccauuguaguccu

SEQ ID NO: 2638312 - RNA, 16 nt, Human
ucuacauacuauggaa

SEQ ID NO: 2638313 - RNA, 23 nt, Human
ucuaaguaaaaccacagcaguug

SEQ ID NO: 2638314 - RNA, 22 nt, Human
ucuaaguaaaaccacagcaguu

SEQ ID NO: 2638315 - RNA, 21 nt, Human
ucuaaguaaaaccacagcagu

SEQ ID NO: 2638316 - RNA, 22 nt, Human
ucggguuuuauuguuuaaaauc

SEQ ID NO: 2638317 - RNA, 18 nt, Human
acuguggguagacacaca

SEQ ID NO: 2638318 - RNA, 21 nt, Human
acugucagcuccccucggaga

SEQ ID NO: 2638319 - RNA, 18 nt, Human
acugggacaggggagaac

SEQ ID NO: 2638320 - RNA, 13 nt, Human
acuggcacaguuu

SEQ ID NO: 2638321 - RNA, 20 nt, Human
acuggcacaguuuucugaga

SEQ ID NO: 2638322 - RNA, 19 nt, Human
acuggcacaguuuucugag

SEQ ID NO: 2638323 - RNA, 13 nt, Human
acugccuucucaa

SEQ ID NO: 2638324 - RNA, 19 nt, Human
acugccuucucaacuccaa

SEQ ID NO: 2638325 - RNA, 20 nt, Human
acugccuucucaacuccaaa

SEQ ID NO: 2638326 - RNA, 14 nt, Human
acugcauuauauuu

SEQ ID NO: 2638327 - RNA, 15 nt, Human
acugcauuauauuua

SEQ ID NO: 2638328 - RNA, 18 nt, Human
ucgcuccaccuugcagcu

SEQ ID NO: 2638329 - RNA, 14 nt, Human
acuccaaagaaaug

SEQ ID NO: 2638330 - RNA, 18 nt, Human
acuccaaagaaauguaag

SEQ ID NO: 2638331 - RNA, 15 nt, Human
acuccaaagaaaugu

SEQ ID NO: 2638332 - RNA, 21 nt, Human
acuccaaagaaauguaaggga

SEQ ID NO: 2638333 - RNA, 16 nt, Human
uccccucggagaagag

SEQ ID NO: 2638334 - RNA, 17 nt, Human
uccccucggagaagagc

SEQ ID NO: 2638335 - RNA, 13 nt, Human
ucccucccuccac

SEQ ID NO: 2638336 - RNA, 14 nt, Human
ucccucccuccacc

SEQ ID NO: 2638337 - RNA, 21 nt, Human
ucccuccaccucccugcaaua

SEQ ID NO: 2638338 - RNA, 23 nt, Human
ucccuccaccucccugcaauaaa

SEQ ID NO: 2638339 - RNA, 15 nt, Human
ucccucccuccaccu

SEQ ID NO: 2638340 - RNA, 16 nt, Human
ucccucccuccaccuc

SEQ ID NO: 2638341 - RNA, 17 nt, Human
ucccucccuccaccucc

SEQ ID NO: 2638342 - RNA, 11 nt, Human
ucccugagcag

SEQ ID NO: 2638343 - RNA, 17 nt, Human
ucccagccagcaguuca

SEQ ID NO: 2638344 - RNA, 18 nt, Human
ucccagccagcaguucag

SEQ ID NO: 2638345 - RNA, 22 nt, Human
ucccagucauuuaauaaaugug

SEQ ID NO: 2638346 - RNA, 14 nt, Human
ucccagucauuuaa

SEQ ID NO: 2638347 - RNA, 13 nt, Human
uccaugaagaugu

SEQ ID NO: 2638348 - RNA, 21 nt, Human
uccaugaagauguagaggaga

SEQ ID NO: 2638349 - RNA, 19 nt, Human
uccauccugaggcuccacu

SEQ ID NO: 2638350 - RNA, 21 nt, Human
uccauccugaggcuccacuug

SEQ ID NO: 2638351 - RNA, 20 nt, Human
uccauccugaggcuccacuu

SEQ ID NO: 2638352 - RNA, 21 nt, Human
ucaugaauuaguuuuauaugc

SEQ ID NO: 2638353 - RNA, 12 nt, Human
accucccugcaa

SEQ ID NO: 2638354 - RNA, 13 nt, Human
accucccugcaau

SEQ ID NO: 2638355 - RNA, 16 nt, Human
ucaugaauuaguuuua

SEQ ID NO: 2638356 - RNA, 23 nt, Human
ucaggaaaucaaauaugcaaagc

SEQ ID NO: 2638357 - RNA, 22 nt, Human
ucaggaaaucaaauaugcaaag

SEQ ID NO: 2638358 - RNA, 21 nt, Human
accuagggugauauuaaccag

SEQ ID NO: 2638359 - RNA, 20 nt, Human
acgagcaggcuacugucagc

SEQ ID NO: 2638360 - RNA, 19 nt, Human
acgagcaggcuacugucag

SEQ ID NO: 2638361 - RNA, 14 nt, Human
acgagaaaacaaua

SEQ ID NO: 2638362 - RNA, 13 nt, Human
uauuucauuucuu

SEQ ID NO: 2638363 - RNA, 21 nt, Human
uaugaaauauuauguuaaaac

SEQ ID NO: 2638364 - RNA, 21 nt, Human
acaguuuucugagaaagacua

SEQ ID NO: 2638365 - RNA, 20 nt, Human
acaguuuucugagaaagacu

SEQ ID NO: 2638366 - RNA, 19 nt, Human
acaguuuucugagaaagac

SEQ ID NO: 2638367 - RNA, 18 nt, Human
acaguuuucugagaaaga

SEQ ID NO: 2638368 - RNA, 15 nt, Human
acaguuuucugagaa

SEQ ID NO: 2638369 - RNA, 17 nt, Human
acaguuuucugagaaag

SEQ ID NO: 2638370 - RNA, 16 nt, Human
acaguuuucugagaaa

SEQ ID NO: 2638371 - RNA, 13 nt, Human
acaucaacagaua

SEQ ID NO: 2638372 - RNA, 18 nt, Human
acauagaauuaacacaug

SEQ ID NO: 2638373 - RNA, 14 nt, Human
acauagaauuaaca

SEQ ID NO: 2638374 - RNA, 19 nt, Human
acauauauaacaaugcugu

SEQ ID NO: 2638375 - RNA, 14 nt, Human
ucaaagcugaaaug

SEQ ID NO: 2638376 - RNA, 19 nt, Human
acaugauccugcaauucca

SEQ ID NO: 2638377 - RNA, 18 nt, Human
ucaaaagaaagaaaauca

SEQ ID NO: 2638378 - RNA, 21 nt, Human
ucaaaauaccaugccauuuaa

SEQ ID NO: 2638379 - RNA, 23 nt, Human
ucaaaauaccaugccauuuaaag

SEQ ID NO: 2638380 - RNA, 21 nt, Human
ucaaaauaugccccauucaac

SEQ ID NO: 2638381 - RNA, 14 nt, Human
acaugcugaacauc

SEQ ID NO: 2638382 - RNA, 21 nt, Human
acaugcugaacaucacagcuu

SEQ ID NO: 2638383 - RNA, 22 nt, Human
ucaagaugaugaugaucuuuaa

SEQ ID NO: 2638384 - RNA, 13 nt, Human
ucaggaaagagaa

SEQ ID NO: 2638385 - RNA, 19 nt, Human
ucaggaaagagaacuucca

SEQ ID NO: 2638386 - RNA, 21 nt, Human
ucaggaaaucaaauaugcaaa

SEQ ID NO: 2638387 - RNA, 20 nt, Human
ucaggaaaucaaauaugcaa

SEQ ID NO: 2638388 - RNA, 12 nt, Human
ucagagcugccc

SEQ ID NO: 2638389 - RNA, 23 nt, Human
accauuucuugagguaaaagcau

SEQ ID NO: 2638390 - RNA, 14 nt, Human
accagggacugagg

SEQ ID NO: 2638391 - RNA, 18 nt, Human
accacuuguguuuugcaa

SEQ ID NO: 2638392 - RNA, 23 nt, Human
ucaauuuuucuuauuucauuucu

SEQ ID NO: 2638393 - RNA, 20 nt, Human
ucaauuuuucuuauuucauu

SEQ ID NO: 2638394 - RNA, 15 nt, Human
ucaauucuugccaaa

SEQ ID NO: 2638395 - RNA, 13 nt, Human
accaaucaugaau

SEQ ID NO: 2638396 - RNA, 15 nt, Human
accaaucaugaauua

SEQ ID NO: 2638397 - RNA, 14 nt, Human
acaaugcuguauuu

SEQ ID NO: 2638398 - RNA, 17 nt, Human
acaaugcuguauuuuaa

SEQ ID NO: 2638399 - RNA, 14 nt, Human
acacaacuauauug

SEQ ID NO: 2638400 - RNA, 17 nt, Human
acacaacuauauuguuu

SEQ ID NO: 2638401 - RNA, 13 nt, Human
acacacugaagaa

SEQ ID NO: 2638402 - RNA, 20 nt, Human
acacacucaaaucaagaaac

SEQ ID NO: 2638403 - RNA, 14 nt, Human
acacacugaagaag

SEQ ID NO: 2638404 - RNA, 12 nt, Human
uaguguuggaga

SEQ ID NO: 2638405 - RNA, 16 nt, Human
uaguguuggagaagaa

SEQ ID NO: 2638406 - RNA, 17 nt, Human
uaguguuggagaagaac

SEQ ID NO: 2638407 - RNA, 18 nt, Human
acacaugcugaacaucac

SEQ ID NO: 2638408 - RNA, 17 nt, Human
acacuaagagagaauga

SEQ ID NO: 2638409 - RNA, 18 nt, Human
acacuaagagagaaugag

SEQ ID NO: 2638410 - RNA, 19 nt, Human
acacuaagagagaaugaga

SEQ ID NO: 2638411 - RNA, 12 nt, Human
acacugaagaag

SEQ ID NO: 2638412 - RNA, 14 nt, Human
acacugaagaagca

SEQ ID NO: 2638413 - RNA, 14 nt, Human
acacuccagugaga

SEQ ID NO: 2638414 - RNA, 15 nt, Human
acacuuaaaaauggu

SEQ ID NO: 2638415 - RNA, 13 nt, Human
acacuuaaaaaug

SEQ ID NO: 2638416 - RNA, 12 nt, Human
uauauuuacaaa

SEQ ID NO: 2638417 - RNA, 19 nt, Human
uauauuuauuacuguaaga

SEQ ID NO: 2638418 - RNA, 15 nt, Human
uauauuuauuacugu

SEQ ID NO: 2638419 - RNA, 20 nt, Human
acagcccuucuuuccacaga

SEQ ID NO: 2638420 - RNA, 21 nt, Human
acagcccuucuuuccacagaa

SEQ ID NO: 2638421 - RNA, 19 nt, Human
aauuucucccagucauuua

SEQ ID NO: 2638422 - RNA, 15 nt, Human
aauuggagcucgugg

SEQ ID NO: 2638423 - RNA, 18 nt, Human
aauuuacagagacagaaa

SEQ ID NO: 2638424 - RNA, 17 nt, Human
aauuuacagagacagaa

SEQ ID NO: 2638425 - RNA, 19 nt, Human
uacuucuuaggguuaugau

SEQ ID NO: 2638426 - RNA, 18 nt, Human
uacuaaaaauacaaaaaa

SEQ ID NO: 2638427 - RNA, 14 nt, Human
uacuaaaaauacaa

SEQ ID NO: 2638428 - RNA, 19 nt, Human
uacugagagugaacaaauu

SEQ ID NO: 2638429 - RNA, 23 nt, Human
uacugggaaagggauuuucagcc

SEQ ID NO: 2638430 - RNA, 17 nt, Human
uacugagagugaacaaa

SEQ ID NO: 2638431 - RNA, 18 nt, Human
aauugaggacacugauau

SEQ ID NO: 2638432 - RNA, 22 nt, Human
acaagcucacagaccuuugaac

SEQ ID NO: 2638433 - RNA, 17 nt, Human
acaaauuuacagagaca

SEQ ID NO: 2638434 - RNA, 16 nt, Human
uagcuacuaauuuuaa

SEQ ID NO: 2638435 - RNA, 17 nt, Human
uagauaggccaugggca

SEQ ID NO: 2638436 - RNA, 22 nt, Human
uagauaggucagugcaaauacu

SEQ ID NO: 2638437 - RNA, 21 nt, Human
uagaugcaguucugaagaaga

SEQ ID NO: 2638438 - RNA, 20 nt, Human
uagaugcaguucugaagaag

SEQ ID NO: 2638439 - RNA, 21 nt, Human
aauuuuucuuauuucauuucu

SEQ ID NO: 2638440 - RNA, 22 nt, Human
aauuuuuucucuaggaaauauu

SEQ ID NO: 2638441 - RNA, 15 nt, Human
aauaacgauaaaaga

SEQ ID NO: 2638442 - RNA, 21 nt, Human
aauaacaaugaaaguugauaa

SEQ ID NO: 2638443 - RNA, 16 nt, Human
aauaauuuuuauauuu

SEQ ID NO: 2638444 - RNA, 17 nt, Human
aauaauuuuuauauuug

SEQ ID NO: 2638445 - RNA, 19 nt, Human
aauaauuuuuauauuugaa

SEQ ID NO: 2638446 - RNA, 20 nt, Human
aauaauuuuuauauuugaaa

SEQ ID NO: 2638447 - RNA, 18 nt, Human
aauaggcguaacuaauuu

SEQ ID NO: 2638448 - RNA, 15 nt, Human
aauaucacuugucaa

SEQ ID NO: 2638449 - RNA, 12 nt, Human
aauaucacuugu

SEQ ID NO: 2638450 - RNA, 19 nt, Human
aauaucuuuuuuuuaauaa

SEQ ID NO: 2638451 - RNA, 15 nt, Human
aauauuucagauaau

SEQ ID NO: 2638452 - RNA, 14 nt, Human
aauauuucagauaa

SEQ ID NO: 2638453 - RNA, 24 nt, Human
aauaugcaaagcacugacuucuaa

SEQ ID NO: 2638454 - RNA, 17 nt, Human
aauaugcaaagcacuga

SEQ ID NO: 2638455 - RNA, 15 nt, Human
aauaugcaaagcacu

SEQ ID NO: 2638456 - RNA, 16 nt, Human
aaucuuauaauuuaaa

SEQ ID NO: 2638457 - RNA, 14 nt, Human
aaucuuauaauuua

SEQ ID NO: 2638458 - RNA, 13 nt, Human
aauccuugaagau

SEQ ID NO: 2638459 - RNA, 15 nt, Human
aaucaucaagucuuu

SEQ ID NO: 2638460 - RNA, 23 nt, Human
aaucaugaauuaguuuuauaugc

SEQ ID NO: 2638461 - RNA, 19 nt, Human
aaucaugaauuaguuuuau

SEQ ID NO: 2638462 - RNA, 17 nt, Human
aaucaugaauuaguuuu

SEQ ID NO: 2638463 - RNA, 18 nt, Human
uaaguuuuuuuuuaaaaa

SEQ ID NO: 2638464 - RNA, 21 nt, Human
aaugagagacacacugaagaa

SEQ ID NO: 2638465 - RNA, 16 nt, Human
uaaugauaacuggaaa

SEQ ID NO: 2638466 - RNA, 14 nt, Human
uacaaaaacacagc

SEQ ID NO: 2638467 - RNA, 13 nt, Human
uacaaaaacacag

SEQ ID NO: 2638468 - RNA, 16 nt, Human
uacaaaaacacagcaa

SEQ ID NO: 2638469 - RNA, 15 nt, Human
uacaaaaacacagca

SEQ ID NO: 2638470 - RNA, 11 nt, Human
aaugugauaug

SEQ ID NO: 2638471 - RNA, 19 nt, Human
aauggacuuuuguacauag

SEQ ID NO: 2638472 - RNA, 19 nt, Human
uacacuaagagagaaugag

SEQ ID NO: 2638473 - RNA, 22 nt, Human
aagaagugaaaaucuacacucc

SEQ ID NO: 2638474 - RNA, 16 nt, Human
aagaagugaaaaucua

SEQ ID NO: 2638475 - RNA, 18 nt, Human
gugcuaguaauuggaaag

SEQ ID NO: 2638476 - RNA, 18 nt, Human
aagaaugauuaugaauua

SEQ ID NO: 2638477 - RNA, 16 nt, Human
aagaaugauuaugaau

SEQ ID NO: 2638478 - RNA, 13 nt, Human
aagacuauucaaa

SEQ ID NO: 2638479 - RNA, 21 nt, Human
gugggacagucaccucaugga

SEQ ID NO: 2638480 - RNA, 21 nt, Human
gugugaccacugcagaagaca

SEQ ID NO: 2638481 - RNA, 23 nt, Human
guuuucugagaaagacuauucaa

SEQ ID NO: 2638482 - RNA, 21 nt, Human
guuucaaacauauauaacaau

SEQ ID NO: 2638483 - RNA, 13 nt, Human
aagguacuucaaa

SEQ ID NO: 2638484 - RNA, 18 nt, Human
guuguaccgcaaugugac

SEQ ID NO: 2638485 - RNA, 16 nt, Human
guuuaaaaucauuucu

SEQ ID NO: 2638486 - RNA, 10 nt, Human
guuuaaaauc

SEQ ID NO: 2638487 - RNA, 23 nt, Human
aagcuuguauuccuuuuucucuc

SEQ ID NO: 2638488 - RNA, 13 nt, Human
guugacaugggac

SEQ ID NO: 2638489 - RNA, 14 nt, Human
guugacaugggaca

SEQ ID NO: 2638490 - RNA, 18 nt, Human
guugacaugggacauuug

SEQ ID NO: 2638491 - RNA, 21 nt, Human
gucuuaauuaaaagaauauuu

SEQ ID NO: 2638492 - RNA, 19 nt, Human
gucuuaauuaaaagaauau

SEQ ID NO: 2638493 - RNA, 22 nt, Human
gucuuaauuaaaagaauauuuu

SEQ ID NO: 2638494 - RNA, 14 nt, Human
aacuccagaaagug

SEQ ID NO: 2638495 - RNA, 21 nt, Human
aacuccagaaagugacaagcu

SEQ ID NO: 2638496 - RNA, 15 nt, Human
gugaacacaucagcu

SEQ ID NO: 2638497 - RNA, 14 nt, Human
aacucccuuucaac

SEQ ID NO: 2638498 - RNA, 13 nt, Human
aacucccuuucaa

SEQ ID NO: 2638499 - RNA, 18 nt, Human
aacucguuaauuuguagu

SEQ ID NO: 2638500 - RNA, 20 nt, Human
aacccauauuuguacaccaa

SEQ ID NO: 2638501 - RNA, 13 nt, Human
aacccaaauguuc

SEQ ID NO: 2638502 - RNA, 18 nt, Human
aacccaaauguucaucaa

SEQ ID NO: 2638503 - RNA, 20 nt, Human
aaccuagggugauauuaacc

SEQ ID NO: 2638504 - RNA, 12 nt, Human
aaccacagcagu

SEQ ID NO: 2638505 - RNA, 21 nt, Human
guccaagcauuuagauguaua

SEQ ID NO: 2638506 - RNA, 24 nt, Human
guccaagcauaccaacacgagcag

SEQ ID NO: 2638507 - RNA, 15 nt, Human
aacaaggaugaauua

SEQ ID NO: 2638508 - RNA, 21 nt, Human
aacaagccuccuuuuaaagua

SEQ ID NO: 2638509 - RNA, 22 nt, Human
aacaguagugauaguuguaccg

SEQ ID NO: 2638510 - RNA, 18 nt, Human
aacauuugguaaggggaa

SEQ ID NO: 2638511 - RNA, 19 nt, Human
aaauggcuuccuggcaaua

SEQ ID NO: 2638512 - RNA, 14 nt, Human
aaaugcauuucuaa

SEQ ID NO: 2638513 - RNA, 22 nt, Human
aaaugaaagcagggacuugaac

SEQ ID NO: 2638514 - RNA, 21 nt, Human
aaaugaaagcagggacuugaa

SEQ ID NO: 2638515 - RNA, 19 nt, Human
aaaucuacacuccagugag

SEQ ID NO: 2638516 - RNA, 14 nt, Human
aaauccuugaagau

SEQ ID NO: 2638517 - RNA, 22 nt, Human
aaauguaagggaaacugccagc

SEQ ID NO: 2638518 - RNA, 14 nt, Human
guaugauucccagc

SEQ ID NO: 2638519 - RNA, 18 nt, Human
aaauuucagcagcugcag

SEQ ID NO: 2638520 - RNA, 17 nt, Human
aaauuucagcagcugca

SEQ ID NO: 2638521 - RNA, 13 nt, Human
cacaagaaaugaa

SEQ ID NO: 2638522 - RNA, 15 nt, Human
cacaagaaaugaaag

SEQ ID NO: 2638523 - RNA, 23 nt, Human
cacaagacccaaaaggcagaagc

SEQ ID NO: 2638524 - RNA, 23 nt, Human
cacaagaaaugaaagcagggacu

SEQ ID NO: 2638525 - RNA, 23 nt, Human
caaauuuacagagacagaaagca

SEQ ID NO: 2638526 - RNA, 17 nt, Human
caaauuuacagagacag

SEQ ID NO: 2638527 - RNA, 16 nt, Human
caaauuuacagagaca

SEQ ID NO: 2638528 - RNA, 19 nt, Human
caagacugcacaucaaaau

SEQ ID NO: 2638529 - RNA, 13 nt, Human
caagaaaugaaag

SEQ ID NO: 2638530 - RNA, 16 nt, Human
caagcauuuagaugua

SEQ ID NO: 2638531 - RNA, 19 nt, Human
caagcauuuagauguauag

SEQ ID NO: 2638532 - RNA, 21 nt, Human
caagcauaccaacacgagcag

SEQ ID NO: 2638533 - RNA, 16 nt, Human
caagcauaccaacacg

SEQ ID NO: 2638534 - RNA, 18 nt, Human
auuuuaauaauguuucaa

SEQ ID NO: 2638535 - RNA, 19 nt, Human
auuuuaauaauguuucaaa

SEQ ID NO: 2638536 - RNA, 14 nt, Human
caaagaaauguaag

SEQ ID NO: 2638537 - RNA, 22 nt, Human
cacaguuuucugagaaagacua

SEQ ID NO: 2638538 - RNA, 21 nt, Human
cacaguuuucugagaaagacu

SEQ ID NO: 2638539 - RNA, 16 nt, Human
cacaugaaguccaagc

SEQ ID NO: 2638540 - RNA, 17 nt, Human
cacaugaaguccaagca

SEQ ID NO: 2638541 - RNA, 20 nt, Human
cacaugaaguccaagcauuu

SEQ ID NO: 2638542 - RNA, 13 nt, Human
uuuuccugaaaac

SEQ ID NO: 2638543 - RNA, 20 nt, Human
uuuuauaucaauuuaaaaaa

SEQ ID NO: 2638544 - RNA, 15 nt, Human
uuuuauaugcuucug

SEQ ID NO: 2638545 - RNA, 20 nt, Human
uuuuauaugcuucuguuuua

SEQ ID NO: 2638546 - RNA, 10 nt, Human
uuuuauauuu

SEQ ID NO: 2638547 - RNA, 21 nt, Human
uuugcauagauucccugagca

SEQ ID NO: 2638548 - RNA, 21 nt, Human
uuuguauaaaauaauuuuuau

SEQ ID NO: 2638549 - RNA, 15 nt, Human
uuucagauaaucaca

SEQ ID NO: 2638550 - RNA, 21 nt, Human
uuucagauaaucacaauacau

SEQ ID NO: 2638551 - RNA, 15 nt, Human
uuucagcagcugcag

SEQ ID NO: 2638552 - RNA, 22 nt, Human
uuuccucaaaacuucagacaua

SEQ ID NO: 2638553 - RNA, 22 nt, Human
uuucugagaaagacuauucaaa

SEQ ID NO: 2638554 - RNA, 20 nt, Human
uuuagaaacacaacuauauu

SEQ ID NO: 2638555 - RNA, 12 nt, Human
uuuagaaacaca

SEQ ID NO: 2638556 - RNA, 21 nt, Human
uucagagcugcccucuccugg

SEQ ID NO: 2638557 - RNA, 22 nt, Human
uucagagcugcccucuccuggg

SEQ ID NO: 2638558 - RNA, 23 nt, Human
uucagagcugcccucuccugggc

SEQ ID NO: 2638559 - RNA, 19 nt, Human
uuccacuuauaggaauuga

SEQ ID NO: 2638560 - RNA, 19 nt, Human
uucggccuccauccugagg

SEQ ID NO: 2638561 - RNA, 18 nt, Human
uucggccuccauccugag

SEQ ID NO: 2638562 - RNA, 22 nt, Human
uucggccuccauccugaggcuc

SEQ ID NO: 2638563 - RNA, 12 nt, Human
uuccuagugaaa

SEQ ID NO: 2638564 - RNA, 18 nt, Human
uucccuugaugaagaagu

SEQ ID NO: 2638565 - RNA, 23 nt, Human
uucucuccucuccccaugauguu

SEQ ID NO: 2638566 - RNA, 15 nt, Human
uucuuauuucauuuc

SEQ ID NO: 2638567 - RNA, 15 nt, Human
uucugagaaagacua

SEQ ID NO: 2638568 - RNA, 14 nt, Human
uucugagcauuuaa

SEQ ID NO: 2638569 - RNA, 23 nt, Human
uugaaacugagaugugaacacau

SEQ ID NO: 2638570 - RNA, 23 nt, Human
uugaaaagacuccaaagaaaugu

SEQ ID NO: 2638571 - RNA, 22 nt, Human
uugaaaagacuccaaagaaaug

SEQ ID NO: 2638572 - RNA, 18 nt, Human
uugaaaagacuccaaaga

SEQ ID NO: 2638573 - RNA, 16 nt, Human
uugaaaagacuccaaa

SEQ ID NO: 2638574 - RNA, 12 nt, Human
uugaugaagaag

SEQ ID NO: 2638575 - RNA, 18 nt, Human
uugcauagauucccugag

SEQ ID NO: 2638576 - RNA, 15 nt, Human
uugaggacacugaua

SEQ ID NO: 2638577 - RNA, 14 nt, Human
uugaggacacugau

SEQ ID NO: 2638578 - RNA, 12 nt, Human
uugggaggcuga

SEQ ID NO: 2638579 - RNA, 16 nt, Human
uuguaaaggaauuuaa

SEQ ID NO: 2638580 - RNA, 11 nt, Human
uuguaaaugug

SEQ ID NO: 2638581 - RNA, 18 nt, Human
uuguaaaugugcuuuuaa

SEQ ID NO: 2638582 - RNA, 14 nt, Human
uuguaaaugugcuu

SEQ ID NO: 2638583 - RNA, 19 nt, Human
uuguaucacaaaucuuaac

SEQ ID NO: 2638584 - RNA, 14 nt, Human
uuguauuacaaauc

SEQ ID NO: 2638585 - RNA, 14 nt, Human
ugugcguccugucg

SEQ ID NO: 2638586 - RNA, 22 nt, Human
ugucucaguccaugaagaugua

SEQ ID NO: 2638587 - RNA, 21 nt, Human
ugucucaguccaugaagaugu

SEQ ID NO: 2638588 - RNA, 22 nt, Human
ugugaccacugcagaagacagu

SEQ ID NO: 2638589 - RNA, 14 nt, Human
uguaaucacagcua

SEQ ID NO: 2638590 - RNA, 15 nt, Human
uguaaucacagcuac

SEQ ID NO: 2638591 - RNA, 17 nt, Human
uguagauaauacaguuc

SEQ ID NO: 2638592 - RNA, 15 nt, Human
uguaccgcaauguga

SEQ ID NO: 2638593 - RNA, 16 nt, Human
uguaugauucccagcc

SEQ ID NO: 2638594 - RNA, 19 nt, Human
ugugugcguccugucggag

SEQ ID NO: 2638595 - RNA, 14 nt, Human
uguuagugcaaauu

SEQ ID NO: 2638596 - RNA, 12 nt, Human
uguuauaaucuu

SEQ ID NO: 2638597 - RNA, 16 nt, Human
uguucacagccagacu

SEQ ID NO: 2638598 - RNA, 13 nt, Human
uguuuaaaaucau

SEQ ID NO: 2638599 - RNA, 14 nt, Human
uguuuaaaaucauu

SEQ ID NO: 2638600 - RNA, 21 nt, Human
uguuggagaagaacugaaauc

SEQ ID NO: 2638601 - RNA, 20 nt, Human
uuaaagcuuauuaaaacuca

SEQ ID NO: 2638602 - RNA, 13 nt, Human
uuaaaagaaugau

SEQ ID NO: 2638603 - RNA, 19 nt, Human
uuaaaagaaugauuaugaa

SEQ ID NO: 2638604 - RNA, 21 nt, Human
uuaccacuuguguuuugcaag

SEQ ID NO: 2638605 - RNA, 20 nt, Human
uuacagagacagaaagcaga

SEQ ID NO: 2638606 - RNA, 14 nt, Human
uuacauuuguauaa

SEQ ID NO: 2638607 - RNA, 15 nt, Human
uuacauuuguauaaa

SEQ ID NO: 2638608 - RNA, 22 nt, Human
uuaaugucaauucuugccaaau

SEQ ID NO: 2638609 - RNA, 18 nt, Human
uuaauaauguuucaaaca

SEQ ID NO: 2638610 - RNA, 16 nt, Human
uuaauaauguuucaaa

SEQ ID NO: 2638611 - RNA, 18 nt, Human
ugcuagaacucccuuuca

SEQ ID NO: 2638612 - RNA, 19 nt, Human
ugcuagaacucccuuucaa

SEQ ID NO: 2638613 - RNA, 21 nt, Human
ugcuagaacucccuuucaaca

SEQ ID NO: 2638614 - RNA, 20 nt, Human
ugcuagaacucccuuucaac

SEQ ID NO: 2638615 - RNA, 11 nt, Human
ugcucauggaa

SEQ ID NO: 2638616 - RNA, 22 nt, Human
ugccuucucaacuccaaacuga

SEQ ID NO: 2638617 - RNA, 17 nt, Human
ugccuucucaacuccaa

SEQ ID NO: 2638618 - RNA, 18 nt, Human
ugccuccccuccucugcu

SEQ ID NO: 2638619 - RNA, 23 nt, Human
ugccuccccuccucugcuugcca

SEQ ID NO: 2638620 - RNA, 19 nt, Human
ugccuccccuccucugcuu

SEQ ID NO: 2638621 - RNA, 22 nt, Human
ugccuccccuccucugcuugcc

SEQ ID NO: 2638622 - RNA, 16 nt, Human
ugcagauaaacaguag

SEQ ID NO: 2638623 - RNA, 17 nt, Human
ugcagauaaacaguagu

SEQ ID NO: 2638624 - RNA, 15 nt, Human
ugcacaucaaaauau

SEQ ID NO: 2638625 - RNA, 14 nt, Human
ugcauuauauuuau

SEQ ID NO: 2638626 - RNA, 20 nt, Human
ugcauuauauuuauuacugu

SEQ ID NO: 2638627 - RNA, 15 nt, Human
ugcauuauauuuauu

SEQ ID NO: 2638628 - RNA, 22 nt, Human
ugcaucagcugcugaaacaaca

SEQ ID NO: 2638629 - RNA, 21 nt, Human
ugccaucccucccuccaccuc

SEQ ID NO: 2638630 - RNA, 22 nt, Human
ugccaucccucccuccaccucc

SEQ ID NO: 2638631 - RNA, 15 nt, Human
ugccaucccucccuc

SEQ ID NO: 2638632 - RNA, 19 nt, Human
ugccaucccucccuccacc

SEQ ID NO: 2638633 - RNA, 20 nt, Human
ugccaucccucccuccaccu

SEQ ID NO: 2638634 - RNA, 18 nt, Human
uggccuucggccuccauc

SEQ ID NO: 2638635 - RNA, 17 nt, Human
uggccuucggccuccau

SEQ ID NO: 2638636 - RNA, 19 nt, Human
ugggacauuugcucaugga

SEQ ID NO: 2638637 - RNA, 20 nt, Human
ugggacauuugcucauggaa

SEQ ID NO: 2638638 - RNA, 18 nt, Human
ugggacagucaccucaug

SEQ ID NO: 2638639 - RNA, 20 nt, Human
ugggacagucaccucaugga

SEQ ID NO: 2638640 - RNA, 21 nt, Human
ugggacagucaccucauggaa

SEQ ID NO: 2638641 - RNA, 17 nt, Human
uggguagacacacauga

SEQ ID NO: 2638642 - RNA, 16 nt, Human
uggguagacacacaug

SEQ ID NO: 2638643 - RNA, 14 nt, Human
ugcuucuguuuuau

SEQ ID NO: 2638644 - RNA, 14 nt, Human
uggaacucucgagc

SEQ ID NO: 2638645 - RNA, 22 nt, Human
ucuguuuuauaauuuugugaag

SEQ ID NO: 2638646 - RNA, 20 nt, Human
ucuguuuuauaauuuuguga

SEQ ID NO: 2638647 - RNA, 19 nt, Human
ucuguaauaaacucauuuc

SEQ ID NO: 2638648 - RNA, 23 nt, Human
ucuguaauaaacucauuucuagc

SEQ ID NO: 2638649 - RNA, 24 nt, Human
ucuguaauaaacucauuucuagca

SEQ ID NO: 2638650 - RNA, 23 nt, Human
ucuggccuucggccuccauccug

SEQ ID NO: 2638651 - RNA, 22 nt, Human
ugaaaagacuccaaagaaaugu

SEQ ID NO: 2638652 - RNA, 18 nt, Human
ugaaacccugucucuacu

SEQ ID NO: 2638653 - RNA, 23 nt, Human
ugaaagcagggacuugaacccau

SEQ ID NO: 2638654 - RNA, 19 nt, Human
ugaaagcagggacuugaac

SEQ ID NO: 2638655 - RNA, 18 nt, Human
ugaaagcagggacuugaa

SEQ ID NO: 2638656 - RNA, 19 nt, Human
ugaaaacuuuaugcuaagu

SEQ ID NO: 2638657 - RNA, 19 nt, Human
ugaaaagacuccaaagaaa

SEQ ID NO: 2638658 - RNA, 17 nt, Human
ugaaaagacuccaaaga

SEQ ID NO: 2638659 - RNA, 16 nt, Human
ugaaaagacuccaaag

SEQ ID NO: 2638660 - RNA, 15 nt, Human
ugaaaagacuccaaa

SEQ ID NO: 2638661 - RNA, 21 nt, Human
ugaaguccaagcauuuagaug

SEQ ID NO: 2638662 - RNA, 22 nt, Human
ugaaguccaagcauuuagaugu

SEQ ID NO: 2638663 - RNA, 22 nt, Human
ugaacuuguaaaggaauuuaaa

SEQ ID NO: 2638664 - RNA, 14 nt, Human
ugaacacaucagcu

SEQ ID NO: 2638665 - RNA, 19 nt, Human
ugaaauggacuuuuguaca

SEQ ID NO: 2638666 - RNA, 15 nt, Human
uccuugcaucaauuu

SEQ ID NO: 2638667 - RNA, 17 nt, Human
ucuacacuccagugaga

SEQ ID NO: 2638668 - RNA, 21 nt, Human
ucuacacuaagagagaaugag

SEQ ID NO: 2638669 - RNA, 14 nt, Human
ucuccugggcagcu

SEQ ID NO: 2638670 - RNA, 13 nt, Human
ucuccugggcagc

SEQ ID NO: 2638671 - RNA, 15 nt, Human
ucuccugggcagcug

SEQ ID NO: 2638672 - RNA, 16 nt, Human
ucuccugggcagcugc

SEQ ID NO: 2638673 - RNA, 17 nt, Human
ucuccugggcagcugcc

SEQ ID NO: 2638674 - RNA, 18 nt, Human
ucuccugggcagcugccu

SEQ ID NO: 2638675 - RNA, 21 nt, Human
ucucagugucaaugcagcccc

SEQ ID NO: 2638676 - RNA, 21 nt, Human
ucuccugggcagcugccuccc

SEQ ID NO: 2638677 - RNA, 19 nt, Human
ucuccugggcagcugccuc

SEQ ID NO: 2638678 - RNA, 20 nt, Human
ucuccugggcagcugccucc

SEQ ID NO: 2638679 - RNA, 13 nt, Human
ucucuaggaaaua

SEQ ID NO: 2638680 - RNA, 19 nt, Human
ucucuaggaaauauuuauu

SEQ ID NO: 2638681 - RNA, 18 nt, Human
ucucuucacagucacauu

SEQ ID NO: 2638682 - RNA, 13 nt, Human
uccacuuggucug

SEQ ID NO: 2638683 - RNA, 12 nt, Human
uccacuuggucu

SEQ ID NO: 2638684 - RNA, 14 nt, Human
uccagauccuggaa

SEQ ID NO: 2638685 - RNA, 16 nt, Human
uccagauccuggaaau

SEQ ID NO: 2638686 - RNA, 17 nt, Human
uccagauccuggaaauc

SEQ ID NO: 2638687 - RNA, 23 nt, Human
uccaccucccugcaauaaaaugg

SEQ ID NO: 2638688 - RNA, 12 nt, Human
uccaccucccug

SEQ ID NO: 2638689 - RNA, 14 nt, Human
uccaccuacaugag

SEQ ID NO: 2638690 - RNA, 20 nt, Human
uccaagcauuuagauguaua

SEQ ID NO: 2638691 - RNA, 17 nt, Human
uccaagcauuuagaugu

SEQ ID NO: 2638692 - RNA, 23 nt, Human
uccaagcauaccaacacgagcag

SEQ ID NO: 2638693 - RNA, 12 nt, Human
uccaaagaaaug

SEQ ID NO: 2638694 - RNA, 23 nt, Human
uccaaacugacucuuaagaagac

SEQ ID NO: 2638695 - RNA, 14 nt, Human
ucauuucuuugagu

SEQ ID NO: 2638696 - RNA, 22 nt, Human
ucauuucugcaucagcugcuga

SEQ ID NO: 2638697 - RNA, 16 nt, Human
ucauuucugcaucagc

SEQ ID NO: 2638698 - RNA, 16 nt, Human
ucccaaauuucauacc

SEQ ID NO: 2638699 - RNA, 22 nt, Human
ucagacauagaauuaacacaug

SEQ ID NO: 2638700 - RNA, 19 nt, Human
ucagacauagaauuaacac

SEQ ID NO: 2638701 - RNA, 17 nt, Human
ucacuugucaauaaaau

SEQ ID NO: 2638702 - RNA, 19 nt, Human
ucaacuccaaacugacucu

SEQ ID NO: 2638703 - RNA, 23 nt, Human
ucacaggacagcccuucuuucca

SEQ ID NO: 2638704 - RNA, 19 nt, Human
ucacaggaaguagaggagg

SEQ ID NO: 2638705 - RNA, 14 nt, Human
ucacaggaaguaga

SEQ ID NO: 2638706 - RNA, 22 nt, Human
uauuucuaugaaauauuauguu

SEQ ID NO: 2638707 - RNA, 21 nt, Human
uauuucuaugaaauauuaugu

SEQ ID NO: 2638708 - RNA, 13 nt, Human
ucaaaacugcacu

SEQ ID NO: 2638709 - RNA, 20 nt, Human
guuuaggauguugaaaaagu

SEQ ID NO: 2638710 - RNA, 17 nt, Human
guuuagaaagcuugccc

SEQ ID NO: 2638711 - RNA, 13 nt, Human
guuuagaaagcuu

SEQ ID NO: 2638712 - RNA, 16 nt, Human
guuuucauuaucucaa

SEQ ID NO: 2638713 - RNA, 18 nt, Human
guuuucaggcuagaugua

SEQ ID NO: 2638714 - RNA, 16 nt, Human
uaaaaaagaaacauuu

SEQ ID NO: 2638715 - RNA, 19 nt, Human
uaaaauccauacauuugug

SEQ ID NO: 2638716 - RNA, 18 nt, Human
uaaaauccauacauuugu

SEQ ID NO: 2638717 - RNA, 14 nt, Human
uaaaagaugaaaau

SEQ ID NO: 2638718 - RNA, 17 nt, Human
uaaaauggguuuuacug

SEQ ID NO: 2638719 - RNA, 18 nt, Human
uaaauauaugcuaagucu

SEQ ID NO: 2638720 - RNA, 17 nt, Human
uaaauaaaaauaauccu

SEQ ID NO: 2638721 - RNA, 14 nt, Human
uaaaggaauuuaaa

SEQ ID NO: 2638722 - RNA, 23 nt, Human
uaaauugacacuuaaaaaugguu

SEQ ID NO: 2638723 - RNA, 23 nt, Human
uaagagggauuagggagagaaga

SEQ ID NO: 2638724 - RNA, 21 nt, Human
uaagccagacaucaacagaua

SEQ ID NO: 2638725 - RNA, 20 nt, Human
uaagccagacaucaacagau

SEQ ID NO: 2638726 - RNA, 20 nt, Human
uaagcauuccaacuaucuca

SEQ ID NO: 2638727 - RNA, 16 nt, Human
uaagcauuccaacuau

SEQ ID NO: 2638728 - RNA, 18 nt, Human
uaagcauuccaacuaucu

SEQ ID NO: 2638729 - RNA, 13 nt, Human
uaagccagacauc

SEQ ID NO: 2638730 - RNA, 20 nt, Human
uaauuuguaguguuggagaa

SEQ ID NO: 2638731 - RNA, 23 nt, Human
uaauuuguaguguuggagaagaa

SEQ ID NO: 2638732 - RNA, 22 nt, Human
uaauuggaaaggcagcucuaaa

SEQ ID NO: 2638733 - RNA, 20 nt, Human
uaauuaaaagaauauuuuaa

SEQ ID NO: 2638734 - RNA, 15 nt, Human
uaauguuucaaacau

SEQ ID NO: 2638735 - RNA, 14 nt, Human
uaauguuucaaaca

SEQ ID NO: 2638736 - RNA, 19 nt, Human
uaaugccacuaaauugaca

SEQ ID NO: 2638737 - RNA, 15 nt, Human
uaauaauguuucaaa

SEQ ID NO: 2638738 - RNA, 23 nt, Human
uacugauguuccuagugaaagag

SEQ ID NO: 2638739 - RNA, 23 nt, Human
uaccuuuguucccaaauuucaua

SEQ ID NO: 2638740 - RNA, 23 nt, Human
uaccacaggaaccacaagacugc

SEQ ID NO: 2638741 - RNA, 16 nt, Human
uaccaacacgagcagg

SEQ ID NO: 2638742 - RNA, 22 nt, Human
uacaugagguacugagagugaa

SEQ ID NO: 2638743 - RNA, 21 nt, Human
uacaugagguacugagaguga

SEQ ID NO: 2638744 - RNA, 17 nt, Human
uacauuuguauaaaaua

SEQ ID NO: 2638745 - RNA, 11 nt, Human
uacauuugugu

SEQ ID NO: 2638746 - RNA, 16 nt, Human
uacauuuguauaaaau

SEQ ID NO: 2638747 - RNA, 14 nt, Human
uacaggauuugaaa

SEQ ID NO: 2638748 - RNA, 13 nt, Human
uacagaauuuuau

SEQ ID NO: 2638749 - RNA, 13 nt, Human
uaggccaugggac

SEQ ID NO: 2638750 - RNA, 20 nt, Human
uaggaauugacccacaagaa

SEQ ID NO: 2638751 - RNA, 23 nt, Human
uaggaauugacccacaagaaaug

SEQ ID NO: 2638752 - RNA, 20 nt, Human
uagcagggcauggcugggaa

SEQ ID NO: 2638753 - RNA, 20 nt, Human
uagauguauguacuucaugc

SEQ ID NO: 2638754 - RNA, 16 nt, Human
uagauguauguacuuc

SEQ ID NO: 2638755 - RNA, 17 nt, Human
uagaguuuagcuggaaa

SEQ ID NO: 2638756 - RNA, 18 nt, Human
uagaguuuagcuggaaaa

SEQ ID NO: 2638757 - RNA, 13 nt, Human
uauauuugaaaua

SEQ ID NO: 2638758 - RNA, 14 nt, Human
uauauuugaaauau

SEQ ID NO: 2638759 - RNA, 20 nt, Human
uauauuuauuacuguaagaa

SEQ ID NO: 2638760 - RNA, 23 nt, Human
uauauuuauuacuguaagaaaau

SEQ ID NO: 2638761 - RNA, 19 nt, Human
uauauuuuuuguuaaauga

SEQ ID NO: 2638762 - RNA, 21 nt, Human
uaguuguaccgcaaugugacu

SEQ ID NO: 2638763 - RNA, 18 nt, Human
uagucaaauugugugaaa

SEQ ID NO: 2638764 - RNA, 19 nt, Human
ggaggacgcucucuggccu

SEQ ID NO: 2638765 - RNA, 21 nt, Human
ggaggacgcucucuggccuuc

SEQ ID NO: 2638766 - RNA, 20 nt, Human
ggaggacgcucucuggccuu

SEQ ID NO: 2638767 - RNA, 22 nt, Human
ggcagcugccuccccuccucug

SEQ ID NO: 2638768 - RNA, 18 nt, Human
ggcagcugccuccccucc

SEQ ID NO: 2638769 - RNA, 21 nt, Human
ggcagcugccuccccuccucu

SEQ ID NO: 2638770 - RNA, 22 nt, Human
ggccaugggacagggaggacgc

SEQ ID NO: 2638771 - RNA, 22 nt, Human
gcuguauuuuaaaagaaugauu

SEQ ID NO: 2638772 - RNA, 18 nt, Human
gcuagauguauguacuuc

SEQ ID NO: 2638773 - RNA, 16 nt, Human
ggaaaucaaauaugca

SEQ ID NO: 2638774 - RNA, 17 nt, Human
ggaaauauuuauuuuaa

SEQ ID NO: 2638775 - RNA, 18 nt, Human
ggaaauauuuauuuuaau

SEQ ID NO: 2638776 - RNA, 12 nt, Human
ggaaauauuuau

SEQ ID NO: 2638777 - RNA, 13 nt, Human
ggaaauauuuauu

SEQ ID NO: 2638778 - RNA, 15 nt, Human
ggaaauauuuauuuu

SEQ ID NO: 2638779 - RNA, 20 nt, Human
ggaaaaaauaacaaugaaag

SEQ ID NO: 2638780 - RNA, 17 nt, Human
gcuuuuaaaaaaaaaua

SEQ ID NO: 2638781 - RNA, 23 nt, Human
gcuguucacagccagacuggcac

SEQ ID NO: 2638782 - RNA, 16 nt, Human
gcuguucacagccaga

SEQ ID NO: 2638783 - RNA, 15 nt, Human
gcuguucacagccag

SEQ ID NO: 2638784 - RNA, 18 nt, Human
gcuugccaucccucccuc

SEQ ID NO: 2638785 - RNA, 21 nt, Human
gcuugccaucccucccuccac

SEQ ID NO: 2638786 - RNA, 19 nt, Human
gcuugcccuggugccucac

SEQ ID NO: 2638787 - RNA, 17 nt, Human
gcuugcccuggugccuc

SEQ ID NO: 2638788 - RNA, 18 nt, Human
gcuugcccuguuaaaaga

SEQ ID NO: 2638789 - RNA, 16 nt, Human
gcuugccaucccuccc

SEQ ID NO: 2638790 - RNA, 22 nt, Human
ggcuugaguuuaaauuguaaua

SEQ ID NO: 2638791 - RNA, 23 nt, Human
ggugcuacaaaaacacagcaagg

SEQ ID NO: 2638792 - RNA, 21 nt, Human
ggugcuacaaaaacacagcaa

SEQ ID NO: 2638793 - RNA, 19 nt, Human
gccuucggccuccauccug

SEQ ID NO: 2638794 - RNA, 18 nt, Human
gccuuggggcugaugcag

SEQ ID NO: 2638795 - RNA, 18 nt, Human
gccuucggccuccauccu

SEQ ID NO: 2638796 - RNA, 22 nt, Human
gcgacagugagacucugucuca

SEQ ID NO: 2638797 - RNA, 18 nt, Human
gccuguaaucacagcuac

SEQ ID NO: 2638798 - RNA, 22 nt, Human
gcguccugucggagcccugucu

SEQ ID NO: 2638799 - RNA, 19 nt, Human
gcguccugucggagcccug

SEQ ID NO: 2638800 - RNA, 11 nt, Human
gccuccccucc

SEQ ID NO: 2638801 - RNA, 12 nt, Human
gccuccccuccu

SEQ ID NO: 2638802 - RNA, 13 nt, Human
gccuccccuccuc

SEQ ID NO: 2638803 - RNA, 14 nt, Human
gccuccccuccucu

SEQ ID NO: 2638804 - RNA, 16 nt, Human
gccuccccuccucugc

SEQ ID NO: 2638805 - RNA, 19 nt, Human
gcccuucuuuccacagaag

SEQ ID NO: 2638806 - RNA, 17 nt, Human
gccccgugggguuccuc

SEQ ID NO: 2638807 - RNA, 19 nt, Human
gccccugcacuccagccug

SEQ ID NO: 2638808 - RNA, 15 nt, Human
gcccucuccugggca

SEQ ID NO: 2638809 - RNA, 16 nt, Human
gcccucuccugggcag

SEQ ID NO: 2638810 - RNA, 18 nt, Human
gcccucuccugggcagcu

SEQ ID NO: 2638811 - RNA, 19 nt, Human
gcccucuccugggcagcug

SEQ ID NO: 2638812 - RNA, 21 nt, Human
gcccucuccugggcagcugcc

SEQ ID NO: 2638813 - RNA, 22 nt, Human
gccacguucuuacuaguuuccc

SEQ ID NO: 2638814 - RNA, 11 nt, Human
gccaucccucc

SEQ ID NO: 2638815 - RNA, 13 nt, Human
gccaucccucccu

SEQ ID NO: 2638816 - RNA, 14 nt, Human
gccaucccucccuc

SEQ ID NO: 2638817 - RNA, 19 nt, Human
gccaugggacagggaggac

SEQ ID NO: 2638818 - RNA, 14 nt, Human
gccaugggacaggg

SEQ ID NO: 2638819 - RNA, 15 nt, Human
gccaucccucccucc

SEQ ID NO: 2638820 - RNA, 16 nt, Human
gccaucccucccucca

SEQ ID NO: 2638821 - RNA, 22 nt, Human
gccauuuaaagcuuauuaaaac

SEQ ID NO: 2638822 - RNA, 16 nt, Human
gcccacagcuguauga

SEQ ID NO: 2638823 - RNA, 18 nt, Human
gcauagauucccugagca

SEQ ID NO: 2638824 - RNA, 13 nt, Human
gcaguucugaaga

SEQ ID NO: 2638825 - RNA, 14 nt, Human
gcaguucugaagaa

SEQ ID NO: 2638826 - RNA, 15 nt, Human
gcaggcuacugucag

SEQ ID NO: 2638827 - RNA, 20 nt, Human
gcacagccucuuagaugcag

SEQ ID NO: 2638828 - RNA, 14 nt, Human
gcagaagacaguau

SEQ ID NO: 2638829 - RNA, 15 nt, Human
gcacugucaagauga

SEQ ID NO: 2638830 - RNA, 16 nt, Human
gcaagaugugggcagu

SEQ ID NO: 2638831 - RNA, 12 nt, Human
gcaagauguggg

SEQ ID NO: 2638832 - RNA, 16 nt, Human
gaugcuagaacucccu

SEQ ID NO: 2638833 - RNA, 22 nt, Human
gauuaaguaaugauaacuggaa

SEQ ID NO: 2638834 - RNA, 14 nt, Human
gauuaaguaaugau

SEQ ID NO: 2638835 - RNA, 13 nt, Human
gaucuuuaaaaua

SEQ ID NO: 2638836 - RNA, 14 nt, Human
gauccuggaaauca

SEQ ID NO: 2638837 - RNA, 13 nt, Human
gauaaacaguagu

SEQ ID NO: 2638838 - RNA, 17 nt, Human
gauaggucagugcaaau

SEQ ID NO: 2638839 - RNA, 23 nt, Human
gaucagcuuauugucuagugaaa

SEQ ID NO: 2638840 - RNA, 16 nt, Human
gaauauuuuaacuucc

SEQ ID NO: 2638841 - RNA, 16 nt, Human
gaaguauccuucagcc

SEQ ID NO: 2638842 - RNA, 14 nt, Human
gaaguauccuucag

SEQ ID NO: 2638843 - RNA, 12 nt, Human
gaaguccaagca

SEQ ID NO: 2638844 - RNA, 22 nt, Human
gaaguccaagcauuuagaugua

SEQ ID NO: 2638845 - RNA, 19 nt, Human
gaagacugcauuauauuua

SEQ ID NO: 2638846 - RNA, 12 nt, Human
gaagaacugaaa

SEQ ID NO: 2638847 - RNA, 18 nt, Human
gaagauguagaggagaaa

SEQ ID NO: 2638848 - RNA, 15 nt, Human
gaacauaaaauacaa

SEQ ID NO: 2638849 - RNA, 14 nt, Human
gaacaucacagcuu

SEQ ID NO: 2638850 - RNA, 20 nt, Human
gaacagugauuaccagggac

SEQ ID NO: 2638851 - RNA, 16 nt, Human
gaacagugauuaccag

SEQ ID NO: 2638852 - RNA, 16 nt, Human
gaaauuguauuacaaa

SEQ ID NO: 2638853 - RNA, 18 nt, Human
gaaauuguauuacaaauc

SEQ ID NO: 2638854 - RNA, 24 nt, Human
gacugcauuauauuuauuacugua

SEQ ID NO: 2638855 - RNA, 16 nt, Human
gacugaggggagggga

SEQ ID NO: 2638856 - RNA, 22 nt, Human
gacuggauaguccgucucugcu

SEQ ID NO: 2638857 - RNA, 14 nt, Human
gacuggcacaguuu

SEQ ID NO: 2638858 - RNA, 17 nt, Human
gacuggauaguccgucu

SEQ ID NO: 2638859 - RNA, 22 nt, Human
gacuggcacaguuuucugagaa

SEQ ID NO: 2638860 - RNA, 18 nt, Human
gacuggcacaguuuucug

SEQ ID NO: 2638861 - RNA, 21 nt, Human
gacagagccccacccucagau

SEQ ID NO: 2638862 - RNA, 23 nt, Human
gacaggaugguucccuugaugaa

SEQ ID NO: 2638863 - RNA, 20 nt, Human
gacccaaaaggcagaagcaa

SEQ ID NO: 2638864 - RNA, 19 nt, Human
gacccaaaaggcagaagca

SEQ ID NO: 2638865 - RNA, 18 nt, Human
gacccaaaaggcagaagc

SEQ ID NO: 2638866 - RNA, 18 nt, Human
gaccacugcagaagacag

SEQ ID NO: 2638867 - RNA, 16 nt, Human
gaccacugcagaagac

SEQ ID NO: 2638868 - RNA, 16 nt, Human
cuuggacucauuuuaa

SEQ ID NO: 2638869 - RNA, 16 nt, Human
cuuggggcugaugcag

SEQ ID NO: 2638870 - RNA, 18 nt, Human
cuuggggcugaugcaguu

SEQ ID NO: 2638871 - RNA, 17 nt, Human
cuuguacuuuauuuucu

SEQ ID NO: 2638872 - RNA, 22 nt, Human
cuugcccuguuaaaagaugaaa

SEQ ID NO: 2638873 - RNA, 20 nt, Human
cuugcuugauuguauggugg

SEQ ID NO: 2638874 - RNA, 17 nt, Human
cuugccaucccucccuc

SEQ ID NO: 2638875 - RNA, 15 nt, Human
cuugccaucccuccc

SEQ ID NO: 2638876 - RNA, 16 nt, Human
cuugccaucccucccu

SEQ ID NO: 2638877 - RNA, 19 nt, Human
cuugccaucccucccucca

SEQ ID NO: 2638878 - RNA, 18 nt, Human
cuugcccuggugccucac

SEQ ID NO: 2638879 - RNA, 14 nt, Human
cuugcccuguuaaa

SEQ ID NO: 2638880 - RNA, 14 nt, Human
cuugccaucccucc

SEQ ID NO: 2638881 - RNA, 22 nt, Human
cuugcagcucuccccuucucug

SEQ ID NO: 2638882 - RNA, 20 nt, Human
gaaaaguauguuagugcaaa

SEQ ID NO: 2638883 - RNA, 14 nt, Human
gaaaaguauguuag

SEQ ID NO: 2638884 - RNA, 19 nt, Human
gaaaauaacaauaaaagac

SEQ ID NO: 2638885 - RNA, 14 nt, Human
gaaaacaaggauga

SEQ ID NO: 2638886 - RNA, 19 nt, Human
cuuuccucaaaacuucaga

SEQ ID NO: 2638887 - RNA, 17 nt, Human
cuucggccuccauccug

SEQ ID NO: 2638888 - RNA, 19 nt, Human
cuucggccuccauccugag

SEQ ID NO: 2638889 - RNA, 18 nt, Human
cuucggccuccauccuga

SEQ ID NO: 2638890 - RNA, 19 nt, Human
cuuccuuggacucauuuua

SEQ ID NO: 2638891 - RNA, 19 nt, Human
cuuccagauccuggaaauc

SEQ ID NO: 2638892 - RNA, 18 nt, Human
cuucagcgguuuauauaa

SEQ ID NO: 2638893 - RNA, 19 nt, Human
cuguuuuauaauuuuguga

SEQ ID NO: 2638894 - RNA, 18 nt, Human
cuuaaugccacuaaauug

SEQ ID NO: 2638895 - RNA, 21 nt, Human
cuuaggguuaugauuaaguaa

SEQ ID NO: 2638896 - RNA, 13 nt, Human
cuuauaauuuaaa

SEQ ID NO: 2638897 - RNA, 19 nt, Human
cuuauaggaauugacccac

SEQ ID NO: 2638898 - RNA, 14 nt, Human
cuuauaauuuaaaa

SEQ ID NO: 2638899 - RNA, 19 nt, Human
cuuacuaguuucccuugca

SEQ ID NO: 2638900 - RNA, 19 nt, Human
cuuagaugcaguucugaag

SEQ ID NO: 2638901 - RNA, 13 nt, Human
cucuuaagaagac

SEQ ID NO: 2638902 - RNA, 23 nt, Human
cucugcauacucauuaggauggc

SEQ ID NO: 2638903 - RNA, 21 nt, Human
cucuccugggcagcugccucc

SEQ ID NO: 2638904 - RNA, 23 nt, Human
cuccaccucccugcaauaaaaug

SEQ ID NO: 2638905 - RNA, 14 nt, Human
cuccaccucccugc

SEQ ID NO: 2638906 - RNA, 15 nt, Human
cuccaccucccugca

SEQ ID NO: 2638907 - RNA, 16 nt, Human
cuccaccucccugcaa

SEQ ID NO: 2638908 - RNA, 17 nt, Human
cuccaccucccugcaau

SEQ ID NO: 2638909 - RNA, 17 nt, Human
cucccagucauuuaaua

SEQ ID NO: 2638910 - RNA, 23 nt, Human
cuccauccugaggcuccacuugg

SEQ ID NO: 2638911 - RNA, 20 nt, Human
cuccauccugaggcuccacu

SEQ ID NO: 2638912 - RNA, 21 nt, Human
cuccauccugaggcuccacuu

SEQ ID NO: 2638913 - RNA, 18 nt, Human
cucauuaggauggcuagu

SEQ ID NO: 2638914 - RNA, 17 nt, Human
cucauuaggauggcuag

SEQ ID NO: 2638915 - RNA, 12 nt, Human
cucggagaagag

SEQ ID NO: 2638916 - RNA, 20 nt, Human
cucggagaagagcuguucac

SEQ ID NO: 2638917 - RNA, 13 nt, Human
cucggagaagagc

SEQ ID NO: 2638918 - RNA, 12 nt, Human
cucccuuucaac

SEQ ID NO: 2638919 - RNA, 13 nt, Human
cucccuuucaaca

SEQ ID NO: 2638920 - RNA, 16 nt, Human
cucccuucucuucaca

SEQ ID NO: 2638921 - RNA, 21 nt, Human
cugauguuccuagugaaagag

SEQ ID NO: 2638922 - RNA, 20 nt, Human
cugauguuccuagugaaaga

SEQ ID NO: 2638923 - RNA, 18 nt, Human
cugauguuccuagugaaa

SEQ ID NO: 2638924 - RNA, 13 nt, Human
cugauguuccuag

SEQ ID NO: 2638925 - RNA, 23 nt, Human
cugcagaagacaguauggcagcu

SEQ ID NO: 2638926 - RNA, 13 nt, Human
cugcagaagacag

SEQ ID NO: 2638927 - RNA, 15 nt, Human
cugccuaagugcagc

SEQ ID NO: 2638928 - RNA, 16 nt, Human
cuggccaacgggguga

SEQ ID NO: 2638929 - RNA, 19 nt, Human
cuggcacaguuuucugaga

SEQ ID NO: 2638930 - RNA, 18 nt, Human
cuggcacaguuuucugag

SEQ ID NO: 2638931 - RNA, 13 nt, Human
cugcugaaacaac

SEQ ID NO: 2638932 - RNA, 23 nt, Human
cuggaauaauccuaaacauauga

SEQ ID NO: 2638933 - RNA, 22 nt, Human
cugggaacccaaguccaagcau

SEQ ID NO: 2638934 - RNA, 21 nt, Human
cuggucccagccagcaguuca

SEQ ID NO: 2638935 - RNA, 11 nt, Human
ccuccucugcu

SEQ ID NO: 2638936 - RNA, 17 nt, Human
ccuccccuccucugcuu

SEQ ID NO: 2638937 - RNA, 18 nt, Human
ccuccccuccucugcuug

SEQ ID NO: 2638938 - RNA, 12 nt, Human
ccucccugcaau

SEQ ID NO: 2638939 - RNA, 16 nt, Human
ccucccugcaauaaaa

SEQ ID NO: 2638940 - RNA, 20 nt, Human
ccucagaaaacaaggaugaa

SEQ ID NO: 2638941 - RNA, 15 nt, Human
ccuccccuccucugc

SEQ ID NO: 2638942 - RNA, 14 nt, Human
ccuccccuccucug

SEQ ID NO: 2638943 - RNA, 11 nt, Human
ccucuccuggg

SEQ ID NO: 2638944 - RNA, 12 nt, Human
ccucuccugggc

SEQ ID NO: 2638945 - RNA, 13 nt, Human
ccucuccugggca

SEQ ID NO: 2638946 - RNA, 14 nt, Human
ccucuccugggcag

SEQ ID NO: 2638947 - RNA, 21 nt, Human
ccucugcuugccaucccuccc

SEQ ID NO: 2638948 - RNA, 20 nt, Human
ccucugcuugccaucccucc

SEQ ID NO: 2638949 - RNA, 23 nt, Human
ccucuuagaugcaguucugaaga

SEQ ID NO: 2638950 - RNA, 18 nt, Human
ccugaaagaggaaugaag

SEQ ID NO: 2638951 - RNA, 23 nt, Human
ccugaaagaggaaugaaguacuc

SEQ ID NO: 2638952 - RNA, 20 nt, Human
ccugaggcuccacuuggucu

SEQ ID NO: 2638953 - RNA, 18 nt, Human
ccugaggcuccacuuggu

SEQ ID NO: 2638954 - RNA, 22 nt, Human
ccgggaggcagagguugcagug

SEQ ID NO: 2638955 - RNA, 15 nt, Human
cccuugaugaagaag

SEQ ID NO: 2638956 - RNA, 16 nt, Human
cccuugaugaagaagu

SEQ ID NO: 2638957 - RNA, 15 nt, Human
ccugggcagcugccu

SEQ ID NO: 2638958 - RNA, 16 nt, Human
ccugggcagcugccuc

SEQ ID NO: 2638959 - RNA, 17 nt, Human
ccugggcagcugccucc

SEQ ID NO: 2638960 - RNA, 18 nt, Human
ccugggcagcugccuccc

SEQ ID NO: 2638961 - RNA, 20 nt, Human
ccugggcagcugccuccccu

SEQ ID NO: 2638962 - RNA, 18 nt, Human
cgugcacgcacacugucu

SEQ ID NO: 2638963 - RNA, 11 nt, Human
cgcaaugugac

SEQ ID NO: 2638964 - RNA, 17 nt, Human
cggccuccauccugagg

SEQ ID NO: 2638965 - RNA, 16 nt, Human
cggccuccauccugag

SEQ ID NO: 2638966 - RNA, 13 nt, Human
cccaggugccagu

SEQ ID NO: 2638967 - RNA, 14 nt, Human
ccaugaagauguag

SEQ ID NO: 2638968 - RNA, 16 nt, Human
ccaugauguuuagaaa

SEQ ID NO: 2638969 - RNA, 18 nt, Human
ccaucaaggguacacugc

SEQ ID NO: 2638970 - RNA, 18 nt, Human
cccaaaaggcagaagcaa

SEQ ID NO: 2638971 - RNA, 13 nt, Human
cccaaaaggcaga

SEQ ID NO: 2638972 - RNA, 17 nt, Human
ccaggugccaguuaugg

SEQ ID NO: 2638973 - RNA, 18 nt, Human
ccacugcagaagacagua

SEQ ID NO: 2638974 - RNA, 13 nt, Human
ccacugcagaaga

SEQ ID NO: 2638975 - RNA, 20 nt, Human
ccacaggaaccacaagacug

SEQ ID NO: 2638976 - RNA, 16 nt, Human
ccaauauucauagcag

SEQ ID NO: 2638977 - RNA, 22 nt, Human
ccaagcauaccaacacgagcag

SEQ ID NO: 2638978 - RNA, 17 nt, Human
ccaagcauuuagaugua

SEQ ID NO: 2638979 - RNA, 14 nt, Human
ccaagcaaguauua

SEQ ID NO: 2638980 - RNA, 23 nt, Human
ccaaauuucauaccuaucaucuu

SEQ ID NO: 2638981 - RNA, 22 nt, Human
ccaaacugacucuuaagaagac

SEQ ID NO: 2638982 - RNA, 17 nt, Human
cauuuaggccaugggac

SEQ ID NO: 2638983 - RNA, 13 nt, Human
cauuugcucaugg

SEQ ID NO: 2638984 - RNA, 18 nt, Human
cauuugcucauggaauug

SEQ ID NO: 2638985 - RNA, 21 nt, Human metapneumovirus
ugaagcugcuauaagcaguga

SEQ ID NO: 2638986 - RNA, 20 nt, Human metapneumovirus
acaaaaaggacucaucauca

SEQ ID NO: 2638987 - RNA, 23 nt, Human metapneumovirus
gacaacucagacaccaacucaag

SEQ ID NO: 2638988 - RNA, 12 nt, Human metapneumovirus
caaaaacaugua

SEQ ID NO: 2638989 - RNA, 18 nt, Human metapneumovirus
ucaucaagcaacugaaca

SEQ ID NO: 2638990 - RNA, 22 nt, Human metapneumovirus
uguugaagcugcuauaagcagu

SEQ ID NO: 2638991 - RNA, 22 nt, Human metapneumovirus
agucagcuacuguugaagcugc

SEQ ID NO: 2638992 - RNA, 14 nt, Human metapneumovirus
cauaccacauaauu

SEQ ID NO: 2638993 - RNA, 19 nt, Human metapneumovirus
caaggaugguauugucaaa

SEQ ID NO: 2638994 - RNA, 15 nt, Human metapneumovirus
cucaaaaaaauaauu

SEQ ID NO: 2638995 - RNA, 13 nt, Human metapneumovirus
uugcaacugcagc

SEQ ID NO: 2638996 - RNA, 17 nt, Human metapneumovirus
ucaaagguauacaaacu

SEQ ID NO: 2638997 - RNA, 19 nt, Human metapneumovirus
accccugcagaaaagaaac

SEQ ID NO: 2638998 - RNA, 16 nt, Human metapneumovirus
uagaggagaaauuaag

SEQ ID NO: 2638999 - RNA, 15 nt, Human metapneumovirus
uccuuacacagcagc

SEQ ID NO: 2639000 - RNA, 16 nt, Human metapneumovirus
auauuuugaaaacaag

SEQ ID NO: 2639001 - RNA, 16 nt, Human metapneumovirus
aagcuuuccagaaauc

SEQ ID NO: 2639002 - RNA, 16 nt, Human metapneumovirus
cagcaggugcugaaaa

SEQ ID NO: 2639003 - RNA, 19 nt, Human metapneumovirus
uccacacaaaaaacaaccc

SEQ ID NO: 2639004 - RNA, 22 nt, Human metapneumovirus
aagcacaaguggagaauccgaa

SEQ ID NO: 2639005 - RNA, 23 nt, Human metapneumovirus
ggagcauauguccaggcugaaag

SEQ ID NO: 2639006 - RNA, 23 nt, Human metapneumovirus
aauuauacuauauauuuagaaua

SEQ ID NO: 2639007 - RNA, 22 nt, Human metapneumovirus
cuugaaagugaaguaacagcaa

SEQ ID NO: 2639008 - RNA, 16 nt, Human metapneumovirus
agcucagccaaaucag

SEQ ID NO: 2639009 - RNA, 22 nt, Human metapneumovirus
caccuguuacaauaccagcauu

SEQ ID NO: 2639010 - RNA, 22 nt, Human metapneumovirus
aagguuucauuuacaccaaaug

SEQ ID NO: 2639011 - RNA, 21 nt, Human metapneumovirus
agcacucgguguugcaacugc

SEQ ID NO: 2639012 - RNA, 18 nt, Human metapneumovirus
caaguugaucuaauagaa

SEQ ID NO: 2639013 - RNA, 20 nt, Human metapneumovirus
acccaaaugaaaaagacugu

SEQ ID NO: 2639014 - RNA, 16 nt, Human metapneumovirus
guuucaaucaaagaga

SEQ ID NO: 2639015 - RNA, 13 nt, Human metapneumovirus
aaaucccagacaa

SEQ ID NO: 2639016 - RNA, 16 nt, Human metapneumovirus
gacaaauaaaacugau

SEQ ID NO: 2639017 - RNA, 22 nt, Human metapneumovirus
cagaagcuuuccagaaaucauu

SEQ ID NO: 2639018 - RNA, 21 nt, Human metapneumovirus
aauaggaaaugguaguguaaa

SEQ ID NO: 2639019 - RNA, 21 nt, Human metapneumovirus
gaccaagcucuaacacaggcc

SEQ ID NO: 2639020 - RNA, 14 nt, Human metapneumovirus
accugcaaaaccaa

SEQ ID NO: 2639021 - RNA, 13 nt, Human metapneumovirus
agauaacaaacua

SEQ ID NO: 2639022 - RNA, 23 nt, Human metapneumovirus
aagauuuugugagcaagaaucua

SEQ ID NO: 2639023 - RNA, 14 nt, Human metapneumovirus
cugcaggacaaaua

SEQ ID NO: 2639024 - RNA, 20 nt, Human metapneumovirus
auuagcuuuacuaacauuuc

SEQ ID NO: 2639025 - RNA, 22 nt, Human metapneumovirus
caacaugccaacaucugcagga

SEQ ID NO: 2639026 - RNA, 14 nt, Human metapneumovirus
cucagaacaguuuc

SEQ ID NO: 2639027 - RNA, 14 nt, Human metapneumovirus
caauagaggagaaa

SEQ ID NO: 2639028 - RNA, 14 nt, Human metapneumovirus
acacacaacaccac

SEQ ID NO: 2639029 - RNA, 16 nt, Human metapneumovirus
agaagaaccaaaagac

SEQ ID NO: 2639030 - RNA, 14 nt, Human metapneumovirus
aagcauaagcaaaa

SEQ ID NO: 2639031 - RNA, 13 nt, Human metapneumovirus
acaggccaaaauu

SEQ ID NO: 2639032 - RNA, 21 nt, Human metapneumovirus
uaucaaggcauuccuuacaca

SEQ ID NO: 2639033 - RNA, 22 nt, Human metapneumovirus
acacgugcaaucaacaaaaaca

SEQ ID NO: 2639034 - RNA, 13 nt, Human metapneumovirus
aaagugaaguaac

SEQ ID NO: 2639035 - RNA, 22 nt, Human metapneumovirus
aaggcauuccuuacacagcagc

SEQ ID NO: 2639036 - RNA, 19 nt, Human metapneumovirus
ugaagucucauacuaacau

SEQ ID NO: 2639037 - RNA, 16 nt, Human metapneumovirus
aaucaacaaaaacaag

SEQ ID NO: 2639038 - RNA, 12 nt, Human metapneumovirus
uaaaaaacaaua

SEQ ID NO: 2639039 - RNA, 21 nt, Human metapneumovirus
agcaggacccacagcagcaag

SEQ ID NO: 2639040 - RNA, 17 nt, Human metapneumovirus
cuaggagcaauagcacu

SEQ ID NO: 2639041 - RNA, 14 nt, Human metapneumovirus
agucagcuacuguu

SEQ ID NO: 2639042 - RNA, 23 nt, Human metapneumovirus
aucaauagaggagaaauuaagca

SEQ ID NO: 2639043 - RNA, 22 nt, Human metapneumovirus
acaagucaaaaugucauucccu

SEQ ID NO: 2639044 - RNA, 14 nt, Human metapneumovirus
ccagucaaguuucc

SEQ ID NO: 2639045 - RNA, 19 nt, Human metapneumovirus
caacuggcaagagaggagc

SEQ ID NO: 2639046 - RNA, 16 nt, Human metapneumovirus
uccuaagcagugcaga

SEQ ID NO: 2639047 - RNA, 22 nt, Human metapneumovirus
ccuucuuguucaggaaaaaagg

SEQ ID NO: 2639048 - RNA, 19 nt, Human metapneumovirus
accaagcucuaacacaggc

SEQ ID NO: 2639049 - RNA, 22 nt, Human metapneumovirus
caaggcauuccuuacacagcag

SEQ ID NO: 2639050 - RNA, 23 nt, Human metapneumovirus
caauuuaaaaaguaaaaaacaau

SEQ ID NO: 2639051 - RNA, 15 nt, Human metapneumovirus
cugcucgaucagcua

SEQ ID NO: 2639052 - RNA, 15 nt, Human metapneumovirus
ccuaagcagugcaga

SEQ ID NO: 2639053 - RNA, 22 nt, Human metapneumovirus
cccaaaaaauuugaagucaaug

SEQ ID NO: 2639054 - RNA, 12 nt, Human metapneumovirus
caauagaggaga

SEQ ID NO: 2639055 - RNA, 21 nt, Human metapneumovirus
cucagaacaguuucugcugau

SEQ ID NO: 2639056 - RNA, 14 nt, Human metapneumovirus
uaagcagugaagca

SEQ ID NO: 2639057 - RNA, 13 nt, Human metapneumovirus
ggaucuagaaaag

SEQ ID NO: 2639058 - RNA, 18 nt, Human metapneumovirus
uguuuuaaaucugaagac

SEQ ID NO: 2639059 - RNA, 11 nt, Human metapneumovirus
ggugcagcaau

SEQ ID NO: 2639060 - RNA, 16 nt, Human metapneumovirus
gaauuaaaucaaucaa

SEQ ID NO: 2639061 - RNA, 14 nt, Human metapneumovirus
caagaaaaaaacug

SEQ ID NO: 2639062 - RNA, 17 nt, Human metapneumovirus
aagcaaaauaugcaaga

SEQ ID NO: 2639063 - RNA, 21 nt, Human metapneumovirus
acagcauguuauaaaaggaag

SEQ ID NO: 2639064 - RNA, 18 nt, Human metapneumovirus
aacuauucaauuuaaaaa

SEQ ID NO: 2639065 - RNA, 21 nt, Human metapneumovirus
caaguaguuauggaggugaaa

SEQ ID NO: 2639066 - RNA, 13 nt, Human metapneumovirus
agcagcaaaauua

SEQ ID NO: 2639067 - RNA, 15 nt, Human metapneumovirus
cucuaacacaggcca

SEQ ID NO: 2639068 - RNA, 22 nt, Human metapneumovirus
gaccaaaagugcacuaagagag

SEQ ID NO: 2639069 - RNA, 23 nt, Human metapneumovirus
cuccguaauuuacauggugcaac

SEQ ID NO: 2639070 - RNA, 19 nt, Human metapneumovirus
cucaguguucugaggacag

SEQ ID NO: 2639071 - RNA, 17 nt, Human metapneumovirus
aguccacacaaaaaaca

SEQ ID NO: 2639072 - RNA, 15 nt, Human metapneumovirus
gauaaugaagaagaa

SEQ ID NO: 2639073 - RNA, 20 nt, Human metapneumovirus
auggguaaugaagcagcaaa

SEQ ID NO: 2639074 - RNA, 16 nt, Human metapneumovirus
gcaaaguuagcacagg

SEQ ID NO: 2639075 - RNA, 17 nt, Human metapneumovirus
auaaaaauaaacaaugg

SEQ ID NO: 2639076 - RNA, 19 nt, Human metapneumovirus
auuggcguaagagaggaau

SEQ ID NO: 2639077 - RNA, 16 nt, Human metapneumovirus
aagaagaugcagaauc

SEQ ID NO: 2639078 - RNA, 14 nt, Human metapneumovirus
aucuacuacuaauu

SEQ ID NO: 2639079 - RNA, 15 nt, Human metapneumovirus
gauauggacucacaa

SEQ ID NO: 2639080 - RNA, 16 nt, Human metapneumovirus
agcagcaaaauuagca

SEQ ID NO: 2639081 - RNA, 17 nt, Human metapneumovirus
gucaaguuuccugaaga

SEQ ID NO: 2639082 - RNA, 13 nt, Human metapneumovirus
acacaaaaaccaa

SEQ ID NO: 2639083 - RNA, 15 nt, Human metapneumovirus
aauugccaaaaccau

SEQ ID NO: 2639084 - RNA, 14 nt, Human metapneumovirus
auaaaugacaauga

SEQ ID NO: 2639085 - RNA, 23 nt, Human metapneumovirus
gcaacugcagcugcaguuacagc

SEQ ID NO: 2639086 - RNA, 19 nt, Human metapneumovirus
aaacccugacaauaaccac

SEQ ID NO: 2639087 - RNA, 15 nt, Human metapneumovirus
aauuaaaauuaaaaa

SEQ ID NO: 2639088 - RNA, 20 nt, Human metapneumovirus
gaagcuuuccagaaaucauu

SEQ ID NO: 2639089 - RNA, 12 nt, Human metapneumovirus
cacuaagagagc

SEQ ID NO: 2639090 - RNA, 19 nt, Human metapneumovirus
uagcacucucaaauuaaau

SEQ ID NO: 2639091 - RNA, 22 nt, Human metapneumovirus
aaacaguuuacuuaacaaccau

SEQ ID NO: 2639092 - RNA, 13 nt, Human metapneumovirus
gagagaaacugaa

SEQ ID NO: 2639093 - RNA, 21 nt, Human metapneumovirus
acuguuuacuacccaaaugaa

SEQ ID NO: 2639094 - RNA, 22 nt, Human metapneumovirus
aguaaguuucuaugauacuuca

SEQ ID NO: 2639095 - RNA, 14 nt, Human metapneumovirus
gcugucaaauuaaa

SEQ ID NO: 2639096 - RNA, 17 nt, Human metapneumovirus
gcugaaagcauaagcaa

SEQ ID NO: 2639097 - RNA, 15 nt, Human metapneumovirus
aguuuccugaagauc

SEQ ID NO: 2639098 - RNA, 17 nt, Human metapneumovirus
guugcaacugcagcugc

SEQ ID NO: 2639099 - RNA, 19 nt, Human metapneumovirus
caaacuggaauuugacaaa

SEQ ID NO: 2639100 - RNA, 22 nt, Human metapneumovirus
ucccaaaaaauuugaagucaau

SEQ ID NO: 2639101 - RNA, 14 nt, Human metapneumovirus
gagcucagaacagu

SEQ ID NO: 2639102 - RNA, 14 nt, Human metapneumovirus
caauuauauaaaag

SEQ ID NO: 2639103 - RNA, 16 nt, Human metapneumovirus
ucaucaagcaacugaa

SEQ ID NO: 2639104 - RNA, 20 nt, Human metapneumovirus
auagcagacauaauaaagga

SEQ ID NO: 2639105 - RNA, 15 nt, Human metapneumovirus
acaaaccaaaaccag

SEQ ID NO: 2639106 - RNA, 19 nt, Human metapneumovirus
cagaaaugauggaagagga

SEQ ID NO: 2639107 - RNA, 19 nt, Human metapneumovirus
cucgguguugcaacugcag

SEQ ID NO: 2639108 - RNA, 18 nt, Human metapneumovirus
aagacuacucuaaaucau

SEQ ID NO: 2639109 - RNA, 13 nt, Human metapneumovirus
aguggaaaacaau

SEQ ID NO: 2639110 - RNA, 16 nt, Human metapneumovirus
caccuaucaaggcauu

SEQ ID NO: 2639111 - RNA, 19 nt, Human metapneumovirus
aaucaaugcacaaauauaa

SEQ ID NO: 2639112 - RNA, 21 nt, Human metapneumovirus
ggccagugucaagcagcuuug

SEQ ID NO: 2639113 - RNA, 17 nt, Human metapneumovirus
caacuggcaagagagga

SEQ ID NO: 2639114 - RNA, 19 nt, Human metapneumovirus
gccaacacaucaacaacau

SEQ ID NO: 2639115 - RNA, 23 nt, Human metapneumovirus
uaugugauuggcugcaguuaaag

SEQ ID NO: 2639116 - RNA, 14 nt, Human metapneumovirus
agauaaugaagaag

SEQ ID NO: 2639117 - RNA, 18 nt, Human metapneumovirus
caaguuuucgagagcauu

SEQ ID NO: 2639118 - RNA, 17 nt, Human metapneumovirus
aauuugggacaaaucau

SEQ ID NO: 2639119 - RNA, 20 nt, Human metapneumovirus
auucaaagguauacaaacuc

SEQ ID NO: 2639120 - RNA, 15 nt, Human metapneumovirus
ucucagauaaugaag

SEQ ID NO: 2639121 - RNA, 17 nt, Human metapneumovirus
cagaaaugauggaagag

SEQ ID NO: 2639122 - RNA, 20 nt, Human metapneumovirus
caaaaugucauucccugaag

SEQ ID NO: 2639123 - RNA, 16 nt, Human metapneumovirus
ucaaaaaaauaauuaa

SEQ ID NO: 2639124 - RNA, 17 nt, Human metapneumovirus
uacucaaagugaaugca

SEQ ID NO: 2639125 - RNA, 23 nt, Human metapneumovirus
ugcagagaaaggaaacacuggcu

SEQ ID NO: 2639126 - RNA, 23 nt, Human metapneumovirus
ccaugucuuuugcgacacagcag

SEQ ID NO: 2639127 - RNA, 19 nt, Human metapneumovirus
gugacaauagacaacacug

SEQ ID NO: 2639128 - RNA, 12 nt, Human metapneumovirus
aagugcagugag

SEQ ID NO: 2639129 - RNA, 19 nt, Human metapneumovirus
aacuuuuaaggaacacuga

SEQ ID NO: 2639130 - RNA, 23 nt, Human metapneumovirus
caacagaagguuccuaaauguug

SEQ ID NO: 2639131 - RNA, 13 nt, Human metapneumovirus
ccugcaaaaccaa

SEQ ID NO: 2639132 - RNA, 20 nt, Human metapneumovirus
cauaauaaagaaaacaaaga

SEQ ID NO: 2639133 - RNA, 19 nt, Human metapneumovirus
agcauguuauaaaaggaag

SEQ ID NO: 2639134 - RNA, 19 nt, Human metapneumovirus
aaucucccuggaaaaaaca

SEQ ID NO: 2639135 - RNA, 23 nt, Human metapneumovirus
ucugugaaguaaaaacaguuuac

SEQ ID NO: 2639136 - RNA, 13 nt, Human metapneumovirus
cuaagcaaaguug

SEQ ID NO: 2639137 - RNA, 15 nt, Human metapneumovirus
gucucauacuaacau

SEQ ID NO: 2639138 - RNA, 22 nt, Human metapneumovirus
aaugaagaagaagaugcagaau

SEQ ID NO: 2639139 - RNA, 16 nt, Human metapneumovirus
ugaacaaaggcugcuc

SEQ ID NO: 2639140 - RNA, 17 nt, Human metapneumovirus
agaauccuaagcagugc

SEQ ID NO: 2639141 - RNA, 16 nt, Human metapneumovirus
gcucagccaaaucagu

SEQ ID NO: 2639142 - RNA, 16 nt, Human metapneumovirus
aaagauuuugugagca

SEQ ID NO: 2639143 - RNA, 14 nt, Human metapneumovirus
cucaaaaagaccaa

SEQ ID NO: 2639144 - RNA, 21 nt, Human metapneumovirus
aaccauaccgucagaaccaaa

SEQ ID NO: 2639145 - RNA, 21 nt, Human metapneumovirus
accaaugaagcaguaucuaca

SEQ ID NO: 2639146 - RNA, 21 nt, Human metapneumovirus
uuauggaucuagaaaagaaca

SEQ ID NO: 2639147 - RNA, 21 nt, Human metapneumovirus
ggcaauuuucagacaacgcug

SEQ ID NO: 2639148 - RNA, 18 nt, Human metapneumovirus
agcagacauaauaaagga

SEQ ID NO: 2639149 - RNA, 21 nt, Human metapneumovirus
gaccaaaagugcacuaagaga

SEQ ID NO: 2639150 - RNA, 17 nt, Human metapneumovirus
cauaacaaaagcugcag

SEQ ID NO: 2639151 - RNA, 11 nt, Human metapneumovirus
acaaacaaugg

SEQ ID NO: 2639152 - RNA, 14 nt, Human metapneumovirus
aaauaaagcaagca

SEQ ID NO: 2639153 - RNA, 22 nt, Human metapneumovirus
aacuaucugacagcaaacaugu

SEQ ID NO: 2639154 - RNA, 15 nt, Human metapneumovirus
agcagcagaaaugau

SEQ ID NO: 2639155 - RNA, 15 nt, Human metapneumovirus
uaccguguuagaaaa

SEQ ID NO: 2639156 - RNA, 22 nt, Human metapneumovirus
aucaacuaacaccaaaaagaag

SEQ ID NO: 2639157 - RNA, 18 nt, Human metapneumovirus
auggaucccauugaagaa

SEQ ID NO: 2639158 - RNA, 21 nt, Human metapneumovirus
gcugaaagauuuugugagcaa

SEQ ID NO: 2639159 - RNA, 18 nt, Human metapneumovirus
ccggcuugaaagugaagu

SEQ ID NO: 2639160 - RNA, 21 nt, Human metapneumovirus
gugcagagaaaggaaacacug

SEQ ID NO: 2639161 - RNA, 14 nt, Human metapneumovirus
uaauaaaaacagaa

SEQ ID NO: 2639162 - RNA, 17 nt, Human metapneumovirus
cggcuugaaagugaagu

SEQ ID NO: 2639163 - RNA, 23 nt, Human metapneumovirus
caaguugaucuaauagaaaagga

SEQ ID NO: 2639164 - RNA, 18 nt, Human metapneumovirus
auuaaacaaugaaaucac

SEQ ID NO: 2639165 - RNA, 19 nt, Human metapneumovirus
aauacuguaucagaaacau

SEQ ID NO: 2639166 - RNA, 13 nt, Human metapneumovirus
aagaugaaagcac

SEQ ID NO: 2639167 - RNA, 15 nt, Human metapneumovirus
agaacgggacaaaua

SEQ ID NO: 2639168 - RNA, 13 nt, Human metapneumovirus
acaauaccagcau

SEQ ID NO: 2639169 - RNA, 14 nt, Human metapneumovirus
cucagauaaugaag

SEQ ID NO: 2639170 - RNA, 14 nt, Human metapneumovirus
ugcaauaaacagug

SEQ ID NO: 2639171 - RNA, 16 nt, Human metapneumovirus
auaagcagugaagcag

SEQ ID NO: 2639172 - RNA, 18 nt, Human metapneumovirus
aggaccuguuaccugcaa

SEQ ID NO: 2639173 - RNA, 23 nt, Human metapneumovirus
aagaaaaaaacugggcaaaacaa

SEQ ID NO: 2639174 - RNA, 14 nt, Human metapneumovirus
aaaaccaacaauug

SEQ ID NO: 2639175 - RNA, 20 nt, Human metapneumovirus
uaaccacucuguaugcugca

SEQ ID NO: 2639176 - RNA, 15 nt, Human metapneumovirus
acuguauaccagcua

SEQ ID NO: 2639177 - RNA, 15 nt, Human metapneumovirus
cuaagcagugcagag

SEQ ID NO: 2639178 - RNA, 14 nt, Human metapneumovirus
ugauguuggagaac

SEQ ID NO: 2639179 - RNA, 19 nt, Human metapneumovirus
auguugcacuugaccaagu

SEQ ID NO: 2639180 - RNA, 16 nt, Human metapneumovirus
uaccagcuaagcaaag

SEQ ID NO: 2639181 - RNA, 17 nt, Human metapneumovirus
gcugaguggugucacaa

SEQ ID NO: 2639182 - RNA, 16 nt, Human metapneumovirus
gucaaggcuuacuuaa

SEQ ID NO: 2639183 - RNA, 15 nt, Human metapneumovirus
augguaucaaaauuu

SEQ ID NO: 2639184 - RNA, 18 nt, Human metapneumovirus
ggagaaauuaagcaugau

SEQ ID NO: 2639185 - RNA, 17 nt, Human metapneumovirus
gcaacauaaacauaucu

SEQ ID NO: 2639186 - RNA, 13 nt, Human metapneumovirus
aaaguaaaaaaca

SEQ ID NO: 2639187 - RNA, 19 nt, Human metapneumovirus
cauguuagacucaaaaaug

SEQ ID NO: 2639188 - RNA, 15 nt, Human metapneumovirus
acaaacuaucugaca

SEQ ID NO: 2639189 - RNA, 18 nt, Human metapneumovirus
cgagagagaaacugaaaa

SEQ ID NO: 2639190 - RNA, 16 nt, Human metapneumovirus
aucauaauaaagaaaa

SEQ ID NO: 2639191 - RNA, 18 nt, Human metapneumovirus
auccggcuugaaagugaa

SEQ ID NO: 2639192 - RNA, 16 nt, Human metapneumovirus
caguagaccugcaaaa

SEQ ID NO: 2639193 - RNA, 13 nt, Human metapneumovirus
gauaaugaagaag

SEQ ID NO: 2639194 - RNA, 17 nt, Human metapneumovirus
uucaaaaagcuuggagc

SEQ ID NO: 2639195 - RNA, 24 nt, Human metapneumovirus
ccaugucuuuugcgacacagcagc

SEQ ID NO: 2639196 - RNA, 18 nt, Human metapneumovirus
auuaaucaauaaaaacuu

SEQ ID NO: 2639197 - RNA, 19 nt, Human metapneumovirus
cuuuucauggguaaugaag

SEQ ID NO: 2639198 - RNA, 16 nt, Human metapneumovirus
ucaaauuaaacaauga

SEQ ID NO: 2639199 - RNA, 14 nt, Human metapneumovirus
cauacuaacauuua

SEQ ID NO: 2639200 - RNA, 21 nt, Human metapneumovirus
ccacaggagcaccuccagagc

SEQ ID NO: 2639201 - RNA, 22 nt, Human metapneumovirus
gaaacaaaccaaaaccagcagu

SEQ ID NO: 2639202 - RNA, 18 nt, Human metapneumovirus
augcugcaucacaaaaug

SEQ ID NO: 2639203 - RNA, 21 nt, Human metapneumovirus
cacgugcaaucaacaaaaaca

SEQ ID NO: 2639204 - RNA, 20 nt, Human metapneumovirus
aauuaguuaauuaaaaauaa

SEQ ID NO: 2639205 - RNA, 18 nt, Human metapneumovirus
aaugauggaagaggaaau

SEQ ID NO: 2639206 - RNA, 21 nt, Human metapneumovirus
ucaaaaagcuuggagcuggga

SEQ ID NO: 2639207 - RNA, 19 nt, Human metapneumovirus
caacucaagcccacagcau

SEQ ID NO: 2639208 - RNA, 13 nt, Human metapneumovirus
ccguccacagcau

SEQ ID NO: 2639209 - RNA, 11 nt, Human metapneumovirus
ugaagcagcaa

SEQ ID NO: 2639210 - RNA, 15 nt, Human metapneumovirus
acacaccaccagcag

SEQ ID NO: 2639211 - RNA, 19 nt, Human metapneumovirus
uaaagggaaagcagcagaa

SEQ ID NO: 2639212 - RNA, 19 nt, Human metapneumovirus
aaaugaaaaagacugugaa

SEQ ID NO: 2639213 - RNA, 17 nt, Human metapneumovirus
aaggcgaacagcauguu

SEQ ID NO: 2639214 - RNA, 16 nt, Human metapneumovirus
agaauccuaagcagug

SEQ ID NO: 2639215 - RNA, 18 nt, Human metapneumovirus
gugccgauggacccagcu

SEQ ID NO: 2639216 - RNA, 16 nt, Human metapneumovirus
acaaugauaacauuag

SEQ ID NO: 2639217 - RNA, 13 nt, Human metapneumovirus
caggagcaggcag

SEQ ID NO: 2639218 - RNA, 20 nt, Human metapneumovirus
aggagcaccuccagagcuga

SEQ ID NO: 2639219 - RNA, 16 nt, Human metapneumovirus
aaaaguggaaaacaau

SEQ ID NO: 2639220 - RNA, 16 nt, Human metapneumovirus
ugagagagcugaaaga

SEQ ID NO: 2639221 - RNA, 20 nt, Human metapneumovirus
agaaaucaaugcacaaauau

SEQ ID NO: 2639222 - RNA, 17 nt, Human metapneumovirus
uaauaaaaauaaacaau

SEQ ID NO: 2639223 - RNA, 10 nt, Human metapneumovirus
agugcaguga

SEQ ID NO: 2639224 - RNA, 16 nt, Human metapneumovirus
gugcacuaagagagcu

SEQ ID NO: 2639225 - RNA, 14 nt, Human metapneumovirus
augguauuaaauga

SEQ ID NO: 2639226 - RNA, 17 nt, Human metapneumovirus
aggaaacacuggcuuca

SEQ ID NO: 2639227 - RNA, 15 nt, Human metapneumovirus
auaaaugacaaugau

SEQ ID NO: 2639228 - RNA, 21 nt, Human metapneumovirus
agcacuaaucaagugcaguga

SEQ ID NO: 2639229 - RNA, 17 nt, Human metapneumovirus
auuggcguaagagagga

SEQ ID NO: 2639230 - RNA, 18 nt, Human metapneumovirus
cgagagcauugagaacag

SEQ ID NO: 2639231 - RNA, 17 nt, Human metapneumovirus
uuacuuaaguuaguaaa

SEQ ID NO: 2639232 - RNA, 19 nt, Human metapneumovirus
caaaacugaaauaaagcaa

SEQ ID NO: 2639233 - RNA, 18 nt, Human metapneumovirus
caacaaaauuguugaaga

SEQ ID NO: 2639234 - RNA, 17 nt, Human metapneumovirus
ugcuggaaaauaaacag

SEQ ID NO: 2639235 - RNA, 18 nt, Human metapneumovirus
caguagaccugcaaaacc

SEQ ID NO: 2639236 - RNA, 15 nt, Human metapneumovirus
uauugucaaaaugca

SEQ ID NO: 2639237 - RNA, 13 nt, Human metapneumovirus
uaagcagugcaga

SEQ ID NO: 2639238 - RNA, 19 nt, Human metapneumovirus
cuaggagcauauguccagg

SEQ ID NO: 2639239 - RNA, 20 nt, Human metapneumovirus
accucaaaaaaauaauuaaa

SEQ ID NO: 2639240 - RNA, 23 nt, Human metapneumovirus
aaacucacagucugugaaguaaa

SEQ ID NO: 2639241 - RNA, 18 nt, Human metapneumovirus
uugaagaugaaagcacaa

SEQ ID NO: 2639242 - RNA, 19 nt, Human metapneumovirus
gacacaaaaaccaacaauu

SEQ ID NO: 2639243 - RNA, 16 nt, Human metapneumovirus
aacaugccaacaucug

SEQ ID NO: 2639244 - RNA, 17 nt, Human metapneumovirus
cuguuacaauaccagca

SEQ ID NO: 2639245 - RNA, 17 nt, Human metapneumovirus
ggacggcacgcagaacc

SEQ ID NO: 2639246 - RNA, 16 nt, Human metapneumovirus
gaucagagaugcaaug

SEQ ID NO: 2639247 - RNA, 16 nt, Human metapneumovirus
agcugcuauaagcagu

SEQ ID NO: 2639248 - RNA, 17 nt, Human metapneumovirus
uauaagcagugaagcag

SEQ ID NO: 2639249 - RNA, 20 nt, Human metapneumovirus
guguuggcaacugcagugag

SEQ ID NO: 2639250 - RNA, 14 nt, Human metapneumovirus
cugggacucaaguc

SEQ ID NO: 2639251 - RNA, 20 nt, Human metapneumovirus
cuaucaguagaccugcaaaa

SEQ ID NO: 2639252 - RNA, 18 nt, Human metapneumovirus
acagaauccuaagcagug

SEQ ID NO: 2639253 - RNA, 18 nt, Human metapneumovirus
aucugaagacacaaaaac

SEQ ID NO: 2639254 - RNA, 15 nt, Human metapneumovirus
acaaucugcaaauau

SEQ ID NO: 2639255 - RNA, 23 nt, Human metapneumovirus
guuucugcugaucaacuggcaag

SEQ ID NO: 2639256 - RNA, 21 nt, Human metapneumovirus
cacagcagcaggaaucaaugu

SEQ ID NO: 2639257 - RNA, 23 nt, Human metapneumovirus
ucaaaggagugcaacauaaacau

SEQ ID NO: 2639258 - RNA, 18 nt, Human metapneumovirus
uaagagaggaauuaauag

SEQ ID NO: 2639259 - RNA, 21 nt, Human metapneumovirus
caagucauaguagaacuagga

SEQ ID NO: 2639260 - RNA, 11 nt, Human metapneumovirus
auaaauuaaaa

SEQ ID NO: 2639261 - RNA, 21 nt, Human metapneumovirus
auggaugcugucaaauuaaac

SEQ ID NO: 2639262 - RNA, 21 nt, Human metapneumovirus
caaaauaugcaagacuuggag

SEQ ID NO: 2639263 - RNA, 18 nt, Human metapneumovirus
gcagacauaauaaaggaa

SEQ ID NO: 2639264 - RNA, 15 nt, Human metapneumovirus
uaaaguaaauuaaaa

SEQ ID NO: 2639265 - RNA, 15 nt, Human metapneumovirus
agcaagaaucuaaca

SEQ ID NO: 2639266 - RNA, 17 nt, Human metapneumovirus
aucaagggacaagauau

SEQ ID NO: 2639267 - RNA, 23 nt, Human metapneumovirus
gcuggaaaauaaacagaaaucaa

SEQ ID NO: 2639268 - RNA, 16 nt, Human metapneumovirus
acaguauuuuaaaagu

SEQ ID NO: 2639269 - RNA, 16 nt, Human metapneumovirus
cagauaaugaagaaga

SEQ ID NO: 2639270 - RNA, 15 nt, Human metapneumovirus
ucaaaaagcuuggag

SEQ ID NO: 2639271 - RNA, 17 nt, Human metapneumovirus
uuucaggccaacacacc

SEQ ID NO: 2639272 - RNA, 14 nt, Human metapneumovirus
ccuuggccaagagc

SEQ ID NO: 2639273 - RNA, 19 nt, Human metapneumovirus
augcagacaccaacaaugg

SEQ ID NO: 2639274 - RNA, 14 nt, Human metapneumovirus
acagaaaaagcaaa

SEQ ID NO: 2639275 - RNA, 15 nt, Human metapneumovirus
ucaaugcacaaauau

SEQ ID NO: 2639276 - RNA, 17 nt, Human metapneumovirus
aaaaucaaguuagaaca

SEQ ID NO: 2639277 - RNA, 12 nt, Human metapneumovirus
auuguugaagau

SEQ ID NO: 2639278 - RNA, 14 nt, Human metapneumovirus
aagcagcagaaaug

SEQ ID NO: 2639279 - RNA, 19 nt, Human metapneumovirus
uccggcuugaaagugaagu

SEQ ID NO: 2639280 - RNA, 11 nt, Human metapneumovirus
gugcaaucaac

SEQ ID NO: 2639281 - RNA, 14 nt, Human metapneumovirus
aaaaagaccaauga

SEQ ID NO: 2639282 - RNA, 18 nt, Human metapneumovirus
agugaaguaacagcaauu

SEQ ID NO: 2639283 - RNA, 17 nt, Human metapneumovirus
caccagcagugcugcuc

SEQ ID NO: 2639284 - RNA, 19 nt, Human metapneumovirus
aguccacacaaaaaacaac

SEQ ID NO: 2639285 - RNA, 21 nt, Human metapneumovirus
uagaaugccauuguauauaca

SEQ ID NO: 2639286 - RNA, 21 nt, Human metapneumovirus
aguucguguguuggcaacugc

SEQ ID NO: 2639287 - RNA, 11 nt, Human metapneumovirus
uaaaauuaaaa

SEQ ID NO: 2639288 - RNA, 19 nt, Human metapneumovirus
acaucugcaggacaaauaa

SEQ ID NO: 2639289 - RNA, 11 nt, Human metapneumovirus
cgugcaauggu

SEQ ID NO: 2639290 - RNA, 16 nt, Human metapneumovirus
gaucuaauagaaaagg

SEQ ID NO: 2639291 - RNA, 15 nt, Human metapneumovirus
gucccugaaaaaacc

SEQ ID NO: 2639292 - RNA, 18 nt, Human metapneumovirus
ucagacaacgcuggaaua

SEQ ID NO: 2639293 - RNA, 20 nt, Human metapneumovirus
cuuacacagcagcuguucaa

SEQ ID NO: 2639294 - RNA, 18 nt, Human metapneumovirus
acccaugcaaaguuagca

SEQ ID NO: 2639295 - RNA, 13 nt, Human metapneumovirus
cugcagaaaagaa

SEQ ID NO: 2639296 - RNA, 13 nt, Human metapneumovirus
caguuucaaucaa

SEQ ID NO: 2639297 - RNA, 24 nt, Human metapneumovirus
acaaaauuguugaagaugaaagca

SEQ ID NO: 2639298 - RNA, 17 nt, Human metapneumovirus
ugaugggauagugaagu

SEQ ID NO: 2639299 - RNA, 22 nt, Human metapneumovirus
aguggagaauccgaagaagaag

SEQ ID NO: 2639300 - RNA, 22 nt, Human metapneumovirus
acugccgagagagaaacugaaa

SEQ ID NO: 2639301 - RNA, 14 nt, Human metapneumovirus
guuuccaacaugcc

SEQ ID NO: 2639302 - RNA, 16 nt, Human metapneumovirus
ucaugacuaugaacaa

SEQ ID NO: 2639303 - RNA, 16 nt, Human metapneumovirus
cacaaaaaacaaccca

SEQ ID NO: 2639304 - RNA, 17 nt, Human metapneumovirus
ccaugauccuagugagu

SEQ ID NO: 2639305 - RNA, 21 nt, Human metapneumovirus
acaccuaucaaggcauuccuu

SEQ ID NO: 2639306 - RNA, 19 nt, Human metapneumovirus
uaaucaagugcagugagca

SEQ ID NO: 2639307 - RNA, 17 nt, Human metapneumovirus
augggucuucaaaaaca

SEQ ID NO: 2639308 - RNA, 20 nt, Human metapneumovirus
aaacugaaaaaauuagcaaa

SEQ ID NO: 2639309 - RNA, 21 nt, Human metapneumovirus
ugacaaacucacagucuguga

SEQ ID NO: 2639310 - RNA, 16 nt, Human metapneumovirus
agagagcucagaacag

SEQ ID NO: 2639311 - RNA, 16 nt, Human metapneumovirus
aucugcaggacaaaua

SEQ ID NO: 2639312 - RNA, 21 nt, Human metapneumovirus
augguaguguaaaauuaacag

SEQ ID NO: 2639313 - RNA, 19 nt, Human metapneumovirus
aaaauuugggacaaaucau

SEQ ID NO: 2639314 - RNA, 14 nt, Human metapneumovirus
uaacaaaauuaaaa

SEQ ID NO: 2639315 - RNA, 15 nt, Human metapneumovirus
cauuguauauacaca

SEQ ID NO: 2639316 - RNA, 17 nt, Human metapneumovirus
acucgaugaauauagca

SEQ ID NO: 2639317 - RNA, 15 nt, Human metapneumovirus
caaaaaauuugaagu

SEQ ID NO: 2639318 - RNA, 14 nt, Human metapneumovirus
agacucaaaaaugc

SEQ ID NO: 2639319 - RNA, 23 nt, Human metapneumovirus
aacuauucaauuuaaaaaguaaa

SEQ ID NO: 2639320 - RNA, 17 nt, Human metapneumovirus
caacacggucuuaaaga

SEQ ID NO: 2639321 - RNA, 14 nt, Human metapneumovirus
ugucaaaaugcagg

SEQ ID NO: 2639322 - RNA, 22 nt, Human metapneumovirus
uacuuaacaaccaugaaaccau

SEQ ID NO: 2639323 - RNA, 14 nt, Human metapneumovirus
gaaaagaaacugaa

SEQ ID NO: 2639324 - RNA, 19 nt, Human metapneumovirus
guaaauuaaaauaaauuaa

SEQ ID NO: 2639325 - RNA, 21 nt, Human metapneumovirus
ccaugcaaaguuagcacagga

SEQ ID NO: 2639326 - RNA, 16 nt, Human metapneumovirus
uaaaaauaaaaauuug

SEQ ID NO: 2639327 - RNA, 22 nt, Human metapneumovirus
aauaccagcauucaucaaauca

SEQ ID NO: 2639328 - RNA, 15 nt, Human metapneumovirus
uguagacaacaacaa

SEQ ID NO: 2639329 - RNA, 12 nt, Human metapneumovirus
caacugcaguga

SEQ ID NO: 2639330 - RNA, 14 nt, Human metapneumovirus
ucaaucaaagagag

SEQ ID NO: 2639331 - RNA, 15 nt, Human metapneumovirus
agaagauaggacaca

SEQ ID NO: 2639332 - RNA, 17 nt, Human metapneumovirus
cguguguuggcaacugc

SEQ ID NO: 2639333 - RNA, 16 nt, Human metapneumovirus
cauauguccaggcuga

SEQ ID NO: 2639334 - RNA, 15 nt, Human metapneumovirus
auaaacagugacaca

SEQ ID NO: 2639335 - RNA, 12 nt, Human metapneumovirus
aacuuaaaagug

SEQ ID NO: 2639336 - RNA, 15 nt, Human metapneumovirus
ggucuuaaagagagc

SEQ ID NO: 2639337 - RNA, 16 nt, Human metapneumovirus
acagugacaauagaca

SEQ ID NO: 2639338 - RNA, 17 nt, Human metapneumovirus
caaagaaacccacagga

SEQ ID NO: 2639339 - RNA, 19 nt, Human metapneumovirus
cuaagcagugcagagaaag

SEQ ID NO: 2639340 - RNA, 21 nt, Human metapneumovirus
uggccguuagcuucagucaau

SEQ ID NO: 2639341 - RNA, 17 nt, Human metapneumovirus
aacagaaaaagcaaaag

SEQ ID NO: 2639342 - RNA, 18 nt, Human metapneumovirus
aauagaaaaggaccuguu

SEQ ID NO: 2639343 - RNA, 19 nt, Human metapneumovirus
guuacagcagguguugcaa

SEQ ID NO: 2639344 - RNA, 16 nt, Human metapneumovirus
acgcagacacagugac

SEQ ID NO: 2639345 - RNA, 17 nt, Human metapneumovirus
guuggcaacugcaguga

SEQ ID NO: 2639346 - RNA, 18 nt, Human metapneumovirus
ccaagcucuaacacaggc

SEQ ID NO: 2639347 - RNA, 22 nt, Human metapneumovirus
cauauguccaggcugaaagcau

SEQ ID NO: 2639348 - RNA, 13 nt, Human metapneumovirus
ccaccagcagugc

SEQ ID NO: 2639349 - RNA, 18 nt, Human metapneumovirus
auaacaaacuaucugaca

SEQ ID NO: 2639350 - RNA, 15 nt, Human metapneumovirus
aaaaggcaacaacac

SEQ ID NO: 2639351 - RNA, 17 nt, Human metapneumovirus
caccagcaauaucuuug

SEQ ID NO: 2639352 - RNA, 16 nt, Human metapneumovirus
gaacuagccagagcug

SEQ ID NO: 2639353 - RNA, 20 nt, Human metapneumovirus
cugaagaucaauucaauguu

SEQ ID NO: 2639354 - RNA, 23 nt, Human metapneumovirus
aucaacuggcaagagaggagcaa

SEQ ID NO: 2639355 - RNA, 12 nt, Human metapneumovirus
ggccaacacacc

SEQ ID NO: 2639356 - RNA, 16 nt, Human metapneumovirus
caaaguuagcacagga

SEQ ID NO: 2639357 - RNA, 17 nt, Human metapneumovirus
auugaugauaaccaaag

SEQ ID NO: 2639358 - RNA, 16 nt, Human metapneumovirus
agaaaauaaaaaaucg

SEQ ID NO: 2639359 - RNA, 19 nt, Human metapneumovirus
aaaggcauauucaaaaagc

SEQ ID NO: 2639360 - RNA, 19 nt, Human metapneumovirus
acaauggcuucauaccaca

SEQ ID NO: 2639361 - RNA, 21 nt, Human metapneumovirus
cucgguguugcaacugcagcu

SEQ ID NO: 2639362 - RNA, 23 nt, Human metapneumovirus
cacaugcuggaaaauaaacagaa

SEQ ID NO: 2639363 - RNA, 17 nt, Human metapneumovirus
aguuagcauggacagau

SEQ ID NO: 2639364 - RNA, 17 nt, Human metapneumovirus
aaaagacugugaaacaa

SEQ ID NO: 2639365 - RNA, 16 nt, Human metapneumovirus
uaaagggaaagcagca

SEQ ID NO: 2639366 - RNA, 20 nt, Human metapneumovirus
cgacauugcugaccugaaaa

SEQ ID NO: 2639367 - RNA, 16 nt, Human metapneumovirus
gacauaauaaaggaag

SEQ ID NO: 2639368 - RNA, 14 nt, Human metapneumovirus
caagagaggagcaa

SEQ ID NO: 2639369 - RNA, 21 nt, Human metapneumovirus
uuaugaucaugacuaugaaca

SEQ ID NO: 2639370 - RNA, 17 nt, Human metapneumovirus
caauagacaacacugua

SEQ ID NO: 2639371 - RNA, 20 nt, Human metapneumovirus
ggaagcuaaagggaaagcag

SEQ ID NO: 2639372 - RNA, 22 nt, Human metapneumovirus
aagcagcaaaauuagcagaagc

SEQ ID NO: 2639373 - RNA, 21 nt, Human metapneumovirus
agcuuugacccagucaaguuu

SEQ ID NO: 2639374 - RNA, 21 nt, Human metapneumovirus
cccagcuuaauaaaaacagaa

SEQ ID NO: 2639375 - RNA, 16 nt, Human metapneumovirus
cagagaugcaaugauu

SEQ ID NO: 2639376 - RNA, 15 nt, Human metapneumovirus
aucaaucaaacagaa

SEQ ID NO: 2639377 - RNA, 22 nt, Human metapneumovirus
aggaaucaauguugcugagcag

SEQ ID NO: 2639378 - RNA, 12 nt, Human metapneumovirus
guaacagcaauu

SEQ ID NO: 2639379 - RNA, 15 nt, Human metapneumovirus
gaagaagaagaagaa

SEQ ID NO: 2639380 - RNA, 18 nt, Human metapneumovirus
uuuucauggguaaugaag

SEQ ID NO: 2639381 - RNA, 20 nt, Human metapneumovirus
auggaucuagaaaagaacac

SEQ ID NO: 2639382 - RNA, 16 nt, Human metapneumovirus
aaaguuagcacaggaa

SEQ ID NO: 2639383 - RNA, 19 nt, Human metapneumovirus
gcugaaagcauaagcaaaa

SEQ ID NO: 2639384 - RNA, 15 nt, Human metapneumovirus
aacugccaaucuuug

SEQ ID NO: 2639385 - RNA, 12 nt, Human metapneumovirus
aaauuaagcaug

SEQ ID NO: 2639386 - RNA, 20 nt, Human metapneumovirus
uaggaguuuacggaagcucc

SEQ ID NO: 2639387 - RNA, 23 nt, Human metapneumovirus
gauauggacucacaaggacuuaa

SEQ ID NO: 2639388 - RNA, 19 nt, Human metapneumovirus
acacacaagacaauaguca

SEQ ID NO: 2639389 - RNA, 16 nt, Human metapneumovirus
ccuuacacagcagcug

SEQ ID NO: 2639390 - RNA, 20 nt, Human metapneumovirus
gcaggacccacagcagcaag

SEQ ID NO: 2639391 - RNA, 13 nt, Human metapneumovirus
cagaaacaaacca

SEQ ID NO: 2639392 - RNA, 20 nt, Human metapneumovirus
caguuucaaucaaagagagu

SEQ ID NO: 2639393 - RNA, 23 nt, Human metapneumovirus
aggagcaccuccagagcugagug

SEQ ID NO: 2639394 - RNA, 12 nt, Human metapneumovirus
uuggcaacugca

SEQ ID NO: 2639395 - RNA, 17 nt, Human metapneumovirus
uggaucccauugaagaa

SEQ ID NO: 2639396 - RNA, 17 nt, Human metapneumovirus
gagcauauguccaggcu

SEQ ID NO: 2639397 - RNA, 17 nt, Human metapneumovirus
cuaaucaagugcaguga

SEQ ID NO: 2639398 - RNA, 21 nt, Human metapneumovirus
gaagcugcuauaagcagugaa

SEQ ID NO: 2639399 - RNA, 17 nt, Human metapneumovirus
agcucagccaaaucagu

SEQ ID NO: 2639400 - RNA, 20 nt, Human metapneumovirus
gcacuaaucaagugcaguga

SEQ ID NO: 2639401 - RNA, 16 nt, Human metapneumovirus
aagucucauacuaaca

SEQ ID NO: 2639402 - RNA, 22 nt, Human metapneumovirus
aagaucaauucaauguugcacu

SEQ ID NO: 2639403 - RNA, 17 nt, Human metapneumovirus
gcagcaggaaucaaugu

SEQ ID NO: 2639404 - RNA, 14 nt, Human metapneumovirus
uaagaucaaauuau

SEQ ID NO: 2639405 - RNA, 14 nt, Human metapneumovirus
ucaaaucaguuuca

SEQ ID NO: 2639406 - RNA, 17 nt, Human metapneumovirus
aacaaucugcaaauaug

SEQ ID NO: 2639407 - RNA, 14 nt, Human metapneumovirus
agauagauacuuau

SEQ ID NO: 2639408 - RNA, 16 nt, Human metapneumovirus
acaaguaaaaauggag

SEQ ID NO: 2639409 - RNA, 15 nt, Human metapneumovirus
cucagccaaaucagu

SEQ ID NO: 2639410 - RNA, 12 nt, Human metapneumovirus
ucaucaaaucag

SEQ ID NO: 2639411 - RNA, 19 nt, Human metapneumovirus
cgcuggaauaacaccagca

SEQ ID NO: 2639412 - RNA, 18 nt, Human metapneumovirus
gaaaaucccagacaaucu

SEQ ID NO: 2639413 - RNA, 18 nt, Human metapneumovirus
cauauucaaaaagcuugg

SEQ ID NO: 2639414 - RNA, 17 nt, Human metapneumovirus
ucaggccaacacaccac

SEQ ID NO: 2639415 - RNA, 23 nt, Human metapneumovirus
caaggcauuccuuacacagcagc

SEQ ID NO: 2639416 - RNA, 16 nt, Human metapneumovirus
guagcacucgaugaau

SEQ ID NO: 2639417 - RNA, 13 nt, Human metapneumovirus
auaacaccagcaa

SEQ ID NO: 2639418 - RNA, 17 nt, Human metapneumovirus
auggaucuagaaaagaa

SEQ ID NO: 2639419 - RNA, 18 nt, Human metapneumovirus
caggacccacagcagcaa

SEQ ID NO: 2639420 - RNA, 18 nt, Human metapneumovirus
cagauuuaugcagaaaca

SEQ ID NO: 2639421 - RNA, 22 nt, Human metapneumovirus
aaaaacugaaucagacaaaaag

SEQ ID NO: 2639422 - RNA, 12 nt, Human metapneumovirus
aacaagaggaga

SEQ ID NO: 2639423 - RNA, 19 nt, Human metapneumovirus
cacaggagcaccuccagag

SEQ ID NO: 2639424 - RNA, 19 nt, Human metapneumovirus
uucauggguaaugaagcag

SEQ ID NO: 2639425 - RNA, 18 nt, Human metapneumovirus
agaccugaccaaaagugc

SEQ ID NO: 2639426 - RNA, 13 nt, Human metapneumovirus
caacugcagcugc

SEQ ID NO: 2639427 - RNA, 14 nt, Human metapneumovirus
uugucaaaaugcag

SEQ ID NO: 2639428 - RNA, 16 nt, Human metapneumovirus
gauguuggagaaccgu

SEQ ID NO: 2639429 - RNA, 20 nt, Human metapneumovirus
aaauauaacaacauacaaau

SEQ ID NO: 2639430 - RNA, 15 nt, Human metapneumovirus
agaaacccacaggag

SEQ ID NO: 2639431 - RNA, 20 nt, Human metapneumovirus
uguccuagguuccaccaaug

SEQ ID NO: 2639432 - RNA, 15 nt, Human metapneumovirus
agucaaaaacugaau

SEQ ID NO: 2639433 - RNA, 16 nt, Human metapneumovirus
cuggauaguaaaagca

SEQ ID NO: 2639434 - RNA, 13 nt, Human metapneumovirus
accaaaacugaaa

SEQ ID NO: 2639435 - RNA, 19 nt, Human metapneumovirus
acaagaauuaaaucaauca

SEQ ID NO: 2639436 - RNA, 19 nt, Human metapneumovirus
gagaaaggaaacacuggcu

SEQ ID NO: 2639437 - RNA, 22 nt, Human metapneumovirus
aggacagguugguacaccaaug

SEQ ID NO: 2639438 - RNA, 12 nt, Human metapneumovirus
uauuuugaaaac

SEQ ID NO: 2639439 - RNA, 13 nt, Human metapneumovirus
cugaaaaaaccaa

SEQ ID NO: 2639440 - RNA, 13 nt, Human metapneumovirus
acuauaacugaag

SEQ ID NO: 2639441 - RNA, 15 nt, Human metapneumovirus
acauggugcaacugc

SEQ ID NO: 2639442 - RNA, 15 nt, Human metapneumovirus
ugcaguuacagcagg

SEQ ID NO: 2639443 - RNA, 11 nt, Human metapneumovirus
uaaaaaugucu

SEQ ID NO: 2639444 - RNA, 12 nt, Human metapneumovirus
acacagcagcug

SEQ ID NO: 2639445 - RNA, 14 nt, Human metapneumovirus
caaaccaaaaccag

SEQ ID NO: 2639446 - RNA, 20 nt, Human metapneumovirus
gaccaagcucuaacacaggc

SEQ ID NO: 2639447 - RNA, 21 nt, Human metapneumovirus
auuugcucucagauaaugaag

SEQ ID NO: 2639448 - RNA, 17 nt, Human metapneumovirus
ccuuacacagcagcugu

SEQ ID NO: 2639449 - RNA, 13 nt, Human metapneumovirus
aaaaacagaauua

SEQ ID NO: 2639450 - RNA, 18 nt, Human metapneumovirus
caacugcagugagagagc

SEQ ID NO: 2639451 - RNA, 17 nt, Human metapneumovirus
agcuucagucaauucaa

SEQ ID NO: 2639452 - RNA, 15 nt, Human metapneumovirus
aaguuggaaaaagau

SEQ ID NO: 2639453 - RNA, 23 nt, Human metapneumovirus
aucuagaaaagaacacaccuguu

SEQ ID NO: 2639454 - RNA, 20 nt, Human metapneumovirus
gacaacacuguauaccagcu

SEQ ID NO: 2639455 - RNA, 16 nt, Human metapneumovirus
aaaaguaaaaaacaau

SEQ ID NO: 2639456 - RNA, 22 nt, Human metapneumovirus
ugagcagucaaaggagugcaac

SEQ ID NO: 2639457 - RNA, 14 nt, Human metapneumovirus
augauggaagagga

SEQ ID NO: 2639458 - RNA, 22 nt, Human metapneumovirus
aagaugaaagcacaaguggaga

SEQ ID NO: 2639459 - RNA, 15 nt, Human metapneumovirus
ccaaaugaaaaagac

SEQ ID NO: 2639460 - RNA, 17 nt, Human metapneumovirus
agaauuagaccugacca

SEQ ID NO: 2639461 - RNA, 19 nt, Human metapneumovirus
aucuagaaaagaacacacc

SEQ ID NO: 2639462 - RNA, 20 nt, Human metapneumovirus
acccaugcaaaguuagcaca

SEQ ID NO: 2639463 - RNA, 13 nt, Human metapneumovirus
aaacaaucugcaa

SEQ ID NO: 2639464 - RNA, 18 nt, Human metapneumovirus
ucagauaaugaagaagaa

SEQ ID NO: 2639465 - RNA, 16 nt, Human metapneumovirus
caacugcagcugcagu

SEQ ID NO: 2639466 - RNA, 12 nt, Human metapneumovirus
gcggcaauuuuc

SEQ ID NO: 2639467 - RNA, 19 nt, Human metapneumovirus
guuggagaaccgugcaaug

SEQ ID NO: 2639468 - RNA, 20 nt, Human metapneumovirus
aggaacacugauagagcuga

SEQ ID NO: 2639469 - RNA, 14 nt, Human metapneumovirus
caacugaacaaagg

SEQ ID NO: 2639470 - RNA, 23 nt, Human metapneumovirus
agacaacgcuggaauaacaccag

SEQ ID NO: 2639471 - RNA, 18 nt, Human metapneumovirus
acagucugugaaguaaaa

SEQ ID NO: 2639472 - RNA, 17 nt, Human metapneumovirus
cacuggcuucaucauug

SEQ ID NO: 2639473 - RNA, 13 nt, Human metapneumovirus
aguaaaaaacaau

SEQ ID NO: 2639474 - RNA, 17 nt, Human metapneumovirus
caaaugcaauagaggaa

SEQ ID NO: 2639475 - RNA, 21 nt, Human metapneumovirus
augggaaaaccccugcagaaa

SEQ ID NO: 2639476 - RNA, 12 nt, Human metapneumovirus
caaaauugcacc

SEQ ID NO: 2639477 - RNA, 20 nt, Human metapneumovirus
aaauuagcaaagcucauaau

SEQ ID NO: 2639478 - RNA, 18 nt, Human metapneumovirus
cagaauccuaagcagugc

SEQ ID NO: 2639479 - RNA, 15 nt, Human metapneumovirus
aaucaugauaucaca

SEQ ID NO: 2639480 - RNA, 11 nt, Human metapneumovirus
aagaaaacaaa

SEQ ID NO: 2639481 - RNA, 15 nt, Human metapneumovirus
ccacaggagcaccuc

SEQ ID NO: 2639482 - RNA, 14 nt, Human metapneumovirus
gagaccaugucuuu

SEQ ID NO: 2639483 - RNA, 16 nt, Human metapneumovirus
aagaaacugaaaccau

SEQ ID NO: 2639484 - RNA, 15 nt, Human metapneumovirus
uaggagcauaugucc

SEQ ID NO: 2639485 - RNA, 20 nt, Human metapneumovirus
cagcccaaggugcagcaaug

SEQ ID NO: 2639486 - RNA, 19 nt, Human metapneumovirus
gcaaaaaaacacaugaucu

SEQ ID NO: 2639487 - RNA, 19 nt, Human metapneumovirus
acagaagguuccuaaaugu

SEQ ID NO: 2639488 - RNA, 19 nt, Human metapneumovirus
ccaacaucugcaggacaaa

SEQ ID NO: 2639489 - RNA, 23 nt, Human metapneumovirus
ugggaaaaccccugcagaaaaga

SEQ ID NO: 2639490 - RNA, 16 nt, Human metapneumovirus
acuucccaaaaaauuu

SEQ ID NO: 2639491 - RNA, 23 nt, Human metapneumovirus
agugaguguuuuuaucauaauaa

SEQ ID NO: 2639492 - RNA, 17 nt, Human metapneumovirus
caugaucuaaucgcacu

SEQ ID NO: 2639493 - RNA, 13 nt, Human metapneumovirus
ugcaaucaacaaa

SEQ ID NO: 2639494 - RNA, 18 nt, Human metapneumovirus
aagggacaagauaugucu

SEQ ID NO: 2639495 - RNA, 14 nt, Human metapneumovirus
ggcaacugcaguga

SEQ ID NO: 2639496 - RNA, 17 nt, Human metapneumovirus
gaacuagccagagcugu

SEQ ID NO: 2639497 - RNA, 19 nt, Human metapneumovirus
ugcacaaauauaacaacau

SEQ ID NO: 2639498 - RNA, 13 nt, Human metapneumovirus
aagcagcaaaauu

SEQ ID NO: 2639499 - RNA, 14 nt, Human metapneumovirus
cuguuuccaacaug

SEQ ID NO: 2639500 - RNA, 20 nt, Human metapneumovirus
aaaauauuuugaaaacaagu

SEQ ID NO: 2639501 - RNA, 12 nt, Human metapneumovirus
caaaacaacacc

SEQ ID NO: 2639502 - RNA, 21 nt, Human metapneumovirus
aaggccagugucaagcagcuu

SEQ ID NO: 2639503 - RNA, 18 nt, Human metapneumovirus
agcauucaucaaaucagu

SEQ ID NO: 2639504 - RNA, 16 nt, Human metapneumovirus
gaaagugaaguaacag

SEQ ID NO: 2639505 - RNA, 13 nt, Human metapneumovirus
ccugcagaaaaga

SEQ ID NO: 2639506 - RNA, 15 nt, Human metapneumovirus
uugaagaugaaagca

SEQ ID NO: 2639507 - RNA, 22 nt, Human metapneumovirus
cacucgguguugcaacugcagc

SEQ ID NO: 2639508 - RNA, 16 nt, Human metapneumovirus
acuguugaagcugcua

SEQ ID NO: 2639509 - RNA, 15 nt, Human metapneumovirus
caggacccacagcag

SEQ ID NO: 2639510 - RNA, 17 nt, Human metapneumovirus
acacaccaccagcagug

SEQ ID NO: 2639511 - RNA, 16 nt, Human metapneumovirus
aucaucaagcaacuga

SEQ ID NO: 2639512 - RNA, 15 nt, Human metapneumovirus
aauaaaaaugucuug

SEQ ID NO: 2639513 - RNA, 15 nt, Human metapneumovirus
uaaaaauaaacaaug

SEQ ID NO: 2639514 - RNA, 21 nt, Human metapneumovirus
ucaagagacugccgagagaga

SEQ ID NO: 2639515 - RNA, 17 nt, Human metapneumovirus
ugacaaacucacagucu

SEQ ID NO: 2639516 - RNA, 20 nt, Human metapneumovirus
uagauucguucuaggagcaa

SEQ ID NO: 2639517 - RNA, 13 nt, Human metapneumovirus
uggggaauggagu

SEQ ID NO: 2639518 - RNA, 15 nt, Human metapneumovirus
uaucaggagcaggca

SEQ ID NO: 2639519 - RNA, 23 nt, Human metapneumovirus
ccagagcugaguggugucacaaa

SEQ ID NO: 2639520 - RNA, 21 nt, Human metapneumovirus
cugcaucuuuaaucaacaauc

SEQ ID NO: 2639521 - RNA, 14 nt, Human metapneumovirus
auuuugaaaacaag

SEQ ID NO: 2639522 - RNA, 15 nt, Human metapneumovirus
caucacaacauuauu

SEQ ID NO: 2639523 - RNA, 14 nt, Human metapneumovirus
agaucauaaaguca

SEQ ID NO: 2639524 - RNA, 16 nt, Human metapneumovirus
augcacaaauauaaca

SEQ ID NO: 2639525 - RNA, 15 nt, Human metapneumovirus
ugaaaaagacuguga

SEQ ID NO: 2639526 - RNA, 16 nt, Human metapneumovirus
caccagcagugcugcu

SEQ ID NO: 2639527 - RNA, 18 nt, Human metapneumovirus
uugagaacagucaggccu

SEQ ID NO: 2639528 - RNA, 19 nt, Human metapneumovirus
aauauuuugaaaacaagua

SEQ ID NO: 2639529 - RNA, 21 nt, Human metapneumovirus
caaacucacagucugugaagu

SEQ ID NO: 2639530 - RNA, 18 nt, Human metapneumovirus
caaaaaauuugaagucaa

SEQ ID NO: 2639531 - RNA, 12 nt, Human metapneumovirus
agaaaaagcaaa

SEQ ID NO: 2639532 - RNA, 18 nt, Human metapneumovirus
acugugaaacaagaggag

SEQ ID NO: 2639533 - RNA, 19 nt, Human metapneumovirus
guuauauaaaaaucaaguu

SEQ ID NO: 2639534 - RNA, 16 nt, Human metapneumovirus
caauucaauguugcac

SEQ ID NO: 2639535 - RNA, 18 nt, Human metapneumovirus
cuuaauaaaaacagaauu

SEQ ID NO: 2639536 - RNA, 16 nt, Human metapneumovirus
acacaggccaaaauug

SEQ ID NO: 2639537 - RNA, 20 nt, Human metapneumovirus
caagaauuaaaucaaucaag

SEQ ID NO: 2639538 - RNA, 16 nt, Human metapneumovirus
gacacagcagcaggaa

SEQ ID NO: 2639539 - RNA, 17 nt, Human metapneumovirus
acuaacaccaaaaagaa

SEQ ID NO: 2639540 - RNA, 14 nt, Human metapneumovirus
accaccagcagugc

SEQ ID NO: 2639541 - RNA, 20 nt, Human metapneumovirus
ugaugggucuucaaaaacau

SEQ ID NO: 2639542 - RNA, 23 nt, Human metapneumovirus
agucauggaucccauugaagaag

SEQ ID NO: 2639543 - RNA, 22 nt, Human metapneumovirus
aaggaaggccagugucaagcag

SEQ ID NO: 2639544 - RNA, 13 nt, Human metapneumovirus
acccacaggagca

SEQ ID NO: 2639545 - RNA, 14 nt, Human metapneumovirus
aaaauuugugagcu

SEQ ID NO: 2639546 - RNA, 15 nt, Human metapneumovirus
cacucgguguugcaa

SEQ ID NO: 2639547 - RNA, 14 nt, Human metapneumovirus
cuugaaguccagau

SEQ ID NO: 2639548 - RNA, 18 nt, Human metapneumovirus
aagauaugucuugaaguc

SEQ ID NO: 2639549 - RNA, 18 nt, Human metapneumovirus
aggacccacagcagcaag

SEQ ID NO: 2639550 - RNA, 15 nt, Human metapneumovirus
acucaagcccacagc

SEQ ID NO: 2639551 - RNA, 20 nt, Human metapneumovirus
auugaaaaucccagacaauc

SEQ ID NO: 2639552 - RNA, 13 nt, Human metapneumovirus
uguuggagaaccg

SEQ ID NO: 2639553 - RNA, 16 nt, Human metapneumovirus
guuauauaaaaaucaa

SEQ ID NO: 2639554 - RNA, 13 nt, Human metapneumovirus
aaaugaaaaagac

SEQ ID NO: 2639555 - RNA, 17 nt, Human metapneumovirus
ucaauguugcugagcag

SEQ ID NO: 2639556 - RNA, 21 nt, Human metapneumovirus
agucaaguuuccugaagauca

SEQ ID NO: 2639557 - RNA, 12 nt, Human metapneumovirus
auaaaaacagaa

SEQ ID NO: 2639558 - RNA, 17 nt, Human metapneumovirus
aagagcucaacaaaauu

SEQ ID NO: 2639559 - RNA, 14 nt, Human metapneumovirus
cacaaauauaacaa

SEQ ID NO: 2639560 - RNA, 14 nt, Human metapneumovirus
cuaagcagugcaga

SEQ ID NO: 2639561 - RNA, 20 nt, Human metapneumovirus
ucaaucaaacagaauccuaa

SEQ ID NO: 2639562 - RNA, 22 nt, Human metapneumovirus
acaucagagugggauaaaugac

SEQ ID NO: 2639563 - RNA, 13 nt, Human metapneumovirus
uaguuaauuaaaa

SEQ ID NO: 2639564 - RNA, 12 nt, Human metapneumovirus
cagucaaaaacu

SEQ ID NO: 2639565 - RNA, 18 nt, Human metapneumovirus
ggcauuccuuacacagca

SEQ ID NO: 2639566 - RNA, 15 nt, Human metapneumovirus
agacugugaaacaag

SEQ ID NO: 2639567 - RNA, 16 nt, Human metapneumovirus
guaaugaagcagcaaa

SEQ ID NO: 2639568 - RNA, 17 nt, Human metapneumovirus
aaacaaaccaaaaccag

SEQ ID NO: 2639569 - RNA, 14 nt, Human metapneumovirus
uuggcaacugcagu

SEQ ID NO: 2639570 - RNA, 16 nt, Human metapneumovirus
aauuguuauuuagaaa

SEQ ID NO: 2639571 - RNA, 21 nt, Human metapneumovirus
gucaagcagcuuugacccagu

SEQ ID NO: 2639572 - RNA, 22 nt, Human metapneumovirus
auaagcaaaauaugcaagacuu

SEQ ID NO: 2639573 - RNA, 21 nt, Human metapneumovirus
aauccuaaauguuaacaccag

SEQ ID NO: 2639574 - RNA, 18 nt, Human metapneumovirus
aauuaaaaacuuaaaagu

SEQ ID NO: 2639575 - RNA, 15 nt, Human metapneumovirus
cagagaaaggaaaca

SEQ ID NO: 2639576 - RNA, 19 nt, Human metapneumovirus
agacugugaaacaagagga

SEQ ID NO: 2639577 - RNA, 19 nt, Human metapneumovirus
cagcuuaauaaaaacagaa

SEQ ID NO: 2639578 - RNA, 17 nt, Human metapneumovirus
acagcaggacccacagc

SEQ ID NO: 2639579 - RNA, 21 nt, Human metapneumovirus
caaacuaucugacagcaaaca

SEQ ID NO: 2639580 - RNA, 15 nt, Human metapneumovirus
ucaaaaacugaauca

SEQ ID NO: 2639581 - RNA, 14 nt, Human metapneumovirus
agaacuaggagcau

SEQ ID NO: 2639582 - RNA, 19 nt, Human metapneumovirus
gccuugguggaucaaucaa

SEQ ID NO: 2639583 - RNA, 15 nt, Human metapneumovirus
gccucuuaagagaag

SEQ ID NO: 2639584 - RNA, 21 nt, Human metapneumovirus
ggaauaacaccagcaauaucu

SEQ ID NO: 2639585 - RNA, 16 nt, Human metapneumovirus
aagaagaagaagaacc

SEQ ID NO: 2639586 - RNA, 17 nt, Human metapneumovirus
agaauuaaaucaaucaa

SEQ ID NO: 2639587 - RNA, 22 nt, Human metapneumovirus
accacauaauuaguuaauuaaa

SEQ ID NO: 2639588 - RNA, 21 nt, Human metapneumovirus
caaucuuaaccuuugaagaaa

SEQ ID NO: 2639589 - RNA, 22 nt, Human metapneumovirus
agacagugaaagcacuaaucaa

SEQ ID NO: 2639590 - RNA, 21 nt, Human metapneumovirus
ugagcuguuccauuggcagca

SEQ ID NO: 2639591 - RNA, 21 nt, Human metapneumovirus
gucaaguuuccugaagaucaa

SEQ ID NO: 2639592 - RNA, 14 nt, Human metapneumovirus
ugacacaugcugga

SEQ ID NO: 2639593 - RNA, 23 nt, Human metapneumovirus
acuuauuaauaagaucaaauuau

SEQ ID NO: 2639594 - RNA, 23 nt, Human metapneumovirus
gcaagaaucuaacacgugcaauc

SEQ ID NO: 2639595 - RNA, 16 nt, Human metapneumovirus
cagguguugcaauugc

SEQ ID NO: 2639596 - RNA, 19 nt, Human metapneumovirus
ccaagcucuaacacaggcc

SEQ ID NO: 2639597 - RNA, 16 nt, Human metapneumovirus
aagcuuggagcuggga

SEQ ID NO: 2639598 - RNA, 15 nt, Human metapneumovirus
gagaaccgugcaaug

SEQ ID NO: 2639599 - RNA, 20 nt, Human metapneumovirus
aagucucauacuaacauuua

SEQ ID NO: 2639600 - RNA, 23 nt, Human metapneumovirus
ggagaugagcaaaacuccugcau

SEQ ID NO: 2639601 - RNA, 13 nt, Human metapneumovirus
agagagcugaaag

SEQ ID NO: 2639602 - RNA, 14 nt, Human metapneumovirus
caagcccacagcau

SEQ ID NO: 2639603 - RNA, 14 nt, Human metapneumovirus
uccauuggcagcaa

SEQ ID NO: 2639604 - RNA, 21 nt, Human metapneumovirus
agacacagugacaauagacaa

SEQ ID NO: 2639605 - RNA, 18 nt, Human metapneumovirus
ucagcccaaggugcagca

SEQ ID NO: 2639606 - RNA, 13 nt, Human metapneumovirus
gcacuaagagagc

SEQ ID NO: 2639607 - RNA, 18 nt, Human metapneumovirus
ucauuuacaccaaaugaa

SEQ ID NO: 2639608 - RNA, 20 nt, Human metapneumovirus
ccaccagcagugcugcucga

SEQ ID NO: 2639609 - RNA, 18 nt, Human metapneumovirus
ggcaacugcagugagaga

SEQ ID NO: 2639610 - RNA, 19 nt, Human metapneumovirus
guguuggcaacugcaguga

SEQ ID NO: 2639611 - RNA, 22 nt, Human metapneumovirus
cuacauaauauaaucaaacaac

SEQ ID NO: 2639612 - RNA, 14 nt, Human metapneumovirus
aaaauaaacaaugg

SEQ ID NO: 2639613 - RNA, 13 nt, Human metapneumovirus
accuuugaagaaa

SEQ ID NO: 2639614 - RNA, 19 nt, Human metapneumovirus
aauuacccaugcaaaguua

SEQ ID NO: 2639615 - RNA, 14 nt, Human metapneumovirus
aauacucaaaguga

SEQ ID NO: 2639616 - RNA, 17 nt, Human metapneumovirus
cuuaagagaagaccaag

SEQ ID NO: 2639617 - RNA, 19 nt, Human metapneumovirus
agcaaaagagcucaacaaa

SEQ ID NO: 2639618 - RNA, 11 nt, Human metapneumovirus
guugaagauga

SEQ ID NO: 2639619 - RNA, 19 nt, Human metapneumovirus
ugcagaaaagaaacugaaa

SEQ ID NO: 2639620 - RNA, 19 nt, Human metapneumovirus
agggaucaucaagcaacug

SEQ ID NO: 2639621 - RNA, 12 nt, Human metapneumovirus
uacacagcagcu

SEQ ID NO: 2639622 - RNA, 23 nt, Human metapneumovirus
caauagacaacacuguauaccag

SEQ ID NO: 2639623 - RNA, 14 nt, Human metapneumovirus
agagagcugaaaga

SEQ ID NO: 2639624 - RNA, 17 nt, Human metapneumovirus
acagcaauuaagaaugc

SEQ ID NO: 2639625 - RNA, 16 nt, Human metapneumovirus
uauaagcagugaagca

SEQ ID NO: 2639626 - RNA, 16 nt, Human metapneumovirus
cacagcagcuguucaa

SEQ ID NO: 2639627 - RNA, 12 nt, Human metapneumovirus
aaacccugacaa

SEQ ID NO: 2639628 - RNA, 21 nt, Human metapneumovirus
cuuacaugugccgauggaccc

SEQ ID NO: 2639629 - RNA, 20 nt, Human metapneumovirus
uaucaaaauuugugagcuca

SEQ ID NO: 2639630 - RNA, 14 nt, Human metapneumovirus
uucaucaaaucagu

SEQ ID NO: 2639631 - RNA, 18 nt, Human metapneumovirus
aaauuguugaagaugaaa

SEQ ID NO: 2639632 - RNA, 19 nt, Human metapneumovirus
agugcacuaagagagcuca

SEQ ID NO: 2639633 - RNA, 21 nt, Human metapneumovirus
ugugagcucagccaaaucagu

SEQ ID NO: 2639634 - RNA, 14 nt, Human metapneumovirus
acaccaaaaagaag

SEQ ID NO: 2639635 - RNA, 14 nt, Human metapneumovirus
cuaggagcaauagc

SEQ ID NO: 2639636 - RNA, 16 nt, Human metapneumovirus
uggaaaacaaucugca

SEQ ID NO: 2639637 - RNA, 22 nt, Human metapneumovirus
acuaugcuugccucuuaagaga

SEQ ID NO: 2639638 - RNA, 18 nt, Human metapneumovirus
aaggcuccgugcaaauau

SEQ ID NO: 2639639 - RNA, 13 nt, Human metapneumovirus
guuggcaacugca

SEQ ID NO: 2639640 - RNA, 20 nt, Human metapneumovirus
aauacucaaagugaaugcau

SEQ ID NO: 2639641 - RNA, 17 nt, Human metapneumovirus
cuggaaaauaaacagaa

SEQ ID NO: 2639642 - RNA, 14 nt, Human metapneumovirus
caacccacaaaaac

SEQ ID NO: 2639643 - RNA, 15 nt, Human metapneumovirus
ucaguguucugagga

SEQ ID NO: 2639644 - RNA, 22 nt, Human metapneumovirus
agcacuaaucaagugcagugag

SEQ ID NO: 2639645 - RNA, 17 nt, Human metapneumovirus
caacgguccccacagac

SEQ ID NO: 2639646 - RNA, 18 nt, Human metapneumovirus
ugacaauagacaacacug

SEQ ID NO: 2639647 - RNA, 18 nt, Human metapneumovirus
uggaucccauugaagaag

SEQ ID NO: 2639648 - RNA, 15 nt, Human metapneumovirus
agcauaagcaaaaua

SEQ ID NO: 2639649 - RNA, 13 nt, Human metapneumovirus
caauucaacagaa

SEQ ID NO: 2639650 - RNA, 12 nt, Human metapneumovirus
aaaaacagaauu

SEQ ID NO: 2639651 - RNA, 14 nt, Human metapneumovirus
caaugauaacauua

SEQ ID NO: 2639652 - RNA, 13 nt, Human metapneumovirus
aacugcagugaga

SEQ ID NO: 2639653 - RNA, 14 nt, Human metapneumovirus
ccaauacucaaagu

SEQ ID NO: 2639654 - RNA, 19 nt, Human metapneumovirus
cagucaaguuuccugaaga

SEQ ID NO: 2639655 - RNA, 22 nt, Human metapneumovirus
agagauacuucaucauuaagca

SEQ ID NO: 2639656 - RNA, 22 nt, Human metapneumovirus
cucaaaaagaccaaugaagcag

SEQ ID NO: 2639657 - RNA, 23 nt, Human metapneumovirus
uagauacuuauuaauaagaucaa

SEQ ID NO: 2639658 - RNA, 22 nt, Human metapneumovirus
ucuacauaauauaaucaaacaa

SEQ ID NO: 2639659 - RNA, 13 nt, Human metapneumovirus
caauuaacaaaau

SEQ ID NO: 2639660 - RNA, 15 nt, Human metapneumovirus
gcagugagagagcug

SEQ ID NO: 2639661 - RNA, 12 nt, Human metapneumovirus
ugauaaacugac

SEQ ID NO: 2639662 - RNA, 15 nt, Human metapneumovirus
uagaucauaaaguca

SEQ ID NO: 2639663 - RNA, 14 nt, Human metapneumovirus
caguguucugagga

SEQ ID NO: 2639664 - RNA, 18 nt, Human metapneumovirus
caacuggcaagagaggag

SEQ ID NO: 2639665 - RNA, 18 nt, Human metapneumovirus
aucaucaagcaacugaac

SEQ ID NO: 2639666 - RNA, 18 nt, Human metapneumovirus
ugaauauagcaaacugga

SEQ ID NO: 2639667 - RNA, 23 nt, Human metapneumovirus
aagagaggaauuaauagcagaca

SEQ ID NO: 2639668 - RNA, 18 nt, Human metapneumovirus
caacaucugcaggacaaa

SEQ ID NO: 2639669 - RNA, 13 nt, Human metapneumovirus
gugcacuaagaga

SEQ ID NO: 2639670 - RNA, 15 nt, Human metapneumovirus
aguggugaucauuuu

SEQ ID NO: 2639671 - RNA, 13 nt, Human metapneumovirus
gaauccuaagcag

SEQ ID NO: 2639672 - RNA, 14 nt, Human metapneumovirus
aaucaaacagaauc

SEQ ID NO: 2639673 - RNA, 17 nt, Human metapneumovirus
agcagucaaaggagugc

SEQ ID NO: 2639674 - RNA, 18 nt, Human metapneumovirus
gcaaaguuagcacaggaa

SEQ ID NO: 2639675 - RNA, 22 nt, Human metapneumovirus
aaaguugaaggcgaacagcaug

SEQ ID NO: 2639676 - RNA, 13 nt, Human metapneumovirus
aacaaaaacaagu

SEQ ID NO: 2639677 - RNA, 15 nt, Human metapneumovirus
aucaagcaacugaac

SEQ ID NO: 2639678 - RNA, 12 nt, Human metapneumovirus
guaaugaagcag

SEQ ID NO: 2639679 - RNA, 19 nt, Human metapneumovirus
ggaucccauugaagaagaa

SEQ ID NO: 2639680 - RNA, 11 nt, Human metapneumovirus
cucaaauuaaa

SEQ ID NO: 2639681 - RNA, 13 nt, Human metapneumovirus
uuggcaacugcag

SEQ ID NO: 2639682 - RNA, 14 nt, Human metapneumovirus
gaaguaacagcaau

SEQ ID NO: 2639683 - RNA, 16 nt, Human metapneumovirus
gcccaaggugcagcaa

SEQ ID NO: 2639684 - RNA, 19 nt, Human metapneumovirus
aagcuaaagggaaagcagc

SEQ ID NO: 2639685 - RNA, 15 nt, Human metapneumovirus
agagagcuacuuaga

SEQ ID NO: 2639686 - RNA, 13 nt, Human metapneumovirus
aaggaaacacugg

SEQ ID NO: 2639687 - RNA, 19 nt, Human metapneumovirus
ucugugaaguaaaaacagu

SEQ ID NO: 2639688 - RNA, 13 nt, Human metapneumovirus
ccuuacacagcag

SEQ ID NO: 2639689 - RNA, 16 nt, Human metapneumovirus
auaaagaaaacaaaga

SEQ ID NO: 2639690 - RNA, 16 nt, Human metapneumovirus
acugaaauaaagcaag

SEQ ID NO: 2639691 - RNA, 17 nt, Human metapneumovirus
aggagcaccuccagagc

SEQ ID NO: 2639692 - RNA, 23 nt, Human metapneumovirus
caaaaugucauucccugaaggaa

SEQ ID NO: 2639693 - RNA, 21 nt, Human metapneumovirus
cuaucugacagcaaacaugua

SEQ ID NO: 2639694 - RNA, 15 nt, Human metapneumovirus
aauaaaggaagcuaa

SEQ ID NO: 2639695 - RNA, 17 nt, Human metapneumovirus
ccagugucaagcagcuu

SEQ ID NO: 2639696 - RNA, 15 nt, Human metapneumovirus
uaaccuuugaagaaa

SEQ ID NO: 2639697 - RNA, 17 nt, Human metapneumovirus
acaauagacaacacugu

SEQ ID NO: 2639698 - RNA, 20 nt, Human metapneumovirus
ugauggaagaggaaaugagu

SEQ ID NO: 2639699 - RNA, 12 nt, Human metapneumovirus
caagcaccuugg

SEQ ID NO: 2639700 - RNA, 20 nt, Human metapneumovirus
ccauaccgucagaaccaaag

SEQ ID NO: 2639701 - RNA, 14 nt, Human metapneumovirus
gagcagucaaagga

SEQ ID NO: 2639702 - RNA, 13 nt, Human metapneumovirus
caaaaacaagugc

SEQ ID NO: 2639703 - RNA, 21 nt, Human metapneumovirus
gacccacagcagcaagagaug

SEQ ID NO: 2639704 - RNA, 15 nt, Human metapneumovirus
ugcgacacagcagca

SEQ ID NO: 2639705 - RNA, 20 nt, Human metapneumovirus
aagugggacaagucaaaaug

SEQ ID NO: 2639706 - RNA, 19 nt, Human metapneumovirus
uccuaaauguuaacaccag

SEQ ID NO: 2639707 - RNA, 18 nt, Human metapneumovirus
guaauaauucuaauugcu

SEQ ID NO: 2639708 - RNA, 17 nt, Human metapneumovirus
gauggcccaaaauuaaa

SEQ ID NO: 2639709 - RNA, 15 nt, Human metapneumovirus
gaauccgaagaagaa

SEQ ID NO: 2639710 - RNA, 15 nt, Human metapneumovirus
gaucaaucaaacaga

SEQ ID NO: 2639711 - RNA, 19 nt, Human metapneumovirus
guugaaggcgaacagcaug

SEQ ID NO: 2639712 - RNA, 15 nt, Human metapneumovirus
gaucuaauagaaaag

SEQ ID NO: 2639713 - RNA, 16 nt, Human metapneumovirus
aaauuugaagucaaug

SEQ ID NO: 2639714 - RNA, 15 nt, Human metapneumovirus
ugaagcagaccaagc

SEQ ID NO: 2639715 - RNA, 14 nt, Human metapneumovirus
guauuuuaaaaguu

SEQ ID NO: 2639716 - RNA, 19 nt, Human metapneumovirus
cguguguuggcaacugcag

SEQ ID NO: 2639717 - RNA, 15 nt, Human metapneumovirus
cuuuggacuuaauga

SEQ ID NO: 2639718 - RNA, 17 nt, Human metapneumovirus
aaacaagaggagaccau

SEQ ID NO: 2639719 - RNA, 19 nt, Human metapneumovirus
uuacauggugcaacugcca

SEQ ID NO: 2639720 - RNA, 19 nt, Human metapneumovirus
aaguaauaauuaauugcuu

SEQ ID NO: 2639721 - RNA, 20 nt, Human metapneumovirus
aaauaauuaaagaccacucu

SEQ ID NO: 2639722 - RNA, 20 nt, Human metapneumovirus
agggaaagcagcagaaauga

SEQ ID NO: 2639723 - RNA, 16 nt, Human metapneumovirus
caucauuguaauaauu

SEQ ID NO: 2639724 - RNA, 20 nt, Human metapneumovirus
gcaaugguaagaagaaaagg

SEQ ID NO: 2639725 - RNA, 16 nt, Human metapneumovirus
agaaccuuacaugugc

SEQ ID NO: 2639726 - RNA, 14 nt, Human metapneumovirus
gcuucauaccacau

SEQ ID NO: 2639727 - RNA, 18 nt, Human metapneumovirus
aacacaccaccagcagug

SEQ ID NO: 2639728 - RNA, 15 nt, Human metapneumovirus
gcaaccaaaacugaa

SEQ ID NO: 2639729 - RNA, 22 nt, Human metapneumovirus
uacagcaggacccacagcagca

SEQ ID NO: 2639730 - RNA, 18 nt, Human metapneumovirus
aauaaaguaaauuaaaau

SEQ ID NO: 2639731 - RNA, 12 nt, Human metapneumovirus
caagcaacugaa

SEQ ID NO: 2639732 - RNA, 21 nt, Human metapneumovirus
guccaauacucaaagugaaug

SEQ ID NO: 2639733 - RNA, 13 nt, Human metapneumovirus
aaugaagaagaag

SEQ ID NO: 2639734 - RNA, 21 nt, Human metapneumovirus
aaaaaucaaguuagaacaaga

SEQ ID NO: 2639735 - RNA, 23 nt, Human metapneumovirus
ucaacaccagauacaacaaaccg

SEQ ID NO: 2639736 - RNA, 21 nt, Human metapneumovirus
gcuauuaagaacacucaacau

SEQ ID NO: 2639737 - RNA, 11 nt, Human metapneumovirus
aucacaaaaau

SEQ ID NO: 2639738 - RNA, 13 nt, Human metapneumovirus
gaaucuucaaucu

SEQ ID NO: 2639739 - RNA, 17 nt, Human metapneumovirus
ucgguguugcaacugca

SEQ ID NO: 2639740 - RNA, 21 nt, Human metapneumovirus
caacaauugugauaaacugac

SEQ ID NO: 2639741 - RNA, 22 nt, Human metapneumovirus
cucucagauaaugaagaagaag

SEQ ID NO: 2639742 - RNA, 15 nt, Human metapneumovirus
acggcacgcagaacc

SEQ ID NO: 2639743 - RNA, 15 nt, Human metapneumovirus
agcaccuccagagcu

SEQ ID NO: 2639744 - RNA, 16 nt, Human metapneumovirus
ugaccaaaagugcacu

SEQ ID NO: 2639745 - RNA, 18 nt, Human metapneumovirus
auauuagcuuuacuaaca

SEQ ID NO: 2639746 - RNA, 20 nt, Human metapneumovirus
guagggaucaucaagcaacu

SEQ ID NO: 2639747 - RNA, 16 nt, Human metapneumovirus
cuuacacagcagcugu

SEQ ID NO: 2639748 - RNA, 14 nt, Human metapneumovirus
gaagaagaagaugc

SEQ ID NO: 2639749 - RNA, 17 nt, Human metapneumovirus
aagcaccuuggccaaga

SEQ ID NO: 2639750 - RNA, 19 nt, Human metapneumovirus
caaugcgacuguagcacuc

SEQ ID NO: 2639751 - RNA, 16 nt, Human metapneumovirus
ucauuaagaaaaccag

SEQ ID NO: 2639752 - RNA, 16 nt, Human metapneumovirus
agcagugcagagaaag

SEQ ID NO: 2639753 - RNA, 16 nt, Human metapneumovirus
aggacccacagcagca

SEQ ID NO: 2639754 - RNA, 14 nt, Human metapneumovirus
agugagagagcuga

SEQ ID NO: 2639755 - RNA, 17 nt, Human metapneumovirus
gugaagcagaccaagcu

SEQ ID NO: 2639756 - RNA, 18 nt, Human metapneumovirus
aaaaguggaaaacaaucu

SEQ ID NO: 2639757 - RNA, 22 nt, Human metapneumovirus
caagagacugccgagagagaaa

SEQ ID NO: 2639758 - RNA, 12 nt, Human metapneumovirus
aaauuugaaguc

SEQ ID NO: 2639759 - RNA, 13 nt, Human metapneumovirus
uccgaagaagaag

SEQ ID NO: 2639760 - RNA, 12 nt, Human metapneumovirus
gauaaugaagaa

SEQ ID NO: 2639761 - RNA, 14 nt, Human metapneumovirus
acaaauaaaaaugu

SEQ ID NO: 2639762 - RNA, 17 nt, Human metapneumovirus
gaucaauuaacaaaauu

SEQ ID NO: 2639763 - RNA, 14 nt, Human metapneumovirus
agucaagaagauga

SEQ ID NO: 2639764 - RNA, 12 nt, Human metapneumovirus
caaucaaagaga

SEQ ID NO: 2639765 - RNA, 13 nt, Human metapneumovirus
aaucugcaaauau

SEQ ID NO: 2639766 - RNA, 18 nt, Human metapneumovirus
ggagaauccgaagaagaa

SEQ ID NO: 2639767 - RNA, 23 nt, Human metapneumovirus
ucuucaaaaacauguacucaccu

SEQ ID NO: 2639768 - RNA, 17 nt, Human metapneumovirus
gcucagccaaaucaguu

SEQ ID NO: 2639769 - RNA, 13 nt, Human metapneumovirus
ugacagaugcuga

SEQ ID NO: 2639770 - RNA, 15 nt, Human metapneumovirus
ucaguuucaaucaaa

SEQ ID NO: 2639771 - RNA, 14 nt, Human metapneumovirus
caggaaucaauguu

SEQ ID NO: 2639772 - RNA, 15 nt, Human metapneumovirus
aagaacacaccuguu

SEQ ID NO: 2639773 - RNA, 15 nt, Human metapneumovirus
ugcaaaaaaacacau

SEQ ID NO: 2639774 - RNA, 14 nt, Human metapneumovirus
aaaggcaacaacac

SEQ ID NO: 2639775 - RNA, 22 nt, Human metapneumovirus
aagugcacuaagagagcucaga

SEQ ID NO: 2639776 - RNA, 14 nt, Human metapneumovirus
ugacuaugaacaau

SEQ ID NO: 2639777 - RNA, 21 nt, Human metapneumovirus
acugaaucagacaaaaaggac

SEQ ID NO: 2639778 - RNA, 23 nt, Human metapneumovirus
acagucugugaaguaaaaacagu

SEQ ID NO: 2639779 - RNA, 21 nt, Human metapneumovirus
ugcucucagauaaugaagaag

SEQ ID NO: 2639780 - RNA, 19 nt, Human metapneumovirus
aacucugcaauaaacagug

SEQ ID NO: 2639781 - RNA, 22 nt, Human metapneumovirus
ugcagaaacaaaccaaaaccag

SEQ ID NO: 2639782 - RNA, 12 nt, Human metapneumovirus
acaccagcaaua

SEQ ID NO: 2639783 - RNA, 16 nt, Human metapneumovirus
aggagaaaaagugaau

SEQ ID NO: 2639784 - RNA, 12 nt, Human metapneumovirus
cgacacagcagc

SEQ ID NO: 2639785 - RNA, 17 nt, Human metapneumovirus
aauuguuauuuagaaaa

SEQ ID NO: 2639786 - RNA, 14 nt, Human metapneumovirus
uggggcaaccaaaa

SEQ ID NO: 2639787 - RNA, 14 nt, Human metapneumovirus
uaaucaagugcagu

SEQ ID NO: 2639788 - RNA, 15 nt, Human metapneumovirus
uguuuuaaaucugaa

SEQ ID NO: 2639789 - RNA, 23 nt, Human metapneumovirus
uuuucauggguaaugaagcagca

SEQ ID NO: 2639790 - RNA, 18 nt, Human metapneumovirus
acacggucuuaaagagag

SEQ ID NO: 2639791 - RNA, 20 nt, Human metapneumovirus
caaaaugcagggucaacugu

SEQ ID NO: 2639792 - RNA, 23 nt, Human metapneumovirus
aaguuucuaugauacuucauaau

SEQ ID NO: 2639793 - RNA, 16 nt, Human metapneumovirus
agacaaauaacaaugg

SEQ ID NO: 2639794 - RNA, 17 nt, Human metapneumovirus
acauaucuacuacuaau

SEQ ID NO: 2639795 - RNA, 22 nt, Human metapneumovirus
auggaucccauugaagaagaag

SEQ ID NO: 2639796 - RNA, 10 nt, Human metapneumovirus
guaaauuaaa

SEQ ID NO: 2639797 - RNA, 16 nt, Human metapneumovirus
aacaguuuacuuaaca

SEQ ID NO: 2639798 - RNA, 17 nt, Human metapneumovirus
ggaucccauugaagaag

SEQ ID NO: 2639799 - RNA, 15 nt, Human metapneumovirus
agcaggaaucaaugu

SEQ ID NO: 2639800 - RNA, 17 nt, Human metapneumovirus
aaaagaccaaugaagca

SEQ ID NO: 2639801 - RNA, 16 nt, Human metapneumovirus
uacuacccaaaugaaa

SEQ ID NO: 2639802 - RNA, 15 nt, Human metapneumovirus
cuuugggguuauaga

SEQ ID NO: 2639803 - RNA, 18 nt, Human metapneumovirus
agaugacauuuaccaguu

SEQ ID NO: 2639804 - RNA, 22 nt, Human metapneumovirus
caagaaucuaacacgugcaauc

SEQ ID NO: 2639805 - RNA, 16 nt, Human metapneumovirus
gaauaacaccagcaau

SEQ ID NO: 2639806 - RNA, 13 nt, Human metapneumovirus
uggcaagagagga

SEQ ID NO: 2639807 - RNA, 18 nt, Human metapneumovirus
ugagcucagccaaaucag

SEQ ID NO: 2639808 - RNA, 14 nt, Human metapneumovirus
cagguguugcaauu

SEQ ID NO: 2639809 - RNA, 19 nt, Human metapneumovirus
agggacaagauaugucuug

SEQ ID NO: 2639810 - RNA, 14 nt, Human metapneumovirus
acacaucugaauca

SEQ ID NO: 2639811 - RNA, 21 nt, Human metapneumovirus
ucaaucuuaaccuuugaagaa

SEQ ID NO: 2639812 - RNA, 16 nt, Human metapneumovirus
ugcaacugcagcugca

SEQ ID NO: 2639813 - RNA, 16 nt, Human metapneumovirus
ucaucaaauaccacau

SEQ ID NO: 2639814 - RNA, 17 nt, Human metapneumovirus
ccagcagugcugcucga

SEQ ID NO: 2639815 - RNA, 17 nt, Human metapneumovirus
aaaugauggaagaggaa

SEQ ID NO: 2639816 - RNA, 12 nt, Human metapneumovirus
guuauagacacg

SEQ ID NO: 2639817 - RNA, 19 nt, Human metapneumovirus
ccaaacuaguuaacaaaaa

SEQ ID NO: 2639818 - RNA, 15 nt, Human metapneumovirus
agcagucaaaggagu

SEQ ID NO: 2639819 - RNA, 11 nt, Human metapneumovirus
guuagcacagg

SEQ ID NO: 2639820 - RNA, 19 nt, Human metapneumovirus
auauaacaacauacaaauu

SEQ ID NO: 2639821 - RNA, 15 nt, Human metapneumovirus
uauaacaacauacaa

SEQ ID NO: 2639822 - RNA, 15 nt, Human metapneumovirus
ggaucuagaaaagaa

SEQ ID NO: 2639823 - RNA, 17 nt, Human metapneumovirus
aagcagugaagcagacc

SEQ ID NO: 2639824 - RNA, 22 nt, Human metapneumovirus
ucaacuggcaagagaggagcaa

SEQ ID NO: 2639825 - RNA, 15 nt, Human metapneumovirus
ugguauugucaaaau

SEQ ID NO: 2639826 - RNA, 16 nt, Human metapneumovirus
gaagaagaugcagaau

SEQ ID NO: 2639827 - RNA, 14 nt, Human metapneumovirus
cagucuacauaaua

SEQ ID NO: 2639828 - RNA, 23 nt, Human metapneumovirus
accaacaauugugauaaacugac

SEQ ID NO: 2639829 - RNA, 22 nt, Human metapneumovirus
aaguuagcauggacagauaaag

SEQ ID NO: 2639830 - RNA, 19 nt, Human metapneumovirus
aaaaagugggacaagucaa

SEQ ID NO: 2639831 - RNA, 15 nt, Human metapneumovirus
auaacaccagcaaua

SEQ ID NO: 2639832 - RNA, 16 nt, Human metapneumovirus
ccauggaauccagcag

SEQ ID NO: 2639833 - RNA, 19 nt, Human metapneumovirus
gaucccauugaagaagaag

SEQ ID NO: 2639834 - RNA, 18 nt, Human metapneumovirus
cuaggagcaauagcacuc

SEQ ID NO: 2639835 - RNA, 17 nt, Human metapneumovirus
uagaccugcaaaaccaa

SEQ ID NO: 2639836 - RNA, 19 nt, Human metapneumovirus
augucauucccugaaggaa

SEQ ID NO: 2639837 - RNA, 18 nt, Human metapneumovirus
ucauaauaaagaaaacaa

SEQ ID NO: 2639838 - RNA, 21 nt, Human metapneumovirus
cuguugaagcugcuauaagca

SEQ ID NO: 2639839 - RNA, 20 nt, Human metapneumovirus
augcccucaaaaagaccaau

SEQ ID NO: 2639840 - RNA, 12 nt, Human metapneumovirus
ugguaucaaaau

SEQ ID NO: 2639841 - RNA, 23 nt, Human metapneumovirus
aaagaccaaugaagcaguaucua

SEQ ID NO: 2639842 - RNA, 23 nt, Human metapneumovirus
gcuugaaagugaaguaacagcaa

SEQ ID NO: 2639843 - RNA, 23 nt, Human metapneumovirus
ccgaagaagaagaagaaccaaaa

SEQ ID NO: 2639844 - RNA, 22 nt, Human metapneumovirus
ugaaacccaauccuaaauguua

SEQ ID NO: 2639845 - RNA, 21 nt, Human metapneumovirus
gauacuuauuaauaagaucaa

SEQ ID NO: 2639846 - RNA, 17 nt, Human metapneumovirus
aaucaguuggcaaaaaa

SEQ ID NO: 2639847 - RNA, 20 nt, Human metapneumovirus
gcugaucaacuggcaagaga

SEQ ID NO: 2639848 - RNA, 15 nt, Human metapneumovirus
auuaacagaaaaagc

SEQ ID NO: 2639849 - RNA, 19 nt, Human metapneumovirus
ucuagaaaagaacacaccu

SEQ ID NO: 2639850 - RNA, 13 nt, Human metapneumovirus
cagucaaaaacug

SEQ ID NO: 2639851 - RNA, 16 nt, Human metapneumovirus
uccagauaacaaccaa

SEQ ID NO: 2639852 - RNA, 20 nt, Human metapneumovirus
ccagcauucaucaaaucagu

SEQ ID NO: 2639853 - RNA, 16 nt, Human metapneumovirus
uggaaaauaaacagaa

SEQ ID NO: 2639854 - RNA, 16 nt, Human metapneumovirus
ucaaaggagugcaaca

SEQ ID NO: 2639855 - RNA, 18 nt, Human metapneumovirus
gcauuccuuacacagcag

SEQ ID NO: 2639856 - RNA, 23 nt, Human metapneumovirus
aagccuaacaauaugguucccuu

SEQ ID NO: 2639857 - RNA, 16 nt, Human metapneumovirus
cucuguaugcugcauc

SEQ ID NO: 2639858 - RNA, 18 nt, Human metapneumovirus
gcauucaucaaaucaguu

SEQ ID NO: 2639859 - RNA, 17 nt, Human metapneumovirus
uaacaaccaugaaacca

SEQ ID NO: 2639860 - RNA, 20 nt, Human metapneumovirus
agcagacauaauaaaggaag

SEQ ID NO: 2639861 - RNA, 21 nt, Human metapneumovirus
ucaagcaacugaacaaaggcu

SEQ ID NO: 2639862 - RNA, 15 nt, Human metapneumovirus
aaucaauaaaaacuu

SEQ ID NO: 2639863 - RNA, 21 nt, Human metapneumovirus
augaagaagaagaugcagaau

SEQ ID NO: 2639864 - RNA, 14 nt, Human metapneumovirus
aaaaaccaacaauu

SEQ ID NO: 2639865 - RNA, 16 nt, Human metapneumovirus
aaaaauuugaagucaa

SEQ ID NO: 2639866 - RNA, 22 nt, Human metapneumovirus
ugcagcugcaguuacagcaggu

SEQ ID NO: 2639867 - RNA, 17 nt, Human metapneumovirus
caccccaagaaaaaaac

SEQ ID NO: 2639868 - RNA, 19 nt, Human metapneumovirus
uugugagcucagccaaauc

SEQ ID NO: 2639869 - RNA, 22 nt, Human metapneumovirus
agugcugcucgaucagcuaaaa

SEQ ID NO: 2639870 - RNA, 15 nt, Human metapneumovirus
aagcaagcaaucaaa

SEQ ID NO: 2639871 - RNA, 14 nt, Human metapneumovirus
cacaccuguuacaa

SEQ ID NO: 2639872 - RNA, 16 nt, Human metapneumovirus
aagcgcaagcagaaca

SEQ ID NO: 2639873 - RNA, 16 nt, Human metapneumovirus
uguuggcaacugcagu

SEQ ID NO: 2639874 - RNA, 18 nt, Human metapneumovirus
cauaauaaagaaaacaaa

SEQ ID NO: 2639875 - RNA, 11 nt, Human metapneumovirus
agugcagugag

SEQ ID NO: 2639876 - RNA, 18 nt, Human metapneumovirus
ccuaaauguuaacaccag

SEQ ID NO: 2639877 - RNA, 14 nt, Human metapneumovirus
uggcagcaacagag

SEQ ID NO: 2639878 - RNA, 21 nt, Human metapneumovirus
cuaugaacaaucccaaaggca

SEQ ID NO: 2639879 - RNA, 22 nt, Human metapneumovirus
agcaacagaguagggaucauca

SEQ ID NO: 2639880 - RNA, 15 nt, Human metapneumovirus
agagagaaacugaaa

SEQ ID NO: 2639881 - RNA, 17 nt, Human metapneumovirus
agcagcuguucaaguug

SEQ ID NO: 2639882 - RNA, 15 nt, Human metapneumovirus
aaaauuguugaagau

SEQ ID NO: 2639883 - RNA, 22 nt, Human metapneumovirus
augcugaacuagccagagcugu

SEQ ID NO: 2639884 - RNA, 23 nt, Human metapneumovirus
aaccauccggcuugaaagugaag

SEQ ID NO: 2639885 - RNA, 23 nt, Human metapneumovirus
agauuuaugcagaaacaaaccaa

SEQ ID NO: 2639886 - RNA, 18 nt, Human metapneumovirus
acuguaucagaaacauug

SEQ ID NO: 2639887 - RNA, 19 nt, Human metapneumovirus
uguuuacuacccaaaugaa

SEQ ID NO: 2639888 - RNA, 17 nt, Human metapneumovirus
acccaaaugaaaaagac

SEQ ID NO: 2639889 - RNA, 20 nt, Human metapneumovirus
ugaccaaguuuucgagagca

SEQ ID NO: 2639890 - RNA, 21 nt, Human metapneumovirus
uggaauuugacaaacucacag

SEQ ID NO: 2639891 - RNA, 22 nt, Human metapneumovirus
aggagcaccuccagagcugagu

SEQ ID NO: 2639892 - RNA, 19 nt, Human metapneumovirus
uagcacucgguguugcaac

SEQ ID NO: 2639893 - RNA, 22 nt, Human metapneumovirus
gcuugaaagugaaguaacagca

SEQ ID NO: 2639894 - RNA, 22 nt, Human metapneumovirus
gcugaucaacuggcaagagagg

SEQ ID NO: 2639895 - RNA, 22 nt, Human metapneumovirus
gaauuagaccugaccaaaagug

SEQ ID NO: 2639896 - RNA, 17 nt, Human metapneumovirus
uaucugacagcaaacau

SEQ ID NO: 2639897 - RNA, 19 nt, Human metapneumovirus
ccagcuuaauaaaaacaga

SEQ ID NO: 2639898 - RNA, 23 nt, Human metapneumovirus
auuaaaacaguuuuuaacaagga

SEQ ID NO: 2639899 - RNA, 22 nt, Human metapneumovirus
guaaagugcuuauuguacuuaa

SEQ ID NO: 2639900 - RNA, 19 nt, Human metapneumovirus
aauuacuuaccugagaaaa

SEQ ID NO: 2639901 - RNA, 14 nt, Human metapneumovirus
aaaaaaacacauga

SEQ ID NO: 2639902 - RNA, 18 nt, Human metapneumovirus
cuaaagggaaagcagcag

SEQ ID NO: 2639903 - RNA, 14 nt, Human metapneumovirus
ggcaacaacaccau

SEQ ID NO: 2639904 - RNA, 16 nt, Human metapneumovirus
caguccacacaaaaaa

SEQ ID NO: 2639905 - RNA, 14 nt, Human metapneumovirus
aaaauuaacagaaa

SEQ ID NO: 2639906 - RNA, 22 nt, Human metapneumovirus
aagcacuaaucaagugcaguga

SEQ ID NO: 2639907 - RNA, 19 nt, Human metapneumovirus
cagcaagcucaccagagac

SEQ ID NO: 2639908 - RNA, 15 nt, Human metapneumovirus
guuagcacaggaaga

SEQ ID NO: 2639909 - RNA, 20 nt, Human metapneumovirus
cugcagaaaagaaacugaaa

SEQ ID NO: 2639910 - RNA, 16 nt, Human metapneumovirus
cagugcagagaaagga

SEQ ID NO: 2639911 - RNA, 22 nt, Human metapneumovirus
uggcaacugcagugagagagcu

SEQ ID NO: 2639912 - RNA, 14 nt, Human metapneumovirus
guggaucaaucaaa

SEQ ID NO: 2639913 - RNA, 13 nt, Human metapneumovirus
caaucaaacagaa

SEQ ID NO: 2639914 - RNA, 22 nt, Human metapneumovirus
caaguggagaauccgaagaaga

SEQ ID NO: 2639915 - RNA, 15 nt, Human metapneumovirus
ggcaacugcagugag

SEQ ID NO: 2639916 - RNA, 16 nt, Human metapneumovirus
cauaauaaagaaaaca

SEQ ID NO: 2639917 - RNA, 14 nt, Human metapneumovirus
ccuuacacagcagc

SEQ ID NO: 2639918 - RNA, 15 nt, Human metapneumovirus
ccugaaggaaaagau

SEQ ID NO: 2639919 - RNA, 22 nt, Human metapneumovirus
agcagcaaaauuagcagaagcu

SEQ ID NO: 2639920 - RNA, 21 nt, Human metapneumovirus
cugaagaucaauucaauguug

SEQ ID NO: 2639921 - RNA, 21 nt, Human metapneumovirus
caaggcauuccuuacacagca

SEQ ID NO: 2639922 - RNA, 23 nt, Human metapneumovirus
cucaaagugaaugcaucagccca

SEQ ID NO: 2639923 - RNA, 18 nt, Human metapneumovirus
aucaugacuaugaacaau

SEQ ID NO: 2639924 - RNA, 19 nt, Human metapneumovirus
acggucuuaaagagagcua

SEQ ID NO: 2639925 - RNA, 16 nt, Human metapneumovirus
aagcagugcagagaaa

SEQ ID NO: 2639926 - RNA, 21 nt, Human metapneumovirus
aacaucugcaggacaaauaaa

SEQ ID NO: 2639927 - RNA, 23 nt, Human metapneumovirus
gguaucaaaauuugugagcucag

SEQ ID NO: 2639928 - RNA, 17 nt, Human metapneumovirus
uguccaggcugaaagca

SEQ ID NO: 2639929 - RNA, 20 nt, Human metapneumovirus
agagaggagcaaauugaaaa

SEQ ID NO: 2639930 - RNA, 17 nt, Human metapneumovirus
ugaacuagccagagcug

SEQ ID NO: 2639931 - RNA, 17 nt, Human metapneumovirus
auagaaaaggaccuguu

SEQ ID NO: 2639932 - RNA, 13 nt, Human metapneumovirus
acaccaaaaagaa

SEQ ID NO: 2639933 - RNA, 20 nt, Human metapneumovirus
cagaauccuaagcagugcag

SEQ ID NO: 2639934 - RNA, 20 nt, Human metapneumovirus
aacgaucaaaaauaggaaau

SEQ ID NO: 2639935 - RNA, 17 nt, Human metapneumovirus
caaggugcagcaauguc

SEQ ID NO: 2639936 - RNA, 16 nt, Human metapneumovirus
ucagauaaugaagaag

SEQ ID NO: 2639937 - RNA, 18 nt, Human metapneumovirus
gcgaacagcauguuauaa

SEQ ID NO: 2639938 - RNA, 12 nt, Human metapneumovirus
gaaauuaagcau

SEQ ID NO: 2639939 - RNA, 23 nt, Human metapneumovirus
caggaaucaauguugcugagcag

SEQ ID NO: 2639940 - RNA, 13 nt, Human metapneumovirus
uuaagaaaaccag

SEQ ID NO: 2639941 - RNA, 18 nt, Human metapneumovirus
caagaaucuaacacgugc

SEQ ID NO: 2639942 - RNA, 17 nt, Human metapneumovirus
auggcccaaaauuaaaa

SEQ ID NO: 2639943 - RNA, 11 nt, Human metapneumovirus
cccaauccuaa

SEQ ID NO: 2639944 - RNA, 22 nt, Human metapneumovirus
aaggaagcuaaagggaaagcag

SEQ ID NO: 2639945 - RNA, 16 nt, Human metapneumovirus
caagcucuaacacagg

SEQ ID NO: 2639946 - RNA, 20 nt, Human metapneumovirus
aaaguuggaaaaagaugcuc

SEQ ID NO: 2639947 - RNA, 20 nt, Human metapneumovirus
aaagcaagcaaucaaaguca

SEQ ID NO: 2639948 - RNA, 15 nt, Human metapneumovirus
agugucaagcagcuu

SEQ ID NO: 2639949 - RNA, 18 nt, Human metapneumovirus
aagaacgggacaaauaaa

SEQ ID NO: 2639950 - RNA, 17 nt, Human metapneumovirus
gugagagagcugaaaga

SEQ ID NO: 2639951 - RNA, 14 nt, Human metapneumovirus
ugaagcagaccaag

SEQ ID NO: 2639952 - RNA, 14 nt, Human metapneumovirus
ccucuuaagagaag

SEQ ID NO: 2639953 - RNA, 20 nt, Human metapneumovirus
ucugaagacacaaaaaccaa

SEQ ID NO: 2639954 - RNA, 18 nt, Human metapneumovirus
agugaagucucauacuaa

SEQ ID NO: 2639955 - RNA, 15 nt, Human metapneumovirus
agcucaacaaaauug

SEQ ID NO: 2639956 - RNA, 16 nt, Human metapneumovirus
aaaaugcaaaaaaaca

SEQ ID NO: 2639957 - RNA, 20 nt, Human metapneumovirus
agcagcaggaaucaauguug

SEQ ID NO: 2639958 - RNA, 23 nt, Human metapneumovirus
aaccgugcaaugguaagaagaaa

SEQ ID NO: 2639959 - RNA, 21 nt, Human metapneumovirus
cccacaaacaucugcaagcac

SEQ ID NO: 2639960 - RNA, 23 nt, Human metapneumovirus
ugccucuuaagagaagaccaagg

SEQ ID NO: 2639961 - RNA, 14 nt, Human metapneumovirus
acuuuauuaaaugg

SEQ ID NO: 2639962 - RNA, 16 nt, Human metapneumovirus
uuuacaccaaaugaac

SEQ ID NO: 2639963 - RNA, 21 nt, Human metapneumovirus
agucaaaggagugcaacauaa

SEQ ID NO: 2639964 - RNA, 14 nt, Human metapneumovirus
caaucccaaaggca

SEQ ID NO: 2639965 - RNA, 17 nt, Human metapneumovirus
auauaaaaaucaaguua

SEQ ID NO: 2639966 - RNA, 13 nt, Human metapneumovirus
aaaccagcaguug

SEQ ID NO: 2639967 - RNA, 17 nt, Human metapneumovirus
aauuaguuaauuaaaaa

SEQ ID NO: 2639968 - RNA, 18 nt, Human metapneumovirus
gaaagauuuugugagcaa

SEQ ID NO: 2639969 - RNA, 21 nt, Human metapneumovirus
cacaugcuggaaaauaaacag

SEQ ID NO: 2639970 - RNA, 21 nt, Human metapneumovirus
caggccaacacaccaccagca

SEQ ID NO: 2639971 - RNA, 18 nt, Human metapneumovirus
ggaauaacaccagcaaua

SEQ ID NO: 2639972 - RNA, 21 nt, Human metapneumovirus
caauguuuuuacacuggaggu

SEQ ID NO: 2639973 - RNA, 23 nt, Human metapneumovirus
auuaagaaugcccucaaaaagac

SEQ ID NO: 2639974 - RNA, 19 nt, Human metapneumovirus
agaggaagugagugcaagu

SEQ ID NO: 2639975 - RNA, 13 nt, Human metapneumovirus
auggaagaggaaa

SEQ ID NO: 2639976 - RNA, 21 nt, Human metapneumovirus
auuaguuaauuaaaaauaaag

SEQ ID NO: 2639977 - RNA, 15 nt, Human metapneumovirus
auaugcaagacuugg

SEQ ID NO: 2639978 - RNA, 16 nt, Human metapneumovirus
agcauucaucaaauca

SEQ ID NO: 2639979 - RNA, 22 nt, Human metapneumovirus
gauuuuauggaucuagaaaaga

SEQ ID NO: 2639980 - RNA, 16 nt, Human metapneumovirus
ugucaagcagcuuuga

SEQ ID NO: 2639981 - RNA, 13 nt, Human metapneumovirus
ggguaaugaagca

SEQ ID NO: 2639982 - RNA, 13 nt, Human metapneumovirus
aauaggaaauggu

SEQ ID NO: 2639983 - RNA, 18 nt, Human metapneumovirus
auuauaggagaaaaagug

SEQ ID NO: 2639984 - RNA, 18 nt, Human metapneumovirus
caacugaacaaaggcugc

SEQ ID NO: 2639985 - RNA, 22 nt, Human metapneumovirus
aaaacaaucugcaaauaugcca

SEQ ID NO: 2639986 - RNA, 15 nt, Human metapneumovirus
caagagcaacaaaag

SEQ ID NO: 2639987 - RNA, 18 nt, Human metapneumovirus
acggucuuaaagagagcu

SEQ ID NO: 2639988 - RNA, 13 nt, Human metapneumovirus
caucaaaucaguu

SEQ ID NO: 2639989 - RNA, 19 nt, Human metapneumovirus
cauuccuuacacagcagcu

SEQ ID NO: 2639990 - RNA, 21 nt, Human metapneumovirus
ugggacaaguaaaaauggagu

SEQ ID NO: 2639991 - RNA, 21 nt, Human metapneumovirus
gcacuaaucaagugcagugag

SEQ ID NO: 2639992 - RNA, 15 nt, Human metapneumovirus
caauucaacagaagg

SEQ ID NO: 2639993 - RNA, 19 nt, Human metapneumovirus
aggaacacugauagagcug

SEQ ID NO: 2639994 - RNA, 17 nt, Human metapneumovirus
gaucaacuggcaagaga

SEQ ID NO: 2639995 - RNA, 12 nt, Human metapneumovirus
agaaacugaaaa

SEQ ID NO: 2639996 - RNA, 20 nt, Human metapneumovirus
aucaguuggcaaaaaaacac

SEQ ID NO: 2639997 - RNA, 13 nt, Human metapneumovirus
uaaugaagcagca

SEQ ID NO: 2639998 - RNA, 22 nt, Human metapneumovirus
gccaacacaccaccagcagugc

SEQ ID NO: 2639999 - RNA, 19 nt, Human metapneumovirus
caaacuaguuaacaaaaaa

SEQ ID NO: 2640000 - RNA, 17 nt, Human metapneumovirus
acaagugcgacauugcu

SEQ ID NO: 2640001 - RNA, 16 nt, Human metapneumovirus
gaagaugaaagcacaa

SEQ ID NO: 2640002 - RNA, 17 nt, Human metapneumovirus
aucuaauagaaaaggac

SEQ ID NO: 2640003 - RNA, 15 nt, Human metapneumovirus
cuuuguuucaggcca

SEQ ID NO: 2640004 - RNA, 20 nt, Human metapneumovirus
cgacacacacacaacaccac

SEQ ID NO: 2640005 - RNA, 20 nt, Human metapneumovirus
aggccagugucaagcagcuu

SEQ ID NO: 2640006 - RNA, 19 nt, Human metapneumovirus
uagcacuauaacugaagga

SEQ ID NO: 2640007 - RNA, 21 nt, Human metapneumovirus
aaauuugggacaaaucauaau

SEQ ID NO: 2640008 - RNA, 21 nt, Human metapneumovirus
acauuagaugucauuaaaagu

SEQ ID NO: 2640009 - RNA, 13 nt, Human metapneumovirus
aaggaagcuaaag

SEQ ID NO: 2640010 - RNA, 14 nt, Human metapneumovirus
ggagugagcuguuc

SEQ ID NO: 2640011 - RNA, 15 nt, Human metapneumovirus
ugcaagacuuggagc

SEQ ID NO: 2640012 - RNA, 20 nt, Human metapneumovirus
caaauuauuuauuaaaucaa

SEQ ID NO: 2640013 - RNA, 16 nt, Human metapneumovirus
aucucaagagacugcc

SEQ ID NO: 2640014 - RNA, 14 nt, Human metapneumovirus
auuaagaaaaccag

SEQ ID NO: 2640015 - RNA, 21 nt, Human metapneumovirus
ccaugucuuuugcgacacagc

SEQ ID NO: 2640016 - RNA, 18 nt, Human metapneumovirus
aguguaaaauuaacagaa

SEQ ID NO: 2640017 - RNA, 11 nt, Human metapneumovirus
cccugcagaaa

SEQ ID NO: 2640018 - RNA, 19 nt, Human metapneumovirus
gaggaaaugagucaacgau

SEQ ID NO: 2640019 - RNA, 17 nt, Human metapneumovirus
gagcaccuccagagcug

SEQ ID NO: 2640020 - RNA, 20 nt, Human metapneumovirus
gagagcuugacagaacuaag

SEQ ID NO: 2640021 - RNA, 14 nt, Human metapneumovirus
cagaaaaagcaaaa

SEQ ID NO: 2640022 - RNA, 21 nt, Human metapneumovirus
caguuacagcagguguugcaa

SEQ ID NO: 2640023 - RNA, 14 nt, Human metapneumovirus
agcagugaagcaga

SEQ ID NO: 2640024 - RNA, 21 nt, Human metapneumovirus
cagcaagagaugggaucagag

SEQ ID NO: 2640025 - RNA, 13 nt, Human metapneumovirus
aauauagcaaacu

SEQ ID NO: 2640026 - RNA, 20 nt, Human metapneumovirus
cauaauaauaaguaauaauu

SEQ ID NO: 2640027 - RNA, 16 nt, Human metapneumovirus
gggcuauuaagaacac

SEQ ID NO: 2640028 - RNA, 19 nt, Human metapneumovirus
auagaaauuauauauguca

SEQ ID NO: 2640029 - RNA, 16 nt, Human metapneumovirus
aagggagugagcuguu

SEQ ID NO: 2640030 - RNA, 13 nt, Human metapneumovirus
aaccuuugaagaa

SEQ ID NO: 2640031 - RNA, 16 nt, Human metapneumovirus
caaguuagaacaagaa

SEQ ID NO: 2640032 - RNA, 23 nt, Human metapneumovirus
uauacaaacucugcaauaaacag

SEQ ID NO: 2640033 - RNA, 15 nt, Human metapneumovirus
agcugggacucaagu

SEQ ID NO: 2640034 - RNA, 13 nt, Human metapneumovirus
aucacaaaauggu

SEQ ID NO: 2640035 - RNA, 21 nt, Human metapneumovirus
uacagcaggacccacagcagc

SEQ ID NO: 2640036 - RNA, 22 nt, Human metapneumovirus
agaaugccauuguauauacaca

SEQ ID NO: 2640037 - RNA, 13 nt, Human metapneumovirus
acagcagcuguuc

SEQ ID NO: 2640038 - RNA, 20 nt, Human metapneumovirus
augauaaccaaagcauaaca

SEQ ID NO: 2640039 - RNA, 11 nt, Human metapneumovirus
uaucaggagca

SEQ ID NO: 2640040 - RNA, 16 nt, Human metapneumovirus
cagacacagugacaau

SEQ ID NO: 2640041 - RNA, 22 nt, Human metapneumovirus
uaaccacucuguaugcugcauc

SEQ ID NO: 2640042 - RNA, 16 nt, Human metapneumovirus
accagcagugcugcuc

SEQ ID NO: 2640043 - RNA, 20 nt, Human metapneumovirus
cugaguggugucacaaacaa

SEQ ID NO: 2640044 - RNA, 12 nt, Human metapneumovirus
uuaaucaacaau

SEQ ID NO: 2640045 - RNA, 18 nt, Human metapneumovirus
aaaucaguuucaaucaaa

SEQ ID NO: 2640046 - RNA, 19 nt, Human metapneumovirus
acaagggagugagcuguuc

SEQ ID NO: 2640047 - RNA, 21 nt, Human metapneumovirus
gaaagugaaguaacagcaauu

SEQ ID NO: 2640048 - RNA, 15 nt, Human metapneumovirus
ugcacuaagagagcu

SEQ ID NO: 2640049 - RNA, 12 nt, Human metapneumovirus
caacaacaaaag

SEQ ID NO: 2640050 - RNA, 22 nt, Human metapneumovirus
accaagacgcagacacagugac

SEQ ID NO: 2640051 - RNA, 20 nt, Human metapneumovirus
caaauaaaaaugucuuggaa

SEQ ID NO: 2640052 - RNA, 14 nt, Human metapneumovirus
acacaguuaaaugg

SEQ ID NO: 2640053 - RNA, 19 nt, Human metapneumovirus
ugaguggugucacaaacaa

SEQ ID NO: 2640054 - RNA, 14 nt, Human metapneumovirus
aaaauaaaaauuug

SEQ ID NO: 2640055 - RNA, 12 nt, Human metapneumovirus
aggugcagcaau

SEQ ID NO: 2640056 - RNA, 17 nt, Human metapneumovirus
uagaacaagaauuaaau

SEQ ID NO: 2640057 - RNA, 16 nt, Human metapneumovirus
ccaacaucaacaccag

SEQ ID NO: 2640058 - RNA, 16 nt, Human metapneumovirus
cagcccaaggugcagc

SEQ ID NO: 2640059 - RNA, 22 nt, Human metapneumovirus
uccccaaaaaggcaacaacacc

SEQ ID NO: 2640060 - RNA, 16 nt, Human metapneumovirus
gacaaacucacagucu

SEQ ID NO: 2640061 - RNA, 22 nt, Human metapneumovirus
acuuaaguuaguaaaaacacau

SEQ ID NO: 2640062 - RNA, 22 nt, Human metapneumovirus
auucuuuucauggguaaugaag

SEQ ID NO: 2640063 - RNA, 20 nt, Human metapneumovirus
cagucugugaaguaaaaaca

SEQ ID NO: 2640064 - RNA, 15 nt, Human metapneumovirus
aauuauauaaaagug

SEQ ID NO: 2640065 - RNA, 15 nt, Human metapneumovirus
caccagcagugcugc

SEQ ID NO: 2640066 - RNA, 23 nt, Human metapneumovirus
aacaauugugauaaacugacaga

SEQ ID NO: 2640067 - RNA, 11 nt, Human metapneumovirus
agagagcucag

SEQ ID NO: 2640068 - RNA, 22 nt, Human metapneumovirus
aaaagcugcagccuguuacagu

SEQ ID NO: 2640069 - RNA, 21 nt, Human metapneumovirus
ucaacacggucuuaaagagag

SEQ ID NO: 2640070 - RNA, 16 nt, Human metapneumovirus
aucaagugcagugagc

SEQ ID NO: 2640071 - RNA, 12 nt, Human metapneumovirus
ccaaugaagcag

SEQ ID NO: 2640072 - RNA, 23 nt, Human metapneumovirus
gcugcuauaagcagugaagcaga

SEQ ID NO: 2640073 - RNA, 15 nt, Human metapneumovirus
cacacaaaaaacaac

SEQ ID NO: 2640074 - RNA, 18 nt, Human metapneumovirus
aguacuagauuuagaaau

SEQ ID NO: 2640075 - RNA, 22 nt, Human metapneumovirus
uucuaguuauauaaaaaucaag

SEQ ID NO: 2640076 - RNA, 21 nt, Human metapneumovirus
cugugaaacaagaggagacca

SEQ ID NO: 2640077 - RNA, 17 nt, Human metapneumovirus
aaagcagcagaaaugau

SEQ ID NO: 2640078 - RNA, 19 nt, Human metapneumovirus
auuccuuacacagcagcug

SEQ ID NO: 2640079 - RNA, 16 nt, Human metapneumovirus
acucugguaaagugcu

SEQ ID NO: 2640080 - RNA, 16 nt, Human metapneumovirus
aacugggcaaaacaac

SEQ ID NO: 2640081 - RNA, 14 nt, Human metapneumovirus
aauauaaucaaaca

SEQ ID NO: 2640082 - RNA, 21 nt, Human metapneumovirus
caacacggucuuaaagagagc

SEQ ID NO: 2640083 - RNA, 16 nt, Human metapneumovirus
agagcucaacaaaauu

SEQ ID NO: 2640084 - RNA, 21 nt, Human metapneumovirus
aucaguuucaaucaaagagag

SEQ ID NO: 2640085 - RNA, 12 nt, Human metapneumovirus
aaauaaagcaag

SEQ ID NO: 2640086 - RNA, 17 nt, Human metapneumovirus
ccaagcucuaacacagg

SEQ ID NO: 2640087 - RNA, 17 nt, Human metapneumovirus
gaaucaauagaggagaa

SEQ ID NO: 2640088 - RNA, 14 nt, Human metapneumovirus
augggacaaguaaa

SEQ ID NO: 2640089 - RNA, 23 nt, Human metapneumovirus
cuguuccauuggcagcaacagag

SEQ ID NO: 2640090 - RNA, 16 nt, Human metapneumovirus
cucagccaaaucaguu

SEQ ID NO: 2640091 - RNA, 13 nt, Human metapneumovirus
aaucccaaaggca

SEQ ID NO: 2640092 - RNA, 16 nt, Human metapneumovirus
gaugucauuaaaagug

SEQ ID NO: 2640093 - RNA, 14 nt, Human metapneumovirus
aaaagaaacugaaa

SEQ ID NO: 2640094 - RNA, 17 nt, Human metapneumovirus
auuuacaccaaaugaac

SEQ ID NO: 2640095 - RNA, 15 nt, Human metapneumovirus
aauagacaacacugu

SEQ ID NO: 2640096 - RNA, 23 nt, Human metapneumovirus
cagaccaagcucuaacacaggcc

SEQ ID NO: 2640097 - RNA, 18 nt, Human metapneumovirus
uggaucaaucaaacagaa

SEQ ID NO: 2640098 - RNA, 16 nt, Human metapneumovirus
gucuuaaagagagcua

SEQ ID NO: 2640099 - RNA, 17 nt, Human metapneumovirus
ucacaguaacaaucacc

SEQ ID NO: 2640100 - RNA, 20 nt, Human metapneumovirus
gaagagucuaccgagaagaa

SEQ ID NO: 2640101 - RNA, 16 nt, Human metapneumovirus
cauauucaaaaagcuu

SEQ ID NO: 2640102 - RNA, 18 nt, Human metapneumovirus
gcuauaagcagugaagca

SEQ ID NO: 2640103 - RNA, 17 nt, Human metapneumovirus
cuguuaguucaacaauu

SEQ ID NO: 2640104 - RNA, 12 nt, Human metapneumovirus
cagcagcuguuc

SEQ ID NO: 2640105 - RNA, 18 nt, Human metapneumovirus
aaccaacaucaacaccag

SEQ ID NO: 2640106 - RNA, 19 nt, Human metapneumovirus
aucaauguugcugagcagu

SEQ ID NO: 2640107 - RNA, 22 nt, Human metapneumovirus
aucagcaggugcugaaaaugac

SEQ ID NO: 2640108 - RNA, 19 nt, Human metapneumovirus
agcccaaggugcagcaaug

SEQ ID NO: 2640109 - RNA, 16 nt, Human metapneumovirus
uaagaacacucaacau

SEQ ID NO: 2640110 - RNA, 22 nt, Human metapneumovirus
gacagugaaagcacuaaucaag

SEQ ID NO: 2640111 - RNA, 14 nt, Human metapneumovirus
gcgcaagcagaaca

SEQ ID NO: 2640112 - RNA, 17 nt, Human metapneumovirus
aauuagaccugaccaaa

SEQ ID NO: 2640113 - RNA, 17 nt, Human metapneumovirus
aauaucuuuggacuuaa

SEQ ID NO: 2640114 - RNA, 14 nt, Human metapneumovirus
cuacucuaaaucau

SEQ ID NO: 2640115 - RNA, 12 nt, Human metapneumovirus
cauuguuaauaa

SEQ ID NO: 2640116 - RNA, 13 nt, Human metapneumovirus
aguuauuuaaaaa

SEQ ID NO: 2640117 - RNA, 21 nt, Human metapneumovirus
gugucacaaacaauggcuuca

SEQ ID NO: 2640118 - RNA, 16 nt, Human metapneumovirus
gaaaucauuaagaaaa

SEQ ID NO: 2640119 - RNA, 19 nt, Human metapneumovirus
gcucucagauaaugaagaa

SEQ ID NO: 2640120 - RNA, 15 nt, Human metapneumovirus
agcaggugcugaaaa

SEQ ID NO: 2640121 - RNA, 14 nt, Human metapneumovirus
ugucacaaacaaug

SEQ ID NO: 2640122 - RNA, 16 nt, Human metapneumovirus
aaggcaacaacaccau

SEQ ID NO: 2640123 - RNA, 16 nt, Human metapneumovirus
acaaggacuuaaaaga

SEQ ID NO: 2640124 - RNA, 21 nt, Human metapneumovirus
aaccaccccaagaaaaaaacu

SEQ ID NO: 2640125 - RNA, 18 nt, Human metapneumovirus
ugaagacacaaaaaccaa

SEQ ID NO: 2640126 - RNA, 17 nt, Human metapneumovirus
aaugcccucaaaaagac

SEQ ID NO: 2640127 - RNA, 15 nt, Human metapneumovirus
aaucaacaaucucaa

SEQ ID NO: 2640128 - RNA, 19 nt, Human metapneumovirus
ucaagaacgggacaaauaa

SEQ ID NO: 2640129 - RNA, 13 nt, Human metapneumovirus
aguaacagcaauu

SEQ ID NO: 2640130 - RNA, 20 nt, Human metapneumovirus
acaaacucugcaauaaacag

SEQ ID NO: 2640131 - RNA, 12 nt, Human metapneumovirus
caagugcaguga

SEQ ID NO: 2640132 - RNA, 22 nt, Human metapneumovirus
ucaaucuuaaccuuugaagaaa

SEQ ID NO: 2640133 - RNA, 20 nt, Human metapneumovirus
aaacaaugggacaaguaaaa

SEQ ID NO: 2640134 - RNA, 22 nt, Human metapneumovirus
agcauauguccaggcugaaagc

SEQ ID NO: 2640135 - RNA, 12 nt, Human metapneumovirus
ggugcagcaaug

SEQ ID NO: 2640136 - RNA, 17 nt, Human metapneumovirus
caaggcuccgugcaaau

SEQ ID NO: 2640137 - RNA, 13 nt, Human metapneumovirus
ucacaaacaaugg

SEQ ID NO: 2640138 - RNA, 11 nt, Human metapneumovirus
aagugcaguga

SEQ ID NO: 2640139 - RNA, 17 nt, Human metapneumovirus
gaaagugaaguaacagc

SEQ ID NO: 2640140 - RNA, 13 nt, Human metapneumovirus
gccagagcuguuu

SEQ ID NO: 2640141 - RNA, 19 nt, Human metapneumovirus
aaaacugaaauaaagcaag

SEQ ID NO: 2640142 - RNA, 13 nt, Human metapneumovirus
caacaaaaacaag

SEQ ID NO: 2640143 - RNA, 17 nt, Human metapneumovirus
cuacauaauauaaucaa

SEQ ID NO: 2640144 - RNA, 20 nt, Human metapneumovirus
aagggaaagcagcagaaaug

SEQ ID NO: 2640145 - RNA, 23 nt, Human metapneumovirus
cuuagaagagucauguagcacua

SEQ ID NO: 2640146 - RNA, 20 nt, Human metapneumovirus
aaaucaguuggcaaaaaaac

SEQ ID NO: 2640147 - RNA, 21 nt, Human metapneumovirus
acuggcaagagaggagcaaau

SEQ ID NO: 2640148 - RNA, 16 nt, Human metapneumovirus
ucugaagacacaaaaa

SEQ ID NO: 2640149 - RNA, 17 nt, Human metapneumovirus
aacuggaauuugacaaa

SEQ ID NO: 2640150 - RNA, 23 nt, Human metapneumovirus
aagcagcuuugacccagucaagu

SEQ ID NO: 2640151 - RNA, 15 nt, Human metapneumovirus
aaauuugaagucaau

SEQ ID NO: 2640152 - RNA, 17 nt, Human metapneumovirus
agcagcuuugacccagu

SEQ ID NO: 2640153 - RNA, 14 nt, Human metapneumovirus
ugccaacaucugca

SEQ ID NO: 2640154 - RNA, 18 nt, Human metapneumovirus
ucucagauaaugaagaag

SEQ ID NO: 2640155 - RNA, 17 nt, Human metapneumovirus
aaguaacagcaauuaag

SEQ ID NO: 2640156 - RNA, 16 nt, Human metapneumovirus
ggcaacugcagugaga

SEQ ID NO: 2640157 - RNA, 17 nt, Human metapneumovirus
acagaauccuaagcagu

SEQ ID NO: 2640158 - RNA, 10 nt, Human metapneumovirus
auaauuaaag

SEQ ID NO: 2640159 - RNA, 13 nt, Human metapneumovirus
gcaagcaaucaaa

SEQ ID NO: 2640160 - RNA, 19 nt, Human metapneumovirus
aguuggcaaaaaaacacau

SEQ ID NO: 2640161 - RNA, 15 nt, Human metapneumovirus
aagacuuggagccau

SEQ ID NO: 2640162 - RNA, 17 nt, Human metapneumovirus
caguuggcaaaaaaaca

SEQ ID NO: 2640163 - RNA, 12 nt, Human metapneumovirus
auuaaaagugau

SEQ ID NO: 2640164 - RNA, 18 nt, Human metapneumovirus
ucaagaacgggacaaaua

SEQ ID NO: 2640165 - RNA, 16 nt, Human metapneumovirus
agcaccuccagagcug

SEQ ID NO: 2640166 - RNA, 23 nt, Human metapneumovirus
acaauggcuucauaccacauaau

SEQ ID NO: 2640167 - RNA, 20 nt, Human metapneumovirus
agaccuuaccuaaaaaauga

SEQ ID NO: 2640168 - RNA, 11 nt, Human metapneumovirus
aauaaaguaaa

SEQ ID NO: 2640169 - RNA, 18 nt, Human metapneumovirus
guggaucaaucaaacaga

SEQ ID NO: 2640170 - RNA, 13 nt, Human metapneumovirus
gucaaaaacugaa

SEQ ID NO: 2640171 - RNA, 21 nt, Human metapneumovirus
ugaaguccagauaacaaccaa

SEQ ID NO: 2640172 - RNA, 17 nt, Human metapneumovirus
aacaaccaugaaaccau

SEQ ID NO: 2640173 - RNA, 13 nt, Human metapneumovirus
uccuaagcagugc

SEQ ID NO: 2640174 - RNA, 21 nt, Human metapneumovirus
uuaaaaauauuuugaaaacaa

SEQ ID NO: 2640175 - RNA, 23 nt, Human metapneumovirus
ucauggaucccauugaagaagaa

SEQ ID NO: 2640176 - RNA, 22 nt, Human metapneumovirus
aguuuucgagagcauugagaac

SEQ ID NO: 2640177 - RNA, 21 nt, Human metapneumovirus
uauuauaggagaaaaagugaa

SEQ ID NO: 2640178 - RNA, 23 nt, Human metapneumovirus
aggcauuccuuacacagcagcug

SEQ ID NO: 2640179 - RNA, 14 nt, Human metapneumovirus
aagacacaaaaacc

SEQ ID NO: 2640180 - RNA, 19 nt, Human metapneumovirus
agucaaugcgacuguagca

SEQ ID NO: 2640181 - RNA, 16 nt, Human metapneumovirus
gaucaaucaaacagaa

SEQ ID NO: 2640182 - RNA, 12 nt, Human metapneumovirus
uaguucaacaau

SEQ ID NO: 2640183 - RNA, 21 nt, Human metapneumovirus
uuucugcugaucaacuggcaa

SEQ ID NO: 2640184 - RNA, 16 nt, Human metapneumovirus
auggaucuagaaaaga

SEQ ID NO: 2640185 - RNA, 12 nt, Human metapneumovirus
gcaaaacaacac

SEQ ID NO: 2640186 - RNA, 17 nt, Human metapneumovirus
cucagccaaaucaguug

SEQ ID NO: 2640187 - RNA, 15 nt, Human metapneumovirus
uucccugaaggaaaa

SEQ ID NO: 2640188 - RNA, 21 nt, Human metapneumovirus
caucagcccaaggugcagcaa

SEQ ID NO: 2640189 - RNA, 16 nt, Human metapneumovirus
agaacgggacaaauaa

SEQ ID NO: 2640190 - RNA, 15 nt, Human metapneumovirus
acaccaccagcagug

SEQ ID NO: 2640191 - RNA, 14 nt, Human metapneumovirus
acugccaaucuuug

SEQ ID NO: 2640192 - RNA, 18 nt, Human metapneumovirus
aagaucaauucaauguug

SEQ ID NO: 2640193 - RNA, 20 nt, Human metapneumovirus
gauacuucaucauuaagcau

SEQ ID NO: 2640194 - RNA, 19 nt, Human metapneumovirus
ucgacacacacacaacacc

SEQ ID NO: 2640195 - RNA, 17 nt, Human metapneumovirus
gaauaacaccagcaaua

SEQ ID NO: 2640196 - RNA, 22 nt, Human metapneumovirus
cugaucaauuaacaaaauuaaa

SEQ ID NO: 2640197 - RNA, 14 nt, Human metapneumovirus
caccuccagagcug

SEQ ID NO: 2640198 - RNA, 12 nt, Human metapneumovirus
uguagagaaccu

SEQ ID NO: 2640199 - RNA, 18 nt, Human metapneumovirus
aaaagcaaaagagcucaa

SEQ ID NO: 2640200 - RNA, 23 nt, Human metapneumovirus
accaugucuuuugcgacacagca

SEQ ID NO: 2640201 - RNA, 11 nt, Human metapneumovirus
aacugaacaaa

SEQ ID NO: 2640202 - RNA, 20 nt, Human metapneumovirus
uccagaaaucauuaagaaaa

SEQ ID NO: 2640203 - RNA, 13 nt, Human metapneumovirus
cugaccaaaagug

SEQ ID NO: 2640204 - RNA, 15 nt, Human metapneumovirus
ugcuauaagcaguga

SEQ ID NO: 2640205 - RNA, 23 nt, Human metapneumovirus
ucaacacggucuuaaagagagcu

SEQ ID NO: 2640206 - RNA, 17 nt, Human metapneumovirus
cuagagauaacaaacua

SEQ ID NO: 2640207 - RNA, 22 nt, Human metapneumovirus
ugaaaaagacugugaaacaaga

SEQ ID NO: 2640208 - RNA, 19 nt, Human metapneumovirus
caaucuauuauaggagaaa

SEQ ID NO: 2640209 - RNA, 20 nt, Human metapneumovirus
caacaugccaacaucugcag

SEQ ID NO: 2640210 - RNA, 17 nt, Human metapneumovirus
gcuugaaagugaaguaa

SEQ ID NO: 2640211 - RNA, 15 nt, Human metapneumovirus
gugggacaagucaaa

SEQ ID NO: 2640212 - RNA, 14 nt, Human metapneumovirus
acaccaccagcagu

SEQ ID NO: 2640213 - RNA, 13 nt, Human metapneumovirus
gcaacugcaguga

SEQ ID NO: 2640214 - RNA, 19 nt, Human metapneumovirus
auuagaugucauuaaaagu

SEQ ID NO: 2640215 - RNA, 20 nt, Human metapneumovirus
acucuaaaucaugauaucac

SEQ ID NO: 2640216 - RNA, 20 nt, Human metapneumovirus
acuccaacgguccccacaga

SEQ ID NO: 2640217 - RNA, 18 nt, Human metapneumovirus
agugcacuaagagagcuc

SEQ ID NO: 2640218 - RNA, 21 nt, Human metapneumovirus
gucagcuacuguugaagcugc

SEQ ID NO: 2640219 - RNA, 16 nt, Human metapneumovirus
guaauaauuaauugcu

SEQ ID NO: 2640220 - RNA, 16 nt, Human metapneumovirus
ggaauaacaccagcaa

SEQ ID NO: 2640221 - RNA, 19 nt, Human metapneumovirus
cugcugaucaacuggcaag

SEQ ID NO: 2640222 - RNA, 21 nt, Human metapneumovirus
ccaaaugaaaaagacugugaa

SEQ ID NO: 2640223 - RNA, 15 nt, Human metapneumovirus
ucacagucugugaag

SEQ ID NO: 2640224 - RNA, 11 nt, Human metapneumovirus
acagaaaucaa

SEQ ID NO: 2640225 - RNA, 21 nt, Human metapneumovirus
cuuuugcgacacagcagcagg

SEQ ID NO: 2640226 - RNA, 14 nt, Human metapneumovirus
aacacaccaccagc

SEQ ID NO: 2640227 - RNA, 11 nt, Human metapneumovirus
augaaaaagac

SEQ ID NO: 2640228 - RNA, 14 nt, Human metapneumovirus
acagucuacauaau

SEQ ID NO: 2640229 - RNA, 15 nt, Human metapneumovirus
agagaagauaggaca

SEQ ID NO: 2640230 - RNA, 20 nt, Human metapneumovirus
gaaggccagugucaagcagc

SEQ ID NO: 2640231 - RNA, 22 nt, Human metapneumovirus
cacaggagcaccuccagagcug

SEQ ID NO: 2640232 - RNA, 13 nt, Human metapneumovirus
aucagacaaaaag

SEQ ID NO: 2640233 - RNA, 17 nt, Human metapneumovirus
gugcacuaagagagcuc

SEQ ID NO: 2640234 - RNA, 18 nt, Human metapneumovirus
uuagggcuauuaagaaca

SEQ ID NO: 2640235 - RNA, 14 nt, Human metapneumovirus
cauugaagaagaag

SEQ ID NO: 2640236 - RNA, 20 nt, Human metapneumovirus
aguccuaccuaguagacacc

SEQ ID NO: 2640237 - RNA, 17 nt, Human metapneumovirus
acagcauccaacucaac

SEQ ID NO: 2640238 - RNA, 17 nt, Human metapneumovirus
ccuaagcagugcagaga

SEQ ID NO: 2640239 - RNA, 14 nt, Human metapneumovirus
aaguggaaaacaau

SEQ ID NO: 2640240 - RNA, 17 nt, Human metapneumovirus
cauggguaaugaagcag

SEQ ID NO: 2640241 - RNA, 14 nt, Human metapneumovirus
augguaagaagaaa

SEQ ID NO: 2640242 - RNA, 14 nt, Human metapneumovirus
ccugcagaaaagaa

SEQ ID NO: 2640243 - RNA, 20 nt, Human metapneumovirus
accaaaacugaaauaaagca

SEQ ID NO: 2640244 - RNA, 14 nt, Human metapneumovirus
aguuggaaaaagau

SEQ ID NO: 2640245 - RNA, 16 nt, Human metapneumovirus
ccucaaaaagaccaau

SEQ ID NO: 2640246 - RNA, 17 nt, Human metapneumovirus
ccaagacgcagacacag

SEQ ID NO: 2640247 - RNA, 21 nt, Human metapneumovirus
cagaauccuaagcagugcaga

SEQ ID NO: 2640248 - RNA, 20 nt, Human metapneumovirus
acagcauguuauaaaaggaa

SEQ ID NO: 2640249 - RNA, 21 nt, Human metapneumovirus
uuagagaaugcugcugaauua

SEQ ID NO: 2640250 - RNA, 18 nt, Human metapneumovirus
uauaaaaguggaaaacaa

SEQ ID NO: 2640251 - RNA, 22 nt, Human metapneumovirus
aaugagucaacgaucaaaaaua

SEQ ID NO: 2640252 - RNA, 17 nt, Human metapneumovirus
ccaaagcauaacaaaag

SEQ ID NO: 2640253 - RNA, 13 nt, Human metapneumovirus
uaagaaaaccagg

SEQ ID NO: 2640254 - RNA, 17 nt, Human metapneumovirus
gaaggcgaacagcaugu

SEQ ID NO: 2640255 - RNA, 18 nt, Human metapneumovirus
uuaaaaaguaaaaaacaa

SEQ ID NO: 2640256 - RNA, 19 nt, Human metapneumovirus
cgacacagcagcaggaauc

SEQ ID NO: 2640257 - RNA, 17 nt, Human metapneumovirus
auuccuuacacagcagc

SEQ ID NO: 2640258 - RNA, 20 nt, Human metapneumovirus
uacacuggagguaggcgaug

SEQ ID NO: 2640259 - RNA, 19 nt, Human metapneumovirus
aaaaugacucuucauaugc

SEQ ID NO: 2640260 - RNA, 21 nt, Human papillomavirus type 11
uacaaauugcugcagcaacaa

SEQ ID NO: 2640261 - RNA, 14 nt, Human papillomavirus type 11
ggaauguguaugua

SEQ ID NO: 2640262 - RNA, 16 nt, Human papillomavirus type 11
acuggggggccagcag

SEQ ID NO: 2640263 - RNA, 20 nt, Human papillomavirus type 11
uaccaccauuaacuguguca

SEQ ID NO: 2640264 - RNA, 20 nt, Human papillomavirus type 11
acaccuguauauauguauau

SEQ ID NO: 2640265 - RNA, 13 nt, Human papillomavirus type 11
auuuguuugaauu

SEQ ID NO: 2640266 - RNA, 21 nt, Human papillomavirus type 11
ccaacauauuuuaucaugcca

SEQ ID NO: 2640267 - RNA, 23 nt, Human papillomavirus type 11
gaugaggaagaggagguggagga

SEQ ID NO: 2640268 - RNA, 18 nt, Human papillomavirus type 11
caauucuuuuuacuaaca

SEQ ID NO: 2640269 - RNA, 22 nt, Human papillomavirus type 11
cuuaauugaggagucugcuauu

SEQ ID NO: 2640270 - RNA, 16 nt, Human papillomavirus type 11
uacaucugugcuggua

SEQ ID NO: 2640271 - RNA, 17 nt, Human papillomavirus type 11
uauuauguguguccugu

SEQ ID NO: 2640272 - RNA, 23 nt, Human papillomavirus type 11
uacuuggauuguuguuacuacau

SEQ ID NO: 2640273 - RNA, 13 nt, Human papillomavirus type 11
auguuucuuguau

SEQ ID NO: 2640274 - RNA, 18 nt, Human papillomavirus type 11
auuuuccugccuuuuaua

SEQ ID NO: 2640275 - RNA, 20 nt, Human papillomavirus type 11
uuuucgguugcccuuacaua

SEQ ID NO: 2640276 - RNA, 16 nt, Human papillomavirus type 11
uuguuauugcauuugc

SEQ ID NO: 2640277 - RNA, 21 nt, Human papillomavirus type 11
auauauuuguggaauguguau

SEQ ID NO: 2640278 - RNA, 13 nt, Human papillomavirus type 11
accuguugcugug

SEQ ID NO: 2640279 - RNA, 11 nt, Human papillomavirus type 11
auguauguuuu

SEQ ID NO: 2640280 - RNA, 22 nt, Human papillomavirus type 11
gugauaauggagauuaugugua

SEQ ID NO: 2640281 - RNA, 23 nt, Human papillomavirus type 11
gcacguccgccagugcuugugga

SEQ ID NO: 2640282 - RNA, 19 nt, Human papillomavirus type 11
agggguuuuuuuugguggg

SEQ ID NO: 2640283 - RNA, 22 nt, Human papillomavirus type 11
acauuaugcauuggaaaugcau

SEQ ID NO: 2640284 - RNA, 23 nt, Human papillomavirus type 11
gguacacaaauaucagaagauga

SEQ ID NO: 2640285 - RNA, 11 nt, Human papillomavirus type 11
uuuauauacac

SEQ ID NO: 2640286 - RNA, 20 nt, Human papillomavirus type 11
ugauuuuguaguauauacau

SEQ ID NO: 2640287 - RNA, 13 nt, Human papillomavirus type 11
uuagauauagacu

SEQ ID NO: 2640288 - RNA, 18 nt, Human papillomavirus type 11
cuuuaacacaacauuacc

SEQ ID NO: 2640289 - RNA, 18 nt, Human papillomavirus type 11
guauauacaucugugcug

SEQ ID NO: 2640290 - RNA, 23 nt, Human papillomavirus type 11
cugcagcaacaacuacaacauug

SEQ ID NO: 2640291 - RNA, 14 nt, Human papillomavirus type 11
uguaacauuaacau

SEQ ID NO: 2640292 - RNA, 12 nt, Human papillomavirus type 11
uauacacauaua

SEQ ID NO: 2640293 - RNA, 14 nt, Human papillomavirus type 11
caccauuaacugug

SEQ ID NO: 2640294 - RNA, 13 nt, Human papillomavirus type 11
uguugccuucaua

SEQ ID NO: 2640295 - RNA, 16 nt, Human papillomavirus type 11
cugccuuuuauauaca

SEQ ID NO: 2640296 - RNA, 21 nt, Human papillomavirus type 11
uuguuucugugguuguuuacu

SEQ ID NO: 2640297 - RNA, 14 nt, Human papillomavirus type 11
auacacauauacau

SEQ ID NO: 2640298 - RNA, 14 nt, Human papillomavirus type 11
cagccuccugaccc

SEQ ID NO: 2640299 - RNA, 14 nt, Human papillomavirus type 11
uuauguauguuugu

SEQ ID NO: 2640300 - RNA, 14 nt, Human papillomavirus type 11
gcauuggaaaugca

SEQ ID NO: 2640301 - RNA, 15 nt, Human papillomavirus type 11
cugugugugugcuau

SEQ ID NO: 2640302 - RNA, 12 nt, Human papillomavirus type 11
uauuuuccugcc

SEQ ID NO: 2640303 - RNA, 16 nt, Human papillomavirus type 11
auucuuaguauuguac

SEQ ID NO: 2640304 - RNA, 13 nt, Human papillomavirus type 11
uuguaguguguau

SEQ ID NO: 2640305 - RNA, 14 nt, Human papillomavirus type 11
uauuguacuuauaa

SEQ ID NO: 2640306 - RNA, 16 nt, Human papillomavirus type 11
ccuguugcuguggaug

SEQ ID NO: 2640307 - RNA, 15 nt, Human papillomavirus type 11
auuccaauuguuuaa

SEQ ID NO: 2640308 - RNA, 17 nt, Human papillomavirus type 11
uacauaacauacgugua

SEQ ID NO: 2640309 - RNA, 14 nt, Human papillomavirus type 11
gaauguguauguau

SEQ ID NO: 2640310 - RNA, 16 nt, Human papillomavirus type 11
acagcucagaagauga

SEQ ID NO: 2640311 - RNA, 17 nt, Human papillomavirus type 11
uuauuaaugcuggugca

SEQ ID NO: 2640312 - RNA, 13 nt, Human papillomavirus type 11
ccgcaauacuacu

SEQ ID NO: 2640313 - RNA, 20 nt, Human papillomavirus type 11
uauguuuuugugcaauaaac

SEQ ID NO: 2640314 - RNA, 18 nt, Human papillomavirus type 11
guaccaccauuaacugug

SEQ ID NO: 2640315 - RNA, 12 nt, Human papillomavirus type 11
aagguaaagcga

SEQ ID NO: 2640316 - RNA, 15 nt, Human papillomavirus type 11
ucugauuuuguagua

SEQ ID NO: 2640317 - RNA, 21 nt, Human papillomavirus type 11
auaucaauauagaguguuuaa

SEQ ID NO: 2640318 - RNA, 16 nt, Human papillomavirus type 11
cguuuguguugccuuc

SEQ ID NO: 2640319 - RNA, 15 nt, Human papillomavirus type 11
uggaagcacaggcau

SEQ ID NO: 2640320 - RNA, 18 nt, Human papillomavirus type 11
uguauuacuacacaaagc

SEQ ID NO: 2640321 - RNA, 14 nt, Human papillomavirus type 11
uauguuguuaugua

SEQ ID NO: 2640322 - RNA, 21 nt, Human papillomavirus type 11
gaggggucgggguguacagga

SEQ ID NO: 2640323 - RNA, 14 nt, Human papillomavirus type 11
aauguguauguaug

SEQ ID NO: 2640324 - RNA, 15 nt, Human papillomavirus type 11
auugaugacaggcau

SEQ ID NO: 2640325 - RNA, 23 nt, Human papillomavirus type 11
cuacaagaccuuuugcugggcac

SEQ ID NO: 2640326 - RNA, 15 nt, Human papillomavirus type 11
aauuuuuaaacagug

SEQ ID NO: 2640327 - RNA, 22 nt, Human papillomavirus type 11
uacuacuguggauuauguguau

SEQ ID NO: 2640328 - RNA, 21 nt, Human papillomavirus type 11
uacuguggauuauguguauau

SEQ ID NO: 2640329 - RNA, 20 nt, Human papillomavirus type 11
aguggguaugacauggugga

SEQ ID NO: 2640330 - RNA, 16 nt, Human papillomavirus type 11
cauuaugcgacugugc

SEQ ID NO: 2640331 - RNA, 22 nt, Human papillomavirus type 11
cacauuaugcauuggaaaugca

SEQ ID NO: 2640332 - RNA, 20 nt, Human papillomavirus type 11
agcucagaagaugaggugga

SEQ ID NO: 2640333 - RNA, 15 nt, Human papillomavirus type 11
uaaaucaaaccgcaa

SEQ ID NO: 2640334 - RNA, 11 nt, Human papillomavirus type 11
cugcaggacaa

SEQ ID NO: 2640335 - RNA, 15 nt, Human papillomavirus type 11
uuguaguauauacau

SEQ ID NO: 2640336 - RNA, 16 nt, Human papillomavirus type 11
accauuaacuguguca

SEQ ID NO: 2640337 - RNA, 16 nt, Human papillomavirus type 11
aauaccacccaccauu

SEQ ID NO: 2640338 - RNA, 13 nt, Human papillomavirus type 11
ggguguacaggau

SEQ ID NO: 2640339 - RNA, 12 nt, Human papillomavirus type 11
agcacaggcauu

SEQ ID NO: 2640340 - RNA, 15 nt, Human papillomavirus type 11
gguguacaggauggu

SEQ ID NO: 2640341 - RNA, 23 nt, Human papillomavirus type 11
ucccaagccugcuauuacugggg

SEQ ID NO: 2640342 - RNA, 17 nt, Human papillomavirus type 11
uuguuuacugcauuugu

SEQ ID NO: 2640343 - RNA, 12 nt, Human papillomavirus type 11
caugaacuagag

SEQ ID NO: 2640344 - RNA, 19 nt, Human papillomavirus type 11
gauacaugguuguuucugu

SEQ ID NO: 2640345 - RNA, 16 nt, Human papillomavirus type 11
guuacacccagugacu

SEQ ID NO: 2640346 - RNA, 18 nt, Human papillomavirus type 11
gaugagguggacaaggug

SEQ ID NO: 2640347 - RNA, 19 nt, Human papillomavirus type 11
acgcaacaauaauggugau

SEQ ID NO: 2640348 - RNA, 15 nt, Human papillomavirus type 11
caauuguaacauuaa

SEQ ID NO: 2640349 - RNA, 23 nt, Human papillomavirus type 11
cagaucaaauauuaaaaugggga

SEQ ID NO: 2640350 - RNA, 18 nt, Human papillomavirus type 11
cagagacuaaaggacaua

SEQ ID NO: 2640351 - RNA, 17 nt, Human papillomavirus type 11
aaauacugaccuguugc

SEQ ID NO: 2640352 - RNA, 18 nt, Human papillomavirus type 11
aguugaacauacuacuau

SEQ ID NO: 2640353 - RNA, 21 nt, Human papillomavirus type 11
cuguacaaauugcugcagcaa

SEQ ID NO: 2640354 - RNA, 15 nt, Human papillomavirus type 11
cugcuauuacugggg

SEQ ID NO: 2640355 - RNA, 14 nt, Human papillomavirus type 11
cuuagcaaaaacuc

SEQ ID NO: 2640356 - RNA, 17 nt, Human papillomavirus type 11
cuauaucaaacaugcaa

SEQ ID NO: 2640357 - RNA, 19 nt, Human papillomavirus type 11
uuaccaaauacugaccugu

SEQ ID NO: 2640358 - RNA, 16 nt, Human papillomavirus type 11
gacugguuguggagug

SEQ ID NO: 2640359 - RNA, 22 nt, Human papillomavirus type 11
uguguacauaacauacguguau

SEQ ID NO: 2640360 - RNA, 19 nt, Human papillomavirus type 11
auguaauuccuaaaguuga

SEQ ID NO: 2640361 - RNA, 18 nt, Human papillomavirus type 11
uuauuauguguguccugu

SEQ ID NO: 2640362 - RNA, 14 nt, Human papillomavirus type 11
uaguguguguauau

SEQ ID NO: 2640363 - RNA, 14 nt, Human papillomavirus type 11
ggaagcacaggcau

SEQ ID NO: 2640364 - RNA, 22 nt, Human papillomavirus type 11
uaacacugugugugugcuauuu

SEQ ID NO: 2640365 - RNA, 20 nt, Human papillomavirus type 11
aacgucagcaauuuuuaaac

SEQ ID NO: 2640366 - RNA, 11 nt, Human papillomavirus type 11
gacccuguagg

SEQ ID NO: 2640367 - RNA, 19 nt, Human papillomavirus type 11
ugauacaugguuguuucug

SEQ ID NO: 2640368 - RNA, 15 nt, Human papillomavirus type 11
gcaguccauauguaa

SEQ ID NO: 2640369 - RNA, 23 nt, Human papillomavirus type 11
cuuuaaaaaacagggaaauacug

SEQ ID NO: 2640370 - RNA, 13 nt, Human papillomavirus type 11
auauguguacaua

SEQ ID NO: 2640371 - RNA, 23 nt, Human papillomavirus type 11
ccauuaaacuuacaacacagcca

SEQ ID NO: 2640372 - RNA, 16 nt, Human papillomavirus type 11
gccauaguagagcaca

SEQ ID NO: 2640373 - RNA, 20 nt, Human papillomavirus type 11
gcuaaugcaguagaaaguga

SEQ ID NO: 2640374 - RNA, 15 nt, Human papillomavirus type 11
cauaaugcuauugaa

SEQ ID NO: 2640375 - RNA, 15 nt, Human papillomavirus type 11
cuccucccaacccug

SEQ ID NO: 2640376 - RNA, 20 nt, Human papillomavirus type 11
gggguuuaugucauuacauu

SEQ ID NO: 2640377 - RNA, 22 nt, Human papillomavirus type 11
acuaaucccauauguugugugc

SEQ ID NO: 2640378 - RNA, 15 nt, Human papillomavirus type 11
auauguuucuuguau

SEQ ID NO: 2640379 - RNA, 17 nt, Human papillomavirus type 11
ccugcagccuccugacc

SEQ ID NO: 2640380 - RNA, 17 nt, Human papillomavirus type 11
auuacaccuguauauau

SEQ ID NO: 2640381 - RNA, 16 nt, Human papillomavirus type 11
uucaucccuguuugac

SEQ ID NO: 2640382 - RNA, 15 nt, Human papillomavirus type 11
uuguguauaugugua

SEQ ID NO: 2640383 - RNA, 15 nt, Human papillomavirus type 11
gcucagaagaugagg

SEQ ID NO: 2640384 - RNA, 23 nt, Human papillomavirus type 11
ugguacaggggcugguaguggcg

SEQ ID NO: 2640385 - RNA, 12 nt, Human papillomavirus type 11
accuuuugcugg

SEQ ID NO: 2640386 - RNA, 13 nt, Human papillomavirus type 11
gaggagucugcua

SEQ ID NO: 2640387 - RNA, 18 nt, Human papillomavirus type 11
uacuauugcagaucaaau

SEQ ID NO: 2640388 - RNA, 20 nt, Human papillomavirus type 11
cauauauaccugcaggacaa

SEQ ID NO: 2640389 - RNA, 18 nt, Human papillomavirus type 11
aaccauaacaaggauggc

SEQ ID NO: 2640390 - RNA, 20 nt, Human papillomavirus type 11
uaaaaaugcaauuguaacau

SEQ ID NO: 2640391 - RNA, 15 nt, Human papillomavirus type 11
uuguggaauguguau

SEQ ID NO: 2640392 - RNA, 14 nt, Human papillomavirus type 11
uguagcuguacuug

SEQ ID NO: 2640393 - RNA, 23 nt, Human papillomavirus type 11
gaagaggagguggaggacagugg

SEQ ID NO: 2640394 - RNA, 16 nt, Human papillomavirus type 11
guaacauuaacauaua

SEQ ID NO: 2640395 - RNA, 14 nt, Human papillomavirus type 11
guguauauguuucu

SEQ ID NO: 2640396 - RNA, 16 nt, Human papillomavirus type 11
gggucgggguguacag

SEQ ID NO: 2640397 - RNA, 16 nt, Human papillomavirus type 11
ugaauuagcaucuuca

SEQ ID NO: 2640398 - RNA, 21 nt, Human papillomavirus type 11
acuuuauugaugacaggcaua

SEQ ID NO: 2640399 - RNA, 14 nt, Human papillomavirus type 11
agaaagugagauaa

SEQ ID NO: 2640400 - RNA, 12 nt, Human papillomavirus type 11
uuggaaaugcau

SEQ ID NO: 2640401 - RNA, 20 nt, Human papillomavirus type 11
uauugaaaugcaaaugcauu

SEQ ID NO: 2640402 - RNA, 19 nt, Human papillomavirus type 11
uuaaccugucacuuaaaug

SEQ ID NO: 2640403 - RNA, 20 nt, Human papillomavirus type 11
uuucugugguuguuuacugc

SEQ ID NO: 2640404 - RNA, 14 nt, Human papillomavirus type 11
aaugcaauuguaac

SEQ ID NO: 2640405 - RNA, 16 nt, Human papillomavirus type 11
augugguauggacaca

SEQ ID NO: 2640406 - RNA, 17 nt, Human papillomavirus type 11
ucuuguauuguguauau

SEQ ID NO: 2640407 - RNA, 15 nt, Human papillomavirus type 11
auugcauuugcagua

SEQ ID NO: 2640408 - RNA, 22 nt, Human papillomavirus type 11
uauguuucuuguauuguguaua

SEQ ID NO: 2640409 - RNA, 22 nt, Human papillomavirus type 11
caaaacaaaugggccugagcca

SEQ ID NO: 2640410 - RNA, 19 nt, Human papillomavirus type 11
auaguacuagaccugcagc

SEQ ID NO: 2640411 - RNA, 16 nt, Human papillomavirus type 11
aggagguggaggacag

SEQ ID NO: 2640412 - RNA, 15 nt, Human papillomavirus type 11
cagcaacguccgacu

SEQ ID NO: 2640413 - RNA, 15 nt, Human papillomavirus type 11
gaccuuuugcugggc

SEQ ID NO: 2640414 - RNA, 20 nt, Human papillomavirus type 11
cuguugcuguggaugugaca

SEQ ID NO: 2640415 - RNA, 21 nt, Human papillomavirus type 11
caugguacugaaaaaacuaaa

SEQ ID NO: 2640416 - RNA, 17 nt, Human papillomavirus type 11
aauacugaccuguugcu

SEQ ID NO: 2640417 - RNA, 14 nt, Human papillomavirus type 11
uauuauauuauaua

SEQ ID NO: 2640418 - RNA, 17 nt, Human papillomavirus type 11
ugcauuggaaaugcaua

SEQ ID NO: 2640419 - RNA, 18 nt, Human papillomavirus type 11
cauuguuuaauaggcagg

SEQ ID NO: 2640420 - RNA, 20 nt, Human papillomavirus type 11
acaugguuguuucugugguu

SEQ ID NO: 2640421 - RNA, 20 nt, Human papillomavirus type 11
cuguggaagcacaggcauug

SEQ ID NO: 2640422 - RNA, 19 nt, Human papillomavirus type 11
gccaaaaaagguaaagcga

SEQ ID NO: 2640423 - RNA, 14 nt, Human papillomavirus type 11
ugaugacaggcaua

SEQ ID NO: 2640424 - RNA, 14 nt, Human papillomavirus type 11
aauuguuuaaaaug

SEQ ID NO: 2640425 - RNA, 19 nt, Human papillomavirus type 11
uaaaguugaacauacuacu

SEQ ID NO: 2640426 - RNA, 15 nt, Human papillomavirus type 11
uguguauauguguau

SEQ ID NO: 2640427 - RNA, 13 nt, Human papillomavirus type 11
uggauuaugugua

SEQ ID NO: 2640428 - RNA, 21 nt, Human papillomavirus type 11
uauauauguauauguguacau

SEQ ID NO: 2640429 - RNA, 16 nt, Human papillomavirus type 11
ugcuaaguguaaauca

SEQ ID NO: 2640430 - RNA, 20 nt, Human papillomavirus type 11
cuguuguuauugcauuugca

SEQ ID NO: 2640431 - RNA, 22 nt, Human papillomavirus type 11
uauguuguuguaguguguauau

SEQ ID NO: 2640432 - RNA, 13 nt, Human papillomavirus type 11
uaacaaggauggc

SEQ ID NO: 2640433 - RNA, 17 nt, Human papillomavirus type 11
uuuuuaaacaguguaaa

SEQ ID NO: 2640434 - RNA, 14 nt, Human papillomavirus type 11
auauguguacauaa

SEQ ID NO: 2640435 - RNA, 21 nt, Human papillomavirus type 11
cugcuauuauuaaugcuggug

SEQ ID NO: 2640436 - RNA, 13 nt, Human papillomavirus type 11
uccaauuguuuaa

SEQ ID NO: 2640437 - RNA, 18 nt, Human papillomavirus type 11
cuguuguuauugcauuug

SEQ ID NO: 2640438 - RNA, 14 nt, Human papillomavirus type 11
uuuguguugccuuc

SEQ ID NO: 2640439 - RNA, 15 nt, Human papillomavirus type 11
accuagggcacgcag

SEQ ID NO: 2640440 - RNA, 18 nt, Human papillomavirus type 11
acaccaguuaugaaaugu

SEQ ID NO: 2640441 - RNA, 22 nt, Human papillomavirus type 11
guacaugucccccagauguaau

SEQ ID NO: 2640442 - RNA, 16 nt, Human papillomavirus type 11
aggagucugcuauuau

SEQ ID NO: 2640443 - RNA, 16 nt, Human papillomavirus type 11
uauacacauauacauu

SEQ ID NO: 2640444 - RNA, 17 nt, Human papillomavirus type 11
auguuguuauguauguu

SEQ ID NO: 2640445 - RNA, 16 nt, Human papillomavirus type 11
uuguguauauguguau

SEQ ID NO: 2640446 - RNA, 16 nt, Human papillomavirus type 11
ggcgugcacaggguug

SEQ ID NO: 2640447 - RNA, 16 nt, Human papillomavirus type 11
cugcuauuacuggggg

SEQ ID NO: 2640448 - RNA, 22 nt, Human papillomavirus type 11
uacuaacacugugugugugcua

SEQ ID NO: 2640449 - RNA, 21 nt, Human papillomavirus type 11
uguauauguguauauguuugu

SEQ ID NO: 2640450 - RNA, 22 nt, Human papillomavirus type 11
aaguaguaccaccauuaacugu

SEQ ID NO: 2640451 - RNA, 14 nt, Human papillomavirus type 11
cucagaagaugagg

SEQ ID NO: 2640452 - RNA, 10 nt, Human papillomavirus type 11
uauauguuuc

SEQ ID NO: 2640453 - RNA, 19 nt, Human papillomavirus type 11
accugucacuuaaaugaug

SEQ ID NO: 2640454 - RNA, 22 nt, Human papillomavirus type 11
aguaugguguggaaccuuggac

SEQ ID NO: 2640455 - RNA, 22 nt, Human papillomavirus type 11
guggaauguguauguauguuuu

SEQ ID NO: 2640456 - RNA, 13 nt, Human papillomavirus type 11
uuguuauguaugu

SEQ ID NO: 2640457 - RNA, 14 nt, Human papillomavirus type 11
agugccuguacaaa

SEQ ID NO: 2640458 - RNA, 20 nt, Human papillomavirus type 11
caucugugcugguacuaaca

SEQ ID NO: 2640459 - RNA, 15 nt, Human papillomavirus type 11
ugugcuauuuuccug

SEQ ID NO: 2640460 - RNA, 16 nt, Human papillomavirus type 11
gauauugccuguuguu

SEQ ID NO: 2640461 - RNA, 22 nt, Human papillomavirus type 11
auuaauaucugauuuuguagua

SEQ ID NO: 2640462 - RNA, 11 nt, Human papillomavirus type 11
auguauguuug

SEQ ID NO: 2640463 - RNA, 23 nt, Human papillomavirus type 11
ugguagaagccauaguagagcac

SEQ ID NO: 2640464 - RNA, 14 nt, Human papillomavirus type 11
cacauuaugcauug

SEQ ID NO: 2640465 - RNA, 23 nt, Human papillomavirus type 11
caaaacaguuguaccaaaggugu

SEQ ID NO: 2640466 - RNA, 21 nt, Human papillomavirus type 11
auggugauguuaaccugucac

SEQ ID NO: 2640467 - RNA, 22 nt, Human papillomavirus type 11
ugcaggguauauacccuuggga

SEQ ID NO: 2640468 - RNA, 17 nt, Human papillomavirus type 11
ugaggcaccacauaaaa

SEQ ID NO: 2640469 - RNA, 14 nt, Human papillomavirus type 11
uaugucauuacauu

SEQ ID NO: 2640470 - RNA, 14 nt, Human papillomavirus type 11
guuguuauugcauu

SEQ ID NO: 2640471 - RNA, 18 nt, Human papillomavirus type 11
gccauuaaacuuacaaca

SEQ ID NO: 2640472 - RNA, 14 nt, Human papillomavirus type 11
gaagaggaggugga

SEQ ID NO: 2640473 - RNA, 17 nt, Human papillomavirus type 11
gacggcuguuugaaaca

SEQ ID NO: 2640474 - RNA, 22 nt, Human papillomavirus type 11
uccuaaaguugaacauacuacu

SEQ ID NO: 2640475 - RNA, 13 nt, Human papillomavirus type 11
uauguugugugcc

SEQ ID NO: 2640476 - RNA, 22 nt, Human papillomavirus type 11
acagcaacguccgacugguugu

SEQ ID NO: 2640477 - RNA, 22 nt, Human papillomavirus type 11
cgucagcaauuuuuaaacagug

SEQ ID NO: 2640478 - RNA, 18 nt, Human papillomavirus type 11
auuacagggcuguacaug

SEQ ID NO: 2640479 - RNA, 18 nt, Human papillomavirus type 11
gugguuguuuacugcauu

SEQ ID NO: 2640480 - RNA, 22 nt, Human papillomavirus type 11
aaaacgaaaguauuuaggcagu

SEQ ID NO: 2640481 - RNA, 21 nt, Human papillomavirus type 11
agcucagaagaugagguggac

SEQ ID NO: 2640482 - RNA, 21 nt, Human papillomavirus type 11
guuuaaaauguuuuagauaua

SEQ ID NO: 2640483 - RNA, 17 nt, Human papillomavirus type 11
acaccacccaaacggug

SEQ ID NO: 2640484 - RNA, 15 nt, Human papillomavirus type 11
cacguccgccagugc

SEQ ID NO: 2640485 - RNA, 20 nt, Human papillomavirus type 11
ugagcaauuagaagacagcu

SEQ ID NO: 2640486 - RNA, 21 nt, Human papillomavirus type 11
ggacgauucagguacagaaaa

SEQ ID NO: 2640487 - RNA, 18 nt, Human papillomavirus type 11
uauuacuacacaaagcaa

SEQ ID NO: 2640488 - RNA, 19 nt, Human papillomavirus type 11
uauguaaguccuauaagca

SEQ ID NO: 2640489 - RNA, 19 nt, Human papillomavirus type 11
cagaagaugaggaagagga

SEQ ID NO: 2640490 - RNA, 20 nt, Human papillomavirus type 11
gacaccaguuaugaaaugug

SEQ ID NO: 2640491 - RNA, 20 nt, Human papillomavirus type 11
uacuauugcagaucaaauau

SEQ ID NO: 2640492 - RNA, 18 nt, Human papillomavirus type 11
uuaugcauuggaaaugca

SEQ ID NO: 2640493 - RNA, 22 nt, Human papillomavirus type 11
uacaaauugcugcagcaacaac

SEQ ID NO: 2640494 - RNA, 19 nt, Human papillomavirus type 11
auauauuuguaauauaccu

SEQ ID NO: 2640495 - RNA, 18 nt, Human papillomavirus type 11
auuagaagacagcucaga

SEQ ID NO: 2640496 - RNA, 20 nt, Human papillomavirus type 11
auggagguagugccuguaca

SEQ ID NO: 2640497 - RNA, 22 nt, Human papillomavirus type 11
gacauaaugcuauugaaaugca

SEQ ID NO: 2640498 - RNA, 17 nt, Human papillomavirus type 11
gcauuugcaguauguau

SEQ ID NO: 2640499 - RNA, 21 nt, Human papillomavirus type 11
uaauggagauuauguguacau

SEQ ID NO: 2640500 - RNA, 22 nt, Human papillomavirus type 11
aauuagaagacagcucagaaga

SEQ ID NO: 2640501 - RNA, 21 nt, Human papillomavirus type 11
auugccuguuguuauugcauu

SEQ ID NO: 2640502 - RNA, 22 nt, Human papillomavirus type 11
acuacauuacagggcuguacau

SEQ ID NO: 2640503 - RNA, 17 nt, Human papillomavirus type 11
auuacauuuauuguaac

SEQ ID NO: 2640504 - RNA, 15 nt, Human papillomavirus type 11
uauauguuuguguau

SEQ ID NO: 2640505 - RNA, 16 nt, Human papillomavirus type 11
auguauguuuuugugc

SEQ ID NO: 2640506 - RNA, 19 nt, Human papillomavirus type 11
caaauaucagaagaugagg

SEQ ID NO: 2640507 - RNA, 20 nt, Human papillomavirus type 11
uaaacaauuauuaugugugu

SEQ ID NO: 2640508 - RNA, 15 nt, Human papillomavirus type 11
gugcuauuuuccugc

SEQ ID NO: 2640509 - RNA, 12 nt, Human papillomavirus type 11
guagcuaaugca

SEQ ID NO: 2640510 - RNA, 18 nt, Human papillomavirus type 11
agguggaggacagugggu

SEQ ID NO: 2640511 - RNA, 23 nt, Human papillomavirus type 11
gggaagcucucccaagccugcua

SEQ ID NO: 2640512 - RNA, 18 nt, Human papillomavirus type 11
gaaaaaacuaaaugugcu

SEQ ID NO: 2640513 - RNA, 14 nt, Human papillomavirus type 11
ccugauucaucccu

SEQ ID NO: 2640514 - RNA, 20 nt, Human papillomavirus type 11
uaaaugugcuaaguguaaau

SEQ ID NO: 2640515 - RNA, 17 nt, Human papillomavirus type 11
caaagcaaaacaaaugg

SEQ ID NO: 2640516 - RNA, 15 nt, Human papillomavirus type 11
caguuaugaaaugug

SEQ ID NO: 2640517 - RNA, 21 nt, Human papillomavirus type 11
auucuguggaagcacaggcau

SEQ ID NO: 2640518 - RNA, 19 nt, Human papillomavirus type 11
guuacauugcuaugagcaa

SEQ ID NO: 2640519 - RNA, 24 nt, Human papillomavirus type 11
uacauuacagggcuguacauggua

SEQ ID NO: 2640520 - RNA, 12 nt, Human papillomavirus type 11
caacacagccaa

SEQ ID NO: 2640521 - RNA, 19 nt, Human papillomavirus type 11
guagagcacacuacaggua

SEQ ID NO: 2640522 - RNA, 12 nt, Human papillomavirus type 11
augcauuggaaa

SEQ ID NO: 2640523 - RNA, 12 nt, Human papillomavirus type 11
uaucugauuuug

SEQ ID NO: 2640524 - RNA, 17 nt, Human papillomavirus type 11
aaccgcaauacuacugu

SEQ ID NO: 2640525 - RNA, 18 nt, Human papillomavirus type 11
uguguauguuauguaugu

SEQ ID NO: 2640526 - RNA, 20 nt, Human papillomavirus type 11
aguccacgguuagacgccau

SEQ ID NO: 2640527 - RNA, 18 nt, Human papillomavirus type 11
uauacaguguguggugua

SEQ ID NO: 2640528 - RNA, 16 nt, Human papillomavirus type 11
uaaaguugaacauacu

SEQ ID NO: 2640529 - RNA, 20 nt, Human papillomavirus type 11
aaacuaaaugugcuaagugu

SEQ ID NO: 2640530 - RNA, 21 nt, Human papillomavirus type 11
ccuuggacauuacaggacacc

SEQ ID NO: 2640531 - RNA, 17 nt, Human papillomavirus type 11
uaccaaauacugaccug

SEQ ID NO: 2640532 - RNA, 15 nt, Human papillomavirus type 11
cacuuaaaugauggu

SEQ ID NO: 2640533 - RNA, 13 nt, Human papillomavirus type 11
cauugcuaaacaa

SEQ ID NO: 2640534 - RNA, 18 nt, Human papillomavirus type 11
ugauucaucccuguuuga

SEQ ID NO: 2640535 - RNA, 23 nt, Human papillomavirus type 11
uggagauuauguguacaugaacu

SEQ ID NO: 2640536 - RNA, 15 nt, Human papillomavirus type 11
ugauauacacaaaca

SEQ ID NO: 2640537 - RNA, 16 nt, Human papillomavirus type 11
augcgacugugcagga

SEQ ID NO: 2640538 - RNA, 14 nt, Human papillomavirus type 11
aauucuuuuuacua

SEQ ID NO: 2640539 - RNA, 16 nt, Human papillomavirus type 11
aauuauuauguguguc

SEQ ID NO: 2640540 - RNA, 18 nt, Human papillomavirus type 11
uagugccuguacaaauug

SEQ ID NO: 2640541 - RNA, 14 nt, Human papillomavirus type 11
cugguuguggagug

SEQ ID NO: 2640542 - RNA, 11 nt, Human papillomavirus type 11
auguguauguu

SEQ ID NO: 2640543 - RNA, 21 nt, Human papillomavirus type 11
uauuuuccugccuuuuauaua

SEQ ID NO: 2640544 - RNA, 20 nt, Human papillomavirus type 11
agugccuguacaaauugcug

SEQ ID NO: 2640545 - RNA, 17 nt, Human papillomavirus type 11
uuuaugguagaagccau

SEQ ID NO: 2640546 - RNA, 16 nt, Human papillomavirus type 11
gagacuaaaggacaua

SEQ ID NO: 2640547 - RNA, 23 nt, Human papillomavirus type 11
auugugcaaacgcaacaauaaug

SEQ ID NO: 2640548 - RNA, 23 nt, Human papillomavirus type 11
guuacacccagugacuaaguugu

SEQ ID NO: 2640549 - RNA, 15 nt, Human papillomavirus type 11
augucacauggugau

SEQ ID NO: 2640550 - RNA, 20 nt, Human papillomavirus type 11
cuauugaaaugcaaaugcau

SEQ ID NO: 2640551 - RNA, 19 nt, Human papillomavirus type 11
auguagaaaauaguggugg

SEQ ID NO: 2640552 - RNA, 19 nt, Human papillomavirus type 11
gcaacaacuacaacauuga

SEQ ID NO: 2640553 - RNA, 22 nt, Human papillomavirus type 11
acuaacacuucuuuuauauuug

SEQ ID NO: 2640554 - RNA, 19 nt, Human papillomavirus type 11
uuauacaguguguggugua

SEQ ID NO: 2640555 - RNA, 18 nt, Human papillomavirus type 11
cuguggaagcacaggcau

SEQ ID NO: 2640556 - RNA, 15 nt, Human papillomavirus type 11
uggagauuaugugua

SEQ ID NO: 2640557 - RNA, 17 nt, Human papillomavirus type 11
auguuuuugugcaauaa

SEQ ID NO: 2640558 - RNA, 20 nt, Human papillomavirus type 11
uaucugauuuuguaguauau

SEQ ID NO: 2640559 - RNA, 13 nt, Human papillomavirus type 11
caucugugcuggu

SEQ ID NO: 2640560 - RNA, 17 nt, Human papillomavirus type 11
uaaccugucacuuaaau

SEQ ID NO: 2640561 - RNA, 14 nt, Human papillomavirus type 11
uugcagaucaaaua

SEQ ID NO: 2640562 - RNA, 22 nt, Human papillomavirus type 11
aaaugcauuuagaauccuuagc

SEQ ID NO: 2640563 - RNA, 18 nt, Human papillomavirus type 11
uaacacaacauuaccaaa

SEQ ID NO: 2640564 - RNA, 17 nt, Human papillomavirus type 11
augcuauugaaaugcaa

SEQ ID NO: 2640565 - RNA, 16 nt, Human papillomavirus type 11
cauuuauuguaaccau

SEQ ID NO: 2640566 - RNA, 16 nt, Human papillomavirus type 11
gguuguuucugugguu

SEQ ID NO: 2640567 - RNA, 20 nt, Human papillomavirus type 11
uaacaaccccuuugcaauuc

SEQ ID NO: 2640568 - RNA, 12 nt, Human papillomavirus type 11
uagaagccauag

SEQ ID NO: 2640569 - RNA, 17 nt, Human papillomavirus type 11
uguuguuacuacauuac

SEQ ID NO: 2640570 - RNA, 16 nt, Human papillomavirus type 11
auauaccugcaggaca

SEQ ID NO: 2640571 - RNA, 19 nt, Human papillomavirus type 11
uguacuaaucccauauguu

SEQ ID NO: 2640572 - RNA, 16 nt, Human papillomavirus type 11
ugcaauucuuuuuacu

SEQ ID NO: 2640573 - RNA, 20 nt, Human papillomavirus type 11
gaccccacuacacagcguuu

SEQ ID NO: 2640574 - RNA, 16 nt, Human papillomavirus type 11
ggacauuacaggacac

SEQ ID NO: 2640575 - RNA, 17 nt, Human papillomavirus type 11
ugcagccuccugacccu

SEQ ID NO: 2640576 - RNA, 22 nt, Human papillomavirus type 11
acaaauaucagaagaugaggaa

SEQ ID NO: 2640577 - RNA, 23 nt, Human papillomavirus type 11
uguuucugugguuguuuacugca

SEQ ID NO: 2640578 - RNA, 17 nt, Human papillomavirus type 11
uaaaugugcuaagugua

SEQ ID NO: 2640579 - RNA, 17 nt, Human papillomavirus type 11
cacauuaugcauuggaa

SEQ ID NO: 2640580 - RNA, 18 nt, Human papillomavirus type 11
gucgggguguacaggaug

SEQ ID NO: 2640581 - RNA, 17 nt, Human papillomavirus type 11
uuaugaaauguggcuaa

SEQ ID NO: 2640582 - RNA, 19 nt, Human papillomavirus type 11
cacacuaaauauugugugu

SEQ ID NO: 2640583 - RNA, 16 nt, Human papillomavirus type 11
agaauccuuagcaaaa

SEQ ID NO: 2640584 - RNA, 14 nt, Human papillomavirus type 11
guauaugucacaug

SEQ ID NO: 2640585 - RNA, 14 nt, Human papillomavirus type 11
uugaugacaggcau

SEQ ID NO: 2640586 - RNA, 19 nt, Human papillomavirus type 11
cauaguagagcacacuaca

SEQ ID NO: 2640587 - RNA, 23 nt, Human papillomavirus type 11
ggccacugguacaugucccccag

SEQ ID NO: 2640588 - RNA, 10 nt, Human papillomavirus type 11
acugcauuug

SEQ ID NO: 2640589 - RNA, 17 nt, Human papillomavirus type 11
auacccuugggaagcuc

SEQ ID NO: 2640590 - RNA, 20 nt, Human papillomavirus type 11
uaucaauauagaguguuuaa

SEQ ID NO: 2640591 - RNA, 21 nt, Human papillomavirus type 11
auguuuuagauauagacugaa

SEQ ID NO: 2640592 - RNA, 20 nt, Human papillomavirus type 11
uacuaaucccauauguugug

SEQ ID NO: 2640593 - RNA, 13 nt, Human papillomavirus type 11
cuauacuauguua

SEQ ID NO: 2640594 - RNA, 13 nt, Human papillomavirus type 11
cggagacaucaga

SEQ ID NO: 2640595 - RNA, 20 nt, Human papillomavirus type 11
auauuaaaauggggaagcuu

SEQ ID NO: 2640596 - RNA, 22 nt, Human papillomavirus type 11
ggaggacaguggguaugacaug

SEQ ID NO: 2640597 - RNA, 14 nt, Human papillomavirus type 11
cugauucaucccug

SEQ ID NO: 2640598 - RNA, 14 nt, Human papillomavirus type 11
guauugauauacac

SEQ ID NO: 2640599 - RNA, 19 nt, Human papillomavirus type 11
gugauguuaaccugucacu

SEQ ID NO: 2640600 - RNA, 18 nt, Human papillomavirus type 11
uguggaagcacaggcauu

SEQ ID NO: 2640601 - RNA, 14 nt, Human papillomavirus type 11
caagaccuuuugcu

SEQ ID NO: 2640602 - RNA, 18 nt, Human papillomavirus type 11
acaaaugggccugagcca

SEQ ID NO: 2640603 - RNA, 12 nt, Human papillomavirus type 11
augacaggcaua

SEQ ID NO: 2640604 - RNA, 15 nt, Human papillomavirus type 11
gggaagcucucccaa

SEQ ID NO: 2640605 - RNA, 21 nt, Human papillomavirus type 11
aagacagcucagaagaugagg

SEQ ID NO: 2640606 - RNA, 23 nt, Human papillomavirus type 11
acuaaaugugcuaaguguaaauc

SEQ ID NO: 2640607 - RNA, 18 nt, Human papillomavirus type 11
uauaaacauuuguuugaa

SEQ ID NO: 2640608 - RNA, 18 nt, Human papillomavirus type 11
aaauaucagaagaugagg

SEQ ID NO: 2640609 - RNA, 14 nt, Human papillomavirus type 11
uagugccuguacaa

SEQ ID NO: 2640610 - RNA, 21 nt, Human papillomavirus type 11
guggaaccuuggacauuacag

SEQ ID NO: 2640611 - RNA, 15 nt, Human papillomavirus type 11
cagggaaauacugug

SEQ ID NO: 2640612 - RNA, 14 nt, Human papillomavirus type 11
auguguauguuaug

SEQ ID NO: 2640613 - RNA, 19 nt, Human papillomavirus type 11
ugugcaggaccuaaaacga

SEQ ID NO: 2640614 - RNA, 14 nt, Human papillomavirus type 11
gcuguggaugugac

SEQ ID NO: 2640615 - RNA, 18 nt, Human papillomavirus type 11
cauaacaaggauggcgga

SEQ ID NO: 2640616 - RNA, 16 nt, Human papillomavirus type 11
uguggaaccuuggaca

SEQ ID NO: 2640617 - RNA, 14 nt, Human papillomavirus type 11
gcuuguggagccug

SEQ ID NO: 2640618 - RNA, 21 nt, Human papillomavirus type 11
uuguaaccauuacaccuguau

SEQ ID NO: 2640619 - RNA, 15 nt, Human papillomavirus type 11
aucugcgcaccaaaa

SEQ ID NO: 2640620 - RNA, 16 nt, Human papillomavirus type 11
cagguacacaaauauc

SEQ ID NO: 2640621 - RNA, 19 nt, Human papillomavirus type 11
caggaugguuuaugguaga

SEQ ID NO: 2640622 - RNA, 16 nt, Human papillomavirus type 11
gcagcacguccgccag

SEQ ID NO: 2640623 - RNA, 21 nt, Human papillomavirus type 11
cacugugugugugcuauuuuc

SEQ ID NO: 2640624 - RNA, 12 nt, Human papillomavirus type 11
aauaucagaaga

SEQ ID NO: 2640625 - RNA, 17 nt, Human papillomavirus type 11
auauguguauauguuug

SEQ ID NO: 2640626 - RNA, 15 nt, Human papillomavirus type 11
gacaggcauauuaca

SEQ ID NO: 2640627 - RNA, 21 nt, Human papillomavirus type 11
gacagcucagaagaugaggug

SEQ ID NO: 2640628 - RNA, 23 nt, Human papillomavirus type 11
uuacaacacagccaaaaaaggua

SEQ ID NO: 2640629 - RNA, 18 nt, Human papillomavirus type 11
guacacaaauaucagaag

SEQ ID NO: 2640630 - RNA, 22 nt, Human papillomavirus type 11
uauauauuuguggaauguguau

SEQ ID NO: 2640631 - RNA, 14 nt, Human papillomavirus type 11
guaguauauacauc

SEQ ID NO: 2640632 - RNA, 14 nt, Human papillomavirus type 11
uauguuuguguaua

SEQ ID NO: 2640633 - RNA, 16 nt, Human papillomavirus type 11
uugauggcugugaaga

SEQ ID NO: 2640634 - RNA, 19 nt, Human papillomavirus type 11
auauaaacauuuguuugaa

SEQ ID NO: 2640635 - RNA, 13 nt, Human papillomavirus type 11
ggaugugacagca

SEQ ID NO: 2640636 - RNA, 22 nt, Human papillomavirus type 11
caggaccuaaaacgaaaguauu

SEQ ID NO: 2640637 - RNA, 15 nt, Human papillomavirus type 11
ugaugacaggcauau

SEQ ID NO: 2640638 - RNA, 19 nt, Human papillomavirus type 11
uggagauuauguguacaug

SEQ ID NO: 2640639 - RNA, 14 nt, Human papillomavirus type 11
caauuguaacauua

SEQ ID NO: 2640640 - RNA, 15 nt, Human papillomavirus type 11
aauaucagaagauga

SEQ ID NO: 2640641 - RNA, 16 nt, Human papillomavirus type 11
caugcaaggccacugg

SEQ ID NO: 2640642 - RNA, 15 nt, Human papillomavirus type 11
uuauguauguuaugu

SEQ ID NO: 2640643 - RNA, 22 nt, Human papillomavirus type 11
uguauauauguauauguguaca

SEQ ID NO: 2640644 - RNA, 19 nt, Human papillomavirus type 11
aacacauuaugcauuggaa

SEQ ID NO: 2640645 - RNA, 15 nt, Human papillomavirus type 11
ugcaaacgcaacaau

SEQ ID NO: 2640646 - RNA, 16 nt, Human papillomavirus type 11
ugucccaucugcgcac

SEQ ID NO: 2640647 - RNA, 19 nt, Human papillomavirus type 11
aggaugguuuaugguagaa

SEQ ID NO: 2640648 - RNA, 19 nt, Human papillomavirus type 11
auaucugauuuuguaguau

SEQ ID NO: 2640649 - RNA, 14 nt, Human papillomavirus type 11
agcucagaagauga

SEQ ID NO: 2640650 - RNA, 17 nt, Human papillomavirus type 11
aggugauuccaauuguu

SEQ ID NO: 2640651 - RNA, 15 nt, Human papillomavirus type 11
caaaauucuguggaa

SEQ ID NO: 2640652 - RNA, 12 nt, Human papillomavirus type 11
uaaccugucacu

SEQ ID NO: 2640653 - RNA, 22 nt, Human papillomavirus type 11
gguggacuuuauugaugacagg

SEQ ID NO: 2640654 - RNA, 22 nt, Human papillomavirus type 11
uggacuuuauugaugacaggca

SEQ ID NO: 2640655 - RNA, 18 nt, Human papillomavirus type 11
uguauguuuuugugcaau

SEQ ID NO: 2640656 - RNA, 13 nt, Human papillomavirus type 11
aguauuuaggcag

SEQ ID NO: 2640657 - RNA, 16 nt, Human papillomavirus type 11
uaacauuaacauauag

SEQ ID NO: 2640658 - RNA, 11 nt, Human papillomavirus type 11
gaagcacaggc

SEQ ID NO: 2640659 - RNA, 18 nt, Human papillomavirus type 11
uguauauguguauauguu

SEQ ID NO: 2640660 - RNA, 20 nt, Human papillomavirus type 11
aggcguugguguuagugggc

SEQ ID NO: 2640661 - RNA, 22 nt, Human papillomavirus type 11
gacugguuguggagugcacaga

SEQ ID NO: 2640662 - RNA, 22 nt, Human papillomavirus type 11
ugugaagacaauguaauggagu

SEQ ID NO: 2640663 - RNA, 14 nt, Human papillomavirus type 11
cauuggaaaugcau

SEQ ID NO: 2640664 - RNA, 14 nt, Human papillomavirus type 11
uacaaauugcugca

SEQ ID NO: 2640665 - RNA, 17 nt, Human papillomavirus type 11
cugaccuguugcugugg

SEQ ID NO: 2640666 - RNA, 21 nt, Human papillomavirus type 11
ugugucagagacuaaaggaca

SEQ ID NO: 2640667 - RNA, 15 nt, Human papillomavirus type 11
cagcucagaagauga

SEQ ID NO: 2640668 - RNA, 17 nt, Human papillomavirus type 11
acagcucagaagaugag

SEQ ID NO: 2640669 - RNA, 14 nt, Human papillomavirus type 11
auauguuguuguag

SEQ ID NO: 2640670 - RNA, 21 nt, Human papillomavirus type 11
gcaguauguauucuuaguauu

SEQ ID NO: 2640671 - RNA, 17 nt, Human papillomavirus type 11
uacugcauuuguuguag

SEQ ID NO: 2640672 - RNA, 21 nt, Human papillomavirus type 11
acgacucauggguaaaaguaa

SEQ ID NO: 2640673 - RNA, 12 nt, Human papillomavirus type 11
aguaugugguau

SEQ ID NO: 2640674 - RNA, 16 nt, Human papillomavirus type 11
uggacauuacaggaca

SEQ ID NO: 2640675 - RNA, 13 nt, Human papillomavirus type 11
auauuuguggaau

SEQ ID NO: 2640676 - RNA, 20 nt, Human papillomavirus type 11
cagaagaugagguggacaag

SEQ ID NO: 2640677 - RNA, 17 nt, Human papillomavirus type 11
uuaccaaauacugaccu

SEQ ID NO: 2640678 - RNA, 16 nt, Human papillomavirus type 11
auguuguuguagugug

SEQ ID NO: 2640679 - RNA, 21 nt, Human papillomavirus type 11
ggcggacgauucagguacaga

SEQ ID NO: 2640680 - RNA, 18 nt, Human papillomavirus type 11
cugaaaaaacuaaaugug

SEQ ID NO: 2640681 - RNA, 17 nt, Human papillomavirus type 11
aauggaguaugugguau

SEQ ID NO: 2640682 - RNA, 16 nt, Human papillomavirus type 11
augucauuacauuuau

SEQ ID NO: 2640683 - RNA, 16 nt, Human papillomavirus type 11
gaagaugagguggaca

SEQ ID NO: 2640684 - RNA, 16 nt, Human papillomavirus type 11
aacaacgucagcaauu

SEQ ID NO: 2640685 - RNA, 17 nt, Human papillomavirus type 11
cagaagaugaggaagag

SEQ ID NO: 2640686 - RNA, 15 nt, Human papillomavirus type 11
aacuauaucaaacau

SEQ ID NO: 2640687 - RNA, 23 nt, Human papillomavirus type 11
caauuuuuaaacaguguaaaaau

SEQ ID NO: 2640688 - RNA, 15 nt, Human papillomavirus type 11
uaucagaagaugagg

SEQ ID NO: 2640689 - RNA, 17 nt, Human papillomavirus type 11
uauguguauguuaugua

SEQ ID NO: 2640690 - RNA, 12 nt, Human papillomavirus type 11
acagccaaaaaa

SEQ ID NO: 2640691 - RNA, 17 nt, Human papillomavirus type 11
uauaaacauuuguuuga

SEQ ID NO: 2640692 - RNA, 13 nt, Human papillomavirus type 11
acacaaagcaaaa

SEQ ID NO: 2640693 - RNA, 18 nt, Human papillomavirus type 11
auggugauguuaaccugu

SEQ ID NO: 2640694 - RNA, 14 nt, Human papillomavirus type 11
aagcacaggcauug

SEQ ID NO: 2640695 - RNA, 18 nt, Human papillomavirus type 11
ccugucacuuaaaugaug

SEQ ID NO: 2640696 - RNA, 15 nt, Human papillomavirus type 11
uggauuguuguuacu

SEQ ID NO: 2640697 - RNA, 17 nt, Human papillomavirus type 11
gggaaauacuguggagg

SEQ ID NO: 2640698 - RNA, 18 nt, Human papillomavirus type 11
cucaccugaggcaccaca

SEQ ID NO: 2640699 - RNA, 17 nt, Human papillomavirus type 11
caauuuuuaaacagugu

SEQ ID NO: 2640700 - RNA, 17 nt, Human papillomavirus type 11
ugauuccaauuguuuaa

SEQ ID NO: 2640701 - RNA, 14 nt, Human papillomavirus type 11
gguauugguacagg

SEQ ID NO: 2640702 - RNA, 23 nt, Human papillomavirus type 11
augcuauugaaaugcaaaugcau

SEQ ID NO: 2640703 - RNA, 14 nt, Human papillomavirus type 11
uggaagcacaggca

SEQ ID NO: 2640704 - RNA, 15 nt, Human papillomavirus type 11
uauguguacaugaac

SEQ ID NO: 2640705 - RNA, 20 nt, Human papillomavirus type 11
guguauuacuacacaaagca

SEQ ID NO: 2640706 - RNA, 18 nt, Human papillomavirus type 11
ugccuuuuauauacacau

SEQ ID NO: 2640707 - RNA, 18 nt, Human papillomavirus type 11
gcuaugagcaauuagaag

SEQ ID NO: 2640708 - RNA, 22 nt, Human papillomavirus type 11
uaacaaaacaguuguaccaaag

SEQ ID NO: 2640709 - RNA, 18 nt, Human papillomavirus type 11
aaaaacucaguauggugu

SEQ ID NO: 2640710 - RNA, 17 nt, Human papillomavirus type 11
uacauuacagggcugua

SEQ ID NO: 2640711 - RNA, 22 nt, Human papillomavirus type 11
aauuugauggcugugaagacaa

SEQ ID NO: 2640712 - RNA, 18 nt, Human papillomavirus type 11
ucagccacacaacuauau

SEQ ID NO: 2640713 - RNA, 16 nt, Human papillomavirus type 11
uggaagcacaggcauu

SEQ ID NO: 2640714 - RNA, 19 nt, Human papillomavirus type 11
gcaaggccacugguacaug

SEQ ID NO: 2640715 - RNA, 10 nt, Human papillomavirus type 11
acaggauggu

SEQ ID NO: 2640716 - RNA, 14 nt, Human papillomavirus type 11
uuuaguguguguau

SEQ ID NO: 2640717 - RNA, 16 nt, Human papillomavirus type 11
gcguauguuaaacgca

SEQ ID NO: 2640718 - RNA, 14 nt, Human papillomavirus type 11
caucuucaacgugg

SEQ ID NO: 2640719 - RNA, 12 nt, Human papillomavirus type 11
ugcuauuuuccu

SEQ ID NO: 2640720 - RNA, 19 nt, Human papillomavirus type 11
uguguuuaguguguguaua

SEQ ID NO: 2640721 - RNA, 22 nt, Human papillomavirus type 11
aguaguaccaccauuaacugug

SEQ ID NO: 2640722 - RNA, 19 nt, Human papillomavirus type 11
ucauuaugcgacugugcag

SEQ ID NO: 2640723 - RNA, 18 nt, Human papillomavirus type 11
aaacagggaaauacugug

SEQ ID NO: 2640724 - RNA, 17 nt, Human papillomavirus type 11
cauauacauugugcaaa

SEQ ID NO: 2640725 - RNA, 15 nt, Human papillomavirus type 11
uguauauguuucuug

SEQ ID NO: 2640726 - RNA, 14 nt, Human papillomavirus type 11
uguauauauguaua

SEQ ID NO: 2640727 - RNA, 14 nt, Human papillomavirus type 11
gccacugguacaug

SEQ ID NO: 2640728 - RNA, 13 nt, Human papillomavirus type 11
cugggcacacuaa

SEQ ID NO: 2640729 - RNA, 16 nt, Human papillomavirus type 11
gacaguggguaugaca

SEQ ID NO: 2640730 - RNA, 19 nt, Human papillomavirus type 11
gaaaaaacuaaaugugcua

SEQ ID NO: 2640731 - RNA, 17 nt, Human papillomavirus type 11
cauuaacauauagcagu

SEQ ID NO: 2640732 - RNA, 13 nt, Human papillomavirus type 11
ugugguauggaca

SEQ ID NO: 2640733 - RNA, 23 nt, Human papillomavirus type 11
uggauuauguguauaugucacau

SEQ ID NO: 2640734 - RNA, 23 nt, Human papillomavirus type 11
ccugucacuuaaaugauggugau

SEQ ID NO: 2640735 - RNA, 14 nt, Human papillomavirus type 11
uauugauauacaca

SEQ ID NO: 2640736 - RNA, 18 nt, Human papillomavirus type 11
auuauauauauuuguaau

SEQ ID NO: 2640737 - RNA, 15 nt, Human papillomavirus type 11
accuguauauaugua

SEQ ID NO: 2640738 - RNA, 22 nt, Human papillomavirus type 11
acuaaaugugcuaaguguaaau

SEQ ID NO: 2640739 - RNA, 19 nt, Human papillomavirus type 11
gcucagaagaugaggugga

SEQ ID NO: 2640740 - RNA, 20 nt, Human papillomavirus type 11
cugauuuuguaguauauaca

SEQ ID NO: 2640741 - RNA, 15 nt, Human papillomavirus type 11
uguuauuuauauguu

SEQ ID NO: 2640742 - RNA, 15 nt, Human papillomavirus type 11
ccuguugcuguggau

SEQ ID NO: 2640743 - RNA, 15 nt, Human papillomavirus type 11
gacgauucagguaca

SEQ ID NO: 2640744 - RNA, 18 nt, Human papillomavirus type 11
uaaucccauauguugugu

SEQ ID NO: 2640745 - RNA, 21 nt, Human papillomavirus type 11
uuuguguguuuagugugugua

SEQ ID NO: 2640746 - RNA, 12 nt, Human papillomavirus type 11
agugcuugugga

SEQ ID NO: 2640747 - RNA, 18 nt, Human papillomavirus type 11
uggaauguguauguaugu

SEQ ID NO: 2640748 - RNA, 18 nt, Human papillomavirus type 11
cauaguagagcacacuac

SEQ ID NO: 2640749 - RNA, 17 nt, Human papillomavirus type 11
ggacauuacaggacacc

SEQ ID NO: 2640750 - RNA, 21 nt, Human papillomavirus type 11
gcuauugaaaugcaaaugcau

SEQ ID NO: 2640751 - RNA, 11 nt, Human papillomavirus type 11
acuaacacugu

SEQ ID NO: 2640752 - RNA, 16 nt, Human papillomavirus type 11
agaugaggaagaggag

SEQ ID NO: 2640753 - RNA, 17 nt, Human papillomavirus type 11
cucccaagccugcuauu

SEQ ID NO: 2640754 - RNA, 14 nt, Human papillomavirus type 11
ccuccugacccugu

SEQ ID NO: 2640755 - RNA, 13 nt, Human papillomavirus type 11
uuuuaucaugcca

SEQ ID NO: 2640756 - RNA, 18 nt, Human papillomavirus type 11
uguauauauuuguggaau

SEQ ID NO: 2640757 - RNA, 16 nt, Human papillomavirus type 11
cagcucagaagaugag

SEQ ID NO: 2640758 - RNA, 23 nt, Human papillomavirus type 11
uuacaccuguauauauguauaug

SEQ ID NO: 2640759 - RNA, 11 nt, Human papillomavirus type 11
ggaugugacag

SEQ ID NO: 2640760 - RNA, 21 nt, Human papillomavirus type 11
agaugaggaagaggaggugga

SEQ ID NO: 2640761 - RNA, 15 nt, Human papillomavirus type 11
uauguuuguguauau

SEQ ID NO: 2640762 - RNA, 19 nt, Human papillomavirus type 11
auauguguauguuauguau

SEQ ID NO: 2640763 - RNA, 16 nt, Human papillomavirus type 11
uuggauuguuguuacu

SEQ ID NO: 2640764 - RNA, 18 nt, Human papillomavirus type 11
auuacuacacaaagcaaa

SEQ ID NO: 2640765 - RNA, 17 nt, Human papillomavirus type 11
caugaacuagaguaaac

SEQ ID NO: 2640766 - RNA, 16 nt, Human papillomavirus type 11
uauuacucuaucaaaa

SEQ ID NO: 2640767 - RNA, 15 nt, Human papillomavirus type 11
ugaaaugcaaaugca

SEQ ID NO: 2640768 - RNA, 17 nt, Human papillomavirus type 11
uauugaugacaggcaua

SEQ ID NO: 2640769 - RNA, 21 nt, Human papillomavirus type 11
gcaacaauaauggugauguua

SEQ ID NO: 2640770 - RNA, 17 nt, Human papillomavirus type 11
uauaauauuaauaucug

SEQ ID NO: 2640771 - RNA, 15 nt, Human papillomavirus type 11
aguaugguguggaac

SEQ ID NO: 2640772 - RNA, 13 nt, Human papillomavirus type 11
uguauauauguau

SEQ ID NO: 2640773 - RNA, 15 nt, Human papillomavirus type 11
cgacugguuguggag

SEQ ID NO: 2640774 - RNA, 14 nt, Human papillomavirus type 11
guauauguguacau

SEQ ID NO: 2640775 - RNA, 19 nt, Human papillomavirus type 11
aaaacaaaugggccugagc

SEQ ID NO: 2640776 - RNA, 13 nt, Human papillomavirus type 11
aaugcaaaugcau

SEQ ID NO: 2640777 - RNA, 19 nt, Human papillomavirus type 11
gcuauuacuggggggccag

SEQ ID NO: 2640778 - RNA, 23 nt, Human papillomavirus type 11
auuugcaguauguauucuuagua

SEQ ID NO: 2640779 - RNA, 23 nt, Human papillomavirus type 11
uauauguuucuuguauuguguau

SEQ ID NO: 2640780 - RNA, 13 nt, Human papillomavirus type 11
acugguacauguc

SEQ ID NO: 2640781 - RNA, 17 nt, Human papillomavirus type 11
augcauuggaaaugcau

SEQ ID NO: 2640782 - RNA, 13 nt, Human papillomavirus type 11
cauuacaggacac

SEQ ID NO: 2640783 - RNA, 15 nt, Human papillomavirus type 11
agggaaauacugugg

SEQ ID NO: 2640784 - RNA, 16 nt, Human papillomavirus type 11
cuguauccaagguugu

SEQ ID NO: 2640785 - RNA, 17 nt, Human papillomavirus type 11
ugguacaugucccccag

SEQ ID NO: 2640786 - RNA, 15 nt, Human papillomavirus type 11
uauguuuuugugcaa

SEQ ID NO: 2640787 - RNA, 16 nt, Human papillomavirus type 11
uagcagugaggaacaa

SEQ ID NO: 2640788 - RNA, 22 nt, Human papillomavirus type 11
uacacaaauaucagaagaugag

SEQ ID NO: 2640789 - RNA, 14 nt, Human papillomavirus type 11
gcuauugaaaugca

SEQ ID NO: 2640790 - RNA, 23 nt, Human papillomavirus type 11
aaaauucuguggaagcacaggca

SEQ ID NO: 2640791 - RNA, 12 nt, Human papillomavirus type 11
caauuguaacau

SEQ ID NO: 2640792 - RNA, 17 nt, Human papillomavirus type 11
uaaacaauuauuaugug

SEQ ID NO: 2640793 - RNA, 19 nt, Human papillomavirus type 11
acugaaaaaacuaaaugug

SEQ ID NO: 2640794 - RNA, 18 nt, Human papillomavirus type 11
caauuuuuaaacagugua

SEQ ID NO: 2640795 - RNA, 22 nt, Human papillomavirus type 11
uugcauuaccugauucaucccu

SEQ ID NO: 2640796 - RNA, 16 nt, Human papillomavirus type 11
uauuguacuuauaaua

SEQ ID NO: 2640797 - RNA, 22 nt, Human papillomavirus type 11
cuauugaaaugcaaaugcauuu

SEQ ID NO: 2640798 - RNA, 16 nt, Human papillomavirus type 11
uggagauuauguguac

SEQ ID NO: 2640799 - RNA, 19 nt, Human papillomavirus type 11
caccuguauauauguauau

SEQ ID NO: 2640800 - RNA, 14 nt, Human papillomavirus type 11
gacguaaacgugcg

SEQ ID NO: 2640801 - RNA, 22 nt, Human
cacauauaaauguacuuuuucu

SEQ ID NO: 2640802 - RNA, 18 nt, Human
ccaaaucauacuuuuucu

SEQ ID NO: 2640803 - RNA, 13 nt, Human papillomavirus type 16
ugugucuacauac

SEQ ID NO: 2640804 - RNA, 20 nt, Human papillomavirus type 16
accauggcugauccugcagg

SEQ ID NO: 2640805 - RNA, 20 nt, Human papillomavirus type 16
gcuuguaaauauuaaguugu

SEQ ID NO: 2640806 - RNA, 14 nt, Human papillomavirus type 16
augcaguacagguu

SEQ ID NO: 2640807 - RNA, 18 nt, Human papillomavirus type 16
gcugaacaaauauuacaa

SEQ ID NO: 2640808 - RNA, 19 nt, Human papillomavirus type 16
aaugacagcucagaggagg

SEQ ID NO: 2640809 - RNA, 18 nt, Human papillomavirus type 16
uaugauagugaauggcaa

SEQ ID NO: 2640810 - RNA, 11 nt, Human papillomavirus type 16
uuccugacacc

SEQ ID NO: 2640811 - RNA, 17 nt, Human papillomavirus type 16
uguauguguguuuguau

SEQ ID NO: 2640812 - RNA, 20 nt, Human papillomavirus type 16
augacgagaacgaaaaugac

SEQ ID NO: 2640813 - RNA, 17 nt, Human papillomavirus type 16
agugcuuaugcagcaaa

SEQ ID NO: 2640814 - RNA, 22 nt, Human papillomavirus type 16
caaaaacuauuacagugucuac

SEQ ID NO: 2640815 - RNA, 16 nt, Human papillomavirus type 16
guucucagaaaccaua

SEQ ID NO: 2640816 - RNA, 17 nt, Human papillomavirus type 16
accaaguggugccaaca

SEQ ID NO: 2640817 - RNA, 16 nt, Human papillomavirus type 16
ugugugccccaucugu

SEQ ID NO: 2640818 - RNA, 18 nt, Human papillomavirus type 16
agaaaccauaaucuacca

SEQ ID NO: 2640819 - RNA, 18 nt, Human papillomavirus type 16
gagguaggucguggucag

SEQ ID NO: 2640820 - RNA, 16 nt, Human papillomavirus type 16
uguuguauaccauaac

SEQ ID NO: 2640821 - RNA, 11 nt, Human papillomavirus type 16
aauaaacuguu

SEQ ID NO: 2640822 - RNA, 19 nt, Human papillomavirus type 16
aauguaaaacauaaaagug

SEQ ID NO: 2640823 - RNA, 14 nt, Human papillomavirus type 16
ugugucuacauaca

SEQ ID NO: 2640824 - RNA, 16 nt, Human papillomavirus type 16
gagaugcaguacaggu

SEQ ID NO: 2640825 - RNA, 14 nt, Human papillomavirus type 16
uauuuguuuauaua

SEQ ID NO: 2640826 - RNA, 14 nt, Human papillomavirus type 16
auauaauuguugua

SEQ ID NO: 2640827 - RNA, 17 nt, Human papillomavirus type 16
auguauaaaaaaacaug

SEQ ID NO: 2640828 - RNA, 19 nt, Human papillomavirus type 16
aaccuaacaauaacaaaau

SEQ ID NO: 2640829 - RNA, 19 nt, Human papillomavirus type 16
ugugugccccaucuguucu

SEQ ID NO: 2640830 - RNA, 16 nt, Human papillomavirus type 16
uagguguuuuauugua

SEQ ID NO: 2640831 - RNA, 16 nt, Human papillomavirus type 16
uauuacuauuguggau

SEQ ID NO: 2640832 - RNA, 14 nt, Human papillomavirus type 16
cuacuaauuguguu

SEQ ID NO: 2640833 - RNA, 22 nt, Human papillomavirus type 16
cuauaugacaaaucuugauacu

SEQ ID NO: 2640834 - RNA, 14 nt, Human papillomavirus type 16
ggcugauccugcag

SEQ ID NO: 2640835 - RNA, 20 nt, Human papillomavirus type 16
uaauguaauuguuacauaua

SEQ ID NO: 2640836 - RNA, 15 nt, Human papillomavirus type 16
gaaacagagacagca

SEQ ID NO: 2640837 - RNA, 23 nt, Human papillomavirus type 16
caggauguauaaaaaaacaugga

SEQ ID NO: 2640838 - RNA, 18 nt, Human papillomavirus type 16
guccacuuagugauauua

SEQ ID NO: 2640839 - RNA, 14 nt, Human papillomavirus type 16
acuauauuugcuac

SEQ ID NO: 2640840 - RNA, 18 nt, Human papillomavirus type 16
uguaguggaaaaaaaaac

SEQ ID NO: 2640841 - RNA, 21 nt, Human papillomavirus type 16
auuguuacacuuacauaugau

SEQ ID NO: 2640842 - RNA, 20 nt, Human papillomavirus type 16
caagcaauugaacugcaacu

SEQ ID NO: 2640843 - RNA, 14 nt, Human papillomavirus type 16
aaacacguguguau

SEQ ID NO: 2640844 - RNA, 19 nt, Human papillomavirus type 16
guugugcguacaaagcaca

SEQ ID NO: 2640845 - RNA, 18 nt, Human papillomavirus type 16
aauacuuuaaaauguuua

SEQ ID NO: 2640846 - RNA, 21 nt, Human papillomavirus type 16
aggugaugcuaauacuuuaaa

SEQ ID NO: 2640847 - RNA, 13 nt, Human papillomavirus type 16
uacauacacauca

SEQ ID NO: 2640848 - RNA, 19 nt, Human papillomavirus type 16
agguucuaaaacgaaagua

SEQ ID NO: 2640849 - RNA, 19 nt, Human papillomavirus type 16
ggaggaugaaauagauggu

SEQ ID NO: 2640850 - RNA, 15 nt, Human papillomavirus type 16
uaugugcuuguaaau

SEQ ID NO: 2640851 - RNA, 19 nt, Human papillomavirus type 16
aacauggauauacagugga

SEQ ID NO: 2640852 - RNA, 19 nt, Human papillomavirus type 16
cuaauacuuuaaaauguuu

SEQ ID NO: 2640853 - RNA, 13 nt, Human papillomavirus type 16
cucagaggaggag

SEQ ID NO: 2640854 - RNA, 19 nt, Human papillomavirus type 16
aaaugggauuuaaacauau

SEQ ID NO: 2640855 - RNA, 19 nt, Human papillomavirus type 16
auguauaaaaaaacaugga

SEQ ID NO: 2640856 - RNA, 16 nt, Human papillomavirus type 16
acaagcaauugaacug

SEQ ID NO: 2640857 - RNA, 14 nt, Human papillomavirus type 16
cuauuacagugucu

SEQ ID NO: 2640858 - RNA, 17 nt, Human papillomavirus type 16
auuuuuaauacauacac

SEQ ID NO: 2640859 - RNA, 11 nt, Human papillomavirus type 16
uugaacugcaa

SEQ ID NO: 2640860 - RNA, 12 nt, Human papillomavirus type 16
ugguccagcugg

SEQ ID NO: 2640861 - RNA, 16 nt, Human papillomavirus type 16
cauuguauacugcagu

SEQ ID NO: 2640862 - RNA, 19 nt, Human papillomavirus type 16
aguaaugaaaaguggacau

SEQ ID NO: 2640863 - RNA, 14 nt, Human papillomavirus type 16
aaagcauuacaagc

SEQ ID NO: 2640864 - RNA, 19 nt, Human papillomavirus type 16
uaucaggauuacaauacag

SEQ ID NO: 2640865 - RNA, 23 nt, Human papillomavirus type 16
guuauucauuguauauaaacuau

SEQ ID NO: 2640866 - RNA, 19 nt, Human papillomavirus type 16
uuacauaauguauauguac

SEQ ID NO: 2640867 - RNA, 14 nt, Human papillomavirus type 16
auugaacugcaacu

SEQ ID NO: 2640868 - RNA, 17 nt, Human papillomavirus type 16
ucugugucuacauacac

SEQ ID NO: 2640869 - RNA, 21 nt, Human papillomavirus type 16
uauauguuuguaugugcuugu

SEQ ID NO: 2640870 - RNA, 14 nt, Human papillomavirus type 16
acauuauaccuaag

SEQ ID NO: 2640871 - RNA, 13 nt, Human papillomavirus type 16
gcuuaugcagcaa

SEQ ID NO: 2640872 - RNA, 14 nt, Human papillomavirus type 16
ucagaugacgagaa

SEQ ID NO: 2640873 - RNA, 23 nt, Human papillomavirus type 16
ugaccauauagacuauuggaaac

SEQ ID NO: 2640874 - RNA, 22 nt, Human papillomavirus type 16
accucauuuuauaauccagaua

SEQ ID NO: 2640875 - RNA, 11 nt, Human papillomavirus type 16
ugcuuuugugu

SEQ ID NO: 2640876 - RNA, 23 nt, Human papillomavirus type 16
ccuugaaguguauuuaacugcac

SEQ ID NO: 2640877 - RNA, 21 nt, Human papillomavirus type 16
caaaaacuauuacagugucua

SEQ ID NO: 2640878 - RNA, 12 nt, Human papillomavirus type 16
guugaaggcaaa

SEQ ID NO: 2640879 - RNA, 15 nt, Human papillomavirus type 16
aacaggauguauaaa

SEQ ID NO: 2640880 - RNA, 17 nt, Human papillomavirus type 16
uuauacaaacuggacac

SEQ ID NO: 2640881 - RNA, 13 nt, Human papillomavirus type 16
cagaaacagagac

SEQ ID NO: 2640882 - RNA, 21 nt, Human papillomavirus type 16
uauacaaacuggacacauaua

SEQ ID NO: 2640883 - RNA, 20 nt, Human papillomavirus type 16
cauuauuuuuaauacauaca

SEQ ID NO: 2640884 - RNA, 13 nt, Human papillomavirus type 16
ugcuuuugucugu

SEQ ID NO: 2640885 - RNA, 23 nt, Human papillomavirus type 16
auguauaaaaaaacauggauaua

SEQ ID NO: 2640886 - RNA, 17 nt, Human papillomavirus type 16
cauauauauauuuguga

SEQ ID NO: 2640887 - RNA, 15 nt, Human papillomavirus type 16
ggcagaaacagagac

SEQ ID NO: 2640888 - RNA, 16 nt, Human papillomavirus type 16
cagguaccaaugggga

SEQ ID NO: 2640889 - RNA, 19 nt, Human papillomavirus type 16
accuguuaaugggcacacu

SEQ ID NO: 2640890 - RNA, 22 nt, Human papillomavirus type 16
guacauaauguaauuguuacau

SEQ ID NO: 2640891 - RNA, 21 nt, Human papillomavirus type 16
ugcuuuugucugugucuacau

SEQ ID NO: 2640892 - RNA, 18 nt, Human papillomavirus type 16
ugaccaauuuuugucuca

SEQ ID NO: 2640893 - RNA, 18 nt, Human papillomavirus type 16
acaccuacuaauuguguu

SEQ ID NO: 2640894 - RNA, 22 nt, Human papillomavirus type 16
uuuaaaaggugaugcuaauacu

SEQ ID NO: 2640895 - RNA, 23 nt, Human papillomavirus type 16
cguacuuuggaagaccuguuaau

SEQ ID NO: 2640896 - RNA, 15 nt, Human papillomavirus type 16
acauaugauagugaa

SEQ ID NO: 2640897 - RNA, 21 nt, Human papillomavirus type 16
uagauuuuauaguaaaugaua

SEQ ID NO: 2640898 - RNA, 20 nt, Human papillomavirus type 16
ugagcaauuaaaugacagcu

SEQ ID NO: 2640899 - RNA, 14 nt, Human papillomavirus type 16
uuuuuaauuacaua

SEQ ID NO: 2640900 - RNA, 23 nt, Human papillomavirus type 16
uguugugguuauucauuguauau

SEQ ID NO: 2640901 - RNA, 16 nt, Human papillomavirus type 16
auguugcacgcacaaa

SEQ ID NO: 2640902 - RNA, 17 nt, Human papillomavirus type 16
gaacaaauauuacaaua

SEQ ID NO: 2640903 - RNA, 19 nt, Human papillomavirus type 16
uuaguggauguguagacaa

SEQ ID NO: 2640904 - RNA, 20 nt, Human papillomavirus type 16
augucuauaugacaaaucuu

SEQ ID NO: 2640905 - RNA, 13 nt, Human papillomavirus type 16
ggcuguaguggaa

SEQ ID NO: 2640906 - RNA, 16 nt, Human papillomavirus type 16
aaaacaugcaaacagg

SEQ ID NO: 2640907 - RNA, 18 nt, Human papillomavirus type 16
uaccauaacuuacuauuu

SEQ ID NO: 2640908 - RNA, 15 nt, Human papillomavirus type 16
accauggcugauccu

SEQ ID NO: 2640909 - RNA, 19 nt, Human papillomavirus type 16
acauauauauauuugugaa

SEQ ID NO: 2640910 - RNA, 19 nt, Human papillomavirus type 16
uacaguggaagugcaguuu

SEQ ID NO: 2640911 - RNA, 22 nt, Human papillomavirus type 16
aauggcaacgugaccaauuuuu

SEQ ID NO: 2640912 - RNA, 21 nt, Human papillomavirus type 16
cagguaccaauggggaagagg

SEQ ID NO: 2640913 - RNA, 22 nt, Human papillomavirus type 16
aggccucccacagcuacagaua

SEQ ID NO: 2640914 - RNA, 20 nt, Human papillomavirus type 16
gagcugcaaaaaggagauua

SEQ ID NO: 2640915 - RNA, 18 nt, Human papillomavirus type 16
uguacauuguauacugca

SEQ ID NO: 2640916 - RNA, 19 nt, Human papillomavirus type 16
uccacaacauuacuggcgu

SEQ ID NO: 2640917 - RNA, 13 nt, Human papillomavirus type 16
agugauacaggug

SEQ ID NO: 2640918 - RNA, 20 nt, Human papillomavirus type 16
auguauagaaaaacaaagua

SEQ ID NO: 2640919 - RNA, 20 nt, Human papillomavirus type 16
gccucccacagcuacagaua

SEQ ID NO: 2640920 - RNA, 20 nt, Human papillomavirus type 16
ugacaaaucuugauacugca

SEQ ID NO: 2640921 - RNA, 15 nt, Human papillomavirus type 16
auacuuuaaaauguu

SEQ ID NO: 2640922 - RNA, 14 nt, Human papillomavirus type 16
uauuuuuaauacau

SEQ ID NO: 2640923 - RNA, 16 nt, Human papillomavirus type 16
cccaucuguucucaga

SEQ ID NO: 2640924 - RNA, 20 nt, Human papillomavirus type 16
uaauaaacacguguguaugu

SEQ ID NO: 2640925 - RNA, 14 nt, Human papillomavirus type 16
aauacuuuaaaaug

SEQ ID NO: 2640926 - RNA, 14 nt, Human papillomavirus type 16
uacauacacaugca

SEQ ID NO: 2640927 - RNA, 23 nt, Human papillomavirus type 16
uugaaggcaaaacuauugcugaa

SEQ ID NO: 2640928 - RNA, 20 nt, Human papillomavirus type 16
auaauguaauuguuacauau

SEQ ID NO: 2640929 - RNA, 18 nt, Human papillomavirus type 16
ucaggauuacaauacagg

SEQ ID NO: 2640930 - RNA, 18 nt, Human papillomavirus type 16
cugaucucuacuguuaug

SEQ ID NO: 2640931 - RNA, 16 nt, Human papillomavirus type 16
aucuugauacugcauc

SEQ ID NO: 2640932 - RNA, 14 nt, Human papillomavirus type 16
aauacauacacaug

SEQ ID NO: 2640933 - RNA, 15 nt, Human papillomavirus type 16
ugcagcaaaugcagg

SEQ ID NO: 2640934 - RNA, 22 nt, Human papillomavirus type 16
cuugaaguguauuuaacugcac

SEQ ID NO: 2640935 - RNA, 15 nt, Human papillomavirus type 16
agcugcaaaaaggag

SEQ ID NO: 2640936 - RNA, 13 nt, Human papillomavirus type 16
uuguaugugcuug

SEQ ID NO: 2640937 - RNA, 16 nt, Human papillomavirus type 16
gaggguacgggaugua

SEQ ID NO: 2640938 - RNA, 18 nt, Human papillomavirus type 16
cgggauguaauggauggu

SEQ ID NO: 2640939 - RNA, 19 nt, Human papillomavirus type 16
uuaauacauacacaugcac

SEQ ID NO: 2640940 - RNA, 20 nt, Human papillomavirus type 16
ugcuuguaaauauuaaguug

SEQ ID NO: 2640941 - RNA, 13 nt, Human papillomavirus type 16
agaccuguuaaug

SEQ ID NO: 2640942 - RNA, 16 nt, Human papillomavirus type 16
aaacgcacaaaacgug

SEQ ID NO: 2640943 - RNA, 16 nt, Human papillomavirus type 16
uuauaaaacaugcaaa

SEQ ID NO: 2640944 - RNA, 16 nt, Human papillomavirus type 16
gcaggaacauccagac

SEQ ID NO: 2640945 - RNA, 20 nt, Human papillomavirus type 16
uaauaaacuguuauuacuua

SEQ ID NO: 2640946 - RNA, 22 nt, Human papillomavirus type 16
cagguaccaauggggaagaggg

SEQ ID NO: 2640947 - RNA, 20 nt, Human papillomavirus type 16
uauagacuauuggaaacaca

SEQ ID NO: 2640948 - RNA, 14 nt, Human papillomavirus type 16
uacauccuguuuuu

SEQ ID NO: 2640949 - RNA, 14 nt, Human papillomavirus type 16
caauugaacugcaa

SEQ ID NO: 2640950 - RNA, 15 nt, Human papillomavirus type 16
gcacaaaauguguuu

SEQ ID NO: 2640951 - RNA, 21 nt, Human papillomavirus type 16
uaaguuguauguguguuugua

SEQ ID NO: 2640952 - RNA, 23 nt, Human papillomavirus type 16
ccuaagguugaaggcaaaacuau

SEQ ID NO: 2640953 - RNA, 20 nt, Human papillomavirus type 16
cagguaccaauggggaagag

SEQ ID NO: 2640954 - RNA, 16 nt, Human papillomavirus type 16
aaaacauggauauaca

SEQ ID NO: 2640955 - RNA, 22 nt, Human papillomavirus type 16
caccaaguggugccaacacugg

SEQ ID NO: 2640956 - RNA, 17 nt, Human papillomavirus type 16
aaugacagugauacagg

SEQ ID NO: 2640957 - RNA, 20 nt, Human papillomavirus type 16
auuacuuaacaaugcgacac

SEQ ID NO: 2640958 - RNA, 21 nt, Human papillomavirus type 16
gaccauauagacuauuggaaa

SEQ ID NO: 2640959 - RNA, 18 nt, Human papillomavirus type 16
ccauccuuuauuaaauaa

SEQ ID NO: 2640960 - RNA, 23 nt, Human papillomavirus type 16
uuauacaaacuggacacauauau

SEQ ID NO: 2640961 - RNA, 18 nt, Human papillomavirus type 16
auggagacauaugcaaua

SEQ ID NO: 2640962 - RNA, 20 nt, Human papillomavirus type 16
aaacuauugcugaacaaaua

SEQ ID NO: 2640963 - RNA, 18 nt, Human papillomavirus type 16
gaacagggucggguacag

SEQ ID NO: 2640964 - RNA, 17 nt, Human papillomavirus type 16
aacuauugcugaacaaa

SEQ ID NO: 2640965 - RNA, 15 nt, Human papillomavirus type 16
ccuguuuuuguuuua

SEQ ID NO: 2640966 - RNA, 21 nt, Human papillomavirus type 16
uaaacacguguguauguguuu

SEQ ID NO: 2640967 - RNA, 17 nt, Human papillomavirus type 16
aaaacgcacaaaacgug

SEQ ID NO: 2640968 - RNA, 15 nt, Human papillomavirus type 16
aaacguucugcaaaa

SEQ ID NO: 2640969 - RNA, 20 nt, Human papillomavirus type 16
aucccuauuuuccuauuaaa

SEQ ID NO: 2640970 - RNA, 15 nt, Human papillomavirus type 16
uguauuuaacugcac

SEQ ID NO: 2640971 - RNA, 18 nt, Human papillomavirus type 16
acgugaccaauuuuuguc

SEQ ID NO: 2640972 - RNA, 21 nt, Human papillomavirus type 16
cuggcuguaucaaagaauaaa

SEQ ID NO: 2640973 - RNA, 21 nt, Human papillomavirus type 16
ccauauagacuauuggaaaca

SEQ ID NO: 2640974 - RNA, 20 nt, Human papillomavirus type 16
uguacauuguauacugcagu

SEQ ID NO: 2640975 - RNA, 16 nt, Human papillomavirus type 16
auuuuccuauuaaaaa

SEQ ID NO: 2640976 - RNA, 13 nt, Human papillomavirus type 16
auguuuguaugug

SEQ ID NO: 2640977 - RNA, 17 nt, Human papillomavirus type 16
acaggugaagauuuggu

SEQ ID NO: 2640978 - RNA, 22 nt, Human papillomavirus type 16
aagcacggaugaauauguugca

SEQ ID NO: 2640979 - RNA, 13 nt, Human papillomavirus type 16
uaauuguuacaua

SEQ ID NO: 2640980 - RNA, 13 nt, Human papillomavirus type 16
uaaacuauauuug

SEQ ID NO: 2640981 - RNA, 17 nt, Human papillomavirus type 16
ugugccccaucuguucu

SEQ ID NO: 2640982 - RNA, 21 nt, Human papillomavirus type 16
uacuuuggaagaccuguuaau

SEQ ID NO: 2640983 - RNA, 16 nt, Human papillomavirus type 16
guaauggaugguuuua

SEQ ID NO: 2640984 - RNA, 18 nt, Human papillomavirus type 16
auuugaaagcgaagacag

SEQ ID NO: 2640985 - RNA, 16 nt, Human papillomavirus type 16
ccugaccccaauaagu

SEQ ID NO: 2640986 - RNA, 19 nt, Human papillomavirus type 16
uuguauacugcagugucgu

SEQ ID NO: 2640987 - RNA, 11 nt, Human papillomavirus type 16
ucaugcaggaa

SEQ ID NO: 2640988 - RNA, 22 nt, Human papillomavirus type 16
cugcaccaacaggauguauaaa

SEQ ID NO: 2640989 - RNA, 17 nt, Human papillomavirus type 16
caauuguuacacuuaca

SEQ ID NO: 2640990 - RNA, 11 nt, Human papillomavirus type 16
acauccagacu

SEQ ID NO: 2640991 - RNA, 15 nt, Human papillomavirus type 16
acacagaaaaugcua

SEQ ID NO: 2640992 - RNA, 23 nt, Human papillomavirus type 16
aagcaaaacaacauagagaugca

SEQ ID NO: 2640993 - RNA, 20 nt, Human papillomavirus type 16
aaugcauuauacaaacugga

SEQ ID NO: 2640994 - RNA, 21 nt, Human papillomavirus type 16
auguaauuguuacauauaauu

SEQ ID NO: 2640995 - RNA, 18 nt, Human papillomavirus type 16
uccacaacauuacuggcg

SEQ ID NO: 2640996 - RNA, 11 nt, Human papillomavirus type 16
aauaaagcauu

SEQ ID NO: 2640997 - RNA, 16 nt, Human papillomavirus type 16
cuauuacagugucuac

SEQ ID NO: 2640998 - RNA, 17 nt, Human papillomavirus type 16
gugucgucuacauggca

SEQ ID NO: 2640999 - RNA, 20 nt, Human papillomavirus type 16
uaugucuauaugacaaaucu

SEQ ID NO: 2641000 - RNA, 14 nt, Human papillomavirus type 16
aguguauuuaacug

SEQ ID NO: 2641001 - RNA, 23 nt, Human papillomavirus type 16
cacaugcguuguuuacugcacag

SEQ ID NO: 2641002 - RNA, 17 nt, Human papillomavirus type 16
augucuauaugacaaau

SEQ ID NO: 2641003 - RNA, 24 nt, Human papillomavirus type 16
uuggaugacacagaaaaugcuagu

SEQ ID NO: 2641004 - RNA, 13 nt, Human papillomavirus type 16
acuguuauuacuu

SEQ ID NO: 2641005 - RNA, 12 nt, Human papillomavirus type 16
aaguuguaugug

SEQ ID NO: 2641006 - RNA, 14 nt, Human papillomavirus type 16
uauacuauauuuug

SEQ ID NO: 2641007 - RNA, 12 nt, Human papillomavirus type 16
aaaaaaaacagg

SEQ ID NO: 2641008 - RNA, 23 nt, Human papillomavirus type 16
aaaauguuuaagauauagauuua

SEQ ID NO: 2641009 - RNA, 13 nt, Human papillomavirus type 16
gaaccggacagag

SEQ ID NO: 2641010 - RNA, 16 nt, Human papillomavirus type 16
auuuaaacauauuaac

SEQ ID NO: 2641011 - RNA, 17 nt, Human papillomavirus type 16
uaaaaagcauuguacau

SEQ ID NO: 2641012 - RNA, 19 nt, Human papillomavirus type 16
aaaugcuuguguaacuauu

SEQ ID NO: 2641013 - RNA, 13 nt, Human papillomavirus type 16
uauuacagugucu

SEQ ID NO: 2641014 - RNA, 21 nt, Human papillomavirus type 16
auaaugauuauuuaacacagg

SEQ ID NO: 2641015 - RNA, 22 nt, Human papillomavirus type 16
cuuuugucugugucuacauaca

SEQ ID NO: 2641016 - RNA, 14 nt, Human papillomavirus type 16
gcuggacaagcaga

SEQ ID NO: 2641017 - RNA, 15 nt, Human papillomavirus type 16
cagaaacagagacag

SEQ ID NO: 2641018 - RNA, 20 nt, Human papillomavirus type 16
cauguccaccugacauuaua

SEQ ID NO: 2641019 - RNA, 19 nt, Human papillomavirus type 16
caaaaacuauuacaguguc

SEQ ID NO: 2641020 - RNA, 23 nt, Human papillomavirus type 16
caauaaguuugguuuuccugaca

SEQ ID NO: 2641021 - RNA, 13 nt, Human papillomavirus type 16
aaacaugcaaaca

SEQ ID NO: 2641022 - RNA, 13 nt, Human papillomavirus type 16
acaacauuacugg

SEQ ID NO: 2641023 - RNA, 14 nt, Human papillomavirus type 16
uagauuaaaagcua

SEQ ID NO: 2641024 - RNA, 22 nt, Human papillomavirus type 16
agacauaugcaauacaaugcau

SEQ ID NO: 2641025 - RNA, 20 nt, Human papillomavirus type 16
auuugcaaccagagacaacu

SEQ ID NO: 2641026 - RNA, 11 nt, Human papillomavirus type 16
acauacacaug

SEQ ID NO: 2641027 - RNA, 22 nt, Human papillomavirus type 16
gcacaugcguuguuuacugcac

SEQ ID NO: 2641028 - RNA, 14 nt, Human papillomavirus type 16
auuccauugggaac

SEQ ID NO: 2641029 - RNA, 15 nt, Human papillomavirus type 16
cagcucagaggagga

SEQ ID NO: 2641030 - RNA, 22 nt, Human papillomavirus type 16
acauuacuggcgugcuuuuugc

SEQ ID NO: 2641031 - RNA, 20 nt, Human papillomavirus type 16
ugguaguccacuuagugaua

SEQ ID NO: 2641032 - RNA, 19 nt, Human papillomavirus type 16
aauuguuacacuuacauau

SEQ ID NO: 2641033 - RNA, 18 nt, Human papillomavirus type 16
agacauaugcaauacaau

SEQ ID NO: 2641034 - RNA, 15 nt, Human papillomavirus type 16
caaaacaacauagag

SEQ ID NO: 2641035 - RNA, 20 nt, Human papillomavirus type 16
ccucauuuuauaauccagau

SEQ ID NO: 2641036 - RNA, 14 nt, Human papillomavirus type 16
uuuugucugugucu

SEQ ID NO: 2641037 - RNA, 19 nt, Human papillomavirus type 16
uguaacuauugugucaugc

SEQ ID NO: 2641038 - RNA, 16 nt, Human papillomavirus type 16
caggcagaaacagaga

SEQ ID NO: 2641039 - RNA, 16 nt, Human papillomavirus type 16
cuaugguuuaaacuug

SEQ ID NO: 2641040 - RNA, 22 nt, Human papillomavirus type 16
cuuuuguugcaagugugacucu

SEQ ID NO: 2641041 - RNA, 18 nt, Human papillomavirus type 16
auuauacaaacuggacac

SEQ ID NO: 2641042 - RNA, 17 nt, Human papillomavirus type 16
acuuuaaaauguuuaag

SEQ ID NO: 2641043 - RNA, 15 nt, Human papillomavirus type 16
gauggagacauaugc

SEQ ID NO: 2641044 - RNA, 17 nt, Human papillomavirus type 16
auaaauaaacuuauugu

SEQ ID NO: 2641045 - RNA, 12 nt, Human papillomavirus type 16
aaauaaacuuau

SEQ ID NO: 2641046 - RNA, 19 nt, Human papillomavirus type 16
uuacaagcaauugaacugc

SEQ ID NO: 2641047 - RNA, 12 nt, Human papillomavirus type 16
uuaaaauguuua

SEQ ID NO: 2641048 - RNA, 20 nt, Human papillomavirus type 16
acgcuuuuuaauuacauaau

SEQ ID NO: 2641049 - RNA, 18 nt, Human papillomavirus type 16
cauagagaugcaguacag

SEQ ID NO: 2641050 - RNA, 19 nt, Human papillomavirus type 16
uaaaagugcaauuguuaca

SEQ ID NO: 2641051 - RNA, 22 nt, Human papillomavirus type 16
caggauguauaaaaaaacaugg

SEQ ID NO: 2641052 - RNA, 15 nt, Human papillomavirus type 16
uaugcagcaaaugca

SEQ ID NO: 2641053 - RNA, 15 nt, Human papillomavirus type 16
uauacugcagugucg

SEQ ID NO: 2641054 - RNA, 13 nt, Human papillomavirus type 16
cagcucagaggag

SEQ ID NO: 2641055 - RNA, 15 nt, Human papillomavirus type 16
uaauuguuacauaua

SEQ ID NO: 2641056 - RNA, 17 nt, Human papillomavirus type 16
auuacaagcaauugaac

SEQ ID NO: 2641057 - RNA, 16 nt, Human papillomavirus type 16
aaaucuugauacugca

SEQ ID NO: 2641058 - RNA, 22 nt, Human papillomavirus type 16
ggccagagaaaugggauuuaaa

SEQ ID NO: 2641059 - RNA, 21 nt, Human papillomavirus type 16
uuacuauuguggauaacagca

SEQ ID NO: 2641060 - RNA, 17 nt, Human papillomavirus type 16
aguguauuuaacugcac

SEQ ID NO: 2641061 - RNA, 14 nt, Human papillomavirus type 16
uauuacuauugugg

SEQ ID NO: 2641062 - RNA, 14 nt, Human papillomavirus type 16
auauuaaguuguau

SEQ ID NO: 2641063 - RNA, 15 nt, Human papillomavirus type 16
caucaguaacugugg

SEQ ID NO: 2641064 - RNA, 13 nt, Human papillomavirus type 16
acagcuacagaua

SEQ ID NO: 2641065 - RNA, 16 nt, Human papillomavirus type 16
aacucacaauauagua

SEQ ID NO: 2641066 - RNA, 12 nt, Human papillomavirus type 16
aacauccagacu

SEQ ID NO: 2641067 - RNA, 22 nt, Human papillomavirus type 16
uaaaugcuuguguaacuauugu

SEQ ID NO: 2641068 - RNA, 21 nt, Human papillomavirus type 16
ugcugaacaaauauuacaaua

SEQ ID NO: 2641069 - RNA, 23 nt, Human papillomavirus type 16
auauaauuguuguauaccauaac

SEQ ID NO: 2641070 - RNA, 21 nt, Human papillomavirus type 16
gacauucguacuuuggaagac

SEQ ID NO: 2641071 - RNA, 14 nt, Human papillomavirus type 16
auuuuugucucaag

SEQ ID NO: 2641072 - RNA, 16 nt, Human papillomavirus type 16
gauccugcagguacca

SEQ ID NO: 2641073 - RNA, 19 nt, Human papillomavirus type 16
gcaaacaggcagguacaug

SEQ ID NO: 2641074 - RNA, 17 nt, Human papillomavirus type 16
auuggacaggacauaau

SEQ ID NO: 2641075 - RNA, 21 nt, Human papillomavirus type 16
acauaugcaauacaaugcauu

SEQ ID NO: 2641076 - RNA, 22 nt, Human papillomavirus type 16
uugucucaaguuaaaauaccaa

SEQ ID NO: 2641077 - RNA, 23 nt, Human papillomavirus type 16
gaugacgagaacgaaaaugacag

SEQ ID NO: 2641078 - RNA, 15 nt, Human papillomavirus type 16
caauggggaagaggg

SEQ ID NO: 2641079 - RNA, 13 nt, Human papillomavirus type 16
agaaacaauauau

SEQ ID NO: 2641080 - RNA, 18 nt, Human papillomavirus type 16
gcaaaacaacauagagau

SEQ ID NO: 2641081 - RNA, 16 nt, Human papillomavirus type 16
cauccacaacauuacu

SEQ ID NO: 2641082 - RNA, 17 nt, Human papillomavirus type 16
uaaaagugcaauuguua

SEQ ID NO: 2641083 - RNA, 15 nt, Human papillomavirus type 16
aucaguaacuguggu

SEQ ID NO: 2641084 - RNA, 14 nt, Human papillomavirus type 16
cauuauacaaacug

SEQ ID NO: 2641085 - RNA, 18 nt, Human papillomavirus type 16
ugacacagaaaaugcuag

SEQ ID NO: 2641086 - RNA, 20 nt, Human papillomavirus type 16
aguggccauccuuuauuaaa

SEQ ID NO: 2641087 - RNA, 20 nt, Human papillomavirus type 16
auguauaaaaaaacauggau

SEQ ID NO: 2641088 - RNA, 22 nt, Human papillomavirus type 16
cuauugcugaacaaauauuaca

SEQ ID NO: 2641089 - RNA, 22 nt, Human papillomavirus type 16
auuugugaagaagcaucaguaa

SEQ ID NO: 2641090 - RNA, 18 nt, Human papillomavirus type 16
gugggcauuaguggccau

SEQ ID NO: 2641091 - RNA, 22 nt, Human papillomavirus type 16
ggaagcaaaacaacauagagau

SEQ ID NO: 2641092 - RNA, 12 nt, Human papillomavirus type 16
aaauaguucuau

SEQ ID NO: 2641093 - RNA, 21 nt, Human papillomavirus type 16
cugcagguaccaauggggaag

SEQ ID NO: 2641094 - RNA, 16 nt, Human papillomavirus type 16
agcaauugaacugcaa

SEQ ID NO: 2641095 - RNA, 17 nt, Human papillomavirus type 16
ucagaggaggaggauga

SEQ ID NO: 2641096 - RNA, 17 nt, Human papillomavirus type 16
cauuacuggcgugcuuu

SEQ ID NO: 2641097 - RNA, 24 nt, Human papillomavirus type 16
gaagcaaaacaacauagagaugca

SEQ ID NO: 2641098 - RNA, 23 nt, Human papillomavirus type 16
auuuaacacaggcagaaacagag

SEQ ID NO: 2641099 - RNA, 19 nt, Human papillomavirus type 16
guuaaugggcacacuagga

SEQ ID NO: 2641100 - RNA, 17 nt, Human papillomavirus type 16
guuacacuuacauauga

SEQ ID NO: 2641101 - RNA, 23 nt, Human papillomavirus type 16
agcagaaccggacagagcccauu

SEQ ID NO: 2641102 - RNA, 13 nt, Human papillomavirus type 16
auauaaacuauau

SEQ ID NO: 2641103 - RNA, 22 nt, Human papillomavirus type 16
gcuuaugcagcaaaugcaggug

SEQ ID NO: 2641104 - RNA, 13 nt, Human papillomavirus type 16
uugaaguguauuu

SEQ ID NO: 2641105 - RNA, 23 nt, Human papillomavirus type 16
uuguuacauauaauuguuguaua

SEQ ID NO: 2641106 - RNA, 14 nt, Human papillomavirus type 16
uauguagaggcugu

SEQ ID NO: 2641107 - RNA, 20 nt, Human papillomavirus type 16
aaagcacacacguagacauu

SEQ ID NO: 2641108 - RNA, 14 nt, Human papillomavirus type 16
gacagugauacagg

SEQ ID NO: 2641109 - RNA, 23 nt, Human papillomavirus type 16
cacaauauaguaaugaaaagugg

SEQ ID NO: 2641110 - RNA, 18 nt, Human papillomavirus type 16
acacguguguauguguuu

SEQ ID NO: 2641111 - RNA, 13 nt, Human papillomavirus type 16
uauauguuuguau

SEQ ID NO: 2641112 - RNA, 15 nt, Human papillomavirus type 16
ccagcuggacaagca

SEQ ID NO: 2641113 - RNA, 16 nt, Human papillomavirus type 16
auaaacacguguguau

SEQ ID NO: 2641114 - RNA, 22 nt, Human papillomavirus type 16
uagauuaaaagcuauauguaua

SEQ ID NO: 2641115 - RNA, 12 nt, Human papillomavirus type 16
uaauuacauaau

SEQ ID NO: 2641116 - RNA, 19 nt, Human papillomavirus type 16
cucauuuuauaauccagau

SEQ ID NO: 2641117 - RNA, 15 nt, Human papillomavirus type 16
gacagugauacaggu

SEQ ID NO: 2641118 - RNA, 17 nt, Human papillomavirus type 16
cuauaugacaaaucuug

SEQ ID NO: 2641119 - RNA, 22 nt, Human papillomavirus type 16
auguuagauuugcaaccagaga

SEQ ID NO: 2641120 - RNA, 10 nt, Human papillomavirus type 16
cugugucuac

SEQ ID NO: 2641121 - RNA, 14 nt, Human papillomavirus type 16
cacguguguaugug

SEQ ID NO: 2641122 - RNA, 17 nt, Human papillomavirus type 16
acugcauccacaacauu

SEQ ID NO: 2641123 - RNA, 12 nt, Human papillomavirus type 16
agcaucaguaac

SEQ ID NO: 2641124 - RNA, 18 nt, Human papillomavirus type 16
cuuugcuuugugugcuuu

SEQ ID NO: 2641125 - RNA, 22 nt, Human papillomavirus type 16
auguuuaagauauagauuuaaa

SEQ ID NO: 2641126 - RNA, 13 nt, Human papillomavirus type 16
uuuauuguauaua

SEQ ID NO: 2641127 - RNA, 18 nt, Human papillomavirus type 16
aacucacaauauaguaau

SEQ ID NO: 2641128 - RNA, 15 nt, Human papillomavirus type 16
gaugaaauagauggu

SEQ ID NO: 2641129 - RNA, 13 nt, Human papillomavirus type 16
uggaagugcaguu

SEQ ID NO: 2641130 - RNA, 16 nt, Human papillomavirus type 16
acuaugguuuaaacuu

SEQ ID NO: 2641131 - RNA, 13 nt, Human papillomavirus type 16
auaauuguuguau

SEQ ID NO: 2641132 - RNA, 21 nt, Human papillomavirus type 16
ugugguuauucauuguauaua

SEQ ID NO: 2641133 - RNA, 14 nt, Human papillomavirus type 16
uacuuuaaaauguu

SEQ ID NO: 2641134 - RNA, 21 nt, Human papillomavirus type 16
ugaagaagcaucaguaacugu

SEQ ID NO: 2641135 - RNA, 19 nt, Human papillomavirus type 16
uuguuacauauaauuguug

SEQ ID NO: 2641136 - RNA, 18 nt, Human papillomavirus type 16
ugucuacauacacaucau

SEQ ID NO: 2641137 - RNA, 17 nt, Human papillomavirus type 16
ccauauagacuauugga

SEQ ID NO: 2641138 - RNA, 16 nt, Human papillomavirus type 16
gucggguacaggcgga

SEQ ID NO: 2641139 - RNA, 15 nt, Human papillomavirus type 16
auuauauuuguuuau

SEQ ID NO: 2641140 - RNA, 16 nt, Human papillomavirus type 16
caguuugauggagaca

SEQ ID NO: 2641141 - RNA, 13 nt, Human papillomavirus type 16
uuuguuguguaua

SEQ ID NO: 2641142 - RNA, 13 nt, Human papillomavirus type 16
gaagaggguacgg

SEQ ID NO: 2641143 - RNA, 16 nt, Human papillomavirus type 16
caggaacauccagacu

SEQ ID NO: 2641144 - RNA, 20 nt, Human papillomavirus type 16
uuauuugaaagcgaagacag

SEQ ID NO: 2641145 - RNA, 21 nt, Human papillomavirus type 16
uaugucuauaugacaaaucuu

SEQ ID NO: 2641146 - RNA, 13 nt, Human papillomavirus type 16
acaaaauguguuu

SEQ ID NO: 2641147 - RNA, 15 nt, Human papillomavirus type 16
cagaaccggacagag

SEQ ID NO: 2641148 - RNA, 13 nt, Human papillomavirus type 16
cuacauacacauc

SEQ ID NO: 2641149 - RNA, 21 nt, Human papillomavirus type 16
aauaaacuguuauuacuuaac

SEQ ID NO: 2641150 - RNA, 13 nt, Human papillomavirus type 16
caccuacauugca

SEQ ID NO: 2641151 - RNA, 21 nt, Human papillomavirus type 16
guuucaacaccuacuaauugu

SEQ ID NO: 2641152 - RNA, 21 nt, Human papillomavirus type 16
aacugcaacuaacguuagaaa

SEQ ID NO: 2641153 - RNA, 13 nt, Human papillomavirus type 16
acugcagugucgu

SEQ ID NO: 2641154 - RNA, 15 nt, Human papillomavirus type 16
auggagacauaugca

SEQ ID NO: 2641155 - RNA, 12 nt, Human papillomavirus type 16
uuuauuaaauaa

SEQ ID NO: 2641156 - RNA, 23 nt, Human papillomavirus type 16
gaauauguugcacgcacaaacau

SEQ ID NO: 2641157 - RNA, 19 nt, Human papillomavirus type 16
uggagacauaugcaauaca

SEQ ID NO: 2641158 - RNA, 16 nt, Human papillomavirus type 16
uaaaaagcauuguaca

SEQ ID NO: 2641159 - RNA, 17 nt, Human papillomavirus type 16
aaacauggauauacagu

SEQ ID NO: 2641160 - RNA, 20 nt, Human papillomavirus type 16
agcuucaaccgaauucgguu

SEQ ID NO: 2641161 - RNA, 13 nt, Human papillomavirus type 16
auuuaccugaccc

SEQ ID NO: 2641162 - RNA, 17 nt, Human papillomavirus type 16
caugcaaacaggcaggu

SEQ ID NO: 2641163 - RNA, 15 nt, Human papillomavirus type 16
caaguggugccaaca

SEQ ID NO: 2641164 - RNA, 19 nt, Human papillomavirus type 16
aacauccagacuacuugca

SEQ ID NO: 2641165 - RNA, 15 nt, Human papillomavirus type 16
acgaaaguauuuggu

SEQ ID NO: 2641166 - RNA, 15 nt, Human papillomavirus type 16
uagaaugugcuauuu

SEQ ID NO: 2641167 - RNA, 16 nt, Human papillomavirus type 16
gaugguccagcuggac

SEQ ID NO: 2641168 - RNA, 20 nt, Human papillomavirus type 16
uuggcacaaaauguguuuuu

SEQ ID NO: 2641169 - RNA, 20 nt, Human papillomavirus type 16
caguuugauggagacauaug

SEQ ID NO: 2641170 - RNA, 19 nt, Human papillomavirus type 16
uguauguugaauuaguguu

SEQ ID NO: 2641171 - RNA, 17 nt, Human papillomavirus type 16
aacauggauauacagug

SEQ ID NO: 2641172 - RNA, 14 nt, Human papillomavirus type 16
caugaauauauguu

SEQ ID NO: 2641173 - RNA, 22 nt, Human papillomavirus type 16
caaugcauuauacaaacuggac

SEQ ID NO: 2641174 - RNA, 13 nt, Human papillomavirus type 16
uuuaaaugcuugu

SEQ ID NO: 2641175 - RNA, 22 nt, Human papillomavirus type 16
uuguaaauauuaaguuguaugu

SEQ ID NO: 2641176 - RNA, 21 nt, Human papillomavirus type 16
ccaaguggugccaacacuggc

SEQ ID NO: 2641177 - RNA, 18 nt, Human papillomavirus type 16
gaaaaacaaaguagagcu

SEQ ID NO: 2641178 - RNA, 23 nt, Human papillomavirus type 16
auauauaacucacaauauaguaa

SEQ ID NO: 2641179 - RNA, 16 nt, Human papillomavirus type 16
gcuuuugugugucugc

SEQ ID NO: 2641180 - RNA, 14 nt, Human papillomavirus type 16
auuuaaaaagcauu

SEQ ID NO: 2641181 - RNA, 16 nt, Human papillomavirus type 16
uaacuauugugucaug

SEQ ID NO: 2641182 - RNA, 14 nt, Human papillomavirus type 16
uuaauuacauaaug

SEQ ID NO: 2641183 - RNA, 18 nt, Human papillomavirus type 16
uuguacguuuccugcuug

SEQ ID NO: 2641184 - RNA, 21 nt, Human papillomavirus type 16
aguggaaaaaaaaacagggga

SEQ ID NO: 2641185 - RNA, 19 nt, Human papillomavirus type 16
acccaacuuuauaaaacau

SEQ ID NO: 2641186 - RNA, 22 nt, Human papillomavirus type 16
aaugugcuauuuauuacaaggc

SEQ ID NO: 2641187 - RNA, 15 nt, Human papillomavirus type 16
uugguauuacuauug

SEQ ID NO: 2641188 - RNA, 14 nt, Human papillomavirus type 16
uuuuuauuuucaua

SEQ ID NO: 2641189 - RNA, 17 nt, Human papillomavirus type 16
auaaacacguguguaug

SEQ ID NO: 2641190 - RNA, 17 nt, Human papillomavirus type 16
cugaucucuacuguuau

SEQ ID NO: 2641191 - RNA, 19 nt, Human
ggauuuaaaagccugcuca

SEQ ID NO: 2641192 - RNA, 16 nt, Human
ggauuuaaaagccugc

SEQ ID NO: 2641193 - RNA, 17 nt, Human
ggauuuaaaagccugcu

SEQ ID NO: 2641194 - RNA, 18 nt, Human
ggauuuaaaagccugcuc

SEQ ID NO: 2641195 - RNA, 12 nt, Human
aaaaaaagauga

SEQ ID NO: 2641196 - RNA, 18 nt, Human
aaaaaaacaguggaucac

SEQ ID NO: 2641197 - RNA, 15 nt, Human
ggccugcccaguugc

SEQ ID NO: 2641198 - RNA, 21 nt, Human
ggccuguugcuauagagccua

SEQ ID NO: 2641199 - RNA, 24 nt, Human
ggccuguugcuauagagccuaccu

SEQ ID NO: 2641200 - RNA, 15 nt, Human
ggccuuagggcacug

SEQ ID NO: 2641201 - RNA, 20 nt, Human
ggccuuagggcacugggcug

SEQ ID NO: 2641202 - RNA, 12 nt, Human
ggcuaauuuaac

SEQ ID NO: 2641203 - RNA, 13 nt, Human
ggcuaauuuaaca

SEQ ID NO: 2641204 - RNA, 15 nt, Human
gguagguugggacac

SEQ ID NO: 2641205 - RNA, 17 nt, Human
gguagguugggacacca

SEQ ID NO: 2641206 - RNA, 19 nt, Human
aaacuguuggaauggauuu

SEQ ID NO: 2641207 - RNA, 19 nt, Human
gggucaagaaacagccagc

SEQ ID NO: 2641208 - RNA, 14 nt, Human
aaagcugauuuuuu

SEQ ID NO: 2641209 - RNA, 20 nt, Human
aaagguuuaagaaauagaau

SEQ ID NO: 2641210 - RNA, 18 nt, Human
gcuguuguuccauugaag

SEQ ID NO: 2641211 - RNA, 13 nt, Human
ggaaaucuuaaac

SEQ ID NO: 2641212 - RNA, 22 nt, Human
gcuaguuauacuuauuuguaua

SEQ ID NO: 2641213 - RNA, 12 nt, Human
gaucaaagauga

SEQ ID NO: 2641214 - RNA, 15 nt, Human
gaucaaagaugaaaa

SEQ ID NO: 2641215 - RNA, 18 nt, Human
gaucaaagaugaaaagua

SEQ ID NO: 2641216 - RNA, 15 nt, Human
gagccccuccuccag

SEQ ID NO: 2641217 - RNA, 17 nt, Human
gagccccuccuccagcc

SEQ ID NO: 2641218 - RNA, 20 nt, Human
gagccccuccuccagccccu

SEQ ID NO: 2641219 - RNA, 21 nt, Human
gagccccuccuccagccccug

SEQ ID NO: 2641220 - RNA, 22 nt, Human
gagccccuccuccagccccugu

SEQ ID NO: 2641221 - RNA, 17 nt, Human
gaggacucccaacccug

SEQ ID NO: 2641222 - RNA, 18 nt, Human
gaggacucccaacccugg

SEQ ID NO: 2641223 - RNA, 20 nt, Human
gaggacucccaacccuggcu

SEQ ID NO: 2641224 - RNA, 21 nt, Human
gaggacucccaacccuggcuu

SEQ ID NO: 2641225 - RNA, 14 nt, Human
cuuccauuuucccc

SEQ ID NO: 2641226 - RNA, 19 nt, Human
cuuccauuuucccccacua

SEQ ID NO: 2641227 - RNA, 22 nt, Human
cuuccauuuucccccacuacug

SEQ ID NO: 2641228 - RNA, 23 nt, Human
cuuccauuuucccccacuacugc

SEQ ID NO: 2641229 - RNA, 21 nt, Human
cuuuaacugccguaauuuaac

SEQ ID NO: 2641230 - RNA, 23 nt, Human
cuuuaacugccguaauuuaacuu

SEQ ID NO: 2641231 - RNA, 13 nt, Human
gaaagaauagaac

SEQ ID NO: 2641232 - RNA, 14 nt, Human
cuuaaacuaaaugu

SEQ ID NO: 2641233 - RNA, 15 nt, Human
cuuaaacuaaaugug

SEQ ID NO: 2641234 - RNA, 18 nt, Human
cuguugcuauagagccua

SEQ ID NO: 2641235 - RNA, 23 nt, Human
cuguugcuauagagccuaccugu

SEQ ID NO: 2641236 - RNA, 12 nt, Human
cuguaaagaugu

SEQ ID NO: 2641237 - RNA, 16 nt, Human
cuguaaagauguuuau

SEQ ID NO: 2641238 - RNA, 21 nt, Human
cuguaaagauguuuauuucag

SEQ ID NO: 2641239 - RNA, 22 nt, Human
cuguaaagauguuuauuucagg

SEQ ID NO: 2641240 - RNA, 14 nt, Human
cugaggacugauuu

SEQ ID NO: 2641241 - RNA, 22 nt, Human
cugaggacugauuucagaguga

SEQ ID NO: 2641242 - RNA, 15 nt, Human
cucuaaaauuauaaa

SEQ ID NO: 2641243 - RNA, 17 nt, Human
cucuaaaauuauaaaug

SEQ ID NO: 2641244 - RNA, 16 nt, Human
cgacucuggcccuggc

SEQ ID NO: 2641245 - RNA, 18 nt, Human
cgacucuggcccuggccc

SEQ ID NO: 2641246 - RNA, 15 nt, Human
cuacaguuuuaacug

SEQ ID NO: 2641247 - RNA, 18 nt, Human
ccugcagcaaacacucca

SEQ ID NO: 2641248 - RNA, 19 nt, Human
ccugcagcaaacacuccac

SEQ ID NO: 2641249 - RNA, 21 nt, Human
ccugcagcaaacacuccaccc

SEQ ID NO: 2641250 - RNA, 24 nt, Human
ccugcagcaaacacuccacccucc

SEQ ID NO: 2641251 - RNA, 14 nt, Human
cccuaucuguauuc

SEQ ID NO: 2641252 - RNA, 19 nt, Human
ccauugaagccgacucugg

SEQ ID NO: 2641253 - RNA, 20 nt, Human
ccauugaagccgacucuggc

SEQ ID NO: 2641254 - RNA, 23 nt, Human
ccauugaagccgacucuggcccu

SEQ ID NO: 2641255 - RNA, 11 nt, Human
ccagccccugu

SEQ ID NO: 2641256 - RNA, 13 nt, Human
ccagccccugucc

SEQ ID NO: 2641257 - RNA, 17 nt, Human
ccagccccugucccacc

SEQ ID NO: 2641258 - RNA, 23 nt, Human
auuucagagugacuacacacagu

SEQ ID NO: 2641259 - RNA, 15 nt, Human
auuguaaaaauggca

SEQ ID NO: 2641260 - RNA, 15 nt, Human
caacaaagaaacaaa

SEQ ID NO: 2641261 - RNA, 12 nt, Human
caaagaugaaaa

SEQ ID NO: 2641262 - RNA, 16 nt, Human
caauaaacaacagcug

SEQ ID NO: 2641263 - RNA, 21 nt, Human
caauaaacaacagcugaagca

SEQ ID NO: 2641264 - RNA, 12 nt, Human
cacuacugcagc

SEQ ID NO: 2641265 - RNA, 13 nt, Human
cacuacugcagca

SEQ ID NO: 2641266 - RNA, 16 nt, Human
cacuacugcagcaccu

SEQ ID NO: 2641267 - RNA, 17 nt, Human
cacuacugcagcaccuc

SEQ ID NO: 2641268 - RNA, 19 nt, Human
cacuacugcagcaccucca

SEQ ID NO: 2641269 - RNA, 20 nt, Human
cacuggucuguuugcauuug

SEQ ID NO: 2641270 - RNA, 16 nt, Human
cagaaauucaauuugg

SEQ ID NO: 2641271 - RNA, 20 nt, Human
cagaaauucaauuuggauuu

SEQ ID NO: 2641272 - RNA, 20 nt, Human
guguuugcagccugcucuag

SEQ ID NO: 2641273 - RNA, 15 nt, Human
uaaaauuauuucaug

SEQ ID NO: 2641274 - RNA, 18 nt, Human
guuucaacggaaagugcu

SEQ ID NO: 2641275 - RNA, 15 nt, Human
guuuugcacagccaa

SEQ ID NO: 2641276 - RNA, 15 nt, Human
guuuuaacuguggau

SEQ ID NO: 2641277 - RNA, 21 nt, Human
aacacacaggugcaacagacu

SEQ ID NO: 2641278 - RNA, 18 nt, Human
aaauuucuguaaaacagg

SEQ ID NO: 2641279 - RNA, 17 nt, Human
gucuuaaacuaaaugug

SEQ ID NO: 2641280 - RNA, 22 nt, Human
gucuuaaacuaaaugugcaaua

SEQ ID NO: 2641281 - RNA, 14 nt, Human
gugacagcuuccuu

SEQ ID NO: 2641282 - RNA, 14 nt, Human
aagaaacagccagc

SEQ ID NO: 2641283 - RNA, 14 nt, Human
aagaaacaaagaug

SEQ ID NO: 2641284 - RNA, 15 nt, Human
aagaaacaaagaugu

SEQ ID NO: 2641285 - RNA, 19 nt, Human
aagaagagcgagagaucaa

SEQ ID NO: 2641286 - RNA, 22 nt, Human
aagaagagcgagagaucaaaga

SEQ ID NO: 2641287 - RNA, 23 nt, Human
aagaagagcgagagaucaaagau

SEQ ID NO: 2641288 - RNA, 18 nt, Human
aacuguggauauuguuac

SEQ ID NO: 2641289 - RNA, 11 nt, Human
aacuguggaua

SEQ ID NO: 2641290 - RNA, 13 nt, Human
aacuguggauauu

SEQ ID NO: 2641291 - RNA, 14 nt, Human
aacuguggauauug

SEQ ID NO: 2641292 - RNA, 16 nt, Human
aacugccguaauuuaa

SEQ ID NO: 2641293 - RNA, 17 nt, Human
aacugccguaauuuaac

SEQ ID NO: 2641294 - RNA, 18 nt, Human
aacugccguaauuuaacu

SEQ ID NO: 2641295 - RNA, 12 nt, Human
gugcaauagaag

SEQ ID NO: 2641296 - RNA, 22 nt, Human
uagcugugugaauaccugcuca

SEQ ID NO: 2641297 - RNA, 15 nt, Human
uagauaugaaagcug

SEQ ID NO: 2641298 - RNA, 20 nt, Human
aauuguguuuuaauuguaaa

SEQ ID NO: 2641299 - RNA, 15 nt, Human
acaguacccaaacug

SEQ ID NO: 2641300 - RNA, 15 nt, Human
uacuguauauucagg

SEQ ID NO: 2641301 - RNA, 16 nt, Human
uacuaaaaaaaagaug

SEQ ID NO: 2641302 - RNA, 18 nt, Human
uacuaaaaaaaagaugaa

SEQ ID NO: 2641303 - RNA, 14 nt, Human
aauuaccuguggau

SEQ ID NO: 2641304 - RNA, 21 nt, Human
uaccugcucacgucaaaugca

SEQ ID NO: 2641305 - RNA, 15 nt, Human
aaugugcaauagaag

SEQ ID NO: 2641306 - RNA, 17 nt, Human
aaugugcaauagaaggu

SEQ ID NO: 2641307 - RNA, 13 nt, Human
aauggauuuuucu

SEQ ID NO: 2641308 - RNA, 17 nt, Human
aauggauuuuucuuuaa

SEQ ID NO: 2641309 - RNA, 18 nt, Human
aauggauuuuucuuuaac

SEQ ID NO: 2641310 - RNA, 20 nt, Human
aauggauuuuucuuuaacug

SEQ ID NO: 2641311 - RNA, 16 nt, Human
aaucuuuauaaaugua

SEQ ID NO: 2641312 - RNA, 13 nt, Human
uaacuuucugggu

SEQ ID NO: 2641313 - RNA, 14 nt, Human
uaacaguguuuaaa

SEQ ID NO: 2641314 - RNA, 20 nt, Human
ucacaaaauauauuuuguuu

SEQ ID NO: 2641315 - RNA, 16 nt, Human
accaaaacaguuaauc

SEQ ID NO: 2641316 - RNA, 14 nt, Human
ucaacaaagaaaca

SEQ ID NO: 2641317 - RNA, 20 nt, Human
ucaacaaagaaacaaagaug

SEQ ID NO: 2641318 - RNA, 21 nt, Human
ucaacaaagaaacaaagaugu

SEQ ID NO: 2641319 - RNA, 14 nt, Human
accuccaggccugu

SEQ ID NO: 2641320 - RNA, 15 nt, Human
accuccaggccuguu

SEQ ID NO: 2641321 - RNA, 12 nt, Human
acuacugcagca

SEQ ID NO: 2641322 - RNA, 13 nt, Human
acuacugcagcac

SEQ ID NO: 2641323 - RNA, 15 nt, Human
acuacugcagcaccu

SEQ ID NO: 2641324 - RNA, 20 nt, Human
acguccaucacguuagcugu

SEQ ID NO: 2641325 - RNA, 21 nt, Human
uccaguauaagacuacugaau

SEQ ID NO: 2641326 - RNA, 18 nt, Human
acgccucacugaaacaug

SEQ ID NO: 2641327 - RNA, 22 nt, Human
acgccucacugaaacauggcug

SEQ ID NO: 2641328 - RNA, 23 nt, Human
accuugaaaaaaaacaguggauc

SEQ ID NO: 2641329 - RNA, 17 nt, Human
uccuagcugugugaaua

SEQ ID NO: 2641330 - RNA, 17 nt, Human
agaauagaacacaguuu

SEQ ID NO: 2641331 - RNA, 15 nt, Human
acuugcuucucuagc

SEQ ID NO: 2641332 - RNA, 16 nt, Human
acuugcuucucuagcu

SEQ ID NO: 2641333 - RNA, 22 nt, Human
acuuugaccuaaauuauuuacu

SEQ ID NO: 2641334 - RNA, 14 nt, Human
acuuugacaguguu

SEQ ID NO: 2641335 - RNA, 18 nt, Human
acuuugacaguguuuuua

SEQ ID NO: 2641336 - RNA, 20 nt, Human
acuuugaccuaaauuauuua

SEQ ID NO: 2641337 - RNA, 15 nt, Human
acuuacaucaugugu

SEQ ID NO: 2641338 - RNA, 14 nt, Human
ucuauaaacuauaa

SEQ ID NO: 2641339 - RNA, 21 nt, Human
ucuauaaacuauaaccucucc

SEQ ID NO: 2641340 - RNA, 19 nt, Human
ugaaugccuaugguggauc

SEQ ID NO: 2641341 - RNA, 15 nt, Human
agcaccuccaggccu

SEQ ID NO: 2641342 - RNA, 16 nt, Human
agcaccuccaggccug

SEQ ID NO: 2641343 - RNA, 17 nt, Human
agcaccuccaggccugu

SEQ ID NO: 2641344 - RNA, 22 nt, Human
agagacugaauagauaugaaag

SEQ ID NO: 2641345 - RNA, 20 nt, Human
ugugaagcaaacucuaaaau

SEQ ID NO: 2641346 - RNA, 17 nt, Human
agggugacagcuuccuu

SEQ ID NO: 2641347 - RNA, 11 nt, Human
uguaaagaugu

SEQ ID NO: 2641348 - RNA, 17 nt, Human
uguagaacucacucugg

SEQ ID NO: 2641349 - RNA, 19 nt, Human
uguagaacucacucugggc

SEQ ID NO: 2641350 - RNA, 20 nt, Human
uguagaacucacucugggcu

SEQ ID NO: 2641351 - RNA, 21 nt, Human
uguagaacucacucugggcug

SEQ ID NO: 2641352 - RNA, 19 nt, Human
uguaaggauccggaaagaa

SEQ ID NO: 2641353 - RNA, 21 nt, Human
uguaaggauccggaaagaaga

SEQ ID NO: 2641354 - RNA, 23 nt, Human
uuauaaauguaccagagagaguu

SEQ ID NO: 2641355 - RNA, 17 nt, Human
uuauaacuguaaagaug

SEQ ID NO: 2641356 - RNA, 18 nt, Human
uuauaacuguaaagaugu

SEQ ID NO: 2641357 - RNA, 20 nt, Human
aguuauacuuauuuguauau

SEQ ID NO: 2641358 - RNA, 14 nt, Human
aguuaggggccuua

SEQ ID NO: 2641359 - RNA, 14 nt, Human
aguuccuuuagaaa

SEQ ID NO: 2641360 - RNA, 20 nt, Human
uguuggggaagggccugccc

SEQ ID NO: 2641361 - RNA, 23 nt, Human
uuaaacgcucuagguacgaugac

SEQ ID NO: 2641362 - RNA, 22 nt, Human
agccuccaccccacaacccaaa

SEQ ID NO: 2641363 - RNA, 16 nt, Human
ugcaauagaaggugau

SEQ ID NO: 2641364 - RNA, 21 nt, Human
aggccaaagagucuccaguuu

SEQ ID NO: 2641365 - RNA, 21 nt, Human
aggccucuccaguuugcaccu

SEQ ID NO: 2641366 - RNA, 23 nt, Human
aggccucuccaguuugcaccugu

SEQ ID NO: 2641367 - RNA, 24 nt, Human
aggccucuccaguuugcaccuguc

SEQ ID NO: 2641368 - RNA, 21 nt, Human
uggcuguguuugcagccugcu

SEQ ID NO: 2641369 - RNA, 22 nt, Human
uggcugcccaucauguggcccc

SEQ ID NO: 2641370 - RNA, 16 nt, Human
aggcuccuguuuugca

SEQ ID NO: 2641371 - RNA, 22 nt, Human
aggcuccuguuuugcacagcca

SEQ ID NO: 2641372 - RNA, 14 nt, Human
ugcugucuuaaacu

SEQ ID NO: 2641373 - RNA, 21 nt, Human
ugcugucuuaaacuaaaugug

SEQ ID NO: 2641374 - RNA, 13 nt, Human
ugcugucuuaaac

SEQ ID NO: 2641375 - RNA, 14 nt, Human
ugcuucacaauguu

SEQ ID NO: 2641376 - RNA, 15 nt, Human
aggagcugauacuuu

SEQ ID NO: 2641377 - RNA, 18 nt, Human
aggaggcaccuacacuca

SEQ ID NO: 2641378 - RNA, 22 nt, Human
aucccugaggacugauuucaga

SEQ ID NO: 2641379 - RNA, 15 nt, Human
aucccugaggacuga

SEQ ID NO: 2641380 - RNA, 18 nt, Human
aucccugaggacugauuu

SEQ ID NO: 2641381 - RNA, 13 nt, Human
auccaguauaaga

SEQ ID NO: 2641382 - RNA, 14 nt, Human
uugacaguguuuuu

SEQ ID NO: 2641383 - RNA, 18 nt, Human
uugauaaccuugaaaaaa

SEQ ID NO: 2641384 - RNA, 17 nt, Human
auaugaaagcugauuuu

SEQ ID NO: 2641385 - RNA, 13 nt, Human
auaugaaagcuga

SEQ ID NO: 2641386 - RNA, 16 nt, Human
auauauuuuguuuaca

SEQ ID NO: 2641387 - RNA, 16 nt, Human
augccuaugguggauc

SEQ ID NO: 2641388 - RNA, 19 nt, Human
augccuaugguggauccaa

SEQ ID NO: 2641389 - RNA, 21 nt, Human
augccuaugguggauccaaac

SEQ ID NO: 2641390 - RNA, 16 nt, Human
uuucguaacacagcau

SEQ ID NO: 2641391 - RNA, 21 nt, Human
uuugaaagaauagaacacagu

SEQ ID NO: 2641392 - RNA, 12 nt, Human
uuucuuuaacug

SEQ ID NO: 2641393 - RNA, 13 nt, Human
uuucuuuaacugc

SEQ ID NO: 2641394 - RNA, 15 nt, Human
uuucuggauuucaua

SEQ ID NO: 2641395 - RNA, 9 nt, Human
uuucuuuuc

SEQ ID NO: 2641396 - RNA, 17 nt, Human
augacaguguuccccga

SEQ ID NO: 2641397 - RNA, 16 nt, Human
uuguguggauucuuua

SEQ ID NO: 2641398 - RNA, 23 nt, Human
uuggggucaagaaacagccagca

SEQ ID NO: 2641399 - RNA, 15 nt, Human
auuuguuuuggauau

SEQ ID NO: 2641400 - RNA, 16 nt, Human
auuuguuuuggauaua

SEQ ID NO: 2641401 - RNA, 13 nt, Human
auugggguaguug

SEQ ID NO: 2641402 - RNA, 14 nt, Human
auguggccccaccc

SEQ ID NO: 2641403 - RNA, 22 nt, Human
auguugccauccuaccgucuuu

SEQ ID NO: 2641404 - RNA, 14 nt, Human
auguuaaguuauau

SEQ ID NO: 2641405 - RNA, 22 nt, Human
auguguuggggaagggccugcc

SEQ ID NO: 2641406 - RNA, 17 nt, Human
uuuugcacagccaaauu

SEQ ID NO: 2641407 - RNA, 13 nt, Human
aagaaauggugaa

SEQ ID NO: 2641408 - RNA, 19 nt, Human
aaucugcuaccaaaacagu

SEQ ID NO: 2641409 - RNA, 13 nt, Human
aaaacacacaggu

SEQ ID NO: 2641410 - RNA, 21 nt, Human
aacugauccaguauaagacua

SEQ ID NO: 2641411 - RNA, 11 nt, Human
aacaaagaaac

SEQ ID NO: 2641412 - RNA, 14 nt, Human
acgaugacaguguu

SEQ ID NO: 2641413 - RNA, 23 nt, Human
accuguaugucaauaaacaacag

SEQ ID NO: 2641414 - RNA, 12 nt, Human
acucugggcugu

SEQ ID NO: 2641415 - RNA, 23 nt, Human
acucugggcuguaacguggcacu

SEQ ID NO: 2641416 - RNA, 12 nt, Human
acucuggcccug

SEQ ID NO: 2641417 - RNA, 13 nt, Human
acucuggcccugg

SEQ ID NO: 2641418 - RNA, 14 nt, Human
acucuggcccuggc

SEQ ID NO: 2641419 - RNA, 15 nt, Human
acucuggcccuggcc

SEQ ID NO: 2641420 - RNA, 16 nt, Human
acucuggcccuggccc

SEQ ID NO: 2641421 - RNA, 17 nt, Human
acucuggcccuggcccu

SEQ ID NO: 2641422 - RNA, 14 nt, Human
acucagcuguccug

SEQ ID NO: 2641423 - RNA, 17 nt, Human
acucagcuguccugcag

SEQ ID NO: 2641424 - RNA, 13 nt, Human
agaaacaaagaug

SEQ ID NO: 2641425 - RNA, 17 nt, Human
agaaacaaagauguuau

SEQ ID NO: 2641426 - RNA, 15 nt, Human
acagguuauaacagu

SEQ ID NO: 2641427 - RNA, 18 nt, Human
acagguuauaacaguguu

SEQ ID NO: 2641428 - RNA, 20 nt, Human
aauuauaacuguaaagaugu

SEQ ID NO: 2641429 - RNA, 13 nt, Human
aauuauaaaugac

SEQ ID NO: 2641430 - RNA, 14 nt, Human
acagccagcaagag

SEQ ID NO: 2641431 - RNA, 18 nt, Human
auacuuauuuguauaugg

SEQ ID NO: 2641432 - RNA, 16 nt, Human
augaaaaguauauuga

SEQ ID NO: 2641433 - RNA, 19 nt, Human
augucaauaaacaacagcu

SEQ ID NO: 2641434 - RNA, 23 nt, Human
augucaauaaacaacagcugaag

SEQ ID NO: 2641435 - RNA, 19 nt, Human
auggaugcccagaggacuc

SEQ ID NO: 2641436 - RNA, 15 nt, Human
agagccccuccucca

SEQ ID NO: 2641437 - RNA, 19 nt, Human
agagccccuccuccagccc

SEQ ID NO: 2641438 - RNA, 20 nt, Human
agagccccuccuccagcccc

SEQ ID NO: 2641439 - RNA, 22 nt, Human
agagccccuccuccagccccug

SEQ ID NO: 2641440 - RNA, 23 nt, Human
agagccccuccuccagccccugu

SEQ ID NO: 2641441 - RNA, 20 nt, Human
agcugauacuuugacagugu

SEQ ID NO: 2641442 - RNA, 23 nt, Human
caauuuggauuuaaaagccugcu

SEQ ID NO: 2641443 - RNA, 21 nt, Human
caauuuggauuuaaaagccug

SEQ ID NO: 2641444 - RNA, 23 nt, Human
caacgcuuguagaacucacucug

SEQ ID NO: 2641445 - RNA, 20 nt, Human
caacggaaagugcugucuua

SEQ ID NO: 2641446 - RNA, 18 nt, Human
caaauacuguauauucag

SEQ ID NO: 2641447 - RNA, 11 nt, Human
caaaguggaac

SEQ ID NO: 2641448 - RNA, 14 nt, Human
caaaguggaacgaa

SEQ ID NO: 2641449 - RNA, 15 nt, Human
caaaguggaacgaaa

SEQ ID NO: 2641450 - RNA, 22 nt, Human
caaaaauuucuguaaaacaggu

SEQ ID NO: 2641451 - RNA, 21 nt, Human
caaaaauuucuguaaaacagg

SEQ ID NO: 2641452 - RNA, 14 nt, Human
cacuaacagagugg

SEQ ID NO: 2641453 - RNA, 12 nt, Human
cacucaccugca

SEQ ID NO: 2641454 - RNA, 18 nt, Human
cacucagcuguccugcag

SEQ ID NO: 2641455 - RNA, 20 nt, Human
cacucagcuguccugcagca

SEQ ID NO: 2641456 - RNA, 22 nt, Human
cacucagcuguccugcagcaaa

SEQ ID NO: 2641457 - RNA, 19 nt, Human
cacuaaaacacacaggugc

SEQ ID NO: 2641458 - RNA, 20 nt, Human
cacgucaaaugcauacaagu

SEQ ID NO: 2641459 - RNA, 18 nt, Human
caccuuccauuuuccccc

SEQ ID NO: 2641460 - RNA, 13 nt, Human
caccuccaggccu

SEQ ID NO: 2641461 - RNA, 14 nt, Human
caccuccaggccug

SEQ ID NO: 2641462 - RNA, 15 nt, Human
caccuccaggccugu

SEQ ID NO: 2641463 - RNA, 18 nt, Human
caccuccaggccuguugc

SEQ ID NO: 2641464 - RNA, 15 nt, Human
caccugcacuaacag

SEQ ID NO: 2641465 - RNA, 16 nt, Human
caccugcacuaacaga

SEQ ID NO: 2641466 - RNA, 21 nt, Human
caccugcacuaacagaguggc

SEQ ID NO: 2641467 - RNA, 20 nt, Human
caccuguccccacccuccac

SEQ ID NO: 2641468 - RNA, 21 nt, Human
caccuguccccacccuccacu

SEQ ID NO: 2641469 - RNA, 22 nt, Human
caccuguccccacccuccacuc

SEQ ID NO: 2641470 - RNA, 16 nt, Human
cagagccccuccucca

SEQ ID NO: 2641471 - RNA, 17 nt, Human
cagagccccuccuccag

SEQ ID NO: 2641472 - RNA, 18 nt, Human
cagagccccuccuccagc

SEQ ID NO: 2641473 - RNA, 21 nt, Human
cagagccccuccuccagcccc

SEQ ID NO: 2641474 - RNA, 22 nt, Human
cagagccccuccuccagccccu

SEQ ID NO: 2641475 - RNA, 19 nt, Human
cagaggacucccaacccug

SEQ ID NO: 2641476 - RNA, 21 nt, Human
cagaggacucccaacccuggc

SEQ ID NO: 2641477 - RNA, 22 nt, Human
cagaggacucccaacccuggcu

SEQ ID NO: 2641478 - RNA, 21 nt, Human
cagccugcucuagugggacag

SEQ ID NO: 2641479 - RNA, 23 nt, Human
cagccugcucuagugggacagcc

SEQ ID NO: 2641480 - RNA, 13 nt, Human
cagccccuguccc

SEQ ID NO: 2641481 - RNA, 14 nt, Human
cagccccuguccca

SEQ ID NO: 2641482 - RNA, 21 nt, Human
caggaauucuuggagaaaaug

SEQ ID NO: 2641483 - RNA, 20 nt, Human
cagcuuccuuuccugugugu

SEQ ID NO: 2641484 - RNA, 17 nt, Human
cagcaacgcuuguagaa

SEQ ID NO: 2641485 - RNA, 18 nt, Human
cagcaacgcuuguagaac

SEQ ID NO: 2641486 - RNA, 14 nt, Human
cagcaaacaggugc

SEQ ID NO: 2641487 - RNA, 15 nt, Human
cagcaaacacuccac

SEQ ID NO: 2641488 - RNA, 21 nt, Human
cagcaaacacuccacccucca

SEQ ID NO: 2641489 - RNA, 12 nt, Human
cagcccauccau

SEQ ID NO: 2641490 - RNA, 18 nt, Human
cagcccauccauuaggcc

SEQ ID NO: 2641491 - RNA, 21 nt, Human
cagcccauccauuaggccagc

SEQ ID NO: 2641492 - RNA, 22 nt, Human
cagcccauccauuaggccagca

SEQ ID NO: 2641493 - RNA, 14 nt, Human
cagcccagagccug

SEQ ID NO: 2641494 - RNA, 15 nt, Human
cagcccagagccugg

SEQ ID NO: 2641495 - RNA, 18 nt, Human
cagcccagagccuggcug

SEQ ID NO: 2641496 - RNA, 16 nt, Human
cagcauuguauaugug

SEQ ID NO: 2641497 - RNA, 22 nt, Human
cagccaaauuuaaaacuguugg

SEQ ID NO: 2641498 - RNA, 14 nt, Human
cagccaaauuuaaa

SEQ ID NO: 2641499 - RNA, 16 nt, Human
cagguuauaacagugu

SEQ ID NO: 2641500 - RNA, 17 nt, Human
cagguuauaacaguguu

SEQ ID NO: 2641501 - RNA, 15 nt, Human
cagguuauaacagug

SEQ ID NO: 2641502 - RNA, 15 nt, Human
caggcauuggauauu

SEQ ID NO: 2641503 - RNA, 22 nt, Human
caggccaaagagucuccaguuu

SEQ ID NO: 2641504 - RNA, 16 nt, Human
caggacuugaaagaaa

SEQ ID NO: 2641505 - RNA, 16 nt, Human
cauugaagccgacucu

SEQ ID NO: 2641506 - RNA, 17 nt, Human
cauugaagccgacucug

SEQ ID NO: 2641507 - RNA, 18 nt, Human
cauugaagccgacucugg

SEQ ID NO: 2641508 - RNA, 20 nt, Human
cauugaagccgacucuggcc

SEQ ID NO: 2641509 - RNA, 21 nt, Human
cauugaagccgacucuggccc

SEQ ID NO: 2641510 - RNA, 23 nt, Human
cauugaagccgacucuggcccug

SEQ ID NO: 2641511 - RNA, 21 nt, Human
cauuuucccccacuacugcag

SEQ ID NO: 2641512 - RNA, 13 nt, Human
cauucaggaauuc

SEQ ID NO: 2641513 - RNA, 19 nt, Human
cauucaggaauucuuggag

SEQ ID NO: 2641514 - RNA, 18 nt, Human
cauucaacagagacugaa

SEQ ID NO: 2641515 - RNA, 22 nt, Human
caucauguggccccacccaauc

SEQ ID NO: 2641516 - RNA, 19 nt, Human
caucacguuagcuguccca

SEQ ID NO: 2641517 - RNA, 20 nt, Human
cccaacccuggcuugggguc

SEQ ID NO: 2641518 - RNA, 15 nt, Human
ccagaggacucccaa

SEQ ID NO: 2641519 - RNA, 20 nt, Human
ccagaggacucccaacccug

SEQ ID NO: 2641520 - RNA, 17 nt, Human
ccacccuccaccuucca

SEQ ID NO: 2641521 - RNA, 19 nt, Human
ccacccuccaccuuccauu

SEQ ID NO: 2641522 - RNA, 13 nt, Human
ccacccuccacuc

SEQ ID NO: 2641523 - RNA, 12 nt, Human
ccacuacugcag

SEQ ID NO: 2641524 - RNA, 13 nt, Human
ccacuacugcagc

SEQ ID NO: 2641525 - RNA, 14 nt, Human
ccacuacugcagca

SEQ ID NO: 2641526 - RNA, 20 nt, Human
ccacuacugcagcaccucca

SEQ ID NO: 2641527 - RNA, 18 nt, Human
ccuguguguacucugucc

SEQ ID NO: 2641528 - RNA, 19 nt, Human
ccuguguguacucugucca

SEQ ID NO: 2641529 - RNA, 20 nt, Human
ccuguguguacucuguccag

SEQ ID NO: 2641530 - RNA, 19 nt, Human
ccugaggacugauuucaga

SEQ ID NO: 2641531 - RNA, 23 nt, Human
ccugaggacugauuucagaguga

SEQ ID NO: 2641532 - RNA, 17 nt, Human
ccugcacuaacagagug

SEQ ID NO: 2641533 - RNA, 22 nt, Human
ccugcauaauguuucuggauuu

SEQ ID NO: 2641534 - RNA, 19 nt, Human
ccugcucaaucccugagga

SEQ ID NO: 2641535 - RNA, 19 nt, Human
ccugcucacgucaaaugca

SEQ ID NO: 2641536 - RNA, 17 nt, Human
ccugcucuagugggaca

SEQ ID NO: 2641537 - RNA, 18 nt, Human
ccugcucuagugggacag

SEQ ID NO: 2641538 - RNA, 19 nt, Human
ccugcucuagugggacagc

SEQ ID NO: 2641539 - RNA, 22 nt, Human
ccugcucuagugggacagccca

SEQ ID NO: 2641540 - RNA, 12 nt, Human
ccuggcugccca

SEQ ID NO: 2641541 - RNA, 15 nt, Human
ccuggcugcccauca

SEQ ID NO: 2641542 - RNA, 23 nt, Human
ccuggcugcccaucauguggccc

SEQ ID NO: 2641543 - RNA, 12 nt, Human
cccuccaccuuc

SEQ ID NO: 2641544 - RNA, 15 nt, Human
cccuccaccuuccau

SEQ ID NO: 2641545 - RNA, 17 nt, Human
cccuccacucagcuguc

SEQ ID NO: 2641546 - RNA, 21 nt, Human
cccuccacucagcuguccugc

SEQ ID NO: 2641547 - RNA, 19 nt, Human
cccacaacccaaaagguuu

SEQ ID NO: 2641548 - RNA, 13 nt, Human
ccuccaccuucca

SEQ ID NO: 2641549 - RNA, 14 nt, Human
ccuccaccuuccau

SEQ ID NO: 2641550 - RNA, 21 nt, Human
ccuccaccuuccauuuucccc

SEQ ID NO: 2641551 - RNA, 21 nt, Human
ccuccacucagcuguccugca

SEQ ID NO: 2641552 - RNA, 13 nt, Human
ccuccaggccugu

SEQ ID NO: 2641553 - RNA, 17 nt, Human
ccuccaggccuguugcu

SEQ ID NO: 2641554 - RNA, 12 nt, Human
ccuccaggccug

SEQ ID NO: 2641555 - RNA, 14 nt, Human
ccuccagccccugu

SEQ ID NO: 2641556 - RNA, 15 nt, Human
ccuccagccccuguc

SEQ ID NO: 2641557 - RNA, 17 nt, Human
ccuccagccccuguccc

SEQ ID NO: 2641558 - RNA, 18 nt, Human
ccuccagccccuguccca

SEQ ID NO: 2641559 - RNA, 21 nt, Human
ccuccagccccugucccaccc

SEQ ID NO: 2641560 - RNA, 18 nt, Human
ccuacacucaccugcacu

SEQ ID NO: 2641561 - RNA, 18 nt, Human
cuguuugcauuugauaca

SEQ ID NO: 2641562 - RNA, 22 nt, Human
cuguuugcauuugauacauuuu

SEQ ID NO: 2641563 - RNA, 14 nt, Human
cuucccccagccca

SEQ ID NO: 2641564 - RNA, 16 nt, Human
cuucccccagcccauc

SEQ ID NO: 2641565 - RNA, 18 nt, Human
cuucagguugguuuaauc

SEQ ID NO: 2641566 - RNA, 19 nt, Human
cugucuuaaacuaaaugug

SEQ ID NO: 2641567 - RNA, 21 nt, Human
cugucuuaaacuaaaugugca

SEQ ID NO: 2641568 - RNA, 18 nt, Human
cuguguuuugaaagaaua

SEQ ID NO: 2641569 - RNA, 22 nt, Human
cuguguuuugaaagaauagaac

SEQ ID NO: 2641570 - RNA, 17 nt, Human
cuguguuuugaaagaau

SEQ ID NO: 2641571 - RNA, 22 nt, Human
cuguguuacuaaaaaaaagaug

SEQ ID NO: 2641572 - RNA, 23 nt, Human
cuguguuacuaaaaaaaagauga

SEQ ID NO: 2641573 - RNA, 18 nt, Human
cugugugaauaccugcuc

SEQ ID NO: 2641574 - RNA, 19 nt, Human
cugugugaauaccugcuca

SEQ ID NO: 2641575 - RNA, 12 nt, Human
cuguaauugugu

SEQ ID NO: 2641576 - RNA, 12 nt, Human
cugggcuguugu

SEQ ID NO: 2641577 - RNA, 14 nt, Human
cugggcuguuguuc

SEQ ID NO: 2641578 - RNA, 22 nt, Human
cugggcuguaacguggcacugg

SEQ ID NO: 2641579 - RNA, 23 nt, Human
cugggcuguaacguggcacuggu

SEQ ID NO: 2641580 - RNA, 13 nt, Human
cuuuauaaaugua

SEQ ID NO: 2641581 - RNA, 15 nt, Human
cuuuagaagccugca

SEQ ID NO: 2641582 - RNA, 14 nt, Human
cuuuagaagccugc

SEQ ID NO: 2641583 - RNA, 12 nt, Human
gaaacagccagc

SEQ ID NO: 2641584 - RNA, 15 nt, Human
gaaacagccagcaag

SEQ ID NO: 2641585 - RNA, 19 nt, Human
gaauagauaugaaagcuga

SEQ ID NO: 2641586 - RNA, 16 nt, Human
gaauagauaugaaagc

SEQ ID NO: 2641587 - RNA, 20 nt, Human
gaaggaggaaugcuggacug

SEQ ID NO: 2641588 - RNA, 22 nt, Human
gaaggaggaaugcuggacugga

SEQ ID NO: 2641589 - RNA, 15 nt, Human
gaaauuaccugugga

SEQ ID NO: 2641590 - RNA, 16 nt, Human
gaaauagaauuauaac

SEQ ID NO: 2641591 - RNA, 18 nt, Human
gaaccuacaguuuuaacu

SEQ ID NO: 2641592 - RNA, 23 nt, Human
gaaccuacaguuuuaacugugga

SEQ ID NO: 2641593 - RNA, 19 nt, Human
gaaccuacaguuuuaacug

SEQ ID NO: 2641594 - RNA, 21 nt, Human
gaaccuacaguuuuaacugug

SEQ ID NO: 2641595 - RNA, 11 nt, Human
cucugggcugu

SEQ ID NO: 2641596 - RNA, 23 nt, Human
cucugggcuguaacguggcacug

SEQ ID NO: 2641597 - RNA, 18 nt, Human
cugaauuaucuauuucau

SEQ ID NO: 2641598 - RNA, 17 nt, Human
cugaauuaucuauuuca

SEQ ID NO: 2641599 - RNA, 18 nt, Human
cugcccaucauguggccc

SEQ ID NO: 2641600 - RNA, 13 nt, Human
cugcccaguugca

SEQ ID NO: 2641601 - RNA, 14 nt, Human
cugcaaaaagaaaa

SEQ ID NO: 2641602 - RNA, 15 nt, Human
cuccuccagccccug

SEQ ID NO: 2641603 - RNA, 16 nt, Human
cuccuccagccccugu

SEQ ID NO: 2641604 - RNA, 17 nt, Human
cuccuccagccccuguc

SEQ ID NO: 2641605 - RNA, 18 nt, Human
cuccuccagccccugucc

SEQ ID NO: 2641606 - RNA, 20 nt, Human
cuccuccagccccuguccca

SEQ ID NO: 2641607 - RNA, 12 nt, Human
cuccaccuucca

SEQ ID NO: 2641608 - RNA, 14 nt, Human
cuagguacgaugac

SEQ ID NO: 2641609 - RNA, 19 nt, Human
cuagguacgaugacagugu

SEQ ID NO: 2641610 - RNA, 20 nt, Human
cuagguacgaugacaguguu

SEQ ID NO: 2641611 - RNA, 12 nt, Human
cuaucuguauuc

SEQ ID NO: 2641612 - RNA, 17 nt, Human
cuaucuguauucccaaa

SEQ ID NO: 2641613 - RNA, 16 nt, Human
cuauagagccuaccug

SEQ ID NO: 2641614 - RNA, 13 nt, Human
cuagugggacagc

SEQ ID NO: 2641615 - RNA, 17 nt, Human
cuagugggacagcccag

SEQ ID NO: 2641616 - RNA, 18 nt, Human
cuagugggacagcccaga

SEQ ID NO: 2641617 - RNA, 22 nt, Human
cuagugggacagcccagagccu

SEQ ID NO: 2641618 - RNA, 23 nt, Human
cuagugggacagcccagagccug

SEQ ID NO: 2641619 - RNA, 11 nt, Human
cucacucuggg

SEQ ID NO: 2641620 - RNA, 12 nt, Human
cucacucugggc

SEQ ID NO: 2641621 - RNA, 13 nt, Human
cucacucugggcu

SEQ ID NO: 2641622 - RNA, 14 nt, Human
cucacucugggcug

SEQ ID NO: 2641623 - RNA, 15 nt, Human
cucacucugggcugu

SEQ ID NO: 2641624 - RNA, 23 nt, Human
cucacugaaacauggcuguguuu

SEQ ID NO: 2641625 - RNA, 17 nt, Human
gaggaaugcuggacugg

SEQ ID NO: 2641626 - RNA, 18 nt, Human
gaggaaugcuggacugga

SEQ ID NO: 2641627 - RNA, 17 nt, Human
gaggccccuggagccag

SEQ ID NO: 2641628 - RNA, 18 nt, Human
gaggccccuggagccaga

SEQ ID NO: 2641629 - RNA, 15 nt, Human
gagaucaaagaugaa

SEQ ID NO: 2641630 - RNA, 20 nt, Human
gagaucaaagaugaaaagua

SEQ ID NO: 2641631 - RNA, 18 nt, Human
gaaugcuggacuggaggc

SEQ ID NO: 2641632 - RNA, 23 nt, Human
gaaugcuggacuggaggccccug

SEQ ID NO: 2641633 - RNA, 13 nt, Human
gagaucaaagaug

SEQ ID NO: 2641634 - RNA, 14 nt, Human
gagaucaaagauga

SEQ ID NO: 2641635 - RNA, 15 nt, Human
gagccagauggcaag

SEQ ID NO: 2641636 - RNA, 16 nt, Human
gagccuggcugcccau

SEQ ID NO: 2641637 - RNA, 18 nt, Human
gaguuaggggccuuaggg

SEQ ID NO: 2641638 - RNA, 21 nt, Human
gaugaaaaguauauugauaac

SEQ ID NO: 2641639 - RNA, 23 nt, Human
gaugaaaaguauauugauaaccu

SEQ ID NO: 2641640 - RNA, 16 nt, Human
gaucaacgccucacug

SEQ ID NO: 2641641 - RNA, 18 nt, Human
gaucaacgccucacugaa

SEQ ID NO: 2641642 - RNA, 13 nt, Human
gcccagagccugg

SEQ ID NO: 2641643 - RNA, 16 nt, Human
gcccagaggacuccca

SEQ ID NO: 2641644 - RNA, 20 nt, Human
gcccagaggacucccaaccc

SEQ ID NO: 2641645 - RNA, 21 nt, Human
gcccagaggacucccaacccu

SEQ ID NO: 2641646 - RNA, 12 nt, Human
gcacugggcugu

SEQ ID NO: 2641647 - RNA, 17 nt, Human
gcacagccaaauuuaaa

SEQ ID NO: 2641648 - RNA, 18 nt, Human
gcugugugaauaccugcu

SEQ ID NO: 2641649 - RNA, 20 nt, Human
gcugugugaauaccugcuca

SEQ ID NO: 2641650 - RNA, 17 nt, Human
gcuguguuugcagccug

SEQ ID NO: 2641651 - RNA, 18 nt, Human
gcuguguuugcagccugc

SEQ ID NO: 2641652 - RNA, 19 nt, Human
gcuguguuugcagccugcu

SEQ ID NO: 2641653 - RNA, 11 nt, Human
gcugauuuuuu

SEQ ID NO: 2641654 - RNA, 19 nt, Human
gccugcucuagugggacag

SEQ ID NO: 2641655 - RNA, 16 nt, Human
gcucaaucccugagga

SEQ ID NO: 2641656 - RNA, 20 nt, Human
gcucaaucccugaggacuga

SEQ ID NO: 2641657 - RNA, 22 nt, Human
gcuccuguuuugcacagccaaa

SEQ ID NO: 2641658 - RNA, 14 nt, Human
ggacagcccagagc

SEQ ID NO: 2641659 - RNA, 17 nt, Human
ggacagcccagagccug

SEQ ID NO: 2641660 - RNA, 18 nt, Human
ggacagcccagagccugg

SEQ ID NO: 2641661 - RNA, 21 nt, Human
ggacagcccagagccuggcug

SEQ ID NO: 2641662 - RNA, 12 nt, Human
ggauucuuuaaa

SEQ ID NO: 2641663 - RNA, 17 nt, Human
ggcaagagggugacagc

SEQ ID NO: 2641664 - RNA, 12 nt, Human
ggccucuccagu

SEQ ID NO: 2641665 - RNA, 17 nt, Human
gggacaccagggaagaa

SEQ ID NO: 2641666 - RNA, 20 nt, Human
ggcuguguuugcagccugcu

SEQ ID NO: 2641667 - RNA, 21 nt, Human
ucaucacuuugaccuaaauua

SEQ ID NO: 2641668 - RNA, 23 nt, Human
uccaccuuccauuuucccccacu

SEQ ID NO: 2641669 - RNA, 13 nt, Human
uccacccuccacc

SEQ ID NO: 2641670 - RNA, 14 nt, Human
uccacccuccaccu

SEQ ID NO: 2641671 - RNA, 15 nt, Human
uccacccuccaccuu

SEQ ID NO: 2641672 - RNA, 18 nt, Human
uccacccuccaccuucca

SEQ ID NO: 2641673 - RNA, 22 nt, Human
uauuguuacguagccuaaggcu

SEQ ID NO: 2641674 - RNA, 17 nt, Human
uaugguggauccaaacu

SEQ ID NO: 2641675 - RNA, 21 nt, Human
uaugucaauaaacaacagcug

SEQ ID NO: 2641676 - RNA, 16 nt, Human
ucaauaaacaacagcu

SEQ ID NO: 2641677 - RNA, 17 nt, Human
ucaauaaacaacagcug

SEQ ID NO: 2641678 - RNA, 18 nt, Human
ucaauaaacaacagcuga

SEQ ID NO: 2641679 - RNA, 19 nt, Human
ucaacgccucacugaaaca

SEQ ID NO: 2641680 - RNA, 23 nt, Human
ucaacgccucacugaaacauggc

SEQ ID NO: 2641681 - RNA, 19 nt, Human
uauuuuuucuuuucuuuac

SEQ ID NO: 2641682 - RNA, 12 nt, Human
ucuuaaacuaaa

SEQ ID NO: 2641683 - RNA, 18 nt, Human
ucucuaggccucuccagu

SEQ ID NO: 2641684 - RNA, 19 nt, Human
ucucuaggccucuccaguu

SEQ ID NO: 2641685 - RNA, 14 nt, Human
ucccuaauguguuu

SEQ ID NO: 2641686 - RNA, 20 nt, Human
ugucuuaaacuaaaugugca

SEQ ID NO: 2641687 - RNA, 18 nt, Human
ugucuuaaacuaaaugug

SEQ ID NO: 2641688 - RNA, 20 nt, Human
ugucuguguuuugaaagaau

SEQ ID NO: 2641689 - RNA, 18 nt, Human
uguccugcagcaaacacu

SEQ ID NO: 2641690 - RNA, 13 nt, Human
uguauaaaagugu

SEQ ID NO: 2641691 - RNA, 18 nt, Human
uguauaaaagugugaaau

SEQ ID NO: 2641692 - RNA, 21 nt, Human
uguauaaaagugugaaauaaa

SEQ ID NO: 2641693 - RNA, 14 nt, Human
ugggacagcccaga

SEQ ID NO: 2641694 - RNA, 18 nt, Human
ugggacagcccagagccu

SEQ ID NO: 2641695 - RNA, 20 nt, Human
ugggacagcccagagccugg

SEQ ID NO: 2641696 - RNA, 22 nt, Human
uggcuuggggucaagaaacagc

SEQ ID NO: 2641697 - RNA, 23 nt, Human
uggcuuggggucaagaaacagcc

SEQ ID NO: 2641698 - RNA, 21 nt, Human
ugcuucucuagcucucuaggc

SEQ ID NO: 2641699 - RNA, 22 nt, Human
ugcuucucuagcucucuaggcc

SEQ ID NO: 2641700 - RNA, 23 nt, Human
ugcuucucuagcucucuaggccu

SEQ ID NO: 2641701 - RNA, 10 nt, Human
ugcuucucua

SEQ ID NO: 2641702 - RNA, 16 nt, Human
uggauuuaaaagccug

SEQ ID NO: 2641703 - RNA, 18 nt, Human
uggauuuaaaagccugcu

SEQ ID NO: 2641704 - RNA, 20 nt, Human
uggauuuaaaagccugcuca

SEQ ID NO: 2641705 - RNA, 18 nt, Human
uggcaagagggugacagc

SEQ ID NO: 2641706 - RNA, 22 nt, Human
uggcaagagggugacagcuucc

SEQ ID NO: 2641707 - RNA, 14 nt, Human
uggaucacaaagug

SEQ ID NO: 2641708 - RNA, 15 nt, Human
uggaucacaaagugg

SEQ ID NO: 2641709 - RNA, 13 nt, Human
uggauauuuguau

SEQ ID NO: 2641710 - RNA, 11 nt, Human
uggauauuugu

SEQ ID NO: 2641711 - RNA, 14 nt, Human
uggauauuguuacg

SEQ ID NO: 2641712 - RNA, 17 nt, Human
ugaggacugauuucaga

SEQ ID NO: 2641713 - RNA, 17 nt, Human
ugaccuaaauuauuuac

SEQ ID NO: 2641714 - RNA, 13 nt, Human
ugcaccugucccc

SEQ ID NO: 2641715 - RNA, 16 nt, Human
ugcaccuguccccacc

SEQ ID NO: 2641716 - RNA, 17 nt, Human
ugcaccuguccccaccc

SEQ ID NO: 2641717 - RNA, 21 nt, Human
ugcaccuguccccacccucca

SEQ ID NO: 2641718 - RNA, 17 nt, Human
ugauuuuuuuuaauuac

SEQ ID NO: 2641719 - RNA, 14 nt, Human
ugccguaauuuaac

SEQ ID NO: 2641720 - RNA, 14 nt, Human
uuuucuuuaacugc

SEQ ID NO: 2641721 - RNA, 18 nt, Human
uuuucuuuaacugccgua

SEQ ID NO: 2641722 - RNA, 13 nt, Human
uuugcaccugucc

SEQ ID NO: 2641723 - RNA, 15 nt, Human
uuugcaccugucccc

SEQ ID NO: 2641724 - RNA, 23 nt, Human
uuugcaccuguccccacccucca

SEQ ID NO: 2641725 - RNA, 15 nt, Human
uuguuaaaaauguca

SEQ ID NO: 2641726 - RNA, 16 nt, Human
uuguuacguagccuaa

SEQ ID NO: 2641727 - RNA, 23 nt, Human
uuguuuccuccccuaucuguauu

SEQ ID NO: 2641728 - RNA, 17 nt, Human
uuuaacuguggauauug

SEQ ID NO: 2641729 - RNA, 18 nt, Human
uuuaacuguggauauugu

SEQ ID NO: 2641730 - RNA, 14 nt, Human
uuuaagaaauagaa

SEQ ID NO: 2641731 - RNA, 12 nt, Human
uuuaacugccgu

SEQ ID NO: 2641732 - RNA, 21 nt, Human
uuuaacugccguaauuuaacu

SEQ ID NO: 2641733 - RNA, 12 nt, Human
uuuaacugugga

SEQ ID NO: 2641734 - RNA, 13 nt, Human
uuuaacuguggau

SEQ ID NO: 2641735 - RNA, 15 nt, Human
uuuaacuguggauau

SEQ ID NO: 2641736 - RNA, 12 nt, Human
uuuaaauugugu

SEQ ID NO: 2641737 - RNA, 15 nt, Human
uuucaacggaaagug

SEQ ID NO: 2641738 - RNA, 23 nt, Human
uuucaacggaaagugcugucuua

SEQ ID NO: 2641739 - RNA, 13 nt, Human
uucguaacacagc

SEQ ID NO: 2641740 - RNA, 13 nt, Human
uugcaccuguccc

SEQ ID NO: 2641741 - RNA, 16 nt, Human
uugcaccuguccccac

SEQ ID NO: 2641742 - RNA, 18 nt, Human
uugcaccuguccccaccc

SEQ ID NO: 2641743 - RNA, 18 nt, Human
acucagcuguccugcagc

SEQ ID NO: 2641744 - RNA, 19 nt, Human
acucagcuguccugcagca

SEQ ID NO: 2641745 - RNA, 11 nt, Human
acucuguccag

SEQ ID NO: 2641746 - RNA, 22 nt, Human
acgcuuguagaacucacucugg

SEQ ID NO: 2641747 - RNA, 23 nt, Human
acgcuuguagaacucacucuggg

SEQ ID NO: 2641748 - RNA, 15 nt, Human
acggaaagugcuguc

SEQ ID NO: 2641749 - RNA, 14 nt, Human
accuguccccaccc

SEQ ID NO: 2641750 - RNA, 20 nt, Human
accuguccccacccuccacu

SEQ ID NO: 2641751 - RNA, 21 nt, Human
accuguccccacccuccacuc

SEQ ID NO: 2641752 - RNA, 22 nt, Human
accuguccccacccuccacuca

SEQ ID NO: 2641753 - RNA, 15 nt, Human
acuucuguaauugug

SEQ ID NO: 2641754 - RNA, 21 nt, Human
acuucuguaauuguguggauu

SEQ ID NO: 2641755 - RNA, 18 nt, Human
acugguagguugggacac

SEQ ID NO: 2641756 - RNA, 15 nt, Human
agaaaaucuuuauaa

SEQ ID NO: 2641757 - RNA, 15 nt, Human
acagccaaauuuaaa

SEQ ID NO: 2641758 - RNA, 14 nt, Human
acagccaaauuuaa

SEQ ID NO: 2641759 - RNA, 12 nt, Human
acccccuucccc

SEQ ID NO: 2641760 - RNA, 14 nt, Human
aaauuaaaugaauu

SEQ ID NO: 2641761 - RNA, 20 nt, Human
aaccuacaguuuuaacugug

SEQ ID NO: 2641762 - RNA, 12 nt, Human
aacucacucugg

SEQ ID NO: 2641763 - RNA, 13 nt, Human
aacucacucuggg

SEQ ID NO: 2641764 - RNA, 16 nt, Human
aacucacucugggcug

SEQ ID NO: 2641765 - RNA, 17 nt, Human
aacucacucugggcugu

SEQ ID NO: 2641766 - RNA, 20 nt, Human
aacgcucuagguacgaugac

SEQ ID NO: 2641767 - RNA, 22 nt, Human
aacgcuuguagaacucacucug

SEQ ID NO: 2641768 - RNA, 23 nt, Human
aacgcuuguagaacucacucugg

SEQ ID NO: 2641769 - RNA, 13 nt, Human
aaaguggaacgaa

SEQ ID NO: 2641770 - RNA, 20 nt, Human
aaaguggaacgaaaaugaaa

SEQ ID NO: 2641771 - RNA, 20 nt, Human
aaacacuccacccuccaccu

SEQ ID NO: 2641772 - RNA, 22 nt, Human
aaagaagagcgagagaucaaag

SEQ ID NO: 2641773 - RNA, 20 nt, Human
aagggaagaaggaggaaugc

SEQ ID NO: 2641774 - RNA, 20 nt, Human
aaguggaacgaaaaugaaag

SEQ ID NO: 2641775 - RNA, 20 nt, Human
aagauguuaugguguuuaga

SEQ ID NO: 2641776 - RNA, 20 nt, Human
aagauacuaaggacguuguu

SEQ ID NO: 2641777 - RNA, 16 nt, Human
aagauguuaugguguu

SEQ ID NO: 2641778 - RNA, 14 nt, Human
aaugcuggacugga

SEQ ID NO: 2641779 - RNA, 17 nt, Human
aaugcuggacuggaggc

SEQ ID NO: 2641780 - RNA, 22 nt, Human
aaugcuggacuggaggccccug

SEQ ID NO: 2641781 - RNA, 23 nt, Human
aaugcuggacuggaggccccugg

SEQ ID NO: 2641782 - RNA, 16 nt, Human
aauguuucuggauuuc

SEQ ID NO: 2641783 - RNA, 18 nt, Human
aaugaaagcuacucauag

SEQ ID NO: 2641784 - RNA, 14 nt, Human
aauagaaggugaug

SEQ ID NO: 2641785 - RNA, 13 nt, Human
aauagaaggugau

SEQ ID NO: 2641786 - RNA, 16 nt, Human
aauagaauuauaacug

SEQ ID NO: 2641787 - RNA, 18 nt, Human
agaggacucccaacccug

SEQ ID NO: 2641788 - RNA, 21 nt, Human
agaggacucccaacccuggcu

SEQ ID NO: 2641789 - RNA, 12 nt, Human
agccaaauuuaa

SEQ ID NO: 2641790 - RNA, 13 nt, Human
agccaaauuuaaa

SEQ ID NO: 2641791 - RNA, 19 nt, Human
agccaaauuuaaaacuguu

SEQ ID NO: 2641792 - RNA, 15 nt, Human
auaaauuuuuuauaa

SEQ ID NO: 2641793 - RNA, 14 nt, Human
aguuguguuucaac

SEQ ID NO: 2641794 - RNA, 23 nt, Human
aguuguguuucaacggaaagugc

SEQ ID NO: 2641795 - RNA, 22 nt, Human
agugucuguguuuugaaagaau

SEQ ID NO: 2641796 - RNA, 16 nt, Human
agugucuguguuuuga

SEQ ID NO: 2641797 - RNA, 20 nt, Human
auguucuauuuuuuguuuug

SEQ ID NO: 2641798 - RNA, 20 nt, Human
auggcuguguuugcagccug

SEQ ID NO: 2641799 - RNA, 21 nt, Human
auggcuguguuugcagccugc

SEQ ID NO: 2641800 - RNA, 17 nt, Human
aucauguggccccaccc

SEQ ID NO: 2641801 - RNA, 19 nt, Human
cuggacuggaggccccugg

SEQ ID NO: 2641802 - RNA, 15 nt, Human
cuguaacauucagga

SEQ ID NO: 2641803 - RNA, 13 nt, Human
cuuagggcacugg

SEQ ID NO: 2641804 - RNA, 17 nt, Human
cuuagggcacugggcug

SEQ ID NO: 2641805 - RNA, 18 nt, Human
cuuagggcacugggcugu

SEQ ID NO: 2641806 - RNA, 12 nt, Human
gaaacaaagaug

SEQ ID NO: 2641807 - RNA, 20 nt, Human
cuuucacuaaaacacacagg

SEQ ID NO: 2641808 - RNA, 15 nt, Human
cuuggggucaagaaa

SEQ ID NO: 2641809 - RNA, 15 nt, Human
gauuucauacuguaa

SEQ ID NO: 2641810 - RNA, 13 nt, Human
gcaccuccaggcc

SEQ ID NO: 2641811 - RNA, 15 nt, Human
gcaccuccaggccug

SEQ ID NO: 2641812 - RNA, 16 nt, Human
gcaccuccaggccugu

SEQ ID NO: 2641813 - RNA, 20 nt, Human
gcaccuccaggccuguugcu

SEQ ID NO: 2641814 - RNA, 20 nt, Human
gcauacaaguuucauucucc

SEQ ID NO: 2641815 - RNA, 17 nt, Human
gagcgagagaucaaaga

SEQ ID NO: 2641816 - RNA, 19 nt, Human
gagcgagagaucaaagaug

SEQ ID NO: 2641817 - RNA, 20 nt, Human
gagcgagagaucaaagauga

SEQ ID NO: 2641818 - RNA, 21 nt, Human
ggcacugguagguugggacac

SEQ ID NO: 2641819 - RNA, 14 nt, Human
ggcuccuguuuugc

SEQ ID NO: 2641820 - RNA, 15 nt, Human
ggcuccuguuuugca

SEQ ID NO: 2641821 - RNA, 16 nt, Human
gggacagcccagagcc

SEQ ID NO: 2641822 - RNA, 19 nt, Human
gggacagcccagagccugg

SEQ ID NO: 2641823 - RNA, 21 nt, Human
gggacagcccagagccuggcu

SEQ ID NO: 2641824 - RNA, 15 nt, Human
guaauuguguggauu

SEQ ID NO: 2641825 - RNA, 21 nt, Human
guaauuguguggauucuuuaa

SEQ ID NO: 2641826 - RNA, 12 nt, Human
guaauuuaacuu

SEQ ID NO: 2641827 - RNA, 16 nt, Human
guagaacucacucugg

SEQ ID NO: 2641828 - RNA, 17 nt, Human
guagaacucacucuggg

SEQ ID NO: 2641829 - RNA, 18 nt, Human
guagaacucacucugggc

SEQ ID NO: 2641830 - RNA, 19 nt, Human
guagaacucacucugggcu

SEQ ID NO: 2641831 - RNA, 20 nt, Human
guagaacucacucugggcug

SEQ ID NO: 2641832 - RNA, 21 nt, Human
guagaacucacucugggcugu

SEQ ID NO: 2641833 - RNA, 22 nt, Human
guagaacucacucugggcugua

SEQ ID NO: 2641834 - RNA, 19 nt, Human
gccugcccaguugcacuca

SEQ ID NO: 2641835 - RNA, 20 nt, Human
gccuguugcuauagagccua

SEQ ID NO: 2641836 - RNA, 18 nt, Human
ggacucccaacccuggcu

SEQ ID NO: 2641837 - RNA, 21 nt, Human
ggacucccaacccuggcuugg

SEQ ID NO: 2641838 - RNA, 14 nt, Human
ggacguuguuuugg

SEQ ID NO: 2641839 - RNA, 13 nt, Human
caugacagccucc

SEQ ID NO: 2641840 - RNA, 14 nt, Human
caugacagccucca

SEQ ID NO: 2641841 - RNA, 13 nt, Human
cauccauuaggcc

SEQ ID NO: 2641842 - RNA, 17 nt, Human
cauccauuaggccagca

SEQ ID NO: 2641843 - RNA, 20 nt, Human
cauccauuaggccagcaacg

SEQ ID NO: 2641844 - RNA, 16 nt, Human
cagcuguccugcagca

SEQ ID NO: 2641845 - RNA, 22 nt, Human
cagcuguccugcagcaaacacu

SEQ ID NO: 2641846 - RNA, 20 nt, Human
caggugcuaauuuguuuugg

SEQ ID NO: 2641847 - RNA, 23 nt, Human
auuucauacuguaacauucagga

SEQ ID NO: 2641848 - RNA, 18 nt, Human
auuaggccagcaacgcuu

SEQ ID NO: 2641849 - RNA, 20 nt, Human
caacaaagaaacaaagaugu

SEQ ID NO: 2641850 - RNA, 18 nt, Human
cacugguagguugggaca

SEQ ID NO: 2641851 - RNA, 19 nt, Human
cacugguagguugggacac

SEQ ID NO: 2641852 - RNA, 21 nt, Human
cacugguagguugggacacca

SEQ ID NO: 2641853 - RNA, 22 nt, Human
cacugguagguugggacaccag

SEQ ID NO: 2641854 - RNA, 13 nt, Human
caccagggaagaa

SEQ ID NO: 2641855 - RNA, 15 nt, Human
caccagggaagaaga

SEQ ID NO: 2641856 - RNA, 23 nt, Human
ccccagcccauccauuaggccag

SEQ ID NO: 2641857 - RNA, 18 nt, Human
cccuccuccagccccugu

SEQ ID NO: 2641858 - RNA, 19 nt, Human
cccuccuccagccccuguc

SEQ ID NO: 2641859 - RNA, 21 nt, Human
cccuccuccagccccuguccc

SEQ ID NO: 2641860 - RNA, 16 nt, Human
ccauccauuaggccag

SEQ ID NO: 2641861 - RNA, 17 nt, Human
ccauccauuaggccagc

SEQ ID NO: 2641862 - RNA, 18 nt, Human
ccauccauuaggccagca

SEQ ID NO: 2641863 - RNA, 18 nt, Human
ccaguugcacucagguga

SEQ ID NO: 2641864 - RNA, 13 nt, Human
cccacccuccacu

SEQ ID NO: 2641865 - RNA, 14 nt, Human
cccacccuccacuc

SEQ ID NO: 2641866 - RNA, 14 nt, Human
ccguaauuuaacuu

SEQ ID NO: 2641867 - RNA, 12 nt, Human
ccguaauuuaac

SEQ ID NO: 2641868 - RNA, 13 nt, Human
ccguaauuuaacu

SEQ ID NO: 2641869 - RNA, 13 nt, Human
ccuaauguguuua

SEQ ID NO: 2641870 - RNA, 16 nt, Human
ccgucuuuuccuguuu

SEQ ID NO: 2641871 - RNA, 17 nt, Human
cucaccugcacuaacag

SEQ ID NO: 2641872 - RNA, 20 nt, Human
cucaccugcacuaacagagu

SEQ ID NO: 2641873 - RNA, 15 nt, Human
cuaggccucuccagu

SEQ ID NO: 2641874 - RNA, 16 nt, Human
cuaggccucuccaguu

SEQ ID NO: 2641875 - RNA, 12 nt, Human
cguaauuuaacu

SEQ ID NO: 2641876 - RNA, 16 nt, Human
cuccaguuugcaccug

SEQ ID NO: 2641877 - RNA, 17 nt, Human
cuccaguuugcaccugu

SEQ ID NO: 2641878 - RNA, 18 nt, Human
cuccaguuugcaccuguc

SEQ ID NO: 2641879 - RNA, 20 nt, Human
cuccaguuugcaccuguccc

SEQ ID NO: 2641880 - RNA, 21 nt, Human
cuccaguuugcaccugucccc

SEQ ID NO: 2641881 - RNA, 13 nt, Human
aaccuuaagauac

SEQ ID NO: 2641882 - RNA, 20 nt, Human
guccugcagcaaacacucca

SEQ ID NO: 2641883 - RNA, 21 nt, Human
guccugcagcaaacacuccac

SEQ ID NO: 2641884 - RNA, 23 nt, Human
guccugcagcaaacacuccaccc

SEQ ID NO: 2641885 - RNA, 19 nt, Human
aacagguuauaacaguguu

SEQ ID NO: 2641886 - RNA, 19 nt, Human
aacagagacugaauagaua

SEQ ID NO: 2641887 - RNA, 22 nt, Human
guccuaaccucgggccugcugc

SEQ ID NO: 2641888 - RNA, 21 nt, Human
aagcaaacucuaaaauuauaa

SEQ ID NO: 2641889 - RNA, 15 nt, Human
aagaaaaucuuuaua

SEQ ID NO: 2641890 - RNA, 19 nt, Human
aacuugugucccuaaugug

SEQ ID NO: 2641891 - RNA, 21 nt, Human
guggcacugguagguugggac

SEQ ID NO: 2641892 - RNA, 22 nt, Human
guggcacugguagguugggaca

SEQ ID NO: 2641893 - RNA, 19 nt, Human
uaacaagaacuuuaaauug

SEQ ID NO: 2641894 - RNA, 22 nt, Human
aauaaauuuuuuauaaaagugu

SEQ ID NO: 2641895 - RNA, 13 nt, Human
uaaacuaaaugug

SEQ ID NO: 2641896 - RNA, 14 nt, Human
uaaacuaaaugugc

SEQ ID NO: 2641897 - RNA, 13 nt, Human
uaaaauuauuuca

SEQ ID NO: 2641898 - RNA, 23 nt, Human
aaguuucauucucccuuucacua

SEQ ID NO: 2641899 - RNA, 14 nt, Human
aaguguucauuguu

SEQ ID NO: 2641900 - RNA, 16 nt, Human
aaggauccggaaagaa

SEQ ID NO: 2641901 - RNA, 17 nt, Human
aaggauccggaaagaag

SEQ ID NO: 2641902 - RNA, 18 nt, Human
guuggggaagggccugcc

SEQ ID NO: 2641903 - RNA, 16 nt, Human
guuuuaacuguggaua

SEQ ID NO: 2641904 - RNA, 22 nt, Human
guuuuaacuguggauauuguua

SEQ ID NO: 2641905 - RNA, 14 nt, Human
guuucuggauuuca

SEQ ID NO: 2641906 - RNA, 11 nt, Human
guuugcagccu

SEQ ID NO: 2641907 - RNA, 21 nt, Human
aaggguguugggagggugguu

SEQ ID NO: 2641908 - RNA, 23 nt, Human
aagggccugcccaguugcacuca

SEQ ID NO: 2641909 - RNA, 24 nt, Human
uagcauuguaaaauuauuucauga

SEQ ID NO: 2641910 - RNA, 15 nt, Human
uagaacucacucugg

SEQ ID NO: 2641911 - RNA, 16 nt, Human
uagaacucacucuggg

SEQ ID NO: 2641912 - RNA, 17 nt, Human
uagaacucacucugggc

SEQ ID NO: 2641913 - RNA, 18 nt, Human
uagaacucacucugggcu

SEQ ID NO: 2641914 - RNA, 19 nt, Human
uagaacucacucugggcug

SEQ ID NO: 2641915 - RNA, 20 nt, Human
uagaacucacucugggcugu

SEQ ID NO: 2641916 - RNA, 12 nt, Human
uagaagccugca

SEQ ID NO: 2641917 - RNA, 17 nt, Human
aauuuguuuuggauaua

SEQ ID NO: 2641918 - RNA, 17 nt, Human
aauuuuuuauaaaagug

SEQ ID NO: 2641919 - RNA, 16 nt, Human
uacuguaacauucagg

SEQ ID NO: 2641920 - RNA, 15 nt, Human
aauuguguggauucu

SEQ ID NO: 2641921 - RNA, 19 nt, Human
aauuguguggauucuuuaa

SEQ ID NO: 2641922 - RNA, 21 nt, Human
uacguagccuaaggcuccugu

SEQ ID NO: 2641923 - RNA, 13 nt, Human
uacugaaucugcu

SEQ ID NO: 2641924 - RNA, 20 nt, Human
uauucaggacuugaaagaaa

SEQ ID NO: 2641925 - RNA, 22 nt, Human
uauugacuaacaggccaaagag

SEQ ID NO: 2641926 - RNA, 20 nt, Human
acagagacugaauagauaug

SEQ ID NO: 2641927 - RNA, 14 nt, Human
acagaguggccguc

SEQ ID NO: 2641928 - RNA, 10 nt, Human
acagcccaga

SEQ ID NO: 2641929 - RNA, 13 nt, Human
acagcccagagcc

SEQ ID NO: 2641930 - RNA, 15 nt, Human
acagcccagagccug

SEQ ID NO: 2641931 - RNA, 18 nt, Human
acagcccagagccuggcu

SEQ ID NO: 2641932 - RNA, 16 nt, Human
uauaacaguguuuaaa

SEQ ID NO: 2641933 - RNA, 19 nt, Human
uaguuauacuuauuuguau

SEQ ID NO: 2641934 - RNA, 15 nt, Human
acuaaaaaaaagaug

SEQ ID NO: 2641935 - RNA, 16 nt, Human
acuaaaaaaaagauga

SEQ ID NO: 2641936 - RNA, 17 nt, Human
acuaaaaaaaagaugaa

SEQ ID NO: 2641937 - RNA, 19 nt, Human
uccuucaugacagccucca

SEQ ID NO: 2641938 - RNA, 18 nt, Human
uccuguuuccuagcugug

SEQ ID NO: 2641939 - RNA, 21 nt, Human
uccuguuuugcacagccaaau

SEQ ID NO: 2641940 - RNA, 18 nt, Human
uccuguguguacucuguc

SEQ ID NO: 2641941 - RNA, 17 nt, Human
uccuguuuugcacagcc

SEQ ID NO: 2641942 - RNA, 12 nt, Human
acugcagcaccu

SEQ ID NO: 2641943 - RNA, 14 nt, Human
acugcagcaccucc

SEQ ID NO: 2641944 - RNA, 15 nt, Human
acugcagcaccucca

SEQ ID NO: 2641945 - RNA, 16 nt, Human
acugcagcaccuccag

SEQ ID NO: 2641946 - RNA, 18 nt, Human
acugcagcaccuccaggc

SEQ ID NO: 2641947 - RNA, 21 nt, Human
acugcagcaccuccaggccug

SEQ ID NO: 2641948 - RNA, 22 nt, Human
acugcagcaccuccaggccugu

SEQ ID NO: 2641949 - RNA, 13 nt, Human
uccugcagcaaac

SEQ ID NO: 2641950 - RNA, 19 nt, Human
uccugcagcaaacacucca

SEQ ID NO: 2641951 - RNA, 20 nt, Human
uccugcagcaaacacuccac

SEQ ID NO: 2641952 - RNA, 22 nt, Human
uccugcagcaaacacuccaccc

SEQ ID NO: 2641953 - RNA, 12 nt, Human
uccagccccugu

SEQ ID NO: 2641954 - RNA, 13 nt, Human
uccagccccuguc

SEQ ID NO: 2641955 - RNA, 14 nt, Human
uccagccccugucc

SEQ ID NO: 2641956 - RNA, 15 nt, Human
uccagccccuguccc

SEQ ID NO: 2641957 - RNA, 16 nt, Human
uccagccccuguccca

SEQ ID NO: 2641958 - RNA, 20 nt, Human
uccagccccugucccacccc

SEQ ID NO: 2641959 - RNA, 23 nt, Human
uccagccccugucccacccccuu

SEQ ID NO: 2641960 - RNA, 22 nt, Human
accuugaaaaaaaacaguggau

SEQ ID NO: 2641961 - RNA, 16 nt, Human
accuugaaaaaaaaca

SEQ ID NO: 2641962 - RNA, 18 nt, Human
accuugaaaaaaaacagu

SEQ ID NO: 2641963 - RNA, 14 nt, Human
ucaugacagccucc

SEQ ID NO: 2641964 - RNA, 15 nt, Human
accucgggccugcug

SEQ ID NO: 2641965 - RNA, 15 nt, Human
accagagagaguugu

SEQ ID NO: 2641966 - RNA, 21 nt, Human
uauuucaggcauuggauauuu

SEQ ID NO: 2641967 - RNA, 23 nt, Human
accauuuuguuauugacuaacag

SEQ ID NO: 2641968 - RNA, 12 nt, Human
acccuccaccuu

SEQ ID NO: 2641969 - RNA, 15 nt, Human
acccuccaccuucca

SEQ ID NO: 2641970 - RNA, 21 nt, Human
acccuccacucagcuguccug

SEQ ID NO: 2641971 - RNA, 20 nt, Human
ucaggcauuggauauuuuuu

SEQ ID NO: 2641972 - RNA, 22 nt, Human
agauggcaagagggugacagcu

SEQ ID NO: 2641973 - RNA, 16 nt, Human
agaucaacgccucacu

SEQ ID NO: 2641974 - RNA, 17 nt, Human
agaucaacgccucacug

SEQ ID NO: 2641975 - RNA, 15 nt, Human
ugaagccgacucugg

SEQ ID NO: 2641976 - RNA, 16 nt, Human
ugaagccgacucuggc

SEQ ID NO: 2641977 - RNA, 17 nt, Human
ugaagccgacucuggcc

SEQ ID NO: 2641978 - RNA, 18 nt, Human
ugaagccgacucuggccc

SEQ ID NO: 2641979 - RNA, 19 nt, Human
ugaagccgacucuggcccu

SEQ ID NO: 2641980 - RNA, 20 nt, Human
ugaagccgacucuggcccug

SEQ ID NO: 2641981 - RNA, 13 nt, Human
ucuggcccuggcc

SEQ ID NO: 2641982 - RNA, 14 nt, Human
ucuggcccuggccc

SEQ ID NO: 2641983 - RNA, 15 nt, Human
ucuggcccuggcccu

SEQ ID NO: 2641984 - RNA, 10 nt, Human
agaagccugc

SEQ ID NO: 2641985 - RNA, 11 nt, Human
agaagccugca

SEQ ID NO: 2641986 - RNA, 21 nt, Human
agaagccugcauaauguuucu

SEQ ID NO: 2641987 - RNA, 21 nt, Human
ucuccuucaugacagccucca

SEQ ID NO: 2641988 - RNA, 22 nt, Human
acuugugucccuaauguguuua

SEQ ID NO: 2641989 - RNA, 17 nt, Human
acuuuggggcuaauuua

SEQ ID NO: 2641990 - RNA, 17 nt, Human
ugcauaauguuucugga

SEQ ID NO: 2641991 - RNA, 18 nt, Human
ugcauaauguuucuggau

SEQ ID NO: 2641992 - RNA, 18 nt, Human
agccuaaggcuccuguuu

SEQ ID NO: 2641993 - RNA, 19 nt, Human
agccuaaggcuccuguuuu

SEQ ID NO: 2641994 - RNA, 17 nt, Human
ugcacuaacagaguggc

SEQ ID NO: 2641995 - RNA, 19 nt, Human
ugccauugggguaguugug

SEQ ID NO: 2641996 - RNA, 10 nt, Human
agccugcuca

SEQ ID NO: 2641997 - RNA, 12 nt, Human
ugccacuguugu

SEQ ID NO: 2641998 - RNA, 13 nt, Human
agcucucuaggcc

SEQ ID NO: 2641999 - RNA, 16 nt, Human
agcucucuaggccucu

SEQ ID NO: 2642000 - RNA, 17 nt, Human
agcucucuaggccucuc

SEQ ID NO: 2642001 - RNA, 18 nt, Human
agcucucuaggccucucc

SEQ ID NO: 2642002 - RNA, 19 nt, Human
agcucucuaggccucucca

SEQ ID NO: 2642003 - RNA, 22 nt, Human
agcucucuaggccucuccaguu

SEQ ID NO: 2642004 - RNA, 18 nt, Human
ugcuauagagccuaccug

SEQ ID NO: 2642005 - RNA, 21 nt, Human
uggcccuuacuugcuucucua

SEQ ID NO: 2642006 - RNA, 23 nt, Human
uggcccuuacuugcuucucuagc

SEQ ID NO: 2642007 - RNA, 14 nt, Human
aggccccuggagcc

SEQ ID NO: 2642008 - RNA, 16 nt, Human
aggccccuggagccag

SEQ ID NO: 2642009 - RNA, 20 nt, Human
uggcugacuuacaucaugug

SEQ ID NO: 2642010 - RNA, 16 nt, Human
uguaauuguguggauu

SEQ ID NO: 2642011 - RNA, 20 nt, Human
uguaauuguguggauucuuu

SEQ ID NO: 2642012 - RNA, 21 nt, Human
uguaauuguguggauucuuua

SEQ ID NO: 2642013 - RNA, 17 nt, Human
aggugcuaauuuguuuu

SEQ ID NO: 2642014 - RNA, 20 nt, Human
aggugcuaauuuguuuugga

SEQ ID NO: 2642015 - RNA, 23 nt, Human
aggugcuaauuuguuuuggauau

SEQ ID NO: 2642016 - RNA, 19 nt, Human
aguauaagacuacugaauc

SEQ ID NO: 2642017 - RNA, 23 nt, Human
agucacuggucuguuugcauuug

SEQ ID NO: 2642018 - RNA, 23 nt, Human
uguguuacuaaaaaaaagaugaa

SEQ ID NO: 2642019 - RNA, 14 nt, Human
uguggauucuuuaa

SEQ ID NO: 2642020 - RNA, 13 nt, Human
auagaaggugaug

SEQ ID NO: 2642021 - RNA, 19 nt, Human
auacuguauauucaggacu

SEQ ID NO: 2642022 - RNA, 13 nt, Human
aguuuuaacugug

SEQ ID NO: 2642023 - RNA, 18 nt, Human
aguuuuaacuguggauau

SEQ ID NO: 2642024 - RNA, 15 nt, Human
uuagggcacugggcu

SEQ ID NO: 2642025 - RNA, 16 nt, Human
uuauaaaaguguucau

SEQ ID NO: 2642026 - RNA, 12 nt, Human
uuauaaaagugu

SEQ ID NO: 2642027 - RNA, 23 nt, Human
uuagaagccugcauaauguuucu

SEQ ID NO: 2642028 - RNA, 18 nt, Human
uuggggaagggccugccc

SEQ ID NO: 2642029 - RNA, 18 nt, Human
aucugcuaccaaaacagu

SEQ ID NO: 2642030 - RNA, 17 nt, Human
uugaagccgacucuggc

SEQ ID NO: 2642031 - RNA, 18 nt, Human
uugaagccgacucuggcc

SEQ ID NO: 2642032 - RNA, 19 nt, Human
uugaagccgacucuggccc

SEQ ID NO: 2642033 - RNA, 23 nt, Human
aucuacuucuguaauugugugga

SEQ ID NO: 2642034 - RNA, 19 nt, Human
aucuacuucuguaauugug

SEQ ID NO: 2642035 - RNA, 20 nt, Human
aucuacuucuguaauugugu

SEQ ID NO: 2642036 - RNA, 13 nt, Human
auccggaaagaag

SEQ ID NO: 2642037 - RNA, 13 nt, Human
augugcaauagaa

SEQ ID NO: 2642038 - RNA, 18 nt, Human
augugcaauagaagguga

SEQ ID NO: 2642039 - RNA, 13 nt, Human
uuugacaguguuu

SEQ ID NO: 2642040 - RNA, 18 nt, Human
uuuaaagucucaguuucu

SEQ ID NO: 2642041 - RNA, 22 nt, Human
augauuagaaauuaccugugga

SEQ ID NO: 2642042 - RNA, 17 nt, Human
auggcaggggguggaau

SEQ ID NO: 2642043 - RNA, 24 nt, Human
auggcaggggguggaauuauuacu

SEQ ID NO: 2642044 - RNA, 18 nt, Human
auugaagccgacucuggc

SEQ ID NO: 2642045 - RNA, 22 nt, Human
auugaagccgacucuggcccug

SEQ ID NO: 2642046 - RNA, 15 nt, Human
auuuuucuuuaacug

SEQ ID NO: 2642047 - RNA, 16 nt, Human
auuuuucuuuaacugc

SEQ ID NO: 2642048 - RNA, 20 nt, Human
auuuucccccacuacugcag

SEQ ID NO: 2642049 - RNA, 21 nt, Human
auuuucccccacuacugcagc

SEQ ID NO: 2642050 - RNA, 11 nt, Human
auuuuguuuac

SEQ ID NO: 2642051 - RNA, 12 nt, Human
auuuuguuuaca

SEQ ID NO: 2642052 - RNA, 22 nt, Human
auuggauauuuuuuacuuuaga

SEQ ID NO: 2642053 - RNA, 11 nt, Human
auuggauauuu

SEQ ID NO: 2642054 - RNA, 16 nt, Human
cacagcauuguauaug

SEQ ID NO: 2642055 - RNA, 16 nt, Human
cacagccaaauuuaaa

SEQ ID NO: 2642056 - RNA, 20 nt, Human
cacaucacaagacuaugcca

SEQ ID NO: 2642057 - RNA, 12 nt, Human
caagaaacagcc

SEQ ID NO: 2642058 - RNA, 13 nt, Human
caagaaacagcca

SEQ ID NO: 2642059 - RNA, 14 nt, Human
caagaaacagccag

SEQ ID NO: 2642060 - RNA, 15 nt, Human
caagaaacagccagc

SEQ ID NO: 2642061 - RNA, 16 nt, Human
caagaaacagccagca

SEQ ID NO: 2642062 - RNA, 18 nt, Human
caagaaacagccagcaag

SEQ ID NO: 2642063 - RNA, 19 nt, Human
caagaaacagccagcaaga

SEQ ID NO: 2642064 - RNA, 19 nt, Human
caaauuuaaaacuguugga

SEQ ID NO: 2642065 - RNA, 16 nt, Human
caaagaaacaaagaug

SEQ ID NO: 2642066 - RNA, 17 nt, Human
caaagaaacaaagaugu

SEQ ID NO: 2642067 - RNA, 19 nt, Human
cacccaaucaagggaagaa

SEQ ID NO: 2642068 - RNA, 21 nt, Human
cacccaaucaagggaagaagg

SEQ ID NO: 2642069 - RNA, 12 nt, Human
cacccccuuccc

SEQ ID NO: 2642070 - RNA, 13 nt, Human
cacccccuucccc

SEQ ID NO: 2642071 - RNA, 14 nt, Human
cacccccuuccccc

SEQ ID NO: 2642072 - RNA, 22 nt, Human
ccauuuuguuauugacuaacag

SEQ ID NO: 2642073 - RNA, 23 nt, Human
ccauuuuguuauugacuaacagg

SEQ ID NO: 2642074 - RNA, 18 nt, Human
ccauuuuguuauugacua

SEQ ID NO: 2642075 - RNA, 22 nt, Human
ccauuuucccccacuacugcag

SEQ ID NO: 2642076 - RNA, 13 nt, Human
ccauuaggccagc

SEQ ID NO: 2642077 - RNA, 14 nt, Human
ccauuaggccagca

SEQ ID NO: 2642078 - RNA, 16 nt, Human
ccauuaggccagcaac

SEQ ID NO: 2642079 - RNA, 20 nt, Human
ccauuaggccagcaacgcuu

SEQ ID NO: 2642080 - RNA, 21 nt, Human
ccagcccauccauuaggccag

SEQ ID NO: 2642081 - RNA, 22 nt, Human
ccagcccauccauuaggccagc

SEQ ID NO: 2642082 - RNA, 21 nt, Human
ccagagccccuccuccagccc

SEQ ID NO: 2642083 - RNA, 19 nt, Human
ccagagccuggcugcccau

SEQ ID NO: 2642084 - RNA, 21 nt, Human
ccagagccuggcugcccauca

SEQ ID NO: 2642085 - RNA, 18 nt, Human
ccuaaccucgggccugcu

SEQ ID NO: 2642086 - RNA, 13 nt, Human
ccgacucuggccc

SEQ ID NO: 2642087 - RNA, 14 nt, Human
ccgacucuggcccu

SEQ ID NO: 2642088 - RNA, 19 nt, Human
ccgacucuggcccuggccc

SEQ ID NO: 2642089 - RNA, 20 nt, Human
cccuuacuugcuucucuagc

SEQ ID NO: 2642090 - RNA, 16 nt, Human
cccuucccccagccca

SEQ ID NO: 2642091 - RNA, 21 nt, Human
cccuucccccagcccauccau

SEQ ID NO: 2642092 - RNA, 13 nt, Human
ccccuccuccagc

SEQ ID NO: 2642093 - RNA, 17 nt, Human
ccccuccuccagccccu

SEQ ID NO: 2642094 - RNA, 22 nt, Human
ccccuccuccagccccuguccc

SEQ ID NO: 2642095 - RNA, 11 nt, Human
ccccuggagcc

SEQ ID NO: 2642096 - RNA, 19 nt, Human
cccaguugcacucagguga

SEQ ID NO: 2642097 - RNA, 20 nt, Human
cccaguugcacucaggugac

SEQ ID NO: 2642098 - RNA, 14 nt, Human
ccccacuacugcag

SEQ ID NO: 2642099 - RNA, 19 nt, Human
ccccacuacugcagcaccu

SEQ ID NO: 2642100 - RNA, 21 nt, Human
ccccacuacugcagcaccucc

SEQ ID NO: 2642101 - RNA, 23 nt, Human
ccccacuacugcagcaccuccag

SEQ ID NO: 2642102 - RNA, 15 nt, Human
ccccacccuccacuc

SEQ ID NO: 2642103 - RNA, 17 nt, Human
ccccacccuccacucag

SEQ ID NO: 2642104 - RNA, 15 nt, Human
cucaguuucuugcuu

SEQ ID NO: 2642105 - RNA, 14 nt, Human
cuccacucagcugu

SEQ ID NO: 2642106 - RNA, 15 nt, Human
cuccacucagcuguc

SEQ ID NO: 2642107 - RNA, 18 nt, Human
cuccacucagcuguccug

SEQ ID NO: 2642108 - RNA, 21 nt, Human
cuccacucagcuguccugcag

SEQ ID NO: 2642109 - RNA, 23 nt, Human
cuccacucagcuguccugcagca

SEQ ID NO: 2642110 - RNA, 14 nt, Human
cucccaacccuggc

SEQ ID NO: 2642111 - RNA, 16 nt, Human
cucccaacccuggcuu

SEQ ID NO: 2642112 - RNA, 12 nt, Human
cuccagccccug

SEQ ID NO: 2642113 - RNA, 16 nt, Human
cucagcuguccugcag

SEQ ID NO: 2642114 - RNA, 17 nt, Human
cucagcuguccugcagc

SEQ ID NO: 2642115 - RNA, 18 nt, Human
cucagcuguccugcagca

SEQ ID NO: 2642116 - RNA, 19 nt, Human
cucagcuguccugcagcaa

SEQ ID NO: 2642117 - RNA, 23 nt, Human
cuagcugugugaauaccugcuca

SEQ ID NO: 2642118 - RNA, 15 nt, Human
cuagcucucuaggcc

SEQ ID NO: 2642119 - RNA, 16 nt, Human
cuagcucucuaggccu

SEQ ID NO: 2642120 - RNA, 21 nt, Human
cuagcucucuaggccucucca

SEQ ID NO: 2642121 - RNA, 22 nt, Human
cuagcucucuaggccucuccag

SEQ ID NO: 2642122 - RNA, 13 nt, Human
cuacugcagcacc

SEQ ID NO: 2642123 - RNA, 18 nt, Human
cuacugcagcaccuccag

SEQ ID NO: 2642124 - RNA, 19 nt, Human
cuacugcagcaccuccagg

SEQ ID NO: 2642125 - RNA, 20 nt, Human
cuacugcagcaccuccaggc

SEQ ID NO: 2642126 - RNA, 21 nt, Human
cuacugcagcaccuccaggcc

SEQ ID NO: 2642127 - RNA, 22 nt, Human
cuacugcagcaccuccaggccu

SEQ ID NO: 2642128 - RNA, 16 nt, Human
cuaccgucuuuuccug

SEQ ID NO: 2642129 - RNA, 16 nt, Human
cuaaggcuccuguuuu

SEQ ID NO: 2642130 - RNA, 17 nt, Human
cuaaccucgggccugcu

SEQ ID NO: 2642131 - RNA, 14 nt, Human
cuaaaaaaaagaug

SEQ ID NO: 2642132 - RNA, 15 nt, Human
cuaaaaaaaagauga

SEQ ID NO: 2642133 - RNA, 15 nt, Human
cuacacucaccugca

SEQ ID NO: 2642134 - RNA, 22 nt, Human
ccuguaugucaauaaacaacag

SEQ ID NO: 2642135 - RNA, 12 nt, Human
ccugucccaccc

SEQ ID NO: 2642136 - RNA, 16 nt, Human
ccugucccacccccuu

SEQ ID NO: 2642137 - RNA, 19 nt, Human
ccugucccacccccuuccc

SEQ ID NO: 2642138 - RNA, 22 nt, Human
ccugucccacccccuuccccca

SEQ ID NO: 2642139 - RNA, 13 nt, Human
ccuguccccaccc

SEQ ID NO: 2642140 - RNA, 14 nt, Human
ccuguccccacccu

SEQ ID NO: 2642141 - RNA, 17 nt, Human
ccuguccccacccucca

SEQ ID NO: 2642142 - RNA, 19 nt, Human
ccuguccccacccuccacu

SEQ ID NO: 2642143 - RNA, 17 nt, Human
ccuucaugacagccucc

SEQ ID NO: 2642144 - RNA, 18 nt, Human
ccuucaugacagccucca

SEQ ID NO: 2642145 - RNA, 12 nt, Human
ccuguggauauu

SEQ ID NO: 2642146 - RNA, 16 nt, Human
cgagagaucaaagaug

SEQ ID NO: 2642147 - RNA, 17 nt, Human
cgagagaucaaagauga

SEQ ID NO: 2642148 - RNA, 13 nt, Human
gaaaaugaaagcu

SEQ ID NO: 2642149 - RNA, 19 nt, Human
gaaaaucuuuauaaaugua

SEQ ID NO: 2642150 - RNA, 20 nt, Human
cuucuguaauuguguggauu

SEQ ID NO: 2642151 - RNA, 15 nt, Human
cuucuguaauugugu

SEQ ID NO: 2642152 - RNA, 13 nt, Human
cuugaaagaaaug

SEQ ID NO: 2642153 - RNA, 14 nt, Human
cuugaaaaaaaaca

SEQ ID NO: 2642154 - RNA, 20 nt, Human
cuugaaaaaaaacaguggau

SEQ ID NO: 2642155 - RNA, 16 nt, Human
cuugaaaaaaaacagu

SEQ ID NO: 2642156 - RNA, 18 nt, Human
cuugaaaaaaaacagugg

SEQ ID NO: 2642157 - RNA, 16 nt, Human
cuuauuuguauauggu

SEQ ID NO: 2642158 - RNA, 16 nt, Human
cuguguuuugaaagaa

SEQ ID NO: 2642159 - RNA, 15 nt, Human
cuguguuugcagccu

SEQ ID NO: 2642160 - RNA, 20 nt, Human
cuguguuugcagccugcucu

SEQ ID NO: 2642161 - RNA, 23 nt, Human
cuguguuugcagccugcucuagu

SEQ ID NO: 2642162 - RNA, 20 nt, Human
cuguccaguuccuuuagaaa

SEQ ID NO: 2642163 - RNA, 14 nt, Human
cuguauauucagga

SEQ ID NO: 2642164 - RNA, 15 nt, Human
cugccguaauuuaac

SEQ ID NO: 2642165 - RNA, 14 nt, Human
gagagaucaaagau

SEQ ID NO: 2642166 - RNA, 15 nt, Human
gagagaucaaagaug

SEQ ID NO: 2642167 - RNA, 13 nt, Human
gacuugaaagaaa

SEQ ID NO: 2642168 - RNA, 15 nt, Human
gacuggaggccccug

SEQ ID NO: 2642169 - RNA, 16 nt, Human
gacuggaggccccugg

SEQ ID NO: 2642170 - RNA, 20 nt, Human
gacuggaggccccuggagcc

SEQ ID NO: 2642171 - RNA, 22 nt, Human
gacuggaggccccuggagccag

SEQ ID NO: 2642172 - RNA, 23 nt, Human
gacuggaggccccuggagccaga

SEQ ID NO: 2642173 - RNA, 11 nt, Human
gacagcccaga

SEQ ID NO: 2642174 - RNA, 13 nt, Human
gacagcccagagc

SEQ ID NO: 2642175 - RNA, 15 nt, Human
gacagcccagagccu

SEQ ID NO: 2642176 - RNA, 17 nt, Human
gacagcccagagccugg

SEQ ID NO: 2642177 - RNA, 20 nt, Human
gacaguguuccccgauacca

SEQ ID NO: 2642178 - RNA, 21 nt, Human
gacaguguuccccgauaccau

SEQ ID NO: 2642179 - RNA, 18 nt, Human
gaugcccagaggacuccc

SEQ ID NO: 2642180 - RNA, 19 nt, Human
gcacugguagguugggaca

SEQ ID NO: 2642181 - RNA, 22 nt, Human
gcacugguagguugggacacca

SEQ ID NO: 2642182 - RNA, 23 nt, Human
gcacugguagguugggacaccag

SEQ ID NO: 2642183 - RNA, 11 nt, Human
gcaccuguccc

SEQ ID NO: 2642184 - RNA, 15 nt, Human
gcaccuguccccacc

SEQ ID NO: 2642185 - RNA, 18 nt, Human
gcaccuguccccacccuc

SEQ ID NO: 2642186 - RNA, 20 nt, Human
gcaccuguccccacccucca

SEQ ID NO: 2642187 - RNA, 21 nt, Human
gcaccuguccccacccuccac

SEQ ID NO: 2642188 - RNA, 23 nt, Human
gcaccuguccccacccuccacuc

SEQ ID NO: 2642189 - RNA, 15 nt, Human
gauaugaaagcugau

SEQ ID NO: 2642190 - RNA, 18 nt, Human
gagggugacagcuuccuu

SEQ ID NO: 2642191 - RNA, 20 nt, Human
gagggugguucaacaaagaa

SEQ ID NO: 2642192 - RNA, 12 nt, Human
ggcccuggcccu

SEQ ID NO: 2642193 - RNA, 20 nt, Human
ggaauggauuuuucuuuaac

SEQ ID NO: 2642194 - RNA, 22 nt, Human
ggaauggauuuuucuuuaacug

SEQ ID NO: 2642195 - RNA, 19 nt, Human
ggaauggauuuuucuuuaa

SEQ ID NO: 2642196 - RNA, 14 nt, Human
ggaaugcuggacug

SEQ ID NO: 2642197 - RNA, 17 nt, Human
ggacuggaggccccugg

SEQ ID NO: 2642198 - RNA, 21 nt, Human
ggacuggaggccccuggagcc

SEQ ID NO: 2642199 - RNA, 12 nt, Human
gccucacugaaa

SEQ ID NO: 2642200 - RNA, 20 nt, Human
gccucacugaaacauggcug

SEQ ID NO: 2642201 - RNA, 14 nt, Human
gcagacguccauca

SEQ ID NO: 2642202 - RNA, 13 nt, Human
gccccuccuccag

SEQ ID NO: 2642203 - RNA, 15 nt, Human
gccccuccuccagcc

SEQ ID NO: 2642204 - RNA, 18 nt, Human
gccccuccuccagccccu

SEQ ID NO: 2642205 - RNA, 20 nt, Human
gccccuccuccagccccugu

SEQ ID NO: 2642206 - RNA, 21 nt, Human
gccccuccuccagccccuguc

SEQ ID NO: 2642207 - RNA, 15 nt, Human
gcucucuaggccucu

SEQ ID NO: 2642208 - RNA, 18 nt, Human
gcucucuaggccucucca

SEQ ID NO: 2642209 - RNA, 19 nt, Human
gcucucuaggccucuccag

SEQ ID NO: 2642210 - RNA, 15 nt, Human
guacgaugacagugu

SEQ ID NO: 2642211 - RNA, 23 nt, Human
guacgaaccuacaguuuuaacug

SEQ ID NO: 2642212 - RNA, 18 nt, Human
gguuuacucacugcugca

SEQ ID NO: 2642213 - RNA, 17 nt, Human
gguuuaagaaauagaau

SEQ ID NO: 2642214 - RNA, 23 nt, Human
gguucaacaaagaaacaaagaug

SEQ ID NO: 2642215 - RNA, 18 nt, Human
guaaggauccggaaagaa

SEQ ID NO: 2642216 - RNA, 19 nt, Human
guaaggauccggaaagaag

SEQ ID NO: 2642217 - RNA, 15 nt, Human
ggguuuauucacuga

SEQ ID NO: 2642218 - RNA, 14 nt, Human
ggucaagaaacagc

SEQ ID NO: 2642219 - RNA, 18 nt, Human
ggucaagaaacagccagc

SEQ ID NO: 2642220 - RNA, 19 nt, Human
ggucaagaaacagccagca

SEQ ID NO: 2642221 - RNA, 21 nt, Human
ggucaagaaacagccagcaag

SEQ ID NO: 2642222 - RNA, 17 nt, Human
gggccuuagggcacugg

SEQ ID NO: 2642223 - RNA, 21 nt, Human
gggccuuagggcacugggcug

SEQ ID NO: 2642224 - RNA, 19 nt, Human
gggcuguaacguggcacug

SEQ ID NO: 2642225 - RNA, 18 nt, Human
gucaagaaacagccagca

SEQ ID NO: 2642226 - RNA, 19 nt, Human
guauuuauuuuuucuuuuc

SEQ ID NO: 2642227 - RNA, 21 nt, Human
guauucccaaaaauuacuuug

SEQ ID NO: 2642228 - RNA, 15 nt, Human
gugaauaccugcuca

SEQ ID NO: 2642229 - RNA, 23 nt, Human
guggaucacaaaguggaacgaaa

SEQ ID NO: 2642230 - RNA, 14 nt, Human
guggauauuguuac

SEQ ID NO: 2642231 - RNA, 16 nt, Human
guggauauuuguauaa

SEQ ID NO: 2642232 - RNA, 19 nt, Human
guggauccaaacugaucca

SEQ ID NO: 2642233 - RNA, 16 nt, Human
guggaacgaaaaugaa

SEQ ID NO: 2642234 - RNA, 12 nt, Human
guggccccaccc

SEQ ID NO: 2642235 - RNA, 13 nt, Human
ucuagugggacag

SEQ ID NO: 2642236 - RNA, 15 nt, Human
ucuagugggacagcc

SEQ ID NO: 2642237 - RNA, 19 nt, Human
ucuagugggacagcccaga

SEQ ID NO: 2642238 - RNA, 24 nt, Human
ucuagugggacagcccagagccug

SEQ ID NO: 2642239 - RNA, 18 nt, Human
uccuccagccccuguccc

SEQ ID NO: 2642240 - RNA, 12 nt, Human
uccuccagcccc

SEQ ID NO: 2642241 - RNA, 14 nt, Human
uccuccagccccug

SEQ ID NO: 2642242 - RNA, 15 nt, Human
uccuccagccccugu

SEQ ID NO: 2642243 - RNA, 17 nt, Human
uccaguuugcaccuguc

SEQ ID NO: 2642244 - RNA, 18 nt, Human
uccaguuugcaccugucc

SEQ ID NO: 2642245 - RNA, 19 nt, Human
uccaguuugcaccuguccc

SEQ ID NO: 2642246 - RNA, 15 nt, Human
uccaguuccuuuaga

SEQ ID NO: 2642247 - RNA, 17 nt, Human
uccaguuccuuuagaaa

SEQ ID NO: 2642248 - RNA, 19 nt, Human
uccaucacguuagcugucc

SEQ ID NO: 2642249 - RNA, 15 nt, Human
uccagauaguguagc

SEQ ID NO: 2642250 - RNA, 22 nt, Human
uccagauaguguagcugaggag

SEQ ID NO: 2642251 - RNA, 14 nt, Human
uccauuaggccagc

SEQ ID NO: 2642252 - RNA, 15 nt, Human
uccauuaggccagca

SEQ ID NO: 2642253 - RNA, 17 nt, Human
uccauuaggccagcaac

SEQ ID NO: 2642254 - RNA, 20 nt, Human
uccauuaggccagcaacgcu

SEQ ID NO: 2642255 - RNA, 18 nt, Human
ucaggaauucuuggagaa

SEQ ID NO: 2642256 - RNA, 16 nt, Human
ucaggaauucuuggag

SEQ ID NO: 2642257 - RNA, 15 nt, Human
ucagcuguccugcag

SEQ ID NO: 2642258 - RNA, 17 nt, Human
ucagcuguccugcagca

SEQ ID NO: 2642259 - RNA, 18 nt, Human
ucagcuguccugcagcaa

SEQ ID NO: 2642260 - RNA, 19 nt, Human
ucagcuguccugcagcaaa

SEQ ID NO: 2642261 - RNA, 20 nt, Human
ucuugcuuggggaacuugug

SEQ ID NO: 2642262 - RNA, 15 nt, Human
ugaaagcuacucaua

SEQ ID NO: 2642263 - RNA, 23 nt, Human
ugauuagaaauuaccuguggaua

SEQ ID NO: 2642264 - RNA, 17 nt, Human
ugcucacgucaaaugca

SEQ ID NO: 2642265 - RNA, 14 nt, Human
ugcucuagugggac

SEQ ID NO: 2642266 - RNA, 16 nt, Human
ugcucuagugggacag

SEQ ID NO: 2642267 - RNA, 18 nt, Human
ugcucuagugggacagcc

SEQ ID NO: 2642268 - RNA, 16 nt, Human
ugcauuugauacauuu

SEQ ID NO: 2642269 - RNA, 21 nt, Human
ugcccagaggacucccaaccc

SEQ ID NO: 2642270 - RNA, 18 nt, Human
uggauuuuucuuuaacug

SEQ ID NO: 2642271 - RNA, 17 nt, Human
uggacuggaggccccug

SEQ ID NO: 2642272 - RNA, 21 nt, Human
uggacuggaggccccuggagc

SEQ ID NO: 2642273 - RNA, 23 nt, Human
uggacuggaggccccuggagcca

SEQ ID NO: 2642274 - RNA, 13 nt, Human
uuaaaagccugcu

SEQ ID NO: 2642275 - RNA, 12 nt, Human
uuaacuguggau

SEQ ID NO: 2642276 - RNA, 13 nt, Human
uuaacuguggaua

SEQ ID NO: 2642277 - RNA, 15 nt, Human
uuaacuguggauauu

SEQ ID NO: 2642278 - RNA, 19 nt, Human
uuaacugccguaauuuaac

SEQ ID NO: 2642279 - RNA, 10 nt, Human
uuaggccagc

SEQ ID NO: 2642280 - RNA, 17 nt, Human
uuaggccagcaacgcuu

SEQ ID NO: 2642281 - RNA, 13 nt, Human
uuacuugcuucuc

SEQ ID NO: 2642282 - RNA, 14 nt, Human
uuacuugcuucucu

SEQ ID NO: 2642283 - RNA, 15 nt, Human
uuacuugcuucucua

SEQ ID NO: 2642284 - RNA, 21 nt, Human
uuacuuuggggcuaauuuaac

SEQ ID NO: 2642285 - RNA, 18 nt, Human
uuacuuuagaagccugca

SEQ ID NO: 2642286 - RNA, 16 nt, Human
uuagaccuguguuacu

SEQ ID NO: 2642287 - RNA, 17 nt, Human
uucccccacuacugcag

SEQ ID NO: 2642288 - RNA, 18 nt, Human
uucccccacuacugcagc

SEQ ID NO: 2642289 - RNA, 13 nt, Human
uucccccagccca

SEQ ID NO: 2642290 - RNA, 16 nt, Human
uucaacggaaagugcu

SEQ ID NO: 2642291 - RNA, 15 nt, Human
uuuaaaacuguugga

SEQ ID NO: 2642292 - RNA, 22 nt, Human
uuuaaaacuguuggaauggauu

SEQ ID NO: 2642293 - RNA, 14 nt, Human
uuuaaaagccugcu

SEQ ID NO: 2642294 - RNA, 13 nt, Human
uuuaaaagccugc

SEQ ID NO: 2642295 - RNA, 15 nt, Human
uugcagccugcucua

SEQ ID NO: 2642296 - RNA, 22 nt, Human
uugcagccugcucuagugggac

SEQ ID NO: 2642297 - RNA, 23 nt, Human
uugcagccugcucuagugggaca

SEQ ID NO: 2642298 - RNA, 12 nt, Human
uucuuuaacugc

SEQ ID NO: 2642299 - RNA, 19 nt, Human
uucuuuaacugccguaauu

SEQ ID NO: 2642300 - RNA, 19 nt, Human
uuggauuuaaaagccugcu

SEQ ID NO: 2642301 - RNA, 21 nt, Human
uuggauuuaaaagccugcuca

SEQ ID NO: 2642302 - RNA, 17 nt, Human
uuguaaaauuauuucau

SEQ ID NO: 2642303 - RNA, 17 nt, Human
uuguagaacucacucug

SEQ ID NO: 2642304 - RNA, 19 nt, Human
uuguagaacucacucuggg

SEQ ID NO: 2642305 - RNA, 20 nt, Human
uuguagaacucacucugggc

SEQ ID NO: 2642306 - RNA, 22 nt, Human
uuguagaacucacucugggcug

SEQ ID NO: 2642307 - RNA, 14 nt, Human
uugggacaccaggg

SEQ ID NO: 2642308 - RNA, 16 nt, Human
aguuugcaccuguccc

SEQ ID NO: 2642309 - RNA, 13 nt, Human
aguuucuugcuug

SEQ ID NO: 2642310 - RNA, 15 nt, Human
agugggacagcccag

SEQ ID NO: 2642311 - RNA, 22 nt, Human
agugggacagcccagagccugg

SEQ ID NO: 2642312 - RNA, 12 nt, Human
auguuucuggau

SEQ ID NO: 2642313 - RNA, 15 nt, Human
aucuauaaacuauaa

SEQ ID NO: 2642314 - RNA, 12 nt, Human
aucaaagaugaa

SEQ ID NO: 2642315 - RNA, 19 nt, Human
agguacgaugacaguguuc

SEQ ID NO: 2642316 - RNA, 18 nt, Human
agcuucacaguacccaaa

SEQ ID NO: 2642317 - RNA, 17 nt, Human
agccuggcugcccauca

SEQ ID NO: 2642318 - RNA, 22 nt, Human
aaacugauccaguauaagacua

SEQ ID NO: 2642319 - RNA, 14 nt, Human
aaacagccagcaag

SEQ ID NO: 2642320 - RNA, 16 nt, Human
aacgaaaaugaaagcu

SEQ ID NO: 2642321 - RNA, 13 nt, Human
aauagaacacagu

SEQ ID NO: 2642322 - RNA, 19 nt, Human
aacuguuggaauggauuuu

SEQ ID NO: 2642323 - RNA, 18 nt, Human
acaggugcuaauuuguuu

SEQ ID NO: 2642324 - RNA, 18 nt, Human
acaaagaaacaaagaugu

SEQ ID NO: 2642325 - RNA, 17 nt, Human
acaaagaaacaaagaug

SEQ ID NO: 2642326 - RNA, 20 nt, Human
acaaagaaacaaagauguua

SEQ ID NO: 2642327 - RNA, 22 nt, Human
acugcaaaaagaaaaucuuuau

SEQ ID NO: 2642328 - RNA, 12 nt, Human
acugauuucaga

SEQ ID NO: 2642329 - RNA, 15 nt, Human
acugauuucagagug

SEQ ID NO: 2642330 - RNA, 13 nt, Human
acguggcacuggu

SEQ ID NO: 2642331 - RNA, 22 nt, Human
cugcuuuuuccaacucagaaau

SEQ ID NO: 2642332 - RNA, 13 nt, Human
cuguccugcagca

SEQ ID NO: 2642333 - RNA, 14 nt, Human
cuguccugcagcaa

SEQ ID NO: 2642334 - RNA, 15 nt, Human
cuguccugcagcaaa

SEQ ID NO: 2642335 - RNA, 16 nt, Human
cuguccugcagcaaac

SEQ ID NO: 2642336 - RNA, 23 nt, Human
cuguccugcagcaaacacuccac

SEQ ID NO: 2642337 - RNA, 15 nt, Human
cuguaaaacagguua

SEQ ID NO: 2642338 - RNA, 21 nt, Human
cuuuccuguguguacucuguc

SEQ ID NO: 2642339 - RNA, 16 nt, Human
gaaaaaaaacagugga

SEQ ID NO: 2642340 - RNA, 16 nt, Human
cuucaugacagccucc

SEQ ID NO: 2642341 - RNA, 16 nt, Human
gauccaguauaagacu

SEQ ID NO: 2642342 - RNA, 17 nt, Human
gauccaguauaagacua

SEQ ID NO: 2642343 - RNA, 15 nt, Human
gauuagaaauuaccu

SEQ ID NO: 2642344 - RNA, 20 nt, Human
gauuagaaauuaccugugga

SEQ ID NO: 2642345 - RNA, 22 nt, Human
gauuagaaauuaccuguggaua

SEQ ID NO: 2642346 - RNA, 19 nt, Human
gauaccaugcuguaaggau

SEQ ID NO: 2642347 - RNA, 13 nt, Human
gauacuaaggacg

SEQ ID NO: 2642348 - RNA, 12 nt, Human
gacucuggcccu

SEQ ID NO: 2642349 - RNA, 13 nt, Human
gacucuggcccug

SEQ ID NO: 2642350 - RNA, 14 nt, Human
gacucuggcccugg

SEQ ID NO: 2642351 - RNA, 16 nt, Human
gacucuggcccuggcc

SEQ ID NO: 2642352 - RNA, 17 nt, Human
gacucuggcccuggccc

SEQ ID NO: 2642353 - RNA, 18 nt, Human
gacucuggcccuggcccu

SEQ ID NO: 2642354 - RNA, 14 nt, Human
gaauuauaacugua

SEQ ID NO: 2642355 - RNA, 13 nt, Human
gaauuauaacugu

SEQ ID NO: 2642356 - RNA, 21 nt, Human
gaauuauaacuguaaagaugu

SEQ ID NO: 2642357 - RNA, 19 nt, Human
aaaacaguggaucacaaag

SEQ ID NO: 2642358 - RNA, 23 nt, Human
aaacaguggaucacaaaguggaa

SEQ ID NO: 2642359 - RNA, 13 nt, Human
gggcuaauuuaac

SEQ ID NO: 2642360 - RNA, 14 nt, Human
aaaaugaaagcuac

SEQ ID NO: 2642361 - RNA, 19 nt, Human
aaaaugaaagcuacucaua

SEQ ID NO: 2642362 - RNA, 21 nt, Human
guaaagauguuuauuucaggc

SEQ ID NO: 2642363 - RNA, 21 nt, Human
aaagugugaaauaaauuuuuu

SEQ ID NO: 2642364 - RNA, 12 nt, Human
ggucuguuugca

SEQ ID NO: 2642365 - RNA, 15 nt, Human
ggaggccccuggagc

SEQ ID NO: 2642366 - RNA, 18 nt, Human
ggaggccccuggagccag

SEQ ID NO: 2642367 - RNA, 16 nt, Human
ggaggaaugcuggacu

SEQ ID NO: 2642368 - RNA, 12 nt, Human
ggcacugggcug

SEQ ID NO: 2642369 - RNA, 13 nt, Human
ggcacugggcugu

SEQ ID NO: 2642370 - RNA, 22 nt, Human
ggcacugggcuguuguuccauu

SEQ ID NO: 2642371 - RNA, 13 nt, Human
ggccccuggagcc

SEQ ID NO: 2642372 - RNA, 20 nt, Human
ggcccuuacuugcuucucua

SEQ ID NO: 2642373 - RNA, 15 nt, Human
ggccuguugcuauag

SEQ ID NO: 2642374 - RNA, 14 nt, Human
ggaagaaggaggaa

SEQ ID NO: 2642375 - RNA, 19 nt, Human
gcucuagguacgaugacag

SEQ ID NO: 2642376 - RNA, 14 nt, Human
gcucuagugggaca

SEQ ID NO: 2642377 - RNA, 15 nt, Human
gcucuagugggacag

SEQ ID NO: 2642378 - RNA, 20 nt, Human
gcucuagugggacagcccag

SEQ ID NO: 2642379 - RNA, 21 nt, Human
gcucuagugggacagcccaga

SEQ ID NO: 2642380 - RNA, 13 nt, Human
gccccuggagcca

SEQ ID NO: 2642381 - RNA, 14 nt, Human
gccccuggagccag

SEQ ID NO: 2642382 - RNA, 15 nt, Human
gccccuggagccaga

SEQ ID NO: 2642383 - RNA, 12 nt, Human
gcguggcugacu

SEQ ID NO: 2642384 - RNA, 20 nt, Human
gcuaauuuguuuuggauaua

SEQ ID NO: 2642385 - RNA, 19 nt, Human
gcgagagaucaaagaugaa

SEQ ID NO: 2642386 - RNA, 20 nt, Human
auuguaaaauuauuucauga

SEQ ID NO: 2642387 - RNA, 19 nt, Human
auuguguggauucuuuaaa

SEQ ID NO: 2642388 - RNA, 19 nt, Human
auuguuacguagccuaagg

SEQ ID NO: 2642389 - RNA, 19 nt, Human
auugauaaccuugaaaaaa

SEQ ID NO: 2642390 - RNA, 13 nt, Human
cacccuccaccuu

SEQ ID NO: 2642391 - RNA, 17 nt, Human
cacccuccaccuuccau

SEQ ID NO: 2642392 - RNA, 15 nt, Human
cacccuccacucagc

SEQ ID NO: 2642393 - RNA, 19 nt, Human
cacaggugcaacagacuug

SEQ ID NO: 2642394 - RNA, 19 nt, Human
cacaguacgaaccuacagu

SEQ ID NO: 2642395 - RNA, 17 nt, Human
cauggcuguguuugcag

SEQ ID NO: 2642396 - RNA, 20 nt, Human
cauggcuguguuugcagccu

SEQ ID NO: 2642397 - RNA, 23 nt, Human
cauggcuguguuugcagccugcu

SEQ ID NO: 2642398 - RNA, 16 nt, Human
cauuaggccagcaacg

SEQ ID NO: 2642399 - RNA, 20 nt, Human
cauuaggccagcaacgcuug

SEQ ID NO: 2642400 - RNA, 20 nt, Human
cauuuuuguacuaacuagca

SEQ ID NO: 2642401 - RNA, 18 nt, Human
cauagcgggggccuaaaa

SEQ ID NO: 2642402 - RNA, 18 nt, Human
caguuuguagugccacug

SEQ ID NO: 2642403 - RNA, 18 nt, Human
caguuugcaccugucccc

SEQ ID NO: 2642404 - RNA, 17 nt, Human
cagagccuggcugccca

SEQ ID NO: 2642405 - RNA, 16 nt, Human
ccugcccaguugcacu

SEQ ID NO: 2642406 - RNA, 22 nt, Human
ccugcccaguugcacucaggug

SEQ ID NO: 2642407 - RNA, 12 nt, Human
ccuggcccuuac

SEQ ID NO: 2642408 - RNA, 18 nt, Human
ccuggcccuuacuugcuu

SEQ ID NO: 2642409 - RNA, 19 nt, Human
ccccagagccccuccucca

SEQ ID NO: 2642410 - RNA, 21 nt, Human
ccccagagccccuccuccagc

SEQ ID NO: 2642411 - RNA, 15 nt, Human
cccacuacugcagca

SEQ ID NO: 2642412 - RNA, 18 nt, Human
cccacuacugcagcaccu

SEQ ID NO: 2642413 - RNA, 17 nt, Human
ccaguuugcaccugucc

SEQ ID NO: 2642414 - RNA, 22 nt, Human
cuagcauuguaaaauuauuuca

SEQ ID NO: 2642415 - RNA, 23 nt, Human
cuagcauuguaaaauuauuucau

SEQ ID NO: 2642416 - RNA, 19 nt, Human
cuacaguuuuaacugugga

SEQ ID NO: 2642417 - RNA, 17 nt, Human
cuacaguuuuaacugug

SEQ ID NO: 2642418 - RNA, 18 nt, Human
cuacaguuuuaacugugg

SEQ ID NO: 2642419 - RNA, 20 nt, Human
cuacaguuuuaacuguggau

SEQ ID NO: 2642420 - RNA, 11 nt, Human
cuaauuuaaca

SEQ ID NO: 2642421 - RNA, 14 nt, Human
aacuguaaagaugu

SEQ ID NO: 2642422 - RNA, 16 nt, Human
aaccucgggccugcug

SEQ ID NO: 2642423 - RNA, 17 nt, Human
aaccuugaaaaaaaaca

SEQ ID NO: 2642424 - RNA, 20 nt, Human
aaccuugaaaaaaaacagug

SEQ ID NO: 2642425 - RNA, 22 nt, Human
guaugucaauaaacaacagcug

SEQ ID NO: 2642426 - RNA, 19 nt, Human
gucccacccccuuccccca

SEQ ID NO: 2642427 - RNA, 17 nt, Human
guuggaauggauuuuuc

SEQ ID NO: 2642428 - RNA, 15 nt, Human
guuggaauggauuuu

SEQ ID NO: 2642429 - RNA, 22 nt, Human
guuuugcacagccaaauuuaaa

SEQ ID NO: 2642430 - RNA, 14 nt, Human
aagccgacucuggc

SEQ ID NO: 2642431 - RNA, 16 nt, Human
aagccgacucuggccc

SEQ ID NO: 2642432 - RNA, 17 nt, Human
aagccgacucuggcccu

SEQ ID NO: 2642433 - RNA, 18 nt, Human
aagccgacucuggcccug

SEQ ID NO: 2642434 - RNA, 19 nt, Human
aagccgacucuggcccugg

SEQ ID NO: 2642435 - RNA, 21 nt, Human
aagccgacucuggcccuggcc

SEQ ID NO: 2642436 - RNA, 13 nt, Human
guucaacaaagaa

SEQ ID NO: 2642437 - RNA, 22 nt, Human
guucaacaaagaaacaaagaug

SEQ ID NO: 2642438 - RNA, 23 nt, Human
guucaacaaagaaacaaagaugu

SEQ ID NO: 2642439 - RNA, 12 nt, Human
aauaccugcuca

SEQ ID NO: 2642440 - RNA, 19 nt, Human
aauauauuuuguuuacaaa

SEQ ID NO: 2642441 - RNA, 18 nt, Human
uaagcagugucuguguuu

SEQ ID NO: 2642442 - RNA, 17 nt, Human
uaaggauccggaaagaa

SEQ ID NO: 2642443 - RNA, 18 nt, Human
uaaggauccggaaagaag

SEQ ID NO: 2642444 - RNA, 11 nt, Human
uaauuuaacuu

SEQ ID NO: 2642445 - RNA, 19 nt, Human
uaauuuaacuuucuggguu

SEQ ID NO: 2642446 - RNA, 12 nt, Human
uaccuguggaua

SEQ ID NO: 2642447 - RNA, 21 nt, Human
aauuaccaugcuucacaaugu

SEQ ID NO: 2642448 - RNA, 22 nt, Human
aauuacuuuggggcuaauuuaa

SEQ ID NO: 2642449 - RNA, 23 nt, Human
aauuacuuuggggcuaauuuaac

SEQ ID NO: 2642450 - RNA, 17 nt, Human
aauucaauuuggauuua

SEQ ID NO: 2642451 - RNA, 22 nt, Human
aauuauuucaugauuagaaauu

SEQ ID NO: 2642452 - RNA, 18 nt, Human
uaccaugcuucacaaugu

SEQ ID NO: 2642453 - RNA, 18 nt, Human
acagcuuccuuuccugug

SEQ ID NO: 2642454 - RNA, 19 nt, Human
uaugccauugggguaguug

SEQ ID NO: 2642455 - RNA, 21 nt, Human
uaugguauuuauuuuuucuuu

SEQ ID NO: 2642456 - RNA, 13 nt, Human
uagggcacugggc

SEQ ID NO: 2642457 - RNA, 14 nt, Human
uagggcacugggcu

SEQ ID NO: 2642458 - RNA, 15 nt, Human
uagggcacugggcug

SEQ ID NO: 2642459 - RNA, 16 nt, Human
uagggcacugggcugu

SEQ ID NO: 2642460 - RNA, 12 nt, Human
aauuuggauuua

SEQ ID NO: 2642461 - RNA, 23 nt, Human
aauuuggauuuaaaagccugcuc

SEQ ID NO: 2642462 - RNA, 17 nt, Human
uacuuuggaauucuuag

SEQ ID NO: 2642463 - RNA, 20 nt, Human
uacuuuggggcuaauuuaac

SEQ ID NO: 2642464 - RNA, 18 nt, Human
ucccccacuacugcagca

SEQ ID NO: 2642465 - RNA, 24 nt, Human
ucccccacuacugcagcaccucca

SEQ ID NO: 2642466 - RNA, 16 nt, Human
acuccacccuccaccu

SEQ ID NO: 2642467 - RNA, 13 nt, Human
acucagaaauuca

SEQ ID NO: 2642468 - RNA, 22 nt, Human
acucaccugcacuaacagagug

SEQ ID NO: 2642469 - RNA, 17 nt, Human
acugaaacauggcugug

SEQ ID NO: 2642470 - RNA, 13 nt, Human
uccuaccgucuuu

SEQ ID NO: 2642471 - RNA, 14 nt, Human
uccauuuuccccca

SEQ ID NO: 2642472 - RNA, 17 nt, Human
uccauuuucccccacua

SEQ ID NO: 2642473 - RNA, 21 nt, Human
uccauuuucccccacuacugc

SEQ ID NO: 2642474 - RNA, 19 nt, Human
acgaaccuacaguuuuaac

SEQ ID NO: 2642475 - RNA, 20 nt, Human
accugcucacgucaaaugca

SEQ ID NO: 2642476 - RNA, 16 nt, Human
accugcucacgucaaa

SEQ ID NO: 2642477 - RNA, 18 nt, Human
acauucaacagagacuga

SEQ ID NO: 2642478 - RNA, 18 nt, Human
uauuuguauaaaagugug

SEQ ID NO: 2642479 - RNA, 22 nt, Human
uauuuguauaaaagugugaaau

SEQ ID NO: 2642480 - RNA, 14 nt, Human
ucacugaaacaugg

SEQ ID NO: 2642481 - RNA, 22 nt, Human
ucagaauuagagcaugggaggu

SEQ ID NO: 2642482 - RNA, 15 nt, Human
acuguggauauuguu

SEQ ID NO: 2642483 - RNA, 18 nt, Human
ucuaaaauuauaaaugac

SEQ ID NO: 2642484 - RNA, 14 nt, Human
acuguauauucagg

SEQ ID NO: 2642485 - RNA, 14 nt, Human
ucuagcucucuagg

SEQ ID NO: 2642486 - RNA, 15 nt, Human
ucuagcucucuaggc

SEQ ID NO: 2642487 - RNA, 16 nt, Human
ucuagcucucuaggcc

SEQ ID NO: 2642488 - RNA, 12 nt, Human
acuugaaagaaa

SEQ ID NO: 2642489 - RNA, 16 nt, Human
agaaauagaauuauaa

SEQ ID NO: 2642490 - RNA, 16 nt, Human
acuuuagaagccugca

SEQ ID NO: 2642491 - RNA, 15 nt, Human
acuuuagaagccugc

SEQ ID NO: 2642492 - RNA, 15 nt, Human
agaacucacucuggg

SEQ ID NO: 2642493 - RNA, 19 nt, Human
agaacucacucugggcugu

SEQ ID NO: 2642494 - RNA, 20 nt, Human
agaacucacucugggcugua

SEQ ID NO: 2642495 - RNA, 19 nt, Human
agaaauuaccuguggauau

SEQ ID NO: 2642496 - RNA, 20 nt, Human
agaaauuaccuguggauauu

SEQ ID NO: 2642497 - RNA, 18 nt, Human
agaaauuaccuguggaua

SEQ ID NO: 2642498 - RNA, 22 nt, Human
agaaggaggaaugcuggacugg

SEQ ID NO: 2642499 - RNA, 20 nt, Human
ugaaaaggguguugggaggg

SEQ ID NO: 2642500 - RNA, 21 nt, Human
ugaaaaguauauugauaaccu

SEQ ID NO: 2642501 - RNA, 16 nt, Human
ugaaaaaaaacagugg

SEQ ID NO: 2642502 - RNA, 20 nt, Human
ugaaagaauagaacacaguu

SEQ ID NO: 2642503 - RNA, 14 nt, Human
agagaucaaagaug

SEQ ID NO: 2642504 - RNA, 15 nt, Human
agagaucaaagauga

SEQ ID NO: 2642505 - RNA, 11 nt, Human
ucuuuaacugc

SEQ ID NO: 2642506 - RNA, 20 nt, Human
ucuuuaacugccguaauuua

SEQ ID NO: 2642507 - RNA, 21 nt, Human
ucuuuaacugccguaauuuaa

SEQ ID NO: 2642508 - RNA, 22 nt, Human
ucuuuaacugccguaauuuaac

SEQ ID NO: 2642509 - RNA, 14 nt, Human
ugaauaccugcuca

SEQ ID NO: 2642510 - RNA, 21 nt, Human
ugaauagauaugaaagcugau

SEQ ID NO: 2642511 - RNA, 18 nt, Human
ugaauagauaugaaagcu

SEQ ID NO: 2642512 - RNA, 12 nt, Human
agaucaaagaug

SEQ ID NO: 2642513 - RNA, 13 nt, Human
agaucaaagauga

SEQ ID NO: 2642514 - RNA, 14 nt, Human
agcaacgcuuguag

SEQ ID NO: 2642515 - RNA, 17 nt, Human
agcaacgcuuguagaac

SEQ ID NO: 2642516 - RNA, 23 nt, Human
agcaacgcuuguagaacucacuc

SEQ ID NO: 2642517 - RNA, 15 nt, Human
agauguuuauuucag

SEQ ID NO: 2642518 - RNA, 16 nt, Human
agauguuuauuucagg

SEQ ID NO: 2642519 - RNA, 22 nt, Human
agcauuguaaaauuauuucaug

SEQ ID NO: 2642520 - RNA, 14 nt, Human
agcccagagccugg

SEQ ID NO: 2642521 - RNA, 17 nt, Human
agcccagagccuggcug

SEQ ID NO: 2642522 - RNA, 21 nt, Human
agcccagagccuggcugccca

SEQ ID NO: 2642523 - RNA, 18 nt, Human
agcgggggccuaaaaaaa

SEQ ID NO: 2642524 - RNA, 12 nt, Human
ugcagccugcuc

SEQ ID NO: 2642525 - RNA, 22 nt, Human
ugcagccugcucuagugggaca

SEQ ID NO: 2642526 - RNA, 14 nt, Human
agccuaccuguaug

SEQ ID NO: 2642527 - RNA, 12 nt, Human
agccgacucugg

SEQ ID NO: 2642528 - RNA, 13 nt, Human
agccgacucuggc

SEQ ID NO: 2642529 - RNA, 15 nt, Human
agccgacucuggccc

SEQ ID NO: 2642530 - RNA, 16 nt, Human
agccgacucuggcccu

SEQ ID NO: 2642531 - RNA, 17 nt, Human
agccgacucuggcccug

SEQ ID NO: 2642532 - RNA, 18 nt, Human
agccgacucuggcccugg

SEQ ID NO: 2642533 - RNA, 19 nt, Human
agccgacucuggcccuggc

SEQ ID NO: 2642534 - RNA, 20 nt, Human
agccgacucuggcccuggcc

SEQ ID NO: 2642535 - RNA, 21 nt, Human
agccgacucuggcccuggccc

SEQ ID NO: 2642536 - RNA, 20 nt, Human
agcccauccauuaggccagc

SEQ ID NO: 2642537 - RNA, 21 nt, Human
agcccauccauuaggccagca

SEQ ID NO: 2642538 - RNA, 23 nt, Human
agcccauccauuaggccagcaac

SEQ ID NO: 2642539 - RNA, 12 nt, Human
aggccagcaacg

SEQ ID NO: 2642540 - RNA, 13 nt, Human
aggccagcaacgc

SEQ ID NO: 2642541 - RNA, 14 nt, Human
aggccagcaacgcu

SEQ ID NO: 2642542 - RNA, 17 nt, Human
aggccagcaacgcuugu

SEQ ID NO: 2642543 - RNA, 13 nt, Human
uggcccuggcccu

SEQ ID NO: 2642544 - RNA, 23 nt, Human
aggcaccuacacucaccugcacu

SEQ ID NO: 2642545 - RNA, 21 nt, Human
aggcaccuacacucaccugca

SEQ ID NO: 2642546 - RNA, 22 nt, Human
uggaauucuuagucacaaaaua

SEQ ID NO: 2642547 - RNA, 14 nt, Human
aggauccggaaaga

SEQ ID NO: 2642548 - RNA, 16 nt, Human
aggauccggaaagaag

SEQ ID NO: 2642549 - RNA, 15 nt, Human
aggaaugcuggacug

SEQ ID NO: 2642550 - RNA, 16 nt, Human
aggaaugcuggacugg

SEQ ID NO: 2642551 - RNA, 17 nt, Human
aggaaugcuggacugga

SEQ ID NO: 2642552 - RNA, 14 nt, Human
agcuguccugcagc

SEQ ID NO: 2642553 - RNA, 15 nt, Human
agcuguccugcagca

SEQ ID NO: 2642554 - RNA, 16 nt, Human
agcuguccugcagcaa

SEQ ID NO: 2642555 - RNA, 22 nt, Human
agcuguccugcagcaaacacuc

SEQ ID NO: 2642556 - RNA, 20 nt, Human
agggugguucaacaaagaaa

SEQ ID NO: 2642557 - RNA, 17 nt, Human
aggggccuuagggcacu

SEQ ID NO: 2642558 - RNA, 19 nt, Human
aggggccuuagggcacugg

SEQ ID NO: 2642559 - RNA, 20 nt, Human
aggggccuuagggcacuggg

SEQ ID NO: 2642560 - RNA, 21 nt, Human
aggggccuuagggcacugggc

SEQ ID NO: 2642561 - RNA, 22 nt, Human
aggggccuuagggcacugggcu

SEQ ID NO: 2642562 - RNA, 20 nt, Human
aggccuguugcuauagagcc

SEQ ID NO: 2642563 - RNA, 16 nt, Human
uggggaagggccugcc

SEQ ID NO: 2642564 - RNA, 21 nt, Human
aggugcaacagacuugaaugc

SEQ ID NO: 2642565 - RNA, 18 nt, Human
ugucaauaaacaacagcu

SEQ ID NO: 2642566 - RNA, 17 nt, Human
agugccacuguuguuuu

SEQ ID NO: 2642567 - RNA, 13 nt, Human
uguggccccaccc

SEQ ID NO: 2642568 - RNA, 16 nt, Human
aguggaucacaaagug

SEQ ID NO: 2642569 - RNA, 16 nt, Human
aguggaacgaaaauga

SEQ ID NO: 2642570 - RNA, 24 nt, Human
aguggaacgaaaaugaaagcuacu

SEQ ID NO: 2642571 - RNA, 15 nt, Human
aguggaucacaaagu

SEQ ID NO: 2642572 - RNA, 15 nt, Human
uuaagaaauagaauu

SEQ ID NO: 2642573 - RNA, 19 nt, Human
uuagaaauuaccuguggau

SEQ ID NO: 2642574 - RNA, 23 nt, Human
uuagaaauuaccuguggauauuu

SEQ ID NO: 2642575 - RNA, 14 nt, Human
uuuuaacuguggau

SEQ ID NO: 2642576 - RNA, 14 nt, Human
auguuuauuucagg

SEQ ID NO: 2642577 - RNA, 22 nt, Human
auuagaaauuaccuguggauau

SEQ ID NO: 2642578 - RNA, 21 nt, Human
auuacuuuggggcuaauuuaa

SEQ ID NO: 2642579 - RNA, 23 nt, Human
auuacuuuggggcuaauuuaaca

SEQ ID NO: 2642580 - RNA, 14 nt, Human
auuaccuguggaua

SEQ ID NO: 2642581 - RNA, 15 nt, Human
auuaccuguggauau

SEQ ID NO: 2642582 - RNA, 16 nt, Human
auuaccuguggauauu

SEQ ID NO: 2642583 - RNA, 19 nt, Human
auuaccuguggauauuugu

SEQ ID NO: 2642584 - RNA, 13 nt, Human
auuuaaaacuguu

SEQ ID NO: 2642585 - RNA, 16 nt, Human
auuuguauaugguauu

SEQ ID NO: 2642586 - RNA, 19 nt, Human
auaguguagcugaggaggc

SEQ ID NO: 2642587 - RNA, 23 nt, Human
uuauuuuuggcguggcugacuua

SEQ ID NO: 2642588 - RNA, 13 nt, Human
uucacaauguuaa

SEQ ID NO: 2642589 - RNA, 18 nt, Human
uucauucucccuuucacu

SEQ ID NO: 2642590 - RNA, 17 nt, Human
uucucuagcucucuagg

SEQ ID NO: 2642591 - RNA, 18 nt, Human
uucucuagcucucuaggc

SEQ ID NO: 2642592 - RNA, 20 nt, Human
uucucuagcucucuaggccu

SEQ ID NO: 2642593 - RNA, 22 nt, Human
uucucuagcucucuaggccucu

SEQ ID NO: 2642594 - RNA, 23 nt, Human
augauuagaaauuaccuguggau

SEQ ID NO: 2642595 - RNA, 13 nt, Human
uuguguggauucu

SEQ ID NO: 2642596 - RNA, 11 nt, Human
uuuaaauugug

SEQ ID NO: 2642597 - RNA, 15 nt, Human
auggauuuuucuuua

SEQ ID NO: 2642598 - RNA, 16 nt, Human
auggauuuuucuuuaa

SEQ ID NO: 2642599 - RNA, 19 nt, Human
auggauuuuucuuuaacug

SEQ ID NO: 2642600 - RNA, 20 nt, Human
auggauuuuucuuuaacugc

SEQ ID NO: 2642601 - RNA, 16 nt, Human
uuucaugauuagaaau

SEQ ID NO: 2642602 - RNA, 19 nt, Human
uuguagugccacuguuguu

SEQ ID NO: 2642603 - RNA, 15 nt, Human
aucuuuauaaaugua

SEQ ID NO: 2642604 - RNA, 19 nt, Human
uuggauauuuuuuacuuua

SEQ ID NO: 2642605 - RNA, 19 nt, Human
uugcacagccaaauuuaaa

SEQ ID NO: 2642606 - RNA, 18 nt, Human
uugcacagccaaauuuaa

SEQ ID NO: 2642607 - RNA, 20 nt, Human
caaaauauauuuuguuuaca

SEQ ID NO: 2642608 - RNA, 22 nt, Human
caaaauauauuuuguuuacaaa

SEQ ID NO: 2642609 - RNA, 18 nt, Human
caaacacuccacccucca

SEQ ID NO: 2642610 - RNA, 20 nt, Human
caacagagacugaauagaua

SEQ ID NO: 2642611 - RNA, 15 nt, Human
caacagcaaacaggu

SEQ ID NO: 2642612 - RNA, 17 nt, Human
caacagcaaacaggugc

SEQ ID NO: 2642613 - RNA, 14 nt, Human
caacagcugaagca

SEQ ID NO: 2642614 - RNA, 22 nt, Human
cacaaaauauauuuuguuuaca

SEQ ID NO: 2642615 - RNA, 23 nt, Human
cagugucuguguuuugaaagaau

SEQ ID NO: 2642616 - RNA, 13 nt, Human
cagugucuguguu

SEQ ID NO: 2642617 - RNA, 17 nt, Human
caguggaucacaaagug

SEQ ID NO: 2642618 - RNA, 15 nt, Human
caguuccuuuagaaa

SEQ ID NO: 2642619 - RNA, 21 nt, Human
caguguuuuuagaccuguguu

SEQ ID NO: 2642620 - RNA, 15 nt, Human
cauccuaccgucuuu

SEQ ID NO: 2642621 - RNA, 17 nt, Human
cauccuccagauagugu

SEQ ID NO: 2642622 - RNA, 17 nt, Human
cauacuguaacauucag

SEQ ID NO: 2642623 - RNA, 11 nt, Human
ccaaauuuaaa

SEQ ID NO: 2642624 - RNA, 18 nt, Human
ccaaauuuaaaacuguug

SEQ ID NO: 2642625 - RNA, 17 nt, Human
ccaacccuggcuugggg

SEQ ID NO: 2642626 - RNA, 16 nt, Human
caugcuucacaauguu

SEQ ID NO: 2642627 - RNA, 15 nt, Human
cauguggccccaccc

SEQ ID NO: 2642628 - RNA, 20 nt, Human
ccaucauguggccccaccca

SEQ ID NO: 2642629 - RNA, 13 nt, Human
ccaggccuguugc

SEQ ID NO: 2642630 - RNA, 16 nt, Human
cccagagccccuccuc

SEQ ID NO: 2642631 - RNA, 20 nt, Human
cccagagccccuccuccagc

SEQ ID NO: 2642632 - RNA, 20 nt, Human
cccagagccuggcugcccau

SEQ ID NO: 2642633 - RNA, 12 nt, Human
ccuccuccagcc

SEQ ID NO: 2642634 - RNA, 16 nt, Human
ccuccuccagccccug

SEQ ID NO: 2642635 - RNA, 18 nt, Human
ccuccuccagccccuguc

SEQ ID NO: 2642636 - RNA, 20 nt, Human
ccuccuccagccccuguccc

SEQ ID NO: 2642637 - RNA, 18 nt, Human
ccucuccaguuugcaccu

SEQ ID NO: 2642638 - RNA, 19 nt, Human
ccucuccaguuugcaccug

SEQ ID NO: 2642639 - RNA, 20 nt, Human
ccucuccaguuugcaccugu

SEQ ID NO: 2642640 - RNA, 21 nt, Human
ccucuccaguuugcaccuguc

SEQ ID NO: 2642641 - RNA, 23 nt, Human
ccucuccaguuugcaccuguccc

SEQ ID NO: 2642642 - RNA, 15 nt, Human
ccuaaauuauuuacu

SEQ ID NO: 2642643 - RNA, 20 nt, Human
ccuacaguuuuaacugugga

SEQ ID NO: 2642644 - RNA, 21 nt, Human
ccuacaguuuuaacuguggau

SEQ ID NO: 2642645 - RNA, 22 nt, Human
ccuacaguuuuaacuguggaua

SEQ ID NO: 2642646 - RNA, 15 nt, Human
ccuacaguuuuaacu

SEQ ID NO: 2642647 - RNA, 17 nt, Human
ccuacaguuuuaacugu

SEQ ID NO: 2642648 - RNA, 19 nt, Human
ccuacaguuuuaacugugg

SEQ ID NO: 2642649 - RNA, 13 nt, Human
cccuggagccaga

SEQ ID NO: 2642650 - RNA, 12 nt, Human
cccuggagccag

SEQ ID NO: 2642651 - RNA, 17 nt, Human
cuacuucuguaauugug

SEQ ID NO: 2642652 - RNA, 18 nt, Human
cuacuucuguaauugugu

SEQ ID NO: 2642653 - RNA, 21 nt, Human
cuagauugcuaaggagcugau

SEQ ID NO: 2642654 - RNA, 16 nt, Human
cuaguuauacuuauuu

SEQ ID NO: 2642655 - RNA, 23 nt, Human
cuaguuauacuuauuuguauaug

SEQ ID NO: 2642656 - RNA, 23 nt, Human
cuaaauuauuuacugcaaaaaga

SEQ ID NO: 2642657 - RNA, 14 nt, Human
cuaaauuauuuacu

SEQ ID NO: 2642658 - RNA, 15 nt, Human
cuaaauuauuuacug

SEQ ID NO: 2642659 - RNA, 18 nt, Human
cuaaaugugcaauagaag

SEQ ID NO: 2642660 - RNA, 21 nt, Human
cuaaaugugcaauagaaggug

SEQ ID NO: 2642661 - RNA, 18 nt, Human
cgucuuuuccuguuuccu

SEQ ID NO: 2642662 - RNA, 12 nt, Human
cgcuuguagaac

SEQ ID NO: 2642663 - RNA, 19 nt, Human
cgcuuguagaacucacucu

SEQ ID NO: 2642664 - RNA, 20 nt, Human
cgcuuguagaacucacucug

SEQ ID NO: 2642665 - RNA, 21 nt, Human
cgcuuguagaacucacucugg

SEQ ID NO: 2642666 - RNA, 22 nt, Human
cgcuuguagaacucacucuggg

SEQ ID NO: 2642667 - RNA, 23 nt, Human
cgcuuguagaacucacucugggc

SEQ ID NO: 2642668 - RNA, 16 nt, Human
cucuaggccucuccag

SEQ ID NO: 2642669 - RNA, 17 nt, Human
cucuaggccucuccagu

SEQ ID NO: 2642670 - RNA, 23 nt, Human
cucuagguacgaugacaguguuc

SEQ ID NO: 2642671 - RNA, 17 nt, Human
cucuagcucucuaggcc

SEQ ID NO: 2642672 - RNA, 22 nt, Human
cucuccuucaugacagccucca

SEQ ID NO: 2642673 - RNA, 14 nt, Human
cucucuaggccucu

SEQ ID NO: 2642674 - RNA, 19 nt, Human
cucucuaggccucuccagu

SEQ ID NO: 2642675 - RNA, 13 nt, Human
cucuagugggaca

SEQ ID NO: 2642676 - RNA, 16 nt, Human
cucuagugggacagcc

SEQ ID NO: 2642677 - RNA, 18 nt, Human
cucuagugggacagccca

SEQ ID NO: 2642678 - RNA, 19 nt, Human
cucuagugggacagcccag

SEQ ID NO: 2642679 - RNA, 20 nt, Human
cucuagugggacagcccaga

SEQ ID NO: 2642680 - RNA, 22 nt, Human
cucuagugggacagcccagagc

SEQ ID NO: 2642681 - RNA, 23 nt, Human
cucuagugggacagcccagagcc

SEQ ID NO: 2642682 - RNA, 17 nt, Human
cucuagugcgguuuacu

SEQ ID NO: 2642683 - RNA, 13 nt, Human
cucuggcccuggc

SEQ ID NO: 2642684 - RNA, 14 nt, Human
cucuggcccuggcc

SEQ ID NO: 2642685 - RNA, 16 nt, Human
cucuggcccuggcccu

SEQ ID NO: 2642686 - RNA, 20 nt, Human
cucuggcccuggcccuuacu

SEQ ID NO: 2642687 - RNA, 12 nt, Human
cuguccccaccc

SEQ ID NO: 2642688 - RNA, 18 nt, Human
cuguccccacccuccacu

SEQ ID NO: 2642689 - RNA, 19 nt, Human
cuguccccacccuccacuc

SEQ ID NO: 2642690 - RNA, 21 nt, Human
cuguaaggauccggaaagaag

SEQ ID NO: 2642691 - RNA, 16 nt, Human
cugguagguugggaca

SEQ ID NO: 2642692 - RNA, 17 nt, Human
cugguagguugggacac

SEQ ID NO: 2642693 - RNA, 20 nt, Human
cugguagguugggacaccag

SEQ ID NO: 2642694 - RNA, 22 nt, Human
cugguagguugggacaccaggg

SEQ ID NO: 2642695 - RNA, 20 nt, Human
cuggcuuggggucaagaaac

SEQ ID NO: 2642696 - RNA, 15 nt, Human
cugcauaauguuucu

SEQ ID NO: 2642697 - RNA, 22 nt, Human
cugcauaauguuucuggauuuc

SEQ ID NO: 2642698 - RNA, 12 nt, Human
cugcagcaccuc

SEQ ID NO: 2642699 - RNA, 14 nt, Human
cugcagcaccucca

SEQ ID NO: 2642700 - RNA, 15 nt, Human
cugcagcaccuccag

SEQ ID NO: 2642701 - RNA, 17 nt, Human
cugcagcaccuccaggc

SEQ ID NO: 2642702 - RNA, 18 nt, Human
cugcagcaccuccaggcc

SEQ ID NO: 2642703 - RNA, 19 nt, Human
cugcagcaccuccaggccu

SEQ ID NO: 2642704 - RNA, 20 nt, Human
cugcagcaccuccaggccug

SEQ ID NO: 2642705 - RNA, 17 nt, Human
cugcagcaaacacucca

SEQ ID NO: 2642706 - RNA, 18 nt, Human
cugcagcaaacacuccac

SEQ ID NO: 2642707 - RNA, 20 nt, Human
cugcagcaaacacuccaccc

SEQ ID NO: 2642708 - RNA, 16 nt, Human
cugcucuagugggaca

SEQ ID NO: 2642709 - RNA, 17 nt, Human
cugcucuagugggacag

SEQ ID NO: 2642710 - RNA, 21 nt, Human
cugcucuagugggacagccca

SEQ ID NO: 2642711 - RNA, 23 nt, Human
cugcucuagugggacagcccaga

SEQ ID NO: 2642712 - RNA, 18 nt, Human
cuugcuuggggaacuugu

SEQ ID NO: 2642713 - RNA, 22 nt, Human
cuuuuuccaacucagaaauuca

SEQ ID NO: 2642714 - RNA, 19 nt, Human
gaaauuaccuguggauauu

SEQ ID NO: 2642715 - RNA, 16 nt, Human
gaaauuaccuguggau

SEQ ID NO: 2642716 - RNA, 17 nt, Human
gaaauuaccuguggaua

SEQ ID NO: 2642717 - RNA, 18 nt, Human
gaaauuaccuguggauau

SEQ ID NO: 2642718 - RNA, 19 nt, Human
gaaggugauguugccaucc

SEQ ID NO: 2642719 - RNA, 22 nt, Human
gaagccgacucuggcccuggcc

SEQ ID NO: 2642720 - RNA, 22 nt, Human
gaagagcgagagaucaaagaug

SEQ ID NO: 2642721 - RNA, 20 nt, Human
gaacuugugucccuaaugug

SEQ ID NO: 2642722 - RNA, 23 nt, Human
gaagaaggaggaaugcuggacug

SEQ ID NO: 2642723 - RNA, 21 nt, Human
gagagaguuguuuuaauaacu

SEQ ID NO: 2642724 - RNA, 20 nt, Human
gagccuaccuguaugucaau

SEQ ID NO: 2642725 - RNA, 15 nt, Human
gacucccaacccugg

SEQ ID NO: 2642726 - RNA, 18 nt, Human
gcagugucuguguuuuga

SEQ ID NO: 2642727 - RNA, 13 nt, Human
gauuuuucuuuaa

SEQ ID NO: 2642728 - RNA, 15 nt, Human
gauuuuucuuuaacu

SEQ ID NO: 2642729 - RNA, 14 nt, Human
gcaaacacuccacc

SEQ ID NO: 2642730 - RNA, 15 nt, Human
gcaaacacuccaccc

SEQ ID NO: 2642731 - RNA, 17 nt, Human
gcaaacacuccacccuc

SEQ ID NO: 2642732 - RNA, 21 nt, Human
gccaaauuuaaaacuguugga

SEQ ID NO: 2642733 - RNA, 15 nt, Human
gccccugucccaccc

SEQ ID NO: 2642734 - RNA, 19 nt, Human
gcccauccauuaggccagc

SEQ ID NO: 2642735 - RNA, 20 nt, Human
gcccauccauuaggccagca

SEQ ID NO: 2642736 - RNA, 22 nt, Human
gcccauccauuaggccagcaac

SEQ ID NO: 2642737 - RNA, 20 nt, Human
gcgguuuacucacugcugca

SEQ ID NO: 2642738 - RNA, 13 nt, Human
gccguaauuuaac

SEQ ID NO: 2642739 - RNA, 14 nt, Human
gccguaauuuaacu

SEQ ID NO: 2642740 - RNA, 23 nt, Human
gccguccuaaccucgggccugcu

SEQ ID NO: 2642741 - RNA, 21 nt, Human
uuuuucuuuucggaaaucuua

SEQ ID NO: 2642742 - RNA, 20 nt, Human
uuuguauaaaagugugaaau

SEQ ID NO: 2642743 - RNA, 14 nt, Human
uuuguauaaaagug

SEQ ID NO: 2642744 - RNA, 16 nt, Human
guauaugguauuuauu

SEQ ID NO: 2642745 - RNA, 19 nt, Human
guagguugggacaccaggg

SEQ ID NO: 2642746 - RNA, 16 nt, Human
guccccacccuccacu

SEQ ID NO: 2642747 - RNA, 17 nt, Human
guccccacccuccacuc

SEQ ID NO: 2642748 - RNA, 18 nt, Human
guccccacccuccacuca

SEQ ID NO: 2642749 - RNA, 17 nt, Human
gucaauaaacaacagcu

SEQ ID NO: 2642750 - RNA, 18 nt, Human
gucaauaaacaacagcug

SEQ ID NO: 2642751 - RNA, 20 nt, Human
gucaauaaacaacagcugaa

SEQ ID NO: 2642752 - RNA, 22 nt, Human
gucaauaaacaacagcugaagc

SEQ ID NO: 2642753 - RNA, 17 nt, Human
gucuguguuuugaaaga

SEQ ID NO: 2642754 - RNA, 14 nt, Human
gugucccuaaugug

SEQ ID NO: 2642755 - RNA, 15 nt, Human
guguuuugaaagaau

SEQ ID NO: 2642756 - RNA, 20 nt, Human
guguuuugaaagaauagaac

SEQ ID NO: 2642757 - RNA, 14 nt, Human
guguucauuguuuc

SEQ ID NO: 2642758 - RNA, 20 nt, Human
guguuacuaaaaaaaagaug

SEQ ID NO: 2642759 - RNA, 21 nt, Human
guguuacuaaaaaaaagauga

SEQ ID NO: 2642760 - RNA, 23 nt, Human
guugccauccuaccgucuuuucc

SEQ ID NO: 2642761 - RNA, 22 nt, Human
guuggaauggauuuuucuuuaa

SEQ ID NO: 2642762 - RNA, 18 nt, Human
guuacguagccuaaggcu

SEQ ID NO: 2642763 - RNA, 22 nt, Human
guuuguagugccacuguuguuu

SEQ ID NO: 2642764 - RNA, 14 nt, Human
uaaaacacacaggu

SEQ ID NO: 2642765 - RNA, 21 nt, Human
uaaaacagguuauaacagugu

SEQ ID NO: 2642766 - RNA, 19 nt, Human
uaaaugugcaauagaaggu

SEQ ID NO: 2642767 - RNA, 22 nt, Human
uaaaugugcaauagaaggugau

SEQ ID NO: 2642768 - RNA, 22 nt, Human
uaauguuucuggauuucauacu

SEQ ID NO: 2642769 - RNA, 17 nt, Human
uauauuuuguuuacaaa

SEQ ID NO: 2642770 - RNA, 11 nt, Human
uagauuuaugg

SEQ ID NO: 2642771 - RNA, 20 nt, Human
uagccuaaggcuccuguuuu

SEQ ID NO: 2642772 - RNA, 21 nt, Human
uagccuaaggcuccuguuuug

SEQ ID NO: 2642773 - RNA, 22 nt, Human
uagaauuauaacuguaaagaug

SEQ ID NO: 2642774 - RNA, 22 nt, Human
uacgaaccuacaguuuuaacug

SEQ ID NO: 2642775 - RNA, 16 nt, Human
uacuaaggacguuguu

SEQ ID NO: 2642776 - RNA, 15 nt, Human
uacugcagcaccucc

SEQ ID NO: 2642777 - RNA, 16 nt, Human
uacugcagcaccucca

SEQ ID NO: 2642778 - RNA, 21 nt, Human
uacugcagcaccuccaggccu

SEQ ID NO: 2642779 - RNA, 16 nt, Human
uacugcaaaaagaaaa

SEQ ID NO: 2642780 - RNA, 14 nt, Human
uacaguuuuaacug

SEQ ID NO: 2642781 - RNA, 15 nt, Human
uacaguuuuaacugu

SEQ ID NO: 2642782 - RNA, 20 nt, Human
uacaguuuuaacuguggaua

SEQ ID NO: 2642783 - RNA, 17 nt, Human
uacaguuuuaacugugg

SEQ ID NO: 2642784 - RNA, 19 nt, Human
uacaguuuuaacuguggau

SEQ ID NO: 2642785 - RNA, 21 nt, Human
uacaguuuuaacuguggauau

SEQ ID NO: 2642786 - RNA, 17 nt, Human
ugacuaacaggccaaag

SEQ ID NO: 2642787 - RNA, 21 nt, Human
ugacuaacaggccaaagaguc

SEQ ID NO: 2642788 - RNA, 13 nt, Human
ucuguaauugugu

SEQ ID NO: 2642789 - RNA, 16 nt, Human
ucaggacuugaaagaa

SEQ ID NO: 2642790 - RNA, 17 nt, Human
ucaggacuugaaagaaa

SEQ ID NO: 2642791 - RNA, 15 nt, Human
ucccaacccuggcuu

SEQ ID NO: 2642792 - RNA, 12 nt, Human
uccggaaagaag

SEQ ID NO: 2642793 - RNA, 14 nt, Human
ucuaggccucucca

SEQ ID NO: 2642794 - RNA, 15 nt, Human
ucuaggccucuccag

SEQ ID NO: 2642795 - RNA, 21 nt, Human
ucuagguacgaugacaguguu

SEQ ID NO: 2642796 - RNA, 15 nt, Human
uggaauggauuuuuc

SEQ ID NO: 2642797 - RNA, 21 nt, Human
ugcuggacuggaggccccugg

SEQ ID NO: 2642798 - RNA, 15 nt, Human
uggauuuuucuuuaa

SEQ ID NO: 2642799 - RNA, 20 nt, Human
ugggcuguaacguggcacug

SEQ ID NO: 2642800 - RNA, 13 nt, Human
ugggacaccaggg

SEQ ID NO: 2642801 - RNA, 14 nt, Human
ugggacaccaggga

SEQ ID NO: 2642802 - RNA, 18 nt, Human
ugggacaccagggaagaa

SEQ ID NO: 2642803 - RNA, 18 nt, Human
ugcccaucauguggcccc

SEQ ID NO: 2642804 - RNA, 21 nt, Human
ugcccaucauguggccccacc

SEQ ID NO: 2642805 - RNA, 22 nt, Human
ugcccaucauguggccccaccc

SEQ ID NO: 2642806 - RNA, 12 nt, Human
ugcagcaccucc

SEQ ID NO: 2642807 - RNA, 14 nt, Human
ugcagcaccuccag

SEQ ID NO: 2642808 - RNA, 15 nt, Human
ugcagcaccuccagg

SEQ ID NO: 2642809 - RNA, 16 nt, Human
ugcagcaccuccaggc

SEQ ID NO: 2642810 - RNA, 18 nt, Human
ugcagcaccuccaggccu

SEQ ID NO: 2642811 - RNA, 19 nt, Human
ugcagcaccuccaggccug

SEQ ID NO: 2642812 - RNA, 20 nt, Human
ugcagcaccuccaggccugu

SEQ ID NO: 2642813 - RNA, 15 nt, Human
uguagcugaggaggc

SEQ ID NO: 2642814 - RNA, 19 nt, Human
ugucccacccccuuccccc

SEQ ID NO: 2642815 - RNA, 20 nt, Human
ugucccacccccuuccccca

SEQ ID NO: 2642816 - RNA, 14 nt, Human
uuaaacuaaaugug

SEQ ID NO: 2642817 - RNA, 16 nt, Human
uguuuuaauaacuuau

SEQ ID NO: 2642818 - RNA, 13 nt, Human
uguuuuaauugua

SEQ ID NO: 2642819 - RNA, 17 nt, Human
uguuucuggauuucaua

SEQ ID NO: 2642820 - RNA, 16 nt, Human
uguuuccuagcugugu

SEQ ID NO: 2642821 - RNA, 16 nt, Human
uguguuuugaaagaau

SEQ ID NO: 2642822 - RNA, 14 nt, Human
uguguggauucuuu

SEQ ID NO: 2642823 - RNA, 14 nt, Human
uguuaaaaauguca

SEQ ID NO: 2642824 - RNA, 16 nt, Human
uguuacguagccuaag

SEQ ID NO: 2642825 - RNA, 20 nt, Human
uguuacuaaaaaaaagauga

SEQ ID NO: 2642826 - RNA, 19 nt, Human
agugcgguuuacucacugc

SEQ ID NO: 2642827 - RNA, 18 nt, Human
aguacgaaccuacaguuu

SEQ ID NO: 2642828 - RNA, 16 nt, Human
aguacgaaccuacagu

SEQ ID NO: 2642829 - RNA, 21 nt, Human
aguauauugauaaccuugaaa

SEQ ID NO: 2642830 - RNA, 14 nt, Human
augcauacaaguuu

SEQ ID NO: 2642831 - RNA, 15 nt, Human
agauaugaaagcuga

SEQ ID NO: 2642832 - RNA, 17 nt, Human
agaugaauguccugaaa

SEQ ID NO: 2642833 - RNA, 24 nt, Human
agaagagcgagagaucaaagauga

SEQ ID NO: 2642834 - RNA, 20 nt, Human
agaagaucaacgccucacug

SEQ ID NO: 2642835 - RNA, 11 nt, Human
agaacacaguu

SEQ ID NO: 2642836 - RNA, 24 nt, Human
agacugaauagauaugaaagcuga

SEQ ID NO: 2642837 - RNA, 21 nt, Human
agacugaauagauaugaaagc

SEQ ID NO: 2642838 - RNA, 22 nt, Human
agacugaauagauaugaaagcu

SEQ ID NO: 2642839 - RNA, 15 nt, Human
acucuaaaauuauaa

SEQ ID NO: 2642840 - RNA, 21 nt, Human
acucuaaaauuauaaaugaca

SEQ ID NO: 2642841 - RNA, 16 nt, Human
acucccaacccuggcu

SEQ ID NO: 2642842 - RNA, 15 nt, Human
acuggaggccccugg

SEQ ID NO: 2642843 - RNA, 18 nt, Human
acuggaggccccuggagc

SEQ ID NO: 2642844 - RNA, 21 nt, Human
acuggaggccccuggagccag

SEQ ID NO: 2642845 - RNA, 22 nt, Human
acuggaggccccuggagccaga

SEQ ID NO: 2642846 - RNA, 15 nt, Human
acugccguaauuuaa

SEQ ID NO: 2642847 - RNA, 16 nt, Human
acugccguaauuuaac

SEQ ID NO: 2642848 - RNA, 17 nt, Human
acugccguaauuuaacu

SEQ ID NO: 2642849 - RNA, 13 nt, Human
acuguaaagaugu

SEQ ID NO: 2642850 - RNA, 15 nt, Human
acuguaacauucagg

SEQ ID NO: 2642851 - RNA, 13 nt, Human
accuguggauauu

SEQ ID NO: 2642852 - RNA, 14 nt, Human
accuguggauauuu

SEQ ID NO: 2642853 - RNA, 10 nt, Human
accuguggau

SEQ ID NO: 2642854 - RNA, 20 nt, Human
acgcuuguagaacucacucu

SEQ ID NO: 2642855 - RNA, 21 nt, Human
acgcuuguagaacucacucug

SEQ ID NO: 2642856 - RNA, 18 nt, Human
acaguggaucacaaagug

SEQ ID NO: 2642857 - RNA, 15 nt, Human
acaguggaucacaaa

SEQ ID NO: 2642858 - RNA, 17 nt, Human
acaguggaucacaaagu

SEQ ID NO: 2642859 - RNA, 20 nt, Human
acacagcauuguauauguga

SEQ ID NO: 2642860 - RNA, 17 nt, Human
acacagcauuguauaug

SEQ ID NO: 2642861 - RNA, 18 nt, Human
acacagcauuguauaugu

SEQ ID NO: 2642862 - RNA, 17 nt, Human
aagaacuuuaaauugug

SEQ ID NO: 2642863 - RNA, 18 nt, Human
aagcugauuuuuuuuaau

SEQ ID NO: 2642864 - RNA, 13 nt, Human
aaagccugcucaa

SEQ ID NO: 2642865 - RNA, 12 nt, Human
aacagccagcaa

SEQ ID NO: 2642866 - RNA, 12 nt, Human
aaagccugcuca

SEQ ID NO: 2642867 - RNA, 22 nt, Human
aaaagaaaaucuuuauaaaugu

SEQ ID NO: 2642868 - RNA, 17 nt, Human
cugcacuaacagagugg

SEQ ID NO: 2642869 - RNA, 19 nt, Human
cugcaaauacuguauauuc

SEQ ID NO: 2642870 - RNA, 18 nt, Human
cugcucacgucaaaugca

SEQ ID NO: 2642871 - RNA, 19 nt, Human
cuggcccuuacuugcuucu

SEQ ID NO: 2642872 - RNA, 23 nt, Human
cuguuggaauggauuuuucuuua

SEQ ID NO: 2642873 - RNA, 18 nt, Human
cuuuggggcuaauuuaac

SEQ ID NO: 2642874 - RNA, 13 nt, Human
cuuuaaaugaaua

SEQ ID NO: 2642875 - RNA, 13 nt, Human
cuuuaaauugugu

SEQ ID NO: 2642876 - RNA, 16 nt, Human
gagugacuacacacag

SEQ ID NO: 2642877 - RNA, 22 nt, Human
gaagggccugcccaguugcacu

SEQ ID NO: 2642878 - RNA, 16 nt, Human
ggccaaagagucucca

SEQ ID NO: 2642879 - RNA, 17 nt, Human
ggccagcaacgcuugua

SEQ ID NO: 2642880 - RNA, 18 nt, Human
gcuuguagaacucacucu

SEQ ID NO: 2642881 - RNA, 19 nt, Human
gcuuguagaacucacucug

SEQ ID NO: 2642882 - RNA, 22 nt, Human
gcuuguagaacucacucugggc

SEQ ID NO: 2642883 - RNA, 23 nt, Human
gcuuguagaacucacucugggcu

SEQ ID NO: 2642884 - RNA, 12 nt, Human
aaaaaaaacagu

SEQ ID NO: 2642885 - RNA, 11 nt, Human
aaaaaagauga

SEQ ID NO: 2642886 - RNA, 13 nt, Human
aaaaaaaagcuuc

SEQ ID NO: 2642887 - RNA, 19 nt, Human
ggcugcccaucauguggcc

SEQ ID NO: 2642888 - RNA, 11 nt, Human
aaaagccugcu

SEQ ID NO: 2642889 - RNA, 20 nt, Human
ggggccuuagggcacugggc

SEQ ID NO: 2642890 - RNA, 23 nt, Human
ggggccuuagggcacugggcugu

SEQ ID NO: 2642891 - RNA, 12 nt, Human
aaacaaagaugu

SEQ ID NO: 2642892 - RNA, 15 nt, Human
aaacaacagcugaag

SEQ ID NO: 2642893 - RNA, 21 nt, Human
aaaauggcaggggguggaauu

SEQ ID NO: 2642894 - RNA, 16 nt, Human
aaagcuucacaguacc

SEQ ID NO: 2642895 - RNA, 18 nt, Human
gguagguugggacaccag

SEQ ID NO: 2642896 - RNA, 19 nt, Human
gguagguugggacaccagg

SEQ ID NO: 2642897 - RNA, 23 nt, Human
gcuuccuuuccuguguguacucu

SEQ ID NO: 2642898 - RNA, 23 nt, Human
gcuguaaggauccggaaagaaga

SEQ ID NO: 2642899 - RNA, 16 nt, Human
gcuguaacguggcacu

SEQ ID NO: 2642900 - RNA, 18 nt, Human
gcuguaacguggcacugg

SEQ ID NO: 2642901 - RNA, 20 nt, Human
gcuggacuggaggccccugg

SEQ ID NO: 2642902 - RNA, 23 nt, Human
gcuggacuggaggccccuggagc

SEQ ID NO: 2642903 - RNA, 17 nt, Human
gcugcccaucauguggc

SEQ ID NO: 2642904 - RNA, 19 nt, Human
gcugcccaucauguggccc

SEQ ID NO: 2642905 - RNA, 21 nt, Human
gcugcccaucauguggcccca

SEQ ID NO: 2642906 - RNA, 18 nt, Human
gcugaggaggcaccuaca

SEQ ID NO: 2642907 - RNA, 16 nt, Human
gccacuguuguuuugg

SEQ ID NO: 2642908 - RNA, 19 nt, Human
gccagcaagaguuaggggc

SEQ ID NO: 2642909 - RNA, 12 nt, Human
gccagcaacgcu

SEQ ID NO: 2642910 - RNA, 13 nt, Human
gccagcaacgcuu

SEQ ID NO: 2642911 - RNA, 14 nt, Human
gccagcaacgcuug

SEQ ID NO: 2642912 - RNA, 18 nt, Human
gccagcaacgcuuguaga

SEQ ID NO: 2642913 - RNA, 22 nt, Human
gccagcaacgcuuguagaacuc

SEQ ID NO: 2642914 - RNA, 14 nt, Human
gccuaccuguaugu

SEQ ID NO: 2642915 - RNA, 19 nt, Human
ccaaaagguuuaagaaaua

SEQ ID NO: 2642916 - RNA, 23 nt, Human
ccaaaagguuuaagaaauagaau

SEQ ID NO: 2642917 - RNA, 23 nt, Human
cauugggguaguuguguuucaac

SEQ ID NO: 2642918 - RNA, 18 nt, Human
cauuggauauuuuuuacu

SEQ ID NO: 2642919 - RNA, 11 nt, Human
cauuggauauu

SEQ ID NO: 2642920 - RNA, 14 nt, Human
caguuuuaacugug

SEQ ID NO: 2642921 - RNA, 15 nt, Human
caguuuuaacugugg

SEQ ID NO: 2642922 - RNA, 16 nt, Human
caguuuuaacugugga

SEQ ID NO: 2642923 - RNA, 17 nt, Human
caguuuuaacuguggau

SEQ ID NO: 2642924 - RNA, 18 nt, Human
caguuuuaacuguggaua

SEQ ID NO: 2642925 - RNA, 20 nt, Human
caguuuuaacuguggauauu

SEQ ID NO: 2642926 - RNA, 22 nt, Human
caguuuuaacuguggauauugu

SEQ ID NO: 2642927 - RNA, 23 nt, Human
caguuuuaacuguggauauuguu

SEQ ID NO: 2642928 - RNA, 18 nt, Human
cauaauguuucuggauuu

SEQ ID NO: 2642929 - RNA, 23 nt, Human
cauaauguuucuggauuucauac

SEQ ID NO: 2642930 - RNA, 21 nt, Human
cauaauguuucuggauuucau

SEQ ID NO: 2642931 - RNA, 22 nt, Human
cauaauguuucuggauuucaua

SEQ ID NO: 2642932 - RNA, 12 nt, Human
caguuuuaacug

SEQ ID NO: 2642933 - RNA, 13 nt, Human
caguuuuaacugu

SEQ ID NO: 2642934 - RNA, 15 nt, Human
caucacuuugaccua

SEQ ID NO: 2642935 - RNA, 18 nt, Human
cagauaguguagcugagg

SEQ ID NO: 2642936 - RNA, 20 nt, Human
cagauaguguagcugaggag

SEQ ID NO: 2642937 - RNA, 14 nt, Human
cagcaccuccaggc

SEQ ID NO: 2642938 - RNA, 16 nt, Human
cagcaccuccaggccu

SEQ ID NO: 2642939 - RNA, 18 nt, Human
cagcaccuccaggccugu

SEQ ID NO: 2642940 - RNA, 13 nt, Human
caggccuguugcu

SEQ ID NO: 2642941 - RNA, 23 nt, Human
caggccuguugcuauagagccua

SEQ ID NO: 2642942 - RNA, 12 nt, Human
cacuccacccuc

SEQ ID NO: 2642943 - RNA, 15 nt, Human
cacuccacccuccac

SEQ ID NO: 2642944 - RNA, 17 nt, Human
cacuccacccuccaccu

SEQ ID NO: 2642945 - RNA, 18 nt, Human
cacuccacccuccaccuu

SEQ ID NO: 2642946 - RNA, 21 nt, Human
cacuccacccuccaccuucca

SEQ ID NO: 2642947 - RNA, 19 nt, Human
auuucaggcauuggauauu

SEQ ID NO: 2642948 - RNA, 14 nt, Human
cucacgucaaaugc

SEQ ID NO: 2642949 - RNA, 15 nt, Human
cucaaucccugagga

SEQ ID NO: 2642950 - RNA, 24 nt, Human
ccuuuccuguguguacucugucca

SEQ ID NO: 2642951 - RNA, 19 nt, Human
cuaauuuguuuuggauaua

SEQ ID NO: 2642952 - RNA, 14 nt, Human
ccuucccccagccc

SEQ ID NO: 2642953 - RNA, 15 nt, Human
ccuucccccagccca

SEQ ID NO: 2642954 - RNA, 17 nt, Human
ccuucccccagcccauc

SEQ ID NO: 2642955 - RNA, 21 nt, Human
ccuuuauuuuuggcguggcug

SEQ ID NO: 2642956 - RNA, 16 nt, Human
ccuuagggcacugggc

SEQ ID NO: 2642957 - RNA, 19 nt, Human
ccuguugcuauagagccua

SEQ ID NO: 2642958 - RNA, 23 nt, Human
ccucuccuucaugacagccucca

SEQ ID NO: 2642959 - RNA, 13 nt, Human
ccucgggccugcu

SEQ ID NO: 2642960 - RNA, 22 nt, Human
ccuagcugugugaauaccugcu

SEQ ID NO: 2642961 - RNA, 16 nt, Human
ccuagcugugugaaua

SEQ ID NO: 2642962 - RNA, 17 nt, Human
ccagauaguguagcuga

SEQ ID NO: 2642963 - RNA, 20 nt, Human
ccagauaguguagcugagga

SEQ ID NO: 2642964 - RNA, 22 nt, Human
cccagcccauccauuaggccag

SEQ ID NO: 2642965 - RNA, 14 nt, Human
cccauccauuaggc

SEQ ID NO: 2642966 - RNA, 15 nt, Human
cccauccauuaggcc

SEQ ID NO: 2642967 - RNA, 19 nt, Human
cccauccauuaggccagca

SEQ ID NO: 2642968 - RNA, 14 nt, Human
cccaucauguggcc

SEQ ID NO: 2642969 - RNA, 19 nt, Human
cccaucauguggccccacc

SEQ ID NO: 2642970 - RNA, 22 nt, Human
gucaaaugcauacaaguuucau

SEQ ID NO: 2642971 - RNA, 15 nt, Human
aaauuaccuguggau

SEQ ID NO: 2642972 - RNA, 18 nt, Human
aaauuaccuguggauauu

SEQ ID NO: 2642973 - RNA, 23 nt, Human
guauauucaggacuugaaagaaa

SEQ ID NO: 2642974 - RNA, 12 nt, Human
guauauucagga

SEQ ID NO: 2642975 - RNA, 13 nt, Human
aaaugaaagcuac

SEQ ID NO: 2642976 - RNA, 14 nt, Human
aaaugaaagcuacu

SEQ ID NO: 2642977 - RNA, 13 nt, Human
aacaguguuuaaa

SEQ ID NO: 2642978 - RNA, 14 nt, Human
aacaguggaucaca

SEQ ID NO: 2642979 - RNA, 14 nt, Human
gucucaguuucuug

SEQ ID NO: 2642980 - RNA, 15 nt, Human
aacuagcauuguaaa

SEQ ID NO: 2642981 - RNA, 21 nt, Human
aacuaaaugugcaauagaagg

SEQ ID NO: 2642982 - RNA, 21 nt, Human
guuccauugaagccgacucug

SEQ ID NO: 2642983 - RNA, 22 nt, Human
guuccauugaagccgacucugg

SEQ ID NO: 2642984 - RNA, 23 nt, Human
guuccauugaagccgacucuggc

SEQ ID NO: 2642985 - RNA, 16 nt, Human
guguuuuaauuguaaa

SEQ ID NO: 2642986 - RNA, 14 nt, Human
guguuuuaauugua

SEQ ID NO: 2642987 - RNA, 22 nt, Human
guuaggggccuuagggcacugg

SEQ ID NO: 2642988 - RNA, 20 nt, Human
guuuacaaaaauuucuguaa

SEQ ID NO: 2642989 - RNA, 18 nt, Human
guuguacuuuggaauucu

SEQ ID NO: 2642990 - RNA, 15 nt, Human
guuugcaccuguccc

SEQ ID NO: 2642991 - RNA, 15 nt, Human
guguguacucugucc

SEQ ID NO: 2642992 - RNA, 17 nt, Human
guguguacucuguccag

SEQ ID NO: 2642993 - RNA, 13 nt, Human
gugggacagccca

SEQ ID NO: 2642994 - RNA, 18 nt, Human
gugggacagcccagagcc

SEQ ID NO: 2642995 - RNA, 21 nt, Human
gugggacagcccagagccugg

SEQ ID NO: 2642996 - RNA, 23 nt, Human
aagagcgagagaucaaagaugaa

SEQ ID NO: 2642997 - RNA, 18 nt, Human
aagagcgagagaucaaag

SEQ ID NO: 2642998 - RNA, 21 nt, Human
aagagcgagagaucaaagaug

SEQ ID NO: 2642999 - RNA, 13 nt, Human
guggauucuuuaa

SEQ ID NO: 2643000 - RNA, 11 nt, Human
aagaauagaac

SEQ ID NO: 2643001 - RNA, 12 nt, Human
aagaaauagaau

SEQ ID NO: 2643002 - RNA, 14 nt, Human
aaugcauacaaguu

SEQ ID NO: 2643003 - RNA, 13 nt, Human
aaucagaauuaga

SEQ ID NO: 2643004 - RNA, 16 nt, Human
uaaccucgggccugcu

SEQ ID NO: 2643005 - RNA, 18 nt, Human
aauagauaugaaagcuga

SEQ ID NO: 2643006 - RNA, 19 nt, Human
aauagauaugaaagcugau

SEQ ID NO: 2643007 - RNA, 15 nt, Human
acaacagcugaagca

SEQ ID NO: 2643008 - RNA, 16 nt, Human
acaacagcugaagcac

SEQ ID NO: 2643009 - RNA, 16 nt, Human
uacuucuguaauugug

SEQ ID NO: 2643010 - RNA, 17 nt, Human
uacuucuguaauugugu

SEQ ID NO: 2643011 - RNA, 20 nt, Human
uacuucuguaauugugugga

SEQ ID NO: 2643012 - RNA, 22 nt, Human
uacuucuguaauuguguggauu

SEQ ID NO: 2643013 - RNA, 20 nt, Human
uacuuugacaguguuuuuag

SEQ ID NO: 2643014 - RNA, 15 nt, Human
uacuuugacaguguu

SEQ ID NO: 2643015 - RNA, 18 nt, Human
uacuuauuuguauauggu

SEQ ID NO: 2643016 - RNA, 15 nt, Human
acagcaaacaggugc

SEQ ID NO: 2643017 - RNA, 22 nt, Human
acagcaaacaggugcuaauuug

SEQ ID NO: 2643018 - RNA, 22 nt, Human
uauauucaggacuugaaagaaa

SEQ ID NO: 2643019 - RNA, 15 nt, Human
acacuccacccucca

SEQ ID NO: 2643020 - RNA, 18 nt, Human
acacuccacccuccaccu

SEQ ID NO: 2643021 - RNA, 22 nt, Human
acacuccacccuccaccuucca

SEQ ID NO: 2643022 - RNA, 13 nt, Human
uagguugggacac

SEQ ID NO: 2643023 - RNA, 12 nt, Human
acacacaguacg

SEQ ID NO: 2643024 - RNA, 17 nt, Human
ucacaaaguggaacgaa

SEQ ID NO: 2643025 - RNA, 23 nt, Human
accagggaagaagaucaacgccu

SEQ ID NO: 2643026 - RNA, 13 nt, Human
ucaccugcacuaa

SEQ ID NO: 2643027 - RNA, 12 nt, Human
ucaagaaacagc

SEQ ID NO: 2643028 - RNA, 13 nt, Human
ucaagaaacagcc

SEQ ID NO: 2643029 - RNA, 15 nt, Human
ucaagaaacagccag

SEQ ID NO: 2643030 - RNA, 16 nt, Human
ucaagaaacagccagc

SEQ ID NO: 2643031 - RNA, 17 nt, Human
ucaagaaacagccagca

SEQ ID NO: 2643032 - RNA, 18 nt, Human
ucaagaaacagccagcaa

SEQ ID NO: 2643033 - RNA, 20 nt, Human
ucaagaaacagccagcaaga

SEQ ID NO: 2643034 - RNA, 19 nt, Human
acauucaggaauucuugga

SEQ ID NO: 2643035 - RNA, 16 nt, Human
ucaacagagacugaau

SEQ ID NO: 2643036 - RNA, 14 nt, Human
acaucacaagacua

SEQ ID NO: 2643037 - RNA, 17 nt, Human
acaguuuuaacugugga

SEQ ID NO: 2643038 - RNA, 19 nt, Human
acaguuuuaacuguggaua

SEQ ID NO: 2643039 - RNA, 21 nt, Human
acaguuuuaacuguggauauu

SEQ ID NO: 2643040 - RNA, 13 nt, Human
acaguuuuaacug

SEQ ID NO: 2643041 - RNA, 21 nt, Human
uccacucagcuguccugcagc

SEQ ID NO: 2643042 - RNA, 22 nt, Human
uccacucagcuguccugcagca

SEQ ID NO: 2643043 - RNA, 18 nt, Human
accuacaguuuuaacugu

SEQ ID NO: 2643044 - RNA, 19 nt, Human
accuacaguuuuaacugug

SEQ ID NO: 2643045 - RNA, 11 nt, Human
accuacaguuu

SEQ ID NO: 2643046 - RNA, 16 nt, Human
accuacaguuuuaacu

SEQ ID NO: 2643047 - RNA, 17 nt, Human
accuacaguuuuaacug

SEQ ID NO: 2643048 - RNA, 23 nt, Human
ucaugauuagaaauuaccugugg

SEQ ID NO: 2643049 - RNA, 17 nt, Human
accugcacuaacagagu

SEQ ID NO: 2643050 - RNA, 18 nt, Human
accugcacuaacagagug

SEQ ID NO: 2643051 - RNA, 21 nt, Human
uccauugaagccgacucuggc

SEQ ID NO: 2643052 - RNA, 22 nt, Human
uccauugaagccgacucuggcc

SEQ ID NO: 2643053 - RNA, 13 nt, Human
uccccacccucca

SEQ ID NO: 2643054 - RNA, 14 nt, Human
uccccacccuccac

SEQ ID NO: 2643055 - RNA, 15 nt, Human
uccccacccuccacu

SEQ ID NO: 2643056 - RNA, 16 nt, Human
uccccacccuccacuc

SEQ ID NO: 2643057 - RNA, 19 nt, Human
uccccacccuccacucagc

SEQ ID NO: 2643058 - RNA, 13 nt, Human
acuacacacagua

SEQ ID NO: 2643059 - RNA, 18 nt, Human
acuaacaggccaaagagu

SEQ ID NO: 2643060 - RNA, 15 nt, Human
ucccugaggacugau

SEQ ID NO: 2643061 - RNA, 20 nt, Human
ucccugaggacugauuucag

SEQ ID NO: 2643062 - RNA, 21 nt, Human
ucccugaggacugauuucaga

SEQ ID NO: 2643063 - RNA, 13 nt, Human
acucacucugggc

SEQ ID NO: 2643064 - RNA, 14 nt, Human
acucacucugggcu

SEQ ID NO: 2643065 - RNA, 15 nt, Human
acucacucugggcug

SEQ ID NO: 2643066 - RNA, 16 nt, Human
acucacucugggcugu

SEQ ID NO: 2643067 - RNA, 12 nt, Human
acuguuggaaug

SEQ ID NO: 2643068 - RNA, 21 nt, Human
acuguuggaauggauuuuucu

SEQ ID NO: 2643069 - RNA, 13 nt, Human
acuuuaaauugug

SEQ ID NO: 2643070 - RNA, 18 nt, Human
ucuccaguuugcaccugu

SEQ ID NO: 2643071 - RNA, 24 nt, Human
acuugaaugcuaguuauacuuauu

SEQ ID NO: 2643072 - RNA, 13 nt, Human
agaaacagccagc

SEQ ID NO: 2643073 - RNA, 15 nt, Human
agaaacagccagcaa

SEQ ID NO: 2643074 - RNA, 21 nt, Human
ucugggcuguaacguggcacu

SEQ ID NO: 2643075 - RNA, 22 nt, Human
ucugggcuguaacguggcacug

SEQ ID NO: 2643076 - RNA, 23 nt, Human
ucugggcuguaacguggcacugg

SEQ ID NO: 2643077 - RNA, 15 nt, Human
ucuggguugccuuua

SEQ ID NO: 2643078 - RNA, 19 nt, Human
agaaauucaauuuggauuu

SEQ ID NO: 2643079 - RNA, 22 nt, Human
agaaauucaauuuggauuuaaa

SEQ ID NO: 2643080 - RNA, 14 nt, Human
ugacaguguuuuua

SEQ ID NO: 2643081 - RNA, 18 nt, Human
agauacuaaggacguugu

SEQ ID NO: 2643082 - RNA, 19 nt, Human
agagcgagagaucaaagau

SEQ ID NO: 2643083 - RNA, 22 nt, Human
ugaagcaaacucuaaaauuaua

SEQ ID NO: 2643084 - RNA, 14 nt, Human
ugauacauuuuugu

SEQ ID NO: 2643085 - RNA, 21 nt, Human
ugaucuacuucuguaauugug

SEQ ID NO: 2643086 - RNA, 18 nt, Human
ugaucuacuucuguaauu

SEQ ID NO: 2643087 - RNA, 20 nt, Human
ugaucuacuucuguaauugu

SEQ ID NO: 2643088 - RNA, 16 nt, Human
ugcaacagacuugaau

SEQ ID NO: 2643089 - RNA, 23 nt, Human
ugcaaauacuguauauucaggac

SEQ ID NO: 2643090 - RNA, 13 nt, Human
agccccuccucca

SEQ ID NO: 2643091 - RNA, 20 nt, Human
agccccuccuccagccccug

SEQ ID NO: 2643092 - RNA, 21 nt, Human
agccccuccuccagccccugu

SEQ ID NO: 2643093 - RNA, 22 nt, Human
agccccuccuccagccccuguc

SEQ ID NO: 2643094 - RNA, 23 nt, Human
agccccuccuccagccccugucc

SEQ ID NO: 2643095 - RNA, 11 nt, Human
agccccugucc

SEQ ID NO: 2643096 - RNA, 12 nt, Human
agccccuguccc

SEQ ID NO: 2643097 - RNA, 13 nt, Human
agccccuguccca

SEQ ID NO: 2643098 - RNA, 17 nt, Human
aggacucccaacccugg

SEQ ID NO: 2643099 - RNA, 18 nt, Human
aggacucccaacccuggc

SEQ ID NO: 2643100 - RNA, 19 nt, Human
aggacucccaacccuggcu

SEQ ID NO: 2643101 - RNA, 20 nt, Human
aggacucccaacccuggcuu

SEQ ID NO: 2643102 - RNA, 18 nt, Human
aggacugauuucagagug

SEQ ID NO: 2643103 - RNA, 13 nt, Human
aggacuugaaaga

SEQ ID NO: 2643104 - RNA, 16 nt, Human
aggacuugaaagaaau

SEQ ID NO: 2643105 - RNA, 14 nt, Human
ugcuuuuuccaacu

SEQ ID NO: 2643106 - RNA, 21 nt, Human
ugcuuuuuccaacucagaaau

SEQ ID NO: 2643107 - RNA, 17 nt, Human
aggaggaaugcuggacu

SEQ ID NO: 2643108 - RNA, 19 nt, Human
aggaggaaugcuggacugg

SEQ ID NO: 2643109 - RNA, 22 nt, Human
aggaggaaugcuggacuggagg

SEQ ID NO: 2643110 - RNA, 13 nt, Human
uggagaaaauggg

SEQ ID NO: 2643111 - RNA, 22 nt, Human
uggagaaaauggguuuauucac

SEQ ID NO: 2643112 - RNA, 13 nt, Human
aggcauuggauau

SEQ ID NO: 2643113 - RNA, 14 nt, Human
aggcauuggauauu

SEQ ID NO: 2643114 - RNA, 13 nt, Human
ugcuaauuuguuu

SEQ ID NO: 2643115 - RNA, 21 nt, Human
agcugugugaauaccugcuca

SEQ ID NO: 2643116 - RNA, 22 nt, Human
uguaugucaauaaacaacagcu

SEQ ID NO: 2643117 - RNA, 20 nt, Human
uggggucaagaaacagccag

SEQ ID NO: 2643118 - RNA, 21 nt, Human
uggggucaagaaacagccagc

SEQ ID NO: 2643119 - RNA, 22 nt, Human
uggggucaagaaacagccagca

SEQ ID NO: 2643120 - RNA, 15 nt, Human
agggaagaaggagga

SEQ ID NO: 2643121 - RNA, 18 nt, Human
agggaagaaggaggaaug

SEQ ID NO: 2643122 - RNA, 13 nt, Human
agggcacugggcu

SEQ ID NO: 2643123 - RNA, 14 nt, Human
agggcacugggcug

SEQ ID NO: 2643124 - RNA, 15 nt, Human
agggcacugggcugu

SEQ ID NO: 2643125 - RNA, 16 nt, Human
agggcacugggcuguu

SEQ ID NO: 2643126 - RNA, 18 nt, Human
agggcacugggcuguugu

SEQ ID NO: 2643127 - RNA, 16 nt, Human
auaaacaacagcugaa

SEQ ID NO: 2643128 - RNA, 13 nt, Human
uuagaagccugca

SEQ ID NO: 2643129 - RNA, 12 nt, Human
uuaccuguggau

SEQ ID NO: 2643130 - RNA, 13 nt, Human
uuaccuguggaua

SEQ ID NO: 2643131 - RNA, 20 nt, Human
uuaccuguggauauuuguau

SEQ ID NO: 2643132 - RNA, 12 nt, Human
uuacucacugcu

SEQ ID NO: 2643133 - RNA, 18 nt, Human
auaaauguaccagagaga

SEQ ID NO: 2643134 - RNA, 18 nt, Human
uguuuugcacagccaaau

SEQ ID NO: 2643135 - RNA, 17 nt, Human
uguuugcagccugcucu

SEQ ID NO: 2643136 - RNA, 13 nt, Human
uguuuauuucagg

SEQ ID NO: 2643137 - RNA, 14 nt, Human
uuaacaagaacuuu

SEQ ID NO: 2643138 - RNA, 15 nt, Human
uuaaauuguguuuua

SEQ ID NO: 2643139 - RNA, 15 nt, Human
aguugcacucaggug

SEQ ID NO: 2643140 - RNA, 21 nt, Human
uguuccauugaagccgacucu

SEQ ID NO: 2643141 - RNA, 23 nt, Human
agugcugucuuaaacuaaaugug

SEQ ID NO: 2643142 - RNA, 17 nt, Human
uuccuguguguacucug

SEQ ID NO: 2643143 - RNA, 21 nt, Human
uuccuguguguacucugucca

SEQ ID NO: 2643144 - RNA, 14 nt, Human
aucacaaaguggaa

SEQ ID NO: 2643145 - RNA, 24 nt, Human
aucacaaaguggaacgaaaaugaa

SEQ ID NO: 2643146 - RNA, 15 nt, Human
aucacaaaguggaac

SEQ ID NO: 2643147 - RNA, 15 nt, Human
auccauuaggccagc

SEQ ID NO: 2643148 - RNA, 16 nt, Human
auccauuaggccagca

SEQ ID NO: 2643149 - RNA, 17 nt, Human
auccauuaggccagcaa

SEQ ID NO: 2643150 - RNA, 18 nt, Human
auccauuaggccagcaac

SEQ ID NO: 2643151 - RNA, 19 nt, Human
auccauuaggccagcaacg

SEQ ID NO: 2643152 - RNA, 13 nt, Human
uucuguaauugug

SEQ ID NO: 2643153 - RNA, 19 nt, Human
uuauuucaugauuagaaau

SEQ ID NO: 2643154 - RNA, 19 nt, Human
uucacaguacccaaacugc

SEQ ID NO: 2643155 - RNA, 23 nt, Human
uucacaguacccaaacugcuuuu

SEQ ID NO: 2643156 - RNA, 22 nt, Human
uucauacuguaacauucaggaa

SEQ ID NO: 2643157 - RNA, 19 nt, Human
aucuuaaaccuuaagauac

SEQ ID NO: 2643158 - RNA, 13 nt, Human
uuuacccuucagg

SEQ ID NO: 2643159 - RNA, 16 nt, Human
augcuggacuggaggc

SEQ ID NO: 2643160 - RNA, 20 nt, Human
augcuggacuggaggccccu

SEQ ID NO: 2643161 - RNA, 22 nt, Human
augcuggacuggaggccccugg

SEQ ID NO: 2643162 - RNA, 16 nt, Human
uugugucccuaaugug

SEQ ID NO: 2643163 - RNA, 20 nt, Human
uuuuuggcguggcugacuua

SEQ ID NO: 2643164 - RNA, 12 nt, Human
auuauaacugua

SEQ ID NO: 2643165 - RNA, 15 nt, Human
auuauaaaugacaac

SEQ ID NO: 2643166 - RNA, 18 nt, Human
auucaggacuugaaagaa

SEQ ID NO: 2643167 - RNA, 19 nt, Human
auucaggacuugaaagaaa

SEQ ID NO: 2643168 - RNA, 20 nt, Human
uuuggauuuaaaagccugcu

SEQ ID NO: 2643169 - RNA, 18 nt, Human
auuuggauuuaaaagccu

SEQ ID NO: 2643170 - RNA, 20 nt, Human
auuuggauuuaaaagccugc

SEQ ID NO: 2643171 - RNA, 23 nt, Human
auuuggauuuaaaagccugcuca

SEQ ID NO: 2643172 - RNA, 14 nt, Human
auuuaaaagccugc

SEQ ID NO: 2643173 - RNA, 15 nt, Human
auuuaaaagccugcu

SEQ ID NO: 2643174 - RNA, 17 nt, Human
auuuaaaagccugcuca

SEQ ID NO: 2643175 - RNA, 15 nt, Human
auuuaugguuguuaa

SEQ ID NO: 2643176 - RNA, 23 nt, Human
auuuaugguuguuaaaaauguca

SEQ ID NO: 2643177 - RNA, 17 nt, Human
auuuauuuuuucuuuuc

SEQ ID NO: 2643178 - RNA, 22 nt, Human
auuuauuuuuucuuuucuuuac

SEQ ID NO: 2643179 - RNA, 15 nt, Human
auuucaugauuagaa

SEQ ID NO: 2643180 - RNA, 21 nt, Human
caagagggugacagcuuccuu

SEQ ID NO: 2643181 - RNA, 14 nt, Human
cauuguauauguga

SEQ ID NO: 2643182 - RNA, 17 nt, Human
cauuguuucguaacaca

SEQ ID NO: 2643183 - RNA, 17 nt, Human
ccaaacugauccaguau

SEQ ID NO: 2643184 - RNA, 15 nt, Human
ccacucagcuguccu

SEQ ID NO: 2643185 - RNA, 12 nt, Human
cggaaagaagag

SEQ ID NO: 2643186 - RNA, 18 nt, Human
cggaaagaagagcgagag

SEQ ID NO: 2643187 - RNA, 23 nt, Human
cguccaucacguuagcuguccca

SEQ ID NO: 2643188 - RNA, 12 nt, Human
ccuggagccaga

SEQ ID NO: 2643189 - RNA, 17 nt, Human
ccuuccauuuuccccca

SEQ ID NO: 2643190 - RNA, 19 nt, Human
ccuuccauuuucccccacu

SEQ ID NO: 2643191 - RNA, 20 nt, Human
ccuuccauuuucccccacua

SEQ ID NO: 2643192 - RNA, 20 nt, Human
ccuuacuugcuucucuagcu

SEQ ID NO: 2643193 - RNA, 17 nt, Human
ccuugaaaaaaaacagu

SEQ ID NO: 2643194 - RNA, 15 nt, Human
cccugucccaccccc

SEQ ID NO: 2643195 - RNA, 19 nt, Human
cccugucccacccccuucc

SEQ ID NO: 2643196 - RNA, 22 nt, Human
cccugucccacccccuuccccc

SEQ ID NO: 2643197 - RNA, 11 nt, Human
ccggaaagaag

SEQ ID NO: 2643198 - RNA, 17 nt, Human
cuggguugccuuuauuu

SEQ ID NO: 2643199 - RNA, 13 nt, Human
cuggaggccccug

SEQ ID NO: 2643200 - RNA, 14 nt, Human
cuggaggccccugg

SEQ ID NO: 2643201 - RNA, 17 nt, Human
cuggaggccccuggagc

SEQ ID NO: 2643202 - RNA, 19 nt, Human
cuggaggccccuggagcca

SEQ ID NO: 2643203 - RNA, 20 nt, Human
cuggaggccccuggagccag

SEQ ID NO: 2643204 - RNA, 21 nt, Human
cuggaggccccuggagccaga

SEQ ID NO: 2643205 - RNA, 20 nt, Human
cugauacuuugacaguguuu

SEQ ID NO: 2643206 - RNA, 15 nt, Human
cucccuuucacuaaa

SEQ ID NO: 2643207 - RNA, 19 nt, Human
cuccuguuuugcacagcca

SEQ ID NO: 2643208 - RNA, 19 nt, Human
cuccuucaugacagccucc

SEQ ID NO: 2643209 - RNA, 13 nt, Human
cuccaggccuguu

SEQ ID NO: 2643210 - RNA, 20 nt, Human
cuccaggccuguugcuauag

SEQ ID NO: 2643211 - RNA, 14 nt, Human
cuccacccuccacc

SEQ ID NO: 2643212 - RNA, 15 nt, Human
cuccacccuccaccu

SEQ ID NO: 2643213 - RNA, 16 nt, Human
cuccacccuccaccuu

SEQ ID NO: 2643214 - RNA, 13 nt, Human
cuccagccccugu

SEQ ID NO: 2643215 - RNA, 14 nt, Human
cuccagccccuguc

SEQ ID NO: 2643216 - RNA, 15 nt, Human
cuccagccccugucc

SEQ ID NO: 2643217 - RNA, 16 nt, Human
cuccagccccuguccc

SEQ ID NO: 2643218 - RNA, 17 nt, Human
cuccagccccuguccca

SEQ ID NO: 2643219 - RNA, 17 nt, Human
cucuccaguuugcaccu

SEQ ID NO: 2643220 - RNA, 19 nt, Human
cucuccaguuugcaccugu

SEQ ID NO: 2643221 - RNA, 20 nt, Human
cucuccaguuugcaccuguc

SEQ ID NO: 2643222 - RNA, 22 nt, Human
cucuccaguuugcaccuguccc

SEQ ID NO: 2643223 - RNA, 23 nt, Human
cucuccaguuugcaccugucccc

SEQ ID NO: 2643224 - RNA, 15 nt, Human
cugaaucugcuacca

SEQ ID NO: 2643225 - RNA, 17 nt, Human
cugaaucugcuaccaaa

SEQ ID NO: 2643226 - RNA, 22 nt, Human
cugaaucugcuaccaaaacagu

SEQ ID NO: 2643227 - RNA, 15 nt, Human
cugaauagauaugaa

SEQ ID NO: 2643228 - RNA, 17 nt, Human
cuguuuccuagcugugu

SEQ ID NO: 2643229 - RNA, 16 nt, Human
cuguuuccuagcugug

SEQ ID NO: 2643230 - RNA, 21 nt, Human
cuuugaccuaaauuauuuacu

SEQ ID NO: 2643231 - RNA, 20 nt, Human
gaaaaguauauugauaaccu

SEQ ID NO: 2643232 - RNA, 19 nt, Human
cuugcuucucuagcucucu

SEQ ID NO: 2643233 - RNA, 17 nt, Human
cuuguagaacucacucu

SEQ ID NO: 2643234 - RNA, 18 nt, Human
cuuguagaacucacucug

SEQ ID NO: 2643235 - RNA, 19 nt, Human
cuuguagaacucacucugg

SEQ ID NO: 2643236 - RNA, 20 nt, Human
cuuguagaacucacucuggg

SEQ ID NO: 2643237 - RNA, 21 nt, Human
cuuguagaacucacucugggc

SEQ ID NO: 2643238 - RNA, 23 nt, Human
cuuguagaacucacucugggcug

SEQ ID NO: 2643239 - RNA, 16 nt, Human
gacugauuucagagug

SEQ ID NO: 2643240 - RNA, 14 nt, Human
gacugauuucagag

SEQ ID NO: 2643241 - RNA, 16 nt, Human
gaacgaaaaugaaagc

SEQ ID NO: 2643242 - RNA, 13 nt, Human
gaacucacucugg

SEQ ID NO: 2643243 - RNA, 14 nt, Human
gaacucacucuggg

SEQ ID NO: 2643244 - RNA, 15 nt, Human
gaacucacucugggc

SEQ ID NO: 2643245 - RNA, 16 nt, Human
gaacucacucugggcu

SEQ ID NO: 2643246 - RNA, 17 nt, Human
gaacucacucugggcug

SEQ ID NO: 2643247 - RNA, 18 nt, Human
gaacucacucugggcugu

SEQ ID NO: 2643248 - RNA, 13 nt, Human
gaagccgacucug

SEQ ID NO: 2643249 - RNA, 14 nt, Human
gaagccgacucugg

SEQ ID NO: 2643250 - RNA, 15 nt, Human
gaagccgacucuggc

SEQ ID NO: 2643251 - RNA, 16 nt, Human
gaagccgacucuggcc

SEQ ID NO: 2643252 - RNA, 17 nt, Human
gaagccgacucuggccc

SEQ ID NO: 2643253 - RNA, 19 nt, Human
gaagccgacucuggcccug

SEQ ID NO: 2643254 - RNA, 21 nt, Human
gaagccgacucuggcccuggc

SEQ ID NO: 2643255 - RNA, 13 nt, Human
gaauaccugcuca

SEQ ID NO: 2643256 - RNA, 21 nt, Human
gaauggauuuuucuuuaacug

SEQ ID NO: 2643257 - RNA, 16 nt, Human
gauaaccuugaaaaaa

SEQ ID NO: 2643258 - RNA, 20 nt, Human
gaucuacuucuguaauugug

SEQ ID NO: 2643259 - RNA, 14 nt, Human
gauccggaaagaag

SEQ ID NO: 2643260 - RNA, 22 nt, Human
gauguucuauuuuuuguuuugu

SEQ ID NO: 2643261 - RNA, 16 nt, Human
gauuuaaaagccugcu

SEQ ID NO: 2643262 - RNA, 18 nt, Human
gauuuaaaagccugcuca

SEQ ID NO: 2643263 - RNA, 16 nt, Human
gcagccugcucuagug

SEQ ID NO: 2643264 - RNA, 21 nt, Human
gcagccugcucuagugggaca

SEQ ID NO: 2643265 - RNA, 16 nt, Human
gcagcaaacacuccac

SEQ ID NO: 2643266 - RNA, 22 nt, Human
gcagcaaacacuccacccucca

SEQ ID NO: 2643267 - RNA, 14 nt, Human
gcagcaccuccagg

SEQ ID NO: 2643268 - RNA, 15 nt, Human
gcagcaccuccaggc

SEQ ID NO: 2643269 - RNA, 16 nt, Human
gcagcaccuccaggcc

SEQ ID NO: 2643270 - RNA, 17 nt, Human
gcagcaccuccaggccu

SEQ ID NO: 2643271 - RNA, 18 nt, Human
gcagcaccuccaggccug

SEQ ID NO: 2643272 - RNA, 19 nt, Human
gcagcaccuccaggccugu

SEQ ID NO: 2643273 - RNA, 12 nt, Human
gcauuggauauu

SEQ ID NO: 2643274 - RNA, 18 nt, Human
gcauuggauauuuuuuac

SEQ ID NO: 2643275 - RNA, 12 nt, Human
gccgacucuggc

SEQ ID NO: 2643276 - RNA, 14 nt, Human
gccgacucuggccc

SEQ ID NO: 2643277 - RNA, 15 nt, Human
gccgacucuggcccu

SEQ ID NO: 2643278 - RNA, 16 nt, Human
gccgacucuggcccug

SEQ ID NO: 2643279 - RNA, 17 nt, Human
gccgacucuggcccugg

SEQ ID NO: 2643280 - RNA, 18 nt, Human
gccgacucuggcccuggc

SEQ ID NO: 2643281 - RNA, 21 nt, Human
gccucuccaguuugcaccugu

SEQ ID NO: 2643282 - RNA, 14 nt, Human
gcuaccaaaacagu

SEQ ID NO: 2643283 - RNA, 17 nt, Human
gccuuagggcacugggc

SEQ ID NO: 2643284 - RNA, 19 nt, Human
gccuuagggcacugggcug

SEQ ID NO: 2643285 - RNA, 23 nt, Human
gccuuuauuuuuggcguggcuga

SEQ ID NO: 2643286 - RNA, 14 nt, Human
gggcuuuuuucuuu

SEQ ID NO: 2643287 - RNA, 14 nt, Human
ggggcuaauuuaac

SEQ ID NO: 2643288 - RNA, 16 nt, Human
gggaagggccugccca

SEQ ID NO: 2643289 - RNA, 14 nt, Human
gggcacugggcugu

SEQ ID NO: 2643290 - RNA, 18 nt, Human
gcuucucuagcucucuag

SEQ ID NO: 2643291 - RNA, 19 nt, Human
gcuucucuagcucucuagg

SEQ ID NO: 2643292 - RNA, 21 nt, Human
gcuucucuagcucucuaggcc

SEQ ID NO: 2643293 - RNA, 22 nt, Human
gcuucucuagcucucuaggccu

SEQ ID NO: 2643294 - RNA, 19 nt, Human
ggaaagugcugucuuaaac

SEQ ID NO: 2643295 - RNA, 21 nt, Human
gcugucuuaaacuaaaugugc

SEQ ID NO: 2643296 - RNA, 21 nt, Human
ggcaccuacacucaccugcac

SEQ ID NO: 2643297 - RNA, 17 nt, Human
ggauccaaacugaucca

SEQ ID NO: 2643298 - RNA, 15 nt, Human
uaguuguguuucaac

SEQ ID NO: 2643299 - RNA, 13 nt, Human
uagcucucuaggc

SEQ ID NO: 2643300 - RNA, 14 nt, Human
uagcucucuaggcc

SEQ ID NO: 2643301 - RNA, 15 nt, Human
uagcucucuaggccu

SEQ ID NO: 2643302 - RNA, 17 nt, Human
uagcucucuaggccucu

SEQ ID NO: 2643303 - RNA, 14 nt, Human
uacccaaacugcuu

SEQ ID NO: 2643304 - RNA, 15 nt, Human
uacccaaacugcuuu

SEQ ID NO: 2643305 - RNA, 16 nt, Human
uagaaauuaccugugg

SEQ ID NO: 2643306 - RNA, 18 nt, Human
uagaaauuaccuguggau

SEQ ID NO: 2643307 - RNA, 17 nt, Human
uacuuuagaagccugca

SEQ ID NO: 2643308 - RNA, 21 nt, Human
uacuuuagaagccugcauaau

SEQ ID NO: 2643309 - RNA, 14 nt, Human
uaauuguguggauu

SEQ ID NO: 2643310 - RNA, 20 nt, Human
uaauuguguggauucuuuaa

SEQ ID NO: 2643311 - RNA, 17 nt, Human
uaauuuguuuuggauau

SEQ ID NO: 2643312 - RNA, 13 nt, Human
uaagaaauagaau

SEQ ID NO: 2643313 - RNA, 21 nt, Human
uaacacagcauuguauaugug

SEQ ID NO: 2643314 - RNA, 21 nt, Human
uaacauucaggaauucuugga

SEQ ID NO: 2643315 - RNA, 15 nt, Human
uaacaggccaaagag

SEQ ID NO: 2643316 - RNA, 17 nt, Human
uaacugccguaauuuaa

SEQ ID NO: 2643317 - RNA, 15 nt, Human
uaacuguaaagaugu

SEQ ID NO: 2643318 - RNA, 23 nt, Human
uaacuguaaagauguuuauuuca

SEQ ID NO: 2643319 - RNA, 15 nt, Human
uaaacaacagcugaa

SEQ ID NO: 2643320 - RNA, 18 nt, Human
uaaacaacagcugaagca

SEQ ID NO: 2643321 - RNA, 23 nt, Human
uaaaaauggcaggggguggaauu

SEQ ID NO: 2643322 - RNA, 14 nt, Human
uaaaagccugcuca

SEQ ID NO: 2643323 - RNA, 12 nt, Human
uaaaagccugcu

SEQ ID NO: 2643324 - RNA, 15 nt, Human
uaaaaaaaagaugaa

SEQ ID NO: 2643325 - RNA, 20 nt, Human
guuuagauuuaugguuguua

SEQ ID NO: 2643326 - RNA, 21 nt, Human
ucaacggaaagugcugucuua

SEQ ID NO: 2643327 - RNA, 12 nt, Human
ucacucugggcu

SEQ ID NO: 2643328 - RNA, 13 nt, Human
ucacucugggcug

SEQ ID NO: 2643329 - RNA, 20 nt, Human
ucagagugacuacacacagu

SEQ ID NO: 2643330 - RNA, 23 nt, Human
uccccgauaccaugcuguaagga

SEQ ID NO: 2643331 - RNA, 15 nt, Human
ucggaaaucuuaaac

SEQ ID NO: 2643332 - RNA, 12 nt, Human
ucuuuucuuuac

SEQ ID NO: 2643333 - RNA, 16 nt, Human
ugaaagcugauuuuuu

SEQ ID NO: 2643334 - RNA, 18 nt, Human
ucuguguuuugaaagaau

SEQ ID NO: 2643335 - RNA, 13 nt, Human
uggaggccccugg

SEQ ID NO: 2643336 - RNA, 16 nt, Human
uggaggccccuggagc

SEQ ID NO: 2643337 - RNA, 17 nt, Human
uggaggccccuggagcc

SEQ ID NO: 2643338 - RNA, 20 nt, Human
uggaggccccuggagccaga

SEQ ID NO: 2643339 - RNA, 21 nt, Human
uggcacugguagguugggaca

SEQ ID NO: 2643340 - RNA, 22 nt, Human
uggcacugguagguugggacac

SEQ ID NO: 2643341 - RNA, 15 nt, Human
uggaugcccagagga

SEQ ID NO: 2643342 - RNA, 18 nt, Human
ugcagcaaacacuccacc

SEQ ID NO: 2643343 - RNA, 19 nt, Human
ugcagcaaacacuccaccc

SEQ ID NO: 2643344 - RNA, 22 nt, Human
ugcagcaaacacuccacccucc

SEQ ID NO: 2643345 - RNA, 21 nt, Human
uguuuacaaaaauuucuguaa

SEQ ID NO: 2643346 - RNA, 16 nt, Human
uguguuugcagccugc

SEQ ID NO: 2643347 - RNA, 16 nt, Human
uguacuaacuagcauu

SEQ ID NO: 2643348 - RNA, 16 nt, Human
uguaacguggcacugg

SEQ ID NO: 2643349 - RNA, 14 nt, Human
ugguagguugggac

SEQ ID NO: 2643350 - RNA, 18 nt, Human
ugguagguugggacacca

SEQ ID NO: 2643351 - RNA, 21 nt, Human
ugguagguugggacaccaggg

SEQ ID NO: 2643352 - RNA, 21 nt, Human
ugugaauaccugcucacguca

SEQ ID NO: 2643353 - RNA, 13 nt, Human
ugugcaauagaag

SEQ ID NO: 2643354 - RNA, 16 nt, Human
ugugcaauagaaggug

SEQ ID NO: 2643355 - RNA, 17 nt, Human
uguccccacccuccacu

SEQ ID NO: 2643356 - RNA, 18 nt, Human
uguccccacccuccacuc

SEQ ID NO: 2643357 - RNA, 19 nt, Human
uguccccacccuccacuca

SEQ ID NO: 2643358 - RNA, 22 nt, Human
uguccccacccuccacucagcu

SEQ ID NO: 2643359 - RNA, 14 nt, Human
uguguacucugucc

SEQ ID NO: 2643360 - RNA, 14 nt, Human
uugaaagaauagaa

SEQ ID NO: 2643361 - RNA, 15 nt, Human
uucuauuuuuuguuu

SEQ ID NO: 2643362 - RNA, 23 nt, Human
uucuauuuuuuguuuuguuuccu

SEQ ID NO: 2643363 - RNA, 18 nt, Human
uuccuagcugugugaaua

SEQ ID NO: 2643364 - RNA, 23 nt, Human
uuccuuuccuguguguacucugu

SEQ ID NO: 2643365 - RNA, 14 nt, Human
uuccauuuuccccc

SEQ ID NO: 2643366 - RNA, 16 nt, Human
uuccauuuucccccac

SEQ ID NO: 2643367 - RNA, 18 nt, Human
uuccauuuucccccacua

SEQ ID NO: 2643368 - RNA, 16 nt, Human
uucaugacagccucca

SEQ ID NO: 2643369 - RNA, 15 nt, Human
uucaugauuagaaau

SEQ ID NO: 2643370 - RNA, 23 nt, Human
uucaugauuagaaauuaccugug

SEQ ID NO: 2643371 - RNA, 15 nt, Human
uucaugacagccucc

SEQ ID NO: 2643372 - RNA, 22 nt, Human
uucaacaaagaaacaaagaugu

SEQ ID NO: 2643373 - RNA, 21 nt, Human
uucaacaaagaaacaaagaug

SEQ ID NO: 2643374 - RNA, 17 nt, Human
uuacuaaaaaaaagaug

SEQ ID NO: 2643375 - RNA, 18 nt, Human
uuacuaaaaaaaagauga

SEQ ID NO: 2643376 - RNA, 18 nt, Human
uuuacuuuagaagccugc

SEQ ID NO: 2643377 - RNA, 14 nt, Human
uuuagaagccugca

SEQ ID NO: 2643378 - RNA, 22 nt, Human
uuuauaaaaguguucauuguuu

SEQ ID NO: 2643379 - RNA, 23 nt, Human
uuuagaaaaaauggaugcccaga

SEQ ID NO: 2643380 - RNA, 22 nt, Human
uuucagagugacuacacacagu

SEQ ID NO: 2643381 - RNA, 19 nt, Human
uuucaggcauuggauauuu

SEQ ID NO: 2643382 - RNA, 14 nt, Human
uuugauacauuuuu

SEQ ID NO: 2643383 - RNA, 12 nt, Human
uuuugaaagaau

SEQ ID NO: 2643384 - RNA, 15 nt, Human papillomavirus type 18
gagacagcacaggca

SEQ ID NO: 2643385 - RNA, 12 nt, Human papillomavirus type 18
gugaagccagaa

SEQ ID NO: 2643386 - RNA, 19 nt, Human papillomavirus type 18
caguguauuguacauugua

SEQ ID NO: 2643387 - RNA, 13 nt, Human papillomavirus type 18
guguuuguauguc

SEQ ID NO: 2643388 - RNA, 17 nt, Human papillomavirus type 18
aaaggcggcuguuuaca

SEQ ID NO: 2643389 - RNA, 16 nt, Human papillomavirus type 18
ugaacacccuguccuu

SEQ ID NO: 2643390 - RNA, 21 nt, Human papillomavirus type 18
gcagagcuagagacagcacag

SEQ ID NO: 2643391 - RNA, 16 nt, Human papillomavirus type 18
augguaucccaccgug

SEQ ID NO: 2643392 - RNA, 16 nt, Human papillomavirus type 18
auugauacacaaggaa

SEQ ID NO: 2643393 - RNA, 11 nt, Human papillomavirus type 18
uauugcccaug

SEQ ID NO: 2643394 - RNA, 19 nt, Human papillomavirus type 18
cagaugacgaggacgaaaa

SEQ ID NO: 2643395 - RNA, 13 nt, Human papillomavirus type 18
auggcaacaaaga

SEQ ID NO: 2643396 - RNA, 20 nt, Human papillomavirus type 18
aaacaggaauacugacugua

SEQ ID NO: 2643397 - RNA, 20 nt, Human papillomavirus type 18
guguguauauauauauacau

SEQ ID NO: 2643398 - RNA, 18 nt, Human papillomavirus type 18
ggcagagcuagagacagc

SEQ ID NO: 2643399 - RNA, 19 nt, Human papillomavirus type 18
aaguauauuuugauggcaa

SEQ ID NO: 2643400 - RNA, 17 nt, Human papillomavirus type 18
guccacaaugaugcaca

SEQ ID NO: 2643401 - RNA, 13 nt, Human papillomavirus type 18
accuucgagcauu

SEQ ID NO: 2643402 - RNA, 12 nt, Human papillomavirus type 18
uguauguccugu

SEQ ID NO: 2643403 - RNA, 19 nt, Human papillomavirus type 18
gcagaaaaaggcaaaaagg

SEQ ID NO: 2643404 - RNA, 18 nt, Human papillomavirus type 18
uuaaauacuguugcaauu

SEQ ID NO: 2643405 - RNA, 20 nt, Human papillomavirus type 18
uugcuuuuguguaugcaugu

SEQ ID NO: 2643406 - RNA, 12 nt, Human papillomavirus type 18
guguaugcaugu

SEQ ID NO: 2643407 - RNA, 21 nt, Human papillomavirus type 18
ggcugauccagaagguacaga

SEQ ID NO: 2643408 - RNA, 17 nt, Human papillomavirus type 18
ugccaucugucuguaug

SEQ ID NO: 2643409 - RNA, 20 nt, Human papillomavirus type 18
uguuacuauugcauauacau

SEQ ID NO: 2643410 - RNA, 14 nt, Human papillomavirus type 18
ggaggcagcacaga

SEQ ID NO: 2643411 - RNA, 18 nt, Human papillomavirus type 18
ccuuacagcauccauuuu

SEQ ID NO: 2643412 - RNA, 23 nt, Human papillomavirus type 18
gucuguaugugugcguaugcaug

SEQ ID NO: 2643413 - RNA, 17 nt, Human papillomavirus type 18
cacauaaagcuauugaa

SEQ ID NO: 2643414 - RNA, 19 nt, Human papillomavirus type 18
uggcuuaugucugugguuu

SEQ ID NO: 2643415 - RNA, 19 nt, Human papillomavirus type 18
guuuuauguacaagcuauu

SEQ ID NO: 2643416 - RNA, 16 nt, Human papillomavirus type 18
uuuagguguuggccuu

SEQ ID NO: 2643417 - RNA, 13 nt, Human papillomavirus type 18
agagacagcacag

SEQ ID NO: 2643418 - RNA, 17 nt, Human papillomavirus type 18
gguuguuguuguauguu

SEQ ID NO: 2643419 - RNA, 18 nt, Human papillomavirus type 18
aaauaucuuuaaauagug

SEQ ID NO: 2643420 - RNA, 21 nt, Human papillomavirus type 18
guaacugacuuauauaaaaca

SEQ ID NO: 2643421 - RNA, 21 nt, Human papillomavirus type 18
auauugcaauggucaagccuu

SEQ ID NO: 2643422 - RNA, 21 nt, Human papillomavirus type 18
ugaugcacaaguguugcaugu

SEQ ID NO: 2643423 - RNA, 15 nt, Human papillomavirus type 18
ggagcggcuggaggu

SEQ ID NO: 2643424 - RNA, 17 nt, Human papillomavirus type 18
cuagauuauuaacuguu

SEQ ID NO: 2643425 - RNA, 11 nt, Human papillomavirus type 18
guaauaaaagu

SEQ ID NO: 2643426 - RNA, 15 nt, Human papillomavirus type 18
cguuuagugugggcc

SEQ ID NO: 2643427 - RNA, 14 nt, Human papillomavirus type 18
gcaacagacacagg

SEQ ID NO: 2643428 - RNA, 17 nt, Human papillomavirus type 18
uagaguauuuagggugc

SEQ ID NO: 2643429 - RNA, 14 nt, Human papillomavirus type 18
caugcuauauuguc

SEQ ID NO: 2643430 - RNA, 16 nt, Human papillomavirus type 18
caucugucuguaugug

SEQ ID NO: 2643431 - RNA, 14 nt, Human papillomavirus type 18
ggcagcacagaaaa

SEQ ID NO: 2643432 - RNA, 18 nt, Human papillomavirus type 18
aagguggagggcaccacg

SEQ ID NO: 2643433 - RNA, 16 nt, Human papillomavirus type 18
uacaguguauuguaca

SEQ ID NO: 2643434 - RNA, 17 nt, Human papillomavirus type 18
gcuuuuguguaugcaug

SEQ ID NO: 2643435 - RNA, 13 nt, Human papillomavirus type 18
augcgcaggaggu

SEQ ID NO: 2643436 - RNA, 18 nt, Human papillomavirus type 18
agauaguguacaaauauu

SEQ ID NO: 2643437 - RNA, 13 nt, Human papillomavirus type 18
ugugaacaggcag

SEQ ID NO: 2643438 - RNA, 19 nt, Human papillomavirus type 18
agcuagagacagcacaggc

SEQ ID NO: 2643439 - RNA, 14 nt, Human papillomavirus type 18
aggcagagcuagag

SEQ ID NO: 2643440 - RNA, 15 nt, Human papillomavirus type 18
aguaagcaacaaugg

SEQ ID NO: 2643441 - RNA, 14 nt, Human papillomavirus type 18
gcugauccagaagg

SEQ ID NO: 2643442 - RNA, 23 nt, Human papillomavirus type 18
gacacagggucggauaugguaga

SEQ ID NO: 2643443 - RNA, 23 nt, Human papillomavirus type 18
ugcgaggaacuauggaauacaga

SEQ ID NO: 2643444 - RNA, 16 nt, Human papillomavirus type 18
gcagcucuagauuauu

SEQ ID NO: 2643445 - RNA, 15 nt, Human papillomavirus type 18
aaaaguaaagcacau

SEQ ID NO: 2643446 - RNA, 20 nt, Human papillomavirus type 18
agguccacaaugaugcacaa

SEQ ID NO: 2643447 - RNA, 16 nt, Human papillomavirus type 18
gaaccacaacgucaca

SEQ ID NO: 2643448 - RNA, 12 nt, Human papillomavirus type 18
uuaaauacuguu

SEQ ID NO: 2643449 - RNA, 21 nt, Human papillomavirus type 18
uacuauugcauauacaugcua

SEQ ID NO: 2643450 - RNA, 20 nt, Human papillomavirus type 18
agcagauaaaauauugcaau

SEQ ID NO: 2643451 - RNA, 15 nt, Human papillomavirus type 18
guuuguauguccugu

SEQ ID NO: 2643452 - RNA, 15 nt, Human papillomavirus type 18
cuagagacagcacag

SEQ ID NO: 2643453 - RNA, 13 nt, Human papillomavirus type 18
caugggacaaaac

SEQ ID NO: 2643454 - RNA, 17 nt, Human papillomavirus type 18
aaugcaacagacacagg

SEQ ID NO: 2643455 - RNA, 14 nt, Human papillomavirus type 18
gucuguaugugugc

SEQ ID NO: 2643456 - RNA, 14 nt, Human papillomavirus type 18
aguuugcaggaggc

SEQ ID NO: 2643457 - RNA, 16 nt, Human papillomavirus type 18
caacuguauuuguguu

SEQ ID NO: 2643458 - RNA, 22 nt, Human papillomavirus type 18
ugccaucugucuguaugugugc

SEQ ID NO: 2643459 - RNA, 13 nt, Human papillomavirus type 18
ugugcguaugcau

SEQ ID NO: 2643460 - RNA, 15 nt, Human papillomavirus type 18
uccaauacaguggug

SEQ ID NO: 2643461 - RNA, 14 nt, Human papillomavirus type 18
aaaugcaacagaca

SEQ ID NO: 2643462 - RNA, 15 nt, Human papillomavirus type 18
agacggggagggcac

SEQ ID NO: 2643463 - RNA, 22 nt, Human papillomavirus type 18
aggaacauuuugugaacaggca

SEQ ID NO: 2643464 - RNA, 14 nt, Human papillomavirus type 18
ugggauacaugaca

SEQ ID NO: 2643465 - RNA, 20 nt, Human papillomavirus type 18
auacagaaccuacucacugc

SEQ ID NO: 2643466 - RNA, 21 nt, Human papillomavirus type 18
cagagcuagagacagcacagg

SEQ ID NO: 2643467 - RNA, 18 nt, Human papillomavirus type 18
uaucauccaccuggcauu

SEQ ID NO: 2643468 - RNA, 12 nt, Human papillomavirus type 18
ugcuuuuuguau

SEQ ID NO: 2643469 - RNA, 13 nt, Human papillomavirus type 18
gaggcagcacaga

SEQ ID NO: 2643470 - RNA, 19 nt, Human papillomavirus type 18
ccuucgagcauuccagcag

SEQ ID NO: 2643471 - RNA, 15 nt, Human papillomavirus type 18
aggguacauuccauu

SEQ ID NO: 2643472 - RNA, 18 nt, Human papillomavirus type 18
acaacuguauuuguguuu

SEQ ID NO: 2643473 - RNA, 15 nt, Human papillomavirus type 18
uaagcgacucagagg

SEQ ID NO: 2643474 - RNA, 15 nt, Human papillomavirus type 18
uuacaguaauuguau

SEQ ID NO: 2643475 - RNA, 14 nt, Human papillomavirus type 18
auaugacugaugca

SEQ ID NO: 2643476 - RNA, 12 nt, Human papillomavirus type 18
agcauuccagca

SEQ ID NO: 2643477 - RNA, 15 nt, Human papillomavirus type 18
cauuuugcugugcaa

SEQ ID NO: 2643478 - RNA, 16 nt, Human papillomavirus type 18
ugcauaccaauauaga

SEQ ID NO: 2643479 - RNA, 14 nt, Human papillomavirus type 18
acaguaauuguaua

SEQ ID NO: 2643480 - RNA, 16 nt, Human papillomavirus type 18
uccuaagguuucugca

SEQ ID NO: 2643481 - RNA, 19 nt, Human papillomavirus type 18
ugaaauuccgguugaccuu

SEQ ID NO: 2643482 - RNA, 16 nt, Human papillomavirus type 18
uagacagccaaauaca

SEQ ID NO: 2643483 - RNA, 21 nt, Human papillomavirus type 18
auagguuguuuuauacagugu

SEQ ID NO: 2643484 - RNA, 22 nt, Human papillomavirus type 18
cuuagugggcauccauuuuaua

SEQ ID NO: 2643485 - RNA, 19 nt, Human papillomavirus type 18
guacgcuggcacuauugca

SEQ ID NO: 2643486 - RNA, 16 nt, Human papillomavirus type 18
uggugggauacaugac

SEQ ID NO: 2643487 - RNA, 15 nt, Human papillomavirus type 18
gguuauugaaccugu

SEQ ID NO: 2643488 - RNA, 16 nt, Human papillomavirus type 18
cugauacuaguauuua

SEQ ID NO: 2643489 - RNA, 14 nt, Human papillomavirus type 18
uguauuguacauug

SEQ ID NO: 2643490 - RNA, 16 nt, Human papillomavirus type 18
cagacggggagggcac

SEQ ID NO: 2643491 - RNA, 21 nt, Human papillomavirus type 18
uucacaguauauguauuuugu

SEQ ID NO: 2643492 - RNA, 18 nt, Human papillomavirus type 18
gaaaaugcaacagacaca

SEQ ID NO: 2643493 - RNA, 16 nt, Human papillomavirus type 18
agcuagagacagcaca

SEQ ID NO: 2643494 - RNA, 15 nt, Human papillomavirus type 18
gacaaaaaaacagga

SEQ ID NO: 2643495 - RNA, 20 nt, Human papillomavirus type 18
cagcaagggaacauggcaua

SEQ ID NO: 2643496 - RNA, 15 nt, Human papillomavirus type 18
acgucuaauguuucu

SEQ ID NO: 2643497 - RNA, 22 nt, Human papillomavirus type 18
gacagcacaggcauuguuccau

SEQ ID NO: 2643498 - RNA, 22 nt, Human papillomavirus type 18
cugcauaccaauauagaguauu

SEQ ID NO: 2643499 - RNA, 19 nt, Human papillomavirus type 18
ccugauacuaguauuuaua

SEQ ID NO: 2643500 - RNA, 20 nt, Human papillomavirus type 18
gcauuuagagccccaaaaug

SEQ ID NO: 2643501 - RNA, 19 nt, Human papillomavirus type 18
guguuuguauguccugugu

SEQ ID NO: 2643502 - RNA, 20 nt, Human papillomavirus type 18
aggauauuccuaagguuucu

SEQ ID NO: 2643503 - RNA, 16 nt, Human papillomavirus type 18
gaccacuauagagaua

SEQ ID NO: 2643504 - RNA, 13 nt, Human papillomavirus type 18
gaaagcucagcag

SEQ ID NO: 2643505 - RNA, 19 nt, Human papillomavirus type 18
uacacgucccccagugguu

SEQ ID NO: 2643506 - RNA, 12 nt, Human papillomavirus type 18
ccaauacagugg

SEQ ID NO: 2643507 - RNA, 20 nt, Human papillomavirus type 18
aaauguuuacgguacagauu

SEQ ID NO: 2643508 - RNA, 13 nt, Human papillomavirus type 18
cauagacagccaa

SEQ ID NO: 2643509 - RNA, 20 nt, Human papillomavirus type 18
uauauuuuguuuuauaccuu

SEQ ID NO: 2643510 - RNA, 17 nt, Human papillomavirus type 18
acuuauauaaaacaugu

SEQ ID NO: 2643511 - RNA, 16 nt, Human papillomavirus type 18
caguauuggcaacuaa

SEQ ID NO: 2643512 - RNA, 21 nt, Human papillomavirus type 18
cauagacagccaaauacagua

SEQ ID NO: 2643513 - RNA, 12 nt, Human papillomavirus type 18
augcaacagaca

SEQ ID NO: 2643514 - RNA, 16 nt, Human papillomavirus type 18
ugucuguaugugugcg

SEQ ID NO: 2643515 - RNA, 17 nt, Human papillomavirus type 18
uguaguaccaauauguu

SEQ ID NO: 2643516 - RNA, 23 nt, Human papillomavirus type 18
aaaguuugcaggaggcagcacag

SEQ ID NO: 2643517 - RNA, 20 nt, Human papillomavirus type 18
cagagcuagagacagcacag

SEQ ID NO: 2643518 - RNA, 16 nt, Human papillomavirus type 18
ccaugucccgcuuuug

SEQ ID NO: 2643519 - RNA, 15 nt, Human papillomavirus type 18
auuucaaaaaguaaa

SEQ ID NO: 2643520 - RNA, 22 nt, Human papillomavirus type 18
gaaaaugcaacagacacagggu

SEQ ID NO: 2643521 - RNA, 18 nt, Human papillomavirus type 18
cacaacguuuaguguggg

SEQ ID NO: 2643522 - RNA, 16 nt, Human papillomavirus type 18
gacgaaaaugcaacag

SEQ ID NO: 2643523 - RNA, 17 nt, Human papillomavirus type 18
uaauaacguccccugcc

SEQ ID NO: 2643524 - RNA, 20 nt, Human papillomavirus type 18
uaaaacgaaaguuugcagga

SEQ ID NO: 2643525 - RNA, 13 nt, Human papillomavirus type 18
guuugcaggaggc

SEQ ID NO: 2643526 - RNA, 22 nt, Human papillomavirus type 18
ugugacucccacaagcauauuu

SEQ ID NO: 2643527 - RNA, 18 nt, Human papillomavirus type 18
acauuuugugaacaggca

SEQ ID NO: 2643528 - RNA, 22 nt, Human papillomavirus type 18
acugaugcaggaacaugggaca

SEQ ID NO: 2643529 - RNA, 20 nt, Human papillomavirus type 18
uggcauuggacaggugcagg

SEQ ID NO: 2643530 - RNA, 21 nt, Human papillomavirus type 18
uuauugauacacaaggaacau

SEQ ID NO: 2643531 - RNA, 13 nt, Human papillomavirus type 18
uacgguacagauu

SEQ ID NO: 2643532 - RNA, 18 nt, Human papillomavirus type 18
ccuacaauccuccauuuu

SEQ ID NO: 2643533 - RNA, 14 nt, Human papillomavirus type 18
gcuauugaacugca

SEQ ID NO: 2643534 - RNA, 12 nt, Human papillomavirus type 18
gcugauccagaa

SEQ ID NO: 2643535 - RNA, 12 nt, Human papillomavirus type 18
acuggcaguggu

SEQ ID NO: 2643536 - RNA, 22 nt, Human papillomavirus type 18
ugugguaauaacguccccugcc

SEQ ID NO: 2643537 - RNA, 21 nt, Human papillomavirus type 18
uggacaggugcaggcaaugaa

SEQ ID NO: 2643538 - RNA, 21 nt, Human papillomavirus type 18
agguuguuuuauacaguguau

SEQ ID NO: 2643539 - RNA, 13 nt, Human papillomavirus type 18
uguaugcauguau

SEQ ID NO: 2643540 - RNA, 15 nt, Human papillomavirus type 18
cuuuuguguaugcau

SEQ ID NO: 2643541 - RNA, 18 nt, Human papillomavirus type 18
auacaucuauuguugugu

SEQ ID NO: 2643542 - RNA, 15 nt, Human papillomavirus type 18
uggaccuaaggcaac

SEQ ID NO: 2643543 - RNA, 22 nt, Human papillomavirus type 18
agggaacauggcauacagacau

SEQ ID NO: 2643544 - RNA, 19 nt, Human papillomavirus type 18
guccacgguuacaagaaau

SEQ ID NO: 2643545 - RNA, 16 nt, Human papillomavirus type 18
cuauauauuguccugu

SEQ ID NO: 2643546 - RNA, 18 nt, Human papillomavirus type 18
cauguuacuauugcauau

SEQ ID NO: 2643547 - RNA, 22 nt, Human papillomavirus type 18
ugggcguuccaauacaguggug

SEQ ID NO: 2643548 - RNA, 18 nt, Human papillomavirus type 18
acaccuuacagcauccau

SEQ ID NO: 2643549 - RNA, 13 nt, Human papillomavirus type 18
acagaaaacaguc

SEQ ID NO: 2643550 - RNA, 14 nt, Human papillomavirus type 18
acguccccugccac

SEQ ID NO: 2643551 - RNA, 17 nt, Human papillomavirus type 18
auccuacaauccuccau

SEQ ID NO: 2643552 - RNA, 13 nt, Human papillomavirus type 18
ccaauacaguggu

SEQ ID NO: 2643553 - RNA, 21 nt, Human papillomavirus type 18
uccccugccacagcauucaca

SEQ ID NO: 2643554 - RNA, 20 nt, Human papillomavirus type 18
uaugcauggaccuaaggcaa

SEQ ID NO: 2643555 - RNA, 19 nt, Human papillomavirus type 18
cgaggaacuauggaauaca

SEQ ID NO: 2643556 - RNA, 12 nt, Human papillomavirus type 18
auccauauuuua

SEQ ID NO: 2643557 - RNA, 16 nt, Human papillomavirus type 18
auguagcaugggacag

SEQ ID NO: 2643558 - RNA, 21 nt, Human papillomavirus type 18
auauguuuugugguucugugu

SEQ ID NO: 2643559 - RNA, 13 nt, Human papillomavirus type 18
augcauguaugug

SEQ ID NO: 2643560 - RNA, 20 nt, Human papillomavirus type 18
uguaaacaaucugguacaug

SEQ ID NO: 2643561 - RNA, 14 nt, Human papillomavirus type 18
ucuauuguuguguu

SEQ ID NO: 2643562 - RNA, 15 nt, Human papillomavirus type 18
caguguauuguacau

SEQ ID NO: 2643563 - RNA, 20 nt, Human papillomavirus type 18
ugcaggugguggcaauaagc

SEQ ID NO: 2643564 - RNA, 21 nt, Human papillomavirus type 18
gcauauuuuaucaugcuggca

SEQ ID NO: 2643565 - RNA, 15 nt, Human papillomavirus type 18
caggcagagcuagag

SEQ ID NO: 2643566 - RNA, 22 nt, Human papillomavirus type 18
gccaugucccgcuuuugccauc

SEQ ID NO: 2643567 - RNA, 19 nt, Human papillomavirus type 18
augcaggaacaugggacaa

SEQ ID NO: 2643568 - RNA, 23 nt, Human papillomavirus type 18
ugcauguaugugugcugccaugu

SEQ ID NO: 2643569 - RNA, 17 nt, Human papillomavirus type 18
gcuauauauuguccugu

SEQ ID NO: 2643570 - RNA, 21 nt, Human papillomavirus type 18
uggcugauccagaagguacag

SEQ ID NO: 2643571 - RNA, 17 nt, Human papillomavirus type 18
ccauuuugcugugcaac

SEQ ID NO: 2643572 - RNA, 15 nt, Human papillomavirus type 18
cacacaauguugugu

SEQ ID NO: 2643573 - RNA, 20 nt, Human papillomavirus type 18
gcagagcuagagacagcaca

SEQ ID NO: 2643574 - RNA, 14 nt, Human papillomavirus type 18
guauuguacauugu

SEQ ID NO: 2643575 - RNA, 16 nt, Human papillomavirus type 18
uuuguauuuuuguaau

SEQ ID NO: 2643576 - RNA, 12 nt, Human papillomavirus type 18
guguauauugug

SEQ ID NO: 2643577 - RNA, 11 nt, Human papillomavirus type 18
guauguccugu

SEQ ID NO: 2643578 - RNA, 16 nt, Human papillomavirus type 18
auggcaacaaagacaa

SEQ ID NO: 2643579 - RNA, 13 nt, Human papillomavirus type 18
aguaagcaacaau

SEQ ID NO: 2643580 - RNA, 21 nt, Human papillomavirus type 18
ccaugucccgcuuuugccauc

SEQ ID NO: 2643581 - RNA, 14 nt, Human papillomavirus type 18
uaccaauauguuau

SEQ ID NO: 2643582 - RNA, 20 nt, Human papillomavirus type 18
uacuguugcaauuccagaua

SEQ ID NO: 2643583 - RNA, 13 nt, Human papillomavirus type 18
acgaggacgaaaa

SEQ ID NO: 2643584 - RNA, 14 nt, Human papillomavirus type 18
uauuguccuguauu

SEQ ID NO: 2643585 - RNA, 14 nt, Human papillomavirus type 18
acuggcagugguac

SEQ ID NO: 2643586 - RNA, 14 nt, Human papillomavirus type 18
caguacgcuggcac

SEQ ID NO: 2643587 - RNA, 16 nt, Human papillomavirus type 18
cuagagacagcacagg

SEQ ID NO: 2643588 - RNA, 18 nt, Human papillomavirus type 18
uguugguaauccauauuu

SEQ ID NO: 2643589 - RNA, 13 nt, Human papillomavirus type 18
ccuaagguuucug

SEQ ID NO: 2643590 - RNA, 23 nt, Human papillomavirus type 18
ccagcaguaagcaacaauggcug

SEQ ID NO: 2643591 - RNA, 13 nt, Human papillomavirus type 18
uggaaauuggccg

SEQ ID NO: 2643592 - RNA, 18 nt, Human papillomavirus type 18
uucugcauaccaauauag

SEQ ID NO: 2643593 - RNA, 16 nt, Human papillomavirus type 18
guuagcagauaaaaua

SEQ ID NO: 2643594 - RNA, 14 nt, Human papillomavirus type 18
ugcuauauugucuu

SEQ ID NO: 2643595 - RNA, 23 nt, Human papillomavirus type 18
ggcacggguuguaacggcugguu

SEQ ID NO: 2643596 - RNA, 18 nt, Human papillomavirus type 18
aggaggcagcacagaaaa

SEQ ID NO: 2643597 - RNA, 16 nt, Human papillomavirus type 18
uucacaguauauguau

SEQ ID NO: 2643598 - RNA, 21 nt, Human papillomavirus type 18
cagauaaaauauugcaauggu

SEQ ID NO: 2643599 - RNA, 23 nt, Human papillomavirus type 18
agaacaaaauuuuuaaauacugu

SEQ ID NO: 2643600 - RNA, 15 nt, Human papillomavirus type 18
gaggauuggacacug

SEQ ID NO: 2643601 - RNA, 17 nt, Human papillomavirus type 18
uuguaugauugcauugu

SEQ ID NO: 2643602 - RNA, 13 nt, Human papillomavirus type 18
uuguauauuuugu

SEQ ID NO: 2643603 - RNA, 19 nt, Human papillomavirus type 18
ggcuggagguggauacaga

SEQ ID NO: 2643604 - RNA, 16 nt, Human papillomavirus type 18
uaaacaaucugguaca

SEQ ID NO: 2643605 - RNA, 19 nt, Human papillomavirus type 18
cuguaacauaccauaguga

SEQ ID NO: 2643606 - RNA, 23 nt, Human papillomavirus type 18
uagugaguaacaacuguauuugu

SEQ ID NO: 2643607 - RNA, 13 nt, Human papillomavirus type 18
ucccccagugguu

SEQ ID NO: 2643608 - RNA, 18 nt, Human papillomavirus type 18
gaacauggcauacagaca

SEQ ID NO: 2643609 - RNA, 16 nt, Human papillomavirus type 18
gagacagcacaggcau

SEQ ID NO: 2643610 - RNA, 18 nt, Human papillomavirus type 18
cagcaagggaacauggca

SEQ ID NO: 2643611 - RNA, 13 nt, Human papillomavirus type 18
auuuuguuuuaua

SEQ ID NO: 2643612 - RNA, 20 nt, Human papillomavirus type 18
uagugaguaacaacuguauu

SEQ ID NO: 2643613 - RNA, 21 nt, Human papillomavirus type 18
caaauauuggugggauacaug

SEQ ID NO: 2643614 - RNA, 15 nt, Human papillomavirus type 18
auuggcaacuaauac

SEQ ID NO: 2643615 - RNA, 22 nt, Human papillomavirus type 18
guaaagacauagacagccaaau

SEQ ID NO: 2643616 - RNA, 17 nt, Human papillomavirus type 18
agggcacggguuguaac

SEQ ID NO: 2643617 - RNA, 17 nt, Human papillomavirus type 18
cuauauauuguccugua

SEQ ID NO: 2643618 - RNA, 21 nt, Human papillomavirus type 18
accgaggauuggacacugcaa

SEQ ID NO: 2643619 - RNA, 11 nt, Human papillomavirus type 18
ccaauacagug

SEQ ID NO: 2643620 - RNA, 15 nt, Human papillomavirus type 18
acaaaaaaacaggag

SEQ ID NO: 2643621 - RNA, 19 nt, Human papillomavirus type 18
auauuuuaggguuccugca

SEQ ID NO: 2643622 - RNA, 22 nt, Human papillomavirus type 18
uauagguuguuuuauacagugu

SEQ ID NO: 2643623 - RNA, 22 nt, Human papillomavirus type 18
augcauguaugugugcugccau

SEQ ID NO: 2643624 - RNA, 23 nt, Human papillomavirus type 18
uccguggugugcaucccagcagu

SEQ ID NO: 2643625 - RNA, 15 nt, Human papillomavirus type 18
auauaaaacauguaa

SEQ ID NO: 2643626 - RNA, 14 nt, Human papillomavirus type 18
uguauuauaugacu

SEQ ID NO: 2643627 - RNA, 15 nt, Human papillomavirus type 18
ugugguucugugugu

SEQ ID NO: 2643628 - RNA, 22 nt, Human papillomavirus type 18
ggcagcacagaaaacaguccau

SEQ ID NO: 2643629 - RNA, 18 nt, Human papillomavirus type 18
uagguacuggcaguggua

SEQ ID NO: 2643630 - RNA, 14 nt, Human papillomavirus type 18
cugauacuaguauu

SEQ ID NO: 2643631 - RNA, 19 nt, Human papillomavirus type 18
ucuauuguuguguuuguau

SEQ ID NO: 2643632 - RNA, 13 nt, Human papillomavirus type 18
cacaguauaugua

SEQ ID NO: 2643633 - RNA, 14 nt, Human papillomavirus type 18
cuguaugugugcgu

SEQ ID NO: 2643634 - RNA, 19 nt, Human papillomavirus type 18
gagcauuccagcagcuguu

SEQ ID NO: 2643635 - RNA, 15 nt, Human papillomavirus type 18
uuuauacaguguauu

SEQ ID NO: 2643636 - RNA, 20 nt, Human papillomavirus type 18
caaguauauuuugauggcaa

SEQ ID NO: 2643637 - RNA, 14 nt, Human papillomavirus type 18
ccugcagguggugg

SEQ ID NO: 2643638 - RNA, 16 nt, Human papillomavirus type 18
auauucuuugcagcaa

SEQ ID NO: 2643639 - RNA, 16 nt, Human papillomavirus type 18
acaauguaauacauau

SEQ ID NO: 2643640 - RNA, 18 nt, Human papillomavirus type 18
auggcugauccagaaggu

SEQ ID NO: 2643641 - RNA, 14 nt, Human papillomavirus type 18
uuaccugauacuag

SEQ ID NO: 2643642 - RNA, 17 nt, Human papillomavirus type 18
caggaggcagcacagaa

SEQ ID NO: 2643643 - RNA, 22 nt, Human papillomavirus type 18
ugugcaucccagcaguaagcaa

SEQ ID NO: 2643644 - RNA, 18 nt, Human papillomavirus type 18
uugcauguuuuaaaacga

SEQ ID NO: 2643645 - RNA, 12 nt, Human papillomavirus type 18
gccaaauacagu

SEQ ID NO: 2643646 - RNA, 16 nt, Human papillomavirus type 18
ugcauguaugugugcu

SEQ ID NO: 2643647 - RNA, 17 nt, Human papillomavirus type 18
uucacaguauauguauu

SEQ ID NO: 2643648 - RNA, 14 nt, Human papillomavirus type 18
uaggguuccugcag

SEQ ID NO: 2643649 - RNA, 14 nt, Human papillomavirus type 18
cuguguuuguguuu

SEQ ID NO: 2643650 - RNA, 19 nt, Human papillomavirus type 18
uaguagaaagcucagcaga

SEQ ID NO: 2643651 - RNA, 10 nt, Human papillomavirus type 18
uuuguuguau

SEQ ID NO: 2643652 - RNA, 15 nt, Human papillomavirus type 18
caacauuuaccagcc

SEQ ID NO: 2643653 - RNA, 16 nt, Human papillomavirus type 18
gcaggaggcagcacag

SEQ ID NO: 2643654 - RNA, 17 nt, Human papillomavirus type 18
ucccgcuuuugccaucu

SEQ ID NO: 2643655 - RNA, 18 nt, Human papillomavirus type 18
ucacacaauguuguguau

SEQ ID NO: 2643656 - RNA, 22 nt, Human papillomavirus type 18
ugaaaaaacaggaauacugacu

SEQ ID NO: 2643657 - RNA, 18 nt, Human papillomavirus type 18
caauggcugauccagaag

SEQ ID NO: 2643658 - RNA, 13 nt, Human papillomavirus type 18
ugcaggaggcagc

SEQ ID NO: 2643659 - RNA, 13 nt, Human papillomavirus type 18
uuugugguucugu

SEQ ID NO: 2643660 - RNA, 21 nt, Human papillomavirus type 18
cugcaggugguggcaauaagc

SEQ ID NO: 2643661 - RNA, 15 nt, Human papillomavirus type 18
ucugguacaugucca

SEQ ID NO: 2643662 - RNA, 18 nt, Human papillomavirus type 18
gaacuauggaauacagaa

SEQ ID NO: 2643663 - RNA, 19 nt, Human papillomavirus type 18
acagaaccuacucacugcu

SEQ ID NO: 2643664 - RNA, 14 nt, Human papillomavirus type 18
guugggaaaaugca

SEQ ID NO: 2643665 - RNA, 20 nt, Human papillomavirus type 18
gguguuggccuuagugggca

SEQ ID NO: 2643666 - RNA, 23 nt, Human papillomavirus type 18
gugguggauguugguccuacacg

SEQ ID NO: 2643667 - RNA, 21 nt, Human papillomavirus type 18
uugggcuauauauuguccugu

SEQ ID NO: 2643668 - RNA, 17 nt, Human papillomavirus type 18
guuugcaggaggcagca

SEQ ID NO: 2643669 - RNA, 12 nt, Human papillomavirus type 18
gcgacucagagg

SEQ ID NO: 2643670 - RNA, 22 nt, Human papillomavirus type 18
cagagcuagagacagcacaggc

SEQ ID NO: 2643671 - RNA, 12 nt, Human papillomavirus type 18
ugcaggaggcag

SEQ ID NO: 2643672 - RNA, 15 nt, Human papillomavirus type 18
guacaggguacauuc

SEQ ID NO: 2643673 - RNA, 17 nt, Human papillomavirus type 18
ccgccacgucuaauguu

SEQ ID NO: 2643674 - RNA, 22 nt, Human papillomavirus type 18
cucccacaagcauauuuuauca

SEQ ID NO: 2643675 - RNA, 17 nt, Human papillomavirus type 18
uauaucauccaccuggc

SEQ ID NO: 2643676 - RNA, 14 nt, Human papillomavirus type 18
gagcuagagacagc

SEQ ID NO: 2643677 - RNA, 22 nt, Human papillomavirus type 18
accuucuaugucacgagcaauu

SEQ ID NO: 2643678 - RNA, 17 nt, Human papillomavirus type 18
agagacagcacaggcau

SEQ ID NO: 2643679 - RNA, 19 nt, Human papillomavirus type 18
uugcaggaggcagcacaga

SEQ ID NO: 2643680 - RNA, 18 nt, Human papillomavirus type 18
ggcaaaaaggcggcuguu

SEQ ID NO: 2643681 - RNA, 15 nt, Human papillomavirus type 18
aauacaguauuggca

SEQ ID NO: 2643682 - RNA, 22 nt, Human papillomavirus type 18
aaaguuugcaggaggcagcaca

SEQ ID NO: 2643683 - RNA, 22 nt, Human papillomavirus type 18
gaaaacaguccauuaggggagc

SEQ ID NO: 2643684 - RNA, 21 nt, Human papillomavirus type 18
auuuugugaacaggcagagcu

SEQ ID NO: 2643685 - RNA, 15 nt, Human papillomavirus type 18
uauugugguaauaac

SEQ ID NO: 2643686 - RNA, 21 nt, Human papillomavirus type 18
ggcguuccaauacaguggugg

SEQ ID NO: 2643687 - RNA, 13 nt, Human papillomavirus type 18
caggaacauggga

SEQ ID NO: 2643688 - RNA, 19 nt, Human papillomavirus type 18
gcaauuaagcgacucagag

SEQ ID NO: 2643689 - RNA, 13 nt, Human papillomavirus type 18
ugcaucccagcag

SEQ ID NO: 2643690 - RNA, 20 nt, Human papillomavirus type 18
uaauaacguccccugccaca

SEQ ID NO: 2643691 - RNA, 14 nt, Human papillomavirus type 18
caagggaacauggc

SEQ ID NO: 2643692 - RNA, 21 nt, Human papillomavirus type 18
acagaaaacaguccauuaggg

SEQ ID NO: 2643693 - RNA, 18 nt, Human papillomavirus type 18
cuuauuuuuuuauuuugc

SEQ ID NO: 2643694 - RNA, 15 nt, Human papillomavirus type 18
cuauagagauauauc

SEQ ID NO: 2643695 - RNA, 22 nt, Human papillomavirus type 18
acaguguauuguacauuguaua

SEQ ID NO: 2643696 - RNA, 22 nt, Human papillomavirus type 18
cuaauacguugggaaaaugcaa

SEQ ID NO: 2643697 - RNA, 22 nt, Human papillomavirus type 18
aguuugcaggaggcagcacaga

SEQ ID NO: 2643698 - RNA, 21 nt, Human papillomavirus type 18
ugcaucccagcaguaagcaac

SEQ ID NO: 2643699 - RNA, 11 nt, Human papillomavirus type 18
ccguggugugc

SEQ ID NO: 2643700 - RNA, 21 nt, Human papillomavirus type 18
uaacggcugguuuuauguaca

SEQ ID NO: 2643701 - RNA, 14 nt, Human papillomavirus type 18
ggccuuagugggca

SEQ ID NO: 2643702 - RNA, 18 nt, Human papillomavirus type 18
augugugcguaugcaugg

SEQ ID NO: 2643703 - RNA, 17 nt, Human papillomavirus type 18
gcuagagacagcacagg

SEQ ID NO: 2643704 - RNA, 17 nt, Human papillomavirus type 18
uaugcauguaugugugc

SEQ ID NO: 2643705 - RNA, 14 nt, Human papillomavirus type 18
guuguuuuauacag

SEQ ID NO: 2643706 - RNA, 15 nt, Human papillomavirus type 18
cuaagguuucugcau

SEQ ID NO: 2643707 - RNA, 22 nt, Human papillomavirus type 18
uaugugacucccacaagcauau

SEQ ID NO: 2643708 - RNA, 21 nt, Human papillomavirus type 18
uagugaguaacaacuguauuu

SEQ ID NO: 2643709 - RNA, 15 nt, Human papillomavirus type 18
cuauggaauacagaa

SEQ ID NO: 2643710 - RNA, 13 nt, Human papillomavirus type 18
aaacaguacaagu

SEQ ID NO: 2643711 - RNA, 14 nt, Human papillomavirus type 18
uuuguauguccugu

SEQ ID NO: 2643712 - RNA, 20 nt, Human papillomavirus type 18
acucccacaagcauauuuua

SEQ ID NO: 2643713 - RNA, 13 nt, Human papillomavirus type 18
ggagcggcuggag

SEQ ID NO: 2643714 - RNA, 19 nt, Human papillomavirus type 18
caggaggcagcacagaaaa

SEQ ID NO: 2643715 - RNA, 20 nt, Human papillomavirus type 18
auauuccuaagguuucugca

SEQ ID NO: 2643716 - RNA, 22 nt, Human papillomavirus type 18
agacgaccuucgagcauuccag

SEQ ID NO: 2643717 - RNA, 20 nt, Human papillomavirus type 18
cauagacagccaaauacagu

SEQ ID NO: 2643718 - RNA, 17 nt, Human papillomavirus type 18
cacugcuuuaaaaaagg

SEQ ID NO: 2643719 - RNA, 18 nt, Human papillomavirus type 18
aaggaacauuuugugaac

SEQ ID NO: 2643720 - RNA, 16 nt, Human papillomavirus type 18
auugcauuuagagccc

SEQ ID NO: 2643721 - RNA, 17 nt, Human papillomavirus type 18
gaguuaaucaucaacau

SEQ ID NO: 2643722 - RNA, 17 nt, Human papillomavirus type 18
uuguauguuacuauauu

SEQ ID NO: 2643723 - RNA, 20 nt, Human papillomavirus type 18
uuaugcuuuuuguauuuuug

SEQ ID NO: 2643724 - RNA, 20 nt, Human papillomavirus type 18
caagccuugguauauuuuug

SEQ ID NO: 2643725 - RNA, 18 nt, Human papillomavirus type 18
cugaugcaggaacauggg

SEQ ID NO: 2643726 - RNA, 13 nt, Human papillomavirus type 18
uacauaugcugua

SEQ ID NO: 2643727 - RNA, 19 nt, Human papillomavirus type 18
ggccugugcuggaguggaa

SEQ ID NO: 2643728 - RNA, 21 nt, Human papillomavirus type 18
gacugaugcaggaacauggga

SEQ ID NO: 2643729 - RNA, 21 nt, Human papillomavirus type 18
auuguuccaugcgcaggaggu

SEQ ID NO: 2643730 - RNA, 16 nt, Human papillomavirus type 18
ccuauguagcauggga

SEQ ID NO: 2643731 - RNA, 16 nt, Human papillomavirus type 18
uugcaagacauuguau

SEQ ID NO: 2643732 - RNA, 22 nt, Human papillomavirus type 18
auagugggcagaaaaaggcaaa

SEQ ID NO: 2643733 - RNA, 16 nt, Human papillomavirus type 18
agagacagcacaggca

SEQ ID NO: 2643734 - RNA, 20 nt, Human papillomavirus type 18
gggaacauggcauacagaca

SEQ ID NO: 2643735 - RNA, 20 nt, Human papillomavirus type 18
ugggcguuccaauacagugg

SEQ ID NO: 2643736 - RNA, 15 nt, Human papillomavirus type 18
uaugugugcugccau

SEQ ID NO: 2643737 - RNA, 16 nt, Human papillomavirus type 18
cggguuguaacggcug

SEQ ID NO: 2643738 - RNA, 16 nt, Human papillomavirus type 18
caauauagaguauuua

SEQ ID NO: 2643739 - RNA, 18 nt, Human papillomavirus type 18
agaaacaguuuaaaaugu

SEQ ID NO: 2643740 - RNA, 14 nt, Human papillomavirus type 18
gagguggauacaga

SEQ ID NO: 2643741 - RNA, 19 nt, Human papillomavirus type 18
cagcagcuguuucugaaca

SEQ ID NO: 2643742 - RNA, 12 nt, Human papillomavirus type 18
cuaauguuucug

SEQ ID NO: 2643743 - RNA, 23 nt, Human papillomavirus type 18
caaggaacauuuugugaacaggc

SEQ ID NO: 2643744 - RNA, 14 nt, Human papillomavirus type 18
aucugucuguaugu

SEQ ID NO: 2643745 - RNA, 21 nt, Human papillomavirus type 18
aauuguauagguuguuuuaua

SEQ ID NO: 2643746 - RNA, 13 nt, Human papillomavirus type 18
gcauauacaugcu

SEQ ID NO: 2643747 - RNA, 14 nt, Human papillomavirus type 18
gauguaauaucaga

SEQ ID NO: 2643748 - RNA, 23 nt, Human papillomavirus type 18
uggcauagguacuggcaguggua

SEQ ID NO: 2643749 - RNA, 17 nt, Human papillomavirus type 18
uagugaaacacaaagaa

SEQ ID NO: 2643750 - RNA, 22 nt, Human papillomavirus type 18
ugccaugucccgcuuuugccau

SEQ ID NO: 2643751 - RNA, 16 nt, Human papillomavirus type 18
guagcaugggacagug

SEQ ID NO: 2643752 - RNA, 21 nt, Human papillomavirus type 18
gggacaaaaccgcuaccugug

SEQ ID NO: 2643753 - RNA, 16 nt, Human papillomavirus type 18
auauauuguccuguau

SEQ ID NO: 2643754 - RNA, 22 nt, Human papillomavirus type 18
gcggcuggagguggauacagag

SEQ ID NO: 2643755 - RNA, 20 nt, Human papillomavirus type 18
gagcuagagacagcacaggc

SEQ ID NO: 2643756 - RNA, 19 nt, Human papillomavirus type 18
ccugcaggugguggcaaua

SEQ ID NO: 2643757 - RNA, 20 nt, Human papillomavirus type 18
auguaugguuguuguuguau

SEQ ID NO: 2643758 - RNA, 17 nt, Human papillomavirus type 18
uggcuuaugucuguggu

SEQ ID NO: 2643759 - RNA, 18 nt, Human papillomavirus type 18
agugggcagaaaaaggca

SEQ ID NO: 2643760 - RNA, 13 nt, Human papillomavirus type 18
ccgacgagccgaa

SEQ ID NO: 2643761 - RNA, 18 nt, Human papillomavirus type 18
augcaacagacacagggu

SEQ ID NO: 2643762 - RNA, 15 nt, Human papillomavirus type 18
cagaaaacaguccau

SEQ ID NO: 2643763 - RNA, 19 nt, Human papillomavirus type 18
caucaacauuuaccagccc

SEQ ID NO: 2643764 - RNA, 13 nt, Human papillomavirus type 18
agccaaauacagu

SEQ ID NO: 2643765 - RNA, 19 nt, Human papillomavirus type 18
accuauguagcaugggaca

SEQ ID NO: 2643766 - RNA, 17 nt, Human papillomavirus type 18
augcgcaggagguccac

SEQ ID NO: 2643767 - RNA, 18 nt, Human papillomavirus type 18
auugauacacaaggaaca

SEQ ID NO: 2643768 - RNA, 19 nt, Human papillomavirus type 18
gagcuagagacagcacagg

SEQ ID NO: 2643769 - RNA, 18 nt, Human papillomavirus type 18
aaugcaauauucuuugca

SEQ ID NO: 2643770 - RNA, 16 nt, Human papillomavirus type 18
accugugggccccaca

SEQ ID NO: 2643771 - RNA, 20 nt, Human papillomavirus type 18
gacgaaaaugcaacagacac

SEQ ID NO: 2643772 - RNA, 18 nt, Human papillomavirus type 18
uucgagcauuccagcagc

SEQ ID NO: 2643773 - RNA, 16 nt, Human papillomavirus type 18
aggaagaaaacgauga

SEQ ID NO: 2643774 - RNA, 16 nt, Human papillomavirus type 18
uaugcuuuuuguauuu

SEQ ID NO: 2643775 - RNA, 19 nt, Human papillomavirus type 18
guacagacggggagggcac

SEQ ID NO: 2643776 - RNA, 21 nt, Human papillomavirus type 18
cuaagguuucugcauaccaau

SEQ ID NO: 2643777 - RNA, 19 nt, Human papillomavirus type 18
uaugguaucccaccgugcc

SEQ ID NO: 2643778 - RNA, 23 nt, Human papillomavirus type 18
caaauaaauuugguuuaccugau

SEQ ID NO: 2643779 - RNA, 21 nt, Human papillomavirus type 18
uacaauccuccauuuugcugu

SEQ ID NO: 2643780 - RNA, 20 nt, Human papillomavirus type 18
uuugcaggaggcagcacaga

SEQ ID NO: 2643781 - RNA, 17 nt, Human papillomavirus type 18
guagaaagcucagcaga

SEQ ID NO: 2643782 - RNA, 18 nt, Human papillomavirus type 18
uaaaauauugcaaugguc

SEQ ID NO: 2643783 - RNA, 17 nt, Human papillomavirus type 18
ugcaggaggcagcacag

SEQ ID NO: 2643784 - RNA, 20 nt, Human papillomavirus type 18
uaaaauguuuacgguacaga

SEQ ID NO: 2643785 - RNA, 21 nt, Human papillomavirus type 18
cagauugcgaaaacauagcga

SEQ ID NO: 2643786 - RNA, 12 nt, Human papillomavirus type 18
acagacacaggg

SEQ ID NO: 2643787 - RNA, 20 nt, Human papillomavirus type 18
uaacuguugguaauccauau

SEQ ID NO: 2643788 - RNA, 17 nt, Human papillomavirus type 18
caaauacaguauuggca

SEQ ID NO: 2643789 - RNA, 13 nt, Human papillomavirus type 18
acaaguguugcau

SEQ ID NO: 2643790 - RNA, 16 nt, Human papillomavirus type 18
gauggcaacaaagaca

SEQ ID NO: 2643791 - RNA, 15 nt, Human papillomavirus type 18
guauauauauauaca

SEQ ID NO: 2643792 - RNA, 14 nt, Human papillomavirus type 18
gcauguaugugugc

SEQ ID NO: 2643793 - RNA, 16 nt, Human papillomavirus type 18
ccuuuuaugcuuuuug

SEQ ID NO: 2643794 - RNA, 20 nt, Human papillomavirus type 18
gcccauguuacuauugcaua

SEQ ID NO: 2643795 - RNA, 20 nt, Human papillomavirus type 18
uaauccauauuuuaggguuc

SEQ ID NO: 2643796 - RNA, 13 nt, Human papillomavirus type 18
guauguccugugu

SEQ ID NO: 2643797 - RNA, 20 nt, Human papillomavirus type 18
auguacaagcuauuguagac

SEQ ID NO: 2643798 - RNA, 15 nt, Human papillomavirus type 18
ccuccuucuguggca

SEQ ID NO: 2643799 - RNA, 18 nt, Human papillomavirus type 18
ucugcauaccaauauaga

SEQ ID NO: 2643800 - RNA, 13 nt, Human papillomavirus type 18
gcaacagacacag

SEQ ID NO: 2643801 - RNA, 14 nt, Human papillomavirus type 18
aggcaacauugcaa

SEQ ID NO: 2643802 - RNA, 14 nt, Human papillomavirus type 18
uauguccuguguuu

SEQ ID NO: 2643803 - RNA, 19 nt, Human papillomavirus type 18
acaggugcaggcaaugaaa

SEQ ID NO: 2643804 - RNA, 17 nt, Human papillomavirus type 18
uagacaaaaaaacagga

SEQ ID NO: 2643805 - RNA, 20 nt, Human papillomavirus type 18
auagguuguuuuauacagug

SEQ ID NO: 2643806 - RNA, 18 nt, Human papillomavirus type 18
uguaugugugcugccaug

SEQ ID NO: 2643807 - RNA, 20 nt, Human papillomavirus type 18
auacaucuauuguuguguuu

SEQ ID NO: 2643808 - RNA, 12 nt, Human papillomavirus type 18
cagcacaggcau

SEQ ID NO: 2643809 - RNA, 23 nt, Human papillomavirus type 18
accauagugaaacacaaagaaca

SEQ ID NO: 2643810 - RNA, 22 nt, Human papillomavirus type 18
caauuccagauaguguacaaau

SEQ ID NO: 2643811 - RNA, 22 nt, Human papillomavirus type 18
gcagagcuagagacagcacagg

SEQ ID NO: 2643812 - RNA, 16 nt, Human papillomavirus type 18
uauauaaaacauguaa

SEQ ID NO: 2643813 - RNA, 19 nt, Human papillomavirus type 18
augucccgcuuuugccauc

SEQ ID NO: 2643814 - RNA, 12 nt, Human papillomavirus type 18
cauguccaccug

SEQ ID NO: 2643815 - RNA, 20 nt, Human papillomavirus type 18
cagcagacgaccuucgagca

SEQ ID NO: 2643816 - RNA, 12 nt, Human papillomavirus type 18
aagacauagaca

SEQ ID NO: 2643817 - RNA, 15 nt, Human papillomavirus type 18
auguuuuaaaacgaa

SEQ ID NO: 2643818 - RNA, 21 nt, Human papillomavirus type 18
aaaccgaggauuggacacugc

SEQ ID NO: 2643819 - RNA, 20 nt, Human papillomavirus type 18
cauaaagcuauugaacugca

SEQ ID NO: 2643820 - RNA, 15 nt, Human papillomavirus type 18
uauauaaaacaugua

SEQ ID NO: 2643821 - RNA, 18 nt, Human
aaaguaacucauuuguua

SEQ ID NO: 2643822 - RNA, 20 nt, Human
aaaguaacucauuuguuaaa

SEQ ID NO: 2643823 - RNA, 14 nt, Human
aaaguaacucauuu

SEQ ID NO: 2643824 - RNA, 15 nt, Human
aaaguaacucauuug

SEQ ID NO: 2643825 - RNA, 22 nt, Human
aaaguaacucauuuguuaaaau

SEQ ID NO: 2643826 - RNA, 17 nt, Human
gguuucgaagucauuaa

SEQ ID NO: 2643827 - RNA, 21 nt, Human
gcugccuccccucuccuuccu

SEQ ID NO: 2643828 - RNA, 14 nt, Human
gcagccaaccuaag

SEQ ID NO: 2643829 - RNA, 17 nt, Human
gaauaucuauuaauaua

SEQ ID NO: 2643830 - RNA, 17 nt, Human
cuuuuguguaaugaaaa

SEQ ID NO: 2643831 - RNA, 16 nt, Human
cuuuuguguaaugaaa

SEQ ID NO: 2643832 - RNA, 19 nt, Human
auuguugacaacugugacu

SEQ ID NO: 2643833 - RNA, 18 nt, Human
auuguugacaacugugac

SEQ ID NO: 2643834 - RNA, 20 nt, Human
auuguugacaacugugacug

SEQ ID NO: 2643835 - RNA, 14 nt, Human
auuuauaauuccua

SEQ ID NO: 2643836 - RNA, 18 nt, Human
ccaccgaagccgccugug

SEQ ID NO: 2643837 - RNA, 13 nt, Human
ccaccgcccagag

SEQ ID NO: 2643838 - RNA, 17 nt, Human
ccaccgcccagagaccc

SEQ ID NO: 2643839 - RNA, 23 nt, Human
ccaagcugccuccccucuccuuc

SEQ ID NO: 2643840 - RNA, 16 nt, Human
ccugugacugucucac

SEQ ID NO: 2643841 - RNA, 21 nt, Human
cuauuaauauauguauuauuu

SEQ ID NO: 2643842 - RNA, 17 nt, Human
cuauuaauauauguauu

SEQ ID NO: 2643843 - RNA, 12 nt, Human
cuauuaauauau

SEQ ID NO: 2643844 - RNA, 14 nt, Human
cuauuaauauaugu

SEQ ID NO: 2643845 - RNA, 15 nt, Human
cuauuaauauaugua

SEQ ID NO: 2643846 - RNA, 11 nt, Human
cuauuaauaua

SEQ ID NO: 2643847 - RNA, 19 nt, Human
cgccuggcugcagccugcg

SEQ ID NO: 2643848 - RNA, 22 nt, Human
cgguuucgaagucauuaaacug

SEQ ID NO: 2643849 - RNA, 18 nt, Human
cgguuucgaagucauuaa

SEQ ID NO: 2643850 - RNA, 13 nt, Human
uuuucugacuaau

SEQ ID NO: 2643851 - RNA, 12 nt, Human
auuuauuaauau

SEQ ID NO: 2643852 - RNA, 14 nt, Human
auuuauuaauauuu

SEQ ID NO: 2643853 - RNA, 15 nt, Human
auuuauuaauauuua

SEQ ID NO: 2643854 - RNA, 23 nt, Human
auuuauuaauauuuaacauuauu

SEQ ID NO: 2643855 - RNA, 20 nt, Human
uuguccugccugcaauauuu

SEQ ID NO: 2643856 - RNA, 20 nt, Human
uuucgaagucauuaaacugg

SEQ ID NO: 2643857 - RNA, 16 nt, Human
uuucgaagucauuaaa

SEQ ID NO: 2643858 - RNA, 16 nt, Human
auauggggaauauauu

SEQ ID NO: 2643859 - RNA, 21 nt, Human
uucacuugaugauacaaugaa

SEQ ID NO: 2643860 - RNA, 22 nt, Human
auauuuaacauuauuuauaugg

SEQ ID NO: 2643861 - RNA, 19 nt, Human
auauuuaacauuauuuaua

SEQ ID NO: 2643862 - RNA, 13 nt, Human
auauuugaauuuu

SEQ ID NO: 2643863 - RNA, 20 nt, Human
auauuugaauuuuaaaucua

SEQ ID NO: 2643864 - RNA, 13 nt, Human
aucuaaaucuauu

SEQ ID NO: 2643865 - RNA, 15 nt, Human
aucuaaaucuauuua

SEQ ID NO: 2643866 - RNA, 16 nt, Human
aucuaaaucuauuuau

SEQ ID NO: 2643867 - RNA, 18 nt, Human
aucuaaaucuauuuauua

SEQ ID NO: 2643868 - RNA, 11 nt, Human
auccugugacu

SEQ ID NO: 2643869 - RNA, 21 nt, Human
auccugugacugucucacuua

SEQ ID NO: 2643870 - RNA, 14 nt, Human
aggaggcaggaccu

SEQ ID NO: 2643871 - RNA, 19 nt, Human
uggaccgcccuuuuccccu

SEQ ID NO: 2643872 - RNA, 21 nt, Human
ugccucaggaggcaggaccuu

SEQ ID NO: 2643873 - RNA, 18 nt, Human
ugccucaggaggcaggac

SEQ ID NO: 2643874 - RNA, 11 nt, Human
uguuguagugu

SEQ ID NO: 2643875 - RNA, 22 nt, Human
auaauuccuauauccugugacu

SEQ ID NO: 2643876 - RNA, 15 nt, Human
aggugaucccguuuu

SEQ ID NO: 2643877 - RNA, 23 nt, Human
aggugaucccguuuuccccauga

SEQ ID NO: 2643878 - RNA, 21 nt, Human
ugaaaaugaauaucuauuaau

SEQ ID NO: 2643879 - RNA, 23 nt, Human
ugaaaaugaauaucuauuaauau

SEQ ID NO: 2643880 - RNA, 19 nt, Human
ugaaaaugaauaucuauua

SEQ ID NO: 2643881 - RNA, 23 nt, Human
agaucccauggguuguguguuua

SEQ ID NO: 2643882 - RNA, 22 nt, Human
ucuauuaauauauguauuauuu

SEQ ID NO: 2643883 - RNA, 10 nt, Human
ucuauuaaua

SEQ ID NO: 2643884 - RNA, 12 nt, Human
ucuauuaauaua

SEQ ID NO: 2643885 - RNA, 13 nt, Human
ucuauuaauauau

SEQ ID NO: 2643886 - RNA, 16 nt, Human
ucuauuaauauaugua

SEQ ID NO: 2643887 - RNA, 21 nt, Human
ucuauuaauauauguauuauu

SEQ ID NO: 2643888 - RNA, 16 nt, Human
ucuauuuauuaauauu

SEQ ID NO: 2643889 - RNA, 16 nt, Human
ucucaggagauuucau

SEQ ID NO: 2643890 - RNA, 21 nt, Human
ucauaguucugagcugccagu

SEQ ID NO: 2643891 - RNA, 13 nt, Human
ucaauaucuaaua

SEQ ID NO: 2643892 - RNA, 15 nt, Human
ucaauaucuaauaua

SEQ ID NO: 2643893 - RNA, 19 nt, Human
ucaauaucuaauauauaug

SEQ ID NO: 2643894 - RNA, 21 nt, Human
ucaauaucuaauauauaugaa

SEQ ID NO: 2643895 - RNA, 14 nt, Human
ucacuugaugauac

SEQ ID NO: 2643896 - RNA, 20 nt, Human
ucacuugaugauacaaugaa

SEQ ID NO: 2643897 - RNA, 23 nt, Human
aauaugccugcaaucugagccag

SEQ ID NO: 2643898 - RNA, 21 nt, Human
aauauuuaacauuauuuauau

SEQ ID NO: 2643899 - RNA, 18 nt, Human
uaaugaaaaugaauaucu

SEQ ID NO: 2643900 - RNA, 21 nt, Human
uaauauuuaacauuauuuaua

SEQ ID NO: 2643901 - RNA, 20 nt, Human
uaauagcaacuuuuguguaa

SEQ ID NO: 2643902 - RNA, 21 nt, Human
uaauagcaacuuuuguguaau

SEQ ID NO: 2643903 - RNA, 23 nt, Human
aauccuuuguuuucugacuaauu

SEQ ID NO: 2643904 - RNA, 22 nt, Human
aauccuuuguuuucugacuaau

SEQ ID NO: 2643905 - RNA, 19 nt, Human
aauggaaaguaacucauuu

SEQ ID NO: 2643906 - RNA, 20 nt, Human
aauuaggcaaggcuauguga

SEQ ID NO: 2643907 - RNA, 23 nt, Human
aauuaggcaaggcuaugugauua

SEQ ID NO: 2643908 - RNA, 17 nt, Human
uacuauccaguuacugc

SEQ ID NO: 2643909 - RNA, 21 nt, Human
aauuccuauauccugugacug

SEQ ID NO: 2643910 - RNA, 12 nt, Human
uaucuauuaaua

SEQ ID NO: 2643911 - RNA, 13 nt, Human
uaucuauuaauau

SEQ ID NO: 2643912 - RNA, 15 nt, Human
uaucuauuaauauau

SEQ ID NO: 2643913 - RNA, 17 nt, Human
uaucuauuaauauaugu

SEQ ID NO: 2643914 - RNA, 18 nt, Human
uaucuauuaauauaugua

SEQ ID NO: 2643915 - RNA, 19 nt, Human
uaucuauuaauauauguau

SEQ ID NO: 2643916 - RNA, 14 nt, Human
uauccaguuacugc

SEQ ID NO: 2643917 - RNA, 19 nt, Human
uaggcaaggcuaugugauu

SEQ ID NO: 2643918 - RNA, 16 nt, Human
aacuugaaugugucag

SEQ ID NO: 2643919 - RNA, 12 nt, Human
aacauuauuuau

SEQ ID NO: 2643920 - RNA, 14 nt, Human
gucaggugacccug

SEQ ID NO: 2643921 - RNA, 12 nt, Human
guauuuauaaua

SEQ ID NO: 2643922 - RNA, 21 nt, Human
aaguaacucauuuguuaaaau

SEQ ID NO: 2643923 - RNA, 14 nt, Human
aaguaacucauuug

SEQ ID NO: 2643924 - RNA, 12 nt, Human
aaguaacucauu

SEQ ID NO: 2643925 - RNA, 16 nt, Human
aaguaacucauuuguu

SEQ ID NO: 2643926 - RNA, 19 nt, Human
augucagacagaacuugaa

SEQ ID NO: 2643927 - RNA, 19 nt, Human
auccuuuguuuucugacua

SEQ ID NO: 2643928 - RNA, 21 nt, Human
auccuuuguuuucugacuaau

SEQ ID NO: 2643929 - RNA, 23 nt, Human
auccuuuguuuucugacuaauua

SEQ ID NO: 2643930 - RNA, 20 nt, Human
auauccugugacugucucac

SEQ ID NO: 2643931 - RNA, 14 nt, Human
auauccugugacug

SEQ ID NO: 2643932 - RNA, 13 nt, Human
auauccugugacu

SEQ ID NO: 2643933 - RNA, 19 nt, Human
auaaguauuuauaauagca

SEQ ID NO: 2643934 - RNA, 15 nt, Human
auaaguauuuauaau

SEQ ID NO: 2643935 - RNA, 22 nt, Human
acaauguuguagugucccccac

SEQ ID NO: 2643936 - RNA, 20 nt, Human
aacuuuuguguaaugaaaau

SEQ ID NO: 2643937 - RNA, 20 nt, Human
aaauggaaaguaacucauuu

SEQ ID NO: 2643938 - RNA, 23 nt, Human
aagcugccuccccucuccuuccu

SEQ ID NO: 2643939 - RNA, 22 nt, Human
caaaacugccucaggaggcagg

SEQ ID NO: 2643940 - RNA, 14 nt, Human
caacuuuuguguaa

SEQ ID NO: 2643941 - RNA, 20 nt, Human
caacuuuuguguaaugaaaa

SEQ ID NO: 2643942 - RNA, 21 nt, Human
caacuuuuguguaaugaaaau

SEQ ID NO: 2643943 - RNA, 21 nt, Human
uugaugauacaaugaacacuu

SEQ ID NO: 2643944 - RNA, 16 nt, Human
uugacaacugugacug

SEQ ID NO: 2643945 - RNA, 16 nt, Human
uugaauuuuaaaucua

SEQ ID NO: 2643946 - RNA, 15 nt, Human
uugaauuuuaaaucu

SEQ ID NO: 2643947 - RNA, 14 nt, Human
uugacaacugugac

SEQ ID NO: 2643948 - RNA, 14 nt, Human
uucgggcugugccc

SEQ ID NO: 2643949 - RNA, 11 nt, Human
uuauaauagca

SEQ ID NO: 2643950 - RNA, 17 nt, Human
uuauaagugaagugaua

SEQ ID NO: 2643951 - RNA, 18 nt, Human
uuauuaauauuuaacauu

SEQ ID NO: 2643952 - RNA, 11 nt, Human
uuauuaauauu

SEQ ID NO: 2643953 - RNA, 18 nt, Human
uuuauaauagcaacuuuu

SEQ ID NO: 2643954 - RNA, 12 nt, Human
uuuaacauuauu

SEQ ID NO: 2643955 - RNA, 20 nt, Human
uuuuccccuaccaauauuag

SEQ ID NO: 2643956 - RNA, 21 nt, Human
ugcccggggaaaggcaagguc

SEQ ID NO: 2643957 - RNA, 18 nt, Human
ugcccggggaaaggcaag

SEQ ID NO: 2643958 - RNA, 18 nt, Human
ugccuccccucuccuucc

SEQ ID NO: 2643959 - RNA, 15 nt, Human
ugacccugaugaaaa

SEQ ID NO: 2643960 - RNA, 22 nt, Human
uguccugccugcaauauuugaa

SEQ ID NO: 2643961 - RNA, 15 nt, Human
uguaaugaaaaugaa

SEQ ID NO: 2643962 - RNA, 18 nt, Human
uguaaugaaaaugaauau

SEQ ID NO: 2643963 - RNA, 21 nt, Human
uguaaugaaaaugaauaucua

SEQ ID NO: 2643964 - RNA, 16 nt, Human
ucccguuuuccccaug

SEQ ID NO: 2643965 - RNA, 17 nt, Human
ucccguuuuccccauga

SEQ ID NO: 2643966 - RNA, 19 nt, Human
ucccguuuuccccaugaca

SEQ ID NO: 2643967 - RNA, 18 nt, Human
uccuauauccugugacug

SEQ ID NO: 2643968 - RNA, 14 nt, Human
ucuaaaucuauuua

SEQ ID NO: 2643969 - RNA, 16 nt, Human
ucuaaaucuauuuauu

SEQ ID NO: 2643970 - RNA, 17 nt, Human
ucuaaaucuauuuauua

SEQ ID NO: 2643971 - RNA, 19 nt, Human
ucuaaaucuauuuauuaau

SEQ ID NO: 2643972 - RNA, 20 nt, Human
ucuaaaucuauuuauuaaua

SEQ ID NO: 2643973 - RNA, 21 nt, Human
ucuaaaucuauuuauuaauau

SEQ ID NO: 2643974 - RNA, 15 nt, Human
ucuaauauauaugaa

SEQ ID NO: 2643975 - RNA, 19 nt, Human
ucuaauauauaugaauaaa

SEQ ID NO: 2643976 - RNA, 22 nt, Human
uccuuuguuuucugacuaauua

SEQ ID NO: 2643977 - RNA, 18 nt, Human
uccuuuguuuucugacua

SEQ ID NO: 2643978 - RNA, 20 nt, Human
uccuuuguuuucugacuaau

SEQ ID NO: 2643979 - RNA, 22 nt, Human
uauuuauaauagcaacuuuugu

SEQ ID NO: 2643980 - RNA, 15 nt, Human
uauuuauaauuccua

SEQ ID NO: 2643981 - RNA, 21 nt, Human
uauguauuauuuauaauuccu

SEQ ID NO: 2643982 - RNA, 13 nt, Human
uauguauuauuua

SEQ ID NO: 2643983 - RNA, 14 nt, Human
uauuaauauaugua

SEQ ID NO: 2643984 - RNA, 13 nt, Human
uauuaauauuuaa

SEQ ID NO: 2643985 - RNA, 15 nt, Human
ucagacagaacuuga

SEQ ID NO: 2643986 - RNA, 16 nt, Human
ucagacagaacuugaa

SEQ ID NO: 2643987 - RNA, 23 nt, Human
ucagacagaacuugaauguguca

SEQ ID NO: 2643988 - RNA, 12 nt, Human
ggcuccccugag

SEQ ID NO: 2643989 - RNA, 13 nt, Human
ggcuccccugagg

SEQ ID NO: 2643990 - RNA, 15 nt, Human
gcuuccaaauauugu

SEQ ID NO: 2643991 - RNA, 20 nt, Human
gcaggaccuucgggcugugc

SEQ ID NO: 2643992 - RNA, 21 nt, Human
gcaggaccuucgggcugugcc

SEQ ID NO: 2643993 - RNA, 19 nt, Human
gcccagagacccaagcugc

SEQ ID NO: 2643994 - RNA, 14 nt, Human
gaugaaaacauagc

SEQ ID NO: 2643995 - RNA, 13 nt, Human
gagcugccagugg

SEQ ID NO: 2643996 - RNA, 11 nt, Human
gagcugccagu

SEQ ID NO: 2643997 - RNA, 20 nt, Human
cuccauaguuuggcauuugc

SEQ ID NO: 2643998 - RNA, 21 nt, Human
cuccauaguuuggcauuugca

SEQ ID NO: 2643999 - RNA, 21 nt, Human
cucaucaaucaaauaaguauu

SEQ ID NO: 2644000 - RNA, 17 nt, Human
cucaucaaucaaauaag

SEQ ID NO: 2644001 - RNA, 13 nt, Human
cuccuuccugugu

SEQ ID NO: 2644002 - RNA, 15 nt, Human
cuccuuccugugugu

SEQ ID NO: 2644003 - RNA, 22 nt, Human
gaacacuuauaagugaagugau

SEQ ID NO: 2644004 - RNA, 22 nt, Human
cuguguguccaaaacugccuca

SEQ ID NO: 2644005 - RNA, 21 nt, Human
cuguguguccaaaacugccuc

SEQ ID NO: 2644006 - RNA, 19 nt, Human
cuguguguccaaaacugcc

SEQ ID NO: 2644007 - RNA, 15 nt, Human
cuguguguccaaaac

SEQ ID NO: 2644008 - RNA, 23 nt, Human
cuuccuguguguccaaaacugcc

SEQ ID NO: 2644009 - RNA, 15 nt, Human
cuuccugugugucca

SEQ ID NO: 2644010 - RNA, 16 nt, Human
cuucgggcugugcccg

SEQ ID NO: 2644011 - RNA, 15 nt, Human
cuucgggcugugccc

SEQ ID NO: 2644012 - RNA, 16 nt, Human
ccuaccaauauuaggu

SEQ ID NO: 2644013 - RNA, 16 nt, Human
ccuauauccugugacu

SEQ ID NO: 2644014 - RNA, 17 nt, Human
cccucuccuuccugugu

SEQ ID NO: 2644015 - RNA, 22 nt, Human
cccggggaaaggcaagguccgg

SEQ ID NO: 2644016 - RNA, 18 nt, Human
ccuggcugcagccugcgc

SEQ ID NO: 2644017 - RNA, 20 nt, Human
ccugcgccaccgcccagaga

SEQ ID NO: 2644018 - RNA, 16 nt, Human
ccugcaauauuugaau

SEQ ID NO: 2644019 - RNA, 13 nt, Human
ccugcaauauuug

SEQ ID NO: 2644020 - RNA, 21 nt, Human
ccuguguguccaaaacugccu

SEQ ID NO: 2644021 - RNA, 20 nt, Human
ccuguguguccaaaacugcc

SEQ ID NO: 2644022 - RNA, 17 nt, Human
ccuuggugccucuugua

SEQ ID NO: 2644023 - RNA, 14 nt, Human
cauuauuuauaugg

SEQ ID NO: 2644024 - RNA, 23 nt, Human
cauuauuuauauggggaauauau

SEQ ID NO: 2644025 - RNA, 15 nt, Human
caggccccaggaaag

SEQ ID NO: 2644026 - RNA, 15 nt, Human
caggcuccccugagg

SEQ ID NO: 2644027 - RNA, 16 nt, Human
caggcuccccugagga

SEQ ID NO: 2644028 - RNA, 14 nt, Human
caggcuccccugag

SEQ ID NO: 2644029 - RNA, 21 nt, Human
cagccaccgaagccgccugug

SEQ ID NO: 2644030 - RNA, 20 nt, Human
caggaccuucgggcugugcc

SEQ ID NO: 2644031 - RNA, 22 nt, Human
caggaccuucgggcugugcccg

SEQ ID NO: 2644032 - RNA, 21 nt, Human
caggaccuucgggcugugccc

SEQ ID NO: 2644033 - RNA, 20 nt, Human
caggaagggaugcaggcucc

SEQ ID NO: 2644034 - RNA, 16 nt, Human
cagaacuugaaugugu

SEQ ID NO: 2644035 - RNA, 15 nt, Human
cagaacuugaaugug

SEQ ID NO: 2644036 - RNA, 15 nt, Human
cagacagaacuugaa

SEQ ID NO: 2644037 - RNA, 21 nt, Human
cacgguuucgaagucauuaaa

SEQ ID NO: 2644038 - RNA, 23 nt, Human
cacgguuucgaagucauuaaacu

SEQ ID NO: 2644039 - RNA, 23 nt, Human
cacuugaugauacaaugaacacu

SEQ ID NO: 2644040 - RNA, 14 nt, Human
aucuauuaauauau

SEQ ID NO: 2644041 - RNA, 12 nt, Human
aucuauuaauau

SEQ ID NO: 2644042 - RNA, 15 nt, Human
aucuauuaauauaug

SEQ ID NO: 2644043 - RNA, 18 nt, Human
aucuauuaauauauguau

SEQ ID NO: 2644044 - RNA, 16 nt, Human
auggaaaguaacucau

SEQ ID NO: 2644045 - RNA, 15 nt, Human
auguauuauuuauaa

SEQ ID NO: 2644046 - RNA, 16 nt, Human
auguauuauuuauaau

SEQ ID NO: 2644047 - RNA, 17 nt, Human
auguauuauuuauaauu

SEQ ID NO: 2644048 - RNA, 18 nt, Human
agugucccccacccccac

SEQ ID NO: 2644049 - RNA, 23 nt, Human
auagcaucucaggagauuucaug

SEQ ID NO: 2644050 - RNA, 16 nt, Human
agccaaccuaagcaag

SEQ ID NO: 2644051 - RNA, 13 nt, Human
aauauauaugaau

SEQ ID NO: 2644052 - RNA, 18 nt, Human
aaguguaaguucacaacu

SEQ ID NO: 2644053 - RNA, 13 nt, Human
aaaggcaaggucc

SEQ ID NO: 2644054 - RNA, 20 nt, Human
acucaucaaucaaauaagua

SEQ ID NO: 2644055 - RNA, 20 nt, Human
cugccuccccucuccuuccu

SEQ ID NO: 2644056 - RNA, 12 nt, Human
cugaugaaaaca

SEQ ID NO: 2644057 - RNA, 15 nt, Human
cuugaaugugucagg

SEQ ID NO: 2644058 - RNA, 21 nt, Human
gcaugucagacagaacuugaa

SEQ ID NO: 2644059 - RNA, 16 nt, Human
gcaggcuccccugagg

SEQ ID NO: 2644060 - RNA, 14 nt, Human
gcaggcuccccuga

SEQ ID NO: 2644061 - RNA, 19 nt, Human
gacugucucacuuaauccu

SEQ ID NO: 2644062 - RNA, 12 nt, Human
gcuccccugagg

SEQ ID NO: 2644063 - RNA, 13 nt, Human
gcuccccugagga

SEQ ID NO: 2644064 - RNA, 23 nt, Human
gccucuuguaucccuagugcucc

SEQ ID NO: 2644065 - RNA, 18 nt, Human
cuccauaguuuggcauuu

SEQ ID NO: 2644066 - RNA, 14 nt, Human
cugagcugccagug

SEQ ID NO: 2644067 - RNA, 13 nt, Human
cugagcugccagu

SEQ ID NO: 2644068 - RNA, 18 nt, Human
ccgaagccgccuguggac

SEQ ID NO: 2644069 - RNA, 14 nt, Human
caaggcuaugugau

SEQ ID NO: 2644070 - RNA, 20 nt, Human
auuaggcaaggcuaugugau

SEQ ID NO: 2644071 - RNA, 21 nt, Human
auuaggcaaggcuaugugauu

SEQ ID NO: 2644072 - RNA, 19 nt, Human
auuuauauggggaauauau

SEQ ID NO: 2644073 - RNA, 20 nt, Human
auuuauauggggaauauauu

SEQ ID NO: 2644074 - RNA, 12 nt, Human
auuucacuugau

SEQ ID NO: 2644075 - RNA, 19 nt, Human
auuucacuugaugauacaa

SEQ ID NO: 2644076 - RNA, 18 nt, Human
caggaaaggcccagccac

SEQ ID NO: 2644077 - RNA, 18 nt, Human
uuguuuucugacuaauua

SEQ ID NO: 2644078 - RNA, 16 nt, Human
uuguuuucugacuaau

SEQ ID NO: 2644079 - RNA, 17 nt, Human
uuguuuucugacuaauu

SEQ ID NO: 2644080 - RNA, 13 nt, Human
augauacaaugaa

SEQ ID NO: 2644081 - RNA, 17 nt, Human
augauacaaugaacacu

SEQ ID NO: 2644082 - RNA, 15 nt, Human
augcaggcuccccug

SEQ ID NO: 2644083 - RNA, 16 nt, Human
augcaggcuccccuga

SEQ ID NO: 2644084 - RNA, 17 nt, Human
augcaggcuccccugag

SEQ ID NO: 2644085 - RNA, 15 nt, Human
augugauuacaaggc

SEQ ID NO: 2644086 - RNA, 22 nt, Human
aucuaaaucuauuuauuaauau

SEQ ID NO: 2644087 - RNA, 20 nt, Human
aucuaaaucuauuuauuaau

SEQ ID NO: 2644088 - RNA, 22 nt, Human
aucuaauauauaugaauaaagu

SEQ ID NO: 2644089 - RNA, 19 nt, Human
aucuaauauauaugaauaa

SEQ ID NO: 2644090 - RNA, 20 nt, Human
aucuaauauauaugaauaaa

SEQ ID NO: 2644091 - RNA, 15 nt, Human
aucuaauauauauga

SEQ ID NO: 2644092 - RNA, 17 nt, Human
aucuaauauauaugaau

SEQ ID NO: 2644093 - RNA, 18 nt, Human
aucuaauauauaugaaua

SEQ ID NO: 2644094 - RNA, 22 nt, Human
augaauaucuauuaauauaugu

SEQ ID NO: 2644095 - RNA, 18 nt, Human
augaauaucuauuaauau

SEQ ID NO: 2644096 - RNA, 19 nt, Human
augaauaucuauuaauaua

SEQ ID NO: 2644097 - RNA, 20 nt, Human
augaauaucuauuaauauau

SEQ ID NO: 2644098 - RNA, 21 nt, Human
augaauaucuauuaauauaug

SEQ ID NO: 2644099 - RNA, 17 nt, Human
augaauaucuauuaaua

SEQ ID NO: 2644100 - RNA, 19 nt, Human
uuacugccgguuugaaaau

SEQ ID NO: 2644101 - RNA, 22 nt, Human
uuaauccuuuguuuucugacua

SEQ ID NO: 2644102 - RNA, 23 nt, Human
uuaauccuuuguuuucugacuaa

SEQ ID NO: 2644103 - RNA, 19 nt, Human
uuaucaauaucuaauauau

SEQ ID NO: 2644104 - RNA, 22 nt, Human
uuaucaauaucuaauauauaug

SEQ ID NO: 2644105 - RNA, 15 nt, Human
uuaucaauaucuaau

SEQ ID NO: 2644106 - RNA, 16 nt, Human
uuaucaauaucuaaua

SEQ ID NO: 2644107 - RNA, 17 nt, Human
uuaucaauaucuaauau

SEQ ID NO: 2644108 - RNA, 20 nt, Human
agugauacuauccaguuacu

SEQ ID NO: 2644109 - RNA, 20 nt, Human
ugugacuguacccaaaugga

SEQ ID NO: 2644110 - RNA, 16 nt, Human
aguggaccgcccuuuu

SEQ ID NO: 2644111 - RNA, 21 nt, Human
aguggaccgcccuuuuccccu

SEQ ID NO: 2644112 - RNA, 22 nt, Human
aguggaccgcccuuuuccccua

SEQ ID NO: 2644113 - RNA, 16 nt, Human
uguguccaaaacugcc

SEQ ID NO: 2644114 - RNA, 16 nt, Human
aguauuuauaauagca

SEQ ID NO: 2644115 - RNA, 16 nt, Human
uguccaaaacugccuc

SEQ ID NO: 2644116 - RNA, 15 nt, Human
uguccaaaacugccu

SEQ ID NO: 2644117 - RNA, 15 nt, Human
aggcuccccugagga

SEQ ID NO: 2644118 - RNA, 14 nt, Human
aggcuccccugagg

SEQ ID NO: 2644119 - RNA, 14 nt, Human
aggcuaugugauua

SEQ ID NO: 2644120 - RNA, 17 nt, Human
aggcuaugugauuacaa

SEQ ID NO: 2644121 - RNA, 23 nt, Human
aggcaggaccuucgggcugugcc

SEQ ID NO: 2644122 - RNA, 22 nt, Human
aggcaggaccuucgggcugugc

SEQ ID NO: 2644123 - RNA, 21 nt, Human
aggcaggaccuucgggcugug

SEQ ID NO: 2644124 - RNA, 20 nt, Human
agcugccuccccucuccuuc

SEQ ID NO: 2644125 - RNA, 23 nt, Human
agcugccuccccucuccuuccug

SEQ ID NO: 2644126 - RNA, 21 nt, Human
agccugcgccaccgcccagag

SEQ ID NO: 2644127 - RNA, 18 nt, Human
acuuuuguguaaugaaaa

SEQ ID NO: 2644128 - RNA, 19 nt, Human
acuuuuguguaaugaaaau

SEQ ID NO: 2644129 - RNA, 14 nt, Human
ucuccuuccugugu

SEQ ID NO: 2644130 - RNA, 13 nt, Human
ucuccuuccugug

SEQ ID NO: 2644131 - RNA, 14 nt, Human
ugaauaucuauuaa

SEQ ID NO: 2644132 - RNA, 16 nt, Human
ugaauaucuauuaaua

SEQ ID NO: 2644133 - RNA, 17 nt, Human
ugaauaucuauuaauau

SEQ ID NO: 2644134 - RNA, 21 nt, Human
ugagccagugcuuuaauggca

SEQ ID NO: 2644135 - RNA, 18 nt, Human
accgcccuuuuccccuac

SEQ ID NO: 2644136 - RNA, 16 nt, Human
accgcccuuuuccccu

SEQ ID NO: 2644137 - RNA, 22 nt, Human
ucauuuguuaaaauuaucaaua

SEQ ID NO: 2644138 - RNA, 22 nt, Human
uccuguguguccaaaacugccu

SEQ ID NO: 2644139 - RNA, 16 nt, Human
acuguacccaaaugga

SEQ ID NO: 2644140 - RNA, 17 nt, Human
acuguacccaaauggaa

SEQ ID NO: 2644141 - RNA, 16 nt, Human
uccccaggcaccucac

SEQ ID NO: 2644142 - RNA, 22 nt, Human
acucauuuguuaaaauuaucaa

SEQ ID NO: 2644143 - RNA, 18 nt, Human
uaguucugagcugccagu

SEQ ID NO: 2644144 - RNA, 14 nt, Human
uauauccugugacu

SEQ ID NO: 2644145 - RNA, 15 nt, Human
uauauccugugacug

SEQ ID NO: 2644146 - RNA, 17 nt, Human
uauauccugugacuguc

SEQ ID NO: 2644147 - RNA, 18 nt, Human
uauauccugugacugucu

SEQ ID NO: 2644148 - RNA, 22 nt, Human
uaucaauaucuaauauauauga

SEQ ID NO: 2644149 - RNA, 18 nt, Human
uaucaauaucuaauauau

SEQ ID NO: 2644150 - RNA, 21 nt, Human
uaucaauaucuaauauauaug

SEQ ID NO: 2644151 - RNA, 17 nt, Human
uaucaauaucuaauaua

SEQ ID NO: 2644152 - RNA, 14 nt, Human
uaucaauaucuaau

SEQ ID NO: 2644153 - RNA, 15 nt, Human
uauuuaacauuauuu

SEQ ID NO: 2644154 - RNA, 16 nt, Human
uauuucacuugaugau

SEQ ID NO: 2644155 - RNA, 15 nt, Human
uacaaugaacacuua

SEQ ID NO: 2644156 - RNA, 20 nt, Human
aaugaauaucuauuaauaua

SEQ ID NO: 2644157 - RNA, 14 nt, Human
aaugaauaucuauu

SEQ ID NO: 2644158 - RNA, 15 nt, Human
aaugaauaucuauua

SEQ ID NO: 2644159 - RNA, 18 nt, Human
aaugaauaucuauuaaua

SEQ ID NO: 2644160 - RNA, 19 nt, Human
aaugaauaucuauuaauau

SEQ ID NO: 2644161 - RNA, 13 nt, Human
uaauauuuaacau

SEQ ID NO: 2644162 - RNA, 14 nt, Human
aagugaagugauac

SEQ ID NO: 2644163 - RNA, 16 nt, Human
guugacaacugugacu

SEQ ID NO: 2644164 - RNA, 14 nt, Human
guugacaacuguga

SEQ ID NO: 2644165 - RNA, 15 nt, Human
guugacaacugugac

SEQ ID NO: 2644166 - RNA, 22 nt, Human
uaaaauuaucaauaucuaauau

SEQ ID NO: 2644167 - RNA, 16 nt, Human
aauaaguauuuauaau

SEQ ID NO: 2644168 - RNA, 18 nt, Human
uaaaguguaaguucacaa

SEQ ID NO: 2644169 - RNA, 14 nt, Human
uaaaucuaaaucua

SEQ ID NO: 2644170 - RNA, 15 nt, Human
uaaaucuaaaucuau

SEQ ID NO: 2644171 - RNA, 19 nt, Human
uaaaucuaaaucuauuuau

SEQ ID NO: 2644172 - RNA, 12 nt, Human
caccccccaggc

SEQ ID NO: 2644173 - RNA, 16 nt, Human
caaauaaguauuuaua

SEQ ID NO: 2644174 - RNA, 18 nt, Human
caaauaaguauuuauaau

SEQ ID NO: 2644175 - RNA, 17 nt, Human
caaauaaguauuuauaa

SEQ ID NO: 2644176 - RNA, 18 nt, Human
caaugaacacuuauaagu

SEQ ID NO: 2644177 - RNA, 13 nt, Human
uugaaugugucag

SEQ ID NO: 2644178 - RNA, 22 nt, Human
uuuagacucaucaaucaaauaa

SEQ ID NO: 2644179 - RNA, 12 nt, Human
uuccccaugaca

SEQ ID NO: 2644180 - RNA, 13 nt, Human
uucgggcugugcc

SEQ ID NO: 2644181 - RNA, 12 nt, Human
uucgggcugugc

SEQ ID NO: 2644182 - RNA, 14 nt, Human
uuccuauauccugu

SEQ ID NO: 2644183 - RNA, 21 nt, Human
uuagacucaucaaucaaauaa

SEQ ID NO: 2644184 - RNA, 20 nt, Human
uuaggcaaggcuaugugauu

SEQ ID NO: 2644185 - RNA, 19 nt, Human
uuaauauauguauuauuua

SEQ ID NO: 2644186 - RNA, 15 nt, Human
uuaauauauguauua

SEQ ID NO: 2644187 - RNA, 18 nt, Human
ugcaggcuccccugagga

SEQ ID NO: 2644188 - RNA, 15 nt, Human
ugcaggcuccccuga

SEQ ID NO: 2644189 - RNA, 17 nt, Human
ugcaggcuccccugagg

SEQ ID NO: 2644190 - RNA, 17 nt, Human
ugcgccaccgcccagag

SEQ ID NO: 2644191 - RNA, 13 nt, Human
ugacaauguugua

SEQ ID NO: 2644192 - RNA, 14 nt, Human
ugacaauguuguag

SEQ ID NO: 2644193 - RNA, 13 nt, Human
ucaucaaucaaau

SEQ ID NO: 2644194 - RNA, 21 nt, Human
ucaucaaucaaauaaguauuu

SEQ ID NO: 2644195 - RNA, 23 nt, Human
ucaucaaucaaauaaguauuuau

SEQ ID NO: 2644196 - RNA, 13 nt, Human
uccaaaacugccu

SEQ ID NO: 2644197 - RNA, 12 nt, Human
uccaaaacugcc

SEQ ID NO: 2644198 - RNA, 23 nt, Human
uaggugaucccguuuuccccaug

SEQ ID NO: 2644199 - RNA, 16 nt, Human
uauauguauuauuuau

SEQ ID NO: 2644200 - RNA, 19 nt, Human
uauauguauuauuuauaau

SEQ ID NO: 2644201 - RNA, 17 nt, Human
uauaauagcaacuuuug

SEQ ID NO: 2644202 - RNA, 12 nt, Human
uaugaauaaagu

SEQ ID NO: 2644203 - RNA, 21 nt, Human
uaucuaauauauaugaauaaa

SEQ ID NO: 2644204 - RNA, 17 nt, Human
uaucuaauauauaugaa

SEQ ID NO: 2644205 - RNA, 18 nt, Human
uaucuaauauauaugaau

SEQ ID NO: 2644206 - RNA, 20 nt, Human
uaucuaauauauaugaauaa

SEQ ID NO: 2644207 - RNA, 15 nt, Human
uauuauuuauaauuc

SEQ ID NO: 2644208 - RNA, 20 nt, Human
uauuguugacaacugugacu

SEQ ID NO: 2644209 - RNA, 23 nt, Human
uauuguugacaacugugacugua

SEQ ID NO: 2644210 - RNA, 19 nt, Human
uauuguugacaacugugac

SEQ ID NO: 2644211 - RNA, 19 nt, Human
uauuugaauuuuaaaucua

SEQ ID NO: 2644212 - RNA, 21 nt, Human
uauuugaauuuuaaaucuaaa

SEQ ID NO: 2644213 - RNA, 12 nt, Human
uauuugaauuuu

SEQ ID NO: 2644214 - RNA, 18 nt, Human
uauuugaauuuuaaaucu

SEQ ID NO: 2644215 - RNA, 18 nt, Human
gugaucccguuuucccca

SEQ ID NO: 2644216 - RNA, 12 nt, Human
guauuauuuaua

SEQ ID NO: 2644217 - RNA, 17 nt, Human
guaaugaaaaugaauau

SEQ ID NO: 2644218 - RNA, 19 nt, Human
gcuccauaguuuggcauuu

SEQ ID NO: 2644219 - RNA, 13 nt, Human
gcccuuuuccccu

SEQ ID NO: 2644220 - RNA, 19 nt, Human
gcccuuuuccccuaccaau

SEQ ID NO: 2644221 - RNA, 18 nt, Human
gccuccccucuccuuccu

SEQ ID NO: 2644222 - RNA, 21 nt, Human
gccuccccucuccuuccugug

SEQ ID NO: 2644223 - RNA, 19 nt, Human
gccuccccucuccuuccug

SEQ ID NO: 2644224 - RNA, 13 nt, Human
gccugagucaccu

SEQ ID NO: 2644225 - RNA, 20 nt, Human
ggaccuucgggcugugcccg

SEQ ID NO: 2644226 - RNA, 19 nt, Human
ggaccuucgggcugugccc

SEQ ID NO: 2644227 - RNA, 18 nt, Human
ggaccuucgggcugugcc

SEQ ID NO: 2644228 - RNA, 17 nt, Human
ggaccuucgggcugugc

SEQ ID NO: 2644229 - RNA, 18 nt, Human
ggaugcaggcuccccuga

SEQ ID NO: 2644230 - RNA, 17 nt, Human
gaccgcccuuuuccccu

SEQ ID NO: 2644231 - RNA, 18 nt, Human
gaccgcccuuuuccccua

SEQ ID NO: 2644232 - RNA, 19 nt, Human
gacaauguuguaguguccc

SEQ ID NO: 2644233 - RNA, 17 nt, Human
gacaauguuguaguguc

SEQ ID NO: 2644234 - RNA, 18 nt, Human
gacaauguuguagugucc

SEQ ID NO: 2644235 - RNA, 13 nt, Human
gacaacugugacu

SEQ ID NO: 2644236 - RNA, 12 nt, Human
gacaacugugac

SEQ ID NO: 2644237 - RNA, 12 nt, Human
gaaugugucagg

SEQ ID NO: 2644238 - RNA, 14 nt, Human
cugccgguuugaaa

SEQ ID NO: 2644239 - RNA, 20 nt, Human
cugccgguuugaaaauaugc

SEQ ID NO: 2644240 - RNA, 20 nt, Human
gaaaaugaauaucuauuaau

SEQ ID NO: 2644241 - RNA, 22 nt, Human
gaaaaugaauaucuauuaauau

SEQ ID NO: 2644242 - RNA, 14 nt, Human
ccuucgggcugugc

SEQ ID NO: 2644243 - RNA, 16 nt, Human
ccuucgggcugugccc

SEQ ID NO: 2644244 - RNA, 15 nt, Human
ccuucgggcugugcc

SEQ ID NO: 2644245 - RNA, 19 nt, Human
cgaagucauuaaacugguu

SEQ ID NO: 2644246 - RNA, 16 nt, Human
cgaagucauuaaacug

SEQ ID NO: 2644247 - RNA, 13 nt, Human
cuaccaauauuag

SEQ ID NO: 2644248 - RNA, 13 nt, Human
cuaauauauauga

SEQ ID NO: 2644249 - RNA, 18 nt, Human
cuaauauauaugaauaaa

SEQ ID NO: 2644250 - RNA, 15 nt, Human
cuaauauauaugaau

SEQ ID NO: 2644251 - RNA, 17 nt, Human
cuaauauauaugaauaa

SEQ ID NO: 2644252 - RNA, 21 nt, Human
cuauuuauuaauauuuaacau

SEQ ID NO: 2644253 - RNA, 13 nt, Human
cuauuuauuaaua

SEQ ID NO: 2644254 - RNA, 14 nt, Human
cuauuuauuaauau

SEQ ID NO: 2644255 - RNA, 15 nt, Human
cuauuuauuaauauu

SEQ ID NO: 2644256 - RNA, 17 nt, Human
cuauuuauuaauauuua

SEQ ID NO: 2644257 - RNA, 20 nt, Human
cuauuuauuaauauuuaaca

SEQ ID NO: 2644258 - RNA, 18 nt, Human
cucaggaggcaggaccuu

SEQ ID NO: 2644259 - RNA, 17 nt, Human
cucaggaggcaggaccu

SEQ ID NO: 2644260 - RNA, 16 nt, Human
cucaggaggcaggacc

SEQ ID NO: 2644261 - RNA, 16 nt, Human
cuccccucuccuuccu

SEQ ID NO: 2644262 - RNA, 12 nt, Human
cuccccugagga

SEQ ID NO: 2644263 - RNA, 11 nt, Human
cuccccugagg

SEQ ID NO: 2644264 - RNA, 17 nt, Human
cucauuuguuaaaauua

SEQ ID NO: 2644265 - RNA, 23 nt, Human
cccaugacaauguuguagugucc

SEQ ID NO: 2644266 - RNA, 19 nt, Human
ccccucuccuuccugugug

SEQ ID NO: 2644267 - RNA, 14 nt, Human
ccccucuccuuccu

SEQ ID NO: 2644268 - RNA, 14 nt, Human
cccucuccuuccug

SEQ ID NO: 2644269 - RNA, 15 nt, Human
ccaccccccaggccu

SEQ ID NO: 2644270 - RNA, 13 nt, Human
ccaccccccaggc

SEQ ID NO: 2644271 - RNA, 16 nt, Human
uuuguguaaugaaaau

SEQ ID NO: 2644272 - RNA, 17 nt, Human
acagaacuugaaugugu

SEQ ID NO: 2644273 - RNA, 20 nt, Human
acagaacuugaaugugucag

SEQ ID NO: 2644274 - RNA, 19 nt, Human
acagaacuugaauguguca

SEQ ID NO: 2644275 - RNA, 16 nt, Human
aagggaugcaggcucc

SEQ ID NO: 2644276 - RNA, 23 nt, Human
aagggaugcaggcuccccugagg

SEQ ID NO: 2644277 - RNA, 15 nt, Human
aucccguuuucccca

SEQ ID NO: 2644278 - RNA, 16 nt, Human
aucccguuuuccccau

SEQ ID NO: 2644279 - RNA, 18 nt, Human
aucccguuuuccccauga

SEQ ID NO: 2644280 - RNA, 20 nt, Human
aucccguuuuccccaugaca

SEQ ID NO: 2644281 - RNA, 13 nt, Human
aucuauuuauuaa

SEQ ID NO: 2644282 - RNA, 15 nt, Human
aucuauuuauuaaua

SEQ ID NO: 2644283 - RNA, 19 nt, Human
aucuauuuauuaauauuua

SEQ ID NO: 2644284 - RNA, 14 nt, Human
agucauuaaacugg

SEQ ID NO: 2644285 - RNA, 15 nt, Human
aguuuggcauuugca

SEQ ID NO: 2644286 - RNA, 17 nt, Human
auacaaugaacacuuau

SEQ ID NO: 2644287 - RNA, 18 nt, Human
auacaaugaacacuuaua

SEQ ID NO: 2644288 - RNA, 22 nt, Human
gaagugauacuauccaguuacu

SEQ ID NO: 2644289 - RNA, 12 nt, Human
aaauaaguauuu

SEQ ID NO: 2644290 - RNA, 14 nt, Human
aaauaaguauuuau

SEQ ID NO: 2644291 - RNA, 22 nt, Human
aaauaaguauuuauaauagcaa

SEQ ID NO: 2644292 - RNA, 15 nt, Human
aaauaaguauuuaua

SEQ ID NO: 2644293 - RNA, 17 nt, Human
aaauaaguauuuauaau

SEQ ID NO: 2644294 - RNA, 14 nt, Human
aaaaugaauaucua

SEQ ID NO: 2644295 - RNA, 18 nt, Human
aaaaugaauaucuauuaa

SEQ ID NO: 2644296 - RNA, 22 nt, Human
aaaaugaauaucuauuaauaua

SEQ ID NO: 2644297 - RNA, 16 nt, Human
aaaacauagcaucuca

SEQ ID NO: 2644298 - RNA, 21 nt, Human
gcugcagccugcgccaccgcc

SEQ ID NO: 2644299 - RNA, 16 nt, Human
gcugcagccugcgcca

SEQ ID NO: 2644300 - RNA, 14 nt, Human
cgcccuuuuccccu

SEQ ID NO: 2644301 - RNA, 20 nt, Human
ccaugacaauguuguagugu

SEQ ID NO: 2644302 - RNA, 16 nt, Human
cccaggaaaggcccag

SEQ ID NO: 2644303 - RNA, 15 nt, Human
caggaggcaggaccu

SEQ ID NO: 2644304 - RNA, 18 nt, Human
caggaggcaggaccuucg

SEQ ID NO: 2644305 - RNA, 16 nt, Human
caugacaauguuguag

SEQ ID NO: 2644306 - RNA, 23 nt, Human
auuaggugaucccguuuucccca

SEQ ID NO: 2644307 - RNA, 22 nt, Human
caaauggaaaguaacucauuug

SEQ ID NO: 2644308 - RNA, 18 nt, Human
aucucaggagauuucaug

SEQ ID NO: 2644309 - RNA, 15 nt, Human
aucugagccagugcu

SEQ ID NO: 2644310 - RNA, 15 nt, Human
uuguuuucugacuaa

SEQ ID NO: 2644311 - RNA, 18 nt, Human
uuguguguuuauuucacu

SEQ ID NO: 2644312 - RNA, 13 nt, Human
uucgaagucauua

SEQ ID NO: 2644313 - RNA, 14 nt, Human
uucgaagucauuaa

SEQ ID NO: 2644314 - RNA, 15 nt, Human
uucgaagucauuaaa

SEQ ID NO: 2644315 - RNA, 18 nt, Human
uucgaagucauuaaacug

SEQ ID NO: 2644316 - RNA, 16 nt, Human
auauuuuuagacucau

SEQ ID NO: 2644317 - RNA, 19 nt, Human
auauauguauuauuuauaa

SEQ ID NO: 2644318 - RNA, 20 nt, Human
auauauguauuauuuauaau

SEQ ID NO: 2644319 - RNA, 13 nt, Human
auaucuauuaaua

SEQ ID NO: 2644320 - RNA, 14 nt, Human
auaucuauuaauau

SEQ ID NO: 2644321 - RNA, 15 nt, Human
auaucuauuaauaua

SEQ ID NO: 2644322 - RNA, 18 nt, Human
auaucuauuaauauaugu

SEQ ID NO: 2644323 - RNA, 22 nt, Human
auaucuauuaauauauguauua

SEQ ID NO: 2644324 - RNA, 19 nt, Human
auaguucugagcugccagu

SEQ ID NO: 2644325 - RNA, 12 nt, Human
auauaugaauaa

SEQ ID NO: 2644326 - RNA, 14 nt, Human
auauauaugaauaa

SEQ ID NO: 2644327 - RNA, 15 nt, Human
auauauaugaauaaa

SEQ ID NO: 2644328 - RNA, 15 nt, Human
auuuaacauuauuua

SEQ ID NO: 2644329 - RNA, 16 nt, Human
auuuaacauuauuuau

SEQ ID NO: 2644330 - RNA, 17 nt, Human
auuuaacauuauuuaua

SEQ ID NO: 2644331 - RNA, 20 nt, Human
auuuaacauuauuuauaugg

SEQ ID NO: 2644332 - RNA, 20 nt, Human
auuaauauauguauuauuua

SEQ ID NO: 2644333 - RNA, 16 nt, Human
auuaauauauguauua

SEQ ID NO: 2644334 - RNA, 21 nt, Human
auuaauauauguauuauuuau

SEQ ID NO: 2644335 - RNA, 22 nt, Human
auuaauauauguauuauuuaua

SEQ ID NO: 2644336 - RNA, 13 nt, Human
auuauuuauaugg

SEQ ID NO: 2644337 - RNA, 12 nt, Human
auuauuuauaau

SEQ ID NO: 2644338 - RNA, 22 nt, Human
auuauuuauauggggaauauau

SEQ ID NO: 2644339 - RNA, 15 nt, Human
auuaucaauaucuaa

SEQ ID NO: 2644340 - RNA, 17 nt, Human
auuaucaauaucuaaua

SEQ ID NO: 2644341 - RNA, 19 nt, Human
auuaucaauaucuaauaua

SEQ ID NO: 2644342 - RNA, 19 nt, Human
auguuguagugucccccac

SEQ ID NO: 2644343 - RNA, 12 nt, Human
auguuguagugu

SEQ ID NO: 2644344 - RNA, 18 nt, Human
auguuguaguguccccca

SEQ ID NO: 2644345 - RNA, 13 nt, Human
uuuggcauuugca

SEQ ID NO: 2644346 - RNA, 21 nt, Human
auaauagcaacuuuuguguaa

SEQ ID NO: 2644347 - RNA, 16 nt, Human
uuaauauuuaacauua

SEQ ID NO: 2644348 - RNA, 17 nt, Human
uuaauauuuaacauuau

SEQ ID NO: 2644349 - RNA, 12 nt, Human
uuaauauuuaac

SEQ ID NO: 2644350 - RNA, 21 nt, Human
aguuacugccgguuugaaaau

SEQ ID NO: 2644351 - RNA, 13 nt, Human
agugcuuuaaugg

SEQ ID NO: 2644352 - RNA, 14 nt, Human
uguauuauuuauaa

SEQ ID NO: 2644353 - RNA, 15 nt, Human
uguauuauuuauaau

SEQ ID NO: 2644354 - RNA, 14 nt, Human
uguaaguucacaac

SEQ ID NO: 2644355 - RNA, 19 nt, Human
uggaaaguaacucauuugu

SEQ ID NO: 2644356 - RNA, 20 nt, Human
aggcaccucacaggccccag

SEQ ID NO: 2644357 - RNA, 14 nt, Human
ugcagccugcgcca

SEQ ID NO: 2644358 - RNA, 17 nt, Human
ugaugauacaaugaaca

SEQ ID NO: 2644359 - RNA, 21 nt, Human
agccaccgaagccgccugugg

SEQ ID NO: 2644360 - RNA, 20 nt, Human
agccaccgaagccgccugug

SEQ ID NO: 2644361 - RNA, 15 nt, Human
agccaccgaagccgc

SEQ ID NO: 2644362 - RNA, 22 nt, Human
agccaccgaagccgccugugga

SEQ ID NO: 2644363 - RNA, 18 nt, Human
ugauacuauccaguuacu

SEQ ID NO: 2644364 - RNA, 15 nt, Human
agcaacuuuugugua

SEQ ID NO: 2644365 - RNA, 20 nt, Human
agcaacuuuuguguaaugaa

SEQ ID NO: 2644366 - RNA, 23 nt, Human
ugaauuuuaaaucuaaaucuauu

SEQ ID NO: 2644367 - RNA, 17 nt, Human
ugaauuuuaaaucuaaa

SEQ ID NO: 2644368 - RNA, 18 nt, Human
ugaauaucuauuaauaua

SEQ ID NO: 2644369 - RNA, 21 nt, Human
ugaauaucuauuaauauaugu

SEQ ID NO: 2644370 - RNA, 12 nt, Human
ugaauaaagugu

SEQ ID NO: 2644371 - RNA, 18 nt, Human
agaacuugaaugugucag

SEQ ID NO: 2644372 - RNA, 16 nt, Human
ucuccuuccugugugu

SEQ ID NO: 2644373 - RNA, 15 nt, Human
acuugaaugugucag

SEQ ID NO: 2644374 - RNA, 12 nt, Human
ucgggcugugcc

SEQ ID NO: 2644375 - RNA, 13 nt, Human
ucgggcugugccc

SEQ ID NO: 2644376 - RNA, 14 nt, Human
acccugaugaaaac

SEQ ID NO: 2644377 - RNA, 18 nt, Human
acauuauuuauaugggga

SEQ ID NO: 2644378 - RNA, 14 nt, Human
acauuauuuauaug

SEQ ID NO: 2644379 - RNA, 21 nt, Human
ucaaucaaauaaguauuuaua

SEQ ID NO: 2644380 - RNA, 15 nt, Human
accuucgggcugugc

SEQ ID NO: 2644381 - RNA, 14 nt, Human
accuucgggcugug

SEQ ID NO: 2644382 - RNA, 17 nt, Human
accuucgggcugugccc

SEQ ID NO: 2644383 - RNA, 16 nt, Human
accuucgggcugugcc

SEQ ID NO: 2644384 - RNA, 18 nt, Human
accuucgggcugugcccg

SEQ ID NO: 2644385 - RNA, 16 nt, Human
uccccucuccuuccug

SEQ ID NO: 2644386 - RNA, 13 nt, Human
uaugugauuacaa

SEQ ID NO: 2644387 - RNA, 14 nt, Human
acacuuauaaguga

SEQ ID NO: 2644388 - RNA, 14 nt, Human
uauaagugaaguga

SEQ ID NO: 2644389 - RNA, 15 nt, Human
uauaagugaagugau

SEQ ID NO: 2644390 - RNA, 18 nt, Human
uauaagugaagugauacu

SEQ ID NO: 2644391 - RNA, 14 nt, Human
aauguuguaguguc

SEQ ID NO: 2644392 - RNA, 21 nt, Human
uaauuccuauauccugugacu

SEQ ID NO: 2644393 - RNA, 21 nt, Human
uacaaugaacacuuauaagug

SEQ ID NO: 2644394 - RNA, 14 nt, Human
uaaguauuuauaau

SEQ ID NO: 2644395 - RNA, 16 nt, Human
aaucuauuuauuaaua

SEQ ID NO: 2644396 - RNA, 17 nt, Human
aaucuauuuauuaauau

SEQ ID NO: 2644397 - RNA, 18 nt, Human
aaucuauuuauuaauauu

SEQ ID NO: 2644398 - RNA, 20 nt, Human
aaucuauuuauuaauauuua

SEQ ID NO: 2644399 - RNA, 21 nt, Human
aaucuauuuauuaauauuuaa

SEQ ID NO: 2644400 - RNA, 14 nt, Human
aaucuaaaucuauu

SEQ ID NO: 2644401 - RNA, 15 nt, Human
aaucuaaaucuauuu

SEQ ID NO: 2644402 - RNA, 19 nt, Human
aaucuaaaucuauuuauua

SEQ ID NO: 2644403 - RNA, 16 nt, Human
aaucuaaaucuauuua

SEQ ID NO: 2644404 - RNA, 17 nt, Human
aaucuaaaucuauuuau

SEQ ID NO: 2644405 - RNA, 14 nt, Human
aauauauuuuuaga

SEQ ID NO: 2644406 - RNA, 18 nt, Human
aauauauuuuuagacuca

SEQ ID NO: 2644407 - RNA, 15 nt, Human
aauauauuuuuagac

SEQ ID NO: 2644408 - RNA, 13 nt, Human
aauagcaacuuuu

SEQ ID NO: 2644409 - RNA, 19 nt, Human
aauagcaacuuuuguguaa

SEQ ID NO: 2644410 - RNA, 15 nt, Human
aauagcaacuuuugu

SEQ ID NO: 2644411 - RNA, 17 nt, Human
aauagcaacuuuugugu

SEQ ID NO: 2644412 - RNA, 18 nt, Human
guguguccaaaacugccu

SEQ ID NO: 2644413 - RNA, 12 nt, Human
aaguauuuauaa

SEQ ID NO: 2644414 - RNA, 13 nt, Human
aaguauuuauaau

SEQ ID NO: 2644415 - RNA, 16 nt, Human
aagucauuaaacuggu

SEQ ID NO: 2644416 - RNA, 17 nt, Human
aagucauuaaacugguu

SEQ ID NO: 2644417 - RNA, 13 nt, Human
aagucauuaaacu

SEQ ID NO: 2644418 - RNA, 14 nt, Human
aagucauuaaacug

SEQ ID NO: 2644419 - RNA, 16 nt, Human
guuuauuucacuugau

SEQ ID NO: 2644420 - RNA, 18 nt, Human
gucagacagaacuugaau

SEQ ID NO: 2644421 - RNA, 19 nt, Human
aacucauuuguuaaaauua

SEQ ID NO: 2644422 - RNA, 15 nt, Human
caauaucuaauauau

SEQ ID NO: 2644423 - RNA, 16 nt, Human
caauaucuaauauaua

SEQ ID NO: 2644424 - RNA, 17 nt, Human
caauaucuaauauauau

SEQ ID NO: 2644425 - RNA, 14 nt, Human
caauguuguagugu

SEQ ID NO: 2644426 - RNA, 21 nt, Human
uguuaaaauuaucaauaucua

SEQ ID NO: 2644427 - RNA, 23 nt, Human
uguuaaaauuaucaauaucuaau

SEQ ID NO: 2644428 - RNA, 14 nt, Human
uguguuuauuucac

SEQ ID NO: 2644429 - RNA, 15 nt, Human
uguguuuauuucacu

SEQ ID NO: 2644430 - RNA, 15 nt, Human
uguugacaacuguga

SEQ ID NO: 2644431 - RNA, 18 nt, Human
uguugacaacugugacug

SEQ ID NO: 2644432 - RNA, 20 nt, Human
uuaaaucuaaaucuauuuau

SEQ ID NO: 2644433 - RNA, 13 nt, Human
uguguaaugaaaa

SEQ ID NO: 2644434 - RNA, 20 nt, Human
ugccuggugcuuccaaauau

SEQ ID NO: 2644435 - RNA, 16 nt, Human
uccauaguuuggcauu

SEQ ID NO: 2644436 - RNA, 20 nt, Human
uccauaguuuggcauuugca

SEQ ID NO: 2644437 - RNA, 19 nt, Human
uccauaguuuggcauuugc

SEQ ID NO: 2644438 - RNA, 17 nt, Human
ucaggaggcaggaccuu

SEQ ID NO: 2644439 - RNA, 20 nt, Human
ucugagccagugcuuuaaug

SEQ ID NO: 2644440 - RNA, 11 nt, Human
ugacuaauuag

SEQ ID NO: 2644441 - RNA, 12 nt, Human
ugagcugccagu

SEQ ID NO: 2644442 - RNA, 14 nt, Human
ugagcugccagugg

SEQ ID NO: 2644443 - RNA, 12 nt, Human
ugacaacuguga

SEQ ID NO: 2644444 - RNA, 13 nt, Human
ugacaacugugac

SEQ ID NO: 2644445 - RNA, 14 nt, Human
ugacaacugugacu

SEQ ID NO: 2644446 - RNA, 15 nt, Human
ugacaacugugacug

SEQ ID NO: 2644447 - RNA, 16 nt, Human
ugacaacugugacugu

SEQ ID NO: 2644448 - RNA, 21 nt, Human
uaauuaggcaaggcuauguga

SEQ ID NO: 2644449 - RNA, 22 nt, Human
uaauuaggcaaggcuaugugau

SEQ ID NO: 2644450 - RNA, 22 nt, Human
uagcaucucaggagauuucaug

SEQ ID NO: 2644451 - RNA, 16 nt, Human
uauaugaauaaagugu

SEQ ID NO: 2644452 - RNA, 17 nt, Human
uaauuaggcaaggcuau

SEQ ID NO: 2644453 - RNA, 16 nt, Human
uaauggcaugucagac

SEQ ID NO: 2644454 - RNA, 15 nt, Human
guuuuccccaugaca

SEQ ID NO: 2644455 - RNA, 16 nt, Human
guucugagcugccagu

SEQ ID NO: 2644456 - RNA, 18 nt, Human
guucugagcugccagugg

SEQ ID NO: 2644457 - RNA, 12 nt, Human
gucauuaaacug

SEQ ID NO: 2644458 - RNA, 13 nt, Human
gucauuaaacugg

SEQ ID NO: 2644459 - RNA, 15 nt, Human
gucauuaaacugguu

SEQ ID NO: 2644460 - RNA, 18 nt, Human
uuuuaaaucuaaaucuau

SEQ ID NO: 2644461 - RNA, 14 nt, Human
uuuuaaaucuaaau

SEQ ID NO: 2644462 - RNA, 21 nt, Human
uuuuaaaucuaaaucuauuua

SEQ ID NO: 2644463 - RNA, 18 nt, Human
gccugcaaucugagccag

SEQ ID NO: 2644464 - RNA, 20 nt, Human
gccuggugcuuccaaauauu

SEQ ID NO: 2644465 - RNA, 15 nt, Human
gcaaggcuaugugau

SEQ ID NO: 2644466 - RNA, 18 nt, Human
gcaauauuugaauuuuaa

SEQ ID NO: 2644467 - RNA, 14 nt, Human
gcaauauuugaauu

SEQ ID NO: 2644468 - RNA, 17 nt, Human
gaucccguuuuccccau

SEQ ID NO: 2644469 - RNA, 16 nt, Human
gaucccguuuucccca

SEQ ID NO: 2644470 - RNA, 22 nt, Human
gacucaucaaucaaauaaguau

SEQ ID NO: 2644471 - RNA, 14 nt, Human
gaacuugaaugugu

SEQ ID NO: 2644472 - RNA, 17 nt, Human
gaacuugaaugugucag

SEQ ID NO: 2644473 - RNA, 22 nt, Human
cugagccagugcuuuaauggca

SEQ ID NO: 2644474 - RNA, 14 nt, Human
cucuccuuccugug

SEQ ID NO: 2644475 - RNA, 22 nt, Human
cgcccagagacccaagcugccu

SEQ ID NO: 2644476 - RNA, 21 nt, Human
cuaaaucuauuuauuaauauu

SEQ ID NO: 2644477 - RNA, 16 nt, Human
cuaaaucuauuuauua

SEQ ID NO: 2644478 - RNA, 19 nt, Human
cuaaaucuauuuauuaaua

SEQ ID NO: 2644479 - RNA, 12 nt, Human
cuaaaucuauuu

SEQ ID NO: 2644480 - RNA, 14 nt, Human
cuaaaucuauuuau

SEQ ID NO: 2644481 - RNA, 15 nt, Human
cuauauccugugacu

SEQ ID NO: 2644482 - RNA, 17 nt, Human
cuauauccugugacugu

SEQ ID NO: 2644483 - RNA, 22 nt, Human
cuagugcuccauaguuuggcau

SEQ ID NO: 2644484 - RNA, 18 nt, Human
cccguuuuccccaugaca

SEQ ID NO: 2644485 - RNA, 12 nt, Human
cccguuuucccc

SEQ ID NO: 2644486 - RNA, 16 nt, Human
cccguuuuccccauga

SEQ ID NO: 2644487 - RNA, 15 nt, Human
ccggggaaaggcaag

SEQ ID NO: 2644488 - RNA, 18 nt, Human
cccaugacaauguuguag

SEQ ID NO: 2644489 - RNA, 22 nt, Human
cccauggguuguguguuuauuu

SEQ ID NO: 2644490 - RNA, 23 nt, Human
cccauggguuguguguuuauuuc

SEQ ID NO: 2644491 - RNA, 10 nt, Human
cauuaaacug

SEQ ID NO: 2644492 - RNA, 20 nt, Human
cauaguucugagcugccagu

SEQ ID NO: 2644493 - RNA, 21 nt, Human
cauaguucugagcugccagug

SEQ ID NO: 2644494 - RNA, 13 nt, Human
cauaguuuggcau

SEQ ID NO: 2644495 - RNA, 16 nt, Human
cauaguuuggcauuug

SEQ ID NO: 2644496 - RNA, 14 nt, Human
cauaguuuggcauu

SEQ ID NO: 2644497 - RNA, 15 nt, Human
cauaguuuggcauuu

SEQ ID NO: 2644498 - RNA, 18 nt, Human
cauaguuuggcauuugca

SEQ ID NO: 2644499 - RNA, 19 nt, Human
caucaaucaaauaaguauu

SEQ ID NO: 2644500 - RNA, 18 nt, Human
caucucaggagauuucau

SEQ ID NO: 2644501 - RNA, 22 nt, Human
caguggaccgcccuuuuccccu

SEQ ID NO: 2644502 - RNA, 21 nt, Human
caguggaccgcccuuuucccc

SEQ ID NO: 2644503 - RNA, 16 nt, Human
cagugcuuuaauggca

SEQ ID NO: 2644504 - RNA, 17 nt, Human
aaauauuguugacaacu

SEQ ID NO: 2644505 - RNA, 21 nt, Human
aaauauuguugacaacuguga

SEQ ID NO: 2644506 - RNA, 19 nt, Human
aaucaaauaaguauuuaua

SEQ ID NO: 2644507 - RNA, 14 nt, Human
aaucaaauaaguau

SEQ ID NO: 2644508 - RNA, 15 nt, Human
aaucaaauaaguauu

SEQ ID NO: 2644509 - RNA, 16 nt, Human
aaucaaauaaguauuu

SEQ ID NO: 2644510 - RNA, 18 nt, Human
aaucaaauaaguauuuau

SEQ ID NO: 2644511 - RNA, 14 nt, Human
acaacugugacugu

SEQ ID NO: 2644512 - RNA, 11 nt, Human
acaacugugac

SEQ ID NO: 2644513 - RNA, 13 nt, Human
acaacugugacug

SEQ ID NO: 2644514 - RNA, 20 nt, Human
aauuaucaauaucuaauaua

SEQ ID NO: 2644515 - RNA, 19 nt, Human
aggcagccaaccuaagcaa

SEQ ID NO: 2644516 - RNA, 20 nt, Human
agggaugcaggcuccccuga

SEQ ID NO: 2644517 - RNA, 18 nt, Human
agggaugcaggcuccccu

SEQ ID NO: 2644518 - RNA, 22 nt, Human
auagcaacuuuuguguaaugaa

SEQ ID NO: 2644519 - RNA, 19 nt, Human
aucaaauaaguauuuauaa

SEQ ID NO: 2644520 - RNA, 20 nt, Human
aucaaauaaguauuuauaau

SEQ ID NO: 2644521 - RNA, 17 nt, Human
aucaaauaaguauuuau

SEQ ID NO: 2644522 - RNA, 18 nt, Human
aucaaauaaguauuuaua

SEQ ID NO: 2644523 - RNA, 22 nt, Human
aguaacucauuuguuaaaauua

SEQ ID NO: 2644524 - RNA, 12 nt, Human
aguaacucauuu

SEQ ID NO: 2644525 - RNA, 20 nt, Human
agugcuccauaguuuggcau

SEQ ID NO: 2644526 - RNA, 15 nt, Human
auaagugaagugaua

SEQ ID NO: 2644527 - RNA, 18 nt, Human
gacagaacuugaaugugu

SEQ ID NO: 2644528 - RNA, 23 nt, Human
ggcaggaccuucgggcugugccc

SEQ ID NO: 2644529 - RNA, 21 nt, Human
ggcaggaccuucgggcugugc

SEQ ID NO: 2644530 - RNA, 18 nt, Human
ggccccaggaaaggccca

SEQ ID NO: 2644531 - RNA, 18 nt, Human
ggaccgcccuuuuccccu

SEQ ID NO: 2644532 - RNA, 19 nt, Human
ggugaucccguuuucccca

SEQ ID NO: 2644533 - RNA, 22 nt, Human
ggggaaaggcaagguccggccc

SEQ ID NO: 2644534 - RNA, 17 nt, Human
ggggaaaggcaaggucc

SEQ ID NO: 2644535 - RNA, 21 nt, Human
gccugcgccaccgcccagaga

SEQ ID NO: 2644536 - RNA, 19 nt, Human
ccucaggaggcaggaccuu

SEQ ID NO: 2644537 - RNA, 15 nt, Human
ccucuccuuccugug

SEQ ID NO: 2644538 - RNA, 13 nt, Human
ccucuccuuccug

SEQ ID NO: 2644539 - RNA, 22 nt, Human
ccgcccagagacccaagcugcc

SEQ ID NO: 2644540 - RNA, 12 nt, Human
cgggcugugccc

SEQ ID NO: 2644541 - RNA, 14 nt, Human
auuuguuaaaauua

SEQ ID NO: 2644542 - RNA, 21 nt, Human
auuuguuaaaauuaucaauau

SEQ ID NO: 2644543 - RNA, 17 nt, Human
caaucaaauaaguauuu

SEQ ID NO: 2644544 - RNA, 22 nt, Human
caaucaaauaaguauuuauaau

SEQ ID NO: 2644545 - RNA, 23 nt, Human
caaucaaauaaguauuuauaaua

SEQ ID NO: 2644546 - RNA, 19 nt, Human
caauauuugaauuuuaaau

SEQ ID NO: 2644547 - RNA, 15 nt, Human
caauauuugaauuuu

SEQ ID NO: 2644548 - RNA, 20 nt, Human
cagacagaacuugaaugugu

SEQ ID NO: 2644549 - RNA, 22 nt, Human
cagacagaacuugaauguguca

SEQ ID NO: 2644550 - RNA, 23 nt, Human
cagacagaacuugaaugugucag

SEQ ID NO: 2644551 - RNA, 22 nt, Human
cauuuguuaaaauuaucaauau

SEQ ID NO: 2644552 - RNA, 18 nt, Human
cauuuguuaaaauuauca

SEQ ID NO: 2644553 - RNA, 15 nt, Human
cauuuguuaaaauua

SEQ ID NO: 2644554 - RNA, 18 nt, Human
auuugaauuuuaaaucua

SEQ ID NO: 2644555 - RNA, 20 nt, Human
auuugaauuuuaaaucuaaa

SEQ ID NO: 2644556 - RNA, 19 nt, Human
auuccuauauccugugacu

SEQ ID NO: 2644557 - RNA, 20 nt, Human
auuccuauauccugugacug

SEQ ID NO: 2644558 - RNA, 17 nt, Human
uuugaauuuuaaaucua

SEQ ID NO: 2644559 - RNA, 17 nt, Human
uuuuguguaaugaaaau

SEQ ID NO: 2644560 - RNA, 23 nt, Human
auuaauauuuaacauuauuuaua

SEQ ID NO: 2644561 - RNA, 12 nt, Human
auuaauauuuaa

SEQ ID NO: 2644562 - RNA, 23 nt, Human
uuguguaaugaaaaugaauaucu

SEQ ID NO: 2644563 - RNA, 24 nt, Human
uuguguaaugaaaaugaauaucua

SEQ ID NO: 2644564 - RNA, 19 nt, Human
uuuaaaucuaaaucuauuu

SEQ ID NO: 2644565 - RNA, 22 nt, Human
uuuaaaucuaaaucuauuuauu

SEQ ID NO: 2644566 - RNA, 18 nt, Human
uuuauauggggaauauau

SEQ ID NO: 2644567 - RNA, 13 nt, Human
augaacacuuaua

SEQ ID NO: 2644568 - RNA, 19 nt, Human
auaucuaauauauaugaau

SEQ ID NO: 2644569 - RNA, 13 nt, Human
auaucuaauauau

SEQ ID NO: 2644570 - RNA, 14 nt, Human
auaucuaauauaua

SEQ ID NO: 2644571 - RNA, 17 nt, Human
auaucuaauauauauga

SEQ ID NO: 2644572 - RNA, 18 nt, Human
auaucuaauauauaugaa

SEQ ID NO: 2644573 - RNA, 16 nt, Human
auauguauuauuuaua

SEQ ID NO: 2644574 - RNA, 17 nt, Human
auauguauuauuuauaa

SEQ ID NO: 2644575 - RNA, 18 nt, Human
auauguauuauuuauaau

SEQ ID NO: 2644576 - RNA, 22 nt, Human
auauguauuauuuauaauuccu

SEQ ID NO: 2644577 - RNA, 23 nt, Human
auauguauuauuuauaauuccua

SEQ ID NO: 2644578 - RNA, 12 nt, Human
auaucuauuaau

SEQ ID NO: 2644579 - RNA, 12 nt, Human
auaguuuggcau

SEQ ID NO: 2644580 - RNA, 17 nt, Human
auaguuuggcauuugca

SEQ ID NO: 2644581 - RNA, 14 nt, Human
auaguuuggcauuu

SEQ ID NO: 2644582 - RNA, 18 nt, Human
auaguuuggcauuugcac

SEQ ID NO: 2644583 - RNA, 14 nt, Human
uuauuucacuugau

SEQ ID NO: 2644584 - RNA, 21 nt, Human
uuauuuauauggggaauauau

SEQ ID NO: 2644585 - RNA, 19 nt, Human
aucaaucaaauaaguauuu

SEQ ID NO: 2644586 - RNA, 13 nt, Human
aucaaucaaauaa

SEQ ID NO: 2644587 - RNA, 15 nt, Human
aucaaucaaauaagu

SEQ ID NO: 2644588 - RNA, 15 nt, Human
aucaauaucuaauau

SEQ ID NO: 2644589 - RNA, 18 nt, Human
aucaauaucuaauauaua

SEQ ID NO: 2644590 - RNA, 22 nt, Human
uuccuguguguccaaaacugcc

SEQ ID NO: 2644591 - RNA, 21 nt, Human
uuccuguguguccaaaacugc

SEQ ID NO: 2644592 - RNA, 13 nt, Human
auauuguugacaa

SEQ ID NO: 2644593 - RNA, 15 nt, Human
auauuguugacaacu

SEQ ID NO: 2644594 - RNA, 21 nt, Human
auauuguugacaacugugacu

SEQ ID NO: 2644595 - RNA, 21 nt, Human
ugucagacagaacuugaaugu

SEQ ID NO: 2644596 - RNA, 23 nt, Human
ugucagacagaacuugaaugugu

SEQ ID NO: 2644597 - RNA, 23 nt, Human
uuaaaauuaucaauaucuaauau

SEQ ID NO: 2644598 - RNA, 16 nt, Human
uguuuucugacuaauu

SEQ ID NO: 2644599 - RNA, 17 nt, Human
uguuuucugacuaauua

SEQ ID NO: 2644600 - RNA, 18 nt, Human
aguucugagcugccagug

SEQ ID NO: 2644601 - RNA, 17 nt, Human
aguucugagcugccagu

SEQ ID NO: 2644602 - RNA, 19 nt, Human
uggugcuuccaaauauugu

SEQ ID NO: 2644603 - RNA, 18 nt, Human
aggugacccugaugaaaa

SEQ ID NO: 2644604 - RNA, 11 nt, Human
agcugccagug

SEQ ID NO: 2644605 - RNA, 18 nt, Human
ugcuccauaguuuggcau

SEQ ID NO: 2644606 - RNA, 23 nt, Human
ugcuccauaguuuggcauuugca

SEQ ID NO: 2644607 - RNA, 18 nt, Human
aggcaaggcuaugugauu

SEQ ID NO: 2644608 - RNA, 20 nt, Human
aggcaaggcuaugugauuac

SEQ ID NO: 2644609 - RNA, 20 nt, Human
aggaccuucgggcugugccc

SEQ ID NO: 2644610 - RNA, 19 nt, Human
aggaccuucgggcugugcc

SEQ ID NO: 2644611 - RNA, 18 nt, Human
aggaccuucgggcugugc

SEQ ID NO: 2644612 - RNA, 14 nt, Human
ugcaauauuugaau

SEQ ID NO: 2644613 - RNA, 19 nt, Human
agccugagucaccugcaga

SEQ ID NO: 2644614 - RNA, 16 nt, Human
agccugagucaccugc

SEQ ID NO: 2644615 - RNA, 21 nt, Human
ugaucccguuuuccccaugac

SEQ ID NO: 2644616 - RNA, 22 nt, Human
ugaucccguuuuccccaugaca

SEQ ID NO: 2644617 - RNA, 17 nt, Human
ugaucccguuuucccca

SEQ ID NO: 2644618 - RNA, 20 nt, Human
ugaucccguuuuccccauga

SEQ ID NO: 2644619 - RNA, 16 nt, Human
ugauacaaugaacacu

SEQ ID NO: 2644620 - RNA, 12 nt, Human
ugaaugugucag

SEQ ID NO: 2644621 - RNA, 14 nt, Human
agacagaacuugaa

SEQ ID NO: 2644622 - RNA, 17 nt, Human
agacagaacuugaaugu

SEQ ID NO: 2644623 - RNA, 13 nt, Human
ucugacuaauuag

SEQ ID NO: 2644624 - RNA, 15 nt, Human
ucugacuaauuaggc

SEQ ID NO: 2644625 - RNA, 23 nt, Human
acuuauaagugaagugauacuau

SEQ ID NO: 2644626 - RNA, 12 nt, Human
ucgaagucauua

SEQ ID NO: 2644627 - RNA, 16 nt, Human
ucgaagucauuaaacu

SEQ ID NO: 2644628 - RNA, 17 nt, Human
ucgaagucauuaaacug

SEQ ID NO: 2644629 - RNA, 18 nt, Human
ucgaagucauuaaacugg

SEQ ID NO: 2644630 - RNA, 20 nt, Human
ucgaagucauuaaacugguu

SEQ ID NO: 2644631 - RNA, 15 nt, Human
uccccucuccuuccu

SEQ ID NO: 2644632 - RNA, 11 nt, Human
uccccaugaca

SEQ ID NO: 2644633 - RNA, 18 nt, Human
acgguuucgaagucauua

SEQ ID NO: 2644634 - RNA, 19 nt, Human
uauuuuuagacucaucaau

SEQ ID NO: 2644635 - RNA, 17 nt, Human
ucaaauaaguauuuaua

SEQ ID NO: 2644636 - RNA, 20 nt, Human
ucaaauaaguauuuauaaua

SEQ ID NO: 2644637 - RNA, 18 nt, Human
ucaaauaaguauuuauaa

SEQ ID NO: 2644638 - RNA, 19 nt, Human
ucaaauaaguauuuauaau

SEQ ID NO: 2644639 - RNA, 17 nt, Human
uagcaacuuuuguguaa

SEQ ID NO: 2644640 - RNA, 13 nt, Human
uagcaacuuuugu

SEQ ID NO: 2644641 - RNA, 16 nt, Human
acaaugaacacuuaua

SEQ ID NO: 2644642 - RNA, 18 nt, Human
aauauauguauuauuuau

SEQ ID NO: 2644643 - RNA, 14 nt, Human
aauauauguauuau

SEQ ID NO: 2644644 - RNA, 12 nt, Human
aauauauguauu

SEQ ID NO: 2644645 - RNA, 21 nt, Human
aauauauguauuauuuauaau

SEQ ID NO: 2644646 - RNA, 20 nt, Human
aauauuguugacaacuguga

SEQ ID NO: 2644647 - RNA, 16 nt, Human
aauauuguugacaacu

SEQ ID NO: 2644648 - RNA, 22 nt, Human
aauauuguugacaacugugacu

SEQ ID NO: 2644649 - RNA, 15 nt, Human
aauaucuauuaauau

SEQ ID NO: 2644650 - RNA, 16 nt, Human
aauaucuauuaauaua

SEQ ID NO: 2644651 - RNA, 14 nt, Human
aauaucuaauauau

SEQ ID NO: 2644652 - RNA, 20 nt, Human
aauaucuaauauauaugaau

SEQ ID NO: 2644653 - RNA, 21 nt, Human
aauaucuaauauauaugaaua

SEQ ID NO: 2644654 - RNA, 22 nt, Human
aauaucuaauauauaugaauaa

SEQ ID NO: 2644655 - RNA, 14 nt, Human
aauaucuauuaaua

SEQ ID NO: 2644656 - RNA, 18 nt, Human
uaaaucuauuuauuaaua

SEQ ID NO: 2644657 - RNA, 19 nt, Human
uaaaucuauuuauuaauau

SEQ ID NO: 2644658 - RNA, 20 nt, Human
uaaaucuauuuauuaauauu

SEQ ID NO: 2644659 - RNA, 16 nt, Human
uaaaucuauuuauuaa

SEQ ID NO: 2644660 - RNA, 13 nt, Human
aaugaaaaugaau

SEQ ID NO: 2644661 - RNA, 16 nt, Human
aaugaaaaugaauauc

SEQ ID NO: 2644662 - RNA, 19 nt, Human
guguguccaaaacugccuc

SEQ ID NO: 2644663 - RNA, 15 nt, Human
aaggcuuuaucucag

SEQ ID NO: 2644664 - RNA, 15 nt, Human
guuguaguguccccc

SEQ ID NO: 2644665 - RNA, 15 nt, Human
aaggcuaugugauua

SEQ ID NO: 2644666 - RNA, 17 nt, Human
guccugccugcaauauu

SEQ ID NO: 2644667 - RNA, 16 nt, Human
aaaugaauaucuauua

SEQ ID NO: 2644668 - RNA, 17 nt, Human
aaaugaauaucuauuaa

SEQ ID NO: 2644669 - RNA, 18 nt, Human
aaaugaauaucuauuaau

SEQ ID NO: 2644670 - RNA, 19 nt, Human
aaaugaauaucuauuaaua

SEQ ID NO: 2644671 - RNA, 20 nt, Human
aaaucuaaaucuauuuauua

SEQ ID NO: 2644672 - RNA, 15 nt, Human
aaaucuaaaucuauu

SEQ ID NO: 2644673 - RNA, 16 nt, Human
aaaucuaaaucuauuu

SEQ ID NO: 2644674 - RNA, 17 nt, Human
aaaucuaaaucuauuua

SEQ ID NO: 2644675 - RNA, 22 nt, Human
aaaucuauuuauuaauauuuaa

SEQ ID NO: 2644676 - RNA, 12 nt, Human
aaaucuauuuau

SEQ ID NO: 2644677 - RNA, 16 nt, Human
aaaucuauuuauuaau

SEQ ID NO: 2644678 - RNA, 17 nt, Human
aaaucuauuuauuaaua

SEQ ID NO: 2644679 - RNA, 19 nt, Human
aaaucuauuuauuaauauu

SEQ ID NO: 2644680 - RNA, 16 nt, Human
aaauuaucaauaucua

SEQ ID NO: 2644681 - RNA, 12 nt, Human
caacugugacug

SEQ ID NO: 2644682 - RNA, 19 nt, Human
auuuuaaaucuaaaucuau

SEQ ID NO: 2644683 - RNA, 21 nt, Human
auuuuaaaucuaaaucuauuu

SEQ ID NO: 2644684 - RNA, 18 nt, Human
caaauauuguugacaacu

SEQ ID NO: 2644685 - RNA, 22 nt, Human
caaauauuguugacaacuguga

SEQ ID NO: 2644686 - RNA, 23 nt, Human
caaauauuguugacaacugugac

SEQ ID NO: 2644687 - RNA, 22 nt, Human
uuuguuaaaauuaucaauaucu

SEQ ID NO: 2644688 - RNA, 11 nt, Human
uuuauuucacu

SEQ ID NO: 2644689 - RNA, 17 nt, Human
uucaggaagggaugcag

SEQ ID NO: 2644690 - RNA, 22 nt, Human
uucaggaagggaugcaggcucc

SEQ ID NO: 2644691 - RNA, 15 nt, Human
uucugagcugccagu

SEQ ID NO: 2644692 - RNA, 12 nt, Human
uuggcauuugca

SEQ ID NO: 2644693 - RNA, 23 nt, Human
ugucauaguucugagcugccagu

SEQ ID NO: 2644694 - RNA, 19 nt, Human
uguguguccaaaacugccu

SEQ ID NO: 2644695 - RNA, 16 nt, Human
uguguguccaaaacug

SEQ ID NO: 2644696 - RNA, 13 nt, Human
uuaacauuauuua

SEQ ID NO: 2644697 - RNA, 22 nt, Human
ugcacgguuucgaagucauuaa

SEQ ID NO: 2644698 - RNA, 23 nt, Human
ugcacgguuucgaagucauuaaa

SEQ ID NO: 2644699 - RNA, 17 nt, Human
ugccuccccucuccuuc

SEQ ID NO: 2644700 - RNA, 13 nt, Human
ugaacacuuauaa

SEQ ID NO: 2644701 - RNA, 14 nt, Human
ucugagcugccagu

SEQ ID NO: 2644702 - RNA, 19 nt, Human
ucacaggccccaggaaagg

SEQ ID NO: 2644703 - RNA, 19 nt, Human
uauuuauuaauauuuaaca

SEQ ID NO: 2644704 - RNA, 13 nt, Human
uauuuauuaauau

SEQ ID NO: 2644705 - RNA, 17 nt, Human
uauuuauuaauauuuaa

SEQ ID NO: 2644706 - RNA, 18 nt, Human
uauuuauuaauauuuaac

SEQ ID NO: 2644707 - RNA, 17 nt, Human
guuucgaagucauuaaa

SEQ ID NO: 2644708 - RNA, 20 nt, Human
uaacucauuuguuaaaauua

SEQ ID NO: 2644709 - RNA, 12 nt, Human
uaacucauuugu

SEQ ID NO: 2644710 - RNA, 15 nt, Human
uaacauuauuuauau

SEQ ID NO: 2644711 - RNA, 16 nt, Human
uaacauuauuuauaug

SEQ ID NO: 2644712 - RNA, 12 nt, Human
uaacauuauuua

SEQ ID NO: 2644713 - RNA, 14 nt, Human
uaacauuauuuaua

SEQ ID NO: 2644714 - RNA, 20 nt, Human
uaauauauguauuauuuaua

SEQ ID NO: 2644715 - RNA, 14 nt, Human
uaauauauaugaau

SEQ ID NO: 2644716 - RNA, 16 nt, Human
uaauauauaugaauaa

SEQ ID NO: 2644717 - RNA, 18 nt, Human
uaauauauaugaauaaag

SEQ ID NO: 2644718 - RNA, 22 nt, Human
uaauccuuuguuuucugacuaa

SEQ ID NO: 2644719 - RNA, 16 nt, Human
uaauccuuuguuuucu

SEQ ID NO: 2644720 - RNA, 18 nt, Human
uaauccuuuguuuucuga

SEQ ID NO: 2644721 - RNA, 20 nt, Human
uaauccuuuguuuucugacu

SEQ ID NO: 2644722 - RNA, 23 nt, Human
uaauccuuuguuuucugacuaau

SEQ ID NO: 2644723 - RNA, 22 nt, Human
uagugcuccauaguuuggcauu

SEQ ID NO: 2644724 - RNA, 16 nt, Human
uaguuuggcauuugca

SEQ ID NO: 2644725 - RNA, 22 nt, Human
uauaauuccuauauccugugac

SEQ ID NO: 2644726 - RNA, 21 nt, Human
uauaauuccuauauccuguga

SEQ ID NO: 2644727 - RNA, 13 nt, Human
uauccugugacug

SEQ ID NO: 2644728 - RNA, 14 nt, Human
uauccugugacugu

SEQ ID NO: 2644729 - RNA, 16 nt, Human
uauccugugacugucu

SEQ ID NO: 2644730 - RNA, 17 nt, Human
uauccugugacugucuc

SEQ ID NO: 2644731 - RNA, 23 nt, Human
uauccugugacugucucacuuaa

SEQ ID NO: 2644732 - RNA, 19 nt, Human
ggcaccucacaggccccag

SEQ ID NO: 2644733 - RNA, 16 nt, Human
ggcaccucacaggccc

SEQ ID NO: 2644734 - RNA, 18 nt, Human
gcccauccccaggcaccu

SEQ ID NO: 2644735 - RNA, 15 nt, Human
gccccaggaaaggcc

SEQ ID NO: 2644736 - RNA, 22 nt, Human
gccccaggaaaggcccagccac

SEQ ID NO: 2644737 - RNA, 23 nt, Human
gcagccugcgccaccgcccagag

SEQ ID NO: 2644738 - RNA, 20 nt, Human
gcaacuuuuguguaaugaaa

SEQ ID NO: 2644739 - RNA, 18 nt, Human
gcaagguccggcccaucc

SEQ ID NO: 2644740 - RNA, 19 nt, Human
gaugcaggcuccccugagg

SEQ ID NO: 2644741 - RNA, 20 nt, Human
gaugcaggcuccccugagga

SEQ ID NO: 2644742 - RNA, 12 nt, Human
gaugcaggcucc

SEQ ID NO: 2644743 - RNA, 16 nt, Human
gaugcaggcuccccug

SEQ ID NO: 2644744 - RNA, 17 nt, Human
gaugcaggcuccccuga

SEQ ID NO: 2644745 - RNA, 17 nt, Human
gaagucauuaaacuggu

SEQ ID NO: 2644746 - RNA, 15 nt, Human
gaagucauuaaacug

SEQ ID NO: 2644747 - RNA, 15 nt, Human
gacuaauuaggcaag

SEQ ID NO: 2644748 - RNA, 19 nt, Human
gaccuucgggcugugcccg

SEQ ID NO: 2644749 - RNA, 18 nt, Human
gaccuucgggcugugccc

SEQ ID NO: 2644750 - RNA, 16 nt, Human
gaccuucgggcugugc

SEQ ID NO: 2644751 - RNA, 20 nt, Human
cuuuguuuucugacuaauua

SEQ ID NO: 2644752 - RNA, 17 nt, Human
cuuuguuuucugacuaa

SEQ ID NO: 2644753 - RNA, 20 nt, Human
cuuauaagugaagugauacu

SEQ ID NO: 2644754 - RNA, 19 nt, Human
cuuauaagugaagugauac

SEQ ID NO: 2644755 - RNA, 14 nt, Human
cuucgggcugugcc

SEQ ID NO: 2644756 - RNA, 21 nt, Human
cucuuguaucccuagugcucc

SEQ ID NO: 2644757 - RNA, 12 nt, Human
cugcaauauuug

SEQ ID NO: 2644758 - RNA, 16 nt, Human
cugcaauauuugaauu

SEQ ID NO: 2644759 - RNA, 18 nt, Human
cugcaauauuugaauuuu

SEQ ID NO: 2644760 - RNA, 19 nt, Human
cugcaauauuugaauuuua

SEQ ID NO: 2644761 - RNA, 23 nt, Human
cugccucaggaggcaggaccuuc

SEQ ID NO: 2644762 - RNA, 22 nt, Human
cugccucaggaggcaggaccuu

SEQ ID NO: 2644763 - RNA, 20 nt, Human
cugccugcaauauuugaauu

SEQ ID NO: 2644764 - RNA, 18 nt, Human
cugccugcaauauuugaa

SEQ ID NO: 2644765 - RNA, 19 nt, Human
cugccugcaauauuugaau

SEQ ID NO: 2644766 - RNA, 17 nt, Human
cugccugcaauauuuga

SEQ ID NO: 2644767 - RNA, 17 nt, Human
cuggugcuuccaaauau

SEQ ID NO: 2644768 - RNA, 12 nt, Human
ccguuuucccca

SEQ ID NO: 2644769 - RNA, 15 nt, Human
ccguuuuccccauga

SEQ ID NO: 2644770 - RNA, 17 nt, Human
ccguuuuccccaugaca

SEQ ID NO: 2644771 - RNA, 15 nt, Human
ccucacaggccccag

SEQ ID NO: 2644772 - RNA, 17 nt, Human
ccccuaccaauauuagg

SEQ ID NO: 2644773 - RNA, 12 nt, Human
cccuuuuccccu

SEQ ID NO: 2644774 - RNA, 13 nt, Human
cccuuuuccccua

SEQ ID NO: 2644775 - RNA, 17 nt, Human
ccuccccucuccuuccu

SEQ ID NO: 2644776 - RNA, 15 nt, Human
ccuggugcuuccaaa

SEQ ID NO: 2644777 - RNA, 14 nt, Human
cguuuuccccauga

SEQ ID NO: 2644778 - RNA, 16 nt, Human
cguuuuccccaugaca

SEQ ID NO: 2644779 - RNA, 20 nt, Human
cggcccauccccaggcaccu

SEQ ID NO: 2644780 - RNA, 18 nt, Human
ccauaguuuggcauuugc

SEQ ID NO: 2644781 - RNA, 17 nt, Human
ccccaccccccaggccu

SEQ ID NO: 2644782 - RNA, 23 nt, Human
caaauauuguugacaacugugac

SEQ ID NO: 2644783 - RNA, 22 nt, Human
caaauauuguugacaacuguga

SEQ ID NO: 2644784 - RNA, 18 nt, Human
caaauauuguugacaacu

SEQ ID NO: 2644785 - RNA, 14 nt, Human
caaauguuuauuuu

SEQ ID NO: 2644786 - RNA, 13 nt, Human
caaauguuuauuu

SEQ ID NO: 2644787 - RNA, 20 nt, Human
caaagggccugcccagacaa

SEQ ID NO: 2644788 - RNA, 21 nt, Human
caaagggccugcccagacaag

SEQ ID NO: 2644789 - RNA, 21 nt, Human
auuuuaaaucuaaaucuauuu

SEQ ID NO: 2644790 - RNA, 19 nt, Human
auuuuaaaucuaaaucuau

SEQ ID NO: 2644791 - RNA, 17 nt, Human
auuuuaaagugcaaaag

SEQ ID NO: 2644792 - RNA, 16 nt, Human
auuuuaagacugauuu

SEQ ID NO: 2644793 - RNA, 20 nt, Human
auuuuaauagggaauauauc

SEQ ID NO: 2644794 - RNA, 19 nt, Human
caaacugggaugaaacuaa

SEQ ID NO: 2644795 - RNA, 12 nt, Human
caaagaaauauu

SEQ ID NO: 2644796 - RNA, 14 nt, Human
caaagaaauauuaa

SEQ ID NO: 2644797 - RNA, 20 nt, Human
caaagaaauccggagaagcu

SEQ ID NO: 2644798 - RNA, 14 nt, Human
caaagacaaaaguc

SEQ ID NO: 2644799 - RNA, 19 nt, Human
caaagacaaaagucugucu

SEQ ID NO: 2644800 - RNA, 21 nt, Human
caaacugcuucccuuacuuug

SEQ ID NO: 2644801 - RNA, 21 nt, Human
caaagagguuuuaaaaaaauc

SEQ ID NO: 2644802 - RNA, 14 nt, Human
caaagagguuuuaa

SEQ ID NO: 2644803 - RNA, 12 nt, Human
caacugugacug

SEQ ID NO: 2644804 - RNA, 19 nt, Human
caacuggguccagaagaga

SEQ ID NO: 2644805 - RNA, 22 nt, Human
caacuucugccucccaugcuua

SEQ ID NO: 2644806 - RNA, 16 nt, Human
caagaccgaucggcgg

SEQ ID NO: 2644807 - RNA, 11 nt, Human
caagcagagga

SEQ ID NO: 2644808 - RNA, 14 nt, Human
caagcagaggacca

SEQ ID NO: 2644809 - RNA, 18 nt, Human
caagcagaggaccagggc

SEQ ID NO: 2644810 - RNA, 19 nt, Human
caagcagaggaccagggcc

SEQ ID NO: 2644811 - RNA, 20 nt, Human
caagcagaggaccagggccu

SEQ ID NO: 2644812 - RNA, 21 nt, Human
caagcagaggaccagggccuu

SEQ ID NO: 2644813 - RNA, 22 nt, Human
caagcagaggaccagggccuuu

SEQ ID NO: 2644814 - RNA, 14 nt, Human
caagagggggugga

SEQ ID NO: 2644815 - RNA, 15 nt, Human
caagaggggguggag

SEQ ID NO: 2644816 - RNA, 17 nt, Human
caagaggggguggaggg

SEQ ID NO: 2644817 - RNA, 18 nt, Human
caagaggggguggagggg

SEQ ID NO: 2644818 - RNA, 21 nt, Human
caagaggggguggaggggugu

SEQ ID NO: 2644819 - RNA, 22 nt, Human
caagagaacucgcgcucaguaa

SEQ ID NO: 2644820 - RNA, 23 nt, Human
caagagaacucgcgcucaguaaa

SEQ ID NO: 2644821 - RNA, 12 nt, Human
caagagccuuaa

SEQ ID NO: 2644822 - RNA, 17 nt, Human
caagagccuuaaaacau

SEQ ID NO: 2644823 - RNA, 16 nt, Human
caagagccuuaaaaca

SEQ ID NO: 2644824 - RNA, 15 nt, Human
caagagccuuaaaac

SEQ ID NO: 2644825 - RNA, 14 nt, Human
caagagccuuaaaa

SEQ ID NO: 2644826 - RNA, 21 nt, Human
caagcagucgugccugugucc

SEQ ID NO: 2644827 - RNA, 15 nt, Human
caagcagucgugccu

SEQ ID NO: 2644828 - RNA, 16 nt, Human
caagcagucgugccug

SEQ ID NO: 2644829 - RNA, 18 nt, Human
caagcagucgugccugug

SEQ ID NO: 2644830 - RNA, 19 nt, Human
caagcagucgugccugugu

SEQ ID NO: 2644831 - RNA, 20 nt, Human
caagcagucgugccuguguc

SEQ ID NO: 2644832 - RNA, 21 nt, Human
caagcaucuuggggggguggc

SEQ ID NO: 2644833 - RNA, 17 nt, Human
caagcaugcagcuuugc

SEQ ID NO: 2644834 - RNA, 20 nt, Human
caagcaugcuugugaaaaug

SEQ ID NO: 2644835 - RNA, 13 nt, Human
caagccaggcuca

SEQ ID NO: 2644836 - RNA, 19 nt, Human
caagccaggcucacucaca

SEQ ID NO: 2644837 - RNA, 20 nt, Human
caagccaggcucacucacag

SEQ ID NO: 2644838 - RNA, 21 nt, Human
caaggcugggggaagaagcuc

SEQ ID NO: 2644839 - RNA, 17 nt, Human
caagguuauaauuuuuu

SEQ ID NO: 2644840 - RNA, 21 nt, Human
caagguuauaauuuuuuuuaa

SEQ ID NO: 2644841 - RNA, 22 nt, Human
caagguuauaauuuuuuuuaaa

SEQ ID NO: 2644842 - RNA, 9 nt, Human
caagguaua

SEQ ID NO: 2644843 - RNA, 14 nt, Human
caagguauaauaaa

SEQ ID NO: 2644844 - RNA, 17 nt, Human
caagguauaauaaaauu

SEQ ID NO: 2644845 - RNA, 19 nt, Human
caagguauaauaaaauuau

SEQ ID NO: 2644846 - RNA, 19 nt, Human
caaggucacuguuuccugg

SEQ ID NO: 2644847 - RNA, 20 nt, Human
caaggucacuguuuccuggg

SEQ ID NO: 2644848 - RNA, 16 nt, Human
caagggcauaaaguaa

SEQ ID NO: 2644849 - RNA, 14 nt, Human
caagggauuugagg

SEQ ID NO: 2644850 - RNA, 19 nt, Human
caagugagacccugucuca

SEQ ID NO: 2644851 - RNA, 15 nt, Human
caagugagacccugu

SEQ ID NO: 2644852 - RNA, 14 nt, Human
caagugagacccug

SEQ ID NO: 2644853 - RNA, 13 nt, Human
caagugaaauuau

SEQ ID NO: 2644854 - RNA, 20 nt, Human
caagugaaauuauuuuggag

SEQ ID NO: 2644855 - RNA, 23 nt, Human
caagugaaaaaggaggaagagaa

SEQ ID NO: 2644856 - RNA, 22 nt, Human
caagugaaaaaggaggaagaga

SEQ ID NO: 2644857 - RNA, 14 nt, Human
caaccucagggcuc

SEQ ID NO: 2644858 - RNA, 15 nt, Human
caaccucagggcucc

SEQ ID NO: 2644859 - RNA, 17 nt, Human
caaccucagggcuccca

SEQ ID NO: 2644860 - RNA, 18 nt, Human
caaccucagggcucccag

SEQ ID NO: 2644861 - RNA, 19 nt, Human
caaccucagggcucccagg

SEQ ID NO: 2644862 - RNA, 20 nt, Human
caaccucagggcucccaggg

SEQ ID NO: 2644863 - RNA, 20 nt, Human
caaccuccgcauccgggguu

SEQ ID NO: 2644864 - RNA, 20 nt, Human
caacugucucucuucucaga

SEQ ID NO: 2644865 - RNA, 15 nt, Human
caacugucuuccuca

SEQ ID NO: 2644866 - RNA, 16 nt, Human
caacugucuuccucaa

SEQ ID NO: 2644867 - RNA, 18 nt, Human
cacaacuugauggcugcg

SEQ ID NO: 2644868 - RNA, 20 nt, Human
cacaagaacacacacauaua

SEQ ID NO: 2644869 - RNA, 15 nt, Human
cacaaaugcucaaag

SEQ ID NO: 2644870 - RNA, 13 nt, Human
cacaaaugacuuu

SEQ ID NO: 2644871 - RNA, 22 nt, Human
cacaaaugacuuuauuauuuau

SEQ ID NO: 2644872 - RNA, 20 nt, Human
cacaaaugacuuuauuauuu

SEQ ID NO: 2644873 - RNA, 15 nt, Human
cacaaaugacuuuau

SEQ ID NO: 2644874 - RNA, 14 nt, Human
cacaaaugacuuua

SEQ ID NO: 2644875 - RNA, 17 nt, Human
caauuaguaacauucau

SEQ ID NO: 2644876 - RNA, 18 nt, Human
caauuaguaacauucaug

SEQ ID NO: 2644877 - RNA, 17 nt, Human
cacaaacgggcucagca

SEQ ID NO: 2644878 - RNA, 22 nt, Human
cacaaacucuaucggagaacau

SEQ ID NO: 2644879 - RNA, 23 nt, Human
cacaaacucuaucggagaacaug

SEQ ID NO: 2644880 - RNA, 15 nt, Human
cacacagcagcaguu

SEQ ID NO: 2644881 - RNA, 22 nt, Human
cacaccuacuagucaccagaga

SEQ ID NO: 2644882 - RNA, 13 nt, Human
caagugcuggagu

SEQ ID NO: 2644883 - RNA, 14 nt, Human
caagugcuggaguc

SEQ ID NO: 2644884 - RNA, 20 nt, Human
caagugcuggagucuccuga

SEQ ID NO: 2644885 - RNA, 21 nt, Human
caagugcuggagucuccugag

SEQ ID NO: 2644886 - RNA, 24 nt, Human
caauauuaaccuaaucaccaugua

SEQ ID NO: 2644887 - RNA, 19 nt, Human
caauauuccagaucuuuca

SEQ ID NO: 2644888 - RNA, 19 nt, Human
caaucuauugcuucaccau

SEQ ID NO: 2644889 - RNA, 16 nt, Human
caaucuuacuuuguaa

SEQ ID NO: 2644890 - RNA, 23 nt, Human
caaucuuacuuuguaaauucuga

SEQ ID NO: 2644891 - RNA, 22 nt, Human
caaucuuacuuuguaaauucug

SEQ ID NO: 2644892 - RNA, 19 nt, Human
caaucuuacuuuguaaauu

SEQ ID NO: 2644893 - RNA, 17 nt, Human
caaucuuacuuuguaaa

SEQ ID NO: 2644894 - RNA, 21 nt, Human
caaugaaaaauagugucuuug

SEQ ID NO: 2644895 - RNA, 15 nt, Human
caaugauuguuaauu

SEQ ID NO: 2644896 - RNA, 22 nt, Human
caaugauuguuaauuuacagcu

SEQ ID NO: 2644897 - RNA, 17 nt, Human
caauguaagcauacuuu

SEQ ID NO: 2644898 - RNA, 14 nt, Human
cacaguuuugaccu

SEQ ID NO: 2644899 - RNA, 15 nt, Human
cacagugaagugcug

SEQ ID NO: 2644900 - RNA, 20 nt, Human
cacaugacucgggggugggg

SEQ ID NO: 2644901 - RNA, 15 nt, Human
cacagccagcaccug

SEQ ID NO: 2644902 - RNA, 16 nt, Human
cacagccagcaccugg

SEQ ID NO: 2644903 - RNA, 17 nt, Human
cacagccagcaccuggc

SEQ ID NO: 2644904 - RNA, 20 nt, Human
cacagccagcaccuggcauc

SEQ ID NO: 2644905 - RNA, 22 nt, Human
cacagcaacgaucacaaaugac

SEQ ID NO: 2644906 - RNA, 21 nt, Human
cacagcaacgaucacaaauga

SEQ ID NO: 2644907 - RNA, 22 nt, Human
cacacggacacucaaaagcugg

SEQ ID NO: 2644908 - RNA, 14 nt, Human
cacacgcuuuugaa

SEQ ID NO: 2644909 - RNA, 20 nt, Human
cacagcaacgaucacaaaug

SEQ ID NO: 2644910 - RNA, 15 nt, Human
cacaggacccucgcc

SEQ ID NO: 2644911 - RNA, 18 nt, Human
cacagucuccggccucuc

SEQ ID NO: 2644912 - RNA, 20 nt, Human
cacagucuccggccucucca

SEQ ID NO: 2644913 - RNA, 15 nt, Human
caccagggguuucuc

SEQ ID NO: 2644914 - RNA, 21 nt, Human
caccauauuggccagucuggu

SEQ ID NO: 2644915 - RNA, 11 nt, Human
caccaugaaac

SEQ ID NO: 2644916 - RNA, 15 nt, Human
caccaucaauccuga

SEQ ID NO: 2644917 - RNA, 14 nt, Human
caccaagccaaggg

SEQ ID NO: 2644918 - RNA, 13 nt, Human
caccaagccaagg

SEQ ID NO: 2644919 - RNA, 19 nt, Human
caccaaucuuacuuuguaa

SEQ ID NO: 2644920 - RNA, 18 nt, Human
caccaaucuuacuuugua

SEQ ID NO: 2644921 - RNA, 22 nt, Human
caccaaucuuacuuuguaaauu

SEQ ID NO: 2644922 - RNA, 17 nt, Human
caccaaucuuacuuugu

SEQ ID NO: 2644923 - RNA, 18 nt, Human
caccaccuucuucuccua

SEQ ID NO: 2644924 - RNA, 12 nt, Human
cacccaaagcug

SEQ ID NO: 2644925 - RNA, 15 nt, Human
cacccaaagcugagc

SEQ ID NO: 2644926 - RNA, 16 nt, Human
cacccaaagcugagcc

SEQ ID NO: 2644927 - RNA, 18 nt, Human
cacccaaagcugagccug

SEQ ID NO: 2644928 - RNA, 19 nt, Human
cacccaaagcugagccugc

SEQ ID NO: 2644929 - RNA, 22 nt, Human
cacccaaagcugagccugcagg

SEQ ID NO: 2644930 - RNA, 15 nt, Human
cacccaaccccaagc

SEQ ID NO: 2644931 - RNA, 24 nt, Human
cacccaacccuaucuccugacaga

SEQ ID NO: 2644932 - RNA, 22 nt, Human
cacccaacccuaucuccugaca

SEQ ID NO: 2644933 - RNA, 23 nt, Human
cacccaacccuaucuccugacag

SEQ ID NO: 2644934 - RNA, 20 nt, Human
cacccaaaccggcaggugcg

SEQ ID NO: 2644935 - RNA, 21 nt, Human
cacccaaaccggcaggugcga

SEQ ID NO: 2644936 - RNA, 14 nt, Human
caccauucugacuc

SEQ ID NO: 2644937 - RNA, 13 nt, Human
caccauucugacu

SEQ ID NO: 2644938 - RNA, 23 nt, Human
caccauucguacauaauacugaa

SEQ ID NO: 2644939 - RNA, 22 nt, Human
caccauucguacauaauacuga

SEQ ID NO: 2644940 - RNA, 20 nt, Human
caccauucguacauaauacu

SEQ ID NO: 2644941 - RNA, 17 nt, Human
caccaugugagcucuuc

SEQ ID NO: 2644942 - RNA, 16 nt, Human
aaauuaucaauaucua

SEQ ID NO: 2644943 - RNA, 16 nt, Human
aaauuccccacccuga

SEQ ID NO: 2644944 - RNA, 12 nt, Human
aaauucauuucu

SEQ ID NO: 2644945 - RNA, 16 nt, Human
aaauucauuucuaauu

SEQ ID NO: 2644946 - RNA, 16 nt, Human
aaauguuauuaucugg

SEQ ID NO: 2644947 - RNA, 14 nt, Human
aaauguuaccucug

SEQ ID NO: 2644948 - RNA, 15 nt, Human
aaauguuaccucuga

SEQ ID NO: 2644949 - RNA, 17 nt, Human
aaauguuaccucugaau

SEQ ID NO: 2644950 - RNA, 19 nt, Human
aaauguuaccucugaauuu

SEQ ID NO: 2644951 - RNA, 19 nt, Human
guauuuaacagaaauugua

SEQ ID NO: 2644952 - RNA, 20 nt, Human
guauuuaacagaaauuguau

SEQ ID NO: 2644953 - RNA, 21 nt, Human
guauuuaacagaaauuguaua

SEQ ID NO: 2644954 - RNA, 21 nt, Human
gucaaccucgcgcuugcuggc

SEQ ID NO: 2644955 - RNA, 21 nt, Human
guauuuuuucaaguuguaaau

SEQ ID NO: 2644956 - RNA, 14 nt, Human
guauuuuuuccuuu

SEQ ID NO: 2644957 - RNA, 18 nt, Human
guauuuuuuuuucuaaga

SEQ ID NO: 2644958 - RNA, 22 nt, Human
guauuuuuuuuucuaagagaag

SEQ ID NO: 2644959 - RNA, 16 nt, Human
guauuuuuuuuucuaa

SEQ ID NO: 2644960 - RNA, 16 nt, Human
gucaaaugaugugcaa

SEQ ID NO: 2644961 - RNA, 17 nt, Human
gucaaaugaugugcaaa

SEQ ID NO: 2644962 - RNA, 18 nt, Human
aaauuucacuacuagauu

SEQ ID NO: 2644963 - RNA, 12 nt, Human
aaauuuagaaca

SEQ ID NO: 2644964 - RNA, 12 nt, Human
aaauuuaguguu

SEQ ID NO: 2644965 - RNA, 16 nt, Human
aaauuuagccgggcgc

SEQ ID NO: 2644966 - RNA, 18 nt, Human
guauauuacaaugaucac

SEQ ID NO: 2644967 - RNA, 15 nt, Human
guauauuacaaugau

SEQ ID NO: 2644968 - RNA, 17 nt, Human
guauauuacaaugauca

SEQ ID NO: 2644969 - RNA, 22 nt, Human
guauaaaauacauagugaaaau

SEQ ID NO: 2644970 - RNA, 12 nt, Human
guauaaauauac

SEQ ID NO: 2644971 - RNA, 13 nt, Human
aaauguaauuuaa

SEQ ID NO: 2644972 - RNA, 14 nt, Human
aaauguaauuuaaa

SEQ ID NO: 2644973 - RNA, 17 nt, Human
aaauguaauuuaaauga

SEQ ID NO: 2644974 - RNA, 18 nt, Human
aaauguaauuuaaaugaa

SEQ ID NO: 2644975 - RNA, 19 nt, Human
aaauguaauuuaaaugaaa

SEQ ID NO: 2644976 - RNA, 21 nt, Human
aaauguaggcaucaugcaugu

SEQ ID NO: 2644977 - RNA, 13 nt, Human
aaauguagguccu

SEQ ID NO: 2644978 - RNA, 20 nt, Human
aaauguaggcuuaguuugug

SEQ ID NO: 2644979 - RNA, 16 nt, Human
guaguucuguauuuga

SEQ ID NO: 2644980 - RNA, 15 nt, Human
guaguucuguauuug

SEQ ID NO: 2644981 - RNA, 14 nt, Human
guaguucuguauuu

SEQ ID NO: 2644982 - RNA, 16 nt, Human
guaguucuaccggcuu

SEQ ID NO: 2644983 - RNA, 17 nt, Human
guaguucuuuaaacugu

SEQ ID NO: 2644984 - RNA, 14 nt, Human
guaguucuuuaaac

SEQ ID NO: 2644985 - RNA, 20 nt, Human
guaguucuguauuugaaagu

SEQ ID NO: 2644986 - RNA, 18 nt, Human
guaguucuguauuugaaa

SEQ ID NO: 2644987 - RNA, 17 nt, Human
guaguucuguauuugaa

SEQ ID NO: 2644988 - RNA, 16 nt, Human
guauggaaguuuuccu

SEQ ID NO: 2644989 - RNA, 17 nt, Human
guauggaaguuuuccua

SEQ ID NO: 2644990 - RNA, 18 nt, Human
guauggacuaucugucug

SEQ ID NO: 2644991 - RNA, 22 nt, Human
guauggcuuuauuuuuuugaac

SEQ ID NO: 2644992 - RNA, 21 nt, Human
guauggcuuuauuuuuuugaa

SEQ ID NO: 2644993 - RNA, 14 nt, Human
guauccccccaucu

SEQ ID NO: 2644994 - RNA, 17 nt, Human
guauccccccaucuugc

SEQ ID NO: 2644995 - RNA, 18 nt, Human
guauccccccaucuugcu

SEQ ID NO: 2644996 - RNA, 14 nt, Human
guaugguaaucuuu

SEQ ID NO: 2644997 - RNA, 16 nt, Human
guauucuucucuuccu

SEQ ID NO: 2644998 - RNA, 22 nt, Human
guauucuucucuuccuuuuauc

SEQ ID NO: 2644999 - RNA, 15 nt, Human
guaugugggauauug

SEQ ID NO: 2645000 - RNA, 20 nt, Human
guaugugggauauugaaugu

SEQ ID NO: 2645001 - RNA, 16 nt, Human
guaugugguuuuguaa

SEQ ID NO: 2645002 - RNA, 19 nt, Human
aaaucuauuuauuaauauu

SEQ ID NO: 2645003 - RNA, 17 nt, Human
aaaucuauuuauuaaua

SEQ ID NO: 2645004 - RNA, 16 nt, Human
aaaucuauuuauuaau

SEQ ID NO: 2645005 - RNA, 12 nt, Human
aaaucuauuuau

SEQ ID NO: 2645006 - RNA, 22 nt, Human
aaaucuauuuauuaauauuuaa

SEQ ID NO: 2645007 - RNA, 21 nt, Human
aaaugaaaacaguguguaaac

SEQ ID NO: 2645008 - RNA, 12 nt, Human
aaaugaaaauug

SEQ ID NO: 2645009 - RNA, 13 nt, Human
aaaugaaaauugu

SEQ ID NO: 2645010 - RNA, 14 nt, Human
aaaugaaaauugua

SEQ ID NO: 2645011 - RNA, 17 nt, Human
aaaucuaaaucuauuua

SEQ ID NO: 2645012 - RNA, 16 nt, Human
aaaucuaaaucuauuu

SEQ ID NO: 2645013 - RNA, 15 nt, Human
aaaucuaaaucuauu

SEQ ID NO: 2645014 - RNA, 20 nt, Human
aaaucuaaaucuauuuauua

SEQ ID NO: 2645015 - RNA, 21 nt, Human
aaaucuaagcagcuuauuguu

SEQ ID NO: 2645016 - RNA, 17 nt, Human
aaauccuuuuaccuuuu

SEQ ID NO: 2645017 - RNA, 15 nt, Human
aaauccugaagagca

SEQ ID NO: 2645018 - RNA, 17 nt, Human
aaauccugaagagcauu

SEQ ID NO: 2645019 - RNA, 16 nt, Human
aaauccggagaagcug

SEQ ID NO: 2645020 - RNA, 18 nt, Human
aaaucccuuaccucggug

SEQ ID NO: 2645021 - RNA, 15 nt, Human
aaaucccauuuaaaa

SEQ ID NO: 2645022 - RNA, 15 nt, Human
guaggacuccuuauu

SEQ ID NO: 2645023 - RNA, 19 nt, Human
guaggaccaagcaucuugg

SEQ ID NO: 2645024 - RNA, 16 nt, Human
guaggaaagaggaagc

SEQ ID NO: 2645025 - RNA, 16 nt, Human
guaggagggugggaag

SEQ ID NO: 2645026 - RNA, 17 nt, Human
guaggagggugggaagg

SEQ ID NO: 2645027 - RNA, 23 nt, Human
guaggagcugccuuggcucagac

SEQ ID NO: 2645028 - RNA, 22 nt, Human
guaggagcugccuuggcucaga

SEQ ID NO: 2645029 - RNA, 14 nt, Human
guaggagcugccuu

SEQ ID NO: 2645030 - RNA, 15 nt, Human
guaggaugaaaagau

SEQ ID NO: 2645031 - RNA, 21 nt, Human
aaaggauaguaagcauagaaa

SEQ ID NO: 2645032 - RNA, 15 nt, Human
aaaggagagcaucgg

SEQ ID NO: 2645033 - RNA, 13 nt, Human
aaaggauaaagaa

SEQ ID NO: 2645034 - RNA, 14 nt, Human
aaaggauaaagaag

SEQ ID NO: 2645035 - RNA, 22 nt, Human
aaaggauaaagaaggaugaugu

SEQ ID NO: 2645036 - RNA, 13 nt, Human
aaaggagagcauc

SEQ ID NO: 2645037 - RNA, 19 nt, Human
aaaugaauaucuauuaaua

SEQ ID NO: 2645038 - RNA, 18 nt, Human
aaaugaauaucuauuaau

SEQ ID NO: 2645039 - RNA, 17 nt, Human
aaaugaauaucuauuaa

SEQ ID NO: 2645040 - RNA, 16 nt, Human
aaaugaauaucuauua

SEQ ID NO: 2645041 - RNA, 14 nt, Human
aaaugacuuuauua

SEQ ID NO: 2645042 - RNA, 21 nt, Human
aaaugacuuuauuauuuauuu

SEQ ID NO: 2645043 - RNA, 20 nt, Human
aaaugacuuuauuauuuauu

SEQ ID NO: 2645044 - RNA, 18 nt, Human
aaaugacuuuauuauuua

SEQ ID NO: 2645045 - RNA, 15 nt, Human
aaaugacuuuauuau

SEQ ID NO: 2645046 - RNA, 12 nt, Human
aaaugaaaugca

SEQ ID NO: 2645047 - RNA, 14 nt, Human
aaaugaaaugcaua

SEQ ID NO: 2645048 - RNA, 15 nt, Human
aaaugaaaugcauau

SEQ ID NO: 2645049 - RNA, 14 nt, Human
aaaugaaagaaaau

SEQ ID NO: 2645050 - RNA, 15 nt, Human
aaaugaaagaaaauu

SEQ ID NO: 2645051 - RNA, 20 nt, Human
aaaugaaagaaaauugaguu

SEQ ID NO: 2645052 - RNA, 15 nt, Human
aaaugaagaauuuaa

SEQ ID NO: 2645053 - RNA, 13 nt, Human
aaaugaagaauuu

SEQ ID NO: 2645054 - RNA, 18 nt, Human
aaaugaagaauuuaaaga

SEQ ID NO: 2645055 - RNA, 16 nt, Human
aaaugaagaauuuaaa

SEQ ID NO: 2645056 - RNA, 15 nt, Human
aaaugaggaggaugc

SEQ ID NO: 2645057 - RNA, 22 nt, Human
aaaugaggaggaugcuaaaaau

SEQ ID NO: 2645058 - RNA, 23 nt, Human
aaaugagcucgcauuugucaaug

SEQ ID NO: 2645059 - RNA, 15 nt, Human
aaaugagcucugaaa

SEQ ID NO: 2645060 - RNA, 19 nt, Human
aaaugagcucugaaaucuu

SEQ ID NO: 2645061 - RNA, 19 nt, Human
aaaugagccuggcaagaau

SEQ ID NO: 2645062 - RNA, 13 nt, Human
aaaugagccuggc

SEQ ID NO: 2645063 - RNA, 13 nt, Human
aaaugcccagcuu

SEQ ID NO: 2645064 - RNA, 19 nt, Human
aaaugccauuuauuuauug

SEQ ID NO: 2645065 - RNA, 18 nt, Human
aaaugccauagaaaugua

SEQ ID NO: 2645066 - RNA, 20 nt, Human
aaaugccauuuauuuauuga

SEQ ID NO: 2645067 - RNA, 21 nt, Human
aaaugccauuuauuuauugau

SEQ ID NO: 2645068 - RNA, 22 nt, Human
aaaugccauuuauuuauugauu

SEQ ID NO: 2645069 - RNA, 13 nt, Human
aaaugcccucuuc

SEQ ID NO: 2645070 - RNA, 22 nt, Human
aaaugcccucuucucgugccuc

SEQ ID NO: 2645071 - RNA, 19 nt, Human
aaaugcaaaaacucuuuga

SEQ ID NO: 2645072 - RNA, 19 nt, Human
aaaugaugauguggaagaa

SEQ ID NO: 2645073 - RNA, 22 nt, Human
aaaugaugauguggaagaacuu

SEQ ID NO: 2645074 - RNA, 16 nt, Human
aaaugaugugcaaaac

SEQ ID NO: 2645075 - RNA, 14 nt, Human
aaaugcaucuuuga

SEQ ID NO: 2645076 - RNA, 16 nt, Human
aaaugcaucuuugaug

SEQ ID NO: 2645077 - RNA, 15 nt, Human
aaaugcaucuuugau

SEQ ID NO: 2645078 - RNA, 21 nt, Human
aaaugcaucuuugauguguug

SEQ ID NO: 2645079 - RNA, 20 nt, Human
aaaugcaucuuugauguguu

SEQ ID NO: 2645080 - RNA, 19 nt, Human
aaaugcaucuuugaugugu

SEQ ID NO: 2645081 - RNA, 18 nt, Human
aaaugcaucuuugaugug

SEQ ID NO: 2645082 - RNA, 17 nt, Human
guccugccugcaauauu

SEQ ID NO: 2645083 - RNA, 14 nt, Human
guccugccuguggc

SEQ ID NO: 2645084 - RNA, 13 nt, Human
guccugccugugg

SEQ ID NO: 2645085 - RNA, 11 nt, Human
guccugccugu

SEQ ID NO: 2645086 - RNA, 13 nt, Human
guccucuggagcc

SEQ ID NO: 2645087 - RNA, 18 nt, Human
guccucuggagcccuaac

SEQ ID NO: 2645088 - RNA, 20 nt, Human
guccugagauggaaaagugu

SEQ ID NO: 2645089 - RNA, 22 nt, Human
aacauuuauuuuuuuuaaagaa

SEQ ID NO: 2645090 - RNA, 23 nt, Human
aacauuuauuuuuuuuaaagaaa

SEQ ID NO: 2645091 - RNA, 12 nt, Human
aacauuugcugc

SEQ ID NO: 2645092 - RNA, 13 nt, Human
aacauuugcugcc

SEQ ID NO: 2645093 - RNA, 16 nt, Human
aacauuugcugccauu

SEQ ID NO: 2645094 - RNA, 19 nt, Human
aacauugaaguaaugaauu

SEQ ID NO: 2645095 - RNA, 18 nt, Human
aacauugaaguaaugaau

SEQ ID NO: 2645096 - RNA, 16 nt, Human
aacauugaaguaauga

SEQ ID NO: 2645097 - RNA, 21 nt, Human
aacauacaaaugcaucuuuga

SEQ ID NO: 2645098 - RNA, 20 nt, Human
aacauacaaaugcaucuuug

SEQ ID NO: 2645099 - RNA, 15 nt, Human
aacauacaaaugcau

SEQ ID NO: 2645100 - RNA, 14 nt, Human
aacauacaaaugca

SEQ ID NO: 2645101 - RNA, 22 nt, Human
aacauacaaaugcaucuuugau

SEQ ID NO: 2645102 - RNA, 15 nt, Human
aacaguggaauauaa

SEQ ID NO: 2645103 - RNA, 20 nt, Human
aacaguaugugggauauuga

SEQ ID NO: 2645104 - RNA, 21 nt, Human
aacaguaugugggauauugaa

SEQ ID NO: 2645105 - RNA, 21 nt, Human
aacaguacccugguugugugu

SEQ ID NO: 2645106 - RNA, 15 nt, Human
aacaguguguaaaca

SEQ ID NO: 2645107 - RNA, 21 nt, Human
aacaguguguaaacaaaauga

SEQ ID NO: 2645108 - RNA, 23 nt, Human
aacaguguguaaacaaaaugaag

SEQ ID NO: 2645109 - RNA, 20 nt, Human
aacaguguggccucuucuga

SEQ ID NO: 2645110 - RNA, 13 nt, Human
aacaguuguauuu

SEQ ID NO: 2645111 - RNA, 16 nt, Human
aacaguuuggaaaagu

SEQ ID NO: 2645112 - RNA, 23 nt, Human
aacaguuguauuuaacagaaauu

SEQ ID NO: 2645113 - RNA, 20 nt, Human
aacaguuguauuuaacagaa

SEQ ID NO: 2645114 - RNA, 14 nt, Human
aacagaaauggaaa

SEQ ID NO: 2645115 - RNA, 15 nt, Human
aacagaaauuguaua

SEQ ID NO: 2645116 - RNA, 17 nt, Human
aacagaaauuguauauu

SEQ ID NO: 2645117 - RNA, 18 nt, Human
aacagaaauuguauauug

SEQ ID NO: 2645118 - RNA, 19 nt, Human
aacagaaauuguauauugu

SEQ ID NO: 2645119 - RNA, 21 nt, Human
aacagaaauuguauauuguaa

SEQ ID NO: 2645120 - RNA, 21 nt, Human
guccggucccugucccagugc

SEQ ID NO: 2645121 - RNA, 13 nt, Human
guccgagcuuuga

SEQ ID NO: 2645122 - RNA, 12 nt, Human
aacaagcuucag

SEQ ID NO: 2645123 - RNA, 14 nt, Human
aacaagcuucagua

SEQ ID NO: 2645124 - RNA, 22 nt, Human
aacaagaccaccacuucgaaac

SEQ ID NO: 2645125 - RNA, 15 nt, Human
gucaaaguugaaaau

SEQ ID NO: 2645126 - RNA, 16 nt, Human
aacaauugguaaaacu

SEQ ID NO: 2645127 - RNA, 17 nt, Human
aacaauugguaaaacuc

SEQ ID NO: 2645128 - RNA, 23 nt, Human
aacaauugguaaaacucacugug

SEQ ID NO: 2645129 - RNA, 24 nt, Human
aacaauugguaaaacucacuguga

SEQ ID NO: 2645130 - RNA, 12 nt, Human
aacaaugaaguu

SEQ ID NO: 2645131 - RNA, 15 nt, Human
aacaaugaaguugaa

SEQ ID NO: 2645132 - RNA, 16 nt, Human
aacaaugaaguugaaa

SEQ ID NO: 2645133 - RNA, 18 nt, Human
aacaaugaaguugaaaau

SEQ ID NO: 2645134 - RNA, 21 nt, Human
aacaauauuuuaugguuaugu

SEQ ID NO: 2645135 - RNA, 22 nt, Human
aacaauauuuuaugguuauguu

SEQ ID NO: 2645136 - RNA, 23 nt, Human
aacaauaggaugggcuucugugc

SEQ ID NO: 2645137 - RNA, 18 nt, Human
aacaauaggcuguuccca

SEQ ID NO: 2645138 - RNA, 11 nt, Human
aacacuuccag

SEQ ID NO: 2645139 - RNA, 23 nt, Human
aacacugccuuuuuauuuauaug

SEQ ID NO: 2645140 - RNA, 14 nt, Human
aacacugccuuuuu

SEQ ID NO: 2645141 - RNA, 15 nt, Human
aacacugccuuuuua

SEQ ID NO: 2645142 - RNA, 21 nt, Human
aacacuccccauuaacagaug

SEQ ID NO: 2645143 - RNA, 13 nt, Human
aacacuccucugc

SEQ ID NO: 2645144 - RNA, 13 nt, Human
aacuaaagcaaua

SEQ ID NO: 2645145 - RNA, 16 nt, Human
aacuaaagcaauagaa

SEQ ID NO: 2645146 - RNA, 19 nt, Human
aacuaaagcaauagaaaca

SEQ ID NO: 2645147 - RNA, 13 nt, Human
aacuaaauuucac

SEQ ID NO: 2645148 - RNA, 22 nt, Human
aacuaaauuucacuacuagauu

SEQ ID NO: 2645149 - RNA, 13 nt, Human
aacuccagcaacu

SEQ ID NO: 2645150 - RNA, 21 nt, Human
aacucuaucggagaacaugaa

SEQ ID NO: 2645151 - RNA, 17 nt, Human
gugaacagagagacccu

SEQ ID NO: 2645152 - RNA, 22 nt, Human
gucugggcagcugucccuugcu

SEQ ID NO: 2645153 - RNA, 18 nt, Human
aaccucucacuucacccu

SEQ ID NO: 2645154 - RNA, 17 nt, Human
aaccucuucuggcucaa

SEQ ID NO: 2645155 - RNA, 16 nt, Human
gucuuugagcucccac

SEQ ID NO: 2645156 - RNA, 20 nt, Human
gucuuacuacagaaaugagg

SEQ ID NO: 2645157 - RNA, 18 nt, Human
gucuuagaucauaguuuu

SEQ ID NO: 2645158 - RNA, 23 nt, Human
gucuuccucaaaauaaagaagua

SEQ ID NO: 2645159 - RNA, 19 nt, Human
guccuugagugcucuugcu

SEQ ID NO: 2645160 - RNA, 14 nt, Human
guccuugauuucaa

SEQ ID NO: 2645161 - RNA, 15 nt, Human
guccuuccugaaacu

SEQ ID NO: 2645162 - RNA, 20 nt, Human
gucuccugacuggugcugca

SEQ ID NO: 2645163 - RNA, 16 nt, Human
gucuccuccccuuccc

SEQ ID NO: 2645164 - RNA, 14 nt, Human
gucuccuccccuuc

SEQ ID NO: 2645165 - RNA, 14 nt, Human
gucuccggccucuc

SEQ ID NO: 2645166 - RNA, 19 nt, Human
gucuccggccucuccagcc

SEQ ID NO: 2645167 - RNA, 16 nt, Human
aaccacaaaacucauc

SEQ ID NO: 2645168 - RNA, 19 nt, Human
aaccacacuugaaaccuuu

SEQ ID NO: 2645169 - RNA, 16 nt, Human
aaccaaaggaaaaugu

SEQ ID NO: 2645170 - RNA, 22 nt, Human
gucuccuauauauuucuauuau

SEQ ID NO: 2645171 - RNA, 20 nt, Human
aaccaagugaucaaacuaca

SEQ ID NO: 2645172 - RNA, 19 nt, Human
aaccaaagagggcuuccuc

SEQ ID NO: 2645173 - RNA, 14 nt, Human
aaccacauugaaga

SEQ ID NO: 2645174 - RNA, 16 nt, Human
aaccacauugaagaau

SEQ ID NO: 2645175 - RNA, 22 nt, Human
aaccacauugaagaauguuaga

SEQ ID NO: 2645176 - RNA, 16 nt, Human
aaccuccccagccugc

SEQ ID NO: 2645177 - RNA, 17 nt, Human
aaccuccccagccugcg

SEQ ID NO: 2645178 - RNA, 23 nt, Human
aaccuccccagccugcgccugcu

SEQ ID NO: 2645179 - RNA, 22 nt, Human
aaccauguagcagugagucaua

SEQ ID NO: 2645180 - RNA, 17 nt, Human
aaccaugucauuucaga

SEQ ID NO: 2645181 - RNA, 23 nt, Human
aacccauuaaggggaagaaugaa

SEQ ID NO: 2645182 - RNA, 14 nt, Human
aaccccaaacagug

SEQ ID NO: 2645183 - RNA, 16 nt, Human
aacccaguuucccguc

SEQ ID NO: 2645184 - RNA, 15 nt, Human
aaggcuaugugauua

SEQ ID NO: 2645185 - RNA, 12 nt, Human
guugauaaaucc

SEQ ID NO: 2645186 - RNA, 19 nt, Human
aaggaugaugucuuuuuau

SEQ ID NO: 2645187 - RNA, 15 nt, Human
guuguaguguccccc

SEQ ID NO: 2645188 - RNA, 14 nt, Human
guuguaccaaguga

SEQ ID NO: 2645189 - RNA, 16 nt, Human
guuguaccaagugaaa

SEQ ID NO: 2645190 - RNA, 16 nt, Human
guuguaagaauucuga

SEQ ID NO: 2645191 - RNA, 16 nt, Human
guuguauuuaacagaa

SEQ ID NO: 2645192 - RNA, 16 nt, Human
guugcugguaaaauga

SEQ ID NO: 2645193 - RNA, 12 nt, Human
guugcugguaaa

SEQ ID NO: 2645194 - RNA, 18 nt, Human
guugguauauuuuauauu

SEQ ID NO: 2645195 - RNA, 14 nt, Human
guugguaaacaguu

SEQ ID NO: 2645196 - RNA, 21 nt, Human
guugggugucuccuuaagcug

SEQ ID NO: 2645197 - RNA, 21 nt, Human
guuuaaaauaaaaugaaaauu

SEQ ID NO: 2645198 - RNA, 22 nt, Human
guuuaaaauaaaaugaaaauug

SEQ ID NO: 2645199 - RNA, 13 nt, Human
guuuaaaauguaa

SEQ ID NO: 2645200 - RNA, 19 nt, Human
guuuaaaauguaauuuaaa

SEQ ID NO: 2645201 - RNA, 20 nt, Human
guuuaaaauguaauuuaaau

SEQ ID NO: 2645202 - RNA, 21 nt, Human
guuuaaaauguaauuuaaaug

SEQ ID NO: 2645203 - RNA, 15 nt, Human
aaggcuuuaucucag

SEQ ID NO: 2645204 - RNA, 22 nt, Human
aaggcuuuucaaccacaaaacu

SEQ ID NO: 2645205 - RNA, 11 nt, Human
aagggaaaaau

SEQ ID NO: 2645206 - RNA, 12 nt, Human
aagggaaaaaua

SEQ ID NO: 2645207 - RNA, 15 nt, Human
aagggaaaaauauau

SEQ ID NO: 2645208 - RNA, 13 nt, Human
aaggcuugaagcu

SEQ ID NO: 2645209 - RNA, 14 nt, Human
aaggcuugaagcug

SEQ ID NO: 2645210 - RNA, 16 nt, Human
aaggcuugaagcugug

SEQ ID NO: 2645211 - RNA, 16 nt, Human
aaggcuuauaaaacag

SEQ ID NO: 2645212 - RNA, 15 nt, Human
guuguacuuaaaugg

SEQ ID NO: 2645213 - RNA, 23 nt, Human
guuuauuuucuacguuucuuuaa

SEQ ID NO: 2645214 - RNA, 14 nt, Human
aaggggugcuuuua

SEQ ID NO: 2645215 - RNA, 17 nt, Human
aaggggugcuuuuauag

SEQ ID NO: 2645216 - RNA, 13 nt, Human
aagguaaugugug

SEQ ID NO: 2645217 - RNA, 19 nt, Human
aagguuuuugauagcauug

SEQ ID NO: 2645218 - RNA, 14 nt, Human
aagguuuuugauag

SEQ ID NO: 2645219 - RNA, 14 nt, Human
aagggguuccucaa

SEQ ID NO: 2645220 - RNA, 18 nt, Human
aagggguuccucaaauuu

SEQ ID NO: 2645221 - RNA, 19 nt, Human
aagggguuccucaaauuuu

SEQ ID NO: 2645222 - RNA, 21 nt, Human
guuucugugguuggcugggaa

SEQ ID NO: 2645223 - RNA, 22 nt, Human
guuucugugguuggcugggaaa

SEQ ID NO: 2645224 - RNA, 14 nt, Human
guuuuauaaaauag

SEQ ID NO: 2645225 - RNA, 20 nt, Human
guuuuacaauaguucugugg

SEQ ID NO: 2645226 - RNA, 16 nt, Human
guuuuacaauaguucu

SEQ ID NO: 2645227 - RNA, 13 nt, Human
guuuuacaauagu

SEQ ID NO: 2645228 - RNA, 11 nt, Human
guuuuacaaua

SEQ ID NO: 2645229 - RNA, 14 nt, Human
guuagcuccugugg

SEQ ID NO: 2645230 - RNA, 15 nt, Human
guuagcuccuguggc

SEQ ID NO: 2645231 - RNA, 13 nt, Human
guuaguggcaccg

SEQ ID NO: 2645232 - RNA, 12 nt, Human
guuagcuccugu

SEQ ID NO: 2645233 - RNA, 19 nt, Human
guguuucgcggguaacugg

SEQ ID NO: 2645234 - RNA, 15 nt, Human
guuaaggugggcccg

SEQ ID NO: 2645235 - RNA, 15 nt, Human
aagccugcugucuug

SEQ ID NO: 2645236 - RNA, 14 nt, Human
guucauagcccagu

SEQ ID NO: 2645237 - RNA, 19 nt, Human
aagccuccuccagccgcca

SEQ ID NO: 2645238 - RNA, 13 nt, Human
guucauagcccag

SEQ ID NO: 2645239 - RNA, 19 nt, Human
aagccuccuuagaaaaaaa

SEQ ID NO: 2645240 - RNA, 20 nt, Human
aagcuuuauuuugagaugua

SEQ ID NO: 2645241 - RNA, 17 nt, Human
guucccauguagccccc

SEQ ID NO: 2645242 - RNA, 22 nt, Human
aagcuuuacuggggcuggggaa

SEQ ID NO: 2645243 - RNA, 19 nt, Human
guucccauguagcccccug

SEQ ID NO: 2645244 - RNA, 18 nt, Human
guucccauguagcccccu

SEQ ID NO: 2645245 - RNA, 14 nt, Human
guucccggcuggac

SEQ ID NO: 2645246 - RNA, 16 nt, Human
guucccgcggggcugu

SEQ ID NO: 2645247 - RNA, 20 nt, Human
aagcuucaugcacuuaaaga

SEQ ID NO: 2645248 - RNA, 21 nt, Human
aagcuucaugcacuuaaagaa

SEQ ID NO: 2645249 - RNA, 22 nt, Human
aagcuucaugcacuuaaagaag

SEQ ID NO: 2645250 - RNA, 15 nt, Human
aagcuucaguugcuu

SEQ ID NO: 2645251 - RNA, 16 nt, Human
aagcuucaguugcuug

SEQ ID NO: 2645252 - RNA, 18 nt, Human
aagcuucaguugcuuguc

SEQ ID NO: 2645253 - RNA, 11 nt, Human
aagcugagccu

SEQ ID NO: 2645254 - RNA, 13 nt, Human
aagcugagccugc

SEQ ID NO: 2645255 - RNA, 15 nt, Human
aagcugagccugcag

SEQ ID NO: 2645256 - RNA, 18 nt, Human
aagcuauucacauuguua

SEQ ID NO: 2645257 - RNA, 21 nt, Human
guugagcuucauauaccagca

SEQ ID NO: 2645258 - RNA, 15 nt, Human
guugagucuguacua

SEQ ID NO: 2645259 - RNA, 12 nt, Human
guugauaaaaac

SEQ ID NO: 2645260 - RNA, 23 nt, Human
guucuuuaaacugucgugucaua

SEQ ID NO: 2645261 - RNA, 14 nt, Human
guucuuuaaacugu

SEQ ID NO: 2645262 - RNA, 15 nt, Human
guucuuaugaggagg

SEQ ID NO: 2645263 - RNA, 20 nt, Human
guucuuaugaggaggggagg

SEQ ID NO: 2645264 - RNA, 20 nt, Human
guucucucaacaagaaauaa

SEQ ID NO: 2645265 - RNA, 14 nt, Human
guucuggggggacc

SEQ ID NO: 2645266 - RNA, 16 nt, Human
guucuggggggaccca

SEQ ID NO: 2645267 - RNA, 19 nt, Human
guucuggggggacccagug

SEQ ID NO: 2645268 - RNA, 20 nt, Human
guucuggggggacccagugc

SEQ ID NO: 2645269 - RNA, 21 nt, Human
guucuggggggacccagugca

SEQ ID NO: 2645270 - RNA, 14 nt, Human
guucuguauuugaa

SEQ ID NO: 2645271 - RNA, 12 nt, Human
guucuguauuug

SEQ ID NO: 2645272 - RNA, 13 nt, Human
guucuacucaggc

SEQ ID NO: 2645273 - RNA, 16 nt, Human
guucuacucaggcugg

SEQ ID NO: 2645274 - RNA, 21 nt, Human
guucuccguuagcuccugugg

SEQ ID NO: 2645275 - RNA, 22 nt, Human
guucuccguuagcuccuguggc

SEQ ID NO: 2645276 - RNA, 23 nt, Human
guucuccguuagcuccuguggcc

SEQ ID NO: 2645277 - RNA, 14 nt, Human
gugugucccaggca

SEQ ID NO: 2645278 - RNA, 18 nt, Human
gugugucccaggcaggga

SEQ ID NO: 2645279 - RNA, 14 nt, Human
guguugccaagcuc

SEQ ID NO: 2645280 - RNA, 18 nt, Human
guguugccaagcuccaag

SEQ ID NO: 2645281 - RNA, 19 nt, Human
guguugccacaguagaacu

SEQ ID NO: 2645282 - RNA, 15 nt, Human
guguugucucuugag

SEQ ID NO: 2645283 - RNA, 21 nt, Human
gugugagaagugaaugcuggg

SEQ ID NO: 2645284 - RNA, 22 nt, Human
gugugagaagugaaugcuggga

SEQ ID NO: 2645285 - RNA, 13 nt, Human
aagcaaugguuga

SEQ ID NO: 2645286 - RNA, 17 nt, Human
gugugacuacuccccca

SEQ ID NO: 2645287 - RNA, 12 nt, Human
gugucuuuggag

SEQ ID NO: 2645288 - RNA, 21 nt, Human
gugucuuugugauuuugagua

SEQ ID NO: 2645289 - RNA, 17 nt, Human
aagcaauauuuuggagu

SEQ ID NO: 2645290 - RNA, 16 nt, Human
aagcaauaaaugaaug

SEQ ID NO: 2645291 - RNA, 14 nt, Human
aagcaauaaaugaa

SEQ ID NO: 2645292 - RNA, 12 nt, Human
aagcaauagaaa

SEQ ID NO: 2645293 - RNA, 13 nt, Human
aagcaauagaaac

SEQ ID NO: 2645294 - RNA, 14 nt, Human
aagcaauagaaaca

SEQ ID NO: 2645295 - RNA, 15 nt, Human
aagcaauagaaacaa

SEQ ID NO: 2645296 - RNA, 17 nt, Human
aagcaauagaaacaaca

SEQ ID NO: 2645297 - RNA, 11 nt, Human
aagaugugaaa

SEQ ID NO: 2645298 - RNA, 13 nt, Human
aagaugugaaaau

SEQ ID NO: 2645299 - RNA, 14 nt, Human
aagaugugaaaauu

SEQ ID NO: 2645300 - RNA, 11 nt, Human
aagaugugaau

SEQ ID NO: 2645301 - RNA, 12 nt, Human
aagaugugaauu

SEQ ID NO: 2645302 - RNA, 13 nt, Human
aagaugugaauua

SEQ ID NO: 2645303 - RNA, 15 nt, Human
aagaugugaauuauu

SEQ ID NO: 2645304 - RNA, 16 nt, Human
aagaugugaauuauug

SEQ ID NO: 2645305 - RNA, 18 nt, Human
aagaugugaauuauugac

SEQ ID NO: 2645306 - RNA, 20 nt, Human
aagaugugaauuauugacac

SEQ ID NO: 2645307 - RNA, 21 nt, Human
aagaugugaauuauugacacu

SEQ ID NO: 2645308 - RNA, 23 nt, Human
aagaugugaauuauugacacuga

SEQ ID NO: 2645309 - RNA, 23 nt, Human
aagaugcuccagcaacacagccu

SEQ ID NO: 2645310 - RNA, 14 nt, Human
gugggggagggagg

SEQ ID NO: 2645311 - RNA, 20 nt, Human
gugguuuuauacugaaggaa

SEQ ID NO: 2645312 - RNA, 18 nt, Human
aagagguuuuaaaaaaau

SEQ ID NO: 2645313 - RNA, 16 nt, Human
aagagccuuaaaacau

SEQ ID NO: 2645314 - RNA, 14 nt, Human
aagagccuuaaaac

SEQ ID NO: 2645315 - RNA, 13 nt, Human
aagagccuuaaaa

SEQ ID NO: 2645316 - RNA, 14 nt, Human
aagaggaagcaaau

SEQ ID NO: 2645317 - RNA, 13 nt, Human
aagaggaagcaaa

SEQ ID NO: 2645318 - RNA, 14 nt, Human
aagagcaaaucaau

SEQ ID NO: 2645319 - RNA, 13 nt, Human
aagagcccuugcc

SEQ ID NO: 2645320 - RNA, 14 nt, Human
aagagcccuugccu

SEQ ID NO: 2645321 - RNA, 16 nt, Human
aagagcccuugccucc

SEQ ID NO: 2645322 - RNA, 18 nt, Human
aagagcccuugccucccc

SEQ ID NO: 2645323 - RNA, 22 nt, Human
aagacucuugggagggaguuac

SEQ ID NO: 2645324 - RNA, 16 nt, Human
aagacuguagauaugu

SEQ ID NO: 2645325 - RNA, 17 nt, Human
aagacuguagauaugua

SEQ ID NO: 2645326 - RNA, 17 nt, Human
aagaccucaccuagaaa

SEQ ID NO: 2645327 - RNA, 16 nt, Human
aagaccucaccuagaa

SEQ ID NO: 2645328 - RNA, 23 nt, Human
aagaccuggggcugcugugaagc

SEQ ID NO: 2645329 - RNA, 15 nt, Human
aagaccgccccccgc

SEQ ID NO: 2645330 - RNA, 18 nt, Human
guggcgugggagccagcc

SEQ ID NO: 2645331 - RNA, 22 nt, Human
guggcgccgucuccaggggcug

SEQ ID NO: 2645332 - RNA, 15 nt, Human
guggcggccccagca

SEQ ID NO: 2645333 - RNA, 17 nt, Human
guggcgccgucuccagg

SEQ ID NO: 2645334 - RNA, 21 nt, Human
guggcgccgucuccaggggcu

SEQ ID NO: 2645335 - RNA, 17 nt, Human
gugggagguggaagaag

SEQ ID NO: 2645336 - RNA, 20 nt, Human
gugggacgggaugguucugg

SEQ ID NO: 2645337 - RNA, 14 nt, Human
guggcgggcaccug

SEQ ID NO: 2645338 - RNA, 23 nt, Human
gugggaggaucucuugagccugg

SEQ ID NO: 2645339 - RNA, 19 nt, Human
gugggacggugcccaagcc

SEQ ID NO: 2645340 - RNA, 20 nt, Human
gugggacggugcccaagcca

SEQ ID NO: 2645341 - RNA, 20 nt, Human
gugggggaucacagccucug

SEQ ID NO: 2645342 - RNA, 14 nt, Human
gugggguuuccugg

SEQ ID NO: 2645343 - RNA, 16 nt, Human
gugggguuuccuggca

SEQ ID NO: 2645344 - RNA, 13 nt, Human
guggggugugcug

SEQ ID NO: 2645345 - RNA, 16 nt, Human
guggggugugcuggga

SEQ ID NO: 2645346 - RNA, 19 nt, Human
guggggugugcugggagcu

SEQ ID NO: 2645347 - RNA, 14 nt, Human
aagaaauaauagaa

SEQ ID NO: 2645348 - RNA, 19 nt, Human
aagaaauaaugcuacaauu

SEQ ID NO: 2645349 - RNA, 13 nt, Human
aagaauagaaaca

SEQ ID NO: 2645350 - RNA, 15 nt, Human
aagaauagaaacaag

SEQ ID NO: 2645351 - RNA, 18 nt, Human
aagaauauccuuuaaaau

SEQ ID NO: 2645352 - RNA, 19 nt, Human
aagaauauccuuuaaaauu

SEQ ID NO: 2645353 - RNA, 23 nt, Human
aagaagucuucucugccuguaag

SEQ ID NO: 2645354 - RNA, 14 nt, Human
aagaaggcaauauu

SEQ ID NO: 2645355 - RNA, 15 nt, Human
aagaaggcaauauua

SEQ ID NO: 2645356 - RNA, 14 nt, Human
aagaaggaugaugu

SEQ ID NO: 2645357 - RNA, 17 nt, Human
aagaaggaugaugucuu

SEQ ID NO: 2645358 - RNA, 16 nt, Human
aagaaaucauguccau

SEQ ID NO: 2645359 - RNA, 23 nt, Human
aagaaaucauguccauacacuuu

SEQ ID NO: 2645360 - RNA, 13 nt, Human
aagaaaaaaaugu

SEQ ID NO: 2645361 - RNA, 14 nt, Human
aagaaaaaaauacu

SEQ ID NO: 2645362 - RNA, 15 nt, Human
aagaaaaaaauacua

SEQ ID NO: 2645363 - RNA, 22 nt, Human
aagaaaaaaauacuauuuaaga

SEQ ID NO: 2645364 - RNA, 20 nt, Human
aagaaaaaaaugucaaaagu

SEQ ID NO: 2645365 - RNA, 21 nt, Human
aacuuggcucgaaucucugug

SEQ ID NO: 2645366 - RNA, 16 nt, Human
aacuccaggcccuccu

SEQ ID NO: 2645367 - RNA, 22 nt, Human
aacuuggcucgaaucucugugc

SEQ ID NO: 2645368 - RNA, 23 nt, Human
aacuuggcucgaaucucugugcc

SEQ ID NO: 2645369 - RNA, 22 nt, Human
gugccgagaaggaagccuccca

SEQ ID NO: 2645370 - RNA, 12 nt, Human
gugccguggcac

SEQ ID NO: 2645371 - RNA, 13 nt, Human
gugccguggcacc

SEQ ID NO: 2645372 - RNA, 14 nt, Human
gugccguggcacca

SEQ ID NO: 2645373 - RNA, 21 nt, Human
gugccgccugcacuccucagg

SEQ ID NO: 2645374 - RNA, 15 nt, Human
gugccucaagaggaa

SEQ ID NO: 2645375 - RNA, 22 nt, Human
gugccucaagaggaaugaaaaa

SEQ ID NO: 2645376 - RNA, 19 nt, Human
guggcaccagcagccugga

SEQ ID NO: 2645377 - RNA, 18 nt, Human
guggcaccagcagccugg

SEQ ID NO: 2645378 - RNA, 17 nt, Human
guggauugccucugaaa

SEQ ID NO: 2645379 - RNA, 19 nt, Human
guggcaccaggcgcugccc

SEQ ID NO: 2645380 - RNA, 16 nt, Human
aagaaugacuauauaa

SEQ ID NO: 2645381 - RNA, 18 nt, Human
aagaaugacuauauaauu

SEQ ID NO: 2645382 - RNA, 13 nt, Human
aagaaugaaagcu

SEQ ID NO: 2645383 - RNA, 17 nt, Human
aagaaugaaagcuguuc

SEQ ID NO: 2645384 - RNA, 19 nt, Human
aagaaugaaagcuguuccu

SEQ ID NO: 2645385 - RNA, 16 nt, Human
aagaauugaagcagga

SEQ ID NO: 2645386 - RNA, 16 nt, Human
aagaauuuaguauuau

SEQ ID NO: 2645387 - RNA, 16 nt, Human
aagaauguacguccag

SEQ ID NO: 2645388 - RNA, 14 nt, Human
aagaauuuaaagaa

SEQ ID NO: 2645389 - RNA, 13 nt, Human
aagaauuuaaaga

SEQ ID NO: 2645390 - RNA, 14 nt, Human
aagacaaaagucug

SEQ ID NO: 2645391 - RNA, 16 nt, Human
aagacaaaagucuguc

SEQ ID NO: 2645392 - RNA, 22 nt, Human
aagacaaaagucugucuuuccu

SEQ ID NO: 2645393 - RNA, 13 nt, Human
aagacaaauauuc

SEQ ID NO: 2645394 - RNA, 20 nt, Human
aagacaaauauuccuuugca

SEQ ID NO: 2645395 - RNA, 16 nt, Human
aagacccucuugccca

SEQ ID NO: 2645396 - RNA, 21 nt, Human
aagacccucuugcccauccug

SEQ ID NO: 2645397 - RNA, 22 nt, Human
aagacccucuugcccauccuga

SEQ ID NO: 2645398 - RNA, 15 nt, Human
guggauggccccagc

SEQ ID NO: 2645399 - RNA, 16 nt, Human
guggauggccccagca

SEQ ID NO: 2645400 - RNA, 19 nt, Human
guggauggccccagcacag

SEQ ID NO: 2645401 - RNA, 22 nt, Human
guggauggccccagcacagcuu

SEQ ID NO: 2645402 - RNA, 13 nt, Human
guggauggcccca

SEQ ID NO: 2645403 - RNA, 21 nt, Human
guggaccuuaggccuuccucu

SEQ ID NO: 2645404 - RNA, 18 nt, Human
guggaccuuaggccuucc

SEQ ID NO: 2645405 - RNA, 17 nt, Human
guggaccuuaggccuuc

SEQ ID NO: 2645406 - RNA, 18 nt, Human
guggaauauaaggaaagc

SEQ ID NO: 2645407 - RNA, 23 nt, Human
gugcugggaggagggagagggag

SEQ ID NO: 2645408 - RNA, 18 nt, Human
gugcugggaggagggaga

SEQ ID NO: 2645409 - RNA, 19 nt, Human
gugcugggaggagggagag

SEQ ID NO: 2645410 - RNA, 23 nt, Human
gugcugggagcuccacucugcuu

SEQ ID NO: 2645411 - RNA, 15 nt, Human
gugcugggaggaggg

SEQ ID NO: 2645412 - RNA, 17 nt, Human
gugcugggaggagggag

SEQ ID NO: 2645413 - RNA, 16 nt, Human
gugcugggagcuccac

SEQ ID NO: 2645414 - RNA, 22 nt, Human
gugcugggagcuccacucugcu

SEQ ID NO: 2645415 - RNA, 13 nt, Human
gugcuaugaauuu

SEQ ID NO: 2645416 - RNA, 24 nt, Human
gugcuauuacgaaguucaagauca

SEQ ID NO: 2645417 - RNA, 16 nt, Human
gugcucagaagggcua

SEQ ID NO: 2645418 - RNA, 16 nt, Human
aaugaaaaugaauauc

SEQ ID NO: 2645419 - RNA, 13 nt, Human
aaugaaaaugaau

SEQ ID NO: 2645420 - RNA, 13 nt, Human
aaugaaaacagug

SEQ ID NO: 2645421 - RNA, 18 nt, Human
aaugaaaacaguguguaa

SEQ ID NO: 2645422 - RNA, 22 nt, Human
aaugaaaacaguguguaaacaa

SEQ ID NO: 2645423 - RNA, 15 nt, Human
aaugagccuggcaag

SEQ ID NO: 2645424 - RNA, 14 nt, Human
uaaugacgaggaac

SEQ ID NO: 2645425 - RNA, 22 nt, Human
uaauggugaugcagucuuagau

SEQ ID NO: 2645426 - RNA, 22 nt, Human
aaucuuuguuucagguucagua

SEQ ID NO: 2645427 - RNA, 16 nt, Human
aaucuuguuucugaaa

SEQ ID NO: 2645428 - RNA, 17 nt, Human
aaucuuguuucugaaaa

SEQ ID NO: 2645429 - RNA, 19 nt, Human
aaucuuguuucugaaaaga

SEQ ID NO: 2645430 - RNA, 19 nt, Human
aaucuuguugguucaccau

SEQ ID NO: 2645431 - RNA, 18 nt, Human
aaucuuguugguucacca

SEQ ID NO: 2645432 - RNA, 21 nt, Human
uaauacugaaccacuuguaga

SEQ ID NO: 2645433 - RNA, 20 nt, Human
uaauacugaaccacuuguag

SEQ ID NO: 2645434 - RNA, 22 nt, Human
uaauacugaaccacuuguagau

SEQ ID NO: 2645435 - RNA, 19 nt, Human
uaauacugaaccacuugua

SEQ ID NO: 2645436 - RNA, 15 nt, Human
uaauacugaaccacu

SEQ ID NO: 2645437 - RNA, 14 nt, Human
uaauacugaaccac

SEQ ID NO: 2645438 - RNA, 13 nt, Human
uaauacugaacca

SEQ ID NO: 2645439 - RNA, 16 nt, Human
aaucuucaaagccuuc

SEQ ID NO: 2645440 - RNA, 17 nt, Human
aaucuucaaagccuucu

SEQ ID NO: 2645441 - RNA, 17 nt, Human
aaucuuauaauuguucu

SEQ ID NO: 2645442 - RNA, 14 nt, Human
aaucuuccuuuuau

SEQ ID NO: 2645443 - RNA, 17 nt, Human
aaucuucccaugcauuc

SEQ ID NO: 2645444 - RNA, 14 nt, Human
uaauagggaauaua

SEQ ID NO: 2645445 - RNA, 15 nt, Human
uaauagggaauauau

SEQ ID NO: 2645446 - RNA, 16 nt, Human
uaauagggaauauauc

SEQ ID NO: 2645447 - RNA, 18 nt, Human
uaauaggcucugccugac

SEQ ID NO: 2645448 - RNA, 20 nt, Human
uaaucaagagccuuaaaaca

SEQ ID NO: 2645449 - RNA, 19 nt, Human
uaaucaagagccuuaaaac

SEQ ID NO: 2645450 - RNA, 18 nt, Human
uaaucaagagccuuaaaa

SEQ ID NO: 2645451 - RNA, 14 nt, Human
uaaucaagagccuu

SEQ ID NO: 2645452 - RNA, 21 nt, Human
uaaucaaguaaggauguaugu

SEQ ID NO: 2645453 - RNA, 23 nt, Human
uaaucaagagccuuaaaacauca

SEQ ID NO: 2645454 - RNA, 22 nt, Human
uaaucacgaguaagauuaagag

SEQ ID NO: 2645455 - RNA, 15 nt, Human
uaaucaccauguaag

SEQ ID NO: 2645456 - RNA, 20 nt, Human
uaaucaccauguaagcacuc

SEQ ID NO: 2645457 - RNA, 16 nt, Human
uaaugaauuuuuauga

SEQ ID NO: 2645458 - RNA, 21 nt, Human
uaaugaauuuuuaugauauuc

SEQ ID NO: 2645459 - RNA, 14 nt, Human
uaaucaucuaaguc

SEQ ID NO: 2645460 - RNA, 23 nt, Human
uaaucaucuaagucaguacccac

SEQ ID NO: 2645461 - RNA, 17 nt, Human
uaaucauaguuacugug

SEQ ID NO: 2645462 - RNA, 23 nt, Human
uaaucauaguuacuguguaaacu

SEQ ID NO: 2645463 - RNA, 13 nt, Human
aaucagagacaaa

SEQ ID NO: 2645464 - RNA, 14 nt, Human
uaaguauguuauuu

SEQ ID NO: 2645465 - RNA, 12 nt, Human
uaaguuauugca

SEQ ID NO: 2645466 - RNA, 14 nt, Human
uaaguuauugcagu

SEQ ID NO: 2645467 - RNA, 15 nt, Human
uaaguuauugcaguu

SEQ ID NO: 2645468 - RNA, 16 nt, Human
uaaguuauugcaguuu

SEQ ID NO: 2645469 - RNA, 20 nt, Human
uaaguuauugcaguuuauca

SEQ ID NO: 2645470 - RNA, 14 nt, Human
aaucaucuaaguca

SEQ ID NO: 2645471 - RNA, 22 nt, Human
aaucauguugaucauguacuuu

SEQ ID NO: 2645472 - RNA, 23 nt, Human
aaucauguugaucauguacuuuu

SEQ ID NO: 2645473 - RNA, 19 nt, Human
aaucauucagaaauguuga

SEQ ID NO: 2645474 - RNA, 23 nt, Human
aaucauucagaaauguugagucu

SEQ ID NO: 2645475 - RNA, 17 nt, Human
aaucauguccauacacu

SEQ ID NO: 2645476 - RNA, 19 nt, Human
aaucauguccauacacuuu

SEQ ID NO: 2645477 - RNA, 22 nt, Human
aaucauguccauacacuuuguu

SEQ ID NO: 2645478 - RNA, 21 nt, Human
uaaguuuugacaagcuggcuu

SEQ ID NO: 2645479 - RNA, 24 nt, Human
aauccuaauuucuccucccuuccu

SEQ ID NO: 2645480 - RNA, 19 nt, Human
aauccuaauuucuccuccc

SEQ ID NO: 2645481 - RNA, 21 nt, Human
aauccuaauuucuccucccuu

SEQ ID NO: 2645482 - RNA, 16 nt, Human
aauccuaauuucuccu

SEQ ID NO: 2645483 - RNA, 17 nt, Human
aaucauucuuacuaaaa

SEQ ID NO: 2645484 - RNA, 18 nt, Human
aaucauucuuacuaaaaa

SEQ ID NO: 2645485 - RNA, 14 nt, Human
aaucuuauaauugu

SEQ ID NO: 2645486 - RNA, 15 nt, Human
aaucuuauaauuguu

SEQ ID NO: 2645487 - RNA, 21 nt, Human
aauccuuccauuccacacaga

SEQ ID NO: 2645488 - RNA, 13 nt, Human
aaucuacugcauu

SEQ ID NO: 2645489 - RNA, 14 nt, Human
aaucuacugcauuu

SEQ ID NO: 2645490 - RNA, 22 nt, Human
aaucuagauaucgacuuguuuu

SEQ ID NO: 2645491 - RNA, 15 nt, Human
aaucuacugcauuua

SEQ ID NO: 2645492 - RNA, 16 nt, Human
aaugcaguuucuucau

SEQ ID NO: 2645493 - RNA, 14 nt, Human
uacaaguaguucug

SEQ ID NO: 2645494 - RNA, 16 nt, Human
uacaaguaguucugua

SEQ ID NO: 2645495 - RNA, 15 nt, Human
uacaaguaguucugu

SEQ ID NO: 2645496 - RNA, 21 nt, Human
uacaaguaguucuguauuuga

SEQ ID NO: 2645497 - RNA, 19 nt, Human
uacaaguaguucuguauuu

SEQ ID NO: 2645498 - RNA, 18 nt, Human
uacaaguaguucuguauu

SEQ ID NO: 2645499 - RNA, 17 nt, Human
uacaaguaguucuguau

SEQ ID NO: 2645500 - RNA, 23 nt, Human
uacaaguaguucuguauuugaaa

SEQ ID NO: 2645501 - RNA, 22 nt, Human
uacaaguaguucuguauuugaa

SEQ ID NO: 2645502 - RNA, 14 nt, Human
uacaaaauuaagca

SEQ ID NO: 2645503 - RNA, 15 nt, Human
uacaaaauuaagcaa

SEQ ID NO: 2645504 - RNA, 23 nt, Human
uacaaaauuaagcaaauguuaaa

SEQ ID NO: 2645505 - RNA, 16 nt, Human
uacaagguauaauaaa

SEQ ID NO: 2645506 - RNA, 17 nt, Human
uacaagguauaauaaaa

SEQ ID NO: 2645507 - RNA, 18 nt, Human
uacaagguauaauaaaau

SEQ ID NO: 2645508 - RNA, 19 nt, Human
uacaagguauaauaaaauu

SEQ ID NO: 2645509 - RNA, 20 nt, Human
uacaagguauaauaaaauua

SEQ ID NO: 2645510 - RNA, 19 nt, Human
uacaagggaagauuuaugu

SEQ ID NO: 2645511 - RNA, 18 nt, Human
uacaagggcauaaaguaa

SEQ ID NO: 2645512 - RNA, 19 nt, Human
uacaagggcauaaaguaaa

SEQ ID NO: 2645513 - RNA, 15 nt, Human
aaugcuuuccaaaac

SEQ ID NO: 2645514 - RNA, 14 nt, Human
aaugcuuuauuugu

SEQ ID NO: 2645515 - RNA, 16 nt, Human
aaugcuuuauuuguaa

SEQ ID NO: 2645516 - RNA, 17 nt, Human
aaugcuuuauuuguaaa

SEQ ID NO: 2645517 - RNA, 18 nt, Human
aaugcuuuauuuguaaau

SEQ ID NO: 2645518 - RNA, 19 nt, Human
aaugcuuuauuuguaaauu

SEQ ID NO: 2645519 - RNA, 21 nt, Human
aaugcuuuauuuguaaauuua

SEQ ID NO: 2645520 - RNA, 22 nt, Human
aaugcuuuauuuguaaauuuag

SEQ ID NO: 2645521 - RNA, 22 nt, Human
aauggaauaaaaggcuugaagc

SEQ ID NO: 2645522 - RNA, 18 nt, Human
aauggaauaaaaggcuug

SEQ ID NO: 2645523 - RNA, 15 nt, Human
uacaaaaagcauaaa

SEQ ID NO: 2645524 - RNA, 20 nt, Human
uacaaaaagcauaaaaauua

SEQ ID NO: 2645525 - RNA, 22 nt, Human
uacaaaaauaaacuauaaaaca

SEQ ID NO: 2645526 - RNA, 20 nt, Human
uaauuucauguaaaacagaa

SEQ ID NO: 2645527 - RNA, 12 nt, Human
uaauuucagggu

SEQ ID NO: 2645528 - RNA, 19 nt, Human
uaauuuauuuccacuaaaa

SEQ ID NO: 2645529 - RNA, 20 nt, Human
uaauuuauuuaauauuuaau

SEQ ID NO: 2645530 - RNA, 14 nt, Human
uaauuuaaaaauau

SEQ ID NO: 2645531 - RNA, 22 nt, Human
uaauuuaaaaauauauuuauaa

SEQ ID NO: 2645532 - RNA, 12 nt, Human
uaauuguuuaaa

SEQ ID NO: 2645533 - RNA, 13 nt, Human
uaauuguuuaaaa

SEQ ID NO: 2645534 - RNA, 15 nt, Human
uaauuguuucagaau

SEQ ID NO: 2645535 - RNA, 22 nt, Human
aaugagcucgcauuugucaaug

SEQ ID NO: 2645536 - RNA, 14 nt, Human
aaugagcucugaaa

SEQ ID NO: 2645537 - RNA, 17 nt, Human
aaugaggaaaauucuua

SEQ ID NO: 2645538 - RNA, 19 nt, Human
aaugaggaaaauucuuaaa

SEQ ID NO: 2645539 - RNA, 14 nt, Human
uacacuaguuguuu

SEQ ID NO: 2645540 - RNA, 21 nt, Human
uacaggcuggcgcagaacgaa

SEQ ID NO: 2645541 - RNA, 12 nt, Human
uacaggcuggcg

SEQ ID NO: 2645542 - RNA, 17 nt, Human
uacaguagauuuuccaa

SEQ ID NO: 2645543 - RNA, 21 nt, Human
uacaguagauuuuccaaaugu

SEQ ID NO: 2645544 - RNA, 22 nt, Human
aauggacccuuuuuguuaugau

SEQ ID NO: 2645545 - RNA, 15 nt, Human
aauggagaagcugca

SEQ ID NO: 2645546 - RNA, 16 nt, Human
aauggagaagcugcag

SEQ ID NO: 2645547 - RNA, 17 nt, Human
aauggagaagcugcagg

SEQ ID NO: 2645548 - RNA, 19 nt, Human
aauggaggaucucuaaaga

SEQ ID NO: 2645549 - RNA, 20 nt, Human
aauggaggaucucuaaagag

SEQ ID NO: 2645550 - RNA, 15 nt, Human
aaugugacccuccaa

SEQ ID NO: 2645551 - RNA, 19 nt, Human
aaugugacccuccaaaugg

SEQ ID NO: 2645552 - RNA, 23 nt, Human
aaugugagugguugaauaugauu

SEQ ID NO: 2645553 - RNA, 22 nt, Human
aaugugagugguugaauaugau

SEQ ID NO: 2645554 - RNA, 15 nt, Human
aaugugagaagccag

SEQ ID NO: 2645555 - RNA, 21 nt, Human
aaugugagaagccagccagag

SEQ ID NO: 2645556 - RNA, 18 nt, Human
aauguacguccagccugc

SEQ ID NO: 2645557 - RNA, 20 nt, Human
uacauauaaaauguaauuac

SEQ ID NO: 2645558 - RNA, 15 nt, Human
uacaguauagauuuu

SEQ ID NO: 2645559 - RNA, 15 nt, Human
uacaguaucucaggg

SEQ ID NO: 2645560 - RNA, 13 nt, Human
uacauagugaaaa

SEQ ID NO: 2645561 - RNA, 16 nt, Human
uaaaucuauuuauuaa

SEQ ID NO: 2645562 - RNA, 20 nt, Human
uaaaucuauuuauuaauauu

SEQ ID NO: 2645563 - RNA, 19 nt, Human
uaaaucuauuuauuaauau

SEQ ID NO: 2645564 - RNA, 18 nt, Human
uaaaucuauuuauuaaua

SEQ ID NO: 2645565 - RNA, 15 nt, Human
uaaaucuuaauguuc

SEQ ID NO: 2645566 - RNA, 16 nt, Human
uaaaucuuaauguucc

SEQ ID NO: 2645567 - RNA, 17 nt, Human
uaaaucuuaauguuccu

SEQ ID NO: 2645568 - RNA, 19 nt, Human
uaaaucuuaauguuccuca

SEQ ID NO: 2645569 - RNA, 13 nt, Human
uaaauguuauuau

SEQ ID NO: 2645570 - RNA, 21 nt, Human
aauacaaaaaauuagccgggc

SEQ ID NO: 2645571 - RNA, 20 nt, Human
aauacaaaaauuagccgggc

SEQ ID NO: 2645572 - RNA, 18 nt, Human
aauacaacuuaaauaaua

SEQ ID NO: 2645573 - RNA, 12 nt, Human
aauacaagguau

SEQ ID NO: 2645574 - RNA, 13 nt, Human
aauacaagguaua

SEQ ID NO: 2645575 - RNA, 16 nt, Human
uaaauacauauggaug

SEQ ID NO: 2645576 - RNA, 15 nt, Human
uaaauacaugcauau

SEQ ID NO: 2645577 - RNA, 16 nt, Human
uaaauacaugcauaua

SEQ ID NO: 2645578 - RNA, 20 nt, Human
uaaauacaugcauauaauga

SEQ ID NO: 2645579 - RNA, 21 nt, Human
uaaauacaugcauauaaugaa

SEQ ID NO: 2645580 - RNA, 20 nt, Human
uaaauacaugccacaucaaa

SEQ ID NO: 2645581 - RNA, 13 nt, Human
uaaauaauucuuu

SEQ ID NO: 2645582 - RNA, 12 nt, Human
uaaauaauucuu

SEQ ID NO: 2645583 - RNA, 18 nt, Human
aauaauuuucauuuugca

SEQ ID NO: 2645584 - RNA, 12 nt, Human
aauaacugugua

SEQ ID NO: 2645585 - RNA, 15 nt, Human
aauaacuguguacug

SEQ ID NO: 2645586 - RNA, 16 nt, Human
aauaacuguguacugu

SEQ ID NO: 2645587 - RNA, 23 nt, Human
aauaauucuuuuuuauuaaucac

SEQ ID NO: 2645588 - RNA, 21 nt, Human
aauaauucuuuuuuauuaauc

SEQ ID NO: 2645589 - RNA, 20 nt, Human
aauaauucuuuuuuauuaau

SEQ ID NO: 2645590 - RNA, 15 nt, Human
aauaauucuuuuuua

SEQ ID NO: 2645591 - RNA, 14 nt, Human
aauaauucuuuuuu

SEQ ID NO: 2645592 - RNA, 12 nt, Human
aauaagaauuug

SEQ ID NO: 2645593 - RNA, 15 nt, Human
aauaagaauuugcau

SEQ ID NO: 2645594 - RNA, 16 nt, Human
aauaagaauuugcaua

SEQ ID NO: 2645595 - RNA, 18 nt, Human
aauaacccuuugguuuuu

SEQ ID NO: 2645596 - RNA, 18 nt, Human
aauaacccauaauugaag

SEQ ID NO: 2645597 - RNA, 20 nt, Human
aauaacuggaacaaauuauu

SEQ ID NO: 2645598 - RNA, 21 nt, Human
aauaacuggaacaaauuauuu

SEQ ID NO: 2645599 - RNA, 15 nt, Human
aauaaaacauagcaa

SEQ ID NO: 2645600 - RNA, 21 nt, Human
aauaaaucauucuuacuaaaa

SEQ ID NO: 2645601 - RNA, 15 nt, Human
aauaaaugcccucuu

SEQ ID NO: 2645602 - RNA, 16 nt, Human
aauaaaugcccucuuc

SEQ ID NO: 2645603 - RNA, 21 nt, Human
aauaaaaccgaaggugaaaaa

SEQ ID NO: 2645604 - RNA, 12 nt, Human
aaguuuuguugu

SEQ ID NO: 2645605 - RNA, 13 nt, Human
aaguuuuguugua

SEQ ID NO: 2645606 - RNA, 22 nt, Human
aaguuuuguuguacuuaaaugg

SEQ ID NO: 2645607 - RNA, 15 nt, Human
aaguuuuuguuugga

SEQ ID NO: 2645608 - RNA, 12 nt, Human
aaguuuuuuugc

SEQ ID NO: 2645609 - RNA, 13 nt, Human
aaguuuuuuugcu

SEQ ID NO: 2645610 - RNA, 23 nt, Human
aaguuuuuuugcugcugccucuu

SEQ ID NO: 2645611 - RNA, 19 nt, Human
aaguuuuguaaaagaaauc

SEQ ID NO: 2645612 - RNA, 13 nt, Human
uaaaguauucuuc

SEQ ID NO: 2645613 - RNA, 14 nt, Human
uaaaguauucuucu

SEQ ID NO: 2645614 - RNA, 18 nt, Human
uaaaguauucuucucuuc

SEQ ID NO: 2645615 - RNA, 19 nt, Human
uaaaguauguauuauuuac

SEQ ID NO: 2645616 - RNA, 21 nt, Human
uaaaguauguauuauuuacau

SEQ ID NO: 2645617 - RNA, 20 nt, Human
uaaagguggugaggcaauaa

SEQ ID NO: 2645618 - RNA, 13 nt, Human
uaaagguggauuu

SEQ ID NO: 2645619 - RNA, 21 nt, Human
uaaagguggugaggcaauaaa

SEQ ID NO: 2645620 - RNA, 17 nt, Human
uaaaguaguccugugaa

SEQ ID NO: 2645621 - RNA, 21 nt, Human
uaaaguaaaaagggaauuaug

SEQ ID NO: 2645622 - RNA, 13 nt, Human
uaaaguaaauaca

SEQ ID NO: 2645623 - RNA, 14 nt, Human
aauaucuauuaaua

SEQ ID NO: 2645624 - RNA, 22 nt, Human
aauaucuaauauauaugaauaa

SEQ ID NO: 2645625 - RNA, 21 nt, Human
aauaucuaauauauaugaaua

SEQ ID NO: 2645626 - RNA, 20 nt, Human
aauaucuaauauauaugaau

SEQ ID NO: 2645627 - RNA, 14 nt, Human
aauaucuaauauau

SEQ ID NO: 2645628 - RNA, 16 nt, Human
aauaucuauuaauaua

SEQ ID NO: 2645629 - RNA, 15 nt, Human
aauaucuauuaauau

SEQ ID NO: 2645630 - RNA, 15 nt, Human
aauaucuuggccuaa

SEQ ID NO: 2645631 - RNA, 19 nt, Human
aauaugacuuuuuauaaaa

SEQ ID NO: 2645632 - RNA, 20 nt, Human
aauaugacuuuuuauaaaau

SEQ ID NO: 2645633 - RNA, 22 nt, Human
aauauuguugacaacugugacu

SEQ ID NO: 2645634 - RNA, 16 nt, Human
aauauuguugacaacu

SEQ ID NO: 2645635 - RNA, 14 nt, Human
aauauuguuucugc

SEQ ID NO: 2645636 - RNA, 15 nt, Human
aauauuguuucugca

SEQ ID NO: 2645637 - RNA, 23 nt, Human
aauauuguuucugcauucauuuu

SEQ ID NO: 2645638 - RNA, 17 nt, Human
aauauuguuuuacaaua

SEQ ID NO: 2645639 - RNA, 16 nt, Human
aauauuguuugguaaa

SEQ ID NO: 2645640 - RNA, 20 nt, Human
aauauuguuugguaaauguu

SEQ ID NO: 2645641 - RNA, 21 nt, Human
aauauuguuugguaaauguuu

SEQ ID NO: 2645642 - RNA, 22 nt, Human
aauauuguuugguaaauguuuc

SEQ ID NO: 2645643 - RNA, 23 nt, Human
aauauuguuugguaaauguuucu

SEQ ID NO: 2645644 - RNA, 20 nt, Human
aauauuguugacaacuguga

SEQ ID NO: 2645645 - RNA, 18 nt, Human
aauauuguuuuacaauag

SEQ ID NO: 2645646 - RNA, 12 nt, Human
aauauuguuucu

SEQ ID NO: 2645647 - RNA, 20 nt, Human
aauauuucagguucuucaga

SEQ ID NO: 2645648 - RNA, 21 nt, Human
aaucacuguguauauuugauu

SEQ ID NO: 2645649 - RNA, 12 nt, Human
aauauuuuaugg

SEQ ID NO: 2645650 - RNA, 21 nt, Human
aauauuuuaugguuauguuuu

SEQ ID NO: 2645651 - RNA, 22 nt, Human
aaucacuguguauauuugauuu

SEQ ID NO: 2645652 - RNA, 23 nt, Human
aaucacuguguauauuugauuua

SEQ ID NO: 2645653 - RNA, 12 nt, Human
aauauuuucaac

SEQ ID NO: 2645654 - RNA, 18 nt, Human
aauaugauuaaaaauauc

SEQ ID NO: 2645655 - RNA, 17 nt, Human
aauaugcaacauugucc

SEQ ID NO: 2645656 - RNA, 16 nt, Human
aauauugauugggaaa

SEQ ID NO: 2645657 - RNA, 20 nt, Human
aauauugauugggaaaacau

SEQ ID NO: 2645658 - RNA, 21 nt, Human
aauauugauugggaaaacauu

SEQ ID NO: 2645659 - RNA, 22 nt, Human
aauauugauugggaaaacauuu

SEQ ID NO: 2645660 - RNA, 23 nt, Human
aauauugauugggaaaacauuug

SEQ ID NO: 2645661 - RNA, 13 nt, Human
aauauugcaaaau

SEQ ID NO: 2645662 - RNA, 14 nt, Human
aauauugcaaaaua

SEQ ID NO: 2645663 - RNA, 16 nt, Human
aauauugcaaaauaca

SEQ ID NO: 2645664 - RNA, 17 nt, Human
aauauugcaaaauacau

SEQ ID NO: 2645665 - RNA, 18 nt, Human
aauauugcaaaauacaug

SEQ ID NO: 2645666 - RNA, 19 nt, Human
aauauugcaaaauacauga

SEQ ID NO: 2645667 - RNA, 20 nt, Human
aauauugcaaaauacaugaa

SEQ ID NO: 2645668 - RNA, 23 nt, Human
aauauugcaaaauacaugaagcu

SEQ ID NO: 2645669 - RNA, 21 nt, Human
aauauauguauuauuuauaau

SEQ ID NO: 2645670 - RNA, 12 nt, Human
aauauauguauu

SEQ ID NO: 2645671 - RNA, 14 nt, Human
aauaguaugaaaau

SEQ ID NO: 2645672 - RNA, 17 nt, Human
aauaguaugaaaaugga

SEQ ID NO: 2645673 - RNA, 18 nt, Human
aauaguaugaaaauggaa

SEQ ID NO: 2645674 - RNA, 14 nt, Human
aauauauguauuau

SEQ ID NO: 2645675 - RNA, 18 nt, Human
aauauauguauuauuuau

SEQ ID NO: 2645676 - RNA, 21 nt, Human
aauaucaaauuaauuguguga

SEQ ID NO: 2645677 - RNA, 19 nt, Human
aauaucaaauuaauugugu

SEQ ID NO: 2645678 - RNA, 17 nt, Human
aauaucaaauuaauugu

SEQ ID NO: 2645679 - RNA, 17 nt, Human
uaaccucgcccucuccu

SEQ ID NO: 2645680 - RNA, 14 nt, Human
uaaccucgcccucu

SEQ ID NO: 2645681 - RNA, 16 nt, Human
uaaccucgcccucucc

SEQ ID NO: 2645682 - RNA, 15 nt, Human
uaaccucgcccucuc

SEQ ID NO: 2645683 - RNA, 12 nt, Human
uaacauaaauuu

SEQ ID NO: 2645684 - RNA, 22 nt, Human
uaacaugcuggugaauauuuuc

SEQ ID NO: 2645685 - RNA, 20 nt, Human
aauagccugccucuucucua

SEQ ID NO: 2645686 - RNA, 22 nt, Human
aauagauauaaauuuuuaagag

SEQ ID NO: 2645687 - RNA, 13 nt, Human
aauagacaucaaa

SEQ ID NO: 2645688 - RNA, 15 nt, Human
aauagacaucaaacu

SEQ ID NO: 2645689 - RNA, 15 nt, Human
aauagacacauacau

SEQ ID NO: 2645690 - RNA, 13 nt, Human
uaaauuuuuaaga

SEQ ID NO: 2645691 - RNA, 17 nt, Human
uaaauuuuguaugaaaa

SEQ ID NO: 2645692 - RNA, 15 nt, Human
uaaaugccauagaaa

SEQ ID NO: 2645693 - RNA, 20 nt, Human
aauaggaugggcuucugugc

SEQ ID NO: 2645694 - RNA, 14 nt, Human
aauaggaugggcuu

SEQ ID NO: 2645695 - RNA, 21 nt, Human
aauaggaguggugauuugaaa

SEQ ID NO: 2645696 - RNA, 19 nt, Human
aauaggaaucauucagaaa

SEQ ID NO: 2645697 - RNA, 20 nt, Human
aauaggaaucauucagaaau

SEQ ID NO: 2645698 - RNA, 22 nt, Human
aauaggaaucauucagaaaugu

SEQ ID NO: 2645699 - RNA, 23 nt, Human
aauaggaaucauucagaaauguu

SEQ ID NO: 2645700 - RNA, 13 nt, Human
aauaguaauguuu

SEQ ID NO: 2645701 - RNA, 13 nt, Human
aauaguagaugug

SEQ ID NO: 2645702 - RNA, 22 nt, Human
aauaguagauguggccuuugaa

SEQ ID NO: 2645703 - RNA, 15 nt, Human
aauaggauuuuuaga

SEQ ID NO: 2645704 - RNA, 16 nt, Human
aauaggauuuuuagaa

SEQ ID NO: 2645705 - RNA, 13 nt, Human
aauaggaaacaag

SEQ ID NO: 2645706 - RNA, 16 nt, Human
acaaugaacacuuaua

SEQ ID NO: 2645707 - RNA, 17 nt, Human
acaaugaaguugaaaau

SEQ ID NO: 2645708 - RNA, 20 nt, Human
acaaugaaguugaaaaucau

SEQ ID NO: 2645709 - RNA, 21 nt, Human
acaaugaaguugaaaaucaua

SEQ ID NO: 2645710 - RNA, 19 nt, Human
acaaucucuuuuuguuugc

SEQ ID NO: 2645711 - RNA, 20 nt, Human
uagcgaacccuuuauuugaa

SEQ ID NO: 2645712 - RNA, 14 nt, Human
acaauaaaauuuuu

SEQ ID NO: 2645713 - RNA, 22 nt, Human
acaauaggaguggugauuugaa

SEQ ID NO: 2645714 - RNA, 23 nt, Human
acaauaggaguggugauuugaaa

SEQ ID NO: 2645715 - RNA, 22 nt, Human
acaauaggaugggcuucugugc

SEQ ID NO: 2645716 - RNA, 17 nt, Human
acaauauuccagaucuu

SEQ ID NO: 2645717 - RNA, 16 nt, Human
acaaguuuauauauau

SEQ ID NO: 2645718 - RNA, 18 nt, Human
acaaguugcuuuuaccug

SEQ ID NO: 2645719 - RNA, 21 nt, Human
acaaguugagcuaugacuuaa

SEQ ID NO: 2645720 - RNA, 20 nt, Human
acaaguugagcuaugacuua

SEQ ID NO: 2645721 - RNA, 22 nt, Human
acaaguucgagucaaaguugaa

SEQ ID NO: 2645722 - RNA, 13 nt, Human
uagcaacuuuugu

SEQ ID NO: 2645723 - RNA, 17 nt, Human
uagcaacuuuuguguaa

SEQ ID NO: 2645724 - RNA, 16 nt, Human
uagcaacaacaauugg

SEQ ID NO: 2645725 - RNA, 18 nt, Human
uagcaacaacaauuggua

SEQ ID NO: 2645726 - RNA, 19 nt, Human
uagcaacaacaauugguaa

SEQ ID NO: 2645727 - RNA, 17 nt, Human
acaaaugacuuuauuau

SEQ ID NO: 2645728 - RNA, 16 nt, Human
acaaaugacuuuauua

SEQ ID NO: 2645729 - RNA, 17 nt, Human
acaaaugcucaaagaaa

SEQ ID NO: 2645730 - RNA, 21 nt, Human
acaaaugcucaaagaaaucua

SEQ ID NO: 2645731 - RNA, 20 nt, Human
acaaaugcaucuuugaugug

SEQ ID NO: 2645732 - RNA, 18 nt, Human
acaaaugcaucuuugaug

SEQ ID NO: 2645733 - RNA, 16 nt, Human
acaaaugcaucuuuga

SEQ ID NO: 2645734 - RNA, 15 nt, Human
acaaaugcaucuuug

SEQ ID NO: 2645735 - RNA, 23 nt, Human
acaaaugacuuuauuauuuauuu

SEQ ID NO: 2645736 - RNA, 21 nt, Human
acaaaugacuuuauuauuuau

SEQ ID NO: 2645737 - RNA, 18 nt, Human
acaaaugacuuuauuauu

SEQ ID NO: 2645738 - RNA, 15 nt, Human
acaagauuuuuuaau

SEQ ID NO: 2645739 - RNA, 20 nt, Human
acaagauuuuuuaauuguuu

SEQ ID NO: 2645740 - RNA, 21 nt, Human
acaagauuuuuuaauuguuua

SEQ ID NO: 2645741 - RNA, 22 nt, Human
acaagauuuuuuaauuguuuaa

SEQ ID NO: 2645742 - RNA, 19 nt, Human
acaagaccaccacuucgaa

SEQ ID NO: 2645743 - RNA, 13 nt, Human
aauuuuuugacuu

SEQ ID NO: 2645744 - RNA, 23 nt, Human
aauuuuuuuuaguauuuauuuau

SEQ ID NO: 2645745 - RNA, 15 nt, Human
aauuuuuuuuaguau

SEQ ID NO: 2645746 - RNA, 20 nt, Human
aauuuuuuuuaguauuuauu

SEQ ID NO: 2645747 - RNA, 19 nt, Human
aauuuuuuuguaugaaaac

SEQ ID NO: 2645748 - RNA, 18 nt, Human
aauuuuuuuguaugaaaa

SEQ ID NO: 2645749 - RNA, 17 nt, Human
aauuuuuuuguaugaaa

SEQ ID NO: 2645750 - RNA, 15 nt, Human
aauuuuuuuguauga

SEQ ID NO: 2645751 - RNA, 19 nt, Human
aauuuuuuuuaaaauagaa

SEQ ID NO: 2645752 - RNA, 20 nt, Human
aauuuuuuuuaaaauagaaa

SEQ ID NO: 2645753 - RNA, 14 nt, Human
aauuuuuaagagaa

SEQ ID NO: 2645754 - RNA, 11 nt, Human
aauuuuuaagc

SEQ ID NO: 2645755 - RNA, 14 nt, Human
aauuuuuaaugaug

SEQ ID NO: 2645756 - RNA, 17 nt, Human
aauuuuuaagcugcaaa

SEQ ID NO: 2645757 - RNA, 12 nt, Human
aauuuuuaaaaa

SEQ ID NO: 2645758 - RNA, 12 nt, Human
aauuuguugcau

SEQ ID NO: 2645759 - RNA, 14 nt, Human
uacuuuuaaaaaca

SEQ ID NO: 2645760 - RNA, 15 nt, Human
uacuuuuaaaaacau

SEQ ID NO: 2645761 - RNA, 18 nt, Human
uacuuuuaaaaacauaac

SEQ ID NO: 2645762 - RNA, 14 nt, Human
aauuugcauacuua

SEQ ID NO: 2645763 - RNA, 19 nt, Human
uacuuuguuaggauuuuca

SEQ ID NO: 2645764 - RNA, 16 nt, Human
aauuugcacuguuuaa

SEQ ID NO: 2645765 - RNA, 20 nt, Human
aauuugcacuaaaucagaga

SEQ ID NO: 2645766 - RNA, 13 nt, Human
uacuuuuuuaaau

SEQ ID NO: 2645767 - RNA, 18 nt, Human
uacuuuuuuaaauauuuu

SEQ ID NO: 2645768 - RNA, 20 nt, Human
uacuuuuuuaaauauuuucu

SEQ ID NO: 2645769 - RNA, 21 nt, Human
uacuuuuuuaaauauuuucua

SEQ ID NO: 2645770 - RNA, 22 nt, Human
uacuuuuuuaaauauuuucuau

SEQ ID NO: 2645771 - RNA, 23 nt, Human
uacuuuuuuaaauauuuucuauu

SEQ ID NO: 2645772 - RNA, 12 nt, Human
uagaucuccagc

SEQ ID NO: 2645773 - RNA, 13 nt, Human
uagaucuccagcg

SEQ ID NO: 2645774 - RNA, 15 nt, Human
uagauccauuuccau

SEQ ID NO: 2645775 - RNA, 18 nt, Human
uagauccauuuccauugc

SEQ ID NO: 2645776 - RNA, 21 nt, Human
uagauccauuuccauugcuua

SEQ ID NO: 2645777 - RNA, 23 nt, Human
uagauauaaauuuuuaagagaaa

SEQ ID NO: 2645778 - RNA, 19 nt, Human
acaaauauucacuggcccc

SEQ ID NO: 2645779 - RNA, 14 nt, Human
acaaaacuuuucua

SEQ ID NO: 2645780 - RNA, 13 nt, Human
acaaaagagcagu

SEQ ID NO: 2645781 - RNA, 18 nt, Human
acaaaguuaaaauuguua

SEQ ID NO: 2645782 - RNA, 14 nt, Human
acaaagugccaaag

SEQ ID NO: 2645783 - RNA, 15 nt, Human
acaaagugccaaaga

SEQ ID NO: 2645784 - RNA, 16 nt, Human
acaaagugccaaagaa

SEQ ID NO: 2645785 - RNA, 17 nt, Human
acaaagugccaaagaaa

SEQ ID NO: 2645786 - RNA, 18 nt, Human
acaaagugccaaagaaag

SEQ ID NO: 2645787 - RNA, 23 nt, Human
acaaagugccaaagaaagugguc

SEQ ID NO: 2645788 - RNA, 22 nt, Human
aauuucuuuuuuuccuuuuuaa

SEQ ID NO: 2645789 - RNA, 14 nt, Human
uacuuccaugaauu

SEQ ID NO: 2645790 - RNA, 16 nt, Human
uacuuuguauuuugau

SEQ ID NO: 2645791 - RNA, 21 nt, Human
uacuuuguauuuugauuauuu

SEQ ID NO: 2645792 - RNA, 22 nt, Human
uacuucuuuuuucaaaagaaag

SEQ ID NO: 2645793 - RNA, 20 nt, Human
uacuucuuuuuucaaaagaa

SEQ ID NO: 2645794 - RNA, 13 nt, Human
uacuucugaggua

SEQ ID NO: 2645795 - RNA, 13 nt, Human
aauuuaguguuuu

SEQ ID NO: 2645796 - RNA, 22 nt, Human
aauuuaguguuuuuuuauuucu

SEQ ID NO: 2645797 - RNA, 23 nt, Human
aauuuaguguuuuuuuauuucua

SEQ ID NO: 2645798 - RNA, 16 nt, Human
aauuuaccugauuucu

SEQ ID NO: 2645799 - RNA, 13 nt, Human
aauuuacuuguuu

SEQ ID NO: 2645800 - RNA, 15 nt, Human
aauuuacuuguuuug

SEQ ID NO: 2645801 - RNA, 16 nt, Human
aauuuacuuguuuugg

SEQ ID NO: 2645802 - RNA, 23 nt, Human
aauuggacagauugccuguuucu

SEQ ID NO: 2645803 - RNA, 23 nt, Human
aauugcuugguuguaauuaaauu

SEQ ID NO: 2645804 - RNA, 12 nt, Human
aauuuaaaugaa

SEQ ID NO: 2645805 - RNA, 16 nt, Human
aauuuaaaugaaagaa

SEQ ID NO: 2645806 - RNA, 18 nt, Human
aauuuaaaugaaagaaaa

SEQ ID NO: 2645807 - RNA, 19 nt, Human
aauuuaaaugaaagaaaau

SEQ ID NO: 2645808 - RNA, 22 nt, Human
aauuuaaaugaaagaaaauuga

SEQ ID NO: 2645809 - RNA, 14 nt, Human
aauuucuuauguga

SEQ ID NO: 2645810 - RNA, 15 nt, Human
aauuucuuaugugac

SEQ ID NO: 2645811 - RNA, 16 nt, Human
aauuucuuaugugaca

SEQ ID NO: 2645812 - RNA, 18 nt, Human
aauuucuuaugugacauu

SEQ ID NO: 2645813 - RNA, 20 nt, Human
aauuucuuaugugacauuaa

SEQ ID NO: 2645814 - RNA, 12 nt, Human
aauuuaguauua

SEQ ID NO: 2645815 - RNA, 16 nt, Human
aauugcauacuuugua

SEQ ID NO: 2645816 - RNA, 22 nt, Human
aauugcauacuuuguauuuuga

SEQ ID NO: 2645817 - RNA, 20 nt, Human
aauugcaaaaacauagaaau

SEQ ID NO: 2645818 - RNA, 14 nt, Human
uacugacauuucuu

SEQ ID NO: 2645819 - RNA, 16 nt, Human
uacugacauuucuucu

SEQ ID NO: 2645820 - RNA, 22 nt, Human
uacucucacacugguucucaau

SEQ ID NO: 2645821 - RNA, 15 nt, Human
uacuggggcugggga

SEQ ID NO: 2645822 - RNA, 21 nt, Human
uacuggggcuggggaaggaag

SEQ ID NO: 2645823 - RNA, 18 nt, Human
uacugggcccugagucug

SEQ ID NO: 2645824 - RNA, 23 nt, Human
uacugggcccugagucugggcag

SEQ ID NO: 2645825 - RNA, 19 nt, Human
uacuaaaaaguauaaaaua

SEQ ID NO: 2645826 - RNA, 21 nt, Human
uacuaaaaaguauaaaauagu

SEQ ID NO: 2645827 - RNA, 23 nt, Human
uacuaggaagaacguuuuuuccu

SEQ ID NO: 2645828 - RNA, 14 nt, Human
uacuagcaaaauaa

SEQ ID NO: 2645829 - RNA, 17 nt, Human
uacuagcaaaauaaaac

SEQ ID NO: 2645830 - RNA, 18 nt, Human
uacuagcaaaauaaaaca

SEQ ID NO: 2645831 - RNA, 19 nt, Human
uacuagcaaaauaaaacau

SEQ ID NO: 2645832 - RNA, 21 nt, Human
uacuagcaaaauaaaacauag

SEQ ID NO: 2645833 - RNA, 24 nt, Human
uacuagcaaaauaaaacauagcaa

SEQ ID NO: 2645834 - RNA, 11 nt, Human
uacuauuucca

SEQ ID NO: 2645835 - RNA, 12 nt, Human
uacuauuuaaga

SEQ ID NO: 2645836 - RNA, 15 nt, Human
uacuauuuaagaugu

SEQ ID NO: 2645837 - RNA, 17 nt, Human
uacuauuuaagauguga

SEQ ID NO: 2645838 - RNA, 18 nt, Human
uacuauuuaagaugugaa

SEQ ID NO: 2645839 - RNA, 19 nt, Human
uacuauuuaagaugugaaa

SEQ ID NO: 2645840 - RNA, 21 nt, Human
uacuauuuaagaugugaaaau

SEQ ID NO: 2645841 - RNA, 22 nt, Human
uacucuacccucuuagaaaaac

SEQ ID NO: 2645842 - RNA, 16 nt, Human
uacucuacccucuuag

SEQ ID NO: 2645843 - RNA, 16 nt, Human
aauguguggccugcac

SEQ ID NO: 2645844 - RNA, 22 nt, Human
aauugaaguguauaauauaaaa

SEQ ID NO: 2645845 - RNA, 23 nt, Human
aauguguggauugccucugaaaa

SEQ ID NO: 2645846 - RNA, 11 nt, Human
acacaccugua

SEQ ID NO: 2645847 - RNA, 20 nt, Human
acacaccuguagcacuuacu

SEQ ID NO: 2645848 - RNA, 16 nt, Human
acacacauauacacga

SEQ ID NO: 2645849 - RNA, 17 nt, Human
acaaugcugauuuggug

SEQ ID NO: 2645850 - RNA, 21 nt, Human
uagguuggcaaaaaggcagga

SEQ ID NO: 2645851 - RNA, 18 nt, Human
uaguaagaagacaaacug

SEQ ID NO: 2645852 - RNA, 11 nt, Human
uaguaagaaua

SEQ ID NO: 2645853 - RNA, 22 nt, Human
uaguaagaauaccacaucaaau

SEQ ID NO: 2645854 - RNA, 21 nt, Human
uaguaagauugauaucuauaa

SEQ ID NO: 2645855 - RNA, 22 nt, Human
uaguaagauugauaucuauaaa

SEQ ID NO: 2645856 - RNA, 11 nt, Human
uaguaagcaua

SEQ ID NO: 2645857 - RNA, 12 nt, Human
uaguaagcauag

SEQ ID NO: 2645858 - RNA, 15 nt, Human
uaguaagcauagaaa

SEQ ID NO: 2645859 - RNA, 16 nt, Human
uaguaagcauagaaac

SEQ ID NO: 2645860 - RNA, 15 nt, Human
uagucuuuugcuuuu

SEQ ID NO: 2645861 - RNA, 16 nt, Human
uagucuuuugcuuuug

SEQ ID NO: 2645862 - RNA, 21 nt, Human
uagucuuuugcuuuuggcaaa

SEQ ID NO: 2645863 - RNA, 18 nt, Human
uagucuuugccagucauu

SEQ ID NO: 2645864 - RNA, 14 nt, Human
uagucuuuugcuuu

SEQ ID NO: 2645865 - RNA, 13 nt, Human
uagucuaagacua

SEQ ID NO: 2645866 - RNA, 17 nt, Human
uagucuaagacuauaua

SEQ ID NO: 2645867 - RNA, 11 nt, Human
uaguccuguga

SEQ ID NO: 2645868 - RNA, 12 nt, Human
uaguccugugaa

SEQ ID NO: 2645869 - RNA, 22 nt, Human
uaguccugugaaugccacugcc

SEQ ID NO: 2645870 - RNA, 23 nt, Human
uauaaggaaagcaauaaaugaau

SEQ ID NO: 2645871 - RNA, 22 nt, Human
uauaaggaaagcaauaaaugaa

SEQ ID NO: 2645872 - RNA, 16 nt, Human
uauaaggaaagcaaua

SEQ ID NO: 2645873 - RNA, 18 nt, Human
acaccucugcacaagcug

SEQ ID NO: 2645874 - RNA, 17 nt, Human
uauaaaauccugugcaa

SEQ ID NO: 2645875 - RNA, 21 nt, Human
uauaaaauccugugcaauaga

SEQ ID NO: 2645876 - RNA, 14 nt, Human
acacauuacaaagu

SEQ ID NO: 2645877 - RNA, 18 nt, Human
acacauuacaaaguuaaa

SEQ ID NO: 2645878 - RNA, 22 nt, Human
acacauuacaaaguuaaaauug

SEQ ID NO: 2645879 - RNA, 23 nt, Human
acacauuacaaaguuaaaauugu

SEQ ID NO: 2645880 - RNA, 16 nt, Human
acacauuugcuacugu

SEQ ID NO: 2645881 - RNA, 17 nt, Human
acacauuugcuacuguu

SEQ ID NO: 2645882 - RNA, 19 nt, Human
acacauuugcuacuguugu

SEQ ID NO: 2645883 - RNA, 20 nt, Human
acacauuugcuacuguugua

SEQ ID NO: 2645884 - RNA, 14 nt, Human
acacccaaagcuga

SEQ ID NO: 2645885 - RNA, 19 nt, Human
acacccaaagcugagccug

SEQ ID NO: 2645886 - RNA, 19 nt, Human
uaguucaauauuuguuacu

SEQ ID NO: 2645887 - RNA, 13 nt, Human
uaguuuugucaaa

SEQ ID NO: 2645888 - RNA, 15 nt, Human
uaguuuugucaaacu

SEQ ID NO: 2645889 - RNA, 21 nt, Human
uaguuauguaaauaauucuuu

SEQ ID NO: 2645890 - RNA, 20 nt, Human
uaguuauguaaauaauucuu

SEQ ID NO: 2645891 - RNA, 19 nt, Human
uaguuauguaaauaauucu

SEQ ID NO: 2645892 - RNA, 15 nt, Human
uaguuauguaaauaa

SEQ ID NO: 2645893 - RNA, 13 nt, Human
uaguuauguaaau

SEQ ID NO: 2645894 - RNA, 14 nt, Human
uauaaaagaaacac

SEQ ID NO: 2645895 - RNA, 12 nt, Human
uauaaaauacau

SEQ ID NO: 2645896 - RNA, 15 nt, Human
uauaaaauacauagu

SEQ ID NO: 2645897 - RNA, 21 nt, Human
uauaaaauacauagugaaaau

SEQ ID NO: 2645898 - RNA, 18 nt, Human
uauaaaauauaaacaaag

SEQ ID NO: 2645899 - RNA, 19 nt, Human
uauaaaauauaaacaaaga

SEQ ID NO: 2645900 - RNA, 21 nt, Human
uauaaaacagaguaaucuugu

SEQ ID NO: 2645901 - RNA, 10 nt, Human
uauaaaacaa

SEQ ID NO: 2645902 - RNA, 14 nt, Human
acacuccagggaca

SEQ ID NO: 2645903 - RNA, 20 nt, Human
acacuccagggacacacagc

SEQ ID NO: 2645904 - RNA, 13 nt, Human
acacugaaaguuu

SEQ ID NO: 2645905 - RNA, 14 nt, Human
acacugaaaguuuu

SEQ ID NO: 2645906 - RNA, 17 nt, Human
acacugaaaguuuugua

SEQ ID NO: 2645907 - RNA, 18 nt, Human
acacugaaaguuuuguaa

SEQ ID NO: 2645908 - RNA, 20 nt, Human
acacugaaaguuuuguaaaa

SEQ ID NO: 2645909 - RNA, 23 nt, Human
acacugaaaguuuuguaaaagaa

SEQ ID NO: 2645910 - RNA, 12 nt, Human
acacugaacuua

SEQ ID NO: 2645911 - RNA, 12 nt, Human
uauauuauuaua

SEQ ID NO: 2645912 - RNA, 17 nt, Human
acacuguugauaaaaac

SEQ ID NO: 2645913 - RNA, 19 nt, Human
acacuguugauaaaaacuc

SEQ ID NO: 2645914 - RNA, 15 nt, Human
acagaaacacugccu

SEQ ID NO: 2645915 - RNA, 18 nt, Human
acagaaacacugccuuuu

SEQ ID NO: 2645916 - RNA, 12 nt, Human
acagaaacacug

SEQ ID NO: 2645917 - RNA, 13 nt, Human
acagaaacacugc

SEQ ID NO: 2645918 - RNA, 14 nt, Human
acagaaacacugcc

SEQ ID NO: 2645919 - RNA, 20 nt, Human
acagaaagagacuccgucuc

SEQ ID NO: 2645920 - RNA, 19 nt, Human
acagaaacacugccuuuuu

SEQ ID NO: 2645921 - RNA, 23 nt, Human
acacuuuguugcaagaugugaau

SEQ ID NO: 2645922 - RNA, 16 nt, Human
acagcaaaugcaaaaa

SEQ ID NO: 2645923 - RNA, 15 nt, Human
acagauucuuucagu

SEQ ID NO: 2645924 - RNA, 19 nt, Human
acagauucuuucaguucuu

SEQ ID NO: 2645925 - RNA, 20 nt, Human
acagauucuuucaguucuuu

SEQ ID NO: 2645926 - RNA, 21 nt, Human
acagauucuuucaguucuuug

SEQ ID NO: 2645927 - RNA, 17 nt, Human
acagaugugcugacaag

SEQ ID NO: 2645928 - RNA, 19 nt, Human
acagauggaaaaacugagg

SEQ ID NO: 2645929 - RNA, 21 nt, Human
acagauggaaaaacugaggcu

SEQ ID NO: 2645930 - RNA, 13 nt, Human
acagauaccucca

SEQ ID NO: 2645931 - RNA, 16 nt, Human
acagauaccuccaacc

SEQ ID NO: 2645932 - RNA, 19 nt, Human
acagauaccuccaacccug

SEQ ID NO: 2645933 - RNA, 21 nt, Human
acagauaccuccaacccugcc

SEQ ID NO: 2645934 - RNA, 22 nt, Human
acagauaccuccaacccugccg

SEQ ID NO: 2645935 - RNA, 22 nt, Human
acagcaacgaucacaaaugacu

SEQ ID NO: 2645936 - RNA, 21 nt, Human
acagcaacgaucacaaaugac

SEQ ID NO: 2645937 - RNA, 20 nt, Human
acagcaacgaucacaaauga

SEQ ID NO: 2645938 - RNA, 11 nt, Human
uaucuuggccu

SEQ ID NO: 2645939 - RNA, 15 nt, Human
uaucuuugaauaugu

SEQ ID NO: 2645940 - RNA, 19 nt, Human
uaugaaagcaacaaagaaa

SEQ ID NO: 2645941 - RNA, 15 nt, Human
uauauuuauaaggaa

SEQ ID NO: 2645942 - RNA, 15 nt, Human
uaucucagggccugg

SEQ ID NO: 2645943 - RNA, 13 nt, Human
uaucucagggccu

SEQ ID NO: 2645944 - RNA, 16 nt, Human
uaucucaaugaaccau

SEQ ID NO: 2645945 - RNA, 22 nt, Human
uaucucaaugaaccauaaauuc

SEQ ID NO: 2645946 - RNA, 21 nt, Human
acagagcaagugagacccugu

SEQ ID NO: 2645947 - RNA, 16 nt, Human
uaucucuauuugagaa

SEQ ID NO: 2645948 - RNA, 17 nt, Human
uaucucuauuugagaau

SEQ ID NO: 2645949 - RNA, 19 nt, Human
ucaaauaaguauuuauaau

SEQ ID NO: 2645950 - RNA, 18 nt, Human
ucaaauaaguauuuauaa

SEQ ID NO: 2645951 - RNA, 20 nt, Human
ucaaauaaguauuuauaaua

SEQ ID NO: 2645952 - RNA, 17 nt, Human
ucaaauaaguauuuaua

SEQ ID NO: 2645953 - RNA, 12 nt, Human
ucaaauaagaaa

SEQ ID NO: 2645954 - RNA, 13 nt, Human
ucaaauaagaaau

SEQ ID NO: 2645955 - RNA, 23 nt, Human
ucaaauaaagagagaacaggacu

SEQ ID NO: 2645956 - RNA, 14 nt, Human
ucaaauacacauuu

SEQ ID NO: 2645957 - RNA, 16 nt, Human
ucaaauacacauuugc

SEQ ID NO: 2645958 - RNA, 17 nt, Human
ucaaauacacauuugcu

SEQ ID NO: 2645959 - RNA, 17 nt, Human
ucaaagggauaaagaaa

SEQ ID NO: 2645960 - RNA, 13 nt, Human
ucaaaguuuuguu

SEQ ID NO: 2645961 - RNA, 18 nt, Human
acaugaagaauagaaaca

SEQ ID NO: 2645962 - RNA, 15 nt, Human
acaugaagcuucaug

SEQ ID NO: 2645963 - RNA, 16 nt, Human
acaugaagcuucaugc

SEQ ID NO: 2645964 - RNA, 20 nt, Human
acaugaagcuucaugcacuu

SEQ ID NO: 2645965 - RNA, 17 nt, Human
ucaaaauaaagaaguau

SEQ ID NO: 2645966 - RNA, 18 nt, Human
ucaaagggcccacaguga

SEQ ID NO: 2645967 - RNA, 19 nt, Human
ucaaagcacuguugagaag

SEQ ID NO: 2645968 - RNA, 11 nt, Human
ucaaagccuuc

SEQ ID NO: 2645969 - RNA, 20 nt, Human
ucaaaggagcgagcaugucg

SEQ ID NO: 2645970 - RNA, 21 nt, Human
ucaaagcuuggauuaaauaca

SEQ ID NO: 2645971 - RNA, 22 nt, Human
ucaaagcuuggauuaaauacau

SEQ ID NO: 2645972 - RNA, 19 nt, Human
uauuuuuagacucaucaau

SEQ ID NO: 2645973 - RNA, 20 nt, Human
uauuuuuauaauuguacaaa

SEQ ID NO: 2645974 - RNA, 17 nt, Human
uauuuuuauacaaaccu

SEQ ID NO: 2645975 - RNA, 14 nt, Human
uauuuuuagaauaa

SEQ ID NO: 2645976 - RNA, 20 nt, Human
uauuuuuagaauaagaauuu

SEQ ID NO: 2645977 - RNA, 20 nt, Human
uauuuguaaauuuaguguuu

SEQ ID NO: 2645978 - RNA, 21 nt, Human
uauuuguaaauuuaguguuuu

SEQ ID NO: 2645979 - RNA, 19 nt, Human
uauuuuuauaucaugcaaa

SEQ ID NO: 2645980 - RNA, 20 nt, Human
uauuuuuauaucaugcaaaa

SEQ ID NO: 2645981 - RNA, 16 nt, Human
uauuuuuauauuuccu

SEQ ID NO: 2645982 - RNA, 17 nt, Human
uauuuuuauauuuccuu

SEQ ID NO: 2645983 - RNA, 21 nt, Human
uauuuuuauauuuccuuuaug

SEQ ID NO: 2645984 - RNA, 12 nt, Human
uauuuuucuuga

SEQ ID NO: 2645985 - RNA, 23 nt, Human
ucaaaauccaaaaagaaaugaug

SEQ ID NO: 2645986 - RNA, 16 nt, Human
ucaaaauccaaaaaga

SEQ ID NO: 2645987 - RNA, 16 nt, Human
ucaacagcaaguguga

SEQ ID NO: 2645988 - RNA, 15 nt, Human
ucaacagcaagugug

SEQ ID NO: 2645989 - RNA, 22 nt, Human
ucaacagcaagugugaauacug

SEQ ID NO: 2645990 - RNA, 17 nt, Human
ucaacaauaaaauuuuu

SEQ ID NO: 2645991 - RNA, 18 nt, Human
ucaacaauaaaauuuuuu

SEQ ID NO: 2645992 - RNA, 21 nt, Human
acaugcuggugaauauuuuca

SEQ ID NO: 2645993 - RNA, 14 nt, Human
acauuaacaaauaa

SEQ ID NO: 2645994 - RNA, 15 nt, Human
acauuaacaaauaaa

SEQ ID NO: 2645995 - RNA, 17 nt, Human
acauguccagcaccuug

SEQ ID NO: 2645996 - RNA, 20 nt, Human
acauguccagcaccuugugc

SEQ ID NO: 2645997 - RNA, 23 nt, Human
acauguccagcaccuugugccug

SEQ ID NO: 2645998 - RNA, 14 nt, Human
acauuagagaacau

SEQ ID NO: 2645999 - RNA, 11 nt, Human
ucaagagccuu

SEQ ID NO: 2646000 - RNA, 24 nt, Human
ucaagaucaaaaaggcuuauaaaa

SEQ ID NO: 2646001 - RNA, 23 nt, Human
ucaagaucaaaaaggcuuauaaa

SEQ ID NO: 2646002 - RNA, 15 nt, Human
ucaagagccuuaaaa

SEQ ID NO: 2646003 - RNA, 17 nt, Human
ucaagagccuuaaaaca

SEQ ID NO: 2646004 - RNA, 16 nt, Human
ucaagagccuuaaaac

SEQ ID NO: 2646005 - RNA, 21 nt, Human
ucaagagccuuaaaacaucau

SEQ ID NO: 2646006 - RNA, 20 nt, Human
ucaagagccuuaaaacauca

SEQ ID NO: 2646007 - RNA, 19 nt, Human
ucaagagccuuaaaacauc

SEQ ID NO: 2646008 - RNA, 18 nt, Human
ucaagagccuuaaaacau

SEQ ID NO: 2646009 - RNA, 19 nt, Human
ucaagaucaaaaaggcuua

SEQ ID NO: 2646010 - RNA, 17 nt, Human
ucaagaucaaaaaggcu

SEQ ID NO: 2646011 - RNA, 15 nt, Human
ucaagggcugucauu

SEQ ID NO: 2646012 - RNA, 15 nt, Human
ucaaggucacuguuu

SEQ ID NO: 2646013 - RNA, 18 nt, Human
ucaaggucacuguuuccu

SEQ ID NO: 2646014 - RNA, 19 nt, Human
ucaaggucacuguuuccug

SEQ ID NO: 2646015 - RNA, 14 nt, Human
acaguuuucagaaa

SEQ ID NO: 2646016 - RNA, 21 nt, Human
acaguuuucagaaaaagaaau

SEQ ID NO: 2646017 - RNA, 14 nt, Human
acaguuuuuccugg

SEQ ID NO: 2646018 - RNA, 15 nt, Human
acauacgauuuaagg

SEQ ID NO: 2646019 - RNA, 18 nt, Human
acauacgauuuaagguau

SEQ ID NO: 2646020 - RNA, 19 nt, Human
acauacgauuuaagguauu

SEQ ID NO: 2646021 - RNA, 24 nt, Human
acauacuccuuccaucaaauagaa

SEQ ID NO: 2646022 - RNA, 14 nt, Human
acauacuguucacu

SEQ ID NO: 2646023 - RNA, 21 nt, Human
uaugaagcuaccucaaacuuc

SEQ ID NO: 2646024 - RNA, 14 nt, Human
uauuuccacuaaaa

SEQ ID NO: 2646025 - RNA, 15 nt, Human
uauuuccacuaaaaa

SEQ ID NO: 2646026 - RNA, 17 nt, Human
uauuuccacuaaaaaua

SEQ ID NO: 2646027 - RNA, 19 nt, Human
uauuuccacuaaaaauauu

SEQ ID NO: 2646028 - RNA, 21 nt, Human
uauuucccauuugugccagag

SEQ ID NO: 2646029 - RNA, 18 nt, Human
uauuucccucucauuuug

SEQ ID NO: 2646030 - RNA, 11 nt, Human
uauuuccuuua

SEQ ID NO: 2646031 - RNA, 14 nt, Human
uauuuccuuuaugu

SEQ ID NO: 2646032 - RNA, 16 nt, Human
uauuuccuuuauguga

SEQ ID NO: 2646033 - RNA, 17 nt, Human
uauuuccuuuaugugaa

SEQ ID NO: 2646034 - RNA, 18 nt, Human
uauuuccuuuaugugaau

SEQ ID NO: 2646035 - RNA, 11 nt, Human
uauuucuacug

SEQ ID NO: 2646036 - RNA, 12 nt, Human
uauuucuacugu

SEQ ID NO: 2646037 - RNA, 16 nt, Human
uauuucuacugucaaa

SEQ ID NO: 2646038 - RNA, 18 nt, Human
uauuucuacugucaaaug

SEQ ID NO: 2646039 - RNA, 19 nt, Human
acaguuucuuuuuucuuac

SEQ ID NO: 2646040 - RNA, 12 nt, Human
acaguuguauuu

SEQ ID NO: 2646041 - RNA, 13 nt, Human
acaguuguauuua

SEQ ID NO: 2646042 - RNA, 18 nt, Human
acaguuguauuuaacaga

SEQ ID NO: 2646043 - RNA, 22 nt, Human
acaguuguauuuaacagaaauu

SEQ ID NO: 2646044 - RNA, 16 nt, Human
acaguugaaaaacagc

SEQ ID NO: 2646045 - RNA, 15 nt, Human
acaguugaaaaacag

SEQ ID NO: 2646046 - RNA, 19 nt, Human
acaguugcucuaugcuuuc

SEQ ID NO: 2646047 - RNA, 16 nt, Human
acaguugcucuaugcu

SEQ ID NO: 2646048 - RNA, 18 nt, Human
acaguugcagcccuugug

SEQ ID NO: 2646049 - RNA, 20 nt, Human
acaguugaaaaacagcugag

SEQ ID NO: 2646050 - RNA, 13 nt, Human
acaucaaaccuuu

SEQ ID NO: 2646051 - RNA, 17 nt, Human
acaucaaaccuuugagu

SEQ ID NO: 2646052 - RNA, 19 nt, Human
acaucaaacucaaugcuuu

SEQ ID NO: 2646053 - RNA, 20 nt, Human
acaucaaacucaaugcuuua

SEQ ID NO: 2646054 - RNA, 13 nt, Human
acaucaaauaaga

SEQ ID NO: 2646055 - RNA, 14 nt, Human
acaucaaauaagaa

SEQ ID NO: 2646056 - RNA, 18 nt, Human
acaucaaauaagaaauaa

SEQ ID NO: 2646057 - RNA, 14 nt, Human
acaucacagggugg

SEQ ID NO: 2646058 - RNA, 15 nt, Human
acaucacaggguggg

SEQ ID NO: 2646059 - RNA, 18 nt, Human
acaucacagggugggccu

SEQ ID NO: 2646060 - RNA, 19 nt, Human
acaucacagggugggccuc

SEQ ID NO: 2646061 - RNA, 20 nt, Human
acaucucaauaaagugcuuu

SEQ ID NO: 2646062 - RNA, 18 nt, Human
acaucuaauaaguauaua

SEQ ID NO: 2646063 - RNA, 11 nt, Human
acaucugccuu

SEQ ID NO: 2646064 - RNA, 12 nt, Human
acaucugccuua

SEQ ID NO: 2646065 - RNA, 23 nt, Human
acaucugagguuuuauuucauuu

SEQ ID NO: 2646066 - RNA, 18 nt, Human
acaucugaccuggcaucu

SEQ ID NO: 2646067 - RNA, 21 nt, Human
acaucugagguuuuauuucau

SEQ ID NO: 2646068 - RNA, 14 nt, Human
acaucuugaauccu

SEQ ID NO: 2646069 - RNA, 19 nt, Human
acaucuugaauccuuccau

SEQ ID NO: 2646070 - RNA, 23 nt, Human
acaucugccuuaaaaccaaagag

SEQ ID NO: 2646071 - RNA, 17 nt, Human
uauuugguacuguauuu

SEQ ID NO: 2646072 - RNA, 13 nt, Human
uauuuguaaagcu

SEQ ID NO: 2646073 - RNA, 14 nt, Human
uauuuguaaagcua

SEQ ID NO: 2646074 - RNA, 20 nt, Human
acauauacacgaauagacau

SEQ ID NO: 2646075 - RNA, 15 nt, Human
acauacaugucacau

SEQ ID NO: 2646076 - RNA, 13 nt, Human
acauagugaaaau

SEQ ID NO: 2646077 - RNA, 14 nt, Human
acauagugaaaauu

SEQ ID NO: 2646078 - RNA, 18 nt, Human
acauagugaaaauuguuu

SEQ ID NO: 2646079 - RNA, 23 nt, Human
acauagugaaaauuguuuaguga

SEQ ID NO: 2646080 - RNA, 12 nt, Human
acauagaaaugg

SEQ ID NO: 2646081 - RNA, 20 nt, Human
acauagaaauggaaauuuug

SEQ ID NO: 2646082 - RNA, 22 nt, Human
acauagaaauggaaauuuugcu

SEQ ID NO: 2646083 - RNA, 19 nt, Human
acauagccaaaaugugagu

SEQ ID NO: 2646084 - RNA, 16 nt, Human
acauagccaaaaugug

SEQ ID NO: 2646085 - RNA, 15 nt, Human
acauaugaaaauaca

SEQ ID NO: 2646086 - RNA, 13 nt, Human
acauauggaauuu

SEQ ID NO: 2646087 - RNA, 17 nt, Human
acauauggaauuuugca

SEQ ID NO: 2646088 - RNA, 14 nt, Human
acauauaguguaca

SEQ ID NO: 2646089 - RNA, 23 nt, Human
acauaucuacacuucgcaccgga

SEQ ID NO: 2646090 - RNA, 14 nt, Human
acauauauauuaca

SEQ ID NO: 2646091 - RNA, 15 nt, Human
acauauauauauaua

SEQ ID NO: 2646092 - RNA, 16 nt, Human
acauauauauauauaa

SEQ ID NO: 2646093 - RNA, 17 nt, Human
acauauauauauauaac

SEQ ID NO: 2646094 - RNA, 16 nt, Human
acauaucaucugugga

SEQ ID NO: 2646095 - RNA, 15 nt, Human
acauaucccuuccag

SEQ ID NO: 2646096 - RNA, 16 nt, Human
acauaucccuuccaga

SEQ ID NO: 2646097 - RNA, 13 nt, Human
acauauggauguu

SEQ ID NO: 2646098 - RNA, 14 nt, Human
acauauggauguua

SEQ ID NO: 2646099 - RNA, 15 nt, Human
acauauggauguuac

SEQ ID NO: 2646100 - RNA, 16 nt, Human
acauauggauguuacu

SEQ ID NO: 2646101 - RNA, 18 nt, Human
acauauggauguuacucu

SEQ ID NO: 2646102 - RNA, 20 nt, Human
acauauggaauuuugcaaag

SEQ ID NO: 2646103 - RNA, 17 nt, Human
accaggcugccucccuu

SEQ ID NO: 2646104 - RNA, 19 nt, Human
ucacuaggcccccacuugc

SEQ ID NO: 2646105 - RNA, 21 nt, Human
ucacuaggcccccacuugccu

SEQ ID NO: 2646106 - RNA, 22 nt, Human
ucacuaggcccccacuugccuc

SEQ ID NO: 2646107 - RNA, 13 nt, Human
accacuucgaaac

SEQ ID NO: 2646108 - RNA, 21 nt, Human
accacugcacuccagccuggg

SEQ ID NO: 2646109 - RNA, 20 nt, Human
accacugcacuccagccugg

SEQ ID NO: 2646110 - RNA, 17 nt, Human
accacugcacuccagcc

SEQ ID NO: 2646111 - RNA, 16 nt, Human
accacuuguagauuug

SEQ ID NO: 2646112 - RNA, 14 nt, Human
accacuuguagauu

SEQ ID NO: 2646113 - RNA, 13 nt, Human
accacuuguagau

SEQ ID NO: 2646114 - RNA, 16 nt, Human
accacuugaggccuga

SEQ ID NO: 2646115 - RNA, 20 nt, Human
accacuugaggccugaucug

SEQ ID NO: 2646116 - RNA, 19 nt, Human
accacuuguagauuugauu

SEQ ID NO: 2646117 - RNA, 22 nt, Human
accagaccuggaagaacaggcc

SEQ ID NO: 2646118 - RNA, 23 nt, Human
accagaccuggaagaacaggccu

SEQ ID NO: 2646119 - RNA, 11 nt, Human
accagacaggu

SEQ ID NO: 2646120 - RNA, 15 nt, Human
accaauguucucucu

SEQ ID NO: 2646121 - RNA, 23 nt, Human
ucaagugaaaaaggaggaagaga

SEQ ID NO: 2646122 - RNA, 15 nt, Human
ucaagugaaaaagga

SEQ ID NO: 2646123 - RNA, 19 nt, Human
ucacccaggcuggacugca

SEQ ID NO: 2646124 - RNA, 19 nt, Human
ucacccaugcaagcagagg

SEQ ID NO: 2646125 - RNA, 20 nt, Human
ucacccaugcaagcagagga

SEQ ID NO: 2646126 - RNA, 21 nt, Human
ucacccaugcaagcagaggac

SEQ ID NO: 2646127 - RNA, 15 nt, Human
ucaccaucaauccug

SEQ ID NO: 2646128 - RNA, 19 nt, Human
ucaccaucaauccugauuc

SEQ ID NO: 2646129 - RNA, 20 nt, Human
ucaccaucaauccugauucc

SEQ ID NO: 2646130 - RNA, 20 nt, Human
ucacaaaugacuuuauuauu

SEQ ID NO: 2646131 - RNA, 19 nt, Human
ucacaaaugacuuuauuau

SEQ ID NO: 2646132 - RNA, 18 nt, Human
ucacaaaugacuuuauua

SEQ ID NO: 2646133 - RNA, 11 nt, Human
ucacaaaugac

SEQ ID NO: 2646134 - RNA, 15 nt, Human
ucacaaaugacuuua

SEQ ID NO: 2646135 - RNA, 14 nt, Human
ucacaaaugacuuu

SEQ ID NO: 2646136 - RNA, 13 nt, Human
ucacaaaugacuu

SEQ ID NO: 2646137 - RNA, 12 nt, Human
ucacaaaugacu

SEQ ID NO: 2646138 - RNA, 18 nt, Human
accauguaagcacucugg

SEQ ID NO: 2646139 - RNA, 21 nt, Human
accauguaagcacucuggaug

SEQ ID NO: 2646140 - RNA, 24 nt, Human
accauucugacucgguuucuccaa

SEQ ID NO: 2646141 - RNA, 22 nt, Human
accauugagaccgugaagauac

SEQ ID NO: 2646142 - RNA, 23 nt, Human
accauugagaccgugaagauacu

SEQ ID NO: 2646143 - RNA, 16 nt, Human
accauggugaagugcu

SEQ ID NO: 2646144 - RNA, 13 nt, Human
ucagaagggcuau

SEQ ID NO: 2646145 - RNA, 15 nt, Human
ucagaaggagcuaca

SEQ ID NO: 2646146 - RNA, 17 nt, Human
ucagaaguuaguuugua

SEQ ID NO: 2646147 - RNA, 14 nt, Human
ucagaagcaaacaa

SEQ ID NO: 2646148 - RNA, 18 nt, Human
ucagaagcacagaauauu

SEQ ID NO: 2646149 - RNA, 20 nt, Human
ucagaagcacagaauauuuu

SEQ ID NO: 2646150 - RNA, 14 nt, Human
ucagagcucucucu

SEQ ID NO: 2646151 - RNA, 22 nt, Human
ucagccaagguuuuauaaggcu

SEQ ID NO: 2646152 - RNA, 23 nt, Human
ucagccguguaaccauggaccca

SEQ ID NO: 2646153 - RNA, 11 nt, Human
accccaggacg

SEQ ID NO: 2646154 - RNA, 17 nt, Human
accccaggacgccacuc

SEQ ID NO: 2646155 - RNA, 20 nt, Human
accccaggacgccacucauu

SEQ ID NO: 2646156 - RNA, 21 nt, Human
accccaggacgccacucauuu

SEQ ID NO: 2646157 - RNA, 23 nt, Human
accccaggacgccacucauuuca

SEQ ID NO: 2646158 - RNA, 17 nt, Human
acccaggaguguggcca

SEQ ID NO: 2646159 - RNA, 15 nt, Human
acccagcguggccuc

SEQ ID NO: 2646160 - RNA, 16 nt, Human
ucagcucaaugcaguu

SEQ ID NO: 2646161 - RNA, 14 nt, Human
accccccgugggcu

SEQ ID NO: 2646162 - RNA, 23 nt, Human
ucagcgacuccguuggccacucc

SEQ ID NO: 2646163 - RNA, 19 nt, Human
ucagcgacuccguuggcca

SEQ ID NO: 2646164 - RNA, 20 nt, Human
ucagcgacuccguuggccac

SEQ ID NO: 2646165 - RNA, 18 nt, Human
acgguuucgaagucauua

SEQ ID NO: 2646166 - RNA, 13 nt, Human
acguacauguuua

SEQ ID NO: 2646167 - RNA, 17 nt, Human
acgguuuuacugcagcu

SEQ ID NO: 2646168 - RNA, 15 nt, Human
acgguuuuacugcag

SEQ ID NO: 2646169 - RNA, 16 nt, Human
acgugggcaaacaggc

SEQ ID NO: 2646170 - RNA, 19 nt, Human
acgugggcaaacaggcagu

SEQ ID NO: 2646171 - RNA, 12 nt, Human
ucccacacccaa

SEQ ID NO: 2646172 - RNA, 17 nt, Human
ucccacacccaaagcug

SEQ ID NO: 2646173 - RNA, 13 nt, Human
ucccacaccccaa

SEQ ID NO: 2646174 - RNA, 16 nt, Human
ucccacaaaggagagc

SEQ ID NO: 2646175 - RNA, 22 nt, Human
acgggaugguucuggcuguuug

SEQ ID NO: 2646176 - RNA, 14 nt, Human
acgguuuccaggga

SEQ ID NO: 2646177 - RNA, 15 nt, Human
acgguuuccagggag

SEQ ID NO: 2646178 - RNA, 17 nt, Human
acgguuuccagggaggg

SEQ ID NO: 2646179 - RNA, 15 nt, Human
acgguguuuugccau

SEQ ID NO: 2646180 - RNA, 17 nt, Human
acgguguuuugccaugu

SEQ ID NO: 2646181 - RNA, 21 nt, Human
acgguggucggugggacccug

SEQ ID NO: 2646182 - RNA, 14 nt, Human
uccauucucccagg

SEQ ID NO: 2646183 - RNA, 15 nt, Human
uccauucucccaggu

SEQ ID NO: 2646184 - RNA, 16 nt, Human
uccauucucccaggua

SEQ ID NO: 2646185 - RNA, 12 nt, Human
uccauuugagaa

SEQ ID NO: 2646186 - RNA, 13 nt, Human
uccauuugagaaa

SEQ ID NO: 2646187 - RNA, 14 nt, Human
uccauuugagaaaa

SEQ ID NO: 2646188 - RNA, 14 nt, Human
ucccaaaaaacuac

SEQ ID NO: 2646189 - RNA, 15 nt, Human
uccauuuccauugcu

SEQ ID NO: 2646190 - RNA, 19 nt, Human
uccauuuccauugcuuauu

SEQ ID NO: 2646191 - RNA, 14 nt, Human
uccauuuccccucu

SEQ ID NO: 2646192 - RNA, 20 nt, Human
ucccaaaccacgccucuuga

SEQ ID NO: 2646193 - RNA, 21 nt, Human
ucccaaacgccuccccugccc

SEQ ID NO: 2646194 - RNA, 15 nt, Human
ucccaaacgccuccc

SEQ ID NO: 2646195 - RNA, 11 nt, Human
uccccaugaca

SEQ ID NO: 2646196 - RNA, 13 nt, Human
uccccauggagcc

SEQ ID NO: 2646197 - RNA, 18 nt, Human
uccccaugcuuccuugcc

SEQ ID NO: 2646198 - RNA, 16 nt, Human
uccccauggagccagc

SEQ ID NO: 2646199 - RNA, 15 nt, Human
uccccauggagccag

SEQ ID NO: 2646200 - RNA, 15 nt, Human
uccccaccccugccc

SEQ ID NO: 2646201 - RNA, 16 nt, Human
uccccaccccugcccc

SEQ ID NO: 2646202 - RNA, 18 nt, Human
uccccaccccugccccca

SEQ ID NO: 2646203 - RNA, 22 nt, Human
uccccaccccugcccccagccc

SEQ ID NO: 2646204 - RNA, 20 nt, Human
uccccauuucccaucugcac

SEQ ID NO: 2646205 - RNA, 15 nt, Human
uccccauuucccauc

SEQ ID NO: 2646206 - RNA, 16 nt, Human
uccccauuucccaucu

SEQ ID NO: 2646207 - RNA, 17 nt, Human
uccccauuucccaucug

SEQ ID NO: 2646208 - RNA, 18 nt, Human
uccccauuucccaucugc

SEQ ID NO: 2646209 - RNA, 19 nt, Human
uccccauuucccaucugca

SEQ ID NO: 2646210 - RNA, 15 nt, Human
acuacccauagacau

SEQ ID NO: 2646211 - RNA, 19 nt, Human
acuacccauagacaugaaa

SEQ ID NO: 2646212 - RNA, 17 nt, Human
uccccacagcgucccug

SEQ ID NO: 2646213 - RNA, 18 nt, Human
uccccacagcgucccugg

SEQ ID NO: 2646214 - RNA, 19 nt, Human
uccccacagcgucccuggc

SEQ ID NO: 2646215 - RNA, 20 nt, Human
uccccacagcgucccuggcg

SEQ ID NO: 2646216 - RNA, 13 nt, Human
uccccaccccugc

SEQ ID NO: 2646217 - RNA, 14 nt, Human
uccccaccccugcc

SEQ ID NO: 2646218 - RNA, 13 nt, Human
acuacaagucagc

SEQ ID NO: 2646219 - RNA, 14 nt, Human
acuacagaaaugag

SEQ ID NO: 2646220 - RNA, 23 nt, Human
acuacagaaaugaggaggaugcu

SEQ ID NO: 2646221 - RNA, 16 nt, Human
ucccagcacuuuggga

SEQ ID NO: 2646222 - RNA, 18 nt, Human
ucccagcacuuugggagg

SEQ ID NO: 2646223 - RNA, 19 nt, Human
ucccagcacuuugggaggc

SEQ ID NO: 2646224 - RNA, 21 nt, Human
uccccuuguuugucccuucua

SEQ ID NO: 2646225 - RNA, 14 nt, Human
acucaccagcccca

SEQ ID NO: 2646226 - RNA, 20 nt, Human
acucaccagccccacugcca

SEQ ID NO: 2646227 - RNA, 21 nt, Human
acucaccagccccacugccag

SEQ ID NO: 2646228 - RNA, 22 nt, Human
acucaccagccccacugccagc

SEQ ID NO: 2646229 - RNA, 23 nt, Human
acucaccagccccacugccagca

SEQ ID NO: 2646230 - RNA, 17 nt, Human
acuacucccccaggugg

SEQ ID NO: 2646231 - RNA, 22 nt, Human
acucacuggggccuacagcuuu

SEQ ID NO: 2646232 - RNA, 13 nt, Human
acucacucuaaag

SEQ ID NO: 2646233 - RNA, 21 nt, Human
acucacuaggcccccacuugc

SEQ ID NO: 2646234 - RNA, 22 nt, Human
acucacuaggcccccacuugcc

SEQ ID NO: 2646235 - RNA, 14 nt, Human
acucacuaggcccc

SEQ ID NO: 2646236 - RNA, 15 nt, Human
acucacuaggccccc

SEQ ID NO: 2646237 - RNA, 17 nt, Human
acucacuaggcccccac

SEQ ID NO: 2646238 - RNA, 19 nt, Human
acucacguggguccugagg

SEQ ID NO: 2646239 - RNA, 12 nt, Human
acucaccuucua

SEQ ID NO: 2646240 - RNA, 15 nt, Human
ucccugagacaggga

SEQ ID NO: 2646241 - RNA, 18 nt, Human
acucacugugaucaauau

SEQ ID NO: 2646242 - RNA, 13 nt, Human
acuccagccuggg

SEQ ID NO: 2646243 - RNA, 12 nt, Human
acuccagccugg

SEQ ID NO: 2646244 - RNA, 20 nt, Human
acuccagccagcgccucccu

SEQ ID NO: 2646245 - RNA, 21 nt, Human
acuccagccagcgccucccuc

SEQ ID NO: 2646246 - RNA, 22 nt, Human
acuccagccagcgccucccucc

SEQ ID NO: 2646247 - RNA, 23 nt, Human
acuccagccagcgccucccucca

SEQ ID NO: 2646248 - RNA, 15 nt, Human
acuccucugcgucua

SEQ ID NO: 2646249 - RNA, 20 nt, Human
acuccucugcgucuauccug

SEQ ID NO: 2646250 - RNA, 23 nt, Human
acuccucugcgucuauccugugu

SEQ ID NO: 2646251 - RNA, 18 nt, Human
acuccucgguacucccau

SEQ ID NO: 2646252 - RNA, 12 nt, Human
ucccugucccag

SEQ ID NO: 2646253 - RNA, 20 nt, Human
ucccuguguuaauuuaaguu

SEQ ID NO: 2646254 - RNA, 20 nt, Human
ucccuuaagggguaucaugu

SEQ ID NO: 2646255 - RNA, 22 nt, Human
ucccuuaacaguuguauuuaac

SEQ ID NO: 2646256 - RNA, 17 nt, Human
ucccuuaacaguuguau

SEQ ID NO: 2646257 - RNA, 20 nt, Human
ucccuuaacaguuguauuua

SEQ ID NO: 2646258 - RNA, 16 nt, Human
ucccuuaacaguugua

SEQ ID NO: 2646259 - RNA, 16 nt, Human
uccuagaaauucccca

SEQ ID NO: 2646260 - RNA, 20 nt, Human
ucccuuuuucauaaauuauu

SEQ ID NO: 2646261 - RNA, 17 nt, Human
uccggucccugucccag

SEQ ID NO: 2646262 - RNA, 20 nt, Human
uccggucggaucucucuccu

SEQ ID NO: 2646263 - RNA, 21 nt, Human
uccggcucccagccucagcgc

SEQ ID NO: 2646264 - RNA, 18 nt, Human
uccggcucccagccucag

SEQ ID NO: 2646265 - RNA, 17 nt, Human
uccggcucccagccuca

SEQ ID NO: 2646266 - RNA, 16 nt, Human
uccggcucccagccuc

SEQ ID NO: 2646267 - RNA, 14 nt, Human
accugcauaaaaag

SEQ ID NO: 2646268 - RNA, 16 nt, Human
accugacuaagaaauu

SEQ ID NO: 2646269 - RNA, 14 nt, Human
ucaugauuagcaag

SEQ ID NO: 2646270 - RNA, 13 nt, Human
ucaugauuagcaa

SEQ ID NO: 2646271 - RNA, 17 nt, Human
ucauuacuuguugccua

SEQ ID NO: 2646272 - RNA, 12 nt, Human
ucauuacuuguu

SEQ ID NO: 2646273 - RNA, 15 nt, Human
ucauucuuacuaaaa

SEQ ID NO: 2646274 - RNA, 20 nt, Human
ucauucuuacuaaaaaguau

SEQ ID NO: 2646275 - RNA, 19 nt, Human
accucggugccuuccucuu

SEQ ID NO: 2646276 - RNA, 22 nt, Human
ucauugcugagccucugcuccc

SEQ ID NO: 2646277 - RNA, 17 nt, Human
ucauugcugagccucug

SEQ ID NO: 2646278 - RNA, 23 nt, Human
ucauugcugagccucugcucccc

SEQ ID NO: 2646279 - RNA, 19 nt, Human
ucauugccaagggcccaaa

SEQ ID NO: 2646280 - RNA, 16 nt, Human
ucauugcugagccucu

SEQ ID NO: 2646281 - RNA, 15 nt, Human
ucauugcugagccuc

SEQ ID NO: 2646282 - RNA, 17 nt, Human
ucauugcacauaagcuu

SEQ ID NO: 2646283 - RNA, 23 nt, Human
ucauugcacauaagcuuccauuu

SEQ ID NO: 2646284 - RNA, 14 nt, Human
accuaccaaaaugg

SEQ ID NO: 2646285 - RNA, 17 nt, Human
accuacccucagugagc

SEQ ID NO: 2646286 - RNA, 23 nt, Human
accucaaacuuccagucagguag

SEQ ID NO: 2646287 - RNA, 13 nt, Human
accuagugaaacu

SEQ ID NO: 2646288 - RNA, 14 nt, Human
accuagugaaacuu

SEQ ID NO: 2646289 - RNA, 19 nt, Human
accuagugaaacuuuucua

SEQ ID NO: 2646290 - RNA, 20 nt, Human
accuagugaaacuuuucuag

SEQ ID NO: 2646291 - RNA, 15 nt, Human
accuaaauggccuca

SEQ ID NO: 2646292 - RNA, 18 nt, Human
accgcgggugugggaaag

SEQ ID NO: 2646293 - RNA, 19 nt, Human
accgcgggugugggaaagc

SEQ ID NO: 2646294 - RNA, 15 nt, Human
accuaggucuccagu

SEQ ID NO: 2646295 - RNA, 14 nt, Human
ucaucccauuccag

SEQ ID NO: 2646296 - RNA, 16 nt, Human
ucaucccauuccaggc

SEQ ID NO: 2646297 - RNA, 17 nt, Human
ucaucccauuccaggca

SEQ ID NO: 2646298 - RNA, 20 nt, Human
ucaucccauuccaggcagcc

SEQ ID NO: 2646299 - RNA, 23 nt, Human
ucaucccauuccaggcagccucu

SEQ ID NO: 2646300 - RNA, 20 nt, Human
uccagacuuccuugagacac

SEQ ID NO: 2646301 - RNA, 19 nt, Human
uccagacuuccuugagaca

SEQ ID NO: 2646302 - RNA, 14 nt, Human
uccagacuuccuug

SEQ ID NO: 2646303 - RNA, 14 nt, Human
uccagacucagagc

SEQ ID NO: 2646304 - RNA, 18 nt, Human
uccagacucagagcucuc

SEQ ID NO: 2646305 - RNA, 18 nt, Human
uccaggcuuucccacuuc

SEQ ID NO: 2646306 - RNA, 20 nt, Human
uccaggcuuucccacuuccc

SEQ ID NO: 2646307 - RNA, 22 nt, Human
uccaggcuuucccacuucccac

SEQ ID NO: 2646308 - RNA, 14 nt, Human
acgagaccccggcu

SEQ ID NO: 2646309 - RNA, 15 nt, Human
acgaggaaccgaaaa

SEQ ID NO: 2646310 - RNA, 15 nt, Human
uccacuccauugucg

SEQ ID NO: 2646311 - RNA, 13 nt, Human
uccaggccugccu

SEQ ID NO: 2646312 - RNA, 18 nt, Human
uccaggccgcgcccuuuc

SEQ ID NO: 2646313 - RNA, 20 nt, Human
uccaggccgcgcccuuuccc

SEQ ID NO: 2646314 - RNA, 21 nt, Human
uccaggccgcgcccuuucccc

SEQ ID NO: 2646315 - RNA, 15 nt, Human
uccaggcagccucug

SEQ ID NO: 2646316 - RNA, 18 nt, Human
uccaggcagccucuguca

SEQ ID NO: 2646317 - RNA, 14 nt, Human
uccagccccucugg

SEQ ID NO: 2646318 - RNA, 15 nt, Human
uccagccccucuggu

SEQ ID NO: 2646319 - RNA, 16 nt, Human
uccagccccucugguc

SEQ ID NO: 2646320 - RNA, 18 nt, Human
uccagccccucuggucgc

SEQ ID NO: 2646321 - RNA, 23 nt, Human
uccagccccucuggucgcuccug

SEQ ID NO: 2646322 - RNA, 13 nt, Human
accuggcugaggu

SEQ ID NO: 2646323 - RNA, 19 nt, Human
accuggcugagguuccucu

SEQ ID NO: 2646324 - RNA, 21 nt, Human
accuggcugagguuccucugc

SEQ ID NO: 2646325 - RNA, 22 nt, Human
accuggcugagguuccucugcc

SEQ ID NO: 2646326 - RNA, 21 nt, Human
accuggcaucgcaccauucug

SEQ ID NO: 2646327 - RNA, 21 nt, Human
accuggcaucuaauucugauu

SEQ ID NO: 2646328 - RNA, 12 nt, Human
uccaacccugcc

SEQ ID NO: 2646329 - RNA, 13 nt, Human
uccaacccugccg

SEQ ID NO: 2646330 - RNA, 21 nt, Human
uccaacccugccgucaccacc

SEQ ID NO: 2646331 - RNA, 22 nt, Human
uccaacccugccgucaccacca

SEQ ID NO: 2646332 - RNA, 13 nt, Human
uccaaccuuccca

SEQ ID NO: 2646333 - RNA, 14 nt, Human
uccaacuccagcaa

SEQ ID NO: 2646334 - RNA, 12 nt, Human
uccaacuccagc

SEQ ID NO: 2646335 - RNA, 13 nt, Human
uccaacuccagca

SEQ ID NO: 2646336 - RNA, 18 nt, Human
uccaacucccuuaaaaua

SEQ ID NO: 2646337 - RNA, 20 nt, Human
ucgaagucauuaaacugguu

SEQ ID NO: 2646338 - RNA, 18 nt, Human
ucgaagucauuaaacugg

SEQ ID NO: 2646339 - RNA, 17 nt, Human
ucgaagucauuaaacug

SEQ ID NO: 2646340 - RNA, 16 nt, Human
ucgaagucauuaaacu

SEQ ID NO: 2646341 - RNA, 13 nt, Human
ucgaagugcugag

SEQ ID NO: 2646342 - RNA, 12 nt, Human
ucgaagugcuga

SEQ ID NO: 2646343 - RNA, 12 nt, Human
ucgaagucauua

SEQ ID NO: 2646344 - RNA, 23 nt, Human
ucgaauuuugucuuuaaaauuca

SEQ ID NO: 2646345 - RNA, 19 nt, Human
ucgagaaagaggcaccagg

SEQ ID NO: 2646346 - RNA, 20 nt, Human
ucgagaaagaggcaccagga

SEQ ID NO: 2646347 - RNA, 14 nt, Human
ucgaaucucugugc

SEQ ID NO: 2646348 - RNA, 16 nt, Human
ucgaaucucugugccu

SEQ ID NO: 2646349 - RNA, 17 nt, Human
ucgaaucucugugccuu

SEQ ID NO: 2646350 - RNA, 22 nt, Human
ucgaaucucugugccuucgucu

SEQ ID NO: 2646351 - RNA, 21 nt, Human
ucgagaaagaggcaccaggaa

SEQ ID NO: 2646352 - RNA, 21 nt, Human
acuggcugucaguaugacauu

SEQ ID NO: 2646353 - RNA, 17 nt, Human
acuggcugucaguauga

SEQ ID NO: 2646354 - RNA, 14 nt, Human
acuggcuuuuauua

SEQ ID NO: 2646355 - RNA, 18 nt, Human
acuggcuuuuauuaaugc

SEQ ID NO: 2646356 - RNA, 19 nt, Human
acuggcuuuuauuaaugca

SEQ ID NO: 2646357 - RNA, 14 nt, Human
ucgcgcucaguaaa

SEQ ID NO: 2646358 - RNA, 15 nt, Human
ucgcgcucaguaaac

SEQ ID NO: 2646359 - RNA, 15 nt, Human
ucgagaccauccugg

SEQ ID NO: 2646360 - RNA, 16 nt, Human
ucgagaccauccuggc

SEQ ID NO: 2646361 - RNA, 18 nt, Human
ucgagaccauccuggcua

SEQ ID NO: 2646362 - RNA, 19 nt, Human
ucgagaccauccuggcuaa

SEQ ID NO: 2646363 - RNA, 21 nt, Human
acuggccccuacuuuguggca

SEQ ID NO: 2646364 - RNA, 14 nt, Human
uccuuccauuccac

SEQ ID NO: 2646365 - RNA, 15 nt, Human
uccuuccaguauaac

SEQ ID NO: 2646366 - RNA, 18 nt, Human
uccuuccaguauaaccag

SEQ ID NO: 2646367 - RNA, 15 nt, Human
uccuuccaucaaaua

SEQ ID NO: 2646368 - RNA, 22 nt, Human
acuggccauuugccaauuuucc

SEQ ID NO: 2646369 - RNA, 20 nt, Human
uccuuguagcgacuaaacua

SEQ ID NO: 2646370 - RNA, 13 nt, Human
uccuuuaauugua

SEQ ID NO: 2646371 - RNA, 15 nt, Human
uccuuuaauuguaaa

SEQ ID NO: 2646372 - RNA, 14 nt, Human
acugccugaauaaa

SEQ ID NO: 2646373 - RNA, 15 nt, Human
acugccugaauaaag

SEQ ID NO: 2646374 - RNA, 17 nt, Human
acugccugaauaaagag

SEQ ID NO: 2646375 - RNA, 19 nt, Human
acugccugaauaaagagcc

SEQ ID NO: 2646376 - RNA, 11 nt, Human
acugccugggc

SEQ ID NO: 2646377 - RNA, 18 nt, Human
acugccugccuuaaguga

SEQ ID NO: 2646378 - RNA, 15 nt, Human
acugccugccuuaag

SEQ ID NO: 2646379 - RNA, 14 nt, Human
acugccugccuuaa

SEQ ID NO: 2646380 - RNA, 13 nt, Human
acugccugccuua

SEQ ID NO: 2646381 - RNA, 15 nt, Human
acugccuucgcuucu

SEQ ID NO: 2646382 - RNA, 12 nt, Human
acugccugggcu

SEQ ID NO: 2646383 - RNA, 16 nt, Human
acugccuucgcuucuu

SEQ ID NO: 2646384 - RNA, 17 nt, Human
acugccuucgcuucuug

SEQ ID NO: 2646385 - RNA, 21 nt, Human
acugccuucgcuucuugccuc

SEQ ID NO: 2646386 - RNA, 22 nt, Human
acugccuucgcuucuugccucu

SEQ ID NO: 2646387 - RNA, 21 nt, Human
uccuagaggcccuuugcuguc

SEQ ID NO: 2646388 - RNA, 20 nt, Human
uccuagaggcccuuugcugu

SEQ ID NO: 2646389 - RNA, 19 nt, Human
uccuagaggcccuuugcug

SEQ ID NO: 2646390 - RNA, 18 nt, Human
uccuagaggcccuuugcu

SEQ ID NO: 2646391 - RNA, 22 nt, Human
uccuagaaauuccccacccuga

SEQ ID NO: 2646392 - RNA, 21 nt, Human
uccuagaaauuccccacccug

SEQ ID NO: 2646393 - RNA, 15 nt, Human
acugcauccagccug

SEQ ID NO: 2646394 - RNA, 14 nt, Human
acugcauccagccu

SEQ ID NO: 2646395 - RNA, 23 nt, Human
acugccuucgcuucuugccucug

SEQ ID NO: 2646396 - RNA, 13 nt, Human
acugcuaaauaaa

SEQ ID NO: 2646397 - RNA, 14 nt, Human
acugcuaaauaaaa

SEQ ID NO: 2646398 - RNA, 15 nt, Human
acugcuaaauaaaau

SEQ ID NO: 2646399 - RNA, 19 nt, Human
acugcuaccuuucaaagcu

SEQ ID NO: 2646400 - RNA, 20 nt, Human
acugcuaccuuucaaagcuu

SEQ ID NO: 2646401 - RNA, 16 nt, Human
acugcuaaauaaaauu

SEQ ID NO: 2646402 - RNA, 17 nt, Human
acugcuaaauaaaauuu

SEQ ID NO: 2646403 - RNA, 19 nt, Human
acugcuaaauaaaauuugu

SEQ ID NO: 2646404 - RNA, 20 nt, Human
acugcuaaauaaaauuuguu

SEQ ID NO: 2646405 - RNA, 23 nt, Human
acuggcaaugguaguuucugugg

SEQ ID NO: 2646406 - RNA, 18 nt, Human
acuggaugcagaaacagu

SEQ ID NO: 2646407 - RNA, 17 nt, Human
acuggaugcagaaacag

SEQ ID NO: 2646408 - RNA, 21 nt, Human
acuggcaaugguaguuucugu

SEQ ID NO: 2646409 - RNA, 23 nt, Human
acuuauaagugaagugauacuau

SEQ ID NO: 2646410 - RNA, 14 nt, Human
acuuacuugcuuau

SEQ ID NO: 2646411 - RNA, 16 nt, Human
acuuacuugcuuauuu

SEQ ID NO: 2646412 - RNA, 18 nt, Human
acuuagaaucccuguguu

SEQ ID NO: 2646413 - RNA, 22 nt, Human
acuuagaaucccuguguuaauu

SEQ ID NO: 2646414 - RNA, 20 nt, Human
acuuagaaucccuguguuaa

SEQ ID NO: 2646415 - RNA, 19 nt, Human
acuuagaaucccuguguua

SEQ ID NO: 2646416 - RNA, 21 nt, Human
acuuagaaucccuguguuaau

SEQ ID NO: 2646417 - RNA, 17 nt, Human
acuuagucaauaagaaa

SEQ ID NO: 2646418 - RNA, 15 nt, Human
acuuacuugcuuauu

SEQ ID NO: 2646419 - RNA, 15 nt, Human
acuuaccuagugaaa

SEQ ID NO: 2646420 - RNA, 16 nt, Human
acuuaccuagugaaac

SEQ ID NO: 2646421 - RNA, 23 nt, Human
acuuaauaaucaagagccuuaaa

SEQ ID NO: 2646422 - RNA, 14 nt, Human
acuguuguaagaau

SEQ ID NO: 2646423 - RNA, 15 nt, Human
acuguuguaagaauu

SEQ ID NO: 2646424 - RNA, 21 nt, Human
acuguuguaagaauucugauu

SEQ ID NO: 2646425 - RNA, 22 nt, Human
acuguuguaagaauucugauug

SEQ ID NO: 2646426 - RNA, 13 nt, Human
acuuaauaacugu

SEQ ID NO: 2646427 - RNA, 15 nt, Human
acuuaauaacugugu

SEQ ID NO: 2646428 - RNA, 17 nt, Human
acuuaauaacuguguac

SEQ ID NO: 2646429 - RNA, 18 nt, Human
acuuaauaacuguguacu

SEQ ID NO: 2646430 - RNA, 22 nt, Human
acuuaauaaucaagagccuuaa

SEQ ID NO: 2646431 - RNA, 19 nt, Human
acuuaauaaucaagagccu

SEQ ID NO: 2646432 - RNA, 15 nt, Human
acuuaauaaucaaga

SEQ ID NO: 2646433 - RNA, 13 nt, Human
acuuaauaaucaa

SEQ ID NO: 2646434 - RNA, 19 nt, Human
acuguuguagaagacaaaa

SEQ ID NO: 2646435 - RNA, 12 nt, Human
ucuacagugguu

SEQ ID NO: 2646436 - RNA, 13 nt, Human
ucuacagugguuu

SEQ ID NO: 2646437 - RNA, 21 nt, Human
ucuacagugguuuuauacuga

SEQ ID NO: 2646438 - RNA, 15 nt, Human
acuguuacugggccc

SEQ ID NO: 2646439 - RNA, 16 nt, Human
acuguuacugggcccu

SEQ ID NO: 2646440 - RNA, 18 nt, Human
acuguuacugggcccuga

SEQ ID NO: 2646441 - RNA, 23 nt, Human
ucuacagugguuuuauacugaag

SEQ ID NO: 2646442 - RNA, 22 nt, Human
ucuacagugguuuuauacugaa

SEQ ID NO: 2646443 - RNA, 23 nt, Human
acuguucggaagggguuccucaa

SEQ ID NO: 2646444 - RNA, 23 nt, Human
acuggcuuuuauuaaugcacuuu

SEQ ID NO: 2646445 - RNA, 20 nt, Human
acuggcuuuuauuaaugcac

SEQ ID NO: 2646446 - RNA, 21 nt, Human
acuggcuuuuauuaaugcacu

SEQ ID NO: 2646447 - RNA, 23 nt, Human
acugucacucauugcugagccuc

SEQ ID NO: 2646448 - RNA, 24 nt, Human
acugucacucauugcugagccucu

SEQ ID NO: 2646449 - RNA, 18 nt, Human
acuggcuuaccuccucau

SEQ ID NO: 2646450 - RNA, 17 nt, Human
acugugcuguuguucuc

SEQ ID NO: 2646451 - RNA, 12 nt, Human
acuguguaaacu

SEQ ID NO: 2646452 - RNA, 14 nt, Human
acuguguaaacuca

SEQ ID NO: 2646453 - RNA, 19 nt, Human
acuguguauauuugauuua

SEQ ID NO: 2646454 - RNA, 18 nt, Human
acuguguauauuugauuu

SEQ ID NO: 2646455 - RNA, 17 nt, Human
acuguguauauuugauu

SEQ ID NO: 2646456 - RNA, 13 nt, Human
acuguguauauuu

SEQ ID NO: 2646457 - RNA, 16 nt, Human
acuguguauauuugau

SEQ ID NO: 2646458 - RNA, 15 nt, Human
acuguguauauuuga

SEQ ID NO: 2646459 - RNA, 14 nt, Human
acuguguacuguuc

SEQ ID NO: 2646460 - RNA, 18 nt, Human
ucggguuucucuguggcu

SEQ ID NO: 2646461 - RNA, 19 nt, Human
ucgggcaggggcuggaggg

SEQ ID NO: 2646462 - RNA, 21 nt, Human
ucgggaggucgaggcaggagg

SEQ ID NO: 2646463 - RNA, 19 nt, Human
ucgggaggucgaggcagga

SEQ ID NO: 2646464 - RNA, 16 nt, Human
ucggcugaccaugcuc

SEQ ID NO: 2646465 - RNA, 17 nt, Human
ucgggaggucgaggcag

SEQ ID NO: 2646466 - RNA, 15 nt, Human
ucggcugaccaugcu

SEQ ID NO: 2646467 - RNA, 21 nt, Human
ucggcucugcaguccuacuca

SEQ ID NO: 2646468 - RNA, 14 nt, Human
ucggcucagcucgg

SEQ ID NO: 2646469 - RNA, 17 nt, Human
ucggcguggcccaaggc

SEQ ID NO: 2646470 - RNA, 18 nt, Human
ucggcguggcccaaggcu

SEQ ID NO: 2646471 - RNA, 22 nt, Human
ucggcguggcccaaggcuggca

SEQ ID NO: 2646472 - RNA, 14 nt, Human
ucuaaaaucaugaa

SEQ ID NO: 2646473 - RNA, 17 nt, Human
ucuaaaagguaaugugu

SEQ ID NO: 2646474 - RNA, 18 nt, Human
ucuaaaagguaaugugug

SEQ ID NO: 2646475 - RNA, 13 nt, Human
ucuaaaaacuucu

SEQ ID NO: 2646476 - RNA, 11 nt, Human
ucguuuuugua

SEQ ID NO: 2646477 - RNA, 20 nt, Human
ucguuuuuguauuuucauga

SEQ ID NO: 2646478 - RNA, 13 nt, Human
ucgguuucuccaa

SEQ ID NO: 2646479 - RNA, 22 nt, Human
ucgguuugccaaaauucauuuc

SEQ ID NO: 2646480 - RNA, 13 nt, Human
ucgguacucccau

SEQ ID NO: 2646481 - RNA, 16 nt, Human
ucgguagguucagcca

SEQ ID NO: 2646482 - RNA, 22 nt, Human
ucgguacccggggcccagggca

SEQ ID NO: 2646483 - RNA, 21 nt, Human
ucgguacccggggcccagggc

SEQ ID NO: 2646484 - RNA, 20 nt, Human
ucgguauccccccaucuugc

SEQ ID NO: 2646485 - RNA, 15 nt, Human
ucugacuaauuaggc

SEQ ID NO: 2646486 - RNA, 13 nt, Human
ucugacuaauuag

SEQ ID NO: 2646487 - RNA, 13 nt, Human
ucugauggccuua

SEQ ID NO: 2646488 - RNA, 15 nt, Human
ucugauggccuuaau

SEQ ID NO: 2646489 - RNA, 20 nt, Human
ucugauggccuuaauuuccu

SEQ ID NO: 2646490 - RNA, 21 nt, Human
ucugauggccuuaauuuccuu

SEQ ID NO: 2646491 - RNA, 22 nt, Human
ucugauggccuuaauuuccuuu

SEQ ID NO: 2646492 - RNA, 23 nt, Human
ucugauggccuuaauuuccuuuu

SEQ ID NO: 2646493 - RNA, 16 nt, Human
agaaaugaaaacagug

SEQ ID NO: 2646494 - RNA, 23 nt, Human
ucugaccuggcaucuaauucuga

SEQ ID NO: 2646495 - RNA, 20 nt, Human
ucugaauuuacuuccuugca

SEQ ID NO: 2646496 - RNA, 21 nt, Human
ucugaauuuacuuccuugcau

SEQ ID NO: 2646497 - RNA, 16 nt, Human
agaaaucauguccaua

SEQ ID NO: 2646498 - RNA, 13 nt, Human
agaaacuugugaa

SEQ ID NO: 2646499 - RNA, 23 nt, Human
agaaacuugugaaguggaaaugu

SEQ ID NO: 2646500 - RNA, 23 nt, Human
agaaacuuuuaucuauucugaga

SEQ ID NO: 2646501 - RNA, 22 nt, Human
agaaacuuuuaucuauucugag

SEQ ID NO: 2646502 - RNA, 16 nt, Human
agaaauauaacacauu

SEQ ID NO: 2646503 - RNA, 17 nt, Human
agaaauauaacacauuu

SEQ ID NO: 2646504 - RNA, 18 nt, Human
agaaauauaacacauuuu

SEQ ID NO: 2646505 - RNA, 19 nt, Human
agaaauauaacacauuuuu

SEQ ID NO: 2646506 - RNA, 13 nt, Human
agaaacacugccu

SEQ ID NO: 2646507 - RNA, 15 nt, Human
agaaacacugccuuu

SEQ ID NO: 2646508 - RNA, 11 nt, Human
agaaacacugc

SEQ ID NO: 2646509 - RNA, 12 nt, Human
agaaacacugcc

SEQ ID NO: 2646510 - RNA, 20 nt, Human
agaaacuuauuucucauauc

SEQ ID NO: 2646511 - RNA, 21 nt, Human
agaaacuuauuucucauauca

SEQ ID NO: 2646512 - RNA, 22 nt, Human
agaaacuuauuucucauaucaa

SEQ ID NO: 2646513 - RNA, 17 nt, Human
agaaaagaacuggaaac

SEQ ID NO: 2646514 - RNA, 13 nt, Human
agaaaaagaaaug

SEQ ID NO: 2646515 - RNA, 17 nt, Human
ucucuugagccugggag

SEQ ID NO: 2646516 - RNA, 16 nt, Human
ucucuugagcuggccu

SEQ ID NO: 2646517 - RNA, 17 nt, Human
ucucuugagcuggccuc

SEQ ID NO: 2646518 - RNA, 14 nt, Human
ucucuugagcuggc

SEQ ID NO: 2646519 - RNA, 15 nt, Human
ucucuugagcuggcc

SEQ ID NO: 2646520 - RNA, 18 nt, Human
ucucuugagccugggagg

SEQ ID NO: 2646521 - RNA, 13 nt, Human
agaaaaagaaaaa

SEQ ID NO: 2646522 - RNA, 14 nt, Human
ucucuugaguuugu

SEQ ID NO: 2646523 - RNA, 22 nt, Human
ucucuugcaccaaauuaucuug

SEQ ID NO: 2646524 - RNA, 15 nt, Human
ucucuugaguuuguc

SEQ ID NO: 2646525 - RNA, 13 nt, Human
ucucuccacugug

SEQ ID NO: 2646526 - RNA, 18 nt, Human
ucucuuuaaaaggaaaga

SEQ ID NO: 2646527 - RNA, 21 nt, Human
ucucuuuaaaaggaaagaaaa

SEQ ID NO: 2646528 - RNA, 19 nt, Human
ucucuuuaaaaggaaagaa

SEQ ID NO: 2646529 - RNA, 13 nt, Human
ucucuccucccca

SEQ ID NO: 2646530 - RNA, 11 nt, Human
ucucuccuggc

SEQ ID NO: 2646531 - RNA, 12 nt, Human
ucucuccuggcc

SEQ ID NO: 2646532 - RNA, 13 nt, Human
ucucuccuggccu

SEQ ID NO: 2646533 - RNA, 16 nt, Human
ucucuccuggccuauc

SEQ ID NO: 2646534 - RNA, 22 nt, Human
acuugaaccauaaaauguccag

SEQ ID NO: 2646535 - RNA, 20 nt, Human
acuugaaccauaaaaugucc

SEQ ID NO: 2646536 - RNA, 19 nt, Human
acuugaaccauaaaauguc

SEQ ID NO: 2646537 - RNA, 17 nt, Human
acuugaaccauaaaaug

SEQ ID NO: 2646538 - RNA, 16 nt, Human
acuugaaccauaaaau

SEQ ID NO: 2646539 - RNA, 15 nt, Human
acuugaaccauaaaa

SEQ ID NO: 2646540 - RNA, 14 nt, Human
acuugaaccauaaa

SEQ ID NO: 2646541 - RNA, 18 nt, Human
acuuggcucgaaucucug

SEQ ID NO: 2646542 - RNA, 19 nt, Human
acuuggcucgaaucucugu

SEQ ID NO: 2646543 - RNA, 20 nt, Human
acuuggcucgaaucucugug

SEQ ID NO: 2646544 - RNA, 21 nt, Human
acuuggcucgaaucucugugc

SEQ ID NO: 2646545 - RNA, 13 nt, Human
acuugccuggguc

SEQ ID NO: 2646546 - RNA, 14 nt, Human
acuugccuggguca

SEQ ID NO: 2646547 - RNA, 12 nt, Human
acuugccugggu

SEQ ID NO: 2646548 - RNA, 13 nt, Human
acuugccucuucc

SEQ ID NO: 2646549 - RNA, 17 nt, Human
acuugccucuuccuuga

SEQ ID NO: 2646550 - RNA, 14 nt, Human
acuuccuuuuaacu

SEQ ID NO: 2646551 - RNA, 14 nt, Human
acuucuaccugccc

SEQ ID NO: 2646552 - RNA, 16 nt, Human
acuucuaccugcccuc

SEQ ID NO: 2646553 - RNA, 17 nt, Human
acuucuaccugcccuca

SEQ ID NO: 2646554 - RNA, 17 nt, Human
acuucuaagaaaagccu

SEQ ID NO: 2646555 - RNA, 22 nt, Human
acuucgggaggucgaggcagga

SEQ ID NO: 2646556 - RNA, 22 nt, Human
acuuccuugagacacggagccc

SEQ ID NO: 2646557 - RNA, 14 nt, Human
acuuccuugagaca

SEQ ID NO: 2646558 - RNA, 19 nt, Human
ucucacacugguucucaau

SEQ ID NO: 2646559 - RNA, 20 nt, Human
ucucacacugguucucaaug

SEQ ID NO: 2646560 - RNA, 21 nt, Human
ucucacacugguucucaauga

SEQ ID NO: 2646561 - RNA, 22 nt, Human
ucucacacugguucucaaugaa

SEQ ID NO: 2646562 - RNA, 23 nt, Human
ucucacacugguucucaaugaaa

SEQ ID NO: 2646563 - RNA, 22 nt, Human
ucucacagcuaugcaaaaagcu

SEQ ID NO: 2646564 - RNA, 18 nt, Human
ucucacagcuaugcaaaa

SEQ ID NO: 2646565 - RNA, 17 nt, Human
ucucacagcuaugcaaa

SEQ ID NO: 2646566 - RNA, 14 nt, Human
ucucacagcuaugc

SEQ ID NO: 2646567 - RNA, 18 nt, Human
ucucacuaaagcaugaaa

SEQ ID NO: 2646568 - RNA, 23 nt, Human
ucucacuaaagcaugaaauguga

SEQ ID NO: 2646569 - RNA, 16 nt, Human
acuucagcugacuuuu

SEQ ID NO: 2646570 - RNA, 11 nt, Human
acuucagcuga

SEQ ID NO: 2646571 - RNA, 21 nt, Human
ucuccauaaacaugaaaacac

SEQ ID NO: 2646572 - RNA, 20 nt, Human
ucuccaucacccucuuccug

SEQ ID NO: 2646573 - RNA, 21 nt, Human
ucuccaucacccucuuccugu

SEQ ID NO: 2646574 - RNA, 23 nt, Human
ucuccaggggcugcuuccuccug

SEQ ID NO: 2646575 - RNA, 17 nt, Human
ucuccaggggcugcuuc

SEQ ID NO: 2646576 - RNA, 18 nt, Human
ucuccaggggcugcuucc

SEQ ID NO: 2646577 - RNA, 20 nt, Human
ucuccaggggcugcuuccuc

SEQ ID NO: 2646578 - RNA, 22 nt, Human
ucuccaggggcugcuuccuccu

SEQ ID NO: 2646579 - RNA, 23 nt, Human
ucuccaaacugaagcagccucuc

SEQ ID NO: 2646580 - RNA, 22 nt, Human
ucuccaaacugaagcagccucu

SEQ ID NO: 2646581 - RNA, 19 nt, Human
ucucagcuuugagaagccu

SEQ ID NO: 2646582 - RNA, 13 nt, Human
ucucagggccugg

SEQ ID NO: 2646583 - RNA, 12 nt, Human
ucucagggccug

SEQ ID NO: 2646584 - RNA, 13 nt, Human
ucucagcuuugag

SEQ ID NO: 2646585 - RNA, 22 nt, Human
ucucauugacuuuuauaaagca

SEQ ID NO: 2646586 - RNA, 14 nt, Human
ucucauuacuuguu

SEQ ID NO: 2646587 - RNA, 19 nt, Human
ucucauuaauacucuuuau

SEQ ID NO: 2646588 - RNA, 23 nt, Human
ucucauuaauacucuuuauuuau

SEQ ID NO: 2646589 - RNA, 15 nt, Human
ucucagggccugguc

SEQ ID NO: 2646590 - RNA, 14 nt, Human
ucucagggccuggu

SEQ ID NO: 2646591 - RNA, 19 nt, Human
ucucagggccuggucguuu

SEQ ID NO: 2646592 - RNA, 12 nt, Human
acuuuaaaagug

SEQ ID NO: 2646593 - RNA, 17 nt, Human
acuuucuauccucugua

SEQ ID NO: 2646594 - RNA, 19 nt, Human
acuuucuauuuuaaucuug

SEQ ID NO: 2646595 - RNA, 10 nt, Human
acuuguguuu

SEQ ID NO: 2646596 - RNA, 17 nt, Human
acuuguguuuuaaaaua

SEQ ID NO: 2646597 - RNA, 14 nt, Human
ucuccuccccuucc

SEQ ID NO: 2646598 - RNA, 13 nt, Human
ucuccucccuucc

SEQ ID NO: 2646599 - RNA, 14 nt, Human
ucuccucccuuccu

SEQ ID NO: 2646600 - RNA, 23 nt, Human
ucuccucccuuccuuuucccugc

SEQ ID NO: 2646601 - RNA, 20 nt, Human
ucuccguuagcuccuguggc

SEQ ID NO: 2646602 - RNA, 21 nt, Human
ucuccguuagcuccuguggcc

SEQ ID NO: 2646603 - RNA, 22 nt, Human
ucuccguuagcuccuguggccc

SEQ ID NO: 2646604 - RNA, 23 nt, Human
ucuccguuagcuccuguggcccc

SEQ ID NO: 2646605 - RNA, 20 nt, Human
ucuccuacauaucccuucca

SEQ ID NO: 2646606 - RNA, 15 nt, Human
ucuccuauauauuuc

SEQ ID NO: 2646607 - RNA, 18 nt, Human
ucuccuauauauuucuau

SEQ ID NO: 2646608 - RNA, 19 nt, Human
ucuccuauauauuucuauu

SEQ ID NO: 2646609 - RNA, 22 nt, Human
ucuccuauauauuucuauuauu

SEQ ID NO: 2646610 - RNA, 23 nt, Human
ucuccuauauauuucuauuauua

SEQ ID NO: 2646611 - RNA, 17 nt, Human
agacagaacuugaaugu

SEQ ID NO: 2646612 - RNA, 14 nt, Human
agacagaacuugaa

SEQ ID NO: 2646613 - RNA, 21 nt, Human
agacacggagcccagcccucc

SEQ ID NO: 2646614 - RNA, 22 nt, Human
agacaccuuggacauccuccuc

SEQ ID NO: 2646615 - RNA, 19 nt, Human
ucuguggacugaccuugua

SEQ ID NO: 2646616 - RNA, 15 nt, Human
agaauucugauugau

SEQ ID NO: 2646617 - RNA, 18 nt, Human
agaauucugauugauuug

SEQ ID NO: 2646618 - RNA, 23 nt, Human
agaauucugauugauuugauugg

SEQ ID NO: 2646619 - RNA, 22 nt, Human
ucuuacuuuguaaauucugauu

SEQ ID NO: 2646620 - RNA, 20 nt, Human
ucuuacuuuguaaauucuga

SEQ ID NO: 2646621 - RNA, 18 nt, Human
ucuuacuuuguaaauucu

SEQ ID NO: 2646622 - RNA, 13 nt, Human
ucuuacuuuguaa

SEQ ID NO: 2646623 - RNA, 11 nt, Human
ucuuacuuugu

SEQ ID NO: 2646624 - RNA, 17 nt, Human
ucuuacuuuguaaauuc

SEQ ID NO: 2646625 - RNA, 16 nt, Human
ucuuacuuuguaaauu

SEQ ID NO: 2646626 - RNA, 15 nt, Human
ucuuacuuuguaaau

SEQ ID NO: 2646627 - RNA, 14 nt, Human
ucuuacuuuguaaa

SEQ ID NO: 2646628 - RNA, 12 nt, Human
ucuuaugugaca

SEQ ID NO: 2646629 - RNA, 13 nt, Human
ucuuaugugacau

SEQ ID NO: 2646630 - RNA, 16 nt, Human
ucuuaugugacauuaa

SEQ ID NO: 2646631 - RNA, 19 nt, Human
ucuuaugugacauuaacaa

SEQ ID NO: 2646632 - RNA, 21 nt, Human
ucuuaugugacauuaacaaau

SEQ ID NO: 2646633 - RNA, 16 nt, Human
ucuuacuaaaaaguau

SEQ ID NO: 2646634 - RNA, 17 nt, Human
ucuuacuaaaaaguaua

SEQ ID NO: 2646635 - RNA, 21 nt, Human
ucuuacaauauugauugggaa

SEQ ID NO: 2646636 - RNA, 13 nt, Human
ucuuaauguuccu

SEQ ID NO: 2646637 - RNA, 15 nt, Human
ucuuaauguuccuca

SEQ ID NO: 2646638 - RNA, 20 nt, Human
ucuuaauguuccucaaagcu

SEQ ID NO: 2646639 - RNA, 21 nt, Human
ucuuaauguuccucaaagcuu

SEQ ID NO: 2646640 - RNA, 16 nt, Human
agacaguguauguaga

SEQ ID NO: 2646641 - RNA, 17 nt, Human
agacaguguauguagaa

SEQ ID NO: 2646642 - RNA, 21 nt, Human
agacaguguauguagaagcau

SEQ ID NO: 2646643 - RNA, 23 nt, Human
agacaguguauguagaagcauga

SEQ ID NO: 2646644 - RNA, 12 nt, Human
agacagucuugc

SEQ ID NO: 2646645 - RNA, 21 nt, Human
agaauuaagcccuaagguccu

SEQ ID NO: 2646646 - RNA, 15 nt, Human
agaauguuagaguaa

SEQ ID NO: 2646647 - RNA, 16 nt, Human
agaauguuagaguaau

SEQ ID NO: 2646648 - RNA, 21 nt, Human
agaauguguuuaaacuugguu

SEQ ID NO: 2646649 - RNA, 16 nt, Human
ucuggguuugagaaau

SEQ ID NO: 2646650 - RNA, 15 nt, Human
ucugguacuuucugu

SEQ ID NO: 2646651 - RNA, 21 nt, Human
ucugguaaucgggguauaaua

SEQ ID NO: 2646652 - RNA, 15 nt, Human
ucuggguccuuccug

SEQ ID NO: 2646653 - RNA, 18 nt, Human
ucuggggggacccagugc

SEQ ID NO: 2646654 - RNA, 19 nt, Human
ucuggggggacccagugca

SEQ ID NO: 2646655 - RNA, 20 nt, Human
ucuggggggacccagugcag

SEQ ID NO: 2646656 - RNA, 21 nt, Human
ucuggggggacccagugcaga

SEQ ID NO: 2646657 - RNA, 20 nt, Human
ucuggggaaagacacugccu

SEQ ID NO: 2646658 - RNA, 23 nt, Human
ucuggggaaagacacugccuggg

SEQ ID NO: 2646659 - RNA, 21 nt, Human
ucuggggaaagacacugccug

SEQ ID NO: 2646660 - RNA, 22 nt, Human
ucuggggaaagacacugccugg

SEQ ID NO: 2646661 - RNA, 20 nt, Human
ucugggcuuauaucuggccu

SEQ ID NO: 2646662 - RNA, 21 nt, Human
ucugggcuuauaucuggccuc

SEQ ID NO: 2646663 - RNA, 20 nt, Human
agaauuagauuucuauagga

SEQ ID NO: 2646664 - RNA, 20 nt, Human
agaauuauaauuaguuccuc

SEQ ID NO: 2646665 - RNA, 14 nt, Human
ucuguacuuuucau

SEQ ID NO: 2646666 - RNA, 20 nt, Human
ucuguacuuuucauucucuu

SEQ ID NO: 2646667 - RNA, 23 nt, Human
ucuguacuguuacugggcccuga

SEQ ID NO: 2646668 - RNA, 20 nt, Human
ucuguauccuggaacaauau

SEQ ID NO: 2646669 - RNA, 22 nt, Human
ucuguacuaaacaguaagauau

SEQ ID NO: 2646670 - RNA, 12 nt, Human
ucuguauuugaa

SEQ ID NO: 2646671 - RNA, 14 nt, Human
ucugugaugagcug

SEQ ID NO: 2646672 - RNA, 17 nt, Human
ucugugaugagcugauc

SEQ ID NO: 2646673 - RNA, 12 nt, Human
ucugugcugugu

SEQ ID NO: 2646674 - RNA, 19 nt, Human
ucuguggaugccagggccg

SEQ ID NO: 2646675 - RNA, 20 nt, Human
ucugugggcuacaugcuggg

SEQ ID NO: 2646676 - RNA, 23 nt, Human
ucugugggcuacaugcugggguc

SEQ ID NO: 2646677 - RNA, 18 nt, Human
agagacagauaccuccaa

SEQ ID NO: 2646678 - RNA, 23 nt, Human
agagacagauaccuccaacccug

SEQ ID NO: 2646679 - RNA, 13 nt, Human
agagacaaaauau

SEQ ID NO: 2646680 - RNA, 22 nt, Human
agagaaaaaauauuuuccugcc

SEQ ID NO: 2646681 - RNA, 21 nt, Human
agacuuguauagcaugaaaua

SEQ ID NO: 2646682 - RNA, 17 nt, Human
agacucgacucugugcc

SEQ ID NO: 2646683 - RNA, 22 nt, Human
agacuggguaggaaagaggaag

SEQ ID NO: 2646684 - RNA, 18 nt, Human
agacuggguaggaaagag

SEQ ID NO: 2646685 - RNA, 17 nt, Human
agacuguagauauguau

SEQ ID NO: 2646686 - RNA, 23 nt, Human
agacuguagauauguauucuuuu

SEQ ID NO: 2646687 - RNA, 23 nt, Human
agacuuacagggauaaggccugu

SEQ ID NO: 2646688 - RNA, 16 nt, Human
agacuuagggcaccag

SEQ ID NO: 2646689 - RNA, 17 nt, Human
agacuuagggcaccagg

SEQ ID NO: 2646690 - RNA, 16 nt, Human
agacuuccuugagaca

SEQ ID NO: 2646691 - RNA, 14 nt, Human
agacuuccuugaga

SEQ ID NO: 2646692 - RNA, 13 nt, Human
ucuuguaaagacu

SEQ ID NO: 2646693 - RNA, 14 nt, Human
ucuuguaaagacug

SEQ ID NO: 2646694 - RNA, 15 nt, Human
ucuuguaaagacugg

SEQ ID NO: 2646695 - RNA, 17 nt, Human
ucuuguaaagacugguu

SEQ ID NO: 2646696 - RNA, 23 nt, Human
ucuuguaaagacugguuuucugc

SEQ ID NO: 2646697 - RNA, 12 nt, Human
ucuuuaguuuuu

SEQ ID NO: 2646698 - RNA, 22 nt, Human
ucuuuaguuuuugguugggaau

SEQ ID NO: 2646699 - RNA, 23 nt, Human
ucuuuaguuuuugguugggaaug

SEQ ID NO: 2646700 - RNA, 14 nt, Human
ucuugguguaauuu

SEQ ID NO: 2646701 - RNA, 13 nt, Human
ucuugauacauuc

SEQ ID NO: 2646702 - RNA, 14 nt, Human
ucuugauacauuca

SEQ ID NO: 2646703 - RNA, 18 nt, Human
ucuugauacauucaaauu

SEQ ID NO: 2646704 - RNA, 19 nt, Human
ucuugauacauucaaauuu

SEQ ID NO: 2646705 - RNA, 20 nt, Human
ucuucugagcuuacguaguu

SEQ ID NO: 2646706 - RNA, 13 nt, Human
ucuucuggcucaa

SEQ ID NO: 2646707 - RNA, 12 nt, Human
ucuucuggcuca

SEQ ID NO: 2646708 - RNA, 21 nt, Human
ucuucuggcucaaaaagagaa

SEQ ID NO: 2646709 - RNA, 18 nt, Human
ucuucuggcucaaaaaga

SEQ ID NO: 2646710 - RNA, 22 nt, Human
ucuucugagcuuacguaguucu

SEQ ID NO: 2646711 - RNA, 19 nt, Human
agacauuuuaaaaaauggu

SEQ ID NO: 2646712 - RNA, 22 nt, Human
agacauuuuaaaaaauggucac

SEQ ID NO: 2646713 - RNA, 22 nt, Human
agacauacuccuuccaucaaau

SEQ ID NO: 2646714 - RNA, 22 nt, Human
ucuucuuaauauguucuuuuaa

SEQ ID NO: 2646715 - RNA, 20 nt, Human
agaccuggaagaacaggccu

SEQ ID NO: 2646716 - RNA, 21 nt, Human
agaccuggaagaacaggccuc

SEQ ID NO: 2646717 - RNA, 14 nt, Human
agacuauuuuuaga

SEQ ID NO: 2646718 - RNA, 21 nt, Human
agacuauuuuuagauuuucuu

SEQ ID NO: 2646719 - RNA, 16 nt, Human
agacucagugcagaug

SEQ ID NO: 2646720 - RNA, 18 nt, Human
agacucagugcagaugga

SEQ ID NO: 2646721 - RNA, 22 nt, Human
ucuugaguuugucgcucaugug

SEQ ID NO: 2646722 - RNA, 21 nt, Human
ucuugaguuugucgcucaugu

SEQ ID NO: 2646723 - RNA, 20 nt, Human
ucuugaguuugucgcucaug

SEQ ID NO: 2646724 - RNA, 18 nt, Human
agaccgugaagauacuuu

SEQ ID NO: 2646725 - RNA, 20 nt, Human
agacauuuuaaaaaaugguc

SEQ ID NO: 2646726 - RNA, 17 nt, Human
agaccgggcccuggguu

SEQ ID NO: 2646727 - RNA, 15 nt, Human
agaccgaucggcggc

SEQ ID NO: 2646728 - RNA, 12 nt, Human
ugaaugugucag

SEQ ID NO: 2646729 - RNA, 14 nt, Human
agagucagccagga

SEQ ID NO: 2646730 - RNA, 18 nt, Human
agagucagccaggaccau

SEQ ID NO: 2646731 - RNA, 20 nt, Human
agaggcccagauauuagaaa

SEQ ID NO: 2646732 - RNA, 18 nt, Human
ugaauggggucucaaagu

SEQ ID NO: 2646733 - RNA, 19 nt, Human
agaguugggugucuccuua

SEQ ID NO: 2646734 - RNA, 22 nt, Human
agaguugggugucuccuuaagc

SEQ ID NO: 2646735 - RNA, 16 nt, Human
agagugaaaaagagaa

SEQ ID NO: 2646736 - RNA, 21 nt, Human
agagucugagggcuuguaguu

SEQ ID NO: 2646737 - RNA, 14 nt, Human
agagucugagggcu

SEQ ID NO: 2646738 - RNA, 12 nt, Human
agagucugaggg

SEQ ID NO: 2646739 - RNA, 15 nt, Human
agagucuggcccuag

SEQ ID NO: 2646740 - RNA, 23 nt, Human
agagucugagggcuuguaguucu

SEQ ID NO: 2646741 - RNA, 22 nt, Human
agagucugagggcuuguaguuc

SEQ ID NO: 2646742 - RNA, 13 nt, Human
agagucuggcccu

SEQ ID NO: 2646743 - RNA, 14 nt, Human
agauauguauucuu

SEQ ID NO: 2646744 - RNA, 15 nt, Human
agauauguauucuuu

SEQ ID NO: 2646745 - RNA, 20 nt, Human
agauauugaggccaagaaua

SEQ ID NO: 2646746 - RNA, 22 nt, Human
agauauugaggccaagaauauu

SEQ ID NO: 2646747 - RNA, 15 nt, Human
ugaauuuuuuuguaa

SEQ ID NO: 2646748 - RNA, 16 nt, Human
ugaauuuuuuuguaau

SEQ ID NO: 2646749 - RNA, 18 nt, Human
ugaauuuuuuuguaauaa

SEQ ID NO: 2646750 - RNA, 22 nt, Human
ugaauuuuuuuguaauaagcaa

SEQ ID NO: 2646751 - RNA, 15 nt, Human
ugaauuuuucucuuc

SEQ ID NO: 2646752 - RNA, 18 nt, Human
ugacaaaaaauguuuuaa

SEQ ID NO: 2646753 - RNA, 21 nt, Human
ugacaaaaaauguuuuaaaga

SEQ ID NO: 2646754 - RNA, 11 nt, Human
ugacauugucu

SEQ ID NO: 2646755 - RNA, 12 nt, Human
ugacauugucuc

SEQ ID NO: 2646756 - RNA, 14 nt, Human
ugacauugucuccu

SEQ ID NO: 2646757 - RNA, 15 nt, Human
agaucagccugggca

SEQ ID NO: 2646758 - RNA, 13 nt, Human
agaucagccuggg

SEQ ID NO: 2646759 - RNA, 22 nt, Human
agaucauaguuuuauuuauauu

SEQ ID NO: 2646760 - RNA, 20 nt, Human
agaucauaguuuuauuuaua

SEQ ID NO: 2646761 - RNA, 19 nt, Human
agaucauaguuuuauuuau

SEQ ID NO: 2646762 - RNA, 17 nt, Human
agaucauaguuuuauuu

SEQ ID NO: 2646763 - RNA, 16 nt, Human
agaucauaguuuuauu

SEQ ID NO: 2646764 - RNA, 14 nt, Human
agaucauaguuuua

SEQ ID NO: 2646765 - RNA, 13 nt, Human
agaucauaguuuu

SEQ ID NO: 2646766 - RNA, 23 nt, Human
agaucauaguuuuauuuauauuu

SEQ ID NO: 2646767 - RNA, 23 nt, Human
agaugcgucccaagauguugauu

SEQ ID NO: 2646768 - RNA, 20 nt, Human
agaugcgucccaagauguug

SEQ ID NO: 2646769 - RNA, 15 nt, Human
agaugcgucccaaga

SEQ ID NO: 2646770 - RNA, 23 nt, Human
agaugcacuuaaguuagccucca

SEQ ID NO: 2646771 - RNA, 21 nt, Human
agaugcaccaccaagccaagg

SEQ ID NO: 2646772 - RNA, 23 nt, Human
agaugcaccaccaagccaaggga

SEQ ID NO: 2646773 - RNA, 18 nt, Human
agauccauuuccauugcu

SEQ ID NO: 2646774 - RNA, 19 nt, Human
agauccauuuccauugcuu

SEQ ID NO: 2646775 - RNA, 15 nt, Human
agauguuagauauuu

SEQ ID NO: 2646776 - RNA, 12 nt, Human
ugaccauuuuuu

SEQ ID NO: 2646777 - RNA, 22 nt, Human
ugaccauuuuuuaauuuacuug

SEQ ID NO: 2646778 - RNA, 16 nt, Human
agauguggcuacugac

SEQ ID NO: 2646779 - RNA, 23 nt, Human
agauguuacaaguuuauauauau

SEQ ID NO: 2646780 - RNA, 15 nt, Human
agaugugcugacaag

SEQ ID NO: 2646781 - RNA, 21 nt, Human
agaugugauuaaagcuaagga

SEQ ID NO: 2646782 - RNA, 16 nt, Human
agauguggauuuggca

SEQ ID NO: 2646783 - RNA, 15 nt, Human
agaugcuucucacug

SEQ ID NO: 2646784 - RNA, 16 nt, Human
agaugcuguguauaug

SEQ ID NO: 2646785 - RNA, 18 nt, Human
agaugcuguguauauggu

SEQ ID NO: 2646786 - RNA, 19 nt, Human
agaugcuguguauauggua

SEQ ID NO: 2646787 - RNA, 15 nt, Human
ugaagcaaaucagaa

SEQ ID NO: 2646788 - RNA, 14 nt, Human
ugaagcaaaucaga

SEQ ID NO: 2646789 - RNA, 18 nt, Human
ugaagcaaaucagaaacu

SEQ ID NO: 2646790 - RNA, 18 nt, Human
agaguaaucuuguugguu

SEQ ID NO: 2646791 - RNA, 19 nt, Human
agaguacacugccugccuu

SEQ ID NO: 2646792 - RNA, 15 nt, Human
agaguacacugccug

SEQ ID NO: 2646793 - RNA, 13 nt, Human
agaguacacugcc

SEQ ID NO: 2646794 - RNA, 12 nt, Human
agaguacacugc

SEQ ID NO: 2646795 - RNA, 19 nt, Human
agagguucuaaaaucauga

SEQ ID NO: 2646796 - RNA, 18 nt, Human
agagguccucuggagccc

SEQ ID NO: 2646797 - RNA, 17 nt, Human
agagguccucuggagcc

SEQ ID NO: 2646798 - RNA, 14 nt, Human
agagguacccuggg

SEQ ID NO: 2646799 - RNA, 15 nt, Human
agagguacccugggu

SEQ ID NO: 2646800 - RNA, 17 nt, Human
agagguacccugggugu

SEQ ID NO: 2646801 - RNA, 16 nt, Human
agagguauuaaaacua

SEQ ID NO: 2646802 - RNA, 17 nt, Human
agagguauuaaaacuaa

SEQ ID NO: 2646803 - RNA, 17 nt, Human
agagcuuugucguauuu

SEQ ID NO: 2646804 - RNA, 12 nt, Human
ugaacuuuugua

SEQ ID NO: 2646805 - RNA, 13 nt, Human
ugaacuuuuguac

SEQ ID NO: 2646806 - RNA, 14 nt, Human
ugaacuuuuguacu

SEQ ID NO: 2646807 - RNA, 15 nt, Human
ugaacuuuuguacug

SEQ ID NO: 2646808 - RNA, 16 nt, Human
ugaacuuuuguacuga

SEQ ID NO: 2646809 - RNA, 18 nt, Human
ugaacuuuuguacugaau

SEQ ID NO: 2646810 - RNA, 14 nt, Human
ugaaccgcacagcu

SEQ ID NO: 2646811 - RNA, 15 nt, Human
agagccuuuugugca

SEQ ID NO: 2646812 - RNA, 20 nt, Human
agagcgcgccccuagccggu

SEQ ID NO: 2646813 - RNA, 15 nt, Human
agagcgcgccccuag

SEQ ID NO: 2646814 - RNA, 16 nt, Human
agagcugccaucgcug

SEQ ID NO: 2646815 - RNA, 17 nt, Human
ugaaagugccuuugcag

SEQ ID NO: 2646816 - RNA, 16 nt, Human
ugaaagugccuuugca

SEQ ID NO: 2646817 - RNA, 14 nt, Human
ugaaagugccuuug

SEQ ID NO: 2646818 - RNA, 13 nt, Human
ugaaagugccuuu

SEQ ID NO: 2646819 - RNA, 14 nt, Human
ugaaagugcauuuu

SEQ ID NO: 2646820 - RNA, 18 nt, Human
ugaaagugcauuuuugua

SEQ ID NO: 2646821 - RNA, 20 nt, Human
ugaaagugcauuuuuguaaa

SEQ ID NO: 2646822 - RNA, 21 nt, Human
ugaaagugcauuuuuguaaau

SEQ ID NO: 2646823 - RNA, 13 nt, Human
ugaaaguuuugua

SEQ ID NO: 2646824 - RNA, 14 nt, Human
ugaaaguuuuguaa

SEQ ID NO: 2646825 - RNA, 16 nt, Human
ugaaaguuuuguaaaa

SEQ ID NO: 2646826 - RNA, 21 nt, Human
ugaaagugccuuugcagcuca

SEQ ID NO: 2646827 - RNA, 21 nt, Human
agagacagcuacacagagcuu

SEQ ID NO: 2646828 - RNA, 12 nt, Human
agagauuucuca

SEQ ID NO: 2646829 - RNA, 13 nt, Human
agagauuucucau

SEQ ID NO: 2646830 - RNA, 15 nt, Human
ucuuuggauucuaaa

SEQ ID NO: 2646831 - RNA, 16 nt, Human
ucuuuggauucuaaau

SEQ ID NO: 2646832 - RNA, 17 nt, Human
agagcagugguaagaau

SEQ ID NO: 2646833 - RNA, 13 nt, Human
agagccuucucag

SEQ ID NO: 2646834 - RNA, 15 nt, Human
agagccuucucagaa

SEQ ID NO: 2646835 - RNA, 16 nt, Human
agagccuucucagaag

SEQ ID NO: 2646836 - RNA, 18 nt, Human
agagccuucucagaagca

SEQ ID NO: 2646837 - RNA, 19 nt, Human
agagccuucucagaagcac

SEQ ID NO: 2646838 - RNA, 21 nt, Human
agagccuugcggaagguucua

SEQ ID NO: 2646839 - RNA, 11 nt, Human
agagccuugcg

SEQ ID NO: 2646840 - RNA, 20 nt, Human
agagcaagagauaagucuuu

SEQ ID NO: 2646841 - RNA, 16 nt, Human
ugauacaaugaacacu

SEQ ID NO: 2646842 - RNA, 14 nt, Human
ugauaccagcugga

SEQ ID NO: 2646843 - RNA, 18 nt, Human
ugauacauuuuuuaagcu

SEQ ID NO: 2646844 - RNA, 13 nt, Human
ugauacauucaaa

SEQ ID NO: 2646845 - RNA, 16 nt, Human
ugauacauucaaauuu

SEQ ID NO: 2646846 - RNA, 20 nt, Human
ugauacauucaaauuugucu

SEQ ID NO: 2646847 - RNA, 16 nt, Human
ugaucaauauuuuuau

SEQ ID NO: 2646848 - RNA, 21 nt, Human
ugaucaauauuuuuauaucau

SEQ ID NO: 2646849 - RNA, 19 nt, Human
ugaucaccgacugaaaaua

SEQ ID NO: 2646850 - RNA, 17 nt, Human
ugaucaccgacugaaaa

SEQ ID NO: 2646851 - RNA, 22 nt, Human
agcaucacuuaaaacacguuuu

SEQ ID NO: 2646852 - RNA, 18 nt, Human
agcaucacuuaaaacacg

SEQ ID NO: 2646853 - RNA, 15 nt, Human
agcaucaccugccug

SEQ ID NO: 2646854 - RNA, 17 nt, Human
agcaucacuuaaaacac

SEQ ID NO: 2646855 - RNA, 16 nt, Human
agcaucacuuaaaaca

SEQ ID NO: 2646856 - RNA, 14 nt, Human
agcaucacuuaaaa

SEQ ID NO: 2646857 - RNA, 13 nt, Human
agcaucaccugcc

SEQ ID NO: 2646858 - RNA, 22 nt, Human
agcaucaggguuaagaagacuu

SEQ ID NO: 2646859 - RNA, 16 nt, Human
agcauuccagccccuc

SEQ ID NO: 2646860 - RNA, 19 nt, Human
agcauuccagccccucugg

SEQ ID NO: 2646861 - RNA, 20 nt, Human
agcauuccagccccucuggu

SEQ ID NO: 2646862 - RNA, 21 nt, Human
agcaugguacuuggccuuugg

SEQ ID NO: 2646863 - RNA, 13 nt, Human
agcauguaauggu

SEQ ID NO: 2646864 - RNA, 17 nt, Human
agccaaaauguaggcuu

SEQ ID NO: 2646865 - RNA, 22 nt, Human
agccaaaauguaggcuuaguuu

SEQ ID NO: 2646866 - RNA, 15 nt, Human
agccaaaauuaaggu

SEQ ID NO: 2646867 - RNA, 23 nt, Human
agccaaaaugugagugguugaau

SEQ ID NO: 2646868 - RNA, 18 nt, Human
agccaaaauuaagguguu

SEQ ID NO: 2646869 - RNA, 17 nt, Human
agccaaaauuaaggugu

SEQ ID NO: 2646870 - RNA, 15 nt, Human
agcauuuugcuaaau

SEQ ID NO: 2646871 - RNA, 12 nt, Human
agcauuuuucaa

SEQ ID NO: 2646872 - RNA, 13 nt, Human
agcauuuuucaau

SEQ ID NO: 2646873 - RNA, 16 nt, Human
agcauuuuucaauaua

SEQ ID NO: 2646874 - RNA, 20 nt, Human
agcauuuuucaauauauuga

SEQ ID NO: 2646875 - RNA, 22 nt, Human
agcauuuuucaauauauugaac

SEQ ID NO: 2646876 - RNA, 23 nt, Human
agcauuuuucaauauauugaacu

SEQ ID NO: 2646877 - RNA, 22 nt, Human
agcauuuugcuaaaugugaaug

SEQ ID NO: 2646878 - RNA, 16 nt, Human
agcauuuagcuggcca

SEQ ID NO: 2646879 - RNA, 18 nt, Human
agcauuuagucuugccag

SEQ ID NO: 2646880 - RNA, 20 nt, Human
ugaucccguuuuccccauga

SEQ ID NO: 2646881 - RNA, 17 nt, Human
ugaucccguuuucccca

SEQ ID NO: 2646882 - RNA, 22 nt, Human
ugaucccguuuuccccaugaca

SEQ ID NO: 2646883 - RNA, 21 nt, Human
ugaucccguuuuccccaugac

SEQ ID NO: 2646884 - RNA, 15 nt, Human
ugaucccauuuuccu

SEQ ID NO: 2646885 - RNA, 17 nt, Human
ugaucccuugagauaug

SEQ ID NO: 2646886 - RNA, 19 nt, Human
ugaucccuugagauaugga

SEQ ID NO: 2646887 - RNA, 15 nt, Human
ugaucuacaugagga

SEQ ID NO: 2646888 - RNA, 23 nt, Human
ugauccacuuugggggaggagaa

SEQ ID NO: 2646889 - RNA, 16 nt, Human
agccaaugucuccucc

SEQ ID NO: 2646890 - RNA, 19 nt, Human
agccaaucuacaaucucuu

SEQ ID NO: 2646891 - RNA, 22 nt, Human
agccaaucuacaaucucuuuuu

SEQ ID NO: 2646892 - RNA, 20 nt, Human
agccaaugucuccuccccuu

SEQ ID NO: 2646893 - RNA, 13 nt, Human
ugaugggaaaacu

SEQ ID NO: 2646894 - RNA, 16 nt, Human
ugauggccuuaauuuc

SEQ ID NO: 2646895 - RNA, 18 nt, Human
ugauggccuuaauuuccu

SEQ ID NO: 2646896 - RNA, 19 nt, Human
ugauggccuuaauuuccuu

SEQ ID NO: 2646897 - RNA, 20 nt, Human
ugauggccuuaauuuccuuu

SEQ ID NO: 2646898 - RNA, 20 nt, Human
ugauuaaccacuucagcuga

SEQ ID NO: 2646899 - RNA, 19 nt, Human
agcaggcacgggugguccc

SEQ ID NO: 2646900 - RNA, 20 nt, Human
agcaggcacggguggucccc

SEQ ID NO: 2646901 - RNA, 12 nt, Human
agcagcagguga

SEQ ID NO: 2646902 - RNA, 13 nt, Human
agcagcaggugau

SEQ ID NO: 2646903 - RNA, 12 nt, Human
agcagcagcagg

SEQ ID NO: 2646904 - RNA, 13 nt, Human
agcagcagcaggu

SEQ ID NO: 2646905 - RNA, 16 nt, Human
agcagcagcaggugau

SEQ ID NO: 2646906 - RNA, 16 nt, Human
agcagcagggagggcu

SEQ ID NO: 2646907 - RNA, 13 nt, Human
agcagcaccuccu

SEQ ID NO: 2646908 - RNA, 20 nt, Human
agcagggagggcuucugcca

SEQ ID NO: 2646909 - RNA, 23 nt, Human
agcaggugauuggaccaggccau

SEQ ID NO: 2646910 - RNA, 19 nt, Human
agcaggugauuggaccagg

SEQ ID NO: 2646911 - RNA, 20 nt, Human
agcaggugauuggaccaggc

SEQ ID NO: 2646912 - RNA, 22 nt, Human
agcaggugauuggaccaggcca

SEQ ID NO: 2646913 - RNA, 15 nt, Human
agcauagauaauauu

SEQ ID NO: 2646914 - RNA, 19 nt, Human
agcauagauaauauuguuu

SEQ ID NO: 2646915 - RNA, 17 nt, Human
agcauacuuuguaaaua

SEQ ID NO: 2646916 - RNA, 22 nt, Human
agcauacuuuguaaauaggauu

SEQ ID NO: 2646917 - RNA, 16 nt, Human
agcauagaaaccacua

SEQ ID NO: 2646918 - RNA, 20 nt, Human
agcauagaaaccacuagaaa

SEQ ID NO: 2646919 - RNA, 20 nt, Human
agcauaauuuaaaaauauau

SEQ ID NO: 2646920 - RNA, 21 nt, Human
agcauaauuuaaaaauauauu

SEQ ID NO: 2646921 - RNA, 22 nt, Human
agcauaauuuaaaaauauauuu

SEQ ID NO: 2646922 - RNA, 23 nt, Human
agcauaaaaauuagccaagugug

SEQ ID NO: 2646923 - RNA, 16 nt, Human
agcagucgugccugug

SEQ ID NO: 2646924 - RNA, 17 nt, Human
agcagucgugccugugu

SEQ ID NO: 2646925 - RNA, 14 nt, Human
agcagucgugccug

SEQ ID NO: 2646926 - RNA, 19 nt, Human
agcauaaaaauuagccaag

SEQ ID NO: 2646927 - RNA, 15 nt, Human
agcaguaagggaaca

SEQ ID NO: 2646928 - RNA, 12 nt, Human
agcaguauuuuu

SEQ ID NO: 2646929 - RNA, 13 nt, Human
ugaguggcagggg

SEQ ID NO: 2646930 - RNA, 21 nt, Human
ugaguggcaggggacaggagu

SEQ ID NO: 2646931 - RNA, 12 nt, Human
ugagugggaagc

SEQ ID NO: 2646932 - RNA, 13 nt, Human
ugagugggaagcc

SEQ ID NO: 2646933 - RNA, 14 nt, Human
ugagugggaagccc

SEQ ID NO: 2646934 - RNA, 18 nt, Human
ugagucauaucuuaauau

SEQ ID NO: 2646935 - RNA, 23 nt, Human
ugagucacuaugggaugagaaaa

SEQ ID NO: 2646936 - RNA, 15 nt, Human
ugaguacagcagaaa

SEQ ID NO: 2646937 - RNA, 21 nt, Human
ugagugggggaucacagccuc

SEQ ID NO: 2646938 - RNA, 22 nt, Human
agccugaguaaaguuaaaagaa

SEQ ID NO: 2646939 - RNA, 19 nt, Human
agccuguaacacuccucug

SEQ ID NO: 2646940 - RNA, 20 nt, Human
agccuguaacacuccucugc

SEQ ID NO: 2646941 - RNA, 19 nt, Human
agccuugcggaagguucua

SEQ ID NO: 2646942 - RNA, 22 nt, Human
agccuuaaaacaucauuccuuu

SEQ ID NO: 2646943 - RNA, 19 nt, Human
agccuuaaaacaucauucc

SEQ ID NO: 2646944 - RNA, 17 nt, Human
ugccaguuacuugcuuu

SEQ ID NO: 2646945 - RNA, 18 nt, Human
ugccaguuacuugcuuua

SEQ ID NO: 2646946 - RNA, 17 nt, Human
ugccagccuugagcccu

SEQ ID NO: 2646947 - RNA, 19 nt, Human
ugccagccuugagcccugg

SEQ ID NO: 2646948 - RNA, 21 nt, Human
ugccagccuugagcccuggcu

SEQ ID NO: 2646949 - RNA, 23 nt, Human
ugccagccuugagcccuggcugu

SEQ ID NO: 2646950 - RNA, 19 nt, Human
ugccagcccccuaaaagca

SEQ ID NO: 2646951 - RNA, 21 nt, Human
ugccagcccccuaaaagcacu

SEQ ID NO: 2646952 - RNA, 22 nt, Human
ugccagcccccuaaaagcacuc

SEQ ID NO: 2646953 - RNA, 23 nt, Human
ugccagcccccuaaaagcacucc

SEQ ID NO: 2646954 - RNA, 13 nt, Human
ugccaagcuccaa

SEQ ID NO: 2646955 - RNA, 15 nt, Human
ugccaagcuccaagc

SEQ ID NO: 2646956 - RNA, 16 nt, Human
ugccaagcuccaagcc

SEQ ID NO: 2646957 - RNA, 23 nt, Human
ugccaagcuccaagccccaucuu

SEQ ID NO: 2646958 - RNA, 20 nt, Human
ugcauacuuaccuagugaaa

SEQ ID NO: 2646959 - RNA, 22 nt, Human
ugcauacuuaccuagugaaacu

SEQ ID NO: 2646960 - RNA, 17 nt, Human
ugcagucacuggagguu

SEQ ID NO: 2646961 - RNA, 13 nt, Human
ugcauacuuugua

SEQ ID NO: 2646962 - RNA, 20 nt, Human
ugcauacuuuguauuuugau

SEQ ID NO: 2646963 - RNA, 22 nt, Human
ugcauacuuuguauuuugauua

SEQ ID NO: 2646964 - RNA, 14 nt, Human
ugcagucacuggag

SEQ ID NO: 2646965 - RNA, 15 nt, Human
ugcagucacuggagg

SEQ ID NO: 2646966 - RNA, 19 nt, Human
ugcagggccauggcucagg

SEQ ID NO: 2646967 - RNA, 14 nt, Human
ugcagguuuucugu

SEQ ID NO: 2646968 - RNA, 17 nt, Human
ugcaucguuucaucuuc

SEQ ID NO: 2646969 - RNA, 18 nt, Human
ugcaucuuugauguguug

SEQ ID NO: 2646970 - RNA, 11 nt, Human
ugcaugaaaau

SEQ ID NO: 2646971 - RNA, 12 nt, Human
ugcaucuuugau

SEQ ID NO: 2646972 - RNA, 17 nt, Human
ugcaucuuugauguguu

SEQ ID NO: 2646973 - RNA, 16 nt, Human
ugcaucuuugaugugu

SEQ ID NO: 2646974 - RNA, 12 nt, Human
ugcauggaaauc

SEQ ID NO: 2646975 - RNA, 14 nt, Human
ugcauggaaaucag

SEQ ID NO: 2646976 - RNA, 15 nt, Human
ugcauggaaaucagc

SEQ ID NO: 2646977 - RNA, 17 nt, Human
ugcauggaaaucagcca

SEQ ID NO: 2646978 - RNA, 22 nt, Human
ugcauggaaaucagccaaguuu

SEQ ID NO: 2646979 - RNA, 16 nt, Human
ugcaugcccucucagg

SEQ ID NO: 2646980 - RNA, 15 nt, Human
ugcaugcaaaugagc

SEQ ID NO: 2646981 - RNA, 22 nt, Human
ugcaugcaaaugagcucugaaa

SEQ ID NO: 2646982 - RNA, 18 nt, Human
ugcaugcaugcaaaugag

SEQ ID NO: 2646983 - RNA, 15 nt, Human
ugcaugcccucucag

SEQ ID NO: 2646984 - RNA, 14 nt, Human
ugcaugcccucuca

SEQ ID NO: 2646985 - RNA, 21 nt, Human
ugcaggucaaguugucagguu

SEQ ID NO: 2646986 - RNA, 16 nt, Human
agccucugucaggccu

SEQ ID NO: 2646987 - RNA, 17 nt, Human
agccucugucaggccuu

SEQ ID NO: 2646988 - RNA, 17 nt, Human
agccuccuuagaaaaaa

SEQ ID NO: 2646989 - RNA, 23 nt, Human
agccucuccccagguccagcucu

SEQ ID NO: 2646990 - RNA, 18 nt, Human
agccucuccccaggucca

SEQ ID NO: 2646991 - RNA, 22 nt, Human
agccucuccccagguccagcuc

SEQ ID NO: 2646992 - RNA, 17 nt, Human
agccuccugcugccaca

SEQ ID NO: 2646993 - RNA, 18 nt, Human
agccucucagugcccucc

SEQ ID NO: 2646994 - RNA, 20 nt, Human
agccucucagugcccuccag

SEQ ID NO: 2646995 - RNA, 16 nt, Human
agccucuccccagguc

SEQ ID NO: 2646996 - RNA, 14 nt, Human
ugcaauauuugaau

SEQ ID NO: 2646997 - RNA, 14 nt, Human
ugcaauaaaauuua

SEQ ID NO: 2646998 - RNA, 15 nt, Human
ugcaauaaaauuuaa

SEQ ID NO: 2646999 - RNA, 16 nt, Human
ugcaauaaaauuuaaa

SEQ ID NO: 2647000 - RNA, 17 nt, Human
ugcaauaaaauuuaaaa

SEQ ID NO: 2647001 - RNA, 24 nt, Human
ugcaauaaaaaugauacugauggu

SEQ ID NO: 2647002 - RNA, 23 nt, Human
ugcaaggccugguguuucuugau

SEQ ID NO: 2647003 - RNA, 21 nt, Human
ugcaaggccugguguuucuug

SEQ ID NO: 2647004 - RNA, 18 nt, Human
ugcaaaugagcucugaaa

SEQ ID NO: 2647005 - RNA, 20 nt, Human
ugcaaaugagcucugaaauc

SEQ ID NO: 2647006 - RNA, 21 nt, Human
ugcaaaugagcucugaaaucu

SEQ ID NO: 2647007 - RNA, 14 nt, Human
ugcaaaucugaugg

SEQ ID NO: 2647008 - RNA, 15 nt, Human
ugcaacaagcaugca

SEQ ID NO: 2647009 - RNA, 12 nt, Human
ugcaaauuucau

SEQ ID NO: 2647010 - RNA, 13 nt, Human
ugcaagaugugaa

SEQ ID NO: 2647011 - RNA, 14 nt, Human
ugcaagaugugaau

SEQ ID NO: 2647012 - RNA, 15 nt, Human
ugcaagaugugaauu

SEQ ID NO: 2647013 - RNA, 16 nt, Human
ugcaagaugugaauua

SEQ ID NO: 2647014 - RNA, 18 nt, Human
ugcaagaugugaauuauu

SEQ ID NO: 2647015 - RNA, 13 nt, Human
ugcaagcagagga

SEQ ID NO: 2647016 - RNA, 15 nt, Human
ugcaagcagaggacc

SEQ ID NO: 2647017 - RNA, 16 nt, Human
ugcaagcagaggacca

SEQ ID NO: 2647018 - RNA, 17 nt, Human
ugcaagcagaggaccag

SEQ ID NO: 2647019 - RNA, 21 nt, Human
ugcaagcagaggaccagggcc

SEQ ID NO: 2647020 - RNA, 22 nt, Human
ugcaagcagaggaccagggccu

SEQ ID NO: 2647021 - RNA, 20 nt, Human
ugauuucaaaguuuuguugu

SEQ ID NO: 2647022 - RNA, 21 nt, Human
ugauuucaaaguuuuguugua

SEQ ID NO: 2647023 - RNA, 22 nt, Human
ugauuuauuaacuuaauaauca

SEQ ID NO: 2647024 - RNA, 19 nt, Human
ugauuuauuaacuuaauaa

SEQ ID NO: 2647025 - RNA, 20 nt, Human
ugauuuauaaaugccauuua

SEQ ID NO: 2647026 - RNA, 12 nt, Human
ugauuuauuaac

SEQ ID NO: 2647027 - RNA, 16 nt, Human
ugauuuauuaacuuaa

SEQ ID NO: 2647028 - RNA, 15 nt, Human
ugauuuauuaacuua

SEQ ID NO: 2647029 - RNA, 17 nt, Human
ugauuugcaauaaaaau

SEQ ID NO: 2647030 - RNA, 17 nt, Human
ugauuugcugcucuuca

SEQ ID NO: 2647031 - RNA, 12 nt, Human
agccccucuggu

SEQ ID NO: 2647032 - RNA, 13 nt, Human
agccccucugguc

SEQ ID NO: 2647033 - RNA, 16 nt, Human
agccccucuggucgcu

SEQ ID NO: 2647034 - RNA, 24 nt, Human
agccccggggugaguccauucucc

SEQ ID NO: 2647035 - RNA, 19 nt, Human
agcccccuggccucugugc

SEQ ID NO: 2647036 - RNA, 17 nt, Human
agcccccuggccucugu

SEQ ID NO: 2647037 - RNA, 12 nt, Human
agcccccugguc

SEQ ID NO: 2647038 - RNA, 22 nt, Human
agcccccuggucuuugagcucc

SEQ ID NO: 2647039 - RNA, 18 nt, Human
agcccccuggucuuugag

SEQ ID NO: 2647040 - RNA, 16 nt, Human
agcccccuggccucug

SEQ ID NO: 2647041 - RNA, 15 nt, Human
agcccccuggccucu

SEQ ID NO: 2647042 - RNA, 20 nt, Human
agccccgcgaccauguggcc

SEQ ID NO: 2647043 - RNA, 23 nt, Human
agccccgcgaccauguggccaca

SEQ ID NO: 2647044 - RNA, 14 nt, Human
agccccgacuccag

SEQ ID NO: 2647045 - RNA, 15 nt, Human
agccccgacuccagc

SEQ ID NO: 2647046 - RNA, 16 nt, Human
agccccgacuccagcc

SEQ ID NO: 2647047 - RNA, 17 nt, Human
agccccgacuccagcca

SEQ ID NO: 2647048 - RNA, 18 nt, Human
agccccgacuccagccag

SEQ ID NO: 2647049 - RNA, 19 nt, Human
agccccgacuccagccagc

SEQ ID NO: 2647050 - RNA, 20 nt, Human
agccccgacuccagccagcg

SEQ ID NO: 2647051 - RNA, 21 nt, Human
agccccgacuccagccagcgc

SEQ ID NO: 2647052 - RNA, 22 nt, Human
agccccgacuccagccagcgcc

SEQ ID NO: 2647053 - RNA, 23 nt, Human
agccccgacuccagccagcgccu

SEQ ID NO: 2647054 - RNA, 11 nt, Human
ugcagaaugua

SEQ ID NO: 2647055 - RNA, 12 nt, Human
ugcagaauguaa

SEQ ID NO: 2647056 - RNA, 19 nt, Human
ugcagaauguaagugggcc

SEQ ID NO: 2647057 - RNA, 20 nt, Human
ugcagaauguaagugggccc

SEQ ID NO: 2647058 - RNA, 21 nt, Human
ugcagaauguaagugggccca

SEQ ID NO: 2647059 - RNA, 15 nt, Human
ugcacuccagccugg

SEQ ID NO: 2647060 - RNA, 13 nt, Human
ugcacuccagccu

SEQ ID NO: 2647061 - RNA, 16 nt, Human
ugcacuccagccuggg

SEQ ID NO: 2647062 - RNA, 14 nt, Human
ugcacuccagccug

SEQ ID NO: 2647063 - RNA, 13 nt, Human
ugcacauguuucc

SEQ ID NO: 2647064 - RNA, 14 nt, Human
ugcacauguuuccu

SEQ ID NO: 2647065 - RNA, 16 nt, Human
ugcacauguuuccucu

SEQ ID NO: 2647066 - RNA, 17 nt, Human
ugcacauguuuccucua

SEQ ID NO: 2647067 - RNA, 18 nt, Human
ugcacauguuuccucuag

SEQ ID NO: 2647068 - RNA, 15 nt, Human
ugcaccacugcacuc

SEQ ID NO: 2647069 - RNA, 21 nt, Human
ugcaccacugcacuccagccu

SEQ ID NO: 2647070 - RNA, 16 nt, Human
ugcacccaugguacca

SEQ ID NO: 2647071 - RNA, 21 nt, Human
aggaauuaccaagaauauccu

SEQ ID NO: 2647072 - RNA, 16 nt, Human
aggacaauacuggggu

SEQ ID NO: 2647073 - RNA, 21 nt, Human
aggaccuuuccaccacagcca

SEQ ID NO: 2647074 - RNA, 20 nt, Human
aggacgaacauccaaccuuc

SEQ ID NO: 2647075 - RNA, 22 nt, Human
aggaccuuuccaccacagccag

SEQ ID NO: 2647076 - RNA, 12 nt, Human
aggacgccacuc

SEQ ID NO: 2647077 - RNA, 16 nt, Human
aggacgccacucauuu

SEQ ID NO: 2647078 - RNA, 17 nt, Human
aggacgccacucauuuc

SEQ ID NO: 2647079 - RNA, 18 nt, Human
aggacgccacucauuuca

SEQ ID NO: 2647080 - RNA, 19 nt, Human
aggacgccacucauuucau

SEQ ID NO: 2647081 - RNA, 20 nt, Human
aggacgccacucauuucauc

SEQ ID NO: 2647082 - RNA, 23 nt, Human
aggacgccacucauuucaucuca

SEQ ID NO: 2647083 - RNA, 17 nt, Human
aggaccuuaagacagag

SEQ ID NO: 2647084 - RNA, 15 nt, Human
aggacuuuguacauu

SEQ ID NO: 2647085 - RNA, 20 nt, Human
aggagauaauuacugccuug

SEQ ID NO: 2647086 - RNA, 20 nt, Human
aggagaucgagaccauccug

SEQ ID NO: 2647087 - RNA, 23 nt, Human
aggagaucgagaccauccuggcu

SEQ ID NO: 2647088 - RNA, 14 nt, Human
aggaggaaggcaag

SEQ ID NO: 2647089 - RNA, 17 nt, Human
aggaggaaggcaagagg

SEQ ID NO: 2647090 - RNA, 15 nt, Human
uggaagaggaaaagg

SEQ ID NO: 2647091 - RNA, 17 nt, Human
aggauagcuaacuguaa

SEQ ID NO: 2647092 - RNA, 20 nt, Human
aggauagcuaacuguaaauc

SEQ ID NO: 2647093 - RNA, 23 nt, Human
aggauagcuaacuguaaaucaug

SEQ ID NO: 2647094 - RNA, 20 nt, Human
aggaggcgcccuuggcuucu

SEQ ID NO: 2647095 - RNA, 21 nt, Human
aggauugaaaauguccaggaa

SEQ ID NO: 2647096 - RNA, 24 nt, Human
aggauugaaaauguccaggaaagu

SEQ ID NO: 2647097 - RNA, 24 nt, Human
aggaugaugccaguuacuugcuuu

SEQ ID NO: 2647098 - RNA, 23 nt, Human
aggaugaugucuuuuuauuaaaa

SEQ ID NO: 2647099 - RNA, 14 nt, Human
ugcuuuuucuuguu

SEQ ID NO: 2647100 - RNA, 22 nt, Human
ugcuuuuucuuguuuguuuaaa

SEQ ID NO: 2647101 - RNA, 14 nt, Human
aggagccucacugg

SEQ ID NO: 2647102 - RNA, 22 nt, Human
aggagccucacuggggcagaca

SEQ ID NO: 2647103 - RNA, 12 nt, Human
ugcuugaauaaa

SEQ ID NO: 2647104 - RNA, 20 nt, Human
ugcuugaauaaacaccacug

SEQ ID NO: 2647105 - RNA, 15 nt, Human
ugcuugaauaaacac

SEQ ID NO: 2647106 - RNA, 15 nt, Human
ugcuugagcucagga

SEQ ID NO: 2647107 - RNA, 18 nt, Human
ugcuuuggaccuaaaugg

SEQ ID NO: 2647108 - RNA, 23 nt, Human
ugcuuuggaccuaaauggccuca

SEQ ID NO: 2647109 - RNA, 21 nt, Human
ugcuuuggaccuaaauggccu

SEQ ID NO: 2647110 - RNA, 22 nt, Human
ugcuuuggaccuaaauggccuc

SEQ ID NO: 2647111 - RNA, 20 nt, Human
aggcaaggcuaugugauuac

SEQ ID NO: 2647112 - RNA, 18 nt, Human
aggcaaggcuaugugauu

SEQ ID NO: 2647113 - RNA, 14 nt, Human
aggcaagccaggcu

SEQ ID NO: 2647114 - RNA, 16 nt, Human
aggcaagccaggcuca

SEQ ID NO: 2647115 - RNA, 22 nt, Human
aggcaagccaggcucacucaca

SEQ ID NO: 2647116 - RNA, 13 nt, Human
uggagccagcucc

SEQ ID NO: 2647117 - RNA, 15 nt, Human
uggagaaaugaaaac

SEQ ID NO: 2647118 - RNA, 21 nt, Human
uggagcacugggcucccgggc

SEQ ID NO: 2647119 - RNA, 19 nt, Human
uggagcacugggcucccgg

SEQ ID NO: 2647120 - RNA, 12 nt, Human
uggagcacuggg

SEQ ID NO: 2647121 - RNA, 17 nt, Human
uggagcacugggcuccc

SEQ ID NO: 2647122 - RNA, 15 nt, Human
uggagcacugggcuc

SEQ ID NO: 2647123 - RNA, 14 nt, Human
uggacuucaaagca

SEQ ID NO: 2647124 - RNA, 18 nt, Human
uggacuucaaagcaagcu

SEQ ID NO: 2647125 - RNA, 19 nt, Human
uggacuucaaagcaagcug

SEQ ID NO: 2647126 - RNA, 17 nt, Human
uggacuucuaccugccc

SEQ ID NO: 2647127 - RNA, 18 nt, Human
uggacuucuaccugcccu

SEQ ID NO: 2647128 - RNA, 22 nt, Human
aggcauagaggcuucuccgcca

SEQ ID NO: 2647129 - RNA, 15 nt, Human
aggcauagaggcuuc

SEQ ID NO: 2647130 - RNA, 22 nt, Human
aggcagggguggggguggaggc

SEQ ID NO: 2647131 - RNA, 23 nt, Human
aggcagggguggggguggaggcu

SEQ ID NO: 2647132 - RNA, 17 nt, Human
aggcaggugggauggau

SEQ ID NO: 2647133 - RNA, 23 nt, Human
aggcaggugaucugcugcagagc

SEQ ID NO: 2647134 - RNA, 20 nt, Human
aggcaggugaucugcugcag

SEQ ID NO: 2647135 - RNA, 23 nt, Human
aggcaguuugaggauuaguuuag

SEQ ID NO: 2647136 - RNA, 14 nt, Human
aggcaggauugaaa

SEQ ID NO: 2647137 - RNA, 16 nt, Human
aggcaggauugaaaau

SEQ ID NO: 2647138 - RNA, 18 nt, Human
aggcaggauugaaaaugu

SEQ ID NO: 2647139 - RNA, 22 nt, Human
aggcaggauugaaaauguccag

SEQ ID NO: 2647140 - RNA, 22 nt, Human
aggcaggcauagaggcuucucc

SEQ ID NO: 2647141 - RNA, 14 nt, Human
aggcaggcauggcc

SEQ ID NO: 2647142 - RNA, 15 nt, Human
aggcaggcauggccc

SEQ ID NO: 2647143 - RNA, 17 nt, Human
aggcaggcauggcccug

SEQ ID NO: 2647144 - RNA, 18 nt, Human
aggcaggcauggcccugg

SEQ ID NO: 2647145 - RNA, 19 nt, Human
aggcaggcauggcccuggg

SEQ ID NO: 2647146 - RNA, 20 nt, Human
aggcaggcauggcccugggc

SEQ ID NO: 2647147 - RNA, 20 nt, Human
aggcaaggaaagaaauacag

SEQ ID NO: 2647148 - RNA, 19 nt, Human
aggcaggccuauuucauca

SEQ ID NO: 2647149 - RNA, 15 nt, Human
aggcagggguggggg

SEQ ID NO: 2647150 - RNA, 16 nt, Human
aggcaggggugggggu

SEQ ID NO: 2647151 - RNA, 19 nt, Human
aggcaggggugggggugga

SEQ ID NO: 2647152 - RNA, 20 nt, Human
aggcagggguggggguggag

SEQ ID NO: 2647153 - RNA, 14 nt, Human
uggaguguaugacu

SEQ ID NO: 2647154 - RNA, 17 nt, Human
uggaguguaugacugca

SEQ ID NO: 2647155 - RNA, 19 nt, Human
uggaguguaugacugcaca

SEQ ID NO: 2647156 - RNA, 15 nt, Human
uggagugugagccac

SEQ ID NO: 2647157 - RNA, 20 nt, Human
aggcauuugcugaauacaga

SEQ ID NO: 2647158 - RNA, 16 nt, Human
aggcauuugcugaaua

SEQ ID NO: 2647159 - RNA, 20 nt, Human
uggaggucgguagguucagc

SEQ ID NO: 2647160 - RNA, 18 nt, Human
uggaugcggccauucaag

SEQ ID NO: 2647161 - RNA, 19 nt, Human
uggaguucucaaagaccug

SEQ ID NO: 2647162 - RNA, 15 nt, Human
uggauucuaaauaca

SEQ ID NO: 2647163 - RNA, 16 nt, Human
uggauugccucugaaa

SEQ ID NO: 2647164 - RNA, 23 nt, Human
aggcccccagcccagggcuccug

SEQ ID NO: 2647165 - RNA, 13 nt, Human
aggcccccacuug

SEQ ID NO: 2647166 - RNA, 17 nt, Human
aggcccccacuugccuc

SEQ ID NO: 2647167 - RNA, 18 nt, Human
aggcccccacuugccucu

SEQ ID NO: 2647168 - RNA, 20 nt, Human
aggcccccacuugccucuuc

SEQ ID NO: 2647169 - RNA, 14 nt, Human
aggcccccagccca

SEQ ID NO: 2647170 - RNA, 17 nt, Human
aggcccccagcccaggg

SEQ ID NO: 2647171 - RNA, 18 nt, Human
aggcccccagcccagggc

SEQ ID NO: 2647172 - RNA, 19 nt, Human
aggcccccagcccagggcu

SEQ ID NO: 2647173 - RNA, 22 nt, Human
aggcccccagcccagggcuccu

SEQ ID NO: 2647174 - RNA, 17 nt, Human
aggccaccuccccagca

SEQ ID NO: 2647175 - RNA, 14 nt, Human
aggccaccucccca

SEQ ID NO: 2647176 - RNA, 15 nt, Human
aggccaccuccccag

SEQ ID NO: 2647177 - RNA, 23 nt, Human
ugcuccauaguuuggcauuugca

SEQ ID NO: 2647178 - RNA, 18 nt, Human
ugcuccauaguuuggcau

SEQ ID NO: 2647179 - RNA, 21 nt, Human
ugcuccagcuguucagcuggu

SEQ ID NO: 2647180 - RNA, 20 nt, Human
ugcuccagcuguucagcugg

SEQ ID NO: 2647181 - RNA, 17 nt, Human
ugcucuucaucccauuc

SEQ ID NO: 2647182 - RNA, 15 nt, Human
ugcugacuuagaauc

SEQ ID NO: 2647183 - RNA, 14 nt, Human
ugcugacuuagaau

SEQ ID NO: 2647184 - RNA, 13 nt, Human
ugcugacuuagaa

SEQ ID NO: 2647185 - RNA, 17 nt, Human
ugcucuucagaugccac

SEQ ID NO: 2647186 - RNA, 18 nt, Human
ugcucuucagaugccacu

SEQ ID NO: 2647187 - RNA, 19 nt, Human
aggaaacaaccaugucauu

SEQ ID NO: 2647188 - RNA, 13 nt, Human
aggaaacaaguga

SEQ ID NO: 2647189 - RNA, 14 nt, Human
aggaaacaagugaa

SEQ ID NO: 2647190 - RNA, 17 nt, Human
agcuuuggucugugugu

SEQ ID NO: 2647191 - RNA, 14 nt, Human
aggaaaaugucugu

SEQ ID NO: 2647192 - RNA, 20 nt, Human
aggaaaaugucuguaauaau

SEQ ID NO: 2647193 - RNA, 23 nt, Human
aggaaaaugucuguaauaauaga

SEQ ID NO: 2647194 - RNA, 15 nt, Human
ugcucaaaaaaugag

SEQ ID NO: 2647195 - RNA, 17 nt, Human
ugcuauuugaacaagug

SEQ ID NO: 2647196 - RNA, 20 nt, Human
ugcuauuugaacaagugggc

SEQ ID NO: 2647197 - RNA, 12 nt, Human
ugcuauuuuugu

SEQ ID NO: 2647198 - RNA, 13 nt, Human
ugcuauuuuugua

SEQ ID NO: 2647199 - RNA, 15 nt, Human
ugcuauuuuuguaaa

SEQ ID NO: 2647200 - RNA, 16 nt, Human
ugcuauuuuuguaaag

SEQ ID NO: 2647201 - RNA, 17 nt, Human
ugcuauuuuuguaaagu

SEQ ID NO: 2647202 - RNA, 22 nt, Human
ugcuauuuuuguaaaguuuccg

SEQ ID NO: 2647203 - RNA, 16 nt, Human
aggaaaauucuuaaaa

SEQ ID NO: 2647204 - RNA, 13 nt, Human
ugcucaaagaaau

SEQ ID NO: 2647205 - RNA, 14 nt, Human
ugcucaaagaaauc

SEQ ID NO: 2647206 - RNA, 15 nt, Human
ugcucaaagaaaucu

SEQ ID NO: 2647207 - RNA, 14 nt, Human
ugcugagccucugc

SEQ ID NO: 2647208 - RNA, 12 nt, Human
ugcugagccucu

SEQ ID NO: 2647209 - RNA, 17 nt, Human
ugcugagccucugcucc

SEQ ID NO: 2647210 - RNA, 16 nt, Human
ugcugagccucugcuc

SEQ ID NO: 2647211 - RNA, 20 nt, Human
ugcugagccucugcucccca

SEQ ID NO: 2647212 - RNA, 17 nt, Human
ugcugaggccugggccg

SEQ ID NO: 2647213 - RNA, 13 nt, Human
ugcugaggccugg

SEQ ID NO: 2647214 - RNA, 14 nt, Human
ugcugaggccuggg

SEQ ID NO: 2647215 - RNA, 15 nt, Human
ugcugaggccugggc

SEQ ID NO: 2647216 - RNA, 16 nt, Human
ugcugaggccugggcc

SEQ ID NO: 2647217 - RNA, 19 nt, Human
aggaagcaaauagaagaga

SEQ ID NO: 2647218 - RNA, 14 nt, Human
aggaaggcaagagg

SEQ ID NO: 2647219 - RNA, 13 nt, Human
aggaaggcaagag

SEQ ID NO: 2647220 - RNA, 16 nt, Human
aggaauuacgugcucu

SEQ ID NO: 2647221 - RNA, 16 nt, Human
aggaauguguggccug

SEQ ID NO: 2647222 - RNA, 19 nt, Human
ugccuuuugcaaccaggaa

SEQ ID NO: 2647223 - RNA, 23 nt, Human
ugcggguggggcuuggggcucac

SEQ ID NO: 2647224 - RNA, 20 nt, Human
agcuuaaaggggcuagagug

SEQ ID NO: 2647225 - RNA, 14 nt, Human
agcuuaaugcuaca

SEQ ID NO: 2647226 - RNA, 14 nt, Human
agcuugaccugagg

SEQ ID NO: 2647227 - RNA, 17 nt, Human
agcuuguugacucagcu

SEQ ID NO: 2647228 - RNA, 21 nt, Human
agcuuugcaaacccauuaagg

SEQ ID NO: 2647229 - RNA, 17 nt, Human
agcuuugagaagccuuc

SEQ ID NO: 2647230 - RNA, 19 nt, Human
agcuuugagaagccuucag

SEQ ID NO: 2647231 - RNA, 11 nt, Human
agcugccagug

SEQ ID NO: 2647232 - RNA, 19 nt, Human
agcugccaucgcugugaug

SEQ ID NO: 2647233 - RNA, 19 nt, Human
agcugccaggugagaaacu

SEQ ID NO: 2647234 - RNA, 24 nt, Human
agcugcccacuguuucucuugagc

SEQ ID NO: 2647235 - RNA, 14 nt, Human
agcugccauggcua

SEQ ID NO: 2647236 - RNA, 15 nt, Human
agcugccauggcuag

SEQ ID NO: 2647237 - RNA, 16 nt, Human
agcugcagagauuucu

SEQ ID NO: 2647238 - RNA, 19 nt, Human
agcugcagagauuucucau

SEQ ID NO: 2647239 - RNA, 17 nt, Human
agcugcaauucccugga

SEQ ID NO: 2647240 - RNA, 16 nt, Human
agcugcaaaucugaug

SEQ ID NO: 2647241 - RNA, 18 nt, Human
ugccauagaguacacugc

SEQ ID NO: 2647242 - RNA, 15 nt, Human
ugccauagaguacac

SEQ ID NO: 2647243 - RNA, 14 nt, Human
ugccauagaguaca

SEQ ID NO: 2647244 - RNA, 15 nt, Human
ugccaucagugaaaa

SEQ ID NO: 2647245 - RNA, 14 nt, Human
agcucggcucagcu

SEQ ID NO: 2647246 - RNA, 15 nt, Human
agcucggggagccuu

SEQ ID NO: 2647247 - RNA, 22 nt, Human
agcucgguacccggggcccagg

SEQ ID NO: 2647248 - RNA, 15 nt, Human
agcucgguacccggg

SEQ ID NO: 2647249 - RNA, 16 nt, Human
agcucggggagccuua

SEQ ID NO: 2647250 - RNA, 21 nt, Human
agcucugaccacuugaggccu

SEQ ID NO: 2647251 - RNA, 22 nt, Human
agcucugaccacuugaggccug

SEQ ID NO: 2647252 - RNA, 13 nt, Human
agcucugaaaucu

SEQ ID NO: 2647253 - RNA, 16 nt, Human
agcucugaaaucuucc

SEQ ID NO: 2647254 - RNA, 19 nt, Human
agcuguuacugucuucagu

SEQ ID NO: 2647255 - RNA, 21 nt, Human
ugccuguguccaugcgcucag

SEQ ID NO: 2647256 - RNA, 11 nt, Human
ugccuguggcg

SEQ ID NO: 2647257 - RNA, 21 nt, Human
ugccuguggcgccgucuccag

SEQ ID NO: 2647258 - RNA, 22 nt, Human
ugccuguggcgccgucuccagg

SEQ ID NO: 2647259 - RNA, 23 nt, Human
ugccuguggcgccgucuccaggg

SEQ ID NO: 2647260 - RNA, 15 nt, Human
ugccuguguccaugc

SEQ ID NO: 2647261 - RNA, 19 nt, Human
ugccuguguccaugcgcuc

SEQ ID NO: 2647262 - RNA, 15 nt, Human
ugccuuaagugagga

SEQ ID NO: 2647263 - RNA, 22 nt, Human
ugccuuaagugaggaaaucaaa

SEQ ID NO: 2647264 - RNA, 21 nt, Human
ugccuuaagugaggaaaucaa

SEQ ID NO: 2647265 - RNA, 14 nt, Human
agcuguuacugucu

SEQ ID NO: 2647266 - RNA, 18 nt, Human
agcuguuacugucuucag

SEQ ID NO: 2647267 - RNA, 22 nt, Human
agcuguggucaaggcuacagau

SEQ ID NO: 2647268 - RNA, 15 nt, Human
agcugugcucagaag

SEQ ID NO: 2647269 - RNA, 14 nt, Human
ugccuccaggugca

SEQ ID NO: 2647270 - RNA, 15 nt, Human
ugccuccaggugcag

SEQ ID NO: 2647271 - RNA, 14 nt, Human
agcuggcucaccuu

SEQ ID NO: 2647272 - RNA, 15 nt, Human
agcuggccuggacag

SEQ ID NO: 2647273 - RNA, 16 nt, Human
agcuggccucucuagc

SEQ ID NO: 2647274 - RNA, 18 nt, Human
aggugacccugaugaaaa

SEQ ID NO: 2647275 - RNA, 16 nt, Human
aggugagaagcagagg

SEQ ID NO: 2647276 - RNA, 23 nt, Human
aggugagaagcagaggaaggaga

SEQ ID NO: 2647277 - RNA, 21 nt, Human
aggugagaagcagaggaagga

SEQ ID NO: 2647278 - RNA, 19 nt, Human
aggucuucuuaauauguuc

SEQ ID NO: 2647279 - RNA, 15 nt, Human
agguccagcucugga

SEQ ID NO: 2647280 - RNA, 16 nt, Human
agguccagcucuggag

SEQ ID NO: 2647281 - RNA, 17 nt, Human
agguccagcucuggagg

SEQ ID NO: 2647282 - RNA, 13 nt, Human
agguccagcucug

SEQ ID NO: 2647283 - RNA, 14 nt, Human
agguccagcucugg

SEQ ID NO: 2647284 - RNA, 19 nt, Human
uggugcuuccaaauauugu

SEQ ID NO: 2647285 - RNA, 23 nt, Human
uggugcuucucagauuucugagg

SEQ ID NO: 2647286 - RNA, 19 nt, Human
ugguggcaacauucauugc

SEQ ID NO: 2647287 - RNA, 16 nt, Human
uggugugaacccggga

SEQ ID NO: 2647288 - RNA, 17 nt, Human
uggugugaacccgggag

SEQ ID NO: 2647289 - RNA, 14 nt, Human
ugguuacuucuucu

SEQ ID NO: 2647290 - RNA, 15 nt, Human
ugguuacuucuucuc

SEQ ID NO: 2647291 - RNA, 18 nt, Human
ugguuacuucuucucuua

SEQ ID NO: 2647292 - RNA, 21 nt, Human
ugguuacuucuucucuuagau

SEQ ID NO: 2647293 - RNA, 22 nt, Human
aggugaguuugagcugccuucc

SEQ ID NO: 2647294 - RNA, 20 nt, Human
aggugaguuugagcugccuu

SEQ ID NO: 2647295 - RNA, 21 nt, Human
aggugaguuugagcugccuuc

SEQ ID NO: 2647296 - RNA, 19 nt, Human
aggugaguuugagcugccu

SEQ ID NO: 2647297 - RNA, 13 nt, Human
aggugagaaacug

SEQ ID NO: 2647298 - RNA, 13 nt, Human
uggugccugagag

SEQ ID NO: 2647299 - RNA, 19 nt, Human
uggugccugagaggcaggc

SEQ ID NO: 2647300 - RNA, 20 nt, Human
uggugccugagaggcaggca

SEQ ID NO: 2647301 - RNA, 14 nt, Human
uggugccugagagg

SEQ ID NO: 2647302 - RNA, 15 nt, Human
uggugccugagaggc

SEQ ID NO: 2647303 - RNA, 17 nt, Human
uggugccugagaggcag

SEQ ID NO: 2647304 - RNA, 18 nt, Human
uggugccugagaggcagg

SEQ ID NO: 2647305 - RNA, 19 nt, Human
uggugcugcugcugcugug

SEQ ID NO: 2647306 - RNA, 19 nt, Human
uguaaaguauguauuauuu

SEQ ID NO: 2647307 - RNA, 13 nt, Human
uguaaacuuuuug

SEQ ID NO: 2647308 - RNA, 15 nt, Human
uguaaauaauucuuu

SEQ ID NO: 2647309 - RNA, 14 nt, Human
uguaaauaauucuu

SEQ ID NO: 2647310 - RNA, 23 nt, Human
uguaaauaauucuuuuuuauuaa

SEQ ID NO: 2647311 - RNA, 22 nt, Human
uguaaauaauucuuuuuuauua

SEQ ID NO: 2647312 - RNA, 17 nt, Human
uguaaauaggauuuuua

SEQ ID NO: 2647313 - RNA, 18 nt, Human
uguaaauaggauuuuuag

SEQ ID NO: 2647314 - RNA, 18 nt, Human
ugguuauacaaguucuug

SEQ ID NO: 2647315 - RNA, 14 nt, Human
ugguuauggagagg

SEQ ID NO: 2647316 - RNA, 22 nt, Human
ugguuuccuccauuugagaaaa

SEQ ID NO: 2647317 - RNA, 18 nt, Human
aggugggggcggggagua

SEQ ID NO: 2647318 - RNA, 14 nt, Human
agguuuaagcuguu

SEQ ID NO: 2647319 - RNA, 15 nt, Human
agguucuucagaagu

SEQ ID NO: 2647320 - RNA, 19 nt, Human
agguucuccguuagcuccu

SEQ ID NO: 2647321 - RNA, 20 nt, Human
agguucuccguuagcuccug

SEQ ID NO: 2647322 - RNA, 21 nt, Human
agguucuccguuagcuccugu

SEQ ID NO: 2647323 - RNA, 22 nt, Human
agguucuccguuagcuccugug

SEQ ID NO: 2647324 - RNA, 20 nt, Human
agguguggagccgaggccua

SEQ ID NO: 2647325 - RNA, 21 nt, Human
aggugcccagaauaaguuauu

SEQ ID NO: 2647326 - RNA, 23 nt, Human
aggugccacuuuacccaccuaga

SEQ ID NO: 2647327 - RNA, 15 nt, Human
uguaaauaauuuauu

SEQ ID NO: 2647328 - RNA, 16 nt, Human
uguaugucagaagugc

SEQ ID NO: 2647329 - RNA, 11 nt, Human
uguauguguuu

SEQ ID NO: 2647330 - RNA, 14 nt, Human
uguauguguuuaga

SEQ ID NO: 2647331 - RNA, 12 nt, Human
uguauguguuua

SEQ ID NO: 2647332 - RNA, 20 nt, Human
uguauguguuuagaauugaa

SEQ ID NO: 2647333 - RNA, 19 nt, Human
uguauguguuuagaauuga

SEQ ID NO: 2647334 - RNA, 16 nt, Human
uguauguguuuagaau

SEQ ID NO: 2647335 - RNA, 15 nt, Human
uguauguguuuagaa

SEQ ID NO: 2647336 - RNA, 15 nt, Human
uguauguguguuuuu

SEQ ID NO: 2647337 - RNA, 15 nt, Human
uguauguuaaagaga

SEQ ID NO: 2647338 - RNA, 22 nt, Human
uguauguuaaagagaaugaguc

SEQ ID NO: 2647339 - RNA, 13 nt, Human
uguauguuucucu

SEQ ID NO: 2647340 - RNA, 22 nt, Human
ugucaaaaguagaacuuuguau

SEQ ID NO: 2647341 - RNA, 21 nt, Human
ugucaaaaguagaacuuugua

SEQ ID NO: 2647342 - RNA, 20 nt, Human
ugucaaaaguagaacuuugu

SEQ ID NO: 2647343 - RNA, 17 nt, Human
ugucaaaaguagaacuu

SEQ ID NO: 2647344 - RNA, 12 nt, Human
ugucaaaaguag

SEQ ID NO: 2647345 - RNA, 21 nt, Human
uguauuuuuuuuucuaagaga

SEQ ID NO: 2647346 - RNA, 22 nt, Human
uguauuuuuuuuucuaagagaa

SEQ ID NO: 2647347 - RNA, 13 nt, Human
agucaccucuguc

SEQ ID NO: 2647348 - RNA, 18 nt, Human
agucacacauuacaaagu

SEQ ID NO: 2647349 - RNA, 12 nt, Human
aguauucuucuc

SEQ ID NO: 2647350 - RNA, 14 nt, Human
aguauucuucucuu

SEQ ID NO: 2647351 - RNA, 21 nt, Human
uguagaaaugaugauguggaa

SEQ ID NO: 2647352 - RNA, 20 nt, Human
uguagaaaagaacuggaaac

SEQ ID NO: 2647353 - RNA, 17 nt, Human
agguuuuauaaggcuga

SEQ ID NO: 2647354 - RNA, 22 nt, Human
agguuuacaauaggagugguga

SEQ ID NO: 2647355 - RNA, 20 nt, Human
agguuuuauuucauuuuuca

SEQ ID NO: 2647356 - RNA, 23 nt, Human
agguuuuugauagcauuguaagc

SEQ ID NO: 2647357 - RNA, 23 nt, Human
aguagaccuuguuacuucugagg

SEQ ID NO: 2647358 - RNA, 20 nt, Human
aguagaccuuguuacuucug

SEQ ID NO: 2647359 - RNA, 21 nt, Human
aguagaccuuguuacuucuga

SEQ ID NO: 2647360 - RNA, 17 nt, Human
uguaggcuuaguuugug

SEQ ID NO: 2647361 - RNA, 17 nt, Human
uguaggcaucaugcaug

SEQ ID NO: 2647362 - RNA, 18 nt, Human
uguaggcaucaugcaugu

SEQ ID NO: 2647363 - RNA, 22 nt, Human
aguacccaccaccuucuucucc

SEQ ID NO: 2647364 - RNA, 19 nt, Human
aguacccugguuguguguc

SEQ ID NO: 2647365 - RNA, 18 nt, Human
aguacccugguugugugu

SEQ ID NO: 2647366 - RNA, 12 nt, Human
aguacccugguu

SEQ ID NO: 2647367 - RNA, 19 nt, Human
agggcaccagggguuucuc

SEQ ID NO: 2647368 - RNA, 21 nt, Human
agggcaccagggguuucucgc

SEQ ID NO: 2647369 - RNA, 12 nt, Human
agggcagcugcu

SEQ ID NO: 2647370 - RNA, 13 nt, Human
agggcagcugcua

SEQ ID NO: 2647371 - RNA, 14 nt, Human
agggcaccaggggu

SEQ ID NO: 2647372 - RNA, 23 nt, Human
agggccacugguccccaacaaug

SEQ ID NO: 2647373 - RNA, 19 nt, Human
agggccaugcugaggccug

SEQ ID NO: 2647374 - RNA, 20 nt, Human
agggccaugcugaggccugg

SEQ ID NO: 2647375 - RNA, 21 nt, Human
agggccaugcugaggccuggg

SEQ ID NO: 2647376 - RNA, 22 nt, Human
agggccaugcugaggccugggc

SEQ ID NO: 2647377 - RNA, 23 nt, Human
agggccaugcugaggccugggcc

SEQ ID NO: 2647378 - RNA, 14 nt, Human
agggccauggcuca

SEQ ID NO: 2647379 - RNA, 16 nt, Human
agggccauggcucagg

SEQ ID NO: 2647380 - RNA, 21 nt, Human
agggccauggcucaggguggu

SEQ ID NO: 2647381 - RNA, 19 nt, Human
agggccgacuaagagaagu

SEQ ID NO: 2647382 - RNA, 22 nt, Human
agggccgaccagaggagccuuu

SEQ ID NO: 2647383 - RNA, 20 nt, Human
ugggaggccaaggugggagg

SEQ ID NO: 2647384 - RNA, 19 nt, Human
ugggaggccaaggugggag

SEQ ID NO: 2647385 - RNA, 22 nt, Human
ugggaggaucucuugagccugg

SEQ ID NO: 2647386 - RNA, 21 nt, Human
ugggaggaucucuugagccug

SEQ ID NO: 2647387 - RNA, 20 nt, Human
ugggaggaucucuugagccu

SEQ ID NO: 2647388 - RNA, 12 nt, Human
ugggccccagcu

SEQ ID NO: 2647389 - RNA, 20 nt, Human
ugggccagucuguggaucag

SEQ ID NO: 2647390 - RNA, 16 nt, Human
ugggccagucugugga

SEQ ID NO: 2647391 - RNA, 14 nt, Human
ugggccauguccaa

SEQ ID NO: 2647392 - RNA, 17 nt, Human
ugggccauguccaaaga

SEQ ID NO: 2647393 - RNA, 18 nt, Human
ugggccauguccaaagag

SEQ ID NO: 2647394 - RNA, 19 nt, Human
ugggccauguccaaagagg

SEQ ID NO: 2647395 - RNA, 23 nt, Human
ugggccauguccaaagaggcugc

SEQ ID NO: 2647396 - RNA, 11 nt, Human
agggaggcccc

SEQ ID NO: 2647397 - RNA, 15 nt, Human
agggaggccccaggg

SEQ ID NO: 2647398 - RNA, 16 nt, Human
agggaggccccagggg

SEQ ID NO: 2647399 - RNA, 18 nt, Human
agggaggcgggggcugcc

SEQ ID NO: 2647400 - RNA, 20 nt, Human
agggaggcgggggcugcccu

SEQ ID NO: 2647401 - RNA, 12 nt, Human
agggaagaaacu

SEQ ID NO: 2647402 - RNA, 13 nt, Human
agggaagaaacug

SEQ ID NO: 2647403 - RNA, 14 nt, Human
agggaagaacuauu

SEQ ID NO: 2647404 - RNA, 15 nt, Human
agggaagaacuauug

SEQ ID NO: 2647405 - RNA, 13 nt, Human
agggaacugggga

SEQ ID NO: 2647406 - RNA, 14 nt, Human
agggaaccuguguc

SEQ ID NO: 2647407 - RNA, 20 nt, Human
agggaacaaguugagcuaug

SEQ ID NO: 2647408 - RNA, 21 nt, Human
agggaacaaguugagcuauga

SEQ ID NO: 2647409 - RNA, 21 nt, Human
aggcccuccucucccauccuu

SEQ ID NO: 2647410 - RNA, 23 nt, Human
aggcccuccucucccauccuuga

SEQ ID NO: 2647411 - RNA, 15 nt, Human
agggacacacagccu

SEQ ID NO: 2647412 - RNA, 17 nt, Human
agggacacacagccuag

SEQ ID NO: 2647413 - RNA, 18 nt, Human
agggacacacagccuagc

SEQ ID NO: 2647414 - RNA, 19 nt, Human
agggacacacagccuagca

SEQ ID NO: 2647415 - RNA, 17 nt, Human
agggaaggguuucucua

SEQ ID NO: 2647416 - RNA, 15 nt, Human
agggaauccaagccu

SEQ ID NO: 2647417 - RNA, 16 nt, Human
agggaauccaagccuc

SEQ ID NO: 2647418 - RNA, 19 nt, Human
agggaauccaagccuccac

SEQ ID NO: 2647419 - RNA, 22 nt, Human
agggaauccaagccuccacagc

SEQ ID NO: 2647420 - RNA, 13 nt, Human
agggagagggagg

SEQ ID NO: 2647421 - RNA, 14 nt, Human
agggagagggaggu

SEQ ID NO: 2647422 - RNA, 14 nt, Human
agggagcugggccc

SEQ ID NO: 2647423 - RNA, 15 nt, Human
agggagcugggcccg

SEQ ID NO: 2647424 - RNA, 16 nt, Human
agggagcugggcccga

SEQ ID NO: 2647425 - RNA, 23 nt, Human
agggagagagagagagagaggac

SEQ ID NO: 2647426 - RNA, 22 nt, Human
agggagagagagagagagagga

SEQ ID NO: 2647427 - RNA, 18 nt, Human
ugggaggaucucuugagc

SEQ ID NO: 2647428 - RNA, 16 nt, Human
ugggagagccauacau

SEQ ID NO: 2647429 - RNA, 17 nt, Human
ugggacugcuaaauaaa

SEQ ID NO: 2647430 - RNA, 18 nt, Human
ugggacugcuaaauaaaa

SEQ ID NO: 2647431 - RNA, 17 nt, Human
ugggacucagccuucag

SEQ ID NO: 2647432 - RNA, 23 nt, Human
ugggacucagccuucagacagag

SEQ ID NO: 2647433 - RNA, 18 nt, Human
ugggacucguggcuguca

SEQ ID NO: 2647434 - RNA, 13 nt, Human
ugggacucagccu

SEQ ID NO: 2647435 - RNA, 14 nt, Human
uggggcugcuguga

SEQ ID NO: 2647436 - RNA, 23 nt, Human
uggggucucaaaguuugacagga

SEQ ID NO: 2647437 - RNA, 17 nt, Human
aggggaaggagaaguaa

SEQ ID NO: 2647438 - RNA, 13 nt, Human
aggggaagaauga

SEQ ID NO: 2647439 - RNA, 15 nt, Human
aggggaagaaugaaa

SEQ ID NO: 2647440 - RNA, 22 nt, Human
aggggaaaaucagccugcucca

SEQ ID NO: 2647441 - RNA, 18 nt, Human
aggggaaaaucagccugc

SEQ ID NO: 2647442 - RNA, 13 nt, Human
uggggugcuggga

SEQ ID NO: 2647443 - RNA, 18 nt, Human
uggggugcugggaggagg

SEQ ID NO: 2647444 - RNA, 18 nt, Human
uggggagggauucugguu

SEQ ID NO: 2647445 - RNA, 17 nt, Human
uggggccugaggucauc

SEQ ID NO: 2647446 - RNA, 20 nt, Human
uggggccuccagaacucacu

SEQ ID NO: 2647447 - RNA, 14 nt, Human
uggggccuccagaa

SEQ ID NO: 2647448 - RNA, 21 nt, Human
uggggccuagcgaucucuccu

SEQ ID NO: 2647449 - RNA, 22 nt, Human
uggggccuagcgaucucuccug

SEQ ID NO: 2647450 - RNA, 12 nt, Human
uggggcccagug

SEQ ID NO: 2647451 - RNA, 13 nt, Human
uggggcccagugc

SEQ ID NO: 2647452 - RNA, 14 nt, Human
uggggcccagugca

SEQ ID NO: 2647453 - RNA, 19 nt, Human
uggggcccagugcauggug

SEQ ID NO: 2647454 - RNA, 22 nt, Human
uggggcccagugcaugguggcc

SEQ ID NO: 2647455 - RNA, 22 nt, Human
uggggagggauucugguuccag

SEQ ID NO: 2647456 - RNA, 17 nt, Human
uggggcucacacaccug

SEQ ID NO: 2647457 - RNA, 21 nt, Human
aggggcugcuuccuccuggaa

SEQ ID NO: 2647458 - RNA, 16 nt, Human
agggggcaagaggaau

SEQ ID NO: 2647459 - RNA, 15 nt, Human
aggggcugcuuccuc

SEQ ID NO: 2647460 - RNA, 16 nt, Human
aggggcugcuuccucc

SEQ ID NO: 2647461 - RNA, 18 nt, Human
aggggcugcuuccuccug

SEQ ID NO: 2647462 - RNA, 20 nt, Human
aggggcugcuuccuccugga

SEQ ID NO: 2647463 - RNA, 22 nt, Human
aggguaaauaaaccacugugcg

SEQ ID NO: 2647464 - RNA, 21 nt, Human
agggguaucauguauggugau

SEQ ID NO: 2647465 - RNA, 15 nt, Human
uggguccuuccugaa

SEQ ID NO: 2647466 - RNA, 17 nt, Human
agggugggggagggagg

SEQ ID NO: 2647467 - RNA, 18 nt, Human
agggugggggagggaggu

SEQ ID NO: 2647468 - RNA, 23 nt, Human
aggguggucucuucuuggggccc

SEQ ID NO: 2647469 - RNA, 21 nt, Human
uggguggcaccagcagccugg

SEQ ID NO: 2647470 - RNA, 17 nt, Human
ugguaaagacuggcuuu

SEQ ID NO: 2647471 - RNA, 20 nt, Human
uggguggcaccagcagccug

SEQ ID NO: 2647472 - RNA, 17 nt, Human
uggguggcaccagcagc

SEQ ID NO: 2647473 - RNA, 13 nt, Human
ugguaaauguuuc

SEQ ID NO: 2647474 - RNA, 14 nt, Human
ugguaaauguuucu

SEQ ID NO: 2647475 - RNA, 15 nt, Human
ugguaaauguuucuu

SEQ ID NO: 2647476 - RNA, 20 nt, Human
ugguagagugugccugaagu

SEQ ID NO: 2647477 - RNA, 12 nt, Human
ugguagaaacaa

SEQ ID NO: 2647478 - RNA, 19 nt, Human
ugguagaaguuuggcugcu

SEQ ID NO: 2647479 - RNA, 20 nt, Human
uggucacguuuggugcuucu

SEQ ID NO: 2647480 - RNA, 21 nt, Human
ugguaccaaucaugaaucuuu

SEQ ID NO: 2647481 - RNA, 17 nt, Human
aguucugagcugccagu

SEQ ID NO: 2647482 - RNA, 15 nt, Human
uguuuugcaagugcu

SEQ ID NO: 2647483 - RNA, 20 nt, Human
uguuuugccaaagacuguaa

SEQ ID NO: 2647484 - RNA, 18 nt, Human
aguucugagcugccagug

SEQ ID NO: 2647485 - RNA, 11 nt, Human
uguuuugcaag

SEQ ID NO: 2647486 - RNA, 17 nt, Human
uguuuucugacuaauua

SEQ ID NO: 2647487 - RNA, 16 nt, Human
uguuuucugacuaauu

SEQ ID NO: 2647488 - RNA, 17 nt, Human
uguuuucuuuugguaaa

SEQ ID NO: 2647489 - RNA, 18 nt, Human
uguuugagauucucaaag

SEQ ID NO: 2647490 - RNA, 19 nt, Human
uguuugaaaauaguuuauu

SEQ ID NO: 2647491 - RNA, 18 nt, Human
uguuugaaaauaguuuau

SEQ ID NO: 2647492 - RNA, 17 nt, Human
uguuugaaaauaguuua

SEQ ID NO: 2647493 - RNA, 16 nt, Human
uguuugaaaauaguuu

SEQ ID NO: 2647494 - RNA, 15 nt, Human
uguuucuuuuguuug

SEQ ID NO: 2647495 - RNA, 18 nt, Human
uguuucuuuuguuuggua

SEQ ID NO: 2647496 - RNA, 21 nt, Human
uguuucuuuuguuugguaaau

SEQ ID NO: 2647497 - RNA, 19 nt, Human
uguuugaaaacuucagaag

SEQ ID NO: 2647498 - RNA, 19 nt, Human
uguugcucaaaaaaugagc

SEQ ID NO: 2647499 - RNA, 23 nt, Human
uguugcucaguguuuuugugaau

SEQ ID NO: 2647500 - RNA, 22 nt, Human
uguuuauaaaauauaaacaaag

SEQ ID NO: 2647501 - RNA, 22 nt, Human
uguuuauaucugcaaaaaaccu

SEQ ID NO: 2647502 - RNA, 19 nt, Human
uguuuauaaaucuuaugcu

SEQ ID NO: 2647503 - RNA, 17 nt, Human
uguuuagugauauuaca

SEQ ID NO: 2647504 - RNA, 23 nt, Human
uguuuauaaaauauaaacaaaga

SEQ ID NO: 2647505 - RNA, 16 nt, Human
uguuuauaauaaaaau

SEQ ID NO: 2647506 - RNA, 18 nt, Human
uguuuauguuguuuauaa

SEQ ID NO: 2647507 - RNA, 22 nt, Human
uguuuauguuguuuauaauaaa

SEQ ID NO: 2647508 - RNA, 13 nt, Human
uguuuauuuacaa

SEQ ID NO: 2647509 - RNA, 14 nt, Human
uguuuauuuacaag

SEQ ID NO: 2647510 - RNA, 23 nt, Human
uuaaaauuaucaauaucuaauau

SEQ ID NO: 2647511 - RNA, 16 nt, Human
uuaaaaagaaugacgu

SEQ ID NO: 2647512 - RNA, 18 nt, Human
uuaaaaagggaagaaacu

SEQ ID NO: 2647513 - RNA, 21 nt, Human
uuaaaaagggaagaaacugcu

SEQ ID NO: 2647514 - RNA, 18 nt, Human
uuaaaaacugaaaaaucu

SEQ ID NO: 2647515 - RNA, 18 nt, Human
uuaaaaaccgaauaaaug

SEQ ID NO: 2647516 - RNA, 19 nt, Human
uuaaaaacauaacauaaau

SEQ ID NO: 2647517 - RNA, 16 nt, Human
uuaaaauuuuguaugu

SEQ ID NO: 2647518 - RNA, 13 nt, Human
uuaaaauucaugu

SEQ ID NO: 2647519 - RNA, 14 nt, Human
uuaaauuucuuaug

SEQ ID NO: 2647520 - RNA, 17 nt, Human
uuaaauuucuuauguga

SEQ ID NO: 2647521 - RNA, 18 nt, Human
uuaaauuucuuaugugac

SEQ ID NO: 2647522 - RNA, 19 nt, Human
uuaaauuucuuaugugaca

SEQ ID NO: 2647523 - RNA, 22 nt, Human
uuaaauuucuuaugugacauua

SEQ ID NO: 2647524 - RNA, 15 nt, Human
uuaaauuuaauacca

SEQ ID NO: 2647525 - RNA, 15 nt, Human
uuaacaguuguauuu

SEQ ID NO: 2647526 - RNA, 13 nt, Human
uuaacaguuguau

SEQ ID NO: 2647527 - RNA, 14 nt, Human
aguucuuaguuaua

SEQ ID NO: 2647528 - RNA, 23 nt, Human
aguugcacuuauugaccauuuuu

SEQ ID NO: 2647529 - RNA, 17 nt, Human
aguucuuaugaggaggg

SEQ ID NO: 2647530 - RNA, 20 nt, Human
aguucuuaugaggaggggag

SEQ ID NO: 2647531 - RNA, 21 nt, Human
aguucuuaugaggaggggagg

SEQ ID NO: 2647532 - RNA, 14 nt, Human
aguugcucuaugcu

SEQ ID NO: 2647533 - RNA, 13 nt, Human
aguugcuauuuuu

SEQ ID NO: 2647534 - RNA, 15 nt, Human
aguugcuauuuuugu

SEQ ID NO: 2647535 - RNA, 19 nt, Human
aguugcuauuuuuguaaag

SEQ ID NO: 2647536 - RNA, 23 nt, Human
aguugcuauuuuuguaaaguuuc

SEQ ID NO: 2647537 - RNA, 17 nt, Human
aguugcucuaugcuuuc

SEQ ID NO: 2647538 - RNA, 16 nt, Human
aguugcucuaugcuuu

SEQ ID NO: 2647539 - RNA, 21 nt, Human
aguugcucuaugcuuuccaaa

SEQ ID NO: 2647540 - RNA, 16 nt, Human
aguuggccagagagcc

SEQ ID NO: 2647541 - RNA, 18 nt, Human
aguuguuuuuguauauug

SEQ ID NO: 2647542 - RNA, 17 nt, Human
aguuguuuuuguauauu

SEQ ID NO: 2647543 - RNA, 16 nt, Human
aguuguuuuuguauau

SEQ ID NO: 2647544 - RNA, 15 nt, Human
aguuguuuuuguaua

SEQ ID NO: 2647545 - RNA, 22 nt, Human
aguuguuuuuguauauugguuu

SEQ ID NO: 2647546 - RNA, 20 nt, Human
aguuguuuuuguauauuggu

SEQ ID NO: 2647547 - RNA, 19 nt, Human
aguuguuuuuguauauugg

SEQ ID NO: 2647548 - RNA, 15 nt, Human
aguugggugucuccu

SEQ ID NO: 2647549 - RNA, 16 nt, Human
aguugggugucuccuu

SEQ ID NO: 2647550 - RNA, 12 nt, Human
aguuguaaagua

SEQ ID NO: 2647551 - RNA, 13 nt, Human
aguuguaaaguau

SEQ ID NO: 2647552 - RNA, 18 nt, Human
aguuguaaaguauguauu

SEQ ID NO: 2647553 - RNA, 18 nt, Human
aguuguaaauaauuuauu

SEQ ID NO: 2647554 - RNA, 22 nt, Human
aguuguaaauaauuuauuuaau

SEQ ID NO: 2647555 - RNA, 16 nt, Human
aguuguaccaagugaa

SEQ ID NO: 2647556 - RNA, 17 nt, Human
auaaauguauaaauaua

SEQ ID NO: 2647557 - RNA, 19 nt, Human
auaaauguauaaauauaca

SEQ ID NO: 2647558 - RNA, 20 nt, Human
auaaauguauaaauauacag

SEQ ID NO: 2647559 - RNA, 11 nt, Human
auaaaugaaug

SEQ ID NO: 2647560 - RNA, 19 nt, Human
uuacagcucauuaaacuuu

SEQ ID NO: 2647561 - RNA, 16 nt, Human
auaaagugcuuuaaaa

SEQ ID NO: 2647562 - RNA, 22 nt, Human
auaaaguggaaguauguauauu

SEQ ID NO: 2647563 - RNA, 20 nt, Human
auaaacaccacuggauuaau

SEQ ID NO: 2647564 - RNA, 18 nt, Human
auaaacaccacuggauua

SEQ ID NO: 2647565 - RNA, 19 nt, Human
auaaaguuugcuuagaaaa

SEQ ID NO: 2647566 - RNA, 12 nt, Human
auaaaguuugcu

SEQ ID NO: 2647567 - RNA, 12 nt, Human
auaaauaauuuu

SEQ ID NO: 2647568 - RNA, 21 nt, Human
auaaauagaugcuguguauau

SEQ ID NO: 2647569 - RNA, 22 nt, Human
auaaauaugguuaauuucaugu

SEQ ID NO: 2647570 - RNA, 14 nt, Human
uuacugacauuucu

SEQ ID NO: 2647571 - RNA, 15 nt, Human
uuaccuguauacagu

SEQ ID NO: 2647572 - RNA, 18 nt, Human
uuaccuguauacagugca

SEQ ID NO: 2647573 - RNA, 19 nt, Human
uuaccuguauacagugcag

SEQ ID NO: 2647574 - RNA, 19 nt, Human
uuacaguccaaaauacugu

SEQ ID NO: 2647575 - RNA, 23 nt, Human
uuagaagcacuacaccuugccuu

SEQ ID NO: 2647576 - RNA, 17 nt, Human
uuagaauugaagguuuu

SEQ ID NO: 2647577 - RNA, 16 nt, Human
uuagaauugaagguuu

SEQ ID NO: 2647578 - RNA, 14 nt, Human
uuagaauugaaggu

SEQ ID NO: 2647579 - RNA, 13 nt, Human
uuagaauugaagg

SEQ ID NO: 2647580 - RNA, 15 nt, Human
uuagaacagguuuuu

SEQ ID NO: 2647581 - RNA, 18 nt, Human
uuagaauugaagguuuuu

SEQ ID NO: 2647582 - RNA, 16 nt, Human
uuagacaagagauggg

SEQ ID NO: 2647583 - RNA, 13 nt, Human
uuacugguugcau

SEQ ID NO: 2647584 - RNA, 14 nt, Human
uuacugguugcaug

SEQ ID NO: 2647585 - RNA, 15 nt, Human
uuacugguugcaugg

SEQ ID NO: 2647586 - RNA, 18 nt, Human
uuacugguugcauggaaa

SEQ ID NO: 2647587 - RNA, 19 nt, Human
uuacugguugcauggaaau

SEQ ID NO: 2647588 - RNA, 14 nt, Human
uuacugggcccuga

SEQ ID NO: 2647589 - RNA, 22 nt, Human
uuacuggggcuggggaaggaag

SEQ ID NO: 2647590 - RNA, 23 nt, Human
uuacuggggcuggggaaggaagc

SEQ ID NO: 2647591 - RNA, 16 nt, Human
auaaacaaagauucau

SEQ ID NO: 2647592 - RNA, 16 nt, Human
auaaaauuuguugcau

SEQ ID NO: 2647593 - RNA, 13 nt, Human
auaaaauuuguug

SEQ ID NO: 2647594 - RNA, 12 nt, Human
auaaaauuuaaa

SEQ ID NO: 2647595 - RNA, 20 nt, Human
auaaaauuuaaaaaauaaau

SEQ ID NO: 2647596 - RNA, 23 nt, Human
uuaauuuaaguuuugacaagcug

SEQ ID NO: 2647597 - RNA, 22 nt, Human
uuacaaaaacaaaauaaaauaa

SEQ ID NO: 2647598 - RNA, 13 nt, Human
uuaauuuaaguuu

SEQ ID NO: 2647599 - RNA, 16 nt, Human
uuaauuuaaguuuuga

SEQ ID NO: 2647600 - RNA, 15 nt, Human
uuaauuuaaguuuug

SEQ ID NO: 2647601 - RNA, 12 nt, Human
uuaauuguuuaa

SEQ ID NO: 2647602 - RNA, 13 nt, Human
uuaauuguuuaaa

SEQ ID NO: 2647603 - RNA, 12 nt, Human
uuaaguucuuau

SEQ ID NO: 2647604 - RNA, 16 nt, Human
auaaaauggcuguaau

SEQ ID NO: 2647605 - RNA, 23 nt, Human
uuaagugaggaaaucaaagugcu

SEQ ID NO: 2647606 - RNA, 20 nt, Human
uuaagugaggaaaucaaagu

SEQ ID NO: 2647607 - RNA, 19 nt, Human
uuaagugaggaaaucaaag

SEQ ID NO: 2647608 - RNA, 17 nt, Human
uuaagugaggaaaucaa

SEQ ID NO: 2647609 - RNA, 16 nt, Human
uuaagugaggaaauca

SEQ ID NO: 2647610 - RNA, 13 nt, Human
auaaaaugaaaau

SEQ ID NO: 2647611 - RNA, 16 nt, Human
auaaaaugaaaauugu

SEQ ID NO: 2647612 - RNA, 17 nt, Human
auaaaaugaaaauugua

SEQ ID NO: 2647613 - RNA, 18 nt, Human
auaaaaugaaaauuguau

SEQ ID NO: 2647614 - RNA, 19 nt, Human
auaaaaugaaaauuguauu

SEQ ID NO: 2647615 - RNA, 14 nt, Human
auaaaauccugugc

SEQ ID NO: 2647616 - RNA, 16 nt, Human
auaaaauccugugcaa

SEQ ID NO: 2647617 - RNA, 17 nt, Human
auaaaauguaauuacuu

SEQ ID NO: 2647618 - RNA, 23 nt, Human
auaaaauguccaguaagaucacu

SEQ ID NO: 2647619 - RNA, 21 nt, Human
auaaaauguccaguaagauca

SEQ ID NO: 2647620 - RNA, 19 nt, Human
auaaaauguccaguaagau

SEQ ID NO: 2647621 - RNA, 23 nt, Human
ugucagacagaacuugaaugugu

SEQ ID NO: 2647622 - RNA, 21 nt, Human
ugucuugggcagagcuggcuc

SEQ ID NO: 2647623 - RNA, 22 nt, Human
ugucuugggcagagcuggcucu

SEQ ID NO: 2647624 - RNA, 12 nt, Human
ugucuugggcag

SEQ ID NO: 2647625 - RNA, 13 nt, Human
ugucuugggcaga

SEQ ID NO: 2647626 - RNA, 16 nt, Human
ugucuugggcagagcu

SEQ ID NO: 2647627 - RNA, 21 nt, Human
ugucagacagaacuugaaugu

SEQ ID NO: 2647628 - RNA, 12 nt, Human
ugucagaagugc

SEQ ID NO: 2647629 - RNA, 17 nt, Human
ugucagaagugcagaau

SEQ ID NO: 2647630 - RNA, 12 nt, Human
ugucacuuuuua

SEQ ID NO: 2647631 - RNA, 16 nt, Human
ugucacuuuuuaugcu

SEQ ID NO: 2647632 - RNA, 13 nt, Human
ugugaaauugcau

SEQ ID NO: 2647633 - RNA, 18 nt, Human
ugugaaauugcauacuuu

SEQ ID NO: 2647634 - RNA, 11 nt, Human
ugugacccucc

SEQ ID NO: 2647635 - RNA, 13 nt, Human
ugugacccuccaa

SEQ ID NO: 2647636 - RNA, 15 nt, Human
ugugacccuccaaau

SEQ ID NO: 2647637 - RNA, 17 nt, Human
ugugacccuccaaaugg

SEQ ID NO: 2647638 - RNA, 18 nt, Human
ugugaacuuggaagcaca

SEQ ID NO: 2647639 - RNA, 15 nt, Human
ugugaacuuggaagc

SEQ ID NO: 2647640 - RNA, 23 nt, Human
ugugaacaagcuucaguaaguua

SEQ ID NO: 2647641 - RNA, 15 nt, Human
ugugaacagagagac

SEQ ID NO: 2647642 - RNA, 23 nt, Human
ugugaacagagagacccuugugg

SEQ ID NO: 2647643 - RNA, 13 nt, Human
ugugagagaaagu

SEQ ID NO: 2647644 - RNA, 15 nt, Human
agucuuucauggcug

SEQ ID NO: 2647645 - RNA, 17 nt, Human
agucuuucauggcugcu

SEQ ID NO: 2647646 - RNA, 12 nt, Human
agugaaacuuuu

SEQ ID NO: 2647647 - RNA, 15 nt, Human
agugaaacuuuucua

SEQ ID NO: 2647648 - RNA, 17 nt, Human
agucuuugccagucauu

SEQ ID NO: 2647649 - RNA, 22 nt, Human
agucuuugccagucauucagca

SEQ ID NO: 2647650 - RNA, 17 nt, Human
agugaaauuauuuugga

SEQ ID NO: 2647651 - RNA, 12 nt, Human
ugugccaucugu

SEQ ID NO: 2647652 - RNA, 13 nt, Human
ugugccaucugua

SEQ ID NO: 2647653 - RNA, 14 nt, Human
ugugauuucuuuaa

SEQ ID NO: 2647654 - RNA, 19 nt, Human
ugugauuucuuuaaaagaa

SEQ ID NO: 2647655 - RNA, 21 nt, Human
ugugauuucuuuaaaagaaug

SEQ ID NO: 2647656 - RNA, 22 nt, Human
ugugauuucuuuaaaagaauga

SEQ ID NO: 2647657 - RNA, 17 nt, Human
ugugccaccaugccuca

SEQ ID NO: 2647658 - RNA, 20 nt, Human
ugugccagaggaauccuggc

SEQ ID NO: 2647659 - RNA, 21 nt, Human
ugugccagaggaauccuggca

SEQ ID NO: 2647660 - RNA, 22 nt, Human
ugugccagaggaauccuggcag

SEQ ID NO: 2647661 - RNA, 23 nt, Human
ugugccagaggaauccuggcagc

SEQ ID NO: 2647662 - RNA, 21 nt, Human
ugugccacuaaacuacauugu

SEQ ID NO: 2647663 - RNA, 21 nt, Human
ugugcugggagcuccacucug

SEQ ID NO: 2647664 - RNA, 11 nt, Human
uguggcagugg

SEQ ID NO: 2647665 - RNA, 12 nt, Human
uguggcaguggu

SEQ ID NO: 2647666 - RNA, 15 nt, Human
uguggcagugguuuu

SEQ ID NO: 2647667 - RNA, 16 nt, Human
uguggcagugguuuug

SEQ ID NO: 2647668 - RNA, 23 nt, Human
uguggcauaaauugcaucacugu

SEQ ID NO: 2647669 - RNA, 21 nt, Human
ugugcccagaauacugaugga

SEQ ID NO: 2647670 - RNA, 18 nt, Human
ugugcccagaauacugau

SEQ ID NO: 2647671 - RNA, 17 nt, Human
ugugcccagaauacuga

SEQ ID NO: 2647672 - RNA, 10 nt, Human
ugugcuggga

SEQ ID NO: 2647673 - RNA, 12 nt, Human
ugugcugggagc

SEQ ID NO: 2647674 - RNA, 17 nt, Human
ugugcugggagcuccac

SEQ ID NO: 2647675 - RNA, 12 nt, Human
uguggccaggcu

SEQ ID NO: 2647676 - RNA, 20 nt, Human
ugugucuuuggaggugcugc

SEQ ID NO: 2647677 - RNA, 18 nt, Human
uguguucucggagugugu

SEQ ID NO: 2647678 - RNA, 14 nt, Human
uguuaaaugaaacc

SEQ ID NO: 2647679 - RNA, 16 nt, Human
uguuaauuuaaguuuu

SEQ ID NO: 2647680 - RNA, 15 nt, Human
uguuaauuuaaguuu

SEQ ID NO: 2647681 - RNA, 16 nt, Human
uguucccacaccccaa

SEQ ID NO: 2647682 - RNA, 21 nt, Human
uguucuggggggacccagugc

SEQ ID NO: 2647683 - RNA, 22 nt, Human
uguucuggggggacccagugca

SEQ ID NO: 2647684 - RNA, 23 nt, Human
uguucuggggggacccagugcag

SEQ ID NO: 2647685 - RNA, 19 nt, Human
uguucugugguuccucugc

SEQ ID NO: 2647686 - RNA, 23 nt, Human
uguucugugguuccucugcucac

SEQ ID NO: 2647687 - RNA, 15 nt, Human
uguugcaagauguga

SEQ ID NO: 2647688 - RNA, 16 nt, Human
uguugcaagaugugaa

SEQ ID NO: 2647689 - RNA, 17 nt, Human
uguugcaagaugugaau

SEQ ID NO: 2647690 - RNA, 18 nt, Human
uguugcaagaugugaauu

SEQ ID NO: 2647691 - RNA, 19 nt, Human
uguugcaagaugugaauua

SEQ ID NO: 2647692 - RNA, 23 nt, Human
uguugcaagaugugaauuauuga

SEQ ID NO: 2647693 - RNA, 22 nt, Human
uguugauuuuuacuguguuuua

SEQ ID NO: 2647694 - RNA, 18 nt, Human
uguugauuuuuacugugu

SEQ ID NO: 2647695 - RNA, 20 nt, Human
uguugauuuuuacuguguuu

SEQ ID NO: 2647696 - RNA, 22 nt, Human
aguguagaaaagaacuggaaac

SEQ ID NO: 2647697 - RNA, 14 nt, Human
aguguaaaauauuu

SEQ ID NO: 2647698 - RNA, 18 nt, Human
aguguaaaauauuuugaa

SEQ ID NO: 2647699 - RNA, 21 nt, Human
aguguaaaauauuuugaauca

SEQ ID NO: 2647700 - RNA, 20 nt, Human
aguggaaguauguauauuaa

SEQ ID NO: 2647701 - RNA, 21 nt, Human
aguggaaguauguauauuaaa

SEQ ID NO: 2647702 - RNA, 22 nt, Human
aguggaaguauguauauuaaaa

SEQ ID NO: 2647703 - RNA, 14 nt, Human
aguggugggggaag

SEQ ID NO: 2647704 - RNA, 16 nt, Human
aguggugggggaaggc

SEQ ID NO: 2647705 - RNA, 21 nt, Human
auauuguugacaacugugacu

SEQ ID NO: 2647706 - RNA, 15 nt, Human
auauuguugacaacu

SEQ ID NO: 2647707 - RNA, 13 nt, Human
auauuguugacaa

SEQ ID NO: 2647708 - RNA, 15 nt, Human
auauugcaaaauaca

SEQ ID NO: 2647709 - RNA, 16 nt, Human
auauugcaaaauacau

SEQ ID NO: 2647710 - RNA, 18 nt, Human
auauugcaaaauacauga

SEQ ID NO: 2647711 - RNA, 19 nt, Human
auauugcaaaauacaugaa

SEQ ID NO: 2647712 - RNA, 23 nt, Human
auauugcaaaauacaugaagcuu

SEQ ID NO: 2647713 - RNA, 14 nt, Human
auauuugaaggguc

SEQ ID NO: 2647714 - RNA, 15 nt, Human
auauuuguaaagcua

SEQ ID NO: 2647715 - RNA, 16 nt, Human
auauuuguaaagcuau

SEQ ID NO: 2647716 - RNA, 15 nt, Human
auauuccagaucuuu

SEQ ID NO: 2647717 - RNA, 17 nt, Human
auauuccagaucuuuca

SEQ ID NO: 2647718 - RNA, 21 nt, Human
auauuccagaucuuucagaaa

SEQ ID NO: 2647719 - RNA, 15 nt, Human
auauugauugggaaa

SEQ ID NO: 2647720 - RNA, 19 nt, Human
auauugauugggaaaacau

SEQ ID NO: 2647721 - RNA, 21 nt, Human
auauugauugggaaaacauuu

SEQ ID NO: 2647722 - RNA, 15 nt, Human
auauucuuucaaagg

SEQ ID NO: 2647723 - RNA, 12 nt, Human
auauugaacuuu

SEQ ID NO: 2647724 - RNA, 18 nt, Human
auauugaacuuuuguacu

SEQ ID NO: 2647725 - RNA, 20 nt, Human
auauugaacuuuuguacuga

SEQ ID NO: 2647726 - RNA, 17 nt, Human
auauguuuuuaaaggug

SEQ ID NO: 2647727 - RNA, 22 nt, Human
auauuaaggaagacaaugugaa

SEQ ID NO: 2647728 - RNA, 15 nt, Human
uuccucuugucugau

SEQ ID NO: 2647729 - RNA, 14 nt, Human
uuccuguucaguaa

SEQ ID NO: 2647730 - RNA, 19 nt, Human
uuccuguucaguaauaaaa

SEQ ID NO: 2647731 - RNA, 17 nt, Human
uuccucuagaagccaag

SEQ ID NO: 2647732 - RNA, 17 nt, Human
uuccucuaguucuuugu

SEQ ID NO: 2647733 - RNA, 14 nt, Human
uuccucugcucacc

SEQ ID NO: 2647734 - RNA, 15 nt, Human
uuccucuagaagcca

SEQ ID NO: 2647735 - RNA, 14 nt, Human
uuccuccuggaaau

SEQ ID NO: 2647736 - RNA, 20 nt, Human
auauuuuaugugagagaaag

SEQ ID NO: 2647737 - RNA, 15 nt, Human
auauuuuauuacugu

SEQ ID NO: 2647738 - RNA, 16 nt, Human
auauuuuauuacuguu

SEQ ID NO: 2647739 - RNA, 15 nt, Human
auauuuuaugugaga

SEQ ID NO: 2647740 - RNA, 14 nt, Human
auauuuuauauuac

SEQ ID NO: 2647741 - RNA, 14 nt, Human
auauuuuaugguua

SEQ ID NO: 2647742 - RNA, 15 nt, Human
auauuuuaugguuau

SEQ ID NO: 2647743 - RNA, 19 nt, Human
auauuuuaugguuauguuu

SEQ ID NO: 2647744 - RNA, 16 nt, Human
auauuuuaaccugcau

SEQ ID NO: 2647745 - RNA, 19 nt, Human
auauuuuaaccugcauaaa

SEQ ID NO: 2647746 - RNA, 18 nt, Human
aucaauaucuaauauaua

SEQ ID NO: 2647747 - RNA, 15 nt, Human
aucaauaucuaauau

SEQ ID NO: 2647748 - RNA, 19 nt, Human
aucaauacacuaguuguuu

SEQ ID NO: 2647749 - RNA, 15 nt, Human
aucaaucaaauaagu

SEQ ID NO: 2647750 - RNA, 13 nt, Human
aucaaucaaauaa

SEQ ID NO: 2647751 - RNA, 16 nt, Human
aucaauaauauauuuu

SEQ ID NO: 2647752 - RNA, 18 nt, Human
aucaauaauauauuuucu

SEQ ID NO: 2647753 - RNA, 20 nt, Human
aucaauaauauauuuucugu

SEQ ID NO: 2647754 - RNA, 21 nt, Human
aucaauaauauauuuucuguu

SEQ ID NO: 2647755 - RNA, 12 nt, Human
aucaauacacua

SEQ ID NO: 2647756 - RNA, 17 nt, Human
aucaauacacuaguugu

SEQ ID NO: 2647757 - RNA, 12 nt, Human
auauuuugaauc

SEQ ID NO: 2647758 - RNA, 13 nt, Human
auauuuugaauca

SEQ ID NO: 2647759 - RNA, 19 nt, Human
auauuuugaaucaauaaua

SEQ ID NO: 2647760 - RNA, 14 nt, Human
auauuuugaaucaa

SEQ ID NO: 2647761 - RNA, 21 nt, Human
aucaagagccuuaaaacauca

SEQ ID NO: 2647762 - RNA, 15 nt, Human
aucaagagccuuaaa

SEQ ID NO: 2647763 - RNA, 18 nt, Human
aucaagagccuuaaaaca

SEQ ID NO: 2647764 - RNA, 16 nt, Human
aucaagagccuuaaaa

SEQ ID NO: 2647765 - RNA, 17 nt, Human
aucaagaagacuuuagg

SEQ ID NO: 2647766 - RNA, 21 nt, Human
aucaagaagacuuuaggaaug

SEQ ID NO: 2647767 - RNA, 14 nt, Human
aucaagagccuuaa

SEQ ID NO: 2647768 - RNA, 19 nt, Human
aucaaucaaauaaguauuu

SEQ ID NO: 2647769 - RNA, 11 nt, Human
aucacaaauga

SEQ ID NO: 2647770 - RNA, 13 nt, Human
aucacaaaugacu

SEQ ID NO: 2647771 - RNA, 12 nt, Human
aucacaaaugac

SEQ ID NO: 2647772 - RNA, 20 nt, Human
aucacaaaugacuuuauuau

SEQ ID NO: 2647773 - RNA, 19 nt, Human
aucacaaaugacuuuauua

SEQ ID NO: 2647774 - RNA, 16 nt, Human
aucacaaaugacuuua

SEQ ID NO: 2647775 - RNA, 15 nt, Human
aucacaaaugacuuu

SEQ ID NO: 2647776 - RNA, 14 nt, Human
aucacaaaugacuu

SEQ ID NO: 2647777 - RNA, 15 nt, Human
aucacuguuuagauu

SEQ ID NO: 2647778 - RNA, 20 nt, Human
aucacuguguauauuugauu

SEQ ID NO: 2647779 - RNA, 23 nt, Human
aucacuacaguauuacucuuaca

SEQ ID NO: 2647780 - RNA, 14 nt, Human
aucacuguuuagau

SEQ ID NO: 2647781 - RNA, 19 nt, Human
aucacuguguauauuugau

SEQ ID NO: 2647782 - RNA, 18 nt, Human
aucacuguguauauuuga

SEQ ID NO: 2647783 - RNA, 17 nt, Human
aucacuguguauauuug

SEQ ID NO: 2647784 - RNA, 15 nt, Human
aucacuguguauauu

SEQ ID NO: 2647785 - RNA, 18 nt, Human
aucacuguaucauuuucu

SEQ ID NO: 2647786 - RNA, 19 nt, Human
aucacuguaucauuuucuu

SEQ ID NO: 2647787 - RNA, 12 nt, Human
uuccuuuuauca

SEQ ID NO: 2647788 - RNA, 14 nt, Human
uuccuuuucccugc

SEQ ID NO: 2647789 - RNA, 15 nt, Human
uuccuuuucccugcu

SEQ ID NO: 2647790 - RNA, 16 nt, Human
aucacuguuuagauuu

SEQ ID NO: 2647791 - RNA, 11 nt, Human
uucugguaauc

SEQ ID NO: 2647792 - RNA, 15 nt, Human
uucugguacuuucug

SEQ ID NO: 2647793 - RNA, 17 nt, Human
uucugguacuuucuguu

SEQ ID NO: 2647794 - RNA, 22 nt, Human
uucuggucaagggcugucauug

SEQ ID NO: 2647795 - RNA, 22 nt, Human
uucugccagauguccuaauggu

SEQ ID NO: 2647796 - RNA, 15 nt, Human
uucugccgcccccuc

SEQ ID NO: 2647797 - RNA, 21 nt, Human
uucugccgcccccuccugaac

SEQ ID NO: 2647798 - RNA, 22 nt, Human
uucugccgcccccuccugaacc

SEQ ID NO: 2647799 - RNA, 21 nt, Human
uucugccacccugcugagucu

SEQ ID NO: 2647800 - RNA, 19 nt, Human
uucugcauucauuuuuaua

SEQ ID NO: 2647801 - RNA, 21 nt, Human
uucugcauucauuuuuauagc

SEQ ID NO: 2647802 - RNA, 18 nt, Human
uucucuuagcaacucaga

SEQ ID NO: 2647803 - RNA, 23 nt, Human
aucauuccuuuuuauuuauaugu

SEQ ID NO: 2647804 - RNA, 14 nt, Human
aucccaagccuccu

SEQ ID NO: 2647805 - RNA, 22 nt, Human
aucccaaccaggcaccucuucc

SEQ ID NO: 2647806 - RNA, 15 nt, Human
uucuguacuguuacu

SEQ ID NO: 2647807 - RNA, 21 nt, Human
uucuguacuguuacugggccc

SEQ ID NO: 2647808 - RNA, 23 nt, Human
aucccucuaaugagacugaccau

SEQ ID NO: 2647809 - RNA, 15 nt, Human
aucccucuccuaacu

SEQ ID NO: 2647810 - RNA, 20 nt, Human
aucccuguguuaauuuaagu

SEQ ID NO: 2647811 - RNA, 15 nt, Human
aucccuguguuaauu

SEQ ID NO: 2647812 - RNA, 17 nt, Human
uucuauaaauagaugcu

SEQ ID NO: 2647813 - RNA, 13 nt, Human
uucuaguuuuguc

SEQ ID NO: 2647814 - RNA, 21 nt, Human
uucuauaaaacucugcaugua

SEQ ID NO: 2647815 - RNA, 11 nt, Human
uucucaaugaa

SEQ ID NO: 2647816 - RNA, 12 nt, Human
uucucaaugaaa

SEQ ID NO: 2647817 - RNA, 13 nt, Human
uucucaaugaaaa

SEQ ID NO: 2647818 - RNA, 14 nt, Human
uucucaaugaaaaa

SEQ ID NO: 2647819 - RNA, 18 nt, Human
uucucaaugaaaaauagu

SEQ ID NO: 2647820 - RNA, 16 nt, Human
uuccuuuucccugcuu

SEQ ID NO: 2647821 - RNA, 17 nt, Human
uuccuuuucccugcuuc

SEQ ID NO: 2647822 - RNA, 18 nt, Human
uuccuuuuuauuuauaug

SEQ ID NO: 2647823 - RNA, 13 nt, Human
uucuaggccuggg

SEQ ID NO: 2647824 - RNA, 20 nt, Human
uuccuuuuuauuuauaugua

SEQ ID NO: 2647825 - RNA, 15 nt, Human
uuccuuuuugacacu

SEQ ID NO: 2647826 - RNA, 16 nt, Human
uuccuuuuugacacug

SEQ ID NO: 2647827 - RNA, 17 nt, Human
uuccuuuuugacacuga

SEQ ID NO: 2647828 - RNA, 18 nt, Human
uuccuuuuugacacugaa

SEQ ID NO: 2647829 - RNA, 16 nt, Human
uuccuuuuuucaaaau

SEQ ID NO: 2647830 - RNA, 22 nt, Human
aucagagaugcaccaccaagcc

SEQ ID NO: 2647831 - RNA, 22 nt, Human
aucagagacaaaauauuuccca

SEQ ID NO: 2647832 - RNA, 21 nt, Human
aucauuccuuuuuauuuauau

SEQ ID NO: 2647833 - RNA, 20 nt, Human
aucauuccuuuuuauuuaua

SEQ ID NO: 2647834 - RNA, 15 nt, Human
aucauuccuuuuuau

SEQ ID NO: 2647835 - RNA, 14 nt, Human
aucauuccuuuuua

SEQ ID NO: 2647836 - RNA, 12 nt, Human
aucauucaagug

SEQ ID NO: 2647837 - RNA, 12 nt, Human
aucauucagaaa

SEQ ID NO: 2647838 - RNA, 13 nt, Human
aucauucagaaau

SEQ ID NO: 2647839 - RNA, 14 nt, Human
aucauucagaaaug

SEQ ID NO: 2647840 - RNA, 16 nt, Human
aucauucagaaauguu

SEQ ID NO: 2647841 - RNA, 16 nt, Human
aucauguugaucaugu

SEQ ID NO: 2647842 - RNA, 19 nt, Human
aucauguugaucauguacu

SEQ ID NO: 2647843 - RNA, 21 nt, Human
aucauaggcaccuuuuacugu

SEQ ID NO: 2647844 - RNA, 22 nt, Human
aucauaggcaccuuuuacugug

SEQ ID NO: 2647845 - RNA, 23 nt, Human
aucauaggcaccuuuuacuguga

SEQ ID NO: 2647846 - RNA, 21 nt, Human
uuauuuauauggggaauauau

SEQ ID NO: 2647847 - RNA, 13 nt, Human
uuauuuauaugua

SEQ ID NO: 2647848 - RNA, 14 nt, Human
uuauuuauauguac

SEQ ID NO: 2647849 - RNA, 15 nt, Human
uuauuuauauguacu

SEQ ID NO: 2647850 - RNA, 14 nt, Human
uuauuuauauguau

SEQ ID NO: 2647851 - RNA, 21 nt, Human
uuauuuauauguacuguuuua

SEQ ID NO: 2647852 - RNA, 17 nt, Human
uuauuuauauguacugu

SEQ ID NO: 2647853 - RNA, 18 nt, Human
uuauuuauauguacuguu

SEQ ID NO: 2647854 - RNA, 16 nt, Human
uuauuuaguuccuuga

SEQ ID NO: 2647855 - RNA, 13 nt, Human
uuauuuacauuua

SEQ ID NO: 2647856 - RNA, 15 nt, Human
uuauuuacauuuaau

SEQ ID NO: 2647857 - RNA, 20 nt, Human
uuauuuacagaugaauguau

SEQ ID NO: 2647858 - RNA, 15 nt, Human
uuauuuacagaugaa

SEQ ID NO: 2647859 - RNA, 14 nt, Human
uuauuuagacaaga

SEQ ID NO: 2647860 - RNA, 16 nt, Human
uuauuuacauuuaaua

SEQ ID NO: 2647861 - RNA, 15 nt, Human
uuauuuagacaagag

SEQ ID NO: 2647862 - RNA, 16 nt, Human
uuauuuagacaagaga

SEQ ID NO: 2647863 - RNA, 18 nt, Human
uuauuuagacaagagaug

SEQ ID NO: 2647864 - RNA, 14 nt, Human
uuauuucacuugau

SEQ ID NO: 2647865 - RNA, 23 nt, Human
uuauuucaaaauauacauucaaa

SEQ ID NO: 2647866 - RNA, 15 nt, Human
uuauuuccacuaaaa

SEQ ID NO: 2647867 - RNA, 18 nt, Human
uuauuuccacuaaaaaua

SEQ ID NO: 2647868 - RNA, 19 nt, Human
uuauuuccacuaaaaauau

SEQ ID NO: 2647869 - RNA, 22 nt, Human
uuauuuauccagaaaacuguga

SEQ ID NO: 2647870 - RNA, 23 nt, Human
uuauuuauccagaaaacugugau

SEQ ID NO: 2647871 - RNA, 17 nt, Human
uuauuuauauuuauuga

SEQ ID NO: 2647872 - RNA, 16 nt, Human
uuauuuauauuuauug

SEQ ID NO: 2647873 - RNA, 15 nt, Human
uuauuuauauuuauu

SEQ ID NO: 2647874 - RNA, 16 nt, Human
uuauuuauauguaugu

SEQ ID NO: 2647875 - RNA, 15 nt, Human
uuauuuauauguaug

SEQ ID NO: 2647876 - RNA, 16 nt, Human
uuauuuauguacuuuu

SEQ ID NO: 2647877 - RNA, 13 nt, Human
uuauuuauguacu

SEQ ID NO: 2647878 - RNA, 14 nt, Human
uuauuguuaauaca

SEQ ID NO: 2647879 - RNA, 12 nt, Human
uuauuuaaauua

SEQ ID NO: 2647880 - RNA, 14 nt, Human
uuauuuaagacuaa

SEQ ID NO: 2647881 - RNA, 15 nt, Human
uuauuuaagacuaaa

SEQ ID NO: 2647882 - RNA, 23 nt, Human
auagcuccccgcuucugccugca

SEQ ID NO: 2647883 - RNA, 20 nt, Human
auagcuccccgcuucugccu

SEQ ID NO: 2647884 - RNA, 11 nt, Human
auagccuggac

SEQ ID NO: 2647885 - RNA, 18 nt, Human
auagccuggacugcuacc

SEQ ID NO: 2647886 - RNA, 14 nt, Human
auagcuaacuguaa

SEQ ID NO: 2647887 - RNA, 15 nt, Human
auagcuaacuguaaa

SEQ ID NO: 2647888 - RNA, 16 nt, Human
auagcuaacuguaaau

SEQ ID NO: 2647889 - RNA, 17 nt, Human
auagcuaacuguaaauc

SEQ ID NO: 2647890 - RNA, 18 nt, Human
auagccugccucuucucu

SEQ ID NO: 2647891 - RNA, 18 nt, Human
auaacuuuuacacgacca

SEQ ID NO: 2647892 - RNA, 15 nt, Human
uucacaguagagcca

SEQ ID NO: 2647893 - RNA, 17 nt, Human
uucacaguagagccagc

SEQ ID NO: 2647894 - RNA, 18 nt, Human
uucacaguagagccagcu

SEQ ID NO: 2647895 - RNA, 20 nt, Human
uucacaguagagccagcuug

SEQ ID NO: 2647896 - RNA, 19 nt, Human
uucacaguagagccagcuu

SEQ ID NO: 2647897 - RNA, 17 nt, Human
uucacauuguuaagaaa

SEQ ID NO: 2647898 - RNA, 21 nt, Human
uucacauuguuaagaaaaaua

SEQ ID NO: 2647899 - RNA, 17 nt, Human
auagcuugcagaacugu

SEQ ID NO: 2647900 - RNA, 13 nt, Human
uucaccauucgua

SEQ ID NO: 2647901 - RNA, 17 nt, Human
uucaccaucaauccuga

SEQ ID NO: 2647902 - RNA, 19 nt, Human
uucaccaucaauccugauu

SEQ ID NO: 2647903 - RNA, 21 nt, Human
auaggaguggugauuugaaaa

SEQ ID NO: 2647904 - RNA, 17 nt, Human
auagggaauauaucucu

SEQ ID NO: 2647905 - RNA, 19 nt, Human
auaggaugggcuucugugc

SEQ ID NO: 2647906 - RNA, 18 nt, Human
auaggaaucauucagaaa

SEQ ID NO: 2647907 - RNA, 20 nt, Human
auaggaaucauucagaaaug

SEQ ID NO: 2647908 - RNA, 21 nt, Human
auaggaaucauucagaaaugu

SEQ ID NO: 2647909 - RNA, 16 nt, Human
auaggauuuuuagaau

SEQ ID NO: 2647910 - RNA, 15 nt, Human
auaggcaccuuuuac

SEQ ID NO: 2647911 - RNA, 19 nt, Human
auaggcaccuuuuacugug

SEQ ID NO: 2647912 - RNA, 20 nt, Human
auaggcaccuuuuacuguga

SEQ ID NO: 2647913 - RNA, 15 nt, Human
uucaacugucuuccu

SEQ ID NO: 2647914 - RNA, 19 nt, Human
uucaacugucuuccucaaa

SEQ ID NO: 2647915 - RNA, 21 nt, Human
uucaaacuggggccuccagaa

SEQ ID NO: 2647916 - RNA, 16 nt, Human
uucaaacuggggccuc

SEQ ID NO: 2647917 - RNA, 15 nt, Human
uucaaacuggggccu

SEQ ID NO: 2647918 - RNA, 15 nt, Human
uucaaaauccaaaaa

SEQ ID NO: 2647919 - RNA, 17 nt, Human
uuauuuccuuuguccuu

SEQ ID NO: 2647920 - RNA, 19 nt, Human
uuauuuuuuuuaauuguau

SEQ ID NO: 2647921 - RNA, 13 nt, Human
uuauuuuuuugaa

SEQ ID NO: 2647922 - RNA, 24 nt, Human
uucaaggggagccaaaaucucaag

SEQ ID NO: 2647923 - RNA, 22 nt, Human
uucaaguuguaaauaauuuauu

SEQ ID NO: 2647924 - RNA, 19 nt, Human
uucaaguguaaaauauuuu

SEQ ID NO: 2647925 - RNA, 18 nt, Human
auaguuuggcauuugcac

SEQ ID NO: 2647926 - RNA, 14 nt, Human
auaguuuggcauuu

SEQ ID NO: 2647927 - RNA, 17 nt, Human
auaguuuggcauuugca

SEQ ID NO: 2647928 - RNA, 12 nt, Human
auaguuuggcau

SEQ ID NO: 2647929 - RNA, 13 nt, Human
auaguuucuuuau

SEQ ID NO: 2647930 - RNA, 18 nt, Human
auaguuucuuuauuuugu

SEQ ID NO: 2647931 - RNA, 19 nt, Human
auaguuucuuuauuuugug

SEQ ID NO: 2647932 - RNA, 22 nt, Human
auaguuucuuuauuuuguguaa

SEQ ID NO: 2647933 - RNA, 19 nt, Human
auaguuuauuuuaaaacaa

SEQ ID NO: 2647934 - RNA, 12 nt, Human
auagucccugcc

SEQ ID NO: 2647935 - RNA, 18 nt, Human
auagucuaagacuauaua

SEQ ID NO: 2647936 - RNA, 12 nt, Human
auauaaaauuau

SEQ ID NO: 2647937 - RNA, 19 nt, Human
auagucaauggcuuguuca

SEQ ID NO: 2647938 - RNA, 18 nt, Human
auauaaauguauaaauau

SEQ ID NO: 2647939 - RNA, 13 nt, Human
auauaggcuauuu

SEQ ID NO: 2647940 - RNA, 22 nt, Human
auauaggcuauuuucuaaagac

SEQ ID NO: 2647941 - RNA, 23 nt, Human
auauaaggaaagcaauaaaugaa

SEQ ID NO: 2647942 - RNA, 13 nt, Human
auauaagacaaau

SEQ ID NO: 2647943 - RNA, 20 nt, Human
auauaaauuuuuaagagaaa

SEQ ID NO: 2647944 - RNA, 11 nt, Human
uucagccaagg

SEQ ID NO: 2647945 - RNA, 13 nt, Human
uucagaugccacu

SEQ ID NO: 2647946 - RNA, 18 nt, Human
uucagaugccacuucuaa

SEQ ID NO: 2647947 - RNA, 13 nt, Human
uucagauguaugu

SEQ ID NO: 2647948 - RNA, 17 nt, Human
uucagaagucacacauu

SEQ ID NO: 2647949 - RNA, 22 nt, Human
uucagaagucacacauuacaaa

SEQ ID NO: 2647950 - RNA, 20 nt, Human
uucagaagugcccuuccugc

SEQ ID NO: 2647951 - RNA, 15 nt, Human
uucagaaguuaguuu

SEQ ID NO: 2647952 - RNA, 20 nt, Human
uucagaaguuaguuuguaua

SEQ ID NO: 2647953 - RNA, 22 nt, Human
uucacuggccccuacuuugugg

SEQ ID NO: 2647954 - RNA, 14 nt, Human
auauauacauauau

SEQ ID NO: 2647955 - RNA, 13 nt, Human
auauaguguacag

SEQ ID NO: 2647956 - RNA, 20 nt, Human
auauauaggcuauuuucuaa

SEQ ID NO: 2647957 - RNA, 12 nt, Human
auaucuauuaau

SEQ ID NO: 2647958 - RNA, 13 nt, Human
auaucuaucuauu

SEQ ID NO: 2647959 - RNA, 14 nt, Human
auaucuaucuauuu

SEQ ID NO: 2647960 - RNA, 16 nt, Human
auaucuaucuauuuga

SEQ ID NO: 2647961 - RNA, 17 nt, Human
auaucuaucuauuugag

SEQ ID NO: 2647962 - RNA, 18 nt, Human
auaucuaucuauuugagg

SEQ ID NO: 2647963 - RNA, 12 nt, Human
auaucugcaaaa

SEQ ID NO: 2647964 - RNA, 13 nt, Human
auaucugcaaaaa

SEQ ID NO: 2647965 - RNA, 19 nt, Human
auaucuucugauuuguccc

SEQ ID NO: 2647966 - RNA, 20 nt, Human
auaugauuuaaaucagccgu

SEQ ID NO: 2647967 - RNA, 13 nt, Human
auaucuggccucu

SEQ ID NO: 2647968 - RNA, 19 nt, Human
auaucuggccucugcuuuc

SEQ ID NO: 2647969 - RNA, 17 nt, Human
auaucuuaauauauuuc

SEQ ID NO: 2647970 - RNA, 23 nt, Human
auauguauuauuuauaauuccua

SEQ ID NO: 2647971 - RNA, 13 nt, Human
auauguauucuuu

SEQ ID NO: 2647972 - RNA, 14 nt, Human
auauguauucuuuu

SEQ ID NO: 2647973 - RNA, 18 nt, Human
auauguauucuuuucuca

SEQ ID NO: 2647974 - RNA, 20 nt, Human
auauguauucuuuucucagu

SEQ ID NO: 2647975 - RNA, 18 nt, Human
uucauggcugcuguugcu

SEQ ID NO: 2647976 - RNA, 19 nt, Human
uucauggcugcuguugcuu

SEQ ID NO: 2647977 - RNA, 21 nt, Human
uucauggcugcuguugcuuaa

SEQ ID NO: 2647978 - RNA, 22 nt, Human
uucauggcugcuguugcuuaaa

SEQ ID NO: 2647979 - RNA, 16 nt, Human
uucauguaaaguguca

SEQ ID NO: 2647980 - RNA, 20 nt, Human
uucauguaaagugucagaag

SEQ ID NO: 2647981 - RNA, 22 nt, Human
auauguauuauuuauaauuccu

SEQ ID NO: 2647982 - RNA, 18 nt, Human
auauguauuauuuauaau

SEQ ID NO: 2647983 - RNA, 17 nt, Human
auauguauuauuuauaa

SEQ ID NO: 2647984 - RNA, 16 nt, Human
auauguauuauuuaua

SEQ ID NO: 2647985 - RNA, 23 nt, Human
auauguauguguuuagaauugaa

SEQ ID NO: 2647986 - RNA, 22 nt, Human
auauguauguguuuagaauuga

SEQ ID NO: 2647987 - RNA, 21 nt, Human
auauguauguguuuagaauug

SEQ ID NO: 2647988 - RNA, 20 nt, Human
auauguauguguuuagaauu

SEQ ID NO: 2647989 - RNA, 19 nt, Human
auauguauguguuuagaau

SEQ ID NO: 2647990 - RNA, 18 nt, Human
auauguauguguuuagaa

SEQ ID NO: 2647991 - RNA, 17 nt, Human
auauguauguguuuaga

SEQ ID NO: 2647992 - RNA, 15 nt, Human
auauguauguguuua

SEQ ID NO: 2647993 - RNA, 14 nt, Human
auauguauguguuu

SEQ ID NO: 2647994 - RNA, 11 nt, Human
auauguaugug

SEQ ID NO: 2647995 - RNA, 13 nt, Human
auauguauguguu

SEQ ID NO: 2647996 - RNA, 14 nt, Human
auaugcaacauugu

SEQ ID NO: 2647997 - RNA, 18 nt, Human
auaucuaauauauaugaa

SEQ ID NO: 2647998 - RNA, 17 nt, Human
auaucuaauauauauga

SEQ ID NO: 2647999 - RNA, 14 nt, Human
auaucuaauauaua

SEQ ID NO: 2648000 - RNA, 13 nt, Human
auaucuaauauau

SEQ ID NO: 2648001 - RNA, 19 nt, Human
auaucuaauauauaugaau

SEQ ID NO: 2648002 - RNA, 17 nt, Human
auaucgacuuguuuuug

SEQ ID NO: 2648003 - RNA, 13 nt, Human
auauauuauuaua

SEQ ID NO: 2648004 - RNA, 14 nt, Human
auauauuauuauaa

SEQ ID NO: 2648005 - RNA, 16 nt, Human
auauauuauuauaauc

SEQ ID NO: 2648006 - RNA, 18 nt, Human
auauauuauuauaaucuu

SEQ ID NO: 2648007 - RNA, 17 nt, Human
auauauuacaagggaua

SEQ ID NO: 2648008 - RNA, 23 nt, Human
uucauacuccuuuuaagcaguga

SEQ ID NO: 2648009 - RNA, 20 nt, Human
uucaguauuauguaguuguu

SEQ ID NO: 2648010 - RNA, 14 nt, Human
uucaguacuuuuuu

SEQ ID NO: 2648011 - RNA, 19 nt, Human
uucaguacuuuuuuaaaua

SEQ ID NO: 2648012 - RNA, 21 nt, Human
uucaguacuuuuuuaaauauu

SEQ ID NO: 2648013 - RNA, 13 nt, Human
uucauagcccagu

SEQ ID NO: 2648014 - RNA, 14 nt, Human
uucaggguaaauag

SEQ ID NO: 2648015 - RNA, 23 nt, Human
uucaggguaaauaggaaucauuc

SEQ ID NO: 2648016 - RNA, 20 nt, Human
uucagggcuggcuccugauc

SEQ ID NO: 2648017 - RNA, 13 nt, Human
augaacacuuaua

SEQ ID NO: 2648018 - RNA, 15 nt, Human
augaaccauaaauuc

SEQ ID NO: 2648019 - RNA, 20 nt, Human
augaauguauuuauuuggga

SEQ ID NO: 2648020 - RNA, 17 nt, Human
augaauguauuuauuug

SEQ ID NO: 2648021 - RNA, 15 nt, Human
augaauguauuuauu

SEQ ID NO: 2648022 - RNA, 23 nt, Human
augaaucuuuguuucagguucag

SEQ ID NO: 2648023 - RNA, 16 nt, Human
augaaauaaaauauau

SEQ ID NO: 2648024 - RNA, 14 nt, Human
augaacacucccca

SEQ ID NO: 2648025 - RNA, 21 nt, Human
uugguguggcccauggcuguu

SEQ ID NO: 2648026 - RNA, 15 nt, Human
uugguguaauuugaa

SEQ ID NO: 2648027 - RNA, 17 nt, Human
uugguguaauuugaaga

SEQ ID NO: 2648028 - RNA, 20 nt, Human
uugguguaauuugaagauug

SEQ ID NO: 2648029 - RNA, 14 nt, Human
uugguguacagacu

SEQ ID NO: 2648030 - RNA, 13 nt, Human
uugguuuccccaa

SEQ ID NO: 2648031 - RNA, 12 nt, Human
uugguuuuauga

SEQ ID NO: 2648032 - RNA, 12 nt, Human
uuggugguuuuu

SEQ ID NO: 2648033 - RNA, 17 nt, Human
uugguuuuccuguggca

SEQ ID NO: 2648034 - RNA, 13 nt, Human
uugguuuuauggu

SEQ ID NO: 2648035 - RNA, 23 nt, Human
uugguuuuaugguuacuucuucu

SEQ ID NO: 2648036 - RNA, 19 nt, Human
uugguuuuaugaugacgua

SEQ ID NO: 2648037 - RNA, 16 nt, Human
uugguuuuaugaugac

SEQ ID NO: 2648038 - RNA, 15 nt, Human
uuguaaauuuagugu

SEQ ID NO: 2648039 - RNA, 16 nt, Human
uuguaaauuuaguguu

SEQ ID NO: 2648040 - RNA, 13 nt, Human
uuguaagaaggca

SEQ ID NO: 2648041 - RNA, 15 nt, Human
uuguaagaaggcaau

SEQ ID NO: 2648042 - RNA, 19 nt, Human
uuguaagaaggcaauauua

SEQ ID NO: 2648043 - RNA, 20 nt, Human
uuguaagaaggcaauauuaa

SEQ ID NO: 2648044 - RNA, 24 nt, Human
uuguaagaaggcaauauuaaccua

SEQ ID NO: 2648045 - RNA, 16 nt, Human
uuguaauuuaaaauaa

SEQ ID NO: 2648046 - RNA, 13 nt, Human
uuguaauaagcaa

SEQ ID NO: 2648047 - RNA, 14 nt, Human
uuguaauaagcaau

SEQ ID NO: 2648048 - RNA, 20 nt, Human
uuguaauaagcaaucaaggu

SEQ ID NO: 2648049 - RNA, 19 nt, Human
aucugugggcauggucaaa

SEQ ID NO: 2648050 - RNA, 22 nt, Human
aucugugggcauggucaaaggc

SEQ ID NO: 2648051 - RNA, 19 nt, Human
aucuuaaaguguguuucua

SEQ ID NO: 2648052 - RNA, 12 nt, Human
aucuuaauguuc

SEQ ID NO: 2648053 - RNA, 14 nt, Human
aucuuaauguuccu

SEQ ID NO: 2648054 - RNA, 21 nt, Human
aucuuaauguuccucaaagcu

SEQ ID NO: 2648055 - RNA, 14 nt, Human
aucuuaauauauuu

SEQ ID NO: 2648056 - RNA, 23 nt, Human
aucuuaauauauuucuaaauguu

SEQ ID NO: 2648057 - RNA, 19 nt, Human
aucuuaaucuguuuauuua

SEQ ID NO: 2648058 - RNA, 22 nt, Human
aucuuaaucuguuuauuuacaa

SEQ ID NO: 2648059 - RNA, 21 nt, Human
aucuuaaugaaugagucuguu

SEQ ID NO: 2648060 - RNA, 15 nt, Human
aucuuguuucugaaa

SEQ ID NO: 2648061 - RNA, 16 nt, Human
aucuuguuucugaaaa

SEQ ID NO: 2648062 - RNA, 16 nt, Human
aucuuggggggguggc

SEQ ID NO: 2648063 - RNA, 20 nt, Human
aucuuggggggguggccgcu

SEQ ID NO: 2648064 - RNA, 23 nt, Human
aucuuggggggguggccgcugag

SEQ ID NO: 2648065 - RNA, 20 nt, Human
aucuuggccuaaaccucagu

SEQ ID NO: 2648066 - RNA, 21 nt, Human
aucuuggccuaaaccucaguu

SEQ ID NO: 2648067 - RNA, 17 nt, Human
uugcucuucagaugcca

SEQ ID NO: 2648068 - RNA, 17 nt, Human
uugcuucaccauggccu

SEQ ID NO: 2648069 - RNA, 22 nt, Human
uugcuucaccauggccuuauga

SEQ ID NO: 2648070 - RNA, 18 nt, Human
uuggagaaaugaaaacag

SEQ ID NO: 2648071 - RNA, 20 nt, Human
uuggagccccaggggacaag

SEQ ID NO: 2648072 - RNA, 20 nt, Human
uuggagaagcccgugugaga

SEQ ID NO: 2648073 - RNA, 20 nt, Human
uuggacuucaaagcaagcug

SEQ ID NO: 2648074 - RNA, 20 nt, Human
uugcuuuguauuguauauua

SEQ ID NO: 2648075 - RNA, 12 nt, Human
aucuagccagcc

SEQ ID NO: 2648076 - RNA, 19 nt, Human
aucuagccagccccucuuc

SEQ ID NO: 2648077 - RNA, 21 nt, Human
aucuagccagccccucuuccc

SEQ ID NO: 2648078 - RNA, 12 nt, Human
aucuacugcauu

SEQ ID NO: 2648079 - RNA, 10 nt, Human
aucuacugca

SEQ ID NO: 2648080 - RNA, 16 nt, Human
aucuagauaucgacuu

SEQ ID NO: 2648081 - RNA, 13 nt, Human
aucuaauucugau

SEQ ID NO: 2648082 - RNA, 15 nt, Human
aucuaauucugauuc

SEQ ID NO: 2648083 - RNA, 15 nt, Human
uugaguguaugagua

SEQ ID NO: 2648084 - RNA, 14 nt, Human
uugacacugaacuu

SEQ ID NO: 2648085 - RNA, 15 nt, Human
uugacacugaacuua

SEQ ID NO: 2648086 - RNA, 11 nt, Human
uugacacugaa

SEQ ID NO: 2648087 - RNA, 12 nt, Human
uugacacugaaa

SEQ ID NO: 2648088 - RNA, 17 nt, Human
uugacacugaaaguuuu

SEQ ID NO: 2648089 - RNA, 21 nt, Human
uugacacugaaaguuuuguaa

SEQ ID NO: 2648090 - RNA, 22 nt, Human
uugacacugaaaguuuuguaaa

SEQ ID NO: 2648091 - RNA, 14 nt, Human
aucccuuuauuacc

SEQ ID NO: 2648092 - RNA, 13 nt, Human
aucccuuuauuac

SEQ ID NO: 2648093 - RNA, 18 nt, Human
uugacacaaguggaccuu

SEQ ID NO: 2648094 - RNA, 17 nt, Human
uugacacaaguggaccu

SEQ ID NO: 2648095 - RNA, 14 nt, Human
uugacacaagugga

SEQ ID NO: 2648096 - RNA, 22 nt, Human
aucccuuuuucauaaauuauuu

SEQ ID NO: 2648097 - RNA, 22 nt, Human
aucccuuuauuacccccuccuu

SEQ ID NO: 2648098 - RNA, 18 nt, Human
uugacuuuuauaaagcau

SEQ ID NO: 2648099 - RNA, 20 nt, Human
uugacuuuuauaaagcaugu

SEQ ID NO: 2648100 - RNA, 21 nt, Human
uugacuuuuauaaagcauguu

SEQ ID NO: 2648101 - RNA, 17 nt, Human
uugagaaaauaaagcua

SEQ ID NO: 2648102 - RNA, 17 nt, Human
uugacuuuuuuuguaug

SEQ ID NO: 2648103 - RNA, 22 nt, Human
uugagcacuuuucaaacaauca

SEQ ID NO: 2648104 - RNA, 22 nt, Human
uugagacacggagcccagcccu

SEQ ID NO: 2648105 - RNA, 22 nt, Human
uugccaagcuccaagccccauc

SEQ ID NO: 2648106 - RNA, 23 nt, Human
uugccaagggcccaaagaaagag

SEQ ID NO: 2648107 - RNA, 11 nt, Human
uugcaugcaug

SEQ ID NO: 2648108 - RNA, 13 nt, Human
uugcaugcaugca

SEQ ID NO: 2648109 - RNA, 15 nt, Human
uugcaugcaugcaaa

SEQ ID NO: 2648110 - RNA, 16 nt, Human
uugcaugcaugcaaau

SEQ ID NO: 2648111 - RNA, 17 nt, Human
uugcaugcaugcaaaug

SEQ ID NO: 2648112 - RNA, 21 nt, Human
uugcauggaaaucagccaagu

SEQ ID NO: 2648113 - RNA, 23 nt, Human
uugcauggaaaucagccaaguuu

SEQ ID NO: 2648114 - RNA, 14 nt, Human
uugcaagugcugga

SEQ ID NO: 2648115 - RNA, 16 nt, Human
uugcaagugcuggagu

SEQ ID NO: 2648116 - RNA, 14 nt, Human
uugcaauaacagcu

SEQ ID NO: 2648117 - RNA, 16 nt, Human
uugcaauaacagcugc

SEQ ID NO: 2648118 - RNA, 17 nt, Human
uugcaauaacagcugca

SEQ ID NO: 2648119 - RNA, 18 nt, Human
uugcaauaacagcugcaa

SEQ ID NO: 2648120 - RNA, 20 nt, Human
uugcaauaacagcugcaauu

SEQ ID NO: 2648121 - RNA, 15 nt, Human
uugcaauaccaagua

SEQ ID NO: 2648122 - RNA, 21 nt, Human
uugcaccacugcacuccagcc

SEQ ID NO: 2648123 - RNA, 17 nt, Human
uugccacaguagaacug

SEQ ID NO: 2648124 - RNA, 18 nt, Human
uugccacaguagaacugu

SEQ ID NO: 2648125 - RNA, 20 nt, Human
uugccacaguagaacugucu

SEQ ID NO: 2648126 - RNA, 14 nt, Human
uugccaauuuuccu

SEQ ID NO: 2648127 - RNA, 13 nt, Human
uugcccauccuga

SEQ ID NO: 2648128 - RNA, 14 nt, Human
uugcccauccugac

SEQ ID NO: 2648129 - RNA, 16 nt, Human
uugcccauccugacug

SEQ ID NO: 2648130 - RNA, 17 nt, Human
uugcccauccugacuga

SEQ ID NO: 2648131 - RNA, 14 nt, Human
uugcaagaugugaa

SEQ ID NO: 2648132 - RNA, 15 nt, Human
uugcaagaugugaau

SEQ ID NO: 2648133 - RNA, 16 nt, Human
uugcaagaugugaauu

SEQ ID NO: 2648134 - RNA, 19 nt, Human
uugcaagaugugaauuauu

SEQ ID NO: 2648135 - RNA, 20 nt, Human
uugcaagaugugaauuauug

SEQ ID NO: 2648136 - RNA, 21 nt, Human
uugcaagaugugaauuauuga

SEQ ID NO: 2648137 - RNA, 22 nt, Human
uugcaagaugugaauuauugac

SEQ ID NO: 2648138 - RNA, 23 nt, Human
uugcaagaugugaauuauugaca

SEQ ID NO: 2648139 - RNA, 19 nt, Human
uugcaagcaugcuugugaa

SEQ ID NO: 2648140 - RNA, 15 nt, Human
aucucuuuuuguuug

SEQ ID NO: 2648141 - RNA, 16 nt, Human
aucucuuuuuguuugc

SEQ ID NO: 2648142 - RNA, 10 nt, Human
aucucuuuuc

SEQ ID NO: 2648143 - RNA, 23 nt, Human
aucucuuuuccacuccauugucg

SEQ ID NO: 2648144 - RNA, 21 nt, Human
aucugaagagcuauuauauaa

SEQ ID NO: 2648145 - RNA, 13 nt, Human
aucugaaauguua

SEQ ID NO: 2648146 - RNA, 16 nt, Human
aucugaaauguuacaa

SEQ ID NO: 2648147 - RNA, 15 nt, Human
aucucacagcuaugc

SEQ ID NO: 2648148 - RNA, 12 nt, Human
aucucacagcua

SEQ ID NO: 2648149 - RNA, 19 nt, Human
aucucaauaaagugcuuua

SEQ ID NO: 2648150 - RNA, 22 nt, Human
aucucaauaaagugcuuuaaaa

SEQ ID NO: 2648151 - RNA, 18 nt, Human
uuuauauggggaauauau

SEQ ID NO: 2648152 - RNA, 12 nt, Human
uuuauauguacu

SEQ ID NO: 2648153 - RNA, 12 nt, Human
uuuauaugcuuu

SEQ ID NO: 2648154 - RNA, 14 nt, Human
uuuauauguacugu

SEQ ID NO: 2648155 - RNA, 15 nt, Human
uuuauauguaugugu

SEQ ID NO: 2648156 - RNA, 18 nt, Human
uuuaguguuuuuuuauuu

SEQ ID NO: 2648157 - RNA, 20 nt, Human
uuuaguguuuuuuuauuucu

SEQ ID NO: 2648158 - RNA, 21 nt, Human
uuuaguguuuuuuuauuucua

SEQ ID NO: 2648159 - RNA, 18 nt, Human
uuuagggaguauucuaau

SEQ ID NO: 2648160 - RNA, 15 nt, Human
uuuagggaguauucu

SEQ ID NO: 2648161 - RNA, 19 nt, Human
augccuuuuuuucucugca

SEQ ID NO: 2648162 - RNA, 19 nt, Human
augcuaccccacuaugaca

SEQ ID NO: 2648163 - RNA, 11 nt, Human
uuuacuuaaac

SEQ ID NO: 2648164 - RNA, 23 nt, Human
uuuacugucuauuaauauucagg

SEQ ID NO: 2648165 - RNA, 16 nt, Human
uuuacugguugcaugg

SEQ ID NO: 2648166 - RNA, 19 nt, Human
uuuacugguugcauggaaa

SEQ ID NO: 2648167 - RNA, 22 nt, Human
uuuacugguugcauggaaauca

SEQ ID NO: 2648168 - RNA, 15 nt, Human
uuuacugugauguuu

SEQ ID NO: 2648169 - RNA, 12 nt, Human
uuuacuguguuu

SEQ ID NO: 2648170 - RNA, 17 nt, Human
uuuacugccugaauaaa

SEQ ID NO: 2648171 - RNA, 22 nt, Human
uuuacugccugaauaaagagcc

SEQ ID NO: 2648172 - RNA, 16 nt, Human
uuuacugcagcuuugu

SEQ ID NO: 2648173 - RNA, 22 nt, Human
augccauagaaauguagguccu

SEQ ID NO: 2648174 - RNA, 17 nt, Human
augccacugccuucgcu

SEQ ID NO: 2648175 - RNA, 15 nt, Human
augccacugccuucg

SEQ ID NO: 2648176 - RNA, 18 nt, Human
augccacugccuucgcuu

SEQ ID NO: 2648177 - RNA, 12 nt, Human
augccacuuccu

SEQ ID NO: 2648178 - RNA, 20 nt, Human
augccacuuccuuuuaacug

SEQ ID NO: 2648179 - RNA, 18 nt, Human
augccacuucuaagaaaa

SEQ ID NO: 2648180 - RNA, 12 nt, Human
augccagcuggc

SEQ ID NO: 2648181 - RNA, 13 nt, Human
augccagcuggcc

SEQ ID NO: 2648182 - RNA, 21 nt, Human
augccagggccgaccagagga

SEQ ID NO: 2648183 - RNA, 18 nt, Human
augccagggccgaccaga

SEQ ID NO: 2648184 - RNA, 19 nt, Human
augcuccuggcccacugca

SEQ ID NO: 2648185 - RNA, 14 nt, Human
augcuccuggccca

SEQ ID NO: 2648186 - RNA, 15 nt, Human
augcucaaagaaauc

SEQ ID NO: 2648187 - RNA, 16 nt, Human
augcucaaagaaaucu

SEQ ID NO: 2648188 - RNA, 17 nt, Human
augcucaaagaaaucua

SEQ ID NO: 2648189 - RNA, 13 nt, Human
augcucaucugcu

SEQ ID NO: 2648190 - RNA, 14 nt, Human
augcucaucugcug

SEQ ID NO: 2648191 - RNA, 16 nt, Human
augcucaucugcuggu

SEQ ID NO: 2648192 - RNA, 20 nt, Human
augcuucucacugccaugcc

SEQ ID NO: 2648193 - RNA, 16 nt, Human
augcuucucacugcca

SEQ ID NO: 2648194 - RNA, 20 nt, Human
auggaagaggaaaaggcugg

SEQ ID NO: 2648195 - RNA, 16 nt, Human
uuucacauucuuggcu

SEQ ID NO: 2648196 - RNA, 15 nt, Human
uuucacgggagauuu

SEQ ID NO: 2648197 - RNA, 14 nt, Human
uuucacggaaacuc

SEQ ID NO: 2648198 - RNA, 18 nt, Human
uuucacggaaacucccga

SEQ ID NO: 2648199 - RNA, 13 nt, Human
uuucagaaauaua

SEQ ID NO: 2648200 - RNA, 14 nt, Human
uuucagaaauauaa

SEQ ID NO: 2648201 - RNA, 20 nt, Human
uuucagaaauauaacacauu

SEQ ID NO: 2648202 - RNA, 21 nt, Human
uuucagaaauauaacacauuu

SEQ ID NO: 2648203 - RNA, 22 nt, Human
uuucagaaauauaacacauuuu

SEQ ID NO: 2648204 - RNA, 12 nt, Human
uuucaucucauu

SEQ ID NO: 2648205 - RNA, 21 nt, Human
uuucaucucauuuaagggaaa

SEQ ID NO: 2648206 - RNA, 22 nt, Human
uuucaucucauuuaagggaaaa

SEQ ID NO: 2648207 - RNA, 23 nt, Human
uuucaucucauuuaagggaaaaa

SEQ ID NO: 2648208 - RNA, 20 nt, Human
uuucauggcugcuguugcuu

SEQ ID NO: 2648209 - RNA, 14 nt, Human
uuucauguaaaaca

SEQ ID NO: 2648210 - RNA, 10 nt, Human
uuucccaagc

SEQ ID NO: 2648211 - RNA, 16 nt, Human
uuucccuauuagagaa

SEQ ID NO: 2648212 - RNA, 22 nt, Human
uuuaaaucuaaaucuauuuauu

SEQ ID NO: 2648213 - RNA, 19 nt, Human
uuuaaaucuaaaucuauuu

SEQ ID NO: 2648214 - RNA, 19 nt, Human
uuuaaauccugaagagcau

SEQ ID NO: 2648215 - RNA, 13 nt, Human
uuuaaauauuuuc

SEQ ID NO: 2648216 - RNA, 14 nt, Human
uuuaaauauuuucu

SEQ ID NO: 2648217 - RNA, 15 nt, Human
uuuaaauauuuucua

SEQ ID NO: 2648218 - RNA, 17 nt, Human
uuuaaauauuuucuauu

SEQ ID NO: 2648219 - RNA, 19 nt, Human
uuuaaauauuuucuauuuu

SEQ ID NO: 2648220 - RNA, 17 nt, Human
uuuaaaaagggaagaaa

SEQ ID NO: 2648221 - RNA, 19 nt, Human
uuuaaaaagggaagaaacu

SEQ ID NO: 2648222 - RNA, 20 nt, Human
uuuaaaaagggaagaaacug

SEQ ID NO: 2648223 - RNA, 19 nt, Human
uuuaaaaaccgaauaaaug

SEQ ID NO: 2648224 - RNA, 14 nt, Human
uuuaagcuucaguu

SEQ ID NO: 2648225 - RNA, 21 nt, Human
uuuaagcuucaguugcuuguc

SEQ ID NO: 2648226 - RNA, 21 nt, Human
uuuaagcuguuacugucuuca

SEQ ID NO: 2648227 - RNA, 22 nt, Human
uuuaagcuguggucaaggcuac

SEQ ID NO: 2648228 - RNA, 12 nt, Human
uuuaaaugccau

SEQ ID NO: 2648229 - RNA, 14 nt, Human
uuuaaggaaaacua

SEQ ID NO: 2648230 - RNA, 18 nt, Human
uuuaaggcuaaaacuuaa

SEQ ID NO: 2648231 - RNA, 15 nt, Human
uuuaagggaaagaaa

SEQ ID NO: 2648232 - RNA, 17 nt, Human
uuuaagggaaagaaaau

SEQ ID NO: 2648233 - RNA, 22 nt, Human
uuuaaggcagauuuuacagagc

SEQ ID NO: 2648234 - RNA, 19 nt, Human
uuuaaggacugacugaggc

SEQ ID NO: 2648235 - RNA, 18 nt, Human
uuuaaggacugacugagg

SEQ ID NO: 2648236 - RNA, 15 nt, Human
augcacuuaaagaag

SEQ ID NO: 2648237 - RNA, 19 nt, Human
augcacuuaaagaaguauu

SEQ ID NO: 2648238 - RNA, 21 nt, Human
augcacuuaaagaaguauuuu

SEQ ID NO: 2648239 - RNA, 23 nt, Human
augcaaaaagcuagucaacagua

SEQ ID NO: 2648240 - RNA, 17 nt, Human
augcaaaaacucuuuga

SEQ ID NO: 2648241 - RNA, 23 nt, Human
augcaaaaacucuuugagagggu

SEQ ID NO: 2648242 - RNA, 14 nt, Human
augcaaaagguuua

SEQ ID NO: 2648243 - RNA, 17 nt, Human
augcaaaauauguuuaa

SEQ ID NO: 2648244 - RNA, 21 nt, Human
uuguucuuggcaauaaauuuu

SEQ ID NO: 2648245 - RNA, 19 nt, Human
uuguucuuggcaauaaauu

SEQ ID NO: 2648246 - RNA, 18 nt, Human
uuguucuuauucuggcau

SEQ ID NO: 2648247 - RNA, 24 nt, Human
uuguguaaugaaaaugaauaucua

SEQ ID NO: 2648248 - RNA, 23 nt, Human
uuguguaaugaaaaugaauaucu

SEQ ID NO: 2648249 - RNA, 22 nt, Human
augaguagauaauuucagggug

SEQ ID NO: 2648250 - RNA, 13 nt, Human
augaguagccagg

SEQ ID NO: 2648251 - RNA, 22 nt, Human
augagucacuaugggaugagaa

SEQ ID NO: 2648252 - RNA, 12 nt, Human
auuaauauuuaa

SEQ ID NO: 2648253 - RNA, 23 nt, Human
auuaauauuuaacauuauuuaua

SEQ ID NO: 2648254 - RNA, 15 nt, Human
auuaaucacugugua

SEQ ID NO: 2648255 - RNA, 14 nt, Human
auuaaucacugugu

SEQ ID NO: 2648256 - RNA, 13 nt, Human
auuaaucacugug

SEQ ID NO: 2648257 - RNA, 12 nt, Human
auuaaucacugu

SEQ ID NO: 2648258 - RNA, 23 nt, Human
auuaaucacuguguauauuugau

SEQ ID NO: 2648259 - RNA, 22 nt, Human
auuaaucacuguguauauuuga

SEQ ID NO: 2648260 - RNA, 21 nt, Human
auuaaucacuguguauauuug

SEQ ID NO: 2648261 - RNA, 20 nt, Human
auuaaucacuguguauauuu

SEQ ID NO: 2648262 - RNA, 19 nt, Human
auuaaucacuguguauauu

SEQ ID NO: 2648263 - RNA, 18 nt, Human
auuaaucacuguguauau

SEQ ID NO: 2648264 - RNA, 17 nt, Human
auuaaucacuguguaua

SEQ ID NO: 2648265 - RNA, 16 nt, Human
auuaaucacuguguau

SEQ ID NO: 2648266 - RNA, 17 nt, Human
auuacuguuuauuacuu

SEQ ID NO: 2648267 - RNA, 18 nt, Human
auuacuguuuauuacuuc

SEQ ID NO: 2648268 - RNA, 20 nt, Human
auuacuguuuauuacuucca

SEQ ID NO: 2648269 - RNA, 13 nt, Human
auuagagaagaga

SEQ ID NO: 2648270 - RNA, 15 nt, Human
auuacuuguugccua

SEQ ID NO: 2648271 - RNA, 17 nt, Human
uuuuguguaaugaaaau

SEQ ID NO: 2648272 - RNA, 14 nt, Human
uuuugugugaaauu

SEQ ID NO: 2648273 - RNA, 15 nt, Human
uuuugugugaaauug

SEQ ID NO: 2648274 - RNA, 16 nt, Human
uuuuguuaacugauuu

SEQ ID NO: 2648275 - RNA, 15 nt, Human
uuuuguuaacugauu

SEQ ID NO: 2648276 - RNA, 18 nt, Human
uuuuggagauuauaauaa

SEQ ID NO: 2648277 - RNA, 14 nt, Human
uuuucuguuucugu

SEQ ID NO: 2648278 - RNA, 12 nt, Human
auuaaaauauuu

SEQ ID NO: 2648279 - RNA, 13 nt, Human
auuaaaauauuuc

SEQ ID NO: 2648280 - RNA, 14 nt, Human
auuaaaauauuuca

SEQ ID NO: 2648281 - RNA, 17 nt, Human
auuaaaauauuucaggu

SEQ ID NO: 2648282 - RNA, 21 nt, Human
uuuugcuuuuggcaaaacucu

SEQ ID NO: 2648283 - RNA, 17 nt, Human
uuuuggacuucaaagca

SEQ ID NO: 2648284 - RNA, 19 nt, Human
uuuuguuguacuuaaaugg

SEQ ID NO: 2648285 - RNA, 16 nt, Human
uuuuguuuuugucuua

SEQ ID NO: 2648286 - RNA, 22 nt, Human
uuuuguuuuaaaacuggaccug

SEQ ID NO: 2648287 - RNA, 15 nt, Human
uuuuguuuuggcuga

SEQ ID NO: 2648288 - RNA, 14 nt, Human
uuuuuacaagaugu

SEQ ID NO: 2648289 - RNA, 16 nt, Human
uuuuuaauuuacuugu

SEQ ID NO: 2648290 - RNA, 13 nt, Human
uuuuuaauuguau

SEQ ID NO: 2648291 - RNA, 16 nt, Human
uuuuuaauuguuuaaa

SEQ ID NO: 2648292 - RNA, 18 nt, Human
uuuuguuuuucugcuuua

SEQ ID NO: 2648293 - RNA, 18 nt, Human
uuuuuauagcaacaacaa

SEQ ID NO: 2648294 - RNA, 21 nt, Human
uuuuuauaucaugcaaaauau

SEQ ID NO: 2648295 - RNA, 21 nt, Human
uuuuugggggguuuucuugcc

SEQ ID NO: 2648296 - RNA, 22 nt, Human
uuuuugggggguuuucuugccu

SEQ ID NO: 2648297 - RNA, 22 nt, Human
uuuuuguauauugguuuuauga

SEQ ID NO: 2648298 - RNA, 9 nt, Human
uuuuuguau

SEQ ID NO: 2648299 - RNA, 14 nt, Human
uuuuugguugggaa

SEQ ID NO: 2648300 - RNA, 12 nt, Human
uuuuuguaugug

SEQ ID NO: 2648301 - RNA, 14 nt, Human
uuuuuguaugugug

SEQ ID NO: 2648302 - RNA, 22 nt, Human
auuaagcuguuccuguucagua

SEQ ID NO: 2648303 - RNA, 13 nt, Human
auuaaggaagaca

SEQ ID NO: 2648304 - RNA, 15 nt, Human
auuaaggggaagaau

SEQ ID NO: 2648305 - RNA, 18 nt, Human
auuaaggggaagaaugaa

SEQ ID NO: 2648306 - RNA, 19 nt, Human
auuaaggggaagaaugaaa

SEQ ID NO: 2648307 - RNA, 21 nt, Human
uuuuucaaaauccaaaaagaa

SEQ ID NO: 2648308 - RNA, 17 nt, Human
uuuuucaaguuguaaau

SEQ ID NO: 2648309 - RNA, 19 nt, Human
uuuuucaaguuguaaauaa

SEQ ID NO: 2648310 - RNA, 21 nt, Human
uuuuucaaguuguaaauaauu

SEQ ID NO: 2648311 - RNA, 12 nt, Human
uuuuucaauaua

SEQ ID NO: 2648312 - RNA, 16 nt, Human
uuuuucaauauauuga

SEQ ID NO: 2648313 - RNA, 17 nt, Human
uuuuucaauauauugaa

SEQ ID NO: 2648314 - RNA, 19 nt, Human
uuuuucaauauauugaacu

SEQ ID NO: 2648315 - RNA, 20 nt, Human
uuuuucaauauauugaacuu

SEQ ID NO: 2648316 - RNA, 12 nt, Human
uuuuugacacug

SEQ ID NO: 2648317 - RNA, 13 nt, Human
uuuuugacacuga

SEQ ID NO: 2648318 - RNA, 15 nt, Human
uuuuugacacugaaa

SEQ ID NO: 2648319 - RNA, 18 nt, Human
uuuuugacacugaaaguu

SEQ ID NO: 2648320 - RNA, 19 nt, Human
uuuuugacacugaaaguuu

SEQ ID NO: 2648321 - RNA, 22 nt, Human
uuuuugacacugaaaguuuugu

SEQ ID NO: 2648322 - RNA, 13 nt, Human
uuuuuauuuauau

SEQ ID NO: 2648323 - RNA, 15 nt, Human
uuuuuauauuuccuu

SEQ ID NO: 2648324 - RNA, 22 nt, Human
uuuuuauauuuccuuuauguga

SEQ ID NO: 2648325 - RNA, 17 nt, Human
uuuuuauuuauauguau

SEQ ID NO: 2648326 - RNA, 18 nt, Human
uuuuuauuuauauguacu

SEQ ID NO: 2648327 - RNA, 14 nt, Human
uuuuuauuuauaug

SEQ ID NO: 2648328 - RNA, 13 nt, Human
uuuuuauuuaaau

SEQ ID NO: 2648329 - RNA, 13 nt, Human
uuuuucaaaagaa

SEQ ID NO: 2648330 - RNA, 21 nt, Human
uuuuuauuuauauguaugugu

SEQ ID NO: 2648331 - RNA, 15 nt, Human
uuuuuauuucuacug

SEQ ID NO: 2648332 - RNA, 16 nt, Human
uuuuuauuucuacugu

SEQ ID NO: 2648333 - RNA, 12 nt, Human
uuuuuggacuuc

SEQ ID NO: 2648334 - RNA, 18 nt, Human
uuuuuggacuucaaagca

SEQ ID NO: 2648335 - RNA, 23 nt, Human
uuuuugcugcugccucuuucccu

SEQ ID NO: 2648336 - RNA, 20 nt, Human
uuuuugcacauguuuccucu

SEQ ID NO: 2648337 - RNA, 19 nt, Human
uuuuugcaugcaugcaaau

SEQ ID NO: 2648338 - RNA, 19 nt, Human
uuuuugauagcauuguaag

SEQ ID NO: 2648339 - RNA, 14 nt, Human
uuuuugauagcauu

SEQ ID NO: 2648340 - RNA, 13 nt, Human
uuuuugauagcau

SEQ ID NO: 2648341 - RNA, 12 nt, Human
uuuuugacuuuu

SEQ ID NO: 2648342 - RNA, 20 nt, Human
uuuuugacuuuuuuuguaug

SEQ ID NO: 2648343 - RNA, 23 nt, Human
uuuuugacuuuuuuuguaugugu

SEQ ID NO: 2648344 - RNA, 18 nt, Human
auucaggguaaauaggaa

SEQ ID NO: 2648345 - RNA, 14 nt, Human
auucagguaacacu

SEQ ID NO: 2648346 - RNA, 19 nt, Human
auucaguggcgagaaauaa

SEQ ID NO: 2648347 - RNA, 13 nt, Human
auucacuggcccc

SEQ ID NO: 2648348 - RNA, 21 nt, Human
auucacucccacacccaagaa

SEQ ID NO: 2648349 - RNA, 18 nt, Human
auucagcagcaaauuuuc

SEQ ID NO: 2648350 - RNA, 19 nt, Human
auucagcagcaaauuuuca

SEQ ID NO: 2648351 - RNA, 20 nt, Human
auucagcagcaaauuuucag

SEQ ID NO: 2648352 - RNA, 12 nt, Human
auucagauguau

SEQ ID NO: 2648353 - RNA, 14 nt, Human
auucagauguaugu

SEQ ID NO: 2648354 - RNA, 12 nt, Human
auuccaauaaac

SEQ ID NO: 2648355 - RNA, 17 nt, Human
auuccuaaagaaaaaua

SEQ ID NO: 2648356 - RNA, 18 nt, Human
auuccuaaagaaaaauau

SEQ ID NO: 2648357 - RNA, 18 nt, Human
auuauaaaggauaaagaa

SEQ ID NO: 2648358 - RNA, 22 nt, Human
auuauaaaggauaaagaaggau

SEQ ID NO: 2648359 - RNA, 14 nt, Human
auuagagaacaucc

SEQ ID NO: 2648360 - RNA, 15 nt, Human
auuagagaacauccu

SEQ ID NO: 2648361 - RNA, 17 nt, Human
auuauaaauaucauugu

SEQ ID NO: 2648362 - RNA, 19 nt, Human
auucaaacuggggccucca

SEQ ID NO: 2648363 - RNA, 17 nt, Human
auucaaacuggggccuc

SEQ ID NO: 2648364 - RNA, 22 nt, Human
auucaaacuggggccuccagaa

SEQ ID NO: 2648365 - RNA, 12 nt, Human
auucacucccac

SEQ ID NO: 2648366 - RNA, 13 nt, Human
auucacucccaca

SEQ ID NO: 2648367 - RNA, 14 nt, Human
auuauuuaagacua

SEQ ID NO: 2648368 - RNA, 19 nt, Human
auuauuuaagacuaaaagu

SEQ ID NO: 2648369 - RNA, 17 nt, Human
auuauuuuuuuaaaauu

SEQ ID NO: 2648370 - RNA, 18 nt, Human
auuauuuuuuuaaaauuu

SEQ ID NO: 2648371 - RNA, 19 nt, Human
auuauuuuuuuaaaauuuu

SEQ ID NO: 2648372 - RNA, 20 nt, Human
auuauuuuuuuaaaauuuug

SEQ ID NO: 2648373 - RNA, 21 nt, Human
auuauuuuuuuaaaauuuugu

SEQ ID NO: 2648374 - RNA, 22 nt, Human
auuauuuuuuuaaaauuuugua

SEQ ID NO: 2648375 - RNA, 14 nt, Human
auuauuuuuguaga

SEQ ID NO: 2648376 - RNA, 14 nt, Human
auuauuuuuauaau

SEQ ID NO: 2648377 - RNA, 18 nt, Human
auuauuuuuauaauugua

SEQ ID NO: 2648378 - RNA, 19 nt, Human
auuauuuuuauaauuguac

SEQ ID NO: 2648379 - RNA, 17 nt, Human
auuauuuuucacucuaa

SEQ ID NO: 2648380 - RNA, 17 nt, Human
uuugaauuuuaaaucua

SEQ ID NO: 2648381 - RNA, 22 nt, Human
uuugaauuauccacaugaaaau

SEQ ID NO: 2648382 - RNA, 15 nt, Human
uuucccucacccccu

SEQ ID NO: 2648383 - RNA, 19 nt, Human
uuucccucacccccuccca

SEQ ID NO: 2648384 - RNA, 20 nt, Human
uuugacaacguuucagcgac

SEQ ID NO: 2648385 - RNA, 23 nt, Human
uuugacaagcuggcuuacacugg

SEQ ID NO: 2648386 - RNA, 12 nt, Human
uuugacacugaa

SEQ ID NO: 2648387 - RNA, 13 nt, Human
uuugacacugaaa

SEQ ID NO: 2648388 - RNA, 17 nt, Human
uuugacacugaaaguuu

SEQ ID NO: 2648389 - RNA, 18 nt, Human
uuugacacugaaaguuuu

SEQ ID NO: 2648390 - RNA, 19 nt, Human
uuugacacugaaaguuuug

SEQ ID NO: 2648391 - RNA, 22 nt, Human
uuugacacugaaaguuuuguaa

SEQ ID NO: 2648392 - RNA, 22 nt, Human
uuugacuuuuuuuguaugugug

SEQ ID NO: 2648393 - RNA, 16 nt, Human
uuugagaaaauaaagc

SEQ ID NO: 2648394 - RNA, 20 nt, Human
uuugagaaaugaaauauugu

SEQ ID NO: 2648395 - RNA, 13 nt, Human
uuugagacaggag

SEQ ID NO: 2648396 - RNA, 17 nt, Human
uuugauuauuuaagacu

SEQ ID NO: 2648397 - RNA, 14 nt, Human
uuugauuauuugca

SEQ ID NO: 2648398 - RNA, 15 nt, Human
uuugauuauuugcau

SEQ ID NO: 2648399 - RNA, 16 nt, Human
uuugauuauuugcaug

SEQ ID NO: 2648400 - RNA, 17 nt, Human
uuugauuauuugcaugu

SEQ ID NO: 2648401 - RNA, 20 nt, Human
uuugauuauuugcauguuau

SEQ ID NO: 2648402 - RNA, 22 nt, Human
uuugauuauuugcauguuaugu

SEQ ID NO: 2648403 - RNA, 21 nt, Human
uuugaugagguauuuuuuccu

SEQ ID NO: 2648404 - RNA, 16 nt, Human
uuugaugcaugucuuu

SEQ ID NO: 2648405 - RNA, 17 nt, Human
uuugaugcaugucuuuu

SEQ ID NO: 2648406 - RNA, 22 nt, Human
uuugaugcaugucuuuuaaaau

SEQ ID NO: 2648407 - RNA, 19 nt, Human
uuuggcaaacgcuaaagag

SEQ ID NO: 2648408 - RNA, 20 nt, Human
uuuggcugaaauucuccugg

SEQ ID NO: 2648409 - RNA, 21 nt, Human
uuuggcugaaauucuccugga

SEQ ID NO: 2648410 - RNA, 15 nt, Human
uuugggaguuuuuau

SEQ ID NO: 2648411 - RNA, 22 nt, Human
uuuggcugaaauucuccuggag

SEQ ID NO: 2648412 - RNA, 23 nt, Human
uuugggaguuuuuaugagaaacu

SEQ ID NO: 2648413 - RNA, 23 nt, Human
uuuggguggggggcauugaguau

SEQ ID NO: 2648414 - RNA, 20 nt, Human
uuugggggguuuucuugccu

SEQ ID NO: 2648415 - RNA, 15 nt, Human
uuuggauucuaaaua

SEQ ID NO: 2648416 - RNA, 18 nt, Human
uuuggauucuaaauacau

SEQ ID NO: 2648417 - RNA, 19 nt, Human
uuuggauucuaaauacaug

SEQ ID NO: 2648418 - RNA, 21 nt, Human
uuugauugaauaaugccacca

SEQ ID NO: 2648419 - RNA, 16 nt, Human
uuugauuuauuaacuu

SEQ ID NO: 2648420 - RNA, 13 nt, Human
uuugauuuauuaa

SEQ ID NO: 2648421 - RNA, 21 nt, Human
uuugauuuauuaacuuaauaa

SEQ ID NO: 2648422 - RNA, 17 nt, Human
uuugauugggaugaaug

SEQ ID NO: 2648423 - RNA, 23 nt, Human
uuuguaauaagcaaucaagguua

SEQ ID NO: 2648424 - RNA, 20 nt, Human
uuuguaagaaggcaauauua

SEQ ID NO: 2648425 - RNA, 19 nt, Human
augugaggggucccuagca

SEQ ID NO: 2648426 - RNA, 11 nt, Human
uuuguuuguuu

SEQ ID NO: 2648427 - RNA, 15 nt, Human
uuugugcaaagccaa

SEQ ID NO: 2648428 - RNA, 13 nt, Human
uuugugccagagg

SEQ ID NO: 2648429 - RNA, 14 nt, Human
uuugugcuagaaau

SEQ ID NO: 2648430 - RNA, 20 nt, Human
uuugugcuagaaauuuucaa

SEQ ID NO: 2648431 - RNA, 21 nt, Human
uuugugcuagaaauuuucaag

SEQ ID NO: 2648432 - RNA, 14 nt, Human
uuugucuuaaaaag

SEQ ID NO: 2648433 - RNA, 13 nt, Human
uuugucuuaaaaa

SEQ ID NO: 2648434 - RNA, 23 nt, Human
uuugucuuaaaaaguggaaaaau

SEQ ID NO: 2648435 - RNA, 15 nt, Human
augugacauuaacaa

SEQ ID NO: 2648436 - RNA, 18 nt, Human
augugacauuaacaaaua

SEQ ID NO: 2648437 - RNA, 21 nt, Human
augugacauuaacaaauaaaa

SEQ ID NO: 2648438 - RNA, 21 nt, Human
augugacaauuuuguacaaau

SEQ ID NO: 2648439 - RNA, 20 nt, Human
augugacaauuuuguacaaa

SEQ ID NO: 2648440 - RNA, 18 nt, Human
augugacaauuuuguaca

SEQ ID NO: 2648441 - RNA, 19 nt, Human
augucguggacacacacag

SEQ ID NO: 2648442 - RNA, 20 nt, Human
augucguggacacacacaga

SEQ ID NO: 2648443 - RNA, 10 nt, Human
augugaauuu

SEQ ID NO: 2648444 - RNA, 11 nt, Human
augugaauuuu

SEQ ID NO: 2648445 - RNA, 12 nt, Human
augugaauuuuu

SEQ ID NO: 2648446 - RNA, 13 nt, Human
augugaauuuuua

SEQ ID NO: 2648447 - RNA, 14 nt, Human
augugaauuuuuaa

SEQ ID NO: 2648448 - RNA, 15 nt, Human
augugaauuuuuaag

SEQ ID NO: 2648449 - RNA, 16 nt, Human
augugaauuuuuaagc

SEQ ID NO: 2648450 - RNA, 17 nt, Human
augugaauuuuuaagcu

SEQ ID NO: 2648451 - RNA, 18 nt, Human
augugaauuuuuaagcug

SEQ ID NO: 2648452 - RNA, 19 nt, Human
augugaauuuuuaagcugc

SEQ ID NO: 2648453 - RNA, 21 nt, Human
augugaauuuuuaagcugcaa

SEQ ID NO: 2648454 - RNA, 17 nt, Human
augugaauuuuuauugu

SEQ ID NO: 2648455 - RNA, 18 nt, Human
augugaauuuuuauuguu

SEQ ID NO: 2648456 - RNA, 15 nt, Human
augugagcucuuccu

SEQ ID NO: 2648457 - RNA, 14 nt, Human
augugagaagccag

SEQ ID NO: 2648458 - RNA, 15 nt, Human
augugagaagccagc

SEQ ID NO: 2648459 - RNA, 19 nt, Human
augugagugguugaauaug

SEQ ID NO: 2648460 - RNA, 16 nt, Human
augugagugguugaau

SEQ ID NO: 2648461 - RNA, 15 nt, Human
augugagugguugaa

SEQ ID NO: 2648462 - RNA, 20 nt, Human
augugagugacgaugaugua

SEQ ID NO: 2648463 - RNA, 22 nt, Human
augugagugguugaauaugauu

SEQ ID NO: 2648464 - RNA, 15 nt, Human
augugauacauuuuu

SEQ ID NO: 2648465 - RNA, 21 nt, Human
augugauacauuuuuuaagcu

SEQ ID NO: 2648466 - RNA, 22 nt, Human
augugauacauuuuuuaagcuu

SEQ ID NO: 2648467 - RNA, 15 nt, Human
augugagagaaagug

SEQ ID NO: 2648468 - RNA, 14 nt, Human
augugagagaaagu

SEQ ID NO: 2648469 - RNA, 14 nt, Human
auguauauuaaaaa

SEQ ID NO: 2648470 - RNA, 16 nt, Human
auguauauuaaaaaag

SEQ ID NO: 2648471 - RNA, 17 nt, Human
auguauauuaaaaaaga

SEQ ID NO: 2648472 - RNA, 20 nt, Human
auguauauuaaaaaagagac

SEQ ID NO: 2648473 - RNA, 21 nt, Human
auguauauuaaaaaagagaca

SEQ ID NO: 2648474 - RNA, 22 nt, Human
auguauauuaaaaaagagacau

SEQ ID NO: 2648475 - RNA, 16 nt, Human
uuuggggucuuugugg

SEQ ID NO: 2648476 - RNA, 16 nt, Human
augucauuucagaagu

SEQ ID NO: 2648477 - RNA, 17 nt, Human
augucauuucagaaguu

SEQ ID NO: 2648478 - RNA, 15 nt, Human
auguccuaaugguga

SEQ ID NO: 2648479 - RNA, 16 nt, Human
auguccuaauggugau

SEQ ID NO: 2648480 - RNA, 12 nt, Human
auguccaaagag

SEQ ID NO: 2648481 - RNA, 15 nt, Human
auguccaaagaggcu

SEQ ID NO: 2648482 - RNA, 16 nt, Human
auguccaaagaggcug

SEQ ID NO: 2648483 - RNA, 18 nt, Human
auguccaaagaggcugcc

SEQ ID NO: 2648484 - RNA, 19 nt, Human
auguccaaagaggcugccc

SEQ ID NO: 2648485 - RNA, 20 nt, Human
auguccaaagaggcugcccc

SEQ ID NO: 2648486 - RNA, 21 nt, Human
auguccaaagaggcugccccu

SEQ ID NO: 2648487 - RNA, 22 nt, Human
auguccaaagaggcugccccuc

SEQ ID NO: 2648488 - RNA, 16 nt, Human
augugcauaguuucuu

SEQ ID NO: 2648489 - RNA, 17 nt, Human
augugcauaguuucuuu

SEQ ID NO: 2648490 - RNA, 18 nt, Human
augugcauaguuucuuua

SEQ ID NO: 2648491 - RNA, 18 nt, Human
uuuuaaaaaacugcugac

SEQ ID NO: 2648492 - RNA, 18 nt, Human
uuuguuuuuuguuuuucu

SEQ ID NO: 2648493 - RNA, 18 nt, Human
uuuguuuuuauuuaaauu

SEQ ID NO: 2648494 - RNA, 15 nt, Human
uuuguuuuuuaaaaa

SEQ ID NO: 2648495 - RNA, 15 nt, Human
uuuguuuuucugcuu

SEQ ID NO: 2648496 - RNA, 13 nt, Human
auguguuuagaau

SEQ ID NO: 2648497 - RNA, 16 nt, Human
auguguuuagaauuga

SEQ ID NO: 2648498 - RNA, 14 nt, Human
auguguuuagaauu

SEQ ID NO: 2648499 - RNA, 20 nt, Human
auguguuuagaauugaaggu

SEQ ID NO: 2648500 - RNA, 17 nt, Human
auguguuuagaauugaa

SEQ ID NO: 2648501 - RNA, 16 nt, Human
auguuaaagagaauga

SEQ ID NO: 2648502 - RNA, 17 nt, Human
auguuaaagagaaugag

SEQ ID NO: 2648503 - RNA, 18 nt, Human
auguuaaagagaaugagu

SEQ ID NO: 2648504 - RNA, 22 nt, Human
auguuaaagagaaugaguccuu

SEQ ID NO: 2648505 - RNA, 15 nt, Human
auguguuuuagaugg

SEQ ID NO: 2648506 - RNA, 14 nt, Human
auguguggccugca

SEQ ID NO: 2648507 - RNA, 21 nt, Human
uuuuagacccuauugcugcuu

SEQ ID NO: 2648508 - RNA, 20 nt, Human
auguucuuuuaaaugauuga

SEQ ID NO: 2648509 - RNA, 19 nt, Human
auguuacaaaaauaaacua

SEQ ID NO: 2648510 - RNA, 17 nt, Human
auguuacaaguuuauau

SEQ ID NO: 2648511 - RNA, 20 nt, Human
auguuacaaguuuauauaua

SEQ ID NO: 2648512 - RNA, 21 nt, Human
auguuauuuucuguugaaguu

SEQ ID NO: 2648513 - RNA, 18 nt, Human
auguuauuuucuguugaa

SEQ ID NO: 2648514 - RNA, 13 nt, Human
auguuauuaucug

SEQ ID NO: 2648515 - RNA, 12 nt, Human
auguuauguuua

SEQ ID NO: 2648516 - RNA, 13 nt, Human
auguuauguuuaa

SEQ ID NO: 2648517 - RNA, 16 nt, Human
auguuauguuuaauaa

SEQ ID NO: 2648518 - RNA, 19 nt, Human
auguuauguuuaauaagcu

SEQ ID NO: 2648519 - RNA, 15 nt, Human
auguuauuagauguu

SEQ ID NO: 2648520 - RNA, 14 nt, Human
uuuuaguaauuucu

SEQ ID NO: 2648521 - RNA, 19 nt, Human
uuuuaguauuuauuuaugu

SEQ ID NO: 2648522 - RNA, 20 nt, Human
uuuuaguauuuauuuaugua

SEQ ID NO: 2648523 - RNA, 23 nt, Human
uuuuaguauuuauuuauguacuu

SEQ ID NO: 2648524 - RNA, 23 nt, Human
uuuuauuaaucacuguguauauu

SEQ ID NO: 2648525 - RNA, 11 nt, Human
uuuuauuaaug

SEQ ID NO: 2648526 - RNA, 22 nt, Human
uuuuauuaaucacuguguauau

SEQ ID NO: 2648527 - RNA, 21 nt, Human
uuuuauuaaucacuguguaua

SEQ ID NO: 2648528 - RNA, 20 nt, Human
uuuuauuaaucacuguguau

SEQ ID NO: 2648529 - RNA, 18 nt, Human
uuuuauuaaucacugugu

SEQ ID NO: 2648530 - RNA, 15 nt, Human
uuuuauuaaucacug

SEQ ID NO: 2648531 - RNA, 14 nt, Human
uuuuauuaaucacu

SEQ ID NO: 2648532 - RNA, 13 nt, Human
uuuuauuaaucac

SEQ ID NO: 2648533 - RNA, 12 nt, Human
uuuuauuaauca

SEQ ID NO: 2648534 - RNA, 14 nt, Human
uuuuauuaaaacau

SEQ ID NO: 2648535 - RNA, 19 nt, Human
uuuuauuaaaauauuucag

SEQ ID NO: 2648536 - RNA, 22 nt, Human
uuuuauuaaaauauuucagguu

SEQ ID NO: 2648537 - RNA, 10 nt, Human
uuuuauuguu

SEQ ID NO: 2648538 - RNA, 13 nt, Human
uuuuauuguugua

SEQ ID NO: 2648539 - RNA, 22 nt, Human
uuuucagggcuggcuccugauc

SEQ ID NO: 2648540 - RNA, 19 nt, Human
uuuuccaaagagugauagu

SEQ ID NO: 2648541 - RNA, 11 nt, Human
uuuuccaaaug

SEQ ID NO: 2648542 - RNA, 22 nt, Human
uuuuccaaauguaauaaacuuu

SEQ ID NO: 2648543 - RNA, 18 nt, Human
uuuuccacuccauugucg

SEQ ID NO: 2648544 - RNA, 17 nt, Human
uuuucuacuuuuuuuaa

SEQ ID NO: 2648545 - RNA, 14 nt, Human
uuuucuagaauuau

SEQ ID NO: 2648546 - RNA, 15 nt, Human
uuuucuagaauuauu

SEQ ID NO: 2648547 - RNA, 20 nt, Human
uuuucuagaauuauuuuuca

SEQ ID NO: 2648548 - RNA, 22 nt, Human
uuuucuagaauuauuuuucacu

SEQ ID NO: 2648549 - RNA, 14 nt, Human
uuuucucuguacuu

SEQ ID NO: 2648550 - RNA, 18 nt, Human
uuuucucuguacuuuuca

SEQ ID NO: 2648551 - RNA, 20 nt, Human
uuuucucugcauuuaaaaaa

SEQ ID NO: 2648552 - RNA, 23 nt, Human
uuuucuguugaaguuuacaauca

SEQ ID NO: 2648553 - RNA, 12 nt, Human
uuuucugcccug

SEQ ID NO: 2648554 - RNA, 13 nt, Human
uuuucugcccugg

SEQ ID NO: 2648555 - RNA, 15 nt, Human
uuuucugcccuggcu

SEQ ID NO: 2648556 - RNA, 16 nt, Human
uuuucugcccuggcug

SEQ ID NO: 2648557 - RNA, 12 nt, Human
uuuucugcuuua

SEQ ID NO: 2648558 - RNA, 19 nt, Human
uuuucugcuuuagacuuga

SEQ ID NO: 2648559 - RNA, 15 nt, Human
uuuucugcuuuagac

SEQ ID NO: 2648560 - RNA, 22 nt, Human
uuuucugcuuuagacuugaaaa

SEQ ID NO: 2648561 - RNA, 19 nt, Human
auguugggaaacuuggcuc

SEQ ID NO: 2648562 - RNA, 20 nt, Human
auguugggaaacuuggcucg

SEQ ID NO: 2648563 - RNA, 12 nt, Human
auguugggacug

SEQ ID NO: 2648564 - RNA, 12 nt, Human
auguuuaaaaua

SEQ ID NO: 2648565 - RNA, 15 nt, Human
auguuuaaaauaaaa

SEQ ID NO: 2648566 - RNA, 17 nt, Human
auguuuaaaauaaaaug

SEQ ID NO: 2648567 - RNA, 18 nt, Human
auguuuaaaauaaaauga

SEQ ID NO: 2648568 - RNA, 19 nt, Human
auguuuaaaauaaaaugaa

SEQ ID NO: 2648569 - RNA, 22 nt, Human
auguuuuuuaaaauauuuaucu

SEQ ID NO: 2648570 - RNA, 13 nt, Human
auuaaaaaagaga

SEQ ID NO: 2648571 - RNA, 16 nt, Human
auuaaaaaagagacau

SEQ ID NO: 2648572 - RNA, 22 nt, Human
auuaaaaaagagacauccaaau

SEQ ID NO: 2648573 - RNA, 14 nt, Human
auguuuuuauacaa

SEQ ID NO: 2648574 - RNA, 15 nt, Human
auguuuuuauacaaa

SEQ ID NO: 2648575 - RNA, 18 nt, Human
auguuuuuauacaaaaua

SEQ ID NO: 2648576 - RNA, 12 nt, Human
auguuuuuauac

SEQ ID NO: 2648577 - RNA, 20 nt, Human
auuccuauauccugugacug

SEQ ID NO: 2648578 - RNA, 19 nt, Human
auuccuauauccugugacu

SEQ ID NO: 2648579 - RNA, 17 nt, Human
auugaagguuuuugaua

SEQ ID NO: 2648580 - RNA, 13 nt, Human
auugaagguuuuu

SEQ ID NO: 2648581 - RNA, 19 nt, Human
auugaagguuuuugauagc

SEQ ID NO: 2648582 - RNA, 18 nt, Human
auugaagguuuuugauag

SEQ ID NO: 2648583 - RNA, 22 nt, Human
auugaaugauauauaaauauau

SEQ ID NO: 2648584 - RNA, 16 nt, Human
auugaaguaaugaauu

SEQ ID NO: 2648585 - RNA, 22 nt, Human
auugaaguguauaauauaaaaa

SEQ ID NO: 2648586 - RNA, 15 nt, Human
auugaaguaaugaau

SEQ ID NO: 2648587 - RNA, 14 nt, Human
auugaaguaaugaa

SEQ ID NO: 2648588 - RNA, 20 nt, Human
auugaagguuuuugauagca

SEQ ID NO: 2648589 - RNA, 23 nt, Human
auugcaguuuaucauucaagugu

SEQ ID NO: 2648590 - RNA, 14 nt, Human
auugauuugauugg

SEQ ID NO: 2648591 - RNA, 12 nt, Human
auugcaccacug

SEQ ID NO: 2648592 - RNA, 21 nt, Human
auugauguggcccuggcugcc

SEQ ID NO: 2648593 - RNA, 14 nt, Human
auugcaaaauacau

SEQ ID NO: 2648594 - RNA, 16 nt, Human
auugcaaaauacauga

SEQ ID NO: 2648595 - RNA, 17 nt, Human
auugcaaaauacaugaa

SEQ ID NO: 2648596 - RNA, 18 nt, Human
auugcaaaauacaugaag

SEQ ID NO: 2648597 - RNA, 19 nt, Human
auugcaaaauacaugaagc

SEQ ID NO: 2648598 - RNA, 12 nt, Human
auuggggaggag

SEQ ID NO: 2648599 - RNA, 14 nt, Human
auuggggaggaggg

SEQ ID NO: 2648600 - RNA, 21 nt, Human
auuggggaggagggggccggg

SEQ ID NO: 2648601 - RNA, 14 nt, Human
auugccuguuucug

SEQ ID NO: 2648602 - RNA, 15 nt, Human
auugccuguuucuga

SEQ ID NO: 2648603 - RNA, 21 nt, Human
auugccuguuucugauuugcu

SEQ ID NO: 2648604 - RNA, 17 nt, Human
auugccuuuuaauuuuu

SEQ ID NO: 2648605 - RNA, 15 nt, Human
auugcauacuuugua

SEQ ID NO: 2648606 - RNA, 21 nt, Human
auugcauacuuuguauuuuga

SEQ ID NO: 2648607 - RNA, 14 nt, Human
auugcaucacugua

SEQ ID NO: 2648608 - RNA, 15 nt, Human
auugcaucacuguau

SEQ ID NO: 2648609 - RNA, 16 nt, Human
auugcaucacuguauc

SEQ ID NO: 2648610 - RNA, 19 nt, Human
auugcaucacuguaucauu

SEQ ID NO: 2648611 - RNA, 20 nt, Human
auuugaauuuuaaaucuaaa

SEQ ID NO: 2648612 - RNA, 18 nt, Human
auuugaauuuuaaaucua

SEQ ID NO: 2648613 - RNA, 23 nt, Human
auuugagaauagacccuuacuag

SEQ ID NO: 2648614 - RNA, 19 nt, Human
auuugagaaaauaaagcua

SEQ ID NO: 2648615 - RNA, 15 nt, Human
auuucuucagggcug

SEQ ID NO: 2648616 - RNA, 13 nt, Human
auuucuuauguga

SEQ ID NO: 2648617 - RNA, 14 nt, Human
auuucuuaugugac

SEQ ID NO: 2648618 - RNA, 16 nt, Human
auuucuuaugugacau

SEQ ID NO: 2648619 - RNA, 17 nt, Human
auuucuuaugugacauu

SEQ ID NO: 2648620 - RNA, 18 nt, Human
auuucuuaugugacauua

SEQ ID NO: 2648621 - RNA, 19 nt, Human
auuucuuaugugacauuaa

SEQ ID NO: 2648622 - RNA, 21 nt, Human
auuucuuaugugacauuaaca

SEQ ID NO: 2648623 - RNA, 18 nt, Human
auuucuuuaaaagaauga

SEQ ID NO: 2648624 - RNA, 20 nt, Human
auuucuuuaaaagaaugacu

SEQ ID NO: 2648625 - RNA, 21 nt, Human
auuucuuuaaaagaaugacua

SEQ ID NO: 2648626 - RNA, 23 nt, Human
auuuauuuuuuuuaauuguauuu

SEQ ID NO: 2648627 - RNA, 22 nt, Human
auuuauuuuuuuuaauuguauu

SEQ ID NO: 2648628 - RNA, 13 nt, Human
auuuccauugcuu

SEQ ID NO: 2648629 - RNA, 17 nt, Human
auuuauuuuuuuuaaag

SEQ ID NO: 2648630 - RNA, 18 nt, Human
auuuauuuuuuuuaaaga

SEQ ID NO: 2648631 - RNA, 19 nt, Human
auuuauuuuuuuuaaagaa

SEQ ID NO: 2648632 - RNA, 21 nt, Human
auuuauuuuuuuuaauuguau

SEQ ID NO: 2648633 - RNA, 19 nt, Human
auuuauuuuuuuuaauugu

SEQ ID NO: 2648634 - RNA, 19 nt, Human
auuuauuuuccuaaagaga

SEQ ID NO: 2648635 - RNA, 15 nt, Human
auuuauuuuccuaaa

SEQ ID NO: 2648636 - RNA, 16 nt, Human
auuuauuuuccuaaag

SEQ ID NO: 2648637 - RNA, 17 nt, Human
auuuauuuuccuaaaga

SEQ ID NO: 2648638 - RNA, 10 nt, Human
auuuccuuua

SEQ ID NO: 2648639 - RNA, 17 nt, Human
auuuccucgcagccucu

SEQ ID NO: 2648640 - RNA, 19 nt, Human
auuuccucgcagccucuca

SEQ ID NO: 2648641 - RNA, 19 nt, Human
auuuccucccucugccccu

SEQ ID NO: 2648642 - RNA, 21 nt, Human
auuuccucccucugccccucc

SEQ ID NO: 2648643 - RNA, 15 nt, Human
auuuccuuuuugaca

SEQ ID NO: 2648644 - RNA, 17 nt, Human
auuuccuuuuugacacu

SEQ ID NO: 2648645 - RNA, 18 nt, Human
auuuccuuuuugacacug

SEQ ID NO: 2648646 - RNA, 19 nt, Human
auuuccuuuuugacacuga

SEQ ID NO: 2648647 - RNA, 20 nt, Human
auuuccuuuuugacacugaa

SEQ ID NO: 2648648 - RNA, 13 nt, Human
auuuccuuuaugu

SEQ ID NO: 2648649 - RNA, 14 nt, Human
auuuccuuuaugug

SEQ ID NO: 2648650 - RNA, 15 nt, Human
auuuccuuuauguga

SEQ ID NO: 2648651 - RNA, 16 nt, Human
auuuccuuuaugugaa

SEQ ID NO: 2648652 - RNA, 17 nt, Human
auuuccuuuaugugaau

SEQ ID NO: 2648653 - RNA, 18 nt, Human
auuuccuuuaugugaauu

SEQ ID NO: 2648654 - RNA, 19 nt, Human
auuuccuuuaugugaauuu

SEQ ID NO: 2648655 - RNA, 20 nt, Human
auuuccuuuaugugaauuuu

SEQ ID NO: 2648656 - RNA, 21 nt, Human
auuuccuuuaugugaauuuuu

SEQ ID NO: 2648657 - RNA, 20 nt, Human
auuucauguaaaacagaaaa

SEQ ID NO: 2648658 - RNA, 14 nt, Human
auuuauugaguuuu

SEQ ID NO: 2648659 - RNA, 23 nt, Human
auuuauugauuccuuuuuucaaa

SEQ ID NO: 2648660 - RNA, 14 nt, Human
auuuauugacucuu

SEQ ID NO: 2648661 - RNA, 13 nt, Human
auuuauugacucu

SEQ ID NO: 2648662 - RNA, 22 nt, Human
auuuauugacucuugaguuguu

SEQ ID NO: 2648663 - RNA, 20 nt, Human
auuuauugacucuugaguug

SEQ ID NO: 2648664 - RNA, 19 nt, Human
auuuauugacucuugaguu

SEQ ID NO: 2648665 - RNA, 16 nt, Human
auuuauugacucuuga

SEQ ID NO: 2648666 - RNA, 15 nt, Human
auuuauguguauaug

SEQ ID NO: 2648667 - RNA, 16 nt, Human
auuuauguguauaugg

SEQ ID NO: 2648668 - RNA, 16 nt, Human
auuuaguuguaaacca

SEQ ID NO: 2648669 - RNA, 22 nt, Human
auuuaguguuuuuuuauuucua

SEQ ID NO: 2648670 - RNA, 23 nt, Human
auuuaguguuuuuuuauuucuac

SEQ ID NO: 2648671 - RNA, 12 nt, Human
auuuacuuguuu

SEQ ID NO: 2648672 - RNA, 15 nt, Human
auuuacuuguuuugg

SEQ ID NO: 2648673 - RNA, 16 nt, Human
auuuacuuguuuugga

SEQ ID NO: 2648674 - RNA, 23 nt, Human
auuuacuuguuuuggauggcuug

SEQ ID NO: 2648675 - RNA, 23 nt, Human
auuuaaaaggauggcaaguugca

SEQ ID NO: 2648676 - RNA, 16 nt, Human
auuuaaaauaauuaua

SEQ ID NO: 2648677 - RNA, 14 nt, Human
auuuaaaaaaaauc

SEQ ID NO: 2648678 - RNA, 19 nt, Human
auuguuuuacaauaguucu

SEQ ID NO: 2648679 - RNA, 15 nt, Human
auuuacauuuaauag

SEQ ID NO: 2648680 - RNA, 16 nt, Human
auuuacucuaaaaacu

SEQ ID NO: 2648681 - RNA, 17 nt, Human
auuuacucuaaaaacug

SEQ ID NO: 2648682 - RNA, 15 nt, Human
auuuacuacuuuugc

SEQ ID NO: 2648683 - RNA, 15 nt, Human
auuuacuacaguagu

SEQ ID NO: 2648684 - RNA, 19 nt, Human
auuuacagaugaauguauu

SEQ ID NO: 2648685 - RNA, 18 nt, Human
auuuacaagggaagauuu

SEQ ID NO: 2648686 - RNA, 21 nt, Human
auuuacaagggaagauuuaug

SEQ ID NO: 2648687 - RNA, 20 nt, Human
auuuaaauccugaagagcau

SEQ ID NO: 2648688 - RNA, 13 nt, Human
auuuaaaugccau

SEQ ID NO: 2648689 - RNA, 13 nt, Human
auuuaaaugaaag

SEQ ID NO: 2648690 - RNA, 17 nt, Human
auuuaaaugaaagaaaa

SEQ ID NO: 2648691 - RNA, 15 nt, Human
cauuuguuaaaauua

SEQ ID NO: 2648692 - RNA, 18 nt, Human
cauuuguuaaaauuauca

SEQ ID NO: 2648693 - RNA, 22 nt, Human
cauuuguuaaaauuaucaauau

SEQ ID NO: 2648694 - RNA, 20 nt, Human
cauuuguuuacauuugaugc

SEQ ID NO: 2648695 - RNA, 17 nt, Human
cauuugggguaauacuu

SEQ ID NO: 2648696 - RNA, 23 nt, Human
cauuugggaguuuuuaugagaaa

SEQ ID NO: 2648697 - RNA, 12 nt, Human
ccaaaaaacuac

SEQ ID NO: 2648698 - RNA, 14 nt, Human
cauuuaguaagaau

SEQ ID NO: 2648699 - RNA, 15 nt, Human
cauuuaguaagaaua

SEQ ID NO: 2648700 - RNA, 13 nt, Human
ccaacuccagcaa

SEQ ID NO: 2648701 - RNA, 14 nt, Human
ccaacuccagcaac

SEQ ID NO: 2648702 - RNA, 15 nt, Human
ccaacuccagcaacu

SEQ ID NO: 2648703 - RNA, 16 nt, Human
ccaacuauuuauugac

SEQ ID NO: 2648704 - RNA, 11 nt, Human
ccaacuauuua

SEQ ID NO: 2648705 - RNA, 23 nt, Human
ccaacuauuuauugacucugggu

SEQ ID NO: 2648706 - RNA, 21 nt, Human
ccaacuccagcaacuucuucu

SEQ ID NO: 2648707 - RNA, 21 nt, Human
ccaaagugccggugagaccca

SEQ ID NO: 2648708 - RNA, 20 nt, Human
ccaaauauuaggcuuaaaaa

SEQ ID NO: 2648709 - RNA, 21 nt, Human
cauguccaaagaggcugcccc

SEQ ID NO: 2648710 - RNA, 22 nt, Human
cauguaugucagaagugcagaa

SEQ ID NO: 2648711 - RNA, 12 nt, Human
cauguauguuuc

SEQ ID NO: 2648712 - RNA, 13 nt, Human
cauguauguuucu

SEQ ID NO: 2648713 - RNA, 18 nt, Human
caugucauuucagaaguu

SEQ ID NO: 2648714 - RNA, 19 nt, Human
cauguccaaacguccucuu

SEQ ID NO: 2648715 - RNA, 12 nt, Human
cauguccaaaga

SEQ ID NO: 2648716 - RNA, 13 nt, Human
cauguccaaagag

SEQ ID NO: 2648717 - RNA, 14 nt, Human
cauguccaaagagg

SEQ ID NO: 2648718 - RNA, 15 nt, Human
cauguccaaagaggc

SEQ ID NO: 2648719 - RNA, 16 nt, Human
cauguccaaagaggcu

SEQ ID NO: 2648720 - RNA, 17 nt, Human
cauguccaaagaggcug

SEQ ID NO: 2648721 - RNA, 18 nt, Human
cauguccaaagaggcugc

SEQ ID NO: 2648722 - RNA, 19 nt, Human
cauguccaaagaggcugcc

SEQ ID NO: 2648723 - RNA, 20 nt, Human
cauguccaaagaggcugccc

SEQ ID NO: 2648724 - RNA, 13 nt, Human
cauucucuuuuaa

SEQ ID NO: 2648725 - RNA, 14 nt, Human
cauucucuuuuaau

SEQ ID NO: 2648726 - RNA, 16 nt, Human
caugcuccuggcccac

SEQ ID NO: 2648727 - RNA, 14 nt, Human
caugcuccuggccc

SEQ ID NO: 2648728 - RNA, 17 nt, Human
caugcuccuggcccacu

SEQ ID NO: 2648729 - RNA, 13 nt, Human
cauggcccugggc

SEQ ID NO: 2648730 - RNA, 14 nt, Human
cauggcccugggcg

SEQ ID NO: 2648731 - RNA, 12 nt, Human
cauggcccuggg

SEQ ID NO: 2648732 - RNA, 14 nt, Human
caugcaagcagagg

SEQ ID NO: 2648733 - RNA, 15 nt, Human
caugcaagcagagga

SEQ ID NO: 2648734 - RNA, 17 nt, Human
caugcaagcagaggacc

SEQ ID NO: 2648735 - RNA, 22 nt, Human
caugcaagcagaggaccagggc

SEQ ID NO: 2648736 - RNA, 23 nt, Human
caugcaagcagaggaccagggcc

SEQ ID NO: 2648737 - RNA, 16 nt, Human
caugcaaaugagcucu

SEQ ID NO: 2648738 - RNA, 20 nt, Human
caugcaaaugagcucugaaa

SEQ ID NO: 2648739 - RNA, 22 nt, Human
caugcaaaugagcucugaaauc

SEQ ID NO: 2648740 - RNA, 15 nt, Human
caugaauuuuaaaau

SEQ ID NO: 2648741 - RNA, 17 nt, Human
caugaaucuuuguuuca

SEQ ID NO: 2648742 - RNA, 16 nt, Human
caugaaucaaaagugc

SEQ ID NO: 2648743 - RNA, 17 nt, Human
caugaaucaaaagugcc

SEQ ID NO: 2648744 - RNA, 18 nt, Human
caugaaucaaaagugccu

SEQ ID NO: 2648745 - RNA, 15 nt, Human
caucagaaagcuuua

SEQ ID NO: 2648746 - RNA, 22 nt, Human
caucagaaagcuuuauuuugag

SEQ ID NO: 2648747 - RNA, 18 nt, Human
caucccaaccaggcaccu

SEQ ID NO: 2648748 - RNA, 20 nt, Human
caucccaaccaggcaccucu

SEQ ID NO: 2648749 - RNA, 23 nt, Human
caucccaaccaggcaccucuucc

SEQ ID NO: 2648750 - RNA, 19 nt, Human
cauccugaccagcugcucc

SEQ ID NO: 2648751 - RNA, 16 nt, Human
caucuggaguucucaa

SEQ ID NO: 2648752 - RNA, 15 nt, Human
caucuggaguucuca

SEQ ID NO: 2648753 - RNA, 14 nt, Human
caguuuguuggaaa

SEQ ID NO: 2648754 - RNA, 15 nt, Human
caguuuguuggaaag

SEQ ID NO: 2648755 - RNA, 21 nt, Human
caguuugaggauuaguuuaga

SEQ ID NO: 2648756 - RNA, 15 nt, Human
caguuugagacagga

SEQ ID NO: 2648757 - RNA, 18 nt, Human
caguuugagacaggagac

SEQ ID NO: 2648758 - RNA, 16 nt, Human
caguuugagacaggag

SEQ ID NO: 2648759 - RNA, 19 nt, Human
caguuuaucauucaagugu

SEQ ID NO: 2648760 - RNA, 14 nt, Human
caguuuaucauuca

SEQ ID NO: 2648761 - RNA, 15 nt, Human
caguuuaucauucaa

SEQ ID NO: 2648762 - RNA, 16 nt, Human
caguuuaucauucaag

SEQ ID NO: 2648763 - RNA, 18 nt, Human
caguuuaucauucaagug

SEQ ID NO: 2648764 - RNA, 13 nt, Human
cauacauaaaaga

SEQ ID NO: 2648765 - RNA, 14 nt, Human
cauacauaaaagaa

SEQ ID NO: 2648766 - RNA, 15 nt, Human
cauacauaaaagaaa

SEQ ID NO: 2648767 - RNA, 18 nt, Human
cauacauaaaagaaauaa

SEQ ID NO: 2648768 - RNA, 20 nt, Human
cauacauaaaagaaauaaac

SEQ ID NO: 2648769 - RNA, 13 nt, Human
caguuuucagaaa

SEQ ID NO: 2648770 - RNA, 14 nt, Human
caguuuucagaaaa

SEQ ID NO: 2648771 - RNA, 13 nt, Human
caguuuucauagu

SEQ ID NO: 2648772 - RNA, 15 nt, Human
caguuuucauaguau

SEQ ID NO: 2648773 - RNA, 17 nt, Human
cauauuauaaaggauaa

SEQ ID NO: 2648774 - RNA, 21 nt, Human
cauauuauaaaggauaaagaa

SEQ ID NO: 2648775 - RNA, 22 nt, Human
cauauuauaaaggauaaagaag

SEQ ID NO: 2648776 - RNA, 22 nt, Human
cauagguucacaccauuuuguu

SEQ ID NO: 2648777 - RNA, 13 nt, Human
cagugcaaaugca

SEQ ID NO: 2648778 - RNA, 18 nt, Human
cagugcaaaugcaugcuu

SEQ ID NO: 2648779 - RNA, 20 nt, Human
cagugcaaaugcaugcuucu

SEQ ID NO: 2648780 - RNA, 14 nt, Human
caguggguuaacau

SEQ ID NO: 2648781 - RNA, 21 nt, Human
caguggguuaacaucaguuuu

SEQ ID NO: 2648782 - RNA, 16 nt, Human
cagugguaagaauagu

SEQ ID NO: 2648783 - RNA, 17 nt, Human
cagugguaagaauagua

SEQ ID NO: 2648784 - RNA, 15 nt, Human
cagucuccggccucu

SEQ ID NO: 2648785 - RNA, 17 nt, Human
cagucuccggccucucc

SEQ ID NO: 2648786 - RNA, 18 nt, Human
cagucuccggccucucca

SEQ ID NO: 2648787 - RNA, 20 nt, Human
cagucuccggccucuccagc

SEQ ID NO: 2648788 - RNA, 21 nt, Human
cagucuccggccucuccagcc

SEQ ID NO: 2648789 - RNA, 22 nt, Human
cagucuccggccucuccagccu

SEQ ID NO: 2648790 - RNA, 14 nt, Human
cagucgugccugug

SEQ ID NO: 2648791 - RNA, 17 nt, Human
cagucgugccugugucc

SEQ ID NO: 2648792 - RNA, 15 nt, Human
cagucgugccugugu

SEQ ID NO: 2648793 - RNA, 15 nt, Human
caguuauuacaugua

SEQ ID NO: 2648794 - RNA, 18 nt, Human
caguuauuacauguaauu

SEQ ID NO: 2648795 - RNA, 15 nt, Human
caguuauaagaagaa

SEQ ID NO: 2648796 - RNA, 16 nt, Human
caguucaucgauuuuc

SEQ ID NO: 2648797 - RNA, 19 nt, Human
caguucaucgauuuucuau

SEQ ID NO: 2648798 - RNA, 23 nt, Human
cagacagaacuugaaugugucag

SEQ ID NO: 2648799 - RNA, 22 nt, Human
cagacagaacuugaauguguca

SEQ ID NO: 2648800 - RNA, 20 nt, Human
cagacagaacuugaaugugu

SEQ ID NO: 2648801 - RNA, 15 nt, Human
cagacagaacuugaa

SEQ ID NO: 2648802 - RNA, 14 nt, Human
cagacuggggcauc

SEQ ID NO: 2648803 - RNA, 16 nt, Human
cagacuggggcauccu

SEQ ID NO: 2648804 - RNA, 18 nt, Human
cagacuggggcauccugu

SEQ ID NO: 2648805 - RNA, 21 nt, Human
cagacuggggcauccugugcc

SEQ ID NO: 2648806 - RNA, 22 nt, Human
cagacuggggcauccugugcca

SEQ ID NO: 2648807 - RNA, 14 nt, Human
cagauuucugagga

SEQ ID NO: 2648808 - RNA, 17 nt, Human
cagauuucugaggaaau

SEQ ID NO: 2648809 - RNA, 15 nt, Human
cagauuucugaggaa

SEQ ID NO: 2648810 - RNA, 23 nt, Human
cagccagaccagauuaaacuuca

SEQ ID NO: 2648811 - RNA, 12 nt, Human
cagcaccuggca

SEQ ID NO: 2648812 - RNA, 13 nt, Human
cagcaccuugugc

SEQ ID NO: 2648813 - RNA, 15 nt, Human
cagcaccuugugccu

SEQ ID NO: 2648814 - RNA, 16 nt, Human
cagcaccuugugccug

SEQ ID NO: 2648815 - RNA, 17 nt, Human
cagcaccuugugccugg

SEQ ID NO: 2648816 - RNA, 18 nt, Human
cagcaccuugugccuggg

SEQ ID NO: 2648817 - RNA, 19 nt, Human
cagcaccuugugccugggg

SEQ ID NO: 2648818 - RNA, 20 nt, Human
cagcaccuugugccuggggu

SEQ ID NO: 2648819 - RNA, 20 nt, Human
cagauauacuggaacccuuu

SEQ ID NO: 2648820 - RNA, 19 nt, Human
cagauacuuggggggcuga

SEQ ID NO: 2648821 - RNA, 15 nt, Human
cagagcuuuggucug

SEQ ID NO: 2648822 - RNA, 17 nt, Human
cagagcuuuggucugug

SEQ ID NO: 2648823 - RNA, 20 nt, Human
cagagcuuuggucugugugu

SEQ ID NO: 2648824 - RNA, 12 nt, Human
cagagcucucuc

SEQ ID NO: 2648825 - RNA, 17 nt, Human
cagagcucucucuacag

SEQ ID NO: 2648826 - RNA, 18 nt, Human
cagagcucucucuacaga

SEQ ID NO: 2648827 - RNA, 16 nt, Human
cagagagacccuugug

SEQ ID NO: 2648828 - RNA, 17 nt, Human
cagagacuuuagggggu

SEQ ID NO: 2648829 - RNA, 14 nt, Human
cagagacuuuguag

SEQ ID NO: 2648830 - RNA, 12 nt, Human
caggccucucca

SEQ ID NO: 2648831 - RNA, 13 nt, Human
caggccucuccau

SEQ ID NO: 2648832 - RNA, 17 nt, Human
caggccucuccauuugc

SEQ ID NO: 2648833 - RNA, 21 nt, Human
cagggagacgguuuccaggga

SEQ ID NO: 2648834 - RNA, 22 nt, Human
cagggagacgguuuccagggag

SEQ ID NO: 2648835 - RNA, 23 nt, Human
cagggagacgguuuccagggagg

SEQ ID NO: 2648836 - RNA, 22 nt, Human
cagggagacuggguaggaaaga

SEQ ID NO: 2648837 - RNA, 10 nt, Human
caggcugggc

SEQ ID NO: 2648838 - RNA, 11 nt, Human
cagggcuccug

SEQ ID NO: 2648839 - RNA, 12 nt, Human
cagggcuccugc

SEQ ID NO: 2648840 - RNA, 14 nt, Human
cagggcuccugcac

SEQ ID NO: 2648841 - RNA, 17 nt, Human
caggggaaaaucagccu

SEQ ID NO: 2648842 - RNA, 23 nt, Human
caggaccucaggugagaagcaga

SEQ ID NO: 2648843 - RNA, 16 nt, Human
caggaccucaggugag

SEQ ID NO: 2648844 - RNA, 17 nt, Human
caggaggcgcccuuggc

SEQ ID NO: 2648845 - RNA, 22 nt, Human
caggaggcgcccuuggcuucug

SEQ ID NO: 2648846 - RNA, 13 nt, Human
caggaggcgcccu

SEQ ID NO: 2648847 - RNA, 19 nt, Human
caggaggaucacuugaguc

SEQ ID NO: 2648848 - RNA, 16 nt, Human
caggcacggguggucc

SEQ ID NO: 2648849 - RNA, 17 nt, Human
caggcacgggugguccc

SEQ ID NO: 2648850 - RNA, 18 nt, Human
caggcacggguggucccc

SEQ ID NO: 2648851 - RNA, 19 nt, Human
caggcacgggugguccccg

SEQ ID NO: 2648852 - RNA, 20 nt, Human
caggcacgggugguccccgu

SEQ ID NO: 2648853 - RNA, 23 nt, Human
caggcacgggugguccccguucc

SEQ ID NO: 2648854 - RNA, 14 nt, Human
caggcaccucuucc

SEQ ID NO: 2648855 - RNA, 15 nt, Human
caggcaccucuuccu

SEQ ID NO: 2648856 - RNA, 12 nt, Human
cagcuuauuguu

SEQ ID NO: 2648857 - RNA, 13 nt, Human
cagcuuauuguuu

SEQ ID NO: 2648858 - RNA, 20 nt, Human
caggaaacuccacaucugcc

SEQ ID NO: 2648859 - RNA, 21 nt, Human
caggaaacuccacaucugccu

SEQ ID NO: 2648860 - RNA, 22 nt, Human
caggaaacuccacaucugccuu

SEQ ID NO: 2648861 - RNA, 23 nt, Human
caggaaacuccacaucugccuua

SEQ ID NO: 2648862 - RNA, 23 nt, Human
caggaaaauuguuugaacccagg

SEQ ID NO: 2648863 - RNA, 19 nt, Human
caggaaacuccacaucugc

SEQ ID NO: 2648864 - RNA, 13 nt, Human
caggaaaccgagu

SEQ ID NO: 2648865 - RNA, 21 nt, Human
cagcugacuuuucuguccgag

SEQ ID NO: 2648866 - RNA, 22 nt, Human
cagcggagguguggagccgagg

SEQ ID NO: 2648867 - RNA, 16 nt, Human
cagccugcuccagcug

SEQ ID NO: 2648868 - RNA, 15 nt, Human
cagccugcuccagcu

SEQ ID NO: 2648869 - RNA, 17 nt, Human
cagcgcggcccucccga

SEQ ID NO: 2648870 - RNA, 19 nt, Human
cagccugcuccagcuguuc

SEQ ID NO: 2648871 - RNA, 17 nt, Human
cagccugcuccagcugu

SEQ ID NO: 2648872 - RNA, 15 nt, Human
caauauuugaauuuu

SEQ ID NO: 2648873 - RNA, 16 nt, Human
caauauugucucccuu

SEQ ID NO: 2648874 - RNA, 22 nt, Human
caauauugucucccuuccagca

SEQ ID NO: 2648875 - RNA, 19 nt, Human
caauauuugaauuuuaaau

SEQ ID NO: 2648876 - RNA, 15 nt, Human
caauauuuuaugguu

SEQ ID NO: 2648877 - RNA, 17 nt, Human
caauauuuuaugguuau

SEQ ID NO: 2648878 - RNA, 21 nt, Human
caauauuuuaugguuauguuu

SEQ ID NO: 2648879 - RNA, 22 nt, Human
caauauuuuaugguuauguuuu

SEQ ID NO: 2648880 - RNA, 23 nt, Human
caauauuuuaugguuauguuuuu

SEQ ID NO: 2648881 - RNA, 16 nt, Human
caauauuuuuauauca

SEQ ID NO: 2648882 - RNA, 20 nt, Human
caauauuuuuauaucaugca

SEQ ID NO: 2648883 - RNA, 22 nt, Human
caauauuuuuauaucaugcaaa

SEQ ID NO: 2648884 - RNA, 23 nt, Human
caauauuuuuauaucaugcaaaa

SEQ ID NO: 2648885 - RNA, 23 nt, Human
caaucaaauaaguauuuauaaua

SEQ ID NO: 2648886 - RNA, 18 nt, Human
caaucaagguuauaauuu

SEQ ID NO: 2648887 - RNA, 19 nt, Human
caaucaagguuauaauuuu

SEQ ID NO: 2648888 - RNA, 20 nt, Human
caaucaagguuauaauuuuu

SEQ ID NO: 2648889 - RNA, 22 nt, Human
caaucaaauaaguauuuauaau

SEQ ID NO: 2648890 - RNA, 17 nt, Human
caaucaaauaaguauuu

SEQ ID NO: 2648891 - RNA, 18 nt, Human
caaucaaaggaaaauagu

SEQ ID NO: 2648892 - RNA, 21 nt, Human
caauauuuuggaguauguuaa

SEQ ID NO: 2648893 - RNA, 16 nt, Human
caauauuuguuacugu

SEQ ID NO: 2648894 - RNA, 21 nt, Human
caauugguaaaacucacugug

SEQ ID NO: 2648895 - RNA, 15 nt, Human
caauugucacuuuuu

SEQ ID NO: 2648896 - RNA, 16 nt, Human
caauugucacuuuuua

SEQ ID NO: 2648897 - RNA, 17 nt, Human
caauugucacuuuuuau

SEQ ID NO: 2648898 - RNA, 13 nt, Human
caauugucuuuuu

SEQ ID NO: 2648899 - RNA, 21 nt, Human
caaugcugauuuggugaccaa

SEQ ID NO: 2648900 - RNA, 16 nt, Human
caaugcugauuuggug

SEQ ID NO: 2648901 - RNA, 14 nt, Human
caaugcugauuugg

SEQ ID NO: 2648902 - RNA, 19 nt, Human
caagguuuuauaaggcuga

SEQ ID NO: 2648903 - RNA, 15 nt, Human
caaguaaaaaggcua

SEQ ID NO: 2648904 - RNA, 10 nt, Human
caaguaaaaa

SEQ ID NO: 2648905 - RNA, 17 nt, Human
caagcuccgcaggacuu

SEQ ID NO: 2648906 - RNA, 16 nt, Human
caagcuccgcaggacu

SEQ ID NO: 2648907 - RNA, 15 nt, Human
caagcuccgcaggac

SEQ ID NO: 2648908 - RNA, 14 nt, Human
caagcuccgcagga

SEQ ID NO: 2648909 - RNA, 12 nt, Human
caaguucaaucu

SEQ ID NO: 2648910 - RNA, 17 nt, Human
caaguucaaucuguuuu

SEQ ID NO: 2648911 - RNA, 21 nt, Human
caacuagugggguuuccuggc

SEQ ID NO: 2648912 - RNA, 22 nt, Human
caacuauuuauugacucugggu

SEQ ID NO: 2648913 - RNA, 21 nt, Human
caacuauuuauugacucuggg

SEQ ID NO: 2648914 - RNA, 20 nt, Human
caacuccagcaacuucuucu

SEQ ID NO: 2648915 - RNA, 22 nt, Human
caacuccagcaacuucuucucc

SEQ ID NO: 2648916 - RNA, 13 nt, Human
caacuccagcaac

SEQ ID NO: 2648917 - RNA, 18 nt, Human
caagaauauccuuuaaaa

SEQ ID NO: 2648918 - RNA, 13 nt, Human
caagaauauugca

SEQ ID NO: 2648919 - RNA, 15 nt, Human
caagaauauugcaaa

SEQ ID NO: 2648920 - RNA, 18 nt, Human
caagaauauugcaaaaua

SEQ ID NO: 2648921 - RNA, 20 nt, Human
caagaauauugcaaaauaca

SEQ ID NO: 2648922 - RNA, 21 nt, Human
caagaauauugcaaaauacau

SEQ ID NO: 2648923 - RNA, 23 nt, Human
caagaauauugcaaaauacauga

SEQ ID NO: 2648924 - RNA, 17 nt, Human
caagauuuucuacuuuu

SEQ ID NO: 2648925 - RNA, 16 nt, Human
caagauuuuuuaauug

SEQ ID NO: 2648926 - RNA, 18 nt, Human
caagauuuuuuaauuguu

SEQ ID NO: 2648927 - RNA, 19 nt, Human
caagauuuuuuaauuguuu

SEQ ID NO: 2648928 - RNA, 21 nt, Human
caagauuuuuuaauuguuuaa

SEQ ID NO: 2648929 - RNA, 18 nt, Human
caagauuuuccucuugug

SEQ ID NO: 2648930 - RNA, 19 nt, Human
caagauuuuccucuuguga

SEQ ID NO: 2648931 - RNA, 19 nt, Human
caagaccaccacuucgaaa

SEQ ID NO: 2648932 - RNA, 16 nt, Human
caagaucaaaaaggcu

SEQ ID NO: 2648933 - RNA, 21 nt, Human
caagaucaaaaaggcuuauaa

SEQ ID NO: 2648934 - RNA, 17 nt, Human
caagaucaaaaaggcuu

SEQ ID NO: 2648935 - RNA, 15 nt, Human
caagcaaguucugag

SEQ ID NO: 2648936 - RNA, 22 nt, Human
cacuccacauaagggguuuagu

SEQ ID NO: 2648937 - RNA, 22 nt, Human
cacggaagagccuugcggaagg

SEQ ID NO: 2648938 - RNA, 16 nt, Human
cacggaagagccuugc

SEQ ID NO: 2648939 - RNA, 14 nt, Human
cacgcuucuccgga

SEQ ID NO: 2648940 - RNA, 12 nt, Human
cacccugagccg

SEQ ID NO: 2648941 - RNA, 14 nt, Human
cacccugagccggc

SEQ ID NO: 2648942 - RNA, 17 nt, Human
cacccugccccucagag

SEQ ID NO: 2648943 - RNA, 13 nt, Human
cacccugccugcc

SEQ ID NO: 2648944 - RNA, 16 nt, Human
cacccugcugagucug

SEQ ID NO: 2648945 - RNA, 17 nt, Human
cacccugcugcuggugc

SEQ ID NO: 2648946 - RNA, 20 nt, Human
cacccugcugcuggugcaca

SEQ ID NO: 2648947 - RNA, 22 nt, Human
cacccugggcccugggcuggaa

SEQ ID NO: 2648948 - RNA, 12 nt, Human
cacccugggccc

SEQ ID NO: 2648949 - RNA, 14 nt, Human
cacccugggcccug

SEQ ID NO: 2648950 - RNA, 17 nt, Human
cacccugggcccugggc

SEQ ID NO: 2648951 - RNA, 21 nt, Human
cacccugggcccugggcugga

SEQ ID NO: 2648952 - RNA, 19 nt, Human
cacauccaacuccagcaac

SEQ ID NO: 2648953 - RNA, 12 nt, Human
cacauccaacuc

SEQ ID NO: 2648954 - RNA, 16 nt, Human
cacauccaacuccagc

SEQ ID NO: 2648955 - RNA, 18 nt, Human
cacauccaacuccagcaa

SEQ ID NO: 2648956 - RNA, 13 nt, Human
caccaggaagccg

SEQ ID NO: 2648957 - RNA, 20 nt, Human
cacccaggcuggacugcaau

SEQ ID NO: 2648958 - RNA, 21 nt, Human
auuuguuaaaauuaucaauau

SEQ ID NO: 2648959 - RNA, 14 nt, Human
auuuguuaaaauua

SEQ ID NO: 2648960 - RNA, 16 nt, Human
auuuucuauuuuaaga

SEQ ID NO: 2648961 - RNA, 23 nt, Human
auuuucuauuuuaagacugauuu

SEQ ID NO: 2648962 - RNA, 14 nt, Human
auuuucucuguacu

SEQ ID NO: 2648963 - RNA, 16 nt, Human
auuuucucuguacuuu

SEQ ID NO: 2648964 - RNA, 17 nt, Human
auuuucucuguacuuuu

SEQ ID NO: 2648965 - RNA, 12 nt, Human
auuuugaaaagu

SEQ ID NO: 2648966 - RNA, 21 nt, Human
auuuugaaaaguaauauuuau

SEQ ID NO: 2648967 - RNA, 17 nt, Human
auuuugaaaaguaauau

SEQ ID NO: 2648968 - RNA, 16 nt, Human
auuuugaaaaguaaua

SEQ ID NO: 2648969 - RNA, 14 nt, Human
auuuugaaaaguaa

SEQ ID NO: 2648970 - RNA, 16 nt, Human
auuuuuuuuaaagaaa

SEQ ID NO: 2648971 - RNA, 20 nt, Human
auuuuuuuuaauuguauuuu

SEQ ID NO: 2648972 - RNA, 18 nt, Human
auuuuuuuuaauuguauu

SEQ ID NO: 2648973 - RNA, 17 nt, Human
auuuuuuuuaauuguau

SEQ ID NO: 2648974 - RNA, 18 nt, Human
auuuuuuuuaguauuuau

SEQ ID NO: 2648975 - RNA, 22 nt, Human
auuuuuuuuaauuguauuuuug

SEQ ID NO: 2648976 - RNA, 14 nt, Human
auuuuuuuuaguau

SEQ ID NO: 2648977 - RNA, 22 nt, Human
auuuuguuuuugucuuaaaaag

SEQ ID NO: 2648978 - RNA, 14 nt, Human
auuuuuaaaaaaua

SEQ ID NO: 2648979 - RNA, 15 nt, Human
auuuuuaaaaaauau

SEQ ID NO: 2648980 - RNA, 18 nt, Human
auuuuuaaaaaauauuuu

SEQ ID NO: 2648981 - RNA, 19 nt, Human
auuuuuaaaaaauauuuuc

SEQ ID NO: 2648982 - RNA, 20 nt, Human
auuuuuaaaaaauauuuucu

SEQ ID NO: 2648983 - RNA, 23 nt, Human
auuuuuaaaaaauauuuucucug

SEQ ID NO: 2648984 - RNA, 13 nt, Human
auuuuuuucuauu

SEQ ID NO: 2648985 - RNA, 19 nt, Human
auuuuuuuuaaaauagaaa

SEQ ID NO: 2648986 - RNA, 22 nt, Human
auuuuuuuuaaaauagaaauuu

SEQ ID NO: 2648987 - RNA, 14 nt, Human
auuuuuauuucaaa

SEQ ID NO: 2648988 - RNA, 12 nt, Human
auuuuuauuguu

SEQ ID NO: 2648989 - RNA, 23 nt, Human
caaacaugagauguguggacugu

SEQ ID NO: 2648990 - RNA, 15 nt, Human
caaacaugagaugug

SEQ ID NO: 2648991 - RNA, 18 nt, Human
auuucacuacuagauuga

SEQ ID NO: 2648992 - RNA, 16 nt, Human
auuuauccagaaaacu

SEQ ID NO: 2648993 - RNA, 20 nt, Human
auuuauccagaaaacuguga

SEQ ID NO: 2648994 - RNA, 22 nt, Human
auuuauccagaaaacugugauu

SEQ ID NO: 2648995 - RNA, 12 nt, Human
auuuaagguauu

SEQ ID NO: 2648996 - RNA, 16 nt, Human
auuuaagcuuuccugu

SEQ ID NO: 2648997 - RNA, 13 nt, Human
auuuaagggaaaa

SEQ ID NO: 2648998 - RNA, 14 nt, Human
auuuaagggaaaaa

SEQ ID NO: 2648999 - RNA, 15 nt, Human
auuuaagggaaaaau

SEQ ID NO: 2649000 - RNA, 16 nt, Human
auuuaagggaaaaaua

SEQ ID NO: 2649001 - RNA, 18 nt, Human
auuuaagggaaaaauaua

SEQ ID NO: 2649002 - RNA, 16 nt, Human
auuuaagggaaagaaa

SEQ ID NO: 2649003 - RNA, 17 nt, Human
auuuaagggaaagaaaa

SEQ ID NO: 2649004 - RNA, 19 nt, Human
auuuaagggaaagaaaaug

SEQ ID NO: 2649005 - RNA, 13 nt, Human
auuuaagauguga

SEQ ID NO: 2649006 - RNA, 14 nt, Human
auuuaagaugugaa

SEQ ID NO: 2649007 - RNA, 15 nt, Human
auuuaagaugugaaa

SEQ ID NO: 2649008 - RNA, 20 nt, Human
auuuaaguuuugacaagcug

SEQ ID NO: 2649009 - RNA, 12 nt, Human
auuuaaguuuug

SEQ ID NO: 2649010 - RNA, 19 nt, Human
auuuaauaccagauaccuu

SEQ ID NO: 2649011 - RNA, 12 nt, Human
auuucagggugc

SEQ ID NO: 2649012 - RNA, 15 nt, Human
auuucagggugcagc

SEQ ID NO: 2649013 - RNA, 16 nt, Human
auuugcaauaacagcu

SEQ ID NO: 2649014 - RNA, 18 nt, Human
auuugcaauaacagcugc

SEQ ID NO: 2649015 - RNA, 19 nt, Human
auuugcaauaacagcugca

SEQ ID NO: 2649016 - RNA, 20 nt, Human
auuugcaauaacagcugcaa

SEQ ID NO: 2649017 - RNA, 17 nt, Human
auugaggccaagaauau

SEQ ID NO: 2649018 - RNA, 18 nt, Human
auugaggccaagaauauu

SEQ ID NO: 2649019 - RNA, 21 nt, Human
auugaggccaagaauauugca

SEQ ID NO: 2649020 - RNA, 22 nt, Human
auugaggccaagaauauugcaa

SEQ ID NO: 2649021 - RNA, 14 nt, Human
auuccuuugcauau

SEQ ID NO: 2649022 - RNA, 15 nt, Human
auuccuuuuuauuua

SEQ ID NO: 2649023 - RNA, 18 nt, Human
auuccuuuuuauuuauau

SEQ ID NO: 2649024 - RNA, 16 nt, Human
auuccuuuuuauuuau

SEQ ID NO: 2649025 - RNA, 21 nt, Human
auuccuuuuuauuuauaugua

SEQ ID NO: 2649026 - RNA, 20 nt, Human
auuccuuuuuauuuauaugu

SEQ ID NO: 2649027 - RNA, 23 nt, Human
auucguacauaauacugaaccac

SEQ ID NO: 2649028 - RNA, 22 nt, Human
auucguacauaauacugaacca

SEQ ID NO: 2649029 - RNA, 18 nt, Human
auucguacauaauacuga

SEQ ID NO: 2649030 - RNA, 16 nt, Human
auucguacauaauacu

SEQ ID NO: 2649031 - RNA, 21 nt, Human
auucgguauccccccaucuug

SEQ ID NO: 2649032 - RNA, 19 nt, Human
auucguuguguuuuuuaag

SEQ ID NO: 2649033 - RNA, 20 nt, Human
auucguuguguuuuuuaaga

SEQ ID NO: 2649034 - RNA, 22 nt, Human
auucguuguguuuuuuaagaua

SEQ ID NO: 2649035 - RNA, 15 nt, Human
auucuuucaguucuu

SEQ ID NO: 2649036 - RNA, 17 nt, Human
auucuuucaguucuuug

SEQ ID NO: 2649037 - RNA, 17 nt, Human
auucauaguaagauuga

SEQ ID NO: 2649038 - RNA, 20 nt, Human
auucaaguguaaaauauuuu

SEQ ID NO: 2649039 - RNA, 21 nt, Human
auucaaguguaaaauauuuug

SEQ ID NO: 2649040 - RNA, 22 nt, Human
auuagauguuacaaguuuauau

SEQ ID NO: 2649041 - RNA, 13 nt, Human
auuacaauuuuau

SEQ ID NO: 2649042 - RNA, 14 nt, Human
auuacaauuuuauc

SEQ ID NO: 2649043 - RNA, 15 nt, Human
auuacaauuuuaucu

SEQ ID NO: 2649044 - RNA, 18 nt, Human
auuacaauuuuaucuguu

SEQ ID NO: 2649045 - RNA, 13 nt, Human
auuaaugcacuuu

SEQ ID NO: 2649046 - RNA, 14 nt, Human
auuaaugcacuuuc

SEQ ID NO: 2649047 - RNA, 15 nt, Human
auuaaugcacuuucu

SEQ ID NO: 2649048 - RNA, 16 nt, Human
auuaaugcacuuucua

SEQ ID NO: 2649049 - RNA, 12 nt, Human
auuaaugcacuu

SEQ ID NO: 2649050 - RNA, 16 nt, Human
auuaauugugugaacu

SEQ ID NO: 2649051 - RNA, 14 nt, Human
auuaauugugugaa

SEQ ID NO: 2649052 - RNA, 11 nt, Human
auuaauugugu

SEQ ID NO: 2649053 - RNA, 21 nt, Human
auuaauugugugaacuuggaa

SEQ ID NO: 2649054 - RNA, 20 nt, Human
auuaauugugugaacuugga

SEQ ID NO: 2649055 - RNA, 18 nt, Human
auuaauugugugaacuug

SEQ ID NO: 2649056 - RNA, 15 nt, Human
auuaauuugcaucug

SEQ ID NO: 2649057 - RNA, 21 nt, Human
auuaauuugcaucugaaauag

SEQ ID NO: 2649058 - RNA, 23 nt, Human
auuaaauuuuuuuguaugaaaac

SEQ ID NO: 2649059 - RNA, 22 nt, Human
auuaaauuuuuuuguaugaaaa

SEQ ID NO: 2649060 - RNA, 21 nt, Human
auuaaauuuuuuuguaugaaa

SEQ ID NO: 2649061 - RNA, 20 nt, Human
auuaaauuuuuuuguaugaa

SEQ ID NO: 2649062 - RNA, 19 nt, Human
auuaaauuuuuuuguauga

SEQ ID NO: 2649063 - RNA, 18 nt, Human
auuaaauuuuuuuguaug

SEQ ID NO: 2649064 - RNA, 17 nt, Human
auuaaauuuuuuuguau

SEQ ID NO: 2649065 - RNA, 16 nt, Human
auuaaauuuuuuugua

SEQ ID NO: 2649066 - RNA, 15 nt, Human
auuaaauuuuuuugu

SEQ ID NO: 2649067 - RNA, 17 nt, Human
cgguggcggccccagca

SEQ ID NO: 2649068 - RNA, 15 nt, Human
cgguggcgggcaccu

SEQ ID NO: 2649069 - RNA, 20 nt, Human
cgguggcucacgccuguaau

SEQ ID NO: 2649070 - RNA, 18 nt, Human
cggugggacccccguggg

SEQ ID NO: 2649071 - RNA, 16 nt, Human
cggugggacucguggc

SEQ ID NO: 2649072 - RNA, 22 nt, Human
cggugggacucguggcugucaa

SEQ ID NO: 2649073 - RNA, 13 nt, Human
cguacauguuuau

SEQ ID NO: 2649074 - RNA, 20 nt, Human
cguacauaauacugaaccac

SEQ ID NO: 2649075 - RNA, 16 nt, Human
cguacauaauacugaa

SEQ ID NO: 2649076 - RNA, 15 nt, Human
cguacauaauacuga

SEQ ID NO: 2649077 - RNA, 17 nt, Human
cguacaggcuggcgcag

SEQ ID NO: 2649078 - RNA, 19 nt, Human
cgggcucagcaaaagaugc

SEQ ID NO: 2649079 - RNA, 15 nt, Human
cgggccccugggcuu

SEQ ID NO: 2649080 - RNA, 23 nt, Human
cgggccccugggcuuggccugcu

SEQ ID NO: 2649081 - RNA, 15 nt, Human
cgggcccuggguucc

SEQ ID NO: 2649082 - RNA, 15 nt, Human
cggaggccgaggcca

SEQ ID NO: 2649083 - RNA, 18 nt, Human
cggaggccugcgacccug

SEQ ID NO: 2649084 - RNA, 20 nt, Human
cggaggccugcgacccuggg

SEQ ID NO: 2649085 - RNA, 21 nt, Human
cggaggccugcgacccugggg

SEQ ID NO: 2649086 - RNA, 22 nt, Human
cggaggccugcgacccuggggg

SEQ ID NO: 2649087 - RNA, 12 nt, Human
cggagggcugcg

SEQ ID NO: 2649088 - RNA, 15 nt, Human
cggagucguggggug

SEQ ID NO: 2649089 - RNA, 16 nt, Human
cggcguggcccaaggc

SEQ ID NO: 2649090 - RNA, 17 nt, Human
cggcguggcccaaggcu

SEQ ID NO: 2649091 - RNA, 22 nt, Human
cggcguggcccaaggcuggcag

SEQ ID NO: 2649092 - RNA, 16 nt, Human
cggcguacaggcuggc

SEQ ID NO: 2649093 - RNA, 15 nt, Human
cggcguacaggcugg

SEQ ID NO: 2649094 - RNA, 13 nt, Human
ccuuuucccugcu

SEQ ID NO: 2649095 - RNA, 14 nt, Human
ccuuuucccugcuu

SEQ ID NO: 2649096 - RNA, 15 nt, Human
ccuuuucccugcuuc

SEQ ID NO: 2649097 - RNA, 19 nt, Human
ccuuuucccugcuuccagg

SEQ ID NO: 2649098 - RNA, 23 nt, Human
cgccaaggcugggggaagaagcu

SEQ ID NO: 2649099 - RNA, 13 nt, Human
cgccacaggaccc

SEQ ID NO: 2649100 - RNA, 12 nt, Human
cgccacaggacc

SEQ ID NO: 2649101 - RNA, 20 nt, Human
cgagugccgcaucucacagc

SEQ ID NO: 2649102 - RNA, 13 nt, Human
cgagucugaggcc

SEQ ID NO: 2649103 - RNA, 13 nt, Human
cgcaggugggcug

SEQ ID NO: 2649104 - RNA, 14 nt, Human
cgcaggugggcugg

SEQ ID NO: 2649105 - RNA, 18 nt, Human
cgcaggugggcuggacuu

SEQ ID NO: 2649106 - RNA, 22 nt, Human
cgaggggccuuuguucuggggg

SEQ ID NO: 2649107 - RNA, 18 nt, Human
cgaggggugucuugggca

SEQ ID NO: 2649108 - RNA, 19 nt, Human
cgaggggugucuugggcag

SEQ ID NO: 2649109 - RNA, 20 nt, Human
cgcucuguggaugccagggc

SEQ ID NO: 2649110 - RNA, 21 nt, Human
cgcucuguggaugccagggcc

SEQ ID NO: 2649111 - RNA, 13 nt, Human
cgcugaguggcag

SEQ ID NO: 2649112 - RNA, 16 nt, Human
cgcugagacugugcug

SEQ ID NO: 2649113 - RNA, 17 nt, Human
cgcugagacugugcugu

SEQ ID NO: 2649114 - RNA, 14 nt, Human
cgcugaguggcagg

SEQ ID NO: 2649115 - RNA, 16 nt, Human
cgcugaguggcagggg

SEQ ID NO: 2649116 - RNA, 16 nt, Human
cgcaguguuuugcaag

SEQ ID NO: 2649117 - RNA, 23 nt, Human
cgccaccgcgggugugggaaagc

SEQ ID NO: 2649118 - RNA, 22 nt, Human
cgccugcacuccucagggcagc

SEQ ID NO: 2649119 - RNA, 15 nt, Human
cgcucucuuugcaac

SEQ ID NO: 2649120 - RNA, 20 nt, Human
cgcugaguggcaggggacag

SEQ ID NO: 2649121 - RNA, 19 nt, Human
cuaauuuuacauguuuaua

SEQ ID NO: 2649122 - RNA, 20 nt, Human
cuaauuuuacauguuuauaa

SEQ ID NO: 2649123 - RNA, 19 nt, Human
cuaauuucuccucccuucc

SEQ ID NO: 2649124 - RNA, 19 nt, Human
cuacaaaaagcauaaaaau

SEQ ID NO: 2649125 - RNA, 20 nt, Human
cuaauuucuccucccuuccu

SEQ ID NO: 2649126 - RNA, 18 nt, Human
cuaauuucuccucccuuc

SEQ ID NO: 2649127 - RNA, 19 nt, Human
cuaaguccaguguuucuuu

SEQ ID NO: 2649128 - RNA, 12 nt, Human
cuaagucaguac

SEQ ID NO: 2649129 - RNA, 15 nt, Human
cuaagucaguaccca

SEQ ID NO: 2649130 - RNA, 15 nt, Human
cuaagucauguaugu

SEQ ID NO: 2649131 - RNA, 18 nt, Human
cuaagucauguauguuuc

SEQ ID NO: 2649132 - RNA, 13 nt, Human
cuaagacuauaua

SEQ ID NO: 2649133 - RNA, 22 nt, Human
cuaagacuauauauauaaaugu

SEQ ID NO: 2649134 - RNA, 17 nt, Human
cuaagaauucaaacugg

SEQ ID NO: 2649135 - RNA, 16 nt, Human
cuaagagaaguuauuu

SEQ ID NO: 2649136 - RNA, 11 nt, Human
cuaagagaagu

SEQ ID NO: 2649137 - RNA, 21 nt, Human
cuaaaguaaaaagggaauuau

SEQ ID NO: 2649138 - RNA, 20 nt, Human
cuaaaguguauuuucagagc

SEQ ID NO: 2649139 - RNA, 11 nt, Human
cguuauauuaa

SEQ ID NO: 2649140 - RNA, 13 nt, Human
cguuagcuccugu

SEQ ID NO: 2649141 - RNA, 14 nt, Human
cguuagcuccugug

SEQ ID NO: 2649142 - RNA, 15 nt, Human
cguuagcuccugugg

SEQ ID NO: 2649143 - RNA, 16 nt, Human
cguuagcuccuguggc

SEQ ID NO: 2649144 - RNA, 17 nt, Human
cguuagcuccuguggcc

SEQ ID NO: 2649145 - RNA, 14 nt, Human
cuaaagcaauagaa

SEQ ID NO: 2649146 - RNA, 15 nt, Human
cuaaagcaauagaaa

SEQ ID NO: 2649147 - RNA, 16 nt, Human
cuaaagcaauagaaac

SEQ ID NO: 2649148 - RNA, 17 nt, Human
cuaaagcaauagaaaca

SEQ ID NO: 2649149 - RNA, 14 nt, Human
cuaaagcaugaaau

SEQ ID NO: 2649150 - RNA, 19 nt, Human
cuaaagcaugaaaugugaa

SEQ ID NO: 2649151 - RNA, 20 nt, Human
cuaaagcaugaaaugugaau

SEQ ID NO: 2649152 - RNA, 22 nt, Human
cuaaagcaugaaaugugaauuu

SEQ ID NO: 2649153 - RNA, 16 nt, Human
ccuuagcaaauucugu

SEQ ID NO: 2649154 - RNA, 19 nt, Human
ccuuauggaugauuuaagu

SEQ ID NO: 2649155 - RNA, 23 nt, Human
ccuuaucuccacaaccucuuccc

SEQ ID NO: 2649156 - RNA, 13 nt, Human
ccuuaggccuucc

SEQ ID NO: 2649157 - RNA, 15 nt, Human
ccuuaggccuuccuc

SEQ ID NO: 2649158 - RNA, 14 nt, Human
ccuuaggccuuccu

SEQ ID NO: 2649159 - RNA, 23 nt, Human
ccuuaggccuuccucucuccaga

SEQ ID NO: 2649160 - RNA, 12 nt, Human
ccuuauaaaauc

SEQ ID NO: 2649161 - RNA, 17 nt, Human
ccuuauagucuaagacu

SEQ ID NO: 2649162 - RNA, 19 nt, Human
ccuguuaggagaagcugca

SEQ ID NO: 2649163 - RNA, 14 nt, Human
ccugcugcuggugc

SEQ ID NO: 2649164 - RNA, 15 nt, Human
ccugcugcuggugca

SEQ ID NO: 2649165 - RNA, 18 nt, Human
ccugcugcuggugcacag

SEQ ID NO: 2649166 - RNA, 19 nt, Human
ccugcugcuggugcacagc

SEQ ID NO: 2649167 - RNA, 19 nt, Human
ccugcuggcacccaccgug

SEQ ID NO: 2649168 - RNA, 15 nt, Human
ccugcuggcacccac

SEQ ID NO: 2649169 - RNA, 9 nt, Human
ccugcuggc

SEQ ID NO: 2649170 - RNA, 16 nt, Human
ccuuucccucaccccc

SEQ ID NO: 2649171 - RNA, 17 nt, Human
ccuuucccucacccccu

SEQ ID NO: 2649172 - RNA, 19 nt, Human
ccuuucccucacccccucc

SEQ ID NO: 2649173 - RNA, 20 nt, Human
ccuuucccucacccccuccc

SEQ ID NO: 2649174 - RNA, 21 nt, Human
ccuuucccucacccccuccca

SEQ ID NO: 2649175 - RNA, 13 nt, Human
ccuuuauuuuaga

SEQ ID NO: 2649176 - RNA, 12 nt, Human
ccuuucaaagcu

SEQ ID NO: 2649177 - RNA, 13 nt, Human
ccuuucaaagcuu

SEQ ID NO: 2649178 - RNA, 23 nt, Human
ccuuuauuacccccuccuucaga

SEQ ID NO: 2649179 - RNA, 12 nt, Human
ccuuuaugugaa

SEQ ID NO: 2649180 - RNA, 13 nt, Human
ccuuuaugugaau

SEQ ID NO: 2649181 - RNA, 14 nt, Human
ccuuuaugugaauu

SEQ ID NO: 2649182 - RNA, 17 nt, Human
ccuuuaugugaauuuuu

SEQ ID NO: 2649183 - RNA, 23 nt, Human
ccuuuaugugaauuuuuaagcug

SEQ ID NO: 2649184 - RNA, 21 nt, Human
ccuucccccaccgguccagcu

SEQ ID NO: 2649185 - RNA, 22 nt, Human
ccuucccccaccgguccagcug

SEQ ID NO: 2649186 - RNA, 22 nt, Human
ccuuccccagcuuugcugccug

SEQ ID NO: 2649187 - RNA, 14 nt, Human
ccuuccccaugcuu

SEQ ID NO: 2649188 - RNA, 21 nt, Human
ccuuccccaugcuuccuugcc

SEQ ID NO: 2649189 - RNA, 23 nt, Human
ccuuccccaugcuuccuugccug

SEQ ID NO: 2649190 - RNA, 12 nt, Human
ccuucccuagcu

SEQ ID NO: 2649191 - RNA, 15 nt, Human
ccuucccuagcuuua

SEQ ID NO: 2649192 - RNA, 18 nt, Human
ccuuccgcaguguggcca

SEQ ID NO: 2649193 - RNA, 22 nt, Human
ccuuccgcaguguggccaggcu

SEQ ID NO: 2649194 - RNA, 15 nt, Human
ccuucucuccucccc

SEQ ID NO: 2649195 - RNA, 16 nt, Human
ccuucucuccucccca

SEQ ID NO: 2649196 - RNA, 17 nt, Human
ccuucucuccuccccaa

SEQ ID NO: 2649197 - RNA, 20 nt, Human
ccuucucuccuccccaaauc

SEQ ID NO: 2649198 - RNA, 14 nt, Human
cucaauccuaauuu

SEQ ID NO: 2649199 - RNA, 19 nt, Human
cucaauccuaauuucuccu

SEQ ID NO: 2649200 - RNA, 20 nt, Human
cucaauccuaauuucuccuc

SEQ ID NO: 2649201 - RNA, 22 nt, Human
cucaauccuaauuucuccuccc

SEQ ID NO: 2649202 - RNA, 23 nt, Human
cucaauccuaauuucuccucccu

SEQ ID NO: 2649203 - RNA, 12 nt, Human
cucaaugaaaaa

SEQ ID NO: 2649204 - RNA, 13 nt, Human
cucaaugaaaaau

SEQ ID NO: 2649205 - RNA, 22 nt, Human
cucaaugaaaaauagugucuuu

SEQ ID NO: 2649206 - RNA, 19 nt, Human
cucaaugaaccauaaauuc

SEQ ID NO: 2649207 - RNA, 20 nt, Human
cucaaugaaccauaaauuca

SEQ ID NO: 2649208 - RNA, 22 nt, Human
cuaucggagaacaugaaucaaa

SEQ ID NO: 2649209 - RNA, 12 nt, Human
cuaugugacaau

SEQ ID NO: 2649210 - RNA, 18 nt, Human
cuaucucaauccuaauuu

SEQ ID NO: 2649211 - RNA, 21 nt, Human
cuaucucaucuaucucaaucc

SEQ ID NO: 2649212 - RNA, 12 nt, Human
cuaucucaucua

SEQ ID NO: 2649213 - RNA, 13 nt, Human
cuauccuacccca

SEQ ID NO: 2649214 - RNA, 14 nt, Human
cuauccgcugccag

SEQ ID NO: 2649215 - RNA, 15 nt, Human
cuauccgcugccagc

SEQ ID NO: 2649216 - RNA, 17 nt, Human
cuauccgcugccagccu

SEQ ID NO: 2649217 - RNA, 22 nt, Human
cuauccgcugccagccuugagc

SEQ ID NO: 2649218 - RNA, 12 nt, Human
cuauccucugua

SEQ ID NO: 2649219 - RNA, 13 nt, Human
cuauccucuguaa

SEQ ID NO: 2649220 - RNA, 11 nt, Human
cuauccugauu

SEQ ID NO: 2649221 - RNA, 22 nt, Human
cuacaaaaccuacccucaguga

SEQ ID NO: 2649222 - RNA, 14 nt, Human
cucacuaaagcaug

SEQ ID NO: 2649223 - RNA, 19 nt, Human
cucacuaaagcaugaaaug

SEQ ID NO: 2649224 - RNA, 20 nt, Human
cucacuaaagcaugaaaugu

SEQ ID NO: 2649225 - RNA, 13 nt, Human
cucacuaauuuuu

SEQ ID NO: 2649226 - RNA, 15 nt, Human
cucacuaauuuuugu

SEQ ID NO: 2649227 - RNA, 17 nt, Human
cucacuaauuuuuguau

SEQ ID NO: 2649228 - RNA, 23 nt, Human
cucacuaauuuuuguauuauuuu

SEQ ID NO: 2649229 - RNA, 21 nt, Human
cucacgccuguaaucccagca

SEQ ID NO: 2649230 - RNA, 18 nt, Human
cucacgccuguaauccca

SEQ ID NO: 2649231 - RNA, 14 nt, Human
cucagaaccacagc

SEQ ID NO: 2649232 - RNA, 15 nt, Human
cucacuaggccccca

SEQ ID NO: 2649233 - RNA, 18 nt, Human
cucacuaggcccccacuu

SEQ ID NO: 2649234 - RNA, 22 nt, Human
cucacuaggcccccacuugccu

SEQ ID NO: 2649235 - RNA, 23 nt, Human
cucagaaaguguauaauaagaaa

SEQ ID NO: 2649236 - RNA, 20 nt, Human
cucaggccggcagccccagc

SEQ ID NO: 2649237 - RNA, 19 nt, Human
cucaggccggcagccccag

SEQ ID NO: 2649238 - RNA, 24 nt, Human
cucaggccggcagccccagccugc

SEQ ID NO: 2649239 - RNA, 23 nt, Human
cucaggccggcagccccagccug

SEQ ID NO: 2649240 - RNA, 22 nt, Human
cucaggccggcagccccagccu

SEQ ID NO: 2649241 - RNA, 21 nt, Human
cucaggccggcagccccagcc

SEQ ID NO: 2649242 - RNA, 11 nt, Human
cucagccugca

SEQ ID NO: 2649243 - RNA, 16 nt, Human
cucagccucucgaagu

SEQ ID NO: 2649244 - RNA, 13 nt, Human
cucagccugcaca

SEQ ID NO: 2649245 - RNA, 13 nt, Human
cucagaagcacag

SEQ ID NO: 2649246 - RNA, 14 nt, Human
cucagugcauuugu

SEQ ID NO: 2649247 - RNA, 16 nt, Human
cucagugcauuugugc

SEQ ID NO: 2649248 - RNA, 17 nt, Human
cucagugcauuugugcu

SEQ ID NO: 2649249 - RNA, 10 nt, Human
cucagugcag

SEQ ID NO: 2649250 - RNA, 11 nt, Human
cucagugcaga

SEQ ID NO: 2649251 - RNA, 12 nt, Human
cucagugcagau

SEQ ID NO: 2649252 - RNA, 15 nt, Human
cucagugcagaugga

SEQ ID NO: 2649253 - RNA, 14 nt, Human
cuccggccucucca

SEQ ID NO: 2649254 - RNA, 19 nt, Human
cuccggccucugccuuugc

SEQ ID NO: 2649255 - RNA, 17 nt, Human
cuccggcucccagccuc

SEQ ID NO: 2649256 - RNA, 14 nt, Human
cuccggcucccagc

SEQ ID NO: 2649257 - RNA, 16 nt, Human
cuccggcucccagccu

SEQ ID NO: 2649258 - RNA, 15 nt, Human
cuccggcucccagcc

SEQ ID NO: 2649259 - RNA, 19 nt, Human
cuccuggcccacugcaucg

SEQ ID NO: 2649260 - RNA, 13 nt, Human
cuccuggccuauc

SEQ ID NO: 2649261 - RNA, 18 nt, Human
cuccuggccuauccgcug

SEQ ID NO: 2649262 - RNA, 22 nt, Human
cuccuggccuauccgcugccag

SEQ ID NO: 2649263 - RNA, 23 nt, Human
cuccuggccuauccgcugccagc

SEQ ID NO: 2649264 - RNA, 21 nt, Human
cuccucuggacggcaggcuca

SEQ ID NO: 2649265 - RNA, 15 nt, Human
cuccuuuaauuguaa

SEQ ID NO: 2649266 - RNA, 16 nt, Human
cuccuggggcguccag

SEQ ID NO: 2649267 - RNA, 12 nt, Human
cucccucccaca

SEQ ID NO: 2649268 - RNA, 23 nt, Human
cuccccggcaugagacucagugc

SEQ ID NO: 2649269 - RNA, 22 nt, Human
cucccccuaguuugugagaaac

SEQ ID NO: 2649270 - RNA, 15 nt, Human
cucccccggcucuac

SEQ ID NO: 2649271 - RNA, 18 nt, Human
cucccaggagccugccca

SEQ ID NO: 2649272 - RNA, 20 nt, Human
cucccaggagccugcccagc

SEQ ID NO: 2649273 - RNA, 19 nt, Human
cucccaggagccugcccag

SEQ ID NO: 2649274 - RNA, 21 nt, Human
cucccaggagccugcccagcc

SEQ ID NO: 2649275 - RNA, 16 nt, Human
cucccaggaagcccag

SEQ ID NO: 2649276 - RNA, 21 nt, Human
cucccaggaagcccaggagcc

SEQ ID NO: 2649277 - RNA, 14 nt, Human
cucccucuauuuau

SEQ ID NO: 2649278 - RNA, 15 nt, Human
cucccacuucugcca

SEQ ID NO: 2649279 - RNA, 17 nt, Human
cucccacuucugccaga

SEQ ID NO: 2649280 - RNA, 16 nt, Human
cucccacuucugccag

SEQ ID NO: 2649281 - RNA, 12 nt, Human
cucccacuuugc

SEQ ID NO: 2649282 - RNA, 20 nt, Human
cucccacuuugcuguuccuu

SEQ ID NO: 2649283 - RNA, 13 nt, Human
cuccaggugcaga

SEQ ID NO: 2649284 - RNA, 14 nt, Human
cuccaggugcagag

SEQ ID NO: 2649285 - RNA, 15 nt, Human
cuccaggugcagagg

SEQ ID NO: 2649286 - RNA, 16 nt, Human
cuccaggugcagaggu

SEQ ID NO: 2649287 - RNA, 18 nt, Human
cuccaggugcagagguac

SEQ ID NO: 2649288 - RNA, 11 nt, Human
cucuccucccc

SEQ ID NO: 2649289 - RNA, 17 nt, Human
cucucuucucagagugg

SEQ ID NO: 2649290 - RNA, 19 nt, Human
cucucuucucagaguggug

SEQ ID NO: 2649291 - RNA, 16 nt, Human
cucuaugcuuuccaaa

SEQ ID NO: 2649292 - RNA, 14 nt, Human
cucuaugcuuucca

SEQ ID NO: 2649293 - RNA, 13 nt, Human
cuccuuuaauugu

SEQ ID NO: 2649294 - RNA, 14 nt, Human
cucggugggagcca

SEQ ID NO: 2649295 - RNA, 16 nt, Human
cucgguguggagaagc

SEQ ID NO: 2649296 - RNA, 17 nt, Human
cucgguguggagaagcg

SEQ ID NO: 2649297 - RNA, 16 nt, Human
cucgugcaucccugag

SEQ ID NO: 2649298 - RNA, 17 nt, Human
cucgugcaucccugaga

SEQ ID NO: 2649299 - RNA, 19 nt, Human
cucgugcaucccugagaca

SEQ ID NO: 2649300 - RNA, 21 nt, Human
cucugcacaagcugcacccuc

SEQ ID NO: 2649301 - RNA, 20 nt, Human
cucugcacaagcugcacccu

SEQ ID NO: 2649302 - RNA, 11 nt, Human
ccgaauaaaug

SEQ ID NO: 2649303 - RNA, 17 nt, Human
cccuuccuuuucccugc

SEQ ID NO: 2649304 - RNA, 18 nt, Human
cccuuccuuuucccugcu

SEQ ID NO: 2649305 - RNA, 20 nt, Human
cccuuccucuugucugauuu

SEQ ID NO: 2649306 - RNA, 22 nt, Human
cccuuccugcugcgcaguucuc

SEQ ID NO: 2649307 - RNA, 16 nt, Human
ccguccugccuguggc

SEQ ID NO: 2649308 - RNA, 12 nt, Human
ccggccucucca

SEQ ID NO: 2649309 - RNA, 13 nt, Human
ccggccucuccag

SEQ ID NO: 2649310 - RNA, 14 nt, Human
ccggccucuccagc

SEQ ID NO: 2649311 - RNA, 18 nt, Human
ccggccucuccagccuca

SEQ ID NO: 2649312 - RNA, 21 nt, Human
ccggccucuccagccucagcc

SEQ ID NO: 2649313 - RNA, 17 nt, Human
ccggccgcuccaccagc

SEQ ID NO: 2649314 - RNA, 20 nt, Human
ccggccacccaggaggcagg

SEQ ID NO: 2649315 - RNA, 16 nt, Human
ccggccggccacccag

SEQ ID NO: 2649316 - RNA, 17 nt, Human
ccuagcacuuugggagg

SEQ ID NO: 2649317 - RNA, 15 nt, Human
ccuagcagcccaccc

SEQ ID NO: 2649318 - RNA, 17 nt, Human
ccuagcagcccacccug

SEQ ID NO: 2649319 - RNA, 20 nt, Human
ccuagcagcccacccugcug

SEQ ID NO: 2649320 - RNA, 22 nt, Human
ccuagcagcccacccugcugcu

SEQ ID NO: 2649321 - RNA, 23 nt, Human
ccuagcagcccacccugcugcug

SEQ ID NO: 2649322 - RNA, 17 nt, Human
ccuagccgguuccuguc

SEQ ID NO: 2649323 - RNA, 20 nt, Human
ccuaaucuauggucgggaga

SEQ ID NO: 2649324 - RNA, 17 nt, Human
ccggcccgcgccacagg

SEQ ID NO: 2649325 - RNA, 18 nt, Human
ccggcccgcgccacagga

SEQ ID NO: 2649326 - RNA, 15 nt, Human
ccggccgcuccacca

SEQ ID NO: 2649327 - RNA, 13 nt, Human
ccggcccugugug

SEQ ID NO: 2649328 - RNA, 14 nt, Human
ccggcccugugugc

SEQ ID NO: 2649329 - RNA, 15 nt, Human
ccggcccugugugca

SEQ ID NO: 2649330 - RNA, 17 nt, Human
ccggcccugugugcagg

SEQ ID NO: 2649331 - RNA, 20 nt, Human
ccggcaugagacucagugca

SEQ ID NO: 2649332 - RNA, 21 nt, Human
ccggcaugagacucagugcag

SEQ ID NO: 2649333 - RNA, 22 nt, Human
ccggcaugagacucagugcaga

SEQ ID NO: 2649334 - RNA, 23 nt, Human
ccggcaugagacucagugcagau

SEQ ID NO: 2649335 - RNA, 18 nt, Human
ccggcaggguccuagaaa

SEQ ID NO: 2649336 - RNA, 12 nt, Human
cccugagccggc

SEQ ID NO: 2649337 - RNA, 16 nt, Human
cccugagcuuucugcu

SEQ ID NO: 2649338 - RNA, 20 nt, Human
cccugcccguucuugaaaug

SEQ ID NO: 2649339 - RNA, 18 nt, Human
cccugcccccagccccgg

SEQ ID NO: 2649340 - RNA, 12 nt, Human
cccugcccugca

SEQ ID NO: 2649341 - RNA, 13 nt, Human
cccugcccugcac

SEQ ID NO: 2649342 - RNA, 21 nt, Human
cccuggauagacgaguugauu

SEQ ID NO: 2649343 - RNA, 11 nt, Human
cccuggccucc

SEQ ID NO: 2649344 - RNA, 13 nt, Human
cccuggccucccc

SEQ ID NO: 2649345 - RNA, 14 nt, Human
cccuggccuccccu

SEQ ID NO: 2649346 - RNA, 20 nt, Human
cccuggccgcgcuccgggcu

SEQ ID NO: 2649347 - RNA, 12 nt, Human
cccuggcucccu

SEQ ID NO: 2649348 - RNA, 13 nt, Human
cccuggcucccuc

SEQ ID NO: 2649349 - RNA, 15 nt, Human
cccuggcucccuccu

SEQ ID NO: 2649350 - RNA, 16 nt, Human
cccuggcucccuccuc

SEQ ID NO: 2649351 - RNA, 18 nt, Human
cccuggcucccuccucca

SEQ ID NO: 2649352 - RNA, 20 nt, Human
cccuggcucccuccuccagg

SEQ ID NO: 2649353 - RNA, 23 nt, Human
cccuggcucccuccuccaggccu

SEQ ID NO: 2649354 - RNA, 19 nt, Human
cccuggccucugugccuuc

SEQ ID NO: 2649355 - RNA, 18 nt, Human
cccuggccucugugccuu

SEQ ID NO: 2649356 - RNA, 15 nt, Human
cccuggccucugugc

SEQ ID NO: 2649357 - RNA, 13 nt, Human
cccuggccucugu

SEQ ID NO: 2649358 - RNA, 19 nt, Human
cccuggccuccccugccac

SEQ ID NO: 2649359 - RNA, 20 nt, Human
cccuggccuccccugccacc

SEQ ID NO: 2649360 - RNA, 18 nt, Human
cccugaaagcccugagcu

SEQ ID NO: 2649361 - RNA, 16 nt, Human
cccucggugggagcca

SEQ ID NO: 2649362 - RNA, 14 nt, Human
cccuccgcccugcc

SEQ ID NO: 2649363 - RNA, 15 nt, Human
cccuccgcccugcca

SEQ ID NO: 2649364 - RNA, 16 nt, Human
cccuccgcccugccac

SEQ ID NO: 2649365 - RNA, 19 nt, Human
cccuccgcccugccacuca

SEQ ID NO: 2649366 - RNA, 13 nt, Human
cccuccgcccugc

SEQ ID NO: 2649367 - RNA, 14 nt, Human
ccucuccuuuguuc

SEQ ID NO: 2649368 - RNA, 22 nt, Human
ccucgccggacccucuaaccuc

SEQ ID NO: 2649369 - RNA, 19 nt, Human
ccucgccggaucugaggga

SEQ ID NO: 2649370 - RNA, 18 nt, Human
ccucgccggaucugaggg

SEQ ID NO: 2649371 - RNA, 19 nt, Human
ccucucuauauuucggguc

SEQ ID NO: 2649372 - RNA, 20 nt, Human
ccucugccccucccccagcc

SEQ ID NO: 2649373 - RNA, 17 nt, Human
ccucgcgcuugcuggcc

SEQ ID NO: 2649374 - RNA, 13 nt, Human
ccuccguuuuucu

SEQ ID NO: 2649375 - RNA, 12 nt, Human
ccuccgcccugc

SEQ ID NO: 2649376 - RNA, 13 nt, Human
ccuccgcccugcc

SEQ ID NO: 2649377 - RNA, 14 nt, Human
ccuccgcccugcca

SEQ ID NO: 2649378 - RNA, 15 nt, Human
ccuccgcccugccac

SEQ ID NO: 2649379 - RNA, 16 nt, Human
ccuccgcccugccacu

SEQ ID NO: 2649380 - RNA, 18 nt, Human
ccuccgcccugccacuca

SEQ ID NO: 2649381 - RNA, 12 nt, Human
ccucagccugca

SEQ ID NO: 2649382 - RNA, 14 nt, Human
ccucagccugcaca

SEQ ID NO: 2649383 - RNA, 17 nt, Human
ccuagcuuuagacccug

SEQ ID NO: 2649384 - RNA, 21 nt, Human
ccuagcuugggaggcuucccc

SEQ ID NO: 2649385 - RNA, 20 nt, Human
ccuagcuugggaggcuuccc

SEQ ID NO: 2649386 - RNA, 23 nt, Human
ccuagcuuuagacccuggguggg

SEQ ID NO: 2649387 - RNA, 16 nt, Human
ccuaggaaacucacac

SEQ ID NO: 2649388 - RNA, 22 nt, Human
ccuaggaaacucacacuccccu

SEQ ID NO: 2649389 - RNA, 18 nt, Human
ccuagcuuuagacccugg

SEQ ID NO: 2649390 - RNA, 20 nt, Human
ccuagcuuuagacccugggu

SEQ ID NO: 2649391 - RNA, 21 nt, Human
ccuagcuuuagacccugggug

SEQ ID NO: 2649392 - RNA, 22 nt, Human
ccuagcuuuagacccugggugg

SEQ ID NO: 2649393 - RNA, 23 nt, Human
ccuagccgguuccugucccugcg

SEQ ID NO: 2649394 - RNA, 22 nt, Human
ccuagccgguuccugucccugc

SEQ ID NO: 2649395 - RNA, 21 nt, Human
ccuagccgguuccugucccug

SEQ ID NO: 2649396 - RNA, 20 nt, Human
ccuagccgguuccugucccu

SEQ ID NO: 2649397 - RNA, 17 nt, Human
ccuagcgaucucuccug

SEQ ID NO: 2649398 - RNA, 19 nt, Human
ccuagcgaucucuccuggc

SEQ ID NO: 2649399 - RNA, 21 nt, Human
ccuagcgaucucuccuggccu

SEQ ID NO: 2649400 - RNA, 22 nt, Human
ccuagcgaucucuccuggccua

SEQ ID NO: 2649401 - RNA, 15 nt, Human
ccuagcuaauuauuu

SEQ ID NO: 2649402 - RNA, 20 nt, Human
ccuagcuccuccccuuccuc

SEQ ID NO: 2649403 - RNA, 16 nt, Human
ccucccacuucacugc

SEQ ID NO: 2649404 - RNA, 12 nt, Human
ccucccacuuug

SEQ ID NO: 2649405 - RNA, 19 nt, Human
ccucccacuuugcuguucc

SEQ ID NO: 2649406 - RNA, 21 nt, Human
ccucaugcccacccccugccc

SEQ ID NO: 2649407 - RNA, 22 nt, Human
ccucaugcccacccccugcccu

SEQ ID NO: 2649408 - RNA, 23 nt, Human
ccucaugcccacccccugcccug

SEQ ID NO: 2649409 - RNA, 22 nt, Human
ccuccccagccugcgccugcug

SEQ ID NO: 2649410 - RNA, 21 nt, Human
ccuccccagccugcgccugcu

SEQ ID NO: 2649411 - RNA, 16 nt, Human
ccuccccagccugcgc

SEQ ID NO: 2649412 - RNA, 15 nt, Human
ccuccccagccugcg

SEQ ID NO: 2649413 - RNA, 14 nt, Human
ccuccccagccugc

SEQ ID NO: 2649414 - RNA, 13 nt, Human
ccuccccagccug

SEQ ID NO: 2649415 - RNA, 12 nt, Human
ccuccccagccu

SEQ ID NO: 2649416 - RNA, 22 nt, Human
ccuccccagcauuccagccccu

SEQ ID NO: 2649417 - RNA, 13 nt, Human
ccucaugcccacc

SEQ ID NO: 2649418 - RNA, 14 nt, Human
ccucaugcccaccc

SEQ ID NO: 2649419 - RNA, 15 nt, Human
ccucaugcccacccc

SEQ ID NO: 2649420 - RNA, 20 nt, Human
ccucaugcccacccccugcc

SEQ ID NO: 2649421 - RNA, 24 nt, Human
ccucaugcccacccccugcccugc

SEQ ID NO: 2649422 - RNA, 11 nt, Human
ccucaggcagg

SEQ ID NO: 2649423 - RNA, 15 nt, Human
ccugccucuucucua

SEQ ID NO: 2649424 - RNA, 21 nt, Human
ccugcugcaugcccucucagg

SEQ ID NO: 2649425 - RNA, 20 nt, Human
ccugcugcaugcccucucag

SEQ ID NO: 2649426 - RNA, 16 nt, Human
ccugcugcaugcccuc

SEQ ID NO: 2649427 - RNA, 13 nt, Human
ccugcugcaugcc

SEQ ID NO: 2649428 - RNA, 23 nt, Human
ccugcugcaugcccucucaggcc

SEQ ID NO: 2649429 - RNA, 13 nt, Human
ccucuugaccagg

SEQ ID NO: 2649430 - RNA, 14 nt, Human
ccucuugaccaggc

SEQ ID NO: 2649431 - RNA, 14 nt, Human
ccucuucugagcuu

SEQ ID NO: 2649432 - RNA, 15 nt, Human
ccucuucuggcucaa

SEQ ID NO: 2649433 - RNA, 19 nt, Human
ccucuucucgugccucccc

SEQ ID NO: 2649434 - RNA, 23 nt, Human
ccucugccuuugcaccacgggac

SEQ ID NO: 2649435 - RNA, 19 nt, Human
ccucugcgucuauccugug

SEQ ID NO: 2649436 - RNA, 13 nt, Human
ccucugcucaccg

SEQ ID NO: 2649437 - RNA, 15 nt, Human
ccucugcucaccgcc

SEQ ID NO: 2649438 - RNA, 18 nt, Human
ccucugcucaccgcccau

SEQ ID NO: 2649439 - RNA, 20 nt, Human
ccucugcucaccgcccauca

SEQ ID NO: 2649440 - RNA, 21 nt, Human
ccucugcucaccgcccaucag

SEQ ID NO: 2649441 - RNA, 23 nt, Human
ccucugcucaccgcccaucaggg

SEQ ID NO: 2649442 - RNA, 13 nt, Human
ccugagucugggc

SEQ ID NO: 2649443 - RNA, 16 nt, Human
ccugagucugggcagc

SEQ ID NO: 2649444 - RNA, 17 nt, Human
ccugagucugggcagcu

SEQ ID NO: 2649445 - RNA, 14 nt, Human
ccugaggcuguggu

SEQ ID NO: 2649446 - RNA, 20 nt, Human
cccauccagucucccaacuu

SEQ ID NO: 2649447 - RNA, 15 nt, Human
cccagggcaagcucc

SEQ ID NO: 2649448 - RNA, 20 nt, Human
cccagggcaagcuccgcagg

SEQ ID NO: 2649449 - RNA, 18 nt, Human
cccagggcaagcuccgca

SEQ ID NO: 2649450 - RNA, 18 nt, Human
cccagcccagggcuccug

SEQ ID NO: 2649451 - RNA, 11 nt, Human
cccagcccagg

SEQ ID NO: 2649452 - RNA, 22 nt, Human
cccagcauuccagccccucugg

SEQ ID NO: 2649453 - RNA, 19 nt, Human
cccagcauuccagccccuc

SEQ ID NO: 2649454 - RNA, 20 nt, Human
cccagcauuccagccccucu

SEQ ID NO: 2649455 - RNA, 18 nt, Human
cccagcauuccagccccu

SEQ ID NO: 2649456 - RNA, 16 nt, Human
cccccuuaaauuuaau

SEQ ID NO: 2649457 - RNA, 13 nt, Human
ccccgcagcccug

SEQ ID NO: 2649458 - RNA, 12 nt, Human
ccccgcccccag

SEQ ID NO: 2649459 - RNA, 16 nt, Human
ccccgcccccaguccc

SEQ ID NO: 2649460 - RNA, 13 nt, Human
ccccgccuggcca

SEQ ID NO: 2649461 - RNA, 14 nt, Human
ccccgccuggccag

SEQ ID NO: 2649462 - RNA, 16 nt, Human
ccccgccuggccagga

SEQ ID NO: 2649463 - RNA, 17 nt, Human
ccccgccuggccaggag

SEQ ID NO: 2649464 - RNA, 22 nt, Human
ccccgcgaccauguggccacaa

SEQ ID NO: 2649465 - RNA, 12 nt, Human
cccauugcuguu

SEQ ID NO: 2649466 - RNA, 19 nt, Human
ccccagcauuccagccccu

SEQ ID NO: 2649467 - RNA, 14 nt, Human
ccccaaaacccggg

SEQ ID NO: 2649468 - RNA, 17 nt, Human
ccccagccauccagggg

SEQ ID NO: 2649469 - RNA, 19 nt, Human
ccccagccaugccagcugg

SEQ ID NO: 2649470 - RNA, 20 nt, Human
ccccagccaugccagcuggc

SEQ ID NO: 2649471 - RNA, 22 nt, Human
ccccagccaugccagcuggccu

SEQ ID NO: 2649472 - RNA, 23 nt, Human
ccccagccaugccagcuggccuu

SEQ ID NO: 2649473 - RNA, 20 nt, Human
ccauggggagggauucuggu

SEQ ID NO: 2649474 - RNA, 12 nt, Human
ccauggggaggg

SEQ ID NO: 2649475 - RNA, 18 nt, Human
ccauggggagggauucug

SEQ ID NO: 2649476 - RNA, 20 nt, Human
ccauugugccuaaguccagu

SEQ ID NO: 2649477 - RNA, 15 nt, Human
cccaaccuuucccuc

SEQ ID NO: 2649478 - RNA, 16 nt, Human
cccaaccuuucccuca

SEQ ID NO: 2649479 - RNA, 17 nt, Human
cccaaccuuucccucac

SEQ ID NO: 2649480 - RNA, 20 nt, Human
cccaaccuuucccucacccc

SEQ ID NO: 2649481 - RNA, 14 nt, Human
cccaagccagaggc

SEQ ID NO: 2649482 - RNA, 15 nt, Human
cccaagccagaggcu

SEQ ID NO: 2649483 - RNA, 16 nt, Human
cccaagccagaggcug

SEQ ID NO: 2649484 - RNA, 22 nt, Human
cccaagccuucgggcgucugug

SEQ ID NO: 2649485 - RNA, 14 nt, Human
cccaagcuuagaac

SEQ ID NO: 2649486 - RNA, 13 nt, Human
cccaccccgggga

SEQ ID NO: 2649487 - RNA, 14 nt, Human
cccaccccggggac

SEQ ID NO: 2649488 - RNA, 17 nt, Human
cccaccccggggacccu

SEQ ID NO: 2649489 - RNA, 18 nt, Human
cccaccccggggacccug

SEQ ID NO: 2649490 - RNA, 18 nt, Human
cccacccccugcccugca

SEQ ID NO: 2649491 - RNA, 19 nt, Human
cccacccccugcccugcac

SEQ ID NO: 2649492 - RNA, 13 nt, Human
cccacccccugcc

SEQ ID NO: 2649493 - RNA, 14 nt, Human
cccacccccugccc

SEQ ID NO: 2649494 - RNA, 15 nt, Human
cccacccccugcccu

SEQ ID NO: 2649495 - RNA, 16 nt, Human
cccacccccugcccug

SEQ ID NO: 2649496 - RNA, 17 nt, Human
cccacccccugcccugc

SEQ ID NO: 2649497 - RNA, 20 nt, Human
cccaccccggggacccugug

SEQ ID NO: 2649498 - RNA, 21 nt, Human
cccaccccggggacccuguga

SEQ ID NO: 2649499 - RNA, 13 nt, Human
cccacccugggcc

SEQ ID NO: 2649500 - RNA, 14 nt, Human
cccacccugggccc

SEQ ID NO: 2649501 - RNA, 15 nt, Human
ccagaucacugccac

SEQ ID NO: 2649502 - RNA, 16 nt, Human
ccagaucacugccaca

SEQ ID NO: 2649503 - RNA, 18 nt, Human
ccagaucacugccacacu

SEQ ID NO: 2649504 - RNA, 20 nt, Human
ccagaucacugccacacucu

SEQ ID NO: 2649505 - RNA, 16 nt, Human
ccagaucuuucagaaa

SEQ ID NO: 2649506 - RNA, 21 nt, Human
ccagaucuuucagaaauauaa

SEQ ID NO: 2649507 - RNA, 22 nt, Human
ccagagagccuggugcugcugc

SEQ ID NO: 2649508 - RNA, 21 nt, Human
ccagagagccuggugcugcug

SEQ ID NO: 2649509 - RNA, 17 nt, Human
ccagagguugugcacug

SEQ ID NO: 2649510 - RNA, 19 nt, Human
ccagagguugugcacuguu

SEQ ID NO: 2649511 - RNA, 16 nt, Human
ccagacucagagcucu

SEQ ID NO: 2649512 - RNA, 17 nt, Human
ccagacucagagcucuc

SEQ ID NO: 2649513 - RNA, 22 nt, Human
ccagacucagagcucucucuac

SEQ ID NO: 2649514 - RNA, 23 nt, Human
ccagacucagagcucucucuaca

SEQ ID NO: 2649515 - RNA, 14 nt, Human
ccagacuuccuuga

SEQ ID NO: 2649516 - RNA, 13 nt, Human
ccagacuuccuug

SEQ ID NO: 2649517 - RNA, 15 nt, Human
ccagacuuccuugag

SEQ ID NO: 2649518 - RNA, 14 nt, Human
ccagagacuuuagg

SEQ ID NO: 2649519 - RNA, 16 nt, Human
ccagagacuuuguaga

SEQ ID NO: 2649520 - RNA, 19 nt, Human
ccacuucugccagaugucc

SEQ ID NO: 2649521 - RNA, 12 nt, Human
ccacuugccucu

SEQ ID NO: 2649522 - RNA, 13 nt, Human
ccacuugccucuu

SEQ ID NO: 2649523 - RNA, 13 nt, Human
ccacuugaggccu

SEQ ID NO: 2649524 - RNA, 14 nt, Human
ccacuugaggccug

SEQ ID NO: 2649525 - RNA, 15 nt, Human
ccacuugaggccuga

SEQ ID NO: 2649526 - RNA, 18 nt, Human
ccacuugaggccugaucu

SEQ ID NO: 2649527 - RNA, 19 nt, Human
ccacuugaggccugaucug

SEQ ID NO: 2649528 - RNA, 20 nt, Human
ccacuugaggccugaucugc

SEQ ID NO: 2649529 - RNA, 22 nt, Human
ccacuugaggccugaucugccc

SEQ ID NO: 2649530 - RNA, 24 nt, Human
ccacuugaggccugaucugcccau

SEQ ID NO: 2649531 - RNA, 16 nt, Human
ccacuugccucuuccu

SEQ ID NO: 2649532 - RNA, 17 nt, Human
ccacuugccucuuccuu

SEQ ID NO: 2649533 - RNA, 19 nt, Human
ccacuugccucuuccuuga

SEQ ID NO: 2649534 - RNA, 22 nt, Human
ccacuugccucuuccuugaaga

SEQ ID NO: 2649535 - RNA, 14 nt, Human
ccacuucugccaga

SEQ ID NO: 2649536 - RNA, 13 nt, Human
ccacuucugccag

SEQ ID NO: 2649537 - RNA, 13 nt, Human
ccacuuccuuuua

SEQ ID NO: 2649538 - RNA, 15 nt, Human
ccacuucccacccug

SEQ ID NO: 2649539 - RNA, 20 nt, Human
ccacuuguagauuugauuuu

SEQ ID NO: 2649540 - RNA, 12 nt, Human
ccacuuguagau

SEQ ID NO: 2649541 - RNA, 18 nt, Human
ccacuuguagauuugauu

SEQ ID NO: 2649542 - RNA, 17 nt, Human
ccacuuguagauuugau

SEQ ID NO: 2649543 - RNA, 16 nt, Human
ccacuuugcuguuccu

SEQ ID NO: 2649544 - RNA, 17 nt, Human
ccacuuugcuguuccuu

SEQ ID NO: 2649545 - RNA, 22 nt, Human
ccacuuuguuucguggggaggu

SEQ ID NO: 2649546 - RNA, 19 nt, Human
ccacuuuacccaccuagaa

SEQ ID NO: 2649547 - RNA, 18 nt, Human
ccacuuuacccaccuaga

SEQ ID NO: 2649548 - RNA, 12 nt, Human
ccagaccuggaa

SEQ ID NO: 2649549 - RNA, 22 nt, Human
ccagaccuggaagaacaggccu

SEQ ID NO: 2649550 - RNA, 10 nt, Human
ccaggcaggg

SEQ ID NO: 2649551 - RNA, 12 nt, Human
ccaggcagggag

SEQ ID NO: 2649552 - RNA, 13 nt, Human
ccaggcagggaga

SEQ ID NO: 2649553 - RNA, 22 nt, Human
ccaggcagccucugucaggccu

SEQ ID NO: 2649554 - RNA, 23 nt, Human
ccaggcagccucugucaggccuu

SEQ ID NO: 2649555 - RNA, 14 nt, Human
ccaggcagccucug

SEQ ID NO: 2649556 - RNA, 15 nt, Human
ccaggcagggguggg

SEQ ID NO: 2649557 - RNA, 21 nt, Human
ccaggcaggggugggggugga

SEQ ID NO: 2649558 - RNA, 22 nt, Human
ccaggcagggguggggguggag

SEQ ID NO: 2649559 - RNA, 13 nt, Human
ccagcgccucccu

SEQ ID NO: 2649560 - RNA, 14 nt, Human
ccagcgccucccuc

SEQ ID NO: 2649561 - RNA, 15 nt, Human
ccagcgccucccucc

SEQ ID NO: 2649562 - RNA, 16 nt, Human
ccagcgccucccucca

SEQ ID NO: 2649563 - RNA, 17 nt, Human
ccagcgccucccuccac

SEQ ID NO: 2649564 - RNA, 18 nt, Human
ccagcgccucccuccacc

SEQ ID NO: 2649565 - RNA, 19 nt, Human
ccagcgccucccuccaccc

SEQ ID NO: 2649566 - RNA, 20 nt, Human
ccagcgccucccuccacccc

SEQ ID NO: 2649567 - RNA, 21 nt, Human
ccagcgccucccuccacccca

SEQ ID NO: 2649568 - RNA, 22 nt, Human
ccagcgccucccuccaccccag

SEQ ID NO: 2649569 - RNA, 23 nt, Human
ccagcgccucccuccaccccagg

SEQ ID NO: 2649570 - RNA, 23 nt, Human
ccagcgucagcugcucccuggca

SEQ ID NO: 2649571 - RNA, 14 nt, Human
ccagcuuggggcca

SEQ ID NO: 2649572 - RNA, 16 nt, Human
ccagcuuggggccacc

SEQ ID NO: 2649573 - RNA, 22 nt, Human
ccagcuuggggccaccaaagcu

SEQ ID NO: 2649574 - RNA, 19 nt, Human
ccagcuuggggccaccaaa

SEQ ID NO: 2649575 - RNA, 21 nt, Human
ccagcuuggggccaccaaagc

SEQ ID NO: 2649576 - RNA, 12 nt, Human
ccagcagccugg

SEQ ID NO: 2649577 - RNA, 11 nt, Human
ccagcagccug

SEQ ID NO: 2649578 - RNA, 13 nt, Human
ccagcagccugga

SEQ ID NO: 2649579 - RNA, 14 nt, Human
ccagccccgacucc

SEQ ID NO: 2649580 - RNA, 15 nt, Human
ccagccccgacucca

SEQ ID NO: 2649581 - RNA, 16 nt, Human
ccagccccgacuccag

SEQ ID NO: 2649582 - RNA, 17 nt, Human
ccagccccgacuccagc

SEQ ID NO: 2649583 - RNA, 18 nt, Human
ccagccccgacuccagcc

SEQ ID NO: 2649584 - RNA, 19 nt, Human
ccagccccgacuccagcca

SEQ ID NO: 2649585 - RNA, 20 nt, Human
ccagccccgacuccagccag

SEQ ID NO: 2649586 - RNA, 21 nt, Human
ccagccccgacuccagccagc

SEQ ID NO: 2649587 - RNA, 22 nt, Human
ccagccccgacuccagccagcg

SEQ ID NO: 2649588 - RNA, 18 nt, Human
ccagcgaucucuccacug

SEQ ID NO: 2649589 - RNA, 19 nt, Human
ccagcgaucucuccacugu

SEQ ID NO: 2649590 - RNA, 20 nt, Human
ccagcgaucucuccacugug

SEQ ID NO: 2649591 - RNA, 21 nt, Human
ccagcgaucucuccacugugc

SEQ ID NO: 2649592 - RNA, 14 nt, Human
gccugcgacccugg

SEQ ID NO: 2649593 - RNA, 15 nt, Human
gccugcgacccuggg

SEQ ID NO: 2649594 - RNA, 16 nt, Human
gccugcgacccugggg

SEQ ID NO: 2649595 - RNA, 23 nt, Human
gccugcgacccugggggcacagg

SEQ ID NO: 2649596 - RNA, 21 nt, Human
gccugccuuaagugaggaaau

SEQ ID NO: 2649597 - RNA, 20 nt, Human
gccugccuuaagugaggaaa

SEQ ID NO: 2649598 - RNA, 16 nt, Human
gccugccucuucucua

SEQ ID NO: 2649599 - RNA, 13 nt, Human
gccugccucccac

SEQ ID NO: 2649600 - RNA, 21 nt, Human
gccuguguccaugcgcucagg

SEQ ID NO: 2649601 - RNA, 23 nt, Human
gccuguguccaugcgcucagggc

SEQ ID NO: 2649602 - RNA, 19 nt, Human
gccuguguccaugcgcuca

SEQ ID NO: 2649603 - RNA, 20 nt, Human
gccuguguccaugcgcucag

SEQ ID NO: 2649604 - RNA, 22 nt, Human
gccugggaggucaaggcugcag

SEQ ID NO: 2649605 - RNA, 21 nt, Human
gccugggaggucaaggcugca

SEQ ID NO: 2649606 - RNA, 18 nt, Human
gccugggaaauaagcccc

SEQ ID NO: 2649607 - RNA, 13 nt, Human
gccuccuccagcc

SEQ ID NO: 2649608 - RNA, 12 nt, Human
gccucugugccu

SEQ ID NO: 2649609 - RNA, 23 nt, Human
gccucuucucuacucuagggaaa

SEQ ID NO: 2649610 - RNA, 12 nt, Human
gccucuucucua

SEQ ID NO: 2649611 - RNA, 15 nt, Human
gccucuucugagcuu

SEQ ID NO: 2649612 - RNA, 18 nt, Human
gccucugugcugugugug

SEQ ID NO: 2649613 - RNA, 11 nt, Human
gccucugugcu

SEQ ID NO: 2649614 - RNA, 12 nt, Human
gccucugugcug

SEQ ID NO: 2649615 - RNA, 14 nt, Human
gccucugugcugug

SEQ ID NO: 2649616 - RNA, 17 nt, Human
gccucugugcugugugu

SEQ ID NO: 2649617 - RNA, 22 nt, Human
gccucuugaccaggcugccucc

SEQ ID NO: 2649618 - RNA, 17 nt, Human
gccucuugaccaggcug

SEQ ID NO: 2649619 - RNA, 20 nt, Human
gccucuugaccaggcugccu

SEQ ID NO: 2649620 - RNA, 13 nt, Human
gccucuugaccag

SEQ ID NO: 2649621 - RNA, 14 nt, Human
gccucuugaccagg

SEQ ID NO: 2649622 - RNA, 15 nt, Human
gccucuugaccaggc

SEQ ID NO: 2649623 - RNA, 16 nt, Human
gccucuugaccaggcu

SEQ ID NO: 2649624 - RNA, 21 nt, Human
gccuaccccgcagacaccuug

SEQ ID NO: 2649625 - RNA, 14 nt, Human
gccuaccccgcaga

SEQ ID NO: 2649626 - RNA, 17 nt, Human
gccuaccccgcagacac

SEQ ID NO: 2649627 - RNA, 13 nt, Human
gccggcccugugu

SEQ ID NO: 2649628 - RNA, 14 nt, Human
gccggcccugugug

SEQ ID NO: 2649629 - RNA, 15 nt, Human
gccggcccugugugc

SEQ ID NO: 2649630 - RNA, 16 nt, Human
gccggcccugugugca

SEQ ID NO: 2649631 - RNA, 17 nt, Human
gccggcccugugugcag

SEQ ID NO: 2649632 - RNA, 18 nt, Human
gccggcccugugugcagg

SEQ ID NO: 2649633 - RNA, 12 nt, Human
gccggccccagg

SEQ ID NO: 2649634 - RNA, 14 nt, Human
gccggccccaggcu

SEQ ID NO: 2649635 - RNA, 16 nt, Human
gccggcccgccucucc

SEQ ID NO: 2649636 - RNA, 12 nt, Human
gcccugugugca

SEQ ID NO: 2649637 - RNA, 13 nt, Human
gcccugugugcag

SEQ ID NO: 2649638 - RNA, 14 nt, Human
gcccugugugcagg

SEQ ID NO: 2649639 - RNA, 15 nt, Human
gcccugugugcaggu

SEQ ID NO: 2649640 - RNA, 16 nt, Human
gccgccaugcuccugg

SEQ ID NO: 2649641 - RNA, 15 nt, Human
gccgccaugcuccug

SEQ ID NO: 2649642 - RNA, 16 nt, Human
gccgcgcguccagcug

SEQ ID NO: 2649643 - RNA, 18 nt, Human
gccgcgcguccagcugcc

SEQ ID NO: 2649644 - RNA, 15 nt, Human
gccgcggagccugca

SEQ ID NO: 2649645 - RNA, 22 nt, Human
gccgccugcacuccucagggca

SEQ ID NO: 2649646 - RNA, 18 nt, Human
gccgccugcacuccucag

SEQ ID NO: 2649647 - RNA, 19 nt, Human
gccgccugcacuccucagg

SEQ ID NO: 2649648 - RNA, 13 nt, Human
gccgccugcacuc

SEQ ID NO: 2649649 - RNA, 21 nt, Human
gccggcagccccagccugcua

SEQ ID NO: 2649650 - RNA, 20 nt, Human
gccggcagccccagccugcu

SEQ ID NO: 2649651 - RNA, 19 nt, Human
gccggcagccccagccugc

SEQ ID NO: 2649652 - RNA, 18 nt, Human
gccggcagccccagccug

SEQ ID NO: 2649653 - RNA, 12 nt, Human
gccgcugccacg

SEQ ID NO: 2649654 - RNA, 16 nt, Human
gccgcugaguggcagg

SEQ ID NO: 2649655 - RNA, 15 nt, Human
gcccccaguccccac

SEQ ID NO: 2649656 - RNA, 17 nt, Human
gcccccaguccccaccc

SEQ ID NO: 2649657 - RNA, 18 nt, Human
gcccccaguccccacccc

SEQ ID NO: 2649658 - RNA, 20 nt, Human
gcccccaguccccaccccug

SEQ ID NO: 2649659 - RNA, 22 nt, Human
gcccccuccugaaccgcacagc

SEQ ID NO: 2649660 - RNA, 16 nt, Human
gcccccuccgcccugc

SEQ ID NO: 2649661 - RNA, 21 nt, Human
gcccccaguccccaccccugc

SEQ ID NO: 2649662 - RNA, 22 nt, Human
gcccccaguccccaccccugcc

SEQ ID NO: 2649663 - RNA, 18 nt, Human
gcccccuccgcccugcca

SEQ ID NO: 2649664 - RNA, 20 nt, Human
gcccccuccgcccugccacu

SEQ ID NO: 2649665 - RNA, 22 nt, Human
gcccccuccgcccugccacuca

SEQ ID NO: 2649666 - RNA, 12 nt, Human
gcccccuccuga

SEQ ID NO: 2649667 - RNA, 13 nt, Human
gcccccuccugaa

SEQ ID NO: 2649668 - RNA, 15 nt, Human
gcccccuccugaacc

SEQ ID NO: 2649669 - RNA, 21 nt, Human
gcccccuccugaaccgcacag

SEQ ID NO: 2649670 - RNA, 18 nt, Human
gcccuaaccccuuccaga

SEQ ID NO: 2649671 - RNA, 14 nt, Human
gcccuacuauucag

SEQ ID NO: 2649672 - RNA, 20 nt, Human
gcccuacucccugcagaugc

SEQ ID NO: 2649673 - RNA, 22 nt, Human
gcccuacucccugcagaugcca

SEQ ID NO: 2649674 - RNA, 16 nt, Human
gcccuacucccugcag

SEQ ID NO: 2649675 - RNA, 17 nt, Human
gcccuacucccugcaga

SEQ ID NO: 2649676 - RNA, 23 nt, Human
gcccguguaguccccaaccgugu

SEQ ID NO: 2649677 - RNA, 12 nt, Human
gccccuggcacu

SEQ ID NO: 2649678 - RNA, 13 nt, Human
gccccuggcacuc

SEQ ID NO: 2649679 - RNA, 17 nt, Human
gccccuggcacucuugu

SEQ ID NO: 2649680 - RNA, 18 nt, Human
gccacuuccuuuuaacug

SEQ ID NO: 2649681 - RNA, 22 nt, Human
gccacuuuacccaccuagaaca

SEQ ID NO: 2649682 - RNA, 19 nt, Human
gccacuuuacccaccuaga

SEQ ID NO: 2649683 - RNA, 20 nt, Human
gccacuuuacccaccuagaa

SEQ ID NO: 2649684 - RNA, 18 nt, Human
gccacuuuacccaccuag

SEQ ID NO: 2649685 - RNA, 23 nt, Human
gccacuuuacccaccuagaacac

SEQ ID NO: 2649686 - RNA, 19 nt, Human
gccacugugaagagaacca

SEQ ID NO: 2649687 - RNA, 18 nt, Human
gccacugugaagagaacc

SEQ ID NO: 2649688 - RNA, 18 nt, Human
gccacugccuucgcuucu

SEQ ID NO: 2649689 - RNA, 23 nt, Human
gccacugccuucgcuucuugccu

SEQ ID NO: 2649690 - RNA, 22 nt, Human
gccacugccuucgcuucuugcc

SEQ ID NO: 2649691 - RNA, 22 nt, Human
gccacccuagccaaugucuccu

SEQ ID NO: 2649692 - RNA, 12 nt, Human
gccacccuagcc

SEQ ID NO: 2649693 - RNA, 15 nt, Human
gccacccaggaggca

SEQ ID NO: 2649694 - RNA, 16 nt, Human
gccacccaggaggcag

SEQ ID NO: 2649695 - RNA, 17 nt, Human
gccacccaggaggcagg

SEQ ID NO: 2649696 - RNA, 14 nt, Human
gccaccaaagcugc

SEQ ID NO: 2649697 - RNA, 20 nt, Human
gccaccaaagcugcccacug

SEQ ID NO: 2649698 - RNA, 15 nt, Human
gccaccaaagcugcc

SEQ ID NO: 2649699 - RNA, 16 nt, Human
gccaccaaagcugccc

SEQ ID NO: 2649700 - RNA, 17 nt, Human
gccaccaaagcugccca

SEQ ID NO: 2649701 - RNA, 19 nt, Human
gccaccaaagcugcccacu

SEQ ID NO: 2649702 - RNA, 22 nt, Human
gccaccaugccucacuaauuuu

SEQ ID NO: 2649703 - RNA, 15 nt, Human
gccaccagcucugcc

SEQ ID NO: 2649704 - RNA, 17 nt, Human
gccaccagcucugccgu

SEQ ID NO: 2649705 - RNA, 12 nt, Human
gccaccaggcca

SEQ ID NO: 2649706 - RNA, 19 nt, Human
gccaccagcucugccgucu

SEQ ID NO: 2649707 - RNA, 15 nt, Human
gccaccaggccaccu

SEQ ID NO: 2649708 - RNA, 18 nt, Human
gccaccaggccaccuccc

SEQ ID NO: 2649709 - RNA, 20 nt, Human
gccaccaggccaccucccca

SEQ ID NO: 2649710 - RNA, 17 nt, Human
gccaugugcaccuuggg

SEQ ID NO: 2649711 - RNA, 12 nt, Human
gccaugugcaua

SEQ ID NO: 2649712 - RNA, 19 nt, Human
gccaugugcauaguuucuu

SEQ ID NO: 2649713 - RNA, 20 nt, Human
gccaugugcauaguuucuuu

SEQ ID NO: 2649714 - RNA, 22 nt, Human
gccauguccaaagaggcugccc

SEQ ID NO: 2649715 - RNA, 18 nt, Human
gccauguccaaagaggcu

SEQ ID NO: 2649716 - RNA, 19 nt, Human
gccauguccaaagaggcug

SEQ ID NO: 2649717 - RNA, 15 nt, Human
gccauguaugaagcc

SEQ ID NO: 2649718 - RNA, 14 nt, Human
gccauguccaaaga

SEQ ID NO: 2649719 - RNA, 15 nt, Human
gccauguccaaagag

SEQ ID NO: 2649720 - RNA, 19 nt, Human
gccauucauguaugucaga

SEQ ID NO: 2649721 - RNA, 19 nt, Human
gccauguuggccaggcugg

SEQ ID NO: 2649722 - RNA, 20 nt, Human
gccauucuccugccucagcc

SEQ ID NO: 2649723 - RNA, 22 nt, Human
gccauucugccgcccccuccug

SEQ ID NO: 2649724 - RNA, 13 nt, Human
gccacuucuaaga

SEQ ID NO: 2649725 - RNA, 19 nt, Human
gccagcagcagcaggugau

SEQ ID NO: 2649726 - RNA, 15 nt, Human
gccagcagcagcagg

SEQ ID NO: 2649727 - RNA, 16 nt, Human
gccagcagcagcaggu

SEQ ID NO: 2649728 - RNA, 13 nt, Human
gccagcagcagca

SEQ ID NO: 2649729 - RNA, 14 nt, Human
gccagcaccuggca

SEQ ID NO: 2649730 - RNA, 18 nt, Human
gccagccaacucugggaa

SEQ ID NO: 2649731 - RNA, 19 nt, Human
gcuccccacagcgucccug

SEQ ID NO: 2649732 - RNA, 20 nt, Human
gcuccccacagcgucccugg

SEQ ID NO: 2649733 - RNA, 21 nt, Human
gcuccccacagcgucccuggc

SEQ ID NO: 2649734 - RNA, 22 nt, Human
gcuccccacagcgucccuggcg

SEQ ID NO: 2649735 - RNA, 12 nt, Human
gcuccugcccac

SEQ ID NO: 2649736 - RNA, 19 nt, Human
gcucggagaagagcgcagu

SEQ ID NO: 2649737 - RNA, 23 nt, Human
gcucggagaagagcgcaguguuu

SEQ ID NO: 2649738 - RNA, 13 nt, Human
gcucggcucagcu

SEQ ID NO: 2649739 - RNA, 16 nt, Human
gcucggcucagcucgg

SEQ ID NO: 2649740 - RNA, 14 nt, Human
gcucugaccacuug

SEQ ID NO: 2649741 - RNA, 21 nt, Human
gcucugaccacuugaggccug

SEQ ID NO: 2649742 - RNA, 22 nt, Human
gcucugaccacuugaggccuga

SEQ ID NO: 2649743 - RNA, 13 nt, Human
gcucuggagggga

SEQ ID NO: 2649744 - RNA, 15 nt, Human
gcucuggaggggagg

SEQ ID NO: 2649745 - RNA, 16 nt, Human
gcucuggaggggaggg

SEQ ID NO: 2649746 - RNA, 18 nt, Human
gcucugcaguccuacuca

SEQ ID NO: 2649747 - RNA, 21 nt, Human
gcucugcaguccuacucaagc

SEQ ID NO: 2649748 - RNA, 14 nt, Human
gcugaaauucuccu

SEQ ID NO: 2649749 - RNA, 15 nt, Human
gcugaaauucuccug

SEQ ID NO: 2649750 - RNA, 16 nt, Human
gcugaaauucuccugg

SEQ ID NO: 2649751 - RNA, 18 nt, Human
gcucuucaucccauucca

SEQ ID NO: 2649752 - RNA, 19 nt, Human
gcucuucaucccauuccag

SEQ ID NO: 2649753 - RNA, 15 nt, Human
gcucuucagaugcca

SEQ ID NO: 2649754 - RNA, 20 nt, Human
gcugaauguugggacugcua

SEQ ID NO: 2649755 - RNA, 23 nt, Human
gcugaauguugggacugcuaaau

SEQ ID NO: 2649756 - RNA, 17 nt, Human
gcugaauguugggacug

SEQ ID NO: 2649757 - RNA, 22 nt, Human
gcugaauacagaggcaacugca

SEQ ID NO: 2649758 - RNA, 17 nt, Human
gcugaaauucuccugga

SEQ ID NO: 2649759 - RNA, 18 nt, Human
gcugaaauucuccuggag

SEQ ID NO: 2649760 - RNA, 12 nt, Human
gcucaggguggu

SEQ ID NO: 2649761 - RNA, 23 nt, Human
gcucagggccaugcugaggccug

SEQ ID NO: 2649762 - RNA, 20 nt, Human
gcucagggccaugcugaggc

SEQ ID NO: 2649763 - RNA, 22 nt, Human
gcuagucaacaguacccugguu

SEQ ID NO: 2649764 - RNA, 13 nt, Human
gcuagucaacagu

SEQ ID NO: 2649765 - RNA, 13 nt, Human
gcuaggaagaguc

SEQ ID NO: 2649766 - RNA, 21 nt, Human
gcuaggaagagucuacccgac

SEQ ID NO: 2649767 - RNA, 15 nt, Human
gcuaugucaguacua

SEQ ID NO: 2649768 - RNA, 15 nt, Human
gcuauguauaaaaua

SEQ ID NO: 2649769 - RNA, 16 nt, Human
gcuauguauaaaauac

SEQ ID NO: 2649770 - RNA, 22 nt, Human
gcuauuuauuuuccuaaagaga

SEQ ID NO: 2649771 - RNA, 16 nt, Human
gcuauuuauuuuccua

SEQ ID NO: 2649772 - RNA, 20 nt, Human
gcuauuuauuuuccuaaaga

SEQ ID NO: 2649773 - RNA, 16 nt, Human
gcuauuuaugggcccc

SEQ ID NO: 2649774 - RNA, 17 nt, Human
gcuauuuaugggccccu

SEQ ID NO: 2649775 - RNA, 18 nt, Human
gcuauuuaugggccccug

SEQ ID NO: 2649776 - RNA, 19 nt, Human
gcuauuuaugggccccugg

SEQ ID NO: 2649777 - RNA, 22 nt, Human
gcuauuuaugggccccuggcac

SEQ ID NO: 2649778 - RNA, 15 nt, Human
gcuauuuauuuuccu

SEQ ID NO: 2649779 - RNA, 20 nt, Human
gccuguuaggagaagcugca

SEQ ID NO: 2649780 - RNA, 19 nt, Human
gcuucuugccucugugcug

SEQ ID NO: 2649781 - RNA, 20 nt, Human
gcuucuugccucugugcugu

SEQ ID NO: 2649782 - RNA, 21 nt, Human
gcuucuugccucugugcugug

SEQ ID NO: 2649783 - RNA, 15 nt, Human
gcuucccuuacuuug

SEQ ID NO: 2649784 - RNA, 14 nt, Human
gcuuccuugccuga

SEQ ID NO: 2649785 - RNA, 24 nt, Human
gcuuccuuucccaagccuucgggc

SEQ ID NO: 2649786 - RNA, 23 nt, Human
gcuuccuuguagcgacuaaacua

SEQ ID NO: 2649787 - RNA, 16 nt, Human
gcuuccuuucccaagc

SEQ ID NO: 2649788 - RNA, 14 nt, Human
gcuuggccugcugu

SEQ ID NO: 2649789 - RNA, 15 nt, Human
gcuuggccugcugug

SEQ ID NO: 2649790 - RNA, 16 nt, Human
gcuuggccugcuguga

SEQ ID NO: 2649791 - RNA, 23 nt, Human
gcuuggggccaccaaagcugccc

SEQ ID NO: 2649792 - RNA, 16 nt, Human
gcuuggggcucacaca

SEQ ID NO: 2649793 - RNA, 20 nt, Human
gcuuggggcucacacaccug

SEQ ID NO: 2649794 - RNA, 19 nt, Human
gcuuggggccaccaaagcu

SEQ ID NO: 2649795 - RNA, 20 nt, Human
gcuuggggccaccaaagcug

SEQ ID NO: 2649796 - RNA, 22 nt, Human
gcuuggggccaccaaagcugcc

SEQ ID NO: 2649797 - RNA, 19 nt, Human
gcuuccauuuuaauuuuaa

SEQ ID NO: 2649798 - RNA, 13 nt, Human
gcuucccuaaucu

SEQ ID NO: 2649799 - RNA, 14 nt, Human
gcuucccuaaucua

SEQ ID NO: 2649800 - RNA, 15 nt, Human
gcuguaaucauuugu

SEQ ID NO: 2649801 - RNA, 22 nt, Human
gcuguaaucauuuguuuacauu

SEQ ID NO: 2649802 - RNA, 15 nt, Human
gcuguuggugggacc

SEQ ID NO: 2649803 - RNA, 20 nt, Human
gcuucacggaagagccuugc

SEQ ID NO: 2649804 - RNA, 13 nt, Human
gcuuaaauuucuu

SEQ ID NO: 2649805 - RNA, 15 nt, Human
gcuuaaauuucuuau

SEQ ID NO: 2649806 - RNA, 16 nt, Human
gcuuaaauuucuuaug

SEQ ID NO: 2649807 - RNA, 21 nt, Human
gcuuaaauuucuuaugugaca

SEQ ID NO: 2649808 - RNA, 19 nt, Human
gcuucacaguagagccagc

SEQ ID NO: 2649809 - RNA, 20 nt, Human
gcuucacaguagagccagcu

SEQ ID NO: 2649810 - RNA, 21 nt, Human
gcuucacaguagagccagcuu

SEQ ID NO: 2649811 - RNA, 22 nt, Human
gcuucacaguagagccagcuug

SEQ ID NO: 2649812 - RNA, 17 nt, Human
gcuucaccauggccuua

SEQ ID NO: 2649813 - RNA, 20 nt, Human
gcuucaccauggccuuauga

SEQ ID NO: 2649814 - RNA, 17 nt, Human
gcuucacaguagagcca

SEQ ID NO: 2649815 - RNA, 18 nt, Human
gcuucacaguagagccag

SEQ ID NO: 2649816 - RNA, 13 nt, Human
gcugugcugcccu

SEQ ID NO: 2649817 - RNA, 19 nt, Human
gcuggacggguuagacagc

SEQ ID NO: 2649818 - RNA, 20 nt, Human
gcuggacuucuaccugcccu

SEQ ID NO: 2649819 - RNA, 21 nt, Human
gcuggacuucuaccugcccuc

SEQ ID NO: 2649820 - RNA, 22 nt, Human
gcuggacuucuaccugcccuca

SEQ ID NO: 2649821 - RNA, 16 nt, Human
gcuggguucauuugug

SEQ ID NO: 2649822 - RNA, 16 nt, Human
gcugagggcagacugg

SEQ ID NO: 2649823 - RNA, 17 nt, Human
gcugccaggugagaaac

SEQ ID NO: 2649824 - RNA, 16 nt, Human
gcugccagccuugagc

SEQ ID NO: 2649825 - RNA, 19 nt, Human
gcugccagccuugagcccu

SEQ ID NO: 2649826 - RNA, 20 nt, Human
gcugccagccuugagcccug

SEQ ID NO: 2649827 - RNA, 21 nt, Human
gcugccagccuugagcccugg

SEQ ID NO: 2649828 - RNA, 22 nt, Human
gcugccagccuugagcccuggc

SEQ ID NO: 2649829 - RNA, 23 nt, Human
gcugccagccuugagcccuggcu

SEQ ID NO: 2649830 - RNA, 22 nt, Human
gcugcccacuguuucucuugag

SEQ ID NO: 2649831 - RNA, 23 nt, Human
gcugcccacuguuucucuugagc

SEQ ID NO: 2649832 - RNA, 18 nt, Human
gcugcccacuguuucucu

SEQ ID NO: 2649833 - RNA, 22 nt, Human
gcugccccaucuccccucagcu

SEQ ID NO: 2649834 - RNA, 21 nt, Human
gcugccccaucuccccucagc

SEQ ID NO: 2649835 - RNA, 23 nt, Human
gcugccccaucuccccucagcuc

SEQ ID NO: 2649836 - RNA, 13 nt, Human
gcugccguggggc

SEQ ID NO: 2649837 - RNA, 22 nt, Human
gcugccguggggccgccgccuc

SEQ ID NO: 2649838 - RNA, 18 nt, Human
gcugccgugccgccugca

SEQ ID NO: 2649839 - RNA, 22 nt, Human
gcugccgugccgccugcacucc

SEQ ID NO: 2649840 - RNA, 13 nt, Human
gcugcugccucuu

SEQ ID NO: 2649841 - RNA, 12 nt, Human
gcugcugcugcu

SEQ ID NO: 2649842 - RNA, 17 nt, Human
gcugcugcccccacccc

SEQ ID NO: 2649843 - RNA, 24 nt, Human
ggggaaaaucagccugcuccagcu

SEQ ID NO: 2649844 - RNA, 23 nt, Human
ggggaaagacacugccugggcug

SEQ ID NO: 2649845 - RNA, 22 nt, Human
ggggaaagacacugccugggcu

SEQ ID NO: 2649846 - RNA, 22 nt, Human
aaacaguuuuuauuaaaacaug

SEQ ID NO: 2649847 - RNA, 14 nt, Human
aaacauagaaaugg

SEQ ID NO: 2649848 - RNA, 21 nt, Human
aaacauagaaauggaaauuuu

SEQ ID NO: 2649849 - RNA, 17 nt, Human
aaacauaacauaaauuu

SEQ ID NO: 2649850 - RNA, 14 nt, Human
aaaauggaauaaaa

SEQ ID NO: 2649851 - RNA, 14 nt, Human
aaaauguaauuuaa

SEQ ID NO: 2649852 - RNA, 18 nt, Human
aaaauguaauuuaaauga

SEQ ID NO: 2649853 - RNA, 19 nt, Human
aaaauguaauuuaaaugaa

SEQ ID NO: 2649854 - RNA, 21 nt, Human
aaaauguaggcuuaguuugug

SEQ ID NO: 2649855 - RNA, 18 nt, Human
gggcuggacuucuaccug

SEQ ID NO: 2649856 - RNA, 17 nt, Human
gggcugcuuccuccugg

SEQ ID NO: 2649857 - RNA, 18 nt, Human
gggcugcuuccuccugga

SEQ ID NO: 2649858 - RNA, 19 nt, Human
gggcugcuuccuccuggaa

SEQ ID NO: 2649859 - RNA, 20 nt, Human
gggcugcuuccuccuggaaa

SEQ ID NO: 2649860 - RNA, 13 nt, Human
aaacaaaaugaag

SEQ ID NO: 2649861 - RNA, 12 nt, Human
aaacaaaauuug

SEQ ID NO: 2649862 - RNA, 13 nt, Human
aaacaaaauuuga

SEQ ID NO: 2649863 - RNA, 15 nt, Human
aaacaaaauuugacu

SEQ ID NO: 2649864 - RNA, 17 nt, Human
aaacaaaauuugacuaa

SEQ ID NO: 2649865 - RNA, 15 nt, Human
aaacaaccaugucau

SEQ ID NO: 2649866 - RNA, 17 nt, Human
aaacaaccaugucauuu

SEQ ID NO: 2649867 - RNA, 13 nt, Human
aaaauuguuauuu

SEQ ID NO: 2649868 - RNA, 16 nt, Human
aaaauuguuuagugau

SEQ ID NO: 2649869 - RNA, 17 nt, Human
ggggucucacccaugca

SEQ ID NO: 2649870 - RNA, 13 nt, Human
ggggucucccugg

SEQ ID NO: 2649871 - RNA, 14 nt, Human
ggggucucccuggc

SEQ ID NO: 2649872 - RNA, 21 nt, Human
ggggucucccuggcucccucc

SEQ ID NO: 2649873 - RNA, 24 nt, Human
ggguaggggaagaagagcuaucag

SEQ ID NO: 2649874 - RNA, 19 nt, Human
ggguaggagggugggaagg

SEQ ID NO: 2649875 - RNA, 16 nt, Human
aaacauugaaguaaug

SEQ ID NO: 2649876 - RNA, 12 nt, Human
aaacauuuauuu

SEQ ID NO: 2649877 - RNA, 20 nt, Human
aaacauugaaguaaugaauu

SEQ ID NO: 2649878 - RNA, 21 nt, Human
aaaccaaagagggcuuccucu

SEQ ID NO: 2649879 - RNA, 17 nt, Human
aaaccaaagagggcuuc

SEQ ID NO: 2649880 - RNA, 19 nt, Human
aaaccaaagagggcuuccu

SEQ ID NO: 2649881 - RNA, 20 nt, Human
aaaccaaagagggcuuccuc

SEQ ID NO: 2649882 - RNA, 23 nt, Human
aaacauuuauuuuuuuuaaagaa

SEQ ID NO: 2649883 - RNA, 19 nt, Human
gggucgggggcaggugcug

SEQ ID NO: 2649884 - RNA, 20 nt, Human
gggucggcugaccaugcuca

SEQ ID NO: 2649885 - RNA, 21 nt, Human
aaacuaccuguauuuaaaaau

SEQ ID NO: 2649886 - RNA, 16 nt, Human
aaacuccacaucugcc

SEQ ID NO: 2649887 - RNA, 19 nt, Human
aaacuccacaucugccuua

SEQ ID NO: 2649888 - RNA, 17 nt, Human
aaacuccacaucugccu

SEQ ID NO: 2649889 - RNA, 18 nt, Human
aaacuccacaucugccuu

SEQ ID NO: 2649890 - RNA, 20 nt, Human
aaacuggggccuccagaacu

SEQ ID NO: 2649891 - RNA, 19 nt, Human
aaacugggaugaaacuaaa

SEQ ID NO: 2649892 - RNA, 23 nt, Human
aaacugggaugaaacuaaagcaa

SEQ ID NO: 2649893 - RNA, 18 nt, Human
aaacuggggccuccagaa

SEQ ID NO: 2649894 - RNA, 17 nt, Human
aaacuggggccuccaga

SEQ ID NO: 2649895 - RNA, 15 nt, Human
aaacuacauauugua

SEQ ID NO: 2649896 - RNA, 13 nt, Human
aaacuaaauuuca

SEQ ID NO: 2649897 - RNA, 16 nt, Human
aaacuaauauuuuaug

SEQ ID NO: 2649898 - RNA, 17 nt, Human
aaaccaccaaaaacaaa

SEQ ID NO: 2649899 - RNA, 19 nt, Human
ggugaucccguuuucccca

SEQ ID NO: 2649900 - RNA, 17 nt, Human
ggucuuugagcucccac

SEQ ID NO: 2649901 - RNA, 18 nt, Human
ggucuuuaaaauauuguu

SEQ ID NO: 2649902 - RNA, 19 nt, Human
ggucuugauucagucacau

SEQ ID NO: 2649903 - RNA, 20 nt, Human
ggucuuucaguacuuuuuua

SEQ ID NO: 2649904 - RNA, 10 nt, Human
ggucuuugag

SEQ ID NO: 2649905 - RNA, 16 nt, Human
ggucuguuggcaggcu

SEQ ID NO: 2649906 - RNA, 18 nt, Human
ggucuguuggcaggcugg

SEQ ID NO: 2649907 - RNA, 18 nt, Human
ggugauuggaccaggcca

SEQ ID NO: 2649908 - RNA, 11 nt, Human
aaagcuucccc

SEQ ID NO: 2649909 - RNA, 19 nt, Human
aaagcuagucaacaguacc

SEQ ID NO: 2649910 - RNA, 20 nt, Human
aaagcuauaaagcaguauuu

SEQ ID NO: 2649911 - RNA, 17 nt, Human
aaagcuauauaagacaa

SEQ ID NO: 2649912 - RNA, 19 nt, Human
aaagcuuggauuaaauaca

SEQ ID NO: 2649913 - RNA, 20 nt, Human
aaagcuuggauuaaauacau

SEQ ID NO: 2649914 - RNA, 21 nt, Human
aaagcuuggauuaaauacaua

SEQ ID NO: 2649915 - RNA, 18 nt, Human
aaagcuugguucugugaa

SEQ ID NO: 2649916 - RNA, 16 nt, Human
aaaggaaagaaaacau

SEQ ID NO: 2649917 - RNA, 18 nt, Human
aaaggaaaauaguaaugu

SEQ ID NO: 2649918 - RNA, 16 nt, Human
aaaggaaaaugucugu

SEQ ID NO: 2649919 - RNA, 15 nt, Human
aaaggaaagaaaaca

SEQ ID NO: 2649920 - RNA, 23 nt, Human
ggugcccagaauaaguuauugca

SEQ ID NO: 2649921 - RNA, 14 nt, Human
ggugcccaagccag

SEQ ID NO: 2649922 - RNA, 17 nt, Human
ggugcccaagccagagg

SEQ ID NO: 2649923 - RNA, 18 nt, Human
ggugcccaagccagaggc

SEQ ID NO: 2649924 - RNA, 22 nt, Human
ggugccaugaagggacccuuug

SEQ ID NO: 2649925 - RNA, 23 nt, Human
ggugcccaagccagaggcugggu

SEQ ID NO: 2649926 - RNA, 21 nt, Human
ggugcccaagccagaggcugg

SEQ ID NO: 2649927 - RNA, 22 nt, Human
ggugcccaagccagaggcuggg

SEQ ID NO: 2649928 - RNA, 18 nt, Human
aaacuguagaaaugauga

SEQ ID NO: 2649929 - RNA, 16 nt, Human
aaacuguagaaaugau

SEQ ID NO: 2649930 - RNA, 15 nt, Human
aaacuguagaaauga

SEQ ID NO: 2649931 - RNA, 18 nt, Human
gguaguugcaauugaauu

SEQ ID NO: 2649932 - RNA, 13 nt, Human
gguaguuucugug

SEQ ID NO: 2649933 - RNA, 20 nt, Human
gguccaaccagaccuggaag

SEQ ID NO: 2649934 - RNA, 19 nt, Human
gguauuaaaacuaaauuuc

SEQ ID NO: 2649935 - RNA, 22 nt, Human
ggucauccagacucagagcucu

SEQ ID NO: 2649936 - RNA, 16 nt, Human
aaacuuguuucacuga

SEQ ID NO: 2649937 - RNA, 17 nt, Human
aaacuuguuucacugaa

SEQ ID NO: 2649938 - RNA, 18 nt, Human
aaacuuguuucacugaaa

SEQ ID NO: 2649939 - RNA, 13 nt, Human
aaacuuuaauaua

SEQ ID NO: 2649940 - RNA, 14 nt, Human
gguccagaagagaa

SEQ ID NO: 2649941 - RNA, 14 nt, Human
aaagaauuuaguau

SEQ ID NO: 2649942 - RNA, 16 nt, Human
aaagaauuuaguauua

SEQ ID NO: 2649943 - RNA, 12 nt, Human
aaagagaaugag

SEQ ID NO: 2649944 - RNA, 14 nt, Human
aaagagaaugaguc

SEQ ID NO: 2649945 - RNA, 20 nt, Human
aaagagaaugaguccuugau

SEQ ID NO: 2649946 - RNA, 21 nt, Human
aaagagaauugggggcuuagg

SEQ ID NO: 2649947 - RNA, 14 nt, Human
aaagagacaggcag

SEQ ID NO: 2649948 - RNA, 18 nt, Human
aaagacuuuaaaagugau

SEQ ID NO: 2649949 - RNA, 18 nt, Human
aaagacaaaagucugucu

SEQ ID NO: 2649950 - RNA, 18 nt, Human
aaagagagaacaggacua

SEQ ID NO: 2649951 - RNA, 20 nt, Human
aaagaugguaucauauauuu

SEQ ID NO: 2649952 - RNA, 15 nt, Human
aaagauucaugauuu

SEQ ID NO: 2649953 - RNA, 16 nt, Human
aaaagcgcuuuuccuu

SEQ ID NO: 2649954 - RNA, 14 nt, Human
aaaacuaaauuuca

SEQ ID NO: 2649955 - RNA, 19 nt, Human
aaaacuugguuuuaugguu

SEQ ID NO: 2649956 - RNA, 21 nt, Human
aaaagcuauaaagcaguauuu

SEQ ID NO: 2649957 - RNA, 17 nt, Human
aaaagcuauaaagcagu

SEQ ID NO: 2649958 - RNA, 13 nt, Human
aaaagcucuuuua

SEQ ID NO: 2649959 - RNA, 14 nt, Human
aaaagcucuuuuaa

SEQ ID NO: 2649960 - RNA, 15 nt, Human
aaaagcucuuuuaau

SEQ ID NO: 2649961 - RNA, 15 nt, Human
aaaagcuccuggggc

SEQ ID NO: 2649962 - RNA, 14 nt, Human
aaaagcugggcagg

SEQ ID NO: 2649963 - RNA, 21 nt, Human
gggagggcggcaggggccugg

SEQ ID NO: 2649964 - RNA, 22 nt, Human
gggagggcggcaggggccugga

SEQ ID NO: 2649965 - RNA, 23 nt, Human
gggagagagagagagagaggaca

SEQ ID NO: 2649966 - RNA, 14 nt, Human
gggagagagagaga

SEQ ID NO: 2649967 - RNA, 22 nt, Human
gggagagagagagagagaggac

SEQ ID NO: 2649968 - RNA, 14 nt, Human
gggagacuuugaug

SEQ ID NO: 2649969 - RNA, 18 nt, Human
gggagacgguuuccaggg

SEQ ID NO: 2649970 - RNA, 20 nt, Human
gggagacgguuuccagggag

SEQ ID NO: 2649971 - RNA, 21 nt, Human
gggagacgguuuccagggagg

SEQ ID NO: 2649972 - RNA, 22 nt, Human
gggagacgguuuccagggaggg

SEQ ID NO: 2649973 - RNA, 15 nt, Human
gggacugcuaaauaa

SEQ ID NO: 2649974 - RNA, 16 nt, Human
gggacugcuaaauaaa

SEQ ID NO: 2649975 - RNA, 23 nt, Human
aaaaaugucaaaaguagaacuuu

SEQ ID NO: 2649976 - RNA, 18 nt, Human
aaaaaugucaaaaguaga

SEQ ID NO: 2649977 - RNA, 23 nt, Human
gggaaauguuuuguaaacauuua

SEQ ID NO: 2649978 - RNA, 23 nt, Human
gggaaauauauacaaaaagaaaa

SEQ ID NO: 2649979 - RNA, 23 nt, Human
gggaaaucgagugccgcaucuca

SEQ ID NO: 2649980 - RNA, 13 nt, Human
gggaaaggggugc

SEQ ID NO: 2649981 - RNA, 12 nt, Human
aaaacauuugcu

SEQ ID NO: 2649982 - RNA, 13 nt, Human
aaaacauuugcug

SEQ ID NO: 2649983 - RNA, 15 nt, Human
aaaaccaauguucuc

SEQ ID NO: 2649984 - RNA, 13 nt, Human
aaaaccaaagagg

SEQ ID NO: 2649985 - RNA, 22 nt, Human
aaaaccaaagagggcuuccucu

SEQ ID NO: 2649986 - RNA, 15 nt, Human
aaaaccaaauguuua

SEQ ID NO: 2649987 - RNA, 18 nt, Human
aaaaccaaauguuuauuu

SEQ ID NO: 2649988 - RNA, 17 nt, Human
aaaacuacuucuuuuuu

SEQ ID NO: 2649989 - RNA, 12 nt, Human
gggcagcugcua

SEQ ID NO: 2649990 - RNA, 15 nt, Human
aaaagggaagaaacu

SEQ ID NO: 2649991 - RNA, 16 nt, Human
aaaagggaagaaacug

SEQ ID NO: 2649992 - RNA, 14 nt, Human
aaaaggcuugaagc

SEQ ID NO: 2649993 - RNA, 16 nt, Human
aaaaggcugugcugcc

SEQ ID NO: 2649994 - RNA, 19 nt, Human
aaaaggcugugcugcccug

SEQ ID NO: 2649995 - RNA, 20 nt, Human
aaaaggcuuauaaaacagag

SEQ ID NO: 2649996 - RNA, 19 nt, Human
aaaaggcuuauaaaacaga

SEQ ID NO: 2649997 - RNA, 17 nt, Human
aaaaggcuuauaaaaca

SEQ ID NO: 2649998 - RNA, 20 nt, Human
aaaaggcugugcugcccuga

SEQ ID NO: 2649999 - RNA, 15 nt, Human
gggcagcugucccuu

SEQ ID NO: 2650000 - RNA, 15 nt, Human
aaaaggcgcaucuaa

SEQ ID NO: 2650001 - RNA, 20 nt, Human
aaaaggcgcaucuaacgcgu

SEQ ID NO: 2650002 - RNA, 17 nt, Human
gggaggggccggcccug

SEQ ID NO: 2650003 - RNA, 16 nt, Human
gggaggggagacuuug

SEQ ID NO: 2650004 - RNA, 16 nt, Human
gggaggggaaaagcau

SEQ ID NO: 2650005 - RNA, 14 nt, Human
gggcaaacaggcag

SEQ ID NO: 2650006 - RNA, 19 nt, Human
gggauucugguuccagggu

SEQ ID NO: 2650007 - RNA, 11 nt, Human
gggcagagcug

SEQ ID NO: 2650008 - RNA, 16 nt, Human
gggcagagcuggcucu

SEQ ID NO: 2650009 - RNA, 17 nt, Human
gggcagagcuggcucug

SEQ ID NO: 2650010 - RNA, 19 nt, Human
gggcagagcuggcucugag

SEQ ID NO: 2650011 - RNA, 15 nt, Human
gggcaaacaggcagu

SEQ ID NO: 2650012 - RNA, 20 nt, Human
aaaauaaauaaaaacuaauu

SEQ ID NO: 2650013 - RNA, 13 nt, Human
aaaaguaauauuu

SEQ ID NO: 2650014 - RNA, 15 nt, Human
aaaaguaauauuuau

SEQ ID NO: 2650015 - RNA, 13 nt, Human
aaaaguagaacuu

SEQ ID NO: 2650016 - RNA, 15 nt, Human
aaaaguagaacuuug

SEQ ID NO: 2650017 - RNA, 16 nt, Human
aaaauacuauuuaaga

SEQ ID NO: 2650018 - RNA, 17 nt, Human
aaaauacuauuuaagau

SEQ ID NO: 2650019 - RNA, 18 nt, Human
aaaauacuauuuaagaug

SEQ ID NO: 2650020 - RNA, 21 nt, Human
aaaauacuauuuaagauguga

SEQ ID NO: 2650021 - RNA, 22 nt, Human
aaaauacuauuuaagaugugaa

SEQ ID NO: 2650022 - RNA, 23 nt, Human
aaaauacuauuuaagaugugaaa

SEQ ID NO: 2650023 - RNA, 23 nt, Human
aaaauagauauaaauuuuuaaga

SEQ ID NO: 2650024 - RNA, 18 nt, Human
aaaauagauuuuauaaga

SEQ ID NO: 2650025 - RNA, 21 nt, Human
aaaauagauuuuauaagauga

SEQ ID NO: 2650026 - RNA, 12 nt, Human
aaaauagccugc

SEQ ID NO: 2650027 - RNA, 16 nt, Human
aaaauauaaacaaaga

SEQ ID NO: 2650028 - RNA, 14 nt, Human
aaaauauaaaauua

SEQ ID NO: 2650029 - RNA, 15 nt, Human
aaaauauaaacaaag

SEQ ID NO: 2650030 - RNA, 13 nt, Human
aaaauaguuuauu

SEQ ID NO: 2650031 - RNA, 14 nt, Human
aaaauaguuuauuu

SEQ ID NO: 2650032 - RNA, 12 nt, Human
aaaauauaucuu

SEQ ID NO: 2650033 - RNA, 13 nt, Human
aaaauauauaucu

SEQ ID NO: 2650034 - RNA, 14 nt, Human
aaaauauauaucua

SEQ ID NO: 2650035 - RNA, 13 nt, Human
ggcugccccucuc

SEQ ID NO: 2650036 - RNA, 13 nt, Human
ggcuggcuccuga

SEQ ID NO: 2650037 - RNA, 15 nt, Human
ggcuggcuccugauc

SEQ ID NO: 2650038 - RNA, 11 nt, Human
ggcugggaaau

SEQ ID NO: 2650039 - RNA, 20 nt, Human
ggcucgaaucucugugccuu

SEQ ID NO: 2650040 - RNA, 18 nt, Human
ggcucgaaucucugugcc

SEQ ID NO: 2650041 - RNA, 19 nt, Human
ggcucgaaucucugugccu

SEQ ID NO: 2650042 - RNA, 13 nt, Human
ggcucgaaucucu

SEQ ID NO: 2650043 - RNA, 15 nt, Human
ggcucgaaucucugu

SEQ ID NO: 2650044 - RNA, 17 nt, Human
ggcucgaaucucugugc

SEQ ID NO: 2650045 - RNA, 14 nt, Human
ggcugaaauucucc

SEQ ID NO: 2650046 - RNA, 16 nt, Human
ggcugaaauucuccug

SEQ ID NO: 2650047 - RNA, 17 nt, Human
ggcugaaauucuccugg

SEQ ID NO: 2650048 - RNA, 18 nt, Human
ggcugaaauucuccugga

SEQ ID NO: 2650049 - RNA, 19 nt, Human
ggcugaaauucuccuggag

SEQ ID NO: 2650050 - RNA, 21 nt, Human
ggcugaaauucuccuggaggu

SEQ ID NO: 2650051 - RNA, 22 nt, Human
ggcugaaauucuccuggagguc

SEQ ID NO: 2650052 - RNA, 17 nt, Human
ggcugcaguucuacuca

SEQ ID NO: 2650053 - RNA, 9 nt, Human
ggcuccugc

SEQ ID NO: 2650054 - RNA, 11 nt, Human
ggcuccugauc

SEQ ID NO: 2650055 - RNA, 14 nt, Human
ggcuccggccucug

SEQ ID NO: 2650056 - RNA, 15 nt, Human
ggcuccggccucugc

SEQ ID NO: 2650057 - RNA, 17 nt, Human
ggcuccggccucugccu

SEQ ID NO: 2650058 - RNA, 12 nt, Human
aaaaaaaaguca

SEQ ID NO: 2650059 - RNA, 13 nt, Human
aaaaaaaagucag

SEQ ID NO: 2650060 - RNA, 12 nt, Human
aaaaaagagaca

SEQ ID NO: 2650061 - RNA, 12 nt, Human
aaaaaagucaga

SEQ ID NO: 2650062 - RNA, 13 nt, Human
aaaaaagucagag

SEQ ID NO: 2650063 - RNA, 13 nt, Human
aaaaaauacuauu

SEQ ID NO: 2650064 - RNA, 12 nt, Human
aaaaagccuucc

SEQ ID NO: 2650065 - RNA, 19 nt, Human
aaaaagcuagucaacagua

SEQ ID NO: 2650066 - RNA, 13 nt, Human
aaaaagcuucccc

SEQ ID NO: 2650067 - RNA, 20 nt, Human
aaaaaggcuuauaaaacaga

SEQ ID NO: 2650068 - RNA, 14 nt, Human
aaaaaguauaaaau

SEQ ID NO: 2650069 - RNA, 18 nt, Human
aaaaagucagagacagau

SEQ ID NO: 2650070 - RNA, 19 nt, Human
aaaaagucagagacagaua

SEQ ID NO: 2650071 - RNA, 23 nt, Human
gggaaaagcauuuuucaauauau

SEQ ID NO: 2650072 - RNA, 22 nt, Human
gggaaaacugccaauauagaaa

SEQ ID NO: 2650073 - RNA, 23 nt, Human
gggaaaaucagccugcuccagcu

SEQ ID NO: 2650074 - RNA, 14 nt, Human
gggaaacuuggcuc

SEQ ID NO: 2650075 - RNA, 13 nt, Human
gggaaagacacug

SEQ ID NO: 2650076 - RNA, 17 nt, Human
gggaaagacacugccug

SEQ ID NO: 2650077 - RNA, 18 nt, Human
gggaaagacacugccugg

SEQ ID NO: 2650078 - RNA, 22 nt, Human
gggaaagacacugccugggcug

SEQ ID NO: 2650079 - RNA, 13 nt, Human
gggaaaaucagcc

SEQ ID NO: 2650080 - RNA, 16 nt, Human
ggcuucuccgccagcc

SEQ ID NO: 2650081 - RNA, 17 nt, Human
ggcuucuccgccagccu

SEQ ID NO: 2650082 - RNA, 18 nt, Human
ggcuucuccgccagccuc

SEQ ID NO: 2650083 - RNA, 21 nt, Human
ggcuucuccgccagccuccuc

SEQ ID NO: 2650084 - RNA, 23 nt, Human
ggcuucuccgccagccuccucug

SEQ ID NO: 2650085 - RNA, 21 nt, Human
ggcuuccucuagaagccaagg

SEQ ID NO: 2650086 - RNA, 19 nt, Human
ggcuuccugcguccuccuc

SEQ ID NO: 2650087 - RNA, 20 nt, Human
ggcuuccugcguccuccuca

SEQ ID NO: 2650088 - RNA, 22 nt, Human
ggcugguggagaacucuggcuu

SEQ ID NO: 2650089 - RNA, 18 nt, Human
ggcugucaguaugacauu

SEQ ID NO: 2650090 - RNA, 23 nt, Human
ggcugucaaugggaccuguggcu

SEQ ID NO: 2650091 - RNA, 18 nt, Human
ggaccgcccuuuuccccu

SEQ ID NO: 2650092 - RNA, 17 nt, Human
ggaccuaaauggccuca

SEQ ID NO: 2650093 - RNA, 22 nt, Human
ggaccuaaauggccucaugugg

SEQ ID NO: 2650094 - RNA, 21 nt, Human
ggaccccagcaagugguccua

SEQ ID NO: 2650095 - RNA, 17 nt, Human
ggaccccagccauccag

SEQ ID NO: 2650096 - RNA, 23 nt, Human
ggacccgaccccccgugggcucc

SEQ ID NO: 2650097 - RNA, 15 nt, Human
ggagagcuagcagca

SEQ ID NO: 2650098 - RNA, 16 nt, Human
ggagagccugcuggca

SEQ ID NO: 2650099 - RNA, 13 nt, Human
ggagagccugcug

SEQ ID NO: 2650100 - RNA, 14 nt, Human
ggagagccugcugg

SEQ ID NO: 2650101 - RNA, 11 nt, Human
ggagagccugc

SEQ ID NO: 2650102 - RNA, 12 nt, Human
ggagagccugcu

SEQ ID NO: 2650103 - RNA, 21 nt, Human
ggagagccauacauaaaagaa

SEQ ID NO: 2650104 - RNA, 18 nt, Human
ggagagcaucggccuagg

SEQ ID NO: 2650105 - RNA, 20 nt, Human
ggagagcaucggccuagggc

SEQ ID NO: 2650106 - RNA, 19 nt, Human
ggagagagagagagagagg

SEQ ID NO: 2650107 - RNA, 22 nt, Human
ggagacuuagggcaccaggggu

SEQ ID NO: 2650108 - RNA, 16 nt, Human
ggagacuugccagagc

SEQ ID NO: 2650109 - RNA, 20 nt, Human
ggacuuccccggagggcugc

SEQ ID NO: 2650110 - RNA, 19 nt, Human
ggacuuccccggagggcug

SEQ ID NO: 2650111 - RNA, 20 nt, Human
ggagaaccaaaucuggaagc

SEQ ID NO: 2650112 - RNA, 23 nt, Human
ggagaacaugaaucaaaagugcc

SEQ ID NO: 2650113 - RNA, 19 nt, Human
ggacuucaaagcaagcugg

SEQ ID NO: 2650114 - RNA, 17 nt, Human
ggacuucuaccugcccu

SEQ ID NO: 2650115 - RNA, 23 nt, Human
ggacuucuaccugcccucaaggg

SEQ ID NO: 2650116 - RNA, 13 nt, Human
ggacuuuucugca

SEQ ID NO: 2650117 - RNA, 12 nt, Human
ggacuuuguaca

SEQ ID NO: 2650118 - RNA, 20 nt, Human
ggagcacugggcucccgggc

SEQ ID NO: 2650119 - RNA, 22 nt, Human
ggagccaugcgcccccuccgcc

SEQ ID NO: 2650120 - RNA, 23 nt, Human
ggagccaugcgcccccuccgccc

SEQ ID NO: 2650121 - RNA, 14 nt, Human
ggaggucgaggcag

SEQ ID NO: 2650122 - RNA, 16 nt, Human
ggaggucgaggcagga

SEQ ID NO: 2650123 - RNA, 15 nt, Human
ggaggucgaggcagg

SEQ ID NO: 2650124 - RNA, 18 nt, Human
ggagguguggagccgagg

SEQ ID NO: 2650125 - RNA, 18 nt, Human
ggaggucgaggcaggagg

SEQ ID NO: 2650126 - RNA, 14 nt, Human
ggagguugaagcca

SEQ ID NO: 2650127 - RNA, 16 nt, Human
ggagguugaagccaag

SEQ ID NO: 2650128 - RNA, 14 nt, Human
ggagguugcaguga

SEQ ID NO: 2650129 - RNA, 16 nt, Human
ggagcaggcacgggug

SEQ ID NO: 2650130 - RNA, 21 nt, Human
ggagcugccuuggcucagaca

SEQ ID NO: 2650131 - RNA, 18 nt, Human
ggagcugccuuggcucag

SEQ ID NO: 2650132 - RNA, 16 nt, Human
ggagcugaguggggga

SEQ ID NO: 2650133 - RNA, 17 nt, Human
ggagcugccuuggcuca

SEQ ID NO: 2650134 - RNA, 20 nt, Human
ggagcuccacucugcuucuc

SEQ ID NO: 2650135 - RNA, 17 nt, Human
ggagcuccacucugcuu

SEQ ID NO: 2650136 - RNA, 18 nt, Human
ggaggccaaggugggagg

SEQ ID NO: 2650137 - RNA, 21 nt, Human
ggaggaagaacugaaaggcuu

SEQ ID NO: 2650138 - RNA, 18 nt, Human
ggaggaacacugcacucu

SEQ ID NO: 2650139 - RNA, 19 nt, Human
ggaggaaccagagugcuga

SEQ ID NO: 2650140 - RNA, 12 nt, Human
ggaggaagagaa

SEQ ID NO: 2650141 - RNA, 23 nt, Human
ggcccauggcuguuggugggacc

SEQ ID NO: 2650142 - RNA, 19 nt, Human
ggcccgccucuccucgguu

SEQ ID NO: 2650143 - RNA, 14 nt, Human
ggcccgcgccacag

SEQ ID NO: 2650144 - RNA, 16 nt, Human
ggcccccaaccucagg

SEQ ID NO: 2650145 - RNA, 20 nt, Human
ggcccccaaccucagggcuc

SEQ ID NO: 2650146 - RNA, 18 nt, Human
ggcccgcgccacaggacc

SEQ ID NO: 2650147 - RNA, 17 nt, Human
ggcccgcgccacaggac

SEQ ID NO: 2650148 - RNA, 20 nt, Human
ggcccagggcaagcuccgca

SEQ ID NO: 2650149 - RNA, 22 nt, Human
ggcccagggcaagcuccgcagg

SEQ ID NO: 2650150 - RNA, 19 nt, Human
ggcccagggcaagcuccgc

SEQ ID NO: 2650151 - RNA, 17 nt, Human
ggcccagggcaagcucc

SEQ ID NO: 2650152 - RNA, 22 nt, Human
ggccuccccugccaccaggcca

SEQ ID NO: 2650153 - RNA, 15 nt, Human
ggccuccccugccac

SEQ ID NO: 2650154 - RNA, 17 nt, Human
ggccuccccugccacca

SEQ ID NO: 2650155 - RNA, 19 nt, Human
ggccuccccugccaccagg

SEQ ID NO: 2650156 - RNA, 13 nt, Human
ggcccgacauggc

SEQ ID NO: 2650157 - RNA, 13 nt, Human
ggccaagguggga

SEQ ID NO: 2650158 - RNA, 23 nt, Human
ggccaaagugccggugagaccca

SEQ ID NO: 2650159 - RNA, 11 nt, Human
ggcauugagua

SEQ ID NO: 2650160 - RNA, 19 nt, Human
ggcauugaguauuguuuaa

SEQ ID NO: 2650161 - RNA, 20 nt, Human
ggccaguccacccugccugc

SEQ ID NO: 2650162 - RNA, 16 nt, Human
ggccagccuccgagag

SEQ ID NO: 2650163 - RNA, 19 nt, Human
ggccagccuccgagaggga

SEQ ID NO: 2650164 - RNA, 20 nt, Human
ggccagccuccgagagggag

SEQ ID NO: 2650165 - RNA, 14 nt, Human
ggccaguccaggcu

SEQ ID NO: 2650166 - RNA, 15 nt, Human
ggccaguccaggcug

SEQ ID NO: 2650167 - RNA, 16 nt, Human
ggccaguccaggcugc

SEQ ID NO: 2650168 - RNA, 13 nt, Human
ggcaggcugggcc

SEQ ID NO: 2650169 - RNA, 20 nt, Human
ggcaggcuggccaguccagg

SEQ ID NO: 2650170 - RNA, 12 nt, Human
ggcaggcugggc

SEQ ID NO: 2650171 - RNA, 11 nt, Human
ggcaggcuggc

SEQ ID NO: 2650172 - RNA, 12 nt, Human
ggcaggcuggcc

SEQ ID NO: 2650173 - RNA, 13 nt, Human
ggcaggcuggcca

SEQ ID NO: 2650174 - RNA, 17 nt, Human
ggcaggcuggccagucc

SEQ ID NO: 2650175 - RNA, 15 nt, Human
ggcaggcauggcccu

SEQ ID NO: 2650176 - RNA, 16 nt, Human
ggcaggcauggcccug

SEQ ID NO: 2650177 - RNA, 17 nt, Human
ggcaggcauggcccugg

SEQ ID NO: 2650178 - RNA, 18 nt, Human
ggcaggcauggcccuggg

SEQ ID NO: 2650179 - RNA, 20 nt, Human
ggcaggcauggcccugggcg

SEQ ID NO: 2650180 - RNA, 10 nt, Human
ggcaggcugg

SEQ ID NO: 2650181 - RNA, 15 nt, Human
ggcaggcucacugcc

SEQ ID NO: 2650182 - RNA, 16 nt, Human
ggcaggcucacugcca

SEQ ID NO: 2650183 - RNA, 19 nt, Human
ggcaggcucacugccaggc

SEQ ID NO: 2650184 - RNA, 22 nt, Human
ggcaggcucacugccaggccag

SEQ ID NO: 2650185 - RNA, 13 nt, Human
ggcaggcucacug

SEQ ID NO: 2650186 - RNA, 19 nt, Human
ggcaaccacuaagaauuca

SEQ ID NO: 2650187 - RNA, 16 nt, Human
ggcaaccacuaagaau

SEQ ID NO: 2650188 - RNA, 18 nt, Human
ggauguuacucucuugca

SEQ ID NO: 2650189 - RNA, 15 nt, Human
ggauuuguugccaug

SEQ ID NO: 2650190 - RNA, 13 nt, Human
ggcaaacaggcag

SEQ ID NO: 2650191 - RNA, 23 nt, Human
ggcaaacaggcaguuggccagag

SEQ ID NO: 2650192 - RNA, 16 nt, Human
ggcaaaggaaggugga

SEQ ID NO: 2650193 - RNA, 17 nt, Human
ggcaaaggaagguggau

SEQ ID NO: 2650194 - RNA, 19 nt, Human
ggcaaaggaagguggaugg

SEQ ID NO: 2650195 - RNA, 18 nt, Human
gacagaacuugaaugugu

SEQ ID NO: 2650196 - RNA, 23 nt, Human
gacauugaccuauuuccagaaau

SEQ ID NO: 2650197 - RNA, 21 nt, Human
gacauugucuccuauauauuu

SEQ ID NO: 2650198 - RNA, 16 nt, Human
gaccaggcuuggccuu

SEQ ID NO: 2650199 - RNA, 23 nt, Human
gaccagcugcuccgaggacccag

SEQ ID NO: 2650200 - RNA, 13 nt, Human
gaccagcugcucc

SEQ ID NO: 2650201 - RNA, 15 nt, Human
gaccagcugcuccga

SEQ ID NO: 2650202 - RNA, 19 nt, Human
gaccagcugcuccgaggac

SEQ ID NO: 2650203 - RNA, 20 nt, Human
gaccagcugcuccgaggacc

SEQ ID NO: 2650204 - RNA, 21 nt, Human
gaccagcugcuccgaggaccc

SEQ ID NO: 2650205 - RNA, 11 nt, Human
gaccagggccu

SEQ ID NO: 2650206 - RNA, 14 nt, Human
gaccagggccuuuu

SEQ ID NO: 2650207 - RNA, 19 nt, Human
gaccagggccuuuucuggc

SEQ ID NO: 2650208 - RNA, 22 nt, Human
gaccagggagccuuugguucug

SEQ ID NO: 2650209 - RNA, 15 nt, Human
gaccagggagccuuu

SEQ ID NO: 2650210 - RNA, 14 nt, Human
gaccagggagccuu

SEQ ID NO: 2650211 - RNA, 13 nt, Human
gaccauccuggcu

SEQ ID NO: 2650212 - RNA, 14 nt, Human
gaccauccuggcua

SEQ ID NO: 2650213 - RNA, 12 nt, Human
gaccauccuggc

SEQ ID NO: 2650214 - RNA, 15 nt, Human
gacuuuauuauuuau

SEQ ID NO: 2650215 - RNA, 14 nt, Human
gacuuuauuauuua

SEQ ID NO: 2650216 - RNA, 13 nt, Human
gacuuuauuauuu

SEQ ID NO: 2650217 - RNA, 14 nt, Human
gacucuugggaggg

SEQ ID NO: 2650218 - RNA, 19 nt, Human
gacugaaaauauuguuuua

SEQ ID NO: 2650219 - RNA, 15 nt, Human
gacugaaaguagggg

SEQ ID NO: 2650220 - RNA, 19 nt, Human
gacugaaauuacggguacc

SEQ ID NO: 2650221 - RNA, 16 nt, Human
gacucuugaguuguuu

SEQ ID NO: 2650222 - RNA, 18 nt, Human
gacuuguuuuugcacaug

SEQ ID NO: 2650223 - RNA, 16 nt, Human
gacuuguuuuugcaca

SEQ ID NO: 2650224 - RNA, 17 nt, Human
gacuguggcacuugccu

SEQ ID NO: 2650225 - RNA, 21 nt, Human
gacuguggcacuugccugggu

SEQ ID NO: 2650226 - RNA, 20 nt, Human
gacuguagauauguauucuu

SEQ ID NO: 2650227 - RNA, 13 nt, Human
gacuguagggagg

SEQ ID NO: 2650228 - RNA, 22 nt, Human
gacuguagggagggcggcaggg

SEQ ID NO: 2650229 - RNA, 23 nt, Human
gacuguagggagggcggcagggg

SEQ ID NO: 2650230 - RNA, 15 nt, Human
gaagcagaggaagga

SEQ ID NO: 2650231 - RNA, 23 nt, Human
gaagcacaccaaucuuacuuugu

SEQ ID NO: 2650232 - RNA, 23 nt, Human
gaagacaaugugaaaagaaaaau

SEQ ID NO: 2650233 - RNA, 20 nt, Human
gaagcaaguaaaaaggcuaa

SEQ ID NO: 2650234 - RNA, 22 nt, Human
gaagcacaccaaucuuacuuug

SEQ ID NO: 2650235 - RNA, 13 nt, Human
gaacccuuuauuu

SEQ ID NO: 2650236 - RNA, 17 nt, Human
gaacucgcgcucaguaa

SEQ ID NO: 2650237 - RNA, 18 nt, Human
gaacucgcgcucaguaaa

SEQ ID NO: 2650238 - RNA, 19 nt, Human
gaacucgcgcucaguaaac

SEQ ID NO: 2650239 - RNA, 18 nt, Human
gaacccuuuuaaaguuga

SEQ ID NO: 2650240 - RNA, 21 nt, Human
gaaccgcacagcucaggaggc

SEQ ID NO: 2650241 - RNA, 16 nt, Human
gaaccgcacagcucag

SEQ ID NO: 2650242 - RNA, 17 nt, Human
gaaccgcacagcucagg

SEQ ID NO: 2650243 - RNA, 13 nt, Human
gaaccgcacagcu

SEQ ID NO: 2650244 - RNA, 14 nt, Human
gaaccgcacagcuc

SEQ ID NO: 2650245 - RNA, 15 nt, Human
gaaccgcacagcuca

SEQ ID NO: 2650246 - RNA, 12 nt, Human
gaagaaugaaag

SEQ ID NO: 2650247 - RNA, 16 nt, Human
gaagaaugaaagcugu

SEQ ID NO: 2650248 - RNA, 12 nt, Human
gaagaauuuaaa

SEQ ID NO: 2650249 - RNA, 13 nt, Human
gaagaauuuaaag

SEQ ID NO: 2650250 - RNA, 17 nt, Human
gaagaauugaaaaguuu

SEQ ID NO: 2650251 - RNA, 18 nt, Human
gaagaauugaaaaguuuu

SEQ ID NO: 2650252 - RNA, 21 nt, Human
gaagaauugaaaaguuuuugu

SEQ ID NO: 2650253 - RNA, 22 nt, Human
gaagaauugaaaaguuuuuguu

SEQ ID NO: 2650254 - RNA, 19 nt, Human
gaagaauguuagaguaaug

SEQ ID NO: 2650255 - RNA, 19 nt, Human
gaauauguaguaucuauau

SEQ ID NO: 2650256 - RNA, 23 nt, Human
gaauauguaguaucuauaugacu

SEQ ID NO: 2650257 - RNA, 16 nt, Human
gaaguguuuauguugu

SEQ ID NO: 2650258 - RNA, 21 nt, Human
gaaguuauuuucuacaguggu

SEQ ID NO: 2650259 - RNA, 15 nt, Human
gaaguucaagaucaa

SEQ ID NO: 2650260 - RNA, 16 nt, Human
gaaguuaguuuguaua

SEQ ID NO: 2650261 - RNA, 17 nt, Human
gaaguuaguuuguauau

SEQ ID NO: 2650262 - RNA, 15 nt, Human
gaaguuaguuuguau

SEQ ID NO: 2650263 - RNA, 12 nt, Human
gaaggcuguacg

SEQ ID NO: 2650264 - RNA, 15 nt, Human
gaagcugcaggcuuu

SEQ ID NO: 2650265 - RNA, 13 nt, Human
gaagcugcaucca

SEQ ID NO: 2650266 - RNA, 12 nt, Human
gaucugcugcag

SEQ ID NO: 2650267 - RNA, 17 nt, Human
gaucugcggaucucagc

SEQ ID NO: 2650268 - RNA, 18 nt, Human
gaucugcggaucucagcu

SEQ ID NO: 2650269 - RNA, 19 nt, Human
gaucugcggaucucagcuu

SEQ ID NO: 2650270 - RNA, 21 nt, Human
gaucugcggaucucagcuuug

SEQ ID NO: 2650271 - RNA, 16 nt, Human
gaugagguauuuuuuc

SEQ ID NO: 2650272 - RNA, 18 nt, Human
gaugauaaauaugguuaa

SEQ ID NO: 2650273 - RNA, 18 nt, Human
gaugguucuucaccuccu

SEQ ID NO: 2650274 - RNA, 14 nt, Human
gaugguuucuugca

SEQ ID NO: 2650275 - RNA, 16 nt, Human
gaugguuuuaaacuuu

SEQ ID NO: 2650276 - RNA, 17 nt, Human
gaugguuuuaaacuuuc

SEQ ID NO: 2650277 - RNA, 20 nt, Human
gauggaauuuuuuuguacga

SEQ ID NO: 2650278 - RNA, 14 nt, Human
gauggacacuccag

SEQ ID NO: 2650279 - RNA, 15 nt, Human
gauggacacuccagg

SEQ ID NO: 2650280 - RNA, 23 nt, Human
gaugcugccagggcgccaucgcc

SEQ ID NO: 2650281 - RNA, 16 nt, Human
gauucuggcuuuaagc

SEQ ID NO: 2650282 - RNA, 20 nt, Human
gauucuggcuuuaagccuuc

SEQ ID NO: 2650283 - RNA, 17 nt, Human
gauucugguuccagggu

SEQ ID NO: 2650284 - RNA, 12 nt, Human
gauuuauuaacu

SEQ ID NO: 2650285 - RNA, 18 nt, Human
gauuuuuuaauuguuuaa

SEQ ID NO: 2650286 - RNA, 15 nt, Human
gaugucaauuucugu

SEQ ID NO: 2650287 - RNA, 18 nt, Human
gaugucaauuucuguguu

SEQ ID NO: 2650288 - RNA, 12 nt, Human
gcaagugcugga

SEQ ID NO: 2650289 - RNA, 15 nt, Human
gcaagugcuggaguc

SEQ ID NO: 2650290 - RNA, 21 nt, Human
gcaagugcuggagucuccuga

SEQ ID NO: 2650291 - RNA, 19 nt, Human
gcaagugugaauacugcuu

SEQ ID NO: 2650292 - RNA, 16 nt, Human
gcaagugugaauacug

SEQ ID NO: 2650293 - RNA, 13 nt, Human
gcaagugugaaua

SEQ ID NO: 2650294 - RNA, 23 nt, Human
gcacauauggaauuuugcaaaga

SEQ ID NO: 2650295 - RNA, 16 nt, Human
gcacagugucccccag

SEQ ID NO: 2650296 - RNA, 22 nt, Human
gcacaagcugcacccucaggca

SEQ ID NO: 2650297 - RNA, 21 nt, Human
gcacaccaaucuuacuuugua

SEQ ID NO: 2650298 - RNA, 20 nt, Human
gcacaccaaucuuacuuugu

SEQ ID NO: 2650299 - RNA, 22 nt, Human
gcacaccaaucuuacuuuguaa

SEQ ID NO: 2650300 - RNA, 17 nt, Human
gcacaccaaucuuacuu

SEQ ID NO: 2650301 - RNA, 16 nt, Human
gcacaccaaucuuacu

SEQ ID NO: 2650302 - RNA, 19 nt, Human
gcacuccucgguacuccca

SEQ ID NO: 2650303 - RNA, 20 nt, Human
gcacuccucgguacucccau

SEQ ID NO: 2650304 - RNA, 18 nt, Human
gcacuugccugggucaca

SEQ ID NO: 2650305 - RNA, 13 nt, Human
gcacuugccuggg

SEQ ID NO: 2650306 - RNA, 14 nt, Human
gcacuugccugggu

SEQ ID NO: 2650307 - RNA, 15 nt, Human
gcacuugccuggguc

SEQ ID NO: 2650308 - RNA, 15 nt, Human
gcaccucagccugca

SEQ ID NO: 2650309 - RNA, 16 nt, Human
gcaccucagccugcac

SEQ ID NO: 2650310 - RNA, 13 nt, Human
gcaccucagccug

SEQ ID NO: 2650311 - RNA, 19 nt, Human
gcacauccgcgugugccug

SEQ ID NO: 2650312 - RNA, 20 nt, Human
gcacauccgcgugugccugu

SEQ ID NO: 2650313 - RNA, 23 nt, Human
gcacauccgcgugugccugugug

SEQ ID NO: 2650314 - RNA, 17 nt, Human
gaggggccggcccugug

SEQ ID NO: 2650315 - RNA, 21 nt, Human
gaggggccggcccugugugca

SEQ ID NO: 2650316 - RNA, 22 nt, Human
gaggggccggcccugugugcag

SEQ ID NO: 2650317 - RNA, 12 nt, Human
gagggcugcagu

SEQ ID NO: 2650318 - RNA, 15 nt, Human
gaggcaggugagaga

SEQ ID NO: 2650319 - RNA, 15 nt, Human
gaggcaguuugagga

SEQ ID NO: 2650320 - RNA, 22 nt, Human
gaggccaaggugggaggauugc

SEQ ID NO: 2650321 - RNA, 17 nt, Human
gaggccaaggugggagg

SEQ ID NO: 2650322 - RNA, 15 nt, Human
gaggcugaggcagga

SEQ ID NO: 2650323 - RNA, 20 nt, Human
gaggcauccuacccuuuucu

SEQ ID NO: 2650324 - RNA, 16 nt, Human
gaggcaguuugaggau

SEQ ID NO: 2650325 - RNA, 19 nt, Human
gaggcauccuacccuuuuc

SEQ ID NO: 2650326 - RNA, 22 nt, Human
gagcugccuuggcucagacaug

SEQ ID NO: 2650327 - RNA, 21 nt, Human
gagcugccuuggcucagacau

SEQ ID NO: 2650328 - RNA, 19 nt, Human
gagcgcaguguuuugcaag

SEQ ID NO: 2650329 - RNA, 13 nt, Human
gagccuucucaga

SEQ ID NO: 2650330 - RNA, 17 nt, Human
gagccuucucagaagca

SEQ ID NO: 2650331 - RNA, 18 nt, Human
gagccuucucagaagcac

SEQ ID NO: 2650332 - RNA, 18 nt, Human
gagcugccuuggcucaga

SEQ ID NO: 2650333 - RNA, 15 nt, Human
gagcugccuuggcuc

SEQ ID NO: 2650334 - RNA, 19 nt, Human
gagcgccuccauccaaggc

SEQ ID NO: 2650335 - RNA, 23 nt, Human
gagcgccuccauccaaggccagg

SEQ ID NO: 2650336 - RNA, 18 nt, Human
gaguuguuuuuguauauu

SEQ ID NO: 2650337 - RNA, 16 nt, Human
gaguuguuuuuguaua

SEQ ID NO: 2650338 - RNA, 14 nt, Human
gaguuguuuuugua

SEQ ID NO: 2650339 - RNA, 13 nt, Human
gaguuguuuuugu

SEQ ID NO: 2650340 - RNA, 18 nt, Human
gaguugauucagcucugc

SEQ ID NO: 2650341 - RNA, 15 nt, Human
gaggucgaggcagga

SEQ ID NO: 2650342 - RNA, 21 nt, Human
gaggucgguagguucagccaa

SEQ ID NO: 2650343 - RNA, 22 nt, Human
gaggucgguagguucagccaag

SEQ ID NO: 2650344 - RNA, 23 nt, Human
gaggucgguagguucagccaagg

SEQ ID NO: 2650345 - RNA, 13 nt, Human
gaggucuaaucua

SEQ ID NO: 2650346 - RNA, 19 nt, Human
gagugauagucuuuugcuu

SEQ ID NO: 2650347 - RNA, 20 nt, Human
gaguccauucucccagguac

SEQ ID NO: 2650348 - RNA, 14 nt, Human
gaguggcaggggac

SEQ ID NO: 2650349 - RNA, 16 nt, Human
gaguggcaggggacag

SEQ ID NO: 2650350 - RNA, 19 nt, Human
gaguggcaggggacaggag

SEQ ID NO: 2650351 - RNA, 17 nt, Human
gaguugauucagcucug

SEQ ID NO: 2650352 - RNA, 16 nt, Human
gaguugauucagcucu

SEQ ID NO: 2650353 - RNA, 15 nt, Human
gaguugauucagcuc

SEQ ID NO: 2650354 - RNA, 19 nt, Human
gagguggaagaagggagaa

SEQ ID NO: 2650355 - RNA, 17 nt, Human
gagguggaagaagggag

SEQ ID NO: 2650356 - RNA, 18 nt, Human
gagguggaagaagggaga

SEQ ID NO: 2650357 - RNA, 13 nt, Human
gagguggaagaag

SEQ ID NO: 2650358 - RNA, 15 nt, Human
gagguggaagaaggg

SEQ ID NO: 2650359 - RNA, 16 nt, Human
gagguggaagaaggga

SEQ ID NO: 2650360 - RNA, 13 nt, Human
gaggugauuccag

SEQ ID NO: 2650361 - RNA, 21 nt, Human
gaggugauuccagugaagaua

SEQ ID NO: 2650362 - RNA, 17 nt, Human
gaguccauucucccagg

SEQ ID NO: 2650363 - RNA, 18 nt, Human
gaguccauucucccaggu

SEQ ID NO: 2650364 - RNA, 15 nt, Human
gaguccauucuccca

SEQ ID NO: 2650365 - RNA, 16 nt, Human
gaguccauucucccag

SEQ ID NO: 2650366 - RNA, 13 nt, Human
cugcauuggcuuu

SEQ ID NO: 2650367 - RNA, 15 nt, Human
cugcauuuaaaaaaa

SEQ ID NO: 2650368 - RNA, 21 nt, Human
cugccccaucuccccucagcu

SEQ ID NO: 2650369 - RNA, 18 nt, Human
cugccaggugagaaacug

SEQ ID NO: 2650370 - RNA, 19 nt, Human
cugccccggagcuggagga

SEQ ID NO: 2650371 - RNA, 23 nt, Human
cugccccgcccccaguccccacc

SEQ ID NO: 2650372 - RNA, 14 nt, Human
cugccccgccccca

SEQ ID NO: 2650373 - RNA, 16 nt, Human
cugccccgcccccagu

SEQ ID NO: 2650374 - RNA, 17 nt, Human
cugccccgcccccaguc

SEQ ID NO: 2650375 - RNA, 18 nt, Human
cugccccgcccccagucc

SEQ ID NO: 2650376 - RNA, 22 nt, Human
cugccccaucuccccucagcuc

SEQ ID NO: 2650377 - RNA, 16 nt, Human
cugcccccagccccgg

SEQ ID NO: 2650378 - RNA, 15 nt, Human
cugcccccaccccgg

SEQ ID NO: 2650379 - RNA, 19 nt, Human
cugcaaaucugauggccuu

SEQ ID NO: 2650380 - RNA, 20 nt, Human
cugcaaaucugauggccuua

SEQ ID NO: 2650381 - RNA, 18 nt, Human
cugcaagaauugaagcag

SEQ ID NO: 2650382 - RNA, 20 nt, Human
cugcaagaauugaagcagga

SEQ ID NO: 2650383 - RNA, 17 nt, Human
cugaugagauuuuuaaa

SEQ ID NO: 2650384 - RNA, 17 nt, Human
cugaugacaauaaagcu

SEQ ID NO: 2650385 - RNA, 18 nt, Human
cugaugacaauaaagcuu

SEQ ID NO: 2650386 - RNA, 20 nt, Human
cugaugacaauaaagcuugu

SEQ ID NO: 2650387 - RNA, 18 nt, Human
cugauggaauuuuuuugu

SEQ ID NO: 2650388 - RNA, 22 nt, Human
cugaugggaaaacugccaauau

SEQ ID NO: 2650389 - RNA, 14 nt, Human
cugauggccuuaau

SEQ ID NO: 2650390 - RNA, 19 nt, Human
cugauggccuuaauuuccu

SEQ ID NO: 2650391 - RNA, 20 nt, Human
cugauggccuuaauuuccuu

SEQ ID NO: 2650392 - RNA, 21 nt, Human
cugauggccuuaauuuccuuu

SEQ ID NO: 2650393 - RNA, 12 nt, Human
cugcacgucaug

SEQ ID NO: 2650394 - RNA, 15 nt, Human
cugcacuccagccug

SEQ ID NO: 2650395 - RNA, 13 nt, Human
cugcacuccagcc

SEQ ID NO: 2650396 - RNA, 17 nt, Human
cugcacuccagccuggg

SEQ ID NO: 2650397 - RNA, 16 nt, Human
cugcacuccagccugg

SEQ ID NO: 2650398 - RNA, 14 nt, Human
cugcacuccagccu

SEQ ID NO: 2650399 - RNA, 18 nt, Human
cugcacuccagccugggu

SEQ ID NO: 2650400 - RNA, 20 nt, Human
cugcacuccagccuggggga

SEQ ID NO: 2650401 - RNA, 19 nt, Human
cugcacuccagccugggug

SEQ ID NO: 2650402 - RNA, 13 nt, Human
cugcaggcccugg

SEQ ID NO: 2650403 - RNA, 14 nt, Human
cugcaggcccuggc

SEQ ID NO: 2650404 - RNA, 15 nt, Human
cugcaggcccuggcc

SEQ ID NO: 2650405 - RNA, 16 nt, Human
cugcaggcccuggccu

SEQ ID NO: 2650406 - RNA, 17 nt, Human
cugcaggcccuggccuc

SEQ ID NO: 2650407 - RNA, 18 nt, Human
cugcaggcccuggccucc

SEQ ID NO: 2650408 - RNA, 18 nt, Human
cugcaggaaauagucacu

SEQ ID NO: 2650409 - RNA, 23 nt, Human
cugcaggacuugagaagaccuca

SEQ ID NO: 2650410 - RNA, 19 nt, Human
cugcaggacuugagaagac

SEQ ID NO: 2650411 - RNA, 12 nt, Human
cugcagcuuugu

SEQ ID NO: 2650412 - RNA, 19 nt, Human
cugcugugaagcuggaacu

SEQ ID NO: 2650413 - RNA, 16 nt, Human
cugcugugauuccacu

SEQ ID NO: 2650414 - RNA, 22 nt, Human
cugcugugauuccacuacaccu

SEQ ID NO: 2650415 - RNA, 11 nt, Human
cugcugugcaa

SEQ ID NO: 2650416 - RNA, 14 nt, Human
cugcugugcaacgg

SEQ ID NO: 2650417 - RNA, 22 nt, Human
cugcuuaaucuucaaagccuuc

SEQ ID NO: 2650418 - RNA, 23 nt, Human
cugcuuaaucuucaaagccuucu

SEQ ID NO: 2650419 - RNA, 15 nt, Human
cugcucaccgcccau

SEQ ID NO: 2650420 - RNA, 19 nt, Human
cugcucaccgcccaucagg

SEQ ID NO: 2650421 - RNA, 20 nt, Human
cugcucaccgcccaucaggg

SEQ ID NO: 2650422 - RNA, 23 nt, Human
cugcucaccgcccaucaggguuc

SEQ ID NO: 2650423 - RNA, 22 nt, Human
cugcugagucuguucugguaau

SEQ ID NO: 2650424 - RNA, 17 nt, Human
cugcugagucuguucug

SEQ ID NO: 2650425 - RNA, 15 nt, Human
cuggacuucuaccug

SEQ ID NO: 2650426 - RNA, 18 nt, Human
cuggacuucuaccugccc

SEQ ID NO: 2650427 - RNA, 19 nt, Human
cuggacuucuaccugcccu

SEQ ID NO: 2650428 - RNA, 20 nt, Human
cuggacuucuaccugcccuc

SEQ ID NO: 2650429 - RNA, 23 nt, Human
cuggacuucuaccugcccucaag

SEQ ID NO: 2650430 - RNA, 16 nt, Human
cuggaugauggauucc

SEQ ID NO: 2650431 - RNA, 21 nt, Human
cuggguggcaccagcagccug

SEQ ID NO: 2650432 - RNA, 20 nt, Human
cuggguguccccgcugcugu

SEQ ID NO: 2650433 - RNA, 21 nt, Human
cuggguguccccgcugcugug

SEQ ID NO: 2650434 - RNA, 16 nt, Human
cugggcagcugucccu

SEQ ID NO: 2650435 - RNA, 17 nt, Human
cugggcagcugucccuu

SEQ ID NO: 2650436 - RNA, 19 nt, Human
cugggcagcugucccuugc

SEQ ID NO: 2650437 - RNA, 20 nt, Human
cugggcagguuggugggggc

SEQ ID NO: 2650438 - RNA, 17 nt, Human
cugggccauguccaaag

SEQ ID NO: 2650439 - RNA, 18 nt, Human
cugggccauguccaaaga

SEQ ID NO: 2650440 - RNA, 19 nt, Human
cugggccauguccaaagag

SEQ ID NO: 2650441 - RNA, 22 nt, Human
cugggccauguccaaagaggcu

SEQ ID NO: 2650442 - RNA, 23 nt, Human
cugggccauguccaaagaggcug

SEQ ID NO: 2650443 - RNA, 20 nt, Human
cuggguggcaccagcagccu

SEQ ID NO: 2650444 - RNA, 18 nt, Human
cuggguggcaccagcagc

SEQ ID NO: 2650445 - RNA, 19 nt, Human
cuggggacgcuccgcugcc

SEQ ID NO: 2650446 - RNA, 21 nt, Human
cuggggacgcuccgcugccgu

SEQ ID NO: 2650447 - RNA, 13 nt, Human
cuggcuccugauc

SEQ ID NO: 2650448 - RNA, 13 nt, Human
cuuaugugacauu

SEQ ID NO: 2650449 - RNA, 23 nt, Human
cuuaugugacauuaacaaauaaa

SEQ ID NO: 2650450 - RNA, 15 nt, Human
cuucaucccauucca

SEQ ID NO: 2650451 - RNA, 16 nt, Human
cuucaucccauuccag

SEQ ID NO: 2650452 - RNA, 17 nt, Human
cuucaucccauuccagg

SEQ ID NO: 2650453 - RNA, 23 nt, Human
cuucaucccauuccaggcagccu

SEQ ID NO: 2650454 - RNA, 19 nt, Human
cuucagacagagaggacug

SEQ ID NO: 2650455 - RNA, 20 nt, Human
cuucagacagagaggacugu

SEQ ID NO: 2650456 - RNA, 14 nt, Human
cuucaccuccugcc

SEQ ID NO: 2650457 - RNA, 13 nt, Human
cuguguacuguuc

SEQ ID NO: 2650458 - RNA, 20 nt, Human
cugugucagcauagaaguaa

SEQ ID NO: 2650459 - RNA, 11 nt, Human
cuguguacugu

SEQ ID NO: 2650460 - RNA, 23 nt, Human
cugugagaacccaguuucccguc

SEQ ID NO: 2650461 - RNA, 17 nt, Human
cugugagaagguuuauu

SEQ ID NO: 2650462 - RNA, 19 nt, Human
cugugagaagguuuauugu

SEQ ID NO: 2650463 - RNA, 20 nt, Human
cugugagaagguuuauuguu

SEQ ID NO: 2650464 - RNA, 22 nt, Human
cugugagaagguuuauuguuaa

SEQ ID NO: 2650465 - RNA, 16 nt, Human
cugugcuaugaauuuu

SEQ ID NO: 2650466 - RNA, 15 nt, Human
cugugcuaugaauuu

SEQ ID NO: 2650467 - RNA, 13 nt, Human
cugugcucagaag

SEQ ID NO: 2650468 - RNA, 17 nt, Human
cugugcucagaagggcu

SEQ ID NO: 2650469 - RNA, 13 nt, Human
cugugcuaugaau

SEQ ID NO: 2650470 - RNA, 21 nt, Human
cugugcgucuugguguaauuu

SEQ ID NO: 2650471 - RNA, 22 nt, Human
cugugcgucuugguguaauuug

SEQ ID NO: 2650472 - RNA, 23 nt, Human
cugugaccaggaaggaagucagc

SEQ ID NO: 2650473 - RNA, 18 nt, Human
cugugaccaggaaggaag

SEQ ID NO: 2650474 - RNA, 24 nt, Human
cugugacauggugccugagaggca

SEQ ID NO: 2650475 - RNA, 16 nt, Human
cugugacauggugccu

SEQ ID NO: 2650476 - RNA, 17 nt, Human
cugugacauggugccug

SEQ ID NO: 2650477 - RNA, 18 nt, Human
cugugacauggugccuga

SEQ ID NO: 2650478 - RNA, 19 nt, Human
cugugacauggugccugag

SEQ ID NO: 2650479 - RNA, 20 nt, Human
cugugacauggugccugaga

SEQ ID NO: 2650480 - RNA, 21 nt, Human
cugugacauggugccugagag

SEQ ID NO: 2650481 - RNA, 22 nt, Human
cugugacauggugccugagagg

SEQ ID NO: 2650482 - RNA, 23 nt, Human
cugugacauggugccugagaggc

SEQ ID NO: 2650483 - RNA, 21 nt, Human
cuuacacuggcaaugguaguu

SEQ ID NO: 2650484 - RNA, 14 nt, Human
cuuaccuagugaaa

SEQ ID NO: 2650485 - RNA, 16 nt, Human
cuuaccuagugaaacu

SEQ ID NO: 2650486 - RNA, 18 nt, Human
cuuaccuagugaaacuuu

SEQ ID NO: 2650487 - RNA, 21 nt, Human
cuuaccuagugaaacuuuucu

SEQ ID NO: 2650488 - RNA, 22 nt, Human
cuuaccuagugaaacuuuucua

SEQ ID NO: 2650489 - RNA, 13 nt, Human
cuuaccucggugc

SEQ ID NO: 2650490 - RNA, 15 nt, Human
cuuaccuaacaucug

SEQ ID NO: 2650491 - RNA, 14 nt, Human
cuuagauucuuaau

SEQ ID NO: 2650492 - RNA, 16 nt, Human
cuuagauucuuaauuc

SEQ ID NO: 2650493 - RNA, 21 nt, Human
cuuaccucggugccuuccucu

SEQ ID NO: 2650494 - RNA, 19 nt, Human
cuuaccucggugccuuccu

SEQ ID NO: 2650495 - RNA, 14 nt, Human
cuucuuaaaguauu

SEQ ID NO: 2650496 - RNA, 19 nt, Human
cuucuuaaaguauucuucu

SEQ ID NO: 2650497 - RNA, 23 nt, Human
cuugaauaaacaccacuggauua

SEQ ID NO: 2650498 - RNA, 22 nt, Human
cuuggcauuccgcaucccuacc

SEQ ID NO: 2650499 - RNA, 14 nt, Human
cuuggcauuccgca

SEQ ID NO: 2650500 - RNA, 14 nt, Human
cuugaauccuucca

SEQ ID NO: 2650501 - RNA, 15 nt, Human
cuugaauccuuccau

SEQ ID NO: 2650502 - RNA, 20 nt, Human
cuugaauccuuccauuccac

SEQ ID NO: 2650503 - RNA, 21 nt, Human
cuugaauccuuccauuccaca

SEQ ID NO: 2650504 - RNA, 23 nt, Human
cuugaauccuuccauuccacaca

SEQ ID NO: 2650505 - RNA, 13 nt, Human
cuugccucugugc

SEQ ID NO: 2650506 - RNA, 14 nt, Human
cuugccucugugcu

SEQ ID NO: 2650507 - RNA, 15 nt, Human
cuugccucugugcug

SEQ ID NO: 2650508 - RNA, 16 nt, Human
cuugccucugugcugu

SEQ ID NO: 2650509 - RNA, 19 nt, Human
cuugccucugugcugugug

SEQ ID NO: 2650510 - RNA, 20 nt, Human
cuugccucugugcugugugu

SEQ ID NO: 2650511 - RNA, 12 nt, Human
cuugccucuucc

SEQ ID NO: 2650512 - RNA, 13 nt, Human
cuugccucuuccu

SEQ ID NO: 2650513 - RNA, 16 nt, Human
cuugccucuuccuuga

SEQ ID NO: 2650514 - RNA, 18 nt, Human
cuugccucuuccuugaag

SEQ ID NO: 2650515 - RNA, 17 nt, Human
cuugugauuauuuauua

SEQ ID NO: 2650516 - RNA, 15 nt, Human
cuugugauuauuuau

SEQ ID NO: 2650517 - RNA, 23 nt, Human
cuugugauccacucgccucagcc

SEQ ID NO: 2650518 - RNA, 15 nt, Human
cuuuaaccuuguaua

SEQ ID NO: 2650519 - RNA, 17 nt, Human
cuuuaaccuuguauaaa

SEQ ID NO: 2650520 - RNA, 18 nt, Human
cuuuaaccuuguauaaau

SEQ ID NO: 2650521 - RNA, 16 nt, Human
cuugugauuucuuuaa

SEQ ID NO: 2650522 - RNA, 21 nt, Human
cuugugauuucuuuaaaagaa

SEQ ID NO: 2650523 - RNA, 22 nt, Human
cuugugauuucuuuaaaagaau

SEQ ID NO: 2650524 - RNA, 23 nt, Human
cuugugauuucuuuaaaagaaug

SEQ ID NO: 2650525 - RNA, 20 nt, Human
cuuuaaggggaggaaccaga

SEQ ID NO: 2650526 - RNA, 10 nt, Human
cuuucagaaa

SEQ ID NO: 2650527 - RNA, 11 nt, Human
cuuucagaaag

SEQ ID NO: 2650528 - RNA, 14 nt, Human
cuuucagaaagcuu

SEQ ID NO: 2650529 - RNA, 15 nt, Human
cuuucagaaauauaa

SEQ ID NO: 2650530 - RNA, 21 nt, Human
cuuucagaaauauaacacauu

SEQ ID NO: 2650531 - RNA, 22 nt, Human
cuuucagaaauauaacacauuu

SEQ ID NO: 2650532 - RNA, 23 nt, Human
cuuucagaaauauaacacauuuu

SEQ ID NO: 2650533 - RNA, 21 nt, Human
cuuucagaagugcccuuccug

SEQ ID NO: 2650534 - RNA, 23 nt, Human
cuuugggggaggagaacaugagu

SEQ ID NO: 2650535 - RNA, 16 nt, Human
cuuugguacuaauaau

SEQ ID NO: 2650536 - RNA, 21 nt, Human
cuuugguacuaauaaucuugu

SEQ ID NO: 2650537 - RNA, 15 nt, Human
cuuuuacugguugca

SEQ ID NO: 2650538 - RNA, 16 nt, Human
cuuuuacugguugcau

SEQ ID NO: 2650539 - RNA, 17 nt, Human
cuuuuacugguugcaug

SEQ ID NO: 2650540 - RNA, 18 nt, Human
cuuuuacugguugcaugg

SEQ ID NO: 2650541 - RNA, 21 nt, Human
cuuuuacugguugcauggaaa

SEQ ID NO: 2650542 - RNA, 22 nt, Human
cuuuuacugguugcauggaaau

SEQ ID NO: 2650543 - RNA, 11 nt, Human
cuuuuacugug

SEQ ID NO: 2650544 - RNA, 12 nt, Human
cuuuuacuguga

SEQ ID NO: 2650545 - RNA, 20 nt, Human
cuuuuauuuuacacagaaac

SEQ ID NO: 2650546 - RNA, 21 nt, Human
cuuuuauuuuacacagaaaca

SEQ ID NO: 2650547 - RNA, 22 nt, Human
cuuuuauuuuacacagaaacac

SEQ ID NO: 2650548 - RNA, 21 nt, Human
cuuuccuuuucgccuuuccuc

SEQ ID NO: 2650549 - RNA, 18 nt, Human
cuuucuccuuuaauugua

SEQ ID NO: 2650550 - RNA, 17 nt, Human
cuuucuauccucuguaa

SEQ ID NO: 2650551 - RNA, 16 nt, Human
cuuucuauccucugua

SEQ ID NO: 2650552 - RNA, 21 nt, Human
cuuugaguagauccauuucca

SEQ ID NO: 2650553 - RNA, 23 nt, Human
cuuugaguagauccauuuccauu

SEQ ID NO: 2650554 - RNA, 15 nt, Human
cuuugauuauuugca

SEQ ID NO: 2650555 - RNA, 16 nt, Human
cuuugauuauuugcau

SEQ ID NO: 2650556 - RNA, 17 nt, Human
cuuugauuauuugcaug

SEQ ID NO: 2650557 - RNA, 18 nt, Human
cuuugauuauuugcaugu

SEQ ID NO: 2650558 - RNA, 19 nt, Human
cuuugauuauuugcauguu

SEQ ID NO: 2650559 - RNA, 20 nt, Human
cuuugauuauuugcauguua

SEQ ID NO: 2650560 - RNA, 21 nt, Human
cuuugauuauuugcauguuau

SEQ ID NO: 2650561 - RNA, 22 nt, Human
cuuugauuauuugcauguuaug

SEQ ID NO: 2650562 - RNA, 24 nt, Human
cuuugauuauuugcauguuauguu

SEQ ID NO: 2650563 - RNA, 23 nt, Human
cuuugagcucccacuucugccag

SEQ ID NO: 2650564 - RNA, 14 nt, Human
cuuugagcucccac

SEQ ID NO: 2650565 - RNA, 17 nt, Human
cuuugagccugggaaau

SEQ ID NO: 2650566 - RNA, 19 nt, Human
cuuugagccugggaaauaa

SEQ ID NO: 2650567 - RNA, 15 nt, Human
auaagugaagugaua

SEQ ID NO: 2650568 - RNA, 16 nt, Human
auaagcuacuagcaaa

SEQ ID NO: 2650569 - RNA, 17 nt, Human
auaagcuacuagcaaaa

SEQ ID NO: 2650570 - RNA, 19 nt, Human
auaagcuacuagcaaaaua

SEQ ID NO: 2650571 - RNA, 22 nt, Human
auaagcuacuagcaaaauaaaa

SEQ ID NO: 2650572 - RNA, 15 nt, Human
auaagcuaguugaau

SEQ ID NO: 2650573 - RNA, 14 nt, Human
auaagcuaguugaa

SEQ ID NO: 2650574 - RNA, 21 nt, Human
auaagcuaguugaauacuuga

SEQ ID NO: 2650575 - RNA, 20 nt, Human
auaagcuaguugaauacuug

SEQ ID NO: 2650576 - RNA, 18 nt, Human
auaagcuaguugaauacu

SEQ ID NO: 2650577 - RNA, 17 nt, Human
auaagcuaguugaauac

SEQ ID NO: 2650578 - RNA, 23 nt, Human
auaagcuaguugaauacuugaac

SEQ ID NO: 2650579 - RNA, 22 nt, Human
auaagcuaguugaauacuugaa

SEQ ID NO: 2650580 - RNA, 20 nt, Human
auaaagagagaacaggacua

SEQ ID NO: 2650581 - RNA, 16 nt, Human
auagcaacaacaauug

SEQ ID NO: 2650582 - RNA, 17 nt, Human
auagcaacaacaauugg

SEQ ID NO: 2650583 - RNA, 18 nt, Human
auagcaacaacaauuggu

SEQ ID NO: 2650584 - RNA, 19 nt, Human
auagcaacaacaauuggua

SEQ ID NO: 2650585 - RNA, 14 nt, Human
auagcaaaugacau

SEQ ID NO: 2650586 - RNA, 22 nt, Human
auacuugaaccauaaaaugucc

SEQ ID NO: 2650587 - RNA, 20 nt, Human
auacuugaaccauaaaaugu

SEQ ID NO: 2650588 - RNA, 18 nt, Human
auacuugaaccauaaaau

SEQ ID NO: 2650589 - RNA, 17 nt, Human
auacuugaaccauaaaa

SEQ ID NO: 2650590 - RNA, 16 nt, Human
auacuugaaccauaaa

SEQ ID NO: 2650591 - RNA, 13 nt, Human
auacuugaaccau

SEQ ID NO: 2650592 - RNA, 12 nt, Human
auacuugaacca

SEQ ID NO: 2650593 - RNA, 19 nt, Human
auacacgaauagacaucaa

SEQ ID NO: 2650594 - RNA, 20 nt, Human
auacacgaauagacaucaaa

SEQ ID NO: 2650595 - RNA, 15 nt, Human
auacacauauagugu

SEQ ID NO: 2650596 - RNA, 14 nt, Human
auacacauuugcua

SEQ ID NO: 2650597 - RNA, 22 nt, Human
auacacauuugcuacuguugua

SEQ ID NO: 2650598 - RNA, 20 nt, Human
agugcuccauaguuuggcau

SEQ ID NO: 2650599 - RNA, 23 nt, Human
agugcuauuacgaaguucaagau

SEQ ID NO: 2650600 - RNA, 19 nt, Human
agugcuauuacgaaguuca

SEQ ID NO: 2650601 - RNA, 18 nt, Human
aguggccaagaagcagug

SEQ ID NO: 2650602 - RNA, 11 nt, Human
aguguuucuuu

SEQ ID NO: 2650603 - RNA, 18 nt, Human
aguuaaauguuaccucug

SEQ ID NO: 2650604 - RNA, 13 nt, Human
aguguuuugcaag

SEQ ID NO: 2650605 - RNA, 21 nt, Human
aguucuuuguucauagcccag

SEQ ID NO: 2650606 - RNA, 22 nt, Human
aguucuuuguucauagcccagu

SEQ ID NO: 2650607 - RNA, 18 nt, Human
aguugaaaaacagcugag

SEQ ID NO: 2650608 - RNA, 17 nt, Human
aguugaaaaacagcuga

SEQ ID NO: 2650609 - RNA, 19 nt, Human
aguucuuuguucauagccc

SEQ ID NO: 2650610 - RNA, 19 nt, Human
aguucaucagaguuauggu

SEQ ID NO: 2650611 - RNA, 20 nt, Human
aguucaucagaguuauggug

SEQ ID NO: 2650612 - RNA, 14 nt, Human
aguugaauacuuga

SEQ ID NO: 2650613 - RNA, 19 nt, Human
aguugaauacuugaaccau

SEQ ID NO: 2650614 - RNA, 18 nt, Human
aguugaauacuugaacca

SEQ ID NO: 2650615 - RNA, 17 nt, Human
aguugaauacuugaacc

SEQ ID NO: 2650616 - RNA, 16 nt, Human
aguugaauacuugaac

SEQ ID NO: 2650617 - RNA, 15 nt, Human
aguugaauacuugaa

SEQ ID NO: 2650618 - RNA, 12 nt, Human
auaaaaauggau

SEQ ID NO: 2650619 - RNA, 14 nt, Human
auaaaaaugucuug

SEQ ID NO: 2650620 - RNA, 15 nt, Human
auaaaacauagcaaa

SEQ ID NO: 2650621 - RNA, 21 nt, Human
auaaaacagaguaaucuuguu

SEQ ID NO: 2650622 - RNA, 19 nt, Human
auaaaacagaguaaucuug

SEQ ID NO: 2650623 - RNA, 16 nt, Human
auaaaacagaguaauc

SEQ ID NO: 2650624 - RNA, 16 nt, Human
auaaaaaaagaaagca

SEQ ID NO: 2650625 - RNA, 21 nt, Human
auaaaaacucaggcaaagaaa

SEQ ID NO: 2650626 - RNA, 13 nt, Human
auaaaaagaauga

SEQ ID NO: 2650627 - RNA, 13 nt, Human
auaaaaaauuuua

SEQ ID NO: 2650628 - RNA, 18 nt, Human
aguuugaggauuaguuua

SEQ ID NO: 2650629 - RNA, 23 nt, Human
aguuugagcugccuucccuagcu

SEQ ID NO: 2650630 - RNA, 15 nt, Human
aguuugagcugccuu

SEQ ID NO: 2650631 - RNA, 16 nt, Human
aguuugagcugccuuc

SEQ ID NO: 2650632 - RNA, 17 nt, Human
aguuugaggauuaguuu

SEQ ID NO: 2650633 - RNA, 23 nt, Human
aguuucugugguuggcugggaaa

SEQ ID NO: 2650634 - RNA, 21 nt, Human
aguuucugugguuggcuggga

SEQ ID NO: 2650635 - RNA, 17 nt, Human
aguuucugugguuggcu

SEQ ID NO: 2650636 - RNA, 13 nt, Human
aguuucugugguu

SEQ ID NO: 2650637 - RNA, 12 nt, Human
aguaacucauuu

SEQ ID NO: 2650638 - RNA, 22 nt, Human
aguaacucauuuguuaaaauua

SEQ ID NO: 2650639 - RNA, 17 nt, Human
aguaacugucaggcuga

SEQ ID NO: 2650640 - RNA, 23 nt, Human
aguaacugucaggcugaaaacaa

SEQ ID NO: 2650641 - RNA, 17 nt, Human
aguaacuuacuuaggug

SEQ ID NO: 2650642 - RNA, 19 nt, Human
aguaacccccuuaaauuua

SEQ ID NO: 2650643 - RNA, 21 nt, Human
aguaacccccuuaaauuuaau

SEQ ID NO: 2650644 - RNA, 15 nt, Human
aguaaaguuaaaaga

SEQ ID NO: 2650645 - RNA, 14 nt, Human
aguaaacgggaaca

SEQ ID NO: 2650646 - RNA, 16 nt, Human
aguaaacgggaacaug

SEQ ID NO: 2650647 - RNA, 19 nt, Human
aguaaacgggaacaugccc

SEQ ID NO: 2650648 - RNA, 21 nt, Human
aguaaacgggaacaugccccc

SEQ ID NO: 2650649 - RNA, 23 nt, Human
aguaaacgggaacaugcccccug

SEQ ID NO: 2650650 - RNA, 21 nt, Human
agugccuuugcagcucagaac

SEQ ID NO: 2650651 - RNA, 20 nt, Human
agugccuuugcagcucagaa

SEQ ID NO: 2650652 - RNA, 18 nt, Human
agugccuuugcagcucag

SEQ ID NO: 2650653 - RNA, 17 nt, Human
agugccuuugcagcuca

SEQ ID NO: 2650654 - RNA, 16 nt, Human
agucugucuuuccuga

SEQ ID NO: 2650655 - RNA, 21 nt, Human
agucugucuuuccugaaccau

SEQ ID NO: 2650656 - RNA, 14 nt, Human
agugaaugcuggga

SEQ ID NO: 2650657 - RNA, 22 nt, Human
aguccugugaaugccacugccu

SEQ ID NO: 2650658 - RNA, 21 nt, Human
aguccugugaaugccacugcc

SEQ ID NO: 2650659 - RNA, 17 nt, Human
agucuguacuaaacagu

SEQ ID NO: 2650660 - RNA, 22 nt, Human
agucuguacuaaacaguaagau

SEQ ID NO: 2650661 - RNA, 22 nt, Human
agucuggcccuagacucggggu

SEQ ID NO: 2650662 - RNA, 13 nt, Human
agucuggcccuag

SEQ ID NO: 2650663 - RNA, 18 nt, Human
aucaaauaaguauuuaua

SEQ ID NO: 2650664 - RNA, 17 nt, Human
aucaaauaaguauuuau

SEQ ID NO: 2650665 - RNA, 17 nt, Human
aucaaauaaagagagaa

SEQ ID NO: 2650666 - RNA, 14 nt, Human
aucaaauaagaaau

SEQ ID NO: 2650667 - RNA, 15 nt, Human
aucaaauaagaaaua

SEQ ID NO: 2650668 - RNA, 20 nt, Human
aucaaauaaguauuuauaau

SEQ ID NO: 2650669 - RNA, 19 nt, Human
aucaaauaaguauuuauaa

SEQ ID NO: 2650670 - RNA, 19 nt, Human
aucaaagucauuaaagaca

SEQ ID NO: 2650671 - RNA, 22 nt, Human
aucaaagucauuaaagacagga

SEQ ID NO: 2650672 - RNA, 11 nt, Human
aucaaagugcu

SEQ ID NO: 2650673 - RNA, 15 nt, Human
aucaaauaaagagag

SEQ ID NO: 2650674 - RNA, 12 nt, Human
aucaugcaaaau

SEQ ID NO: 2650675 - RNA, 12 nt, Human
aucaucuaaguc

SEQ ID NO: 2650676 - RNA, 19 nt, Human
aucaucuaauucucugugg

SEQ ID NO: 2650677 - RNA, 17 nt, Human
aucauccagauguggcu

SEQ ID NO: 2650678 - RNA, 15 nt, Human
auccacuuuggggga

SEQ ID NO: 2650679 - RNA, 12 nt, Human
auccagaaaacu

SEQ ID NO: 2650680 - RNA, 15 nt, Human
auccagaaaacugug

SEQ ID NO: 2650681 - RNA, 17 nt, Human
auccagaaaacugugau

SEQ ID NO: 2650682 - RNA, 19 nt, Human
auccagccggaggccagag

SEQ ID NO: 2650683 - RNA, 19 nt, Human
auccagccuggggcugagg

SEQ ID NO: 2650684 - RNA, 14 nt, Human
auccagauguggcu

SEQ ID NO: 2650685 - RNA, 15 nt, Human
auccagauguggcua

SEQ ID NO: 2650686 - RNA, 23 nt, Human
auccagauguggcuacugacaua

SEQ ID NO: 2650687 - RNA, 21 nt, Human
auccagccuggggcugaggcu

SEQ ID NO: 2650688 - RNA, 20 nt, Human
auccccccaucuugcuuccc

SEQ ID NO: 2650689 - RNA, 15 nt, Human
auccccccaucuugc

SEQ ID NO: 2650690 - RNA, 17 nt, Human
auccccccaucuugcuu

SEQ ID NO: 2650691 - RNA, 17 nt, Human
auccagggggcaagagg

SEQ ID NO: 2650692 - RNA, 13 nt, Human
auccccaucuccc

SEQ ID NO: 2650693 - RNA, 15 nt, Human
auccccaucucccug

SEQ ID NO: 2650694 - RNA, 16 nt, Human
auccccaucucccugc

SEQ ID NO: 2650695 - RNA, 18 nt, Human
auccccaucucccugccu

SEQ ID NO: 2650696 - RNA, 19 nt, Human
auccccaucucccugccug

SEQ ID NO: 2650697 - RNA, 20 nt, Human
auccccaucucccugccugg

SEQ ID NO: 2650698 - RNA, 22 nt, Human
auagcaacuuuuguguaaugaa

SEQ ID NO: 2650699 - RNA, 23 nt, Human
aucaaaaaggcuuauaaaacaga

SEQ ID NO: 2650700 - RNA, 21 nt, Human
aucaaaaaggcuuauaaaaca

SEQ ID NO: 2650701 - RNA, 17 nt, Human
aucaaaaaggcuuauaa

SEQ ID NO: 2650702 - RNA, 16 nt, Human
aucaaaaaggcuuaua

SEQ ID NO: 2650703 - RNA, 13 nt, Human
aucaaaaaggcuu

SEQ ID NO: 2650704 - RNA, 12 nt, Human
aucaaaaaggcu

SEQ ID NO: 2650705 - RNA, 15 nt, Human
aucaaaccuuugagu

SEQ ID NO: 2650706 - RNA, 16 nt, Human
aucaaacucaaugcuu

SEQ ID NO: 2650707 - RNA, 19 nt, Human
aucaaagagguuuuaaaaa

SEQ ID NO: 2650708 - RNA, 21 nt, Human
aucaaaggaaaauaguaaugu

SEQ ID NO: 2650709 - RNA, 20 nt, Human
aucaaagggauaaagaaaaa

SEQ ID NO: 2650710 - RNA, 17 nt, Human
augcaucauuucaggag

SEQ ID NO: 2650711 - RNA, 23 nt, Human
augcaucauuucaggaguuacug

SEQ ID NO: 2650712 - RNA, 12 nt, Human
augcauauuugc

SEQ ID NO: 2650713 - RNA, 17 nt, Human
augcauauuugcaaagu

SEQ ID NO: 2650714 - RNA, 21 nt, Human
augcauauuugcaaaguguau

SEQ ID NO: 2650715 - RNA, 16 nt, Human
augcaugucaaacaug

SEQ ID NO: 2650716 - RNA, 22 nt, Human
augcaugucaaacaugagaugu

SEQ ID NO: 2650717 - RNA, 13 nt, Human
auggcuugucuau

SEQ ID NO: 2650718 - RNA, 20 nt, Human
auggcuugucuauacuccuu

SEQ ID NO: 2650719 - RNA, 14 nt, Human
auggcuuguucauc

SEQ ID NO: 2650720 - RNA, 23 nt, Human
auggcuuguucaucauccagaug

SEQ ID NO: 2650721 - RNA, 23 nt, Human
auggcuuuauuuuuuugaacucu

SEQ ID NO: 2650722 - RNA, 18 nt, Human
auggcuuuauuuuuuuga

SEQ ID NO: 2650723 - RNA, 18 nt, Human
augggaaaacugccaaua

SEQ ID NO: 2650724 - RNA, 17 nt, Human
augggaaugagguggga

SEQ ID NO: 2650725 - RNA, 18 nt, Human
augggaaugaggugggag

SEQ ID NO: 2650726 - RNA, 15 nt, Human
augcuuuccaaaacc

SEQ ID NO: 2650727 - RNA, 15 nt, Human
augcuuuccaaaccu

SEQ ID NO: 2650728 - RNA, 18 nt, Human
augcuuuauuaauguuuu

SEQ ID NO: 2650729 - RNA, 19 nt, Human
augcuuuauuaauguuuuc

SEQ ID NO: 2650730 - RNA, 22 nt, Human
augcuuuauuaauguuuucaaa

SEQ ID NO: 2650731 - RNA, 14 nt, Human
augcuuuauuugua

SEQ ID NO: 2650732 - RNA, 15 nt, Human
augcuuuauuuguaa

SEQ ID NO: 2650733 - RNA, 16 nt, Human
augcuuuauuuguaaa

SEQ ID NO: 2650734 - RNA, 17 nt, Human
augcuuuauuuguaaau

SEQ ID NO: 2650735 - RNA, 18 nt, Human
augcuuuauuuguaaauu

SEQ ID NO: 2650736 - RNA, 19 nt, Human
augcuuuauuuguaaauuu

SEQ ID NO: 2650737 - RNA, 21 nt, Human
augcuuuauuuguaaauuuag

SEQ ID NO: 2650738 - RNA, 20 nt, Human
augcuuuccaaaccuuaucu

SEQ ID NO: 2650739 - RNA, 18 nt, Human
auggagccagcucccucu

SEQ ID NO: 2650740 - RNA, 15 nt, Human
auggagccagcuccc

SEQ ID NO: 2650741 - RNA, 11 nt, Human
auggagccagc

SEQ ID NO: 2650742 - RNA, 12 nt, Human
augagccuggca

SEQ ID NO: 2650743 - RNA, 17 nt, Human
augagcucugaaaucuu

SEQ ID NO: 2650744 - RNA, 19 nt, Human
augagcucugaaaucuucc

SEQ ID NO: 2650745 - RNA, 22 nt, Human
augagcucugaaaucuucccau

SEQ ID NO: 2650746 - RNA, 11 nt, Human
augagccuggc

SEQ ID NO: 2650747 - RNA, 17 nt, Human
augagcugaucugcgga

SEQ ID NO: 2650748 - RNA, 15 nt, Human
augaggaaaauucuu

SEQ ID NO: 2650749 - RNA, 19 nt, Human
augaggaaaauucuuaaaa

SEQ ID NO: 2650750 - RNA, 21 nt, Human
augaggaaaauucuuaaaagg

SEQ ID NO: 2650751 - RNA, 16 nt, Human
augaggaacuguagau

SEQ ID NO: 2650752 - RNA, 13 nt, Human
augaaacuaaagc

SEQ ID NO: 2650753 - RNA, 15 nt, Human
augaaacuaaagcaa

SEQ ID NO: 2650754 - RNA, 16 nt, Human
augaaacuaaagcaau

SEQ ID NO: 2650755 - RNA, 19 nt, Human
augaaacuaaagcaauaga

SEQ ID NO: 2650756 - RNA, 20 nt, Human
augaaacuaaagcaauagaa

SEQ ID NO: 2650757 - RNA, 21 nt, Human
augaaacuaaagcaauagaaa

SEQ ID NO: 2650758 - RNA, 22 nt, Human
augaaacuaaagcaauagaaac

SEQ ID NO: 2650759 - RNA, 23 nt, Human
augaaacuaaagcaauagaaaca

SEQ ID NO: 2650760 - RNA, 14 nt, Human
augaagcuaccuca

SEQ ID NO: 2650761 - RNA, 20 nt, Human
augaagccuccuuagaaaaa

SEQ ID NO: 2650762 - RNA, 19 nt, Human
augaaacuuguuucacuga

SEQ ID NO: 2650763 - RNA, 15 nt, Human
augaagcuaccucaa

SEQ ID NO: 2650764 - RNA, 12 nt, Human
augaaagaaaau

SEQ ID NO: 2650765 - RNA, 14 nt, Human
augaauacauuucc

SEQ ID NO: 2650766 - RNA, 21 nt, Human
augaauacauuuccaaaaugg

SEQ ID NO: 2650767 - RNA, 18 nt, Human
agggaugcaggcuccccu

SEQ ID NO: 2650768 - RNA, 20 nt, Human
agggaugcaggcuccccuga

SEQ ID NO: 2650769 - RNA, 16 nt, Human
agggauggaggaagaa

SEQ ID NO: 2650770 - RNA, 20 nt, Human
agggauucugguuccagggu

SEQ ID NO: 2650771 - RNA, 14 nt, Human
aggcuuaaaaacug

SEQ ID NO: 2650772 - RNA, 20 nt, Human
aggcuguucccauguagccc

SEQ ID NO: 2650773 - RNA, 19 nt, Human
aggcugcagugagccgaga

SEQ ID NO: 2650774 - RNA, 17 nt, Human
aggcugcagugagccga

SEQ ID NO: 2650775 - RNA, 18 nt, Human
aggcuagcuucugcuuuu

SEQ ID NO: 2650776 - RNA, 15 nt, Human
aggcuagcuucugcu

SEQ ID NO: 2650777 - RNA, 17 nt, Human
aggcuagcuucugcuuu

SEQ ID NO: 2650778 - RNA, 19 nt, Human
aggcagccaaccuaagcaa

SEQ ID NO: 2650779 - RNA, 19 nt, Human
aggcaucugugggcauggu

SEQ ID NO: 2650780 - RNA, 14 nt, Human
aggcaucugagggg

SEQ ID NO: 2650781 - RNA, 13 nt, Human
aggcaucuaucug

SEQ ID NO: 2650782 - RNA, 23 nt, Human
aggcaugugucaccaugcccagc

SEQ ID NO: 2650783 - RNA, 17 nt, Human
aggcacuucauguaaag

SEQ ID NO: 2650784 - RNA, 21 nt, Human
aggagaccuggcacuggaugc

SEQ ID NO: 2650785 - RNA, 19 nt, Human
aggagagcaucggccuagg

SEQ ID NO: 2650786 - RNA, 15 nt, Human
aggagggugggaagg

SEQ ID NO: 2650787 - RNA, 13 nt, Human
aggaggguggggg

SEQ ID NO: 2650788 - RNA, 21 nt, Human
aggagggugggggagggaggu

SEQ ID NO: 2650789 - RNA, 14 nt, Human
aggagggugggaag

SEQ ID NO: 2650790 - RNA, 20 nt, Human
aggagguggaggcugcagug

SEQ ID NO: 2650791 - RNA, 16 nt, Human
aggaugggcuucugug

SEQ ID NO: 2650792 - RNA, 17 nt, Human
aggaugggcuucugugc

SEQ ID NO: 2650793 - RNA, 15 nt, Human
agcuaacuguaaauc

SEQ ID NO: 2650794 - RNA, 16 nt, Human
agcuaacuguaaauca

SEQ ID NO: 2650795 - RNA, 19 nt, Human
agccuuuaccuuuuaugca

SEQ ID NO: 2650796 - RNA, 22 nt, Human
agcgaacccuuuauuugaacaa

SEQ ID NO: 2650797 - RNA, 16 nt, Human
agccuuuuuaaaacac

SEQ ID NO: 2650798 - RNA, 21 nt, Human
agccuuuuuaaaacacauguu

SEQ ID NO: 2650799 - RNA, 22 nt, Human
agccuuuuuaaaacacauguuu

SEQ ID NO: 2650800 - RNA, 17 nt, Human
agccuuuuuaaaacaca

SEQ ID NO: 2650801 - RNA, 18 nt, Human
agccuuuuuaaaacacau

SEQ ID NO: 2650802 - RNA, 19 nt, Human
agccuuuuuaaaacacaug

SEQ ID NO: 2650803 - RNA, 20 nt, Human
agccuuuuuaaaacacaugu

SEQ ID NO: 2650804 - RNA, 18 nt, Human
agccugggcaaugugaua

SEQ ID NO: 2650805 - RNA, 20 nt, Human
agccugggaggucaaggcug

SEQ ID NO: 2650806 - RNA, 10 nt, Human
agccugcugg

SEQ ID NO: 2650807 - RNA, 17 nt, Human
agccugcuggcacccac

SEQ ID NO: 2650808 - RNA, 11 nt, Human
agccugcuggc

SEQ ID NO: 2650809 - RNA, 18 nt, Human
agccugcuggcacccacc

SEQ ID NO: 2650810 - RNA, 14 nt, Human
agccuggacccugu

SEQ ID NO: 2650811 - RNA, 19 nt, Human
agcccacccugcugcuggu

SEQ ID NO: 2650812 - RNA, 22 nt, Human
agcccacccugcugcuggugca

SEQ ID NO: 2650813 - RNA, 17 nt, Human
agcugcgcuugcuuuuc

SEQ ID NO: 2650814 - RNA, 20 nt, Human
agcugccuuggcucagacau

SEQ ID NO: 2650815 - RNA, 19 nt, Human
agcugccuuggcucagaca

SEQ ID NO: 2650816 - RNA, 17 nt, Human
agcugccuuggcucaga

SEQ ID NO: 2650817 - RNA, 16 nt, Human
agcugccuuggcucag

SEQ ID NO: 2650818 - RNA, 14 nt, Human
agcugccuuggcuc

SEQ ID NO: 2650819 - RNA, 16 nt, Human
agcugccuucccuagc

SEQ ID NO: 2650820 - RNA, 17 nt, Human
agcugccuucccuagcu

SEQ ID NO: 2650821 - RNA, 18 nt, Human
agcugccuucccuagcuu

SEQ ID NO: 2650822 - RNA, 19 nt, Human
agcugccuucccuagcuuu

SEQ ID NO: 2650823 - RNA, 10 nt, Human
agcugccuuc

SEQ ID NO: 2650824 - RNA, 12 nt, Human
agcugccuuccc

SEQ ID NO: 2650825 - RNA, 13 nt, Human
agcugccuucccu

SEQ ID NO: 2650826 - RNA, 14 nt, Human
agcugccuucccua

SEQ ID NO: 2650827 - RNA, 18 nt, Human
agcugcgcuugcuuuucu

SEQ ID NO: 2650828 - RNA, 21 nt, Human
agcugacuuuucuguccgagc

SEQ ID NO: 2650829 - RNA, 15 nt, Human
agcugacuuuucugu

SEQ ID NO: 2650830 - RNA, 17 nt, Human
aggaaaaacacaagcaa

SEQ ID NO: 2650831 - RNA, 19 nt, Human
aggaaaaacacaagcaaaa

SEQ ID NO: 2650832 - RNA, 21 nt, Human
agcuuuguuuguugucagcug

SEQ ID NO: 2650833 - RNA, 22 nt, Human
agcuuuguuuguugucagcuga

SEQ ID NO: 2650834 - RNA, 15 nt, Human
agcuuugucguauuu

SEQ ID NO: 2650835 - RNA, 19 nt, Human
agcuuugucguauuuggca

SEQ ID NO: 2650836 - RNA, 16 nt, Human
aggaacauaugaaaau

SEQ ID NO: 2650837 - RNA, 13 nt, Human
aggaaaacuaccu

SEQ ID NO: 2650838 - RNA, 17 nt, Human
aggaacaaucggcugca

SEQ ID NO: 2650839 - RNA, 19 nt, Human
aggaagaacugaaaggcuu

SEQ ID NO: 2650840 - RNA, 16 nt, Human
aggaagaacguuuuuu

SEQ ID NO: 2650841 - RNA, 15 nt, Human
aggaagguggauggc

SEQ ID NO: 2650842 - RNA, 16 nt, Human
aggaagguggauggcc

SEQ ID NO: 2650843 - RNA, 19 nt, Human
aggaaggugaaucugcccu

SEQ ID NO: 2650844 - RNA, 14 nt, Human
agagaacaggacua

SEQ ID NO: 2650845 - RNA, 13 nt, Human
agagaacaggacu

SEQ ID NO: 2650846 - RNA, 12 nt, Human
agagaaguugua

SEQ ID NO: 2650847 - RNA, 11 nt, Human
agagccugcug

SEQ ID NO: 2650848 - RNA, 16 nt, Human
agacucuuuggacacu

SEQ ID NO: 2650849 - RNA, 20 nt, Human
agacaagauuuuuuaauugu

SEQ ID NO: 2650850 - RNA, 21 nt, Human
agacaagauuuuuuaauuguu

SEQ ID NO: 2650851 - RNA, 22 nt, Human
agacaagauuuuuuaauuguuu

SEQ ID NO: 2650852 - RNA, 23 nt, Human
agacaagauuuuuuaauuguuua

SEQ ID NO: 2650853 - RNA, 15 nt, Human
agacaaaagagcagu

SEQ ID NO: 2650854 - RNA, 17 nt, Human
agacaaaagucugucuu

SEQ ID NO: 2650855 - RNA, 22 nt, Human
agacaaaagucugucuuuccug

SEQ ID NO: 2650856 - RNA, 18 nt, Human
agacaauggacccuuuuu

SEQ ID NO: 2650857 - RNA, 20 nt, Human
agacaaugugaaaagaaaaa

SEQ ID NO: 2650858 - RNA, 22 nt, Human
agaccuuuuggcccaaucucug

SEQ ID NO: 2650859 - RNA, 14 nt, Human
agaccauccuggcu

SEQ ID NO: 2650860 - RNA, 15 nt, Human
agaccauccuggcua

SEQ ID NO: 2650861 - RNA, 19 nt, Human
agaccacgcccguccugcc

SEQ ID NO: 2650862 - RNA, 20 nt, Human
agaccacgcccguccugccu

SEQ ID NO: 2650863 - RNA, 21 nt, Human
agaccacgcccguccugccug

SEQ ID NO: 2650864 - RNA, 23 nt, Human
agaccacgcccguccugccugug

SEQ ID NO: 2650865 - RNA, 24 nt, Human
agaccacgcccguccugccugugg

SEQ ID NO: 2650866 - RNA, 19 nt, Human
agacuauauauauaaaugu

SEQ ID NO: 2650867 - RNA, 21 nt, Human
agacuauauauauaaauguau

SEQ ID NO: 2650868 - RNA, 17 nt, Human
agacuagcaaucucuuc

SEQ ID NO: 2650869 - RNA, 23 nt, Human
agacuagcaaucucuucauuauu

SEQ ID NO: 2650870 - RNA, 18 nt, Human
agaacacuaacucaccag

SEQ ID NO: 2650871 - RNA, 20 nt, Human
agaacacuaacucaccagcc

SEQ ID NO: 2650872 - RNA, 22 nt, Human
agaacacacacauauacacgaa

SEQ ID NO: 2650873 - RNA, 21 nt, Human
agaacagguuuuuuuguuugu

SEQ ID NO: 2650874 - RNA, 18 nt, Human
agaacagguuuuuuuguu

SEQ ID NO: 2650875 - RNA, 17 nt, Human
agaacagguuuuuuugu

SEQ ID NO: 2650876 - RNA, 17 nt, Human
agaacaggccucuccau

SEQ ID NO: 2650877 - RNA, 12 nt, Human
agaacaggacua

SEQ ID NO: 2650878 - RNA, 11 nt, Human
agaacaggacu

SEQ ID NO: 2650879 - RNA, 15 nt, Human
agaacagcauugucc

SEQ ID NO: 2650880 - RNA, 14 nt, Human
agaacaugaaucaa

SEQ ID NO: 2650881 - RNA, 17 nt, Human
agaacaugaaucaaaag

SEQ ID NO: 2650882 - RNA, 12 nt, Human
agaagagcgcag

SEQ ID NO: 2650883 - RNA, 14 nt, Human
agaagagcgcagug

SEQ ID NO: 2650884 - RNA, 23 nt, Human
agaagagcgcaguguuuugcaag

SEQ ID NO: 2650885 - RNA, 13 nt, Human
agaaccacuauga

SEQ ID NO: 2650886 - RNA, 23 nt, Human
agaaccaccccggcccccugccc

SEQ ID NO: 2650887 - RNA, 22 nt, Human
agaaccaccccggcccccugcc

SEQ ID NO: 2650888 - RNA, 16 nt, Human
agaaccacacuugaaa

SEQ ID NO: 2650889 - RNA, 19 nt, Human
agaaccacacuugaaaccu

SEQ ID NO: 2650890 - RNA, 20 nt, Human
agaaccacacuugaaaccuu

SEQ ID NO: 2650891 - RNA, 21 nt, Human
agaaccacacuugaaaccuuu

SEQ ID NO: 2650892 - RNA, 18 nt, Human
agaaccaaaucuggaagc

SEQ ID NO: 2650893 - RNA, 13 nt, Human
agaaccaaaucug

SEQ ID NO: 2650894 - RNA, 16 nt, Human
agaaccaaaucuggaa

SEQ ID NO: 2650895 - RNA, 16 nt, Human
agaagggagaagaaag

SEQ ID NO: 2650896 - RNA, 14 nt, Human
agaagaugcuccag

SEQ ID NO: 2650897 - RNA, 15 nt, Human
agaagggagaagaaa

SEQ ID NO: 2650898 - RNA, 23 nt, Human
agaagaugcuccagcaacacagc

SEQ ID NO: 2650899 - RNA, 14 nt, Human
agaagggagaagaa

SEQ ID NO: 2650900 - RNA, 22 nt, Human
agaaucccuuaacaguuguauu

SEQ ID NO: 2650901 - RNA, 16 nt, Human
agaaugaaagcuguuc

SEQ ID NO: 2650902 - RNA, 21 nt, Human
agaaugaaagcuguuccuugg

SEQ ID NO: 2650903 - RNA, 20 nt, Human
agaaucccuuaacaguugua

SEQ ID NO: 2650904 - RNA, 20 nt, Human
agaaugaguccuugauuuca

SEQ ID NO: 2650905 - RNA, 21 nt, Human
agaaugaguccuugauuucaa

SEQ ID NO: 2650906 - RNA, 22 nt, Human
agaaugaguccuugauuucaaa

SEQ ID NO: 2650907 - RNA, 15 nt, Human
agcaaauuuucagca

SEQ ID NO: 2650908 - RNA, 13 nt, Human
agcaacaaagaaa

SEQ ID NO: 2650909 - RNA, 23 nt, Human
agcaacaacaauugguaaaacuc

SEQ ID NO: 2650910 - RNA, 20 nt, Human
agcaaaucagaaacuuguga

SEQ ID NO: 2650911 - RNA, 16 nt, Human
agcaaaucagaaacuu

SEQ ID NO: 2650912 - RNA, 19 nt, Human
agcaaauucuguuuuucua

SEQ ID NO: 2650913 - RNA, 17 nt, Human
agauugauaucuauaaa

SEQ ID NO: 2650914 - RNA, 18 nt, Human
agauugauaucuauaaaa

SEQ ID NO: 2650915 - RNA, 19 nt, Human
agauugauaucuauaaaau

SEQ ID NO: 2650916 - RNA, 20 nt, Human
agauugauaucuauaaaaua

SEQ ID NO: 2650917 - RNA, 21 nt, Human
agauugauaucuauaaaauag

SEQ ID NO: 2650918 - RNA, 22 nt, Human
agauugauaucuauaaaauaga

SEQ ID NO: 2650919 - RNA, 17 nt, Human
agauugacuaacucaaa

SEQ ID NO: 2650920 - RNA, 19 nt, Human
agauugacuaacucaaaua

SEQ ID NO: 2650921 - RNA, 21 nt, Human
agauugacuaacucaaauaca

SEQ ID NO: 2650922 - RNA, 16 nt, Human
agauugcaccacugca

SEQ ID NO: 2650923 - RNA, 21 nt, Human
agauucuuucaguucuuugga

SEQ ID NO: 2650924 - RNA, 11 nt, Human
agauauacugg

SEQ ID NO: 2650925 - RNA, 19 nt, Human
agauauacuggaacccuuu

SEQ ID NO: 2650926 - RNA, 15 nt, Human
agauauaaauuuuua

SEQ ID NO: 2650927 - RNA, 13 nt, Human
agagugguggggg

SEQ ID NO: 2650928 - RNA, 21 nt, Human
agaguggugggggaaggcugu

SEQ ID NO: 2650929 - RNA, 20 nt, Human
agaguguaguuuacagaaaa

SEQ ID NO: 2650930 - RNA, 18 nt, Human
agaguguagacuguggcu

SEQ ID NO: 2650931 - RNA, 14 nt, Human
agauagacaggucc

SEQ ID NO: 2650932 - RNA, 15 nt, Human
agauagacagguccu

SEQ ID NO: 2650933 - RNA, 16 nt, Human
agaggguauuuuugua

SEQ ID NO: 2650934 - RNA, 16 nt, Human
agcagccuggacccug

SEQ ID NO: 2650935 - RNA, 21 nt, Human
agcacuccucgguacucccau

SEQ ID NO: 2650936 - RNA, 16 nt, Human
agcacuccugcuuaau

SEQ ID NO: 2650937 - RNA, 20 nt, Human
agcacuccugcuuaaucuuc

SEQ ID NO: 2650938 - RNA, 18 nt, Human
agcacuacaccuugccuu

SEQ ID NO: 2650939 - RNA, 20 nt, Human
agcagccuggacccugugga

SEQ ID NO: 2650940 - RNA, 12 nt, Human
agcaguggccuu

SEQ ID NO: 2650941 - RNA, 19 nt, Human
agcaguggccuuauugcau

SEQ ID NO: 2650942 - RNA, 22 nt, Human
agccaagguuuuauaaggcuga

SEQ ID NO: 2650943 - RNA, 23 nt, Human
agcccaccccucaacaccucugc

SEQ ID NO: 2650944 - RNA, 12 nt, Human
agcccacccugc

SEQ ID NO: 2650945 - RNA, 13 nt, Human
agcccacccugcu

SEQ ID NO: 2650946 - RNA, 14 nt, Human
agcccacccugcug

SEQ ID NO: 2650947 - RNA, 23 nt, Human
agccaagggaaaggggugcuuuu

SEQ ID NO: 2650948 - RNA, 16 nt, Human
agccaagggaaccugu

SEQ ID NO: 2650949 - RNA, 17 nt, Human
agccaagggaaccugug

SEQ ID NO: 2650950 - RNA, 19 nt, Human
agccaagggaaccuguguc

SEQ ID NO: 2650951 - RNA, 20 nt, Human
agccaagggaaccugugucc

SEQ ID NO: 2650952 - RNA, 21 nt, Human
agccaagggaaccuguguccg

SEQ ID NO: 2650953 - RNA, 23 nt, Human
agcaucuggaagaucauuuugaa

SEQ ID NO: 2650954 - RNA, 13 nt, Human
agccaacucuggg

SEQ ID NO: 2650955 - RNA, 15 nt, Human
agcaucggccuaggg

SEQ ID NO: 2650956 - RNA, 14 nt, Human
agcaucggccuagg

SEQ ID NO: 2650957 - RNA, 21 nt, Human
agcaucggccuagggccccca

SEQ ID NO: 2650958 - RNA, 19 nt, Human
agcaucggccuagggcccc

SEQ ID NO: 2650959 - RNA, 15 nt, Human
agcaucuaucucauc

SEQ ID NO: 2650960 - RNA, 20 nt, Human
aauuaucaauaucuaauaua

SEQ ID NO: 2650961 - RNA, 17 nt, Human
aauuaucuugauacauu

SEQ ID NO: 2650962 - RNA, 18 nt, Human
aauuaucuugauacauuc

SEQ ID NO: 2650963 - RNA, 19 nt, Human
aauuaucuugauacauuca

SEQ ID NO: 2650964 - RNA, 20 nt, Human
aauuaucuugauacauucaa

SEQ ID NO: 2650965 - RNA, 21 nt, Human
aauuaucuugauacauucaaa

SEQ ID NO: 2650966 - RNA, 17 nt, Human
aauuaugagauugguuu

SEQ ID NO: 2650967 - RNA, 23 nt, Human
aauuaugagauugguuuuccugu

SEQ ID NO: 2650968 - RNA, 20 nt, Human
aauuaugaguuuuucaauua

SEQ ID NO: 2650969 - RNA, 19 nt, Human
aauuauaguguagaaaaga

SEQ ID NO: 2650970 - RNA, 14 nt, Human
aauuauauaacugu

SEQ ID NO: 2650971 - RNA, 17 nt, Human
aauuauauaacuguauu

SEQ ID NO: 2650972 - RNA, 19 nt, Human
aauuauauaacuguauuug

SEQ ID NO: 2650973 - RNA, 21 nt, Human
aauuauauaacuguauuugaa

SEQ ID NO: 2650974 - RNA, 14 nt, Human
aauuauacuacuuu

SEQ ID NO: 2650975 - RNA, 23 nt, Human
aauucuaccaaggucuucuuaau

SEQ ID NO: 2650976 - RNA, 20 nt, Human
aauucucuguggaaugaaua

SEQ ID NO: 2650977 - RNA, 13 nt, Human
aauucuccacugu

SEQ ID NO: 2650978 - RNA, 14 nt, Human
aauucuccacugug

SEQ ID NO: 2650979 - RNA, 15 nt, Human
aauucuccacugugc

SEQ ID NO: 2650980 - RNA, 15 nt, Human
aauucuccuggaggu

SEQ ID NO: 2650981 - RNA, 12 nt, Human
aauucuccugga

SEQ ID NO: 2650982 - RNA, 13 nt, Human
aauucuccuggag

SEQ ID NO: 2650983 - RNA, 11 nt, Human
aauucuuaaaa

SEQ ID NO: 2650984 - RNA, 23 nt, Human
aauucuuaaaaggcccauagcag

SEQ ID NO: 2650985 - RNA, 18 nt, Human
aauucuguuuuucuaggc

SEQ ID NO: 2650986 - RNA, 14 nt, Human
aauucuguuuuucu

SEQ ID NO: 2650987 - RNA, 22 nt, Human
aauucugauuucuuuucaccau

SEQ ID NO: 2650988 - RNA, 16 nt, Human
aauucugauuucuuuu

SEQ ID NO: 2650989 - RNA, 15 nt, Human
aauucugauuucuuu

SEQ ID NO: 2650990 - RNA, 14 nt, Human
aauucugauuucuu

SEQ ID NO: 2650991 - RNA, 13 nt, Human
aauucugauuucu

SEQ ID NO: 2650992 - RNA, 11 nt, Human
aauucugauuu

SEQ ID NO: 2650993 - RNA, 23 nt, Human
aauucugauucuggcuuuaagcc

SEQ ID NO: 2650994 - RNA, 15 nt, Human
aauucugauugauuu

SEQ ID NO: 2650995 - RNA, 19 nt, Human
aauucuguuuuuaaugcua

SEQ ID NO: 2650996 - RNA, 21 nt, Human
aauucuguuuuuaaugcuauu

SEQ ID NO: 2650997 - RNA, 22 nt, Human
aauucuguuuuuaaugcuauuu

SEQ ID NO: 2650998 - RNA, 16 nt, Human
aauuggggaggagggg

SEQ ID NO: 2650999 - RNA, 12 nt, Human
aauuguacaaaa

SEQ ID NO: 2651000 - RNA, 13 nt, Human
aauuguacaaaau

SEQ ID NO: 2651001 - RNA, 18 nt, Human
aauuguacaaaauuaagc

SEQ ID NO: 2651002 - RNA, 19 nt, Human
aauuguacaaaauuaagca

SEQ ID NO: 2651003 - RNA, 20 nt, Human
aauuguacaaaauuaagcaa

SEQ ID NO: 2651004 - RNA, 15 nt, Human
aauucuguuuaauuu

SEQ ID NO: 2651005 - RNA, 16 nt, Human
aauuucauguaaaaca

SEQ ID NO: 2651006 - RNA, 18 nt, Human
aauuucauguaaaacaga

SEQ ID NO: 2651007 - RNA, 13 nt, Human
acaacugugacug

SEQ ID NO: 2651008 - RNA, 11 nt, Human
acaacugugac

SEQ ID NO: 2651009 - RNA, 14 nt, Human
acaacuuaaauaau

SEQ ID NO: 2651010 - RNA, 14 nt, Human
acaacugugacugu

SEQ ID NO: 2651011 - RNA, 15 nt, Human
acaacuuaaauaaua

SEQ ID NO: 2651012 - RNA, 14 nt, Human
acaaccaugucauu

SEQ ID NO: 2651013 - RNA, 18 nt, Human
acaagguauaauaaaauu

SEQ ID NO: 2651014 - RNA, 22 nt, Human
acaaacaucuaauaaguauaua

SEQ ID NO: 2651015 - RNA, 22 nt, Human
acaaacugcuucccuuacuuug

SEQ ID NO: 2651016 - RNA, 22 nt, Human
acaaccaugucauuucagaagu

SEQ ID NO: 2651017 - RNA, 19 nt, Human
acaacauguuuaauaaaua

SEQ ID NO: 2651018 - RNA, 14 nt, Human
acacagcagcaguu

SEQ ID NO: 2651019 - RNA, 13 nt, Human
acacagccugggc

SEQ ID NO: 2651020 - RNA, 14 nt, Human
acacagccugggcc

SEQ ID NO: 2651021 - RNA, 18 nt, Human
acaccaaucuuacuuugu

SEQ ID NO: 2651022 - RNA, 14 nt, Human
acaccaaucuuacu

SEQ ID NO: 2651023 - RNA, 22 nt, Human
acacguuuuaaggacugacuga

SEQ ID NO: 2651024 - RNA, 17 nt, Human
acacguuuuaaggacug

SEQ ID NO: 2651025 - RNA, 16 nt, Human
acacguuuuaaggacu

SEQ ID NO: 2651026 - RNA, 15 nt, Human
acacguuuuaaggac

SEQ ID NO: 2651027 - RNA, 14 nt, Human
acacguuuuaagga

SEQ ID NO: 2651028 - RNA, 18 nt, Human
acaguggaauauaaggaa

SEQ ID NO: 2651029 - RNA, 21 nt, Human
acagugcuuuuaagugaaaau

SEQ ID NO: 2651030 - RNA, 24 nt, Human
acagugaugcugugcuaugaauuu

SEQ ID NO: 2651031 - RNA, 17 nt, Human
acauuugcuacuguugu

SEQ ID NO: 2651032 - RNA, 19 nt, Human
acauuugcuacuguuguaa

SEQ ID NO: 2651033 - RNA, 19 nt, Human
acauuucuucuagugauga

SEQ ID NO: 2651034 - RNA, 17 nt, Human
acauuugaugcaugucu

SEQ ID NO: 2651035 - RNA, 20 nt, Human
acauuugaugcaugucuuuu

SEQ ID NO: 2651036 - RNA, 22 nt, Human
acauuugaugcaugucuuuuaa

SEQ ID NO: 2651037 - RNA, 22 nt, Human
accacgggacaucacagggugg

SEQ ID NO: 2651038 - RNA, 19 nt, Human
acauccaacuccagcaacu

SEQ ID NO: 2651039 - RNA, 16 nt, Human
acauccaacuccagca

SEQ ID NO: 2651040 - RNA, 18 nt, Human
acauccaacuccagcaac

SEQ ID NO: 2651041 - RNA, 16 nt, Human
acauaacauaaauuuu

SEQ ID NO: 2651042 - RNA, 16 nt, Human
acauaauacugaacca

SEQ ID NO: 2651043 - RNA, 14 nt, Human
acauaauacugaac

SEQ ID NO: 2651044 - RNA, 18 nt, Human
acauaauacugaaccacu

SEQ ID NO: 2651045 - RNA, 17 nt, Human
acauaauacugaaccac

SEQ ID NO: 2651046 - RNA, 21 nt, Human
acaucauuccuuuuuauuuau

SEQ ID NO: 2651047 - RNA, 17 nt, Human
acaucauuccuuuuuau

SEQ ID NO: 2651048 - RNA, 16 nt, Human
acaucauuccuuuuua

SEQ ID NO: 2651049 - RNA, 13 nt, Human
acaucauuccuuu

SEQ ID NO: 2651050 - RNA, 22 nt, Human
acaucauuccuuuuuauuuaua

SEQ ID NO: 2651051 - RNA, 17 nt, Human
acauguuuuuauacaaa

SEQ ID NO: 2651052 - RNA, 19 nt, Human
acauguuuuuauacaaaau

SEQ ID NO: 2651053 - RNA, 17 nt, Human
acggacacucaaaagcu

SEQ ID NO: 2651054 - RNA, 17 nt, Human
acuaauuauacuacuuu

SEQ ID NO: 2651055 - RNA, 21 nt, Human
acuaauuauacuacuuuguua

SEQ ID NO: 2651056 - RNA, 18 nt, Human
acgugcucugugggucuc

SEQ ID NO: 2651057 - RNA, 13 nt, Human
acgcuucuccgga

SEQ ID NO: 2651058 - RNA, 20 nt, Human
accuguaacuuuuguaaaua

SEQ ID NO: 2651059 - RNA, 17 nt, Human
accuguaacuuuuguaa

SEQ ID NO: 2651060 - RNA, 15 nt, Human
accuguaacuuuugu

SEQ ID NO: 2651061 - RNA, 13 nt, Human
accugccaggcag

SEQ ID NO: 2651062 - RNA, 18 nt, Human
accuuggacauccuccuc

SEQ ID NO: 2651063 - RNA, 19 nt, Human
accuuggacauccuccucc

SEQ ID NO: 2651064 - RNA, 14 nt, Human
accuuggccugggc

SEQ ID NO: 2651065 - RNA, 13 nt, Human
accuuggccuggg

SEQ ID NO: 2651066 - RNA, 16 nt, Human
accuuggccugggccg

SEQ ID NO: 2651067 - RNA, 15 nt, Human
accuuggccugggcc

SEQ ID NO: 2651068 - RNA, 13 nt, Human
acccucagagccu

SEQ ID NO: 2651069 - RNA, 14 nt, Human
acccucagagccuc

SEQ ID NO: 2651070 - RNA, 14 nt, Human
acccucaggcaggu

SEQ ID NO: 2651071 - RNA, 13 nt, Human
acccucaggcagg

SEQ ID NO: 2651072 - RNA, 16 nt, Human
acccucaggcaggugg

SEQ ID NO: 2651073 - RNA, 15 nt, Human
acccucaggcaggug

SEQ ID NO: 2651074 - RNA, 21 nt, Human
acccuaguuaguguuuugccu

SEQ ID NO: 2651075 - RNA, 19 nt, Human
acccucagugagcauggua

SEQ ID NO: 2651076 - RNA, 13 nt, Human
acccuggagccca

SEQ ID NO: 2651077 - RNA, 14 nt, Human
acccugguugugug

SEQ ID NO: 2651078 - RNA, 14 nt, Human
acccugggggcaca

SEQ ID NO: 2651079 - RNA, 16 nt, Human
acccugggggcacagg

SEQ ID NO: 2651080 - RNA, 18 nt, Human
acccugggggcacaggag

SEQ ID NO: 2651081 - RNA, 22 nt, Human
acccugggggcacaggaggcag

SEQ ID NO: 2651082 - RNA, 18 nt, Human
acccugggugggcucugu

SEQ ID NO: 2651083 - RNA, 19 nt, Human
acccugggugggcucugug

SEQ ID NO: 2651084 - RNA, 20 nt, Human
acccugggugggcucugugc

SEQ ID NO: 2651085 - RNA, 20 nt, Human
acccuggguguccccgcugc

SEQ ID NO: 2651086 - RNA, 23 nt, Human
acccuggguguccccgcugcugu

SEQ ID NO: 2651087 - RNA, 14 nt, Human
acccugggcccugg

SEQ ID NO: 2651088 - RNA, 15 nt, Human
acccugggcccuggg

SEQ ID NO: 2651089 - RNA, 17 nt, Human
acccugggcccugggcu

SEQ ID NO: 2651090 - RNA, 22 nt, Human
acccugggcccugggcuggaau

SEQ ID NO: 2651091 - RNA, 18 nt, Human
acccugggcccugggcug

SEQ ID NO: 2651092 - RNA, 20 nt, Human
acccugggcccugggcugga

SEQ ID NO: 2651093 - RNA, 16 nt, Human
acccuagccaaugucu

SEQ ID NO: 2651094 - RNA, 19 nt, Human
acccuagccaaugucuccu

SEQ ID NO: 2651095 - RNA, 19 nt, Human
acccuauugcugcuugagg

SEQ ID NO: 2651096 - RNA, 14 nt, Human
acccuauugcugcu

SEQ ID NO: 2651097 - RNA, 21 nt, Human
acccucaaccucuucuggcuc

SEQ ID NO: 2651098 - RNA, 15 nt, Human
acccuaucuccugac

SEQ ID NO: 2651099 - RNA, 18 nt, Human
acccuaucuccugacaga

SEQ ID NO: 2651100 - RNA, 13 nt, Human
acccuauugcugc

SEQ ID NO: 2651101 - RNA, 14 nt, Human
acccuaucuccuga

SEQ ID NO: 2651102 - RNA, 19 nt, Human
accuccacacccgugagaa

SEQ ID NO: 2651103 - RNA, 14 nt, Human
accuccaacccugc

SEQ ID NO: 2651104 - RNA, 15 nt, Human
accuccaacccugcc

SEQ ID NO: 2651105 - RNA, 16 nt, Human
accuccaacccugccg

SEQ ID NO: 2651106 - RNA, 22 nt, Human
accuccaacccugccgucacca

SEQ ID NO: 2651107 - RNA, 23 nt, Human
accuccaacccugccgucaccac

SEQ ID NO: 2651108 - RNA, 21 nt, Human
accucaugcccacccccugcc

SEQ ID NO: 2651109 - RNA, 22 nt, Human
accucaugcccacccccugccc

SEQ ID NO: 2651110 - RNA, 15 nt, Human
accgggcccuggguu

SEQ ID NO: 2651111 - RNA, 19 nt, Human
accgggcccuggguuccuc

SEQ ID NO: 2651112 - RNA, 19 nt, Human
acccugugacauggugccu

SEQ ID NO: 2651113 - RNA, 21 nt, Human
acccugugacauggugccuga

SEQ ID NO: 2651114 - RNA, 15 nt, Human
accguggaggaggaa

SEQ ID NO: 2651115 - RNA, 22 nt, Human
accguggaggaggaaggcaaga

SEQ ID NO: 2651116 - RNA, 12 nt, Human
accucagccugc

SEQ ID NO: 2651117 - RNA, 18 nt, Human
accguggaggaggaaggc

SEQ ID NO: 2651118 - RNA, 20 nt, Human
accucagccugcacaguguc

SEQ ID NO: 2651119 - RNA, 23 nt, Human
accucagccugcacagugucccc

SEQ ID NO: 2651120 - RNA, 13 nt, Human
accucaugcccac

SEQ ID NO: 2651121 - RNA, 16 nt, Human
accucaugcccacccc

SEQ ID NO: 2651122 - RNA, 20 nt, Human
accucaugcccacccccugc

SEQ ID NO: 2651123 - RNA, 23 nt, Human
accucaugcccacccccugcccu

SEQ ID NO: 2651124 - RNA, 22 nt, Human
acuguaaauauuuauuuaugug

SEQ ID NO: 2651125 - RNA, 11 nt, Human
acuguaaauca

SEQ ID NO: 2651126 - RNA, 12 nt, Human
acuguaaaucau

SEQ ID NO: 2651127 - RNA, 13 nt, Human
acugguuuucugc

SEQ ID NO: 2651128 - RNA, 14 nt, Human
acugguuuucugcc

SEQ ID NO: 2651129 - RNA, 15 nt, Human
acugguuuucugcca

SEQ ID NO: 2651130 - RNA, 19 nt, Human
acugguuuucugccaauga

SEQ ID NO: 2651131 - RNA, 17 nt, Human
acuguaaacuucugcaa

SEQ ID NO: 2651132 - RNA, 16 nt, Human
acugugaagagaacca

SEQ ID NO: 2651133 - RNA, 20 nt, Human
acuguaacuuccaaauaaau

SEQ ID NO: 2651134 - RNA, 22 nt, Human
acuguaacuuccaaauaaauaa

SEQ ID NO: 2651135 - RNA, 14 nt, Human
acugccaugccagc

SEQ ID NO: 2651136 - RNA, 15 nt, Human
acuggagcucaucug

SEQ ID NO: 2651137 - RNA, 13 nt, Human
acuggaacccuuu

SEQ ID NO: 2651138 - RNA, 14 nt, Human
acuggaacccuuuu

SEQ ID NO: 2651139 - RNA, 16 nt, Human
acuggaacccuuuuaa

SEQ ID NO: 2651140 - RNA, 22 nt, Human
acuggaacccuuuuaaaguuga

SEQ ID NO: 2651141 - RNA, 20 nt, Human
acuggaaaggggagagccug

SEQ ID NO: 2651142 - RNA, 21 nt, Human
acuggaaaggggagagccugc

SEQ ID NO: 2651143 - RNA, 22 nt, Human
acuggaaaggggagagccugcu

SEQ ID NO: 2651144 - RNA, 23 nt, Human
acuggaaaggggagagccugcug

SEQ ID NO: 2651145 - RNA, 17 nt, Human
acuggaaaggggagagc

SEQ ID NO: 2651146 - RNA, 15 nt, Human
acuggaaaggggaga

SEQ ID NO: 2651147 - RNA, 19 nt, Human
acuggagguugaagccaag

SEQ ID NO: 2651148 - RNA, 17 nt, Human
acuggagguugaagcca

SEQ ID NO: 2651149 - RNA, 18 nt, Human
acuggagguugaagccaa

SEQ ID NO: 2651150 - RNA, 16 nt, Human
acuggagguugaagcc

SEQ ID NO: 2651151 - RNA, 18 nt, Human
acuuaaaacacguuuuaa

SEQ ID NO: 2651152 - RNA, 14 nt, Human
acuuaaaacacguu

SEQ ID NO: 2651153 - RNA, 12 nt, Human
acuuaaaacacg

SEQ ID NO: 2651154 - RNA, 13 nt, Human
acuguuuccuggg

SEQ ID NO: 2651155 - RNA, 17 nt, Human
acuguuuccugggcacg

SEQ ID NO: 2651156 - RNA, 23 nt, Human
acuuggggggcugaggugggagg

SEQ ID NO: 2651157 - RNA, 22 nt, Human
acuugaaaagagacaggcaggu

SEQ ID NO: 2651158 - RNA, 11 nt, Human
acuugaaaaga

SEQ ID NO: 2651159 - RNA, 23 nt, Human
acuucuuuuuucaaaagaaaguc

SEQ ID NO: 2651160 - RNA, 22 nt, Human
acuucuuuuuucaaaagaaagu

SEQ ID NO: 2651161 - RNA, 21 nt, Human
acuucuuuuuucaaaagaaag

SEQ ID NO: 2651162 - RNA, 21 nt, Human
acuugaaaagagacaggcagg

SEQ ID NO: 2651163 - RNA, 20 nt, Human
acuugaaaagagacaggcag

SEQ ID NO: 2651164 - RNA, 17 nt, Human
acuugaaaagagacagg

SEQ ID NO: 2651165 - RNA, 15 nt, Human
acuugaaaagagaca

SEQ ID NO: 2651166 - RNA, 15 nt, Human
acuucaaagcaagcu

SEQ ID NO: 2651167 - RNA, 16 nt, Human
acuucaaagcaagcug

SEQ ID NO: 2651168 - RNA, 18 nt, Human
acuuguagauuugauuuu

SEQ ID NO: 2651169 - RNA, 17 nt, Human
acuuguagauuugauuu

SEQ ID NO: 2651170 - RNA, 16 nt, Human
acuuguagauuugauu

SEQ ID NO: 2651171 - RNA, 15 nt, Human
acuuguagauuugau

SEQ ID NO: 2651172 - RNA, 14 nt, Human
acuuguagauuuga

SEQ ID NO: 2651173 - RNA, 13 nt, Human
acuuguagauuug

SEQ ID NO: 2651174 - RNA, 12 nt, Human
acuuguagauuu

SEQ ID NO: 2651175 - RNA, 16 nt, Human
acucccacacccaaga

SEQ ID NO: 2651176 - RNA, 22 nt, Human
acuccgagaggugggccagucu

SEQ ID NO: 2651177 - RNA, 23 nt, Human
acuccgagaggugggccagucug

SEQ ID NO: 2651178 - RNA, 17 nt, Human
acucccugcagaugcca

SEQ ID NO: 2651179 - RNA, 14 nt, Human
acucccugcagaug

SEQ ID NO: 2651180 - RNA, 15 nt, Human
acuccguuggccacu

SEQ ID NO: 2651181 - RNA, 17 nt, Human
acuccguuggccacucc

SEQ ID NO: 2651182 - RNA, 12 nt, Human
acuccauugucg

SEQ ID NO: 2651183 - RNA, 18 nt, Human
acuccguuggccacuccg

SEQ ID NO: 2651184 - RNA, 21 nt, Human
acuccguuggccacuccgaga

SEQ ID NO: 2651185 - RNA, 12 nt, Human
acucuaaaaacu

SEQ ID NO: 2651186 - RNA, 15 nt, Human
acugaauuuuuuugu

SEQ ID NO: 2651187 - RNA, 16 nt, Human
acugaauuuuuuugua

SEQ ID NO: 2651188 - RNA, 17 nt, Human
acugaauuuuuuuguaa

SEQ ID NO: 2651189 - RNA, 18 nt, Human
acugaauuuuuuuguaau

SEQ ID NO: 2651190 - RNA, 20 nt, Human
acugaauuuuuuuguaauaa

SEQ ID NO: 2651191 - RNA, 22 nt, Human
acugauuugcaauaaaaaugau

SEQ ID NO: 2651192 - RNA, 18 nt, Human
aaucaaauaaguauuuau

SEQ ID NO: 2651193 - RNA, 16 nt, Human
aaucaaauaaguauuu

SEQ ID NO: 2651194 - RNA, 15 nt, Human
aaucaaauaaguauu

SEQ ID NO: 2651195 - RNA, 14 nt, Human
aaucaaauaaguau

SEQ ID NO: 2651196 - RNA, 13 nt, Human
aaucaaagugcua

SEQ ID NO: 2651197 - RNA, 19 nt, Human
aaucaaauaaguauuuaua

SEQ ID NO: 2651198 - RNA, 12 nt, Human
aaucaauaauau

SEQ ID NO: 2651199 - RNA, 14 nt, Human
aaucaauacacuag

SEQ ID NO: 2651200 - RNA, 18 nt, Human
aaucaauacacuaguugu

SEQ ID NO: 2651201 - RNA, 20 nt, Human
aaucaauacacuaguuguuu

SEQ ID NO: 2651202 - RNA, 19 nt, Human
aaucaauacacuaguuguu

SEQ ID NO: 2651203 - RNA, 14 nt, Human
aaucaaaagugccu

SEQ ID NO: 2651204 - RNA, 19 nt, Human
aaucaaaagugccucaaga

SEQ ID NO: 2651205 - RNA, 22 nt, Human
aauauuaaccuaaucaccaugu

SEQ ID NO: 2651206 - RNA, 19 nt, Human
aauauguggaagcaaccaa

SEQ ID NO: 2651207 - RNA, 14 nt, Human
aaucugauggccuu

SEQ ID NO: 2651208 - RNA, 15 nt, Human
aaucugauggccuua

SEQ ID NO: 2651209 - RNA, 16 nt, Human
aaucugauggccuuaa

SEQ ID NO: 2651210 - RNA, 17 nt, Human
aaucugauggccuuaau

SEQ ID NO: 2651211 - RNA, 18 nt, Human
aaucugauggccuuaauu

SEQ ID NO: 2651212 - RNA, 19 nt, Human
aaucugauggccuuaauuu

SEQ ID NO: 2651213 - RNA, 20 nt, Human
aaucugauggccuuaauuuc

SEQ ID NO: 2651214 - RNA, 21 nt, Human
aaucugauggccuuaauuucc

SEQ ID NO: 2651215 - RNA, 22 nt, Human
aaucugauggccuuaauuuccu

SEQ ID NO: 2651216 - RNA, 23 nt, Human
aaucugauggccuuaauuuccuu

SEQ ID NO: 2651217 - RNA, 15 nt, Human
aaucugagggaaaug

SEQ ID NO: 2651218 - RNA, 18 nt, Human
aaucugagggaaauguuu

SEQ ID NO: 2651219 - RNA, 19 nt, Human
aaucugagggaaauguuuu

SEQ ID NO: 2651220 - RNA, 20 nt, Human
aaucugagggaaauguuuug

SEQ ID NO: 2651221 - RNA, 21 nt, Human
aaucugagggaaauguuuugu

SEQ ID NO: 2651222 - RNA, 22 nt, Human
aaucugagggaaauguuuugua

SEQ ID NO: 2651223 - RNA, 22 nt, Human
aagugcuggcaaccacuaagaa

SEQ ID NO: 2651224 - RNA, 19 nt, Human
aagugcuggagucuccuga

SEQ ID NO: 2651225 - RNA, 23 nt, Human
aagugcuggcaaccacuaagaau

SEQ ID NO: 2651226 - RNA, 19 nt, Human
aaguggccaagaagcagug

SEQ ID NO: 2651227 - RNA, 20 nt, Human
aaguggcgugggagccagcc

SEQ ID NO: 2651228 - RNA, 21 nt, Human
aaguugaaaaucauaggcacc

SEQ ID NO: 2651229 - RNA, 22 nt, Human
aaguggaccuuaggccuuccuc

SEQ ID NO: 2651230 - RNA, 14 nt, Human
aaguuguaaaguau

SEQ ID NO: 2651231 - RNA, 17 nt, Human
aaguuguaaaguaugua

SEQ ID NO: 2651232 - RNA, 13 nt, Human
aauaaacuuuaau

SEQ ID NO: 2651233 - RNA, 18 nt, Human
aauaaaccaaaggaaaau

SEQ ID NO: 2651234 - RNA, 20 nt, Human
aauaaagaaguaugguaauc

SEQ ID NO: 2651235 - RNA, 15 nt, Human
aagcugcaaaucuga

SEQ ID NO: 2651236 - RNA, 19 nt, Human
aagcugcaaaucugauggc

SEQ ID NO: 2651237 - RNA, 19 nt, Human
aagcugcacccucaggcag

SEQ ID NO: 2651238 - RNA, 13 nt, Human
aagcugcacccuc

SEQ ID NO: 2651239 - RNA, 13 nt, Human
aaggcaagagggg

SEQ ID NO: 2651240 - RNA, 19 nt, Human
aaggcaagaggggguggag

SEQ ID NO: 2651241 - RNA, 11 nt, Human
aaggcaagcca

SEQ ID NO: 2651242 - RNA, 15 nt, Human
aaggcaagccaggcu

SEQ ID NO: 2651243 - RNA, 16 nt, Human
aaggcaagccaggcuc

SEQ ID NO: 2651244 - RNA, 23 nt, Human
aaggcaagccaggcucacucaca

SEQ ID NO: 2651245 - RNA, 14 nt, Human
aaggacuuuguaca

SEQ ID NO: 2651246 - RNA, 15 nt, Human
aaggacuuuguacau

SEQ ID NO: 2651247 - RNA, 17 nt, Human
aaggacuuuguacauuu

SEQ ID NO: 2651248 - RNA, 21 nt, Human
aaggcaagaggggguggaggg

SEQ ID NO: 2651249 - RNA, 23 nt, Human
aaggcaguagaacuccaggcccu

SEQ ID NO: 2651250 - RNA, 15 nt, Human
aagcguauggcuuua

SEQ ID NO: 2651251 - RNA, 13 nt, Human
aagcguauggcuu

SEQ ID NO: 2651252 - RNA, 14 nt, Human
aagcggcuggcagc

SEQ ID NO: 2651253 - RNA, 21 nt, Human
aagauaauauuaaggaagaca

SEQ ID NO: 2651254 - RNA, 19 nt, Human
aagauaauauuaaggaaga

SEQ ID NO: 2651255 - RNA, 16 nt, Human
aagccaggcucacuca

SEQ ID NO: 2651256 - RNA, 18 nt, Human
aagccaggcucacucaca

SEQ ID NO: 2651257 - RNA, 19 nt, Human
aagccaggcucacucacag

SEQ ID NO: 2651258 - RNA, 22 nt, Human
aagccaggcucacucacagagu

SEQ ID NO: 2651259 - RNA, 13 nt, Human
aagaagaaguuca

SEQ ID NO: 2651260 - RNA, 20 nt, Human
aagacaaugugaaaagaaaa

SEQ ID NO: 2651261 - RNA, 14 nt, Human
aagacaccugguug

SEQ ID NO: 2651262 - RNA, 19 nt, Human
aagacaaugugaaaagaaa

SEQ ID NO: 2651263 - RNA, 22 nt, Human
aagacaagaacuccccuuuuuu

SEQ ID NO: 2651264 - RNA, 17 nt, Human
aacgccuccccugcccc

SEQ ID NO: 2651265 - RNA, 21 nt, Human
aagaacguuuuuuccucagug

SEQ ID NO: 2651266 - RNA, 23 nt, Human
aagaacuauugugcucagagaca

SEQ ID NO: 2651267 - RNA, 18 nt, Human
aagaacugcaggcccugg

SEQ ID NO: 2651268 - RNA, 22 nt, Human
aagaacugcaggcccuggccuc

SEQ ID NO: 2651269 - RNA, 23 nt, Human
aagaacugcaggcccuggccucc

SEQ ID NO: 2651270 - RNA, 13 nt, Human
aagaacuggaaac

SEQ ID NO: 2651271 - RNA, 11 nt, Human
aagacacugcc

SEQ ID NO: 2651272 - RNA, 12 nt, Human
aagacacugccu

SEQ ID NO: 2651273 - RNA, 13 nt, Human
aagacacugccug

SEQ ID NO: 2651274 - RNA, 14 nt, Human
aagacacugccugg

SEQ ID NO: 2651275 - RNA, 15 nt, Human
aagacacugccuggg

SEQ ID NO: 2651276 - RNA, 16 nt, Human
aagacacugccugggc

SEQ ID NO: 2651277 - RNA, 17 nt, Human
aagacacugccugggcu

SEQ ID NO: 2651278 - RNA, 20 nt, Human
aagacaguguauguagaagc

SEQ ID NO: 2651279 - RNA, 21 nt, Human
aagacaguguauguagaagca

SEQ ID NO: 2651280 - RNA, 23 nt, Human
aagacauacuccuuccaucaaau

SEQ ID NO: 2651281 - RNA, 13 nt, Human
aagagaaaaaaua

SEQ ID NO: 2651282 - RNA, 18 nt, Human
aagaccaccacuucgaaa

SEQ ID NO: 2651283 - RNA, 22 nt, Human
aagagaguauuuuuauacaaac

SEQ ID NO: 2651284 - RNA, 15 nt, Human
aagagauaagucuuu

SEQ ID NO: 2651285 - RNA, 15 nt, Human
aagagacauccaaau

SEQ ID NO: 2651286 - RNA, 14 nt, Human
aagagauccaaaga

SEQ ID NO: 2651287 - RNA, 15 nt, Human
aagagauccaaagac

SEQ ID NO: 2651288 - RNA, 16 nt, Human
aagagauccaaagacu

SEQ ID NO: 2651289 - RNA, 17 nt, Human
aagagauccaaagacuc

SEQ ID NO: 2651290 - RNA, 18 nt, Human
aagaguuucaguuuguug

SEQ ID NO: 2651291 - RNA, 19 nt, Human
aagaguuucaguuuguugg

SEQ ID NO: 2651292 - RNA, 21 nt, Human
aagaguuucaguuuguuggaa

SEQ ID NO: 2651293 - RNA, 16 nt, Human
aagaguucccuugaaa

SEQ ID NO: 2651294 - RNA, 20 nt, Human
aagaguucccuugaaacuuu

SEQ ID NO: 2651295 - RNA, 21 nt, Human
aaauauuguugacaacuguga

SEQ ID NO: 2651296 - RNA, 17 nt, Human
aaauauuguugacaacu

SEQ ID NO: 2651297 - RNA, 15 nt, Human
aaauauuguuucugc

SEQ ID NO: 2651298 - RNA, 16 nt, Human
aaauauuguuucugca

SEQ ID NO: 2651299 - RNA, 21 nt, Human
aaauauuguuucugcauucau

SEQ ID NO: 2651300 - RNA, 22 nt, Human
aaauauuguuucugcauucauu

SEQ ID NO: 2651301 - RNA, 22 nt, Human
aaauauuguuuuacaauaguuc

SEQ ID NO: 2651302 - RNA, 21 nt, Human
aaauagauuuuauaagaugac

SEQ ID NO: 2651303 - RNA, 15 nt, Human
aaauagaugcugugu

SEQ ID NO: 2651304 - RNA, 22 nt, Human
aaauagaugcuguguauauggu

SEQ ID NO: 2651305 - RNA, 14 nt, Human
aaauagauauaaau

SEQ ID NO: 2651306 - RNA, 15 nt, Human
aaauagauauaaauu

SEQ ID NO: 2651307 - RNA, 14 nt, Human
aaauagaguguagu

SEQ ID NO: 2651308 - RNA, 18 nt, Human
aaauagaguguaguuuac

SEQ ID NO: 2651309 - RNA, 16 nt, Human
aaauauuucagugaau

SEQ ID NO: 2651310 - RNA, 12 nt, Human
aaauauuuaucu

SEQ ID NO: 2651311 - RNA, 22 nt, Human
aaauauuuugaaucaauaauau

SEQ ID NO: 2651312 - RNA, 13 nt, Human
aaauggauacugg

SEQ ID NO: 2651313 - RNA, 16 nt, Human
aaauggagaagcugca

SEQ ID NO: 2651314 - RNA, 17 nt, Human
aaauggagaagcugcag

SEQ ID NO: 2651315 - RNA, 18 nt, Human
aaauggagaagcugcagg

SEQ ID NO: 2651316 - RNA, 20 nt, Human
aaauggaggaucucuaaaga

SEQ ID NO: 2651317 - RNA, 22 nt, Human
aaauggaggaucucuaaagagc

SEQ ID NO: 2651318 - RNA, 23 nt, Human
aaauggaggaucucuaaagagca

SEQ ID NO: 2651319 - RNA, 15 nt, Human
aaaucuuuugaagca

SEQ ID NO: 2651320 - RNA, 17 nt, Human
aaaucuuuugaagcaua

SEQ ID NO: 2651321 - RNA, 10 nt, Human
aaauguuugg

SEQ ID NO: 2651322 - RNA, 19 nt, Human
aaauguuuggcauguaaau

SEQ ID NO: 2651323 - RNA, 20 nt, Human
aaauguuuggcauguaaaug

SEQ ID NO: 2651324 - RNA, 22 nt, Human
aaauguuuggcauguaaaugua

SEQ ID NO: 2651325 - RNA, 11 nt, Human
aaauguuucuu

SEQ ID NO: 2651326 - RNA, 15 nt, Human
aaauguuucuuuuaa

SEQ ID NO: 2651327 - RNA, 18 nt, Human
aaauguuucuuuuaaaga

SEQ ID NO: 2651328 - RNA, 14 nt, Human
aaauguuucuuuug

SEQ ID NO: 2651329 - RNA, 19 nt, Human
aaauguuucuuuuguuugg

SEQ ID NO: 2651330 - RNA, 17 nt, Human
aaauguuuuguaaacau

SEQ ID NO: 2651331 - RNA, 18 nt, Human
aaauguuuuguaaacauu

SEQ ID NO: 2651332 - RNA, 20 nt, Human
aaauguuuuguaaacauuua

SEQ ID NO: 2651333 - RNA, 14 nt, Human
aaauguuuuguaaa

SEQ ID NO: 2651334 - RNA, 13 nt, Human
aaauguuuuguaa

SEQ ID NO: 2651335 - RNA, 18 nt, Human
aacagccaagauuuuccu

SEQ ID NO: 2651336 - RNA, 13 nt, Human
aacaugaaucaaa

SEQ ID NO: 2651337 - RNA, 20 nt, Human
aacaugaaucaaaagugccu

SEQ ID NO: 2651338 - RNA, 16 nt, Human
aacagccucuuuuuga

SEQ ID NO: 2651339 - RNA, 12 nt, Human
aacaucuuuaag

SEQ ID NO: 2651340 - RNA, 18 nt, Human
aacaucuuuaaggggagg

SEQ ID NO: 2651341 - RNA, 15 nt, Human
aacaggccucuccau

SEQ ID NO: 2651342 - RNA, 21 nt, Human
aaauucuucuaauugcugugu

SEQ ID NO: 2651343 - RNA, 13 nt, Human
aaccuuuuacugg

SEQ ID NO: 2651344 - RNA, 19 nt, Human
aaccuuuuacugguugcau

SEQ ID NO: 2651345 - RNA, 20 nt, Human
aaccuuuuacugguugcaug

SEQ ID NO: 2651346 - RNA, 21 nt, Human
aaccuuuuacugguugcaugg

SEQ ID NO: 2651347 - RNA, 10 nt, Human
aaaagaaaca

SEQ ID NO: 2651348 - RNA, 13 nt, Human
aaaagaaaugaug

SEQ ID NO: 2651349 - RNA, 14 nt, Human
aaaagaaaugaaca

SEQ ID NO: 2651350 - RNA, 11 nt, Human
aaaagaaagca

SEQ ID NO: 2651351 - RNA, 11 nt, Human
aaaagaaugac

SEQ ID NO: 2651352 - RNA, 23 nt, Human
aaaagaaugacguuuacauauaa

SEQ ID NO: 2651353 - RNA, 19 nt, Human
aaaagacaguguauguaga

SEQ ID NO: 2651354 - RNA, 15 nt, Human
aaaacaccuucuaua

SEQ ID NO: 2651355 - RNA, 11 nt, Human
aaaagaaaaag

SEQ ID NO: 2651356 - RNA, 18 nt, Human
aaaacagaguaaucuugu

SEQ ID NO: 2651357 - RNA, 22 nt, Human
aaaacagaguaaucuuguuggu

SEQ ID NO: 2651358 - RNA, 19 nt, Human
aaaacagaguaaucuuguu

SEQ ID NO: 2651359 - RNA, 21 nt, Human
aaaagagcagugguaagaaua

SEQ ID NO: 2651360 - RNA, 19 nt, Human
aaaagaaaucauguccaua

SEQ ID NO: 2651361 - RNA, 21 nt, Human
aaaaucagccugcuccagcug

SEQ ID NO: 2651362 - RNA, 17 nt, Human
aaaaucagccugcucca

SEQ ID NO: 2651363 - RNA, 13 nt, Human
aaaaucagccugc

SEQ ID NO: 2651364 - RNA, 17 nt, Human
aaaaguugcauuuuaac

SEQ ID NO: 2651365 - RNA, 12 nt, Human
aaaauaaaacau

SEQ ID NO: 2651366 - RNA, 13 nt, Human
aaaauaaaacaua

SEQ ID NO: 2651367 - RNA, 16 nt, Human
aaaauaaaacauagca

SEQ ID NO: 2651368 - RNA, 17 nt, Human
aaaauaaaacauagcaa

SEQ ID NO: 2651369 - RNA, 18 nt, Human
aaaauaaaacauagcaaa

SEQ ID NO: 2651370 - RNA, 19 nt, Human
aaaaguauuuuuucaaguu

SEQ ID NO: 2651371 - RNA, 14 nt, Human
aaaagucugucuuu

SEQ ID NO: 2651372 - RNA, 18 nt, Human
aaaagucugucuuuccug

SEQ ID NO: 2651373 - RNA, 14 nt, Human
aaaagucagagaca

SEQ ID NO: 2651374 - RNA, 16 nt, Human
aaaagucagagacaga

SEQ ID NO: 2651375 - RNA, 22 nt, Human
aaagcauguucacccuuauagu

SEQ ID NO: 2651376 - RNA, 19 nt, Human
aaagaaaaaaaugucaaaa

SEQ ID NO: 2651377 - RNA, 16 nt, Human
aaagaaaaaaauguca

SEQ ID NO: 2651378 - RNA, 15 nt, Human
aaagaaaaaaauguc

SEQ ID NO: 2651379 - RNA, 23 nt, Human
aaacucuuaaaacccaagugccu

SEQ ID NO: 2651380 - RNA, 12 nt, Human
aaacucuuaaaa

SEQ ID NO: 2651381 - RNA, 13 nt, Human
aaaccgaauaaau

SEQ ID NO: 2651382 - RNA, 14 nt, Human
aaaccgaauaaaug

SEQ ID NO: 2651383 - RNA, 16 nt, Human
aaaccgaauaaauguu

SEQ ID NO: 2651384 - RNA, 20 nt, Human
aaaccgaguagaaaauguga

SEQ ID NO: 2651385 - RNA, 16 nt, Human
aaaccgccaaggcugg

SEQ ID NO: 2651386 - RNA, 15 nt, Human
aaaccgccaaggcug

SEQ ID NO: 2651387 - RNA, 17 nt, Human
ccccaccccccaggccu

SEQ ID NO: 2651388 - RNA, 19 nt, Human
ccccaccccggggacccug

SEQ ID NO: 2651389 - RNA, 23 nt, Human
ccccaccccggggacccugugac

SEQ ID NO: 2651390 - RNA, 22 nt, Human
ccccaacaucucccucccacau

SEQ ID NO: 2651391 - RNA, 19 nt, Human
ccccaacaucucccuccca

SEQ ID NO: 2651392 - RNA, 17 nt, Human
cccagugcaaaugcaug

SEQ ID NO: 2651393 - RNA, 19 nt, Human
cccauggagccagcucccu

SEQ ID NO: 2651394 - RNA, 13 nt, Human
cccauggagccag

SEQ ID NO: 2651395 - RNA, 10 nt, Human
cccagugcag

SEQ ID NO: 2651396 - RNA, 11 nt, Human
cccagugcaga

SEQ ID NO: 2651397 - RNA, 12 nt, Human
cccagugcagaa

SEQ ID NO: 2651398 - RNA, 15 nt, Human
cccagugcagaaugu

SEQ ID NO: 2651399 - RNA, 17 nt, Human
cccagugcagaauguaa

SEQ ID NO: 2651400 - RNA, 12 nt, Human
cccagugcaugg

SEQ ID NO: 2651401 - RNA, 14 nt, Human
cccagugcauggug

SEQ ID NO: 2651402 - RNA, 18 nt, Human
cccagugcaugguggcca

SEQ ID NO: 2651403 - RNA, 19 nt, Human
cccagugcaugguggccag

SEQ ID NO: 2651404 - RNA, 20 nt, Human
cccagugcaugguggccaga

SEQ ID NO: 2651405 - RNA, 21 nt, Human
cccagugcaugguggccagag

SEQ ID NO: 2651406 - RNA, 22 nt, Human
cccagugcaugguggccagagg

SEQ ID NO: 2651407 - RNA, 17 nt, Human
cccagugccgagaagga

SEQ ID NO: 2651408 - RNA, 18 nt, Human
cccagugccgagaaggaa

SEQ ID NO: 2651409 - RNA, 18 nt, Human
cccagguccagcucugga

SEQ ID NO: 2651410 - RNA, 17 nt, Human
cccagguccagcucugg

SEQ ID NO: 2651411 - RNA, 14 nt, Human
cccagguccagcuc

SEQ ID NO: 2651412 - RNA, 19 nt, Human
cccaguccccaccccugcc

SEQ ID NO: 2651413 - RNA, 20 nt, Human
cccaguccccaccccugccc

SEQ ID NO: 2651414 - RNA, 16 nt, Human
cccaguagaccuuguu

SEQ ID NO: 2651415 - RNA, 13 nt, Human
cccaguccccacc

SEQ ID NO: 2651416 - RNA, 14 nt, Human
cccaguccccaccc

SEQ ID NO: 2651417 - RNA, 15 nt, Human
cccaguccccacccc

SEQ ID NO: 2651418 - RNA, 18 nt, Human
cccaguccccaccccugc

SEQ ID NO: 2651419 - RNA, 18 nt, Human
cccaggggacaagggauu

SEQ ID NO: 2651420 - RNA, 17 nt, Human
cccaggcucguggacug

SEQ ID NO: 2651421 - RNA, 22 nt, Human
cccaggcucguggacugagugg

SEQ ID NO: 2651422 - RNA, 19 nt, Human
cccagggggcaugaccaga

SEQ ID NO: 2651423 - RNA, 22 nt, Human
cccagggggucucacccaugca

SEQ ID NO: 2651424 - RNA, 14 nt, Human
cccaggggucuccc

SEQ ID NO: 2651425 - RNA, 16 nt, Human
cccaggggucucccug

SEQ ID NO: 2651426 - RNA, 17 nt, Human
cccaggggucucccugg

SEQ ID NO: 2651427 - RNA, 18 nt, Human
cccaggggucucccuggc

SEQ ID NO: 2651428 - RNA, 19 nt, Human
cccaggggucucccuggcu

SEQ ID NO: 2651429 - RNA, 20 nt, Human
cccaggggucucccuggcuc

SEQ ID NO: 2651430 - RNA, 21 nt, Human
cccaggggucucccuggcucc

SEQ ID NO: 2651431 - RNA, 22 nt, Human
cccaggggucucccuggcuccc

SEQ ID NO: 2651432 - RNA, 23 nt, Human
cccaggggucucccuggcucccu

SEQ ID NO: 2651433 - RNA, 14 nt, Human
cccaggagccucac

SEQ ID NO: 2651434 - RNA, 15 nt, Human
cccaggaggcaggga

SEQ ID NO: 2651435 - RNA, 17 nt, Human
cccaggaggcagggagg

SEQ ID NO: 2651436 - RNA, 21 nt, Human
cccaggaggcagggaggcagc

SEQ ID NO: 2651437 - RNA, 22 nt, Human
cccaggaggcagggaggcagcc

SEQ ID NO: 2651438 - RNA, 23 nt, Human
cccaggaggcagggaggcagccg

SEQ ID NO: 2651439 - RNA, 17 nt, Human
cccaggagccugcccag

SEQ ID NO: 2651440 - RNA, 19 nt, Human
cccaggagccugcccagcc

SEQ ID NO: 2651441 - RNA, 11 nt, Human
cccaggcaggg

SEQ ID NO: 2651442 - RNA, 12 nt, Human
cccaggcaggga

SEQ ID NO: 2651443 - RNA, 17 nt, Human
cccaggcagggagacgg

SEQ ID NO: 2651444 - RNA, 15 nt, Human
cccagcguggccucc

SEQ ID NO: 2651445 - RNA, 16 nt, Human
cccagcucgcgggacc

SEQ ID NO: 2651446 - RNA, 12 nt, Human
cccagccugcua

SEQ ID NO: 2651447 - RNA, 21 nt, Human
cccagccugcuagcuagcuca

SEQ ID NO: 2651448 - RNA, 16 nt, Human
cccagccugcuagcua

SEQ ID NO: 2651449 - RNA, 15 nt, Human
cccagccugcuagcu

SEQ ID NO: 2651450 - RNA, 14 nt, Human
cccagccugcuagc

SEQ ID NO: 2651451 - RNA, 11 nt, Human
cccagccugcu

SEQ ID NO: 2651452 - RNA, 11 nt, Human
cccagccugcg

SEQ ID NO: 2651453 - RNA, 23 nt, Human
cccagccugcgccugcugcaugc

SEQ ID NO: 2651454 - RNA, 22 nt, Human
cccagccugcgccugcugcaug

SEQ ID NO: 2651455 - RNA, 19 nt, Human
cccagccugcgccugcugc

SEQ ID NO: 2651456 - RNA, 18 nt, Human
cccagccugcgccugcug

SEQ ID NO: 2651457 - RNA, 15 nt, Human
cccagccccggggug

SEQ ID NO: 2651458 - RNA, 22 nt, Human
cccagccccgacuccagccagc

SEQ ID NO: 2651459 - RNA, 23 nt, Human
cccagccccgacuccagccagcg

SEQ ID NO: 2651460 - RNA, 16 nt, Human
cccaauguaggagcug

SEQ ID NO: 2651461 - RNA, 16 nt, Human
cccacacccaaagcug

SEQ ID NO: 2651462 - RNA, 18 nt, Human
ccauaguuuggcauuugc

SEQ ID NO: 2651463 - RNA, 13 nt, Human
ccaucaccagaca

SEQ ID NO: 2651464 - RNA, 18 nt, Human
ccagugagggacgucaga

SEQ ID NO: 2651465 - RNA, 15 nt, Human
ccagugaagauauuu

SEQ ID NO: 2651466 - RNA, 22 nt, Human
ccagugagggacgucagacuug

SEQ ID NO: 2651467 - RNA, 13 nt, Human
ccaucucccugcc

SEQ ID NO: 2651468 - RNA, 14 nt, Human
ccaucucccugccu

SEQ ID NO: 2651469 - RNA, 16 nt, Human
ccaucucccugccugg

SEQ ID NO: 2651470 - RNA, 17 nt, Human
ccaucucccugccuggc

SEQ ID NO: 2651471 - RNA, 18 nt, Human
ccaucucccugccuggcc

SEQ ID NO: 2651472 - RNA, 23 nt, Human
ccaucuccccucagcucggcuca

SEQ ID NO: 2651473 - RNA, 18 nt, Human
ccaucuccccucagcucg

SEQ ID NO: 2651474 - RNA, 17 nt, Human
ccaucuccccucagcuc

SEQ ID NO: 2651475 - RNA, 16 nt, Human
ccaucuccccucagcu

SEQ ID NO: 2651476 - RNA, 15 nt, Human
ccaucuccccucagc

SEQ ID NO: 2651477 - RNA, 14 nt, Human
ccaucuccccucag

SEQ ID NO: 2651478 - RNA, 19 nt, Human
ccaucaggguucucuuagc

SEQ ID NO: 2651479 - RNA, 20 nt, Human
ccaucaggguucucuuagca

SEQ ID NO: 2651480 - RNA, 15 nt, Human
ccauccaaggccagg

SEQ ID NO: 2651481 - RNA, 21 nt, Human
ccaugauuaaccacuucagcu

SEQ ID NO: 2651482 - RNA, 19 nt, Human
ccaugauuaaccacuucag

SEQ ID NO: 2651483 - RNA, 15 nt, Human
ccaugcaagcagagg

SEQ ID NO: 2651484 - RNA, 16 nt, Human
ccaugcaagcagagga

SEQ ID NO: 2651485 - RNA, 17 nt, Human
ccaugcaagcagaggac

SEQ ID NO: 2651486 - RNA, 19 nt, Human
ccaugcaagcagaggacca

SEQ ID NO: 2651487 - RNA, 20 nt, Human
ccaugcaagcagaggaccag

SEQ ID NO: 2651488 - RNA, 23 nt, Human
ccaugcaagcagaggaccagggc

SEQ ID NO: 2651489 - RNA, 18 nt, Human
ccaugaagggacccuuug

SEQ ID NO: 2651490 - RNA, 17 nt, Human
ccaugccgucugccgga

SEQ ID NO: 2651491 - RNA, 22 nt, Human
ccaugcgcucagggccaugcug

SEQ ID NO: 2651492 - RNA, 13 nt, Human
ccaugcucaucug

SEQ ID NO: 2651493 - RNA, 16 nt, Human
ccaugcucaucugcug

SEQ ID NO: 2651494 - RNA, 22 nt, Human
ccaugcgcccccuccgcccugc

SEQ ID NO: 2651495 - RNA, 13 nt, Human
ccaugcgcucagg

SEQ ID NO: 2651496 - RNA, 15 nt, Human
ccaugcgcucagggc

SEQ ID NO: 2651497 - RNA, 16 nt, Human
ccaugcgcucagggcc

SEQ ID NO: 2651498 - RNA, 12 nt, Human
ccaugccagcug

SEQ ID NO: 2651499 - RNA, 14 nt, Human
ccaugccagcuggc

SEQ ID NO: 2651500 - RNA, 15 nt, Human
ccaugccagcuggcc

SEQ ID NO: 2651501 - RNA, 20 nt, Human
ccaugcugaggccugggccg

SEQ ID NO: 2651502 - RNA, 18 nt, Human
ccaugcugaggccugggc

SEQ ID NO: 2651503 - RNA, 19 nt, Human
ccaugcugaggccugggcc

SEQ ID NO: 2651504 - RNA, 17 nt, Human
ccaugcucaucugcugg

SEQ ID NO: 2651505 - RNA, 18 nt, Human
ccaugcucaucugcuggu

SEQ ID NO: 2651506 - RNA, 20 nt, Human
ccaugcucaucugcuggucc

SEQ ID NO: 2651507 - RNA, 19 nt, Human
ccaugcuuacgugauccuc

SEQ ID NO: 2651508 - RNA, 23 nt, Human
cccaaacuguugauuauuagcca

SEQ ID NO: 2651509 - RNA, 19 nt, Human
cccaaacccaagugccuuc

SEQ ID NO: 2651510 - RNA, 17 nt, Human
cccaaagauagacaggu

SEQ ID NO: 2651511 - RNA, 21 nt, Human
cccaaagauagacagguccug

SEQ ID NO: 2651512 - RNA, 12 nt, Human
ccagggccuuuu

SEQ ID NO: 2651513 - RNA, 20 nt, Human
ccagggccuuuucuggcacc

SEQ ID NO: 2651514 - RNA, 21 nt, Human
ccagggccuuuucuggcaccg

SEQ ID NO: 2651515 - RNA, 18 nt, Human
ccagguccagcucuggag

SEQ ID NO: 2651516 - RNA, 16 nt, Human
ccagguccagcucugg

SEQ ID NO: 2651517 - RNA, 17 nt, Human
ccagguccagcucugga

SEQ ID NO: 2651518 - RNA, 19 nt, Human
ccagguccagcucuggagg

SEQ ID NO: 2651519 - RNA, 13 nt, Human
ccagguccagcuc

SEQ ID NO: 2651520 - RNA, 14 nt, Human
ccagguccagcucu

SEQ ID NO: 2651521 - RNA, 15 nt, Human
ccagguccagcucug

SEQ ID NO: 2651522 - RNA, 22 nt, Human
ccaguagaccuuguuacuucug

SEQ ID NO: 2651523 - RNA, 21 nt, Human
ccagucuguggaucagagaug

SEQ ID NO: 2651524 - RNA, 12 nt, Human
ccaguaagauca

SEQ ID NO: 2651525 - RNA, 21 nt, Human
ccaguaagaucacuguuuaga

SEQ ID NO: 2651526 - RNA, 17 nt, Human
ccaguaagaucacuguu

SEQ ID NO: 2651527 - RNA, 16 nt, Human
ccaguaagaucacugu

SEQ ID NO: 2651528 - RNA, 15 nt, Human
ccaguaagaucacug

SEQ ID NO: 2651529 - RNA, 14 nt, Human
ccaguaagaucacu

SEQ ID NO: 2651530 - RNA, 14 nt, Human
ccaggcuuggccuu

SEQ ID NO: 2651531 - RNA, 15 nt, Human
ccaggagcaggcacg

SEQ ID NO: 2651532 - RNA, 16 nt, Human
ccaggagcaggcacgg

SEQ ID NO: 2651533 - RNA, 20 nt, Human
ccaggaggcagggaggcagc

SEQ ID NO: 2651534 - RNA, 21 nt, Human
ccaggaggcagggaggcagcc

SEQ ID NO: 2651535 - RNA, 22 nt, Human
ccaggaggcagggaggcagccg

SEQ ID NO: 2651536 - RNA, 13 nt, Human
ccaggcauggugg

SEQ ID NO: 2651537 - RNA, 15 nt, Human
ccagcugccuauuga

SEQ ID NO: 2651538 - RNA, 16 nt, Human
ccagcugcgcuugcuu

SEQ ID NO: 2651539 - RNA, 17 nt, Human
ccagcugcgcuugcuuu

SEQ ID NO: 2651540 - RNA, 18 nt, Human
ccagcugcgcuugcuuuu

SEQ ID NO: 2651541 - RNA, 16 nt, Human
ccagcugcccuuccgc

SEQ ID NO: 2651542 - RNA, 17 nt, Human
ccagcugcccuuccgca

SEQ ID NO: 2651543 - RNA, 20 nt, Human
ccagcugcccuuccgcagug

SEQ ID NO: 2651544 - RNA, 21 nt, Human
ccagcugcccuuccgcagugu

SEQ ID NO: 2651545 - RNA, 22 nt, Human
ccagcugcuccgaggacccagg

SEQ ID NO: 2651546 - RNA, 21 nt, Human
ccagcugcgcuugcuuuucug

SEQ ID NO: 2651547 - RNA, 19 nt, Human
ccagcugcgcuugcuuuuc

SEQ ID NO: 2651548 - RNA, 20 nt, Human
ccagcugcgcuugcuuuucu

SEQ ID NO: 2651549 - RNA, 14 nt, Human
ccagcucuggaggg

SEQ ID NO: 2651550 - RNA, 19 nt, Human
ccagcucuggaggggaggg

SEQ ID NO: 2651551 - RNA, 11 nt, Human
ccaggaagccg

SEQ ID NO: 2651552 - RNA, 22 nt, Human
ccaggaagccguccuggcgccu

SEQ ID NO: 2651553 - RNA, 16 nt, Human
ccaggaagccguccug

SEQ ID NO: 2651554 - RNA, 15 nt, Human
ccaggaagcccagga

SEQ ID NO: 2651555 - RNA, 18 nt, Human
ccaggaagcccaggagcc

SEQ ID NO: 2651556 - RNA, 20 nt, Human
ccaggacaugcaauaaaauu

SEQ ID NO: 2651557 - RNA, 23 nt, Human
ccaggacaugcaauaaaauuuaa

SEQ ID NO: 2651558 - RNA, 22 nt, Human
ccacucacuaggcccccacuug

SEQ ID NO: 2651559 - RNA, 18 nt, Human
ccacuaugacagaggauu

SEQ ID NO: 2651560 - RNA, 17 nt, Human
ccacuacaccuggcuga

SEQ ID NO: 2651561 - RNA, 20 nt, Human
ccacgggacaucacagggug

SEQ ID NO: 2651562 - RNA, 22 nt, Human
ccacgggacaucacaggguggg

SEQ ID NO: 2651563 - RNA, 12 nt, Human
ccaccccaggac

SEQ ID NO: 2651564 - RNA, 13 nt, Human
ccaccccaggacg

SEQ ID NO: 2651565 - RNA, 13 nt, Human
ccaccccaagaga

SEQ ID NO: 2651566 - RNA, 15 nt, Human
ccaccccaagagaac

SEQ ID NO: 2651567 - RNA, 17 nt, Human
ccaccccaagagaacuc

SEQ ID NO: 2651568 - RNA, 19 nt, Human
ccaccccaagagaacucgc

SEQ ID NO: 2651569 - RNA, 15 nt, Human
ccacuacaccuggcu

SEQ ID NO: 2651570 - RNA, 16 nt, Human
ccacuacaccuggcug

SEQ ID NO: 2651571 - RNA, 13 nt, Human
ccacuaaugcaaa

SEQ ID NO: 2651572 - RNA, 13 nt, Human
ccacuacaccugg

SEQ ID NO: 2651573 - RNA, 14 nt, Human
ccacuacaccuggc

SEQ ID NO: 2651574 - RNA, 23 nt, Human
ccacugcacuccagccuggguga

SEQ ID NO: 2651575 - RNA, 18 nt, Human
ccagaaauggugagaugu

SEQ ID NO: 2651576 - RNA, 13 nt, Human
ccacuucacugcg

SEQ ID NO: 2651577 - RNA, 14 nt, Human
ccacuucagcugac

SEQ ID NO: 2651578 - RNA, 13 nt, Human
ccacuucagcuga

SEQ ID NO: 2651579 - RNA, 21 nt, Human
ccagaagagaauuaagcccua

SEQ ID NO: 2651580 - RNA, 22 nt, Human
ccagaaguuugagaucagccug

SEQ ID NO: 2651581 - RNA, 23 nt, Human
ccagaaguuugagaucagccugg

SEQ ID NO: 2651582 - RNA, 17 nt, Human
ccacaggacccucgccg

SEQ ID NO: 2651583 - RNA, 19 nt, Human
ccacaccccaacacuucca

SEQ ID NO: 2651584 - RNA, 21 nt, Human
ccacaccccaacacuuccagc

SEQ ID NO: 2651585 - RNA, 19 nt, Human
ccacaguagaacugucugu

SEQ ID NO: 2651586 - RNA, 20 nt, Human
ccacaguagaacugucugug

SEQ ID NO: 2651587 - RNA, 14 nt, Human
ccacaguugcucua

SEQ ID NO: 2651588 - RNA, 16 nt, Human
ccacauugaagaaugu

SEQ ID NO: 2651589 - RNA, 14 nt, Human
ccaccaaaaacaaa

SEQ ID NO: 2651590 - RNA, 13 nt, Human
ccacauguccagc

SEQ ID NO: 2651591 - RNA, 18 nt, Human
ccacauggcggagaguuu

SEQ ID NO: 2651592 - RNA, 12 nt, Human
ccaccccaacau

SEQ ID NO: 2651593 - RNA, 16 nt, Human
ccacccaggaggcagg

SEQ ID NO: 2651594 - RNA, 21 nt, Human
ccacccaacccuaucuccuga

SEQ ID NO: 2651595 - RNA, 16 nt, Human
ccacccaacccuaucu

SEQ ID NO: 2651596 - RNA, 19 nt, Human
ccacccaacccuaucuccu

SEQ ID NO: 2651597 - RNA, 21 nt, Human
ccacccaaccccaagccagcc

SEQ ID NO: 2651598 - RNA, 13 nt, Human
ccacccaacccua

SEQ ID NO: 2651599 - RNA, 16 nt, Human
ccaccaugccucacua

SEQ ID NO: 2651600 - RNA, 22 nt, Human
ccaaagccuccuccagccgcca

SEQ ID NO: 2651601 - RNA, 17 nt, Human
ccaaagccuccuccagc

SEQ ID NO: 2651602 - RNA, 14 nt, Human
ccaaaggaaaaugu

SEQ ID NO: 2651603 - RNA, 20 nt, Human
ccaaaggaaaaugucuguaa

SEQ ID NO: 2651604 - RNA, 18 nt, Human
ccaaagcugcccacuguu

SEQ ID NO: 2651605 - RNA, 20 nt, Human
ccaaagcugcccacuguuuc

SEQ ID NO: 2651606 - RNA, 21 nt, Human
ccaaagcugcccacuguuucu

SEQ ID NO: 2651607 - RNA, 14 nt, Human
ccaaagcugagccu

SEQ ID NO: 2651608 - RNA, 15 nt, Human
ccaaagcugagccug

SEQ ID NO: 2651609 - RNA, 20 nt, Human
ccaaagcugagccugcaggg

SEQ ID NO: 2651610 - RNA, 21 nt, Human
ccaaagcugagccugcaggga

SEQ ID NO: 2651611 - RNA, 13 nt, Human
ccaaagcugccca

SEQ ID NO: 2651612 - RNA, 21 nt, Human
ccaacaagauugcuuaauaaa

SEQ ID NO: 2651613 - RNA, 14 nt, Human
ccaacaagcagcug

SEQ ID NO: 2651614 - RNA, 12 nt, Human
ccaacacuucca

SEQ ID NO: 2651615 - RNA, 13 nt, Human
ccaacacuuccag

SEQ ID NO: 2651616 - RNA, 17 nt, Human
ccaaccagaccuggaag

SEQ ID NO: 2651617 - RNA, 13 nt, Human
ccaagagaacucg

SEQ ID NO: 2651618 - RNA, 23 nt, Human
ccaagagaacucgcgcucaguaa

SEQ ID NO: 2651619 - RNA, 23 nt, Human
ccaacccuaucuccugacagaag

SEQ ID NO: 2651620 - RNA, 19 nt, Human
ccaacccuaucuccugaca

SEQ ID NO: 2651621 - RNA, 20 nt, Human
ccaacccuaucuccugacag

SEQ ID NO: 2651622 - RNA, 11 nt, Human
ccaagaaugua

SEQ ID NO: 2651623 - RNA, 12 nt, Human
ccaagaauguac

SEQ ID NO: 2651624 - RNA, 17 nt, Human
ccaagaauguacgucca

SEQ ID NO: 2651625 - RNA, 18 nt, Human
ccaagaauguacguccag

SEQ ID NO: 2651626 - RNA, 21 nt, Human
ccaagaauguacguccagccu

SEQ ID NO: 2651627 - RNA, 15 nt, Human
ccaagaauauugcaa

SEQ ID NO: 2651628 - RNA, 16 nt, Human
ccaagaauauugcaaa

SEQ ID NO: 2651629 - RNA, 21 nt, Human
ccaagaauauugcaaaauaca

SEQ ID NO: 2651630 - RNA, 22 nt, Human
ccaagaauauugcaaaauacau

SEQ ID NO: 2651631 - RNA, 23 nt, Human
ccaagaauauugcaaaauacaug

SEQ ID NO: 2651632 - RNA, 12 nt, Human
ccaagaaugcaa

SEQ ID NO: 2651633 - RNA, 20 nt, Human
ccaagaaugcaagauuucag

SEQ ID NO: 2651634 - RNA, 17 nt, Human
ccaagauuuaaaugcca

SEQ ID NO: 2651635 - RNA, 19 nt, Human
ccaagauuuaaaugccaua

SEQ ID NO: 2651636 - RNA, 16 nt, Human
ccaagauuuuccucuu

SEQ ID NO: 2651637 - RNA, 19 nt, Human
ccaagauuuuccucuugug

SEQ ID NO: 2651638 - RNA, 20 nt, Human
ccaagauuuuccucuuguga

SEQ ID NO: 2651639 - RNA, 22 nt, Human
ccaagauuuuccucuugugauu

SEQ ID NO: 2651640 - RNA, 13 nt, Human
ccaagcaucuugg

SEQ ID NO: 2651641 - RNA, 22 nt, Human
ccaagcaucuuggggggguggc

SEQ ID NO: 2651642 - RNA, 23 nt, Human
ccaagcaucuuggggggguggcc

SEQ ID NO: 2651643 - RNA, 22 nt, Human
ccaagauauuuuuaucccaaga

SEQ ID NO: 2651644 - RNA, 16 nt, Human
ccaagccagaggcugg

SEQ ID NO: 2651645 - RNA, 17 nt, Human
ccaagccagaggcuggg

SEQ ID NO: 2651646 - RNA, 19 nt, Human
ccaagccagaggcuggguu

SEQ ID NO: 2651647 - RNA, 18 nt, Human
ccaagccaagggaaccug

SEQ ID NO: 2651648 - RNA, 20 nt, Human
ccaagccaagggaaccugug

SEQ ID NO: 2651649 - RNA, 22 nt, Human
ccaagccaagggaaccuguguc

SEQ ID NO: 2651650 - RNA, 23 nt, Human
ccaagccaagggaaccugugucc

SEQ ID NO: 2651651 - RNA, 20 nt, Human
ccaagccuccacagcgaggg

SEQ ID NO: 2651652 - RNA, 13 nt, Human
ccaagccuccaca

SEQ ID NO: 2651653 - RNA, 14 nt, Human
ccaagccuccacag

SEQ ID NO: 2651654 - RNA, 15 nt, Human
ccaagccuccacagc

SEQ ID NO: 2651655 - RNA, 16 nt, Human
ccaagccuccacagcg

SEQ ID NO: 2651656 - RNA, 18 nt, Human
ccaagccuccacagcgag

SEQ ID NO: 2651657 - RNA, 19 nt, Human
ccaagccuccacagcgagg

SEQ ID NO: 2651658 - RNA, 17 nt, Human
ccaagcuauucaauucu

SEQ ID NO: 2651659 - RNA, 17 nt, Human
ccaagggaaaggggugc

SEQ ID NO: 2651660 - RNA, 21 nt, Human
ccaagggaaaggggugcuuuu

SEQ ID NO: 2651661 - RNA, 22 nt, Human
ccaagggaaaggggugcuuuua

SEQ ID NO: 2651662 - RNA, 16 nt, Human
ccaagggaaccugugu

SEQ ID NO: 2651663 - RNA, 17 nt, Human
ccaagggaaccuguguc

SEQ ID NO: 2651664 - RNA, 18 nt, Human
ccaagggaaccugugucc

SEQ ID NO: 2651665 - RNA, 19 nt, Human
ccaagggaaccuguguccg

SEQ ID NO: 2651666 - RNA, 18 nt, Human
ccaagggccgacuaagag

SEQ ID NO: 2651667 - RNA, 13 nt, Human
ccaagggcccaaa

SEQ ID NO: 2651668 - RNA, 13 nt, Human
ccaaggugggagg

SEQ ID NO: 2651669 - RNA, 18 nt, Human
ccaaggugggaggauugc

SEQ ID NO: 2651670 - RNA, 16 nt, Human
ccaaggucuucuuaau

SEQ ID NO: 2651671 - RNA, 19 nt, Human
ccaagguuuuauaaggcug

SEQ ID NO: 2651672 - RNA, 20 nt, Human
ccaagguuuuauaaggcuga

SEQ ID NO: 2651673 - RNA, 21 nt, Human
ccaagguuuuauaaggcugau

SEQ ID NO: 2651674 - RNA, 20 nt, Human
ccaaguaacugggauuacag

SEQ ID NO: 2651675 - RNA, 21 nt, Human
ccaaguauagccuauggcaga

SEQ ID NO: 2651676 - RNA, 20 nt, Human
ccaagucacacgcuuuugaa

SEQ ID NO: 2651677 - RNA, 20 nt, Human
ccaagucaagugaaaaagga

SEQ ID NO: 2651678 - RNA, 22 nt, Human
ccaauaauaaaugcccucuucu

SEQ ID NO: 2651679 - RNA, 23 nt, Human
ccaauaauaaaugcccucuucuc

SEQ ID NO: 2651680 - RNA, 19 nt, Human
cauuguucuuauucuggca

SEQ ID NO: 2651681 - RNA, 20 nt, Human
cauuguucuuauucuggcau

SEQ ID NO: 2651682 - RNA, 19 nt, Human
cauugucuccuauauauuu

SEQ ID NO: 2651683 - RNA, 21 nt, Human
cauugucuccuauauauuucu

SEQ ID NO: 2651684 - RNA, 22 nt, Human
cauugucguauaggcauguaaa

SEQ ID NO: 2651685 - RNA, 21 nt, Human
cauuuagggaguauucuaaua

SEQ ID NO: 2651686 - RNA, 20 nt, Human
cauuuagggaguauucuaau

SEQ ID NO: 2651687 - RNA, 17 nt, Human
cauuuagggaguauucu

SEQ ID NO: 2651688 - RNA, 14 nt, Human
cauuuagcuggcca

SEQ ID NO: 2651689 - RNA, 21 nt, Human
cauuuagcuggccacauggcg

SEQ ID NO: 2651690 - RNA, 13 nt, Human
cauuuaauagacu

SEQ ID NO: 2651691 - RNA, 14 nt, Human
cauuucuauaaaua

SEQ ID NO: 2651692 - RNA, 13 nt, Human
cauuucuaauuaa

SEQ ID NO: 2651693 - RNA, 23 nt, Human
cauuucuaauuaaccuuacuaau

SEQ ID NO: 2651694 - RNA, 18 nt, Human
cauuuccucgcagccucu

SEQ ID NO: 2651695 - RNA, 12 nt, Human
cauuugcucuuc

SEQ ID NO: 2651696 - RNA, 19 nt, Human
cauuugcucuucagaugcc

SEQ ID NO: 2651697 - RNA, 20 nt, Human
cauuugcucuucagaugcca

SEQ ID NO: 2651698 - RNA, 22 nt, Human
cauuugcucuucagaugccacu

SEQ ID NO: 2651699 - RNA, 15 nt, Human
cauuugcuacuguug

SEQ ID NO: 2651700 - RNA, 18 nt, Human
cauuugcuacuguuguaa

SEQ ID NO: 2651701 - RNA, 22 nt, Human
cauuugcuacuguuguaagaau

SEQ ID NO: 2651702 - RNA, 17 nt, Human
cauuugccaauuuuccu

SEQ ID NO: 2651703 - RNA, 17 nt, Human
cauuuuucaauagcaca

SEQ ID NO: 2651704 - RNA, 14 nt, Human
cauuuuucaauaua

SEQ ID NO: 2651705 - RNA, 15 nt, Human
cauuuuucaauauau

SEQ ID NO: 2651706 - RNA, 21 nt, Human
cauuuuucaauauauugaacu

SEQ ID NO: 2651707 - RNA, 10 nt, Human
cauuuuucaa

SEQ ID NO: 2651708 - RNA, 21 nt, Human
cggcaguauugaagcucguga

SEQ ID NO: 2651709 - RNA, 15 nt, Human
cggcaggggccugga

SEQ ID NO: 2651710 - RNA, 17 nt, Human
cggcaggggccuggaga

SEQ ID NO: 2651711 - RNA, 18 nt, Human
cggcaggggccuggagau

SEQ ID NO: 2651712 - RNA, 19 nt, Human
cggcaggggccuggagauc

SEQ ID NO: 2651713 - RNA, 22 nt, Human
cggccccagcaccucagccugc

SEQ ID NO: 2651714 - RNA, 12 nt, Human
cggcccccugcc

SEQ ID NO: 2651715 - RNA, 15 nt, Human
cggccuuuggcuuca

SEQ ID NO: 2651716 - RNA, 16 nt, Human
cgggaggucgaggcag

SEQ ID NO: 2651717 - RNA, 17 nt, Human
cgggaggucgaggcagg

SEQ ID NO: 2651718 - RNA, 22 nt, Human
cgggaggcggagcuugcaguga

SEQ ID NO: 2651719 - RNA, 17 nt, Human
cggaacccaagcuuaga

SEQ ID NO: 2651720 - RNA, 19 nt, Human
cggaacccaagcuuagaac

SEQ ID NO: 2651721 - RNA, 15 nt, Human
cgcgucgccgccacc

SEQ ID NO: 2651722 - RNA, 19 nt, Human
cggaaacuaguguacauuu

SEQ ID NO: 2651723 - RNA, 21 nt, Human
cgcuagguagagucugagggc

SEQ ID NO: 2651724 - RNA, 20 nt, Human
cgcuagguagagucugaggg

SEQ ID NO: 2651725 - RNA, 13 nt, Human
cggaauuuaccug

SEQ ID NO: 2651726 - RNA, 19 nt, Human
cggaauuuaccugauuucu

SEQ ID NO: 2651727 - RNA, 14 nt, Human
cggcaggcucacug

SEQ ID NO: 2651728 - RNA, 17 nt, Human
cggcaggcucacugcca

SEQ ID NO: 2651729 - RNA, 18 nt, Human
cggcaggcucacugccag

SEQ ID NO: 2651730 - RNA, 19 nt, Human
cggcaggcucacugccagg

SEQ ID NO: 2651731 - RNA, 23 nt, Human
cggcaggcucacugccaggccag

SEQ ID NO: 2651732 - RNA, 20 nt, Human
cggcaggcucacugccaggc

SEQ ID NO: 2651733 - RNA, 22 nt, Human
cggcaggcucacugccaggcca

SEQ ID NO: 2651734 - RNA, 14 nt, Human
cggcaggggccugg

SEQ ID NO: 2651735 - RNA, 20 nt, Human
cggacccggaggccgaggcc

SEQ ID NO: 2651736 - RNA, 16 nt, Human
cggacccucuaaccuc

SEQ ID NO: 2651737 - RNA, 15 nt, Human
cggaccccagccauc

SEQ ID NO: 2651738 - RNA, 20 nt, Human
cgcagaacgaaccuuggccu

SEQ ID NO: 2651739 - RNA, 19 nt, Human
cgcagaacgaaccuuggcc

SEQ ID NO: 2651740 - RNA, 23 nt, Human
cgcagaacgaaccuuggccuggg

SEQ ID NO: 2651741 - RNA, 14 nt, Human
cgauuuaagguauu

SEQ ID NO: 2651742 - RNA, 16 nt, Human
cgagggcagcugcuau

SEQ ID NO: 2651743 - RNA, 13 nt, Human
cgaucucuccugg

SEQ ID NO: 2651744 - RNA, 15 nt, Human
cgaucucuccuggcc

SEQ ID NO: 2651745 - RNA, 16 nt, Human
cgaucucuccuggccu

SEQ ID NO: 2651746 - RNA, 17 nt, Human
cgaucucuccuggccua

SEQ ID NO: 2651747 - RNA, 20 nt, Human
cgaucuugguucacugcaac

SEQ ID NO: 2651748 - RNA, 13 nt, Human
cgagggcagcugc

SEQ ID NO: 2651749 - RNA, 21 nt, Human
ccuuuggaaagcucugaccac

SEQ ID NO: 2651750 - RNA, 14 nt, Human
ccuuuguaagugca

SEQ ID NO: 2651751 - RNA, 16 nt, Human
ccuuuguaagugcagg

SEQ ID NO: 2651752 - RNA, 15 nt, Human
ccuuucucucucuaa

SEQ ID NO: 2651753 - RNA, 15 nt, Human
ccuuguuacuucuga

SEQ ID NO: 2651754 - RNA, 15 nt, Human
ccuuggcucagacau

SEQ ID NO: 2651755 - RNA, 12 nt, Human
ccuuggcucaga

SEQ ID NO: 2651756 - RNA, 15 nt, Human
ccuuugcagcucaga

SEQ ID NO: 2651757 - RNA, 11 nt, Human
ccuuugcuguc

SEQ ID NO: 2651758 - RNA, 18 nt, Human
ccuuugcugucccauagu

SEQ ID NO: 2651759 - RNA, 12 nt, Human
cgcccugccacu

SEQ ID NO: 2651760 - RNA, 16 nt, Human
cgcgaccauguggcca

SEQ ID NO: 2651761 - RNA, 17 nt, Human
cgcgugccguggcacca

SEQ ID NO: 2651762 - RNA, 17 nt, Human
cgcccguccugccugug

SEQ ID NO: 2651763 - RNA, 20 nt, Human
cgcccucuccuuuguucccg

SEQ ID NO: 2651764 - RNA, 11 nt, Human
cgcccucuccu

SEQ ID NO: 2651765 - RNA, 19 nt, Human
cgcccccuccgcccugcca

SEQ ID NO: 2651766 - RNA, 20 nt, Human
cgcccccuccgcccugccac

SEQ ID NO: 2651767 - RNA, 18 nt, Human
cgcccccaguccccaccc

SEQ ID NO: 2651768 - RNA, 22 nt, Human
cgcccccaguccccaccccugc

SEQ ID NO: 2651769 - RNA, 17 nt, Human
cgcccccuccgcccugc

SEQ ID NO: 2651770 - RNA, 11 nt, Human
cgcccugccac

SEQ ID NO: 2651771 - RNA, 16 nt, Human
cgccccaucugcccca

SEQ ID NO: 2651772 - RNA, 17 nt, Human
cgcagacaccuuggaca

SEQ ID NO: 2651773 - RNA, 16 nt, Human
cguuuuccccaugaca

SEQ ID NO: 2651774 - RNA, 14 nt, Human
cguuuuccccauga

SEQ ID NO: 2651775 - RNA, 21 nt, Human
cguuccaccccaagagaacuc

SEQ ID NO: 2651776 - RNA, 21 nt, Human
cguuucuuuaaccuuguauaa

SEQ ID NO: 2651777 - RNA, 22 nt, Human
cguuucuuuaaccuuguauaaa

SEQ ID NO: 2651778 - RNA, 20 nt, Human
cguucuguacuguuacuggg

SEQ ID NO: 2651779 - RNA, 23 nt, Human
cguucuguacuguuacugggccc

SEQ ID NO: 2651780 - RNA, 22 nt, Human
cguuucagcgacuccguuggcc

SEQ ID NO: 2651781 - RNA, 18 nt, Human
cguuuauaaacagaaaug

SEQ ID NO: 2651782 - RNA, 14 nt, Human
cgugaagaagccug

SEQ ID NO: 2651783 - RNA, 21 nt, Human
cguggccucccaaagugcugg

SEQ ID NO: 2651784 - RNA, 20 nt, Human
cguggcucgacuauagaaaa

SEQ ID NO: 2651785 - RNA, 15 nt, Human
cgugccuguguccau

SEQ ID NO: 2651786 - RNA, 12 nt, Human
cgugccuguguc

SEQ ID NO: 2651787 - RNA, 14 nt, Human
cgugccugugucca

SEQ ID NO: 2651788 - RNA, 13 nt, Human
cguccaucucccu

SEQ ID NO: 2651789 - RNA, 15 nt, Human
cgucccaagauguug

SEQ ID NO: 2651790 - RNA, 22 nt, Human
cguccaggccgcgcccuuuccc

SEQ ID NO: 2651791 - RNA, 13 nt, Human
cguccagccugcc

SEQ ID NO: 2651792 - RNA, 16 nt, Human
cguccagcugcccuuc

SEQ ID NO: 2651793 - RNA, 17 nt, Human
cguccagcugcccuucc

SEQ ID NO: 2651794 - RNA, 21 nt, Human
cguccaggccgcgcccuuucc

SEQ ID NO: 2651795 - RNA, 15 nt, Human
cguauggcuuuauuu

SEQ ID NO: 2651796 - RNA, 15 nt, Human
cguaucuccggcucc

SEQ ID NO: 2651797 - RNA, 15 nt, Human
cguauaggcauguaa

SEQ ID NO: 2651798 - RNA, 16 nt, Human
cguauaggcauguaaa

SEQ ID NO: 2651799 - RNA, 22 nt, Human
cguaucuccggcucccagccuc

SEQ ID NO: 2651800 - RNA, 21 nt, Human
cguaucuccggcucccagccu

SEQ ID NO: 2651801 - RNA, 18 nt, Human
cguaucuccggcucccag

SEQ ID NO: 2651802 - RNA, 17 nt, Human
cgucaacgugcauuuua

SEQ ID NO: 2651803 - RNA, 12 nt, Human
cgucaccaccac

SEQ ID NO: 2651804 - RNA, 13 nt, Human
cgucaccaccacc

SEQ ID NO: 2651805 - RNA, 15 nt, Human
cgucaccaccacccc

SEQ ID NO: 2651806 - RNA, 21 nt, Human
cgucaccaccaccccuaccac

SEQ ID NO: 2651807 - RNA, 18 nt, Human
cggugcucggagaagagc

SEQ ID NO: 2651808 - RNA, 16 nt, Human
cggugcugugagggag

SEQ ID NO: 2651809 - RNA, 18 nt, Human
cggugcugugagggaggg

SEQ ID NO: 2651810 - RNA, 19 nt, Human
cggugcugugagggagggg

SEQ ID NO: 2651811 - RNA, 21 nt, Human
cggggcccagggcaagcuccg

SEQ ID NO: 2651812 - RNA, 20 nt, Human
cggggcccagggcaagcucc

SEQ ID NO: 2651813 - RNA, 14 nt, Human
cggggcccagggca

SEQ ID NO: 2651814 - RNA, 21 nt, Human
cguaggaugaaaagauucuuc

SEQ ID NO: 2651815 - RNA, 15 nt, Human
cgugccgccugcacu

SEQ ID NO: 2651816 - RNA, 16 nt, Human
cgugccgccugcacuc

SEQ ID NO: 2651817 - RNA, 15 nt, Human
cgugccguggcacca

SEQ ID NO: 2651818 - RNA, 11 nt, Human
cgucugugugc

SEQ ID NO: 2651819 - RNA, 16 nt, Human
cgugaaagcagaugag

SEQ ID NO: 2651820 - RNA, 17 nt, Human
cgugaaagugcauuuuu

SEQ ID NO: 2651821 - RNA, 19 nt, Human
cgugaaagugcauuuuugu

SEQ ID NO: 2651822 - RNA, 22 nt, Human
cgugaaagugcauuuuuguaaa

SEQ ID NO: 2651823 - RNA, 23 nt, Human
cgugaaagugcauuuuuguaaau

SEQ ID NO: 2651824 - RNA, 22 nt, Human
cgugaagauacuuuguauuguc

SEQ ID NO: 2651825 - RNA, 16 nt, Human
cgugaagauacuuugu

SEQ ID NO: 2651826 - RNA, 21 nt, Human
cgucggggaggcuccugccug

SEQ ID NO: 2651827 - RNA, 21 nt, Human
cgugaagauacuuuguauugu

SEQ ID NO: 2651828 - RNA, 19 nt, Human
cgugaagauacuuuguauu

SEQ ID NO: 2651829 - RNA, 18 nt, Human
cgugaagauacuuuguau

SEQ ID NO: 2651830 - RNA, 17 nt, Human
cgugaagauacuuugua

SEQ ID NO: 2651831 - RNA, 21 nt, Human
cguccuccucaccucaugccc

SEQ ID NO: 2651832 - RNA, 17 nt, Human
cguccuccucaccucau

SEQ ID NO: 2651833 - RNA, 17 nt, Human
cguccccccccaaccuu

SEQ ID NO: 2651834 - RNA, 22 nt, Human
cguccccccccaaccuuucccu

SEQ ID NO: 2651835 - RNA, 11 nt, Human
cgucccuggcg

SEQ ID NO: 2651836 - RNA, 14 nt, Human
cgucccuggcgcag

SEQ ID NO: 2651837 - RNA, 18 nt, Human
cgucugccggacccggag

SEQ ID NO: 2651838 - RNA, 23 nt, Human
cgucucuggagcggaauuuaccu

SEQ ID NO: 2651839 - RNA, 15 nt, Human
ccuggugcuuccaaa

SEQ ID NO: 2651840 - RNA, 13 nt, Human
ccuggugcugcug

SEQ ID NO: 2651841 - RNA, 12 nt, Human
ccuggugcugcu

SEQ ID NO: 2651842 - RNA, 20 nt, Human
ccuguaauccuagcacuuug

SEQ ID NO: 2651843 - RNA, 13 nt, Human
ccuguagucccag

SEQ ID NO: 2651844 - RNA, 22 nt, Human
ccuguaggguccaaccagaccu

SEQ ID NO: 2651845 - RNA, 23 nt, Human
ccuguaggguccaaccagaccug

SEQ ID NO: 2651846 - RNA, 18 nt, Human
ccuguauuuaaaaauaga

SEQ ID NO: 2651847 - RNA, 20 nt, Human
ccuguauuuaaaaauagaaa

SEQ ID NO: 2651848 - RNA, 23 nt, Human
ccuguauuuaaaaauagaaacau

SEQ ID NO: 2651849 - RNA, 23 nt, Human
ccuguagagugggagcugagugg

SEQ ID NO: 2651850 - RNA, 15 nt, Human
ccuguagcacuuacu

SEQ ID NO: 2651851 - RNA, 19 nt, Human
ccuguagagugggagcuga

SEQ ID NO: 2651852 - RNA, 21 nt, Human
ccuguagagugggagcugagu

SEQ ID NO: 2651853 - RNA, 20 nt, Human
ccugugauccacccaacccu

SEQ ID NO: 2651854 - RNA, 12 nt, Human
ccuguccccgca

SEQ ID NO: 2651855 - RNA, 14 nt, Human
ccuguccccgcagc

SEQ ID NO: 2651856 - RNA, 19 nt, Human
ccuggagauccuccugcag

SEQ ID NO: 2651857 - RNA, 14 nt, Human
ccuggacugcuacc

SEQ ID NO: 2651858 - RNA, 15 nt, Human
ccuggacugcuaccu

SEQ ID NO: 2651859 - RNA, 21 nt, Human
ccuggagauccuccugcagac

SEQ ID NO: 2651860 - RNA, 12 nt, Human
ccuggcacugga

SEQ ID NO: 2651861 - RNA, 20 nt, Human
ccuggcacuggaccccagca

SEQ ID NO: 2651862 - RNA, 16 nt, Human
ccuggcacuggacccc

SEQ ID NO: 2651863 - RNA, 15 nt, Human
ccuggcacuggaccc

SEQ ID NO: 2651864 - RNA, 19 nt, Human
ccuggaccuuuuguuuucu

SEQ ID NO: 2651865 - RNA, 20 nt, Human
ccuggaccuuuuguuuucug

SEQ ID NO: 2651866 - RNA, 14 nt, Human
ccuggacccugugg

SEQ ID NO: 2651867 - RNA, 13 nt, Human
ccuggacccugug

SEQ ID NO: 2651868 - RNA, 19 nt, Human
ccuggacaguaucccacau

SEQ ID NO: 2651869 - RNA, 23 nt, Human
ccuggacaguaucccacauccaa

SEQ ID NO: 2651870 - RNA, 20 nt, Human
ccugggcacgcacuggguug

SEQ ID NO: 2651871 - RNA, 23 nt, Human
ccuggcugagguuccucugccug

SEQ ID NO: 2651872 - RNA, 20 nt, Human
ccugggaggucaaggcugca

SEQ ID NO: 2651873 - RNA, 19 nt, Human
ccuggcugagguuccucug

SEQ ID NO: 2651874 - RNA, 20 nt, Human
ccuggcugagguuccucugc

SEQ ID NO: 2651875 - RNA, 21 nt, Human
ccuggcugagguuccucugcc

SEQ ID NO: 2651876 - RNA, 22 nt, Human
ccuggcugagguuccucugccu

SEQ ID NO: 2651877 - RNA, 16 nt, Human
ccuggcugagguuccu

SEQ ID NO: 2651878 - RNA, 23 nt, Human
ccuggcguccccucccucugucu

SEQ ID NO: 2651879 - RNA, 15 nt, Human
ccuggcgccuggcag

SEQ ID NO: 2651880 - RNA, 15 nt, Human
ccuggcgcagguggg

SEQ ID NO: 2651881 - RNA, 19 nt, Human
ccuggcgcaggugggcugg

SEQ ID NO: 2651882 - RNA, 22 nt, Human
ccuggcgcaggugggcuggacu

SEQ ID NO: 2651883 - RNA, 23 nt, Human
ccuggcgcaggugggcuggacuu

SEQ ID NO: 2651884 - RNA, 19 nt, Human
ccuggccuuguccucagcc

SEQ ID NO: 2651885 - RNA, 21 nt, Human
ccuggccuuguccucagccag

SEQ ID NO: 2651886 - RNA, 22 nt, Human
ccuggccuuguccucagccagu

SEQ ID NO: 2651887 - RNA, 16 nt, Human
ccuggcccccaaccuc

SEQ ID NO: 2651888 - RNA, 19 nt, Human
ccuggcccccaaccucagg

SEQ ID NO: 2651889 - RNA, 20 nt, Human
ccuggcccccaaccucaggg

SEQ ID NO: 2651890 - RNA, 22 nt, Human
ccuggcccccaaccucagggcu

SEQ ID NO: 2651891 - RNA, 23 nt, Human
ccuggcccccaaccucagggcuc

SEQ ID NO: 2651892 - RNA, 14 nt, Human
ccuggccaggagca

SEQ ID NO: 2651893 - RNA, 16 nt, Human
ccuggccaggagcagg

SEQ ID NO: 2651894 - RNA, 13 nt, Human
ccuggccaggagc

SEQ ID NO: 2651895 - RNA, 22 nt, Human
ccugcuuccaggaaacuccaca

SEQ ID NO: 2651896 - RNA, 20 nt, Human
ccugcuuugaauaaaugugu

SEQ ID NO: 2651897 - RNA, 16 nt, Human
ccugcuuuuuguguuu

SEQ ID NO: 2651898 - RNA, 14 nt, Human
ccugaaccaugugg

SEQ ID NO: 2651899 - RNA, 15 nt, Human
ccugauuucuucagg

SEQ ID NO: 2651900 - RNA, 20 nt, Human
ccugcguccuccucaccuca

SEQ ID NO: 2651901 - RNA, 22 nt, Human
ccugcguccuccucaccucaug

SEQ ID NO: 2651902 - RNA, 22 nt, Human
ccugcuccagcuguucagcugg

SEQ ID NO: 2651903 - RNA, 14 nt, Human
ccugcuccagcugu

SEQ ID NO: 2651904 - RNA, 13 nt, Human
ccugcuccagcug

SEQ ID NO: 2651905 - RNA, 12 nt, Human
ccugcuccagcu

SEQ ID NO: 2651906 - RNA, 23 nt, Human
ccuugaguugauucagcucugca

SEQ ID NO: 2651907 - RNA, 22 nt, Human
ccuugaguugauucagcucugc

SEQ ID NO: 2651908 - RNA, 11 nt, Human
ccuuuggcuuc

SEQ ID NO: 2651909 - RNA, 21 nt, Human
ccuuacuuuacugccugaaua

SEQ ID NO: 2651910 - RNA, 22 nt, Human
ccuuacuuuacugccugaauaa

SEQ ID NO: 2651911 - RNA, 23 nt, Human
ccuuacuuuacugccugaauaaa

SEQ ID NO: 2651912 - RNA, 20 nt, Human
ccuuaccucggugccuuccu

SEQ ID NO: 2651913 - RNA, 15 nt, Human
ccuguggccccaccc

SEQ ID NO: 2651914 - RNA, 16 nt, Human
ccuguggccccacccu

SEQ ID NO: 2651915 - RNA, 17 nt, Human
ccuguggccccacccug

SEQ ID NO: 2651916 - RNA, 18 nt, Human
ccuguggccccacccugg

SEQ ID NO: 2651917 - RNA, 20 nt, Human
ccuguggccccacccugggc

SEQ ID NO: 2651918 - RNA, 22 nt, Human
ccuguggccccacccugggccc

SEQ ID NO: 2651919 - RNA, 15 nt, Human
ccuguggcauaaauu

SEQ ID NO: 2651920 - RNA, 18 nt, Human
ccuguggcauaaauugca

SEQ ID NO: 2651921 - RNA, 18 nt, Human
ccuuagagguccucugga

SEQ ID NO: 2651922 - RNA, 19 nt, Human
ccuuagagguccucuggag

SEQ ID NO: 2651923 - RNA, 17 nt, Human
ccuuagagguccucugg

SEQ ID NO: 2651924 - RNA, 20 nt, Human
ccuuagagguccucuggagc

SEQ ID NO: 2651925 - RNA, 20 nt, Human
ccuucaaaacuauagcuugc

SEQ ID NO: 2651926 - RNA, 12 nt, Human
ccuuccauucca

SEQ ID NO: 2651927 - RNA, 13 nt, Human
ccuuccauuccac

SEQ ID NO: 2651928 - RNA, 21 nt, Human
ccuuccucuugucugauuucu

SEQ ID NO: 2651929 - RNA, 15 nt, Human
ccuuccugcugcgca

SEQ ID NO: 2651930 - RNA, 12 nt, Human
ccuucagcucca

SEQ ID NO: 2651931 - RNA, 23 nt, Human
ccuccucccacccggcugcagag

SEQ ID NO: 2651932 - RNA, 19 nt, Human
ccuccugcagaccacgccc

SEQ ID NO: 2651933 - RNA, 22 nt, Human
ccucaggugagaagcagaggaa

SEQ ID NO: 2651934 - RNA, 16 nt, Human
ccucaggugagaagca

SEQ ID NO: 2651935 - RNA, 14 nt, Human
ccucagggcuccca

SEQ ID NO: 2651936 - RNA, 15 nt, Human
ccucagggcucccag

SEQ ID NO: 2651937 - RNA, 16 nt, Human
ccucagggcucccagg

SEQ ID NO: 2651938 - RNA, 17 nt, Human
ccucagggcucccaggg

SEQ ID NO: 2651939 - RNA, 18 nt, Human
ccucagggcucccagggg

SEQ ID NO: 2651940 - RNA, 22 nt, Human
ccucugcuuucuccuuuaauug

SEQ ID NO: 2651941 - RNA, 15 nt, Human
ccucuggacggcagg

SEQ ID NO: 2651942 - RNA, 16 nt, Human
ccucuggacggcaggc

SEQ ID NO: 2651943 - RNA, 21 nt, Human
ccucuggacggcaggcucacu

SEQ ID NO: 2651944 - RNA, 22 nt, Human
ccucuggacggcaggcucacug

SEQ ID NO: 2651945 - RNA, 23 nt, Human
ccucuggacggcaggcucacugc

SEQ ID NO: 2651946 - RNA, 17 nt, Human
ccucuggagcccuaacc

SEQ ID NO: 2651947 - RNA, 16 nt, Human
ccucuggucgcuccug

SEQ ID NO: 2651948 - RNA, 19 nt, Human
ccucugcacaagcugcacc

SEQ ID NO: 2651949 - RNA, 17 nt, Human
ccucugcacaagcugca

SEQ ID NO: 2651950 - RNA, 20 nt, Human
ccucugcacaagcugcaccc

SEQ ID NO: 2651951 - RNA, 16 nt, Human
ccucugcacccagaac

SEQ ID NO: 2651952 - RNA, 17 nt, Human
ccucugcacccagaaca

SEQ ID NO: 2651953 - RNA, 15 nt, Human
ccucugcacaagcug

SEQ ID NO: 2651954 - RNA, 11 nt, Human
ccucugcacaa

SEQ ID NO: 2651955 - RNA, 23 nt, Human
ccucuccccagguccagcucugg

SEQ ID NO: 2651956 - RNA, 21 nt, Human
ccucuccccagguccagcucu

SEQ ID NO: 2651957 - RNA, 23 nt, Human
ccucugaaaaccaauguucucuc

SEQ ID NO: 2651958 - RNA, 18 nt, Human
ccucugaaaaguguguau

SEQ ID NO: 2651959 - RNA, 23 nt, Human
ccucucaggccggcagccccagc

SEQ ID NO: 2651960 - RNA, 12 nt, Human
ccuccuucagac

SEQ ID NO: 2651961 - RNA, 15 nt, Human
ccugaucugcccauc

SEQ ID NO: 2651962 - RNA, 16 nt, Human
ccugaugagauuuuua

SEQ ID NO: 2651963 - RNA, 17 nt, Human
ccugaugagauuuuuaa

SEQ ID NO: 2651964 - RNA, 21 nt, Human
ccugaaccgcacagcucagga

SEQ ID NO: 2651965 - RNA, 22 nt, Human
ccugaaccgcacagcucaggag

SEQ ID NO: 2651966 - RNA, 16 nt, Human
ccugaaccgcacagcu

SEQ ID NO: 2651967 - RNA, 18 nt, Human
ccugaaccgcacagcuca

SEQ ID NO: 2651968 - RNA, 20 nt, Human
ccugaaccgcacagcucagg

SEQ ID NO: 2651969 - RNA, 15 nt, Human
ccugaaccgcacagc

SEQ ID NO: 2651970 - RNA, 14 nt, Human
ccucuuagaaaaac

SEQ ID NO: 2651971 - RNA, 15 nt, Human
ccucugugcugugug

SEQ ID NO: 2651972 - RNA, 18 nt, Human
ccucuguguauuugcuuu

SEQ ID NO: 2651973 - RNA, 21 nt, Human
ccucugugccuucuuuugauu

SEQ ID NO: 2651974 - RNA, 13 nt, Human
ccucugugcugug

SEQ ID NO: 2651975 - RNA, 16 nt, Human
ccucugugcugugugu

SEQ ID NO: 2651976 - RNA, 14 nt, Human
ccucugugccuucu

SEQ ID NO: 2651977 - RNA, 20 nt, Human
ccucugucuucagcacccuc

SEQ ID NO: 2651978 - RNA, 17 nt, Human
ccucuggucgcuccugc

SEQ ID NO: 2651979 - RNA, 19 nt, Human
ccucuggucgcuccugccc

SEQ ID NO: 2651980 - RNA, 20 nt, Human
ccucuggucgcuccugccca

SEQ ID NO: 2651981 - RNA, 21 nt, Human
ccucuggucgcuccugcccac

SEQ ID NO: 2651982 - RNA, 14 nt, Human
ccucugucaggccu

SEQ ID NO: 2651983 - RNA, 18 nt, Human
ccucugucaggccuucag

SEQ ID NO: 2651984 - RNA, 13 nt, Human
cccuuuuccccua

SEQ ID NO: 2651985 - RNA, 12 nt, Human
cccuuuuccccu

SEQ ID NO: 2651986 - RNA, 17 nt, Human
ccgagaaggaagccucc

SEQ ID NO: 2651987 - RNA, 17 nt, Human
ccgacugcuuuggaccu

SEQ ID NO: 2651988 - RNA, 13 nt, Human
ccgagaagguuua

SEQ ID NO: 2651989 - RNA, 23 nt, Human
ccgccccuggccgcgcuccgggc

SEQ ID NO: 2651990 - RNA, 11 nt, Human
ccgcccugcca

SEQ ID NO: 2651991 - RNA, 12 nt, Human
ccgcccugccac

SEQ ID NO: 2651992 - RNA, 20 nt, Human
ccgaggcggguggaucacga

SEQ ID NO: 2651993 - RNA, 14 nt, Human
ccgaggggccuuug

SEQ ID NO: 2651994 - RNA, 17 nt, Human
ccgauagagggacggcc

SEQ ID NO: 2651995 - RNA, 18 nt, Human
ccgauagagggacggcca

SEQ ID NO: 2651996 - RNA, 22 nt, Human
ccgaguuaaggugggcccggcc

SEQ ID NO: 2651997 - RNA, 19 nt, Human
cccuuaccucggugccuuc

SEQ ID NO: 2651998 - RNA, 12 nt, Human
cccuugcagccg

SEQ ID NO: 2651999 - RNA, 16 nt, Human
cccuuggcuucuguga

SEQ ID NO: 2652000 - RNA, 18 nt, Human
cccuuggcuucugugaug

SEQ ID NO: 2652001 - RNA, 12 nt, Human
cccuugggccac

SEQ ID NO: 2652002 - RNA, 19 nt, Human
cccuugggccaccccuccu

SEQ ID NO: 2652003 - RNA, 14 nt, Human
ccccucccccagcc

SEQ ID NO: 2652004 - RNA, 10 nt, Human
cccuuguggg

SEQ ID NO: 2652005 - RNA, 12 nt, Human
cccuuugcuguc

SEQ ID NO: 2652006 - RNA, 13 nt, Human
cccuuugcugucc

SEQ ID NO: 2652007 - RNA, 20 nt, Human
cccuuugguuuuuuucuucu

SEQ ID NO: 2652008 - RNA, 15 nt, Human
cccuuuuaaaguuga

SEQ ID NO: 2652009 - RNA, 16 nt, Human
cccuuuuaaaguugau

SEQ ID NO: 2652010 - RNA, 20 nt, Human
cccuuuggggguugaauagg

SEQ ID NO: 2652011 - RNA, 17 nt, Human
ccccuaccaauauuagg

SEQ ID NO: 2652012 - RNA, 14 nt, Human
ccccguuucuggug

SEQ ID NO: 2652013 - RNA, 13 nt, Human
ccccguggggcag

SEQ ID NO: 2652014 - RNA, 21 nt, Human
ccccuaaaagcacuccugcuu

SEQ ID NO: 2652015 - RNA, 13 nt, Human
cccuguguuaauu

SEQ ID NO: 2652016 - RNA, 11 nt, Human
cccugugugca

SEQ ID NO: 2652017 - RNA, 13 nt, Human
cccugugugcagg

SEQ ID NO: 2652018 - RNA, 16 nt, Human
ccccacugccagcagc

SEQ ID NO: 2652019 - RNA, 17 nt, Human
ccccacugccagcagca

SEQ ID NO: 2652020 - RNA, 19 nt, Human
ccccacugccagcagcagc

SEQ ID NO: 2652021 - RNA, 22 nt, Human
ccccacugccagcagcagcagg

SEQ ID NO: 2652022 - RNA, 15 nt, Human
ccccacugccagcag

SEQ ID NO: 2652023 - RNA, 23 nt, Human
ccccaccccugcccccagccccg

SEQ ID NO: 2652024 - RNA, 22 nt, Human
ccccaccccggggacccuguga

SEQ ID NO: 2652025 - RNA, 13 nt, Human
ccccaccccugcc

SEQ ID NO: 2652026 - RNA, 14 nt, Human
ccccaccccugccc

SEQ ID NO: 2652027 - RNA, 17 nt, Human
ccccaccccugccccca

SEQ ID NO: 2652028 - RNA, 13 nt, Human
ccccagcccugcu

SEQ ID NO: 2652029 - RNA, 14 nt, Human
ccccagcccugcug

SEQ ID NO: 2652030 - RNA, 16 nt, Human
ccccagcccugcuggg

SEQ ID NO: 2652031 - RNA, 17 nt, Human
ccccagcccugcugggg

SEQ ID NO: 2652032 - RNA, 20 nt, Human
ccccagcccugcuggggauc

SEQ ID NO: 2652033 - RNA, 14 nt, Human
cccccaaccucagg

SEQ ID NO: 2652034 - RNA, 15 nt, Human
cccccaaccucaggg

SEQ ID NO: 2652035 - RNA, 15 nt, Human
cccccaaccuuuccc

SEQ ID NO: 2652036 - RNA, 20 nt, Human
cccccagguuccgaagaaga

SEQ ID NO: 2652037 - RNA, 15 nt, Human
cccccaguccccacc

SEQ ID NO: 2652038 - RNA, 20 nt, Human
cccccaguccccaccccugc

SEQ ID NO: 2652039 - RNA, 22 nt, Human
cccccaguccccaccccugccc

SEQ ID NO: 2652040 - RNA, 19 nt, Human
cccccagccaugccagcug

SEQ ID NO: 2652041 - RNA, 20 nt, Human
cccccagccaugccagcugg

SEQ ID NO: 2652042 - RNA, 21 nt, Human
cccccagccaugccagcuggc

SEQ ID NO: 2652043 - RNA, 23 nt, Human
cccccagccaugccagcuggccu

SEQ ID NO: 2652044 - RNA, 13 nt, Human
cccccagcccagg

SEQ ID NO: 2652045 - RNA, 14 nt, Human
cccccagcccaggg

SEQ ID NO: 2652046 - RNA, 21 nt, Human
cccccagcccagggcuccugc

SEQ ID NO: 2652047 - RNA, 13 nt, Human
cccccagccccgg

SEQ ID NO: 2652048 - RNA, 23 nt, Human
cccccagccccgacuccagccag

SEQ ID NO: 2652049 - RNA, 24 nt, Human
cccccagccccgacuccagccagc

SEQ ID NO: 2652050 - RNA, 12 nt, Human
cccccugcccug

SEQ ID NO: 2652051 - RNA, 13 nt, Human
cccccugcccugc

SEQ ID NO: 2652052 - RNA, 14 nt, Human
cccccugcccugca

SEQ ID NO: 2652053 - RNA, 22 nt, Human
cccccuggccucugugccuucu

SEQ ID NO: 2652054 - RNA, 19 nt, Human
cccccuggccucugugccu

SEQ ID NO: 2652055 - RNA, 15 nt, Human
cccccuggccucugu

SEQ ID NO: 2652056 - RNA, 13 nt, Human
cccccugcuucag

SEQ ID NO: 2652057 - RNA, 18 nt, Human
cccccugcuucagucccu

SEQ ID NO: 2652058 - RNA, 18 nt, Human
ccucaauagaucuccagc

SEQ ID NO: 2652059 - RNA, 20 nt, Human
ccuagaggcccuuugcuguc

SEQ ID NO: 2652060 - RNA, 17 nt, Human
ccuagaggcccuuugcu

SEQ ID NO: 2652061 - RNA, 23 nt, Human
ccuauggcagaaaaaaugucugu

SEQ ID NO: 2652062 - RNA, 14 nt, Human
ccucacuaauuuuu

SEQ ID NO: 2652063 - RNA, 16 nt, Human
ccucacccccucccac

SEQ ID NO: 2652064 - RNA, 17 nt, Human
ccucacccccucccacc

SEQ ID NO: 2652065 - RNA, 20 nt, Human
ccucacccccucccaccccc

SEQ ID NO: 2652066 - RNA, 21 nt, Human
ccucacccccucccaccccca

SEQ ID NO: 2652067 - RNA, 17 nt, Human
ccguuuuccccaugaca

SEQ ID NO: 2652068 - RNA, 15 nt, Human
ccguuuuccccauga

SEQ ID NO: 2652069 - RNA, 12 nt, Human
ccguuuucccca

SEQ ID NO: 2652070 - RNA, 17 nt, Human
ccguggggccgccgccu

SEQ ID NO: 2652071 - RNA, 13 nt, Human
ccguggggcaggg

SEQ ID NO: 2652072 - RNA, 14 nt, Human
ccguggggcaggga

SEQ ID NO: 2652073 - RNA, 15 nt, Human
ccguggggcagggag

SEQ ID NO: 2652074 - RNA, 22 nt, Human
ccguggggcagggagcugggcc

SEQ ID NO: 2652075 - RNA, 23 nt, Human
ccguggggcagggagcugggccc

SEQ ID NO: 2652076 - RNA, 13 nt, Human
ccgggccccacag

SEQ ID NO: 2652077 - RNA, 14 nt, Human
ccgggccccugggc

SEQ ID NO: 2652078 - RNA, 16 nt, Human
ccgggccccugggcuu

SEQ ID NO: 2652079 - RNA, 19 nt, Human
ccgggccccugggcuuggc

SEQ ID NO: 2652080 - RNA, 21 nt, Human
ccgggccccugggcuuggccu

SEQ ID NO: 2652081 - RNA, 23 nt, Human
ccgggccccugggcuuggccugc

SEQ ID NO: 2652082 - RNA, 21 nt, Human
ccgugccgccugcacuccuca

SEQ ID NO: 2652083 - RNA, 14 nt, Human
ccgugccgccugca

SEQ ID NO: 2652084 - RNA, 17 nt, Human
ccgugccgccugcacuc

SEQ ID NO: 2652085 - RNA, 14 nt, Human
ccgggcgcgguggc

SEQ ID NO: 2652086 - RNA, 21 nt, Human
ccgggcgcgguggcgggcacc

SEQ ID NO: 2652087 - RNA, 23 nt, Human
ccuaaagagaguauuuuuauaca

SEQ ID NO: 2652088 - RNA, 13 nt, Human
ccuaaagagagua

SEQ ID NO: 2652089 - RNA, 13 nt, Human
ccuaaaccucagu

SEQ ID NO: 2652090 - RNA, 20 nt, Human
ccuaaagaaaaauaucuugg

SEQ ID NO: 2652091 - RNA, 22 nt, Human
ccuaaagaaaaauaucuuggcc

SEQ ID NO: 2652092 - RNA, 14 nt, Human
ccuaauuucuccuc

SEQ ID NO: 2652093 - RNA, 15 nt, Human
ccuaauuucuccucc

SEQ ID NO: 2652094 - RNA, 16 nt, Human
ccuaauuucuccuccc

SEQ ID NO: 2652095 - RNA, 17 nt, Human
ccuaauuucuccucccu

SEQ ID NO: 2652096 - RNA, 18 nt, Human
ccuaauuucuccucccuu

SEQ ID NO: 2652097 - RNA, 20 nt, Human
ccuaccccgcagacaccuug

SEQ ID NO: 2652098 - RNA, 12 nt, Human
ccuaccccauag

SEQ ID NO: 2652099 - RNA, 21 nt, Human
ccuaccccgcagacaccuugg

SEQ ID NO: 2652100 - RNA, 15 nt, Human
ccggcugcagaggcc

SEQ ID NO: 2652101 - RNA, 17 nt, Human
ccggacccucuaaccuc

SEQ ID NO: 2652102 - RNA, 13 nt, Human
ccgcccugccacu

SEQ ID NO: 2652103 - RNA, 14 nt, Human
ccgcccugccacuc

SEQ ID NO: 2652104 - RNA, 15 nt, Human
ccgcccugccacuca

SEQ ID NO: 2652105 - RNA, 15 nt, Human
ccgcuucugccugca

SEQ ID NO: 2652106 - RNA, 20 nt, Human
ccguggggccgccgccucuu

SEQ ID NO: 2652107 - RNA, 17 nt, Human
cuggugcuuccaaauau

SEQ ID NO: 2652108 - RNA, 14 nt, Human
cuggugcugcugcu

SEQ ID NO: 2652109 - RNA, 12 nt, Human
cuggugcugcug

SEQ ID NO: 2652110 - RNA, 23 nt, Human
cuggucgcuccugcccacggagu

SEQ ID NO: 2652111 - RNA, 16 nt, Human
cuggucgcuccugccc

SEQ ID NO: 2652112 - RNA, 18 nt, Human
cuggucgcuccugcccac

SEQ ID NO: 2652113 - RNA, 21 nt, Human
cugguggccccguuucuggug

SEQ ID NO: 2652114 - RNA, 22 nt, Human
cugguggccccguuucuggugg

SEQ ID NO: 2652115 - RNA, 20 nt, Human
cugguggccccguuucuggu

SEQ ID NO: 2652116 - RNA, 18 nt, Human
cugguggucuguuggcag

SEQ ID NO: 2652117 - RNA, 20 nt, Human
cugguggucuguuggcaggc

SEQ ID NO: 2652118 - RNA, 22 nt, Human
cugguggucuguuggcaggcug

SEQ ID NO: 2652119 - RNA, 23 nt, Human
cugguggucuguuggcaggcugg

SEQ ID NO: 2652120 - RNA, 13 nt, Human
cugguucucaaug

SEQ ID NO: 2652121 - RNA, 18 nt, Human
cugguucucaaugaaaaa

SEQ ID NO: 2652122 - RNA, 15 nt, Human
cugguucucaaugaa

SEQ ID NO: 2652123 - RNA, 16 nt, Human
cugguucucaaugaaa

SEQ ID NO: 2652124 - RNA, 17 nt, Human
cugguucucaaugaaaa

SEQ ID NO: 2652125 - RNA, 16 nt, Human
cuggguugcgggacag

SEQ ID NO: 2652126 - RNA, 20 nt, Human
cuggguugcgggacagagua

SEQ ID NO: 2652127 - RNA, 14 nt, Human
cugggucacacacg

SEQ ID NO: 2652128 - RNA, 19 nt, Human
cuggguaggaaagaggaag

SEQ ID NO: 2652129 - RNA, 13 nt, Human
cuggucgcuccug

SEQ ID NO: 2652130 - RNA, 14 nt, Human
cuggucgcuccugc

SEQ ID NO: 2652131 - RNA, 15 nt, Human
cuggucgcuccugcc

SEQ ID NO: 2652132 - RNA, 18 nt, Human
cugggcucccgggcccca

SEQ ID NO: 2652133 - RNA, 14 nt, Human
cugggcggcugugc

SEQ ID NO: 2652134 - RNA, 17 nt, Human
cugggcggcugugcuuc

SEQ ID NO: 2652135 - RNA, 21 nt, Human
cugggcucccgggccccacag

SEQ ID NO: 2652136 - RNA, 14 nt, Human
cuggguaggaaaga

SEQ ID NO: 2652137 - RNA, 17 nt, Human
cuggguaggaaagagga

SEQ ID NO: 2652138 - RNA, 15 nt, Human
cuggguaggaaagag

SEQ ID NO: 2652139 - RNA, 21 nt, Human
cuggcuucaccaucaauccug

SEQ ID NO: 2652140 - RNA, 23 nt, Human
cugggagcuccacucugcuucuc

SEQ ID NO: 2652141 - RNA, 20 nt, Human
cugggaggcccugagacagg

SEQ ID NO: 2652142 - RNA, 18 nt, Human
cugggaggucaaggcugc

SEQ ID NO: 2652143 - RNA, 20 nt, Human
cugggcaaugugauaaaacc

SEQ ID NO: 2652144 - RNA, 18 nt, Human
cuggcuuacacuggcaau

SEQ ID NO: 2652145 - RNA, 12 nt, Human
cuggcuguuuga

SEQ ID NO: 2652146 - RNA, 14 nt, Human
cuggcuuacacugg

SEQ ID NO: 2652147 - RNA, 21 nt, Human
cuggcuggguggcaccagcag

SEQ ID NO: 2652148 - RNA, 22 nt, Human
cuggcuggguggcaccagcagc

SEQ ID NO: 2652149 - RNA, 12 nt, Human
cuggcugcugcc

SEQ ID NO: 2652150 - RNA, 13 nt, Human
cuggcugcugccc

SEQ ID NO: 2652151 - RNA, 14 nt, Human
cuggcugcugcccc

SEQ ID NO: 2652152 - RNA, 20 nt, Human
cuggccucugugccuucuuu

SEQ ID NO: 2652153 - RNA, 16 nt, Human
cuggccucugugccuu

SEQ ID NO: 2652154 - RNA, 15 nt, Human
cuggccucugugccu

SEQ ID NO: 2652155 - RNA, 14 nt, Human
cuggccucugugcc

SEQ ID NO: 2652156 - RNA, 22 nt, Human
cuggaggauccccuccaagccu

SEQ ID NO: 2652157 - RNA, 22 nt, Human
cuggcaaugguaguuucugugg

SEQ ID NO: 2652158 - RNA, 21 nt, Human
cuggcaaugguaguuucugug

SEQ ID NO: 2652159 - RNA, 16 nt, Human
cuggcaaugguaguuu

SEQ ID NO: 2652160 - RNA, 22 nt, Human
cuggcaaacaugaaaaaucggc

SEQ ID NO: 2652161 - RNA, 16 nt, Human
cuggcaaacaugaaaa

SEQ ID NO: 2652162 - RNA, 20 nt, Human
cuggcacugacugggcauag

SEQ ID NO: 2652163 - RNA, 19 nt, Human
cuggcacucuuguucccac

SEQ ID NO: 2652164 - RNA, 22 nt, Human
cuggccauuugccaauuuuccu

SEQ ID NO: 2652165 - RNA, 19 nt, Human
cuggccuauccgcugccag

SEQ ID NO: 2652166 - RNA, 22 nt, Human
cuggccuauccgcugccagccu

SEQ ID NO: 2652167 - RNA, 13 nt, Human
cuggccucugugc

SEQ ID NO: 2652168 - RNA, 11 nt, Human
cuggccucugu

SEQ ID NO: 2652169 - RNA, 14 nt, Human
cuggccucugcuuu

SEQ ID NO: 2652170 - RNA, 15 nt, Human
cuggccucugcuuuc

SEQ ID NO: 2652171 - RNA, 16 nt, Human
cuggccuccccugcca

SEQ ID NO: 2652172 - RNA, 17 nt, Human
cuggccuccccugccac

SEQ ID NO: 2652173 - RNA, 18 nt, Human
cuggccuccccugccacc

SEQ ID NO: 2652174 - RNA, 21 nt, Human
cuggccuccccugccaccagg

SEQ ID NO: 2652175 - RNA, 13 nt, Human
cuggcccacugca

SEQ ID NO: 2652176 - RNA, 12 nt, Human
cuggcccacugc

SEQ ID NO: 2652177 - RNA, 14 nt, Human
cugcuuuucugccc

SEQ ID NO: 2652178 - RNA, 15 nt, Human
cugcuuuucugcccu

SEQ ID NO: 2652179 - RNA, 16 nt, Human
cugcuuuucugcccug

SEQ ID NO: 2652180 - RNA, 17 nt, Human
cugcuuuucugcccugg

SEQ ID NO: 2652181 - RNA, 18 nt, Human
cugcuuuucugcccuggc

SEQ ID NO: 2652182 - RNA, 17 nt, Human
cuggaauugccagcuga

SEQ ID NO: 2652183 - RNA, 18 nt, Human
cuggaauugccagcugac

SEQ ID NO: 2652184 - RNA, 15 nt, Human
cuggaauuguggcua

SEQ ID NO: 2652185 - RNA, 22 nt, Human
cuggaauuguggcuauccugau

SEQ ID NO: 2652186 - RNA, 23 nt, Human
cuggaauuguggcuauccugauu

SEQ ID NO: 2652187 - RNA, 23 nt, Human
cugcuuuuaacuuuauaaaucca

SEQ ID NO: 2652188 - RNA, 14 nt, Human
cugcuuucuccuuu

SEQ ID NO: 2652189 - RNA, 14 nt, Human
cuggagcucaucug

SEQ ID NO: 2652190 - RNA, 20 nt, Human
cuggagcucaucugcaaaag

SEQ ID NO: 2652191 - RNA, 21 nt, Human
cuggagcucaucugcaaaagg

SEQ ID NO: 2652192 - RNA, 18 nt, Human
cuggaggaacacuugaug

SEQ ID NO: 2652193 - RNA, 22 nt, Human
cuggacggcaggcucacugcca

SEQ ID NO: 2652194 - RNA, 16 nt, Human
cuggacaguaucccac

SEQ ID NO: 2652195 - RNA, 18 nt, Human
cuggacaguaucccacau

SEQ ID NO: 2652196 - RNA, 20 nt, Human
cuggacaguaucccacaucc

SEQ ID NO: 2652197 - RNA, 20 nt, Human
cuggagcacugggcucccgg

SEQ ID NO: 2652198 - RNA, 19 nt, Human
cuggagcacugggcucccg

SEQ ID NO: 2652199 - RNA, 17 nt, Human
cuggagcacugggcucc

SEQ ID NO: 2652200 - RNA, 16 nt, Human
cuggagcacugggcuc

SEQ ID NO: 2652201 - RNA, 23 nt, Human
cuggagcacugggcucccgggcc

SEQ ID NO: 2652202 - RNA, 21 nt, Human
cuggagcacugggcucccggg

SEQ ID NO: 2652203 - RNA, 15 nt, Human
cuggagacuuagggc

SEQ ID NO: 2652204 - RNA, 21 nt, Human
cuggagacuuagggcaccagg

SEQ ID NO: 2652205 - RNA, 17 nt, Human
cugccugcaauauuuga

SEQ ID NO: 2652206 - RNA, 19 nt, Human
cugccugcaauauuugaau

SEQ ID NO: 2652207 - RNA, 18 nt, Human
cugccugcaauauuugaa

SEQ ID NO: 2652208 - RNA, 20 nt, Human
cugccugcaauauuugaauu

SEQ ID NO: 2652209 - RNA, 20 nt, Human
cugccugacagagggaugga

SEQ ID NO: 2652210 - RNA, 13 nt, Human
cugccugaauaaa

SEQ ID NO: 2652211 - RNA, 18 nt, Human
cugccugaauaaagagcc

SEQ ID NO: 2652212 - RNA, 16 nt, Human
cugccuuaaaaccaaa

SEQ ID NO: 2652213 - RNA, 17 nt, Human
cugccuuaaaaccaaag

SEQ ID NO: 2652214 - RNA, 18 nt, Human
cugccuuaaaaccaaaga

SEQ ID NO: 2652215 - RNA, 19 nt, Human
cugccuuaaaaccaaagag

SEQ ID NO: 2652216 - RNA, 22 nt, Human
cugccuuaaaaccaaagagggc

SEQ ID NO: 2652217 - RNA, 14 nt, Human
cugccucuucucua

SEQ ID NO: 2652218 - RNA, 13 nt, Human
cugccucuucucu

SEQ ID NO: 2652219 - RNA, 17 nt, Human
cugcccuggcugcugcc

SEQ ID NO: 2652220 - RNA, 21 nt, Human
cugcccuggcugcugccccca

SEQ ID NO: 2652221 - RNA, 18 nt, Human
cugcccuggcugcugccc

SEQ ID NO: 2652222 - RNA, 20 nt, Human
cugcccuggcugcugccccc

SEQ ID NO: 2652223 - RNA, 15 nt, Human
cugcuccagcuguuc

SEQ ID NO: 2652224 - RNA, 13 nt, Human
cugcucccuggca

SEQ ID NO: 2652225 - RNA, 15 nt, Human
cugcucccuggcauu

SEQ ID NO: 2652226 - RNA, 19 nt, Human
cugcucccuguagggucca

SEQ ID NO: 2652227 - RNA, 13 nt, Human
cugcgcuugcuuu

SEQ ID NO: 2652228 - RNA, 16 nt, Human
cugccuuaagugagga

SEQ ID NO: 2652229 - RNA, 13 nt, Human
cugccuuaaguga

SEQ ID NO: 2652230 - RNA, 21 nt, Human
cugcggguggggcuuggggcu

SEQ ID NO: 2652231 - RNA, 13 nt, Human
cugcggguggggc

SEQ ID NO: 2652232 - RNA, 17 nt, Human
cugcgcuugcuuuucug

SEQ ID NO: 2652233 - RNA, 23 nt, Human
cugcuaaauaaaauuuguugcau

SEQ ID NO: 2652234 - RNA, 12 nt, Human
cugcuaaauaaa

SEQ ID NO: 2652235 - RNA, 15 nt, Human
cugcuaaauaaaauu

SEQ ID NO: 2652236 - RNA, 14 nt, Human
cugcuccagcuguu

SEQ ID NO: 2652237 - RNA, 18 nt, Human
cugcagggccauggcuca

SEQ ID NO: 2652238 - RNA, 19 nt, Human
cugcagggccauggcucag

SEQ ID NO: 2652239 - RNA, 20 nt, Human
cugcagggccauggcucagg

SEQ ID NO: 2652240 - RNA, 21 nt, Human
cugcagggccauggcucaggg

SEQ ID NO: 2652241 - RNA, 23 nt, Human
cugcagggccauggcucagggug

SEQ ID NO: 2652242 - RNA, 21 nt, Human
cugccacacucuccaucaccc

SEQ ID NO: 2652243 - RNA, 13 nt, Human
cugccaccaggcc

SEQ ID NO: 2652244 - RNA, 14 nt, Human
cugccaccaggcca

SEQ ID NO: 2652245 - RNA, 15 nt, Human
cugccaccaggccac

SEQ ID NO: 2652246 - RNA, 17 nt, Human
cugccaccaggccaccu

SEQ ID NO: 2652247 - RNA, 18 nt, Human
cugccaccaggccaccuc

SEQ ID NO: 2652248 - RNA, 23 nt, Human
cugccaccaggccaccuccccag

SEQ ID NO: 2652249 - RNA, 11 nt, Human
cugccagcagc

SEQ ID NO: 2652250 - RNA, 12 nt, Human
cugccagcagca

SEQ ID NO: 2652251 - RNA, 13 nt, Human
cugccagcagcag

SEQ ID NO: 2652252 - RNA, 15 nt, Human
cugccagcagcagca

SEQ ID NO: 2652253 - RNA, 17 nt, Human
cugccagcagcagcagg

SEQ ID NO: 2652254 - RNA, 19 nt, Human
cugccagcagcagcaggug

SEQ ID NO: 2652255 - RNA, 21 nt, Human
cugccagcagcagcaggugau

SEQ ID NO: 2652256 - RNA, 19 nt, Human
cugccaugccagcuuaucu

SEQ ID NO: 2652257 - RNA, 13 nt, Human
cugccaggcaggg

SEQ ID NO: 2652258 - RNA, 12 nt, Human
cugccaggcagg

SEQ ID NO: 2652259 - RNA, 17 nt, Human
cugccaugccagcuuau

SEQ ID NO: 2652260 - RNA, 15 nt, Human
cugccaggcaggggu

SEQ ID NO: 2652261 - RNA, 15 nt, Human
cugccaugccagcuu

SEQ ID NO: 2652262 - RNA, 11 nt, Human
cugcagggcca

SEQ ID NO: 2652263 - RNA, 13 nt, Human
cugccagccuuga

SEQ ID NO: 2652264 - RNA, 15 nt, Human
cugccagccuugagc

SEQ ID NO: 2652265 - RNA, 17 nt, Human
cugccagccuugagccc

SEQ ID NO: 2652266 - RNA, 20 nt, Human
cugccagccuugagcccugg

SEQ ID NO: 2652267 - RNA, 21 nt, Human
cugccagccuugagcccuggc

SEQ ID NO: 2652268 - RNA, 22 nt, Human
cugccagccuugagcccuggcu

SEQ ID NO: 2652269 - RNA, 17 nt, Human
cugcccugcacgucaug

SEQ ID NO: 2652270 - RNA, 20 nt, Human
cugcccugcacgucauggga

SEQ ID NO: 2652271 - RNA, 16 nt, Human
cugccauuucugagau

SEQ ID NO: 2652272 - RNA, 19 nt, Human
cugcaauauuugaauuuua

SEQ ID NO: 2652273 - RNA, 18 nt, Human
cugcaauauuugaauuuu

SEQ ID NO: 2652274 - RNA, 16 nt, Human
cugcaauauuugaauu

SEQ ID NO: 2652275 - RNA, 12 nt, Human
cugcaauauuug

SEQ ID NO: 2652276 - RNA, 22 nt, Human
cugcaaacaccaacauguuggg

SEQ ID NO: 2652277 - RNA, 15 nt, Human
cugcaaaaggccucu

SEQ ID NO: 2652278 - RNA, 19 nt, Human
cugcaaaaggccucuugua

SEQ ID NO: 2652279 - RNA, 21 nt, Human
cugcaaaaggccucuuguaaa

SEQ ID NO: 2652280 - RNA, 14 nt, Human
cugauucuggcuuu

SEQ ID NO: 2652281 - RNA, 15 nt, Human
cugauucuggcuuua

SEQ ID NO: 2652282 - RNA, 18 nt, Human
cugauucuggcuuuaagc

SEQ ID NO: 2652283 - RNA, 19 nt, Human
cugauucuggcuuuaagcc

SEQ ID NO: 2652284 - RNA, 22 nt, Human
cugauucuggcuuuaagccuuc

SEQ ID NO: 2652285 - RNA, 14 nt, Human
cugcaauucccugg

SEQ ID NO: 2652286 - RNA, 19 nt, Human
cugcaauucccuggauaga

SEQ ID NO: 2652287 - RNA, 18 nt, Human
cugcacccagaacagugg

SEQ ID NO: 2652288 - RNA, 18 nt, Human
cugcacccucaggcaggu

SEQ ID NO: 2652289 - RNA, 16 nt, Human
cugcacccucaggcag

SEQ ID NO: 2652290 - RNA, 17 nt, Human
cugcacccucaggcagg

SEQ ID NO: 2652291 - RNA, 16 nt, Human
cugcacaagcugcacc

SEQ ID NO: 2652292 - RNA, 15 nt, Human
cugcacaagcugcac

SEQ ID NO: 2652293 - RNA, 14 nt, Human
cugcacaagcugca

SEQ ID NO: 2652294 - RNA, 13 nt, Human
cugcacaagcugc

SEQ ID NO: 2652295 - RNA, 18 nt, Human
cugcacaagcugcacccu

SEQ ID NO: 2652296 - RNA, 22 nt, Human
cugauucuuguugcuguacaaa

SEQ ID NO: 2652297 - RNA, 14 nt, Human
cugcagagauuucu

SEQ ID NO: 2652298 - RNA, 23 nt, Human
cugcagagauuucucauugacuu

SEQ ID NO: 2652299 - RNA, 21 nt, Human
cugcagagcaguaagggaaca

SEQ ID NO: 2652300 - RNA, 15 nt, Human
cugcacuuacuugcu

SEQ ID NO: 2652301 - RNA, 16 nt, Human
cugcacuuacuugcuu

SEQ ID NO: 2652302 - RNA, 14 nt, Human
cugcagaugccacc

SEQ ID NO: 2652303 - RNA, 16 nt, Human
cugcagaugccacccu

SEQ ID NO: 2652304 - RNA, 22 nt, Human
cugcagaugccacccuagccaa

SEQ ID NO: 2652305 - RNA, 19 nt, Human
cugcagaugccacccuagc

SEQ ID NO: 2652306 - RNA, 21 nt, Human
cugcagaugccacccuagcca

SEQ ID NO: 2652307 - RNA, 21 nt, Human
cugcaggcccuggccuccccu

SEQ ID NO: 2652308 - RNA, 19 nt, Human
cugcaggcccuggccuccc

SEQ ID NO: 2652309 - RNA, 15 nt, Human
cugcaggcuuugcca

SEQ ID NO: 2652310 - RNA, 21 nt, Human
cugaucuccauaaacaugaaa

SEQ ID NO: 2652311 - RNA, 20 nt, Human
cugaucccauuuuccucuga

SEQ ID NO: 2652312 - RNA, 18 nt, Human
cugaugucaauuucugug

SEQ ID NO: 2652313 - RNA, 19 nt, Human
cugaugucaauuucugugu

SEQ ID NO: 2652314 - RNA, 20 nt, Human
cugaugucaauuucuguguu

SEQ ID NO: 2652315 - RNA, 22 nt, Human
cugaugucaauuucuguguugc

SEQ ID NO: 2652316 - RNA, 21 nt, Human
cugauuaaguugucuaaacaa

SEQ ID NO: 2652317 - RNA, 16 nt, Human
cugauuauaggauuuu

SEQ ID NO: 2652318 - RNA, 18 nt, Human
cugaguggcaggggacag

SEQ ID NO: 2652319 - RNA, 13 nt, Human
cugaguggcaggg

SEQ ID NO: 2652320 - RNA, 16 nt, Human
cugaguggcaggggac

SEQ ID NO: 2652321 - RNA, 13 nt, Human
cugagugggaagc

SEQ ID NO: 2652322 - RNA, 15 nt, Human
cugagugggaagccc

SEQ ID NO: 2652323 - RNA, 17 nt, Human
cugagugggaagcccau

SEQ ID NO: 2652324 - RNA, 22 nt, Human
cugagugggggaucacagccuc

SEQ ID NO: 2652325 - RNA, 21 nt, Human
cugagugggaagcccauccug

SEQ ID NO: 2652326 - RNA, 22 nt, Human
cugaccaugcucaucugcuggu

SEQ ID NO: 2652327 - RNA, 20 nt, Human
cugaccaugcucaucugcug

SEQ ID NO: 2652328 - RNA, 21 nt, Human
cugaccaugcucaucugcugg

SEQ ID NO: 2652329 - RNA, 16 nt, Human
cugagggaaauguuuu

SEQ ID NO: 2652330 - RNA, 17 nt, Human
cugagggaaauguuuug

SEQ ID NO: 2652331 - RNA, 18 nt, Human
cugagggaaauguuuugu

SEQ ID NO: 2652332 - RNA, 21 nt, Human
cugagggaaauguuuuguaaa

SEQ ID NO: 2652333 - RNA, 22 nt, Human
cugagggaaauguuuuguaaac

SEQ ID NO: 2652334 - RNA, 23 nt, Human
cugagggaaauguuuuguaaaca

SEQ ID NO: 2652335 - RNA, 19 nt, Human
cugagggcagacuggggca

SEQ ID NO: 2652336 - RNA, 20 nt, Human
cugagggcagacuggggcau

SEQ ID NO: 2652337 - RNA, 20 nt, Human
cugagggcuuguaguucuuu

SEQ ID NO: 2652338 - RNA, 17 nt, Human
cugagggcuuguaguuc

SEQ ID NO: 2652339 - RNA, 14 nt, Human
cugagggcuuguag

SEQ ID NO: 2652340 - RNA, 21 nt, Human
cucuuguaucccuagugcucc

SEQ ID NO: 2652341 - RNA, 12 nt, Human
cucuugugauuu

SEQ ID NO: 2652342 - RNA, 14 nt, Human
cucuugugauuucu

SEQ ID NO: 2652343 - RNA, 17 nt, Human
cucuugugauuucuuua

SEQ ID NO: 2652344 - RNA, 22 nt, Human
cucuugugauuucuuuaaaaga

SEQ ID NO: 2652345 - RNA, 22 nt, Human
cucuuuccaguggaucauaaga

SEQ ID NO: 2652346 - RNA, 22 nt, Human
cucuuucaagcagucgugccug

SEQ ID NO: 2652347 - RNA, 18 nt, Human
cucuuuggacacucacac

SEQ ID NO: 2652348 - RNA, 15 nt, Human
cucuuuggacacuca

SEQ ID NO: 2652349 - RNA, 16 nt, Human
cucuuucccuaggaaa

SEQ ID NO: 2652350 - RNA, 14 nt, Human
cucuugaccaggcu

SEQ ID NO: 2652351 - RNA, 15 nt, Human
cucuugaccaggcug

SEQ ID NO: 2652352 - RNA, 19 nt, Human
cucuugaccaggcugccuc

SEQ ID NO: 2652353 - RNA, 14 nt, Human
cucuuguaaagacu

SEQ ID NO: 2652354 - RNA, 15 nt, Human
cucuuguaaagacug

SEQ ID NO: 2652355 - RNA, 16 nt, Human
cucuuguaaagacugg

SEQ ID NO: 2652356 - RNA, 22 nt, Human
cucuuguaaagacugguuuucu

SEQ ID NO: 2652357 - RNA, 24 nt, Human
cucuuaaaacccaagugccuuagc

SEQ ID NO: 2652358 - RNA, 13 nt, Human
cucuuaaaaccca

SEQ ID NO: 2652359 - RNA, 14 nt, Human
cucuucuggcucaa

SEQ ID NO: 2652360 - RNA, 11 nt, Human
cucuucuggcu

SEQ ID NO: 2652361 - RNA, 19 nt, Human
cucuucuggggcaggcugg

SEQ ID NO: 2652362 - RNA, 21 nt, Human
cucuucuggggcaggcugggc

SEQ ID NO: 2652363 - RNA, 23 nt, Human
cucuucuggggcaggcugggcca

SEQ ID NO: 2652364 - RNA, 12 nt, Human
cugaagagcauu

SEQ ID NO: 2652365 - RNA, 16 nt, Human
cugacagagggaugga

SEQ ID NO: 2652366 - RNA, 22 nt, Human
cugaccauauugugcuucacag

SEQ ID NO: 2652367 - RNA, 17 nt, Human
cugaccacuugaggccu

SEQ ID NO: 2652368 - RNA, 18 nt, Human
cugaccacuugaggccug

SEQ ID NO: 2652369 - RNA, 19 nt, Human
cugaccacuugaggccuga

SEQ ID NO: 2652370 - RNA, 15 nt, Human
cugaccaugcucauc

SEQ ID NO: 2652371 - RNA, 21 nt, Human
cugaaccuggguaacuaggga

SEQ ID NO: 2652372 - RNA, 23 nt, Human
cugaaccgcacagcucaggaggc

SEQ ID NO: 2652373 - RNA, 15 nt, Human
cugaaccgcacagcu

SEQ ID NO: 2652374 - RNA, 17 nt, Human
cugaaccgcacagcuca

SEQ ID NO: 2652375 - RNA, 18 nt, Human
cugaaccgcacagcucag

SEQ ID NO: 2652376 - RNA, 19 nt, Human
cugaaccgcacagcucagg

SEQ ID NO: 2652377 - RNA, 20 nt, Human
cugaaccgcacagcucagga

SEQ ID NO: 2652378 - RNA, 21 nt, Human
cugaaccgcacagcucaggag

SEQ ID NO: 2652379 - RNA, 20 nt, Human
cugaacuuaauaacugugua

SEQ ID NO: 2652380 - RNA, 20 nt, Human
cugaagagcuauuauauaaa

SEQ ID NO: 2652381 - RNA, 16 nt, Human
cugaauacagaggcaa

SEQ ID NO: 2652382 - RNA, 13 nt, Human
cucucccaaaaaa

SEQ ID NO: 2652383 - RNA, 13 nt, Human
cucuccacugugc

SEQ ID NO: 2652384 - RNA, 19 nt, Human
cucuccacugugcuuucag

SEQ ID NO: 2652385 - RNA, 20 nt, Human
cucuccagauguuuccagac

SEQ ID NO: 2652386 - RNA, 17 nt, Human
cucucagugcccuccag

SEQ ID NO: 2652387 - RNA, 20 nt, Human
cucucagugcccuccagccc

SEQ ID NO: 2652388 - RNA, 16 nt, Human
cucuaagucauguaug

SEQ ID NO: 2652389 - RNA, 17 nt, Human
cucuaagucauguaugu

SEQ ID NO: 2652390 - RNA, 18 nt, Human
cucuaagucauguauguu

SEQ ID NO: 2652391 - RNA, 20 nt, Human
cucuaagucauguauguuuc

SEQ ID NO: 2652392 - RNA, 21 nt, Human
cucuaagucauguauguuucu

SEQ ID NO: 2652393 - RNA, 22 nt, Human
cucuaagucauguauguuucuc

SEQ ID NO: 2652394 - RNA, 18 nt, Human
cucuaagugggcauugcc

SEQ ID NO: 2652395 - RNA, 19 nt, Human
cucuaagugggcauugcca

SEQ ID NO: 2652396 - RNA, 20 nt, Human
cucuaagugggcauugccau

SEQ ID NO: 2652397 - RNA, 21 nt, Human
cucucaggccggcagccccag

SEQ ID NO: 2652398 - RNA, 18 nt, Human
cucucaggccggcagccc

SEQ ID NO: 2652399 - RNA, 18 nt, Human
cucuccuuuguucccggc

SEQ ID NO: 2652400 - RNA, 22 nt, Human
cucucuaagugggcauugccau

SEQ ID NO: 2652401 - RNA, 18 nt, Human
cucucuacagagaggaaa

SEQ ID NO: 2652402 - RNA, 19 nt, Human
cucucuacagagaggaaau

SEQ ID NO: 2652403 - RNA, 20 nt, Human
cucugcaguccuacucaagc

SEQ ID NO: 2652404 - RNA, 22 nt, Human
cucugcaagaauugaagcagga

SEQ ID NO: 2652405 - RNA, 22 nt, Human
cucugaugguucuucaccuccu

SEQ ID NO: 2652406 - RNA, 17 nt, Human
cucugauccuucuuccu

SEQ ID NO: 2652407 - RNA, 22 nt, Human
cucugaucuccauaaacaugaa

SEQ ID NO: 2652408 - RNA, 13 nt, Human
cucugacuucugc

SEQ ID NO: 2652409 - RNA, 14 nt, Human
cucugacuucugcc

SEQ ID NO: 2652410 - RNA, 15 nt, Human
cucugacuucugccu

SEQ ID NO: 2652411 - RNA, 16 nt, Human
cucugacuucugccug

SEQ ID NO: 2652412 - RNA, 17 nt, Human
cucugacuucugccugg

SEQ ID NO: 2652413 - RNA, 18 nt, Human
cucugacuucugccugga

SEQ ID NO: 2652414 - RNA, 19 nt, Human
cucugacuucugccuggag

SEQ ID NO: 2652415 - RNA, 21 nt, Human
cucugacuucugccuggagac

SEQ ID NO: 2652416 - RNA, 13 nt, Human
cucugagcgccuc

SEQ ID NO: 2652417 - RNA, 22 nt, Human
cucugccuuugcaccacgggac

SEQ ID NO: 2652418 - RNA, 23 nt, Human
cucugccuuugcaccacgggaca

SEQ ID NO: 2652419 - RNA, 15 nt, Human
cucugccugccccgc

SEQ ID NO: 2652420 - RNA, 20 nt, Human
cucugccugccccgccccca

SEQ ID NO: 2652421 - RNA, 15 nt, Human
cucuggacggcaggc

SEQ ID NO: 2652422 - RNA, 16 nt, Human
cucuggacggcaggcu

SEQ ID NO: 2652423 - RNA, 17 nt, Human
cucuggacggcaggcuc

SEQ ID NO: 2652424 - RNA, 18 nt, Human
cucuggacggcaggcuca

SEQ ID NO: 2652425 - RNA, 23 nt, Human
cucuggacggcaggcucacugcc

SEQ ID NO: 2652426 - RNA, 12 nt, Human
cuccagccagcg

SEQ ID NO: 2652427 - RNA, 13 nt, Human
cuccagccagcgc

SEQ ID NO: 2652428 - RNA, 14 nt, Human
cuccagccagcgcc

SEQ ID NO: 2652429 - RNA, 15 nt, Human
cuccagccagcgccu

SEQ ID NO: 2652430 - RNA, 17 nt, Human
cuccagccagcgccucc

SEQ ID NO: 2652431 - RNA, 19 nt, Human
cuccagccagcgccucccu

SEQ ID NO: 2652432 - RNA, 20 nt, Human
cuccagccagcgccucccuc

SEQ ID NO: 2652433 - RNA, 21 nt, Human
cuccagccagcgccucccucc

SEQ ID NO: 2652434 - RNA, 22 nt, Human
cuccagccagcgccucccucca

SEQ ID NO: 2652435 - RNA, 23 nt, Human
cuccagccagcgccucccuccac

SEQ ID NO: 2652436 - RNA, 11 nt, Human
cuccagccagc

SEQ ID NO: 2652437 - RNA, 21 nt, Human
cuccagcaacuucuucuccau

SEQ ID NO: 2652438 - RNA, 16 nt, Human
cuccagccucagcccc

SEQ ID NO: 2652439 - RNA, 18 nt, Human
cuccagccucagcccccu

SEQ ID NO: 2652440 - RNA, 12 nt, Human
cuccacucugcu

SEQ ID NO: 2652441 - RNA, 13 nt, Human
cuccacucugcuu

SEQ ID NO: 2652442 - RNA, 14 nt, Human
cuccacucugcuuc

SEQ ID NO: 2652443 - RNA, 15 nt, Human
cuccacucugcuucu

SEQ ID NO: 2652444 - RNA, 16 nt, Human
cuccacucugcuucuc

SEQ ID NO: 2652445 - RNA, 17 nt, Human
cuccacucugcuucucu

SEQ ID NO: 2652446 - RNA, 20 nt, Human
cuccacucugcuucucugac

SEQ ID NO: 2652447 - RNA, 21 nt, Human
cuccacucugcuucucugacu

SEQ ID NO: 2652448 - RNA, 17 nt, Human
cuccagcaacacagccu

SEQ ID NO: 2652449 - RNA, 18 nt, Human
cuccagcaacacagccug

SEQ ID NO: 2652450 - RNA, 20 nt, Human
cuccagcaacacagccuggg

SEQ ID NO: 2652451 - RNA, 21 nt, Human
cuccagcaacacagccugggc

SEQ ID NO: 2652452 - RNA, 15 nt, Human
cuccagcaacuucuu

SEQ ID NO: 2652453 - RNA, 20 nt, Human
cuccacagcgagggcagcug

SEQ ID NO: 2652454 - RNA, 21 nt, Human
cuccacagcgagggcagcugc

SEQ ID NO: 2652455 - RNA, 22 nt, Human
cuccacagcgagggcagcugcu

SEQ ID NO: 2652456 - RNA, 23 nt, Human
cuccacagcgagggcagcugcua

SEQ ID NO: 2652457 - RNA, 16 nt, Human
cucauuuaagggaaaa

SEQ ID NO: 2652458 - RNA, 17 nt, Human
cucauuuaagggaaaaa

SEQ ID NO: 2652459 - RNA, 18 nt, Human
cucauuuaagggaaaaau

SEQ ID NO: 2652460 - RNA, 22 nt, Human
cucauuuaagggaaaaauauau

SEQ ID NO: 2652461 - RNA, 13 nt, Human
cuccacagcgagg

SEQ ID NO: 2652462 - RNA, 14 nt, Human
cuccacagcgaggg

SEQ ID NO: 2652463 - RNA, 16 nt, Human
cuccacagcgagggca

SEQ ID NO: 2652464 - RNA, 19 nt, Human
cuccacagcgagggcagcu

SEQ ID NO: 2652465 - RNA, 13 nt, Human
cuccaggccugcc

SEQ ID NO: 2652466 - RNA, 14 nt, Human
cuccaggccugccu

SEQ ID NO: 2652467 - RNA, 15 nt, Human
cuccaggccugccuc

SEQ ID NO: 2652468 - RNA, 16 nt, Human
cuccaggccugccucc

SEQ ID NO: 2652469 - RNA, 17 nt, Human
cuccaggccugccuccc

SEQ ID NO: 2652470 - RNA, 18 nt, Human
cuccaggccugccuccca

SEQ ID NO: 2652471 - RNA, 19 nt, Human
cuccaggccugccucccac

SEQ ID NO: 2652472 - RNA, 20 nt, Human
cuccaggccugccucccacu

SEQ ID NO: 2652473 - RNA, 22 nt, Human
cuccaggccugccucccacuuc

SEQ ID NO: 2652474 - RNA, 13 nt, Human
cuccagcuguuca

SEQ ID NO: 2652475 - RNA, 19 nt, Human
cuccagcuguucagcuggu

SEQ ID NO: 2652476 - RNA, 18 nt, Human
cuccagcuguucagcugg

SEQ ID NO: 2652477 - RNA, 12 nt, Human
cuccaggccaaa

SEQ ID NO: 2652478 - RNA, 13 nt, Human
cuccaggcccucc

SEQ ID NO: 2652479 - RNA, 18 nt, Human
cuccaggcccuccucucc

SEQ ID NO: 2652480 - RNA, 20 nt, Human
cuccaggcccuccucuccca

SEQ ID NO: 2652481 - RNA, 18 nt, Human
cucauuaugccacuuccu

SEQ ID NO: 2652482 - RNA, 14 nt, Human
cucaucuaucucaa

SEQ ID NO: 2652483 - RNA, 18 nt, Human
cucaucuaucucaauccu

SEQ ID NO: 2652484 - RNA, 21 nt, Human
cucauuagcauuuugcuaaau

SEQ ID NO: 2652485 - RNA, 19 nt, Human
cucauugcugagccucugc

SEQ ID NO: 2652486 - RNA, 18 nt, Human
cucauugcugagccucug

SEQ ID NO: 2652487 - RNA, 20 nt, Human
cucauugcugagccucugcu

SEQ ID NO: 2652488 - RNA, 15 nt, Human
cguuuuuguauuuuc

SEQ ID NO: 2652489 - RNA, 21 nt, Human
cguuuuuguauuuucaugaaa

SEQ ID NO: 2652490 - RNA, 16 nt, Human
cguuuuuuccucagug

SEQ ID NO: 2652491 - RNA, 23 nt, Human
cucaguuauuacauguaauuuga

SEQ ID NO: 2652492 - RNA, 19 nt, Human
cucaguguugguauauuuu

SEQ ID NO: 2652493 - RNA, 21 nt, Human
cucaguguugguauauuuuau

SEQ ID NO: 2652494 - RNA, 22 nt, Human
cucaguguugguauauuuuaua

SEQ ID NO: 2652495 - RNA, 14 nt, Human
cucaggugagaagc

SEQ ID NO: 2652496 - RNA, 12 nt, Human
cuccuucagaca

SEQ ID NO: 2652497 - RNA, 23 nt, Human
cuccuuaagcugcagagauuucu

SEQ ID NO: 2652498 - RNA, 14 nt, Human
cuccuucagacacc

SEQ ID NO: 2652499 - RNA, 13 nt, Human
cuccuucagacac

SEQ ID NO: 2652500 - RNA, 19 nt, Human
cuccuucagacacccucaa

SEQ ID NO: 2652501 - RNA, 20 nt, Human
cuccuucuaaaaacuucuca

SEQ ID NO: 2652502 - RNA, 19 nt, Human
cuccuugaguguaugagua

SEQ ID NO: 2652503 - RNA, 13 nt, Human
cuccuuagaaaaa

SEQ ID NO: 2652504 - RNA, 17 nt, Human
cuccugcccacggaguc

SEQ ID NO: 2652505 - RNA, 13 nt, Human
cuccugcccacgg

SEQ ID NO: 2652506 - RNA, 18 nt, Human
cucggaucaggcucccag

SEQ ID NO: 2652507 - RNA, 15 nt, Human
cucggccccucccac

SEQ ID NO: 2652508 - RNA, 17 nt, Human
cucggagaagagcgcag

SEQ ID NO: 2652509 - RNA, 21 nt, Human
cucgcauuugucaaugacagu

SEQ ID NO: 2652510 - RNA, 22 nt, Human
cucgcauuugucaaugacaguu

SEQ ID NO: 2652511 - RNA, 19 nt, Human
cucgcauaggaccuuucca

SEQ ID NO: 2652512 - RNA, 22 nt, Human
cucgcauaggaccuuuccacca

SEQ ID NO: 2652513 - RNA, 16 nt, Human
cucgcgcucaguaaac

SEQ ID NO: 2652514 - RNA, 16 nt, Human
cucgcgcuugcuggcc

SEQ ID NO: 2652515 - RNA, 15 nt, Human
cucgaaucucugugc

SEQ ID NO: 2652516 - RNA, 16 nt, Human
cucgaaucucugugcc

SEQ ID NO: 2652517 - RNA, 17 nt, Human
cucgaaucucugugccu

SEQ ID NO: 2652518 - RNA, 18 nt, Human
cucgaaucucugugccuu

SEQ ID NO: 2652519 - RNA, 13 nt, Human
cucgaaucucugu

SEQ ID NO: 2652520 - RNA, 14 nt, Human
cucgaaucucugug

SEQ ID NO: 2652521 - RNA, 12 nt, Human
cucgagucugag

SEQ ID NO: 2652522 - RNA, 14 nt, Human
cuccuauauauuuc

SEQ ID NO: 2652523 - RNA, 15 nt, Human
cuccuauauauuucu

SEQ ID NO: 2652524 - RNA, 17 nt, Human
cuccuauauauuucuau

SEQ ID NO: 2652525 - RNA, 18 nt, Human
cuccuauauauuucuauu

SEQ ID NO: 2652526 - RNA, 17 nt, Human
cuccuaguuugggagga

SEQ ID NO: 2652527 - RNA, 12 nt, Human
cucccuugcugg

SEQ ID NO: 2652528 - RNA, 14 nt, Human
cucccuugcuggcc

SEQ ID NO: 2652529 - RNA, 15 nt, Human
cucccuugcuggccc

SEQ ID NO: 2652530 - RNA, 17 nt, Human
cucccuugcuggcccca

SEQ ID NO: 2652531 - RNA, 18 nt, Human
cucccuugcuggccccag

SEQ ID NO: 2652532 - RNA, 22 nt, Human
cucccuugcuggccccagcccu

SEQ ID NO: 2652533 - RNA, 23 nt, Human
cucccuugcuggccccagcccug

SEQ ID NO: 2652534 - RNA, 12 nt, Human
cucccuuccuuu

SEQ ID NO: 2652535 - RNA, 19 nt, Human
cucccuuccuuuucccugc

SEQ ID NO: 2652536 - RNA, 20 nt, Human
cucccuuccuuuucccugcu

SEQ ID NO: 2652537 - RNA, 12 nt, Human
cucccuggcucc

SEQ ID NO: 2652538 - RNA, 14 nt, Human
cucccuggcucccu

SEQ ID NO: 2652539 - RNA, 15 nt, Human
cucccuggcucccuc

SEQ ID NO: 2652540 - RNA, 16 nt, Human
cucccuggcucccucc

SEQ ID NO: 2652541 - RNA, 22 nt, Human
cuccucccuuccuuuucccugc

SEQ ID NO: 2652542 - RNA, 13 nt, Human
cuccucccuuccu

SEQ ID NO: 2652543 - RNA, 14 nt, Human
cuccucccuuccuu

SEQ ID NO: 2652544 - RNA, 15 nt, Human
cuccucccuuccuuu

SEQ ID NO: 2652545 - RNA, 21 nt, Human
cuccucccuuccuuuucccug

SEQ ID NO: 2652546 - RNA, 17 nt, Human
cuccucgguucaagguc

SEQ ID NO: 2652547 - RNA, 20 nt, Human
cuccucgugaaagugcauuu

SEQ ID NO: 2652548 - RNA, 13 nt, Human
cuccugagcuagg

SEQ ID NO: 2652549 - RNA, 20 nt, Human
cuccugagcuaggaagaguc

SEQ ID NO: 2652550 - RNA, 15 nt, Human
cuccugacuggugcu

SEQ ID NO: 2652551 - RNA, 16 nt, Human
cuccugacuggugcug

SEQ ID NO: 2652552 - RNA, 18 nt, Human
cuccugacccauugcugu

SEQ ID NO: 2652553 - RNA, 19 nt, Human
cuccugacccauugcuguu

SEQ ID NO: 2652554 - RNA, 18 nt, Human
cuccugaaccgcacagcu

SEQ ID NO: 2652555 - RNA, 19 nt, Human
cuccugaaccgcacagcuc

SEQ ID NO: 2652556 - RNA, 20 nt, Human
cuccugaaccgcacagcuca

SEQ ID NO: 2652557 - RNA, 21 nt, Human
cuccugaaccgcacagcucag

SEQ ID NO: 2652558 - RNA, 23 nt, Human
cuccugaaccgcacagcucagga

SEQ ID NO: 2652559 - RNA, 19 nt, Human
cuccugacagaaggugcca

SEQ ID NO: 2652560 - RNA, 16 nt, Human
cuccugacagaaggug

SEQ ID NO: 2652561 - RNA, 18 nt, Human
cuccugacagaaggugcc

SEQ ID NO: 2652562 - RNA, 14 nt, Human
cuccugacagaagg

SEQ ID NO: 2652563 - RNA, 18 nt, Human
cuucgggcgucugugugc

SEQ ID NO: 2652564 - RNA, 21 nt, Human
cuucgggaggucgaggcagga

SEQ ID NO: 2652565 - RNA, 20 nt, Human
cuucgggaggucgaggcagg

SEQ ID NO: 2652566 - RNA, 12 nt, Human
cuucuaaaaacu

SEQ ID NO: 2652567 - RNA, 13 nt, Human
cuucuaaaaacuu

SEQ ID NO: 2652568 - RNA, 16 nt, Human
cuucucagaguggugg

SEQ ID NO: 2652569 - RNA, 14 nt, Human
cuucucagauuucu

SEQ ID NO: 2652570 - RNA, 22 nt, Human
cuucucagauuucugaggaaau

SEQ ID NO: 2652571 - RNA, 19 nt, Human
cuucucagauuucugagga

SEQ ID NO: 2652572 - RNA, 15 nt, Human
cuucgaaaccuggga

SEQ ID NO: 2652573 - RNA, 15 nt, Human
cuuccuuuucccugc

SEQ ID NO: 2652574 - RNA, 16 nt, Human
cuuccuuuucccugcu

SEQ ID NO: 2652575 - RNA, 17 nt, Human
cuuccuuuucccugcuu

SEQ ID NO: 2652576 - RNA, 19 nt, Human
cuuccuuuucccugcuucc

SEQ ID NO: 2652577 - RNA, 22 nt, Human
cuuccuuuucccugcuuccagg

SEQ ID NO: 2652578 - RNA, 23 nt, Human
cuuccuugagacacggagcccag

SEQ ID NO: 2652579 - RNA, 20 nt, Human
cuuccuugagacacggagcc

SEQ ID NO: 2652580 - RNA, 18 nt, Human
cuuccuugagacacggag

SEQ ID NO: 2652581 - RNA, 22 nt, Human
cuuccuugaagaacugcaggcc

SEQ ID NO: 2652582 - RNA, 21 nt, Human
cuuccuugaagaacugcaggc

SEQ ID NO: 2652583 - RNA, 23 nt, Human
cuucugcuuuucugcccuggcug

SEQ ID NO: 2652584 - RNA, 14 nt, Human
cuucugcuuuucug

SEQ ID NO: 2652585 - RNA, 16 nt, Human
cuucugcuuuucugcc

SEQ ID NO: 2652586 - RNA, 17 nt, Human
cuucugcuuuucugccc

SEQ ID NO: 2652587 - RNA, 18 nt, Human
cuucugcuuuucugcccu

SEQ ID NO: 2652588 - RNA, 19 nt, Human
cuucugcuuuucugcccug

SEQ ID NO: 2652589 - RNA, 20 nt, Human
cuucugcuuuucugcccugg

SEQ ID NO: 2652590 - RNA, 21 nt, Human
cuucugcuuuucugcccuggc

SEQ ID NO: 2652591 - RNA, 22 nt, Human
cuucugcuuuucugcccuggcu

SEQ ID NO: 2652592 - RNA, 13 nt, Human
cuucagcuccagg

SEQ ID NO: 2652593 - RNA, 15 nt, Human
cuucagcuccaggga

SEQ ID NO: 2652594 - RNA, 23 nt, Human
cuucagcuccagggaauccaagc

SEQ ID NO: 2652595 - RNA, 11 nt, Human
cuucagcugac

SEQ ID NO: 2652596 - RNA, 16 nt, Human
cuucagggcugcuggg

SEQ ID NO: 2652597 - RNA, 14 nt, Human
cuuccaaauaaaua

SEQ ID NO: 2652598 - RNA, 15 nt, Human
cuuccaaauaaauaa

SEQ ID NO: 2652599 - RNA, 18 nt, Human
cuuccagauggucaucca

SEQ ID NO: 2652600 - RNA, 19 nt, Human
cuuccagauggucauccag

SEQ ID NO: 2652601 - RNA, 20 nt, Human
cuuccagauggucauccaga

SEQ ID NO: 2652602 - RNA, 21 nt, Human
cuuccagauggucauccagac

SEQ ID NO: 2652603 - RNA, 13 nt, Human
cuuccagcauuua

SEQ ID NO: 2652604 - RNA, 21 nt, Human
cuuccagcauuuagcuggcca

SEQ ID NO: 2652605 - RNA, 16 nt, Human
cuuccaguauaaccag

SEQ ID NO: 2652606 - RNA, 14 nt, Human
cuuccgcagugugg

SEQ ID NO: 2652607 - RNA, 15 nt, Human
cuuccgcaguguggc

SEQ ID NO: 2652608 - RNA, 17 nt, Human
cuuccgcaguguggcca

SEQ ID NO: 2652609 - RNA, 21 nt, Human
cuuccgcaguguggccaggcu

SEQ ID NO: 2652610 - RNA, 19 nt, Human
cuuauaagugaagugauac

SEQ ID NO: 2652611 - RNA, 21 nt, Human
cuuauaaaacagaguaaucuu

SEQ ID NO: 2652612 - RNA, 18 nt, Human
cuuauaaaauccugugca

SEQ ID NO: 2652613 - RNA, 19 nt, Human
cuuauaaaauccugugcaa

SEQ ID NO: 2652614 - RNA, 18 nt, Human
cuuauaaaguggaaguau

SEQ ID NO: 2652615 - RNA, 20 nt, Human
cuuauaaaguggaaguaugu

SEQ ID NO: 2652616 - RNA, 24 nt, Human
cuuauaaaguggaaguauguauau

SEQ ID NO: 2652617 - RNA, 20 nt, Human
cuuauaaaacagaguaaucu

SEQ ID NO: 2652618 - RNA, 17 nt, Human
cuuagguuggcaaaaag

SEQ ID NO: 2652619 - RNA, 20 nt, Human
cuuauaagugaagugauacu

SEQ ID NO: 2652620 - RNA, 16 nt, Human
cuuauagucuaagacu

SEQ ID NO: 2652621 - RNA, 21 nt, Human
cuuauagucuaagacuauaua

SEQ ID NO: 2652622 - RNA, 14 nt, Human
cuuauaauuguucu

SEQ ID NO: 2652623 - RNA, 21 nt, Human
cuuauaauuguucucagaauc

SEQ ID NO: 2652624 - RNA, 15 nt, Human
cuuauaaugggcucu

SEQ ID NO: 2652625 - RNA, 18 nt, Human
cuuaucuccacaaccucu

SEQ ID NO: 2652626 - RNA, 20 nt, Human
cuuaucuuacaauauugauu

SEQ ID NO: 2652627 - RNA, 18 nt, Human
cuuauuguuucucugaaa

SEQ ID NO: 2652628 - RNA, 20 nt, Human
cuuaugauuaaacuuccuuc

SEQ ID NO: 2652629 - RNA, 21 nt, Human
cuuaugauuaaacuuccuucu

SEQ ID NO: 2652630 - RNA, 19 nt, Human
cuuaugaaugauuugcaua

SEQ ID NO: 2652631 - RNA, 14 nt, Human
cuuaugaggagggg

SEQ ID NO: 2652632 - RNA, 15 nt, Human
cuuaugaggagggga

SEQ ID NO: 2652633 - RNA, 20 nt, Human
cuuaugaaugauuugcauau

SEQ ID NO: 2652634 - RNA, 18 nt, Human
cuuaugaaugauuugcau

SEQ ID NO: 2652635 - RNA, 22 nt, Human
cuuagaucauaguuuuauuuau

SEQ ID NO: 2652636 - RNA, 21 nt, Human
cuuagaucauaguuuuauuua

SEQ ID NO: 2652637 - RNA, 13 nt, Human
cuuagaucauagu

SEQ ID NO: 2652638 - RNA, 19 nt, Human
cuuagaucauaguuuuauu

SEQ ID NO: 2652639 - RNA, 18 nt, Human
cuuagaucauaguuuuau

SEQ ID NO: 2652640 - RNA, 17 nt, Human
cuuagaucauaguuuua

SEQ ID NO: 2652641 - RNA, 16 nt, Human
cuuagaucauaguuuu

SEQ ID NO: 2652642 - RNA, 21 nt, Human
cuuacuuuguaaauucugauu

SEQ ID NO: 2652643 - RNA, 20 nt, Human
cuuacuuuguaaauucugau

SEQ ID NO: 2652644 - RNA, 19 nt, Human
cuuacuuuguaaauucuga

SEQ ID NO: 2652645 - RNA, 17 nt, Human
cuuacuuuguaaauucu

SEQ ID NO: 2652646 - RNA, 15 nt, Human
cuuacuuuguaaauu

SEQ ID NO: 2652647 - RNA, 13 nt, Human
cuuacuaaaaagu

SEQ ID NO: 2652648 - RNA, 15 nt, Human
cuuacuaaaaaguau

SEQ ID NO: 2652649 - RNA, 17 nt, Human
cuuacuaaaaaguauaa

SEQ ID NO: 2652650 - RNA, 18 nt, Human
cuuacuaaaaaguauaaa

SEQ ID NO: 2652651 - RNA, 21 nt, Human
cuuacuaaaaaguauaaaaua

SEQ ID NO: 2652652 - RNA, 17 nt, Human
cuuaauggaguucuugu

SEQ ID NO: 2652653 - RNA, 18 nt, Human
cuuaauggaguucuugug

SEQ ID NO: 2652654 - RNA, 15 nt, Human
cuuacuacagaaaug

SEQ ID NO: 2652655 - RNA, 12 nt, Human
cuuacuaggaag

SEQ ID NO: 2652656 - RNA, 13 nt, Human
cuuacuuugcuga

SEQ ID NO: 2652657 - RNA, 11 nt, Human
cuuacuuugua

SEQ ID NO: 2652658 - RNA, 14 nt, Human
cuuacuuuguaaau

SEQ ID NO: 2652659 - RNA, 12 nt, Human
cuuacuuuguaa

SEQ ID NO: 2652660 - RNA, 15 nt, Human
cuguuucucuugagc

SEQ ID NO: 2652661 - RNA, 16 nt, Human
cuguuucucuugagcu

SEQ ID NO: 2652662 - RNA, 17 nt, Human
cuguuucucuugagcug

SEQ ID NO: 2652663 - RNA, 20 nt, Human
cuguuucucuugagcuggcc

SEQ ID NO: 2652664 - RNA, 21 nt, Human
cuguuucucuugagcuggccu

SEQ ID NO: 2652665 - RNA, 22 nt, Human
cuguuucucuugagcuggccuc

SEQ ID NO: 2652666 - RNA, 19 nt, Human
cuguuuccugacauugucu

SEQ ID NO: 2652667 - RNA, 20 nt, Human
cuguuuccugacauugucuc

SEQ ID NO: 2652668 - RNA, 13 nt, Human
cuguuuccugggc

SEQ ID NO: 2652669 - RNA, 16 nt, Human
cuguuuccugggcacg

SEQ ID NO: 2652670 - RNA, 13 nt, Human
cuguuuauuacuu

SEQ ID NO: 2652671 - RNA, 14 nt, Human
cuguuuauuacuuc

SEQ ID NO: 2652672 - RNA, 18 nt, Human
cuguuuauuacuuccaug

SEQ ID NO: 2652673 - RNA, 19 nt, Human
cuguuuauuacuuccauga

SEQ ID NO: 2652674 - RNA, 21 nt, Human
cuguuuauuacuuccaugaau

SEQ ID NO: 2652675 - RNA, 22 nt, Human
cuguuuaaucauaguuacugug

SEQ ID NO: 2652676 - RNA, 23 nt, Human
cuguuuaaucauaguuacugugu

SEQ ID NO: 2652677 - RNA, 12 nt, Human
cugguugcaugg

SEQ ID NO: 2652678 - RNA, 22 nt, Human
cugguugcauggaaaucagcca

SEQ ID NO: 2652679 - RNA, 17 nt, Human
cuguuucugauuugcug

SEQ ID NO: 2652680 - RNA, 17 nt, Human
cuguuucugcuugcucu

SEQ ID NO: 2652681 - RNA, 14 nt, Human
cuguuuucucuuga

SEQ ID NO: 2652682 - RNA, 13 nt, Human
cuguuuucucuug

SEQ ID NO: 2652683 - RNA, 17 nt, Human
cuguuuucucuugagag

SEQ ID NO: 2652684 - RNA, 14 nt, Human
cuuaaucauuuuca

SEQ ID NO: 2652685 - RNA, 20 nt, Human
cuuaaucauuuucauuccua

SEQ ID NO: 2652686 - RNA, 17 nt, Human
cuuaagaaauguauaaa

SEQ ID NO: 2652687 - RNA, 20 nt, Human
cuuaagaaauguauaaacuu

SEQ ID NO: 2652688 - RNA, 18 nt, Human
cuuaagugaggaaaucaa

SEQ ID NO: 2652689 - RNA, 19 nt, Human
cuuaagugaggaaaucaaa

SEQ ID NO: 2652690 - RNA, 21 nt, Human
cuuaagugaggaaaucaaagu

SEQ ID NO: 2652691 - RNA, 20 nt, Human
cuuaagugaggaaaucaaag

SEQ ID NO: 2652692 - RNA, 20 nt, Human
cuuaaguuagccuccaccac

SEQ ID NO: 2652693 - RNA, 19 nt, Human
cuuaacugcauuuuuagac

SEQ ID NO: 2652694 - RNA, 12 nt, Human
cuuaacugaaau

SEQ ID NO: 2652695 - RNA, 11 nt, Human
cuuaaaucuua

SEQ ID NO: 2652696 - RNA, 12 nt, Human
cuuaaaucuuaa

SEQ ID NO: 2652697 - RNA, 19 nt, Human
cuuaaaucuuaauguuccu

SEQ ID NO: 2652698 - RNA, 14 nt, Human
cuguuuuuuuguua

SEQ ID NO: 2652699 - RNA, 16 nt, Human
cuuaaauguuauuauc

SEQ ID NO: 2652700 - RNA, 12 nt, Human
cuuaaauuuaau

SEQ ID NO: 2652701 - RNA, 16 nt, Human
cuuaaauuuaauacca

SEQ ID NO: 2652702 - RNA, 13 nt, Human
cuuaaauuucuua

SEQ ID NO: 2652703 - RNA, 14 nt, Human
cuuaaauuucuuau

SEQ ID NO: 2652704 - RNA, 18 nt, Human
cuuaaauuucuuauguga

SEQ ID NO: 2652705 - RNA, 19 nt, Human
cuuaaauuucuuaugugac

SEQ ID NO: 2652706 - RNA, 20 nt, Human
cuuaaauuucuuaugugaca

SEQ ID NO: 2652707 - RNA, 22 nt, Human
cuuaaauuucuuaugugacauu

SEQ ID NO: 2652708 - RNA, 17 nt, Human
cuuuguuuucugacuaa

SEQ ID NO: 2652709 - RNA, 20 nt, Human
cuuuguuuucugacuaauua

SEQ ID NO: 2652710 - RNA, 21 nt, Human
cuuuguuuguugucagcugaa

SEQ ID NO: 2652711 - RNA, 18 nt, Human
cuuuguugcaagauguga

SEQ ID NO: 2652712 - RNA, 19 nt, Human
cuuuguugcaagaugugaa

SEQ ID NO: 2652713 - RNA, 20 nt, Human
cuuuguugcaagaugugaau

SEQ ID NO: 2652714 - RNA, 21 nt, Human
cuuuguugcaagaugugaauu

SEQ ID NO: 2652715 - RNA, 20 nt, Human
cuuugggaggccgaggcggg

SEQ ID NO: 2652716 - RNA, 13 nt, Human
cuuuucugcccug

SEQ ID NO: 2652717 - RNA, 14 nt, Human
cuuuucugcccugg

SEQ ID NO: 2652718 - RNA, 15 nt, Human
cuuuucugcccuggc

SEQ ID NO: 2652719 - RNA, 17 nt, Human
cuuuuuuaaauauuuuc

SEQ ID NO: 2652720 - RNA, 18 nt, Human
cuuuuuuaaauauuuucu

SEQ ID NO: 2652721 - RNA, 22 nt, Human
cuuuuuuaaauauuuucuauuu

SEQ ID NO: 2652722 - RNA, 21 nt, Human
cuuuuuguuguaaaacaaaau

SEQ ID NO: 2652723 - RNA, 13 nt, Human
cuuuuugacacug

SEQ ID NO: 2652724 - RNA, 14 nt, Human
cuuuuugacacuga

SEQ ID NO: 2652725 - RNA, 15 nt, Human
cuuuuugacacugaa

SEQ ID NO: 2652726 - RNA, 21 nt, Human
cuuuugaagcauagauaauau

SEQ ID NO: 2652727 - RNA, 12 nt, Human
cuuuuguuuggu

SEQ ID NO: 2652728 - RNA, 14 nt, Human
cuuuuguuugguaa

SEQ ID NO: 2652729 - RNA, 15 nt, Human
cuuuuguuugguaaa

SEQ ID NO: 2652730 - RNA, 16 nt, Human
cuuuuguuugguaaau

SEQ ID NO: 2652731 - RNA, 18 nt, Human
cuuuuguuugguaaaugu

SEQ ID NO: 2652732 - RNA, 18 nt, Human
cuuuuuaaaaauuguuau

SEQ ID NO: 2652733 - RNA, 21 nt, Human
cuuuuuaaaaauuguuauuua

SEQ ID NO: 2652734 - RNA, 14 nt, Human
cuuuuuaaaacaca

SEQ ID NO: 2652735 - RNA, 17 nt, Human
cuuuuuaaaacacaugu

SEQ ID NO: 2652736 - RNA, 17 nt, Human
cuuuuucaggagaauua

SEQ ID NO: 2652737 - RNA, 18 nt, Human
cuuuuucauaaauuauuu

SEQ ID NO: 2652738 - RNA, 20 nt, Human
gaaaaguaauauuuauuaaa

SEQ ID NO: 2652739 - RNA, 19 nt, Human
gaaaaguaauauuuauuaa

SEQ ID NO: 2652740 - RNA, 17 nt, Human
gaaaaguaauauuuauu

SEQ ID NO: 2652741 - RNA, 16 nt, Human
gaaaaguaauauuuau

SEQ ID NO: 2652742 - RNA, 14 nt, Human
gaaaaguaauauuu

SEQ ID NO: 2652743 - RNA, 14 nt, Human
gaaaacggagcuga

SEQ ID NO: 2652744 - RNA, 13 nt, Human
gaaaacggagcug

SEQ ID NO: 2652745 - RNA, 14 nt, Human
gaaaacauguuaau

SEQ ID NO: 2652746 - RNA, 16 nt, Human
gaaaacauguuaauga

SEQ ID NO: 2652747 - RNA, 20 nt, Human
gaaaacauguuaaugacaau

SEQ ID NO: 2652748 - RNA, 16 nt, Human
gaaaacauggaacagu

SEQ ID NO: 2652749 - RNA, 16 nt, Human
gaaaaauaucuuggcc

SEQ ID NO: 2652750 - RNA, 17 nt, Human
gaaaaauagugucuuug

SEQ ID NO: 2652751 - RNA, 20 nt, Human
gaaaaauagugucuuuguga

SEQ ID NO: 2652752 - RNA, 12 nt, Human
gaaaaauauaaa

SEQ ID NO: 2652753 - RNA, 16 nt, Human
gaaaaauauaaaauua

SEQ ID NO: 2652754 - RNA, 17 nt, Human
gaaaaauauaaaauuau

SEQ ID NO: 2652755 - RNA, 16 nt, Human
gaaaaauuggggagga

SEQ ID NO: 2652756 - RNA, 19 nt, Human
gaaaaauuggggaggaggg

SEQ ID NO: 2652757 - RNA, 19 nt, Human
gaaaaaucgcgaguguuuc

SEQ ID NO: 2652758 - RNA, 13 nt, Human
cuuugcauauuau

SEQ ID NO: 2652759 - RNA, 15 nt, Human
cuuugcauauuauaa

SEQ ID NO: 2652760 - RNA, 23 nt, Human
cuuugcauauuauaaaggauaaa

SEQ ID NO: 2652761 - RNA, 23 nt, Human
cuuugggaggccaaggugggagg

SEQ ID NO: 2652762 - RNA, 14 nt, Human
cuuuggauucuaaa

SEQ ID NO: 2652763 - RNA, 18 nt, Human
cuuuggauucuaaauaca

SEQ ID NO: 2652764 - RNA, 20 nt, Human
cuuuggauucuaaauacaug

SEQ ID NO: 2652765 - RNA, 21 nt, Human
cuuuggauucuaaauacaugc

SEQ ID NO: 2652766 - RNA, 22 nt, Human
cuuuaggagauuuauuuuuugg

SEQ ID NO: 2652767 - RNA, 21 nt, Human
cuuuagacuugaaaagagaca

SEQ ID NO: 2652768 - RNA, 17 nt, Human
cuuuagacuugaaaaga

SEQ ID NO: 2652769 - RNA, 18 nt, Human
cuuuccucucuauauuuc

SEQ ID NO: 2652770 - RNA, 17 nt, Human
cuuuccucucuauauuu

SEQ ID NO: 2652771 - RNA, 16 nt, Human
cuuuccucucuauauu

SEQ ID NO: 2652772 - RNA, 21 nt, Human
cuuucugccaucuagccagcc

SEQ ID NO: 2652773 - RNA, 22 nt, Human
cuuucugccaucuagccagccc

SEQ ID NO: 2652774 - RNA, 11 nt, Human
cuuucugccug

SEQ ID NO: 2652775 - RNA, 12 nt, Human
cuuucugccugg

SEQ ID NO: 2652776 - RNA, 14 nt, Human
cuuucugccuggag

SEQ ID NO: 2652777 - RNA, 15 nt, Human
cuuucugccuggagu

SEQ ID NO: 2652778 - RNA, 15 nt, Human
cuuguagauuugauu

SEQ ID NO: 2652779 - RNA, 14 nt, Human
cuuguagauuugau

SEQ ID NO: 2652780 - RNA, 18 nt, Human
cuuggggcucacacaccu

SEQ ID NO: 2652781 - RNA, 15 nt, Human
cuugguugucuggca

SEQ ID NO: 2652782 - RNA, 21 nt, Human
cuugggcuauuuggacucagg

SEQ ID NO: 2652783 - RNA, 12 nt, Human
cuugcuugccug

SEQ ID NO: 2652784 - RNA, 17 nt, Human
cuugcuugccugcaggg

SEQ ID NO: 2652785 - RNA, 19 nt, Human
cuugcuugccugcagggcc

SEQ ID NO: 2652786 - RNA, 16 nt, Human
cuugggaggcuucccc

SEQ ID NO: 2652787 - RNA, 15 nt, Human
cuugggaggcuuccc

SEQ ID NO: 2652788 - RNA, 14 nt, Human
cuugggaggcugag

SEQ ID NO: 2652789 - RNA, 16 nt, Human
cuugggaggcugaggc

SEQ ID NO: 2652790 - RNA, 23 nt, Human
cuugggaggcugaggcaggagaa

SEQ ID NO: 2652791 - RNA, 23 nt, Human
cuuggagaaugugagaagccagc

SEQ ID NO: 2652792 - RNA, 13 nt, Human
cuuggagaaauga

SEQ ID NO: 2652793 - RNA, 15 nt, Human
cuuggagaaaugaaa

SEQ ID NO: 2652794 - RNA, 13 nt, Human
cuugggcagagcu

SEQ ID NO: 2652795 - RNA, 20 nt, Human
cuugggccacugugaagaga

SEQ ID NO: 2652796 - RNA, 18 nt, Human
cuugggccacugugaaga

SEQ ID NO: 2652797 - RNA, 15 nt, Human
cuuguguuuuaaaau

SEQ ID NO: 2652798 - RNA, 14 nt, Human
cuuguuacuucuga

SEQ ID NO: 2652799 - RNA, 15 nt, Human
cuuguuacuucugag

SEQ ID NO: 2652800 - RNA, 17 nt, Human
cuuguuacuucugaggu

SEQ ID NO: 2652801 - RNA, 14 nt, Human
cuuguggguccaug

SEQ ID NO: 2652802 - RNA, 16 nt, Human
cuuguggguccaugcu

SEQ ID NO: 2652803 - RNA, 24 nt, Human
cuuguggguccaugcuaacaaaga

SEQ ID NO: 2652804 - RNA, 17 nt, Human
cuuguagcgacuaaacu

SEQ ID NO: 2652805 - RNA, 22 nt, Human
cuuguagcgacuaaacuagauu

SEQ ID NO: 2652806 - RNA, 17 nt, Human
cuuguagauuugauuuu

SEQ ID NO: 2652807 - RNA, 18 nt, Human
cuuguccuagcuugggag

SEQ ID NO: 2652808 - RNA, 15 nt, Human
cuuguccucagccag

SEQ ID NO: 2652809 - RNA, 16 nt, Human
cuuguccucagccagu

SEQ ID NO: 2652810 - RNA, 14 nt, Human
cuuuaccuguauac

SEQ ID NO: 2652811 - RNA, 17 nt, Human
cuuuaccuuuucagggc

SEQ ID NO: 2652812 - RNA, 20 nt, Human
cuuuaccuuuucagggcugg

SEQ ID NO: 2652813 - RNA, 14 nt, Human
cuuuagacccuggg

SEQ ID NO: 2652814 - RNA, 16 nt, Human
cuuuagacccugggug

SEQ ID NO: 2652815 - RNA, 23 nt, Human
cuuuagacccugggugggcucug

SEQ ID NO: 2652816 - RNA, 15 nt, Human
cuuuagacuugaaaa

SEQ ID NO: 2652817 - RNA, 14 nt, Human
cuuuagacuugaaa

SEQ ID NO: 2652818 - RNA, 13 nt, Human
cuuuagacuugaa

SEQ ID NO: 2652819 - RNA, 12 nt, Human
cuuuagacuuga

SEQ ID NO: 2652820 - RNA, 12 nt, Human
cuuuaaaagaau

SEQ ID NO: 2652821 - RNA, 15 nt, Human
cuuuaaaagaaugac

SEQ ID NO: 2652822 - RNA, 16 nt, Human
cuuuaaaagaaugacu

SEQ ID NO: 2652823 - RNA, 20 nt, Human
cuuuaaaaagggaagaaacu

SEQ ID NO: 2652824 - RNA, 21 nt, Human
cuuuaaaaagggaagaaacug

SEQ ID NO: 2652825 - RNA, 12 nt, Human
cuuguuucugaa

SEQ ID NO: 2652826 - RNA, 15 nt, Human
cuuguuucacugaaa

SEQ ID NO: 2652827 - RNA, 20 nt, Human
cuuguugcucaaaaaaugag

SEQ ID NO: 2652828 - RNA, 20 nt, Human
cuuguugccuauaagccaaa

SEQ ID NO: 2652829 - RNA, 15 nt, Human
cuuguuuaccuuucu

SEQ ID NO: 2652830 - RNA, 19 nt, Human
cuuguuuaccuuucucucu

SEQ ID NO: 2652831 - RNA, 22 nt, Human
cuuguuuaccuuucucucucua

SEQ ID NO: 2652832 - RNA, 17 nt, Human
cuugcuucccuaaucua

SEQ ID NO: 2652833 - RNA, 13 nt, Human
cuugcuucccuaa

SEQ ID NO: 2652834 - RNA, 15 nt, Human
cuugccaucagugaa

SEQ ID NO: 2652835 - RNA, 17 nt, Human
cuugccaucagugaaaa

SEQ ID NO: 2652836 - RNA, 12 nt, Human
cuugcccauccu

SEQ ID NO: 2652837 - RNA, 13 nt, Human
cuugcccauccug

SEQ ID NO: 2652838 - RNA, 14 nt, Human
cuugcccauccuga

SEQ ID NO: 2652839 - RNA, 16 nt, Human
cuugcccauccugacu

SEQ ID NO: 2652840 - RNA, 18 nt, Human
cuugcccauccugacuga

SEQ ID NO: 2652841 - RNA, 15 nt, Human
cuugcaccaaauuau

SEQ ID NO: 2652842 - RNA, 18 nt, Human
cuugcaccaaauuaucuu

SEQ ID NO: 2652843 - RNA, 19 nt, Human
cuugaguugauucagcucu

SEQ ID NO: 2652844 - RNA, 18 nt, Human
cuugaguugauucagcuc

SEQ ID NO: 2652845 - RNA, 20 nt, Human
cuugaguugauucagcucug

SEQ ID NO: 2652846 - RNA, 12 nt, Human
cuucuggcucaa

SEQ ID NO: 2652847 - RNA, 23 nt, Human
cuugagaagaccucaccuagaaa

SEQ ID NO: 2652848 - RNA, 22 nt, Human
cuugagacacggagcccagccc

SEQ ID NO: 2652849 - RNA, 17 nt, Human
cuugagacacggagccc

SEQ ID NO: 2652850 - RNA, 12 nt, Human
cuugagcccugg

SEQ ID NO: 2652851 - RNA, 13 nt, Human
cuugagcccuggc

SEQ ID NO: 2652852 - RNA, 14 nt, Human
cuugagcccuggcu

SEQ ID NO: 2652853 - RNA, 20 nt, Human
cuugagcccuggcuguucug

SEQ ID NO: 2652854 - RNA, 15 nt, Human
cuugagccugggagg

SEQ ID NO: 2652855 - RNA, 12 nt, Human
cuugagccuggg

SEQ ID NO: 2652856 - RNA, 20 nt, Human
cuugagccgggccccugggc

SEQ ID NO: 2652857 - RNA, 17 nt, Human
cuugagccgggccccug

SEQ ID NO: 2652858 - RNA, 19 nt, Human
cuugagccgggccccuggg

SEQ ID NO: 2652859 - RNA, 13 nt, Human
cuugagggcugca

SEQ ID NO: 2652860 - RNA, 14 nt, Human
cuugagggcugcag

SEQ ID NO: 2652861 - RNA, 15 nt, Human
cuugagggcugcagu

SEQ ID NO: 2652862 - RNA, 23 nt, Human
cuugagggcugcaguucuacuca

SEQ ID NO: 2652863 - RNA, 21 nt, Human
gaccuuaggccuuccucucuc

SEQ ID NO: 2652864 - RNA, 18 nt, Human
gaccuuaggccuuccucu

SEQ ID NO: 2652865 - RNA, 16 nt, Human
gaccuuaggccuuccu

SEQ ID NO: 2652866 - RNA, 15 nt, Human
gaccuuaggccuucc

SEQ ID NO: 2652867 - RNA, 13 nt, Human
gaccuuaggccuu

SEQ ID NO: 2652868 - RNA, 17 nt, Human
gaccuguaacuuuugua

SEQ ID NO: 2652869 - RNA, 21 nt, Human
gaccuguauauuuguaaagcu

SEQ ID NO: 2652870 - RNA, 23 nt, Human
gaccuguauauuuguaaagcuau

SEQ ID NO: 2652871 - RNA, 22 nt, Human
gaccuggcacuggaugcagaaa

SEQ ID NO: 2652872 - RNA, 18 nt, Human
gaccuggcacuggaugca

SEQ ID NO: 2652873 - RNA, 19 nt, Human
gaccuggggcugcugugaa

SEQ ID NO: 2652874 - RNA, 20 nt, Human
gaccuggcaucuaauucuga

SEQ ID NO: 2652875 - RNA, 19 nt, Human
gacguuuauaaacagaaau

SEQ ID NO: 2652876 - RNA, 23 nt, Human
gacguuuauaaacagaaauggaa

SEQ ID NO: 2652877 - RNA, 16 nt, Human
gacuaacucaaauaca

SEQ ID NO: 2652878 - RNA, 16 nt, Human
gacuaagagaaguugu

SEQ ID NO: 2652879 - RNA, 23 nt, Human
gacuaagagaaguuguaaaguau

SEQ ID NO: 2652880 - RNA, 19 nt, Human
gacggcaggcucacugcca

SEQ ID NO: 2652881 - RNA, 11 nt, Human
gacggcaggcu

SEQ ID NO: 2652882 - RNA, 16 nt, Human
gacggcaggcucacug

SEQ ID NO: 2652883 - RNA, 20 nt, Human
gacggcaggcucacugccag

SEQ ID NO: 2652884 - RNA, 16 nt, Human
gacggccaagaaugua

SEQ ID NO: 2652885 - RNA, 11 nt, Human
gacgugcuggg

SEQ ID NO: 2652886 - RNA, 22 nt, Human
gacgugaccggacuuuucugca

SEQ ID NO: 2652887 - RNA, 15 nt, Human
gacuaauuaggcaag

SEQ ID NO: 2652888 - RNA, 19 nt, Human
gacucgguuucuccaaacu

SEQ ID NO: 2652889 - RNA, 13 nt, Human
gacugauuuuaau

SEQ ID NO: 2652890 - RNA, 22 nt, Human
gacugagugggaagcccauccu

SEQ ID NO: 2652891 - RNA, 15 nt, Human
gacugagugggaagc

SEQ ID NO: 2652892 - RNA, 16 nt, Human
gacugagugggaagcc

SEQ ID NO: 2652893 - RNA, 17 nt, Human
gacugagugggaagccc

SEQ ID NO: 2652894 - RNA, 16 nt, Human
gacugacugaggcagu

SEQ ID NO: 2652895 - RNA, 21 nt, Human
gacugaccuuguaaaagacag

SEQ ID NO: 2652896 - RNA, 15 nt, Human
gacugacugaggcag

SEQ ID NO: 2652897 - RNA, 14 nt, Human
gacugacugaggca

SEQ ID NO: 2652898 - RNA, 12 nt, Human
gacugcuaaaua

SEQ ID NO: 2652899 - RNA, 14 nt, Human
gacugcuaaauaaa

SEQ ID NO: 2652900 - RNA, 17 nt, Human
gacugcuaaauaaaauu

SEQ ID NO: 2652901 - RNA, 18 nt, Human
gacugcuaaauaaaauuu

SEQ ID NO: 2652902 - RNA, 21 nt, Human
gacugcuaccuuucaaagcuu

SEQ ID NO: 2652903 - RNA, 10 nt, Human
gacuggcuuu

SEQ ID NO: 2652904 - RNA, 20 nt, Human
gacuggcuuuuauuaaugca

SEQ ID NO: 2652905 - RNA, 21 nt, Human
gacuggcuuuuauuaaugcac

SEQ ID NO: 2652906 - RNA, 22 nt, Human
gacuggcuuuuauuaaugcacu

SEQ ID NO: 2652907 - RNA, 23 nt, Human
gacuggcuuuuauuaaugcacuu

SEQ ID NO: 2652908 - RNA, 12 nt, Human
gacuucaaagca

SEQ ID NO: 2652909 - RNA, 17 nt, Human
gacuucaaagcaagcug

SEQ ID NO: 2652910 - RNA, 16 nt, Human
gacuuagggcaccagg

SEQ ID NO: 2652911 - RNA, 17 nt, Human
gacuuagggcaccaggg

SEQ ID NO: 2652912 - RNA, 23 nt, Human
gacuuagaaucccuguguuaauu

SEQ ID NO: 2652913 - RNA, 21 nt, Human
gacuuagaaucccuguguuaa

SEQ ID NO: 2652914 - RNA, 20 nt, Human
gacuuagaaucccuguguua

SEQ ID NO: 2652915 - RNA, 12 nt, Human
gacuuagaaucc

SEQ ID NO: 2652916 - RNA, 15 nt, Human
gaccagaggagccuu

SEQ ID NO: 2652917 - RNA, 18 nt, Human
gaccagaggagccuuuuu

SEQ ID NO: 2652918 - RNA, 19 nt, Human
gaccagaggagccuuuuua

SEQ ID NO: 2652919 - RNA, 21 nt, Human
gaccagaggagccuuuuuaaa

SEQ ID NO: 2652920 - RNA, 15 nt, Human
gaccaagcaucuugg

SEQ ID NO: 2652921 - RNA, 20 nt, Human
gaccaagcaucuuggggggg

SEQ ID NO: 2652922 - RNA, 18 nt, Human
gaccacaaaacuuuucua

SEQ ID NO: 2652923 - RNA, 10 nt, Human
gacccagugc

SEQ ID NO: 2652924 - RNA, 12 nt, Human
gacccagugcag

SEQ ID NO: 2652925 - RNA, 13 nt, Human
gacccagugcaga

SEQ ID NO: 2652926 - RNA, 14 nt, Human
gacccagugcagaa

SEQ ID NO: 2652927 - RNA, 15 nt, Human
gacccccguggggca

SEQ ID NO: 2652928 - RNA, 17 nt, Human
gaccccccgugggcucc

SEQ ID NO: 2652929 - RNA, 19 nt, Human
gaccccagcaagugguccu

SEQ ID NO: 2652930 - RNA, 15 nt, Human
gaccccagccaucca

SEQ ID NO: 2652931 - RNA, 13 nt, Human
gacccauugcugu

SEQ ID NO: 2652932 - RNA, 15 nt, Human
gacccauugcuguug

SEQ ID NO: 2652933 - RNA, 14 nt, Human
gacccauugcuguu

SEQ ID NO: 2652934 - RNA, 15 nt, Human
gacaucacagggugg

SEQ ID NO: 2652935 - RNA, 16 nt, Human
gacaucacaggguggg

SEQ ID NO: 2652936 - RNA, 19 nt, Human
gacaucacagggugggccu

SEQ ID NO: 2652937 - RNA, 15 nt, Human
gacacggagcccagc

SEQ ID NO: 2652938 - RNA, 15 nt, Human
gaagucauuaaacug

SEQ ID NO: 2652939 - RNA, 21 nt, Human
gaaguauguauauuaaaaaag

SEQ ID NO: 2652940 - RNA, 17 nt, Human
gaagucauuaaacuggu

SEQ ID NO: 2652941 - RNA, 18 nt, Human
gaagucucuagguucuga

SEQ ID NO: 2652942 - RNA, 17 nt, Human
gaagucuuaaggacaaa

SEQ ID NO: 2652943 - RNA, 19 nt, Human
gaagucuuacuacagaaau

SEQ ID NO: 2652944 - RNA, 14 nt, Human
gaagcggcuggcag

SEQ ID NO: 2652945 - RNA, 22 nt, Human
gaagguggauggccccagcaca

SEQ ID NO: 2652946 - RNA, 15 nt, Human
gaaguaaugaauuuu

SEQ ID NO: 2652947 - RNA, 13 nt, Human
gaaguaaugaauu

SEQ ID NO: 2652948 - RNA, 16 nt, Human
gaauaccacaucaaau

SEQ ID NO: 2652949 - RNA, 19 nt, Human
gaauaccacaucaaauaag

SEQ ID NO: 2652950 - RNA, 22 nt, Human
gaauaccacaucaaauaagaaa

SEQ ID NO: 2652951 - RNA, 19 nt, Human
gaauauuuuuauauuuccu

SEQ ID NO: 2652952 - RNA, 20 nt, Human
gaauauuuuuauauuuccuu

SEQ ID NO: 2652953 - RNA, 21 nt, Human
gaauauuuuuauauuuccuuu

SEQ ID NO: 2652954 - RNA, 22 nt, Human
gaauauuuuuauauuuccuuua

SEQ ID NO: 2652955 - RNA, 14 nt, Human
gaaucaaaagugcc

SEQ ID NO: 2652956 - RNA, 15 nt, Human
gaaucaaaagugccu

SEQ ID NO: 2652957 - RNA, 23 nt, Human
gaaucaaaagugccucaagagga

SEQ ID NO: 2652958 - RNA, 17 nt, Human
gaauaauacaguaucuc

SEQ ID NO: 2652959 - RNA, 12 nt, Human
gaauaagaauuu

SEQ ID NO: 2652960 - RNA, 14 nt, Human
gaauaagaauuugc

SEQ ID NO: 2652961 - RNA, 15 nt, Human
gaauaagaauuugca

SEQ ID NO: 2652962 - RNA, 16 nt, Human
gaauaagaauuugcau

SEQ ID NO: 2652963 - RNA, 17 nt, Human
gaauaagaauuugcaua

SEQ ID NO: 2652964 - RNA, 21 nt, Human
gaauacagaggcaacugcauu

SEQ ID NO: 2652965 - RNA, 12 nt, Human
gaaguuuuccua

SEQ ID NO: 2652966 - RNA, 21 nt, Human
gaauaaaaggcuugaagcugu

SEQ ID NO: 2652967 - RNA, 14 nt, Human
gaaguuuggcugcu

SEQ ID NO: 2652968 - RNA, 20 nt, Human
gaaguuugagaucagccugg

SEQ ID NO: 2652969 - RNA, 13 nt, Human
gaaugguggugga

SEQ ID NO: 2652970 - RNA, 19 nt, Human
gaauggugugaacccggga

SEQ ID NO: 2652971 - RNA, 19 nt, Human
gaaugccaucuaucuaguu

SEQ ID NO: 2652972 - RNA, 16 nt, Human
gaauguauuuauuugg

SEQ ID NO: 2652973 - RNA, 13 nt, Human
gaauguauuuauu

SEQ ID NO: 2652974 - RNA, 22 nt, Human
gaaugccacugccuucgcuucu

SEQ ID NO: 2652975 - RNA, 21 nt, Human
gaaugccacugccuucgcuuc

SEQ ID NO: 2652976 - RNA, 15 nt, Human
gaauucugauugauu

SEQ ID NO: 2652977 - RNA, 14 nt, Human
gaauugaaaaguuu

SEQ ID NO: 2652978 - RNA, 17 nt, Human
gaauugaaaaguuuuug

SEQ ID NO: 2652979 - RNA, 22 nt, Human
gaauugaaaaguuuuuguuugg

SEQ ID NO: 2652980 - RNA, 13 nt, Human
gaauucagacauc

SEQ ID NO: 2652981 - RNA, 23 nt, Human
gaauucaaacuggggccuccaga

SEQ ID NO: 2652982 - RNA, 12 nt, Human
gaauuguggcua

SEQ ID NO: 2652983 - RNA, 18 nt, Human
gaauuguggcuauccuga

SEQ ID NO: 2652984 - RNA, 20 nt, Human
gaauuguggcuauccugauu

SEQ ID NO: 2652985 - RNA, 17 nt, Human
gaauuuaguauuaucaa

SEQ ID NO: 2652986 - RNA, 18 nt, Human
gaauuuaguauuaucaaa

SEQ ID NO: 2652987 - RNA, 16 nt, Human
gaauuuacuuccuugc

SEQ ID NO: 2652988 - RNA, 22 nt, Human
gaauuuaaagaaaaaaauguca

SEQ ID NO: 2652989 - RNA, 20 nt, Human
gaauuuaaagaaaaaaaugu

SEQ ID NO: 2652990 - RNA, 14 nt, Human
gaagcccaggagcc

SEQ ID NO: 2652991 - RNA, 16 nt, Human
gaagcccauccugacc

SEQ ID NO: 2652992 - RNA, 17 nt, Human
gaagcccauccugacca

SEQ ID NO: 2652993 - RNA, 21 nt, Human
gaagcccauccugaccagcug

SEQ ID NO: 2652994 - RNA, 17 nt, Human
gaagccccacaugucca

SEQ ID NO: 2652995 - RNA, 18 nt, Human
gaagccccacauguccag

SEQ ID NO: 2652996 - RNA, 23 nt, Human
gaagccccacauguccagcaccu

SEQ ID NO: 2652997 - RNA, 19 nt, Human
gaagcccauccugaccagc

SEQ ID NO: 2652998 - RNA, 15 nt, Human
gaagauacuuuguau

SEQ ID NO: 2652999 - RNA, 14 nt, Human
gaagauacuuugua

SEQ ID NO: 2653000 - RNA, 13 nt, Human
gaagauacuuugu

SEQ ID NO: 2653001 - RNA, 12 nt, Human
gaagauacuuug

SEQ ID NO: 2653002 - RNA, 20 nt, Human
gaagauaauauuaaggaaga

SEQ ID NO: 2653003 - RNA, 22 nt, Human
gaagccaaguggggugcuggga

SEQ ID NO: 2653004 - RNA, 23 nt, Human
gaagccaaguggggugcugggag

SEQ ID NO: 2653005 - RNA, 21 nt, Human
gaagccaagggaaaggggugc

SEQ ID NO: 2653006 - RNA, 13 nt, Human
gaagccaaguggg

SEQ ID NO: 2653007 - RNA, 19 nt, Human
gaagccaaguggggugcug

SEQ ID NO: 2653008 - RNA, 21 nt, Human
gaagccaaguggggugcuggg

SEQ ID NO: 2653009 - RNA, 14 nt, Human
gaagccaagggaaa

SEQ ID NO: 2653010 - RNA, 15 nt, Human
gaagccaagggaaag

SEQ ID NO: 2653011 - RNA, 16 nt, Human
gaagccaagggaaagg

SEQ ID NO: 2653012 - RNA, 17 nt, Human
gaagccaagggaaaggg

SEQ ID NO: 2653013 - RNA, 19 nt, Human
gaagccaagggaaaggggu

SEQ ID NO: 2653014 - RNA, 20 nt, Human
gaagccaagggaaaggggug

SEQ ID NO: 2653015 - RNA, 22 nt, Human
gaagaacguuuuuuccucagug

SEQ ID NO: 2653016 - RNA, 13 nt, Human
gaagaacugcagg

SEQ ID NO: 2653017 - RNA, 16 nt, Human
gaagaacugaaaggcu

SEQ ID NO: 2653018 - RNA, 14 nt, Human
gaagaacugcaggc

SEQ ID NO: 2653019 - RNA, 15 nt, Human
gaagaacugcaggcc

SEQ ID NO: 2653020 - RNA, 15 nt, Human
gaacuuuguauaguu

SEQ ID NO: 2653021 - RNA, 12 nt, Human
gaacuuuguaua

SEQ ID NO: 2653022 - RNA, 21 nt, Human
gaacuuuguauaguuauguaa

SEQ ID NO: 2653023 - RNA, 16 nt, Human
gaacuuuuguacugaa

SEQ ID NO: 2653024 - RNA, 20 nt, Human
gaacuuuuguacugaauuuu

SEQ ID NO: 2653025 - RNA, 21 nt, Human
gaacuuuuguacugaauuuuu

SEQ ID NO: 2653026 - RNA, 15 nt, Human
gaagagauccaaaga

SEQ ID NO: 2653027 - RNA, 16 nt, Human
gaagagauccaaagac

SEQ ID NO: 2653028 - RNA, 17 nt, Human
gaagagauccaaagacu

SEQ ID NO: 2653029 - RNA, 16 nt, Human
gaacucacuggggccu

SEQ ID NO: 2653030 - RNA, 14 nt, Human
gaacucacuggggc

SEQ ID NO: 2653031 - RNA, 21 nt, Human
gaacgaaccuuggccugggcc

SEQ ID NO: 2653032 - RNA, 22 nt, Human
gaacgaaccuuggccugggccg

SEQ ID NO: 2653033 - RNA, 19 nt, Human
gaacguuuuuuccucagug

SEQ ID NO: 2653034 - RNA, 16 nt, Human
gaaccuccccagccug

SEQ ID NO: 2653035 - RNA, 15 nt, Human
gaaccuccccagccu

SEQ ID NO: 2653036 - RNA, 22 nt, Human
gaaccuccccagccugcgccug

SEQ ID NO: 2653037 - RNA, 18 nt, Human
gaaccuccccagccugcg

SEQ ID NO: 2653038 - RNA, 17 nt, Human
gaaccuccccagccugc

SEQ ID NO: 2653039 - RNA, 13 nt, Human
gaaauuguauauu

SEQ ID NO: 2653040 - RNA, 19 nt, Human
gaaauuguauauuguaauu

SEQ ID NO: 2653041 - RNA, 23 nt, Human
gaaaauaguuuauuuuaaaacaa

SEQ ID NO: 2653042 - RNA, 20 nt, Human
gaaaauaguuuauuuuaaaa

SEQ ID NO: 2653043 - RNA, 19 nt, Human
gaaaauaguuuauuuuaaa

SEQ ID NO: 2653044 - RNA, 19 nt, Human
gaaaauacaacuuaaauaa

SEQ ID NO: 2653045 - RNA, 13 nt, Human
gaaaauaaagcua

SEQ ID NO: 2653046 - RNA, 15 nt, Human
gaaaauaguuuauuu

SEQ ID NO: 2653047 - RNA, 14 nt, Human
gaaaauaguuuauu

SEQ ID NO: 2653048 - RNA, 13 nt, Human
gaaaauaguuuau

SEQ ID NO: 2653049 - RNA, 23 nt, Human
gaacacugcacucuuaagcuucc

SEQ ID NO: 2653050 - RNA, 18 nt, Human
gaacauccaaccuuccca

SEQ ID NO: 2653051 - RNA, 17 nt, Human
gaacauccaaccuuccc

SEQ ID NO: 2653052 - RNA, 16 nt, Human
gaacauacuguucacu

SEQ ID NO: 2653053 - RNA, 22 nt, Human
gaacauacuguucacucacucu

SEQ ID NO: 2653054 - RNA, 13 nt, Human
gaacauacaaaug

SEQ ID NO: 2653055 - RNA, 23 nt, Human
gaacauacaaaugcaucuuugau

SEQ ID NO: 2653056 - RNA, 22 nt, Human
gaacauacaaaugcaucuuuga

SEQ ID NO: 2653057 - RNA, 17 nt, Human
gaacauacaaaugcauc

SEQ ID NO: 2653058 - RNA, 15 nt, Human
gaacauacaaaugca

SEQ ID NO: 2653059 - RNA, 21 nt, Human
gaacaguguggccucuucuga

SEQ ID NO: 2653060 - RNA, 21 nt, Human
gaacagugguggcaacauuca

SEQ ID NO: 2653061 - RNA, 17 nt, Human
gaugcaggcuccccuga

SEQ ID NO: 2653062 - RNA, 16 nt, Human
gaugcaggcuccccug

SEQ ID NO: 2653063 - RNA, 12 nt, Human
gaugcaggcucc

SEQ ID NO: 2653064 - RNA, 20 nt, Human
gaugcaggcuccccugagga

SEQ ID NO: 2653065 - RNA, 19 nt, Human
gaugcaggcuccccugagg

SEQ ID NO: 2653066 - RNA, 14 nt, Human
gaugaacaucuaac

SEQ ID NO: 2653067 - RNA, 14 nt, Human
gaugaauguauuua

SEQ ID NO: 2653068 - RNA, 20 nt, Human
gauccgacugcuuuggaccu

SEQ ID NO: 2653069 - RNA, 14 nt, Human
gauccgacugcuuu

SEQ ID NO: 2653070 - RNA, 17 nt, Human
gauccgacugcuuugga

SEQ ID NO: 2653071 - RNA, 18 nt, Human
gauccgacugcuuuggac

SEQ ID NO: 2653072 - RNA, 18 nt, Human
gauccuaggcauuugcug

SEQ ID NO: 2653073 - RNA, 22 nt, Human
gaucauaguuuuauuuauauuu

SEQ ID NO: 2653074 - RNA, 12 nt, Human
gaucauaguuuu

SEQ ID NO: 2653075 - RNA, 14 nt, Human
gaucauaguuuuau

SEQ ID NO: 2653076 - RNA, 13 nt, Human
gaucauaguuuua

SEQ ID NO: 2653077 - RNA, 19 nt, Human
gaucauaguuuuauuuaua

SEQ ID NO: 2653078 - RNA, 18 nt, Human
gaucauaguuuuauuuau

SEQ ID NO: 2653079 - RNA, 16 nt, Human
gaucauaguuuuauuu

SEQ ID NO: 2653080 - RNA, 15 nt, Human
gaucauaguuuuauu

SEQ ID NO: 2653081 - RNA, 18 nt, Human
gaucuaccagcauaaaua

SEQ ID NO: 2653082 - RNA, 23 nt, Human
gaucuacaugaggaacuguagau

SEQ ID NO: 2653083 - RNA, 19 nt, Human
gauccugggggccuggguu

SEQ ID NO: 2653084 - RNA, 15 nt, Human
gauccuccugcagac

SEQ ID NO: 2653085 - RNA, 16 nt, Human
gauccuccugcagacc

SEQ ID NO: 2653086 - RNA, 21 nt, Human
gauccuccugcagaccacgcc

SEQ ID NO: 2653087 - RNA, 22 nt, Human
gauccuccugcagaccacgccc

SEQ ID NO: 2653088 - RNA, 15 nt, Human
gauccucucaccuca

SEQ ID NO: 2653089 - RNA, 16 nt, Human
gauccucucaccucag

SEQ ID NO: 2653090 - RNA, 19 nt, Human
gauccucucaccucagccu

SEQ ID NO: 2653091 - RNA, 17 nt, Human
gauaaagaaaaaaauac

SEQ ID NO: 2653092 - RNA, 18 nt, Human
gauaaagaaaaaaauacu

SEQ ID NO: 2653093 - RNA, 18 nt, Human
gacuuccccggagggcug

SEQ ID NO: 2653094 - RNA, 17 nt, Human
gaguguguaugccaaga

SEQ ID NO: 2653095 - RNA, 14 nt, Human
gacuuccuugagac

SEQ ID NO: 2653096 - RNA, 23 nt, Human
gacuuccccggagggcugcggcg

SEQ ID NO: 2653097 - RNA, 20 nt, Human
gacuuccccggagggcugcg

SEQ ID NO: 2653098 - RNA, 19 nt, Human
gacuuccccggagggcugc

SEQ ID NO: 2653099 - RNA, 15 nt, Human
gaucaggcucccagg

SEQ ID NO: 2653100 - RNA, 14 nt, Human
gaucaggcucccag

SEQ ID NO: 2653101 - RNA, 13 nt, Human
gaucacugccaca

SEQ ID NO: 2653102 - RNA, 15 nt, Human
gaucacugccacacu

SEQ ID NO: 2653103 - RNA, 16 nt, Human
gaucacugccacacuc

SEQ ID NO: 2653104 - RNA, 23 nt, Human
gauaucgacuuguuuuugcacau

SEQ ID NO: 2653105 - RNA, 15 nt, Human
gauaucuauaaaaua

SEQ ID NO: 2653106 - RNA, 17 nt, Human
gauaucuauaaaauaga

SEQ ID NO: 2653107 - RNA, 23 nt, Human
gauaucuauaaaauagauauaaa

SEQ ID NO: 2653108 - RNA, 16 nt, Human
gauaucaugcaaauuu

SEQ ID NO: 2653109 - RNA, 14 nt, Human
gaucacagccucug

SEQ ID NO: 2653110 - RNA, 23 nt, Human
gaucaccgacugaaaauauuguu

SEQ ID NO: 2653111 - RNA, 15 nt, Human
gauaauauuguuugg

SEQ ID NO: 2653112 - RNA, 22 nt, Human
gauaauauuguuugguaaaugu

SEQ ID NO: 2653113 - RNA, 15 nt, Human
gauaauuucagggug

SEQ ID NO: 2653114 - RNA, 19 nt, Human
gauauauaggcuauuuucu

SEQ ID NO: 2653115 - RNA, 21 nt, Human
gauauauaggcuauuuucuaa

SEQ ID NO: 2653116 - RNA, 15 nt, Human
gauaguugcuauuuu

SEQ ID NO: 2653117 - RNA, 22 nt, Human
gauaguugcuauuuuuguaaag

SEQ ID NO: 2653118 - RNA, 23 nt, Human
gauaguugcuauuuuuguaaagu

SEQ ID NO: 2653119 - RNA, 17 nt, Human
gcaaucucuucauuauu

SEQ ID NO: 2653120 - RNA, 23 nt, Human
gcaaucucuucauuauucucugc

SEQ ID NO: 2653121 - RNA, 20 nt, Human
gcaacuuuuguguaaugaaa

SEQ ID NO: 2653122 - RNA, 14 nt, Human
gcaacuucuucucc

SEQ ID NO: 2653123 - RNA, 18 nt, Human
gcaacuucuucuccaucc

SEQ ID NO: 2653124 - RNA, 20 nt, Human
gcaacuucuucuccaucccu

SEQ ID NO: 2653125 - RNA, 13 nt, Human
gcaagaugugaau

SEQ ID NO: 2653126 - RNA, 14 nt, Human
gcaagaugugaauu

SEQ ID NO: 2653127 - RNA, 15 nt, Human
gcaagaugugaauua

SEQ ID NO: 2653128 - RNA, 17 nt, Human
gcaagaugugaauuauu

SEQ ID NO: 2653129 - RNA, 21 nt, Human
gcaagaugugaauuauugaca

SEQ ID NO: 2653130 - RNA, 12 nt, Human
gcaagcagagga

SEQ ID NO: 2653131 - RNA, 13 nt, Human
gcaagcagaggac

SEQ ID NO: 2653132 - RNA, 14 nt, Human
gcaagcagaggacc

SEQ ID NO: 2653133 - RNA, 16 nt, Human
gcaagcagaggaccag

SEQ ID NO: 2653134 - RNA, 21 nt, Human
gcaagcagaggaccagggccu

SEQ ID NO: 2653135 - RNA, 11 nt, Human
gcaagcaugcu

SEQ ID NO: 2653136 - RNA, 15 nt, Human
gcaagcaugcuugug

SEQ ID NO: 2653137 - RNA, 16 nt, Human
gcaagcaugcuuguga

SEQ ID NO: 2653138 - RNA, 20 nt, Human
gauuucuuuaaaagaaugac

SEQ ID NO: 2653139 - RNA, 16 nt, Human
gcaaacccauuaaggg

SEQ ID NO: 2653140 - RNA, 14 nt, Human
gcaaacgcuaaaga

SEQ ID NO: 2653141 - RNA, 12 nt, Human
gcaaagaaaaug

SEQ ID NO: 2653142 - RNA, 16 nt, Human
gcaaaugagcucugaa

SEQ ID NO: 2653143 - RNA, 18 nt, Human
gcaacugcauuggcuuug

SEQ ID NO: 2653144 - RNA, 13 nt, Human
gauuguucaucau

SEQ ID NO: 2653145 - RNA, 22 nt, Human
gauuuguugccaugugcaccuu

SEQ ID NO: 2653146 - RNA, 21 nt, Human
gauuuguuguucuuucagaaa

SEQ ID NO: 2653147 - RNA, 19 nt, Human
gauuuccagaaccacacuu

SEQ ID NO: 2653148 - RNA, 22 nt, Human
gauuuccagaaccacacuugaa

SEQ ID NO: 2653149 - RNA, 15 nt, Human
gauuugaaaaauaua

SEQ ID NO: 2653150 - RNA, 16 nt, Human
gauuugaaaaauauaa

SEQ ID NO: 2653151 - RNA, 21 nt, Human
gauuugaaaaauauaaaauua

SEQ ID NO: 2653152 - RNA, 18 nt, Human
gauugcugauaauaaauu

SEQ ID NO: 2653153 - RNA, 17 nt, Human
gauuccacuacaccugg

SEQ ID NO: 2653154 - RNA, 20 nt, Human
gauuccacuacaccuggcug

SEQ ID NO: 2653155 - RNA, 22 nt, Human
gaugcggccauucaaggggagc

SEQ ID NO: 2653156 - RNA, 19 nt, Human
gauguuuccagacuuccuu

SEQ ID NO: 2653157 - RNA, 13 nt, Human
gauguuuccagac

SEQ ID NO: 2653158 - RNA, 12 nt, Human
gauguuuccaga

SEQ ID NO: 2653159 - RNA, 20 nt, Human
gauuaauuugcaucugaaau

SEQ ID NO: 2653160 - RNA, 13 nt, Human
gauucaggaaugu

SEQ ID NO: 2653161 - RNA, 13 nt, Human
gauucagucacau

SEQ ID NO: 2653162 - RNA, 14 nt, Human
gauucagucacaug

SEQ ID NO: 2653163 - RNA, 22 nt, Human
gauucagucacauggcaugguu

SEQ ID NO: 2653164 - RNA, 12 nt, Human
gauucaugauuu

SEQ ID NO: 2653165 - RNA, 17 nt, Human
gauucaugauuuauaaa

SEQ ID NO: 2653166 - RNA, 14 nt, Human
gcagccuggacccu

SEQ ID NO: 2653167 - RNA, 19 nt, Human
gcagccucugucaggccuu

SEQ ID NO: 2653168 - RNA, 21 nt, Human
gcagcaggugauuggaccagg

SEQ ID NO: 2653169 - RNA, 20 nt, Human
gcagcagggagggcuucugc

SEQ ID NO: 2653170 - RNA, 12 nt, Human
gcagcaccuccu

SEQ ID NO: 2653171 - RNA, 16 nt, Human
gcagcaccgaggggcc

SEQ ID NO: 2653172 - RNA, 20 nt, Human
gcagcaccgaggggccuuug

SEQ ID NO: 2653173 - RNA, 14 nt, Human
gcagcaaauuuuca

SEQ ID NO: 2653174 - RNA, 14 nt, Human
gcagaugccacccu

SEQ ID NO: 2653175 - RNA, 16 nt, Human
gcagaugccacccuag

SEQ ID NO: 2653176 - RNA, 17 nt, Human
gcagaugccacccuagc

SEQ ID NO: 2653177 - RNA, 18 nt, Human
gcagaugccacccuagcc

SEQ ID NO: 2653178 - RNA, 14 nt, Human
gcaccucuuccuug

SEQ ID NO: 2653179 - RNA, 20 nt, Human
gcaccucuuccuugauguuu

SEQ ID NO: 2653180 - RNA, 12 nt, Human
gcacagcucagg

SEQ ID NO: 2653181 - RNA, 20 nt, Human
gcacagcucaggaggcgccc

SEQ ID NO: 2653182 - RNA, 15 nt, Human
gcacagcucaggagg

SEQ ID NO: 2653183 - RNA, 15 nt, Human
gcacagcuaauucua

SEQ ID NO: 2653184 - RNA, 15 nt, Human
gcacaggaggcaggc

SEQ ID NO: 2653185 - RNA, 16 nt, Human
gcacaggaggcaggca

SEQ ID NO: 2653186 - RNA, 20 nt, Human
gcacaggaggcaggcauggc

SEQ ID NO: 2653187 - RNA, 21 nt, Human
gcacaggaggcaggcauggcc

SEQ ID NO: 2653188 - RNA, 22 nt, Human
gcacaggaggcaggcauggccc

SEQ ID NO: 2653189 - RNA, 18 nt, Human
gcacccaccguggaggag

SEQ ID NO: 2653190 - RNA, 19 nt, Human
gcacccaccguggaggagg

SEQ ID NO: 2653191 - RNA, 19 nt, Human
gcaccacugcacuccagcc

SEQ ID NO: 2653192 - RNA, 17 nt, Human
gcaccaccaagccaagg

SEQ ID NO: 2653193 - RNA, 23 nt, Human
gcaccacgggacaucacagggug

SEQ ID NO: 2653194 - RNA, 18 nt, Human
gcaccaccaagccaaggg

SEQ ID NO: 2653195 - RNA, 11 nt, Human
gcacccagaac

SEQ ID NO: 2653196 - RNA, 12 nt, Human
gcacccagaaca

SEQ ID NO: 2653197 - RNA, 14 nt, Human
gcacccagaacagu

SEQ ID NO: 2653198 - RNA, 20 nt, Human
gcacccaccguggaggagga

SEQ ID NO: 2653199 - RNA, 17 nt, Human
gcauuugcugaauacag

SEQ ID NO: 2653200 - RNA, 23 nt, Human
gcauuugcugaauacagaggcaa

SEQ ID NO: 2653201 - RNA, 22 nt, Human
gcauucguuguguuuuuuaaga

SEQ ID NO: 2653202 - RNA, 23 nt, Human
gcauucguuguguuuuuuaagau

SEQ ID NO: 2653203 - RNA, 14 nt, Human
gcauuuucccagau

SEQ ID NO: 2653204 - RNA, 22 nt, Human
gcauuuugcuaaaugugaauga

SEQ ID NO: 2653205 - RNA, 17 nt, Human
gcauugccauguggaag

SEQ ID NO: 2653206 - RNA, 21 nt, Human
gccaaaauuaagguguuugaa

SEQ ID NO: 2653207 - RNA, 14 nt, Human
gccaaaauuaaggu

SEQ ID NO: 2653208 - RNA, 17 nt, Human
gccaaaauauuuggaau

SEQ ID NO: 2653209 - RNA, 17 nt, Human
gccaaaauucauuucua

SEQ ID NO: 2653210 - RNA, 23 nt, Human
gccaaaauuaagguguuugaaaa

SEQ ID NO: 2653211 - RNA, 13 nt, Human
gcauggaaaucag

SEQ ID NO: 2653212 - RNA, 16 nt, Human
gcauggaaaucagcca

SEQ ID NO: 2653213 - RNA, 19 nt, Human
gcauggaaaucagccaagu

SEQ ID NO: 2653214 - RNA, 16 nt, Human
gcaugcuucuucucaa

SEQ ID NO: 2653215 - RNA, 15 nt, Human
gcauuauaaaaagaa

SEQ ID NO: 2653216 - RNA, 14 nt, Human
gcauucauuuuuau

SEQ ID NO: 2653217 - RNA, 15 nt, Human
gcauucauuuuuaua

SEQ ID NO: 2653218 - RNA, 17 nt, Human
gcauucauuuuuauagc

SEQ ID NO: 2653219 - RNA, 18 nt, Human
gcauucauuuuuauagca

SEQ ID NO: 2653220 - RNA, 19 nt, Human
gcauucauuuuuauagcaa

SEQ ID NO: 2653221 - RNA, 22 nt, Human
gcauucauuuuuauagcaacaa

SEQ ID NO: 2653222 - RNA, 16 nt, Human
gcauuccagccccucu

SEQ ID NO: 2653223 - RNA, 19 nt, Human
gcauuccagccccucuggu

SEQ ID NO: 2653224 - RNA, 12 nt, Human
gcauuccagccc

SEQ ID NO: 2653225 - RNA, 15 nt, Human
gcauuccagccccuc

SEQ ID NO: 2653226 - RNA, 15 nt, Human
gcauguuuuguugcu

SEQ ID NO: 2653227 - RNA, 14 nt, Human
gcaugcaugcaaau

SEQ ID NO: 2653228 - RNA, 14 nt, Human
gcaugcagcuuugc

SEQ ID NO: 2653229 - RNA, 17 nt, Human
gcaugcagcuuugcaaa

SEQ ID NO: 2653230 - RNA, 16 nt, Human
gcaugcaaaugagcuc

SEQ ID NO: 2653231 - RNA, 18 nt, Human
gcaugcaaaugagcucug

SEQ ID NO: 2653232 - RNA, 21 nt, Human
gcaugcaaaugagcucugaaa

SEQ ID NO: 2653233 - RNA, 14 nt, Human
gcaggcucacugcc

SEQ ID NO: 2653234 - RNA, 15 nt, Human
gcaggcucacugcca

SEQ ID NO: 2653235 - RNA, 22 nt, Human
gcaggcucacugccaggccagc

SEQ ID NO: 2653236 - RNA, 23 nt, Human
gcaggcucacugccaggccagcc

SEQ ID NO: 2653237 - RNA, 17 nt, Human
gcaggcucacugccagg

SEQ ID NO: 2653238 - RNA, 18 nt, Human
gcaggcucacugccaggc

SEQ ID NO: 2653239 - RNA, 19 nt, Human
gcaggcucacugccaggcc

SEQ ID NO: 2653240 - RNA, 21 nt, Human
gcaggcucacugccaggccag

SEQ ID NO: 2653241 - RNA, 22 nt, Human
gcaggauugaaaauguccagga

SEQ ID NO: 2653242 - RNA, 14 nt, Human
gcaggauugaaaau

SEQ ID NO: 2653243 - RNA, 16 nt, Human
gcagggagggcuucug

SEQ ID NO: 2653244 - RNA, 23 nt, Human
gcagggguggggguggaggcuuc

SEQ ID NO: 2653245 - RNA, 21 nt, Human
gcaggugauuggaccaggcca

SEQ ID NO: 2653246 - RNA, 22 nt, Human
gcaggugauuggaccaggccau

SEQ ID NO: 2653247 - RNA, 17 nt, Human
gcaggggugggggugga

SEQ ID NO: 2653248 - RNA, 20 nt, Human
gcagggguggggguggaggc

SEQ ID NO: 2653249 - RNA, 21 nt, Human
gcagggguggggguggaggcu

SEQ ID NO: 2653250 - RNA, 17 nt, Human
gcaggugggcuggacuu

SEQ ID NO: 2653251 - RNA, 16 nt, Human
gcaggugcuggagcac

SEQ ID NO: 2653252 - RNA, 19 nt, Human
gcaggugcuggagcacugg

SEQ ID NO: 2653253 - RNA, 18 nt, Human
gcaggugcuggagcacug

SEQ ID NO: 2653254 - RNA, 21 nt, Human
gcaggugcuggagcacugggc

SEQ ID NO: 2653255 - RNA, 20 nt, Human
gcaggugcuggagcacuggg

SEQ ID NO: 2653256 - RNA, 18 nt, Human
gcaguucuacucaggcug

SEQ ID NO: 2653257 - RNA, 19 nt, Human
gcaguucuacucaggcugg

SEQ ID NO: 2653258 - RNA, 20 nt, Human
gcaguucuacucaggcuggu

SEQ ID NO: 2653259 - RNA, 19 nt, Human
gcauaggaccuuuccacca

SEQ ID NO: 2653260 - RNA, 17 nt, Human
gcauauaaugaauaaau

SEQ ID NO: 2653261 - RNA, 18 nt, Human
gcauauaaugaauaaauc

SEQ ID NO: 2653262 - RNA, 19 nt, Human
gcauauaaugaauaaauca

SEQ ID NO: 2653263 - RNA, 16 nt, Human
gcaguguggccaggcu

SEQ ID NO: 2653264 - RNA, 17 nt, Human
gcaguguggccaggcug

SEQ ID NO: 2653265 - RNA, 17 nt, Human
gcaguuagcugaagaau

SEQ ID NO: 2653266 - RNA, 22 nt, Human
gcaguuagcugaagaauugaaa

SEQ ID NO: 2653267 - RNA, 15 nt, Human
gcaguguuuugcaag

SEQ ID NO: 2653268 - RNA, 22 nt, Human
gcaguguuuugcaagugcugga

SEQ ID NO: 2653269 - RNA, 16 nt, Human
gcauauuauaaaggau

SEQ ID NO: 2653270 - RNA, 23 nt, Human
gcauauuauaaaggauaaagaag

SEQ ID NO: 2653271 - RNA, 22 nt, Human
gccccagccugcuagcuagcuc

SEQ ID NO: 2653272 - RNA, 12 nt, Human
gccccagccugc

SEQ ID NO: 2653273 - RNA, 11 nt, Human
gccccagccug

SEQ ID NO: 2653274 - RNA, 17 nt, Human
gccccagccugcuagcu

SEQ ID NO: 2653275 - RNA, 15 nt, Human
gccccagccugcuag

SEQ ID NO: 2653276 - RNA, 14 nt, Human
gccccagccugcua

SEQ ID NO: 2653277 - RNA, 13 nt, Human
gccccagccugcu

SEQ ID NO: 2653278 - RNA, 14 nt, Human
gccccagcccugcu

SEQ ID NO: 2653279 - RNA, 15 nt, Human
gccccagcccugcug

SEQ ID NO: 2653280 - RNA, 16 nt, Human
gccccagcccugcugg

SEQ ID NO: 2653281 - RNA, 17 nt, Human
gccccagcccugcuggg

SEQ ID NO: 2653282 - RNA, 18 nt, Human
gccccagcccugcugggg

SEQ ID NO: 2653283 - RNA, 20 nt, Human
gccccagcccugcuggggau

SEQ ID NO: 2653284 - RNA, 17 nt, Human
gcccaugcacuggggac

SEQ ID NO: 2653285 - RNA, 18 nt, Human
gcccaucgccacaaacuc

SEQ ID NO: 2653286 - RNA, 17 nt, Human
gcccaucgugaagaagc

SEQ ID NO: 2653287 - RNA, 19 nt, Human
gcccaucgugaagaagccu

SEQ ID NO: 2653288 - RNA, 20 nt, Human
gcccaucgugaagaagccug

SEQ ID NO: 2653289 - RNA, 14 nt, Human
gcccauccugacca

SEQ ID NO: 2653290 - RNA, 15 nt, Human
gcccauccugaccag

SEQ ID NO: 2653291 - RNA, 16 nt, Human
gcccauccugaccagc

SEQ ID NO: 2653292 - RNA, 18 nt, Human
gcccauccugaccagcug

SEQ ID NO: 2653293 - RNA, 15 nt, Human
gcccauccugacuga

SEQ ID NO: 2653294 - RNA, 20 nt, Human
gccccaucuccccucagcuc

SEQ ID NO: 2653295 - RNA, 21 nt, Human
gccccaucuccccucagcucg

SEQ ID NO: 2653296 - RNA, 19 nt, Human
gccccaucuccccucagcu

SEQ ID NO: 2653297 - RNA, 18 nt, Human
gccccaucuccccucagc

SEQ ID NO: 2653298 - RNA, 17 nt, Human
gccccaucuccccucag

SEQ ID NO: 2653299 - RNA, 12 nt, Human
gccccaucuccc

SEQ ID NO: 2653300 - RNA, 11 nt, Human
gcccagugcau

SEQ ID NO: 2653301 - RNA, 12 nt, Human
gcccagugcaug

SEQ ID NO: 2653302 - RNA, 14 nt, Human
gcccagugcauggu

SEQ ID NO: 2653303 - RNA, 20 nt, Human
gcccagugcaugguggccag

SEQ ID NO: 2653304 - RNA, 21 nt, Human
gcccagugcaugguggccaga

SEQ ID NO: 2653305 - RNA, 15 nt, Human
gcccaguagaccuug

SEQ ID NO: 2653306 - RNA, 17 nt, Human
gcccaguagaccuuguu

SEQ ID NO: 2653307 - RNA, 14 nt, Human
gcccaccugccggc

SEQ ID NO: 2653308 - RNA, 15 nt, Human
gcccaccugccggcc

SEQ ID NO: 2653309 - RNA, 14 nt, Human
gcccuccucuccca

SEQ ID NO: 2653310 - RNA, 18 nt, Human
gcccuccccauggagcca

SEQ ID NO: 2653311 - RNA, 19 nt, Human
gcccuccccauggagccag

SEQ ID NO: 2653312 - RNA, 11 nt, Human
gccccugggcu

SEQ ID NO: 2653313 - RNA, 23 nt, Human
gcccgcgccacaggacccucgcc

SEQ ID NO: 2653314 - RNA, 17 nt, Human
gcccgcgccacaggacc

SEQ ID NO: 2653315 - RNA, 15 nt, Human
gccccuggccgcgcu

SEQ ID NO: 2653316 - RNA, 19 nt, Human
gccccuggccgcgcuccgg

SEQ ID NO: 2653317 - RNA, 20 nt, Human
gccccuggccgcgcuccggg

SEQ ID NO: 2653318 - RNA, 21 nt, Human
gccccuggccgcgcuccgggc

SEQ ID NO: 2653319 - RNA, 19 nt, Human
gccccuagccgguuccugu

SEQ ID NO: 2653320 - RNA, 18 nt, Human
gccccuagccgguuccug

SEQ ID NO: 2653321 - RNA, 20 nt, Human
gccccuagccgguuccuguc

SEQ ID NO: 2653322 - RNA, 21 nt, Human
gccccucccacacccaaagcu

SEQ ID NO: 2653323 - RNA, 22 nt, Human
gccccucccacacccaaagcug

SEQ ID NO: 2653324 - RNA, 23 nt, Human
gccccucccacacccaaagcuga

SEQ ID NO: 2653325 - RNA, 19 nt, Human
gccccggggugaguccauu

SEQ ID NO: 2653326 - RNA, 21 nt, Human
gccccgcccccaguccccacc

SEQ ID NO: 2653327 - RNA, 15 nt, Human
gcccaccccucaaca

SEQ ID NO: 2653328 - RNA, 14 nt, Human
gcccacccccugcc

SEQ ID NO: 2653329 - RNA, 15 nt, Human
gcccacccccugccc

SEQ ID NO: 2653330 - RNA, 16 nt, Human
gcccacccccugcccu

SEQ ID NO: 2653331 - RNA, 17 nt, Human
gcccacccccugcccug

SEQ ID NO: 2653332 - RNA, 18 nt, Human
gcccacccccugcccugc

SEQ ID NO: 2653333 - RNA, 19 nt, Human
gcccacccccugcccugca

SEQ ID NO: 2653334 - RNA, 20 nt, Human
gcccacccccugcccugcac

SEQ ID NO: 2653335 - RNA, 18 nt, Human
gcccacccggugggaccc

SEQ ID NO: 2653336 - RNA, 22 nt, Human
gcccacccccugcccugcacgu

SEQ ID NO: 2653337 - RNA, 16 nt, Human
gcccacccugcugcug

SEQ ID NO: 2653338 - RNA, 17 nt, Human
gcccacccugcugcugg

SEQ ID NO: 2653339 - RNA, 18 nt, Human
gcccacccugcugcuggu

SEQ ID NO: 2653340 - RNA, 19 nt, Human
gcccacccugcugcuggug

SEQ ID NO: 2653341 - RNA, 20 nt, Human
gcccacccugcugcuggugc

SEQ ID NO: 2653342 - RNA, 21 nt, Human
gcccacccugcugcuggugca

SEQ ID NO: 2653343 - RNA, 22 nt, Human
gcccacccugcugcuggugcac

SEQ ID NO: 2653344 - RNA, 13 nt, Human
gccauuuauuuau

SEQ ID NO: 2653345 - RNA, 16 nt, Human
gccauuuauuuauuga

SEQ ID NO: 2653346 - RNA, 12 nt, Human
gccauuugcaau

SEQ ID NO: 2653347 - RNA, 17 nt, Human
gccauuugcaauaacag

SEQ ID NO: 2653348 - RNA, 20 nt, Human
gccauuugcaauaacagcug

SEQ ID NO: 2653349 - RNA, 22 nt, Human
gccauuugcaauaacagcugca

SEQ ID NO: 2653350 - RNA, 23 nt, Human
gccauuugcaauaacagcugcaa

SEQ ID NO: 2653351 - RNA, 18 nt, Human
gccauccccagggggcau

SEQ ID NO: 2653352 - RNA, 17 nt, Human
gccauggcucagggugg

SEQ ID NO: 2653353 - RNA, 23 nt, Human
gccauggcucaggguggucucuu

SEQ ID NO: 2653354 - RNA, 16 nt, Human
gccauccccagggggc

SEQ ID NO: 2653355 - RNA, 12 nt, Human
gccagucugugg

SEQ ID NO: 2653356 - RNA, 13 nt, Human
gccagucugugga

SEQ ID NO: 2653357 - RNA, 20 nt, Human
gccagucuguggaucagaga

SEQ ID NO: 2653358 - RNA, 17 nt, Human
gccaggggaaaaucagc

SEQ ID NO: 2653359 - RNA, 22 nt, Human
gccaggggaaaaucagccugcu

SEQ ID NO: 2653360 - RNA, 21 nt, Human
gccaggggaaaaucagccugc

SEQ ID NO: 2653361 - RNA, 15 nt, Human
gccagguaaugugaa

SEQ ID NO: 2653362 - RNA, 21 nt, Human
gccagguaaugugaauaaauu

SEQ ID NO: 2653363 - RNA, 15 nt, Human
gccaggugagaaacu

SEQ ID NO: 2653364 - RNA, 16 nt, Human
gccaggugagaaacug

SEQ ID NO: 2653365 - RNA, 23 nt, Human
gccaggggaaaaucagccugcuc

SEQ ID NO: 2653366 - RNA, 22 nt, Human
gccacguuggagaagcccgugu

SEQ ID NO: 2653367 - RNA, 21 nt, Human
gccacgugggcaaacaggcag

SEQ ID NO: 2653368 - RNA, 14 nt, Human
gccacucacuaggc

SEQ ID NO: 2653369 - RNA, 15 nt, Human
gccacucacuaggcc

SEQ ID NO: 2653370 - RNA, 18 nt, Human
gccacucacuaggccccc

SEQ ID NO: 2653371 - RNA, 19 nt, Human
gccacucacuaggccccca

SEQ ID NO: 2653372 - RNA, 23 nt, Human
gccacucacuaggcccccacuug

SEQ ID NO: 2653373 - RNA, 13 nt, Human
gccaaaggcuggc

SEQ ID NO: 2653374 - RNA, 14 nt, Human
gccagagccgggca

SEQ ID NO: 2653375 - RNA, 12 nt, Human
gccacucauuuc

SEQ ID NO: 2653376 - RNA, 13 nt, Human
gccacucauuuca

SEQ ID NO: 2653377 - RNA, 14 nt, Human
gccacucauuucau

SEQ ID NO: 2653378 - RNA, 15 nt, Human
gccacucauuucauc

SEQ ID NO: 2653379 - RNA, 16 nt, Human
gccacucauuucaucu

SEQ ID NO: 2653380 - RNA, 18 nt, Human
gccacucauuucaucuca

SEQ ID NO: 2653381 - RNA, 20 nt, Human
gccacucauuucaucucauu

SEQ ID NO: 2653382 - RNA, 17 nt, Human
gccagccuugagcccug

SEQ ID NO: 2653383 - RNA, 18 nt, Human
gccagccuugagcccugg

SEQ ID NO: 2653384 - RNA, 19 nt, Human
gccagccuugagcccuggc

SEQ ID NO: 2653385 - RNA, 20 nt, Human
gccagccuugagcccuggcu

SEQ ID NO: 2653386 - RNA, 22 nt, Human
gccagccuugagcccuggcugu

SEQ ID NO: 2653387 - RNA, 14 nt, Human
gccagcgccucccu

SEQ ID NO: 2653388 - RNA, 15 nt, Human
gccagcgccucccuc

SEQ ID NO: 2653389 - RNA, 16 nt, Human
gccagcgccucccucc

SEQ ID NO: 2653390 - RNA, 17 nt, Human
gccagcgccucccucca

SEQ ID NO: 2653391 - RNA, 18 nt, Human
gccagcgccucccuccac

SEQ ID NO: 2653392 - RNA, 20 nt, Human
gccagcgccucccuccaccc

SEQ ID NO: 2653393 - RNA, 21 nt, Human
gccagcgccucccuccacccc

SEQ ID NO: 2653394 - RNA, 22 nt, Human
gccagcgccucccuccacccca

SEQ ID NO: 2653395 - RNA, 23 nt, Human
gccagcgccucccuccaccccag

SEQ ID NO: 2653396 - RNA, 13 nt, Human
gccagcucccucu

SEQ ID NO: 2653397 - RNA, 13 nt, Human
gccagcuggccuu

SEQ ID NO: 2653398 - RNA, 16 nt, Human
gccagcuggccuuugu

SEQ ID NO: 2653399 - RNA, 18 nt, Human
gccagcuggccuuuguaa

SEQ ID NO: 2653400 - RNA, 18 nt, Human
gccagcuuggggccacca

SEQ ID NO: 2653401 - RNA, 22 nt, Human
gccagcuuggggccaccaaagc

SEQ ID NO: 2653402 - RNA, 15 nt, Human
gccagccccucuucc

SEQ ID NO: 2653403 - RNA, 20 nt, Human
gccagccccucuuccccaau

SEQ ID NO: 2653404 - RNA, 21 nt, Human
gccagcccggccgcuccacca

SEQ ID NO: 2653405 - RNA, 22 nt, Human
gccagcccggccgcuccaccag

SEQ ID NO: 2653406 - RNA, 15 nt, Human
gccagauguccuaau

SEQ ID NO: 2653407 - RNA, 17 nt, Human
gccuuuguaagugcagg

SEQ ID NO: 2653408 - RNA, 18 nt, Human
gccuuuugcaaccaggaa

SEQ ID NO: 2653409 - RNA, 14 nt, Human
gccuuuuaauuuuu

SEQ ID NO: 2653410 - RNA, 15 nt, Human
gccuuuucuggcacc

SEQ ID NO: 2653411 - RNA, 16 nt, Human
gccuuuucuggcaccg

SEQ ID NO: 2653412 - RNA, 22 nt, Human
gccuuuucuggcaccgcaguuu

SEQ ID NO: 2653413 - RNA, 14 nt, Human
gccuuuguucuggg

SEQ ID NO: 2653414 - RNA, 22 nt, Human
gccuuuuuaaaacacauguuuu

SEQ ID NO: 2653415 - RNA, 18 nt, Human
gccuuuuuaaaacacaug

SEQ ID NO: 2653416 - RNA, 12 nt, Human
gcgaccaccgcc

SEQ ID NO: 2653417 - RNA, 17 nt, Human
gcgaccauguggccaca

SEQ ID NO: 2653418 - RNA, 13 nt, Human
gcgacccuggggg

SEQ ID NO: 2653419 - RNA, 19 nt, Human
gcgacccugggggcacagg

SEQ ID NO: 2653420 - RNA, 23 nt, Human
gcgacccugggggcacaggaggc

SEQ ID NO: 2653421 - RNA, 17 nt, Human
gccuucgcuucuugccu

SEQ ID NO: 2653422 - RNA, 18 nt, Human
gccuuccauuuccccucu

SEQ ID NO: 2653423 - RNA, 23 nt, Human
gccuucagacagagaggacugua

SEQ ID NO: 2653424 - RNA, 13 nt, Human
gccuucagcucca

SEQ ID NO: 2653425 - RNA, 14 nt, Human
gccuucagcuccag

SEQ ID NO: 2653426 - RNA, 22 nt, Human
gccuucgcuucuugccucugug

SEQ ID NO: 2653427 - RNA, 20 nt, Human
gccuucgcuucuugccucug

SEQ ID NO: 2653428 - RNA, 21 nt, Human
gccuucgcuucuugccucugu

SEQ ID NO: 2653429 - RNA, 22 nt, Human
gccuugggcuauuuggacucag

SEQ ID NO: 2653430 - RNA, 21 nt, Human
gccuuagccgcccaugcacug

SEQ ID NO: 2653431 - RNA, 19 nt, Human
gccuucaaaacuauagcuu

SEQ ID NO: 2653432 - RNA, 22 nt, Human
gccuucaaaacuauagcuugca

SEQ ID NO: 2653433 - RNA, 15 nt, Human
gccuguaaucccagc

SEQ ID NO: 2653434 - RNA, 22 nt, Human
gccuguaacacuccucugcguc

SEQ ID NO: 2653435 - RNA, 13 nt, Human
gccuggacugcua

SEQ ID NO: 2653436 - RNA, 22 nt, Human
gccuggagauccuccugcagac

SEQ ID NO: 2653437 - RNA, 17 nt, Human
gccuggagauccuccug

SEQ ID NO: 2653438 - RNA, 18 nt, Human
gccuggagauccuccugc

SEQ ID NO: 2653439 - RNA, 19 nt, Human
gccuggagauccuccugca

SEQ ID NO: 2653440 - RNA, 20 nt, Human
gccuggagauccuccugcag

SEQ ID NO: 2653441 - RNA, 17 nt, Human
gccuggagacuuagggc

SEQ ID NO: 2653442 - RNA, 19 nt, Human
gccuggagacuuagggcac

SEQ ID NO: 2653443 - RNA, 23 nt, Human
gccuggagacuuagggcaccagg

SEQ ID NO: 2653444 - RNA, 16 nt, Human
gccuggagauccuccu

SEQ ID NO: 2653445 - RNA, 16 nt, Human
gcuacaugcugggguc

SEQ ID NO: 2653446 - RNA, 20 nt, Human
gcuaacauggugaaaccccg

SEQ ID NO: 2653447 - RNA, 13 nt, Human
gcuaacuguaaau

SEQ ID NO: 2653448 - RNA, 14 nt, Human
gcuaacuguaaauc

SEQ ID NO: 2653449 - RNA, 16 nt, Human
gcuaacuguaaaucau

SEQ ID NO: 2653450 - RNA, 20 nt, Human
gcguccuccucaccucaugc

SEQ ID NO: 2653451 - RNA, 11 nt, Human
gcgucccuggc

SEQ ID NO: 2653452 - RNA, 12 nt, Human
gcgucccuggcg

SEQ ID NO: 2653453 - RNA, 14 nt, Human
gcgucccuggcgca

SEQ ID NO: 2653454 - RNA, 18 nt, Human
gcgucccuggcgcaggug

SEQ ID NO: 2653455 - RNA, 13 nt, Human
gcgcuugcuggcc

SEQ ID NO: 2653456 - RNA, 15 nt, Human
gcgcuugcuggccag

SEQ ID NO: 2653457 - RNA, 17 nt, Human
gcgacuaaacuagauuu

SEQ ID NO: 2653458 - RNA, 20 nt, Human
gcgacuccguuggccacucc

SEQ ID NO: 2653459 - RNA, 18 nt, Human
gcgacuccguuggccacu

SEQ ID NO: 2653460 - RNA, 19 nt, Human
gcgacuccguuggccacuc

SEQ ID NO: 2653461 - RNA, 12 nt, Human
gcgacuuucugc

SEQ ID NO: 2653462 - RNA, 14 nt, Human
gcgcuccgggcuuu

SEQ ID NO: 2653463 - RNA, 23 nt, Human
gcgcucuguggaugccagggccg

SEQ ID NO: 2653464 - RNA, 16 nt, Human
gcgcucucuuugcaac

SEQ ID NO: 2653465 - RNA, 19 nt, Human
gcgcucucuuugcaacugu

SEQ ID NO: 2653466 - RNA, 19 nt, Human
gcgcugcccaccugccggc

SEQ ID NO: 2653467 - RNA, 23 nt, Human
gcgcugccccaucuccccucagc

SEQ ID NO: 2653468 - RNA, 16 nt, Human
gccucuccauuugcuc

SEQ ID NO: 2653469 - RNA, 22 nt, Human
gccucuccauuugcucuucaga

SEQ ID NO: 2653470 - RNA, 18 nt, Human
gccucuccccagguccag

SEQ ID NO: 2653471 - RNA, 14 nt, Human
gccucuccagccuc

SEQ ID NO: 2653472 - RNA, 15 nt, Human
gccucuccagccuca

SEQ ID NO: 2653473 - RNA, 14 nt, Human
gccucccuccaccc

SEQ ID NO: 2653474 - RNA, 15 nt, Human
gccucccuccacccc

SEQ ID NO: 2653475 - RNA, 16 nt, Human
gccucccuccacccca

SEQ ID NO: 2653476 - RNA, 17 nt, Human
gccucccuccaccccag

SEQ ID NO: 2653477 - RNA, 18 nt, Human
gccucccuccaccccagg

SEQ ID NO: 2653478 - RNA, 19 nt, Human
gccucccuccaccccagga

SEQ ID NO: 2653479 - RNA, 20 nt, Human
gccucccuccaccccaggac

SEQ ID NO: 2653480 - RNA, 21 nt, Human
gccucccuccaccccaggacg

SEQ ID NO: 2653481 - RNA, 19 nt, Human
gccucccuccccagugcaa

SEQ ID NO: 2653482 - RNA, 20 nt, Human
gccucuccccagguccagcu

SEQ ID NO: 2653483 - RNA, 22 nt, Human
gccucuccccagguccagcucu

SEQ ID NO: 2653484 - RNA, 23 nt, Human
gccucuccccagguccagcucug

SEQ ID NO: 2653485 - RNA, 23 nt, Human
gccuccccauuucccaucugcac

SEQ ID NO: 2653486 - RNA, 21 nt, Human
gccuccccauuucccaucugc

SEQ ID NO: 2653487 - RNA, 22 nt, Human
gccuccccauuucccaucugca

SEQ ID NO: 2653488 - RNA, 13 nt, Human
gccuccccauuuc

SEQ ID NO: 2653489 - RNA, 16 nt, Human
gccuccccauuuccca

SEQ ID NO: 2653490 - RNA, 18 nt, Human
gccuccccauuucccauc

SEQ ID NO: 2653491 - RNA, 19 nt, Human
gccuccccauuucccaucu

SEQ ID NO: 2653492 - RNA, 20 nt, Human
gccuccccauuucccaucug

SEQ ID NO: 2653493 - RNA, 16 nt, Human
gccuccccaccuccag

SEQ ID NO: 2653494 - RNA, 17 nt, Human
gccuccccaccuccagg

SEQ ID NO: 2653495 - RNA, 18 nt, Human
gccuccccaccuccaggc

SEQ ID NO: 2653496 - RNA, 22 nt, Human
gccugagaggcaggcauagagg

SEQ ID NO: 2653497 - RNA, 16 nt, Human
gccucugaaaagugug

SEQ ID NO: 2653498 - RNA, 22 nt, Human
gccugagcccuacucccugcag

SEQ ID NO: 2653499 - RNA, 22 nt, Human
gccugcuggcacccaccgugga

SEQ ID NO: 2653500 - RNA, 13 nt, Human
gccugcuggcacc

SEQ ID NO: 2653501 - RNA, 16 nt, Human
gccugcuggcacccac

SEQ ID NO: 2653502 - RNA, 17 nt, Human
gccugcuggcacccacc

SEQ ID NO: 2653503 - RNA, 19 nt, Human
gccugcuggcacccaccgu

SEQ ID NO: 2653504 - RNA, 14 nt, Human
gccuggacccugug

SEQ ID NO: 2653505 - RNA, 14 nt, Human
gccugcccagacaa

SEQ ID NO: 2653506 - RNA, 15 nt, Human
gccugcccagacaag

SEQ ID NO: 2653507 - RNA, 16 nt, Human
gccugcccagacaaga

SEQ ID NO: 2653508 - RNA, 10 nt, Human
gccugcuggc

SEQ ID NO: 2653509 - RNA, 19 nt, Human
gccgagacucgacucugug

SEQ ID NO: 2653510 - RNA, 21 nt, Human
gccgagacucgacucugugcc

SEQ ID NO: 2653511 - RNA, 23 nt, Human
gccgagacucgacucugugccuc

SEQ ID NO: 2653512 - RNA, 17 nt, Human
gcccuuccugcugcgca

SEQ ID NO: 2653513 - RNA, 14 nt, Human
gccgauagagggac

SEQ ID NO: 2653514 - RNA, 21 nt, Human
gccgauagagggacggccaag

SEQ ID NO: 2653515 - RNA, 22 nt, Human
gccgauagagggacggccaaga

SEQ ID NO: 2653516 - RNA, 12 nt, Human
gccgggccccug

SEQ ID NO: 2653517 - RNA, 22 nt, Human
gccgggcacauugagcugugca

SEQ ID NO: 2653518 - RNA, 12 nt, Human
gccggggaagag

SEQ ID NO: 2653519 - RNA, 22 nt, Human
gccggggaagagauccaaagac

SEQ ID NO: 2653520 - RNA, 14 nt, Human
gccgggccccuggg

SEQ ID NO: 2653521 - RNA, 17 nt, Human
gccgggccccugggcuu

SEQ ID NO: 2653522 - RNA, 19 nt, Human
gccgggccccugggcuugg

SEQ ID NO: 2653523 - RNA, 18 nt, Human
gccguugcugacuuagaa

SEQ ID NO: 2653524 - RNA, 17 nt, Human
gccguugcugacuuaga

SEQ ID NO: 2653525 - RNA, 19 nt, Human
gccguugcugacuuagaau

SEQ ID NO: 2653526 - RNA, 23 nt, Human
gccgucuccaggggcugcuuccu

SEQ ID NO: 2653527 - RNA, 12 nt, Human
gccgucucugga

SEQ ID NO: 2653528 - RNA, 16 nt, Human
gccgucuccaggggcu

SEQ ID NO: 2653529 - RNA, 21 nt, Human
gccgucuccaggggcugcuuc

SEQ ID NO: 2653530 - RNA, 11 nt, Human
gccgucucaac

SEQ ID NO: 2653531 - RNA, 14 nt, Human
gccgucuccagggg

SEQ ID NO: 2653532 - RNA, 16 nt, Human
gccgguaacuguccug

SEQ ID NO: 2653533 - RNA, 17 nt, Human
gccgguaacuguccugu

SEQ ID NO: 2653534 - RNA, 15 nt, Human
gccuauugauacuug

SEQ ID NO: 2653535 - RNA, 11 nt, Human
gccuauuucau

SEQ ID NO: 2653536 - RNA, 15 nt, Human
gccuaaaccucaguu

SEQ ID NO: 2653537 - RNA, 12 nt, Human
ggcaccucuucc

SEQ ID NO: 2653538 - RNA, 19 nt, Human
ggcagagcuggcucugagc

SEQ ID NO: 2653539 - RNA, 15 nt, Human
ggcaauaaauuuuga

SEQ ID NO: 2653540 - RNA, 19 nt, Human
ggcaacuggccauuugcca

SEQ ID NO: 2653541 - RNA, 21 nt, Human
ggaucaucuaauucucugugg

SEQ ID NO: 2653542 - RNA, 16 nt, Human
ggaucccaagccuccu

SEQ ID NO: 2653543 - RNA, 21 nt, Human
ggaucccaagccuccugcugc

SEQ ID NO: 2653544 - RNA, 18 nt, Human
ggaucaggcucccaggag

SEQ ID NO: 2653545 - RNA, 16 nt, Human
ggaucaggcucccagg

SEQ ID NO: 2653546 - RNA, 12 nt, Human
ggcaacuggcca

SEQ ID NO: 2653547 - RNA, 19 nt, Human
ggcaacugcauuggcuuug

SEQ ID NO: 2653548 - RNA, 18 nt, Human
ggcaacugcauuggcuuu

SEQ ID NO: 2653549 - RNA, 16 nt, Human
ggauccccgccuggcc

SEQ ID NO: 2653550 - RNA, 19 nt, Human
ggauccccgccuggccagg

SEQ ID NO: 2653551 - RNA, 21 nt, Human
ggauccccgccuggccaggag

SEQ ID NO: 2653552 - RNA, 22 nt, Human
ggauccccgccuggccaggagc

SEQ ID NO: 2653553 - RNA, 23 nt, Human
ggauccccgccuggccaggagca

SEQ ID NO: 2653554 - RNA, 19 nt, Human
ggcaggugcuggagcacug

SEQ ID NO: 2653555 - RNA, 21 nt, Human
ggcaggugcuggagcacuggg

SEQ ID NO: 2653556 - RNA, 20 nt, Human
ggcaggugcuggagcacugg

SEQ ID NO: 2653557 - RNA, 20 nt, Human
ggcagauuuuacagagcgca

SEQ ID NO: 2653558 - RNA, 21 nt, Human
ggcagauuuuacagagcgcac

SEQ ID NO: 2653559 - RNA, 15 nt, Human
ggcccccacuugccu

SEQ ID NO: 2653560 - RNA, 21 nt, Human
ggcccccaaccucagggcucc

SEQ ID NO: 2653561 - RNA, 23 nt, Human
ggcccccaaccucagggcuccca

SEQ ID NO: 2653562 - RNA, 14 nt, Human
ggccauggcucagg

SEQ ID NO: 2653563 - RNA, 16 nt, Human
ggcccccacuugccuc

SEQ ID NO: 2653564 - RNA, 18 nt, Human
ggcccccacuugccucuu

SEQ ID NO: 2653565 - RNA, 14 nt, Human
ggcccccagcccag

SEQ ID NO: 2653566 - RNA, 17 nt, Human
ggcccccagcccagggc

SEQ ID NO: 2653567 - RNA, 18 nt, Human
ggcccccagcccagggcu

SEQ ID NO: 2653568 - RNA, 20 nt, Human
ggcccccagcccagggcucc

SEQ ID NO: 2653569 - RNA, 18 nt, Human
ggccccguuucugguggu

SEQ ID NO: 2653570 - RNA, 11 nt, Human
ggcccccugcc

SEQ ID NO: 2653571 - RNA, 13 nt, Human
ggcccccugcccg

SEQ ID NO: 2653572 - RNA, 23 nt, Human
ggcccccagcccagggcuccugc

SEQ ID NO: 2653573 - RNA, 14 nt, Human
ggccccucccacac

SEQ ID NO: 2653574 - RNA, 22 nt, Human
ggccccucccacacccaaagcu

SEQ ID NO: 2653575 - RNA, 23 nt, Human
ggccccucccacacccaaagcug

SEQ ID NO: 2653576 - RNA, 16 nt, Human
ggccacugugaagaga

SEQ ID NO: 2653577 - RNA, 11 nt, Human
ggccacuguga

SEQ ID NO: 2653578 - RNA, 15 nt, Human
ggcagguuggugggg

SEQ ID NO: 2653579 - RNA, 21 nt, Human
ggagccgaggccuaccccgca

SEQ ID NO: 2653580 - RNA, 15 nt, Human
ggaggagggggccgg

SEQ ID NO: 2653581 - RNA, 12 nt, Human
ggaggagggaga

SEQ ID NO: 2653582 - RNA, 13 nt, Human
ggaggagggagag

SEQ ID NO: 2653583 - RNA, 13 nt, Human
ggaggaggaaggc

SEQ ID NO: 2653584 - RNA, 15 nt, Human
ggaggaggaaggcaa

SEQ ID NO: 2653585 - RNA, 21 nt, Human
ggaggaucucuugagccuggg

SEQ ID NO: 2653586 - RNA, 17 nt, Human
ggaggaucucuugagcc

SEQ ID NO: 2653587 - RNA, 23 nt, Human
ggaggaucacuugaguccagaag

SEQ ID NO: 2653588 - RNA, 13 nt, Human
ggagggagaggga

SEQ ID NO: 2653589 - RNA, 22 nt, Human
ggagggauucugguuccagggu

SEQ ID NO: 2653590 - RNA, 11 nt, Human
ggagggaggcc

SEQ ID NO: 2653591 - RNA, 13 nt, Human
ggagggaggcccc

SEQ ID NO: 2653592 - RNA, 21 nt, Human
ggagggcaagggguucccuug

SEQ ID NO: 2653593 - RNA, 18 nt, Human
ggauagcuaacuguaaau

SEQ ID NO: 2653594 - RNA, 19 nt, Human
ggauagcuaacuguaaauc

SEQ ID NO: 2653595 - RNA, 16 nt, Human
ggaucacagccucuga

SEQ ID NO: 2653596 - RNA, 22 nt, Human
ggagucguggggugugcuggga

SEQ ID NO: 2653597 - RNA, 24 nt, Human
ggagucguggggugugcugggagc

SEQ ID NO: 2653598 - RNA, 16 nt, Human
ggaggggagacuuuga

SEQ ID NO: 2653599 - RNA, 14 nt, Human
ggaggggagacuuu

SEQ ID NO: 2653600 - RNA, 16 nt, Human
ggaguccacuuuguuu

SEQ ID NO: 2653601 - RNA, 12 nt, Human
ggagacgccaug

SEQ ID NO: 2653602 - RNA, 19 nt, Human
ggagacgccaugugaugga

SEQ ID NO: 2653603 - RNA, 19 nt, Human
ggagacgguuuccagggag

SEQ ID NO: 2653604 - RNA, 21 nt, Human
ggagacgguuuccagggaggg

SEQ ID NO: 2653605 - RNA, 20 nt, Human
ggagaccgggguauccuggg

SEQ ID NO: 2653606 - RNA, 21 nt, Human
ggagagcuagcagcagggagg

SEQ ID NO: 2653607 - RNA, 17 nt, Human
ggagagcuagcagcagg

SEQ ID NO: 2653608 - RNA, 22 nt, Human
ggagacguuuauaaacagaaau

SEQ ID NO: 2653609 - RNA, 13 nt, Human
ggagagggagguc

SEQ ID NO: 2653610 - RNA, 17 nt, Human
ggagagggaggucacug

SEQ ID NO: 2653611 - RNA, 18 nt, Human
ggacugcuaaauaaaauu

SEQ ID NO: 2653612 - RNA, 19 nt, Human
ggacugcuaaauaaaauuu

SEQ ID NO: 2653613 - RNA, 22 nt, Human
ggacugcuaccuuucaaagcuu

SEQ ID NO: 2653614 - RNA, 18 nt, Human
ggacuguagggagggcgg

SEQ ID NO: 2653615 - RNA, 20 nt, Human
ggacuguagggagggcggca

SEQ ID NO: 2653616 - RNA, 15 nt, Human
ggacuguaagggauu

SEQ ID NO: 2653617 - RNA, 12 nt, Human
ggagauuauaau

SEQ ID NO: 2653618 - RNA, 14 nt, Human
ggagauuauaauaa

SEQ ID NO: 2653619 - RNA, 15 nt, Human
ggagaggggcacagg

SEQ ID NO: 2653620 - RNA, 14 nt, Human
ggaccugccaggca

SEQ ID NO: 2653621 - RNA, 16 nt, Human
ggaccugccaggcagg

SEQ ID NO: 2653622 - RNA, 17 nt, Human
ggaccugccaggcaggg

SEQ ID NO: 2653623 - RNA, 21 nt, Human
ggaccuuaggccuuccucucu

SEQ ID NO: 2653624 - RNA, 18 nt, Human
ggaccuuaggccuuccuc

SEQ ID NO: 2653625 - RNA, 12 nt, Human
ggaccuguggcu

SEQ ID NO: 2653626 - RNA, 16 nt, Human
ggaccuguggcugucg

SEQ ID NO: 2653627 - RNA, 15 nt, Human
ggacugagugggaag

SEQ ID NO: 2653628 - RNA, 17 nt, Human
ggacugagugggaagcc

SEQ ID NO: 2653629 - RNA, 18 nt, Human
ggacugagugggaagccc

SEQ ID NO: 2653630 - RNA, 11 nt, Human
ggacccagugc

SEQ ID NO: 2653631 - RNA, 13 nt, Human
ggacccagugcag

SEQ ID NO: 2653632 - RNA, 16 nt, Human
ggacccagugcagaau

SEQ ID NO: 2653633 - RNA, 21 nt, Human
gcuguguauaugguauauaua

SEQ ID NO: 2653634 - RNA, 20 nt, Human
gcugucaaugggaccugugg

SEQ ID NO: 2653635 - RNA, 22 nt, Human
gcugucaaugggaccuguggcu

SEQ ID NO: 2653636 - RNA, 21 nt, Human
gcugguggagaacucuggcuu

SEQ ID NO: 2653637 - RNA, 23 nt, Human
gcugggggaagaagcucucuccu

SEQ ID NO: 2653638 - RNA, 14 nt, Human
gcugggggcaacug

SEQ ID NO: 2653639 - RNA, 18 nt, Human
gcugggggcaacuggcca

SEQ ID NO: 2653640 - RNA, 13 nt, Human
gcugggagcucca

SEQ ID NO: 2653641 - RNA, 14 nt, Human
gcugggagcuccac

SEQ ID NO: 2653642 - RNA, 16 nt, Human
gcugggagcuccacuc

SEQ ID NO: 2653643 - RNA, 18 nt, Human
gcugggagcuccacucug

SEQ ID NO: 2653644 - RNA, 22 nt, Human
gcugggagcuccacucugcuuc

SEQ ID NO: 2653645 - RNA, 20 nt, Human
gcugggagcuccacucugcu

SEQ ID NO: 2653646 - RNA, 21 nt, Human
gcugggagcuccacucugcuu

SEQ ID NO: 2653647 - RNA, 16 nt, Human
gcugggaggagggaga

SEQ ID NO: 2653648 - RNA, 17 nt, Human
gcugggaggagggagag

SEQ ID NO: 2653649 - RNA, 18 nt, Human
gcugggaggagggagagg

SEQ ID NO: 2653650 - RNA, 22 nt, Human
gcugggaggagggagagggagg

SEQ ID NO: 2653651 - RNA, 22 nt, Human
gcuagcagcagggagggcuucu

SEQ ID NO: 2653652 - RNA, 13 nt, Human
gcugcccuugggc

SEQ ID NO: 2653653 - RNA, 18 nt, Human
gcugcccuugggccaccc

SEQ ID NO: 2653654 - RNA, 20 nt, Human
gcugcccuugggccaccccu

SEQ ID NO: 2653655 - RNA, 14 nt, Human
gcugccuuggcuca

SEQ ID NO: 2653656 - RNA, 16 nt, Human
gcugccuuggcucaga

SEQ ID NO: 2653657 - RNA, 19 nt, Human
gcugccuuggcucagacau

SEQ ID NO: 2653658 - RNA, 17 nt, Human
gcugccuuggcucagac

SEQ ID NO: 2653659 - RNA, 23 nt, Human
gcugccuuggcucagacauguuu

SEQ ID NO: 2653660 - RNA, 21 nt, Human
gcugccuuggcucagacaugu

SEQ ID NO: 2653661 - RNA, 15 nt, Human
gcugcgcuugcuuuu

SEQ ID NO: 2653662 - RNA, 19 nt, Human
gcugcuauuuauuuuccua

SEQ ID NO: 2653663 - RNA, 17 nt, Human
gcugcuauccccaucuc

SEQ ID NO: 2653664 - RNA, 21 nt, Human
gcugcuauccccaucucccug

SEQ ID NO: 2653665 - RNA, 22 nt, Human
gcugcuauccccaucucccugc

SEQ ID NO: 2653666 - RNA, 23 nt, Human
gcugcuauccccaucucccugcc

SEQ ID NO: 2653667 - RNA, 18 nt, Human
gcugcuauuuauuuuccu

SEQ ID NO: 2653668 - RNA, 13 nt, Human
gcugcuuccuccu

SEQ ID NO: 2653669 - RNA, 14 nt, Human
gcugcuuccuccug

SEQ ID NO: 2653670 - RNA, 15 nt, Human
gcugcuuccuccugg

SEQ ID NO: 2653671 - RNA, 16 nt, Human
gcugcuuccuccugga

SEQ ID NO: 2653672 - RNA, 17 nt, Human
gcugcuuccuccuggaa

SEQ ID NO: 2653673 - RNA, 21 nt, Human
gcugcuuaauaccaaacaugc

SEQ ID NO: 2653674 - RNA, 12 nt, Human
gcuggccccagc

SEQ ID NO: 2653675 - RNA, 14 nt, Human
gcuggccccagccc

SEQ ID NO: 2653676 - RNA, 15 nt, Human
gcuggccccagcccu

SEQ ID NO: 2653677 - RNA, 16 nt, Human
gcuggccccagcccug

SEQ ID NO: 2653678 - RNA, 17 nt, Human
gcuggccccagcccugc

SEQ ID NO: 2653679 - RNA, 18 nt, Human
gcuggccccagcccugcu

SEQ ID NO: 2653680 - RNA, 19 nt, Human
gcuggccccagcccugcug

SEQ ID NO: 2653681 - RNA, 21 nt, Human
gcuggccccagcccugcuggg

SEQ ID NO: 2653682 - RNA, 22 nt, Human
gcuggccccagcccugcugggg

SEQ ID NO: 2653683 - RNA, 15 nt, Human
gcuggccucucuagc

SEQ ID NO: 2653684 - RNA, 19 nt, Human
gcuggccucucuagcacaa

SEQ ID NO: 2653685 - RNA, 14 nt, Human
gcuggccuggacag

SEQ ID NO: 2653686 - RNA, 22 nt, Human
gcugggacucagccuucagaca

SEQ ID NO: 2653687 - RNA, 23 nt, Human
gcugggacucagccuucagacag

SEQ ID NO: 2653688 - RNA, 14 nt, Human
gcugggacucagcc

SEQ ID NO: 2653689 - RNA, 15 nt, Human
gcugggacucagccu

SEQ ID NO: 2653690 - RNA, 16 nt, Human
gcugggacucagccuu

SEQ ID NO: 2653691 - RNA, 19 nt, Human
gcugggacucagccuucag

SEQ ID NO: 2653692 - RNA, 12 nt, Human
gcugggacucag

SEQ ID NO: 2653693 - RNA, 23 nt, Human
ggaaaguggccaagaagcagugg

SEQ ID NO: 2653694 - RNA, 20 nt, Human
ggaaaucaaagugcuauuac

SEQ ID NO: 2653695 - RNA, 17 nt, Human
ggaaaucaaagugcuau

SEQ ID NO: 2653696 - RNA, 20 nt, Human
ggaaaggggucggcugacca

SEQ ID NO: 2653697 - RNA, 15 nt, Human
ggaaaaucagccugc

SEQ ID NO: 2653698 - RNA, 12 nt, Human
ggaagauccugc

SEQ ID NO: 2653699 - RNA, 22 nt, Human
ggaagauccugcggguggggcu

SEQ ID NO: 2653700 - RNA, 15 nt, Human
ggaagaucauuuuga

SEQ ID NO: 2653701 - RNA, 14 nt, Human
ggaagagauccaaa

SEQ ID NO: 2653702 - RNA, 16 nt, Human
ggaagagauccaaaga

SEQ ID NO: 2653703 - RNA, 17 nt, Human
ggaagagauccaaagac

SEQ ID NO: 2653704 - RNA, 18 nt, Human
ggaagagauccaaagacu

SEQ ID NO: 2653705 - RNA, 20 nt, Human
ggaagagauccaaagacucu

SEQ ID NO: 2653706 - RNA, 13 nt, Human
ggaagagccuugc

SEQ ID NO: 2653707 - RNA, 18 nt, Human
ggaagaggaaaaggcugg

SEQ ID NO: 2653708 - RNA, 22 nt, Human
ggaagccaaaauguaggcuuag

SEQ ID NO: 2653709 - RNA, 24 nt, Human
gcuucuccgccagccuccucugga

SEQ ID NO: 2653710 - RNA, 23 nt, Human
gcuucuccgccagccuccucugg

SEQ ID NO: 2653711 - RNA, 21 nt, Human
gcuucucugacuucugccugg

SEQ ID NO: 2653712 - RNA, 22 nt, Human
gcuucucugacuucugccugga

SEQ ID NO: 2653713 - RNA, 13 nt, Human
gcuucucugacuu

SEQ ID NO: 2653714 - RNA, 14 nt, Human
gcuucucugacuuc

SEQ ID NO: 2653715 - RNA, 17 nt, Human
gcuucucugacuucugc

SEQ ID NO: 2653716 - RNA, 18 nt, Human
gcuucucugacuucugcc

SEQ ID NO: 2653717 - RNA, 20 nt, Human
gcuucucugacuucugccug

SEQ ID NO: 2653718 - RNA, 19 nt, Human
gcuugcagugagccgagau

SEQ ID NO: 2653719 - RNA, 11 nt, Human
gcuugcagaac

SEQ ID NO: 2653720 - RNA, 21 nt, Human
gcuucugugcccagaauacug

SEQ ID NO: 2653721 - RNA, 19 nt, Human
gcuucugugcccagaauac

SEQ ID NO: 2653722 - RNA, 15 nt, Human
gcuucugugcccaga

SEQ ID NO: 2653723 - RNA, 16 nt, Human
gcuucugugaugagcu

SEQ ID NO: 2653724 - RNA, 17 nt, Human
gcuucugugaugagcug

SEQ ID NO: 2653725 - RNA, 18 nt, Human
gcuucugugaugagcuga

SEQ ID NO: 2653726 - RNA, 19 nt, Human
gcuucugugaugagcugau

SEQ ID NO: 2653727 - RNA, 20 nt, Human
gcuucugugaugagcugauc

SEQ ID NO: 2653728 - RNA, 23 nt, Human
gcuuuuaacuuuauaaauccagu

SEQ ID NO: 2653729 - RNA, 14 nt, Human
gcuuuuacuuaaac

SEQ ID NO: 2653730 - RNA, 22 nt, Human
ggaaaacuaccuguauuuaaaa

SEQ ID NO: 2653731 - RNA, 13 nt, Human
ggaaaacuguguu

SEQ ID NO: 2653732 - RNA, 14 nt, Human
ggaaaacuguguug

SEQ ID NO: 2653733 - RNA, 15 nt, Human
ggaaaaauagccugc

SEQ ID NO: 2653734 - RNA, 13 nt, Human
ggaaaaacacaag

SEQ ID NO: 2653735 - RNA, 13 nt, Human
ggaaaaauagccu

SEQ ID NO: 2653736 - RNA, 22 nt, Human
gcuuuggaccuaaauggccuca

SEQ ID NO: 2653737 - RNA, 16 nt, Human
gcuuuauuuguaaauu

SEQ ID NO: 2653738 - RNA, 17 nt, Human
gcuuuauuuguaaauuu

SEQ ID NO: 2653739 - RNA, 18 nt, Human
gcuuuauuuugagaugua

SEQ ID NO: 2653740 - RNA, 20 nt, Human
gcuuuauuuugagauguaaa

SEQ ID NO: 2653741 - RNA, 23 nt, Human
gcuuuacuggggcuggggaagga

SEQ ID NO: 2653742 - RNA, 16 nt, Human
gcuuuauuaauguuuu

SEQ ID NO: 2653743 - RNA, 17 nt, Human
gcuuuaccuuuucaggg

SEQ ID NO: 2653744 - RNA, 18 nt, Human
gcuuuaccuuuucagggc

SEQ ID NO: 2653745 - RNA, 20 nt, Human
gcuuuaccuuuucagggcug

SEQ ID NO: 2653746 - RNA, 21 nt, Human
gcuuuaccuuuucagggcugg

SEQ ID NO: 2653747 - RNA, 22 nt, Human
gcuuuaccuuuucagggcuggc

SEQ ID NO: 2653748 - RNA, 13 nt, Human
gcuuggccugcug

SEQ ID NO: 2653749 - RNA, 13 nt, Human
gcuuuaagccuuc

SEQ ID NO: 2653750 - RNA, 14 nt, Human
gcuuuaagccuuca

SEQ ID NO: 2653751 - RNA, 16 nt, Human
gggcacgcacuggguu

SEQ ID NO: 2653752 - RNA, 13 nt, Human
gggcaggggcugg

SEQ ID NO: 2653753 - RNA, 22 nt, Human
gggcaggugcuggagcacuggg

SEQ ID NO: 2653754 - RNA, 17 nt, Human
gggcagguugguggggg

SEQ ID NO: 2653755 - RNA, 16 nt, Human
gggcacagggucucua

SEQ ID NO: 2653756 - RNA, 13 nt, Human
gggcacagggucu

SEQ ID NO: 2653757 - RNA, 18 nt, Human
gggcaccagggguuucuc

SEQ ID NO: 2653758 - RNA, 20 nt, Human
gggcaccagggguuucucgc

SEQ ID NO: 2653759 - RNA, 13 nt, Human
gggcacaggaggc

SEQ ID NO: 2653760 - RNA, 18 nt, Human
gggcacaggaggcaggca

SEQ ID NO: 2653761 - RNA, 23 nt, Human
gggagguggaagaagggagaaga

SEQ ID NO: 2653762 - RNA, 20 nt, Human
gggacuacccauagacauga

SEQ ID NO: 2653763 - RNA, 22 nt, Human
gggacucagccuucagacagag

SEQ ID NO: 2653764 - RNA, 13 nt, Human
gggcaagaggaau

SEQ ID NO: 2653765 - RNA, 20 nt, Human
gggcaagcuccgcaggacuu

SEQ ID NO: 2653766 - RNA, 20 nt, Human
gggaugaaacuaaagcaaua

SEQ ID NO: 2653767 - RNA, 17 nt, Human
gggauccgacugcuuug

SEQ ID NO: 2653768 - RNA, 17 nt, Human
gggauccccgccuggcc

SEQ ID NO: 2653769 - RNA, 19 nt, Human
gggauccccgccuggccag

SEQ ID NO: 2653770 - RNA, 20 nt, Human
gggauccccgccuggccagg

SEQ ID NO: 2653771 - RNA, 22 nt, Human
gggauccccgccuggccaggag

SEQ ID NO: 2653772 - RNA, 23 nt, Human
gggauccccgccuggccaggagc

SEQ ID NO: 2653773 - RNA, 15 nt, Human
gggauauuuuuuucu

SEQ ID NO: 2653774 - RNA, 21 nt, Human
gggauaugauuuaaaucagcc

SEQ ID NO: 2653775 - RNA, 14 nt, Human
gggccaccccuccu

SEQ ID NO: 2653776 - RNA, 14 nt, Human
gggccaccaaagcu

SEQ ID NO: 2653777 - RNA, 16 nt, Human
gggccaccaaagcugc

SEQ ID NO: 2653778 - RNA, 17 nt, Human
gggccaccaaagcugcc

SEQ ID NO: 2653779 - RNA, 19 nt, Human
gggccaccaaagcugccca

SEQ ID NO: 2653780 - RNA, 13 nt, Human
gggccaccccucc

SEQ ID NO: 2653781 - RNA, 14 nt, Human
gggcccagauucua

SEQ ID NO: 2653782 - RNA, 14 nt, Human
gggcauaaaguaaa

SEQ ID NO: 2653783 - RNA, 11 nt, Human
gggccccagcu

SEQ ID NO: 2653784 - RNA, 13 nt, Human
gggcccagugcau

SEQ ID NO: 2653785 - RNA, 22 nt, Human
gggcccagugcaugguggccag

SEQ ID NO: 2653786 - RNA, 13 nt, Human
gggcccugggcug

SEQ ID NO: 2653787 - RNA, 14 nt, Human
gggcccugagucug

SEQ ID NO: 2653788 - RNA, 18 nt, Human
gggcccgacauggcuccg

SEQ ID NO: 2653789 - RNA, 11 nt, Human
gggccccuggc

SEQ ID NO: 2653790 - RNA, 12 nt, Human
gggccccuggca

SEQ ID NO: 2653791 - RNA, 15 nt, Human
gggccccuggcacuc

SEQ ID NO: 2653792 - RNA, 14 nt, Human
gggccccugggcuu

SEQ ID NO: 2653793 - RNA, 21 nt, Human
gggccccugggcuuggccugc

SEQ ID NO: 2653794 - RNA, 23 nt, Human
gggccccugggcuuggccugcug

SEQ ID NO: 2653795 - RNA, 14 nt, Human
gggcccugggcugg

SEQ ID NO: 2653796 - RNA, 20 nt, Human
gggaccggcggaccccagcc

SEQ ID NO: 2653797 - RNA, 23 nt, Human
gggacccugugacauggugccug

SEQ ID NO: 2653798 - RNA, 13 nt, Human
gggacaagggauu

SEQ ID NO: 2653799 - RNA, 16 nt, Human
ggcuugaagccaaaga

SEQ ID NO: 2653800 - RNA, 22 nt, Human
ggcuuggggcucacacaccugu

SEQ ID NO: 2653801 - RNA, 13 nt, Human
ggcuuguaguucu

SEQ ID NO: 2653802 - RNA, 16 nt, Human
ggcuuguaguucuuua

SEQ ID NO: 2653803 - RNA, 22 nt, Human
ggcuugucuauacuccuucccu

SEQ ID NO: 2653804 - RNA, 19 nt, Human
ggcuuguucaucauccaga

SEQ ID NO: 2653805 - RNA, 17 nt, Human
ggcuuguuuaccuuucu

SEQ ID NO: 2653806 - RNA, 22 nt, Human
ggcuuuauuuuuuugaacucuu

SEQ ID NO: 2653807 - RNA, 17 nt, Human
ggcuuuauuuuuuugaa

SEQ ID NO: 2653808 - RNA, 22 nt, Human
ggcuuucccacuucccacccug

SEQ ID NO: 2653809 - RNA, 23 nt, Human
ggcuuucccacuucccacccugc

SEQ ID NO: 2653810 - RNA, 21 nt, Human
ggcugggccauguccaaagag

SEQ ID NO: 2653811 - RNA, 17 nt, Human
ggcugggccauguccaa

SEQ ID NO: 2653812 - RNA, 20 nt, Human
ggcugggccauguccaaaga

SEQ ID NO: 2653813 - RNA, 22 nt, Human
ggcuuaguuuguguguugucuc

SEQ ID NO: 2653814 - RNA, 14 nt, Human
ggcuuauaaaacag

SEQ ID NO: 2653815 - RNA, 14 nt, Human
ggcuuaaucauuuu

SEQ ID NO: 2653816 - RNA, 18 nt, Human
ggcuuauaucuggccucu

SEQ ID NO: 2653817 - RNA, 12 nt, Human
ggcuugaagcca

SEQ ID NO: 2653818 - RNA, 13 nt, Human
ggcuugaagccaa

SEQ ID NO: 2653819 - RNA, 15 nt, Human
ggcuugaagccaaag

SEQ ID NO: 2653820 - RNA, 20 nt, Human
ggcuugaagccaaagaaaaa

SEQ ID NO: 2653821 - RNA, 13 nt, Human
ggcuugaagcugu

SEQ ID NO: 2653822 - RNA, 14 nt, Human
ggcuugaagcugug

SEQ ID NO: 2653823 - RNA, 23 nt, Human
ggcugagguuccucugccugccc

SEQ ID NO: 2653824 - RNA, 14 nt, Human
ggcugagguuccuc

SEQ ID NO: 2653825 - RNA, 16 nt, Human
ggcugagguuccucug

SEQ ID NO: 2653826 - RNA, 17 nt, Human
ggcugagguuccucugc

SEQ ID NO: 2653827 - RNA, 18 nt, Human
ggcugagguuccucugcc

SEQ ID NO: 2653828 - RNA, 19 nt, Human
ggcugagguuccucugccu

SEQ ID NO: 2653829 - RNA, 20 nt, Human
ggcugagguuccucugccug

SEQ ID NO: 2653830 - RNA, 21 nt, Human
ggcugagguuccucugccugc

SEQ ID NO: 2653831 - RNA, 22 nt, Human
ggcugagguuccucugccugcc

SEQ ID NO: 2653832 - RNA, 18 nt, Human
ggcugaugucaauuucug

SEQ ID NO: 2653833 - RNA, 22 nt, Human
ggcugaugucaauuucuguguu

SEQ ID NO: 2653834 - RNA, 24 nt, Human
ggcugaugucaauuucuguguugc

SEQ ID NO: 2653835 - RNA, 19 nt, Human
ggcugcagaggccagaggc

SEQ ID NO: 2653836 - RNA, 23 nt, Human
ggcugaugguguggccuguggcu

SEQ ID NO: 2653837 - RNA, 13 nt, Human
ggcugcagaggcc

SEQ ID NO: 2653838 - RNA, 16 nt, Human
ggcugcagaggccaga

SEQ ID NO: 2653839 - RNA, 18 nt, Human
ggcugcagaggccagagg

SEQ ID NO: 2653840 - RNA, 15 nt, Human
ggcugaggugggagg

SEQ ID NO: 2653841 - RNA, 13 nt, Human
ggcugagguggga

SEQ ID NO: 2653842 - RNA, 11 nt, Human
ggcugggccau

SEQ ID NO: 2653843 - RNA, 19 nt, Human
ggcuggaagauccugcggg

SEQ ID NO: 2653844 - RNA, 15 nt, Human
ggcuggaagauccug

SEQ ID NO: 2653845 - RNA, 22 nt, Human
ggcuggaagauccugcgggugg

SEQ ID NO: 2653846 - RNA, 13 nt, Human
ggcugcuuccucc

SEQ ID NO: 2653847 - RNA, 19 nt, Human
ggcugcuuccuccuggaaa

SEQ ID NO: 2653848 - RNA, 15 nt, Human
ggcugcuuccuccug

SEQ ID NO: 2653849 - RNA, 16 nt, Human
ggcugcuuccuccugg

SEQ ID NO: 2653850 - RNA, 17 nt, Human
ggcugcuuccuccugga

SEQ ID NO: 2653851 - RNA, 18 nt, Human
ggcugcuuccuccuggaa

SEQ ID NO: 2653852 - RNA, 14 nt, Human
ggcugcugugaagc

SEQ ID NO: 2653853 - RNA, 22 nt, Human
ggcugcugggggcaacuggcca

SEQ ID NO: 2653854 - RNA, 18 nt, Human
ggcugcugcccccacccc

SEQ ID NO: 2653855 - RNA, 15 nt, Human
ggcugcugcuacaau

SEQ ID NO: 2653856 - RNA, 10 nt, Human
ggcugcugcc

SEQ ID NO: 2653857 - RNA, 11 nt, Human
ggcugcugccc

SEQ ID NO: 2653858 - RNA, 13 nt, Human
ggcugcugccccc

SEQ ID NO: 2653859 - RNA, 17 nt, Human
ggcugcugcccccaccc

SEQ ID NO: 2653860 - RNA, 17 nt, Human
ggggcugaggugggagg

SEQ ID NO: 2653861 - RNA, 13 nt, Human
ggggcguccaggc

SEQ ID NO: 2653862 - RNA, 15 nt, Human
ggggcaacuguauga

SEQ ID NO: 2653863 - RNA, 13 nt, Human
ggggcacaggagg

SEQ ID NO: 2653864 - RNA, 14 nt, Human
ggggagggauucug

SEQ ID NO: 2653865 - RNA, 21 nt, Human
ggggaaaaucagccugcucca

SEQ ID NO: 2653866 - RNA, 14 nt, Human
ggggaggagggggc

SEQ ID NO: 2653867 - RNA, 15 nt, Human
gggcuuucuggggcc

SEQ ID NO: 2653868 - RNA, 15 nt, Human
ggggagggggauccg

SEQ ID NO: 2653869 - RNA, 15 nt, Human
ggggagggauucugg

SEQ ID NO: 2653870 - RNA, 19 nt, Human
ggggaaaaucagccugcuc

SEQ ID NO: 2653871 - RNA, 17 nt, Human
ggggaaaaucagccugc

SEQ ID NO: 2653872 - RNA, 16 nt, Human
ggggaaaaucagccug

SEQ ID NO: 2653873 - RNA, 17 nt, Human
gggcuuguaguucuuua

SEQ ID NO: 2653874 - RNA, 19 nt, Human
ggggcugaggugggaggau

SEQ ID NO: 2653875 - RNA, 19 nt, Human
ggggcguggagggaggccc

SEQ ID NO: 2653876 - RNA, 20 nt, Human
ggggugcuuuuauagaggcu

SEQ ID NO: 2653877 - RNA, 17 nt, Human
gggguggaggcuuccug

SEQ ID NO: 2653878 - RNA, 18 nt, Human
gggguggggguggaggcu

SEQ ID NO: 2653879 - RNA, 22 nt, Human
gggggagccgguaacuguccug

SEQ ID NO: 2653880 - RNA, 15 nt, Human
gggggacccagugca

SEQ ID NO: 2653881 - RNA, 16 nt, Human
ggggugcuuccuugua

SEQ ID NO: 2653882 - RNA, 14 nt, Human
ggggugcuuccuug

SEQ ID NO: 2653883 - RNA, 18 nt, Human
gggguguuaguggcaccg

SEQ ID NO: 2653884 - RNA, 19 nt, Human
gggguuuccuggcacugga

SEQ ID NO: 2653885 - RNA, 13 nt, Human
gggucucccuggc

SEQ ID NO: 2653886 - RNA, 14 nt, Human
gggucucccuggcu

SEQ ID NO: 2653887 - RNA, 16 nt, Human
gggucucccuggcucc

SEQ ID NO: 2653888 - RNA, 17 nt, Human
gggucucccuggcuccc

SEQ ID NO: 2653889 - RNA, 18 nt, Human
gggucucccuggcucccu

SEQ ID NO: 2653890 - RNA, 21 nt, Human
gggucucccuggcucccuccu

SEQ ID NO: 2653891 - RNA, 22 nt, Human
gggucucccuggcucccuccuc

SEQ ID NO: 2653892 - RNA, 17 nt, Human
ggguaaucccugcuuuu

SEQ ID NO: 2653893 - RNA, 18 nt, Human
ggguuagauguugccaug

SEQ ID NO: 2653894 - RNA, 18 nt, Human
gggugcugggaggaggga

SEQ ID NO: 2653895 - RNA, 16 nt, Human
ggguuaagaagacuuu

SEQ ID NO: 2653896 - RNA, 19 nt, Human
gggugacagagcaagugag

SEQ ID NO: 2653897 - RNA, 19 nt, Human
gggucuugauucagucaca

SEQ ID NO: 2653898 - RNA, 22 nt, Human
gggucuuugugguagcuuaucu

SEQ ID NO: 2653899 - RNA, 13 nt, Human
gggugcagcccaa

SEQ ID NO: 2653900 - RNA, 15 nt, Human
gggugcugggaggag

SEQ ID NO: 2653901 - RNA, 19 nt, Human
gggugaguccauucuccca

SEQ ID NO: 2653902 - RNA, 15 nt, Human
gguaccagcugcgcu

SEQ ID NO: 2653903 - RNA, 12 nt, Human
gguaccagcugc

SEQ ID NO: 2653904 - RNA, 14 nt, Human
gguaccagcugcgc

SEQ ID NO: 2653905 - RNA, 16 nt, Human
gguacuugucauuucg

SEQ ID NO: 2653906 - RNA, 14 nt, Human
gguauuuaaaguau

SEQ ID NO: 2653907 - RNA, 19 nt, Human
gguauuuaaaguauuuucu

SEQ ID NO: 2653908 - RNA, 17 nt, Human
ggucaggagaucgagac

SEQ ID NO: 2653909 - RNA, 13 nt, Human
ggucacuggaaag

SEQ ID NO: 2653910 - RNA, 15 nt, Human
ggucacuggaaaggg

SEQ ID NO: 2653911 - RNA, 18 nt, Human
ggucacuguuuccugggc

SEQ ID NO: 2653912 - RNA, 20 nt, Human
ggucacguuuggugcuucuc

SEQ ID NO: 2653913 - RNA, 15 nt, Human
ggucaccaugaaacu

SEQ ID NO: 2653914 - RNA, 14 nt, Human
ggucaccaugaaac

SEQ ID NO: 2653915 - RNA, 21 nt, Human
ggucacagcggagguguggag

SEQ ID NO: 2653916 - RNA, 16 nt, Human
gguauuuuuuccuuuu

SEQ ID NO: 2653917 - RNA, 15 nt, Human
ggugagaagcagagg

SEQ ID NO: 2653918 - RNA, 18 nt, Human
ggugagacccauggcugu

SEQ ID NO: 2653919 - RNA, 19 nt, Human
ggugccugagaggcaggca

SEQ ID NO: 2653920 - RNA, 17 nt, Human
gguggccagagguguca

SEQ ID NO: 2653921 - RNA, 16 nt, Human
gguggcggccccagca

SEQ ID NO: 2653922 - RNA, 13 nt, Human
gguggccacagcg

SEQ ID NO: 2653923 - RNA, 17 nt, Human
gguggccacagcgccag

SEQ ID NO: 2653924 - RNA, 21 nt, Human
ggugcugcagcaccgaggggc

SEQ ID NO: 2653925 - RNA, 13 nt, Human
ggucucacccaug

SEQ ID NO: 2653926 - RNA, 23 nt, Human
ggucucacccaugcaagcagagg

SEQ ID NO: 2653927 - RNA, 20 nt, Human
ggucucuucuuggggcccag

SEQ ID NO: 2653928 - RNA, 21 nt, Human
ggucucuucuuggggcccagu

SEQ ID NO: 2653929 - RNA, 19 nt, Human
ggucucggaucaggcuccc

SEQ ID NO: 2653930 - RNA, 22 nt, Human
gguggucuguuggcaggcuggc

SEQ ID NO: 2653931 - RNA, 16 nt, Human
gguggucuguuggcag

SEQ ID NO: 2653932 - RNA, 21 nt, Human
gguggucuguuggcaggcugg

SEQ ID NO: 2653933 - RNA, 19 nt, Human
gguggcucacgccuguaau

SEQ ID NO: 2653934 - RNA, 17 nt, Human
gguguagcccucccacu

SEQ ID NO: 2653935 - RNA, 20 nt, Human
gguguagcccucccacuuug

SEQ ID NO: 2653936 - RNA, 21 nt, Human
ggugguuauggagaggguguc

SEQ ID NO: 2653937 - RNA, 20 nt, Human
gguguccccgcugcugugca

SEQ ID NO: 2653938 - RNA, 21 nt, Human
ggugucacccaaaccggcagg

SEQ ID NO: 2653939 - RNA, 24 nt, Human
ggugucacccaaaccggcaggugc

SEQ ID NO: 2653940 - RNA, 21 nt, Human
gguuacccaguuagcucucaa

SEQ ID NO: 2653941 - RNA, 13 nt, Human
gguuauggagagg

SEQ ID NO: 2653942 - RNA, 15 nt, Human
gguuacuucuucucu

SEQ ID NO: 2653943 - RNA, 17 nt, Human
gguuacuucuucucuua

SEQ ID NO: 2653944 - RNA, 22 nt, Human
gguuagacagccaaaggcuggc

SEQ ID NO: 2653945 - RNA, 13 nt, Human
gguuagauguugc

SEQ ID NO: 2653946 - RNA, 18 nt, Human
gguuagauguugccaugu

SEQ ID NO: 2653947 - RNA, 11 nt, Human
gguuauguuuu

SEQ ID NO: 2653948 - RNA, 12 nt, Human
gguuauaauuuu

SEQ ID NO: 2653949 - RNA, 16 nt, Human
gguucaccauugagac

SEQ ID NO: 2653950 - RNA, 16 nt, Human
gguucaaggucacugu

SEQ ID NO: 2653951 - RNA, 18 nt, Human
gguucaaggucacuguuu

SEQ ID NO: 2653952 - RNA, 13 nt, Human
gguugagguuuca

SEQ ID NO: 2653953 - RNA, 23 nt, Human
uauccugugacugucucacuuaa

SEQ ID NO: 2653954 - RNA, 17 nt, Human
uauccugugacugucuc

SEQ ID NO: 2653955 - RNA, 16 nt, Human
uauccugugacugucu

SEQ ID NO: 2653956 - RNA, 14 nt, Human
uauccugugacugu

SEQ ID NO: 2653957 - RNA, 12 nt, Human
uaucauguaugg

SEQ ID NO: 2653958 - RNA, 13 nt, Human
uauccugugacug

SEQ ID NO: 2653959 - RNA, 22 nt, Human
uauccugggggacccaauguag

SEQ ID NO: 2653960 - RNA, 16 nt, Human
uauccuggaacaauau

SEQ ID NO: 2653961 - RNA, 21 nt, Human
uauccuggaacaauauuuuau

SEQ ID NO: 2653962 - RNA, 20 nt, Human
uaucaucuguggacugaccu

SEQ ID NO: 2653963 - RNA, 12 nt, Human
uaucguuuuugu

SEQ ID NO: 2653964 - RNA, 18 nt, Human
uaucguuuuuguauuuuc

SEQ ID NO: 2653965 - RNA, 20 nt, Human
uaucguuuuuguauuuucau

SEQ ID NO: 2653966 - RNA, 23 nt, Human
uaucgacuuguuuuugcacaugu

SEQ ID NO: 2653967 - RNA, 22 nt, Human
uauauuuuaaccugcauaaaaa

SEQ ID NO: 2653968 - RNA, 21 nt, Human
uaucaguugagcuucauauac

SEQ ID NO: 2653969 - RNA, 13 nt, Human
uauauguaugugu

SEQ ID NO: 2653970 - RNA, 18 nt, Human
uauaugagacuuuaugug

SEQ ID NO: 2653971 - RNA, 21 nt, Human
uauauuuauugacucuugagu

SEQ ID NO: 2653972 - RNA, 13 nt, Human
uauauuuauugac

SEQ ID NO: 2653973 - RNA, 12 nt, Human
uauauuuauuga

SEQ ID NO: 2653974 - RNA, 15 nt, Human
uauaugguauauaua

SEQ ID NO: 2653975 - RNA, 18 nt, Human
uauaugguauauauacau

SEQ ID NO: 2653976 - RNA, 22 nt, Human
uauaugguauauauacauauau

SEQ ID NO: 2653977 - RNA, 14 nt, Human
uauauguacuguuu

SEQ ID NO: 2653978 - RNA, 11 nt, Human
uauauuuccuu

SEQ ID NO: 2653979 - RNA, 13 nt, Human
uauauuuccuuua

SEQ ID NO: 2653980 - RNA, 14 nt, Human
uauauuuccuuuau

SEQ ID NO: 2653981 - RNA, 16 nt, Human
uauauuuccuuuaugu

SEQ ID NO: 2653982 - RNA, 17 nt, Human
uauauuuccuuuaugug

SEQ ID NO: 2653983 - RNA, 18 nt, Human
uauauuuccuuuauguga

SEQ ID NO: 2653984 - RNA, 19 nt, Human
uauauuuccuuuaugugaa

SEQ ID NO: 2653985 - RNA, 20 nt, Human
uauauuuccuuuaugugaau

SEQ ID NO: 2653986 - RNA, 22 nt, Human
uauauuuccuuuaugugaauuu

SEQ ID NO: 2653987 - RNA, 13 nt, Human
uauauuucuaaau

SEQ ID NO: 2653988 - RNA, 16 nt, Human
uauauuucuaaauguu

SEQ ID NO: 2653989 - RNA, 13 nt, Human
uauauuucuauua

SEQ ID NO: 2653990 - RNA, 16 nt, Human
uauaugaauaaagugu

SEQ ID NO: 2653991 - RNA, 16 nt, Human
uauauacaaaaagaaa

SEQ ID NO: 2653992 - RNA, 18 nt, Human
uauauacaaaaagaaaau

SEQ ID NO: 2653993 - RNA, 21 nt, Human
uauaauuccuauauccuguga

SEQ ID NO: 2653994 - RNA, 22 nt, Human
uauaauuccuauauccugugac

SEQ ID NO: 2653995 - RNA, 16 nt, Human
uaguuuggcauuugca

SEQ ID NO: 2653996 - RNA, 13 nt, Human
uaguuugugagaa

SEQ ID NO: 2653997 - RNA, 14 nt, Human
uaguuugugagaaa

SEQ ID NO: 2653998 - RNA, 15 nt, Human
uaguuugugagaaac

SEQ ID NO: 2653999 - RNA, 19 nt, Human
uaguuuguguguugucucu

SEQ ID NO: 2654000 - RNA, 14 nt, Human
uauaaauauacagu

SEQ ID NO: 2654001 - RNA, 15 nt, Human
uauaaauauacagua

SEQ ID NO: 2654002 - RNA, 15 nt, Human
uauaaauaucauugu

SEQ ID NO: 2654003 - RNA, 14 nt, Human
uauaaauccaguga

SEQ ID NO: 2654004 - RNA, 13 nt, Human
uauaaugaauaaa

SEQ ID NO: 2654005 - RNA, 15 nt, Human
uauaaugaauaaauc

SEQ ID NO: 2654006 - RNA, 16 nt, Human
uauaaugaauaaauca

SEQ ID NO: 2654007 - RNA, 22 nt, Human
uauaaauuuuuaagagaaagaa

SEQ ID NO: 2654008 - RNA, 22 nt, Human
uagugcuccauaguuuggcauu

SEQ ID NO: 2654009 - RNA, 23 nt, Human
uagucaacaguacccugguugug

SEQ ID NO: 2654010 - RNA, 18 nt, Human
uagucaauggcuuguuca

SEQ ID NO: 2654011 - RNA, 15 nt, Human
uagucaauaagaaaa

SEQ ID NO: 2654012 - RNA, 15 nt, Human
uaggcgaccaccgcc

SEQ ID NO: 2654013 - RNA, 17 nt, Human
uaguuuauuuuaaaaca

SEQ ID NO: 2654014 - RNA, 14 nt, Human
uagugucacugcuu

SEQ ID NO: 2654015 - RNA, 14 nt, Human
uaguuucugugguu

SEQ ID NO: 2654016 - RNA, 13 nt, Human
uaguugcuauuuu

SEQ ID NO: 2654017 - RNA, 19 nt, Human
uaguugcuauuuuuguaaa

SEQ ID NO: 2654018 - RNA, 18 nt, Human
uaguuguaaaccaaguga

SEQ ID NO: 2654019 - RNA, 23 nt, Human
uaguguaacuugcuuaaauuucu

SEQ ID NO: 2654020 - RNA, 18 nt, Human
uaguguacauuucuauaa

SEQ ID NO: 2654021 - RNA, 21 nt, Human
uaguguacauuucuauaaaua

SEQ ID NO: 2654022 - RNA, 23 nt, Human
uaguguacauuucuauaaauaga

SEQ ID NO: 2654023 - RNA, 20 nt, Human
uagcuccuguggccccaccc

SEQ ID NO: 2654024 - RNA, 22 nt, Human
uagcuccuguggccccacccug

SEQ ID NO: 2654025 - RNA, 12 nt, Human
uagcuccugugg

SEQ ID NO: 2654026 - RNA, 13 nt, Human
uagcuccuguggc

SEQ ID NO: 2654027 - RNA, 14 nt, Human
uagcuccuguggcc

SEQ ID NO: 2654028 - RNA, 16 nt, Human
uagcuccuguggcccc

SEQ ID NO: 2654029 - RNA, 21 nt, Human
uagcuccccgcuucugccugc

SEQ ID NO: 2654030 - RNA, 16 nt, Human
uagcuccuccccuucc

SEQ ID NO: 2654031 - RNA, 19 nt, Human
uagcuccuccccuuccucu

SEQ ID NO: 2654032 - RNA, 17 nt, Human
uagccugccucuucucu

SEQ ID NO: 2654033 - RNA, 14 nt, Human
uagcccaaaaccaa

SEQ ID NO: 2654034 - RNA, 17 nt, Human
uagcagugagucauauc

SEQ ID NO: 2654035 - RNA, 13 nt, Human
uagccugaugaga

SEQ ID NO: 2654036 - RNA, 13 nt, Human
uagcccucccacu

SEQ ID NO: 2654037 - RNA, 16 nt, Human
uagcccucccacuuug

SEQ ID NO: 2654038 - RNA, 17 nt, Human
uagcccucccacuuugc

SEQ ID NO: 2654039 - RNA, 20 nt, Human
uaggaagucaauauguggaa

SEQ ID NO: 2654040 - RNA, 12 nt, Human
uaggaauaaaua

SEQ ID NO: 2654041 - RNA, 23 nt, Human
uaggaagaacguuuuuuccucag

SEQ ID NO: 2654042 - RNA, 16 nt, Human
uaggaacauaugaaaa

SEQ ID NO: 2654043 - RNA, 22 nt, Human
uagaguacacugccugccuuaa

SEQ ID NO: 2654044 - RNA, 21 nt, Human
uagaguacacugccugccuua

SEQ ID NO: 2654045 - RNA, 17 nt, Human
uagaguacacugccugc

SEQ ID NO: 2654046 - RNA, 13 nt, Human
uagaguacacugc

SEQ ID NO: 2654047 - RNA, 12 nt, Human
uagaguaaugaa

SEQ ID NO: 2654048 - RNA, 14 nt, Human
uagaguaaugaaau

SEQ ID NO: 2654049 - RNA, 15 nt, Human
uagaguaaugaaaug

SEQ ID NO: 2654050 - RNA, 17 nt, Human
uagaguaaugaaaugga

SEQ ID NO: 2654051 - RNA, 21 nt, Human
uagagaggacaauacuggggu

SEQ ID NO: 2654052 - RNA, 22 nt, Human
uagagaggacaauacugggguu

SEQ ID NO: 2654053 - RNA, 15 nt, Human
uagaaccacuaugaa

SEQ ID NO: 2654054 - RNA, 16 nt, Human
uagaaccacuaugaag

SEQ ID NO: 2654055 - RNA, 12 nt, Human
uagacccugggu

SEQ ID NO: 2654056 - RNA, 16 nt, Human
uagacccugggugggc

SEQ ID NO: 2654057 - RNA, 20 nt, Human
uagacccugggugggcucug

SEQ ID NO: 2654058 - RNA, 23 nt, Human
uagacuugaaaagagacaggcag

SEQ ID NO: 2654059 - RNA, 20 nt, Human
uagacuugaaaagagacagg

SEQ ID NO: 2654060 - RNA, 19 nt, Human
uagacuugaaaagagacag

SEQ ID NO: 2654061 - RNA, 18 nt, Human
uagacuugaaaagagaca

SEQ ID NO: 2654062 - RNA, 14 nt, Human
uagacuugaaaaga

SEQ ID NO: 2654063 - RNA, 13 nt, Human
uagacuugaaaag

SEQ ID NO: 2654064 - RNA, 19 nt, Human
uagaugguuugagccugag

SEQ ID NO: 2654065 - RNA, 13 nt, Human
uagauaauauugu

SEQ ID NO: 2654066 - RNA, 15 nt, Human
uagauaauauuguuu

SEQ ID NO: 2654067 - RNA, 14 nt, Human
uagcagcaccuccu

SEQ ID NO: 2654068 - RNA, 16 nt, Human
uagcagccaguucaaa

SEQ ID NO: 2654069 - RNA, 18 nt, Human
uagcagccaguucaaaaa

SEQ ID NO: 2654070 - RNA, 14 nt, Human
uagcagcccacccu

SEQ ID NO: 2654071 - RNA, 15 nt, Human
uagcagcccacccug

SEQ ID NO: 2654072 - RNA, 16 nt, Human
uagcagcccacccugc

SEQ ID NO: 2654073 - RNA, 17 nt, Human
uagcagcccacccugcu

SEQ ID NO: 2654074 - RNA, 21 nt, Human
uagcagcccacccugcugcug

SEQ ID NO: 2654075 - RNA, 14 nt, Human
uagauguugccaug

SEQ ID NO: 2654076 - RNA, 15 nt, Human
uagauguugccaugu

SEQ ID NO: 2654077 - RNA, 22 nt, Human
uagauugacuaacucaaauaca

SEQ ID NO: 2654078 - RNA, 16 nt, Human
uagcacuuugggaggc

SEQ ID NO: 2654079 - RNA, 15 nt, Human
uacuuuacugccuga

SEQ ID NO: 2654080 - RNA, 11 nt, Human
uagaaagcuau

SEQ ID NO: 2654081 - RNA, 13 nt, Human
uagaaauuuucaa

SEQ ID NO: 2654082 - RNA, 13 nt, Human
uagaaauuuugua

SEQ ID NO: 2654083 - RNA, 14 nt, Human
uagaaauuuuguaa

SEQ ID NO: 2654084 - RNA, 15 nt, Human
uagaaauuuuguaag

SEQ ID NO: 2654085 - RNA, 16 nt, Human
uagaaauuuuguaaga

SEQ ID NO: 2654086 - RNA, 17 nt, Human
uagaaauuuuguaagaa

SEQ ID NO: 2654087 - RNA, 18 nt, Human
uagaaauuuuguaagaag

SEQ ID NO: 2654088 - RNA, 22 nt, Human
uagaaauuuuguaagaaggcaa

SEQ ID NO: 2654089 - RNA, 16 nt, Human
uagaacacuaacucac

SEQ ID NO: 2654090 - RNA, 13 nt, Human
uagaacagguuuu

SEQ ID NO: 2654091 - RNA, 14 nt, Human
uagaacagguuuuu

SEQ ID NO: 2654092 - RNA, 12 nt, Human
uagaacagguuu

SEQ ID NO: 2654093 - RNA, 19 nt, Human
uagaaaugaugauguggaa

SEQ ID NO: 2654094 - RNA, 16 nt, Human
uagaaauggaaauuuu

SEQ ID NO: 2654095 - RNA, 17 nt, Human
uagaaauggaaauuuug

SEQ ID NO: 2654096 - RNA, 21 nt, Human
uagaaauggaaauuuugcuau

SEQ ID NO: 2654097 - RNA, 16 nt, Human
uagaaauguagguccu

SEQ ID NO: 2654098 - RNA, 20 nt, Human
uagaaauguagguccucaga

SEQ ID NO: 2654099 - RNA, 19 nt, Human
uacuugcuuuaccuuuuca

SEQ ID NO: 2654100 - RNA, 23 nt, Human
uacuugcuuuaccuuuucagggc

SEQ ID NO: 2654101 - RNA, 12 nt, Human
uacuugggaggc

SEQ ID NO: 2654102 - RNA, 18 nt, Human
uacuugggaggcugaggc

SEQ ID NO: 2654103 - RNA, 18 nt, Human
uacuuaccuagugaaacu

SEQ ID NO: 2654104 - RNA, 19 nt, Human
uacuuaccuagugaaacuu

SEQ ID NO: 2654105 - RNA, 15 nt, Human
uacuuaauccaaugg

SEQ ID NO: 2654106 - RNA, 13 nt, Human
uacuguguaaacu

SEQ ID NO: 2654107 - RNA, 15 nt, Human
uacuguguaaacuca

SEQ ID NO: 2654108 - RNA, 16 nt, Human
uacuguguaaacucau

SEQ ID NO: 2654109 - RNA, 23 nt, Human
uacuguguaaacucaucugaaau

SEQ ID NO: 2654110 - RNA, 16 nt, Human
uacuguuguaagaauu

SEQ ID NO: 2654111 - RNA, 17 nt, Human
uacuguuguaagaauuc

SEQ ID NO: 2654112 - RNA, 22 nt, Human
uacuguuguaagaauucugauu

SEQ ID NO: 2654113 - RNA, 19 nt, Human
uacugugucucauggauuu

SEQ ID NO: 2654114 - RNA, 23 nt, Human
uacuguugcacaauuuugauaaa

SEQ ID NO: 2654115 - RNA, 14 nt, Human
uacugucaaaugau

SEQ ID NO: 2654116 - RNA, 15 nt, Human
uacugucaaaugaug

SEQ ID NO: 2654117 - RNA, 16 nt, Human
uacugucaaaugaugu

SEQ ID NO: 2654118 - RNA, 17 nt, Human
uacugucaaaugaugug

SEQ ID NO: 2654119 - RNA, 20 nt, Human
uacugucaaaugaugugcaa

SEQ ID NO: 2654120 - RNA, 17 nt, Human
uacgaaguucaagauca

SEQ ID NO: 2654121 - RNA, 16 nt, Human
uacgaaguucaagauc

SEQ ID NO: 2654122 - RNA, 21 nt, Human
uacgacacggguggggaaagg

SEQ ID NO: 2654123 - RNA, 18 nt, Human
uacgaaguucaagaucaa

SEQ ID NO: 2654124 - RNA, 19 nt, Human
uacuaauaaucuuguuucu

SEQ ID NO: 2654125 - RNA, 14 nt, Human
uaccuuucaaagcu

SEQ ID NO: 2654126 - RNA, 15 nt, Human
uaccuuucaaagcuu

SEQ ID NO: 2654127 - RNA, 18 nt, Human
uaccuuucucucucuaag

SEQ ID NO: 2654128 - RNA, 15 nt, Human
uacccauagacauga

SEQ ID NO: 2654129 - RNA, 16 nt, Human
uacccauagacaugaa

SEQ ID NO: 2654130 - RNA, 17 nt, Human
uacccauagacaugaaa

SEQ ID NO: 2654131 - RNA, 18 nt, Human
uacccauagacaugaaag

SEQ ID NO: 2654132 - RNA, 14 nt, Human
uacugauggaauuu

SEQ ID NO: 2654133 - RNA, 23 nt, Human
uacucaggcugguggagaacucu

SEQ ID NO: 2654134 - RNA, 12 nt, Human
uacccaccuaga

SEQ ID NO: 2654135 - RNA, 15 nt, Human
uacccaccuagaaca

SEQ ID NO: 2654136 - RNA, 22 nt, Human
uacccaccuagaacacuaacuc

SEQ ID NO: 2654137 - RNA, 17 nt, Human
uaccacaucaaauaaga

SEQ ID NO: 2654138 - RNA, 18 nt, Human
uaccauuuaguaagaaua

SEQ ID NO: 2654139 - RNA, 19 nt, Human
uaccauuuaguaagaauac

SEQ ID NO: 2654140 - RNA, 14 nt, Human
uaccaagugaaauu

SEQ ID NO: 2654141 - RNA, 18 nt, Human
uaccaaggucuucuuaau

SEQ ID NO: 2654142 - RNA, 20 nt, Human
uaccaaguauagccuauggc

SEQ ID NO: 2654143 - RNA, 21 nt, Human
uacauuugaugcaugucuuuu

SEQ ID NO: 2654144 - RNA, 19 nt, Human
uacauuugggaguuuuuau

SEQ ID NO: 2654145 - RNA, 21 nt, Human
uacauuugggaguuuuuauga

SEQ ID NO: 2654146 - RNA, 20 nt, Human
uacaugaagaauagaaacaa

SEQ ID NO: 2654147 - RNA, 21 nt, Human
uacaugaagaauagaaacaag

SEQ ID NO: 2654148 - RNA, 18 nt, Human
uacaugaagcuucaugca

SEQ ID NO: 2654149 - RNA, 19 nt, Human
uacaugaggaacuguagau

SEQ ID NO: 2654150 - RNA, 20 nt, Human
uacaugaggaacuguagaug

SEQ ID NO: 2654151 - RNA, 23 nt, Human
uacaugaggaacuguagaugaug

SEQ ID NO: 2654152 - RNA, 11 nt, Human
uacagaacuac

SEQ ID NO: 2654153 - RNA, 15 nt, Human
uacagaaaaagacuu

SEQ ID NO: 2654154 - RNA, 13 nt, Human
uacacuuuguugc

SEQ ID NO: 2654155 - RNA, 14 nt, Human
uacacuuuguugca

SEQ ID NO: 2654156 - RNA, 15 nt, Human
uacacuuuguugcaa

SEQ ID NO: 2654157 - RNA, 18 nt, Human
uacacuuuguugcaagau

SEQ ID NO: 2654158 - RNA, 22 nt, Human
uacacuuuguugcaagauguga

SEQ ID NO: 2654159 - RNA, 19 nt, Human
uacagcuuugaucccugac

SEQ ID NO: 2654160 - RNA, 21 nt, Human
uacagugguuuuauacugaag

SEQ ID NO: 2654161 - RNA, 22 nt, Human
uacagugguuuuauacugaagg

SEQ ID NO: 2654162 - RNA, 19 nt, Human
uacagccagaccagauuaa

SEQ ID NO: 2654163 - RNA, 18 nt, Human
uacagcuuucaugauuag

SEQ ID NO: 2654164 - RNA, 22 nt, Human
uacagccgagacucgacucugu

SEQ ID NO: 2654165 - RNA, 24 nt, Human
uacacuggcaaugguaguuucugu

SEQ ID NO: 2654166 - RNA, 23 nt, Human
uacacuggcaaugguaguuucug

SEQ ID NO: 2654167 - RNA, 18 nt, Human
uacacuggcaaugguagu

SEQ ID NO: 2654168 - RNA, 22 nt, Human
uacacuggcaaugguaguuucu

SEQ ID NO: 2654169 - RNA, 20 nt, Human
uacacuggcaaugguaguuu

SEQ ID NO: 2654170 - RNA, 21 nt, Human
uacacugccugccuuaaguga

SEQ ID NO: 2654171 - RNA, 18 nt, Human
uacacugccugccuuaag

SEQ ID NO: 2654172 - RNA, 11 nt, Human
uacacagaaac

SEQ ID NO: 2654173 - RNA, 13 nt, Human
uacacagaaacac

SEQ ID NO: 2654174 - RNA, 14 nt, Human
uacacagaaacacu

SEQ ID NO: 2654175 - RNA, 15 nt, Human
uacacagaaacacug

SEQ ID NO: 2654176 - RNA, 17 nt, Human
uacacugccugccuuaa

SEQ ID NO: 2654177 - RNA, 18 nt, Human
uacacagaaacacugccu

SEQ ID NO: 2654178 - RNA, 23 nt, Human
uaauccuuuguuuucugacuaau

SEQ ID NO: 2654179 - RNA, 20 nt, Human
uaauccuuuguuuucugacu

SEQ ID NO: 2654180 - RNA, 18 nt, Human
uaauccuuuguuuucuga

SEQ ID NO: 2654181 - RNA, 16 nt, Human
uaauccuuuguuuucu

SEQ ID NO: 2654182 - RNA, 14 nt, Human
uaauccuuuggaaa

SEQ ID NO: 2654183 - RNA, 22 nt, Human
uaauccuuuguuuucugacuaa

SEQ ID NO: 2654184 - RNA, 17 nt, Human
uaaucgggguauaauag

SEQ ID NO: 2654185 - RNA, 22 nt, Human
uaauccuuaaaucuuaauguuc

SEQ ID NO: 2654186 - RNA, 18 nt, Human
uaauauauaugaauaaag

SEQ ID NO: 2654187 - RNA, 16 nt, Human
uaauauauaugaauaa

SEQ ID NO: 2654188 - RNA, 14 nt, Human
uaauauauaugaau

SEQ ID NO: 2654189 - RNA, 16 nt, Human
uaauauagcugagacu

SEQ ID NO: 2654190 - RNA, 20 nt, Human
uaauauauguauuauuuaua

SEQ ID NO: 2654191 - RNA, 13 nt, Human
uaauauauuuucu

SEQ ID NO: 2654192 - RNA, 20 nt, Human
uaauauguucuuuuaaauga

SEQ ID NO: 2654193 - RNA, 17 nt, Human
uaauauauuuucuguuu

SEQ ID NO: 2654194 - RNA, 21 nt, Human
uaauauauuuucuguuuucuu

SEQ ID NO: 2654195 - RNA, 12 nt, Human
uaaugcacuuuc

SEQ ID NO: 2654196 - RNA, 13 nt, Human
uaaugcacuuucu

SEQ ID NO: 2654197 - RNA, 14 nt, Human
uaaugcacuuucua

SEQ ID NO: 2654198 - RNA, 22 nt, Human
uaaugaugacaaaaaauguuuu

SEQ ID NO: 2654199 - RNA, 22 nt, Human
uaaucuuauaauuguucucaga

SEQ ID NO: 2654200 - RNA, 16 nt, Human
uaaucuucaaagccuu

SEQ ID NO: 2654201 - RNA, 17 nt, Human
uaaucuucaaagccuuc

SEQ ID NO: 2654202 - RNA, 18 nt, Human
uaaucuguuuauuuacaa

SEQ ID NO: 2654203 - RNA, 17 nt, Human
uaaucuuaaucuguuua

SEQ ID NO: 2654204 - RNA, 15 nt, Human
uaaucuuauaauugu

SEQ ID NO: 2654205 - RNA, 18 nt, Human
uaaucuuauaauuguucu

SEQ ID NO: 2654206 - RNA, 14 nt, Human
uaaucucuaggaag

SEQ ID NO: 2654207 - RNA, 17 nt, Human
uaaucucuaggaaguca

SEQ ID NO: 2654208 - RNA, 14 nt, Human
uaauaauaauguuu

SEQ ID NO: 2654209 - RNA, 13 nt, Human
uaauacaagguau

SEQ ID NO: 2654210 - RNA, 14 nt, Human
uaauacaagguaua

SEQ ID NO: 2654211 - RNA, 19 nt, Human
uaauacaagguauaauaaa

SEQ ID NO: 2654212 - RNA, 20 nt, Human
uaauacaagguauaauaaaa

SEQ ID NO: 2654213 - RNA, 21 nt, Human
uaauacaagguauaauaaaau

SEQ ID NO: 2654214 - RNA, 22 nt, Human
uaauacaagguauaauaaaauu

SEQ ID NO: 2654215 - RNA, 12 nt, Human
uaauauaaaaaa

SEQ ID NO: 2654216 - RNA, 15 nt, Human
uaauauaaaaaauuu

SEQ ID NO: 2654217 - RNA, 21 nt, Human
uaauauaaaguaguccuguga

SEQ ID NO: 2654218 - RNA, 15 nt, Human
uaagugggcccaccc

SEQ ID NO: 2654219 - RNA, 18 nt, Human
uaagugggcccacccggu

SEQ ID NO: 2654220 - RNA, 17 nt, Human
uaauaaacuuuaauaua

SEQ ID NO: 2654221 - RNA, 16 nt, Human
uaaggccugugggggg

SEQ ID NO: 2654222 - RNA, 14 nt, Human
uaauaaaugcccuc

SEQ ID NO: 2654223 - RNA, 18 nt, Human
uaauaaaugcccucuucu

SEQ ID NO: 2654224 - RNA, 12 nt, Human
uaauuuuaaagu

SEQ ID NO: 2654225 - RNA, 14 nt, Human
uaauuuuaaagugc

SEQ ID NO: 2654226 - RNA, 21 nt, Human
uaauuuuacauguuuauaaau

SEQ ID NO: 2654227 - RNA, 22 nt, Human
uaauuuuacauguuuauaaauc

SEQ ID NO: 2654228 - RNA, 16 nt, Human
uaauuguucucagaau

SEQ ID NO: 2654229 - RNA, 17 nt, Human
uaauuguucucagaauc

SEQ ID NO: 2654230 - RNA, 22 nt, Human
uaauuguaaaguaaaagcuaua

SEQ ID NO: 2654231 - RNA, 15 nt, Human
uaauuguacaaaauu

SEQ ID NO: 2654232 - RNA, 17 nt, Human
uaauuguacaaaauuaa

SEQ ID NO: 2654233 - RNA, 22 nt, Human
uaauuguacaaaauuaagcaaa

SEQ ID NO: 2654234 - RNA, 23 nt, Human
uaauuguacaaaauuaagcaaau

SEQ ID NO: 2654235 - RNA, 21 nt, Human
uaauugugaaaaaguuaaaca

SEQ ID NO: 2654236 - RNA, 15 nt, Human
uaauuguauuuuugu

SEQ ID NO: 2654237 - RNA, 12 nt, Human
uaauuguauuuu

SEQ ID NO: 2654238 - RNA, 22 nt, Human
uaauugugugaacuuggaagca

SEQ ID NO: 2654239 - RNA, 21 nt, Human
uaauugugugaacuuggaagc

SEQ ID NO: 2654240 - RNA, 20 nt, Human
uaauugugugaacuuggaag

SEQ ID NO: 2654241 - RNA, 19 nt, Human
uaauugugugaacuuggaa

SEQ ID NO: 2654242 - RNA, 12 nt, Human
uaauugugugaa

SEQ ID NO: 2654243 - RNA, 23 nt, Human
uaauugguacuuuuaaaaacaua

SEQ ID NO: 2654244 - RNA, 21 nt, Human
uaauugcaaaaacauagaaau

SEQ ID NO: 2654245 - RNA, 22 nt, Human
uaauugaugcaaauaacacaaa

SEQ ID NO: 2654246 - RNA, 14 nt, Human
uaauugcugugugu

SEQ ID NO: 2654247 - RNA, 22 nt, Human
uaauugcugugugucccaggca

SEQ ID NO: 2654248 - RNA, 19 nt, Human
uaaugccauuuuaaggaaa

SEQ ID NO: 2654249 - RNA, 20 nt, Human
uaaugccauuuuaaggaaaa

SEQ ID NO: 2654250 - RNA, 21 nt, Human
uaauucuuuuuuauuaaucac

SEQ ID NO: 2654251 - RNA, 20 nt, Human
uaauucuuuuuuauuaauca

SEQ ID NO: 2654252 - RNA, 19 nt, Human
uaauucuuuuuuauuaauc

SEQ ID NO: 2654253 - RNA, 18 nt, Human
uaauucuuuuuuauuaau

SEQ ID NO: 2654254 - RNA, 17 nt, Human
uaauucuuuuuuauuaa

SEQ ID NO: 2654255 - RNA, 16 nt, Human
uaauucuuuuuuauua

SEQ ID NO: 2654256 - RNA, 15 nt, Human
uaauucuuuuuuauu

SEQ ID NO: 2654257 - RNA, 22 nt, Human
uaauugaaguguauaauauaaa

SEQ ID NO: 2654258 - RNA, 16 nt, Human
uaauuacugccuugaa

SEQ ID NO: 2654259 - RNA, 17 nt, Human
uaauuacugccuugaaa

SEQ ID NO: 2654260 - RNA, 22 nt, Human
uaauuacuuauuguauuuaugu

SEQ ID NO: 2654261 - RNA, 14 nt, Human
uaacauuauuuaua

SEQ ID NO: 2654262 - RNA, 12 nt, Human
uaacauuauuua

SEQ ID NO: 2654263 - RNA, 16 nt, Human
uaacauuauuuauaug

SEQ ID NO: 2654264 - RNA, 15 nt, Human
uaacauuauuuauau

SEQ ID NO: 2654265 - RNA, 20 nt, Human
uaacccuuugguuuuuuucu

SEQ ID NO: 2654266 - RNA, 12 nt, Human
uaacucauuugu

SEQ ID NO: 2654267 - RNA, 20 nt, Human
uaacucauuuguuaaaauua

SEQ ID NO: 2654268 - RNA, 22 nt, Human
uaaccuaaucaccauguaagca

SEQ ID NO: 2654269 - RNA, 12 nt, Human
uaacuguaaauc

SEQ ID NO: 2654270 - RNA, 13 nt, Human
uaacuguaaauca

SEQ ID NO: 2654271 - RNA, 14 nt, Human
uaacuguaaaucau

SEQ ID NO: 2654272 - RNA, 14 nt, Human
uaacuguauuugaa

SEQ ID NO: 2654273 - RNA, 11 nt, Human
uaacuguccug

SEQ ID NO: 2654274 - RNA, 12 nt, Human
uaacuguccugu

SEQ ID NO: 2654275 - RNA, 14 nt, Human
uaacuguccugucc

SEQ ID NO: 2654276 - RNA, 15 nt, Human
uaacuguccuguccu

SEQ ID NO: 2654277 - RNA, 17 nt, Human
uaacuguccuguccugc

SEQ ID NO: 2654278 - RNA, 12 nt, Human
uaacuguauuug

SEQ ID NO: 2654279 - RNA, 22 nt, Human
uaacuguauuugaaauaagaau

SEQ ID NO: 2654280 - RNA, 21 nt, Human
uaacugucaggcugaaaacaa

SEQ ID NO: 2654281 - RNA, 22 nt, Human
uaacugucaggcugaaaacaau

SEQ ID NO: 2654282 - RNA, 21 nt, Human
uaacugauuugcaauaaaaau

SEQ ID NO: 2654283 - RNA, 16 nt, Human
uaacugcauuuuuaga

SEQ ID NO: 2654284 - RNA, 18 nt, Human
uaacacaaaugcucaaag

SEQ ID NO: 2654285 - RNA, 13 nt, Human
uaacagaaauugu

SEQ ID NO: 2654286 - RNA, 14 nt, Human
uaacagaaauugua

SEQ ID NO: 2654287 - RNA, 15 nt, Human
uaacagaaauuguau

SEQ ID NO: 2654288 - RNA, 17 nt, Human
uaacagaaauuguauau

SEQ ID NO: 2654289 - RNA, 22 nt, Human
uaacagaaauuguauauuguaa

SEQ ID NO: 2654290 - RNA, 12 nt, Human
uaacagcugcaa

SEQ ID NO: 2654291 - RNA, 12 nt, Human
uaaauugcauca

SEQ ID NO: 2654292 - RNA, 16 nt, Human
uaaauugcaucacugu

SEQ ID NO: 2654293 - RNA, 18 nt, Human
uaaauugcaucacuguau

SEQ ID NO: 2654294 - RNA, 19 nt, Human
uaaauugcaucacuguauc

SEQ ID NO: 2654295 - RNA, 17 nt, Human
uaaaucauucuuacuaa

SEQ ID NO: 2654296 - RNA, 21 nt, Human
uaaauccaucacuauaauaaa

SEQ ID NO: 2654297 - RNA, 14 nt, Human
uaaauuuaauacca

SEQ ID NO: 2654298 - RNA, 17 nt, Human
uaaauuuaauaccagau

SEQ ID NO: 2654299 - RNA, 22 nt, Human
uaagaaagugaagcaaaucaga

SEQ ID NO: 2654300 - RNA, 18 nt, Human
uaagaaagugaagcaaau

SEQ ID NO: 2654301 - RNA, 15 nt, Human
uaagaaagugaagca

SEQ ID NO: 2654302 - RNA, 17 nt, Human
uaagaagaaguucaugu

SEQ ID NO: 2654303 - RNA, 22 nt, Human
uaagaagaaguucauguccaaa

SEQ ID NO: 2654304 - RNA, 15 nt, Human
uaagaacgaggauuu

SEQ ID NO: 2654305 - RNA, 20 nt, Human
uaagaucacuguuuagauuu

SEQ ID NO: 2654306 - RNA, 18 nt, Human
uaagaucacuguuuagau

SEQ ID NO: 2654307 - RNA, 21 nt, Human
uaagaucacuguuuagauuug

SEQ ID NO: 2654308 - RNA, 12 nt, Human
uaagaucacugu

SEQ ID NO: 2654309 - RNA, 17 nt, Human
uaagauaucucaaugaa

SEQ ID NO: 2654310 - RNA, 17 nt, Human
uaagaucacuguuuaga

SEQ ID NO: 2654311 - RNA, 15 nt, Human
uaagaucacuguuua

SEQ ID NO: 2654312 - RNA, 14 nt, Human
uaagaucacuguuu

SEQ ID NO: 2654313 - RNA, 13 nt, Human
uaagaucacuguu

SEQ ID NO: 2654314 - RNA, 15 nt, Human
uaagauaguguaacu

SEQ ID NO: 2654315 - RNA, 16 nt, Human
uaagauaguguaacuu

SEQ ID NO: 2654316 - RNA, 20 nt, Human
uaagauaguguaacuugcuu

SEQ ID NO: 2654317 - RNA, 21 nt, Human
uaagccaaaauuaagguguuu

SEQ ID NO: 2654318 - RNA, 19 nt, Human
uaagccaaaauuaaggugu

SEQ ID NO: 2654319 - RNA, 17 nt, Human
uaagccaaaauuaaggu

SEQ ID NO: 2654320 - RNA, 14 nt, Human
uaagccuucaaaac

SEQ ID NO: 2654321 - RNA, 21 nt, Human
uaaggcagauuuuacagagcg

SEQ ID NO: 2654322 - RNA, 17 nt, Human
guuucgaagucauuaaa

SEQ ID NO: 2654323 - RNA, 19 nt, Human
guuuccuggcacuggaccc

SEQ ID NO: 2654324 - RNA, 15 nt, Human
guuucguggggaggu

SEQ ID NO: 2654325 - RNA, 23 nt, Human
guuucguggggaggucuaaucua

SEQ ID NO: 2654326 - RNA, 15 nt, Human
guuucguuauauuaa

SEQ ID NO: 2654327 - RNA, 15 nt, Human
guuugagauucucaa

SEQ ID NO: 2654328 - RNA, 20 nt, Human
guuucuuuauuuuguguaaa

SEQ ID NO: 2654329 - RNA, 22 nt, Human
guuugaggauuaguuuagaaca

SEQ ID NO: 2654330 - RNA, 18 nt, Human
guuugagcugccuucccu

SEQ ID NO: 2654331 - RNA, 13 nt, Human
guuugagcugccu

SEQ ID NO: 2654332 - RNA, 14 nt, Human
guuugagcugccuu

SEQ ID NO: 2654333 - RNA, 15 nt, Human
guuugagcugccuuc

SEQ ID NO: 2654334 - RNA, 20 nt, Human
guuugucuuggauauauagg

SEQ ID NO: 2654335 - RNA, 22 nt, Human
guuuagauuugccauagaguac

SEQ ID NO: 2654336 - RNA, 12 nt, Human
guuuagauuugc

SEQ ID NO: 2654337 - RNA, 19 nt, Human
gguuggcugggaaaucgag

SEQ ID NO: 2654338 - RNA, 20 nt, Human
guuuccagacuuccuugaga

SEQ ID NO: 2654339 - RNA, 14 nt, Human
guuuccagggaggg

SEQ ID NO: 2654340 - RNA, 19 nt, Human
guuuccagacuuccuugag

SEQ ID NO: 2654341 - RNA, 18 nt, Human
guuucagcgacuccguug

SEQ ID NO: 2654342 - RNA, 17 nt, Human
guuuccuggcacuggac

SEQ ID NO: 2654343 - RNA, 15 nt, Human
guuuccugacauugu

SEQ ID NO: 2654344 - RNA, 17 nt, Human
guuuccugacauugucu

SEQ ID NO: 2654345 - RNA, 12 nt, Human
uaaaaaaaccac

SEQ ID NO: 2654346 - RNA, 22 nt, Human
uaaaaaaaccaccaaaaacaaa

SEQ ID NO: 2654347 - RNA, 20 nt, Human
uaaaaaaauaauaauaaugu

SEQ ID NO: 2654348 - RNA, 14 nt, Human
uaaaaaaaaaguca

SEQ ID NO: 2654349 - RNA, 15 nt, Human
uaaaaaaaaagucag

SEQ ID NO: 2654350 - RNA, 19 nt, Human
uaaaaaaaaagucagagac

SEQ ID NO: 2654351 - RNA, 16 nt, Human
guuuuuauuaaaacau

SEQ ID NO: 2654352 - RNA, 15 nt, Human
guuuuuaugagaaac

SEQ ID NO: 2654353 - RNA, 17 nt, Human
guuuuuaugagaaacuu

SEQ ID NO: 2654354 - RNA, 15 nt, Human
uaaaaaaagaaagca

SEQ ID NO: 2654355 - RNA, 13 nt, Human
uaaaaaagagaca

SEQ ID NO: 2654356 - RNA, 23 nt, Human
uaaaaaacugcugacuguuuucu

SEQ ID NO: 2654357 - RNA, 20 nt, Human
uaaaaaacugcugacuguuu

SEQ ID NO: 2654358 - RNA, 15 nt, Human
uaaaaacauaacaua

SEQ ID NO: 2654359 - RNA, 17 nt, Human
uaaaaacauaacauaaa

SEQ ID NO: 2654360 - RNA, 16 nt, Human
uaaaaaccgaauaaau

SEQ ID NO: 2654361 - RNA, 17 nt, Human
uaaaaaccgaauaaaug

SEQ ID NO: 2654362 - RNA, 18 nt, Human
uaaaaaccgaauaaaugu

SEQ ID NO: 2654363 - RNA, 20 nt, Human
uaaaaaccgaauaaauguuu

SEQ ID NO: 2654364 - RNA, 20 nt, Human
uaaaaacucaggcaaagaaa

SEQ ID NO: 2654365 - RNA, 14 nt, Human
uaaaaaauuuuaaa

SEQ ID NO: 2654366 - RNA, 19 nt, Human
uaaaaaauuuuaaaaaucu

SEQ ID NO: 2654367 - RNA, 13 nt, Human
uaaaaaauauuuu

SEQ ID NO: 2654368 - RNA, 14 nt, Human
uaaaaaauauuuuc

SEQ ID NO: 2654369 - RNA, 16 nt, Human
uaaaaaauauuuucuc

SEQ ID NO: 2654370 - RNA, 18 nt, Human
uaaaaaauauuuucucug

SEQ ID NO: 2654371 - RNA, 18 nt, Human
uaaaaaagcauacuucua

SEQ ID NO: 2654372 - RNA, 14 nt, Human
uaaaaaagccuucc

SEQ ID NO: 2654373 - RNA, 15 nt, Human
uaaaaaagccuuccu

SEQ ID NO: 2654374 - RNA, 18 nt, Human
uaaaaaagcucuuuuaau

SEQ ID NO: 2654375 - RNA, 14 nt, Human
uaaaaaauggucac

SEQ ID NO: 2654376 - RNA, 13 nt, Human
guuuguuggaaag

SEQ ID NO: 2654377 - RNA, 22 nt, Human
guuuucauuuacucuaaaaacu

SEQ ID NO: 2654378 - RNA, 18 nt, Human
guuuugugauguuugucc

SEQ ID NO: 2654379 - RNA, 24 nt, Human
guuuugucaaacuguagaaaugau

SEQ ID NO: 2654380 - RNA, 20 nt, Human
guuuugucauucagagucag

SEQ ID NO: 2654381 - RNA, 17 nt, Human
guuuugucaaacuguag

SEQ ID NO: 2654382 - RNA, 19 nt, Human
guuuucucuugagagggug

SEQ ID NO: 2654383 - RNA, 12 nt, Human
guuuucucuuga

SEQ ID NO: 2654384 - RNA, 17 nt, Human
uaaaaaugauacugaug

SEQ ID NO: 2654385 - RNA, 22 nt, Human
uaaaaauggaaacuauauugac

SEQ ID NO: 2654386 - RNA, 15 nt, Human
uaaaauccugugcaa

SEQ ID NO: 2654387 - RNA, 17 nt, Human
uaaaaucugagggaaau

SEQ ID NO: 2654388 - RNA, 20 nt, Human
uaaaaucugagggaaauguu

SEQ ID NO: 2654389 - RNA, 21 nt, Human
uaaaaucugagggaaauguuu

SEQ ID NO: 2654390 - RNA, 22 nt, Human
uaaaaucugagggaaauguuuu

SEQ ID NO: 2654391 - RNA, 23 nt, Human
uaaaaucugagggaaauguuuug

SEQ ID NO: 2654392 - RNA, 20 nt, Human
uaaaauauuuugaaucaaua

SEQ ID NO: 2654393 - RNA, 22 nt, Human
uaaaaggcccauagcagccagu

SEQ ID NO: 2654394 - RNA, 18 nt, Human
uaaaaggcuugaagcugu

SEQ ID NO: 2654395 - RNA, 14 nt, Human
uaaaauauuuugaa

SEQ ID NO: 2654396 - RNA, 16 nt, Human
uaaaauauuuugaauc

SEQ ID NO: 2654397 - RNA, 15 nt, Human
uaaaaugaaaauugu

SEQ ID NO: 2654398 - RNA, 16 nt, Human
uaaaaugaaaauugua

SEQ ID NO: 2654399 - RNA, 16 nt, Human
uaaaaugaagaauuua

SEQ ID NO: 2654400 - RNA, 15 nt, Human
uaaaaugaagaauuu

SEQ ID NO: 2654401 - RNA, 17 nt, Human
uaaaaugaagaauuuaa

SEQ ID NO: 2654402 - RNA, 15 nt, Human
uaaaaugcaauguaa

SEQ ID NO: 2654403 - RNA, 21 nt, Human
uaaacaaugcugauuugguga

SEQ ID NO: 2654404 - RNA, 22 nt, Human
uaaacaaguucgagucaaaguu

SEQ ID NO: 2654405 - RNA, 12 nt, Human
uaaacagaaaug

SEQ ID NO: 2654406 - RNA, 14 nt, Human
uaaacagaaaugga

SEQ ID NO: 2654407 - RNA, 18 nt, Human
uaaaauggcuguaaucau

SEQ ID NO: 2654408 - RNA, 17 nt, Human
uaaacaguaagauaucu

SEQ ID NO: 2654409 - RNA, 15 nt, Human
uaaagcuaaggaccu

SEQ ID NO: 2654410 - RNA, 14 nt, Human
uaaagcaguauuuu

SEQ ID NO: 2654411 - RNA, 17 nt, Human
uaaagcaguauuuuucu

SEQ ID NO: 2654412 - RNA, 13 nt, Human
uaaagcaguauuu

SEQ ID NO: 2654413 - RNA, 14 nt, Human
uaaagcaugaaaug

SEQ ID NO: 2654414 - RNA, 16 nt, Human
uaaagcaugaaaugug

SEQ ID NO: 2654415 - RNA, 17 nt, Human
uaaagcaugaaauguga

SEQ ID NO: 2654416 - RNA, 18 nt, Human
uaaagcaugaaaugugaa

SEQ ID NO: 2654417 - RNA, 19 nt, Human
uaaagcaugaaaugugaau

SEQ ID NO: 2654418 - RNA, 20 nt, Human
uaaagcaugaaaugugaauu

SEQ ID NO: 2654419 - RNA, 21 nt, Human
uaaagcaugaaaugugaauuu

SEQ ID NO: 2654420 - RNA, 14 nt, Human
uaaauaaaaaugga

SEQ ID NO: 2654421 - RNA, 15 nt, Human
uaaauaaaaaugucu

SEQ ID NO: 2654422 - RNA, 14 nt, Human
uaaauaaaaacuaa

SEQ ID NO: 2654423 - RNA, 19 nt, Human
uaaauaaaaacuaauuaag

SEQ ID NO: 2654424 - RNA, 17 nt, Human
uaaaguuugcuuagaaa

SEQ ID NO: 2654425 - RNA, 14 nt, Human
uaaaguuugcuuag

SEQ ID NO: 2654426 - RNA, 14 nt, Human
uaaaggauaaagaa

SEQ ID NO: 2654427 - RNA, 18 nt, Human
uaaauaucuucugauuug

SEQ ID NO: 2654428 - RNA, 17 nt, Human
uaaauaucuucugauuu

SEQ ID NO: 2654429 - RNA, 14 nt, Human
uaaauaaaccacug

SEQ ID NO: 2654430 - RNA, 15 nt, Human
uaaauaaaccacugu

SEQ ID NO: 2654431 - RNA, 13 nt, Human
uaaauaaaauuug

SEQ ID NO: 2654432 - RNA, 14 nt, Human
uaaauaaaauuugu

SEQ ID NO: 2654433 - RNA, 20 nt, Human
uaaauaaaauuuguugcaua

SEQ ID NO: 2654434 - RNA, 17 nt, Human
uaaauauuuauuuaugu

SEQ ID NO: 2654435 - RNA, 13 nt, Human
uaaauauuuucua

SEQ ID NO: 2654436 - RNA, 14 nt, Human
uaaauauuuucuau

SEQ ID NO: 2654437 - RNA, 16 nt, Human
uaaauauuuucuauuu

SEQ ID NO: 2654438 - RNA, 17 nt, Human
uaaauauuuucuauuuu

SEQ ID NO: 2654439 - RNA, 19 nt, Human
uaaaucagccguguaacca

SEQ ID NO: 2654440 - RNA, 16 nt, Human
uaaaucauguugauca

SEQ ID NO: 2654441 - RNA, 18 nt, Human
uauuuauuaauauuuaac

SEQ ID NO: 2654442 - RNA, 17 nt, Human
uauuuauugacucuuga

SEQ ID NO: 2654443 - RNA, 15 nt, Human
uauuuauugacucuu

SEQ ID NO: 2654444 - RNA, 12 nt, Human
uauuuauugacu

SEQ ID NO: 2654445 - RNA, 17 nt, Human
uauuuauuaauauuuaa

SEQ ID NO: 2654446 - RNA, 24 nt, Human
uauuuauuaaauuuuuuuguauga

SEQ ID NO: 2654447 - RNA, 13 nt, Human
uauuuauuaauau

SEQ ID NO: 2654448 - RNA, 19 nt, Human
uauuuauuaauauuuaaca

SEQ ID NO: 2654449 - RNA, 21 nt, Human
uauuuauugacucuugaguug

SEQ ID NO: 2654450 - RNA, 13 nt, Human
uauuucuauuauu

SEQ ID NO: 2654451 - RNA, 14 nt, Human
uauuucuauuauua

SEQ ID NO: 2654452 - RNA, 21 nt, Human
uauuucuauuauuaauugcaa

SEQ ID NO: 2654453 - RNA, 15 nt, Human
uauuuauuaaauuuu

SEQ ID NO: 2654454 - RNA, 15 nt, Human
uauuucuguauauaa

SEQ ID NO: 2654455 - RNA, 13 nt, Human
uauuugauuauuu

SEQ ID NO: 2654456 - RNA, 14 nt, Human
uauuugauuauuua

SEQ ID NO: 2654457 - RNA, 16 nt, Human
uauuuuauaaugucca

SEQ ID NO: 2654458 - RNA, 11 nt, Human
uauuugcuuuu

SEQ ID NO: 2654459 - RNA, 22 nt, Human
ucaaaacgguuuuacugcagcu

SEQ ID NO: 2654460 - RNA, 18 nt, Human
ucaaacuacauauuguaa

SEQ ID NO: 2654461 - RNA, 16 nt, Human
ucaaacucaaugcuuu

SEQ ID NO: 2654462 - RNA, 18 nt, Human
ucaaacucaaugcuuuau

SEQ ID NO: 2654463 - RNA, 22 nt, Human
ucaaacucaaugcuuuauuugu

SEQ ID NO: 2654464 - RNA, 23 nt, Human
ucaaacucaaugcuuuauuugua

SEQ ID NO: 2654465 - RNA, 14 nt, Human
ucaaacucuuaaaa

SEQ ID NO: 2654466 - RNA, 17 nt, Human
ucaaaaaggcuuauaaa

SEQ ID NO: 2654467 - RNA, 20 nt, Human
ucaaaaaggcuuauaaaaca

SEQ ID NO: 2654468 - RNA, 19 nt, Human
ucaaaaaggcuuauaaaac

SEQ ID NO: 2654469 - RNA, 21 nt, Human
ucaaaaaggcuuauaaaacag

SEQ ID NO: 2654470 - RNA, 11 nt, Human
uauuuuuucaa

SEQ ID NO: 2654471 - RNA, 13 nt, Human
ucaaaaaaugagc

SEQ ID NO: 2654472 - RNA, 13 nt, Human
uauuuuuguuguu

SEQ ID NO: 2654473 - RNA, 16 nt, Human
uauuuucauacaaauu

SEQ ID NO: 2654474 - RNA, 23 nt, Human
uauuuugaaucaauaauauauuu

SEQ ID NO: 2654475 - RNA, 16 nt, Human
uauuuugaaucaauaa

SEQ ID NO: 2654476 - RNA, 22 nt, Human
uauuuugaaucaauaauauauu

SEQ ID NO: 2654477 - RNA, 12 nt, Human
uauuuugaauca

SEQ ID NO: 2654478 - RNA, 13 nt, Human
uauuuugaaucaa

SEQ ID NO: 2654479 - RNA, 15 nt, Human
uauuuugaaucaaua

SEQ ID NO: 2654480 - RNA, 13 nt, Human
uauuuuaugguua

SEQ ID NO: 2654481 - RNA, 16 nt, Human
uauuuuaugguuaugu

SEQ ID NO: 2654482 - RNA, 19 nt, Human
uauuuuaugguuauguuuu

SEQ ID NO: 2654483 - RNA, 23 nt, Human
uauuuuaugguuauguuuuucug

SEQ ID NO: 2654484 - RNA, 14 nt, Human
uauuuucaugaaaa

SEQ ID NO: 2654485 - RNA, 20 nt, Human
uauuuucaugaaaauaccau

SEQ ID NO: 2654486 - RNA, 22 nt, Human
ucaacuagugggguuuccuggc

SEQ ID NO: 2654487 - RNA, 21 nt, Human
ucaacuagugggguuuccugg

SEQ ID NO: 2654488 - RNA, 16 nt, Human
ucaagcagucgugccu

SEQ ID NO: 2654489 - RNA, 17 nt, Human
ucaagcagucgugccug

SEQ ID NO: 2654490 - RNA, 18 nt, Human
ucaagcagucgugccugu

SEQ ID NO: 2654491 - RNA, 15 nt, Human
ucaaagaaauauuaa

SEQ ID NO: 2654492 - RNA, 15 nt, Human
ucaaccguacaaugg

SEQ ID NO: 2654493 - RNA, 23 nt, Human
ucaagcagucgugccugugucca

SEQ ID NO: 2654494 - RNA, 19 nt, Human
ucaagcagucgugccugug

SEQ ID NO: 2654495 - RNA, 20 nt, Human
ucaagcagucgugccugugu

SEQ ID NO: 2654496 - RNA, 21 nt, Human
ucaagcagucgugccuguguc

SEQ ID NO: 2654497 - RNA, 22 nt, Human
ucaagcagucgugccugugucc

SEQ ID NO: 2654498 - RNA, 16 nt, Human
ucaaugggaccugugg

SEQ ID NO: 2654499 - RNA, 16 nt, Human
ucaaugcuuuauuugu

SEQ ID NO: 2654500 - RNA, 17 nt, Human
ucaaugcuuuauuugua

SEQ ID NO: 2654501 - RNA, 18 nt, Human
ucaaugcuuuauuuguaa

SEQ ID NO: 2654502 - RNA, 19 nt, Human
ucaaugcuuuauuuguaaa

SEQ ID NO: 2654503 - RNA, 20 nt, Human
ucaaugcuuuauuuguaaau

SEQ ID NO: 2654504 - RNA, 16 nt, Human
ucaauagaucuccagc

SEQ ID NO: 2654505 - RNA, 18 nt, Human
ucaauacacuaguuguuu

SEQ ID NO: 2654506 - RNA, 15 nt, Human
ucaccuagaaauuga

SEQ ID NO: 2654507 - RNA, 13 nt, Human
ucaccucaugccc

SEQ ID NO: 2654508 - RNA, 20 nt, Human
ucacgccuguaauccuagca

SEQ ID NO: 2654509 - RNA, 19 nt, Human
ucacgccuguaauccuagc

SEQ ID NO: 2654510 - RNA, 22 nt, Human
ucacgggagauuucuuguugcu

SEQ ID NO: 2654511 - RNA, 20 nt, Human
ucaccuucuagucuuggcca

SEQ ID NO: 2654512 - RNA, 20 nt, Human
ucacucggguuucucugugg

SEQ ID NO: 2654513 - RNA, 16 nt, Human
ucacucuaagucaugu

SEQ ID NO: 2654514 - RNA, 20 nt, Human
ucacucuaagucauguaugu

SEQ ID NO: 2654515 - RNA, 21 nt, Human
ucacucuaagucauguauguu

SEQ ID NO: 2654516 - RNA, 17 nt, Human
ucacggaagagccuugc

SEQ ID NO: 2654517 - RNA, 16 nt, Human
ucacggaagagccuug

SEQ ID NO: 2654518 - RNA, 14 nt, Human
ucacggaagagccu

SEQ ID NO: 2654519 - RNA, 18 nt, Human
ucagaaaguguauaauaa

SEQ ID NO: 2654520 - RNA, 15 nt, Human
ucagacauguuuucc

SEQ ID NO: 2654521 - RNA, 14 nt, Human
ucagacauguuuuc

SEQ ID NO: 2654522 - RNA, 19 nt, Human
ucagacaucugagguuuua

SEQ ID NO: 2654523 - RNA, 20 nt, Human
ucagacauguuuuccgugaa

SEQ ID NO: 2654524 - RNA, 22 nt, Human
ucagacaucugagguuuuauuu

SEQ ID NO: 2654525 - RNA, 12 nt, Human
ucagaaagugua

SEQ ID NO: 2654526 - RNA, 18 nt, Human
ucagaaaaugaaaaaucu

SEQ ID NO: 2654527 - RNA, 13 nt, Human
ucagaaauauaac

SEQ ID NO: 2654528 - RNA, 19 nt, Human
ucagaaauauaacacauuu

SEQ ID NO: 2654529 - RNA, 20 nt, Human
ucagaaauauaacacauuuu

SEQ ID NO: 2654530 - RNA, 16 nt, Human
ucagaaagcuuuauuu

SEQ ID NO: 2654531 - RNA, 19 nt, Human
ucagaaagcuuuauuuuga

SEQ ID NO: 2654532 - RNA, 20 nt, Human
ucacuuuuggcaaugacuca

SEQ ID NO: 2654533 - RNA, 21 nt, Human
ucacuuuuuaugcuauuucug

SEQ ID NO: 2654534 - RNA, 22 nt, Human
ucacuuuuuaugcuauuucugu

SEQ ID NO: 2654535 - RNA, 18 nt, Human
uccccgcagcccuggcag

SEQ ID NO: 2654536 - RNA, 13 nt, Human
uccccgccuggcc

SEQ ID NO: 2654537 - RNA, 14 nt, Human
uccccgccuggcca

SEQ ID NO: 2654538 - RNA, 15 nt, Human
uccccgccuggccag

SEQ ID NO: 2654539 - RNA, 16 nt, Human
uccccgccuggccagg

SEQ ID NO: 2654540 - RNA, 17 nt, Human
uccccgccuggccagga

SEQ ID NO: 2654541 - RNA, 18 nt, Human
uccccgccuggccaggag

SEQ ID NO: 2654542 - RNA, 19 nt, Human
uccccgccuggccaggagc

SEQ ID NO: 2654543 - RNA, 20 nt, Human
uccccgccuggccaggagca

SEQ ID NO: 2654544 - RNA, 18 nt, Human
uccccgacgcccacccaa

SEQ ID NO: 2654545 - RNA, 15 nt, Human
uccccgcugcugugc

SEQ ID NO: 2654546 - RNA, 16 nt, Human
uccccgcugcugugca

SEQ ID NO: 2654547 - RNA, 19 nt, Human
uccccugccaccaggccac

SEQ ID NO: 2654548 - RNA, 13 nt, Human
uccccugccacca

SEQ ID NO: 2654549 - RNA, 14 nt, Human
uccccugccaccag

SEQ ID NO: 2654550 - RNA, 16 nt, Human
uccccugccaccaggc

SEQ ID NO: 2654551 - RNA, 17 nt, Human
uccccugccaccaggcc

SEQ ID NO: 2654552 - RNA, 11 nt, Human
uccccagccug

SEQ ID NO: 2654553 - RNA, 17 nt, Human
uccccagccugcgccug

SEQ ID NO: 2654554 - RNA, 14 nt, Human
uccccagccugcgc

SEQ ID NO: 2654555 - RNA, 13 nt, Human
uccccagccugcg

SEQ ID NO: 2654556 - RNA, 12 nt, Human
uccccagccugc

SEQ ID NO: 2654557 - RNA, 20 nt, Human
uccccagccugcgccugcug

SEQ ID NO: 2654558 - RNA, 19 nt, Human
uccccagccugcgccugcu

SEQ ID NO: 2654559 - RNA, 22 nt, Human
uccccuguagagugggagcuga

SEQ ID NO: 2654560 - RNA, 19 nt, Human
uccccuguagagugggagc

SEQ ID NO: 2654561 - RNA, 23 nt, Human
ucccaaagugcugggauuacaga

SEQ ID NO: 2654562 - RNA, 15 nt, Human
ucccaacaagcagcu

SEQ ID NO: 2654563 - RNA, 20 nt, Human
uccagcauuuagcuggccac

SEQ ID NO: 2654564 - RNA, 21 nt, Human
uccagcauuuagcuggccaca

SEQ ID NO: 2654565 - RNA, 21 nt, Human
uccauccaaggccagguucuc

SEQ ID NO: 2654566 - RNA, 13 nt, Human
uccauccaaggcc

SEQ ID NO: 2654567 - RNA, 21 nt, Human
ucccauguagcccccuggccu

SEQ ID NO: 2654568 - RNA, 15 nt, Human
ucccauguagccccc

SEQ ID NO: 2654569 - RNA, 13 nt, Human
ucccauguagccc

SEQ ID NO: 2654570 - RNA, 11 nt, Human
ucccauuccag

SEQ ID NO: 2654571 - RNA, 13 nt, Human
ucccauuccaggc

SEQ ID NO: 2654572 - RNA, 14 nt, Human
ucccauuccaggca

SEQ ID NO: 2654573 - RNA, 13 nt, Human
ucccaucugcacc

SEQ ID NO: 2654574 - RNA, 19 nt, Human
ucccaucugcaccccuucu

SEQ ID NO: 2654575 - RNA, 14 nt, Human
ucccauggggaggg

SEQ ID NO: 2654576 - RNA, 18 nt, Human
ucccaggagccugcccag

SEQ ID NO: 2654577 - RNA, 17 nt, Human
ucccaggagccugccca

SEQ ID NO: 2654578 - RNA, 13 nt, Human
ucccaggagccug

SEQ ID NO: 2654579 - RNA, 20 nt, Human
ucccaaguaacugggauuac

SEQ ID NO: 2654580 - RNA, 21 nt, Human
ucccaaguaacugggauuaca

SEQ ID NO: 2654581 - RNA, 13 nt, Human
ucauucagaaaug

SEQ ID NO: 2654582 - RNA, 14 nt, Human
ucauucagaaaugu

SEQ ID NO: 2654583 - RNA, 14 nt, Human
ucauucagagucag

SEQ ID NO: 2654584 - RNA, 20 nt, Human
ucauucagagucagccagga

SEQ ID NO: 2654585 - RNA, 22 nt, Human
ucauucagagucagccaggacc

SEQ ID NO: 2654586 - RNA, 19 nt, Human
ucauucagcagcaaauuuu

SEQ ID NO: 2654587 - RNA, 21 nt, Human
ucauucagcagcaaauuuuca

SEQ ID NO: 2654588 - RNA, 23 nt, Human
ucauucagcagcaaauuuucagc

SEQ ID NO: 2654589 - RNA, 23 nt, Human
ucauguaaauuuuguaugaaaaa

SEQ ID NO: 2654590 - RNA, 19 nt, Human
uccaaacugaagcagccuc

SEQ ID NO: 2654591 - RNA, 22 nt, Human
uccacaaccucuuccccccaaa

SEQ ID NO: 2654592 - RNA, 20 nt, Human
uccaagauuuaaaugccaua

SEQ ID NO: 2654593 - RNA, 19 nt, Human
uccagaaccacacuugaaa

SEQ ID NO: 2654594 - RNA, 19 nt, Human
uccagaaauacaauuuuag

SEQ ID NO: 2654595 - RNA, 22 nt, Human
uccagaacucacuggggccuac

SEQ ID NO: 2654596 - RNA, 18 nt, Human
ucagcagcaaauuuucag

SEQ ID NO: 2654597 - RNA, 17 nt, Human
ucaguggguuaacauca

SEQ ID NO: 2654598 - RNA, 20 nt, Human
ucaguggguuaacaucaguu

SEQ ID NO: 2654599 - RNA, 23 nt, Human
ucaguggguuaacaucaguuuug

SEQ ID NO: 2654600 - RNA, 13 nt, Human
ucaguugcuuguc

SEQ ID NO: 2654601 - RNA, 15 nt, Human
ucaguugcuugucuu

SEQ ID NO: 2654602 - RNA, 23 nt, Human
ucaguugagcuucauauaccagc

SEQ ID NO: 2654603 - RNA, 19 nt, Human
ucaguucauugugguccuu

SEQ ID NO: 2654604 - RNA, 14 nt, Human
ucaucugaaauguu

SEQ ID NO: 2654605 - RNA, 15 nt, Human
ucaucugaaauguua

SEQ ID NO: 2654606 - RNA, 20 nt, Human
ucaucugucuauauuuuauu

SEQ ID NO: 2654607 - RNA, 23 nt, Human
ucaugcccacccccugcccugca

SEQ ID NO: 2654608 - RNA, 20 nt, Human
ucauaguacucuuuguagca

SEQ ID NO: 2654609 - RNA, 13 nt, Human
ucauguaaaacag

SEQ ID NO: 2654610 - RNA, 15 nt, Human
ucauguaaaacagaa

SEQ ID NO: 2654611 - RNA, 18 nt, Human
ucauguaaaacagaaaaa

SEQ ID NO: 2654612 - RNA, 16 nt, Human
ucauguaaauuuugua

SEQ ID NO: 2654613 - RNA, 17 nt, Human
ucauguaaauuuuguau

SEQ ID NO: 2654614 - RNA, 14 nt, Human
ucugagcugccagu

SEQ ID NO: 2654615 - RNA, 19 nt, Human
ucugagcuuacguaguucu

SEQ ID NO: 2654616 - RNA, 17 nt, Human
ucugagcuuacguaguu

SEQ ID NO: 2654617 - RNA, 15 nt, Human
ucugauucuggcuuu

SEQ ID NO: 2654618 - RNA, 19 nt, Human
ucugauucuggcuuuaagc

SEQ ID NO: 2654619 - RNA, 23 nt, Human
ucugauucuggcuuuaagccuuc

SEQ ID NO: 2654620 - RNA, 22 nt, Human
ucugauugauuugauugggaug

SEQ ID NO: 2654621 - RNA, 14 nt, Human
ucugcacaagcugc

SEQ ID NO: 2654622 - RNA, 19 nt, Human
ucugcacaagcugcacccu

SEQ ID NO: 2654623 - RNA, 12 nt, Human
ucugaacuugcc

SEQ ID NO: 2654624 - RNA, 17 nt, Human
ucugaacuugccuuaaa

SEQ ID NO: 2654625 - RNA, 19 nt, Human
ucugaccacuugaggccug

SEQ ID NO: 2654626 - RNA, 20 nt, Human
ucugaccacuugaggccuga

SEQ ID NO: 2654627 - RNA, 18 nt, Human
ucucuuugauuauuugca

SEQ ID NO: 2654628 - RNA, 19 nt, Human
ucucuuugauuauuugcau

SEQ ID NO: 2654629 - RNA, 20 nt, Human
ucucuuccuuuuaucaguag

SEQ ID NO: 2654630 - RNA, 14 nt, Human
ucucuucucagagu

SEQ ID NO: 2654631 - RNA, 17 nt, Human
ucucuucucagaguggu

SEQ ID NO: 2654632 - RNA, 19 nt, Human
ucucuucucagaguggugg

SEQ ID NO: 2654633 - RNA, 19 nt, Human
ucucuucauuauucucugc

SEQ ID NO: 2654634 - RNA, 15 nt, Human
ucugaaauguuacaa

SEQ ID NO: 2654635 - RNA, 18 nt, Human
ucugaaauguuacaaaaa

SEQ ID NO: 2654636 - RNA, 20 nt, Human
ucugaaauguuacaaaaaua

SEQ ID NO: 2654637 - RNA, 22 nt, Human
ucugaaauguuacaaaaauaaa

SEQ ID NO: 2654638 - RNA, 22 nt, Human
ucugaaaucuucccaugcauuc

SEQ ID NO: 2654639 - RNA, 20 nt, Human
ucugaaauaggaaacaagug

SEQ ID NO: 2654640 - RNA, 17 nt, Human
ucugaaauaggaaacaa

SEQ ID NO: 2654641 - RNA, 18 nt, Human
ucugaaauaggaaacaag

SEQ ID NO: 2654642 - RNA, 12 nt, Human
ucucuuuuccac

SEQ ID NO: 2654643 - RNA, 22 nt, Human
ucucuuuuccacuccauugucg

SEQ ID NO: 2654644 - RNA, 13 nt, Human
ucucuagcacaau

SEQ ID NO: 2654645 - RNA, 15 nt, Human
ucucuacaaaaagca

SEQ ID NO: 2654646 - RNA, 19 nt, Human
ucucugacuucugccugga

SEQ ID NO: 2654647 - RNA, 17 nt, Human
ucucugacuucugccug

SEQ ID NO: 2654648 - RNA, 18 nt, Human
ucucugacuucugccugg

SEQ ID NO: 2654649 - RNA, 15 nt, Human
ucucucuucucagag

SEQ ID NO: 2654650 - RNA, 16 nt, Human
ucucucuucucagagu

SEQ ID NO: 2654651 - RNA, 13 nt, Human
ucucugacuucug

SEQ ID NO: 2654652 - RNA, 14 nt, Human
ucucugaaagugug

SEQ ID NO: 2654653 - RNA, 14 nt, Human
ucucugacuucugc

SEQ ID NO: 2654654 - RNA, 16 nt, Human
ucucugacuucugccu

SEQ ID NO: 2654655 - RNA, 14 nt, Human
ucucuauuaaaaug

SEQ ID NO: 2654656 - RNA, 13 nt, Human
ucucuauuugaga

SEQ ID NO: 2654657 - RNA, 14 nt, Human
ucucagugcccucc

SEQ ID NO: 2654658 - RNA, 16 nt, Human
ucucagugcccuccag

SEQ ID NO: 2654659 - RNA, 13 nt, Human
ucucaguguuggu

SEQ ID NO: 2654660 - RNA, 14 nt, Human
ucucaguguuggua

SEQ ID NO: 2654661 - RNA, 14 nt, Human
ucuccugagcuagg

SEQ ID NO: 2654662 - RNA, 13 nt, Human
ucuccugacuggu

SEQ ID NO: 2654663 - RNA, 15 nt, Human
ucuccugacuggugc

SEQ ID NO: 2654664 - RNA, 15 nt, Human
ucuccugacagaagg

SEQ ID NO: 2654665 - RNA, 15 nt, Human
ucucccuagcuccuc

SEQ ID NO: 2654666 - RNA, 16 nt, Human
ucucccuagcuccucc

SEQ ID NO: 2654667 - RNA, 20 nt, Human
ucucccuagcuccuccccuu

SEQ ID NO: 2654668 - RNA, 17 nt, Human
ucgcuucuugccucugu

SEQ ID NO: 2654669 - RNA, 20 nt, Human
ucggaacccaagcuuagaac

SEQ ID NO: 2654670 - RNA, 19 nt, Human
ucggaacccaagcuuagaa

SEQ ID NO: 2654671 - RNA, 14 nt, Human
ucgcuucuugccuc

SEQ ID NO: 2654672 - RNA, 15 nt, Human
ucgcuucuugccucu

SEQ ID NO: 2654673 - RNA, 16 nt, Human
ucgcuucuugccucug

SEQ ID NO: 2654674 - RNA, 19 nt, Human
ucgcccaggcuggagugca

SEQ ID NO: 2654675 - RNA, 16 nt, Human
ucgcaccauucugacu

SEQ ID NO: 2654676 - RNA, 13 nt, Human
ucgcaccggagug

SEQ ID NO: 2654677 - RNA, 22 nt, Human
ucgcaccggagugucuggaauu

SEQ ID NO: 2654678 - RNA, 17 nt, Human
ucgcaccauucugacuc

SEQ ID NO: 2654679 - RNA, 13 nt, Human
ucgagucugaggc

SEQ ID NO: 2654680 - RNA, 14 nt, Human
uccuuuuugacacu

SEQ ID NO: 2654681 - RNA, 16 nt, Human
uccuuuuugacacuga

SEQ ID NO: 2654682 - RNA, 17 nt, Human
uccuuuuugacacugaa

SEQ ID NO: 2654683 - RNA, 23 nt, Human
uccuuuuuauuuauauguaugug

SEQ ID NO: 2654684 - RNA, 22 nt, Human
uccuuuuuauuuauauguaugu

SEQ ID NO: 2654685 - RNA, 23 nt, Human
ucgagugccgcaucucacagcua

SEQ ID NO: 2654686 - RNA, 22 nt, Human
ucgagugccgcaucucacagcu

SEQ ID NO: 2654687 - RNA, 20 nt, Human
ucgagugccgcaucucacag

SEQ ID NO: 2654688 - RNA, 14 nt, Human
ucgagucugaggcc

SEQ ID NO: 2654689 - RNA, 14 nt, Human
ucgauacugcgacu

SEQ ID NO: 2654690 - RNA, 18 nt, Human
uccuuuuuauuuauaugu

SEQ ID NO: 2654691 - RNA, 15 nt, Human
uccuuuuuauuuaua

SEQ ID NO: 2654692 - RNA, 14 nt, Human
uccuuuuuauuuau

SEQ ID NO: 2654693 - RNA, 13 nt, Human
uccuuuuuauuua

SEQ ID NO: 2654694 - RNA, 12 nt, Human
uccuuuuuaagg

SEQ ID NO: 2654695 - RNA, 14 nt, Human
uccuugauuucaaa

SEQ ID NO: 2654696 - RNA, 22 nt, Human
uccuugauuucaaaguuuuguu

SEQ ID NO: 2654697 - RNA, 12 nt, Human
uccuucuuuaaa

SEQ ID NO: 2654698 - RNA, 17 nt, Human
uccuuaauucacuccca

SEQ ID NO: 2654699 - RNA, 18 nt, Human
uccuuaauucacucccac

SEQ ID NO: 2654700 - RNA, 19 nt, Human
uccuuaauucacucccaca

SEQ ID NO: 2654701 - RNA, 20 nt, Human
uccuuauuuggcgugacccg

SEQ ID NO: 2654702 - RNA, 17 nt, Human
uccuggcccacugcauc

SEQ ID NO: 2654703 - RNA, 18 nt, Human
uccccuuccucuugucug

SEQ ID NO: 2654704 - RNA, 19 nt, Human
uccuggcagcccagagacu

SEQ ID NO: 2654705 - RNA, 17 nt, Human
uccuggcagcccagaga

SEQ ID NO: 2654706 - RNA, 18 nt, Human
ucuaaccucgcccucucc

SEQ ID NO: 2654707 - RNA, 21 nt, Human
ucuaaauguuuggcauguaaa

SEQ ID NO: 2654708 - RNA, 22 nt, Human
ucuaaauguuuggcauguaaau

SEQ ID NO: 2654709 - RNA, 22 nt, Human
ucuagggaaaaaccagcgugug

SEQ ID NO: 2654710 - RNA, 23 nt, Human
ucuagaagccaagggaaaggggu

SEQ ID NO: 2654711 - RNA, 19 nt, Human
ucuagggaaaaaccagcgu

SEQ ID NO: 2654712 - RNA, 17 nt, Human
ucuagaauuauuuuuca

SEQ ID NO: 2654713 - RNA, 19 nt, Human
ucuagaauuauuuuucacu

SEQ ID NO: 2654714 - RNA, 17 nt, Human
ucuagaagccaagggaa

SEQ ID NO: 2654715 - RNA, 20 nt, Human
ucuagaagccaagggaaagg

SEQ ID NO: 2654716 - RNA, 21 nt, Human
ucuagaagccaagggaaaggg

SEQ ID NO: 2654717 - RNA, 24 nt, Human
ucuacugcauuuagggaguauucu

SEQ ID NO: 2654718 - RNA, 17 nt, Human
ucucaaagaaauauuaa

SEQ ID NO: 2654719 - RNA, 15 nt, Human
ucucacuguuuguuu

SEQ ID NO: 2654720 - RNA, 19 nt, Human
ucucacuguuuguuuuuau

SEQ ID NO: 2654721 - RNA, 12 nt, Human
ucucagaagcac

SEQ ID NO: 2654722 - RNA, 14 nt, Human
ucucagaagcacag

SEQ ID NO: 2654723 - RNA, 15 nt, Human
ucucagaagcacaga

SEQ ID NO: 2654724 - RNA, 16 nt, Human
ucucagaagcacagaa

SEQ ID NO: 2654725 - RNA, 12 nt, Human
ucucagaauccc

SEQ ID NO: 2654726 - RNA, 21 nt, Human
ucucagaaucccuuaacaguu

SEQ ID NO: 2654727 - RNA, 13 nt, Human
ugaacacuuauaa

SEQ ID NO: 2654728 - RNA, 17 nt, Human
ugaaaccuuuuuuuauc

SEQ ID NO: 2654729 - RNA, 23 nt, Human
ugaacauacaaaugcaucuuuga

SEQ ID NO: 2654730 - RNA, 16 nt, Human
ugaacauacaaaugca

SEQ ID NO: 2654731 - RNA, 15 nt, Human
ugaacauacaaaugc

SEQ ID NO: 2654732 - RNA, 17 nt, Human
ugaaaugccugcuuuga

SEQ ID NO: 2654733 - RNA, 13 nt, Human
ugaaaugcauauu

SEQ ID NO: 2654734 - RNA, 21 nt, Human
ugaacucuucucauuacuugu

SEQ ID NO: 2654735 - RNA, 18 nt, Human
ugaacucuucucauuacu

SEQ ID NO: 2654736 - RNA, 14 nt, Human
ugaacucuucucau

SEQ ID NO: 2654737 - RNA, 16 nt, Human
ugaacuuggaagcaca

SEQ ID NO: 2654738 - RNA, 16 nt, Human
ugaagauccagcugcc

SEQ ID NO: 2654739 - RNA, 17 nt, Human
ugaagauccagcugccu

SEQ ID NO: 2654740 - RNA, 15 nt, Human
ugaagaugggagccu

SEQ ID NO: 2654741 - RNA, 18 nt, Human
ugaaaagaugguaucaua

SEQ ID NO: 2654742 - RNA, 16 nt, Human
ugaaaagagacaggca

SEQ ID NO: 2654743 - RNA, 18 nt, Human
ugaaaucuucccaugcau

SEQ ID NO: 2654744 - RNA, 19 nt, Human
ugaaaucuucccaugcauu

SEQ ID NO: 2654745 - RNA, 22 nt, Human
ugaaaucuucccaugcauucug

SEQ ID NO: 2654746 - RNA, 19 nt, Human
ugaaaggcaggccuauuuc

SEQ ID NO: 2654747 - RNA, 20 nt, Human
ugaaaggcaggccuauuuca

SEQ ID NO: 2654748 - RNA, 21 nt, Human
ugaaaggcaggccuauuucau

SEQ ID NO: 2654749 - RNA, 22 nt, Human
ugaaaggcaggccuauuucauc

SEQ ID NO: 2654750 - RNA, 23 nt, Human
ugaaaggcaggccuauuucauca

SEQ ID NO: 2654751 - RNA, 22 nt, Human
ugaaaggagagcaucggccuag

SEQ ID NO: 2654752 - RNA, 22 nt, Human
ucuuuugguaaagacuggcuuu

SEQ ID NO: 2654753 - RNA, 23 nt, Human
ucuuuugccuuuugcaaccagga

SEQ ID NO: 2654754 - RNA, 16 nt, Human
ucuuuugauuauguuu

SEQ ID NO: 2654755 - RNA, 13 nt, Human
ucuuuugcuuuug

SEQ ID NO: 2654756 - RNA, 18 nt, Human
ucuuuugcuuuuggcaaa

SEQ ID NO: 2654757 - RNA, 12 nt, Human
ucuuuugaagca

SEQ ID NO: 2654758 - RNA, 14 nt, Human
ucuuuugaagcaua

SEQ ID NO: 2654759 - RNA, 15 nt, Human
ugaaaacuucagaag

SEQ ID NO: 2654760 - RNA, 12 nt, Human
ucuuuuuuaacc

SEQ ID NO: 2654761 - RNA, 21 nt, Human
ucuuuuuuaaccgguaagagu

SEQ ID NO: 2654762 - RNA, 23 nt, Human
ucuuuuuuaaccgguaagaguuu

SEQ ID NO: 2654763 - RNA, 15 nt, Human
ucuuuuuguuguaaa

SEQ ID NO: 2654764 - RNA, 16 nt, Human
ucuuuuuguuguaaaa

SEQ ID NO: 2654765 - RNA, 12 nt, Human
ucuuuuuguuug

SEQ ID NO: 2654766 - RNA, 15 nt, Human
ucuuuuuuauuaauc

SEQ ID NO: 2654767 - RNA, 24 nt, Human
ucuuuuuuauuaaucacuguguau

SEQ ID NO: 2654768 - RNA, 21 nt, Human
ucuuuuuuauuaaucacugug

SEQ ID NO: 2654769 - RNA, 16 nt, Human
ucuuuuuuauuaauca

SEQ ID NO: 2654770 - RNA, 13 nt, Human
ucuguguuuauaa

SEQ ID NO: 2654771 - RNA, 14 nt, Human
ucuguguugccaag

SEQ ID NO: 2654772 - RNA, 16 nt, Human
ucuguguugccaagcu

SEQ ID NO: 2654773 - RNA, 20 nt, Human
ucugugugugugugugugcg

SEQ ID NO: 2654774 - RNA, 15 nt, Human
ucuguuaugggcuuu

SEQ ID NO: 2654775 - RNA, 21 nt, Human
ucuguuaugggcuuuugggga

SEQ ID NO: 2654776 - RNA, 18 nt, Human
ucuuaaaaaguggaaaaa

SEQ ID NO: 2654777 - RNA, 20 nt, Human
ucugugguuggcugggaaau

SEQ ID NO: 2654778 - RNA, 19 nt, Human
ucugugguuggcugggaaa

SEQ ID NO: 2654779 - RNA, 14 nt, Human
ucugugguuggcug

SEQ ID NO: 2654780 - RNA, 13 nt, Human
ucugugguuggcu

SEQ ID NO: 2654781 - RNA, 12 nt, Human
ucugugguuggc

SEQ ID NO: 2654782 - RNA, 16 nt, Human
ucugugguuccucugc

SEQ ID NO: 2654783 - RNA, 17 nt, Human
ucugugguuccucugcu

SEQ ID NO: 2654784 - RNA, 18 nt, Human
ucugugguuccucugcuc

SEQ ID NO: 2654785 - RNA, 19 nt, Human
ucugugguuccucugcuca

SEQ ID NO: 2654786 - RNA, 20 nt, Human
ucugugguuccucugcucac

SEQ ID NO: 2654787 - RNA, 19 nt, Human
ucuguccgagcuuugaaaa

SEQ ID NO: 2654788 - RNA, 14 nt, Human
ucuggaggggaggg

SEQ ID NO: 2654789 - RNA, 21 nt, Human
ucuggaggggagggggauccg

SEQ ID NO: 2654790 - RNA, 16 nt, Human
ucuggagcccuaaccc

SEQ ID NO: 2654791 - RNA, 21 nt, Human
ucuggagcccuaaccccuucc

SEQ ID NO: 2654792 - RNA, 23 nt, Human
ucuggagcccuaaccccuuccag

SEQ ID NO: 2654793 - RNA, 21 nt, Human
ucugcaccccuucucuccucc

SEQ ID NO: 2654794 - RNA, 22 nt, Human
ucugcaccccuucucuccuccc

SEQ ID NO: 2654795 - RNA, 15 nt, Human
ucugcaccccuucuc

SEQ ID NO: 2654796 - RNA, 18 nt, Human
ucugcaccccuucucucc

SEQ ID NO: 2654797 - RNA, 19 nt, Human
ucugcaccccuucucuccu

SEQ ID NO: 2654798 - RNA, 20 nt, Human
ucugcaccccuucucuccuc

SEQ ID NO: 2654799 - RNA, 14 nt, Human
ucugcacccagaac

SEQ ID NO: 2654800 - RNA, 15 nt, Human
ucugcacccagaaca

SEQ ID NO: 2654801 - RNA, 21 nt, Human
ucuggagaccagggagccuuu

SEQ ID NO: 2654802 - RNA, 20 nt, Human
ucuggagaccagggagccuu

SEQ ID NO: 2654803 - RNA, 19 nt, Human
ucuggagaccagggagccu

SEQ ID NO: 2654804 - RNA, 15 nt, Human
ucuggagaccaggga

SEQ ID NO: 2654805 - RNA, 12 nt, Human
ucuguaauaaua

SEQ ID NO: 2654806 - RNA, 13 nt, Human
ucuguaauaauag

SEQ ID NO: 2654807 - RNA, 15 nt, Human
ucuguaauaauagac

SEQ ID NO: 2654808 - RNA, 16 nt, Human
ucuguaauaauagacu

SEQ ID NO: 2654809 - RNA, 19 nt, Human
ucuguaauaauagacugua

SEQ ID NO: 2654810 - RNA, 14 nt, Human
ucuggcuuuaagcc

SEQ ID NO: 2654811 - RNA, 17 nt, Human
ucuggcuuuaagccuuc

SEQ ID NO: 2654812 - RNA, 12 nt, Human
ucuugccucugu

SEQ ID NO: 2654813 - RNA, 14 nt, Human
ucuugccuccaggu

SEQ ID NO: 2654814 - RNA, 15 nt, Human
ucuugccuccaggug

SEQ ID NO: 2654815 - RNA, 17 nt, Human
ucuugccuccaggugca

SEQ ID NO: 2654816 - RNA, 18 nt, Human
ucuugccuccaggugcag

SEQ ID NO: 2654817 - RNA, 19 nt, Human
ucuugccuccaggugcaga

SEQ ID NO: 2654818 - RNA, 13 nt, Human
ucuugccucugug

SEQ ID NO: 2654819 - RNA, 14 nt, Human
ucuugccucugugc

SEQ ID NO: 2654820 - RNA, 15 nt, Human
ucuugccucugugcu

SEQ ID NO: 2654821 - RNA, 16 nt, Human
ucuugccucugugcug

SEQ ID NO: 2654822 - RNA, 19 nt, Human
ucuugccucugugcugugu

SEQ ID NO: 2654823 - RNA, 16 nt, Human
ucuuuaaaaggaaaga

SEQ ID NO: 2654824 - RNA, 15 nt, Human
ucuuuaaaagaauga

SEQ ID NO: 2654825 - RNA, 16 nt, Human
ucuuuaaaagaaugac

SEQ ID NO: 2654826 - RNA, 17 nt, Human
ucuuuaaaagaaugacu

SEQ ID NO: 2654827 - RNA, 16 nt, Human
ucuugucugauuucuu

SEQ ID NO: 2654828 - RNA, 16 nt, Human
ucuucaguaagccgug

SEQ ID NO: 2654829 - RNA, 12 nt, Human
ucuucuaaaugg

SEQ ID NO: 2654830 - RNA, 15 nt, Human
ucuucuaauugcugu

SEQ ID NO: 2654831 - RNA, 14 nt, Human
ucuucucagagugg

SEQ ID NO: 2654832 - RNA, 19 nt, Human
ucuucuagugaugaugguu

SEQ ID NO: 2654833 - RNA, 21 nt, Human
ucuuauaauuguucucagaau

SEQ ID NO: 2654834 - RNA, 21 nt, Human
ucuuaugcucucacuguuugu

SEQ ID NO: 2654835 - RNA, 15 nt, Human
ucuucaguaagccgu

SEQ ID NO: 2654836 - RNA, 14 nt, Human
ucuuaguuauauag

SEQ ID NO: 2654837 - RNA, 21 nt, Human
ucuuauaaaguggaaguaugu

SEQ ID NO: 2654838 - RNA, 13 nt, Human
ucuuaaaaagugg

SEQ ID NO: 2654839 - RNA, 22 nt, Human
ugccauggcuagguagaaguga

SEQ ID NO: 2654840 - RNA, 22 nt, Human
ugcccagcccccuggucuuuga

SEQ ID NO: 2654841 - RNA, 22 nt, Human
ugccuaaguccaguguuucuuu

SEQ ID NO: 2654842 - RNA, 18 nt, Human
ugccugauccuccaacag

SEQ ID NO: 2654843 - RNA, 12 nt, Human
ugccugaauaaa

SEQ ID NO: 2654844 - RNA, 13 nt, Human
ugccugaauaaag

SEQ ID NO: 2654845 - RNA, 17 nt, Human
ugccugaauaaagagcc

SEQ ID NO: 2654846 - RNA, 14 nt, Human
ugccucugugcugu

SEQ ID NO: 2654847 - RNA, 16 nt, Human
ugccucugugcugugu

SEQ ID NO: 2654848 - RNA, 11 nt, Human
ugccucugugc

SEQ ID NO: 2654849 - RNA, 12 nt, Human
ugccucugugcu

SEQ ID NO: 2654850 - RNA, 13 nt, Human
ugccucugugcug

SEQ ID NO: 2654851 - RNA, 13 nt, Human
ugccuucgcuucu

SEQ ID NO: 2654852 - RNA, 14 nt, Human
ugccuucgcuucuu

SEQ ID NO: 2654853 - RNA, 16 nt, Human
ugccuucgcuucuugc

SEQ ID NO: 2654854 - RNA, 17 nt, Human
ugccuucgcuucuugcc

SEQ ID NO: 2654855 - RNA, 16 nt, Human
ugccuucccuagcuuu

SEQ ID NO: 2654856 - RNA, 21 nt, Human
ugcgcccccuccgcccugcca

SEQ ID NO: 2654857 - RNA, 23 nt, Human
ugcgcccccuccgcccugccacu

SEQ ID NO: 2654858 - RNA, 21 nt, Human
ugcgcccuuaacugcauccag

SEQ ID NO: 2654859 - RNA, 13 nt, Human
ugccuucccuagc

SEQ ID NO: 2654860 - RNA, 14 nt, Human
ugccuucccuagcu

SEQ ID NO: 2654861 - RNA, 17 nt, Human
ugccuucccuagcuuua

SEQ ID NO: 2654862 - RNA, 16 nt, Human
ugccugaugacaauaa

SEQ ID NO: 2654863 - RNA, 22 nt, Human
ugccuggccuuguccucagcca

SEQ ID NO: 2654864 - RNA, 11 nt, Human
ugccuggcccc

SEQ ID NO: 2654865 - RNA, 12 nt, Human
ugccuggccccc

SEQ ID NO: 2654866 - RNA, 13 nt, Human
ugcucaucugcug

SEQ ID NO: 2654867 - RNA, 14 nt, Human
ugcucaucugcugg

SEQ ID NO: 2654868 - RNA, 15 nt, Human
ugcucaucugcuggu

SEQ ID NO: 2654869 - RNA, 16 nt, Human
ugcucaucugcugguc

SEQ ID NO: 2654870 - RNA, 18 nt, Human
ugcucaucugcugguccg

SEQ ID NO: 2654871 - RNA, 15 nt, Human
ugcuagaagcuguaa

SEQ ID NO: 2654872 - RNA, 13 nt, Human
ugcuagcuagcuc

SEQ ID NO: 2654873 - RNA, 21 nt, Human
ugcugagucuguucugguaau

SEQ ID NO: 2654874 - RNA, 19 nt, Human
ugcugagucuguucuggua

SEQ ID NO: 2654875 - RNA, 16 nt, Human
ugcugagucuguucug

SEQ ID NO: 2654876 - RNA, 20 nt, Human
ugcugaauguugggacugcu

SEQ ID NO: 2654877 - RNA, 18 nt, Human
ugcugaauguugggacug

SEQ ID NO: 2654878 - RNA, 21 nt, Human
ugcugcaggacuugagaagac

SEQ ID NO: 2654879 - RNA, 19 nt, Human
ugcuccuggcccacugcau

SEQ ID NO: 2654880 - RNA, 23 nt, Human
ugcugaauacagaggcaacugca

SEQ ID NO: 2654881 - RNA, 18 nt, Human
ugcugaauacagaggcaa

SEQ ID NO: 2654882 - RNA, 23 nt, Human
ugcacgguuucgaagucauuaaa

SEQ ID NO: 2654883 - RNA, 22 nt, Human
ugcacgguuucgaagucauuaa

SEQ ID NO: 2654884 - RNA, 17 nt, Human
ugcacuugugauuauuu

SEQ ID NO: 2654885 - RNA, 20 nt, Human
ugcacuugugauuauuuauu

SEQ ID NO: 2654886 - RNA, 14 nt, Human
ugcaggaccucagg

SEQ ID NO: 2654887 - RNA, 14 nt, Human
ugcagcuuugcaaa

SEQ ID NO: 2654888 - RNA, 15 nt, Human
ugcagcuuugcaaac

SEQ ID NO: 2654889 - RNA, 16 nt, Human
ugcaggaccucaggug

SEQ ID NO: 2654890 - RNA, 15 nt, Human
ugcaggaccucaggu

SEQ ID NO: 2654891 - RNA, 18 nt, Human
ugcaggaccucaggugag

SEQ ID NO: 2654892 - RNA, 20 nt, Human
ugcacauccgcgugugccug

SEQ ID NO: 2654893 - RNA, 21 nt, Human
ugcacauccgcgugugccugu

SEQ ID NO: 2654894 - RNA, 22 nt, Human
ugcacauccgcgugugccugug

SEQ ID NO: 2654895 - RNA, 21 nt, Human
ugcacauaagcuuccauuuua

SEQ ID NO: 2654896 - RNA, 22 nt, Human
ugcacauaagcuuccauuuuaa

SEQ ID NO: 2654897 - RNA, 19 nt, Human
ugaagucuuuaauaaauaa

SEQ ID NO: 2654898 - RNA, 23 nt, Human
ugaagucuuaaggacaaagugcc

SEQ ID NO: 2654899 - RNA, 21 nt, Human
ugaagucuuacuacagaaaug

SEQ ID NO: 2654900 - RNA, 20 nt, Human
ugcacagccacuccccggca

SEQ ID NO: 2654901 - RNA, 12 nt, Human
ugccaucuguag

SEQ ID NO: 2654902 - RNA, 14 nt, Human
ugccaucgcuguga

SEQ ID NO: 2654903 - RNA, 16 nt, Human
ugccaucuagccagcc

SEQ ID NO: 2654904 - RNA, 17 nt, Human
ugccaucuagccagccc

SEQ ID NO: 2654905 - RNA, 18 nt, Human
ugccaucuagccagcccc

SEQ ID NO: 2654906 - RNA, 16 nt, Human
ugccaucuaucuaguu

SEQ ID NO: 2654907 - RNA, 11 nt, Human
ugcccaccccc

SEQ ID NO: 2654908 - RNA, 13 nt, Human
ugcccacccccug

SEQ ID NO: 2654909 - RNA, 14 nt, Human
ugcccacccccugc

SEQ ID NO: 2654910 - RNA, 15 nt, Human
ugcccacccccugcc

SEQ ID NO: 2654911 - RNA, 16 nt, Human
ugcccacccccugccc

SEQ ID NO: 2654912 - RNA, 18 nt, Human
ugcccacccccugcccug

SEQ ID NO: 2654913 - RNA, 19 nt, Human
ugcccacccccugcccugc

SEQ ID NO: 2654914 - RNA, 20 nt, Human
ugcccacccccugcccugca

SEQ ID NO: 2654915 - RNA, 18 nt, Human
ugcaggacuugagaagac

SEQ ID NO: 2654916 - RNA, 15 nt, Human
ugcaggacuugagaa

SEQ ID NO: 2654917 - RNA, 13 nt, Human
ugcaggacuugag

SEQ ID NO: 2654918 - RNA, 15 nt, Human
ugcaucguuucaucu

SEQ ID NO: 2654919 - RNA, 14 nt, Human
ugcaugucuuuuaa

SEQ ID NO: 2654920 - RNA, 20 nt, Human
ugcaugucaaacaugagaug

SEQ ID NO: 2654921 - RNA, 14 nt, Human
ugcauccagaggca

SEQ ID NO: 2654922 - RNA, 21 nt, Human
ugcauccagccuggggcugag

SEQ ID NO: 2654923 - RNA, 11 nt, Human
ugcauuuuugu

SEQ ID NO: 2654924 - RNA, 14 nt, Human
ugcauuuuuguaaa

SEQ ID NO: 2654925 - RNA, 15 nt, Human
ugcauuuuuguaaau

SEQ ID NO: 2654926 - RNA, 22 nt, Human
ugcauuuuuguaaauguguaca

SEQ ID NO: 2654927 - RNA, 14 nt, Human
uggcacuugccugg

SEQ ID NO: 2654928 - RNA, 15 nt, Human
uggcacuugccuggg

SEQ ID NO: 2654929 - RNA, 16 nt, Human
uggcacuugccugggu

SEQ ID NO: 2654930 - RNA, 17 nt, Human
uggcacuugccuggguc

SEQ ID NO: 2654931 - RNA, 18 nt, Human
uggcacuugccuggguca

SEQ ID NO: 2654932 - RNA, 20 nt, Human
uggcagaaaaaaugucugua

SEQ ID NO: 2654933 - RNA, 21 nt, Human
uggcagaaaaaaugucuguaa

SEQ ID NO: 2654934 - RNA, 22 nt, Human
uggaugccagggccgaccagag

SEQ ID NO: 2654935 - RNA, 12 nt, Human
uggcaggcuggc

SEQ ID NO: 2654936 - RNA, 13 nt, Human
uggcaggcuggcc

SEQ ID NO: 2654937 - RNA, 14 nt, Human
uggcaggcuggcca

SEQ ID NO: 2654938 - RNA, 15 nt, Human
uggcaggcuggccag

SEQ ID NO: 2654939 - RNA, 18 nt, Human
uggcaggcuggccagucc

SEQ ID NO: 2654940 - RNA, 23 nt, Human
uggccagagagccuggugcugcu

SEQ ID NO: 2654941 - RNA, 13 nt, Human
uggccagagagcc

SEQ ID NO: 2654942 - RNA, 20 nt, Human
uggccacuccgagagguggg

SEQ ID NO: 2654943 - RNA, 23 nt, Human
uggccacuccgagaggugggcca

SEQ ID NO: 2654944 - RNA, 12 nt, Human
uggcagugguuu

SEQ ID NO: 2654945 - RNA, 14 nt, Human
uggccacuccgaga

SEQ ID NO: 2654946 - RNA, 18 nt, Human
uggccacuccgagaggug

SEQ ID NO: 2654947 - RNA, 13 nt, Human
uggaggcuuccug

SEQ ID NO: 2654948 - RNA, 15 nt, Human
uggaggcuuccugcg

SEQ ID NO: 2654949 - RNA, 16 nt, Human
uggaggcuuccugcgu

SEQ ID NO: 2654950 - RNA, 17 nt, Human
uggaggcuuccugcguc

SEQ ID NO: 2654951 - RNA, 15 nt, Human
uggagauuauaauaa

SEQ ID NO: 2654952 - RNA, 16 nt, Human
uggagauuauaauaaa

SEQ ID NO: 2654953 - RNA, 19 nt, Human
uggagauuauaauaaauau

SEQ ID NO: 2654954 - RNA, 21 nt, Human
uggagacuuagggcaccaggg

SEQ ID NO: 2654955 - RNA, 16 nt, Human
uggagacuuagggcac

SEQ ID NO: 2654956 - RNA, 16 nt, Human
uggaaaaguguccuuc

SEQ ID NO: 2654957 - RNA, 22 nt, Human
uggaacccuuuuaaaguugaua

SEQ ID NO: 2654958 - RNA, 23 nt, Human
uggaaucccacuaaugcaaacug

SEQ ID NO: 2654959 - RNA, 23 nt, Human
uggaaucaggaauauuuuccaaa

SEQ ID NO: 2654960 - RNA, 21 nt, Human
uggaaucaggaauauuuucca

SEQ ID NO: 2654961 - RNA, 22 nt, Human
uggaaucaggaauauuuuccaa

SEQ ID NO: 2654962 - RNA, 18 nt, Human
uggaaucuggagaccagg

SEQ ID NO: 2654963 - RNA, 17 nt, Human
uggaaucuggagaccag

SEQ ID NO: 2654964 - RNA, 23 nt, Human
ugcuucucugacuucugccugga

SEQ ID NO: 2654965 - RNA, 21 nt, Human
ugcuucucugacuucugccug

SEQ ID NO: 2654966 - RNA, 22 nt, Human
ugcuucucugacuucugccugg

SEQ ID NO: 2654967 - RNA, 13 nt, Human
ugcuucugccacc

SEQ ID NO: 2654968 - RNA, 12 nt, Human
ugcuucugccac

SEQ ID NO: 2654969 - RNA, 23 nt, Human
ugcugcagcaccgaggggccuuu

SEQ ID NO: 2654970 - RNA, 14 nt, Human
ugcuucucugacuu

SEQ ID NO: 2654971 - RNA, 17 nt, Human
ugcuucucugacuucug

SEQ ID NO: 2654972 - RNA, 19 nt, Human
ugcuucucugacuucugcc

SEQ ID NO: 2654973 - RNA, 20 nt, Human
ugcuucucugacuucugccu

SEQ ID NO: 2654974 - RNA, 19 nt, Human
ugcuuuagacuugaaaaga

SEQ ID NO: 2654975 - RNA, 21 nt, Human
ugcuuuagacuugaaaagaga

SEQ ID NO: 2654976 - RNA, 20 nt, Human
ugcuuuccaaaccuuaucuc

SEQ ID NO: 2654977 - RNA, 14 nt, Human
ugcuuuccaaaccu

SEQ ID NO: 2654978 - RNA, 16 nt, Human
ugcuuucagaagugcc

SEQ ID NO: 2654979 - RNA, 23 nt, Human
ugcuuucagaagugcccuuccug

SEQ ID NO: 2654980 - RNA, 13 nt, Human
ugcuuuauuugua

SEQ ID NO: 2654981 - RNA, 14 nt, Human
ugcuuuauuuguaa

SEQ ID NO: 2654982 - RNA, 15 nt, Human
ugcuuuauuuguaaa

SEQ ID NO: 2654983 - RNA, 16 nt, Human
ugcuuuauuuguaaau

SEQ ID NO: 2654984 - RNA, 23 nt, Human
ugcuuuauuuguaaauuuagugu

SEQ ID NO: 2654985 - RNA, 17 nt, Human
ugcuuuuuuguuuuggc

SEQ ID NO: 2654986 - RNA, 16 nt, Human
ugcuuuuuguguuuuu

SEQ ID NO: 2654987 - RNA, 15 nt, Human
ugcuuuauuaauguu

SEQ ID NO: 2654988 - RNA, 17 nt, Human
ugcuuuauuaauguuuu

SEQ ID NO: 2654989 - RNA, 18 nt, Human
ugcuuuauuaauguuuuc

SEQ ID NO: 2654990 - RNA, 20 nt, Human
ugcuuuauuaauguuuucaa

SEQ ID NO: 2654991 - RNA, 21 nt, Human
ugcuuuauuaauguuuucaaa

SEQ ID NO: 2654992 - RNA, 23 nt, Human
ugcuuuauuaauguuuucaaaag

SEQ ID NO: 2654993 - RNA, 21 nt, Human
ugggguggggggggguccuaa

SEQ ID NO: 2654994 - RNA, 23 nt, Human
uggguaggaaagaggaagcaaau

SEQ ID NO: 2654995 - RNA, 14 nt, Human
uggggcaggcuggg

SEQ ID NO: 2654996 - RNA, 15 nt, Human
uggggcaggcugggc

SEQ ID NO: 2654997 - RNA, 16 nt, Human
uggggcaggcugggcc

SEQ ID NO: 2654998 - RNA, 17 nt, Human
uggggcaggcugggcca

SEQ ID NO: 2654999 - RNA, 18 nt, Human
uggggcaggcugggccau

SEQ ID NO: 2655000 - RNA, 20 nt, Human
uggggcaggcugggccaugu

SEQ ID NO: 2655001 - RNA, 12 nt, Human
uggggcagggag

SEQ ID NO: 2655002 - RNA, 13 nt, Human
uggggcagggagc

SEQ ID NO: 2655003 - RNA, 14 nt, Human
uggggcagggagcu

SEQ ID NO: 2655004 - RNA, 21 nt, Human
uggggcagggagcugggcccg

SEQ ID NO: 2655005 - RNA, 17 nt, Human
uggggcauccugugcca

SEQ ID NO: 2655006 - RNA, 14 nt, Human
uggguuccuccucu

SEQ ID NO: 2655007 - RNA, 17 nt, Human
ugggugucuccuuaagc

SEQ ID NO: 2655008 - RNA, 14 nt, Human
ugggcggcugugcu

SEQ ID NO: 2655009 - RNA, 15 nt, Human
ugggcuuggccugcu

SEQ ID NO: 2655010 - RNA, 16 nt, Human
ugggcuuggccugcug

SEQ ID NO: 2655011 - RNA, 14 nt, Human
ugggcuuggccugc

SEQ ID NO: 2655012 - RNA, 19 nt, Human
ugggcuuggccugcuguga

SEQ ID NO: 2655013 - RNA, 17 nt, Human
ugggcuuggccugcugu

SEQ ID NO: 2655014 - RNA, 18 nt, Human
ugggcuuggccugcugug

SEQ ID NO: 2655015 - RNA, 13 nt, Human
ugggagccagccu

SEQ ID NO: 2655016 - RNA, 14 nt, Human
ugggaggagggaga

SEQ ID NO: 2655017 - RNA, 13 nt, Human
ugggaggagcaga

SEQ ID NO: 2655018 - RNA, 13 nt, Human
ugggaggagggag

SEQ ID NO: 2655019 - RNA, 18 nt, Human
ugggaggagcagauuuuu

SEQ ID NO: 2655020 - RNA, 22 nt, Human
uggcuuuuauuaaugcacuuuc

SEQ ID NO: 2655021 - RNA, 14 nt, Human
ugggaaugaggugg

SEQ ID NO: 2655022 - RNA, 17 nt, Human
ugggaaugaggugggag

SEQ ID NO: 2655023 - RNA, 13 nt, Human
uggcuguaaucau

SEQ ID NO: 2655024 - RNA, 16 nt, Human
uggcuguaaucauuug

SEQ ID NO: 2655025 - RNA, 22 nt, Human
uggcuguaaucauuuguuuaca

SEQ ID NO: 2655026 - RNA, 18 nt, Human
uggcugucaaugggaccu

SEQ ID NO: 2655027 - RNA, 22 nt, Human
uggcugucaaugggaccugugg

SEQ ID NO: 2655028 - RNA, 17 nt, Human
uggcuuuuauuaaugca

SEQ ID NO: 2655029 - RNA, 20 nt, Human
uggcuuuuauuaaugcacuu

SEQ ID NO: 2655030 - RNA, 21 nt, Human
uggcuuuuauuaaugcacuuu

SEQ ID NO: 2655031 - RNA, 14 nt, Human
ugggacccccgugg

SEQ ID NO: 2655032 - RNA, 17 nt, Human
ugggacccccguggggc

SEQ ID NO: 2655033 - RNA, 22 nt, Human
ugggacccccguggggcaggga

SEQ ID NO: 2655034 - RNA, 16 nt, Human
ugggaaugaggaaaau

SEQ ID NO: 2655035 - RNA, 16 nt, Human
ugggagcuccacucug

SEQ ID NO: 2655036 - RNA, 19 nt, Human
ugggagcuccacucugcuu

SEQ ID NO: 2655037 - RNA, 22 nt, Human
ugggagcuccacucugcuucuc

SEQ ID NO: 2655038 - RNA, 20 nt, Human
ugggagccaugccgucugcc

SEQ ID NO: 2655039 - RNA, 18 nt, Human
uggccagaggugucaccc

SEQ ID NO: 2655040 - RNA, 20 nt, Human
uggccuuguccucagccagu

SEQ ID NO: 2655041 - RNA, 15 nt, Human
uggcauaaauugcau

SEQ ID NO: 2655042 - RNA, 17 nt, Human
uggccuuuguaagugca

SEQ ID NO: 2655043 - RNA, 18 nt, Human
uggccuuuguaagugcag

SEQ ID NO: 2655044 - RNA, 19 nt, Human
uggccuuuguaagugcagg

SEQ ID NO: 2655045 - RNA, 20 nt, Human
uggccuuuguaagugcagga

SEQ ID NO: 2655046 - RNA, 18 nt, Human
uggcgccgucuccagggg

SEQ ID NO: 2655047 - RNA, 15 nt, Human
uggcgccgucuccag

SEQ ID NO: 2655048 - RNA, 17 nt, Human
uggcgccgucuccaggg

SEQ ID NO: 2655049 - RNA, 17 nt, Human
uggcgccaccagcucug

SEQ ID NO: 2655050 - RNA, 14 nt, Human
uggcgcaggugggc

SEQ ID NO: 2655051 - RNA, 16 nt, Human
uggcgcaggugggcug

SEQ ID NO: 2655052 - RNA, 21 nt, Human
uggcgcaggugggcuggacuu

SEQ ID NO: 2655053 - RNA, 12 nt, Human
uggcgugacccg

SEQ ID NO: 2655054 - RNA, 21 nt, Human
uggcgugacccgaccuggccg

SEQ ID NO: 2655055 - RNA, 17 nt, Human
uggcgugggagccagcc

SEQ ID NO: 2655056 - RNA, 18 nt, Human
uggcgugggagccagccu

SEQ ID NO: 2655057 - RNA, 14 nt, Human
uggcucaggguggu

SEQ ID NO: 2655058 - RNA, 12 nt, Human
uggcuccugauc

SEQ ID NO: 2655059 - RNA, 18 nt, Human
uggcucgaaucucugugc

SEQ ID NO: 2655060 - RNA, 19 nt, Human
uggcucgaaucucugugcc

SEQ ID NO: 2655061 - RNA, 20 nt, Human
uggcucgaaucucugugccu

SEQ ID NO: 2655062 - RNA, 21 nt, Human
uggcucgaaucucugugccuu

SEQ ID NO: 2655063 - RNA, 15 nt, Human
uggcucugggauccu

SEQ ID NO: 2655064 - RNA, 18 nt, Human
uggcucugggauccuggg

SEQ ID NO: 2655065 - RNA, 13 nt, Human
uuaacauuauuua

SEQ ID NO: 2655066 - RNA, 15 nt, Human
uuaacauucauagag

SEQ ID NO: 2655067 - RNA, 13 nt, Human
uuaacaucaguuu

SEQ ID NO: 2655068 - RNA, 22 nt, Human
uuaaaugguaauaagcacugua

SEQ ID NO: 2655069 - RNA, 12 nt, Human
uguuuuugugaa

SEQ ID NO: 2655070 - RNA, 23 nt, Human
uuaaaacaucauuccuuuuuauu

SEQ ID NO: 2655071 - RNA, 14 nt, Human
uuaaaaccaaagag

SEQ ID NO: 2655072 - RNA, 18 nt, Human
uuaaaacaucauuccuuu

SEQ ID NO: 2655073 - RNA, 16 nt, Human
uuaaaacaucauuccu

SEQ ID NO: 2655074 - RNA, 14 nt, Human
uuaaagagaaugag

SEQ ID NO: 2655075 - RNA, 15 nt, Human
uuaaagagaaugagu

SEQ ID NO: 2655076 - RNA, 13 nt, Human
uguuuuguaaaca

SEQ ID NO: 2655077 - RNA, 16 nt, Human
uguuuuguaaacauuu

SEQ ID NO: 2655078 - RNA, 17 nt, Human
uguuuuguaaacauuua

SEQ ID NO: 2655079 - RNA, 18 nt, Human
uguuuuguaaacauuuau

SEQ ID NO: 2655080 - RNA, 21 nt, Human
uguuuuuauacaaaauaagaa

SEQ ID NO: 2655081 - RNA, 12 nt, Human
uguuuuaaagaa

SEQ ID NO: 2655082 - RNA, 19 nt, Human
uguuuuaaagaauaugacu

SEQ ID NO: 2655083 - RNA, 22 nt, Human
uguuuuaaagaauaugacuuuu

SEQ ID NO: 2655084 - RNA, 18 nt, Human
uguuuuaaaacuggaccu

SEQ ID NO: 2655085 - RNA, 17 nt, Human
uguuuuggauggcuugu

SEQ ID NO: 2655086 - RNA, 18 nt, Human
uguuuuggcugaaauucu

SEQ ID NO: 2655087 - RNA, 23 nt, Human
uguuuuggcugaaauucuccugg

SEQ ID NO: 2655088 - RNA, 13 nt, Human
uguuuuugucuua

SEQ ID NO: 2655089 - RNA, 12 nt, Human
uguuuuuuaaga

SEQ ID NO: 2655090 - RNA, 14 nt, Human
uguuuuuuaagaua

SEQ ID NO: 2655091 - RNA, 16 nt, Human
uguuuuuuaagauagu

SEQ ID NO: 2655092 - RNA, 20 nt, Human
uguuuuuuaagauaguguaa

SEQ ID NO: 2655093 - RNA, 21 nt, Human
uguuuuuuaagauaguguaac

SEQ ID NO: 2655094 - RNA, 20 nt, Human
uuaaaacacauguuuuuaua

SEQ ID NO: 2655095 - RNA, 13 nt, Human
uuaaaacacguuu

SEQ ID NO: 2655096 - RNA, 21 nt, Human
uuaaaacacguuuuaaggacu

SEQ ID NO: 2655097 - RNA, 19 nt, Human
uuaaaacacguuuuaagga

SEQ ID NO: 2655098 - RNA, 23 nt, Human
uuaaaacacguuuuaaggacuga

SEQ ID NO: 2655099 - RNA, 22 nt, Human
uuaaaacacguuuuaaggacug

SEQ ID NO: 2655100 - RNA, 22 nt, Human
uguuuuuucuuuuuuuuuaagu

SEQ ID NO: 2655101 - RNA, 17 nt, Human
uguuuuaaaauaaggau

SEQ ID NO: 2655102 - RNA, 21 nt, Human
uguuuaaucauaguuacugug

SEQ ID NO: 2655103 - RNA, 13 nt, Human
uguuucucugaaa

SEQ ID NO: 2655104 - RNA, 18 nt, Human
uguuucucuugagcuggc

SEQ ID NO: 2655105 - RNA, 16 nt, Human
uguuuguugucagcug

SEQ ID NO: 2655106 - RNA, 17 nt, Human
uguuuguugucagcuga

SEQ ID NO: 2655107 - RNA, 22 nt, Human
uguuucucuuugauuauuugca

SEQ ID NO: 2655108 - RNA, 20 nt, Human
uguuucucuugagcuggccu

SEQ ID NO: 2655109 - RNA, 13 nt, Human
uguuucugaaaag

SEQ ID NO: 2655110 - RNA, 16 nt, Human
uguuucuauuuuuuga

SEQ ID NO: 2655111 - RNA, 22 nt, Human
uguuucuauuuuuugaaaagca

SEQ ID NO: 2655112 - RNA, 15 nt, Human
uguuucuccugagcu

SEQ ID NO: 2655113 - RNA, 13 nt, Human
uuaagggaaaaau

SEQ ID NO: 2655114 - RNA, 15 nt, Human
uuaagggaaaaauau

SEQ ID NO: 2655115 - RNA, 16 nt, Human
uuaagggaaaaauaua

SEQ ID NO: 2655116 - RNA, 15 nt, Human
uuaagggaaagaaaa

SEQ ID NO: 2655117 - RNA, 23 nt, Human
uuaaggaaaacuaccuguauuua

SEQ ID NO: 2655118 - RNA, 21 nt, Human
uuaaggaagacaaugugaaaa

SEQ ID NO: 2655119 - RNA, 22 nt, Human
uuaaggacaaagugccaaagaa

SEQ ID NO: 2655120 - RNA, 18 nt, Human
uuaaggacugacugaggc

SEQ ID NO: 2655121 - RNA, 16 nt, Human
uuaaggacugacugag

SEQ ID NO: 2655122 - RNA, 15 nt, Human
uuaaggacugacuga

SEQ ID NO: 2655123 - RNA, 20 nt, Human
uuaauggaaguguauuuauu

SEQ ID NO: 2655124 - RNA, 14 nt, Human
uuaaugcuacaugu

SEQ ID NO: 2655125 - RNA, 14 nt, Human
uuaaugcuauuuga

SEQ ID NO: 2655126 - RNA, 16 nt, Human
uuaaugcuauuugaac

SEQ ID NO: 2655127 - RNA, 20 nt, Human
uuaaugcuauuugaacaagu

SEQ ID NO: 2655128 - RNA, 21 nt, Human
uuaaugcuauuugaacaagug

SEQ ID NO: 2655129 - RNA, 17 nt, Human
uuaauagggaauauauc

SEQ ID NO: 2655130 - RNA, 23 nt, Human
uuaauagucaucacauuucuaug

SEQ ID NO: 2655131 - RNA, 22 nt, Human
uuaauauaaaguaguccuguga

SEQ ID NO: 2655132 - RNA, 16 nt, Human
uuacauguuuauaaau

SEQ ID NO: 2655133 - RNA, 20 nt, Human
uuacauuugaugcaugucuu

SEQ ID NO: 2655134 - RNA, 15 nt, Human
uuacauguaauuuga

SEQ ID NO: 2655135 - RNA, 16 nt, Human
uuacauguaauuugau

SEQ ID NO: 2655136 - RNA, 20 nt, Human
uuacauguaauuugaugagg

SEQ ID NO: 2655137 - RNA, 21 nt, Human
uuacagagguauuaaaacuaa

SEQ ID NO: 2655138 - RNA, 20 nt, Human
uuacagaugaauguauuuau

SEQ ID NO: 2655139 - RNA, 15 nt, Human
uuaauucacucccac

SEQ ID NO: 2655140 - RNA, 15 nt, Human
uuaauucaugaggag

SEQ ID NO: 2655141 - RNA, 17 nt, Human
uuacaauaguucugugg

SEQ ID NO: 2655142 - RNA, 21 nt, Human
uuacaauauugauugggaaaa

SEQ ID NO: 2655143 - RNA, 15 nt, Human
uuacaauaguucugu

SEQ ID NO: 2655144 - RNA, 12 nt, Human
uuacaaucaaag

SEQ ID NO: 2655145 - RNA, 17 nt, Human
uuacaaguuuauauaua

SEQ ID NO: 2655146 - RNA, 17 nt, Human
uuacaauaggaguggug

SEQ ID NO: 2655147 - RNA, 22 nt, Human
uuaccagagguugugcacuguu

SEQ ID NO: 2655148 - RNA, 19 nt, Human
uuaccuuuuuuuuuucuug

SEQ ID NO: 2655149 - RNA, 14 nt, Human
uuacggguaccuga

SEQ ID NO: 2655150 - RNA, 20 nt, Human
uuacgguuuuccagguuuaa

SEQ ID NO: 2655151 - RNA, 20 nt, Human
uuacgaaguucaagaucaaa

SEQ ID NO: 2655152 - RNA, 19 nt, Human
uuacgaaguucaagaucaa

SEQ ID NO: 2655153 - RNA, 17 nt, Human
ugugugucaguuuucau

SEQ ID NO: 2655154 - RNA, 18 nt, Human
ugugugucaugccaguga

SEQ ID NO: 2655155 - RNA, 22 nt, Human
uguguuuagaauugaagguuuu

SEQ ID NO: 2655156 - RNA, 14 nt, Human
uguguuuauaaaau

SEQ ID NO: 2655157 - RNA, 18 nt, Human
uguguuuagaauugaagg

SEQ ID NO: 2655158 - RNA, 17 nt, Human
uguguuuagaauugaag

SEQ ID NO: 2655159 - RNA, 19 nt, Human
uguguguccccuugcagcc

SEQ ID NO: 2655160 - RNA, 15 nt, Human
ugugugucccaggca

SEQ ID NO: 2655161 - RNA, 16 nt, Human
ugugugucccaggcag

SEQ ID NO: 2655162 - RNA, 19 nt, Human
ugugugucccaggcaggga

SEQ ID NO: 2655163 - RNA, 14 nt, Human
ugugugacaauucu

SEQ ID NO: 2655164 - RNA, 15 nt, Human
ugugugacaauucug

SEQ ID NO: 2655165 - RNA, 20 nt, Human
ugugugacaauucuguuuuu

SEQ ID NO: 2655166 - RNA, 19 nt, Human
uguguagcauacuggcuuc

SEQ ID NO: 2655167 - RNA, 19 nt, Human
uguguauauauuuugugug

SEQ ID NO: 2655168 - RNA, 22 nt, Human
uguguauauauuuugugugaaa

SEQ ID NO: 2655169 - RNA, 21 nt, Human
uguguauauuugauuuauuaa

SEQ ID NO: 2655170 - RNA, 15 nt, Human
uguguauauuugauu

SEQ ID NO: 2655171 - RNA, 13 nt, Human
uguguauauggua

SEQ ID NO: 2655172 - RNA, 12 nt, Human
uguguuuuauaa

SEQ ID NO: 2655173 - RNA, 16 nt, Human
uguuacugucuucagu

SEQ ID NO: 2655174 - RNA, 15 nt, Human
uguuacugucuucag

SEQ ID NO: 2655175 - RNA, 15 nt, Human
uguuacuuuauacag

SEQ ID NO: 2655176 - RNA, 12 nt, Human
uguuaaagagaa

SEQ ID NO: 2655177 - RNA, 16 nt, Human
uguuaaagagaaugag

SEQ ID NO: 2655178 - RNA, 16 nt, Human
uguucacaauauauuu

SEQ ID NO: 2655179 - RNA, 11 nt, Human
uguucagcugg

SEQ ID NO: 2655180 - RNA, 19 nt, Human
uguuagauauuuuucauaa

SEQ ID NO: 2655181 - RNA, 20 nt, Human
uguuagauauuuuucauaaa

SEQ ID NO: 2655182 - RNA, 23 nt, Human
uguuagauauuuuucauaaacaa

SEQ ID NO: 2655183 - RNA, 14 nt, Human
uguuaguggcaccg

SEQ ID NO: 2655184 - RNA, 12 nt, Human
uguuuaaaauaa

SEQ ID NO: 2655185 - RNA, 14 nt, Human
uguuuaaaauaaaa

SEQ ID NO: 2655186 - RNA, 15 nt, Human
uguuuaaaauaaaau

SEQ ID NO: 2655187 - RNA, 18 nt, Human
uguuuaaaauaaaaugaa

SEQ ID NO: 2655188 - RNA, 19 nt, Human
uguuuaaaauaaaaugaaa

SEQ ID NO: 2655189 - RNA, 21 nt, Human
uguuuaaaauaaaaugaaaau

SEQ ID NO: 2655190 - RNA, 22 nt, Human
uguuuaaaauaaaaugaaaauu

SEQ ID NO: 2655191 - RNA, 20 nt, Human
uguuuaauauugagaaagaa

SEQ ID NO: 2655192 - RNA, 15 nt, Human
uguuguuuauaauaa

SEQ ID NO: 2655193 - RNA, 20 nt, Human
uguuguuuauaauaaaaaua

SEQ ID NO: 2655194 - RNA, 21 nt, Human
uguuguuuauaauaaaaauau

SEQ ID NO: 2655195 - RNA, 23 nt, Human
uguuguucuuggcaauaaauuuu

SEQ ID NO: 2655196 - RNA, 16 nt, Human
uguuguucuuucagaa

SEQ ID NO: 2655197 - RNA, 18 nt, Human
uguuguucuuucagaaag

SEQ ID NO: 2655198 - RNA, 19 nt, Human
uguuguucuuggcaauaaa

SEQ ID NO: 2655199 - RNA, 20 nt, Human
uguuuaaaaaccgaauaaau

SEQ ID NO: 2655200 - RNA, 21 nt, Human
uguuuaaaaaccgaauaaaug

SEQ ID NO: 2655201 - RNA, 22 nt, Human
uguuuaaaaaccgaauaaaugu

SEQ ID NO: 2655202 - RNA, 12 nt, Human
uguuuaaaacac

SEQ ID NO: 2655203 - RNA, 20 nt, Human
uguuuaaaacaccuucuaua

SEQ ID NO: 2655204 - RNA, 19 nt, Human
uguugcuguacaaaagcaa

SEQ ID NO: 2655205 - RNA, 23 nt, Human
uguugagcaagcaguagcauuug

SEQ ID NO: 2655206 - RNA, 14 nt, Human
uguugagcaagcag

SEQ ID NO: 2655207 - RNA, 13 nt, Human
uguugagagguuc

SEQ ID NO: 2655208 - RNA, 13 nt, Human
uguucaguaauaa

SEQ ID NO: 2655209 - RNA, 18 nt, Human
uguucacucacucuaaag

SEQ ID NO: 2655210 - RNA, 22 nt, Human
uguucucagaaucccuuaacag

SEQ ID NO: 2655211 - RNA, 23 nt, Human
ugucauaguucugagcugccagu

SEQ ID NO: 2655212 - RNA, 20 nt, Human
uguccaugcgcucagggcca

SEQ ID NO: 2655213 - RNA, 22 nt, Human
uguccaugcgcucagggccaug

SEQ ID NO: 2655214 - RNA, 17 nt, Human
ugucauugcacauaagc

SEQ ID NO: 2655215 - RNA, 21 nt, Human
ugucauugcacauaagcuucc

SEQ ID NO: 2655216 - RNA, 19 nt, Human
ugucauucagagucagcca

SEQ ID NO: 2655217 - RNA, 22 nt, Human
ugucauucagagucagccagga

SEQ ID NO: 2655218 - RNA, 19 nt, Human
ugucccauagucccugcca

SEQ ID NO: 2655219 - RNA, 18 nt, Human
ugucccauagucccugcc

SEQ ID NO: 2655220 - RNA, 14 nt, Human
ugucccaggcaggg

SEQ ID NO: 2655221 - RNA, 17 nt, Human
ugucccaggcagggaga

SEQ ID NO: 2655222 - RNA, 20 nt, Human
ugucauacucgagucugagg

SEQ ID NO: 2655223 - RNA, 21 nt, Human
ugucauaacauccagagcuuu

SEQ ID NO: 2655224 - RNA, 23 nt, Human
ugucauaacauccagagcuuugu

SEQ ID NO: 2655225 - RNA, 14 nt, Human
ugucaguuuucaua

SEQ ID NO: 2655226 - RNA, 14 nt, Human
uguauuugcuuuuu

SEQ ID NO: 2655227 - RNA, 16 nt, Human
ugucacucauugcuga

SEQ ID NO: 2655228 - RNA, 15 nt, Human
ugucacucauugcug

SEQ ID NO: 2655229 - RNA, 23 nt, Human
ugucacucauugcugagccucug

SEQ ID NO: 2655230 - RNA, 22 nt, Human
ugucacucauugcugagccucu

SEQ ID NO: 2655231 - RNA, 21 nt, Human
ugucacucauugcugagccuc

SEQ ID NO: 2655232 - RNA, 16 nt, Human
uguauucuuuucucag

SEQ ID NO: 2655233 - RNA, 18 nt, Human
uguauucuuuucucagug

SEQ ID NO: 2655234 - RNA, 19 nt, Human
uguauucuuuucucagugu

SEQ ID NO: 2655235 - RNA, 16 nt, Human
uguaugcacaguaaaa

SEQ ID NO: 2655236 - RNA, 14 nt, Human
uguauuuaacagaa

SEQ ID NO: 2655237 - RNA, 15 nt, Human
uguauuuaacagaaa

SEQ ID NO: 2655238 - RNA, 16 nt, Human
uguauuuaacagaaau

SEQ ID NO: 2655239 - RNA, 21 nt, Human
uguauuuaacagaaauuguau

SEQ ID NO: 2655240 - RNA, 13 nt, Human
uguauuugaaagu

SEQ ID NO: 2655241 - RNA, 12 nt, Human
uguauuugaaag

SEQ ID NO: 2655242 - RNA, 17 nt, Human
uguauuugaaauaagaa

SEQ ID NO: 2655243 - RNA, 15 nt, Human
uguauuugagcauau

SEQ ID NO: 2655244 - RNA, 16 nt, Human
uguauuguauauuaca

SEQ ID NO: 2655245 - RNA, 18 nt, Human
uguauuguauauuacaau

SEQ ID NO: 2655246 - RNA, 13 nt, Human
uguauaauauaaa

SEQ ID NO: 2655247 - RNA, 16 nt, Human
uguauaauauaaaaaa

SEQ ID NO: 2655248 - RNA, 14 nt, Human
uguauaauaagaaa

SEQ ID NO: 2655249 - RNA, 20 nt, Human
uguagcaaccuucugcauuc

SEQ ID NO: 2655250 - RNA, 19 nt, Human
uguagcacuuacugguagg

SEQ ID NO: 2655251 - RNA, 15 nt, Human
uguagcacuuacugg

SEQ ID NO: 2655252 - RNA, 13 nt, Human
uguagauuugauu

SEQ ID NO: 2655253 - RNA, 16 nt, Human
uguagauuugauuuuu

SEQ ID NO: 2655254 - RNA, 22 nt, Human
uguagcaaaauucuuaaguaug

SEQ ID NO: 2655255 - RNA, 17 nt, Human
uguauccuggaacaaua

SEQ ID NO: 2655256 - RNA, 18 nt, Human
uguauccuggaacaauau

SEQ ID NO: 2655257 - RNA, 19 nt, Human
uguauccuggaacaauauu

SEQ ID NO: 2655258 - RNA, 13 nt, Human
uguauacagugca

SEQ ID NO: 2655259 - RNA, 16 nt, Human
uguauacagugcagag

SEQ ID NO: 2655260 - RNA, 22 nt, Human
uguauacagugcagagccuucu

SEQ ID NO: 2655261 - RNA, 23 nt, Human
uguauacagugcagagccuucuc

SEQ ID NO: 2655262 - RNA, 15 nt, Human
ugguaguuucugugg

SEQ ID NO: 2655263 - RNA, 14 nt, Human
ugguaguuucugug

SEQ ID NO: 2655264 - RNA, 18 nt, Human
uguaaacagccucuuuuu

SEQ ID NO: 2655265 - RNA, 11 nt, Human
uguaaacauuu

SEQ ID NO: 2655266 - RNA, 13 nt, Human
uguaaacauuuau

SEQ ID NO: 2655267 - RNA, 14 nt, Human
uguaaauguaaacu

SEQ ID NO: 2655268 - RNA, 15 nt, Human
uguaaauguaaacuc

SEQ ID NO: 2655269 - RNA, 16 nt, Human
uguaaauguaaacuca

SEQ ID NO: 2655270 - RNA, 15 nt, Human
uguaaauguguacau

SEQ ID NO: 2655271 - RNA, 14 nt, Human
uguaaauuuagugu

SEQ ID NO: 2655272 - RNA, 15 nt, Human
uguaaauuuaguguu

SEQ ID NO: 2655273 - RNA, 16 nt, Human
uguaaauuauuuaugu

SEQ ID NO: 2655274 - RNA, 12 nt, Human
uguaaauucuga

SEQ ID NO: 2655275 - RNA, 14 nt, Human
uguaaauucugauu

SEQ ID NO: 2655276 - RNA, 13 nt, Human
uguaaauucugau

SEQ ID NO: 2655277 - RNA, 22 nt, Human
uguaaauucugauuucuuuuca

SEQ ID NO: 2655278 - RNA, 19 nt, Human
uguaaauucugauuucuuu

SEQ ID NO: 2655279 - RNA, 18 nt, Human
uguaaauucugauuucuu

SEQ ID NO: 2655280 - RNA, 15 nt, Human
uguaaauucugauuu

SEQ ID NO: 2655281 - RNA, 14 nt, Human
uguaaucauuuguu

SEQ ID NO: 2655282 - RNA, 19 nt, Human
uguaaucauuuguuuacau

SEQ ID NO: 2655283 - RNA, 23 nt, Human
uguacguggccauguaugaagcc

SEQ ID NO: 2655284 - RNA, 14 nt, Human
uguacuaaacagua

SEQ ID NO: 2655285 - RNA, 20 nt, Human
uguacuaaacaguaagauau

SEQ ID NO: 2655286 - RNA, 20 nt, Human
uguagaguuuugucauucag

SEQ ID NO: 2655287 - RNA, 12 nt, Human
uguagauuugau

SEQ ID NO: 2655288 - RNA, 14 nt, Human
uguacugaauuuuu

SEQ ID NO: 2655289 - RNA, 20 nt, Human
uguacugaauuuuuuuguaa

SEQ ID NO: 2655290 - RNA, 23 nt, Human
uguacugaauuuuuuuguaauaa

SEQ ID NO: 2655291 - RNA, 17 nt, Human
uguagaguguagacugu

SEQ ID NO: 2655292 - RNA, 14 nt, Human
uguacaguagauuu

SEQ ID NO: 2655293 - RNA, 20 nt, Human
uguaaugguaucuuaaagug

SEQ ID NO: 2655294 - RNA, 20 nt, Human
uguacaguagauuuuccaaa

SEQ ID NO: 2655295 - RNA, 17 nt, Human
uguacaguagauuuucc

SEQ ID NO: 2655296 - RNA, 18 nt, Human
uguacaguagauuuucca

SEQ ID NO: 2655297 - RNA, 19 nt, Human
ugugggggguaaucccugc

SEQ ID NO: 2655298 - RNA, 22 nt, Human
ugugggggguaaucccugcuuu

SEQ ID NO: 2655299 - RNA, 16 nt, Human
ugugggcuugaccagg

SEQ ID NO: 2655300 - RNA, 11 nt, Human
ugugggaaagc

SEQ ID NO: 2655301 - RNA, 15 nt, Human
ugugcuuccuccugc

SEQ ID NO: 2655302 - RNA, 21 nt, Human
uguggagaagcggcuggcagc

SEQ ID NO: 2655303 - RNA, 12 nt, Human
uguggagaagcg

SEQ ID NO: 2655304 - RNA, 23 nt, Human
uguggacuguggcacuugccugg

SEQ ID NO: 2655305 - RNA, 13 nt, Human
ugugccugugugc

SEQ ID NO: 2655306 - RNA, 15 nt, Human
ugugcgcucugugga

SEQ ID NO: 2655307 - RNA, 12 nt, Human
ugugccuggggu

SEQ ID NO: 2655308 - RNA, 15 nt, Human
ugugcuucacaguag

SEQ ID NO: 2655309 - RNA, 22 nt, Human
ugugcuucacaguagagccagc

SEQ ID NO: 2655310 - RNA, 15 nt, Human
ugugcuucugccacc

SEQ ID NO: 2655311 - RNA, 23 nt, Human
ugugcuucacaguagagccagcu

SEQ ID NO: 2655312 - RNA, 14 nt, Human
ugugcauaguuucu

SEQ ID NO: 2655313 - RNA, 15 nt, Human
ugugcauaguuucuu

SEQ ID NO: 2655314 - RNA, 16 nt, Human
ugugcauaguuucuuu

SEQ ID NO: 2655315 - RNA, 18 nt, Human
ugugcagucacuggaggu

SEQ ID NO: 2655316 - RNA, 17 nt, Human
ugugcagucacuggagg

SEQ ID NO: 2655317 - RNA, 13 nt, Human
ugucugguggccc

SEQ ID NO: 2655318 - RNA, 16 nt, Human
ugucuggguuugagaa

SEQ ID NO: 2655319 - RNA, 17 nt, Human
ugucuggguuugagaaa

SEQ ID NO: 2655320 - RNA, 19 nt, Human
ugucuggguuugagaaaug

SEQ ID NO: 2655321 - RNA, 14 nt, Human
ugucugguggcccc

SEQ ID NO: 2655322 - RNA, 16 nt, Human
ugucugguggccccgu

SEQ ID NO: 2655323 - RNA, 14 nt, Human
ugucugguuaaaaa

SEQ ID NO: 2655324 - RNA, 16 nt, Human
ugucugguuaaaaaau

SEQ ID NO: 2655325 - RNA, 14 nt, Human
ugugaaaauguguu

SEQ ID NO: 2655326 - RNA, 20 nt, Human
ugugcaauagacacauacau

SEQ ID NO: 2655327 - RNA, 21 nt, Human
ugugauacauuuuuuaagcuu

SEQ ID NO: 2655328 - RNA, 22 nt, Human
ugugauacauuuuuuaagcuuc

SEQ ID NO: 2655329 - RNA, 14 nt, Human
ugugagggagggga

SEQ ID NO: 2655330 - RNA, 22 nt, Human
ugugagggaggggaaaagcauu

SEQ ID NO: 2655331 - RNA, 12 nt, Human
ugugaauaaauu

SEQ ID NO: 2655332 - RNA, 18 nt, Human
ugugaauacugcuugaau

SEQ ID NO: 2655333 - RNA, 14 nt, Human
ugugaauacugcuu

SEQ ID NO: 2655334 - RNA, 21 nt, Human
ugugaauacugcuugaauaaa

SEQ ID NO: 2655335 - RNA, 17 nt, Human
ugugaaugccacugccu

SEQ ID NO: 2655336 - RNA, 14 nt, Human
ugugaauuuuuaag

SEQ ID NO: 2655337 - RNA, 15 nt, Human
ugugaauuuuuaagc

SEQ ID NO: 2655338 - RNA, 16 nt, Human
ugugaauuuuuaagcu

SEQ ID NO: 2655339 - RNA, 17 nt, Human
ugugaauuuuuaagcug

SEQ ID NO: 2655340 - RNA, 19 nt, Human
ugugaauuuuuaagcugca

SEQ ID NO: 2655341 - RNA, 22 nt, Human
ugugaauuuuuaagcugcaaau

SEQ ID NO: 2655342 - RNA, 15 nt, Human
ugugaauuuuuauug

SEQ ID NO: 2655343 - RNA, 16 nt, Human
ugugaauuuuuauugu

SEQ ID NO: 2655344 - RNA, 17 nt, Human
ugugaauuuuuauuguu

SEQ ID NO: 2655345 - RNA, 20 nt, Human
ugugaauuuuuauuguugua

SEQ ID NO: 2655346 - RNA, 16 nt, Human
ugugacauggugccug

SEQ ID NO: 2655347 - RNA, 17 nt, Human
ugugacauggugccuga

SEQ ID NO: 2655348 - RNA, 18 nt, Human
ugugacauggugccugag

SEQ ID NO: 2655349 - RNA, 20 nt, Human
ugugacauggugccugagag

SEQ ID NO: 2655350 - RNA, 22 nt, Human
ugugacauggugccugagaggc

SEQ ID NO: 2655351 - RNA, 19 nt, Human
ugugacaauuuuguacaaa

SEQ ID NO: 2655352 - RNA, 15 nt, Human
ugugacaauucuguu

SEQ ID NO: 2655353 - RNA, 19 nt, Human
ugugacaauucuguuuuua

SEQ ID NO: 2655354 - RNA, 21 nt, Human
ugugacaauucuguuuuuaau

SEQ ID NO: 2655355 - RNA, 12 nt, Human
uuggcauuugca

SEQ ID NO: 2655356 - RNA, 13 nt, Human
uuggcauuccgca

SEQ ID NO: 2655357 - RNA, 14 nt, Human
uuggccacuccgag

SEQ ID NO: 2655358 - RNA, 21 nt, Human
uuggccacuccgagagguggg

SEQ ID NO: 2655359 - RNA, 22 nt, Human
uuggccacuccgagaggugggc

SEQ ID NO: 2655360 - RNA, 20 nt, Human
uuggcauguaaauguaaacu

SEQ ID NO: 2655361 - RNA, 22 nt, Human
uuggccagccaacucugggaau

SEQ ID NO: 2655362 - RNA, 16 nt, Human
uugggaggccgaggcg

SEQ ID NO: 2655363 - RNA, 16 nt, Human
uugggaaacuuggcuc

SEQ ID NO: 2655364 - RNA, 16 nt, Human
uuggcuuaaucauuuu

SEQ ID NO: 2655365 - RNA, 12 nt, Human
uugggaaaacau

SEQ ID NO: 2655366 - RNA, 13 nt, Human
uugggaaaacaug

SEQ ID NO: 2655367 - RNA, 16 nt, Human
uugggaaaacauguua

SEQ ID NO: 2655368 - RNA, 15 nt, Human
uugggaaaacauuug

SEQ ID NO: 2655369 - RNA, 16 nt, Human
uugggaaaacauuugc

SEQ ID NO: 2655370 - RNA, 17 nt, Human
uugggaaaacauuugcu

SEQ ID NO: 2655371 - RNA, 22 nt, Human
uuggcuuuggguugcaggaccu

SEQ ID NO: 2655372 - RNA, 18 nt, Human
uugguaaaacucacugug

SEQ ID NO: 2655373 - RNA, 19 nt, Human
uugguaaaacucacuguga

SEQ ID NO: 2655374 - RNA, 20 nt, Human
uugguaaaacucacugugau

SEQ ID NO: 2655375 - RNA, 14 nt, Human
uugguaaauguuuc

SEQ ID NO: 2655376 - RNA, 17 nt, Human
uugguaaauguuucuuu

SEQ ID NO: 2655377 - RNA, 16 nt, Human
uugguaaagacuggcu

SEQ ID NO: 2655378 - RNA, 19 nt, Human
uugguaaagacuggcuuuu

SEQ ID NO: 2655379 - RNA, 21 nt, Human
uuggguggggggcauugagua

SEQ ID NO: 2655380 - RNA, 14 nt, Human
uuguagauuugauu

SEQ ID NO: 2655381 - RNA, 12 nt, Human
uuguagauuuga

SEQ ID NO: 2655382 - RNA, 18 nt, Human
uuguagaguguagacugu

SEQ ID NO: 2655383 - RNA, 12 nt, Human
uuguaaaguuuc

SEQ ID NO: 2655384 - RNA, 12 nt, Human
uuguaaagacug

SEQ ID NO: 2655385 - RNA, 13 nt, Human
uuguaaagacugg

SEQ ID NO: 2655386 - RNA, 21 nt, Human
uuguaaagacugguuuucugc

SEQ ID NO: 2655387 - RNA, 17 nt, Human
uuguaaaguauguauua

SEQ ID NO: 2655388 - RNA, 13 nt, Human
uugccugcagggc

SEQ ID NO: 2655389 - RNA, 15 nt, Human
uugccugcagggcca

SEQ ID NO: 2655390 - RNA, 20 nt, Human
uugccugaugacaauaaagc

SEQ ID NO: 2655391 - RNA, 14 nt, Human
uugccucugugcug

SEQ ID NO: 2655392 - RNA, 19 nt, Human
uugccucugugcugugugu

SEQ ID NO: 2655393 - RNA, 14 nt, Human
uugcgggacagagu

SEQ ID NO: 2655394 - RNA, 12 nt, Human
uugccucugugc

SEQ ID NO: 2655395 - RNA, 13 nt, Human
uugccucugugcu

SEQ ID NO: 2655396 - RNA, 22 nt, Human
uugccuccccauuucccaucug

SEQ ID NO: 2655397 - RNA, 21 nt, Human
uugccuccccauuucccaucu

SEQ ID NO: 2655398 - RNA, 17 nt, Human
uugccauagaguacacu

SEQ ID NO: 2655399 - RNA, 23 nt, Human
uugccauagaguacacugccugc

SEQ ID NO: 2655400 - RNA, 17 nt, Human
uuggcaaaaaggcagga

SEQ ID NO: 2655401 - RNA, 17 nt, Human
uuggauucuaaauacau

SEQ ID NO: 2655402 - RNA, 13 nt, Human
uugcuguacaaaa

SEQ ID NO: 2655403 - RNA, 17 nt, Human
uugcuguacaaaagcaa

SEQ ID NO: 2655404 - RNA, 15 nt, Human
uugcugguaaaauga

SEQ ID NO: 2655405 - RNA, 23 nt, Human
uugcugguaaaaugaagaauuua

SEQ ID NO: 2655406 - RNA, 16 nt, Human
uugcugguaaaaugaa

SEQ ID NO: 2655407 - RNA, 20 nt, Human
uugcugccauuacagaggua

SEQ ID NO: 2655408 - RNA, 14 nt, Human
uugcuuaaauuucu

SEQ ID NO: 2655409 - RNA, 23 nt, Human
uugcuuaaauuucuuaugugaca

SEQ ID NO: 2655410 - RNA, 18 nt, Human
uugcuuaaaccacuuaaa

SEQ ID NO: 2655411 - RNA, 11 nt, Human
uuggaaauucc

SEQ ID NO: 2655412 - RNA, 18 nt, Human
uuggaaauuccuguacug

SEQ ID NO: 2655413 - RNA, 15 nt, Human
uucugagcugccagu

SEQ ID NO: 2655414 - RNA, 14 nt, Human
uucugagaaaacaa

SEQ ID NO: 2655415 - RNA, 21 nt, Human
uucugagaaaacaagcaaguu

SEQ ID NO: 2655416 - RNA, 21 nt, Human
uucuguccgagcuuugaaaau

SEQ ID NO: 2655417 - RNA, 17 nt, Human
uucuguccgagcuuuga

SEQ ID NO: 2655418 - RNA, 13 nt, Human
uucugagaaaaca

SEQ ID NO: 2655419 - RNA, 12 nt, Human
uucugagaaaac

SEQ ID NO: 2655420 - RNA, 20 nt, Human
uucugagcuuacguaguucu

SEQ ID NO: 2655421 - RNA, 16 nt, Human
uucugugguuccucug

SEQ ID NO: 2655422 - RNA, 17 nt, Human
uucugugguuccucugc

SEQ ID NO: 2655423 - RNA, 20 nt, Human
uucugugguuccucugcuca

SEQ ID NO: 2655424 - RNA, 21 nt, Human
uucugugguuccucugcucac

SEQ ID NO: 2655425 - RNA, 20 nt, Human
uucugugguuggcugggaaa

SEQ ID NO: 2655426 - RNA, 18 nt, Human
uucuucacacagacacua

SEQ ID NO: 2655427 - RNA, 20 nt, Human
uugaacucuucucauuacuu

SEQ ID NO: 2655428 - RNA, 19 nt, Human
uugaacucuucucauuacu

SEQ ID NO: 2655429 - RNA, 16 nt, Human
uugaacucuucucauu

SEQ ID NO: 2655430 - RNA, 21 nt, Human
uugaacucuucucauuacuug

SEQ ID NO: 2655431 - RNA, 13 nt, Human
uugaacuuuugua

SEQ ID NO: 2655432 - RNA, 14 nt, Human
uugaacuuuuguac

SEQ ID NO: 2655433 - RNA, 19 nt, Human
uugaacuuuuguacugaau

SEQ ID NO: 2655434 - RNA, 23 nt, Human
uugaacuuuuguacugaauuuuu

SEQ ID NO: 2655435 - RNA, 19 nt, Human
uugaagaacugcaggcccu

SEQ ID NO: 2655436 - RNA, 16 nt, Human
uugaagaacugcaggc

SEQ ID NO: 2655437 - RNA, 20 nt, Human
uugaagaacugcaggcccug

SEQ ID NO: 2655438 - RNA, 20 nt, Human
uugaaacuuugggaaaacau

SEQ ID NO: 2655439 - RNA, 22 nt, Human
uugaaacuuugggaaaacaugu

SEQ ID NO: 2655440 - RNA, 13 nt, Human
uugagggcugcag

SEQ ID NO: 2655441 - RNA, 14 nt, Human
uugagggcugcagu

SEQ ID NO: 2655442 - RNA, 15 nt, Human
uugagggcugcaguu

SEQ ID NO: 2655443 - RNA, 12 nt, Human
uugagcuggccu

SEQ ID NO: 2655444 - RNA, 13 nt, Human
uugagcuggccuc

SEQ ID NO: 2655445 - RNA, 11 nt, Human
uugagcuggcc

SEQ ID NO: 2655446 - RNA, 20 nt, Human
uugacuaacucaaauacaca

SEQ ID NO: 2655447 - RNA, 22 nt, Human
uugacuaacucaaauacacauu

SEQ ID NO: 2655448 - RNA, 23 nt, Human
uugacuaacucaaauacacauuu

SEQ ID NO: 2655449 - RNA, 14 nt, Human
uugacuaauuuuac

SEQ ID NO: 2655450 - RNA, 15 nt, Human
uugacuaauuuuaca

SEQ ID NO: 2655451 - RNA, 11 nt, Human
uugagcugccu

SEQ ID NO: 2655452 - RNA, 12 nt, Human
uugagcugccuu

SEQ ID NO: 2655453 - RNA, 13 nt, Human
uugagcugccuuc

SEQ ID NO: 2655454 - RNA, 14 nt, Human
uugagcugccuucc

SEQ ID NO: 2655455 - RNA, 15 nt, Human
uugagcugccuuccc

SEQ ID NO: 2655456 - RNA, 16 nt, Human
uugagcugccuucccu

SEQ ID NO: 2655457 - RNA, 19 nt, Human
uugagcugccuucccuagc

SEQ ID NO: 2655458 - RNA, 13 nt, Human
uugaccugaggcu

SEQ ID NO: 2655459 - RNA, 19 nt, Human
uugaccugaggcugugguc

SEQ ID NO: 2655460 - RNA, 16 nt, Human
uugcauacuuuguauu

SEQ ID NO: 2655461 - RNA, 17 nt, Human
uugcauacuuuguauuu

SEQ ID NO: 2655462 - RNA, 21 nt, Human
uugcauacuuuguauuuugau

SEQ ID NO: 2655463 - RNA, 16 nt, Human
uugcagugagcugaga

SEQ ID NO: 2655464 - RNA, 16 nt, Human
uugcagaacuguagcu

SEQ ID NO: 2655465 - RNA, 13 nt, Human
uugcaaccaggaa

SEQ ID NO: 2655466 - RNA, 18 nt, Human
uugcaaccaggaacagca

SEQ ID NO: 2655467 - RNA, 20 nt, Human
uugaugaaacgucauguguu

SEQ ID NO: 2655468 - RNA, 21 nt, Human
uugauuggugauuagguggug

SEQ ID NO: 2655469 - RNA, 13 nt, Human
uugauuuauuaac

SEQ ID NO: 2655470 - RNA, 20 nt, Human
uugauuuauuaacuuaauaa

SEQ ID NO: 2655471 - RNA, 17 nt, Human
uugauuuauuaacuuaa

SEQ ID NO: 2655472 - RNA, 15 nt, Human
uugauuuauuaacuu

SEQ ID NO: 2655473 - RNA, 14 nt, Human
uugauuuauuaacu

SEQ ID NO: 2655474 - RNA, 16 nt, Human
uugauuuuuacugugu

SEQ ID NO: 2655475 - RNA, 19 nt, Human
uugauuuuuuuuuuuaauc

SEQ ID NO: 2655476 - RNA, 17 nt, Human
uugauuuuuacuguguu

SEQ ID NO: 2655477 - RNA, 11 nt, Human
uugauuuccuc

SEQ ID NO: 2655478 - RNA, 21 nt, Human
uugauuuauuaacuuaauaau

SEQ ID NO: 2655479 - RNA, 14 nt, Human
uugauuucaaaguu

SEQ ID NO: 2655480 - RNA, 20 nt, Human
uugauuucaaaguuuuguug

SEQ ID NO: 2655481 - RNA, 13 nt, Human
uugcaaaauacau

SEQ ID NO: 2655482 - RNA, 14 nt, Human
uugcaaaauacaug

SEQ ID NO: 2655483 - RNA, 16 nt, Human
uugcaaaauacaugaa

SEQ ID NO: 2655484 - RNA, 17 nt, Human
uugcaaaauacaugaag

SEQ ID NO: 2655485 - RNA, 22 nt, Human
uucaggaagggaugcaggcucc

SEQ ID NO: 2655486 - RNA, 17 nt, Human
uucaggaagggaugcag

SEQ ID NO: 2655487 - RNA, 21 nt, Human
uucaggagaaccuaacaugcu

SEQ ID NO: 2655488 - RNA, 19 nt, Human
uucaggaauguguggccug

SEQ ID NO: 2655489 - RNA, 17 nt, Human
uucagcugacuuuucug

SEQ ID NO: 2655490 - RNA, 24 nt, Human
uucagcucugcaagaauugaagca

SEQ ID NO: 2655491 - RNA, 17 nt, Human
uucagcucugcaagaau

SEQ ID NO: 2655492 - RNA, 22 nt, Human
uucagaggauaaauaucaaugg

SEQ ID NO: 2655493 - RNA, 15 nt, Human
uuacuaaaaaguaua

SEQ ID NO: 2655494 - RNA, 17 nt, Human
uuacuaaaaaguauaaa

SEQ ID NO: 2655495 - RNA, 15 nt, Human
uuacgugcucugugg

SEQ ID NO: 2655496 - RNA, 12 nt, Human
uuauuuucuaca

SEQ ID NO: 2655497 - RNA, 18 nt, Human
uuauuuucuacguuucuu

SEQ ID NO: 2655498 - RNA, 19 nt, Human
uuauuuucuacguuucuuu

SEQ ID NO: 2655499 - RNA, 18 nt, Human
uuaccuuuucagggcugg

SEQ ID NO: 2655500 - RNA, 21 nt, Human
uuauuuugagauguaaaaaga

SEQ ID NO: 2655501 - RNA, 22 nt, Human
uucaaauuugucugguuaaaaa

SEQ ID NO: 2655502 - RNA, 22 nt, Human
uucaacaaauauucacuggccc

SEQ ID NO: 2655503 - RNA, 20 nt, Human
uucaacagcaagugugaaua

SEQ ID NO: 2655504 - RNA, 19 nt, Human
uucaacagcaagugugaau

SEQ ID NO: 2655505 - RNA, 20 nt, Human
uucaucuuccaacucaaacu

SEQ ID NO: 2655506 - RNA, 16 nt, Human
uucaugaccaguaaag

SEQ ID NO: 2655507 - RNA, 12 nt, Human
uucaucucauuu

SEQ ID NO: 2655508 - RNA, 13 nt, Human
uucaucucauuua

SEQ ID NO: 2655509 - RNA, 16 nt, Human
uucaucucauuuaagg

SEQ ID NO: 2655510 - RNA, 19 nt, Human
uucaucucauuuaagggaa

SEQ ID NO: 2655511 - RNA, 23 nt, Human
uucaucucauuuaagggaaaaau

SEQ ID NO: 2655512 - RNA, 17 nt, Human
uucaguugcuugucuuc

SEQ ID NO: 2655513 - RNA, 18 nt, Human
uucaguugcuugucuucu

SEQ ID NO: 2655514 - RNA, 19 nt, Human
uucaguugcuugucuucug

SEQ ID NO: 2655515 - RNA, 22 nt, Human
uucaguugguucguucuguacu

SEQ ID NO: 2655516 - RNA, 13 nt, Human
uuccauuuuaauu

SEQ ID NO: 2655517 - RNA, 18 nt, Human
uuccauuuuaauuuuaaa

SEQ ID NO: 2655518 - RNA, 17 nt, Human
uucccauuugugccaga

SEQ ID NO: 2655519 - RNA, 20 nt, Human
uucccauuugugccagagga

SEQ ID NO: 2655520 - RNA, 16 nt, Human
uucccaaacgccuccc

SEQ ID NO: 2655521 - RNA, 13 nt, Human
uuccaugaauuuu

SEQ ID NO: 2655522 - RNA, 16 nt, Human
uuccaugaaggcagag

SEQ ID NO: 2655523 - RNA, 22 nt, Human
uucauuuugcacugaggauauu

SEQ ID NO: 2655524 - RNA, 21 nt, Human
uuccagaaccacacuugaaac

SEQ ID NO: 2655525 - RNA, 20 nt, Human
uuccagcauuuagcuggcca

SEQ ID NO: 2655526 - RNA, 21 nt, Human
uuccagcauuuagcuggccac

SEQ ID NO: 2655527 - RNA, 14 nt, Human
uuccagccccucug

SEQ ID NO: 2655528 - RNA, 20 nt, Human
uuccagccccucuggucgcu

SEQ ID NO: 2655529 - RNA, 16 nt, Human
uuccagccccucuggu

SEQ ID NO: 2655530 - RNA, 17 nt, Human
uuccagccccucugguc

SEQ ID NO: 2655531 - RNA, 14 nt, Human
uuccuuucccaagc

SEQ ID NO: 2655532 - RNA, 14 nt, Human
uuccuuugcauauu

SEQ ID NO: 2655533 - RNA, 19 nt, Human
uuccuuugcauauuauaaa

SEQ ID NO: 2655534 - RNA, 18 nt, Human
uucuaaaaucaugaaacu

SEQ ID NO: 2655535 - RNA, 23 nt, Human
uucuaauaagcuaguugaauacu

SEQ ID NO: 2655536 - RNA, 20 nt, Human
uucuaauaagcuaguugaau

SEQ ID NO: 2655537 - RNA, 19 nt, Human
uucuaauaagcuaguugaa

SEQ ID NO: 2655538 - RNA, 17 nt, Human
uucuaauaagcuaguug

SEQ ID NO: 2655539 - RNA, 11 nt, Human
uuccuccugga

SEQ ID NO: 2655540 - RNA, 13 nt, Human
uuccuccuggaaa

SEQ ID NO: 2655541 - RNA, 22 nt, Human
uucccuuaagggguaucaugua

SEQ ID NO: 2655542 - RNA, 22 nt, Human
uucuauuuuaagacugauuuua

SEQ ID NO: 2655543 - RNA, 20 nt, Human
uucuccaaacugaagcagcc

SEQ ID NO: 2655544 - RNA, 18 nt, Human
uucucaaaggagcgagca

SEQ ID NO: 2655545 - RNA, 22 nt, Human
uucuaugugacaauuuuguaca

SEQ ID NO: 2655546 - RNA, 16 nt, Human
uucuaugcaaaguucu

SEQ ID NO: 2655547 - RNA, 15 nt, Human
uucuauuauggaaaa

SEQ ID NO: 2655548 - RNA, 18 nt, Human
uucuauuauggaaaacug

SEQ ID NO: 2655549 - RNA, 19 nt, Human
uucuauuauggaaaacugu

SEQ ID NO: 2655550 - RNA, 19 nt, Human
uucuauuauuuuuauaauu

SEQ ID NO: 2655551 - RNA, 12 nt, Human
uucucuccuccc

SEQ ID NO: 2655552 - RNA, 14 nt, Human
uucucuccucccca

SEQ ID NO: 2655553 - RNA, 15 nt, Human
uucucuccuccccaa

SEQ ID NO: 2655554 - RNA, 17 nt, Human
uucucuccuccccaaau

SEQ ID NO: 2655555 - RNA, 13 nt, Human
uucucucucuaag

SEQ ID NO: 2655556 - RNA, 19 nt, Human
uucucccagguaccagcug

SEQ ID NO: 2655557 - RNA, 20 nt, Human
uucucccagguaccagcugc

SEQ ID NO: 2655558 - RNA, 12 nt, Human
uucuccaucccu

SEQ ID NO: 2655559 - RNA, 11 nt, Human
uucucugacuu

SEQ ID NO: 2655560 - RNA, 12 nt, Human
uucucugacuuc

SEQ ID NO: 2655561 - RNA, 16 nt, Human
uucucugacuucugcc

SEQ ID NO: 2655562 - RNA, 21 nt, Human
uucucugcuauauauaaaacg

SEQ ID NO: 2655563 - RNA, 18 nt, Human
uucugacucgguuucucc

SEQ ID NO: 2655564 - RNA, 19 nt, Human
uucugacucgguuucucca

SEQ ID NO: 2655565 - RNA, 13 nt, Human
uucucuguacuuu

SEQ ID NO: 2655566 - RNA, 14 nt, Human
uucucuguacuuuu

SEQ ID NO: 2655567 - RNA, 18 nt, Human
uucucuguacuuuucauu

SEQ ID NO: 2655568 - RNA, 21 nt, Human
uucucuguacuuuucauucuc

SEQ ID NO: 2655569 - RNA, 11 nt, Human
uuuauuucacu

SEQ ID NO: 2655570 - RNA, 15 nt, Human
uuuauuuauguacuu

SEQ ID NO: 2655571 - RNA, 14 nt, Human
uuuauuuauguacu

SEQ ID NO: 2655572 - RNA, 14 nt, Human
uuuauuuauuuaca

SEQ ID NO: 2655573 - RNA, 12 nt, Human
uuuauuuccacu

SEQ ID NO: 2655574 - RNA, 20 nt, Human
uuuauuuccacuaaaaauau

SEQ ID NO: 2655575 - RNA, 20 nt, Human
uuuauuucauuuuucaauag

SEQ ID NO: 2655576 - RNA, 14 nt, Human
uuuauuucuacugu

SEQ ID NO: 2655577 - RNA, 16 nt, Human
uuuauuucuacuguca

SEQ ID NO: 2655578 - RNA, 21 nt, Human
uuuauuucuacugucaaauga

SEQ ID NO: 2655579 - RNA, 20 nt, Human
uuuauuugaacaaugaaguu

SEQ ID NO: 2655580 - RNA, 23 nt, Human
uuuauuugaacaaugaaguugaa

SEQ ID NO: 2655581 - RNA, 16 nt, Human
uuuauuuguaaauuua

SEQ ID NO: 2655582 - RNA, 13 nt, Human
uuuauuuuaaaac

SEQ ID NO: 2655583 - RNA, 13 nt, Human
uuucaauauauug

SEQ ID NO: 2655584 - RNA, 14 nt, Human
uuucaauauauuga

SEQ ID NO: 2655585 - RNA, 17 nt, Human
uuucaauauauugaacu

SEQ ID NO: 2655586 - RNA, 18 nt, Human
uuucaauauauugaacuu

SEQ ID NO: 2655587 - RNA, 19 nt, Human
uuucaauauauugaacuuu

SEQ ID NO: 2655588 - RNA, 22 nt, Human
uuucaauauauugaacuuuugu

SEQ ID NO: 2655589 - RNA, 13 nt, Human
uuucagggcuggc

SEQ ID NO: 2655590 - RNA, 15 nt, Human
uuucagggcuggcuc

SEQ ID NO: 2655591 - RNA, 18 nt, Human
uuucagggcuggcuccug

SEQ ID NO: 2655592 - RNA, 22 nt, Human
uuucauugcugggcuugucugu

SEQ ID NO: 2655593 - RNA, 18 nt, Human
uuucagcauuaagcuguu

SEQ ID NO: 2655594 - RNA, 16 nt, Human
uuuccaaaccuuaucu

SEQ ID NO: 2655595 - RNA, 21 nt, Human
uuuccagaaccacacuugaaa

SEQ ID NO: 2655596 - RNA, 19 nt, Human
uuuccagacuuccuugaga

SEQ ID NO: 2655597 - RNA, 18 nt, Human
uuuccagacuuccuugag

SEQ ID NO: 2655598 - RNA, 18 nt, Human
uuucuccuuuaauuguaa

SEQ ID NO: 2655599 - RNA, 15 nt, Human
uuucuccucccuucc

SEQ ID NO: 2655600 - RNA, 16 nt, Human
uuucuccucccuuccu

SEQ ID NO: 2655601 - RNA, 16 nt, Human
uuucucuguggcucca

SEQ ID NO: 2655602 - RNA, 19 nt, Human
uuucuccuuuaauuguaaa

SEQ ID NO: 2655603 - RNA, 22 nt, Human
uuucuccuuuaauuguaaagua

SEQ ID NO: 2655604 - RNA, 18 nt, Human
uuucucuugagcuggccu

SEQ ID NO: 2655605 - RNA, 16 nt, Human
uuucucuugagcuggc

SEQ ID NO: 2655606 - RNA, 17 nt, Human
uuucucuugagcuggcc

SEQ ID NO: 2655607 - RNA, 15 nt, Human
uuucucuugagcugg

SEQ ID NO: 2655608 - RNA, 12 nt, Human
uuuccucuugug

SEQ ID NO: 2655609 - RNA, 13 nt, Human
uuuccucuuguga

SEQ ID NO: 2655610 - RNA, 22 nt, Human
uuuccaggcuauguauaaaaua

SEQ ID NO: 2655611 - RNA, 23 nt, Human
uuuccaggcuauguauaaaauac

SEQ ID NO: 2655612 - RNA, 13 nt, Human
uuucuaagagaag

SEQ ID NO: 2655613 - RNA, 11 nt, Human
uuucuaagaga

SEQ ID NO: 2655614 - RNA, 16 nt, Human
uuucuaagagaaguua

SEQ ID NO: 2655615 - RNA, 18 nt, Human
uuuccugaaccaugugga

SEQ ID NO: 2655616 - RNA, 16 nt, Human
uuuauaaaauggcugu

SEQ ID NO: 2655617 - RNA, 17 nt, Human
uuuauaaaauauaaaca

SEQ ID NO: 2655618 - RNA, 15 nt, Human
uuuauaaacagaaau

SEQ ID NO: 2655619 - RNA, 16 nt, Human
uuuauaaacagaaaug

SEQ ID NO: 2655620 - RNA, 23 nt, Human
uuuauaaacagaaauggaaagca

SEQ ID NO: 2655621 - RNA, 21 nt, Human
uuuauaaaauagaguguaguu

SEQ ID NO: 2655622 - RNA, 14 nt, Human
uuuaucguuuuugu

SEQ ID NO: 2655623 - RNA, 20 nt, Human
uuuaucuauucugagaaaac

SEQ ID NO: 2655624 - RNA, 16 nt, Human
uuuaugcaaaagguuu

SEQ ID NO: 2655625 - RNA, 18 nt, Human
uuuaugcaaaagguuuau

SEQ ID NO: 2655626 - RNA, 23 nt, Human
uuuauugccuuuuaauuuuuaau

SEQ ID NO: 2655627 - RNA, 16 nt, Human
uuuauuauuuauuuau

SEQ ID NO: 2655628 - RNA, 23 nt, Human
uuuauuauuuauuuuuuuuaauu

SEQ ID NO: 2655629 - RNA, 15 nt, Human
uuuauuguuaauaca

SEQ ID NO: 2655630 - RNA, 17 nt, Human
uuuauuguuaauacaag

SEQ ID NO: 2655631 - RNA, 19 nt, Human
uuuauuguuaauacaaggu

SEQ ID NO: 2655632 - RNA, 15 nt, Human
uuuauuuauauguau

SEQ ID NO: 2655633 - RNA, 19 nt, Human
uuuauuuauauguacuguu

SEQ ID NO: 2655634 - RNA, 21 nt, Human
uuuauuuauccagaaaacugu

SEQ ID NO: 2655635 - RNA, 22 nt, Human
uuuauuuauccagaaaacugug

SEQ ID NO: 2655636 - RNA, 17 nt, Human
uuuauuuauauuuauug

SEQ ID NO: 2655637 - RNA, 15 nt, Human
uuuauuuauauuuau

SEQ ID NO: 2655638 - RNA, 19 nt, Human
uuuauuuaguuccuugagu

SEQ ID NO: 2655639 - RNA, 12 nt, Human
uuuagacuugaa

SEQ ID NO: 2655640 - RNA, 15 nt, Human
uuuagaauaagaauu

SEQ ID NO: 2655641 - RNA, 19 nt, Human
uuuagaauaagaauuugca

SEQ ID NO: 2655642 - RNA, 20 nt, Human
uuuagaauaagaauuugcau

SEQ ID NO: 2655643 - RNA, 21 nt, Human
uuuagaauaagaauuugcaua

SEQ ID NO: 2655644 - RNA, 23 nt, Human
uuuagacuugaaaagagacaggc

SEQ ID NO: 2655645 - RNA, 22 nt, Human
uuuagacuugaaaagagacagg

SEQ ID NO: 2655646 - RNA, 21 nt, Human
uuuagacuugaaaagagacag

SEQ ID NO: 2655647 - RNA, 20 nt, Human
uuuagacuugaaaagagaca

SEQ ID NO: 2655648 - RNA, 19 nt, Human
uuuagacuugaaaagagac

SEQ ID NO: 2655649 - RNA, 15 nt, Human
uuuagacuugaaaag

SEQ ID NO: 2655650 - RNA, 14 nt, Human
uuuagacuugaaaa

SEQ ID NO: 2655651 - RNA, 13 nt, Human
uuuagacuugaaa

SEQ ID NO: 2655652 - RNA, 16 nt, Human
uuuagaacagcauugu

SEQ ID NO: 2655653 - RNA, 15 nt, Human
uuuagaacagguuuu

SEQ ID NO: 2655654 - RNA, 14 nt, Human
uuuagaacagguuu

SEQ ID NO: 2655655 - RNA, 13 nt, Human
uuuaaucuacugc

SEQ ID NO: 2655656 - RNA, 17 nt, Human
uuuaaucuacugcauuu

SEQ ID NO: 2655657 - RNA, 16 nt, Human
uuuaaucuacugcauu

SEQ ID NO: 2655658 - RNA, 18 nt, Human
uuuaaucuacugcauuua

SEQ ID NO: 2655659 - RNA, 12 nt, Human
uuuaauccaguu

SEQ ID NO: 2655660 - RNA, 17 nt, Human
uuguauuauuuuuguag

SEQ ID NO: 2655661 - RNA, 20 nt, Human
uuuacaagggcauaaaguaa

SEQ ID NO: 2655662 - RNA, 17 nt, Human
uuuacaauaguucugug

SEQ ID NO: 2655663 - RNA, 16 nt, Human
uuguauuguccuauua

SEQ ID NO: 2655664 - RNA, 18 nt, Human
uuguauuguauauuacaa

SEQ ID NO: 2655665 - RNA, 19 nt, Human
uuguauuguauauuacaau

SEQ ID NO: 2655666 - RNA, 9 nt, Human
uuguauuuu

SEQ ID NO: 2655667 - RNA, 13 nt, Human
uuguauuuaacag

SEQ ID NO: 2655668 - RNA, 17 nt, Human
uuguauuuaacagaaau

SEQ ID NO: 2655669 - RNA, 18 nt, Human
uuguauuuaacagaaauu

SEQ ID NO: 2655670 - RNA, 22 nt, Human
uuguauuuaacagaaauuguau

SEQ ID NO: 2655671 - RNA, 16 nt, Human
uuguauuuauguguau

SEQ ID NO: 2655672 - RNA, 22 nt, Human
uuuguuaaaauuaucaauaucu

SEQ ID NO: 2655673 - RNA, 16 nt, Human
uuuguugucagcugaa

SEQ ID NO: 2655674 - RNA, 13 nt, Human
uuugucccuucua

SEQ ID NO: 2655675 - RNA, 13 nt, Human
uuugucauaucaa

SEQ ID NO: 2655676 - RNA, 12 nt, Human
uuugucauucag

SEQ ID NO: 2655677 - RNA, 13 nt, Human
uuugucauucaga

SEQ ID NO: 2655678 - RNA, 11 nt, Human
uuugucaauga

SEQ ID NO: 2655679 - RNA, 23 nt, Human
uuugucaaacuguagaaaugaug

SEQ ID NO: 2655680 - RNA, 17 nt, Human
uuugucaaacuguagaa

SEQ ID NO: 2655681 - RNA, 16 nt, Human
uuugucaaacuguaga

SEQ ID NO: 2655682 - RNA, 14 nt, Human
uuugucaaacugua

SEQ ID NO: 2655683 - RNA, 17 nt, Human
uuugucaaugacaguuu

SEQ ID NO: 2655684 - RNA, 15 nt, Human
uuugguguacagacu

SEQ ID NO: 2655685 - RNA, 21 nt, Human
uuugauacaguuuucagaaaa

SEQ ID NO: 2655686 - RNA, 22 nt, Human
uuugauacaguuuucagaaaaa

SEQ ID NO: 2655687 - RNA, 17 nt, Human
uuugagcugccuucccu

SEQ ID NO: 2655688 - RNA, 12 nt, Human
uuugagcugccu

SEQ ID NO: 2655689 - RNA, 14 nt, Human
uuugagcugccuuc

SEQ ID NO: 2655690 - RNA, 19 nt, Human
uuugagcucccacuucugc

SEQ ID NO: 2655691 - RNA, 10 nt, Human
uuugagcucc

SEQ ID NO: 2655692 - RNA, 16 nt, Human
uuugagccugggaaau

SEQ ID NO: 2655693 - RNA, 17 nt, Human
uuugccaggacaugcaa

SEQ ID NO: 2655694 - RNA, 22 nt, Human
uuugcauacuuaccuagugaaa

SEQ ID NO: 2655695 - RNA, 14 nt, Human
uuugccaugugcuu

SEQ ID NO: 2655696 - RNA, 22 nt, Human
uuugccauagaguacacugccu

SEQ ID NO: 2655697 - RNA, 20 nt, Human
uuugccaugugcuucugcca

SEQ ID NO: 2655698 - RNA, 19 nt, Human
uuugauagggaacugggga

SEQ ID NO: 2655699 - RNA, 14 nt, Human
uuugcacuguuuaa

SEQ ID NO: 2655700 - RNA, 21 nt, Human
uuugcacuugugauuauuuau

SEQ ID NO: 2655701 - RNA, 14 nt, Human
uuugcagcucagaa

SEQ ID NO: 2655702 - RNA, 19 nt, Human
uuuuauauuacugacauuu

SEQ ID NO: 2655703 - RNA, 12 nt, Human
uuuuaucaguag

SEQ ID NO: 2655704 - RNA, 13 nt, Human
uuuuauaugcuuu

SEQ ID NO: 2655705 - RNA, 15 nt, Human
uuuuacugguugcau

SEQ ID NO: 2655706 - RNA, 17 nt, Human
uuuuacugguugcaugg

SEQ ID NO: 2655707 - RNA, 18 nt, Human
uuuuacugguugcaugga

SEQ ID NO: 2655708 - RNA, 21 nt, Human
uuuuacugguugcauggaaau

SEQ ID NO: 2655709 - RNA, 13 nt, Human
uuuuacugucuau

SEQ ID NO: 2655710 - RNA, 15 nt, Human
uuuuacuguguuuua

SEQ ID NO: 2655711 - RNA, 12 nt, Human
uuuuaauuuuua

SEQ ID NO: 2655712 - RNA, 18 nt, Human
uuuuacauguuuauaaau

SEQ ID NO: 2655713 - RNA, 18 nt, Human
uuuuaauuuacuuguuuu

SEQ ID NO: 2655714 - RNA, 16 nt, Human
uuuuaaaaugcaaugu

SEQ ID NO: 2655715 - RNA, 19 nt, Human
uuuguuguucuuucagaaa

SEQ ID NO: 2655716 - RNA, 14 nt, Human
uuuucacuuaugaa

SEQ ID NO: 2655717 - RNA, 14 nt, Human
uuuucgccuuuccu

SEQ ID NO: 2655718 - RNA, 16 nt, Human
uuuucuucuugggaua

SEQ ID NO: 2655719 - RNA, 14 nt, Human
uuuuccucuuguga

SEQ ID NO: 2655720 - RNA, 16 nt, Human
uuuuccucuugugauu

SEQ ID NO: 2655721 - RNA, 19 nt, Human
uuuucacucuaagucaugu

SEQ ID NO: 2655722 - RNA, 21 nt, Human
uuuucacucuaagucauguau

SEQ ID NO: 2655723 - RNA, 23 nt, Human
uuuucacucuaagucauguaugu

SEQ ID NO: 2655724 - RNA, 17 nt, Human
uuuucagaaaaagaaau

SEQ ID NO: 2655725 - RNA, 18 nt, Human
uuuucagaaaaagaaaug

SEQ ID NO: 2655726 - RNA, 13 nt, Human
uuuucaaguugua

SEQ ID NO: 2655727 - RNA, 14 nt, Human
uuuucaauauauug

SEQ ID NO: 2655728 - RNA, 15 nt, Human
uuuucaauauauuga

SEQ ID NO: 2655729 - RNA, 18 nt, Human
uuuucaauauauugaacu

SEQ ID NO: 2655730 - RNA, 20 nt, Human
uuuucaauauauugaacuuu

SEQ ID NO: 2655731 - RNA, 21 nt, Human
uuuucaauauauugaacuuuu

SEQ ID NO: 2655732 - RNA, 22 nt, Human
uuuucaauauauugaacuuuug

SEQ ID NO: 2655733 - RNA, 23 nt, Human
uuuucaauauauugaacuuuugu

SEQ ID NO: 2655734 - RNA, 13 nt, Human
uuuuaugaugacg

SEQ ID NO: 2655735 - RNA, 20 nt, Human
uuuuaugaugacguacaagu

SEQ ID NO: 2655736 - RNA, 20 nt, Human
uuuugaaaaguaauauuuau

SEQ ID NO: 2655737 - RNA, 11 nt, Human
uuuugaaaagu

SEQ ID NO: 2655738 - RNA, 20 nt, Human
uuuugaaaagcagacauuuu

SEQ ID NO: 2655739 - RNA, 20 nt, Human
uuuuucugcuuuagacuuga

SEQ ID NO: 2655740 - RNA, 13 nt, Human
uuuuucugcuuua

SEQ ID NO: 2655741 - RNA, 18 nt, Human
uuuuucugugugucaguu

SEQ ID NO: 2655742 - RNA, 16 nt, Human
uuuuucuucuguauuu

SEQ ID NO: 2655743 - RNA, 21 nt, Human
uuuuuuaguauuuauuuaugu

SEQ ID NO: 2655744 - RNA, 15 nt, Human
uuuuuucuaagagaa

SEQ ID NO: 2655745 - RNA, 12 nt, Human
uuuuuucuaaga

SEQ ID NO: 2655746 - RNA, 11 nt, Human
uuuuuuauuau

SEQ ID NO: 2655747 - RNA, 19 nt, Human
uuuuuugaacucuucucau

SEQ ID NO: 2655748 - RNA, 14 nt, Human
caauguuguagugu

SEQ ID NO: 2655749 - RNA, 17 nt, Human
caauaucuaauauauau

SEQ ID NO: 2655750 - RNA, 16 nt, Human
caauaucuaauauaua

SEQ ID NO: 2655751 - RNA, 15 nt, Human
caauaucuaauauau

SEQ ID NO: 2655752 - RNA, 19 nt, Human
caaugugaaaagaaaaaug

SEQ ID NO: 2655753 - RNA, 22 nt, Human
caaugugaaaagaaaaaugagc

SEQ ID NO: 2655754 - RNA, 13 nt, Human
cacaaaggagagc

SEQ ID NO: 2655755 - RNA, 13 nt, Human
cacaauuugcacu

SEQ ID NO: 2655756 - RNA, 18 nt, Human
cacaauuuugauaaaaau

SEQ ID NO: 2655757 - RNA, 11 nt, Human
cacacaccugu

SEQ ID NO: 2655758 - RNA, 13 nt, Human
cacacaccuguag

SEQ ID NO: 2655759 - RNA, 20 nt, Human
cacacacggaggcauccuac

SEQ ID NO: 2655760 - RNA, 22 nt, Human
cacacucuccaucacccucuuc

SEQ ID NO: 2655761 - RNA, 21 nt, Human
cacagagcuuuggucugugug

SEQ ID NO: 2655762 - RNA, 22 nt, Human
cacagagcuuuggucugugugu

SEQ ID NO: 2655763 - RNA, 15 nt, Human
cacagagucaaggcc

SEQ ID NO: 2655764 - RNA, 16 nt, Human
cacagagucaaggccu

SEQ ID NO: 2655765 - RNA, 17 nt, Human
cacagagucaaggccug

SEQ ID NO: 2655766 - RNA, 18 nt, Human
cacagagucaaggccugc

SEQ ID NO: 2655767 - RNA, 19 nt, Human
cacagagucaaggccugcu

SEQ ID NO: 2655768 - RNA, 20 nt, Human
cacagagucaaggccugcuc

SEQ ID NO: 2655769 - RNA, 21 nt, Human
cacagagucaaggccugcucc

SEQ ID NO: 2655770 - RNA, 12 nt, Human
caauaaaugaau

SEQ ID NO: 2655771 - RNA, 18 nt, Human
caauaaauuuugaaaagu

SEQ ID NO: 2655772 - RNA, 17 nt, Human
caauaaauuuugaaaag

SEQ ID NO: 2655773 - RNA, 16 nt, Human
caauaaauuuugaaaa

SEQ ID NO: 2655774 - RNA, 15 nt, Human
caauaaauuuugaaa

SEQ ID NO: 2655775 - RNA, 14 nt, Human
caauaaauuuugaa

SEQ ID NO: 2655776 - RNA, 13 nt, Human
caauaaauuuuga

SEQ ID NO: 2655777 - RNA, 11 nt, Human
caauaaauuuu

SEQ ID NO: 2655778 - RNA, 21 nt, Human
caagggaaaggggugcuuuua

SEQ ID NO: 2655779 - RNA, 12 nt, Human
caagggaaaggg

SEQ ID NO: 2655780 - RNA, 14 nt, Human
caagggaaaggggu

SEQ ID NO: 2655781 - RNA, 16 nt, Human
caagggaaaggggugc

SEQ ID NO: 2655782 - RNA, 20 nt, Human
caagggaaaggggugcuuuu

SEQ ID NO: 2655783 - RNA, 15 nt, Human
caagggaaccugugu

SEQ ID NO: 2655784 - RNA, 16 nt, Human
caagggaaccuguguc

SEQ ID NO: 2655785 - RNA, 18 nt, Human
caaggcugggggaagaag

SEQ ID NO: 2655786 - RNA, 13 nt, Human
caaggcuggcagg

SEQ ID NO: 2655787 - RNA, 17 nt, Human
caauagcacauauggaa

SEQ ID NO: 2655788 - RNA, 16 nt, Human
caauagcacauaugga

SEQ ID NO: 2655789 - RNA, 15 nt, Human
caauagaucuccagc

SEQ ID NO: 2655790 - RNA, 16 nt, Human
caauagaucuccagcg

SEQ ID NO: 2655791 - RNA, 16 nt, Human
caauagacacauacau

SEQ ID NO: 2655792 - RNA, 12 nt, Human
caauagaaacaa

SEQ ID NO: 2655793 - RNA, 21 nt, Human
caauaagugugugguagaaac

SEQ ID NO: 2655794 - RNA, 23 nt, Human
caauaagugugugguagaaacaa

SEQ ID NO: 2655795 - RNA, 12 nt, Human
caauaacagcug

SEQ ID NO: 2655796 - RNA, 13 nt, Human
caauaacagcugc

SEQ ID NO: 2655797 - RNA, 14 nt, Human
caauaacagcugca

SEQ ID NO: 2655798 - RNA, 15 nt, Human
caauaacagcugcaa

SEQ ID NO: 2655799 - RNA, 22 nt, Human
caauaaauuuugaaaaguaaua

SEQ ID NO: 2655800 - RNA, 16 nt, Human
caaggacuuuguacau

SEQ ID NO: 2655801 - RNA, 20 nt, Human
caagagucuaauagucuuug

SEQ ID NO: 2655802 - RNA, 22 nt, Human
caaggcugcagugagccgagau

SEQ ID NO: 2655803 - RNA, 17 nt, Human
caaggcugcagugagcc

SEQ ID NO: 2655804 - RNA, 22 nt, Human
caagcugcacccucaggcaggu

SEQ ID NO: 2655805 - RNA, 21 nt, Human
caagcugcacccucaggcagg

SEQ ID NO: 2655806 - RNA, 24 nt, Human
caacacuuccagcauuuagcuggc

SEQ ID NO: 2655807 - RNA, 22 nt, Human
caaauuugucugguuaaaaaau

SEQ ID NO: 2655808 - RNA, 20 nt, Human
caaauuaauugugugaacuu

SEQ ID NO: 2655809 - RNA, 19 nt, Human
caaauuaauugugugaacu

SEQ ID NO: 2655810 - RNA, 16 nt, Human
caaauuaauuguguga

SEQ ID NO: 2655811 - RNA, 12 nt, Human
caaauuaauugu

SEQ ID NO: 2655812 - RNA, 14 nt, Human
caaaucaauacacu

SEQ ID NO: 2655813 - RNA, 15 nt, Human
caaaucaauacacua

SEQ ID NO: 2655814 - RNA, 17 nt, Human
caaauaaauaauuuuca

SEQ ID NO: 2655815 - RNA, 23 nt, Human
caaauaaagagagaacaggacua

SEQ ID NO: 2655816 - RNA, 17 nt, Human
caaauggagaagcugca

SEQ ID NO: 2655817 - RNA, 18 nt, Human
caaauggagaagcugcag

SEQ ID NO: 2655818 - RNA, 19 nt, Human
caaauggagaagcugcagg

SEQ ID NO: 2655819 - RNA, 16 nt, Human
caaaucaauucuaguc

SEQ ID NO: 2655820 - RNA, 19 nt, Human
caaaucaauucuagucaua

SEQ ID NO: 2655821 - RNA, 17 nt, Human
caaaucaauacacuagu

SEQ ID NO: 2655822 - RNA, 22 nt, Human
caaaguguauuaggaaguguuu

SEQ ID NO: 2655823 - RNA, 17 nt, Human
caaaguuaaaauuguua

SEQ ID NO: 2655824 - RNA, 23 nt, Human
caacuuguauuaaagacagaggc

SEQ ID NO: 2655825 - RNA, 13 nt, Human
caagaagcagugg

SEQ ID NO: 2655826 - RNA, 14 nt, Human
caagaagcaguggc

SEQ ID NO: 2655827 - RNA, 18 nt, Human
caagaagcaguggccuua

SEQ ID NO: 2655828 - RNA, 15 nt, Human
caaccuuucccucac

SEQ ID NO: 2655829 - RNA, 18 nt, Human
caaccuuucccucacccc

SEQ ID NO: 2655830 - RNA, 19 nt, Human
caaccuuucccucaccccc

SEQ ID NO: 2655831 - RNA, 17 nt, Human
caacuaaaauuugaagu

SEQ ID NO: 2655832 - RNA, 19 nt, Human
caacuaaaauuugaaguag

SEQ ID NO: 2655833 - RNA, 12 nt, Human
caagaggaauga

SEQ ID NO: 2655834 - RNA, 15 nt, Human
caagaggaaugaaaa

SEQ ID NO: 2655835 - RNA, 24 nt, Human
caagagaacucgcgcucaguaaac

SEQ ID NO: 2655836 - RNA, 16 nt, Human
caagagauaagucuuu

SEQ ID NO: 2655837 - RNA, 16 nt, Human
caagagaugggaauga

SEQ ID NO: 2655838 - RNA, 23 nt, Human
caaacugaagcagccucucccca

SEQ ID NO: 2655839 - RNA, 17 nt, Human
caaacugaagcagccuc

SEQ ID NO: 2655840 - RNA, 14 nt, Human
caaaccuuugagua

SEQ ID NO: 2655841 - RNA, 15 nt, Human
caaaccuuugaguag

SEQ ID NO: 2655842 - RNA, 18 nt, Human
caaacucuaucggagaac

SEQ ID NO: 2655843 - RNA, 21 nt, Human
caaaccuuaucuccacaaccu

SEQ ID NO: 2655844 - RNA, 17 nt, Human
caaaccuuaucuccaca

SEQ ID NO: 2655845 - RNA, 15 nt, Human
caaaccuuaucucca

SEQ ID NO: 2655846 - RNA, 20 nt, Human
caaaccuuuauuuuagaauu

SEQ ID NO: 2655847 - RNA, 18 nt, Human
caaaccuuuauuuuagaa

SEQ ID NO: 2655848 - RNA, 13 nt, Human
caaaauuugacua

SEQ ID NO: 2655849 - RNA, 14 nt, Human
caaaauuugacuaa

SEQ ID NO: 2655850 - RNA, 23 nt, Human
caaaauuugacuaauuuuacaug

SEQ ID NO: 2655851 - RNA, 16 nt, Human
caaaauauguuuaaaa

SEQ ID NO: 2655852 - RNA, 16 nt, Human
caaaaucaauuaaaau

SEQ ID NO: 2655853 - RNA, 15 nt, Human
caaaauauuucccau

SEQ ID NO: 2655854 - RNA, 16 nt, Human
caaaauccaaaaagaa

SEQ ID NO: 2655855 - RNA, 22 nt, Human
caaaauccaaaaagaaaugaug

SEQ ID NO: 2655856 - RNA, 13 nt, Human
caaaauacaugaa

SEQ ID NO: 2655857 - RNA, 14 nt, Human
caaaauacaugaag

SEQ ID NO: 2655858 - RNA, 17 nt, Human
caaaauacaugaagcuu

SEQ ID NO: 2655859 - RNA, 22 nt, Human
caaaauacaugaagcuucaugc

SEQ ID NO: 2655860 - RNA, 11 nt, Human
caaaacucuac

SEQ ID NO: 2655861 - RNA, 19 nt, Human
caaaacucuacuuaaucca

SEQ ID NO: 2655862 - RNA, 21 nt, Human
caaaacgguuuuacugcagcu

SEQ ID NO: 2655863 - RNA, 15 nt, Human
caaaacgguuuuacu

SEQ ID NO: 2655864 - RNA, 15 nt, Human
caaaaccuuuuacug

SEQ ID NO: 2655865 - RNA, 21 nt, Human
caaaaccuuuuacugguugca

SEQ ID NO: 2655866 - RNA, 22 nt, Human
cacagcuugaccugaggcugug

SEQ ID NO: 2655867 - RNA, 20 nt, Human
cacagcuugaccugaggcug

SEQ ID NO: 2655868 - RNA, 21 nt, Human
cacagcuugaccugaggcugu

SEQ ID NO: 2655869 - RNA, 18 nt, Human
cacagcuugaccugaggc

SEQ ID NO: 2655870 - RNA, 19 nt, Human
cacagcuugaccugaggcu

SEQ ID NO: 2655871 - RNA, 19 nt, Human
aacucauuuguuaaaauua

SEQ ID NO: 2655872 - RNA, 16 nt, Human
aacucgcgcucaguaa

SEQ ID NO: 2655873 - RNA, 20 nt, Human
aacucaucuggaguucucaa

SEQ ID NO: 2655874 - RNA, 14 nt, Human
aacucaucugaaau

SEQ ID NO: 2655875 - RNA, 17 nt, Human
aacucaucugaaauguu

SEQ ID NO: 2655876 - RNA, 18 nt, Human
aacucaucugaaauguua

SEQ ID NO: 2655877 - RNA, 19 nt, Human
aacucaucugaaauguuac

SEQ ID NO: 2655878 - RNA, 20 nt, Human
aacucaucugaaauguuaca

SEQ ID NO: 2655879 - RNA, 15 nt, Human
aacuaccuguauuua

SEQ ID NO: 2655880 - RNA, 21 nt, Human
aacuaccuguauuuaaaaaua

SEQ ID NO: 2655881 - RNA, 23 nt, Human
aacuaccuguauuuaaaaauaga

SEQ ID NO: 2655882 - RNA, 17 nt, Human
aaccuuggccugggccg

SEQ ID NO: 2655883 - RNA, 12 nt, Human
gucuuuugcuuu

SEQ ID NO: 2655884 - RNA, 13 nt, Human
gucuuuugcuuuu

SEQ ID NO: 2655885 - RNA, 14 nt, Human
gucuuuugcuuuug

SEQ ID NO: 2655886 - RNA, 16 nt, Human
gucuuuugcuuuuggc

SEQ ID NO: 2655887 - RNA, 20 nt, Human
gucuggcccuagacucgggg

SEQ ID NO: 2655888 - RNA, 20 nt, Human
gucuguaauaauagacugua

SEQ ID NO: 2655889 - RNA, 20 nt, Human
aaccucgcccucuccuuugu

SEQ ID NO: 2655890 - RNA, 19 nt, Human
aaccucgcgcuugcuggcc

SEQ ID NO: 2655891 - RNA, 17 nt, Human
aaccucgcccucuccuu

SEQ ID NO: 2655892 - RNA, 14 nt, Human
aaccucgcccucuc

SEQ ID NO: 2655893 - RNA, 15 nt, Human
aaccugaaguuuuuu

SEQ ID NO: 2655894 - RNA, 23 nt, Human
aacccgggagcggagguugcagu

SEQ ID NO: 2655895 - RNA, 17 nt, Human
aaccucagggcucccag

SEQ ID NO: 2655896 - RNA, 18 nt, Human
aaccucagggcucccagg

SEQ ID NO: 2655897 - RNA, 19 nt, Human
aaccucagggcucccaggg

SEQ ID NO: 2655898 - RNA, 15 nt, Human
aaccuccccagccug

SEQ ID NO: 2655899 - RNA, 14 nt, Human
aaccuccccagccu

SEQ ID NO: 2655900 - RNA, 16 nt, Human
aacccaagcuuagaac

SEQ ID NO: 2655901 - RNA, 15 nt, Human
aacccaagcuuagaa

SEQ ID NO: 2655902 - RNA, 16 nt, Human
aaccaccaaaaacaaa

SEQ ID NO: 2655903 - RNA, 11 nt, Human
gucucccuggc

SEQ ID NO: 2655904 - RNA, 12 nt, Human
gucucccuggcu

SEQ ID NO: 2655905 - RNA, 14 nt, Human
gucucccuggcucc

SEQ ID NO: 2655906 - RNA, 15 nt, Human
gucucccuggcuccc

SEQ ID NO: 2655907 - RNA, 15 nt, Human
aaccaagucaaguga

SEQ ID NO: 2655908 - RNA, 11 nt, Human
aacuguaaauc

SEQ ID NO: 2655909 - RNA, 12 nt, Human
aacuguaaauca

SEQ ID NO: 2655910 - RNA, 19 nt, Human
aacuggucaccaugaaacu

SEQ ID NO: 2655911 - RNA, 16 nt, Human
aacugggguugagggc

SEQ ID NO: 2655912 - RNA, 18 nt, Human
aacugggguugagggcca

SEQ ID NO: 2655913 - RNA, 17 nt, Human
aacuguagaaaugauga

SEQ ID NO: 2655914 - RNA, 16 nt, Human
aacuguagaaaugaug

SEQ ID NO: 2655915 - RNA, 15 nt, Human
aacuguagaaaugau

SEQ ID NO: 2655916 - RNA, 14 nt, Human
aacuguagaaauga

SEQ ID NO: 2655917 - RNA, 16 nt, Human
aacuuccaaauaaaua

SEQ ID NO: 2655918 - RNA, 23 nt, Human
aacuuccaaauaaauaauuuuca

SEQ ID NO: 2655919 - RNA, 20 nt, Human
aacuguagaugauguauuuu

SEQ ID NO: 2655920 - RNA, 19 nt, Human
aacuguagaaaugaugaug

SEQ ID NO: 2655921 - RNA, 17 nt, Human
aacuucauauguaaucu

SEQ ID NO: 2655922 - RNA, 21 nt, Human
aacuucuucuccaucccucua

SEQ ID NO: 2655923 - RNA, 19 nt, Human
aacuucugcaacaagcaug

SEQ ID NO: 2655924 - RNA, 20 nt, Human
aacuucugcaacaagcaugc

SEQ ID NO: 2655925 - RNA, 22 nt, Human
aacuucugcaacaagcaugcag

SEQ ID NO: 2655926 - RNA, 12 nt, Human
gugaugagcuga

SEQ ID NO: 2655927 - RNA, 20 nt, Human
gugccucccuccccagugca

SEQ ID NO: 2655928 - RNA, 23 nt, Human
gugccacuuuacccaccuagaac

SEQ ID NO: 2655929 - RNA, 13 nt, Human
gugccugugucca

SEQ ID NO: 2655930 - RNA, 22 nt, Human
gugccuguguccaugcgcucag

SEQ ID NO: 2655931 - RNA, 14 nt, Human
gugccugugugcgu

SEQ ID NO: 2655932 - RNA, 16 nt, Human
gugaugguguagcccu

SEQ ID NO: 2655933 - RNA, 16 nt, Human
gugccaccaugccuca

SEQ ID NO: 2655934 - RNA, 24 nt, Human
gugcaacaggguauggacuaucug

SEQ ID NO: 2655935 - RNA, 19 nt, Human
gugcaaccucgcugagggc

SEQ ID NO: 2655936 - RNA, 16 nt, Human
gugcaacgccgugggc

SEQ ID NO: 2655937 - RNA, 15 nt, Human
gugcaugguggccag

SEQ ID NO: 2655938 - RNA, 16 nt, Human
gugcaugguggccaga

SEQ ID NO: 2655939 - RNA, 21 nt, Human
gugcacauccgcgugugccug

SEQ ID NO: 2655940 - RNA, 13 nt, Human
gugcacagccacu

SEQ ID NO: 2655941 - RNA, 23 nt, Human
aacugggaugaaacuaaagcaau

SEQ ID NO: 2655942 - RNA, 17 nt, Human
aacuggaccuguauauu

SEQ ID NO: 2655943 - RNA, 15 nt, Human
aacugcugacuguuu

SEQ ID NO: 2655944 - RNA, 21 nt, Human
aacugcugacuguuuucucuu

SEQ ID NO: 2655945 - RNA, 20 nt, Human
aacugcugacuguuuucucu

SEQ ID NO: 2655946 - RNA, 22 nt, Human
aacugcuucccuuacuuugcug

SEQ ID NO: 2655947 - RNA, 23 nt, Human
aacugcuucccuuacuuugcuga

SEQ ID NO: 2655948 - RNA, 23 nt, Human
aacugcugacuguuuucucuuga

SEQ ID NO: 2655949 - RNA, 16 nt, Human
aacugaaacaugcuua

SEQ ID NO: 2655950 - RNA, 13 nt, Human
gugaggggucccu

SEQ ID NO: 2655951 - RNA, 18 nt, Human
gugagugacgaugaugua

SEQ ID NO: 2655952 - RNA, 14 nt, Human
gugaacuuggaagc

SEQ ID NO: 2655953 - RNA, 19 nt, Human
gugaacuugggccacugug

SEQ ID NO: 2655954 - RNA, 17 nt, Human
gugaacuugggccacug

SEQ ID NO: 2655955 - RNA, 13 nt, Human
gugagggagggga

SEQ ID NO: 2655956 - RNA, 21 nt, Human
gugagggaggggaaaagcauu

SEQ ID NO: 2655957 - RNA, 18 nt, Human
gucagacagaacuugaau

SEQ ID NO: 2655958 - RNA, 16 nt, Human
gucaggcugaaaacaa

SEQ ID NO: 2655959 - RNA, 17 nt, Human
gucaggcugaaaacaau

SEQ ID NO: 2655960 - RNA, 18 nt, Human
gucacacgcuuuugaauu

SEQ ID NO: 2655961 - RNA, 20 nt, Human
gucacacgcuuuugaauuau

SEQ ID NO: 2655962 - RNA, 19 nt, Human
gucacacauuacaaaguua

SEQ ID NO: 2655963 - RNA, 21 nt, Human
aaauuugucugguuaaaaaau

SEQ ID NO: 2655964 - RNA, 15 nt, Human
aaauuuuaaaaaucu

SEQ ID NO: 2655965 - RNA, 14 nt, Human
aaauuuguugcaua

SEQ ID NO: 2655966 - RNA, 13 nt, Human
aaauuuguugcau

SEQ ID NO: 2655967 - RNA, 11 nt, Human
gucaguuuuca

SEQ ID NO: 2655968 - RNA, 13 nt, Human
gucaguuuucaua

SEQ ID NO: 2655969 - RNA, 14 nt, Human
gucaguaugacauu

SEQ ID NO: 2655970 - RNA, 20 nt, Human
gucaguaguuuaaaaguucu

SEQ ID NO: 2655971 - RNA, 12 nt, Human
aaauuuuguaag

SEQ ID NO: 2655972 - RNA, 14 nt, Human
aaauuuuguaagaa

SEQ ID NO: 2655973 - RNA, 21 nt, Human
aaauuuugcuaucaacaauaa

SEQ ID NO: 2655974 - RNA, 21 nt, Human
aaauuuuacaagggcauaaag

SEQ ID NO: 2655975 - RNA, 13 nt, Human
aaauuuucagcau

SEQ ID NO: 2655976 - RNA, 13 nt, Human
aaauuuugaaaag

SEQ ID NO: 2655977 - RNA, 21 nt, Human
aaauuuugaaaaguaauauuu

SEQ ID NO: 2655978 - RNA, 18 nt, Human
aaauuuugaaaaguaaua

SEQ ID NO: 2655979 - RNA, 17 nt, Human
aaauuuugaaaaguaau

SEQ ID NO: 2655980 - RNA, 14 nt, Human
aaauuuugaaaagu

SEQ ID NO: 2655981 - RNA, 19 nt, Human
aaauuuuuuuguaugaaaa

SEQ ID NO: 2655982 - RNA, 20 nt, Human
aaauuuuuuuguaugaaaac

SEQ ID NO: 2655983 - RNA, 18 nt, Human
aaauuuuuuuguaugaaa

SEQ ID NO: 2655984 - RNA, 17 nt, Human
aaauuuuuuuguaugaa

SEQ ID NO: 2655985 - RNA, 14 nt, Human
aaauuuuuuuguau

SEQ ID NO: 2655986 - RNA, 13 nt, Human
aaauuuuuuugua

SEQ ID NO: 2655987 - RNA, 12 nt, Human
aaauuuuuuugu

SEQ ID NO: 2655988 - RNA, 12 nt, Human
aaauuuuuugac

SEQ ID NO: 2655989 - RNA, 13 nt, Human
aaauuuuuugacu

SEQ ID NO: 2655990 - RNA, 23 nt, Human
aaauuuuuugacuuuuuuuguau

SEQ ID NO: 2655991 - RNA, 14 nt, Human
aacaaguugagcua

SEQ ID NO: 2655992 - RNA, 22 nt, Human
aacaaguugagcuaugacuuaa

SEQ ID NO: 2655993 - RNA, 21 nt, Human
aacaaguugagcuaugacuua

SEQ ID NO: 2655994 - RNA, 17 nt, Human
aacaaguugagcuauga

SEQ ID NO: 2655995 - RNA, 13 nt, Human
aacaagcaugcag

SEQ ID NO: 2655996 - RNA, 15 nt, Human
aacaauggaguauuc

SEQ ID NO: 2655997 - RNA, 16 nt, Human
aacaauggaguauucu

SEQ ID NO: 2655998 - RNA, 17 nt, Human
aacaauggaguauucuc

SEQ ID NO: 2655999 - RNA, 14 nt, Human
aacaauaaaauuuu

SEQ ID NO: 2656000 - RNA, 16 nt, Human
aacaauaaaauuuuuu

SEQ ID NO: 2656001 - RNA, 15 nt, Human
guccaguguuucuuu

SEQ ID NO: 2656002 - RNA, 20 nt, Human
guccaaaaagcuccuggggc

SEQ ID NO: 2656003 - RNA, 15 nt, Human
guccauacacuuugu

SEQ ID NO: 2656004 - RNA, 20 nt, Human
gucccuugcuugccugcagg

SEQ ID NO: 2656005 - RNA, 22 nt, Human
gucccuugcuugccugcagggc

SEQ ID NO: 2656006 - RNA, 23 nt, Human
aaaugucaaaaguagaacuuugu

SEQ ID NO: 2656007 - RNA, 20 nt, Human
aaaugucaaaaguagaacuu

SEQ ID NO: 2656008 - RNA, 16 nt, Human
guauguagaagcauga

SEQ ID NO: 2656009 - RNA, 23 nt, Human
guauguauauuaaaaaagagaca

SEQ ID NO: 2656010 - RNA, 13 nt, Human
guauguauuauuu

SEQ ID NO: 2656011 - RNA, 19 nt, Human
aaaugucuaguuguaacac

SEQ ID NO: 2656012 - RNA, 22 nt, Human
aaauguccaguaagaucacugu

SEQ ID NO: 2656013 - RNA, 21 nt, Human
aaauguccaguaagaucacug

SEQ ID NO: 2656014 - RNA, 24 nt, Human
aaaugucuaguuguaacaccauga

SEQ ID NO: 2656015 - RNA, 20 nt, Human
aaaugugagugguugaauau

SEQ ID NO: 2656016 - RNA, 18 nt, Human
aaaugugaauuuuuauug

SEQ ID NO: 2656017 - RNA, 20 nt, Human
aaaugugaauuuuuauuguu

SEQ ID NO: 2656018 - RNA, 21 nt, Human
aaaugugaauuuuuauuguug

SEQ ID NO: 2656019 - RNA, 12 nt, Human
aaauuaaggugu

SEQ ID NO: 2656020 - RNA, 13 nt, Human
aaauuaagcaaau

SEQ ID NO: 2656021 - RNA, 16 nt, Human
aaauuaagcaaauguu

SEQ ID NO: 2656022 - RNA, 17 nt, Human
aaauuaagcaaauguua

SEQ ID NO: 2656023 - RNA, 23 nt, Human
aaauuaagguguuugaaaauagu

SEQ ID NO: 2656024 - RNA, 21 nt, Human
aaauuaagguguuugaaaaua

SEQ ID NO: 2656025 - RNA, 19 nt, Human
aaauuaagguguuugaaaa

SEQ ID NO: 2656026 - RNA, 17 nt, Human
aaauuaagguguuugaa

SEQ ID NO: 2656027 - RNA, 14 nt, Human
aaauguuaaaaguu

SEQ ID NO: 2656028 - RNA, 16 nt, Human
aaauguuaaaaguuuu

SEQ ID NO: 2656029 - RNA, 18 nt, Human
aaauguuaaaaguuuuau

SEQ ID NO: 2656030 - RNA, 19 nt, Human
aaauguuaaaaguuuuaua

SEQ ID NO: 2656031 - RNA, 23 nt, Human
aaauguuaaaaguuuuauaugcu

SEQ ID NO: 2656032 - RNA, 13 nt, Human
aaauguguacaua

SEQ ID NO: 2656033 - RNA, 20 nt, Human
gucaaacuguagaaaugaug

SEQ ID NO: 2656034 - RNA, 16 nt, Human
gucaaacuguagaaau

SEQ ID NO: 2656035 - RNA, 23 nt, Human
gucaaaaguagaacuuuguauag

SEQ ID NO: 2656036 - RNA, 17 nt, Human
gucaaaaguagaacuuu

SEQ ID NO: 2656037 - RNA, 16 nt, Human
gucaaaaguagaacuu

SEQ ID NO: 2656038 - RNA, 13 nt, Human
guauuuuucuuga

SEQ ID NO: 2656039 - RNA, 22 nt, Human
guauuuuguuuuugucuuaaaa

SEQ ID NO: 2656040 - RNA, 21 nt, Human
guauuuuuagaauaagaauuu

SEQ ID NO: 2656041 - RNA, 22 nt, Human
guauuuuuagaauaagaauuug

SEQ ID NO: 2656042 - RNA, 18 nt, Human
guauuuuuauacaaaccu

SEQ ID NO: 2656043 - RNA, 23 nt, Human
aaauuuaugguuuugguauuuuu

SEQ ID NO: 2656044 - RNA, 13 nt, Human
aaauuguuuagug

SEQ ID NO: 2656045 - RNA, 15 nt, Human
aaauuguuuagugau

SEQ ID NO: 2656046 - RNA, 23 nt, Human
aaauuguuuagugauauuacauu

SEQ ID NO: 2656047 - RNA, 16 nt, Human
aaauuguuaucaaaau

SEQ ID NO: 2656048 - RNA, 19 nt, Human
aaauuguuaucaaaauagu

SEQ ID NO: 2656049 - RNA, 17 nt, Human
aaauuauuugauuauuu

SEQ ID NO: 2656050 - RNA, 16 nt, Human
aaauucugauuucuuu

SEQ ID NO: 2656051 - RNA, 14 nt, Human
aaauucugauuucu

SEQ ID NO: 2656052 - RNA, 12 nt, Human
aaauucugauuu

SEQ ID NO: 2656053 - RNA, 16 nt, Human
aaauucuccuggaggu

SEQ ID NO: 2656054 - RNA, 20 nt, Human
aaauucugauuucuuuucac

SEQ ID NO: 2656055 - RNA, 17 nt, Human
aaauucugauuucuuuu

SEQ ID NO: 2656056 - RNA, 22 nt, Human
aaauucugauuucuuuucacca

SEQ ID NO: 2656057 - RNA, 20 nt, Human
aaauggucucuaacauuucc

SEQ ID NO: 2656058 - RNA, 22 nt, Human
guaaauuuaguguuuuuuuauu

SEQ ID NO: 2656059 - RNA, 20 nt, Human
guaacacuagggccuuggaa

SEQ ID NO: 2656060 - RNA, 15 nt, Human
guaacacuccucugc

SEQ ID NO: 2656061 - RNA, 17 nt, Human
guaguugccuuaaaaua

SEQ ID NO: 2656062 - RNA, 12 nt, Human
guaguugaaugg

SEQ ID NO: 2656063 - RNA, 11 nt, Human
aaauguaaacu

SEQ ID NO: 2656064 - RNA, 22 nt, Human
aaauguaaacucagcaucaaaa

SEQ ID NO: 2656065 - RNA, 19 nt, Human
guauauugguuuuaugaug

SEQ ID NO: 2656066 - RNA, 17 nt, Human
guauauuugauuuauua

SEQ ID NO: 2656067 - RNA, 22 nt, Human
guauauuguauaggggcaacug

SEQ ID NO: 2656068 - RNA, 17 nt, Human
guauauuuguaaagcua

SEQ ID NO: 2656069 - RNA, 23 nt, Human
guauauuugauuuauuaacuuaa

SEQ ID NO: 2656070 - RNA, 20 nt, Human
guauauuugauuuauuaacu

SEQ ID NO: 2656071 - RNA, 19 nt, Human
guauauuugauuuauuaac

SEQ ID NO: 2656072 - RNA, 18 nt, Human
guauauuugauuuauuaa

SEQ ID NO: 2656073 - RNA, 21 nt, Human
guauauuuuauauuacugaca

SEQ ID NO: 2656074 - RNA, 12 nt, Human
guauaaaauaca

SEQ ID NO: 2656075 - RNA, 14 nt, Human
guauaaaauacaua

SEQ ID NO: 2656076 - RNA, 18 nt, Human
guauaaaauacauaguga

SEQ ID NO: 2656077 - RNA, 20 nt, Human
guauaaaauacauagugaaa

SEQ ID NO: 2656078 - RNA, 12 nt, Human
guauaauaggcu

SEQ ID NO: 2656079 - RNA, 12 nt, Human
guauaauauaaa

SEQ ID NO: 2656080 - RNA, 13 nt, Human
guauaauauaaaa

SEQ ID NO: 2656081 - RNA, 14 nt, Human
guauaauauaaaaa

SEQ ID NO: 2656082 - RNA, 13 nt, Human
guauaauaaaauu

SEQ ID NO: 2656083 - RNA, 14 nt, Human
guauaauaaaauua

SEQ ID NO: 2656084 - RNA, 13 nt, Human
guauauugguuuu

SEQ ID NO: 2656085 - RNA, 14 nt, Human
guaucauauauuua

SEQ ID NO: 2656086 - RNA, 16 nt, Human
guaucauauauuuaau

SEQ ID NO: 2656087 - RNA, 14 nt, Human
guauccauauuuua

SEQ ID NO: 2656088 - RNA, 15 nt, Human
guauccauauuuuau

SEQ ID NO: 2656089 - RNA, 20 nt, Human
guauccauauuuuauuacug

SEQ ID NO: 2656090 - RNA, 21 nt, Human
guauccauauuuuauuacugu

SEQ ID NO: 2656091 - RNA, 16 nt, Human
guuuauuucacuugau

SEQ ID NO: 2656092 - RNA, 13 nt, Human
guuuacagaaaaa

SEQ ID NO: 2656093 - RNA, 19 nt, Human
guuuaauauugagaaagaa

SEQ ID NO: 2656094 - RNA, 17 nt, Human
guuuaauauugagaaag

SEQ ID NO: 2656095 - RNA, 15 nt, Human
guuuaauauugagaa

SEQ ID NO: 2656096 - RNA, 20 nt, Human
guuuaaucauaguuacugug

SEQ ID NO: 2656097 - RNA, 16 nt, Human
guuuauuuuaaaacaa

SEQ ID NO: 2656098 - RNA, 15 nt, Human
guuuauuuuaaaaca

SEQ ID NO: 2656099 - RNA, 17 nt, Human
guuuauuuucuacguuu

SEQ ID NO: 2656100 - RNA, 21 nt, Human
guuuauuuucuacguuucuuu

SEQ ID NO: 2656101 - RNA, 19 nt, Human
aagguauuuaaaguauuuu

SEQ ID NO: 2656102 - RNA, 22 nt, Human
aagguauuauacaugugauaca

SEQ ID NO: 2656103 - RNA, 20 nt, Human
guuucucuugagcuggccuc

SEQ ID NO: 2656104 - RNA, 19 nt, Human
guuucucuuugauuauuug

SEQ ID NO: 2656105 - RNA, 21 nt, Human
guuucucuuugauuauuugca

SEQ ID NO: 2656106 - RNA, 22 nt, Human
guuucucuuugauuauuugcau

SEQ ID NO: 2656107 - RNA, 17 nt, Human
guuucucuugagcuggc

SEQ ID NO: 2656108 - RNA, 18 nt, Human
guuucucuugagcuggcc

SEQ ID NO: 2656109 - RNA, 18 nt, Human
guuucuaugcaaaguucu

SEQ ID NO: 2656110 - RNA, 14 nt, Human
guuucucuguggcu

SEQ ID NO: 2656111 - RNA, 17 nt, Human
guuucuauuuuuugaaa

SEQ ID NO: 2656112 - RNA, 20 nt, Human
aaguaagaaagugaagcaaa

SEQ ID NO: 2656113 - RNA, 21 nt, Human
aaguaagaaagugaagcaaau

SEQ ID NO: 2656114 - RNA, 14 nt, Human
aaggucacuguuuc

SEQ ID NO: 2656115 - RNA, 15 nt, Human
aaggucacuguuucc

SEQ ID NO: 2656116 - RNA, 18 nt, Human
aaggucacuguuuccugg

SEQ ID NO: 2656117 - RNA, 13 nt, Human
guugcuugucuuc

SEQ ID NO: 2656118 - RNA, 14 nt, Human
guugcuugucuucu

SEQ ID NO: 2656119 - RNA, 13 nt, Human
guugcgggacaga

SEQ ID NO: 2656120 - RNA, 23 nt, Human
guugccuauaagccaaaauuaag

SEQ ID NO: 2656121 - RNA, 12 nt, Human
aaggauaaagaa

SEQ ID NO: 2656122 - RNA, 13 nt, Human
aaggauaaagaag

SEQ ID NO: 2656123 - RNA, 19 nt, Human
aaggcauuauaaaaagaau

SEQ ID NO: 2656124 - RNA, 17 nt, Human
aaggcaucuaucugugc

SEQ ID NO: 2656125 - RNA, 18 nt, Human
aaggcaucuaucugugcu

SEQ ID NO: 2656126 - RNA, 11 nt, Human
aaggagagcua

SEQ ID NO: 2656127 - RNA, 20 nt, Human
aaggaagcacucuguauauu

SEQ ID NO: 2656128 - RNA, 18 nt, Human
aaggaggaagagaaaaaa

SEQ ID NO: 2656129 - RNA, 19 nt, Human
aaggaagccggggaagaga

SEQ ID NO: 2656130 - RNA, 13 nt, Human
aaggaaauuuuac

SEQ ID NO: 2656131 - RNA, 20 nt, Human
aaggaaagcaauaaaugaau

SEQ ID NO: 2656132 - RNA, 16 nt, Human
aaggaaagcaauaaau

SEQ ID NO: 2656133 - RNA, 13 nt, Human
aaggaaagcaaua

SEQ ID NO: 2656134 - RNA, 15 nt, Human
aaggaaagaaaacau

SEQ ID NO: 2656135 - RNA, 13 nt, Human
aagcuccaagccc

SEQ ID NO: 2656136 - RNA, 12 nt, Human
aaggaaagaaaa

SEQ ID NO: 2656137 - RNA, 14 nt, Human
aagucauuaaacug

SEQ ID NO: 2656138 - RNA, 13 nt, Human
aagucauuaaacu

SEQ ID NO: 2656139 - RNA, 13 nt, Human
aagucauguaugu

SEQ ID NO: 2656140 - RNA, 16 nt, Human
aagucauguauguuuc

SEQ ID NO: 2656141 - RNA, 17 nt, Human
aagucauguauguuucu

SEQ ID NO: 2656142 - RNA, 19 nt, Human
aagucauguauguuucucu

SEQ ID NO: 2656143 - RNA, 17 nt, Human
aagucauuaaacugguu

SEQ ID NO: 2656144 - RNA, 15 nt, Human
aagucauuaaagaca

SEQ ID NO: 2656145 - RNA, 16 nt, Human
aagucauuaaacuggu

SEQ ID NO: 2656146 - RNA, 15 nt, Human
aagucuuucauggcu

SEQ ID NO: 2656147 - RNA, 14 nt, Human
aagucuuuaauaaa

SEQ ID NO: 2656148 - RNA, 16 nt, Human
aagucuuuaauaaaua

SEQ ID NO: 2656149 - RNA, 18 nt, Human
aagucuuuaauaaauaac

SEQ ID NO: 2656150 - RNA, 14 nt, Human
guuuuuccuggaau

SEQ ID NO: 2656151 - RNA, 18 nt, Human
guuuuucugugugucagu

SEQ ID NO: 2656152 - RNA, 20 nt, Human
guuuuucugugugucaguuu

SEQ ID NO: 2656153 - RNA, 21 nt, Human
aagugaaaaaggaggaagaga

SEQ ID NO: 2656154 - RNA, 16 nt, Human
aagucuuuuuugauca

SEQ ID NO: 2656155 - RNA, 15 nt, Human
aagucuuuuuuuucc

SEQ ID NO: 2656156 - RNA, 14 nt, Human
aagugaaaaugguc

SEQ ID NO: 2656157 - RNA, 13 nt, Human
aaguauuuauaau

SEQ ID NO: 2656158 - RNA, 12 nt, Human
aaguauuuauaa

SEQ ID NO: 2656159 - RNA, 21 nt, Human
aaguaaugaauuuuuaugaua

SEQ ID NO: 2656160 - RNA, 20 nt, Human
guuucugcauucauuuuuau

SEQ ID NO: 2656161 - RNA, 21 nt, Human
guuucugauuugcugcucuuc

SEQ ID NO: 2656162 - RNA, 20 nt, Human
guuuuggcaaacgcuaaaga

SEQ ID NO: 2656163 - RNA, 14 nt, Human
aaguaauauuuauu

SEQ ID NO: 2656164 - RNA, 22 nt, Human
aaguaauauuuauuaaauuuuu

SEQ ID NO: 2656165 - RNA, 15 nt, Human
aaguaaucaucuaag

SEQ ID NO: 2656166 - RNA, 17 nt, Human
aaguaaucaucuaaguc

SEQ ID NO: 2656167 - RNA, 23 nt, Human
guuuuggcugaaauucuccugga

SEQ ID NO: 2656168 - RNA, 20 nt, Human
guuuuggcugaaauucuccu

SEQ ID NO: 2656169 - RNA, 22 nt, Human
guuuuggcugaaauucuccugg

SEQ ID NO: 2656170 - RNA, 23 nt, Human
uaaaacggugcugugagggaggg

SEQ ID NO: 2656171 - RNA, 15 nt, Human
uaaaagaaugacuau

SEQ ID NO: 2656172 - RNA, 17 nt, Human
uaaaacuaaauuucacu

SEQ ID NO: 2656173 - RNA, 21 nt, Human
uaaaaccgaaggugaaaaaaa

SEQ ID NO: 2656174 - RNA, 22 nt, Human
uaaaaaucuaagcagcuuauug

SEQ ID NO: 2656175 - RNA, 15 nt, Human
uaaaaaucauaguac

SEQ ID NO: 2656176 - RNA, 15 nt, Human
uaaaaaguggaaaaa

SEQ ID NO: 2656177 - RNA, 19 nt, Human
guuuuugauagcauuguaa

SEQ ID NO: 2656178 - RNA, 23 nt, Human
guuuuugaggcuuucuguugcca

SEQ ID NO: 2656179 - RNA, 19 nt, Human
uaaaaauauuguuucugca

SEQ ID NO: 2656180 - RNA, 18 nt, Human
uaaaagacaguguaugua

SEQ ID NO: 2656181 - RNA, 21 nt, Human
uaaaagacaguguauguagaa

SEQ ID NO: 2656182 - RNA, 23 nt, Human
uaaaagacaguguauguagaagc

SEQ ID NO: 2656183 - RNA, 17 nt, Human
uaaaaguugcauuuuaa

SEQ ID NO: 2656184 - RNA, 18 nt, Human
uaaaauaauuauauaacu

SEQ ID NO: 2656185 - RNA, 21 nt, Human
uaaaauaauuauauaacugua

SEQ ID NO: 2656186 - RNA, 19 nt, Human
uaaaauaauuauauaacug

SEQ ID NO: 2656187 - RNA, 20 nt, Human
uaaaauaauuauauaacugu

SEQ ID NO: 2656188 - RNA, 17 nt, Human
uaaaaguuuuauaugcu

SEQ ID NO: 2656189 - RNA, 19 nt, Human
uaaaaguuuuauaugcuuu

SEQ ID NO: 2656190 - RNA, 14 nt, Human
uaaaauaaaaugaa

SEQ ID NO: 2656191 - RNA, 15 nt, Human
uaaaauaaaaugaaa

SEQ ID NO: 2656192 - RNA, 16 nt, Human
uaaaauaaaaugaaaa

SEQ ID NO: 2656193 - RNA, 17 nt, Human
uaaaauaaaaugaaaau

SEQ ID NO: 2656194 - RNA, 19 nt, Human
uaaaauaaaaugaaaauug

SEQ ID NO: 2656195 - RNA, 20 nt, Human
uaaaauaaaaugaaaauugu

SEQ ID NO: 2656196 - RNA, 21 nt, Human
uaaaauaaaaugaaaauugua

SEQ ID NO: 2656197 - RNA, 22 nt, Human
uaaaauaaaaugaaaauuguau

SEQ ID NO: 2656198 - RNA, 19 nt, Human
uaaaauagaaauuuuguaa

SEQ ID NO: 2656199 - RNA, 22 nt, Human
uaaaauagaaauuuuguaagaa

SEQ ID NO: 2656200 - RNA, 16 nt, Human
uaaaauagaguguagu

SEQ ID NO: 2656201 - RNA, 17 nt, Human
uaaaauagaguguaguu

SEQ ID NO: 2656202 - RNA, 21 nt, Human
uaaaauagaguguaguuuaca

SEQ ID NO: 2656203 - RNA, 23 nt, Human
uaaaauagaguguaguuuacaga

SEQ ID NO: 2656204 - RNA, 19 nt, Human
aagugccucaagaggaaug

SEQ ID NO: 2656205 - RNA, 20 nt, Human
aagugccucaagaggaauga

SEQ ID NO: 2656206 - RNA, 21 nt, Human
aagugccucaagaggaaugaa

SEQ ID NO: 2656207 - RNA, 15 nt, Human
aagugcccuuccugc

SEQ ID NO: 2656208 - RNA, 21 nt, Human
aagugaggaaaucaaagugcu

SEQ ID NO: 2656209 - RNA, 18 nt, Human
aagugaggaaaucaaagu

SEQ ID NO: 2656210 - RNA, 21 nt, Human
aagugaucaaacuacauauug

SEQ ID NO: 2656211 - RNA, 15 nt, Human
uaaaauauuuaucug

SEQ ID NO: 2656212 - RNA, 23 nt, Human
uaaaauauuguugaacacuugaa

SEQ ID NO: 2656213 - RNA, 16 nt, Human
gugugguagagugugc

SEQ ID NO: 2656214 - RNA, 22 nt, Human
gugugacaauucuguuuuuaau

SEQ ID NO: 2656215 - RNA, 16 nt, Human
aagaugguauauuugg

SEQ ID NO: 2656216 - RNA, 18 nt, Human
aagaugguaucauauauu

SEQ ID NO: 2656217 - RNA, 14 nt, Human
guguauuugcuuuu

SEQ ID NO: 2656218 - RNA, 12 nt, Human
guguauuuauuu

SEQ ID NO: 2656219 - RNA, 19 nt, Human
guguauuuauuuuacagcu

SEQ ID NO: 2656220 - RNA, 16 nt, Human
gugucagcauagaagu

SEQ ID NO: 2656221 - RNA, 16 nt, Human
aagaucgaauuuuuca

SEQ ID NO: 2656222 - RNA, 19 nt, Human
aagaugaaaggcaggccua

SEQ ID NO: 2656223 - RNA, 21 nt, Human
aagaugaaaggcaggccuauu

SEQ ID NO: 2656224 - RNA, 16 nt, Human
aagaugcuucucacug

SEQ ID NO: 2656225 - RNA, 17 nt, Human
aagaugcuucucacugc

SEQ ID NO: 2656226 - RNA, 19 nt, Human
aagaugcuucucacugcca

SEQ ID NO: 2656227 - RNA, 17 nt, Human
aagaggcugccccucuc

SEQ ID NO: 2656228 - RNA, 21 nt, Human
aagaggcugccccucucacca

SEQ ID NO: 2656229 - RNA, 22 nt, Human
aagaggcugccccucucaccaa

SEQ ID NO: 2656230 - RNA, 23 nt, Human
aagaggcugccccucucaccaaa

SEQ ID NO: 2656231 - RNA, 16 nt, Human
aagaggggguggaggg

SEQ ID NO: 2656232 - RNA, 13 nt, Human
aagagggggugga

SEQ ID NO: 2656233 - RNA, 20 nt, Human
guggggguggaggcuuccug

SEQ ID NO: 2656234 - RNA, 14 nt, Human
aagacuauauauau

SEQ ID NO: 2656235 - RNA, 20 nt, Human
aagacuauauauauaaaugu

SEQ ID NO: 2656236 - RNA, 21 nt, Human
aagacuauauauauaaaugua

SEQ ID NO: 2656237 - RNA, 22 nt, Human
aagacuauauauauaaauguau

SEQ ID NO: 2656238 - RNA, 12 nt, Human
aagacuaaaagu

SEQ ID NO: 2656239 - RNA, 18 nt, Human
aagagcagugguaagaau

SEQ ID NO: 2656240 - RNA, 14 nt, Human
aagagcaucugauu

SEQ ID NO: 2656241 - RNA, 19 nt, Human
aagaggaauuacgugcucu

SEQ ID NO: 2656242 - RNA, 20 nt, Human
aagaggaaugaaaaaagcuu

SEQ ID NO: 2656243 - RNA, 13 nt, Human
guggccuguggcu

SEQ ID NO: 2656244 - RNA, 17 nt, Human
guggccuguggcugucg

SEQ ID NO: 2656245 - RNA, 18 nt, Human
guggccuguggcugucgg

SEQ ID NO: 2656246 - RNA, 21 nt, Human
gugggaagcccauccugacca

SEQ ID NO: 2656247 - RNA, 20 nt, Human
gugggaagcccauccugacc

SEQ ID NO: 2656248 - RNA, 12 nt, Human
guggggcuuggg

SEQ ID NO: 2656249 - RNA, 15 nt, Human
guggggguggaggcu

SEQ ID NO: 2656250 - RNA, 17 nt, Human
guggggccgccgccucu

SEQ ID NO: 2656251 - RNA, 17 nt, Human
guuauuaucugggcuua

SEQ ID NO: 2656252 - RNA, 22 nt, Human
guuauuaucugggcuuauaucu

SEQ ID NO: 2656253 - RNA, 22 nt, Human
guuauucaacagcaagugugaa

SEQ ID NO: 2656254 - RNA, 16 nt, Human
guuagcuccuguggcc

SEQ ID NO: 2656255 - RNA, 20 nt, Human
guuagcuccuguggccccac

SEQ ID NO: 2656256 - RNA, 17 nt, Human
guuagcugaagaauuga

SEQ ID NO: 2656257 - RNA, 14 nt, Human
guuacuucugaggu

SEQ ID NO: 2656258 - RNA, 14 nt, Human
guuacuucuucucu

SEQ ID NO: 2656259 - RNA, 15 nt, Human
guuacuucuucucuu

SEQ ID NO: 2656260 - RNA, 16 nt, Human
guuacuucuucucuua

SEQ ID NO: 2656261 - RNA, 17 nt, Human
aagcuauuuaugggccc

SEQ ID NO: 2656262 - RNA, 18 nt, Human
aagcuauuuaugggcccc

SEQ ID NO: 2656263 - RNA, 22 nt, Human
aagcuauuuaugggccccuggc

SEQ ID NO: 2656264 - RNA, 20 nt, Human
guucaagaucaaaaaggcuu

SEQ ID NO: 2656265 - RNA, 14 nt, Human
guucaagaucaaaa

SEQ ID NO: 2656266 - RNA, 22 nt, Human
aagccucaaagagagaaaguuu

SEQ ID NO: 2656267 - RNA, 20 nt, Human
aagccuagaagagcuucuga

SEQ ID NO: 2656268 - RNA, 22 nt, Human
aagccuaaucacaguuuuuccu

SEQ ID NO: 2656269 - RNA, 17 nt, Human
aagccgagagccuuuug

SEQ ID NO: 2656270 - RNA, 21 nt, Human
aagccggggaagagauccaaa

SEQ ID NO: 2656271 - RNA, 22 nt, Human
aagccggggaagagauccaaag

SEQ ID NO: 2656272 - RNA, 19 nt, Human
aagcccugagcuuucugcu

SEQ ID NO: 2656273 - RNA, 14 nt, Human
aagcccauccugac

SEQ ID NO: 2656274 - RNA, 15 nt, Human
aagcccauccugacc

SEQ ID NO: 2656275 - RNA, 16 nt, Human
aagcccauccugacca

SEQ ID NO: 2656276 - RNA, 18 nt, Human
aagcccauccugaccagc

SEQ ID NO: 2656277 - RNA, 20 nt, Human
aagcccauccugaccagcug

SEQ ID NO: 2656278 - RNA, 13 nt, Human
aagccccacaugu

SEQ ID NO: 2656279 - RNA, 16 nt, Human
aagccccacaugucca

SEQ ID NO: 2656280 - RNA, 15 nt, Human
aagccaaagaaaaau

SEQ ID NO: 2656281 - RNA, 21 nt, Human
aagccaaagaaaaauaacccu

SEQ ID NO: 2656282 - RNA, 11 nt, Human
aagccaaagaa

SEQ ID NO: 2656283 - RNA, 13 nt, Human
aagccaaagaaaa

SEQ ID NO: 2656284 - RNA, 12 nt, Human
aagccaaagaaa

SEQ ID NO: 2656285 - RNA, 22 nt, Human
aagccaaaauuaagguguuuga

SEQ ID NO: 2656286 - RNA, 20 nt, Human
aagccaaaauuaagguguuu

SEQ ID NO: 2656287 - RNA, 17 nt, Human
aagccaaaauuaaggug

SEQ ID NO: 2656288 - RNA, 14 nt, Human
aagccaaaauuaag

SEQ ID NO: 2656289 - RNA, 18 nt, Human
aagcauuuuucaauauau

SEQ ID NO: 2656290 - RNA, 19 nt, Human
aagcauuuuucaauauauu

SEQ ID NO: 2656291 - RNA, 17 nt, Human
gugugugacaauucugu

SEQ ID NO: 2656292 - RNA, 17 nt, Human
aagcaguauuuuucuug

SEQ ID NO: 2656293 - RNA, 17 nt, Human
aagcagucgugccugug

SEQ ID NO: 2656294 - RNA, 18 nt, Human
aagcaguauuuuucuuga

SEQ ID NO: 2656295 - RNA, 18 nt, Human
aagcagucgugccugugu

SEQ ID NO: 2656296 - RNA, 19 nt, Human
aagcagucgugccuguguc

SEQ ID NO: 2656297 - RNA, 14 nt, Human
aagcauacuuugua

SEQ ID NO: 2656298 - RNA, 17 nt, Human
aagcauacuuuguaaau

SEQ ID NO: 2656299 - RNA, 18 nt, Human
aagcauacuuuguaaaua

SEQ ID NO: 2656300 - RNA, 20 nt, Human
aagcauagauaauauuguuu

SEQ ID NO: 2656301 - RNA, 21 nt, Human
aagcauagauaauauuguuug

SEQ ID NO: 2656302 - RNA, 22 nt, Human
aagcauagauaauauuguuugg

SEQ ID NO: 2656303 - RNA, 17 nt, Human
aauagcaacuuuugugu

SEQ ID NO: 2656304 - RNA, 15 nt, Human
aauagcaacuuuugu

SEQ ID NO: 2656305 - RNA, 21 nt, Human
aauagauuuuauaagaugacu

SEQ ID NO: 2656306 - RNA, 19 nt, Human
aauagcaacuuuuguguaa

SEQ ID NO: 2656307 - RNA, 13 nt, Human
aauagcaacuuuu

SEQ ID NO: 2656308 - RNA, 21 nt, Human
aauagacuguaacuuccaaau

SEQ ID NO: 2656309 - RNA, 23 nt, Human
aauagaguguaguuuacagaaaa

SEQ ID NO: 2656310 - RNA, 15 nt, Human
aauaccauuuaguaa

SEQ ID NO: 2656311 - RNA, 18 nt, Human
aauaccauuuaguaagaa

SEQ ID NO: 2656312 - RNA, 17 nt, Human
aauacaugaagcuucau

SEQ ID NO: 2656313 - RNA, 19 nt, Human
aauacaugaagcuucaugc

SEQ ID NO: 2656314 - RNA, 15 nt, Human
aauacaugcauauaa

SEQ ID NO: 2656315 - RNA, 18 nt, Human
aauacaugccacaucaaa

SEQ ID NO: 2656316 - RNA, 19 nt, Human
aauaccacaucaaauaaga

SEQ ID NO: 2656317 - RNA, 21 nt, Human
aauaccacaucaaauaagaaa

SEQ ID NO: 2656318 - RNA, 16 nt, Human
aauacacuaguuguuu

SEQ ID NO: 2656319 - RNA, 17 nt, Human
aauacacuaguuguuuc

SEQ ID NO: 2656320 - RNA, 13 nt, Human
aauacagaggcaa

SEQ ID NO: 2656321 - RNA, 12 nt, Human
uaacaaauaaaa

SEQ ID NO: 2656322 - RNA, 21 nt, Human
uaacaaauaaaaaagcucuuu

SEQ ID NO: 2656323 - RNA, 17 nt, Human
uaaauuauaguguagaa

SEQ ID NO: 2656324 - RNA, 19 nt, Human
uaaauuauaguguagaaaa

SEQ ID NO: 2656325 - RNA, 13 nt, Human
uaacaaagacaaa

SEQ ID NO: 2656326 - RNA, 10 nt, Human
uaaauuauuu

SEQ ID NO: 2656327 - RNA, 13 nt, Human
uaaauuauuuaug

SEQ ID NO: 2656328 - RNA, 20 nt, Human
uaaauuauuugauuauuuaa

SEQ ID NO: 2656329 - RNA, 22 nt, Human
uaaauuauuugauuauuuaaga

SEQ ID NO: 2656330 - RNA, 23 nt, Human
uaaauuauuugauuauuuaagac

SEQ ID NO: 2656331 - RNA, 22 nt, Human
uaaauguuaauggauuucagaa

SEQ ID NO: 2656332 - RNA, 23 nt, Human
uaaauguuaauggauuucagaag

SEQ ID NO: 2656333 - RNA, 16 nt, Human
uaaauguuaccucuga

SEQ ID NO: 2656334 - RNA, 17 nt, Human
uaaauguuaccucugaa

SEQ ID NO: 2656335 - RNA, 18 nt, Human
uaaauguuaccucugaau

SEQ ID NO: 2656336 - RNA, 16 nt, Human
aagugccuuugcagcu

SEQ ID NO: 2656337 - RNA, 22 nt, Human
aagugcgggguaggggaagaag

SEQ ID NO: 2656338 - RNA, 17 nt, Human
aagugcggugcuuuagc

SEQ ID NO: 2656339 - RNA, 14 nt, Human
uaaaugaaagaaaa

SEQ ID NO: 2656340 - RNA, 22 nt, Human
uaaaugaaagaaaauugaguug

SEQ ID NO: 2656341 - RNA, 15 nt, Human
aauauauuuuuagac

SEQ ID NO: 2656342 - RNA, 18 nt, Human
aauauauuuuuagacuca

SEQ ID NO: 2656343 - RNA, 14 nt, Human
aauaucaaagucau

SEQ ID NO: 2656344 - RNA, 20 nt, Human
aauaucaaagucauuaaaga

SEQ ID NO: 2656345 - RNA, 21 nt, Human
aauaucaaagucauuaaagac

SEQ ID NO: 2656346 - RNA, 14 nt, Human
aauaucaaauuaau

SEQ ID NO: 2656347 - RNA, 13 nt, Human
aauaucaaauuaa

SEQ ID NO: 2656348 - RNA, 14 nt, Human
aauauauuuuuaga

SEQ ID NO: 2656349 - RNA, 15 nt, Human
aauauauuuucuguu

SEQ ID NO: 2656350 - RNA, 21 nt, Human
aauauauuuucuguuuucuuu

SEQ ID NO: 2656351 - RNA, 21 nt, Human
aauauauuuauaaggaaauuu

SEQ ID NO: 2656352 - RNA, 21 nt, Human
uaacaguaugugggauauuga

SEQ ID NO: 2656353 - RNA, 16 nt, Human
aauagucuuugccagu

SEQ ID NO: 2656354 - RNA, 15 nt, Human
aauagucuauauuuu

SEQ ID NO: 2656355 - RNA, 13 nt, Human
aauauauugaacu

SEQ ID NO: 2656356 - RNA, 18 nt, Human
aauauauugaacuuuugu

SEQ ID NO: 2656357 - RNA, 19 nt, Human
aauauauugaacuuuugua

SEQ ID NO: 2656358 - RNA, 20 nt, Human
aauauauugaacuuuuguac

SEQ ID NO: 2656359 - RNA, 23 nt, Human
aauauauugaacuuuuguacuga

SEQ ID NO: 2656360 - RNA, 18 nt, Human
uaagaauucaaacugggg

SEQ ID NO: 2656361 - RNA, 14 nt, Human
uaagaauucaaacu

SEQ ID NO: 2656362 - RNA, 15 nt, Human
uaagaaggcaauauu

SEQ ID NO: 2656363 - RNA, 17 nt, Human
uaagaaggcaauauuaa

SEQ ID NO: 2656364 - RNA, 20 nt, Human
uaagaaggcaauauuaaccu

SEQ ID NO: 2656365 - RNA, 22 nt, Human
uaagaauucaaacuggggccuc

SEQ ID NO: 2656366 - RNA, 15 nt, Human
uaagaauucagacau

SEQ ID NO: 2656367 - RNA, 16 nt, Human
uaagaauucagacauc

SEQ ID NO: 2656368 - RNA, 13 nt, Human
uaagaauucugau

SEQ ID NO: 2656369 - RNA, 18 nt, Human
uaagaauucugauugauu

SEQ ID NO: 2656370 - RNA, 19 nt, Human
uaagaauucugauugauuu

SEQ ID NO: 2656371 - RNA, 20 nt, Human
uaagaauucugauugauuug

SEQ ID NO: 2656372 - RNA, 12 nt, Human
uaagaauuugca

SEQ ID NO: 2656373 - RNA, 13 nt, Human
uaagaauuugcau

SEQ ID NO: 2656374 - RNA, 14 nt, Human
uaagaauuugcaua

SEQ ID NO: 2656375 - RNA, 18 nt, Human
uaagaauuugcauacuua

SEQ ID NO: 2656376 - RNA, 22 nt, Human
uaacgcguaucuaggcuuuggu

SEQ ID NO: 2656377 - RNA, 17 nt, Human
aaucuaaaucuauuuau

SEQ ID NO: 2656378 - RNA, 16 nt, Human
aaucuaaaucuauuua

SEQ ID NO: 2656379 - RNA, 19 nt, Human
aaucuaaaucuauuuauua

SEQ ID NO: 2656380 - RNA, 20 nt, Human
aauccuccaaccaggcuccu

SEQ ID NO: 2656381 - RNA, 15 nt, Human
aaucuaaaucuauuu

SEQ ID NO: 2656382 - RNA, 14 nt, Human
aaucuaaaucuauu

SEQ ID NO: 2656383 - RNA, 15 nt, Human
aaucgggguauaaua

SEQ ID NO: 2656384 - RNA, 19 nt, Human
aaucgggguauaauaggcu

SEQ ID NO: 2656385 - RNA, 17 nt, Human
aauccugauuccucucu

SEQ ID NO: 2656386 - RNA, 19 nt, Human
aauccugauuccucucuaa

SEQ ID NO: 2656387 - RNA, 21 nt, Human
aauccuggagaggguauuuuu

SEQ ID NO: 2656388 - RNA, 12 nt, Human
aauccuggcagc

SEQ ID NO: 2656389 - RNA, 13 nt, Human
aauccuggcagcc

SEQ ID NO: 2656390 - RNA, 20 nt, Human
aaucccuguguuaauuuaag

SEQ ID NO: 2656391 - RNA, 21 nt, Human
aaucuauuuauuaauauuuaa

SEQ ID NO: 2656392 - RNA, 20 nt, Human
aaucuauuuauuaauauuua

SEQ ID NO: 2656393 - RNA, 18 nt, Human
aaucuauuuauuaauauu

SEQ ID NO: 2656394 - RNA, 17 nt, Human
aaucuauuuauuaauau

SEQ ID NO: 2656395 - RNA, 16 nt, Human
aaucuauuuauuaaua

SEQ ID NO: 2656396 - RNA, 21 nt, Human
aaucuauggucgggagacagc

SEQ ID NO: 2656397 - RNA, 19 nt, Human
aaucccuguguuaauuuaa

SEQ ID NO: 2656398 - RNA, 18 nt, Human
aaucccuguguuaauuua

SEQ ID NO: 2656399 - RNA, 22 nt, Human
aaucccugcuuuuuguguuuuu

SEQ ID NO: 2656400 - RNA, 13 nt, Human
aaucccugcuuuu

SEQ ID NO: 2656401 - RNA, 14 nt, Human
aaucccugcuuuuu

SEQ ID NO: 2656402 - RNA, 14 nt, Human
aauccccuaaaaua

SEQ ID NO: 2656403 - RNA, 17 nt, Human
aauccccuaaaauaaca

SEQ ID NO: 2656404 - RNA, 20 nt, Human
aaucccagcacuuugggagg

SEQ ID NO: 2656405 - RNA, 17 nt, Human
aaucccauuuaaaaaaa

SEQ ID NO: 2656406 - RNA, 21 nt, Human
uaauaaaaaggaguauacaaa

SEQ ID NO: 2656407 - RNA, 23 nt, Human
uaauaaaaaggaguauacaaaca

SEQ ID NO: 2656408 - RNA, 14 nt, Human
uaaguauuuauaau

SEQ ID NO: 2656409 - RNA, 20 nt, Human
uaagugugugguagaaacaa

SEQ ID NO: 2656410 - RNA, 21 nt, Human
uaagugugugguagaaacaaa

SEQ ID NO: 2656411 - RNA, 13 nt, Human
uaaguuaucuuug

SEQ ID NO: 2656412 - RNA, 16 nt, Human
uaauaaaaaaagaaag

SEQ ID NO: 2656413 - RNA, 17 nt, Human
uaauaaaaaaagaaagc

SEQ ID NO: 2656414 - RNA, 19 nt, Human
uaauaaaaaaagaaagcau

SEQ ID NO: 2656415 - RNA, 17 nt, Human
uaagcagcuuauuguuu

SEQ ID NO: 2656416 - RNA, 22 nt, Human
aaucagucauguguaauaugca

SEQ ID NO: 2656417 - RNA, 17 nt, Human
uaagcauacuuuguaaa

SEQ ID NO: 2656418 - RNA, 18 nt, Human
uaagcauacuuuguaaau

SEQ ID NO: 2656419 - RNA, 19 nt, Human
uaagcauacuuuguaaaua

SEQ ID NO: 2656420 - RNA, 17 nt, Human
uaagauuaagagcaaau

SEQ ID NO: 2656421 - RNA, 13 nt, Human
uaaggaagacaau

SEQ ID NO: 2656422 - RNA, 21 nt, Human
uaaggaaagcaauaaaugaau

SEQ ID NO: 2656423 - RNA, 18 nt, Human
uaaggaaagcaauaaaug

SEQ ID NO: 2656424 - RNA, 16 nt, Human
uaaggaaagcaauaaa

SEQ ID NO: 2656425 - RNA, 15 nt, Human
uaaggacaaagugcc

SEQ ID NO: 2656426 - RNA, 16 nt, Human
uaaggacaaagugcca

SEQ ID NO: 2656427 - RNA, 20 nt, Human
uaaggacaaagugccaaaga

SEQ ID NO: 2656428 - RNA, 21 nt, Human
uaaggacaaagugccaaagaa

SEQ ID NO: 2656429 - RNA, 23 nt, Human
uaaggacaaagugccaaagaaag

SEQ ID NO: 2656430 - RNA, 16 nt, Human
uaaggaccuuaagaca

SEQ ID NO: 2656431 - RNA, 14 nt, Human
uaaggacugacuga

SEQ ID NO: 2656432 - RNA, 19 nt, Human
uaaggacugacugaggcag

SEQ ID NO: 2656433 - RNA, 18 nt, Human
uaaggacugacugaggca

SEQ ID NO: 2656434 - RNA, 11 nt, Human
aaucagccugc

SEQ ID NO: 2656435 - RNA, 18 nt, Human
aaucacuguguauauuug

SEQ ID NO: 2656436 - RNA, 17 nt, Human
aaucacuguguauauuu

SEQ ID NO: 2656437 - RNA, 16 nt, Human
aaucacuguguauauu

SEQ ID NO: 2656438 - RNA, 15 nt, Human
aaucacuguguauau

SEQ ID NO: 2656439 - RNA, 14 nt, Human
aaucagcauuuagu

SEQ ID NO: 2656440 - RNA, 15 nt, Human
aaucagccaaguuuu

SEQ ID NO: 2656441 - RNA, 17 nt, Human
aaucagccaaguuuuau

SEQ ID NO: 2656442 - RNA, 18 nt, Human
aaucagccaaguuuuaua

SEQ ID NO: 2656443 - RNA, 10 nt, Human
aaucacugug

SEQ ID NO: 2656444 - RNA, 14 nt, Human
aaucacuguguaua

SEQ ID NO: 2656445 - RNA, 13 nt, Human
aaucacuguguau

SEQ ID NO: 2656446 - RNA, 18 nt, Human
aaucagccugcuccagcu

SEQ ID NO: 2656447 - RNA, 13 nt, Human
aaucagccugcuc

SEQ ID NO: 2656448 - RNA, 19 nt, Human
aaucagccugcuccagcug

SEQ ID NO: 2656449 - RNA, 19 nt, Human
aaucacuguguauauuuga

SEQ ID NO: 2656450 - RNA, 20 nt, Human
aaucaggaauauuuuccaaa

SEQ ID NO: 2656451 - RNA, 18 nt, Human
aaucaggaauauuuucca

SEQ ID NO: 2656452 - RNA, 13 nt, Human
aauauuuucuauu

SEQ ID NO: 2656453 - RNA, 16 nt, Human
aauauuuucuauuuua

SEQ ID NO: 2656454 - RNA, 19 nt, Human
aauauuuucucuguacuuu

SEQ ID NO: 2656455 - RNA, 22 nt, Human
aauauuuucucuguacuuuuca

SEQ ID NO: 2656456 - RNA, 23 nt, Human
aauauuuucucuguacuuuucau

SEQ ID NO: 2656457 - RNA, 16 nt, Human
aauauuuauuaaauuu

SEQ ID NO: 2656458 - RNA, 20 nt, Human
aauauuuugaaucaauaaua

SEQ ID NO: 2656459 - RNA, 13 nt, Human
aauauuuugaauc

SEQ ID NO: 2656460 - RNA, 14 nt, Human
aauauuuugaauca

SEQ ID NO: 2656461 - RNA, 15 nt, Human
aauauuuugaaucaa

SEQ ID NO: 2656462 - RNA, 16 nt, Human
aauauuuugaaucaau

SEQ ID NO: 2656463 - RNA, 18 nt, Human
aauauuuugaaucaauaa

SEQ ID NO: 2656464 - RNA, 22 nt, Human
aauauuuugaaucaauaauaua

SEQ ID NO: 2656465 - RNA, 18 nt, Human
uaagacuauauauauaaa

SEQ ID NO: 2656466 - RNA, 19 nt, Human
uaagacuauauauauaaau

SEQ ID NO: 2656467 - RNA, 20 nt, Human
uaagacuauauauauaaaug

SEQ ID NO: 2656468 - RNA, 23 nt, Human
uaagacuauauauauaaauguau

SEQ ID NO: 2656469 - RNA, 15 nt, Human
uaagacuguguauuc

SEQ ID NO: 2656470 - RNA, 17 nt, Human
uaagacuguagauaugu

SEQ ID NO: 2656471 - RNA, 15 nt, Human
aauauuuauuaaauu

SEQ ID NO: 2656472 - RNA, 12 nt, Human
aauauuuauuaa

SEQ ID NO: 2656473 - RNA, 21 nt, Human
uacaaugaacacuuauaagug

SEQ ID NO: 2656474 - RNA, 17 nt, Human
uaauuuuuguauuauuu

SEQ ID NO: 2656475 - RNA, 21 nt, Human
uaauuuuuguauuauuuuugu

SEQ ID NO: 2656476 - RNA, 13 nt, Human
uaauuuuuuuuaa

SEQ ID NO: 2656477 - RNA, 17 nt, Human
uaauuuuuuuuaaaaua

SEQ ID NO: 2656478 - RNA, 20 nt, Human
uaauuuuuuuuaaaauagaa

SEQ ID NO: 2656479 - RNA, 16 nt, Human
uaauuuuuuuuaguau

SEQ ID NO: 2656480 - RNA, 18 nt, Human
aaugcugggacucagccu

SEQ ID NO: 2656481 - RNA, 14 nt, Human
aaugcauauuugca

SEQ ID NO: 2656482 - RNA, 17 nt, Human
aaugcauauuugcaaag

SEQ ID NO: 2656483 - RNA, 18 nt, Human
aaugcauauuugcaaagu

SEQ ID NO: 2656484 - RNA, 23 nt, Human
aaugcauauuugcaaaguguauu

SEQ ID NO: 2656485 - RNA, 14 nt, Human
aaugcaucuuugau

SEQ ID NO: 2656486 - RNA, 20 nt, Human
aaugcaucuuugauguguug

SEQ ID NO: 2656487 - RNA, 19 nt, Human
aaugcaucuuugauguguu

SEQ ID NO: 2656488 - RNA, 18 nt, Human
aaugcaucuuugaugugu

SEQ ID NO: 2656489 - RNA, 15 nt, Human
aaugcaucuuugaug

SEQ ID NO: 2656490 - RNA, 15 nt, Human
aauguaagugggccc

SEQ ID NO: 2656491 - RNA, 13 nt, Human
aauguaauuuaaa

SEQ ID NO: 2656492 - RNA, 16 nt, Human
aauguaauuuaaauga

SEQ ID NO: 2656493 - RNA, 17 nt, Human
aauguaauuuaaaugaa

SEQ ID NO: 2656494 - RNA, 21 nt, Human
uaauuccuauauccugugacu

SEQ ID NO: 2656495 - RNA, 12 nt, Human
uaauuuaaauga

SEQ ID NO: 2656496 - RNA, 13 nt, Human
uaauuuaaaugaa

SEQ ID NO: 2656497 - RNA, 16 nt, Human
uaauuuaaaugaaaga

SEQ ID NO: 2656498 - RNA, 17 nt, Human
uaauuauuauuuccagu

SEQ ID NO: 2656499 - RNA, 16 nt, Human
uaauuuacuuguuuug

SEQ ID NO: 2656500 - RNA, 20 nt, Human
uaauuuacuuguuuuggaug

SEQ ID NO: 2656501 - RNA, 17 nt, Human
aaugcaaaaacucuuug

SEQ ID NO: 2656502 - RNA, 22 nt, Human
aaugcacuuucuauccucugua

SEQ ID NO: 2656503 - RNA, 11 nt, Human
aaugcacuuuc

SEQ ID NO: 2656504 - RNA, 13 nt, Human
aaugcacuuucua

SEQ ID NO: 2656505 - RNA, 15 nt, Human
aaugcacuuucuauc

SEQ ID NO: 2656506 - RNA, 14 nt, Human
aaugacguuuacau

SEQ ID NO: 2656507 - RNA, 12 nt, Human
aaugagagcaua

SEQ ID NO: 2656508 - RNA, 11 nt, Human
aaugagccugg

SEQ ID NO: 2656509 - RNA, 15 nt, Human
aaugacuauauaauu

SEQ ID NO: 2656510 - RNA, 21 nt, Human
aaugacuauauaauuuauuuc

SEQ ID NO: 2656511 - RNA, 23 nt, Human
aaugacuauauaauuuauuucca

SEQ ID NO: 2656512 - RNA, 15 nt, Human
aaugacucaaagucu

SEQ ID NO: 2656513 - RNA, 16 nt, Human
aaugacucaaagucug

SEQ ID NO: 2656514 - RNA, 11 nt, Human
aaugacuuuau

SEQ ID NO: 2656515 - RNA, 17 nt, Human
aaugacuuuauuauuua

SEQ ID NO: 2656516 - RNA, 15 nt, Human
aaugacuuuauuauu

SEQ ID NO: 2656517 - RNA, 14 nt, Human
aaugacuuuauuau

SEQ ID NO: 2656518 - RNA, 13 nt, Human
aaugacuuuauua

SEQ ID NO: 2656519 - RNA, 19 nt, Human
aaugagucuguuguguguc

SEQ ID NO: 2656520 - RNA, 23 nt, Human
aaugaggugggagguggaagaag

SEQ ID NO: 2656521 - RNA, 14 nt, Human
aaugagucuguugu

SEQ ID NO: 2656522 - RNA, 13 nt, Human
aaugagccuggca

SEQ ID NO: 2656523 - RNA, 12 nt, Human
aaugagccuggc

SEQ ID NO: 2656524 - RNA, 14 nt, Human
aaugagccuggcaa

SEQ ID NO: 2656525 - RNA, 14 nt, Human
aauguuguaguguc

SEQ ID NO: 2656526 - RNA, 22 nt, Human
aauguugggacugcuaaauaaa

SEQ ID NO: 2656527 - RNA, 21 nt, Human
aauguuccucaaagcuuggau

SEQ ID NO: 2656528 - RNA, 22 nt, Human
aauguuccucaaagcuuggauu

SEQ ID NO: 2656529 - RNA, 13 nt, Human
aauguugggacug

SEQ ID NO: 2656530 - RNA, 21 nt, Human
aauguugggacugcuaaauaa

SEQ ID NO: 2656531 - RNA, 18 nt, Human
aauguucacaauauauuu

SEQ ID NO: 2656532 - RNA, 12 nt, Human
aauguuagagua

SEQ ID NO: 2656533 - RNA, 20 nt, Human
aauguuagaguaaugaaaug

SEQ ID NO: 2656534 - RNA, 15 nt, Human
aauguuaccucugaa

SEQ ID NO: 2656535 - RNA, 16 nt, Human
aauguuaccucugaau

SEQ ID NO: 2656536 - RNA, 17 nt, Human
uacccccuccuucagac

SEQ ID NO: 2656537 - RNA, 16 nt, Human
uacccccuccuucaga

SEQ ID NO: 2656538 - RNA, 13 nt, Human
uacccccuccuuc

SEQ ID NO: 2656539 - RNA, 13 nt, Human
uaccagcugcgcu

SEQ ID NO: 2656540 - RNA, 14 nt, Human
uaccagcugcgcuu

SEQ ID NO: 2656541 - RNA, 21 nt, Human
uaccagcugcgcuugcuuuuc

SEQ ID NO: 2656542 - RNA, 22 nt, Human
uaccagcugcgcuugcuuuucu

SEQ ID NO: 2656543 - RNA, 13 nt, Human
uacauucaaauuu

SEQ ID NO: 2656544 - RNA, 14 nt, Human
uacauucaaauuug

SEQ ID NO: 2656545 - RNA, 15 nt, Human
uacauucaaauuugu

SEQ ID NO: 2656546 - RNA, 17 nt, Human
uacauucaaauuugucu

SEQ ID NO: 2656547 - RNA, 18 nt, Human
uacauucaaauuugucug

SEQ ID NO: 2656548 - RNA, 21 nt, Human
uacauucaaauuugucugguu

SEQ ID NO: 2656549 - RNA, 14 nt, Human
uacauuuauuuauc

SEQ ID NO: 2656550 - RNA, 17 nt, Human
uacauuuauuuauccag

SEQ ID NO: 2656551 - RNA, 20 nt, Human
uacauuuauuuauccagaaa

SEQ ID NO: 2656552 - RNA, 23 nt, Human
uacauuuauuuauccagaaaacu

SEQ ID NO: 2656553 - RNA, 19 nt, Human
uacauuugaugcaugucuu

SEQ ID NO: 2656554 - RNA, 19 nt, Human
uaccagagguugugcacug

SEQ ID NO: 2656555 - RNA, 16 nt, Human
aauuauuuaauugucc

SEQ ID NO: 2656556 - RNA, 14 nt, Human
aauuauuugauuau

SEQ ID NO: 2656557 - RNA, 20 nt, Human
aauuauuugauuauuuaaga

SEQ ID NO: 2656558 - RNA, 14 nt, Human
aauucaacuuugua

SEQ ID NO: 2656559 - RNA, 15 nt, Human
aauucaacuuuguaa

SEQ ID NO: 2656560 - RNA, 16 nt, Human
aauucaacuuuguaaa

SEQ ID NO: 2656561 - RNA, 22 nt, Human
aauucaacuuuguaaaaaucuu

SEQ ID NO: 2656562 - RNA, 16 nt, Human
aauucagacaucugag

SEQ ID NO: 2656563 - RNA, 21 nt, Human
aauucagacaucugagguuuu

SEQ ID NO: 2656564 - RNA, 22 nt, Human
aauucagacaucugagguuuua

SEQ ID NO: 2656565 - RNA, 16 nt, Human
aauucaucugucuaua

SEQ ID NO: 2656566 - RNA, 18 nt, Human
aauucauaguaagauuga

SEQ ID NO: 2656567 - RNA, 19 nt, Human
aauuacaguccaaaauacu

SEQ ID NO: 2656568 - RNA, 21 nt, Human
uaccugauuucuucagggcug

SEQ ID NO: 2656569 - RNA, 18 nt, Human
uacccggggcccagggca

SEQ ID NO: 2656570 - RNA, 18 nt, Human
uacccccuccuucagaca

SEQ ID NO: 2656571 - RNA, 18 nt, Human
uauaagugaagugauacu

SEQ ID NO: 2656572 - RNA, 21 nt, Human
uauaauuguucucagaauccc

SEQ ID NO: 2656573 - RNA, 15 nt, Human
uauacaugugauaca

SEQ ID NO: 2656574 - RNA, 18 nt, Human
uauacaugugauacauuu

SEQ ID NO: 2656575 - RNA, 20 nt, Human
uauacaugugauacauuuuu

SEQ ID NO: 2656576 - RNA, 21 nt, Human
uauacaugaagaauagaaaca

SEQ ID NO: 2656577 - RNA, 22 nt, Human
uauacaugaagaauagaaacaa

SEQ ID NO: 2656578 - RNA, 19 nt, Human
uauacauauauauauauaa

SEQ ID NO: 2656579 - RNA, 15 nt, Human
uauaagugaagugau

SEQ ID NO: 2656580 - RNA, 14 nt, Human
uauaagugaaguga

SEQ ID NO: 2656581 - RNA, 13 nt, Human
uauaacuguauuu

SEQ ID NO: 2656582 - RNA, 23 nt, Human
uauaacuguauuugaaauaagaa

SEQ ID NO: 2656583 - RNA, 21 nt, Human
acacucaaaagcugggcaggu

SEQ ID NO: 2656584 - RNA, 18 nt, Human
uagucaccagagacuuua

SEQ ID NO: 2656585 - RNA, 15 nt, Human
uagucaccagagacu

SEQ ID NO: 2656586 - RNA, 13 nt, Human
uauaggcuauuuu

SEQ ID NO: 2656587 - RNA, 17 nt, Human
uauaggcuauuuucuaa

SEQ ID NO: 2656588 - RNA, 21 nt, Human
uauaggcuauuuucuaaagac

SEQ ID NO: 2656589 - RNA, 15 nt, Human
uauagcuugcagaac

SEQ ID NO: 2656590 - RNA, 19 nt, Human
uauaggaacauaugaaaau

SEQ ID NO: 2656591 - RNA, 21 nt, Human
uauagcugagacuacaagugu

SEQ ID NO: 2656592 - RNA, 18 nt, Human
uauagcaucacuuaaaac

SEQ ID NO: 2656593 - RNA, 17 nt, Human
uauagcaucacuuaaaa

SEQ ID NO: 2656594 - RNA, 16 nt, Human
uauagcaucacuuaaa

SEQ ID NO: 2656595 - RNA, 15 nt, Human
uauagcaucacuuaa

SEQ ID NO: 2656596 - RNA, 16 nt, Human
uauagcaugaaauaaa

SEQ ID NO: 2656597 - RNA, 20 nt, Human
uauagcaugaaauaaaauau

SEQ ID NO: 2656598 - RNA, 14 nt, Human
uauagcaucacuua

SEQ ID NO: 2656599 - RNA, 16 nt, Human
uauauauuuuguguga

SEQ ID NO: 2656600 - RNA, 18 nt, Human
uauauauuuugugugaaa

SEQ ID NO: 2656601 - RNA, 23 nt, Human
uauauauuuugugugaaauugca

SEQ ID NO: 2656602 - RNA, 13 nt, Human
uauauauuucuau

SEQ ID NO: 2656603 - RNA, 17 nt, Human
uauauauuucuauuauu

SEQ ID NO: 2656604 - RNA, 17 nt, Human
uauaucuauauauauaa

SEQ ID NO: 2656605 - RNA, 23 nt, Human
uauauauguguaugcacaguaaa

SEQ ID NO: 2656606 - RNA, 21 nt, Human
uauauauguguaugcacagua

SEQ ID NO: 2656607 - RNA, 21 nt, Human
uauauagcaucuggaagauca

SEQ ID NO: 2656608 - RNA, 14 nt, Human
uauauaggcuauuu

SEQ ID NO: 2656609 - RNA, 18 nt, Human
uauauaggcuauuuucua

SEQ ID NO: 2656610 - RNA, 23 nt, Human
uauauaggcuauuuucuaaagac

SEQ ID NO: 2656611 - RNA, 14 nt, Human
acacuuauaaguga

SEQ ID NO: 2656612 - RNA, 13 nt, Human
acagaaaugagga

SEQ ID NO: 2656613 - RNA, 17 nt, Human
acagaaauggaaagcag

SEQ ID NO: 2656614 - RNA, 15 nt, Human
acagaaauggacugg

SEQ ID NO: 2656615 - RNA, 15 nt, Human
acagaaaaagacuuu

SEQ ID NO: 2656616 - RNA, 23 nt, Human
acacuugauggagugugagccac

SEQ ID NO: 2656617 - RNA, 13 nt, Human
acacuugaaaccu

SEQ ID NO: 2656618 - RNA, 14 nt, Human
acacuugaaaccuu

SEQ ID NO: 2656619 - RNA, 19 nt, Human
acacuucuuacgcaaugcu

SEQ ID NO: 2656620 - RNA, 20 nt, Human
acacuucuuacgcaaugcuu

SEQ ID NO: 2656621 - RNA, 12 nt, Human
uaucaaagucau

SEQ ID NO: 2656622 - RNA, 18 nt, Human
uaucaaagucauuaaaga

SEQ ID NO: 2656623 - RNA, 20 nt, Human
uaucaaagucauuaaagaca

SEQ ID NO: 2656624 - RNA, 14 nt, Human
uaucaaauuaauug

SEQ ID NO: 2656625 - RNA, 16 nt, Human
uaucaaauuaauugug

SEQ ID NO: 2656626 - RNA, 15 nt, Human
uaucaaauuaauugu

SEQ ID NO: 2656627 - RNA, 17 nt, Human
uaucaaauuaauugugu

SEQ ID NO: 2656628 - RNA, 12 nt, Human
uaucuauaaaau

SEQ ID NO: 2656629 - RNA, 13 nt, Human
uaucuauaaaaua

SEQ ID NO: 2656630 - RNA, 18 nt, Human
uaucuauaaaauagauau

SEQ ID NO: 2656631 - RNA, 22 nt, Human
uaucuauaaaauagauauaaau

SEQ ID NO: 2656632 - RNA, 18 nt, Human
uaucccaagaaugcaaga

SEQ ID NO: 2656633 - RNA, 13 nt, Human
uauccccaucucc

SEQ ID NO: 2656634 - RNA, 17 nt, Human
uauccccaucucccugc

SEQ ID NO: 2656635 - RNA, 20 nt, Human
uauccccaucucccugccug

SEQ ID NO: 2656636 - RNA, 21 nt, Human
uauccccaucucccugccugg

SEQ ID NO: 2656637 - RNA, 22 nt, Human
uauccccaucucccugccuggc

SEQ ID NO: 2656638 - RNA, 16 nt, Human
uaucccacauccaacu

SEQ ID NO: 2656639 - RNA, 15 nt, Human
uauccccccaucuug

SEQ ID NO: 2656640 - RNA, 17 nt, Human
uauccccccaucuugcu

SEQ ID NO: 2656641 - RNA, 19 nt, Human
uauccccccaucuugcuuc

SEQ ID NO: 2656642 - RNA, 20 nt, Human
uauccccccaucuugcuucc

SEQ ID NO: 2656643 - RNA, 16 nt, Human
uauccacaugaaaaua

SEQ ID NO: 2656644 - RNA, 18 nt, Human
uauccacaugaaaauaaa

SEQ ID NO: 2656645 - RNA, 13 nt, Human
uaugugauuacaa

SEQ ID NO: 2656646 - RNA, 23 nt, Human
acaggccucuccauuugcucuuc

SEQ ID NO: 2656647 - RNA, 22 nt, Human
acagcuugagccgggccccugg

SEQ ID NO: 2656648 - RNA, 23 nt, Human
acagcuugaccugaggcuguggu

SEQ ID NO: 2656649 - RNA, 16 nt, Human
acagcuugagccgggc

SEQ ID NO: 2656650 - RNA, 21 nt, Human
acagcuugagccgggccccug

SEQ ID NO: 2656651 - RNA, 15 nt, Human
acaggagacaaaaga

SEQ ID NO: 2656652 - RNA, 18 nt, Human
acaggagacaaaagagca

SEQ ID NO: 2656653 - RNA, 14 nt, Human
acaggagaccuggc

SEQ ID NO: 2656654 - RNA, 15 nt, Human
acagcuugaccugag

SEQ ID NO: 2656655 - RNA, 17 nt, Human
acagcuugaccugaggc

SEQ ID NO: 2656656 - RNA, 19 nt, Human
acagcuugaccugaggcug

SEQ ID NO: 2656657 - RNA, 21 nt, Human
acagcuugaccugaggcugug

SEQ ID NO: 2656658 - RNA, 22 nt, Human
acagcuugaccugaggcugugg

SEQ ID NO: 2656659 - RNA, 21 nt, Human
acagcuaauucuacucacagu

SEQ ID NO: 2656660 - RNA, 14 nt, Human
acagcuaugcaaaa

SEQ ID NO: 2656661 - RNA, 21 nt, Human
acagcuaugcaaaaagcuagu

SEQ ID NO: 2656662 - RNA, 17 nt, Human
uaugguauauauacaua

SEQ ID NO: 2656663 - RNA, 15 nt, Human
acagcggaggugugg

SEQ ID NO: 2656664 - RNA, 18 nt, Human
acagcgagggcagcugcu

SEQ ID NO: 2656665 - RNA, 19 nt, Human
acagcgagggcagcugcua

SEQ ID NO: 2656666 - RNA, 23 nt, Human
acagcgagggcagcugcuauuua

SEQ ID NO: 2656667 - RNA, 15 nt, Human
acagcgccagccuca

SEQ ID NO: 2656668 - RNA, 18 nt, Human
acagcgccagccucagac

SEQ ID NO: 2656669 - RNA, 14 nt, Human
acagcgagggcagc

SEQ ID NO: 2656670 - RNA, 15 nt, Human
acagcgagggcagcu

SEQ ID NO: 2656671 - RNA, 16 nt, Human
acagcgagggcagcug

SEQ ID NO: 2656672 - RNA, 17 nt, Human
acagcgagggcagcugc

SEQ ID NO: 2656673 - RNA, 16 nt, Human
acagcggaggugugga

SEQ ID NO: 2656674 - RNA, 14 nt, Human
uaugccacuuccuu

SEQ ID NO: 2656675 - RNA, 15 nt, Human
uaugccacuuccuuu

SEQ ID NO: 2656676 - RNA, 20 nt, Human
uaugccacuuccuuuuaacu

SEQ ID NO: 2656677 - RNA, 18 nt, Human
uaugcucucacuguuugu

SEQ ID NO: 2656678 - RNA, 13 nt, Human
uaugcuauuucug

SEQ ID NO: 2656679 - RNA, 14 nt, Human
uaugcuauuucugu

SEQ ID NO: 2656680 - RNA, 19 nt, Human
uaugaaaaauuggggagga

SEQ ID NO: 2656681 - RNA, 18 nt, Human
uaugaaaacauggaacag

SEQ ID NO: 2656682 - RNA, 13 nt, Human
uaugaaaacaugg

SEQ ID NO: 2656683 - RNA, 21 nt, Human
uaugaaaacauggaacagugu

SEQ ID NO: 2656684 - RNA, 20 nt, Human
uaugaaaacauggaacagug

SEQ ID NO: 2656685 - RNA, 14 nt, Human
uaugaaaauggaaa

SEQ ID NO: 2656686 - RNA, 15 nt, Human
acagcaagugugaau

SEQ ID NO: 2656687 - RNA, 16 nt, Human
acagcaagugugaaua

SEQ ID NO: 2656688 - RNA, 14 nt, Human
uacuuuguaaauuc

SEQ ID NO: 2656689 - RNA, 13 nt, Human
uacuuuguaaaua

SEQ ID NO: 2656690 - RNA, 23 nt, Human
uacuuuguaaauaggauuuuuag

SEQ ID NO: 2656691 - RNA, 12 nt, Human
uacuuuguauug

SEQ ID NO: 2656692 - RNA, 22 nt, Human
uacuuuguaaauucugauuucu

SEQ ID NO: 2656693 - RNA, 19 nt, Human
uacuuuguaaauucugauu

SEQ ID NO: 2656694 - RNA, 18 nt, Human
uacuuuguaaauucugau

SEQ ID NO: 2656695 - RNA, 17 nt, Human
uacuuuguaaauucuga

SEQ ID NO: 2656696 - RNA, 23 nt, Human
uacuuuuauuuuacacagaaaca

SEQ ID NO: 2656697 - RNA, 16 nt, Human
uacuuuucauucucuu

SEQ ID NO: 2656698 - RNA, 16 nt, Human
uacuuuguauuguccu

SEQ ID NO: 2656699 - RNA, 14 nt, Human
uacuuuguauuguc

SEQ ID NO: 2656700 - RNA, 18 nt, Human
uacuuuguauuguccuau

SEQ ID NO: 2656701 - RNA, 19 nt, Human
uacuuuuuaguaauuucuu

SEQ ID NO: 2656702 - RNA, 17 nt, Human
uacuuuugcaugaaaau

SEQ ID NO: 2656703 - RNA, 15 nt, Human
uagaaaaauaaaaau

SEQ ID NO: 2656704 - RNA, 15 nt, Human
uagaaaaaaaauuau

SEQ ID NO: 2656705 - RNA, 17 nt, Human
uagaaacaaacaucuaa

SEQ ID NO: 2656706 - RNA, 16 nt, Human
uagaaaagaacuggaa

SEQ ID NO: 2656707 - RNA, 18 nt, Human
uagaaaagaacuggaaac

SEQ ID NO: 2656708 - RNA, 12 nt, Human
uagaaaauguga

SEQ ID NO: 2656709 - RNA, 18 nt, Human
uagaaaaugugacccucc

SEQ ID NO: 2656710 - RNA, 20 nt, Human
uagaaaaugugacccuccaa

SEQ ID NO: 2656711 - RNA, 21 nt, Human
uagaaaaugugacccuccaaa

SEQ ID NO: 2656712 - RNA, 16 nt, Human
uagaacuuuguauagu

SEQ ID NO: 2656713 - RNA, 18 nt, Human
uagaagacaaaauguuca

SEQ ID NO: 2656714 - RNA, 14 nt, Human
uagaacuuuguaua

SEQ ID NO: 2656715 - RNA, 13 nt, Human
uagaacuuuguau

SEQ ID NO: 2656716 - RNA, 12 nt, Human
uagaacuuugua

SEQ ID NO: 2656717 - RNA, 19 nt, Human
uagaacuuuaagcaacaag

SEQ ID NO: 2656718 - RNA, 11 nt, Human
uagacaugaaa

SEQ ID NO: 2656719 - RNA, 12 nt, Human
uagacaugaaag

SEQ ID NO: 2656720 - RNA, 13 nt, Human
uagacaucaaacu

SEQ ID NO: 2656721 - RNA, 14 nt, Human
uagacaucaaacuc

SEQ ID NO: 2656722 - RNA, 22 nt, Human
uagacaucaaacucaaugcuuu

SEQ ID NO: 2656723 - RNA, 23 nt, Human
uagacaucaaacucaaugcuuua

SEQ ID NO: 2656724 - RNA, 23 nt, Human
aauuuuacaagggcauaaaguaa

SEQ ID NO: 2656725 - RNA, 15 nt, Human
acaaaaagcuucccc

SEQ ID NO: 2656726 - RNA, 14 nt, Human
acaaaaagcuuccc

SEQ ID NO: 2656727 - RNA, 14 nt, Human
acaaaaaauguuuu

SEQ ID NO: 2656728 - RNA, 20 nt, Human
aauuuuacauguuuauaaau

SEQ ID NO: 2656729 - RNA, 15 nt, Human
acaaaagucugucuu

SEQ ID NO: 2656730 - RNA, 21 nt, Human
acaaaagucugucuuuccuga

SEQ ID NO: 2656731 - RNA, 16 nt, Human
acaaaauaaaauaaua

SEQ ID NO: 2656732 - RNA, 16 nt, Human
acaaaauauuucccau

SEQ ID NO: 2656733 - RNA, 14 nt, Human
acaaauaauuuaga

SEQ ID NO: 2656734 - RNA, 13 nt, Human
acaaauaauuuag

SEQ ID NO: 2656735 - RNA, 22 nt, Human
uagaggcuucuccgccagccuc

SEQ ID NO: 2656736 - RNA, 21 nt, Human
uagagggacggccaagaaugu

SEQ ID NO: 2656737 - RNA, 22 nt, Human
uagagggacggccaagaaugua

SEQ ID NO: 2656738 - RNA, 23 nt, Human
uagagggacggccaagaauguac

SEQ ID NO: 2656739 - RNA, 13 nt, Human
uagaggcuagcuu

SEQ ID NO: 2656740 - RNA, 14 nt, Human
uagaggcuucuccg

SEQ ID NO: 2656741 - RNA, 18 nt, Human
uagaggcuucuccgccag

SEQ ID NO: 2656742 - RNA, 19 nt, Human
uagaggcuucuccgccagc

SEQ ID NO: 2656743 - RNA, 20 nt, Human
uagaggcuucuccgccagcc

SEQ ID NO: 2656744 - RNA, 21 nt, Human
uagaggcuucuccgccagccu

SEQ ID NO: 2656745 - RNA, 23 nt, Human
uagaggcuucuccgccagccucc

SEQ ID NO: 2656746 - RNA, 15 nt, Human
uagcaaaauaaaaca

SEQ ID NO: 2656747 - RNA, 16 nt, Human
uagcaaaauaaaacau

SEQ ID NO: 2656748 - RNA, 17 nt, Human
uagcaaaauaaaacaua

SEQ ID NO: 2656749 - RNA, 19 nt, Human
uagcaaaauaaaacauagc

SEQ ID NO: 2656750 - RNA, 21 nt, Human
uagcaaaauaaaacauagcaa

SEQ ID NO: 2656751 - RNA, 23 nt, Human
uagcaaaauaaaacauagcaaau

SEQ ID NO: 2656752 - RNA, 14 nt, Human
uagcaaucucuuca

SEQ ID NO: 2656753 - RNA, 18 nt, Human
uagcaaguuacagugaug

SEQ ID NO: 2656754 - RNA, 21 nt, Human
uagcaaaauucuuaaguaugu

SEQ ID NO: 2656755 - RNA, 23 nt, Human
uagccaaaaugugagugguugaa

SEQ ID NO: 2656756 - RNA, 16 nt, Human
uagccaaaaugugagu

SEQ ID NO: 2656757 - RNA, 15 nt, Human
uagccaaaaugugag

SEQ ID NO: 2656758 - RNA, 15 nt, Human
uagggggcuuucugg

SEQ ID NO: 2656759 - RNA, 18 nt, Human
uaggggaaggagaaguaa

SEQ ID NO: 2656760 - RNA, 13 nt, Human
uagggaagauaau

SEQ ID NO: 2656761 - RNA, 18 nt, Human
uagggagggcggcagggg

SEQ ID NO: 2656762 - RNA, 15 nt, Human
uagggcaccaggggu

SEQ ID NO: 2656763 - RNA, 20 nt, Human
uagggcaccagggguuucuc

SEQ ID NO: 2656764 - RNA, 15 nt, Human
uagggaacuggggaa

SEQ ID NO: 2656765 - RNA, 15 nt, Human
uagggaguauucuaa

SEQ ID NO: 2656766 - RNA, 23 nt, Human
uaggauuuuaacuuaacugaaau

SEQ ID NO: 2656767 - RNA, 13 nt, Human
uaggauuuucaca

SEQ ID NO: 2656768 - RNA, 22 nt, Human
uaggauuuucacauucuuggcu

SEQ ID NO: 2656769 - RNA, 22 nt, Human
uaggauuuuggauguugagagg

SEQ ID NO: 2656770 - RNA, 13 nt, Human
uaggauuuuuaga

SEQ ID NO: 2656771 - RNA, 14 nt, Human
uaggauuuuuagaa

SEQ ID NO: 2656772 - RNA, 14 nt, Human
uaggcauguaaaca

SEQ ID NO: 2656773 - RNA, 18 nt, Human
uaggauagcuaacuguaa

SEQ ID NO: 2656774 - RNA, 19 nt, Human
uaggauagcuaacuguaaa

SEQ ID NO: 2656775 - RNA, 21 nt, Human
uaggauagcuaacuguaaauc

SEQ ID NO: 2656776 - RNA, 18 nt, Human
uaggaugaaaagauucuu

SEQ ID NO: 2656777 - RNA, 17 nt, Human
uaggaugggcuucugug

SEQ ID NO: 2656778 - RNA, 16 nt, Human
uaggagggugggaagg

SEQ ID NO: 2656779 - RNA, 13 nt, Human
uaggaaacaagug

SEQ ID NO: 2656780 - RNA, 22 nt, Human
uaggaguuaaccccugcgcucu

SEQ ID NO: 2656781 - RNA, 19 nt, Human
uaggaguggugauuugaaa

SEQ ID NO: 2656782 - RNA, 18 nt, Human
acaauauugauugggaaa

SEQ ID NO: 2656783 - RNA, 15 nt, Human
acaaaugacuuuauu

SEQ ID NO: 2656784 - RNA, 13 nt, Human
acaaaugacuuua

SEQ ID NO: 2656785 - RNA, 12 nt, Human
acaaaugacuuu

SEQ ID NO: 2656786 - RNA, 19 nt, Human
acaaucaaaggaaaauagu

SEQ ID NO: 2656787 - RNA, 14 nt, Human
acaaucaaaggaaa

SEQ ID NO: 2656788 - RNA, 15 nt, Human
acaauauuuuauggu

SEQ ID NO: 2656789 - RNA, 16 nt, Human
uagcgaucucuccugg

SEQ ID NO: 2656790 - RNA, 17 nt, Human
uagcgaucucuccuggc

SEQ ID NO: 2656791 - RNA, 19 nt, Human
uagcgaucucuccuggccu

SEQ ID NO: 2656792 - RNA, 20 nt, Human
uagcgaucucuccuggccua

SEQ ID NO: 2656793 - RNA, 20 nt, Human
uagcgacuaaacuagauuuu

SEQ ID NO: 2656794 - RNA, 17 nt, Human
uagcuugcagaacugua

SEQ ID NO: 2656795 - RNA, 19 nt, Human
uagcuugggaggcuucccc

SEQ ID NO: 2656796 - RNA, 16 nt, Human
uagcuuuagacccugg

SEQ ID NO: 2656797 - RNA, 17 nt, Human
uagcuuuagacccuggg

SEQ ID NO: 2656798 - RNA, 18 nt, Human
uagcuuuagacccugggu

SEQ ID NO: 2656799 - RNA, 13 nt, Human
uagcuucugcuuu

SEQ ID NO: 2656800 - RNA, 15 nt, Human
uagcuucugcuuuuc

SEQ ID NO: 2656801 - RNA, 16 nt, Human
uagcuucugcuuuucu

SEQ ID NO: 2656802 - RNA, 22 nt, Human
uagcuucugcuuuucugcccug

SEQ ID NO: 2656803 - RNA, 15 nt, Human
uagcuaacuguaaau

SEQ ID NO: 2656804 - RNA, 17 nt, Human
uagcuaacuguaaauca

SEQ ID NO: 2656805 - RNA, 20 nt, Human
acacaaaugcucaaagaaau

SEQ ID NO: 2656806 - RNA, 22 nt, Human
acacaaaugcucaaagaaaucu

SEQ ID NO: 2656807 - RNA, 15 nt, Human
uagggucggaaccca

SEQ ID NO: 2656808 - RNA, 21 nt, Human
acaaugaucaccgacugaaaa

SEQ ID NO: 2656809 - RNA, 15 nt, Human
uaguaauguuuuaua

SEQ ID NO: 2656810 - RNA, 14 nt, Human
uaguaauuucuuuu

SEQ ID NO: 2656811 - RNA, 20 nt, Human
uaguaauuucuuuuuuuccu

SEQ ID NO: 2656812 - RNA, 21 nt, Human
uaguaauuucuuuuuuuccuu

SEQ ID NO: 2656813 - RNA, 17 nt, Human
acucacauuagagaaca

SEQ ID NO: 2656814 - RNA, 17 nt, Human
uccccgcugcugugcaa

SEQ ID NO: 2656815 - RNA, 22 nt, Human
uccccggcaugagacucagugc

SEQ ID NO: 2656816 - RNA, 18 nt, Human
uccccgcuucugccugca

SEQ ID NO: 2656817 - RNA, 15 nt, Human
uccccggagggcugc

SEQ ID NO: 2656818 - RNA, 19 nt, Human
ucccccaccgguccagcug

SEQ ID NO: 2656819 - RNA, 20 nt, Human
ucccccaccgguccagcugg

SEQ ID NO: 2656820 - RNA, 21 nt, Human
ucccccaccgguccagcuggc

SEQ ID NO: 2656821 - RNA, 22 nt, Human
ucccccaccgguccagcuggcc

SEQ ID NO: 2656822 - RNA, 23 nt, Human
ucccccaccgguccagcuggccu

SEQ ID NO: 2656823 - RNA, 14 nt, Human
uccccaucucccug

SEQ ID NO: 2656824 - RNA, 15 nt, Human
uccccaucucccugc

SEQ ID NO: 2656825 - RNA, 16 nt, Human
uccccaucucccugcc

SEQ ID NO: 2656826 - RNA, 19 nt, Human
uccccaucucccugccugg

SEQ ID NO: 2656827 - RNA, 20 nt, Human
uccccaucucccugccuggc

SEQ ID NO: 2656828 - RNA, 22 nt, Human
uccccaucucccugccuggccc

SEQ ID NO: 2656829 - RNA, 20 nt, Human
ucccccaccucggucacucc

SEQ ID NO: 2656830 - RNA, 18 nt, Human
acuaccuguauuuaaaaa

SEQ ID NO: 2656831 - RNA, 22 nt, Human
acuaccuguauuuaaaaauaga

SEQ ID NO: 2656832 - RNA, 23 nt, Human
acuaccuguauuuaaaaauagaa

SEQ ID NO: 2656833 - RNA, 20 nt, Human
ucccccagccaugccagcug

SEQ ID NO: 2656834 - RNA, 21 nt, Human
ucccccagccaugccagcugg

SEQ ID NO: 2656835 - RNA, 22 nt, Human
ucccccagccaugccagcuggc

SEQ ID NO: 2656836 - RNA, 23 nt, Human
ucccccagccaugccagcuggcc

SEQ ID NO: 2656837 - RNA, 19 nt, Human
acuacuuuguuaggauuuu

SEQ ID NO: 2656838 - RNA, 22 nt, Human
acuacuuuguuaggauuuucac

SEQ ID NO: 2656839 - RNA, 14 nt, Human
acuacuagauugac

SEQ ID NO: 2656840 - RNA, 23 nt, Human
acuacuucuuuuuucaaaagaaa

SEQ ID NO: 2656841 - RNA, 17 nt, Human
acuccacaucugccuua

SEQ ID NO: 2656842 - RNA, 12 nt, Human
acucaucuuaua

SEQ ID NO: 2656843 - RNA, 19 nt, Human
acucaucuuauaugggaaa

SEQ ID NO: 2656844 - RNA, 12 nt, Human
acucaucuuagg

SEQ ID NO: 2656845 - RNA, 22 nt, Human
acucaucuggaguucucaaaga

SEQ ID NO: 2656846 - RNA, 19 nt, Human
acucaucuggaguucucaa

SEQ ID NO: 2656847 - RNA, 13 nt, Human
acucaucugaaau

SEQ ID NO: 2656848 - RNA, 15 nt, Human
acucaucugaaaugu

SEQ ID NO: 2656849 - RNA, 16 nt, Human
acucaucugaaauguu

SEQ ID NO: 2656850 - RNA, 17 nt, Human
acucaucugaaauguua

SEQ ID NO: 2656851 - RNA, 19 nt, Human
acucaucugaaauguuaca

SEQ ID NO: 2656852 - RNA, 23 nt, Human
acucaucugaaauguuacaaaaa

SEQ ID NO: 2656853 - RNA, 21 nt, Human
acucagagaaaaaugcucccc

SEQ ID NO: 2656854 - RNA, 22 nt, Human
acucagagaaaaaugcucccca

SEQ ID NO: 2656855 - RNA, 14 nt, Human
acucagagcucucu

SEQ ID NO: 2656856 - RNA, 20 nt, Human
acucagagcucucucuacag

SEQ ID NO: 2656857 - RNA, 21 nt, Human
acucagagcucucucuacaga

SEQ ID NO: 2656858 - RNA, 11 nt, Human
ucccuccaccc

SEQ ID NO: 2656859 - RNA, 13 nt, Human
ucccuccacccca

SEQ ID NO: 2656860 - RNA, 14 nt, Human
ucccuccaccccag

SEQ ID NO: 2656861 - RNA, 15 nt, Human
ucccuccaccccagg

SEQ ID NO: 2656862 - RNA, 16 nt, Human
ucccuccaccccagga

SEQ ID NO: 2656863 - RNA, 17 nt, Human
ucccuccaccccaggac

SEQ ID NO: 2656864 - RNA, 18 nt, Human
ucccuccaccccaggacg

SEQ ID NO: 2656865 - RNA, 16 nt, Human
uccuacucggcucugc

SEQ ID NO: 2656866 - RNA, 19 nt, Human
uccuacucggcucugcagu

SEQ ID NO: 2656867 - RNA, 22 nt, Human
uccuacucucacacugguucuc

SEQ ID NO: 2656868 - RNA, 15 nt, Human
acucgagucugaggc

SEQ ID NO: 2656869 - RNA, 14 nt, Human
acucgagucugagg

SEQ ID NO: 2656870 - RNA, 15 nt, Human
acucgacucugugcc

SEQ ID NO: 2656871 - RNA, 15 nt, Human
acuccuuauuuggcg

SEQ ID NO: 2656872 - RNA, 22 nt, Human
acuccuuauuuggcgugacccg

SEQ ID NO: 2656873 - RNA, 16 nt, Human
acuccacaucugccuu

SEQ ID NO: 2656874 - RNA, 15 nt, Human
uccggccucuccagc

SEQ ID NO: 2656875 - RNA, 16 nt, Human
uccggccucuccagcc

SEQ ID NO: 2656876 - RNA, 19 nt, Human
uccggccucuccagccuca

SEQ ID NO: 2656877 - RNA, 14 nt, Human
uccggccucugccu

SEQ ID NO: 2656878 - RNA, 18 nt, Human
uccggccucugccuuugc

SEQ ID NO: 2656879 - RNA, 19 nt, Human
uccggccucugccuuugca

SEQ ID NO: 2656880 - RNA, 16 nt, Human
uccguuagcuccugug

SEQ ID NO: 2656881 - RNA, 17 nt, Human
uccguuagcuccugugg

SEQ ID NO: 2656882 - RNA, 14 nt, Human
uccuacccuuuucu

SEQ ID NO: 2656883 - RNA, 13 nt, Human
uccuacccuuuuc

SEQ ID NO: 2656884 - RNA, 15 nt, Human
uccguuagcuccugu

SEQ ID NO: 2656885 - RNA, 17 nt, Human
uccgugggacggugccc

SEQ ID NO: 2656886 - RNA, 16 nt, Human
uccgugggacggugcc

SEQ ID NO: 2656887 - RNA, 23 nt, Human
uccgugggacggugcccaagcca

SEQ ID NO: 2656888 - RNA, 15 nt, Human
uccggcucccagccu

SEQ ID NO: 2656889 - RNA, 12 nt, Human
uccggcucccag

SEQ ID NO: 2656890 - RNA, 12 nt, Human
acucuucucauu

SEQ ID NO: 2656891 - RNA, 24 nt, Human
acucuucucauuacuuguugccua

SEQ ID NO: 2656892 - RNA, 18 nt, Human
acucuucucauuacuugu

SEQ ID NO: 2656893 - RNA, 17 nt, Human
acucuucucauuacuug

SEQ ID NO: 2656894 - RNA, 15 nt, Human
acucuucagagaaau

SEQ ID NO: 2656895 - RNA, 16 nt, Human
acucuucagagaaauc

SEQ ID NO: 2656896 - RNA, 14 nt, Human
acucugcuucucug

SEQ ID NO: 2656897 - RNA, 15 nt, Human
acucugcuucucuga

SEQ ID NO: 2656898 - RNA, 15 nt, Human
acucguggcugucaa

SEQ ID NO: 2656899 - RNA, 12 nt, Human
acucugcuucuc

SEQ ID NO: 2656900 - RNA, 22 nt, Human
acucucacacugguucucaaug

SEQ ID NO: 2656901 - RNA, 21 nt, Human
acucucacacugguucucaau

SEQ ID NO: 2656902 - RNA, 23 nt, Human
acucguguguuucuauuuuuuga

SEQ ID NO: 2656903 - RNA, 15 nt, Human
acucguguguuucua

SEQ ID NO: 2656904 - RNA, 12 nt, Human
acucgguuucuc

SEQ ID NO: 2656905 - RNA, 14 nt, Human
acucgguuucucca

SEQ ID NO: 2656906 - RNA, 16 nt, Human
acucgguuucuccaaa

SEQ ID NO: 2656907 - RNA, 16 nt, Human
acucucaucacuacag

SEQ ID NO: 2656908 - RNA, 17 nt, Human
acucucaucacuacagu

SEQ ID NO: 2656909 - RNA, 18 nt, Human
acucucaucacuacagua

SEQ ID NO: 2656910 - RNA, 17 nt, Human
acugaaaggcuuuucaa

SEQ ID NO: 2656911 - RNA, 20 nt, Human
uccucugcucaccgcccauc

SEQ ID NO: 2656912 - RNA, 18 nt, Human
acugaaaauauuguuuua

SEQ ID NO: 2656913 - RNA, 12 nt, Human
acucuuugagag

SEQ ID NO: 2656914 - RNA, 18 nt, Human
uccugacccauugcuguu

SEQ ID NO: 2656915 - RNA, 17 nt, Human
uccugacccauugcugu

SEQ ID NO: 2656916 - RNA, 16 nt, Human
uccugacccauugcug

SEQ ID NO: 2656917 - RNA, 11 nt, Human
uccugaccagc

SEQ ID NO: 2656918 - RNA, 18 nt, Human
uccucuuuaguuuuuggu

SEQ ID NO: 2656919 - RNA, 19 nt, Human
uccucuuuaguuuuugguu

SEQ ID NO: 2656920 - RNA, 13 nt, Human
uccucuuguccua

SEQ ID NO: 2656921 - RNA, 19 nt, Human
uccucuuguccuacaauga

SEQ ID NO: 2656922 - RNA, 20 nt, Human
uccucuugucugauuucuua

SEQ ID NO: 2656923 - RNA, 20 nt, Human
uccucuugugauuucuuuaa

SEQ ID NO: 2656924 - RNA, 11 nt, Human
uccucugccug

SEQ ID NO: 2656925 - RNA, 12 nt, Human
uccucugccugc

SEQ ID NO: 2656926 - RNA, 13 nt, Human
uccucugccugcc

SEQ ID NO: 2656927 - RNA, 14 nt, Human
uccucugccugccc

SEQ ID NO: 2656928 - RNA, 22 nt, Human
uccucugccugccccgccccca

SEQ ID NO: 2656929 - RNA, 17 nt, Human
uccucucccauccuuga

SEQ ID NO: 2656930 - RNA, 18 nt, Human
uccucucuaagugggcau

SEQ ID NO: 2656931 - RNA, 19 nt, Human
uccucucuccagauguuuc

SEQ ID NO: 2656932 - RNA, 14 nt, Human
uccucucuccagau

SEQ ID NO: 2656933 - RNA, 13 nt, Human
uccucucuauauu

SEQ ID NO: 2656934 - RNA, 14 nt, Human
uccucucuauauuu

SEQ ID NO: 2656935 - RNA, 22 nt, Human
uccucccuuccuuuucccugcu

SEQ ID NO: 2656936 - RNA, 19 nt, Human
uccucccuuccuuuucccu

SEQ ID NO: 2656937 - RNA, 21 nt, Human
uccucccuuccuuuucccugc

SEQ ID NO: 2656938 - RNA, 13 nt, Human
uccucccuuccuu

SEQ ID NO: 2656939 - RNA, 17 nt, Human
uccucccuuccuuuucc

SEQ ID NO: 2656940 - RNA, 18 nt, Human
uccucccuuccuuuuccc

SEQ ID NO: 2656941 - RNA, 16 nt, Human
uccuccccaaaucaau

SEQ ID NO: 2656942 - RNA, 21 nt, Human
uccuccccaaaucaauacacu

SEQ ID NO: 2656943 - RNA, 20 nt, Human
accuggggcugcugugaagc

SEQ ID NO: 2656944 - RNA, 21 nt, Human
accuggguaacuagggaagau

SEQ ID NO: 2656945 - RNA, 19 nt, Human
accuggggcugcugugaag

SEQ ID NO: 2656946 - RNA, 23 nt, Human
accuggcugagguuccucugccu

SEQ ID NO: 2656947 - RNA, 18 nt, Human
accugggauucaggaaug

SEQ ID NO: 2656948 - RNA, 20 nt, Human
accuggccgcggagccugca

SEQ ID NO: 2656949 - RNA, 12 nt, Human
uccaccccagga

SEQ ID NO: 2656950 - RNA, 13 nt, Human
uccaccccaggac

SEQ ID NO: 2656951 - RNA, 19 nt, Human
uccaccccaggacgccacu

SEQ ID NO: 2656952 - RNA, 18 nt, Human
uccaccccaagagaacuc

SEQ ID NO: 2656953 - RNA, 19 nt, Human
uccaccccaagagaacucg

SEQ ID NO: 2656954 - RNA, 19 nt, Human
uccacccaacccuaucucc

SEQ ID NO: 2656955 - RNA, 23 nt, Human
uccacccaacccuaucuccugac

SEQ ID NO: 2656956 - RNA, 15 nt, Human
uccacccaacccuau

SEQ ID NO: 2656957 - RNA, 21 nt, Human
uccaaauuuuuuuuuaaagca

SEQ ID NO: 2656958 - RNA, 19 nt, Human
uccaaauggagaagcugca

SEQ ID NO: 2656959 - RNA, 20 nt, Human
uccaaauggagaagcugcag

SEQ ID NO: 2656960 - RNA, 21 nt, Human
uccaaauggagaagcugcagg

SEQ ID NO: 2656961 - RNA, 12 nt, Human
uccacaucugcc

SEQ ID NO: 2656962 - RNA, 13 nt, Human
uccacaucugccu

SEQ ID NO: 2656963 - RNA, 14 nt, Human
uccacaucugccuu

SEQ ID NO: 2656964 - RNA, 15 nt, Human
uccacaucugccuua

SEQ ID NO: 2656965 - RNA, 18 nt, Human
uccacaucugccuuaaaa

SEQ ID NO: 2656966 - RNA, 19 nt, Human
ucauuuuucaauagcacau

SEQ ID NO: 2656967 - RNA, 13 nt, Human
ucauuuuuauagc

SEQ ID NO: 2656968 - RNA, 14 nt, Human
ucauuuuuauagca

SEQ ID NO: 2656969 - RNA, 16 nt, Human
ucauuuuuauagcaac

SEQ ID NO: 2656970 - RNA, 21 nt, Human
ucauuuuuauagcaacaacaa

SEQ ID NO: 2656971 - RNA, 16 nt, Human
ucauuuucuuuuuuaa

SEQ ID NO: 2656972 - RNA, 14 nt, Human
ucauuuugaaauug

SEQ ID NO: 2656973 - RNA, 16 nt, Human
ucauuuugaaauuguu

SEQ ID NO: 2656974 - RNA, 14 nt, Human
accugaggcugugg

SEQ ID NO: 2656975 - RNA, 12 nt, Human
accugaggcugu

SEQ ID NO: 2656976 - RNA, 19 nt, Human
accugaagaugggagccuu

SEQ ID NO: 2656977 - RNA, 18 nt, Human
acgaaccuuggccugggc

SEQ ID NO: 2656978 - RNA, 11 nt, Human
uccagggaggg

SEQ ID NO: 2656979 - RNA, 22 nt, Human
uccagggaggggccggcccugu

SEQ ID NO: 2656980 - RNA, 17 nt, Human
uccagggacacacagcc

SEQ ID NO: 2656981 - RNA, 19 nt, Human
uccagggaauccaagccuc

SEQ ID NO: 2656982 - RNA, 20 nt, Human
uccagggaauccaagccucc

SEQ ID NO: 2656983 - RNA, 21 nt, Human
acgaagguaaaaaguauuuuu

SEQ ID NO: 2656984 - RNA, 15 nt, Human
acgaauagacaucaa

SEQ ID NO: 2656985 - RNA, 16 nt, Human
acgaauagacaucaaa

SEQ ID NO: 2656986 - RNA, 18 nt, Human
acgaauagacaucaaacu

SEQ ID NO: 2656987 - RNA, 18 nt, Human
acgaauauggacauauca

SEQ ID NO: 2656988 - RNA, 15 nt, Human
uccacgcgugccgug

SEQ ID NO: 2656989 - RNA, 21 nt, Human
uccacgcgugccguggcacca

SEQ ID NO: 2656990 - RNA, 14 nt, Human
uccagggaauccaa

SEQ ID NO: 2656991 - RNA, 18 nt, Human
uccagggaauccaagccu

SEQ ID NO: 2656992 - RNA, 16 nt, Human
uccaggcugccguggg

SEQ ID NO: 2656993 - RNA, 23 nt, Human
acgccaggggaaaaucagccugc

SEQ ID NO: 2656994 - RNA, 20 nt, Human
acgcccacccaaccccaagc

SEQ ID NO: 2656995 - RNA, 18 nt, Human
acgaucacaaaugacuuu

SEQ ID NO: 2656996 - RNA, 17 nt, Human
acgaucacaaaugacuu

SEQ ID NO: 2656997 - RNA, 16 nt, Human
acgaucacaaaugacu

SEQ ID NO: 2656998 - RNA, 15 nt, Human
acgaucacaaaugac

SEQ ID NO: 2656999 - RNA, 21 nt, Human
acgaggggugucuugggcaga

SEQ ID NO: 2657000 - RNA, 20 nt, Human
acgaggucaggagaucgaga

SEQ ID NO: 2657001 - RNA, 18 nt, Human
acgaggggugucuugggc

SEQ ID NO: 2657002 - RNA, 20 nt, Human
acgaggggugucuugggcag

SEQ ID NO: 2657003 - RNA, 18 nt, Human
acgccaggggaaaaucag

SEQ ID NO: 2657004 - RNA, 14 nt, Human
acgaucacaaauga

SEQ ID NO: 2657005 - RNA, 15 nt, Human
acgacugcccggcag

SEQ ID NO: 2657006 - RNA, 20 nt, Human
acgacacggguggggaaagg

SEQ ID NO: 2657007 - RNA, 21 nt, Human
acgcuaaagagcccuugccuc

SEQ ID NO: 2657008 - RNA, 18 nt, Human
acgcuaaagagcccuugc

SEQ ID NO: 2657009 - RNA, 20 nt, Human
acgcuaaagagcccuugccu

SEQ ID NO: 2657010 - RNA, 23 nt, Human
acggaggcaaagcuggcucaccu

SEQ ID NO: 2657011 - RNA, 18 nt, Human
acggaggcauccuacccu

SEQ ID NO: 2657012 - RNA, 20 nt, Human
acggaggccugcgacccugg

SEQ ID NO: 2657013 - RNA, 21 nt, Human
acggaggccugcgacccuggg

SEQ ID NO: 2657014 - RNA, 20 nt, Human
acggagcccagcccucccca

SEQ ID NO: 2657015 - RNA, 15 nt, Human
acggagcccagcccu

SEQ ID NO: 2657016 - RNA, 16 nt, Human
acgcuaaagagcccuu

SEQ ID NO: 2657017 - RNA, 17 nt, Human
acgcuaaagagcccuug

SEQ ID NO: 2657018 - RNA, 19 nt, Human
acgccaugugauggacacu

SEQ ID NO: 2657019 - RNA, 16 nt, Human
acgcgugccguggcac

SEQ ID NO: 2657020 - RNA, 20 nt, Human
acgcccguccugccuguggc

SEQ ID NO: 2657021 - RNA, 16 nt, Human
acgcccguccugccug

SEQ ID NO: 2657022 - RNA, 18 nt, Human
acgcccguccugccugug

SEQ ID NO: 2657023 - RNA, 19 nt, Human
acgcccguccugccugugg

SEQ ID NO: 2657024 - RNA, 14 nt, Human
uccauuugcucuuc

SEQ ID NO: 2657025 - RNA, 15 nt, Human
uccauuugcucuuca

SEQ ID NO: 2657026 - RNA, 17 nt, Human
uccauuuuaauuuuaaa

SEQ ID NO: 2657027 - RNA, 14 nt, Human
ucccacaaaggaga

SEQ ID NO: 2657028 - RNA, 19 nt, Human
ucccacauccaacuccagc

SEQ ID NO: 2657029 - RNA, 23 nt, Human
acggguuagacagccaaaggcug

SEQ ID NO: 2657030 - RNA, 14 nt, Human
acggguggggaaag

SEQ ID NO: 2657031 - RNA, 13 nt, Human
acggguggucccc

SEQ ID NO: 2657032 - RNA, 14 nt, Human
acgggugguccccg

SEQ ID NO: 2657033 - RNA, 12 nt, Human
ucccacccccag

SEQ ID NO: 2657034 - RNA, 13 nt, Human
ucccacccccagc

SEQ ID NO: 2657035 - RNA, 14 nt, Human
ucccacccccagcc

SEQ ID NO: 2657036 - RNA, 15 nt, Human
ucccacccccagccc

SEQ ID NO: 2657037 - RNA, 17 nt, Human
ucccacccccagccccg

SEQ ID NO: 2657038 - RNA, 23 nt, Human
ucccacccccagccccgacucca

SEQ ID NO: 2657039 - RNA, 23 nt, Human
ucccacauccaacuccagcaacu

SEQ ID NO: 2657040 - RNA, 20 nt, Human
ucccacauccaacuccagca

SEQ ID NO: 2657041 - RNA, 22 nt, Human
ucccacauccaacuccagcaac

SEQ ID NO: 2657042 - RNA, 12 nt, Human
uccaucccucua

SEQ ID NO: 2657043 - RNA, 15 nt, Human
uccaucccucuaaug

SEQ ID NO: 2657044 - RNA, 23 nt, Human
uccaucccucuaaugagacugac

SEQ ID NO: 2657045 - RNA, 14 nt, Human
uccagugaccucuc

SEQ ID NO: 2657046 - RNA, 17 nt, Human
uccagugaccucucucu

SEQ ID NO: 2657047 - RNA, 15 nt, Human
uccaugaaggcagag

SEQ ID NO: 2657048 - RNA, 17 nt, Human
uccaugaauuuuaaaau

SEQ ID NO: 2657049 - RNA, 21 nt, Human
ucaaucaaauaaguauuuaua

SEQ ID NO: 2657050 - RNA, 16 nt, Human
ucaauauuuuuauauc

SEQ ID NO: 2657051 - RNA, 16 nt, Human
ucaaguaauugugaaa

SEQ ID NO: 2657052 - RNA, 15 nt, Human
ucaaguaauugugaa

SEQ ID NO: 2657053 - RNA, 14 nt, Human
acauuauuuauaug

SEQ ID NO: 2657054 - RNA, 18 nt, Human
acauuauuuauaugggga

SEQ ID NO: 2657055 - RNA, 19 nt, Human
acauucaaauuugucuggu

SEQ ID NO: 2657056 - RNA, 22 nt, Human
acauuacaaaguuaaaauuguu

SEQ ID NO: 2657057 - RNA, 18 nt, Human
ucaagaggaaugaaaaaa

SEQ ID NO: 2657058 - RNA, 22 nt, Human
ucaagaggaaugaaaaaagcuu

SEQ ID NO: 2657059 - RNA, 13 nt, Human
ucaaggccugcuc

SEQ ID NO: 2657060 - RNA, 20 nt, Human
ucaaggcuacagaugugcug

SEQ ID NO: 2657061 - RNA, 21 nt, Human
ucaauccuaauuucuccuccc

SEQ ID NO: 2657062 - RNA, 22 nt, Human
ucaauccuaauuucuccucccu

SEQ ID NO: 2657063 - RNA, 18 nt, Human
acauuuuuuugcaugcau

SEQ ID NO: 2657064 - RNA, 23 nt, Human
acauuuuuuugcaugcaugcaaa

SEQ ID NO: 2657065 - RNA, 14 nt, Human
acauuuuuuaagcu

SEQ ID NO: 2657066 - RNA, 17 nt, Human
acauuuuuuaagcuuca

SEQ ID NO: 2657067 - RNA, 12 nt, Human
ucacagagucaa

SEQ ID NO: 2657068 - RNA, 16 nt, Human
ucacagagucaaggcc

SEQ ID NO: 2657069 - RNA, 17 nt, Human
ucacagagucaaggccu

SEQ ID NO: 2657070 - RNA, 18 nt, Human
ucacagagucaaggccug

SEQ ID NO: 2657071 - RNA, 19 nt, Human
ucacagagucaaggccugc

SEQ ID NO: 2657072 - RNA, 21 nt, Human
ucacagagucaaggccugcuc

SEQ ID NO: 2657073 - RNA, 20 nt, Human
ucacagcuaugcaaaaagcu

SEQ ID NO: 2657074 - RNA, 16 nt, Human
accaaucuuacuuugu

SEQ ID NO: 2657075 - RNA, 15 nt, Human
accaaucuuacuuug

SEQ ID NO: 2657076 - RNA, 20 nt, Human
accaaucuuacuuuguaaau

SEQ ID NO: 2657077 - RNA, 19 nt, Human
accaaucuuacuuuguaaa

SEQ ID NO: 2657078 - RNA, 18 nt, Human
accaaucuuacuuuguaa

SEQ ID NO: 2657079 - RNA, 17 nt, Human
accaaucuuacuuugua

SEQ ID NO: 2657080 - RNA, 23 nt, Human
accaaucuuacuuuguaaauucu

SEQ ID NO: 2657081 - RNA, 21 nt, Human
accaaucuuacuuuguaaauu

SEQ ID NO: 2657082 - RNA, 14 nt, Human
accaaauuaucuug

SEQ ID NO: 2657083 - RNA, 15 nt, Human
accaaauuaucuuga

SEQ ID NO: 2657084 - RNA, 16 nt, Human
accaaauuaucuugau

SEQ ID NO: 2657085 - RNA, 18 nt, Human
accaaauguuuauuuucu

SEQ ID NO: 2657086 - RNA, 12 nt, Human
accaaaaacaaa

SEQ ID NO: 2657087 - RNA, 15 nt, Human
accaaaucuggaagc

SEQ ID NO: 2657088 - RNA, 13 nt, Human
accaaaucuggaa

SEQ ID NO: 2657089 - RNA, 13 nt, Human
uauuuuaaaacaa

SEQ ID NO: 2657090 - RNA, 14 nt, Human
uauuuuaaaaauau

SEQ ID NO: 2657091 - RNA, 20 nt, Human
acaucuuuaaggggaggaac

SEQ ID NO: 2657092 - RNA, 11 nt, Human
acaucuuuaag

SEQ ID NO: 2657093 - RNA, 15 nt, Human
uaugugguuuuguaa

SEQ ID NO: 2657094 - RNA, 17 nt, Human
uaugugguuuuguaauu

SEQ ID NO: 2657095 - RNA, 18 nt, Human
uauuuuaaccugcauaaa

SEQ ID NO: 2657096 - RNA, 18 nt, Human
uauuuuaagacugauuuu

SEQ ID NO: 2657097 - RNA, 23 nt, Human
uauuuuaagacugauuuuaauag

SEQ ID NO: 2657098 - RNA, 14 nt, Human
uauuuuacacagaa

SEQ ID NO: 2657099 - RNA, 15 nt, Human
uauuuuacacagaaa

SEQ ID NO: 2657100 - RNA, 17 nt, Human
uauuuuacacagaaaca

SEQ ID NO: 2657101 - RNA, 18 nt, Human
uauuuuacacagaaacac

SEQ ID NO: 2657102 - RNA, 19 nt, Human
uauuuuacacagaaacacu

SEQ ID NO: 2657103 - RNA, 18 nt, Human
uauuuuacagcucauuaa

SEQ ID NO: 2657104 - RNA, 21 nt, Human
uauuuuacagcucauuaaacu

SEQ ID NO: 2657105 - RNA, 23 nt, Human
uauuuuacacagaaacacugccu

SEQ ID NO: 2657106 - RNA, 24 nt, Human
uauuuuacacagaaacacugccuu

SEQ ID NO: 2657107 - RNA, 18 nt, Human
uauuuugucauaucaaau

SEQ ID NO: 2657108 - RNA, 16 nt, Human
uauuuugucauaucaa

SEQ ID NO: 2657109 - RNA, 12 nt, Human
uauuuuguguaa

SEQ ID NO: 2657110 - RNA, 13 nt, Human
uauuuuguguaaa

SEQ ID NO: 2657111 - RNA, 16 nt, Human
uauuuuguguaaaaaa

SEQ ID NO: 2657112 - RNA, 14 nt, Human
uauuuugugugaaa

SEQ ID NO: 2657113 - RNA, 15 nt, Human
uauuuugugugaaau

SEQ ID NO: 2657114 - RNA, 17 nt, Human
uauuuugugugaaauug

SEQ ID NO: 2657115 - RNA, 12 nt, Human
uauuuuucacuc

SEQ ID NO: 2657116 - RNA, 22 nt, Human
uauuuuucacucuaagucaugu

SEQ ID NO: 2657117 - RNA, 16 nt, Human
uauuuuucauaaacaa

SEQ ID NO: 2657118 - RNA, 18 nt, Human
uauuuuucauaaacaagu

SEQ ID NO: 2657119 - RNA, 16 nt, Human
uauuuuuguaaaguuu

SEQ ID NO: 2657120 - RNA, 12 nt, Human
uauuuuuguaaa

SEQ ID NO: 2657121 - RNA, 12 nt, Human
ucaaaagugccu

SEQ ID NO: 2657122 - RNA, 16 nt, Human
ucaaaagugccucaag

SEQ ID NO: 2657123 - RNA, 16 nt, Human
ucaaaagcugggcagg

SEQ ID NO: 2657124 - RNA, 20 nt, Human
ucaaaagguauuauacaugu

SEQ ID NO: 2657125 - RNA, 21 nt, Human
ucaaaagguauuauacaugug

SEQ ID NO: 2657126 - RNA, 23 nt, Human
ucaaaaguagaacuuuguauagu

SEQ ID NO: 2657127 - RNA, 18 nt, Human
ucaaaaguagaacuuugu

SEQ ID NO: 2657128 - RNA, 17 nt, Human
ucaaaaguagaacuuug

SEQ ID NO: 2657129 - RNA, 21 nt, Human
ucaaagucugcucucauauaa

SEQ ID NO: 2657130 - RNA, 14 nt, Human
ucaaagugcuauua

SEQ ID NO: 2657131 - RNA, 14 nt, Human
ucaaaguugaaaau

SEQ ID NO: 2657132 - RNA, 15 nt, Human
ucaaaguugaaaauu

SEQ ID NO: 2657133 - RNA, 17 nt, Human
ucaaaguugaaaauuca

SEQ ID NO: 2657134 - RNA, 18 nt, Human
ucaaaguugaaaauucau

SEQ ID NO: 2657135 - RNA, 13 nt, Human
ucaaagucauuaa

SEQ ID NO: 2657136 - RNA, 17 nt, Human
ucaaagucauuaaagac

SEQ ID NO: 2657137 - RNA, 18 nt, Human
ucaaagucauuaaagaca

SEQ ID NO: 2657138 - RNA, 19 nt, Human
acauuacucugccucugua

SEQ ID NO: 2657139 - RNA, 20 nt, Human
acauggugccugagaggcag

SEQ ID NO: 2657140 - RNA, 23 nt, Human
acauggugccugagaggcaggca

SEQ ID NO: 2657141 - RNA, 22 nt, Human
acaugaggaacuguagaugaug

SEQ ID NO: 2657142 - RNA, 17 nt, Human
acaugaggaacuguaga

SEQ ID NO: 2657143 - RNA, 18 nt, Human
acaugaggaacuguagau

SEQ ID NO: 2657144 - RNA, 21 nt, Human
acaugaggaacuguagaugau

SEQ ID NO: 2657145 - RNA, 23 nt, Human
acaugagauguguggacuguggc

SEQ ID NO: 2657146 - RNA, 18 nt, Human
acaugagauguguggacu

SEQ ID NO: 2657147 - RNA, 20 nt, Human
acaugagauguguggacugu

SEQ ID NO: 2657148 - RNA, 14 nt, Human
acaugaggaacugu

SEQ ID NO: 2657149 - RNA, 19 nt, Human
acauggugccugagaggca

SEQ ID NO: 2657150 - RNA, 22 nt, Human
acauggcuccggccucugccuu

SEQ ID NO: 2657151 - RNA, 14 nt, Human
acccugaugaaaac

SEQ ID NO: 2657152 - RNA, 10 nt, Human
acccugcccc

SEQ ID NO: 2657153 - RNA, 17 nt, Human
acccugccccucagaga

SEQ ID NO: 2657154 - RNA, 12 nt, Human
acccugagccgg

SEQ ID NO: 2657155 - RNA, 14 nt, Human
acccggaggccgag

SEQ ID NO: 2657156 - RNA, 11 nt, Human
acccuccaaau

SEQ ID NO: 2657157 - RNA, 22 nt, Human
acccuccaaauggagaagcugc

SEQ ID NO: 2657158 - RNA, 23 nt, Human
acccuccaaauggagaagcugca

SEQ ID NO: 2657159 - RNA, 11 nt, Human
acccccagccc

SEQ ID NO: 2657160 - RNA, 12 nt, Human
acccccagcccc

SEQ ID NO: 2657161 - RNA, 13 nt, Human
acccccagccccg

SEQ ID NO: 2657162 - RNA, 14 nt, Human
acccccagccccga

SEQ ID NO: 2657163 - RNA, 20 nt, Human
acccccagccccgacuccag

SEQ ID NO: 2657164 - RNA, 21 nt, Human
acccccagccccgacuccagc

SEQ ID NO: 2657165 - RNA, 22 nt, Human
acccccagccccgacuccagcc

SEQ ID NO: 2657166 - RNA, 23 nt, Human
acccccagccccgacuccagcca

SEQ ID NO: 2657167 - RNA, 18 nt, Human
ucaggcaggugggaugga

SEQ ID NO: 2657168 - RNA, 17 nt, Human
ucaggcaggugggaugg

SEQ ID NO: 2657169 - RNA, 23 nt, Human
ucaggggugugcggccuuuggcu

SEQ ID NO: 2657170 - RNA, 19 nt, Human
ucaggggugugcggccuuu

SEQ ID NO: 2657171 - RNA, 12 nt, Human
ucaggggugugc

SEQ ID NO: 2657172 - RNA, 19 nt, Human
ucagguaguugcaauugaa

SEQ ID NO: 2657173 - RNA, 19 nt, Human
ucaguaguuuaaaaguucu

SEQ ID NO: 2657174 - RNA, 18 nt, Human
ucaguaggacuccuuauu

SEQ ID NO: 2657175 - RNA, 17 nt, Human
ucaguauuauguaguug

SEQ ID NO: 2657176 - RNA, 14 nt, Human
ucaguuuguuggaa

SEQ ID NO: 2657177 - RNA, 15 nt, Human
ucaguuuguuggaaa

SEQ ID NO: 2657178 - RNA, 16 nt, Human
ucaguuuguuggaaag

SEQ ID NO: 2657179 - RNA, 19 nt, Human
ucaguuuguuggaaaguaa

SEQ ID NO: 2657180 - RNA, 20 nt, Human
ucaguauuagaugcacuuaa

SEQ ID NO: 2657181 - RNA, 14 nt, Human
acccugcugagucu

SEQ ID NO: 2657182 - RNA, 16 nt, Human
acccugcugcuggugc

SEQ ID NO: 2657183 - RNA, 19 nt, Human
acccugcugcuggugcaca

SEQ ID NO: 2657184 - RNA, 13 nt, Human
ucaguaagccgug

SEQ ID NO: 2657185 - RNA, 14 nt, Human
ucaguaaguuaucu

SEQ ID NO: 2657186 - RNA, 23 nt, Human
ucaguaaguuaucuuugaauaug

SEQ ID NO: 2657187 - RNA, 23 nt, Human
ucaguaggugcccagaauaaguu

SEQ ID NO: 2657188 - RNA, 14 nt, Human
ucaguacuuuuuua

SEQ ID NO: 2657189 - RNA, 23 nt, Human
ucaguacuuuuuuaaauauuuuc

SEQ ID NO: 2657190 - RNA, 21 nt, Human
ucaguaacccccuuaaauuua

SEQ ID NO: 2657191 - RNA, 22 nt, Human
ucaguaacccccuuaaauuuaa

SEQ ID NO: 2657192 - RNA, 23 nt, Human
ucaguaacccccuuaaauuuaau

SEQ ID NO: 2657193 - RNA, 15 nt, Human
ucaguaacugucagg

SEQ ID NO: 2657194 - RNA, 21 nt, Human
ucaguaaacgggaacaugccc

SEQ ID NO: 2657195 - RNA, 22 nt, Human
ucaguaaacgggaacaugcccc

SEQ ID NO: 2657196 - RNA, 20 nt, Human
ucagguuauuuauuuuauaa

SEQ ID NO: 2657197 - RNA, 18 nt, Human
ucagguucaguauuaugu

SEQ ID NO: 2657198 - RNA, 14 nt, Human
ucagagacaaaaua

SEQ ID NO: 2657199 - RNA, 21 nt, Human
ucagagacaaaauauuuccca

SEQ ID NO: 2657200 - RNA, 22 nt, Human
ucagagacaaaauauuucccau

SEQ ID NO: 2657201 - RNA, 12 nt, Human
ucagagacacug

SEQ ID NO: 2657202 - RNA, 12 nt, Human
ucagagacagau

SEQ ID NO: 2657203 - RNA, 18 nt, Human
ucagaaucccuuaacagu

SEQ ID NO: 2657204 - RNA, 22 nt, Human
ucagagaugcaccaccaagcca

SEQ ID NO: 2657205 - RNA, 16 nt, Human
ucagagaugcaccacc

SEQ ID NO: 2657206 - RNA, 21 nt, Human
ucagagaugcaccaccaagcc

SEQ ID NO: 2657207 - RNA, 15 nt, Human
ucagauuucugagga

SEQ ID NO: 2657208 - RNA, 18 nt, Human
ucagagaugaacaucuaa

SEQ ID NO: 2657209 - RNA, 22 nt, Human
acccaggguucccgcggggcug

SEQ ID NO: 2657210 - RNA, 21 nt, Human
acccaggguucccgcggggcu

SEQ ID NO: 2657211 - RNA, 14 nt, Human
ucacuccagccugg

SEQ ID NO: 2657212 - RNA, 17 nt, Human
ucacugaaaauuggaca

SEQ ID NO: 2657213 - RNA, 22 nt, Human
ucacugaaaauuggacagauug

SEQ ID NO: 2657214 - RNA, 22 nt, Human
ucacucauugcugagccucugc

SEQ ID NO: 2657215 - RNA, 20 nt, Human
ucacucauugcugagccucu

SEQ ID NO: 2657216 - RNA, 19 nt, Human
ucacucauugcugagccuc

SEQ ID NO: 2657217 - RNA, 18 nt, Human
ucacucauugcugagccu

SEQ ID NO: 2657218 - RNA, 17 nt, Human
ucacucauugcugagcc

SEQ ID NO: 2657219 - RNA, 15 nt, Human
ucacucauugcugag

SEQ ID NO: 2657220 - RNA, 13 nt, Human
ucacucauugcug

SEQ ID NO: 2657221 - RNA, 15 nt, Human
ucacucacucuaaag

SEQ ID NO: 2657222 - RNA, 14 nt, Human
ucacucacagaguc

SEQ ID NO: 2657223 - RNA, 16 nt, Human
ucacucacagagucaa

SEQ ID NO: 2657224 - RNA, 22 nt, Human
ucacucacagagucaaggccug

SEQ ID NO: 2657225 - RNA, 23 nt, Human
ucacucacagagucaaggccugc

SEQ ID NO: 2657226 - RNA, 15 nt, Human
ucacuucacccugga

SEQ ID NO: 2657227 - RNA, 22 nt, Human
ucacuuaugaaugauuugcaua

SEQ ID NO: 2657228 - RNA, 16 nt, Human
ucacuguuuguuuuua

SEQ ID NO: 2657229 - RNA, 15 nt, Human
ucacuuaaaacacgu

SEQ ID NO: 2657230 - RNA, 13 nt, Human
ucacuuaaaacac

SEQ ID NO: 2657231 - RNA, 16 nt, Human
ucacugaugggaaaac

SEQ ID NO: 2657232 - RNA, 18 nt, Human
ucacugaugggaaaacug

SEQ ID NO: 2657233 - RNA, 11 nt, Human
acccaaagcug

SEQ ID NO: 2657234 - RNA, 16 nt, Human
acccaaagcugagccu

SEQ ID NO: 2657235 - RNA, 17 nt, Human
acccaaagcugagccug

SEQ ID NO: 2657236 - RNA, 18 nt, Human
acccaaagcugagccugc

SEQ ID NO: 2657237 - RNA, 22 nt, Human
acccaaagcugagccugcaggg

SEQ ID NO: 2657238 - RNA, 13 nt, Human
accauucugacuc

SEQ ID NO: 2657239 - RNA, 21 nt, Human
accauucugacucgguuucuc

SEQ ID NO: 2657240 - RNA, 17 nt, Human
accaugccucacuaauu

SEQ ID NO: 2657241 - RNA, 19 nt, Human
accaugccucacuaauuuu

SEQ ID NO: 2657242 - RNA, 20 nt, Human
accaugccucacuaauuuuu

SEQ ID NO: 2657243 - RNA, 19 nt, Human
accaugcucaucugcuggu

SEQ ID NO: 2657244 - RNA, 20 nt, Human
accaugcucaucugcugguc

SEQ ID NO: 2657245 - RNA, 14 nt, Human
accagggguuucuc

SEQ ID NO: 2657246 - RNA, 16 nt, Human
accagggguuucucgc

SEQ ID NO: 2657247 - RNA, 17 nt, Human
accagggguuucucgca

SEQ ID NO: 2657248 - RNA, 16 nt, Human
accaugugagcucuuc

SEQ ID NO: 2657249 - RNA, 18 nt, Human
accaugugagcucuuccu

SEQ ID NO: 2657250 - RNA, 19 nt, Human
accaugugagcucuuccua

SEQ ID NO: 2657251 - RNA, 22 nt, Human
accauguggauaacuuuacaga

SEQ ID NO: 2657252 - RNA, 14 nt, Human
accauguggccaca

SEQ ID NO: 2657253 - RNA, 12 nt, Human
accaugucauuu

SEQ ID NO: 2657254 - RNA, 15 nt, Human
accaugucauuucag

SEQ ID NO: 2657255 - RNA, 18 nt, Human
accaugucauuucagaag

SEQ ID NO: 2657256 - RNA, 13 nt, Human
ucggggagccuua

SEQ ID NO: 2657257 - RNA, 22 nt, Human
ucguacauaauacugaaccacu

SEQ ID NO: 2657258 - RNA, 15 nt, Human
ucguacauaauacug

SEQ ID NO: 2657259 - RNA, 14 nt, Human
ucguacauaauacu

SEQ ID NO: 2657260 - RNA, 20 nt, Human
ucuaaacaaugcugauuugg

SEQ ID NO: 2657261 - RNA, 18 nt, Human
ucgucacuaauacacagu

SEQ ID NO: 2657262 - RNA, 21 nt, Human
ucguucuguacuguuacuggg

SEQ ID NO: 2657263 - RNA, 22 nt, Human
ucguugguuauacaaguucuug

SEQ ID NO: 2657264 - RNA, 20 nt, Human
acuguggcacuugccugggu

SEQ ID NO: 2657265 - RNA, 19 nt, Human
acuguggcacuugccuggg

SEQ ID NO: 2657266 - RNA, 22 nt, Human
acuguggcacuugccuggguca

SEQ ID NO: 2657267 - RNA, 14 nt, Human
acuguguugccaca

SEQ ID NO: 2657268 - RNA, 21 nt, Human
acuguguuguaccaaaauuca

SEQ ID NO: 2657269 - RNA, 17 nt, Human
acuguguuuuauaaaau

SEQ ID NO: 2657270 - RNA, 18 nt, Human
acuguguuuuauaaaaua

SEQ ID NO: 2657271 - RNA, 19 nt, Human
acuguguuuuauaaaauag

SEQ ID NO: 2657272 - RNA, 16 nt, Human
ucgggagacagcauca

SEQ ID NO: 2657273 - RNA, 21 nt, Human
ucgggagacagcaucaggguu

SEQ ID NO: 2657274 - RNA, 21 nt, Human
ucuacaugaggaacuguagau

SEQ ID NO: 2657275 - RNA, 21 nt, Human
ucuacccucuuagaaaaacca

SEQ ID NO: 2657276 - RNA, 20 nt, Human
ucuacaugaggaacuguaga

SEQ ID NO: 2657277 - RNA, 18 nt, Human
ucuaagcagcuuauuguu

SEQ ID NO: 2657278 - RNA, 21 nt, Human
ucuaagucaguacccaccacc

SEQ ID NO: 2657279 - RNA, 15 nt, Human
ucuaagucauguaug

SEQ ID NO: 2657280 - RNA, 16 nt, Human
ucuaagucauguaugu

SEQ ID NO: 2657281 - RNA, 18 nt, Human
ucuaagucauguauguuu

SEQ ID NO: 2657282 - RNA, 19 nt, Human
ucuaagucauguauguuuc

SEQ ID NO: 2657283 - RNA, 20 nt, Human
ucuaagucauguauguuucu

SEQ ID NO: 2657284 - RNA, 18 nt, Human
ucuaagugggcauugcca

SEQ ID NO: 2657285 - RNA, 21 nt, Human
ucuaagugggcauugccaugu

SEQ ID NO: 2657286 - RNA, 12 nt, Human
ucuaaagagcau

SEQ ID NO: 2657287 - RNA, 13 nt, Human
ucuaaagagcauc

SEQ ID NO: 2657288 - RNA, 14 nt, Human
ucuaaagagcaucu

SEQ ID NO: 2657289 - RNA, 12 nt, Human
ucuaagagaagu

SEQ ID NO: 2657290 - RNA, 16 nt, Human
ucuaagacuauauaua

SEQ ID NO: 2657291 - RNA, 21 nt, Human
ucuaagacuauauauauaaau

SEQ ID NO: 2657292 - RNA, 23 nt, Human
ucuaagacuauauauauaaaugu

SEQ ID NO: 2657293 - RNA, 15 nt, Human
acuggggcauccugu

SEQ ID NO: 2657294 - RNA, 15 nt, Human
acugggguugagggc

SEQ ID NO: 2657295 - RNA, 15 nt, Human
acugucaaaugaugu

SEQ ID NO: 2657296 - RNA, 20 nt, Human
acugucaaaugaugugcaaa

SEQ ID NO: 2657297 - RNA, 22 nt, Human
acugucaaaugaugugcaaaac

SEQ ID NO: 2657298 - RNA, 15 nt, Human
acugucacucauugc

SEQ ID NO: 2657299 - RNA, 14 nt, Human
acugucacucauug

SEQ ID NO: 2657300 - RNA, 20 nt, Human
acugucaggcugaaaacaau

SEQ ID NO: 2657301 - RNA, 14 nt, Human
acuguaucauuuuc

SEQ ID NO: 2657302 - RNA, 15 nt, Human
acuguaucauuuucu

SEQ ID NO: 2657303 - RNA, 16 nt, Human
acuguaucauuuucuu

SEQ ID NO: 2657304 - RNA, 12 nt, Human
acuguauuugaa

SEQ ID NO: 2657305 - RNA, 23 nt, Human
acuguauuugaaauaagaauuca

SEQ ID NO: 2657306 - RNA, 15 nt, Human
acugaaaguuuugua

SEQ ID NO: 2657307 - RNA, 16 nt, Human
acugaaaguuuuguaa

SEQ ID NO: 2657308 - RNA, 17 nt, Human
acugaaaguuuuguaaa

SEQ ID NO: 2657309 - RNA, 18 nt, Human
acugaaaguuuuguaaaa

SEQ ID NO: 2657310 - RNA, 23 nt, Human
acugaaaguuuuguaaaagaaau

SEQ ID NO: 2657311 - RNA, 21 nt, Human
acugaagcagccucuccccag

SEQ ID NO: 2657312 - RNA, 13 nt, Human
acugaagcagccu

SEQ ID NO: 2657313 - RNA, 14 nt, Human
acugaagcagccuc

SEQ ID NO: 2657314 - RNA, 16 nt, Human
acugaaaggcuuuuca

SEQ ID NO: 2657315 - RNA, 17 nt, Human
ucgccggaucugaggga

SEQ ID NO: 2657316 - RNA, 16 nt, Human
ucgccggaucugaggg

SEQ ID NO: 2657317 - RNA, 12 nt, Human
ucgccucagccu

SEQ ID NO: 2657318 - RNA, 12 nt, Human
acugggcccuga

SEQ ID NO: 2657319 - RNA, 14 nt, Human
acugggcccugagu

SEQ ID NO: 2657320 - RNA, 17 nt, Human
acugggcccugagucug

SEQ ID NO: 2657321 - RNA, 22 nt, Human
acugggcucccgggccccacag

SEQ ID NO: 2657322 - RNA, 16 nt, Human
acugggcucccgggcc

SEQ ID NO: 2657323 - RNA, 23 nt, Human
ucgcugugucagcauagaaguaa

SEQ ID NO: 2657324 - RNA, 17 nt, Human
acugaaaugccugcuuu

SEQ ID NO: 2657325 - RNA, 22 nt, Human
ucgcugagggcagacuggggca

SEQ ID NO: 2657326 - RNA, 19 nt, Human
acuggggcuggggaaggaa

SEQ ID NO: 2657327 - RNA, 21 nt, Human
acuggggcuggggaaggaagc

SEQ ID NO: 2657328 - RNA, 22 nt, Human
acuggggcuggggaaggaagcc

SEQ ID NO: 2657329 - RNA, 17 nt, Human
acuggggccuccagaac

SEQ ID NO: 2657330 - RNA, 16 nt, Human
acuggggccuccagaa

SEQ ID NO: 2657331 - RNA, 13 nt, Human
acuggggccucca

SEQ ID NO: 2657332 - RNA, 12 nt, Human
acuggggccucc

SEQ ID NO: 2657333 - RNA, 21 nt, Human
acuggggccuacagcuuugau

SEQ ID NO: 2657334 - RNA, 15 nt, Human
acuugaaugugucag

SEQ ID NO: 2657335 - RNA, 20 nt, Human
acuugaagccaucuaaagua

SEQ ID NO: 2657336 - RNA, 17 nt, Human
acuugacuuuuaaggcu

SEQ ID NO: 2657337 - RNA, 13 nt, Human
acuugaggccuga

SEQ ID NO: 2657338 - RNA, 12 nt, Human
acuugccucuuc

SEQ ID NO: 2657339 - RNA, 23 nt, Human
acuuggaagcacaccaaucuuac

SEQ ID NO: 2657340 - RNA, 18 nt, Human
acuuguauuaaagacaga

SEQ ID NO: 2657341 - RNA, 20 nt, Human
ucuauuuuuugaaaagcaga

SEQ ID NO: 2657342 - RNA, 14 nt, Human
ucuauauauauaau

SEQ ID NO: 2657343 - RNA, 16 nt, Human
ucucaaaaaaagaaaa

SEQ ID NO: 2657344 - RNA, 20 nt, Human
acuucgggaggucgaggcag

SEQ ID NO: 2657345 - RNA, 17 nt, Human
acuucgggaggucgagg

SEQ ID NO: 2657346 - RNA, 22 nt, Human
acuucgcaccggagugucugga

SEQ ID NO: 2657347 - RNA, 16 nt, Human
ucuagcagcaccuccu

SEQ ID NO: 2657348 - RNA, 21 nt, Human
ucuagccagccccucuucccc

SEQ ID NO: 2657349 - RNA, 22 nt, Human
ucuagcacaauuugcacuaaau

SEQ ID NO: 2657350 - RNA, 15 nt, Human
ucuagauaucgacuu

SEQ ID NO: 2657351 - RNA, 13 nt, Human
ucuaguuuuguca

SEQ ID NO: 2657352 - RNA, 12 nt, Human
ucuauaaaacuc

SEQ ID NO: 2657353 - RNA, 16 nt, Human
ucuauaaaacucugca

SEQ ID NO: 2657354 - RNA, 16 nt, Human
ucuauaaaagaaacac

SEQ ID NO: 2657355 - RNA, 14 nt, Human
ucuauaaaauagau

SEQ ID NO: 2657356 - RNA, 17 nt, Human
ucuauaaaauagauaua

SEQ ID NO: 2657357 - RNA, 19 nt, Human
ucuauaaaauagauauaaa

SEQ ID NO: 2657358 - RNA, 21 nt, Human
ucuauaggaacauaugaaaau

SEQ ID NO: 2657359 - RNA, 20 nt, Human
ucuauaggaacauaugaaaa

SEQ ID NO: 2657360 - RNA, 18 nt, Human
ucuauaggaacauaugaa

SEQ ID NO: 2657361 - RNA, 20 nt, Human
ucuauagcaucacuuaaaac

SEQ ID NO: 2657362 - RNA, 19 nt, Human
ucuauagcaucacuuaaaa

SEQ ID NO: 2657363 - RNA, 13 nt, Human
acuucccacccug

SEQ ID NO: 2657364 - RNA, 14 nt, Human
acuucccacccugc

SEQ ID NO: 2657365 - RNA, 17 nt, Human
acuucccacccugcccc

SEQ ID NO: 2657366 - RNA, 19 nt, Human
acuucccacccugccccuc

SEQ ID NO: 2657367 - RNA, 13 nt, Human
acuuccaugaauu

SEQ ID NO: 2657368 - RNA, 14 nt, Human
acuuccaugaauuu

SEQ ID NO: 2657369 - RNA, 15 nt, Human
acuuccaugaauuuu

SEQ ID NO: 2657370 - RNA, 17 nt, Human
acuuagcgaacccuuua

SEQ ID NO: 2657371 - RNA, 12 nt, Human
acuucauguaaa

SEQ ID NO: 2657372 - RNA, 13 nt, Human
acuucauguaaag

SEQ ID NO: 2657373 - RNA, 16 nt, Human
acuucauguaaagugu

SEQ ID NO: 2657374 - RNA, 21 nt, Human
acuucauuauuuuaaaaauau

SEQ ID NO: 2657375 - RNA, 12 nt, Human
ucuaccugcccu

SEQ ID NO: 2657376 - RNA, 18 nt, Human
ucuaccugcccucaaggg

SEQ ID NO: 2657377 - RNA, 19 nt, Human
ucuccuucuaaaaacuucu

SEQ ID NO: 2657378 - RNA, 12 nt, Human
ucuccuuaagcu

SEQ ID NO: 2657379 - RNA, 20 nt, Human
ucuccuuaagcugcagagau

SEQ ID NO: 2657380 - RNA, 22 nt, Human
ucuccuuaagcugcagagauuu

SEQ ID NO: 2657381 - RNA, 13 nt, Human
agaaaaaaauguc

SEQ ID NO: 2657382 - RNA, 19 nt, Human
agaaaaaaaugucaaaagu

SEQ ID NO: 2657383 - RNA, 20 nt, Human
agaaaaaaaugucaaaagua

SEQ ID NO: 2657384 - RNA, 19 nt, Human
acuuugcuguuccuuacuu

SEQ ID NO: 2657385 - RNA, 14 nt, Human
acuuuguauuuuga

SEQ ID NO: 2657386 - RNA, 23 nt, Human
acuuuguauaguuauguaaauaa

SEQ ID NO: 2657387 - RNA, 24 nt, Human
acuuuguauuguccuauuaguguu

SEQ ID NO: 2657388 - RNA, 15 nt, Human
acuuuguauuguccu

SEQ ID NO: 2657389 - RNA, 16 nt, Human
agaaaaaaauacuauu

SEQ ID NO: 2657390 - RNA, 16 nt, Human
ucucgcauaggaccuu

SEQ ID NO: 2657391 - RNA, 23 nt, Human
ucucgcauaggaccuuuccacca

SEQ ID NO: 2657392 - RNA, 16 nt, Human
ucuccuugaguguaug

SEQ ID NO: 2657393 - RNA, 18 nt, Human
ucucggauaguugcuauu

SEQ ID NO: 2657394 - RNA, 23 nt, Human
ucucggauaguugcuauuuuugu

SEQ ID NO: 2657395 - RNA, 20 nt, Human
ucucggaucaggcucccagg

SEQ ID NO: 2657396 - RNA, 19 nt, Human
acuuuacugccugaauaaa

SEQ ID NO: 2657397 - RNA, 18 nt, Human
acuuguuuuggauggcuu

SEQ ID NO: 2657398 - RNA, 19 nt, Human
acuuguuuuggauggcuug

SEQ ID NO: 2657399 - RNA, 20 nt, Human
acuuguuuuggauggcuugu

SEQ ID NO: 2657400 - RNA, 16 nt, Human
acuugugauuauuuau

SEQ ID NO: 2657401 - RNA, 20 nt, Human
acuugugauuauuuauuauu

SEQ ID NO: 2657402 - RNA, 17 nt, Human
acuugugauuauuuauu

SEQ ID NO: 2657403 - RNA, 11 nt, Human
acuuugauguc

SEQ ID NO: 2657404 - RNA, 10 nt, Human
acuuugaugu

SEQ ID NO: 2657405 - RNA, 22 nt, Human
acuuugaugucagcaguugcug

SEQ ID NO: 2657406 - RNA, 17 nt, Human
acuuugaugucagcagu

SEQ ID NO: 2657407 - RNA, 16 nt, Human
acuuugaugucagcag

SEQ ID NO: 2657408 - RNA, 12 nt, Human
acuuugauguca

SEQ ID NO: 2657409 - RNA, 21 nt, Human
acuuuguauaguuauguaaau

SEQ ID NO: 2657410 - RNA, 18 nt, Human
acuuuguauaguuaugua

SEQ ID NO: 2657411 - RNA, 17 nt, Human
acuuuguauaguuaugu

SEQ ID NO: 2657412 - RNA, 14 nt, Human
acuuuguauaguua

SEQ ID NO: 2657413 - RNA, 12 nt, Human
acuuuguauagu

SEQ ID NO: 2657414 - RNA, 17 nt, Human
agaaauacaguacuguu

SEQ ID NO: 2657415 - RNA, 16 nt, Human
agaaauggaaagcaga

SEQ ID NO: 2657416 - RNA, 16 nt, Human
agaaauggaaauuuug

SEQ ID NO: 2657417 - RNA, 23 nt, Human
ucugaaggcgucaacgugcauuu

SEQ ID NO: 2657418 - RNA, 23 nt, Human
agaaacuuaaauguuauuaucug

SEQ ID NO: 2657419 - RNA, 12 nt, Human
agaaagagcuac

SEQ ID NO: 2657420 - RNA, 15 nt, Human
agaaagagcuaccug

SEQ ID NO: 2657421 - RNA, 22 nt, Human
agaaagaggcaccaggaagccg

SEQ ID NO: 2657422 - RNA, 13 nt, Human
agaaaagaugaaa

SEQ ID NO: 2657423 - RNA, 21 nt, Human
agaaaacaagcaaguucugag

SEQ ID NO: 2657424 - RNA, 22 nt, Human
agaaaacaagcaaguucugaga

SEQ ID NO: 2657425 - RNA, 19 nt, Human
agaaaagccuaaucacagu

SEQ ID NO: 2657426 - RNA, 18 nt, Human
agaaacuuaaauguuauu

SEQ ID NO: 2657427 - RNA, 20 nt, Human
agaaacuuaaauguuauuau

SEQ ID NO: 2657428 - RNA, 17 nt, Human
agaaacuuaaauguuau

SEQ ID NO: 2657429 - RNA, 18 nt, Human
agaaaaaugagccuggca

SEQ ID NO: 2657430 - RNA, 16 nt, Human
agaaaacaagcaaguu

SEQ ID NO: 2657431 - RNA, 23 nt, Human
agaaaaaauauuuuccugccagg

SEQ ID NO: 2657432 - RNA, 17 nt, Human
agaaaaaauauuuuccu

SEQ ID NO: 2657433 - RNA, 19 nt, Human
agaaaaaauauuuucccua

SEQ ID NO: 2657434 - RNA, 18 nt, Human
agaacuugaaugugucag

SEQ ID NO: 2657435 - RNA, 12 nt, Human
agaacuuuguau

SEQ ID NO: 2657436 - RNA, 13 nt, Human
agaagcaaguaaa

SEQ ID NO: 2657437 - RNA, 15 nt, Human
agaacuuuguauagu

SEQ ID NO: 2657438 - RNA, 13 nt, Human
agaacuuuguaua

SEQ ID NO: 2657439 - RNA, 17 nt, Human
agaacuuuguauaguua

SEQ ID NO: 2657440 - RNA, 16 nt, Human
agaagcagaggaagga

SEQ ID NO: 2657441 - RNA, 15 nt, Human
agaagcaguggccuu

SEQ ID NO: 2657442 - RNA, 23 nt, Human
agaagcaguuguaccaagugaaa

SEQ ID NO: 2657443 - RNA, 17 nt, Human
agaagcaugaagucuua

SEQ ID NO: 2657444 - RNA, 16 nt, Human
agaagcacagaauauu

SEQ ID NO: 2657445 - RNA, 19 nt, Human
agaagcacagaauauuuuu

SEQ ID NO: 2657446 - RNA, 21 nt, Human
agaagcacagaauauuuuuau

SEQ ID NO: 2657447 - RNA, 20 nt, Human
agaagcccgugugagaagug

SEQ ID NO: 2657448 - RNA, 13 nt, Human
ucugcccuggcug

SEQ ID NO: 2657449 - RNA, 14 nt, Human
ucugcccuggcugc

SEQ ID NO: 2657450 - RNA, 15 nt, Human
ucugcccuggcugcu

SEQ ID NO: 2657451 - RNA, 16 nt, Human
ucugcccuggcugcug

SEQ ID NO: 2657452 - RNA, 21 nt, Human
ucugcccuggcugcugccccc

SEQ ID NO: 2657453 - RNA, 14 nt, Human
agaacucacugggg

SEQ ID NO: 2657454 - RNA, 12 nt, Human
agaacugcaggc

SEQ ID NO: 2657455 - RNA, 15 nt, Human
agaacugcaggcccu

SEQ ID NO: 2657456 - RNA, 20 nt, Human
agaacugcaggcccuggccu

SEQ ID NO: 2657457 - RNA, 16 nt, Human
agaacugcaggcccug

SEQ ID NO: 2657458 - RNA, 18 nt, Human
agaacugcaggcccuggc

SEQ ID NO: 2657459 - RNA, 21 nt, Human
agaacuauugugcucagagac

SEQ ID NO: 2657460 - RNA, 23 nt, Human
agaacuauugugcucagagacac

SEQ ID NO: 2657461 - RNA, 18 nt, Human
agaacgaggauuuuaauu

SEQ ID NO: 2657462 - RNA, 13 nt, Human
agaaggaugaugu

SEQ ID NO: 2657463 - RNA, 17 nt, Human
agaaguucauguccaaa

SEQ ID NO: 2657464 - RNA, 17 nt, Human
agaagugcccuuccugc

SEQ ID NO: 2657465 - RNA, 14 nt, Human
agaagugagcaaaa

SEQ ID NO: 2657466 - RNA, 18 nt, Human
agaagugagcaaaaaaga

SEQ ID NO: 2657467 - RNA, 22 nt, Human
agaaguuugagaucagccuggg

SEQ ID NO: 2657468 - RNA, 21 nt, Human
agaaguuguaaaguauguauu

SEQ ID NO: 2657469 - RNA, 21 nt, Human
agaauauuuuuauauuuccuu

SEQ ID NO: 2657470 - RNA, 22 nt, Human
agaauauuuuuauauuuccuuu

SEQ ID NO: 2657471 - RNA, 23 nt, Human
agaauauuuuuauauuuccuuua

SEQ ID NO: 2657472 - RNA, 11 nt, Human
agaauacugau

SEQ ID NO: 2657473 - RNA, 14 nt, Human
agaauacugaugga

SEQ ID NO: 2657474 - RNA, 16 nt, Human
agaauaccacaucaaa

SEQ ID NO: 2657475 - RNA, 17 nt, Human
agaauaccacaucaaau

SEQ ID NO: 2657476 - RNA, 18 nt, Human
agaauaccacaucaaaua

SEQ ID NO: 2657477 - RNA, 21 nt, Human
agaaguuuggcugcugucaua

SEQ ID NO: 2657478 - RNA, 22 nt, Human
agaaguuuggcugcugucauaa

SEQ ID NO: 2657479 - RNA, 15 nt, Human
ucuggccucugcuuu

SEQ ID NO: 2657480 - RNA, 21 nt, Human
agaagccgagagccuuuugug

SEQ ID NO: 2657481 - RNA, 12 nt, Human
ucuggcaaggac

SEQ ID NO: 2657482 - RNA, 18 nt, Human
ucuggcaaggacuuugua

SEQ ID NO: 2657483 - RNA, 23 nt, Human
ucuggcaaggacuuuguacauuu

SEQ ID NO: 2657484 - RNA, 21 nt, Human
ucugcuuuucugcccuggcug

SEQ ID NO: 2657485 - RNA, 22 nt, Human
ucugcuuuucugcccuggcugc

SEQ ID NO: 2657486 - RNA, 15 nt, Human
ucugcuuuucugccc

SEQ ID NO: 2657487 - RNA, 16 nt, Human
ucugcuuuucugcccu

SEQ ID NO: 2657488 - RNA, 17 nt, Human
ucugcuuuucugcccug

SEQ ID NO: 2657489 - RNA, 18 nt, Human
ucugcuuuucugcccugg

SEQ ID NO: 2657490 - RNA, 19 nt, Human
ucugcuuuucugcccuggc

SEQ ID NO: 2657491 - RNA, 20 nt, Human
ucugcuuuucugcccuggcu

SEQ ID NO: 2657492 - RNA, 16 nt, Human
ucugccuuaaaaccaa

SEQ ID NO: 2657493 - RNA, 17 nt, Human
ucugccuuaaaaccaaa

SEQ ID NO: 2657494 - RNA, 20 nt, Human
ucugccuuaaaaccaaagag

SEQ ID NO: 2657495 - RNA, 17 nt, Human
ucugcccuggcugcugc

SEQ ID NO: 2657496 - RNA, 12 nt, Human
ugaauaaagugu

SEQ ID NO: 2657497 - RNA, 21 nt, Human
ugaauacugcuugaauaaaca

SEQ ID NO: 2657498 - RNA, 18 nt, Human
ugaauacugcuugaauaa

SEQ ID NO: 2657499 - RNA, 16 nt, Human
ugaauacugcuugaau

SEQ ID NO: 2657500 - RNA, 15 nt, Human
ugaauacugcuugaa

SEQ ID NO: 2657501 - RNA, 13 nt, Human
ugaauacugcuug

SEQ ID NO: 2657502 - RNA, 19 nt, Human
ugaauacuugaaccauaaa

SEQ ID NO: 2657503 - RNA, 16 nt, Human
ugaauacuugaaccau

SEQ ID NO: 2657504 - RNA, 15 nt, Human
ugaauacuugaacca

SEQ ID NO: 2657505 - RNA, 13 nt, Human
ugaauacuugaac

SEQ ID NO: 2657506 - RNA, 21 nt, Human
ugaauaucuauuaauauaugu

SEQ ID NO: 2657507 - RNA, 18 nt, Human
ugaauaucuauuaauaua

SEQ ID NO: 2657508 - RNA, 13 nt, Human
ugaauaugauuaa

SEQ ID NO: 2657509 - RNA, 22 nt, Human
ugaauaugauuaaaaauaucaa

SEQ ID NO: 2657510 - RNA, 21 nt, Human
ugaauaugauuaaaaauauca

SEQ ID NO: 2657511 - RNA, 15 nt, Human
ugaauaugauuaaaa

SEQ ID NO: 2657512 - RNA, 14 nt, Human
ugaauaugauuaaa

SEQ ID NO: 2657513 - RNA, 23 nt, Human
ugaauauguaguaucuauaugac

SEQ ID NO: 2657514 - RNA, 13 nt, Human
ugaauaaagagcc

SEQ ID NO: 2657515 - RNA, 11 nt, Human
ugaauguauuu

SEQ ID NO: 2657516 - RNA, 21 nt, Human
ugaaggggguaccuuaagaga

SEQ ID NO: 2657517 - RNA, 23 nt, Human
ugaagccaaguggggugcuggga

SEQ ID NO: 2657518 - RNA, 21 nt, Human
ugaagccaaguggggugcugg

SEQ ID NO: 2657519 - RNA, 22 nt, Human
ugaagccaaguggggugcuggg

SEQ ID NO: 2657520 - RNA, 11 nt, Human
ugaagccaaag

SEQ ID NO: 2657521 - RNA, 12 nt, Human
ugaagccaaaga

SEQ ID NO: 2657522 - RNA, 14 nt, Human
ugaagccaaagaaa

SEQ ID NO: 2657523 - RNA, 14 nt, Human
ugaagccaaguggg

SEQ ID NO: 2657524 - RNA, 24 nt, Human
agaggugggccagucuguggauca

SEQ ID NO: 2657525 - RNA, 14 nt, Human
agaggcccccagcc

SEQ ID NO: 2657526 - RNA, 16 nt, Human
agaggcccccagccca

SEQ ID NO: 2657527 - RNA, 17 nt, Human
agaggcccccagcccag

SEQ ID NO: 2657528 - RNA, 20 nt, Human
agaggcccccagcccagggc

SEQ ID NO: 2657529 - RNA, 21 nt, Human
agaggcccccagcccagggcu

SEQ ID NO: 2657530 - RNA, 22 nt, Human
agaggcccccagcccagggcuc

SEQ ID NO: 2657531 - RNA, 14 nt, Human
agaggcuggguuca

SEQ ID NO: 2657532 - RNA, 15 nt, Human
ugaaaguagggggcu

SEQ ID NO: 2657533 - RNA, 12 nt, Human
agaggcuucucc

SEQ ID NO: 2657534 - RNA, 16 nt, Human
agaggcuucuccgcca

SEQ ID NO: 2657535 - RNA, 17 nt, Human
agaggcuucuccgccag

SEQ ID NO: 2657536 - RNA, 19 nt, Human
agaggcuucuccgccagcc

SEQ ID NO: 2657537 - RNA, 20 nt, Human
agaggcuucuccgccagccu

SEQ ID NO: 2657538 - RNA, 21 nt, Human
agaggcuucuccgccagccuc

SEQ ID NO: 2657539 - RNA, 22 nt, Human
agaggcuucuccgccagccucc

SEQ ID NO: 2657540 - RNA, 12 nt, Human
agagggagagag

SEQ ID NO: 2657541 - RNA, 13 nt, Human
agagggagagaga

SEQ ID NO: 2657542 - RNA, 23 nt, Human
agaggcuucuccgccagccuccu

SEQ ID NO: 2657543 - RNA, 21 nt, Human
agaggugggccagucugugga

SEQ ID NO: 2657544 - RNA, 17 nt, Human
ugaauuuuaaaucuaaa

SEQ ID NO: 2657545 - RNA, 13 nt, Human
ugaauuuuuaagc

SEQ ID NO: 2657546 - RNA, 14 nt, Human
ugaauuuuuauugu

SEQ ID NO: 2657547 - RNA, 15 nt, Human
ugaauuuuuauuguu

SEQ ID NO: 2657548 - RNA, 16 nt, Human
ugaauuuuuauuguug

SEQ ID NO: 2657549 - RNA, 23 nt, Human
ugaauuuuaaaucuaaaucuauu

SEQ ID NO: 2657550 - RNA, 15 nt, Human
ugaauuuuaaaaucu

SEQ ID NO: 2657551 - RNA, 20 nt, Human
agaguuucaguuuguuggaa

SEQ ID NO: 2657552 - RNA, 21 nt, Human
agaguuucaguuuguuggaaa

SEQ ID NO: 2657553 - RNA, 15 nt, Human
agagucaaggccugc

SEQ ID NO: 2657554 - RNA, 16 nt, Human
agagucaaggccugcu

SEQ ID NO: 2657555 - RNA, 23 nt, Human
agaguuuuauagccuggacugcu

SEQ ID NO: 2657556 - RNA, 15 nt, Human
agaucaaaaaggcuu

SEQ ID NO: 2657557 - RNA, 14 nt, Human
agaucaaaaaggcu

SEQ ID NO: 2657558 - RNA, 20 nt, Human
agaucaaaaaggcuuauaaa

SEQ ID NO: 2657559 - RNA, 19 nt, Human
agaucaaaaaggcuuauaa

SEQ ID NO: 2657560 - RNA, 16 nt, Human
agaucaaaaaggcuua

SEQ ID NO: 2657561 - RNA, 22 nt, Human
agauaauauuaaggaagacaau

SEQ ID NO: 2657562 - RNA, 18 nt, Human
agauaauauuaaggaaga

SEQ ID NO: 2657563 - RNA, 14 nt, Human
agauaauauuguuu

SEQ ID NO: 2657564 - RNA, 17 nt, Human
agauaauauuguuuggu

SEQ ID NO: 2657565 - RNA, 20 nt, Human
agauaauauuguuugguaaa

SEQ ID NO: 2657566 - RNA, 20 nt, Human
agcaacuuuuguguaaugaa

SEQ ID NO: 2657567 - RNA, 15 nt, Human
agcaacuuuugugua

SEQ ID NO: 2657568 - RNA, 21 nt, Human
agcaacuucuucuccaucccu

SEQ ID NO: 2657569 - RNA, 15 nt, Human
agcaacuucuucucc

SEQ ID NO: 2657570 - RNA, 16 nt, Human
agcaacuucuucucca

SEQ ID NO: 2657571 - RNA, 18 nt, Human
agcaacuucuucuccauc

SEQ ID NO: 2657572 - RNA, 13 nt, Human
agcaacggcacag

SEQ ID NO: 2657573 - RNA, 23 nt, Human
agcaaaaaaaaaaaaaagcaucu

SEQ ID NO: 2657574 - RNA, 14 nt, Human
agcaaaaaagaguu

SEQ ID NO: 2657575 - RNA, 13 nt, Human
agauuuuugcaau

SEQ ID NO: 2657576 - RNA, 17 nt, Human
agauuuuuuaauuguuu

SEQ ID NO: 2657577 - RNA, 23 nt, Human
agauuuuuuaauuguuuaaaaac

SEQ ID NO: 2657578 - RNA, 14 nt, Human
agauuuuugcaaua

SEQ ID NO: 2657579 - RNA, 15 nt, Human
ugagaagguuuauug

SEQ ID NO: 2657580 - RNA, 16 nt, Human
ugagaagguuuauugu

SEQ ID NO: 2657581 - RNA, 17 nt, Human
ugagaagguuuauuguu

SEQ ID NO: 2657582 - RNA, 18 nt, Human
ugagaagguuuauuguua

SEQ ID NO: 2657583 - RNA, 19 nt, Human
ugagaagguuuauuguuaa

SEQ ID NO: 2657584 - RNA, 20 nt, Human
ugagaagguuuauuguuaau

SEQ ID NO: 2657585 - RNA, 18 nt, Human
ugagaagugaaugcuggg

SEQ ID NO: 2657586 - RNA, 19 nt, Human
ugagaagugaaugcuggga

SEQ ID NO: 2657587 - RNA, 21 nt, Human
ugagaagugaaugcugggacu

SEQ ID NO: 2657588 - RNA, 22 nt, Human
ugagaagugaaugcugggacuc

SEQ ID NO: 2657589 - RNA, 20 nt, Human
ugagaagcagaggaaggaga

SEQ ID NO: 2657590 - RNA, 18 nt, Human
agauucaugauuuauaaa

SEQ ID NO: 2657591 - RNA, 16 nt, Human
agauuucucauugacu

SEQ ID NO: 2657592 - RNA, 18 nt, Human
agauuucucauugacuuu

SEQ ID NO: 2657593 - RNA, 15 nt, Human
agauuucugaggaaa

SEQ ID NO: 2657594 - RNA, 14 nt, Human
agauuucugaggaa

SEQ ID NO: 2657595 - RNA, 22 nt, Human
agauuuucuuuugccuuuugca

SEQ ID NO: 2657596 - RNA, 19 nt, Human
agauuuuuaaaaaauauuu

SEQ ID NO: 2657597 - RNA, 21 nt, Human
agauuuuuaaaaaauauuuuc

SEQ ID NO: 2657598 - RNA, 16 nt, Human
agauguuuaaaacacc

SEQ ID NO: 2657599 - RNA, 15 nt, Human
agauguuuaaaacac

SEQ ID NO: 2657600 - RNA, 14 nt, Human
agauguuuaaaaca

SEQ ID NO: 2657601 - RNA, 17 nt, Human
agauguugccauguguu

SEQ ID NO: 2657602 - RNA, 18 nt, Human
agauguugccauguguuu

SEQ ID NO: 2657603 - RNA, 14 nt, Human
agauguuuccagac

SEQ ID NO: 2657604 - RNA, 23 nt, Human
agauguuuccagacuuccuugag

SEQ ID NO: 2657605 - RNA, 21 nt, Human
agauguuuccagacuuccuug

SEQ ID NO: 2657606 - RNA, 16 nt, Human
agauguugauuuuuac

SEQ ID NO: 2657607 - RNA, 22 nt, Human
agauguugauuuuuacuguguu

SEQ ID NO: 2657608 - RNA, 23 nt, Human
agauguugauuuuuacuguguuu

SEQ ID NO: 2657609 - RNA, 14 nt, Human
agauguugccaugu

SEQ ID NO: 2657610 - RNA, 16 nt, Human
agauuaaacuucauau

SEQ ID NO: 2657611 - RNA, 15 nt, Human
ugacccauugcuguu

SEQ ID NO: 2657612 - RNA, 14 nt, Human
ugacccauugcugu

SEQ ID NO: 2657613 - RNA, 13 nt, Human
ugacccauugcug

SEQ ID NO: 2657614 - RNA, 10 nt, Human
ugacacugaa

SEQ ID NO: 2657615 - RNA, 12 nt, Human
ugacacugaaag

SEQ ID NO: 2657616 - RNA, 18 nt, Human
ugacacugaaaguuuugu

SEQ ID NO: 2657617 - RNA, 19 nt, Human
ugacacugaaaguuuugua

SEQ ID NO: 2657618 - RNA, 20 nt, Human
ugacacugaaaguuuuguaa

SEQ ID NO: 2657619 - RNA, 22 nt, Human
ugacacugaaaguuuuguaaaa

SEQ ID NO: 2657620 - RNA, 14 nt, Human
ugacucaaagucug

SEQ ID NO: 2657621 - RNA, 16 nt, Human
ugacucgggggugggg

SEQ ID NO: 2657622 - RNA, 17 nt, Human
ugacucgggggugggga

SEQ ID NO: 2657623 - RNA, 17 nt, Human
ugaccugaggcuguggu

SEQ ID NO: 2657624 - RNA, 12 nt, Human
ugaccugaggcu

SEQ ID NO: 2657625 - RNA, 15 nt, Human
ugaccugaggcugug

SEQ ID NO: 2657626 - RNA, 16 nt, Human
ucuuuaaccuuguaua

SEQ ID NO: 2657627 - RNA, 17 nt, Human
ucuuuaaccuuguauaa

SEQ ID NO: 2657628 - RNA, 18 nt, Human
ucuuuaaccuuguauaaa

SEQ ID NO: 2657629 - RNA, 15 nt, Human
ucuuuaauaaauaac

SEQ ID NO: 2657630 - RNA, 12 nt, Human
ucuuuauuuugu

SEQ ID NO: 2657631 - RNA, 16 nt, Human
ucuuuauuuuguguaa

SEQ ID NO: 2657632 - RNA, 15 nt, Human
ucuuggcuuaaucau

SEQ ID NO: 2657633 - RNA, 16 nt, Human
ucuuggcuuaaucauu

SEQ ID NO: 2657634 - RNA, 18 nt, Human
ucuuggcuuaaucauuuu

SEQ ID NO: 2657635 - RNA, 19 nt, Human
ucuuggcuuaaucauuuuc

SEQ ID NO: 2657636 - RNA, 20 nt, Human
ucuuggcuuaaucauuuuca

SEQ ID NO: 2657637 - RNA, 21 nt, Human
ucuuggcuuaaucauuuucau

SEQ ID NO: 2657638 - RNA, 13 nt, Human
ucuuggccagcca

SEQ ID NO: 2657639 - RNA, 14 nt, Human
ucuuggccagccaa

SEQ ID NO: 2657640 - RNA, 23 nt, Human
ucuugggcagagcuggcucugag

SEQ ID NO: 2657641 - RNA, 13 nt, Human
ucuuggggcccag

SEQ ID NO: 2657642 - RNA, 17 nt, Human
ucuuggggcccagugca

SEQ ID NO: 2657643 - RNA, 18 nt, Human
ucuuggggcccagugcau

SEQ ID NO: 2657644 - RNA, 19 nt, Human
ucuugggcagagcuggcuc

SEQ ID NO: 2657645 - RNA, 20 nt, Human
ucuugggcagagcuggcucu

SEQ ID NO: 2657646 - RNA, 21 nt, Human
ucuugggcagagcuggcucug

SEQ ID NO: 2657647 - RNA, 20 nt, Human
ucuuggggggguggccgcug

SEQ ID NO: 2657648 - RNA, 19 nt, Human
ucuuggggggguggccgcu

SEQ ID NO: 2657649 - RNA, 18 nt, Human
agaccuuguuacuucuga

SEQ ID NO: 2657650 - RNA, 19 nt, Human
agaccuuguuacuucugag

SEQ ID NO: 2657651 - RNA, 21 nt, Human
agaccuuguuacuucugaggu

SEQ ID NO: 2657652 - RNA, 22 nt, Human
agaccuuguuacuucugaggua

SEQ ID NO: 2657653 - RNA, 20 nt, Human
agaccuggggcugcugugaa

SEQ ID NO: 2657654 - RNA, 23 nt, Human
ucuugagcuggccucucuagcac

SEQ ID NO: 2657655 - RNA, 17 nt, Human
ucuugagcuggccucuc

SEQ ID NO: 2657656 - RNA, 21 nt, Human
ucuugagcuggccucucuagc

SEQ ID NO: 2657657 - RNA, 12 nt, Human
ucuugagcuggc

SEQ ID NO: 2657658 - RNA, 13 nt, Human
ucuugagcuggcc

SEQ ID NO: 2657659 - RNA, 14 nt, Human
ucuugagcuggccu

SEQ ID NO: 2657660 - RNA, 13 nt, Human
ucuugaguuuguc

SEQ ID NO: 2657661 - RNA, 21 nt, Human
ucuugaguuguuuuuguauau

SEQ ID NO: 2657662 - RNA, 20 nt, Human
ucuugaguuguuuuuguaua

SEQ ID NO: 2657663 - RNA, 14 nt, Human
ucuugaguuugucg

SEQ ID NO: 2657664 - RNA, 15 nt, Human
ucuugauucagucac

SEQ ID NO: 2657665 - RNA, 17 nt, Human
ucuugauucagucacau

SEQ ID NO: 2657666 - RNA, 17 nt, Human
agacucagagcucucuc

SEQ ID NO: 2657667 - RNA, 18 nt, Human
agacucagagcucucucu

SEQ ID NO: 2657668 - RNA, 16 nt, Human
ucuugagccugggagg

SEQ ID NO: 2657669 - RNA, 13 nt, Human
ucuugagccuggg

SEQ ID NO: 2657670 - RNA, 12 nt, Human
ucuucaaccagu

SEQ ID NO: 2657671 - RNA, 13 nt, Human
ucuucccaugcau

SEQ ID NO: 2657672 - RNA, 17 nt, Human
ucuucccaugcauucug

SEQ ID NO: 2657673 - RNA, 22 nt, Human
ucuucccuacaguugaaaaaca

SEQ ID NO: 2657674 - RNA, 19 nt, Human
ucuucccuacaguugaaaa

SEQ ID NO: 2657675 - RNA, 22 nt, Human
agacauccaaauuuuuuuuuaa

SEQ ID NO: 2657676 - RNA, 19 nt, Human
agacaucugagguuuuauu

SEQ ID NO: 2657677 - RNA, 18 nt, Human
agacauguuuuccgugaa

SEQ ID NO: 2657678 - RNA, 21 nt, Human
agaccccggcuuccuuuccca

SEQ ID NO: 2657679 - RNA, 21 nt, Human
ucuucuguguuuauaaaauau

SEQ ID NO: 2657680 - RNA, 22 nt, Human
ucuucuguauuuuuuuuucuaa

SEQ ID NO: 2657681 - RNA, 14 nt, Human
ucuucuguauuuuu

SEQ ID NO: 2657682 - RNA, 22 nt, Human
ucuucugguacuuucuguuaug

SEQ ID NO: 2657683 - RNA, 22 nt, Human
ucuucuggggcaggcugggcca

SEQ ID NO: 2657684 - RNA, 21 nt, Human
ucuucucuuccuuuuaucagu

SEQ ID NO: 2657685 - RNA, 19 nt, Human
ucuucucuuccuuuuauca

SEQ ID NO: 2657686 - RNA, 14 nt, Human
ucuucucugugaga

SEQ ID NO: 2657687 - RNA, 18 nt, Human
ucuucucugugagaaggu

SEQ ID NO: 2657688 - RNA, 18 nt, Human
ucuucuggggcaggcugg

SEQ ID NO: 2657689 - RNA, 20 nt, Human
ucuucuggggcaggcugggc

SEQ ID NO: 2657690 - RNA, 21 nt, Human
ucuucuggggcaggcugggcc

SEQ ID NO: 2657691 - RNA, 16 nt, Human
agagagaacaggacua

SEQ ID NO: 2657692 - RNA, 19 nt, Human
agagaugggaaugaggugg

SEQ ID NO: 2657693 - RNA, 15 nt, Human
agagacgguguuuug

SEQ ID NO: 2657694 - RNA, 20 nt, Human
ugaaacuuguuucacugaaa

SEQ ID NO: 2657695 - RNA, 15 nt, Human
ugaaacuuugggaaa

SEQ ID NO: 2657696 - RNA, 16 nt, Human
ugaaacuuugggaaaa

SEQ ID NO: 2657697 - RNA, 19 nt, Human
ugaaacuuugggaaaacau

SEQ ID NO: 2657698 - RNA, 21 nt, Human
ugaaacuuugggaaaacaugu

SEQ ID NO: 2657699 - RNA, 22 nt, Human
ugaaacuuugggaaaacauguu

SEQ ID NO: 2657700 - RNA, 23 nt, Human
ugaaacuuugggaaaacauguua

SEQ ID NO: 2657701 - RNA, 15 nt, Human
ugaaacuuuucuaga

SEQ ID NO: 2657702 - RNA, 16 nt, Human
ugaaacuuuucuagaa

SEQ ID NO: 2657703 - RNA, 17 nt, Human
ugaaacuuuucuagaau

SEQ ID NO: 2657704 - RNA, 21 nt, Human
ugaaacuuuucuagaauuauu

SEQ ID NO: 2657705 - RNA, 23 nt, Human
ugaaacuuuucuagaauuauuuu

SEQ ID NO: 2657706 - RNA, 19 nt, Human
agagcagugguaagaauag

SEQ ID NO: 2657707 - RNA, 14 nt, Human
agagcauaauuuaa

SEQ ID NO: 2657708 - RNA, 18 nt, Human
agagcauaauuuaaaaau

SEQ ID NO: 2657709 - RNA, 20 nt, Human
agagcauaauuuaaaaauau

SEQ ID NO: 2657710 - RNA, 21 nt, Human
agagcauaauuuaaaaauaua

SEQ ID NO: 2657711 - RNA, 23 nt, Human
agagcauaauuuaaaaauauauu

SEQ ID NO: 2657712 - RNA, 16 nt, Human
agagcaucggccuagg

SEQ ID NO: 2657713 - RNA, 12 nt, Human
agagccagcuug

SEQ ID NO: 2657714 - RNA, 11 nt, Human
agagccagcuu

SEQ ID NO: 2657715 - RNA, 13 nt, Human
agagccagcuugg

SEQ ID NO: 2657716 - RNA, 13 nt, Human
agagcucucucua

SEQ ID NO: 2657717 - RNA, 14 nt, Human
agagcucucucuac

SEQ ID NO: 2657718 - RNA, 22 nt, Human
agagcucucucuacagagagga

SEQ ID NO: 2657719 - RNA, 17 nt, Human
agagcuaucaggagaaa

SEQ ID NO: 2657720 - RNA, 14 nt, Human
agagcuauugccaa

SEQ ID NO: 2657721 - RNA, 20 nt, Human
agagcuagcagcagggaggg

SEQ ID NO: 2657722 - RNA, 13 nt, Human
ucuuuuaaagacc

SEQ ID NO: 2657723 - RNA, 18 nt, Human
ucuuuuaaagacccuccu

SEQ ID NO: 2657724 - RNA, 21 nt, Human
ucuuuuaaugaggaccaaugu

SEQ ID NO: 2657725 - RNA, 20 nt, Human
ucuuuuaauuguuucagaau

SEQ ID NO: 2657726 - RNA, 16 nt, Human
ucuuuguucauagccc

SEQ ID NO: 2657727 - RNA, 23 nt, Human
ucuuuguucauagcccaguagac

SEQ ID NO: 2657728 - RNA, 16 nt, Human
ugaaaaaggaggaaga

SEQ ID NO: 2657729 - RNA, 13 nt, Human
ugaaaaacugagu

SEQ ID NO: 2657730 - RNA, 17 nt, Human
ucuuugguguacagacu

SEQ ID NO: 2657731 - RNA, 24 nt, Human
agagacaucuuugggccugucccu

SEQ ID NO: 2657732 - RNA, 12 nt, Human
agagacaggcag

SEQ ID NO: 2657733 - RNA, 22 nt, Human
agagacaggcaggugaucugcu

SEQ ID NO: 2657734 - RNA, 13 nt, Human
agagacaggcagg

SEQ ID NO: 2657735 - RNA, 20 nt, Human
ugaaaaguaauauuuauuaa

SEQ ID NO: 2657736 - RNA, 19 nt, Human
ugaaaaguaauauuuauua

SEQ ID NO: 2657737 - RNA, 18 nt, Human
ugaaaaguaauauuuauu

SEQ ID NO: 2657738 - RNA, 23 nt, Human
ugaaaauaguuuauuuuaaaaca

SEQ ID NO: 2657739 - RNA, 22 nt, Human
ugaaaauaguuuauuuuaaaac

SEQ ID NO: 2657740 - RNA, 21 nt, Human
ugaaaaguaauauuuauuaaa

SEQ ID NO: 2657741 - RNA, 20 nt, Human
ugaaaauaguuuauuuuaaa

SEQ ID NO: 2657742 - RNA, 14 nt, Human
ugaaaaguguguau

SEQ ID NO: 2657743 - RNA, 18 nt, Human
ugaaaaguguguauauau

SEQ ID NO: 2657744 - RNA, 19 nt, Human
ugaaaaguguguauauauu

SEQ ID NO: 2657745 - RNA, 16 nt, Human
ugaaaauauuguuuua

SEQ ID NO: 2657746 - RNA, 23 nt, Human
ugaaaauauuguuuuacaauagu

SEQ ID NO: 2657747 - RNA, 20 nt, Human
ugaaaauauuguuuuacaau

SEQ ID NO: 2657748 - RNA, 18 nt, Human
ugaaaaaucggcuuacca

SEQ ID NO: 2657749 - RNA, 23 nt, Human
ugaaaaaucuguugauaaaucca

SEQ ID NO: 2657750 - RNA, 12 nt, Human
ugaaaaauauaa

SEQ ID NO: 2657751 - RNA, 13 nt, Human
ugaaaaauauaaa

SEQ ID NO: 2657752 - RNA, 17 nt, Human
ugaaaaauauaaaauua

SEQ ID NO: 2657753 - RNA, 19 nt, Human
ugaaaaauauaaaauuaug

SEQ ID NO: 2657754 - RNA, 20 nt, Human
ugaaaaauauaaaauuauga

SEQ ID NO: 2657755 - RNA, 22 nt, Human
ugaaaaauauaaaauuaugaga

SEQ ID NO: 2657756 - RNA, 22 nt, Human
ugaaaaaggaggaagagaaaaa

SEQ ID NO: 2657757 - RNA, 20 nt, Human
ugaaaaaggaggaagagaaa

SEQ ID NO: 2657758 - RNA, 21 nt, Human
ugaaacuauauuuugucauau

SEQ ID NO: 2657759 - RNA, 19 nt, Human
ugaaacuauauuuugucau

SEQ ID NO: 2657760 - RNA, 13 nt, Human
ugaaacuauauuu

SEQ ID NO: 2657761 - RNA, 14 nt, Human
ugaaacuaaagcaa

SEQ ID NO: 2657762 - RNA, 19 nt, Human
ugaaacuaaagcaauagaa

SEQ ID NO: 2657763 - RNA, 20 nt, Human
ugaaacuaaagcaauagaaa

SEQ ID NO: 2657764 - RNA, 22 nt, Human
ugaaacuaaagcaauagaaaca

SEQ ID NO: 2657765 - RNA, 16 nt, Human
ugaaaauguccaggaa

SEQ ID NO: 2657766 - RNA, 20 nt, Human
ugaaaauguccaggaaagug

SEQ ID NO: 2657767 - RNA, 18 nt, Human
ugauacuauccaguuacu

SEQ ID NO: 2657768 - RNA, 13 nt, Human
ugauacugauggu

SEQ ID NO: 2657769 - RNA, 18 nt, Human
ugauacuggaggaacacu

SEQ ID NO: 2657770 - RNA, 17 nt, Human
ugauauuacauuuauuu

SEQ ID NO: 2657771 - RNA, 22 nt, Human
ugauauuacauuuauuuaucca

SEQ ID NO: 2657772 - RNA, 21 nt, Human
ugauauuccccccacuuaaga

SEQ ID NO: 2657773 - RNA, 19 nt, Human
ugaucaaaaucaauuaaaa

SEQ ID NO: 2657774 - RNA, 17 nt, Human
agcaucaaaauauuuca

SEQ ID NO: 2657775 - RNA, 22 nt, Human
agcauuguaagcguauggcuuu

SEQ ID NO: 2657776 - RNA, 20 nt, Human
agcauuaagcuguuccuguu

SEQ ID NO: 2657777 - RNA, 21 nt, Human
ugaguaaaauagauuuuauaa

SEQ ID NO: 2657778 - RNA, 22 nt, Human
ugagguuuuauuucauuuuuca

SEQ ID NO: 2657779 - RNA, 20 nt, Human
agcauauggguuagauguug

SEQ ID NO: 2657780 - RNA, 17 nt, Human
ugaguagaguugaucaa

SEQ ID NO: 2657781 - RNA, 14 nt, Human
ugaguagaguugau

SEQ ID NO: 2657782 - RNA, 16 nt, Human
agcauaauuuaaaaau

SEQ ID NO: 2657783 - RNA, 17 nt, Human
agcauaauuuaaaaaua

SEQ ID NO: 2657784 - RNA, 18 nt, Human
agcauaauuuaaaaauau

SEQ ID NO: 2657785 - RNA, 21 nt, Human
agcauacuggcuucaccauca

SEQ ID NO: 2657786 - RNA, 15 nt, Human
agcauacuucuagga

SEQ ID NO: 2657787 - RNA, 13 nt, Human
agcauacuuugua

SEQ ID NO: 2657788 - RNA, 14 nt, Human
agcauacuuuguaa

SEQ ID NO: 2657789 - RNA, 14 nt, Human
ugaguguaugagua

SEQ ID NO: 2657790 - RNA, 18 nt, Human
ugaguguaugaguagcca

SEQ ID NO: 2657791 - RNA, 21 nt, Human
ugagugggugaauaauacagu

SEQ ID NO: 2657792 - RNA, 23 nt, Human
ugagugggggaucacagccucug

SEQ ID NO: 2657793 - RNA, 12 nt, Human
ugaguauuguuu

SEQ ID NO: 2657794 - RNA, 15 nt, Human
ugaguauuguuuaaa

SEQ ID NO: 2657795 - RNA, 19 nt, Human
ugaguauuguuuaaaaugu

SEQ ID NO: 2657796 - RNA, 21 nt, Human
ugaguauuguuuaaaauguaa

SEQ ID NO: 2657797 - RNA, 23 nt, Human
ugaguauuguuuaaaauguaauu

SEQ ID NO: 2657798 - RNA, 19 nt, Human
ugaguagauccauuuccau

SEQ ID NO: 2657799 - RNA, 21 nt, Human
ugaguagauccauuuccauug

SEQ ID NO: 2657800 - RNA, 17 nt, Human
ugaugacaauaaagcuu

SEQ ID NO: 2657801 - RNA, 18 nt, Human
ugaugacaaaaaauguuu

SEQ ID NO: 2657802 - RNA, 20 nt, Human
ugaugacaaaaaauguuuua

SEQ ID NO: 2657803 - RNA, 17 nt, Human
ugaugauacaaugaaca

SEQ ID NO: 2657804 - RNA, 13 nt, Human
ugauguuuguccu

SEQ ID NO: 2657805 - RNA, 15 nt, Human
ugauuaaaaauauca

SEQ ID NO: 2657806 - RNA, 20 nt, Human
ugauuaaaaauaucaaauua

SEQ ID NO: 2657807 - RNA, 19 nt, Human
ugauuaaaaauaucaaauu

SEQ ID NO: 2657808 - RNA, 22 nt, Human
ugauuaaaaauaucaaauuaau

SEQ ID NO: 2657809 - RNA, 20 nt, Human
ugaugauccuaggcauuugc

SEQ ID NO: 2657810 - RNA, 13 nt, Human
ugaugagguauuu

SEQ ID NO: 2657811 - RNA, 16 nt, Human
ugaugagguauuuuuu

SEQ ID NO: 2657812 - RNA, 19 nt, Human
ugaugagguauuuuuuccu

SEQ ID NO: 2657813 - RNA, 22 nt, Human
ugaugagguauuuuuuccuuuu

SEQ ID NO: 2657814 - RNA, 14 nt, Human
ugaugauccuaggc

SEQ ID NO: 2657815 - RNA, 13 nt, Human
agcccagcccucc

SEQ ID NO: 2657816 - RNA, 12 nt, Human
agcccagagacu

SEQ ID NO: 2657817 - RNA, 20 nt, Human
agcccagagacuuuguagau

SEQ ID NO: 2657818 - RNA, 17 nt, Human
ugauuccuuuuuucaaa

SEQ ID NO: 2657819 - RNA, 19 nt, Human
ugauuccacuacaccuggc

SEQ ID NO: 2657820 - RNA, 20 nt, Human
ugauuccacuacaccuggcu

SEQ ID NO: 2657821 - RNA, 21 nt, Human
ugauuccacuacaccuggcug

SEQ ID NO: 2657822 - RNA, 22 nt, Human
ugauuccacuacaccuggcuga

SEQ ID NO: 2657823 - RNA, 23 nt, Human
ugauuccacuacaccuggcugag

SEQ ID NO: 2657824 - RNA, 14 nt, Human
ugauucagcucugc

SEQ ID NO: 2657825 - RNA, 13 nt, Human
ugauucagcucug

SEQ ID NO: 2657826 - RNA, 13 nt, Human
ugauucagucaca

SEQ ID NO: 2657827 - RNA, 14 nt, Human
ugauucagucacau

SEQ ID NO: 2657828 - RNA, 15 nt, Human
ugauucagucacaug

SEQ ID NO: 2657829 - RNA, 15 nt, Human
agccagaccagauua

SEQ ID NO: 2657830 - RNA, 12 nt, Human
agccagcuuggg

SEQ ID NO: 2657831 - RNA, 15 nt, Human
agccaggcucacuca

SEQ ID NO: 2657832 - RNA, 18 nt, Human
agccaggcucacucacag

SEQ ID NO: 2657833 - RNA, 13 nt, Human
agccauaaaugau

SEQ ID NO: 2657834 - RNA, 16 nt, Human
agccauacauaaaaga

SEQ ID NO: 2657835 - RNA, 17 nt, Human
agccauacauaaaagaa

SEQ ID NO: 2657836 - RNA, 18 nt, Human
agccauacauaaaagaaa

SEQ ID NO: 2657837 - RNA, 21 nt, Human
agccauacauaaaagaaauaa

SEQ ID NO: 2657838 - RNA, 22 nt, Human
agccauacauaaaagaaauaaa

SEQ ID NO: 2657839 - RNA, 23 nt, Human
agccauacauaaaagaaauaaac

SEQ ID NO: 2657840 - RNA, 17 nt, Human
agccuagcacagcagcu

SEQ ID NO: 2657841 - RNA, 16 nt, Human
agccucuuuuugauac

SEQ ID NO: 2657842 - RNA, 17 nt, Human
ugcaguccuacucaagc

SEQ ID NO: 2657843 - RNA, 22 nt, Human
agccgagacucgacucugugcc

SEQ ID NO: 2657844 - RNA, 13 nt, Human
agccuacucuccu

SEQ ID NO: 2657845 - RNA, 14 nt, Human
agccuacucuccuu

SEQ ID NO: 2657846 - RNA, 19 nt, Human
agccuagaagagcuucuga

SEQ ID NO: 2657847 - RNA, 17 nt, Human
agccuagaagagcuucu

SEQ ID NO: 2657848 - RNA, 14 nt, Human
agcccauccugacc

SEQ ID NO: 2657849 - RNA, 15 nt, Human
agcccauccugacca

SEQ ID NO: 2657850 - RNA, 16 nt, Human
agcccauccugaccag

SEQ ID NO: 2657851 - RNA, 23 nt, Human
agcccauccugaccagcugcucc

SEQ ID NO: 2657852 - RNA, 17 nt, Human
agcccauccugaccagc

SEQ ID NO: 2657853 - RNA, 18 nt, Human
agcccaucgccacaaacu

SEQ ID NO: 2657854 - RNA, 19 nt, Human
agcccaucgccacaaacuc

SEQ ID NO: 2657855 - RNA, 15 nt, Human
agcccaguagaccuu

SEQ ID NO: 2657856 - RNA, 18 nt, Human
agcccaguagaccuuguu

SEQ ID NO: 2657857 - RNA, 13 nt, Human
ugcacccagaaca

SEQ ID NO: 2657858 - RNA, 14 nt, Human
ugcacccagaacag

SEQ ID NO: 2657859 - RNA, 17 nt, Human
ugcacccagaacagugg

SEQ ID NO: 2657860 - RNA, 18 nt, Human
ugcacccacccaggagug

SEQ ID NO: 2657861 - RNA, 17 nt, Human
ugcacccacccaggagu

SEQ ID NO: 2657862 - RNA, 22 nt, Human
ugcacaccuacuagucaccaga

SEQ ID NO: 2657863 - RNA, 20 nt, Human
ugcacaccuacuagucacca

SEQ ID NO: 2657864 - RNA, 17 nt, Human
ugcacccucaggcaggu

SEQ ID NO: 2657865 - RNA, 16 nt, Human
ugcacccucaggcagg

SEQ ID NO: 2657866 - RNA, 15 nt, Human
ugcaccccuucucuc

SEQ ID NO: 2657867 - RNA, 19 nt, Human
ugcaccccuucucuccucc

SEQ ID NO: 2657868 - RNA, 20 nt, Human
ugcaccccuucucuccuccc

SEQ ID NO: 2657869 - RNA, 21 nt, Human
ugcacaagcugcacccucagg

SEQ ID NO: 2657870 - RNA, 18 nt, Human
ugcacaagcugcacccuc

SEQ ID NO: 2657871 - RNA, 15 nt, Human
ugcacaagcugcacc

SEQ ID NO: 2657872 - RNA, 14 nt, Human
agcgggggaggccc

SEQ ID NO: 2657873 - RNA, 20 nt, Human
agcgggggaggcccgcagag

SEQ ID NO: 2657874 - RNA, 16 nt, Human
agcuaccucaaacuuc

SEQ ID NO: 2657875 - RNA, 18 nt, Human
agcuacuugggaggcuga

SEQ ID NO: 2657876 - RNA, 17 nt, Human
agcuacuugggaggcug

SEQ ID NO: 2657877 - RNA, 21 nt, Human
agcuacuugggaggcugaggc

SEQ ID NO: 2657878 - RNA, 16 nt, Human
agcuagcucaacuagu

SEQ ID NO: 2657879 - RNA, 15 nt, Human
agcuagcucaacuag

SEQ ID NO: 2657880 - RNA, 20 nt, Human
ugcccaagccagaggcuggg

SEQ ID NO: 2657881 - RNA, 16 nt, Human
ugcccaagccagaggc

SEQ ID NO: 2657882 - RNA, 18 nt, Human
ugcccaagccagaggcug

SEQ ID NO: 2657883 - RNA, 16 nt, Human
agcucauuaaacuuuu

SEQ ID NO: 2657884 - RNA, 18 nt, Human
agcucauuaaacuuuuuu

SEQ ID NO: 2657885 - RNA, 19 nt, Human
agcucauuaaacuuuuuua

SEQ ID NO: 2657886 - RNA, 21 nt, Human
agcucauuaaacuuuuuuaac

SEQ ID NO: 2657887 - RNA, 11 nt, Human
ugcccaagcca

SEQ ID NO: 2657888 - RNA, 13 nt, Human
ugcccaagccaga

SEQ ID NO: 2657889 - RNA, 14 nt, Human
ugcccaagccagag

SEQ ID NO: 2657890 - RNA, 15 nt, Human
ugcccaagccagagg

SEQ ID NO: 2657891 - RNA, 22 nt, Human
agcgccuccauccaaggccagg

SEQ ID NO: 2657892 - RNA, 18 nt, Human
agcgccuccauccaaggc

SEQ ID NO: 2657893 - RNA, 20 nt, Human
agcgccuccauccaaggcca

SEQ ID NO: 2657894 - RNA, 23 nt, Human
agcgccuccauccaaggccaggu

SEQ ID NO: 2657895 - RNA, 12 nt, Human
agcgccucccuc

SEQ ID NO: 2657896 - RNA, 13 nt, Human
agcgccucccucc

SEQ ID NO: 2657897 - RNA, 14 nt, Human
agcgccucccucca

SEQ ID NO: 2657898 - RNA, 15 nt, Human
agcgccucccuccac

SEQ ID NO: 2657899 - RNA, 18 nt, Human
agcgccucccuccacccc

SEQ ID NO: 2657900 - RNA, 19 nt, Human
agcgccucccuccacccca

SEQ ID NO: 2657901 - RNA, 20 nt, Human
agcgccucccuccaccccag

SEQ ID NO: 2657902 - RNA, 21 nt, Human
agcgccucccuccaccccagg

SEQ ID NO: 2657903 - RNA, 22 nt, Human
agcgccucccuccaccccagga

SEQ ID NO: 2657904 - RNA, 23 nt, Human
agcgccucccuccaccccaggac

SEQ ID NO: 2657905 - RNA, 14 nt, Human
agcggaggugugga

SEQ ID NO: 2657906 - RNA, 23 nt, Human
ugccaagucauagccauaaauga

SEQ ID NO: 2657907 - RNA, 12 nt, Human
ugcauugaagau

SEQ ID NO: 2657908 - RNA, 17 nt, Human
agccugcuccagcuguu

SEQ ID NO: 2657909 - RNA, 16 nt, Human
agccugcuccagcugu

SEQ ID NO: 2657910 - RNA, 15 nt, Human
agccugcuccagcug

SEQ ID NO: 2657911 - RNA, 14 nt, Human
agccugcuccagcu

SEQ ID NO: 2657912 - RNA, 22 nt, Human
agccugcuccagcuguucagcu

SEQ ID NO: 2657913 - RNA, 19 nt, Human
agccugcuccagcuguuca

SEQ ID NO: 2657914 - RNA, 22 nt, Human
agccugggugacagagcaagug

SEQ ID NO: 2657915 - RNA, 14 nt, Human
agccuucagcucca

SEQ ID NO: 2657916 - RNA, 20 nt, Human
agccuucaaaacuauagcuu

SEQ ID NO: 2657917 - RNA, 21 nt, Human
agccuucaaaacuauagcuug

SEQ ID NO: 2657918 - RNA, 22 nt, Human
agccuucaaaacuauagcuugc

SEQ ID NO: 2657919 - RNA, 16 nt, Human
agccuggugcugcugc

SEQ ID NO: 2657920 - RNA, 15 nt, Human
agccuggugcugcug

SEQ ID NO: 2657921 - RNA, 14 nt, Human
agccuggugcugcu

SEQ ID NO: 2657922 - RNA, 17 nt, Human
aggcaauaaaaaucaua

SEQ ID NO: 2657923 - RNA, 22 nt, Human
aggcaaugauuguuaauuuaca

SEQ ID NO: 2657924 - RNA, 14 nt, Human
aggcaauaaaaauc

SEQ ID NO: 2657925 - RNA, 23 nt, Human
uggagcggaauuuaccugauuuc

SEQ ID NO: 2657926 - RNA, 15 nt, Human
uggagaacucuggcu

SEQ ID NO: 2657927 - RNA, 22 nt, Human
uggagaagcggcuggcagccca

SEQ ID NO: 2657928 - RNA, 13 nt, Human
uggagaagcggcu

SEQ ID NO: 2657929 - RNA, 13 nt, Human
uggagccccaggg

SEQ ID NO: 2657930 - RNA, 16 nt, Human
uggacacacacagacu

SEQ ID NO: 2657931 - RNA, 17 nt, Human
aggcaaagaaaaugaaa

SEQ ID NO: 2657932 - RNA, 14 nt, Human
aggcaaagcuggcu

SEQ ID NO: 2657933 - RNA, 18 nt, Human
aggaucucuugagccugg

SEQ ID NO: 2657934 - RNA, 17 nt, Human
aggaucucuugagccug

SEQ ID NO: 2657935 - RNA, 19 nt, Human
aggaucucuugagccuggg

SEQ ID NO: 2657936 - RNA, 12 nt, Human
aggaucucuuga

SEQ ID NO: 2657937 - RNA, 20 nt, Human
uggacacacacagacuauuu

SEQ ID NO: 2657938 - RNA, 23 nt, Human
uggacccuguggaugauaaaaca

SEQ ID NO: 2657939 - RNA, 21 nt, Human
uggaccuuaggccuuccucuc

SEQ ID NO: 2657940 - RNA, 19 nt, Human
uggaccuuaggccuuccuc

SEQ ID NO: 2657941 - RNA, 17 nt, Human
uggaccuuaggccuucc

SEQ ID NO: 2657942 - RNA, 16 nt, Human
uggaccuuaggccuuc

SEQ ID NO: 2657943 - RNA, 15 nt, Human
uggaccuuaggccuu

SEQ ID NO: 2657944 - RNA, 23 nt, Human
uggaccuguauauuuguaaagcu

SEQ ID NO: 2657945 - RNA, 19 nt, Human
uggaaaguaacucauuugu

SEQ ID NO: 2657946 - RNA, 23 nt, Human
uggaaaggggagagccugcuggc

SEQ ID NO: 2657947 - RNA, 13 nt, Human
uggaaaggggaga

SEQ ID NO: 2657948 - RNA, 14 nt, Human
uggaaaggggagag

SEQ ID NO: 2657949 - RNA, 15 nt, Human
uggaaaggggagagc

SEQ ID NO: 2657950 - RNA, 17 nt, Human
uggaaaggggagagccu

SEQ ID NO: 2657951 - RNA, 19 nt, Human
uggaaaggggagagccugc

SEQ ID NO: 2657952 - RNA, 21 nt, Human
uggaaaggggagagccugcug

SEQ ID NO: 2657953 - RNA, 22 nt, Human
uggaaaggggagagccugcugg

SEQ ID NO: 2657954 - RNA, 16 nt, Human
ugcuuuucugcccugg

SEQ ID NO: 2657955 - RNA, 18 nt, Human
ugcuuuucugcccuggcu

SEQ ID NO: 2657956 - RNA, 15 nt, Human
ugcuuuucugcccug

SEQ ID NO: 2657957 - RNA, 17 nt, Human
ugcuuuucuguauuuua

SEQ ID NO: 2657958 - RNA, 19 nt, Human
ugcuuuuggcaaaacucua

SEQ ID NO: 2657959 - RNA, 21 nt, Human
ugcuuuuggcaaaacucuacu

SEQ ID NO: 2657960 - RNA, 15 nt, Human
ugcuugucuucuggu

SEQ ID NO: 2657961 - RNA, 20 nt, Human
ugcuugucuucugguacuuu

SEQ ID NO: 2657962 - RNA, 17 nt, Human
ugcuuggaacauacugu

SEQ ID NO: 2657963 - RNA, 22 nt, Human
ugcuuggaacauacuguucacu

SEQ ID NO: 2657964 - RNA, 21 nt, Human
ugcuugaggcaacucaucuua

SEQ ID NO: 2657965 - RNA, 16 nt, Human
aggauccccuccaagc

SEQ ID NO: 2657966 - RNA, 18 nt, Human
aggauccccuccaagccu

SEQ ID NO: 2657967 - RNA, 19 nt, Human
uggaaggcaagccaggcuc

SEQ ID NO: 2657968 - RNA, 23 nt, Human
uggaagcacaccaaucuuacuuu

SEQ ID NO: 2657969 - RNA, 22 nt, Human
uggaagcacaccaaucuuacuu

SEQ ID NO: 2657970 - RNA, 21 nt, Human
uggaagcacaccaaucuuacu

SEQ ID NO: 2657971 - RNA, 13 nt, Human
uggaagauccugc

SEQ ID NO: 2657972 - RNA, 21 nt, Human
uggaagauccugcgggugggg

SEQ ID NO: 2657973 - RNA, 17 nt, Human
uggaagaucauuuugaa

SEQ ID NO: 2657974 - RNA, 16 nt, Human
uggaaaucagccaagu

SEQ ID NO: 2657975 - RNA, 18 nt, Human
uggaaaucagccaaguuu

SEQ ID NO: 2657976 - RNA, 20 nt, Human
uggaaaucagccaaguuuua

SEQ ID NO: 2657977 - RNA, 15 nt, Human
uggaaaguaacugug

SEQ ID NO: 2657978 - RNA, 12 nt, Human
uggcccugggcg

SEQ ID NO: 2657979 - RNA, 21 nt, Human
uggcccugggcggggcguggg

SEQ ID NO: 2657980 - RNA, 23 nt, Human
uggccgggcgcgguggcucacgc

SEQ ID NO: 2657981 - RNA, 13 nt, Human
uggcccacgcacu

SEQ ID NO: 2657982 - RNA, 14 nt, Human
uggccauguaugaa

SEQ ID NO: 2657983 - RNA, 12 nt, Human
uggcccaaggcu

SEQ ID NO: 2657984 - RNA, 16 nt, Human
uggcccaaggcuggca

SEQ ID NO: 2657985 - RNA, 17 nt, Human
uggcccaaggcuggcag

SEQ ID NO: 2657986 - RNA, 18 nt, Human
uggcccaaggcuggcagg

SEQ ID NO: 2657987 - RNA, 23 nt, Human
uggcccaaggcuggcaggucaac

SEQ ID NO: 2657988 - RNA, 19 nt, Human
aggccugggccgcugccac

SEQ ID NO: 2657989 - RNA, 20 nt, Human
aggccugggccgcugccacg

SEQ ID NO: 2657990 - RNA, 21 nt, Human
aggccugggccgcugccacgu

SEQ ID NO: 2657991 - RNA, 15 nt, Human
uggccuuaauuuccu

SEQ ID NO: 2657992 - RNA, 16 nt, Human
uggccuuaauuuccuu

SEQ ID NO: 2657993 - RNA, 12 nt, Human
aggccuggggac

SEQ ID NO: 2657994 - RNA, 14 nt, Human
uggcccuggcugcc

SEQ ID NO: 2657995 - RNA, 21 nt, Human
uggccuaaaccucaguuauua

SEQ ID NO: 2657996 - RNA, 21 nt, Human
uggccaguccacccugccugc

SEQ ID NO: 2657997 - RNA, 22 nt, Human
uggccaguccacccugccugcc

SEQ ID NO: 2657998 - RNA, 14 nt, Human
uggccaguccaggc

SEQ ID NO: 2657999 - RNA, 15 nt, Human
uggccaguccaggcu

SEQ ID NO: 2658000 - RNA, 13 nt, Human
uggccacagcgcc

SEQ ID NO: 2658001 - RNA, 18 nt, Human
uggccacagcgccagccu

SEQ ID NO: 2658002 - RNA, 20 nt, Human
uggccacagcgccagccuca

SEQ ID NO: 2658003 - RNA, 16 nt, Human
uggccacauggcggag

SEQ ID NO: 2658004 - RNA, 21 nt, Human
uggcaucgcaccauucugacu

SEQ ID NO: 2658005 - RNA, 22 nt, Human
uggcaucgcaccauucugacuc

SEQ ID NO: 2658006 - RNA, 23 nt, Human
uggcaucgcaccauucugacucg

SEQ ID NO: 2658007 - RNA, 20 nt, Human
uggcaucuuagaccuccaca

SEQ ID NO: 2658008 - RNA, 18 nt, Human
aggccagaggcccccagc

SEQ ID NO: 2658009 - RNA, 22 nt, Human
aggccagaggcccccagcccag

SEQ ID NO: 2658010 - RNA, 10 nt, Human
aggccagccu

SEQ ID NO: 2658011 - RNA, 23 nt, Human
aggccagccuccgagagggagag

SEQ ID NO: 2658012 - RNA, 18 nt, Human
aggccagccuccgagagg

SEQ ID NO: 2658013 - RNA, 22 nt, Human
aggccagccuccgagagggaga

SEQ ID NO: 2658014 - RNA, 11 nt, Human
aggccagccuc

SEQ ID NO: 2658015 - RNA, 13 nt, Human
aggccagccuccg

SEQ ID NO: 2658016 - RNA, 14 nt, Human
aggccagccuccga

SEQ ID NO: 2658017 - RNA, 17 nt, Human
aggccagccuccgagag

SEQ ID NO: 2658018 - RNA, 13 nt, Human
aggcccauagcag

SEQ ID NO: 2658019 - RNA, 19 nt, Human
uggcaaugacucaaagucu

SEQ ID NO: 2658020 - RNA, 16 nt, Human
uggcaauuuaacaugu

SEQ ID NO: 2658021 - RNA, 21 nt, Human
uggcaaugguaguuucugugg

SEQ ID NO: 2658022 - RNA, 19 nt, Human
uggcaaugguaguuucugu

SEQ ID NO: 2658023 - RNA, 18 nt, Human
uggcaaugguaguuucug

SEQ ID NO: 2658024 - RNA, 17 nt, Human
uggcaaugguaguuucu

SEQ ID NO: 2658025 - RNA, 16 nt, Human
uggcaaugguaguuuc

SEQ ID NO: 2658026 - RNA, 16 nt, Human
aggccaaggugggagg

SEQ ID NO: 2658027 - RNA, 14 nt, Human
uggagggguguggc

SEQ ID NO: 2658028 - RNA, 11 nt, Human
uggaggggugu

SEQ ID NO: 2658029 - RNA, 17 nt, Human
uggagggguguggcagu

SEQ ID NO: 2658030 - RNA, 18 nt, Human
uggagggguguggcagug

SEQ ID NO: 2658031 - RNA, 19 nt, Human
uggagggguguggcagugg

SEQ ID NO: 2658032 - RNA, 14 nt, Human
uggauuaaauacau

SEQ ID NO: 2658033 - RNA, 15 nt, Human
uggauuaaauacaua

SEQ ID NO: 2658034 - RNA, 21 nt, Human
uggauuaaauacauauggaug

SEQ ID NO: 2658035 - RNA, 15 nt, Human
uggagguugaagcca

SEQ ID NO: 2658036 - RNA, 17 nt, Human
uggagguugaagccaag

SEQ ID NO: 2658037 - RNA, 18 nt, Human
uggagguugaagccaagu

SEQ ID NO: 2658038 - RNA, 22 nt, Human
uggagguugaagccaagugggg

SEQ ID NO: 2658039 - RNA, 23 nt, Human
uggauggcuugucuauacuccuu

SEQ ID NO: 2658040 - RNA, 21 nt, Human
uggauggccccagcacagcuu

SEQ ID NO: 2658041 - RNA, 14 nt, Human
uggauggccccagc

SEQ ID NO: 2658042 - RNA, 15 nt, Human
uggauggccccagca

SEQ ID NO: 2658043 - RNA, 16 nt, Human
uggauggccccagcac

SEQ ID NO: 2658044 - RNA, 17 nt, Human
uggauggccccagcaca

SEQ ID NO: 2658045 - RNA, 18 nt, Human
uggauggccccagcacag

SEQ ID NO: 2658046 - RNA, 23 nt, Human
agcuggcucugagcgccuccauc

SEQ ID NO: 2658047 - RNA, 13 nt, Human
agcuggcucugag

SEQ ID NO: 2658048 - RNA, 14 nt, Human
agcuggcucugagc

SEQ ID NO: 2658049 - RNA, 19 nt, Human
agcuggcucugagcgccuc

SEQ ID NO: 2658050 - RNA, 20 nt, Human
agcuggcucugagcgccucc

SEQ ID NO: 2658051 - RNA, 14 nt, Human
agcugucccuugcu

SEQ ID NO: 2658052 - RNA, 18 nt, Human
agcugucacaacuugugu

SEQ ID NO: 2658053 - RNA, 15 nt, Human
agcugcccuuccgca

SEQ ID NO: 2658054 - RNA, 20 nt, Human
agcuggcuuacacuggcaau

SEQ ID NO: 2658055 - RNA, 15 nt, Human
agcugucacaacuug

SEQ ID NO: 2658056 - RNA, 14 nt, Human
agcuguucagcugg

SEQ ID NO: 2658057 - RNA, 13 nt, Human
agcuguucagcug

SEQ ID NO: 2658058 - RNA, 19 nt, Human
ugccuuaaacacucaccuu

SEQ ID NO: 2658059 - RNA, 22 nt, Human
ugccuuaaacacucaccuucua

SEQ ID NO: 2658060 - RNA, 15 nt, Human
ugccuuaaaaccaaa

SEQ ID NO: 2658061 - RNA, 16 nt, Human
ugccuguuucugauuu

SEQ ID NO: 2658062 - RNA, 16 nt, Human
ugccuuaaaaccaaag

SEQ ID NO: 2658063 - RNA, 18 nt, Human
ugccuuaaaaccaaagag

SEQ ID NO: 2658064 - RNA, 20 nt, Human
ugccuuaaaaccaaagaggg

SEQ ID NO: 2658065 - RNA, 22 nt, Human
ugccuuaaaaccaaagagggcu

SEQ ID NO: 2658066 - RNA, 20 nt, Human
ugccuggagacuuagggcac

SEQ ID NO: 2658067 - RNA, 23 nt, Human
ugccuggaguguaugacugcaca

SEQ ID NO: 2658068 - RNA, 17 nt, Human
ugccugccccgccccca

SEQ ID NO: 2658069 - RNA, 12 nt, Human
ugccugccccgc

SEQ ID NO: 2658070 - RNA, 16 nt, Human
agcucaucugcaaaag

SEQ ID NO: 2658071 - RNA, 12 nt, Human
ugcuacaauguc

SEQ ID NO: 2658072 - RNA, 14 nt, Human
ugcuacaauuuuaa

SEQ ID NO: 2658073 - RNA, 16 nt, Human
agcuguuccuguucag

SEQ ID NO: 2658074 - RNA, 18 nt, Human
agcuguuccuguucagua

SEQ ID NO: 2658075 - RNA, 19 nt, Human
agcuguuccuguucaguaa

SEQ ID NO: 2658076 - RNA, 20 nt, Human
agcuguuccuugguccuagu

SEQ ID NO: 2658077 - RNA, 10 nt, Human
agcuuagaac

SEQ ID NO: 2658078 - RNA, 15 nt, Human
agcuuacguaguucu

SEQ ID NO: 2658079 - RNA, 13 nt, Human
agcuuacguaguu

SEQ ID NO: 2658080 - RNA, 21 nt, Human
agcuugagccgggccccuggg

SEQ ID NO: 2658081 - RNA, 20 nt, Human
agcuugaccugaggcugugg

SEQ ID NO: 2658082 - RNA, 23 nt, Human
agcuugagccgggccccugggcu

SEQ ID NO: 2658083 - RNA, 24 nt, Human
agcuugagccgggccccugggcuu

SEQ ID NO: 2658084 - RNA, 18 nt, Human
agcuugggaggcuucccc

SEQ ID NO: 2658085 - RNA, 18 nt, Human
agcuugguucugugaaca

SEQ ID NO: 2658086 - RNA, 23 nt, Human
agcuuggggccaccaaagcugcc

SEQ ID NO: 2658087 - RNA, 16 nt, Human
agcuugaccugaggcu

SEQ ID NO: 2658088 - RNA, 20 nt, Human
agcuuggggccaccaaagcu

SEQ ID NO: 2658089 - RNA, 21 nt, Human
agcuuggggccaccaaagcug

SEQ ID NO: 2658090 - RNA, 22 nt, Human
agcuuggggccaccaaagcugc

SEQ ID NO: 2658091 - RNA, 18 nt, Human
ugccuuugcagcucagaa

SEQ ID NO: 2658092 - RNA, 19 nt, Human
ugccuuugcaccacgggac

SEQ ID NO: 2658093 - RNA, 16 nt, Human
ugccuuuuaauuuuua

SEQ ID NO: 2658094 - RNA, 17 nt, Human
ugcggaucucagcuuug

SEQ ID NO: 2658095 - RNA, 15 nt, Human
ugcggaucucagcuu

SEQ ID NO: 2658096 - RNA, 14 nt, Human
ugcgggacagagua

SEQ ID NO: 2658097 - RNA, 19 nt, Human
ugcggccuuuggcuucacg

SEQ ID NO: 2658098 - RNA, 17 nt, Human
ugcggccuuuggcuuca

SEQ ID NO: 2658099 - RNA, 18 nt, Human
ugcggcguacaggcuggc

SEQ ID NO: 2658100 - RNA, 16 nt, Human
ugcggcguacaggcug

SEQ ID NO: 2658101 - RNA, 14 nt, Human
aggaauggaagucc

SEQ ID NO: 2658102 - RNA, 19 nt, Human
aggaagccggggaagagau

SEQ ID NO: 2658103 - RNA, 18 nt, Human
ugcuggagucuccugagg

SEQ ID NO: 2658104 - RNA, 16 nt, Human
ugcugggauuacagac

SEQ ID NO: 2658105 - RNA, 16 nt, Human
ugcugggacucagccu

SEQ ID NO: 2658106 - RNA, 18 nt, Human
ugcugggacucagccuuc

SEQ ID NO: 2658107 - RNA, 22 nt, Human
ugcugggacucagccuucagac

SEQ ID NO: 2658108 - RNA, 23 nt, Human
ugcugggacucagccuucagaca

SEQ ID NO: 2658109 - RNA, 19 nt, Human
ugcuuccaggaaacuccac

SEQ ID NO: 2658110 - RNA, 16 nt, Human
ugcuuccaggaaacuc

SEQ ID NO: 2658111 - RNA, 22 nt, Human
ugcuguauauggaauucuuuua

SEQ ID NO: 2658112 - RNA, 23 nt, Human
ugcuuauuugacaacguuucagc

SEQ ID NO: 2658113 - RNA, 14 nt, Human
ugcuuagaaaagaa

SEQ ID NO: 2658114 - RNA, 14 nt, Human
aggaagccguccug

SEQ ID NO: 2658115 - RNA, 20 nt, Human
aggaagcccaggagccucac

SEQ ID NO: 2658116 - RNA, 17 nt, Human
ugcucauuaugccacuu

SEQ ID NO: 2658117 - RNA, 21 nt, Human
agcuuuacuggggcuggggaa

SEQ ID NO: 2658118 - RNA, 13 nt, Human
agcuuuagacccu

SEQ ID NO: 2658119 - RNA, 16 nt, Human
agcuuuagacccuggg

SEQ ID NO: 2658120 - RNA, 17 nt, Human
agcuuuagacccugggu

SEQ ID NO: 2658121 - RNA, 19 nt, Human
agcuuuagacccugggugg

SEQ ID NO: 2658122 - RNA, 22 nt, Human
agcuuuagacccugggugggcu

SEQ ID NO: 2658123 - RNA, 21 nt, Human
agcuuuauuuugagauguaaa

SEQ ID NO: 2658124 - RNA, 19 nt, Human
ugcuauuacgaaguucaag

SEQ ID NO: 2658125 - RNA, 18 nt, Human
ugcuauuacgaaguucaa

SEQ ID NO: 2658126 - RNA, 14 nt, Human
uguaaguucacaac

SEQ ID NO: 2658127 - RNA, 17 nt, Human
uguaagaauucugauug

SEQ ID NO: 2658128 - RNA, 14 nt, Human
uguaagugggccca

SEQ ID NO: 2658129 - RNA, 17 nt, Human
uguaagcguauggcuuu

SEQ ID NO: 2658130 - RNA, 20 nt, Human
uguaagcauacuuuguaaau

SEQ ID NO: 2658131 - RNA, 22 nt, Human
uguaagcauacuuuguaaauag

SEQ ID NO: 2658132 - RNA, 21 nt, Human
uguaagcguauggcuuuauuu

SEQ ID NO: 2658133 - RNA, 17 nt, Human
uguaagcacucuggaug

SEQ ID NO: 2658134 - RNA, 18 nt, Human
uguaagcacucuggauga

SEQ ID NO: 2658135 - RNA, 17 nt, Human
uguaauuacuuauugua

SEQ ID NO: 2658136 - RNA, 15 nt, Human
uguaacuuccaaaua

SEQ ID NO: 2658137 - RNA, 17 nt, Human
uguaacuuccaaauaaa

SEQ ID NO: 2658138 - RNA, 19 nt, Human
uguaacuuccaaauaaaua

SEQ ID NO: 2658139 - RNA, 20 nt, Human
uguaacuuccaaauaaauaa

SEQ ID NO: 2658140 - RNA, 21 nt, Human
uguaacuuccaaauaaauaau

SEQ ID NO: 2658141 - RNA, 16 nt, Human
uguaacuugcuuaaau

SEQ ID NO: 2658142 - RNA, 20 nt, Human
uguaacuugcuuaaauuucu

SEQ ID NO: 2658143 - RNA, 22 nt, Human
uguaacuugcuuaaauuucuua

SEQ ID NO: 2658144 - RNA, 14 nt, Human
agguuggugggggc

SEQ ID NO: 2658145 - RNA, 14 nt, Human
uguaagaaggcaau

SEQ ID NO: 2658146 - RNA, 17 nt, Human
uguaagaaggcaauauu

SEQ ID NO: 2658147 - RNA, 17 nt, Human
agguugagcucuucuua

SEQ ID NO: 2658148 - RNA, 24 nt, Human
agguugagcucuucuuaaaguauu

SEQ ID NO: 2658149 - RNA, 17 nt, Human
aggugguuauggagagg

SEQ ID NO: 2658150 - RNA, 18 nt, Human
aggucuuucaguacuuuu

SEQ ID NO: 2658151 - RNA, 21 nt, Human
agguggugguagagaagcaag

SEQ ID NO: 2658152 - RNA, 12 nt, Human
aggugggcccgg

SEQ ID NO: 2658153 - RNA, 11 nt, Human
aggugcagagg

SEQ ID NO: 2658154 - RNA, 12 nt, Human
aggugcagaggu

SEQ ID NO: 2658155 - RNA, 21 nt, Human
aggugcagagguacccugggu

SEQ ID NO: 2658156 - RNA, 18 nt, Human
aguagauaauuucagggu

SEQ ID NO: 2658157 - RNA, 19 nt, Human
aguagauaauuucagggug

SEQ ID NO: 2658158 - RNA, 20 nt, Human
aguagauaauuucagggugc

SEQ ID NO: 2658159 - RNA, 16 nt, Human
aguagauccauuucca

SEQ ID NO: 2658160 - RNA, 23 nt, Human
aguagauccauuuccauugcuua

SEQ ID NO: 2658161 - RNA, 14 nt, Human
uguagguccucaga

SEQ ID NO: 2658162 - RNA, 22 nt, Human
uguaggagcugccuuggcucag

SEQ ID NO: 2658163 - RNA, 15 nt, Human
uguaggagcugccuu

SEQ ID NO: 2658164 - RNA, 12 nt, Human
uguaggagcugc

SEQ ID NO: 2658165 - RNA, 18 nt, Human
uguaggagacuugccaga

SEQ ID NO: 2658166 - RNA, 22 nt, Human
uguaggagacuugccagagccg

SEQ ID NO: 2658167 - RNA, 13 nt, Human
uguaggagacuug

SEQ ID NO: 2658168 - RNA, 18 nt, Human
aguagauguggccuuuga

SEQ ID NO: 2658169 - RNA, 20 nt, Human
aguagauguggccuuugaau

SEQ ID NO: 2658170 - RNA, 13 nt, Human
aguagagccagcu

SEQ ID NO: 2658171 - RNA, 12 nt, Human
aguagagccagc

SEQ ID NO: 2658172 - RNA, 15 nt, Human
aguagagccagcuug

SEQ ID NO: 2658173 - RNA, 11 nt, Human
aguagaacugu

SEQ ID NO: 2658174 - RNA, 21 nt, Human
aguagaacuuuguauaguuau

SEQ ID NO: 2658175 - RNA, 19 nt, Human
aguagaacuuuguauaguu

SEQ ID NO: 2658176 - RNA, 18 nt, Human
aguagaacuuuguauagu

SEQ ID NO: 2658177 - RNA, 16 nt, Human
aguagaacuuuguaua

SEQ ID NO: 2658178 - RNA, 15 nt, Human
aguagaacuuuguau

SEQ ID NO: 2658179 - RNA, 14 nt, Human
aguagaacuuugua

SEQ ID NO: 2658180 - RNA, 13 nt, Human
aguacuuuuuuaa

SEQ ID NO: 2658181 - RNA, 15 nt, Human
aguacuuuuuuaaau

SEQ ID NO: 2658182 - RNA, 16 nt, Human
aguacuuuuuuaaaua

SEQ ID NO: 2658183 - RNA, 23 nt, Human
aguacuuuuuuaaauauuuucua

SEQ ID NO: 2658184 - RNA, 12 nt, Human
aguagaaaaugu

SEQ ID NO: 2658185 - RNA, 14 nt, Human
aguagaaaauguga

SEQ ID NO: 2658186 - RNA, 18 nt, Human
aguagaaaaugugacccu

SEQ ID NO: 2658187 - RNA, 22 nt, Human
aguagaaaaugugacccuccaa

SEQ ID NO: 2658188 - RNA, 19 nt, Human
aguacacugccugccuuaa

SEQ ID NO: 2658189 - RNA, 17 nt, Human
aguacacugccugccuu

SEQ ID NO: 2658190 - RNA, 12 nt, Human
aguacacugccu

SEQ ID NO: 2658191 - RNA, 14 nt, Human
aguaauuucuuuuu

SEQ ID NO: 2658192 - RNA, 21 nt, Human
aguaauuucuuuuuuuccuuu

SEQ ID NO: 2658193 - RNA, 12 nt, Human
aguaaucaucua

SEQ ID NO: 2658194 - RNA, 17 nt, Human
aguaaucaucuaaguca

SEQ ID NO: 2658195 - RNA, 22 nt, Human
aguaaucaucuaagucaguacc

SEQ ID NO: 2658196 - RNA, 13 nt, Human
aguaauauuuauu

SEQ ID NO: 2658197 - RNA, 19 nt, Human
aguaauauuuauuaaauuu

SEQ ID NO: 2658198 - RNA, 15 nt, Human
aguaauauuuauuaa

SEQ ID NO: 2658199 - RNA, 22 nt, Human
aguaauauuuauuaaauuuuuu

SEQ ID NO: 2658200 - RNA, 20 nt, Human
aguaagccgugauuuucauu

SEQ ID NO: 2658201 - RNA, 14 nt, Human
aguaaaaaggcuaa

SEQ ID NO: 2658202 - RNA, 21 nt, Human
aguaagggaacaaguugagcu

SEQ ID NO: 2658203 - RNA, 14 nt, Human
uguagagugggagc

SEQ ID NO: 2658204 - RNA, 13 nt, Human
uguagagugggag

SEQ ID NO: 2658205 - RNA, 12 nt, Human
uguacuuuucau

SEQ ID NO: 2658206 - RNA, 13 nt, Human
uguacuuuucauu

SEQ ID NO: 2658207 - RNA, 17 nt, Human
uguacuuuucauucucu

SEQ ID NO: 2658208 - RNA, 18 nt, Human
uguacuuuucauucucuu

SEQ ID NO: 2658209 - RNA, 22 nt, Human
uguacuuuucauucucuuuuaa

SEQ ID NO: 2658210 - RNA, 15 nt, Human
uguacuuuuuaguaa

SEQ ID NO: 2658211 - RNA, 20 nt, Human
uguacuuuuuaguaauuucu

SEQ ID NO: 2658212 - RNA, 21 nt, Human
uguacuuuuuaguaauuucuu

SEQ ID NO: 2658213 - RNA, 23 nt, Human
uguacuuuuauuuuacacagaaa

SEQ ID NO: 2658214 - RNA, 14 nt, Human
uguaccaagugaaa

SEQ ID NO: 2658215 - RNA, 16 nt, Human
uguaccaagugaaauu

SEQ ID NO: 2658216 - RNA, 19 nt, Human
uguaauuugaugagguauu

SEQ ID NO: 2658217 - RNA, 14 nt, Human
uguaccaaaauuca

SEQ ID NO: 2658218 - RNA, 23 nt, Human
uguaccaaaauucaucugucuau

SEQ ID NO: 2658219 - RNA, 15 nt, Human
uguaauuuaaaugaa

SEQ ID NO: 2658220 - RNA, 16 nt, Human
uguaauuuaaaugaaa

SEQ ID NO: 2658221 - RNA, 17 nt, Human
uguaauuuaaaugaaag

SEQ ID NO: 2658222 - RNA, 15 nt, Human
uguauuauuuauaau

SEQ ID NO: 2658223 - RNA, 14 nt, Human
uguauuauuuauaa

SEQ ID NO: 2658224 - RNA, 18 nt, Human
uguauuauuuacauuuaa

SEQ ID NO: 2658225 - RNA, 21 nt, Human
uguauuauuuacauuuaauag

SEQ ID NO: 2658226 - RNA, 17 nt, Human
uguauuuuuaguagaga

SEQ ID NO: 2658227 - RNA, 17 nt, Human
ugucaaugagagcauaa

SEQ ID NO: 2658228 - RNA, 23 nt, Human
aguaggacuccuuauuuggcgug

SEQ ID NO: 2658229 - RNA, 14 nt, Human
aguaguccugugaa

SEQ ID NO: 2658230 - RNA, 12 nt, Human
aguaguccugug

SEQ ID NO: 2658231 - RNA, 13 nt, Human
aguaguccuguga

SEQ ID NO: 2658232 - RNA, 23 nt, Human
aguagugucacugcuuguuaugc

SEQ ID NO: 2658233 - RNA, 13 nt, Human
aguaguucuguau

SEQ ID NO: 2658234 - RNA, 21 nt, Human
aguaguucuguauuugaaagu

SEQ ID NO: 2658235 - RNA, 18 nt, Human
aguaguucuguauuugaa

SEQ ID NO: 2658236 - RNA, 17 nt, Human
aguaguucuguauuuga

SEQ ID NO: 2658237 - RNA, 16 nt, Human
aguaguucuguauuug

SEQ ID NO: 2658238 - RNA, 15 nt, Human
aguaguucuguauuu

SEQ ID NO: 2658239 - RNA, 14 nt, Human
aguaguucuguauu

SEQ ID NO: 2658240 - RNA, 21 nt, Human
aguaugugguuuuguaauuug

SEQ ID NO: 2658241 - RNA, 13 nt, Human
aguauguauuauu

SEQ ID NO: 2658242 - RNA, 15 nt, Human
aguauguauauuaaa

SEQ ID NO: 2658243 - RNA, 18 nt, Human
aguauguauauuaaaaaa

SEQ ID NO: 2658244 - RNA, 20 nt, Human
aguauguauauuaaaaaaga

SEQ ID NO: 2658245 - RNA, 22 nt, Human
aguauguauauuaaaaaagaga

SEQ ID NO: 2658246 - RNA, 23 nt, Human
aguauguauauuaaaaaagagac

SEQ ID NO: 2658247 - RNA, 13 nt, Human
aguauguaugugu

SEQ ID NO: 2658248 - RNA, 13 nt, Human
aguauaaaauagu

SEQ ID NO: 2658249 - RNA, 22 nt, Human
aguauaaaauaguaugaaaaug

SEQ ID NO: 2658250 - RNA, 17 nt, Human
ugucaguacuauucagg

SEQ ID NO: 2658251 - RNA, 11 nt, Human
ugucaggccuu

SEQ ID NO: 2658252 - RNA, 14 nt, Human
ugucaggccuucag

SEQ ID NO: 2658253 - RNA, 19 nt, Human
ugucaggccuucaggguuc

SEQ ID NO: 2658254 - RNA, 17 nt, Human
ugucaggcugaaaacaa

SEQ ID NO: 2658255 - RNA, 18 nt, Human
ugucaggcugaaaacaau

SEQ ID NO: 2658256 - RNA, 16 nt, Human
ugucagcugaaccugg

SEQ ID NO: 2658257 - RNA, 19 nt, Human
ugucagcugaaccugggua

SEQ ID NO: 2658258 - RNA, 13 nt, Human
agucagagacaga

SEQ ID NO: 2658259 - RNA, 15 nt, Human
agucagagacagaua

SEQ ID NO: 2658260 - RNA, 17 nt, Human
agucagagacagauacc

SEQ ID NO: 2658261 - RNA, 19 nt, Human
agucagagacagauaccuc

SEQ ID NO: 2658262 - RNA, 17 nt, Human
ugucuaaacaaugcuga

SEQ ID NO: 2658263 - RNA, 16 nt, Human
ugucuaaacaaugcug

SEQ ID NO: 2658264 - RNA, 20 nt, Human
ugucguggacacacacagac

SEQ ID NO: 2658265 - RNA, 21 nt, Human
ugucuaaacaaugcugauuug

SEQ ID NO: 2658266 - RNA, 20 nt, Human
ugucuaaacaaugcugauuu

SEQ ID NO: 2658267 - RNA, 22 nt, Human
ugucguauuuggcacacagcag

SEQ ID NO: 2658268 - RNA, 14 nt, Human
uguccgagcuuuga

SEQ ID NO: 2658269 - RNA, 13 nt, Human
uguccgagcuuug

SEQ ID NO: 2658270 - RNA, 18 nt, Human
uguccuaauggugaugca

SEQ ID NO: 2658271 - RNA, 15 nt, Human
uguccuaauggugau

SEQ ID NO: 2658272 - RNA, 14 nt, Human
aguccaggcugccg

SEQ ID NO: 2658273 - RNA, 17 nt, Human
aguccaggcugccgugg

SEQ ID NO: 2658274 - RNA, 18 nt, Human
aguccaggcugccguggg

SEQ ID NO: 2658275 - RNA, 23 nt, Human
aguccgugggacgggaugguucu

SEQ ID NO: 2658276 - RNA, 13 nt, Human
aguccgugggacg

SEQ ID NO: 2658277 - RNA, 12 nt, Human
agucgugccugu

SEQ ID NO: 2658278 - RNA, 13 nt, Human
agucgugccugug

SEQ ID NO: 2658279 - RNA, 14 nt, Human
agucgugccugugu

SEQ ID NO: 2658280 - RNA, 15 nt, Human
agucgugccuguguc

SEQ ID NO: 2658281 - RNA, 17 nt, Human
agucguggggugugcug

SEQ ID NO: 2658282 - RNA, 18 nt, Human
agucguggggugugcugg

SEQ ID NO: 2658283 - RNA, 19 nt, Human
agucguggggugugcuggg

SEQ ID NO: 2658284 - RNA, 20 nt, Human
agucguggggugugcuggga

SEQ ID NO: 2658285 - RNA, 21 nt, Human
agucguggggugugcugggag

SEQ ID NO: 2658286 - RNA, 18 nt, Human
ugggcuggaaucaggaau

SEQ ID NO: 2658287 - RNA, 12 nt, Human
ugggcuggacuu

SEQ ID NO: 2658288 - RNA, 23 nt, Human
ugggcuggacuucuaccugcccu

SEQ ID NO: 2658289 - RNA, 21 nt, Human
ugggcugaccccgguggcggc

SEQ ID NO: 2658290 - RNA, 18 nt, Human
ugggcucugugcagucac

SEQ ID NO: 2658291 - RNA, 12 nt, Human
ugggcucugugc

SEQ ID NO: 2658292 - RNA, 17 nt, Human
ugggcucugugcaguca

SEQ ID NO: 2658293 - RNA, 23 nt, Human
agggcuucugccauuucugagau

SEQ ID NO: 2658294 - RNA, 12 nt, Human
agggcuuccucu

SEQ ID NO: 2658295 - RNA, 20 nt, Human
agggcuuccucuagaagcca

SEQ ID NO: 2658296 - RNA, 21 nt, Human
agggcuuccucuagaagccaa

SEQ ID NO: 2658297 - RNA, 22 nt, Human
agggcuuccucuagaagccaag

SEQ ID NO: 2658298 - RNA, 17 nt, Human
agggcuuguaguucuuu

SEQ ID NO: 2658299 - RNA, 16 nt, Human
agggcuuguaguucuu

SEQ ID NO: 2658300 - RNA, 15 nt, Human
agggcuuguaguucu

SEQ ID NO: 2658301 - RNA, 14 nt, Human
agggcuuguaguuc

SEQ ID NO: 2658302 - RNA, 19 nt, Human
agggcuuguaguucuuuaa

SEQ ID NO: 2658303 - RNA, 21 nt, Human
uggggacgcuccgcugccgug

SEQ ID NO: 2658304 - RNA, 19 nt, Human
uggggccgccgccucuuuc

SEQ ID NO: 2658305 - RNA, 18 nt, Human
uggggccuacagcuuuga

SEQ ID NO: 2658306 - RNA, 19 nt, Human
uggggcuggggaaggaagc

SEQ ID NO: 2658307 - RNA, 22 nt, Human
ugggagguggaagaagggagaa

SEQ ID NO: 2658308 - RNA, 17 nt, Human
ugggauucaggaaugug

SEQ ID NO: 2658309 - RNA, 19 nt, Human
ugggagguggaagaaggga

SEQ ID NO: 2658310 - RNA, 18 nt, Human
ugggagguggaagaaggg

SEQ ID NO: 2658311 - RNA, 22 nt, Human
ugggauuuccagaaccacacuu

SEQ ID NO: 2658312 - RNA, 15 nt, Human
aggccuuccucucuc

SEQ ID NO: 2658313 - RNA, 21 nt, Human
aggccuucaggguucagcagu

SEQ ID NO: 2658314 - RNA, 17 nt, Human
ugggaggucaaggcugc

SEQ ID NO: 2658315 - RNA, 19 nt, Human
aggccuuccucucuccaga

SEQ ID NO: 2658316 - RNA, 18 nt, Human
aggccuuccucucuccag

SEQ ID NO: 2658317 - RNA, 16 nt, Human
aggccuuccucucucc

SEQ ID NO: 2658318 - RNA, 23 nt, Human
ugggaggucaaggcugcagugag

SEQ ID NO: 2658319 - RNA, 20 nt, Human
ugggaggucaaggcugcagu

SEQ ID NO: 2658320 - RNA, 19 nt, Human
ugggaggucaaggcugcag

SEQ ID NO: 2658321 - RNA, 18 nt, Human
ugggaggucaaggcugca

SEQ ID NO: 2658322 - RNA, 24 nt, Human
ugggccauguccaaagaggcugcc

SEQ ID NO: 2658323 - RNA, 20 nt, Human
agggccgacuaagagaaguu

SEQ ID NO: 2658324 - RNA, 17 nt, Human
agggaggggccggcccu

SEQ ID NO: 2658325 - RNA, 18 nt, Human
agggaggggccggcccug

SEQ ID NO: 2658326 - RNA, 19 nt, Human
agggaggggccggcccugu

SEQ ID NO: 2658327 - RNA, 23 nt, Human
agggaggggccggcccugugugc

SEQ ID NO: 2658328 - RNA, 15 nt, Human
agggagggcuucugc

SEQ ID NO: 2658329 - RNA, 21 nt, Human
agggaggggaaaagcauuuuu

SEQ ID NO: 2658330 - RNA, 21 nt, Human
agggaggucacuggaaagggg

SEQ ID NO: 2658331 - RNA, 20 nt, Human
agggaggucacuggaaaggg

SEQ ID NO: 2658332 - RNA, 22 nt, Human
aggggagagccugcuggcaccc

SEQ ID NO: 2658333 - RNA, 15 nt, Human
aggggagagccugcu

SEQ ID NO: 2658334 - RNA, 15 nt, Human
aggggagacuuugau

SEQ ID NO: 2658335 - RNA, 16 nt, Human
aggggagagccugcug

SEQ ID NO: 2658336 - RNA, 17 nt, Human
aggggagagccugcugg

SEQ ID NO: 2658337 - RNA, 13 nt, Human
aggggagacuuug

SEQ ID NO: 2658338 - RNA, 23 nt, Human
agggggagccgguaacuguccug

SEQ ID NO: 2658339 - RNA, 15 nt, Human
aggggguggaggggu

SEQ ID NO: 2658340 - RNA, 19 nt, Human
agggguggggguggaggcu

SEQ ID NO: 2658341 - RNA, 19 nt, Human
agggggauccgacugcuuu

SEQ ID NO: 2658342 - RNA, 20 nt, Human
agggggauccgacugcuuug

SEQ ID NO: 2658343 - RNA, 14 nt, Human
aggggugucuuggg

SEQ ID NO: 2658344 - RNA, 22 nt, Human
aggggugucuugggcagagcug

SEQ ID NO: 2658345 - RNA, 24 nt, Human
aggggugucuugggcagagcuggc

SEQ ID NO: 2658346 - RNA, 16 nt, Human
agggguguggcagugg

SEQ ID NO: 2658347 - RNA, 18 nt, Human
agggguguggcagugguu

SEQ ID NO: 2658348 - RNA, 14 nt, Human
agggguuccucaaa

SEQ ID NO: 2658349 - RNA, 20 nt, Human
agggguuccucaaauuuuuu

SEQ ID NO: 2658350 - RNA, 18 nt, Human
agggguucccuugagggc

SEQ ID NO: 2658351 - RNA, 20 nt, Human
agggguucccuugagggcug

SEQ ID NO: 2658352 - RNA, 21 nt, Human
agggguucccuugagggcugc

SEQ ID NO: 2658353 - RNA, 23 nt, Human
agggguucccuugagggcugcag

SEQ ID NO: 2658354 - RNA, 16 nt, Human
ugguaauaagcacugu

SEQ ID NO: 2658355 - RNA, 17 nt, Human
ugguaaucuuuaccugu

SEQ ID NO: 2658356 - RNA, 22 nt, Human
ugguaaucuuuaccuguauaca

SEQ ID NO: 2658357 - RNA, 23 nt, Human
ugguaaucuuuaccuguauacag

SEQ ID NO: 2658358 - RNA, 21 nt, Human
ugguaauccccuaaaauaaca

SEQ ID NO: 2658359 - RNA, 23 nt, Human
ugguaauccccuaaaauaacagu

SEQ ID NO: 2658360 - RNA, 20 nt, Human
uggguggggggcauugagua

SEQ ID NO: 2658361 - RNA, 15 nt, Human
ugggugggcucugug

SEQ ID NO: 2658362 - RNA, 16 nt, Human
ugggugggcucugugc

SEQ ID NO: 2658363 - RNA, 19 nt, Human
ugggugggcucugugcagu

SEQ ID NO: 2658364 - RNA, 16 nt, Human
ugguaggaccaagcau

SEQ ID NO: 2658365 - RNA, 22 nt, Human
ugguaggaccaagcaucuuggg

SEQ ID NO: 2658366 - RNA, 22 nt, Human
uggguggcaccagcagccugga

SEQ ID NO: 2658367 - RNA, 12 nt, Human
agggugggaagg

SEQ ID NO: 2658368 - RNA, 19 nt, Human
agggugucugcgucgucac

SEQ ID NO: 2658369 - RNA, 22 nt, Human
aggguguccggucccuguccca

SEQ ID NO: 2658370 - RNA, 11 nt, Human
uggucuuugag

SEQ ID NO: 2658371 - RNA, 10 nt, Human
uggucuuuga

SEQ ID NO: 2658372 - RNA, 12 nt, Human
agguagaaacuu

SEQ ID NO: 2658373 - RNA, 13 nt, Human
agguauuauacau

SEQ ID NO: 2658374 - RNA, 19 nt, Human
agguauuaaaacuaaauuu

SEQ ID NO: 2658375 - RNA, 20 nt, Human
agguauuaaaacuaaauuuc

SEQ ID NO: 2658376 - RNA, 16 nt, Human
aggucaaguugucagg

SEQ ID NO: 2658377 - RNA, 17 nt, Human
aggucaaguugucaggu

SEQ ID NO: 2658378 - RNA, 19 nt, Human
aggucaaguugucagguua

SEQ ID NO: 2658379 - RNA, 20 nt, Human
agguauuuaaaguauuuucu

SEQ ID NO: 2658380 - RNA, 16 nt, Human
aggucacuggaaaggg

SEQ ID NO: 2658381 - RNA, 20 nt, Human
aggucacuggaaaggggaga

SEQ ID NO: 2658382 - RNA, 21 nt, Human
aggucacuggaaaggggagag

SEQ ID NO: 2658383 - RNA, 23 nt, Human
agguccagcucuggaggggaggg

SEQ ID NO: 2658384 - RNA, 18 nt, Human
agguccagcucuggaggg

SEQ ID NO: 2658385 - RNA, 15 nt, Human
agguauaauaaaauu

SEQ ID NO: 2658386 - RNA, 14 nt, Human
aggucacuguuucc

SEQ ID NO: 2658387 - RNA, 16 nt, Human
aggucacuguuuccug

SEQ ID NO: 2658388 - RNA, 18 nt, Human
aggucacuguuuccuggg

SEQ ID NO: 2658389 - RNA, 13 nt, Human
agugcuuuaaugg

SEQ ID NO: 2658390 - RNA, 19 nt, Human
uguuaauggauuucagaag

SEQ ID NO: 2658391 - RNA, 23 nt, Human
uguuaauggauuucagaagccua

SEQ ID NO: 2658392 - RNA, 19 nt, Human
aguggaaaaauagccugcc

SEQ ID NO: 2658393 - RNA, 18 nt, Human
aguggaaaaauagccugc

SEQ ID NO: 2658394 - RNA, 19 nt, Human
agugcuuuuaagugaaaau

SEQ ID NO: 2658395 - RNA, 23 nt, Human
agugcuuuuaagugaaaaugguc

SEQ ID NO: 2658396 - RNA, 11 nt, Human
aguggaaaaau

SEQ ID NO: 2658397 - RNA, 22 nt, Human
uguguugccacaguagaacugu

SEQ ID NO: 2658398 - RNA, 16 nt, Human
uguguugccaagcucc

SEQ ID NO: 2658399 - RNA, 17 nt, Human
uguguugguguggccca

SEQ ID NO: 2658400 - RNA, 19 nt, Human
uguguugucucuugaguuu

SEQ ID NO: 2658401 - RNA, 12 nt, Human
ugugugugugca

SEQ ID NO: 2658402 - RNA, 15 nt, Human
ugugugugugcacau

SEQ ID NO: 2658403 - RNA, 14 nt, Human
ugugugugugugca

SEQ ID NO: 2658404 - RNA, 14 nt, Human
ugugugugugugcg

SEQ ID NO: 2658405 - RNA, 16 nt, Human
ugugugugugugugca

SEQ ID NO: 2658406 - RNA, 16 nt, Human
ugugugugugugugcg

SEQ ID NO: 2658407 - RNA, 13 nt, Human
uguguugccaagc

SEQ ID NO: 2658408 - RNA, 14 nt, Human
agugccuauugaua

SEQ ID NO: 2658409 - RNA, 21 nt, Human
agugccucaagaggaaugaaa

SEQ ID NO: 2658410 - RNA, 23 nt, Human
agugccgcaucucacagcuaugc

SEQ ID NO: 2658411 - RNA, 19 nt, Human
agugccgcaucucacagcu

SEQ ID NO: 2658412 - RNA, 18 nt, Human
agugccgcaucucacagc

SEQ ID NO: 2658413 - RNA, 20 nt, Human
agugcccuuccugcugcgca

SEQ ID NO: 2658414 - RNA, 16 nt, Human
agugccgcaucucaca

SEQ ID NO: 2658415 - RNA, 19 nt, Human
agugcuggagucuccugag

SEQ ID NO: 2658416 - RNA, 22 nt, Human
agugcuggagucuccugaggac

SEQ ID NO: 2658417 - RNA, 18 nt, Human
ugugguuuacuagcagga

SEQ ID NO: 2658418 - RNA, 13 nt, Human
ugugguuccucug

SEQ ID NO: 2658419 - RNA, 17 nt, Human
ugugguuccucugcuca

SEQ ID NO: 2658420 - RNA, 12 nt, Human
ugugguuucauu

SEQ ID NO: 2658421 - RNA, 19 nt, Human
ugugucagcauagaaguaa

SEQ ID NO: 2658422 - RNA, 13 nt, Human
uguggugaugaaa

SEQ ID NO: 2658423 - RNA, 13 nt, Human
agugcuuggaaca

SEQ ID NO: 2658424 - RNA, 22 nt, Human
agugcuuggaacauacuguuca

SEQ ID NO: 2658425 - RNA, 13 nt, Human
uguggccccaccc

SEQ ID NO: 2658426 - RNA, 12 nt, Human
uguggccccacc

SEQ ID NO: 2658427 - RNA, 17 nt, Human
uguggccccacccuggg

SEQ ID NO: 2658428 - RNA, 19 nt, Human
uguggccccacccugggcc

SEQ ID NO: 2658429 - RNA, 15 nt, Human
uguggcacuugccug

SEQ ID NO: 2658430 - RNA, 16 nt, Human
uguggcacuugccugg

SEQ ID NO: 2658431 - RNA, 18 nt, Human
uguggcacuugccugggu

SEQ ID NO: 2658432 - RNA, 19 nt, Human
uguggcacuugccuggguc

SEQ ID NO: 2658433 - RNA, 17 nt, Human
uguggcaaucugugggc

SEQ ID NO: 2658434 - RNA, 18 nt, Human
uguggcaaucugugggcu

SEQ ID NO: 2658435 - RNA, 20 nt, Human
uguggagccgaggccuaccc

SEQ ID NO: 2658436 - RNA, 16 nt, Human
uguggagccgaggccu

SEQ ID NO: 2658437 - RNA, 19 nt, Human
uguggagccgaggccuacc

SEQ ID NO: 2658438 - RNA, 12 nt, Human
ugugcugcccug

SEQ ID NO: 2658439 - RNA, 16 nt, Human
ugugcugcccugaaga

SEQ ID NO: 2658440 - RNA, 17 nt, Human
ugugcugcccugaagaa

SEQ ID NO: 2658441 - RNA, 18 nt, Human
ugugcugcccugaagaau

SEQ ID NO: 2658442 - RNA, 12 nt, Human
agugccaaagaa

SEQ ID NO: 2658443 - RNA, 13 nt, Human
agugccaaagaaa

SEQ ID NO: 2658444 - RNA, 23 nt, Human
uguggccccacccugggcccugg

SEQ ID NO: 2658445 - RNA, 16 nt, Human
uguggcccuggcugcc

SEQ ID NO: 2658446 - RNA, 21 nt, Human
aguuacugccgguuugaaaau

SEQ ID NO: 2658447 - RNA, 14 nt, Human
aguuacuguguaaa

SEQ ID NO: 2658448 - RNA, 15 nt, Human
aguuacuguguaaac

SEQ ID NO: 2658449 - RNA, 16 nt, Human
aguuacuguguaaacu

SEQ ID NO: 2658450 - RNA, 13 nt, Human
aguguuauaugaa

SEQ ID NO: 2658451 - RNA, 20 nt, Human
aguguuauaugaacauacaa

SEQ ID NO: 2658452 - RNA, 16 nt, Human
aguguuauaugaacau

SEQ ID NO: 2658453 - RNA, 15 nt, Human
aguguuauaugaaca

SEQ ID NO: 2658454 - RNA, 14 nt, Human
aguguuauaugaac

SEQ ID NO: 2658455 - RNA, 15 nt, Human
aguggaaauguucua

SEQ ID NO: 2658456 - RNA, 12 nt, Human
uguuauaugaac

SEQ ID NO: 2658457 - RNA, 14 nt, Human
uguuauaugaacau

SEQ ID NO: 2658458 - RNA, 13 nt, Human
uguuauaugaaca

SEQ ID NO: 2658459 - RNA, 13 nt, Human
uguuaucaaaaua

SEQ ID NO: 2658460 - RNA, 15 nt, Human
uguuauaugaacaua

SEQ ID NO: 2658461 - RNA, 14 nt, Human
uguuauuagauguu

SEQ ID NO: 2658462 - RNA, 16 nt, Human
uguuauuaucugggcu

SEQ ID NO: 2658463 - RNA, 23 nt, Human
uguuauuaucugggcuuauaucu

SEQ ID NO: 2658464 - RNA, 16 nt, Human
uguuauucaacagcaa

SEQ ID NO: 2658465 - RNA, 14 nt, Human
aguucuaccggcuu

SEQ ID NO: 2658466 - RNA, 16 nt, Human
aguucuacucaggcug

SEQ ID NO: 2658467 - RNA, 17 nt, Human
aguucuacucaggcugg

SEQ ID NO: 2658468 - RNA, 23 nt, Human
aguuccucauuagcauuuugcua

SEQ ID NO: 2658469 - RNA, 20 nt, Human
aguucaagaucaaaaaggcu

SEQ ID NO: 2658470 - RNA, 15 nt, Human
aguucaagaucaaaa

SEQ ID NO: 2658471 - RNA, 17 nt, Human
uguuuagauuugccaua

SEQ ID NO: 2658472 - RNA, 12 nt, Human
uguuuagauuug

SEQ ID NO: 2658473 - RNA, 15 nt, Human
uguugucucuugagu

SEQ ID NO: 2658474 - RNA, 15 nt, Human
uguuuauuacuucca

SEQ ID NO: 2658475 - RNA, 18 nt, Human
uguuuauuacuuccauga

SEQ ID NO: 2658476 - RNA, 21 nt, Human
uguuuauuacuuccaugaauu

SEQ ID NO: 2658477 - RNA, 22 nt, Human
uguuuauggcaauuuaacaugu

SEQ ID NO: 2658478 - RNA, 12 nt, Human
uguuuauuuucu

SEQ ID NO: 2658479 - RNA, 20 nt, Human
uguuuauuuucuacguuucu

SEQ ID NO: 2658480 - RNA, 22 nt, Human
uguuuauuuucuacguuucuuu

SEQ ID NO: 2658481 - RNA, 12 nt, Human
uuaauauuuaac

SEQ ID NO: 2658482 - RNA, 17 nt, Human
uuaauauuuaacauuau

SEQ ID NO: 2658483 - RNA, 16 nt, Human
uuaauauuuaacauua

SEQ ID NO: 2658484 - RNA, 12 nt, Human
uuaauauuuccu

SEQ ID NO: 2658485 - RNA, 13 nt, Human
uuaaucauuuuca

SEQ ID NO: 2658486 - RNA, 15 nt, Human
uuaaucauuuucauu

SEQ ID NO: 2658487 - RNA, 19 nt, Human
uuaaucauuuucauuccua

SEQ ID NO: 2658488 - RNA, 21 nt, Human
uuaaucuacugcauuuaggga

SEQ ID NO: 2658489 - RNA, 20 nt, Human
uuaaucuguuuauuuacaag

SEQ ID NO: 2658490 - RNA, 19 nt, Human
uuaagaaauguauaaacuu

SEQ ID NO: 2658491 - RNA, 24 nt, Human
uuaaggggaggaaccagagugcug

SEQ ID NO: 2658492 - RNA, 18 nt, Human
uuaagggguaucauguau

SEQ ID NO: 2658493 - RNA, 17 nt, Human
uuaaggggaagaaugaa

SEQ ID NO: 2658494 - RNA, 18 nt, Human
uuaaggggaagaaugaaa

SEQ ID NO: 2658495 - RNA, 20 nt, Human
uuaaggggaagaaugaaagc

SEQ ID NO: 2658496 - RNA, 16 nt, Human
uuaaggucuuucagua

SEQ ID NO: 2658497 - RNA, 22 nt, Human
uuaagguguuugaaaauaguuu

SEQ ID NO: 2658498 - RNA, 17 nt, Human
uuaagguguuugaaaau

SEQ ID NO: 2658499 - RNA, 16 nt, Human
uuaagguguuugaaaa

SEQ ID NO: 2658500 - RNA, 14 nt, Human
uuaagguguuugaa

SEQ ID NO: 2658501 - RNA, 18 nt, Human
aguuuugacaagcuggcu

SEQ ID NO: 2658502 - RNA, 15 nt, Human
aguuuugacaagcug

SEQ ID NO: 2658503 - RNA, 14 nt, Human
aguuuugacaagcu

SEQ ID NO: 2658504 - RNA, 17 nt, Human
aguuuccgugcguggca

SEQ ID NO: 2658505 - RNA, 20 nt, Human
aguuuccgugcguggcacuc

SEQ ID NO: 2658506 - RNA, 14 nt, Human
aguuuugucauuca

SEQ ID NO: 2658507 - RNA, 17 nt, Human
aguuuuuacaagaugua

SEQ ID NO: 2658508 - RNA, 19 nt, Human
aguuuugacaagcuggcuu

SEQ ID NO: 2658509 - RNA, 16 nt, Human
aguuuuguaaaagaaa

SEQ ID NO: 2658510 - RNA, 22 nt, Human
aguuuuguaaaagaaaucaugu

SEQ ID NO: 2658511 - RNA, 17 nt, Human
auaaaauacauagugaa

SEQ ID NO: 2658512 - RNA, 18 nt, Human
auaaaauacauagugaaa

SEQ ID NO: 2658513 - RNA, 22 nt, Human
auaaaauagauauaaauuuuua

SEQ ID NO: 2658514 - RNA, 18 nt, Human
auaaaauaguaugaaaau

SEQ ID NO: 2658515 - RNA, 17 nt, Human
auaaaauauaucuuaua

SEQ ID NO: 2658516 - RNA, 15 nt, Human
auaaaauauaaacaa

SEQ ID NO: 2658517 - RNA, 18 nt, Human
aguuuuuaugagaaacuu

SEQ ID NO: 2658518 - RNA, 16 nt, Human
aguuuuuaugagaaac

SEQ ID NO: 2658519 - RNA, 21 nt, Human
aguugcugguaaaaugaagaa

SEQ ID NO: 2658520 - RNA, 18 nt, Human
aguugcugguaaaaugaa

SEQ ID NO: 2658521 - RNA, 17 nt, Human
aguugcugguaaaauga

SEQ ID NO: 2658522 - RNA, 15 nt, Human
aguugcugguaaaau

SEQ ID NO: 2658523 - RNA, 19 nt, Human
aguugcuugucuucuggua

SEQ ID NO: 2658524 - RNA, 22 nt, Human
aguuuaaaaguucuuaguuaua

SEQ ID NO: 2658525 - RNA, 13 nt, Human
uuaaaaaaaaucc

SEQ ID NO: 2658526 - RNA, 13 nt, Human
aguuuacagaaaa

SEQ ID NO: 2658527 - RNA, 20 nt, Human
uuaaaauuuuguauguuaaa

SEQ ID NO: 2658528 - RNA, 14 nt, Human
uuaaaguauuuucu

SEQ ID NO: 2658529 - RNA, 13 nt, Human
uuaaaguauucuu

SEQ ID NO: 2658530 - RNA, 15 nt, Human
uuaaacauugaagua

SEQ ID NO: 2658531 - RNA, 13 nt, Human
uuaaacauugaag

SEQ ID NO: 2658532 - RNA, 20 nt, Human
aguuucaguauuagaugcac

SEQ ID NO: 2658533 - RNA, 22 nt, Human
aguuucaguauuagaugcacuu

SEQ ID NO: 2658534 - RNA, 18 nt, Human
aguuucaguuuguuggaa

SEQ ID NO: 2658535 - RNA, 19 nt, Human
aguuucaguuuguuggaaa

SEQ ID NO: 2658536 - RNA, 13 nt, Human
uuaacagaaauug

SEQ ID NO: 2658537 - RNA, 15 nt, Human
uuaacagaaauugua

SEQ ID NO: 2658538 - RNA, 16 nt, Human
uuaacagaaauuguau

SEQ ID NO: 2658539 - RNA, 17 nt, Human
uuaacagaaauuguaua

SEQ ID NO: 2658540 - RNA, 19 nt, Human
uuaacagaaauuguauauu

SEQ ID NO: 2658541 - RNA, 21 nt, Human
uuaacagaaauuguauauugu

SEQ ID NO: 2658542 - RNA, 16 nt, Human
uuaaauacauauggau

SEQ ID NO: 2658543 - RNA, 18 nt, Human
uuaaauacauauggaugu

SEQ ID NO: 2658544 - RNA, 19 nt, Human
uuaaauacauauggauguu

SEQ ID NO: 2658545 - RNA, 23 nt, Human
uuaaauacauauggauguuacuc

SEQ ID NO: 2658546 - RNA, 21 nt, Human
auaauagcaacuuuuguguaa

SEQ ID NO: 2658547 - RNA, 20 nt, Human
auaauccugugaaaauauga

SEQ ID NO: 2658548 - RNA, 16 nt, Human
auaauccuuaaaucuu

SEQ ID NO: 2658549 - RNA, 17 nt, Human
auaauucuuuuuuauua

SEQ ID NO: 2658550 - RNA, 14 nt, Human
auaauucuuuuuua

SEQ ID NO: 2658551 - RNA, 22 nt, Human
auaauucuuuuuuauuaaucac

SEQ ID NO: 2658552 - RNA, 21 nt, Human
auaauucuuuuuuauuaauca

SEQ ID NO: 2658553 - RNA, 19 nt, Human
auaauucuuuuuuauuaau

SEQ ID NO: 2658554 - RNA, 17 nt, Human
auaaugaggaguuuaug

SEQ ID NO: 2658555 - RNA, 18 nt, Human
auaaugaggaguuuauga

SEQ ID NO: 2658556 - RNA, 20 nt, Human
auaaugccauuuuaaggaaa

SEQ ID NO: 2658557 - RNA, 14 nt, Human
auaauacugaacca

SEQ ID NO: 2658558 - RNA, 13 nt, Human
auaauacugaacc

SEQ ID NO: 2658559 - RNA, 16 nt, Human
auaauacugaaccacu

SEQ ID NO: 2658560 - RNA, 15 nt, Human
auaauacugaaccac

SEQ ID NO: 2658561 - RNA, 20 nt, Human
auaauacugaaccacuugua

SEQ ID NO: 2658562 - RNA, 13 nt, Human
auaauagacugua

SEQ ID NO: 2658563 - RNA, 12 nt, Human
auaauagaaaug

SEQ ID NO: 2658564 - RNA, 13 nt, Human
auaauagaaaugu

SEQ ID NO: 2658565 - RNA, 15 nt, Human
auaauagaaaugucu

SEQ ID NO: 2658566 - RNA, 14 nt, Human
uuagaacagguuuu

SEQ ID NO: 2658567 - RNA, 13 nt, Human
uuagaacagguuu

SEQ ID NO: 2658568 - RNA, 13 nt, Human
uuagacagccaaa

SEQ ID NO: 2658569 - RNA, 16 nt, Human
auaagaauucagacau

SEQ ID NO: 2658570 - RNA, 12 nt, Human
auaagaauuugc

SEQ ID NO: 2658571 - RNA, 13 nt, Human
auaagaauuugca

SEQ ID NO: 2658572 - RNA, 14 nt, Human
auaagaauuugcau

SEQ ID NO: 2658573 - RNA, 15 nt, Human
auaagaauuugcaua

SEQ ID NO: 2658574 - RNA, 17 nt, Human
auaagaauuugcauacu

SEQ ID NO: 2658575 - RNA, 23 nt, Human
auaagacaaauauuccuuugcau

SEQ ID NO: 2658576 - RNA, 13 nt, Human
auaauaaaauuau

SEQ ID NO: 2658577 - RNA, 13 nt, Human
auaauaaaaauau

SEQ ID NO: 2658578 - RNA, 15 nt, Human
auaauaaaaauauau

SEQ ID NO: 2658579 - RNA, 19 nt, Human
auaauaaaaauauauuuuc

SEQ ID NO: 2658580 - RNA, 13 nt, Human
auaauaaauauau

SEQ ID NO: 2658581 - RNA, 23 nt, Human
uuagggacuacccauagacauga

SEQ ID NO: 2658582 - RNA, 18 nt, Human
uuagguuggcaaaaaggc

SEQ ID NO: 2658583 - RNA, 16 nt, Human
uuaguuuagaacaggu

SEQ ID NO: 2658584 - RNA, 20 nt, Human
uuaguuuagaacagguuuuu

SEQ ID NO: 2658585 - RNA, 22 nt, Human
uuaguuuguaugccaagugaga

SEQ ID NO: 2658586 - RNA, 15 nt, Human
uuaguuuguguguug

SEQ ID NO: 2658587 - RNA, 15 nt, Human
uuaguuuguauauau

SEQ ID NO: 2658588 - RNA, 18 nt, Human
uuagcaaauucuguuuuu

SEQ ID NO: 2658589 - RNA, 17 nt, Human
auaauuuaaaaauauau

SEQ ID NO: 2658590 - RNA, 19 nt, Human
auaauuuaaaaauauauuu

SEQ ID NO: 2658591 - RNA, 21 nt, Human
auaauuuaaaaauauauuuau

SEQ ID NO: 2658592 - RNA, 15 nt, Human
auaauuguucucaga

SEQ ID NO: 2658593 - RNA, 23 nt, Human
auaauuguucucagaaucccuua

SEQ ID NO: 2658594 - RNA, 19 nt, Human
uuagccagguaaugugaau

SEQ ID NO: 2658595 - RNA, 15 nt, Human
auaauugaaguguau

SEQ ID NO: 2658596 - RNA, 17 nt, Human
uuagccagauuugucuu

SEQ ID NO: 2658597 - RNA, 18 nt, Human
uuagccaagugugguaga

SEQ ID NO: 2658598 - RNA, 23 nt, Human
uuacucucuugcaccaaauuauc

SEQ ID NO: 2658599 - RNA, 14 nt, Human
uuaccuuucucucu

SEQ ID NO: 2658600 - RNA, 18 nt, Human
uuaccuagcuaauuauuu

SEQ ID NO: 2658601 - RNA, 21 nt, Human
uuaccuagcuaauuauuuaau

SEQ ID NO: 2658602 - RNA, 13 nt, Human
uuaccuagugaaa

SEQ ID NO: 2658603 - RNA, 15 nt, Human
uuaccuagugaaacu

SEQ ID NO: 2658604 - RNA, 19 nt, Human
uuaccuagugaaacuuuuc

SEQ ID NO: 2658605 - RNA, 21 nt, Human
uuaccuagugaaacuuuucua

SEQ ID NO: 2658606 - RNA, 22 nt, Human
uuaccuagugaaacuuuucuag

SEQ ID NO: 2658607 - RNA, 15 nt, Human
auaacuguguacugu

SEQ ID NO: 2658608 - RNA, 16 nt, Human
auaacuguguacuguu

SEQ ID NO: 2658609 - RNA, 17 nt, Human
auaaauuauuugauuau

SEQ ID NO: 2658610 - RNA, 19 nt, Human
auaaauuauuugauuauuu

SEQ ID NO: 2658611 - RNA, 15 nt, Human
auaaauucaacuuug

SEQ ID NO: 2658612 - RNA, 20 nt, Human
auaaauucaacuuuguaaaa

SEQ ID NO: 2658613 - RNA, 19 nt, Human
auaaaucauucuuacuaaa

SEQ ID NO: 2658614 - RNA, 20 nt, Human
auaaaucauucuuacuaaaa

SEQ ID NO: 2658615 - RNA, 21 nt, Human
auaaaucauucuuacuaaaaa

SEQ ID NO: 2658616 - RNA, 13 nt, Human
auaaauccaguga

SEQ ID NO: 2658617 - RNA, 14 nt, Human
auaaauccagugac

SEQ ID NO: 2658618 - RNA, 15 nt, Human
auaaauccagugacc

SEQ ID NO: 2658619 - RNA, 20 nt, Human
auaaauccagugaccucucu

SEQ ID NO: 2658620 - RNA, 22 nt, Human
auaaauccagugaccucucucu

SEQ ID NO: 2658621 - RNA, 23 nt, Human
auaaauccagugaccucucucuc

SEQ ID NO: 2658622 - RNA, 16 nt, Human
auaaaguaaauacaug

SEQ ID NO: 2658623 - RNA, 18 nt, Human
auaaaguaaauacaugca

SEQ ID NO: 2658624 - RNA, 21 nt, Human
uuaauugugugaacuuggaag

SEQ ID NO: 2658625 - RNA, 16 nt, Human
uuaauugugugaacuu

SEQ ID NO: 2658626 - RNA, 15 nt, Human
uuaauuguaaaguaa

SEQ ID NO: 2658627 - RNA, 13 nt, Human
uuaauuguauuuu

SEQ ID NO: 2658628 - RNA, 14 nt, Human
uuaauuguaaagua

SEQ ID NO: 2658629 - RNA, 15 nt, Human
auaaauauauacauu

SEQ ID NO: 2658630 - RNA, 13 nt, Human
uuuggcauuugca

SEQ ID NO: 2658631 - RNA, 23 nt, Human
uuuggcauguaaauguaaacuca

SEQ ID NO: 2658632 - RNA, 19 nt, Human
uuuggcccaaucucugcca

SEQ ID NO: 2658633 - RNA, 23 nt, Human
uuugcugucccauagucccugcc

SEQ ID NO: 2658634 - RNA, 16 nt, Human
uuugcuuagaaaagaa

SEQ ID NO: 2658635 - RNA, 12 nt, Human
uuugcuuagaaa

SEQ ID NO: 2658636 - RNA, 22 nt, Human
uuugggaggccaaggugggagg

SEQ ID NO: 2658637 - RNA, 20 nt, Human
uuugcuaauuaacugaaaca

SEQ ID NO: 2658638 - RNA, 15 nt, Human
uuugcaauaacagcu

SEQ ID NO: 2658639 - RNA, 16 nt, Human
uuugcaauaacagcug

SEQ ID NO: 2658640 - RNA, 17 nt, Human
uuugcaauaacagcugc

SEQ ID NO: 2658641 - RNA, 19 nt, Human
uuugcaauaacagcugcaa

SEQ ID NO: 2658642 - RNA, 14 nt, Human
uuugcaagugcugg

SEQ ID NO: 2658643 - RNA, 18 nt, Human
uuugcaauaaaaaugaua

SEQ ID NO: 2658644 - RNA, 14 nt, Human
uuugccauugugaa

SEQ ID NO: 2658645 - RNA, 17 nt, Human
uuugccauugugaacca

SEQ ID NO: 2658646 - RNA, 19 nt, Human
uuugcacauguuuccucua

SEQ ID NO: 2658647 - RNA, 21 nt, Human
uuugcuacuguuguaagaauu

SEQ ID NO: 2658648 - RNA, 12 nt, Human
auguauaaauau

SEQ ID NO: 2658649 - RNA, 14 nt, Human
auguauaaauauac

SEQ ID NO: 2658650 - RNA, 16 nt, Human
auguauaaauauacag

SEQ ID NO: 2658651 - RNA, 17 nt, Human
auguauaaauauacagu

SEQ ID NO: 2658652 - RNA, 14 nt, Human
auguauaaaauaca

SEQ ID NO: 2658653 - RNA, 15 nt, Human
auguauaaaauacau

SEQ ID NO: 2658654 - RNA, 20 nt, Human
auguauaaaauacauaguga

SEQ ID NO: 2658655 - RNA, 22 nt, Human
auguauaaaauacauagugaaa

SEQ ID NO: 2658656 - RNA, 21 nt, Human
auguauaaacuuuagaguaga

SEQ ID NO: 2658657 - RNA, 22 nt, Human
augucagcaguugcugguaaaa

SEQ ID NO: 2658658 - RNA, 21 nt, Human
augucagcaguugcugguaaa

SEQ ID NO: 2658659 - RNA, 13 nt, Human
auguccauacacu

SEQ ID NO: 2658660 - RNA, 21 nt, Human
auguccauacacuuuguugca

SEQ ID NO: 2658661 - RNA, 21 nt, Human
auguccaguaagaucacuguu

SEQ ID NO: 2658662 - RNA, 22 nt, Human
uuuuaaccgguaagaguuucag

SEQ ID NO: 2658663 - RNA, 13 nt, Human
uuuuaaggucuuu

SEQ ID NO: 2658664 - RNA, 17 nt, Human
uuuuaaggucuuucagu

SEQ ID NO: 2658665 - RNA, 18 nt, Human
uuuuaaggucuuucagua

SEQ ID NO: 2658666 - RNA, 21 nt, Human
uuuuaaggucuuucaguacuu

SEQ ID NO: 2658667 - RNA, 23 nt, Human
uuuuaaggucuuucaguacuuuu

SEQ ID NO: 2658668 - RNA, 15 nt, Human
uuuuaaggaaaacua

SEQ ID NO: 2658669 - RNA, 15 nt, Human
uuuuaaggacugacu

SEQ ID NO: 2658670 - RNA, 21 nt, Human
uuuuaagcugcaaaucugaug

SEQ ID NO: 2658671 - RNA, 22 nt, Human
uuuuaaggacugacugaggcag

SEQ ID NO: 2658672 - RNA, 19 nt, Human
uuuuaaggacugacugagg

SEQ ID NO: 2658673 - RNA, 16 nt, Human
uuuuaaggacugacug

SEQ ID NO: 2658674 - RNA, 13 nt, Human
uuuuaagauagug

SEQ ID NO: 2658675 - RNA, 14 nt, Human
uuuuaagauagugu

SEQ ID NO: 2658676 - RNA, 15 nt, Human
uuuuaagauagugua

SEQ ID NO: 2658677 - RNA, 16 nt, Human
uuuuaagauaguguaa

SEQ ID NO: 2658678 - RNA, 23 nt, Human
uuuuaagauaguguaacuugcuu

SEQ ID NO: 2658679 - RNA, 13 nt, Human
uuuuaaaaaccua

SEQ ID NO: 2658680 - RNA, 15 nt, Human
uuuuaaaacuggacc

SEQ ID NO: 2658681 - RNA, 17 nt, Human
uuuuaaaacuggaccug

SEQ ID NO: 2658682 - RNA, 20 nt, Human
uuuuaaaacuggaccuguau

SEQ ID NO: 2658683 - RNA, 21 nt, Human
uuuuaaaaaucuaagcagcuu

SEQ ID NO: 2658684 - RNA, 19 nt, Human
uuuuaaaaauuguuauuua

SEQ ID NO: 2658685 - RNA, 13 nt, Human
uuuuaaaacacau

SEQ ID NO: 2658686 - RNA, 11 nt, Human
uuuuaaaacac

SEQ ID NO: 2658687 - RNA, 20 nt, Human
uuuuaaaacacauguuuuua

SEQ ID NO: 2658688 - RNA, 21 nt, Human
uuuuaaaaaacugcugacugu

SEQ ID NO: 2658689 - RNA, 18 nt, Human
uuuuaaaaaauauuuucu

SEQ ID NO: 2658690 - RNA, 20 nt, Human
uuuuaaaaacauaacauaaa

SEQ ID NO: 2658691 - RNA, 17 nt, Human
uuuuaaaaaauggucac

SEQ ID NO: 2658692 - RNA, 16 nt, Human
uuuuaaaaaaugguca

SEQ ID NO: 2658693 - RNA, 12 nt, Human
augucuguaaau

SEQ ID NO: 2658694 - RNA, 20 nt, Human
augucucaaggcaguuaauu

SEQ ID NO: 2658695 - RNA, 16 nt, Human
uuuguaaauuuagugu

SEQ ID NO: 2658696 - RNA, 16 nt, Human
uuuguaaauucugauu

SEQ ID NO: 2658697 - RNA, 15 nt, Human
uuuguaaauucugau

SEQ ID NO: 2658698 - RNA, 12 nt, Human
uuuguaaauucu

SEQ ID NO: 2658699 - RNA, 18 nt, Human
uuuguaaauuauuuaugu

SEQ ID NO: 2658700 - RNA, 20 nt, Human
uuuguaaauucugauuucuu

SEQ ID NO: 2658701 - RNA, 19 nt, Human
uuuguaaauucugauuucu

SEQ ID NO: 2658702 - RNA, 18 nt, Human
uuuguacauuugggaguu

SEQ ID NO: 2658703 - RNA, 20 nt, Human
uuuguacgacgucagauguu

SEQ ID NO: 2658704 - RNA, 15 nt, Human
uuuguacugaauuuu

SEQ ID NO: 2658705 - RNA, 16 nt, Human
uuuguacugaauuuuu

SEQ ID NO: 2658706 - RNA, 22 nt, Human
uuuguacugaauuuuuuuguaa

SEQ ID NO: 2658707 - RNA, 19 nt, Human
uuugucgcucaugugugca

SEQ ID NO: 2658708 - RNA, 13 nt, Human
uuugucugguuaa

SEQ ID NO: 2658709 - RNA, 22 nt, Human
uuugugagaaacaucucaauaa

SEQ ID NO: 2658710 - RNA, 18 nt, Human
auguuguaguguccccca

SEQ ID NO: 2658711 - RNA, 12 nt, Human
auguuguagugu

SEQ ID NO: 2658712 - RNA, 19 nt, Human
auguuguagugucccccac

SEQ ID NO: 2658713 - RNA, 19 nt, Human
uuuucuauuauggaaaacu

SEQ ID NO: 2658714 - RNA, 23 nt, Human
uuuucuauuauggaaaacugugu

SEQ ID NO: 2658715 - RNA, 19 nt, Human
uuuucuauuauuuuuauaa

SEQ ID NO: 2658716 - RNA, 18 nt, Human
auuaaaaaagcauacuuc

SEQ ID NO: 2658717 - RNA, 19 nt, Human
auuaaaaaagcauacuucu

SEQ ID NO: 2658718 - RNA, 17 nt, Human
auuaaaaauaucaaauu

SEQ ID NO: 2658719 - RNA, 19 nt, Human
auuaacuuaauaaucaaga

SEQ ID NO: 2658720 - RNA, 14 nt, Human
auuaacuuaauaau

SEQ ID NO: 2658721 - RNA, 16 nt, Human
auuaacuuaauaauca

SEQ ID NO: 2658722 - RNA, 17 nt, Human
auuaaccuuacuaauua

SEQ ID NO: 2658723 - RNA, 14 nt, Human
auuaacugaaacau

SEQ ID NO: 2658724 - RNA, 19 nt, Human
auuaaaggcauaaaugacu

SEQ ID NO: 2658725 - RNA, 18 nt, Human
auuaaaggaagcacucug

SEQ ID NO: 2658726 - RNA, 17 nt, Human
auuaaccacuucagcug

SEQ ID NO: 2658727 - RNA, 20 nt, Human
auuaaccacuucagcugacu

SEQ ID NO: 2658728 - RNA, 18 nt, Human
auuaaccacuucagcuga

SEQ ID NO: 2658729 - RNA, 12 nt, Human
uuuuaaguucuu

SEQ ID NO: 2658730 - RNA, 13 nt, Human
uuuuaaguucuua

SEQ ID NO: 2658731 - RNA, 15 nt, Human
uuuuaaguucuuaug

SEQ ID NO: 2658732 - RNA, 21 nt, Human
auguugauuuuuacuguguuu

SEQ ID NO: 2658733 - RNA, 17 nt, Human
uuuuagaugguuucuug

SEQ ID NO: 2658734 - RNA, 18 nt, Human
auguugaucauguacuuu

SEQ ID NO: 2658735 - RNA, 16 nt, Human
auguugauuuuuacug

SEQ ID NO: 2658736 - RNA, 17 nt, Human
auguugauuuuuacugu

SEQ ID NO: 2658737 - RNA, 20 nt, Human
auguugauuuuuacuguguu

SEQ ID NO: 2658738 - RNA, 23 nt, Human
auguugauuuuuacuguguuuua

SEQ ID NO: 2658739 - RNA, 16 nt, Human
uuuuauaauuguacaa

SEQ ID NO: 2658740 - RNA, 18 nt, Human
uuuuaugugagagaaagu

SEQ ID NO: 2658741 - RNA, 17 nt, Human
uuuuaugguuacuucuu

SEQ ID NO: 2658742 - RNA, 15 nt, Human
uuuuaugguuauguu

SEQ ID NO: 2658743 - RNA, 22 nt, Human
uuuuauaaaauggcuguaauca

SEQ ID NO: 2658744 - RNA, 15 nt, Human
auguugagagguucu

SEQ ID NO: 2658745 - RNA, 12 nt, Human
uuuuauaaagca

SEQ ID NO: 2658746 - RNA, 15 nt, Human
uuuuauaaagcaugu

SEQ ID NO: 2658747 - RNA, 19 nt, Human
uuuuccagguuuaagcugu

SEQ ID NO: 2658748 - RNA, 17 nt, Human
uuuucauuccuaaagaa

SEQ ID NO: 2658749 - RNA, 21 nt, Human
uuuucauucagguauuuguaa

SEQ ID NO: 2658750 - RNA, 19 nt, Human
auuaucaauaucuaauaua

SEQ ID NO: 2658751 - RNA, 17 nt, Human
auuaucaauaucuaaua

SEQ ID NO: 2658752 - RNA, 15 nt, Human
auuaucaauaucuaa

SEQ ID NO: 2658753 - RNA, 14 nt, Human
auuaucugggcuua

SEQ ID NO: 2658754 - RNA, 15 nt, Human
auuaucuugauacau

SEQ ID NO: 2658755 - RNA, 16 nt, Human
auuaucuugauacauu

SEQ ID NO: 2658756 - RNA, 18 nt, Human
auuaucuugauacauuca

SEQ ID NO: 2658757 - RNA, 20 nt, Human
auuaucuugauacauucaaa

SEQ ID NO: 2658758 - RNA, 23 nt, Human
auuaucuugauacauucaaauuu

SEQ ID NO: 2658759 - RNA, 16 nt, Human
auuauguuuuuuaaaa

SEQ ID NO: 2658760 - RNA, 20 nt, Human
auuauguuuuuuaaaauauu

SEQ ID NO: 2658761 - RNA, 22 nt, Human
auuauuuauauggggaauauau

SEQ ID NO: 2658762 - RNA, 13 nt, Human
auuauuuauuauu

SEQ ID NO: 2658763 - RNA, 13 nt, Human
auuauuuuaaaaa

SEQ ID NO: 2658764 - RNA, 12 nt, Human
auuauuuauaau

SEQ ID NO: 2658765 - RNA, 15 nt, Human
auuauuuaauugucc

SEQ ID NO: 2658766 - RNA, 13 nt, Human
auuauuuauaugg

SEQ ID NO: 2658767 - RNA, 12 nt, Human
auuauucucugc

SEQ ID NO: 2658768 - RNA, 12 nt, Human
auuauugacacu

SEQ ID NO: 2658769 - RNA, 13 nt, Human
auuauugacacug

SEQ ID NO: 2658770 - RNA, 14 nt, Human
auuauugacacuga

SEQ ID NO: 2658771 - RNA, 15 nt, Human
auuauugacacugaa

SEQ ID NO: 2658772 - RNA, 16 nt, Human
auuauugacacugaac

SEQ ID NO: 2658773 - RNA, 18 nt, Human
auuauugacacugaacuu

SEQ ID NO: 2658774 - RNA, 17 nt, Human
auuacuuguugccuaua

SEQ ID NO: 2658775 - RNA, 18 nt, Human
auuacuuguugccuauaa

SEQ ID NO: 2658776 - RNA, 15 nt, Human
auuagaagacaacag

SEQ ID NO: 2658777 - RNA, 14 nt, Human
auuauaaucuuaua

SEQ ID NO: 2658778 - RNA, 15 nt, Human
auuauaauaaauaua

SEQ ID NO: 2658779 - RNA, 19 nt, Human
auuauaauaaauauauaca

SEQ ID NO: 2658780 - RNA, 18 nt, Human
auuauaaucuuauaauug

SEQ ID NO: 2658781 - RNA, 22 nt, Human
auuaauauauguauuauuuaua

SEQ ID NO: 2658782 - RNA, 21 nt, Human
auuaauauauguauuauuuau

SEQ ID NO: 2658783 - RNA, 16 nt, Human
auuaauauauguauua

SEQ ID NO: 2658784 - RNA, 20 nt, Human
auuaauauauguauuauuua

SEQ ID NO: 2658785 - RNA, 20 nt, Human
auuaagguguuugaaaauag

SEQ ID NO: 2658786 - RNA, 18 nt, Human
auuaagguguuugaaaau

SEQ ID NO: 2658787 - RNA, 17 nt, Human
auuaagguguuugaaaa

SEQ ID NO: 2658788 - RNA, 15 nt, Human
auuaagguguuugaa

SEQ ID NO: 2658789 - RNA, 12 nt, Human
uuuuuguuugcc

SEQ ID NO: 2658790 - RNA, 11 nt, Human
uuuuuguuugg

SEQ ID NO: 2658791 - RNA, 14 nt, Human
uuuuuguuuggaga

SEQ ID NO: 2658792 - RNA, 16 nt, Human
uuuuuguuuuucugcu

SEQ ID NO: 2658793 - RNA, 14 nt, Human
uuuuuguuuuucug

SEQ ID NO: 2658794 - RNA, 14 nt, Human
auuacugccuugaa

SEQ ID NO: 2658795 - RNA, 15 nt, Human
auuacugccuugaaa

SEQ ID NO: 2658796 - RNA, 13 nt, Human
auuacugacauuu

SEQ ID NO: 2658797 - RNA, 15 nt, Human
auuacugacauuucu

SEQ ID NO: 2658798 - RNA, 16 nt, Human
auuacugacauuucuu

SEQ ID NO: 2658799 - RNA, 21 nt, Human
auuacugacauuucuucuagu

SEQ ID NO: 2658800 - RNA, 23 nt, Human
auuaauauucaggguaaauagga

SEQ ID NO: 2658801 - RNA, 11 nt, Human
auuaaugcacu

SEQ ID NO: 2658802 - RNA, 13 nt, Human
auuauuaauugca

SEQ ID NO: 2658803 - RNA, 18 nt, Human
auucagcucugcaagaau

SEQ ID NO: 2658804 - RNA, 14 nt, Human
auucagcucugcaa

SEQ ID NO: 2658805 - RNA, 21 nt, Human
auucaggaauguguggccugc

SEQ ID NO: 2658806 - RNA, 16 nt, Human
auuccacuacaccugg

SEQ ID NO: 2658807 - RNA, 12 nt, Human
auucauaaaucu

SEQ ID NO: 2658808 - RNA, 17 nt, Human
auuccacuacaccuggc

SEQ ID NO: 2658809 - RNA, 18 nt, Human
auuccacuacaccuggcu

SEQ ID NO: 2658810 - RNA, 19 nt, Human
auuccacuacaccuggcug

SEQ ID NO: 2658811 - RNA, 22 nt, Human
auuccacuacaccuggcugagg

SEQ ID NO: 2658812 - RNA, 16 nt, Human
auucccuuguuauuca

SEQ ID NO: 2658813 - RNA, 14 nt, Human
auuccgcaucccua

SEQ ID NO: 2658814 - RNA, 22 nt, Human
auuccggaaacuaguguacauu

SEQ ID NO: 2658815 - RNA, 23 nt, Human
auuccggaaacuaguguacauuu

SEQ ID NO: 2658816 - RNA, 19 nt, Human
auucccuuguuauucaaca

SEQ ID NO: 2658817 - RNA, 22 nt, Human
auuccccacccugaaagcccug

SEQ ID NO: 2658818 - RNA, 20 nt, Human
auuuaacauuauuuauaugg

SEQ ID NO: 2658819 - RNA, 17 nt, Human
auuuaacauuauuuaua

SEQ ID NO: 2658820 - RNA, 16 nt, Human
auuuaacauuauuuau

SEQ ID NO: 2658821 - RNA, 15 nt, Human
auuuaacauuauuua

SEQ ID NO: 2658822 - RNA, 20 nt, Human
auuuaacagaaauuguauau

SEQ ID NO: 2658823 - RNA, 22 nt, Human
auuuaacagaaauuguauauug

SEQ ID NO: 2658824 - RNA, 14 nt, Human
auuuaacagaaauu

SEQ ID NO: 2658825 - RNA, 16 nt, Human
auuuaacagaaauugu

SEQ ID NO: 2658826 - RNA, 17 nt, Human
auuuaacagaaauugua

SEQ ID NO: 2658827 - RNA, 18 nt, Human
auuuaacagaaauuguau

SEQ ID NO: 2658828 - RNA, 20 nt, Human
auugucuccuauauauuucu

SEQ ID NO: 2658829 - RNA, 22 nt, Human
auugucuccuauauauuucuau

SEQ ID NO: 2658830 - RNA, 23 nt, Human
auugucuccuauauauuucuauu

SEQ ID NO: 2658831 - RNA, 18 nt, Human
auugucuuuggugcuuuu

SEQ ID NO: 2658832 - RNA, 16 nt, Human
auuguuucucugaaag

SEQ ID NO: 2658833 - RNA, 12 nt, Human
auuguuucugca

SEQ ID NO: 2658834 - RNA, 17 nt, Human
auuguuucugcauucau

SEQ ID NO: 2658835 - RNA, 17 nt, Human
auuguggcuauccugau

SEQ ID NO: 2658836 - RNA, 13 nt, Human
auuguuucagaau

SEQ ID NO: 2658837 - RNA, 24 nt, Human
auugugcuucacaguagagccagc

SEQ ID NO: 2658838 - RNA, 15 nt, Human
auugugcucagagac

SEQ ID NO: 2658839 - RNA, 15 nt, Human
auugugcuucacagu

SEQ ID NO: 2658840 - RNA, 20 nt, Human
auugugcuucacaguagagc

SEQ ID NO: 2658841 - RNA, 15 nt, Human
auuguauauuguaau

SEQ ID NO: 2658842 - RNA, 17 nt, Human
auuguauauuguaauuu

SEQ ID NO: 2658843 - RNA, 13 nt, Human
auuguauauugua

SEQ ID NO: 2658844 - RNA, 20 nt, Human
auuguauauuacaaugauca

SEQ ID NO: 2658845 - RNA, 19 nt, Human
auuguauauuacaaugauc

SEQ ID NO: 2658846 - RNA, 18 nt, Human
auuguauauuacaaugau

SEQ ID NO: 2658847 - RNA, 17 nt, Human
auuguauauuacaauga

SEQ ID NO: 2658848 - RNA, 15 nt, Human
auuguauauuacaau

SEQ ID NO: 2658849 - RNA, 18 nt, Human
auugccccaucuagacua

SEQ ID NO: 2658850 - RNA, 23 nt, Human
auuggcuuuggguugcaggaccu

SEQ ID NO: 2658851 - RNA, 22 nt, Human
auugaccuauuuccagaaauac

SEQ ID NO: 2658852 - RNA, 13 nt, Human
auugccucugaaa

SEQ ID NO: 2658853 - RNA, 18 nt, Human
auugccucugaaaagugu

SEQ ID NO: 2658854 - RNA, 12 nt, Human
auugccaugugg

SEQ ID NO: 2658855 - RNA, 21 nt, Human
auugccagcugacaucuugaa

SEQ ID NO: 2658856 - RNA, 14 nt, Human
auugcaguuuauca

SEQ ID NO: 2658857 - RNA, 17 nt, Human
auugcaguuuaucauuc

SEQ ID NO: 2658858 - RNA, 18 nt, Human
auugcaguuuaucauuca

SEQ ID NO: 2658859 - RNA, 19 nt, Human
auugcaguuuaucauucaa

SEQ ID NO: 2658860 - RNA, 14 nt, Human
auuuuacacagaaa

SEQ ID NO: 2658861 - RNA, 15 nt, Human
auuuuacacagaaac

SEQ ID NO: 2658862 - RNA, 17 nt, Human
auuuuacacagaaacac

SEQ ID NO: 2658863 - RNA, 13 nt, Human
auuuuacagagcg

SEQ ID NO: 2658864 - RNA, 18 nt, Human
auuuuacagcucauuaaa

SEQ ID NO: 2658865 - RNA, 22 nt, Human
auuuuacagcucauuaaacuuu

SEQ ID NO: 2658866 - RNA, 23 nt, Human
auuuuacagcucauuaaacuuuu

SEQ ID NO: 2658867 - RNA, 23 nt, Human
auuuuacacagaaacacugccuu

SEQ ID NO: 2658868 - RNA, 18 nt, Human
auuuuacacagaaacacu

SEQ ID NO: 2658869 - RNA, 19 nt, Human
auuuuacacagaaacacug

SEQ ID NO: 2658870 - RNA, 20 nt, Human
auuuuacacagaaacacugc

SEQ ID NO: 2658871 - RNA, 22 nt, Human
auuuuacacagaaacacugccu

SEQ ID NO: 2658872 - RNA, 22 nt, Human
auuuuacaagggcauaaaguaa

SEQ ID NO: 2658873 - RNA, 16 nt, Human
auuugagcauaucagu

SEQ ID NO: 2658874 - RNA, 19 nt, Human
auuuuauuuagacaagaga

SEQ ID NO: 2658875 - RNA, 17 nt, Human
auuuuauuuagacaaga

SEQ ID NO: 2658876 - RNA, 22 nt, Human
auuuuauuuagacaagagaugg

SEQ ID NO: 2658877 - RNA, 15 nt, Human
auuuuauuacuguuu

SEQ ID NO: 2658878 - RNA, 16 nt, Human
auuuuauuacuguuua

SEQ ID NO: 2658879 - RNA, 18 nt, Human
auuuuauuacuguuuauu

SEQ ID NO: 2658880 - RNA, 24 nt, Human
auuuagggaguauucuaauaagcu

SEQ ID NO: 2658881 - RNA, 22 nt, Human
auuuauguuugcacuugugauu

SEQ ID NO: 2658882 - RNA, 14 nt, Human
auuuaguaagaaua

SEQ ID NO: 2658883 - RNA, 15 nt, Human
auuuaguaagaauac

SEQ ID NO: 2658884 - RNA, 13 nt, Human
auuuauguuugca

SEQ ID NO: 2658885 - RNA, 20 nt, Human
auuuagggaguauucuaaua

SEQ ID NO: 2658886 - RNA, 19 nt, Human
auuuagggaguauucuaau

SEQ ID NO: 2658887 - RNA, 18 nt, Human
auuuagggaguauucuaa

SEQ ID NO: 2658888 - RNA, 16 nt, Human
auuuagggaguauucu

SEQ ID NO: 2658889 - RNA, 16 nt, Human
auuuagccgggcgcgg

SEQ ID NO: 2658890 - RNA, 17 nt, Human
auuuguaaagcuauuua

SEQ ID NO: 2658891 - RNA, 19 nt, Human
auuuguaaagcuauuuaug

SEQ ID NO: 2658892 - RNA, 20 nt, Human
auuucuuuucaccauucgua

SEQ ID NO: 2658893 - RNA, 15 nt, Human
auauauaugaauaaa

SEQ ID NO: 2658894 - RNA, 14 nt, Human
auauauaugaauaa

SEQ ID NO: 2658895 - RNA, 17 nt, Human
auauauaauguugccag

SEQ ID NO: 2658896 - RNA, 15 nt, Human
auauauauaaaugua

SEQ ID NO: 2658897 - RNA, 16 nt, Human
auauauauaaauguau

SEQ ID NO: 2658898 - RNA, 16 nt, Human
auauauauaacauaua

SEQ ID NO: 2658899 - RNA, 11 nt, Human
auauauauaau

SEQ ID NO: 2658900 - RNA, 17 nt, Human
auauauacaaaaagaaa

SEQ ID NO: 2658901 - RNA, 15 nt, Human
auauauaucuauaua

SEQ ID NO: 2658902 - RNA, 21 nt, Human
auauauaucuauauauauaau

SEQ ID NO: 2658903 - RNA, 21 nt, Human
auauauaucuaucuauuugag

SEQ ID NO: 2658904 - RNA, 15 nt, Human
auauauauauauaac

SEQ ID NO: 2658905 - RNA, 12 nt, Human
auauaugaauaa

SEQ ID NO: 2658906 - RNA, 19 nt, Human
auauaucuuauaaagugga

SEQ ID NO: 2658907 - RNA, 16 nt, Human
auauaucucuauuuga

SEQ ID NO: 2658908 - RNA, 17 nt, Human
auauaucucuauuugag

SEQ ID NO: 2658909 - RNA, 15 nt, Human
auauaucuaucuauu

SEQ ID NO: 2658910 - RNA, 16 nt, Human
auauaucuaucuauuu

SEQ ID NO: 2658911 - RNA, 18 nt, Human
auauaucuaucuauuuga

SEQ ID NO: 2658912 - RNA, 19 nt, Human
auauaucuaucuauuugag

SEQ ID NO: 2658913 - RNA, 20 nt, Human
auauaucuaucuauuugagg

SEQ ID NO: 2658914 - RNA, 22 nt, Human
uucacuuaugaaugauuugcau

SEQ ID NO: 2658915 - RNA, 17 nt, Human
auauauaaaacggugcu

SEQ ID NO: 2658916 - RNA, 21 nt, Human
auauauaaaacggugcuguga

SEQ ID NO: 2658917 - RNA, 12 nt, Human
auauauaaaugu

SEQ ID NO: 2658918 - RNA, 13 nt, Human
auauauaaaugua

SEQ ID NO: 2658919 - RNA, 14 nt, Human
auauauaaauguau

SEQ ID NO: 2658920 - RNA, 15 nt, Human
auauauaaauguaua

SEQ ID NO: 2658921 - RNA, 16 nt, Human
auauauaaauguauaa

SEQ ID NO: 2658922 - RNA, 18 nt, Human
auauauaacauauaugga

SEQ ID NO: 2658923 - RNA, 12 nt, Human
auauaacacauu

SEQ ID NO: 2658924 - RNA, 14 nt, Human
auauaacacauuuu

SEQ ID NO: 2658925 - RNA, 15 nt, Human
auauaacacauuuuu

SEQ ID NO: 2658926 - RNA, 13 nt, Human
auauaacauauau

SEQ ID NO: 2658927 - RNA, 16 nt, Human
auauaacauauaugga

SEQ ID NO: 2658928 - RNA, 17 nt, Human
auauaacuguauuugaa

SEQ ID NO: 2658929 - RNA, 20 nt, Human
auauaacuguauuugaaaua

SEQ ID NO: 2658930 - RNA, 19 nt, Human
auauaaaguaguccuguga

SEQ ID NO: 2658931 - RNA, 19 nt, Human
auaguucugagcugccagu

SEQ ID NO: 2658932 - RNA, 12 nt, Human
auaguuacugug

SEQ ID NO: 2658933 - RNA, 19 nt, Human
auaguuauguaaauaauuc

SEQ ID NO: 2658934 - RNA, 14 nt, Human
auaguuauguaaau

SEQ ID NO: 2658935 - RNA, 18 nt, Human
auaguuauguaaauaauu

SEQ ID NO: 2658936 - RNA, 17 nt, Human
auaguuauguaaauaau

SEQ ID NO: 2658937 - RNA, 16 nt, Human
auaguuauguaaauaa

SEQ ID NO: 2658938 - RNA, 15 nt, Human
auaguuauguaaaua

SEQ ID NO: 2658939 - RNA, 16 nt, Human
auaguuacuguguaaa

SEQ ID NO: 2658940 - RNA, 17 nt, Human
auaguuacuguguaaac

SEQ ID NO: 2658941 - RNA, 18 nt, Human
auaguuacuguguaaacu

SEQ ID NO: 2658942 - RNA, 20 nt, Human
auaguuacuguguaaacuca

SEQ ID NO: 2658943 - RNA, 23 nt, Human
auaguuggaggugauuccaguga

SEQ ID NO: 2658944 - RNA, 23 nt, Human
auauaaaaaccccaaacuguuga

SEQ ID NO: 2658945 - RNA, 16 nt, Human
auaguuuuauuuauau

SEQ ID NO: 2658946 - RNA, 24 nt, Human
auaguuuuauuuauauuuauugac

SEQ ID NO: 2658947 - RNA, 18 nt, Human
auaguuuuauuuauauuu

SEQ ID NO: 2658948 - RNA, 14 nt, Human
auaguguaacuugc

SEQ ID NO: 2658949 - RNA, 18 nt, Human
auaguguaacuugcuuaa

SEQ ID NO: 2658950 - RNA, 23 nt, Human
auaguguaacuugcuuaaauuuc

SEQ ID NO: 2658951 - RNA, 15 nt, Human
auagugggauuucca

SEQ ID NO: 2658952 - RNA, 12 nt, Human
auagugucuuug

SEQ ID NO: 2658953 - RNA, 21 nt, Human
auaguuaaauguuaccucuga

SEQ ID NO: 2658954 - RNA, 21 nt, Human
auagucuaagacuauauauau

SEQ ID NO: 2658955 - RNA, 23 nt, Human
auagucuaagacuauauauauaa

SEQ ID NO: 2658956 - RNA, 17 nt, Human
auaggcuauuuucuaaa

SEQ ID NO: 2658957 - RNA, 18 nt, Human
auaggcuauuuucuaaag

SEQ ID NO: 2658958 - RNA, 20 nt, Human
auaggcuauuuucuaaagac

SEQ ID NO: 2658959 - RNA, 21 nt, Human
auaggcuauuuucuaaagacu

SEQ ID NO: 2658960 - RNA, 22 nt, Human
auaggcuauuuucuaaagacuu

SEQ ID NO: 2658961 - RNA, 21 nt, Human
auagucucuuuaaaaggaaag

SEQ ID NO: 2658962 - RNA, 14 nt, Human
auagucucuuuaaa

SEQ ID NO: 2658963 - RNA, 14 nt, Human
auagucuuuugcuu

SEQ ID NO: 2658964 - RNA, 16 nt, Human
auagucuuuugcuuuu

SEQ ID NO: 2658965 - RNA, 17 nt, Human
auagucuuuugcuuuug

SEQ ID NO: 2658966 - RNA, 15 nt, Human
auagugaucaagaag

SEQ ID NO: 2658967 - RNA, 20 nt, Human
auagugaucaagaagacuuu

SEQ ID NO: 2658968 - RNA, 16 nt, Human
uucaaguaauugugaa

SEQ ID NO: 2658969 - RNA, 23 nt, Human
auaggaccuuuccaccacagcca

SEQ ID NO: 2658970 - RNA, 14 nt, Human
auaggaccuuucca

SEQ ID NO: 2658971 - RNA, 20 nt, Human
auaggaccuuuccaccacag

SEQ ID NO: 2658972 - RNA, 21 nt, Human
auaggaacauaugaaaauaca

SEQ ID NO: 2658973 - RNA, 18 nt, Human
auaggaacauaugaaaau

SEQ ID NO: 2658974 - RNA, 16 nt, Human
auaggaacauaugaaa

SEQ ID NO: 2658975 - RNA, 15 nt, Human
auaggaacauaugaa

SEQ ID NO: 2658976 - RNA, 15 nt, Human
uucacauucuuggcu

SEQ ID NO: 2658977 - RNA, 16 nt, Human
uucacauucuuggcuu

SEQ ID NO: 2658978 - RNA, 14 nt, Human
uuauuuuuauaauu

SEQ ID NO: 2658979 - RNA, 16 nt, Human
uuauuuuuauaauugu

SEQ ID NO: 2658980 - RNA, 18 nt, Human
uuauuuuuauaauuguac

SEQ ID NO: 2658981 - RNA, 21 nt, Human
uuauuuuuauaauuguacaaa

SEQ ID NO: 2658982 - RNA, 14 nt, Human
uuauuuuucacucu

SEQ ID NO: 2658983 - RNA, 12 nt, Human
uucaaaagaaag

SEQ ID NO: 2658984 - RNA, 21 nt, Human
uuauuuuuuggacuucaaagc

SEQ ID NO: 2658985 - RNA, 16 nt, Human
uuauuuuuuuaaaauu

SEQ ID NO: 2658986 - RNA, 17 nt, Human
uuauuuuuuuaaaauuu

SEQ ID NO: 2658987 - RNA, 18 nt, Human
uuaguuuuugguugggaa

SEQ ID NO: 2658988 - RNA, 19 nt, Human
uuaguuuuugguugggaau

SEQ ID NO: 2658989 - RNA, 23 nt, Human
uuaguuuuugguugggaaugagg

SEQ ID NO: 2658990 - RNA, 16 nt, Human
uuaguuuguguguugu

SEQ ID NO: 2658991 - RNA, 13 nt, Human
uucaaaagaaagu

SEQ ID NO: 2658992 - RNA, 20 nt, Human
uucaaaagguauuauacaug

SEQ ID NO: 2658993 - RNA, 21 nt, Human
uucaaaagguauuauacaugu

SEQ ID NO: 2658994 - RNA, 22 nt, Human
uucaaggucacuguuuccuggg

SEQ ID NO: 2658995 - RNA, 17 nt, Human
uucaagcagucgugccu

SEQ ID NO: 2658996 - RNA, 18 nt, Human
uucaagcagucgugccug

SEQ ID NO: 2658997 - RNA, 22 nt, Human
uucaagcagucgugccuguguc

SEQ ID NO: 2658998 - RNA, 23 nt, Human
uucaagcagucgugccugugucc

SEQ ID NO: 2658999 - RNA, 13 nt, Human
uucaagaucaaaa

SEQ ID NO: 2659000 - RNA, 22 nt, Human
auaucuauuaauauauguauua

SEQ ID NO: 2659001 - RNA, 18 nt, Human
auaucuauuaauauaugu

SEQ ID NO: 2659002 - RNA, 15 nt, Human
auaucuauuaauaua

SEQ ID NO: 2659003 - RNA, 14 nt, Human
auaucuauuaauau

SEQ ID NO: 2659004 - RNA, 13 nt, Human
auaucuauuaaua

SEQ ID NO: 2659005 - RNA, 15 nt, Human
auaucuauauauaua

SEQ ID NO: 2659006 - RNA, 17 nt, Human
auaucuauauauauaau

SEQ ID NO: 2659007 - RNA, 18 nt, Human
auaucuauauauauaauu

SEQ ID NO: 2659008 - RNA, 19 nt, Human
auaucuauauauauaauuu

SEQ ID NO: 2659009 - RNA, 13 nt, Human
auaucuauaaaau

SEQ ID NO: 2659010 - RNA, 14 nt, Human
auaucuauaaaaua

SEQ ID NO: 2659011 - RNA, 15 nt, Human
auaucuauaaaauag

SEQ ID NO: 2659012 - RNA, 17 nt, Human
auaucuauaaaauagau

SEQ ID NO: 2659013 - RNA, 22 nt, Human
auaucuauaaaauagauauaaa

SEQ ID NO: 2659014 - RNA, 23 nt, Human
auaucuauaaaauagauauaaau

SEQ ID NO: 2659015 - RNA, 20 nt, Human
auaugaaaaaaaugcauuuu

SEQ ID NO: 2659016 - RNA, 16 nt, Human
auaugaaaauacaacu

SEQ ID NO: 2659017 - RNA, 13 nt, Human
auaucucuauuug

SEQ ID NO: 2659018 - RNA, 14 nt, Human
auaucucuauuuga

SEQ ID NO: 2659019 - RNA, 16 nt, Human
auaucucuauuugaga

SEQ ID NO: 2659020 - RNA, 23 nt, Human
auaucucaaugaaccauaaauuc

SEQ ID NO: 2659021 - RNA, 22 nt, Human
auaugauuaaaaauaucaaauu

SEQ ID NO: 2659022 - RNA, 21 nt, Human
auaugauuaaaaauaucaaau

SEQ ID NO: 2659023 - RNA, 14 nt, Human
auaugguauauaua

SEQ ID NO: 2659024 - RNA, 15 nt, Human
auaugguauauauac

SEQ ID NO: 2659025 - RNA, 18 nt, Human
auaugguauauauacaua

SEQ ID NO: 2659026 - RNA, 19 nt, Human
auaugguauauauacauau

SEQ ID NO: 2659027 - RNA, 23 nt, Human
auaugaaaauacaacuuaaauaa

SEQ ID NO: 2659028 - RNA, 11 nt, Human
auaugauuaaa

SEQ ID NO: 2659029 - RNA, 17 nt, Human
auaugauuaaaaauauc

SEQ ID NO: 2659030 - RNA, 23 nt, Human
auaucuuggccuaaaccucaguu

SEQ ID NO: 2659031 - RNA, 14 nt, Human
auauguaagggaaa

SEQ ID NO: 2659032 - RNA, 20 nt, Human
auauguaaucucuaggaagu

SEQ ID NO: 2659033 - RNA, 20 nt, Human
auauauguauuauuuauaau

SEQ ID NO: 2659034 - RNA, 19 nt, Human
auauauguauuauuuauaa

SEQ ID NO: 2659035 - RNA, 14 nt, Human
uucaucccauucca

SEQ ID NO: 2659036 - RNA, 15 nt, Human
uucaucccauuccag

SEQ ID NO: 2659037 - RNA, 13 nt, Human
uucauauguaauc

SEQ ID NO: 2659038 - RNA, 18 nt, Human
auauauucuuucaaagga

SEQ ID NO: 2659039 - RNA, 13 nt, Human
auauauugaacuu

SEQ ID NO: 2659040 - RNA, 15 nt, Human
auauauugaacuuuu

SEQ ID NO: 2659041 - RNA, 17 nt, Human
auauauugaacuuuugu

SEQ ID NO: 2659042 - RNA, 18 nt, Human
auauauugaacuuuugua

SEQ ID NO: 2659043 - RNA, 22 nt, Human
auauauugaacuuuuguacuga

SEQ ID NO: 2659044 - RNA, 15 nt, Human
uucagaaauauaaca

SEQ ID NO: 2659045 - RNA, 20 nt, Human
uucagaaauauaacacauuu

SEQ ID NO: 2659046 - RNA, 21 nt, Human
uucagaaauauaacacauuuu

SEQ ID NO: 2659047 - RNA, 22 nt, Human
uucagaaauauaacacauuuuu

SEQ ID NO: 2659048 - RNA, 16 nt, Human
uucauuccuaaagaaa

SEQ ID NO: 2659049 - RNA, 14 nt, Human
uucauucucuuuua

SEQ ID NO: 2659050 - RNA, 15 nt, Human
uucauuuaagggaaa

SEQ ID NO: 2659051 - RNA, 20 nt, Human
uucauuuaagggaaagaaaa

SEQ ID NO: 2659052 - RNA, 17 nt, Human
uuccacacagaaugcaa

SEQ ID NO: 2659053 - RNA, 19 nt, Human
uuccacacagaaugcaacc

SEQ ID NO: 2659054 - RNA, 15 nt, Human
uuccaauaaacuaug

SEQ ID NO: 2659055 - RNA, 15 nt, Human
uuccaccccaagaga

SEQ ID NO: 2659056 - RNA, 18 nt, Human
uuccaccccaagagaacu

SEQ ID NO: 2659057 - RNA, 19 nt, Human
uuccaccccaagagaacuc

SEQ ID NO: 2659058 - RNA, 20 nt, Human
uuccaccccaagagaacucg

SEQ ID NO: 2659059 - RNA, 21 nt, Human
uuccaggaaacuccacaucug

SEQ ID NO: 2659060 - RNA, 22 nt, Human
uuccaggaaacuccacaucugc

SEQ ID NO: 2659061 - RNA, 24 nt, Human
uuccaggaaacuccacaucugccu

SEQ ID NO: 2659062 - RNA, 23 nt, Human
uuccaggaaacuccacaucugcc

SEQ ID NO: 2659063 - RNA, 13 nt, Human
uuccaggcagccu

SEQ ID NO: 2659064 - RNA, 19 nt, Human
uuccaggcagccucuguca

SEQ ID NO: 2659065 - RNA, 11 nt, Human
uucccacccug

SEQ ID NO: 2659066 - RNA, 23 nt, Human
uucccaagccuucgggcgucugu

SEQ ID NO: 2659067 - RNA, 18 nt, Human
uuccaguggaucauaaga

SEQ ID NO: 2659068 - RNA, 22 nt, Human
uuccagugucuauaaaagaaac

SEQ ID NO: 2659069 - RNA, 23 nt, Human
uucccaaaggcauuauaaaaaga

SEQ ID NO: 2659070 - RNA, 20 nt, Human
uuccaggcuauguauaaaau

SEQ ID NO: 2659071 - RNA, 20 nt, Human
uuccagggucccucugugua

SEQ ID NO: 2659072 - RNA, 16 nt, Human
uuccagggucccucug

SEQ ID NO: 2659073 - RNA, 18 nt, Human
uuccagggucccucugug

SEQ ID NO: 2659074 - RNA, 19 nt, Human
uuccagggucccucugugu

SEQ ID NO: 2659075 - RNA, 16 nt, Human
auauuuuuagacucau

SEQ ID NO: 2659076 - RNA, 21 nt, Human
auauuuugucauaucaaauaa

SEQ ID NO: 2659077 - RNA, 13 nt, Human
auauuuuguguga

SEQ ID NO: 2659078 - RNA, 18 nt, Human
auauuuugugugaaauug

SEQ ID NO: 2659079 - RNA, 22 nt, Human
auauuuugugugaaauugcaua

SEQ ID NO: 2659080 - RNA, 13 nt, Human
auauuuucuguuu

SEQ ID NO: 2659081 - RNA, 12 nt, Human
auauuuucuguu

SEQ ID NO: 2659082 - RNA, 13 nt, Human
auauuuucuauuu

SEQ ID NO: 2659083 - RNA, 14 nt, Human
auauuuucuauuuu

SEQ ID NO: 2659084 - RNA, 13 nt, Human
auauuuucucugu

SEQ ID NO: 2659085 - RNA, 18 nt, Human
auauuuucucuguacuuu

SEQ ID NO: 2659086 - RNA, 22 nt, Human
uuccugucccugcgccuuuccu

SEQ ID NO: 2659087 - RNA, 14 nt, Human
uuccugucccugcg

SEQ ID NO: 2659088 - RNA, 21 nt, Human
uuccugucccugcgccuuucc

SEQ ID NO: 2659089 - RNA, 15 nt, Human
uuccugucccugcgc

SEQ ID NO: 2659090 - RNA, 12 nt, Human
uuccuguacugu

SEQ ID NO: 2659091 - RNA, 16 nt, Human
uuccuguacugugucu

SEQ ID NO: 2659092 - RNA, 18 nt, Human
uucccacuucccacccug

SEQ ID NO: 2659093 - RNA, 23 nt, Human
uuccuacguaggaugaaaagauu

SEQ ID NO: 2659094 - RNA, 18 nt, Human
uucgaagucauuaaacug

SEQ ID NO: 2659095 - RNA, 15 nt, Human
uucgaagucauuaaa

SEQ ID NO: 2659096 - RNA, 14 nt, Human
uucgaagucauuaa

SEQ ID NO: 2659097 - RNA, 13 nt, Human
uucgaagucauua

SEQ ID NO: 2659098 - RNA, 14 nt, Human
uucgagaccagccu

SEQ ID NO: 2659099 - RNA, 22 nt, Human
uucgaaaccugggauucaggaa

SEQ ID NO: 2659100 - RNA, 16 nt, Human
aucaaguucuuaaaau

SEQ ID NO: 2659101 - RNA, 16 nt, Human
uucuaagaaaagccua

SEQ ID NO: 2659102 - RNA, 18 nt, Human
uucuaagagaaguuauuu

SEQ ID NO: 2659103 - RNA, 19 nt, Human
uucgcggguaacugggguu

SEQ ID NO: 2659104 - RNA, 22 nt, Human
uucgcggguaacugggguugag

SEQ ID NO: 2659105 - RNA, 16 nt, Human
uucgccuuuccucucu

SEQ ID NO: 2659106 - RNA, 13 nt, Human
uucgccuuuccuc

SEQ ID NO: 2659107 - RNA, 23 nt, Human
uucuaaauacaugccacaucaaa

SEQ ID NO: 2659108 - RNA, 21 nt, Human
uucuagaaacaaacaucuaau

SEQ ID NO: 2659109 - RNA, 18 nt, Human
uucuagaauuauuuuuca

SEQ ID NO: 2659110 - RNA, 22 nt, Human
uucuagaguuuuauagccugga

SEQ ID NO: 2659111 - RNA, 23 nt, Human
uucuagugaugaugguucacguu

SEQ ID NO: 2659112 - RNA, 21 nt, Human
uucucacugccaugccagcuu

SEQ ID NO: 2659113 - RNA, 13 nt, Human
uucucagaagcac

SEQ ID NO: 2659114 - RNA, 21 nt, Human
uucucagaagcacagaauauu

SEQ ID NO: 2659115 - RNA, 20 nt, Human
aucacuuugagccugggaaa

SEQ ID NO: 2659116 - RNA, 22 nt, Human
aucacuuugagccugggaaaua

SEQ ID NO: 2659117 - RNA, 23 nt, Human
aucacuuugagccugggaaauaa

SEQ ID NO: 2659118 - RNA, 16 nt, Human
aucagaaagcuuuauu

SEQ ID NO: 2659119 - RNA, 19 nt, Human
aucagaaagcuuuauuuug

SEQ ID NO: 2659120 - RNA, 15 nt, Human
uucucagauuucuga

SEQ ID NO: 2659121 - RNA, 19 nt, Human
uucucagagugguggggga

SEQ ID NO: 2659122 - RNA, 16 nt, Human
uucucagauuucugag

SEQ ID NO: 2659123 - RNA, 20 nt, Human
uucucagauuucugaggaaa

SEQ ID NO: 2659124 - RNA, 22 nt, Human
aucaggaauauuuuccaaagag

SEQ ID NO: 2659125 - RNA, 19 nt, Human
aucaggaauauuuuccaaa

SEQ ID NO: 2659126 - RNA, 17 nt, Human
uucucuacucuagggaa

SEQ ID NO: 2659127 - RNA, 19 nt, Human
uucucuuugauuauuugca

SEQ ID NO: 2659128 - RNA, 20 nt, Human
uucucuuugauuauuugcau

SEQ ID NO: 2659129 - RNA, 22 nt, Human
uucucuuugauuauuugcaugu

SEQ ID NO: 2659130 - RNA, 19 nt, Human
uucugcccuggcugcugcc

SEQ ID NO: 2659131 - RNA, 18 nt, Human
uucugcccuggcugcugc

SEQ ID NO: 2659132 - RNA, 16 nt, Human
aucauuucaggaguua

SEQ ID NO: 2659133 - RNA, 20 nt, Human
uucuccucccuuccuuuucc

SEQ ID NO: 2659134 - RNA, 19 nt, Human
uucuccucccuuccuuuuc

SEQ ID NO: 2659135 - RNA, 23 nt, Human
aucaggagaaagcuugguucugu

SEQ ID NO: 2659136 - RNA, 16 nt, Human
auccauuuccauugcu

SEQ ID NO: 2659137 - RNA, 17 nt, Human
auccauuuccauugcuu

SEQ ID NO: 2659138 - RNA, 13 nt, Human
aucccacauccaa

SEQ ID NO: 2659139 - RNA, 22 nt, Human
aucccacauccaacuccagcaa

SEQ ID NO: 2659140 - RNA, 10 nt, Human
auccaaagac

SEQ ID NO: 2659141 - RNA, 15 nt, Human
uucugguuccagggu

SEQ ID NO: 2659142 - RNA, 17 nt, Human
uucugguuccagggucc

SEQ ID NO: 2659143 - RNA, 10 nt, Human
uucuggcuca

SEQ ID NO: 2659144 - RNA, 20 nt, Human
uucugcccuggcugcugccc

SEQ ID NO: 2659145 - RNA, 13 nt, Human
uucuuuuguuugg

SEQ ID NO: 2659146 - RNA, 14 nt, Human
uucuuuuguuuggu

SEQ ID NO: 2659147 - RNA, 15 nt, Human
uucuuuuguuuggua

SEQ ID NO: 2659148 - RNA, 17 nt, Human
uugaaagugccuuugca

SEQ ID NO: 2659149 - RNA, 16 nt, Human
uugaaauaagaauuca

SEQ ID NO: 2659150 - RNA, 21 nt, Human
uugaaauaagaauucagacau

SEQ ID NO: 2659151 - RNA, 14 nt, Human
uugaaauaaagcua

SEQ ID NO: 2659152 - RNA, 16 nt, Human
uugaaauaacuggaac

SEQ ID NO: 2659153 - RNA, 21 nt, Human
uugaaauaacuggaacaaauu

SEQ ID NO: 2659154 - RNA, 14 nt, Human
uugaaccauaaaau

SEQ ID NO: 2659155 - RNA, 21 nt, Human
uugaaccauaaaauguccagu

SEQ ID NO: 2659156 - RNA, 17 nt, Human
uugaaccauaaaauguc

SEQ ID NO: 2659157 - RNA, 16 nt, Human
uugaaccauaaaaugu

SEQ ID NO: 2659158 - RNA, 23 nt, Human
uugaacaaugaaguugaaaauca

SEQ ID NO: 2659159 - RNA, 21 nt, Human
auccuaggcauuugcugaaua

SEQ ID NO: 2659160 - RNA, 20 nt, Human
auccuaauuucuccucccuu

SEQ ID NO: 2659161 - RNA, 23 nt, Human
auccuaauuucuccucccuuccu

SEQ ID NO: 2659162 - RNA, 15 nt, Human
auccuaauuucuccu

SEQ ID NO: 2659163 - RNA, 16 nt, Human
auccuaauuucuccuc

SEQ ID NO: 2659164 - RNA, 18 nt, Human
auccuaauuucuccuccc

SEQ ID NO: 2659165 - RNA, 19 nt, Human
auccuaauuucuccucccu

SEQ ID NO: 2659166 - RNA, 13 nt, Human
uucuguuuuuaau

SEQ ID NO: 2659167 - RNA, 19 nt, Human
uucuuaauucaugaggagg

SEQ ID NO: 2659168 - RNA, 20 nt, Human
uucuguuuuucuaggccugg

SEQ ID NO: 2659169 - RNA, 21 nt, Human
uucuuaaaaggcccauagcag

SEQ ID NO: 2659170 - RNA, 14 nt, Human
uucuuuuaaagacc

SEQ ID NO: 2659171 - RNA, 17 nt, Human
uucuuggggcccagugc

SEQ ID NO: 2659172 - RNA, 18 nt, Human
uucuuggggcccagugca

SEQ ID NO: 2659173 - RNA, 19 nt, Human
uucuuggggcccagugcau

SEQ ID NO: 2659174 - RNA, 21 nt, Human
uucuuggcaauaaauuuugaa

SEQ ID NO: 2659175 - RNA, 22 nt, Human
uucuuggcaauaaauuuugaaa

SEQ ID NO: 2659176 - RNA, 22 nt, Human
uucuuggcuuaaucauuuucau

SEQ ID NO: 2659177 - RNA, 22 nt, Human
uucuuccuuaauucacucccac

SEQ ID NO: 2659178 - RNA, 18 nt, Human
uuguguguuuauuucacu

SEQ ID NO: 2659179 - RNA, 15 nt, Human
uuguguguugucucu

SEQ ID NO: 2659180 - RNA, 17 nt, Human
uuguguguugucucuug

SEQ ID NO: 2659181 - RNA, 13 nt, Human
uuguguguugucu

SEQ ID NO: 2659182 - RNA, 13 nt, Human
uugugugaacuug

SEQ ID NO: 2659183 - RNA, 12 nt, Human
uugugugaaauu

SEQ ID NO: 2659184 - RNA, 14 nt, Human
uugugugaaauugc

SEQ ID NO: 2659185 - RNA, 15 nt, Human
uugugugaaauugca

SEQ ID NO: 2659186 - RNA, 16 nt, Human
uugugugaaauugcau

SEQ ID NO: 2659187 - RNA, 16 nt, Human
uugugugaacuuggaa

SEQ ID NO: 2659188 - RNA, 21 nt, Human
uugugagaaacaucucaauaa

SEQ ID NO: 2659189 - RNA, 12 nt, Human
uuguguaaaaaa

SEQ ID NO: 2659190 - RNA, 17 nt, Human
uuguggcuauccugauu

SEQ ID NO: 2659191 - RNA, 21 nt, Human
augauuaaccacuucagcuga

SEQ ID NO: 2659192 - RNA, 20 nt, Human
augauuaaccacuucagcug

SEQ ID NO: 2659193 - RNA, 19 nt, Human
augauuaaccacuucagcu

SEQ ID NO: 2659194 - RNA, 21 nt, Human
uuguuguaaaacaaaauuuga

SEQ ID NO: 2659195 - RNA, 12 nt, Human
uuguuguacuua

SEQ ID NO: 2659196 - RNA, 14 nt, Human
uuguuguacuuaaa

SEQ ID NO: 2659197 - RNA, 23 nt, Human
augauuagcaaguuacagugaug

SEQ ID NO: 2659198 - RNA, 14 nt, Human
augauuagcaaguu

SEQ ID NO: 2659199 - RNA, 16 nt, Human
augcaaauaacacaaa

SEQ ID NO: 2659200 - RNA, 14 nt, Human
augcaaaugagcuc

SEQ ID NO: 2659201 - RNA, 19 nt, Human
augcaaaugagcucugaaa

SEQ ID NO: 2659202 - RNA, 20 nt, Human
augcaaaugagcucugaaau

SEQ ID NO: 2659203 - RNA, 21 nt, Human
augcaaaugagcucugaaauc

SEQ ID NO: 2659204 - RNA, 23 nt, Human
augcaaaugagcucugaaaucuu

SEQ ID NO: 2659205 - RNA, 14 nt, Human
augcaccaccaagc

SEQ ID NO: 2659206 - RNA, 22 nt, Human
augcacuuucuauccucuguaa

SEQ ID NO: 2659207 - RNA, 21 nt, Human
augcaccaccaagccaaggga

SEQ ID NO: 2659208 - RNA, 15 nt, Human
augcaccaccaagcc

SEQ ID NO: 2659209 - RNA, 18 nt, Human
augcaccaccaagccaag

SEQ ID NO: 2659210 - RNA, 14 nt, Human
uuuaagauagugua

SEQ ID NO: 2659211 - RNA, 12 nt, Human
uuuaagauguga

SEQ ID NO: 2659212 - RNA, 13 nt, Human
uuuaagaugugaa

SEQ ID NO: 2659213 - RNA, 14 nt, Human
uuuaagaugugaaa

SEQ ID NO: 2659214 - RNA, 13 nt, Human
uuuaaauuacaau

SEQ ID NO: 2659215 - RNA, 20 nt, Human
uuuaagcugcaaaucugaug

SEQ ID NO: 2659216 - RNA, 15 nt, Human
uuuaaugcuauuuga

SEQ ID NO: 2659217 - RNA, 17 nt, Human
uuuaauuguauuuuugu

SEQ ID NO: 2659218 - RNA, 14 nt, Human
uuuaauuguauuuu

SEQ ID NO: 2659219 - RNA, 13 nt, Human
uuuaauuguauuu

SEQ ID NO: 2659220 - RNA, 15 nt, Human
uuuaauuguaaagua

SEQ ID NO: 2659221 - RNA, 21 nt, Human
uuuaauuguaaaguaaaagcu

SEQ ID NO: 2659222 - RNA, 12 nt, Human
uuuaauuguaaa

SEQ ID NO: 2659223 - RNA, 14 nt, Human
augccacugccuuc

SEQ ID NO: 2659224 - RNA, 12 nt, Human
augcccaccccc

SEQ ID NO: 2659225 - RNA, 15 nt, Human
augcccacccccugc

SEQ ID NO: 2659226 - RNA, 16 nt, Human
augcccacccccugcc

SEQ ID NO: 2659227 - RNA, 17 nt, Human
augcccacccccugccc

SEQ ID NO: 2659228 - RNA, 18 nt, Human
augcccacccccugcccu

SEQ ID NO: 2659229 - RNA, 19 nt, Human
augcccacccccugcccug

SEQ ID NO: 2659230 - RNA, 20 nt, Human
augcccacccccugcccugc

SEQ ID NO: 2659231 - RNA, 20 nt, Human
augccaagagugcacccaug

SEQ ID NO: 2659232 - RNA, 22 nt, Human
augcagucuuagaucauaguuu

SEQ ID NO: 2659233 - RNA, 21 nt, Human
augcagucuuagaucauaguu

SEQ ID NO: 2659234 - RNA, 13 nt, Human
augcagucuuaga

SEQ ID NO: 2659235 - RNA, 18 nt, Human
uuuaagccuucaaaacua

SEQ ID NO: 2659236 - RNA, 14 nt, Human
uuuaauuuucacuu

SEQ ID NO: 2659237 - RNA, 21 nt, Human
uuucaugauuagcaaguuaca

SEQ ID NO: 2659238 - RNA, 24 nt, Human
uuucaugaccaguaaaggcugcug

SEQ ID NO: 2659239 - RNA, 17 nt, Human
uuucaugaccaguaaag

SEQ ID NO: 2659240 - RNA, 14 nt, Human
uuucaugaaaauac

SEQ ID NO: 2659241 - RNA, 17 nt, Human
uuucaugaaaauaccau

SEQ ID NO: 2659242 - RNA, 19 nt, Human
uuucaugaaaauaccauuu

SEQ ID NO: 2659243 - RNA, 16 nt, Human
uuucccauggggaggg

SEQ ID NO: 2659244 - RNA, 21 nt, Human
uuucccauuugugccagagga

SEQ ID NO: 2659245 - RNA, 22 nt, Human
uuucccauuugugccagaggaa

SEQ ID NO: 2659246 - RNA, 16 nt, Human
uuucagaaguuaguuu

SEQ ID NO: 2659247 - RNA, 23 nt, Human
uuucagaaguuaguuuguauaua

SEQ ID NO: 2659248 - RNA, 20 nt, Human
uuucagaaguuaguuuguau

SEQ ID NO: 2659249 - RNA, 22 nt, Human
uuucagaaguuaguuuguauau

SEQ ID NO: 2659250 - RNA, 18 nt, Human
auggcaaaggaaggugga

SEQ ID NO: 2659251 - RNA, 22 nt, Human
auggauuuggcacuagccaaag

SEQ ID NO: 2659252 - RNA, 18 nt, Human
auggauuuccagccaaag

SEQ ID NO: 2659253 - RNA, 20 nt, Human
auggcaaguugcaucagaaa

SEQ ID NO: 2659254 - RNA, 21 nt, Human
auggcagaaaaaaugucugua

SEQ ID NO: 2659255 - RNA, 17 nt, Human
auggccuuaauuuccuu

SEQ ID NO: 2659256 - RNA, 18 nt, Human
auggccuuaauuuccuuu

SEQ ID NO: 2659257 - RNA, 19 nt, Human
auggccuuaauuuccuuuu

SEQ ID NO: 2659258 - RNA, 20 nt, Human
auggcgccaccagcucugcc

SEQ ID NO: 2659259 - RNA, 21 nt, Human
auggccgggcgcgguggcuca

SEQ ID NO: 2659260 - RNA, 22 nt, Human
augcucucacuguuuguuuuua

SEQ ID NO: 2659261 - RNA, 23 nt, Human
uuuauuacccccuccuucagaca

SEQ ID NO: 2659262 - RNA, 17 nt, Human
uuuauuacccccuccuu

SEQ ID NO: 2659263 - RNA, 12 nt, Human
uuuauuaccccc

SEQ ID NO: 2659264 - RNA, 18 nt, Human
uuuaugggccccuggcac

SEQ ID NO: 2659265 - RNA, 13 nt, Human
uuuaugugaauuu

SEQ ID NO: 2659266 - RNA, 15 nt, Human
uuuaugugaauuuuu

SEQ ID NO: 2659267 - RNA, 16 nt, Human
uuuaugugaauuuuua

SEQ ID NO: 2659268 - RNA, 20 nt, Human
uuuaugugaauuuuuaagcu

SEQ ID NO: 2659269 - RNA, 21 nt, Human
uuuaugguuacuucuucucuu

SEQ ID NO: 2659270 - RNA, 15 nt, Human
uuuaugguuauguuu

SEQ ID NO: 2659271 - RNA, 16 nt, Human
uuuaugguuauguuuu

SEQ ID NO: 2659272 - RNA, 19 nt, Human
uuuaugguuauguuuuucu

SEQ ID NO: 2659273 - RNA, 21 nt, Human
uuuaugguuauguuuuucugu

SEQ ID NO: 2659274 - RNA, 23 nt, Human
uuuauguuugcacuugugauuau

SEQ ID NO: 2659275 - RNA, 12 nt, Human
uuuauuaaaaca

SEQ ID NO: 2659276 - RNA, 14 nt, Human
uuuauuaaaauauu

SEQ ID NO: 2659277 - RNA, 18 nt, Human
uuuauuaaaauauuucag

SEQ ID NO: 2659278 - RNA, 19 nt, Human
uuuauuaaaauauuucagg

SEQ ID NO: 2659279 - RNA, 21 nt, Human
uuuauuaaaauauuucagguu

SEQ ID NO: 2659280 - RNA, 19 nt, Human
uuuagauuuucuuuugccu

SEQ ID NO: 2659281 - RNA, 10 nt, Human
augcccccug

SEQ ID NO: 2659282 - RNA, 13 nt, Human
uuuagcuggccac

SEQ ID NO: 2659283 - RNA, 15 nt, Human
uuuaguauuaucaaa

SEQ ID NO: 2659284 - RNA, 15 nt, Human
aucugagccagugcu

SEQ ID NO: 2659285 - RNA, 17 nt, Human
uugccuccccauuuccc

SEQ ID NO: 2659286 - RNA, 20 nt, Human
uugccuccccauuucccauc

SEQ ID NO: 2659287 - RNA, 12 nt, Human
uugccuccaggu

SEQ ID NO: 2659288 - RNA, 15 nt, Human
uugccuccaggugca

SEQ ID NO: 2659289 - RNA, 20 nt, Human
uugccuccaggugcagaggu

SEQ ID NO: 2659290 - RNA, 14 nt, Human
uugccuagacagcu

SEQ ID NO: 2659291 - RNA, 20 nt, Human
uugccuauaagccaaaauua

SEQ ID NO: 2659292 - RNA, 18 nt, Human
aucugaggaugaccagaa

SEQ ID NO: 2659293 - RNA, 14 nt, Human
aucugagggaaaug

SEQ ID NO: 2659294 - RNA, 15 nt, Human
aucugagggaaaugu

SEQ ID NO: 2659295 - RNA, 17 nt, Human
aucugagggaaauguuu

SEQ ID NO: 2659296 - RNA, 18 nt, Human
aucugagggaaauguuuu

SEQ ID NO: 2659297 - RNA, 21 nt, Human
aucugagggaaauguuuugua

SEQ ID NO: 2659298 - RNA, 22 nt, Human
aucugagggaaauguuuuguaa

SEQ ID NO: 2659299 - RNA, 23 nt, Human
aucugagggaaauguuuuguaaa

SEQ ID NO: 2659300 - RNA, 19 nt, Human
aucugauggccuuaauuuc

SEQ ID NO: 2659301 - RNA, 21 nt, Human
aucugauggccuuaauuuccu

SEQ ID NO: 2659302 - RNA, 22 nt, Human
aucugauggccuuaauuuccuu

SEQ ID NO: 2659303 - RNA, 23 nt, Human
aucugauggccuuaauuuccuuu

SEQ ID NO: 2659304 - RNA, 11 nt, Human
aucugcaaaag

SEQ ID NO: 2659305 - RNA, 21 nt, Human
aucugcaaaaggccucuugua

SEQ ID NO: 2659306 - RNA, 22 nt, Human
aucugcaaaaggccucuuguaa

SEQ ID NO: 2659307 - RNA, 17 nt, Human
aucugcaccccuucucu

SEQ ID NO: 2659308 - RNA, 18 nt, Human
aucugcaccccuucucuc

SEQ ID NO: 2659309 - RNA, 20 nt, Human
aucugcaccccuucucuccu

SEQ ID NO: 2659310 - RNA, 10 nt, Human
aucugcaccc

SEQ ID NO: 2659311 - RNA, 21 nt, Human
aucugcaccccuucucuccuc

SEQ ID NO: 2659312 - RNA, 22 nt, Human
aucugcaccccuucucuccucc

SEQ ID NO: 2659313 - RNA, 23 nt, Human
aucugcaccccuucucuccuccc

SEQ ID NO: 2659314 - RNA, 20 nt, Human
uugcaccaaauuaucuugau

SEQ ID NO: 2659315 - RNA, 21 nt, Human
aucuguagcuauaaugagcau

SEQ ID NO: 2659316 - RNA, 14 nt, Human
aucuugcuucccua

SEQ ID NO: 2659317 - RNA, 15 nt, Human
aucuugcuucccuaa

SEQ ID NO: 2659318 - RNA, 13 nt, Human
aucuugauacauu

SEQ ID NO: 2659319 - RNA, 15 nt, Human
aucuugauacauuca

SEQ ID NO: 2659320 - RNA, 16 nt, Human
aucuugauacauucaa

SEQ ID NO: 2659321 - RNA, 20 nt, Human
aucuugauacauucaaauuu

SEQ ID NO: 2659322 - RNA, 21 nt, Human
aucuugauacauucaaauuug

SEQ ID NO: 2659323 - RNA, 15 nt, Human
aucuuacaauauuga

SEQ ID NO: 2659324 - RNA, 17 nt, Human
aucuuacaauauugauu

SEQ ID NO: 2659325 - RNA, 12 nt, Human
aucuuacuuugu

SEQ ID NO: 2659326 - RNA, 14 nt, Human
aucuuacuuuguaa

SEQ ID NO: 2659327 - RNA, 13 nt, Human
aucuuacuuugua

SEQ ID NO: 2659328 - RNA, 20 nt, Human
aucuuacuuuguaaauucug

SEQ ID NO: 2659329 - RNA, 19 nt, Human
aucuuacuuuguaaauucu

SEQ ID NO: 2659330 - RNA, 17 nt, Human
aucuuacuuuguaaauu

SEQ ID NO: 2659331 - RNA, 16 nt, Human
aucuuacuuuguaaau

SEQ ID NO: 2659332 - RNA, 22 nt, Human
aucuuacuuuguaaauucugau

SEQ ID NO: 2659333 - RNA, 21 nt, Human
aucuuacuuuguaaauucuga

SEQ ID NO: 2659334 - RNA, 17 nt, Human
aucuguugauaaaucca

SEQ ID NO: 2659335 - RNA, 18 nt, Human
aucucaggagauuucaug

SEQ ID NO: 2659336 - RNA, 22 nt, Human
aucucagcuuugagaagccuuc

SEQ ID NO: 2659337 - RNA, 13 nt, Human
aucucagcuuuga

SEQ ID NO: 2659338 - RNA, 23 nt, Human
aucucagcuuugagaagccuuca

SEQ ID NO: 2659339 - RNA, 23 nt, Human
aucucaaugaaccauaaauucaa

SEQ ID NO: 2659340 - RNA, 15 nt, Human
aucucaucuaucuca

SEQ ID NO: 2659341 - RNA, 22 nt, Human
aucuccauugugccuaagucca

SEQ ID NO: 2659342 - RNA, 16 nt, Human
aucuccauaaacauga

SEQ ID NO: 2659343 - RNA, 17 nt, Human
uugcaucugaaauagga

SEQ ID NO: 2659344 - RNA, 14 nt, Human
uugcaucugaaaua

SEQ ID NO: 2659345 - RNA, 16 nt, Human
uugcauguuauguuua

SEQ ID NO: 2659346 - RNA, 17 nt, Human
uugcauguuauguuuaa

SEQ ID NO: 2659347 - RNA, 21 nt, Human
uugcauguuauguuuaauaag

SEQ ID NO: 2659348 - RNA, 23 nt, Human
uugcaucccaaaccacgccucuu

SEQ ID NO: 2659349 - RNA, 16 nt, Human
uugcacauguuuccuc

SEQ ID NO: 2659350 - RNA, 13 nt, Human
uugauguggcccu

SEQ ID NO: 2659351 - RNA, 18 nt, Human
uugauguggcccuggcug

SEQ ID NO: 2659352 - RNA, 19 nt, Human
uugauguggcccuggcugc

SEQ ID NO: 2659353 - RNA, 20 nt, Human
uugauguggcccuggcugcc

SEQ ID NO: 2659354 - RNA, 18 nt, Human
uugaugucagcaguugcu

SEQ ID NO: 2659355 - RNA, 12 nt, Human
uugaugucagca

SEQ ID NO: 2659356 - RNA, 14 nt, Human
uugauguguuguuc

SEQ ID NO: 2659357 - RNA, 13 nt, Human
uugauguguuguu

SEQ ID NO: 2659358 - RNA, 12 nt, Human
uugauguguugu

SEQ ID NO: 2659359 - RNA, 12 nt, Human
uugauggcugcg

SEQ ID NO: 2659360 - RNA, 16 nt, Human
uugauggagugugagc

SEQ ID NO: 2659361 - RNA, 21 nt, Human
uugauggagugugagccaccu

SEQ ID NO: 2659362 - RNA, 13 nt, Human
aucucuucauuau

SEQ ID NO: 2659363 - RNA, 20 nt, Human
aucucuucauuauucucugc

SEQ ID NO: 2659364 - RNA, 16 nt, Human
uuggauggcuugucua

SEQ ID NO: 2659365 - RNA, 16 nt, Human
uuggauguugagaggu

SEQ ID NO: 2659366 - RNA, 15 nt, Human
uuggauuaaauacau

SEQ ID NO: 2659367 - RNA, 16 nt, Human
uuggauuaaauacaua

SEQ ID NO: 2659368 - RNA, 21 nt, Human
uuggauuaaauacauauggau

SEQ ID NO: 2659369 - RNA, 23 nt, Human
uuggauuaaauacauauggaugu

SEQ ID NO: 2659370 - RNA, 23 nt, Human
aucuugcuucccuaaucuauggu

SEQ ID NO: 2659371 - RNA, 22 nt, Human
uuggcucgaaucucugugccuu

SEQ ID NO: 2659372 - RNA, 13 nt, Human
uuggcgugacccg

SEQ ID NO: 2659373 - RNA, 22 nt, Human
uuggcugaaauucuccuggagg

SEQ ID NO: 2659374 - RNA, 20 nt, Human
uuggcugaaauucuccugga

SEQ ID NO: 2659375 - RNA, 21 nt, Human
uuggcugaaauucuccuggag

SEQ ID NO: 2659376 - RNA, 19 nt, Human
uuggcugaaauucuccugg

SEQ ID NO: 2659377 - RNA, 17 nt, Human
aucuuuaccuguauaca

SEQ ID NO: 2659378 - RNA, 16 nt, Human
augaaagcuguuccuu

SEQ ID NO: 2659379 - RNA, 18 nt, Human
augaaagcuguuccuugg

SEQ ID NO: 2659380 - RNA, 12 nt, Human
augaaaggagag

SEQ ID NO: 2659381 - RNA, 15 nt, Human
augaaaggagagcau

SEQ ID NO: 2659382 - RNA, 21 nt, Human
augaaaggcaggccuauuuca

SEQ ID NO: 2659383 - RNA, 13 nt, Human
augaaagcaacaa

SEQ ID NO: 2659384 - RNA, 21 nt, Human
augaaagcaacaaagaaaucc

SEQ ID NO: 2659385 - RNA, 15 nt, Human
augaaugauuugcau

SEQ ID NO: 2659386 - RNA, 15 nt, Human
augaaugagucuguu

SEQ ID NO: 2659387 - RNA, 17 nt, Human
augaaugauuugcauau

SEQ ID NO: 2659388 - RNA, 22 nt, Human
uuggggggcugaggugggagga

SEQ ID NO: 2659389 - RNA, 20 nt, Human
uuggggggguggccgcugag

SEQ ID NO: 2659390 - RNA, 13 nt, Human
uuggggggguggc

SEQ ID NO: 2659391 - RNA, 23 nt, Human
uugggggaggggagacuuugaug

SEQ ID NO: 2659392 - RNA, 22 nt, Human
uugggggaggggagacuuugau

SEQ ID NO: 2659393 - RNA, 15 nt, Human
uuggggcccagugca

SEQ ID NO: 2659394 - RNA, 23 nt, Human
uuggggccaccaaagcugcccac

SEQ ID NO: 2659395 - RNA, 21 nt, Human
uuggggccaccaaagcugccc

SEQ ID NO: 2659396 - RNA, 18 nt, Human
uuguacaaaauuaagcaa

SEQ ID NO: 2659397 - RNA, 20 nt, Human
uuguacaaaauuaagcaaau

SEQ ID NO: 2659398 - RNA, 15 nt, Human
uuguaggagacuugc

SEQ ID NO: 2659399 - RNA, 14 nt, Human
uugguucugugaac

SEQ ID NO: 2659400 - RNA, 15 nt, Human
uugguucugugaaca

SEQ ID NO: 2659401 - RNA, 22 nt, Human
uugguugggaaugaggaaaauu

SEQ ID NO: 2659402 - RNA, 18 nt, Human
augaauuuucaaguaauu

SEQ ID NO: 2659403 - RNA, 22 nt, Human
augaauuuucaaguaauuguga

SEQ ID NO: 2659404 - RNA, 17 nt, Human
augaauuuuaaaaucug

SEQ ID NO: 2659405 - RNA, 20 nt, Human
uuguauagcaugaaauaaaa

SEQ ID NO: 2659406 - RNA, 22 nt, Human
uuguauagcaugaaauaaaaua

SEQ ID NO: 2659407 - RNA, 14 nt, Human
uuguauauuguaau

SEQ ID NO: 2659408 - RNA, 22 nt, Human
uuguauauugguuuuaugauga

SEQ ID NO: 2659409 - RNA, 19 nt, Human
uuguauauugguuuuauga

SEQ ID NO: 2659410 - RNA, 16 nt, Human
uuguauauugguuuua

SEQ ID NO: 2659411 - RNA, 14 nt, Human
uuguauauugguuu

SEQ ID NO: 2659412 - RNA, 13 nt, Human
uuguauauugguu

SEQ ID NO: 2659413 - RNA, 21 nt, Human
uuguauaguuauguaaauaau

SEQ ID NO: 2659414 - RNA, 20 nt, Human
uuguauaguuauguaaauaa

SEQ ID NO: 2659415 - RNA, 19 nt, Human
uuguauaguuauguaaaua

SEQ ID NO: 2659416 - RNA, 18 nt, Human
uuguauaguuauguaaau

SEQ ID NO: 2659417 - RNA, 17 nt, Human
uuguauaguuauguaaa

SEQ ID NO: 2659418 - RNA, 16 nt, Human
uuguauaguuauguaa

SEQ ID NO: 2659419 - RNA, 14 nt, Human
uuguauaguuaugu

SEQ ID NO: 2659420 - RNA, 16 nt, Human
augagacucagugcag

SEQ ID NO: 2659421 - RNA, 17 nt, Human
augacacauuuggcagu

SEQ ID NO: 2659422 - RNA, 13 nt, Human
augacuuuuuaua

SEQ ID NO: 2659423 - RNA, 15 nt, Human
augacuuuuuauaaa

SEQ ID NO: 2659424 - RNA, 18 nt, Human
augacuuuuuauaaaaug

SEQ ID NO: 2659425 - RNA, 11 nt, Human
augagaaacuu

SEQ ID NO: 2659426 - RNA, 20 nt, Human
augagaaacuuaaauguuau

SEQ ID NO: 2659427 - RNA, 21 nt, Human
augagaaacuuaaauguuauu

SEQ ID NO: 2659428 - RNA, 17 nt, Human
augacuuuauuauuuau

SEQ ID NO: 2659429 - RNA, 18 nt, Human
augacuuuauuauuuauu

SEQ ID NO: 2659430 - RNA, 22 nt, Human
caaauggaaaguaacucauuug

SEQ ID NO: 2659431 - RNA, 13 nt, Human
caacaaguaacuu

SEQ ID NO: 2659432 - RNA, 15 nt, Human
caacaauaaaauuuu

SEQ ID NO: 2659433 - RNA, 16 nt, Human
caacaauaaaauuuuu

SEQ ID NO: 2659434 - RNA, 20 nt, Human
caacaccucugcacaagcug

SEQ ID NO: 2659435 - RNA, 18 nt, Human
caacaaugugaggggucc

SEQ ID NO: 2659436 - RNA, 21 nt, Human
caaagcacuguugagaaggag

SEQ ID NO: 2659437 - RNA, 13 nt, Human
caaagauucauga

SEQ ID NO: 2659438 - RNA, 13 nt, Human
caaagauuuaauc

SEQ ID NO: 2659439 - RNA, 16 nt, Human
caaagauucaugauuu

SEQ ID NO: 2659440 - RNA, 19 nt, Human
caaagauucaugauuuaua

SEQ ID NO: 2659441 - RNA, 16 nt, Human
caaagauuuaaucugc

SEQ ID NO: 2659442 - RNA, 22 nt, Human
caaagugcuauuacgaaguuca

SEQ ID NO: 2659443 - RNA, 14 nt, Human
caaagugccaaaga

SEQ ID NO: 2659444 - RNA, 15 nt, Human
caaagugccaaagaa

SEQ ID NO: 2659445 - RNA, 16 nt, Human
caaagugccaaagaaa

SEQ ID NO: 2659446 - RNA, 20 nt, Human
caaagucugcucucauauaa

SEQ ID NO: 2659447 - RNA, 23 nt, Human
caaagucugcucucauauaagac

SEQ ID NO: 2659448 - RNA, 21 nt, Human
auuuuuuuuuuuaaucuacug

SEQ ID NO: 2659449 - RNA, 18 nt, Human
auuuuuuuuuuuaaucua

SEQ ID NO: 2659450 - RNA, 16 nt, Human
caaaagaugcuucuca

SEQ ID NO: 2659451 - RNA, 16 nt, Human
caaaaggccucuugua

SEQ ID NO: 2659452 - RNA, 22 nt, Human
caaaaggccucuuguaaagacu

SEQ ID NO: 2659453 - RNA, 23 nt, Human
caaaaggccucuuguaaagacug

SEQ ID NO: 2659454 - RNA, 18 nt, Human
caaaagaugcuucucacu

SEQ ID NO: 2659455 - RNA, 14 nt, Human
auuuuuuuuucuaa

SEQ ID NO: 2659456 - RNA, 15 nt, Human
auuuuuuuuucuaag

SEQ ID NO: 2659457 - RNA, 18 nt, Human
auuuuuuuuucuaagaga

SEQ ID NO: 2659458 - RNA, 19 nt, Human
auuuuuuuuucuaagagaa

SEQ ID NO: 2659459 - RNA, 15 nt, Human
caaacaggaacaauc

SEQ ID NO: 2659460 - RNA, 18 nt, Human
caaacagccaagauuuuc

SEQ ID NO: 2659461 - RNA, 16 nt, Human
auuugcuacuguugua

SEQ ID NO: 2659462 - RNA, 17 nt, Human
auuugcuacuguuguaa

SEQ ID NO: 2659463 - RNA, 18 nt, Human
auuugcucuucagaugcc

SEQ ID NO: 2659464 - RNA, 13 nt, Human
auuugcugccauu

SEQ ID NO: 2659465 - RNA, 14 nt, Human
auuugcugcucuuc

SEQ ID NO: 2659466 - RNA, 11 nt, Human
auuugcuuuuu

SEQ ID NO: 2659467 - RNA, 14 nt, Human
auuugugccagagg

SEQ ID NO: 2659468 - RNA, 20 nt, Human
auuugugcuagaaauuuuca

SEQ ID NO: 2659469 - RNA, 11 nt, Human
auuuguugcau

SEQ ID NO: 2659470 - RNA, 20 nt, Human
auuuguuguucuuucagaaa

SEQ ID NO: 2659471 - RNA, 21 nt, Human
auuugcaucugaaauaggaaa

SEQ ID NO: 2659472 - RNA, 15 nt, Human
auuugcaucugaaau

SEQ ID NO: 2659473 - RNA, 13 nt, Human
auuugcauacuua

SEQ ID NO: 2659474 - RNA, 15 nt, Human
auuugcauacuuacc

SEQ ID NO: 2659475 - RNA, 12 nt, Human
auuugcauguua

SEQ ID NO: 2659476 - RNA, 13 nt, Human
auuugcauguuau

SEQ ID NO: 2659477 - RNA, 14 nt, Human
auuugcauguuaug

SEQ ID NO: 2659478 - RNA, 15 nt, Human
auuugcauguuaugu

SEQ ID NO: 2659479 - RNA, 22 nt, Human
auuugcauguuauguuuaauaa

SEQ ID NO: 2659480 - RNA, 16 nt, Human
auuugauuauuuaaga

SEQ ID NO: 2659481 - RNA, 19 nt, Human
auuugauuauuuaagacua

SEQ ID NO: 2659482 - RNA, 22 nt, Human
auuugauuuauuaacuuaauaa

SEQ ID NO: 2659483 - RNA, 18 nt, Human
auuugauuuauuaacuua

SEQ ID NO: 2659484 - RNA, 17 nt, Human
auuugauuuauuaacuu

SEQ ID NO: 2659485 - RNA, 15 nt, Human
auuugauuuauuaac

SEQ ID NO: 2659486 - RNA, 14 nt, Human
auuugauuuauuaa

SEQ ID NO: 2659487 - RNA, 18 nt, Human
auuugauugggaugaaug

SEQ ID NO: 2659488 - RNA, 21 nt, Human
auuugccuguuucugcuugcu

SEQ ID NO: 2659489 - RNA, 21 nt, Human
auuugccauagaguacacugc

SEQ ID NO: 2659490 - RNA, 15 nt, Human
auuugccauagagua

SEQ ID NO: 2659491 - RNA, 13 nt, Human
auuugccauagag

SEQ ID NO: 2659492 - RNA, 23 nt, Human
auuaggugaucccguuuucccca

SEQ ID NO: 2659493 - RNA, 16 nt, Human
auuaggaauaaauaaa

SEQ ID NO: 2659494 - RNA, 13 nt, Human
auuaggaauaaau

SEQ ID NO: 2659495 - RNA, 15 nt, Human
auuaggaaguguuua

SEQ ID NO: 2659496 - RNA, 20 nt, Human
auuaugaaagcaacaaagaa

SEQ ID NO: 2659497 - RNA, 21 nt, Human
auuaugaaagcaacaaagaaa

SEQ ID NO: 2659498 - RNA, 22 nt, Human
auuaugaaagcaacaaagaaau

SEQ ID NO: 2659499 - RNA, 23 nt, Human
auuaugaaagcaacaaagaaauc

SEQ ID NO: 2659500 - RNA, 20 nt, Human
auuaugagaggcaaugauug

SEQ ID NO: 2659501 - RNA, 23 nt, Human
auuaugagauugguuuuccugug

SEQ ID NO: 2659502 - RNA, 16 nt, Human
auucacacuguuccag

SEQ ID NO: 2659503 - RNA, 15 nt, Human
auuagccagguaaug

SEQ ID NO: 2659504 - RNA, 18 nt, Human
auuacaguccaaaauacu

SEQ ID NO: 2659505 - RNA, 21 nt, Human
auuacagagguauuaaaacua

SEQ ID NO: 2659506 - RNA, 15 nt, Human
auuaauguuuucaaa

SEQ ID NO: 2659507 - RNA, 17 nt, Human
auuaauguuuucaaaag

SEQ ID NO: 2659508 - RNA, 13 nt, Human
auuacaaaguuaa

SEQ ID NO: 2659509 - RNA, 15 nt, Human
auuacaaaguuaaaa

SEQ ID NO: 2659510 - RNA, 23 nt, Human
auuacaaaguuaaaauuguuauc

SEQ ID NO: 2659511 - RNA, 24 nt, Human
auuacaaaguuaaaauuguuauca

SEQ ID NO: 2659512 - RNA, 13 nt, Human
auuacaaaaacaa

SEQ ID NO: 2659513 - RNA, 16 nt, Human
auguuuggcauguaaa

SEQ ID NO: 2659514 - RNA, 17 nt, Human
auguuuggcauguaaau

SEQ ID NO: 2659515 - RNA, 22 nt, Human
auguuuggcauguaaauguaaa

SEQ ID NO: 2659516 - RNA, 13 nt, Human
auguuuggcucug

SEQ ID NO: 2659517 - RNA, 15 nt, Human
auguuuggcucugcu

SEQ ID NO: 2659518 - RNA, 19 nt, Human
auguuuggcucugcuuuua

SEQ ID NO: 2659519 - RNA, 23 nt, Human
auguuuguccugaacacuuuugu

SEQ ID NO: 2659520 - RNA, 12 nt, Human
auguuugggguc

SEQ ID NO: 2659521 - RNA, 18 nt, Human
auguuuggugaacuauau

SEQ ID NO: 2659522 - RNA, 13 nt, Human
auugaguauuguu

SEQ ID NO: 2659523 - RNA, 14 nt, Human
auugaguauuguuu

SEQ ID NO: 2659524 - RNA, 15 nt, Human
auugaguauuguuua

SEQ ID NO: 2659525 - RNA, 16 nt, Human
auugaguauuguuuaa

SEQ ID NO: 2659526 - RNA, 20 nt, Human
auugaguauuguuuaaaaug

SEQ ID NO: 2659527 - RNA, 21 nt, Human
auugaguauuguuuaaaaugu

SEQ ID NO: 2659528 - RNA, 23 nt, Human
auugaguauuguuuaaaauguaa

SEQ ID NO: 2659529 - RNA, 21 nt, Human
auugauauacacggaugacuu

SEQ ID NO: 2659530 - RNA, 19 nt, Human
auucuucuguguuuauaaa

SEQ ID NO: 2659531 - RNA, 14 nt, Human
auucuucuguguuu

SEQ ID NO: 2659532 - RNA, 15 nt, Human
auucuucuguguuua

SEQ ID NO: 2659533 - RNA, 13 nt, Human
auucuucuguguu

SEQ ID NO: 2659534 - RNA, 12 nt, Human
auucucuuuuaa

SEQ ID NO: 2659535 - RNA, 21 nt, Human
auucuucucuuccuuuuauca

SEQ ID NO: 2659536 - RNA, 12 nt, Human
auuguuaucaaa

SEQ ID NO: 2659537 - RNA, 14 nt, Human
auugugugaacuug

SEQ ID NO: 2659538 - RNA, 12 nt, Human
auuguaaaguaa

SEQ ID NO: 2659539 - RNA, 18 nt, Human
auugcuugagcucaggag

SEQ ID NO: 2659540 - RNA, 22 nt, Human
auugcugagccucugcucccca

SEQ ID NO: 2659541 - RNA, 16 nt, Human
auugcugagccucugc

SEQ ID NO: 2659542 - RNA, 14 nt, Human
auugcugagccucu

SEQ ID NO: 2659543 - RNA, 14 nt, Human
auugcuugagcuca

SEQ ID NO: 2659544 - RNA, 12 nt, Human
auugcugcuuga

SEQ ID NO: 2659545 - RNA, 23 nt, Human
auugcugagccucugcuccccag

SEQ ID NO: 2659546 - RNA, 13 nt, Human
cacaguagaacug

SEQ ID NO: 2659547 - RNA, 20 nt, Human
cacaguagaacugucuguga

SEQ ID NO: 2659548 - RNA, 14 nt, Human
cacaguagagccag

SEQ ID NO: 2659549 - RNA, 15 nt, Human
cacaguagagccagc

SEQ ID NO: 2659550 - RNA, 21 nt, Human
cacaguaaaaauggaaacuau

SEQ ID NO: 2659551 - RNA, 16 nt, Human
cacaguagagccagcu

SEQ ID NO: 2659552 - RNA, 17 nt, Human
cacaguagagccagcuu

SEQ ID NO: 2659553 - RNA, 12 nt, Human
cacagccugggc

SEQ ID NO: 2659554 - RNA, 14 nt, Human
cacagccugggccc

SEQ ID NO: 2659555 - RNA, 14 nt, Human
cacagcgagggcag

SEQ ID NO: 2659556 - RNA, 19 nt, Human
cacagccugggccccagcu

SEQ ID NO: 2659557 - RNA, 21 nt, Human
cacagccugggccccagcucg

SEQ ID NO: 2659558 - RNA, 15 nt, Human
cacagcgagggcagc

SEQ ID NO: 2659559 - RNA, 16 nt, Human
cacagcgagggcagcu

SEQ ID NO: 2659560 - RNA, 17 nt, Human
cacagcgagggcagcug

SEQ ID NO: 2659561 - RNA, 14 nt, Human
cacagcgccagccu

SEQ ID NO: 2659562 - RNA, 16 nt, Human
cacagcgccagccuca

SEQ ID NO: 2659563 - RNA, 20 nt, Human
cacagcggagguguggagcc

SEQ ID NO: 2659564 - RNA, 18 nt, Human
cacagcgagggcagcugc

SEQ ID NO: 2659565 - RNA, 19 nt, Human
cacagcgagggcagcugcu

SEQ ID NO: 2659566 - RNA, 20 nt, Human
cacacauauauauuacaagg

SEQ ID NO: 2659567 - RNA, 16 nt, Human
cacagaaacacugccu

SEQ ID NO: 2659568 - RNA, 15 nt, Human
cacagaaacacugcc

SEQ ID NO: 2659569 - RNA, 11 nt, Human
cacagaaacac

SEQ ID NO: 2659570 - RNA, 17 nt, Human
cacagaaacacugccuu

SEQ ID NO: 2659571 - RNA, 18 nt, Human
cacagaaacacugccuuu

SEQ ID NO: 2659572 - RNA, 19 nt, Human
cacagaaacacugccuuuu

SEQ ID NO: 2659573 - RNA, 20 nt, Human
cacagaaacacugccuuuuu

SEQ ID NO: 2659574 - RNA, 11 nt, Human
cacagccucug

SEQ ID NO: 2659575 - RNA, 23 nt, Human
cacaagcugcacccucaggcagg

SEQ ID NO: 2659576 - RNA, 17 nt, Human
cacaagcugcacccuca

SEQ ID NO: 2659577 - RNA, 15 nt, Human
caauggaguauucuc

SEQ ID NO: 2659578 - RNA, 19 nt, Human
caauucuuuuaacuguugu

SEQ ID NO: 2659579 - RNA, 17 nt, Human
caagucaagugaaaaag

SEQ ID NO: 2659580 - RNA, 13 nt, Human
caagucaagugaa

SEQ ID NO: 2659581 - RNA, 18 nt, Human
caaguauagccuauggca

SEQ ID NO: 2659582 - RNA, 23 nt, Human
caaguaguucuguauuugaaagu

SEQ ID NO: 2659583 - RNA, 21 nt, Human
caaguaguucuguauuugaaa

SEQ ID NO: 2659584 - RNA, 20 nt, Human
caaguaguucuguauuugaa

SEQ ID NO: 2659585 - RNA, 19 nt, Human
caaguaguucuguauuuga

SEQ ID NO: 2659586 - RNA, 18 nt, Human
caaguaguucuguauuug

SEQ ID NO: 2659587 - RNA, 17 nt, Human
caaguaguucuguauuu

SEQ ID NO: 2659588 - RNA, 24 nt, Human
caaggcacuucauguaaaguguca

SEQ ID NO: 2659589 - RNA, 20 nt, Human
caagcugcacccucaggcag

SEQ ID NO: 2659590 - RNA, 18 nt, Human
caagcugcacccucaggc

SEQ ID NO: 2659591 - RNA, 14 nt, Human
caagcugcacccuc

SEQ ID NO: 2659592 - RNA, 13 nt, Human
caagcugcacccu

SEQ ID NO: 2659593 - RNA, 13 nt, Human
caagcuccaagcc

SEQ ID NO: 2659594 - RNA, 14 nt, Human
caagcuccaagccc

SEQ ID NO: 2659595 - RNA, 19 nt, Human
caagcuccaagccccaucu

SEQ ID NO: 2659596 - RNA, 15 nt, Human
caagcuauucaauuc

SEQ ID NO: 2659597 - RNA, 13 nt, Human
caauaaagcuugu

SEQ ID NO: 2659598 - RNA, 14 nt, Human
caauaaagcuuguu

SEQ ID NO: 2659599 - RNA, 17 nt, Human
caauaaagcuuguugac

SEQ ID NO: 2659600 - RNA, 14 nt, Human
cacccucaggcagg

SEQ ID NO: 2659601 - RNA, 17 nt, Human
cacccugaaagcccuga

SEQ ID NO: 2659602 - RNA, 23 nt, Human
cacccugggcccugggcuggaau

SEQ ID NO: 2659603 - RNA, 15 nt, Human
cacccucuuccugug

SEQ ID NO: 2659604 - RNA, 14 nt, Human
cacccucuuccugu

SEQ ID NO: 2659605 - RNA, 12 nt, Human
caccucagccug

SEQ ID NO: 2659606 - RNA, 14 nt, Human
caccucagccugca

SEQ ID NO: 2659607 - RNA, 17 nt, Human
caccucagccugcacag

SEQ ID NO: 2659608 - RNA, 18 nt, Human
caccugccuguuaggaga

SEQ ID NO: 2659609 - RNA, 23 nt, Human
caccugccuguuaggagaagcug

SEQ ID NO: 2659610 - RNA, 12 nt, Human
cacucauuucau

SEQ ID NO: 2659611 - RNA, 13 nt, Human
cacucauuucauc

SEQ ID NO: 2659612 - RNA, 14 nt, Human
cacucauuucaucu

SEQ ID NO: 2659613 - RNA, 16 nt, Human
cacucauuucaucuca

SEQ ID NO: 2659614 - RNA, 17 nt, Human
cacucauuucaucucau

SEQ ID NO: 2659615 - RNA, 18 nt, Human
cacucauuucaucucauu

SEQ ID NO: 2659616 - RNA, 19 nt, Human
cacucauuucaucucauuu

SEQ ID NO: 2659617 - RNA, 22 nt, Human
cacucauuucaucucauuuaag

SEQ ID NO: 2659618 - RNA, 23 nt, Human
cacucauugcugagccucugcuc

SEQ ID NO: 2659619 - RNA, 21 nt, Human
cacucauugcugagccucugc

SEQ ID NO: 2659620 - RNA, 19 nt, Human
cacucauugcugagccucu

SEQ ID NO: 2659621 - RNA, 16 nt, Human
cacucauugcugagcc

SEQ ID NO: 2659622 - RNA, 23 nt, Human
cacuaggcccccacuugccucuu

SEQ ID NO: 2659623 - RNA, 17 nt, Human
cacuagggccuuggaaa

SEQ ID NO: 2659624 - RNA, 18 nt, Human
cacuagggccuuggaaau

SEQ ID NO: 2659625 - RNA, 16 nt, Human
cacuccagccugggug

SEQ ID NO: 2659626 - RNA, 15 nt, Human
cacuccagccugggg

SEQ ID NO: 2659627 - RNA, 13 nt, Human
cacuccagggaca

SEQ ID NO: 2659628 - RNA, 20 nt, Human
cacuccagggacacacagcc

SEQ ID NO: 2659629 - RNA, 21 nt, Human
cacuccagggacacacagccu

SEQ ID NO: 2659630 - RNA, 17 nt, Human
cacucuuguucccacac

SEQ ID NO: 2659631 - RNA, 20 nt, Human
cacugcacuccagccugggu

SEQ ID NO: 2659632 - RNA, 19 nt, Human
cacugcacuccagccuggg

SEQ ID NO: 2659633 - RNA, 18 nt, Human
cacugcacuccagccugg

SEQ ID NO: 2659634 - RNA, 16 nt, Human
cacugcacuccagccu

SEQ ID NO: 2659635 - RNA, 15 nt, Human
cacugcacuccagcc

SEQ ID NO: 2659636 - RNA, 20 nt, Human
cacugccacacucuccauca

SEQ ID NO: 2659637 - RNA, 12 nt, Human
cacugccagcag

SEQ ID NO: 2659638 - RNA, 13 nt, Human
cacugccagcagc

SEQ ID NO: 2659639 - RNA, 21 nt, Human
cacugccagcagcagcaggug

SEQ ID NO: 2659640 - RNA, 22 nt, Human
cacugccagcagcagcagguga

SEQ ID NO: 2659641 - RNA, 14 nt, Human
cacugccagcagca

SEQ ID NO: 2659642 - RNA, 16 nt, Human
cacugccagcagcagc

SEQ ID NO: 2659643 - RNA, 19 nt, Human
cacugccagcagcagcagg

SEQ ID NO: 2659644 - RNA, 20 nt, Human
cacugccagcagcagcaggu

SEQ ID NO: 2659645 - RNA, 16 nt, Human
cacuggggccuacagc

SEQ ID NO: 2659646 - RNA, 14 nt, Human
cacuggggccuaca

SEQ ID NO: 2659647 - RNA, 22 nt, Human
cacuggcugucaguaugacauu

SEQ ID NO: 2659648 - RNA, 12 nt, Human
cacugccaggcc

SEQ ID NO: 2659649 - RNA, 17 nt, Human
cacuuguagauuugauu

SEQ ID NO: 2659650 - RNA, 16 nt, Human
cacuuguagauuugau

SEQ ID NO: 2659651 - RNA, 17 nt, Human
cacuuagcgaacccuuu

SEQ ID NO: 2659652 - RNA, 21 nt, Human
cacuuaugaaugauuugcaua

SEQ ID NO: 2659653 - RNA, 15 nt, Human
cacuuauugaauaua

SEQ ID NO: 2659654 - RNA, 16 nt, Human
cacuuauugaauauau

SEQ ID NO: 2659655 - RNA, 17 nt, Human
cacuuauugaauauaug

SEQ ID NO: 2659656 - RNA, 15 nt, Human
cacuuguagauuuga

SEQ ID NO: 2659657 - RNA, 14 nt, Human
cacuuguagauuug

SEQ ID NO: 2659658 - RNA, 12 nt, Human
cacugguucuca

SEQ ID NO: 2659659 - RNA, 16 nt, Human
caugacaauguuguag

SEQ ID NO: 2659660 - RNA, 12 nt, Human
caugauuagcaa

SEQ ID NO: 2659661 - RNA, 14 nt, Human
caugaccaguaaag

SEQ ID NO: 2659662 - RNA, 15 nt, Human
caugcugaggccugg

SEQ ID NO: 2659663 - RNA, 14 nt, Human
caugcaauaaaauu

SEQ ID NO: 2659664 - RNA, 15 nt, Human
caugcaauaaaauuu

SEQ ID NO: 2659665 - RNA, 18 nt, Human
caugcaauaaaauuuaaa

SEQ ID NO: 2659666 - RNA, 16 nt, Human
caugcugaggccuggg

SEQ ID NO: 2659667 - RNA, 17 nt, Human
caugcugaggccugggc

SEQ ID NO: 2659668 - RNA, 18 nt, Human
caugcugaggccugggcc

SEQ ID NO: 2659669 - RNA, 19 nt, Human
caugcugaggccugggccg

SEQ ID NO: 2659670 - RNA, 23 nt, Human
cauccugugccacuaaacuacau

SEQ ID NO: 2659671 - RNA, 13 nt, Human
caucccauuccag

SEQ ID NO: 2659672 - RNA, 22 nt, Human
caucccauuccaggcagccucu

SEQ ID NO: 2659673 - RNA, 18 nt, Human
caucugucuauauuuuau

SEQ ID NO: 2659674 - RNA, 22 nt, Human
caucuuagguuggcaaaaaggc

SEQ ID NO: 2659675 - RNA, 21 nt, Human
caucuuagguuggcaaaaagg

SEQ ID NO: 2659676 - RNA, 17 nt, Human
caucuuagaccuccaca

SEQ ID NO: 2659677 - RNA, 13 nt, Human
caguuuaucauuc

SEQ ID NO: 2659678 - RNA, 23 nt, Human
caguuugaggauuaguuuagaac

SEQ ID NO: 2659679 - RNA, 18 nt, Human
caguuuauacccuaguua

SEQ ID NO: 2659680 - RNA, 16 nt, Human
caguuugucuuggaua

SEQ ID NO: 2659681 - RNA, 20 nt, Human
cauaggcaccuuuuacugug

SEQ ID NO: 2659682 - RNA, 21 nt, Human
cauaggcaccuuuuacuguga

SEQ ID NO: 2659683 - RNA, 16 nt, Human
cauaggaccuuuccac

SEQ ID NO: 2659684 - RNA, 18 nt, Human
cauaggaccuuuccacca

SEQ ID NO: 2659685 - RNA, 16 nt, Human
cauagccaaaauguga

SEQ ID NO: 2659686 - RNA, 14 nt, Human
cauagccaaaaugu

SEQ ID NO: 2659687 - RNA, 15 nt, Human
cauagcccaguagac

SEQ ID NO: 2659688 - RNA, 13 nt, Human
cauagccauaaau

SEQ ID NO: 2659689 - RNA, 17 nt, Human
cauagccauaaaugaug

SEQ ID NO: 2659690 - RNA, 11 nt, Human
cauagcccagu

SEQ ID NO: 2659691 - RNA, 19 nt, Human
cauacaaguuuauaaagag

SEQ ID NO: 2659692 - RNA, 22 nt, Human
cauacaaaugcaucuuugaugu

SEQ ID NO: 2659693 - RNA, 20 nt, Human
cauacaaaugcaucuuugau

SEQ ID NO: 2659694 - RNA, 19 nt, Human
cauacaaaugcaucuuuga

SEQ ID NO: 2659695 - RNA, 11 nt, Human
ccaaaaacaaa

SEQ ID NO: 2659696 - RNA, 12 nt, Human
cauuuuuguaaa

SEQ ID NO: 2659697 - RNA, 13 nt, Human
cauuuuuguaaau

SEQ ID NO: 2659698 - RNA, 22 nt, Human
cauugcuguuguccaacuauuu

SEQ ID NO: 2659699 - RNA, 21 nt, Human
cauugcuguuguccaacuauu

SEQ ID NO: 2659700 - RNA, 19 nt, Human
cauugcuguuguccaacua

SEQ ID NO: 2659701 - RNA, 17 nt, Human
cauuuauuuauccagaa

SEQ ID NO: 2659702 - RNA, 23 nt, Human
cauuuauuuauccagaaaacugu

SEQ ID NO: 2659703 - RNA, 19 nt, Human
cauuuauuuuuuuuaaaga

SEQ ID NO: 2659704 - RNA, 20 nt, Human
cauuuauuuuuuuuaaagaa

SEQ ID NO: 2659705 - RNA, 21 nt, Human
cauuuauuuuuuuuaaagaaa

SEQ ID NO: 2659706 - RNA, 22 nt, Human
cauuuauuuuuuuuaaagaaaa

SEQ ID NO: 2659707 - RNA, 21 nt, Human
cauuucagaaguuaguuugua

SEQ ID NO: 2659708 - RNA, 13 nt, Human
cauuucagaaguu

SEQ ID NO: 2659709 - RNA, 15 nt, Human
cauugcugagccucu

SEQ ID NO: 2659710 - RNA, 14 nt, Human
cauugcugagccuc

SEQ ID NO: 2659711 - RNA, 18 nt, Human
cauugcugggcuugucug

SEQ ID NO: 2659712 - RNA, 21 nt, Human
cauugcugagccucugcuccc

SEQ ID NO: 2659713 - RNA, 18 nt, Human
cauugcugagccucugcu

SEQ ID NO: 2659714 - RNA, 17 nt, Human
cauugcugagccucugc

SEQ ID NO: 2659715 - RNA, 16 nt, Human
cauugcugagccucug

SEQ ID NO: 2659716 - RNA, 16 nt, Human
cauuaugccacuuccu

SEQ ID NO: 2659717 - RNA, 18 nt, Human
cauuaugccacuuccuuu

SEQ ID NO: 2659718 - RNA, 23 nt, Human
cauuaugccacuuccuuuuaacu

SEQ ID NO: 2659719 - RNA, 15 nt, Human
cauucucccagguac

SEQ ID NO: 2659720 - RNA, 23 nt, Human
cauucucccagguaccagcugcg

SEQ ID NO: 2659721 - RNA, 12 nt, Human
cauucucccagg

SEQ ID NO: 2659722 - RNA, 21 nt, Human
cauucucccagguaccagcug

SEQ ID NO: 2659723 - RNA, 12 nt, Human
cauggcuguguu

SEQ ID NO: 2659724 - RNA, 15 nt, Human
cauggcugcuguugc

SEQ ID NO: 2659725 - RNA, 18 nt, Human
cauggcugcuguugcuua

SEQ ID NO: 2659726 - RNA, 19 nt, Human
cauggccuuaugaggcagg

SEQ ID NO: 2659727 - RNA, 18 nt, Human
cauuagccagauuugucu

SEQ ID NO: 2659728 - RNA, 19 nt, Human
cauuagccagauuugucuu

SEQ ID NO: 2659729 - RNA, 14 nt, Human
ccaaauguuuauuu

SEQ ID NO: 2659730 - RNA, 14 nt, Human
ccaaaucuggaagc

SEQ ID NO: 2659731 - RNA, 23 nt, Human
ccaacuuguauuaaagacagagg

SEQ ID NO: 2659732 - RNA, 20 nt, Human
ccaauguucucucuucucca

SEQ ID NO: 2659733 - RNA, 12 nt, Human
ccacccugggcc

SEQ ID NO: 2659734 - RNA, 21 nt, Human
ccaccaggccaccuccccagc

SEQ ID NO: 2659735 - RNA, 14 nt, Human
ccacccugcugcug

SEQ ID NO: 2659736 - RNA, 15 nt, Human
ccacccugcugcugg

SEQ ID NO: 2659737 - RNA, 16 nt, Human
ccacccugcugcuggu

SEQ ID NO: 2659738 - RNA, 18 nt, Human
ccacccugcugcuggugc

SEQ ID NO: 2659739 - RNA, 21 nt, Human
ccacccugcugcuggugcaca

SEQ ID NO: 2659740 - RNA, 13 nt, Human
ccacccugggccc

SEQ ID NO: 2659741 - RNA, 15 nt, Human
ccaccgguccagcug

SEQ ID NO: 2659742 - RNA, 17 nt, Human
ccaccgguccagcuggc

SEQ ID NO: 2659743 - RNA, 18 nt, Human
ccaccgguccagcuggcc

SEQ ID NO: 2659744 - RNA, 14 nt, Human
ccaccuagaacacu

SEQ ID NO: 2659745 - RNA, 16 nt, Human
ccaccguggaggagga

SEQ ID NO: 2659746 - RNA, 13 nt, Human
ccaccguggagga

SEQ ID NO: 2659747 - RNA, 16 nt, Human
ccaccagcucugccgu

SEQ ID NO: 2659748 - RNA, 18 nt, Human
ccaccagcaucaccugcc

SEQ ID NO: 2659749 - RNA, 19 nt, Human
ccaccagcaucaccugccu

SEQ ID NO: 2659750 - RNA, 13 nt, Human
ccaccaggccacc

SEQ ID NO: 2659751 - RNA, 19 nt, Human
ccaccaggccaccucccca

SEQ ID NO: 2659752 - RNA, 16 nt, Human
ccacacuugaaaccuu

SEQ ID NO: 2659753 - RNA, 17 nt, Human
ccacacuugaaaccuuu

SEQ ID NO: 2659754 - RNA, 12 nt, Human
caggaggcaggc

SEQ ID NO: 2659755 - RNA, 15 nt, Human
caggaggcaggcaug

SEQ ID NO: 2659756 - RNA, 18 nt, Human
caggaggcaggcauggcc

SEQ ID NO: 2659757 - RNA, 21 nt, Human
caggaggcaggcauggcccug

SEQ ID NO: 2659758 - RNA, 23 nt, Human
caggaggcaggcauggcccuggg

SEQ ID NO: 2659759 - RNA, 19 nt, Human
caggaggcagggaggcagc

SEQ ID NO: 2659760 - RNA, 20 nt, Human
caggaggcagggaggcagcc

SEQ ID NO: 2659761 - RNA, 23 nt, Human
caggaggcagggaggcagccgcc

SEQ ID NO: 2659762 - RNA, 13 nt, Human
caggaccucaggu

SEQ ID NO: 2659763 - RNA, 15 nt, Human
caggacaugcaauaa

SEQ ID NO: 2659764 - RNA, 19 nt, Human
caggacaugcaauaaaauu

SEQ ID NO: 2659765 - RNA, 21 nt, Human
caggacaugcaauaaaauuua

SEQ ID NO: 2659766 - RNA, 16 nt, Human
caggccagccuccgag

SEQ ID NO: 2659767 - RNA, 19 nt, Human
caggccagccuccgagagg

SEQ ID NO: 2659768 - RNA, 21 nt, Human
caggccagccuccgagaggga

SEQ ID NO: 2659769 - RNA, 23 nt, Human
caggccagccuccgagagggaga

SEQ ID NO: 2659770 - RNA, 11 nt, Human
caggccagccu

SEQ ID NO: 2659771 - RNA, 12 nt, Human
caggccagccuc

SEQ ID NO: 2659772 - RNA, 13 nt, Human
caggccagccucc

SEQ ID NO: 2659773 - RNA, 15 nt, Human
caggccagccuccga

SEQ ID NO: 2659774 - RNA, 11 nt, Human
caggccaccuc

SEQ ID NO: 2659775 - RNA, 19 nt, Human
caggccaccuccccagcau

SEQ ID NO: 2659776 - RNA, 20 nt, Human
caggccaccuccccagcauu

SEQ ID NO: 2659777 - RNA, 12 nt, Human
caggccaccucc

SEQ ID NO: 2659778 - RNA, 15 nt, Human
caggccaccucccca

SEQ ID NO: 2659779 - RNA, 16 nt, Human
caggccaccuccccag

SEQ ID NO: 2659780 - RNA, 18 nt, Human
cagcuuauaaugggcucu

SEQ ID NO: 2659781 - RNA, 16 nt, Human
cagcuguucagcuggu

SEQ ID NO: 2659782 - RNA, 15 nt, Human
cagcuguucagcugg

SEQ ID NO: 2659783 - RNA, 16 nt, Human
caggaaaguggccaag

SEQ ID NO: 2659784 - RNA, 23 nt, Human
caggcugggccauguccaaagag

SEQ ID NO: 2659785 - RNA, 11 nt, Human
caggcugggcc

SEQ ID NO: 2659786 - RNA, 12 nt, Human
caggcugggcca

SEQ ID NO: 2659787 - RNA, 13 nt, Human
caggcugggccau

SEQ ID NO: 2659788 - RNA, 17 nt, Human
caggcugggccaugucc

SEQ ID NO: 2659789 - RNA, 18 nt, Human
caggcugggccaugucca

SEQ ID NO: 2659790 - RNA, 20 nt, Human
caggcugggccauguccaaa

SEQ ID NO: 2659791 - RNA, 22 nt, Human
caggcugggccauguccaaaga

SEQ ID NO: 2659792 - RNA, 12 nt, Human
cagggaggggcc

SEQ ID NO: 2659793 - RNA, 16 nt, Human
cagggaggggccggcc

SEQ ID NO: 2659794 - RNA, 19 nt, Human
cagggaggggccggcccug

SEQ ID NO: 2659795 - RNA, 21 nt, Human
cagggaggggccggcccugug

SEQ ID NO: 2659796 - RNA, 22 nt, Human
cagggaggggccggcccugugu

SEQ ID NO: 2659797 - RNA, 16 nt, Human
cagggagggcuucugc

SEQ ID NO: 2659798 - RNA, 13 nt, Human
cagggcuggcucc

SEQ ID NO: 2659799 - RNA, 18 nt, Human
cagggcuggcuccugauc

SEQ ID NO: 2659800 - RNA, 20 nt, Human
cagguucuccguuagcuccu

SEQ ID NO: 2659801 - RNA, 24 nt, Human
cagguucuccguuagcuccugugg

SEQ ID NO: 2659802 - RNA, 21 nt, Human
cagguucuccguuagcuccug

SEQ ID NO: 2659803 - RNA, 22 nt, Human
cagguucuccguuagcuccugu

SEQ ID NO: 2659804 - RNA, 23 nt, Human
cagguucuccguuagcuccugug

SEQ ID NO: 2659805 - RNA, 12 nt, Human
caguauuaugua

SEQ ID NO: 2659806 - RNA, 21 nt, Human
cagggucucuaccauccccug

SEQ ID NO: 2659807 - RNA, 15 nt, Human
cagggugcagcccaa

SEQ ID NO: 2659808 - RNA, 23 nt, Human
cagggugcagcccaaucugccag

SEQ ID NO: 2659809 - RNA, 13 nt, Human
cagagccuucuca

SEQ ID NO: 2659810 - RNA, 15 nt, Human
cagagccuucucaga

SEQ ID NO: 2659811 - RNA, 16 nt, Human
cagagccuucucagaa

SEQ ID NO: 2659812 - RNA, 18 nt, Human
cagagccuucucagaagc

SEQ ID NO: 2659813 - RNA, 19 nt, Human
cagagccuucucagaagca

SEQ ID NO: 2659814 - RNA, 20 nt, Human
cagagccuucucagaagcac

SEQ ID NO: 2659815 - RNA, 21 nt, Human
cagagccuucucagaagcaca

SEQ ID NO: 2659816 - RNA, 19 nt, Human
cagagcgcgccccuagccg

SEQ ID NO: 2659817 - RNA, 18 nt, Human
cagagcgcgccccuagcc

SEQ ID NO: 2659818 - RNA, 17 nt, Human
cagagcgcgccccuagc

SEQ ID NO: 2659819 - RNA, 18 nt, Human
cagagaggacuguaggga

SEQ ID NO: 2659820 - RNA, 20 nt, Human
cagagaggacuguagggagg

SEQ ID NO: 2659821 - RNA, 19 nt, Human
cagagaggaaauucuccac

SEQ ID NO: 2659822 - RNA, 21 nt, Human
cagagaggaaauucuccacug

SEQ ID NO: 2659823 - RNA, 20 nt, Human
cagagagccuggugcugcug

SEQ ID NO: 2659824 - RNA, 19 nt, Human
cagagagccuggugcugcu

SEQ ID NO: 2659825 - RNA, 18 nt, Human
cagauaccuccaacccug

SEQ ID NO: 2659826 - RNA, 19 nt, Human
cagauaccuccaacccugc

SEQ ID NO: 2659827 - RNA, 20 nt, Human
cagauaccuccaacccugcc

SEQ ID NO: 2659828 - RNA, 21 nt, Human
cagauaccuccaacccugccg

SEQ ID NO: 2659829 - RNA, 18 nt, Human
cagauaccuuaucuuaca

SEQ ID NO: 2659830 - RNA, 19 nt, Human
cagauaccuuaucuuacaa

SEQ ID NO: 2659831 - RNA, 22 nt, Human
cagauaccuuaucuuacaauau

SEQ ID NO: 2659832 - RNA, 23 nt, Human
cagauaccuuaucuuacaauauu

SEQ ID NO: 2659833 - RNA, 18 nt, Human
cagagcuggcucugagcg

SEQ ID NO: 2659834 - RNA, 13 nt, Human
cagagcuggcucu

SEQ ID NO: 2659835 - RNA, 17 nt, Human
cagagcuggcucugagc

SEQ ID NO: 2659836 - RNA, 16 nt, Human
cagccucuccccaggu

SEQ ID NO: 2659837 - RNA, 19 nt, Human
cagccucuccccaggucca

SEQ ID NO: 2659838 - RNA, 20 nt, Human
cagccucuccccagguccag

SEQ ID NO: 2659839 - RNA, 23 nt, Human
cagccucuccccagguccagcuc

SEQ ID NO: 2659840 - RNA, 22 nt, Human
cagccugcacagugucccccag

SEQ ID NO: 2659841 - RNA, 14 nt, Human
cagccugcacagug

SEQ ID NO: 2659842 - RNA, 23 nt, Human
cagccgccaugcuccuggcccac

SEQ ID NO: 2659843 - RNA, 14 nt, Human
cagccucuccccag

SEQ ID NO: 2659844 - RNA, 20 nt, Human
cagccgccccaucugcccca

SEQ ID NO: 2659845 - RNA, 16 nt, Human
cagcguggcucuaaaa

SEQ ID NO: 2659846 - RNA, 14 nt, Human
cagccugccccgga

SEQ ID NO: 2659847 - RNA, 17 nt, Human
cagccugcgccugcugc

SEQ ID NO: 2659848 - RNA, 13 nt, Human
cagccugcgccug

SEQ ID NO: 2659849 - RNA, 16 nt, Human
cagccugcgccugcug

SEQ ID NO: 2659850 - RNA, 15 nt, Human
cagccugcgccugcu

SEQ ID NO: 2659851 - RNA, 21 nt, Human
cagccccgcgaccauguggcc

SEQ ID NO: 2659852 - RNA, 13 nt, Human
cagcccccugguc

SEQ ID NO: 2659853 - RNA, 16 nt, Human
cagcccccugcuucag

SEQ ID NO: 2659854 - RNA, 20 nt, Human
cagcccccugcuucaguccc

SEQ ID NO: 2659855 - RNA, 15 nt, Human
cagccccgacuccag

SEQ ID NO: 2659856 - RNA, 16 nt, Human
cagccccgacuccagc

SEQ ID NO: 2659857 - RNA, 17 nt, Human
cagccccgacuccagcc

SEQ ID NO: 2659858 - RNA, 18 nt, Human
cagccccgacuccagcca

SEQ ID NO: 2659859 - RNA, 19 nt, Human
cagccccgacuccagccag

SEQ ID NO: 2659860 - RNA, 20 nt, Human
cagccccgacuccagccagc

SEQ ID NO: 2659861 - RNA, 21 nt, Human
cagccccgacuccagccagcg

SEQ ID NO: 2659862 - RNA, 19 nt, Human
cagcccccuaaaagcacuc

SEQ ID NO: 2659863 - RNA, 22 nt, Human
cagccccucuggucgcuccugc

SEQ ID NO: 2659864 - RNA, 18 nt, Human
cagccccucuggucgcuc

SEQ ID NO: 2659865 - RNA, 21 nt, Human
cagccccucuggucgcuccug

SEQ ID NO: 2659866 - RNA, 13 nt, Human
cagccccucuggu

SEQ ID NO: 2659867 - RNA, 14 nt, Human
cagccccucugguc

SEQ ID NO: 2659868 - RNA, 16 nt, Human
cagccccucuggucgc

SEQ ID NO: 2659869 - RNA, 17 nt, Human
cagcauagaaguaacuu

SEQ ID NO: 2659870 - RNA, 22 nt, Human
cagcacagcuugaccugaggcu

SEQ ID NO: 2659871 - RNA, 13 nt, Human
cagcacagcuuga

SEQ ID NO: 2659872 - RNA, 15 nt, Human
cagcacagcuugacc

SEQ ID NO: 2659873 - RNA, 14 nt, Human
cagauuugucuuuu

SEQ ID NO: 2659874 - RNA, 16 nt, Human
cagcacagcuugaccu

SEQ ID NO: 2659875 - RNA, 17 nt, Human
cagcacagcuugaccug

SEQ ID NO: 2659876 - RNA, 20 nt, Human
cagcacagcuugaccugagg

SEQ ID NO: 2659877 - RNA, 21 nt, Human
cagcacagcuugaccugaggc

SEQ ID NO: 2659878 - RNA, 16 nt, Human
cagauugccuguuucu

SEQ ID NO: 2659879 - RNA, 19 nt, Human
cagccagaggcaucugagg

SEQ ID NO: 2659880 - RNA, 12 nt, Human
cagccagcaccu

SEQ ID NO: 2659881 - RNA, 13 nt, Human
cagccagcaccug

SEQ ID NO: 2659882 - RNA, 14 nt, Human
cagccagcaccugg

SEQ ID NO: 2659883 - RNA, 16 nt, Human
cagccagcaccuggca

SEQ ID NO: 2659884 - RNA, 19 nt, Human
cccaggaaaggcaggauug

SEQ ID NO: 2659885 - RNA, 19 nt, Human
cccaggcuggagugcagug

SEQ ID NO: 2659886 - RNA, 20 nt, Human
cccauagcagccaguucaaa

SEQ ID NO: 2659887 - RNA, 15 nt, Human
cccauagucccugcc

SEQ ID NO: 2659888 - RNA, 23 nt, Human
cccagggcccucggugggagcca

SEQ ID NO: 2659889 - RNA, 22 nt, Human
cccagcuuaaaggggcuagagu

SEQ ID NO: 2659890 - RNA, 15 nt, Human
cccacccugcugcug

SEQ ID NO: 2659891 - RNA, 17 nt, Human
cccacccugcugcuggu

SEQ ID NO: 2659892 - RNA, 17 nt, Human
cccacuaaugcaaacug

SEQ ID NO: 2659893 - RNA, 14 nt, Human
cccacugccagcag

SEQ ID NO: 2659894 - RNA, 15 nt, Human
cccacugccagcagc

SEQ ID NO: 2659895 - RNA, 16 nt, Human
cccacugccagcagca

SEQ ID NO: 2659896 - RNA, 17 nt, Human
cccacugccagcagcag

SEQ ID NO: 2659897 - RNA, 21 nt, Human
cccacugccagcagcagcagg

SEQ ID NO: 2659898 - RNA, 13 nt, Human
cccacugccagca

SEQ ID NO: 2659899 - RNA, 17 nt, Human
cccacuucccacccugc

SEQ ID NO: 2659900 - RNA, 21 nt, Human
cccacuguuucucuugagcug

SEQ ID NO: 2659901 - RNA, 22 nt, Human
cccacuguuucucuugagcugg

SEQ ID NO: 2659902 - RNA, 23 nt, Human
cccacuguuucucuugagcuggc

SEQ ID NO: 2659903 - RNA, 18 nt, Human
cccacccugaaagcccug

SEQ ID NO: 2659904 - RNA, 13 nt, Human
cccacccccagcc

SEQ ID NO: 2659905 - RNA, 16 nt, Human
cccacccccagccccg

SEQ ID NO: 2659906 - RNA, 18 nt, Human
cccacccccagccccgac

SEQ ID NO: 2659907 - RNA, 22 nt, Human
ccccagcaagugguccuagagg

SEQ ID NO: 2659908 - RNA, 18 nt, Human
ccccagcaccucagccug

SEQ ID NO: 2659909 - RNA, 19 nt, Human
ccccaucuccccucagcuc

SEQ ID NO: 2659910 - RNA, 13 nt, Human
ccccaucucccug

SEQ ID NO: 2659911 - RNA, 14 nt, Human
ccccaucucccugc

SEQ ID NO: 2659912 - RNA, 17 nt, Human
ccccaucucccugccug

SEQ ID NO: 2659913 - RNA, 18 nt, Human
ccccaucucccugccugg

SEQ ID NO: 2659914 - RNA, 19 nt, Human
ccccaucucccugccuggc

SEQ ID NO: 2659915 - RNA, 20 nt, Human
ccccauuucccaucugcacc

SEQ ID NO: 2659916 - RNA, 22 nt, Human
ccccauuucccaucugcacccc

SEQ ID NO: 2659917 - RNA, 16 nt, Human
ccccauuucccaucug

SEQ ID NO: 2659918 - RNA, 17 nt, Human
ccccauuucccaucugc

SEQ ID NO: 2659919 - RNA, 18 nt, Human
ccccauuucccaucugca

SEQ ID NO: 2659920 - RNA, 19 nt, Human
ccccauuucccaucugcac

SEQ ID NO: 2659921 - RNA, 19 nt, Human
cccccaaagauagacaggu

SEQ ID NO: 2659922 - RNA, 24 nt, Human
cccccaaagauagacagguccuga

SEQ ID NO: 2659923 - RNA, 13 nt, Human
ccccaaacaguga

SEQ ID NO: 2659924 - RNA, 14 nt, Human
ccccgcuucugccu

SEQ ID NO: 2659925 - RNA, 15 nt, Human
ccccggagggcugcg

SEQ ID NO: 2659926 - RNA, 21 nt, Human
ccccggcaugagacucagugc

SEQ ID NO: 2659927 - RNA, 23 nt, Human
ccccggcaugagacucagugcag

SEQ ID NO: 2659928 - RNA, 13 nt, Human
ccccgacuccagc

SEQ ID NO: 2659929 - RNA, 14 nt, Human
ccccgacuccagcc

SEQ ID NO: 2659930 - RNA, 15 nt, Human
ccccgacuccagcca

SEQ ID NO: 2659931 - RNA, 16 nt, Human
ccccgacuccagccag

SEQ ID NO: 2659932 - RNA, 17 nt, Human
ccccgacuccagccagc

SEQ ID NO: 2659933 - RNA, 18 nt, Human
ccccgacuccagccagcg

SEQ ID NO: 2659934 - RNA, 13 nt, Human
ccccgcugcugug

SEQ ID NO: 2659935 - RNA, 18 nt, Human
cccuauuagagaagagau

SEQ ID NO: 2659936 - RNA, 14 nt, Human
cccgggagcggagg

SEQ ID NO: 2659937 - RNA, 18 nt, Human
cccggcucuacgggggcc

SEQ ID NO: 2659938 - RNA, 20 nt, Human
cccggcucuacgggggccgc

SEQ ID NO: 2659939 - RNA, 16 nt, Human
cccggcugcagaggcc

SEQ ID NO: 2659940 - RNA, 20 nt, Human
cccggcaugagacucagugc

SEQ ID NO: 2659941 - RNA, 23 nt, Human
cccggcaugagacucagugcaga

SEQ ID NO: 2659942 - RNA, 20 nt, Human
ccccuuguuugucccuucua

SEQ ID NO: 2659943 - RNA, 12 nt, Human
ccccucuggucg

SEQ ID NO: 2659944 - RNA, 23 nt, Human
ccccucuggucgcuccugcccac

SEQ ID NO: 2659945 - RNA, 19 nt, Human
ccccucuggucgcuccugc

SEQ ID NO: 2659946 - RNA, 20 nt, Human
ccccucuggucgcuccugcc

SEQ ID NO: 2659947 - RNA, 20 nt, Human
ccaugacaauguuguagugu

SEQ ID NO: 2659948 - RNA, 16 nt, Human
ccauggugauggugua

SEQ ID NO: 2659949 - RNA, 20 nt, Human
ccauggugaugguguagccc

SEQ ID NO: 2659950 - RNA, 13 nt, Human
ccauguccaaaga

SEQ ID NO: 2659951 - RNA, 14 nt, Human
ccauguccaaagag

SEQ ID NO: 2659952 - RNA, 17 nt, Human
ccauguccaaagaggcu

SEQ ID NO: 2659953 - RNA, 15 nt, Human
ccauguaagcacucu

SEQ ID NO: 2659954 - RNA, 20 nt, Human
ccauguccaaagaggcugcc

SEQ ID NO: 2659955 - RNA, 18 nt, Human
ccauguccaaagaggcug

SEQ ID NO: 2659956 - RNA, 19 nt, Human
ccauguccaaagaggcugc

SEQ ID NO: 2659957 - RNA, 12 nt, Human
ccaguucaaaaa

SEQ ID NO: 2659958 - RNA, 18 nt, Human
ccagggucccucugugua

SEQ ID NO: 2659959 - RNA, 16 nt, Human
ccagggucccucugug

SEQ ID NO: 2659960 - RNA, 17 nt, Human
ccagggucccucugugu

SEQ ID NO: 2659961 - RNA, 16 nt, Human
ccaggcaccucuuccu

SEQ ID NO: 2659962 - RNA, 19 nt, Human
ccaggggaaaaucagccug

SEQ ID NO: 2659963 - RNA, 20 nt, Human
ccaggggaaaaucagccugc

SEQ ID NO: 2659964 - RNA, 13 nt, Human
ccagggguuucuc

SEQ ID NO: 2659965 - RNA, 18 nt, Human
ccaggcucguggacugag

SEQ ID NO: 2659966 - RNA, 20 nt, Human
ccaggcucguggacugagug

SEQ ID NO: 2659967 - RNA, 21 nt, Human
ccaggcucguggacugagugg

SEQ ID NO: 2659968 - RNA, 23 nt, Human
ccaggcucguggacugaguggga

SEQ ID NO: 2659969 - RNA, 18 nt, Human
ccagagugcugaaggaau

SEQ ID NO: 2659970 - RNA, 16 nt, Human
ccaccuagaacacuaa

SEQ ID NO: 2659971 - RNA, 18 nt, Human
ccaccuagaacacuaacu

SEQ ID NO: 2659972 - RNA, 19 nt, Human
ccaccuagaacacuaacuc

SEQ ID NO: 2659973 - RNA, 14 nt, Human
ccagccccucuggu

SEQ ID NO: 2659974 - RNA, 15 nt, Human
ccagccccucugguc

SEQ ID NO: 2659975 - RNA, 17 nt, Human
ccagccccucuggucgc

SEQ ID NO: 2659976 - RNA, 22 nt, Human
ccagccccucuggucgcuccug

SEQ ID NO: 2659977 - RNA, 23 nt, Human
ccagccccucuggucgcuccugc

SEQ ID NO: 2659978 - RNA, 15 nt, Human
ccagccccucuuccc

SEQ ID NO: 2659979 - RNA, 17 nt, Human
ccagccccucuucccca

SEQ ID NO: 2659980 - RNA, 16 nt, Human
ccagcuguucagcugg

SEQ ID NO: 2659981 - RNA, 17 nt, Human
ccagcuguucagcuggu

SEQ ID NO: 2659982 - RNA, 19 nt, Human
ccagcuuaaaggggcuaga

SEQ ID NO: 2659983 - RNA, 23 nt, Human
ccaggaaacuccacaucugccuu

SEQ ID NO: 2659984 - RNA, 19 nt, Human
ccaggaacagcaaaugcaa

SEQ ID NO: 2659985 - RNA, 18 nt, Human
ccaggaacagcaaaugca

SEQ ID NO: 2659986 - RNA, 18 nt, Human
ccagcagcagcaggugau

SEQ ID NO: 2659987 - RNA, 14 nt, Human
ccagcagcagcagg

SEQ ID NO: 2659988 - RNA, 15 nt, Human
ccagcagcagcaggu

SEQ ID NO: 2659989 - RNA, 13 nt, Human
ccugcuggggauc

SEQ ID NO: 2659990 - RNA, 21 nt, Human
ccugcuggggauccccgccug

SEQ ID NO: 2659991 - RNA, 23 nt, Human
ccugcuggggauccccgccuggc

SEQ ID NO: 2659992 - RNA, 22 nt, Human
ccuggaucuaccagcauaaaua

SEQ ID NO: 2659993 - RNA, 16 nt, Human
ccuggaucuaccagca

SEQ ID NO: 2659994 - RNA, 16 nt, Human
ccuggauagacgaguu

SEQ ID NO: 2659995 - RNA, 22 nt, Human
ccuggaguguaugacugcacau

SEQ ID NO: 2659996 - RNA, 12 nt, Human
ccucucucucug

SEQ ID NO: 2659997 - RNA, 13 nt, Human
ccucugcucccca

SEQ ID NO: 2659998 - RNA, 14 nt, Human
ccucugcuccccag

SEQ ID NO: 2659999 - RNA, 21 nt, Human
ccucugccugccccgccccca

SEQ ID NO: 2660000 - RNA, 12 nt, Human
ccucugccugcc

SEQ ID NO: 2660001 - RNA, 13 nt, Human
ccucugccugccc

SEQ ID NO: 2660002 - RNA, 16 nt, Human
ccucugccugccccgc

SEQ ID NO: 2660003 - RNA, 11 nt, Human
ccucugccugc

SEQ ID NO: 2660004 - RNA, 12 nt, Human
ccugacuggugc

SEQ ID NO: 2660005 - RNA, 13 nt, Human
ccugacuggugcu

SEQ ID NO: 2660006 - RNA, 16 nt, Human
ccucuuguaaagacug

SEQ ID NO: 2660007 - RNA, 17 nt, Human
ccucuuguaaagacugg

SEQ ID NO: 2660008 - RNA, 20 nt, Human
ccucuugaccaggcugccuc

SEQ ID NO: 2660009 - RNA, 15 nt, Human
ccucuugaccaggcu

SEQ ID NO: 2660010 - RNA, 17 nt, Human
ccugagaggcaggcaua

SEQ ID NO: 2660011 - RNA, 18 nt, Human
ccugagaggcaggcauag

SEQ ID NO: 2660012 - RNA, 12 nt, Human
ccugagaggcag

SEQ ID NO: 2660013 - RNA, 13 nt, Human
ccugagaggcagg

SEQ ID NO: 2660014 - RNA, 14 nt, Human
ccugagaggcaggc

SEQ ID NO: 2660015 - RNA, 15 nt, Human
ccugagaggcaggca

SEQ ID NO: 2660016 - RNA, 14 nt, Human
ccucuugucugauu

SEQ ID NO: 2660017 - RNA, 13 nt, Human
ccucauguggcug

SEQ ID NO: 2660018 - RNA, 15 nt, Human
ccucauguggcugga

SEQ ID NO: 2660019 - RNA, 16 nt, Human
ccucauguggcuggaa

SEQ ID NO: 2660020 - RNA, 17 nt, Human
ccucauguggcuggaag

SEQ ID NO: 2660021 - RNA, 11 nt, Human
ccuccaagccu

SEQ ID NO: 2660022 - RNA, 18 nt, Human
ccucauuagcauuuugcu

SEQ ID NO: 2660023 - RNA, 18 nt, Human
ccucauguggcuggaaga

SEQ ID NO: 2660024 - RNA, 23 nt, Human
ccucauguggcuggaagauccug

SEQ ID NO: 2660025 - RNA, 18 nt, Human
ccucccacacccaaagcu

SEQ ID NO: 2660026 - RNA, 19 nt, Human
ccucccacacccaaagcug

SEQ ID NO: 2660027 - RNA, 22 nt, Human
ccucccacacccaaagcugagc

SEQ ID NO: 2660028 - RNA, 16 nt, Human
ccucccaggaagccca

SEQ ID NO: 2660029 - RNA, 17 nt, Human
ccucccaggaagcccag

SEQ ID NO: 2660030 - RNA, 18 nt, Human
ccucccaggaagcccagg

SEQ ID NO: 2660031 - RNA, 20 nt, Human
ccucccaggaagcccaggag

SEQ ID NO: 2660032 - RNA, 21 nt, Human
ccucccaggaagcccaggagc

SEQ ID NO: 2660033 - RNA, 15 nt, Human
ccuauuucaucacaa

SEQ ID NO: 2660034 - RNA, 16 nt, Human
ccuauuuccagaaaua

SEQ ID NO: 2660035 - RNA, 20 nt, Human
ccucaaccucuucuggcuca

SEQ ID NO: 2660036 - RNA, 17 nt, Human
ccucaaccucuucuggc

SEQ ID NO: 2660037 - RNA, 12 nt, Human
ccucaaccucuu

SEQ ID NO: 2660038 - RNA, 20 nt, Human
ccguaucuccggcucccagc

SEQ ID NO: 2660039 - RNA, 22 nt, Human
ccguaucuccggcucccagccu

SEQ ID NO: 2660040 - RNA, 13 nt, Human
ccgucaccaccac

SEQ ID NO: 2660041 - RNA, 15 nt, Human
ccgucaccaccaccc

SEQ ID NO: 2660042 - RNA, 16 nt, Human
ccgucaccaccacccc

SEQ ID NO: 2660043 - RNA, 17 nt, Human
ccgucaccaccaccccu

SEQ ID NO: 2660044 - RNA, 20 nt, Human
ccgucaccaccaccccuacc

SEQ ID NO: 2660045 - RNA, 22 nt, Human
ccgucaccaccaccccuaccac

SEQ ID NO: 2660046 - RNA, 20 nt, Human
ccgucuccaggggcugcuuc

SEQ ID NO: 2660047 - RNA, 21 nt, Human
ccgucuccaggggcugcuucc

SEQ ID NO: 2660048 - RNA, 21 nt, Human
ccuaagaucucgguuugccaa

SEQ ID NO: 2660049 - RNA, 21 nt, Human
ccuaaggcaucuaucugugcu

SEQ ID NO: 2660050 - RNA, 23 nt, Human
ccuaaggcaucuaucugugcuag

SEQ ID NO: 2660051 - RNA, 13 nt, Human
ccuagcacagcag

SEQ ID NO: 2660052 - RNA, 15 nt, Human
ccuagcacagcagcu

SEQ ID NO: 2660053 - RNA, 16 nt, Human
ccuagcacagcagcuu

SEQ ID NO: 2660054 - RNA, 15 nt, Human
cccuucucuuaguua

SEQ ID NO: 2660055 - RNA, 17 nt, Human
ccgaccagaggagccuu

SEQ ID NO: 2660056 - RNA, 18 nt, Human
ccgaccagaggagccuuu

SEQ ID NO: 2660057 - RNA, 19 nt, Human
ccgccaccgcggguguggg

SEQ ID NO: 2660058 - RNA, 18 nt, Human
ccgccagccuccucugga

SEQ ID NO: 2660059 - RNA, 23 nt, Human
ccgccagccuccucuggacggca

SEQ ID NO: 2660060 - RNA, 11 nt, Human
ccgccagccuc

SEQ ID NO: 2660061 - RNA, 12 nt, Human
ccgccagccucc

SEQ ID NO: 2660062 - RNA, 13 nt, Human
ccgccagccuccu

SEQ ID NO: 2660063 - RNA, 14 nt, Human
ccgccagccuccuc

SEQ ID NO: 2660064 - RNA, 15 nt, Human
ccgccagccuccucu

SEQ ID NO: 2660065 - RNA, 17 nt, Human
ccgccaaggcuggggga

SEQ ID NO: 2660066 - RNA, 21 nt, Human
ccgacccaggguucccgcggg

SEQ ID NO: 2660067 - RNA, 14 nt, Human
ccgcccccuccuga

SEQ ID NO: 2660068 - RNA, 19 nt, Human
ccgcccccaguccccaccc

SEQ ID NO: 2660069 - RNA, 19 nt, Human
ccgcccaugcacuggggac

SEQ ID NO: 2660070 - RNA, 13 nt, Human
ccgcccccagucc

SEQ ID NO: 2660071 - RNA, 13 nt, Human
ccgcccaugcacu

SEQ ID NO: 2660072 - RNA, 14 nt, Human
ccgcccaugcacug

SEQ ID NO: 2660073 - RNA, 16 nt, Human
ccgccaugcuccuggc

SEQ ID NO: 2660074 - RNA, 21 nt, Human
cccuggccucugugccuucuu

SEQ ID NO: 2660075 - RNA, 22 nt, Human
cccuggcugcugcccccacccc

SEQ ID NO: 2660076 - RNA, 22 nt, Human
cccuggcuguucugugguuccu

SEQ ID NO: 2660077 - RNA, 15 nt, Human
cccuggcugcugccc

SEQ ID NO: 2660078 - RNA, 18 nt, Human
cccuggcugcugccccca

SEQ ID NO: 2660079 - RNA, 14 nt, Human
cccuggcugccggc

SEQ ID NO: 2660080 - RNA, 13 nt, Human
cccuggcugcugc

SEQ ID NO: 2660081 - RNA, 14 nt, Human
cccuggcugcugcc

SEQ ID NO: 2660082 - RNA, 18 nt, Human
cccucacccccucccacc

SEQ ID NO: 2660083 - RNA, 14 nt, Human
cgcccuuuuccccu

SEQ ID NO: 2660084 - RNA, 20 nt, Human
cgccgauagagggacggcca

SEQ ID NO: 2660085 - RNA, 16 nt, Human
cgccaaggcuggggga

SEQ ID NO: 2660086 - RNA, 13 nt, Human
cgccaaggcuggg

SEQ ID NO: 2660087 - RNA, 12 nt, Human
cgccaaggcugg

SEQ ID NO: 2660088 - RNA, 12 nt, Human
cgccgccucuuu

SEQ ID NO: 2660089 - RNA, 15 nt, Human
cgccggaucugaggg

SEQ ID NO: 2660090 - RNA, 14 nt, Human
cgccgugggcugcg

SEQ ID NO: 2660091 - RNA, 15 nt, Human
cgccgucuccagggg

SEQ ID NO: 2660092 - RNA, 16 nt, Human
cgaccagaggagccuu

SEQ ID NO: 2660093 - RNA, 21 nt, Human
cgaccaccgccccuggccgcg

SEQ ID NO: 2660094 - RNA, 17 nt, Human
cgaccagaggagccuuu

SEQ ID NO: 2660095 - RNA, 14 nt, Human
cgaccauguggcca

SEQ ID NO: 2660096 - RNA, 16 nt, Human
cgaccauguggccaca

SEQ ID NO: 2660097 - RNA, 17 nt, Human
ccuuuuuaaaacacaug

SEQ ID NO: 2660098 - RNA, 13 nt, Human
cgaccuggccgcg

SEQ ID NO: 2660099 - RNA, 19 nt, Human
cgaccuggccgcggagccu

SEQ ID NO: 2660100 - RNA, 16 nt, Human
cggagguguggagccg

SEQ ID NO: 2660101 - RNA, 13 nt, Human
cgccgccaccgcg

SEQ ID NO: 2660102 - RNA, 13 nt, Human
cgccucccuccac

SEQ ID NO: 2660103 - RNA, 15 nt, Human
cgccucccuccaccc

SEQ ID NO: 2660104 - RNA, 18 nt, Human
cgccucccuccaccccag

SEQ ID NO: 2660105 - RNA, 20 nt, Human
cgccucccuccaccccagga

SEQ ID NO: 2660106 - RNA, 17 nt, Human
cgccuccccaccuccag

SEQ ID NO: 2660107 - RNA, 18 nt, Human
cgccuccccaccuccagg

SEQ ID NO: 2660108 - RNA, 19 nt, Human
cgccuccccaccuccaggc

SEQ ID NO: 2660109 - RNA, 16 nt, Human
cgccuccccugcccca

SEQ ID NO: 2660110 - RNA, 15 nt, Human
cgccucuccucgguu

SEQ ID NO: 2660111 - RNA, 23 nt, Human
cgacauggcuccggccucugccu

SEQ ID NO: 2660112 - RNA, 13 nt, Human
ccuuuuguuuucu

SEQ ID NO: 2660113 - RNA, 15 nt, Human
ccuuuuuaaaacaca

SEQ ID NO: 2660114 - RNA, 19 nt, Human
ccuuuucgccuuuccucuc

SEQ ID NO: 2660115 - RNA, 15 nt, Human
ccuuuucuggcaccg

SEQ ID NO: 2660116 - RNA, 22 nt, Human
ccuuuucuggggaaagacacug

SEQ ID NO: 2660117 - RNA, 17 nt, Human
ccuuuucgccuuuccuc

SEQ ID NO: 2660118 - RNA, 18 nt, Human
ccuuucccccuucucuua

SEQ ID NO: 2660119 - RNA, 20 nt, Human
ccuuuccccgacgcccaccc

SEQ ID NO: 2660120 - RNA, 19 nt, Human
ccuuuccaccacagccagc

SEQ ID NO: 2660121 - RNA, 23 nt, Human
ccuuuccaccacagccagcaccu

SEQ ID NO: 2660122 - RNA, 16 nt, Human
ccuuggacauccuccu

SEQ ID NO: 2660123 - RNA, 17 nt, Human
ccuuggacauccuccuc

SEQ ID NO: 2660124 - RNA, 23 nt, Human
ccuugccuccccauuucccaucu

SEQ ID NO: 2660125 - RNA, 12 nt, Human
ccuugccucccc

SEQ ID NO: 2660126 - RNA, 14 nt, Human
ccuugccuccccau

SEQ ID NO: 2660127 - RNA, 17 nt, Human
ccuugccuccccauuuc

SEQ ID NO: 2660128 - RNA, 22 nt, Human
ccuugccuccccauuucccauc

SEQ ID NO: 2660129 - RNA, 14 nt, Human
ccuggccucugugc

SEQ ID NO: 2660130 - RNA, 15 nt, Human
cuaauugguacuuuu

SEQ ID NO: 2660131 - RNA, 19 nt, Human
cuaauugguacuuuuaaaa

SEQ ID NO: 2660132 - RNA, 21 nt, Human
cuaauugguacuuuuaaaaac

SEQ ID NO: 2660133 - RNA, 13 nt, Human
cuaauuuuuuugu

SEQ ID NO: 2660134 - RNA, 18 nt, Human
cuaauuuuuguauuauuu

SEQ ID NO: 2660135 - RNA, 19 nt, Human
cuaauuuuuguauuauuuu

SEQ ID NO: 2660136 - RNA, 21 nt, Human
cuacaugaggaacuguagaug

SEQ ID NO: 2660137 - RNA, 13 nt, Human
cuacaguugaaaa

SEQ ID NO: 2660138 - RNA, 21 nt, Human
cgugugagaagugaaugcugg

SEQ ID NO: 2660139 - RNA, 23 nt, Human
cgugugagaagugaaugcuggga

SEQ ID NO: 2660140 - RNA, 22 nt, Human
cgugugagaagugaaugcuggg

SEQ ID NO: 2660141 - RNA, 15 nt, Human
cuaaagagcccuugc

SEQ ID NO: 2660142 - RNA, 16 nt, Human
cuaaagagcccuugcc

SEQ ID NO: 2660143 - RNA, 17 nt, Human
cuaaagagcccuugccu

SEQ ID NO: 2660144 - RNA, 18 nt, Human
cuaaagagcccuugccuc

SEQ ID NO: 2660145 - RNA, 15 nt, Human
cgugugccugugugc

SEQ ID NO: 2660146 - RNA, 19 nt, Human
cguggguccugaggccugc

SEQ ID NO: 2660147 - RNA, 15 nt, Human
cguggggcagggagc

SEQ ID NO: 2660148 - RNA, 16 nt, Human
cguggggcagggagcu

SEQ ID NO: 2660149 - RNA, 22 nt, Human
cguggggcagggagcugggccc

SEQ ID NO: 2660150 - RNA, 23 nt, Human
cguggggcagggagcugggcccg

SEQ ID NO: 2660151 - RNA, 16 nt, Human
cgugggggggcgugga

SEQ ID NO: 2660152 - RNA, 15 nt, Human
cguggggugugcugg

SEQ ID NO: 2660153 - RNA, 17 nt, Human
cguggggugugcuggga

SEQ ID NO: 2660154 - RNA, 18 nt, Human
cguggggugugcugggag

SEQ ID NO: 2660155 - RNA, 22 nt, Human
cggagguugcagugagcugaga

SEQ ID NO: 2660156 - RNA, 13 nt, Human
cggcucugcaguc

SEQ ID NO: 2660157 - RNA, 11 nt, Human
cggcugaccau

SEQ ID NO: 2660158 - RNA, 14 nt, Human
cggcugaccaugcu

SEQ ID NO: 2660159 - RNA, 15 nt, Human
cggcugaccaugcuc

SEQ ID NO: 2660160 - RNA, 16 nt, Human
cggcugaccaugcuca

SEQ ID NO: 2660161 - RNA, 22 nt, Human
cggcugaccaugcucaucugcu

SEQ ID NO: 2660162 - RNA, 23 nt, Human
cggcugaccaugcucaucugcug

SEQ ID NO: 2660163 - RNA, 15 nt, Human
cgugacccgaccugg

SEQ ID NO: 2660164 - RNA, 18 nt, Human
cgugacccgaccuggccg

SEQ ID NO: 2660165 - RNA, 20 nt, Human
cgugaccggacuuuucugca

SEQ ID NO: 2660166 - RNA, 23 nt, Human
cuaaagagcccuugccuccccau

SEQ ID NO: 2660167 - RNA, 19 nt, Human
cuaaagagcccuugccucc

SEQ ID NO: 2660168 - RNA, 20 nt, Human
cuaaagagcccuugccuccc

SEQ ID NO: 2660169 - RNA, 21 nt, Human
cuaaagagcccuugccucccc

SEQ ID NO: 2660170 - RNA, 22 nt, Human
cuaaagagcccuugccucccca

SEQ ID NO: 2660171 - RNA, 13 nt, Human
cuaacuguaaauc

SEQ ID NO: 2660172 - RNA, 14 nt, Human
cuaacuguaaauca

SEQ ID NO: 2660173 - RNA, 15 nt, Human
cuaacuguaaaucau

SEQ ID NO: 2660174 - RNA, 17 nt, Human
cuaacuguaaaucaugu

SEQ ID NO: 2660175 - RNA, 18 nt, Human
cuaacuguaaaucauguu

SEQ ID NO: 2660176 - RNA, 20 nt, Human
cuaacgaaauaucaaaguca

SEQ ID NO: 2660177 - RNA, 17 nt, Human
cuaagaaaagccuaauc

SEQ ID NO: 2660178 - RNA, 22 nt, Human
cuaagaaaagccuaaucacagu

SEQ ID NO: 2660179 - RNA, 23 nt, Human
cuagcagcagggagggcuucugc

SEQ ID NO: 2660180 - RNA, 19 nt, Human
cuagcagcccacccugcug

SEQ ID NO: 2660181 - RNA, 20 nt, Human
cuagcagcccacccugcugc

SEQ ID NO: 2660182 - RNA, 23 nt, Human
cuagcagcccacccugcugcugg

SEQ ID NO: 2660183 - RNA, 16 nt, Human
cuagaacacuaacuca

SEQ ID NO: 2660184 - RNA, 22 nt, Human
cuagcagcagggagggcuucug

SEQ ID NO: 2660185 - RNA, 12 nt, Human
cuagcagcaggg

SEQ ID NO: 2660186 - RNA, 20 nt, Human
cuagaaauugacacaagugg

SEQ ID NO: 2660187 - RNA, 16 nt, Human
cuagaaauugacacaa

SEQ ID NO: 2660188 - RNA, 12 nt, Human
cuagaaauuuuc

SEQ ID NO: 2660189 - RNA, 13 nt, Human
cuagaaauuuuca

SEQ ID NO: 2660190 - RNA, 19 nt, Human
cuagaaauuccccacccug

SEQ ID NO: 2660191 - RNA, 22 nt, Human
cuaguucuuuguucauagccca

SEQ ID NO: 2660192 - RNA, 12 nt, Human
cuaguugaauac

SEQ ID NO: 2660193 - RNA, 18 nt, Human
cuaguugaauacuugaac

SEQ ID NO: 2660194 - RNA, 17 nt, Human
cuaguugaauacuugaa

SEQ ID NO: 2660195 - RNA, 15 nt, Human
cuaguugaauacuug

SEQ ID NO: 2660196 - RNA, 13 nt, Human
cuaguugaauacu

SEQ ID NO: 2660197 - RNA, 23 nt, Human
cuaguugaauacuugaaccauaa

SEQ ID NO: 2660198 - RNA, 21 nt, Human
cuaguugaauacuugaaccau

SEQ ID NO: 2660199 - RNA, 20 nt, Human
cuaguugaauacuugaacca

SEQ ID NO: 2660200 - RNA, 20 nt, Human
cuagccugaugagauuuuua

SEQ ID NO: 2660201 - RNA, 16 nt, Human
cuagccgguuccuguc

SEQ ID NO: 2660202 - RNA, 15 nt, Human
cuagccgguuccugu

SEQ ID NO: 2660203 - RNA, 19 nt, Human
cuagccgguuccugucccu

SEQ ID NO: 2660204 - RNA, 19 nt, Human
cuagggaaaaaccagcgug

SEQ ID NO: 2660205 - RNA, 21 nt, Human
cuagggaaaaaccagcgugug

SEQ ID NO: 2660206 - RNA, 16 nt, Human
cuagggccuuggaaau

SEQ ID NO: 2660207 - RNA, 17 nt, Human
cucccacccggcugcag

SEQ ID NO: 2660208 - RNA, 19 nt, Human
cucccacccggcugcagag

SEQ ID NO: 2660209 - RNA, 14 nt, Human
cuccccgcuucugc

SEQ ID NO: 2660210 - RNA, 15 nt, Human
cucccugcagaugcc

SEQ ID NO: 2660211 - RNA, 16 nt, Human
cucccugcagaugcca

SEQ ID NO: 2660212 - RNA, 23 nt, Human
cucccugcagaugccacccuagc

SEQ ID NO: 2660213 - RNA, 14 nt, Human
cucccuccuccagg

SEQ ID NO: 2660214 - RNA, 15 nt, Human
cucccuccuccaggc

SEQ ID NO: 2660215 - RNA, 16 nt, Human
cucccuccuccaggcc

SEQ ID NO: 2660216 - RNA, 21 nt, Human
cuccgcugccgugccgccugc

SEQ ID NO: 2660217 - RNA, 22 nt, Human
cuccaggggcugcuuccuccug

SEQ ID NO: 2660218 - RNA, 23 nt, Human
cuccaggggcugcuuccuccugg

SEQ ID NO: 2660219 - RNA, 17 nt, Human
cuauccccaucucccug

SEQ ID NO: 2660220 - RNA, 18 nt, Human
cuauccccaucucccugc

SEQ ID NO: 2660221 - RNA, 19 nt, Human
cuauccccaucucccugcc

SEQ ID NO: 2660222 - RNA, 20 nt, Human
cuauccccaucucccugccu

SEQ ID NO: 2660223 - RNA, 21 nt, Human
cuauccccaucucccugccug

SEQ ID NO: 2660224 - RNA, 22 nt, Human
cuauccccaucucccugccugg

SEQ ID NO: 2660225 - RNA, 23 nt, Human
cuauccccaucucccugccuggc

SEQ ID NO: 2660226 - RNA, 18 nt, Human
cucagccucccaaguaac

SEQ ID NO: 2660227 - RNA, 19 nt, Human
cucagccuucagacagaga

SEQ ID NO: 2660228 - RNA, 16 nt, Human
cucagccuucagacag

SEQ ID NO: 2660229 - RNA, 17 nt, Human
cucagccuucagacaga

SEQ ID NO: 2660230 - RNA, 15 nt, Human
cucagccuucagaca

SEQ ID NO: 2660231 - RNA, 16 nt, Human
cucagcgcggcccucc

SEQ ID NO: 2660232 - RNA, 14 nt, Human
cucagcgcggcccu

SEQ ID NO: 2660233 - RNA, 20 nt, Human
cuccaaauggagaagcugca

SEQ ID NO: 2660234 - RNA, 21 nt, Human
cuccaaauggagaagcugcag

SEQ ID NO: 2660235 - RNA, 22 nt, Human
cuccaaauggagaagcugcagg

SEQ ID NO: 2660236 - RNA, 12 nt, Human
cuccaacccugc

SEQ ID NO: 2660237 - RNA, 13 nt, Human
cuccaacccugcc

SEQ ID NO: 2660238 - RNA, 14 nt, Human
cuccaacccugccg

SEQ ID NO: 2660239 - RNA, 15 nt, Human
cuccaacccugccgu

SEQ ID NO: 2660240 - RNA, 22 nt, Human
cuccaacccugccgucaccacc

SEQ ID NO: 2660241 - RNA, 23 nt, Human
cuccaacccugccgucaccacca

SEQ ID NO: 2660242 - RNA, 22 nt, Human
cucaguggguuaacaucaguuu

SEQ ID NO: 2660243 - RNA, 15 nt, Human
cucagugcccuccag

SEQ ID NO: 2660244 - RNA, 16 nt, Human
cucagugcccuccagc

SEQ ID NO: 2660245 - RNA, 22 nt, Human
cucagugcauuugugcuagaaa

SEQ ID NO: 2660246 - RNA, 22 nt, Human
cucuccuaacugccagcccccu

SEQ ID NO: 2660247 - RNA, 17 nt, Human
cucuccuacucggcucu

SEQ ID NO: 2660248 - RNA, 18 nt, Human
cucuccuacucggcucug

SEQ ID NO: 2660249 - RNA, 19 nt, Human
cucuccuacucggcucugc

SEQ ID NO: 2660250 - RNA, 16 nt, Human
cucuccggggccauuu

SEQ ID NO: 2660251 - RNA, 21 nt, Human
cucuccggggccauuugcaau

SEQ ID NO: 2660252 - RNA, 23 nt, Human
cucuccccagguccagcucugga

SEQ ID NO: 2660253 - RNA, 18 nt, Human
cucuccccagguccagcu

SEQ ID NO: 2660254 - RNA, 20 nt, Human
cucuccccagguccagcucu

SEQ ID NO: 2660255 - RNA, 15 nt, Human
cucuccccaggucca

SEQ ID NO: 2660256 - RNA, 16 nt, Human
cucuccccagguccag

SEQ ID NO: 2660257 - RNA, 14 nt, Human
cucuauuaaaaugc

SEQ ID NO: 2660258 - RNA, 17 nt, Human
cucuauuuauguuugca

SEQ ID NO: 2660259 - RNA, 16 nt, Human
cucuauuuauguuugc

SEQ ID NO: 2660260 - RNA, 14 nt, Human
cucuauuugagaau

SEQ ID NO: 2660261 - RNA, 14 nt, Human
cucucaaguaauau

SEQ ID NO: 2660262 - RNA, 15 nt, Human
cuccguuagcuccug

SEQ ID NO: 2660263 - RNA, 16 nt, Human
cuccguuagcuccugu

SEQ ID NO: 2660264 - RNA, 16 nt, Human
cucugucacccuuguc

SEQ ID NO: 2660265 - RNA, 19 nt, Human
cucugucacccuuguccuu

SEQ ID NO: 2660266 - RNA, 11 nt, Human
cucuguacuuu

SEQ ID NO: 2660267 - RNA, 12 nt, Human
cucuguacuuuu

SEQ ID NO: 2660268 - RNA, 20 nt, Human
cucuguacuuuucauucucu

SEQ ID NO: 2660269 - RNA, 22 nt, Human
cucuguacuuuucauucucuuu

SEQ ID NO: 2660270 - RNA, 14 nt, Human
cucugcacccagaa

SEQ ID NO: 2660271 - RNA, 15 nt, Human
cucugcacccagaac

SEQ ID NO: 2660272 - RNA, 16 nt, Human
cucugcacccagaaca

SEQ ID NO: 2660273 - RNA, 17 nt, Human
cucugcacccagaacag

SEQ ID NO: 2660274 - RNA, 23 nt, Human
cucugcuauauauaaaacggugc

SEQ ID NO: 2660275 - RNA, 15 nt, Human
cucugcgucuauccu

SEQ ID NO: 2660276 - RNA, 21 nt, Human
cucugcgucuauccuguguag

SEQ ID NO: 2660277 - RNA, 21 nt, Human
cucugcucaccgcccaucagg

SEQ ID NO: 2660278 - RNA, 22 nt, Human
cucugcucaccgcccaucaggg

SEQ ID NO: 2660279 - RNA, 14 nt, Human
cugaaggaaaaaca

SEQ ID NO: 2660280 - RNA, 16 nt, Human
cugaaggaaaaacaca

SEQ ID NO: 2660281 - RNA, 17 nt, Human
cugaaggaaaaacacaa

SEQ ID NO: 2660282 - RNA, 11 nt, Human
cugaaggaaaa

SEQ ID NO: 2660283 - RNA, 18 nt, Human
cugaaggaaaaacacaag

SEQ ID NO: 2660284 - RNA, 21 nt, Human
cugaaggaaaaacacaagcaa

SEQ ID NO: 2660285 - RNA, 22 nt, Human
cugaaggaaaaacacaagcaaa

SEQ ID NO: 2660286 - RNA, 22 nt, Human
cugaaaacaauggaguauucuc

SEQ ID NO: 2660287 - RNA, 16 nt, Human
cugacagaaggugcca

SEQ ID NO: 2660288 - RNA, 21 nt, Human
cugacagaaggugccacuuua

SEQ ID NO: 2660289 - RNA, 15 nt, Human
gcugcagaggccaga

SEQ ID NO: 2660290 - RNA, 18 nt, Human
gcugcagaggccagaggc

SEQ ID NO: 2660291 - RNA, 22 nt, Human
gcugcagaggccagaggccccc

SEQ ID NO: 2660292 - RNA, 17 nt, Human
gcugcaggacuugagaa

SEQ ID NO: 2660293 - RNA, 20 nt, Human
gcugcaggcuuugccauugu

SEQ ID NO: 2660294 - RNA, 15 nt, Human
gcugcacccucaggc

SEQ ID NO: 2660295 - RNA, 13 nt, Human
gcugcacccucag

SEQ ID NO: 2660296 - RNA, 18 nt, Human
gcugcagagauuucucau

SEQ ID NO: 2660297 - RNA, 13 nt, Human
gcugcagagcagu

SEQ ID NO: 2660298 - RNA, 16 nt, Human
gcugcacccucaggca

SEQ ID NO: 2660299 - RNA, 13 nt, Human
gcugagguuccuc

SEQ ID NO: 2660300 - RNA, 16 nt, Human
gcugagguuccucugc

SEQ ID NO: 2660301 - RNA, 17 nt, Human
gcugagguuccucugcc

SEQ ID NO: 2660302 - RNA, 18 nt, Human
gcugagguuccucugccu

SEQ ID NO: 2660303 - RNA, 19 nt, Human
gcugagguuccucugccug

SEQ ID NO: 2660304 - RNA, 20 nt, Human
gcugagguuccucugccugc

SEQ ID NO: 2660305 - RNA, 21 nt, Human
gcugagguuccucugccugcc

SEQ ID NO: 2660306 - RNA, 22 nt, Human
gcugagguuccucugccugccc

SEQ ID NO: 2660307 - RNA, 23 nt, Human
gcugagguuccucugccugcccc

SEQ ID NO: 2660308 - RNA, 15 nt, Human
gcugaggugggagga

SEQ ID NO: 2660309 - RNA, 17 nt, Human
gcugaggccugggccgc

SEQ ID NO: 2660310 - RNA, 20 nt, Human
gcugaggccugggccgcugc

SEQ ID NO: 2660311 - RNA, 23 nt, Human
gcugaggccugggccgcugccac

SEQ ID NO: 2660312 - RNA, 22 nt, Human
gcugcugugcaacggucuccug

SEQ ID NO: 2660313 - RNA, 12 nt, Human
gcugcugugaag

SEQ ID NO: 2660314 - RNA, 20 nt, Human
gcugcuccgaggacccagga

SEQ ID NO: 2660315 - RNA, 13 nt, Human
gcugcucccuggc

SEQ ID NO: 2660316 - RNA, 21 nt, Human
gcugcugggggcaacuggcca

SEQ ID NO: 2660317 - RNA, 22 nt, Human
gcugcugggggcaacuggccau

SEQ ID NO: 2660318 - RNA, 15 nt, Human
gcugcuggugcacag

SEQ ID NO: 2660319 - RNA, 17 nt, Human
gcugcuggugcacagcc

SEQ ID NO: 2660320 - RNA, 21 nt, Human
gcuggagcacugggcucccgg

SEQ ID NO: 2660321 - RNA, 18 nt, Human
gcuggagcacugggcucc

SEQ ID NO: 2660322 - RNA, 16 nt, Human
gcuggagcacugggcu

SEQ ID NO: 2660323 - RNA, 15 nt, Human
gcuggagcacugggc

SEQ ID NO: 2660324 - RNA, 14 nt, Human
gcuggagcacuggg

SEQ ID NO: 2660325 - RNA, 19 nt, Human
gcuccagcaacacagccug

SEQ ID NO: 2660326 - RNA, 22 nt, Human
gcuccagcaacacagccugggc

SEQ ID NO: 2660327 - RNA, 16 nt, Human
gcucccaggggucucc

SEQ ID NO: 2660328 - RNA, 18 nt, Human
gcucccaggggucucccu

SEQ ID NO: 2660329 - RNA, 19 nt, Human
gcucccaggggucucccug

SEQ ID NO: 2660330 - RNA, 20 nt, Human
gcucccaggggucucccugg

SEQ ID NO: 2660331 - RNA, 21 nt, Human
gcucccaggggucucccuggc

SEQ ID NO: 2660332 - RNA, 22 nt, Human
gcucccaggggucucccuggcu

SEQ ID NO: 2660333 - RNA, 23 nt, Human
gcuccagcaacacagccugggcc

SEQ ID NO: 2660334 - RNA, 21 nt, Human
gcuccagcgaucucuccacug

SEQ ID NO: 2660335 - RNA, 19 nt, Human
gcucuaucgcccaggcugg

SEQ ID NO: 2660336 - RNA, 17 nt, Human
gcucuaugcuuuccaaa

SEQ ID NO: 2660337 - RNA, 18 nt, Human
gcucucaaguuaucaggg

SEQ ID NO: 2660338 - RNA, 13 nt, Human
gcucuacgggggc

SEQ ID NO: 2660339 - RNA, 14 nt, Human
gcucucuuugcaac

SEQ ID NO: 2660340 - RNA, 12 nt, Human
gcugaaaacaau

SEQ ID NO: 2660341 - RNA, 14 nt, Human
gcucugugcaguca

SEQ ID NO: 2660342 - RNA, 19 nt, Human
gcucugugcagucacugga

SEQ ID NO: 2660343 - RNA, 21 nt, Human
gcucugugcagucacuggagg

SEQ ID NO: 2660344 - RNA, 24 nt, Human
gcucuguggaugccagggccgacc

SEQ ID NO: 2660345 - RNA, 17 nt, Human
gcugaauacagaggcaa

SEQ ID NO: 2660346 - RNA, 16 nt, Human
gcugaagaauugaaaa

SEQ ID NO: 2660347 - RNA, 19 nt, Human
gcugaaguugcagauguua

SEQ ID NO: 2660348 - RNA, 20 nt, Human
gcugagccucugcuccccag

SEQ ID NO: 2660349 - RNA, 12 nt, Human
gcugagccugca

SEQ ID NO: 2660350 - RNA, 15 nt, Human
gcugagccugcaggg

SEQ ID NO: 2660351 - RNA, 16 nt, Human
gcugagccugcaggga

SEQ ID NO: 2660352 - RNA, 19 nt, Human
gcugagccugcagggaagc

SEQ ID NO: 2660353 - RNA, 20 nt, Human
gcugagccugcagggaagcc

SEQ ID NO: 2660354 - RNA, 19 nt, Human
gcugagccucugcucccca

SEQ ID NO: 2660355 - RNA, 13 nt, Human
gcugagccucugc

SEQ ID NO: 2660356 - RNA, 13 nt, Human
gcugaggccuggg

SEQ ID NO: 2660357 - RNA, 14 nt, Human
gcugaggccugggc

SEQ ID NO: 2660358 - RNA, 15 nt, Human
gcugaggccugggcc

SEQ ID NO: 2660359 - RNA, 16 nt, Human
gcugaggccugggccg

SEQ ID NO: 2660360 - RNA, 18 nt, Human
gcuguacgacacgggugg

SEQ ID NO: 2660361 - RNA, 16 nt, Human
gcuuaaugcuacaugu

SEQ ID NO: 2660362 - RNA, 18 nt, Human
gcuuaaugcuacauguga

SEQ ID NO: 2660363 - RNA, 18 nt, Human
gcuuaauggaguucuugu

SEQ ID NO: 2660364 - RNA, 13 nt, Human
gcuguuuuuuugu

SEQ ID NO: 2660365 - RNA, 19 nt, Human
gcuguugcuuaaaccacuu

SEQ ID NO: 2660366 - RNA, 17 nt, Human
gcuguuuguccugagau

SEQ ID NO: 2660367 - RNA, 20 nt, Human
gcuuccugcguccuccucac

SEQ ID NO: 2660368 - RNA, 11 nt, Human
gcuugaagcca

SEQ ID NO: 2660369 - RNA, 12 nt, Human
gcuugaagccaa

SEQ ID NO: 2660370 - RNA, 14 nt, Human
gcuugaagccaaag

SEQ ID NO: 2660371 - RNA, 15 nt, Human
gcuugaagccaaaga

SEQ ID NO: 2660372 - RNA, 16 nt, Human
gcuugaagccaaagaa

SEQ ID NO: 2660373 - RNA, 11 nt, Human
gcuugaagcug

SEQ ID NO: 2660374 - RNA, 18 nt, Human
gcuugaagccaaagaaaa

SEQ ID NO: 2660375 - RNA, 20 nt, Human
gcuugaagccaaagaaaaau

SEQ ID NO: 2660376 - RNA, 20 nt, Human
gcuugaccaggcuuggccuu

SEQ ID NO: 2660377 - RNA, 15 nt, Human
gcuuucugccaucua

SEQ ID NO: 2660378 - RNA, 14 nt, Human
gcuuucuggggccu

SEQ ID NO: 2660379 - RNA, 17 nt, Human
gcuuucuggggccuagc

SEQ ID NO: 2660380 - RNA, 23 nt, Human
gcuuucuggggccuagcgaucuc

SEQ ID NO: 2660381 - RNA, 19 nt, Human
gcuuucuccuuuaauugua

SEQ ID NO: 2660382 - RNA, 14 nt, Human
gcuugaccugaggc

SEQ ID NO: 2660383 - RNA, 15 nt, Human
gcuugguucugugaa

SEQ ID NO: 2660384 - RNA, 21 nt, Human
gcuuucccacuucccacccug

SEQ ID NO: 2660385 - RNA, 22 nt, Human
gcuuucccacuucccacccugc

SEQ ID NO: 2660386 - RNA, 14 nt, Human
gcuuuucugcccug

SEQ ID NO: 2660387 - RNA, 15 nt, Human
gcuuuucugcccugg

SEQ ID NO: 2660388 - RNA, 11 nt, Human
gcuuuuggcaa

SEQ ID NO: 2660389 - RNA, 17 nt, Human
gcuuuuuuguuuuggcu

SEQ ID NO: 2660390 - RNA, 16 nt, Human
gcuuuuuguguuuuuu

SEQ ID NO: 2660391 - RNA, 21 nt, Human
gcuuuuccuuggcauuccgca

SEQ ID NO: 2660392 - RNA, 18 nt, Human
gcuuuuggggagccagaa

SEQ ID NO: 2660393 - RNA, 15 nt, Human
gcuuugaucccugac

SEQ ID NO: 2660394 - RNA, 14 nt, Human
gcuuugaucccuga

SEQ ID NO: 2660395 - RNA, 13 nt, Human
ggaagaagggaga

SEQ ID NO: 2660396 - RNA, 14 nt, Human
ggaagaagggagaa

SEQ ID NO: 2660397 - RNA, 15 nt, Human
ggaagaagggagaag

SEQ ID NO: 2660398 - RNA, 16 nt, Human
ggaagaagggagaaga

SEQ ID NO: 2660399 - RNA, 16 nt, Human
ggaagacaaugugaaa

SEQ ID NO: 2660400 - RNA, 14 nt, Human
ggaagacaauguga

SEQ ID NO: 2660401 - RNA, 15 nt, Human
ggaagaacaggccuc

SEQ ID NO: 2660402 - RNA, 23 nt, Human
ggaacaaguugagcuaugacuua

SEQ ID NO: 2660403 - RNA, 13 nt, Human
ggaacaaguugag

SEQ ID NO: 2660404 - RNA, 15 nt, Human
ggaacaaauuauuuu

SEQ ID NO: 2660405 - RNA, 18 nt, Human
ggaaauguuuuguaaaca

SEQ ID NO: 2660406 - RNA, 16 nt, Human
ggaaauuccuguacug

SEQ ID NO: 2660407 - RNA, 23 nt, Human
ggaaauuuuacaagggcauaaag

SEQ ID NO: 2660408 - RNA, 22 nt, Human
ggaaaccgaguagaaaauguga

SEQ ID NO: 2660409 - RNA, 15 nt, Human
ggaagaaacugcuga

SEQ ID NO: 2660410 - RNA, 18 nt, Human
ggaagaagggagaagaaa

SEQ ID NO: 2660411 - RNA, 11 nt, Human
ggaagaaugaa

SEQ ID NO: 2660412 - RNA, 13 nt, Human
ggaagaaugaaag

SEQ ID NO: 2660413 - RNA, 16 nt, Human
ggaagaaugaaagcug

SEQ ID NO: 2660414 - RNA, 22 nt, Human
gccauagaguacacugccugcc

SEQ ID NO: 2660415 - RNA, 17 nt, Human
gccauagaguacacugc

SEQ ID NO: 2660416 - RNA, 19 nt, Human
gccauagaguacacugccu

SEQ ID NO: 2660417 - RNA, 18 nt, Human
gccauagaguacacugcc

SEQ ID NO: 2660418 - RNA, 14 nt, Human
gccaggccagccuc

SEQ ID NO: 2660419 - RNA, 15 nt, Human
gccaggccagccucc

SEQ ID NO: 2660420 - RNA, 12 nt, Human
gccaggccagcc

SEQ ID NO: 2660421 - RNA, 13 nt, Human
gccaggccagccu

SEQ ID NO: 2660422 - RNA, 14 nt, Human
gccaggcaggggug

SEQ ID NO: 2660423 - RNA, 15 nt, Human
gccaggcaggggugg

SEQ ID NO: 2660424 - RNA, 16 nt, Human
gccaggcagggguggg

SEQ ID NO: 2660425 - RNA, 17 nt, Human
gccaggcaggggugggg

SEQ ID NO: 2660426 - RNA, 19 nt, Human
gccaggccagccuccgaga

SEQ ID NO: 2660427 - RNA, 14 nt, Human
gcccaggagccuca

SEQ ID NO: 2660428 - RNA, 15 nt, Human
gcccaggagccucac

SEQ ID NO: 2660429 - RNA, 18 nt, Human
gcccaggagccucacugg

SEQ ID NO: 2660430 - RNA, 16 nt, Human
gccaugugcuucugcc

SEQ ID NO: 2660431 - RNA, 19 nt, Human
gccauacauaaaagaaaua

SEQ ID NO: 2660432 - RNA, 23 nt, Human
gccauguggaaggcaagccaggc

SEQ ID NO: 2660433 - RNA, 19 nt, Human
gccccaaucccuuuauuac

SEQ ID NO: 2660434 - RNA, 18 nt, Human
gccccaaucccuuuauua

SEQ ID NO: 2660435 - RNA, 12 nt, Human
gccccacccugg

SEQ ID NO: 2660436 - RNA, 13 nt, Human
gccugcuccagcu

SEQ ID NO: 2660437 - RNA, 14 nt, Human
gccuccacagcgag

SEQ ID NO: 2660438 - RNA, 23 nt, Human
gccugcuagcuagcucaacuagu

SEQ ID NO: 2660439 - RNA, 22 nt, Human
gccugcuagcuagcucaacuag

SEQ ID NO: 2660440 - RNA, 20 nt, Human
gccugcuagcuagcucaacu

SEQ ID NO: 2660441 - RNA, 16 nt, Human
gccugcuagcuagcuc

SEQ ID NO: 2660442 - RNA, 13 nt, Human
gccugcgccugcu

SEQ ID NO: 2660443 - RNA, 16 nt, Human
gccugcgccugcugca

SEQ ID NO: 2660444 - RNA, 14 nt, Human
gccugcgccugcug

SEQ ID NO: 2660445 - RNA, 22 nt, Human
gccugcgccugcugcaugcccu

SEQ ID NO: 2660446 - RNA, 18 nt, Human
gccucauguggcuggaag

SEQ ID NO: 2660447 - RNA, 19 nt, Human
gccucauguggcuggaaga

SEQ ID NO: 2660448 - RNA, 17 nt, Human
gccuccagaacucacug

SEQ ID NO: 2660449 - RNA, 19 nt, Human
gccuccagaacucacuggg

SEQ ID NO: 2660450 - RNA, 12 nt, Human
gccuccacagcg

SEQ ID NO: 2660451 - RNA, 18 nt, Human
gcgagacuccgucucaaa

SEQ ID NO: 2660452 - RNA, 17 nt, Human
gcgacuuucugccugga

SEQ ID NO: 2660453 - RNA, 14 nt, Human
gcgacuuucugccu

SEQ ID NO: 2660454 - RNA, 16 nt, Human
gcgacuuucugccugg

SEQ ID NO: 2660455 - RNA, 17 nt, Human
gcgagggcagcugcuau

SEQ ID NO: 2660456 - RNA, 15 nt, Human
gcgagggcagcugcu

SEQ ID NO: 2660457 - RNA, 16 nt, Human
gcgagggcagcugcua

SEQ ID NO: 2660458 - RNA, 12 nt, Human
gcgagggcagcu

SEQ ID NO: 2660459 - RNA, 13 nt, Human
gcgagggcagcug

SEQ ID NO: 2660460 - RNA, 14 nt, Human
gcgagggcagcugc

SEQ ID NO: 2660461 - RNA, 18 nt, Human
gcgagcaugucguggaca

SEQ ID NO: 2660462 - RNA, 13 nt, Human
gcuacaauuuuaa

SEQ ID NO: 2660463 - RNA, 18 nt, Human
gcuacuguuguaagaauu

SEQ ID NO: 2660464 - RNA, 19 nt, Human
gcuacuguuguaagaauuc

SEQ ID NO: 2660465 - RNA, 16 nt, Human
gcuacuugggaggcug

SEQ ID NO: 2660466 - RNA, 15 nt, Human
gcgugggagccagcc

SEQ ID NO: 2660467 - RNA, 16 nt, Human
gcgugggagccagccu

SEQ ID NO: 2660468 - RNA, 14 nt, Human
gcguggcccaaggc

SEQ ID NO: 2660469 - RNA, 15 nt, Human
gcguggcccaaggcu

SEQ ID NO: 2660470 - RNA, 20 nt, Human
gcguggcccaaggcuggcag

SEQ ID NO: 2660471 - RNA, 23 nt, Human
gcguggcucuaaaagguaaugug

SEQ ID NO: 2660472 - RNA, 13 nt, Human
gcguggugccauc

SEQ ID NO: 2660473 - RNA, 14 nt, Human
gcguggugccaucc

SEQ ID NO: 2660474 - RNA, 19 nt, Human
gcggagguugcagugagcu

SEQ ID NO: 2660475 - RNA, 16 nt, Human
gcggagcuugcaguga

SEQ ID NO: 2660476 - RNA, 21 nt, Human
gcggagguguggagccgaggc

SEQ ID NO: 2660477 - RNA, 16 nt, Human
aaaacauagcaucuca

SEQ ID NO: 2660478 - RNA, 15 nt, Human
aaaacauaacauaaa

SEQ ID NO: 2660479 - RNA, 17 nt, Human
aaaacauaacauaaauu

SEQ ID NO: 2660480 - RNA, 14 nt, Human
aaaacaucauuccu

SEQ ID NO: 2660481 - RNA, 23 nt, Human
aaaacauagaaauggaaauuuug

SEQ ID NO: 2660482 - RNA, 17 nt, Human
aaaacaguguguaaaca

SEQ ID NO: 2660483 - RNA, 20 nt, Human
aaaacaguguguaaacaaaa

SEQ ID NO: 2660484 - RNA, 21 nt, Human
aaaacaucauuccuuuuuauu

SEQ ID NO: 2660485 - RNA, 19 nt, Human
aaaacaucauuccuuuuua

SEQ ID NO: 2660486 - RNA, 21 nt, Human
aaaaccaauguucucucuucu

SEQ ID NO: 2660487 - RNA, 18 nt, Human
aaaaauauauaucuaucu

SEQ ID NO: 2660488 - RNA, 12 nt, Human
aaaacucuacuu

SEQ ID NO: 2660489 - RNA, 15 nt, Human
aaaacucuacuuaau

SEQ ID NO: 2660490 - RNA, 22 nt, Human
aaaacugcugacuguuuucucu

SEQ ID NO: 2660491 - RNA, 18 nt, Human
aaaacucuacuuaaucca

SEQ ID NO: 2660492 - RNA, 19 nt, Human
aaaacucuacuuaauccaa

SEQ ID NO: 2660493 - RNA, 20 nt, Human
aaaacugcugacuguuuucu

SEQ ID NO: 2660494 - RNA, 13 nt, Human
aaaagaugcuucu

SEQ ID NO: 2660495 - RNA, 23 nt, Human
aaaacugcugacuguuuucucuu

SEQ ID NO: 2660496 - RNA, 16 nt, Human
aaaacuggaccuguau

SEQ ID NO: 2660497 - RNA, 19 nt, Human
aaaacuggaccuguauauu

SEQ ID NO: 2660498 - RNA, 18 nt, Human
aaaacucaggcaaagaaa

SEQ ID NO: 2660499 - RNA, 23 nt, Human
aaaacucaggcaaagaaaaugaa

SEQ ID NO: 2660500 - RNA, 14 nt, Human
aaaacucacuguga

SEQ ID NO: 2660501 - RNA, 15 nt, Human
aaaacucacugugau

SEQ ID NO: 2660502 - RNA, 14 nt, Human
aaaaccgaauaaau

SEQ ID NO: 2660503 - RNA, 15 nt, Human
aaaaccgaauaaaug

SEQ ID NO: 2660504 - RNA, 18 nt, Human
gggaagcccauccugacc

SEQ ID NO: 2660505 - RNA, 16 nt, Human
gggaagagauccaaag

SEQ ID NO: 2660506 - RNA, 17 nt, Human
gggaagagauccaaaga

SEQ ID NO: 2660507 - RNA, 19 nt, Human
gggaagagauccaaagacu

SEQ ID NO: 2660508 - RNA, 19 nt, Human
gggaagcccauccugacca

SEQ ID NO: 2660509 - RNA, 22 nt, Human
aaaaauauaaaauuaugagauu

SEQ ID NO: 2660510 - RNA, 17 nt, Human
aaaaauagugucuuugu

SEQ ID NO: 2660511 - RNA, 22 nt, Human
gggacagaguagccagguucug

SEQ ID NO: 2660512 - RNA, 13 nt, Human
aaaaauauuuucu

SEQ ID NO: 2660513 - RNA, 22 nt, Human
aaaaauauuuucucuguacuuu

SEQ ID NO: 2660514 - RNA, 11 nt, Human
aaaaauauugu

SEQ ID NO: 2660515 - RNA, 12 nt, Human
aaaaauauuguu

SEQ ID NO: 2660516 - RNA, 23 nt, Human
aaaaauauuguuucugcauucau

SEQ ID NO: 2660517 - RNA, 11 nt, Human
aaaaauauauu

SEQ ID NO: 2660518 - RNA, 16 nt, Human
aaaaauaucaaauuaa

SEQ ID NO: 2660519 - RNA, 15 nt, Human
aaaaauaucaaauua

SEQ ID NO: 2660520 - RNA, 14 nt, Human
aaaaauaucaaauu

SEQ ID NO: 2660521 - RNA, 15 nt, Human
gggcagccucccccg

SEQ ID NO: 2660522 - RNA, 18 nt, Human
gggcagccucccccggcu

SEQ ID NO: 2660523 - RNA, 15 nt, Human
gggcagggagcuggg

SEQ ID NO: 2660524 - RNA, 18 nt, Human
gggcagggagcugggccc

SEQ ID NO: 2660525 - RNA, 19 nt, Human
gggcagggagcugggcccg

SEQ ID NO: 2660526 - RNA, 20 nt, Human
gggcagggagcugggcccga

SEQ ID NO: 2660527 - RNA, 11 nt, Human
gggcagggagc

SEQ ID NO: 2660528 - RNA, 16 nt, Human
gggcaggcugggccau

SEQ ID NO: 2660529 - RNA, 14 nt, Human
gggcaggcugggcc

SEQ ID NO: 2660530 - RNA, 15 nt, Human
gggcaggcugggcca

SEQ ID NO: 2660531 - RNA, 12 nt, Human
gggcaggcuggg

SEQ ID NO: 2660532 - RNA, 13 nt, Human
gggcaggcugggc

SEQ ID NO: 2660533 - RNA, 19 nt, Human
gggaggccaaggugggagg

SEQ ID NO: 2660534 - RNA, 20 nt, Human
gggaggcggagcuugcagug

SEQ ID NO: 2660535 - RNA, 14 nt, Human
gggaggccccaggg

SEQ ID NO: 2660536 - RNA, 15 nt, Human
gggaggccgaggcgg

SEQ ID NO: 2660537 - RNA, 12 nt, Human
gggagacagcau

SEQ ID NO: 2660538 - RNA, 13 nt, Human
aaaagcagacauu

SEQ ID NO: 2660539 - RNA, 15 nt, Human
aaaagcaaugguuga

SEQ ID NO: 2660540 - RNA, 20 nt, Human
aaaagcaaguacucuggagc

SEQ ID NO: 2660541 - RNA, 16 nt, Human
aaaagaugguaucaua

SEQ ID NO: 2660542 - RNA, 15 nt, Human
aaaagcacuccugcu

SEQ ID NO: 2660543 - RNA, 14 nt, Human
aaaagcagacauuu

SEQ ID NO: 2660544 - RNA, 22 nt, Human
gggagaagaaaggugaguuuga

SEQ ID NO: 2660545 - RNA, 15 nt, Human
gggaggucgaggcag

SEQ ID NO: 2660546 - RNA, 19 nt, Human
gggaggucgaggcaggagg

SEQ ID NO: 2660547 - RNA, 18 nt, Human
gggaggucgaggcaggag

SEQ ID NO: 2660548 - RNA, 17 nt, Human
gggaggucgaggcagga

SEQ ID NO: 2660549 - RNA, 22 nt, Human
aaaaugaauaucuauuaauaua

SEQ ID NO: 2660550 - RNA, 18 nt, Human
aaaaugaauaucuauuaa

SEQ ID NO: 2660551 - RNA, 16 nt, Human
aaaaugaagaauuuaa

SEQ ID NO: 2660552 - RNA, 15 nt, Human
aaaaugaagaauuua

SEQ ID NO: 2660553 - RNA, 14 nt, Human
aaaaugaauaucua

SEQ ID NO: 2660554 - RNA, 14 nt, Human
aaaaugaaaugcau

SEQ ID NO: 2660555 - RNA, 16 nt, Human
aaaaugaaaugcauau

SEQ ID NO: 2660556 - RNA, 18 nt, Human
aaaaugaaaugcauauuu

SEQ ID NO: 2660557 - RNA, 14 nt, Human
aaaaugaagaauuu

SEQ ID NO: 2660558 - RNA, 11 nt, Human
aaaaugaagaa

SEQ ID NO: 2660559 - RNA, 12 nt, Human
aaaaugaaaaau

SEQ ID NO: 2660560 - RNA, 15 nt, Human
aaaaugaaaauugua

SEQ ID NO: 2660561 - RNA, 16 nt, Human
aaaaugaaaauuguau

SEQ ID NO: 2660562 - RNA, 16 nt, Human
aaaaucuuuugaagca

SEQ ID NO: 2660563 - RNA, 23 nt, Human
aaaaugagcucgcauuugucaau

SEQ ID NO: 2660564 - RNA, 21 nt, Human
aaaaugagccuggcaagaaug

SEQ ID NO: 2660565 - RNA, 14 nt, Human
aaaaugagccuggc

SEQ ID NO: 2660566 - RNA, 18 nt, Human
aaaaguagaacuuuguau

SEQ ID NO: 2660567 - RNA, 17 nt, Human
aaaaguagaacuuugua

SEQ ID NO: 2660568 - RNA, 16 nt, Human
aaaaguauaaaauagu

SEQ ID NO: 2660569 - RNA, 20 nt, Human
aaaaguagaacuuuguauag

SEQ ID NO: 2660570 - RNA, 20 nt, Human
aaaaucuguugauaaaucca

SEQ ID NO: 2660571 - RNA, 21 nt, Human
aaaaucuguugauaaauccau

SEQ ID NO: 2660572 - RNA, 18 nt, Human
aaaaugcuccccacagcg

SEQ ID NO: 2660573 - RNA, 22 nt, Human
gggccagucuguggaucagaga

SEQ ID NO: 2660574 - RNA, 17 nt, Human
gggcggcaggggccugg

SEQ ID NO: 2660575 - RNA, 21 nt, Human
gggcggcaggggccuggagau

SEQ ID NO: 2660576 - RNA, 14 nt, Human
gggccuccagaacu

SEQ ID NO: 2660577 - RNA, 16 nt, Human
gggccguaucuccggc

SEQ ID NO: 2660578 - RNA, 24 nt, Human
gggccguaucuccggcucccagcc

SEQ ID NO: 2660579 - RNA, 23 nt, Human
gggccguaucuccggcucccagc

SEQ ID NO: 2660580 - RNA, 20 nt, Human
gggccguaucuccggcuccc

SEQ ID NO: 2660581 - RNA, 19 nt, Human
gggccguaucuccggcucc

SEQ ID NO: 2660582 - RNA, 20 nt, Human
gggccuagcgaucucuccug

SEQ ID NO: 2660583 - RNA, 21 nt, Human
gggccuagcgaucucuccugg

SEQ ID NO: 2660584 - RNA, 23 nt, Human
gggccuagcgaucucuccuggcc

SEQ ID NO: 2660585 - RNA, 17 nt, Human
gggccaugcugaggccu

SEQ ID NO: 2660586 - RNA, 15 nt, Human
gggcccugggcugga

SEQ ID NO: 2660587 - RNA, 14 nt, Human
gggccgacuaagag

SEQ ID NO: 2660588 - RNA, 13 nt, Human
gggccgaccagag

SEQ ID NO: 2660589 - RNA, 20 nt, Human
gggccgaccagaggagccuu

SEQ ID NO: 2660590 - RNA, 14 nt, Human
gggccaugcugagg

SEQ ID NO: 2660591 - RNA, 15 nt, Human
gggccaugcugaggc

SEQ ID NO: 2660592 - RNA, 15 nt, Human
aaacaguguguaaac

SEQ ID NO: 2660593 - RNA, 17 nt, Human
aaacaguguguaaacaa

SEQ ID NO: 2660594 - RNA, 13 nt, Human
aaacagugacugu

SEQ ID NO: 2660595 - RNA, 19 nt, Human
aaacaccaacauguuggga

SEQ ID NO: 2660596 - RNA, 20 nt, Human
aaacacccgacgucauguau

SEQ ID NO: 2660597 - RNA, 19 nt, Human
aaacaagcaaguucugaga

SEQ ID NO: 2660598 - RNA, 19 nt, Human
ggggccuggagauccuccu

SEQ ID NO: 2660599 - RNA, 19 nt, Human
ggggccaccaaagcugccc

SEQ ID NO: 2660600 - RNA, 18 nt, Human
ggggccaccaaagcugcc

SEQ ID NO: 2660601 - RNA, 14 nt, Human
ggggccaccaaagc

SEQ ID NO: 2660602 - RNA, 19 nt, Human
ggggcauugaguauuguuu

SEQ ID NO: 2660603 - RNA, 17 nt, Human
ggggcaugaccagaugc

SEQ ID NO: 2660604 - RNA, 15 nt, Human
ggggcaugaccagau

SEQ ID NO: 2660605 - RNA, 15 nt, Human
aaacaugagaugugu

SEQ ID NO: 2660606 - RNA, 16 nt, Human
aaacaucauuccuuuu

SEQ ID NO: 2660607 - RNA, 18 nt, Human
aaacaucauuccuuuuua

SEQ ID NO: 2660608 - RNA, 20 nt, Human
aaacaucauuccuuuuuauu

SEQ ID NO: 2660609 - RNA, 19 nt, Human
aaacaucauuccuuuuuau

SEQ ID NO: 2660610 - RNA, 22 nt, Human
aaacaucauuccuuuuuauuua

SEQ ID NO: 2660611 - RNA, 21 nt, Human
aaacaucauuccuuuuuauuu

SEQ ID NO: 2660612 - RNA, 13 nt, Human
aaaauuuguugca

SEQ ID NO: 2660613 - RNA, 14 nt, Human
aaaauuuguugcau

SEQ ID NO: 2660614 - RNA, 12 nt, Human
aaaauuugaagu

SEQ ID NO: 2660615 - RNA, 19 nt, Human
aaaauuugacuaauuuuac

SEQ ID NO: 2660616 - RNA, 11 nt, Human
aaaauguguuc

SEQ ID NO: 2660617 - RNA, 13 nt, Human
aaaaugugacccu

SEQ ID NO: 2660618 - RNA, 15 nt, Human
aaaaugugacccucc

SEQ ID NO: 2660619 - RNA, 18 nt, Human
aaaaugugagugguugaa

SEQ ID NO: 2660620 - RNA, 20 nt, Human
aaaaugugagugguugaaua

SEQ ID NO: 2660621 - RNA, 14 nt, Human
gggcuggcuccuga

SEQ ID NO: 2660622 - RNA, 18 nt, Human
gggcucagcaaaagaugc

SEQ ID NO: 2660623 - RNA, 10 nt, Human
gggcucagca

SEQ ID NO: 2660624 - RNA, 14 nt, Human
gggcucacacaccu

SEQ ID NO: 2660625 - RNA, 17 nt, Human
aaauaaguauuuauaau

SEQ ID NO: 2660626 - RNA, 15 nt, Human
aaauaaguauuuaua

SEQ ID NO: 2660627 - RNA, 22 nt, Human
aaauaaguauuuauaauagcaa

SEQ ID NO: 2660628 - RNA, 14 nt, Human
aaauaaguauuuau

SEQ ID NO: 2660629 - RNA, 12 nt, Human
aaauaaguauuu

SEQ ID NO: 2660630 - RNA, 22 nt, Human
aaauaaggauuuuucucuuauu

SEQ ID NO: 2660631 - RNA, 21 nt, Human
aaauaaaaaagcucuuuuaau

SEQ ID NO: 2660632 - RNA, 20 nt, Human
aaauaagcccccucaacuac

SEQ ID NO: 2660633 - RNA, 17 nt, Human
aaaguuuuauaugcuuu

SEQ ID NO: 2660634 - RNA, 13 nt, Human
aaaguuuuguaaa

SEQ ID NO: 2660635 - RNA, 16 nt, Human
aaaguuuuguaaaaga

SEQ ID NO: 2660636 - RNA, 18 nt, Human
aaaguuuuguaaaagaaa

SEQ ID NO: 2660637 - RNA, 12 nt, Human
aaaguuuuguug

SEQ ID NO: 2660638 - RNA, 14 nt, Human
aaaguuuuguugua

SEQ ID NO: 2660639 - RNA, 23 nt, Human
aaaguuuuguuguacuuaaaugg

SEQ ID NO: 2660640 - RNA, 14 nt, Human
aaaguuuuuguuug

SEQ ID NO: 2660641 - RNA, 19 nt, Human
aaauaaugaauacauuucc

SEQ ID NO: 2660642 - RNA, 13 nt, Human
aaauaaugcuaca

SEQ ID NO: 2660643 - RNA, 19 nt, Human
aaauaaugcuacaauuuua

SEQ ID NO: 2660644 - RNA, 20 nt, Human
aaauaaugcuacaauuuuaa

SEQ ID NO: 2660645 - RNA, 15 nt, Human
guaaagacuggcuuu

SEQ ID NO: 2660646 - RNA, 19 nt, Human
guaaagacuggcuuuuauu

SEQ ID NO: 2660647 - RNA, 14 nt, Human
guaaagacugguuu

SEQ ID NO: 2660648 - RNA, 18 nt, Human
guaaagacugguuuucug

SEQ ID NO: 2660649 - RNA, 19 nt, Human
guaaagacugguuuucugc

SEQ ID NO: 2660650 - RNA, 14 nt, Human
guaaagacuggcuu

SEQ ID NO: 2660651 - RNA, 12 nt, Human
guaaauucugau

SEQ ID NO: 2660652 - RNA, 14 nt, Human
guaaauucugauuu

SEQ ID NO: 2660653 - RNA, 13 nt, Human
guaaauucugauu

SEQ ID NO: 2660654 - RNA, 18 nt, Human
guaaauucugauuucuuu

SEQ ID NO: 2660655 - RNA, 15 nt, Human
guaaauucugauuuc

SEQ ID NO: 2660656 - RNA, 15 nt, Human
guaaaauauuuugaa

SEQ ID NO: 2660657 - RNA, 21 nt, Human
guaaaauauuuugaaucaaua

SEQ ID NO: 2660658 - RNA, 18 nt, Human
guaaaauauuuugaauca

SEQ ID NO: 2660659 - RNA, 19 nt, Human
guaaaauauuuugaaucaa

SEQ ID NO: 2660660 - RNA, 16 nt, Human
guaaaaugaagaauuu

SEQ ID NO: 2660661 - RNA, 14 nt, Human
guaaaaugaagaau

SEQ ID NO: 2660662 - RNA, 17 nt, Human
guaaaaugaagaauuua

SEQ ID NO: 2660663 - RNA, 18 nt, Human
aaagugugagcaaacuaa

SEQ ID NO: 2660664 - RNA, 16 nt, Human
aaaguguguauauauu

SEQ ID NO: 2660665 - RNA, 18 nt, Human
aaaguguguauauauuuu

SEQ ID NO: 2660666 - RNA, 19 nt, Human
aaaguguguauauauuuug

SEQ ID NO: 2660667 - RNA, 20 nt, Human
aaaguguguauauauuuugu

SEQ ID NO: 2660668 - RNA, 21 nt, Human
aaaguguguauauauuuugug

SEQ ID NO: 2660669 - RNA, 23 nt, Human
aaaguguguauauauuuugugug

SEQ ID NO: 2660670 - RNA, 21 nt, Human
gguuugccaaaauucauuucu

SEQ ID NO: 2660671 - RNA, 12 nt, Human
gguuugagaaau

SEQ ID NO: 2660672 - RNA, 15 nt, Human
aaaguuugcuuagaa

SEQ ID NO: 2660673 - RNA, 16 nt, Human
aaaguuugcuuagaaa

SEQ ID NO: 2660674 - RNA, 10 nt, Human
aaaguuuccg

SEQ ID NO: 2660675 - RNA, 13 nt, Human
gguucuggcuguu

SEQ ID NO: 2660676 - RNA, 16 nt, Human
gguuccuccucuccua

SEQ ID NO: 2660677 - RNA, 19 nt, Human
gguuccucaaauuuuuuga

SEQ ID NO: 2660678 - RNA, 12 nt, Human
gguuccucugcc

SEQ ID NO: 2660679 - RNA, 14 nt, Human
gguuccucugccug

SEQ ID NO: 2660680 - RNA, 15 nt, Human
gguuccucugccugc

SEQ ID NO: 2660681 - RNA, 17 nt, Human
gguuccucugccugccc

SEQ ID NO: 2660682 - RNA, 18 nt, Human
gguuccucugccugcccc

SEQ ID NO: 2660683 - RNA, 19 nt, Human
gguucuccguuagcuccug

SEQ ID NO: 2660684 - RNA, 20 nt, Human
gguucuccguuagcuccugu

SEQ ID NO: 2660685 - RNA, 21 nt, Human
gguucuccguuagcuccugug

SEQ ID NO: 2660686 - RNA, 21 nt, Human
gguuucucgcauaggaccuuu

SEQ ID NO: 2660687 - RNA, 20 nt, Human
gguuucucuauuaaaaugca

SEQ ID NO: 2660688 - RNA, 15 nt, Human
gguuucucuguggcu

SEQ ID NO: 2660689 - RNA, 22 nt, Human
gguuucucuguggcuccaggcc

SEQ ID NO: 2660690 - RNA, 21 nt, Human
ggugugcggccuuuggcuuca

SEQ ID NO: 2660691 - RNA, 12 nt, Human
ggugugcuggga

SEQ ID NO: 2660692 - RNA, 19 nt, Human
ggugugcugggagcuccac

SEQ ID NO: 2660693 - RNA, 22 nt, Human
ggugugcugggagcuccacucu

SEQ ID NO: 2660694 - RNA, 21 nt, Human
gguucccuugagggcugcagu

SEQ ID NO: 2660695 - RNA, 20 nt, Human
ggugucuugggcagagcugg

SEQ ID NO: 2660696 - RNA, 15 nt, Human
ggugucuccuuaagc

SEQ ID NO: 2660697 - RNA, 15 nt, Human
ggugugaacccggga

SEQ ID NO: 2660698 - RNA, 16 nt, Human
ggugugaacccgggag

SEQ ID NO: 2660699 - RNA, 17 nt, Human
ggugugaacccgggagc

SEQ ID NO: 2660700 - RNA, 16 nt, Human
gguggggguggaggcu

SEQ ID NO: 2660701 - RNA, 22 nt, Human
ggugggcccggcccgcgccaca

SEQ ID NO: 2660702 - RNA, 20 nt, Human
ggugggaggauugcuugagc

SEQ ID NO: 2660703 - RNA, 10 nt, Human
aaagccuucc

SEQ ID NO: 2660704 - RNA, 22 nt, Human
ggucugugugugugugugugcg

SEQ ID NO: 2660705 - RNA, 14 nt, Human
ggucuuaagaaaug

SEQ ID NO: 2660706 - RNA, 23 nt, Human
ggucuuaagaaauguauaaacuu

SEQ ID NO: 2660707 - RNA, 19 nt, Human
ggucuguuggcaggcuggc

SEQ ID NO: 2660708 - RNA, 20 nt, Human
ggucuguuggcaggcuggcc

SEQ ID NO: 2660709 - RNA, 14 nt, Human
ggugcugugaggga

SEQ ID NO: 2660710 - RNA, 17 nt, Human
ggugcugugagggaggg

SEQ ID NO: 2660711 - RNA, 21 nt, Human
ggucuugaacuccuggacuca

SEQ ID NO: 2660712 - RNA, 19 nt, Human
ggugccacuuuacccaccu

SEQ ID NO: 2660713 - RNA, 16 nt, Human
ggugccacuuuaccca

SEQ ID NO: 2660714 - RNA, 21 nt, Human
aaagcauauggguuagauguu

SEQ ID NO: 2660715 - RNA, 16 nt, Human
aaagcaugaaauguga

SEQ ID NO: 2660716 - RNA, 17 nt, Human
aaagcaugaaaugugaa

SEQ ID NO: 2660717 - RNA, 18 nt, Human
aaagcaugaaaugugaau

SEQ ID NO: 2660718 - RNA, 22 nt, Human
gguggauggccccagcacagcu

SEQ ID NO: 2660719 - RNA, 14 nt, Human
gguggauggcccca

SEQ ID NO: 2660720 - RNA, 15 nt, Human
aaagcaacaaagaaa

SEQ ID NO: 2660721 - RNA, 22 nt, Human
gguccuagaggcccuuugcugu

SEQ ID NO: 2660722 - RNA, 13 nt, Human
gguccucuggagc

SEQ ID NO: 2660723 - RNA, 15 nt, Human
gguccucuggagccc

SEQ ID NO: 2660724 - RNA, 15 nt, Human
ggucggaacccaagc

SEQ ID NO: 2660725 - RNA, 20 nt, Human
ggucgguagguucagccaag

SEQ ID NO: 2660726 - RNA, 15 nt, Human
gguccuaguaagaag

SEQ ID NO: 2660727 - RNA, 12 nt, Human
ggucgcuccugc

SEQ ID NO: 2660728 - RNA, 13 nt, Human
ggucgcuccugcc

SEQ ID NO: 2660729 - RNA, 14 nt, Human
ggucgcuccugccc

SEQ ID NO: 2660730 - RNA, 13 nt, Human
aaagaaugacuau

SEQ ID NO: 2660731 - RNA, 15 nt, Human
aaagaauaugacuuu

SEQ ID NO: 2660732 - RNA, 20 nt, Human
aaagaauaugacuuuuuaua

SEQ ID NO: 2660733 - RNA, 16 nt, Human
aaagaaguauuuuuag

SEQ ID NO: 2660734 - RNA, 18 nt, Human
aaagaauacuauuuccaa

SEQ ID NO: 2660735 - RNA, 13 nt, Human
ggguggggaaagg

SEQ ID NO: 2660736 - RNA, 22 nt, Human
ggguggucucuucuuggggccc

SEQ ID NO: 2660737 - RNA, 15 nt, Human
gggugucuugggcag

SEQ ID NO: 2660738 - RNA, 21 nt, Human
gggugucuugggcagagcugg

SEQ ID NO: 2660739 - RNA, 23 nt, Human
gggugucuugggcagagcuggcu

SEQ ID NO: 2660740 - RNA, 13 nt, Human
gggugugcuggga

SEQ ID NO: 2660741 - RNA, 12 nt, Human
ggguguggcagu

SEQ ID NO: 2660742 - RNA, 11 nt, Human
gggugggccuc

SEQ ID NO: 2660743 - RNA, 13 nt, Human
gggugggccucgg

SEQ ID NO: 2660744 - RNA, 15 nt, Human
ggguggcaccagcag

SEQ ID NO: 2660745 - RNA, 14 nt, Human
gguacaacggaggc

SEQ ID NO: 2660746 - RNA, 16 nt, Human
gguacaacggaggccu

SEQ ID NO: 2660747 - RNA, 20 nt, Human
gguaauacuuccagaagugc

SEQ ID NO: 2660748 - RNA, 14 nt, Human
gggugugggaaagc

SEQ ID NO: 2660749 - RNA, 16 nt, Human
ggguuucucuguggcu

SEQ ID NO: 2660750 - RNA, 18 nt, Human
gguaacuagggaagauaa

SEQ ID NO: 2660751 - RNA, 16 nt, Human
ggauguauggggaauc

SEQ ID NO: 2660752 - RNA, 12 nt, Human
ggcacaggaggc

SEQ ID NO: 2660753 - RNA, 16 nt, Human
ggcacaggaggcaggc

SEQ ID NO: 2660754 - RNA, 20 nt, Human
ggcacaggaggcaggcaugg

SEQ ID NO: 2660755 - RNA, 23 nt, Human
ggcacaggaggcaggcauggccc

SEQ ID NO: 2660756 - RNA, 18 nt, Human
ggauggauuuccagccaa

SEQ ID NO: 2660757 - RNA, 18 nt, Human
ggauggaggaagaacuga

SEQ ID NO: 2660758 - RNA, 13 nt, Human
ggauggccccagc

SEQ ID NO: 2660759 - RNA, 14 nt, Human
ggauggccccagca

SEQ ID NO: 2660760 - RNA, 14 nt, Human
ggauggcuugucua

SEQ ID NO: 2660761 - RNA, 16 nt, Human
ggauggccccagcaca

SEQ ID NO: 2660762 - RNA, 20 nt, Human
ggauaacuuuacagaaaugg

SEQ ID NO: 2660763 - RNA, 22 nt, Human
ggauaaagaauacuauuuccaa

SEQ ID NO: 2660764 - RNA, 18 nt, Human
ggaguuuuuaugagaaac

SEQ ID NO: 2660765 - RNA, 22 nt, Human
ggaguucuaacaaaacaaguug

SEQ ID NO: 2660766 - RNA, 14 nt, Human
ggaggaaggcaaga

SEQ ID NO: 2660767 - RNA, 20 nt, Human
ggaggccaaggugggaggau

SEQ ID NO: 2660768 - RNA, 14 nt, Human
ggaggccccagggg

SEQ ID NO: 2660769 - RNA, 15 nt, Human
ggaggccccaggggg

SEQ ID NO: 2660770 - RNA, 13 nt, Human
ggaggaaggcaag

SEQ ID NO: 2660771 - RNA, 12 nt, Human
ggagcugggccc

SEQ ID NO: 2660772 - RNA, 21 nt, Human
ggagccagcucccucuauuua

SEQ ID NO: 2660773 - RNA, 15 nt, Human
ggagccagccucccu

SEQ ID NO: 2660774 - RNA, 19 nt, Human
ggagcccagcccuccccau

SEQ ID NO: 2660775 - RNA, 16 nt, Human
ggagcccagcccuccc

SEQ ID NO: 2660776 - RNA, 13 nt, Human
ggaggcgcccuug

SEQ ID NO: 2660777 - RNA, 23 nt, Human
ggaggcgcccuuggcuucuguga

SEQ ID NO: 2660778 - RNA, 13 nt, Human
ggaggccgaggcc

SEQ ID NO: 2660779 - RNA, 18 nt, Human
ggaggccgaggccaugug

SEQ ID NO: 2660780 - RNA, 19 nt, Human
ggaggccugcgacccuggg

SEQ ID NO: 2660781 - RNA, 20 nt, Human
ggaggccugcgacccugggg

SEQ ID NO: 2660782 - RNA, 21 nt, Human
ggaggccugcgacccuggggg

SEQ ID NO: 2660783 - RNA, 17 nt, Human
ggaggcccgcagagcgc

SEQ ID NO: 2660784 - RNA, 17 nt, Human
ggagggguguggcagug

SEQ ID NO: 2660785 - RNA, 13 nt, Human
ggaggguaaauaa

SEQ ID NO: 2660786 - RNA, 20 nt, Human
ggaggguaaauaaaccacug

SEQ ID NO: 2660787 - RNA, 13 nt, Human
ggaggucacugga

SEQ ID NO: 2660788 - RNA, 21 nt, Human
ggaggucacuggaaaggggag

SEQ ID NO: 2660789 - RNA, 20 nt, Human
ggaggucaaggcugcaguga

SEQ ID NO: 2660790 - RNA, 17 nt, Human
ggaggucacuggaaagg

SEQ ID NO: 2660791 - RNA, 18 nt, Human
ggaggucgguagguucag

SEQ ID NO: 2660792 - RNA, 20 nt, Human
ggagguggaggcugcaguga

SEQ ID NO: 2660793 - RNA, 17 nt, Human
ggagguggaagaaggga

SEQ ID NO: 2660794 - RNA, 20 nt, Human
ggagguggaagaagggagaa

SEQ ID NO: 2660795 - RNA, 17 nt, Human
ggaggugauuccaguga

SEQ ID NO: 2660796 - RNA, 17 nt, Human
ggcacuggaccccagca

SEQ ID NO: 2660797 - RNA, 16 nt, Human
ggcacuggcgaggaga

SEQ ID NO: 2660798 - RNA, 16 nt, Human
ggcaccagcagccugg

SEQ ID NO: 2660799 - RNA, 15 nt, Human
ggcaccagcagccug

SEQ ID NO: 2660800 - RNA, 22 nt, Human
ggcaucccuuuuucauaaauua

SEQ ID NO: 2660801 - RNA, 21 nt, Human
ggcauagcuccccgcuucugc

SEQ ID NO: 2660802 - RNA, 23 nt, Human
ggccagagagccuggugcugcug

SEQ ID NO: 2660803 - RNA, 22 nt, Human
ggccagagagccuggugcugcu

SEQ ID NO: 2660804 - RNA, 16 nt, Human
ggccagaggcccccag

SEQ ID NO: 2660805 - RNA, 18 nt, Human
ggccagaggcccccagcc

SEQ ID NO: 2660806 - RNA, 15 nt, Human
ggccaugaguaaaau

SEQ ID NO: 2660807 - RNA, 13 nt, Human
ggccccuggcacu

SEQ ID NO: 2660808 - RNA, 15 nt, Human
ggccccacccugggc

SEQ ID NO: 2660809 - RNA, 17 nt, Human
ggccccacccugggccc

SEQ ID NO: 2660810 - RNA, 21 nt, Human
ggccccacccugggcccuggg

SEQ ID NO: 2660811 - RNA, 23 nt, Human
ggccccacccugggcccugggcu

SEQ ID NO: 2660812 - RNA, 23 nt, Human
ggccccacucccuugcuggcccc

SEQ ID NO: 2660813 - RNA, 13 nt, Human
ggccccacccugg

SEQ ID NO: 2660814 - RNA, 18 nt, Human
ggcccauagcagccaguu

SEQ ID NO: 2660815 - RNA, 15 nt, Human
ggcccagugcauggu

SEQ ID NO: 2660816 - RNA, 18 nt, Human
ggcccagugcaugguggc

SEQ ID NO: 2660817 - RNA, 21 nt, Human
ggcccagugcaugguggccag

SEQ ID NO: 2660818 - RNA, 22 nt, Human
ggcccagugcaugguggccaga

SEQ ID NO: 2660819 - RNA, 20 nt, Human
ggccccugggcuuggccugc

SEQ ID NO: 2660820 - RNA, 21 nt, Human
ggccccugggcuuggccugcu

SEQ ID NO: 2660821 - RNA, 22 nt, Human
ggccccugggcuuggccugcug

SEQ ID NO: 2660822 - RNA, 23 nt, Human
ggccccugggcuuggccugcugu

SEQ ID NO: 2660823 - RNA, 12 nt, Human
ggccgaggcggg

SEQ ID NO: 2660824 - RNA, 14 nt, Human
ggccgaggcgggug

SEQ ID NO: 2660825 - RNA, 14 nt, Human
ggcccugugugcag

SEQ ID NO: 2660826 - RNA, 15 nt, Human
ggcccugugugcagg

SEQ ID NO: 2660827 - RNA, 12 nt, Human
ggccgcugccac

SEQ ID NO: 2660828 - RNA, 17 nt, Human
ggccgcugaguggcagg

SEQ ID NO: 2660829 - RNA, 16 nt, Human
ggccgcuccaccagca

SEQ ID NO: 2660830 - RNA, 19 nt, Human
ggccgcuccaccagcauca

SEQ ID NO: 2660831 - RNA, 16 nt, Human
ggcguggcccaaggcu

SEQ ID NO: 2660832 - RNA, 18 nt, Human
ggcgugggagccagccuc

SEQ ID NO: 2660833 - RNA, 14 nt, Human
ggcgucugugugcg

SEQ ID NO: 2660834 - RNA, 17 nt, Human
ggcguccaggccgcgcc

SEQ ID NO: 2660835 - RNA, 15 nt, Human
ggcguggagggaggc

SEQ ID NO: 2660836 - RNA, 17 nt, Human
ggcguggagggaggccc

SEQ ID NO: 2660837 - RNA, 18 nt, Human
ggcguggagggaggcccc

SEQ ID NO: 2660838 - RNA, 19 nt, Human
ggcucagcaaaagaugcuu

SEQ ID NO: 2660839 - RNA, 13 nt, Human
ggcucacugccag

SEQ ID NO: 2660840 - RNA, 14 nt, Human
ggcucacugccagg

SEQ ID NO: 2660841 - RNA, 23 nt, Human
ggcucagcaaaagaugcuucuca

SEQ ID NO: 2660842 - RNA, 20 nt, Human
ggcucagcucggggagccuu

SEQ ID NO: 2660843 - RNA, 15 nt, Human
ggccuguggcugucg

SEQ ID NO: 2660844 - RNA, 10 nt, Human
ggccugcugu

SEQ ID NO: 2660845 - RNA, 19 nt, Human
ggccugcugugauuccacu

SEQ ID NO: 2660846 - RNA, 18 nt, Human
ggccuggagauccuccug

SEQ ID NO: 2660847 - RNA, 11 nt, Human
ggccuggagau

SEQ ID NO: 2660848 - RNA, 14 nt, Human
ggccuggagauccu

SEQ ID NO: 2660849 - RNA, 15 nt, Human
ggccuggagauccuc

SEQ ID NO: 2660850 - RNA, 17 nt, Human
ggccuggagauccuccu

SEQ ID NO: 2660851 - RNA, 14 nt, Human
ggcguacaggcugg

SEQ ID NO: 2660852 - RNA, 16 nt, Human
ggccuuuucuggcacc

SEQ ID NO: 2660853 - RNA, 17 nt, Human
ggccuuuucuggcaccg

SEQ ID NO: 2660854 - RNA, 17 nt, Human
ggccuuuguucuggggg

SEQ ID NO: 2660855 - RNA, 14 nt, Human
ggccuuuggcuuca

SEQ ID NO: 2660856 - RNA, 17 nt, Human
ggcgaccaccgccccug

SEQ ID NO: 2660857 - RNA, 21 nt, Human
ggcgaccaccgccccuggccg

SEQ ID NO: 2660858 - RNA, 20 nt, Human
ggcgacagagcgagacuccg

SEQ ID NO: 2660859 - RNA, 19 nt, Human
ggccuuguccucagccagu

SEQ ID NO: 2660860 - RNA, 13 nt, Human
ggccuuuggcuuc

SEQ ID NO: 2660861 - RNA, 12 nt, Human
ggccuuggaaau

SEQ ID NO: 2660862 - RNA, 20 nt, Human
ggccuccagaacucacuggg

SEQ ID NO: 2660863 - RNA, 15 nt, Human
ggccuccagaacuca

SEQ ID NO: 2660864 - RNA, 19 nt, Human
ggccucauguggcuggaag

SEQ ID NO: 2660865 - RNA, 20 nt, Human
ggccucauguggcuggaaga

SEQ ID NO: 2660866 - RNA, 15 nt, Human
ggccucauguggcug

SEQ ID NO: 2660867 - RNA, 12 nt, Human
ggccggcccugu

SEQ ID NO: 2660868 - RNA, 14 nt, Human
ggccucauguggcu

SEQ ID NO: 2660869 - RNA, 16 nt, Human
ggccucauguggcugg

SEQ ID NO: 2660870 - RNA, 17 nt, Human
ggccucauguggcugga

SEQ ID NO: 2660871 - RNA, 21 nt, Human
ggccggcagccccagccugcu

SEQ ID NO: 2660872 - RNA, 18 nt, Human
ggccggcagccccagccu

SEQ ID NO: 2660873 - RNA, 20 nt, Human
ggccggcagccccagccugc

SEQ ID NO: 2660874 - RNA, 22 nt, Human
gaagugauacuauccaguuacu

SEQ ID NO: 2660875 - RNA, 13 nt, Human
gaagugcuuggaa

SEQ ID NO: 2660876 - RNA, 19 nt, Human
gaagugcuuggaacauacu

SEQ ID NO: 2660877 - RNA, 16 nt, Human
gaagugcccuuccugc

SEQ ID NO: 2660878 - RNA, 22 nt, Human
gaagugcgggguaggggaagaa

SEQ ID NO: 2660879 - RNA, 20 nt, Human
gaagugcuggcaaccacuaa

SEQ ID NO: 2660880 - RNA, 15 nt, Human
gaagugaaugcuggg

SEQ ID NO: 2660881 - RNA, 16 nt, Human
gaagugaaugcuggga

SEQ ID NO: 2660882 - RNA, 17 nt, Human
gaagugaaugcugggac

SEQ ID NO: 2660883 - RNA, 13 nt, Human
gaagggcaaguuu

SEQ ID NO: 2660884 - RNA, 14 nt, Human
gaagggaaaguuuu

SEQ ID NO: 2660885 - RNA, 16 nt, Human
gaagggagaagaaagg

SEQ ID NO: 2660886 - RNA, 21 nt, Human
gaagcugccaggugagaaacu

SEQ ID NO: 2660887 - RNA, 22 nt, Human
gaagcugccaggugagaaacug

SEQ ID NO: 2660888 - RNA, 18 nt, Human
gaagcugcauccagaggc

SEQ ID NO: 2660889 - RNA, 17 nt, Human
gaaaucauguccauaca

SEQ ID NO: 2660890 - RNA, 14 nt, Human
gaaguguauaauau

SEQ ID NO: 2660891 - RNA, 17 nt, Human
gaaguguauaauauaaa

SEQ ID NO: 2660892 - RNA, 21 nt, Human
gaaguguauaauauaaaaaau

SEQ ID NO: 2660893 - RNA, 15 nt, Human
gaaguguauuuauuu

SEQ ID NO: 2660894 - RNA, 19 nt, Human
gacacugaaaguuuuguaa

SEQ ID NO: 2660895 - RNA, 20 nt, Human
gacacugaaaguuuuguaaa

SEQ ID NO: 2660896 - RNA, 14 nt, Human
gacacugccugggc

SEQ ID NO: 2660897 - RNA, 12 nt, Human
gacacugccugg

SEQ ID NO: 2660898 - RNA, 13 nt, Human
gacacugccuggg

SEQ ID NO: 2660899 - RNA, 14 nt, Human
gacagaaggugcca

SEQ ID NO: 2660900 - RNA, 23 nt, Human
gacagaaggugccacuuuaccca

SEQ ID NO: 2660901 - RNA, 17 nt, Human
gacacuguugauaaaaa

SEQ ID NO: 2660902 - RNA, 18 nt, Human
gacacuguugauaaaaac

SEQ ID NO: 2660903 - RNA, 19 nt, Human
gacauuaacaaauaaaaaa

SEQ ID NO: 2660904 - RNA, 18 nt, Human
gacagcuacacagagcuu

SEQ ID NO: 2660905 - RNA, 14 nt, Human
gaaugaggugggag

SEQ ID NO: 2660906 - RNA, 14 nt, Human
gaaugaggaaaauu

SEQ ID NO: 2660907 - RNA, 16 nt, Human
gaaugaggaaaauucu

SEQ ID NO: 2660908 - RNA, 23 nt, Human
gaaugaggaaaauucuuaaaagg

SEQ ID NO: 2660909 - RNA, 23 nt, Human
gaauuuuaaaaucugagggaaau

SEQ ID NO: 2660910 - RNA, 16 nt, Human
gacaaaauauuuccca

SEQ ID NO: 2660911 - RNA, 14 nt, Human
gacaaaagucuguc

SEQ ID NO: 2660912 - RNA, 17 nt, Human
gacaaaagucugucuuu

SEQ ID NO: 2660913 - RNA, 13 nt, Human
gaauuuuuauugu

SEQ ID NO: 2660914 - RNA, 15 nt, Human
gaauuuuuauuguug

SEQ ID NO: 2660915 - RNA, 12 nt, Human
gaauuuuuaagc

SEQ ID NO: 2660916 - RNA, 21 nt, Human
gaauuuugcaaagauuuaauc

SEQ ID NO: 2660917 - RNA, 22 nt, Human
gaauuuugcaaagauuuaaucu

SEQ ID NO: 2660918 - RNA, 18 nt, Human
gagauuucuuguugcuca

SEQ ID NO: 2660919 - RNA, 19 nt, Human
gagauuuuuaaaaaauauu

SEQ ID NO: 2660920 - RNA, 21 nt, Human
gagaugggaaugaggugggag

SEQ ID NO: 2660921 - RNA, 20 nt, Human
gagaugggaaugagguggga

SEQ ID NO: 2660922 - RNA, 18 nt, Human
gagauugcaccacugcac

SEQ ID NO: 2660923 - RNA, 21 nt, Human
gagauugcaccacugcacucc

SEQ ID NO: 2660924 - RNA, 20 nt, Human
gagauguauguuuggcucug

SEQ ID NO: 2660925 - RNA, 12 nt, Human
gagaggcaggca

SEQ ID NO: 2660926 - RNA, 11 nt, Human
gagaggcaggc

SEQ ID NO: 2660927 - RNA, 18 nt, Human
gagaugcaccaccaagcc

SEQ ID NO: 2660928 - RNA, 21 nt, Human
gagaugcaccaccaagccaag

SEQ ID NO: 2660929 - RNA, 15 nt, Human
gagaggcaggcauag

SEQ ID NO: 2660930 - RNA, 21 nt, Human
gagaggcaggcauagaggcuu

SEQ ID NO: 2660931 - RNA, 22 nt, Human
gagcaugguacuuggccuuugg

SEQ ID NO: 2660932 - RNA, 12 nt, Human
gagcauaauuua

SEQ ID NO: 2660933 - RNA, 17 nt, Human
gagcauaauuuaaaaau

SEQ ID NO: 2660934 - RNA, 20 nt, Human
gagcauaauuuaaaaauaua

SEQ ID NO: 2660935 - RNA, 22 nt, Human
gagcauaguccaaaaagcuccu

SEQ ID NO: 2660936 - RNA, 16 nt, Human
gagcauaguccaaaaa

SEQ ID NO: 2660937 - RNA, 22 nt, Human
gagcuggcucugagcgccucca

SEQ ID NO: 2660938 - RNA, 13 nt, Human
gagcugggcccga

SEQ ID NO: 2660939 - RNA, 16 nt, Human
gagcugggcccgacau

SEQ ID NO: 2660940 - RNA, 19 nt, Human
gagcugggcccgacauggc

SEQ ID NO: 2660941 - RNA, 20 nt, Human
gagcugggcccgacauggcu

SEQ ID NO: 2660942 - RNA, 23 nt, Human
gagcugggcccgacauggcuccg

SEQ ID NO: 2660943 - RNA, 18 nt, Human
gagccuuugguucuggcc

SEQ ID NO: 2660944 - RNA, 20 nt, Human
gagccuuuuuaaaacacaug

SEQ ID NO: 2660945 - RNA, 23 nt, Human
gagccuuugguucuggccagaau

SEQ ID NO: 2660946 - RNA, 11 nt, Human
gagcugccuuc

SEQ ID NO: 2660947 - RNA, 13 nt, Human
gagcugccuuccc

SEQ ID NO: 2660948 - RNA, 23 nt, Human
gagcugccuucccuagcuuuaga

SEQ ID NO: 2660949 - RNA, 14 nt, Human
gagcugccuucccu

SEQ ID NO: 2660950 - RNA, 19 nt, Human
gagcugccuucccuagcuu

SEQ ID NO: 2660951 - RNA, 13 nt, Human
gagcuggcucuga

SEQ ID NO: 2660952 - RNA, 17 nt, Human
gagcuggcucugagcgc

SEQ ID NO: 2660953 - RNA, 13 nt, Human
gagcggagguugc

SEQ ID NO: 2660954 - RNA, 13 nt, Human
gacucuggguccu

SEQ ID NO: 2660955 - RNA, 20 nt, Human
gacucuggguccuuccugaa

SEQ ID NO: 2660956 - RNA, 19 nt, Human
gacucuggguccuuccuga

SEQ ID NO: 2660957 - RNA, 18 nt, Human
gacucuggguccuuccug

SEQ ID NO: 2660958 - RNA, 14 nt, Human
gacucuggguccuu

SEQ ID NO: 2660959 - RNA, 17 nt, Human
gacuagcaaucucuuca

SEQ ID NO: 2660960 - RNA, 18 nt, Human
gacuaucugucugguggc

SEQ ID NO: 2660961 - RNA, 13 nt, Human
gacuuuuuauaaa

SEQ ID NO: 2660962 - RNA, 15 nt, Human
gacuuucugccugga

SEQ ID NO: 2660963 - RNA, 21 nt, Human
gacuggguaggaaagaggaag

SEQ ID NO: 2660964 - RNA, 17 nt, Human
gacuggguaggaaagag

SEQ ID NO: 2660965 - RNA, 15 nt, Human
gacugaaaauauugu

SEQ ID NO: 2660966 - RNA, 16 nt, Human
gacugguaaguaacug

SEQ ID NO: 2660967 - RNA, 12 nt, Human
gacuuucugccu

SEQ ID NO: 2660968 - RNA, 14 nt, Human
gacuuucugccugg

SEQ ID NO: 2660969 - RNA, 12 nt, Human
gagaaggaagcc

SEQ ID NO: 2660970 - RNA, 15 nt, Human
gagaagcggcuggca

SEQ ID NO: 2660971 - RNA, 13 nt, Human
gagaagcggcugg

SEQ ID NO: 2660972 - RNA, 16 nt, Human
gagaagcggcuggcag

SEQ ID NO: 2660973 - RNA, 18 nt, Human
gagaagccuucagcucca

SEQ ID NO: 2660974 - RNA, 14 nt, Human
gagaagccuucagc

SEQ ID NO: 2660975 - RNA, 13 nt, Human
gagaagccuucag

SEQ ID NO: 2660976 - RNA, 17 nt, Human
gagaagugaaugcuggg

SEQ ID NO: 2660977 - RNA, 19 nt, Human
gagaagugaaugcugggac

SEQ ID NO: 2660978 - RNA, 20 nt, Human
gagaagugaaugcugggacu

SEQ ID NO: 2660979 - RNA, 17 nt, Human
gcacuugugauuauuua

SEQ ID NO: 2660980 - RNA, 23 nt, Human
gcacuugugauuauuuauuauuu

SEQ ID NO: 2660981 - RNA, 21 nt, Human
gcacuugugauuauuuauuau

SEQ ID NO: 2660982 - RNA, 20 nt, Human
gcacuugugauuauuuauua

SEQ ID NO: 2660983 - RNA, 16 nt, Human
gcacugacugggcaua

SEQ ID NO: 2660984 - RNA, 16 nt, Human
gcagagauuucucauu

SEQ ID NO: 2660985 - RNA, 23 nt, Human
gcagagauuucucauugacuuuu

SEQ ID NO: 2660986 - RNA, 12 nt, Human
gcaauaaaugaa

SEQ ID NO: 2660987 - RNA, 14 nt, Human
gcaauaaauuuuga

SEQ ID NO: 2660988 - RNA, 13 nt, Human
gcaauaaauuuug

SEQ ID NO: 2660989 - RNA, 18 nt, Human
gcaauaaauuuugaaaag

SEQ ID NO: 2660990 - RNA, 16 nt, Human
gcaauaacagcugcaa

SEQ ID NO: 2660991 - RNA, 16 nt, Human
gcaauaaauuuugaaa

SEQ ID NO: 2660992 - RNA, 15 nt, Human
gcaauaaauuuugaa

SEQ ID NO: 2660993 - RNA, 14 nt, Human
gcacaagcugcacc

SEQ ID NO: 2660994 - RNA, 12 nt, Human
gcacaauuugca

SEQ ID NO: 2660995 - RNA, 14 nt, Human
gcacaauuugcacu

SEQ ID NO: 2660996 - RNA, 19 nt, Human
gcacaauuugcacuaaauc

SEQ ID NO: 2660997 - RNA, 13 nt, Human
gcacaugacucgg

SEQ ID NO: 2660998 - RNA, 14 nt, Human
gcagagccuucuca

SEQ ID NO: 2660999 - RNA, 16 nt, Human
gcagagccuucucaga

SEQ ID NO: 2661000 - RNA, 19 nt, Human
gcagagccuucucagaagc

SEQ ID NO: 2661001 - RNA, 23 nt, Human
gcagagccuucucagaagcacag

SEQ ID NO: 2661002 - RNA, 19 nt, Human
gcagagcgcgccccuagcc

SEQ ID NO: 2661003 - RNA, 18 nt, Human
gcagagcgcgccccuagc

SEQ ID NO: 2661004 - RNA, 13 nt, Human
gcagccccagccu

SEQ ID NO: 2661005 - RNA, 17 nt, Human
gcagccccagccugcua

SEQ ID NO: 2661006 - RNA, 16 nt, Human
gcagccccagccugcu

SEQ ID NO: 2661007 - RNA, 15 nt, Human
gcagccccagccugc

SEQ ID NO: 2661008 - RNA, 14 nt, Human
gcagccccagccug

SEQ ID NO: 2661009 - RNA, 13 nt, Human
gcagcccacccug

SEQ ID NO: 2661010 - RNA, 17 nt, Human
gcagcccacccugcugc

SEQ ID NO: 2661011 - RNA, 20 nt, Human
gcagcccacccugcugcugg

SEQ ID NO: 2661012 - RNA, 13 nt, Human
gcagcccagagac

SEQ ID NO: 2661013 - RNA, 22 nt, Human
gcagcccagagacuuuguagau

SEQ ID NO: 2661014 - RNA, 14 nt, Human
gcagcccagagacu

SEQ ID NO: 2661015 - RNA, 18 nt, Human
gcagcccagagacuuugu

SEQ ID NO: 2661016 - RNA, 23 nt, Human
gcaggcugggccauguccaaaga

SEQ ID NO: 2661017 - RNA, 14 nt, Human
gcaggcugggccau

SEQ ID NO: 2661018 - RNA, 15 nt, Human
gcaggcugggccaug

SEQ ID NO: 2661019 - RNA, 10 nt, Human
gcaggcuggg

SEQ ID NO: 2661020 - RNA, 11 nt, Human
gcaggcugggc

SEQ ID NO: 2661021 - RNA, 12 nt, Human
gcaggcugggcc

SEQ ID NO: 2661022 - RNA, 13 nt, Human
gcaggcugggcca

SEQ ID NO: 2661023 - RNA, 23 nt, Human
gcaggcuuugccauugugaacca

SEQ ID NO: 2661024 - RNA, 13 nt, Human
gcagggaggcagc

SEQ ID NO: 2661025 - RNA, 14 nt, Human
gcagggaggcagcc

SEQ ID NO: 2661026 - RNA, 16 nt, Human
gcagggagcugggccc

SEQ ID NO: 2661027 - RNA, 22 nt, Human
gcagggagcugggcccgacaug

SEQ ID NO: 2661028 - RNA, 17 nt, Human
gcaguagaacuccaggc

SEQ ID NO: 2661029 - RNA, 14 nt, Human
gcagucacuggagg

SEQ ID NO: 2661030 - RNA, 23 nt, Human
gcagucacuggagguugaagcca

SEQ ID NO: 2661031 - RNA, 15 nt, Human
gcaguaagucuuuuu

SEQ ID NO: 2661032 - RNA, 18 nt, Human
gcaguaagucuuuuuuga

SEQ ID NO: 2661033 - RNA, 17 nt, Human
gcaguuucuucaucuca

SEQ ID NO: 2661034 - RNA, 21 nt, Human
gcaguuuuguuuuaaaacugg

SEQ ID NO: 2661035 - RNA, 19 nt, Human
gcaguuugaggauuaguuu

SEQ ID NO: 2661036 - RNA, 16 nt, Human
gcaguuuaucauucaa

SEQ ID NO: 2661037 - RNA, 20 nt, Human
gcaguuuaucauucaagugu

SEQ ID NO: 2661038 - RNA, 13 nt, Human
gcagucgugccug

SEQ ID NO: 2661039 - RNA, 15 nt, Human
gcagucgugccugug

SEQ ID NO: 2661040 - RNA, 15 nt, Human
gcaguuuaucauuca

SEQ ID NO: 2661041 - RNA, 19 nt, Human
gaugcugggaguucuaaca

SEQ ID NO: 2661042 - RNA, 18 nt, Human
gaugugaauuauugacac

SEQ ID NO: 2661043 - RNA, 20 nt, Human
gaugugaauuauugacacug

SEQ ID NO: 2661044 - RNA, 22 nt, Human
gaugugaauuauugacacugaa

SEQ ID NO: 2661045 - RNA, 16 nt, Human
gaugucuuuuuauuaa

SEQ ID NO: 2661046 - RNA, 19 nt, Human
gaugucuuuuuauuaaaau

SEQ ID NO: 2661047 - RNA, 23 nt, Human
gaugucuuuuuauuaaaauauuu

SEQ ID NO: 2661048 - RNA, 19 nt, Human
gauuagcaaguuacaguga

SEQ ID NO: 2661049 - RNA, 17 nt, Human
gauuaugguuuugugau

SEQ ID NO: 2661050 - RNA, 16 nt, Human
gauuaugguuuuguga

SEQ ID NO: 2661051 - RNA, 15 nt, Human
gauuaugguuuugug

SEQ ID NO: 2661052 - RNA, 20 nt, Human
gauuauuagccagguaaugu

SEQ ID NO: 2661053 - RNA, 13 nt, Human
gauuaguuuagaa

SEQ ID NO: 2661054 - RNA, 16 nt, Human
gaugagauuuuuaaaa

SEQ ID NO: 2661055 - RNA, 15 nt, Human
gauuaguuuagaaca

SEQ ID NO: 2661056 - RNA, 14 nt, Human
gauuaguuuagaac

SEQ ID NO: 2661057 - RNA, 17 nt, Human
gauuauuuaagacuaaa

SEQ ID NO: 2661058 - RNA, 11 nt, Human
gauuauuugca

SEQ ID NO: 2661059 - RNA, 12 nt, Human
gauuauuugcau

SEQ ID NO: 2661060 - RNA, 13 nt, Human
gauuauuugcaug

SEQ ID NO: 2661061 - RNA, 14 nt, Human
gauuauuugcaugu

SEQ ID NO: 2661062 - RNA, 17 nt, Human
gauuauuugcauguuau

SEQ ID NO: 2661063 - RNA, 18 nt, Human
gauuauuugcauguuaug

SEQ ID NO: 2661064 - RNA, 19 nt, Human
gauuauuugcauguuaugu

SEQ ID NO: 2661065 - RNA, 17 nt, Human
gauccauuuccauugcu

SEQ ID NO: 2661066 - RNA, 23 nt, Human
gauccauuuccauugcuuauuau

SEQ ID NO: 2661067 - RNA, 11 nt, Human
gaucuccagcg

SEQ ID NO: 2661068 - RNA, 17 nt, Human
gauauuuuucauaaaca

SEQ ID NO: 2661069 - RNA, 18 nt, Human
gauauuuuucauaaacaa

SEQ ID NO: 2661070 - RNA, 22 nt, Human
gauauuuuucauaaacaaguuc

SEQ ID NO: 2661071 - RNA, 16 nt, Human
gaucucuugagccugg

SEQ ID NO: 2661072 - RNA, 12 nt, Human
gaucucuugagc

SEQ ID NO: 2661073 - RNA, 17 nt, Human
gaucucuugagccuggg

SEQ ID NO: 2661074 - RNA, 14 nt, Human
gaucucgguuugcc

SEQ ID NO: 2661075 - RNA, 20 nt, Human
gaucucgguuugccaaaauu

SEQ ID NO: 2661076 - RNA, 17 nt, Human
gaguuugucgcucaugu

SEQ ID NO: 2661077 - RNA, 18 nt, Human
gaguuugucgcucaugug

SEQ ID NO: 2661078 - RNA, 22 nt, Human
gaguuugucgcucaugugugca

SEQ ID NO: 2661079 - RNA, 19 nt, Human
gagugcugaaggaauggaa

SEQ ID NO: 2661080 - RNA, 17 nt, Human
gaguuugagcugccuuc

SEQ ID NO: 2661081 - RNA, 18 nt, Human
gaggugggagguggaaga

SEQ ID NO: 2661082 - RNA, 21 nt, Human
gagucaaggccugcucccugu

SEQ ID NO: 2661083 - RNA, 15 nt, Human
gaggugggaggugga

SEQ ID NO: 2661084 - RNA, 11 nt, Human
gaggugggagg

SEQ ID NO: 2661085 - RNA, 13 nt, Human
gaguccacuuugu

SEQ ID NO: 2661086 - RNA, 22 nt, Human
gaguccacuuuguuucgugggg

SEQ ID NO: 2661087 - RNA, 17 nt, Human
gauaccuccaacccugc

SEQ ID NO: 2661088 - RNA, 18 nt, Human
gauaccuccaacccugcc

SEQ ID NO: 2661089 - RNA, 20 nt, Human
gauaccuccaacccugccgu

SEQ ID NO: 2661090 - RNA, 20 nt, Human
gauauguauucuuuucucag

SEQ ID NO: 2661091 - RNA, 14 nt, Human
gauauucagaugua

SEQ ID NO: 2661092 - RNA, 15 nt, Human
gauauucagauguau

SEQ ID NO: 2661093 - RNA, 17 nt, Human
gauauucagauguaugu

SEQ ID NO: 2661094 - RNA, 20 nt, Human
gauauuccccccacuuaaga

SEQ ID NO: 2661095 - RNA, 13 nt, Human
gauauugaauguu

SEQ ID NO: 2661096 - RNA, 16 nt, Human
gauauugaauguuaaa

SEQ ID NO: 2661097 - RNA, 18 nt, Human
gauauugaggccaagaau

SEQ ID NO: 2661098 - RNA, 20 nt, Human
gauauugaggccaagaauau

SEQ ID NO: 2661099 - RNA, 23 nt, Human
gauauugaggccaagaauauugc

SEQ ID NO: 2661100 - RNA, 19 nt, Human
gauacuucccacaccacaa

SEQ ID NO: 2661101 - RNA, 17 nt, Human
cugcauuuccucgcagc

SEQ ID NO: 2661102 - RNA, 19 nt, Human
cugcauuuccucgcagccu

SEQ ID NO: 2661103 - RNA, 23 nt, Human
cugcauuuagggaguauucuaau

SEQ ID NO: 2661104 - RNA, 22 nt, Human
cugcauuuagggaguauucuaa

SEQ ID NO: 2661105 - RNA, 13 nt, Human
cugcauuuaggga

SEQ ID NO: 2661106 - RNA, 15 nt, Human
cugcauucauuuuua

SEQ ID NO: 2661107 - RNA, 16 nt, Human
cugcauucauuuuuau

SEQ ID NO: 2661108 - RNA, 23 nt, Human
cugcauucauuuuuauagcaaca

SEQ ID NO: 2661109 - RNA, 18 nt, Human
cugcauuuuuagaccauu

SEQ ID NO: 2661110 - RNA, 15 nt, Human
cugccccucagagac

SEQ ID NO: 2661111 - RNA, 16 nt, Human
cugccccucccccagc

SEQ ID NO: 2661112 - RNA, 13 nt, Human
cugccccaucucc

SEQ ID NO: 2661113 - RNA, 17 nt, Human
cugccccaucuccccuc

SEQ ID NO: 2661114 - RNA, 16 nt, Human
cugccccaucuccccu

SEQ ID NO: 2661115 - RNA, 20 nt, Human
cugccccaucuccccucagc

SEQ ID NO: 2661116 - RNA, 19 nt, Human
cugccccaucuccccucag

SEQ ID NO: 2661117 - RNA, 19 nt, Human
cugaccuuguaaaagacag

SEQ ID NO: 2661118 - RNA, 16 nt, Human
cuggaacaaauuauuu

SEQ ID NO: 2661119 - RNA, 17 nt, Human
cuggaacaaauuauuuu

SEQ ID NO: 2661120 - RNA, 19 nt, Human
cuggaacaaauuauuuuug

SEQ ID NO: 2661121 - RNA, 13 nt, Human
cuggaacaauauu

SEQ ID NO: 2661122 - RNA, 17 nt, Human
cuggaaccacauugaag

SEQ ID NO: 2661123 - RNA, 20 nt, Human
cuggaaccacauugaagaau

SEQ ID NO: 2661124 - RNA, 20 nt, Human
cuggaacccuuuuaaaguug

SEQ ID NO: 2661125 - RNA, 12 nt, Human
cugccugggcug

SEQ ID NO: 2661126 - RNA, 11 nt, Human
cugccugggcu

SEQ ID NO: 2661127 - RNA, 23 nt, Human
cugccugggcugaccccgguggc

SEQ ID NO: 2661128 - RNA, 12 nt, Human
cugccuguggcg

SEQ ID NO: 2661129 - RNA, 22 nt, Human
cugccuguggcgccgucuccag

SEQ ID NO: 2661130 - RNA, 23 nt, Human
cugccuguggcgccgucuccagg

SEQ ID NO: 2661131 - RNA, 22 nt, Human
cugccuguuaggagaagcugca

SEQ ID NO: 2661132 - RNA, 15 nt, Human
cugcuacaauguccu

SEQ ID NO: 2661133 - RNA, 19 nt, Human
cuggugcacagccacuccc

SEQ ID NO: 2661134 - RNA, 22 nt, Human
cuggguggcaccagcagccugg

SEQ ID NO: 2661135 - RNA, 17 nt, Human
cuggggccuccagaacu

SEQ ID NO: 2661136 - RNA, 15 nt, Human
cuggggccuccagaa

SEQ ID NO: 2661137 - RNA, 12 nt, Human
cuggggccucca

SEQ ID NO: 2661138 - RNA, 11 nt, Human
cuggggccucc

SEQ ID NO: 2661139 - RNA, 23 nt, Human
cuggguggcaccagcagccugga

SEQ ID NO: 2661140 - RNA, 20 nt, Human
cuggggaaagacacugccug

SEQ ID NO: 2661141 - RNA, 23 nt, Human
cuggggaaagacacugccugggc

SEQ ID NO: 2661142 - RNA, 21 nt, Human
cuggggaaagacacugccugg

SEQ ID NO: 2661143 - RNA, 22 nt, Human
cuggggaaagacacugccuggg

SEQ ID NO: 2661144 - RNA, 13 nt, Human
cuggggaaggaag

SEQ ID NO: 2661145 - RNA, 22 nt, Human
cuggggccuagcgaucucuccu

SEQ ID NO: 2661146 - RNA, 23 nt, Human
cuggggccuagcgaucucuccug

SEQ ID NO: 2661147 - RNA, 24 nt, Human
cuggggccuagcgaucucuccugg

SEQ ID NO: 2661148 - RNA, 17 nt, Human
cugggaccugccaggca

SEQ ID NO: 2661149 - RNA, 18 nt, Human
cugggaccugccaggcag

SEQ ID NO: 2661150 - RNA, 19 nt, Human
cugggaccugccaggcagg

SEQ ID NO: 2661151 - RNA, 20 nt, Human
cugggaccugccaggcaggg

SEQ ID NO: 2661152 - RNA, 19 nt, Human
cuggagaccagggagccuu

SEQ ID NO: 2661153 - RNA, 18 nt, Human
cuggagaccagggagccu

SEQ ID NO: 2661154 - RNA, 17 nt, Human
cuggagaccagggagcc

SEQ ID NO: 2661155 - RNA, 18 nt, Human
cuggcaggucaaccucgc

SEQ ID NO: 2661156 - RNA, 15 nt, Human
cuggcagggggcaug

SEQ ID NO: 2661157 - RNA, 15 nt, Human
cugugaagagaacca

SEQ ID NO: 2661158 - RNA, 17 nt, Human
cuguacuuucuauuuua

SEQ ID NO: 2661159 - RNA, 21 nt, Human
cuguagggagggcggcagggg

SEQ ID NO: 2661160 - RNA, 21 nt, Human
cugucacucauugcugagccu

SEQ ID NO: 2661161 - RNA, 14 nt, Human
cugucacucauugc

SEQ ID NO: 2661162 - RNA, 20 nt, Human
cuguagggagggcggcaggg

SEQ ID NO: 2661163 - RNA, 18 nt, Human
cuguacuuuucauucucu

SEQ ID NO: 2661164 - RNA, 22 nt, Human
cuguccugcucauuaugccacu

SEQ ID NO: 2661165 - RNA, 23 nt, Human
cugucacucauugcugagccucu

SEQ ID NO: 2661166 - RNA, 22 nt, Human
cugucacucauugcugagccuc

SEQ ID NO: 2661167 - RNA, 11 nt, Human
cuuugauguca

SEQ ID NO: 2661168 - RNA, 12 nt, Human
cuuuguaaauuc

SEQ ID NO: 2661169 - RNA, 20 nt, Human
cuuugauguguuguucuugg

SEQ ID NO: 2661170 - RNA, 23 nt, Human
cuuugguuuuuuucuucuguauu

SEQ ID NO: 2661171 - RNA, 13 nt, Human
cuuuguaaaaauc

SEQ ID NO: 2661172 - RNA, 16 nt, Human
cuuuguaaaaaucuuu

SEQ ID NO: 2661173 - RNA, 12 nt, Human
cuuuguaaauag

SEQ ID NO: 2661174 - RNA, 17 nt, Human
cuuuguaaauucugauu

SEQ ID NO: 2661175 - RNA, 16 nt, Human
cuuuguaaauucugau

SEQ ID NO: 2661176 - RNA, 15 nt, Human
cuuuguaaauucuga

SEQ ID NO: 2661177 - RNA, 12 nt, Human
cuuugauguguu

SEQ ID NO: 2661178 - RNA, 22 nt, Human
cuuugaugucagcaguugcugg

SEQ ID NO: 2661179 - RNA, 18 nt, Human
cuuugauguguuguucuu

SEQ ID NO: 2661180 - RNA, 16 nt, Human
cuuugauguguuguuc

SEQ ID NO: 2661181 - RNA, 15 nt, Human
cuuugauguguuguu

SEQ ID NO: 2661182 - RNA, 13 nt, Human
cuuugauguguug

SEQ ID NO: 2661183 - RNA, 13 nt, Human
cuuuguagauccu

SEQ ID NO: 2661184 - RNA, 21 nt, Human
cuuuguagauccuuagagguc

SEQ ID NO: 2661185 - RNA, 13 nt, Human
cuuuguauauuac

SEQ ID NO: 2661186 - RNA, 21 nt, Human
cuuuguauaguuauguaaaua

SEQ ID NO: 2661187 - RNA, 19 nt, Human
cuuuguauaguuauguaaa

SEQ ID NO: 2661188 - RNA, 18 nt, Human
cuuuguauaguuauguaa

SEQ ID NO: 2661189 - RNA, 15 nt, Human
cuuuguauaguuaug

SEQ ID NO: 2661190 - RNA, 12 nt, Human
cuuuguauaguu

SEQ ID NO: 2661191 - RNA, 14 nt, Human
cuuuguauauuaca

SEQ ID NO: 2661192 - RNA, 24 nt, Human
cuuuuaucuauucugagaaaacaa

SEQ ID NO: 2661193 - RNA, 23 nt, Human
cuuuuaucuauucugagaaaaca

SEQ ID NO: 2661194 - RNA, 18 nt, Human
cuuuuaugcaaaagguuu

SEQ ID NO: 2661195 - RNA, 19 nt, Human
cuuucaauugucacuuuuu

SEQ ID NO: 2661196 - RNA, 20 nt, Human
cuuucaauugucacuuuuua

SEQ ID NO: 2661197 - RNA, 17 nt, Human
gaaacuuugggaaaaca

SEQ ID NO: 2661198 - RNA, 21 nt, Human
gaaacuuugggaaaacauguu

SEQ ID NO: 2661199 - RNA, 12 nt, Human
gaaacuuuuauc

SEQ ID NO: 2661200 - RNA, 14 nt, Human
gaaacuuuucuaga

SEQ ID NO: 2661201 - RNA, 15 nt, Human
gaaacuuuucuagaa

SEQ ID NO: 2661202 - RNA, 22 nt, Human
gaaaggugaguuugagcugccu

SEQ ID NO: 2661203 - RNA, 23 nt, Human
gaaaggugaguuugagcugccuu

SEQ ID NO: 2661204 - RNA, 15 nt, Human
gaaaggggugcuuuu

SEQ ID NO: 2661205 - RNA, 17 nt, Human
gaaaggggucggcugac

SEQ ID NO: 2661206 - RNA, 14 nt, Human
gaaaggggugcuuu

SEQ ID NO: 2661207 - RNA, 14 nt, Human
gaaaucagccaagu

SEQ ID NO: 2661208 - RNA, 15 nt, Human
gaaaucagccaaguu

SEQ ID NO: 2661209 - RNA, 20 nt, Human
gaaaucagccaaguuuuaua

SEQ ID NO: 2661210 - RNA, 12 nt, Human
gaaaauuguauu

SEQ ID NO: 2661211 - RNA, 14 nt, Human
gaaaauuguuuagu

SEQ ID NO: 2661212 - RNA, 21 nt, Human
gaaaauuguuuagugauauua

SEQ ID NO: 2661213 - RNA, 22 nt, Human
gaaaauggucgagaaagaggca

SEQ ID NO: 2661214 - RNA, 21 nt, Human
gaaaauucauaguaagauuga

SEQ ID NO: 2661215 - RNA, 16 nt, Human
gaaaauucuuaaaagg

SEQ ID NO: 2661216 - RNA, 19 nt, Human
gaaaauugaaauaaagcua

SEQ ID NO: 2661217 - RNA, 12 nt, Human
gaaaauugaguu

SEQ ID NO: 2661218 - RNA, 18 nt, Human
gaaaagaaaaaugagccu

SEQ ID NO: 2661219 - RNA, 13 nt, Human
gaaaaaaaauuau

SEQ ID NO: 2661220 - RNA, 14 nt, Human
gaaaaacacaagca

SEQ ID NO: 2661221 - RNA, 15 nt, Human
gaaaaacacaagcaa

SEQ ID NO: 2661222 - RNA, 17 nt, Human
gaaaaacacaagcaaaa

SEQ ID NO: 2661223 - RNA, 14 nt, Human
gaaaaaaauacuau

SEQ ID NO: 2661224 - RNA, 15 nt, Human
gaaaaaaauacuauu

SEQ ID NO: 2661225 - RNA, 20 nt, Human
gaaaaaaauacuauuuaaga

SEQ ID NO: 2661226 - RNA, 13 nt, Human
cuuuuuuguuuug

SEQ ID NO: 2661227 - RNA, 16 nt, Human
cuuuuuuuccuuuuua

SEQ ID NO: 2661228 - RNA, 22 nt, Human
cuuuuuuucucugcauuuaaaa

SEQ ID NO: 2661229 - RNA, 16 nt, Human
cuuuuuuuuuucuugg

SEQ ID NO: 2661230 - RNA, 12 nt, Human
cuuuuguacuga

SEQ ID NO: 2661231 - RNA, 17 nt, Human
cuuuuguacugaauuuu

SEQ ID NO: 2661232 - RNA, 23 nt, Human
cuuuuguacugaauuuuuuugua

SEQ ID NO: 2661233 - RNA, 23 nt, Human
cuuuuggcaaugacucaaagucu

SEQ ID NO: 2661234 - RNA, 19 nt, Human
cuucacggaagagccuugc

SEQ ID NO: 2661235 - RNA, 15 nt, Human
cuucacggaagagcc

SEQ ID NO: 2661236 - RNA, 13 nt, Human
cuuauugaauaua

SEQ ID NO: 2661237 - RNA, 22 nt, Human
cuuauugacaaccgagaagguu

SEQ ID NO: 2661238 - RNA, 14 nt, Human
cuuauugaccauuu

SEQ ID NO: 2661239 - RNA, 16 nt, Human
cuuauugaccauuuuu

SEQ ID NO: 2661240 - RNA, 20 nt, Human
cuuauuauguagguaagacu

SEQ ID NO: 2661241 - RNA, 13 nt, Human
cuucaugcacuua

SEQ ID NO: 2661242 - RNA, 18 nt, Human
cuucaugcacuuaaagaa

SEQ ID NO: 2661243 - RNA, 15 nt, Human
cuucauauauuucuc

SEQ ID NO: 2661244 - RNA, 20 nt, Human
cuucacuccagccuggguga

SEQ ID NO: 2661245 - RNA, 14 nt, Human
cuucaguugcuugu

SEQ ID NO: 2661246 - RNA, 15 nt, Human
cuucaguugcuuguc

SEQ ID NO: 2661247 - RNA, 23 nt, Human
cuucaguugcuugucuucuggua

SEQ ID NO: 2661248 - RNA, 13 nt, Human
cuucccacccugc

SEQ ID NO: 2661249 - RNA, 19 nt, Human
cuucccacccugccccuca

SEQ ID NO: 2661250 - RNA, 18 nt, Human
cuucugcaacaagcaugc

SEQ ID NO: 2661251 - RNA, 12 nt, Human
cuuccuccugga

SEQ ID NO: 2661252 - RNA, 13 nt, Human
cuuccuccuggaa

SEQ ID NO: 2661253 - RNA, 14 nt, Human
cuuccuccuggaaa

SEQ ID NO: 2661254 - RNA, 13 nt, Human
cuucuagaguuuu

SEQ ID NO: 2661255 - RNA, 15 nt, Human
cuucuagaguuuuau

SEQ ID NO: 2661256 - RNA, 22 nt, Human
cuucuaggauagcuaacuguaa

SEQ ID NO: 2661257 - RNA, 12 nt, Human
cuugaagccaaa

SEQ ID NO: 2661258 - RNA, 13 nt, Human
cuugaagccaaag

SEQ ID NO: 2661259 - RNA, 14 nt, Human
cuugaagccaaaga

SEQ ID NO: 2661260 - RNA, 15 nt, Human
cuugaagccaaagaa

SEQ ID NO: 2661261 - RNA, 16 nt, Human
cuugaagccaaagaaa

SEQ ID NO: 2661262 - RNA, 19 nt, Human
cuugaagccaaagaaaaau

SEQ ID NO: 2661263 - RNA, 16 nt, Human
cuugaguuugucgcuc

SEQ ID NO: 2661264 - RNA, 21 nt, Human
cuugaguuugucgcucaugug

SEQ ID NO: 2661265 - RNA, 15 nt, Human
cuugauacauucaaa

SEQ ID NO: 2661266 - RNA, 18 nt, Human
cuugauacauucaaauuu

SEQ ID NO: 2661267 - RNA, 20 nt, Human
cuugauacauucaaauuugu

SEQ ID NO: 2661268 - RNA, 22 nt, Human
cuugauacauucaaauuugucu

SEQ ID NO: 2661269 - RNA, 11 nt, Human
cuugaagcugu

SEQ ID NO: 2661270 - RNA, 13 nt, Human
cuugccugcaggg

SEQ ID NO: 2661271 - RNA, 14 nt, Human
cuugccugcagggc

SEQ ID NO: 2661272 - RNA, 16 nt, Human
cuugccugcagggcca

SEQ ID NO: 2661273 - RNA, 17 nt, Human
cuugccugcagggccau

SEQ ID NO: 2661274 - RNA, 20 nt, Human
cuugccugcagggccauggc

SEQ ID NO: 2661275 - RNA, 23 nt, Human
cuugccuuaaacacucaccuucu

SEQ ID NO: 2661276 - RNA, 10 nt, Human
cuugccuggg

SEQ ID NO: 2661277 - RNA, 16 nt, Human
cuugccugggucacac

SEQ ID NO: 2661278 - RNA, 18 nt, Human
cuuggcacuuauugaaua

SEQ ID NO: 2661279 - RNA, 20 nt, Human
cuuggcacuuauugaauaua

SEQ ID NO: 2661280 - RNA, 23 nt, Human
cuuggcaauaaauuuugaaaagu

SEQ ID NO: 2661281 - RNA, 22 nt, Human
cuuggcaauaaauuuugaaaag

SEQ ID NO: 2661282 - RNA, 18 nt, Human
auacaaugaacacuuaua

SEQ ID NO: 2661283 - RNA, 17 nt, Human
auacaaugaacacuuau

SEQ ID NO: 2661284 - RNA, 22 nt, Human
auaauguuuaauauugagaaag

SEQ ID NO: 2661285 - RNA, 19 nt, Human
auaauguuuaauauugaga

SEQ ID NO: 2661286 - RNA, 15 nt, Human
auacacuuuguugca

SEQ ID NO: 2661287 - RNA, 17 nt, Human
auacacuuuguugcaag

SEQ ID NO: 2661288 - RNA, 21 nt, Human
auacacuuuguugcaagaugu

SEQ ID NO: 2661289 - RNA, 23 nt, Human
auacacuuuguugcaagauguga

SEQ ID NO: 2661290 - RNA, 15 nt, Human
aguuuggcauuugca

SEQ ID NO: 2661291 - RNA, 14 nt, Human
aguuugcuuagaaa

SEQ ID NO: 2661292 - RNA, 13 nt, Human
aguuugcuuagaa

SEQ ID NO: 2661293 - RNA, 11 nt, Human
aguuugcuuag

SEQ ID NO: 2661294 - RNA, 14 nt, Human
aguuugagcugccu

SEQ ID NO: 2661295 - RNA, 14 nt, Human
auaaaacuaggaau

SEQ ID NO: 2661296 - RNA, 11 nt, Human
auaaaacucug

SEQ ID NO: 2661297 - RNA, 16 nt, Human
aguuucuuuauuuugu

SEQ ID NO: 2661298 - RNA, 20 nt, Human
aguuucuuuauuuuguguaa

SEQ ID NO: 2661299 - RNA, 22 nt, Human
aguuucuuuauuuuguguaaaa

SEQ ID NO: 2661300 - RNA, 15 nt, Human
aguuugaagaccgcc

SEQ ID NO: 2661301 - RNA, 19 nt, Human
aguuugagaucagccuggg

SEQ ID NO: 2661302 - RNA, 18 nt, Human
aguuugagaucagccugg

SEQ ID NO: 2661303 - RNA, 20 nt, Human
aguuugagaucagccugggc

SEQ ID NO: 2661304 - RNA, 21 nt, Human
auaaauuuugaaaaguaauau

SEQ ID NO: 2661305 - RNA, 16 nt, Human
auaaauuuugaaaagu

SEQ ID NO: 2661306 - RNA, 15 nt, Human
auaaauuuugaaaag

SEQ ID NO: 2661307 - RNA, 14 nt, Human
auaaauuuugaaaa

SEQ ID NO: 2661308 - RNA, 13 nt, Human
auaaauuuugaaa

SEQ ID NO: 2661309 - RNA, 12 nt, Human
auauggauguua

SEQ ID NO: 2661310 - RNA, 14 nt, Human
auauggauguuacu

SEQ ID NO: 2661311 - RNA, 22 nt, Human
auauggauguuacucucuugca

SEQ ID NO: 2661312 - RNA, 23 nt, Human
auauggauguuacucucuugcac

SEQ ID NO: 2661313 - RNA, 23 nt, Human
auaucaguaacccccuuaaauuu

SEQ ID NO: 2661314 - RNA, 16 nt, Human
auaucagugacaguug

SEQ ID NO: 2661315 - RNA, 21 nt, Human
auauuucccauuugugccaga

SEQ ID NO: 2661316 - RNA, 19 nt, Human
auauucaggguaaauagga

SEQ ID NO: 2661317 - RNA, 20 nt, Human
auauucaggguaaauaggaa

SEQ ID NO: 2661318 - RNA, 13 nt, Human
auagcauguaaug

SEQ ID NO: 2661319 - RNA, 17 nt, Human
auagcagccaguucaaa

SEQ ID NO: 2661320 - RNA, 19 nt, Human
auagcagccaguucaaaaa

SEQ ID NO: 2661321 - RNA, 12 nt, Human
auagaaagcuau

SEQ ID NO: 2661322 - RNA, 18 nt, Human
auacuuuguauuguccua

SEQ ID NO: 2661323 - RNA, 13 nt, Human
auacuuuguauuu

SEQ ID NO: 2661324 - RNA, 17 nt, Human
auacuuuguauuuugau

SEQ ID NO: 2661325 - RNA, 14 nt, Human
auacuuuguauugu

SEQ ID NO: 2661326 - RNA, 13 nt, Human
auacuuuguauug

SEQ ID NO: 2661327 - RNA, 10 nt, Human
auacuuugua

SEQ ID NO: 2661328 - RNA, 14 nt, Human
auacuuuguaaaua

SEQ ID NO: 2661329 - RNA, 22 nt, Human
auaguagauguggccuuugaau

SEQ ID NO: 2661330 - RNA, 19 nt, Human
auauaaugaauaaaucauu

SEQ ID NO: 2661331 - RNA, 15 nt, Human
auauacaaaaagaaa

SEQ ID NO: 2661332 - RNA, 18 nt, Human
auaguacucuuuguagca

SEQ ID NO: 2661333 - RNA, 13 nt, Human
auaguaagauuga

SEQ ID NO: 2661334 - RNA, 13 nt, Human
auaguaagcauag

SEQ ID NO: 2661335 - RNA, 19 nt, Human
auagccuauggcagaaaaa

SEQ ID NO: 2661336 - RNA, 13 nt, Human
auauacacgaaua

SEQ ID NO: 2661337 - RNA, 17 nt, Human
auauacacgaauagaca

SEQ ID NO: 2661338 - RNA, 20 nt, Human
auauacacgaauagacauca

SEQ ID NO: 2661339 - RNA, 21 nt, Human
auauacacgaauagacaucaa

SEQ ID NO: 2661340 - RNA, 22 nt, Human
auauacacgaauagacaucaaa

SEQ ID NO: 2661341 - RNA, 17 nt, Human
auauacaguauagauuu

SEQ ID NO: 2661342 - RNA, 21 nt, Human
aguccaaaaagcuccuggggc

SEQ ID NO: 2661343 - RNA, 11 nt, Human
agucauguaug

SEQ ID NO: 2661344 - RNA, 12 nt, Human
agucauguaugu

SEQ ID NO: 2661345 - RNA, 13 nt, Human
agucauguauguu

SEQ ID NO: 2661346 - RNA, 15 nt, Human
agucauguauguuuc

SEQ ID NO: 2661347 - RNA, 17 nt, Human
agucauguauguuucuc

SEQ ID NO: 2661348 - RNA, 22 nt, Human
agucauguauguuucucuuuga

SEQ ID NO: 2661349 - RNA, 13 nt, Human
aguccaaaauacu

SEQ ID NO: 2661350 - RNA, 23 nt, Human
aguccuugauuucaaaguuuugu

SEQ ID NO: 2661351 - RNA, 14 nt, Human
agucuguggaucag

SEQ ID NO: 2661352 - RNA, 17 nt, Human
agucuguggaucagaga

SEQ ID NO: 2661353 - RNA, 16 nt, Human
agucugaguaaaaucu

SEQ ID NO: 2661354 - RNA, 21 nt, Human
agucugagggcuuguaguucu

SEQ ID NO: 2661355 - RNA, 18 nt, Human
agucugagggcuuguagu

SEQ ID NO: 2661356 - RNA, 17 nt, Human
agucugagggcuuguag

SEQ ID NO: 2661357 - RNA, 18 nt, Human
agucugaggccguugcug

SEQ ID NO: 2661358 - RNA, 16 nt, Human
agugaauuugcacugu

SEQ ID NO: 2661359 - RNA, 16 nt, Human
agucuguucugguaau

SEQ ID NO: 2661360 - RNA, 15 nt, Human
agugaaugcugggac

SEQ ID NO: 2661361 - RNA, 13 nt, Human
agucuguugugug

SEQ ID NO: 2661362 - RNA, 16 nt, Human
agucuguuguguguca

SEQ ID NO: 2661363 - RNA, 19 nt, Human
agugaaugcugggacucag

SEQ ID NO: 2661364 - RNA, 13 nt, Human
agugaccucucuc

SEQ ID NO: 2661365 - RNA, 21 nt, Human
aguaagaaagugaagcaaauc

SEQ ID NO: 2661366 - RNA, 20 nt, Human
aguaagaaagugaagcaaau

SEQ ID NO: 2661367 - RNA, 18 nt, Human
aguaacauucauguucua

SEQ ID NO: 2661368 - RNA, 21 nt, Human
aguaagaauaccacaucaaau

SEQ ID NO: 2661369 - RNA, 23 nt, Human
aguaagaauaccacaucaaauaa

SEQ ID NO: 2661370 - RNA, 14 nt, Human
aguaagaucacugu

SEQ ID NO: 2661371 - RNA, 14 nt, Human
aguaagauaucuca

SEQ ID NO: 2661372 - RNA, 21 nt, Human
aguaagaucacuguuuagauu

SEQ ID NO: 2661373 - RNA, 20 nt, Human
aguaagaucacuguuuagau

SEQ ID NO: 2661374 - RNA, 15 nt, Human
aguaagaucacuguu

SEQ ID NO: 2661375 - RNA, 12 nt, Human
aguaagauugau

SEQ ID NO: 2661376 - RNA, 22 nt, Human
aguaagauugauaucuauaaaa

SEQ ID NO: 2661377 - RNA, 14 nt, Human
agucaauggcuugu

SEQ ID NO: 2661378 - RNA, 19 nt, Human
aguauuuuuauacaaaccu

SEQ ID NO: 2661379 - RNA, 14 nt, Human
aguauuuuuucaag

SEQ ID NO: 2661380 - RNA, 19 nt, Human
aguauuuuuucaaguugua

SEQ ID NO: 2661381 - RNA, 12 nt, Human
aguaucccacau

SEQ ID NO: 2661382 - RNA, 18 nt, Human
aguaucccacauccaacu

SEQ ID NO: 2661383 - RNA, 21 nt, Human
agugggaagcccauccugacc

SEQ ID NO: 2661384 - RNA, 22 nt, Human
agugggaagcccauccugacca

SEQ ID NO: 2661385 - RNA, 12 nt, Human
agugggaagccc

SEQ ID NO: 2661386 - RNA, 17 nt, Human
agugggaagcccauccu

SEQ ID NO: 2661387 - RNA, 23 nt, Human
agugucagaaggagcuacaaaac

SEQ ID NO: 2661388 - RNA, 17 nt, Human
agugucuauaaaagaaa

SEQ ID NO: 2661389 - RNA, 19 nt, Human
agugucuauaaaagaaaca

SEQ ID NO: 2661390 - RNA, 20 nt, Human
agugucuauaaaagaaacac

SEQ ID NO: 2661391 - RNA, 17 nt, Human
aguguccuucuugcucc

SEQ ID NO: 2661392 - RNA, 16 nt, Human
agugucuggaauugug

SEQ ID NO: 2661393 - RNA, 17 nt, Human
agugucuggaauugugg

SEQ ID NO: 2661394 - RNA, 21 nt, Human
agugucuggaauuguggcuau

SEQ ID NO: 2661395 - RNA, 21 nt, Human
agugaugcugugcuaugaauu

SEQ ID NO: 2661396 - RNA, 22 nt, Human
agugaucuacaugaggaacugu

SEQ ID NO: 2661397 - RNA, 17 nt, Human
aguucaucgauuuucua

SEQ ID NO: 2661398 - RNA, 18 nt, Human
aguucaucgauuuucuau

SEQ ID NO: 2661399 - RNA, 13 nt, Human
aguugucuaaaca

SEQ ID NO: 2661400 - RNA, 13 nt, Human
aguugucagguua

SEQ ID NO: 2661401 - RNA, 13 nt, Human
aguugagcuauga

SEQ ID NO: 2661402 - RNA, 17 nt, Human
aguugagcuaugacuua

SEQ ID NO: 2661403 - RNA, 15 nt, Human
aguugagcuaugacu

SEQ ID NO: 2661404 - RNA, 18 nt, Human
aguugagcuaugacuuaa

SEQ ID NO: 2661405 - RNA, 19 nt, Human
aucuauuuauuaauauuua

SEQ ID NO: 2661406 - RNA, 15 nt, Human
aucuauuuauuaaua

SEQ ID NO: 2661407 - RNA, 12 nt, Human
aucuauuugagg

SEQ ID NO: 2661408 - RNA, 13 nt, Human
aucuauuuauuaa

SEQ ID NO: 2661409 - RNA, 17 nt, Human
aucuauagaaagcuaua

SEQ ID NO: 2661410 - RNA, 14 nt, Human
aucuauauauauaa

SEQ ID NO: 2661411 - RNA, 15 nt, Human
aucuccugacagaag

SEQ ID NO: 2661412 - RNA, 21 nt, Human
aucuccggcucccagccucag

SEQ ID NO: 2661413 - RNA, 19 nt, Human
aucuccggcucccagccuc

SEQ ID NO: 2661414 - RNA, 18 nt, Human
aucuccugacagaaggug

SEQ ID NO: 2661415 - RNA, 22 nt, Human
aucuccggcucccagccucagc

SEQ ID NO: 2661416 - RNA, 17 nt, Human
aucuccugacagaaggu

SEQ ID NO: 2661417 - RNA, 14 nt, Human
aucuccggcuccca

SEQ ID NO: 2661418 - RNA, 18 nt, Human
aucuccggcucccagccu

SEQ ID NO: 2661419 - RNA, 16 nt, Human
aucuccggcucccagc

SEQ ID NO: 2661420 - RNA, 11 nt, Human
aucuauaaaau

SEQ ID NO: 2661421 - RNA, 12 nt, Human
aucuauaaaaua

SEQ ID NO: 2661422 - RNA, 14 nt, Human
aucuauaaaauaga

SEQ ID NO: 2661423 - RNA, 20 nt, Human
aucuauaaaauagauauaaa

SEQ ID NO: 2661424 - RNA, 16 nt, Human
aucuauagaaagcuau

SEQ ID NO: 2661425 - RNA, 20 nt, Human
aucuaggggagccuugauuc

SEQ ID NO: 2661426 - RNA, 19 nt, Human
aucuaggggagccuugauu

SEQ ID NO: 2661427 - RNA, 17 nt, Human
aucuaggggagccuuga

SEQ ID NO: 2661428 - RNA, 15 nt, Human
aucuucaaagccuuc

SEQ ID NO: 2661429 - RNA, 18 nt, Human
aucuucaaagccuucucc

SEQ ID NO: 2661430 - RNA, 12 nt, Human
aucucuccuggc

SEQ ID NO: 2661431 - RNA, 13 nt, Human
aucucuccuggcc

SEQ ID NO: 2661432 - RNA, 14 nt, Human
aucucuccuggccu

SEQ ID NO: 2661433 - RNA, 22 nt, Human
aucucuccuggccuauccgcug

SEQ ID NO: 2661434 - RNA, 14 nt, Human
aucucuccacugug

SEQ ID NO: 2661435 - RNA, 16 nt, Human
aucucugaaugcccca

SEQ ID NO: 2661436 - RNA, 18 nt, Human
aucuggaguucucaaaga

SEQ ID NO: 2661437 - RNA, 22 nt, Human
aucuggagaccagggagccuuu

SEQ ID NO: 2661438 - RNA, 21 nt, Human
aucuggagaccagggagccuu

SEQ ID NO: 2661439 - RNA, 20 nt, Human
aucuggagaccagggagccu

SEQ ID NO: 2661440 - RNA, 14 nt, Human
aucuucccaugcau

SEQ ID NO: 2661441 - RNA, 23 nt, Human
augaagucuuaaggacaaagugc

SEQ ID NO: 2661442 - RNA, 12 nt, Human
augaaaauggaa

SEQ ID NO: 2661443 - RNA, 17 nt, Human
augaaaacauggaacag

SEQ ID NO: 2661444 - RNA, 20 nt, Human
augaaaacauggaacagugu

SEQ ID NO: 2661445 - RNA, 14 nt, Human
augaaguugaaaau

SEQ ID NO: 2661446 - RNA, 16 nt, Human
augaaguugaaaauca

SEQ ID NO: 2661447 - RNA, 18 nt, Human
augaccagaugcguccca

SEQ ID NO: 2661448 - RNA, 21 nt, Human
augaccagaugcgucccaaga

SEQ ID NO: 2661449 - RNA, 13 nt, Human
augaccaguaaag

SEQ ID NO: 2661450 - RNA, 24 nt, Human
augacguacaaguaguucuguauu

SEQ ID NO: 2661451 - RNA, 19 nt, Human
augacguacaaguaguucu

SEQ ID NO: 2661452 - RNA, 23 nt, Human
augacguacaaguaguucuguau

SEQ ID NO: 2661453 - RNA, 20 nt, Human
augacguacaaguaguucug

SEQ ID NO: 2661454 - RNA, 14 nt, Human
augacuguguugua

SEQ ID NO: 2661455 - RNA, 13 nt, Human
augacugcacaug

SEQ ID NO: 2661456 - RNA, 17 nt, Human
augaaaacaguguguaa

SEQ ID NO: 2661457 - RNA, 18 nt, Human
augaaaacaguguguaaa

SEQ ID NO: 2661458 - RNA, 20 nt, Human
augaaaacaguguguaaaca

SEQ ID NO: 2661459 - RNA, 20 nt, Human
aucccguuuuccccaugaca

SEQ ID NO: 2661460 - RNA, 18 nt, Human
aucccguuuuccccauga

SEQ ID NO: 2661461 - RNA, 16 nt, Human
aucccguuuuccccau

SEQ ID NO: 2661462 - RNA, 15 nt, Human
aucccguuuucccca

SEQ ID NO: 2661463 - RNA, 22 nt, Human
auccccagggggcaugaccaga

SEQ ID NO: 2661464 - RNA, 19 nt, Human
aucccuaccgacccagggu

SEQ ID NO: 2661465 - RNA, 17 nt, Human
aucccuaccgacccagg

SEQ ID NO: 2661466 - RNA, 12 nt, Human
aucccauuccag

SEQ ID NO: 2661467 - RNA, 14 nt, Human
aucccauuccaggc

SEQ ID NO: 2661468 - RNA, 15 nt, Human
aucccauuccaggca

SEQ ID NO: 2661469 - RNA, 16 nt, Human
auccagacucagagcu

SEQ ID NO: 2661470 - RNA, 23 nt, Human
auccagacucagagcucucucua

SEQ ID NO: 2661471 - RNA, 22 nt, Human
auccagaggcaaacggaggcaa

SEQ ID NO: 2661472 - RNA, 22 nt, Human
auccuugaugcaagugcaaccu

SEQ ID NO: 2661473 - RNA, 14 nt, Human
aucgccacaaacuc

SEQ ID NO: 2661474 - RNA, 16 nt, Human
aucgccacaaacucua

SEQ ID NO: 2661475 - RNA, 17 nt, Human
auccuuuaaaauuuaaa

SEQ ID NO: 2661476 - RNA, 14 nt, Human
auccuuccauucca

SEQ ID NO: 2661477 - RNA, 15 nt, Human
auccuuccauuccac

SEQ ID NO: 2661478 - RNA, 16 nt, Human
auccuuccauuccaca

SEQ ID NO: 2661479 - RNA, 20 nt, Human
auccuuccauuccacacaga

SEQ ID NO: 2661480 - RNA, 13 nt, Human
auccuuagagguc

SEQ ID NO: 2661481 - RNA, 18 nt, Human
auccuuagagguccucug

SEQ ID NO: 2661482 - RNA, 19 nt, Human
auccuuagagguccucugg

SEQ ID NO: 2661483 - RNA, 20 nt, Human
auccuuagagguccucugga

SEQ ID NO: 2661484 - RNA, 21 nt, Human
auccuuagagguccucuggag

SEQ ID NO: 2661485 - RNA, 21 nt, Human
aucaaauagaaccacuaugaa

SEQ ID NO: 2661486 - RNA, 20 nt, Human
aucaaauagaaccacuauga

SEQ ID NO: 2661487 - RNA, 23 nt, Human
aucaaagagguuuuaaaaaaauc

SEQ ID NO: 2661488 - RNA, 20 nt, Human
aucaaagagguuuuaaaaaa

SEQ ID NO: 2661489 - RNA, 14 nt, Human
aucaaaauagucua

SEQ ID NO: 2661490 - RNA, 13 nt, Human
aucaaaagugccu

SEQ ID NO: 2661491 - RNA, 12 nt, Human
auauuuccuuua

SEQ ID NO: 2661492 - RNA, 14 nt, Human
auauuuccuuuaug

SEQ ID NO: 2661493 - RNA, 15 nt, Human
auauuuccuuuaugu

SEQ ID NO: 2661494 - RNA, 17 nt, Human
auauuuccuuuauguga

SEQ ID NO: 2661495 - RNA, 18 nt, Human
auauuuccuuuaugugaa

SEQ ID NO: 2661496 - RNA, 19 nt, Human
auauuuccuuuaugugaau

SEQ ID NO: 2661497 - RNA, 20 nt, Human
auauuuccuuuaugugaauu

SEQ ID NO: 2661498 - RNA, 21 nt, Human
auauuuccuuuaugugaauuu

SEQ ID NO: 2661499 - RNA, 20 nt, Human
auauuucagguucuucagaa

SEQ ID NO: 2661500 - RNA, 17 nt, Human
aucacagggugggccuc

SEQ ID NO: 2661501 - RNA, 21 nt, Human
aucacagggugggccucggcc

SEQ ID NO: 2661502 - RNA, 13 nt, Human
aucacagccucug

SEQ ID NO: 2661503 - RNA, 17 nt, Human
aucacaguuuuuccugg

SEQ ID NO: 2661504 - RNA, 18 nt, Human
aucacaguuuuuccugga

SEQ ID NO: 2661505 - RNA, 13 nt, Human
aucaccagacagg

SEQ ID NO: 2661506 - RNA, 16 nt, Human
aucaccgacugaaaau

SEQ ID NO: 2661507 - RNA, 17 nt, Human
aucauguacuuuuuagu

SEQ ID NO: 2661508 - RNA, 18 nt, Human
aucauguacuuuuuagua

SEQ ID NO: 2661509 - RNA, 16 nt, Human
aucauguccauacacu

SEQ ID NO: 2661510 - RNA, 22 nt, Human
aucaugaaacuuguuucacuga

SEQ ID NO: 2661511 - RNA, 23 nt, Human
aucaugaaacuuguuucacugaa

SEQ ID NO: 2661512 - RNA, 15 nt, Human
aucaccauguaagca

SEQ ID NO: 2661513 - RNA, 19 nt, Human
aucaugaaucuuuguuuca

SEQ ID NO: 2661514 - RNA, 20 nt, Human
auguuuccucuaguucuuug

SEQ ID NO: 2661515 - RNA, 23 nt, Human
auguuucucuuugauuauuugca

SEQ ID NO: 2661516 - RNA, 24 nt, Human
auguuucucuuugauuauuugcau

SEQ ID NO: 2661517 - RNA, 14 nt, Human
auguuuccucuagu

SEQ ID NO: 2661518 - RNA, 16 nt, Human
auguucucucuucucc

SEQ ID NO: 2661519 - RNA, 17 nt, Human
auguucucucuucucca

SEQ ID NO: 2661520 - RNA, 16 nt, Human
auguuccucaaagcuu

SEQ ID NO: 2661521 - RNA, 17 nt, Human
auguuccucaaagcuug

SEQ ID NO: 2661522 - RNA, 21 nt, Human
auguuccucaaagcuuggauu

SEQ ID NO: 2661523 - RNA, 19 nt, Human
auguguaugcacaguaaaa

SEQ ID NO: 2661524 - RNA, 15 nt, Human
auguguaugcacagu

SEQ ID NO: 2661525 - RNA, 15 nt, Human
augucuuuuuauuaa

SEQ ID NO: 2661526 - RNA, 22 nt, Human
augucuuuuuauuaaaauauuu

SEQ ID NO: 2661527 - RNA, 19 nt, Human
augucaauuucuguguugc

SEQ ID NO: 2661528 - RNA, 16 nt, Human
augucaauuucugugu

SEQ ID NO: 2661529 - RNA, 12 nt, Human
auguaauuuaaa

SEQ ID NO: 2661530 - RNA, 13 nt, Human
auguaauuuaaau

SEQ ID NO: 2661531 - RNA, 15 nt, Human
auguaauuuaaauga

SEQ ID NO: 2661532 - RNA, 16 nt, Human
auguaauuuaaaugaa

SEQ ID NO: 2661533 - RNA, 17 nt, Human
auguaauuuaaaugaaa

SEQ ID NO: 2661534 - RNA, 20 nt, Human
auguaauuuaaaugaaagaa

SEQ ID NO: 2661535 - RNA, 20 nt, Human
auguaaauuuuguaugaaaa

SEQ ID NO: 2661536 - RNA, 20 nt, Human
augguaaucuuuaccuguau

SEQ ID NO: 2661537 - RNA, 23 nt, Human
augguaaucuuuaccuguauaca

SEQ ID NO: 2661538 - RNA, 13 nt, Human
augguaauaagca

SEQ ID NO: 2661539 - RNA, 20 nt, Human
augguaauaagcacuguaaa

SEQ ID NO: 2661540 - RNA, 22 nt, Human
auggguuuuucccuguacagua

SEQ ID NO: 2661541 - RNA, 20 nt, Human
augguaccaaucaugaaucu

SEQ ID NO: 2661542 - RNA, 17 nt, Human
augguaccaaucaugaa

SEQ ID NO: 2661543 - RNA, 19 nt, Human
augguagccagaugauaaa

SEQ ID NO: 2661544 - RNA, 12 nt, Human
augguaguuucu

SEQ ID NO: 2661545 - RNA, 19 nt, Human
augguaguuucugugguug

SEQ ID NO: 2661546 - RNA, 18 nt, Human
augguaguuucugugguu

SEQ ID NO: 2661547 - RNA, 15 nt, Human
augguaguuucugug

SEQ ID NO: 2661548 - RNA, 13 nt, Human
augguaguuucug

SEQ ID NO: 2661549 - RNA, 23 nt, Human
augguaguuucugugguuggcug

SEQ ID NO: 2661550 - RNA, 22 nt, Human
augguaguuucugugguuggcu

SEQ ID NO: 2661551 - RNA, 20 nt, Human
augaugauguggaagaacuu

SEQ ID NO: 2661552 - RNA, 15 nt, Human
augaugauccuaggc

SEQ ID NO: 2661553 - RNA, 14 nt, Human
augaugguucacgu

SEQ ID NO: 2661554 - RNA, 17 nt, Human
augaugacaaaaaaugu

SEQ ID NO: 2661555 - RNA, 17 nt, Human
augaugguuuuaaacuu

SEQ ID NO: 2661556 - RNA, 14 nt, Human
augauguacagauu

SEQ ID NO: 2661557 - RNA, 18 nt, Human
augauguacagauucuuu

SEQ ID NO: 2661558 - RNA, 21 nt, Human
augauguacagauucuuucag

SEQ ID NO: 2661559 - RNA, 23 nt, Human
augccugcuuugaauaaaugugu

SEQ ID NO: 2661560 - RNA, 15 nt, Human
augcaugucuuuuaa

SEQ ID NO: 2661561 - RNA, 18 nt, Human
augcaugucuuuuaaaau

SEQ ID NO: 2661562 - RNA, 19 nt, Human
augcuugugaaaauguguu

SEQ ID NO: 2661563 - RNA, 12 nt, Human
auggaguauucu

SEQ ID NO: 2661564 - RNA, 14 nt, Human
augcugaggccugg

SEQ ID NO: 2661565 - RNA, 15 nt, Human
augcugaggccuggg

SEQ ID NO: 2661566 - RNA, 17 nt, Human
augcugaggccugggcc

SEQ ID NO: 2661567 - RNA, 18 nt, Human
augcugaggccugggccg

SEQ ID NO: 2661568 - RNA, 22 nt, Human
augcugaggccugggccgcugc

SEQ ID NO: 2661569 - RNA, 12 nt, Human
agcuaauuauuu

SEQ ID NO: 2661570 - RNA, 21 nt, Human
agcuaauucuacucacagugc

SEQ ID NO: 2661571 - RNA, 23 nt, Human
agcucaacuagugggguuuccug

SEQ ID NO: 2661572 - RNA, 13 nt, Human
agcucaaugcagu

SEQ ID NO: 2661573 - RNA, 15 nt, Human
agcucagaaccacag

SEQ ID NO: 2661574 - RNA, 16 nt, Human
agcgacuccguuggcc

SEQ ID NO: 2661575 - RNA, 17 nt, Human
agcgacuccguuggcca

SEQ ID NO: 2661576 - RNA, 18 nt, Human
agccuuugguucuggcca

SEQ ID NO: 2661577 - RNA, 19 nt, Human
agccuuugguucuggccag

SEQ ID NO: 2661578 - RNA, 21 nt, Human
agcgacuccguuggccacucc

SEQ ID NO: 2661579 - RNA, 19 nt, Human
agcgacuccguuggccacu

SEQ ID NO: 2661580 - RNA, 20 nt, Human
agcgacuccguuggccacuc

SEQ ID NO: 2661581 - RNA, 23 nt, Human
agcgaggcacccuuacuggcuua

SEQ ID NO: 2661582 - RNA, 12 nt, Human
agcgacuaaacu

SEQ ID NO: 2661583 - RNA, 16 nt, Human
agcgaucucuccacug

SEQ ID NO: 2661584 - RNA, 19 nt, Human
agcgaucucuccacugugc

SEQ ID NO: 2661585 - RNA, 13 nt, Human
agcgaucucuccu

SEQ ID NO: 2661586 - RNA, 17 nt, Human
agcgaucucuccuggcc

SEQ ID NO: 2661587 - RNA, 18 nt, Human
agcgaucucuccuggccu

SEQ ID NO: 2661588 - RNA, 19 nt, Human
agcgaucucuccuggccua

SEQ ID NO: 2661589 - RNA, 17 nt, Human
agcgagggcagcugcua

SEQ ID NO: 2661590 - RNA, 14 nt, Human
agcgagggcagcug

SEQ ID NO: 2661591 - RNA, 15 nt, Human
agcgagggcagcugc

SEQ ID NO: 2661592 - RNA, 16 nt, Human
agcgagggcagcugcu

SEQ ID NO: 2661593 - RNA, 16 nt, Human
agccugggccccagcu

SEQ ID NO: 2661594 - RNA, 12 nt, Human
agccugggcccc

SEQ ID NO: 2661595 - RNA, 11 nt, Human
agccugggccc

SEQ ID NO: 2661596 - RNA, 17 nt, Human
agccuggggcugaggcu

SEQ ID NO: 2661597 - RNA, 15 nt, Human
agccugggaaauaag

SEQ ID NO: 2661598 - RNA, 21 nt, Human
agccugggaaauaagcccccu

SEQ ID NO: 2661599 - RNA, 12 nt, Human
agccugggaggu

SEQ ID NO: 2661600 - RNA, 16 nt, Human
agccccaucuagggga

SEQ ID NO: 2661601 - RNA, 23 nt, Human
agcugaacaauaggcuguuccca

SEQ ID NO: 2661602 - RNA, 12 nt, Human
agcuccuguggc

SEQ ID NO: 2661603 - RNA, 13 nt, Human
agcuccuguggcc

SEQ ID NO: 2661604 - RNA, 15 nt, Human
agcuccuguggcccc

SEQ ID NO: 2661605 - RNA, 16 nt, Human
agcuccuguggcccca

SEQ ID NO: 2661606 - RNA, 19 nt, Human
agcuccuguggccccaccc

SEQ ID NO: 2661607 - RNA, 22 nt, Human
agcuccuguggccccacccugg

SEQ ID NO: 2661608 - RNA, 14 nt, Human
agcugagccugcag

SEQ ID NO: 2661609 - RNA, 16 nt, Human
agcugagccugcaggg

SEQ ID NO: 2661610 - RNA, 17 nt, Human
agcugagccugcaggga

SEQ ID NO: 2661611 - RNA, 21 nt, Human
agcugagccugcagggaagcc

SEQ ID NO: 2661612 - RNA, 23 nt, Human
agcugagccugcagggaagcccc

SEQ ID NO: 2661613 - RNA, 15 nt, Human
agcugaaccugggua

SEQ ID NO: 2661614 - RNA, 18 nt, Human
agcugaagaauugaaaag

SEQ ID NO: 2661615 - RNA, 16 nt, Human
agcugguugagguuuc

SEQ ID NO: 2661616 - RNA, 21 nt, Human
agcuccccgcuucugccugca

SEQ ID NO: 2661617 - RNA, 20 nt, Human
agcuucaugcacuuaaagaa

SEQ ID NO: 2661618 - RNA, 18 nt, Human
agcuucugaggcgcugcu

SEQ ID NO: 2661619 - RNA, 19 nt, Human
agcuucugcuuuucugccc

SEQ ID NO: 2661620 - RNA, 23 nt, Human
agcuuuguuuguugucagcugaa

SEQ ID NO: 2661621 - RNA, 12 nt, Human
agcuucugcuuu

SEQ ID NO: 2661622 - RNA, 17 nt, Human
agcuucugcuuuucugc

SEQ ID NO: 2661623 - RNA, 16 nt, Human
aggaaauucuccacug

SEQ ID NO: 2661624 - RNA, 19 nt, Human
aggaacauaugaaaauaca

SEQ ID NO: 2661625 - RNA, 16 nt, Human
aggaacauugugucua

SEQ ID NO: 2661626 - RNA, 21 nt, Human
aggaauaaauaaaaauggaua

SEQ ID NO: 2661627 - RNA, 19 nt, Human
aggaauaaauaaaaaugga

SEQ ID NO: 2661628 - RNA, 13 nt, Human
aggaauaaauaaa

SEQ ID NO: 2661629 - RNA, 14 nt, Human
aggaaguguuuaug

SEQ ID NO: 2661630 - RNA, 18 nt, Human
aggaacuguagaugaugu

SEQ ID NO: 2661631 - RNA, 15 nt, Human
aggagaggagagggg

SEQ ID NO: 2661632 - RNA, 13 nt, Human
aggaccagggccu

SEQ ID NO: 2661633 - RNA, 15 nt, Human
aggaccagggccuuu

SEQ ID NO: 2661634 - RNA, 20 nt, Human
aggaccagggccuuuucugg

SEQ ID NO: 2661635 - RNA, 20 nt, Human
aggaauauuuuccaaagagu

SEQ ID NO: 2661636 - RNA, 15 nt, Human
aggaauauuuuccaa

SEQ ID NO: 2661637 - RNA, 16 nt, Human
aggaauauuuuccaaa

SEQ ID NO: 2661638 - RNA, 13 nt, Human
agguccuaaggca

SEQ ID NO: 2661639 - RNA, 21 nt, Human
aggucuccaguuggcuuuacu

SEQ ID NO: 2661640 - RNA, 15 nt, Human
agguccucuggagcc

SEQ ID NO: 2661641 - RNA, 16 nt, Human
agguccucagaaagug

SEQ ID NO: 2661642 - RNA, 20 nt, Human
agguccucuggagcccuaac

SEQ ID NO: 2661643 - RNA, 22 nt, Human
aggucgguagguucagccaagg

SEQ ID NO: 2661644 - RNA, 20 nt, Human
aggucuauuuaaaaaaaaag

SEQ ID NO: 2661645 - RNA, 21 nt, Human
aggucuauuuaaaaaaaaagu

SEQ ID NO: 2661646 - RNA, 21 nt, Human
agggcaagcuccgcaggacuu

SEQ ID NO: 2661647 - RNA, 20 nt, Human
agggcaagcuccgcaggacu

SEQ ID NO: 2661648 - RNA, 19 nt, Human
agggcaagcuccgcaggac

SEQ ID NO: 2661649 - RNA, 17 nt, Human
agggcaagcuccgcagg

SEQ ID NO: 2661650 - RNA, 21 nt, Human
aggguauggacuaucugucug

SEQ ID NO: 2661651 - RNA, 22 nt, Human
aggggccuggagauccuccugc

SEQ ID NO: 2661652 - RNA, 13 nt, Human
aggguauuccaga

SEQ ID NO: 2661653 - RNA, 18 nt, Human
aggggccuggagauccuc

SEQ ID NO: 2661654 - RNA, 21 nt, Human
aggggccuggagauccuccug

SEQ ID NO: 2661655 - RNA, 22 nt, Human
agggucggaacccaagcuuaga

SEQ ID NO: 2661656 - RNA, 17 nt, Human
agggucggaacccaagc

SEQ ID NO: 2661657 - RNA, 21 nt, Human
agggccuuggaaauuccugua

SEQ ID NO: 2661658 - RNA, 15 nt, Human
agggccuuuucuggc

SEQ ID NO: 2661659 - RNA, 19 nt, Human
agggccuuuucuggcaccg

SEQ ID NO: 2661660 - RNA, 20 nt, Human
agggccuuuucuggcaccgc

SEQ ID NO: 2661661 - RNA, 13 nt, Human
aggggccuggaga

SEQ ID NO: 2661662 - RNA, 14 nt, Human
aggggccuggagau

SEQ ID NO: 2661663 - RNA, 15 nt, Human
agggacccuuugggg

SEQ ID NO: 2661664 - RNA, 16 nt, Human
agggacccuuuggggg

SEQ ID NO: 2661665 - RNA, 17 nt, Human
agggacccuuugggggu

SEQ ID NO: 2661666 - RNA, 19 nt, Human
aggcugguacaacggaggc

SEQ ID NO: 2661667 - RNA, 21 nt, Human
aggcugguacaacggaggccu

SEQ ID NO: 2661668 - RNA, 20 nt, Human
aggcugguggagaacucugg

SEQ ID NO: 2661669 - RNA, 19 nt, Human
aggcugaggcaggagaaug

SEQ ID NO: 2661670 - RNA, 19 nt, Human
aggcgucaacgugcauuuu

SEQ ID NO: 2661671 - RNA, 19 nt, Human
aggcuaaggcaggaaaauu

SEQ ID NO: 2661672 - RNA, 17 nt, Human
aggcgggggcugcccuu

SEQ ID NO: 2661673 - RNA, 16 nt, Human
aggcauggcccugggc

SEQ ID NO: 2661674 - RNA, 22 nt, Human
aggccauggcaucccuuuuuca

SEQ ID NO: 2661675 - RNA, 15 nt, Human
aggcccugagacagg

SEQ ID NO: 2661676 - RNA, 14 nt, Human
aggcccuggccucc

SEQ ID NO: 2661677 - RNA, 15 nt, Human
aggcccuggccuccc

SEQ ID NO: 2661678 - RNA, 13 nt, Human
aggccggcagccc

SEQ ID NO: 2661679 - RNA, 16 nt, Human
aggccggcagccccag

SEQ ID NO: 2661680 - RNA, 15 nt, Human
aggccggcagcccca

SEQ ID NO: 2661681 - RNA, 23 nt, Human
aggccggcagccccagccugcua

SEQ ID NO: 2661682 - RNA, 22 nt, Human
aggccggcagccccagccugcu

SEQ ID NO: 2661683 - RNA, 21 nt, Human
aggccggcagccccagccugc

SEQ ID NO: 2661684 - RNA, 20 nt, Human
aggccggcagccccagccug

SEQ ID NO: 2661685 - RNA, 19 nt, Human
aggccggcagccccagccu

SEQ ID NO: 2661686 - RNA, 18 nt, Human
aggccgcgcguccagcug

SEQ ID NO: 2661687 - RNA, 19 nt, Human
aggccgcgcguccagcugc

SEQ ID NO: 2661688 - RNA, 20 nt, Human
aggccgcgcguccagcugcc

SEQ ID NO: 2661689 - RNA, 16 nt, Human
aggccgcgcccuuucc

SEQ ID NO: 2661690 - RNA, 21 nt, Human
aggcccuggccuccccugcca

SEQ ID NO: 2661691 - RNA, 22 nt, Human
aggcccuggccuccccugccac

SEQ ID NO: 2661692 - RNA, 23 nt, Human
aggcccuggccuccccugccacc

SEQ ID NO: 2661693 - RNA, 16 nt, Human
aggcaccuuuuacugu

SEQ ID NO: 2661694 - RNA, 17 nt, Human
aggcaccuuuuacugug

SEQ ID NO: 2661695 - RNA, 13 nt, Human
aggcaccucuucc

SEQ ID NO: 2661696 - RNA, 14 nt, Human
aggcaccucuuccu

SEQ ID NO: 2661697 - RNA, 20 nt, Human
aggagagggcgcuccucucu

SEQ ID NO: 2661698 - RNA, 16 nt, Human
aggcacgggugguccc

SEQ ID NO: 2661699 - RNA, 17 nt, Human
aggcacggguggucccc

SEQ ID NO: 2661700 - RNA, 15 nt, Human
aggcaugguggccca

SEQ ID NO: 2661701 - RNA, 14 nt, Human
aggcauggcccugg

SEQ ID NO: 2661702 - RNA, 15 nt, Human
aggcauggcccuggg

SEQ ID NO: 2661703 - RNA, 12 nt, Human
aggcauggcccu

SEQ ID NO: 2661704 - RNA, 13 nt, Human
aggcauggcccug

SEQ ID NO: 2661705 - RNA, 16 nt, Human
aggcagauuugagguu

SEQ ID NO: 2661706 - RNA, 20 nt, Human
aggcagauuuuacagagcgc

SEQ ID NO: 2661707 - RNA, 22 nt, Human
aggcagauuuuacagagcgcac

SEQ ID NO: 2661708 - RNA, 15 nt, Human
agaggaauccuggca

SEQ ID NO: 2661709 - RNA, 17 nt, Human
agaggaauccuggcagc

SEQ ID NO: 2661710 - RNA, 21 nt, Human
agaggaauccuggcagcccag

SEQ ID NO: 2661711 - RNA, 18 nt, Human
agaggaauuacgugcucu

SEQ ID NO: 2661712 - RNA, 13 nt, Human
agaggaaugaaaa

SEQ ID NO: 2661713 - RNA, 15 nt, Human
agaggaaugaaaaaa

SEQ ID NO: 2661714 - RNA, 17 nt, Human
agaggaaugaaaaaagc

SEQ ID NO: 2661715 - RNA, 18 nt, Human
agaggaaugaaaaaagcu

SEQ ID NO: 2661716 - RNA, 22 nt, Human
agaggagccuuuuuaaaacaca

SEQ ID NO: 2661717 - RNA, 23 nt, Human
agaggagccuuuuuaaaacacau

SEQ ID NO: 2661718 - RNA, 15 nt, Human
agagagagaggacag

SEQ ID NO: 2661719 - RNA, 15 nt, Human
agagagagagagaga

SEQ ID NO: 2661720 - RNA, 15 nt, Human
agagagagagagagg

SEQ ID NO: 2661721 - RNA, 13 nt, Human
agagagagagagg

SEQ ID NO: 2661722 - RNA, 14 nt, Human
agagagagaggaca

SEQ ID NO: 2661723 - RNA, 13 nt, Human
agagccauacaua

SEQ ID NO: 2661724 - RNA, 15 nt, Human
agagccauacauaaa

SEQ ID NO: 2661725 - RNA, 16 nt, Human
agagccauacauaaaa

SEQ ID NO: 2661726 - RNA, 18 nt, Human
agagccauacauaaaaga

SEQ ID NO: 2661727 - RNA, 19 nt, Human
agagccauacauaaaagaa

SEQ ID NO: 2661728 - RNA, 20 nt, Human
agagccauacauaaaagaaa

SEQ ID NO: 2661729 - RNA, 21 nt, Human
agagccauacauaaaagaaau

SEQ ID NO: 2661730 - RNA, 14 nt, Human
agagcccuugccuc

SEQ ID NO: 2661731 - RNA, 22 nt, Human
agagccgggcacauugagcugu

SEQ ID NO: 2661732 - RNA, 19 nt, Human
agagcccuugccuccccau

SEQ ID NO: 2661733 - RNA, 19 nt, Human
agagccggcccgccucucc

SEQ ID NO: 2661734 - RNA, 21 nt, Human
agagccggcccgccucuccuc

SEQ ID NO: 2661735 - RNA, 15 nt, Human
agaccagauuaaacu

SEQ ID NO: 2661736 - RNA, 18 nt, Human
agaccagauuaaacuuca

SEQ ID NO: 2661737 - RNA, 19 nt, Human
agacagccaaaggcuggcg

SEQ ID NO: 2661738 - RNA, 18 nt, Human
agacagccaaaggcuggc

SEQ ID NO: 2661739 - RNA, 12 nt, Human
agacaaauauuc

SEQ ID NO: 2661740 - RNA, 22 nt, Human
agacaaauauuccuuugcauau

SEQ ID NO: 2661741 - RNA, 21 nt, Human
acuuuccgaaaaauaaagaca

SEQ ID NO: 2661742 - RNA, 16 nt, Human
agaagugaaugcuggg

SEQ ID NO: 2661743 - RNA, 17 nt, Human
agaagugaaugcuggga

SEQ ID NO: 2661744 - RNA, 19 nt, Human
agaagugaaugcugggacu

SEQ ID NO: 2661745 - RNA, 21 nt, Human
agaagugaaugcugggacuca

SEQ ID NO: 2661746 - RNA, 22 nt, Human
agaaugcugcaggacuugagaa

SEQ ID NO: 2661747 - RNA, 21 nt, Human
agaaugacuauauaauuuauu

SEQ ID NO: 2661748 - RNA, 15 nt, Human
agaaugcaaccaagu

SEQ ID NO: 2661749 - RNA, 20 nt, Human
agaaugcaaccaagucacac

SEQ ID NO: 2661750 - RNA, 21 nt, Human
agaauggcgccaccagcucug

SEQ ID NO: 2661751 - RNA, 15 nt, Human
agaaggugccacuuu

SEQ ID NO: 2661752 - RNA, 14 nt, Human
agaagguuuauugu

SEQ ID NO: 2661753 - RNA, 16 nt, Human
agaagguuuauuguua

SEQ ID NO: 2661754 - RNA, 17 nt, Human
agaagguuuauuguuaa

SEQ ID NO: 2661755 - RNA, 18 nt, Human
agaagguuuauuguuaau

SEQ ID NO: 2661756 - RNA, 14 nt, Human
agaaguaacuuacu

SEQ ID NO: 2661757 - RNA, 21 nt, Human
agaaguacugcccuuuugugu

SEQ ID NO: 2661758 - RNA, 20 nt, Human
agaaguaagaggcuaccucu

SEQ ID NO: 2661759 - RNA, 21 nt, Human
agaaguaagaggcuaccucuu

SEQ ID NO: 2661760 - RNA, 14 nt, Human
agaaguauuuuuag

SEQ ID NO: 2661761 - RNA, 15 nt, Human
agaaguauuuuuaga

SEQ ID NO: 2661762 - RNA, 19 nt, Human
agaaguauuuuuagaauaa

SEQ ID NO: 2661763 - RNA, 21 nt, Human
agaaguauuuuuagaauaaga

SEQ ID NO: 2661764 - RNA, 21 nt, Human
agaagagauugugguuucauu

SEQ ID NO: 2661765 - RNA, 15 nt, Human
agauggucauccaga

SEQ ID NO: 2661766 - RNA, 18 nt, Human
agaugguuugagccugag

SEQ ID NO: 2661767 - RNA, 13 nt, Human
agauguaaaaaga

SEQ ID NO: 2661768 - RNA, 13 nt, Human
agauucucaaagg

SEQ ID NO: 2661769 - RNA, 19 nt, Human
agaugguauauuugguacu

SEQ ID NO: 2661770 - RNA, 22 nt, Human
agagugauagucuuuugcuuuu

SEQ ID NO: 2661771 - RNA, 20 nt, Human
agagugauagucuuuugcuu

SEQ ID NO: 2661772 - RNA, 12 nt, Human
agagggggugga

SEQ ID NO: 2661773 - RNA, 19 nt, Human
agaggggguggaggggugu

SEQ ID NO: 2661774 - RNA, 13 nt, Human
agauucuuaauuc

SEQ ID NO: 2661775 - RNA, 15 nt, Human
agcaaaauaaaacau

SEQ ID NO: 2661776 - RNA, 18 nt, Human
agcaaaagaugcuucuca

SEQ ID NO: 2661777 - RNA, 19 nt, Human
agcaaacuaacuugacuuu

SEQ ID NO: 2661778 - RNA, 16 nt, Human
agauucuucuguguuu

SEQ ID NO: 2661779 - RNA, 13 nt, Human
agauucuucugug

SEQ ID NO: 2661780 - RNA, 20 nt, Human
agauucuuucaguucuuugg

SEQ ID NO: 2661781 - RNA, 13 nt, Human
agcaaaugcaaaa

SEQ ID NO: 2661782 - RNA, 14 nt, Human
agcaaaugcaaaaa

SEQ ID NO: 2661783 - RNA, 22 nt, Human
agcaaaugcaaaaacucuuuga

SEQ ID NO: 2661784 - RNA, 19 nt, Human
agcacaauuugcacuaaau

SEQ ID NO: 2661785 - RNA, 15 nt, Human
agcaaucucuucauu

SEQ ID NO: 2661786 - RNA, 18 nt, Human
agcaaucucuucauuauu

SEQ ID NO: 2661787 - RNA, 23 nt, Human
agcaaucucuucauuauucucug

SEQ ID NO: 2661788 - RNA, 15 nt, Human
agcagccucucccca

SEQ ID NO: 2661789 - RNA, 21 nt, Human
agcagccucuccccaggucca

SEQ ID NO: 2661790 - RNA, 18 nt, Human
agcagccucuccccaggu

SEQ ID NO: 2661791 - RNA, 20 nt, Human
agcagccucuccccaggucc

SEQ ID NO: 2661792 - RNA, 21 nt, Human
agcccuccccauggagccagc

SEQ ID NO: 2661793 - RNA, 20 nt, Human
agcccuccccauggagccag

SEQ ID NO: 2661794 - RNA, 19 nt, Human
agcccuccccauggagcca

SEQ ID NO: 2661795 - RNA, 12 nt, Human
agcccuccccau

SEQ ID NO: 2661796 - RNA, 17 nt, Human
agccccacauguccagc

SEQ ID NO: 2661797 - RNA, 12 nt, Human
agcccucccacu

SEQ ID NO: 2661798 - RNA, 13 nt, Human
agcccucccacuu

SEQ ID NO: 2661799 - RNA, 22 nt, Human
agcccucccacuuugcuguucc

SEQ ID NO: 2661800 - RNA, 15 nt, Human
agcccaccccucaac

SEQ ID NO: 2661801 - RNA, 20 nt, Human
agccaagauuuuccucuugu

SEQ ID NO: 2661802 - RNA, 22 nt, Human
agccaagauuuuccucuuguga

SEQ ID NO: 2661803 - RNA, 12 nt, Human
agccaaagaaaa

SEQ ID NO: 2661804 - RNA, 13 nt, Human
agccaaagaaaaa

SEQ ID NO: 2661805 - RNA, 23 nt, Human
aagggaugcaggcuccccugagg

SEQ ID NO: 2661806 - RNA, 16 nt, Human
aagggaugcaggcucc

SEQ ID NO: 2661807 - RNA, 12 nt, Human
aagggauauuuu

SEQ ID NO: 2661808 - RNA, 12 nt, Human
aagggagaagaa

SEQ ID NO: 2661809 - RNA, 13 nt, Human
aagggauaaagaa

SEQ ID NO: 2661810 - RNA, 13 nt, Human
aagguguuugaaa

SEQ ID NO: 2661811 - RNA, 12 nt, Human
aagguguuugaa

SEQ ID NO: 2661812 - RNA, 15 nt, Human
aagguuauaauuuuu

SEQ ID NO: 2661813 - RNA, 14 nt, Human
aagggcauaaagua

SEQ ID NO: 2661814 - RNA, 15 nt, Human
aagggcauaaaguaa

SEQ ID NO: 2661815 - RNA, 21 nt, Human
aagggcauaaaguaaauacau

SEQ ID NO: 2661816 - RNA, 18 nt, Human
aaggucuuuaaaauauug

SEQ ID NO: 2661817 - RNA, 12 nt, Human
aaggucuuucag

SEQ ID NO: 2661818 - RNA, 18 nt, Human
aaggucuuucaguacuuu

SEQ ID NO: 2661819 - RNA, 19 nt, Human
aaggucuuucaguacuuuu

SEQ ID NO: 2661820 - RNA, 20 nt, Human
aaggcagauuuuacagagcg

SEQ ID NO: 2661821 - RNA, 18 nt, Human
aaggcacuucauguaaag

SEQ ID NO: 2661822 - RNA, 12 nt, Human
aaggaccuuaag

SEQ ID NO: 2661823 - RNA, 18 nt, Human
aaggaccuuaagacagag

SEQ ID NO: 2661824 - RNA, 19 nt, Human
aaggaccuuaagacagagu

SEQ ID NO: 2661825 - RNA, 14 nt, Human
aaggacaaagugcc

SEQ ID NO: 2661826 - RNA, 16 nt, Human
aaggacaaagugccaa

SEQ ID NO: 2661827 - RNA, 19 nt, Human
aaggacaaagugccaaaga

SEQ ID NO: 2661828 - RNA, 20 nt, Human
aaggacaaagugccaaagaa

SEQ ID NO: 2661829 - RNA, 18 nt, Human
aagcugcccacuguuucu

SEQ ID NO: 2661830 - RNA, 20 nt, Human
aagcugcccacuguuucucu

SEQ ID NO: 2661831 - RNA, 21 nt, Human
aaggaauuaccaagaauaucc

SEQ ID NO: 2661832 - RNA, 18 nt, Human
aacuguuguagaagacaa

SEQ ID NO: 2661833 - RNA, 19 nt, Human
aacuguuguagaagacaaa

SEQ ID NO: 2661834 - RNA, 18 nt, Human
aagacaguguauguagaa

SEQ ID NO: 2661835 - RNA, 14 nt, Human
aagacaggagacaa

SEQ ID NO: 2661836 - RNA, 18 nt, Human
aagacaggagacaaaaga

SEQ ID NO: 2661837 - RNA, 14 nt, Human
aagagaaguuauuu

SEQ ID NO: 2661838 - RNA, 21 nt, Human
aagagaaguuauuuucuacag

SEQ ID NO: 2661839 - RNA, 21 nt, Human
aagagaaguuguaaaguaugu

SEQ ID NO: 2661840 - RNA, 11 nt, Human
aagagaaugag

SEQ ID NO: 2661841 - RNA, 16 nt, Human
aagagaaugaguccuu

SEQ ID NO: 2661842 - RNA, 11 nt, Human
aagagaacucg

SEQ ID NO: 2661843 - RNA, 20 nt, Human
aagagaacucgcgcucagua

SEQ ID NO: 2661844 - RNA, 17 nt, Human
aagagagaacaggacua

SEQ ID NO: 2661845 - RNA, 13 nt, Human
aagagacacucca

SEQ ID NO: 2661846 - RNA, 14 nt, Human
aagagacaggcagg

SEQ ID NO: 2661847 - RNA, 13 nt, Human
aagcagaggacca

SEQ ID NO: 2661848 - RNA, 15 nt, Human
aagcagaggaccagg

SEQ ID NO: 2661849 - RNA, 18 nt, Human
aagcagaggaccagggcc

SEQ ID NO: 2661850 - RNA, 19 nt, Human
aagcagaggaccagggccu

SEQ ID NO: 2661851 - RNA, 21 nt, Human
aagcagaggaaggagaggaga

SEQ ID NO: 2661852 - RNA, 14 nt, Human
aagcagaguuuuca

SEQ ID NO: 2661853 - RNA, 15 nt, Human
aagcagaguuuucau

SEQ ID NO: 2661854 - RNA, 18 nt, Human
aagauugccccaucuaga

SEQ ID NO: 2661855 - RNA, 16 nt, Human
aagauuuuccucuugu

SEQ ID NO: 2661856 - RNA, 19 nt, Human
aagauuuuccucuugugau

SEQ ID NO: 2661857 - RNA, 20 nt, Human
aagauuuuccucuugugauu

SEQ ID NO: 2661858 - RNA, 12 nt, Human
aagauagacagg

SEQ ID NO: 2661859 - RNA, 13 nt, Human
aagauagacaggu

SEQ ID NO: 2661860 - RNA, 16 nt, Human
aagauagacagguccu

SEQ ID NO: 2661861 - RNA, 17 nt, Human
aagauagacagguccug

SEQ ID NO: 2661862 - RNA, 19 nt, Human
aagauagacagguccugau

SEQ ID NO: 2661863 - RNA, 16 nt, Human
aagauacuuuguauug

SEQ ID NO: 2661864 - RNA, 14 nt, Human
aagauacuuuguau

SEQ ID NO: 2661865 - RNA, 13 nt, Human
aagauacuuugua

SEQ ID NO: 2661866 - RNA, 12 nt, Human
aagauacuuugu

SEQ ID NO: 2661867 - RNA, 14 nt, Human
aagauugauaucua

SEQ ID NO: 2661868 - RNA, 16 nt, Human
aagauugauaucuaua

SEQ ID NO: 2661869 - RNA, 20 nt, Human
aagauugauaucuauaaaau

SEQ ID NO: 2661870 - RNA, 21 nt, Human
aagauugauaucuauaaaaua

SEQ ID NO: 2661871 - RNA, 20 nt, Human
aagauucuucuguguuuaua

SEQ ID NO: 2661872 - RNA, 22 nt, Human
aauaguuuauuuuaaaacaaua

SEQ ID NO: 2661873 - RNA, 20 nt, Human
aauaguuuauuuuaaaacaa

SEQ ID NO: 2661874 - RNA, 15 nt, Human
aauagaaauuuugua

SEQ ID NO: 2661875 - RNA, 16 nt, Human
aauagaaauuuuguaa

SEQ ID NO: 2661876 - RNA, 17 nt, Human
aauagaaauuuuguaag

SEQ ID NO: 2661877 - RNA, 18 nt, Human
aauagaaauuuuguaaga

SEQ ID NO: 2661878 - RNA, 19 nt, Human
aauagaaauuuuguaagaa

SEQ ID NO: 2661879 - RNA, 12 nt, Human
aauagaaacaag

SEQ ID NO: 2661880 - RNA, 16 nt, Human
aauacuguucuuucca

SEQ ID NO: 2661881 - RNA, 11 nt, Human
aauauaaaaaa

SEQ ID NO: 2661882 - RNA, 12 nt, Human
aauauaaaauua

SEQ ID NO: 2661883 - RNA, 15 nt, Human
aauauaaaauuauga

SEQ ID NO: 2661884 - RNA, 14 nt, Human
aauauaaacaaaga

SEQ ID NO: 2661885 - RNA, 21 nt, Human
aauauaaacaaagauucauga

SEQ ID NO: 2661886 - RNA, 22 nt, Human
aauauaaacaaagauucaugau

SEQ ID NO: 2661887 - RNA, 23 nt, Human
aauauaaacaaagauucaugauu

SEQ ID NO: 2661888 - RNA, 12 nt, Human
aauacuuccaga

SEQ ID NO: 2661889 - RNA, 14 nt, Human
aauacuuccagaag

SEQ ID NO: 2661890 - RNA, 15 nt, Human
aauacuuccagaagu

SEQ ID NO: 2661891 - RNA, 22 nt, Human
aauacuugaaccauaaaauguc

SEQ ID NO: 2661892 - RNA, 19 nt, Human
aauacuugaaccauaaaau

SEQ ID NO: 2661893 - RNA, 17 nt, Human
aauacuugaaccauaaa

SEQ ID NO: 2661894 - RNA, 14 nt, Human
aauacuugaaccau

SEQ ID NO: 2661895 - RNA, 15 nt, Human
aauauagcugagacu

SEQ ID NO: 2661896 - RNA, 14 nt, Human
aauauaacacauuu

SEQ ID NO: 2661897 - RNA, 15 nt, Human
aauauaacacauuuu

SEQ ID NO: 2661898 - RNA, 18 nt, Human
aaguggggugcugggagg

SEQ ID NO: 2661899 - RNA, 11 nt, Human
aagugggccca

SEQ ID NO: 2661900 - RNA, 13 nt, Human
aagugggcccacc

SEQ ID NO: 2661901 - RNA, 15 nt, Human
aagugggcccacccg

SEQ ID NO: 2661902 - RNA, 19 nt, Human
aagugggcccacccggugg

SEQ ID NO: 2661903 - RNA, 11 nt, Human
aaguucuuaug

SEQ ID NO: 2661904 - RNA, 19 nt, Human
aaguucuuaugaggagggg

SEQ ID NO: 2661905 - RNA, 20 nt, Human
aaguucuuaugaggagggga

SEQ ID NO: 2661906 - RNA, 22 nt, Human
aaguucuuaugaggaggggagg

SEQ ID NO: 2661907 - RNA, 20 nt, Human
aaguauaaaauaguaugaaa

SEQ ID NO: 2661908 - RNA, 22 nt, Human
aaguauaaaauaguaugaaaau

SEQ ID NO: 2661909 - RNA, 14 nt, Human
aaguaguucuguau

SEQ ID NO: 2661910 - RNA, 23 nt, Human
aaguaguucuguauuugaaagug

SEQ ID NO: 2661911 - RNA, 22 nt, Human
aaguaguucuguauuugaaagu

SEQ ID NO: 2661912 - RNA, 21 nt, Human
aaguaguucuguauuugaaag

SEQ ID NO: 2661913 - RNA, 20 nt, Human
aaguaguucuguauuugaaa

SEQ ID NO: 2661914 - RNA, 19 nt, Human
aaguaguucuguauuugaa

SEQ ID NO: 2661915 - RNA, 16 nt, Human
aaguaguucuguauuu

SEQ ID NO: 2661916 - RNA, 18 nt, Human
aagugcuauuacgaaguu

SEQ ID NO: 2661917 - RNA, 13 nt, Human
aagugcuauuacg

SEQ ID NO: 2661918 - RNA, 15 nt, Human
aauaaacccucagag

SEQ ID NO: 2661919 - RNA, 16 nt, Human
aauaaaauuuguugca

SEQ ID NO: 2661920 - RNA, 17 nt, Human
aauaaaauuuguugcau

SEQ ID NO: 2661921 - RNA, 12 nt, Human
aauaaaauuuaa

SEQ ID NO: 2661922 - RNA, 13 nt, Human
aauaaaauuuaaa

SEQ ID NO: 2661923 - RNA, 11 nt, Human
aauaaaauuug

SEQ ID NO: 2661924 - RNA, 12 nt, Human
aauaaaauuugu

SEQ ID NO: 2661925 - RNA, 13 nt, Human
aauaaaauuuguu

SEQ ID NO: 2661926 - RNA, 14 nt, Human
aauaaaauuuguug

SEQ ID NO: 2661927 - RNA, 15 nt, Human
aaguugaaaaucaua

SEQ ID NO: 2661928 - RNA, 9 nt, Human
aaguucuua

SEQ ID NO: 2661929 - RNA, 22 nt, Human
aaguugcagauguuagauauuu

SEQ ID NO: 2661930 - RNA, 15 nt, Human
aauaauauauuuucu

SEQ ID NO: 2661931 - RNA, 17 nt, Human
aauaauauauuuucugu

SEQ ID NO: 2661932 - RNA, 19 nt, Human
aauaauauauuuucuguuu

SEQ ID NO: 2661933 - RNA, 16 nt, Human
aauaauaaaugcccuc

SEQ ID NO: 2661934 - RNA, 13 nt, Human
aauaauagacugu

SEQ ID NO: 2661935 - RNA, 14 nt, Human
aauaauagacugua

SEQ ID NO: 2661936 - RNA, 12 nt, Human
aauaaagcuugu

SEQ ID NO: 2661937 - RNA, 13 nt, Human
aaucauuuucauu

SEQ ID NO: 2661938 - RNA, 17 nt, Human
aaucauuuucauuccua

SEQ ID NO: 2661939 - RNA, 18 nt, Human
aaucauuuucauuccuaa

SEQ ID NO: 2661940 - RNA, 14 nt, Human
aaucauuuguuuac

SEQ ID NO: 2661941 - RNA, 16 nt, Human
aaucauuuguuuacau

SEQ ID NO: 2661942 - RNA, 22 nt, Human
aaucauuuguuuacauuugaug

SEQ ID NO: 2661943 - RNA, 16 nt, Human
aaugauacugauggug

SEQ ID NO: 2661944 - RNA, 15 nt, Human
aaugaugugcaaaac

SEQ ID NO: 2661945 - RNA, 17 nt, Human
aaugaugugcaaaaccu

SEQ ID NO: 2661946 - RNA, 14 nt, Human
aaucuggagaccag

SEQ ID NO: 2661947 - RNA, 16 nt, Human
aaugcuccccacagcg

SEQ ID NO: 2661948 - RNA, 20 nt, Human
aaugcuccccacagcguccc

SEQ ID NO: 2661949 - RNA, 14 nt, Human
aaugcucaaagaaa

SEQ ID NO: 2661950 - RNA, 14 nt, Human
aaugggaccugugg

SEQ ID NO: 2661951 - RNA, 23 nt, Human
aauggucacguuuggugcuucuc

SEQ ID NO: 2661952 - RNA, 22 nt, Human
aauggucacguuuggugcuucu

SEQ ID NO: 2661953 - RNA, 15 nt, Human
aauggguuacuugau

SEQ ID NO: 2661954 - RNA, 16 nt, Human
aaugcuacaauuuuaa

SEQ ID NO: 2661955 - RNA, 20 nt, Human
aaugcuacaauuuuaagagg

SEQ ID NO: 2661956 - RNA, 15 nt, Human
aaugcuacaugugag

SEQ ID NO: 2661957 - RNA, 11 nt, Human
aaugcccucuu

SEQ ID NO: 2661958 - RNA, 16 nt, Human
aacgaaauaucaaagu

SEQ ID NO: 2661959 - RNA, 16 nt, Human
aacgaagaguucccuu

SEQ ID NO: 2661960 - RNA, 23 nt, Human
aacgaagaguucccuugaaacuu

SEQ ID NO: 2661961 - RNA, 18 nt, Human
aacgaaccuuggccuggg

SEQ ID NO: 2661962 - RNA, 15 nt, Human
aacgaaccuuggccu

SEQ ID NO: 2661963 - RNA, 21 nt, Human
aacgaaccuuggccugggccg

SEQ ID NO: 2661964 - RNA, 17 nt, Human
aacgaucacaaaugacu

SEQ ID NO: 2661965 - RNA, 22 nt, Human
aacgaucacaaaugacuuuauu

SEQ ID NO: 2661966 - RNA, 18 nt, Human
aacgccuccccugcccca

SEQ ID NO: 2661967 - RNA, 20 nt, Human
aacugaagcagccucucccc

SEQ ID NO: 2661968 - RNA, 21 nt, Human
aacugaagcagccucucccca

SEQ ID NO: 2661969 - RNA, 20 nt, Human
aacggugcugugagggaggg

SEQ ID NO: 2661970 - RNA, 17 nt, Human
aacgcuaaagagcccuu

SEQ ID NO: 2661971 - RNA, 21 nt, Human
aacgcuaaagagcccuugccu

SEQ ID NO: 2661972 - RNA, 22 nt, Human
aacgcuaaagagcccuugccuc

SEQ ID NO: 2661973 - RNA, 19 nt, Human
aacguccucuuuaguuuuu

SEQ ID NO: 2661974 - RNA, 13 nt, Human
aacucaaauacac

SEQ ID NO: 2661975 - RNA, 17 nt, Human
aacucaaacucuuaaaa

SEQ ID NO: 2661976 - RNA, 16 nt, Human
aaccaggcaccucuuc

SEQ ID NO: 2661977 - RNA, 18 nt, Human
aaccaggcaccucuuccu

SEQ ID NO: 2661978 - RNA, 18 nt, Human
aacaugcuggugaauauu

SEQ ID NO: 2661979 - RNA, 22 nt, Human
aacaugcuggugaauauuuuca

SEQ ID NO: 2661980 - RNA, 23 nt, Human
aacaucucaauaaagugcuuuaa

SEQ ID NO: 2661981 - RNA, 14 nt, Human
aaccauaaauucaa

SEQ ID NO: 2661982 - RNA, 18 nt, Human
aaccauaaaauguccagu

SEQ ID NO: 2661983 - RNA, 17 nt, Human
aaccgaguagaaaaugu

SEQ ID NO: 2661984 - RNA, 19 nt, Human
aaccgaguagaaaauguga

SEQ ID NO: 2661985 - RNA, 23 nt, Human
aaccgaguagaaaaugugacccu

SEQ ID NO: 2661986 - RNA, 12 nt, Human
aaccgcacagcu

SEQ ID NO: 2661987 - RNA, 13 nt, Human
aaccgcacagcuc

SEQ ID NO: 2661988 - RNA, 14 nt, Human
aaccgcacagcuca

SEQ ID NO: 2661989 - RNA, 15 nt, Human
aaccgcacagcucag

SEQ ID NO: 2661990 - RNA, 23 nt, Human
aacacuagggccuuggaaauucc

SEQ ID NO: 2661991 - RNA, 20 nt, Human
aacagcaaaugcaaaaacuc

SEQ ID NO: 2661992 - RNA, 20 nt, Human
aaaucugagggaaauguuuu

SEQ ID NO: 2661993 - RNA, 21 nt, Human
aaaucugagggaaauguuuug

SEQ ID NO: 2661994 - RNA, 22 nt, Human
aaaucugagggaaauguuuugu

SEQ ID NO: 2661995 - RNA, 18 nt, Human
aaaugcucaaagaaaucu

SEQ ID NO: 2661996 - RNA, 13 nt, Human
aaaugcuccccac

SEQ ID NO: 2661997 - RNA, 11 nt, Human
aacaaaauuug

SEQ ID NO: 2661998 - RNA, 20 nt, Human
aacaaaauuugacuaauuuu

SEQ ID NO: 2661999 - RNA, 24 nt, Human
aacaaaauuugacuaauuuuacau

SEQ ID NO: 2662000 - RNA, 19 nt, Human
aaauugaguugcacuuauu

SEQ ID NO: 2662001 - RNA, 19 nt, Human
aacaccucugcacaagcug

SEQ ID NO: 2662002 - RNA, 17 nt, Human
aacacuaacucaccagc

SEQ ID NO: 2662003 - RNA, 18 nt, Human
aacacuaacucaccagcc

SEQ ID NO: 2662004 - RNA, 19 nt, Human
aacacuaacucaccagccc

SEQ ID NO: 2662005 - RNA, 19 nt, Human
aacaaauaaaaaagcucuu

SEQ ID NO: 2662006 - RNA, 19 nt, Human
aaaauugaacaaagacuac

SEQ ID NO: 2662007 - RNA, 21 nt, Human
aaacaggcaguuggccagaga

SEQ ID NO: 2662008 - RNA, 11 nt, Human
aaacaggcagu

SEQ ID NO: 2662009 - RNA, 17 nt, Human
aaaaucccccagcacuu

SEQ ID NO: 2662010 - RNA, 20 nt, Human
aaaauuaagcaaauguuaaa

SEQ ID NO: 2662011 - RNA, 18 nt, Human
aaaauuaagguguuugaa

SEQ ID NO: 2662012 - RNA, 17 nt, Human
aaaauuaagguguuuga

SEQ ID NO: 2662013 - RNA, 15 nt, Human
aaaauuagccaagug

SEQ ID NO: 2662014 - RNA, 20 nt, Human
aaaauuaagguguuugaaaa

SEQ ID NO: 2662015 - RNA, 18 nt, Human
aaaauuagccgggcgugg

SEQ ID NO: 2662016 - RNA, 14 nt, Human
aaaauccaaaaaga

SEQ ID NO: 2662017 - RNA, 15 nt, Human
aaaauccaaaaagaa

SEQ ID NO: 2662018 - RNA, 16 nt, Human
aaaaguuuuuguuugg

SEQ ID NO: 2662019 - RNA, 13 nt, Human
aaagaaaaugaaa

SEQ ID NO: 2662020 - RNA, 18 nt, Human
aaacugaagcagccucuc

SEQ ID NO: 2662021 - RNA, 21 nt, Human
aaacugaagcagccucucccc

SEQ ID NO: 2662022 - RNA, 12 nt, Human
aaagaaaauuga

SEQ ID NO: 2662023 - RNA, 13 nt, Human
aaagaaaauugag

SEQ ID NO: 2662024 - RNA, 14 nt, Human
aaagaggcugcccc

SEQ ID NO: 2662025 - RNA, 18 nt, Human
aaagaggcugccccucuc

SEQ ID NO: 2662026 - RNA, 20 nt, Human
aaagaggcugccccucucac

SEQ ID NO: 2662027 - RNA, 11 nt, Human
aaaccuagguc

SEQ ID NO: 2662028 - RNA, 18 nt, Human
aaaccuacccucagugag

SEQ ID NO: 2662029 - RNA, 17 nt, Human
aaaccccaaacagugac

SEQ ID NO: 2662030 - RNA, 17 nt, Human
aaaccccaucucuacaa

SEQ ID NO: 2662031 - RNA, 15 nt, Human
aaagagggcuuccuc

SEQ ID NO: 2662032 - RNA, 19 nt, Human
aaagagggcuuccucuaga

SEQ ID NO: 2662033 - RNA, 22 nt, Human
aaagaggcugccccucucacca

SEQ ID NO: 2662034 - RNA, 23 nt, Human
aaagaggcugccccucucaccaa

SEQ ID NO: 2662035 - RNA, 11 nt, Human
aaagcauuuuu

SEQ ID NO: 2662036 - RNA, 13 nt, Human
aaagcauuuuuca

SEQ ID NO: 2662037 - RNA, 16 nt, Human
aaagcauuuuucaaua

SEQ ID NO: 2662038 - RNA, 21 nt, Human
aaaggcaggccuauuucauca

SEQ ID NO: 2662039 - RNA, 14 nt, Human
aaagugcauuuuug

SEQ ID NO: 2662040 - RNA, 13 nt, Human
aaagugccaaaga

SEQ ID NO: 2662041 - RNA, 14 nt, Human
aaagugccaaagaa

SEQ ID NO: 2662042 - RNA, 15 nt, Human
aaagugccaaagaaa

SEQ ID NO: 2662043 - RNA, 21 nt, Human
aaagugccaaagaaagugguc

SEQ ID NO: 2662044 - RNA, 17 nt, Human
aaagugccucaagagga

SEQ ID NO: 2662045 - RNA, 22 nt, Human
aaagugccucaagaggaaugaa

SEQ ID NO: 2662046 - RNA, 12 nt, Human
aaaguauuuucu

SEQ ID NO: 2662047 - RNA, 18 nt, Human
aaaggcugugcugcccug

SEQ ID NO: 2662048 - RNA, 23 nt, Human
aaaggcugugcugcccugaagaa

SEQ ID NO: 2662049 - RNA, 15 nt, Human
aaaggcugugcugcc

SEQ ID NO: 2662050 - RNA, 13 nt, Human
aaagucagagaca

SEQ ID NO: 2662051 - RNA, 15 nt, Human
aaagucagagacaga

SEQ ID NO: 2662052 - RNA, 18 nt, Human
aaagucagagacagauac

SEQ ID NO: 2662053 - RNA, 16 nt, Human
aaauaaaacauagcaa

SEQ ID NO: 2662054 - RNA, 15 nt, Human
aaauaaaaauggaua

SEQ ID NO: 2662055 - RNA, 14 nt, Human
aaagugccuuugca

SEQ ID NO: 2662056 - RNA, 12 nt, Human
aaagugccuuug

SEQ ID NO: 2662057 - RNA, 18 nt, Human
aaauaaaauuuguugcau

SEQ ID NO: 2662058 - RNA, 19 nt, Human
aaauaaaauuuguugcaua

SEQ ID NO: 2662059 - RNA, 22 nt, Human
aaauaaaccaaaggaaaauguc

SEQ ID NO: 2662060 - RNA, 13 nt, Human
aaauaaaccacug

SEQ ID NO: 2662061 - RNA, 14 nt, Human
aaauaaaccacugu

SEQ ID NO: 2662062 - RNA, 19 nt, Human
acagaacuugaauguguca

SEQ ID NO: 2662063 - RNA, 20 nt, Human
acagaacuugaaugugucag

SEQ ID NO: 2662064 - RNA, 17 nt, Human
acagaacuugaaugugu

SEQ ID NO: 2662065 - RNA, 19 nt, Human
aauuuucauuuugcacuga

SEQ ID NO: 2662066 - RNA, 13 nt, Human
acaaaaugaagcu

SEQ ID NO: 2662067 - RNA, 21 nt, Human
acaaagaaauccggagaagcu

SEQ ID NO: 2662068 - RNA, 22 nt, Human
acaaagaaauccggagaagcug

SEQ ID NO: 2662069 - RNA, 15 nt, Human
aauuuucaaguaauu

SEQ ID NO: 2662070 - RNA, 19 nt, Human
aauuuucaaguaauuguga

SEQ ID NO: 2662071 - RNA, 18 nt, Human
aauuuucacuuuuggcaa

SEQ ID NO: 2662072 - RNA, 21 nt, Human
aauuuucacuuuuggcaauga

SEQ ID NO: 2662073 - RNA, 22 nt, Human
aauuuucaacugucuuccucaa

SEQ ID NO: 2662074 - RNA, 12 nt, Human
aauuuucagcau

SEQ ID NO: 2662075 - RNA, 19 nt, Human
aauugguacuuuuaaaaac

SEQ ID NO: 2662076 - RNA, 23 nt, Human
aauugguacuuuuaaaaacauaa

SEQ ID NO: 2662077 - RNA, 13 nt, Human
aauuggggcacuu

SEQ ID NO: 2662078 - RNA, 20 nt, Human
aauugguaaaacucacugug

SEQ ID NO: 2662079 - RNA, 21 nt, Human
aauugguaaaacucacuguga

SEQ ID NO: 2662080 - RNA, 19 nt, Human
aauuguauuuuuguuguug

SEQ ID NO: 2662081 - RNA, 14 nt, Human
aauuguauuuuugu

SEQ ID NO: 2662082 - RNA, 12 nt, Human
aauuguauuuuu

SEQ ID NO: 2662083 - RNA, 11 nt, Human
aauuguauuuu

SEQ ID NO: 2662084 - RNA, 14 nt, Human
aauuguauauugua

SEQ ID NO: 2662085 - RNA, 21 nt, Human
aauuguaaaguaaaagcuaua

SEQ ID NO: 2662086 - RNA, 11 nt, Human
aauuguggcua

SEQ ID NO: 2662087 - RNA, 18 nt, Human
aauuguggcuauccugau

SEQ ID NO: 2662088 - RNA, 19 nt, Human
aauuguggcuauccugauu

SEQ ID NO: 2662089 - RNA, 12 nt, Human
aauugugaaaaa

SEQ ID NO: 2662090 - RNA, 19 nt, Human
aauugucuuuggugcuuuu

SEQ ID NO: 2662091 - RNA, 19 nt, Human
aauugucacuuuuuaugcu

SEQ ID NO: 2662092 - RNA, 14 nt, Human
aauuuauuuccacu

SEQ ID NO: 2662093 - RNA, 20 nt, Human
aauuuauuuccacuaaaaau

SEQ ID NO: 2662094 - RNA, 21 nt, Human
aauuuauuuccacuaaaaaua

SEQ ID NO: 2662095 - RNA, 22 nt, Human
aauuucacuacuagauugacua

SEQ ID NO: 2662096 - RNA, 14 nt, Human
aauuuccuuuuuga

SEQ ID NO: 2662097 - RNA, 15 nt, Human
aauuuccuuuuugac

SEQ ID NO: 2662098 - RNA, 17 nt, Human
aauuuccuuuuugacac

SEQ ID NO: 2662099 - RNA, 18 nt, Human
aauuuccuuuuugacacu

SEQ ID NO: 2662100 - RNA, 19 nt, Human
aauuuccuuuuugacacug

SEQ ID NO: 2662101 - RNA, 20 nt, Human
aauuuccuuuuugacacuga

SEQ ID NO: 2662102 - RNA, 21 nt, Human
aauuuccuuuuugacacugaa

SEQ ID NO: 2662103 - RNA, 22 nt, Human
aauuuccuuuuugacacugaaa

SEQ ID NO: 2662104 - RNA, 12 nt, Human
aauuucagggug

SEQ ID NO: 2662105 - RNA, 16 nt, Human
aauuucagggugcagc

SEQ ID NO: 2662106 - RNA, 18 nt, Human
acagcugcaauucccugg

SEQ ID NO: 2662107 - RNA, 19 nt, Human
acagcugcaauucccugga

SEQ ID NO: 2662108 - RNA, 19 nt, Human
acagugcagagccuucuca

SEQ ID NO: 2662109 - RNA, 20 nt, Human
acagugcagagccuucucag

SEQ ID NO: 2662110 - RNA, 21 nt, Human
acagugcagagccuucucaga

SEQ ID NO: 2662111 - RNA, 22 nt, Human
acagugcagagccuucucagaa

SEQ ID NO: 2662112 - RNA, 18 nt, Human
acagugguuuuauacuga

SEQ ID NO: 2662113 - RNA, 17 nt, Human
acagugguggcaacauu

SEQ ID NO: 2662114 - RNA, 21 nt, Human
acagugguggcaacauucauu

SEQ ID NO: 2662115 - RNA, 23 nt, Human
acagugguggcaacauucauugc

SEQ ID NO: 2662116 - RNA, 12 nt, Human
acaguguaugua

SEQ ID NO: 2662117 - RNA, 13 nt, Human
acaguguauguag

SEQ ID NO: 2662118 - RNA, 19 nt, Human
acaguguauguagaagcau

SEQ ID NO: 2662119 - RNA, 15 nt, Human
acagugucccccagg

SEQ ID NO: 2662120 - RNA, 16 nt, Human
acagugucccccaggu

SEQ ID NO: 2662121 - RNA, 24 nt, Human
acagugucccccagguuccgaaga

SEQ ID NO: 2662122 - RNA, 22 nt, Human
acagugguuuuauacugaagga

SEQ ID NO: 2662123 - RNA, 20 nt, Human
acagugguuuuauacugaag

SEQ ID NO: 2662124 - RNA, 16 nt, Human
acauccgcgugugccu

SEQ ID NO: 2662125 - RNA, 17 nt, Human
acauccgcgugugccug

SEQ ID NO: 2662126 - RNA, 21 nt, Human
acauccgcgugugccugugug

SEQ ID NO: 2662127 - RNA, 22 nt, Human
acauccgcgugugccugugugc

SEQ ID NO: 2662128 - RNA, 23 nt, Human
acauccgcgugugccugugugcg

SEQ ID NO: 2662129 - RNA, 13 nt, Human
acauccuccuccc

SEQ ID NO: 2662130 - RNA, 15 nt, Human
acauccuccucccac

SEQ ID NO: 2662131 - RNA, 19 nt, Human
acaugccacaucaaaccuu

SEQ ID NO: 2662132 - RNA, 22 nt, Human
acaugccacaucaaaccuuuga

SEQ ID NO: 2662133 - RNA, 12 nt, Human
acaugcccccug

SEQ ID NO: 2662134 - RNA, 21 nt, Human
acauacaaaugcaucuuugau

SEQ ID NO: 2662135 - RNA, 11 nt, Human
acauacaaaug

SEQ ID NO: 2662136 - RNA, 15 nt, Human
acauaagcuuccauu

SEQ ID NO: 2662137 - RNA, 17 nt, Human
acauaagcuuccauuuu

SEQ ID NO: 2662138 - RNA, 18 nt, Human
acauaagcuuccauuuua

SEQ ID NO: 2662139 - RNA, 18 nt, Human
accaccccggcccccugc

SEQ ID NO: 2662140 - RNA, 20 nt, Human
accaccccggcccccugccc

SEQ ID NO: 2662141 - RNA, 13 nt, Human
accaccccuacca

SEQ ID NO: 2662142 - RNA, 14 nt, Human
accaccccuaccac

SEQ ID NO: 2662143 - RNA, 12 nt, Human
accacccugagc

SEQ ID NO: 2662144 - RNA, 13 nt, Human
accacccugagcc

SEQ ID NO: 2662145 - RNA, 14 nt, Human
accacccugagccg

SEQ ID NO: 2662146 - RNA, 15 nt, Human
accaagaaagcucac

SEQ ID NO: 2662147 - RNA, 12 nt, Human
acauuucucuga

SEQ ID NO: 2662148 - RNA, 18 nt, Human
acauuuccuuacagaacu

SEQ ID NO: 2662149 - RNA, 12 nt, Human
acauuucuauaa

SEQ ID NO: 2662150 - RNA, 15 nt, Human
acauuucuauaaaua

SEQ ID NO: 2662151 - RNA, 16 nt, Human
accagccccacugcca

SEQ ID NO: 2662152 - RNA, 17 nt, Human
accagccccacugccag

SEQ ID NO: 2662153 - RNA, 23 nt, Human
accagccccacugccagcagcag

SEQ ID NO: 2662154 - RNA, 18 nt, Human
accagccccacugccagc

SEQ ID NO: 2662155 - RNA, 20 nt, Human
accagccccacugccagcag

SEQ ID NO: 2662156 - RNA, 21 nt, Human
accagccccacugccagcagc

SEQ ID NO: 2662157 - RNA, 22 nt, Human
accagccccacugccagcagca

SEQ ID NO: 2662158 - RNA, 20 nt, Human
acauuuagcugugcucagaa

SEQ ID NO: 2662159 - RNA, 18 nt, Human
acccaugcaagcagagga

SEQ ID NO: 2662160 - RNA, 22 nt, Human
acccaugcaagcagaggaccag

SEQ ID NO: 2662161 - RNA, 13 nt, Human
accaucaauccug

SEQ ID NO: 2662162 - RNA, 16 nt, Human
accaucaauccugauu

SEQ ID NO: 2662163 - RNA, 19 nt, Human
acuaauauuuuaugugaga

SEQ ID NO: 2662164 - RNA, 15 nt, Human
acuaacucaaauaca

SEQ ID NO: 2662165 - RNA, 18 nt, Human
acuaacucaaauacacau

SEQ ID NO: 2662166 - RNA, 22 nt, Human
acuaacucaaauacacauuugc

SEQ ID NO: 2662167 - RNA, 22 nt, Human
acuaacucaccagccccacugc

SEQ ID NO: 2662168 - RNA, 20 nt, Human
acguggccauguaugaagcc

SEQ ID NO: 2662169 - RNA, 22 nt, Human
acuaacgaaauaucaaagucau

SEQ ID NO: 2662170 - RNA, 19 nt, Human
acggacacucaaaagcugg

SEQ ID NO: 2662171 - RNA, 16 nt, Human
acggaagagccuugcg

SEQ ID NO: 2662172 - RNA, 15 nt, Human
acggaagagccuugc

SEQ ID NO: 2662173 - RNA, 23 nt, Human
acuauugugcucagagacacugu

SEQ ID NO: 2662174 - RNA, 23 nt, Human
acuaggcccccacuugccucuuc

SEQ ID NO: 2662175 - RNA, 22 nt, Human
acuaggcccccacuugccucuu

SEQ ID NO: 2662176 - RNA, 17 nt, Human
acuagggaagauaauau

SEQ ID NO: 2662177 - RNA, 15 nt, Human
acuaaugcaaacugg

SEQ ID NO: 2662178 - RNA, 15 nt, Human
accugccaggcaggg

SEQ ID NO: 2662179 - RNA, 18 nt, Human
accugccaggcaggggug

SEQ ID NO: 2662180 - RNA, 20 nt, Human
accugccaggcagggguggg

SEQ ID NO: 2662181 - RNA, 14 nt, Human
accugcccucaagg

SEQ ID NO: 2662182 - RNA, 15 nt, Human
accugcccucaaggg

SEQ ID NO: 2662183 - RNA, 17 nt, Human
accugcccucaagggug

SEQ ID NO: 2662184 - RNA, 12 nt, Human
accucagggcuc

SEQ ID NO: 2662185 - RNA, 13 nt, Human
accucagggcucc

SEQ ID NO: 2662186 - RNA, 15 nt, Human
accucagggcuccca

SEQ ID NO: 2662187 - RNA, 16 nt, Human
accucagggcucccag

SEQ ID NO: 2662188 - RNA, 17 nt, Human
accucagggcucccagg

SEQ ID NO: 2662189 - RNA, 20 nt, Human
accucagggcucccaggggu

SEQ ID NO: 2662190 - RNA, 21 nt, Human
accgugaagauacuuuguauu

SEQ ID NO: 2662191 - RNA, 20 nt, Human
accgugaagauacuuuguau

SEQ ID NO: 2662192 - RNA, 19 nt, Human
accgugaagauacuuugua

SEQ ID NO: 2662193 - RNA, 18 nt, Human
accgugaagauacuuugu

SEQ ID NO: 2662194 - RNA, 18 nt, Human
accucaguuauuacaugu

SEQ ID NO: 2662195 - RNA, 22 nt, Human
accucaguuauuacauguaauu

SEQ ID NO: 2662196 - RNA, 18 nt, Human
accucaguucauuguggu

SEQ ID NO: 2662197 - RNA, 18 nt, Human
accucaggugagaagcag

SEQ ID NO: 2662198 - RNA, 18 nt, Human
accccaagccagcccggc

SEQ ID NO: 2662199 - RNA, 13 nt, Human
accccaagagaac

SEQ ID NO: 2662200 - RNA, 16 nt, Human
accccaagagaacucg

SEQ ID NO: 2662201 - RNA, 18 nt, Human
accccaagagaacucgcg

SEQ ID NO: 2662202 - RNA, 21 nt, Human
accccaagccagcccggccgc

SEQ ID NO: 2662203 - RNA, 24 nt, Human
accggagugucuggaauuguggcu

SEQ ID NO: 2662204 - RNA, 14 nt, Human
acccuuauaaaauc

SEQ ID NO: 2662205 - RNA, 15 nt, Human
acccuuauaaaaucc

SEQ ID NO: 2662206 - RNA, 22 nt, Human
acccuuacuggcuuaccuccuc

SEQ ID NO: 2662207 - RNA, 12 nt, Human
accggcaggugc

SEQ ID NO: 2662208 - RNA, 23 nt, Human
accggcggaccccagccauccag

SEQ ID NO: 2662209 - RNA, 18 nt, Human
accgguccagcuggccug

SEQ ID NO: 2662210 - RNA, 23 nt, Human
accgguccagcuggccuggacag

SEQ ID NO: 2662211 - RNA, 14 nt, Human
accgugaagauacu

SEQ ID NO: 2662212 - RNA, 14 nt, Human
accgguccagcugg

SEQ ID NO: 2662213 - RNA, 21 nt, Human
accgggucuugauucagucac

SEQ ID NO: 2662214 - RNA, 23 nt, Human
accgggucuugauucagucacau

SEQ ID NO: 2662215 - RNA, 15 nt, Human
accgguccagcuggc

SEQ ID NO: 2662216 - RNA, 16 nt, Human
accgguccagcuggcc

SEQ ID NO: 2662217 - RNA, 17 nt, Human
accgguccagcuggccu

SEQ ID NO: 2662218 - RNA, 13 nt, Human
acugacauuucuu

SEQ ID NO: 2662219 - RNA, 15 nt, Human
acugacauuucuucu

SEQ ID NO: 2662220 - RNA, 20 nt, Human
acugaucuuuguauauuaca

SEQ ID NO: 2662221 - RNA, 23 nt, Human
acugauggaauuuuuuuguacga

SEQ ID NO: 2662222 - RNA, 22 nt, Human
acugauggaauuuuuuuguacg

SEQ ID NO: 2662223 - RNA, 21 nt, Human
acugauggaauuuuuuuguac

SEQ ID NO: 2662224 - RNA, 12 nt, Human
acugauggaauu

SEQ ID NO: 2662225 - RNA, 21 nt, Human
acucuacuuaauccaaugggu

SEQ ID NO: 2662226 - RNA, 19 nt, Human
acucuacuuaauccaaugg

SEQ ID NO: 2662227 - RNA, 18 nt, Human
acucuaagucauguaugu

SEQ ID NO: 2662228 - RNA, 19 nt, Human
acucuaagucauguauguu

SEQ ID NO: 2662229 - RNA, 20 nt, Human
acucuaagucauguauguuu

SEQ ID NO: 2662230 - RNA, 22 nt, Human
acucuaagucauguauguuucu

SEQ ID NO: 2662231 - RNA, 23 nt, Human
acucuaagucauguauguuucuc

SEQ ID NO: 2662232 - RNA, 15 nt, Human
acugcccggcagggu

SEQ ID NO: 2662233 - RNA, 18 nt, Human
acugccaggccagccucc

SEQ ID NO: 2662234 - RNA, 19 nt, Human
acugccaggccagccuccg

SEQ ID NO: 2662235 - RNA, 23 nt, Human
acugccaggccagccuccgagag

SEQ ID NO: 2662236 - RNA, 22 nt, Human
acugcccggcaggguccuagaa

SEQ ID NO: 2662237 - RNA, 15 nt, Human
acuuaaagaaguauu

SEQ ID NO: 2662238 - RNA, 22 nt, Human
acuuaaagaaguauuuuuagaa

SEQ ID NO: 2662239 - RNA, 12 nt, Human
acuucugccugg

SEQ ID NO: 2662240 - RNA, 13 nt, Human
acuucugccugga

SEQ ID NO: 2662241 - RNA, 16 nt, Human
acuucugccuggagac

SEQ ID NO: 2662242 - RNA, 22 nt, Human
acuuggcucgaaucucugugcc

SEQ ID NO: 2662243 - RNA, 23 nt, Human
acuuggcucgaaucucugugccu

SEQ ID NO: 2662244 - RNA, 13 nt, Human
acuggaccccagc

SEQ ID NO: 2662245 - RNA, 20 nt, Human
acuuucaauugucacuuuuu

SEQ ID NO: 2662246 - RNA, 16 nt, Human
acuugggaggcugagg

SEQ ID NO: 2662247 - RNA, 17 nt, Human
acuucuuacgcaaugcu

SEQ ID NO: 2662248 - RNA, 16 nt, Human
cagugcuuuaauggca

SEQ ID NO: 2662249 - RNA, 20 nt, Human
cagugcuuuuaagugaaaau

SEQ ID NO: 2662250 - RNA, 23 nt, Human
caguggaauauaaggaaagcaau

SEQ ID NO: 2662251 - RNA, 21 nt, Human
caguggaccgcccuuuucccc

SEQ ID NO: 2662252 - RNA, 22 nt, Human
caguggaccgcccuuuuccccu

SEQ ID NO: 2662253 - RNA, 20 nt, Human
caguggcgcauucuaggcuc

SEQ ID NO: 2662254 - RNA, 11 nt, Human
caguggccuua

SEQ ID NO: 2662255 - RNA, 15 nt, Human
cagugguuuuauacu

SEQ ID NO: 2662256 - RNA, 21 nt, Human
cagugguuuuauacugaagga

SEQ ID NO: 2662257 - RNA, 12 nt, Human
caguguguaaac

SEQ ID NO: 2662258 - RNA, 13 nt, Human
caguguguaaaca

SEQ ID NO: 2662259 - RNA, 14 nt, Human
caguguguaaacaa

SEQ ID NO: 2662260 - RNA, 16 nt, Human
caguguguaaacaaaa

SEQ ID NO: 2662261 - RNA, 17 nt, Human
cagugugggcuugacca

SEQ ID NO: 2662262 - RNA, 19 nt, Human
caguguggccucuucugag

SEQ ID NO: 2662263 - RNA, 15 nt, Human
caguguggccaggcu

SEQ ID NO: 2662264 - RNA, 16 nt, Human
caguguggccaggcug

SEQ ID NO: 2662265 - RNA, 14 nt, Human
caguguauguagaa

SEQ ID NO: 2662266 - RNA, 18 nt, Human
caguguauguagaagcau

SEQ ID NO: 2662267 - RNA, 19 nt, Human
cagugucuauaaaagaaac

SEQ ID NO: 2662268 - RNA, 20 nt, Human
cagugguuuuauacugaagg

SEQ ID NO: 2662269 - RNA, 18 nt, Human
caguguuuugcaagugcu

SEQ ID NO: 2662270 - RNA, 21 nt, Human
caguguuuugcaagugcugga

SEQ ID NO: 2662271 - RNA, 16 nt, Human
caguguugguauauuu

SEQ ID NO: 2662272 - RNA, 16 nt, Human
caguuccucccaggaa

SEQ ID NO: 2662273 - RNA, 22 nt, Human
caguuccucccaggaagcccag

SEQ ID NO: 2662274 - RNA, 17 nt, Human
caguucuacucaggcug

SEQ ID NO: 2662275 - RNA, 19 nt, Human
caguugaaaaacagcugag

SEQ ID NO: 2662276 - RNA, 18 nt, Human
caguugaaaaacagcuga

SEQ ID NO: 2662277 - RNA, 12 nt, Human
caguugaaaaac

SEQ ID NO: 2662278 - RNA, 18 nt, Human
cauaauacugaaccacuu

SEQ ID NO: 2662279 - RNA, 17 nt, Human
cauaauacugaaccacu

SEQ ID NO: 2662280 - RNA, 16 nt, Human
cauaauacugaaccac

SEQ ID NO: 2662281 - RNA, 15 nt, Human
cauaauacugaacca

SEQ ID NO: 2662282 - RNA, 13 nt, Human
cauaagcuuccau

SEQ ID NO: 2662283 - RNA, 17 nt, Human
cauaagcuuccauuuua

SEQ ID NO: 2662284 - RNA, 19 nt, Human
cauaagcuuccauuuuaau

SEQ ID NO: 2662285 - RNA, 14 nt, Human
cauaacauccagag

SEQ ID NO: 2662286 - RNA, 15 nt, Human
cauaacauccagagc

SEQ ID NO: 2662287 - RNA, 12 nt, Human
cauaaauuuuuu

SEQ ID NO: 2662288 - RNA, 22 nt, Human
cauaaauuuuuugaagucuuua

SEQ ID NO: 2662289 - RNA, 14 nt, Human
cauaaaguaaauac

SEQ ID NO: 2662290 - RNA, 15 nt, Human
cauaaaguaaauaca

SEQ ID NO: 2662291 - RNA, 22 nt, Human
cauaaaguaaauacaugcauau

SEQ ID NO: 2662292 - RNA, 12 nt, Human
cauaaauuauuu

SEQ ID NO: 2662293 - RNA, 17 nt, Human
cauaaauuauuugauua

SEQ ID NO: 2662294 - RNA, 22 nt, Human
cauaaauuauuugauuauuuaa

SEQ ID NO: 2662295 - RNA, 16 nt, Human
cauaaauucaacuuug

SEQ ID NO: 2662296 - RNA, 18 nt, Human
cauaaauucaacuuugua

SEQ ID NO: 2662297 - RNA, 19 nt, Human
cauaaauucaacuuuguaa

SEQ ID NO: 2662298 - RNA, 20 nt, Human
cauaaauucaacuuuguaaa

SEQ ID NO: 2662299 - RNA, 21 nt, Human
cauaaaaauuagccaagugug

SEQ ID NO: 2662300 - RNA, 16 nt, Human
cauaaaagaaauaaac

SEQ ID NO: 2662301 - RNA, 22 nt, Human
cauaaaauguccaguaagauca

SEQ ID NO: 2662302 - RNA, 20 nt, Human
caguugcagcccuugugaug

SEQ ID NO: 2662303 - RNA, 20 nt, Human
caguuuugaccuaacauacc

SEQ ID NO: 2662304 - RNA, 14 nt, Human
caguuguauuuaac

SEQ ID NO: 2662305 - RNA, 18 nt, Human
caguuguauuuaacagaa

SEQ ID NO: 2662306 - RNA, 21 nt, Human
caguuguauuuaacagaaauu

SEQ ID NO: 2662307 - RNA, 16 nt, Human
caguugcucuaugcuu

SEQ ID NO: 2662308 - RNA, 20 nt, Human
caguugcugguaaaaugaag

SEQ ID NO: 2662309 - RNA, 19 nt, Human
caguugcugguaaaaugaa

SEQ ID NO: 2662310 - RNA, 18 nt, Human
caguugcugguaaaauga

SEQ ID NO: 2662311 - RNA, 17 nt, Human
caguugcugguaaaaug

SEQ ID NO: 2662312 - RNA, 13 nt, Human
caguugcugguaa

SEQ ID NO: 2662313 - RNA, 14 nt, Human
caguugcugguaaa

SEQ ID NO: 2662314 - RNA, 17 nt, Human
caguuggccagagagcc

SEQ ID NO: 2662315 - RNA, 16 nt, Human
caguuggccagagagc

SEQ ID NO: 2662316 - RNA, 13 nt, Human
caguugcuugucu

SEQ ID NO: 2662317 - RNA, 14 nt, Human
caguugcuugucuu

SEQ ID NO: 2662318 - RNA, 23 nt, Human
caguugcugguaaaaugaagaau

SEQ ID NO: 2662319 - RNA, 22 nt, Human
caguugcugguaaaaugaagaa

SEQ ID NO: 2662320 - RNA, 21 nt, Human
caguugcugguaaaaugaaga

SEQ ID NO: 2662321 - RNA, 18 nt, Human
caucucaggagauuucau

SEQ ID NO: 2662322 - RNA, 13 nt, Human
caucucacagcua

SEQ ID NO: 2662323 - RNA, 18 nt, Human
caucucauuuaagggaaa

SEQ ID NO: 2662324 - RNA, 19 nt, Human
caucucauuuaagggaaaa

SEQ ID NO: 2662325 - RNA, 20 nt, Human
caucucauuuaagggaaaaa

SEQ ID NO: 2662326 - RNA, 21 nt, Human
caucucauuuaagggaaaaau

SEQ ID NO: 2662327 - RNA, 22 nt, Human
caucucauuuaagggaaaaaua

SEQ ID NO: 2662328 - RNA, 23 nt, Human
caucucauuuaagggaaaaauau

SEQ ID NO: 2662329 - RNA, 20 nt, Human
caucuaggggagccuugauu

SEQ ID NO: 2662330 - RNA, 19 nt, Human
caucuaggggagccuugau

SEQ ID NO: 2662331 - RNA, 16 nt, Human
caucuaucucaauccu

SEQ ID NO: 2662332 - RNA, 13 nt, Human
caucuaucugugc

SEQ ID NO: 2662333 - RNA, 14 nt, Human
caucuaucugugcu

SEQ ID NO: 2662334 - RNA, 15 nt, Human
caucuaucucaaucc

SEQ ID NO: 2662335 - RNA, 20 nt, Human
caucuaucucaucuaucuca

SEQ ID NO: 2662336 - RNA, 17 nt, Human
caucuauagaaagcuau

SEQ ID NO: 2662337 - RNA, 13 nt, Human
caucuaucuaguu

SEQ ID NO: 2662338 - RNA, 17 nt, Human
caucuaucuaguucuaa

SEQ ID NO: 2662339 - RNA, 18 nt, Human
caucuaggggagccuuga

SEQ ID NO: 2662340 - RNA, 12 nt, Human
caucuagccagc

SEQ ID NO: 2662341 - RNA, 13 nt, Human
caucuagccagcc

SEQ ID NO: 2662342 - RNA, 17 nt, Human
caucuagccagccccuc

SEQ ID NO: 2662343 - RNA, 21 nt, Human
caucuagccagccccucuucc

SEQ ID NO: 2662344 - RNA, 22 nt, Human
caucuagccagccccucuuccc

SEQ ID NO: 2662345 - RNA, 13 nt, Human
cauccuccuccca

SEQ ID NO: 2662346 - RNA, 16 nt, Human
cauccuccucccaccc

SEQ ID NO: 2662347 - RNA, 20 nt, Human
cauccuccucccacccggcu

SEQ ID NO: 2662348 - RNA, 21 nt, Human
caucuaauucucuguggaaug

SEQ ID NO: 2662349 - RNA, 13 nt, Human
caucuaauucuga

SEQ ID NO: 2662350 - RNA, 14 nt, Human
caucuaauucugau

SEQ ID NO: 2662351 - RNA, 15 nt, Human
caucuaauucugauu

SEQ ID NO: 2662352 - RNA, 16 nt, Human
caucuaauucugauuc

SEQ ID NO: 2662353 - RNA, 18 nt, Human
cauccacaauaaccaaga

SEQ ID NO: 2662354 - RNA, 21 nt, Human
cauccuacaacucacauuaga

SEQ ID NO: 2662355 - RNA, 14 nt, Human
cauccuacccuuuu

SEQ ID NO: 2662356 - RNA, 22 nt, Human
caucugcaccccuucucuccuc

SEQ ID NO: 2662357 - RNA, 23 nt, Human
caucugcaccccuucucuccucc

SEQ ID NO: 2662358 - RNA, 12 nt, Human
caucugcaaaag

SEQ ID NO: 2662359 - RNA, 20 nt, Human
caucugcaaaaggccucuug

SEQ ID NO: 2662360 - RNA, 22 nt, Human
caucugcaaaaggccucuugua

SEQ ID NO: 2662361 - RNA, 23 nt, Human
caucugcaaaaggccucuuguaa

SEQ ID NO: 2662362 - RNA, 16 nt, Human
caucugcaccccuucu

SEQ ID NO: 2662363 - RNA, 17 nt, Human
caucugcaccccuucuc

SEQ ID NO: 2662364 - RNA, 19 nt, Human
caucugcaccccuucucuc

SEQ ID NO: 2662365 - RNA, 21 nt, Human
caucugcaccccuucucuccu

SEQ ID NO: 2662366 - RNA, 15 nt, Human
caucugagguuuuau

SEQ ID NO: 2662367 - RNA, 21 nt, Human
caucugagguuuuauuucauu

SEQ ID NO: 2662368 - RNA, 14 nt, Human
caucuccccucagc

SEQ ID NO: 2662369 - RNA, 13 nt, Human
caucuccccucag

SEQ ID NO: 2662370 - RNA, 15 nt, Human
caucuugccuccagg

SEQ ID NO: 2662371 - RNA, 16 nt, Human
caucuugccuccaggu

SEQ ID NO: 2662372 - RNA, 18 nt, Human
caucuugccuccaggugc

SEQ ID NO: 2662373 - RNA, 19 nt, Human
caucuugccuccaggugca

SEQ ID NO: 2662374 - RNA, 21 nt, Human
caucuugccuccaggugcaga

SEQ ID NO: 2662375 - RNA, 22 nt, Human
caucuugccuccaggugcagag

SEQ ID NO: 2662376 - RNA, 23 nt, Human
caucuugccuccaggugcagagg

SEQ ID NO: 2662377 - RNA, 13 nt, Human
caucuugcuuccc

SEQ ID NO: 2662378 - RNA, 14 nt, Human
caucuugcuucccu

SEQ ID NO: 2662379 - RNA, 15 nt, Human
caucuugcuucccua

SEQ ID NO: 2662380 - RNA, 11 nt, Human
caucuuggggg

SEQ ID NO: 2662381 - RNA, 19 nt, Human
caucccuaccgacccaggg

SEQ ID NO: 2662382 - RNA, 13 nt, Human
cauccagggggca

SEQ ID NO: 2662383 - RNA, 13 nt, Human
cauccagaugugg

SEQ ID NO: 2662384 - RNA, 14 nt, Human
cauccagauguggc

SEQ ID NO: 2662385 - RNA, 15 nt, Human
cauccagauguggcu

SEQ ID NO: 2662386 - RNA, 16 nt, Human
cauccagauguggcua

SEQ ID NO: 2662387 - RNA, 14 nt, Human
cauccaaccuuccc

SEQ ID NO: 2662388 - RNA, 21 nt, Human
cauccaaggccagguucuccg

SEQ ID NO: 2662389 - RNA, 16 nt, Human
cauccaaccuucccaa

SEQ ID NO: 2662390 - RNA, 14 nt, Human
cauccaacuccagc

SEQ ID NO: 2662391 - RNA, 15 nt, Human
cauccaacuccagca

SEQ ID NO: 2662392 - RNA, 16 nt, Human
cauccaacuccagcaa

SEQ ID NO: 2662393 - RNA, 17 nt, Human
cauccaacuccagcaac

SEQ ID NO: 2662394 - RNA, 18 nt, Human
cauccaacuccagcaacu

SEQ ID NO: 2662395 - RNA, 14 nt, Human
caucauuucaggag

SEQ ID NO: 2662396 - RNA, 23 nt, Human
caucccuaccgacccaggguucc

SEQ ID NO: 2662397 - RNA, 19 nt, Human
caucaaucaaauaaguauu

SEQ ID NO: 2662398 - RNA, 14 nt, Human
caucaauccugauu

SEQ ID NO: 2662399 - RNA, 16 nt, Human
caucaauccugauucc

SEQ ID NO: 2662400 - RNA, 21 nt, Human
caucaauccugauuccucucu

SEQ ID NO: 2662401 - RNA, 14 nt, Human
caucacaagaacac

SEQ ID NO: 2662402 - RNA, 17 nt, Human
caucacaagaacacaca

SEQ ID NO: 2662403 - RNA, 13 nt, Human
caucacagggugg

SEQ ID NO: 2662404 - RNA, 14 nt, Human
caucacaggguggg

SEQ ID NO: 2662405 - RNA, 18 nt, Human
caucacagggugggccuc

SEQ ID NO: 2662406 - RNA, 19 nt, Human
caucacagggugggccucg

SEQ ID NO: 2662407 - RNA, 21 nt, Human
caucacagggugggccucggc

SEQ ID NO: 2662408 - RNA, 22 nt, Human
caucacagggugggccucggcc

SEQ ID NO: 2662409 - RNA, 17 nt, Human
caucaaaccuuugagua

SEQ ID NO: 2662410 - RNA, 18 nt, Human
caucaaaccuuugaguag

SEQ ID NO: 2662411 - RNA, 19 nt, Human
caucaaaauauuucaguga

SEQ ID NO: 2662412 - RNA, 21 nt, Human
caucaaaauauuucagugaau

SEQ ID NO: 2662413 - RNA, 13 nt, Human
caucaaauaagaa

SEQ ID NO: 2662414 - RNA, 17 nt, Human
cauauuuuauuacuguu

SEQ ID NO: 2662415 - RNA, 18 nt, Human
cauauuuuauuacuguuu

SEQ ID NO: 2662416 - RNA, 23 nt, Human
cauauuuuauuacuguuuauuac

SEQ ID NO: 2662417 - RNA, 16 nt, Human
cauauuugaagggucu

SEQ ID NO: 2662418 - RNA, 18 nt, Human
cauaguuuggcauuugca

SEQ ID NO: 2662419 - RNA, 15 nt, Human
cauaguuuggcauuu

SEQ ID NO: 2662420 - RNA, 14 nt, Human
cauaguuuggcauu

SEQ ID NO: 2662421 - RNA, 16 nt, Human
cauaguuuggcauuug

SEQ ID NO: 2662422 - RNA, 16 nt, Human
cauaguuuuauuuaua

SEQ ID NO: 2662423 - RNA, 15 nt, Human
cauaguuuuauuuau

SEQ ID NO: 2662424 - RNA, 19 nt, Human
cauaguuuuauuuauauuu

SEQ ID NO: 2662425 - RNA, 14 nt, Human
cauauaaugaauaa

SEQ ID NO: 2662426 - RNA, 16 nt, Human
cauauaaugaauaaau

SEQ ID NO: 2662427 - RNA, 13 nt, Human
cauaguuuggcau

SEQ ID NO: 2662428 - RNA, 21 nt, Human
cauaguucugagcugccagug

SEQ ID NO: 2662429 - RNA, 12 nt, Human
cauaguuucuuu

SEQ ID NO: 2662430 - RNA, 15 nt, Human
cauaguuucuuuauu

SEQ ID NO: 2662431 - RNA, 16 nt, Human
cauaguuucuuuauuu

SEQ ID NO: 2662432 - RNA, 17 nt, Human
cauaguuucuuuauuuu

SEQ ID NO: 2662433 - RNA, 22 nt, Human
cauaguuucuuuauuuugugua

SEQ ID NO: 2662434 - RNA, 23 nt, Human
cauaguuucuuuauuuuguguaa

SEQ ID NO: 2662435 - RNA, 20 nt, Human
cauaguucugagcugccagu

SEQ ID NO: 2662436 - RNA, 13 nt, Human
cauaguuacugug

SEQ ID NO: 2662437 - RNA, 14 nt, Human
cauaguuacugugu

SEQ ID NO: 2662438 - RNA, 16 nt, Human
cauaguuacuguguaa

SEQ ID NO: 2662439 - RNA, 18 nt, Human
cauaguuacuguguaaac

SEQ ID NO: 2662440 - RNA, 19 nt, Human
cauaguuacuguguaaacu

SEQ ID NO: 2662441 - RNA, 18 nt, Human
cauagaaaccacuagaaa

SEQ ID NO: 2662442 - RNA, 23 nt, Human
cauagaggcuucuccgccagccu

SEQ ID NO: 2662443 - RNA, 14 nt, Human
cauagaguacacug

SEQ ID NO: 2662444 - RNA, 19 nt, Human
cauagaggcuucuccgcca

SEQ ID NO: 2662445 - RNA, 20 nt, Human
cauagaggcuucuccgccag

SEQ ID NO: 2662446 - RNA, 21 nt, Human
cauagaggcuucuccgccagc

SEQ ID NO: 2662447 - RNA, 22 nt, Human
cauagaggcuucuccgccagcc

SEQ ID NO: 2662448 - RNA, 12 nt, Human
cauagaggcuuc

SEQ ID NO: 2662449 - RNA, 15 nt, Human
cauagaggcuucucc

SEQ ID NO: 2662450 - RNA, 19 nt, Human
cauagaguacacugccugc

SEQ ID NO: 2662451 - RNA, 18 nt, Human
cauagaguacacugccug

SEQ ID NO: 2662452 - RNA, 17 nt, Human
cauagaguacacugccu

SEQ ID NO: 2662453 - RNA, 15 nt, Human
cauagaguacacugc

SEQ ID NO: 2662454 - RNA, 16 nt, Human
cauagauaauauuguu

SEQ ID NO: 2662455 - RNA, 17 nt, Human
cauagauaauauuguuu

SEQ ID NO: 2662456 - RNA, 19 nt, Human
cauagauaauauuguuugg

SEQ ID NO: 2662457 - RNA, 22 nt, Human
cauagauaauauuguuugguaa

SEQ ID NO: 2662458 - RNA, 23 nt, Human
cauagauaauauuguuugguaaa

SEQ ID NO: 2662459 - RNA, 24 nt, Human
cauagauaauauuguuugguaaau

SEQ ID NO: 2662460 - RNA, 23 nt, Human
cauauacacgaauagacaucaaa

SEQ ID NO: 2662461 - RNA, 11 nt, Human
cauauauauau

SEQ ID NO: 2662462 - RNA, 16 nt, Human
cauauauauauauaac

SEQ ID NO: 2662463 - RNA, 13 nt, Human
cauaucaguugag

SEQ ID NO: 2662464 - RNA, 20 nt, Human
cauaucaacuuagucaauaa

SEQ ID NO: 2662465 - RNA, 13 nt, Human
cauaucccuucca

SEQ ID NO: 2662466 - RNA, 14 nt, Human
cauaucccuuccag

SEQ ID NO: 2662467 - RNA, 15 nt, Human
cauaucccuuccaga

SEQ ID NO: 2662468 - RNA, 17 nt, Human
cauaucccuuccagaug

SEQ ID NO: 2662469 - RNA, 14 nt, Human
cauacuuaccuagu

SEQ ID NO: 2662470 - RNA, 18 nt, Human
cauacuuaccuagugaaa

SEQ ID NO: 2662471 - RNA, 22 nt, Human
cauacuuaccuagugaaacuuu

SEQ ID NO: 2662472 - RNA, 14 nt, Human
cauacgauuuaagg

SEQ ID NO: 2662473 - RNA, 20 nt, Human
cauacuccuuccaucaaaua

SEQ ID NO: 2662474 - RNA, 15 nt, Human
cauacucgagucuga

SEQ ID NO: 2662475 - RNA, 19 nt, Human
cauacucgagucugaggcc

SEQ ID NO: 2662476 - RNA, 18 nt, Human
cauacucgagucugaggc

SEQ ID NO: 2662477 - RNA, 17 nt, Human
cauacucgagucugagg

SEQ ID NO: 2662478 - RNA, 16 nt, Human
cauacucgagucugag

SEQ ID NO: 2662479 - RNA, 20 nt, Human
cauagaaauggaaauuuugc

SEQ ID NO: 2662480 - RNA, 23 nt, Human
cauagaaauggaaauuuugcuau

SEQ ID NO: 2662481 - RNA, 22 nt, Human
cauagaaauguagguccucaga

SEQ ID NO: 2662482 - RNA, 23 nt, Human
cauagaaauguagguccucagaa

SEQ ID NO: 2662483 - RNA, 13 nt, Human
cauagacaugaaa

SEQ ID NO: 2662484 - RNA, 14 nt, Human
cauagacaugaaag

SEQ ID NO: 2662485 - RNA, 16 nt, Human
cauagacaugaaaggu

SEQ ID NO: 2662486 - RNA, 17 nt, Human
cauacuggcuucaccau

SEQ ID NO: 2662487 - RNA, 14 nt, Human
cauacuuuguaaau

SEQ ID NO: 2662488 - RNA, 15 nt, Human
cauacuuuguaaaua

SEQ ID NO: 2662489 - RNA, 22 nt, Human
cauacuuuguaaauaggauuuu

SEQ ID NO: 2662490 - RNA, 16 nt, Human
cauacuuuguauuuug

SEQ ID NO: 2662491 - RNA, 17 nt, Human
cauacuuuguauuuuga

SEQ ID NO: 2662492 - RNA, 18 nt, Human
cauacuuuguauuuugau

SEQ ID NO: 2662493 - RNA, 10 nt, Human
cauuaaacug

SEQ ID NO: 2662494 - RNA, 11 nt, Human
cauuaaacuuu

SEQ ID NO: 2662495 - RNA, 13 nt, Human
cauuaaacuuuuu

SEQ ID NO: 2662496 - RNA, 14 nt, Human
cauuaaacuuuuuu

SEQ ID NO: 2662497 - RNA, 19 nt, Human
cauuaaacuuuuuuaacca

SEQ ID NO: 2662498 - RNA, 15 nt, Human
cauguuuuguuuacg

SEQ ID NO: 2662499 - RNA, 20 nt, Human
cauuaaaggcauaaaugacu

SEQ ID NO: 2662500 - RNA, 15 nt, Human
cauuaauacucuuua

SEQ ID NO: 2662501 - RNA, 13 nt, Human
cauuaacaaauaa

SEQ ID NO: 2662502 - RNA, 15 nt, Human
cauuaacaaauaaaa

SEQ ID NO: 2662503 - RNA, 16 nt, Human
cauuaacaaauaaaaa

SEQ ID NO: 2662504 - RNA, 23 nt, Human
cauuauuuauauggggaauauau

SEQ ID NO: 2662505 - RNA, 19 nt, Human
cauuagagaacauccuggc

SEQ ID NO: 2662506 - RNA, 12 nt, Human
cauguggcugga

SEQ ID NO: 2662507 - RNA, 20 nt, Human
cauguggaaggcaagccagg

SEQ ID NO: 2662508 - RNA, 22 nt, Human
cauguggaaggcaagccaggcu

SEQ ID NO: 2662509 - RNA, 23 nt, Human
cauguggaaggcaagccaggcuc

SEQ ID NO: 2662510 - RNA, 13 nt, Human
cauguggcuggaa

SEQ ID NO: 2662511 - RNA, 15 nt, Human
cauguggcuggaaga

SEQ ID NO: 2662512 - RNA, 14 nt, Human
caugugguuugaaa

SEQ ID NO: 2662513 - RNA, 18 nt, Human
caugugugcaacagggua

SEQ ID NO: 2662514 - RNA, 15 nt, Human
caugugcauaguuuc

SEQ ID NO: 2662515 - RNA, 16 nt, Human
caugugcauaguuucu

SEQ ID NO: 2662516 - RNA, 17 nt, Human
caugugcauaguuucuu

SEQ ID NO: 2662517 - RNA, 18 nt, Human
caugugcauaguuucuuu

SEQ ID NO: 2662518 - RNA, 15 nt, Human
caugugcuucugcca

SEQ ID NO: 2662519 - RNA, 12 nt, Human
cauguuuuguau

SEQ ID NO: 2662520 - RNA, 14 nt, Human
cauguuuuccguga

SEQ ID NO: 2662521 - RNA, 12 nt, Human
cauguuuauaaa

SEQ ID NO: 2662522 - RNA, 13 nt, Human
cauguuuauaaau

SEQ ID NO: 2662523 - RNA, 23 nt, Human
cauguuuauaaaucuuaugcucu

SEQ ID NO: 2662524 - RNA, 15 nt, Human
caugucuuuuaaaau

SEQ ID NO: 2662525 - RNA, 18 nt, Human
cauguaaauguaaacuca

SEQ ID NO: 2662526 - RNA, 14 nt, Human
cauggugccugaga

SEQ ID NO: 2662527 - RNA, 13 nt, Human
cauggugccugag

SEQ ID NO: 2662528 - RNA, 19 nt, Human
cauggugaaaccccgucuc

SEQ ID NO: 2662529 - RNA, 14 nt, Human
cauggugaagugcu

SEQ ID NO: 2662530 - RNA, 23 nt, Human
cauggugaagugcuuggaacaua

SEQ ID NO: 2662531 - RNA, 15 nt, Human
cauggugccugagag

SEQ ID NO: 2662532 - RNA, 16 nt, Human
cauggugccugagagg

SEQ ID NO: 2662533 - RNA, 21 nt, Human
cauguaaugguaucuuaaagu

SEQ ID NO: 2662534 - RNA, 16 nt, Human
cauguaaauuuuguau

SEQ ID NO: 2662535 - RNA, 17 nt, Human
caugcuaacaaagacaa

SEQ ID NO: 2662536 - RNA, 18 nt, Human
caugccucacuaauuuuu

SEQ ID NO: 2662537 - RNA, 23 nt, Human
caugcggugccaugaagggaccc

SEQ ID NO: 2662538 - RNA, 13 nt, Human
caugcggucgggc

SEQ ID NO: 2662539 - RNA, 15 nt, Human
caugcgcucagggcc

SEQ ID NO: 2662540 - RNA, 21 nt, Human
caugcgcccccuccgcccugc

SEQ ID NO: 2662541 - RNA, 23 nt, Human
caugcgcccccuccgcccugcca

SEQ ID NO: 2662542 - RNA, 14 nt, Human
caugcgcucagggc

SEQ ID NO: 2662543 - RNA, 11 nt, Human
cauggggaggg

SEQ ID NO: 2662544 - RNA, 20 nt, Human
cauggggagggauucugguu

SEQ ID NO: 2662545 - RNA, 23 nt, Human
cauggggagggauucugguucca

SEQ ID NO: 2662546 - RNA, 10 nt, Human
cauggagcca

SEQ ID NO: 2662547 - RNA, 16 nt, Human
caugccgucugccgga

SEQ ID NO: 2662548 - RNA, 21 nt, Human
caugcccucucaggccggcag

SEQ ID NO: 2662549 - RNA, 16 nt, Human
caugcccucucaggcc

SEQ ID NO: 2662550 - RNA, 13 nt, Human
caugcccucucag

SEQ ID NO: 2662551 - RNA, 15 nt, Human
caugcccucucaggc

SEQ ID NO: 2662552 - RNA, 14 nt, Human
caugcccucucagg

SEQ ID NO: 2662553 - RNA, 12 nt, Human
caugcauauaau

SEQ ID NO: 2662554 - RNA, 14 nt, Human
caugcauauaauga

SEQ ID NO: 2662555 - RNA, 18 nt, Human
caugcauauaaugaauaa

SEQ ID NO: 2662556 - RNA, 20 nt, Human
caugcauauaaugaauaaau

SEQ ID NO: 2662557 - RNA, 21 nt, Human
caugcauauaaugaauaaauc

SEQ ID NO: 2662558 - RNA, 22 nt, Human
caugcauauaaugaauaaauca

SEQ ID NO: 2662559 - RNA, 23 nt, Human
caugcccacccccugcccugcac

SEQ ID NO: 2662560 - RNA, 11 nt, Human
caugcccccug

SEQ ID NO: 2662561 - RNA, 14 nt, Human
caugcccccugcag

SEQ ID NO: 2662562 - RNA, 16 nt, Human
caugcccccugcagac

SEQ ID NO: 2662563 - RNA, 15 nt, Human
caugcccacccccug

SEQ ID NO: 2662564 - RNA, 16 nt, Human
caugcccacccccugc

SEQ ID NO: 2662565 - RNA, 17 nt, Human
caugcccacccccugcc

SEQ ID NO: 2662566 - RNA, 18 nt, Human
caugcccacccccugccc

SEQ ID NO: 2662567 - RNA, 19 nt, Human
caugcccacccccugcccu

SEQ ID NO: 2662568 - RNA, 20 nt, Human
caugcccacccccugcccug

SEQ ID NO: 2662569 - RNA, 21 nt, Human
caugcccacccccugcccugc

SEQ ID NO: 2662570 - RNA, 22 nt, Human
caugcccacccccugcccugca

SEQ ID NO: 2662571 - RNA, 13 nt, Human
caugcccaccccc

SEQ ID NO: 2662572 - RNA, 14 nt, Human
caugcaugcaaaug

SEQ ID NO: 2662573 - RNA, 19 nt, Human
caugcaugcaaaugagcuc

SEQ ID NO: 2662574 - RNA, 13 nt, Human
caugccagcuggc

SEQ ID NO: 2662575 - RNA, 14 nt, Human
caugccagcuggcc

SEQ ID NO: 2662576 - RNA, 16 nt, Human
caugccagcuggccuu

SEQ ID NO: 2662577 - RNA, 22 nt, Human
caugccagcuggccuuuguaag

SEQ ID NO: 2662578 - RNA, 20 nt, Human
caugccagcuuaucucaggg

SEQ ID NO: 2662579 - RNA, 19 nt, Human
caugccagcuuaucucagg

SEQ ID NO: 2662580 - RNA, 12 nt, Human
ccaacccugccg

SEQ ID NO: 2662581 - RNA, 13 nt, Human
ccaacccugccgu

SEQ ID NO: 2662582 - RNA, 21 nt, Human
ccaacccugccgucaccacca

SEQ ID NO: 2662583 - RNA, 22 nt, Human
ccaacccugccgucaccaccac

SEQ ID NO: 2662584 - RNA, 16 nt, Human
ccaaccgugucugucu

SEQ ID NO: 2662585 - RNA, 14 nt, Human
ccaaccucagggcu

SEQ ID NO: 2662586 - RNA, 18 nt, Human
ccaaccucagggcuccca

SEQ ID NO: 2662587 - RNA, 20 nt, Human
ccaaccucagggcucccagg

SEQ ID NO: 2662588 - RNA, 22 nt, Human
ccaaccucagggcucccagggg

SEQ ID NO: 2662589 - RNA, 16 nt, Human
ccaacaucucccuccc

SEQ ID NO: 2662590 - RNA, 15 nt, Human
ccaaccuuucccuca

SEQ ID NO: 2662591 - RNA, 16 nt, Human
ccaaccuuucccucac

SEQ ID NO: 2662592 - RNA, 12 nt, Human
ccaaccuuccca

SEQ ID NO: 2662593 - RNA, 19 nt, Human
ccaaagauagacagguccu

SEQ ID NO: 2662594 - RNA, 17 nt, Human
ccaaagagggcuuccuc

SEQ ID NO: 2662595 - RNA, 19 nt, Human
ccaaagagggcuuccucua

SEQ ID NO: 2662596 - RNA, 16 nt, Human
ccaaagagggcuuccu

SEQ ID NO: 2662597 - RNA, 23 nt, Human
ccaaagaggcugccccucucacc

SEQ ID NO: 2662598 - RNA, 17 nt, Human
ccaaagaggcugccccu

SEQ ID NO: 2662599 - RNA, 20 nt, Human
ccaaagaggcugccccucuc

SEQ ID NO: 2662600 - RNA, 21 nt, Human
ccaaagaggcugccccucuca

SEQ ID NO: 2662601 - RNA, 22 nt, Human
ccaaagaggcugccccucucac

SEQ ID NO: 2662602 - RNA, 18 nt, Human
ccacaaaggagagcuagc

SEQ ID NO: 2662603 - RNA, 13 nt, Human
ccacaaccucuuc

SEQ ID NO: 2662604 - RNA, 15 nt, Human
ccacaaccucuuccc

SEQ ID NO: 2662605 - RNA, 15 nt, Human
ccaaguggggugcug

SEQ ID NO: 2662606 - RNA, 16 nt, Human
ccaaguggggugcugg

SEQ ID NO: 2662607 - RNA, 22 nt, Human
ccaaguggggugcugggaggag

SEQ ID NO: 2662608 - RNA, 14 nt, Human
ccaaggcuggggga

SEQ ID NO: 2662609 - RNA, 14 nt, Human
ccaaggcuggcagg

SEQ ID NO: 2662610 - RNA, 13 nt, Human
ccaaggccagguu

SEQ ID NO: 2662611 - RNA, 13 nt, Human
ccaagcuccaagc

SEQ ID NO: 2662612 - RNA, 15 nt, Human
ccaagcuccaagccc

SEQ ID NO: 2662613 - RNA, 17 nt, Human
ccaagcuccaagcccca

SEQ ID NO: 2662614 - RNA, 22 nt, Human
ccacaauaaccaagauauuuuu

SEQ ID NO: 2662615 - RNA, 14 nt, Human
cauuucccaucugc

SEQ ID NO: 2662616 - RNA, 14 nt, Human
cauuuccauugcuu

SEQ ID NO: 2662617 - RNA, 15 nt, Human
cauuuccauugcuua

SEQ ID NO: 2662618 - RNA, 16 nt, Human
cauuuccauugcuuau

SEQ ID NO: 2662619 - RNA, 15 nt, Human
cauuucccaucugca

SEQ ID NO: 2662620 - RNA, 17 nt, Human
cauuucccaucugcacc

SEQ ID NO: 2662621 - RNA, 19 nt, Human
cauugcacauaagcuucca

SEQ ID NO: 2662622 - RNA, 21 nt, Human
cauugcacauaagcuuccauu

SEQ ID NO: 2662623 - RNA, 16 nt, Human
cauugacuuuuauaaa

SEQ ID NO: 2662624 - RNA, 18 nt, Human
cauugacuuuuauaaagc

SEQ ID NO: 2662625 - RNA, 18 nt, Human
cauugagaccgugaagau

SEQ ID NO: 2662626 - RNA, 23 nt, Human
cauuuccccucugcacccagaac

SEQ ID NO: 2662627 - RNA, 20 nt, Human
cauuucccaucugcaccccu

SEQ ID NO: 2662628 - RNA, 21 nt, Human
cauugaccuauuuccagaaau

SEQ ID NO: 2662629 - RNA, 15 nt, Human
cauugaccuauuucc

SEQ ID NO: 2662630 - RNA, 13 nt, Human
ccaaacgccuccc

SEQ ID NO: 2662631 - RNA, 12 nt, Human
ccaaagaggcug

SEQ ID NO: 2662632 - RNA, 13 nt, Human
ccaaagaggcugc

SEQ ID NO: 2662633 - RNA, 14 nt, Human
ccaaagaggcugcc

SEQ ID NO: 2662634 - RNA, 16 nt, Human
ccaaagaggcugcccc

SEQ ID NO: 2662635 - RNA, 12 nt, Human
cauuuuuauagc

SEQ ID NO: 2662636 - RNA, 13 nt, Human
ccaaaccggcagg

SEQ ID NO: 2662637 - RNA, 16 nt, Human
ccaaaccggcaggugc

SEQ ID NO: 2662638 - RNA, 18 nt, Human
ccaaaccggcaggugcga

SEQ ID NO: 2662639 - RNA, 15 nt, Human
ccaaagagugauagu

SEQ ID NO: 2662640 - RNA, 22 nt, Human
cauuuuaaggaaaacuaccugu

SEQ ID NO: 2662641 - RNA, 18 nt, Human
cauuuuaacccuauuuua

SEQ ID NO: 2662642 - RNA, 14 nt, Human
cauuuuaauuuuaa

SEQ ID NO: 2662643 - RNA, 15 nt, Human
cauuuuaauuuuaaa

SEQ ID NO: 2662644 - RNA, 18 nt, Human
cauuuuaauuuuaaagug

SEQ ID NO: 2662645 - RNA, 14 nt, Human
cauuuugaccuacu

SEQ ID NO: 2662646 - RNA, 17 nt, Human
cauuuucuuuuuuaacc

SEQ ID NO: 2662647 - RNA, 20 nt, Human
cauuuugaaauuguuccuug

SEQ ID NO: 2662648 - RNA, 24 nt, Human
cauuuugcuaaaugugaaugauga

SEQ ID NO: 2662649 - RNA, 21 nt, Human
cauuuugcuaaaugugaauga

SEQ ID NO: 2662650 - RNA, 18 nt, Human
cauuuugcuaaaugugaa

SEQ ID NO: 2662651 - RNA, 23 nt, Human
cccauggguuguguguuuauuuc

SEQ ID NO: 2662652 - RNA, 22 nt, Human
cccauggguuguguguuuauuu

SEQ ID NO: 2662653 - RNA, 19 nt, Human
cccauggggagggauucug

SEQ ID NO: 2662654 - RNA, 18 nt, Human
cccaucgugaagaagccu

SEQ ID NO: 2662655 - RNA, 12 nt, Human
cccaucuugcuu

SEQ ID NO: 2662656 - RNA, 23 nt, Human
cccauguagcccccuggccucug

SEQ ID NO: 2662657 - RNA, 22 nt, Human
cccauguagcccccuggccucu

SEQ ID NO: 2662658 - RNA, 21 nt, Human
cccauguagcccccuggccuc

SEQ ID NO: 2662659 - RNA, 15 nt, Human
cccauguagcccccu

SEQ ID NO: 2662660 - RNA, 14 nt, Human
cccauguagccccc

SEQ ID NO: 2662661 - RNA, 21 nt, Human
ccccaaagauagacagguccu

SEQ ID NO: 2662662 - RNA, 22 nt, Human
ccccaaagauagacagguccug

SEQ ID NO: 2662663 - RNA, 21 nt, Human
cccauuaaggggaagaaugaa

SEQ ID NO: 2662664 - RNA, 13 nt, Human
ccccaaccucagg

SEQ ID NO: 2662665 - RNA, 14 nt, Human
ccccaaccucaggg

SEQ ID NO: 2662666 - RNA, 20 nt, Human
ccccaaccucagggcuccca

SEQ ID NO: 2662667 - RNA, 21 nt, Human
ccccaaccucagggcucccag

SEQ ID NO: 2662668 - RNA, 22 nt, Human
ccccaaccucagggcucccagg

SEQ ID NO: 2662669 - RNA, 15 nt, Human
ccccaaccuuucccu

SEQ ID NO: 2662670 - RNA, 19 nt, Human
ccccaaccuuucccucacc

SEQ ID NO: 2662671 - RNA, 21 nt, Human
ccccaaccuuucccucacccc

SEQ ID NO: 2662672 - RNA, 15 nt, Human
ccccaaaucaauaca

SEQ ID NO: 2662673 - RNA, 14 nt, Human
cccaguuagcucuc

SEQ ID NO: 2662674 - RNA, 15 nt, Human
cccagugccgagaag

SEQ ID NO: 2662675 - RNA, 21 nt, Human
cccaguccccaccccugcccc

SEQ ID NO: 2662676 - RNA, 23 nt, Human
cccaguccccaccccugccccca

SEQ ID NO: 2662677 - RNA, 17 nt, Human
cccagguaccagcugcg

SEQ ID NO: 2662678 - RNA, 19 nt, Human
cccagguaccagcugcgcu

SEQ ID NO: 2662679 - RNA, 14 nt, Human
cccaggguucccgc

SEQ ID NO: 2662680 - RNA, 14 nt, Human
cccagguaccagcu

SEQ ID NO: 2662681 - RNA, 15 nt, Human
cccagguaccagcug

SEQ ID NO: 2662682 - RNA, 16 nt, Human
cccagguaccagcugc

SEQ ID NO: 2662683 - RNA, 22 nt, Human
cccagccucagcgcggcccucc

SEQ ID NO: 2662684 - RNA, 20 nt, Human
cccagccucagcgcggcccu

SEQ ID NO: 2662685 - RNA, 15 nt, Human
cccagccucagcgcg

SEQ ID NO: 2662686 - RNA, 14 nt, Human
cccagccucagcgc

SEQ ID NO: 2662687 - RNA, 13 nt, Human
cccagccucagcg

SEQ ID NO: 2662688 - RNA, 12 nt, Human
cccagcccugcu

SEQ ID NO: 2662689 - RNA, 14 nt, Human
cccagcccugcugg

SEQ ID NO: 2662690 - RNA, 15 nt, Human
cccagcccugcuggg

SEQ ID NO: 2662691 - RNA, 17 nt, Human
cccagcccugcugggga

SEQ ID NO: 2662692 - RNA, 16 nt, Human
cccagccccgacucca

SEQ ID NO: 2662693 - RNA, 17 nt, Human
cccagccccgacuccag

SEQ ID NO: 2662694 - RNA, 18 nt, Human
cccagccccgacuccagc

SEQ ID NO: 2662695 - RNA, 19 nt, Human
cccagccccgacuccagcc

SEQ ID NO: 2662696 - RNA, 20 nt, Human
cccagccccgacuccagcca

SEQ ID NO: 2662697 - RNA, 21 nt, Human
cccagccccgacuccagccag

SEQ ID NO: 2662698 - RNA, 15 nt, Human
cccagcuacuuggga

SEQ ID NO: 2662699 - RNA, 17 nt, Human
cccagcuacuugggagg

SEQ ID NO: 2662700 - RNA, 18 nt, Human
cccagcuacuugggaggc

SEQ ID NO: 2662701 - RNA, 23 nt, Human
cccagcuacuugggaggcugagg

SEQ ID NO: 2662702 - RNA, 18 nt, Human
ccauuccacacagaaugc

SEQ ID NO: 2662703 - RNA, 13 nt, Human
cccaggacgccac

SEQ ID NO: 2662704 - RNA, 19 nt, Human
cccaggacgccacucauuu

SEQ ID NO: 2662705 - RNA, 22 nt, Human
cccaggacgccacucauuucau

SEQ ID NO: 2662706 - RNA, 23 nt, Human
cccaggacgccacucauuucauc

SEQ ID NO: 2662707 - RNA, 20 nt, Human
ccaugugauggacacuccag

SEQ ID NO: 2662708 - RNA, 21 nt, Human
ccaugugauggacacuccagg

SEQ ID NO: 2662709 - RNA, 22 nt, Human
ccaugugauggacacuccaggg

SEQ ID NO: 2662710 - RNA, 19 nt, Human
ccaugugcauaguuucuuu

SEQ ID NO: 2662711 - RNA, 21 nt, Human
ccaugugcauaguuucuuuau

SEQ ID NO: 2662712 - RNA, 20 nt, Human
ccauguggaaggcaagccag

SEQ ID NO: 2662713 - RNA, 21 nt, Human
ccauguggaaggcaagccagg

SEQ ID NO: 2662714 - RNA, 24 nt, Human
ccauguggaaggcaagccaggcuc

SEQ ID NO: 2662715 - RNA, 21 nt, Human
ccauguggauaacuuuacaga

SEQ ID NO: 2662716 - RNA, 12 nt, Human
ccauguggccac

SEQ ID NO: 2662717 - RNA, 14 nt, Human
ccauguggccacaa

SEQ ID NO: 2662718 - RNA, 22 nt, Human
ccauggagccagcucccucuau

SEQ ID NO: 2662719 - RNA, 18 nt, Human
ccauggagccagcucccu

SEQ ID NO: 2662720 - RNA, 17 nt, Human
ccauggagccagcuccc

SEQ ID NO: 2662721 - RNA, 14 nt, Human
ccauggagccagcu

SEQ ID NO: 2662722 - RNA, 14 nt, Human
ccaugcgcccccuc

SEQ ID NO: 2662723 - RNA, 20 nt, Human
ccaugcgcccccuccgcccu

SEQ ID NO: 2662724 - RNA, 13 nt, Human
ccaugcuccuggc

SEQ ID NO: 2662725 - RNA, 18 nt, Human
ccaugcuccuggcccacu

SEQ ID NO: 2662726 - RNA, 15 nt, Human
ccaugcuccuggccc

SEQ ID NO: 2662727 - RNA, 15 nt, Human
ccaugcugaggccug

SEQ ID NO: 2662728 - RNA, 16 nt, Human
ccaugcugaggccugg

SEQ ID NO: 2662729 - RNA, 17 nt, Human
ccaugcugaggccuggg

SEQ ID NO: 2662730 - RNA, 20 nt, Human
ccauuccaggcagccucugu

SEQ ID NO: 2662731 - RNA, 21 nt, Human
ccauuccaggcagccucuguc

SEQ ID NO: 2662732 - RNA, 19 nt, Human
ccauguuggccaggcuggu

SEQ ID NO: 2662733 - RNA, 13 nt, Human
ccaggccugccuc

SEQ ID NO: 2662734 - RNA, 16 nt, Human
ccaggccugccuccca

SEQ ID NO: 2662735 - RNA, 14 nt, Human
ccagggaccggcgg

SEQ ID NO: 2662736 - RNA, 15 nt, Human
ccagggaauccaagc

SEQ ID NO: 2662737 - RNA, 17 nt, Human
ccagggaauccaagccu

SEQ ID NO: 2662738 - RNA, 18 nt, Human
ccagggaauccaagccuc

SEQ ID NO: 2662739 - RNA, 21 nt, Human
ccagggaauccaagccuccac

SEQ ID NO: 2662740 - RNA, 16 nt, Human
ccagggacacacagcc

SEQ ID NO: 2662741 - RNA, 19 nt, Human
ccagggacacacagccuag

SEQ ID NO: 2662742 - RNA, 21 nt, Human
ccagggacacacagccuagca

SEQ ID NO: 2662743 - RNA, 12 nt, Human
ccauccugacca

SEQ ID NO: 2662744 - RNA, 12 nt, Human
ccauccugacug

SEQ ID NO: 2662745 - RNA, 13 nt, Human
ccauccugacuga

SEQ ID NO: 2662746 - RNA, 12 nt, Human
ccauccuggcua

SEQ ID NO: 2662747 - RNA, 19 nt, Human
ccauccugggacggcggca

SEQ ID NO: 2662748 - RNA, 17 nt, Human
ccauccuguauucuuca

SEQ ID NO: 2662749 - RNA, 16 nt, Human
ccauagacaugaaagg

SEQ ID NO: 2662750 - RNA, 20 nt, Human
ccauauuuuauuacuguuua

SEQ ID NO: 2662751 - RNA, 13 nt, Human
ccaucacccucuu

SEQ ID NO: 2662752 - RNA, 16 nt, Human
ccaucacccucuuccu

SEQ ID NO: 2662753 - RNA, 18 nt, Human
ccaucacccucuuccugu

SEQ ID NO: 2662754 - RNA, 20 nt, Human
ccaucacccucuuccuguga

SEQ ID NO: 2662755 - RNA, 16 nt, Human
ccauagaguacacugc

SEQ ID NO: 2662756 - RNA, 22 nt, Human
ccauagaguacacugccugccu

SEQ ID NO: 2662757 - RNA, 20 nt, Human
ccauagaguacacugccugc

SEQ ID NO: 2662758 - RNA, 19 nt, Human
ccauagaguacacugccug

SEQ ID NO: 2662759 - RNA, 17 nt, Human
ccagcugacaucuugaa

SEQ ID NO: 2662760 - RNA, 21 nt, Human
ccagcugacaucuugaauccu

SEQ ID NO: 2662761 - RNA, 20 nt, Human
ccagcucugccgucucugga

SEQ ID NO: 2662762 - RNA, 21 nt, Human
ccagcucugccgucucuggag

SEQ ID NO: 2662763 - RNA, 22 nt, Human
ccagcucugccgucucuggagc

SEQ ID NO: 2662764 - RNA, 19 nt, Human
ccagcugggccgggaccca

SEQ ID NO: 2662765 - RNA, 17 nt, Human
ccagcuggccuggacag

SEQ ID NO: 2662766 - RNA, 12 nt, Human
ccagcuggccuu

SEQ ID NO: 2662767 - RNA, 13 nt, Human
ccagcuggccuuu

SEQ ID NO: 2662768 - RNA, 14 nt, Human
ccagcuggccuuug

SEQ ID NO: 2662769 - RNA, 16 nt, Human
ccagcuggccuuugua

SEQ ID NO: 2662770 - RNA, 12 nt, Human
ccagcuggccug

SEQ ID NO: 2662771 - RNA, 13 nt, Human
ccagcuggccugg

SEQ ID NO: 2662772 - RNA, 15 nt, Human
ccagcuggccuggac

SEQ ID NO: 2662773 - RNA, 16 nt, Human
ccagcuggccuggaca

SEQ ID NO: 2662774 - RNA, 16 nt, Human
ccagccuccucuggac

SEQ ID NO: 2662775 - RNA, 23 nt, Human
ccagccuccucuggacggcaggc

SEQ ID NO: 2662776 - RNA, 14 nt, Human
ccaggacgccacuc

SEQ ID NO: 2662777 - RNA, 15 nt, Human
ccaggacgccacuca

SEQ ID NO: 2662778 - RNA, 16 nt, Human
ccaggacgccacucau

SEQ ID NO: 2662779 - RNA, 20 nt, Human
ccaggacgccacucauuuca

SEQ ID NO: 2662780 - RNA, 21 nt, Human
ccaggacgccacucauuucau

SEQ ID NO: 2662781 - RNA, 22 nt, Human
ccaggacgccacucauuucauc

SEQ ID NO: 2662782 - RNA, 23 nt, Human
ccaggacgccacucauuucaucu

SEQ ID NO: 2662783 - RNA, 11 nt, Human
ccaggccagcc

SEQ ID NO: 2662784 - RNA, 12 nt, Human
ccaggccagccu

SEQ ID NO: 2662785 - RNA, 13 nt, Human
ccaggccagccuc

SEQ ID NO: 2662786 - RNA, 14 nt, Human
ccaggccagccucc

SEQ ID NO: 2662787 - RNA, 15 nt, Human
ccaggccagccuccg

SEQ ID NO: 2662788 - RNA, 16 nt, Human
ccaggccagccuccga

SEQ ID NO: 2662789 - RNA, 19 nt, Human
ccaggccagccuccgagag

SEQ ID NO: 2662790 - RNA, 20 nt, Human
ccaggccagccuccgagagg

SEQ ID NO: 2662791 - RNA, 22 nt, Human
ccgggaaccuccccagccugcg

SEQ ID NO: 2662792 - RNA, 21 nt, Human
ccggggaagagauccaaagac

SEQ ID NO: 2662793 - RNA, 15 nt, Human
ccggggacccuguga

SEQ ID NO: 2662794 - RNA, 15 nt, Human
ccgguccagcuggcc

SEQ ID NO: 2662795 - RNA, 21 nt, Human
ccgguccagcuggccuggaca

SEQ ID NO: 2662796 - RNA, 16 nt, Human
ccguggaggaggaagg

SEQ ID NO: 2662797 - RNA, 20 nt, Human
ccguggaggaggaaggcaag

SEQ ID NO: 2662798 - RNA, 22 nt, Human
ccguggaggaggaaggcaagag

SEQ ID NO: 2662799 - RNA, 23 nt, Human
ccguggaggaggaaggcaagagg

SEQ ID NO: 2662800 - RNA, 18 nt, Human
ccgguggcggccccagca

SEQ ID NO: 2662801 - RNA, 22 nt, Human
ccggugggacccccguggggca

SEQ ID NO: 2662802 - RNA, 20 nt, Human
ccgguggcggccccagcacc

SEQ ID NO: 2662803 - RNA, 21 nt, Human
ccggacccucuaaccucgccc

SEQ ID NO: 2662804 - RNA, 15 nt, Human
ccggacuuuucugca

SEQ ID NO: 2662805 - RNA, 16 nt, Human
ccggacuuuucugcaa

SEQ ID NO: 2662806 - RNA, 23 nt, Human
cccuuuccccgacgcccacccaa

SEQ ID NO: 2662807 - RNA, 16 nt, Human
ccggaucugagggaga

SEQ ID NO: 2662808 - RNA, 22 nt, Human
ccggagugucuggaauuguggc

SEQ ID NO: 2662809 - RNA, 17 nt, Human
ccgggaaccuccccagc

SEQ ID NO: 2662810 - RNA, 21 nt, Human
ccgggaaccuccccagccugc

SEQ ID NO: 2662811 - RNA, 20 nt, Human
ccgggaaccuccccagccug

SEQ ID NO: 2662812 - RNA, 19 nt, Human
ccgggaaccuccccagccu

SEQ ID NO: 2662813 - RNA, 18 nt, Human
ccgggaaccuccccagcc

SEQ ID NO: 2662814 - RNA, 19 nt, Human
cccuuguuugucccuucua

SEQ ID NO: 2662815 - RNA, 23 nt, Human
cccuuccgcaguguggccaggcu

SEQ ID NO: 2662816 - RNA, 18 nt, Human
cccuugaaacuuugggaa

SEQ ID NO: 2662817 - RNA, 22 nt, Human
cccugguuauugauguggcccu

SEQ ID NO: 2662818 - RNA, 16 nt, Human
cccuguguuaauuuaa

SEQ ID NO: 2662819 - RNA, 13 nt, Human
cccuucccccacc

SEQ ID NO: 2662820 - RNA, 18 nt, Human
cccuuccccaugcuuccu

SEQ ID NO: 2662821 - RNA, 23 nt, Human
cccuuccccaugcuuccuugccu

SEQ ID NO: 2662822 - RNA, 17 nt, Human
ccuacauaucccuucca

SEQ ID NO: 2662823 - RNA, 23 nt, Human
ccuagacucggggugcuuccuug

SEQ ID NO: 2662824 - RNA, 21 nt, Human
ccuagacucggggugcuuccu

SEQ ID NO: 2662825 - RNA, 21 nt, Human
ccuagaacacuaacucaccag

SEQ ID NO: 2662826 - RNA, 21 nt, Human
ccuagaaauuccccacccuga

SEQ ID NO: 2662827 - RNA, 14 nt, Human
ccuaaauggccuca

SEQ ID NO: 2662828 - RNA, 18 nt, Human
ccuaaauggccucaugug

SEQ ID NO: 2662829 - RNA, 21 nt, Human
ccuaacaucugaccuggcauc

SEQ ID NO: 2662830 - RNA, 22 nt, Human
ccuacaguugaaaaacagcuga

SEQ ID NO: 2662831 - RNA, 21 nt, Human
ccuacagcuuugaucccugac

SEQ ID NO: 2662832 - RNA, 20 nt, Human
ccuacagcuuugaucccuga

SEQ ID NO: 2662833 - RNA, 17 nt, Human
ccuacagcuuugauccc

SEQ ID NO: 2662834 - RNA, 18 nt, Human
ccguuagcuccuguggcc

SEQ ID NO: 2662835 - RNA, 13 nt, Human
ccguuagcuccug

SEQ ID NO: 2662836 - RNA, 14 nt, Human
ccguuagcuccugu

SEQ ID NO: 2662837 - RNA, 15 nt, Human
ccguuagcuccugug

SEQ ID NO: 2662838 - RNA, 17 nt, Human
ccguuagcuccuguggc

SEQ ID NO: 2662839 - RNA, 23 nt, Human
ccucaccucaugcccacccccug

SEQ ID NO: 2662840 - RNA, 12 nt, Human
ccucaccucaug

SEQ ID NO: 2662841 - RNA, 22 nt, Human
ccucaccuaauaggcugggaga

SEQ ID NO: 2662842 - RNA, 14 nt, Human
ccucaccucaugcc

SEQ ID NO: 2662843 - RNA, 15 nt, Human
ccucaccucaugccc

SEQ ID NO: 2662844 - RNA, 16 nt, Human
ccucaccucaugccca

SEQ ID NO: 2662845 - RNA, 17 nt, Human
ccucaccucaugcccac

SEQ ID NO: 2662846 - RNA, 19 nt, Human
ccucaccucaugcccaccc

SEQ ID NO: 2662847 - RNA, 22 nt, Human
ccucaccucaugcccacccccu

SEQ ID NO: 2662848 - RNA, 22 nt, Human
ccucacucggguuucucugugg

SEQ ID NO: 2662849 - RNA, 23 nt, Human
ccucacucggguuucucuguggc

SEQ ID NO: 2662850 - RNA, 18 nt, Human
ccuauugauuuaagcuuu

SEQ ID NO: 2662851 - RNA, 16 nt, Human
ccuauucuauaaaacu

SEQ ID NO: 2662852 - RNA, 15 nt, Human
ccuauuaguguuaua

SEQ ID NO: 2662853 - RNA, 11 nt, Human
ccuauuagugu

SEQ ID NO: 2662854 - RNA, 19 nt, Human
ccuauuaguguuauaugaa

SEQ ID NO: 2662855 - RNA, 16 nt, Human
ccuauuaguguuauau

SEQ ID NO: 2662856 - RNA, 17 nt, Human
ccuauuagagaagagau

SEQ ID NO: 2662857 - RNA, 16 nt, Human
ccuauuagagaagaga

SEQ ID NO: 2662858 - RNA, 16 nt, Human
ccuaucuccugacaga

SEQ ID NO: 2662859 - RNA, 14 nt, Human
ccuaucuccugaca

SEQ ID NO: 2662860 - RNA, 15 nt, Human
ccuaucuccugacag

SEQ ID NO: 2662861 - RNA, 14 nt, Human
ccuaucccucuccu

SEQ ID NO: 2662862 - RNA, 15 nt, Human
ccuaucccucuccua

SEQ ID NO: 2662863 - RNA, 15 nt, Human
ccuauccgcugccag

SEQ ID NO: 2662864 - RNA, 17 nt, Human
ccuauccgcugccagcc

SEQ ID NO: 2662865 - RNA, 18 nt, Human
ccuauccgcugccagccu

SEQ ID NO: 2662866 - RNA, 13 nt, Human
ccuaucuccugac

SEQ ID NO: 2662867 - RNA, 19 nt, Human
ccuagaccuaaacggcuca

SEQ ID NO: 2662868 - RNA, 14 nt, Human
ccuaggucuccagu

SEQ ID NO: 2662869 - RNA, 14 nt, Human
ccuagugaaacuuu

SEQ ID NO: 2662870 - RNA, 19 nt, Human
ccuagugaaacuuuucuag

SEQ ID NO: 2662871 - RNA, 13 nt, Human
ccucuccauuugc

SEQ ID NO: 2662872 - RNA, 20 nt, Human
ccucuccauuugcucuucag

SEQ ID NO: 2662873 - RNA, 13 nt, Human
ccucuccagccuc

SEQ ID NO: 2662874 - RNA, 14 nt, Human
ccucuccagccuca

SEQ ID NO: 2662875 - RNA, 16 nt, Human
ccucuccagccucagc

SEQ ID NO: 2662876 - RNA, 17 nt, Human
ccucuccagccucagcc

SEQ ID NO: 2662877 - RNA, 18 nt, Human
ccucuccagccucagccc

SEQ ID NO: 2662878 - RNA, 20 nt, Human
ccucuccagccucagccccc

SEQ ID NO: 2662879 - RNA, 22 nt, Human
ccucuccagccucagcccccug

SEQ ID NO: 2662880 - RNA, 21 nt, Human
ccuccuccagccgccaugcuc

SEQ ID NO: 2662881 - RNA, 16 nt, Human
ccuccucccacccggc

SEQ ID NO: 2662882 - RNA, 15 nt, Human
ccuccuccaggccug

SEQ ID NO: 2662883 - RNA, 19 nt, Human
ccuccucccacccggcugc

SEQ ID NO: 2662884 - RNA, 19 nt, Human
ccuccucucccauccuuga

SEQ ID NO: 2662885 - RNA, 15 nt, Human
ccucuaaugagacug

SEQ ID NO: 2662886 - RNA, 14 nt, Human
ccucuaaugagacu

SEQ ID NO: 2662887 - RNA, 20 nt, Human
ccucuaaccucgcccucucc

SEQ ID NO: 2662888 - RNA, 18 nt, Human
ccucgugaaagugcauuu

SEQ ID NO: 2662889 - RNA, 15 nt, Human
ccucugaacuugccu

SEQ ID NO: 2662890 - RNA, 20 nt, Human
ccucuccuacucggcucugc

SEQ ID NO: 2662891 - RNA, 18 nt, Human
ccucuccucgguucaagg

SEQ ID NO: 2662892 - RNA, 22 nt, Human
ccucugaauuuacuuccuugca

SEQ ID NO: 2662893 - RNA, 19 nt, Human
ccucugacguccaccuccu

SEQ ID NO: 2662894 - RNA, 12 nt, Human
ccuccuccagcc

SEQ ID NO: 2662895 - RNA, 22 nt, Human
ccuccucaccucaugcccaccc

SEQ ID NO: 2662896 - RNA, 17 nt, Human
ccuccucaccucaugcc

SEQ ID NO: 2662897 - RNA, 19 nt, Human
ccuccucaccucaugccca

SEQ ID NO: 2662898 - RNA, 16 nt, Human
ccuccucaccucaugc

SEQ ID NO: 2662899 - RNA, 17 nt, Human
ccuccccugccaccagg

SEQ ID NO: 2662900 - RNA, 12 nt, Human
ccuccccugcca

SEQ ID NO: 2662901 - RNA, 13 nt, Human
ccuccccugccac

SEQ ID NO: 2662902 - RNA, 14 nt, Human
ccuccccugccacc

SEQ ID NO: 2662903 - RNA, 16 nt, Human
ccuccagugugggcuu

SEQ ID NO: 2662904 - RNA, 20 nt, Human
ccucaggugagaagcagagg

SEQ ID NO: 2662905 - RNA, 18 nt, Human
ccucaggugagaagcaga

SEQ ID NO: 2662906 - RNA, 17 nt, Human
ccucaggugagaagcag

SEQ ID NO: 2662907 - RNA, 22 nt, Human
ccuccagaacucacuggggccu

SEQ ID NO: 2662908 - RNA, 21 nt, Human
ccuccagaacucacuggggcc

SEQ ID NO: 2662909 - RNA, 16 nt, Human
cccguuuuccccauga

SEQ ID NO: 2662910 - RNA, 12 nt, Human
cccguuuucccc

SEQ ID NO: 2662911 - RNA, 14 nt, Human
cccguuucuggugg

SEQ ID NO: 2662912 - RNA, 18 nt, Human
cccguuuuccccaugaca

SEQ ID NO: 2662913 - RNA, 20 nt, Human
cccuaaaagcacuccugcuu

SEQ ID NO: 2662914 - RNA, 21 nt, Human
cccuaaccccuuccagaucac

SEQ ID NO: 2662915 - RNA, 17 nt, Human
cccuaaccccuuccaga

SEQ ID NO: 2662916 - RNA, 16 nt, Human
cccggcaggguccuag

SEQ ID NO: 2662917 - RNA, 21 nt, Human
cccggaggccgaggccaugug

SEQ ID NO: 2662918 - RNA, 14 nt, Human
cccggagcuggagg

SEQ ID NO: 2662919 - RNA, 13 nt, Human
cccuaagguccua

SEQ ID NO: 2662920 - RNA, 19 nt, Human
cccuagcagcccacccugc

SEQ ID NO: 2662921 - RNA, 20 nt, Human
cccuagcagcccacccugcu

SEQ ID NO: 2662922 - RNA, 23 nt, Human
cccuagcagcccacccugcugcu

SEQ ID NO: 2662923 - RNA, 20 nt, Human
cccuagccaaugucuccucc

SEQ ID NO: 2662924 - RNA, 20 nt, Human
cccuccaaauggagaagcug

SEQ ID NO: 2662925 - RNA, 23 nt, Human
cccuccaaauggagaagcugcag

SEQ ID NO: 2662926 - RNA, 22 nt, Human
ccccaggugguuauggagaggg

SEQ ID NO: 2662927 - RNA, 17 nt, Human
ccccagguccagcucug

SEQ ID NO: 2662928 - RNA, 21 nt, Human
ccccagguccagcucuggagg

SEQ ID NO: 2662929 - RNA, 22 nt, Human
ccccagguccagcucuggaggg

SEQ ID NO: 2662930 - RNA, 22 nt, Human
ccccagggggucucacccaugc

SEQ ID NO: 2662931 - RNA, 12 nt, Human
ccccaggacgcc

SEQ ID NO: 2662932 - RNA, 23 nt, Human
ccccaggacgccacucauuucau

SEQ ID NO: 2662933 - RNA, 17 nt, Human
ccccacagcgucccugg

SEQ ID NO: 2662934 - RNA, 18 nt, Human
ccccacagcgucccuggc

SEQ ID NO: 2662935 - RNA, 22 nt, Human
ccccacagucuccggccucucc

SEQ ID NO: 2662936 - RNA, 13 nt, Human
ccccacaguugcu

SEQ ID NO: 2662937 - RNA, 17 nt, Human
ccccagccccgacucca

SEQ ID NO: 2662938 - RNA, 18 nt, Human
ccccagccccgacuccag

SEQ ID NO: 2662939 - RNA, 19 nt, Human
ccccagccccgacuccagc

SEQ ID NO: 2662940 - RNA, 23 nt, Human
ccccagccccgacuccagccagc

SEQ ID NO: 2662941 - RNA, 13 nt, Human
ccccagccccggg

SEQ ID NO: 2662942 - RNA, 12 nt, Human
ccccagccugcg

SEQ ID NO: 2662943 - RNA, 11 nt, Human
ccccagccugc

SEQ ID NO: 2662944 - RNA, 10 nt, Human
ccccagccug

SEQ ID NO: 2662945 - RNA, 20 nt, Human
ccccagcccuaaucucaccc

SEQ ID NO: 2662946 - RNA, 13 nt, Human
ccccagccugcua

SEQ ID NO: 2662947 - RNA, 20 nt, Human
ccccagccugcuagcuagcu

SEQ ID NO: 2662948 - RNA, 12 nt, Human
ccccagccugcu

SEQ ID NO: 2662949 - RNA, 19 nt, Human
ccccagccugcgccugcug

SEQ ID NO: 2662950 - RNA, 18 nt, Human
ccccagccugcgccugcu

SEQ ID NO: 2662951 - RNA, 22 nt, Human
cccgcggggcugucggcgcugc

SEQ ID NO: 2662952 - RNA, 12 nt, Human
cccgccuggcca

SEQ ID NO: 2662953 - RNA, 14 nt, Human
cccgccuggccagg

SEQ ID NO: 2662954 - RNA, 15 nt, Human
cccgccuggccagga

SEQ ID NO: 2662955 - RNA, 16 nt, Human
cccgccuggccaggag

SEQ ID NO: 2662956 - RNA, 17 nt, Human
cccgccuggccaggagc

SEQ ID NO: 2662957 - RNA, 21 nt, Human
cccgccuggccaggagcaggc

SEQ ID NO: 2662958 - RNA, 17 nt, Human
cccgcgccacaggaccc

SEQ ID NO: 2662959 - RNA, 19 nt, Human
ccccuuccucuugucugau

SEQ ID NO: 2662960 - RNA, 16 nt, Human
ccccugggcuuggccu

SEQ ID NO: 2662961 - RNA, 18 nt, Human
ccccugggcuuggccugc

SEQ ID NO: 2662962 - RNA, 19 nt, Human
ccccugggcuuggccugcu

SEQ ID NO: 2662963 - RNA, 23 nt, Human
ccccugggcuuggccugcuguga

SEQ ID NO: 2662964 - RNA, 20 nt, Human
ccccugggcuuggccugcug

SEQ ID NO: 2662965 - RNA, 21 nt, Human
ccccugggcuuggccugcugu

SEQ ID NO: 2662966 - RNA, 22 nt, Human
ccccugggcuuggccugcugug

SEQ ID NO: 2662967 - RNA, 16 nt, Human
ccccuggccgcgcucc

SEQ ID NO: 2662968 - RNA, 23 nt, Human
ccccuggccgcgcuccgggcuuu

SEQ ID NO: 2662969 - RNA, 12 nt, Human
cccuggagccca

SEQ ID NO: 2662970 - RNA, 21 nt, Human
cccugggggcacaggaggcag

SEQ ID NO: 2662971 - RNA, 17 nt, Human
cccugggugggcucugu

SEQ ID NO: 2662972 - RNA, 18 nt, Human
cccugggugggcucugug

SEQ ID NO: 2662973 - RNA, 20 nt, Human
cccugggugggcucugugca

SEQ ID NO: 2662974 - RNA, 20 nt, Human
cccuggguguccccgcugcu

SEQ ID NO: 2662975 - RNA, 22 nt, Human
cccuggguguccccgcugcugu

SEQ ID NO: 2662976 - RNA, 23 nt, Human
cccuggguguccccgcugcugug

SEQ ID NO: 2662977 - RNA, 15 nt, Human
cccugccugccgucu

SEQ ID NO: 2662978 - RNA, 13 nt, Human
cccugccuggccc

SEQ ID NO: 2662979 - RNA, 17 nt, Human
cccugccuggcccccaa

SEQ ID NO: 2662980 - RNA, 21 nt, Human
cccugccuggcccccaaccuc

SEQ ID NO: 2662981 - RNA, 10 nt, Human
cccugcuuuu

SEQ ID NO: 2662982 - RNA, 16 nt, Human
cccugaucccauuuuc

SEQ ID NO: 2662983 - RNA, 18 nt, Human
cccugaucccauuuuccu

SEQ ID NO: 2662984 - RNA, 22 nt, Human
cccugaucccauuuuccucuga

SEQ ID NO: 2662985 - RNA, 13 nt, Human
cccucucaccaaa

SEQ ID NO: 2662986 - RNA, 15 nt, Human
cccugccaccaggcc

SEQ ID NO: 2662987 - RNA, 14 nt, Human
cccugccaccaggc

SEQ ID NO: 2662988 - RNA, 22 nt, Human
cuagugcuccauaguuuggcau

SEQ ID NO: 2662989 - RNA, 20 nt, Human
cuagucaacaguacccuggu

SEQ ID NO: 2662990 - RNA, 15 nt, Human
cuagugggguuuccu

SEQ ID NO: 2662991 - RNA, 19 nt, Human
cuagugggguuuccuggca

SEQ ID NO: 2662992 - RNA, 18 nt, Human
cuagugggguuuccuggc

SEQ ID NO: 2662993 - RNA, 17 nt, Human
cuagugggguuuccugg

SEQ ID NO: 2662994 - RNA, 13 nt, Human
cuaggcccccacu

SEQ ID NO: 2662995 - RNA, 15 nt, Human
cuaggcccccacuug

SEQ ID NO: 2662996 - RNA, 16 nt, Human
cuaggcccccacuugc

SEQ ID NO: 2662997 - RNA, 12 nt, Human
cuagauugacua

SEQ ID NO: 2662998 - RNA, 21 nt, Human
cuaggcauuugcugaauacag

SEQ ID NO: 2662999 - RNA, 22 nt, Human
cuaggauagcuaacuguaaauc

SEQ ID NO: 2663000 - RNA, 18 nt, Human
cuaggagaaccaaaucug

SEQ ID NO: 2663001 - RNA, 21 nt, Human
cuaggagaaccaaaucuggaa

SEQ ID NO: 2663002 - RNA, 23 nt, Human
cuaggagaaccaaaucuggaagc

SEQ ID NO: 2663003 - RNA, 16 nt, Human
cuaggaagagucuacc

SEQ ID NO: 2663004 - RNA, 17 nt, Human
cuauauccugugacugu

SEQ ID NO: 2663005 - RNA, 15 nt, Human
cuauauccugugacu

SEQ ID NO: 2663006 - RNA, 23 nt, Human
cuaguuaccacauuacucugccu

SEQ ID NO: 2663007 - RNA, 12 nt, Human
cuauauauuucu

SEQ ID NO: 2663008 - RNA, 13 nt, Human
cuauauauuucua

SEQ ID NO: 2663009 - RNA, 14 nt, Human
cuauauauuucuau

SEQ ID NO: 2663010 - RNA, 16 nt, Human
cuauauauuucuauua

SEQ ID NO: 2663011 - RNA, 15 nt, Human
cuauauauaaaacgg

SEQ ID NO: 2663012 - RNA, 19 nt, Human
cuauauauaaaacggugcu

SEQ ID NO: 2663013 - RNA, 22 nt, Human
cuauauauaaaacggugcugug

SEQ ID NO: 2663014 - RNA, 14 nt, Human
cuauauauauaaau

SEQ ID NO: 2663015 - RNA, 16 nt, Human
cuauauauauaaaugu

SEQ ID NO: 2663016 - RNA, 17 nt, Human
cuauauauauaaaugua

SEQ ID NO: 2663017 - RNA, 18 nt, Human
cuauauauauaaauguau

SEQ ID NO: 2663018 - RNA, 13 nt, Human
cuauauauauaau

SEQ ID NO: 2663019 - RNA, 21 nt, Human
cuauauuuugucauaucaaau

SEQ ID NO: 2663020 - RNA, 16 nt, Human
cuauauuuugucauau

SEQ ID NO: 2663021 - RNA, 15 nt, Human
cuauauuuugucaua

SEQ ID NO: 2663022 - RNA, 14 nt, Human
cuauauuuugucau

SEQ ID NO: 2663023 - RNA, 15 nt, Human
cuaucaacaauaaaa

SEQ ID NO: 2663024 - RNA, 19 nt, Human
cuaucaacaauaaaauuuu

SEQ ID NO: 2663025 - RNA, 15 nt, Human
cucacagugcuuuua

SEQ ID NO: 2663026 - RNA, 23 nt, Human
cucacuaggcccccacuugccuc

SEQ ID NO: 2663027 - RNA, 21 nt, Human
cucacccaugcaagcagagga

SEQ ID NO: 2663028 - RNA, 22 nt, Human
cucacccaugcaagcagaggac

SEQ ID NO: 2663029 - RNA, 14 nt, Human
cucacccccuccca

SEQ ID NO: 2663030 - RNA, 15 nt, Human
cucacccccucccac

SEQ ID NO: 2663031 - RNA, 18 nt, Human
cucacccccucccacccc

SEQ ID NO: 2663032 - RNA, 21 nt, Human
cucacccccucccacccccag

SEQ ID NO: 2663033 - RNA, 22 nt, Human
cucacccccucccacccccagc

SEQ ID NO: 2663034 - RNA, 23 nt, Human
cucacccccucccacccccagcc

SEQ ID NO: 2663035 - RNA, 17 nt, Human
cucaacuggguccagaa

SEQ ID NO: 2663036 - RNA, 16 nt, Human
cucaagaggaaugaaa

SEQ ID NO: 2663037 - RNA, 18 nt, Human
cucaagaggaaugaaaaa

SEQ ID NO: 2663038 - RNA, 18 nt, Human
cucaagcggguggcucug

SEQ ID NO: 2663039 - RNA, 20 nt, Human
cucaagcggguggcucuggg

SEQ ID NO: 2663040 - RNA, 21 nt, Human
cucaaccucuucuggcucaaa

SEQ ID NO: 2663041 - RNA, 12 nt, Human
cucaaccucuuc

SEQ ID NO: 2663042 - RNA, 20 nt, Human
cucaaccucuucuggcucaa

SEQ ID NO: 2663043 - RNA, 18 nt, Human
cucaaccucuucuggcuc

SEQ ID NO: 2663044 - RNA, 14 nt, Human
cucaaccucuucug

SEQ ID NO: 2663045 - RNA, 13 nt, Human
cucaaccucuucu

SEQ ID NO: 2663046 - RNA, 15 nt, Human
cuauuuucuaaagac

SEQ ID NO: 2663047 - RNA, 14 nt, Human
cuauuuuaaucuug

SEQ ID NO: 2663048 - RNA, 11 nt, Human
cuauuuuaaga

SEQ ID NO: 2663049 - RNA, 23 nt, Human
cuauuuuaagacugauuuuaaua

SEQ ID NO: 2663050 - RNA, 16 nt, Human
cuaugacuuaacauag

SEQ ID NO: 2663051 - RNA, 13 nt, Human
cuagauuuucacu

SEQ ID NO: 2663052 - RNA, 19 nt, Human
cuagauuuucacuuaugaa

SEQ ID NO: 2663053 - RNA, 17 nt, Human
cuagcacuuugggaggc

SEQ ID NO: 2663054 - RNA, 19 nt, Human
cuagcaaucucuucauuau

SEQ ID NO: 2663055 - RNA, 17 nt, Human
cuagcacaauuugcacu

SEQ ID NO: 2663056 - RNA, 15 nt, Human
cuagcacagcagcuu

SEQ ID NO: 2663057 - RNA, 15 nt, Human
cuagcaaaauaaaac

SEQ ID NO: 2663058 - RNA, 17 nt, Human
cuagcaaaauaaaacau

SEQ ID NO: 2663059 - RNA, 19 nt, Human
cuagcaaaauaaaacauag

SEQ ID NO: 2663060 - RNA, 19 nt, Human
cuagacuagcaaucucuuc

SEQ ID NO: 2663061 - RNA, 20 nt, Human
cuacuugggaggcugaggca

SEQ ID NO: 2663062 - RNA, 21 nt, Human
cuagagugaacuugggccacu

SEQ ID NO: 2663063 - RNA, 17 nt, Human
cuagagugaacuugggc

SEQ ID NO: 2663064 - RNA, 23 nt, Human
cuacuucuuuuuucaaaagaaag

SEQ ID NO: 2663065 - RNA, 13 nt, Human
cuacuugggaggc

SEQ ID NO: 2663066 - RNA, 16 nt, Human
cuacuugggaggcuga

SEQ ID NO: 2663067 - RNA, 19 nt, Human
cuacugacauaucuacacu

SEQ ID NO: 2663068 - RNA, 20 nt, Human
cuacccgacauaagucgagg

SEQ ID NO: 2663069 - RNA, 22 nt, Human
cuaacauggugaaaccccgucu

SEQ ID NO: 2663070 - RNA, 17 nt, Human
cuaagcagcuuauuguu

SEQ ID NO: 2663071 - RNA, 20 nt, Human
cuaaggcaucuaucugugcu

SEQ ID NO: 2663072 - RNA, 22 nt, Human
cuaaggcaucuaucugugcuag

SEQ ID NO: 2663073 - RNA, 23 nt, Human
cuacacuucgcaccggagugucu

SEQ ID NO: 2663074 - RNA, 22 nt, Human
cuacagaaaugaggaggaugcu

SEQ ID NO: 2663075 - RNA, 22 nt, Human
cuacagagaggaaauucuccac

SEQ ID NO: 2663076 - RNA, 15 nt, Human
cuaccccgcagacac

SEQ ID NO: 2663077 - RNA, 20 nt, Human
cuaccccgcagacaccuugg

SEQ ID NO: 2663078 - RNA, 18 nt, Human
cuacccagcguggccucc

SEQ ID NO: 2663079 - RNA, 23 nt, Human
cuaauguggaccuuagaauacag

SEQ ID NO: 2663080 - RNA, 17 nt, Human
cuaauuaaccuuacuaa

SEQ ID NO: 2663081 - RNA, 18 nt, Human
cuaauuaaccuuacuaau

SEQ ID NO: 2663082 - RNA, 17 nt, Human
cuaauuaacugaaacau

SEQ ID NO: 2663083 - RNA, 16 nt, Human
cuaauuaaucuggaau

SEQ ID NO: 2663084 - RNA, 13 nt, Human
cuacaaucucuuu

SEQ ID NO: 2663085 - RNA, 21 nt, Human
cuacaaucucuuuuuguuugc

SEQ ID NO: 2663086 - RNA, 13 nt, Human
cuaaugagacuga

SEQ ID NO: 2663087 - RNA, 21 nt, Human
cuaaucacaguuuuuccugga

SEQ ID NO: 2663088 - RNA, 22 nt, Human
cuaaucacaguuuuuccuggaa

SEQ ID NO: 2663089 - RNA, 15 nt, Human
cuaaucaccauguaa

SEQ ID NO: 2663090 - RNA, 18 nt, Human
cuaaucaccauguaagca

SEQ ID NO: 2663091 - RNA, 19 nt, Human
cuaaucaccauguaagcac

SEQ ID NO: 2663092 - RNA, 19 nt, Human
cuaaucuagauaucgacuu

SEQ ID NO: 2663093 - RNA, 18 nt, Human
cuaaucuauggucgggag

SEQ ID NO: 2663094 - RNA, 20 nt, Human
cuaaucuauggucgggagac

SEQ ID NO: 2663095 - RNA, 14 nt, Human
cuaauauuuuaugu

SEQ ID NO: 2663096 - RNA, 12 nt, Human
cuaagguccuaa

SEQ ID NO: 2663097 - RNA, 13 nt, Human
cuaagguccuaag

SEQ ID NO: 2663098 - RNA, 14 nt, Human
cuaaaucuauuuau

SEQ ID NO: 2663099 - RNA, 19 nt, Human
cuaaaucagagacaaaaua

SEQ ID NO: 2663100 - RNA, 12 nt, Human
cuaaaucuauuu

SEQ ID NO: 2663101 - RNA, 19 nt, Human
cuaaaucuauuuauuaaua

SEQ ID NO: 2663102 - RNA, 16 nt, Human
cuaaaucuauuuauua

SEQ ID NO: 2663103 - RNA, 21 nt, Human
cuaaaucuauuuauuaauauu

SEQ ID NO: 2663104 - RNA, 12 nt, Human
cuaaauggccuc

SEQ ID NO: 2663105 - RNA, 13 nt, Human
cuaaauggccuca

SEQ ID NO: 2663106 - RNA, 16 nt, Human
cuaaauggccucaugu

SEQ ID NO: 2663107 - RNA, 15 nt, Human
cuaaaucagagacaa

SEQ ID NO: 2663108 - RNA, 14 nt, Human
cuaaaucagagaca

SEQ ID NO: 2663109 - RNA, 17 nt, Human
cuaaauggccucaugug

SEQ ID NO: 2663110 - RNA, 19 nt, Human
cuaaauggccucauguggc

SEQ ID NO: 2663111 - RNA, 22 nt, Human
cuaaauuauaguguagaaaaga

SEQ ID NO: 2663112 - RNA, 13 nt, Human
cuaaaauuugaag

SEQ ID NO: 2663113 - RNA, 21 nt, Human
cuaaauguuuggcauguaaau

SEQ ID NO: 2663114 - RNA, 13 nt, Human
cuaaauuucacua

SEQ ID NO: 2663115 - RNA, 14 nt, Human
cuaaaaauauuguu

SEQ ID NO: 2663116 - RNA, 18 nt, Human
cguuguguuuuuuaagau

SEQ ID NO: 2663117 - RNA, 16 nt, Human
cguuggagaagcccgu

SEQ ID NO: 2663118 - RNA, 12 nt, Human
cuaaaccucagu

SEQ ID NO: 2663119 - RNA, 13 nt, Human
cuaaaccucaguu

SEQ ID NO: 2663120 - RNA, 17 nt, Human
cuaaaccucaguuauua

SEQ ID NO: 2663121 - RNA, 19 nt, Human
cuaaacaaugcugauuugg

SEQ ID NO: 2663122 - RNA, 15 nt, Human
cgugaaaacggagcu

SEQ ID NO: 2663123 - RNA, 17 nt, Human
cgugaaaacggagcuga

SEQ ID NO: 2663124 - RNA, 16 nt, Human
cgugaaaacggagcug

SEQ ID NO: 2663125 - RNA, 14 nt, Human
cgucuauccugugu

SEQ ID NO: 2663126 - RNA, 16 nt, Human
cgucuugguguaauuu

SEQ ID NO: 2663127 - RNA, 22 nt, Human
cgucuugguguaauuugaagau

SEQ ID NO: 2663128 - RNA, 18 nt, Human
cgugaaaacggagcugaa

SEQ ID NO: 2663129 - RNA, 23 nt, Human
cggugcccaagccagaggcuggg

SEQ ID NO: 2663130 - RNA, 17 nt, Human
cgucucaaccccucaca

SEQ ID NO: 2663131 - RNA, 14 nt, Human
cgucuccaggggcu

SEQ ID NO: 2663132 - RNA, 19 nt, Human
cgucuccaggggcugcuuc

SEQ ID NO: 2663133 - RNA, 20 nt, Human
cgucuccaggggcugcuucc

SEQ ID NO: 2663134 - RNA, 21 nt, Human
cgucuccaggggcugcuuccu

SEQ ID NO: 2663135 - RNA, 13 nt, Human
cguccugccugug

SEQ ID NO: 2663136 - RNA, 16 nt, Human
cguccugccuguggcg

SEQ ID NO: 2663137 - RNA, 14 nt, Human
cguccugccugugg

SEQ ID NO: 2663138 - RNA, 15 nt, Human
cguccugccuguggc

SEQ ID NO: 2663139 - RNA, 11 nt, Human
cguggggaggu

SEQ ID NO: 2663140 - RNA, 20 nt, Human
cgugggcucccguguuuugu

SEQ ID NO: 2663141 - RNA, 18 nt, Human
cguugcugacuuagaauc

SEQ ID NO: 2663142 - RNA, 12 nt, Human
cgugggcucccg

SEQ ID NO: 2663143 - RNA, 14 nt, Human
cgugggagccagcc

SEQ ID NO: 2663144 - RNA, 19 nt, Human
cgugggacggugcccaagc

SEQ ID NO: 2663145 - RNA, 20 nt, Human
cgugggacggugcccaagcc

SEQ ID NO: 2663146 - RNA, 13 nt, Human
cguggcccaaggc

SEQ ID NO: 2663147 - RNA, 14 nt, Human
cguggcccaaggcu

SEQ ID NO: 2663148 - RNA, 19 nt, Human
cguggcccaaggcuggcag

SEQ ID NO: 2663149 - RNA, 17 nt, Human
cgugcaucccugagaca

SEQ ID NO: 2663150 - RNA, 18 nt, Human
cguggcacucgcuguaug

SEQ ID NO: 2663151 - RNA, 13 nt, Human
cguggagggaggc

SEQ ID NO: 2663152 - RNA, 15 nt, Human
cguggagggaggccc

SEQ ID NO: 2663153 - RNA, 16 nt, Human
cguggagggaggcccc

SEQ ID NO: 2663154 - RNA, 19 nt, Human
cguggagggaggccccagg

SEQ ID NO: 2663155 - RNA, 20 nt, Human
cguggagggaggccccaggg

SEQ ID NO: 2663156 - RNA, 17 nt, Human
cguggaggaggaaggca

SEQ ID NO: 2663157 - RNA, 15 nt, Human
cguggacugaguggg

SEQ ID NO: 2663158 - RNA, 19 nt, Human
cguggacugagugggaagc

SEQ ID NO: 2663159 - RNA, 21 nt, Human
cguggacugagugggaagccc

SEQ ID NO: 2663160 - RNA, 15 nt, Human
cgugcugggcggcug

SEQ ID NO: 2663161 - RNA, 19 nt, Human
cgugcugggcggcugugcu

SEQ ID NO: 2663162 - RNA, 15 nt, Human
cgugcuacugcacuc

SEQ ID NO: 2663163 - RNA, 17 nt, Human
cgugcuacugcacucca

SEQ ID NO: 2663164 - RNA, 20 nt, Human
cgcccaggcuggagugcagu

SEQ ID NO: 2663165 - RNA, 21 nt, Human
cgccccuagccgguuccuguc

SEQ ID NO: 2663166 - RNA, 14 nt, Human
cgcccugccacuca

SEQ ID NO: 2663167 - RNA, 21 nt, Human
cgcgccacaggacccucgccg

SEQ ID NO: 2663168 - RNA, 17 nt, Human
cgcgccacaggacccuc

SEQ ID NO: 2663169 - RNA, 16 nt, Human
cgcgccacaggacccu

SEQ ID NO: 2663170 - RNA, 14 nt, Human
cgcgccacaggacc

SEQ ID NO: 2663171 - RNA, 11 nt, Human
cgcccuuggcu

SEQ ID NO: 2663172 - RNA, 17 nt, Human
cgcccuuggcuucugug

SEQ ID NO: 2663173 - RNA, 20 nt, Human
cgcccuuggcuucugugaug

SEQ ID NO: 2663174 - RNA, 23 nt, Human
cgccaggggaaaaucagccugcu

SEQ ID NO: 2663175 - RNA, 23 nt, Human
cgccagccuccucuggacggcag

SEQ ID NO: 2663176 - RNA, 13 nt, Human
cgccagccuccuc

SEQ ID NO: 2663177 - RNA, 14 nt, Human
cgccagccuccucu

SEQ ID NO: 2663178 - RNA, 15 nt, Human
cgccagccuccucug

SEQ ID NO: 2663179 - RNA, 16 nt, Human
cgccagccuccucugg

SEQ ID NO: 2663180 - RNA, 17 nt, Human
cgccagccuccucugga

SEQ ID NO: 2663181 - RNA, 18 nt, Human
cgccagccuccucuggac

SEQ ID NO: 2663182 - RNA, 21 nt, Human
cgccagccuccucuggacggc

SEQ ID NO: 2663183 - RNA, 18 nt, Human
ccucugccccucccccag

SEQ ID NO: 2663184 - RNA, 22 nt, Human
cgcuguaugaaaggagagagca

SEQ ID NO: 2663185 - RNA, 17 nt, Human
cgcuuuuccuuggcauu

SEQ ID NO: 2663186 - RNA, 16 nt, Human
cgcuuuuccuuggcau

SEQ ID NO: 2663187 - RNA, 14 nt, Human
cgcuuuuccuuggc

SEQ ID NO: 2663188 - RNA, 11 nt, Human
cgcuuuuccuu

SEQ ID NO: 2663189 - RNA, 22 nt, Human
cgcuucuugccucugugcugug

SEQ ID NO: 2663190 - RNA, 18 nt, Human
cgcuucuugccucugugc

SEQ ID NO: 2663191 - RNA, 19 nt, Human
cgcuucuugccucugugcu

SEQ ID NO: 2663192 - RNA, 18 nt, Human
cgcuugcuuuucuguauu

SEQ ID NO: 2663193 - RNA, 23 nt, Human
cgcuccaccagcaucaccugccu

SEQ ID NO: 2663194 - RNA, 19 nt, Human
cgcucagggccaugcugag

SEQ ID NO: 2663195 - RNA, 20 nt, Human
cgcucagggccaugcugagg

SEQ ID NO: 2663196 - RNA, 21 nt, Human
cgcucagggccaugcugaggc

SEQ ID NO: 2663197 - RNA, 22 nt, Human
cgcucagggccaugcugaggcc

SEQ ID NO: 2663198 - RNA, 15 nt, Human
cgcucaguaaacggg

SEQ ID NO: 2663199 - RNA, 14 nt, Human
cgcgcuugcuggcc

SEQ ID NO: 2663200 - RNA, 16 nt, Human
cgcgcuugcuggccag

SEQ ID NO: 2663201 - RNA, 16 nt, Human
cgcggagccugcauuu

SEQ ID NO: 2663202 - RNA, 13 nt, Human
cgcgccccuagcc

SEQ ID NO: 2663203 - RNA, 20 nt, Human
cggccuagggcccccacagu

SEQ ID NO: 2663204 - RNA, 17 nt, Human
cggcccgcgccacagga

SEQ ID NO: 2663205 - RNA, 16 nt, Human
cggcccgcgccacagg

SEQ ID NO: 2663206 - RNA, 14 nt, Human
cggcccgccucucc

SEQ ID NO: 2663207 - RNA, 17 nt, Human
cggcccgccucuccucg

SEQ ID NO: 2663208 - RNA, 12 nt, Human
cggcugcagagg

SEQ ID NO: 2663209 - RNA, 15 nt, Human
cggcugcagaggcca

SEQ ID NO: 2663210 - RNA, 20 nt, Human
cggcugcagaggccagaggc

SEQ ID NO: 2663211 - RNA, 18 nt, Human
cggcugcauugaagaucc

SEQ ID NO: 2663212 - RNA, 15 nt, Human
cggcagccccagccu

SEQ ID NO: 2663213 - RNA, 22 nt, Human
cgcuuuuccuuggcauuccgca

SEQ ID NO: 2663214 - RNA, 13 nt, Human
cggaagagccuug

SEQ ID NO: 2663215 - RNA, 17 nt, Human
cggaagggguuccucaa

SEQ ID NO: 2663216 - RNA, 18 nt, Human
cggcaugagacucagugc

SEQ ID NO: 2663217 - RNA, 20 nt, Human
cggcaugagacucagugcag

SEQ ID NO: 2663218 - RNA, 21 nt, Human
cggcaugagacucagugcaga

SEQ ID NO: 2663219 - RNA, 23 nt, Human
cggcaugagacucagugcagaug

SEQ ID NO: 2663220 - RNA, 22 nt, Human
cggcagccccagccugcuagcu

SEQ ID NO: 2663221 - RNA, 18 nt, Human
cggcagccccagccugcu

SEQ ID NO: 2663222 - RNA, 17 nt, Human
cggcagccccagccugc

SEQ ID NO: 2663223 - RNA, 16 nt, Human
cggcagccccagccug

SEQ ID NO: 2663224 - RNA, 12 nt, Human
cggccaagaaug

SEQ ID NO: 2663225 - RNA, 13 nt, Human
cggccaagaaugu

SEQ ID NO: 2663226 - RNA, 14 nt, Human
cggccaagaaugua

SEQ ID NO: 2663227 - RNA, 13 nt, Human
cgguaacuguccu

SEQ ID NO: 2663228 - RNA, 14 nt, Human
cgguaacuguccug

SEQ ID NO: 2663229 - RNA, 15 nt, Human
cgguaacuguccugu

SEQ ID NO: 2663230 - RNA, 17 nt, Human
cgguaacuguccugucc

SEQ ID NO: 2663231 - RNA, 18 nt, Human
cgguaacuguccuguccu

SEQ ID NO: 2663232 - RNA, 18 nt, Human
cgguaggcgaccaccgcc

SEQ ID NO: 2663233 - RNA, 18 nt, Human
cgguagguucagccaagg

SEQ ID NO: 2663234 - RNA, 18 nt, Human
cgguauccccccaucuug

SEQ ID NO: 2663235 - RNA, 22 nt, Human
cgguauccccccaucuugcuuc

SEQ ID NO: 2663236 - RNA, 12 nt, Human
cgguacucccau

SEQ ID NO: 2663237 - RNA, 18 nt, Human
cggguggcucugggaucc

SEQ ID NO: 2663238 - RNA, 14 nt, Human
cggguggggaaagg

SEQ ID NO: 2663239 - RNA, 21 nt, Human
cggguggggaaaggagguggg

SEQ ID NO: 2663240 - RNA, 15 nt, Human
cgggugugggaaagc

SEQ ID NO: 2663241 - RNA, 17 nt, Human
cggguuagacagccaaa

SEQ ID NO: 2663242 - RNA, 16 nt, Human
cggguggggcuugggg

SEQ ID NO: 2663243 - RNA, 20 nt, Human
cggguggggcuuggggcuca

SEQ ID NO: 2663244 - RNA, 12 nt, Human
cggguggucccc

SEQ ID NO: 2663245 - RNA, 14 nt, Human
cgggugguccccgu

SEQ ID NO: 2663246 - RNA, 18 nt, Human
cgggucgggggcaggugc

SEQ ID NO: 2663247 - RNA, 21 nt, Human
cgguccagcuggccuggacag

SEQ ID NO: 2663248 - RNA, 12 nt, Human
cggucacugaug

SEQ ID NO: 2663249 - RNA, 11 nt, Human
cgguccagcug

SEQ ID NO: 2663250 - RNA, 13 nt, Human
cgguccagcuggc

SEQ ID NO: 2663251 - RNA, 14 nt, Human
cgguccagcuggcc

SEQ ID NO: 2663252 - RNA, 15 nt, Human
cgguccagcuggccu

SEQ ID NO: 2663253 - RNA, 16 nt, Human
cgguccagcuggccug

SEQ ID NO: 2663254 - RNA, 15 nt, Human
cggucuccugacugg

SEQ ID NO: 2663255 - RNA, 16 nt, Human
cggucuccugacuggu

SEQ ID NO: 2663256 - RNA, 23 nt, Human
cggucucggaucaggcucccagg

SEQ ID NO: 2663257 - RNA, 22 nt, Human
cggucucggaucaggcucccag

SEQ ID NO: 2663258 - RNA, 17 nt, Human
cggugccaugaagggac

SEQ ID NO: 2663259 - RNA, 14 nt, Human
cggugcccaagcca

SEQ ID NO: 2663260 - RNA, 15 nt, Human
cggugcccaagccag

SEQ ID NO: 2663261 - RNA, 18 nt, Human
cggugcccaagccagagg

SEQ ID NO: 2663262 - RNA, 20 nt, Human
cggugcccaagccagaggcu

SEQ ID NO: 2663263 - RNA, 15 nt, Human
cggguuucucugugg

SEQ ID NO: 2663264 - RNA, 22 nt, Human
cgggagccaugcgcccccuccg

SEQ ID NO: 2663265 - RNA, 12 nt, Human
cgggagacagca

SEQ ID NO: 2663266 - RNA, 20 nt, Human
cgggaggucgaggcaggagg

SEQ ID NO: 2663267 - RNA, 18 nt, Human
cgggaggucgaggcagga

SEQ ID NO: 2663268 - RNA, 16 nt, Human
cgggaugguucuggcu

SEQ ID NO: 2663269 - RNA, 15 nt, Human
cggggugcuuccuug

SEQ ID NO: 2663270 - RNA, 14 nt, Human
cgggguggccacag

SEQ ID NO: 2663271 - RNA, 16 nt, Human
cgggguggccacagcg

SEQ ID NO: 2663272 - RNA, 22 nt, Human
cggggugaguccauucucccag

SEQ ID NO: 2663273 - RNA, 23 nt, Human
cggggugaguccauucucccagg

SEQ ID NO: 2663274 - RNA, 21 nt, Human
cgggguauccugggggaccca

SEQ ID NO: 2663275 - RNA, 15 nt, Human
cgggguauccugggg

SEQ ID NO: 2663276 - RNA, 20 nt, Human
cgggggcugcccuugggcca

SEQ ID NO: 2663277 - RNA, 16 nt, Human
cgggggcaggugcugg

SEQ ID NO: 2663278 - RNA, 14 nt, Human
cggggcugucggcg

SEQ ID NO: 2663279 - RNA, 21 nt, Human
cggggcugucggcgcugcccc

SEQ ID NO: 2663280 - RNA, 19 nt, Human
cggggcugucggcgcugcc

SEQ ID NO: 2663281 - RNA, 12 nt, Human
cggggacccugu

SEQ ID NO: 2663282 - RNA, 14 nt, Human
cggggacccuguga

SEQ ID NO: 2663283 - RNA, 14 nt, Human
cucuccuugagugu

SEQ ID NO: 2663284 - RNA, 12 nt, Human
cucuccuggccu

SEQ ID NO: 2663285 - RNA, 13 nt, Human
cucuccuggccua

SEQ ID NO: 2663286 - RNA, 20 nt, Human
cucuccuggccuauccgcug

SEQ ID NO: 2663287 - RNA, 21 nt, Human
cucuccuggccuauccgcugc

SEQ ID NO: 2663288 - RNA, 22 nt, Human
cucuccuggccuauccgcugcc

SEQ ID NO: 2663289 - RNA, 23 nt, Human
cucuccuggccuauccgcugcca

SEQ ID NO: 2663290 - RNA, 13 nt, Human
cucucuagcacaa

SEQ ID NO: 2663291 - RNA, 22 nt, Human
cucucuagcacaauuugcacua

SEQ ID NO: 2663292 - RNA, 17 nt, Human
cucucuccagauguuuc

SEQ ID NO: 2663293 - RNA, 14 nt, Human
cucucuccagaugu

SEQ ID NO: 2663294 - RNA, 12 nt, Human
cucucuccagau

SEQ ID NO: 2663295 - RNA, 13 nt, Human
cucuccagccuca

SEQ ID NO: 2663296 - RNA, 16 nt, Human
cucuccagccucagcc

SEQ ID NO: 2663297 - RNA, 23 nt, Human
cucuccagccucagcccccugcu

SEQ ID NO: 2663298 - RNA, 18 nt, Human
cucuaguucuuuguucau

SEQ ID NO: 2663299 - RNA, 13 nt, Human
cucuaguucuuug

SEQ ID NO: 2663300 - RNA, 15 nt, Human
cucuaguucuuuguu

SEQ ID NO: 2663301 - RNA, 17 nt, Human
cucuagcagcaccuccu

SEQ ID NO: 2663302 - RNA, 19 nt, Human
cucuagcagcaccuccugu

SEQ ID NO: 2663303 - RNA, 15 nt, Human
cucuagaagccaagg

SEQ ID NO: 2663304 - RNA, 22 nt, Human
cucuagaagccaagggaaaggg

SEQ ID NO: 2663305 - RNA, 18 nt, Human
cucuagaagccaagggaa

SEQ ID NO: 2663306 - RNA, 19 nt, Human
cucuagaagccaagggaaa

SEQ ID NO: 2663307 - RNA, 23 nt, Human
cucuagggaaaaaccagcgugug

SEQ ID NO: 2663308 - RNA, 17 nt, Human
cucuacuuaauccaaug

SEQ ID NO: 2663309 - RNA, 18 nt, Human
cucuacuuaauccaaugg

SEQ ID NO: 2663310 - RNA, 20 nt, Human
cucuaccauccccuguagag

SEQ ID NO: 2663311 - RNA, 13 nt, Human
cucuacaaaaagc

SEQ ID NO: 2663312 - RNA, 13 nt, Human
cucggcucugcag

SEQ ID NO: 2663313 - RNA, 13 nt, Human
cucuaacauuucc

SEQ ID NO: 2663314 - RNA, 20 nt, Human
cucuaaccucgcccucuccu

SEQ ID NO: 2663315 - RNA, 19 nt, Human
cucuaaccucgcccucucc

SEQ ID NO: 2663316 - RNA, 17 nt, Human
cucuaaccucgcccucu

SEQ ID NO: 2663317 - RNA, 14 nt, Human
cucuaaccucgccc

SEQ ID NO: 2663318 - RNA, 21 nt, Human
cucggaguguguaugccaaga

SEQ ID NO: 2663319 - RNA, 18 nt, Human
cucggauaguugcuauuu

SEQ ID NO: 2663320 - RNA, 22 nt, Human
cucggauaguugcuauuuuugu

SEQ ID NO: 2663321 - RNA, 13 nt, Human
cucggcucagcuc

SEQ ID NO: 2663322 - RNA, 12 nt, Human
cucccuccaccc

SEQ ID NO: 2663323 - RNA, 13 nt, Human
cucccuccacccc

SEQ ID NO: 2663324 - RNA, 14 nt, Human
cucccuccacccca

SEQ ID NO: 2663325 - RNA, 15 nt, Human
cucccuccaccccag

SEQ ID NO: 2663326 - RNA, 16 nt, Human
cucccuccaccccagg

SEQ ID NO: 2663327 - RNA, 17 nt, Human
cucccuccaccccagga

SEQ ID NO: 2663328 - RNA, 18 nt, Human
cucccuccaccccaggac

SEQ ID NO: 2663329 - RNA, 19 nt, Human
cucccuccaccccaggacg

SEQ ID NO: 2663330 - RNA, 17 nt, Human
cucccuuucuucccuac

SEQ ID NO: 2663331 - RNA, 20 nt, Human
cuccucaccucaugcccacc

SEQ ID NO: 2663332 - RNA, 12 nt, Human
cuccucaccuca

SEQ ID NO: 2663333 - RNA, 14 nt, Human
cuccucaccucaug

SEQ ID NO: 2663334 - RNA, 15 nt, Human
cuccucaccucaugc

SEQ ID NO: 2663335 - RNA, 16 nt, Human
cuccucaccucaugcc

SEQ ID NO: 2663336 - RNA, 17 nt, Human
cuccucaccucaugccc

SEQ ID NO: 2663337 - RNA, 19 nt, Human
cuccucaccucaugcccac

SEQ ID NO: 2663338 - RNA, 15 nt, Human
cuccgccagccuccu

SEQ ID NO: 2663339 - RNA, 14 nt, Human
cucccuagcuccuc

SEQ ID NO: 2663340 - RNA, 14 nt, Human
cuccgccagccucc

SEQ ID NO: 2663341 - RNA, 18 nt, Human
cuccgccagccuccucug

SEQ ID NO: 2663342 - RNA, 20 nt, Human
cuccgccagccuccucugga

SEQ ID NO: 2663343 - RNA, 21 nt, Human
cuccgccagccuccucuggac

SEQ ID NO: 2663344 - RNA, 13 nt, Human
cuccgcccugcca

SEQ ID NO: 2663345 - RNA, 14 nt, Human
cuccgcccugccac

SEQ ID NO: 2663346 - RNA, 17 nt, Human
cuccgcccugccacuca

SEQ ID NO: 2663347 - RNA, 15 nt, Human
cuccgcccugccacu

SEQ ID NO: 2663348 - RNA, 16 nt, Human
cuccgcccugccacuc

SEQ ID NO: 2663349 - RNA, 17 nt, Human
cuccuccagugugggcu

SEQ ID NO: 2663350 - RNA, 23 nt, Human
cuccuccagugugggcuugacca

SEQ ID NO: 2663351 - RNA, 13 nt, Human
cuccuccaggccu

SEQ ID NO: 2663352 - RNA, 14 nt, Human
cuccuccaggccug

SEQ ID NO: 2663353 - RNA, 15 nt, Human
cuccuccaggccugc

SEQ ID NO: 2663354 - RNA, 17 nt, Human
cuccuccaggccugccu

SEQ ID NO: 2663355 - RNA, 18 nt, Human
cuccuccaggccugccuc

SEQ ID NO: 2663356 - RNA, 19 nt, Human
cuccuccaggccugccucc

SEQ ID NO: 2663357 - RNA, 21 nt, Human
cuccuccaggccugccuccca

SEQ ID NO: 2663358 - RNA, 23 nt, Human
cuccuccaggccugccucccacu

SEQ ID NO: 2663359 - RNA, 20 nt, Human
cuccucauggcagccuacuc

SEQ ID NO: 2663360 - RNA, 22 nt, Human
cuccuccagccgccaugcuccu

SEQ ID NO: 2663361 - RNA, 15 nt, Human
cuccuccccuuccuc

SEQ ID NO: 2663362 - RNA, 17 nt, Human
cuccuccccuuccucuu

SEQ ID NO: 2663363 - RNA, 14 nt, Human
cuccuccccaaauc

SEQ ID NO: 2663364 - RNA, 17 nt, Human
cuccuccccaaaucaau

SEQ ID NO: 2663365 - RNA, 21 nt, Human
cuccuguggccccacccuggg

SEQ ID NO: 2663366 - RNA, 22 nt, Human
cuccuguggccccacccugggc

SEQ ID NO: 2663367 - RNA, 13 nt, Human
cuccuguggcccc

SEQ ID NO: 2663368 - RNA, 19 nt, Human
cuccuguggccccacccug

SEQ ID NO: 2663369 - RNA, 20 nt, Human
cuccuguggccccacccugg

SEQ ID NO: 2663370 - RNA, 15 nt, Human
cuccugcacuuacuu

SEQ ID NO: 2663371 - RNA, 17 nt, Human
cuccugcacuuacuugc

SEQ ID NO: 2663372 - RNA, 18 nt, Human
cuccugcacuuacuugcu

SEQ ID NO: 2663373 - RNA, 19 nt, Human
cuccugcacuuacuugcuu

SEQ ID NO: 2663374 - RNA, 20 nt, Human
cuccugcacuuacuugcuua

SEQ ID NO: 2663375 - RNA, 22 nt, Human
cuccugcacuuacuugcuuauu

SEQ ID NO: 2663376 - RNA, 14 nt, Human
cuccugcagaccac

SEQ ID NO: 2663377 - RNA, 17 nt, Human
cucacuauccuacccca

SEQ ID NO: 2663378 - RNA, 21 nt, Human
cucccagguaccagcugcgcu

SEQ ID NO: 2663379 - RNA, 22 nt, Human
cucccagguaccagcugcgcuu

SEQ ID NO: 2663380 - RNA, 17 nt, Human
cucccagguaccagcug

SEQ ID NO: 2663381 - RNA, 18 nt, Human
cucccagguaccagcugc

SEQ ID NO: 2663382 - RNA, 19 nt, Human
cucccagguaccagcugcg

SEQ ID NO: 2663383 - RNA, 16 nt, Human
cucccagguaccagcu

SEQ ID NO: 2663384 - RNA, 24 nt, Human
cucccagguaccagcugcgcuugc

SEQ ID NO: 2663385 - RNA, 13 nt, Human
cucccaggggucu

SEQ ID NO: 2663386 - RNA, 16 nt, Human
cucccaggggucuccc

SEQ ID NO: 2663387 - RNA, 18 nt, Human
cucccaggggucucccug

SEQ ID NO: 2663388 - RNA, 19 nt, Human
cucccaggggucucccugg

SEQ ID NO: 2663389 - RNA, 20 nt, Human
cucccaggggucucccuggc

SEQ ID NO: 2663390 - RNA, 21 nt, Human
cucccaggggucucccuggcu

SEQ ID NO: 2663391 - RNA, 22 nt, Human
cucccaggggucucccuggcuc

SEQ ID NO: 2663392 - RNA, 23 nt, Human
cucccaggggucucccuggcucc

SEQ ID NO: 2663393 - RNA, 21 nt, Human
cuccccagccugcgccugcug

SEQ ID NO: 2663394 - RNA, 16 nt, Human
cuccccagccugcgcc

SEQ ID NO: 2663395 - RNA, 14 nt, Human
cuccccagccugcg

SEQ ID NO: 2663396 - RNA, 13 nt, Human
cuccccagccugc

SEQ ID NO: 2663397 - RNA, 12 nt, Human
cuccccagccug

SEQ ID NO: 2663398 - RNA, 11 nt, Human
cuccccacagc

SEQ ID NO: 2663399 - RNA, 15 nt, Human
cuccccacagcgucc

SEQ ID NO: 2663400 - RNA, 18 nt, Human
cuccccacagcgucccug

SEQ ID NO: 2663401 - RNA, 19 nt, Human
cuccccacagcgucccugg

SEQ ID NO: 2663402 - RNA, 20 nt, Human
cuccccacagcgucccuggc

SEQ ID NO: 2663403 - RNA, 21 nt, Human
cuccccaaaucaauacacuag

SEQ ID NO: 2663404 - RNA, 18 nt, Human
cucccgggccccacagac

SEQ ID NO: 2663405 - RNA, 22 nt, Human
cugagccagugcuuuaauggca

SEQ ID NO: 2663406 - RNA, 18 nt, Human
cugagcccuacucccugc

SEQ ID NO: 2663407 - RNA, 20 nt, Human
cugagcccuacucccugcag

SEQ ID NO: 2663408 - RNA, 21 nt, Human
cugagcccuacucccugcaga

SEQ ID NO: 2663409 - RNA, 22 nt, Human
cugagcccuacucccugcagau

SEQ ID NO: 2663410 - RNA, 23 nt, Human
cugagcccuacucccugcagaug

SEQ ID NO: 2663411 - RNA, 18 nt, Human
cugagccggccccaggcu

SEQ ID NO: 2663412 - RNA, 19 nt, Human
cugagccggccccaggcuc

SEQ ID NO: 2663413 - RNA, 23 nt, Human
cugagccggccccaggcucgugg

SEQ ID NO: 2663414 - RNA, 16 nt, Human
cugagccggccccagg

SEQ ID NO: 2663415 - RNA, 12 nt, Human
cugagccucugc

SEQ ID NO: 2663416 - RNA, 18 nt, Human
cugagccucugcucccca

SEQ ID NO: 2663417 - RNA, 16 nt, Human
cugagccucugcuccc

SEQ ID NO: 2663418 - RNA, 15 nt, Human
cugagccucugcucc

SEQ ID NO: 2663419 - RNA, 14 nt, Human
cugagccucugcuc

SEQ ID NO: 2663420 - RNA, 14 nt, Human
cugagccugcaggg

SEQ ID NO: 2663421 - RNA, 15 nt, Human
cugagccugcaggga

SEQ ID NO: 2663422 - RNA, 18 nt, Human
cugagccugcagggaagc

SEQ ID NO: 2663423 - RNA, 19 nt, Human
cugagccugcagggaagcc

SEQ ID NO: 2663424 - RNA, 22 nt, Human
cugagcgccuccauccaaggcc

SEQ ID NO: 2663425 - RNA, 13 nt, Human
cugagcgccucca

SEQ ID NO: 2663426 - RNA, 15 nt, Human
cugagcgccuccauc

SEQ ID NO: 2663427 - RNA, 16 nt, Human
cugaggaugaccagaa

SEQ ID NO: 2663428 - RNA, 22 nt, Human
cugaggauauucagauguaugu

SEQ ID NO: 2663429 - RNA, 13 nt, Human
cugaggcaggaga

SEQ ID NO: 2663430 - RNA, 17 nt, Human
cugaggcaguuugagga

SEQ ID NO: 2663431 - RNA, 18 nt, Human
cugacuguuuucucuuga

SEQ ID NO: 2663432 - RNA, 22 nt, Human
cugacuuagaaucccuguguua

SEQ ID NO: 2663433 - RNA, 12 nt, Human
cugacuuagaau

SEQ ID NO: 2663434 - RNA, 11 nt, Human
cugacuucugc

SEQ ID NO: 2663435 - RNA, 12 nt, Human
cugacuucugcc

SEQ ID NO: 2663436 - RNA, 13 nt, Human
cugacuucugccu

SEQ ID NO: 2663437 - RNA, 14 nt, Human
cugacuucugccug

SEQ ID NO: 2663438 - RNA, 15 nt, Human
cugacuucugccugg

SEQ ID NO: 2663439 - RNA, 16 nt, Human
cugacuucugccugga

SEQ ID NO: 2663440 - RNA, 18 nt, Human
cugacuucugccuggaga

SEQ ID NO: 2663441 - RNA, 19 nt, Human
cugacuucugccuggagac

SEQ ID NO: 2663442 - RNA, 16 nt, Human
cugacuguuuucucuu

SEQ ID NO: 2663443 - RNA, 16 nt, Human
cugacauaucuacacu

SEQ ID NO: 2663444 - RNA, 13 nt, Human
cugacaucuugaa

SEQ ID NO: 2663445 - RNA, 15 nt, Human
cugacaucuugaauc

SEQ ID NO: 2663446 - RNA, 21 nt, Human
cugacaucuugaauccuucca

SEQ ID NO: 2663447 - RNA, 22 nt, Human
cugacaucuugaauccuuccau

SEQ ID NO: 2663448 - RNA, 16 nt, Human
cugacaucuggaaucu

SEQ ID NO: 2663449 - RNA, 15 nt, Human
cugaagaugggagcc

SEQ ID NO: 2663450 - RNA, 17 nt, Human
cugaagaugggagccuu

SEQ ID NO: 2663451 - RNA, 14 nt, Human
cugacauuucuucu

SEQ ID NO: 2663452 - RNA, 18 nt, Human
cugacauuucuucuagug

SEQ ID NO: 2663453 - RNA, 13 nt, Human
cucuggagcccua

SEQ ID NO: 2663454 - RNA, 14 nt, Human
cucuggaggggagg

SEQ ID NO: 2663455 - RNA, 15 nt, Human
cucuggaggggaggg

SEQ ID NO: 2663456 - RNA, 21 nt, Human
cucuggaugauggauuccaca

SEQ ID NO: 2663457 - RNA, 16 nt, Human
cucuggaggggagggg

SEQ ID NO: 2663458 - RNA, 12 nt, Human
cucugccugccc

SEQ ID NO: 2663459 - RNA, 13 nt, Human
cucugccugcccc

SEQ ID NO: 2663460 - RNA, 21 nt, Human
cucugcuucucugacuucugc

SEQ ID NO: 2663461 - RNA, 16 nt, Human
cucugcuucucugacu

SEQ ID NO: 2663462 - RNA, 17 nt, Human
cucugcuucucugacuu

SEQ ID NO: 2663463 - RNA, 12 nt, Human
cucugcuucucu

SEQ ID NO: 2663464 - RNA, 13 nt, Human
cucugcuucucug

SEQ ID NO: 2663465 - RNA, 14 nt, Human
cucugcuucucuga

SEQ ID NO: 2663466 - RNA, 15 nt, Human
cucugcuucucugac

SEQ ID NO: 2663467 - RNA, 11 nt, Human
cucugccugcc

SEQ ID NO: 2663468 - RNA, 13 nt, Human
cucucuccucccu

SEQ ID NO: 2663469 - RNA, 18 nt, Human
cucuguguauuugcuuuu

SEQ ID NO: 2663470 - RNA, 19 nt, Human
cucuguguauuugcuuuuu

SEQ ID NO: 2663471 - RNA, 20 nt, Human
cucuguggcuccaggccaaa

SEQ ID NO: 2663472 - RNA, 11 nt, Human
cucuguggaug

SEQ ID NO: 2663473 - RNA, 15 nt, Human
cucuuagaaaaacca

SEQ ID NO: 2663474 - RNA, 13 nt, Human
cucuuagaaaaac

SEQ ID NO: 2663475 - RNA, 18 nt, Human
cucuucauuauucucugc

SEQ ID NO: 2663476 - RNA, 17 nt, Human
cucuucaucccauucca

SEQ ID NO: 2663477 - RNA, 19 nt, Human
cucuucaucccauuccagg

SEQ ID NO: 2663478 - RNA, 20 nt, Human
cucugugcagucacuggagg

SEQ ID NO: 2663479 - RNA, 11 nt, Human
cucugugagaa

SEQ ID NO: 2663480 - RNA, 19 nt, Human
cucugugagaagguuuauu

SEQ ID NO: 2663481 - RNA, 21 nt, Human
cucugugagaagguuuauugu

SEQ ID NO: 2663482 - RNA, 22 nt, Human
cucugugagaagguuuauuguu

SEQ ID NO: 2663483 - RNA, 23 nt, Human
cucugugagaagguuuauuguua

SEQ ID NO: 2663484 - RNA, 13 nt, Human
cucugugccuucg

SEQ ID NO: 2663485 - RNA, 15 nt, Human
cucugugccucccuc

SEQ ID NO: 2663486 - RNA, 22 nt, Human
cucugugccucccuccccagug

SEQ ID NO: 2663487 - RNA, 16 nt, Human
cucugugccuucuuuu

SEQ ID NO: 2663488 - RNA, 15 nt, Human
cucugugccuucuuu

SEQ ID NO: 2663489 - RNA, 13 nt, Human
cucugugcugugu

SEQ ID NO: 2663490 - RNA, 10 nt, Human
cucuggcuuu

SEQ ID NO: 2663491 - RNA, 15 nt, Human
cucuggcuuuuggaa

SEQ ID NO: 2663492 - RNA, 16 nt, Human
cucuggcuuuuggaag

SEQ ID NO: 2663493 - RNA, 16 nt, Human
cucuucuuggggccca

SEQ ID NO: 2663494 - RNA, 20 nt, Human
cucuucuuggggcccagugc

SEQ ID NO: 2663495 - RNA, 21 nt, Human
cucuucuuggggcccagugca

SEQ ID NO: 2663496 - RNA, 22 nt, Human
cucuucuuggggcccagugcau

SEQ ID NO: 2663497 - RNA, 20 nt, Human
cucuuccuaucccucuccua

SEQ ID NO: 2663498 - RNA, 23 nt, Human
cucuuuaaaaggaaagaaaacau

SEQ ID NO: 2663499 - RNA, 20 nt, Human
cucuuuaaaaggaaagaaaa

SEQ ID NO: 2663500 - RNA, 19 nt, Human
cucuuuaaaaggaaagaaa

SEQ ID NO: 2663501 - RNA, 13 nt, Human
cugaagaauugaa

SEQ ID NO: 2663502 - RNA, 18 nt, Human
cugaagaauugaaaaguu

SEQ ID NO: 2663503 - RNA, 19 nt, Human
cugaacacuuuuguuguaa

SEQ ID NO: 2663504 - RNA, 20 nt, Human
cugaacacuuuuguuguaaa

SEQ ID NO: 2663505 - RNA, 21 nt, Human
cugaaaucuucccaugcauuc

SEQ ID NO: 2663506 - RNA, 23 nt, Human
cugaaaucuucccaugcauucug

SEQ ID NO: 2663507 - RNA, 19 nt, Human
cugaaauucuccuggaggu

SEQ ID NO: 2663508 - RNA, 20 nt, Human
cugaaauucuccuggagguc

SEQ ID NO: 2663509 - RNA, 15 nt, Human
cugaaagcccugagc

SEQ ID NO: 2663510 - RNA, 11 nt, Human
cucuuugauua

SEQ ID NO: 2663511 - RNA, 13 nt, Human
cucuuugauuauu

SEQ ID NO: 2663512 - RNA, 14 nt, Human
cucuuugauuauuu

SEQ ID NO: 2663513 - RNA, 16 nt, Human
cucuuugauuauuugc

SEQ ID NO: 2663514 - RNA, 17 nt, Human
cucuuugauuauuugca

SEQ ID NO: 2663515 - RNA, 18 nt, Human
cucuuugauuauuugcau

SEQ ID NO: 2663516 - RNA, 19 nt, Human
cucuuugauuauuugcaug

SEQ ID NO: 2663517 - RNA, 20 nt, Human
cucuuugauuauuugcaugu

SEQ ID NO: 2663518 - RNA, 21 nt, Human
cucuuugauuauuugcauguu

SEQ ID NO: 2663519 - RNA, 16 nt, Human
cugaaauaggaaacaa

SEQ ID NO: 2663520 - RNA, 18 nt, Human
cugaaauaggaaacaagu

SEQ ID NO: 2663521 - RNA, 23 nt, Human
cugaaagcccugagcuuucugcu

SEQ ID NO: 2663522 - RNA, 19 nt, Human
cugaaagcccugagcuuuc

SEQ ID NO: 2663523 - RNA, 18 nt, Human
cugaaagcccugagcuuu

SEQ ID NO: 2663524 - RNA, 17 nt, Human
cugaaagcccugagcuu

SEQ ID NO: 2663525 - RNA, 16 nt, Human
cugaaagcccugagcu

SEQ ID NO: 2663526 - RNA, 16 nt, Human
cugcuccccaggggag

SEQ ID NO: 2663527 - RNA, 12 nt, Human
cugcugccucuu

SEQ ID NO: 2663528 - RNA, 13 nt, Human
cugcugccucuuu

SEQ ID NO: 2663529 - RNA, 17 nt, Human
cugcugccucuuucccu

SEQ ID NO: 2663530 - RNA, 20 nt, Human
cugcugccucuuucccuagg

SEQ ID NO: 2663531 - RNA, 21 nt, Human
cugcugccucuuucccuagga

SEQ ID NO: 2663532 - RNA, 22 nt, Human
cugcugccucuuucccuaggaa

SEQ ID NO: 2663533 - RNA, 15 nt, Human
cugcucuucauccca

SEQ ID NO: 2663534 - RNA, 21 nt, Human
cugcucuucaucccauuccag

SEQ ID NO: 2663535 - RNA, 17 nt, Human
cugcucucauauaagac

SEQ ID NO: 2663536 - RNA, 22 nt, Human
cugcccucucccaaaaaacuac

SEQ ID NO: 2663537 - RNA, 22 nt, Human
cugccugccuuaagugaggaaa

SEQ ID NO: 2663538 - RNA, 20 nt, Human
cugccugccuuaagugagga

SEQ ID NO: 2663539 - RNA, 18 nt, Human
cugccugccuuaagugag

SEQ ID NO: 2663540 - RNA, 17 nt, Human
cugccugccuuaaguga

SEQ ID NO: 2663541 - RNA, 15 nt, Human
cugccugcaccccug

SEQ ID NO: 2663542 - RNA, 13 nt, Human
cugccuucgcuuc

SEQ ID NO: 2663543 - RNA, 14 nt, Human
cugccuucgcuucu

SEQ ID NO: 2663544 - RNA, 15 nt, Human
cugccuucgcuucuu

SEQ ID NO: 2663545 - RNA, 17 nt, Human
cugccuucgcuucuugc

SEQ ID NO: 2663546 - RNA, 11 nt, Human
cugccuucccu

SEQ ID NO: 2663547 - RNA, 12 nt, Human
cugccuucccua

SEQ ID NO: 2663548 - RNA, 15 nt, Human
cugccuucccuagcu

SEQ ID NO: 2663549 - RNA, 16 nt, Human
cugccuucccuagcuu

SEQ ID NO: 2663550 - RNA, 17 nt, Human
cugccuucccuagcuuu

SEQ ID NO: 2663551 - RNA, 22 nt, Human
cugcgcccuuaacugcauccag

SEQ ID NO: 2663552 - RNA, 12 nt, Human
cugcgccugcug

SEQ ID NO: 2663553 - RNA, 13 nt, Human
cugcgccuuuccu

SEQ ID NO: 2663554 - RNA, 23 nt, Human
cugcgccugcugcaugcccucuc

SEQ ID NO: 2663555 - RNA, 20 nt, Human
cugcgccugcugcaugcccu

SEQ ID NO: 2663556 - RNA, 13 nt, Human
cugcgccugcugc

SEQ ID NO: 2663557 - RNA, 21 nt, Human
cugcgccuuuccuuuucgccu

SEQ ID NO: 2663558 - RNA, 17 nt, Human
cugcgcucucuuugcaa

SEQ ID NO: 2663559 - RNA, 18 nt, Human
cugcgcucucuuugcaac

SEQ ID NO: 2663560 - RNA, 22 nt, Human
cugcuugaggcaacucaucuua

SEQ ID NO: 2663561 - RNA, 22 nt, Human
cuggaagccaaaauguaggcuu

SEQ ID NO: 2663562 - RNA, 24 nt, Human
cugcuuuucugcccuggcugcugc

SEQ ID NO: 2663563 - RNA, 19 nt, Human
cugcuuuucugcccuggcu

SEQ ID NO: 2663564 - RNA, 20 nt, Human
cugcuuuucugcccuggcug

SEQ ID NO: 2663565 - RNA, 21 nt, Human
cugcuuuucugcccuggcugc

SEQ ID NO: 2663566 - RNA, 22 nt, Human
cugcuuuucugcccuggcugcu

SEQ ID NO: 2663567 - RNA, 13 nt, Human
cugcuuugaauaa

SEQ ID NO: 2663568 - RNA, 19 nt, Human
cugcuuugaauaaaugugu

SEQ ID NO: 2663569 - RNA, 16 nt, Human
cugcuuuagacuugaa

SEQ ID NO: 2663570 - RNA, 14 nt, Human
cugcuuuagacuug

SEQ ID NO: 2663571 - RNA, 20 nt, Human
cugcuuuagacuugaaaaga

SEQ ID NO: 2663572 - RNA, 19 nt, Human
cugcuuuagacuugaaaag

SEQ ID NO: 2663573 - RNA, 17 nt, Human
cugcuuuagacuugaaa

SEQ ID NO: 2663574 - RNA, 15 nt, Human
cugcuggugcacagc

SEQ ID NO: 2663575 - RNA, 15 nt, Human
cugcugucauaacau

SEQ ID NO: 2663576 - RNA, 18 nt, Human
cugcuuccuccuggaaau

SEQ ID NO: 2663577 - RNA, 22 nt, Human
cugcuugaauaaacaccacugg

SEQ ID NO: 2663578 - RNA, 23 nt, Human
cugcuucucugacuucugccugg

SEQ ID NO: 2663579 - RNA, 21 nt, Human
cugcuucucugacuucugccu

SEQ ID NO: 2663580 - RNA, 22 nt, Human
cugcuucucugacuucugccug

SEQ ID NO: 2663581 - RNA, 13 nt, Human
cugcuucucugac

SEQ ID NO: 2663582 - RNA, 14 nt, Human
cugcuucucugacu

SEQ ID NO: 2663583 - RNA, 15 nt, Human
cugcuucucugacuu

SEQ ID NO: 2663584 - RNA, 16 nt, Human
cugcuucucugacuuc

SEQ ID NO: 2663585 - RNA, 17 nt, Human
cugcuucucugacuucu

SEQ ID NO: 2663586 - RNA, 19 nt, Human
cugcuucucugacuucugc

SEQ ID NO: 2663587 - RNA, 20 nt, Human
cugcuucucugacuucugcc

SEQ ID NO: 2663588 - RNA, 21 nt, Human
cugcuugaggcaacucaucuu

SEQ ID NO: 2663589 - RNA, 20 nt, Human
cugcuugaggcaacucaucu

SEQ ID NO: 2663590 - RNA, 13 nt, Human
cugcuugaggcaa

SEQ ID NO: 2663591 - RNA, 16 nt, Human
cugcugguccguggga

SEQ ID NO: 2663592 - RNA, 17 nt, Human
cugcugguccgugggac

SEQ ID NO: 2663593 - RNA, 17 nt, Human
cugcuggggauccccgc

SEQ ID NO: 2663594 - RNA, 21 nt, Human
cugcuggggauccccgccugg

SEQ ID NO: 2663595 - RNA, 22 nt, Human
cugcuggggauccccgccuggc

SEQ ID NO: 2663596 - RNA, 20 nt, Human
cugcugggggcaacuggcca

SEQ ID NO: 2663597 - RNA, 18 nt, Human
cugcugggggcaacuggc

SEQ ID NO: 2663598 - RNA, 14 nt, Human
cugcugcugcugug

SEQ ID NO: 2663599 - RNA, 16 nt, Human
cugcagcaccgagggg

SEQ ID NO: 2663600 - RNA, 18 nt, Human
cugcagcaccgaggggcc

SEQ ID NO: 2663601 - RNA, 19 nt, Human
cugcagcaccgaggggccu

SEQ ID NO: 2663602 - RNA, 22 nt, Human
cugcagcaccgaggggccuuug

SEQ ID NO: 2663603 - RNA, 18 nt, Human
cugcaguccuacucaagc

SEQ ID NO: 2663604 - RNA, 22 nt, Human
cugcaguccuacucaagcgggu

SEQ ID NO: 2663605 - RNA, 23 nt, Human
cugcaguccuacucaagcgggug

SEQ ID NO: 2663606 - RNA, 21 nt, Human
cugcaguuugagacaggagac

SEQ ID NO: 2663607 - RNA, 18 nt, Human
cugcaguucuacucaggc

SEQ ID NO: 2663608 - RNA, 20 nt, Human
cugcaguucuacucaggcug

SEQ ID NO: 2663609 - RNA, 23 nt, Human
cugcaguucuacucaggcuggug

SEQ ID NO: 2663610 - RNA, 19 nt, Human
cugcaguuugagacaggag

SEQ ID NO: 2663611 - RNA, 22 nt, Human
cugcaggucaaguugucagguu

SEQ ID NO: 2663612 - RNA, 14 nt, Human
cugcacuccucagg

SEQ ID NO: 2663613 - RNA, 15 nt, Human
cugcagaccacgccc

SEQ ID NO: 2663614 - RNA, 11 nt, Human
cugcagaggcc

SEQ ID NO: 2663615 - RNA, 13 nt, Human
cugcagaggccag

SEQ ID NO: 2663616 - RNA, 21 nt, Human
cugcagaggccagaggccccc

SEQ ID NO: 2663617 - RNA, 17 nt, Human
cugcagaggccagaggc

SEQ ID NO: 2663618 - RNA, 20 nt, Human
cugcagaggccagaggcccc

SEQ ID NO: 2663619 - RNA, 20 nt, Human
cugcacuccagccuggguga

SEQ ID NO: 2663620 - RNA, 22 nt, Human
cugcauaaaaaggucuuuaaaa

SEQ ID NO: 2663621 - RNA, 15 nt, Human
cugccagacuuaaaa

SEQ ID NO: 2663622 - RNA, 23 nt, Human
cugccauggcuagguagaaguga

SEQ ID NO: 2663623 - RNA, 14 nt, Human
cugccaucuagcca

SEQ ID NO: 2663624 - RNA, 17 nt, Human
cugccaucuagccagcc

SEQ ID NO: 2663625 - RNA, 20 nt, Human
cugccaucuagccagccccu

SEQ ID NO: 2663626 - RNA, 20 nt, Human
cugcccggcaggguccuaga

SEQ ID NO: 2663627 - RNA, 13 nt, Human
cugcccggcaggg

SEQ ID NO: 2663628 - RNA, 15 nt, Human
cugccauuucugaga

SEQ ID NO: 2663629 - RNA, 22 nt, Human
cugccauuacagagguauuaaa

SEQ ID NO: 2663630 - RNA, 23 nt, Human
cugccauuacagagguauuaaaa

SEQ ID NO: 2663631 - RNA, 15 nt, Human
cugcccaccugccgg

SEQ ID NO: 2663632 - RNA, 12 nt, Human
cugcccaccugc

SEQ ID NO: 2663633 - RNA, 16 nt, Human
cuggcuuuaagccuuc

SEQ ID NO: 2663634 - RNA, 17 nt, Human
cuggcuuuaagccuuca

SEQ ID NO: 2663635 - RNA, 15 nt, Human
cuggcuuuugagcac

SEQ ID NO: 2663636 - RNA, 14 nt, Human
cuggcuuuuggaag

SEQ ID NO: 2663637 - RNA, 14 nt, Human
cuggcuuuuauuaa

SEQ ID NO: 2663638 - RNA, 22 nt, Human
cuggcuuuuauuaaugcacuuu

SEQ ID NO: 2663639 - RNA, 23 nt, Human
cuggcuuuuauuaaugcacuuuc

SEQ ID NO: 2663640 - RNA, 15 nt, Human
cuggcugcugccccc

SEQ ID NO: 2663641 - RNA, 16 nt, Human
cuggcugcugccccca

SEQ ID NO: 2663642 - RNA, 17 nt, Human
cuggcugcugcccccac

SEQ ID NO: 2663643 - RNA, 19 nt, Human
cuggcugcugcccccaccc

SEQ ID NO: 2663644 - RNA, 13 nt, Human
cuggcgcaggugg

SEQ ID NO: 2663645 - RNA, 14 nt, Human
cuggcgcagguggg

SEQ ID NO: 2663646 - RNA, 16 nt, Human
cuggcgcaggugggcu

SEQ ID NO: 2663647 - RNA, 14 nt, Human
cuggccuuuguaag

SEQ ID NO: 2663648 - RNA, 19 nt, Human
cuggccuuuguaagugcag

SEQ ID NO: 2663649 - RNA, 23 nt, Human
cuggcgagagucuggcccuagac

SEQ ID NO: 2663650 - RNA, 24 nt, Human
cuggcgcagaacgaaccuuggccu

SEQ ID NO: 2663651 - RNA, 23 nt, Human
cuggcgcagaacgaaccuuggcc

SEQ ID NO: 2663652 - RNA, 19 nt, Human
cuggcgagagucuggcccu

SEQ ID NO: 2663653 - RNA, 23 nt, Human
cuggcuguucugugguuccucug

SEQ ID NO: 2663654 - RNA, 19 nt, Human
cuggcugucaguaugacau

SEQ ID NO: 2663655 - RNA, 21 nt, Human
cugggaugaaacuaaagcaau

SEQ ID NO: 2663656 - RNA, 11 nt, Human
cugggcccugg

SEQ ID NO: 2663657 - RNA, 13 nt, Human
cugggccccagcu

SEQ ID NO: 2663658 - RNA, 15 nt, Human
cugggccgcugccac

SEQ ID NO: 2663659 - RNA, 16 nt, Human
cugggccgcugccacg

SEQ ID NO: 2663660 - RNA, 21 nt, Human
cugggccguaucuccggcucc

SEQ ID NO: 2663661 - RNA, 18 nt, Human
cugggccguaucuccggc

SEQ ID NO: 2663662 - RNA, 24 nt, Human
cugggccguaucuccggcucccag

SEQ ID NO: 2663663 - RNA, 13 nt, Human
cugggcccugggc

SEQ ID NO: 2663664 - RNA, 14 nt, Human
cugggcccugggcu

SEQ ID NO: 2663665 - RNA, 15 nt, Human
cugggcccugggcug

SEQ ID NO: 2663666 - RNA, 16 nt, Human
cugggcccugggcugg

SEQ ID NO: 2663667 - RNA, 18 nt, Human
cugggcccugggcuggaa

SEQ ID NO: 2663668 - RNA, 21 nt, Human
cugggaggucaaggcugcagu

SEQ ID NO: 2663669 - RNA, 19 nt, Human
cugggaggucaaggcugca

SEQ ID NO: 2663670 - RNA, 21 nt, Human
cugggagcuccacucugcuuc

SEQ ID NO: 2663671 - RNA, 16 nt, Human
cugggagcuccacucu

SEQ ID NO: 2663672 - RNA, 17 nt, Human
cugggagcuccacucug

SEQ ID NO: 2663673 - RNA, 20 nt, Human
cugggagcuccacucugcuu

SEQ ID NO: 2663674 - RNA, 14 nt, Human
cugggaggagggag

SEQ ID NO: 2663675 - RNA, 15 nt, Human
cugggaggagggaga

SEQ ID NO: 2663676 - RNA, 16 nt, Human
cugggaggagggagag

SEQ ID NO: 2663677 - RNA, 17 nt, Human
cugggaggagggagagg

SEQ ID NO: 2663678 - RNA, 19 nt, Human
cugggaggagggagaggga

SEQ ID NO: 2663679 - RNA, 20 nt, Human
cugggaggagggagagggag

SEQ ID NO: 2663680 - RNA, 23 nt, Human
cugggaggagggagagggagguc

SEQ ID NO: 2663681 - RNA, 23 nt, Human
cuggccuggacaguaucccacau

SEQ ID NO: 2663682 - RNA, 14 nt, Human
cuggccucucuagc

SEQ ID NO: 2663683 - RNA, 16 nt, Human
cuggccucucuagcac

SEQ ID NO: 2663684 - RNA, 17 nt, Human
cuggccucucuagcaca

SEQ ID NO: 2663685 - RNA, 18 nt, Human
cuggccucucuagcacaa

SEQ ID NO: 2663686 - RNA, 20 nt, Human
cuggccccagguagaaacuu

SEQ ID NO: 2663687 - RNA, 17 nt, Human
cuggcccccaaccucag

SEQ ID NO: 2663688 - RNA, 18 nt, Human
cuggcccccaaccucagg

SEQ ID NO: 2663689 - RNA, 22 nt, Human
cuggcccccaaccucagggcuc

SEQ ID NO: 2663690 - RNA, 23 nt, Human
cuggcccccaaccucagggcucc

SEQ ID NO: 2663691 - RNA, 13 nt, Human
cuggccaggagca

SEQ ID NO: 2663692 - RNA, 14 nt, Human
cuggccaggagcag

SEQ ID NO: 2663693 - RNA, 15 nt, Human
cuggccaggagcagg

SEQ ID NO: 2663694 - RNA, 23 nt, Human
cuggccaggagcaggcacgggug

SEQ ID NO: 2663695 - RNA, 12 nt, Human
cuggccaggagc

SEQ ID NO: 2663696 - RNA, 17 nt, Human
cuggccaguccaggcug

SEQ ID NO: 2663697 - RNA, 15 nt, Human
cuggccaguccaggc

SEQ ID NO: 2663698 - RNA, 16 nt, Human
cuggccaguccaggcu

SEQ ID NO: 2663699 - RNA, 18 nt, Human
cuggccaguccacccugc

SEQ ID NO: 2663700 - RNA, 20 nt, Human
cuggccaguccacccugccu

SEQ ID NO: 2663701 - RNA, 22 nt, Human
cuggccaguccacccugccugc

SEQ ID NO: 2663702 - RNA, 23 nt, Human
cuggcaucgcaccauucugacuc

SEQ ID NO: 2663703 - RNA, 21 nt, Human
cuggcaucuaauucugauucu

SEQ ID NO: 2663704 - RNA, 18 nt, Human
cuggcaucuuagaccucc

SEQ ID NO: 2663705 - RNA, 14 nt, Human
cuggcaagaaugug

SEQ ID NO: 2663706 - RNA, 24 nt, Human
cuggaaucuggagaccagggagcc

SEQ ID NO: 2663707 - RNA, 23 nt, Human
cuggaaucaggaauauuuuccaa

SEQ ID NO: 2663708 - RNA, 17 nt, Human
cuggaaucuggagacca

SEQ ID NO: 2663709 - RNA, 19 nt, Human
cuggaaucuggagaccagg

SEQ ID NO: 2663710 - RNA, 18 nt, Human
cuggaaucuggagaccag

SEQ ID NO: 2663711 - RNA, 19 nt, Human
cuggcacccaccguggagg

SEQ ID NO: 2663712 - RNA, 19 nt, Human
cuggcaaggacuuuguaca

SEQ ID NO: 2663713 - RNA, 20 nt, Human
cuggcaaggacuuuguacau

SEQ ID NO: 2663714 - RNA, 18 nt, Human
cugguaggaccaagcauc

SEQ ID NO: 2663715 - RNA, 15 nt, Human
cugguaggaccaagc

SEQ ID NO: 2663716 - RNA, 17 nt, Human
cugguaggaccaagcau

SEQ ID NO: 2663717 - RNA, 13 nt, Human
cuggguugggggc

SEQ ID NO: 2663718 - RNA, 23 nt, Human
cuggguugggggcuagggagacg

SEQ ID NO: 2663719 - RNA, 20 nt, Human
cugggccgggacccagggcc

SEQ ID NO: 2663720 - RNA, 20 nt, Human
cugguuauugauguggcccu

SEQ ID NO: 2663721 - RNA, 20 nt, Human
cugguucauucuucagauau

SEQ ID NO: 2663722 - RNA, 23 nt, Human
cugguuccagggucccucugugu

SEQ ID NO: 2663723 - RNA, 13 nt, Human
cugguuccagggu

SEQ ID NO: 2663724 - RNA, 14 nt, Human
cugguuccaggguc

SEQ ID NO: 2663725 - RNA, 15 nt, Human
cugguuccagggucc

SEQ ID NO: 2663726 - RNA, 16 nt, Human
cugguuccaggguccc

SEQ ID NO: 2663727 - RNA, 18 nt, Human
cugguuccagggucccuc

SEQ ID NO: 2663728 - RNA, 22 nt, Human
cugguuccagggucccucugug

SEQ ID NO: 2663729 - RNA, 14 nt, Human
cugguguuucuuga

SEQ ID NO: 2663730 - RNA, 13 nt, Human
cugguguuucuug

SEQ ID NO: 2663731 - RNA, 20 nt, Human
cugguggagaacucuggcuu

SEQ ID NO: 2663732 - RNA, 21 nt, Human
cugguggagaacucuggcuuu

SEQ ID NO: 2663733 - RNA, 17 nt, Human
cugucccuugcuugccu

SEQ ID NO: 2663734 - RNA, 18 nt, Human
cugucccuugcuugccug

SEQ ID NO: 2663735 - RNA, 23 nt, Human
cugucccuugcuugccugcaggg

SEQ ID NO: 2663736 - RNA, 22 nt, Human
cugucucaaaaaaagaaaaaga

SEQ ID NO: 2663737 - RNA, 22 nt, Human
cugucccagugccgagaaggaa

SEQ ID NO: 2663738 - RNA, 19 nt, Human
cugucccauagucccugcc

SEQ ID NO: 2663739 - RNA, 18 nt, Human
cugucccauagucccugc

SEQ ID NO: 2663740 - RNA, 14 nt, Human
cuguccacgcgugc

SEQ ID NO: 2663741 - RNA, 19 nt, Human
cuguccacgcgugccgugg

SEQ ID NO: 2663742 - RNA, 13 nt, Human
cuguauuugaaag

SEQ ID NO: 2663743 - RNA, 16 nt, Human
cuguauuugaaagugc

SEQ ID NO: 2663744 - RNA, 14 nt, Human
cuguauuugaaagu

SEQ ID NO: 2663745 - RNA, 21 nt, Human
cuguauuugaaagugccuuug

SEQ ID NO: 2663746 - RNA, 20 nt, Human
cuguauuugaaagugccuuu

SEQ ID NO: 2663747 - RNA, 19 nt, Human
cuguauuugaaagugccuu

SEQ ID NO: 2663748 - RNA, 17 nt, Human
cuguauuugaaagugcc

SEQ ID NO: 2663749 - RNA, 18 nt, Human
cuguauuugaaauaagaa

SEQ ID NO: 2663750 - RNA, 22 nt, Human
cuguauuugaaauaagaauuca

SEQ ID NO: 2663751 - RNA, 15 nt, Human
cuguauauaaaggug

SEQ ID NO: 2663752 - RNA, 14 nt, Human
gaacuugaaugugu

SEQ ID NO: 2663753 - RNA, 17 nt, Human
gaacuugggccacugug

SEQ ID NO: 2663754 - RNA, 14 nt, Human
gaagaagcucucuc

SEQ ID NO: 2663755 - RNA, 13 nt, Human
gaagaacaggccu

SEQ ID NO: 2663756 - RNA, 19 nt, Human
gaagaacaggccucuccau

SEQ ID NO: 2663757 - RNA, 21 nt, Human
gaagagcgcaguguuuugcaa

SEQ ID NO: 2663758 - RNA, 17 nt, Human
gaagagcuauuauauaa

SEQ ID NO: 2663759 - RNA, 17 nt, Human
gaagaggaaaaggcugg

SEQ ID NO: 2663760 - RNA, 12 nt, Human
gaagagccuugc

SEQ ID NO: 2663761 - RNA, 18 nt, Human
gaagaagggagaagaaag

SEQ ID NO: 2663762 - RNA, 19 nt, Human
gaagaagggagaagaaagg

SEQ ID NO: 2663763 - RNA, 14 nt, Human
gaagaagggagaag

SEQ ID NO: 2663764 - RNA, 15 nt, Human
gaagaagggagaaga

SEQ ID NO: 2663765 - RNA, 16 nt, Human
gaagaagggagaagaa

SEQ ID NO: 2663766 - RNA, 17 nt, Human
gaagaagggagaagaaa

SEQ ID NO: 2663767 - RNA, 22 nt, Human
gaagaugcuccagcaacacagc

SEQ ID NO: 2663768 - RNA, 14 nt, Human
gaagauccugcggg

SEQ ID NO: 2663769 - RNA, 22 nt, Human
gaagauccugcggguggggcuu

SEQ ID NO: 2663770 - RNA, 19 nt, Human
gaagaucauuuugaaauug

SEQ ID NO: 2663771 - RNA, 21 nt, Human
gaagauccagcugccuauuga

SEQ ID NO: 2663772 - RNA, 20 nt, Human
gaagaguucccuugaaacuu

SEQ ID NO: 2663773 - RNA, 21 nt, Human
gaagaguucccuugaaacuuu

SEQ ID NO: 2663774 - RNA, 10 nt, Human
gaagccaaag

SEQ ID NO: 2663775 - RNA, 12 nt, Human
gaagccaaagaa

SEQ ID NO: 2663776 - RNA, 13 nt, Human
gaagccaaagaaa

SEQ ID NO: 2663777 - RNA, 14 nt, Human
gaagccaaagaaaa

SEQ ID NO: 2663778 - RNA, 16 nt, Human
gaagccaaagaaaaau

SEQ ID NO: 2663779 - RNA, 16 nt, Human
gaagccuucagcucca

SEQ ID NO: 2663780 - RNA, 17 nt, Human
gaagccuucagcuccag

SEQ ID NO: 2663781 - RNA, 15 nt, Human
gaagccuucagcucc

SEQ ID NO: 2663782 - RNA, 22 nt, Human
gaagccuguaacacuccucugc

SEQ ID NO: 2663783 - RNA, 16 nt, Human
gaagcuucaugcacuu

SEQ ID NO: 2663784 - RNA, 20 nt, Human
gaaggaagccggggaagaga

SEQ ID NO: 2663785 - RNA, 15 nt, Human
gaaguauuuuuagaa

SEQ ID NO: 2663786 - RNA, 17 nt, Human
gaaguauuuuuagaaua

SEQ ID NO: 2663787 - RNA, 19 nt, Human
gaaguauuuuuagaauaag

SEQ ID NO: 2663788 - RNA, 16 nt, Human
gaagucaauaugugga

SEQ ID NO: 2663789 - RNA, 21 nt, Human
gaaggaugaugucuuuuuauu

SEQ ID NO: 2663790 - RNA, 22 nt, Human
gaaauguaggcaucaugcaugu

SEQ ID NO: 2663791 - RNA, 18 nt, Human
gaaauguagguccucaga

SEQ ID NO: 2663792 - RNA, 19 nt, Human
gaaaugugaauuuuuauug

SEQ ID NO: 2663793 - RNA, 20 nt, Human
gaaaugugaauuuuuauugu

SEQ ID NO: 2663794 - RNA, 21 nt, Human
gaaaugugaauuuuuauuguu

SEQ ID NO: 2663795 - RNA, 15 nt, Human
gaaaugaggaggaug

SEQ ID NO: 2663796 - RNA, 11 nt, Human
gaaaugauguu

SEQ ID NO: 2663797 - RNA, 19 nt, Human
gaaauauauacaaaaagaa

SEQ ID NO: 2663798 - RNA, 16 nt, Human
gaaauaucaaagucau

SEQ ID NO: 2663799 - RNA, 23 nt, Human
gaaauaucaaagucauuaaagac

SEQ ID NO: 2663800 - RNA, 16 nt, Human
gaaauaaaauauaucu

SEQ ID NO: 2663801 - RNA, 19 nt, Human
gaaauaaaccaaaggaaaa

SEQ ID NO: 2663802 - RNA, 11 nt, Human
gaacaggacua

SEQ ID NO: 2663803 - RNA, 21 nt, Human
gaacagguuuuuuuguuuguu

SEQ ID NO: 2663804 - RNA, 20 nt, Human
gaacagagagacccuugugg

SEQ ID NO: 2663805 - RNA, 21 nt, Human
gaacagagagacccuuguggg

SEQ ID NO: 2663806 - RNA, 19 nt, Human
gaacaucuaacccacuaga

SEQ ID NO: 2663807 - RNA, 16 nt, Human
gaaccaaaucuggaag

SEQ ID NO: 2663808 - RNA, 17 nt, Human
gaaccaaaucuggaagc

SEQ ID NO: 2663809 - RNA, 18 nt, Human
gaacaugguuugacucau

SEQ ID NO: 2663810 - RNA, 14 nt, Human
gaacaugaaucaaa

SEQ ID NO: 2663811 - RNA, 15 nt, Human
gaacaugaaucaaaa

SEQ ID NO: 2663812 - RNA, 13 nt, Human
gaacaugcccccu

SEQ ID NO: 2663813 - RNA, 14 nt, Human
gaacaugcccccug

SEQ ID NO: 2663814 - RNA, 14 nt, Human
gaaagcaauaaaug

SEQ ID NO: 2663815 - RNA, 17 nt, Human
gaaagcaacaaagaaau

SEQ ID NO: 2663816 - RNA, 17 nt, Human
gaaacuccacaucugcc

SEQ ID NO: 2663817 - RNA, 16 nt, Human
gaaacuccacaucugc

SEQ ID NO: 2663818 - RNA, 15 nt, Human
gaaacuaguguacau

SEQ ID NO: 2663819 - RNA, 21 nt, Human
gaaacucacacuccccuaggg

SEQ ID NO: 2663820 - RNA, 19 nt, Human
gaaacuauauuuugucaua

SEQ ID NO: 2663821 - RNA, 14 nt, Human
gaaaaagauguaca

SEQ ID NO: 2663822 - RNA, 20 nt, Human
gaaaaagacuuuaaaaguga

SEQ ID NO: 2663823 - RNA, 16 nt, Human
gaaaaaugagccuggc

SEQ ID NO: 2663824 - RNA, 16 nt, Human
gaaaaaugcuccccac

SEQ ID NO: 2663825 - RNA, 17 nt, Human
gaaaaaugcuccccaca

SEQ ID NO: 2663826 - RNA, 22 nt, Human
gaaagcuuuauuuugagaugua

SEQ ID NO: 2663827 - RNA, 23 nt, Human
gaaagcuuugaauacuaaauuau

SEQ ID NO: 2663828 - RNA, 20 nt, Human
gaaagucagccauaucucca

SEQ ID NO: 2663829 - RNA, 15 nt, Human
gaaaggagguggggg

SEQ ID NO: 2663830 - RNA, 20 nt, Human
gaaaggcaggccuauuucau

SEQ ID NO: 2663831 - RNA, 21 nt, Human
gaaaguagggggcuuucuggg

SEQ ID NO: 2663832 - RNA, 19 nt, Human
gaaagugaagcaaaucaga

SEQ ID NO: 2663833 - RNA, 13 nt, Human
gaaagugcauuuu

SEQ ID NO: 2663834 - RNA, 14 nt, Human
gaaagugcauuuuu

SEQ ID NO: 2663835 - RNA, 20 nt, Human
gaaagugcauuuuuguaaau

SEQ ID NO: 2663836 - RNA, 20 nt, Human
gaaagugccuuugcagcuca

SEQ ID NO: 2663837 - RNA, 18 nt, Human
gaaagugccuuugcagcu

SEQ ID NO: 2663838 - RNA, 15 nt, Human
gaaagugccuuugca

SEQ ID NO: 2663839 - RNA, 22 nt, Human
gaaagugggcuuaauggaguuc

SEQ ID NO: 2663840 - RNA, 23 nt, Human
gaaagugccuuugcagcucagaa

SEQ ID NO: 2663841 - RNA, 19 nt, Human
gaaaguggucuuaagaaau

SEQ ID NO: 2663842 - RNA, 19 nt, Human
gaaaguguauaauaagaaa

SEQ ID NO: 2663843 - RNA, 23 nt, Human
gaaaguguguguaguuuuacuuu

SEQ ID NO: 2663844 - RNA, 20 nt, Human
gaaaguuucguuauauuaaa

SEQ ID NO: 2663845 - RNA, 13 nt, Human
gaaaguuuuguaa

SEQ ID NO: 2663846 - RNA, 15 nt, Human
gaaaguuuuguaaaa

SEQ ID NO: 2663847 - RNA, 17 nt, Human
gaaaguuuuguaaaaga

SEQ ID NO: 2663848 - RNA, 18 nt, Human
gaaaguuuuguaaaagaa

SEQ ID NO: 2663849 - RNA, 20 nt, Human
gaaaguuuuguaaaagaaau

SEQ ID NO: 2663850 - RNA, 21 nt, Human
gaaaguuuuguaaaagaaauc

SEQ ID NO: 2663851 - RNA, 11 nt, Human
gaaaguuuuuu

SEQ ID NO: 2663852 - RNA, 18 nt, Human
gaaaguuuuuuuuuauua

SEQ ID NO: 2663853 - RNA, 19 nt, Human
gaaaguuuuuuuuuauuau

SEQ ID NO: 2663854 - RNA, 15 nt, Human
cuuuuuuauuaauca

SEQ ID NO: 2663855 - RNA, 14 nt, Human
cuuuuuuauuaauc

SEQ ID NO: 2663856 - RNA, 13 nt, Human
cuuuuuuauuaau

SEQ ID NO: 2663857 - RNA, 16 nt, Human
gaaaaagaaaaaauau

SEQ ID NO: 2663858 - RNA, 11 nt, Human
gaaaaagaaaa

SEQ ID NO: 2663859 - RNA, 14 nt, Human
cuuuuuucaaaauc

SEQ ID NO: 2663860 - RNA, 22 nt, Human
cuuuuuucaaaauccaaaaaga

SEQ ID NO: 2663861 - RNA, 21 nt, Human
cuuuuuuauuaaucacugugu

SEQ ID NO: 2663862 - RNA, 20 nt, Human
cuuuuuuauuaaucacugug

SEQ ID NO: 2663863 - RNA, 19 nt, Human
cuuuuuuauuaaucacugu

SEQ ID NO: 2663864 - RNA, 17 nt, Human
cuuuuuuauuaaucacu

SEQ ID NO: 2663865 - RNA, 16 nt, Human
cuuuuuucaaaagaaa

SEQ ID NO: 2663866 - RNA, 13 nt, Human
cuuuuuucaaaau

SEQ ID NO: 2663867 - RNA, 17 nt, Human
cuuuuuccccuuucugu

SEQ ID NO: 2663868 - RNA, 14 nt, Human
cuuuucgccuuucc

SEQ ID NO: 2663869 - RNA, 15 nt, Human
cuuuucgccuuuccu

SEQ ID NO: 2663870 - RNA, 15 nt, Human
cuuuugcaaccagga

SEQ ID NO: 2663871 - RNA, 16 nt, Human
cuuuugcaaccaggaa

SEQ ID NO: 2663872 - RNA, 17 nt, Human
cuuuugcaaccaggaac

SEQ ID NO: 2663873 - RNA, 24 nt, Human
cuuuugcaaccaggaacagcaaau

SEQ ID NO: 2663874 - RNA, 16 nt, Human
cuuuuuaguaauuucu

SEQ ID NO: 2663875 - RNA, 20 nt, Human
cuuuuuaaggucuuucagua

SEQ ID NO: 2663876 - RNA, 20 nt, Human
cuuuuaacuuuauaaaucca

SEQ ID NO: 2663877 - RNA, 16 nt, Human
cuuuuaaaguugauau

SEQ ID NO: 2663878 - RNA, 22 nt, Human
cuuuuaacuguuguagaagaca

SEQ ID NO: 2663879 - RNA, 12 nt, Human
cuuuuaaagacc

SEQ ID NO: 2663880 - RNA, 18 nt, Human
cuuuuaaagacccuccua

SEQ ID NO: 2663881 - RNA, 22 nt, Human
cuuuuaaaugauugaauuauau

SEQ ID NO: 2663882 - RNA, 13 nt, Human
cuuuuaaaaugca

SEQ ID NO: 2663883 - RNA, 19 nt, Human
cuuuuaaaaugcaauguaa

SEQ ID NO: 2663884 - RNA, 21 nt, Human
cuuuggaccuaaauggccuca

SEQ ID NO: 2663885 - RNA, 18 nt, Human
cuuuuaaaaacauaacau

SEQ ID NO: 2663886 - RNA, 14 nt, Human
cuuuggaggugcug

SEQ ID NO: 2663887 - RNA, 15 nt, Human
cuuuuccuuggcauu

SEQ ID NO: 2663888 - RNA, 13 nt, Human
cuuuuccuuggca

SEQ ID NO: 2663889 - RNA, 19 nt, Human
cuuuuccacuccauugucg

SEQ ID NO: 2663890 - RNA, 15 nt, Human
cuuuucaccauucgu

SEQ ID NO: 2663891 - RNA, 22 nt, Human
cuuucauggcugcuguugcuua

SEQ ID NO: 2663892 - RNA, 23 nt, Human
cuuucaagcagucgugccugugu

SEQ ID NO: 2663893 - RNA, 12 nt, Human
cuuucaaagcuu

SEQ ID NO: 2663894 - RNA, 15 nt, Human
cuuucaaaggaacau

SEQ ID NO: 2663895 - RNA, 20 nt, Human
cuuuauuuuuuugaacucuu

SEQ ID NO: 2663896 - RNA, 17 nt, Human
cuuuauuuuuuugaacu

SEQ ID NO: 2663897 - RNA, 19 nt, Human
cuuucaagcagucgugccu

SEQ ID NO: 2663898 - RNA, 20 nt, Human
cuuucaagcagucgugccug

SEQ ID NO: 2663899 - RNA, 22 nt, Human
cuuucaagcagucgugccugug

SEQ ID NO: 2663900 - RNA, 17 nt, Human
cuuuauuuugagaugua

SEQ ID NO: 2663901 - RNA, 19 nt, Human
cuuuauuuugagauguaaa

SEQ ID NO: 2663902 - RNA, 22 nt, Human
cuuuauuuugagauguaaaaag

SEQ ID NO: 2663903 - RNA, 13 nt, Human
cuuuauuuugugu

SEQ ID NO: 2663904 - RNA, 14 nt, Human
cuuuauuuugugua

SEQ ID NO: 2663905 - RNA, 16 nt, Human
cuuuauuuuguguaaa

SEQ ID NO: 2663906 - RNA, 17 nt, Human
cuuuauuuuguguaaaa

SEQ ID NO: 2663907 - RNA, 18 nt, Human
cuuuauuuuguguaaaaa

SEQ ID NO: 2663908 - RNA, 22 nt, Human
cuugugucuuuggaggugcugc

SEQ ID NO: 2663909 - RNA, 23 nt, Human
cuugugucuuuggaggugcugcu

SEQ ID NO: 2663910 - RNA, 17 nt, Human
cuuucccccuucucuua

SEQ ID NO: 2663911 - RNA, 17 nt, Human
cuuucccauggggaggg

SEQ ID NO: 2663912 - RNA, 16 nt, Human
cuuuccaaaugcccag

SEQ ID NO: 2663913 - RNA, 13 nt, Human
cuuucuguugcca

SEQ ID NO: 2663914 - RNA, 15 nt, Human
cuuugccaugugcuu

SEQ ID NO: 2663915 - RNA, 19 nt, Human
cuuugccagucauucagca

SEQ ID NO: 2663916 - RNA, 16 nt, Human
cuuugaauaaaugugu

SEQ ID NO: 2663917 - RNA, 23 nt, Human
cuuugaauauguaguaucuauau

SEQ ID NO: 2663918 - RNA, 17 nt, Human
cuugcuuuaccuuuuca

SEQ ID NO: 2663919 - RNA, 19 nt, Human
cuugcuuuaccuuuucagg

SEQ ID NO: 2663920 - RNA, 20 nt, Human
cuugcuuuaccuuuucaggg

SEQ ID NO: 2663921 - RNA, 15 nt, Human
cuuggacauccuccu

SEQ ID NO: 2663922 - RNA, 16 nt, Human
cuuggacauccuccuc

SEQ ID NO: 2663923 - RNA, 22 nt, Human
cuuggacauccuccucccaccc

SEQ ID NO: 2663924 - RNA, 17 nt, Human
cuuggacauccuccucc

SEQ ID NO: 2663925 - RNA, 19 nt, Human
cuuggacauccuccuccca

SEQ ID NO: 2663926 - RNA, 20 nt, Human
cuuggacauccuccucccac

SEQ ID NO: 2663927 - RNA, 21 nt, Human
cuuggacauccuccucccacc

SEQ ID NO: 2663928 - RNA, 12 nt, Human
cuugcauguggu

SEQ ID NO: 2663929 - RNA, 12 nt, Human
cuugcuggcccc

SEQ ID NO: 2663930 - RNA, 13 nt, Human
cuugcuggcccca

SEQ ID NO: 2663931 - RNA, 14 nt, Human
cuugcuggccccag

SEQ ID NO: 2663932 - RNA, 15 nt, Human
cuugcuggccccagc

SEQ ID NO: 2663933 - RNA, 16 nt, Human
cuugcuggccccagcc

SEQ ID NO: 2663934 - RNA, 18 nt, Human
cuugcuggccccagcccu

SEQ ID NO: 2663935 - RNA, 20 nt, Human
cuugcuggccccagcccugc

SEQ ID NO: 2663936 - RNA, 21 nt, Human
cuugcuggccccagcccugcu

SEQ ID NO: 2663937 - RNA, 22 nt, Human
cuugcuggccccagcccugcug

SEQ ID NO: 2663938 - RNA, 12 nt, Human
cuuggcucagac

SEQ ID NO: 2663939 - RNA, 16 nt, Human
cuuggcucagacaugu

SEQ ID NO: 2663940 - RNA, 14 nt, Human
cuuggcucagacau

SEQ ID NO: 2663941 - RNA, 18 nt, Human
cuuggcucgaaucucugu

SEQ ID NO: 2663942 - RNA, 19 nt, Human
cuuggcucgaaucucugug

SEQ ID NO: 2663943 - RNA, 20 nt, Human
cuuggcucgaaucucugugc

SEQ ID NO: 2663944 - RNA, 21 nt, Human
cuuggcucgaaucucugugcc

SEQ ID NO: 2663945 - RNA, 22 nt, Human
cuuggcucgaaucucugugccu

SEQ ID NO: 2663946 - RNA, 14 nt, Human
cuugcagaacugua

SEQ ID NO: 2663947 - RNA, 22 nt, Human
cuuggauauauaggcuauuuuc

SEQ ID NO: 2663948 - RNA, 13 nt, Human
cuuggauuaaaua

SEQ ID NO: 2663949 - RNA, 15 nt, Human
cuuggauuaaauaca

SEQ ID NO: 2663950 - RNA, 12 nt, Human
cuuguaaagacu

SEQ ID NO: 2663951 - RNA, 13 nt, Human
cuuguaaagacug

SEQ ID NO: 2663952 - RNA, 14 nt, Human
cuuguaaagacugg

SEQ ID NO: 2663953 - RNA, 15 nt, Human
cuuguaaagacuggu

SEQ ID NO: 2663954 - RNA, 23 nt, Human
cuuguaaagacugguuuucugcc

SEQ ID NO: 2663955 - RNA, 14 nt, Human
cuugguuuuauggu

SEQ ID NO: 2663956 - RNA, 23 nt, Human
cuuggggccaccaaagcugccca

SEQ ID NO: 2663957 - RNA, 12 nt, Human
cuuggggcccag

SEQ ID NO: 2663958 - RNA, 15 nt, Human
cuuggggcccagugc

SEQ ID NO: 2663959 - RNA, 16 nt, Human
cuuggggcccagugca

SEQ ID NO: 2663960 - RNA, 17 nt, Human
cuuggggcccagugcau

SEQ ID NO: 2663961 - RNA, 19 nt, Human
cuuggggcccagugcaugg

SEQ ID NO: 2663962 - RNA, 21 nt, Human
cuuggggccaccaaagcugcc

SEQ ID NO: 2663963 - RNA, 22 nt, Human
cuuggggccaccaaagcugccc

SEQ ID NO: 2663964 - RNA, 19 nt, Human
cuuggggccaccaaagcug

SEQ ID NO: 2663965 - RNA, 13 nt, Human
cuuggcuucugug

SEQ ID NO: 2663966 - RNA, 17 nt, Human
cuuggcuucugugauga

SEQ ID NO: 2663967 - RNA, 14 nt, Human
cuuggcuuaaucau

SEQ ID NO: 2663968 - RNA, 19 nt, Human
cuuggcuuaaucauuuuca

SEQ ID NO: 2663969 - RNA, 21 nt, Human
cuuggcuucugugaugagcug

SEQ ID NO: 2663970 - RNA, 17 nt, Human
cuuguauuaaagacaga

SEQ ID NO: 2663971 - RNA, 18 nt, Human
cuuguaaaagacagugua

SEQ ID NO: 2663972 - RNA, 17 nt, Human
cuugcaagcaugcuugu

SEQ ID NO: 2663973 - RNA, 16 nt, Human
cuugcaagcaugcuug

SEQ ID NO: 2663974 - RNA, 18 nt, Human
cuugcaagcaugcuugug

SEQ ID NO: 2663975 - RNA, 12 nt, Human
cuugagggcugc

SEQ ID NO: 2663976 - RNA, 15 nt, Human
cuugaggccugaucu

SEQ ID NO: 2663977 - RNA, 17 nt, Human
cuugaggccugaucugc

SEQ ID NO: 2663978 - RNA, 21 nt, Human
cuugaggccugaucugcccau

SEQ ID NO: 2663979 - RNA, 13 nt, Human
cuugagcucagga

SEQ ID NO: 2663980 - RNA, 14 nt, Human
cuugagagggugga

SEQ ID NO: 2663981 - RNA, 20 nt, Human
cuugagaguagaugguuuga

SEQ ID NO: 2663982 - RNA, 21 nt, Human
cuugaccaggcugccucccuu

SEQ ID NO: 2663983 - RNA, 17 nt, Human
cuugaccaggcuuggcc

SEQ ID NO: 2663984 - RNA, 13 nt, Human
cuugaccaggcug

SEQ ID NO: 2663985 - RNA, 18 nt, Human
cuugaacuccuggacuca

SEQ ID NO: 2663986 - RNA, 21 nt, Human
cugucucucuucucagagugg

SEQ ID NO: 2663987 - RNA, 14 nt, Human
cuucuuuugauuau

SEQ ID NO: 2663988 - RNA, 13 nt, Human
cuucuuuugauua

SEQ ID NO: 2663989 - RNA, 16 nt, Human
cuucuuuugauuaugu

SEQ ID NO: 2663990 - RNA, 20 nt, Human
cuucuuuuuucaaaagaaag

SEQ ID NO: 2663991 - RNA, 19 nt, Human
cuucuuuuuucaaaagaaa

SEQ ID NO: 2663992 - RNA, 22 nt, Human
gacucaucaaucaaauaaguau

SEQ ID NO: 2663993 - RNA, 14 nt, Human
gacucagugcagau

SEQ ID NO: 2663994 - RNA, 20 nt, Human
gacucagugcagauggagag

SEQ ID NO: 2663995 - RNA, 16 nt, Human
gacucaggugggcccu

SEQ ID NO: 2663996 - RNA, 20 nt, Human
gacucaggugggcccucuga

SEQ ID NO: 2663997 - RNA, 9 nt, Human
gacuccagc

SEQ ID NO: 2663998 - RNA, 10 nt, Human
gacuccagcc

SEQ ID NO: 2663999 - RNA, 12 nt, Human
gacuccagccag

SEQ ID NO: 2664000 - RNA, 13 nt, Human
gacuccagccagc

SEQ ID NO: 2664001 - RNA, 14 nt, Human
gacuccagccagcg

SEQ ID NO: 2664002 - RNA, 15 nt, Human
gacuccagccagcgc

SEQ ID NO: 2664003 - RNA, 16 nt, Human
gacuccagccagcgcc

SEQ ID NO: 2664004 - RNA, 19 nt, Human
gacuccagccagcgccucc

SEQ ID NO: 2664005 - RNA, 20 nt, Human
gacuccagccagcgccuccc

SEQ ID NO: 2664006 - RNA, 21 nt, Human
gacuccagccagcgccucccu

SEQ ID NO: 2664007 - RNA, 22 nt, Human
gacuccagccagcgccucccuc

SEQ ID NO: 2664008 - RNA, 23 nt, Human
gacuccagccagcgccucccucc

SEQ ID NO: 2664009 - RNA, 16 nt, Human
gacucaucuuauaugg

SEQ ID NO: 2664010 - RNA, 15 nt, Human
gacuaauuuuacaug

SEQ ID NO: 2664011 - RNA, 18 nt, Human
gacuaauuuuacauguuu

SEQ ID NO: 2664012 - RNA, 23 nt, Human
gacuaauuuuacauguuuauaaa

SEQ ID NO: 2664013 - RNA, 17 nt, Human
gacuacucccccaggug

SEQ ID NO: 2664014 - RNA, 23 nt, Human
gacgguguuuugccauguuggcc

SEQ ID NO: 2664015 - RNA, 14 nt, Human
gaccuggaagaaca

SEQ ID NO: 2664016 - RNA, 20 nt, Human
gaccuggaagaacaggccuc

SEQ ID NO: 2664017 - RNA, 16 nt, Human
gaccuuguaaaagaca

SEQ ID NO: 2664018 - RNA, 18 nt, Human
gaccuuguaaaagacagu

SEQ ID NO: 2664019 - RNA, 16 nt, Human
gaccuuguuacuucug

SEQ ID NO: 2664020 - RNA, 17 nt, Human
gaccuuguuacuucuga

SEQ ID NO: 2664021 - RNA, 21 nt, Human
gacgaacauccaaccuuccca

SEQ ID NO: 2664022 - RNA, 21 nt, Human
gaccuuuccaccacagccagc

SEQ ID NO: 2664023 - RNA, 23 nt, Human
gaccuuuccaccacagccagcac

SEQ ID NO: 2664024 - RNA, 13 nt, Human
gaccuuuccacca

SEQ ID NO: 2664025 - RNA, 17 nt, Human
gaccuuuccaccacagc

SEQ ID NO: 2664026 - RNA, 18 nt, Human
gaccuuuccaccacagcc

SEQ ID NO: 2664027 - RNA, 18 nt, Human
gacgaggggugucuuggg

SEQ ID NO: 2664028 - RNA, 15 nt, Human
gacgaguugauuucc

SEQ ID NO: 2664029 - RNA, 17 nt, Human
gacgaguugauuuccuc

SEQ ID NO: 2664030 - RNA, 21 nt, Human
gacgucagauguuuaaaacac

SEQ ID NO: 2664031 - RNA, 18 nt, Human
gacggugcccaagccaga

SEQ ID NO: 2664032 - RNA, 23 nt, Human
gacggugcccaagccagaggcug

SEQ ID NO: 2664033 - RNA, 16 nt, Human
gacggugcccaagcca

SEQ ID NO: 2664034 - RNA, 22 nt, Human
gacguacaaguaguucuguauu

SEQ ID NO: 2664035 - RNA, 19 nt, Human
gacguacaaguaguucugu

SEQ ID NO: 2664036 - RNA, 18 nt, Human
gacguacaaguaguucug

SEQ ID NO: 2664037 - RNA, 16 nt, Human
gacguacaaguaguuc

SEQ ID NO: 2664038 - RNA, 15 nt, Human
gacgguuuccaggga

SEQ ID NO: 2664039 - RNA, 18 nt, Human
gacgguuuccagggaggg

SEQ ID NO: 2664040 - RNA, 22 nt, Human
gacgguuuccagggaggggccg

SEQ ID NO: 2664041 - RNA, 21 nt, Human
gaccugccaggcagggguggg

SEQ ID NO: 2664042 - RNA, 19 nt, Human
gaccugccaggcaggggug

SEQ ID NO: 2664043 - RNA, 20 nt, Human
gaccugccaggcaggggugg

SEQ ID NO: 2664044 - RNA, 16 nt, Human
gaccugccaggcaggg

SEQ ID NO: 2664045 - RNA, 17 nt, Human
gaccugccaggcagggg

SEQ ID NO: 2664046 - RNA, 18 nt, Human
gaccugccaggcaggggu

SEQ ID NO: 2664047 - RNA, 15 nt, Human
gaccugccaggcagg

SEQ ID NO: 2664048 - RNA, 13 nt, Human
gaccugaggcugu

SEQ ID NO: 2664049 - RNA, 14 nt, Human
gaccugaggcugug

SEQ ID NO: 2664050 - RNA, 15 nt, Human
gaccugaggcugugg

SEQ ID NO: 2664051 - RNA, 17 nt, Human
gaccugaggcugugguc

SEQ ID NO: 2664052 - RNA, 21 nt, Human
gacccugugacauggugccug

SEQ ID NO: 2664053 - RNA, 22 nt, Human
gacccugugacauggugccuga

SEQ ID NO: 2664054 - RNA, 20 nt, Human
gacccugugacauggugccu

SEQ ID NO: 2664055 - RNA, 17 nt, Human
gaccggacuuuucugca

SEQ ID NO: 2664056 - RNA, 15 nt, Human
gacccuuauaaaauc

SEQ ID NO: 2664057 - RNA, 17 nt, Human
gacccuuauaaaauccu

SEQ ID NO: 2664058 - RNA, 16 nt, Human
gaccgggcccuggguu

SEQ ID NO: 2664059 - RNA, 19 nt, Human
gaccgugaagauacuuugu

SEQ ID NO: 2664060 - RNA, 20 nt, Human
gaccggcggaccccagccau

SEQ ID NO: 2664061 - RNA, 19 nt, Human
gaccggcggaccccagcca

SEQ ID NO: 2664062 - RNA, 20 nt, Human
gaccuaaauggccucaugug

SEQ ID NO: 2664063 - RNA, 16 nt, Human
gaccuaaauggccuca

SEQ ID NO: 2664064 - RNA, 14 nt, Human
gaccaacugucacu

SEQ ID NO: 2664065 - RNA, 16 nt, Human
gacccaggguucccgc

SEQ ID NO: 2664066 - RNA, 15 nt, Human
gacccaggaaaggca

SEQ ID NO: 2664067 - RNA, 21 nt, Human
gacccaggaaaggcaggauug

SEQ ID NO: 2664068 - RNA, 23 nt, Human
gacccugucucaaaaaaagaaaa

SEQ ID NO: 2664069 - RNA, 19 nt, Human
gaccccggcuuccuuuccc

SEQ ID NO: 2664070 - RNA, 22 nt, Human
gaccccgguggcggccccagca

SEQ ID NO: 2664071 - RNA, 19 nt, Human
gacauggcuccggccucug

SEQ ID NO: 2664072 - RNA, 20 nt, Human
gacauggcuccggccucugc

SEQ ID NO: 2664073 - RNA, 14 nt, Human
gacauggugccuga

SEQ ID NO: 2664074 - RNA, 16 nt, Human
gacauggugccugaga

SEQ ID NO: 2664075 - RNA, 17 nt, Human
gacauggugccugagag

SEQ ID NO: 2664076 - RNA, 18 nt, Human
gacauggugccugagagg

SEQ ID NO: 2664077 - RNA, 19 nt, Human
gacauggugccugagaggc

SEQ ID NO: 2664078 - RNA, 20 nt, Human
gacauggugccugagaggca

SEQ ID NO: 2664079 - RNA, 21 nt, Human
gacauggugccugagaggcag

SEQ ID NO: 2664080 - RNA, 22 nt, Human
gacauggugccugagaggcagg

SEQ ID NO: 2664081 - RNA, 23 nt, Human
gacauggugccugagaggcaggc

SEQ ID NO: 2664082 - RNA, 19 nt, Human
gacaucuggaaucuggaga

SEQ ID NO: 2664083 - RNA, 18 nt, Human
gacaucuggaaucuggag

SEQ ID NO: 2664084 - RNA, 14 nt, Human
gacaucuggaaucu

SEQ ID NO: 2664085 - RNA, 15 nt, Human
gacaucuugaauccu

SEQ ID NO: 2664086 - RNA, 22 nt, Human
gacaucuggaaucuggagacca

SEQ ID NO: 2664087 - RNA, 20 nt, Human
gacaucuggaaucuggagac

SEQ ID NO: 2664088 - RNA, 15 nt, Human
gacauaucaucugug

SEQ ID NO: 2664089 - RNA, 14 nt, Human
gacauaucuacacu

SEQ ID NO: 2664090 - RNA, 19 nt, Human
gacaucaaacucaaugcuu

SEQ ID NO: 2664091 - RNA, 18 nt, Human
gacacggguggggaaagg

SEQ ID NO: 2664092 - RNA, 15 nt, Human
gacagcuugagccgg

SEQ ID NO: 2664093 - RNA, 21 nt, Human
gacaggagaccuggcacugga

SEQ ID NO: 2664094 - RNA, 18 nt, Human
gacaggagaccuggcacu

SEQ ID NO: 2664095 - RNA, 18 nt, Human
gacagccaaaggcuggcg

SEQ ID NO: 2664096 - RNA, 17 nt, Human
gacagccaaaggcuggc

SEQ ID NO: 2664097 - RNA, 16 nt, Human
gacagccaaaggcugg

SEQ ID NO: 2664098 - RNA, 20 nt, Human
gacaagauuuuuuaauuguu

SEQ ID NO: 2664099 - RNA, 18 nt, Human
gacaagagaugggaauga

SEQ ID NO: 2664100 - RNA, 14 nt, Human
gacaagagauggga

SEQ ID NO: 2664101 - RNA, 20 nt, Human
gacaagagaugggaaugagg

SEQ ID NO: 2664102 - RNA, 16 nt, Human
gacaauaaacccucag

SEQ ID NO: 2664103 - RNA, 22 nt, Human
gacaauaaacccucagagccuc

SEQ ID NO: 2664104 - RNA, 13 nt, Human
gacaauaaagcuu

SEQ ID NO: 2664105 - RNA, 14 nt, Human
gacaauaaagcuug

SEQ ID NO: 2664106 - RNA, 19 nt, Human
gacaauaaagcuuguugac

SEQ ID NO: 2664107 - RNA, 15 nt, Human
gacaauacugggguu

SEQ ID NO: 2664108 - RNA, 15 nt, Human
gacaauugucuuuuu

SEQ ID NO: 2664109 - RNA, 22 nt, Human
gacacaaguggaccuuaggccu

SEQ ID NO: 2664110 - RNA, 14 nt, Human
gacacacagccuag

SEQ ID NO: 2664111 - RNA, 17 nt, Human
gacacacacagacuauu

SEQ ID NO: 2664112 - RNA, 13 nt, Human
gacacccucaacc

SEQ ID NO: 2664113 - RNA, 14 nt, Human
gacaccuuggacau

SEQ ID NO: 2664114 - RNA, 16 nt, Human
gagccucugcucccca

SEQ ID NO: 2664115 - RNA, 14 nt, Human
gagccucacugggg

SEQ ID NO: 2664116 - RNA, 23 nt, Human
gagccucacuggggcagacaaua

SEQ ID NO: 2664117 - RNA, 17 nt, Human
gagccucugcuccccag

SEQ ID NO: 2664118 - RNA, 15 nt, Human
gagcccuugccuccc

SEQ ID NO: 2664119 - RNA, 16 nt, Human
gagcccuugccucccc

SEQ ID NO: 2664120 - RNA, 17 nt, Human
gagcccuugccucccca

SEQ ID NO: 2664121 - RNA, 22 nt, Human
gagcccuugccuccccauuucc

SEQ ID NO: 2664122 - RNA, 20 nt, Human
gagccgagaucgcgccacug

SEQ ID NO: 2664123 - RNA, 17 nt, Human
gagccgguaacuguccu

SEQ ID NO: 2664124 - RNA, 18 nt, Human
gagccgguaacuguccug

SEQ ID NO: 2664125 - RNA, 19 nt, Human
gagccgguaacuguccugu

SEQ ID NO: 2664126 - RNA, 21 nt, Human
gagccgguaacuguccugucc

SEQ ID NO: 2664127 - RNA, 22 nt, Human
gagccgguaacuguccuguccu

SEQ ID NO: 2664128 - RNA, 16 nt, Human
gagccggccccaggcu

SEQ ID NO: 2664129 - RNA, 23 nt, Human
gagccggccccaggcucguggac

SEQ ID NO: 2664130 - RNA, 16 nt, Human
gagccgggccccuggg

SEQ ID NO: 2664131 - RNA, 15 nt, Human
gagccgggccccugg

SEQ ID NO: 2664132 - RNA, 21 nt, Human
gagccgggcacauugagcugu

SEQ ID NO: 2664133 - RNA, 18 nt, Human
gagauaauuacugccuug

SEQ ID NO: 2664134 - RNA, 19 nt, Human
gagauaauuacugccuuga

SEQ ID NO: 2664135 - RNA, 18 nt, Human
gagccagcucccucuauu

SEQ ID NO: 2664136 - RNA, 13 nt, Human
gagccagcucccu

SEQ ID NO: 2664137 - RNA, 20 nt, Human
gagccagcuuggggccacca

SEQ ID NO: 2664138 - RNA, 22 nt, Human
gagcuuucugcuaucaaagagg

SEQ ID NO: 2664139 - RNA, 20 nt, Human
gagcuuugaaaauucagugg

SEQ ID NO: 2664140 - RNA, 12 nt, Human
gaggaaaauucu

SEQ ID NO: 2664141 - RNA, 13 nt, Human
gaggaaaauucuu

SEQ ID NO: 2664142 - RNA, 17 nt, Human
gaggaagagaaaaaaua

SEQ ID NO: 2664143 - RNA, 17 nt, Human
gaggaaauucuccacug

SEQ ID NO: 2664144 - RNA, 19 nt, Human
gaggaacaaucggcugcau

SEQ ID NO: 2664145 - RNA, 20 nt, Human
gaggaaaucaaagugcuauu

SEQ ID NO: 2664146 - RNA, 12 nt, Human
gaggaaaucaaa

SEQ ID NO: 2664147 - RNA, 12 nt, Human
gagcucuuccua

SEQ ID NO: 2664148 - RNA, 21 nt, Human
gagcucuuccuaucccucucc

SEQ ID NO: 2664149 - RNA, 19 nt, Human
gagcucccacuucugccag

SEQ ID NO: 2664150 - RNA, 20 nt, Human
gagcucccacuucugccaga

SEQ ID NO: 2664151 - RNA, 15 nt, Human
gagcugaguggggga

SEQ ID NO: 2664152 - RNA, 21 nt, Human
gagcugagaucgugcuacugc

SEQ ID NO: 2664153 - RNA, 17 nt, Human
gagcuaggaagagucua

SEQ ID NO: 2664154 - RNA, 17 nt, Human
gagcuagcagcagggag

SEQ ID NO: 2664155 - RNA, 15 nt, Human
gagcuagcagcaggg

SEQ ID NO: 2664156 - RNA, 23 nt, Human
gagccugcauuuccucgcagccu

SEQ ID NO: 2664157 - RNA, 13 nt, Human
gagccugcccagc

SEQ ID NO: 2664158 - RNA, 22 nt, Human
gagcuccacucugcuucucuga

SEQ ID NO: 2664159 - RNA, 13 nt, Human
gagcuaugacuua

SEQ ID NO: 2664160 - RNA, 19 nt, Human
gagagagguugaaaaacaa

SEQ ID NO: 2664161 - RNA, 18 nt, Human
gagagcaucggccuaggg

SEQ ID NO: 2664162 - RNA, 15 nt, Human
gagagcaucggccua

SEQ ID NO: 2664163 - RNA, 12 nt, Human
gagagcauaauu

SEQ ID NO: 2664164 - RNA, 16 nt, Human
gagagcauaauuuaaa

SEQ ID NO: 2664165 - RNA, 17 nt, Human
gagagagguugaaaaac

SEQ ID NO: 2664166 - RNA, 16 nt, Human
gagagccauacauaaa

SEQ ID NO: 2664167 - RNA, 12 nt, Human
gagagccugcug

SEQ ID NO: 2664168 - RNA, 13 nt, Human
gagagccugcugg

SEQ ID NO: 2664169 - RNA, 14 nt, Human
gagagccugcuggc

SEQ ID NO: 2664170 - RNA, 15 nt, Human
gagagccugcuggca

SEQ ID NO: 2664171 - RNA, 13 nt, Human
gagagaggacagc

SEQ ID NO: 2664172 - RNA, 19 nt, Human
gagacuuugaugucagcag

SEQ ID NO: 2664173 - RNA, 13 nt, Human
gagacuuuguaga

SEQ ID NO: 2664174 - RNA, 15 nt, Human
gagacuuugauguca

SEQ ID NO: 2664175 - RNA, 14 nt, Human
gagacuuugauguc

SEQ ID NO: 2664176 - RNA, 13 nt, Human
gagacuuugaugu

SEQ ID NO: 2664177 - RNA, 11 nt, Human
gagacuuugau

SEQ ID NO: 2664178 - RNA, 10 nt, Human
gagacuuuga

SEQ ID NO: 2664179 - RNA, 18 nt, Human
gagagucuggcccuagac

SEQ ID NO: 2664180 - RNA, 14 nt, Human
gagaggugggccag

SEQ ID NO: 2664181 - RNA, 22 nt, Human
gagaggugggccagucugugga

SEQ ID NO: 2664182 - RNA, 23 nt, Human
gagaggugggccagucuguggau

SEQ ID NO: 2664183 - RNA, 23 nt, Human
gagagggaggucacuggaaaggg

SEQ ID NO: 2664184 - RNA, 19 nt, Human
gagagccuggugcugcugc

SEQ ID NO: 2664185 - RNA, 17 nt, Human
gagagccuggugcugcu

SEQ ID NO: 2664186 - RNA, 13 nt, Human
gagagccuggugc

SEQ ID NO: 2664187 - RNA, 16 nt, Human
gagaccagggagccuu

SEQ ID NO: 2664188 - RNA, 16 nt, Human
gagacucgacucugug

SEQ ID NO: 2664189 - RNA, 17 nt, Human
gagacucgacucugugc

SEQ ID NO: 2664190 - RNA, 18 nt, Human
gagacucgacucugugcc

SEQ ID NO: 2664191 - RNA, 12 nt, Human
gagacugugcug

SEQ ID NO: 2664192 - RNA, 13 nt, Human
gagacugugcugu

SEQ ID NO: 2664193 - RNA, 18 nt, Human
gagacuuagggcaccagg

SEQ ID NO: 2664194 - RNA, 21 nt, Human
gagacuuagggcaccaggggu

SEQ ID NO: 2664195 - RNA, 13 nt, Human
gagacuugccaga

SEQ ID NO: 2664196 - RNA, 18 nt, Human
gagacaaaauauuuccca

SEQ ID NO: 2664197 - RNA, 14 nt, Human
gagaauugggggcu

SEQ ID NO: 2664198 - RNA, 16 nt, Human
gagacacuguugauaa

SEQ ID NO: 2664199 - RNA, 20 nt, Human
gagacacuguugauaaaaac

SEQ ID NO: 2664200 - RNA, 16 nt, Human
gagacacggagcccag

SEQ ID NO: 2664201 - RNA, 15 nt, Human
gagacagauaccucc

SEQ ID NO: 2664202 - RNA, 16 nt, Human
gagacagauaccucca

SEQ ID NO: 2664203 - RNA, 20 nt, Human
gagacagauaccuccaaccc

SEQ ID NO: 2664204 - RNA, 22 nt, Human
gagacagauaccuccaacccug

SEQ ID NO: 2664205 - RNA, 23 nt, Human
gagacagauaccuccaacccugc

SEQ ID NO: 2664206 - RNA, 16 nt, Human
gagaacccaguuuccc

SEQ ID NO: 2664207 - RNA, 23 nt, Human
gagaaugaguccuugauuucaaa

SEQ ID NO: 2664208 - RNA, 14 nt, Human
gagaagcccgugug

SEQ ID NO: 2664209 - RNA, 15 nt, Human
gagaagcccguguga

SEQ ID NO: 2664210 - RNA, 16 nt, Human
gagaagcccgugugag

SEQ ID NO: 2664211 - RNA, 24 nt, Human
gagaaacuuaaauguuauuaucug

SEQ ID NO: 2664212 - RNA, 18 nt, Human
gagaaccaaaucuggaag

SEQ ID NO: 2664213 - RNA, 13 nt, Human
gagaaccaaaucu

SEQ ID NO: 2664214 - RNA, 17 nt, Human
gagaaccaaaucuggaa

SEQ ID NO: 2664215 - RNA, 12 nt, Human
gagaacaggacu

SEQ ID NO: 2664216 - RNA, 19 nt, Human
gagaacaugaaucaaaagu

SEQ ID NO: 2664217 - RNA, 13 nt, Human
gagaacaggacua

SEQ ID NO: 2664218 - RNA, 11 nt, Human
gagaaaugaaa

SEQ ID NO: 2664219 - RNA, 18 nt, Human
gagaaagugugagcaaac

SEQ ID NO: 2664220 - RNA, 23 nt, Human
gagaaauaaaguuugcuuagaaa

SEQ ID NO: 2664221 - RNA, 15 nt, Human
gagaaagaauuuagu

SEQ ID NO: 2664222 - RNA, 16 nt, Human
gacucgggggugggga

SEQ ID NO: 2664223 - RNA, 19 nt, Human
gacucggggugcuuccuug

SEQ ID NO: 2664224 - RNA, 18 nt, Human
gacucggggugcuuccuu

SEQ ID NO: 2664225 - RNA, 14 nt, Human
gacucggggguggg

SEQ ID NO: 2664226 - RNA, 15 nt, Human
gacuuguuuuugcac

SEQ ID NO: 2664227 - RNA, 13 nt, Human
gagaaaauugaaa

SEQ ID NO: 2664228 - RNA, 13 nt, Human
gacucgguuucuc

SEQ ID NO: 2664229 - RNA, 16 nt, Human
gaucccguuuucccca

SEQ ID NO: 2664230 - RNA, 17 nt, Human
gaucccguuuuccccau

SEQ ID NO: 2664231 - RNA, 17 nt, Human
gauccugcggguggggc

SEQ ID NO: 2664232 - RNA, 18 nt, Human
gauccugcggguggggcu

SEQ ID NO: 2664233 - RNA, 22 nt, Human
gaucgugcuacugcacuccagc

SEQ ID NO: 2664234 - RNA, 22 nt, Human
gaucggccaucaagggaagaac

SEQ ID NO: 2664235 - RNA, 16 nt, Human
gaucucagcuuugaga

SEQ ID NO: 2664236 - RNA, 21 nt, Human
gaucucagcuuugagaagccu

SEQ ID NO: 2664237 - RNA, 14 nt, Human
gaucucagcuuuga

SEQ ID NO: 2664238 - RNA, 16 nt, Human
gaugaaacuaaagcaa

SEQ ID NO: 2664239 - RNA, 17 nt, Human
gaugaaacuaaagcaau

SEQ ID NO: 2664240 - RNA, 19 nt, Human
gaugaaacuaaagcaauag

SEQ ID NO: 2664241 - RNA, 22 nt, Human
gaugaaacuaaagcaauagaaa

SEQ ID NO: 2664242 - RNA, 22 nt, Human
gaucucagcuuugagaagccuu

SEQ ID NO: 2664243 - RNA, 13 nt, Human
gauggcuugucua

SEQ ID NO: 2664244 - RNA, 15 nt, Human
gauggcuugucuaua

SEQ ID NO: 2664245 - RNA, 14 nt, Human
gauggccuuaauuu

SEQ ID NO: 2664246 - RNA, 17 nt, Human
gauggccuuaauuuccu

SEQ ID NO: 2664247 - RNA, 18 nt, Human
gauggccuuaauuuccuu

SEQ ID NO: 2664248 - RNA, 22 nt, Human
gauggauuuccagccaaagccu

SEQ ID NO: 2664249 - RNA, 23 nt, Human
gaugccacuucuaagaaaagccu

SEQ ID NO: 2664250 - RNA, 15 nt, Human
gaugacaauaaagcu

SEQ ID NO: 2664251 - RNA, 16 nt, Human
gaugacaauaaagcuu

SEQ ID NO: 2664252 - RNA, 16 nt, Human
gaugcaccaccaagcc

SEQ ID NO: 2664253 - RNA, 12 nt, Human
gaugccacccua

SEQ ID NO: 2664254 - RNA, 16 nt, Human
gaugccacccuagcca

SEQ ID NO: 2664255 - RNA, 15 nt, Human
gauaaggccuguggg

SEQ ID NO: 2664256 - RNA, 13 nt, Human
gauaguaagcaua

SEQ ID NO: 2664257 - RNA, 14 nt, Human
gauaguaagcauag

SEQ ID NO: 2664258 - RNA, 23 nt, Human
gauagucuuuugcuuuuggcaaa

SEQ ID NO: 2664259 - RNA, 17 nt, Human
gauagugggauuuccag

SEQ ID NO: 2664260 - RNA, 19 nt, Human
gauagugggauuuccagaa

SEQ ID NO: 2664261 - RNA, 19 nt, Human
gaucaauauuuuuauauca

SEQ ID NO: 2664262 - RNA, 15 nt, Human
gaucagccugggcaa

SEQ ID NO: 2664263 - RNA, 12 nt, Human
gaucagccuggg

SEQ ID NO: 2664264 - RNA, 13 nt, Human
gaucauguacuuu

SEQ ID NO: 2664265 - RNA, 15 nt, Human
gaucauguacuuuuu

SEQ ID NO: 2664266 - RNA, 19 nt, Human
gaucauguacuuuuuagua

SEQ ID NO: 2664267 - RNA, 20 nt, Human
gaucauguacuuuuuaguaa

SEQ ID NO: 2664268 - RNA, 13 nt, Human
gauccccgccugg

SEQ ID NO: 2664269 - RNA, 14 nt, Human
gauccccgccuggc

SEQ ID NO: 2664270 - RNA, 15 nt, Human
gauccccgccuggcc

SEQ ID NO: 2664271 - RNA, 16 nt, Human
gauccccgccuggcca

SEQ ID NO: 2664272 - RNA, 17 nt, Human
gauccccgccuggccag

SEQ ID NO: 2664273 - RNA, 18 nt, Human
gauccccgccuggccagg

SEQ ID NO: 2664274 - RNA, 19 nt, Human
gauccccgccuggccagga

SEQ ID NO: 2664275 - RNA, 20 nt, Human
gauccccgccuggccaggag

SEQ ID NO: 2664276 - RNA, 21 nt, Human
gauccccgccuggccaggagc

SEQ ID NO: 2664277 - RNA, 22 nt, Human
gauccccgccuggccaggagca

SEQ ID NO: 2664278 - RNA, 14 nt, Human
gcaauauuugaauu

SEQ ID NO: 2664279 - RNA, 18 nt, Human
gcaauauuugaauuuuaa

SEQ ID NO: 2664280 - RNA, 19 nt, Human
gcaaucaagguuauaauuu

SEQ ID NO: 2664281 - RNA, 15 nt, Human
gcaaggcuaugugau

SEQ ID NO: 2664282 - RNA, 22 nt, Human
gcaagggguucccuugagggcu

SEQ ID NO: 2664283 - RNA, 20 nt, Human
gcaaggccugguguuucuug

SEQ ID NO: 2664284 - RNA, 22 nt, Human
gcaagaggggguggaggggugu

SEQ ID NO: 2664285 - RNA, 23 nt, Human
gcaagaggggguggaggggugug

SEQ ID NO: 2664286 - RNA, 13 nt, Human
gcaagccaggcuc

SEQ ID NO: 2664287 - RNA, 20 nt, Human
gcaagccaggcucacucaca

SEQ ID NO: 2664288 - RNA, 21 nt, Human
gcaagccaggcucacucacag

SEQ ID NO: 2664289 - RNA, 18 nt, Human
gcaagcuccgcaggacuu

SEQ ID NO: 2664290 - RNA, 15 nt, Human
gcaagcuccgcagga

SEQ ID NO: 2664291 - RNA, 14 nt, Human
gcaaggacuuugua

SEQ ID NO: 2664292 - RNA, 16 nt, Human
gcaaggacuuuguaca

SEQ ID NO: 2664293 - RNA, 19 nt, Human
gcaaggacuuuguacauuu

SEQ ID NO: 2664294 - RNA, 20 nt, Human
gauuuuugcaauaccaagua

SEQ ID NO: 2664295 - RNA, 22 nt, Human
gcaaaucagaaacuugugaagu

SEQ ID NO: 2664296 - RNA, 20 nt, Human
gcaaaucagaaacuugugaa

SEQ ID NO: 2664297 - RNA, 15 nt, Human
gcaaaucagaaacuu

SEQ ID NO: 2664298 - RNA, 13 nt, Human
gcaaaucagaaac

SEQ ID NO: 2664299 - RNA, 23 nt, Human
gcaacacagccugggccccagcu

SEQ ID NO: 2664300 - RNA, 18 nt, Human
gcaacacagccugggccc

SEQ ID NO: 2664301 - RNA, 16 nt, Human
gcaacacagccugggc

SEQ ID NO: 2664302 - RNA, 17 nt, Human
gcaagaauugaagcagg

SEQ ID NO: 2664303 - RNA, 20 nt, Human
gcaagaggggguggaggggu

SEQ ID NO: 2664304 - RNA, 18 nt, Human
gauuuuuacuguguuuua

SEQ ID NO: 2664305 - RNA, 15 nt, Human
gauuuuuagaauuaa

SEQ ID NO: 2664306 - RNA, 16 nt, Human
gauuuuuacuguguuu

SEQ ID NO: 2664307 - RNA, 23 nt, Human
gauuuucuauuauggaaaacugu

SEQ ID NO: 2664308 - RNA, 19 nt, Human
gauuuucacauucuuggcu

SEQ ID NO: 2664309 - RNA, 13 nt, Human
gauuuuccaaaug

SEQ ID NO: 2664310 - RNA, 15 nt, Human
gauuugcugcucuuc

SEQ ID NO: 2664311 - RNA, 15 nt, Human
gauuucucauugacu

SEQ ID NO: 2664312 - RNA, 16 nt, Human
gauuucucauugacuu

SEQ ID NO: 2664313 - RNA, 22 nt, Human
gauuucucauugacuuuuauaa

SEQ ID NO: 2664314 - RNA, 14 nt, Human
gauuucugaggaaa

SEQ ID NO: 2664315 - RNA, 13 nt, Human
gauuugccauaga

SEQ ID NO: 2664316 - RNA, 17 nt, Human
gauuugccauagaguac

SEQ ID NO: 2664317 - RNA, 19 nt, Human
gauuuggcacuagccaaag

SEQ ID NO: 2664318 - RNA, 21 nt, Human
gauuccacuacaccuggcuga

SEQ ID NO: 2664319 - RNA, 15 nt, Human
gauucagcucugcaa

SEQ ID NO: 2664320 - RNA, 13 nt, Human
gauucagcucugc

SEQ ID NO: 2664321 - RNA, 18 nt, Human
gauggggguuucaccaua

SEQ ID NO: 2664322 - RNA, 16 nt, Human
gauuccuuuuuucaaa

SEQ ID NO: 2664323 - RNA, 16 nt, Human
gauucgguaucccccc

SEQ ID NO: 2664324 - RNA, 17 nt, Human
gauucgguaucccccca

SEQ ID NO: 2664325 - RNA, 23 nt, Human
gauugcaccacugcacuccagcc

SEQ ID NO: 2664326 - RNA, 16 nt, Human
gauugcaccacugcac

SEQ ID NO: 2664327 - RNA, 24 nt, Human
gcagugguuuuggcaaacgcuaaa

SEQ ID NO: 2664328 - RNA, 19 nt, Human
gcaguggcgcauucuaggc

SEQ ID NO: 2664329 - RNA, 16 nt, Human
gcauagaggcuucucc

SEQ ID NO: 2664330 - RNA, 22 nt, Human
gcauagaggcuucuccgccagc

SEQ ID NO: 2664331 - RNA, 14 nt, Human
gcauacuuuguaaa

SEQ ID NO: 2664332 - RNA, 15 nt, Human
gcauacuuuguaaau

SEQ ID NO: 2664333 - RNA, 16 nt, Human
gcauacuuuguaaaua

SEQ ID NO: 2664334 - RNA, 14 nt, Human
gcauacuuuguauu

SEQ ID NO: 2664335 - RNA, 18 nt, Human
gcauacuuuguauuuuga

SEQ ID NO: 2664336 - RNA, 19 nt, Human
gcauagauaauauuguuug

SEQ ID NO: 2664337 - RNA, 23 nt, Human
gcauagauaauauuguuugguaa

SEQ ID NO: 2664338 - RNA, 12 nt, Human
gcauaguuucuu

SEQ ID NO: 2664339 - RNA, 13 nt, Human
gcauaguuucuuu

SEQ ID NO: 2664340 - RNA, 15 nt, Human
gcauaguuucuuuau

SEQ ID NO: 2664341 - RNA, 17 nt, Human
gcauaguuucuuuauuu

SEQ ID NO: 2664342 - RNA, 17 nt, Human
gcauauggguuagaugu

SEQ ID NO: 2664343 - RNA, 19 nt, Human
gcauauuugcaaaguguau

SEQ ID NO: 2664344 - RNA, 20 nt, Human
gcauaugaaaggagagcauc

SEQ ID NO: 2664345 - RNA, 16 nt, Human
gcauaugaaaggagag

SEQ ID NO: 2664346 - RNA, 12 nt, Human
gcaguggccuua

SEQ ID NO: 2664347 - RNA, 23 nt, Human
gcaggugaucugcugcagagcag

SEQ ID NO: 2664348 - RNA, 18 nt, Human
gcaggugauuggaccagg

SEQ ID NO: 2664349 - RNA, 13 nt, Human
gcagggccauggc

SEQ ID NO: 2664350 - RNA, 16 nt, Human
gcagggccauggcuca

SEQ ID NO: 2664351 - RNA, 18 nt, Human
gcagggccauggcucagg

SEQ ID NO: 2664352 - RNA, 22 nt, Human
gcagggccauggcucagggugg

SEQ ID NO: 2664353 - RNA, 13 nt, Human
gcaggggccugga

SEQ ID NO: 2664354 - RNA, 14 nt, Human
gcaggggccuggag

SEQ ID NO: 2664355 - RNA, 16 nt, Human
gcaggggccuggagau

SEQ ID NO: 2664356 - RNA, 20 nt, Human
gcaggggccuggagauccuc

SEQ ID NO: 2664357 - RNA, 18 nt, Human
gcaugagacucagugcag

SEQ ID NO: 2664358 - RNA, 21 nt, Human
gcaugagacucagugcagaug

SEQ ID NO: 2664359 - RNA, 16 nt, Human
gcaucaccugccuguu

SEQ ID NO: 2664360 - RNA, 14 nt, Human
gcaucaccugccug

SEQ ID NO: 2664361 - RNA, 15 nt, Human
gcaucaccugccugu

SEQ ID NO: 2664362 - RNA, 16 nt, Human
gcaucacuuaaaacac

SEQ ID NO: 2664363 - RNA, 20 nt, Human
gcaucacuuaaaacacguuu

SEQ ID NO: 2664364 - RNA, 20 nt, Human
gcaucugaaauaggaaacaa

SEQ ID NO: 2664365 - RNA, 15 nt, Human
gcaucugagggggag

SEQ ID NO: 2664366 - RNA, 22 nt, Human
gcaucuuggggggguggccgcu

SEQ ID NO: 2664367 - RNA, 13 nt, Human
gcaucuuugaugu

SEQ ID NO: 2664368 - RNA, 11 nt, Human
gcaucuuugau

SEQ ID NO: 2664369 - RNA, 17 nt, Human
gcaucuuugauguguug

SEQ ID NO: 2664370 - RNA, 15 nt, Human
gcaucuuugaugugu

SEQ ID NO: 2664371 - RNA, 15 nt, Human
gcaucuugccuccag

SEQ ID NO: 2664372 - RNA, 16 nt, Human
gcaucuugccuccagg

SEQ ID NO: 2664373 - RNA, 17 nt, Human
gcaucuugccuccaggu

SEQ ID NO: 2664374 - RNA, 19 nt, Human
gcaucuugccuccaggugc

SEQ ID NO: 2664375 - RNA, 23 nt, Human
gcaucuugccuccaggugcagag

SEQ ID NO: 2664376 - RNA, 14 nt, Human
gcaugaaaugugaa

SEQ ID NO: 2664377 - RNA, 15 nt, Human
gcaugaaaugugaau

SEQ ID NO: 2664378 - RNA, 20 nt, Human
gcaugaaaugugaauuuuua

SEQ ID NO: 2664379 - RNA, 22 nt, Human
gcaugaaaugugaauuuuuauu

SEQ ID NO: 2664380 - RNA, 14 nt, Human
gcaugaaauaaaau

SEQ ID NO: 2664381 - RNA, 15 nt, Human
gcaugaaauaaaaua

SEQ ID NO: 2664382 - RNA, 18 nt, Human
gcaugaaauaaaauauau

SEQ ID NO: 2664383 - RNA, 14 nt, Human
gcauuuuuguaaau

SEQ ID NO: 2664384 - RNA, 20 nt, Human
gcauuuuucaauauauugaa

SEQ ID NO: 2664385 - RNA, 21 nt, Human
gcauuuuucaauauauugaac

SEQ ID NO: 2664386 - RNA, 19 nt, Human
gccaaagccuccuccagcc

SEQ ID NO: 2664387 - RNA, 16 nt, Human
gccaaagccuccucca

SEQ ID NO: 2664388 - RNA, 17 nt, Human
gcauuugugcuagaaau

SEQ ID NO: 2664389 - RNA, 21 nt, Human
gcauuugugcuagaaauuuuc

SEQ ID NO: 2664390 - RNA, 14 nt, Human
gcauuugcugaaua

SEQ ID NO: 2664391 - RNA, 13 nt, Human
gcauuugcugaau

SEQ ID NO: 2664392 - RNA, 17 nt, Human
gcagacauuuuaaaaaa

SEQ ID NO: 2664393 - RNA, 20 nt, Human
gcagaccacgcccguccugc

SEQ ID NO: 2664394 - RNA, 23 nt, Human
gcagaccacgcccguccugccug

SEQ ID NO: 2664395 - RNA, 12 nt, Human
gcagaguuuuca

SEQ ID NO: 2664396 - RNA, 14 nt, Human
gcagaguuuucauu

SEQ ID NO: 2664397 - RNA, 19 nt, Human
gcagaguuuucauuaaauc

SEQ ID NO: 2664398 - RNA, 16 nt, Human
gcagauuuuacagagc

SEQ ID NO: 2664399 - RNA, 23 nt, Human
gcaggaggaucacuugaguccag

SEQ ID NO: 2664400 - RNA, 20 nt, Human
gcaggaggaucacuugaguc

SEQ ID NO: 2664401 - RNA, 18 nt, Human
gcaggcacgggugguccc

SEQ ID NO: 2664402 - RNA, 19 nt, Human
gcaggcacggguggucccc

SEQ ID NO: 2664403 - RNA, 20 nt, Human
gcaggcacgggugguccccg

SEQ ID NO: 2664404 - RNA, 23 nt, Human
gcaccauucugacucgguuucuc

SEQ ID NO: 2664405 - RNA, 15 nt, Human
gcaccauucugacuc

SEQ ID NO: 2664406 - RNA, 17 nt, Human
gcaccauucugacucgg

SEQ ID NO: 2664407 - RNA, 13 nt, Human
gcaccaggaagcc

SEQ ID NO: 2664408 - RNA, 16 nt, Human
gcaccagcagccugga

SEQ ID NO: 2664409 - RNA, 22 nt, Human
gcaccacugcacuccagccugg

SEQ ID NO: 2664410 - RNA, 21 nt, Human
gcaccacugcacuccagccug

SEQ ID NO: 2664411 - RNA, 15 nt, Human
gcaccagcagccugg

SEQ ID NO: 2664412 - RNA, 20 nt, Human
gcaccacugcacuccagccu

SEQ ID NO: 2664413 - RNA, 13 nt, Human
gcacggguggucc

SEQ ID NO: 2664414 - RNA, 14 nt, Human
gcacgggugguccc

SEQ ID NO: 2664415 - RNA, 15 nt, Human
gcacggguggucccc

SEQ ID NO: 2664416 - RNA, 16 nt, Human
gcacgggugguccccg

SEQ ID NO: 2664417 - RNA, 14 nt, Human
gcaccuuuuacugu

SEQ ID NO: 2664418 - RNA, 15 nt, Human
gcaccuuuuacugug

SEQ ID NO: 2664419 - RNA, 23 nt, Human
gcaccuuuuacugugauguuugu

SEQ ID NO: 2664420 - RNA, 15 nt, Human
gcacccucaggcagg

SEQ ID NO: 2664421 - RNA, 18 nt, Human
gcaccuggcaucgcacca

SEQ ID NO: 2664422 - RNA, 13 nt, Human
gcacgucauggga

SEQ ID NO: 2664423 - RNA, 14 nt, Human
gcacuuaaagaagu

SEQ ID NO: 2664424 - RNA, 17 nt, Human
gcacuuauugaauauau

SEQ ID NO: 2664425 - RNA, 18 nt, Human
gcacuuauugaauauaug

SEQ ID NO: 2664426 - RNA, 20 nt, Human
gcacuuauugaauauaugau

SEQ ID NO: 2664427 - RNA, 18 nt, Human
gcacuuauugaccauuuu

SEQ ID NO: 2664428 - RNA, 19 nt, Human
gcacuuauugaccauuuuu

SEQ ID NO: 2664429 - RNA, 23 nt, Human
gcacuuauugaccauuuuuuaau

SEQ ID NO: 2664430 - RNA, 22 nt, Human
gcacuuacugguaggaccaagc

SEQ ID NO: 2664431 - RNA, 18 nt, Human
gcagaauguaagugggcc

SEQ ID NO: 2664432 - RNA, 19 nt, Human
gcagaauguaagugggccc

SEQ ID NO: 2664433 - RNA, 22 nt, Human
gcagaauguaagugggcccacc

SEQ ID NO: 2664434 - RNA, 15 nt, Human
gcacuucauguaaag

SEQ ID NO: 2664435 - RNA, 18 nt, Human
gcacuucauguaaagugu

SEQ ID NO: 2664436 - RNA, 14 nt, Human
gcagacaauaaacc

SEQ ID NO: 2664437 - RNA, 17 nt, Human
gcagacaauaaacccuc

SEQ ID NO: 2664438 - RNA, 19 nt, Human
gcagacaauaaacccucag

SEQ ID NO: 2664439 - RNA, 20 nt, Human
gcagacaauaaacccucaga

SEQ ID NO: 2664440 - RNA, 21 nt, Human
gcagacaauaaacccucagag

SEQ ID NO: 2664441 - RNA, 20 nt, Human
gccuggugcuuccaaauauu

SEQ ID NO: 2664442 - RNA, 16 nt, Human
gccuuaaaacaucauu

SEQ ID NO: 2664443 - RNA, 19 nt, Human
gccuguuucugauuugcug

SEQ ID NO: 2664444 - RNA, 14 nt, Human
gccuuaaaaccaaa

SEQ ID NO: 2664445 - RNA, 19 nt, Human
gccuuaaaacaucauuccu

SEQ ID NO: 2664446 - RNA, 17 nt, Human
gccuuaaaaccaaagag

SEQ ID NO: 2664447 - RNA, 18 nt, Human
gccugcaaucugagccag

SEQ ID NO: 2664448 - RNA, 21 nt, Human
gccugggguguuaguggcacc

SEQ ID NO: 2664449 - RNA, 22 nt, Human
gccugggguguuaguggcaccg

SEQ ID NO: 2664450 - RNA, 21 nt, Human
gccugggucacacacggaggc

SEQ ID NO: 2664451 - RNA, 13 nt, Human
gccuggugcugcu

SEQ ID NO: 2664452 - RNA, 13 nt, Human
gccuuuggcuuca

SEQ ID NO: 2664453 - RNA, 12 nt, Human
gccuuggcucag

SEQ ID NO: 2664454 - RNA, 16 nt, Human
gccuuggcucagacau

SEQ ID NO: 2664455 - RNA, 15 nt, Human
gccuuggcucagaca

SEQ ID NO: 2664456 - RNA, 14 nt, Human
gccuuggcucagac

SEQ ID NO: 2664457 - RNA, 23 nt, Human
gccuucaggguucagcaguacag

SEQ ID NO: 2664458 - RNA, 21 nt, Human
gccuuugcagcucagaaccac

SEQ ID NO: 2664459 - RNA, 16 nt, Human
gccuuugcagcucaga

SEQ ID NO: 2664460 - RNA, 17 nt, Human
gccuugcuguuuguccu

SEQ ID NO: 2664461 - RNA, 19 nt, Human
gccuugcuguuuguccuga

SEQ ID NO: 2664462 - RNA, 22 nt, Human
gccuugcuguuuguccugagau

SEQ ID NO: 2664463 - RNA, 13 nt, Human
gccuuggaaauuc

SEQ ID NO: 2664464 - RNA, 14 nt, Human
gccuuggaaauucc

SEQ ID NO: 2664465 - RNA, 14 nt, Human
gcguacaggcuggc

SEQ ID NO: 2664466 - RNA, 15 nt, Human
gcgguggcucacgcc

SEQ ID NO: 2664467 - RNA, 18 nt, Human
gcgguggcucacgccugu

SEQ ID NO: 2664468 - RNA, 22 nt, Human
gcggggcugucggcgcugcccc

SEQ ID NO: 2664469 - RNA, 18 nt, Human
gcggggcugucggcgcug

SEQ ID NO: 2664470 - RNA, 16 nt, Human
gcgcucagggccaugc

SEQ ID NO: 2664471 - RNA, 17 nt, Human
gcgaacccuuuauuuga

SEQ ID NO: 2664472 - RNA, 13 nt, Human
gcgccgucuccag

SEQ ID NO: 2664473 - RNA, 15 nt, Human
gcgccgucuccaggg

SEQ ID NO: 2664474 - RNA, 22 nt, Human
gcgccgucuccaggggcugcuu

SEQ ID NO: 2664475 - RNA, 13 nt, Human
gcgcucagggcca

SEQ ID NO: 2664476 - RNA, 22 nt, Human
gcgcucagggccaugcugaggc

SEQ ID NO: 2664477 - RNA, 12 nt, Human
gcgcucaguaaa

SEQ ID NO: 2664478 - RNA, 14 nt, Human
gcgcucaguaaacg

SEQ ID NO: 2664479 - RNA, 15 nt, Human
gcgcucaguaaacgg

SEQ ID NO: 2664480 - RNA, 17 nt, Human
gcgcucaguaaacggga

SEQ ID NO: 2664481 - RNA, 14 nt, Human
gcgcgccccuagcc

SEQ ID NO: 2664482 - RNA, 15 nt, Human
gcgcgccccuagccg

SEQ ID NO: 2664483 - RNA, 17 nt, Human
gcgcggacgugcugggc

SEQ ID NO: 2664484 - RNA, 20 nt, Human
gcgcgguggcgggcaccugu

SEQ ID NO: 2664485 - RNA, 13 nt, Human
gcgcgguggcuca

SEQ ID NO: 2664486 - RNA, 15 nt, Human
gcgcgguggcucacg

SEQ ID NO: 2664487 - RNA, 20 nt, Human
gcgcgguggcucacgccugu

SEQ ID NO: 2664488 - RNA, 22 nt, Human
gcuagcuucugcuuuucugccc

SEQ ID NO: 2664489 - RNA, 16 nt, Human
gcuaccuuucaaagcu

SEQ ID NO: 2664490 - RNA, 17 nt, Human
gcuaccuuucaaagcuu

SEQ ID NO: 2664491 - RNA, 15 nt, Human
gcuagcuucugcuuu

SEQ ID NO: 2664492 - RNA, 12 nt, Human
gcuagcuucugc

SEQ ID NO: 2664493 - RNA, 17 nt, Human
gcuagcuucugcuuuuc

SEQ ID NO: 2664494 - RNA, 18 nt, Human
gcuagcuucugcuuuucu

SEQ ID NO: 2664495 - RNA, 23 nt, Human
gcuagcuucugcuuuucugcccu

SEQ ID NO: 2664496 - RNA, 14 nt, Human
gcuaaagagcccuu

SEQ ID NO: 2664497 - RNA, 18 nt, Human
gcuaaagagcccuugccu

SEQ ID NO: 2664498 - RNA, 22 nt, Human
gcuaaagagcccuugccucccc

SEQ ID NO: 2664499 - RNA, 23 nt, Human
gcuaaagagcccuugccucccca

SEQ ID NO: 2664500 - RNA, 15 nt, Human
gcgucuauccugugu

SEQ ID NO: 2664501 - RNA, 13 nt, Human
gcgucugugugcg

SEQ ID NO: 2664502 - RNA, 22 nt, Human
gccgguuccugucccugcgccu

SEQ ID NO: 2664503 - RNA, 17 nt, Human
gccgguuccugucccug

SEQ ID NO: 2664504 - RNA, 12 nt, Human
gccgguuccugu

SEQ ID NO: 2664505 - RNA, 20 nt, Human
gccguaucuccggcucccag

SEQ ID NO: 2664506 - RNA, 21 nt, Human
gccguaucuccggcucccagc

SEQ ID NO: 2664507 - RNA, 23 nt, Human
gccguaucuccggcucccagccu

SEQ ID NO: 2664508 - RNA, 13 nt, Human
gccgucaccacca

SEQ ID NO: 2664509 - RNA, 15 nt, Human
gccgucaccaccacc

SEQ ID NO: 2664510 - RNA, 16 nt, Human
gccgucaccaccaccc

SEQ ID NO: 2664511 - RNA, 17 nt, Human
gccgucaccaccacccc

SEQ ID NO: 2664512 - RNA, 18 nt, Human
gccgucaccaccaccccu

SEQ ID NO: 2664513 - RNA, 23 nt, Human
gccgucaccaccaccccuaccac

SEQ ID NO: 2664514 - RNA, 20 nt, Human
gccguggggccgccgccucu

SEQ ID NO: 2664515 - RNA, 23 nt, Human
gccguggggccgccgccucuuuc

SEQ ID NO: 2664516 - RNA, 20 nt, Human
gccguguaaccauggaccca

SEQ ID NO: 2664517 - RNA, 16 nt, Human
gccuauggcagaaaaa

SEQ ID NO: 2664518 - RNA, 18 nt, Human
gccucaagaggaaugaaa

SEQ ID NO: 2664519 - RNA, 22 nt, Human
gccgguaacuguccuguccugc

SEQ ID NO: 2664520 - RNA, 14 nt, Human
gccgggcgcggugg

SEQ ID NO: 2664521 - RNA, 16 nt, Human
gccgggcgcgguggcu

SEQ ID NO: 2664522 - RNA, 18 nt, Human
gccgggcgcgguggcuca

SEQ ID NO: 2664523 - RNA, 22 nt, Human
gccgggcgcgguggcucacgcc

SEQ ID NO: 2664524 - RNA, 22 nt, Human
gccgggaccacccugagccggc

SEQ ID NO: 2664525 - RNA, 16 nt, Human
gccgggacccagggcc

SEQ ID NO: 2664526 - RNA, 21 nt, Human
gccgggcgcgguggcucacgc

SEQ ID NO: 2664527 - RNA, 18 nt, Human
gccgggaccacccugagc

SEQ ID NO: 2664528 - RNA, 20 nt, Human
gccgggaccacccugagccg

SEQ ID NO: 2664529 - RNA, 13 nt, Human
gcccugcugggga

SEQ ID NO: 2664530 - RNA, 21 nt, Human
gcccugcuggggauccccgcc

SEQ ID NO: 2664531 - RNA, 16 nt, Human
gcccuugccuccccau

SEQ ID NO: 2664532 - RNA, 15 nt, Human
gcccuuggcuucugu

SEQ ID NO: 2664533 - RNA, 12 nt, Human
gcccuugggcca

SEQ ID NO: 2664534 - RNA, 14 nt, Human
gcccuugggccacc

SEQ ID NO: 2664535 - RNA, 13 nt, Human
gcccuugccuccc

SEQ ID NO: 2664536 - RNA, 14 nt, Human
gcccuugccucccc

SEQ ID NO: 2664537 - RNA, 12 nt, Human
gccgaccagagg

SEQ ID NO: 2664538 - RNA, 19 nt, Human
gccgaccagaggagccuuu

SEQ ID NO: 2664539 - RNA, 16 nt, Human
gccuccgagagggaga

SEQ ID NO: 2664540 - RNA, 18 nt, Human
gccuccgagagggagaga

SEQ ID NO: 2664541 - RNA, 15 nt, Human
gccuccgagagggag

SEQ ID NO: 2664542 - RNA, 14 nt, Human
gccucccuuguggc

SEQ ID NO: 2664543 - RNA, 15 nt, Human
gccucucagugcccu

SEQ ID NO: 2664544 - RNA, 19 nt, Human
gccucucagugcccuccag

SEQ ID NO: 2664545 - RNA, 22 nt, Human
gccucucagugcccuccagccc

SEQ ID NO: 2664546 - RNA, 12 nt, Human
gccucagacugg

SEQ ID NO: 2664547 - RNA, 21 nt, Human
gccucagacuggagggcaagg

SEQ ID NO: 2664548 - RNA, 13 nt, Human
gccucucuagcac

SEQ ID NO: 2664549 - RNA, 16 nt, Human
gccugagaggcaggca

SEQ ID NO: 2664550 - RNA, 18 nt, Human
gccugagaggcaggcaua

SEQ ID NO: 2664551 - RNA, 19 nt, Human
gccugagaggcaggcauag

SEQ ID NO: 2664552 - RNA, 20 nt, Human
gccugagaggcaggcauaga

SEQ ID NO: 2664553 - RNA, 19 nt, Human
gccugaggucaucggcgug

SEQ ID NO: 2664554 - RNA, 13 nt, Human
gccugagaggcag

SEQ ID NO: 2664555 - RNA, 14 nt, Human
gccugagaggcagg

SEQ ID NO: 2664556 - RNA, 15 nt, Human
gccugagaggcaggc

SEQ ID NO: 2664557 - RNA, 14 nt, Human
gccccacccugggc

SEQ ID NO: 2664558 - RNA, 15 nt, Human
gccccacccugggcc

SEQ ID NO: 2664559 - RNA, 16 nt, Human
gccccacccugggccc

SEQ ID NO: 2664560 - RNA, 19 nt, Human
gccccacccugggcccugg

SEQ ID NO: 2664561 - RNA, 20 nt, Human
gccccacccugggcccuggg

SEQ ID NO: 2664562 - RNA, 12 nt, Human
gccccacugcca

SEQ ID NO: 2664563 - RNA, 14 nt, Human
gccccacugccagc

SEQ ID NO: 2664564 - RNA, 15 nt, Human
gccccacugccagca

SEQ ID NO: 2664565 - RNA, 16 nt, Human
gccccacugccagcag

SEQ ID NO: 2664566 - RNA, 17 nt, Human
gccccacugccagcagc

SEQ ID NO: 2664567 - RNA, 20 nt, Human
gccccacugccagcagcagc

SEQ ID NO: 2664568 - RNA, 23 nt, Human
gccccacugccagcagcagcagg

SEQ ID NO: 2664569 - RNA, 24 nt, Human
gccccacccugggcccugggcugg

SEQ ID NO: 2664570 - RNA, 22 nt, Human
gccccacccugggcccugggcu

SEQ ID NO: 2664571 - RNA, 23 nt, Human
gccccacccugggcccugggcug

SEQ ID NO: 2664572 - RNA, 20 nt, Human
gccccacucccuugcuggcc

SEQ ID NO: 2664573 - RNA, 22 nt, Human
gccccacucccuugcuggcccc

SEQ ID NO: 2664574 - RNA, 23 nt, Human
gccccacucccuugcuggcccca

SEQ ID NO: 2664575 - RNA, 17 nt, Human
gcccagaauacugaugg

SEQ ID NO: 2664576 - RNA, 18 nt, Human
gcccagggcuccugcacu

SEQ ID NO: 2664577 - RNA, 15 nt, Human
gcccagggcuccugc

SEQ ID NO: 2664578 - RNA, 16 nt, Human
gcccagggcuccugca

SEQ ID NO: 2664579 - RNA, 12 nt, Human
gcccagggcucc

SEQ ID NO: 2664580 - RNA, 14 nt, Human
gcccagggcuccug

SEQ ID NO: 2664581 - RNA, 16 nt, Human
gcccagggcaagcucc

SEQ ID NO: 2664582 - RNA, 19 nt, Human
gcccagggcaagcuccgca

SEQ ID NO: 2664583 - RNA, 18 nt, Human
gcccagggcaagcuccgc

SEQ ID NO: 2664584 - RNA, 23 nt, Human
gcccagggcaagcuccgcaggac

SEQ ID NO: 2664585 - RNA, 19 nt, Human
gcccaggcuggagugcagu

SEQ ID NO: 2664586 - RNA, 20 nt, Human
gcccaggcuggagugcagug

SEQ ID NO: 2664587 - RNA, 17 nt, Human
gcccccaccccggggac

SEQ ID NO: 2664588 - RNA, 21 nt, Human
gcccccaccccggggacccug

SEQ ID NO: 2664589 - RNA, 22 nt, Human
gcccccaccccggggacccugu

SEQ ID NO: 2664590 - RNA, 18 nt, Human
gcccccacaguugcucua

SEQ ID NO: 2664591 - RNA, 16 nt, Human
gcccccaaccucaggg

SEQ ID NO: 2664592 - RNA, 17 nt, Human
gcccccaaccucagggc

SEQ ID NO: 2664593 - RNA, 19 nt, Human
gcccccaaccucagggcuc

SEQ ID NO: 2664594 - RNA, 23 nt, Human
gcccccaaccucagggcucccag

SEQ ID NO: 2664595 - RNA, 19 nt, Human
gcccccuggccucugugcc

SEQ ID NO: 2664596 - RNA, 17 nt, Human
gcccccuggccucugug

SEQ ID NO: 2664597 - RNA, 18 nt, Human
gcccccugcuucaguccc

SEQ ID NO: 2664598 - RNA, 16 nt, Human
gcccccuggccucugu

SEQ ID NO: 2664599 - RNA, 15 nt, Human
gcccccuggccucug

SEQ ID NO: 2664600 - RNA, 14 nt, Human
gcccccuggccucu

SEQ ID NO: 2664601 - RNA, 13 nt, Human
gcccccuggccuc

SEQ ID NO: 2664602 - RNA, 20 nt, Human
gcccccaaagauagacaggu

SEQ ID NO: 2664603 - RNA, 24 nt, Human
gcccccaaagauagacagguccug

SEQ ID NO: 2664604 - RNA, 21 nt, Human
gccccagcaccucagccugca

SEQ ID NO: 2664605 - RNA, 19 nt, Human
gccccagcaccucagccug

SEQ ID NO: 2664606 - RNA, 13 nt, Human
gccccagcacagc

SEQ ID NO: 2664607 - RNA, 20 nt, Human
gccccagcacagcuugaccu

SEQ ID NO: 2664608 - RNA, 19 nt, Human
gccccaggcucguggacug

SEQ ID NO: 2664609 - RNA, 16 nt, Human
gccccagguagaaacu

SEQ ID NO: 2664610 - RNA, 20 nt, Human
gccccucuggucgcuccugc

SEQ ID NO: 2664611 - RNA, 22 nt, Human
gccccucuggucgcuccugccc

SEQ ID NO: 2664612 - RNA, 14 nt, Human
gccccucuucccca

SEQ ID NO: 2664613 - RNA, 12 nt, Human
gccccugggcuu

SEQ ID NO: 2664614 - RNA, 22 nt, Human
gccccugggcuuggccugcugu

SEQ ID NO: 2664615 - RNA, 23 nt, Human
gccccugggcuuggccugcugug

SEQ ID NO: 2664616 - RNA, 18 nt, Human
gccccugggcuuggccug

SEQ ID NO: 2664617 - RNA, 19 nt, Human
gccccugggcuuggccugc

SEQ ID NO: 2664618 - RNA, 20 nt, Human
gccccugggcuuggccugcu

SEQ ID NO: 2664619 - RNA, 21 nt, Human
gccccugggcuuggccugcug

SEQ ID NO: 2664620 - RNA, 15 nt, Human
gccccucagagacug

SEQ ID NO: 2664621 - RNA, 13 nt, Human
gccccucccccag

SEQ ID NO: 2664622 - RNA, 14 nt, Human
gccccucuggucgc

SEQ ID NO: 2664623 - RNA, 18 nt, Human
gccccucuggucgcuccu

SEQ ID NO: 2664624 - RNA, 19 nt, Human
gccccucuggucgcuccug

SEQ ID NO: 2664625 - RNA, 12 nt, Human
gccccgacucca

SEQ ID NO: 2664626 - RNA, 13 nt, Human
gccccgacuccag

SEQ ID NO: 2664627 - RNA, 14 nt, Human
gccccgacuccagc

SEQ ID NO: 2664628 - RNA, 15 nt, Human
gccccgacuccagcc

SEQ ID NO: 2664629 - RNA, 16 nt, Human
gccccgacuccagcca

SEQ ID NO: 2664630 - RNA, 17 nt, Human
gccccgacuccagccag

SEQ ID NO: 2664631 - RNA, 18 nt, Human
gccccgacuccagccagc

SEQ ID NO: 2664632 - RNA, 19 nt, Human
gccccgacuccagccagcg

SEQ ID NO: 2664633 - RNA, 20 nt, Human
gccccgacuccagccagcgc

SEQ ID NO: 2664634 - RNA, 21 nt, Human
gccccgacuccagccagcgcc

SEQ ID NO: 2664635 - RNA, 14 nt, Human
gcccucccacuuug

SEQ ID NO: 2664636 - RNA, 23 nt, Human
gcccucccacuuugcuguuccuu

SEQ ID NO: 2664637 - RNA, 22 nt, Human
gcccgcagagcgcgccccuagc

SEQ ID NO: 2664638 - RNA, 23 nt, Human
gcccgcagagcgcgccccuagcc

SEQ ID NO: 2664639 - RNA, 18 nt, Human
gcccugaagaauggcgcc

SEQ ID NO: 2664640 - RNA, 14 nt, Human
gcccugagcuuucu

SEQ ID NO: 2664641 - RNA, 12 nt, Human
gcccucuucucg

SEQ ID NO: 2664642 - RNA, 21 nt, Human
gccacuccgagaggugggcca

SEQ ID NO: 2664643 - RNA, 14 nt, Human
gccagaggccccca

SEQ ID NO: 2664644 - RNA, 21 nt, Human
gccagagagccuggugcugcu

SEQ ID NO: 2664645 - RNA, 24 nt, Human
gccagaggcccccagcccagggcu

SEQ ID NO: 2664646 - RNA, 20 nt, Human
gccagaggcccccagcccag

SEQ ID NO: 2664647 - RNA, 23 nt, Human
gccagaggcccccagcccagggc

SEQ ID NO: 2664648 - RNA, 15 nt, Human
gccagaggcccccag

SEQ ID NO: 2664649 - RNA, 16 nt, Human
gccagaggcccccagc

SEQ ID NO: 2664650 - RNA, 18 nt, Human
gccagaggcccccagccc

SEQ ID NO: 2664651 - RNA, 19 nt, Human
gccagaggcccccagccca

SEQ ID NO: 2664652 - RNA, 12 nt, Human
gccagaggcugg

SEQ ID NO: 2664653 - RNA, 13 nt, Human
gccagaggcuggg

SEQ ID NO: 2664654 - RNA, 22 nt, Human
gccacuccccggcaugagacuc

SEQ ID NO: 2664655 - RNA, 15 nt, Human
gccagccucagacug

SEQ ID NO: 2664656 - RNA, 18 nt, Human
gccagccuccgagaggga

SEQ ID NO: 2664657 - RNA, 20 nt, Human
gccagccuccgagagggaga

SEQ ID NO: 2664658 - RNA, 21 nt, Human
gccagccuccgagagggagag

SEQ ID NO: 2664659 - RNA, 12 nt, Human
gccagccuccuc

SEQ ID NO: 2664660 - RNA, 13 nt, Human
gccagccuccucu

SEQ ID NO: 2664661 - RNA, 14 nt, Human
gccagccuccucug

SEQ ID NO: 2664662 - RNA, 17 nt, Human
gccagccuccucuggac

SEQ ID NO: 2664663 - RNA, 15 nt, Human
gccagccuccucugg

SEQ ID NO: 2664664 - RNA, 16 nt, Human
gccagccuccucugga

SEQ ID NO: 2664665 - RNA, 22 nt, Human
gccaggacaugcaauaaaauuu

SEQ ID NO: 2664666 - RNA, 17 nt, Human
gccaggcucacucacag

SEQ ID NO: 2664667 - RNA, 22 nt, Human
gccaggcucacucacagaguca

SEQ ID NO: 2664668 - RNA, 21 nt, Human
gccaggagcaggcacgggugg

SEQ ID NO: 2664669 - RNA, 18 nt, Human
gccagcugacaucuugaa

SEQ ID NO: 2664670 - RNA, 24 nt, Human
gccaugcuccuggcccacugcauc

SEQ ID NO: 2664671 - RNA, 15 nt, Human
gcccaagccagaggc

SEQ ID NO: 2664672 - RNA, 16 nt, Human
gcccaagccagaggcu

SEQ ID NO: 2664673 - RNA, 17 nt, Human
gcccaagccagaggcug

SEQ ID NO: 2664674 - RNA, 18 nt, Human
gcccaagccagaggcugg

SEQ ID NO: 2664675 - RNA, 21 nt, Human
gcccaagccagaggcuggguu

SEQ ID NO: 2664676 - RNA, 23 nt, Human
gcccaagccagaggcuggguuca

SEQ ID NO: 2664677 - RNA, 13 nt, Human
gcccagaauacug

SEQ ID NO: 2664678 - RNA, 20 nt, Human
gcccagaauaaguuauugca

SEQ ID NO: 2664679 - RNA, 23 nt, Human
gcccagaauaaguuauugcaguu

SEQ ID NO: 2664680 - RNA, 16 nt, Human
gcccagaauaaguuau

SEQ ID NO: 2664681 - RNA, 13 nt, Human
gccaucuguagcu

SEQ ID NO: 2664682 - RNA, 20 nt, Human
gccaugcgcccccuccgccc

SEQ ID NO: 2664683 - RNA, 14 nt, Human
gccaugcuccuggc

SEQ ID NO: 2664684 - RNA, 18 nt, Human
gccaugccgucugccgga

SEQ ID NO: 2664685 - RNA, 15 nt, Human
gccaugaagggaccc

SEQ ID NO: 2664686 - RNA, 16 nt, Human
gccaugaagggacccu

SEQ ID NO: 2664687 - RNA, 19 nt, Human
gccaguccacccugccugc

SEQ ID NO: 2664688 - RNA, 13 nt, Human
gccaguccaggcu

SEQ ID NO: 2664689 - RNA, 14 nt, Human
gccaguccaggcug

SEQ ID NO: 2664690 - RNA, 20 nt, Human
gccaguccaggcugccgugg

SEQ ID NO: 2664691 - RNA, 21 nt, Human
gccaguccaggcugccguggg

SEQ ID NO: 2664692 - RNA, 21 nt, Human
uuuuaaaucuaaaucuauuua

SEQ ID NO: 2664693 - RNA, 14 nt, Human
uuuuaaaucuaaau

SEQ ID NO: 2664694 - RNA, 18 nt, Human
uuuuaaaucuaaaucuau

SEQ ID NO: 2664695 - RNA, 15 nt, Human
uuuuaaauauuuucu

SEQ ID NO: 2664696 - RNA, 17 nt, Human
uuuuaaauauuuucuau

SEQ ID NO: 2664697 - RNA, 23 nt, Human
uuuuaaagacccuccuauucuau

SEQ ID NO: 2664698 - RNA, 15 nt, Human
uuuuaaugaugacaa

SEQ ID NO: 2664699 - RNA, 17 nt, Human
uuuuaaugaugacaaaa

SEQ ID NO: 2664700 - RNA, 18 nt, Human
uuuuaaucuacugcauuu

SEQ ID NO: 2664701 - RNA, 14 nt, Human
uuuguaaaaaucuu

SEQ ID NO: 2664702 - RNA, 22 nt, Human
uuuguaaaaaucuuuugaagca

SEQ ID NO: 2664703 - RNA, 23 nt, Human
uuuguaaaaaucuuuugaagcau

SEQ ID NO: 2664704 - RNA, 16 nt, Human
uuuguauaguuaugua

SEQ ID NO: 2664705 - RNA, 14 nt, Human
uuuguauaguuaug

SEQ ID NO: 2664706 - RNA, 22 nt, Human
uuuguauaguuauguaaauaau

SEQ ID NO: 2664707 - RNA, 21 nt, Human
uuuguauaguuauguaaauaa

SEQ ID NO: 2664708 - RNA, 19 nt, Human
uuuguauaguuauguaaau

SEQ ID NO: 2664709 - RNA, 17 nt, Human
uuuguauaguuauguaa

SEQ ID NO: 2664710 - RNA, 13 nt, Human
uuuguaugaaaac

SEQ ID NO: 2664711 - RNA, 20 nt, Human
uuuguauauugguuuuauga

SEQ ID NO: 2664712 - RNA, 18 nt, Human
uuuguauauugguuuuau

SEQ ID NO: 2664713 - RNA, 15 nt, Human
uuuguaugaaaacau

SEQ ID NO: 2664714 - RNA, 23 nt, Human
uuuguaugaaaacauggaacagu

SEQ ID NO: 2664715 - RNA, 13 nt, Human
uuuguucccggcu

SEQ ID NO: 2664716 - RNA, 19 nt, Human
uuuuaaagaaaagaugaaa

SEQ ID NO: 2664717 - RNA, 11 nt, Human
uuuuaaagaau

SEQ ID NO: 2664718 - RNA, 23 nt, Human
uuuuaaagaauaugacuuuuuau

SEQ ID NO: 2664719 - RNA, 21 nt, Human
uuuggugcuucucagauuucu

SEQ ID NO: 2664720 - RNA, 20 nt, Human
uuuggaaaaguggcguggga

SEQ ID NO: 2664721 - RNA, 14 nt, Human
uuugcaucugaaau

SEQ ID NO: 2664722 - RNA, 22 nt, Human
uuugcaucugaaauaggaaaca

SEQ ID NO: 2664723 - RNA, 13 nt, Human
uuugcaugcaugc

SEQ ID NO: 2664724 - RNA, 20 nt, Human
uuugcaugcaugcaaaugag

SEQ ID NO: 2664725 - RNA, 14 nt, Human
uuugcauguuaugu

SEQ ID NO: 2664726 - RNA, 15 nt, Human
uuugcauguuauguu

SEQ ID NO: 2664727 - RNA, 17 nt, Human
uuugcauguuauguuua

SEQ ID NO: 2664728 - RNA, 18 nt, Human
uuugcauguuauguuuaa

SEQ ID NO: 2664729 - RNA, 15 nt, Human
uuucucuguacuuuu

SEQ ID NO: 2664730 - RNA, 16 nt, Human
uuucucuguacuuuuc

SEQ ID NO: 2664731 - RNA, 18 nt, Human
uuucucuguacuuuucau

SEQ ID NO: 2664732 - RNA, 22 nt, Human
uuucucugcauuuaaaaaaauc

SEQ ID NO: 2664733 - RNA, 20 nt, Human
uuucuacugucaaaugaugu

SEQ ID NO: 2664734 - RNA, 19 nt, Human
uuucuagaauuauuuuuca

SEQ ID NO: 2664735 - RNA, 21 nt, Human
uuucuagaauuauuuuucacu

SEQ ID NO: 2664736 - RNA, 11 nt, Human
uuuccucagug

SEQ ID NO: 2664737 - RNA, 20 nt, Human
uuacagaaucuuccuuuuau

SEQ ID NO: 2664738 - RNA, 20 nt, Human
uuuccucccucugccccucc

SEQ ID NO: 2664739 - RNA, 19 nt, Human
uuuccuggaauugccagcu

SEQ ID NO: 2664740 - RNA, 20 nt, Human
uuuccuggaauugccagcug

SEQ ID NO: 2664741 - RNA, 14 nt, Human
uuugaauauguagu

SEQ ID NO: 2664742 - RNA, 19 nt, Human
uuugaauauguaguaucua

SEQ ID NO: 2664743 - RNA, 19 nt, Human
uuugaaucaauaauauauu

SEQ ID NO: 2664744 - RNA, 17 nt, Human
uuugaacucuucucauu

SEQ ID NO: 2664745 - RNA, 22 nt, Human
uuugaacucuucucauuacuug

SEQ ID NO: 2664746 - RNA, 13 nt, Human
uuucuuaugugac

SEQ ID NO: 2664747 - RNA, 14 nt, Human
uuucuuaugugaca

SEQ ID NO: 2664748 - RNA, 15 nt, Human
uuucuuaugugacau

SEQ ID NO: 2664749 - RNA, 16 nt, Human
uuucuuaugugacauu

SEQ ID NO: 2664750 - RNA, 17 nt, Human
uuucuuaugugacauua

SEQ ID NO: 2664751 - RNA, 12 nt, Human
uuucuguuuucu

SEQ ID NO: 2664752 - RNA, 15 nt, Human
uuucuguugaaguuu

SEQ ID NO: 2664753 - RNA, 15 nt, Human
uuucuucagggcugc

SEQ ID NO: 2664754 - RNA, 16 nt, Human
uuucuucagggcugcu

SEQ ID NO: 2664755 - RNA, 23 nt, Human
uuucuucuguauuuuuuuuucua

SEQ ID NO: 2664756 - RNA, 15 nt, Human
uuucuucucugugag

SEQ ID NO: 2664757 - RNA, 20 nt, Human
uuucuucucugugagaaggu

SEQ ID NO: 2664758 - RNA, 20 nt, Human
uuuuugaaaagcagacauuu

SEQ ID NO: 2664759 - RNA, 13 nt, Human
uuuuuuguaauaa

SEQ ID NO: 2664760 - RNA, 13 nt, Human
uuuuuuguaugug

SEQ ID NO: 2664761 - RNA, 14 nt, Human
uuuuuuguaugaaa

SEQ ID NO: 2664762 - RNA, 13 nt, Human
uuuuuuguaugaa

SEQ ID NO: 2664763 - RNA, 20 nt, Human
uuuuugaacucuucucauua

SEQ ID NO: 2664764 - RNA, 19 nt, Human
uuuuugaacucuucucauu

SEQ ID NO: 2664765 - RNA, 15 nt, Human
uuuuucuaagagaag

SEQ ID NO: 2664766 - RNA, 16 nt, Human
uuuuucuaagagaagu

SEQ ID NO: 2664767 - RNA, 16 nt, Human
uuuuuaagcuucaguu

SEQ ID NO: 2664768 - RNA, 11 nt, Human
uuuuuaagaua

SEQ ID NO: 2664769 - RNA, 20 nt, Human
uuuuuaagcugcaaaucuga

SEQ ID NO: 2664770 - RNA, 16 nt, Human
uuuuuaaauauuuucu

SEQ ID NO: 2664771 - RNA, 15 nt, Human
uuuuuaagauagugu

SEQ ID NO: 2664772 - RNA, 16 nt, Human
uuuuuaagauagugua

SEQ ID NO: 2664773 - RNA, 20 nt, Human
uuuuuaagauaguguaacuu

SEQ ID NO: 2664774 - RNA, 22 nt, Human
uuuuaauuguauuuuuguuguu

SEQ ID NO: 2664775 - RNA, 20 nt, Human
uuuuccuggaauugccagcu

SEQ ID NO: 2664776 - RNA, 14 nt, Human
uuuuaauuguuuaa

SEQ ID NO: 2664777 - RNA, 20 nt, Human
uuuuaaugcuauuugaacaa

SEQ ID NO: 2664778 - RNA, 12 nt, Human
uuuuaauuguau

SEQ ID NO: 2664779 - RNA, 14 nt, Human
uuuuaauuguauuu

SEQ ID NO: 2664780 - RNA, 13 nt, Human
uuuuaauuguauu

SEQ ID NO: 2664781 - RNA, 13 nt, Human
uuuucuacagugg

SEQ ID NO: 2664782 - RNA, 15 nt, Human
uuuucuaagagaagu

SEQ ID NO: 2664783 - RNA, 13 nt, Human
uuuucuaagagaa

SEQ ID NO: 2664784 - RNA, 14 nt, Human
uuuucuacaguggu

SEQ ID NO: 2664785 - RNA, 18 nt, Human
uuuucuacagugguuuua

SEQ ID NO: 2664786 - RNA, 15 nt, Human
uuuuggggagccaga

SEQ ID NO: 2664787 - RNA, 16 nt, Human
uuuuggggagccagaa

SEQ ID NO: 2664788 - RNA, 19 nt, Human
uuuugguaaagacuggcuu

SEQ ID NO: 2664789 - RNA, 22 nt, Human
uuuuggcugaaauucuccugga

SEQ ID NO: 2664790 - RNA, 14 nt, Human
uuuucuaaagacuu

SEQ ID NO: 2664791 - RNA, 12 nt, Human
uuuugacacuga

SEQ ID NO: 2664792 - RNA, 13 nt, Human
uuuugacacugaa

SEQ ID NO: 2664793 - RNA, 14 nt, Human
uuuugacacugaaa

SEQ ID NO: 2664794 - RNA, 18 nt, Human
uuuugacacugaaaguuu

SEQ ID NO: 2664795 - RNA, 19 nt, Human
uuuuggcaaacgcuaaaga

SEQ ID NO: 2664796 - RNA, 22 nt, Human
uuuuggcaaugacucaaagucu

SEQ ID NO: 2664797 - RNA, 23 nt, Human
uuuuggcaaugacucaaagucug

SEQ ID NO: 2664798 - RNA, 19 nt, Human
uuuuggcaaaacucuacuu

SEQ ID NO: 2664799 - RNA, 22 nt, Human
uuuucuuuuuuuuuaaguucuu

SEQ ID NO: 2664800 - RNA, 13 nt, Human
uuuugaaucaaua

SEQ ID NO: 2664801 - RNA, 18 nt, Human
uuuuuaaaacacauguuu

SEQ ID NO: 2664802 - RNA, 14 nt, Human
uuuuuaaaacacau

SEQ ID NO: 2664803 - RNA, 23 nt, Human
uuuuuaaaacacauguuuuuaua

SEQ ID NO: 2664804 - RNA, 18 nt, Human
uuuuuaaaaaauauuuuc

SEQ ID NO: 2664805 - RNA, 19 nt, Human
uuuuuaaaaaauauuuucu

SEQ ID NO: 2664806 - RNA, 18 nt, Human
uuuuguauuuucaugaaa

SEQ ID NO: 2664807 - RNA, 14 nt, Human
uuuuguaugugugu

SEQ ID NO: 2664808 - RNA, 14 nt, Human
uuuuguauguuaaa

SEQ ID NO: 2664809 - RNA, 17 nt, Human
uuuuguauguuaaagag

SEQ ID NO: 2664810 - RNA, 12 nt, Human
uuuuuaaaauuu

SEQ ID NO: 2664811 - RNA, 16 nt, Human
uuuuuaaaauauuuau

SEQ ID NO: 2664812 - RNA, 14 nt, Human
uuuuuaaaauagaa

SEQ ID NO: 2664813 - RNA, 23 nt, Human
uuuuuaaaauagaaauuuuguaa

SEQ ID NO: 2664814 - RNA, 15 nt, Human
uuuuguacugaauuu

SEQ ID NO: 2664815 - RNA, 14 nt, Human
uuuuguauauuggu

SEQ ID NO: 2664816 - RNA, 11 nt, Human
uuuuguaagaa

SEQ ID NO: 2664817 - RNA, 14 nt, Human
uuuuguaaaguuuc

SEQ ID NO: 2664818 - RNA, 16 nt, Human
uuuuguaauaagcaau

SEQ ID NO: 2664819 - RNA, 22 nt, Human
uuuuguaauaagcaaucaaggu

SEQ ID NO: 2664820 - RNA, 12 nt, Human
uuuuguaaaaga

SEQ ID NO: 2664821 - RNA, 15 nt, Human
uuuuguaaaagaaau

SEQ ID NO: 2664822 - RNA, 13 nt, Human
uuuuguaaacauu

SEQ ID NO: 2664823 - RNA, 14 nt, Human
uuuuguaaacauuu

SEQ ID NO: 2664824 - RNA, 15 nt, Human
uuuuguaaacauuua

SEQ ID NO: 2664825 - RNA, 16 nt, Human
uuuuguaaacauuuau

SEQ ID NO: 2664826 - RNA, 17 nt, Human
uuuuguaaacauuuauu

SEQ ID NO: 2664827 - RNA, 15 nt, Human
gucauuaaacugguu

SEQ ID NO: 2664828 - RNA, 13 nt, Human
gucauuaaacugg

SEQ ID NO: 2664829 - RNA, 12 nt, Human
gucauuaaacug

SEQ ID NO: 2664830 - RNA, 12 nt, Human
gucagcuccagc

SEQ ID NO: 2664831 - RNA, 13 nt, Human
gucagcuccagcu

SEQ ID NO: 2664832 - RNA, 17 nt, Human
gucagcugcucccuggc

SEQ ID NO: 2664833 - RNA, 20 nt, Human
gucagcugcucccuggcauu

SEQ ID NO: 2664834 - RNA, 21 nt, Human
gucauuaugagaggcaaugau

SEQ ID NO: 2664835 - RNA, 14 nt, Human
gucauucagaguca

SEQ ID NO: 2664836 - RNA, 20 nt, Human
gucauucagagucagccagg

SEQ ID NO: 2664837 - RNA, 19 nt, Human
gucauugcacauaagcuuc

SEQ ID NO: 2664838 - RNA, 15 nt, Human
guccacccugccugc

SEQ ID NO: 2664839 - RNA, 16 nt, Human
guccacccugccugcc

SEQ ID NO: 2664840 - RNA, 16 nt, Human
guccacgcgugccgug

SEQ ID NO: 2664841 - RNA, 19 nt, Human
guccacgcgugccguggca

SEQ ID NO: 2664842 - RNA, 22 nt, Human
guccacgcgugccguggcacca

SEQ ID NO: 2664843 - RNA, 14 nt, Human
guccagccugcccc

SEQ ID NO: 2664844 - RNA, 22 nt, Human
guccagccugccccggagcugg

SEQ ID NO: 2664845 - RNA, 23 nt, Human
guccagccugccccggagcugga

SEQ ID NO: 2664846 - RNA, 19 nt, Human
guccagcaccuugugccug

SEQ ID NO: 2664847 - RNA, 23 nt, Human
guccagcaccuugugccuggggu

SEQ ID NO: 2664848 - RNA, 23 nt, Human
guccaguaagaucacuguuuaga

SEQ ID NO: 2664849 - RNA, 14 nt, Human
guccaguaagauca

SEQ ID NO: 2664850 - RNA, 21 nt, Human
guccaguaagaucacuguuua

SEQ ID NO: 2664851 - RNA, 20 nt, Human
guccaguaagaucacuguuu

SEQ ID NO: 2664852 - RNA, 19 nt, Human
guccaguaagaucacuguu

SEQ ID NO: 2664853 - RNA, 18 nt, Human
guccaguaagaucacugu

SEQ ID NO: 2664854 - RNA, 15 nt, Human
gucccuagcagccca

SEQ ID NO: 2664855 - RNA, 18 nt, Human
gucccuagcagcccaccc

SEQ ID NO: 2664856 - RNA, 20 nt, Human
gucccuagcagcccacccug

SEQ ID NO: 2664857 - RNA, 21 nt, Human
gucccuagcagcccacccugc

SEQ ID NO: 2664858 - RNA, 15 nt, Human
gucccuaugcauauc

SEQ ID NO: 2664859 - RNA, 11 nt, Human
gucccucugug

SEQ ID NO: 2664860 - RNA, 12 nt, Human
gucccucugugu

SEQ ID NO: 2664861 - RNA, 13 nt, Human
gucccucugugua

SEQ ID NO: 2664862 - RNA, 14 nt, Human
gucccucuguguau

SEQ ID NO: 2664863 - RNA, 22 nt, Human
gucccucuguguauuugcuuuu

SEQ ID NO: 2664864 - RNA, 18 nt, Human
gucccauagucccugcca

SEQ ID NO: 2664865 - RNA, 17 nt, Human
gucccauagucccugcc

SEQ ID NO: 2664866 - RNA, 16 nt, Human
gucccaggcagggaga

SEQ ID NO: 2664867 - RNA, 22 nt, Human
guccccaaccgugucugucugg

SEQ ID NO: 2664868 - RNA, 12 nt, Human
guccccaccccu

SEQ ID NO: 2664869 - RNA, 14 nt, Human
guccccaccccugc

SEQ ID NO: 2664870 - RNA, 15 nt, Human
guccccaccccugcc

SEQ ID NO: 2664871 - RNA, 16 nt, Human
guccccaccccugccc

SEQ ID NO: 2664872 - RNA, 17 nt, Human
guccccaccccugcccc

SEQ ID NO: 2664873 - RNA, 15 nt, Human
gucaagugaaaaagg

SEQ ID NO: 2664874 - RNA, 22 nt, Human
gucaagggcugucauugcacau

SEQ ID NO: 2664875 - RNA, 19 nt, Human
guauuuuguuuuugucuua

SEQ ID NO: 2664876 - RNA, 15 nt, Human
gucaccaccaccccu

SEQ ID NO: 2664877 - RNA, 19 nt, Human
gucaccaccaccccuacca

SEQ ID NO: 2664878 - RNA, 20 nt, Human
gucaccaccaccccuaccac

SEQ ID NO: 2664879 - RNA, 16 nt, Human
gucaccagagacuuua

SEQ ID NO: 2664880 - RNA, 13 nt, Human
gucaccagagacu

SEQ ID NO: 2664881 - RNA, 15 nt, Human
guauuuucuucucug

SEQ ID NO: 2664882 - RNA, 16 nt, Human
guauuuucuucucugu

SEQ ID NO: 2664883 - RNA, 19 nt, Human
guauuuucuucucugugag

SEQ ID NO: 2664884 - RNA, 14 nt, Human
guauuuucauacaa

SEQ ID NO: 2664885 - RNA, 15 nt, Human
guauuuucaugaaaa

SEQ ID NO: 2664886 - RNA, 16 nt, Human
guauuuucaugaaaau

SEQ ID NO: 2664887 - RNA, 19 nt, Human
guauuuucaugaaaauacc

SEQ ID NO: 2664888 - RNA, 18 nt, Human
gucagauguuuaaaacac

SEQ ID NO: 2664889 - RNA, 19 nt, Human
gucagauguuuaaaacacc

SEQ ID NO: 2664890 - RNA, 13 nt, Human
gucagauguuuaa

SEQ ID NO: 2664891 - RNA, 17 nt, Human
gucagauguuuaaaaca

SEQ ID NO: 2664892 - RNA, 15 nt, Human
gucagauguuuaaaa

SEQ ID NO: 2664893 - RNA, 10 nt, Human
gucagagaca

SEQ ID NO: 2664894 - RNA, 14 nt, Human
gucacucauugcug

SEQ ID NO: 2664895 - RNA, 19 nt, Human
gucacuaugggaugagaaa

SEQ ID NO: 2664896 - RNA, 20 nt, Human
gucacuaugggaugagaaaa

SEQ ID NO: 2664897 - RNA, 24 nt, Human
gucacucauugcugagccucugcu

SEQ ID NO: 2664898 - RNA, 23 nt, Human
gucacucauugcugagccucugc

SEQ ID NO: 2664899 - RNA, 22 nt, Human
gucacucauugcugagccucug

SEQ ID NO: 2664900 - RNA, 21 nt, Human
gucacucauugcugagccucu

SEQ ID NO: 2664901 - RNA, 20 nt, Human
gucacucauugcugagccuc

SEQ ID NO: 2664902 - RNA, 19 nt, Human
gucacucauugcugagccu

SEQ ID NO: 2664903 - RNA, 18 nt, Human
gucacucauugcugagcc

SEQ ID NO: 2664904 - RNA, 14 nt, Human
gucacuaauacaca

SEQ ID NO: 2664905 - RNA, 19 nt, Human
gucacguuuggugcuucuc

SEQ ID NO: 2664906 - RNA, 17 nt, Human
guagguucagccaaggu

SEQ ID NO: 2664907 - RNA, 15 nt, Human
guagguucagccaag

SEQ ID NO: 2664908 - RNA, 16 nt, Human
guagguucagccaagg

SEQ ID NO: 2664909 - RNA, 13 nt, Human
guagguaagacug

SEQ ID NO: 2664910 - RNA, 23 nt, Human
guagucccagcuacuugggaggc

SEQ ID NO: 2664911 - RNA, 12 nt, Human
guaguccccaac

SEQ ID NO: 2664912 - RNA, 12 nt, Human
guagucccagcu

SEQ ID NO: 2664913 - RNA, 12 nt, Human
guaguccuguga

SEQ ID NO: 2664914 - RNA, 15 nt, Human
guagagugugccuga

SEQ ID NO: 2664915 - RNA, 19 nt, Human
guagaguugaucaaaauca

SEQ ID NO: 2664916 - RNA, 16 nt, Human
guagauaauuucaggg

SEQ ID NO: 2664917 - RNA, 17 nt, Human
guagauaauuucagggu

SEQ ID NO: 2664918 - RNA, 18 nt, Human
guagauaauuucagggug

SEQ ID NO: 2664919 - RNA, 15 nt, Human
guagauccauuucca

SEQ ID NO: 2664920 - RNA, 22 nt, Human
guagauccauuuccauugcuua

SEQ ID NO: 2664921 - RNA, 17 nt, Human
guagauauguauucuuu

SEQ ID NO: 2664922 - RNA, 18 nt, Human
guagauauguauucuuuu

SEQ ID NO: 2664923 - RNA, 13 nt, Human
guagcacuuacug

SEQ ID NO: 2664924 - RNA, 22 nt, Human
guagcagugagucauaucuuaa

SEQ ID NO: 2664925 - RNA, 16 nt, Human
guagauuugauuuuuu

SEQ ID NO: 2664926 - RNA, 12 nt, Human
guagauuugauu

SEQ ID NO: 2664927 - RNA, 14 nt, Human
guagauuuuccaaa

SEQ ID NO: 2664928 - RNA, 17 nt, Human
guagcccccuggccucu

SEQ ID NO: 2664929 - RNA, 16 nt, Human
guagcccccuggccuc

SEQ ID NO: 2664930 - RNA, 13 nt, Human
guagggagggcgg

SEQ ID NO: 2664931 - RNA, 23 nt, Human
guagcccccuggccucugugccu

SEQ ID NO: 2664932 - RNA, 19 nt, Human
guagcccccuggccucugu

SEQ ID NO: 2664933 - RNA, 18 nt, Human
guagcccccuggccucug

SEQ ID NO: 2664934 - RNA, 18 nt, Human
guauauauacauauauau

SEQ ID NO: 2664935 - RNA, 19 nt, Human
guauaugguauauauacau

SEQ ID NO: 2664936 - RNA, 13 nt, Human
guauauauuuugu

SEQ ID NO: 2664937 - RNA, 22 nt, Human
guauauauuuugugugaaauug

SEQ ID NO: 2664938 - RNA, 13 nt, Human
guauauuaaaaaa

SEQ ID NO: 2664939 - RNA, 19 nt, Human
guauauuaaaaaagagaca

SEQ ID NO: 2664940 - RNA, 13 nt, Human
guauauuacaaug

SEQ ID NO: 2664941 - RNA, 17 nt, Human
guauccuggaacaauau

SEQ ID NO: 2664942 - RNA, 21 nt, Human
guauccuggaacaauauuuua

SEQ ID NO: 2664943 - RNA, 22 nt, Human
guauccuggaacaauauuuuau

SEQ ID NO: 2664944 - RNA, 23 nt, Human
guauccuggaacaauauuuuaug

SEQ ID NO: 2664945 - RNA, 14 nt, Human
guauauuacaauga

SEQ ID NO: 2664946 - RNA, 22 nt, Human
guaucuagagcuuaaugcuaca

SEQ ID NO: 2664947 - RNA, 18 nt, Human
guauccugggggacccaa

SEQ ID NO: 2664948 - RNA, 22 nt, Human
guaucuccggcucccagccuca

SEQ ID NO: 2664949 - RNA, 21 nt, Human
guaucuccggcucccagccuc

SEQ ID NO: 2664950 - RNA, 20 nt, Human
guaucuccggcucccagccu

SEQ ID NO: 2664951 - RNA, 18 nt, Human
guaucuccggcucccagc

SEQ ID NO: 2664952 - RNA, 16 nt, Human
guaucuccggcuccca

SEQ ID NO: 2664953 - RNA, 18 nt, Human
guauaguuauguaaauaa

SEQ ID NO: 2664954 - RNA, 20 nt, Human
guauagcaugaaauaaaaua

SEQ ID NO: 2664955 - RNA, 15 nt, Human
guauaguuauguaaa

SEQ ID NO: 2664956 - RNA, 14 nt, Human
guauaguuauguaa

SEQ ID NO: 2664957 - RNA, 23 nt, Human
guauagccuauggcagaaaaaau

SEQ ID NO: 2664958 - RNA, 21 nt, Human
guauagccuauggcagaaaaa

SEQ ID NO: 2664959 - RNA, 13 nt, Human
guauguguuuaga

SEQ ID NO: 2664960 - RNA, 13 nt, Human
guauuaaagacag

SEQ ID NO: 2664961 - RNA, 18 nt, Human
guauuaaaacuaaauuuc

SEQ ID NO: 2664962 - RNA, 20 nt, Human
guauuaaaacuaaauuucac

SEQ ID NO: 2664963 - RNA, 17 nt, Human
guauguuucucuuugau

SEQ ID NO: 2664964 - RNA, 20 nt, Human
guauguuucucuuugauuau

SEQ ID NO: 2664965 - RNA, 18 nt, Human
guauguuaaagagaauga

SEQ ID NO: 2664966 - RNA, 22 nt, Human
guauguguuuagaauugaaggu

SEQ ID NO: 2664967 - RNA, 18 nt, Human
guauguguuuagaauuga

SEQ ID NO: 2664968 - RNA, 13 nt, Human
guaugaaaacaug

SEQ ID NO: 2664969 - RNA, 20 nt, Human
guaugaaaacauggaacagu

SEQ ID NO: 2664970 - RNA, 17 nt, Human
guaugaaaacauggaac

SEQ ID NO: 2664971 - RNA, 20 nt, Human
gucugugugcgcucugugga

SEQ ID NO: 2664972 - RNA, 13 nt, Human
gucuguggaucag

SEQ ID NO: 2664973 - RNA, 22 nt, Human
gucuguuggcaggcuggccagu

SEQ ID NO: 2664974 - RNA, 18 nt, Human
gucuguugugugucaugc

SEQ ID NO: 2664975 - RNA, 21 nt, Human
gucugugugugugugugugcg

SEQ ID NO: 2664976 - RNA, 20 nt, Human
gucuguugugugucaugcca

SEQ ID NO: 2664977 - RNA, 20 nt, Human
gucuguuggcaggcuggcca

SEQ ID NO: 2664978 - RNA, 21 nt, Human
gucuguuggcaggcuggccag

SEQ ID NO: 2664979 - RNA, 22 nt, Human
gucuguugugugucaugccagu

SEQ ID NO: 2664980 - RNA, 14 nt, Human
gucuguuggcaggc

SEQ ID NO: 2664981 - RNA, 16 nt, Human
gucuguuggcaggcug

SEQ ID NO: 2664982 - RNA, 18 nt, Human
gucuguuggcaggcuggc

SEQ ID NO: 2664983 - RNA, 19 nt, Human
gucuguuggcaggcuggcc

SEQ ID NO: 2664984 - RNA, 18 nt, Human
gucugugaacagagagac

SEQ ID NO: 2664985 - RNA, 21 nt, Human
gucugugaacagagagacccu

SEQ ID NO: 2664986 - RNA, 16 nt, Human
gucugucuuuccugaa

SEQ ID NO: 2664987 - RNA, 20 nt, Human
gucugucuuuccugaaccau

SEQ ID NO: 2664988 - RNA, 23 nt, Human
gucuaagacuauauauauaaaug

SEQ ID NO: 2664989 - RNA, 23 nt, Human
gucugccggacccggaggccgag

SEQ ID NO: 2664990 - RNA, 21 nt, Human
gucuuaaaaaguggaaaaaua

SEQ ID NO: 2664991 - RNA, 21 nt, Human
gucuugggcagagcuggcucu

SEQ ID NO: 2664992 - RNA, 22 nt, Human
gucuugggcagagcuggcucug

SEQ ID NO: 2664993 - RNA, 16 nt, Human
gucuugggcagagcug

SEQ ID NO: 2664994 - RNA, 19 nt, Human
gucuugggcagagcuggcu

SEQ ID NO: 2664995 - RNA, 20 nt, Human
gucuugggcagagcuggcuc

SEQ ID NO: 2664996 - RNA, 18 nt, Human
gucuugauucagucacau

SEQ ID NO: 2664997 - RNA, 15 nt, Human
gucuuggauauauag

SEQ ID NO: 2664998 - RNA, 18 nt, Human
gucgugccuguguccaug

SEQ ID NO: 2664999 - RNA, 23 nt, Human
gucguggacacacacagacuauu

SEQ ID NO: 2665000 - RNA, 19 nt, Human
gucgucacuaauacacagu

SEQ ID NO: 2665001 - RNA, 12 nt, Human
gucgugccugug

SEQ ID NO: 2665002 - RNA, 13 nt, Human
gucgugccugugu

SEQ ID NO: 2665003 - RNA, 14 nt, Human
gucgugccuguguc

SEQ ID NO: 2665004 - RNA, 15 nt, Human
gucgugccugugucc

SEQ ID NO: 2665005 - RNA, 17 nt, Human
gucgugccuguguccau

SEQ ID NO: 2665006 - RNA, 13 nt, Human
gucucacccaugc

SEQ ID NO: 2665007 - RNA, 23 nt, Human
gucucacccaugcaagcagagga

SEQ ID NO: 2665008 - RNA, 14 nt, Human
gucggcugaccaug

SEQ ID NO: 2665009 - RNA, 17 nt, Human
gucggcugaccaugcuc

SEQ ID NO: 2665010 - RNA, 18 nt, Human
gucggcugaccaugcuca

SEQ ID NO: 2665011 - RNA, 22 nt, Human
gucccugccacgaauuucugug

SEQ ID NO: 2665012 - RNA, 20 nt, Human
gucucuucuuggggcccagu

SEQ ID NO: 2665013 - RNA, 21 nt, Human
gucucuucuuggggcccagug

SEQ ID NO: 2665014 - RNA, 22 nt, Human
gucucuucuuggggcccagugc

SEQ ID NO: 2665015 - RNA, 23 nt, Human
gucucuucuuggggcccagugca

SEQ ID NO: 2665016 - RNA, 18 nt, Human
gucucucuucucagagug

SEQ ID NO: 2665017 - RNA, 19 nt, Human
gucucucuucucagagugg

SEQ ID NO: 2665018 - RNA, 14 nt, Human
gugcggccuuuggc

SEQ ID NO: 2665019 - RNA, 15 nt, Human
gugcgcucuguggau

SEQ ID NO: 2665020 - RNA, 22 nt, Human
gugcgcucuguggaugccaggg

SEQ ID NO: 2665021 - RNA, 18 nt, Human
gugcgcaucuugccucca

SEQ ID NO: 2665022 - RNA, 20 nt, Human
gugcgcaucuugccuccagg

SEQ ID NO: 2665023 - RNA, 24 nt, Human
gugcgcaucuugccuccaggugca

SEQ ID NO: 2665024 - RNA, 15 nt, Human
gugcagauggagaga

SEQ ID NO: 2665025 - RNA, 14 nt, Human
gugcauaguuucuu

SEQ ID NO: 2665026 - RNA, 15 nt, Human
gugcauaguuucuuu

SEQ ID NO: 2665027 - RNA, 16 nt, Human
gugauuuaauccaguu

SEQ ID NO: 2665028 - RNA, 21 nt, Human
gugauuucuuuaaaagaauga

SEQ ID NO: 2665029 - RNA, 14 nt, Human
gugauuugaaaaau

SEQ ID NO: 2665030 - RNA, 17 nt, Human
gugauuugaaaaauaua

SEQ ID NO: 2665031 - RNA, 22 nt, Human
gugauuugaaaaauauaaaauu

SEQ ID NO: 2665032 - RNA, 23 nt, Human
gugauuugaaaaauauaaaauua

SEQ ID NO: 2665033 - RNA, 17 nt, Human
gugcaaaaccuuuuacu

SEQ ID NO: 2665034 - RNA, 14 nt, Human
gugauuuuuuuguc

SEQ ID NO: 2665035 - RNA, 15 nt, Human
gugcagagguacccu

SEQ ID NO: 2665036 - RNA, 19 nt, Human
gugcagagguacccugggu

SEQ ID NO: 2665037 - RNA, 16 nt, Human
gugcagagccuucuca

SEQ ID NO: 2665038 - RNA, 23 nt, Human
gugcagagccuucucagaagcac

SEQ ID NO: 2665039 - RNA, 12 nt, Human
gugcagaaugua

SEQ ID NO: 2665040 - RNA, 13 nt, Human
gugcagaauguaa

SEQ ID NO: 2665041 - RNA, 22 nt, Human
gugcagaauguaagugggccca

SEQ ID NO: 2665042 - RNA, 14 nt, Human
gucuuggccagcca

SEQ ID NO: 2665043 - RNA, 15 nt, Human
gucuugguguaauuu

SEQ ID NO: 2665044 - RNA, 14 nt, Human
gucuuuuuuuuccu

SEQ ID NO: 2665045 - RNA, 15 nt, Human
gucuuuuuuuuccug

SEQ ID NO: 2665046 - RNA, 11 nt, Human
gugaauuuuua

SEQ ID NO: 2665047 - RNA, 13 nt, Human
gugaauuuuuaag

SEQ ID NO: 2665048 - RNA, 14 nt, Human
gugaauuauugaca

SEQ ID NO: 2665049 - RNA, 16 nt, Human
gugaauuauugacacu

SEQ ID NO: 2665050 - RNA, 17 nt, Human
gugaauuauugacacug

SEQ ID NO: 2665051 - RNA, 18 nt, Human
gugaauuauugacacuga

SEQ ID NO: 2665052 - RNA, 19 nt, Human
gugaauuauugacacugaa

SEQ ID NO: 2665053 - RNA, 21 nt, Human
gugaaugcugggacucagccu

SEQ ID NO: 2665054 - RNA, 21 nt, Human
gugaaugaugauccuaggcau

SEQ ID NO: 2665055 - RNA, 13 nt, Human
gugaaugcuggga

SEQ ID NO: 2665056 - RNA, 15 nt, Human
gugaaugcugggacu

SEQ ID NO: 2665057 - RNA, 20 nt, Human
gugaaugcugggacucagcc

SEQ ID NO: 2665058 - RNA, 16 nt, Human
gugacaauuuuguaca

SEQ ID NO: 2665059 - RNA, 16 nt, Human
gugacaauucuguuuu

SEQ ID NO: 2665060 - RNA, 19 nt, Human
gugacaauucuguuuuuaa

SEQ ID NO: 2665061 - RNA, 17 nt, Human
gugaucaauauuuuuau

SEQ ID NO: 2665062 - RNA, 20 nt, Human
gugaucaauauuuuuauauc

SEQ ID NO: 2665063 - RNA, 23 nt, Human
gugauccacccaacccuaucucc

SEQ ID NO: 2665064 - RNA, 22 nt, Human
gugauagucuuuugcuuuuggc

SEQ ID NO: 2665065 - RNA, 15 nt, Human
gugaguuugagcugc

SEQ ID NO: 2665066 - RNA, 17 nt, Human
gugaguuugagcugccu

SEQ ID NO: 2665067 - RNA, 21 nt, Human
gugaguuugagcugccuuccc

SEQ ID NO: 2665068 - RNA, 15 nt, Human
gugauacauuuuuua

SEQ ID NO: 2665069 - RNA, 18 nt, Human
gugaguuugagcugccuu

SEQ ID NO: 2665070 - RNA, 16 nt, Human
gugagugguugaauau

SEQ ID NO: 2665071 - RNA, 18 nt, Human
guucugagcugccagugg

SEQ ID NO: 2665072 - RNA, 16 nt, Human
guucugagcugccagu

SEQ ID NO: 2665073 - RNA, 22 nt, Human
guucuaacagugaaguuuuacu

SEQ ID NO: 2665074 - RNA, 21 nt, Human
guuccuugguccuaguaagaa

SEQ ID NO: 2665075 - RNA, 14 nt, Human
guucguugguuaua

SEQ ID NO: 2665076 - RNA, 17 nt, Human
guugaaaaacagcugag

SEQ ID NO: 2665077 - RNA, 15 nt, Human
guucuuuuaagccca

SEQ ID NO: 2665078 - RNA, 21 nt, Human
guucuuuguucauagcccagu

SEQ ID NO: 2665079 - RNA, 13 nt, Human
guucuuuguucau

SEQ ID NO: 2665080 - RNA, 20 nt, Human
guucuuuguucauagcccag

SEQ ID NO: 2665081 - RNA, 14 nt, Human
guucuuuggauucu

SEQ ID NO: 2665082 - RNA, 16 nt, Human
guucuggcuguuugag

SEQ ID NO: 2665083 - RNA, 12 nt, Human
guucuuucagaa

SEQ ID NO: 2665084 - RNA, 16 nt, Human
guucuggccagaaugc

SEQ ID NO: 2665085 - RNA, 13 nt, Human
guucuggccagaa

SEQ ID NO: 2665086 - RNA, 12 nt, Human
guucuggccaga

SEQ ID NO: 2665087 - RNA, 22 nt, Human
guuggaggugauuccagugaag

SEQ ID NO: 2665088 - RNA, 19 nt, Human
guugccacaguagaacugu

SEQ ID NO: 2665089 - RNA, 15 nt, Human
guugccaagcuccaa

SEQ ID NO: 2665090 - RNA, 18 nt, Human
guugccaagcuccaagcc

SEQ ID NO: 2665091 - RNA, 19 nt, Human
guugccaagcuccaagccc

SEQ ID NO: 2665092 - RNA, 14 nt, Human
guuggcaaaaaggc

SEQ ID NO: 2665093 - RNA, 18 nt, Human
guuggcaaaaaggcagga

SEQ ID NO: 2665094 - RNA, 13 nt, Human
guuggcaggcugg

SEQ ID NO: 2665095 - RNA, 14 nt, Human
guuggcaggcuggc

SEQ ID NO: 2665096 - RNA, 15 nt, Human
guuggcaggcuggcc

SEQ ID NO: 2665097 - RNA, 16 nt, Human
guuggcaggcuggcca

SEQ ID NO: 2665098 - RNA, 17 nt, Human
guuggcaggcuggccag

SEQ ID NO: 2665099 - RNA, 20 nt, Human
guuggcaggcuggccagucc

SEQ ID NO: 2665100 - RNA, 13 nt, Human
guugaauaugauu

SEQ ID NO: 2665101 - RNA, 23 nt, Human
guugauucgguauccccccaucu

SEQ ID NO: 2665102 - RNA, 17 nt, Human
guugauuuuuacugugu

SEQ ID NO: 2665103 - RNA, 14 nt, Human
guugcaagauguga

SEQ ID NO: 2665104 - RNA, 15 nt, Human
guugcaagaugugaa

SEQ ID NO: 2665105 - RNA, 16 nt, Human
guugcaagaugugaau

SEQ ID NO: 2665106 - RNA, 17 nt, Human
guugcaagaugugaauu

SEQ ID NO: 2665107 - RNA, 18 nt, Human
guugcaagaugugaauua

SEQ ID NO: 2665108 - RNA, 23 nt, Human
guugcauuuuaacccuauuuuac

SEQ ID NO: 2665109 - RNA, 13 nt, Human
guugcauggaaau

SEQ ID NO: 2665110 - RNA, 14 nt, Human
guugcauggaaauc

SEQ ID NO: 2665111 - RNA, 15 nt, Human
guugcaggaccucag

SEQ ID NO: 2665112 - RNA, 15 nt, Human
guuacucucuugcac

SEQ ID NO: 2665113 - RNA, 21 nt, Human
guuacucucuugcaccaaauu

SEQ ID NO: 2665114 - RNA, 16 nt, Human
guuaguuuguauauau

SEQ ID NO: 2665115 - RNA, 17 nt, Human
guuaguuuguauauauu

SEQ ID NO: 2665116 - RNA, 21 nt, Human
guuaguuuguauauauuauua

SEQ ID NO: 2665117 - RNA, 12 nt, Human
guuauaauuuuu

SEQ ID NO: 2665118 - RNA, 23 nt, Human
guuauaauuuuuuuuaaaauaga

SEQ ID NO: 2665119 - RNA, 18 nt, Human
guucaaggucacuguuuc

SEQ ID NO: 2665120 - RNA, 21 nt, Human
guucaaggucacuguuuccug

SEQ ID NO: 2665121 - RNA, 22 nt, Human
guucaaggucacuguuuccugg

SEQ ID NO: 2665122 - RNA, 13 nt, Human
guuaugcaucauu

SEQ ID NO: 2665123 - RNA, 15 nt, Human
guuauguaaauaauu

SEQ ID NO: 2665124 - RNA, 21 nt, Human
guuauguaaauaauucuuuuu

SEQ ID NO: 2665125 - RNA, 13 nt, Human
guuauuagauguu

SEQ ID NO: 2665126 - RNA, 17 nt, Human
guuauguuuaauaagcu

SEQ ID NO: 2665127 - RNA, 17 nt, Human
guuauguuuuucugugu

SEQ ID NO: 2665128 - RNA, 17 nt, Human
guuaucaaaauagucua

SEQ ID NO: 2665129 - RNA, 13 nt, Human
guuauaagaagaa

SEQ ID NO: 2665130 - RNA, 22 nt, Human
guucaccuugaagaaccucuca

SEQ ID NO: 2665131 - RNA, 14 nt, Human
guucaucauccaga

SEQ ID NO: 2665132 - RNA, 21 nt, Human
guucaucauccagauguggcu

SEQ ID NO: 2665133 - RNA, 22 nt, Human
guucaucauccagauguggcua

SEQ ID NO: 2665134 - RNA, 15 nt, Human
guucagccaagguuu

SEQ ID NO: 2665135 - RNA, 12 nt, Human
guucagccaagg

SEQ ID NO: 2665136 - RNA, 14 nt, Human
guucagcaguacag

SEQ ID NO: 2665137 - RNA, 18 nt, Human
guucagcaguacagccga

SEQ ID NO: 2665138 - RNA, 16 nt, Human
guucaucgauuuucua

SEQ ID NO: 2665139 - RNA, 20 nt, Human
guuccucaaagcuuggauua

SEQ ID NO: 2665140 - RNA, 15 nt, Human
guuccucaaauuuuu

SEQ ID NO: 2665141 - RNA, 20 nt, Human
guuccucaaauuuuuugacu

SEQ ID NO: 2665142 - RNA, 22 nt, Human
guuccucccccaguuccuccca

SEQ ID NO: 2665143 - RNA, 12 nt, Human
guuccucugccu

SEQ ID NO: 2665144 - RNA, 13 nt, Human
guuccucugccug

SEQ ID NO: 2665145 - RNA, 14 nt, Human
guuccucugccugc

SEQ ID NO: 2665146 - RNA, 16 nt, Human
guuccucugccugccc

SEQ ID NO: 2665147 - RNA, 13 nt, Human
guuccucugcuca

SEQ ID NO: 2665148 - RNA, 23 nt, Human
guuccucugcucaccgcccauca

SEQ ID NO: 2665149 - RNA, 15 nt, Human
guuccucugccugcc

SEQ ID NO: 2665150 - RNA, 22 nt, Human
guuccucuuugguguacagacu

SEQ ID NO: 2665151 - RNA, 20 nt, Human
guuccuguucaguaauaaaa

SEQ ID NO: 2665152 - RNA, 13 nt, Human
guuccugucccug

SEQ ID NO: 2665153 - RNA, 17 nt, Human
guuccugucccugcgcc

SEQ ID NO: 2665154 - RNA, 16 nt, Human
guuccugucccugcgc

SEQ ID NO: 2665155 - RNA, 15 nt, Human
guuccugucccugcg

SEQ ID NO: 2665156 - RNA, 14 nt, Human
guuccugucccugc

SEQ ID NO: 2665157 - RNA, 22 nt, Human
guuccucauuagcauuuugcua

SEQ ID NO: 2665158 - RNA, 17 nt, Human
guuccagggucccucug

SEQ ID NO: 2665159 - RNA, 19 nt, Human
guuccagggucccucugug

SEQ ID NO: 2665160 - RNA, 20 nt, Human
guuccagggucccucugugu

SEQ ID NO: 2665161 - RNA, 21 nt, Human
guuccagggucccucugugua

SEQ ID NO: 2665162 - RNA, 15 nt, Human
guuccaccccaagag

SEQ ID NO: 2665163 - RNA, 21 nt, Human
guuccaccccaagagaacucg

SEQ ID NO: 2665164 - RNA, 13 nt, Human
guucauuugugua

SEQ ID NO: 2665165 - RNA, 15 nt, Human
guucauucuucagau

SEQ ID NO: 2665166 - RNA, 14 nt, Human
guguuauaugaaca

SEQ ID NO: 2665167 - RNA, 14 nt, Human
guguuaguggcacc

SEQ ID NO: 2665168 - RNA, 15 nt, Human
guguuaguggcaccg

SEQ ID NO: 2665169 - RNA, 21 nt, Human
guguuaguggcaccgccuccc

SEQ ID NO: 2665170 - RNA, 13 nt, Human
guguuaauuuaag

SEQ ID NO: 2665171 - RNA, 18 nt, Human
guguuaauuuaaguuuug

SEQ ID NO: 2665172 - RNA, 16 nt, Human
guguuaauuuaaguuu

SEQ ID NO: 2665173 - RNA, 23 nt, Human
guguuauaugaacauacaaaugc

SEQ ID NO: 2665174 - RNA, 17 nt, Human
guguuauaugaacauac

SEQ ID NO: 2665175 - RNA, 16 nt, Human
guguuuugcaagugcu

SEQ ID NO: 2665176 - RNA, 15 nt, Human
guguuuuauaaaaua

SEQ ID NO: 2665177 - RNA, 16 nt, Human
guguuuuagaugguuu

SEQ ID NO: 2665178 - RNA, 13 nt, Human
guguuuuuuaaga

SEQ ID NO: 2665179 - RNA, 14 nt, Human
guguuuuuuaagau

SEQ ID NO: 2665180 - RNA, 15 nt, Human
guguuuuuuaagaua

SEQ ID NO: 2665181 - RNA, 21 nt, Human
guguuuuuuaagauaguguaa

SEQ ID NO: 2665182 - RNA, 17 nt, Human
guguuuuuuuauuucua

SEQ ID NO: 2665183 - RNA, 19 nt, Human
guguuuuuuuauuucuacu

SEQ ID NO: 2665184 - RNA, 23 nt, Human
guguuuuuucuuuuuuuuuaagu

SEQ ID NO: 2665185 - RNA, 14 nt, Human
guuaaacauugaag

SEQ ID NO: 2665186 - RNA, 15 nt, Human
guuaaagagaaugag

SEQ ID NO: 2665187 - RNA, 21 nt, Human
guuaaagggauauuuuuuucu

SEQ ID NO: 2665188 - RNA, 15 nt, Human
guuaacaucaguuuu

SEQ ID NO: 2665189 - RNA, 17 nt, Human
guuaacugauuugcaau

SEQ ID NO: 2665190 - RNA, 14 nt, Human
guguccggucccug

SEQ ID NO: 2665191 - RNA, 18 nt, Human
gugucucacuaaagcaug

SEQ ID NO: 2665192 - RNA, 22 nt, Human
gugucuccuuaagcugcagaga

SEQ ID NO: 2665193 - RNA, 18 nt, Human
gugucuggaauuguggcu

SEQ ID NO: 2665194 - RNA, 19 nt, Human
gugucuggaauuguggcua

SEQ ID NO: 2665195 - RNA, 23 nt, Human
gugucuggaauuguggcuauccu

SEQ ID NO: 2665196 - RNA, 23 nt, Human
gugugcacauccgcgugugccug

SEQ ID NO: 2665197 - RNA, 11 nt, Human
gugugcuggga

SEQ ID NO: 2665198 - RNA, 12 nt, Human
gugugcugggag

SEQ ID NO: 2665199 - RNA, 19 nt, Human
gugugcugggagcuccacu

SEQ ID NO: 2665200 - RNA, 16 nt, Human
gugugcgcucugugga

SEQ ID NO: 2665201 - RNA, 12 nt, Human
gugugggaaagc

SEQ ID NO: 2665202 - RNA, 13 nt, Human
guguggccaggcu

SEQ ID NO: 2665203 - RNA, 15 nt, Human
guguggccuguggcu

SEQ ID NO: 2665204 - RNA, 12 nt, Human
guguggcagugg

SEQ ID NO: 2665205 - RNA, 14 nt, Human
guguggcagugguu

SEQ ID NO: 2665206 - RNA, 19 nt, Human
guguggauugccucugaaa

SEQ ID NO: 2665207 - RNA, 23 nt, Human
guguggauugccucugaaaagug

SEQ ID NO: 2665208 - RNA, 13 nt, Human
guguggagaagcg

SEQ ID NO: 2665209 - RNA, 21 nt, Human
guguggacuguggcacuugcc

SEQ ID NO: 2665210 - RNA, 21 nt, Human
guguggagaagcggcuggcag

SEQ ID NO: 2665211 - RNA, 14 nt, Human
guguguugucucuu

SEQ ID NO: 2665212 - RNA, 16 nt, Human
guguguugucucuuga

SEQ ID NO: 2665213 - RNA, 22 nt, Human
guggugccauccccagggggca

SEQ ID NO: 2665214 - RNA, 18 nt, Human
guggugauuugaaaaaua

SEQ ID NO: 2665215 - RNA, 21 nt, Human
guggugauuugaaaaauauaa

SEQ ID NO: 2665216 - RNA, 16 nt, Human
guggugccauccccag

SEQ ID NO: 2665217 - RNA, 17 nt, Human
guggugccauccccagg

SEQ ID NO: 2665218 - RNA, 13 nt, Human
guggucuguuggc

SEQ ID NO: 2665219 - RNA, 17 nt, Human
guggucuguuggcaggc

SEQ ID NO: 2665220 - RNA, 19 nt, Human
guggucuguuggcaggcug

SEQ ID NO: 2665221 - RNA, 20 nt, Human
guggucuguuggcaggcugg

SEQ ID NO: 2665222 - RNA, 21 nt, Human
guggucuguuggcaggcuggc

SEQ ID NO: 2665223 - RNA, 22 nt, Human
guggucuguuggcaggcuggcc

SEQ ID NO: 2665224 - RNA, 23 nt, Human
guggucuguuggcaggcuggcca

SEQ ID NO: 2665225 - RNA, 22 nt, Human
guggucacaacuugauggcugc

SEQ ID NO: 2665226 - RNA, 15 nt, Human
guggucacagcggag

SEQ ID NO: 2665227 - RNA, 16 nt, Human
guggucacagcggagg

SEQ ID NO: 2665228 - RNA, 18 nt, Human
guggucacagcggaggug

SEQ ID NO: 2665229 - RNA, 22 nt, Human
guggucacagcggaggugugga

SEQ ID NO: 2665230 - RNA, 12 nt, Human
gugguagaaaca

SEQ ID NO: 2665231 - RNA, 13 nt, Human
gugguagaaacaa

SEQ ID NO: 2665232 - RNA, 17 nt, Human
gugguagagugugccug

SEQ ID NO: 2665233 - RNA, 13 nt, Human
gugguagagaagc

SEQ ID NO: 2665234 - RNA, 15 nt, Human
guggucggugggacc

SEQ ID NO: 2665235 - RNA, 16 nt, Human
guggucggugggaccc

SEQ ID NO: 2665236 - RNA, 20 nt, Human
guggucucuucuuggggccc

SEQ ID NO: 2665237 - RNA, 21 nt, Human
guggucucuucuuggggccca

SEQ ID NO: 2665238 - RNA, 23 nt, Human
guggucucuucuuggggcccagu

SEQ ID NO: 2665239 - RNA, 16 nt, Human
guguacagccagacca

SEQ ID NO: 2665240 - RNA, 14 nt, Human
guguaauuugaaga

SEQ ID NO: 2665241 - RNA, 15 nt, Human
guguaauuugaagau

SEQ ID NO: 2665242 - RNA, 14 nt, Human
guguaugcacagua

SEQ ID NO: 2665243 - RNA, 14 nt, Human
guguauaauauaaa

SEQ ID NO: 2665244 - RNA, 13 nt, Human
gugucccaggcag

SEQ ID NO: 2665245 - RNA, 14 nt, Human
gugucccaggcagg

SEQ ID NO: 2665246 - RNA, 19 nt, Human
gugucccaggcagggagac

SEQ ID NO: 2665247 - RNA, 16 nt, Human
guguauguagaagcau

SEQ ID NO: 2665248 - RNA, 19 nt, Human
guguccccgcugcugugca

SEQ ID NO: 2665249 - RNA, 21 nt, Human
guguccccgcugcugugcaac

SEQ ID NO: 2665250 - RNA, 17 nt, Human
guguauauuugauuuau

SEQ ID NO: 2665251 - RNA, 14 nt, Human
guguauauuugauu

SEQ ID NO: 2665252 - RNA, 13 nt, Human
guguauauuugau

SEQ ID NO: 2665253 - RNA, 12 nt, Human
guguauauuuga

SEQ ID NO: 2665254 - RNA, 14 nt, Human
guggcuacugacau

SEQ ID NO: 2665255 - RNA, 15 nt, Human
guggcuauccugauu

SEQ ID NO: 2665256 - RNA, 14 nt, Human
guggcucacgccug

SEQ ID NO: 2665257 - RNA, 17 nt, Human
gugggcaaacaggcagu

SEQ ID NO: 2665258 - RNA, 22 nt, Human
guggcugucaaugggaccugug

SEQ ID NO: 2665259 - RNA, 20 nt, Human
guggcuggaagauccugcgg

SEQ ID NO: 2665260 - RNA, 22 nt, Human
guggcuggaaccacauugaaga

SEQ ID NO: 2665261 - RNA, 24 nt, Human
guggcuggaaccacauugaagaau

SEQ ID NO: 2665262 - RNA, 12 nt, Human
guggcuggaaga

SEQ ID NO: 2665263 - RNA, 17 nt, Human
guggcuggaagauccug

SEQ ID NO: 2665264 - RNA, 14 nt, Human
gugggccucggccc

SEQ ID NO: 2665265 - RNA, 18 nt, Human
gugggcucugugcaguca

SEQ ID NO: 2665266 - RNA, 17 nt, Human
gugggcuggacuucuac

SEQ ID NO: 2665267 - RNA, 19 nt, Human
gugggcuggacuucuaccu

SEQ ID NO: 2665268 - RNA, 13 nt, Human
guggggcagggag

SEQ ID NO: 2665269 - RNA, 14 nt, Human
guggggcagggagc

SEQ ID NO: 2665270 - RNA, 15 nt, Human
guggggcagggagcu

SEQ ID NO: 2665271 - RNA, 16 nt, Human
gugggcuacaugcugg

SEQ ID NO: 2665272 - RNA, 19 nt, Human
gugggcuacaugcuggggu

SEQ ID NO: 2665273 - RNA, 21 nt, Human
guggcuguugacgcaccugug

SEQ ID NO: 2665274 - RNA, 12 nt, Human
gugggcccaccc

SEQ ID NO: 2665275 - RNA, 22 nt, Human
gugggcccacccggugggaccc

SEQ ID NO: 2665276 - RNA, 17 nt, Human
gugggccagucugugga

SEQ ID NO: 2665277 - RNA, 18 nt, Human
gugggccagucuguggau

SEQ ID NO: 2665278 - RNA, 15 nt, Human
gugggccagucugug

SEQ ID NO: 2665279 - RNA, 16 nt, Human
gugggccagucugugg

SEQ ID NO: 2665280 - RNA, 15 nt, Human
guuuuccccaugaca

SEQ ID NO: 2665281 - RNA, 20 nt, Human
guuuuccagguuuaagcugu

SEQ ID NO: 2665282 - RNA, 13 nt, Human
guuuuguaaaaga

SEQ ID NO: 2665283 - RNA, 14 nt, Human
guuuuguaaaagaa

SEQ ID NO: 2665284 - RNA, 15 nt, Human
guuuuguaaaagaaa

SEQ ID NO: 2665285 - RNA, 13 nt, Human
guuuuguaaacau

SEQ ID NO: 2665286 - RNA, 16 nt, Human
guuuuguaaacauuua

SEQ ID NO: 2665287 - RNA, 17 nt, Human
guuuuguaaacauuuau

SEQ ID NO: 2665288 - RNA, 19 nt, Human
guuuuguacauguaacauu

SEQ ID NO: 2665289 - RNA, 17 nt, Human
guuuuguaggagacuug

SEQ ID NO: 2665290 - RNA, 23 nt, Human
guuuguuuuuuguuuuucugcuu

SEQ ID NO: 2665291 - RNA, 12 nt, Human
guuuguuuuugg

SEQ ID NO: 2665292 - RNA, 18 nt, Human
guuuuaaaacuggaccug

SEQ ID NO: 2665293 - RNA, 21 nt, Human
guuuuaaaacuggaccuguau

SEQ ID NO: 2665294 - RNA, 12 nt, Human
guuuucagaaaa

SEQ ID NO: 2665295 - RNA, 19 nt, Human
guuuucagaaaaagaaaug

SEQ ID NO: 2665296 - RNA, 18 nt, Human
guuugucgcucaugugug

SEQ ID NO: 2665297 - RNA, 20 nt, Human
guuuguguguugucucuuga

SEQ ID NO: 2665298 - RNA, 13 nt, Human
guuuggugcuucu

SEQ ID NO: 2665299 - RNA, 16 nt, Human
guuugguaaauguuuc

SEQ ID NO: 2665300 - RNA, 19 nt, Human
guuugguaaauguuucuuu

SEQ ID NO: 2665301 - RNA, 22 nt, Human
guuuccucuaguucuuuguuca

SEQ ID NO: 2665302 - RNA, 18 nt, Human
guuuccucuaguucuuug

SEQ ID NO: 2665303 - RNA, 17 nt, Human
guuuccuccaagcuauu

SEQ ID NO: 2665304 - RNA, 20 nt, Human
guuuccuccauuugagaaaa

SEQ ID NO: 2665305 - RNA, 13 nt, Human
guuuccgugcgug

SEQ ID NO: 2665306 - RNA, 17 nt, Human
guuuccgugcguggcac

SEQ ID NO: 2665307 - RNA, 19 nt, Human
guuucuuuauuuuguguaa

SEQ ID NO: 2665308 - RNA, 19 nt, Human
guuucuuuaaccuuguaua

SEQ ID NO: 2665309 - RNA, 21 nt, Human
guuucuuuaaccuuguauaaa

SEQ ID NO: 2665310 - RNA, 17 nt, Human
guuucuugcaagcaugc

SEQ ID NO: 2665311 - RNA, 22 nt, Human
guuucuuaacccuuuccagagu

SEQ ID NO: 2665312 - RNA, 18 nt, Human
guuugagaucagccuggg

SEQ ID NO: 2665313 - RNA, 14 nt, Human
guuucuuuuaaaga

SEQ ID NO: 2665314 - RNA, 11 nt, Human
guuugagaaau

SEQ ID NO: 2665315 - RNA, 17 nt, Human
guuugagaucagccugg

SEQ ID NO: 2665316 - RNA, 14 nt, Human
guuucuuuuguuug

SEQ ID NO: 2665317 - RNA, 18 nt, Human
guuucuuuuguuugguaa

SEQ ID NO: 2665318 - RNA, 16 nt, Human
guuugaaaauaguuua

SEQ ID NO: 2665319 - RNA, 13 nt, Human
guuugaaaauagu

SEQ ID NO: 2665320 - RNA, 14 nt, Human
guuugaaaacuuca

SEQ ID NO: 2665321 - RNA, 18 nt, Human
guuugaaaacuucagaag

SEQ ID NO: 2665322 - RNA, 20 nt, Human
guuugaaaacuucagaagca

SEQ ID NO: 2665323 - RNA, 21 nt, Human
guuugaaaacuucagaagcaa

SEQ ID NO: 2665324 - RNA, 16 nt, Human
guuuagaauugaaggu

SEQ ID NO: 2665325 - RNA, 19 nt, Human
guuuauaaaauauaaacaa

SEQ ID NO: 2665326 - RNA, 14 nt, Human
guuuauaaacagaa

SEQ ID NO: 2665327 - RNA, 13 nt, Human
guuuauaaaucuu

SEQ ID NO: 2665328 - RNA, 13 nt, Human
guuuauaauaaaa

SEQ ID NO: 2665329 - RNA, 14 nt, Human
guuuauaauaaaaa

SEQ ID NO: 2665330 - RNA, 15 nt, Human
guuuauaauaaaaau

SEQ ID NO: 2665331 - RNA, 13 nt, Human
guuuauaaaauau

SEQ ID NO: 2665332 - RNA, 18 nt, Human
guuuauaaaauauaaaca

SEQ ID NO: 2665333 - RNA, 15 nt, Human
guuucaguuuguugg

SEQ ID NO: 2665334 - RNA, 18 nt, Human
guuucaguuuguuggaaa

SEQ ID NO: 2665335 - RNA, 21 nt, Human
guuucaguuuguuggaaagua

SEQ ID NO: 2665336 - RNA, 14 nt, Human
guuuaucauucaag

SEQ ID NO: 2665337 - RNA, 15 nt, Human
guuuaucauucaagu

SEQ ID NO: 2665338 - RNA, 16 nt, Human
guuuaucauucaagug

SEQ ID NO: 2665339 - RNA, 17 nt, Human
guuuaucauucaagugu

SEQ ID NO: 2665340 - RNA, 20 nt, Human
guuuaucauucaaguguaaa

SEQ ID NO: 2665341 - RNA, 15 nt, Human
guuguuuauaauaaa

SEQ ID NO: 2665342 - RNA, 16 nt, Human
guuguuuauaauaaaa

SEQ ID NO: 2665343 - RNA, 18 nt, Human
guuguuuauaauaaaaau

SEQ ID NO: 2665344 - RNA, 21 nt, Human
guuguucuuggcaauaaauuu

SEQ ID NO: 2665345 - RNA, 15 nt, Human
guuguucuuucagaa

SEQ ID NO: 2665346 - RNA, 19 nt, Human
guuguucuuggcaauaaau

SEQ ID NO: 2665347 - RNA, 12 nt, Human
guuuagaacagg

SEQ ID NO: 2665348 - RNA, 14 nt, Human
guuuagaauugaag

SEQ ID NO: 2665349 - RNA, 15 nt, Human
guuuagaacagguuu

SEQ ID NO: 2665350 - RNA, 13 nt, Human
guuuaccuuucuc

SEQ ID NO: 2665351 - RNA, 21 nt, Human
guuuacauuugaugcaugucu

SEQ ID NO: 2665352 - RNA, 18 nt, Human
guugucagguuauuuauu

SEQ ID NO: 2665353 - RNA, 14 nt, Human
guuguccaacuauu

SEQ ID NO: 2665354 - RNA, 12 nt, Human
guugucagcuga

SEQ ID NO: 2665355 - RNA, 16 nt, Human
guugucuggcaaggac

SEQ ID NO: 2665356 - RNA, 14 nt, Human
guugucuggcaagg

SEQ ID NO: 2665357 - RNA, 16 nt, Human
guuguguuuuuuaaga

SEQ ID NO: 2665358 - RNA, 15 nt, Human
uaaaacaucauuccu

SEQ ID NO: 2665359 - RNA, 20 nt, Human
uaaaacaucauuccuuuuua

SEQ ID NO: 2665360 - RNA, 17 nt, Human
uaaaacaucauuccuuu

SEQ ID NO: 2665361 - RNA, 16 nt, Human
uaaaacaucauuccuu

SEQ ID NO: 2665362 - RNA, 13 nt, Human
uaaaacauagcaa

SEQ ID NO: 2665363 - RNA, 14 nt, Human
uaaaacauagcaaa

SEQ ID NO: 2665364 - RNA, 15 nt, Human
uaaaacauagcaaau

SEQ ID NO: 2665365 - RNA, 11 nt, Human
uaaaaccaaag

SEQ ID NO: 2665366 - RNA, 13 nt, Human
uaaaaccaaagag

SEQ ID NO: 2665367 - RNA, 21 nt, Human
uaaaaggaaagaaaacaucuu

SEQ ID NO: 2665368 - RNA, 15 nt, Human
uaaaaggaaagaaaa

SEQ ID NO: 2665369 - RNA, 14 nt, Human
uaaaaggauggcaa

SEQ ID NO: 2665370 - RNA, 21 nt, Human
uaaaacacaccuaagagaaaa

SEQ ID NO: 2665371 - RNA, 13 nt, Human
uaaaacagaaaaa

SEQ ID NO: 2665372 - RNA, 17 nt, Human
uaaaacagaguaaucuu

SEQ ID NO: 2665373 - RNA, 19 nt, Human
uaaaacagaguaaucuugu

SEQ ID NO: 2665374 - RNA, 14 nt, Human
uaaaacaaaauuug

SEQ ID NO: 2665375 - RNA, 15 nt, Human
uaaaacaaaauuuga

SEQ ID NO: 2665376 - RNA, 17 nt, Human
uaaaacaaaauuugacu

SEQ ID NO: 2665377 - RNA, 21 nt, Human
uaaaacaaaauuugacuaauu

SEQ ID NO: 2665378 - RNA, 12 nt, Human
uaaaaauuguua

SEQ ID NO: 2665379 - RNA, 14 nt, Human
uaaaaagcaaaaau

SEQ ID NO: 2665380 - RNA, 17 nt, Human
guuuuuacaagauguau

SEQ ID NO: 2665381 - RNA, 17 nt, Human
uaaaguguguuucuaug

SEQ ID NO: 2665382 - RNA, 20 nt, Human
uaaagcuuguugacucagcu

SEQ ID NO: 2665383 - RNA, 20 nt, Human
uaaaggaagcacucuguaua

SEQ ID NO: 2665384 - RNA, 10 nt, Human
uaaagaaaag

SEQ ID NO: 2665385 - RNA, 13 nt, Human
uaaagaaaagaug

SEQ ID NO: 2665386 - RNA, 15 nt, Human
uaaagaaaagaugaa

SEQ ID NO: 2665387 - RNA, 16 nt, Human
uaaagaaaagaugaaa

SEQ ID NO: 2665388 - RNA, 13 nt, Human
uaaagcaauagaa

SEQ ID NO: 2665389 - RNA, 14 nt, Human
uaaagcaauagaaa

SEQ ID NO: 2665390 - RNA, 15 nt, Human
uaaagcaauagaaac

SEQ ID NO: 2665391 - RNA, 22 nt, Human
uaaagcacagucugaugacaca

SEQ ID NO: 2665392 - RNA, 23 nt, Human
uaaacauuuauuuuuuuuaaaga

SEQ ID NO: 2665393 - RNA, 18 nt, Human
uaaacauugaaguaauga

SEQ ID NO: 2665394 - RNA, 17 nt, Human
uaaacugucgugucaua

SEQ ID NO: 2665395 - RNA, 22 nt, Human
uaaacuugguuuuuaaaaaacu

SEQ ID NO: 2665396 - RNA, 18 nt, Human
uaaacuucauauguaauc

SEQ ID NO: 2665397 - RNA, 22 nt, Human
uaaacuucugcaacaagcaugc

SEQ ID NO: 2665398 - RNA, 23 nt, Human
uaaacuucugcaacaagcaugca

SEQ ID NO: 2665399 - RNA, 14 nt, Human
uaaagaaaaaaaua

SEQ ID NO: 2665400 - RNA, 15 nt, Human
uaaagaaaaaaauac

SEQ ID NO: 2665401 - RNA, 20 nt, Human
uaaagaaaaaaaugucaaaa

SEQ ID NO: 2665402 - RNA, 17 nt, Human
uaaagaaaaaaauguca

SEQ ID NO: 2665403 - RNA, 16 nt, Human
uaaagaaaaaaauguc

SEQ ID NO: 2665404 - RNA, 14 nt, Human
uaaagaaaaaaaug

SEQ ID NO: 2665405 - RNA, 20 nt, Human
uaaagaaaaauaucuuggcc

SEQ ID NO: 2665406 - RNA, 22 nt, Human
uaaagaaaaaaaugucaaaagu

SEQ ID NO: 2665407 - RNA, 12 nt, Human
uaaaaucaugaa

SEQ ID NO: 2665408 - RNA, 18 nt, Human
uaaaaucaugaaacuugu

SEQ ID NO: 2665409 - RNA, 22 nt, Human
uaaacaugaaaacacuugaaau

SEQ ID NO: 2665410 - RNA, 14 nt, Human
uaaacacucaccuu

SEQ ID NO: 2665411 - RNA, 16 nt, Human
uaaacacucaccuucu

SEQ ID NO: 2665412 - RNA, 17 nt, Human
uaaacacucaccuucua

SEQ ID NO: 2665413 - RNA, 15 nt, Human
uaaaagguaaugugu

SEQ ID NO: 2665414 - RNA, 16 nt, Human
uaauggcaugucagac

SEQ ID NO: 2665415 - RNA, 19 nt, Human
uaauggaaguguauuuauu

SEQ ID NO: 2665416 - RNA, 20 nt, Human
uaauggaaguguauuuauuu

SEQ ID NO: 2665417 - RNA, 23 nt, Human
uaauggaaguguauuuauuuuac

SEQ ID NO: 2665418 - RNA, 15 nt, Human
uaauggauuucagaa

SEQ ID NO: 2665419 - RNA, 16 nt, Human
uaaugcuauuugaaca

SEQ ID NO: 2665420 - RNA, 17 nt, Human
uaaugcuauuugaacaa

SEQ ID NO: 2665421 - RNA, 19 nt, Human
uaauccccuaaaauaacag

SEQ ID NO: 2665422 - RNA, 14 nt, Human
uaaugcuacaauuu

SEQ ID NO: 2665423 - RNA, 15 nt, Human
uaaugcuacaauuuu

SEQ ID NO: 2665424 - RNA, 17 nt, Human
uaauuaggcaaggcuau

SEQ ID NO: 2665425 - RNA, 13 nt, Human
uaauguuuucaaa

SEQ ID NO: 2665426 - RNA, 14 nt, Human
uaauguuuucaaaa

SEQ ID NO: 2665427 - RNA, 18 nt, Human
uaauuaaccuuacuaauu

SEQ ID NO: 2665428 - RNA, 19 nt, Human
uaauuaaccuuacuaauua

SEQ ID NO: 2665429 - RNA, 16 nt, Human
uaauuaacugaaacau

SEQ ID NO: 2665430 - RNA, 14 nt, Human
uaauaaucaagagc

SEQ ID NO: 2665431 - RNA, 12 nt, Human
uaauaaucaaga

SEQ ID NO: 2665432 - RNA, 12 nt, Human
uaauaaucuugu

SEQ ID NO: 2665433 - RNA, 15 nt, Human
uaauaaucuuguuuc

SEQ ID NO: 2665434 - RNA, 18 nt, Human
uaauaaucuuguuucuga

SEQ ID NO: 2665435 - RNA, 20 nt, Human
uaauaaucuuguuucugaaa

SEQ ID NO: 2665436 - RNA, 22 nt, Human
uaauaaucaagagccuuaaaac

SEQ ID NO: 2665437 - RNA, 20 nt, Human
uaauaaucaagagccuuaaa

SEQ ID NO: 2665438 - RNA, 19 nt, Human
uaauaaucaagagccuuaa

SEQ ID NO: 2665439 - RNA, 15 nt, Human
uaauaauguuuaaua

SEQ ID NO: 2665440 - RNA, 16 nt, Human
uaauaauggcaucaau

SEQ ID NO: 2665441 - RNA, 14 nt, Human
uaagucuuucaugg

SEQ ID NO: 2665442 - RNA, 21 nt, Human
uaaucccugcuuuuuguguuu

SEQ ID NO: 2665443 - RNA, 14 nt, Human
uaaucccugcuuuu

SEQ ID NO: 2665444 - RNA, 17 nt, Human
uaaucccugcuuuuugu

SEQ ID NO: 2665445 - RNA, 13 nt, Human
uaaucccugcuuu

SEQ ID NO: 2665446 - RNA, 20 nt, Human
uaauauuaaggaagacaaug

SEQ ID NO: 2665447 - RNA, 16 nt, Human
uaaucuacugcauuua

SEQ ID NO: 2665448 - RNA, 14 nt, Human
uaaucuacugcauu

SEQ ID NO: 2665449 - RNA, 17 nt, Human
uaaucuagauaucgacu

SEQ ID NO: 2665450 - RNA, 22 nt, Human
uaaucuagauaucgacuuguuu

SEQ ID NO: 2665451 - RNA, 12 nt, Human
uaaguccagugu

SEQ ID NO: 2665452 - RNA, 14 nt, Human
uaagucauguaugu

SEQ ID NO: 2665453 - RNA, 17 nt, Human
uaagucauguauguuuc

SEQ ID NO: 2665454 - RNA, 18 nt, Human
uaagucauguauguuucu

SEQ ID NO: 2665455 - RNA, 18 nt, Human
uaagugauuuuuuugucc

SEQ ID NO: 2665456 - RNA, 19 nt, Human
uaagugaggaaaucaaagu

SEQ ID NO: 2665457 - RNA, 21 nt, Human
uaagugaggaaaucaaagugc

SEQ ID NO: 2665458 - RNA, 14 nt, Human
uaauaaauauauac

SEQ ID NO: 2665459 - RNA, 19 nt, Human
uaauaagcuacuagcaaaa

SEQ ID NO: 2665460 - RNA, 12 nt, Human
uaauaagcuagu

SEQ ID NO: 2665461 - RNA, 15 nt, Human
uaauaagcacuguaa

SEQ ID NO: 2665462 - RNA, 16 nt, Human
uaauaagcacuguaaa

SEQ ID NO: 2665463 - RNA, 21 nt, Human
uaauaagcuaguugaauacuu

SEQ ID NO: 2665464 - RNA, 20 nt, Human
uaauaagcuaguugaauacu

SEQ ID NO: 2665465 - RNA, 17 nt, Human
uaauaagcuaguugaau

SEQ ID NO: 2665466 - RNA, 16 nt, Human
uaauaagcuaguugaa

SEQ ID NO: 2665467 - RNA, 23 nt, Human
uaauaagcuaguugaauacuuga

SEQ ID NO: 2665468 - RNA, 13 nt, Human
uaauaacugugua

SEQ ID NO: 2665469 - RNA, 17 nt, Human
uaauaacuguguacugu

SEQ ID NO: 2665470 - RNA, 13 nt, Human
uaagguccuaagg

SEQ ID NO: 2665471 - RNA, 15 nt, Human
uaaggggaagaauga

SEQ ID NO: 2665472 - RNA, 16 nt, Human
uaaggggaagaaugaa

SEQ ID NO: 2665473 - RNA, 20 nt, Human
uaaggggaagaaugaaagcu

SEQ ID NO: 2665474 - RNA, 19 nt, Human
uaaggggaggaaccagagu

SEQ ID NO: 2665475 - RNA, 12 nt, Human
uaagguguuuga

SEQ ID NO: 2665476 - RNA, 18 nt, Human
uaaggucuuucaguacuu

SEQ ID NO: 2665477 - RNA, 21 nt, Human
uaaggucuuucaguacuuuuu

SEQ ID NO: 2665478 - RNA, 21 nt, Human
uaagguguuugaaaauaguuu

SEQ ID NO: 2665479 - RNA, 20 nt, Human
uaagguguuugaaaauaguu

SEQ ID NO: 2665480 - RNA, 18 nt, Human
uaagguguuugaaaauag

SEQ ID NO: 2665481 - RNA, 17 nt, Human
uaagguguuugaaaaua

SEQ ID NO: 2665482 - RNA, 16 nt, Human
uaagguguuugaaaau

SEQ ID NO: 2665483 - RNA, 15 nt, Human
uaagguguuugaaaa

SEQ ID NO: 2665484 - RNA, 16 nt, Human
uaagcccuaagguccu

SEQ ID NO: 2665485 - RNA, 15 nt, Human
uaagcuacuagcaaa

SEQ ID NO: 2665486 - RNA, 18 nt, Human
uaagcuacuagcaaaaua

SEQ ID NO: 2665487 - RNA, 22 nt, Human
uaagcguauggcuuuauuuuuu

SEQ ID NO: 2665488 - RNA, 16 nt, Human
uaagcguauggcuuua

SEQ ID NO: 2665489 - RNA, 15 nt, Human
uaagcguauggcuuu

SEQ ID NO: 2665490 - RNA, 23 nt, Human
uaagggaacaaguugagcuauga

SEQ ID NO: 2665491 - RNA, 17 nt, Human
uaagggaacaaguugag

SEQ ID NO: 2665492 - RNA, 11 nt, Human
uaagggaaaaa

SEQ ID NO: 2665493 - RNA, 12 nt, Human
uaagggaaaaau

SEQ ID NO: 2665494 - RNA, 17 nt, Human
uaagggaaaaauauaua

SEQ ID NO: 2665495 - RNA, 17 nt, Human
uaaggauuuuucucuua

SEQ ID NO: 2665496 - RNA, 22 nt, Human
uaagcuaguugaauacuugaac

SEQ ID NO: 2665497 - RNA, 21 nt, Human
uaagcuaguugaauacuugaa

SEQ ID NO: 2665498 - RNA, 20 nt, Human
uaagcuaguugaauacuuga

SEQ ID NO: 2665499 - RNA, 19 nt, Human
uaagcuaguugaauacuug

SEQ ID NO: 2665500 - RNA, 18 nt, Human
uaagcuaguugaauacuu

SEQ ID NO: 2665501 - RNA, 16 nt, Human
uaagcuaguugaauac

SEQ ID NO: 2665502 - RNA, 15 nt, Human
uaaauucaacuuugu

SEQ ID NO: 2665503 - RNA, 16 nt, Human
uaaauucaacuuugua

SEQ ID NO: 2665504 - RNA, 18 nt, Human
uaaauucaacuuuguaaa

SEQ ID NO: 2665505 - RNA, 19 nt, Human
uaaauucaacuuuguaaaa

SEQ ID NO: 2665506 - RNA, 20 nt, Human
uaaauucugauuucuuuuca

SEQ ID NO: 2665507 - RNA, 16 nt, Human
uaaauucugauuucuu

SEQ ID NO: 2665508 - RNA, 15 nt, Human
uaaauucugauuucu

SEQ ID NO: 2665509 - RNA, 14 nt, Human
uaaauucugauuuc

SEQ ID NO: 2665510 - RNA, 13 nt, Human
uaaauucugauuu

SEQ ID NO: 2665511 - RNA, 12 nt, Human
uaaauucugauu

SEQ ID NO: 2665512 - RNA, 11 nt, Human
uaaauucugau

SEQ ID NO: 2665513 - RNA, 13 nt, Human
uaaauuuaguguu

SEQ ID NO: 2665514 - RNA, 14 nt, Human
uaaauuuaguguuu

SEQ ID NO: 2665515 - RNA, 21 nt, Human
uaaauuucacuacuagauuga

SEQ ID NO: 2665516 - RNA, 15 nt, Human
uaaauuucuuaugug

SEQ ID NO: 2665517 - RNA, 16 nt, Human
uaaauuucuuauguga

SEQ ID NO: 2665518 - RNA, 18 nt, Human
uaaauuucuuaugugaca

SEQ ID NO: 2665519 - RNA, 22 nt, Human
uaaauuucuuaugugacauuaa

SEQ ID NO: 2665520 - RNA, 14 nt, Human
uaacacuccucugc

SEQ ID NO: 2665521 - RNA, 12 nt, Human
uaacacauuuuu

SEQ ID NO: 2665522 - RNA, 19 nt, Human
uaacacauuuuuuugcaug

SEQ ID NO: 2665523 - RNA, 20 nt, Human
uaacacauuuuuuugcaugc

SEQ ID NO: 2665524 - RNA, 21 nt, Human
uaacacauuuuuuugcaugca

SEQ ID NO: 2665525 - RNA, 18 nt, Human
uaacaccaugauuaacca

SEQ ID NO: 2665526 - RNA, 23 nt, Human
uaaauggccucauguggcuggaa

SEQ ID NO: 2665527 - RNA, 18 nt, Human
uaaaugguaauaagcacu

SEQ ID NO: 2665528 - RNA, 19 nt, Human
uaaaugguaauaagcacug

SEQ ID NO: 2665529 - RNA, 15 nt, Human
uaaauguauaaauau

SEQ ID NO: 2665530 - RNA, 19 nt, Human
uaaauguauaaauauacag

SEQ ID NO: 2665531 - RNA, 22 nt, Human
uaaauguauaaauauacaguau

SEQ ID NO: 2665532 - RNA, 12 nt, Human
uaaauguaaacu

SEQ ID NO: 2665533 - RNA, 14 nt, Human
uaaauguaaacuca

SEQ ID NO: 2665534 - RNA, 15 nt, Human
uaaauguaaacucag

SEQ ID NO: 2665535 - RNA, 16 nt, Human
uaaauguaaacucagc

SEQ ID NO: 2665536 - RNA, 20 nt, Human
uaaaugucuaguuguaacac

SEQ ID NO: 2665537 - RNA, 12 nt, Human
uaaauggccuca

SEQ ID NO: 2665538 - RNA, 16 nt, Human
uaaauggccucaugug

SEQ ID NO: 2665539 - RNA, 22 nt, Human
uaaauggccucauguggcugga

SEQ ID NO: 2665540 - RNA, 15 nt, Human
uaaaugcccucuucu

SEQ ID NO: 2665541 - RNA, 22 nt, Human
uaaaugcccucuucucgugccu

SEQ ID NO: 2665542 - RNA, 19 nt, Human
uaacuggaacaaauuauuu

SEQ ID NO: 2665543 - RNA, 15 nt, Human
uaacuguguacuguu

SEQ ID NO: 2665544 - RNA, 20 nt, Human
uaacuuuuguaaauacacau

SEQ ID NO: 2665545 - RNA, 15 nt, Human
uaagaggcagcguga

SEQ ID NO: 2665546 - RNA, 21 nt, Human
uaagaaaauauauucuuucaa

SEQ ID NO: 2665547 - RNA, 23 nt, Human
uaagaaaauauauucuuucaaag

SEQ ID NO: 2665548 - RNA, 24 nt, Human
uaagaaacuuauuucucauaucaa

SEQ ID NO: 2665549 - RNA, 16 nt, Human
uaagaaauguauaaac

SEQ ID NO: 2665550 - RNA, 18 nt, Human
uaagaaauguauaaacuu

SEQ ID NO: 2665551 - RNA, 16 nt, Human
uaaccacuucagcuga

SEQ ID NO: 2665552 - RNA, 17 nt, Human
uaaauucugagccugau

SEQ ID NO: 2665553 - RNA, 22 nt, Human
uaacacuucuuacgcaaugcuu

SEQ ID NO: 2665554 - RNA, 19 nt, Human
uaacccccuuaaauuuaau

SEQ ID NO: 2665555 - RNA, 19 nt, Human
uaacucccagugaugcugu

SEQ ID NO: 2665556 - RNA, 15 nt, Human
uaacuccccacccca

SEQ ID NO: 2665557 - RNA, 16 nt, Human
uaacucaccagcccca

SEQ ID NO: 2665558 - RNA, 21 nt, Human
uaacucaccagccccacugcc

SEQ ID NO: 2665559 - RNA, 16 nt, Human
uaacccauaauugaag

SEQ ID NO: 2665560 - RNA, 15 nt, Human
uaacucaaauacaca

SEQ ID NO: 2665561 - RNA, 18 nt, Human
uaacucaaauacacauuu

SEQ ID NO: 2665562 - RNA, 20 nt, Human
uaacucaaauacacauuugc

SEQ ID NO: 2665563 - RNA, 21 nt, Human
uaacucaaauacacauuugcu

SEQ ID NO: 2665564 - RNA, 15 nt, Human
uaacucaccagcccc

SEQ ID NO: 2665565 - RNA, 19 nt, Human
uauaugaacauacaaaugc

SEQ ID NO: 2665566 - RNA, 13 nt, Human
uauauuugauuua

SEQ ID NO: 2665567 - RNA, 18 nt, Human
uauaugcuuuauuaaugu

SEQ ID NO: 2665568 - RNA, 17 nt, Human
uauauggaagaggaaaa

SEQ ID NO: 2665569 - RNA, 15 nt, Human
uauauuuguaaagcu

SEQ ID NO: 2665570 - RNA, 17 nt, Human
uauauuuguaaagcuau

SEQ ID NO: 2665571 - RNA, 22 nt, Human
uauauuugauuuauuaacuuaa

SEQ ID NO: 2665572 - RNA, 20 nt, Human
uauauuugauuuauuaacuu

SEQ ID NO: 2665573 - RNA, 17 nt, Human
uauauuugauuuauuaa

SEQ ID NO: 2665574 - RNA, 16 nt, Human
uauauuugauuuauua

SEQ ID NO: 2665575 - RNA, 13 nt, Human
uauauuuugucau

SEQ ID NO: 2665576 - RNA, 14 nt, Human
uauauuuugucaua

SEQ ID NO: 2665577 - RNA, 16 nt, Human
uauauuuugugugaaa

SEQ ID NO: 2665578 - RNA, 18 nt, Human
uauauuuugugugaaauu

SEQ ID NO: 2665579 - RNA, 19 nt, Human
uauauuuugugugaaauug

SEQ ID NO: 2665580 - RNA, 22 nt, Human
uauauuuugugugaaauugcau

SEQ ID NO: 2665581 - RNA, 14 nt, Human
uauauuuucuguuu

SEQ ID NO: 2665582 - RNA, 15 nt, Human
uauauuuuauauuac

SEQ ID NO: 2665583 - RNA, 14 nt, Human
uaucaaaauagucu

SEQ ID NO: 2665584 - RNA, 9 nt, Human
uaucaguag

SEQ ID NO: 2665585 - RNA, 21 nt, Human
uaucaguaacccccuuaaauu

SEQ ID NO: 2665586 - RNA, 13 nt, Human
uaucauucaagug

SEQ ID NO: 2665587 - RNA, 14 nt, Human
uaucauucaagugu

SEQ ID NO: 2665588 - RNA, 15 nt, Human
uaucauauauuuaau

SEQ ID NO: 2665589 - RNA, 19 nt, Human
uaucauauauuuaaucuua

SEQ ID NO: 2665590 - RNA, 13 nt, Human
uaucaugcaaaau

SEQ ID NO: 2665591 - RNA, 14 nt, Human
uaucaugcaaaaua

SEQ ID NO: 2665592 - RNA, 15 nt, Human
uaucaugcaaaauau

SEQ ID NO: 2665593 - RNA, 13 nt, Human
uauaucuggccuc

SEQ ID NO: 2665594 - RNA, 19 nt, Human
uauauaaaacggugcugug

SEQ ID NO: 2665595 - RNA, 13 nt, Human
uauaucugcaaaa

SEQ ID NO: 2665596 - RNA, 14 nt, Human
uauauaacauauau

SEQ ID NO: 2665597 - RNA, 17 nt, Human
uauauaacauauaugga

SEQ ID NO: 2665598 - RNA, 18 nt, Human
uauauaacauauauggaa

SEQ ID NO: 2665599 - RNA, 15 nt, Human
uauagucaauggcuu

SEQ ID NO: 2665600 - RNA, 22 nt, Human
uauagucaauggcuuguucauc

SEQ ID NO: 2665601 - RNA, 16 nt, Human
uauagucuaagacuau

SEQ ID NO: 2665602 - RNA, 18 nt, Human
uauagucuaagacuauau

SEQ ID NO: 2665603 - RNA, 19 nt, Human
uauagucuaagacuauaua

SEQ ID NO: 2665604 - RNA, 20 nt, Human
uauagucuaagacuauauau

SEQ ID NO: 2665605 - RNA, 21 nt, Human
uauagaggcuagcuucugcuu

SEQ ID NO: 2665606 - RNA, 18 nt, Human
uauaaaguaguccuguga

SEQ ID NO: 2665607 - RNA, 16 nt, Human
uauaaaguaguccugu

SEQ ID NO: 2665608 - RNA, 22 nt, Human
uauagaaaaauaaaaaucucuu

SEQ ID NO: 2665609 - RNA, 23 nt, Human
uauagaaaaauaaaaaucucuuu

SEQ ID NO: 2665610 - RNA, 13 nt, Human
uauagaaagcuau

SEQ ID NO: 2665611 - RNA, 24 nt, Human
uauagaaagcuauauaagacaaga

SEQ ID NO: 2665612 - RNA, 19 nt, Human
uauaaaguggaaguaugua

SEQ ID NO: 2665613 - RNA, 23 nt, Human
uaguauuaucaaagggauaaaga

SEQ ID NO: 2665614 - RNA, 16 nt, Human
uaguauuuauuuaugu

SEQ ID NO: 2665615 - RNA, 18 nt, Human
uaguauuuauuuauguac

SEQ ID NO: 2665616 - RNA, 20 nt, Human
uaguucuuuaaacugucgug

SEQ ID NO: 2665617 - RNA, 15 nt, Human
uaguucuuuaaacug

SEQ ID NO: 2665618 - RNA, 12 nt, Human
uaguucuuuaaa

SEQ ID NO: 2665619 - RNA, 17 nt, Human
uaguugaauacuugaac

SEQ ID NO: 2665620 - RNA, 16 nt, Human
uaguugaauacuugaa

SEQ ID NO: 2665621 - RNA, 15 nt, Human
uaguugaauacuuga

SEQ ID NO: 2665622 - RNA, 13 nt, Human
uaguugaauacuu

SEQ ID NO: 2665623 - RNA, 16 nt, Human
uaguucuguauuugaa

SEQ ID NO: 2665624 - RNA, 19 nt, Human
uaguucuguauuugaaagu

SEQ ID NO: 2665625 - RNA, 17 nt, Human
uaguucuguauuugaaa

SEQ ID NO: 2665626 - RNA, 21 nt, Human
uaguucuguauuugaaagugc

SEQ ID NO: 2665627 - RNA, 20 nt, Human
uaguugaauacuugaaccau

SEQ ID NO: 2665628 - RNA, 19 nt, Human
uaguugaauacuugaacca

SEQ ID NO: 2665629 - RNA, 21 nt, Human
uaguugaauacuugaaccaua

SEQ ID NO: 2665630 - RNA, 18 nt, Human
uauaaacaaagauucaug

SEQ ID NO: 2665631 - RNA, 12 nt, Human
uauaaaauuaug

SEQ ID NO: 2665632 - RNA, 20 nt, Human
uauaaaauuaugagauuggu

SEQ ID NO: 2665633 - RNA, 16 nt, Human
uauaaacagaaaugga

SEQ ID NO: 2665634 - RNA, 17 nt, Human
uauaaacagaaauggaa

SEQ ID NO: 2665635 - RNA, 18 nt, Human
uauaaacagaaauggaaa

SEQ ID NO: 2665636 - RNA, 21 nt, Human
uauaaacagaaauggaaagca

SEQ ID NO: 2665637 - RNA, 12 nt, Human
uaguuucuuuau

SEQ ID NO: 2665638 - RNA, 17 nt, Human
uaguuucuuuauuuugu

SEQ ID NO: 2665639 - RNA, 22 nt, Human
uaguuucuuuauuuuguguaaa

SEQ ID NO: 2665640 - RNA, 13 nt, Human
uaguuuacagaaa

SEQ ID NO: 2665641 - RNA, 16 nt, Human
uauaaaggauaaagaa

SEQ ID NO: 2665642 - RNA, 12 nt, Human
uaggucuccagu

SEQ ID NO: 2665643 - RNA, 18 nt, Human
uaggcuuaguuugugugu

SEQ ID NO: 2665644 - RNA, 15 nt, Human
uagguucagccaagg

SEQ ID NO: 2665645 - RNA, 17 nt, Human
uaggugugggggaagca

SEQ ID NO: 2665646 - RNA, 13 nt, Human
uagguguggggga

SEQ ID NO: 2665647 - RNA, 14 nt, Human
uagguucagccaag

SEQ ID NO: 2665648 - RNA, 22 nt, Human
uagcaucucaggagauuucaug

SEQ ID NO: 2665649 - RNA, 18 nt, Human
uagcaucacuuaaaacac

SEQ ID NO: 2665650 - RNA, 17 nt, Human
uagcaucacuuaaaaca

SEQ ID NO: 2665651 - RNA, 23 nt, Human
uagcaucacuuaaaacacguuuu

SEQ ID NO: 2665652 - RNA, 18 nt, Human
uagcaucuggaagaucau

SEQ ID NO: 2665653 - RNA, 15 nt, Human
uagcaugaaauaaaa

SEQ ID NO: 2665654 - RNA, 16 nt, Human
uagcaugaaauaaaau

SEQ ID NO: 2665655 - RNA, 14 nt, Human
uagcauacuggcuu

SEQ ID NO: 2665656 - RNA, 15 nt, Human
uagcaucacuuaaaa

SEQ ID NO: 2665657 - RNA, 21 nt, Human
uagauuugccauagaguacac

SEQ ID NO: 2665658 - RNA, 14 nt, Human
uagccuggacugcu

SEQ ID NO: 2665659 - RNA, 15 nt, Human
uagcugaagaauuga

SEQ ID NO: 2665660 - RNA, 17 nt, Human
uagcugaagaauugaaa

SEQ ID NO: 2665661 - RNA, 21 nt, Human
uagcugaagaauugaaaaguu

SEQ ID NO: 2665662 - RNA, 22 nt, Human
uagcugaagaauugaaaaguuu

SEQ ID NO: 2665663 - RNA, 18 nt, Human
uagccagccccucuuccc

SEQ ID NO: 2665664 - RNA, 19 nt, Human
uagccgcccaugcacuggg

SEQ ID NO: 2665665 - RNA, 21 nt, Human
uagccgguuccugucccugcg

SEQ ID NO: 2665666 - RNA, 16 nt, Human
uagccgguuccugucc

SEQ ID NO: 2665667 - RNA, 15 nt, Human
uagcccccuggccuc

SEQ ID NO: 2665668 - RNA, 18 nt, Human
uagcccccuggccucugu

SEQ ID NO: 2665669 - RNA, 17 nt, Human
uagcccccuggccucug

SEQ ID NO: 2665670 - RNA, 16 nt, Human
uagcccccuggccucu

SEQ ID NO: 2665671 - RNA, 14 nt, Human
uagaauuaaaaaag

SEQ ID NO: 2665672 - RNA, 21 nt, Human
uagaauuaaaaaagcauacuu

SEQ ID NO: 2665673 - RNA, 15 nt, Human
uagaauuauuuuuca

SEQ ID NO: 2665674 - RNA, 18 nt, Human
uagaauuauuuuucacuc

SEQ ID NO: 2665675 - RNA, 19 nt, Human
uagaauuauuuuucacucu

SEQ ID NO: 2665676 - RNA, 22 nt, Human
uagaauuauuuuucacucuaag

SEQ ID NO: 2665677 - RNA, 15 nt, Human
uagaaucccuguguu

SEQ ID NO: 2665678 - RNA, 13 nt, Human
uagaaucccugug

SEQ ID NO: 2665679 - RNA, 20 nt, Human
uagaaucccuguguuaauuu

SEQ ID NO: 2665680 - RNA, 16 nt, Human
uagaaucccuguguua

SEQ ID NO: 2665681 - RNA, 16 nt, Human
uagaaguuuggcugcu

SEQ ID NO: 2665682 - RNA, 21 nt, Human
uagaaguuuggcugcugucau

SEQ ID NO: 2665683 - RNA, 17 nt, Human
uagaauaagaauuugca

SEQ ID NO: 2665684 - RNA, 18 nt, Human
uagaauaagaauuugcau

SEQ ID NO: 2665685 - RNA, 19 nt, Human
uagaauaagaauuugcaua

SEQ ID NO: 2665686 - RNA, 23 nt, Human
uagaauacaguuuugaguagagu

SEQ ID NO: 2665687 - RNA, 14 nt, Human
uacuuguugccuau

SEQ ID NO: 2665688 - RNA, 17 nt, Human
uacuuguugccuauaag

SEQ ID NO: 2665689 - RNA, 20 nt, Human
uagaagugagcaaaaaagag

SEQ ID NO: 2665690 - RNA, 13 nt, Human
uacuuguuuugga

SEQ ID NO: 2665691 - RNA, 17 nt, Human
uagaccuuguuacuucu

SEQ ID NO: 2665692 - RNA, 19 nt, Human
uagaccuuguuacuucuga

SEQ ID NO: 2665693 - RNA, 21 nt, Human
uagacuagcaaucucuucauu

SEQ ID NO: 2665694 - RNA, 20 nt, Human
uagacucggggugcuuccuu

SEQ ID NO: 2665695 - RNA, 21 nt, Human
uagacucggggugcuuccuug

SEQ ID NO: 2665696 - RNA, 23 nt, Human
uagaccauuuaucugggauuaug

SEQ ID NO: 2665697 - RNA, 18 nt, Human
uagaccccauacaaguuu

SEQ ID NO: 2665698 - RNA, 18 nt, Human
uagaauugaagguuuuug

SEQ ID NO: 2665699 - RNA, 17 nt, Human
uagaauugaagguuuuu

SEQ ID NO: 2665700 - RNA, 16 nt, Human
uagaauugaagguuuu

SEQ ID NO: 2665701 - RNA, 16 nt, Human
uagagaagcaaguaaa

SEQ ID NO: 2665702 - RNA, 13 nt, Human
uagagaagcaagu

SEQ ID NO: 2665703 - RNA, 12 nt, Human
uagacuugaaaa

SEQ ID NO: 2665704 - RNA, 10 nt, Human
uagacuugaa

SEQ ID NO: 2665705 - RNA, 17 nt, Human
uagagguccucuggagc

SEQ ID NO: 2665706 - RNA, 18 nt, Human
uagagguccucuggagcc

SEQ ID NO: 2665707 - RNA, 19 nt, Human
uagagguccucuggagccc

SEQ ID NO: 2665708 - RNA, 12 nt, Human
uagagugggagc

SEQ ID NO: 2665709 - RNA, 21 nt, Human
uagagucugagggcuuguagu

SEQ ID NO: 2665710 - RNA, 15 nt, Human
uagagucugagggcu

SEQ ID NO: 2665711 - RNA, 17 nt, Human
uagaguguagacugugg

SEQ ID NO: 2665712 - RNA, 20 nt, Human
uagaguguaguuuacagaaa

SEQ ID NO: 2665713 - RNA, 20 nt, Human
uagagguccucuggagcccu

SEQ ID NO: 2665714 - RNA, 22 nt, Human
uaauuaggcaaggcuaugugau

SEQ ID NO: 2665715 - RNA, 21 nt, Human
uaauuaggcaaggcuauguga

SEQ ID NO: 2665716 - RNA, 19 nt, Human
uaauuuuuaaugaugacaa

SEQ ID NO: 2665717 - RNA, 16 nt, Human
uacaaacauuuaagcu

SEQ ID NO: 2665718 - RNA, 13 nt, Human
uacaaaccuacca

SEQ ID NO: 2665719 - RNA, 17 nt, Human
uacaaaguuaaaauugu

SEQ ID NO: 2665720 - RNA, 18 nt, Human
uacaaaguuaaaauuguu

SEQ ID NO: 2665721 - RNA, 18 nt, Human
uacaaaugcaucuuugau

SEQ ID NO: 2665722 - RNA, 17 nt, Human
uacaaaugcaucuuuga

SEQ ID NO: 2665723 - RNA, 16 nt, Human
uacaaaugcaucuuug

SEQ ID NO: 2665724 - RNA, 13 nt, Human
uacacauuugcua

SEQ ID NO: 2665725 - RNA, 17 nt, Human
uacacauuugcuacugu

SEQ ID NO: 2665726 - RNA, 21 nt, Human
uacacauuugcuacuguugua

SEQ ID NO: 2665727 - RNA, 23 nt, Human
uacacauagcauguaaugguauc

SEQ ID NO: 2665728 - RNA, 18 nt, Human
uacacauauuugaagggu

SEQ ID NO: 2665729 - RNA, 20 nt, Human
uacacauauuugaagggucu

SEQ ID NO: 2665730 - RNA, 16 nt, Human
uacaaauuuguuauuu

SEQ ID NO: 2665731 - RNA, 21 nt, Human
uacaaaugcaucuuugaugug

SEQ ID NO: 2665732 - RNA, 19 nt, Human
uacaaaugcaucuuugaug

SEQ ID NO: 2665733 - RNA, 18 nt, Human
uacaacuuaaauaauaaa

SEQ ID NO: 2665734 - RNA, 15 nt, Human
uacaacggaggccug

SEQ ID NO: 2665735 - RNA, 13 nt, Human
uacaauuuuaaga

SEQ ID NO: 2665736 - RNA, 12 nt, Human
uacaauuuuauc

SEQ ID NO: 2665737 - RNA, 18 nt, Human
uacaauuuuaucuguuuc

SEQ ID NO: 2665738 - RNA, 15 nt, Human
uacaguuuucagaaa

SEQ ID NO: 2665739 - RNA, 18 nt, Human
uacaguuuugaguagagu

SEQ ID NO: 2665740 - RNA, 13 nt, Human
uacauaaaagaaa

SEQ ID NO: 2665741 - RNA, 17 nt, Human
uacauaaaagaaauaaa

SEQ ID NO: 2665742 - RNA, 20 nt, Human
uacaucuuuucaacaaguaa

SEQ ID NO: 2665743 - RNA, 17 nt, Human
uacaugccacaucaaac

SEQ ID NO: 2665744 - RNA, 14 nt, Human
uacaugcauauaau

SEQ ID NO: 2665745 - RNA, 20 nt, Human
uacaugcauauaaugaauaa

SEQ ID NO: 2665746 - RNA, 14 nt, Human
uacaugcugggguc

SEQ ID NO: 2665747 - RNA, 19 nt, Human
uacaguugaaaaacagcug

SEQ ID NO: 2665748 - RNA, 17 nt, Human
uacaguugaaaaacagc

SEQ ID NO: 2665749 - RNA, 17 nt, Human
uacaguugaaauaacug

SEQ ID NO: 2665750 - RNA, 19 nt, Human
uacaguugaaauaacugga

SEQ ID NO: 2665751 - RNA, 20 nt, Human
uacaguugaaaaacagcuga

SEQ ID NO: 2665752 - RNA, 16 nt, Human
uacagcucauuaaacu

SEQ ID NO: 2665753 - RNA, 18 nt, Human
uacagcucauuaaacuuu

SEQ ID NO: 2665754 - RNA, 21 nt, Human
uacagcucauuaaacuuuuuu

SEQ ID NO: 2665755 - RNA, 16 nt, Human
uacacugccugccuua

SEQ ID NO: 2665756 - RNA, 16 nt, Human
uacugcacuccagccu

SEQ ID NO: 2665757 - RNA, 17 nt, Human
uacugcacuccagccug

SEQ ID NO: 2665758 - RNA, 18 nt, Human
uacugcacuccagccugg

SEQ ID NO: 2665759 - RNA, 19 nt, Human
uacugcacuccagccuggg

SEQ ID NO: 2665760 - RNA, 20 nt, Human
uacugcacuccagccugggg

SEQ ID NO: 2665761 - RNA, 18 nt, Human
uacugcauuuagggagua

SEQ ID NO: 2665762 - RNA, 15 nt, Human
uacugcauuuaggga

SEQ ID NO: 2665763 - RNA, 15 nt, Human
uacugccugaauaaa

SEQ ID NO: 2665764 - RNA, 20 nt, Human
uacugccugaauaaagagcc

SEQ ID NO: 2665765 - RNA, 12 nt, Human
uacugccuugaa

SEQ ID NO: 2665766 - RNA, 13 nt, Human
uacugccuugaaa

SEQ ID NO: 2665767 - RNA, 13 nt, Human
uacucccugcaga

SEQ ID NO: 2665768 - RNA, 16 nt, Human
uacucccugcagaugc

SEQ ID NO: 2665769 - RNA, 18 nt, Human
uacucccugcagaugcca

SEQ ID NO: 2665770 - RNA, 19 nt, Human
uacucccugcagaugccac

SEQ ID NO: 2665771 - RNA, 18 nt, Human
uacugcuugaauaaacac

SEQ ID NO: 2665772 - RNA, 21 nt, Human
uacuggaacccuuuuaaaguu

SEQ ID NO: 2665773 - RNA, 21 nt, Human
uacugucaaaugaugugcaaa

SEQ ID NO: 2665774 - RNA, 12 nt, Human
uacugcgacuuu

SEQ ID NO: 2665775 - RNA, 16 nt, Human
uacugcgacuuucugc

SEQ ID NO: 2665776 - RNA, 17 nt, Human
uacugcgacuuucugcc

SEQ ID NO: 2665777 - RNA, 18 nt, Human
uacugcgacuuucugccu

SEQ ID NO: 2665778 - RNA, 19 nt, Human
uacugcgacuuucugccug

SEQ ID NO: 2665779 - RNA, 20 nt, Human
uacugcgacuuucugccugg

SEQ ID NO: 2665780 - RNA, 21 nt, Human
uacugcgacuuucugccugga

SEQ ID NO: 2665781 - RNA, 22 nt, Human
uacugcgacuuucugccuggag

SEQ ID NO: 2665782 - RNA, 18 nt, Human
uacuguguuuuauaaaau

SEQ ID NO: 2665783 - RNA, 13 nt, Human
uacuguuacuggg

SEQ ID NO: 2665784 - RNA, 17 nt, Human
uacuguuacugggcccu

SEQ ID NO: 2665785 - RNA, 18 nt, Human
uacuguuacugggcccug

SEQ ID NO: 2665786 - RNA, 17 nt, Human
uacugucuauuaauauu

SEQ ID NO: 2665787 - RNA, 18 nt, Human
uacugucuauuaauauuc

SEQ ID NO: 2665788 - RNA, 19 nt, Human
uacugucuauuaauauuca

SEQ ID NO: 2665789 - RNA, 21 nt, Human
uacugucuucaguaagccgug

SEQ ID NO: 2665790 - RNA, 16 nt, Human
uacuugaaccauaaaa

SEQ ID NO: 2665791 - RNA, 12 nt, Human
uacuugaaccau

SEQ ID NO: 2665792 - RNA, 21 nt, Human
uacuugaaccauaaaaugucc

SEQ ID NO: 2665793 - RNA, 20 nt, Human
uacuugaaccauaaaauguc

SEQ ID NO: 2665794 - RNA, 19 nt, Human
uacuugaaccauaaaaugu

SEQ ID NO: 2665795 - RNA, 17 nt, Human
uacuugaaccauaaaau

SEQ ID NO: 2665796 - RNA, 14 nt, Human
uacuuaaaugguaa

SEQ ID NO: 2665797 - RNA, 21 nt, Human
uacuuaaaugguaauaagcac

SEQ ID NO: 2665798 - RNA, 23 nt, Human
uacuuaaaugguaauaagcacug

SEQ ID NO: 2665799 - RNA, 24 nt, Human
uacuuaaaugguaauaagcacugu

SEQ ID NO: 2665800 - RNA, 19 nt, Human
uacuguuuuaucuggcccc

SEQ ID NO: 2665801 - RNA, 23 nt, Human
uacuguucggaagggguuccuca

SEQ ID NO: 2665802 - RNA, 15 nt, Human
uacuguuuauuacuu

SEQ ID NO: 2665803 - RNA, 22 nt, Human
uacuguuuauuacuuccaugaa

SEQ ID NO: 2665804 - RNA, 16 nt, Human
uacuguuaucuaucug

SEQ ID NO: 2665805 - RNA, 19 nt, Human
uacuaaacaguaagauauc

SEQ ID NO: 2665806 - RNA, 16 nt, Human
uaccuuuuuuuuuucu

SEQ ID NO: 2665807 - RNA, 18 nt, Human
uaccuuuuuuuuuucuug

SEQ ID NO: 2665808 - RNA, 20 nt, Human
uaccuuuuuuuuuucuuggu

SEQ ID NO: 2665809 - RNA, 14 nt, Human
uaccuuaucuuaca

SEQ ID NO: 2665810 - RNA, 23 nt, Human
uaccuuaucuuacaauauugauu

SEQ ID NO: 2665811 - RNA, 14 nt, Human
uaccuuuucagggc

SEQ ID NO: 2665812 - RNA, 17 nt, Human
uaccuuuucagggcugg

SEQ ID NO: 2665813 - RNA, 18 nt, Human
uaccuuuucagggcuggc

SEQ ID NO: 2665814 - RNA, 18 nt, Human
uaccucggugccuuccuc

SEQ ID NO: 2665815 - RNA, 14 nt, Human
uaccgacccagggu

SEQ ID NO: 2665816 - RNA, 15 nt, Human
uacauuuuuuaagcu

SEQ ID NO: 2665817 - RNA, 14 nt, Human
uaccuagugaaacu

SEQ ID NO: 2665818 - RNA, 15 nt, Human
uaccuagugaaacuu

SEQ ID NO: 2665819 - RNA, 16 nt, Human
uaccuagugaaacuuu

SEQ ID NO: 2665820 - RNA, 18 nt, Human
uaccuagugaaacuuuuc

SEQ ID NO: 2665821 - RNA, 19 nt, Human
uaccuagugaaacuuuucu

SEQ ID NO: 2665822 - RNA, 22 nt, Human
uaccuagugaaacuuuucuaga

SEQ ID NO: 2665823 - RNA, 17 nt, Human
uaccuagcuaauuauuu

SEQ ID NO: 2665824 - RNA, 18 nt, Human
uaccuagcuaauuauuua

SEQ ID NO: 2665825 - RNA, 15 nt, Human
uaccuccaacccugc

SEQ ID NO: 2665826 - RNA, 16 nt, Human
uaccuccaacccugcc

SEQ ID NO: 2665827 - RNA, 17 nt, Human
uaccuccaacccugccg

SEQ ID NO: 2665828 - RNA, 13 nt, Human
uaccuaacaucug

SEQ ID NO: 2665829 - RNA, 16 nt, Human
ugacaacugugacugu

SEQ ID NO: 2665830 - RNA, 15 nt, Human
ugacaacugugacug

SEQ ID NO: 2665831 - RNA, 17 nt, Human
ugacaaggcacuucaug

SEQ ID NO: 2665832 - RNA, 21 nt, Human
ugacaaggcacuucauguaaa

SEQ ID NO: 2665833 - RNA, 14 nt, Human
ugacaacugugacu

SEQ ID NO: 2665834 - RNA, 13 nt, Human
ugacaacugugac

SEQ ID NO: 2665835 - RNA, 12 nt, Human
ugacaacuguga

SEQ ID NO: 2665836 - RNA, 21 nt, Human
ugacaacguuucagcgacucc

SEQ ID NO: 2665837 - RNA, 17 nt, Human
ugacaaccgagaagguu

SEQ ID NO: 2665838 - RNA, 19 nt, Human
ugacaaccgagaagguuua

SEQ ID NO: 2665839 - RNA, 16 nt, Human
ugacacaaguggaccu

SEQ ID NO: 2665840 - RNA, 19 nt, Human
ugacacaaguggaccuuag

SEQ ID NO: 2665841 - RNA, 17 nt, Human
ugacacaaguggaccuu

SEQ ID NO: 2665842 - RNA, 16 nt, Human
ugaauuaaauuaggaa

SEQ ID NO: 2665843 - RNA, 20 nt, Human
ugacaaauaaauuaggacca

SEQ ID NO: 2665844 - RNA, 17 nt, Human
ugacaucuugaauccuu

SEQ ID NO: 2665845 - RNA, 20 nt, Human
ugacaucuugaauccuucca

SEQ ID NO: 2665846 - RNA, 14 nt, Human
ugacaucuggaauc

SEQ ID NO: 2665847 - RNA, 22 nt, Human
ugacagagcaagugagacccug

SEQ ID NO: 2665848 - RNA, 14 nt, Human
ugaaugauuugcau

SEQ ID NO: 2665849 - RNA, 23 nt, Human
ugaaugaugauccuaggcauuug

SEQ ID NO: 2665850 - RNA, 18 nt, Human
ugaauccuuccauuccac

SEQ ID NO: 2665851 - RNA, 22 nt, Human
ugaaucaauaauauauuuucug

SEQ ID NO: 2665852 - RNA, 16 nt, Human
ugaaguuuuacugucu

SEQ ID NO: 2665853 - RNA, 17 nt, Human
ugaaguuuuacugucua

SEQ ID NO: 2665854 - RNA, 22 nt, Human
ugaaguuuuuuugcugcugccu

SEQ ID NO: 2665855 - RNA, 17 nt, Human
ugaaguuuacaaucaaa

SEQ ID NO: 2665856 - RNA, 23 nt, Human
ugaaggaaaaacacaagcaaaaa

SEQ ID NO: 2665857 - RNA, 21 nt, Human
ugaaggaaaaacacaagcaaa

SEQ ID NO: 2665858 - RNA, 18 nt, Human
ugaacuuaauaacugugu

SEQ ID NO: 2665859 - RNA, 22 nt, Human
ugaacuuaauaacuguguacug

SEQ ID NO: 2665860 - RNA, 23 nt, Human
ugaacuuaauaacuguguacugu

SEQ ID NO: 2665861 - RNA, 21 nt, Human
ugaacuuauuuacacauaguu

SEQ ID NO: 2665862 - RNA, 14 nt, Human
ugagcugccagugg

SEQ ID NO: 2665863 - RNA, 20 nt, Human
ugagcugccuguaacuugag

SEQ ID NO: 2665864 - RNA, 11 nt, Human
ugagcugccuu

SEQ ID NO: 2665865 - RNA, 12 nt, Human
ugagcugccagu

SEQ ID NO: 2665866 - RNA, 16 nt, Human
ugagcugaucugcgga

SEQ ID NO: 2665867 - RNA, 18 nt, Human
ugagcuuacguaguucua

SEQ ID NO: 2665868 - RNA, 17 nt, Human
ugagcuuacguaguucu

SEQ ID NO: 2665869 - RNA, 12 nt, Human
ugaggaggggag

SEQ ID NO: 2665870 - RNA, 13 nt, Human
ugaggaggggagg

SEQ ID NO: 2665871 - RNA, 16 nt, Human
ugaggaggggagggua

SEQ ID NO: 2665872 - RNA, 22 nt, Human
ugaggaggggaggguaaauaaa

SEQ ID NO: 2665873 - RNA, 13 nt, Human
ugaggaggguggg

SEQ ID NO: 2665874 - RNA, 17 nt, Human
ugaggagggugggggag

SEQ ID NO: 2665875 - RNA, 20 nt, Human
ugaggagggugggggaggga

SEQ ID NO: 2665876 - RNA, 18 nt, Human
ugaggauauucagaugua

SEQ ID NO: 2665877 - RNA, 20 nt, Human
ugaggcaauaaaaaucauag

SEQ ID NO: 2665878 - RNA, 21 nt, Human
ugaggauuaguuuagaacagg

SEQ ID NO: 2665879 - RNA, 17 nt, Human
ugaggauuaguuuagaa

SEQ ID NO: 2665880 - RNA, 20 nt, Human
ugaggauuaguuuagaacag

SEQ ID NO: 2665881 - RNA, 19 nt, Human
ugaggauuaguuuagaaca

SEQ ID NO: 2665882 - RNA, 19 nt, Human
ugagcucaggaguuugaga

SEQ ID NO: 2665883 - RNA, 11 nt, Human
ugagcucagga

SEQ ID NO: 2665884 - RNA, 21 nt, Human
ugaggugggagguggaagaag

SEQ ID NO: 2665885 - RNA, 22 nt, Human
ugaggugggagguggaagaagg

SEQ ID NO: 2665886 - RNA, 13 nt, Human
ugaggugggaggu

SEQ ID NO: 2665887 - RNA, 18 nt, Human
ugaggugggagguggaag

SEQ ID NO: 2665888 - RNA, 15 nt, Human
ugaggcacuggcgag

SEQ ID NO: 2665889 - RNA, 14 nt, Human
ugaggcaggagaau

SEQ ID NO: 2665890 - RNA, 12 nt, Human
ugaggccugggc

SEQ ID NO: 2665891 - RNA, 13 nt, Human
ugaggccugggcc

SEQ ID NO: 2665892 - RNA, 22 nt, Human
ugaggccugggccgcugccacg

SEQ ID NO: 2665893 - RNA, 11 nt, Human
ugacuaauuag

SEQ ID NO: 2665894 - RNA, 15 nt, Human
ugacuaacucaaaua

SEQ ID NO: 2665895 - RNA, 20 nt, Human
ugacuaacucaaauacacau

SEQ ID NO: 2665896 - RNA, 21 nt, Human
ugacuaacucaaauacacauu

SEQ ID NO: 2665897 - RNA, 22 nt, Human
ugacuaacucaaauacacauuu

SEQ ID NO: 2665898 - RNA, 23 nt, Human
ugacuaacucaaauacacauuug

SEQ ID NO: 2665899 - RNA, 15 nt, Human
ugacuaagaaauucu

SEQ ID NO: 2665900 - RNA, 19 nt, Human
ugaccaugcucaucugcug

SEQ ID NO: 2665901 - RNA, 12 nt, Human
ugaccaugcuca

SEQ ID NO: 2665902 - RNA, 16 nt, Human
ugaccaugcucaucug

SEQ ID NO: 2665903 - RNA, 18 nt, Human
ugaccaugcucaucugcu

SEQ ID NO: 2665904 - RNA, 21 nt, Human
ugacucuugaguuguuuuugu

SEQ ID NO: 2665905 - RNA, 19 nt, Human
ugacucuugaguuguuuuu

SEQ ID NO: 2665906 - RNA, 14 nt, Human
ugacucuugaguug

SEQ ID NO: 2665907 - RNA, 12 nt, Human
ugacguuuacau

SEQ ID NO: 2665908 - RNA, 15 nt, Human
ugacuaauuuuacau

SEQ ID NO: 2665909 - RNA, 18 nt, Human
ugacuaauuuuacauguu

SEQ ID NO: 2665910 - RNA, 21 nt, Human
ugacuaauuuuacauguuuau

SEQ ID NO: 2665911 - RNA, 22 nt, Human
ugacuaauuuuacauguuuaua

SEQ ID NO: 2665912 - RNA, 23 nt, Human
ugacucuugaguuguuuuuguau

SEQ ID NO: 2665913 - RNA, 22 nt, Human
ugacucuugaguuguuuuugua

SEQ ID NO: 2665914 - RNA, 18 nt, Human
ugagaaacuuaaauguua

SEQ ID NO: 2665915 - RNA, 19 nt, Human
ugagaaacuuaaauguuau

SEQ ID NO: 2665916 - RNA, 23 nt, Human
ugagaaacuguuugaaaacuuca

SEQ ID NO: 2665917 - RNA, 14 nt, Human
ugagaaauccugga

SEQ ID NO: 2665918 - RNA, 20 nt, Human
ugacuuuuaaggcuaaaacu

SEQ ID NO: 2665919 - RNA, 16 nt, Human
ugacuuuuauaaagca

SEQ ID NO: 2665920 - RNA, 17 nt, Human
ugacuuuuauaaagcau

SEQ ID NO: 2665921 - RNA, 18 nt, Human
ugacuuuuauaaagcaug

SEQ ID NO: 2665922 - RNA, 22 nt, Human
ugacuuuucuguccgagcuuug

SEQ ID NO: 2665923 - RNA, 13 nt, Human
ugacuuuuuauaa

SEQ ID NO: 2665924 - RNA, 14 nt, Human
ugacuuuuuauaaa

SEQ ID NO: 2665925 - RNA, 19 nt, Human
ugacuuuuuauaaaauggc

SEQ ID NO: 2665926 - RNA, 13 nt, Human
ugagaaaacaagc

SEQ ID NO: 2665927 - RNA, 14 nt, Human
ugacuuuuuuugua

SEQ ID NO: 2665928 - RNA, 15 nt, Human
ugacuuuuuuuguau

SEQ ID NO: 2665929 - RNA, 17 nt, Human
ugacuuuuuuuguaugu

SEQ ID NO: 2665930 - RNA, 18 nt, Human
ugacuuuuuuuguaugug

SEQ ID NO: 2665931 - RNA, 19 nt, Human
ugacuuuuuuuguaugugu

SEQ ID NO: 2665932 - RNA, 14 nt, Human
ugagaaaacaagca

SEQ ID NO: 2665933 - RNA, 23 nt, Human
ugagaaaacaagcaaguucugag

SEQ ID NO: 2665934 - RNA, 20 nt, Human
ugagaaacaucucaauaaag

SEQ ID NO: 2665935 - RNA, 15 nt, Human
ugagaaaauaaagcu

SEQ ID NO: 2665936 - RNA, 16 nt, Human
ugagaaaauugaaaua

SEQ ID NO: 2665937 - RNA, 21 nt, Human
ugagaaaauugaaauaaagcu

SEQ ID NO: 2665938 - RNA, 14 nt, Human
ugagaccaaccugg

SEQ ID NO: 2665939 - RNA, 20 nt, Human
ucugagccagugcuuuaaug

SEQ ID NO: 2665940 - RNA, 14 nt, Human
ucugagcgccucca

SEQ ID NO: 2665941 - RNA, 21 nt, Human
ucugagcgccuccauccaagg

SEQ ID NO: 2665942 - RNA, 24 nt, Human
ucugagaucaaaacgguuuuacug

SEQ ID NO: 2665943 - RNA, 20 nt, Human
ucugauuugucccuaugcau

SEQ ID NO: 2665944 - RNA, 17 nt, Human
ucugauuugcugcucuu

SEQ ID NO: 2665945 - RNA, 19 nt, Human
ucugauuugcugcucuuca

SEQ ID NO: 2665946 - RNA, 20 nt, Human
ucugauuucuuuucaccauu

SEQ ID NO: 2665947 - RNA, 24 nt, Human
ucugcaaacaccaacauguuggga

SEQ ID NO: 2665948 - RNA, 15 nt, Human
ucugagccugauauu

SEQ ID NO: 2665949 - RNA, 18 nt, Human
ucugccaucuagccagcc

SEQ ID NO: 2665950 - RNA, 19 nt, Human
ucugcaguccuacucaagc

SEQ ID NO: 2665951 - RNA, 18 nt, Human
ucuggacccuuauaaaau

SEQ ID NO: 2665952 - RNA, 16 nt, Human
ucuguaaauauguuuu

SEQ ID NO: 2665953 - RNA, 12 nt, Human
ucuguaaauaug

SEQ ID NO: 2665954 - RNA, 14 nt, Human
ucuggacggcaggc

SEQ ID NO: 2665955 - RNA, 15 nt, Human
ucuggacggcaggcu

SEQ ID NO: 2665956 - RNA, 17 nt, Human
ucuggacggcaggcuca

SEQ ID NO: 2665957 - RNA, 19 nt, Human
ucuggacggcaggcucacu

SEQ ID NO: 2665958 - RNA, 23 nt, Human
ucuggacggcaggcucacugcca

SEQ ID NO: 2665959 - RNA, 21 nt, Human
ucuggacggcaggcucacugc

SEQ ID NO: 2665960 - RNA, 22 nt, Human
ucuggacggcaggcucacugcc

SEQ ID NO: 2665961 - RNA, 15 nt, Human
ucuggaauuguggcu

SEQ ID NO: 2665962 - RNA, 22 nt, Human
ucugcugcagagcaguaaggga

SEQ ID NO: 2665963 - RNA, 16 nt, Human
ucugcugcagagcagu

SEQ ID NO: 2665964 - RNA, 15 nt, Human
ucugcugcagagcag

SEQ ID NO: 2665965 - RNA, 16 nt, Human
ucuuugaauauguagu

SEQ ID NO: 2665966 - RNA, 18 nt, Human
ucuuucccauggggaggg

SEQ ID NO: 2665967 - RNA, 15 nt, Human
ucuugugucuuugga

SEQ ID NO: 2665968 - RNA, 20 nt, Human
ucuugugucuuuggaggugc

SEQ ID NO: 2665969 - RNA, 19 nt, Human
ucuugaagcccccagcccu

SEQ ID NO: 2665970 - RNA, 13 nt, Human
ucuuugcaacugu

SEQ ID NO: 2665971 - RNA, 21 nt, Human
ucuuugccagucauucagcag

SEQ ID NO: 2665972 - RNA, 12 nt, Human
ucuuugagaggg

SEQ ID NO: 2665973 - RNA, 20 nt, Human
ucuuuuuaaaaauuguuauu

SEQ ID NO: 2665974 - RNA, 12 nt, Human
ucuuuuguuugg

SEQ ID NO: 2665975 - RNA, 16 nt, Human
ucuuuuguuugguaaa

SEQ ID NO: 2665976 - RNA, 19 nt, Human
ugaaaacaguguguaaaca

SEQ ID NO: 2665977 - RNA, 20 nt, Human
ugaaaacaguguguaaacaa

SEQ ID NO: 2665978 - RNA, 14 nt, Human
ugaaaauucagugg

SEQ ID NO: 2665979 - RNA, 17 nt, Human
ugaaaauuggacagauu

SEQ ID NO: 2665980 - RNA, 23 nt, Human
ugaaaauuggacagauugccugu

SEQ ID NO: 2665981 - RNA, 13 nt, Human
ugaaaauuguauu

SEQ ID NO: 2665982 - RNA, 22 nt, Human
ugaaaauuguuuagugauauua

SEQ ID NO: 2665983 - RNA, 22 nt, Human
ugaaaauucauaguaagauuga

SEQ ID NO: 2665984 - RNA, 22 nt, Human
ugaaaagaaaaaugagccuggc

SEQ ID NO: 2665985 - RNA, 20 nt, Human
ugaaaagaaaaaugagccug

SEQ ID NO: 2665986 - RNA, 21 nt, Human
ugaaaauuacaguccaaaaua

SEQ ID NO: 2665987 - RNA, 15 nt, Human
ugaaaagaaaaauga

SEQ ID NO: 2665988 - RNA, 19 nt, Human
ugaaaagaaaaaugagccu

SEQ ID NO: 2665989 - RNA, 20 nt, Human
ugaaaacggagcugaacaau

SEQ ID NO: 2665990 - RNA, 23 nt, Human
ucuuagguuggcaaaaaggcagg

SEQ ID NO: 2665991 - RNA, 20 nt, Human
ucuuagguuggcaaaaaggc

SEQ ID NO: 2665992 - RNA, 13 nt, Human
ucugugugucagu

SEQ ID NO: 2665993 - RNA, 15 nt, Human
ucugugugucaguuu

SEQ ID NO: 2665994 - RNA, 18 nt, Human
ucugugugucaguuuuca

SEQ ID NO: 2665995 - RNA, 19 nt, Human
ucugugugucaguuuucau

SEQ ID NO: 2665996 - RNA, 13 nt, Human
ucuuagauucuua

SEQ ID NO: 2665997 - RNA, 14 nt, Human
ucuuagauucuuaa

SEQ ID NO: 2665998 - RNA, 17 nt, Human
ucuucauuauucucugc

SEQ ID NO: 2665999 - RNA, 16 nt, Human
ucuuaugaggagggga

SEQ ID NO: 2666000 - RNA, 13 nt, Human
ucuugcccauccu

SEQ ID NO: 2666001 - RNA, 14 nt, Human
ucuugcccauccug

SEQ ID NO: 2666002 - RNA, 15 nt, Human
ucuugcccauccuga

SEQ ID NO: 2666003 - RNA, 18 nt, Human
ucuugcccauccugacug

SEQ ID NO: 2666004 - RNA, 13 nt, Human
ucuuguccuagcu

SEQ ID NO: 2666005 - RNA, 20 nt, Human
ucuuguccucauucuugccu

SEQ ID NO: 2666006 - RNA, 19 nt, Human
ucuucuuggggcccagugc

SEQ ID NO: 2666007 - RNA, 20 nt, Human
ucuucuuggggcccagugca

SEQ ID NO: 2666008 - RNA, 21 nt, Human
ucuucuuggggcccagugcau

SEQ ID NO: 2666009 - RNA, 22 nt, Human
ucuuccuugaagaacugcaggc

SEQ ID NO: 2666010 - RNA, 14 nt, Human
ucuuccuuuuauca

SEQ ID NO: 2666011 - RNA, 23 nt, Human
ucuuccuugaagaacugcaggcc

SEQ ID NO: 2666012 - RNA, 15 nt, Human
ucuuccuugauguuu

SEQ ID NO: 2666013 - RNA, 18 nt, Human
ucuuccuugauguuuggg

SEQ ID NO: 2666014 - RNA, 12 nt, Human
ucaggaggcgcc

SEQ ID NO: 2666015 - RNA, 14 nt, Human
ucaggaggcgcccu

SEQ ID NO: 2666016 - RNA, 18 nt, Human
ucaggagaauuagauuuc

SEQ ID NO: 2666017 - RNA, 22 nt, Human
ucaggagaucgagaccauccug

SEQ ID NO: 2666018 - RNA, 15 nt, Human
ucagcugcucccugg

SEQ ID NO: 2666019 - RNA, 19 nt, Human
ucagcugcucccuggcauu

SEQ ID NO: 2666020 - RNA, 13 nt, Human
ucagcucggcuca

SEQ ID NO: 2666021 - RNA, 18 nt, Human
ucagcucggggagccuua

SEQ ID NO: 2666022 - RNA, 18 nt, Human
ucagcucggcucagcucg

SEQ ID NO: 2666023 - RNA, 17 nt, Human
ucagcucggggagccuu

SEQ ID NO: 2666024 - RNA, 12 nt, Human
ucagccugcaca

SEQ ID NO: 2666025 - RNA, 16 nt, Human
ucagccugcuccagcu

SEQ ID NO: 2666026 - RNA, 13 nt, Human
ucagcaguugcug

SEQ ID NO: 2666027 - RNA, 23 nt, Human
ucagcaguugcugguaaaaugaa

SEQ ID NO: 2666028 - RNA, 22 nt, Human
ucagcaguugcugguaaaauga

SEQ ID NO: 2666029 - RNA, 20 nt, Human
ucagcaguugcugguaaaau

SEQ ID NO: 2666030 - RNA, 19 nt, Human
ucagcaguugcugguaaaa

SEQ ID NO: 2666031 - RNA, 18 nt, Human
ucagcaguugcugguaaa

SEQ ID NO: 2666032 - RNA, 17 nt, Human
ucagcaguugcugguaa

SEQ ID NO: 2666033 - RNA, 16 nt, Human
ucagcaguugcuggua

SEQ ID NO: 2666034 - RNA, 14 nt, Human
ucagcaguugcugg

SEQ ID NO: 2666035 - RNA, 13 nt, Human
ucagcaugaaaau

SEQ ID NO: 2666036 - RNA, 22 nt, Human
uaucauucaaguguaaaauauu

SEQ ID NO: 2666037 - RNA, 14 nt, Human
ucagucauguguaa

SEQ ID NO: 2666038 - RNA, 15 nt, Human
ucaguguugguauau

SEQ ID NO: 2666039 - RNA, 18 nt, Human
ucagucccuuccccaugc

SEQ ID NO: 2666040 - RNA, 17 nt, Human
ucaugaaacuuguuuca

SEQ ID NO: 2666041 - RNA, 20 nt, Human
ucaugaaacuuguuucacug

SEQ ID NO: 2666042 - RNA, 12 nt, Human
ucaugaaaauac

SEQ ID NO: 2666043 - RNA, 14 nt, Human
ucaugaaaauacca

SEQ ID NO: 2666044 - RNA, 16 nt, Human
ucaugaaaauaccauu

SEQ ID NO: 2666045 - RNA, 20 nt, Human
ucaucuggaguucucaaaga

SEQ ID NO: 2666046 - RNA, 14 nt, Human
ucaucuggaguucu

SEQ ID NO: 2666047 - RNA, 19 nt, Human
ucaucugcugguccguggg

SEQ ID NO: 2666048 - RNA, 13 nt, Human
ucaucugcugguc

SEQ ID NO: 2666049 - RNA, 14 nt, Human
ucaucugcuggucc

SEQ ID NO: 2666050 - RNA, 16 nt, Human
ucaucauccagaugug

SEQ ID NO: 2666051 - RNA, 17 nt, Human
ucaucauccagaugugg

SEQ ID NO: 2666052 - RNA, 17 nt, Human
ucaguguuuuugugaau

SEQ ID NO: 2666053 - RNA, 17 nt, Human
ucaucaaagaacaaaca

SEQ ID NO: 2666054 - RNA, 17 nt, Human
ucauacucgagucugag

SEQ ID NO: 2666055 - RNA, 16 nt, Human
ucauacucgagucuga

SEQ ID NO: 2666056 - RNA, 19 nt, Human
uccauaguuuggcauuugc

SEQ ID NO: 2666057 - RNA, 20 nt, Human
uccauaguuuggcauuugca

SEQ ID NO: 2666058 - RNA, 16 nt, Human
uccauaguuuggcauu

SEQ ID NO: 2666059 - RNA, 22 nt, Human
uccauacacuuuguugcaagau

SEQ ID NO: 2666060 - RNA, 13 nt, Human
ucccaagaaugca

SEQ ID NO: 2666061 - RNA, 16 nt, Human
ucccaagaaugcaaga

SEQ ID NO: 2666062 - RNA, 20 nt, Human
ucccaagaaugcaagauuuc

SEQ ID NO: 2666063 - RNA, 15 nt, Human
ucccaaccaggcacc

SEQ ID NO: 2666064 - RNA, 15 nt, Human
uccaugcgcucaggg

SEQ ID NO: 2666065 - RNA, 16 nt, Human
uccaugcgcucagggc

SEQ ID NO: 2666066 - RNA, 15 nt, Human
ucccaggcagggaga

SEQ ID NO: 2666067 - RNA, 16 nt, Human
ucccacuucugccaga

SEQ ID NO: 2666068 - RNA, 15 nt, Human
ucccacuucugccag

SEQ ID NO: 2666069 - RNA, 16 nt, Human
ucccacuucccacccu

SEQ ID NO: 2666070 - RNA, 14 nt, Human
ucccaagauguuga

SEQ ID NO: 2666071 - RNA, 23 nt, Human
ucccaagauguugauuuuuacug

SEQ ID NO: 2666072 - RNA, 13 nt, Human
ucccaagccuccu

SEQ ID NO: 2666073 - RNA, 14 nt, Human
ucccaagccuucgg

SEQ ID NO: 2666074 - RNA, 16 nt, Human
uccacugugcuuucag

SEQ ID NO: 2666075 - RNA, 16 nt, Human
uccacacccgugagaa

SEQ ID NO: 2666076 - RNA, 22 nt, Human
uccacagcgagggcagcugcua

SEQ ID NO: 2666077 - RNA, 17 nt, Human
uccagauggucauccag

SEQ ID NO: 2666078 - RNA, 18 nt, Human
uccagauggucauccaga

SEQ ID NO: 2666079 - RNA, 21 nt, Human
uccagauggucauccagacuc

SEQ ID NO: 2666080 - RNA, 13 nt, Human
uccagauguggcu

SEQ ID NO: 2666081 - RNA, 14 nt, Human
uccagauguggcua

SEQ ID NO: 2666082 - RNA, 21 nt, Human
uccagauguggcuacugacau

SEQ ID NO: 2666083 - RNA, 19 nt, Human
uccagauguuuccagacuu

SEQ ID NO: 2666084 - RNA, 18 nt, Human
uccagauguuuccagacu

SEQ ID NO: 2666085 - RNA, 22 nt, Human
uccagcaacacagccugggccc

SEQ ID NO: 2666086 - RNA, 18 nt, Human
uccagcaacuucuucucc

SEQ ID NO: 2666087 - RNA, 19 nt, Human
uccagcaacuucuucucca

SEQ ID NO: 2666088 - RNA, 20 nt, Human
uccagcaacuucuucuccau

SEQ ID NO: 2666089 - RNA, 17 nt, Human
uccagcaacacagccug

SEQ ID NO: 2666090 - RNA, 20 nt, Human
uccagcaacacagccugggc

SEQ ID NO: 2666091 - RNA, 21 nt, Human
uccagcaacacagccugggcc

SEQ ID NO: 2666092 - RNA, 16 nt, Human
uccagcaacacagccu

SEQ ID NO: 2666093 - RNA, 21 nt, Human
uccaggaaacuccacaucugc

SEQ ID NO: 2666094 - RNA, 17 nt, Human
uccagaucuuucagaaa

SEQ ID NO: 2666095 - RNA, 23 nt, Human
uccaggaaacuccacaucugccu

SEQ ID NO: 2666096 - RNA, 22 nt, Human
uccaggaaaguggccaagaagc

SEQ ID NO: 2666097 - RNA, 17 nt, Human
uccagcuggccuggaca

SEQ ID NO: 2666098 - RNA, 18 nt, Human
uccagcuggccuggacag

SEQ ID NO: 2666099 - RNA, 11 nt, Human
uccagcuggcc

SEQ ID NO: 2666100 - RNA, 12 nt, Human
uccagcuggccu

SEQ ID NO: 2666101 - RNA, 13 nt, Human
uccagcuggccug

SEQ ID NO: 2666102 - RNA, 15 nt, Human
uccaagccccaucuu

SEQ ID NO: 2666103 - RNA, 19 nt, Human
uccaagccccaucuucuaa

SEQ ID NO: 2666104 - RNA, 23 nt, Human
uccaagccccaucuucuaaaugg

SEQ ID NO: 2666105 - RNA, 14 nt, Human
uccaagccuccaca

SEQ ID NO: 2666106 - RNA, 15 nt, Human
uccaagccuccacag

SEQ ID NO: 2666107 - RNA, 16 nt, Human
uccaagccuccacagc

SEQ ID NO: 2666108 - RNA, 21 nt, Human
uccaagccuccacagcgaggg

SEQ ID NO: 2666109 - RNA, 17 nt, Human
uccaagccuccacagcg

SEQ ID NO: 2666110 - RNA, 20 nt, Human
uccaagccuccacagcgagg

SEQ ID NO: 2666111 - RNA, 17 nt, Human
uccacagcgagggcagc

SEQ ID NO: 2666112 - RNA, 18 nt, Human
uccacagcgagggcagcu

SEQ ID NO: 2666113 - RNA, 19 nt, Human
uccacagcgagggcagcug

SEQ ID NO: 2666114 - RNA, 20 nt, Human
uccacagcgagggcagcugc

SEQ ID NO: 2666115 - RNA, 21 nt, Human
uccacagcgagggcagcugcu

SEQ ID NO: 2666116 - RNA, 16 nt, Human
uccacacagaaugcaa

SEQ ID NO: 2666117 - RNA, 12 nt, Human
ucauguauguuu

SEQ ID NO: 2666118 - RNA, 13 nt, Human
ucauguauguuuc

SEQ ID NO: 2666119 - RNA, 14 nt, Human
ucauguauguuucu

SEQ ID NO: 2666120 - RNA, 16 nt, Human
ucauguauguuucucu

SEQ ID NO: 2666121 - RNA, 15 nt, Human
ucauguauuugagca

SEQ ID NO: 2666122 - RNA, 18 nt, Human
ucauguauuugagcauau

SEQ ID NO: 2666123 - RNA, 13 nt, Human
ucauguacuuuuu

SEQ ID NO: 2666124 - RNA, 15 nt, Human
ucauguacuuuuuag

SEQ ID NO: 2666125 - RNA, 22 nt, Human
ucauguacuuuuuaguaauuuc

SEQ ID NO: 2666126 - RNA, 16 nt, Human
ucauggcugcuguugc

SEQ ID NO: 2666127 - RNA, 23 nt, Human
ucaugggagggggcuugaagcca

SEQ ID NO: 2666128 - RNA, 12 nt, Human
ucuagggaaaaa

SEQ ID NO: 2666129 - RNA, 17 nt, Human
ucuacuagauugugauc

SEQ ID NO: 2666130 - RNA, 18 nt, Human
ucuacucuagggaaaaac

SEQ ID NO: 2666131 - RNA, 14 nt, Human
ucuaggauagcuaa

SEQ ID NO: 2666132 - RNA, 23 nt, Human
ucuaggauagcuaacuguaaauc

SEQ ID NO: 2666133 - RNA, 16 nt, Human
ucuaauugcugugugu

SEQ ID NO: 2666134 - RNA, 12 nt, Human
ucuaauucugau

SEQ ID NO: 2666135 - RNA, 14 nt, Human
ucuaauucugauuc

SEQ ID NO: 2666136 - RNA, 13 nt, Human
ucgccacaaacuc

SEQ ID NO: 2666137 - RNA, 19 nt, Human
ucuaaucuagauaucgacu

SEQ ID NO: 2666138 - RNA, 20 nt, Human
ucuaaucuagauaucgacuu

SEQ ID NO: 2666139 - RNA, 15 nt, Human
ucuaauucucugugg

SEQ ID NO: 2666140 - RNA, 20 nt, Human
ucucacugccaugccagcuu

SEQ ID NO: 2666141 - RNA, 14 nt, Human
ucuaucuauuugag

SEQ ID NO: 2666142 - RNA, 15 nt, Human
ucuaucuauuugagg

SEQ ID NO: 2666143 - RNA, 12 nt, Human
ucuaucucaucu

SEQ ID NO: 2666144 - RNA, 14 nt, Human
ucuauccucuguaa

SEQ ID NO: 2666145 - RNA, 14 nt, Human
ucucagauuucuga

SEQ ID NO: 2666146 - RNA, 18 nt, Human
ucucagauuucugaggaa

SEQ ID NO: 2666147 - RNA, 17 nt, Human
ucucagauuucugagga

SEQ ID NO: 2666148 - RNA, 22 nt, Human
ucggccuagggcccccacaguu

SEQ ID NO: 2666149 - RNA, 15 nt, Human
ucggccuagggcccc

SEQ ID NO: 2666150 - RNA, 19 nt, Human
ucgcuucuugccucugugc

SEQ ID NO: 2666151 - RNA, 21 nt, Human
ucgcuucuugccucugugcug

SEQ ID NO: 2666152 - RNA, 15 nt, Human
ucgcauuugucaaug

SEQ ID NO: 2666153 - RNA, 13 nt, Human
ucgcauuugucaa

SEQ ID NO: 2666154 - RNA, 22 nt, Human
ucgauacugcgacuuucugccu

SEQ ID NO: 2666155 - RNA, 23 nt, Human
ucgauacugcgacuuucugccug

SEQ ID NO: 2666156 - RNA, 19 nt, Human
ucgauacugcgacuuucug

SEQ ID NO: 2666157 - RNA, 20 nt, Human
ucgauacugcgacuuucugc

SEQ ID NO: 2666158 - RNA, 18 nt, Human
uccuugaagaacugcagg

SEQ ID NO: 2666159 - RNA, 19 nt, Human
uccuugaagaacugcaggc

SEQ ID NO: 2666160 - RNA, 19 nt, Human
uccuugguccuaguaagaa

SEQ ID NO: 2666161 - RNA, 18 nt, Human
uccuuugguccugucccc

SEQ ID NO: 2666162 - RNA, 14 nt, Human
uccugucccugcgc

SEQ ID NO: 2666163 - RNA, 22 nt, Human
uccugucccugcgccuuuccuu

SEQ ID NO: 2666164 - RNA, 16 nt, Human
uccgcccugccacuca

SEQ ID NO: 2666165 - RNA, 14 nt, Human
uccgcccugccacu

SEQ ID NO: 2666166 - RNA, 15 nt, Human
uccgcccugccacuc

SEQ ID NO: 2666167 - RNA, 13 nt, Human
uccgcccugccac

SEQ ID NO: 2666168 - RNA, 13 nt, Human
uccgagagggaga

SEQ ID NO: 2666169 - RNA, 14 nt, Human
uccgagagggagag

SEQ ID NO: 2666170 - RNA, 16 nt, Human
uccgagaggugggcca

SEQ ID NO: 2666171 - RNA, 15 nt, Human
uccgagagggagaga

SEQ ID NO: 2666172 - RNA, 21 nt, Human
uccgaggacccaggaaaggca

SEQ ID NO: 2666173 - RNA, 14 nt, Human
ucccuugaccuuaa

SEQ ID NO: 2666174 - RNA, 20 nt, Human
uccgccagccuccucuggac

SEQ ID NO: 2666175 - RNA, 12 nt, Human
uccgacugcuuu

SEQ ID NO: 2666176 - RNA, 15 nt, Human
uccgacugcuuugga

SEQ ID NO: 2666177 - RNA, 17 nt, Human
ucccuggcucccuccuc

SEQ ID NO: 2666178 - RNA, 20 nt, Human
ucccuugaaacuuugggaaa

SEQ ID NO: 2666179 - RNA, 11 nt, Human
ucccuggcgca

SEQ ID NO: 2666180 - RNA, 21 nt, Human
ucccuggcgcaggugggcugg

SEQ ID NO: 2666181 - RNA, 12 nt, Human
ucccuggcuccc

SEQ ID NO: 2666182 - RNA, 19 nt, Human
ucccucuauuuauguuugc

SEQ ID NO: 2666183 - RNA, 13 nt, Human
ucccucuauuuau

SEQ ID NO: 2666184 - RNA, 15 nt, Human
ucccucugccccucc

SEQ ID NO: 2666185 - RNA, 16 nt, Human
ucccugcagaugccac

SEQ ID NO: 2666186 - RNA, 22 nt, Human
ucccugcagaugccacccuagc

SEQ ID NO: 2666187 - RNA, 23 nt, Human
ucccugcagaugccacccuagcc

SEQ ID NO: 2666188 - RNA, 22 nt, Human
ucccuagcuuuagacccugggu

SEQ ID NO: 2666189 - RNA, 19 nt, Human
ucccuagcuuuagacccug

SEQ ID NO: 2666190 - RNA, 20 nt, Human
ucccuagcuuuagacccugg

SEQ ID NO: 2666191 - RNA, 15 nt, Human
ucccuagcagcccac

SEQ ID NO: 2666192 - RNA, 17 nt, Human
ucccuagcagcccaccc

SEQ ID NO: 2666193 - RNA, 18 nt, Human
ucccuaccgacccagggu

SEQ ID NO: 2666194 - RNA, 15 nt, Human
ucccuaccgacccag

SEQ ID NO: 2666195 - RNA, 17 nt, Human
uccucucaccucagccu

SEQ ID NO: 2666196 - RNA, 22 nt, Human
uccuccagugugggcuugacca

SEQ ID NO: 2666197 - RNA, 24 nt, Human
uccucuggacggcaggcucacugc

SEQ ID NO: 2666198 - RNA, 12 nt, Human
uccucuggagcc

SEQ ID NO: 2666199 - RNA, 11 nt, Human
uccuccuggaa

SEQ ID NO: 2666200 - RNA, 19 nt, Human
uccggaaacuaguguacau

SEQ ID NO: 2666201 - RNA, 12 nt, Human
uccuccugcaga

SEQ ID NO: 2666202 - RNA, 15 nt, Human
uccuccugcagacca

SEQ ID NO: 2666203 - RNA, 20 nt, Human
uccuccugcagaccacgccc

SEQ ID NO: 2666204 - RNA, 18 nt, Human
uccuccucaccucaugcc

SEQ ID NO: 2666205 - RNA, 12 nt, Human
uccuccucaccu

SEQ ID NO: 2666206 - RNA, 16 nt, Human
uccuccucaccucaug

SEQ ID NO: 2666207 - RNA, 20 nt, Human
ugccuggugcuuccaaauau

SEQ ID NO: 2666208 - RNA, 15 nt, Human
ugccuguaacuugag

SEQ ID NO: 2666209 - RNA, 19 nt, Human
ugccugagaggcaggcaua

SEQ ID NO: 2666210 - RNA, 15 nt, Human
ugccugagaggcagg

SEQ ID NO: 2666211 - RNA, 16 nt, Human
ugccugagaggcaggc

SEQ ID NO: 2666212 - RNA, 17 nt, Human
ugccugagaggcaggca

SEQ ID NO: 2666213 - RNA, 18 nt, Human
ugccugagaggcaggcau

SEQ ID NO: 2666214 - RNA, 13 nt, Human
ugccugagaggca

SEQ ID NO: 2666215 - RNA, 14 nt, Human
ugccugagaggcag

SEQ ID NO: 2666216 - RNA, 14 nt, Human
ugccccucccccag

SEQ ID NO: 2666217 - RNA, 16 nt, Human
ugccccucccccagcc

SEQ ID NO: 2666218 - RNA, 11 nt, Human
ugccucuuucc

SEQ ID NO: 2666219 - RNA, 12 nt, Human
ugccucuuuccc

SEQ ID NO: 2666220 - RNA, 17 nt, Human
ugccucuuucccuagga

SEQ ID NO: 2666221 - RNA, 19 nt, Human
ugccugacagagggaugga

SEQ ID NO: 2666222 - RNA, 16 nt, Human
ugccuucuuuugauua

SEQ ID NO: 2666223 - RNA, 20 nt, Human
ugccuucgcuucuugccucu

SEQ ID NO: 2666224 - RNA, 21 nt, Human
ugccuucgcuucuugccucug

SEQ ID NO: 2666225 - RNA, 22 nt, Human
ugccuucgcuucuugccucugu

SEQ ID NO: 2666226 - RNA, 23 nt, Human
ugccuucgcuucuugccucugug

SEQ ID NO: 2666227 - RNA, 20 nt, Human
ugccuucgucuuucccaugg

SEQ ID NO: 2666228 - RNA, 17 nt, Human
ugcuaaauaaaauuugu

SEQ ID NO: 2666229 - RNA, 21 nt, Human
ugcuaaauaaaauuuguugca

SEQ ID NO: 2666230 - RNA, 22 nt, Human
ugcuaaauaaaauuuguugcau

SEQ ID NO: 2666231 - RNA, 23 nt, Human
ugcuaaauaaaauuuguugcaua

SEQ ID NO: 2666232 - RNA, 15 nt, Human
ugcuaaaugugaaug

SEQ ID NO: 2666233 - RNA, 13 nt, Human
ugcuaacaaagac

SEQ ID NO: 2666234 - RNA, 22 nt, Human
ugcuaacaaagacaaaagucug

SEQ ID NO: 2666235 - RNA, 23 nt, Human
ugcuaacaaagacaaaagucugu

SEQ ID NO: 2666236 - RNA, 12 nt, Human
ugcgucccaaga

SEQ ID NO: 2666237 - RNA, 23 nt, Human
ugcguccccccccaaccuuuccc

SEQ ID NO: 2666238 - RNA, 15 nt, Human
ugcgucuugguguaa

SEQ ID NO: 2666239 - RNA, 16 nt, Human
ugcgucuugguguaau

SEQ ID NO: 2666240 - RNA, 22 nt, Human
ugcgucuugguguaauuugaag

SEQ ID NO: 2666241 - RNA, 23 nt, Human
ugcguccuccucaccucaugccc

SEQ ID NO: 2666242 - RNA, 16 nt, Human
ugcgucuauccugugu

SEQ ID NO: 2666243 - RNA, 14 nt, Human
ugcguccuccucac

SEQ ID NO: 2666244 - RNA, 16 nt, Human
ugcguccuccucaccu

SEQ ID NO: 2666245 - RNA, 19 nt, Human
ugcguccuccucaccucau

SEQ ID NO: 2666246 - RNA, 22 nt, Human
ugcguccuccucaccucaugcc

SEQ ID NO: 2666247 - RNA, 14 nt, Human
ugcucucacuguuu

SEQ ID NO: 2666248 - RNA, 22 nt, Human
ugcucucacuguuuguuuuuau

SEQ ID NO: 2666249 - RNA, 21 nt, Human
ugcucuaugcuuuccaaaccu

SEQ ID NO: 2666250 - RNA, 12 nt, Human
ugcucuaugcuu

SEQ ID NO: 2666251 - RNA, 18 nt, Human
ugcucuaugcuuuccaaa

SEQ ID NO: 2666252 - RNA, 16 nt, Human
ugcucuaugcuuucca

SEQ ID NO: 2666253 - RNA, 16 nt, Human
ugcugcaugcccucuc

SEQ ID NO: 2666254 - RNA, 15 nt, Human
ugcugcaugcccucu

SEQ ID NO: 2666255 - RNA, 19 nt, Human
ugcugcaugcccucucagg

SEQ ID NO: 2666256 - RNA, 18 nt, Human
ugcugcaugcccucucag

SEQ ID NO: 2666257 - RNA, 12 nt, Human
ugcugcuggugc

SEQ ID NO: 2666258 - RNA, 16 nt, Human
ugcugcuggugcacag

SEQ ID NO: 2666259 - RNA, 18 nt, Human
ugcugcuggugcacagcc

SEQ ID NO: 2666260 - RNA, 18 nt, Human
ugcugauuuggugaccaa

SEQ ID NO: 2666261 - RNA, 17 nt, Human
ugcagcaccgaggggcc

SEQ ID NO: 2666262 - RNA, 20 nt, Human
ugcagcaccgaggggccuuu

SEQ ID NO: 2666263 - RNA, 21 nt, Human
ugcagcaccgaggggccuuug

SEQ ID NO: 2666264 - RNA, 17 nt, Human
ugcagaggccagaggcc

SEQ ID NO: 2666265 - RNA, 14 nt, Human
ugcagaggccagag

SEQ ID NO: 2666266 - RNA, 15 nt, Human
ugcagaggccagagg

SEQ ID NO: 2666267 - RNA, 18 nt, Human
ugcagagcaguaagggaa

SEQ ID NO: 2666268 - RNA, 17 nt, Human
ugcagagcaguaaggga

SEQ ID NO: 2666269 - RNA, 15 nt, Human
ugcagagauuucuca

SEQ ID NO: 2666270 - RNA, 20 nt, Human
ugcagagauuucucauugac

SEQ ID NO: 2666271 - RNA, 15 nt, Human
ugcagagccuucuca

SEQ ID NO: 2666272 - RNA, 16 nt, Human
ugcagagccuucucag

SEQ ID NO: 2666273 - RNA, 17 nt, Human
ugcagagccuucucaga

SEQ ID NO: 2666274 - RNA, 19 nt, Human
ugcagagccuucucagaag

SEQ ID NO: 2666275 - RNA, 20 nt, Human
ugcagagccuucucagaagc

SEQ ID NO: 2666276 - RNA, 22 nt, Human
ugcagagccuucucagaagcac

SEQ ID NO: 2666277 - RNA, 20 nt, Human
ugcacuuucuauccucugua

SEQ ID NO: 2666278 - RNA, 21 nt, Human
ugcacuugugauuauuuauua

SEQ ID NO: 2666279 - RNA, 12 nt, Human
ugcaggcccugg

SEQ ID NO: 2666280 - RNA, 15 nt, Human
ugcaggcccuggccu

SEQ ID NO: 2666281 - RNA, 16 nt, Human
ugcaggcccuggccuc

SEQ ID NO: 2666282 - RNA, 13 nt, Human
ugcagugagcuga

SEQ ID NO: 2666283 - RNA, 17 nt, Human
ugcaggcccuggccucc

SEQ ID NO: 2666284 - RNA, 19 nt, Human
ugcaggcccuggccucccc

SEQ ID NO: 2666285 - RNA, 18 nt, Human
ugcaguggcgcauucuag

SEQ ID NO: 2666286 - RNA, 21 nt, Human
ugcaguggcgcauucuaggcu

SEQ ID NO: 2666287 - RNA, 16 nt, Human
ugcauauaaugaauaa

SEQ ID NO: 2666288 - RNA, 17 nt, Human
ugcauauaaugaauaaa

SEQ ID NO: 2666289 - RNA, 20 nt, Human
ugcauauaaugaauaaauca

SEQ ID NO: 2666290 - RNA, 15 nt, Human
ugcccauccugacug

SEQ ID NO: 2666291 - RNA, 20 nt, Human
ugcccaucgugaagaagccu

SEQ ID NO: 2666292 - RNA, 21 nt, Human
ugcccaucgugaagaagccug

SEQ ID NO: 2666293 - RNA, 22 nt, Human
ugcccaucgugaagaagccugu

SEQ ID NO: 2666294 - RNA, 23 nt, Human
ugcccaucgugaagaagccugua

SEQ ID NO: 2666295 - RNA, 14 nt, Human
ugccccucagagac

SEQ ID NO: 2666296 - RNA, 16 nt, Human
ugccccucagagacug

SEQ ID NO: 2666297 - RNA, 16 nt, Human
ugcccaccugccggcc

SEQ ID NO: 2666298 - RNA, 14 nt, Human
ugccaccaggccac

SEQ ID NO: 2666299 - RNA, 17 nt, Human
ugccaccaggccaccuc

SEQ ID NO: 2666300 - RNA, 18 nt, Human
ugccaccaggccaccucc

SEQ ID NO: 2666301 - RNA, 15 nt, Human
ugccacccugcugag

SEQ ID NO: 2666302 - RNA, 14 nt, Human
ugccacccuagcca

SEQ ID NO: 2666303 - RNA, 12 nt, Human
ugccaggcaggg

SEQ ID NO: 2666304 - RNA, 15 nt, Human
ugccaggcaggggug

SEQ ID NO: 2666305 - RNA, 16 nt, Human
ugccaggcaggggugg

SEQ ID NO: 2666306 - RNA, 17 nt, Human
ugccaggcagggguggg

SEQ ID NO: 2666307 - RNA, 18 nt, Human
ugccaggcaggggugggg

SEQ ID NO: 2666308 - RNA, 13 nt, Human
ugccaccaggcca

SEQ ID NO: 2666309 - RNA, 19 nt, Human
ugcauauuugcaaagugua

SEQ ID NO: 2666310 - RNA, 17 nt, Human
ugggaccugccaggcag

SEQ ID NO: 2666311 - RNA, 20 nt, Human
ugggaccugccaggcagggg

SEQ ID NO: 2666312 - RNA, 18 nt, Human
ugggaccugccaggcagg

SEQ ID NO: 2666313 - RNA, 19 nt, Human
ugggaccugccaggcaggg

SEQ ID NO: 2666314 - RNA, 23 nt, Human
ugggaccugccaggcaggggugg

SEQ ID NO: 2666315 - RNA, 14 nt, Human
ugggaccuguggcu

SEQ ID NO: 2666316 - RNA, 18 nt, Human
ugggaccuguggcugucg

SEQ ID NO: 2666317 - RNA, 23 nt, Human
ugggacggugcccaagccagagg

SEQ ID NO: 2666318 - RNA, 13 nt, Human
ugggacggcggca

SEQ ID NO: 2666319 - RNA, 23 nt, Human
ugggacgggaugguucuggcugu

SEQ ID NO: 2666320 - RNA, 14 nt, Human
ugggacggugccca

SEQ ID NO: 2666321 - RNA, 16 nt, Human
ugggcagagcuggcuc

SEQ ID NO: 2666322 - RNA, 18 nt, Human
ugggcagagcuggcucug

SEQ ID NO: 2666323 - RNA, 20 nt, Human
ugggcagagcuggcucugag

SEQ ID NO: 2666324 - RNA, 13 nt, Human
uggcuucugugau

SEQ ID NO: 2666325 - RNA, 14 nt, Human
uggcuucugugaug

SEQ ID NO: 2666326 - RNA, 17 nt, Human
uggcuucugugaugagc

SEQ ID NO: 2666327 - RNA, 21 nt, Human
uggcuucugugaugagcugau

SEQ ID NO: 2666328 - RNA, 22 nt, Human
uggcuucugugaugagcugauc

SEQ ID NO: 2666329 - RNA, 13 nt, Human
uggccccacccug

SEQ ID NO: 2666330 - RNA, 15 nt, Human
uggccccacccuggg

SEQ ID NO: 2666331 - RNA, 16 nt, Human
uggccccacccugggc

SEQ ID NO: 2666332 - RNA, 18 nt, Human
uggccccacccugggccc

SEQ ID NO: 2666333 - RNA, 19 nt, Human
uggcucugagcgccuccau

SEQ ID NO: 2666334 - RNA, 12 nt, Human
uggccccagcac

SEQ ID NO: 2666335 - RNA, 22 nt, Human
uggccccacccugggcccuggg

SEQ ID NO: 2666336 - RNA, 19 nt, Human
uggcuggaagauccugcgg

SEQ ID NO: 2666337 - RNA, 20 nt, Human
uggcuggaagauccugcggg

SEQ ID NO: 2666338 - RNA, 21 nt, Human
uggcuggaagauccugcgggu

SEQ ID NO: 2666339 - RNA, 21 nt, Human
ugggggaucacagccucugaa

SEQ ID NO: 2666340 - RNA, 20 nt, Human
ugggggaucacagccucuga

SEQ ID NO: 2666341 - RNA, 17 nt, Human
uggggaaaggagguggg

SEQ ID NO: 2666342 - RNA, 19 nt, Human
uggggaaaggagguggggg

SEQ ID NO: 2666343 - RNA, 23 nt, Human
uggggaaaggggucggcugacca

SEQ ID NO: 2666344 - RNA, 21 nt, Human
uggggaaaggggucggcugac

SEQ ID NO: 2666345 - RNA, 22 nt, Human
uggggaaaggggucggcugacc

SEQ ID NO: 2666346 - RNA, 14 nt, Human
ugggggcuagggag

SEQ ID NO: 2666347 - RNA, 16 nt, Human
ugggggcacaggaggc

SEQ ID NO: 2666348 - RNA, 20 nt, Human
ugggaguacucucaucacua

SEQ ID NO: 2666349 - RNA, 19 nt, Human
ugggcuacaugcugggguc

SEQ ID NO: 2666350 - RNA, 13 nt, Human
ugggcuuauaucu

SEQ ID NO: 2666351 - RNA, 20 nt, Human
ugggcuuauaucuggccucu

SEQ ID NO: 2666352 - RNA, 21 nt, Human
ugggcuuauaucuggccucug

SEQ ID NO: 2666353 - RNA, 22 nt, Human
ugggcuuauaucuggccucugc

SEQ ID NO: 2666354 - RNA, 20 nt, Human
ugggcuuuuggggagccaga

SEQ ID NO: 2666355 - RNA, 21 nt, Human
ugggcuuuuggggagccagaa

SEQ ID NO: 2666356 - RNA, 22 nt, Human
ugggcuuuuggggagccagaag

SEQ ID NO: 2666357 - RNA, 18 nt, Human
uggggaaagacacugccu

SEQ ID NO: 2666358 - RNA, 19 nt, Human
uggggaaagacacugccug

SEQ ID NO: 2666359 - RNA, 20 nt, Human
uggggaaagacacugccugg

SEQ ID NO: 2666360 - RNA, 21 nt, Human
uggggaaagacacugccuggg

SEQ ID NO: 2666361 - RNA, 22 nt, Human
uggggaaagacacugccugggc

SEQ ID NO: 2666362 - RNA, 16 nt, Human
ugguaucuuaaagugu

SEQ ID NO: 2666363 - RNA, 14 nt, Human
ugguaucauauauu

SEQ ID NO: 2666364 - RNA, 17 nt, Human
ugguaguuucugugguu

SEQ ID NO: 2666365 - RNA, 13 nt, Human
ugguauauauaca

SEQ ID NO: 2666366 - RNA, 14 nt, Human
ugguauauauacau

SEQ ID NO: 2666367 - RNA, 14 nt, Human
uggguuugagaaau

SEQ ID NO: 2666368 - RNA, 12 nt, Human
ugggguuuugua

SEQ ID NO: 2666369 - RNA, 15 nt, Human
ugggguuuccuggca

SEQ ID NO: 2666370 - RNA, 16 nt, Human
uggguaacuagggaag

SEQ ID NO: 2666371 - RNA, 17 nt, Human
ugggguuuccuggcacu

SEQ ID NO: 2666372 - RNA, 14 nt, Human
ugggguuuccuggc

SEQ ID NO: 2666373 - RNA, 13 nt, Human
ugggguuuccugg

SEQ ID NO: 2666374 - RNA, 17 nt, Human
uggcaaaggaaggugga

SEQ ID NO: 2666375 - RNA, 18 nt, Human
uggauuuggcacuagcca

SEQ ID NO: 2666376 - RNA, 21 nt, Human
uggauuuggcacuagccaaag

SEQ ID NO: 2666377 - RNA, 13 nt, Human
uggauuucagaag

SEQ ID NO: 2666378 - RNA, 19 nt, Human
uggaucauaagacaaugga

SEQ ID NO: 2666379 - RNA, 12 nt, Human
uggagggaagcc

SEQ ID NO: 2666380 - RNA, 22 nt, Human
uggaggcuuccugcguccuccu

SEQ ID NO: 2666381 - RNA, 11 nt, Human
uggagggaggc

SEQ ID NO: 2666382 - RNA, 13 nt, Human
uggagggaggccc

SEQ ID NO: 2666383 - RNA, 14 nt, Human
uggagggaggcccc

SEQ ID NO: 2666384 - RNA, 16 nt, Human
uggagggaggccccag

SEQ ID NO: 2666385 - RNA, 18 nt, Human
uggagggaggccccaggg

SEQ ID NO: 2666386 - RNA, 19 nt, Human
uggagggaggccccagggg

SEQ ID NO: 2666387 - RNA, 13 nt, Human
uggagggagggaa

SEQ ID NO: 2666388 - RNA, 17 nt, Human
uggagggagggaagggu

SEQ ID NO: 2666389 - RNA, 20 nt, Human
uggaggcuuccugcguccuc

SEQ ID NO: 2666390 - RNA, 20 nt, Human
uggaggaagaacugaaaggc

SEQ ID NO: 2666391 - RNA, 17 nt, Human
uggaggaagaacugaaa

SEQ ID NO: 2666392 - RNA, 15 nt, Human
uggaggaagaacuga

SEQ ID NO: 2666393 - RNA, 20 nt, Human
uggaggaacaaucggcugca

SEQ ID NO: 2666394 - RNA, 21 nt, Human
uggaggaacaaucggcugcau

SEQ ID NO: 2666395 - RNA, 19 nt, Human
uggaggaacacuugaugga

SEQ ID NO: 2666396 - RNA, 16 nt, Human
uggcaccgccucccca

SEQ ID NO: 2666397 - RNA, 23 nt, Human
uggcaccgccuccccaccuccag

SEQ ID NO: 2666398 - RNA, 15 nt, Human
uggcaggggacagga

SEQ ID NO: 2666399 - RNA, 18 nt, Human
uggcaggggacaggaguc

SEQ ID NO: 2666400 - RNA, 18 nt, Human
uggcaguccgugggacgg

SEQ ID NO: 2666401 - RNA, 12 nt, Human
uggccaggagca

SEQ ID NO: 2666402 - RNA, 14 nt, Human
uggccaggagcagg

SEQ ID NO: 2666403 - RNA, 22 nt, Human
uggccaggagcaggcacgggug

SEQ ID NO: 2666404 - RNA, 20 nt, Human
ugcuggagcacugggcuccc

SEQ ID NO: 2666405 - RNA, 18 nt, Human
ugcuggagcacugggcuc

SEQ ID NO: 2666406 - RNA, 16 nt, Human
ugcuggagcacugggc

SEQ ID NO: 2666407 - RNA, 18 nt, Human
ugcuuugaauaaaugugu

SEQ ID NO: 2666408 - RNA, 17 nt, Human
uggaaaaauagccugcc

SEQ ID NO: 2666409 - RNA, 20 nt, Human
uggaaaaauagccugccucu

SEQ ID NO: 2666410 - RNA, 18 nt, Human
ugcuuuaccuuuucaggg

SEQ ID NO: 2666411 - RNA, 21 nt, Human
ugcuuuaccuuuucagggcug

SEQ ID NO: 2666412 - RNA, 15 nt, Human
ugcuuuagacuugaa

SEQ ID NO: 2666413 - RNA, 14 nt, Human
ugcuuuagacuuga

SEQ ID NO: 2666414 - RNA, 18 nt, Human
ugcuuuagacuugaaaag

SEQ ID NO: 2666415 - RNA, 16 nt, Human
ugcuuuagacuugaaa

SEQ ID NO: 2666416 - RNA, 14 nt, Human
uggaacauacuguu

SEQ ID NO: 2666417 - RNA, 16 nt, Human
uggaacauacuguuca

SEQ ID NO: 2666418 - RNA, 17 nt, Human
uggaacauacuguucac

SEQ ID NO: 2666419 - RNA, 17 nt, Human
uggaaccacauugaaga

SEQ ID NO: 2666420 - RNA, 19 nt, Human
uggaaccacauugaagaau

SEQ ID NO: 2666421 - RNA, 19 nt, Human
uggaaagcagaguuuucau

SEQ ID NO: 2666422 - RNA, 15 nt, Human
uggaaaacuguguug

SEQ ID NO: 2666423 - RNA, 20 nt, Human
uggaaaacuguguugccaca

SEQ ID NO: 2666424 - RNA, 14 nt, Human
uggacuaucugucu

SEQ ID NO: 2666425 - RNA, 15 nt, Human
uggacuaucugucug

SEQ ID NO: 2666426 - RNA, 17 nt, Human
uggacuaucugucuggu

SEQ ID NO: 2666427 - RNA, 20 nt, Human
uggacuaucugucugguggc

SEQ ID NO: 2666428 - RNA, 22 nt, Human
uggacuaucugucugguggccc

SEQ ID NO: 2666429 - RNA, 23 nt, Human
uggacuaucugucugguggcccc

SEQ ID NO: 2666430 - RNA, 18 nt, Human
uggacauccuccucccac

SEQ ID NO: 2666431 - RNA, 20 nt, Human
uggacauccuccucccaccc

SEQ ID NO: 2666432 - RNA, 23 nt, Human
uggacauccuccucccacccggc

SEQ ID NO: 2666433 - RNA, 21 nt, Human
uggacagauugccuguuucug

SEQ ID NO: 2666434 - RNA, 22 nt, Human
uggacagauugccuguuucuga

SEQ ID NO: 2666435 - RNA, 18 nt, Human
uggaauauaaggaaagca

SEQ ID NO: 2666436 - RNA, 14 nt, Human
uggaauauaaggaa

SEQ ID NO: 2666437 - RNA, 21 nt, Human
uggaauauaaggaaagcaaua

SEQ ID NO: 2666438 - RNA, 19 nt, Human
uggaaguuuuccuacacuu

SEQ ID NO: 2666439 - RNA, 22 nt, Human
uggaauaaaaggcuugaagcug

SEQ ID NO: 2666440 - RNA, 15 nt, Human
uggaauaaaaggcuu

SEQ ID NO: 2666441 - RNA, 18 nt, Human
uggaauaaaaggcuugaa

SEQ ID NO: 2666442 - RNA, 13 nt, Human
uguguaaugaaaa

SEQ ID NO: 2666443 - RNA, 17 nt, Human
ugugggauauugaaugu

SEQ ID NO: 2666444 - RNA, 17 nt, Human
uguggcuacugacauau

SEQ ID NO: 2666445 - RNA, 16 nt, Human
uguggcuagugacaaa

SEQ ID NO: 2666446 - RNA, 19 nt, Human
uguggcgccgucuccaggg

SEQ ID NO: 2666447 - RNA, 23 nt, Human
uguggcgccgucuccaggggcug

SEQ ID NO: 2666448 - RNA, 14 nt, Human
uguggcuccaggcc

SEQ ID NO: 2666449 - RNA, 17 nt, Human
uguggcuccaggccaaa

SEQ ID NO: 2666450 - RNA, 22 nt, Human
uguggcuccaggccaaagugcc

SEQ ID NO: 2666451 - RNA, 16 nt, Human
uguggccucuucugag

SEQ ID NO: 2666452 - RNA, 11 nt, Human
uguggccugca

SEQ ID NO: 2666453 - RNA, 18 nt, Human
uguggccucuucugagcu

SEQ ID NO: 2666454 - RNA, 17 nt, Human
uguggccugcacaguga

SEQ ID NO: 2666455 - RNA, 18 nt, Human
uguggcgccgucuccagg

SEQ ID NO: 2666456 - RNA, 19 nt, Human
uguggaaggcaagccaggc

SEQ ID NO: 2666457 - RNA, 22 nt, Human
uguggaaggcaagccaggcuca

SEQ ID NO: 2666458 - RNA, 15 nt, Human
ugugcuaugaauuuu

SEQ ID NO: 2666459 - RNA, 14 nt, Human
ugugcuaugaauuu

SEQ ID NO: 2666460 - RNA, 15 nt, Human
ugugcucagaagggc

SEQ ID NO: 2666461 - RNA, 15 nt, Human
ugugcucagagacac

SEQ ID NO: 2666462 - RNA, 17 nt, Human
ugugcuagaaauuuuca

SEQ ID NO: 2666463 - RNA, 20 nt, Human
ugugcuagaaauuuucaaga

SEQ ID NO: 2666464 - RNA, 14 nt, Human
ugugccuucgucuu

SEQ ID NO: 2666465 - RNA, 23 nt, Human
ugugccuucgucuuucccauggg

SEQ ID NO: 2666466 - RNA, 16 nt, Human
ugugccuucuuuugau

SEQ ID NO: 2666467 - RNA, 15 nt, Human
ugugaauuauugaca

SEQ ID NO: 2666468 - RNA, 16 nt, Human
ugugaauuauugacac

SEQ ID NO: 2666469 - RNA, 17 nt, Human
ugugaauuauugacacu

SEQ ID NO: 2666470 - RNA, 19 nt, Human
ugugaauuauugacacuga

SEQ ID NO: 2666471 - RNA, 20 nt, Human
ugugaauuauugacacugaa

SEQ ID NO: 2666472 - RNA, 21 nt, Human
ugugaauuauugacacugaac

SEQ ID NO: 2666473 - RNA, 14 nt, Human
ugugagugguugaa

SEQ ID NO: 2666474 - RNA, 10 nt, Human
ugugcacauc

SEQ ID NO: 2666475 - RNA, 21 nt, Human
ugugcacauccgcgugugccu

SEQ ID NO: 2666476 - RNA, 22 nt, Human
ugugcacauccgcgugugccug

SEQ ID NO: 2666477 - RNA, 23 nt, Human
ugugcacauccgcgugugccugu

SEQ ID NO: 2666478 - RNA, 14 nt, Human
ugucuggcaaggac

SEQ ID NO: 2666479 - RNA, 15 nt, Human
ugucuggaauugugg

SEQ ID NO: 2666480 - RNA, 20 nt, Human
ugucuggcaaggacuuugua

SEQ ID NO: 2666481 - RNA, 15 nt, Human
ugucuuuuuguugua

SEQ ID NO: 2666482 - RNA, 21 nt, Human
ugucuuuuuauuaaaauauuu

SEQ ID NO: 2666483 - RNA, 23 nt, Human
ugugaaaagaaaaaugagccugg

SEQ ID NO: 2666484 - RNA, 21 nt, Human
ugugaaaagaaaaaugagccu

SEQ ID NO: 2666485 - RNA, 21 nt, Human
ugugaagcuggaacugcggga

SEQ ID NO: 2666486 - RNA, 12 nt, Human
ugugaagcugga

SEQ ID NO: 2666487 - RNA, 13 nt, Human
ugucuuuccugaa

SEQ ID NO: 2666488 - RNA, 22 nt, Human
ugucuuuccugaaccaugugga

SEQ ID NO: 2666489 - RNA, 17 nt, Human
ugucuguaaauauguuu

SEQ ID NO: 2666490 - RNA, 12 nt, Human
ugucuguaaaua

SEQ ID NO: 2666491 - RNA, 18 nt, Human
uguccaugcgcucagggc

SEQ ID NO: 2666492 - RNA, 20 nt, Human
ugucccccagguuccgaaga

SEQ ID NO: 2666493 - RNA, 14 nt, Human
ugucacgaauaugg

SEQ ID NO: 2666494 - RNA, 18 nt, Human
ugucacgaauauggacau

SEQ ID NO: 2666495 - RNA, 19 nt, Human
ugucacgaauauggacaua

SEQ ID NO: 2666496 - RNA, 16 nt, Human
ugucauuucagaaguu

SEQ ID NO: 2666497 - RNA, 15 nt, Human
ugucauuucagaagu

SEQ ID NO: 2666498 - RNA, 16 nt, Human
uguccaguaagaucac

SEQ ID NO: 2666499 - RNA, 19 nt, Human
uguccaguaagaucacugu

SEQ ID NO: 2666500 - RNA, 17 nt, Human
uguccaguaagaucacu

SEQ ID NO: 2666501 - RNA, 22 nt, Human
uguccaguaagaucacuguuua

SEQ ID NO: 2666502 - RNA, 21 nt, Human
uguccaguaagaucacuguuu

SEQ ID NO: 2666503 - RNA, 20 nt, Human
uguccaguaagaucacuguu

SEQ ID NO: 2666504 - RNA, 13 nt, Human
uguccauacacuu

SEQ ID NO: 2666505 - RNA, 20 nt, Human
uguccauacacuuuguugca

SEQ ID NO: 2666506 - RNA, 21 nt, Human
uguaguuguucguugguuaua

SEQ ID NO: 2666507 - RNA, 16 nt, Human
uguaguuuacagaaaa

SEQ ID NO: 2666508 - RNA, 17 nt, Human
uguaguucuuuaaacug

SEQ ID NO: 2666509 - RNA, 15 nt, Human
uguaguucuuuaaac

SEQ ID NO: 2666510 - RNA, 14 nt, Human
uguaguucuuuaaa

SEQ ID NO: 2666511 - RNA, 12 nt, Human
uguaguucuuua

SEQ ID NO: 2666512 - RNA, 14 nt, Human
uguauuguccuauu

SEQ ID NO: 2666513 - RNA, 19 nt, Human
uguauuguccuauuagugu

SEQ ID NO: 2666514 - RNA, 21 nt, Human
uguauuguauauuacaaugau

SEQ ID NO: 2666515 - RNA, 14 nt, Human
uguauuuugauuau

SEQ ID NO: 2666516 - RNA, 20 nt, Human
ugucacauuuagcugugcuc

SEQ ID NO: 2666517 - RNA, 23 nt, Human
ugucacccaaaccggcaggugcg

SEQ ID NO: 2666518 - RNA, 20 nt, Human
uguauuuaaaaauagaaaca

SEQ ID NO: 2666519 - RNA, 18 nt, Human
uguauuuuauuuagacaa

SEQ ID NO: 2666520 - RNA, 19 nt, Human
uguauuuuauuuagacaag

SEQ ID NO: 2666521 - RNA, 14 nt, Human
uguauuuucagagc

SEQ ID NO: 2666522 - RNA, 12 nt, Human
uguauuuucaug

SEQ ID NO: 2666523 - RNA, 16 nt, Human
uguauuuucaugaaaa

SEQ ID NO: 2666524 - RNA, 22 nt, Human
uguauuuuauuuagacaagaga

SEQ ID NO: 2666525 - RNA, 20 nt, Human
uguagcuauaaugagcaugu

SEQ ID NO: 2666526 - RNA, 18 nt, Human
uguagcccccuggccucu

SEQ ID NO: 2666527 - RNA, 17 nt, Human
uguagcccccuggccuc

SEQ ID NO: 2666528 - RNA, 16 nt, Human
uguagcccccuggccu

SEQ ID NO: 2666529 - RNA, 20 nt, Human
uguagcccccuggccucugu

SEQ ID NO: 2666530 - RNA, 19 nt, Human
uguagcccccuggccucug

SEQ ID NO: 2666531 - RNA, 15 nt, Human
uguagcccucccacu

SEQ ID NO: 2666532 - RNA, 21 nt, Human
uguagcccucccacuuugcug

SEQ ID NO: 2666533 - RNA, 15 nt, Human
uguacuguuacuggg

SEQ ID NO: 2666534 - RNA, 18 nt, Human
uguacuguuacugggccc

SEQ ID NO: 2666535 - RNA, 14 nt, Human
uguacguccagccu

SEQ ID NO: 2666536 - RNA, 17 nt, Human
uguacguccagccugcc

SEQ ID NO: 2666537 - RNA, 23 nt, Human
uguacgacacggguggggaaagg

SEQ ID NO: 2666538 - RNA, 23 nt, Human
uguacgacgucagauguuuaaaa

SEQ ID NO: 2666539 - RNA, 22 nt, Human
uguacgacgucagauguuuaaa

SEQ ID NO: 2666540 - RNA, 22 nt, Human
uguagcagugagucauaucuua

SEQ ID NO: 2666541 - RNA, 12 nt, Human
uguagcauacug

SEQ ID NO: 2666542 - RNA, 15 nt, Human
uguacuuaaauggua

SEQ ID NO: 2666543 - RNA, 22 nt, Human
uguacuuaaaugguaauaagca

SEQ ID NO: 2666544 - RNA, 12 nt, Human
uguagaugaugu

SEQ ID NO: 2666545 - RNA, 18 nt, Human
uguagauauguauucuuu

SEQ ID NO: 2666546 - RNA, 15 nt, Human
uguagaugauguauu

SEQ ID NO: 2666547 - RNA, 15 nt, Human
uguaauuaaauucug

SEQ ID NO: 2666548 - RNA, 13 nt, Human
uguaauaaacuuu

SEQ ID NO: 2666549 - RNA, 15 nt, Human
uguaauaaacuuuaa

SEQ ID NO: 2666550 - RNA, 17 nt, Human
uguaauaaacuuuaaua

SEQ ID NO: 2666551 - RNA, 22 nt, Human
uggucacaacuugauggcugcg

SEQ ID NO: 2666552 - RNA, 23 nt, Human
uggucaagggcugucauugcaca

SEQ ID NO: 2666553 - RNA, 15 nt, Human
uggucacagcggagg

SEQ ID NO: 2666554 - RNA, 21 nt, Human
uggucacagcggaggugugga

SEQ ID NO: 2666555 - RNA, 20 nt, Human
uguaaucccagcuacucggg

SEQ ID NO: 2666556 - RNA, 20 nt, Human
uuaaaucuaaaucuauuuau

SEQ ID NO: 2666557 - RNA, 13 nt, Human
uuaaauccuuuua

SEQ ID NO: 2666558 - RNA, 19 nt, Human
uuaaauccuuuuaccuuuu

SEQ ID NO: 2666559 - RNA, 14 nt, Human
uuaaaucuuaaugu

SEQ ID NO: 2666560 - RNA, 15 nt, Human
uuaaaucuuaauguu

SEQ ID NO: 2666561 - RNA, 12 nt, Human
uuaaaugaaaga

SEQ ID NO: 2666562 - RNA, 16 nt, Human
uuaaaugaaagaaaau

SEQ ID NO: 2666563 - RNA, 13 nt, Human
uuaaauauuuucu

SEQ ID NO: 2666564 - RNA, 18 nt, Human
uuaaauauuuucuauuuu

SEQ ID NO: 2666565 - RNA, 22 nt, Human
uuaaauauuuucuauuuuaaga

SEQ ID NO: 2666566 - RNA, 15 nt, Human
uuaaagaaaagauga

SEQ ID NO: 2666567 - RNA, 16 nt, Human
uuaaagaaaagaugaa

SEQ ID NO: 2666568 - RNA, 17 nt, Human
uuaaagaaaagaugaaa

SEQ ID NO: 2666569 - RNA, 23 nt, Human
uuaaagaaaaaaaugucaaaagu

SEQ ID NO: 2666570 - RNA, 15 nt, Human
uuaaaauaauuauau

SEQ ID NO: 2666571 - RNA, 15 nt, Human
uuaaacuuuuuuaac

SEQ ID NO: 2666572 - RNA, 16 nt, Human
uuaaagaaaaaaaugu

SEQ ID NO: 2666573 - RNA, 22 nt, Human
uuaaacuaggagaaccaaaucu

SEQ ID NO: 2666574 - RNA, 14 nt, Human
uuaaaacuggaccu

SEQ ID NO: 2666575 - RNA, 16 nt, Human
uuaaaacuggaccugu

SEQ ID NO: 2666576 - RNA, 14 nt, Human
uuaaaauaaauauu

SEQ ID NO: 2666577 - RNA, 15 nt, Human
uuaaaauaaggauuu

SEQ ID NO: 2666578 - RNA, 14 nt, Human
uuaaaauaaaauga

SEQ ID NO: 2666579 - RNA, 15 nt, Human
uuaaaauaaaaugaa

SEQ ID NO: 2666580 - RNA, 17 nt, Human
uuaaaauaaaaugaaaa

SEQ ID NO: 2666581 - RNA, 20 nt, Human
uuaaaauaaaaugaaaauug

SEQ ID NO: 2666582 - RNA, 21 nt, Human
uuaaaauaaaaugaaaauugu

SEQ ID NO: 2666583 - RNA, 14 nt, Human
uuaaaacccaagug

SEQ ID NO: 2666584 - RNA, 20 nt, Human
uuaaaaaaaaagucagagac

SEQ ID NO: 2666585 - RNA, 22 nt, Human
uuaaaaaaaaagucagagacag

SEQ ID NO: 2666586 - RNA, 13 nt, Human
uuaaaacuaaauu

SEQ ID NO: 2666587 - RNA, 16 nt, Human
uuaaaacuaaauuuca

SEQ ID NO: 2666588 - RNA, 14 nt, Human
uguuuccucuaguu

SEQ ID NO: 2666589 - RNA, 21 nt, Human
uguuuccugacauugucuccu

SEQ ID NO: 2666590 - RNA, 22 nt, Human
uguuucuggacccuuauaaaau

SEQ ID NO: 2666591 - RNA, 23 nt, Human
uguuucuggacccuuauaaaauc

SEQ ID NO: 2666592 - RNA, 12 nt, Human
uguuuacugaaa

SEQ ID NO: 2666593 - RNA, 17 nt, Human
uguuuacauuugaugca

SEQ ID NO: 2666594 - RNA, 22 nt, Human
uguuuacauuugaugcaugucu

SEQ ID NO: 2666595 - RNA, 15 nt, Human
uguuuaccuuucucu

SEQ ID NO: 2666596 - RNA, 16 nt, Human
uguuuaccuuucucuc

SEQ ID NO: 2666597 - RNA, 23 nt, Human
uguuuaccuuucucucucuaagg

SEQ ID NO: 2666598 - RNA, 21 nt, Human
uguuuuuguauauugguuuua

SEQ ID NO: 2666599 - RNA, 14 nt, Human
uguuuuuguauauu

SEQ ID NO: 2666600 - RNA, 10 nt, Human
uguuuuuggg

SEQ ID NO: 2666601 - RNA, 13 nt, Human
uguuuuuguauau

SEQ ID NO: 2666602 - RNA, 12 nt, Human
uguuuuuguaua

SEQ ID NO: 2666603 - RNA, 13 nt, Human
uguuuuuaaugcu

SEQ ID NO: 2666604 - RNA, 19 nt, Human
uguuuuuaaugcuauuuga

SEQ ID NO: 2666605 - RNA, 12 nt, Human
uguuuuucugcu

SEQ ID NO: 2666606 - RNA, 18 nt, Human
uguuuuugaggcuuucug

SEQ ID NO: 2666607 - RNA, 16 nt, Human
uguuuuugcacauguu

SEQ ID NO: 2666608 - RNA, 22 nt, Human
uguuuuucugugugucaguuuu

SEQ ID NO: 2666609 - RNA, 19 nt, Human
uguuuuucugcuuuagacu

SEQ ID NO: 2666610 - RNA, 18 nt, Human
uguuuuucugcuuuagac

SEQ ID NO: 2666611 - RNA, 15 nt, Human
uguuuuucugcuuua

SEQ ID NO: 2666612 - RNA, 14 nt, Human
uguuuuucugcuuu

SEQ ID NO: 2666613 - RNA, 15 nt, Human
uuacagaaauggacu

SEQ ID NO: 2666614 - RNA, 19 nt, Human
uuacagaaauggacuggag

SEQ ID NO: 2666615 - RNA, 23 nt, Human
uuacacuggcaaugguaguuucu

SEQ ID NO: 2666616 - RNA, 22 nt, Human
uuacacuggcaaugguaguuuc

SEQ ID NO: 2666617 - RNA, 21 nt, Human
uuacacuggcaaugguaguuu

SEQ ID NO: 2666618 - RNA, 20 nt, Human
uuacacuggcaaugguaguu

SEQ ID NO: 2666619 - RNA, 13 nt, Human
uuacagaaaaaga

SEQ ID NO: 2666620 - RNA, 18 nt, Human
uuacagaaaaagacuuua

SEQ ID NO: 2666621 - RNA, 14 nt, Human
uuaaugacaauauu

SEQ ID NO: 2666622 - RNA, 19 nt, Human
uuacacagaaacacugccu

SEQ ID NO: 2666623 - RNA, 20 nt, Human
uuacacagaaacacugccuu

SEQ ID NO: 2666624 - RNA, 13 nt, Human
uuacacagaaaca

SEQ ID NO: 2666625 - RNA, 14 nt, Human
uuacacagaaacac

SEQ ID NO: 2666626 - RNA, 16 nt, Human
uuacacagaaacacug

SEQ ID NO: 2666627 - RNA, 18 nt, Human
uuacacagaaacacugcc

SEQ ID NO: 2666628 - RNA, 23 nt, Human
uuaauaccagauaccuuaucuua

SEQ ID NO: 2666629 - RNA, 20 nt, Human
uuaauaaucaagagccuuaa

SEQ ID NO: 2666630 - RNA, 13 nt, Human
uuaauacaaggua

SEQ ID NO: 2666631 - RNA, 19 nt, Human
uuaauacaagguauaauaa

SEQ ID NO: 2666632 - RNA, 22 nt, Human
uuaauacaagguauaauaaaau

SEQ ID NO: 2666633 - RNA, 23 nt, Human
uuaauacaagguauaauaaaauu

SEQ ID NO: 2666634 - RNA, 19 nt, Human
uuaagcaaauguuaaaagu

SEQ ID NO: 2666635 - RNA, 17 nt, Human
uuaagauaguguaacuu

SEQ ID NO: 2666636 - RNA, 22 nt, Human
uuaauaagcuacuagcaaaaua

SEQ ID NO: 2666637 - RNA, 11 nt, Human
uuaagauguga

SEQ ID NO: 2666638 - RNA, 12 nt, Human
uuaagaugugaa

SEQ ID NO: 2666639 - RNA, 13 nt, Human
uuaagaugugaaa

SEQ ID NO: 2666640 - RNA, 14 nt, Human
uuaagaugugaaaa

SEQ ID NO: 2666641 - RNA, 15 nt, Human
uuaagaugugaaaau

SEQ ID NO: 2666642 - RNA, 17 nt, Human
uuaagaugugaaaauua

SEQ ID NO: 2666643 - RNA, 17 nt, Human
uuaaauguuaccucuga

SEQ ID NO: 2666644 - RNA, 18 nt, Human
uguugacaacugugacug

SEQ ID NO: 2666645 - RNA, 15 nt, Human
uguugacaacuguga

SEQ ID NO: 2666646 - RNA, 16 nt, Human
uguugacgcaccugug

SEQ ID NO: 2666647 - RNA, 20 nt, Human
uguucuuuuaaaugauugaa

SEQ ID NO: 2666648 - RNA, 23 nt, Human
uguucauagcccaguagaccuug

SEQ ID NO: 2666649 - RNA, 19 nt, Human
uguucauagcccaguagac

SEQ ID NO: 2666650 - RNA, 20 nt, Human
uguucauagcccaguagacc

SEQ ID NO: 2666651 - RNA, 15 nt, Human
uguucaucauccaga

SEQ ID NO: 2666652 - RNA, 16 nt, Human
uguucaucauccagau

SEQ ID NO: 2666653 - RNA, 18 nt, Human
uguucaucauccagaugu

SEQ ID NO: 2666654 - RNA, 20 nt, Human
uguucaucauccagaugugg

SEQ ID NO: 2666655 - RNA, 17 nt, Human
uguucucggagugugua

SEQ ID NO: 2666656 - RNA, 18 nt, Human
uguucucggaguguguau

SEQ ID NO: 2666657 - RNA, 16 nt, Human
uguucucucuucucca

SEQ ID NO: 2666658 - RNA, 15 nt, Human
uguucucucuucucc

SEQ ID NO: 2666659 - RNA, 13 nt, Human
uguuggaaaguaa

SEQ ID NO: 2666660 - RNA, 16 nt, Human
uguugauuauuagcca

SEQ ID NO: 2666661 - RNA, 11 nt, Human
uguugauuauu

SEQ ID NO: 2666662 - RNA, 17 nt, Human
uguugaucauguacuuu

SEQ ID NO: 2666663 - RNA, 19 nt, Human
uguugaucauguacuuuuu

SEQ ID NO: 2666664 - RNA, 20 nt, Human
uguugaucauguacuuuuua

SEQ ID NO: 2666665 - RNA, 22 nt, Human
uguugaucauguacuuuuuagu

SEQ ID NO: 2666666 - RNA, 23 nt, Human
uguugaucauguacuuuuuagua

SEQ ID NO: 2666667 - RNA, 12 nt, Human
uguuggcaggcu

SEQ ID NO: 2666668 - RNA, 19 nt, Human
uguugggaaacuuggcucg

SEQ ID NO: 2666669 - RNA, 14 nt, Human
uguugggacugcua

SEQ ID NO: 2666670 - RNA, 19 nt, Human
uguugggacugcuaaauaa

SEQ ID NO: 2666671 - RNA, 18 nt, Human
uguuggcaggcuggccag

SEQ ID NO: 2666672 - RNA, 21 nt, Human
uguuggcaggcuggccagucc

SEQ ID NO: 2666673 - RNA, 16 nt, Human
uguuuaauauugagaa

SEQ ID NO: 2666674 - RNA, 13 nt, Human
uguuuaaaaugua

SEQ ID NO: 2666675 - RNA, 14 nt, Human
uguuuaaaauguaa

SEQ ID NO: 2666676 - RNA, 20 nt, Human
uguuuaaaauguaauuuaaa

SEQ ID NO: 2666677 - RNA, 22 nt, Human
uguuuaaaauguaauuuaaaug

SEQ ID NO: 2666678 - RNA, 15 nt, Human
uguguuuauuucacu

SEQ ID NO: 2666679 - RNA, 14 nt, Human
uguguuuauuucac

SEQ ID NO: 2666680 - RNA, 13 nt, Human
ugugugugcgugu

SEQ ID NO: 2666681 - RNA, 16 nt, Human
ugugugugacaauucu

SEQ ID NO: 2666682 - RNA, 14 nt, Human
ugugugguagaaac

SEQ ID NO: 2666683 - RNA, 15 nt, Human
ugugugguagaaaca

SEQ ID NO: 2666684 - RNA, 16 nt, Human
ugugugguagaaacaa

SEQ ID NO: 2666685 - RNA, 20 nt, Human
uguguuucuaugugacaauu

SEQ ID NO: 2666686 - RNA, 21 nt, Human
uguguuucuccugagcuagga

SEQ ID NO: 2666687 - RNA, 23 nt, Human
uguguggauugccucugaaaagu

SEQ ID NO: 2666688 - RNA, 23 nt, Human
uguguggacuguggcacuugccu

SEQ ID NO: 2666689 - RNA, 16 nt, Human
uguguggacuguggca

SEQ ID NO: 2666690 - RNA, 11 nt, Human
uguguggccug

SEQ ID NO: 2666691 - RNA, 22 nt, Human
ugugugcaacaggguauggacu

SEQ ID NO: 2666692 - RNA, 14 nt, Human
uguguaugccaaga

SEQ ID NO: 2666693 - RNA, 14 nt, Human
ugugugaaauugca

SEQ ID NO: 2666694 - RNA, 23 nt, Human
uguuaaaauuaucaauaucuaau

SEQ ID NO: 2666695 - RNA, 21 nt, Human
uguuaaaauuaucaauaucua

SEQ ID NO: 2666696 - RNA, 15 nt, Human
uguuaaaaguuuuau

SEQ ID NO: 2666697 - RNA, 20 nt, Human
uguuaaaaguuuuauaugcu

SEQ ID NO: 2666698 - RNA, 14 nt, Human
uguguuuuuuaaga

SEQ ID NO: 2666699 - RNA, 16 nt, Human
uguguuuuuuaagaua

SEQ ID NO: 2666700 - RNA, 17 nt, Human
uguguuuuuuaagauag

SEQ ID NO: 2666701 - RNA, 14 nt, Human
uguuaccucugaau

SEQ ID NO: 2666702 - RNA, 22 nt, Human
uguuacucucuugcaccaaauu

SEQ ID NO: 2666703 - RNA, 15 nt, Human
uguuacugggcccug

SEQ ID NO: 2666704 - RNA, 21 nt, Human
uguuaggauuuucacauucuu

SEQ ID NO: 2666705 - RNA, 14 nt, Human
uguucauagcccag

SEQ ID NO: 2666706 - RNA, 15 nt, Human
uguucauagcccagu

SEQ ID NO: 2666707 - RNA, 12 nt, Human
uuuuuuguuauu

SEQ ID NO: 2666708 - RNA, 18 nt, Human
caaugaacacuuauaagu

SEQ ID NO: 2666709 - RNA, 15 nt, Human
caaugaaccauaaau

SEQ ID NO: 2666710 - RNA, 16 nt, Human
caaugaaccauaaauu

SEQ ID NO: 2666711 - RNA, 17 nt, Human
caaugaaccauaaauuc

SEQ ID NO: 2666712 - RNA, 19 nt, Human
caaugaaccauaaauucaa

SEQ ID NO: 2666713 - RNA, 18 nt, Human
caauccugauuccucucu

SEQ ID NO: 2666714 - RNA, 21 nt, Human
caauccugauuccucucuaag

SEQ ID NO: 2666715 - RNA, 21 nt, Human
caauccuaauuucuccucccu

SEQ ID NO: 2666716 - RNA, 20 nt, Human
caauccuaauuucuccuccc

SEQ ID NO: 2666717 - RNA, 15 nt, Human
caaguguaaaauauu

SEQ ID NO: 2666718 - RNA, 16 nt, Human
caaguguaaaauauuu

SEQ ID NO: 2666719 - RNA, 22 nt, Human
caagugugugccaccaugccuc

SEQ ID NO: 2666720 - RNA, 22 nt, Human
caauaggaguggugauuugaaa

SEQ ID NO: 2666721 - RNA, 21 nt, Human
caauaggaugggcuucugugc

SEQ ID NO: 2666722 - RNA, 15 nt, Human
caauaggcuguuccc

SEQ ID NO: 2666723 - RNA, 13 nt, Human
caaugaaguugaa

SEQ ID NO: 2666724 - RNA, 21 nt, Human
caaugaaguugaaaaucauag

SEQ ID NO: 2666725 - RNA, 20 nt, Human
caaugaucaccgacugaaaa

SEQ ID NO: 2666726 - RNA, 15 nt, Human
caauuuuaucuguuu

SEQ ID NO: 2666727 - RNA, 18 nt, Human
cacacugguucucaauga

SEQ ID NO: 2666728 - RNA, 19 nt, Human
cacacugguucucaaugaa

SEQ ID NO: 2666729 - RNA, 20 nt, Human
cacacugguucucaaugaaa

SEQ ID NO: 2666730 - RNA, 14 nt, Human
cacacugguucuca

SEQ ID NO: 2666731 - RNA, 15 nt, Human
cacacugguucucaa

SEQ ID NO: 2666732 - RNA, 16 nt, Human
cacacugguucucaau

SEQ ID NO: 2666733 - RNA, 14 nt, Human
cacagacuauuuuu

SEQ ID NO: 2666734 - RNA, 13 nt, Human
cacagacuauuuu

SEQ ID NO: 2666735 - RNA, 23 nt, Human
cacagagcaagagauaagucuuu

SEQ ID NO: 2666736 - RNA, 22 nt, Human
cacacagaccccucgcaacugu

SEQ ID NO: 2666737 - RNA, 16 nt, Human
cacacuugaaaccuuu

SEQ ID NO: 2666738 - RNA, 15 nt, Human
cacacagacuauuuu

SEQ ID NO: 2666739 - RNA, 15 nt, Human
cacacagaaugcaac

SEQ ID NO: 2666740 - RNA, 15 nt, Human
cacacagccuagcac

SEQ ID NO: 2666741 - RNA, 16 nt, Human
cacaccuguagcacuu

SEQ ID NO: 2666742 - RNA, 14 nt, Human
cacacccaaagcug

SEQ ID NO: 2666743 - RNA, 15 nt, Human
cacacccaaagcuga

SEQ ID NO: 2666744 - RNA, 19 nt, Human
cacacccaaagcugagccu

SEQ ID NO: 2666745 - RNA, 22 nt, Human
cacacccaaagcugagccugca

SEQ ID NO: 2666746 - RNA, 23 nt, Human
cacaccaaucuuacuuuguaaau

SEQ ID NO: 2666747 - RNA, 14 nt, Human
cacaucaaauaaga

SEQ ID NO: 2666748 - RNA, 18 nt, Human
cacaucaaauaagaaaua

SEQ ID NO: 2666749 - RNA, 14 nt, Human
cacaucaaaccuuu

SEQ ID NO: 2666750 - RNA, 16 nt, Human
cacauauuugaagggu

SEQ ID NO: 2666751 - RNA, 23 nt, Human
cacauauuugaagggucuuucuc

SEQ ID NO: 2666752 - RNA, 13 nt, Human
cacauguuuuuau

SEQ ID NO: 2666753 - RNA, 16 nt, Human
cacauguccagcaccu

SEQ ID NO: 2666754 - RNA, 12 nt, Human
cacauguuuccu

SEQ ID NO: 2666755 - RNA, 14 nt, Human
cacauguuuccucu

SEQ ID NO: 2666756 - RNA, 15 nt, Human
cacauguuuccucua

SEQ ID NO: 2666757 - RNA, 13 nt, Human
caccaccaagcca

SEQ ID NO: 2666758 - RNA, 14 nt, Human
caccaccaccccua

SEQ ID NO: 2666759 - RNA, 14 nt, Human
caccaccccuacca

SEQ ID NO: 2666760 - RNA, 13 nt, Human
caccacagccagc

SEQ ID NO: 2666761 - RNA, 17 nt, Human
caccacagccagcaccu

SEQ ID NO: 2666762 - RNA, 19 nt, Human
caccacagccagcaccugg

SEQ ID NO: 2666763 - RNA, 13 nt, Human
cacauucuuggcu

SEQ ID NO: 2666764 - RNA, 22 nt, Human
cacauucuuggcuuaaucauuu

SEQ ID NO: 2666765 - RNA, 13 nt, Human
cacauugaagaau

SEQ ID NO: 2666766 - RNA, 23 nt, Human
cacauugaagaauguuagaguaa

SEQ ID NO: 2666767 - RNA, 17 nt, Human
cacauugagcugugcaa

SEQ ID NO: 2666768 - RNA, 23 nt, Human
cacagcagcuuauaaugggcucu

SEQ ID NO: 2666769 - RNA, 13 nt, Human
cacagccuagcac

SEQ ID NO: 2666770 - RNA, 18 nt, Human
cacagccuagcacagcag

SEQ ID NO: 2666771 - RNA, 20 nt, Human
cacagccuagcacagcagcu

SEQ ID NO: 2666772 - RNA, 14 nt, Human
cacauauauauuac

SEQ ID NO: 2666773 - RNA, 13 nt, Human
cacauauacacga

SEQ ID NO: 2666774 - RNA, 17 nt, Human
cacaguuuuuccuggaa

SEQ ID NO: 2666775 - RNA, 18 nt, Human
cacaguugcucuaugcuu

SEQ ID NO: 2666776 - RNA, 17 nt, Human
caaauaaguauuuauaa

SEQ ID NO: 2666777 - RNA, 18 nt, Human
caaauaaguauuuauaau

SEQ ID NO: 2666778 - RNA, 16 nt, Human
caaauaaguauuuaua

SEQ ID NO: 2666779 - RNA, 22 nt, Human
caaaguuuuguuguacuuaaau

SEQ ID NO: 2666780 - RNA, 14 nt, Human
caaauaagaaauaa

SEQ ID NO: 2666781 - RNA, 16 nt, Human
caaaguuugacaggaa

SEQ ID NO: 2666782 - RNA, 17 nt, Human
caaaguuugacaggaac

SEQ ID NO: 2666783 - RNA, 19 nt, Human
caaaguuugacaggaaccu

SEQ ID NO: 2666784 - RNA, 20 nt, Human
caaaguuugacaggaaccuu

SEQ ID NO: 2666785 - RNA, 13 nt, Human
caaauacacauuu

SEQ ID NO: 2666786 - RNA, 14 nt, Human
caaauacacauuug

SEQ ID NO: 2666787 - RNA, 16 nt, Human
caaauacacauuugcu

SEQ ID NO: 2666788 - RNA, 17 nt, Human
caaauacacauuugcua

SEQ ID NO: 2666789 - RNA, 14 nt, Human
caaagaaaaugaaa

SEQ ID NO: 2666790 - RNA, 16 nt, Human
caaagaaaaugaaaug

SEQ ID NO: 2666791 - RNA, 18 nt, Human
caaagaaaaugaaaugca

SEQ ID NO: 2666792 - RNA, 21 nt, Human
caaagaaaaugaaaugcauau

SEQ ID NO: 2666793 - RNA, 14 nt, Human
caaagagggcuucc

SEQ ID NO: 2666794 - RNA, 23 nt, Human
caaagaggcugccccucucacca

SEQ ID NO: 2666795 - RNA, 21 nt, Human
caaagaggcugccccucucac

SEQ ID NO: 2666796 - RNA, 22 nt, Human
caaagaggcugccccucucacc

SEQ ID NO: 2666797 - RNA, 15 nt, Human
caaagagggcuuccu

SEQ ID NO: 2666798 - RNA, 16 nt, Human
caaagagggcuuccuc

SEQ ID NO: 2666799 - RNA, 18 nt, Human
caaagagggcuuccucua

SEQ ID NO: 2666800 - RNA, 22 nt, Human
caaagagggcuuccucuagaag

SEQ ID NO: 2666801 - RNA, 12 nt, Human
caaagaggcugc

SEQ ID NO: 2666802 - RNA, 13 nt, Human
caaagaggcugcc

SEQ ID NO: 2666803 - RNA, 15 nt, Human
caaagaggcugcccc

SEQ ID NO: 2666804 - RNA, 16 nt, Human
caaagaggcugccccu

SEQ ID NO: 2666805 - RNA, 12 nt, Human
caaaaaaugagc

SEQ ID NO: 2666806 - RNA, 15 nt, Human
caaaaaacuacuucu

SEQ ID NO: 2666807 - RNA, 11 nt, Human
caaaaaacuac

SEQ ID NO: 2666808 - RNA, 18 nt, Human
caaaggagcgagcauguc

SEQ ID NO: 2666809 - RNA, 22 nt, Human
caaaggaaaauaguaauguuuu

SEQ ID NO: 2666810 - RNA, 17 nt, Human
caaaggaaaaugucugu

SEQ ID NO: 2666811 - RNA, 18 nt, Human
caaaggaaacuuugcaga

SEQ ID NO: 2666812 - RNA, 19 nt, Human
caaaggaacauugugucua

SEQ ID NO: 2666813 - RNA, 19 nt, Human
caaagcuuggagggaagcc

SEQ ID NO: 2666814 - RNA, 20 nt, Human
caaagcuuggauuaaauaca

SEQ ID NO: 2666815 - RNA, 21 nt, Human
caaagcuuggauuaaauacau

SEQ ID NO: 2666816 - RNA, 16 nt, Human
caaagcuggcucaccu

SEQ ID NO: 2666817 - RNA, 17 nt, Human
caaagcuggcucaccuu

SEQ ID NO: 2666818 - RNA, 13 nt, Human
caaccacaaaacu

SEQ ID NO: 2666819 - RNA, 22 nt, Human
caacauucauugccaagggccc

SEQ ID NO: 2666820 - RNA, 23 nt, Human
caacauguugggaaacuuggcuc

SEQ ID NO: 2666821 - RNA, 19 nt, Human
caacauguugggaaacuug

SEQ ID NO: 2666822 - RNA, 22 nt, Human
caacauguugggaaacuuggcu

SEQ ID NO: 2666823 - RNA, 16 nt, Human
caacugcauuggcuuu

SEQ ID NO: 2666824 - RNA, 19 nt, Human
caacuuagucaauaagaaa

SEQ ID NO: 2666825 - RNA, 19 nt, Human
caacuuuguaaaaaucuuu

SEQ ID NO: 2666826 - RNA, 22 nt, Human
caacuuuguaaaaaucuuuuga

SEQ ID NO: 2666827 - RNA, 16 nt, Human
caaccucuucuggcuc

SEQ ID NO: 2666828 - RNA, 18 nt, Human
caaccucuucuggcucaa

SEQ ID NO: 2666829 - RNA, 17 nt, Human
caaccucuucuggcuca

SEQ ID NO: 2666830 - RNA, 20 nt, Human
caacgaucacaaaugacuuu

SEQ ID NO: 2666831 - RNA, 13 nt, Human
caaccaagucaca

SEQ ID NO: 2666832 - RNA, 14 nt, Human
caacgccgugggcu

SEQ ID NO: 2666833 - RNA, 16 nt, Human
caacgaucacaaauga

SEQ ID NO: 2666834 - RNA, 19 nt, Human
caacgaucacaaaugacuu

SEQ ID NO: 2666835 - RNA, 18 nt, Human
caacgaucacaaaugacu

SEQ ID NO: 2666836 - RNA, 20 nt, Human
caagaaagcucacuguagcu

SEQ ID NO: 2666837 - RNA, 18 nt, Human
caagccaagggaaccugu

SEQ ID NO: 2666838 - RNA, 21 nt, Human
caagccaagggaaccuguguc

SEQ ID NO: 2666839 - RNA, 22 nt, Human
caagccaagggaaccugugucc

SEQ ID NO: 2666840 - RNA, 23 nt, Human
caagccaagggaaccuguguccg

SEQ ID NO: 2666841 - RNA, 15 nt, Human
caagcggguggcucu

SEQ ID NO: 2666842 - RNA, 18 nt, Human
caagcggguggcucuggg

SEQ ID NO: 2666843 - RNA, 19 nt, Human
caagugaaaaaggaggaag

SEQ ID NO: 2666844 - RNA, 15 nt, Human
caaguggggugcugg

SEQ ID NO: 2666845 - RNA, 17 nt, Human
caaguggggugcuggga

SEQ ID NO: 2666846 - RNA, 21 nt, Human
caaguggggugcugggaggag

SEQ ID NO: 2666847 - RNA, 18 nt, Human
caaguggggugcugggag

SEQ ID NO: 2666848 - RNA, 19 nt, Human
caaguggggugcugggagg

SEQ ID NO: 2666849 - RNA, 22 nt, Human
caagugugguagagugugccug

SEQ ID NO: 2666850 - RNA, 23 nt, Human
caaggugggaggauugcuugagc

SEQ ID NO: 2666851 - RNA, 12 nt, Human
caaggugggagg

SEQ ID NO: 2666852 - RNA, 17 nt, Human
caagggcugucauugca

SEQ ID NO: 2666853 - RNA, 12 nt, Human
caccccccaggc

SEQ ID NO: 2666854 - RNA, 12 nt, Human
cacccccagccc

SEQ ID NO: 2666855 - RNA, 13 nt, Human
cacccccagcccc

SEQ ID NO: 2666856 - RNA, 19 nt, Human
cacccccagccccgacucc

SEQ ID NO: 2666857 - RNA, 21 nt, Human
cacccccagccccgacuccag

SEQ ID NO: 2666858 - RNA, 23 nt, Human
cacccccagccccgacuccagcc

SEQ ID NO: 2666859 - RNA, 17 nt, Human
cacccccugcccugcac

SEQ ID NO: 2666860 - RNA, 14 nt, Human
cacccccugcccug

SEQ ID NO: 2666861 - RNA, 16 nt, Human
cacccccugcccugca

SEQ ID NO: 2666862 - RNA, 13 nt, Human
cacccccugcccu

SEQ ID NO: 2666863 - RNA, 14 nt, Human
cacccccucccacc

SEQ ID NO: 2666864 - RNA, 15 nt, Human
cacccccucccaccc

SEQ ID NO: 2666865 - RNA, 16 nt, Human
cacccccucccacccc

SEQ ID NO: 2666866 - RNA, 19 nt, Human
cacccccucccacccccag

SEQ ID NO: 2666867 - RNA, 19 nt, Human
caccccggggacccuguga

SEQ ID NO: 2666868 - RNA, 20 nt, Human
caccccggggacccugugac

SEQ ID NO: 2666869 - RNA, 17 nt, Human
caccccggggacccugu

SEQ ID NO: 2666870 - RNA, 18 nt, Human
caccccggggacccugug

SEQ ID NO: 2666871 - RNA, 18 nt, Human
caccccggcccccugccc

SEQ ID NO: 2666872 - RNA, 23 nt, Human
caccccggcccccugcccguucu

SEQ ID NO: 2666873 - RNA, 22 nt, Human
caccacgggacaucacagggug

SEQ ID NO: 2666874 - RNA, 13 nt, Human
cacccaccgugga

SEQ ID NO: 2666875 - RNA, 16 nt, Human
cacccaccguggagga

SEQ ID NO: 2666876 - RNA, 11 nt, Human
caccccaggac

SEQ ID NO: 2666877 - RNA, 17 nt, Human
caccccaggacgccacu

SEQ ID NO: 2666878 - RNA, 18 nt, Human
caccccaggacgccacuc

SEQ ID NO: 2666879 - RNA, 20 nt, Human
caccccaggacgccacucau

SEQ ID NO: 2666880 - RNA, 19 nt, Human
uaaaucuaaaucuauuuau

SEQ ID NO: 2666881 - RNA, 15 nt, Human
uaaaucuaaaucuau

SEQ ID NO: 2666882 - RNA, 14 nt, Human
uaaaucuaaaucua

SEQ ID NO: 2666883 - RNA, 14 nt, Human
uaaauccugaagag

SEQ ID NO: 2666884 - RNA, 16 nt, Human
uaaauccugaagagca

SEQ ID NO: 2666885 - RNA, 18 nt, Human
uaaauccugaagagcauu

SEQ ID NO: 2666886 - RNA, 21 nt, Human
uaaauaggaaucauucagaaa

SEQ ID NO: 2666887 - RNA, 23 nt, Human
uaaauaggaaucauucagaaaug

SEQ ID NO: 2666888 - RNA, 12 nt, Human
uaaauaggauuu

SEQ ID NO: 2666889 - RNA, 14 nt, Human
aauaaggauuuuuc

SEQ ID NO: 2666890 - RNA, 19 nt, Human
uaaauacacauagcaugua

SEQ ID NO: 2666891 - RNA, 23 nt, Human
uaaauaauucuuuuuuauuaauc

SEQ ID NO: 2666892 - RNA, 17 nt, Human
uaaauaauucuuuuuua

SEQ ID NO: 2666893 - RNA, 14 nt, Human
uaaauaauuuauuu

SEQ ID NO: 2666894 - RNA, 17 nt, Human
uaaauaauuuauuuaau

SEQ ID NO: 2666895 - RNA, 23 nt, Human
aauacacauagcauguaauggua

SEQ ID NO: 2666896 - RNA, 14 nt, Human
aauacacauuugcu

SEQ ID NO: 2666897 - RNA, 15 nt, Human
aauacacauuugcua

SEQ ID NO: 2666898 - RNA, 17 nt, Human
aauacaagguauaauaa

SEQ ID NO: 2666899 - RNA, 19 nt, Human
aauacaagguauaauaaaa

SEQ ID NO: 2666900 - RNA, 20 nt, Human
aauacaagguauaauaaaau

SEQ ID NO: 2666901 - RNA, 22 nt, Human
aauacaagguauaauaaaauua

SEQ ID NO: 2666902 - RNA, 22 nt, Human
uaaauuuuuuuguaugaaaaca

SEQ ID NO: 2666903 - RNA, 21 nt, Human
uaaauuuuuuuguaugaaaac

SEQ ID NO: 2666904 - RNA, 18 nt, Human
uaaauuuuuuuguaugaa

SEQ ID NO: 2666905 - RNA, 17 nt, Human
uaaauuuuuuuguauga

SEQ ID NO: 2666906 - RNA, 16 nt, Human
uaaauuuuuuuguaug

SEQ ID NO: 2666907 - RNA, 15 nt, Human
uaaauuuuuuuguau

SEQ ID NO: 2666908 - RNA, 22 nt, Human
uaaauuuugaaaaguaauauuu

SEQ ID NO: 2666909 - RNA, 15 nt, Human
uaaauuuugaaaagu

SEQ ID NO: 2666910 - RNA, 14 nt, Human
uaaauuuugaaaag

SEQ ID NO: 2666911 - RNA, 20 nt, Human
uaaauguuuggcauguaaau

SEQ ID NO: 2666912 - RNA, 22 nt, Human
uaaauguuuggcauguaaaugu

SEQ ID NO: 2666913 - RNA, 21 nt, Human
uaaauguuucuuuuaaagacc

SEQ ID NO: 2666914 - RNA, 19 nt, Human
uaaauguuucuuuuguuug

SEQ ID NO: 2666915 - RNA, 22 nt, Human
uaaauuaggaauaaauaaaaau

SEQ ID NO: 2666916 - RNA, 21 nt, Human
uaaauuaggaauaaauaaaaa

SEQ ID NO: 2666917 - RNA, 17 nt, Human
uaaauuaggaauaaaua

SEQ ID NO: 2666918 - RNA, 14 nt, Human
uaaauuaggaauaa

SEQ ID NO: 2666919 - RNA, 13 nt, Human
uaaauuacaauuu

SEQ ID NO: 2666920 - RNA, 14 nt, Human
uaaauuacaauuuu

SEQ ID NO: 2666921 - RNA, 16 nt, Human
uaaauuacaauuuuau

SEQ ID NO: 2666922 - RNA, 17 nt, Human
uaaauuacaauuuuauc

SEQ ID NO: 2666923 - RNA, 23 nt, Human
uaaauuacaauuuuaucuguuuc

SEQ ID NO: 2666924 - RNA, 18 nt, Human
uaaaguguaaguucacaa

SEQ ID NO: 2666925 - RNA, 14 nt, Human
aauaaaaaaagaaa

SEQ ID NO: 2666926 - RNA, 22 nt, Human
uaaagggauauuuuuuucuauu

SEQ ID NO: 2666927 - RNA, 13 nt, Human
aauaaaaauggau

SEQ ID NO: 2666928 - RNA, 11 nt, Human
aauaaaaauau

SEQ ID NO: 2666929 - RNA, 14 nt, Human
aauaaaaauauauu

SEQ ID NO: 2666930 - RNA, 15 nt, Human
aauaaaaauauauuu

SEQ ID NO: 2666931 - RNA, 20 nt, Human
aauaaaaauauauuuucaac

SEQ ID NO: 2666932 - RNA, 13 nt, Human
aauaaaaaugaua

SEQ ID NO: 2666933 - RNA, 15 nt, Human
aauaaaauauaucuu

SEQ ID NO: 2666934 - RNA, 20 nt, Human
aauaaaauauaucuuauaaa

SEQ ID NO: 2666935 - RNA, 13 nt, Human
aauaaaaugaaaa

SEQ ID NO: 2666936 - RNA, 14 nt, Human
aauaaaaugaaaau

SEQ ID NO: 2666937 - RNA, 19 nt, Human
aauaaaaugaaaauuguau

SEQ ID NO: 2666938 - RNA, 16 nt, Human
aauaaguauuuauaau

SEQ ID NO: 2666939 - RNA, 12 nt, Human
aauaacagcugc

SEQ ID NO: 2666940 - RNA, 13 nt, Human
aauaacagcugca

SEQ ID NO: 2666941 - RNA, 14 nt, Human
aauaacagcugcaa

SEQ ID NO: 2666942 - RNA, 19 nt, Human
aauaagcuacuagcaaaau

SEQ ID NO: 2666943 - RNA, 20 nt, Human
aauaagcuacuagcaaaaua

SEQ ID NO: 2666944 - RNA, 16 nt, Human
aauaagcuaguugaau

SEQ ID NO: 2666945 - RNA, 18 nt, Human
aauaagcuaguugaauac

SEQ ID NO: 2666946 - RNA, 17 nt, Human
aauaagcuaguugaaua

SEQ ID NO: 2666947 - RNA, 19 nt, Human
aauaagcacuguaaacuuc

SEQ ID NO: 2666948 - RNA, 22 nt, Human
aauaagcuaguugaauacuuga

SEQ ID NO: 2666949 - RNA, 20 nt, Human
aauaagcuaguugaauacuu

SEQ ID NO: 2666950 - RNA, 23 nt, Human
aauaagcuaguugaauacuugaa

SEQ ID NO: 2666951 - RNA, 22 nt, Human
aauaaauuuugaaaaguaauau

SEQ ID NO: 2666952 - RNA, 15 nt, Human
aauaacaaagcccuu

SEQ ID NO: 2666953 - RNA, 20 nt, Human
aauaaauuuugaaaaguaau

SEQ ID NO: 2666954 - RNA, 18 nt, Human
aauaaauuuugaaaagua

SEQ ID NO: 2666955 - RNA, 16 nt, Human
aauaaauuuugaaaag

SEQ ID NO: 2666956 - RNA, 15 nt, Human
aauaaauuuugaaaa

SEQ ID NO: 2666957 - RNA, 12 nt, Human
aauaaauuuuga

SEQ ID NO: 2666958 - RNA, 14 nt, Human
aauaaauuuugaaa

SEQ ID NO: 2666959 - RNA, 13 nt, Human
aauaaauuuugaa

SEQ ID NO: 2666960 - RNA, 11 nt, Human
aauaaaugugu

SEQ ID NO: 2666961 - RNA, 12 nt, Human
aauaaauguguu

SEQ ID NO: 2666962 - RNA, 18 nt, Human
aauaaauguuuuauuucu

SEQ ID NO: 2666963 - RNA, 18 nt, Human
aauaaauaaaaacuaauu

SEQ ID NO: 2666964 - RNA, 16 nt, Human
aauaaauaauuuucau

SEQ ID NO: 2666965 - RNA, 19 nt, Human
aauaaaguuugcuuagaaa

SEQ ID NO: 2666966 - RNA, 11 nt, Human
aauaaauauau

SEQ ID NO: 2666967 - RNA, 15 nt, Human
aauaaauauauacau

SEQ ID NO: 2666968 - RNA, 22 nt, Human
uaaaauuaucaauaucuaauau

SEQ ID NO: 2666969 - RNA, 15 nt, Human
uaaaauuaugagauu

SEQ ID NO: 2666970 - RNA, 22 nt, Human
uaaaauuaugagauugguuuuc

SEQ ID NO: 2666971 - RNA, 14 nt, Human
uaaaauuuguugca

SEQ ID NO: 2666972 - RNA, 15 nt, Human
uaaaauuuguugcau

SEQ ID NO: 2666973 - RNA, 16 nt, Human
uaaaauuuuguauguu

SEQ ID NO: 2666974 - RNA, 19 nt, Human
uaaaauuuuguauguuaaa

SEQ ID NO: 2666975 - RNA, 23 nt, Human
uaaaauuuuguauguuaaagaga

SEQ ID NO: 2666976 - RNA, 20 nt, Human
aaguuuuccuacacuugaga

SEQ ID NO: 2666977 - RNA, 16 nt, Human
uaaacaaagauucaug

SEQ ID NO: 2666978 - RNA, 16 nt, Human
uaaacaaaaugaagcu

SEQ ID NO: 2666979 - RNA, 18 nt, Human
uaaacaaagauucaugau

SEQ ID NO: 2666980 - RNA, 14 nt, Human
uaaaccacugugcg

SEQ ID NO: 2666981 - RNA, 22 nt, Human
uaaaccacuuaaacgaagaguu

SEQ ID NO: 2666982 - RNA, 19 nt, Human
aaguuucaguauuagaugc

SEQ ID NO: 2666983 - RNA, 13 nt, Human
aaguuugcuuaga

SEQ ID NO: 2666984 - RNA, 15 nt, Human
aaguuugcuuagaaa

SEQ ID NO: 2666985 - RNA, 16 nt, Human
aaguuugcuuagaaaa

SEQ ID NO: 2666986 - RNA, 13 nt, Human
aaguuuauauaua

SEQ ID NO: 2666987 - RNA, 13 nt, Human
aaguuuuauaugc

SEQ ID NO: 2666988 - RNA, 13 nt, Human
aaguuuuguaaaa

SEQ ID NO: 2666989 - RNA, 16 nt, Human
aaguuuuguaaaagaa

SEQ ID NO: 2666990 - RNA, 15 nt, Human
aaguuuugacaagcu

SEQ ID NO: 2666991 - RNA, 20 nt, Human
aaguuuugacaagcuggcuu

SEQ ID NO: 2666992 - RNA, 19 nt, Human
aaguuuugacaagcuggcu

SEQ ID NO: 2666993 - RNA, 15 nt, Human
aaguguuuauguugu

SEQ ID NO: 2666994 - RNA, 19 nt, Human
aaguguuuauguuguuuau

SEQ ID NO: 2666995 - RNA, 13 nt, Human
aaguuaaaauugu

SEQ ID NO: 2666996 - RNA, 18 nt, Human
aaguuaaacauugaagua

SEQ ID NO: 2666997 - RNA, 21 nt, Human
aaguucauguccaaacguccu

SEQ ID NO: 2666998 - RNA, 14 nt, Human
aaguuauugcaguu

SEQ ID NO: 2666999 - RNA, 15 nt, Human
aaguuauugcaguuu

SEQ ID NO: 2667000 - RNA, 17 nt, Human
aaguuauugcaguuuau

SEQ ID NO: 2667001 - RNA, 19 nt, Human
aaguuuacaaucaaaggaa

SEQ ID NO: 2667002 - RNA, 18 nt, Human
aaguuuacaaucaaagga

SEQ ID NO: 2667003 - RNA, 15 nt, Human
uaaaccucaguuauu

SEQ ID NO: 2667004 - RNA, 13 nt, Human
uaaacccucagag

SEQ ID NO: 2667005 - RNA, 16 nt, Human
uaaacccucagagccu

SEQ ID NO: 2667006 - RNA, 18 nt, Human
uaaaccgccaaggcuggg

SEQ ID NO: 2667007 - RNA, 16 nt, Human
uaaaccgccaaggcug

SEQ ID NO: 2667008 - RNA, 21 nt, Human
uaaaccuaggacuuccgagcu

SEQ ID NO: 2667009 - RNA, 18 nt, Human
uaaacucaucugaaaugu

SEQ ID NO: 2667010 - RNA, 22 nt, Human
uaaacucaucugaaauguuaca

SEQ ID NO: 2667011 - RNA, 14 nt, Human
uaaacuauaaaaca

SEQ ID NO: 2667012 - RNA, 22 nt, Human
uaaacuauaaaacaaaaauuug

SEQ ID NO: 2667013 - RNA, 23 nt, Human
uaaacucagcaucaaaauauuuc

SEQ ID NO: 2667014 - RNA, 19 nt, Human
uaaagagcccuugccuccc

SEQ ID NO: 2667015 - RNA, 21 nt, Human
uaaagagcccuugccucccca

SEQ ID NO: 2667016 - RNA, 15 nt, Human
uaaagagcccuugcc

SEQ ID NO: 2667017 - RNA, 16 nt, Human
uaaagagcccuugccu

SEQ ID NO: 2667018 - RNA, 17 nt, Human
uaaagagcccuugccuc

SEQ ID NO: 2667019 - RNA, 19 nt, Human
uaaagagagaacaggacua

SEQ ID NO: 2667020 - RNA, 12 nt, Human
uaaagagaauga

SEQ ID NO: 2667021 - RNA, 13 nt, Human
uaaagagaaugag

SEQ ID NO: 2667022 - RNA, 20 nt, Human
uaaagagcaucugauucuug

SEQ ID NO: 2667023 - RNA, 15 nt, Human
uaaagacagaggcag

SEQ ID NO: 2667024 - RNA, 15 nt, Human
uaaagacaggagaca

SEQ ID NO: 2667025 - RNA, 23 nt, Human
uaaagacaggagacaaaagagca

SEQ ID NO: 2667026 - RNA, 15 nt, Human
uaaagacaccugguu

SEQ ID NO: 2667027 - RNA, 20 nt, Human
uaaagacuggcuuuuauuaa

SEQ ID NO: 2667028 - RNA, 13 nt, Human
uaaagacugguuu

SEQ ID NO: 2667029 - RNA, 19 nt, Human
uaaagacugguuuucugcc

SEQ ID NO: 2667030 - RNA, 22 nt, Human
uaaagacugguuuucugccaau

SEQ ID NO: 2667031 - RNA, 22 nt, Human
uaaagacuuguauagcaugaaa

SEQ ID NO: 2667032 - RNA, 15 nt, Human
uaaagacuggcuuuu

SEQ ID NO: 2667033 - RNA, 14 nt, Human
uaaagacuggcuuu

SEQ ID NO: 2667034 - RNA, 19 nt, Human
uaaagacccuccuauucua

SEQ ID NO: 2667035 - RNA, 23 nt, Human
uaaagacccuccuauucuauaaa

SEQ ID NO: 2667036 - RNA, 14 nt, Human
uaaagaaguauuuu

SEQ ID NO: 2667037 - RNA, 15 nt, Human
uaaagaaguauuuuu

SEQ ID NO: 2667038 - RNA, 17 nt, Human
uaaagaaguauuuuuag

SEQ ID NO: 2667039 - RNA, 19 nt, Human
uaaagaaguauuuuuagaa

SEQ ID NO: 2667040 - RNA, 22 nt, Human
uaaagaaguauuuuuagaauaa

SEQ ID NO: 2667041 - RNA, 16 nt, Human
uaaagaauaugacuuu

SEQ ID NO: 2667042 - RNA, 19 nt, Human
uaaagaauaugacuuuuua

SEQ ID NO: 2667043 - RNA, 16 nt, Human
uaaagaaggaugaugu

SEQ ID NO: 2667044 - RNA, 15 nt, Human
guugacaacugugac

SEQ ID NO: 2667045 - RNA, 14 nt, Human
guugacaacuguga

SEQ ID NO: 2667046 - RNA, 16 nt, Human
guugacaacugugacu

SEQ ID NO: 2667047 - RNA, 12 nt, Human
guugagcuauga

SEQ ID NO: 2667048 - RNA, 16 nt, Human
guugagcuaugacuua

SEQ ID NO: 2667049 - RNA, 15 nt, Human
guugagcuaugacuu

SEQ ID NO: 2667050 - RNA, 14 nt, Human
guugagcaagcagu

SEQ ID NO: 2667051 - RNA, 18 nt, Human
guucuccguuagcuccug

SEQ ID NO: 2667052 - RNA, 19 nt, Human
guucuccguuagcuccugu

SEQ ID NO: 2667053 - RNA, 14 nt, Human
guucugugguuccu

SEQ ID NO: 2667054 - RNA, 18 nt, Human
guucugugguuccucugc

SEQ ID NO: 2667055 - RNA, 20 nt, Human
guucuguauuugaaagugcc

SEQ ID NO: 2667056 - RNA, 15 nt, Human
guucuguauuugaaa

SEQ ID NO: 2667057 - RNA, 12 nt, Human
guucucaaugaa

SEQ ID NO: 2667058 - RNA, 13 nt, Human
guucucaaugaaa

SEQ ID NO: 2667059 - RNA, 14 nt, Human
guucucaaugaaaa

SEQ ID NO: 2667060 - RNA, 15 nt, Human
guucucaaugaaaaa

SEQ ID NO: 2667061 - RNA, 23 nt, Human
guucucagaaucccuuaacaguu

SEQ ID NO: 2667062 - RNA, 17 nt, Human
aagcuuuccuguugaau

SEQ ID NO: 2667063 - RNA, 19 nt, Human
aagcuuugaauacuaaauu

SEQ ID NO: 2667064 - RNA, 18 nt, Human
aagcuguuacugucuuca

SEQ ID NO: 2667065 - RNA, 16 nt, Human
aagcucugaccacuug

SEQ ID NO: 2667066 - RNA, 13 nt, Human
aagcuguuccugu

SEQ ID NO: 2667067 - RNA, 17 nt, Human
aagcuccuaucuguuuu

SEQ ID NO: 2667068 - RNA, 16 nt, Human
aagcuccgcaggacuu

SEQ ID NO: 2667069 - RNA, 15 nt, Human
aagcuccgcaggacu

SEQ ID NO: 2667070 - RNA, 14 nt, Human
gugugugugugcac

SEQ ID NO: 2667071 - RNA, 13 nt, Human
guguuuauaaaau

SEQ ID NO: 2667072 - RNA, 14 nt, Human
guguuuauaaaaua

SEQ ID NO: 2667073 - RNA, 22 nt, Human
guguuuauaaaauauaaacaaa

SEQ ID NO: 2667074 - RNA, 18 nt, Human
guguuuagaauugaaggu

SEQ ID NO: 2667075 - RNA, 15 nt, Human
guguuuagaauugaa

SEQ ID NO: 2667076 - RNA, 21 nt, Human
guugggggaggggagacuuug

SEQ ID NO: 2667077 - RNA, 23 nt, Human
guugggaaugaggaaaauucuua

SEQ ID NO: 2667078 - RNA, 16 nt, Human
aaggcuaaaacuuaac

SEQ ID NO: 2667079 - RNA, 18 nt, Human
guugcucaaaaaaugagc

SEQ ID NO: 2667080 - RNA, 17 nt, Human
guugcuauuuuuguaaa

SEQ ID NO: 2667081 - RNA, 15 nt, Human
guugcugacuuagaa

SEQ ID NO: 2667082 - RNA, 23 nt, Human
guugcucuaugcuuuccaaaccu

SEQ ID NO: 2667083 - RNA, 13 nt, Human
aaggccucuugua

SEQ ID NO: 2667084 - RNA, 20 nt, Human
aaggccucuuguaaagacug

SEQ ID NO: 2667085 - RNA, 21 nt, Human
aaggccucuuguaaagacugg

SEQ ID NO: 2667086 - RNA, 20 nt, Human
aaggccugguguuucuugau

SEQ ID NO: 2667087 - RNA, 12 nt, Human
aaggcgcugaga

SEQ ID NO: 2667088 - RNA, 17 nt, Human
aaggcgcugagacugug

SEQ ID NO: 2667089 - RNA, 22 nt, Human
aaggauauuuacuacuuuugca

SEQ ID NO: 2667090 - RNA, 14 nt, Human
aaggauaguaagca

SEQ ID NO: 2667091 - RNA, 15 nt, Human
aaggauaguaagcau

SEQ ID NO: 2667092 - RNA, 20 nt, Human
aaggauaguaagcauagaaa

SEQ ID NO: 2667093 - RNA, 20 nt, Human
aaggaggaagagaaaaaaua

SEQ ID NO: 2667094 - RNA, 18 nt, Human
aaggaagguggauggccc

SEQ ID NO: 2667095 - RNA, 19 nt, Human
aaggagagagcaaagggug

SEQ ID NO: 2667096 - RNA, 12 nt, Human
aaggaaggugga

SEQ ID NO: 2667097 - RNA, 17 nt, Human
aaggaagguggauggcc

SEQ ID NO: 2667098 - RNA, 20 nt, Human
aaggaaacaaccaugucauu

SEQ ID NO: 2667099 - RNA, 22 nt, Human
guugaucauguacuuuuuagua

SEQ ID NO: 2667100 - RNA, 14 nt, Human
aagugaagugauac

SEQ ID NO: 2667101 - RNA, 15 nt, Human
aagugaaugcuggga

SEQ ID NO: 2667102 - RNA, 18 nt, Human
guuuuucuaggccugggg

SEQ ID NO: 2667103 - RNA, 12 nt, Human
guuuuucuacua

SEQ ID NO: 2667104 - RNA, 15 nt, Human
aagugagaagauggu

SEQ ID NO: 2667105 - RNA, 19 nt, Human
guuuuuuucuucuguauuu

SEQ ID NO: 2667106 - RNA, 14 nt, Human
guuuuuuuauuucu

SEQ ID NO: 2667107 - RNA, 18 nt, Human
guuuuuuguuuuucugcu

SEQ ID NO: 2667108 - RNA, 17 nt, Human
guuuuuuuguuauuaaa

SEQ ID NO: 2667109 - RNA, 21 nt, Human
guuuuuuaaaauauuuaucug

SEQ ID NO: 2667110 - RNA, 18 nt, Human
guuuuuuaagauagugua

SEQ ID NO: 2667111 - RNA, 19 nt, Human
guuuuuuaagauaguguaa

SEQ ID NO: 2667112 - RNA, 15 nt, Human
guuuuuuccucagug

SEQ ID NO: 2667113 - RNA, 20 nt, Human
guuuuuuccucagugcauuu

SEQ ID NO: 2667114 - RNA, 9 nt, Human
guuuuuugu

SEQ ID NO: 2667115 - RNA, 16 nt, Human
guuuuugucuuaaaaa

SEQ ID NO: 2667116 - RNA, 14 nt, Human
guuuuuguauauug

SEQ ID NO: 2667117 - RNA, 15 nt, Human
guuuuuguuuggaga

SEQ ID NO: 2667118 - RNA, 15 nt, Human
guuuuugcacauguu

SEQ ID NO: 2667119 - RNA, 22 nt, Human
guuuuucugcuuuagacuugaa

SEQ ID NO: 2667120 - RNA, 19 nt, Human
guuuuucugcuuuagacuu

SEQ ID NO: 2667121 - RNA, 18 nt, Human
guuuuucugcuuuagacu

SEQ ID NO: 2667122 - RNA, 16 nt, Human
guuuuucugcuuuaga

SEQ ID NO: 2667123 - RNA, 14 nt, Human
guuuuucugcuuua

SEQ ID NO: 2667124 - RNA, 14 nt, Human
aaguacucuggagc

SEQ ID NO: 2667125 - RNA, 21 nt, Human
aagucacacauuacaaaguua

SEQ ID NO: 2667126 - RNA, 17 nt, Human
aagucauagccauaaau

SEQ ID NO: 2667127 - RNA, 21 nt, Human
aagucaagugaaaaaggagga

SEQ ID NO: 2667128 - RNA, 20 nt, Human
aagucaauauguggaagcaa

SEQ ID NO: 2667129 - RNA, 16 nt, Human
aagggcccagauucua

SEQ ID NO: 2667130 - RNA, 22 nt, Human
aaggcuggcgagagucuggccc

SEQ ID NO: 2667131 - RNA, 16 nt, Human
aaggcugaugucaauu

SEQ ID NO: 2667132 - RNA, 13 nt, Human
aaggcuggcaggu

SEQ ID NO: 2667133 - RNA, 20 nt, Human
aaggcuggcgagagucuggc

SEQ ID NO: 2667134 - RNA, 21 nt, Human
guuguaaaguauguauuauuu

SEQ ID NO: 2667135 - RNA, 18 nt, Human
guuguaaauaauuuauuu

SEQ ID NO: 2667136 - RNA, 16 nt, Human
guuguaaaccaaguga

SEQ ID NO: 2667137 - RNA, 13 nt, Human
aaggguuucucua

SEQ ID NO: 2667138 - RNA, 14 nt, Human
aaggguuucucuau

SEQ ID NO: 2667139 - RNA, 18 nt, Human
aaguaaauacaugcauau

SEQ ID NO: 2667140 - RNA, 22 nt, Human
guuucuggacccuuauaaaauc

SEQ ID NO: 2667141 - RNA, 18 nt, Human
guuucugguggucuguug

SEQ ID NO: 2667142 - RNA, 21 nt, Human
guuucugguggucuguuggca

SEQ ID NO: 2667143 - RNA, 15 nt, Human
guuucuccugagcua

SEQ ID NO: 2667144 - RNA, 18 nt, Human
guuucuccugagcuagga

SEQ ID NO: 2667145 - RNA, 18 nt, Human
guuucuccaaacugaagc

SEQ ID NO: 2667146 - RNA, 22 nt, Human
guuuggcauguaaauguaaacu

SEQ ID NO: 2667147 - RNA, 18 nt, Human
guuuuauagccuggacug

SEQ ID NO: 2667148 - RNA, 15 nt, Human
guuuuauacugaagg

SEQ ID NO: 2667149 - RNA, 21 nt, Human
guuuuauacugaaggaaaaac

SEQ ID NO: 2667150 - RNA, 18 nt, Human
guuuuacugcagcuuugu

SEQ ID NO: 2667151 - RNA, 16 nt, Human
guuuuacugcagcuuu

SEQ ID NO: 2667152 - RNA, 16 nt, Human
guuuuauaauccuuaa

SEQ ID NO: 2667153 - RNA, 15 nt, Human
guuuuacugcagcuu

SEQ ID NO: 2667154 - RNA, 13 nt, Human
guuuuacugucua

SEQ ID NO: 2667155 - RNA, 15 nt, Human
guuuuacugucuauu

SEQ ID NO: 2667156 - RNA, 19 nt, Human
guuuuaaggacugacugag

SEQ ID NO: 2667157 - RNA, 18 nt, Human
guuuuaaggacugacuga

SEQ ID NO: 2667158 - RNA, 17 nt, Human
guggcacuugccugggu

SEQ ID NO: 2667159 - RNA, 14 nt, Human
guggcaccagcagc

SEQ ID NO: 2667160 - RNA, 13 nt, Human
guggcaccagcag

SEQ ID NO: 2667161 - RNA, 19 nt, Human
guggcacuugccuggguca

SEQ ID NO: 2667162 - RNA, 16 nt, Human
guggcaaucugugggc

SEQ ID NO: 2667163 - RNA, 18 nt, Human
guggauuuuguuuaaaaa

SEQ ID NO: 2667164 - RNA, 20 nt, Human
guggacugagugggaagccc

SEQ ID NO: 2667165 - RNA, 17 nt, Human
guggacugagugggaag

SEQ ID NO: 2667166 - RNA, 18 nt, Human
guggacugagugggaagc

SEQ ID NO: 2667167 - RNA, 20 nt, Human
guggacugaccuuguaaaag

SEQ ID NO: 2667168 - RNA, 21 nt, Human
guggacugaccuuguaaaaga

SEQ ID NO: 2667169 - RNA, 15 nt, Human
aagaauguuagagua

SEQ ID NO: 2667170 - RNA, 16 nt, Human
aagaauguuagaguaa

SEQ ID NO: 2667171 - RNA, 20 nt, Human
aagaauguuagaguaaugaa

SEQ ID NO: 2667172 - RNA, 21 nt, Human
aagaauguuagaguaaugaaa

SEQ ID NO: 2667173 - RNA, 20 nt, Human
aagaauauccuuuaaaauuu

SEQ ID NO: 2667174 - RNA, 21 nt, Human
aagaauauccuuuaaaauuua

SEQ ID NO: 2667175 - RNA, 12 nt, Human
aagaauauugca

SEQ ID NO: 2667176 - RNA, 14 nt, Human
aagaauauugcaaa

SEQ ID NO: 2667177 - RNA, 17 nt, Human
aagaauauugcaaaaua

SEQ ID NO: 2667178 - RNA, 19 nt, Human
aagaauauugcaaaauaca

SEQ ID NO: 2667179 - RNA, 23 nt, Human
aagaauauugcaaaauacaugaa

SEQ ID NO: 2667180 - RNA, 19 nt, Human
guggcagcaacggcacagc

SEQ ID NO: 2667181 - RNA, 14 nt, Human
aagaauaugacuuu

SEQ ID NO: 2667182 - RNA, 12 nt, Human
aagaauuugcau

SEQ ID NO: 2667183 - RNA, 13 nt, Human
aagaauuugcaua

SEQ ID NO: 2667184 - RNA, 14 nt, Human
aagaauuugcauac

SEQ ID NO: 2667185 - RNA, 19 nt, Human
aagaauucaaacuggggcc

SEQ ID NO: 2667186 - RNA, 19 nt, Human
aagaauucugauugauuug

SEQ ID NO: 2667187 - RNA, 20 nt, Human
aagaauucugauugauuuga

SEQ ID NO: 2667188 - RNA, 15 nt, Human
aagaauugaaaaguu

SEQ ID NO: 2667189 - RNA, 18 nt, Human
aagaauugaaaaguuuuu

SEQ ID NO: 2667190 - RNA, 19 nt, Human
aagaauugaaaaguuuuug

SEQ ID NO: 2667191 - RNA, 20 nt, Human
aagaauugaaaaguuuuugu

SEQ ID NO: 2667192 - RNA, 20 nt, Human
aagaaguauuuuuagaauaa

SEQ ID NO: 2667193 - RNA, 14 nt, Human
aagaagggagaaga

SEQ ID NO: 2667194 - RNA, 15 nt, Human
aagaagggagaagaa

SEQ ID NO: 2667195 - RNA, 17 nt, Human
aagaagggagaagaaag

SEQ ID NO: 2667196 - RNA, 15 nt, Human
gugcugcugcugcug

SEQ ID NO: 2667197 - RNA, 22 nt, Human
aagaagccuguaacacuccucu

SEQ ID NO: 2667198 - RNA, 18 nt, Human
gugcugggcggcugugcu

SEQ ID NO: 2667199 - RNA, 22 nt, Human
gugcuggagcacugggcucccg

SEQ ID NO: 2667200 - RNA, 16 nt, Human
gugcuggagcacuggg

SEQ ID NO: 2667201 - RNA, 19 nt, Human
gugcuggagcacugggcuc

SEQ ID NO: 2667202 - RNA, 17 nt, Human
gugcuggagcacugggc

SEQ ID NO: 2667203 - RNA, 15 nt, Human
gugcuggcaaccacu

SEQ ID NO: 2667204 - RNA, 17 nt, Human
gugcuggagucuccuga

SEQ ID NO: 2667205 - RNA, 23 nt, Human
gugcuggagucuccugaggacac

SEQ ID NO: 2667206 - RNA, 13 nt, Human
gugcugugaggga

SEQ ID NO: 2667207 - RNA, 14 nt, Human
gugcugugagggag

SEQ ID NO: 2667208 - RNA, 15 nt, Human
gugcugugagggagg

SEQ ID NO: 2667209 - RNA, 16 nt, Human
gugcugugagggaggg

SEQ ID NO: 2667210 - RNA, 12 nt, Human
guggaagcaacc

SEQ ID NO: 2667211 - RNA, 13 nt, Human
guggaagcaacca

SEQ ID NO: 2667212 - RNA, 16 nt, Human
guggaaggcaagccag

SEQ ID NO: 2667213 - RNA, 20 nt, Human
guggaagaagggagaagaaa

SEQ ID NO: 2667214 - RNA, 15 nt, Human
guggaagaagggaga

SEQ ID NO: 2667215 - RNA, 16 nt, Human
guggaagaagggagaa

SEQ ID NO: 2667216 - RNA, 18 nt, Human
guggaagaagggagaaga

SEQ ID NO: 2667217 - RNA, 16 nt, Human
guggacacacacagac

SEQ ID NO: 2667218 - RNA, 17 nt, Human
aacuuguauuaaagaca

SEQ ID NO: 2667219 - RNA, 11 nt, Human
gugccuggggu

SEQ ID NO: 2667220 - RNA, 13 nt, Human
aagaaaagaccuu

SEQ ID NO: 2667221 - RNA, 13 nt, Human
aagaaaagaugaa

SEQ ID NO: 2667222 - RNA, 14 nt, Human
aagaaaagaugaaa

SEQ ID NO: 2667223 - RNA, 13 nt, Human
aagaaaacaucuu

SEQ ID NO: 2667224 - RNA, 17 nt, Human
aagaaaacaucuuuaag

SEQ ID NO: 2667225 - RNA, 16 nt, Human
aagaaaaugaaaugca

SEQ ID NO: 2667226 - RNA, 14 nt, Human
aagaaaauugaguu

SEQ ID NO: 2667227 - RNA, 22 nt, Human
aagaaaguggucuuaagaaaug

SEQ ID NO: 2667228 - RNA, 16 nt, Human
aagaaagucagccaua

SEQ ID NO: 2667229 - RNA, 17 nt, Human
aagaaauaaaccaaagg

SEQ ID NO: 2667230 - RNA, 22 nt, Human
aagaagcaguggccuuauugca

SEQ ID NO: 2667231 - RNA, 15 nt, Human
aagaagcucucuccu

SEQ ID NO: 2667232 - RNA, 14 nt, Human
aagaagcucucucc

SEQ ID NO: 2667233 - RNA, 14 nt, Human
aacuugcuuaaauu

SEQ ID NO: 2667234 - RNA, 15 nt, Human
aacuugcuuaaauuu

SEQ ID NO: 2667235 - RNA, 18 nt, Human
aacuugcuuaaauuucuu

SEQ ID NO: 2667236 - RNA, 19 nt, Human
aacuugcuuaaauuucuua

SEQ ID NO: 2667237 - RNA, 20 nt, Human
aacuugcuuaaauuucuuau

SEQ ID NO: 2667238 - RNA, 21 nt, Human
aacuugcuuaaauuucuuaug

SEQ ID NO: 2667239 - RNA, 18 nt, Human
gugccugagaggcaggca

SEQ ID NO: 2667240 - RNA, 14 nt, Human
gugccugagaggca

SEQ ID NO: 2667241 - RNA, 15 nt, Human
gugccugagaggcag

SEQ ID NO: 2667242 - RNA, 16 nt, Human
gugccugagaggcagg

SEQ ID NO: 2667243 - RNA, 17 nt, Human
gugccugagaggcaggc

SEQ ID NO: 2667244 - RNA, 23 nt, Human
aacugcaggcccuggccuccccu

SEQ ID NO: 2667245 - RNA, 17 nt, Human
aagcaaaucagaaacuu

SEQ ID NO: 2667246 - RNA, 13 nt, Human
aagaugaucauuu

SEQ ID NO: 2667247 - RNA, 17 nt, Human
aagaugacuguguugua

SEQ ID NO: 2667248 - RNA, 18 nt, Human
gugguuauggagagggug

SEQ ID NO: 2667249 - RNA, 20 nt, Human
gugggauuuccagaaccaca

SEQ ID NO: 2667250 - RNA, 14 nt, Human
aagauccagcugcc

SEQ ID NO: 2667251 - RNA, 12 nt, Human
aagaucacuguu

SEQ ID NO: 2667252 - RNA, 20 nt, Human
aagaucacuguuuagauuug

SEQ ID NO: 2667253 - RNA, 14 nt, Human
aagaucacuguuua

SEQ ID NO: 2667254 - RNA, 20 nt, Human
aagcaaguaaaaaggcuaaa

SEQ ID NO: 2667255 - RNA, 19 nt, Human
aagcaaguaaaaaggcuaa

SEQ ID NO: 2667256 - RNA, 18 nt, Human
guguccaugcgcucaggg

SEQ ID NO: 2667257 - RNA, 19 nt, Human
guguccaugcgcucagggc

SEQ ID NO: 2667258 - RNA, 20 nt, Human
guguccaugcgcucagggcc

SEQ ID NO: 2667259 - RNA, 21 nt, Human
guguccaugcgcucagggcca

SEQ ID NO: 2667260 - RNA, 16 nt, Human
gugucuugggcagagc

SEQ ID NO: 2667261 - RNA, 17 nt, Human
gugucuugggcagagcu

SEQ ID NO: 2667262 - RNA, 20 nt, Human
gugucuugggcagagcuggc

SEQ ID NO: 2667263 - RNA, 23 nt, Human
gugucuugggcagagcuggcucu

SEQ ID NO: 2667264 - RNA, 11 nt, Human
guguguaaaca

SEQ ID NO: 2667265 - RNA, 12 nt, Human
guguguaaacaa

SEQ ID NO: 2667266 - RNA, 17 nt, Human
gugugugguagaaacaa

SEQ ID NO: 2667267 - RNA, 15 nt, Human
gugugugugugugca

SEQ ID NO: 2667268 - RNA, 11 nt, Human
aagacuggcuu

SEQ ID NO: 2667269 - RNA, 23 nt, Human
aagacuggcuuuuauuaaugcac

SEQ ID NO: 2667270 - RNA, 15 nt, Human
aagacugguuuucug

SEQ ID NO: 2667271 - RNA, 16 nt, Human
aagacugguuuucugc

SEQ ID NO: 2667272 - RNA, 17 nt, Human
aagacugguuuucugcc

SEQ ID NO: 2667273 - RNA, 20 nt, Human
aagacugguuuucugccaau

SEQ ID NO: 2667274 - RNA, 21 nt, Human
guggccccacccugggcccug

SEQ ID NO: 2667275 - RNA, 23 nt, Human
guggccccacccugggcccuggg

SEQ ID NO: 2667276 - RNA, 16 nt, Human
guggccccguuucugg

SEQ ID NO: 2667277 - RNA, 17 nt, Human
guggccccguuucuggu

SEQ ID NO: 2667278 - RNA, 18 nt, Human
aagagcccuaaguuugua

SEQ ID NO: 2667279 - RNA, 13 nt, Human
aagagcuauugcc

SEQ ID NO: 2667280 - RNA, 20 nt, Human
aagagcuauugccaaccagu

SEQ ID NO: 2667281 - RNA, 19 nt, Human
aagagauugugguuucauu

SEQ ID NO: 2667282 - RNA, 16 nt, Human
aagagauugugguuuc

SEQ ID NO: 2667283 - RNA, 22 nt, Human
aagacuggcuuuuauuaaugca

SEQ ID NO: 2667284 - RNA, 18 nt, Human
gugguggcucacgccugu

SEQ ID NO: 2667285 - RNA, 18 nt, Human
gugguggcccacgccugu

SEQ ID NO: 2667286 - RNA, 18 nt, Human
guggguccugaggccugc

SEQ ID NO: 2667287 - RNA, 15 nt, Human
gugguggaaggguag

SEQ ID NO: 2667288 - RNA, 22 nt, Human
guggccucagcucaaugcaguu

SEQ ID NO: 2667289 - RNA, 23 nt, Human
guggccccguuucugguggucug

SEQ ID NO: 2667290 - RNA, 12 nt, Human
gugggagcugag

SEQ ID NO: 2667291 - RNA, 13 nt, Human
guccuaaugguga

SEQ ID NO: 2667292 - RNA, 14 nt, Human
guccccgcugcugu

SEQ ID NO: 2667293 - RNA, 15 nt, Human
guccccgcugcugug

SEQ ID NO: 2667294 - RNA, 16 nt, Human
guccccgcugcugugc

SEQ ID NO: 2667295 - RNA, 13 nt, Human
guccccgcagccc

SEQ ID NO: 2667296 - RNA, 18 nt, Human
guccaugcuaacaaagac

SEQ ID NO: 2667297 - RNA, 19 nt, Human
guccaugcuaacaaagaca

SEQ ID NO: 2667298 - RNA, 13 nt, Human
guccauucuccca

SEQ ID NO: 2667299 - RNA, 15 nt, Human
guccauucucccagg

SEQ ID NO: 2667300 - RNA, 21 nt, Human
guccccccccaaccuuucccu

SEQ ID NO: 2667301 - RNA, 21 nt, Human
guccuaauggugaugcagucu

SEQ ID NO: 2667302 - RNA, 16 nt, Human
aacagaguaaucuugu

SEQ ID NO: 2667303 - RNA, 12 nt, Human
aacauauaugga

SEQ ID NO: 2667304 - RNA, 17 nt, Human
aacauaugaaaauacaa

SEQ ID NO: 2667305 - RNA, 23 nt, Human
aacauagaaauggaaauuuugcu

SEQ ID NO: 2667306 - RNA, 20 nt, Human
aacauguuaaugacaauauu

SEQ ID NO: 2667307 - RNA, 22 nt, Human
aacauguuaaugacaauauucc

SEQ ID NO: 2667308 - RNA, 13 nt, Human
aacauaacauaaa

SEQ ID NO: 2667309 - RNA, 21 nt, Human
aacauaaauuuuuugaagucu

SEQ ID NO: 2667310 - RNA, 20 nt, Human
aacagugaaguuuuacuguc

SEQ ID NO: 2667311 - RNA, 21 nt, Human
aacagugaaguuuuacugucu

SEQ ID NO: 2667312 - RNA, 16 nt, Human
guccuugauuucaaag

SEQ ID NO: 2667313 - RNA, 19 nt, Human
guccuugauuucaaaguuu

SEQ ID NO: 2667314 - RNA, 21 nt, Human
guccugcucauuaugccacuu

SEQ ID NO: 2667315 - RNA, 15 nt, Human
guccugccuguggcg

SEQ ID NO: 2667316 - RNA, 22 nt, Human
guccugccuguggcgccgucuc

SEQ ID NO: 2667317 - RNA, 22 nt, Human
gucgagaaagaggcaccaggaa

SEQ ID NO: 2667318 - RNA, 19 nt, Human
gucucaaaaaaagaaaaag

SEQ ID NO: 2667319 - RNA, 15 nt, Human
gucuccaggggcugc

SEQ ID NO: 2667320 - RNA, 16 nt, Human
gucuccaggggcugcu

SEQ ID NO: 2667321 - RNA, 19 nt, Human
gucuccaggggcugcuucc

SEQ ID NO: 2667322 - RNA, 20 nt, Human
gucuccaggggcugcuuccu

SEQ ID NO: 2667323 - RNA, 21 nt, Human
gucuccaggggcugcuuccuc

SEQ ID NO: 2667324 - RNA, 22 nt, Human
gucuccaggggcugcuuccucc

SEQ ID NO: 2667325 - RNA, 23 nt, Human
gucuccaggggcugcuuccuccu

SEQ ID NO: 2667326 - RNA, 15 nt, Human
aaccaaaucuggaag

SEQ ID NO: 2667327 - RNA, 15 nt, Human
aaccaaauguuuauu

SEQ ID NO: 2667328 - RNA, 21 nt, Human
aaccaaauguuuauuuucuac

SEQ ID NO: 2667329 - RNA, 12 nt, Human
aaccuuaaguaa

SEQ ID NO: 2667330 - RNA, 13 nt, Human
gucuuuuaaaaug

SEQ ID NO: 2667331 - RNA, 16 nt, Human
gucuucaguaagccgu

SEQ ID NO: 2667332 - RNA, 21 nt, Human
aaccuuugaguagauccauuu

SEQ ID NO: 2667333 - RNA, 11 nt, Human
aaccuuucccu

SEQ ID NO: 2667334 - RNA, 13 nt, Human
aaccuuucccuca

SEQ ID NO: 2667335 - RNA, 14 nt, Human
aaccuuucccucac

SEQ ID NO: 2667336 - RNA, 15 nt, Human
aaccuuucccucacc

SEQ ID NO: 2667337 - RNA, 17 nt, Human
aaccuuucccucacccc

SEQ ID NO: 2667338 - RNA, 18 nt, Human
aaccuuucccucaccccc

SEQ ID NO: 2667339 - RNA, 19 nt, Human
aaccuuucccucacccccu

SEQ ID NO: 2667340 - RNA, 20 nt, Human
aaccuuucccucacccccuc

SEQ ID NO: 2667341 - RNA, 22 nt, Human
aaccuuucccucacccccuccc

SEQ ID NO: 2667342 - RNA, 13 nt, Human
aaccuuguauaaa

SEQ ID NO: 2667343 - RNA, 14 nt, Human
aaccuuguauaaau

SEQ ID NO: 2667344 - RNA, 16 nt, Human
aaccuuguauaaauua

SEQ ID NO: 2667345 - RNA, 19 nt, Human
aaccuuguauaaauuauuc

SEQ ID NO: 2667346 - RNA, 13 nt, Human
gucugguggcccc

SEQ ID NO: 2667347 - RNA, 20 nt, Human
gucugguggccccguuucug

SEQ ID NO: 2667348 - RNA, 19 nt, Human
aaccaucuugugucuuugg

SEQ ID NO: 2667349 - RNA, 22 nt, Human
gucucuuuaaaaggaaagaaaa

SEQ ID NO: 2667350 - RNA, 14 nt, Human
aacugcaggcccug

SEQ ID NO: 2667351 - RNA, 16 nt, Human
aacugcaggcccuggc

SEQ ID NO: 2667352 - RNA, 17 nt, Human
aacugcaggcccuggcc

SEQ ID NO: 2667353 - RNA, 18 nt, Human
aacugcaggcccuggccu

SEQ ID NO: 2667354 - RNA, 19 nt, Human
aacugcaggcccuggccuc

SEQ ID NO: 2667355 - RNA, 20 nt, Human
aacugcaggcccuggccucc

SEQ ID NO: 2667356 - RNA, 21 nt, Human
aacugcaggcccuggccuccc

SEQ ID NO: 2667357 - RNA, 13 nt, Human
aacugcaggcccu

SEQ ID NO: 2667358 - RNA, 16 nt, Human
aacugaaaugccugcu

SEQ ID NO: 2667359 - RNA, 15 nt, Human
gugaguccauucucc

SEQ ID NO: 2667360 - RNA, 15 nt, Human
aacucugcauguaga

SEQ ID NO: 2667361 - RNA, 15 nt, Human
aacucuggcuuuugg

SEQ ID NO: 2667362 - RNA, 21 nt, Human
gugagaagugaaugcugggac

SEQ ID NO: 2667363 - RNA, 22 nt, Human
gugagaagugaaugcugggacu

SEQ ID NO: 2667364 - RNA, 20 nt, Human
gugagaagugaaugcuggga

SEQ ID NO: 2667365 - RNA, 17 nt, Human
gugagaagguuuauugu

SEQ ID NO: 2667366 - RNA, 20 nt, Human
gugagaagguuuauuguuaa

SEQ ID NO: 2667367 - RNA, 13 nt, Human
gugaagugcuugg

SEQ ID NO: 2667368 - RNA, 17 nt, Human
gugagaacccaguuucc

SEQ ID NO: 2667369 - RNA, 19 nt, Human
gugagaaacaucucaauaa

SEQ ID NO: 2667370 - RNA, 13 nt, Human
gugaagaagccug

SEQ ID NO: 2667371 - RNA, 17 nt, Human
aacuauauuuugucaua

SEQ ID NO: 2667372 - RNA, 16 nt, Human
aacuauauuuugucau

SEQ ID NO: 2667373 - RNA, 20 nt, Human
gugaagauacuuuguauugu

SEQ ID NO: 2667374 - RNA, 18 nt, Human
gugaagauacuuuguauu

SEQ ID NO: 2667375 - RNA, 15 nt, Human
gugaagauacuuugu

SEQ ID NO: 2667376 - RNA, 13 nt, Human
gugaagauacuuu

SEQ ID NO: 2667377 - RNA, 15 nt, Human
gugacauggugccug

SEQ ID NO: 2667378 - RNA, 16 nt, Human
gugacauggugccuga

SEQ ID NO: 2667379 - RNA, 19 nt, Human
gugacauggugccugagag

SEQ ID NO: 2667380 - RNA, 20 nt, Human
gugacauggugccugagagg

SEQ ID NO: 2667381 - RNA, 22 nt, Human
gugacauggugccugagaggca

SEQ ID NO: 2667382 - RNA, 23 nt, Human
gugacauggugccugagaggcag

SEQ ID NO: 2667383 - RNA, 24 nt, Human
gugacauggugccugagaggcagg

SEQ ID NO: 2667384 - RNA, 18 nt, Human
gugaccauguuuuguuua

SEQ ID NO: 2667385 - RNA, 17 nt, Human
uaaucuuguuucugaaa

SEQ ID NO: 2667386 - RNA, 13 nt, Human
uaaugaaauggag

SEQ ID NO: 2667387 - RNA, 15 nt, Human
uaaugaaauggagga

SEQ ID NO: 2667388 - RNA, 19 nt, Human
aaugaauaucuauuaauau

SEQ ID NO: 2667389 - RNA, 18 nt, Human
aaugaauaucuauuaaua

SEQ ID NO: 2667390 - RNA, 15 nt, Human
aaugaauaucuauua

SEQ ID NO: 2667391 - RNA, 14 nt, Human
aaugaauaucuauu

SEQ ID NO: 2667392 - RNA, 13 nt, Human
aaucuuuugaagc

SEQ ID NO: 2667393 - RNA, 21 nt, Human
aaugaaaaauagugucuuugu

SEQ ID NO: 2667394 - RNA, 14 nt, Human
aaugaaaaaagcuu

SEQ ID NO: 2667395 - RNA, 13 nt, Human
uaaucauuuguuu

SEQ ID NO: 2667396 - RNA, 14 nt, Human
uaaucauuuguuua

SEQ ID NO: 2667397 - RNA, 19 nt, Human
uaaucauuuguuuacauuu

SEQ ID NO: 2667398 - RNA, 21 nt, Human
uaaucauuuguuuacauuuga

SEQ ID NO: 2667399 - RNA, 12 nt, Human
uaaucauuuuca

SEQ ID NO: 2667400 - RNA, 13 nt, Human
uaaucauuuucau

SEQ ID NO: 2667401 - RNA, 14 nt, Human
uaaucauuuucauu

SEQ ID NO: 2667402 - RNA, 17 nt, Human
uaaucauuuucauuccu

SEQ ID NO: 2667403 - RNA, 18 nt, Human
uaaucauuuucauuccua

SEQ ID NO: 2667404 - RNA, 19 nt, Human
uaauccaauggguuuuucc

SEQ ID NO: 2667405 - RNA, 20 nt, Human
uaauauucaggguaaauagg

SEQ ID NO: 2667406 - RNA, 21 nt, Human
uaauauucaggguaaauagga

SEQ ID NO: 2667407 - RNA, 19 nt, Human
uaauauugagaaagaaacu

SEQ ID NO: 2667408 - RNA, 14 nt, Human
uaauauugagaaag

SEQ ID NO: 2667409 - RNA, 20 nt, Human
uaauauuguuugguaaaugu

SEQ ID NO: 2667410 - RNA, 21 nt, Human
uaauauuguuugguaaauguu

SEQ ID NO: 2667411 - RNA, 20 nt, Human
aauacaguaucucagggccu

SEQ ID NO: 2667412 - RNA, 14 nt, Human
aauacauagugaaa

SEQ ID NO: 2667413 - RNA, 16 nt, Human
aauacauagugaaaau

SEQ ID NO: 2667414 - RNA, 15 nt, Human
uaauagaaaugucuc

SEQ ID NO: 2667415 - RNA, 18 nt, Human
aauacauauggauguuac

SEQ ID NO: 2667416 - RNA, 20 nt, Human
aaugaauaucuauuaauaua

SEQ ID NO: 2667417 - RNA, 19 nt, Human
uaaucuuuaccuguauaca

SEQ ID NO: 2667418 - RNA, 13 nt, Human
aaugcaaacuggg

SEQ ID NO: 2667419 - RNA, 21 nt, Human
aaugcaaacugggaugaaacu

SEQ ID NO: 2667420 - RNA, 14 nt, Human
uaauuauauaacug

SEQ ID NO: 2667421 - RNA, 16 nt, Human
uaauuauauaacugua

SEQ ID NO: 2667422 - RNA, 17 nt, Human
uaauuauauaacuguau

SEQ ID NO: 2667423 - RNA, 20 nt, Human
uaauuauauaacuguauuug

SEQ ID NO: 2667424 - RNA, 23 nt, Human
uaauuaguuccucauuagcauuu

SEQ ID NO: 2667425 - RNA, 21 nt, Human
aaugcaauguaagcauacuuu

SEQ ID NO: 2667426 - RNA, 13 nt, Human
uacaaaaagaaaa

SEQ ID NO: 2667427 - RNA, 18 nt, Human
uacaagucagcuccagcu

SEQ ID NO: 2667428 - RNA, 14 nt, Human
uacaagucaguagg

SEQ ID NO: 2667429 - RNA, 16 nt, Human
uacaaguuuauauaua

SEQ ID NO: 2667430 - RNA, 17 nt, Human
uacaaguuuauauauau

SEQ ID NO: 2667431 - RNA, 13 nt, Human
uaauuugaagauu

SEQ ID NO: 2667432 - RNA, 14 nt, Human
uaauuugaagauug

SEQ ID NO: 2667433 - RNA, 17 nt, Human
uaauuugaugagguauu

SEQ ID NO: 2667434 - RNA, 20 nt, Human
uaauuugaugagguauuuuu

SEQ ID NO: 2667435 - RNA, 19 nt, Human
uaauuucuccucccuuccu

SEQ ID NO: 2667436 - RNA, 17 nt, Human
uaauuucuuuuuuuccu

SEQ ID NO: 2667437 - RNA, 15 nt, Human
uaauuuaaguuuuga

SEQ ID NO: 2667438 - RNA, 14 nt, Human
uaauuuaaguuuug

SEQ ID NO: 2667439 - RNA, 10 nt, Human
uaauuuccuu

SEQ ID NO: 2667440 - RNA, 20 nt, Human
uaauuuaaguuuugacaagc

SEQ ID NO: 2667441 - RNA, 13 nt, Human
uaauuucuccucc

SEQ ID NO: 2667442 - RNA, 14 nt, Human
uaauuucuccuccc

SEQ ID NO: 2667443 - RNA, 20 nt, Human
uaauuucuagaaacaaacau

SEQ ID NO: 2667444 - RNA, 11 nt, Human
uaauuuccuuu

SEQ ID NO: 2667445 - RNA, 13 nt, Human
uaauuuccuuuuu

SEQ ID NO: 2667446 - RNA, 17 nt, Human
uaauuuccuuuuugaca

SEQ ID NO: 2667447 - RNA, 19 nt, Human
uaauuuccuuuuugacacu

SEQ ID NO: 2667448 - RNA, 20 nt, Human
uaauuuccuuuuugacacug

SEQ ID NO: 2667449 - RNA, 21 nt, Human
uaauuuccuuuuugacacuga

SEQ ID NO: 2667450 - RNA, 22 nt, Human
uaauuuccuuuuugacacugaa

SEQ ID NO: 2667451 - RNA, 15 nt, Human
uacaaugaacacuua

SEQ ID NO: 2667452 - RNA, 17 nt, Human
uacaaucucuuuuuguu

SEQ ID NO: 2667453 - RNA, 20 nt, Human
uacaaucaaaggaaaauagu

SEQ ID NO: 2667454 - RNA, 14 nt, Human
uacaauauugauug

SEQ ID NO: 2667455 - RNA, 15 nt, Human
uacaauauugauugg

SEQ ID NO: 2667456 - RNA, 19 nt, Human
uacaauauugauugggaaa

SEQ ID NO: 2667457 - RNA, 23 nt, Human
uacaauauugauugggaaaacau

SEQ ID NO: 2667458 - RNA, 23 nt, Human
uacaccuggcugagguuccucug

SEQ ID NO: 2667459 - RNA, 14 nt, Human
uacaccuugccuug

SEQ ID NO: 2667460 - RNA, 20 nt, Human
uacaccuugccuugcuguuu

SEQ ID NO: 2667461 - RNA, 18 nt, Human
uacacgaauagacaucaa

SEQ ID NO: 2667462 - RNA, 19 nt, Human
uacacgaauagacaucaaa

SEQ ID NO: 2667463 - RNA, 21 nt, Human
uacacgaauagacaucaaacu

SEQ ID NO: 2667464 - RNA, 21 nt, Human
uacacgaccauuugauaggga

SEQ ID NO: 2667465 - RNA, 12 nt, Human
uacaccuggcug

SEQ ID NO: 2667466 - RNA, 13 nt, Human
uacaccuggcuga

SEQ ID NO: 2667467 - RNA, 14 nt, Human
uacaccuggcugag

SEQ ID NO: 2667468 - RNA, 15 nt, Human
uacaccuggcugagg

SEQ ID NO: 2667469 - RNA, 22 nt, Human
uacaccuggcugagguuccucu

SEQ ID NO: 2667470 - RNA, 16 nt, Human
aauguaagcauacuuu

SEQ ID NO: 2667471 - RNA, 16 nt, Human
aauguacaguugaaau

SEQ ID NO: 2667472 - RNA, 17 nt, Human
aauguacaguugaaaua

SEQ ID NO: 2667473 - RNA, 16 nt, Human
aauguagguccucaga

SEQ ID NO: 2667474 - RNA, 18 nt, Human
aauguagguccucagaaa

SEQ ID NO: 2667475 - RNA, 22 nt, Human
aauguaggcuuaguuugugugu

SEQ ID NO: 2667476 - RNA, 16 nt, Human
aauguaggcuuaguuu

SEQ ID NO: 2667477 - RNA, 19 nt, Human
aauguaggcuuaguuugug

SEQ ID NO: 2667478 - RNA, 23 nt, Human
aauguagcgacugucaacagcgu

SEQ ID NO: 2667479 - RNA, 19 nt, Human
uacaguccaaaauacuguu

SEQ ID NO: 2667480 - RNA, 15 nt, Human
uacauacgauuuaag

SEQ ID NO: 2667481 - RNA, 16 nt, Human
uacauacgauuuaagg

SEQ ID NO: 2667482 - RNA, 17 nt, Human
uacauacgauuuaaggu

SEQ ID NO: 2667483 - RNA, 19 nt, Human
uacauacgauuuaagguau

SEQ ID NO: 2667484 - RNA, 14 nt, Human
aauguauuuuuccu

SEQ ID NO: 2667485 - RNA, 23 nt, Human
aaugucaaaaguagaacuuugua

SEQ ID NO: 2667486 - RNA, 19 nt, Human
aaugucaaaaguagaacuu

SEQ ID NO: 2667487 - RNA, 15 nt, Human
aaugucaaaaguaga

SEQ ID NO: 2667488 - RNA, 14 nt, Human
aaugucaaaaguag

SEQ ID NO: 2667489 - RNA, 18 nt, Human
uacaguaucucagggccu

SEQ ID NO: 2667490 - RNA, 21 nt, Human
uacagugcagagccuucucag

SEQ ID NO: 2667491 - RNA, 22 nt, Human
uacagugcagagccuucucaga

SEQ ID NO: 2667492 - RNA, 11 nt, Human
uacagugguuu

SEQ ID NO: 2667493 - RNA, 20 nt, Human
uacauaauacugaaccacuu

SEQ ID NO: 2667494 - RNA, 23 nt, Human
uacauaauacugaaccacuugua

SEQ ID NO: 2667495 - RNA, 18 nt, Human
aaugugaauuuuuauugu

SEQ ID NO: 2667496 - RNA, 20 nt, Human
aaugugaauuuuuauuguug

SEQ ID NO: 2667497 - RNA, 15 nt, Human
uacauuguauauaug

SEQ ID NO: 2667498 - RNA, 15 nt, Human
uacauguuuauaaau

SEQ ID NO: 2667499 - RNA, 17 nt, Human
uacauguuuauaaaucu

SEQ ID NO: 2667500 - RNA, 20 nt, Human
aauuaagguguuugaaaaua

SEQ ID NO: 2667501 - RNA, 13 nt, Human
uacauguaauuug

SEQ ID NO: 2667502 - RNA, 14 nt, Human
uacauguaauuuga

SEQ ID NO: 2667503 - RNA, 13 nt, Human
aauuaagcaaaug

SEQ ID NO: 2667504 - RNA, 15 nt, Human
aauuaagcaaauguu

SEQ ID NO: 2667505 - RNA, 18 nt, Human
aauuaagcaaauguuaaa

SEQ ID NO: 2667506 - RNA, 22 nt, Human
aauuaagcaaauguuaaaaguu

SEQ ID NO: 2667507 - RNA, 23 nt, Human
aauuaagcaaauguuaaaaguuu

SEQ ID NO: 2667508 - RNA, 19 nt, Human
aauuaagcccuaagguccu

SEQ ID NO: 2667509 - RNA, 22 nt, Human
aauuaagcccuaagguccuaag

SEQ ID NO: 2667510 - RNA, 13 nt, Human
aauuaagguguuu

SEQ ID NO: 2667511 - RNA, 18 nt, Human
aauuaagguguuugaaaa

SEQ ID NO: 2667512 - RNA, 17 nt, Human
aauuaagguguuugaaa

SEQ ID NO: 2667513 - RNA, 16 nt, Human
aauuaagguguuugaa

SEQ ID NO: 2667514 - RNA, 15 nt, Human
aauuaagguguuuga

SEQ ID NO: 2667515 - RNA, 17 nt, Human
uaccccgcagacaccuu

SEQ ID NO: 2667516 - RNA, 11 nt, Human
uacauuuaaua

SEQ ID NO: 2667517 - RNA, 17 nt, Human
uaccauccccuguagag

SEQ ID NO: 2667518 - RNA, 12 nt, Human
uacugaauuuuu

SEQ ID NO: 2667519 - RNA, 16 nt, Human
uacugaauuuuuuugu

SEQ ID NO: 2667520 - RNA, 18 nt, Human
uacugaauuuuuuuguaa

SEQ ID NO: 2667521 - RNA, 19 nt, Human
uacugaauuuuuuuguaau

SEQ ID NO: 2667522 - RNA, 19 nt, Human
uacuggugcagucauuaug

SEQ ID NO: 2667523 - RNA, 13 nt, Human
uacugguugcaug

SEQ ID NO: 2667524 - RNA, 14 nt, Human
uacugguugcaugg

SEQ ID NO: 2667525 - RNA, 18 nt, Human
uacugguugcauggaaau

SEQ ID NO: 2667526 - RNA, 20 nt, Human
uacugguugcauggaaauca

SEQ ID NO: 2667527 - RNA, 19 nt, Human
uacucaagcggguggcucu

SEQ ID NO: 2667528 - RNA, 12 nt, Human
uacugaaggaaa

SEQ ID NO: 2667529 - RNA, 13 nt, Human
uacugaaggaaaa

SEQ ID NO: 2667530 - RNA, 14 nt, Human
uacugaaggaaaaa

SEQ ID NO: 2667531 - RNA, 18 nt, Human
uacugaaggaaaaacaca

SEQ ID NO: 2667532 - RNA, 19 nt, Human
uacugaaggaaaaacacaa

SEQ ID NO: 2667533 - RNA, 20 nt, Human
uacugaaggaaaaacacaag

SEQ ID NO: 2667534 - RNA, 23 nt, Human
uacugaaggaaaaacacaagcaa

SEQ ID NO: 2667535 - RNA, 23 nt, Human
uacugaaccacuuguagauuuga

SEQ ID NO: 2667536 - RNA, 22 nt, Human
uacugaaccacuuguagauuug

SEQ ID NO: 2667537 - RNA, 19 nt, Human
uacugaaccacuuguagau

SEQ ID NO: 2667538 - RNA, 17 nt, Human
uacugaaccacuuguag

SEQ ID NO: 2667539 - RNA, 16 nt, Human
uacugaaccacuugua

SEQ ID NO: 2667540 - RNA, 12 nt, Human
uacguaguucua

SEQ ID NO: 2667541 - RNA, 18 nt, Human
uacgugcucugugggucu

SEQ ID NO: 2667542 - RNA, 21 nt, Human
uacuagucaccagagacuuua

SEQ ID NO: 2667543 - RNA, 20 nt, Human
uacuagucaccagagacuuu

SEQ ID NO: 2667544 - RNA, 22 nt, Human
uacuauucaguggcgagaaaua

SEQ ID NO: 2667545 - RNA, 19 nt, Human
uacuauucagguaacacua

SEQ ID NO: 2667546 - RNA, 22 nt, Human
uacuagucaccagagacuuuag

SEQ ID NO: 2667547 - RNA, 21 nt, Human
aauugaagguuuuugauagca

SEQ ID NO: 2667548 - RNA, 17 nt, Human
aauugaaguguauaaua

SEQ ID NO: 2667549 - RNA, 20 nt, Human
aauugaaguguauaauauaa

SEQ ID NO: 2667550 - RNA, 21 nt, Human
aauugaaguguauaauauaaa

SEQ ID NO: 2667551 - RNA, 19 nt, Human
aauugaagguuuuugauag

SEQ ID NO: 2667552 - RNA, 18 nt, Human
aauugaagguuuuugaua

SEQ ID NO: 2667553 - RNA, 16 nt, Human
aauugaagguuuuuga

SEQ ID NO: 2667554 - RNA, 23 nt, Human
aauucuuuuuuauuaaucacugu

SEQ ID NO: 2667555 - RNA, 22 nt, Human
aauucuuuuuuauuaaucacug

SEQ ID NO: 2667556 - RNA, 21 nt, Human
aauucuuuuuuauuaaucacu

SEQ ID NO: 2667557 - RNA, 18 nt, Human
aauucuuuuuuauuaauc

SEQ ID NO: 2667558 - RNA, 17 nt, Human
aauucuuuuuuauuaau

SEQ ID NO: 2667559 - RNA, 16 nt, Human
aauucuuuuuuauuaa

SEQ ID NO: 2667560 - RNA, 14 nt, Human
aauucuuuuuuauu

SEQ ID NO: 2667561 - RNA, 13 nt, Human
aauucuuuuuuau

SEQ ID NO: 2667562 - RNA, 16 nt, Human
aauucuuaaguauguu

SEQ ID NO: 2667563 - RNA, 11 nt, Human
uacccugggug

SEQ ID NO: 2667564 - RNA, 12 nt, Human
uacccugggugu

SEQ ID NO: 2667565 - RNA, 21 nt, Human
uacccuggguguccccgcugc

SEQ ID NO: 2667566 - RNA, 15 nt, Human
uacccuuuucugggg

SEQ ID NO: 2667567 - RNA, 14 nt, Human
aauuguuucagaau

SEQ ID NO: 2667568 - RNA, 15 nt, Human
aauugugugaacuug

SEQ ID NO: 2667569 - RNA, 18 nt, Human
aauugugugaacuuggaa

SEQ ID NO: 2667570 - RNA, 14 nt, Human
aauuuaaaaaauaa

SEQ ID NO: 2667571 - RNA, 13 nt, Human
aauuguuuaaaaa

SEQ ID NO: 2667572 - RNA, 18 nt, Human
aauuuaaaaaauaaauaa

SEQ ID NO: 2667573 - RNA, 14 nt, Human
aauuuaaaaauaua

SEQ ID NO: 2667574 - RNA, 15 nt, Human
aauuuaaaaauauau

SEQ ID NO: 2667575 - RNA, 17 nt, Human
aauuuaaaaauauauuu

SEQ ID NO: 2667576 - RNA, 20 nt, Human
aauuuaaagaaaaaaauguc

SEQ ID NO: 2667577 - RNA, 19 nt, Human
aauuuaaaauaauuauaua

SEQ ID NO: 2667578 - RNA, 12 nt, Human
aauuuaaguuuu

SEQ ID NO: 2667579 - RNA, 17 nt, Human
aauuuaaguuuugacaa

SEQ ID NO: 2667580 - RNA, 15 nt, Human
aauuuaaguuuugac

SEQ ID NO: 2667581 - RNA, 24 nt, Human
aauuuaaguuuugacaagcuggcu

SEQ ID NO: 2667582 - RNA, 20 nt, Human
aauuuaauaccagauaccuu

SEQ ID NO: 2667583 - RNA, 23 nt, Human
aauuuaaguuuugacaagcuggc

SEQ ID NO: 2667584 - RNA, 20 nt, Human
aauuuaaguuuugacaagcu

SEQ ID NO: 2667585 - RNA, 12 nt, Human
aauuucuccucc

SEQ ID NO: 2667586 - RNA, 14 nt, Human
aauuucuccucccu

SEQ ID NO: 2667587 - RNA, 20 nt, Human
aauuucuccucccuuccuuu

SEQ ID NO: 2667588 - RNA, 14 nt, Human
aauuugaaguaaug

SEQ ID NO: 2667589 - RNA, 16 nt, Human
aauuugacuaauuuua

SEQ ID NO: 2667590 - RNA, 17 nt, Human
aauuugacuaauuuuac

SEQ ID NO: 2667591 - RNA, 12 nt, Human
aauuucugugcc

SEQ ID NO: 2667592 - RNA, 20 nt, Human
aauuucugugcccuccugac

SEQ ID NO: 2667593 - RNA, 19 nt, Human
aauuucugugcccuccuga

SEQ ID NO: 2667594 - RNA, 21 nt, Human
aauuucuguguugccaagcuc

SEQ ID NO: 2667595 - RNA, 12 nt, Human
aauuuuuguauu

SEQ ID NO: 2667596 - RNA, 17 nt, Human
aauuuuuguauuauuuu

SEQ ID NO: 2667597 - RNA, 14 nt, Human
aauuuuuuuguaug

SEQ ID NO: 2667598 - RNA, 15 nt, Human
aauuuuuuuguaaua

SEQ ID NO: 2667599 - RNA, 16 nt, Human
aauuuuuuuguaauaa

SEQ ID NO: 2667600 - RNA, 16 nt, Human
uagacagguccugauu

SEQ ID NO: 2667601 - RNA, 15 nt, Human
aauuuuaaaaaucua

SEQ ID NO: 2667602 - RNA, 15 nt, Human
aauuuuaaaaucuga

SEQ ID NO: 2667603 - RNA, 22 nt, Human
aauuuuaaaaucugagggaaau

SEQ ID NO: 2667604 - RNA, 13 nt, Human
aauuuuaaagugc

SEQ ID NO: 2667605 - RNA, 16 nt, Human
aauuuuaaagugcaaa

SEQ ID NO: 2667606 - RNA, 17 nt, Human
aauuuuaaagugcaaaa

SEQ ID NO: 2667607 - RNA, 12 nt, Human
aauuuuuauugu

SEQ ID NO: 2667608 - RNA, 13 nt, Human
aauuuuuauuguu

SEQ ID NO: 2667609 - RNA, 19 nt, Human
uagaauugaagguuuuuga

SEQ ID NO: 2667610 - RNA, 23 nt, Human
uagaauugaagguuuuugauagc

SEQ ID NO: 2667611 - RNA, 21 nt, Human
uagaauugaagguuuuugaua

SEQ ID NO: 2667612 - RNA, 20 nt, Human
uagaauugaagguuuuugau

SEQ ID NO: 2667613 - RNA, 16 nt, Human
uagaagccaagggaaa

SEQ ID NO: 2667614 - RNA, 19 nt, Human
uagaagccaagggaaaggg

SEQ ID NO: 2667615 - RNA, 19 nt, Human
uagacagcuuuucucaacu

SEQ ID NO: 2667616 - RNA, 23 nt, Human
uagacagcuuuucucaacugggu

SEQ ID NO: 2667617 - RNA, 20 nt, Human
uagacagccaaaggcuggcg

SEQ ID NO: 2667618 - RNA, 18 nt, Human
uagacagccaaaggcugg

SEQ ID NO: 2667619 - RNA, 16 nt, Human
uagaacuccaggcccu

SEQ ID NO: 2667620 - RNA, 19 nt, Human
uagaacuccaggcccuccu

SEQ ID NO: 2667621 - RNA, 14 nt, Human
uagaagagagaggu

SEQ ID NO: 2667622 - RNA, 22 nt, Human
uagaagagagagguugaaaaac

SEQ ID NO: 2667623 - RNA, 21 nt, Human
uagaagcacuacaccuugccu

SEQ ID NO: 2667624 - RNA, 22 nt, Human
uagaagcacuacaccuugccuu

SEQ ID NO: 2667625 - RNA, 12 nt, Human
uagaagccaagg

SEQ ID NO: 2667626 - RNA, 15 nt, Human
uagaagccaagggaa

SEQ ID NO: 2667627 - RNA, 15 nt, Human
uagaacugucuguga

SEQ ID NO: 2667628 - RNA, 16 nt, Human
uagaacugucugugaa

SEQ ID NO: 2667629 - RNA, 22 nt, Human
uagcauuguaagcguauggcuu

SEQ ID NO: 2667630 - RNA, 14 nt, Human
acaaauuauuuuug

SEQ ID NO: 2667631 - RNA, 22 nt, Human
uagcauguuuauaucugcaaaa

SEQ ID NO: 2667632 - RNA, 19 nt, Human
acaagaacacacacauaua

SEQ ID NO: 2667633 - RNA, 18 nt, Human
acaacaauugguaaaacu

SEQ ID NO: 2667634 - RNA, 19 nt, Human
acaacaauugguaaaacuc

SEQ ID NO: 2667635 - RNA, 16 nt, Human
acaagcaaguucugag

SEQ ID NO: 2667636 - RNA, 13 nt, Human
acaagcugcaccc

SEQ ID NO: 2667637 - RNA, 12 nt, Human
uagcacagcagc

SEQ ID NO: 2667638 - RNA, 22 nt, Human
uagauuuuagacccuauugcug

SEQ ID NO: 2667639 - RNA, 19 nt, Human
uagaucauaguuuuauuua

SEQ ID NO: 2667640 - RNA, 17 nt, Human
uagaucauaguuuuauu

SEQ ID NO: 2667641 - RNA, 13 nt, Human
uagauuuuccaaa

SEQ ID NO: 2667642 - RNA, 12 nt, Human
uagauuuuccaa

SEQ ID NO: 2667643 - RNA, 13 nt, Human
uagaucauaguuu

SEQ ID NO: 2667644 - RNA, 13 nt, Human
uagauauuuuuca

SEQ ID NO: 2667645 - RNA, 15 nt, Human
uagauauuuuucaua

SEQ ID NO: 2667646 - RNA, 20 nt, Human
uagauauuuuucauaaacaa

SEQ ID NO: 2667647 - RNA, 21 nt, Human
uagauauuuuucauaaacaag

SEQ ID NO: 2667648 - RNA, 17 nt, Human
uagagcuuucaaguaca

SEQ ID NO: 2667649 - RNA, 13 nt, Human
uagagccagcuug

SEQ ID NO: 2667650 - RNA, 11 nt, Human
acaaaaaccaa

SEQ ID NO: 2667651 - RNA, 18 nt, Human
acaaaaaccaaauguuua

SEQ ID NO: 2667652 - RNA, 20 nt, Human
acaaaaaccaaauguuuauu

SEQ ID NO: 2667653 - RNA, 16 nt, Human
acaaaaagcauaaaaa

SEQ ID NO: 2667654 - RNA, 16 nt, Human
uauuucacuugaugau

SEQ ID NO: 2667655 - RNA, 21 nt, Human
uauuuauuuuccuaaagagag

SEQ ID NO: 2667656 - RNA, 20 nt, Human
uauuucaaaauauacauuca

SEQ ID NO: 2667657 - RNA, 22 nt, Human
uauuuauuuuuuuuaauuguau

SEQ ID NO: 2667658 - RNA, 20 nt, Human
uauuuauuuuuuuuaauugu

SEQ ID NO: 2667659 - RNA, 16 nt, Human
uauuuauuuuccuaaa

SEQ ID NO: 2667660 - RNA, 20 nt, Human
uauuuauuuuccuaaagaga

SEQ ID NO: 2667661 - RNA, 11 nt, Human
uauuuauuuac

SEQ ID NO: 2667662 - RNA, 13 nt, Human
uauuuauuuaugu

SEQ ID NO: 2667663 - RNA, 14 nt, Human
uauuuauuuaugua

SEQ ID NO: 2667664 - RNA, 18 nt, Human
uauuuauuuauguacuuu

SEQ ID NO: 2667665 - RNA, 11 nt, Human
uauuuauuuau

SEQ ID NO: 2667666 - RNA, 17 nt, Human
uauuuaauggaagugua

SEQ ID NO: 2667667 - RNA, 20 nt, Human
uauuuaauggaaguguauuu

SEQ ID NO: 2667668 - RNA, 14 nt, Human
uauuuacauuuaau

SEQ ID NO: 2667669 - RNA, 13 nt, Human
uauuuagacaaga

SEQ ID NO: 2667670 - RNA, 15 nt, Human
uauuuagacaagaga

SEQ ID NO: 2667671 - RNA, 19 nt, Human
uauuuagacaagagauggg

SEQ ID NO: 2667672 - RNA, 20 nt, Human
uauuuagacaagagauggga

SEQ ID NO: 2667673 - RNA, 15 nt, Human
uauuuaacauuauuu

SEQ ID NO: 2667674 - RNA, 14 nt, Human
uauuuaagacuaaa

SEQ ID NO: 2667675 - RNA, 19 nt, Human
uauuuaacagaaauuguau

SEQ ID NO: 2667676 - RNA, 16 nt, Human
uauuuaacagaaauug

SEQ ID NO: 2667677 - RNA, 22 nt, Human
uauuguccuauuaguguuauau

SEQ ID NO: 2667678 - RNA, 18 nt, Human
uauuguccuauuaguguu

SEQ ID NO: 2667679 - RNA, 17 nt, Human
uauuguccuauuagugu

SEQ ID NO: 2667680 - RNA, 13 nt, Human
uauuuaagaugug

SEQ ID NO: 2667681 - RNA, 14 nt, Human
uauuuaagauguga

SEQ ID NO: 2667682 - RNA, 16 nt, Human
uauuuaagaugugaaa

SEQ ID NO: 2667683 - RNA, 18 nt, Human
uauuuaagaugugaaaau

SEQ ID NO: 2667684 - RNA, 14 nt, Human
uauuuaauauuuaa

SEQ ID NO: 2667685 - RNA, 19 nt, Human
uauuguauauuacaaugau

SEQ ID NO: 2667686 - RNA, 17 nt, Human
uauuguauauuacaaug

SEQ ID NO: 2667687 - RNA, 16 nt, Human
uauuguauauuacaau

SEQ ID NO: 2667688 - RNA, 15 nt, Human
uauuguauuuaugug

SEQ ID NO: 2667689 - RNA, 14 nt, Human
uauugacucugggu

SEQ ID NO: 2667690 - RNA, 14 nt, Human
uauugaauguuaaa

SEQ ID NO: 2667691 - RNA, 14 nt, Human
uauugaccauuuuu

SEQ ID NO: 2667692 - RNA, 22 nt, Human
uauugacucuggguccuuccug

SEQ ID NO: 2667693 - RNA, 20 nt, Human
uauugacucuggguccuucc

SEQ ID NO: 2667694 - RNA, 15 nt, Human
uauugacucuggguc

SEQ ID NO: 2667695 - RNA, 17 nt, Human
uauugaggccaagaaua

SEQ ID NO: 2667696 - RNA, 18 nt, Human
uauugaggccaagaauau

SEQ ID NO: 2667697 - RNA, 19 nt, Human
uauugaggccaagaauauu

SEQ ID NO: 2667698 - RNA, 21 nt, Human
uauugaggccaagaauauugc

SEQ ID NO: 2667699 - RNA, 22 nt, Human
uauugaggccaagaauauugca

SEQ ID NO: 2667700 - RNA, 23 nt, Human
uauugaggccaagaauauugcaa

SEQ ID NO: 2667701 - RNA, 15 nt, Human
uauugguuuuaugau

SEQ ID NO: 2667702 - RNA, 14 nt, Human
uauugguuuuauga

SEQ ID NO: 2667703 - RNA, 13 nt, Human
uauugguuuuaug

SEQ ID NO: 2667704 - RNA, 18 nt, Human
uauuggggccaugaguaa

SEQ ID NO: 2667705 - RNA, 23 nt, Human
uauuggggccaugaguaaaauag

SEQ ID NO: 2667706 - RNA, 22 nt, Human
uauucuucucuuccuuuuauca

SEQ ID NO: 2667707 - RNA, 13 nt, Human
uauucuuuucuca

SEQ ID NO: 2667708 - RNA, 19 nt, Human
uauugaacuuuuguacuga

SEQ ID NO: 2667709 - RNA, 21 nt, Human
uauugacaaccgagaagguuu

SEQ ID NO: 2667710 - RNA, 11 nt, Human
uauugacacug

SEQ ID NO: 2667711 - RNA, 12 nt, Human
uauugacacuga

SEQ ID NO: 2667712 - RNA, 13 nt, Human
uauugacacugaa

SEQ ID NO: 2667713 - RNA, 14 nt, Human
uauugacacugaac

SEQ ID NO: 2667714 - RNA, 16 nt, Human
uauugacacugaacuu

SEQ ID NO: 2667715 - RNA, 19 nt, Human
uauugacacugaacuuaau

SEQ ID NO: 2667716 - RNA, 24 nt, Human
uauugacacugaacuuaauaacug

SEQ ID NO: 2667717 - RNA, 13 nt, Human
uauucuucucuuc

SEQ ID NO: 2667718 - RNA, 15 nt, Human
uauucugagaaaaca

SEQ ID NO: 2667719 - RNA, 21 nt, Human
uauucucuuaauuuuucuuaa

SEQ ID NO: 2667720 - RNA, 17 nt, Human
uauucugagaaaacaag

SEQ ID NO: 2667721 - RNA, 15 nt, Human
uauucagauguaugu

SEQ ID NO: 2667722 - RNA, 15 nt, Human
uauucaggguaaaua

SEQ ID NO: 2667723 - RNA, 16 nt, Human
uauucaggguaaauag

SEQ ID NO: 2667724 - RNA, 14 nt, Human
uauucacuggcccc

SEQ ID NO: 2667725 - RNA, 22 nt, Human
uauuacccccuccuucagacac

SEQ ID NO: 2667726 - RNA, 21 nt, Human
uauuacccccuccuucagaca

SEQ ID NO: 2667727 - RNA, 21 nt, Human
uauuacgaaguucaagaucaa

SEQ ID NO: 2667728 - RNA, 20 nt, Human
uauuacgaaguucaagauca

SEQ ID NO: 2667729 - RNA, 12 nt, Human
uauuagagaaga

SEQ ID NO: 2667730 - RNA, 23 nt, Human
uauuaguguuauaugaacauaca

SEQ ID NO: 2667731 - RNA, 15 nt, Human
uauuagaugcacuua

SEQ ID NO: 2667732 - RNA, 16 nt, Human
uauuauaaaggauaaa

SEQ ID NO: 2667733 - RNA, 18 nt, Human
uauuauaaaggauaaaga

SEQ ID NO: 2667734 - RNA, 20 nt, Human
uauuauaaaggauaaagaag

SEQ ID NO: 2667735 - RNA, 21 nt, Human
uauuaguguuauaugaacaua

SEQ ID NO: 2667736 - RNA, 18 nt, Human
uauuaguguuauaugaac

SEQ ID NO: 2667737 - RNA, 17 nt, Human
uauuaguguuauaugaa

SEQ ID NO: 2667738 - RNA, 16 nt, Human
uauuaguguuauauga

SEQ ID NO: 2667739 - RNA, 14 nt, Human
uauuaguguuauau

SEQ ID NO: 2667740 - RNA, 13 nt, Human
uauuaguguuaua

SEQ ID NO: 2667741 - RNA, 21 nt, Human
uauuagccagguaaugugaau

SEQ ID NO: 2667742 - RNA, 12 nt, Human
uauuaaaacuaa

SEQ ID NO: 2667743 - RNA, 14 nt, Human
uauuaaaacuaaau

SEQ ID NO: 2667744 - RNA, 17 nt, Human
uauuaaaacuaaauuuc

SEQ ID NO: 2667745 - RNA, 19 nt, Human
uauuaaaacuaaauuucac

SEQ ID NO: 2667746 - RNA, 12 nt, Human
uauuaaagacag

SEQ ID NO: 2667747 - RNA, 18 nt, Human
uauuacauguaauuugau

SEQ ID NO: 2667748 - RNA, 20 nt, Human
uauuacauguaauuugauga

SEQ ID NO: 2667749 - RNA, 23 nt, Human
uauuaaaggaagcacucuguaua

SEQ ID NO: 2667750 - RNA, 19 nt, Human
acagucuccggccucucca

SEQ ID NO: 2667751 - RNA, 16 nt, Human
acagugaaguuuuacu

SEQ ID NO: 2667752 - RNA, 23 nt, Human
acagugaaguuuuacugucuauu

SEQ ID NO: 2667753 - RNA, 13 nt, Human
acaguguguaaac

SEQ ID NO: 2667754 - RNA, 14 nt, Human
acaguguguaaaca

SEQ ID NO: 2667755 - RNA, 17 nt, Human
acaguguguaaacaaaa

SEQ ID NO: 2667756 - RNA, 18 nt, Human
acaguguguaaacaaaau

SEQ ID NO: 2667757 - RNA, 15 nt, Human
acaguaucccacauc

SEQ ID NO: 2667758 - RNA, 21 nt, Human
acaguaucccacauccaacuc

SEQ ID NO: 2667759 - RNA, 16 nt, Human
acaguauagauuuuug

SEQ ID NO: 2667760 - RNA, 23 nt, Human
acaguaugugggauauugaaugu

SEQ ID NO: 2667761 - RNA, 14 nt, Human
uaucaauaucuaau

SEQ ID NO: 2667762 - RNA, 17 nt, Human
uaucaauaucuaauaua

SEQ ID NO: 2667763 - RNA, 21 nt, Human
uaucaauaucuaauauauaug

SEQ ID NO: 2667764 - RNA, 18 nt, Human
uaucaauaucuaauauau

SEQ ID NO: 2667765 - RNA, 22 nt, Human
uaucaauaucuaauauauauga

SEQ ID NO: 2667766 - RNA, 20 nt, Human
uaucacauuggagucacugc

SEQ ID NO: 2667767 - RNA, 19 nt, Human
uauauugguuuuaugauga

SEQ ID NO: 2667768 - RNA, 17 nt, Human
uauauugguuuuaugau

SEQ ID NO: 2667769 - RNA, 16 nt, Human
uauauugguuuuauga

SEQ ID NO: 2667770 - RNA, 15 nt, Human
uauauugguuuuaug

SEQ ID NO: 2667771 - RNA, 23 nt, Human
acagacuauuuuuagauuuucuu

SEQ ID NO: 2667772 - RNA, 14 nt, Human
acagacuauuuuua

SEQ ID NO: 2667773 - RNA, 17 nt, Human
acagacuauuuuuagau

SEQ ID NO: 2667774 - RNA, 12 nt, Human
uauauucuuuca

SEQ ID NO: 2667775 - RNA, 16 nt, Human
uauauucuuucaaagg

SEQ ID NO: 2667776 - RNA, 12 nt, Human
uauauugaacuu

SEQ ID NO: 2667777 - RNA, 13 nt, Human
uauauugaacuuu

SEQ ID NO: 2667778 - RNA, 21 nt, Human
uauauugaacuuuuguacuga

SEQ ID NO: 2667779 - RNA, 22 nt, Human
uauauugaacuuuuguacugaa

SEQ ID NO: 2667780 - RNA, 12 nt, Human
acacuccucugc

SEQ ID NO: 2667781 - RNA, 14 nt, Human
acacuccucugcgu

SEQ ID NO: 2667782 - RNA, 17 nt, Human
acacuccucugcgucua

SEQ ID NO: 2667783 - RNA, 20 nt, Human
acagacacgagccaccucac

SEQ ID NO: 2667784 - RNA, 22 nt, Human
acagacacuaacgaaauaucaa

SEQ ID NO: 2667785 - RNA, 16 nt, Human
acagagaggacuguag

SEQ ID NO: 2667786 - RNA, 11 nt, Human
uaucuccugac

SEQ ID NO: 2667787 - RNA, 19 nt, Human
uaucuccggcucccagccu

SEQ ID NO: 2667788 - RNA, 18 nt, Human
uaucuccggcucccagcc

SEQ ID NO: 2667789 - RNA, 20 nt, Human
uaucuccggcucccagccuc

SEQ ID NO: 2667790 - RNA, 13 nt, Human
uaucuccugacag

SEQ ID NO: 2667791 - RNA, 14 nt, Human
uaucuccugacaga

SEQ ID NO: 2667792 - RNA, 21 nt, Human
uaucuccugacagaaggugcc

SEQ ID NO: 2667793 - RNA, 18 nt, Human
uaucuaguucuaacagug

SEQ ID NO: 2667794 - RNA, 14 nt, Human
uauccauauuuuau

SEQ ID NO: 2667795 - RNA, 22 nt, Human
uauccauauuuuauuacuguuu

SEQ ID NO: 2667796 - RNA, 14 nt, Human
uaucuccggcuccc

SEQ ID NO: 2667797 - RNA, 16 nt, Human
uaucuccggcucccag

SEQ ID NO: 2667798 - RNA, 16 nt, Human
uaucccaagaaugcaa

SEQ ID NO: 2667799 - RNA, 22 nt, Human
acagcagcuuauaaugggcucu

SEQ ID NO: 2667800 - RNA, 15 nt, Human
uaucuugauacauuc

SEQ ID NO: 2667801 - RNA, 16 nt, Human
uaucuugauacauuca

SEQ ID NO: 2667802 - RNA, 17 nt, Human
uaucuugauacauucaa

SEQ ID NO: 2667803 - RNA, 18 nt, Human
uaucuugauacauucaaa

SEQ ID NO: 2667804 - RNA, 19 nt, Human
uaucuugauacauucaaau

SEQ ID NO: 2667805 - RNA, 13 nt, Human
uaugaggagggga

SEQ ID NO: 2667806 - RNA, 14 nt, Human
uaugaggaggggag

SEQ ID NO: 2667807 - RNA, 14 nt, Human
uaugaguagccagg

SEQ ID NO: 2667808 - RNA, 21 nt, Human
uauggcuuuauuuuuuugaac

SEQ ID NO: 2667809 - RNA, 15 nt, Human
uaugggccccuggca

SEQ ID NO: 2667810 - RNA, 23 nt, Human
uaugggcuuuuggggagccagaa

SEQ ID NO: 2667811 - RNA, 12 nt, Human
acagccugggcc

SEQ ID NO: 2667812 - RNA, 15 nt, Human
acagccugggcccca

SEQ ID NO: 2667813 - RNA, 18 nt, Human
acagccugggccccagcu

SEQ ID NO: 2667814 - RNA, 14 nt, Human
acagcucauuaaac

SEQ ID NO: 2667815 - RNA, 16 nt, Human
acagcucauuaaacuu

SEQ ID NO: 2667816 - RNA, 17 nt, Human
acagcucauuaaacuuu

SEQ ID NO: 2667817 - RNA, 19 nt, Human
acagcucauuaaacuuuuu

SEQ ID NO: 2667818 - RNA, 14 nt, Human
acagcucaggaggc

SEQ ID NO: 2667819 - RNA, 19 nt, Human
acagcucaggaggcgcccu

SEQ ID NO: 2667820 - RNA, 21 nt, Human
uaugauuaaaaauaucaaauu

SEQ ID NO: 2667821 - RNA, 17 nt, Human
uaugauuaaaaauauca

SEQ ID NO: 2667822 - RNA, 23 nt, Human
uaugauuaaaaauaucaaauuaa

SEQ ID NO: 2667823 - RNA, 14 nt, Human
uaugauuaaaaaua

SEQ ID NO: 2667824 - RNA, 12 nt, Human
uaugauuaaaaa

SEQ ID NO: 2667825 - RNA, 16 nt, Human
uaugaugguuuuaaac

SEQ ID NO: 2667826 - RNA, 21 nt, Human
uaugaugacguacaaguaguu

SEQ ID NO: 2667827 - RNA, 18 nt, Human
uauauccugugacugucu

SEQ ID NO: 2667828 - RNA, 17 nt, Human
uauauccugugacuguc

SEQ ID NO: 2667829 - RNA, 15 nt, Human
uauauccugugacug

SEQ ID NO: 2667830 - RNA, 14 nt, Human
uauauccugugacu

SEQ ID NO: 2667831 - RNA, 13 nt, Human
uauaucaugcaaa

SEQ ID NO: 2667832 - RNA, 14 nt, Human
uauaucaugcaaaa

SEQ ID NO: 2667833 - RNA, 11 nt, Human
uauauauauaa

SEQ ID NO: 2667834 - RNA, 14 nt, Human
uauauauauaaaca

SEQ ID NO: 2667835 - RNA, 14 nt, Human
uauauauauaaaug

SEQ ID NO: 2667836 - RNA, 16 nt, Human
uauauauauaaaugua

SEQ ID NO: 2667837 - RNA, 13 nt, Human
uauauauauauaa

SEQ ID NO: 2667838 - RNA, 14 nt, Human
uauauauauauaac

SEQ ID NO: 2667839 - RNA, 20 nt, Human
uauauaucuaucuauuugag

SEQ ID NO: 2667840 - RNA, 14 nt, Human
uauagccuggacug

SEQ ID NO: 2667841 - RNA, 21 nt, Human
uauagccuauggcagaaaaaa

SEQ ID NO: 2667842 - RNA, 19 nt, Human
uauagccuauggcagaaaa

SEQ ID NO: 2667843 - RNA, 20 nt, Human
uauagccuauggcagaaaaa

SEQ ID NO: 2667844 - RNA, 16 nt, Human
uauagcaacaacaauu

SEQ ID NO: 2667845 - RNA, 14 nt, Human
uauauauacauaua

SEQ ID NO: 2667846 - RNA, 15 nt, Human
uauauauacauauau

SEQ ID NO: 2667847 - RNA, 13 nt, Human
uauauauaaaacg

SEQ ID NO: 2667848 - RNA, 13 nt, Human
uauauauaaaugu

SEQ ID NO: 2667849 - RNA, 15 nt, Human
uauauauaaauguau

SEQ ID NO: 2667850 - RNA, 16 nt, Human
uauauauaacauauau

SEQ ID NO: 2667851 - RNA, 19 nt, Human
uauaacauauauggaagag

SEQ ID NO: 2667852 - RNA, 13 nt, Human
uauaacacauuuu

SEQ ID NO: 2667853 - RNA, 14 nt, Human
uauaacacauuuuu

SEQ ID NO: 2667854 - RNA, 22 nt, Human
uauaacacauuuuuuugcaugc

SEQ ID NO: 2667855 - RNA, 23 nt, Human
uauaacacauuuuuuugcaugca

SEQ ID NO: 2667856 - RNA, 19 nt, Human
uauaauuuauuuccacuaa

SEQ ID NO: 2667857 - RNA, 18 nt, Human
uauaagccaaaauuaagg

SEQ ID NO: 2667858 - RNA, 23 nt, Human
uauaagccaaaauuaagguguuu

SEQ ID NO: 2667859 - RNA, 22 nt, Human
uauaagccaaaauuaagguguu

SEQ ID NO: 2667860 - RNA, 21 nt, Human
uauaagccaaaauuaaggugu

SEQ ID NO: 2667861 - RNA, 19 nt, Human
uauaagccaaaauuaaggu

SEQ ID NO: 2667862 - RNA, 17 nt, Human
uauaaccagcugaaguu

SEQ ID NO: 2667863 - RNA, 22 nt, Human
uauacaguauagauuuuugggu

SEQ ID NO: 2667864 - RNA, 19 nt, Human
uauacacgaauagacauca

SEQ ID NO: 2667865 - RNA, 21 nt, Human
uauacacgaauagacaucaaa

SEQ ID NO: 2667866 - RNA, 17 nt, Human
uauaccagcaauauauc

SEQ ID NO: 2667867 - RNA, 17 nt, Human
uauacagugcagagccu

SEQ ID NO: 2667868 - RNA, 18 nt, Human
uauacagugcagagccuu

SEQ ID NO: 2667869 - RNA, 18 nt, Human
uaguucugagcugccagu

SEQ ID NO: 2667870 - RNA, 15 nt, Human
uaguucuguauuuga

SEQ ID NO: 2667871 - RNA, 14 nt, Human
uaguucuguauuug

SEQ ID NO: 2667872 - RNA, 12 nt, Human
uaguucuguauu

SEQ ID NO: 2667873 - RNA, 20 nt, Human
uaguuccucauuagcauuuu

SEQ ID NO: 2667874 - RNA, 19 nt, Human
uagugaugaugguucacgu

SEQ ID NO: 2667875 - RNA, 17 nt, Human
uagugaucaagaagacu

SEQ ID NO: 2667876 - RNA, 11 nt, Human
uaguuacugug

SEQ ID NO: 2667877 - RNA, 15 nt, Human
uaguuacuguguaaa

SEQ ID NO: 2667878 - RNA, 16 nt, Human
uaguuacuguguaaac

SEQ ID NO: 2667879 - RNA, 17 nt, Human
uaguuacuguguaaacu

SEQ ID NO: 2667880 - RNA, 19 nt, Human
uaguuacuguguaaacuca

SEQ ID NO: 2667881 - RNA, 21 nt, Human
uaguuacuguguaaacucauc

SEQ ID NO: 2667882 - RNA, 16 nt, Human
uagucucuuuaaaagg

SEQ ID NO: 2667883 - RNA, 18 nt, Human
uagucucuuuaaaaggaa

SEQ ID NO: 2667884 - RNA, 17 nt, Human
uagucauauauuaaaca

SEQ ID NO: 2667885 - RNA, 21 nt, Human
uaguccaaaaagcuccugggg

SEQ ID NO: 2667886 - RNA, 23 nt, Human
acaagcugcacccucaggcaggu

SEQ ID NO: 2667887 - RNA, 22 nt, Human
acaagcugcacccucaggcagg

SEQ ID NO: 2667888 - RNA, 21 nt, Human
acaagcugcacccucaggcag

SEQ ID NO: 2667889 - RNA, 19 nt, Human
acaagcugcacccucaggc

SEQ ID NO: 2667890 - RNA, 13 nt, Human
acaagcuggcuua

SEQ ID NO: 2667891 - RNA, 19 nt, Human
acaagcaugcagcuuugca

SEQ ID NO: 2667892 - RNA, 16 nt, Human
acaagcuucaguaagu

SEQ ID NO: 2667893 - RNA, 19 nt, Human
acaagcuucaguaaguuau

SEQ ID NO: 2667894 - RNA, 19 nt, Human
acaagcuggcuuacacugg

SEQ ID NO: 2667895 - RNA, 22 nt, Human
uaguuuuauuuauauuuauuga

SEQ ID NO: 2667896 - RNA, 21 nt, Human
uaguuuuauuuauauuuauug

SEQ ID NO: 2667897 - RNA, 15 nt, Human
uaguuuuauuuauau

SEQ ID NO: 2667898 - RNA, 14 nt, Human
uaguuuuauuuaua

SEQ ID NO: 2667899 - RNA, 21 nt, Human
acaccuacuagucaccagaga

SEQ ID NO: 2667900 - RNA, 22 nt, Human
acucauuuguuaaaauuaucaa

SEQ ID NO: 2667901 - RNA, 13 nt, Human
acuccacaucugc

SEQ ID NO: 2667902 - RNA, 14 nt, Human
acuccacaucugcc

SEQ ID NO: 2667903 - RNA, 15 nt, Human
acuccacaucugccu

SEQ ID NO: 2667904 - RNA, 20 nt, Human
acuccaacucccuuaaaaua

SEQ ID NO: 2667905 - RNA, 15 nt, Human
acuccaggcccuccu

SEQ ID NO: 2667906 - RNA, 18 nt, Human
acuccaggcccuccucuc

SEQ ID NO: 2667907 - RNA, 19 nt, Human
acuccaggcccuccucucc

SEQ ID NO: 2667908 - RNA, 19 nt, Human
acuccagggacacacagcc

SEQ ID NO: 2667909 - RNA, 20 nt, Human
acuccagggacacacagccu

SEQ ID NO: 2667910 - RNA, 24 nt, Human
acuccagggacacacagccuagca

SEQ ID NO: 2667911 - RNA, 15 nt, Human
acucauugcugagcc

SEQ ID NO: 2667912 - RNA, 20 nt, Human
acucauugcugagccucugc

SEQ ID NO: 2667913 - RNA, 18 nt, Human
acucauugcugagccucu

SEQ ID NO: 2667914 - RNA, 12 nt, Human
acucauuucauc

SEQ ID NO: 2667915 - RNA, 13 nt, Human
acucauuucaucu

SEQ ID NO: 2667916 - RNA, 14 nt, Human
acucauuucaucuc

SEQ ID NO: 2667917 - RNA, 15 nt, Human
acucauuucaucuca

SEQ ID NO: 2667918 - RNA, 17 nt, Human
acucauuucaucucauu

SEQ ID NO: 2667919 - RNA, 23 nt, Human
acucauugcugagccucugcucc

SEQ ID NO: 2667920 - RNA, 22 nt, Human
acucauugcugagccucugcuc

SEQ ID NO: 2667921 - RNA, 21 nt, Human
acucauugcugagccucugcu

SEQ ID NO: 2667922 - RNA, 19 nt, Human
ucccuguaggguccaacca

SEQ ID NO: 2667923 - RNA, 15 nt, Human
ucccuuacuuugcug

SEQ ID NO: 2667924 - RNA, 22 nt, Human
ucccuuuccaaaugcccagcuu

SEQ ID NO: 2667925 - RNA, 19 nt, Human
uccguuagcuccuguggcc

SEQ ID NO: 2667926 - RNA, 18 nt, Human
uccgugaaaacggagcug

SEQ ID NO: 2667927 - RNA, 18 nt, Human
uccuaaagagaguauuuu

SEQ ID NO: 2667928 - RNA, 23 nt, Human
uccuaaagaaaaauaucuuggcc

SEQ ID NO: 2667929 - RNA, 13 nt, Human
uccguuggccacu

SEQ ID NO: 2667930 - RNA, 15 nt, Human
uccguuggccacucc

SEQ ID NO: 2667931 - RNA, 14 nt, Human
uccuaggcauuugc

SEQ ID NO: 2667932 - RNA, 20 nt, Human
uccuagcacuuugggaggcc

SEQ ID NO: 2667933 - RNA, 19 nt, Human
uccucaaauuuuuugacuu

SEQ ID NO: 2667934 - RNA, 23 nt, Human
uccucacucggguuucucugugg

SEQ ID NO: 2667935 - RNA, 14 nt, Human
uccucagaaagugu

SEQ ID NO: 2667936 - RNA, 19 nt, Human
uccucagugcauuugugcu

SEQ ID NO: 2667937 - RNA, 12 nt, Human
uccucagccagu

SEQ ID NO: 2667938 - RNA, 16 nt, Human
uccuccccuuccucuu

SEQ ID NO: 2667939 - RNA, 19 nt, Human
uccuaggcauuugcugaau

SEQ ID NO: 2667940 - RNA, 15 nt, Human
acucgcgcucaguaa

SEQ ID NO: 2667941 - RNA, 16 nt, Human
acucgcgcucaguaaa

SEQ ID NO: 2667942 - RNA, 15 nt, Human
acucgcuguaugaaa

SEQ ID NO: 2667943 - RNA, 15 nt, Human
acucggcucugcagu

SEQ ID NO: 2667944 - RNA, 16 nt, Human
acucggcucugcaguc

SEQ ID NO: 2667945 - RNA, 20 nt, Human
acucggggugcuuccuugua

SEQ ID NO: 2667946 - RNA, 20 nt, Human
acucggguuucucuguggcu

SEQ ID NO: 2667947 - RNA, 16 nt, Human
acucggggugcuuccu

SEQ ID NO: 2667948 - RNA, 16 nt, Human
acucugcuucucugac

SEQ ID NO: 2667949 - RNA, 22 nt, Human
acucugcuucucugacuucugc

SEQ ID NO: 2667950 - RNA, 14 nt, Human
acucugcauguaga

SEQ ID NO: 2667951 - RNA, 20 nt, Human
acucugcauguagaggcuug

SEQ ID NO: 2667952 - RNA, 17 nt, Human
acucugcuucucugacu

SEQ ID NO: 2667953 - RNA, 18 nt, Human
acucugcuucucugacuu

SEQ ID NO: 2667954 - RNA, 20 nt, Human
acucugcuucucugacuucu

SEQ ID NO: 2667955 - RNA, 21 nt, Human
acucugcuucucugacuucug

SEQ ID NO: 2667956 - RNA, 14 nt, Human
uccccaccuccagg

SEQ ID NO: 2667957 - RNA, 17 nt, Human
uccccaccuccaggcuu

SEQ ID NO: 2667958 - RNA, 16 nt, Human
acuauauauauaaaug

SEQ ID NO: 2667959 - RNA, 17 nt, Human
acuauauauauaaaugu

SEQ ID NO: 2667960 - RNA, 20 nt, Human
acuauauauauaaauguaua

SEQ ID NO: 2667961 - RNA, 22 nt, Human
acuauauauauaaauguauaaa

SEQ ID NO: 2667962 - RNA, 19 nt, Human
acuauauaauuuauuucca

SEQ ID NO: 2667963 - RNA, 21 nt, Human
acuauauaauuuauuuccacu

SEQ ID NO: 2667964 - RNA, 19 nt, Human
acuauauuaguauguaugu

SEQ ID NO: 2667965 - RNA, 14 nt, Human
uccccuugcagccg

SEQ ID NO: 2667966 - RNA, 12 nt, Human
uccccucagcuc

SEQ ID NO: 2667967 - RNA, 10 nt, Human
ucccucaccc

SEQ ID NO: 2667968 - RNA, 12 nt, Human
ucccucaccccc

SEQ ID NO: 2667969 - RNA, 15 nt, Human
ucccucacccccucc

SEQ ID NO: 2667970 - RNA, 17 nt, Human
ucccucacccccuccca

SEQ ID NO: 2667971 - RNA, 20 nt, Human
ucccucacccccucccaccc

SEQ ID NO: 2667972 - RNA, 23 nt, Human
ucccucacccccucccaccccca

SEQ ID NO: 2667973 - RNA, 18 nt, Human
ucccuauuagagaagaga

SEQ ID NO: 2667974 - RNA, 17 nt, Human
acuaaaaaguauaaaau

SEQ ID NO: 2667975 - RNA, 20 nt, Human
acuaaaaaguauaaaauagu

SEQ ID NO: 2667976 - RNA, 21 nt, Human
acuaaaaaguauaaaauagua

SEQ ID NO: 2667977 - RNA, 13 nt, Human
acuaaaaauauug

SEQ ID NO: 2667978 - RNA, 15 nt, Human
acuaaaaauauuguu

SEQ ID NO: 2667979 - RNA, 21 nt, Human
acuaaaaauauuguuucugca

SEQ ID NO: 2667980 - RNA, 17 nt, Human
acguuuuuuccucagug

SEQ ID NO: 2667981 - RNA, 18 nt, Human
acguuuuuuccucagugc

SEQ ID NO: 2667982 - RNA, 19 nt, Human
acguuuuaaggacugacug

SEQ ID NO: 2667983 - RNA, 11 nt, Human
acguuuauaaa

SEQ ID NO: 2667984 - RNA, 14 nt, Human
acguuuauaaacag

SEQ ID NO: 2667985 - RNA, 16 nt, Human
acguuuauaaacagaa

SEQ ID NO: 2667986 - RNA, 19 nt, Human
acguuuauaaacagaaaug

SEQ ID NO: 2667987 - RNA, 21 nt, Human
acguuuauaaacagaaaugga

SEQ ID NO: 2667988 - RNA, 18 nt, Human
accuucuagucuuggcca

SEQ ID NO: 2667989 - RNA, 22 nt, Human
uccagcgaucucuccacugugc

SEQ ID NO: 2667990 - RNA, 24 nt, Human
uccagccugggugacagagcaagu

SEQ ID NO: 2667991 - RNA, 19 nt, Human
uccagccuggggcugaggc

SEQ ID NO: 2667992 - RNA, 13 nt, Human
uccagccugggug

SEQ ID NO: 2667993 - RNA, 20 nt, Human
acuaaacuacauuguucuua

SEQ ID NO: 2667994 - RNA, 12 nt, Human
acuaaagcauga

SEQ ID NO: 2667995 - RNA, 15 nt, Human
acuaaagcaugaaau

SEQ ID NO: 2667996 - RNA, 20 nt, Human
acuaaagcaugaaaugugaa

SEQ ID NO: 2667997 - RNA, 22 nt, Human
acuaaagcaugaaaugugaauu

SEQ ID NO: 2667998 - RNA, 19 nt, Human
acuaaauaagaaaauaaca

SEQ ID NO: 2667999 - RNA, 15 nt, Human
acuaaaucagagaca

SEQ ID NO: 2668000 - RNA, 18 nt, Human
acuaaaucagagacaaaa

SEQ ID NO: 2668001 - RNA, 19 nt, Human
acuaaaucagagacaaaau

SEQ ID NO: 2668002 - RNA, 21 nt, Human
acuaaaucagagacaaaauau

SEQ ID NO: 2668003 - RNA, 17 nt, Human
acuacaguauuacucuu

SEQ ID NO: 2668004 - RNA, 21 nt, Human
ucccagguaccagcugcgcuu

SEQ ID NO: 2668005 - RNA, 19 nt, Human
ucccagguaccagcugcgc

SEQ ID NO: 2668006 - RNA, 22 nt, Human
ucccagugccgagaaggaagcc

SEQ ID NO: 2668007 - RNA, 19 nt, Human
ucccagugccgagaaggaa

SEQ ID NO: 2668008 - RNA, 17 nt, Human
ucccaggggucucccug

SEQ ID NO: 2668009 - RNA, 18 nt, Human
ucccaggggucucccugg

SEQ ID NO: 2668010 - RNA, 19 nt, Human
ucccaggggucucccuggc

SEQ ID NO: 2668011 - RNA, 20 nt, Human
ucccaggggucucccuggcu

SEQ ID NO: 2668012 - RNA, 21 nt, Human
ucccaggggucucccuggcuc

SEQ ID NO: 2668013 - RNA, 22 nt, Human
ucccaggggucucccuggcucc

SEQ ID NO: 2668014 - RNA, 16 nt, Human
ucccagguaccagcug

SEQ ID NO: 2668015 - RNA, 17 nt, Human
ucccagguaccagcugc

SEQ ID NO: 2668016 - RNA, 18 nt, Human
ucccagguaccagcugcg

SEQ ID NO: 2668017 - RNA, 16 nt, Human
ucccauagucccugcc

SEQ ID NO: 2668018 - RNA, 18 nt, Human
ucccauagucccugccac

SEQ ID NO: 2668019 - RNA, 18 nt, Human
uccccaaaucaauacacu

SEQ ID NO: 2668020 - RNA, 23 nt, Human
uccccaaaucaauacacuaguug

SEQ ID NO: 2668021 - RNA, 22 nt, Human
uccccaaccgugucugucuggc

SEQ ID NO: 2668022 - RNA, 17 nt, Human
acuguacccaaauggaa

SEQ ID NO: 2668023 - RNA, 13 nt, Human
acuguaagggauu

SEQ ID NO: 2668024 - RNA, 16 nt, Human
acuguacccaaaugga

SEQ ID NO: 2668025 - RNA, 15 nt, Human
acuguagaaaugaug

SEQ ID NO: 2668026 - RNA, 14 nt, Human
ucgcuccugcccac

SEQ ID NO: 2668027 - RNA, 16 nt, Human
acuggggcagacaaua

SEQ ID NO: 2668028 - RNA, 21 nt, Human
uccuuucccaagccuucgggc

SEQ ID NO: 2668029 - RNA, 16 nt, Human
uccuuucccaagccuu

SEQ ID NO: 2668030 - RNA, 13 nt, Human
uccuuucccaagc

SEQ ID NO: 2668031 - RNA, 13 nt, Human
uccuuuaugugaa

SEQ ID NO: 2668032 - RNA, 14 nt, Human
uccuuuaugugaau

SEQ ID NO: 2668033 - RNA, 15 nt, Human
uccuuuaugugaauu

SEQ ID NO: 2668034 - RNA, 16 nt, Human
uccuuuaugugaauuu

SEQ ID NO: 2668035 - RNA, 17 nt, Human
uccuuuaugugaauuuu

SEQ ID NO: 2668036 - RNA, 20 nt, Human
uccuuuaugugaauuuuuaa

SEQ ID NO: 2668037 - RNA, 23 nt, Human
uccuuuaugugaauuuuuaagcu

SEQ ID NO: 2668038 - RNA, 12 nt, Human
ucgacucugugc

SEQ ID NO: 2668039 - RNA, 12 nt, Human
ucgccuuuccuc

SEQ ID NO: 2668040 - RNA, 21 nt, Human
ucgccuuuccucucuauauuu

SEQ ID NO: 2668041 - RNA, 13 nt, Human
ucgccuuuccucu

SEQ ID NO: 2668042 - RNA, 14 nt, Human
uccuuccugaaacu

SEQ ID NO: 2668043 - RNA, 13 nt, Human
acuggauuuguug

SEQ ID NO: 2668044 - RNA, 16 nt, Human
acuggcaaugguaguu

SEQ ID NO: 2668045 - RNA, 23 nt, Human
uccuucagacacccucaaccucu

SEQ ID NO: 2668046 - RNA, 12 nt, Human
acugccuugaaa

SEQ ID NO: 2668047 - RNA, 17 nt, Human
acugcaggucaaguugu

SEQ ID NO: 2668048 - RNA, 20 nt, Human
acugccuuuuuauuuauaug

SEQ ID NO: 2668049 - RNA, 15 nt, Human
acugcgacuuucugc

SEQ ID NO: 2668050 - RNA, 21 nt, Human
acugcgaagacccucuugccc

SEQ ID NO: 2668051 - RNA, 22 nt, Human
acugcgaagacccucuugccca

SEQ ID NO: 2668052 - RNA, 17 nt, Human
acugcgacuuucugccu

SEQ ID NO: 2668053 - RNA, 18 nt, Human
acugcgacuuucugccug

SEQ ID NO: 2668054 - RNA, 23 nt, Human
acugcgcccuuaacugcauccag

SEQ ID NO: 2668055 - RNA, 19 nt, Human
acugcgacuuucugccugg

SEQ ID NO: 2668056 - RNA, 21 nt, Human
acugcgacuuucugccuggag

SEQ ID NO: 2668057 - RNA, 22 nt, Human
acugcgacuuucugccuggagu

SEQ ID NO: 2668058 - RNA, 23 nt, Human
acugcgacuuucugccuggagug

SEQ ID NO: 2668059 - RNA, 21 nt, Human
acugcuucccuuacuuugcug

SEQ ID NO: 2668060 - RNA, 13 nt, Human
acugcuugaauaa

SEQ ID NO: 2668061 - RNA, 13 nt, Human
uccuguguagcau

SEQ ID NO: 2668062 - RNA, 21 nt, Human
uccuguugaaugacaaaguau

SEQ ID NO: 2668063 - RNA, 18 nt, Human
uccuguucaguaauaaaa

SEQ ID NO: 2668064 - RNA, 12 nt, Human
acugcaggcccu

SEQ ID NO: 2668065 - RNA, 13 nt, Human
acugcaggcccug

SEQ ID NO: 2668066 - RNA, 14 nt, Human
acugcaggcccugg

SEQ ID NO: 2668067 - RNA, 15 nt, Human
acugcaggcccuggc

SEQ ID NO: 2668068 - RNA, 16 nt, Human
acugcaggcccuggcc

SEQ ID NO: 2668069 - RNA, 17 nt, Human
acugcaggcccuggccu

SEQ ID NO: 2668070 - RNA, 18 nt, Human
acugcaggcccuggccuc

SEQ ID NO: 2668071 - RNA, 19 nt, Human
acugcaggcccuggccucc

SEQ ID NO: 2668072 - RNA, 22 nt, Human
acugcaggcccuggccuccccu

SEQ ID NO: 2668073 - RNA, 15 nt, Human
uccuuaaaucuuaau

SEQ ID NO: 2668074 - RNA, 17 nt, Human
uccuuaaaucuuaaugu

SEQ ID NO: 2668075 - RNA, 19 nt, Human
uccuuaaaucuuaauguuc

SEQ ID NO: 2668076 - RNA, 21 nt, Human
uccuuaaaucuuaauguuccu

SEQ ID NO: 2668077 - RNA, 17 nt, Human
uccuuaagcugcagaga

SEQ ID NO: 2668078 - RNA, 20 nt, Human
uccuuaagcugcagagauuu

SEQ ID NO: 2668079 - RNA, 15 nt, Human
uccuggggcguccag

SEQ ID NO: 2668080 - RNA, 23 nt, Human
uccugggggccuggguugggggc

SEQ ID NO: 2668081 - RNA, 22 nt, Human
uccugugauagaguucuuuuaa

SEQ ID NO: 2668082 - RNA, 21 nt, Human
uccugugauccacccaacccu

SEQ ID NO: 2668083 - RNA, 20 nt, Human
uccugugaaugccacugccu

SEQ ID NO: 2668084 - RNA, 22 nt, Human
uccugugaaugccacugccuuc

SEQ ID NO: 2668085 - RNA, 12 nt, Human
uccuguggcccc

SEQ ID NO: 2668086 - RNA, 16 nt, Human
uccuguggcauaaauu

SEQ ID NO: 2668087 - RNA, 19 nt, Human
uccuguggcauaaauugca

SEQ ID NO: 2668088 - RNA, 20 nt, Human
uccuguggcauaaauugcau

SEQ ID NO: 2668089 - RNA, 22 nt, Human
uccuguggccccacccugggcc

SEQ ID NO: 2668090 - RNA, 23 nt, Human
uccuguggccccacccugggccc

SEQ ID NO: 2668091 - RNA, 16 nt, Human
uccugugaaugccacu

SEQ ID NO: 2668092 - RNA, 21 nt, Human
uccugcacuuacuugcuuauu

SEQ ID NO: 2668093 - RNA, 17 nt, Human
uccugcagaccacgccc

SEQ ID NO: 2668094 - RNA, 23 nt, Human
uccugauuucuagaacccgugac

SEQ ID NO: 2668095 - RNA, 14 nt, Human
uccugauuccucuc

SEQ ID NO: 2668096 - RNA, 13 nt, Human
uccugcggguggg

SEQ ID NO: 2668097 - RNA, 14 nt, Human
uccugcgggugggg

SEQ ID NO: 2668098 - RNA, 21 nt, Human
uccugcguccuccucaccuca

SEQ ID NO: 2668099 - RNA, 16 nt, Human
uccugcguccuccuca

SEQ ID NO: 2668100 - RNA, 18 nt, Human
uccugcguccuccucacc

SEQ ID NO: 2668101 - RNA, 13 nt, Human
uccugcguccucc

SEQ ID NO: 2668102 - RNA, 14 nt, Human
uccugcguccuccu

SEQ ID NO: 2668103 - RNA, 15 nt, Human
uccugcguccuccuc

SEQ ID NO: 2668104 - RNA, 22 nt, Human
uccugcucauuaugccacuucc

SEQ ID NO: 2668105 - RNA, 15 nt, Human
acugaggauauucag

SEQ ID NO: 2668106 - RNA, 23 nt, Human
acugaggauauucagauguaugu

SEQ ID NO: 2668107 - RNA, 18 nt, Human
acugaggcaguuugagga

SEQ ID NO: 2668108 - RNA, 20 nt, Human
acugaggcaguuugaggauu

SEQ ID NO: 2668109 - RNA, 19 nt, Human
acugaguauuaauaucuga

SEQ ID NO: 2668110 - RNA, 15 nt, Human
acugagugggaagcc

SEQ ID NO: 2668111 - RNA, 16 nt, Human
acugagugggaagccc

SEQ ID NO: 2668112 - RNA, 13 nt, Human
acugagugggaag

SEQ ID NO: 2668113 - RNA, 14 nt, Human
acugagugggaagc

SEQ ID NO: 2668114 - RNA, 22 nt, Human
ucauuuguuaaaauuaucaaua

SEQ ID NO: 2668115 - RNA, 12 nt, Human
ucauuuguuuac

SEQ ID NO: 2668116 - RNA, 15 nt, Human
ucauuuguuuacauu

SEQ ID NO: 2668117 - RNA, 18 nt, Human
ucauuuguuuacauuuga

SEQ ID NO: 2668118 - RNA, 16 nt, Human
ucauuuuacaguaucu

SEQ ID NO: 2668119 - RNA, 14 nt, Human
accucgcugagggc

SEQ ID NO: 2668120 - RNA, 21 nt, Human
accugaaguuuuuuugcugcu

SEQ ID NO: 2668121 - RNA, 20 nt, Human
accuggaagaacaggccucu

SEQ ID NO: 2668122 - RNA, 23 nt, Human
accuggaagaacaggccucucca

SEQ ID NO: 2668123 - RNA, 14 nt, Human
uccaaccuucccaa

SEQ ID NO: 2668124 - RNA, 14 nt, Human
uccaaccagaccug

SEQ ID NO: 2668125 - RNA, 15 nt, Human
uccaaccagaccugg

SEQ ID NO: 2668126 - RNA, 16 nt, Human
uccaaccagaccugga

SEQ ID NO: 2668127 - RNA, 17 nt, Human
uccaaccagaccuggaa

SEQ ID NO: 2668128 - RNA, 12 nt, Human
uccaccagcauc

SEQ ID NO: 2668129 - RNA, 19 nt, Human
uccaccagcaucaccugcc

SEQ ID NO: 2668130 - RNA, 20 nt, Human
uccaccagcaucaccugccu

SEQ ID NO: 2668131 - RNA, 16 nt, Human
accuucuucuccuaca

SEQ ID NO: 2668132 - RNA, 14 nt, Human
accuucccaaacgc

SEQ ID NO: 2668133 - RNA, 22 nt, Human
accuucccaaacgccuccccug

SEQ ID NO: 2668134 - RNA, 21 nt, Human
accuucccaaacgccuccccu

SEQ ID NO: 2668135 - RNA, 19 nt, Human
accuucccaaacgccuccc

SEQ ID NO: 2668136 - RNA, 20 nt, Human
accuucuauagcaucacuua

SEQ ID NO: 2668137 - RNA, 18 nt, Human
accuucuauagcaucacu

SEQ ID NO: 2668138 - RNA, 17 nt, Human
accuucuauagcaucac

SEQ ID NO: 2668139 - RNA, 13 nt, Human
accuuaggccuuc

SEQ ID NO: 2668140 - RNA, 14 nt, Human
accuuagaauacag

SEQ ID NO: 2668141 - RNA, 17 nt, Human
accuuaggccuuccucu

SEQ ID NO: 2668142 - RNA, 16 nt, Human
accuuaggccuuccuc

SEQ ID NO: 2668143 - RNA, 15 nt, Human
accuuaggccuuccu

SEQ ID NO: 2668144 - RNA, 14 nt, Human
accuuaggccuucc

SEQ ID NO: 2668145 - RNA, 20 nt, Human
accuuaggccuuccucucuc

SEQ ID NO: 2668146 - RNA, 18 nt, Human
accuuaggccuuccucuc

SEQ ID NO: 2668147 - RNA, 21 nt, Human
accuuaggccuuccucucucc

SEQ ID NO: 2668148 - RNA, 13 nt, Human
accuuacuaauua

SEQ ID NO: 2668149 - RNA, 19 nt, Human
accuuaaguaaucaucuaa

SEQ ID NO: 2668150 - RNA, 16 nt, Human
uccacuacaccuggcu

SEQ ID NO: 2668151 - RNA, 17 nt, Human
uccacuacaccuggcug

SEQ ID NO: 2668152 - RNA, 18 nt, Human
uccacuacaccuggcuga

SEQ ID NO: 2668153 - RNA, 14 nt, Human
uccacuaaaaauau

SEQ ID NO: 2668154 - RNA, 17 nt, Human
uccacuaaaaauauugu

SEQ ID NO: 2668155 - RNA, 15 nt, Human
uccacuacaccuggc

SEQ ID NO: 2668156 - RNA, 22 nt, Human
uccagaaguuugagaucagccu

SEQ ID NO: 2668157 - RNA, 24 nt, Human
uccacucugcuucucugacuucug

SEQ ID NO: 2668158 - RNA, 21 nt, Human
uccacucugcuucucugacuu

SEQ ID NO: 2668159 - RNA, 23 nt, Human
uccacucugcuucucugacuucu

SEQ ID NO: 2668160 - RNA, 12 nt, Human
uccacucugcuu

SEQ ID NO: 2668161 - RNA, 14 nt, Human
uccacucugcuucu

SEQ ID NO: 2668162 - RNA, 15 nt, Human
uccacucugcuucuc

SEQ ID NO: 2668163 - RNA, 19 nt, Human
uccacucugcuucucugac

SEQ ID NO: 2668164 - RNA, 20 nt, Human
uccacucugcuucucugacu

SEQ ID NO: 2668165 - RNA, 11 nt, Human
uccagccuggg

SEQ ID NO: 2668166 - RNA, 16 nt, Human
accgcccuuuuccccu

SEQ ID NO: 2668167 - RNA, 18 nt, Human
accgcccuuuuccccuac

SEQ ID NO: 2668168 - RNA, 15 nt, Human
accgccccuggccgc

SEQ ID NO: 2668169 - RNA, 16 nt, Human
accgccccuggccgcg

SEQ ID NO: 2668170 - RNA, 11 nt, Human
accgcccauca

SEQ ID NO: 2668171 - RNA, 20 nt, Human
accgccuccccaccuccagg

SEQ ID NO: 2668172 - RNA, 21 nt, Human
accgccuccccaccuccaggc

SEQ ID NO: 2668173 - RNA, 16 nt, Human
accggacuuuucugca

SEQ ID NO: 2668174 - RNA, 15 nt, Human
accggacuuuucugc

SEQ ID NO: 2668175 - RNA, 12 nt, Human
accgcacagcuc

SEQ ID NO: 2668176 - RNA, 14 nt, Human
accgcacagcucag

SEQ ID NO: 2668177 - RNA, 17 nt, Human
accgccaaggcuggggg

SEQ ID NO: 2668178 - RNA, 18 nt, Human
accgagaagguuuauccc

SEQ ID NO: 2668179 - RNA, 17 nt, Human
acccuuuuaaaguugau

SEQ ID NO: 2668180 - RNA, 12 nt, Human
accgaauaaaug

SEQ ID NO: 2668181 - RNA, 13 nt, Human
accgaauaaaugu

SEQ ID NO: 2668182 - RNA, 15 nt, Human
accgaauaaauguuu

SEQ ID NO: 2668183 - RNA, 12 nt, Human
acccuuugguuu

SEQ ID NO: 2668184 - RNA, 13 nt, Human
acccuuugggggu

SEQ ID NO: 2668185 - RNA, 17 nt, Human
acccuuuggggguugaa

SEQ ID NO: 2668186 - RNA, 21 nt, Human
acccuuugguuuuuuucuucu

SEQ ID NO: 2668187 - RNA, 23 nt, Human
acccuuugguuuuuuucuucugu

SEQ ID NO: 2668188 - RNA, 16 nt, Human
accuagcuaauuauuu

SEQ ID NO: 2668189 - RNA, 20 nt, Human
accuaaucaccauguaagca

SEQ ID NO: 2668190 - RNA, 17 nt, Human
accgugucugucuggca

SEQ ID NO: 2668191 - RNA, 13 nt, Human
accuccccagccu

SEQ ID NO: 2668192 - RNA, 14 nt, Human
accuccccagccug

SEQ ID NO: 2668193 - RNA, 22 nt, Human
accuccccagccugcgccugcu

SEQ ID NO: 2668194 - RNA, 17 nt, Human
accuccccagccugcgc

SEQ ID NO: 2668195 - RNA, 16 nt, Human
accuccccagccugcg

SEQ ID NO: 2668196 - RNA, 15 nt, Human
accuccccagccugc

SEQ ID NO: 2668197 - RNA, 15 nt, Human
accuccucauggcag

SEQ ID NO: 2668198 - RNA, 13 nt, Human
accucaauguccc

SEQ ID NO: 2668199 - RNA, 18 nt, Human
accucggucacuccaacu

SEQ ID NO: 2668200 - RNA, 17 nt, Human
accucggugccuuccuc

SEQ ID NO: 2668201 - RNA, 22 nt, Human
accucgcccucuccuuuguucc

SEQ ID NO: 2668202 - RNA, 17 nt, Human
accucgcccucuccuuu

SEQ ID NO: 2668203 - RNA, 15 nt, Human
accucgcccucuccu

SEQ ID NO: 2668204 - RNA, 14 nt, Human
accucgcccucucc

SEQ ID NO: 2668205 - RNA, 13 nt, Human
accucgcccucuc

SEQ ID NO: 2668206 - RNA, 18 nt, Human
ucauuccuuuuuauuuau

SEQ ID NO: 2668207 - RNA, 20 nt, Human
ucauuccuuuuuauuuauau

SEQ ID NO: 2668208 - RNA, 11 nt, Human
ucauugacuuu

SEQ ID NO: 2668209 - RNA, 12 nt, Human
ucauugacuuuu

SEQ ID NO: 2668210 - RNA, 14 nt, Human
ucauugacuuuuau

SEQ ID NO: 2668211 - RNA, 16 nt, Human
ucauugacuuuuauaa

SEQ ID NO: 2668212 - RNA, 21 nt, Human
ucauugacuuuuauaaagcau

SEQ ID NO: 2668213 - RNA, 24 nt, Human
ucauugacuuuuauaaagcauguu

SEQ ID NO: 2668214 - RNA, 14 nt, Human
accucucucucugg

SEQ ID NO: 2668215 - RNA, 22 nt, Human
accucugaauuuacuuccuugc

SEQ ID NO: 2668216 - RNA, 12 nt, Human
accucugcacaa

SEQ ID NO: 2668217 - RNA, 15 nt, Human
ucaugaccaguaaag

SEQ ID NO: 2668218 - RNA, 14 nt, Human
ucaugaccaguaaa

SEQ ID NO: 2668219 - RNA, 19 nt, Human
ucaugaggaggguggggga

SEQ ID NO: 2668220 - RNA, 17 nt, Human
ucaugcaugucaaacau

SEQ ID NO: 2668221 - RNA, 13 nt, Human
ucaugcccacccc

SEQ ID NO: 2668222 - RNA, 15 nt, Human
ucaugcccacccccu

SEQ ID NO: 2668223 - RNA, 16 nt, Human
ucaugcccacccccug

SEQ ID NO: 2668224 - RNA, 18 nt, Human
ucaugcccacccccugcc

SEQ ID NO: 2668225 - RNA, 19 nt, Human
ucaugcccacccccugccc

SEQ ID NO: 2668226 - RNA, 20 nt, Human
ucaugcccacccccugcccu

SEQ ID NO: 2668227 - RNA, 21 nt, Human
ucaugcccacccccugcccug

SEQ ID NO: 2668228 - RNA, 22 nt, Human
ucaugcccacccccugcccugc

SEQ ID NO: 2668229 - RNA, 16 nt, Human
ucauuaaacuuuuuua

SEQ ID NO: 2668230 - RNA, 17 nt, Human
ucauuaaacuuuuuuaa

SEQ ID NO: 2668231 - RNA, 15 nt, Human
ucauuaaagacagga

SEQ ID NO: 2668232 - RNA, 19 nt, Human
ucauguugaucauguacuu

SEQ ID NO: 2668233 - RNA, 21 nt, Human
ucauguugaucauguacuuuu

SEQ ID NO: 2668234 - RNA, 20 nt, Human
ucaugugugcaacaggguau

SEQ ID NO: 2668235 - RNA, 21 nt, Human
ucauguccaaacguccucuuu

SEQ ID NO: 2668236 - RNA, 17 nt, Human
ucaggguaaauaggaau

SEQ ID NO: 2668237 - RNA, 17 nt, Human
acccgacauaagucgag

SEQ ID NO: 2668238 - RNA, 21 nt, Human
acccgaccccccgugggcucc

SEQ ID NO: 2668239 - RNA, 23 nt, Human
acccgaccccccgugggcucccg

SEQ ID NO: 2668240 - RNA, 15 nt, Human
accccuucucuccuc

SEQ ID NO: 2668241 - RNA, 17 nt, Human
accccuucucuccuccc

SEQ ID NO: 2668242 - RNA, 23 nt, Human
accccuucucuccuccccaaauc

SEQ ID NO: 2668243 - RNA, 17 nt, Human
acccucuuccugugauc

SEQ ID NO: 2668244 - RNA, 19 nt, Human
acccucuuccugugaucca

SEQ ID NO: 2668245 - RNA, 20 nt, Human
acccucuuccugugauccac

SEQ ID NO: 2668246 - RNA, 18 nt, Human
acccucuugcccauccug

SEQ ID NO: 2668247 - RNA, 22 nt, Human
acccucuugcccauccugacug

SEQ ID NO: 2668248 - RNA, 23 nt, Human
acccucuugcccauccugacuga

SEQ ID NO: 2668249 - RNA, 15 nt, Human
acccucuuccuguga

SEQ ID NO: 2668250 - RNA, 16 nt, Human
acccucuuccugugau

SEQ ID NO: 2668251 - RNA, 14 nt, Human
acccucuuagaaaa

SEQ ID NO: 2668252 - RNA, 16 nt, Human
ucagaugccacuucua

SEQ ID NO: 2668253 - RNA, 19 nt, Human
ucagaugccacuucuaaga

SEQ ID NO: 2668254 - RNA, 20 nt, Human
ucagaugccacuucuaagaa

SEQ ID NO: 2668255 - RNA, 16 nt, Human
ucagauguuuaaaaca

SEQ ID NO: 2668256 - RNA, 17 nt, Human
ucagauguuuaaaacac

SEQ ID NO: 2668257 - RNA, 15 nt, Human
ucagauguuuaaaac

SEQ ID NO: 2668258 - RNA, 13 nt, Human
ucagauguuuaaa

SEQ ID NO: 2668259 - RNA, 16 nt, Human
ucagcccccugcuuca

SEQ ID NO: 2668260 - RNA, 17 nt, Human
ucagcccccugcuucag

SEQ ID NO: 2668261 - RNA, 18 nt, Human
acccagucaccucugucu

SEQ ID NO: 2668262 - RNA, 9 nt, Human
acccagugc

SEQ ID NO: 2668263 - RNA, 12 nt, Human
acccagugcaga

SEQ ID NO: 2668264 - RNA, 17 nt, Human
acccagugcagaaugua

SEQ ID NO: 2668265 - RNA, 18 nt, Human
acccagugcagaauguaa

SEQ ID NO: 2668266 - RNA, 13 nt, Human
acccccucccacc

SEQ ID NO: 2668267 - RNA, 14 nt, Human
acccccucccaccc

SEQ ID NO: 2668268 - RNA, 16 nt, Human
acccccucccaccccc

SEQ ID NO: 2668269 - RNA, 17 nt, Human
acccccucccaccccca

SEQ ID NO: 2668270 - RNA, 19 nt, Human
acccccucccacccccagc

SEQ ID NO: 2668271 - RNA, 20 nt, Human
acccccguggggcagggagc

SEQ ID NO: 2668272 - RNA, 12 nt, Human
ucagccugggca

SEQ ID NO: 2668273 - RNA, 10 nt, Human
ucagccuggg

SEQ ID NO: 2668274 - RNA, 13 nt, Human
accccuuccagau

SEQ ID NO: 2668275 - RNA, 15 nt, Human
accccuuccagauca

SEQ ID NO: 2668276 - RNA, 21 nt, Human
accccuuccagaucacugcca

SEQ ID NO: 2668277 - RNA, 16 nt, Human
accccuuccagaucac

SEQ ID NO: 2668278 - RNA, 20 nt, Human
accccuuccagaucacugcc

SEQ ID NO: 2668279 - RNA, 22 nt, Human
accaugauuaaccacuucagcu

SEQ ID NO: 2668280 - RNA, 23 nt, Human
accaugauuaaccacuucagcug

SEQ ID NO: 2668281 - RNA, 17 nt, Human
accauuuuuuaauuuac

SEQ ID NO: 2668282 - RNA, 23 nt, Human
accauuuuuuaauuuacuuguuu

SEQ ID NO: 2668283 - RNA, 19 nt, Human
acccaaccccaagccagcc

SEQ ID NO: 2668284 - RNA, 17 nt, Human
acccaacccuaucuccu

SEQ ID NO: 2668285 - RNA, 18 nt, Human
acccaacccuaucuccug

SEQ ID NO: 2668286 - RNA, 20 nt, Human
acccaacccuaucuccugac

SEQ ID NO: 2668287 - RNA, 22 nt, Human
acccaacccuaucuccugacag

SEQ ID NO: 2668288 - RNA, 13 nt, Human
accagggccuuuu

SEQ ID NO: 2668289 - RNA, 16 nt, Human
accagggccuuuucug

SEQ ID NO: 2668290 - RNA, 21 nt, Human
accagggccuuuucuggcacc

SEQ ID NO: 2668291 - RNA, 23 nt, Human
accagggccuuuucuggcaccgc

SEQ ID NO: 2668292 - RNA, 18 nt, Human
ucacuguaucauuuucuu

SEQ ID NO: 2668293 - RNA, 14 nt, Human
ucaccugccuguua

SEQ ID NO: 2668294 - RNA, 12 nt, Human
ucaccugccugu

SEQ ID NO: 2668295 - RNA, 13 nt, Human
uauuucagugaau

SEQ ID NO: 2668296 - RNA, 13 nt, Human
uauuucaucacaa

SEQ ID NO: 2668297 - RNA, 20 nt, Human
uauuucaucacaagaacaca

SEQ ID NO: 2668298 - RNA, 13 nt, Human
accacacuugaaa

SEQ ID NO: 2668299 - RNA, 17 nt, Human
accacacuugaaaccuu

SEQ ID NO: 2668300 - RNA, 16 nt, Human
accacagccagcaccu

SEQ ID NO: 2668301 - RNA, 17 nt, Human
accacaucaaauaagaa

SEQ ID NO: 2668302 - RNA, 23 nt, Human
accacagcaacgaucacaaauga

SEQ ID NO: 2668303 - RNA, 14 nt, Human
accacuucagcuga

SEQ ID NO: 2668304 - RNA, 13 nt, Human
accacuucagcug

SEQ ID NO: 2668305 - RNA, 15 nt, Human
accacuucagcugac

SEQ ID NO: 2668306 - RNA, 14 nt, Human
accacucgugcauc

SEQ ID NO: 2668307 - RNA, 17 nt, Human
accacucgugcaucccu

SEQ ID NO: 2668308 - RNA, 21 nt, Human
accacucgugcaucccugaga

SEQ ID NO: 2668309 - RNA, 14 nt, Human
accaggccaccucc

SEQ ID NO: 2668310 - RNA, 17 nt, Human
accaggccaccucccca

SEQ ID NO: 2668311 - RNA, 15 nt, Human
accaggccauucugc

SEQ ID NO: 2668312 - RNA, 12 nt, Human
accaggccaccu

SEQ ID NO: 2668313 - RNA, 16 nt, Human
accaggcaccucuucc

SEQ ID NO: 2668314 - RNA, 17 nt, Human
accaggcaccucuuccu

SEQ ID NO: 2668315 - RNA, 21 nt, Human
ugagccagugcuuuaauggca

SEQ ID NO: 2668316 - RNA, 20 nt, Human
agcaagugagacccugucuc

SEQ ID NO: 2668317 - RNA, 13 nt, Human
agcacagcagcuu

SEQ ID NO: 2668318 - RNA, 20 nt, Human
agcaaguucugagagccagg

SEQ ID NO: 2668319 - RNA, 16 nt, Human
agcaaguuacagugau

SEQ ID NO: 2668320 - RNA, 23 nt, Human
agcaagugugaauacugcuugaa

SEQ ID NO: 2668321 - RNA, 13 nt, Human
agcaagugguccu

SEQ ID NO: 2668322 - RNA, 21 nt, Human
agcaagugugaauacugcuug

SEQ ID NO: 2668323 - RNA, 15 nt, Human
agcaagugugaauac

SEQ ID NO: 2668324 - RNA, 19 nt, Human
agcacagucugaugacaca

SEQ ID NO: 2668325 - RNA, 16 nt, Human
agcacauauggaauuu

SEQ ID NO: 2668326 - RNA, 18 nt, Human
agcaacgaucacaaauga

SEQ ID NO: 2668327 - RNA, 15 nt, Human
agcaaccuacccagc

SEQ ID NO: 2668328 - RNA, 22 nt, Human
agcaacgaucacaaaugacuuu

SEQ ID NO: 2668329 - RNA, 21 nt, Human
agcaacgaucacaaaugacuu

SEQ ID NO: 2668330 - RNA, 20 nt, Human
agcaacgaucacaaaugacu

SEQ ID NO: 2668331 - RNA, 19 nt, Human
agcaacgaucacaaaugac

SEQ ID NO: 2668332 - RNA, 14 nt, Human
ugagcacuuuucaa

SEQ ID NO: 2668333 - RNA, 13 nt, Human
agcacuuuucaaa

SEQ ID NO: 2668334 - RNA, 17 nt, Human
agcacuuugggaggccg

SEQ ID NO: 2668335 - RNA, 20 nt, Human
agcacuuugggaggccgagg

SEQ ID NO: 2668336 - RNA, 21 nt, Human
agcacuuugggaggccgaggc

SEQ ID NO: 2668337 - RNA, 23 nt, Human
agcagaaaaaggcugugcugccc

SEQ ID NO: 2668338 - RNA, 23 nt, Human
agcacuuugggaggccaaggugg

SEQ ID NO: 2668339 - RNA, 22 nt, Human
agcacuuugggaggccaaggug

SEQ ID NO: 2668340 - RNA, 15 nt, Human
agcaccuugugccug

SEQ ID NO: 2668341 - RNA, 16 nt, Human
agcaccuugugccugg

SEQ ID NO: 2668342 - RNA, 17 nt, Human
agcaccuugugccuggg

SEQ ID NO: 2668343 - RNA, 18 nt, Human
agcaccuugugccugggg

SEQ ID NO: 2668344 - RNA, 19 nt, Human
agcaccuugugccuggggu

SEQ ID NO: 2668345 - RNA, 16 nt, Human
ugagccugggaaauaa

SEQ ID NO: 2668346 - RNA, 22 nt, Human
ugagccugggaggucaaggcug

SEQ ID NO: 2668347 - RNA, 19 nt, Human
ugagccugggaggucaagg

SEQ ID NO: 2668348 - RNA, 16 nt, Human
ugagccuggcaagaau

SEQ ID NO: 2668349 - RNA, 11 nt, Human
ugagccuggca

SEQ ID NO: 2668350 - RNA, 14 nt, Human
ugagccugggaggu

SEQ ID NO: 2668351 - RNA, 11 nt, Human
agcagacauuu

SEQ ID NO: 2668352 - RNA, 10 nt, Human
ugagccuggc

SEQ ID NO: 2668353 - RNA, 16 nt, Human
ugagguauuuuuuccu

SEQ ID NO: 2668354 - RNA, 15 nt, Human
agcagcaaauuuuca

SEQ ID NO: 2668355 - RNA, 20 nt, Human
agcagcaaauuuucagcauu

SEQ ID NO: 2668356 - RNA, 13 nt, Human
agcagaggaccag

SEQ ID NO: 2668357 - RNA, 14 nt, Human
agcagaggaccagg

SEQ ID NO: 2668358 - RNA, 16 nt, Human
agcagaggaccagggc

SEQ ID NO: 2668359 - RNA, 17 nt, Human
agcagaggaccagggcc

SEQ ID NO: 2668360 - RNA, 18 nt, Human
agcagaggaccagggccu

SEQ ID NO: 2668361 - RNA, 17 nt, Human
agcagaggaaggagagg

SEQ ID NO: 2668362 - RNA, 13 nt, Human
agcagaguuuuca

SEQ ID NO: 2668363 - RNA, 15 nt, Human
agcagaguuuucauu

SEQ ID NO: 2668364 - RNA, 19 nt, Human
agcagaguuuucauuaaau

SEQ ID NO: 2668365 - RNA, 23 nt, Human
agcagaguuuucauuaaauccuu

SEQ ID NO: 2668366 - RNA, 22 nt, Human
ugaggggucccuagcagcccac

SEQ ID NO: 2668367 - RNA, 13 nt, Human
ugagggcugcagu

SEQ ID NO: 2668368 - RNA, 13 nt, Human
ugagggcuuguag

SEQ ID NO: 2668369 - RNA, 22 nt, Human
ugagggccaaaauauuuggaau

SEQ ID NO: 2668370 - RNA, 14 nt, Human
ugagggaggggaaa

SEQ ID NO: 2668371 - RNA, 18 nt, Human
ugagggcagacuggggca

SEQ ID NO: 2668372 - RNA, 22 nt, Human
ugaggccguugcugacuuagaa

SEQ ID NO: 2668373 - RNA, 21 nt, Human
ugaggccguugcugacuuaga

SEQ ID NO: 2668374 - RNA, 20 nt, Human
ugaggccguugcugacuuag

SEQ ID NO: 2668375 - RNA, 14 nt, Human
ugaggccguugcug

SEQ ID NO: 2668376 - RNA, 19 nt, Human
ugaggccguugcugacuua

SEQ ID NO: 2668377 - RNA, 17 nt, Human
ugaggccguugcugacu

SEQ ID NO: 2668378 - RNA, 16 nt, Human
ugaggccaagaauauu

SEQ ID NO: 2668379 - RNA, 19 nt, Human
ugaggccaagaauauugca

SEQ ID NO: 2668380 - RNA, 21 nt, Human
ugaggccaagaauauugcaaa

SEQ ID NO: 2668381 - RNA, 18 nt, Human
ugagcgccuccauccaag

SEQ ID NO: 2668382 - RNA, 23 nt, Human
ugagcgccuccauccaaggccag

SEQ ID NO: 2668383 - RNA, 20 nt, Human
ugagcgccuccauccaaggc

SEQ ID NO: 2668384 - RNA, 16 nt, Human
ugagcuaggaagaguc

SEQ ID NO: 2668385 - RNA, 19 nt, Human
ugagcuaugacuuaacaua

SEQ ID NO: 2668386 - RNA, 15 nt, Human
ugagcuaugacuuaa

SEQ ID NO: 2668387 - RNA, 14 nt, Human
ugagcuaugacuua

SEQ ID NO: 2668388 - RNA, 15 nt, Human
ugaggaaaucaaagu

SEQ ID NO: 2668389 - RNA, 18 nt, Human
ugaggaaaucaaagugcu

SEQ ID NO: 2668390 - RNA, 16 nt, Human
ugaggaaaucaaagug

SEQ ID NO: 2668391 - RNA, 22 nt, Human
ugaggaaaucaaagugcuauua

SEQ ID NO: 2668392 - RNA, 19 nt, Human
ugaggaacuguagaugaug

SEQ ID NO: 2668393 - RNA, 21 nt, Human
ugaggaacuguagaugaugua

SEQ ID NO: 2668394 - RNA, 15 nt, Human
ugaggaaaauucuua

SEQ ID NO: 2668395 - RNA, 17 nt, Human
ugaauaucuauuaauau

SEQ ID NO: 2668396 - RNA, 16 nt, Human
ugaauaucuauuaaua

SEQ ID NO: 2668397 - RNA, 15 nt, Human
ugaaugccacugccu

SEQ ID NO: 2668398 - RNA, 14 nt, Human
ugaauaucuauuaa

SEQ ID NO: 2668399 - RNA, 21 nt, Human
ugaaugccacugccuucgcuu

SEQ ID NO: 2668400 - RNA, 22 nt, Human
ugaaugccacugccuucgcuuc

SEQ ID NO: 2668401 - RNA, 12 nt, Human
ugaauauaugau

SEQ ID NO: 2668402 - RNA, 23 nt, Human
ugaauguauuuauuugggagacc

SEQ ID NO: 2668403 - RNA, 19 nt, Human
ugaauguauuuauuuggga

SEQ ID NO: 2668404 - RNA, 21 nt, Human
agagucuaauagucuuugcca

SEQ ID NO: 2668405 - RNA, 17 nt, Human
ugaauguauuuauuugg

SEQ ID NO: 2668406 - RNA, 15 nt, Human
ugaauguauuuauuu

SEQ ID NO: 2668407 - RNA, 19 nt, Human
agaucacuguuuagauuug

SEQ ID NO: 2668408 - RNA, 18 nt, Human
agaucacuguuuagauuu

SEQ ID NO: 2668409 - RNA, 17 nt, Human
agaucacuguuuagauu

SEQ ID NO: 2668410 - RNA, 16 nt, Human
agaucacuguuuagau

SEQ ID NO: 2668411 - RNA, 15 nt, Human
agaucacuguuuaga

SEQ ID NO: 2668412 - RNA, 14 nt, Human
agaucacugccaca

SEQ ID NO: 2668413 - RNA, 16 nt, Human
agauauuuuucauaaa

SEQ ID NO: 2668414 - RNA, 19 nt, Human
agauaccuuaucuuacaau

SEQ ID NO: 2668415 - RNA, 22 nt, Human
agauaccuuaucuuacaauauu

SEQ ID NO: 2668416 - RNA, 14 nt, Human
agauaccuccaacc

SEQ ID NO: 2668417 - RNA, 19 nt, Human
agauaccuccaacccugcc

SEQ ID NO: 2668418 - RNA, 20 nt, Human
agauaccuccaacccugccg

SEQ ID NO: 2668419 - RNA, 20 nt, Human
agaguuuugucauucagagu

SEQ ID NO: 2668420 - RNA, 15 nt, Human
agauaauuucagggu

SEQ ID NO: 2668421 - RNA, 16 nt, Human
agauaauuucagggug

SEQ ID NO: 2668422 - RNA, 17 nt, Human
agauaauuacugccuug

SEQ ID NO: 2668423 - RNA, 19 nt, Human
agauaauuacugccuugaa

SEQ ID NO: 2668424 - RNA, 14 nt, Human
ugaagccaucuaaa

SEQ ID NO: 2668425 - RNA, 18 nt, Human
ugaagcugcccuaauaaa

SEQ ID NO: 2668426 - RNA, 13 nt, Human
ugaagcuucaugc

SEQ ID NO: 2668427 - RNA, 14 nt, Human
ugaagcuucaugca

SEQ ID NO: 2668428 - RNA, 21 nt, Human
ugaagcuucaugcacuuaaag

SEQ ID NO: 2668429 - RNA, 17 nt, Human
ugaagcauagauaauau

SEQ ID NO: 2668430 - RNA, 22 nt, Human
ugaagcauagauaauauuguuu

SEQ ID NO: 2668431 - RNA, 13 nt, Human
agaggugggccag

SEQ ID NO: 2668432 - RNA, 13 nt, Human
ugaagcagccucu

SEQ ID NO: 2668433 - RNA, 15 nt, Human
ugaagcagccucucc

SEQ ID NO: 2668434 - RNA, 20 nt, Human
ugaagcagccucuccccagg

SEQ ID NO: 2668435 - RNA, 20 nt, Human
agagggacggccaagaaugu

SEQ ID NO: 2668436 - RNA, 21 nt, Human
agagggacggccaagaaugua

SEQ ID NO: 2668437 - RNA, 22 nt, Human
agagggacggccaagaauguac

SEQ ID NO: 2668438 - RNA, 11 nt, Human
agaggcaccag

SEQ ID NO: 2668439 - RNA, 17 nt, Human
agaggcaccaggaagcc

SEQ ID NO: 2668440 - RNA, 13 nt, Human
agaggcaccagga

SEQ ID NO: 2668441 - RNA, 14 nt, Human
agaggcaccaggaa

SEQ ID NO: 2668442 - RNA, 19 nt, Human
agaggcuagcuucugcuuu

SEQ ID NO: 2668443 - RNA, 17 nt, Human
agaggcuagcuucugcu

SEQ ID NO: 2668444 - RNA, 16 nt, Human
agaggcuagcuucugc

SEQ ID NO: 2668445 - RNA, 14 nt, Human
agaggcuuguuuac

SEQ ID NO: 2668446 - RNA, 19 nt, Human
agaggcuuguuuaccuuuc

SEQ ID NO: 2668447 - RNA, 20 nt, Human
ugaagaacugcaggcccugg

SEQ ID NO: 2668448 - RNA, 23 nt, Human
ugaagaacugcaggcccuggccu

SEQ ID NO: 2668449 - RNA, 18 nt, Human
agaggcaacugcauuggc

SEQ ID NO: 2668450 - RNA, 13 nt, Human
agagcuggcucug

SEQ ID NO: 2668451 - RNA, 12 nt, Human
agagcuggcucu

SEQ ID NO: 2668452 - RNA, 15 nt, Human
agagcuggcucugag

SEQ ID NO: 2668453 - RNA, 16 nt, Human
agagcuggcucugagc

SEQ ID NO: 2668454 - RNA, 17 nt, Human
agauguccuaaugguga

SEQ ID NO: 2668455 - RNA, 19 nt, Human
agaugcuccagcaacacag

SEQ ID NO: 2668456 - RNA, 16 nt, Human
agaugcuucucacugc

SEQ ID NO: 2668457 - RNA, 18 nt, Human
agaugcuucucacugcca

SEQ ID NO: 2668458 - RNA, 19 nt, Human
agauguguggacuguggca

SEQ ID NO: 2668459 - RNA, 23 nt, Human
ugaccccgguggcggccccagca

SEQ ID NO: 2668460 - RNA, 12 nt, Human
agaugauguauu

SEQ ID NO: 2668461 - RNA, 16 nt, Human
agaucgagaccauccu

SEQ ID NO: 2668462 - RNA, 17 nt, Human
agaucgagaccauccug

SEQ ID NO: 2668463 - RNA, 18 nt, Human
agaucgagaccauccugg

SEQ ID NO: 2668464 - RNA, 20 nt, Human
agaucgagaccauccuggcu

SEQ ID NO: 2668465 - RNA, 21 nt, Human
agaucgagaccauccuggcua

SEQ ID NO: 2668466 - RNA, 16 nt, Human
agaucauuuugaaauu

SEQ ID NO: 2668467 - RNA, 12 nt, Human
agauccaaagac

SEQ ID NO: 2668468 - RNA, 13 nt, Human
agauccaaagacu

SEQ ID NO: 2668469 - RNA, 14 nt, Human
agauccaaagacuc

SEQ ID NO: 2668470 - RNA, 17 nt, Human
ugaauuuacuuccuugc

SEQ ID NO: 2668471 - RNA, 21 nt, Human
ugaauuuacuuccuugcaugu

SEQ ID NO: 2668472 - RNA, 20 nt, Human
agaucacuguuuagauuugc

SEQ ID NO: 2668473 - RNA, 18 nt, Human
ugacuucugccuggagac

SEQ ID NO: 2668474 - RNA, 12 nt, Human
ugacuucugccu

SEQ ID NO: 2668475 - RNA, 13 nt, Human
ugacuucugccug

SEQ ID NO: 2668476 - RNA, 15 nt, Human
ugacuucugccugga

SEQ ID NO: 2668477 - RNA, 16 nt, Human
ugacuucugccuggag

SEQ ID NO: 2668478 - RNA, 20 nt, Human
ugacuuuauuauuuauuuuu

SEQ ID NO: 2668479 - RNA, 17 nt, Human
ugacuuuauuauuuauu

SEQ ID NO: 2668480 - RNA, 16 nt, Human
ugacuuuauuauuuau

SEQ ID NO: 2668481 - RNA, 15 nt, Human
ugacuuuauuauuua

SEQ ID NO: 2668482 - RNA, 15 nt, Human
agauugguuuuccug

SEQ ID NO: 2668483 - RNA, 20 nt, Human
agauugugaucccuugagau

SEQ ID NO: 2668484 - RNA, 20 nt, Human
agauuuaaucugccaagggc

SEQ ID NO: 2668485 - RNA, 19 nt, Human
agauuuauuuuuuggacuu

SEQ ID NO: 2668486 - RNA, 21 nt, Human
agauuugccauagaguacacu

SEQ ID NO: 2668487 - RNA, 19 nt, Human
agauuugccauagaguaca

SEQ ID NO: 2668488 - RNA, 18 nt, Human
agauuugccauagaguac

SEQ ID NO: 2668489 - RNA, 21 nt, Human
agcaacacagccugggcccca

SEQ ID NO: 2668490 - RNA, 13 nt, Human
agcaacacagccu

SEQ ID NO: 2668491 - RNA, 15 nt, Human
agcaacacagccugg

SEQ ID NO: 2668492 - RNA, 17 nt, Human
agcaacacagccugggc

SEQ ID NO: 2668493 - RNA, 18 nt, Human
agcaacacagccugggcc

SEQ ID NO: 2668494 - RNA, 17 nt, Human
agauuuuccucuuguga

SEQ ID NO: 2668495 - RNA, 20 nt, Human
agauuuuccucuugugauuu

SEQ ID NO: 2668496 - RNA, 22 nt, Human
ucuccuuccaguauaaccagcu

SEQ ID NO: 2668497 - RNA, 18 nt, Human
ucucugccauaucaguga

SEQ ID NO: 2668498 - RNA, 20 nt, Human
ucucugcauuuaaaaaaauc

SEQ ID NO: 2668499 - RNA, 16 nt, Human
ucucuccagauguuuc

SEQ ID NO: 2668500 - RNA, 13 nt, Human
ucucuccagaugu

SEQ ID NO: 2668501 - RNA, 14 nt, Human
ucucuugagagggu

SEQ ID NO: 2668502 - RNA, 13 nt, Human
ucucugcuauaua

SEQ ID NO: 2668503 - RNA, 13 nt, Human
agaaaacugugau

SEQ ID NO: 2668504 - RNA, 14 nt, Human
agaaaacugugauu

SEQ ID NO: 2668505 - RNA, 16 nt, Human
agaaaacugugauuuc

SEQ ID NO: 2668506 - RNA, 19 nt, Human
agaaaaauaaaaaucucuu

SEQ ID NO: 2668507 - RNA, 15 nt, Human
agaaaaauaacccuu

SEQ ID NO: 2668508 - RNA, 17 nt, Human
agaaaaaugagccuggc

SEQ ID NO: 2668509 - RNA, 15 nt, Human
ucucuugagccuggg

SEQ ID NO: 2668510 - RNA, 14 nt, Human
ucucuugagccugg

SEQ ID NO: 2668511 - RNA, 13 nt, Human
ucucuugagccug

SEQ ID NO: 2668512 - RNA, 19 nt, Human
acuuuuguguaaugaaaau

SEQ ID NO: 2668513 - RNA, 18 nt, Human
acuuuuguguaaugaaaa

SEQ ID NO: 2668514 - RNA, 16 nt, Human
acuuuuguacugaauu

SEQ ID NO: 2668515 - RNA, 17 nt, Human
acuuuuguacugaauuu

SEQ ID NO: 2668516 - RNA, 18 nt, Human
acuuuuguacugaauuuu

SEQ ID NO: 2668517 - RNA, 14 nt, Human
acuuugggggagga

SEQ ID NO: 2668518 - RNA, 16 nt, Human
acuuuuuuaaauauuu

SEQ ID NO: 2668519 - RNA, 18 nt, Human
acuuuuuuaaauauuuuc

SEQ ID NO: 2668520 - RNA, 19 nt, Human
acuuuuuuaaauauuuucu

SEQ ID NO: 2668521 - RNA, 13 nt, Human
acuuuuuuuguau

SEQ ID NO: 2668522 - RNA, 14 nt, Human
acuuuuuuuguaug

SEQ ID NO: 2668523 - RNA, 16 nt, Human
acuuuuuuuguaugug

SEQ ID NO: 2668524 - RNA, 17 nt, Human
acuuuuuuuguaugugu

SEQ ID NO: 2668525 - RNA, 16 nt, Human
acuuugggaggccgag

SEQ ID NO: 2668526 - RNA, 21 nt, Human
acuuugggaggccgaggcggg

SEQ ID NO: 2668527 - RNA, 12 nt, Human
acuuugggaggc

SEQ ID NO: 2668528 - RNA, 19 nt, Human
acuuugggaaaacauguua

SEQ ID NO: 2668529 - RNA, 18 nt, Human
acuuugagccugggaaau

SEQ ID NO: 2668530 - RNA, 21 nt, Human
acuuguugccuauaagccaaa

SEQ ID NO: 2668531 - RNA, 16 nt, Human
acuuguugccuauaag

SEQ ID NO: 2668532 - RNA, 21 nt, Human
ucuccggcucccagccucagc

SEQ ID NO: 2668533 - RNA, 15 nt, Human
acuuguugccuauaa

SEQ ID NO: 2668534 - RNA, 16 nt, Human
ucuccguuagcuccug

SEQ ID NO: 2668535 - RNA, 17 nt, Human
ucuccguuagcuccugu

SEQ ID NO: 2668536 - RNA, 18 nt, Human
ucuccguuagcuccugug

SEQ ID NO: 2668537 - RNA, 19 nt, Human
ucuccguuagcuccugugg

SEQ ID NO: 2668538 - RNA, 14 nt, Human
ucuccggcucccag

SEQ ID NO: 2668539 - RNA, 16 nt, Human
ucuccggcucccagcc

SEQ ID NO: 2668540 - RNA, 15 nt, Human
ucuccggcucccagc

SEQ ID NO: 2668541 - RNA, 22 nt, Human
ucuccggcucccagccucagcg

SEQ ID NO: 2668542 - RNA, 16 nt, Human
ucuccggggccauuug

SEQ ID NO: 2668543 - RNA, 19 nt, Human
ucuccggggccauuugcaa

SEQ ID NO: 2668544 - RNA, 18 nt, Human
ucuccggcucccagccuc

SEQ ID NO: 2668545 - RNA, 17 nt, Human
ucuccggcucccagccu

SEQ ID NO: 2668546 - RNA, 13 nt, Human
ucuccgccagccu

SEQ ID NO: 2668547 - RNA, 14 nt, Human
ucuccgccagccuc

SEQ ID NO: 2668548 - RNA, 15 nt, Human
ucuccgccagccucc

SEQ ID NO: 2668549 - RNA, 18 nt, Human
ucuccgccagccuccucu

SEQ ID NO: 2668550 - RNA, 20 nt, Human
ucuccgccagccuccucugg

SEQ ID NO: 2668551 - RNA, 21 nt, Human
ucuccgccagccuccucugga

SEQ ID NO: 2668552 - RNA, 14 nt, Human
ucuccggccucucc

SEQ ID NO: 2668553 - RNA, 17 nt, Human
ucuccggccucuccagc

SEQ ID NO: 2668554 - RNA, 18 nt, Human
ucuccggccucuccagcc

SEQ ID NO: 2668555 - RNA, 21 nt, Human
ucuccggccucuccagccuca

SEQ ID NO: 2668556 - RNA, 19 nt, Human
acuguagcuuuuaggaaua

SEQ ID NO: 2668557 - RNA, 17 nt, Human
ucucccagguaccagcu

SEQ ID NO: 2668558 - RNA, 18 nt, Human
ucucccagguaccagcug

SEQ ID NO: 2668559 - RNA, 19 nt, Human
ucucccagguaccagcugc

SEQ ID NO: 2668560 - RNA, 13 nt, Human
ucuccauuugcuc

SEQ ID NO: 2668561 - RNA, 16 nt, Human
ucuccauuugcucuuc

SEQ ID NO: 2668562 - RNA, 23 nt, Human
ucuccauuugcucuucagaugcc

SEQ ID NO: 2668563 - RNA, 18 nt, Human
ucucccaaaaaacuacuu

SEQ ID NO: 2668564 - RNA, 19 nt, Human
ucuccauugugccuaaguc

SEQ ID NO: 2668565 - RNA, 15 nt, Human
acuguagaugaugua

SEQ ID NO: 2668566 - RNA, 15 nt, Human
acuguagauauguau

SEQ ID NO: 2668567 - RNA, 20 nt, Human
acuguagauauguauucuuu

SEQ ID NO: 2668568 - RNA, 13 nt, Human
acuguagaugaug

SEQ ID NO: 2668569 - RNA, 13 nt, Human
acuguagggaggg

SEQ ID NO: 2668570 - RNA, 18 nt, Human
agaagccuguaacacucc

SEQ ID NO: 2668571 - RNA, 19 nt, Human
agaagccuguaacacuccu

SEQ ID NO: 2668572 - RNA, 20 nt, Human
agaagccuguaacacuccuc

SEQ ID NO: 2668573 - RNA, 22 nt, Human
agaagccuguaacacuccucug

SEQ ID NO: 2668574 - RNA, 12 nt, Human
agaagccuucag

SEQ ID NO: 2668575 - RNA, 13 nt, Human
agaagccuucagc

SEQ ID NO: 2668576 - RNA, 14 nt, Human
agaagccuucagcu

SEQ ID NO: 2668577 - RNA, 17 nt, Human
agaagccuucagcucca

SEQ ID NO: 2668578 - RNA, 18 nt, Human
agaagccuucagcuccag

SEQ ID NO: 2668579 - RNA, 14 nt, Human
ucuggcccuagacu

SEQ ID NO: 2668580 - RNA, 13 nt, Human
ucuggcccuagac

SEQ ID NO: 2668581 - RNA, 11 nt, Human
agaagcugcag

SEQ ID NO: 2668582 - RNA, 12 nt, Human
agaagcugcagg

SEQ ID NO: 2668583 - RNA, 13 nt, Human
agaagcugcaggc

SEQ ID NO: 2668584 - RNA, 15 nt, Human
agaagcugcaggcuu

SEQ ID NO: 2668585 - RNA, 19 nt, Human
agaagcugcauccagaggc

SEQ ID NO: 2668586 - RNA, 21 nt, Human
agaagcugccaggugagaaac

SEQ ID NO: 2668587 - RNA, 22 nt, Human
agaagcugccaggugagaaacu

SEQ ID NO: 2668588 - RNA, 23 nt, Human
agaagcugccaggugagaaacug

SEQ ID NO: 2668589 - RNA, 22 nt, Human
agaagcgauuaugaaagcaaca

SEQ ID NO: 2668590 - RNA, 19 nt, Human
agaagccuucagcuccagg

SEQ ID NO: 2668591 - RNA, 16 nt, Human
agaagcggcuggcagc

SEQ ID NO: 2668592 - RNA, 15 nt, Human
agaagcggcuggcag

SEQ ID NO: 2668593 - RNA, 22 nt, Human
ucugcuucucugacuucugccu

SEQ ID NO: 2668594 - RNA, 16 nt, Human
ucugcuucucugacuu

SEQ ID NO: 2668595 - RNA, 19 nt, Human
ucugcuucucugacuucug

SEQ ID NO: 2668596 - RNA, 14 nt, Human
ucugcuucucugac

SEQ ID NO: 2668597 - RNA, 16 nt, Human
ucugcuguccuugccu

SEQ ID NO: 2668598 - RNA, 14 nt, Human
ucugcuauauauaa

SEQ ID NO: 2668599 - RNA, 15 nt, Human
ucugcuauauauaaa

SEQ ID NO: 2668600 - RNA, 16 nt, Human
ucugcuauauauaaaa

SEQ ID NO: 2668601 - RNA, 15 nt, Human
ucugccgucucugga

SEQ ID NO: 2668602 - RNA, 16 nt, Human
ucugccgucucuggag

SEQ ID NO: 2668603 - RNA, 22 nt, Human
ucugccggacccggaggccgag

SEQ ID NO: 2668604 - RNA, 18 nt, Human
ucugccgcccccuccuga

SEQ ID NO: 2668605 - RNA, 16 nt, Human
ucugccggugcucgga

SEQ ID NO: 2668606 - RNA, 21 nt, Human
ucugccggugcucggagaaga

SEQ ID NO: 2668607 - RNA, 14 nt, Human
ucugccgucucugg

SEQ ID NO: 2668608 - RNA, 15 nt, Human
agaacuccaggcccu

SEQ ID NO: 2668609 - RNA, 16 nt, Human
agaacuccaggcccuc

SEQ ID NO: 2668610 - RNA, 17 nt, Human
agaacuccaggcccucc

SEQ ID NO: 2668611 - RNA, 18 nt, Human
agaacucgcgcucaguaa

SEQ ID NO: 2668612 - RNA, 20 nt, Human
agaacucgcgcucaguaaac

SEQ ID NO: 2668613 - RNA, 21 nt, Human
agaacucgcgcucaguaaacg

SEQ ID NO: 2668614 - RNA, 14 nt, Human
agaacucuggcuuu

SEQ ID NO: 2668615 - RNA, 20 nt, Human
agaacucuggcuuuuggaag

SEQ ID NO: 2668616 - RNA, 20 nt, Human
agaacugaaaggcuuuucaa

SEQ ID NO: 2668617 - RNA, 16 nt, Human
agaacugaaaggcuuu

SEQ ID NO: 2668618 - RNA, 16 nt, Human
agaacucacuggggcc

SEQ ID NO: 2668619 - RNA, 19 nt, Human
agaacucacuggggccuac

SEQ ID NO: 2668620 - RNA, 16 nt, Human
agaacguuuuuuccuc

SEQ ID NO: 2668621 - RNA, 20 nt, Human
agaacguuuuuuccucagug

SEQ ID NO: 2668622 - RNA, 22 nt, Human
agaaauguugagucuguacuaa

SEQ ID NO: 2668623 - RNA, 16 nt, Human
agaaauguauaaacuu

SEQ ID NO: 2668624 - RNA, 20 nt, Human
agaaauguauaaacuuuaga

SEQ ID NO: 2668625 - RNA, 13 nt, Human
agaaccuaacaug

SEQ ID NO: 2668626 - RNA, 11 nt, Human
agaaauuuuca

SEQ ID NO: 2668627 - RNA, 13 nt, Human
agaaauuuucaag

SEQ ID NO: 2668628 - RNA, 13 nt, Human
agaaauuuuguaa

SEQ ID NO: 2668629 - RNA, 14 nt, Human
agaaauuuuguaag

SEQ ID NO: 2668630 - RNA, 16 nt, Human
agaaauuuuguaagaa

SEQ ID NO: 2668631 - RNA, 17 nt, Human
agaaauuuuguaagaag

SEQ ID NO: 2668632 - RNA, 21 nt, Human
agaaauuuuguaagaaggcaa

SEQ ID NO: 2668633 - RNA, 22 nt, Human
agaaauuuuguaagaaggcaau

SEQ ID NO: 2668634 - RNA, 16 nt, Human
agaaauuguauauugu

SEQ ID NO: 2668635 - RNA, 17 nt, Human
agaaauuguauauugua

SEQ ID NO: 2668636 - RNA, 20 nt, Human
agaaauuguauauuguaauu

SEQ ID NO: 2668637 - RNA, 21 nt, Human
agaaauuguauauuguaauuu

SEQ ID NO: 2668638 - RNA, 14 nt, Human
agaaauuguauauu

SEQ ID NO: 2668639 - RNA, 14 nt, Human
ucugagaaaacaag

SEQ ID NO: 2668640 - RNA, 12 nt, Human
ucugagaaaaca

SEQ ID NO: 2668641 - RNA, 17 nt, Human
ucugagggcuuguaguu

SEQ ID NO: 2668642 - RNA, 16 nt, Human
ucugagggaaauguuu

SEQ ID NO: 2668643 - RNA, 17 nt, Human
ucugagggaaauguuuu

SEQ ID NO: 2668644 - RNA, 18 nt, Human
ucugagggaaauguuuug

SEQ ID NO: 2668645 - RNA, 22 nt, Human
ucugagggaaauguuuuguaaa

SEQ ID NO: 2668646 - RNA, 20 nt, Human
ucugagggcuuguaguucuu

SEQ ID NO: 2668647 - RNA, 19 nt, Human
ucugagggcuuguaguucu

SEQ ID NO: 2668648 - RNA, 12 nt, Human
ucugagggggag

SEQ ID NO: 2668649 - RNA, 12 nt, Human
ucugacuucugc

SEQ ID NO: 2668650 - RNA, 19 nt, Human
ucugacuucugccuggaga

SEQ ID NO: 2668651 - RNA, 20 nt, Human
ucugacuucugccuggagac

SEQ ID NO: 2668652 - RNA, 14 nt, Human
ucugacuucugccu

SEQ ID NO: 2668653 - RNA, 15 nt, Human
ucugacuucugccug

SEQ ID NO: 2668654 - RNA, 16 nt, Human
ucugacuucugccugg

SEQ ID NO: 2668655 - RNA, 17 nt, Human
ucugacuucugccugga

SEQ ID NO: 2668656 - RNA, 22 nt, Human
agaaagaauuuaguauuaucaa

SEQ ID NO: 2668657 - RNA, 16 nt, Human
ucuugcaagcaugcuu

SEQ ID NO: 2668658 - RNA, 17 nt, Human
ucuugcaagcaugcuug

SEQ ID NO: 2668659 - RNA, 21 nt, Human
agaccgugaagauacuuugua

SEQ ID NO: 2668660 - RNA, 20 nt, Human
agaccgugaagauacuuugu

SEQ ID NO: 2668661 - RNA, 19 nt, Human
agaccgugaagauacuuug

SEQ ID NO: 2668662 - RNA, 22 nt, Human
agacccugggugggcucugugc

SEQ ID NO: 2668663 - RNA, 17 nt, Human
agacccugggugggcuc

SEQ ID NO: 2668664 - RNA, 19 nt, Human
agacccugggugggcucug

SEQ ID NO: 2668665 - RNA, 20 nt, Human
agacccugggugggcucugu

SEQ ID NO: 2668666 - RNA, 14 nt, Human
agacccucuugccc

SEQ ID NO: 2668667 - RNA, 15 nt, Human
agacccucuugccca

SEQ ID NO: 2668668 - RNA, 18 nt, Human
agacccucuugcccaucc

SEQ ID NO: 2668669 - RNA, 19 nt, Human
agacccucuugcccauccu

SEQ ID NO: 2668670 - RNA, 20 nt, Human
agacccucuugcccauccug

SEQ ID NO: 2668671 - RNA, 17 nt, Human
ucuuccuaucccucucc

SEQ ID NO: 2668672 - RNA, 19 nt, Human
ucuuccuaucccucuccua

SEQ ID NO: 2668673 - RNA, 22 nt, Human
ucuuccuaucccucuccuaacu

SEQ ID NO: 2668674 - RNA, 23 nt, Human
ucuuccucaaaauaaagaaguau

SEQ ID NO: 2668675 - RNA, 15 nt, Human
ucuuuaaacugucgu

SEQ ID NO: 2668676 - RNA, 16 nt, Human
ucuuggcaauaaauuu

SEQ ID NO: 2668677 - RNA, 24 nt, Human
ucuuggcaauaaauuuugaaaagu

SEQ ID NO: 2668678 - RNA, 18 nt, Human
ucuuuaaaaggaaagaaa

SEQ ID NO: 2668679 - RNA, 22 nt, Human
ucuuggcaauaaauuuugaaaa

SEQ ID NO: 2668680 - RNA, 20 nt, Human
ucuuggcaauaaauuuugaa

SEQ ID NO: 2668681 - RNA, 19 nt, Human
ucuuggcaauaaauuuuga

SEQ ID NO: 2668682 - RNA, 17 nt, Human
ucuuggcaauaaauuuu

SEQ ID NO: 2668683 - RNA, 19 nt, Human
ucuuuaccuguauacagug

SEQ ID NO: 2668684 - RNA, 15 nt, Human
ucuuuaggagauuua

SEQ ID NO: 2668685 - RNA, 16 nt, Human
ucuuuaggagauuuau

SEQ ID NO: 2668686 - RNA, 17 nt, Human
agacucggggugcuucc

SEQ ID NO: 2668687 - RNA, 14 nt, Human
agacucggggugcu

SEQ ID NO: 2668688 - RNA, 22 nt, Human
agacucggggugcuuccuugua

SEQ ID NO: 2668689 - RNA, 18 nt, Human
agagaaugaguccuugau

SEQ ID NO: 2668690 - RNA, 10 nt, Human
agagaaugag

SEQ ID NO: 2668691 - RNA, 17 nt, Human
agacuuugaugucagca

SEQ ID NO: 2668692 - RNA, 14 nt, Human
agacuuugauguca

SEQ ID NO: 2668693 - RNA, 18 nt, Human
agacuuugaugucagcag

SEQ ID NO: 2668694 - RNA, 19 nt, Human
agacugugcuguuguucuc

SEQ ID NO: 2668695 - RNA, 17 nt, Human
agacuguuaaaugaaac

SEQ ID NO: 2668696 - RNA, 18 nt, Human
agacuguuaaaugaaacc

SEQ ID NO: 2668697 - RNA, 19 nt, Human
agacuguggcuagugacaa

SEQ ID NO: 2668698 - RNA, 16 nt, Human
agacuugccagagccg

SEQ ID NO: 2668699 - RNA, 13 nt, Human
agacuuugauguc

SEQ ID NO: 2668700 - RNA, 11 nt, Human
agacuuugaug

SEQ ID NO: 2668701 - RNA, 21 nt, Human
agacuugaaaagagacaggca

SEQ ID NO: 2668702 - RNA, 20 nt, Human
agacuugaaaagagacaggc

SEQ ID NO: 2668703 - RNA, 22 nt, Human
agacuugaaaagagacaggcag

SEQ ID NO: 2668704 - RNA, 19 nt, Human
agacuugaaaagagacagg

SEQ ID NO: 2668705 - RNA, 18 nt, Human
agacuugaaaagagacag

SEQ ID NO: 2668706 - RNA, 17 nt, Human
agacuugaaaagagaca

SEQ ID NO: 2668707 - RNA, 15 nt, Human
agacuugaaaagaga

SEQ ID NO: 2668708 - RNA, 12 nt, Human
agacuugaaaag

SEQ ID NO: 2668709 - RNA, 17 nt, Human
ucuuagaucauaguuuu

SEQ ID NO: 2668710 - RNA, 16 nt, Human
ucuuagaucauaguuu

SEQ ID NO: 2668711 - RNA, 14 nt, Human
ucuucaaagccuuc

SEQ ID NO: 2668712 - RNA, 17 nt, Human
ucuucaaagccuucucc

SEQ ID NO: 2668713 - RNA, 18 nt, Human
ucuucaccuccugccagc

SEQ ID NO: 2668714 - RNA, 14 nt, Human
ucuucagagaaauc

SEQ ID NO: 2668715 - RNA, 14 nt, Human
agacagcuuuucuc

SEQ ID NO: 2668716 - RNA, 15 nt, Human
agacagcuuuucuca

SEQ ID NO: 2668717 - RNA, 18 nt, Human
agacagcuuuucucaacu

SEQ ID NO: 2668718 - RNA, 19 nt, Human
agacagcuuuucucaacug

SEQ ID NO: 2668719 - RNA, 19 nt, Human
agacacccucaaccucuuc

SEQ ID NO: 2668720 - RNA, 20 nt, Human
agacacuaacgaaauaucaa

SEQ ID NO: 2668721 - RNA, 21 nt, Human
agacacccucaaccucuucug

SEQ ID NO: 2668722 - RNA, 20 nt, Human
agacaggcaggugaucugcu

SEQ ID NO: 2668723 - RNA, 19 nt, Human
ucuuaauauguucuuuuaa

SEQ ID NO: 2668724 - RNA, 16 nt, Human
ucuuaaggacaaagug

SEQ ID NO: 2668725 - RNA, 19 nt, Human
ucuuaaggacaaagugcca

SEQ ID NO: 2668726 - RNA, 12 nt, Human
ucuuaagcuucc

SEQ ID NO: 2668727 - RNA, 15 nt, Human
agacagguccugauu

SEQ ID NO: 2668728 - RNA, 16 nt, Human
ucuguuuccugacauu

SEQ ID NO: 2668729 - RNA, 20 nt, Human
ucuguuuccugacauugucu

SEQ ID NO: 2668730 - RNA, 14 nt, Human
agaauuuaguauua

SEQ ID NO: 2668731 - RNA, 16 nt, Human
agaauuuaguauuauc

SEQ ID NO: 2668732 - RNA, 19 nt, Human
agaauuuaguauuaucaaa

SEQ ID NO: 2668733 - RNA, 21 nt, Human
agaauuuaaagaaaaaaaugu

SEQ ID NO: 2668734 - RNA, 13 nt, Human
agaauuuaaagaa

SEQ ID NO: 2668735 - RNA, 12 nt, Human
agaauuuaaaga

SEQ ID NO: 2668736 - RNA, 15 nt, Human
ucugugcccuccuga

SEQ ID NO: 2668737 - RNA, 20 nt, Human
ucugugccucccuccccagu

SEQ ID NO: 2668738 - RNA, 16 nt, Human
ucugugccuucgucuu

SEQ ID NO: 2668739 - RNA, 22 nt, Human
ucugugccuucuuuugauuaug

SEQ ID NO: 2668740 - RNA, 18 nt, Human
ucugugccuucuuuugau

SEQ ID NO: 2668741 - RNA, 14 nt, Human
ucugucuuuccuga

SEQ ID NO: 2668742 - RNA, 21 nt, Human
ucugucuuuccugaaccaugu

SEQ ID NO: 2668743 - RNA, 11 nt, Human
ucugucuuucc

SEQ ID NO: 2668744 - RNA, 21 nt, Human
ucuggggcaggcugggccaug

SEQ ID NO: 2668745 - RNA, 17 nt, Human
ucuggggcaggcugggc

SEQ ID NO: 2668746 - RNA, 18 nt, Human
ucuggggcaggcugggcc

SEQ ID NO: 2668747 - RNA, 19 nt, Human
ucuggggcaggcugggcca

SEQ ID NO: 2668748 - RNA, 20 nt, Human
ucuggggcaggcugggccau

SEQ ID NO: 2668749 - RNA, 20 nt, Human
ucuggucaagggcugucauu

SEQ ID NO: 2668750 - RNA, 15 nt, Human
ucuggucgcuccugc

SEQ ID NO: 2668751 - RNA, 17 nt, Human
ucuggucgcuccugccc

SEQ ID NO: 2668752 - RNA, 16 nt, Human
ucuggguccuuccuga

SEQ ID NO: 2668753 - RNA, 20 nt, Human
ucuguagcuauaaugagcau

SEQ ID NO: 2668754 - RNA, 14 nt, Human
ucuggucucgaacu

SEQ ID NO: 2668755 - RNA, 9 nt, Human
agccugcua

SEQ ID NO: 2668756 - RNA, 13 nt, Human
agccugcuagcua

SEQ ID NO: 2668757 - RNA, 12 nt, Human
agccugcuagcu

SEQ ID NO: 2668758 - RNA, 15 nt, Human
agccugcgccugcug

SEQ ID NO: 2668759 - RNA, 14 nt, Human
agccugcgccugcu

SEQ ID NO: 2668760 - RNA, 20 nt, Human
agccugcgccugcugcaugc

SEQ ID NO: 2668761 - RNA, 18 nt, Human
agccugcgccugcugcau

SEQ ID NO: 2668762 - RNA, 17 nt, Human
agccugcgccugcugca

SEQ ID NO: 2668763 - RNA, 16 nt, Human
agccugcgccugcugc

SEQ ID NO: 2668764 - RNA, 18 nt, Human
agccugcuagcuagcuca

SEQ ID NO: 2668765 - RNA, 17 nt, Human
agccugcuagcuagcuc

SEQ ID NO: 2668766 - RNA, 13 nt, Human
agcgccagccuca

SEQ ID NO: 2668767 - RNA, 19 nt, Human
agcgccagccucagacugg

SEQ ID NO: 2668768 - RNA, 21 nt, Human
agcggagguugcagugagcug

SEQ ID NO: 2668769 - RNA, 22 nt, Human
agcggagguugcagugagcuga

SEQ ID NO: 2668770 - RNA, 18 nt, Human
agcgcggcccucccgagu

SEQ ID NO: 2668771 - RNA, 15 nt, Human
agcgcgccccuagcc

SEQ ID NO: 2668772 - RNA, 15 nt, Human
agcgcggcccucccg

SEQ ID NO: 2668773 - RNA, 17 nt, Human
agcgcggacgugcuggg

SEQ ID NO: 2668774 - RNA, 14 nt, Human
ugccacacucucca

SEQ ID NO: 2668775 - RNA, 20 nt, Human
ugccacuuuacccaccuaga

SEQ ID NO: 2668776 - RNA, 20 nt, Human
ugccacuucacuccagccug

SEQ ID NO: 2668777 - RNA, 21 nt, Human
ugccacuuuacccaccuagaa

SEQ ID NO: 2668778 - RNA, 22 nt, Human
ugccacuuuacccaccuagaac

SEQ ID NO: 2668779 - RNA, 22 nt, Human
ugccacugccuucgcuucuugc

SEQ ID NO: 2668780 - RNA, 19 nt, Human
ugccacugccuucgcuucu

SEQ ID NO: 2668781 - RNA, 21 nt, Human
ugccacugccuucgcuucuug

SEQ ID NO: 2668782 - RNA, 15 nt, Human
ugccacuuccuuuua

SEQ ID NO: 2668783 - RNA, 16 nt, Human
ugccacuucuaagaaa

SEQ ID NO: 2668784 - RNA, 23 nt, Human
ugccacuucuaagaaaagccuaa

SEQ ID NO: 2668785 - RNA, 18 nt, Human
ugccacacucuccaucac

SEQ ID NO: 2668786 - RNA, 13 nt, Human
agcgggcgccugu

SEQ ID NO: 2668787 - RNA, 15 nt, Human
agcuacuagcaaaau

SEQ ID NO: 2668788 - RNA, 17 nt, Human
agcuacuagcaaaauaa

SEQ ID NO: 2668789 - RNA, 23 nt, Human
ugcccaagccagaggcuggguuc

SEQ ID NO: 2668790 - RNA, 22 nt, Human
ugccauuacagagguauuaaaa

SEQ ID NO: 2668791 - RNA, 21 nt, Human
ugccauguuggccaggcuggu

SEQ ID NO: 2668792 - RNA, 17 nt, Human
agcuauugccaaccagu

SEQ ID NO: 2668793 - RNA, 15 nt, Human
agcuauuuaugggcc

SEQ ID NO: 2668794 - RNA, 16 nt, Human
agcuauuuaugggccc

SEQ ID NO: 2668795 - RNA, 17 nt, Human
agcuauuuaugggcccc

SEQ ID NO: 2668796 - RNA, 22 nt, Human
agcuauuuaugggccccuggca

SEQ ID NO: 2668797 - RNA, 11 nt, Human
agcuauauaag

SEQ ID NO: 2668798 - RNA, 17 nt, Human
agcuauauaagacaaga

SEQ ID NO: 2668799 - RNA, 12 nt, Human
agcuaugacuua

SEQ ID NO: 2668800 - RNA, 17 nt, Human
agcuaugcaaaaagcua

SEQ ID NO: 2668801 - RNA, 13 nt, Human
agcuaugcaaaaa

SEQ ID NO: 2668802 - RNA, 16 nt, Human
agcuaugacuuaacau

SEQ ID NO: 2668803 - RNA, 20 nt, Human
agcuaguugaauacuugaac

SEQ ID NO: 2668804 - RNA, 19 nt, Human
agcuaguugaauacuugaa

SEQ ID NO: 2668805 - RNA, 23 nt, Human
agcuaguugaauacuugaaccau

SEQ ID NO: 2668806 - RNA, 22 nt, Human
agcuaguugaauacuugaacca

SEQ ID NO: 2668807 - RNA, 24 nt, Human
agcuaguugaauacuugaaccaua

SEQ ID NO: 2668808 - RNA, 22 nt, Human
agcuauaaagcaguauuuuucu

SEQ ID NO: 2668809 - RNA, 22 nt, Human
ugcccaagccagaggcuggguu

SEQ ID NO: 2668810 - RNA, 22 nt, Human
ugcccccaccccggggacccug

SEQ ID NO: 2668811 - RNA, 23 nt, Human
ugcccccaccccggggacccugu

SEQ ID NO: 2668812 - RNA, 14 nt, Human
ugcccccagccccg

SEQ ID NO: 2668813 - RNA, 16 nt, Human
ugcccccagccccggg

SEQ ID NO: 2668814 - RNA, 20 nt, Human
ugcccccagccccgggguga

SEQ ID NO: 2668815 - RNA, 18 nt, Human
ugcacuaaaucagagaca

SEQ ID NO: 2668816 - RNA, 19 nt, Human
ugcacuccagccugggcga

SEQ ID NO: 2668817 - RNA, 15 nt, Human
ugcacgucaugggag

SEQ ID NO: 2668818 - RNA, 19 nt, Human
ugcaccaccaagccaaggg

SEQ ID NO: 2668819 - RNA, 16 nt, Human
ugcaccaccaagccaa

SEQ ID NO: 2668820 - RNA, 18 nt, Human
ugcaccaccaagccaagg

SEQ ID NO: 2668821 - RNA, 14 nt, Human
ugcaccacugcacu

SEQ ID NO: 2668822 - RNA, 12 nt, Human
ugcaccaccaag

SEQ ID NO: 2668823 - RNA, 14 nt, Human
ugcaccaccaagcc

SEQ ID NO: 2668824 - RNA, 15 nt, Human
ugcaccaccaagcca

SEQ ID NO: 2668825 - RNA, 14 nt, Human
ugcacaagcugcac

SEQ ID NO: 2668826 - RNA, 21 nt, Human
ugcacaugacucggggguggg

SEQ ID NO: 2668827 - RNA, 17 nt, Human
ugcacaauuuugauaaa

SEQ ID NO: 2668828 - RNA, 12 nt, Human
agccuaaucaca

SEQ ID NO: 2668829 - RNA, 14 nt, Human
agccuauggcagaa

SEQ ID NO: 2668830 - RNA, 16 nt, Human
agccuauggcagaaaa

SEQ ID NO: 2668831 - RNA, 19 nt, Human
agccuauggcagaaaaaau

SEQ ID NO: 2668832 - RNA, 13 nt, Human
ugcagagauuucu

SEQ ID NO: 2668833 - RNA, 17 nt, Human
ugcacuccagccugggg

SEQ ID NO: 2668834 - RNA, 18 nt, Human
ugcacuccagccuggggg

SEQ ID NO: 2668835 - RNA, 19 nt, Human
ugcaguuugagacaggaga

SEQ ID NO: 2668836 - RNA, 22 nt, Human
ugcagucuuagaucauaguuuu

SEQ ID NO: 2668837 - RNA, 14 nt, Human
ugcagugagccgag

SEQ ID NO: 2668838 - RNA, 22 nt, Human
ugcaucugaaauaggaaacaag

SEQ ID NO: 2668839 - RNA, 19 nt, Human
agccugccucuucucuacu

SEQ ID NO: 2668840 - RNA, 16 nt, Human
agccugccucuucucu

SEQ ID NO: 2668841 - RNA, 23 nt, Human
agccugcccagcccccuggucuu

SEQ ID NO: 2668842 - RNA, 12 nt, Human
agccugcccagc

SEQ ID NO: 2668843 - RNA, 19 nt, Human
agccugcagggaagcccca

SEQ ID NO: 2668844 - RNA, 23 nt, Human
agccugcagggaagccccacaug

SEQ ID NO: 2668845 - RNA, 18 nt, Human
agccugaugagauuuuua

SEQ ID NO: 2668846 - RNA, 19 nt, Human
agccugaugagauuuuuaa

SEQ ID NO: 2668847 - RNA, 16 nt, Human
agccugauauugauau

SEQ ID NO: 2668848 - RNA, 14 nt, Human
agcugggcagguug

SEQ ID NO: 2668849 - RNA, 11 nt, Human
agcugggcccg

SEQ ID NO: 2668850 - RNA, 16 nt, Human
agcugggcccgacaug

SEQ ID NO: 2668851 - RNA, 21 nt, Human
agcugggcccgacauggcucc

SEQ ID NO: 2668852 - RNA, 22 nt, Human
agcugggcccgacauggcuccg

SEQ ID NO: 2668853 - RNA, 15 nt, Human
agcugggccgggacc

SEQ ID NO: 2668854 - RNA, 18 nt, Human
agcugggccgggacccag

SEQ ID NO: 2668855 - RNA, 20 nt, Human
ugcgaagacccucuugccca

SEQ ID NO: 2668856 - RNA, 13 nt, Human
ugcgacccugggg

SEQ ID NO: 2668857 - RNA, 14 nt, Human
ugcgacccuggggg

SEQ ID NO: 2668858 - RNA, 15 nt, Human
ugcgacccugggggc

SEQ ID NO: 2668859 - RNA, 19 nt, Human
ugcgacccugggggcacag

SEQ ID NO: 2668860 - RNA, 21 nt, Human
ugcgacccugggggcacagga

SEQ ID NO: 2668861 - RNA, 19 nt, Human
ugcgaaaggaugaaaguga

SEQ ID NO: 2668862 - RNA, 15 nt, Human
ugcgacuuucugccu

SEQ ID NO: 2668863 - RNA, 16 nt, Human
ugcgacuuucugccug

SEQ ID NO: 2668864 - RNA, 17 nt, Human
ugcgacuuucugccugg

SEQ ID NO: 2668865 - RNA, 18 nt, Human
ugcgacuuucugccugga

SEQ ID NO: 2668866 - RNA, 21 nt, Human
ugcgacuuucugccuggagug

SEQ ID NO: 2668867 - RNA, 13 nt, Human
ugccuuuuuauuu

SEQ ID NO: 2668868 - RNA, 15 nt, Human
ugccuuuuuauuuau

SEQ ID NO: 2668869 - RNA, 19 nt, Human
ugccuuuuuauuuauaugu

SEQ ID NO: 2668870 - RNA, 21 nt, Human
ugccuuuuuauuuauauguac

SEQ ID NO: 2668871 - RNA, 13 nt, Human
ugcgaaaggauga

SEQ ID NO: 2668872 - RNA, 22 nt, Human
ugccuguguccaugcgcucagg

SEQ ID NO: 2668873 - RNA, 12 nt, Human
ugccugugugcg

SEQ ID NO: 2668874 - RNA, 16 nt, Human
agcucucuccucccuu

SEQ ID NO: 2668875 - RNA, 14 nt, Human
agcucugccgucuc

SEQ ID NO: 2668876 - RNA, 17 nt, Human
agcucugccgucucugg

SEQ ID NO: 2668877 - RNA, 18 nt, Human
agcucugccgucucugga

SEQ ID NO: 2668878 - RNA, 19 nt, Human
agcucugccgucucuggag

SEQ ID NO: 2668879 - RNA, 20 nt, Human
agcucugccgucucuggagc

SEQ ID NO: 2668880 - RNA, 22 nt, Human
agcugaucugcggaucucagcu

SEQ ID NO: 2668881 - RNA, 18 nt, Human
agcucuucuuaaaguauu

SEQ ID NO: 2668882 - RNA, 17 nt, Human
agcugcacccucaggca

SEQ ID NO: 2668883 - RNA, 13 nt, Human
agcugcacccuca

SEQ ID NO: 2668884 - RNA, 22 nt, Human
agcugcacccucaggcaggugg

SEQ ID NO: 2668885 - RNA, 20 nt, Human
agcugcacccucaggcaggu

SEQ ID NO: 2668886 - RNA, 19 nt, Human
agcugcacccucaggcagg

SEQ ID NO: 2668887 - RNA, 18 nt, Human
agcugcacccucaggcag

SEQ ID NO: 2668888 - RNA, 13 nt, Human
ugcccuugggcca

SEQ ID NO: 2668889 - RNA, 20 nt, Human
ugccgccugcacuccucagg

SEQ ID NO: 2668890 - RNA, 16 nt, Human
ugccgccugcacuccu

SEQ ID NO: 2668891 - RNA, 23 nt, Human
ugccggacccggaggccgaggcc

SEQ ID NO: 2668892 - RNA, 16 nt, Human
ugccuccaggugcaga

SEQ ID NO: 2668893 - RNA, 17 nt, Human
ugccuccaggugcagag

SEQ ID NO: 2668894 - RNA, 21 nt, Human
ugccuccaggugcagagguac

SEQ ID NO: 2668895 - RNA, 16 nt, Human
ugccucccacuucacu

SEQ ID NO: 2668896 - RNA, 17 nt, Human
ugccucccacuucacug

SEQ ID NO: 2668897 - RNA, 17 nt, Human
aggaaagaggaagcaaa

SEQ ID NO: 2668898 - RNA, 13 nt, Human
aggaaagaaaaca

SEQ ID NO: 2668899 - RNA, 12 nt, Human
aggaaagaaaac

SEQ ID NO: 2668900 - RNA, 22 nt, Human
aggaaacuccacaucugccuua

SEQ ID NO: 2668901 - RNA, 16 nt, Human
aggaaacuccacaucu

SEQ ID NO: 2668902 - RNA, 19 nt, Human
aggaaacuccacaucugcc

SEQ ID NO: 2668903 - RNA, 20 nt, Human
aggaaacuccacaucugccu

SEQ ID NO: 2668904 - RNA, 21 nt, Human
aggaaacuccacaucugccuu

SEQ ID NO: 2668905 - RNA, 16 nt, Human
aggaaaauaguaaugu

SEQ ID NO: 2668906 - RNA, 23 nt, Human
aggaaaccgaguagaaaauguga

SEQ ID NO: 2668907 - RNA, 19 nt, Human
agcuuugaaaauucagugg

SEQ ID NO: 2668908 - RNA, 18 nt, Human
agcuuugaaaauucagug

SEQ ID NO: 2668909 - RNA, 16 nt, Human
agcuuugaaaauucag

SEQ ID NO: 2668910 - RNA, 12 nt, Human
agcuuugaaaau

SEQ ID NO: 2668911 - RNA, 15 nt, Human
agcuuauaaugggcu

SEQ ID NO: 2668912 - RNA, 22 nt, Human
agcuuauuguuucucugaaagu

SEQ ID NO: 2668913 - RNA, 16 nt, Human
agcuuggauuaaauac

SEQ ID NO: 2668914 - RNA, 17 nt, Human
agcuuggauuaaauaca

SEQ ID NO: 2668915 - RNA, 18 nt, Human
agcuuggauuaaauacau

SEQ ID NO: 2668916 - RNA, 23 nt, Human
agcuuuccuguugaaugacaaag

SEQ ID NO: 2668917 - RNA, 15 nt, Human
agcuuaucucagggg

SEQ ID NO: 2668918 - RNA, 14 nt, Human
agcuuaucucaggg

SEQ ID NO: 2668919 - RNA, 12 nt, Human
agcuuaucucag

SEQ ID NO: 2668920 - RNA, 17 nt, Human
ugcuaccuuucaaagcu

SEQ ID NO: 2668921 - RNA, 18 nt, Human
ugcuaccuuucaaagcuu

SEQ ID NO: 2668922 - RNA, 16 nt, Human
aggaaugaaaaaagcu

SEQ ID NO: 2668923 - RNA, 13 nt, Human
aggaauccuggca

SEQ ID NO: 2668924 - RNA, 14 nt, Human
aggaauccuggcag

SEQ ID NO: 2668925 - RNA, 15 nt, Human
aggaauccuggcagc

SEQ ID NO: 2668926 - RNA, 16 nt, Human
aggaauccuggcagcc

SEQ ID NO: 2668927 - RNA, 18 nt, Human
aggaauccuggcagccca

SEQ ID NO: 2668928 - RNA, 19 nt, Human
aggaauccuggcagcccag

SEQ ID NO: 2668929 - RNA, 20 nt, Human
aggaauccuggcagcccaga

SEQ ID NO: 2668930 - RNA, 13 nt, Human
aggaaaucaaagu

SEQ ID NO: 2668931 - RNA, 19 nt, Human
aggaaaucaaagugcuauu

SEQ ID NO: 2668932 - RNA, 14 nt, Human
aggaaaucaaagug

SEQ ID NO: 2668933 - RNA, 14 nt, Human
aggaagagaaaaaa

SEQ ID NO: 2668934 - RNA, 17 nt, Human
aggacaaagugccaaag

SEQ ID NO: 2668935 - RNA, 18 nt, Human
aggacaaagugccaaaga

SEQ ID NO: 2668936 - RNA, 19 nt, Human
aggacaaagugccaaagaa

SEQ ID NO: 2668937 - RNA, 20 nt, Human
aggacaaagugccaaagaaa

SEQ ID NO: 2668938 - RNA, 21 nt, Human
aggacaaagugccaaagaaag

SEQ ID NO: 2668939 - RNA, 22 nt, Human
aggacaaagugccaaagaaagu

SEQ ID NO: 2668940 - RNA, 19 nt, Human
ugcugccauuacagaggua

SEQ ID NO: 2668941 - RNA, 16 nt, Human
ugcugacuguuuucuc

SEQ ID NO: 2668942 - RNA, 17 nt, Human
ugcugaggguuugaaua

SEQ ID NO: 2668943 - RNA, 24 nt, Human
ugcugacuguuuucucuugagagg

SEQ ID NO: 2668944 - RNA, 21 nt, Human
ugcugacuguuuucucuugag

SEQ ID NO: 2668945 - RNA, 16 nt, Human
aggaaagcaauaaaug

SEQ ID NO: 2668946 - RNA, 19 nt, Human
aggaaagcaauaaaugaau

SEQ ID NO: 2668947 - RNA, 18 nt, Human
aggaaagcaauaaaugaa

SEQ ID NO: 2668948 - RNA, 22 nt, Human
aggaaagcaauaaaugaauggg

SEQ ID NO: 2668949 - RNA, 17 nt, Human
ugcugacuguuuucucu

SEQ ID NO: 2668950 - RNA, 19 nt, Human
ugcuaucaacaauaaaauu

SEQ ID NO: 2668951 - RNA, 21 nt, Human
ugcuauauauaaaacggugcu

SEQ ID NO: 2668952 - RNA, 19 nt, Human
ugcuauccccaucucccug

SEQ ID NO: 2668953 - RNA, 20 nt, Human
ugcuauccccaucucccugc

SEQ ID NO: 2668954 - RNA, 21 nt, Human
ugcuauccccaucucccugcc

SEQ ID NO: 2668955 - RNA, 22 nt, Human
ugcuauccccaucucccugccu

SEQ ID NO: 2668956 - RNA, 12 nt, Human
aggcaggauggc

SEQ ID NO: 2668957 - RNA, 23 nt, Human
aggcagggagacgguuuccaggg

SEQ ID NO: 2668958 - RNA, 16 nt, Human
aggcagggaggcagcc

SEQ ID NO: 2668959 - RNA, 19 nt, Human
aggcagggaggcagccgcc

SEQ ID NO: 2668960 - RNA, 18 nt, Human
aggcaggagaauggugug

SEQ ID NO: 2668961 - RNA, 20 nt, Human
aggcagccucugucaggccu

SEQ ID NO: 2668962 - RNA, 21 nt, Human
aggcagccucugucaggccuu

SEQ ID NO: 2668963 - RNA, 16 nt, Human
aggcaccaggaagccg

SEQ ID NO: 2668964 - RNA, 14 nt, Human
aggcaccaggaagc

SEQ ID NO: 2668965 - RNA, 15 nt, Human
aggcaccaggaagcc

SEQ ID NO: 2668966 - RNA, 20 nt, Human
aggcaguuugaggauuaguu

SEQ ID NO: 2668967 - RNA, 15 nt, Human
aggcaguuugaggau

SEQ ID NO: 2668968 - RNA, 12 nt, Human
uggagccgaggc

SEQ ID NO: 2668969 - RNA, 17 nt, Human
uggagccgaggccuacc

SEQ ID NO: 2668970 - RNA, 11 nt, Human
aggcaccagga

SEQ ID NO: 2668971 - RNA, 12 nt, Human
aggcaccaggaa

SEQ ID NO: 2668972 - RNA, 13 nt, Human
aggcaccaggaag

SEQ ID NO: 2668973 - RNA, 22 nt, Human
uggaaguauguauauuaaaaaa

SEQ ID NO: 2668974 - RNA, 15 nt, Human
ugcugcccugaagaa

SEQ ID NO: 2668975 - RNA, 22 nt, Human
ugcugcccugaagaauggcgcc

SEQ ID NO: 2668976 - RNA, 18 nt, Human
uggaacaauauuuuaugg

SEQ ID NO: 2668977 - RNA, 14 nt, Human
ugcugcccccaccc

SEQ ID NO: 2668978 - RNA, 15 nt, Human
ugcugcccccacccc

SEQ ID NO: 2668979 - RNA, 22 nt, Human
ugcugcccccaccccggggacc

SEQ ID NO: 2668980 - RNA, 20 nt, Human
ugcugcccccaccccgggga

SEQ ID NO: 2668981 - RNA, 16 nt, Human
uggaaguguauuuauu

SEQ ID NO: 2668982 - RNA, 22 nt, Human
uggaaguguauuuauuuuacag

SEQ ID NO: 2668983 - RNA, 21 nt, Human
aggaguuugagaccaaccugg

SEQ ID NO: 2668984 - RNA, 19 nt, Human
aggauauucagauguaugu

SEQ ID NO: 2668985 - RNA, 19 nt, Human
aggcaacugcauuggcuuu

SEQ ID NO: 2668986 - RNA, 17 nt, Human
aggcaagagggggugga

SEQ ID NO: 2668987 - RNA, 21 nt, Human
aggcaagaggggguggagggg

SEQ ID NO: 2668988 - RNA, 15 nt, Human
uggaauuuugcaaag

SEQ ID NO: 2668989 - RNA, 22 nt, Human
uggaauuuugcaaagauuuaau

SEQ ID NO: 2668990 - RNA, 18 nt, Human
uggaauuuuuuuguacga

SEQ ID NO: 2668991 - RNA, 23 nt, Human
uggaauuuugcaaagauuuaauc

SEQ ID NO: 2668992 - RNA, 14 nt, Human
aggaucucuaaaga

SEQ ID NO: 2668993 - RNA, 17 nt, Human
aggaucucuaaagagca

SEQ ID NO: 2668994 - RNA, 19 nt, Human
aggaucucuaaagagcauc

SEQ ID NO: 2668995 - RNA, 23 nt, Human
aggauuuuaacuuaacugaaaug

SEQ ID NO: 2668996 - RNA, 17 nt, Human
aggcuaugugauuacaa

SEQ ID NO: 2668997 - RNA, 14 nt, Human
aggcuaugugauua

SEQ ID NO: 2668998 - RNA, 19 nt, Human
aggcuauguauaaaauaca

SEQ ID NO: 2668999 - RNA, 20 nt, Human
aggcuauguauaaaauacau

SEQ ID NO: 2669000 - RNA, 21 nt, Human
aggcuauguauaaaauacaua

SEQ ID NO: 2669001 - RNA, 14 nt, Human
aggcuauuuucuaa

SEQ ID NO: 2669002 - RNA, 17 nt, Human
aggcuauuuucuaaaga

SEQ ID NO: 2669003 - RNA, 18 nt, Human
aggcuauuuucuaaagac

SEQ ID NO: 2669004 - RNA, 19 nt, Human
aggcuauuuucuaaagacu

SEQ ID NO: 2669005 - RNA, 19 nt, Human
aggcgcugagacugugcug

SEQ ID NO: 2669006 - RNA, 22 nt, Human
aggcgcugcccaccugccggcc

SEQ ID NO: 2669007 - RNA, 15 nt, Human
aggcgaccaccgccc

SEQ ID NO: 2669008 - RNA, 22 nt, Human
aggcgaccaccgccccuggccg

SEQ ID NO: 2669009 - RNA, 19 nt, Human
aggccucuuguaaagacug

SEQ ID NO: 2669010 - RNA, 22 nt, Human
aggcucacugcaacuucugccu

SEQ ID NO: 2669011 - RNA, 12 nt, Human
aggcucacugcc

SEQ ID NO: 2669012 - RNA, 13 nt, Human
aggcucacugcca

SEQ ID NO: 2669013 - RNA, 14 nt, Human
aggcucacugccag

SEQ ID NO: 2669014 - RNA, 15 nt, Human
aggcucacugccagg

SEQ ID NO: 2669015 - RNA, 16 nt, Human
aggcucacugccaggc

SEQ ID NO: 2669016 - RNA, 17 nt, Human
aggcucacugccaggcc

SEQ ID NO: 2669017 - RNA, 19 nt, Human
aggcucacugccaggccag

SEQ ID NO: 2669018 - RNA, 20 nt, Human
aggcucacugccaggccagc

SEQ ID NO: 2669019 - RNA, 21 nt, Human
aggcucacugccaggccagcc

SEQ ID NO: 2669020 - RNA, 22 nt, Human
aggcucacugccaggccagccu

SEQ ID NO: 2669021 - RNA, 23 nt, Human
aggcucacugccaggccagccuc

SEQ ID NO: 2669022 - RNA, 24 nt, Human
aggcucacugccaggccagccucc

SEQ ID NO: 2669023 - RNA, 12 nt, Human
uggccucugcuu

SEQ ID NO: 2669024 - RNA, 11 nt, Human
uggccugcugu

SEQ ID NO: 2669025 - RNA, 14 nt, Human
uggccucugcuuuc

SEQ ID NO: 2669026 - RNA, 15 nt, Human
uggccuggacaguau

SEQ ID NO: 2669027 - RNA, 12 nt, Human
uggccugcugug

SEQ ID NO: 2669028 - RNA, 11 nt, Human
uggccuggaca

SEQ ID NO: 2669029 - RNA, 24 nt, Human
uggccugggccguaucuccggcuc

SEQ ID NO: 2669030 - RNA, 11 nt, Human
uggccugggcc

SEQ ID NO: 2669031 - RNA, 12 nt, Human
uggccuguggcu

SEQ ID NO: 2669032 - RNA, 16 nt, Human
uggccuguggcugucg

SEQ ID NO: 2669033 - RNA, 17 nt, Human
uggccuguggcugucgg

SEQ ID NO: 2669034 - RNA, 14 nt, Human
uggcccacugcauc

SEQ ID NO: 2669035 - RNA, 13 nt, Human
uggcccacugcau

SEQ ID NO: 2669036 - RNA, 20 nt, Human
uggcccacgccuguaauccc

SEQ ID NO: 2669037 - RNA, 19 nt, Human
uggcccacgcacuucggga

SEQ ID NO: 2669038 - RNA, 21 nt, Human
uggcaugguuuugugccaucu

SEQ ID NO: 2669039 - RNA, 22 nt, Human
uggcaugguuuugugccaucug

SEQ ID NO: 2669040 - RNA, 23 nt, Human
uggcaugguuuugugccaucugu

SEQ ID NO: 2669041 - RNA, 17 nt, Human
uggcauguaaauguaaa

SEQ ID NO: 2669042 - RNA, 19 nt, Human
uggcauguaaauguaaacu

SEQ ID NO: 2669043 - RNA, 23 nt, Human
aggccguugcugacuuagaaucc

SEQ ID NO: 2669044 - RNA, 21 nt, Human
aggccguugcugacuuagaau

SEQ ID NO: 2669045 - RNA, 18 nt, Human
aggccguugcugacuuag

SEQ ID NO: 2669046 - RNA, 16 nt, Human
aggccuaccccgcaga

SEQ ID NO: 2669047 - RNA, 19 nt, Human
aggccuaccccgcagacac

SEQ ID NO: 2669048 - RNA, 22 nt, Human
aggccuaccccgcagacaccuu

SEQ ID NO: 2669049 - RNA, 20 nt, Human
uggcagcaacggcacagcua

SEQ ID NO: 2669050 - RNA, 17 nt, Human
uggcaccagcagccugg

SEQ ID NO: 2669051 - RNA, 16 nt, Human
uggcaccagcagccug

SEQ ID NO: 2669052 - RNA, 13 nt, Human
uggcacacagcag

SEQ ID NO: 2669053 - RNA, 14 nt, Human
aggccaugugcaua

SEQ ID NO: 2669054 - RNA, 20 nt, Human
aggccaugugcauaguuucu

SEQ ID NO: 2669055 - RNA, 16 nt, Human
aggccauucugccgcc

SEQ ID NO: 2669056 - RNA, 14 nt, Human
aggcuccccugagg

SEQ ID NO: 2669057 - RNA, 15 nt, Human
aggcuccccugagga

SEQ ID NO: 2669058 - RNA, 13 nt, Human
uggcuauccugau

SEQ ID NO: 2669059 - RNA, 14 nt, Human
uggcuauccugauu

SEQ ID NO: 2669060 - RNA, 19 nt, Human
uggcucacgccuguaaucc

SEQ ID NO: 2669061 - RNA, 14 nt, Human
uggcucaccuuccg

SEQ ID NO: 2669062 - RNA, 14 nt, Human
uggcucacgccugu

SEQ ID NO: 2669063 - RNA, 13 nt, Human
uggcucacgccug

SEQ ID NO: 2669064 - RNA, 21 nt, Human
uggcugaaauucuccuggagg

SEQ ID NO: 2669065 - RNA, 22 nt, Human
uggcugaaauucuccuggaggu

SEQ ID NO: 2669066 - RNA, 24 nt, Human
uggcucagcucggggagccuuagc

SEQ ID NO: 2669067 - RNA, 16 nt, Human
uggcugaaauucuccu

SEQ ID NO: 2669068 - RNA, 18 nt, Human
uggcugaaauucuccugg

SEQ ID NO: 2669069 - RNA, 19 nt, Human
uggcugaaauucuccugga

SEQ ID NO: 2669070 - RNA, 20 nt, Human
uggcugaaauucuccuggag

SEQ ID NO: 2669071 - RNA, 14 nt, Human
uggcucagcucggg

SEQ ID NO: 2669072 - RNA, 18 nt, Human
uggcucagacauguuuuc

SEQ ID NO: 2669073 - RNA, 22 nt, Human
uggcucagcucggggagccuua

SEQ ID NO: 2669074 - RNA, 14 nt, Human
uggcuucacggaag

SEQ ID NO: 2669075 - RNA, 14 nt, Human
uggcuguuugagau

SEQ ID NO: 2669076 - RNA, 20 nt, Human
uggcuucacggaagagccuu

SEQ ID NO: 2669077 - RNA, 17 nt, Human
uggcuucacggaagagc

SEQ ID NO: 2669078 - RNA, 21 nt, Human
ugggaaaacauguuaaugaca

SEQ ID NO: 2669079 - RNA, 14 nt, Human
ugggaaaacauuug

SEQ ID NO: 2669080 - RNA, 18 nt, Human
ugggaaacuuggcucgaa

SEQ ID NO: 2669081 - RNA, 17 nt, Human
ugggaaaccauguagca

SEQ ID NO: 2669082 - RNA, 21 nt, Human
aggcuuguuuaccuuucucuc

SEQ ID NO: 2669083 - RNA, 22 nt, Human
aggcuuguuuaccuuucucucu

SEQ ID NO: 2669084 - RNA, 18 nt, Human
aggcuuucccacuuccca

SEQ ID NO: 2669085 - RNA, 22 nt, Human
aggcuuucccacuucccacccu

SEQ ID NO: 2669086 - RNA, 23 nt, Human
aggcuuucccacuucccacccug

SEQ ID NO: 2669087 - RNA, 22 nt, Human
aggcuuucuguugccaugguga

SEQ ID NO: 2669088 - RNA, 18 nt, Human
aggcuuugguaacugcgg

SEQ ID NO: 2669089 - RNA, 13 nt, Human
agggaaaaauaua

SEQ ID NO: 2669090 - RNA, 14 nt, Human
agggaaaaauauau

SEQ ID NO: 2669091 - RNA, 13 nt, Human
aggcuugaagcug

SEQ ID NO: 2669092 - RNA, 22 nt, Human
aggcuuccugcguccuccucac

SEQ ID NO: 2669093 - RNA, 14 nt, Human
aggcuucuccgcca

SEQ ID NO: 2669094 - RNA, 15 nt, Human
aggcuucuccgccag

SEQ ID NO: 2669095 - RNA, 16 nt, Human
aggcuucuccgccagc

SEQ ID NO: 2669096 - RNA, 17 nt, Human
aggcuucuccgccagcc

SEQ ID NO: 2669097 - RNA, 18 nt, Human
aggcuucuccgccagccu

SEQ ID NO: 2669098 - RNA, 19 nt, Human
aggcuucuccgccagccuc

SEQ ID NO: 2669099 - RNA, 20 nt, Human
aggcuucuccgccagccucc

SEQ ID NO: 2669100 - RNA, 21 nt, Human
aggcuucuccgccagccuccu

SEQ ID NO: 2669101 - RNA, 22 nt, Human
aggcuucuccgccagccuccuc

SEQ ID NO: 2669102 - RNA, 23 nt, Human
aggcuucuccgccagccuccucu

SEQ ID NO: 2669103 - RNA, 14 nt, Human
aggcuuaguuugug

SEQ ID NO: 2669104 - RNA, 10 nt, Human
aggcuuccug

SEQ ID NO: 2669105 - RNA, 20 nt, Human
aggcuuccugcguccuccuc

SEQ ID NO: 2669106 - RNA, 21 nt, Human
aggcuuccugcguccuccuca

SEQ ID NO: 2669107 - RNA, 15 nt, Human
aggcuuaguuugugu

SEQ ID NO: 2669108 - RNA, 14 nt, Human
aggcuuauaaaaca

SEQ ID NO: 2669109 - RNA, 16 nt, Human
aggcuuauaaaacaga

SEQ ID NO: 2669110 - RNA, 10 nt, Human
aggcugggcc

SEQ ID NO: 2669111 - RNA, 12 nt, Human
aggcugggccau

SEQ ID NO: 2669112 - RNA, 18 nt, Human
aggcugggccauguccaa

SEQ ID NO: 2669113 - RNA, 22 nt, Human
aggcugggccauguccaaagag

SEQ ID NO: 2669114 - RNA, 20 nt, Human
aggcugggccauguccaaag

SEQ ID NO: 2669115 - RNA, 21 nt, Human
aggcugggccauguccaaaga

SEQ ID NO: 2669116 - RNA, 22 nt, Human
aggcugggggaagaagcucucu

SEQ ID NO: 2669117 - RNA, 17 nt, Human
aggcugggggaagaagc

SEQ ID NO: 2669118 - RNA, 15 nt, Human
agggcugucauugca

SEQ ID NO: 2669119 - RNA, 14 nt, Human
agggcuggcuccug

SEQ ID NO: 2669120 - RNA, 16 nt, Human
agggcuggcuccugau

SEQ ID NO: 2669121 - RNA, 17 nt, Human
agggcuggcuccugauc

SEQ ID NO: 2669122 - RNA, 19 nt, Human
agggcuggcuccugaucca

SEQ ID NO: 2669123 - RNA, 13 nt, Human
ugggcucuccggg

SEQ ID NO: 2669124 - RNA, 14 nt, Human
ugggcucuccgggg

SEQ ID NO: 2669125 - RNA, 16 nt, Human
ugggcucccguguuuu

SEQ ID NO: 2669126 - RNA, 19 nt, Human
ugggcucccguguuuugua

SEQ ID NO: 2669127 - RNA, 11 nt, Human
agggcuccugc

SEQ ID NO: 2669128 - RNA, 13 nt, Human
agggcucccaggg

SEQ ID NO: 2669129 - RNA, 14 nt, Human
agggcucccagggg

SEQ ID NO: 2669130 - RNA, 22 nt, Human
agggcucccaggggucucccug

SEQ ID NO: 2669131 - RNA, 11 nt, Human
agggcugcagu

SEQ ID NO: 2669132 - RNA, 12 nt, Human
agggcugcaguu

SEQ ID NO: 2669133 - RNA, 23 nt, Human
agggcugcggcguacaggcuggc

SEQ ID NO: 2669134 - RNA, 21 nt, Human
agggcugcggcguacaggcug

SEQ ID NO: 2669135 - RNA, 23 nt, Human
agggcugcugggggcaacuggcc

SEQ ID NO: 2669136 - RNA, 12 nt, Human
agggcugcuggg

SEQ ID NO: 2669137 - RNA, 20 nt, Human
agggcugcugggggcaacug

SEQ ID NO: 2669138 - RNA, 18 nt, Human
agggcccccacaguugcu

SEQ ID NO: 2669139 - RNA, 13 nt, Human
agggcccccacag

SEQ ID NO: 2669140 - RNA, 20 nt, Human
agggaguuacugaagucuua

SEQ ID NO: 2669141 - RNA, 20 nt, Human
agggauaaagaaaaaaauac

SEQ ID NO: 2669142 - RNA, 21 nt, Human
agggauaaagaaaaaaauacu

SEQ ID NO: 2669143 - RNA, 23 nt, Human
agggauaaagaaaaaaauacuau

SEQ ID NO: 2669144 - RNA, 15 nt, Human
agggcagacuggggc

SEQ ID NO: 2669145 - RNA, 20 nt, Human
agggcagacuggggcauccu

SEQ ID NO: 2669146 - RNA, 20 nt, Human
agggccaaaauauuuggaau

SEQ ID NO: 2669147 - RNA, 13 nt, Human
agggcauaaagua

SEQ ID NO: 2669148 - RNA, 14 nt, Human
agggcauaaaguaa

SEQ ID NO: 2669149 - RNA, 15 nt, Human
agggcauaaaguaaa

SEQ ID NO: 2669150 - RNA, 19 nt, Human
agggcauaaaguaaauaca

SEQ ID NO: 2669151 - RNA, 20 nt, Human
agggcauaaaguaaauacau

SEQ ID NO: 2669152 - RNA, 15 nt, Human
ugggcauugccaugu

SEQ ID NO: 2669153 - RNA, 18 nt, Human
ugggcauugccaugugga

SEQ ID NO: 2669154 - RNA, 17 nt, Human
ugggccaccccuccuag

SEQ ID NO: 2669155 - RNA, 15 nt, Human
agggaguauucuaau

SEQ ID NO: 2669156 - RNA, 19 nt, Human
agggaaaggggugcuuuua

SEQ ID NO: 2669157 - RNA, 15 nt, Human
agggaaaguuuuuuu

SEQ ID NO: 2669158 - RNA, 15 nt, Human
agggaaaggggugcu

SEQ ID NO: 2669159 - RNA, 18 nt, Human
agggaaaggggugcuuuu

SEQ ID NO: 2669160 - RNA, 13 nt, Human
agggaaagaaaau

SEQ ID NO: 2669161 - RNA, 12 nt, Human
agggaaagaaaa

SEQ ID NO: 2669162 - RNA, 21 nt, Human
agggagacuggguaggaaaga

SEQ ID NO: 2669163 - RNA, 20 nt, Human
agggagacgguuuccaggga

SEQ ID NO: 2669164 - RNA, 11 nt, Human
agggagagaga

SEQ ID NO: 2669165 - RNA, 13 nt, Human
agggaaauguuuu

SEQ ID NO: 2669166 - RNA, 17 nt, Human
agggaaauguuuuguaa

SEQ ID NO: 2669167 - RNA, 18 nt, Human
agggaaauguuuuguaaa

SEQ ID NO: 2669168 - RNA, 16 nt, Human
agggagaagaaaggug

SEQ ID NO: 2669169 - RNA, 18 nt, Human
agggagccuuugguucug

SEQ ID NO: 2669170 - RNA, 14 nt, Human
ugggaggcugaggc

SEQ ID NO: 2669171 - RNA, 11 nt, Human
ugggaggcuga

SEQ ID NO: 2669172 - RNA, 15 nt, Human
ugggaggcugaggca

SEQ ID NO: 2669173 - RNA, 14 nt, Human
ugggaggcuucccc

SEQ ID NO: 2669174 - RNA, 21 nt, Human
ugggaggauugcuugagcuca

SEQ ID NO: 2669175 - RNA, 18 nt, Human
ugggaggauugcuugagc

SEQ ID NO: 2669176 - RNA, 22 nt, Human
ugggaggauugcuugagcucag

SEQ ID NO: 2669177 - RNA, 23 nt, Human
ugggagggggcuugaagccaaag

SEQ ID NO: 2669178 - RNA, 16 nt, Human
ugggcaaacaggcagu

SEQ ID NO: 2669179 - RNA, 15 nt, Human
ugggcaaacaggcag

SEQ ID NO: 2669180 - RNA, 14 nt, Human
ugggcaaacaggca

SEQ ID NO: 2669181 - RNA, 20 nt, Human
ugucagcaguugcugguaaa

SEQ ID NO: 2669182 - RNA, 17 nt, Human
uguccaaacguccucuu

SEQ ID NO: 2669183 - RNA, 21 nt, Human
uguccaaacguccucuuuagu

SEQ ID NO: 2669184 - RNA, 15 nt, Human
ugucagguuauuuau

SEQ ID NO: 2669185 - RNA, 11 nt, Human
uguccaaagag

SEQ ID NO: 2669186 - RNA, 17 nt, Human
uguccaaagaggcugcc

SEQ ID NO: 2669187 - RNA, 19 nt, Human
uguccaaagaggcugcccc

SEQ ID NO: 2669188 - RNA, 20 nt, Human
uguccaaagaggcugccccu

SEQ ID NO: 2669189 - RNA, 21 nt, Human
uguccaaagaggcugccccuc

SEQ ID NO: 2669190 - RNA, 12 nt, Human
uguccagcaccu

SEQ ID NO: 2669191 - RNA, 15 nt, Human
uguccagcaccuugu

SEQ ID NO: 2669192 - RNA, 19 nt, Human
uguccagcaccuugugccu

SEQ ID NO: 2669193 - RNA, 20 nt, Human
uguccagcaccuugugccug

SEQ ID NO: 2669194 - RNA, 22 nt, Human
uguccagcaccuugugccuggg

SEQ ID NO: 2669195 - RNA, 16 nt, Human
aguauuuauaauagca

SEQ ID NO: 2669196 - RNA, 23 nt, Human
aguauucucggauaguugcuauu

SEQ ID NO: 2669197 - RNA, 23 nt, Human
aguauucuaauaagcuaguugaa

SEQ ID NO: 2669198 - RNA, 21 nt, Human
aguauucuaauaagcuaguug

SEQ ID NO: 2669199 - RNA, 17 nt, Human
aguauucuaauaagcua

SEQ ID NO: 2669200 - RNA, 16 nt, Human
aguauucuaauaagcu

SEQ ID NO: 2669201 - RNA, 15 nt, Human
aguauuuauuuaugu

SEQ ID NO: 2669202 - RNA, 13 nt, Human
aguauuuauuuau

SEQ ID NO: 2669203 - RNA, 20 nt, Human
aguauuuauuuauguacuuu

SEQ ID NO: 2669204 - RNA, 18 nt, Human
aguauuuauuuauguacu

SEQ ID NO: 2669205 - RNA, 16 nt, Human
aguauuuauuuaugua

SEQ ID NO: 2669206 - RNA, 17 nt, Human
aguauuuauuuauguac

SEQ ID NO: 2669207 - RNA, 14 nt, Human
agucaccagagacu

SEQ ID NO: 2669208 - RNA, 23 nt, Human
aguauuuucuucucugugagaag

SEQ ID NO: 2669209 - RNA, 15 nt, Human
aguauacaaacauuu

SEQ ID NO: 2669210 - RNA, 17 nt, Human
aguauagccuauggcag

SEQ ID NO: 2669211 - RNA, 17 nt, Human
aguauuaucaaagggau

SEQ ID NO: 2669212 - RNA, 21 nt, Human
aguauuaauaucugaggauga

SEQ ID NO: 2669213 - RNA, 19 nt, Human
uguauauuacaaugaucac

SEQ ID NO: 2669214 - RNA, 21 nt, Human
uguauauugguuuuaugauga

SEQ ID NO: 2669215 - RNA, 13 nt, Human
uguauauuguaau

SEQ ID NO: 2669216 - RNA, 14 nt, Human
uguauauuguaauu

SEQ ID NO: 2669217 - RNA, 17 nt, Human
uguauauuguaauuuaa

SEQ ID NO: 2669218 - RNA, 20 nt, Human
uguauauugguuuuaugaug

SEQ ID NO: 2669219 - RNA, 14 nt, Human
uguauauugguuuu

SEQ ID NO: 2669220 - RNA, 13 nt, Human
uguauauugguuu

SEQ ID NO: 2669221 - RNA, 19 nt, Human
uguauauuugauuuauuaa

SEQ ID NO: 2669222 - RNA, 16 nt, Human
uguauauuuguaaagc

SEQ ID NO: 2669223 - RNA, 18 nt, Human
uguauauuuguaaagcua

SEQ ID NO: 2669224 - RNA, 22 nt, Human
uguauauuuguaaagcuauuua

SEQ ID NO: 2669225 - RNA, 22 nt, Human
uguauauuugauuuauuaacuu

SEQ ID NO: 2669226 - RNA, 17 nt, Human
uguauauuugauuuauu

SEQ ID NO: 2669227 - RNA, 16 nt, Human
uguauauuugauuuau

SEQ ID NO: 2669228 - RNA, 14 nt, Human
uguauauuugauuu

SEQ ID NO: 2669229 - RNA, 12 nt, Human
uguauauuugau

SEQ ID NO: 2669230 - RNA, 23 nt, Human
agucacuggagguugaagccaag

SEQ ID NO: 2669231 - RNA, 21 nt, Human
agucacuggagguugaagcca

SEQ ID NO: 2669232 - RNA, 22 nt, Human
agucacuggagguugaagccaa

SEQ ID NO: 2669233 - RNA, 18 nt, Human
agucagcuuucaucuuug

SEQ ID NO: 2669234 - RNA, 18 nt, Human
ugucccugcgccuuuccu

SEQ ID NO: 2669235 - RNA, 14 nt, Human
ugucgcucaugugu

SEQ ID NO: 2669236 - RNA, 15 nt, Human
ugucgcucaugugug

SEQ ID NO: 2669237 - RNA, 16 nt, Human
ugucgcucaugugugc

SEQ ID NO: 2669238 - RNA, 22 nt, Human
ugucgcucaugugugcaacagg

SEQ ID NO: 2669239 - RNA, 23 nt, Human
agucauaucuuaauauauuucua

SEQ ID NO: 2669240 - RNA, 16 nt, Human
aguccauucucccagg

SEQ ID NO: 2669241 - RNA, 17 nt, Human
aguccauucucccaggu

SEQ ID NO: 2669242 - RNA, 14 nt, Human
aguccauucuccca

SEQ ID NO: 2669243 - RNA, 15 nt, Human
aguccauucucccag

SEQ ID NO: 2669244 - RNA, 19 nt, Human
aguccauucucccagguac

SEQ ID NO: 2669245 - RNA, 20 nt, Human
agucccagcuacuugggagg

SEQ ID NO: 2669246 - RNA, 17 nt, Human
agucuacccgacauaag

SEQ ID NO: 2669247 - RNA, 18 nt, Human
agucuacccgacauaagu

SEQ ID NO: 2669248 - RNA, 18 nt, Human
agucuaaggccauggcau

SEQ ID NO: 2669249 - RNA, 19 nt, Human
agucgcaucucagugcagg

SEQ ID NO: 2669250 - RNA, 14 nt, Human
agucgguccucuuu

SEQ ID NO: 2669251 - RNA, 12 nt, Human
aggugggaggau

SEQ ID NO: 2669252 - RNA, 19 nt, Human
ugggcuauuuggacucagg

SEQ ID NO: 2669253 - RNA, 23 nt, Human
agguugaagccaaguggggugcu

SEQ ID NO: 2669254 - RNA, 12 nt, Human
agguugaagcca

SEQ ID NO: 2669255 - RNA, 13 nt, Human
agguugaagccaa

SEQ ID NO: 2669256 - RNA, 15 nt, Human
agguugaagccaagu

SEQ ID NO: 2669257 - RNA, 16 nt, Human
agguugcagugagcug

SEQ ID NO: 2669258 - RNA, 13 nt, Human
agguugaaaaaca

SEQ ID NO: 2669259 - RNA, 15 nt, Human
aggugggcuggacuu

SEQ ID NO: 2669260 - RNA, 11 nt, Human
uguacaaaagc

SEQ ID NO: 2669261 - RNA, 13 nt, Human
uguacaaaagcaa

SEQ ID NO: 2669262 - RNA, 15 nt, Human
uguacaaaagcaaug

SEQ ID NO: 2669263 - RNA, 18 nt, Human
uguacauacgauuuaagg

SEQ ID NO: 2669264 - RNA, 19 nt, Human
uguacauacgauuuaaggu

SEQ ID NO: 2669265 - RNA, 21 nt, Human
uguacauacgauuuaagguau

SEQ ID NO: 2669266 - RNA, 23 nt, Human
uguacauacgauuuaagguauuu

SEQ ID NO: 2669267 - RNA, 20 nt, Human
agguuggcaaaaaggcagga

SEQ ID NO: 2669268 - RNA, 12 nt, Human
agguuuauuguu

SEQ ID NO: 2669269 - RNA, 19 nt, Human
agguuuauuguuaauacaa

SEQ ID NO: 2669270 - RNA, 14 nt, Human
uguauaguuaugua

SEQ ID NO: 2669271 - RNA, 13 nt, Human
uguauaguuaugu

SEQ ID NO: 2669272 - RNA, 18 nt, Human
uguauaguuauguaaaua

SEQ ID NO: 2669273 - RNA, 17 nt, Human
uguauaguuauguaaau

SEQ ID NO: 2669274 - RNA, 16 nt, Human
uguauaguuauguaaa

SEQ ID NO: 2669275 - RNA, 15 nt, Human
uguauaguuauguaa

SEQ ID NO: 2669276 - RNA, 19 nt, Human
uguauaguuauguaaauaa

SEQ ID NO: 2669277 - RNA, 20 nt, Human
uguauauauuauuauaaucu

SEQ ID NO: 2669278 - RNA, 14 nt, Human
uguauauauuauua

SEQ ID NO: 2669279 - RNA, 20 nt, Human
uguauauauuuugugugaaa

SEQ ID NO: 2669280 - RNA, 22 nt, Human
uguauauauuuugugugaaauu

SEQ ID NO: 2669281 - RNA, 15 nt, Human
uguauauuacaauga

SEQ ID NO: 2669282 - RNA, 14 nt, Human
uguauauuacaaug

SEQ ID NO: 2669283 - RNA, 19 nt, Human
uguauaugguauauauaca

SEQ ID NO: 2669284 - RNA, 20 nt, Human
uguauaugguauauauacau

SEQ ID NO: 2669285 - RNA, 21 nt, Human
uguauaugguauauauacaua

SEQ ID NO: 2669286 - RNA, 23 nt, Human
uguagucccagcuacuugggagg

SEQ ID NO: 2669287 - RNA, 14 nt, Human
uguagguaagacug

SEQ ID NO: 2669288 - RNA, 15 nt, Human
uguagguaagacugu

SEQ ID NO: 2669289 - RNA, 20 nt, Human
uguaggguccaaccagaccu

SEQ ID NO: 2669290 - RNA, 21 nt, Human
uguaggguccaaccagaccug

SEQ ID NO: 2669291 - RNA, 21 nt, Human
aguagauguggccuuugaauu

SEQ ID NO: 2669292 - RNA, 13 nt, Human
uguagggagggcg

SEQ ID NO: 2669293 - RNA, 22 nt, Human
uguagggagggcggcaggggcc

SEQ ID NO: 2669294 - RNA, 15 nt, Human
aguagauuuuccaaa

SEQ ID NO: 2669295 - RNA, 16 nt, Human
aguaaguuaucuuuga

SEQ ID NO: 2669296 - RNA, 20 nt, Human
aguaaguuaucuuugaauau

SEQ ID NO: 2669297 - RNA, 15 nt, Human
aguaaugaaauggag

SEQ ID NO: 2669298 - RNA, 22 nt, Human
aguaaugaauuuuuaugauauu

SEQ ID NO: 2669299 - RNA, 21 nt, Human
aguaaugaauuuuuaugauau

SEQ ID NO: 2669300 - RNA, 12 nt, Human
aguaaugaauuu

SEQ ID NO: 2669301 - RNA, 12 nt, Human
aguaauugugaa

SEQ ID NO: 2669302 - RNA, 15 nt, Human
aguaauugugaaaaa

SEQ ID NO: 2669303 - RNA, 16 nt, Human
aguaauugugaaaaag

SEQ ID NO: 2669304 - RNA, 20 nt, Human
uguguccaugcgcucagggc

SEQ ID NO: 2669305 - RNA, 13 nt, Human
ugugucccaggca

SEQ ID NO: 2669306 - RNA, 14 nt, Human
ugugucccaggcag

SEQ ID NO: 2669307 - RNA, 19 nt, Human
ugugucccaggcagggaga

SEQ ID NO: 2669308 - RNA, 18 nt, Human
uguguguugucucuugag

SEQ ID NO: 2669309 - RNA, 13 nt, Human
ugugguagaaaca

SEQ ID NO: 2669310 - RNA, 14 nt, Human
ugugguagaaacaa

SEQ ID NO: 2669311 - RNA, 20 nt, Human
ugugguagcuuaucuuagaa

SEQ ID NO: 2669312 - RNA, 12 nt, Human
agugcccuccag

SEQ ID NO: 2669313 - RNA, 13 nt, Human
agugcccuccagc

SEQ ID NO: 2669314 - RNA, 14 nt, Human
agugcccuccagcc

SEQ ID NO: 2669315 - RNA, 15 nt, Human
agugcccuccagccc

SEQ ID NO: 2669316 - RNA, 17 nt, Human
agugcccuccagccccg

SEQ ID NO: 2669317 - RNA, 18 nt, Human
agugcccuccagccccgc

SEQ ID NO: 2669318 - RNA, 16 nt, Human
uguguaaaaaaaccac

SEQ ID NO: 2669319 - RNA, 21 nt, Human
uguguaaaaaaaccaccaaaa

SEQ ID NO: 2669320 - RNA, 23 nt, Human
uguggucacagcggaggugugga

SEQ ID NO: 2669321 - RNA, 16 nt, Human
uguggucaaggcuaca

SEQ ID NO: 2669322 - RNA, 14 nt, Human
uguguaaacaaaau

SEQ ID NO: 2669323 - RNA, 20 nt, Human
uguguaaacaaaaugaagcu

SEQ ID NO: 2669324 - RNA, 22 nt, Human
uguguaaacaaaaugaagcugc

SEQ ID NO: 2669325 - RNA, 14 nt, Human
ugugucaguuuuca

SEQ ID NO: 2669326 - RNA, 15 nt, Human
ugugucaguuuucau

SEQ ID NO: 2669327 - RNA, 16 nt, Human
ugugucaugccaguga

SEQ ID NO: 2669328 - RNA, 14 nt, Human
ugugucaugccagu

SEQ ID NO: 2669329 - RNA, 22 nt, Human
aguggaccgcccuuuuccccua

SEQ ID NO: 2669330 - RNA, 16 nt, Human
aguggacucagugggu

SEQ ID NO: 2669331 - RNA, 21 nt, Human
aguggaccgcccuuuuccccu

SEQ ID NO: 2669332 - RNA, 16 nt, Human
aguggaccgcccuuuu

SEQ ID NO: 2669333 - RNA, 23 nt, Human
aguggaccuuaggccuuccucuc

SEQ ID NO: 2669334 - RNA, 20 nt, Human
aguggaccuuaggccuuccu

SEQ ID NO: 2669335 - RNA, 19 nt, Human
aguggaccuuaggccuucc

SEQ ID NO: 2669336 - RNA, 17 nt, Human
aguggaccuuaggccuu

SEQ ID NO: 2669337 - RNA, 18 nt, Human
aguggcaccgccucccca

SEQ ID NO: 2669338 - RNA, 14 nt, Human
aguggggugcuggg

SEQ ID NO: 2669339 - RNA, 16 nt, Human
aguggggugcugggag

SEQ ID NO: 2669340 - RNA, 18 nt, Human
aguggggugcugggagga

SEQ ID NO: 2669341 - RNA, 21 nt, Human
aguggggugcugggaggaggg

SEQ ID NO: 2669342 - RNA, 18 nt, Human
agugggcccacccggugg

SEQ ID NO: 2669343 - RNA, 13 nt, Human
uguguuaauuuaa

SEQ ID NO: 2669344 - RNA, 18 nt, Human
uguguuaauuuaaguuuu

SEQ ID NO: 2669345 - RNA, 14 nt, Human
uguguuaauuuaag

SEQ ID NO: 2669346 - RNA, 14 nt, Human
uguuaauacaaggu

SEQ ID NO: 2669347 - RNA, 16 nt, Human
uguuaauacaagguau

SEQ ID NO: 2669348 - RNA, 17 nt, Human
uguuaauacaagguaua

SEQ ID NO: 2669349 - RNA, 22 nt, Human
uguuaauacaagguauaauaaa

SEQ ID NO: 2669350 - RNA, 19 nt, Human
uguuacaaguuuauauaua

SEQ ID NO: 2669351 - RNA, 22 nt, Human
uguuccucaaagcuuggauuaa

SEQ ID NO: 2669352 - RNA, 18 nt, Human
uguugccaagcuccaagc

SEQ ID NO: 2669353 - RNA, 20 nt, Human
uguugccaagcuccaagccc

SEQ ID NO: 2669354 - RNA, 23 nt, Human
uguugccuauaagccaaaauuaa

SEQ ID NO: 2669355 - RNA, 22 nt, Human
uguugccuauaagccaaaauua

SEQ ID NO: 2669356 - RNA, 18 nt, Human
uguugccuauaagccaaa

SEQ ID NO: 2669357 - RNA, 17 nt, Human
uguugccuauaagccaa

SEQ ID NO: 2669358 - RNA, 19 nt, Human
uguugccaugugcaccuug

SEQ ID NO: 2669359 - RNA, 14 nt, Human
uguugccauguguu

SEQ ID NO: 2669360 - RNA, 15 nt, Human
uguugccauguguuu

SEQ ID NO: 2669361 - RNA, 21 nt, Human
aguguugguauauuuuauauu

SEQ ID NO: 2669362 - RNA, 15 nt, Human
aguuagccuccacca

SEQ ID NO: 2669363 - RNA, 20 nt, Human
uguuccuuacuuuacugccu

SEQ ID NO: 2669364 - RNA, 19 nt, Human
uguucguugguuauacaag

SEQ ID NO: 2669365 - RNA, 20 nt, Human
uguucggaagggguuccuca

SEQ ID NO: 2669366 - RNA, 21 nt, Human
uguucggaagggguuccucaa

SEQ ID NO: 2669367 - RNA, 12 nt, Human
aguguguaaaca

SEQ ID NO: 2669368 - RNA, 18 nt, Human
aguguguauauauuuugu

SEQ ID NO: 2669369 - RNA, 23 nt, Human
aguguguauauauuuugugugaa

SEQ ID NO: 2669370 - RNA, 16 nt, Human
aguguguaugccaaga

SEQ ID NO: 2669371 - RNA, 16 nt, Human
agugugggcuugacca

SEQ ID NO: 2669372 - RNA, 18 nt, Human
agugugggcuugaccagg

SEQ ID NO: 2669373 - RNA, 18 nt, Human
aguguggccucuucugag

SEQ ID NO: 2669374 - RNA, 13 nt, Human
aguguggccaggc

SEQ ID NO: 2669375 - RNA, 14 nt, Human
aguguggccaggcu

SEQ ID NO: 2669376 - RNA, 21 nt, Human
agugugccugaagucccagau

SEQ ID NO: 2669377 - RNA, 17 nt, Human
agugguccuagaggccc

SEQ ID NO: 2669378 - RNA, 13 nt, Human
agugguccuagag

SEQ ID NO: 2669379 - RNA, 20 nt, Human
agugugccugaagucccaga

SEQ ID NO: 2669380 - RNA, 20 nt, Human
ugugacuguacccaaaugga

SEQ ID NO: 2669381 - RNA, 18 nt, Human
ugugagaaacaucucaau

SEQ ID NO: 2669382 - RNA, 13 nt, Human
ugugagaagccag

SEQ ID NO: 2669383 - RNA, 21 nt, Human
ugugagaagccagccagaggc

SEQ ID NO: 2669384 - RNA, 18 nt, Human
ugugagaagguuuauugu

SEQ ID NO: 2669385 - RNA, 19 nt, Human
ugugagaagguuuauuguu

SEQ ID NO: 2669386 - RNA, 21 nt, Human
ugugagaagguuuauuguuaa

SEQ ID NO: 2669387 - RNA, 15 nt, Human
ugugagcucuuccua

SEQ ID NO: 2669388 - RNA, 21 nt, Human
ugugagaagugaaugcuggga

SEQ ID NO: 2669389 - RNA, 22 nt, Human
ugugagaagugaaugcugggac

SEQ ID NO: 2669390 - RNA, 23 nt, Human
ugugagaagugaaugcugggacu

SEQ ID NO: 2669391 - RNA, 24 nt, Human
ugugagaagugaaugcugggacuc

SEQ ID NO: 2669392 - RNA, 16 nt, Human
agucucuagguucuga

SEQ ID NO: 2669393 - RNA, 16 nt, Human
agucuccggccucucc

SEQ ID NO: 2669394 - RNA, 17 nt, Human
agucuccggccucucca

SEQ ID NO: 2669395 - RNA, 19 nt, Human
agucuccggccucuccagc

SEQ ID NO: 2669396 - RNA, 22 nt, Human
agucuccggccucuccagccuc

SEQ ID NO: 2669397 - RNA, 21 nt, Human
agucuuagaucauaguuuuau

SEQ ID NO: 2669398 - RNA, 13 nt, Human
agucuuuaauaaa

SEQ ID NO: 2669399 - RNA, 14 nt, Human
agucuuuaauaaau

SEQ ID NO: 2669400 - RNA, 16 nt, Human
agugaacuugggccac

SEQ ID NO: 2669401 - RNA, 13 nt, Human
ugugaugagcuga

SEQ ID NO: 2669402 - RNA, 14 nt, Human
ugugaugagcugau

SEQ ID NO: 2669403 - RNA, 20 nt, Human
agugauacuauccaguuacu

SEQ ID NO: 2669404 - RNA, 15 nt, Human
agugauagucuuuug

SEQ ID NO: 2669405 - RNA, 17 nt, Human
agugauagucuuuugcu

SEQ ID NO: 2669406 - RNA, 20 nt, Human
agugauagucuuuugcuuuu

SEQ ID NO: 2669407 - RNA, 21 nt, Human
agugauagucuuuugcuuuug

SEQ ID NO: 2669408 - RNA, 14 nt, Human
agugaggaaaucaa

SEQ ID NO: 2669409 - RNA, 17 nt, Human
agugaggaaaucaaagu

SEQ ID NO: 2669410 - RNA, 15 nt, Human
agugaggaaaucaaa

SEQ ID NO: 2669411 - RNA, 20 nt, Human
agugaggaaaucaaagugcu

SEQ ID NO: 2669412 - RNA, 17 nt, Human
agugcagagccuucuca

SEQ ID NO: 2669413 - RNA, 18 nt, Human
agugcagagccuucucag

SEQ ID NO: 2669414 - RNA, 19 nt, Human
agugcagagccuucucaga

SEQ ID NO: 2669415 - RNA, 21 nt, Human
agugcagagccuucucagaag

SEQ ID NO: 2669416 - RNA, 13 nt, Human
agugcagaaugua

SEQ ID NO: 2669417 - RNA, 14 nt, Human
agugcagaauguaa

SEQ ID NO: 2669418 - RNA, 20 nt, Human
agugcagaauguaagugggc

SEQ ID NO: 2669419 - RNA, 22 nt, Human
agugcagaauguaagugggccc

SEQ ID NO: 2669420 - RNA, 23 nt, Human
agugcagaauguaagugggccca

SEQ ID NO: 2669421 - RNA, 14 nt, Human
agugcauuuuugua

SEQ ID NO: 2669422 - RNA, 17 nt, Human
agugcauuuuuguaaau

SEQ ID NO: 2669423 - RNA, 20 nt, Human
agugcauuuuuguaaaugug

SEQ ID NO: 2669424 - RNA, 21 nt, Human
agugcauuugugcuagaaauu

SEQ ID NO: 2669425 - RNA, 16 nt, Human
agugcaugguggccag

SEQ ID NO: 2669426 - RNA, 17 nt, Human
agugcaugguggccaga

SEQ ID NO: 2669427 - RNA, 19 nt, Human
agugcaugguggccagagg

SEQ ID NO: 2669428 - RNA, 15 nt, Human
ugugcugugugugac

SEQ ID NO: 2669429 - RNA, 12 nt, Human
ugugcugugugu

SEQ ID NO: 2669430 - RNA, 14 nt, Human
uguggaugauaaaa

SEQ ID NO: 2669431 - RNA, 14 nt, Human
uguggaucagagau

SEQ ID NO: 2669432 - RNA, 17 nt, Human
uguggaucagagaugca

SEQ ID NO: 2669433 - RNA, 22 nt, Human
ugugauuccacuacaccuggcu

SEQ ID NO: 2669434 - RNA, 17 nt, Human
ugugcccuccugaccca

SEQ ID NO: 2669435 - RNA, 13 nt, Human
ugugcccuccuga

SEQ ID NO: 2669436 - RNA, 23 nt, Human
ugugcccuccugacccauugcug

SEQ ID NO: 2669437 - RNA, 17 nt, Human
uuaucaauaucuaauau

SEQ ID NO: 2669438 - RNA, 16 nt, Human
uuaucaauaucuaaua

SEQ ID NO: 2669439 - RNA, 15 nt, Human
uuaucaauaucuaau

SEQ ID NO: 2669440 - RNA, 22 nt, Human
uuaucaauaucuaauauauaug

SEQ ID NO: 2669441 - RNA, 19 nt, Human
uuaucaauaucuaauauau

SEQ ID NO: 2669442 - RNA, 13 nt, Human
auacgauuuaagg

SEQ ID NO: 2669443 - RNA, 17 nt, Human
auacgauuuaagguauu

SEQ ID NO: 2669444 - RNA, 13 nt, Human
auaccacaucaaa

SEQ ID NO: 2669445 - RNA, 15 nt, Human
auaccacaucaaaua

SEQ ID NO: 2669446 - RNA, 15 nt, Human
auacauagugaaaau

SEQ ID NO: 2669447 - RNA, 16 nt, Human
auacauagugaaaauu

SEQ ID NO: 2669448 - RNA, 18 nt, Human
auacauagugaaaauugu

SEQ ID NO: 2669449 - RNA, 13 nt, Human
auacauauauaua

SEQ ID NO: 2669450 - RNA, 20 nt, Human
auacauauauauauauaaca

SEQ ID NO: 2669451 - RNA, 17 nt, Human
auacaugccacaucaaa

SEQ ID NO: 2669452 - RNA, 21 nt, Human
auacaugccacaucaaaccuu

SEQ ID NO: 2669453 - RNA, 13 nt, Human
auacaugcauaua

SEQ ID NO: 2669454 - RNA, 15 nt, Human
auacaugcauauaau

SEQ ID NO: 2669455 - RNA, 20 nt, Human
auacaugcauauaaugaaua

SEQ ID NO: 2669456 - RNA, 21 nt, Human
auacaugcauauaaugaauaa

SEQ ID NO: 2669457 - RNA, 22 nt, Human
auacauguaauucuaccaaggu

SEQ ID NO: 2669458 - RNA, 21 nt, Human
auacaugucacauuuagcugu

SEQ ID NO: 2669459 - RNA, 23 nt, Human
auacaugucacauuuagcugugc

SEQ ID NO: 2669460 - RNA, 16 nt, Human
auacaugugauacauu

SEQ ID NO: 2669461 - RNA, 18 nt, Human
auacaugugauacauuuu

SEQ ID NO: 2669462 - RNA, 19 nt, Human
auacaugugauacauuuuu

SEQ ID NO: 2669463 - RNA, 13 nt, Human
auacagugcagag

SEQ ID NO: 2669464 - RNA, 17 nt, Human
auacagugcagagccuu

SEQ ID NO: 2669465 - RNA, 21 nt, Human
auacagugcagagccuucuca

SEQ ID NO: 2669466 - RNA, 23 nt, Human
auacagugcagagccuucucaga

SEQ ID NO: 2669467 - RNA, 16 nt, Human
auacaacuuaaauaau

SEQ ID NO: 2669468 - RNA, 12 nt, Human
auacaagguaua

SEQ ID NO: 2669469 - RNA, 20 nt, Human
auacaagguauaauaaaauu

SEQ ID NO: 2669470 - RNA, 19 nt, Human
auacaaguucuuggucccu

SEQ ID NO: 2669471 - RNA, 17 nt, Human
auacagaggcaacugca

SEQ ID NO: 2669472 - RNA, 16 nt, Human
auacagaggcaacugc

SEQ ID NO: 2669473 - RNA, 13 nt, Human
uuauaaagcaugu

SEQ ID NO: 2669474 - RNA, 19 nt, Human
uuauaaaguggaaguaugu

SEQ ID NO: 2669475 - RNA, 21 nt, Human
uuaugaaagcaacaaagaaau

SEQ ID NO: 2669476 - RNA, 20 nt, Human
uuaugagauugguuuuccug

SEQ ID NO: 2669477 - RNA, 13 nt, Human
uuaugagaaacuu

SEQ ID NO: 2669478 - RNA, 22 nt, Human
uuaugagaaacuuaaauguuau

SEQ ID NO: 2669479 - RNA, 17 nt, Human
uuaucccaagaaugcaa

SEQ ID NO: 2669480 - RNA, 18 nt, Human
uuauccagaaaacuguga

SEQ ID NO: 2669481 - RNA, 18 nt, Human
uuauccacaugaaaauaa

SEQ ID NO: 2669482 - RNA, 20 nt, Human
uuaugaugguuuuaaacuuu

SEQ ID NO: 2669483 - RNA, 23 nt, Human
uuaugaugacguacaaguaguuc

SEQ ID NO: 2669484 - RNA, 22 nt, Human
uuaugaugacguacaaguaguu

SEQ ID NO: 2669485 - RNA, 15 nt, Human
uuaugaugacguaca

SEQ ID NO: 2669486 - RNA, 17 nt, Human
uuaugguuuugugaugu

SEQ ID NO: 2669487 - RNA, 11 nt, Human
uuaugguuuug

SEQ ID NO: 2669488 - RNA, 14 nt, Human
uuaugguuacuucu

SEQ ID NO: 2669489 - RNA, 20 nt, Human
uuaugguuacuucuucucuu

SEQ ID NO: 2669490 - RNA, 15 nt, Human
uuaugguuauguuuu

SEQ ID NO: 2669491 - RNA, 16 nt, Human
uuaugguuauguuuuu

SEQ ID NO: 2669492 - RNA, 13 nt, Human
uuauguaaauaau

SEQ ID NO: 2669493 - RNA, 12 nt, Human
uuauguaaauaa

SEQ ID NO: 2669494 - RNA, 13 nt, Human
uuaugugagagaa

SEQ ID NO: 2669495 - RNA, 11 nt, Human
uuaugugaauu

SEQ ID NO: 2669496 - RNA, 17 nt, Human
uuaugugaauuuuuaag

SEQ ID NO: 2669497 - RNA, 19 nt, Human
uuaugugaauuuuuaagcu

SEQ ID NO: 2669498 - RNA, 20 nt, Human
uuaugugaauuuuuaagcug

SEQ ID NO: 2669499 - RNA, 15 nt, Human
uuaugugacauuaac

SEQ ID NO: 2669500 - RNA, 16 nt, Human
uuauguaaauaauucu

SEQ ID NO: 2669501 - RNA, 15 nt, Human
uuauguaaauaauuc

SEQ ID NO: 2669502 - RNA, 15 nt, Human
uuaugggccccuggc

SEQ ID NO: 2669503 - RNA, 12 nt, Human
auagaaauggaa

SEQ ID NO: 2669504 - RNA, 20 nt, Human
auagaaauggaaauuuugcu

SEQ ID NO: 2669505 - RNA, 23 nt, Human
auagaaauggaaauuuugcuauc

SEQ ID NO: 2669506 - RNA, 15 nt, Human
auagaaauguagguc

SEQ ID NO: 2669507 - RNA, 21 nt, Human
auagaaauguagguccucaga

SEQ ID NO: 2669508 - RNA, 12 nt, Human
auagaaaugucu

SEQ ID NO: 2669509 - RNA, 22 nt, Human
auagaaaugucucaaggcaguu

SEQ ID NO: 2669510 - RNA, 14 nt, Human
auagaaauuuugua

SEQ ID NO: 2669511 - RNA, 16 nt, Human
auagaaauuuuguaag

SEQ ID NO: 2669512 - RNA, 17 nt, Human
auagaaauuuuguaaga

SEQ ID NO: 2669513 - RNA, 18 nt, Human
auagaaauuuuguaagaa

SEQ ID NO: 2669514 - RNA, 23 nt, Human
auagaaauuuuguaagaaggcaa

SEQ ID NO: 2669515 - RNA, 15 nt, Human
auacuggaggaacac

SEQ ID NO: 2669516 - RNA, 12 nt, Human
auagacaugaaa

SEQ ID NO: 2669517 - RNA, 13 nt, Human
auagacaugaaag

SEQ ID NO: 2669518 - RNA, 14 nt, Human
auagacacauacau

SEQ ID NO: 2669519 - RNA, 23 nt, Human
auagaguguaguuuacagaaaaa

SEQ ID NO: 2669520 - RNA, 16 nt, Human
auagaguguaguuuac

SEQ ID NO: 2669521 - RNA, 21 nt, Human
auagaggcuucuccgccagcc

SEQ ID NO: 2669522 - RNA, 22 nt, Human
auagaggcuucuccgccagccu

SEQ ID NO: 2669523 - RNA, 23 nt, Human
auagaggcuucuccgccagccuc

SEQ ID NO: 2669524 - RNA, 17 nt, Human
auagaguacacugccug

SEQ ID NO: 2669525 - RNA, 14 nt, Human
auagaguacacugc

SEQ ID NO: 2669526 - RNA, 12 nt, Human
auagaggcuagc

SEQ ID NO: 2669527 - RNA, 19 nt, Human
auagaggcuagcuucugcu

SEQ ID NO: 2669528 - RNA, 20 nt, Human
auagaggcuagcuucugcuu

SEQ ID NO: 2669529 - RNA, 18 nt, Human
auagaggcuucuccgcca

SEQ ID NO: 2669530 - RNA, 13 nt, Human
auagacagguccu

SEQ ID NO: 2669531 - RNA, 19 nt, Human
auagacgaguugauuuccu

SEQ ID NO: 2669532 - RNA, 18 nt, Human
auagauauaaauuuuuaa

SEQ ID NO: 2669533 - RNA, 15 nt, Human
auagauaauauuguu

SEQ ID NO: 2669534 - RNA, 16 nt, Human
auagauaauauuguuu

SEQ ID NO: 2669535 - RNA, 13 nt, Human
auagaucuccagc

SEQ ID NO: 2669536 - RNA, 19 nt, Human
auagaucuccagcgucagc

SEQ ID NO: 2669537 - RNA, 19 nt, Human
auagacuguaacuuccaaa

SEQ ID NO: 2669538 - RNA, 18 nt, Human
auagaugcuguguauaug

SEQ ID NO: 2669539 - RNA, 22 nt, Human
auacugaaggaaaaacacaagc

SEQ ID NO: 2669540 - RNA, 12 nt, Human
auacugaaggaa

SEQ ID NO: 2669541 - RNA, 13 nt, Human
auacugaaggaaa

SEQ ID NO: 2669542 - RNA, 14 nt, Human
auacugaaggaaaa

SEQ ID NO: 2669543 - RNA, 15 nt, Human
auacugaaggaaaaa

SEQ ID NO: 2669544 - RNA, 23 nt, Human
auacugaaccacuuguagauuug

SEQ ID NO: 2669545 - RNA, 19 nt, Human
auacugaaccacuuguaga

SEQ ID NO: 2669546 - RNA, 18 nt, Human
auacugaaccacuuguag

SEQ ID NO: 2669547 - RNA, 12 nt, Human
auacugaaccac

SEQ ID NO: 2669548 - RNA, 12 nt, Human
auacuccuuccc

SEQ ID NO: 2669549 - RNA, 20 nt, Human
auacugaaggaaaaacacaa

SEQ ID NO: 2669550 - RNA, 14 nt, Human
auacugauggaauu

SEQ ID NO: 2669551 - RNA, 13 nt, Human
auacugauggaau

SEQ ID NO: 2669552 - RNA, 22 nt, Human
auacugauggaauuuuuuugua

SEQ ID NO: 2669553 - RNA, 21 nt, Human
auacuggugcagucauuauga

SEQ ID NO: 2669554 - RNA, 23 nt, Human
auacuggcuucaccaucaauccu

SEQ ID NO: 2669555 - RNA, 19 nt, Human
auacugcuugaauaaacac

SEQ ID NO: 2669556 - RNA, 19 nt, Human
auacugcgacuuucugccu

SEQ ID NO: 2669557 - RNA, 20 nt, Human
auacugcgacuuucugccug

SEQ ID NO: 2669558 - RNA, 22 nt, Human
auacugcgacuuucugccugga

SEQ ID NO: 2669559 - RNA, 22 nt, Human
uuauuauaaucuuauaauuguu

SEQ ID NO: 2669560 - RNA, 21 nt, Human
uuauuauaaucuuauaauugu

SEQ ID NO: 2669561 - RNA, 22 nt, Human
uuauucaacagcaagugugaau

SEQ ID NO: 2669562 - RNA, 18 nt, Human
uuauucaguaacugucag

SEQ ID NO: 2669563 - RNA, 12 nt, Human
uuauuauuuauu

SEQ ID NO: 2669564 - RNA, 14 nt, Human
uuauucaacagcaa

SEQ ID NO: 2669565 - RNA, 13 nt, Human
uuauucaacagca

SEQ ID NO: 2669566 - RNA, 23 nt, Human
uuaauccuuuguuuucugacuaa

SEQ ID NO: 2669567 - RNA, 14 nt, Human
uuaaucuacugcau

SEQ ID NO: 2669568 - RNA, 16 nt, Human
uuaaucuacugcauuu

SEQ ID NO: 2669569 - RNA, 15 nt, Human
uuaaucuacugcauu

SEQ ID NO: 2669570 - RNA, 22 nt, Human
uuaauccuuuguuuucugacua

SEQ ID NO: 2669571 - RNA, 12 nt, Human
uuaauccaaugg

SEQ ID NO: 2669572 - RNA, 18 nt, Human
uuaauccaguuauaagaa

SEQ ID NO: 2669573 - RNA, 19 nt, Human
uuaauccaguuauaagaag

SEQ ID NO: 2669574 - RNA, 20 nt, Human
uuaauccaguuauaagaaga

SEQ ID NO: 2669575 - RNA, 21 nt, Human
uuaauccaguuauaagaagaa

SEQ ID NO: 2669576 - RNA, 18 nt, Human
uuaaucauaguuacugug

SEQ ID NO: 2669577 - RNA, 19 nt, Human
uuaaucauaguuacugugu

SEQ ID NO: 2669578 - RNA, 23 nt, Human
uuaaucauaguuacuguguaaac

SEQ ID NO: 2669579 - RNA, 11 nt, Human
uuaaucacugu

SEQ ID NO: 2669580 - RNA, 14 nt, Human
uuaaucacugugua

SEQ ID NO: 2669581 - RNA, 13 nt, Human
uuaaucacugugu

SEQ ID NO: 2669582 - RNA, 20 nt, Human
uuaaucacuguguauauuug

SEQ ID NO: 2669583 - RNA, 17 nt, Human
uuaaucacuguguauau

SEQ ID NO: 2669584 - RNA, 15 nt, Human
uuaaucacuguguau

SEQ ID NO: 2669585 - RNA, 14 nt, Human
uuaagacugauuuu

SEQ ID NO: 2669586 - RNA, 18 nt, Human
uuaagacugauuuuaaua

SEQ ID NO: 2669587 - RNA, 24 nt, Human
uuaagagcaaaucaauucuaguca

SEQ ID NO: 2669588 - RNA, 20 nt, Human
uuaaguuuugacaagcuggc

SEQ ID NO: 2669589 - RNA, 12 nt, Human
aguuuuuuugcu

SEQ ID NO: 2669590 - RNA, 18 nt, Human
uuaaucuucaaagccuuc

SEQ ID NO: 2669591 - RNA, 20 nt, Human
uuaaucuucaaagccuucuc

SEQ ID NO: 2669592 - RNA, 18 nt, Human
uuaauuugcaucugaaau

SEQ ID NO: 2669593 - RNA, 11 nt, Human
uuaauuuccuu

SEQ ID NO: 2669594 - RNA, 12 nt, Human
uuaauuuccuuu

SEQ ID NO: 2669595 - RNA, 13 nt, Human
uuaauuuccuuuu

SEQ ID NO: 2669596 - RNA, 15 nt, Human
uuaauuuccuuuuug

SEQ ID NO: 2669597 - RNA, 16 nt, Human
uuaauuuccuuuuuga

SEQ ID NO: 2669598 - RNA, 18 nt, Human
uuaauuuccuuuuugaca

SEQ ID NO: 2669599 - RNA, 19 nt, Human
uuaauuuccuuuuugacac

SEQ ID NO: 2669600 - RNA, 20 nt, Human
uuaauuuccuuuuugacacu

SEQ ID NO: 2669601 - RNA, 21 nt, Human
uuaauuuccuuuuugacacug

SEQ ID NO: 2669602 - RNA, 22 nt, Human
uuaauuuccuuuuugacacuga

SEQ ID NO: 2669603 - RNA, 23 nt, Human
uuaauuuccuuuuugacacugaa

SEQ ID NO: 2669604 - RNA, 12 nt, Human
uuaauuuucacu

SEQ ID NO: 2669605 - RNA, 13 nt, Human
uuaauuuuaaagu

SEQ ID NO: 2669606 - RNA, 16 nt, Human
uuaauuuuaaagugca

SEQ ID NO: 2669607 - RNA, 18 nt, Human
uuaauuuuaaagugcaaa

SEQ ID NO: 2669608 - RNA, 19 nt, Human
uuaauuuuaaagugcaaaa

SEQ ID NO: 2669609 - RNA, 17 nt, Human
uuaauuuuuaaugauga

SEQ ID NO: 2669610 - RNA, 15 nt, Human
aguuuuauaugcuuu

SEQ ID NO: 2669611 - RNA, 16 nt, Human
aguuuuauaugcuuua

SEQ ID NO: 2669612 - RNA, 17 nt, Human
aguuuuauaugcuuuau

SEQ ID NO: 2669613 - RNA, 14 nt, Human
aguuuuauaugcuu

SEQ ID NO: 2669614 - RNA, 24 nt, Human
aguuuuauaauccuuaaaucuuaa

SEQ ID NO: 2669615 - RNA, 19 nt, Human
aguuuuauagccuggacug

SEQ ID NO: 2669616 - RNA, 23 nt, Human
aguuuuacugucuauuaauauuc

SEQ ID NO: 2669617 - RNA, 13 nt, Human
aguuuuguuguac

SEQ ID NO: 2669618 - RNA, 18 nt, Human
aguuuuguuguacuuaaa

SEQ ID NO: 2669619 - RNA, 23 nt, Human
aguuuuguuguacuuaaauggua

SEQ ID NO: 2669620 - RNA, 13 nt, Human
aguuuuuccugga

SEQ ID NO: 2669621 - RNA, 15 nt, Human
aguuuuuccuggaau

SEQ ID NO: 2669622 - RNA, 23 nt, Human
aguuuuguuuuaaaacuggaccu

SEQ ID NO: 2669623 - RNA, 21 nt, Human
aguuuuuggauaaagaauacu

SEQ ID NO: 2669624 - RNA, 16 nt, Human
aguuuuugguugggaa

SEQ ID NO: 2669625 - RNA, 17 nt, Human
aguuuuugguugggaau

SEQ ID NO: 2669626 - RNA, 12 nt, Human
aguuuuuguuug

SEQ ID NO: 2669627 - RNA, 16 nt, Human
aguuuuuguuuggaga

SEQ ID NO: 2669628 - RNA, 20 nt, Human
auaaaaggcuugaagcugug

SEQ ID NO: 2669629 - RNA, 13 nt, Human
aguuuguuggaaa

SEQ ID NO: 2669630 - RNA, 14 nt, Human
aguuuguguguugu

SEQ ID NO: 2669631 - RNA, 21 nt, Human
aguuuguguguugucucuuga

SEQ ID NO: 2669632 - RNA, 14 nt, Human
aguuuaucauucaa

SEQ ID NO: 2669633 - RNA, 15 nt, Human
aguuuaucauucaag

SEQ ID NO: 2669634 - RNA, 16 nt, Human
aguuuaucauucaagu

SEQ ID NO: 2669635 - RNA, 17 nt, Human
aguuuaucauucaagug

SEQ ID NO: 2669636 - RNA, 23 nt, Human
uuaaauuuuuuuguaugaaaaca

SEQ ID NO: 2669637 - RNA, 17 nt, Human
uuaaauuuuuuuguaug

SEQ ID NO: 2669638 - RNA, 22 nt, Human
uuaaauuuuuuuguaugaaaac

SEQ ID NO: 2669639 - RNA, 21 nt, Human
uuaaauuuuuuuguaugaaaa

SEQ ID NO: 2669640 - RNA, 20 nt, Human
uuaaauuuuuuuguaugaaa

SEQ ID NO: 2669641 - RNA, 17 nt, Human
aguuuagaacagguuuu

SEQ ID NO: 2669642 - RNA, 16 nt, Human
aguuuagaacagguuu

SEQ ID NO: 2669643 - RNA, 12 nt, Human
aguuuagaacag

SEQ ID NO: 2669644 - RNA, 14 nt, Human
uuaaaaaauaaaua

SEQ ID NO: 2669645 - RNA, 23 nt, Human
uuaaaaaauaggugguagauauu

SEQ ID NO: 2669646 - RNA, 14 nt, Human
uuaaaaaauauuuu

SEQ ID NO: 2669647 - RNA, 16 nt, Human
uuaaaaaauauuuucu

SEQ ID NO: 2669648 - RNA, 20 nt, Human
uuaaaaaauauuuucucugu

SEQ ID NO: 2669649 - RNA, 15 nt, Human
uuaaaaaaucuuaau

SEQ ID NO: 2669650 - RNA, 13 nt, Human
uuaaaaaagagac

SEQ ID NO: 2669651 - RNA, 15 nt, Human
uuaaaaaagagacau

SEQ ID NO: 2669652 - RNA, 18 nt, Human
aguuagcugaagaauuga

SEQ ID NO: 2669653 - RNA, 16 nt, Human
uuaaaaaaucuuaaug

SEQ ID NO: 2669654 - RNA, 18 nt, Human
uuaaaaucugagggaaau

SEQ ID NO: 2669655 - RNA, 21 nt, Human
uuaaaaucugagggaaauguu

SEQ ID NO: 2669656 - RNA, 22 nt, Human
uuaaaaucugagggaaauguuu

SEQ ID NO: 2669657 - RNA, 11 nt, Human
uuaaaauguaa

SEQ ID NO: 2669658 - RNA, 13 nt, Human
uuaaaauguaauu

SEQ ID NO: 2669659 - RNA, 17 nt, Human
uuaaaauguaauuuaaa

SEQ ID NO: 2669660 - RNA, 21 nt, Human
uuaaaauguaauuuaaaugaa

SEQ ID NO: 2669661 - RNA, 14 nt, Human
uuaaaccacuuaaa

SEQ ID NO: 2669662 - RNA, 19 nt, Human
uuacugccgguuugaaaau

SEQ ID NO: 2669663 - RNA, 11 nt, Human
uuacugccuug

SEQ ID NO: 2669664 - RNA, 14 nt, Human
uuacugccuugaaa

SEQ ID NO: 2669665 - RNA, 15 nt, Human
uuacugcagcuuugu

SEQ ID NO: 2669666 - RNA, 16 nt, Human
uuagaauaagaauuug

SEQ ID NO: 2669667 - RNA, 18 nt, Human
uuagaauaagaauuugca

SEQ ID NO: 2669668 - RNA, 19 nt, Human
uuagaauaagaauuugcau

SEQ ID NO: 2669669 - RNA, 23 nt, Human
uuagaaucccuguguuaauuuaa

SEQ ID NO: 2669670 - RNA, 20 nt, Human
uuagaaucccuguguuaauu

SEQ ID NO: 2669671 - RNA, 17 nt, Human
uuagaaucccuguguua

SEQ ID NO: 2669672 - RNA, 13 nt, Human
uuagaauuaaaaa

SEQ ID NO: 2669673 - RNA, 17 nt, Human
uuagaauuaaaaaagca

SEQ ID NO: 2669674 - RNA, 14 nt, Human
auaagaugacugug

SEQ ID NO: 2669675 - RNA, 17 nt, Human
auaagaugacuguguug

SEQ ID NO: 2669676 - RNA, 16 nt, Human
auaagaaaauauauuc

SEQ ID NO: 2669677 - RNA, 21 nt, Human
auaagaaaauauauucuuuca

SEQ ID NO: 2669678 - RNA, 21 nt, Human
uuacaaaguuaaaauuguuau

SEQ ID NO: 2669679 - RNA, 21 nt, Human
auaaauucuauaggaacauau

SEQ ID NO: 2669680 - RNA, 16 nt, Human
auaaauucuauaggaa

SEQ ID NO: 2669681 - RNA, 15 nt, Human
auaacucaauggaaa

SEQ ID NO: 2669682 - RNA, 18 nt, Human
uuauaaaauauaaacaaa

SEQ ID NO: 2669683 - RNA, 18 nt, Human
uuauaaaauccugugcaa

SEQ ID NO: 2669684 - RNA, 20 nt, Human
uuauaaaauccugugcaaua

SEQ ID NO: 2669685 - RNA, 13 nt, Human
uuauaaaauggcu

SEQ ID NO: 2669686 - RNA, 20 nt, Human
uuauaaaauggcuguaauca

SEQ ID NO: 2669687 - RNA, 13 nt, Human
uuauaaaauauaa

SEQ ID NO: 2669688 - RNA, 20 nt, Human
uuauaaaauauaaacaaaga

SEQ ID NO: 2669689 - RNA, 13 nt, Human
uuauaaacagaaa

SEQ ID NO: 2669690 - RNA, 17 nt, Human
uuauaaacagaaaugga

SEQ ID NO: 2669691 - RNA, 22 nt, Human
uuauaaaacagaguaaucuugu

SEQ ID NO: 2669692 - RNA, 19 nt, Human
uuauaaaacagaguaaucu

SEQ ID NO: 2669693 - RNA, 17 nt, Human
uuaguaauuucuuuuuu

SEQ ID NO: 2669694 - RNA, 17 nt, Human
uuagggcaccagggguu

SEQ ID NO: 2669695 - RNA, 18 nt, Human
uuagggaguauucuaaua

SEQ ID NO: 2669696 - RNA, 17 nt, Human
uuagggaguauucuaau

SEQ ID NO: 2669697 - RNA, 14 nt, Human
uuagggaguauucu

SEQ ID NO: 2669698 - RNA, 19 nt, Human
uuaggggaaggagaaguaa

SEQ ID NO: 2669699 - RNA, 22 nt, Human
uuagauguugccauguguuuua

SEQ ID NO: 2669700 - RNA, 16 nt, Human
uuagauguugccaugu

SEQ ID NO: 2669701 - RNA, 19 nt, Human
uuagauguugccauguguu

SEQ ID NO: 2669702 - RNA, 19 nt, Human
uuaggugugggggaagcac

SEQ ID NO: 2669703 - RNA, 20 nt, Human
auaaucuuguuucugaaaag

SEQ ID NO: 2669704 - RNA, 21 nt, Human
auaaucuuguuucugaaaaga

SEQ ID NO: 2669705 - RNA, 14 nt, Human
auaauuuagauggu

SEQ ID NO: 2669706 - RNA, 20 nt, Human
auaauuuauuuccacuaaaa

SEQ ID NO: 2669707 - RNA, 13 nt, Human
auaauuucagggu

SEQ ID NO: 2669708 - RNA, 14 nt, Human
auaauuucagggug

SEQ ID NO: 2669709 - RNA, 21 nt, Human
auaauuuuaaaaaagccuucc

SEQ ID NO: 2669710 - RNA, 14 nt, Human
auaagccaaaauua

SEQ ID NO: 2669711 - RNA, 11 nt, Human
auaauauaaaa

SEQ ID NO: 2669712 - RNA, 12 nt, Human
auaauauaaaaa

SEQ ID NO: 2669713 - RNA, 13 nt, Human
auaauauaaaaaa

SEQ ID NO: 2669714 - RNA, 13 nt, Human
auaauauauuuuc

SEQ ID NO: 2669715 - RNA, 17 nt, Human
auaaucaagagccuuaa

SEQ ID NO: 2669716 - RNA, 16 nt, Human
auaaucaagagccuua

SEQ ID NO: 2669717 - RNA, 22 nt, Human
auaaucaagagccuuaaaacau

SEQ ID NO: 2669718 - RNA, 21 nt, Human
auaaucaagagccuuaaaaca

SEQ ID NO: 2669719 - RNA, 20 nt, Human
auaaucaagagccuuaaaac

SEQ ID NO: 2669720 - RNA, 17 nt, Human
auaaucuuauaauuguu

SEQ ID NO: 2669721 - RNA, 14 nt, Human
auaauauuguuugg

SEQ ID NO: 2669722 - RNA, 16 nt, Human
auaauauuguuuggua

SEQ ID NO: 2669723 - RNA, 21 nt, Human
auaauauuguuugguaaaugu

SEQ ID NO: 2669724 - RNA, 22 nt, Human
auaauauuguuugguaaauguu

SEQ ID NO: 2669725 - RNA, 19 nt, Human
uuacugucuauuaauauuc

SEQ ID NO: 2669726 - RNA, 15 nt, Human
auaauauauuuucug

SEQ ID NO: 2669727 - RNA, 17 nt, Human
augaauaucuauuaaua

SEQ ID NO: 2669728 - RNA, 21 nt, Human
augaagacuguuaaaugaaac

SEQ ID NO: 2669729 - RNA, 22 nt, Human
augaagacuguuaaaugaaacc

SEQ ID NO: 2669730 - RNA, 16 nt, Human
augaagaauuuaaaga

SEQ ID NO: 2669731 - RNA, 13 nt, Human
augaagaauuuaa

SEQ ID NO: 2669732 - RNA, 14 nt, Human
augaagaauagaaa

SEQ ID NO: 2669733 - RNA, 16 nt, Human
augaagaauagaaaca

SEQ ID NO: 2669734 - RNA, 17 nt, Human
augaagaauagaaacaa

SEQ ID NO: 2669735 - RNA, 18 nt, Human
augaagaauagaaacaag

SEQ ID NO: 2669736 - RNA, 12 nt, Human
augaaaugugaa

SEQ ID NO: 2669737 - RNA, 13 nt, Human
augaaaugugaau

SEQ ID NO: 2669738 - RNA, 18 nt, Human
augaaaugugaauuuuua

SEQ ID NO: 2669739 - RNA, 22 nt, Human
augaaaugugaauuuuuauugu

SEQ ID NO: 2669740 - RNA, 23 nt, Human
augaaaugugaauuuuuauuguu

SEQ ID NO: 2669741 - RNA, 18 nt, Human
augaaaugcauauuugca

SEQ ID NO: 2669742 - RNA, 21 nt, Human
augaauaucuauuaauauaug

SEQ ID NO: 2669743 - RNA, 20 nt, Human
augaauaucuauuaauauau

SEQ ID NO: 2669744 - RNA, 19 nt, Human
augaauaucuauuaauaua

SEQ ID NO: 2669745 - RNA, 18 nt, Human
augaauaucuauuaauau

SEQ ID NO: 2669746 - RNA, 22 nt, Human
augaauaucuauuaauauaugu

SEQ ID NO: 2669747 - RNA, 21 nt, Human
augaaugggcugagcugccug

SEQ ID NO: 2669748 - RNA, 21 nt, Human
augaaucaaaagugccucaag

SEQ ID NO: 2669749 - RNA, 22 nt, Human
uuggggaggagggggccgggcg

SEQ ID NO: 2669750 - RNA, 23 nt, Human
uuggcccccaaagauagacaggu

SEQ ID NO: 2669751 - RNA, 15 nt, Human
uuggagucacugcca

SEQ ID NO: 2669752 - RNA, 13 nt, Human
uuggcccuauuua

SEQ ID NO: 2669753 - RNA, 21 nt, Human
aucuuugauguguuguucuug

SEQ ID NO: 2669754 - RNA, 16 nt, Human
aucuuuugaagcauag

SEQ ID NO: 2669755 - RNA, 17 nt, Human
aucuuuugaagcauaga

SEQ ID NO: 2669756 - RNA, 19 nt, Human
aucuuugauguguuguucu

SEQ ID NO: 2669757 - RNA, 17 nt, Human
aucuuugauguguuguu

SEQ ID NO: 2669758 - RNA, 16 nt, Human
aucuuugauguguugu

SEQ ID NO: 2669759 - RNA, 15 nt, Human
aucuuugauguguug

SEQ ID NO: 2669760 - RNA, 14 nt, Human
aucuuugauguguu

SEQ ID NO: 2669761 - RNA, 12 nt, Human
aucuuugaugug

SEQ ID NO: 2669762 - RNA, 15 nt, Human
aucuuugaauaugua

SEQ ID NO: 2669763 - RNA, 20 nt, Human
uuggcucgaaucucugugcc

SEQ ID NO: 2669764 - RNA, 21 nt, Human
uuggcucgaaucucugugccu

SEQ ID NO: 2669765 - RNA, 17 nt, Human
uuggcucgaaucucugu

SEQ ID NO: 2669766 - RNA, 14 nt, Human
uuggcucagacaug

SEQ ID NO: 2669767 - RNA, 13 nt, Human
uuggcucagacau

SEQ ID NO: 2669768 - RNA, 15 nt, Human
aucugcgugugugca

SEQ ID NO: 2669769 - RNA, 21 nt, Human
aucugccuuaaaaccaaagag

SEQ ID NO: 2669770 - RNA, 22 nt, Human
aucugcggaucucagcuuugag

SEQ ID NO: 2669771 - RNA, 23 nt, Human
aucugcggaucucagcuuugaga

SEQ ID NO: 2669772 - RNA, 18 nt, Human
aucugccuuaaaaccaaa

SEQ ID NO: 2669773 - RNA, 19 nt, Human
aucugccuuaaaaccaaag

SEQ ID NO: 2669774 - RNA, 17 nt, Human
aucugccuuaaaaccaa

SEQ ID NO: 2669775 - RNA, 18 nt, Human
aucugccccacagucucc

SEQ ID NO: 2669776 - RNA, 16 nt, Human
aucugccaagggccga

SEQ ID NO: 2669777 - RNA, 17 nt, Human
aucugccagacuuaaaa

SEQ ID NO: 2669778 - RNA, 13 nt, Human
uugccaaaauuca

SEQ ID NO: 2669779 - RNA, 19 nt, Human
uugccaaaauucauuucua

SEQ ID NO: 2669780 - RNA, 21 nt, Human
aucugguucauucuucagaua

SEQ ID NO: 2669781 - RNA, 14 nt, Human
aucugucugguggc

SEQ ID NO: 2669782 - RNA, 16 nt, Human
aucugucugguggccc

SEQ ID NO: 2669783 - RNA, 18 nt, Human
aucugucuauauuuuauu

SEQ ID NO: 2669784 - RNA, 16 nt, Human
aucuguuuauuuacaa

SEQ ID NO: 2669785 - RNA, 24 nt, Human
aucuuauaaaguggaaguauguau

SEQ ID NO: 2669786 - RNA, 14 nt, Human
aucuuauaauuguu

SEQ ID NO: 2669787 - RNA, 16 nt, Human
aucuuauaauuguucu

SEQ ID NO: 2669788 - RNA, 14 nt, Human
aucuugccuccagg

SEQ ID NO: 2669789 - RNA, 15 nt, Human
aucuugccuccaggu

SEQ ID NO: 2669790 - RNA, 21 nt, Human
aucuugccuccaggugcagag

SEQ ID NO: 2669791 - RNA, 19 nt, Human
uugcucuaugcuuuccaaa

SEQ ID NO: 2669792 - RNA, 18 nt, Human
uugcucuaugcuuuccaa

SEQ ID NO: 2669793 - RNA, 14 nt, Human
uugcucuacaauga

SEQ ID NO: 2669794 - RNA, 18 nt, Human
uugcucaaaaaaugagcu

SEQ ID NO: 2669795 - RNA, 17 nt, Human
aucuugcuacuaccguu

SEQ ID NO: 2669796 - RNA, 17 nt, Human
uugcucaaaaaaugagc

SEQ ID NO: 2669797 - RNA, 16 nt, Human
uugcuauuuuuguaaa

SEQ ID NO: 2669798 - RNA, 18 nt, Human
aucuaauauauaugaaua

SEQ ID NO: 2669799 - RNA, 17 nt, Human
aucuaauauauaugaau

SEQ ID NO: 2669800 - RNA, 15 nt, Human
aucuaauauauauga

SEQ ID NO: 2669801 - RNA, 20 nt, Human
aucuaauauauaugaauaaa

SEQ ID NO: 2669802 - RNA, 19 nt, Human
aucuaauauauaugaauaa

SEQ ID NO: 2669803 - RNA, 15 nt, Human
uugauacauucaaau

SEQ ID NO: 2669804 - RNA, 17 nt, Human
uugauacauucaaauuu

SEQ ID NO: 2669805 - RNA, 18 nt, Human
uugauacauucaaauuug

SEQ ID NO: 2669806 - RNA, 21 nt, Human
uugauacauucaaauuugucu

SEQ ID NO: 2669807 - RNA, 22 nt, Human
aucuaauauauaugaauaaagu

SEQ ID NO: 2669808 - RNA, 14 nt, Human
aucuacaaucucuu

SEQ ID NO: 2669809 - RNA, 19 nt, Human
aucuacaaucucuuuuugu

SEQ ID NO: 2669810 - RNA, 23 nt, Human
aucuacaaucucuuuuuguuugc

SEQ ID NO: 2669811 - RNA, 14 nt, Human
aucuacugcauuua

SEQ ID NO: 2669812 - RNA, 13 nt, Human
aucuacugcauuu

SEQ ID NO: 2669813 - RNA, 20 nt, Human
uugaguugauucagcucugc

SEQ ID NO: 2669814 - RNA, 17 nt, Human
uugaguuguuuuuguau

SEQ ID NO: 2669815 - RNA, 19 nt, Human
uugaguuguuuuuguauau

SEQ ID NO: 2669816 - RNA, 18 nt, Human
uugaguuguuuuuguaua

SEQ ID NO: 2669817 - RNA, 11 nt, Human
uugaguuuguc

SEQ ID NO: 2669818 - RNA, 23 nt, Human
uugaguuugucgcucaugugugc

SEQ ID NO: 2669819 - RNA, 19 nt, Human
uugauacaguuuucagaaa

SEQ ID NO: 2669820 - RNA, 16 nt, Human
uugagaucagccuggg

SEQ ID NO: 2669821 - RNA, 15 nt, Human
uugagaucagccugg

SEQ ID NO: 2669822 - RNA, 16 nt, Human
uugagaccgugaagau

SEQ ID NO: 2669823 - RNA, 22 nt, Human
uugagaccgugaagauacuuug

SEQ ID NO: 2669824 - RNA, 21 nt, Human
uugagaccgugaagauacuuu

SEQ ID NO: 2669825 - RNA, 17 nt, Human
uugagucuguacuaaac

SEQ ID NO: 2669826 - RNA, 13 nt, Human
uugaguauuguuu

SEQ ID NO: 2669827 - RNA, 14 nt, Human
uugaguauuguuua

SEQ ID NO: 2669828 - RNA, 15 nt, Human
uugaguauuguuuaa

SEQ ID NO: 2669829 - RNA, 20 nt, Human
uugaguauuguuuaaaaugu

SEQ ID NO: 2669830 - RNA, 22 nt, Human
uugaguauuguuuaaaauguaa

SEQ ID NO: 2669831 - RNA, 20 nt, Human
aucuaaaucuauuuauuaau

SEQ ID NO: 2669832 - RNA, 22 nt, Human
aucuaaaucuauuuauuaauau

SEQ ID NO: 2669833 - RNA, 14 nt, Human
aucguuuuuguauu

SEQ ID NO: 2669834 - RNA, 15 nt, Human
aucguuuuuguauuu

SEQ ID NO: 2669835 - RNA, 20 nt, Human
uugaagccaaguggggugcu

SEQ ID NO: 2669836 - RNA, 11 nt, Human
uugaagccaaa

SEQ ID NO: 2669837 - RNA, 14 nt, Human
uugaagccaaagaa

SEQ ID NO: 2669838 - RNA, 15 nt, Human
uugaagccaaagaaa

SEQ ID NO: 2669839 - RNA, 14 nt, Human
aucgugcuacugca

SEQ ID NO: 2669840 - RNA, 20 nt, Human
auccucuguaaacuuuuugu

SEQ ID NO: 2669841 - RNA, 16 nt, Human
auccucucaccucagc

SEQ ID NO: 2669842 - RNA, 14 nt, Human
auccuccucccacc

SEQ ID NO: 2669843 - RNA, 11 nt, Human
auccuccugca

SEQ ID NO: 2669844 - RNA, 16 nt, Human
uugaagccaucuaaag

SEQ ID NO: 2669845 - RNA, 23 nt, Human
uugaauaaacaccacuggauuaa

SEQ ID NO: 2669846 - RNA, 22 nt, Human
uugaauaaacaccacuggauua

SEQ ID NO: 2669847 - RNA, 21 nt, Human
uugaauaaacaccacuggauu

SEQ ID NO: 2669848 - RNA, 23 nt, Human
uugaaucaauaauauauuuucug

SEQ ID NO: 2669849 - RNA, 14 nt, Human
uugaauaaaugugu

SEQ ID NO: 2669850 - RNA, 17 nt, Human
uugaauacuugaaccau

SEQ ID NO: 2669851 - RNA, 16 nt, Human
uugaauacuugaacca

SEQ ID NO: 2669852 - RNA, 14 nt, Human
uugaauacuugaac

SEQ ID NO: 2669853 - RNA, 12 nt, Human
uugaauacuuga

SEQ ID NO: 2669854 - RNA, 14 nt, Human
uugaaucaauaaua

SEQ ID NO: 2669855 - RNA, 22 nt, Human
uugaaucaauaauauauuuucu

SEQ ID NO: 2669856 - RNA, 10 nt, Human
uugaaucaau

SEQ ID NO: 2669857 - RNA, 18 nt, Human
aucuacugcauuuaggga

SEQ ID NO: 2669858 - RNA, 14 nt, Human
aucucagggccugg

SEQ ID NO: 2669859 - RNA, 16 nt, Human
aucucagggccugguc

SEQ ID NO: 2669860 - RNA, 13 nt, Human
aucucauuuaagg

SEQ ID NO: 2669861 - RNA, 16 nt, Human
aucucauuuaagggaa

SEQ ID NO: 2669862 - RNA, 17 nt, Human
aucucauuuaagggaaa

SEQ ID NO: 2669863 - RNA, 18 nt, Human
aucucauuuaagggaaaa

SEQ ID NO: 2669864 - RNA, 19 nt, Human
aucucauuuaagggaaaaa

SEQ ID NO: 2669865 - RNA, 20 nt, Human
aucucauuuaagggaaaaau

SEQ ID NO: 2669866 - RNA, 23 nt, Human
aucucauuuaagggaaaaauaua

SEQ ID NO: 2669867 - RNA, 19 nt, Human
aucuccacaaccucuuccc

SEQ ID NO: 2669868 - RNA, 18 nt, Human
aucuccacaaccucuucc

SEQ ID NO: 2669869 - RNA, 15 nt, Human
aucucuugagccugg

SEQ ID NO: 2669870 - RNA, 18 nt, Human
aucucuugagccugggag

SEQ ID NO: 2669871 - RNA, 12 nt, Human
uugauuauuugc

SEQ ID NO: 2669872 - RNA, 13 nt, Human
uugauuauuugca

SEQ ID NO: 2669873 - RNA, 14 nt, Human
uugauuauuugcau

SEQ ID NO: 2669874 - RNA, 15 nt, Human
uugauuauuugcaug

SEQ ID NO: 2669875 - RNA, 16 nt, Human
uugauuauuugcaugu

SEQ ID NO: 2669876 - RNA, 20 nt, Human
uugauuauuugcauguuaug

SEQ ID NO: 2669877 - RNA, 23 nt, Human
uugauuauuugcauguuauguuu

SEQ ID NO: 2669878 - RNA, 23 nt, Human
uugauuauuuuuuuuuucuucuu

SEQ ID NO: 2669879 - RNA, 16 nt, Human
uugauuauuagccagg

SEQ ID NO: 2669880 - RNA, 21 nt, Human
aucugaaauaggaaacaagug

SEQ ID NO: 2669881 - RNA, 19 nt, Human
uugcauauuauaaaggaua

SEQ ID NO: 2669882 - RNA, 20 nt, Human
uugcaucacuguaucauuuu

SEQ ID NO: 2669883 - RNA, 19 nt, Human
uugcaucagaaagcuuuau

SEQ ID NO: 2669884 - RNA, 18 nt, Human
uugcaccacugcacucca

SEQ ID NO: 2669885 - RNA, 16 nt, Human
uugcaccacugcacuc

SEQ ID NO: 2669886 - RNA, 15 nt, Human
uugcaccacugcacu

SEQ ID NO: 2669887 - RNA, 14 nt, Human
uugcaccacugcac

SEQ ID NO: 2669888 - RNA, 14 nt, Human
auccggagaagcug

SEQ ID NO: 2669889 - RNA, 21 nt, Human
uucuuuggauucuaaauacau

SEQ ID NO: 2669890 - RNA, 20 nt, Human
auccgcugccagccuugagc

SEQ ID NO: 2669891 - RNA, 15 nt, Human
auccgcgugugccug

SEQ ID NO: 2669892 - RNA, 16 nt, Human
auccgcgugugccugu

SEQ ID NO: 2669893 - RNA, 16 nt, Human
auccuaggcauuugcu

SEQ ID NO: 2669894 - RNA, 11 nt, Human
auccuccuccc

SEQ ID NO: 2669895 - RNA, 17 nt, Human
auccgacugcuuuggac

SEQ ID NO: 2669896 - RNA, 15 nt, Human
uugaaagugccuuug

SEQ ID NO: 2669897 - RNA, 22 nt, Human
uucuuaaguauguuauuuucug

SEQ ID NO: 2669898 - RNA, 15 nt, Human
uucuucucugugaga

SEQ ID NO: 2669899 - RNA, 22 nt, Human
uucuucucugugagaagguuua

SEQ ID NO: 2669900 - RNA, 19 nt, Human
uucuucucuuagauucuua

SEQ ID NO: 2669901 - RNA, 20 nt, Human
uucuuaacccuuuccagagu

SEQ ID NO: 2669902 - RNA, 21 nt, Human
uucuucuguguuuauaaaaua

SEQ ID NO: 2669903 - RNA, 13 nt, Human
uucuucuguauuu

SEQ ID NO: 2669904 - RNA, 20 nt, Human
uucuucuguguuuauaaaau

SEQ ID NO: 2669905 - RNA, 18 nt, Human
uucuuuuuuuccuuuuua

SEQ ID NO: 2669906 - RNA, 19 nt, Human
uucuuuuuuuccuuuuuaa

SEQ ID NO: 2669907 - RNA, 21 nt, Human
uucuuuuuuauuaaucacugu

SEQ ID NO: 2669908 - RNA, 20 nt, Human
uucuuuuuuauuaaucacug

SEQ ID NO: 2669909 - RNA, 22 nt, Human
uucuuuuuuauuaaucacugug

SEQ ID NO: 2669910 - RNA, 14 nt, Human
uucuuuuuuauuaa

SEQ ID NO: 2669911 - RNA, 16 nt, Human
uucuuuuuuauuaauc

SEQ ID NO: 2669912 - RNA, 15 nt, Human
uucuuuuuuauuaau

SEQ ID NO: 2669913 - RNA, 20 nt, Human
uucucuuccuuuuaucagua

SEQ ID NO: 2669914 - RNA, 14 nt, Human
uucucuugagcugg

SEQ ID NO: 2669915 - RNA, 15 nt, Human
uucucuugagcuggc

SEQ ID NO: 2669916 - RNA, 16 nt, Human
uucucuugagcuggcc

SEQ ID NO: 2669917 - RNA, 17 nt, Human
uucucuugagcuggccu

SEQ ID NO: 2669918 - RNA, 22 nt, Human
uucucuugagcuggccucucua

SEQ ID NO: 2669919 - RNA, 18 nt, Human
uucucuugagcuggccuc

SEQ ID NO: 2669920 - RNA, 20 nt, Human
uucucuugagcuggccucuc

SEQ ID NO: 2669921 - RNA, 15 nt, Human
aucaguaacccccuu

SEQ ID NO: 2669922 - RNA, 19 nt, Human
aucaguaacccccuuaaau

SEQ ID NO: 2669923 - RNA, 22 nt, Human
aucaguaacccccuuaaauuua

SEQ ID NO: 2669924 - RNA, 23 nt, Human
aucaguaacccccuuaaauuuaa

SEQ ID NO: 2669925 - RNA, 10 nt, Human
uucuccugga

SEQ ID NO: 2669926 - RNA, 19 nt, Human
uucugccaucuagccagcc

SEQ ID NO: 2669927 - RNA, 21 nt, Human
uucugccaucuagccagcccc

SEQ ID NO: 2669928 - RNA, 13 nt, Human
uucugcccuggcu

SEQ ID NO: 2669929 - RNA, 14 nt, Human
uucugcccuggcug

SEQ ID NO: 2669930 - RNA, 14 nt, Human
uucugccuggagac

SEQ ID NO: 2669931 - RNA, 16 nt, Human
uucugcccuggcugcu

SEQ ID NO: 2669932 - RNA, 15 nt, Human
uucuggcuguuugag

SEQ ID NO: 2669933 - RNA, 18 nt, Human
uucuggcuuuaagccuuc

SEQ ID NO: 2669934 - RNA, 12 nt, Human
auccaagccucc

SEQ ID NO: 2669935 - RNA, 14 nt, Human
auccaagccuccac

SEQ ID NO: 2669936 - RNA, 15 nt, Human
auccaagccuccaca

SEQ ID NO: 2669937 - RNA, 16 nt, Human
auccaagccuccacag

SEQ ID NO: 2669938 - RNA, 17 nt, Human
auccaagccuccacagc

SEQ ID NO: 2669939 - RNA, 18 nt, Human
auccaagccuccacagcg

SEQ ID NO: 2669940 - RNA, 19 nt, Human
auccaagccuccacagcga

SEQ ID NO: 2669941 - RNA, 21 nt, Human
auccaagccuccacagcgagg

SEQ ID NO: 2669942 - RNA, 11 nt, Human
aucauuuucau

SEQ ID NO: 2669943 - RNA, 14 nt, Human
aucauuuugaaauu

SEQ ID NO: 2669944 - RNA, 15 nt, Human
aucauuuugaaauug

SEQ ID NO: 2669945 - RNA, 19 nt, Human
uucuggggggacccagugc

SEQ ID NO: 2669946 - RNA, 20 nt, Human
uucuggggggacccagugca

SEQ ID NO: 2669947 - RNA, 21 nt, Human
uucuggggggacccagugcag

SEQ ID NO: 2669948 - RNA, 22 nt, Human
uucuggggggacccagugcaga

SEQ ID NO: 2669949 - RNA, 23 nt, Human
uucuggggggacccagugcagaa

SEQ ID NO: 2669950 - RNA, 20 nt, Human
uucuggggcaggcugggcca

SEQ ID NO: 2669951 - RNA, 21 nt, Human
uucuggggcaggcugggccau

SEQ ID NO: 2669952 - RNA, 14 nt, Human
uucuggggaaagac

SEQ ID NO: 2669953 - RNA, 20 nt, Human
uucuggggaaagacacugcc

SEQ ID NO: 2669954 - RNA, 21 nt, Human
uucuggggaaagacacugccu

SEQ ID NO: 2669955 - RNA, 17 nt, Human
uucuggggcaggcuggg

SEQ ID NO: 2669956 - RNA, 22 nt, Human
uucuggggaaagacacugccug

SEQ ID NO: 2669957 - RNA, 23 nt, Human
uucuggggaaagacacugccugg

SEQ ID NO: 2669958 - RNA, 18 nt, Human
uucuggggcaggcugggc

SEQ ID NO: 2669959 - RNA, 19 nt, Human
uucuggggcaggcugggcc

SEQ ID NO: 2669960 - RNA, 13 nt, Human
auccauauuuuau

SEQ ID NO: 2669961 - RNA, 18 nt, Human
auccauauuuuauuacug

SEQ ID NO: 2669962 - RNA, 19 nt, Human
auccauauuuuauuacugu

SEQ ID NO: 2669963 - RNA, 23 nt, Human
auccauauuuuauuacuguuuau

SEQ ID NO: 2669964 - RNA, 11 nt, Human
auccagugacc

SEQ ID NO: 2669965 - RNA, 17 nt, Human
auccagugaccucucuc

SEQ ID NO: 2669966 - RNA, 19 nt, Human
auccagugaccucucucuc

SEQ ID NO: 2669967 - RNA, 21 nt, Human
auccagugaccucucucucug

SEQ ID NO: 2669968 - RNA, 22 nt, Human
auccagugaccucucucucugg

SEQ ID NO: 2669969 - RNA, 19 nt, Human
auccaguuauaagaagaag

SEQ ID NO: 2669970 - RNA, 20 nt, Human
auccacccaacccuaucucc

SEQ ID NO: 2669971 - RNA, 17 nt, Human
uuccgugaaaacggagc

SEQ ID NO: 2669972 - RNA, 15 nt, Human
uucccuauuagagaa

SEQ ID NO: 2669973 - RNA, 12 nt, Human
uucccucacccc

SEQ ID NO: 2669974 - RNA, 13 nt, Human
uucccucaccccc

SEQ ID NO: 2669975 - RNA, 14 nt, Human
uucccucacccccu

SEQ ID NO: 2669976 - RNA, 18 nt, Human
uucccucacccccuccca

SEQ ID NO: 2669977 - RNA, 19 nt, Human
uucccucacccccucccac

SEQ ID NO: 2669978 - RNA, 22 nt, Human
uucccucacccccucccacccc

SEQ ID NO: 2669979 - RNA, 15 nt, Human
auagauuuuauaaga

SEQ ID NO: 2669980 - RNA, 13 nt, Human
uuccucugccugc

SEQ ID NO: 2669981 - RNA, 14 nt, Human
uuccucugccugcc

SEQ ID NO: 2669982 - RNA, 15 nt, Human
uuccucugccugccc

SEQ ID NO: 2669983 - RNA, 16 nt, Human
uuccucugccugcccc

SEQ ID NO: 2669984 - RNA, 13 nt, Human
uuccuaaagaaaa

SEQ ID NO: 2669985 - RNA, 14 nt, Human
uuccgugcguggca

SEQ ID NO: 2669986 - RNA, 16 nt, Human
uuccgugcguggcacu

SEQ ID NO: 2669987 - RNA, 12 nt, Human
uuccucugccug

SEQ ID NO: 2669988 - RNA, 17 nt, Human
aucaacaauaaaauuuu

SEQ ID NO: 2669989 - RNA, 22 nt, Human
aucaacaauaaaauuuuuuuaa

SEQ ID NO: 2669990 - RNA, 17 nt, Human
aucaaauuaauugugug

SEQ ID NO: 2669991 - RNA, 16 nt, Human
aucaaauuaauugugu

SEQ ID NO: 2669992 - RNA, 14 nt, Human
uuccugaaccaugu

SEQ ID NO: 2669993 - RNA, 23 nt, Human
uuccugucccugcgccuuuccuu

SEQ ID NO: 2669994 - RNA, 17 nt, Human
uuccugugauccaccca

SEQ ID NO: 2669995 - RNA, 22 nt, Human
uuccugugauccacccaacccu

SEQ ID NO: 2669996 - RNA, 18 nt, Human
auauuuuuauauuuccuu

SEQ ID NO: 2669997 - RNA, 19 nt, Human
auauuuuuauauuuccuuu

SEQ ID NO: 2669998 - RNA, 20 nt, Human
auauuuuuauauuuccuuua

SEQ ID NO: 2669999 - RNA, 21 nt, Human
auauuuuuauauuuccuuuau

SEQ ID NO: 2670000 - RNA, 12 nt, Human
aucacugccaca

SEQ ID NO: 2670001 - RNA, 18 nt, Human
aucacugccacacucucc

SEQ ID NO: 2670002 - RNA, 19 nt, Human
aucacugccacacucucca

SEQ ID NO: 2670003 - RNA, 20 nt, Human
aucacugccacacucuccau

SEQ ID NO: 2670004 - RNA, 22 nt, Human
aucacugccacacucuccauca

SEQ ID NO: 2670005 - RNA, 16 nt, Human
aucaagggaagaacua

SEQ ID NO: 2670006 - RNA, 18 nt, Human
aucaagggaagaacuauu

SEQ ID NO: 2670007 - RNA, 13 nt, Human
aucaauccugauu

SEQ ID NO: 2670008 - RNA, 19 nt, Human
aucaauccugauuccucuc

SEQ ID NO: 2670009 - RNA, 20 nt, Human
aucaauccugauuccucucu

SEQ ID NO: 2670010 - RNA, 23 nt, Human
aucaauccugauuccucucuaag

SEQ ID NO: 2670011 - RNA, 15 nt, Human
aucaggggagaaaaa

SEQ ID NO: 2670012 - RNA, 14 nt, Human
aucaggcucccagg

SEQ ID NO: 2670013 - RNA, 13 nt, Human
aucaggcucccag

SEQ ID NO: 2670014 - RNA, 12 nt, Human
uucuaagagaag

SEQ ID NO: 2670015 - RNA, 13 nt, Human
uucuaagagaagu

SEQ ID NO: 2670016 - RNA, 20 nt, Human
uucuaaauguuuggcaugua

SEQ ID NO: 2670017 - RNA, 20 nt, Human
uucggaagggguuccucaaa

SEQ ID NO: 2670018 - RNA, 22 nt, Human
uucgcuucuugccucugugcug

SEQ ID NO: 2670019 - RNA, 21 nt, Human
aucacugccacacucuccauc

SEQ ID NO: 2670020 - RNA, 15 nt, Human
augugauuacaaggc

SEQ ID NO: 2670021 - RNA, 18 nt, Human
augugauggacacuccag

SEQ ID NO: 2670022 - RNA, 18 nt, Human
augugcaaaaccuuuuac

SEQ ID NO: 2670023 - RNA, 21 nt, Human
augugcaaaaccuuuuacugg

SEQ ID NO: 2670024 - RNA, 12 nt, Human
augugacccucc

SEQ ID NO: 2670025 - RNA, 14 nt, Human
augugacccuccaa

SEQ ID NO: 2670026 - RNA, 13 nt, Human
uuugucuuuuugu

SEQ ID NO: 2670027 - RNA, 22 nt, Human
uuugugcugaauguugggacug

SEQ ID NO: 2670028 - RNA, 20 nt, Human
auguccaguaagaucacugu

SEQ ID NO: 2670029 - RNA, 19 nt, Human
auguccaguaagaucacug

SEQ ID NO: 2670030 - RNA, 18 nt, Human
auguccaguaagaucacu

SEQ ID NO: 2670031 - RNA, 16 nt, Human
auguccaguaagauca

SEQ ID NO: 2670032 - RNA, 12 nt, Human
auguccaggaaa

SEQ ID NO: 2670033 - RNA, 16 nt, Human
auguccagcaccuugu

SEQ ID NO: 2670034 - RNA, 21 nt, Human
auguccagcaccuugugccug

SEQ ID NO: 2670035 - RNA, 22 nt, Human
auguccagcaccuugugccugg

SEQ ID NO: 2670036 - RNA, 13 nt, Human
augucuccucccc

SEQ ID NO: 2670037 - RNA, 21 nt, Human
auguauguguuuagaauugaa

SEQ ID NO: 2670038 - RNA, 20 nt, Human
auguauguguuuagaauuga

SEQ ID NO: 2670039 - RNA, 18 nt, Human
auguauguguuuagaauu

SEQ ID NO: 2670040 - RNA, 12 nt, Human
auguauguguuu

SEQ ID NO: 2670041 - RNA, 17 nt, Human
auguauguguuuagaau

SEQ ID NO: 2670042 - RNA, 16 nt, Human
auguauguguuuagaa

SEQ ID NO: 2670043 - RNA, 15 nt, Human
auguauguguuuaga

SEQ ID NO: 2670044 - RNA, 14 nt, Human
auguauguguuuag

SEQ ID NO: 2670045 - RNA, 19 nt, Human
uuugcugcacuuuuuacuu

SEQ ID NO: 2670046 - RNA, 12 nt, Human
auguauguuucu

SEQ ID NO: 2670047 - RNA, 14 nt, Human
auguauguuucucu

SEQ ID NO: 2670048 - RNA, 19 nt, Human
auguauguuuggcucugcu

SEQ ID NO: 2670049 - RNA, 14 nt, Human
auguaguaucuaua

SEQ ID NO: 2670050 - RNA, 19 nt, Human
auguaguaucuauaugacu

SEQ ID NO: 2670051 - RNA, 12 nt, Human
auguagguccuc

SEQ ID NO: 2670052 - RNA, 21 nt, Human
auguagguccucagaaagugu

SEQ ID NO: 2670053 - RNA, 16 nt, Human
auguagguaagacugu

SEQ ID NO: 2670054 - RNA, 18 nt, Human
auguagguaagacuguag

SEQ ID NO: 2670055 - RNA, 19 nt, Human
auguagguaagacuguaga

SEQ ID NO: 2670056 - RNA, 20 nt, Human
auguagguaagacuguagau

SEQ ID NO: 2670057 - RNA, 23 nt, Human
auguagcccccuggccucugugc

SEQ ID NO: 2670058 - RNA, 21 nt, Human
auguagcccccuggccucugu

SEQ ID NO: 2670059 - RNA, 19 nt, Human
auguagcccccuggccucu

SEQ ID NO: 2670060 - RNA, 18 nt, Human
auguagcccccuggccuc

SEQ ID NO: 2670061 - RNA, 18 nt, Human
auguagaggcuuguuuac

SEQ ID NO: 2670062 - RNA, 23 nt, Human
auguaggagcugccuuggcucag

SEQ ID NO: 2670063 - RNA, 14 nt, Human
auguacuuuuuagu

SEQ ID NO: 2670064 - RNA, 15 nt, Human
auguacuuuuuagua

SEQ ID NO: 2670065 - RNA, 20 nt, Human
auguacuuuuauuuuacaca

SEQ ID NO: 2670066 - RNA, 22 nt, Human
auguacuuuuauuuuacacaga

SEQ ID NO: 2670067 - RNA, 18 nt, Human
auguacguccagccugcc

SEQ ID NO: 2670068 - RNA, 20 nt, Human
auguacguccagccugcccc

SEQ ID NO: 2670069 - RNA, 23 nt, Human
uuugcaaccaggaacagcaaaug

SEQ ID NO: 2670070 - RNA, 14 nt, Human
auguagcagugagu

SEQ ID NO: 2670071 - RNA, 14 nt, Human
uuugcaaccaggaa

SEQ ID NO: 2670072 - RNA, 15 nt, Human
uuugcaaccaggaac

SEQ ID NO: 2670073 - RNA, 18 nt, Human
uuugcaaaguguauuagg

SEQ ID NO: 2670074 - RNA, 13 nt, Human
uuugcugcucuuc

SEQ ID NO: 2670075 - RNA, 13 nt, Human
uuugcucuucaga

SEQ ID NO: 2670076 - RNA, 18 nt, Human
uuugcucuucagaugcca

SEQ ID NO: 2670077 - RNA, 20 nt, Human
uuugcucuucagaugccacu

SEQ ID NO: 2670078 - RNA, 21 nt, Human
uuugcucuucagaugccacuu

SEQ ID NO: 2670079 - RNA, 14 nt, Human
uuugacuaauuuua

SEQ ID NO: 2670080 - RNA, 16 nt, Human
uuugacuaauuuuaca

SEQ ID NO: 2670081 - RNA, 17 nt, Human
uuugacuaauuuuacau

SEQ ID NO: 2670082 - RNA, 21 nt, Human
uuugacuaauuuuacauguuu

SEQ ID NO: 2670083 - RNA, 21 nt, Human
uuugauguguuguucuuggca

SEQ ID NO: 2670084 - RNA, 21 nt, Human
uuugaugucagcaguugcugg

SEQ ID NO: 2670085 - RNA, 20 nt, Human
uuugaugucagcaguugcug

SEQ ID NO: 2670086 - RNA, 17 nt, Human
uuugaugucagcaguug

SEQ ID NO: 2670087 - RNA, 16 nt, Human
uuugaugucagcaguu

SEQ ID NO: 2670088 - RNA, 14 nt, Human
uuugaugucagcag

SEQ ID NO: 2670089 - RNA, 17 nt, Human
augguugaugauacuuc

SEQ ID NO: 2670090 - RNA, 19 nt, Human
augguucuggcuguuugag

SEQ ID NO: 2670091 - RNA, 18 nt, Human
augguucuggcuguuuga

SEQ ID NO: 2670092 - RNA, 16 nt, Human
augguuauguuuuucu

SEQ ID NO: 2670093 - RNA, 20 nt, Human
augguucucucaacaagaaa

SEQ ID NO: 2670094 - RNA, 22 nt, Human
augguuuccuccauuugagaaa

SEQ ID NO: 2670095 - RNA, 15 nt, Human
augguuucuugcaag

SEQ ID NO: 2670096 - RNA, 23 nt, Human
augguuugacucaucuuauaugg

SEQ ID NO: 2670097 - RNA, 14 nt, Human
augguucuucaccu

SEQ ID NO: 2670098 - RNA, 14 nt, Human
augguuuuaaacuu

SEQ ID NO: 2670099 - RNA, 15 nt, Human
augguuuuaaacuuu

SEQ ID NO: 2670100 - RNA, 13 nt, Human
augguuuuaagaa

SEQ ID NO: 2670101 - RNA, 17 nt, Human
auguaaaacagaaaaaa

SEQ ID NO: 2670102 - RNA, 15 nt, Human
augguuuugugccau

SEQ ID NO: 2670103 - RNA, 19 nt, Human
augguuuugugccaucugu

SEQ ID NO: 2670104 - RNA, 16 nt, Human
auguaaagugucagaa

SEQ ID NO: 2670105 - RNA, 16 nt, Human
auguaaauaauucuuu

SEQ ID NO: 2670106 - RNA, 14 nt, Human
auguaaauaauucu

SEQ ID NO: 2670107 - RNA, 13 nt, Human
auguaaauaauuc

SEQ ID NO: 2670108 - RNA, 15 nt, Human
auguaaauguaaacu

SEQ ID NO: 2670109 - RNA, 23 nt, Human
auggugccugagaggcaggcaua

SEQ ID NO: 2670110 - RNA, 18 nt, Human
auggugugaacccgggag

SEQ ID NO: 2670111 - RNA, 22 nt, Human
augguguagcccucccacuuug

SEQ ID NO: 2670112 - RNA, 15 nt, Human
augguguggccugug

SEQ ID NO: 2670113 - RNA, 18 nt, Human
augguuacuucuucucuu

SEQ ID NO: 2670114 - RNA, 14 nt, Human
auggugccugagag

SEQ ID NO: 2670115 - RNA, 15 nt, Human
auggugccugagagg

SEQ ID NO: 2670116 - RNA, 16 nt, Human
auggugccugagaggc

SEQ ID NO: 2670117 - RNA, 17 nt, Human
auggugccugagaggca

SEQ ID NO: 2670118 - RNA, 18 nt, Human
auggugccugagaggcag

SEQ ID NO: 2670119 - RNA, 20 nt, Human
auggugccugagaggcaggc

SEQ ID NO: 2670120 - RNA, 21 nt, Human
auggugccugagaggcaggca

SEQ ID NO: 2670121 - RNA, 19 nt, Human
auggugaugcagucuuaga

SEQ ID NO: 2670122 - RNA, 20 nt, Human
auggugaugcagucuuagau

SEQ ID NO: 2670123 - RNA, 14 nt, Human
augggaugagaaaa

SEQ ID NO: 2670124 - RNA, 22 nt, Human
augggagggggcuugaagccaa

SEQ ID NO: 2670125 - RNA, 23 nt, Human
augggagggggcuugaagccaaa

SEQ ID NO: 2670126 - RNA, 17 nt, Human
uuucugauuugcugcuc

SEQ ID NO: 2670127 - RNA, 14 nt, Human
uuucuggggccuag

SEQ ID NO: 2670128 - RNA, 17 nt, Human
uuucugugcccuccuga

SEQ ID NO: 2670129 - RNA, 13 nt, Human
uuucugugcccuc

SEQ ID NO: 2670130 - RNA, 15 nt, Human
uuucugugugucagu

SEQ ID NO: 2670131 - RNA, 18 nt, Human
uuucugugugucaguuuu

SEQ ID NO: 2670132 - RNA, 21 nt, Human
uuucugugugucaguuuucau

SEQ ID NO: 2670133 - RNA, 22 nt, Human
uuucugugugucaguuuucaua

SEQ ID NO: 2670134 - RNA, 15 nt, Human
uuucugguggucugu

SEQ ID NO: 2670135 - RNA, 17 nt, Human
uuucugguggucuguug

SEQ ID NO: 2670136 - RNA, 20 nt, Human
uuucugguggucuguuggca

SEQ ID NO: 2670137 - RNA, 15 nt, Human
uuucuggggaaagac

SEQ ID NO: 2670138 - RNA, 21 nt, Human
uuucuggggaaagacacugcc

SEQ ID NO: 2670139 - RNA, 22 nt, Human
uuucuggggaaagacacugccu

SEQ ID NO: 2670140 - RNA, 12 nt, Human
uuugaaaaauau

SEQ ID NO: 2670141 - RNA, 13 nt, Human
uuugaaaaauaua

SEQ ID NO: 2670142 - RNA, 21 nt, Human
uuugaaaaauauaaaauuaug

SEQ ID NO: 2670143 - RNA, 14 nt, Human
uuucuuuuuuuccu

SEQ ID NO: 2670144 - RNA, 17 nt, Human
uuucuuuuuuuuuaagu

SEQ ID NO: 2670145 - RNA, 18 nt, Human
uuucuuuuuuuuuaaguu

SEQ ID NO: 2670146 - RNA, 11 nt, Human
auggggaggga

SEQ ID NO: 2670147 - RNA, 14 nt, Human
auggggguuucacc

SEQ ID NO: 2670148 - RNA, 17 nt, Human
augcaggcuccccugag

SEQ ID NO: 2670149 - RNA, 16 nt, Human
augcaggcuccccuga

SEQ ID NO: 2670150 - RNA, 15 nt, Human
augcaggcuccccug

SEQ ID NO: 2670151 - RNA, 14 nt, Human
augcagcuuugcaa

SEQ ID NO: 2670152 - RNA, 15 nt, Human
augcagcuuugcaaa

SEQ ID NO: 2670153 - RNA, 13 nt, Human
uuuaauuguuuaa

SEQ ID NO: 2670154 - RNA, 15 nt, Human
uuuaauuguuuaaaa

SEQ ID NO: 2670155 - RNA, 20 nt, Human
uuuaauuguccaguuugucu

SEQ ID NO: 2670156 - RNA, 17 nt, Human
uuuaauuuuuuuuagua

SEQ ID NO: 2670157 - RNA, 18 nt, Human
uuuaauuuuuuuuaguau

SEQ ID NO: 2670158 - RNA, 15 nt, Human
uuuaagugaaaaugg

SEQ ID NO: 2670159 - RNA, 17 nt, Human
uuuaagugaaaaugguc

SEQ ID NO: 2670160 - RNA, 19 nt, Human
augcaguuagcugaagaau

SEQ ID NO: 2670161 - RNA, 20 nt, Human
augcaguuagcugaagaauu

SEQ ID NO: 2670162 - RNA, 22 nt, Human
augcaguuagcugaagaauuga

SEQ ID NO: 2670163 - RNA, 14 nt, Human
augccacccuagcc

SEQ ID NO: 2670164 - RNA, 21 nt, Human
augccauuuuaaggaaaacua

SEQ ID NO: 2670165 - RNA, 18 nt, Human
augccacaucaaaccuuu

SEQ ID NO: 2670166 - RNA, 13 nt, Human
augcccucucagg

SEQ ID NO: 2670167 - RNA, 10 nt, Human
augcccucuc

SEQ ID NO: 2670168 - RNA, 19 nt, Human
augcgucccaagauguuga

SEQ ID NO: 2670169 - RNA, 13 nt, Human
augcgucccaaga

SEQ ID NO: 2670170 - RNA, 17 nt, Human
augauacaaugaacacu

SEQ ID NO: 2670171 - RNA, 13 nt, Human
augauacaaugaa

SEQ ID NO: 2670172 - RNA, 14 nt, Human
uuguucuuucagaa

SEQ ID NO: 2670173 - RNA, 15 nt, Human
uuguucuuucagaaa

SEQ ID NO: 2670174 - RNA, 15 nt, Human
uuguucauagcccag

SEQ ID NO: 2670175 - RNA, 16 nt, Human
uuguucaucauccaga

SEQ ID NO: 2670176 - RNA, 17 nt, Human
uuguucaucauccagau

SEQ ID NO: 2670177 - RNA, 17 nt, Human
uuguuuucugacuaauu

SEQ ID NO: 2670178 - RNA, 16 nt, Human
uuguuuucugacuaau

SEQ ID NO: 2670179 - RNA, 18 nt, Human
uuguuuucugacuaauua

SEQ ID NO: 2670180 - RNA, 15 nt, Human
uuguuuucugacuaa

SEQ ID NO: 2670181 - RNA, 13 nt, Human
uuuaaaaauagaa

SEQ ID NO: 2670182 - RNA, 16 nt, Human
uuuaaaaauagaaaca

SEQ ID NO: 2670183 - RNA, 17 nt, Human
uuuaaaaauagaaacau

SEQ ID NO: 2670184 - RNA, 17 nt, Human
uuguuuuggauggcuug

SEQ ID NO: 2670185 - RNA, 12 nt, Human
uuuaaaaauugu

SEQ ID NO: 2670186 - RNA, 15 nt, Human
uuuaaaaauuguuau

SEQ ID NO: 2670187 - RNA, 11 nt, Human
uuuaaaaauau

SEQ ID NO: 2670188 - RNA, 15 nt, Human
uuuaaaguauuuucu

SEQ ID NO: 2670189 - RNA, 14 nt, Human
uuuaaagugcaaaa

SEQ ID NO: 2670190 - RNA, 23 nt, Human
uuuaaagguggauuuuguuuaaa

SEQ ID NO: 2670191 - RNA, 18 nt, Human
uuuaaagaauaugacuuu

SEQ ID NO: 2670192 - RNA, 17 nt, Human
uuuaaagacccuccuau

SEQ ID NO: 2670193 - RNA, 19 nt, Human
augauugaauuauauguuc

SEQ ID NO: 2670194 - RNA, 14 nt, Human
augcaagcagagga

SEQ ID NO: 2670195 - RNA, 17 nt, Human
augcaagcagaggacca

SEQ ID NO: 2670196 - RNA, 21 nt, Human
augcaagcagaggaccagggc

SEQ ID NO: 2670197 - RNA, 22 nt, Human
augcaagcagaggaccagggcc

SEQ ID NO: 2670198 - RNA, 23 nt, Human
augcaagcagaggaccagggccu

SEQ ID NO: 2670199 - RNA, 16 nt, Human
augcaaccaagucaca

SEQ ID NO: 2670200 - RNA, 17 nt, Human
augcaaccaagucacac

SEQ ID NO: 2670201 - RNA, 18 nt, Human
augcaaccaagucacacg

SEQ ID NO: 2670202 - RNA, 21 nt, Human
augcaaccaagucacacgcuu

SEQ ID NO: 2670203 - RNA, 14 nt, Human
auggccccagcaca

SEQ ID NO: 2670204 - RNA, 15 nt, Human
auggccccagcacag

SEQ ID NO: 2670205 - RNA, 17 nt, Human
auggccccagcacagcu

SEQ ID NO: 2670206 - RNA, 18 nt, Human
auggccccagcacagcuu

SEQ ID NO: 2670207 - RNA, 20 nt, Human
auggccccagcacagcuuga

SEQ ID NO: 2670208 - RNA, 17 nt, Human
auggcaucccuuuuuca

SEQ ID NO: 2670209 - RNA, 21 nt, Human
auggcaucccuuuuucauaaa

SEQ ID NO: 2670210 - RNA, 22 nt, Human
auggcaucccuuuuucauaaau

SEQ ID NO: 2670211 - RNA, 19 nt, Human
auggcagccuacucuccuu

SEQ ID NO: 2670212 - RNA, 15 nt, Human
auggacacuccaggg

SEQ ID NO: 2670213 - RNA, 13 nt, Human
auggcccugggcg

SEQ ID NO: 2670214 - RNA, 13 nt, Human
auggcucagggug

SEQ ID NO: 2670215 - RNA, 14 nt, Human
auggcucagggugg

SEQ ID NO: 2670216 - RNA, 20 nt, Human
augggagggggcuugaagcc

SEQ ID NO: 2670217 - RNA, 16 nt, Human
uuucauuaaauccuuu

SEQ ID NO: 2670218 - RNA, 12 nt, Human
uuucaaaguuuu

SEQ ID NO: 2670219 - RNA, 20 nt, Human
uuucaaaguuuuguuguacu

SEQ ID NO: 2670220 - RNA, 21 nt, Human
uuucaaaguuuuguuguacuu

SEQ ID NO: 2670221 - RNA, 14 nt, Human
auggagaagcugca

SEQ ID NO: 2670222 - RNA, 15 nt, Human
auggagaagcugcag

SEQ ID NO: 2670223 - RNA, 16 nt, Human
auggagaagcugcagg

SEQ ID NO: 2670224 - RNA, 17 nt, Human
auggaauuuugcaaaga

SEQ ID NO: 2670225 - RNA, 17 nt, Human
auggaauuuuuuuguac

SEQ ID NO: 2670226 - RNA, 16 nt, Human
auggaauuuuuuugua

SEQ ID NO: 2670227 - RNA, 15 nt, Human
auggaauuuuuuugu

SEQ ID NO: 2670228 - RNA, 19 nt, Human
auggaauuuugcaaagauu

SEQ ID NO: 2670229 - RNA, 18 nt, Human
auggaauuuuuuuguacg

SEQ ID NO: 2670230 - RNA, 18 nt, Human
uuucaaaggaacauugug

SEQ ID NO: 2670231 - RNA, 22 nt, Human
auggacuaucugucugguggcc

SEQ ID NO: 2670232 - RNA, 20 nt, Human
auggacuaucugucuggugg

SEQ ID NO: 2670233 - RNA, 21 nt, Human
auggacuaucugucugguggc

SEQ ID NO: 2670234 - RNA, 13 nt, Human
auggacuaucugu

SEQ ID NO: 2670235 - RNA, 17 nt, Human
auggacuaucugucugg

SEQ ID NO: 2670236 - RNA, 19 nt, Human
uuucaaacaaucaaguuga

SEQ ID NO: 2670237 - RNA, 22 nt, Human
uuucaaacaaucaaguugacuc

SEQ ID NO: 2670238 - RNA, 20 nt, Human
uuucaaaagguauuauacau

SEQ ID NO: 2670239 - RNA, 21 nt, Human
uuucaaaagguauuauacaug

SEQ ID NO: 2670240 - RNA, 17 nt, Human
uuucaaaauccaaaaag

SEQ ID NO: 2670241 - RNA, 18 nt, Human
uuucaaaauccaaaaaga

SEQ ID NO: 2670242 - RNA, 19 nt, Human
uuucaaaauccaaaaagaa

SEQ ID NO: 2670243 - RNA, 21 nt, Human
uuucaaaauccaaaaagaaau

SEQ ID NO: 2670244 - RNA, 13 nt, Human
uuucaaaagaaag

SEQ ID NO: 2670245 - RNA, 23 nt, Human
augcuguguauaugguauauaua

SEQ ID NO: 2670246 - RNA, 13 nt, Human
augcuuccuugcc

SEQ ID NO: 2670247 - RNA, 16 nt, Human
augcuuccuugccuga

SEQ ID NO: 2670248 - RNA, 21 nt, Human
augcuuccuugccugaugaca

SEQ ID NO: 2670249 - RNA, 16 nt, Human
augcuucuagaguuuu

SEQ ID NO: 2670250 - RNA, 13 nt, Human
augcuucucacug

SEQ ID NO: 2670251 - RNA, 12 nt, Human
augcuccccaca

SEQ ID NO: 2670252 - RNA, 13 nt, Human
augcuccccacag

SEQ ID NO: 2670253 - RNA, 14 nt, Human
augcuccccacagc

SEQ ID NO: 2670254 - RNA, 21 nt, Human
augcuccccacagcgucccug

SEQ ID NO: 2670255 - RNA, 22 nt, Human
augcuccccacagcgucccugg

SEQ ID NO: 2670256 - RNA, 23 nt, Human
augcuccccacagcgucccuggc

SEQ ID NO: 2670257 - RNA, 17 nt, Human
augcugugcuaugaauu

SEQ ID NO: 2670258 - RNA, 18 nt, Human
augcugugcuaugaauuu

SEQ ID NO: 2670259 - RNA, 21 nt, Human
uuuauuaaucacuguguauau

SEQ ID NO: 2670260 - RNA, 19 nt, Human
uuuauuaaucacuguguau

SEQ ID NO: 2670261 - RNA, 13 nt, Human
uuuauuaaucacu

SEQ ID NO: 2670262 - RNA, 15 nt, Human
uuuauuaaucacugu

SEQ ID NO: 2670263 - RNA, 17 nt, Human
uuuauuaaugcacuuuc

SEQ ID NO: 2670264 - RNA, 12 nt, Human
uuuauuaauguu

SEQ ID NO: 2670265 - RNA, 18 nt, Human
uuuauuaauguuuucaaa

SEQ ID NO: 2670266 - RNA, 12 nt, Human
uuuauuaaugca

SEQ ID NO: 2670267 - RNA, 22 nt, Human
augcuccagcaacacagccugg

SEQ ID NO: 2670268 - RNA, 13 nt, Human
augcucaaagaaa

SEQ ID NO: 2670269 - RNA, 14 nt, Human
augcucaaagaaau

SEQ ID NO: 2670270 - RNA, 21 nt, Human
augcuccagcaacacagccug

SEQ ID NO: 2670271 - RNA, 12 nt, Human
augcuauuucug

SEQ ID NO: 2670272 - RNA, 13 nt, Human
augcuauuugaac

SEQ ID NO: 2670273 - RNA, 15 nt, Human
augcuauuugaacaa

SEQ ID NO: 2670274 - RNA, 13 nt, Human
uuuaucaagaagu

SEQ ID NO: 2670275 - RNA, 17 nt, Human
uuuaucauucaagugua

SEQ ID NO: 2670276 - RNA, 14 nt, Human
uuuaucauucaagu

SEQ ID NO: 2670277 - RNA, 15 nt, Human
uuuaucauucaagug

SEQ ID NO: 2670278 - RNA, 15 nt, Human
augcuaacaaagaca

SEQ ID NO: 2670279 - RNA, 23 nt, Human
augcuaacaaagacaaaagucug

SEQ ID NO: 2670280 - RNA, 21 nt, Human
uuuauauguauguguuuagaa

SEQ ID NO: 2670281 - RNA, 20 nt, Human
uuuauauguauguguuuaga

SEQ ID NO: 2670282 - RNA, 18 nt, Human
uuuauauuacugacauuu

SEQ ID NO: 2670283 - RNA, 21 nt, Human
uuuauauuuauugacucuuga

SEQ ID NO: 2670284 - RNA, 13 nt, Human
uuuauauuuccuu

SEQ ID NO: 2670285 - RNA, 14 nt, Human
uuuauauuuccuuu

SEQ ID NO: 2670286 - RNA, 15 nt, Human
uuuauauuuccuuua

SEQ ID NO: 2670287 - RNA, 17 nt, Human
uuuauauuuccuuuaug

SEQ ID NO: 2670288 - RNA, 18 nt, Human
uuuauauuuccuuuaugu

SEQ ID NO: 2670289 - RNA, 19 nt, Human
uuuauauuuccuuuaugug

SEQ ID NO: 2670290 - RNA, 20 nt, Human
uuuauauuuccuuuauguga

SEQ ID NO: 2670291 - RNA, 21 nt, Human
uuuauauuuccuuuaugugaa

SEQ ID NO: 2670292 - RNA, 22 nt, Human
uuuauauuuccuuuaugugaau

SEQ ID NO: 2670293 - RNA, 13 nt, Human
auuggaccaggcc

SEQ ID NO: 2670294 - RNA, 15 nt, Human
auuggaccaggccau

SEQ ID NO: 2670295 - RNA, 13 nt, Human
auugauuccuuuu

SEQ ID NO: 2670296 - RNA, 22 nt, Human
auugauuccuuuuuucaaaauc

SEQ ID NO: 2670297 - RNA, 13 nt, Human
auugauugggaaa

SEQ ID NO: 2670298 - RNA, 14 nt, Human
auugauugggaaaa

SEQ ID NO: 2670299 - RNA, 18 nt, Human
auugauugggaaaacauu

SEQ ID NO: 2670300 - RNA, 19 nt, Human
auugauugggaaaacauuu

SEQ ID NO: 2670301 - RNA, 20 nt, Human
auugauugggaaaacauuug

SEQ ID NO: 2670302 - RNA, 21 nt, Human
auugauugggaaaacauuugc

SEQ ID NO: 2670303 - RNA, 22 nt, Human
auugauugggaaaacauuugcu

SEQ ID NO: 2670304 - RNA, 23 nt, Human
auugauugggaaaacauuugcug

SEQ ID NO: 2670305 - RNA, 21 nt, Human
auugauuuaagcuuuccuguu

SEQ ID NO: 2670306 - RNA, 21 nt, Human
auugcuuuguauuguauauua

SEQ ID NO: 2670307 - RNA, 21 nt, Human
auugguaaaacucacugugau

SEQ ID NO: 2670308 - RNA, 18 nt, Human
auugguuuuaugaugacg

SEQ ID NO: 2670309 - RNA, 17 nt, Human
auugguuuuaugaugac

SEQ ID NO: 2670310 - RNA, 15 nt, Human
auugguuuuaugaug

SEQ ID NO: 2670311 - RNA, 14 nt, Human
auugguuuuaugau

SEQ ID NO: 2670312 - RNA, 15 nt, Human
auugggaaaacauuu

SEQ ID NO: 2670313 - RNA, 13 nt, Human
auuggcaaaacua

SEQ ID NO: 2670314 - RNA, 22 nt, Human
auugucguauaggcauguaaac

SEQ ID NO: 2670315 - RNA, 14 nt, Human
auuguccuauuagu

SEQ ID NO: 2670316 - RNA, 23 nt, Human
auuguccuauuaguguuauauga

SEQ ID NO: 2670317 - RNA, 21 nt, Human
auuguccuauuaguguuauau

SEQ ID NO: 2670318 - RNA, 20 nt, Human
auuguccuauuaguguuaua

SEQ ID NO: 2670319 - RNA, 18 nt, Human
auuguccuauuaguguua

SEQ ID NO: 2670320 - RNA, 15 nt, Human
auugucucccuucca

SEQ ID NO: 2670321 - RNA, 16 nt, Human
auugucucccuuccag

SEQ ID NO: 2670322 - RNA, 18 nt, Human
auugucuccuauauauuu

SEQ ID NO: 2670323 - RNA, 18 nt, Human
auuguggcuauccugauu

SEQ ID NO: 2670324 - RNA, 15 nt, Human
auugguuuuccugug

SEQ ID NO: 2670325 - RNA, 22 nt, Human
auuguaaaaaagguuuucuaua

SEQ ID NO: 2670326 - RNA, 19 nt, Human
auuguacauagcauguuua

SEQ ID NO: 2670327 - RNA, 13 nt, Human
auugucacuuuuu

SEQ ID NO: 2670328 - RNA, 17 nt, Human
auuguuugguaaauguu

SEQ ID NO: 2670329 - RNA, 18 nt, Human
auuguuugguaaauguuu

SEQ ID NO: 2670330 - RNA, 19 nt, Human
auuguuugguaaauguuuc

SEQ ID NO: 2670331 - RNA, 14 nt, Human
auuguuuuacaaua

SEQ ID NO: 2670332 - RNA, 13 nt, Human
auuguuuuacaau

SEQ ID NO: 2670333 - RNA, 18 nt, Human
auuguuuuacaauaguuc

SEQ ID NO: 2670334 - RNA, 17 nt, Human
auuguuuuacaauaguu

SEQ ID NO: 2670335 - RNA, 15 nt, Human
auuguuuuacaauag

SEQ ID NO: 2670336 - RNA, 19 nt, Human
auuuaaagaaaaaaauguc

SEQ ID NO: 2670337 - RNA, 18 nt, Human
auuuaaagaaaaaaaugu

SEQ ID NO: 2670338 - RNA, 23 nt, Human
auuucauuuuucaauagcacaua

SEQ ID NO: 2670339 - RNA, 20 nt, Human
auuuauuuccacuaaaaaua

SEQ ID NO: 2670340 - RNA, 21 nt, Human
auuuauuuccacuaaaaauau

SEQ ID NO: 2670341 - RNA, 22 nt, Human
auuuauuuccacuaaaaauauu

SEQ ID NO: 2670342 - RNA, 12 nt, Human
auuuauuuaaua

SEQ ID NO: 2670343 - RNA, 21 nt, Human
auuuccacuaaaaauauuguu

SEQ ID NO: 2670344 - RNA, 14 nt, Human
auuucuauaaauag

SEQ ID NO: 2670345 - RNA, 21 nt, Human
auuucuauaaauagaugcugu

SEQ ID NO: 2670346 - RNA, 14 nt, Human
auuugaaagugccu

SEQ ID NO: 2670347 - RNA, 13 nt, Human
auuugaaagugcc

SEQ ID NO: 2670348 - RNA, 17 nt, Human
auuugucaaugacaguu

SEQ ID NO: 2670349 - RNA, 14 nt, Human
auuugucaaugaca

SEQ ID NO: 2670350 - RNA, 15 nt, Human
auuuggcgugacccg

SEQ ID NO: 2670351 - RNA, 12 nt, Human
auuugacuaauu

SEQ ID NO: 2670352 - RNA, 13 nt, Human
auuugacuaauuu

SEQ ID NO: 2670353 - RNA, 14 nt, Human
auuugacuaauuuu

SEQ ID NO: 2670354 - RNA, 15 nt, Human
auuugacuaauuuua

SEQ ID NO: 2670355 - RNA, 17 nt, Human
auuugacuaauuuuaca

SEQ ID NO: 2670356 - RNA, 13 nt, Human
auuuguaaauuua

SEQ ID NO: 2670357 - RNA, 14 nt, Human
auuuguaaauuuag

SEQ ID NO: 2670358 - RNA, 16 nt, Human
auuuguaaauuuagug

SEQ ID NO: 2670359 - RNA, 17 nt, Human
auuuguaaauuuagugu

SEQ ID NO: 2670360 - RNA, 20 nt, Human
auuuguaaauuuaguguuuu

SEQ ID NO: 2670361 - RNA, 18 nt, Human
auuuuaaaacaauaggau

SEQ ID NO: 2670362 - RNA, 13 nt, Human
auuuuaaaacaau

SEQ ID NO: 2670363 - RNA, 17 nt, Human
auuuuaaccugcauaaa

SEQ ID NO: 2670364 - RNA, 18 nt, Human
auuuuaacuuaacugaaa

SEQ ID NO: 2670365 - RNA, 19 nt, Human
auuuuaacuuaacugaaau

SEQ ID NO: 2670366 - RNA, 20 nt, Human
auuuuaacuuaacugaaaug

SEQ ID NO: 2670367 - RNA, 22 nt, Human
auuuuaaaaucugagggaaaug

SEQ ID NO: 2670368 - RNA, 23 nt, Human
auuuuaaaaucugagggaaaugu

SEQ ID NO: 2670369 - RNA, 20 nt, Human
auuugucucugucacccuug

SEQ ID NO: 2670370 - RNA, 14 nt, Human
auuugucuuuuugu

SEQ ID NO: 2670371 - RNA, 21 nt, Human
auuugucuuuuuguuguaaaa

SEQ ID NO: 2670372 - RNA, 22 nt, Human
auuugucuuuuuguuguaaaac

SEQ ID NO: 2670373 - RNA, 23 nt, Human
auuugucuuuuuguuguaaaaca

SEQ ID NO: 2670374 - RNA, 17 nt, Human
auuuuguuuaaaaaauc

SEQ ID NO: 2670375 - RNA, 15 nt, Human
auuuuguauguuaaa

SEQ ID NO: 2670376 - RNA, 19 nt, Human
auuuugucauaucaaauaa

SEQ ID NO: 2670377 - RNA, 12 nt, Human
auuuuguguaaa

SEQ ID NO: 2670378 - RNA, 13 nt, Human
auuuuguguaaaa

SEQ ID NO: 2670379 - RNA, 14 nt, Human
auuuuguguaaaaa

SEQ ID NO: 2670380 - RNA, 20 nt, Human
auuuuguguaaaaaaaccac

SEQ ID NO: 2670381 - RNA, 19 nt, Human
auuuugcuaucaacaauaa

SEQ ID NO: 2670382 - RNA, 12 nt, Human
auuuuguaagaa

SEQ ID NO: 2670383 - RNA, 16 nt, Human
auuuuguaagaaggca

SEQ ID NO: 2670384 - RNA, 17 nt, Human
auuuuguaagaaggcaa

SEQ ID NO: 2670385 - RNA, 21 nt, Human
auuuuguaagaaggcaauauu

SEQ ID NO: 2670386 - RNA, 20 nt, Human
auuuuguacaaauuuguuau

SEQ ID NO: 2670387 - RNA, 10 nt, Human
auuuuguaug

SEQ ID NO: 2670388 - RNA, 21 nt, Human
auuuuccauuuuuauuucaaa

SEQ ID NO: 2670389 - RNA, 19 nt, Human
auuuucccuauuagagaag

SEQ ID NO: 2670390 - RNA, 16 nt, Human
auuuuccugccaggca

SEQ ID NO: 2670391 - RNA, 13 nt, Human
auuuugcaaagau

SEQ ID NO: 2670392 - RNA, 16 nt, Human
auuuugcaaagauuua

SEQ ID NO: 2670393 - RNA, 21 nt, Human
auuuugcaaagauuuaaucug

SEQ ID NO: 2670394 - RNA, 20 nt, Human
auuuugcuaaaugugaauga

SEQ ID NO: 2670395 - RNA, 13 nt, Human
auuuuuguaaaug

SEQ ID NO: 2670396 - RNA, 19 nt, Human
auuuuuguaaauguguaca

SEQ ID NO: 2670397 - RNA, 13 nt, Human
auuuuuguaaagu

SEQ ID NO: 2670398 - RNA, 14 nt, Human
auuuuuguaaaguu

SEQ ID NO: 2670399 - RNA, 15 nt, Human
auuuuuguaaaguuu

SEQ ID NO: 2670400 - RNA, 17 nt, Human
auuuuuguaaaguuucc

SEQ ID NO: 2670401 - RNA, 18 nt, Human
auuuuuguaaaguuuccg

SEQ ID NO: 2670402 - RNA, 10 nt, Human
auuuuucucu

SEQ ID NO: 2670403 - RNA, 23 nt, Human
auuuuugauacaguuuucagaaa

SEQ ID NO: 2670404 - RNA, 19 nt, Human
auuuuugcaauaccaagua

SEQ ID NO: 2670405 - RNA, 20 nt, Human
auuuuucaauagcacauaug

SEQ ID NO: 2670406 - RNA, 14 nt, Human
auuuuucaauauau

SEQ ID NO: 2670407 - RNA, 17 nt, Human
auuuuucaauauauuga

SEQ ID NO: 2670408 - RNA, 18 nt, Human
auuuuucaauauauugaa

SEQ ID NO: 2670409 - RNA, 20 nt, Human
auuuuucaauauauugaacu

SEQ ID NO: 2670410 - RNA, 22 nt, Human
auuuuucaauauauugaacuuu

SEQ ID NO: 2670411 - RNA, 22 nt, Human
auuuuucacucuaagucaugua

SEQ ID NO: 2670412 - RNA, 15 nt, Human
auuuuucauaaacaa

SEQ ID NO: 2670413 - RNA, 12 nt, Human
auuuuucucuuc

SEQ ID NO: 2670414 - RNA, 21 nt, Human
auuuuguuuuugucuuaaaaa

SEQ ID NO: 2670415 - RNA, 22 nt, Human
auuuuucaauagcacauaugga

SEQ ID NO: 2670416 - RNA, 12 nt, Human
auuuuuguuguu

SEQ ID NO: 2670417 - RNA, 12 nt, Human
auuuuuuaagcu

SEQ ID NO: 2670418 - RNA, 21 nt, Human
auuuuuuaagcuucaguugcu

SEQ ID NO: 2670419 - RNA, 16 nt, Human
auuuuuugaaaagcag

SEQ ID NO: 2670420 - RNA, 19 nt, Human
auuuuuugaaaagcagaca

SEQ ID NO: 2670421 - RNA, 12 nt, Human
auuuuuugacuu

SEQ ID NO: 2670422 - RNA, 23 nt, Human
auuuuuugacuuuuuuuguaugu

SEQ ID NO: 2670423 - RNA, 15 nt, Human
auuuuuuuaaaauuu

SEQ ID NO: 2670424 - RNA, 17 nt, Human
auuuuuuuaaaauuuug

SEQ ID NO: 2670425 - RNA, 13 nt, Human
auuuuuuaauugu

SEQ ID NO: 2670426 - RNA, 14 nt, Human
auuuuuuaauuguu

SEQ ID NO: 2670427 - RNA, 11 nt, Human
auuuuuuccuu

SEQ ID NO: 2670428 - RNA, 22 nt, Human
auugaagcucgugacaagugcc

SEQ ID NO: 2670429 - RNA, 19 nt, Human
auugacaaccgagaagguu

SEQ ID NO: 2670430 - RNA, 10 nt, Human
auugaagaau

SEQ ID NO: 2670431 - RNA, 16 nt, Human
auugaagaauguuaga

SEQ ID NO: 2670432 - RNA, 14 nt, Human
auugaacuuuugua

SEQ ID NO: 2670433 - RNA, 16 nt, Human
auugaacuuuuguacu

SEQ ID NO: 2670434 - RNA, 17 nt, Human
auugaacuuuuguacug

SEQ ID NO: 2670435 - RNA, 18 nt, Human
auugaacuuuuguacuga

SEQ ID NO: 2670436 - RNA, 19 nt, Human
auugaacuuuuguacugaa

SEQ ID NO: 2670437 - RNA, 20 nt, Human
auugaacuuuuguacugaau

SEQ ID NO: 2670438 - RNA, 23 nt, Human
auugaacuuuuguacugaauuuu

SEQ ID NO: 2670439 - RNA, 12 nt, Human
auugacacugaa

SEQ ID NO: 2670440 - RNA, 14 nt, Human
auugacacugaacu

SEQ ID NO: 2670441 - RNA, 15 nt, Human
auugacacugaacuu

SEQ ID NO: 2670442 - RNA, 16 nt, Human
auugacacugaacuua

SEQ ID NO: 2670443 - RNA, 18 nt, Human
auugacacugaacuuaau

SEQ ID NO: 2670444 - RNA, 19 nt, Human
auugacuaacucaaauaca

SEQ ID NO: 2670445 - RNA, 23 nt, Human
auugacuaacucaaauacacauu

SEQ ID NO: 2670446 - RNA, 15 nt, Human
auugacuuuuauaaa

SEQ ID NO: 2670447 - RNA, 18 nt, Human
auugacuuuuauaaagca

SEQ ID NO: 2670448 - RNA, 22 nt, Human
auugacucuugaguuguuuuug

SEQ ID NO: 2670449 - RNA, 19 nt, Human
auugacucuugaguuguuu

SEQ ID NO: 2670450 - RNA, 16 nt, Human
auugacucuugaguug

SEQ ID NO: 2670451 - RNA, 14 nt, Human
auugacucuggguc

SEQ ID NO: 2670452 - RNA, 13 nt, Human
auugacucugggu

SEQ ID NO: 2670453 - RNA, 15 nt, Human
auugacucuugaguu

SEQ ID NO: 2670454 - RNA, 14 nt, Human
auugacucuugagu

SEQ ID NO: 2670455 - RNA, 13 nt, Human
auugacucuugag

SEQ ID NO: 2670456 - RNA, 23 nt, Human
auugacucuggguccuuccugaa

SEQ ID NO: 2670457 - RNA, 22 nt, Human
auugacucuggguccuuccuga

SEQ ID NO: 2670458 - RNA, 20 nt, Human
auugacucuggguccuuccu

SEQ ID NO: 2670459 - RNA, 16 nt, Human
auugacucuggguccu

SEQ ID NO: 2670460 - RNA, 15 nt, Human
auugacucugggucc

SEQ ID NO: 2670461 - RNA, 22 nt, Human
auucuuuuuuauuaaucacugu

SEQ ID NO: 2670462 - RNA, 14 nt, Human
auucuuuuuuauua

SEQ ID NO: 2670463 - RNA, 16 nt, Human
auucuuuuuuauuaau

SEQ ID NO: 2670464 - RNA, 15 nt, Human
auucuuuuuuauuaa

SEQ ID NO: 2670465 - RNA, 21 nt, Human
auucuuuuuuauuaaucacug

SEQ ID NO: 2670466 - RNA, 20 nt, Human
auucuuuuuuauuaaucacu

SEQ ID NO: 2670467 - RNA, 19 nt, Human
auucuuuuuuauuaaucac

SEQ ID NO: 2670468 - RNA, 17 nt, Human
auucuuuuuuauuaauc

SEQ ID NO: 2670469 - RNA, 22 nt, Human
auucugccgcccccuccugaac

SEQ ID NO: 2670470 - RNA, 20 nt, Human
auucugccgcccccuccuga

SEQ ID NO: 2670471 - RNA, 21 nt, Human
auucugccgcccccuccugaa

SEQ ID NO: 2670472 - RNA, 23 nt, Human
auucugguuccagggucccucug

SEQ ID NO: 2670473 - RNA, 18 nt, Human
auuauauguucagauuau

SEQ ID NO: 2670474 - RNA, 13 nt, Human
auuauacaggaaa

SEQ ID NO: 2670475 - RNA, 15 nt, Human
auuauacaugugaua

SEQ ID NO: 2670476 - RNA, 20 nt, Human
auuauacaugugauacauuu

SEQ ID NO: 2670477 - RNA, 21 nt, Human
auuauacaugugauacauuuu

SEQ ID NO: 2670478 - RNA, 22 nt, Human
auuauacaugugauacauuuuu

SEQ ID NO: 2670479 - RNA, 17 nt, Human
auuaguuuagaacaggu

SEQ ID NO: 2670480 - RNA, 15 nt, Human
auuaguuuagaacag

SEQ ID NO: 2670481 - RNA, 21 nt, Human
auuaguuuagaacagguuuuu

SEQ ID NO: 2670482 - RNA, 13 nt, Human
auuaguuuagaac

SEQ ID NO: 2670483 - RNA, 12 nt, Human
auuaguuuagaa

SEQ ID NO: 2670484 - RNA, 15 nt, Human
auuaguguuauauga

SEQ ID NO: 2670485 - RNA, 17 nt, Human
auuaguguuauaugaac

SEQ ID NO: 2670486 - RNA, 16 nt, Human
auuaguguuauaugaa

SEQ ID NO: 2670487 - RNA, 21 nt, Human
auuaguguuauaugaacauac

SEQ ID NO: 2670488 - RNA, 19 nt, Human
auuaguguuauaugaacau

SEQ ID NO: 2670489 - RNA, 15 nt, Human
auuauuuauuuauuu

SEQ ID NO: 2670490 - RNA, 15 nt, Human
auuauuugauuauuu

SEQ ID NO: 2670491 - RNA, 16 nt, Human
auuauuugauuauuua

SEQ ID NO: 2670492 - RNA, 18 nt, Human
auuauuugauuauuuaag

SEQ ID NO: 2670493 - RNA, 19 nt, Human
auuauuugauuauuuaaga

SEQ ID NO: 2670494 - RNA, 21 nt, Human
auuauuugauuauuuaagacu

SEQ ID NO: 2670495 - RNA, 22 nt, Human
auuauuugauuauuuaagacua

SEQ ID NO: 2670496 - RNA, 11 nt, Human
auuauuugcau

SEQ ID NO: 2670497 - RNA, 12 nt, Human
auuauuugcaug

SEQ ID NO: 2670498 - RNA, 13 nt, Human
auuauuugcaugu

SEQ ID NO: 2670499 - RNA, 14 nt, Human
auuauuugcauguu

SEQ ID NO: 2670500 - RNA, 15 nt, Human
auuauuugcauguua

SEQ ID NO: 2670501 - RNA, 17 nt, Human
auuauuugcauguuaug

SEQ ID NO: 2670502 - RNA, 19 nt, Human
auuauuugcauguuauguu

SEQ ID NO: 2670503 - RNA, 20 nt, Human
auuauuugcauguuauguuu

SEQ ID NO: 2670504 - RNA, 21 nt, Human
auuauuugcauguuauguuua

SEQ ID NO: 2670505 - RNA, 20 nt, Human
auuaucaaagggauaaagaa

SEQ ID NO: 2670506 - RNA, 22 nt, Human
auuaucaaagggauaaagaaaa

SEQ ID NO: 2670507 - RNA, 22 nt, Human
auuauuagccagguaaugugaa

SEQ ID NO: 2670508 - RNA, 22 nt, Human
auuauuaucaggggagaaaaau

SEQ ID NO: 2670509 - RNA, 20 nt, Human
auucuaauaagcuaguugaa

SEQ ID NO: 2670510 - RNA, 19 nt, Human
auucuaauaagcuaguuga

SEQ ID NO: 2670511 - RNA, 16 nt, Human
auucuaauaagcuagu

SEQ ID NO: 2670512 - RNA, 14 nt, Human
auucuaauaagcua

SEQ ID NO: 2670513 - RNA, 13 nt, Human
auuccagccccuc

SEQ ID NO: 2670514 - RNA, 14 nt, Human
auuccagccccucu

SEQ ID NO: 2670515 - RNA, 16 nt, Human
auuccagaucuuucag

SEQ ID NO: 2670516 - RNA, 19 nt, Human
auuccagaucuuucagaaa

SEQ ID NO: 2670517 - RNA, 20 nt, Human
auuccagaucuuucagaaau

SEQ ID NO: 2670518 - RNA, 21 nt, Human
auuccagaucuuucagaaaua

SEQ ID NO: 2670519 - RNA, 13 nt, Human
auucagaaauguu

SEQ ID NO: 2670520 - RNA, 18 nt, Human
auucacauuguuaagaaa

SEQ ID NO: 2670521 - RNA, 16 nt, Human
auucuaguuuugucaa

SEQ ID NO: 2670522 - RNA, 24 nt, Human
cagcugucccuugcuugccugcag

SEQ ID NO: 2670523 - RNA, 18 nt, Human
cagcugcaauucccugga

SEQ ID NO: 2670524 - RNA, 15 nt, Human
cagcugcccuuccgc

SEQ ID NO: 2670525 - RNA, 21 nt, Human
cagcugcccuuccgcagugug

SEQ ID NO: 2670526 - RNA, 20 nt, Human
cagcuccagggaauccaagc

SEQ ID NO: 2670527 - RNA, 21 nt, Human
cagcuccagggaauccaagcc

SEQ ID NO: 2670528 - RNA, 22 nt, Human
cagcuccagggaauccaagccu

SEQ ID NO: 2670529 - RNA, 17 nt, Human
cagccucugucaggccu

SEQ ID NO: 2670530 - RNA, 18 nt, Human
cagccucugucaggccuu

SEQ ID NO: 2670531 - RNA, 20 nt, Human
cagccucugucaggccuuca

SEQ ID NO: 2670532 - RNA, 21 nt, Human
cagcgggggaggcccgcagag

SEQ ID NO: 2670533 - RNA, 21 nt, Human
cagcgucagcugcucccuggc

SEQ ID NO: 2670534 - RNA, 13 nt, Human
cagcgucccuggc

SEQ ID NO: 2670535 - RNA, 14 nt, Human
cagcgucccuggcg

SEQ ID NO: 2670536 - RNA, 15 nt, Human
cagcgucccuggcgc

SEQ ID NO: 2670537 - RNA, 15 nt, Human
cagcaucaccugccu

SEQ ID NO: 2670538 - RNA, 14 nt, Human
cagcaucaccugcc

SEQ ID NO: 2670539 - RNA, 17 nt, Human
cagcaccucagccugca

SEQ ID NO: 2670540 - RNA, 16 nt, Human
cagcaccucagccugc

SEQ ID NO: 2670541 - RNA, 15 nt, Human
cagcaccucagccug

SEQ ID NO: 2670542 - RNA, 18 nt, Human
cagcaggugauuggacca

SEQ ID NO: 2670543 - RNA, 20 nt, Human
cagcaggugauuggaccagg

SEQ ID NO: 2670544 - RNA, 21 nt, Human
cagcaggugauuggaccaggc

SEQ ID NO: 2670545 - RNA, 23 nt, Human
cagcaggugauuggaccaggcca

SEQ ID NO: 2670546 - RNA, 15 nt, Human
cagcaccgaggggcc

SEQ ID NO: 2670547 - RNA, 17 nt, Human
cagcaccgaggggccuu

SEQ ID NO: 2670548 - RNA, 18 nt, Human
cagcaccgaggggccuuu

SEQ ID NO: 2670549 - RNA, 23 nt, Human
cagaaguuugagaucagccuggg

SEQ ID NO: 2670550 - RNA, 22 nt, Human
cagaaguuugagaucagccugg

SEQ ID NO: 2670551 - RNA, 20 nt, Human
cagaaguuugagaucagccu

SEQ ID NO: 2670552 - RNA, 23 nt, Human
cagaaauggugagauguauguuu

SEQ ID NO: 2670553 - RNA, 16 nt, Human
cagagucaaggccugc

SEQ ID NO: 2670554 - RNA, 18 nt, Human
cagagucaaggccugcuc

SEQ ID NO: 2670555 - RNA, 19 nt, Human
cagagucaaggccugcucc

SEQ ID NO: 2670556 - RNA, 13 nt, Human
caggugcagaggu

SEQ ID NO: 2670557 - RNA, 16 nt, Human
caggugcagagguacc

SEQ ID NO: 2670558 - RNA, 23 nt, Human
caggugcagagguacccugggug

SEQ ID NO: 2670559 - RNA, 14 nt, Human
cagguugguggggg

SEQ ID NO: 2670560 - RNA, 14 nt, Human
caggugcgaaagga

SEQ ID NO: 2670561 - RNA, 12 nt, Human
caggugcagagg

SEQ ID NO: 2670562 - RNA, 15 nt, Human
caggguuaagaagac

SEQ ID NO: 2670563 - RNA, 23 nt, Human
caggguucucuuagcaacucaga

SEQ ID NO: 2670564 - RNA, 19 nt, Human
caggguucccgcggggcug

SEQ ID NO: 2670565 - RNA, 21 nt, Human
caggguucccgcggggcuguc

SEQ ID NO: 2670566 - RNA, 13 nt, Human
cagggugggccuc

SEQ ID NO: 2670567 - RNA, 20 nt, Human
cagggugggccucggccccu

SEQ ID NO: 2670568 - RNA, 23 nt, Human
cagggugggccucggccccuccc

SEQ ID NO: 2670569 - RNA, 22 nt, Human
caggguggucucuucuuggggc

SEQ ID NO: 2670570 - RNA, 18 nt, Human
cagguuuaagcuguuacu

SEQ ID NO: 2670571 - RNA, 16 nt, Human
cagguuuaagcuguua

SEQ ID NO: 2670572 - RNA, 13 nt, Human
cagucgugccugu

SEQ ID NO: 2670573 - RNA, 12 nt, Human
cagugcagaaug

SEQ ID NO: 2670574 - RNA, 14 nt, Human
cagugcagaaugua

SEQ ID NO: 2670575 - RNA, 15 nt, Human
cagugcagaauguaa

SEQ ID NO: 2670576 - RNA, 22 nt, Human
cagugcagaauguaagugggcc

SEQ ID NO: 2670577 - RNA, 16 nt, Human
cagugcagagccuucu

SEQ ID NO: 2670578 - RNA, 19 nt, Human
cagugcagagccuucucag

SEQ ID NO: 2670579 - RNA, 20 nt, Human
cagugcagagccuucucaga

SEQ ID NO: 2670580 - RNA, 14 nt, Human
cagugcagauggag

SEQ ID NO: 2670581 - RNA, 14 nt, Human
cagugcaugguggc

SEQ ID NO: 2670582 - RNA, 15 nt, Human
cagugcaugguggcc

SEQ ID NO: 2670583 - RNA, 17 nt, Human
cagugcaugguggccag

SEQ ID NO: 2670584 - RNA, 18 nt, Human
cagugcaugguggccaga

SEQ ID NO: 2670585 - RNA, 20 nt, Human
cagugcaugguggccagagg

SEQ ID NO: 2670586 - RNA, 21 nt, Human
cagugcaugguggccagaggu

SEQ ID NO: 2670587 - RNA, 15 nt, Human
cagggagcugggccc

SEQ ID NO: 2670588 - RNA, 16 nt, Human
cagggagcugggcccg

SEQ ID NO: 2670589 - RNA, 19 nt, Human
cagggagcugggcccgaca

SEQ ID NO: 2670590 - RNA, 22 nt, Human
cagggagcugggcccgacaugg

SEQ ID NO: 2670591 - RNA, 13 nt, Human
cagggaggcagcc

SEQ ID NO: 2670592 - RNA, 14 nt, Human
cagggaggcagccg

SEQ ID NO: 2670593 - RNA, 16 nt, Human
cagggaggcagccgcc

SEQ ID NO: 2670594 - RNA, 21 nt, Human
cagggaggcagccgccccauc

SEQ ID NO: 2670595 - RNA, 23 nt, Human
caggcgcugcccaccugccggcc

SEQ ID NO: 2670596 - RNA, 12 nt, Human
caggccugccuc

SEQ ID NO: 2670597 - RNA, 13 nt, Human
caggccugccucc

SEQ ID NO: 2670598 - RNA, 14 nt, Human
caggccugccuccc

SEQ ID NO: 2670599 - RNA, 15 nt, Human
caggccugccuccca

SEQ ID NO: 2670600 - RNA, 16 nt, Human
caggccugccucccac

SEQ ID NO: 2670601 - RNA, 17 nt, Human
caggccugccucccacu

SEQ ID NO: 2670602 - RNA, 13 nt, Human
caggccuauuuca

SEQ ID NO: 2670603 - RNA, 16 nt, Human
caggccuauuucauca

SEQ ID NO: 2670604 - RNA, 16 nt, Human
caggacccucgccgga

SEQ ID NO: 2670605 - RNA, 13 nt, Human
caggacccucgcc

SEQ ID NO: 2670606 - RNA, 12 nt, Human
caggacccucgc

SEQ ID NO: 2670607 - RNA, 20 nt, Human
caggagguggaggcugcagu

SEQ ID NO: 2670608 - RNA, 14 nt, Human
cauccccuguagag

SEQ ID NO: 2670609 - RNA, 18 nt, Human
caucugccuuaaaaccaa

SEQ ID NO: 2670610 - RNA, 20 nt, Human
caucugccuuaaaaccaaag

SEQ ID NO: 2670611 - RNA, 20 nt, Human
cauacacuuuguugcaagau

SEQ ID NO: 2670612 - RNA, 14 nt, Human
cauaauugaagugu

SEQ ID NO: 2670613 - RNA, 13 nt, Human
cauaauuuaaaaa

SEQ ID NO: 2670614 - RNA, 14 nt, Human
cauaauuuaaaaau

SEQ ID NO: 2670615 - RNA, 15 nt, Human
cauaauuuaaaaaua

SEQ ID NO: 2670616 - RNA, 18 nt, Human
cauaauuuaaaaauauau

SEQ ID NO: 2670617 - RNA, 20 nt, Human
cauaauuuaaaaauauauuu

SEQ ID NO: 2670618 - RNA, 23 nt, Human
caugauuaaccacuucagcugac

SEQ ID NO: 2670619 - RNA, 22 nt, Human
caugauuaaccacuucagcuga

SEQ ID NO: 2670620 - RNA, 24 nt, Human
caugauuaaccacuucagcugacu

SEQ ID NO: 2670621 - RNA, 13 nt, Human
caugcuccuggcc

SEQ ID NO: 2670622 - RNA, 18 nt, Human
caugcucaucugcugguc

SEQ ID NO: 2670623 - RNA, 19 nt, Human
caugcucaucugcuggucc

SEQ ID NO: 2670624 - RNA, 16 nt, Human
caugcucaucugcugg

SEQ ID NO: 2670625 - RNA, 17 nt, Human
caugcucaucugcuggu

SEQ ID NO: 2670626 - RNA, 24 nt, Human
caugaagucuuaaggacaaagugc

SEQ ID NO: 2670627 - RNA, 22 nt, Human
caugaagggacccuuugggggu

SEQ ID NO: 2670628 - RNA, 17 nt, Human
cauggcaucccuuuuuc

SEQ ID NO: 2670629 - RNA, 23 nt, Human
cauggcaucccuuuuucauaaau

SEQ ID NO: 2670630 - RNA, 21 nt, Human
cauggcaugguuuugugccau

SEQ ID NO: 2670631 - RNA, 16 nt, Human
cauuaugagaggcaau

SEQ ID NO: 2670632 - RNA, 17 nt, Human
cauguugaucauguacu

SEQ ID NO: 2670633 - RNA, 20 nt, Human
cauguugaucauguacuuuu

SEQ ID NO: 2670634 - RNA, 21 nt, Human
cauguugaucauguacuuuuu

SEQ ID NO: 2670635 - RNA, 19 nt, Human
cauguccagcaccuugugc

SEQ ID NO: 2670636 - RNA, 20 nt, Human
cauguccagcaccuugugcc

SEQ ID NO: 2670637 - RNA, 21 nt, Human
cauguccagcaccuugugccu

SEQ ID NO: 2670638 - RNA, 22 nt, Human
cauguccagcaccuugugccug

SEQ ID NO: 2670639 - RNA, 23 nt, Human
cauguccagcaccuugugccugg

SEQ ID NO: 2670640 - RNA, 19 nt, Human
cauguccauacacuuuguu

SEQ ID NO: 2670641 - RNA, 22 nt, Human
cauguccauacacuuuguugca

SEQ ID NO: 2670642 - RNA, 23 nt, Human
cauguccauacacuuuguugcaa

SEQ ID NO: 2670643 - RNA, 22 nt, Human
cauuaugagaggcaaugauugu

SEQ ID NO: 2670644 - RNA, 18 nt, Human
cauuccuuuuuauuuaua

SEQ ID NO: 2670645 - RNA, 13 nt, Human
ccaccaccccuac

SEQ ID NO: 2670646 - RNA, 23 nt, Human
ccacagacaaaagcgcuuuuccu

SEQ ID NO: 2670647 - RNA, 18 nt, Human
ccaccaucaccagacagg

SEQ ID NO: 2670648 - RNA, 19 nt, Human
ccaccucaccuagccugau

SEQ ID NO: 2670649 - RNA, 14 nt, Human
ccaccgcgggugug

SEQ ID NO: 2670650 - RNA, 17 nt, Human
ccacgccuguaauccca

SEQ ID NO: 2670651 - RNA, 19 nt, Human
ccacgccucuugaccaggc

SEQ ID NO: 2670652 - RNA, 21 nt, Human
ccacgccucuugaccaggcug

SEQ ID NO: 2670653 - RNA, 18 nt, Human
ccacgccucuugaccagg

SEQ ID NO: 2670654 - RNA, 15 nt, Human
ccacgcgugccgugg

SEQ ID NO: 2670655 - RNA, 20 nt, Human
ccacgcgugccguggcacca

SEQ ID NO: 2670656 - RNA, 23 nt, Human
cauuucagaaguuaguuuguaua

SEQ ID NO: 2670657 - RNA, 14 nt, Human
cauuucaucucauu

SEQ ID NO: 2670658 - RNA, 15 nt, Human
cauuucaucucauuu

SEQ ID NO: 2670659 - RNA, 16 nt, Human
cauuucaucucauuua

SEQ ID NO: 2670660 - RNA, 13 nt, Human
cauuuuuuaagcu

SEQ ID NO: 2670661 - RNA, 19 nt, Human
ccaaucuauugcuucacca

SEQ ID NO: 2670662 - RNA, 14 nt, Human
ccaaucuuacuuug

SEQ ID NO: 2670663 - RNA, 15 nt, Human
ccaaucuuacuuugu

SEQ ID NO: 2670664 - RNA, 17 nt, Human
ccaaucuuacuuuguaa

SEQ ID NO: 2670665 - RNA, 16 nt, Human
ccaaucuuacuuugua

SEQ ID NO: 2670666 - RNA, 21 nt, Human
ccaaucuuacuuuguaaauuc

SEQ ID NO: 2670667 - RNA, 20 nt, Human
ccaaucuuacuuuguaaauu

SEQ ID NO: 2670668 - RNA, 14 nt, Human
ccaagaagcagugg

SEQ ID NO: 2670669 - RNA, 21 nt, Human
ccaagaaagcucacuguagcu

SEQ ID NO: 2670670 - RNA, 17 nt, Human
ccaaccuuucccucacc

SEQ ID NO: 2670671 - RNA, 18 nt, Human
ccaaccuuucccucaccc

SEQ ID NO: 2670672 - RNA, 19 nt, Human
ccaaccuuucccucacccc

SEQ ID NO: 2670673 - RNA, 20 nt, Human
ccaaccuuucccucaccccc

SEQ ID NO: 2670674 - RNA, 23 nt, Human
ccaaccuuucccucacccccucc

SEQ ID NO: 2670675 - RNA, 11 nt, Human
ccaaggauccc

SEQ ID NO: 2670676 - RNA, 18 nt, Human
ccaagaagcaguggccuu

SEQ ID NO: 2670677 - RNA, 12 nt, Human
ccaaauaaauaa

SEQ ID NO: 2670678 - RNA, 19 nt, Human
auuucacuugaugauacaa

SEQ ID NO: 2670679 - RNA, 12 nt, Human
auuucacuugau

SEQ ID NO: 2670680 - RNA, 18 nt, Human
auuucagaaaaugaaaaa

SEQ ID NO: 2670681 - RNA, 19 nt, Human
auuucagaaaaugaaaaau

SEQ ID NO: 2670682 - RNA, 12 nt, Human
auuucagaaguu

SEQ ID NO: 2670683 - RNA, 19 nt, Human
auuucagaaguuaguuugu

SEQ ID NO: 2670684 - RNA, 13 nt, Human
auuuaugggcccc

SEQ ID NO: 2670685 - RNA, 15 nt, Human
auuuaugggccccug

SEQ ID NO: 2670686 - RNA, 16 nt, Human
auuuaugggccccugg

SEQ ID NO: 2670687 - RNA, 18 nt, Human
auuuaugggccccuggca

SEQ ID NO: 2670688 - RNA, 19 nt, Human
auuuaugggccccuggcac

SEQ ID NO: 2670689 - RNA, 20 nt, Human
auuuauauggggaauauauu

SEQ ID NO: 2670690 - RNA, 11 nt, Human
auuuauaugua

SEQ ID NO: 2670691 - RNA, 19 nt, Human
auuuauauggggaauauau

SEQ ID NO: 2670692 - RNA, 13 nt, Human
auuuauauguaug

SEQ ID NO: 2670693 - RNA, 16 nt, Human
auuuauauguaugugu

SEQ ID NO: 2670694 - RNA, 14 nt, Human
auuuauauguaugu

SEQ ID NO: 2670695 - RNA, 13 nt, Human
auuuauauguacu

SEQ ID NO: 2670696 - RNA, 15 nt, Human
auuuauauguacugu

SEQ ID NO: 2670697 - RNA, 16 nt, Human
auuuauauguacuguu

SEQ ID NO: 2670698 - RNA, 17 nt, Human
auuuauauguacuguuu

SEQ ID NO: 2670699 - RNA, 18 nt, Human
auuuauauguauguguuu

SEQ ID NO: 2670700 - RNA, 17 nt, Human
auuuauauguauguguu

SEQ ID NO: 2670701 - RNA, 21 nt, Human
auuuauauguauguguuuaga

SEQ ID NO: 2670702 - RNA, 20 nt, Human
auuuaucugggauuaugguu

SEQ ID NO: 2670703 - RNA, 16 nt, Human
auuuauaaggaaauuu

SEQ ID NO: 2670704 - RNA, 21 nt, Human
auuucagaaguuaguuuguau

SEQ ID NO: 2670705 - RNA, 16 nt, Human
auuucugugcccuccu

SEQ ID NO: 2670706 - RNA, 11 nt, Human
auuucugugcc

SEQ ID NO: 2670707 - RNA, 13 nt, Human
auuucuguauaua

SEQ ID NO: 2670708 - RNA, 19 nt, Human
auuucugggggaggaugua

SEQ ID NO: 2670709 - RNA, 14 nt, Human
auuucuauuauuaa

SEQ ID NO: 2670710 - RNA, 22 nt, Human
auuucuauuauuaauugcaaaa

SEQ ID NO: 2670711 - RNA, 14 nt, Human
auuguuuaaaaacc

SEQ ID NO: 2670712 - RNA, 22 nt, Human
auuguuuaaaaaccgaauaaau

SEQ ID NO: 2670713 - RNA, 15 nt, Human
auuguacaaaauuaa

SEQ ID NO: 2670714 - RNA, 18 nt, Human
auuguacaaaauuaagca

SEQ ID NO: 2670715 - RNA, 21 nt, Human
auuguacaaaauuaagcaaau

SEQ ID NO: 2670716 - RNA, 22 nt, Human
auuguacaaaauuaagcaaaug

SEQ ID NO: 2670717 - RNA, 14 nt, Human
auuguuaauacaag

SEQ ID NO: 2670718 - RNA, 19 nt, Human
auuguuaauacaagguaua

SEQ ID NO: 2670719 - RNA, 23 nt, Human
auuguuaauacaagguauaauaa

SEQ ID NO: 2670720 - RNA, 19 nt, Human
auugcuuauuauguaggua

SEQ ID NO: 2670721 - RNA, 21 nt, Human
auugcuguuguccaacuauuu

SEQ ID NO: 2670722 - RNA, 19 nt, Human
auugcuguuguccaacuau

SEQ ID NO: 2670723 - RNA, 15 nt, Human
auugcuguuguccaa

SEQ ID NO: 2670724 - RNA, 17 nt, Human
auugcugugugucccag

SEQ ID NO: 2670725 - RNA, 18 nt, Human
auugcugugugucccagg

SEQ ID NO: 2670726 - RNA, 19 nt, Human
auugcugugugucccaggc

SEQ ID NO: 2670727 - RNA, 21 nt, Human
auuaggcaaggcuaugugauu

SEQ ID NO: 2670728 - RNA, 20 nt, Human
auuaggcaaggcuaugugau

SEQ ID NO: 2670729 - RNA, 18 nt, Human
auuaaauuaggaauaaau

SEQ ID NO: 2670730 - RNA, 13 nt, Human
auuaaauuaggaa

SEQ ID NO: 2670731 - RNA, 21 nt, Human
auuaguaacauucauguucua

SEQ ID NO: 2670732 - RNA, 22 nt, Human
auuaugccacuuccuuuuaacu

SEQ ID NO: 2670733 - RNA, 22 nt, Human
auucaacagcaagugugaauac

SEQ ID NO: 2670734 - RNA, 21 nt, Human
auucaacagcaagugugaaua

SEQ ID NO: 2670735 - RNA, 18 nt, Human
auucaacagcaaguguga

SEQ ID NO: 2670736 - RNA, 14 nt, Human
auuauggaaaacug

SEQ ID NO: 2670737 - RNA, 15 nt, Human
auuauggaaaacugu

SEQ ID NO: 2670738 - RNA, 21 nt, Human
auuccuguacugugucucaug

SEQ ID NO: 2670739 - RNA, 12 nt, Human
caacaaagaaau

SEQ ID NO: 2670740 - RNA, 15 nt, Human
caacaacaauuggua

SEQ ID NO: 2670741 - RNA, 16 nt, Human
caacaacaauugguaa

SEQ ID NO: 2670742 - RNA, 22 nt, Human
caacaaauauucacuggccccu

SEQ ID NO: 2670743 - RNA, 16 nt, Human
caaaugcucaaagaaa

SEQ ID NO: 2670744 - RNA, 15 nt, Human
caaaugcaucuuuga

SEQ ID NO: 2670745 - RNA, 17 nt, Human
caaaugcaucuuugaug

SEQ ID NO: 2670746 - RNA, 16 nt, Human
caaaugcaucuuugau

SEQ ID NO: 2670747 - RNA, 22 nt, Human
caaaugcaucuuugauguguug

SEQ ID NO: 2670748 - RNA, 21 nt, Human
caaaugcaucuuugauguguu

SEQ ID NO: 2670749 - RNA, 19 nt, Human
caaaugcaugcuucuucuc

SEQ ID NO: 2670750 - RNA, 20 nt, Human
caaaugcaugcuucuucuca

SEQ ID NO: 2670751 - RNA, 21 nt, Human
caaaugacuuuauuauuuauu

SEQ ID NO: 2670752 - RNA, 20 nt, Human
caaaugacuuuauuauuuau

SEQ ID NO: 2670753 - RNA, 18 nt, Human
caaaugacuuuauuauuu

SEQ ID NO: 2670754 - RNA, 17 nt, Human
caaaugacuuuauuauu

SEQ ID NO: 2670755 - RNA, 16 nt, Human
caaaugacuuuauuau

SEQ ID NO: 2670756 - RNA, 15 nt, Human
caaaugacuuuauua

SEQ ID NO: 2670757 - RNA, 14 nt, Human
caaaugacuuuauu

SEQ ID NO: 2670758 - RNA, 13 nt, Human
caaaucuggaagc

SEQ ID NO: 2670759 - RNA, 12 nt, Human
caaagucauuaa

SEQ ID NO: 2670760 - RNA, 16 nt, Human
caaagucauuaaagac

SEQ ID NO: 2670761 - RNA, 17 nt, Human
caaagucauuaaagaca

SEQ ID NO: 2670762 - RNA, 13 nt, Human
caaaugacuuuau

SEQ ID NO: 2670763 - RNA, 23 nt, Human
caaaguaugugguuuuguaauuu

SEQ ID NO: 2670764 - RNA, 22 nt, Human
caacacagccugggccccagcu

SEQ ID NO: 2670765 - RNA, 13 nt, Human
caacacagccugg

SEQ ID NO: 2670766 - RNA, 15 nt, Human
caacacagccugggc

SEQ ID NO: 2670767 - RNA, 16 nt, Human
caacacagccugggcc

SEQ ID NO: 2670768 - RNA, 11 nt, Human
caagaauguac

SEQ ID NO: 2670769 - RNA, 20 nt, Human
caagaauguacguccagccu

SEQ ID NO: 2670770 - RNA, 22 nt, Human
caagaauugaagcaggacuaaa

SEQ ID NO: 2670771 - RNA, 16 nt, Human
caaccaggcaccucuu

SEQ ID NO: 2670772 - RNA, 19 nt, Human
caaccaggcaccucuuccu

SEQ ID NO: 2670773 - RNA, 18 nt, Human
caaccaggcuccugugau

SEQ ID NO: 2670774 - RNA, 12 nt, Human
caaccagaccug

SEQ ID NO: 2670775 - RNA, 23 nt, Human
caacucagagaaaaaugcucccc

SEQ ID NO: 2670776 - RNA, 14 nt, Human
auuuuaugguuaug

SEQ ID NO: 2670777 - RNA, 16 nt, Human
auuuuaugguuauguu

SEQ ID NO: 2670778 - RNA, 18 nt, Human
auuuuaugguuauguuuu

SEQ ID NO: 2670779 - RNA, 22 nt, Human
auuuuaugguuauguuuuucug

SEQ ID NO: 2670780 - RNA, 23 nt, Human
auuuuaugguuauguuuuucugu

SEQ ID NO: 2670781 - RNA, 11 nt, Human
auuuugaauca

SEQ ID NO: 2670782 - RNA, 12 nt, Human
auuuugaaucaa

SEQ ID NO: 2670783 - RNA, 13 nt, Human
auuuugaaucaau

SEQ ID NO: 2670784 - RNA, 14 nt, Human
auuuugaaucaaua

SEQ ID NO: 2670785 - RNA, 15 nt, Human
auuuugaaucaauaa

SEQ ID NO: 2670786 - RNA, 17 nt, Human
auuuugaaucaauaaua

SEQ ID NO: 2670787 - RNA, 20 nt, Human
auuuuuauacaaaccuacca

SEQ ID NO: 2670788 - RNA, 12 nt, Human
auuuuuauaauu

SEQ ID NO: 2670789 - RNA, 21 nt, Human
auuuuuauaauuguacaaaau

SEQ ID NO: 2670790 - RNA, 17 nt, Human
auuuuuauacaaaccua

SEQ ID NO: 2670791 - RNA, 16 nt, Human
auuuuuagaauaagaa

SEQ ID NO: 2670792 - RNA, 19 nt, Human
auuuuuagaauaagaauuu

SEQ ID NO: 2670793 - RNA, 21 nt, Human
auuuuuagaauaagaauuugc

SEQ ID NO: 2670794 - RNA, 22 nt, Human
auuuuuagaauaagaauuugca

SEQ ID NO: 2670795 - RNA, 23 nt, Human
auuuuuagaauaagaauuugcau

SEQ ID NO: 2670796 - RNA, 24 nt, Human
auuuuuagaauaagaauuugcaua

SEQ ID NO: 2670797 - RNA, 21 nt, Human
auuuuuagaauuaaaaaagca

SEQ ID NO: 2670798 - RNA, 14 nt, Human
auuuuuauauuucc

SEQ ID NO: 2670799 - RNA, 16 nt, Human
auuuuuauauuuccuu

SEQ ID NO: 2670800 - RNA, 17 nt, Human
auuuuuauauuuccuuu

SEQ ID NO: 2670801 - RNA, 13 nt, Human
auuuuuauagcaa

SEQ ID NO: 2670802 - RNA, 21 nt, Human
auuuuuauagcaacaacaauu

SEQ ID NO: 2670803 - RNA, 13 nt, Human
auuuuuauaucau

SEQ ID NO: 2670804 - RNA, 17 nt, Human
auuuuuauaucaugcaa

SEQ ID NO: 2670805 - RNA, 19 nt, Human
auuuuuauaucaugcaaaa

SEQ ID NO: 2670806 - RNA, 22 nt, Human
auuuuuauaucaugcaaaauau

SEQ ID NO: 2670807 - RNA, 21 nt, Human
auuuuuuugaacucuucucau

SEQ ID NO: 2670808 - RNA, 23 nt, Human
auuuuuuugaacucuucucauua

SEQ ID NO: 2670809 - RNA, 22 nt, Human
auuuuuuugaacucuucucauu

SEQ ID NO: 2670810 - RNA, 22 nt, Human
auuuuuuugcaugcaugcaaau

SEQ ID NO: 2670811 - RNA, 23 nt, Human
auuuuuuugcaugcaugcaaaug

SEQ ID NO: 2670812 - RNA, 13 nt, Human
auuuuuuuguaug

SEQ ID NO: 2670813 - RNA, 13 nt, Human
auuuuuuuguaau

SEQ ID NO: 2670814 - RNA, 14 nt, Human
auuuuuuuguaaua

SEQ ID NO: 2670815 - RNA, 15 nt, Human
auuuuuuuguaauaa

SEQ ID NO: 2670816 - RNA, 19 nt, Human
auuuuuuuguaauaagcaa

SEQ ID NO: 2670817 - RNA, 19 nt, Human
caaaagcugggcagguugg

SEQ ID NO: 2670818 - RNA, 17 nt, Human
auuuuuuuguaugaaaa

SEQ ID NO: 2670819 - RNA, 14 nt, Human
auuuuuuuguauga

SEQ ID NO: 2670820 - RNA, 13 nt, Human
caaaaggaagucu

SEQ ID NO: 2670821 - RNA, 15 nt, Human
caaacagugacugua

SEQ ID NO: 2670822 - RNA, 14 nt, Human
caaagauagacagg

SEQ ID NO: 2670823 - RNA, 17 nt, Human
caaagauagacaggucc

SEQ ID NO: 2670824 - RNA, 18 nt, Human
caaagauagacagguccu

SEQ ID NO: 2670825 - RNA, 19 nt, Human
caaagauagacagguccug

SEQ ID NO: 2670826 - RNA, 22 nt, Human
caaagauagacagguccugauu

SEQ ID NO: 2670827 - RNA, 14 nt, Human
caaggcuaugugau

SEQ ID NO: 2670828 - RNA, 21 nt, Human
caaggccugguguuucuugau

SEQ ID NO: 2670829 - RNA, 22 nt, Human
caaggccugguguuucuugaua

SEQ ID NO: 2670830 - RNA, 15 nt, Human
caagucagcuccagc

SEQ ID NO: 2670831 - RNA, 16 nt, Human
caagucagcuccagcu

SEQ ID NO: 2670832 - RNA, 22 nt, Human
caagucaguaggacuccuuauu

SEQ ID NO: 2670833 - RNA, 18 nt, Human
caagucauagccauaaau

SEQ ID NO: 2670834 - RNA, 20 nt, Human
caagucauagccauaaauga

SEQ ID NO: 2670835 - RNA, 14 nt, Human
caaguuuauauaua

SEQ ID NO: 2670836 - RNA, 15 nt, Human
caaguuuauauauau

SEQ ID NO: 2670837 - RNA, 12 nt, Human
caagaugugaau

SEQ ID NO: 2670838 - RNA, 13 nt, Human
caagaugugaauu

SEQ ID NO: 2670839 - RNA, 14 nt, Human
caagaugugaauua

SEQ ID NO: 2670840 - RNA, 18 nt, Human
caagaugugaauuauuga

SEQ ID NO: 2670841 - RNA, 16 nt, Human
caagauuuaaaugcca

SEQ ID NO: 2670842 - RNA, 16 nt, Human
caaggccugcucccug

SEQ ID NO: 2670843 - RNA, 17 nt, Human
caauccauaacuuuagu

SEQ ID NO: 2670844 - RNA, 20 nt, Human
caaucccuuuauuacccccu

SEQ ID NO: 2670845 - RNA, 19 nt, Human
caauccuaauuucuccucc

SEQ ID NO: 2670846 - RNA, 17 nt, Human
caaugggaccuguggcu

SEQ ID NO: 2670847 - RNA, 21 nt, Human
caauugaauuaaauuaggaau

SEQ ID NO: 2670848 - RNA, 15 nt, Human
caauuucuguguugc

SEQ ID NO: 2670849 - RNA, 20 nt, Human
caauuucuguguugccaagc

SEQ ID NO: 2670850 - RNA, 22 nt, Human
caccagcccaucgccacaaacu

SEQ ID NO: 2670851 - RNA, 12 nt, Human
caccagccccac

SEQ ID NO: 2670852 - RNA, 14 nt, Human
caccagccccacug

SEQ ID NO: 2670853 - RNA, 23 nt, Human
caccagccccacugccagcagca

SEQ ID NO: 2670854 - RNA, 18 nt, Human
caccagccccacugccag

SEQ ID NO: 2670855 - RNA, 20 nt, Human
caccagccccacugccagca

SEQ ID NO: 2670856 - RNA, 21 nt, Human
caccagccccacugccagcag

SEQ ID NO: 2670857 - RNA, 22 nt, Human
caccagccccacugccagcagc

SEQ ID NO: 2670858 - RNA, 19 nt, Human
cacccaugcaagcagagga

SEQ ID NO: 2670859 - RNA, 22 nt, Human
cacccaugcaagcagaggacca

SEQ ID NO: 2670860 - RNA, 13 nt, Human
cacccaugguacc

SEQ ID NO: 2670861 - RNA, 17 nt, Human
caccccaacacuuccag

SEQ ID NO: 2670862 - RNA, 12 nt, Human
caccccaagaga

SEQ ID NO: 2670863 - RNA, 22 nt, Human
caccaaaucguagcguuuguua

SEQ ID NO: 2670864 - RNA, 13 nt, Human
cacaucugccuua

SEQ ID NO: 2670865 - RNA, 13 nt, Human
caccaaagcugcc

SEQ ID NO: 2670866 - RNA, 14 nt, Human
caccaaagcugccc

SEQ ID NO: 2670867 - RNA, 18 nt, Human
caccaaagcugcccacug

SEQ ID NO: 2670868 - RNA, 12 nt, Human
cacaucugccuu

SEQ ID NO: 2670869 - RNA, 21 nt, Human
cacaccaaucuuacuuuguaa

SEQ ID NO: 2670870 - RNA, 21 nt, Human
cacuggguugcgggacagagu

SEQ ID NO: 2670871 - RNA, 15 nt, Human
cacugggcucccggg

SEQ ID NO: 2670872 - RNA, 16 nt, Human
cacugggcucccgggc

SEQ ID NO: 2670873 - RNA, 22 nt, Human
cacuuaaaacacguuuuaagga

SEQ ID NO: 2670874 - RNA, 16 nt, Human
cacuuaaaacacguuu

SEQ ID NO: 2670875 - RNA, 15 nt, Human
cacuuaaagaaguau

SEQ ID NO: 2670876 - RNA, 16 nt, Human
cacuuaaagaaguauu

SEQ ID NO: 2670877 - RNA, 17 nt, Human
cacuuaaagaaguauuu

SEQ ID NO: 2670878 - RNA, 18 nt, Human
cacuuaaagaaguauuuu

SEQ ID NO: 2670879 - RNA, 21 nt, Human
cacuguuucucuugagcuggc

SEQ ID NO: 2670880 - RNA, 15 nt, Human
cacuguuuguuuuua

SEQ ID NO: 2670881 - RNA, 18 nt, Human
cacuguuuguuuuuauuu

SEQ ID NO: 2670882 - RNA, 22 nt, Human
cacuguuucucuugagcuggcc

SEQ ID NO: 2670883 - RNA, 17 nt, Human
cacugccaugccagcuu

SEQ ID NO: 2670884 - RNA, 13 nt, Human
cacugccaggcca

SEQ ID NO: 2670885 - RNA, 14 nt, Human
cacugccaggccag

SEQ ID NO: 2670886 - RNA, 16 nt, Human
cacugccaggccagcc

SEQ ID NO: 2670887 - RNA, 17 nt, Human
cacugccaggccagccu

SEQ ID NO: 2670888 - RNA, 18 nt, Human
cacugccaggccagccuc

SEQ ID NO: 2670889 - RNA, 19 nt, Human
cacugccaggccagccucc

SEQ ID NO: 2670890 - RNA, 20 nt, Human
cacugccaggccagccuccg

SEQ ID NO: 2670891 - RNA, 21 nt, Human
cacugccaggccagccuccga

SEQ ID NO: 2670892 - RNA, 21 nt, Human
cacuuaagacuguguauucua

SEQ ID NO: 2670893 - RNA, 21 nt, Human
cacuuaaacgaagaguucccu

SEQ ID NO: 2670894 - RNA, 13 nt, Human
cacuuaagacugu

SEQ ID NO: 2670895 - RNA, 17 nt, Human
cacuuaaguuagccucc

SEQ ID NO: 2670896 - RNA, 21 nt, Human
cacuuaaguuagccuccacca

SEQ ID NO: 2670897 - RNA, 17 nt, Human
cacuuuacccaccuaga

SEQ ID NO: 2670898 - RNA, 19 nt, Human
cacuuuacccaccuagaac

SEQ ID NO: 2670899 - RNA, 20 nt, Human
cacuuuacccaccuagaaca

SEQ ID NO: 2670900 - RNA, 22 nt, Human
cacuuuacccaccuagaacacu

SEQ ID NO: 2670901 - RNA, 14 nt, Human
cacuuuacccaccu

SEQ ID NO: 2670902 - RNA, 20 nt, Human
cagaaauauaacacauuuuu

SEQ ID NO: 2670903 - RNA, 21 nt, Human
cagaaauauaacacauuuuuu

SEQ ID NO: 2670904 - RNA, 15 nt, Human
cagaaauggaaagca

SEQ ID NO: 2670905 - RNA, 17 nt, Human
cagaaauggaaagcaga

SEQ ID NO: 2670906 - RNA, 18 nt, Human
cagaaaugaggaggaugc

SEQ ID NO: 2670907 - RNA, 14 nt, Human
cagaaauacaauuu

SEQ ID NO: 2670908 - RNA, 18 nt, Human
cagaaagcuuuauuuuga

SEQ ID NO: 2670909 - RNA, 18 nt, Human
cacuacaguauuacucuu

SEQ ID NO: 2670910 - RNA, 14 nt, Human
cacuccagccuggg

SEQ ID NO: 2670911 - RNA, 13 nt, Human
cacuccagccugg

SEQ ID NO: 2670912 - RNA, 16 nt, Human
cacuccagccugggcg

SEQ ID NO: 2670913 - RNA, 23 nt, Human
cacuacaccuggcugagguuccu

SEQ ID NO: 2670914 - RNA, 14 nt, Human
cacuacaccuugcc

SEQ ID NO: 2670915 - RNA, 16 nt, Human
cacuacaccuugccuu

SEQ ID NO: 2670916 - RNA, 15 nt, Human
cacuacaccuggcug

SEQ ID NO: 2670917 - RNA, 16 nt, Human
cacucuuaagcuuccg

SEQ ID NO: 2670918 - RNA, 14 nt, Human
caccuuuuacugug

SEQ ID NO: 2670919 - RNA, 23 nt, Human
caccuagaacacuaacucaccag

SEQ ID NO: 2670920 - RNA, 13 nt, Human
ccgacauggcucc

SEQ ID NO: 2670921 - RNA, 22 nt, Human
cccugugacauggugccugaga

SEQ ID NO: 2670922 - RNA, 24 nt, Human
cccugugacauggugccugagagg

SEQ ID NO: 2670923 - RNA, 21 nt, Human
cccugugacauggugccugag

SEQ ID NO: 2670924 - RNA, 12 nt, Human
cccuccuucaga

SEQ ID NO: 2670925 - RNA, 22 nt, Human
ccgcagagcgcgccccuagccg

SEQ ID NO: 2670926 - RNA, 21 nt, Human
ccgcagagcgcgccccuagcc

SEQ ID NO: 2670927 - RNA, 17 nt, Human
ccgugaagauacuuugu

SEQ ID NO: 2670928 - RNA, 18 nt, Human
ccgugaaaacggagcuga

SEQ ID NO: 2670929 - RNA, 17 nt, Human
ccgugaaaacggagcug

SEQ ID NO: 2670930 - RNA, 14 nt, Human
ccguccugccugug

SEQ ID NO: 2670931 - RNA, 20 nt, Human
ccgugaagauacuuuguauu

SEQ ID NO: 2670932 - RNA, 18 nt, Human
ccgugaagauacuuugua

SEQ ID NO: 2670933 - RNA, 15 nt, Human
ccuaauggugaugca

SEQ ID NO: 2670934 - RNA, 19 nt, Human
ccgguuccugucccugcgc

SEQ ID NO: 2670935 - RNA, 17 nt, Human
ccgguuccugucccugc

SEQ ID NO: 2670936 - RNA, 13 nt, Human
ccguccugccugu

SEQ ID NO: 2670937 - RNA, 15 nt, Human
ccguccugccugugg

SEQ ID NO: 2670938 - RNA, 21 nt, Human
ccggcagccccagccugcuag

SEQ ID NO: 2670939 - RNA, 20 nt, Human
ccggcagccccagccugcua

SEQ ID NO: 2670940 - RNA, 19 nt, Human
ccggcagccccagccugcu

SEQ ID NO: 2670941 - RNA, 18 nt, Human
ccggcagccccagccugc

SEQ ID NO: 2670942 - RNA, 17 nt, Human
ccggcagccccagccug

SEQ ID NO: 2670943 - RNA, 16 nt, Human
ccggcagccccagccu

SEQ ID NO: 2670944 - RNA, 15 nt, Human
ccggcagccccagcc

SEQ ID NO: 2670945 - RNA, 18 nt, Human
ccucgcccucuccuuugu

SEQ ID NO: 2670946 - RNA, 14 nt, Human
ccucgcccucuccu

SEQ ID NO: 2670947 - RNA, 22 nt, Human
ccucgcagccucucagugcccu

SEQ ID NO: 2670948 - RNA, 21 nt, Human
ccucgcaacuguccacgcgug

SEQ ID NO: 2670949 - RNA, 13 nt, Human
ccuccucaccuca

SEQ ID NO: 2670950 - RNA, 14 nt, Human
ccuccucaccucau

SEQ ID NO: 2670951 - RNA, 15 nt, Human
ccuccucaccucaug

SEQ ID NO: 2670952 - RNA, 12 nt, Human
ccuccuauucua

SEQ ID NO: 2670953 - RNA, 19 nt, Human
ccuccuauucuauaaaacu

SEQ ID NO: 2670954 - RNA, 13 nt, Human
ccucccuuccuuu

SEQ ID NO: 2670955 - RNA, 15 nt, Human
ccucccuuccuuuuc

SEQ ID NO: 2670956 - RNA, 16 nt, Human
ccucccuuccuuuucc

SEQ ID NO: 2670957 - RNA, 17 nt, Human
ccucccuuccuuuuccc

SEQ ID NO: 2670958 - RNA, 21 nt, Human
ccucccuuccuuuucccugcu

SEQ ID NO: 2670959 - RNA, 22 nt, Human
ccucccuuccuuuucccugcuu

SEQ ID NO: 2670960 - RNA, 14 nt, Human
ccuccgagagggag

SEQ ID NO: 2670961 - RNA, 16 nt, Human
ccuccgagagggagag

SEQ ID NO: 2670962 - RNA, 19 nt, Human
ccuccgagagggagagaga

SEQ ID NO: 2670963 - RNA, 18 nt, Human
ccucaggcaggugggaug

SEQ ID NO: 2670964 - RNA, 12 nt, Human
ccucaggcaggu

SEQ ID NO: 2670965 - RNA, 14 nt, Human
ccucagcgcggccc

SEQ ID NO: 2670966 - RNA, 15 nt, Human
ccucagcucggcuca

SEQ ID NO: 2670967 - RNA, 13 nt, Human
ccucagcucggcu

SEQ ID NO: 2670968 - RNA, 19 nt, Human
ccucagcucggcucagcuc

SEQ ID NO: 2670969 - RNA, 18 nt, Human
ccucagcucggcucagcu

SEQ ID NO: 2670970 - RNA, 17 nt, Human
ccucagcucggcucagc

SEQ ID NO: 2670971 - RNA, 16 nt, Human
ccucaacaccucugca

SEQ ID NO: 2670972 - RNA, 15 nt, Human
ccucaaauuuuuuga

SEQ ID NO: 2670973 - RNA, 16 nt, Human
ccucaaauuuuuugac

SEQ ID NO: 2670974 - RNA, 17 nt, Human
ccucaaauuuuuugacu

SEQ ID NO: 2670975 - RNA, 22 nt, Human
ccucaaauuuuuugacuuuuuu

SEQ ID NO: 2670976 - RNA, 17 nt, Human
ccuguaacacuccucug

SEQ ID NO: 2670977 - RNA, 18 nt, Human
ccuguaacacuccucugc

SEQ ID NO: 2670978 - RNA, 15 nt, Human
ccuggccuccccugc

SEQ ID NO: 2670979 - RNA, 17 nt, Human
ccuggccuccccugcca

SEQ ID NO: 2670980 - RNA, 18 nt, Human
ccuggccuccccugccac

SEQ ID NO: 2670981 - RNA, 19 nt, Human
ccuggccuccccugccacc

SEQ ID NO: 2670982 - RNA, 20 nt, Human
ccuggccuccccugccacca

SEQ ID NO: 2670983 - RNA, 18 nt, Human
ccugguuauugauguggc

SEQ ID NO: 2670984 - RNA, 23 nt, Human
ccugguuauugauguggcccugg

SEQ ID NO: 2670985 - RNA, 14 nt, Human
ccugggcuggaauc

SEQ ID NO: 2670986 - RNA, 20 nt, Human
ccugggcuggaaucaggaau

SEQ ID NO: 2670987 - RNA, 18 nt, Human
ccugggcuuggccugcug

SEQ ID NO: 2670988 - RNA, 19 nt, Human
ccugggcuuggccugcugu

SEQ ID NO: 2670989 - RNA, 20 nt, Human
ccugggcuuggccugcugug

SEQ ID NO: 2670990 - RNA, 21 nt, Human
ccugggcuuggccugcuguga

SEQ ID NO: 2670991 - RNA, 13 nt, Human
ccugggcuuggcc

SEQ ID NO: 2670992 - RNA, 14 nt, Human
ccugggcuuggccu

SEQ ID NO: 2670993 - RNA, 15 nt, Human
ccugggcuuggccug

SEQ ID NO: 2670994 - RNA, 16 nt, Human
ccugggcuuggccugc

SEQ ID NO: 2670995 - RNA, 17 nt, Human
ccugggcuuggccugcu

SEQ ID NO: 2670996 - RNA, 19 nt, Human
ccugaggucaucggcgugg

SEQ ID NO: 2670997 - RNA, 15 nt, Human
ccugaggcugugguc

SEQ ID NO: 2670998 - RNA, 16 nt, Human
ccugaggcugugguca

SEQ ID NO: 2670999 - RNA, 17 nt, Human
ccugaggcuguggucac

SEQ ID NO: 2671000 - RNA, 20 nt, Human
ccugacccauugcuguuguc

SEQ ID NO: 2671001 - RNA, 18 nt, Human
ccucggccccucccacac

SEQ ID NO: 2671002 - RNA, 13 nt, Human
ccucuugcccauc

SEQ ID NO: 2671003 - RNA, 16 nt, Human
ccugccucagccuccc

SEQ ID NO: 2671004 - RNA, 13 nt, Human
cccacccgguggg

SEQ ID NO: 2671005 - RNA, 19 nt, Human
cccacucccuugcuggccc

SEQ ID NO: 2671006 - RNA, 16 nt, Human
cccaccccugccccca

SEQ ID NO: 2671007 - RNA, 12 nt, Human
cccaccccugcc

SEQ ID NO: 2671008 - RNA, 15 nt, Human
ccauuuccauugcuu

SEQ ID NO: 2671009 - RNA, 14 nt, Human
cccaagagaacucg

SEQ ID NO: 2671010 - RNA, 24 nt, Human
cccaagagaacucgcgcucaguaa

SEQ ID NO: 2671011 - RNA, 14 nt, Human
cccaagaaugcaag

SEQ ID NO: 2671012 - RNA, 20 nt, Human
cccaagaaugcaagauuuca

SEQ ID NO: 2671013 - RNA, 13 nt, Human
ccauuucccaucu

SEQ ID NO: 2671014 - RNA, 14 nt, Human
ccauuucccaucug

SEQ ID NO: 2671015 - RNA, 15 nt, Human
ccauuucccaucugc

SEQ ID NO: 2671016 - RNA, 16 nt, Human
ccauuucccaucugca

SEQ ID NO: 2671017 - RNA, 17 nt, Human
ccauuucccaucugcac

SEQ ID NO: 2671018 - RNA, 17 nt, Human
ccauugcuuauuaugua

SEQ ID NO: 2671019 - RNA, 18 nt, Human
ccauugcuuauuauguag

SEQ ID NO: 2671020 - RNA, 12 nt, Human
ccauuuauuuau

SEQ ID NO: 2671021 - RNA, 22 nt, Human
ccauccccuguagagugggagc

SEQ ID NO: 2671022 - RNA, 20 nt, Human
ccauguagcccccuggccuc

SEQ ID NO: 2671023 - RNA, 14 nt, Human
ccauguagcccccu

SEQ ID NO: 2671024 - RNA, 23 nt, Human
ccauguccaaagaggcugccccu

SEQ ID NO: 2671025 - RNA, 23 nt, Human
ccauguagcccccuggccucugu

SEQ ID NO: 2671026 - RNA, 22 nt, Human
ccauguagcccccuggccucug

SEQ ID NO: 2671027 - RNA, 14 nt, Human
ccagcucccucuau

SEQ ID NO: 2671028 - RNA, 22 nt, Human
ccagcccggccgcuccaccagc

SEQ ID NO: 2671029 - RNA, 13 nt, Human
ccagccccucugg

SEQ ID NO: 2671030 - RNA, 15 nt, Human
ccagcuacuugggag

SEQ ID NO: 2671031 - RNA, 16 nt, Human
ccagcuacuugggagg

SEQ ID NO: 2671032 - RNA, 17 nt, Human
ccagcuacuugggaggc

SEQ ID NO: 2671033 - RNA, 19 nt, Human
ccagcuacuugggaggcug

SEQ ID NO: 2671034 - RNA, 20 nt, Human
ccagcuacuugggaggcuga

SEQ ID NO: 2671035 - RNA, 17 nt, Human
ccagcacuuugggaggc

SEQ ID NO: 2671036 - RNA, 16 nt, Human
ccagcacuuugggagg

SEQ ID NO: 2671037 - RNA, 15 nt, Human
ccagcacuuugggag

SEQ ID NO: 2671038 - RNA, 20 nt, Human
ccagcacuuugggaggccga

SEQ ID NO: 2671039 - RNA, 18 nt, Human
ccacucgugcaucccuga

SEQ ID NO: 2671040 - RNA, 17 nt, Human
ccagccccggggugagu

SEQ ID NO: 2671041 - RNA, 19 nt, Human
ccaggaaacuccacaucug

SEQ ID NO: 2671042 - RNA, 20 nt, Human
ccaggaaacuccacaucugc

SEQ ID NO: 2671043 - RNA, 21 nt, Human
ccaggaaacuccacaucugcc

SEQ ID NO: 2671044 - RNA, 22 nt, Human
ccaggaaacuccacaucugccu

SEQ ID NO: 2671045 - RNA, 18 nt, Human
ccagggggucucacccau

SEQ ID NO: 2671046 - RNA, 16 nt, Human
ccaggggucucccugg

SEQ ID NO: 2671047 - RNA, 14 nt, Human
ccaggggucucccu

SEQ ID NO: 2671048 - RNA, 15 nt, Human
ccaggggucucccug

SEQ ID NO: 2671049 - RNA, 17 nt, Human
ccaggggucucccuggc

SEQ ID NO: 2671050 - RNA, 18 nt, Human
ccaggggucucccuggcu

SEQ ID NO: 2671051 - RNA, 21 nt, Human
ccaggggucucccuggcuccc

SEQ ID NO: 2671052 - RNA, 13 nt, Human
ccaguccaggcug

SEQ ID NO: 2671053 - RNA, 16 nt, Human
ccaguccacccugccu

SEQ ID NO: 2671054 - RNA, 17 nt, Human
ccaguccacccugccug

SEQ ID NO: 2671055 - RNA, 18 nt, Human
ccaguccacccugccugc

SEQ ID NO: 2671056 - RNA, 14 nt, Human
ccaguccaggcugc

SEQ ID NO: 2671057 - RNA, 15 nt, Human
ccaguccaggcugcc

SEQ ID NO: 2671058 - RNA, 16 nt, Human
ccaguccaggcugccg

SEQ ID NO: 2671059 - RNA, 19 nt, Human
ccaguccaggcugccgugg

SEQ ID NO: 2671060 - RNA, 19 nt, Human
ccagucagguaguugcaau

SEQ ID NO: 2671061 - RNA, 13 nt, Human
ccaggcugccucc

SEQ ID NO: 2671062 - RNA, 23 nt, Human
ccaggcugccucccuuguggcag

SEQ ID NO: 2671063 - RNA, 15 nt, Human
ccaggcugccguggg

SEQ ID NO: 2671064 - RNA, 18 nt, Human
ccaggcugccguggggcc

SEQ ID NO: 2671065 - RNA, 14 nt, Human
ccaggcugccgugg

SEQ ID NO: 2671066 - RNA, 18 nt, Human
ccaggggaguugugucug

SEQ ID NO: 2671067 - RNA, 16 nt, Human
ccaggggaguuguguc

SEQ ID NO: 2671068 - RNA, 21 nt, Human
ccaggggaaaaucagccugcu

SEQ ID NO: 2671069 - RNA, 18 nt, Human
ccaggaucccaagccucc

SEQ ID NO: 2671070 - RNA, 19 nt, Human
ccaggaucccaagccuccu

SEQ ID NO: 2671071 - RNA, 21 nt, Human
ccaggaucccaagccuccugc

SEQ ID NO: 2671072 - RNA, 22 nt, Human
ccaggaucccaagccuccugcu

SEQ ID NO: 2671073 - RNA, 15 nt, Human
cccuccuccaggccu

SEQ ID NO: 2671074 - RNA, 19 nt, Human
cccuccuccaggccugccu

SEQ ID NO: 2671075 - RNA, 23 nt, Human
cccuccuccaggccugccuccca

SEQ ID NO: 2671076 - RNA, 22 nt, Human
cccuccugaaccgcacagcuca

SEQ ID NO: 2671077 - RNA, 23 nt, Human
cccuccugaaccgcacagcucag

SEQ ID NO: 2671078 - RNA, 12 nt, Human
cccuccugaccc

SEQ ID NO: 2671079 - RNA, 12 nt, Human
ccccugccccca

SEQ ID NO: 2671080 - RNA, 12 nt, Human
ccccugccacca

SEQ ID NO: 2671081 - RNA, 20 nt, Human
ccccugccaccaggccaccu

SEQ ID NO: 2671082 - RNA, 19 nt, Human
cccucagcucggcucagcu

SEQ ID NO: 2671083 - RNA, 16 nt, Human
cccucagcucggcuca

SEQ ID NO: 2671084 - RNA, 16 nt, Human
cccucaacaccucugc

SEQ ID NO: 2671085 - RNA, 22 nt, Human
cccggccggccacccaggaggc

SEQ ID NO: 2671086 - RNA, 16 nt, Human
cccucaaccucuucug

SEQ ID NO: 2671087 - RNA, 15 nt, Human
ccccuucucuccucc

SEQ ID NO: 2671088 - RNA, 19 nt, Human
ccccuucucuccuccccaa

SEQ ID NO: 2671089 - RNA, 16 nt, Human
cccggccgccccuccu

SEQ ID NO: 2671090 - RNA, 15 nt, Human
cccggcccccugccc

SEQ ID NO: 2671091 - RNA, 17 nt, Human
cccggccgcuccaccag

SEQ ID NO: 2671092 - RNA, 20 nt, Human
ccccagcccagggcuccugc

SEQ ID NO: 2671093 - RNA, 21 nt, Human
ccccagcccagggcuccugca

SEQ ID NO: 2671094 - RNA, 12 nt, Human
ccccagcccagg

SEQ ID NO: 2671095 - RNA, 14 nt, Human
ccccagcccagggc

SEQ ID NO: 2671096 - RNA, 15 nt, Human
ccccagcccagggcu

SEQ ID NO: 2671097 - RNA, 15 nt, Human
ccccaugcuuccuug

SEQ ID NO: 2671098 - RNA, 17 nt, Human
ccccaugcuuccuugcc

SEQ ID NO: 2671099 - RNA, 24 nt, Human
ccccaugcuuccuugccugaugac

SEQ ID NO: 2671100 - RNA, 15 nt, Human
cccauuuuccucuga

SEQ ID NO: 2671101 - RNA, 16 nt, Human
cccauuugugccagag

SEQ ID NO: 2671102 - RNA, 18 nt, Human
cccauuugugccagagga

SEQ ID NO: 2671103 - RNA, 14 nt, Human
ccccgcagacaccu

SEQ ID NO: 2671104 - RNA, 22 nt, Human
cccagcaccucagccugcacag

SEQ ID NO: 2671105 - RNA, 17 nt, Human
cccagcaccucagccug

SEQ ID NO: 2671106 - RNA, 18 nt, Human
cccagcaccucagccugc

SEQ ID NO: 2671107 - RNA, 18 nt, Human
cccagcacagcuugaccu

SEQ ID NO: 2671108 - RNA, 19 nt, Human
cccagcacagcuugaccug

SEQ ID NO: 2671109 - RNA, 22 nt, Human
cccagcaagugguccuagaggc

SEQ ID NO: 2671110 - RNA, 15 nt, Human
cccagccaugccagc

SEQ ID NO: 2671111 - RNA, 17 nt, Human
cccagccaugccagcug

SEQ ID NO: 2671112 - RNA, 18 nt, Human
cccagccaugccagcugg

SEQ ID NO: 2671113 - RNA, 19 nt, Human
cccagccaugccagcuggc

SEQ ID NO: 2671114 - RNA, 22 nt, Human
cccagccaugccagcuggccuu

SEQ ID NO: 2671115 - RNA, 13 nt, Human
cccagccauccag

SEQ ID NO: 2671116 - RNA, 15 nt, Human
cccauccugaccagc

SEQ ID NO: 2671117 - RNA, 17 nt, Human
cccaucgccacaaacuc

SEQ ID NO: 2671118 - RNA, 13 nt, Human
cugagcugccagu

SEQ ID NO: 2671119 - RNA, 14 nt, Human
cugagcugccagug

SEQ ID NO: 2671120 - RNA, 21 nt, Human
cugaggaaauugcuuuguauu

SEQ ID NO: 2671121 - RNA, 22 nt, Human
cugaggugggaggaucucuuga

SEQ ID NO: 2671122 - RNA, 13 nt, Human
cugaggugggagg

SEQ ID NO: 2671123 - RNA, 13 nt, Human
cugagggggagcc

SEQ ID NO: 2671124 - RNA, 22 nt, Human
cugaggucaucggcguggccca

SEQ ID NO: 2671125 - RNA, 21 nt, Human
cugagguuccucugccugccc

SEQ ID NO: 2671126 - RNA, 23 nt, Human
cugagguuccucugccugccccg

SEQ ID NO: 2671127 - RNA, 14 nt, Human
cugagguuccucug

SEQ ID NO: 2671128 - RNA, 15 nt, Human
cugagguuccucugc

SEQ ID NO: 2671129 - RNA, 16 nt, Human
cugagguuccucugcc

SEQ ID NO: 2671130 - RNA, 17 nt, Human
cugagguuccucugccu

SEQ ID NO: 2671131 - RNA, 18 nt, Human
cugagguuccucugccug

SEQ ID NO: 2671132 - RNA, 19 nt, Human
cugagguuccucugccugc

SEQ ID NO: 2671133 - RNA, 20 nt, Human
cugagguuccucugccugcc

SEQ ID NO: 2671134 - RNA, 24 nt, Human
cugaaaauauuguuuuacaauagu

SEQ ID NO: 2671135 - RNA, 17 nt, Human
cugaaaauauuguuuua

SEQ ID NO: 2671136 - RNA, 22 nt, Human
cugaaaauauuguuuuacaaua

SEQ ID NO: 2671137 - RNA, 20 nt, Human
cugaaaauauuguuuuacaa

SEQ ID NO: 2671138 - RNA, 22 nt, Human
cugaaaaguguguauauauuuu

SEQ ID NO: 2671139 - RNA, 14 nt, Human
cucuugcccauccu

SEQ ID NO: 2671140 - RNA, 15 nt, Human
cucuugcccauccug

SEQ ID NO: 2671141 - RNA, 16 nt, Human
cucuugcccauccuga

SEQ ID NO: 2671142 - RNA, 19 nt, Human
cucuugcccauccugacug

SEQ ID NO: 2671143 - RNA, 20 nt, Human
cucuugcccauccugacuga

SEQ ID NO: 2671144 - RNA, 16 nt, Human
cucuugcaccaaauua

SEQ ID NO: 2671145 - RNA, 20 nt, Human
cucuugcaccaaauuaucuu

SEQ ID NO: 2671146 - RNA, 14 nt, Human
cucuugagccuggg

SEQ ID NO: 2671147 - RNA, 13 nt, Human
cucuugagccugg

SEQ ID NO: 2671148 - RNA, 23 nt, Human
cucuugaguuugucgcucaugug

SEQ ID NO: 2671149 - RNA, 22 nt, Human
cucuugaguuguuuuuguauau

SEQ ID NO: 2671150 - RNA, 21 nt, Human
cucuugaguuguuuuuguaua

SEQ ID NO: 2671151 - RNA, 20 nt, Human
cucuugaguuguuuuuguau

SEQ ID NO: 2671152 - RNA, 18 nt, Human
cucuugaguuguuuuugu

SEQ ID NO: 2671153 - RNA, 16 nt, Human
cucuugaguuguuuuu

SEQ ID NO: 2671154 - RNA, 13 nt, Human
cucuugaguuguu

SEQ ID NO: 2671155 - RNA, 23 nt, Human
cucuugaguuguuuuuguauauu

SEQ ID NO: 2671156 - RNA, 16 nt, Human
cucuugagccugggag

SEQ ID NO: 2671157 - RNA, 15 nt, Human
cucuugagccuggga

SEQ ID NO: 2671158 - RNA, 13 nt, Human
cucuugagcuggc

SEQ ID NO: 2671159 - RNA, 14 nt, Human
cucuugagcuggcc

SEQ ID NO: 2671160 - RNA, 15 nt, Human
cucuugagcuggccu

SEQ ID NO: 2671161 - RNA, 16 nt, Human
cucuugagcuggccuc

SEQ ID NO: 2671162 - RNA, 22 nt, Human
cucuugagcuggccucucuagc

SEQ ID NO: 2671163 - RNA, 18 nt, Human
cucugcacaagcugcacc

SEQ ID NO: 2671164 - RNA, 17 nt, Human
cucugcacaagcugcac

SEQ ID NO: 2671165 - RNA, 19 nt, Human
cucugcacaagcugcaccc

SEQ ID NO: 2671166 - RNA, 14 nt, Human
cugaagcagccucu

SEQ ID NO: 2671167 - RNA, 15 nt, Human
cugaagcagccucuc

SEQ ID NO: 2671168 - RNA, 16 nt, Human
cugaagcagccucucc

SEQ ID NO: 2671169 - RNA, 20 nt, Human
cugaagcagccucuccccag

SEQ ID NO: 2671170 - RNA, 13 nt, Human
cucuuuuuguuug

SEQ ID NO: 2671171 - RNA, 20 nt, Human
cugaccccgguggcggcccc

SEQ ID NO: 2671172 - RNA, 18 nt, Human
cuccauaguuuggcauuu

SEQ ID NO: 2671173 - RNA, 11 nt, Human
cucccagccuc

SEQ ID NO: 2671174 - RNA, 22 nt, Human
cuccagugugggcuugaccagg

SEQ ID NO: 2671175 - RNA, 22 nt, Human
cuccagggaauccaagccucca

SEQ ID NO: 2671176 - RNA, 15 nt, Human
cuccaggcuuuccca

SEQ ID NO: 2671177 - RNA, 16 nt, Human
cuccagggaauccaag

SEQ ID NO: 2671178 - RNA, 19 nt, Human
cuccagggaauccaagccu

SEQ ID NO: 2671179 - RNA, 20 nt, Human
cuccagggaauccaagccuc

SEQ ID NO: 2671180 - RNA, 21 nt, Human
cuccagggaauccaagccucc

SEQ ID NO: 2671181 - RNA, 14 nt, Human
cuccagggacacac

SEQ ID NO: 2671182 - RNA, 18 nt, Human
cuccagggacacacagcc

SEQ ID NO: 2671183 - RNA, 19 nt, Human
cuccagggacacacagccu

SEQ ID NO: 2671184 - RNA, 20 nt, Human
cuccagggacacacagccua

SEQ ID NO: 2671185 - RNA, 22 nt, Human
cuccagggacacacagccuagc

SEQ ID NO: 2671186 - RNA, 19 nt, Human
cucagacauguuuuccgug

SEQ ID NO: 2671187 - RNA, 20 nt, Human
cucagacauguuuuccguga

SEQ ID NO: 2671188 - RNA, 16 nt, Human
cuccccagguccagcu

SEQ ID NO: 2671189 - RNA, 17 nt, Human
cuccccagguccagcuc

SEQ ID NO: 2671190 - RNA, 14 nt, Human
cucccagccucagc

SEQ ID NO: 2671191 - RNA, 18 nt, Human
cuccccagguccagcucu

SEQ ID NO: 2671192 - RNA, 19 nt, Human
cuccccagguccagcucug

SEQ ID NO: 2671193 - RNA, 20 nt, Human
cuccccagguccagcucugg

SEQ ID NO: 2671194 - RNA, 21 nt, Human
cuccccagguccagcucugga

SEQ ID NO: 2671195 - RNA, 23 nt, Human
cuccccagguccagcucuggagg

SEQ ID NO: 2671196 - RNA, 22 nt, Human
cuccauaaacaugaaaacacuu

SEQ ID NO: 2671197 - RNA, 23 nt, Human
cucccucugccccucccccagcc

SEQ ID NO: 2671198 - RNA, 20 nt, Human
cuccggcucccagccucagc

SEQ ID NO: 2671199 - RNA, 19 nt, Human
cuccggcucccagccucag

SEQ ID NO: 2671200 - RNA, 14 nt, Human
cuccggggccauuu

SEQ ID NO: 2671201 - RNA, 19 nt, Human
cuccggggccauuugcaau

SEQ ID NO: 2671202 - RNA, 15 nt, Human
cucuccuccccaaau

SEQ ID NO: 2671203 - RNA, 15 nt, Human
cucugaacuugccuu

SEQ ID NO: 2671204 - RNA, 15 nt, Human
cucugaaaucuuccc

SEQ ID NO: 2671205 - RNA, 23 nt, Human
cucugaaaucuucccaugcauuc

SEQ ID NO: 2671206 - RNA, 16 nt, Human
cucugcacaagcugca

SEQ ID NO: 2671207 - RNA, 13 nt, Human
cucggggagccuu

SEQ ID NO: 2671208 - RNA, 17 nt, Human
cucggguuucucugugg

SEQ ID NO: 2671209 - RNA, 14 nt, Human
cucggggagccuua

SEQ ID NO: 2671210 - RNA, 23 nt, Human
cucgguguggagaagcggcuggc

SEQ ID NO: 2671211 - RNA, 22 nt, Human
cucgguacccggggcccagggc

SEQ ID NO: 2671212 - RNA, 21 nt, Human
cucgguacccggggcccaggg

SEQ ID NO: 2671213 - RNA, 18 nt, Human
cucgguacccggggccca

SEQ ID NO: 2671214 - RNA, 11 nt, Human
cucggugccuu

SEQ ID NO: 2671215 - RNA, 21 nt, Human
cucgguucaaggucacuguuu

SEQ ID NO: 2671216 - RNA, 13 nt, Human
cucgguuucucca

SEQ ID NO: 2671217 - RNA, 15 nt, Human
cucgguuugccaaaa

SEQ ID NO: 2671218 - RNA, 16 nt, Human
cucgguuugccaaaau

SEQ ID NO: 2671219 - RNA, 22 nt, Human
cucgguuugccaaaauucauuu

SEQ ID NO: 2671220 - RNA, 14 nt, Human
cucguggcugucaa

SEQ ID NO: 2671221 - RNA, 16 nt, Human
cuccuuuguucccggc

SEQ ID NO: 2671222 - RNA, 17 nt, Human
cuccuuuguucccggcu

SEQ ID NO: 2671223 - RNA, 19 nt, Human
cguacaaguaguucuguau

SEQ ID NO: 2671224 - RNA, 18 nt, Human
cguacaaguaguucugua

SEQ ID NO: 2671225 - RNA, 22 nt, Human
cguacaaguaguucuguauuug

SEQ ID NO: 2671226 - RNA, 21 nt, Human
cguacaaguaguucuguauuu

SEQ ID NO: 2671227 - RNA, 20 nt, Human
cgguucaaggucacuguuuc

SEQ ID NO: 2671228 - RNA, 16 nt, Human
cggagaagagcgcagu

SEQ ID NO: 2671229 - RNA, 17 nt, Human
cggagaagagcgcagug

SEQ ID NO: 2671230 - RNA, 18 nt, Human
cggagaacaugaaucaaa

SEQ ID NO: 2671231 - RNA, 16 nt, Human
cgguuccugucccugc

SEQ ID NO: 2671232 - RNA, 14 nt, Human
cuaacucaaauaca

SEQ ID NO: 2671233 - RNA, 16 nt, Human
cuaacucaaauacaca

SEQ ID NO: 2671234 - RNA, 20 nt, Human
cuaacucaaauacacauuug

SEQ ID NO: 2671235 - RNA, 14 nt, Human
cuaacucaccagcc

SEQ ID NO: 2671236 - RNA, 21 nt, Human
cuaacucaccagccccacugc

SEQ ID NO: 2671237 - RNA, 21 nt, Human
cuaaagaaaaauaucuuggcc

SEQ ID NO: 2671238 - RNA, 23 nt, Human
cuaaagaaaaauaucuuggccua

SEQ ID NO: 2671239 - RNA, 13 nt, Human
cgcaucucacagc

SEQ ID NO: 2671240 - RNA, 20 nt, Human
cgccuguagucccagcuacu

SEQ ID NO: 2671241 - RNA, 16 nt, Human
cgcaucuugccuccag

SEQ ID NO: 2671242 - RNA, 17 nt, Human
cgcaucuugccuccagg

SEQ ID NO: 2671243 - RNA, 19 nt, Human
cgcaucuugccuccaggug

SEQ ID NO: 2671244 - RNA, 12 nt, Human
cgcaucauaugc

SEQ ID NO: 2671245 - RNA, 23 nt, Human
cgauacugcgacuuucugccugg

SEQ ID NO: 2671246 - RNA, 15 nt, Human
cgcauaggaccuuuc

SEQ ID NO: 2671247 - RNA, 19 nt, Human
cgauacugcgacuuucugc

SEQ ID NO: 2671248 - RNA, 20 nt, Human
cgauacugcgacuuucugcc

SEQ ID NO: 2671249 - RNA, 22 nt, Human
cgauacugcgacuuucugccug

SEQ ID NO: 2671250 - RNA, 14 nt, Human
cgaguaagauuaag

SEQ ID NO: 2671251 - RNA, 13 nt, Human
cgaggucaggaga

SEQ ID NO: 2671252 - RNA, 14 nt, Human
cgaggucaggagau

SEQ ID NO: 2671253 - RNA, 16 nt, Human
cgaguagaaaauguga

SEQ ID NO: 2671254 - RNA, 20 nt, Human
cgaguagaaaaugugacccu

SEQ ID NO: 2671255 - RNA, 22 nt, Human
cgaguagaaaaugugacccucc

SEQ ID NO: 2671256 - RNA, 13 nt, Human
cuaggccugggga

SEQ ID NO: 2671257 - RNA, 12 nt, Human
cuaggccugggg

SEQ ID NO: 2671258 - RNA, 23 nt, Human
cuaggcccccacuugccucuucc

SEQ ID NO: 2671259 - RNA, 19 nt, Human
cuaggcccccacuugccuc

SEQ ID NO: 2671260 - RNA, 17 nt, Human
cuaggcccccacuugcc

SEQ ID NO: 2671261 - RNA, 20 nt, Human
cuaggcccccacuugccucu

SEQ ID NO: 2671262 - RNA, 22 nt, Human
cuaggcccccacuugccucuuc

SEQ ID NO: 2671263 - RNA, 18 nt, Human
cuagccagccccucuucc

SEQ ID NO: 2671264 - RNA, 14 nt, Human
cuagggaagauaau

SEQ ID NO: 2671265 - RNA, 16 nt, Human
cuaguucuaacaguga

SEQ ID NO: 2671266 - RNA, 13 nt, Human
cuauaaaacucug

SEQ ID NO: 2671267 - RNA, 15 nt, Human
cuauaaaacucugca

SEQ ID NO: 2671268 - RNA, 15 nt, Human
cuauaaaagaaacac

SEQ ID NO: 2671269 - RNA, 11 nt, Human
cuauaaaauag

SEQ ID NO: 2671270 - RNA, 13 nt, Human
cuauaaaauagau

SEQ ID NO: 2671271 - RNA, 21 nt, Human
cuauaaaauagauauaaauuu

SEQ ID NO: 2671272 - RNA, 18 nt, Human
cuauaaaaaauaaaauaa

SEQ ID NO: 2671273 - RNA, 14 nt, Human
cuauaaagcaguau

SEQ ID NO: 2671274 - RNA, 16 nt, Human
cuauaaagcaguauuu

SEQ ID NO: 2671275 - RNA, 18 nt, Human
cuauaaagcaguauuuuu

SEQ ID NO: 2671276 - RNA, 19 nt, Human
cuauaaagcaguauuuuuc

SEQ ID NO: 2671277 - RNA, 12 nt, Human
cuacguuucuuu

SEQ ID NO: 2671278 - RNA, 14 nt, Human
cuacguuucuuuaa

SEQ ID NO: 2671279 - RNA, 20 nt, Human
cuacguuucuuuaaccuugu

SEQ ID NO: 2671280 - RNA, 17 nt, Human
cuacucaagcggguggc

SEQ ID NO: 2671281 - RNA, 20 nt, Human
cuacucaagcggguggcucu

SEQ ID NO: 2671282 - RNA, 21 nt, Human
cuacucaagcggguggcucug

SEQ ID NO: 2671283 - RNA, 22 nt, Human
cuacucaagcggguggcucugg

SEQ ID NO: 2671284 - RNA, 15 nt, Human
cuacuagauugacua

SEQ ID NO: 2671285 - RNA, 16 nt, Human
cuacuagcaaaauaaa

SEQ ID NO: 2671286 - RNA, 17 nt, Human
cuacuagcaaaauaaaa

SEQ ID NO: 2671287 - RNA, 19 nt, Human
cuacuagcaaaauaaaaca

SEQ ID NO: 2671288 - RNA, 20 nt, Human
cuacuagcaaaauaaaacau

SEQ ID NO: 2671289 - RNA, 16 nt, Human
cuaccuuucaaagcuu

SEQ ID NO: 2671290 - RNA, 23 nt, Human
cucaccucaugcccacccccugc

SEQ ID NO: 2671291 - RNA, 14 nt, Human
cucaccucaugccc

SEQ ID NO: 2671292 - RNA, 15 nt, Human
cucaccuagccugau

SEQ ID NO: 2671293 - RNA, 13 nt, Human
cucaccgcccauc

SEQ ID NO: 2671294 - RNA, 14 nt, Human
cucaccgcccauca

SEQ ID NO: 2671295 - RNA, 16 nt, Human
cucaccgcccaucagg

SEQ ID NO: 2671296 - RNA, 17 nt, Human
cucaccgcccaucaggg

SEQ ID NO: 2671297 - RNA, 15 nt, Human
cucaccucaugccca

SEQ ID NO: 2671298 - RNA, 17 nt, Human
cucaccucaugcccacc

SEQ ID NO: 2671299 - RNA, 14 nt, Human
cucacuucacccug

SEQ ID NO: 2671300 - RNA, 23 nt, Human
cucaaagaaaucuacuauauccc

SEQ ID NO: 2671301 - RNA, 22 nt, Human
cucaaagcacuguugagaagga

SEQ ID NO: 2671302 - RNA, 15 nt, Human
cucaaaguuugacag

SEQ ID NO: 2671303 - RNA, 21 nt, Human
cucaaaguuugacaggaaccu

SEQ ID NO: 2671304 - RNA, 13 nt, Human
cuauuuuuguaaa

SEQ ID NO: 2671305 - RNA, 17 nt, Human
cucaaaaaaagaaaaag

SEQ ID NO: 2671306 - RNA, 18 nt, Human
cucaaaaaaagaaaaaga

SEQ ID NO: 2671307 - RNA, 12 nt, Human
cuaucuccugac

SEQ ID NO: 2671308 - RNA, 14 nt, Human
cuaucuccugacag

SEQ ID NO: 2671309 - RNA, 15 nt, Human
cuaucuccugacaga

SEQ ID NO: 2671310 - RNA, 19 nt, Human
cuaucuccugacagaaggu

SEQ ID NO: 2671311 - RNA, 15 nt, Human
cucaaauacacauuu

SEQ ID NO: 2671312 - RNA, 16 nt, Human
cucaaauacacauuug

SEQ ID NO: 2671313 - RNA, 17 nt, Human
cucaaauacacauuugc

SEQ ID NO: 2671314 - RNA, 18 nt, Human
cucaaauacacauuugcu

SEQ ID NO: 2671315 - RNA, 23 nt, Human
cucaaagcuuggauuaaauacau

SEQ ID NO: 2671316 - RNA, 23 nt, Human
gccucuuguaucccuagugcucc

SEQ ID NO: 2671317 - RNA, 16 nt, Human
gccucuuguaaagacu

SEQ ID NO: 2671318 - RNA, 17 nt, Human
gccucuuguaaagacug

SEQ ID NO: 2671319 - RNA, 18 nt, Human
gccucuuguaaagacugg

SEQ ID NO: 2671320 - RNA, 12 nt, Human
gccucuuucccu

SEQ ID NO: 2671321 - RNA, 16 nt, Human
gccucuuucccuagga

SEQ ID NO: 2671322 - RNA, 23 nt, Human
gccucuuucaagcagucgugccu

SEQ ID NO: 2671323 - RNA, 15 nt, Human
gccuccauccaaggc

SEQ ID NO: 2671324 - RNA, 15 nt, Human
gccuccaggugcaga

SEQ ID NO: 2671325 - RNA, 16 nt, Human
gccuccaggugcagag

SEQ ID NO: 2671326 - RNA, 17 nt, Human
gccuccaggugcagagg

SEQ ID NO: 2671327 - RNA, 18 nt, Human
gccuccaggugcagaggu

SEQ ID NO: 2671328 - RNA, 16 nt, Human
gccuccauccaaggcc

SEQ ID NO: 2671329 - RNA, 19 nt, Human
gccuccuuagaaaaaaaau

SEQ ID NO: 2671330 - RNA, 21 nt, Human
gccugccccgcccccaguccc

SEQ ID NO: 2671331 - RNA, 20 nt, Human
gccugccccgcccccagucc

SEQ ID NO: 2671332 - RNA, 22 nt, Human
gccuggccuuguccucagccag

SEQ ID NO: 2671333 - RNA, 23 nt, Human
gccuggccuuguccucagccagu

SEQ ID NO: 2671334 - RNA, 12 nt, Human
gccuguguccau

SEQ ID NO: 2671335 - RNA, 14 nt, Human
gccuguguccaugc

SEQ ID NO: 2671336 - RNA, 21 nt, Human
gccuguggcgccgucuccagg

SEQ ID NO: 2671337 - RNA, 23 nt, Human
gccuguggcgccgucuccagggg

SEQ ID NO: 2671338 - RNA, 15 nt, Human
gccuguggcugucgg

SEQ ID NO: 2671339 - RNA, 23 nt, Human
gccuguggcugucggugggacuc

SEQ ID NO: 2671340 - RNA, 19 nt, Human
gccuguggcgccgucucca

SEQ ID NO: 2671341 - RNA, 17 nt, Human
gcgaucucuccacugug

SEQ ID NO: 2671342 - RNA, 18 nt, Human
gcgaucucuccacugugc

SEQ ID NO: 2671343 - RNA, 16 nt, Human
gcgaucucuccuggcc

SEQ ID NO: 2671344 - RNA, 18 nt, Human
gcgaucucuccuggccua

SEQ ID NO: 2671345 - RNA, 17 nt, Human
gccuagggcccccacag

SEQ ID NO: 2671346 - RNA, 17 nt, Human
gccuagcgaucucuccu

SEQ ID NO: 2671347 - RNA, 20 nt, Human
gccuagcgaucucuccuggc

SEQ ID NO: 2671348 - RNA, 21 nt, Human
gccuagcgaucucuccuggcc

SEQ ID NO: 2671349 - RNA, 22 nt, Human
gccuagcgaucucuccuggccu

SEQ ID NO: 2671350 - RNA, 23 nt, Human
gccgccgcuagguagagucugag

SEQ ID NO: 2671351 - RNA, 20 nt, Human
gccgccgcuagguagagucu

SEQ ID NO: 2671352 - RNA, 13 nt, Human
gccgccgccucuu

SEQ ID NO: 2671353 - RNA, 20 nt, Human
gccgccccaucugccccaca

SEQ ID NO: 2671354 - RNA, 15 nt, Human
gccgcccccuccuga

SEQ ID NO: 2671355 - RNA, 16 nt, Human
gccgcccccuccugaa

SEQ ID NO: 2671356 - RNA, 23 nt, Human
gccgcaucucacagcuaugcaaa

SEQ ID NO: 2671357 - RNA, 18 nt, Human
gccgcaucucacagcuau

SEQ ID NO: 2671358 - RNA, 15 nt, Human
gccgcaucucacagc

SEQ ID NO: 2671359 - RNA, 13 nt, Human
gcccucaagggug

SEQ ID NO: 2671360 - RNA, 13 nt, Human
gcccguccugccu

SEQ ID NO: 2671361 - RNA, 16 nt, Human
gcccuaaguuuguacu

SEQ ID NO: 2671362 - RNA, 16 nt, Human
gcccgggguggccaca

SEQ ID NO: 2671363 - RNA, 13 nt, Human
gcuccccugagga

SEQ ID NO: 2671364 - RNA, 12 nt, Human
gcuccccugagg

SEQ ID NO: 2671365 - RNA, 12 nt, Human
gcuccugcacuu

SEQ ID NO: 2671366 - RNA, 20 nt, Human
gcuccugcacuuacuugcuu

SEQ ID NO: 2671367 - RNA, 19 nt, Human
gcuccuggcccacugcauc

SEQ ID NO: 2671368 - RNA, 18 nt, Human
gcuccuggcccacugcau

SEQ ID NO: 2671369 - RNA, 20 nt, Human
gcuccuggcccacugcaucg

SEQ ID NO: 2671370 - RNA, 15 nt, Human
gcuccuggcccacug

SEQ ID NO: 2671371 - RNA, 14 nt, Human
gcuccuggcccacu

SEQ ID NO: 2671372 - RNA, 23 nt, Human
gcuccacucugcuucucugacuu

SEQ ID NO: 2671373 - RNA, 18 nt, Human
gcucccacuucugccaga

SEQ ID NO: 2671374 - RNA, 17 nt, Human
gcucccacuucugccag

SEQ ID NO: 2671375 - RNA, 13 nt, Human
gcucccaggagcc

SEQ ID NO: 2671376 - RNA, 17 nt, Human
gcucccagccucagcgc

SEQ ID NO: 2671377 - RNA, 15 nt, Human
gcucccagccucagc

SEQ ID NO: 2671378 - RNA, 14 nt, Human
gcucccagccucag

SEQ ID NO: 2671379 - RNA, 13 nt, Human
gcucccagccuca

SEQ ID NO: 2671380 - RNA, 12 nt, Human
gcucccagccuc

SEQ ID NO: 2671381 - RNA, 21 nt, Human
gcucccaggagccugcccagc

SEQ ID NO: 2671382 - RNA, 20 nt, Human
gcucccaggagccugcccag

SEQ ID NO: 2671383 - RNA, 17 nt, Human
gcuccacucugcuucuc

SEQ ID NO: 2671384 - RNA, 19 nt, Human
gcuccacucugcuucucug

SEQ ID NO: 2671385 - RNA, 20 nt, Human
gcuccacucugcuucucuga

SEQ ID NO: 2671386 - RNA, 21 nt, Human
gcuccacucugcuucucugac

SEQ ID NO: 2671387 - RNA, 13 nt, Human
gcuccacucugcu

SEQ ID NO: 2671388 - RNA, 15 nt, Human
gcuccacucugcuuc

SEQ ID NO: 2671389 - RNA, 16 nt, Human
gcuccacucugcuucu

SEQ ID NO: 2671390 - RNA, 23 nt, Human
gcuccaccagcaucaccugccug

SEQ ID NO: 2671391 - RNA, 18 nt, Human
gcuccaccagcaucaccu

SEQ ID NO: 2671392 - RNA, 20 nt, Human
gcuccaccagcaucaccugc

SEQ ID NO: 2671393 - RNA, 14 nt, Human
gcucugagcgccuc

SEQ ID NO: 2671394 - RNA, 17 nt, Human
gcucugagcgccuccau

SEQ ID NO: 2671395 - RNA, 18 nt, Human
gcucugagcgccuccauc

SEQ ID NO: 2671396 - RNA, 23 nt, Human
gcucugcaagaauugaagcagga

SEQ ID NO: 2671397 - RNA, 24 nt, Human
gcucgguacccggggcccagggca

SEQ ID NO: 2671398 - RNA, 23 nt, Human
gcucgguacccggggcccagggc

SEQ ID NO: 2671399 - RNA, 17 nt, Human
gcucgguacccggggcc

SEQ ID NO: 2671400 - RNA, 22 nt, Human
gcucguggacugagugggaagc

SEQ ID NO: 2671401 - RNA, 14 nt, Human
gcucuaaaagguaa

SEQ ID NO: 2671402 - RNA, 20 nt, Human
gcucuaaaagguaaugugug

SEQ ID NO: 2671403 - RNA, 23 nt, Human
gcucuaaaagguaauguguggau

SEQ ID NO: 2671404 - RNA, 18 nt, Human
gcuacugcacuccagccu

SEQ ID NO: 2671405 - RNA, 20 nt, Human
gcuacugcacuccagccugg

SEQ ID NO: 2671406 - RNA, 21 nt, Human
gcuacugcacuccagccuggg

SEQ ID NO: 2671407 - RNA, 16 nt, Human
gcgugugccugugugc

SEQ ID NO: 2671408 - RNA, 17 nt, Human
gcgugugccugugugcg

SEQ ID NO: 2671409 - RNA, 16 nt, Human
gcuaauucuacucaca

SEQ ID NO: 2671410 - RNA, 19 nt, Human
gcucagggccaugcugagg

SEQ ID NO: 2671411 - RNA, 21 nt, Human
gcucagacauguuuuccguga

SEQ ID NO: 2671412 - RNA, 20 nt, Human
gcucacugccaggccagccu

SEQ ID NO: 2671413 - RNA, 16 nt, Human
gcucagacauguuuuc

SEQ ID NO: 2671414 - RNA, 14 nt, Human
gcucacugccaggc

SEQ ID NO: 2671415 - RNA, 15 nt, Human
gcucacugccaggcc

SEQ ID NO: 2671416 - RNA, 17 nt, Human
gcucacugccaggccag

SEQ ID NO: 2671417 - RNA, 19 nt, Human
gcucacugccaggccagcc

SEQ ID NO: 2671418 - RNA, 12 nt, Human
gcucacugccag

SEQ ID NO: 2671419 - RNA, 13 nt, Human
gcucacugccagg

SEQ ID NO: 2671420 - RNA, 17 nt, Human
gcuauuuucuaaagacu

SEQ ID NO: 2671421 - RNA, 18 nt, Human
gcuauuuucuaaagacuu

SEQ ID NO: 2671422 - RNA, 22 nt, Human
gcuauuuucuaaagacuuguau

SEQ ID NO: 2671423 - RNA, 15 nt, Human
gcucaaaaaaugagc

SEQ ID NO: 2671424 - RNA, 12 nt, Human
gcuauuuuugua

SEQ ID NO: 2671425 - RNA, 13 nt, Human
gcuauuuuuguaa

SEQ ID NO: 2671426 - RNA, 15 nt, Human
gcuauuuuuguaaag

SEQ ID NO: 2671427 - RNA, 16 nt, Human
gcuauuuuuguaaagu

SEQ ID NO: 2671428 - RNA, 20 nt, Human
gcuauuuuuguaaaguuucc

SEQ ID NO: 2671429 - RNA, 17 nt, Human
gcucacucacagaguca

SEQ ID NO: 2671430 - RNA, 18 nt, Human
gcucacucacagagucaa

SEQ ID NO: 2671431 - RNA, 17 nt, Human
gcucugggauccugggg

SEQ ID NO: 2671432 - RNA, 23 nt, Human
gcuggagggaggcgggggcugcc

SEQ ID NO: 2671433 - RNA, 15 nt, Human
gcuggagucuccuga

SEQ ID NO: 2671434 - RNA, 16 nt, Human
gcuggagucuccugag

SEQ ID NO: 2671435 - RNA, 19 nt, Human
gcuggccuuuguaagugca

SEQ ID NO: 2671436 - RNA, 21 nt, Human
gcuggccuuuguaagugcagg

SEQ ID NO: 2671437 - RNA, 20 nt, Human
gcuggcgagagucuggcccu

SEQ ID NO: 2671438 - RNA, 17 nt, Human
gcuggcgagagucuggc

SEQ ID NO: 2671439 - RNA, 15 nt, Human
gcuggcgagagucug

SEQ ID NO: 2671440 - RNA, 23 nt, Human
gcuggguggcaccagcagccugg

SEQ ID NO: 2671441 - RNA, 22 nt, Human
gcuggguggcaccagcagccug

SEQ ID NO: 2671442 - RNA, 21 nt, Human
gcuggguggcaccagcagccu

SEQ ID NO: 2671443 - RNA, 12 nt, Human
gcuggcucugag

SEQ ID NO: 2671444 - RNA, 13 nt, Human
gcuggcuccugau

SEQ ID NO: 2671445 - RNA, 14 nt, Human
gcuggcuccugauc

SEQ ID NO: 2671446 - RNA, 21 nt, Human
gcuggcuccugauccacuuug

SEQ ID NO: 2671447 - RNA, 17 nt, Human
gcugggcggcugugcuu

SEQ ID NO: 2671448 - RNA, 17 nt, Human
gcugggccgggacccag

SEQ ID NO: 2671449 - RNA, 20 nt, Human
gcugggcccgacauggcucc

SEQ ID NO: 2671450 - RNA, 21 nt, Human
gcugggcccgacauggcuccg

SEQ ID NO: 2671451 - RNA, 22 nt, Human
gcugggcccgacauggcuccgg

SEQ ID NO: 2671452 - RNA, 22 nt, Human
gcuuugagaagccuucagcucc

SEQ ID NO: 2671453 - RNA, 14 nt, Human
gcuuugagaagccu

SEQ ID NO: 2671454 - RNA, 16 nt, Human
gcuuugagaagccuuc

SEQ ID NO: 2671455 - RNA, 14 nt, Human
gcuuccucccaaca

SEQ ID NO: 2671456 - RNA, 20 nt, Human
gcuuccucccaacaagcagc

SEQ ID NO: 2671457 - RNA, 22 nt, Human
gcuuccucuagaagccaaggga

SEQ ID NO: 2671458 - RNA, 23 nt, Human
gcuuccucuagaagccaagggaa

SEQ ID NO: 2671459 - RNA, 15 nt, Human
gcuuccucuagaagc

SEQ ID NO: 2671460 - RNA, 17 nt, Human
gcuuccucuagaagcca

SEQ ID NO: 2671461 - RNA, 20 nt, Human
gcuuccucuagaagccaagg

SEQ ID NO: 2671462 - RNA, 12 nt, Human
gcuuccuccugg

SEQ ID NO: 2671463 - RNA, 13 nt, Human
gcuuccuccugga

SEQ ID NO: 2671464 - RNA, 16 nt, Human
gcuuccuccuggaaau

SEQ ID NO: 2671465 - RNA, 16 nt, Human
gcuuugaauaaaugug

SEQ ID NO: 2671466 - RNA, 17 nt, Human
gcuuugaauaaaugugu

SEQ ID NO: 2671467 - RNA, 20 nt, Human
gcuugucuauacuccuuccc

SEQ ID NO: 2671468 - RNA, 18 nt, Human
gcuugugaaaauguguuc

SEQ ID NO: 2671469 - RNA, 13 nt, Human
gcuuguaguucuu

SEQ ID NO: 2671470 - RNA, 17 nt, Human
gcuuguaguucuuuaaa

SEQ ID NO: 2671471 - RNA, 16 nt, Human
gcuuguaguucuuuaa

SEQ ID NO: 2671472 - RNA, 12 nt, Human
gcuugagccggg

SEQ ID NO: 2671473 - RNA, 12 nt, Human
gcuucuugccuc

SEQ ID NO: 2671474 - RNA, 13 nt, Human
gcuucuugccucu

SEQ ID NO: 2671475 - RNA, 14 nt, Human
gcuucuugccucug

SEQ ID NO: 2671476 - RNA, 15 nt, Human
gcuucuugccucugu

SEQ ID NO: 2671477 - RNA, 16 nt, Human
gcuucuugccucugug

SEQ ID NO: 2671478 - RNA, 17 nt, Human
gcuucuugccucugugc

SEQ ID NO: 2671479 - RNA, 18 nt, Human
gcuucuugccucugugcu

SEQ ID NO: 2671480 - RNA, 14 nt, Human
gcuugagcucagga

SEQ ID NO: 2671481 - RNA, 17 nt, Human
gcuugagccgggccccu

SEQ ID NO: 2671482 - RNA, 18 nt, Human
gcuugagccgggccccug

SEQ ID NO: 2671483 - RNA, 21 nt, Human
gcuugagccgggccccugggc

SEQ ID NO: 2671484 - RNA, 22 nt, Human
gcuugagccgggccccugggcu

SEQ ID NO: 2671485 - RNA, 18 nt, Human
gcuucacggaagagccuu

SEQ ID NO: 2671486 - RNA, 19 nt, Human
gcuucacggaagagccuug

SEQ ID NO: 2671487 - RNA, 15 nt, Human
gcuucacggaagagc

SEQ ID NO: 2671488 - RNA, 17 nt, Human
gcuucacggaagagccu

SEQ ID NO: 2671489 - RNA, 16 nt, Human
gcuuauuguuucucug

SEQ ID NO: 2671490 - RNA, 22 nt, Human
ggaagacaaugugaaaagaaaa

SEQ ID NO: 2671491 - RNA, 13 nt, Human
ggaagagaaaaaa

SEQ ID NO: 2671492 - RNA, 15 nt, Human
ggaagagaaaaaaua

SEQ ID NO: 2671493 - RNA, 20 nt, Human
ggaagcccauccugaccagc

SEQ ID NO: 2671494 - RNA, 13 nt, Human
ggaagccccacau

SEQ ID NO: 2671495 - RNA, 17 nt, Human
ggaagcccauccugacc

SEQ ID NO: 2671496 - RNA, 18 nt, Human
ggaagcccauccugacca

SEQ ID NO: 2671497 - RNA, 11 nt, Human
ggaaggaagcc

SEQ ID NO: 2671498 - RNA, 16 nt, Human
ggaaggagaaguaaga

SEQ ID NO: 2671499 - RNA, 14 nt, Human
ggaauaaaaggcuu

SEQ ID NO: 2671500 - RNA, 15 nt, Human
ggaauaaaaggcuug

SEQ ID NO: 2671501 - RNA, 17 nt, Human
ggaauaaaaggcuugaa

SEQ ID NO: 2671502 - RNA, 18 nt, Human
ggaauaaaaggcuugaag

SEQ ID NO: 2671503 - RNA, 22 nt, Human
ggaauaaaaggcuugaagcugu

SEQ ID NO: 2671504 - RNA, 21 nt, Human
ggaauaacuuuuacacgacca

SEQ ID NO: 2671505 - RNA, 20 nt, Human
ggaauccaagccuccacagc

SEQ ID NO: 2671506 - RNA, 21 nt, Human
ggaauccaagccuccacagcg

SEQ ID NO: 2671507 - RNA, 20 nt, Human
ggaaucccacuaaugcaaac

SEQ ID NO: 2671508 - RNA, 12 nt, Human
ggaauccuggca

SEQ ID NO: 2671509 - RNA, 13 nt, Human
ggaauccuggcag

SEQ ID NO: 2671510 - RNA, 21 nt, Human
ggaauccuggcagcccagaga

SEQ ID NO: 2671511 - RNA, 18 nt, Human
ggaaugaaaaaagcuuua

SEQ ID NO: 2671512 - RNA, 19 nt, Human
ggacagcuugagccgggcc

SEQ ID NO: 2671513 - RNA, 20 nt, Human
ggacacgcgcgucgccgcca

SEQ ID NO: 2671514 - RNA, 16 nt, Human
ggacccccguggggca

SEQ ID NO: 2671515 - RNA, 22 nt, Human
ggacccccguggggcagggagc

SEQ ID NO: 2671516 - RNA, 14 nt, Human
ggacggcggcagua

SEQ ID NO: 2671517 - RNA, 12 nt, Human
ggacggccaaga

SEQ ID NO: 2671518 - RNA, 17 nt, Human
ggacggccaagaaugua

SEQ ID NO: 2671519 - RNA, 16 nt, Human
ggacggguuagacagc

SEQ ID NO: 2671520 - RNA, 17 nt, Human
ggacggugcccaagcca

SEQ ID NO: 2671521 - RNA, 19 nt, Human
ggacggugcccaagccaga

SEQ ID NO: 2671522 - RNA, 21 nt, Human
ggacggugcccaagccagagg

SEQ ID NO: 2671523 - RNA, 17 nt, Human
ggacgucagacuuggcu

SEQ ID NO: 2671524 - RNA, 18 nt, Human
ggacccuuuuuguuauga

SEQ ID NO: 2671525 - RNA, 16 nt, Human
ggacccuuauaaaauc

SEQ ID NO: 2671526 - RNA, 22 nt, Human
ggacccugugacauggugccug

SEQ ID NO: 2671527 - RNA, 23 nt, Human
ggacccugugacauggugccuga

SEQ ID NO: 2671528 - RNA, 16 nt, Human
ggacccugugacaugg

SEQ ID NO: 2671529 - RNA, 19 nt, Human
ggacucaguggguuaacau

SEQ ID NO: 2671530 - RNA, 17 nt, Human
ggacucagccuucagac

SEQ ID NO: 2671531 - RNA, 15 nt, Human
ggacucagccuucag

SEQ ID NO: 2671532 - RNA, 21 nt, Human
ggacucagccuucagacagag

SEQ ID NO: 2671533 - RNA, 24 nt, Human
ggagaaagcuugguucugugaaca

SEQ ID NO: 2671534 - RNA, 12 nt, Human
ggcauaaaguaa

SEQ ID NO: 2671535 - RNA, 21 nt, Human
ggccaguccaggcugccgugg

SEQ ID NO: 2671536 - RNA, 16 nt, Human
ggcauagaggcuucuc

SEQ ID NO: 2671537 - RNA, 22 nt, Human
ggcauagaggcuucuccgccag

SEQ ID NO: 2671538 - RNA, 13 nt, Human
ggccagucugugg

SEQ ID NO: 2671539 - RNA, 14 nt, Human
ggccagucugugga

SEQ ID NO: 2671540 - RNA, 23 nt, Human
ggccagucuguggaucagagaug

SEQ ID NO: 2671541 - RNA, 15 nt, Human
ggccagucuguggau

SEQ ID NO: 2671542 - RNA, 18 nt, Human
ggccagucuguggaucag

SEQ ID NO: 2671543 - RNA, 19 nt, Human
ggccucagcucaaugcagu

SEQ ID NO: 2671544 - RNA, 13 nt, Human
ggcccuuugcugu

SEQ ID NO: 2671545 - RNA, 14 nt, Human
ggcccuuugcuguc

SEQ ID NO: 2671546 - RNA, 14 nt, Human
ggcaggggacagga

SEQ ID NO: 2671547 - RNA, 14 nt, Human
ggcaguuggccaga

SEQ ID NO: 2671548 - RNA, 12 nt, Human
ggacgugcuggg

SEQ ID NO: 2671549 - RNA, 12 nt, Human
ggagagacagcu

SEQ ID NO: 2671550 - RNA, 21 nt, Human
ggagacuuugaugucagcagu

SEQ ID NO: 2671551 - RNA, 19 nt, Human
ggagacuuugaugucagca

SEQ ID NO: 2671552 - RNA, 22 nt, Human
ggagacuugccagagccgggca

SEQ ID NO: 2671553 - RNA, 21 nt, Human
ggcacugccgccgcuagguag

SEQ ID NO: 2671554 - RNA, 21 nt, Human
ggcacuucauguaaaguguca

SEQ ID NO: 2671555 - RNA, 14 nt, Human
ggcacuugccuggg

SEQ ID NO: 2671556 - RNA, 15 nt, Human
ggcacuugccugggu

SEQ ID NO: 2671557 - RNA, 16 nt, Human
ggcacuugccuggguc

SEQ ID NO: 2671558 - RNA, 15 nt, Human
ggcucacugccaggc

SEQ ID NO: 2671559 - RNA, 16 nt, Human
ggcucacugccaggcc

SEQ ID NO: 2671560 - RNA, 18 nt, Human
ggcucacugccaggccag

SEQ ID NO: 2671561 - RNA, 19 nt, Human
ggcucacugccaggccagc

SEQ ID NO: 2671562 - RNA, 20 nt, Human
ggcucacugccaggccagcc

SEQ ID NO: 2671563 - RNA, 22 nt, Human
ggcucacugccaggccagccuc

SEQ ID NO: 2671564 - RNA, 21 nt, Human
ggcucacugccaggccagccu

SEQ ID NO: 2671565 - RNA, 12 nt, Human
ggcucagggugg

SEQ ID NO: 2671566 - RNA, 21 nt, Human
ggcucagcucggggagccuua

SEQ ID NO: 2671567 - RNA, 22 nt, Human
ggcugcggcguacaggcuggcg

SEQ ID NO: 2671568 - RNA, 21 nt, Human
ggcugcggcguacaggcuggc

SEQ ID NO: 2671569 - RNA, 19 nt, Human
ggcugcggcguacaggcug

SEQ ID NO: 2671570 - RNA, 23 nt, Human
ggcucuauuccaauaaacuauga

SEQ ID NO: 2671571 - RNA, 20 nt, Human
ggcugccucccuuguggcag

SEQ ID NO: 2671572 - RNA, 17 nt, Human
gggacaucacagggugg

SEQ ID NO: 2671573 - RNA, 18 nt, Human
gggacaucacaggguggg

SEQ ID NO: 2671574 - RNA, 22 nt, Human
gggacaucacagggugggccuc

SEQ ID NO: 2671575 - RNA, 16 nt, Human
gggaaccuccccagcc

SEQ ID NO: 2671576 - RNA, 19 nt, Human
gggaaccuccccagccugc

SEQ ID NO: 2671577 - RNA, 18 nt, Human
gggaaccuccccagccug

SEQ ID NO: 2671578 - RNA, 20 nt, Human
gggaaccuccccagccugcg

SEQ ID NO: 2671579 - RNA, 13 nt, Human
gggaaccuguguc

SEQ ID NO: 2671580 - RNA, 14 nt, Human
gggaaccugugucc

SEQ ID NO: 2671581 - RNA, 15 nt, Human
gggaaccuguguccg

SEQ ID NO: 2671582 - RNA, 18 nt, Human
gggaagaagcucucuccu

SEQ ID NO: 2671583 - RNA, 18 nt, Human
ggcuucugugaugagcug

SEQ ID NO: 2671584 - RNA, 21 nt, Human
ggcuucugugaugagcugauc

SEQ ID NO: 2671585 - RNA, 14 nt, Human
gggaacaugccccc

SEQ ID NO: 2671586 - RNA, 15 nt, Human
gggaacaugcccccu

SEQ ID NO: 2671587 - RNA, 16 nt, Human
ggcuucugugcccaga

SEQ ID NO: 2671588 - RNA, 19 nt, Human
ggcuggguggcaccagcag

SEQ ID NO: 2671589 - RNA, 18 nt, Human
aaaacugauugaaugaua

SEQ ID NO: 2671590 - RNA, 13 nt, Human
aaaacuucagaag

SEQ ID NO: 2671591 - RNA, 12 nt, Human
aaaacuguguug

SEQ ID NO: 2671592 - RNA, 17 nt, Human
aaaacuguguugccaca

SEQ ID NO: 2671593 - RNA, 12 nt, Human
aaaagauucuuc

SEQ ID NO: 2671594 - RNA, 13 nt, Human
aaaacugaaaaau

SEQ ID NO: 2671595 - RNA, 12 nt, Human
aaaacucuuuga

SEQ ID NO: 2671596 - RNA, 21 nt, Human
aaaacucuacuuaauccaaug

SEQ ID NO: 2671597 - RNA, 13 nt, Human
aaaaccuuuuacu

SEQ ID NO: 2671598 - RNA, 15 nt, Human
aaaaccuuuuacugg

SEQ ID NO: 2671599 - RNA, 23 nt, Human
aaaaccuuuuacugguugcaugg

SEQ ID NO: 2671600 - RNA, 19 nt, Human
gggaccacccugagccggc

SEQ ID NO: 2671601 - RNA, 17 nt, Human
gggaccacccugagccg

SEQ ID NO: 2671602 - RNA, 12 nt, Human
aaaacccaagug

SEQ ID NO: 2671603 - RNA, 18 nt, Human
aaaaccaccaaaaacaaa

SEQ ID NO: 2671604 - RNA, 22 nt, Human
aaaacaucauuccuuuuuauuu

SEQ ID NO: 2671605 - RNA, 15 nt, Human
gggaggucacuggaa

SEQ ID NO: 2671606 - RNA, 19 nt, Human
gggaggcugaggcaggaga

SEQ ID NO: 2671607 - RNA, 18 nt, Human
gggaggucaaggcugcag

SEQ ID NO: 2671608 - RNA, 13 nt, Human
gggaggcuucccc

SEQ ID NO: 2671609 - RNA, 22 nt, Human
gggagggauucugguuccaggg

SEQ ID NO: 2671610 - RNA, 15 nt, Human
gggagggggauccga

SEQ ID NO: 2671611 - RNA, 17 nt, Human
gggagagggaggucacu

SEQ ID NO: 2671612 - RNA, 22 nt, Human
gggagccaaaaucucaagaaau

SEQ ID NO: 2671613 - RNA, 11 nt, Human
gggagccagcc

SEQ ID NO: 2671614 - RNA, 19 nt, Human
gggagccaugcgcccccuc

SEQ ID NO: 2671615 - RNA, 16 nt, Human
gggagagccugcuggc

SEQ ID NO: 2671616 - RNA, 12 nt, Human
gggagagccugc

SEQ ID NO: 2671617 - RNA, 13 nt, Human
gggagagccugcu

SEQ ID NO: 2671618 - RNA, 10 nt, Human
aaaagcauuu

SEQ ID NO: 2671619 - RNA, 17 nt, Human
aaaagcauuuuucaaua

SEQ ID NO: 2671620 - RNA, 21 nt, Human
aaaagcauuuuucaauauauu

SEQ ID NO: 2671621 - RNA, 16 nt, Human
aaaagccuaaucacag

SEQ ID NO: 2671622 - RNA, 13 nt, Human
aaaaggaaagaaa

SEQ ID NO: 2671623 - RNA, 14 nt, Human
aaaaggaaagaaaa

SEQ ID NO: 2671624 - RNA, 17 nt, Human
guagaacuccaggcccu

SEQ ID NO: 2671625 - RNA, 16 nt, Human
guagaacugucuguga

SEQ ID NO: 2671626 - RNA, 15 nt, Human
guagaacuuuguaua

SEQ ID NO: 2671627 - RNA, 14 nt, Human
guagaacuuuguau

SEQ ID NO: 2671628 - RNA, 13 nt, Human
guagaacuuugua

SEQ ID NO: 2671629 - RNA, 14 nt, Human
guagaaaugaugau

SEQ ID NO: 2671630 - RNA, 21 nt, Human
guagaacuuuguauaguuaug

SEQ ID NO: 2671631 - RNA, 19 nt, Human
guagaccuuguuacuucug

SEQ ID NO: 2671632 - RNA, 20 nt, Human
guagaccuuguuacuucuga

SEQ ID NO: 2671633 - RNA, 21 nt, Human
guagaccuuguuacuucugag

SEQ ID NO: 2671634 - RNA, 22 nt, Human
guagaccuuguuacuucugagg

SEQ ID NO: 2671635 - RNA, 14 nt, Human
guagcccucccacu

SEQ ID NO: 2671636 - RNA, 15 nt, Human
guagcccucccacuu

SEQ ID NO: 2671637 - RNA, 17 nt, Human
guagcccucccacuuug

SEQ ID NO: 2671638 - RNA, 12 nt, Human
guagagccagcu

SEQ ID NO: 2671639 - RNA, 14 nt, Human
guagagccagcuug

SEQ ID NO: 2671640 - RNA, 23 nt, Human
guacuuaaaugguaauaagcacu

SEQ ID NO: 2671641 - RNA, 18 nt, Human
guacuguuacugggcccu

SEQ ID NO: 2671642 - RNA, 17 nt, Human
guacuguucggaagggg

SEQ ID NO: 2671643 - RNA, 22 nt, Human
guacuguucggaagggguuccu

SEQ ID NO: 2671644 - RNA, 12 nt, Human
guacugaauuuu

SEQ ID NO: 2671645 - RNA, 14 nt, Human
guacugaauuuuuu

SEQ ID NO: 2671646 - RNA, 18 nt, Human
guacugaauuuuuuugua

SEQ ID NO: 2671647 - RNA, 19 nt, Human
guacugaauuuuuuuguaa

SEQ ID NO: 2671648 - RNA, 20 nt, Human
guacugaauuuuuuuguaau

SEQ ID NO: 2671649 - RNA, 22 nt, Human
guacugaauuuuuuuguaauaa

SEQ ID NO: 2671650 - RNA, 21 nt, Human
guacucucaucacuacaguau

SEQ ID NO: 2671651 - RNA, 23 nt, Human
aaaucauaggcaccuuuuacugu

SEQ ID NO: 2671652 - RNA, 22 nt, Human
aaaucagagacaaaauauuucc

SEQ ID NO: 2671653 - RNA, 18 nt, Human
aaaucagccugcuccagc

SEQ ID NO: 2671654 - RNA, 12 nt, Human
aaaucagccugc

SEQ ID NO: 2671655 - RNA, 19 nt, Human
aaaucagccguguaaccau

SEQ ID NO: 2671656 - RNA, 19 nt, Human
aaauauuaggcuuaaaaac

SEQ ID NO: 2671657 - RNA, 14 nt, Human
aaauauuaagcaug

SEQ ID NO: 2671658 - RNA, 15 nt, Human
aaauauuaagcaugu

SEQ ID NO: 2671659 - RNA, 17 nt, Human
aaauauucacuggcccc

SEQ ID NO: 2671660 - RNA, 16 nt, Human
aaaucagagacaaaau

SEQ ID NO: 2671661 - RNA, 21 nt, Human
aaaucagccaaguuuuauaau

SEQ ID NO: 2671662 - RNA, 13 nt, Human
guaccaagugaaa

SEQ ID NO: 2671663 - RNA, 14 nt, Human
guacauuucuauaa

SEQ ID NO: 2671664 - RNA, 21 nt, Human
guacauuucuauaaauagaug

SEQ ID NO: 2671665 - RNA, 22 nt, Human
guacauuugggaguuuuuauga

SEQ ID NO: 2671666 - RNA, 14 nt, Human
guaccagcugcgcu

SEQ ID NO: 2671667 - RNA, 16 nt, Human
guaccagcugcgcuug

SEQ ID NO: 2671668 - RNA, 19 nt, Human
guaccagcugcgcuugcuu

SEQ ID NO: 2671669 - RNA, 17 nt, Human
guaccagcugcgcuugc

SEQ ID NO: 2671670 - RNA, 19 nt, Human
guaauuuaaaugaaagaaa

SEQ ID NO: 2671671 - RNA, 21 nt, Human
guaauuuaaaugaaagaaaau

SEQ ID NO: 2671672 - RNA, 23 nt, Human
guaauuuaaaugaaagaaaauug

SEQ ID NO: 2671673 - RNA, 21 nt, Human
guaauuuaaaauaauuauaua

SEQ ID NO: 2671674 - RNA, 21 nt, Human
guaauuucuuuuuuuccuuuu

SEQ ID NO: 2671675 - RNA, 13 nt, Human
guaauuugaagau

SEQ ID NO: 2671676 - RNA, 14 nt, Human
guaauuugaagauu

SEQ ID NO: 2671677 - RNA, 15 nt, Human
guaaucccagcacuu

SEQ ID NO: 2671678 - RNA, 15 nt, Human
guaaucauuuguuua

SEQ ID NO: 2671679 - RNA, 18 nt, Human
guaaucauuuguuuacau

SEQ ID NO: 2671680 - RNA, 15 nt, Human
guaauaaacuuuaau

SEQ ID NO: 2671681 - RNA, 12 nt, Human
guaacugucagg

SEQ ID NO: 2671682 - RNA, 23 nt, Human
guaacugucaggcugaaaacaau

SEQ ID NO: 2671683 - RNA, 13 nt, Human
guaacuguccugu

SEQ ID NO: 2671684 - RNA, 15 nt, Human
guaacuguccugucc

SEQ ID NO: 2671685 - RNA, 16 nt, Human
guaacuguccuguccu

SEQ ID NO: 2671686 - RNA, 17 nt, Human
guaacuguccuguccug

SEQ ID NO: 2671687 - RNA, 16 nt, Human
guaaacuuuuugugcu

SEQ ID NO: 2671688 - RNA, 16 nt, Human
guaaacuucugcaaca

SEQ ID NO: 2671689 - RNA, 17 nt, Human
guacacugccugccuua

SEQ ID NO: 2671690 - RNA, 13 nt, Human
guacacugccugc

SEQ ID NO: 2671691 - RNA, 10 nt, Human
guaauuuaaa

SEQ ID NO: 2671692 - RNA, 18 nt, Human
aaauacacauagcaugua

SEQ ID NO: 2671693 - RNA, 12 nt, Human
aaauacacauuu

SEQ ID NO: 2671694 - RNA, 13 nt, Human
aaauacacauuug

SEQ ID NO: 2671695 - RNA, 14 nt, Human
aaauacacauuugc

SEQ ID NO: 2671696 - RNA, 15 nt, Human
aaauacacauuugcu

SEQ ID NO: 2671697 - RNA, 22 nt, Human
aaauacacauuugcuacuguug

SEQ ID NO: 2671698 - RNA, 19 nt, Human
aaauacaacuuaaauaaua

SEQ ID NO: 2671699 - RNA, 12 nt, Human
aaauacaugaag

SEQ ID NO: 2671700 - RNA, 14 nt, Human
aaauacaugaagcu

SEQ ID NO: 2671701 - RNA, 20 nt, Human
aaauacaugaagcuucaugc

SEQ ID NO: 2671702 - RNA, 15 nt, Human
aaauacauagugaaa

SEQ ID NO: 2671703 - RNA, 17 nt, Human
aaauacauagugaaaau

SEQ ID NO: 2671704 - RNA, 15 nt, Human
aaauacaguacuguu

SEQ ID NO: 2671705 - RNA, 15 nt, Human
aaauacuauuuaaga

SEQ ID NO: 2671706 - RNA, 16 nt, Human
aaauacuauuuaagau

SEQ ID NO: 2671707 - RNA, 18 nt, Human
aaauacuauuuaagaugu

SEQ ID NO: 2671708 - RNA, 21 nt, Human
aaauacuauuuaagaugugaa

SEQ ID NO: 2671709 - RNA, 22 nt, Human
aaauacuauuuaagaugugaaa

SEQ ID NO: 2671710 - RNA, 19 nt, Human
aaauacaugcauauaauga

SEQ ID NO: 2671711 - RNA, 19 nt, Human
aaauacaugccacaucaaa

SEQ ID NO: 2671712 - RNA, 23 nt, Human
aaauacaugccacaucaaaccuu

SEQ ID NO: 2671713 - RNA, 18 nt, Human
aaauacauuguauauaug

SEQ ID NO: 2671714 - RNA, 16 nt, Human
aaaguaguccugugaa

SEQ ID NO: 2671715 - RNA, 20 nt, Human
aaagguauuauacaugugau

SEQ ID NO: 2671716 - RNA, 16 nt, Human
aaagguaaugugugga

SEQ ID NO: 2671717 - RNA, 12 nt, Human
aaaguagggggc

SEQ ID NO: 2671718 - RNA, 12 nt, Human
aaaguauucuuc

SEQ ID NO: 2671719 - RNA, 22 nt, Human
aaaguauucuucucuuccuuuu

SEQ ID NO: 2671720 - RNA, 20 nt, Human
aaauaacuggaacaaauuau

SEQ ID NO: 2671721 - RNA, 15 nt, Human
aaauaacccauaauu

SEQ ID NO: 2671722 - RNA, 12 nt, Human
aaauaacaguau

SEQ ID NO: 2671723 - RNA, 15 nt, Human
aaauaaaaacuaauu

SEQ ID NO: 2671724 - RNA, 14 nt, Human
aaauaagaaauaau

SEQ ID NO: 2671725 - RNA, 16 nt, Human
aaauaagaaauaaugc

SEQ ID NO: 2671726 - RNA, 20 nt, Human
aaauaagaacgaggauuuua

SEQ ID NO: 2671727 - RNA, 15 nt, Human
aaauaauaauaaugu

SEQ ID NO: 2671728 - RNA, 22 nt, Human
aaauaauucuuuuuuauuaauc

SEQ ID NO: 2671729 - RNA, 19 nt, Human
guaaacagccucuuuuuga

SEQ ID NO: 2671730 - RNA, 20 nt, Human
guaaacaguuuuuauuaaaa

SEQ ID NO: 2671731 - RNA, 12 nt, Human
guaaacauuuau

SEQ ID NO: 2671732 - RNA, 15 nt, Human
aaagagcccuugccu

SEQ ID NO: 2671733 - RNA, 14 nt, Human
aaagaugcuucuca

SEQ ID NO: 2671734 - RNA, 17 nt, Human
aaagaugcuucucacug

SEQ ID NO: 2671735 - RNA, 19 nt, Human
aaagaugcuucucacugcc

SEQ ID NO: 2671736 - RNA, 19 nt, Human
aaagaggcaccaggaagcc

SEQ ID NO: 2671737 - RNA, 18 nt, Human
aaagagcccuugccuccc

SEQ ID NO: 2671738 - RNA, 13 nt, Human
aaagacuggcuuu

SEQ ID NO: 2671739 - RNA, 21 nt, Human
aaagacuggcuuuuauuaaug

SEQ ID NO: 2671740 - RNA, 23 nt, Human
aaagacuggcuuuuauuaaugca

SEQ ID NO: 2671741 - RNA, 15 nt, Human
aaagacugguuuucu

SEQ ID NO: 2671742 - RNA, 16 nt, Human
aaagacugguuuucug

SEQ ID NO: 2671743 - RNA, 17 nt, Human
aaagacugguuuucugc

SEQ ID NO: 2671744 - RNA, 15 nt, Human
aaagacucuugggag

SEQ ID NO: 2671745 - RNA, 12 nt, Human
aaagacuggcuu

SEQ ID NO: 2671746 - RNA, 11 nt, Human
gguccuuccug

SEQ ID NO: 2671747 - RNA, 15 nt, Human
gguccuguccccgca

SEQ ID NO: 2671748 - RNA, 12 nt, Human
gguccugucccc

SEQ ID NO: 2671749 - RNA, 20 nt, Human
gguccugauuucuagaaccc

SEQ ID NO: 2671750 - RNA, 17 nt, Human
aaagcaauaaaugaaug

SEQ ID NO: 2671751 - RNA, 15 nt, Human
aaagcaauaaaugaa

SEQ ID NO: 2671752 - RNA, 12 nt, Human
aaagcaauagaa

SEQ ID NO: 2671753 - RNA, 13 nt, Human
aaagcaauagaaa

SEQ ID NO: 2671754 - RNA, 15 nt, Human
aaagcaauagaaaca

SEQ ID NO: 2671755 - RNA, 16 nt, Human
aaagcaauagaaacaa

SEQ ID NO: 2671756 - RNA, 18 nt, Human
aaagcaauauuuuggagu

SEQ ID NO: 2671757 - RNA, 13 nt, Human
aaagacacugccu

SEQ ID NO: 2671758 - RNA, 12 nt, Human
aaagacacugcc

SEQ ID NO: 2671759 - RNA, 12 nt, Human
aaacuuuucuag

SEQ ID NO: 2671760 - RNA, 13 nt, Human
aaacuuuucuaga

SEQ ID NO: 2671761 - RNA, 19 nt, Human
aaagacacugccugggcug

SEQ ID NO: 2671762 - RNA, 16 nt, Human
aaagacacugccuggg

SEQ ID NO: 2671763 - RNA, 17 nt, Human
aaagacacugccugggc

SEQ ID NO: 2671764 - RNA, 16 nt, Human
aaagacaguguaugua

SEQ ID NO: 2671765 - RNA, 22 nt, Human
aaagacaguguauguagaagca

SEQ ID NO: 2671766 - RNA, 22 nt, Human
aaagaccuggggcugcugugaa

SEQ ID NO: 2671767 - RNA, 22 nt, Human
aaagacccuccuauucuauaaa

SEQ ID NO: 2671768 - RNA, 13 nt, Human
aaacuuugggaaa

SEQ ID NO: 2671769 - RNA, 17 nt, Human
aaacuuugggaaaacau

SEQ ID NO: 2671770 - RNA, 20 nt, Human
aaacuuugggaaaacauguu

SEQ ID NO: 2671771 - RNA, 20 nt, Human
ggguggccacagcgccagcc

SEQ ID NO: 2671772 - RNA, 24 nt, Human
aaacuuggcucgaaucucugugcc

SEQ ID NO: 2671773 - RNA, 23 nt, Human
aaacuuggugacuugauccacua

SEQ ID NO: 2671774 - RNA, 13 nt, Human
aaagggauauuuu

SEQ ID NO: 2671775 - RNA, 15 nt, Human
aaaggggugcuuuua

SEQ ID NO: 2671776 - RNA, 15 nt, Human
aaaggaagcacucug

SEQ ID NO: 2671777 - RNA, 17 nt, Human
aaaggaacauugugucu

SEQ ID NO: 2671778 - RNA, 17 nt, Human
aaaggagagcuagcagc

SEQ ID NO: 2671779 - RNA, 21 nt, Human
aaaggagagcuagcagcaggg

SEQ ID NO: 2671780 - RNA, 22 nt, Human
gguggaucacgaggucaggaga

SEQ ID NO: 2671781 - RNA, 14 nt, Human
aaagcucugaccac

SEQ ID NO: 2671782 - RNA, 20 nt, Human
aaagcuccuggggcguccag

SEQ ID NO: 2671783 - RNA, 18 nt, Human
aaagcuauuuaugggccc

SEQ ID NO: 2671784 - RNA, 22 nt, Human
aaagcugcccacuguuucucuu

SEQ ID NO: 2671785 - RNA, 24 nt, Human
aaagcugcccacuguuucucuuga

SEQ ID NO: 2671786 - RNA, 11 nt, Human
ggugcagaggu

SEQ ID NO: 2671787 - RNA, 19 nt, Human
ggugcagagguacccuggg

SEQ ID NO: 2671788 - RNA, 22 nt, Human
ggugcagagguacccugggugu

SEQ ID NO: 2671789 - RNA, 15 nt, Human
ggugcugggaggagg

SEQ ID NO: 2671790 - RNA, 15 nt, Human
gguggaggcuuccug

SEQ ID NO: 2671791 - RNA, 20 nt, Human
gguggaaggguagagaggcg

SEQ ID NO: 2671792 - RNA, 21 nt, Human
ggugcuuuuauagaggcuagc

SEQ ID NO: 2671793 - RNA, 19 nt, Human
gguggaagaagggagaaga

SEQ ID NO: 2671794 - RNA, 20 nt, Human
ggugcugggaggagggagag

SEQ ID NO: 2671795 - RNA, 19 nt, Human
ggugcuuuuauagaggcua

SEQ ID NO: 2671796 - RNA, 13 nt, Human
ggucgaggcagga

SEQ ID NO: 2671797 - RNA, 13 nt, Human
aaacucaucugga

SEQ ID NO: 2671798 - RNA, 17 nt, Human
aaacucauauuacaaaa

SEQ ID NO: 2671799 - RNA, 22 nt, Human
aaacucauauuacaaaaacaaa

SEQ ID NO: 2671800 - RNA, 16 nt, Human
aaacucaucugaaaug

SEQ ID NO: 2671801 - RNA, 17 nt, Human
aaacucaucugaaaugu

SEQ ID NO: 2671802 - RNA, 13 nt, Human
aaacucacuguga

SEQ ID NO: 2671803 - RNA, 22 nt, Human
aaacucacugugaucaauauuu

SEQ ID NO: 2671804 - RNA, 17 nt, Human
aaacucaggcaaagaaa

SEQ ID NO: 2671805 - RNA, 19 nt, Human
aaacucaggcaaagaaaau

SEQ ID NO: 2671806 - RNA, 13 nt, Human
aaacucaaugcuu

SEQ ID NO: 2671807 - RNA, 14 nt, Human
aaacucaaugcuuu

SEQ ID NO: 2671808 - RNA, 18 nt, Human
aaacucaaugcuuuauuu

SEQ ID NO: 2671809 - RNA, 23 nt, Human
aaacucaaugcuuuauuuguaaa

SEQ ID NO: 2671810 - RNA, 14 nt, Human
aaacguccucuuua

SEQ ID NO: 2671811 - RNA, 23 nt, Human
aaacguccucuuuaguuuuuggu

SEQ ID NO: 2671812 - RNA, 18 nt, Human
aaacuauauuuugucaua

SEQ ID NO: 2671813 - RNA, 17 nt, Human
aaacuauauuuugucau

SEQ ID NO: 2671814 - RNA, 13 nt, Human
aaacuauaaaaca

SEQ ID NO: 2671815 - RNA, 17 nt, Human
aaacuauaaaacaaaaa

SEQ ID NO: 2671816 - RNA, 17 nt, Human
aaacgggaacaugcccc

SEQ ID NO: 2671817 - RNA, 19 nt, Human
aaacgggaacaugcccccu

SEQ ID NO: 2671818 - RNA, 20 nt, Human
aaacgggaacaugcccccug

SEQ ID NO: 2671819 - RNA, 21 nt, Human
aaacugucgugucauacucga

SEQ ID NO: 2671820 - RNA, 22 nt, Human
aaacugcuucccuuacuuugcu

SEQ ID NO: 2671821 - RNA, 20 nt, Human
aaacucuaucggagaacaug

SEQ ID NO: 2671822 - RNA, 22 nt, Human
aaacucuaucggagaacaugaa

SEQ ID NO: 2671823 - RNA, 14 nt, Human
aaacuguguugcca

SEQ ID NO: 2671824 - RNA, 15 nt, Human
aaacuguguugccac

SEQ ID NO: 2671825 - RNA, 16 nt, Human
aaacuguguugccaca

SEQ ID NO: 2671826 - RNA, 17 nt, Human
aaacuguguugccacag

SEQ ID NO: 2671827 - RNA, 19 nt, Human
ggguggcaccagcagccug

SEQ ID NO: 2671828 - RNA, 21 nt, Human
ggguggccgcugaguggcagg

SEQ ID NO: 2671829 - RNA, 17 nt, Human
ggguggccgcugagugg

SEQ ID NO: 2671830 - RNA, 23 nt, Human
aaaccaagucaagugaaaaagga

SEQ ID NO: 2671831 - RNA, 15 nt, Human
aaacgggcucagcaa

SEQ ID NO: 2671832 - RNA, 22 nt, Human
aaaccuuuuacugguugcaugg

SEQ ID NO: 2671833 - RNA, 23 nt, Human
gggucggaacccaagcuuagaac

SEQ ID NO: 2671834 - RNA, 14 nt, Human
gggucggcugacca

SEQ ID NO: 2671835 - RNA, 15 nt, Human
gggucggcugaccau

SEQ ID NO: 2671836 - RNA, 12 nt, Human
ggguccuuccug

SEQ ID NO: 2671837 - RNA, 17 nt, Human
gggucccuagcagccca

SEQ ID NO: 2671838 - RNA, 13 nt, Human
ggguccuuccuga

SEQ ID NO: 2671839 - RNA, 13 nt, Human
ggggguggaggcu

SEQ ID NO: 2671840 - RNA, 18 nt, Human
gggggucucacccaugca

SEQ ID NO: 2671841 - RNA, 21 nt, Human
ggggccuagcgaucucuccug

SEQ ID NO: 2671842 - RNA, 18 nt, Human
gggggcuagggagacgcc

SEQ ID NO: 2671843 - RNA, 12 nt, Human
gggggcuuucug

SEQ ID NO: 2671844 - RNA, 16 nt, Human
aaacauguuaaugaca

SEQ ID NO: 2671845 - RNA, 21 nt, Human
aaacauguuaaugacaauauu

SEQ ID NO: 2671846 - RNA, 19 nt, Human
ggggaagagauccaaagac

SEQ ID NO: 2671847 - RNA, 12 nt, Human
ggggaaucuaag

SEQ ID NO: 2671848 - RNA, 11 nt, Human
ggggacccugu

SEQ ID NO: 2671849 - RNA, 21 nt, Human
ggggacccaauguaggagcug

SEQ ID NO: 2671850 - RNA, 13 nt, Human
ggggacccagugc

SEQ ID NO: 2671851 - RNA, 15 nt, Human
ggggacccagugcag

SEQ ID NO: 2671852 - RNA, 21 nt, Human
ggggacccagugcagaaugua

SEQ ID NO: 2671853 - RNA, 16 nt, Human
ggggacgcuccgcugc

SEQ ID NO: 2671854 - RNA, 21 nt, Human
ggggccgggcgcgguggcuca

SEQ ID NO: 2671855 - RNA, 20 nt, Human
ggggccggcccugugugcag

SEQ ID NO: 2671856 - RNA, 23 nt, Human
ggggccuacagcuuugaucccug

SEQ ID NO: 2671857 - RNA, 19 nt, Human
aaacacaaacgggcucagc

SEQ ID NO: 2671858 - RNA, 18 nt, Human
aaacaauggaguauucuc

SEQ ID NO: 2671859 - RNA, 18 nt, Human
aaaauuuuguauguuaaa

SEQ ID NO: 2671860 - RNA, 21 nt, Human
aaaauuuuguauguuaaagag

SEQ ID NO: 2671861 - RNA, 22 nt, Human
aaaauuuuguauguuaaagaga

SEQ ID NO: 2671862 - RNA, 13 nt, Human
aaaauuuagaaca

SEQ ID NO: 2671863 - RNA, 22 nt, Human
aaaauuuaugguuuugguauuu

SEQ ID NO: 2671864 - RNA, 17 nt, Human
aaaauuuuaaaaaucua

SEQ ID NO: 2671865 - RNA, 12 nt, Human
aaaauguuuuaa

SEQ ID NO: 2671866 - RNA, 19 nt, Human
gacugucucacuuaauccu

SEQ ID NO: 2671867 - RNA, 16 nt, Human
gacuuucugccuggag

SEQ ID NO: 2671868 - RNA, 18 nt, Human
gacuguuuucucuugaga

SEQ ID NO: 2671869 - RNA, 16 nt, Human
gacuguuuucucuuga

SEQ ID NO: 2671870 - RNA, 22 nt, Human
gacuuugaugucagcaguugcu

SEQ ID NO: 2671871 - RNA, 18 nt, Human
gacuuugaugucagcagu

SEQ ID NO: 2671872 - RNA, 18 nt, Human
gacuuucugccuggagug

SEQ ID NO: 2671873 - RNA, 21 nt, Human
gacuuuucuguccgagcuuug

SEQ ID NO: 2671874 - RNA, 23 nt, Human
gacuuuucuguccgagcuuugaa

SEQ ID NO: 2671875 - RNA, 13 nt, Human
gacuuuucugcaa

SEQ ID NO: 2671876 - RNA, 14 nt, Human
gacuuuucugcaaa

SEQ ID NO: 2671877 - RNA, 15 nt, Human
gacuuuguagauccu

SEQ ID NO: 2671878 - RNA, 14 nt, Human
gacugguuuucugc

SEQ ID NO: 2671879 - RNA, 15 nt, Human
gacugguuuucugcc

SEQ ID NO: 2671880 - RNA, 16 nt, Human
gacugguuuucugcca

SEQ ID NO: 2671881 - RNA, 22 nt, Human
gacuguguauucuaguuuuguc

SEQ ID NO: 2671882 - RNA, 17 nt, Human
gagaagcggcuggcagc

SEQ ID NO: 2671883 - RNA, 16 nt, Human
gacuauauaauuuauu

SEQ ID NO: 2671884 - RNA, 18 nt, Human
gacuauauauauaaaugu

SEQ ID NO: 2671885 - RNA, 19 nt, Human
gacuauauauauaaaugua

SEQ ID NO: 2671886 - RNA, 20 nt, Human
gacuauauauauaaauguau

SEQ ID NO: 2671887 - RNA, 20 nt, Human
gacuaugcguggcuggaacc

SEQ ID NO: 2671888 - RNA, 18 nt, Human
gacccucuaaccucgccc

SEQ ID NO: 2671889 - RNA, 14 nt, Human
gacccucuaaccuc

SEQ ID NO: 2671890 - RNA, 14 nt, Human
gaagcaguggccuu

SEQ ID NO: 2671891 - RNA, 22 nt, Human
gaagcaguuguaccaagugaaa

SEQ ID NO: 2671892 - RNA, 15 nt, Human
gacacuccagggaca

SEQ ID NO: 2671893 - RNA, 21 nt, Human
gacacuccagggacacacagc

SEQ ID NO: 2671894 - RNA, 21 nt, Human
gacaguaucccacauccaacu

SEQ ID NO: 2671895 - RNA, 16 nt, Human
gacaguaucccacauc

SEQ ID NO: 2671896 - RNA, 18 nt, Human
gacaguaucccacaucca

SEQ ID NO: 2671897 - RNA, 15 nt, Human
gacaguaucccacau

SEQ ID NO: 2671898 - RNA, 19 nt, Human
gaccaggccauucugccgc

SEQ ID NO: 2671899 - RNA, 12 nt, Human
gaccaggauccc

SEQ ID NO: 2671900 - RNA, 20 nt, Human
gaccaggaucccaagccucc

SEQ ID NO: 2671901 - RNA, 21 nt, Human
gaccaggaucccaagccuccu

SEQ ID NO: 2671902 - RNA, 22 nt, Human
gaccaggaucccaagccuccug

SEQ ID NO: 2671903 - RNA, 15 nt, Human
gaccaggcugccucc

SEQ ID NO: 2671904 - RNA, 16 nt, Human
gacccuauugcugcuu

SEQ ID NO: 2671905 - RNA, 15 nt, Human
gacccgaccuggccg

SEQ ID NO: 2671906 - RNA, 16 nt, Human
gacccgaccuggccgc

SEQ ID NO: 2671907 - RNA, 12 nt, Human
gaccauguggcc

SEQ ID NO: 2671908 - RNA, 14 nt, Human
gaccauguggccac

SEQ ID NO: 2671909 - RNA, 21 nt, Human
gaccaugcucaucugcugguc

SEQ ID NO: 2671910 - RNA, 22 nt, Human
gaccaugcucaucugcuggucc

SEQ ID NO: 2671911 - RNA, 19 nt, Human
gagguggaggcugcaguga

SEQ ID NO: 2671912 - RNA, 16 nt, Human
gagguggagggaggga

SEQ ID NO: 2671913 - RNA, 18 nt, Human
gagguggagggagggaag

SEQ ID NO: 2671914 - RNA, 19 nt, Human
gagugccgcaucucacagc

SEQ ID NO: 2671915 - RNA, 21 nt, Human
gaggccagaggcccccagccc

SEQ ID NO: 2671916 - RNA, 21 nt, Human
gagggcuuccucuagaagcca

SEQ ID NO: 2671917 - RNA, 19 nt, Human
gagggcuuccucuagaagc

SEQ ID NO: 2671918 - RNA, 22 nt, Human
gagggcuuccucuagaagccaa

SEQ ID NO: 2671919 - RNA, 19 nt, Human
gagggcggcaggggccugg

SEQ ID NO: 2671920 - RNA, 23 nt, Human
gagggcggcaggggccuggagau

SEQ ID NO: 2671921 - RNA, 13 nt, Human
gagggcggcaggg

SEQ ID NO: 2671922 - RNA, 14 nt, Human
gaggcugccccucu

SEQ ID NO: 2671923 - RNA, 15 nt, Human
gaggcugccccucuc

SEQ ID NO: 2671924 - RNA, 18 nt, Human
gaggcugccccucucacc

SEQ ID NO: 2671925 - RNA, 19 nt, Human
gaggcugccccucucacca

SEQ ID NO: 2671926 - RNA, 12 nt, Human
gagaagcugcag

SEQ ID NO: 2671927 - RNA, 13 nt, Human
gagaagcugcagg

SEQ ID NO: 2671928 - RNA, 14 nt, Human
gagaagcugcaucc

SEQ ID NO: 2671929 - RNA, 17 nt, Human
gagcgcgccccuagccg

SEQ ID NO: 2671930 - RNA, 16 nt, Human
gagcgcgccccuagcc

SEQ ID NO: 2671931 - RNA, 22 nt, Human
gagcccuacucccugcagaugc

SEQ ID NO: 2671932 - RNA, 21 nt, Human
gagcccuaaccccuuccagau

SEQ ID NO: 2671933 - RNA, 17 nt, Human
gagcccuacucccugca

SEQ ID NO: 2671934 - RNA, 18 nt, Human
gagcccuacucccugcag

SEQ ID NO: 2671935 - RNA, 19 nt, Human
gagcccuacucccugcaga

SEQ ID NO: 2671936 - RNA, 16 nt, Human
gagcccuaaccccuuc

SEQ ID NO: 2671937 - RNA, 18 nt, Human
gagcccuaaccccuucca

SEQ ID NO: 2671938 - RNA, 19 nt, Human
gagcccuaaccccuuccag

SEQ ID NO: 2671939 - RNA, 20 nt, Human
gagcccuaaccccuuccaga

SEQ ID NO: 2671940 - RNA, 14 nt, Human
gagccuuaaaacau

SEQ ID NO: 2671941 - RNA, 19 nt, Human
gagccuuagccgcccaugc

SEQ ID NO: 2671942 - RNA, 14 nt, Human
gcaggcuccccuga

SEQ ID NO: 2671943 - RNA, 16 nt, Human
gcaggcuccccugagg

SEQ ID NO: 2671944 - RNA, 22 nt, Human
gcaggcuggccaguccaggcug

SEQ ID NO: 2671945 - RNA, 18 nt, Human
gcagggaagccccacaug

SEQ ID NO: 2671946 - RNA, 23 nt, Human
gcagggaagccccacauguccag

SEQ ID NO: 2671947 - RNA, 12 nt, Human
gcaggcuggcca

SEQ ID NO: 2671948 - RNA, 14 nt, Human
gcaggcuggccagu

SEQ ID NO: 2671949 - RNA, 19 nt, Human
gcagcuuauaaugggcucu

SEQ ID NO: 2671950 - RNA, 23 nt, Human
gcagcuuauaaugggcucuccgg

SEQ ID NO: 2671951 - RNA, 15 nt, Human
gcagcugucccuugc

SEQ ID NO: 2671952 - RNA, 22 nt, Human
gcagcugucccuugcuugccug

SEQ ID NO: 2671953 - RNA, 23 nt, Human
gcagcugcuauccccaucucccu

SEQ ID NO: 2671954 - RNA, 22 nt, Human
gcagcugcuauuuauuuuccua

SEQ ID NO: 2671955 - RNA, 20 nt, Human
gcacuuucuauccucuguaa

SEQ ID NO: 2671956 - RNA, 18 nt, Human
gcacucuuguucccacac

SEQ ID NO: 2671957 - RNA, 16 nt, Human
gcacucuuaagcuucc

SEQ ID NO: 2671958 - RNA, 22 nt, Human
gcacuuugggaggccgaggcgg

SEQ ID NO: 2671959 - RNA, 17 nt, Human
gcacucuguauauuuga

SEQ ID NO: 2671960 - RNA, 15 nt, Human
gcauaaauugcauca

SEQ ID NO: 2671961 - RNA, 16 nt, Human
gcauaauuuaaaaaua

SEQ ID NO: 2671962 - RNA, 17 nt, Human
gcauaauuuaaaaauau

SEQ ID NO: 2671963 - RNA, 19 nt, Human
gcauaauuuaaaaauauau

SEQ ID NO: 2671964 - RNA, 20 nt, Human
gcauaauuuaaaaauauauu

SEQ ID NO: 2671965 - RNA, 15 nt, Human
gcauaaaaauuagcc

SEQ ID NO: 2671966 - RNA, 13 nt, Human
gcauaaaguaaau

SEQ ID NO: 2671967 - RNA, 16 nt, Human
gcauaaaguaaauaca

SEQ ID NO: 2671968 - RNA, 13 nt, Human
gcagcuuauuguu

SEQ ID NO: 2671969 - RNA, 21 nt, Human
gcaugucagacagaacuugaa

SEQ ID NO: 2671970 - RNA, 20 nt, Human
gcaugucaaacaugagaugu

SEQ ID NO: 2671971 - RNA, 21 nt, Human
gcaugucaaacaugagaugug

SEQ ID NO: 2671972 - RNA, 14 nt, Human
gcaugucaaacaug

SEQ ID NO: 2671973 - RNA, 14 nt, Human
gcaugucuuuuaaa

SEQ ID NO: 2671974 - RNA, 15 nt, Human
gcaugucuuuuaaaa

SEQ ID NO: 2671975 - RNA, 17 nt, Human
gcaugucuuuuaaaaug

SEQ ID NO: 2671976 - RNA, 22 nt, Human
gcauuguaagcguauggcuuua

SEQ ID NO: 2671977 - RNA, 21 nt, Human
gcauuguaagcguauggcuuu

SEQ ID NO: 2671978 - RNA, 12 nt, Human
gcauuguaagcg

SEQ ID NO: 2671979 - RNA, 18 nt, Human
gcauguagaggcuuguuu

SEQ ID NO: 2671980 - RNA, 20 nt, Human
gcauguagaggcuuguuuac

SEQ ID NO: 2671981 - RNA, 16 nt, Human
gcauccugugccacua

SEQ ID NO: 2671982 - RNA, 18 nt, Human
gcaucgcaccauucugac

SEQ ID NO: 2671983 - RNA, 15 nt, Human
gcaucggccuagggc

SEQ ID NO: 2671984 - RNA, 20 nt, Human
gcaucgcaccauucugacuc

SEQ ID NO: 2671985 - RNA, 14 nt, Human
gcaucggccuaggg

SEQ ID NO: 2671986 - RNA, 13 nt, Human
gcauuuaaaaaaa

SEQ ID NO: 2671987 - RNA, 23 nt, Human
gcauuuagggaguauucuaauaa

SEQ ID NO: 2671988 - RNA, 22 nt, Human
gcauuuagggaguauucuaaua

SEQ ID NO: 2671989 - RNA, 15 nt, Human
gccaagaauauugca

SEQ ID NO: 2671990 - RNA, 16 nt, Human
gccaagaauauugcaa

SEQ ID NO: 2671991 - RNA, 18 nt, Human
gccaagaauauugcaaaa

SEQ ID NO: 2671992 - RNA, 19 nt, Human
gccaagaauauugcaaaau

SEQ ID NO: 2671993 - RNA, 23 nt, Human
gccaagaauauugcaaaauacau

SEQ ID NO: 2671994 - RNA, 12 nt, Human
gccaagaaugua

SEQ ID NO: 2671995 - RNA, 13 nt, Human
gccaagaauguac

SEQ ID NO: 2671996 - RNA, 19 nt, Human
gccaagaagcaguggccuu

SEQ ID NO: 2671997 - RNA, 20 nt, Human
gccaagaagcaguggccuua

SEQ ID NO: 2671998 - RNA, 15 nt, Human
gccaagaagcagugg

SEQ ID NO: 2671999 - RNA, 16 nt, Human
gccaagaagcaguggc

SEQ ID NO: 2672000 - RNA, 16 nt, Human
gccaagcuccaagccc

SEQ ID NO: 2672001 - RNA, 15 nt, Human
gccaagauuuuccuc

SEQ ID NO: 2672002 - RNA, 23 nt, Human
gccaagauuuuccucuugugauu

SEQ ID NO: 2672003 - RNA, 16 nt, Human
gaugcugugcuaugaa

SEQ ID NO: 2672004 - RNA, 17 nt, Human
gaugcuguguauauggu

SEQ ID NO: 2672005 - RNA, 23 nt, Human
gaugcuucucacugccaugccag

SEQ ID NO: 2672006 - RNA, 14 nt, Human
gaugaugcugccag

SEQ ID NO: 2672007 - RNA, 23 nt, Human
gaugcuuuguuucuuucauauga

SEQ ID NO: 2672008 - RNA, 19 nt, Human
gaugucagcaguugcuggu

SEQ ID NO: 2672009 - RNA, 17 nt, Human
gaugucagcaguugcug

SEQ ID NO: 2672010 - RNA, 16 nt, Human
gaugugcaaaaccuuu

SEQ ID NO: 2672011 - RNA, 20 nt, Human
gaugugcaaaaccuuuuacu

SEQ ID NO: 2672012 - RNA, 18 nt, Human
gcaaaaaaaaaaaaaagc

SEQ ID NO: 2672013 - RNA, 15 nt, Human
gauuucagaagccua

SEQ ID NO: 2672014 - RNA, 13 nt, Human
gauuuaagguauu

SEQ ID NO: 2672015 - RNA, 15 nt, Human
gauuuaagguauuua

SEQ ID NO: 2672016 - RNA, 20 nt, Human
gauucuuucaguucuuugga

SEQ ID NO: 2672017 - RNA, 16 nt, Human
gauucuucuguguuua

SEQ ID NO: 2672018 - RNA, 20 nt, Human
gauucuucuguguuuauaaa

SEQ ID NO: 2672019 - RNA, 22 nt, Human
gauucugguuccagggucccuc

SEQ ID NO: 2672020 - RNA, 10 nt, Human
gcaauagaaa

SEQ ID NO: 2672021 - RNA, 12 nt, Human
gcaauagaaaca

SEQ ID NO: 2672022 - RNA, 13 nt, Human
gcaauagaaacaa

SEQ ID NO: 2672023 - RNA, 13 nt, Human
gcaauaccaagua

SEQ ID NO: 2672024 - RNA, 12 nt, Human
gcaauaaaauuu

SEQ ID NO: 2672025 - RNA, 13 nt, Human
gcaauaaaauuua

SEQ ID NO: 2672026 - RNA, 14 nt, Human
gcaauaaaauuuaa

SEQ ID NO: 2672027 - RNA, 15 nt, Human
gcaauaaaauuuaaa

SEQ ID NO: 2672028 - RNA, 19 nt, Human
gcaauaaaauuuaaaaaau

SEQ ID NO: 2672029 - RNA, 21 nt, Human
gcaauaaaauuuaaaaaauaa

SEQ ID NO: 2672030 - RNA, 18 nt, Human
gcaaguuuccaucaucua

SEQ ID NO: 2672031 - RNA, 15 nt, Human
gcaaaagaugcuucu

SEQ ID NO: 2672032 - RNA, 17 nt, Human
gcaaaacucuacuuaau

SEQ ID NO: 2672033 - RNA, 22 nt, Human
gcaaaacucuacuuaauccaau

SEQ ID NO: 2672034 - RNA, 23 nt, Human
gcaaaacucuacuuaauccaaug

SEQ ID NO: 2672035 - RNA, 15 nt, Human
gcaaaaccuuuuacu

SEQ ID NO: 2672036 - RNA, 16 nt, Human
gcaaaaccuuuuacug

SEQ ID NO: 2672037 - RNA, 17 nt, Human
gcaaaaccuuuuacugg

SEQ ID NO: 2672038 - RNA, 16 nt, Human
gcaaaagaugcuucuc

SEQ ID NO: 2672039 - RNA, 14 nt, Human
gcaaccuacccagc

SEQ ID NO: 2672040 - RNA, 18 nt, Human
gcaaccuacccagcgugg

SEQ ID NO: 2672041 - RNA, 22 nt, Human
gcacucuggaugauggauucca

SEQ ID NO: 2672042 - RNA, 17 nt, Human
gcacuccagccugggug

SEQ ID NO: 2672043 - RNA, 17 nt, Human
gcacuccagccuggggg

SEQ ID NO: 2672044 - RNA, 19 nt, Human
gcacuccagccugggggac

SEQ ID NO: 2672045 - RNA, 15 nt, Human
gcacuccagccuggg

SEQ ID NO: 2672046 - RNA, 18 nt, Human
gcaccucagccugcacag

SEQ ID NO: 2672047 - RNA, 15 nt, Human
cuugaaugugucagg

SEQ ID NO: 2672048 - RNA, 17 nt, Human
cuugauguuuggggucu

SEQ ID NO: 2672049 - RNA, 15 nt, Human
cuugauucagucaca

SEQ ID NO: 2672050 - RNA, 16 nt, Human
cuugauucagucacau

SEQ ID NO: 2672051 - RNA, 14 nt, Human
cuuggccuugggcu

SEQ ID NO: 2672052 - RNA, 14 nt, Human
cuuggccugggccg

SEQ ID NO: 2672053 - RNA, 13 nt, Human
cuuggccugggcc

SEQ ID NO: 2672054 - RNA, 12 nt, Human
cuuggccugggc

SEQ ID NO: 2672055 - RNA, 12 nt, Human
cuuggccugcug

SEQ ID NO: 2672056 - RNA, 13 nt, Human
cuuggccugcugu

SEQ ID NO: 2672057 - RNA, 15 nt, Human
cuuggccugcuguga

SEQ ID NO: 2672058 - RNA, 16 nt, Human
cuuggccugcugugau

SEQ ID NO: 2672059 - RNA, 21 nt, Human
cuuggcaauaaauuuugaaaa

SEQ ID NO: 2672060 - RNA, 20 nt, Human
cuuggcaauaaauuuugaaa

SEQ ID NO: 2672061 - RNA, 22 nt, Human
cuucucuuccuuuuaucaguag

SEQ ID NO: 2672062 - RNA, 18 nt, Human
cuuccucuagaagccaag

SEQ ID NO: 2672063 - RNA, 15 nt, Human
cuuccucucuccaga

SEQ ID NO: 2672064 - RNA, 19 nt, Human
cuuccucuagaagccaagg

SEQ ID NO: 2672065 - RNA, 16 nt, Human
cuuccucucuccagau

SEQ ID NO: 2672066 - RNA, 17 nt, Human
cuuccugaaacuauauu

SEQ ID NO: 2672067 - RNA, 19 nt, Human
cuuccugaaacuauauuuu

SEQ ID NO: 2672068 - RNA, 18 nt, Human
cuuccugaaacuauauuu

SEQ ID NO: 2672069 - RNA, 23 nt, Human
cuucuaaauggcaaaggaaggug

SEQ ID NO: 2672070 - RNA, 16 nt, Human
cuucuagucuuggcca

SEQ ID NO: 2672071 - RNA, 18 nt, Human
cuucuagugaugaugguu

SEQ ID NO: 2672072 - RNA, 13 nt, Human
cuucucuuagauu

SEQ ID NO: 2672073 - RNA, 14 nt, Human
cuucucugugagaa

SEQ ID NO: 2672074 - RNA, 15 nt, Human
cuucucugugagaag

SEQ ID NO: 2672075 - RNA, 18 nt, Human
cuucucugugagaagguu

SEQ ID NO: 2672076 - RNA, 18 nt, Human
cuuucucaaagaaauauu

SEQ ID NO: 2672077 - RNA, 20 nt, Human
cuuucucaaagaaauauuaa

SEQ ID NO: 2672078 - RNA, 22 nt, Human
cuuugagaagccuucagcucca

SEQ ID NO: 2672079 - RNA, 15 nt, Human
cuuugagaagccuuc

SEQ ID NO: 2672080 - RNA, 17 nt, Human
cuuugagaagccuucag

SEQ ID NO: 2672081 - RNA, 19 nt, Human
cuuugagaagccuucagcu

SEQ ID NO: 2672082 - RNA, 11 nt, Human
cuuugguuuuu

SEQ ID NO: 2672083 - RNA, 17 nt, Human
cuuugguuuuuuucuuc

SEQ ID NO: 2672084 - RNA, 19 nt, Human
cuuugguuuuuuucuucug

SEQ ID NO: 2672085 - RNA, 21 nt, Human
cuuugguucuggccagaaugc

SEQ ID NO: 2672086 - RNA, 19 nt, Human
cuuugguucuggccagaau

SEQ ID NO: 2672087 - RNA, 14 nt, Human
cuuugguucuggcc

SEQ ID NO: 2672088 - RNA, 13 nt, Human
cuuuuauaaagca

SEQ ID NO: 2672089 - RNA, 14 nt, Human
cuuuuauaaagcau

SEQ ID NO: 2672090 - RNA, 16 nt, Human
cuuuuauaaagcaugu

SEQ ID NO: 2672091 - RNA, 19 nt, Human
cuuucacggaaacucccga

SEQ ID NO: 2672092 - RNA, 14 nt, Human
cuugugccuggggu

SEQ ID NO: 2672093 - RNA, 18 nt, Human
cuuuacccaccuagaaca

SEQ ID NO: 2672094 - RNA, 19 nt, Human
cuuuacccaccuagaacac

SEQ ID NO: 2672095 - RNA, 17 nt, Human
cuuuacccaccuagaac

SEQ ID NO: 2672096 - RNA, 20 nt, Human
cuugggguuuucaguaugaa

SEQ ID NO: 2672097 - RNA, 12 nt, Human
cuugguguaauu

SEQ ID NO: 2672098 - RNA, 13 nt, Human
cuugguguaauuu

SEQ ID NO: 2672099 - RNA, 16 nt, Human
cuugguguaauuugaa

SEQ ID NO: 2672100 - RNA, 18 nt, Human
cuugguguaauuugaaga

SEQ ID NO: 2672101 - RNA, 16 nt, Human
cuugugaaaauguguu

SEQ ID NO: 2672102 - RNA, 13 nt, Human
cuugugaaaaugu

SEQ ID NO: 2672103 - RNA, 14 nt, Human
cuugugaaaaugug

SEQ ID NO: 2672104 - RNA, 18 nt, Human
cuugugaaaauguguucu

SEQ ID NO: 2672105 - RNA, 20 nt, Human
gaacccgggagcggagguug

SEQ ID NO: 2672106 - RNA, 13 nt, Human
gaacucuggcuuu

SEQ ID NO: 2672107 - RNA, 17 nt, Human
gaacucuucucauuacu

SEQ ID NO: 2672108 - RNA, 14 nt, Human
gaacucuucucauu

SEQ ID NO: 2672109 - RNA, 22 nt, Human
gaacugaaaggcuuuucaacca

SEQ ID NO: 2672110 - RNA, 19 nt, Human
gaacucuucucauuacuug

SEQ ID NO: 2672111 - RNA, 12 nt, Human
gaacugcaggcc

SEQ ID NO: 2672112 - RNA, 14 nt, Human
gaacugcaggcccu

SEQ ID NO: 2672113 - RNA, 16 nt, Human
gaacugcaggcccugg

SEQ ID NO: 2672114 - RNA, 17 nt, Human
gaacugcaggcccuggc

SEQ ID NO: 2672115 - RNA, 18 nt, Human
gaacugcaggcccuggcc

SEQ ID NO: 2672116 - RNA, 19 nt, Human
gaacugcaggcccuggccu

SEQ ID NO: 2672117 - RNA, 21 nt, Human
gaacugcaggcccuggccucc

SEQ ID NO: 2672118 - RNA, 23 nt, Human
gaacugcaggcccuggccucccc

SEQ ID NO: 2672119 - RNA, 18 nt, Human
gaaccauggugaagugcu

SEQ ID NO: 2672120 - RNA, 14 nt, Human
gaaccauaaaaugu

SEQ ID NO: 2672121 - RNA, 19 nt, Human
gaaccauaaaauguccagu

SEQ ID NO: 2672122 - RNA, 18 nt, Human
gaaccauaaaauguccag

SEQ ID NO: 2672123 - RNA, 13 nt, Human
gaaccauaaauuc

SEQ ID NO: 2672124 - RNA, 15 nt, Human
gaaccauaaauucaa

SEQ ID NO: 2672125 - RNA, 14 nt, Human
gaaccacuuguaga

SEQ ID NO: 2672126 - RNA, 13 nt, Human
gaaccacuuguag

SEQ ID NO: 2672127 - RNA, 18 nt, Human
gaaccacuuguagauuug

SEQ ID NO: 2672128 - RNA, 15 nt, Human
gaaccacuuguagau

SEQ ID NO: 2672129 - RNA, 20 nt, Human
gaaccacuuguagauuugau

SEQ ID NO: 2672130 - RNA, 20 nt, Human
gaagaccucaccuagaaauu

SEQ ID NO: 2672131 - RNA, 17 nt, Human
gaagacccucuugccca

SEQ ID NO: 2672132 - RNA, 23 nt, Human
gaagacccucuugcccauccuga

SEQ ID NO: 2672133 - RNA, 19 nt, Human
gaagaccucaccuagaaau

SEQ ID NO: 2672134 - RNA, 12 nt, Human
gaagcagccucu

SEQ ID NO: 2672135 - RNA, 22 nt, Human
gaagcagccucuccccaggucc

SEQ ID NO: 2672136 - RNA, 20 nt, Human
gaagcacuacaccuugccuu

SEQ ID NO: 2672137 - RNA, 21 nt, Human
gaagcacuacaccuugccuug

SEQ ID NO: 2672138 - RNA, 16 nt, Human
gaagcaccauaacuuu

SEQ ID NO: 2672139 - RNA, 15 nt, Human
gaagcacagaauauu

SEQ ID NO: 2672140 - RNA, 17 nt, Human
gaagcacagaauauuuu

SEQ ID NO: 2672141 - RNA, 21 nt, Human
gaaaggggagagccugcuggc

SEQ ID NO: 2672142 - RNA, 17 nt, Human
gaaauccggagaagcug

SEQ ID NO: 2672143 - RNA, 18 nt, Human
gaaaggggagagccugcu

SEQ ID NO: 2672144 - RNA, 20 nt, Human
gaaaggggagagccugcugg

SEQ ID NO: 2672145 - RNA, 15 nt, Human
gaaaggggagagccu

SEQ ID NO: 2672146 - RNA, 20 nt, Human
gaaaugaaaacaguguguaa

SEQ ID NO: 2672147 - RNA, 23 nt, Human
gaaaugaaaacaguguguaaaca

SEQ ID NO: 2672148 - RNA, 14 nt, Human
gaacacacacauau

SEQ ID NO: 2672149 - RNA, 16 nt, Human
gaacacacacauauac

SEQ ID NO: 2672150 - RNA, 17 nt, Human
gaacacacacauauaca

SEQ ID NO: 2672151 - RNA, 16 nt, Human
gaacaauauuuuaugg

SEQ ID NO: 2672152 - RNA, 12 nt, Human
gaacaaugaagu

SEQ ID NO: 2672153 - RNA, 14 nt, Human
gaacaaauuauuuu

SEQ ID NO: 2672154 - RNA, 21 nt, Human
gaacaaguugagcuaugacuu

SEQ ID NO: 2672155 - RNA, 20 nt, Human
gaacaaguugagcuaugacu

SEQ ID NO: 2672156 - RNA, 22 nt, Human
gaacaaguugagcuaugacuua

SEQ ID NO: 2672157 - RNA, 19 nt, Human
gaacacuaacucaccagcc

SEQ ID NO: 2672158 - RNA, 22 nt, Human
gaacacuaacucaccagcccca

SEQ ID NO: 2672159 - RNA, 15 nt, Human
gaacacauuucucug

SEQ ID NO: 2672160 - RNA, 16 nt, Human
gaaacaaccaugucau

SEQ ID NO: 2672161 - RNA, 22 nt, Human
gaaaaaaaugucaaaaguagaa

SEQ ID NO: 2672162 - RNA, 23 nt, Human
gaaaagaaaaaugagccuggcaa

SEQ ID NO: 2672163 - RNA, 21 nt, Human
gaaaagaugguaucauauauu

SEQ ID NO: 2672164 - RNA, 15 nt, Human
gaaaagauucuucug

SEQ ID NO: 2672165 - RNA, 23 nt, Human
gaaaagauucuucuguguuuaua

SEQ ID NO: 2672166 - RNA, 14 nt, Human
gaaaauguccagga

SEQ ID NO: 2672167 - RNA, 18 nt, Human
gaaaaugugacccuccaa

SEQ ID NO: 2672168 - RNA, 20 nt, Human
gaaaaugugacccuccaaau

SEQ ID NO: 2672169 - RNA, 22 nt, Human
gaaaaugugacccuccaaaugg

SEQ ID NO: 2672170 - RNA, 15 nt, Human
gaaaauguccaggaa

SEQ ID NO: 2672171 - RNA, 17 nt, Human
gaaaaugucuguaauaa

SEQ ID NO: 2672172 - RNA, 22 nt, Human
gaaaaugucuguaauaauagac

SEQ ID NO: 2672173 - RNA, 12 nt, Human
cugaugaaaaca

SEQ ID NO: 2672174 - RNA, 18 nt, Human
cugaucuuuguauauuac

SEQ ID NO: 2672175 - RNA, 19 nt, Human
cugaucugcggaucucagc

SEQ ID NO: 2672176 - RNA, 20 nt, Human
cugaucugcggaucucagcu

SEQ ID NO: 2672177 - RNA, 11 nt, Human
cugaucugccc

SEQ ID NO: 2672178 - RNA, 12 nt, Human
cugaucugccca

SEQ ID NO: 2672179 - RNA, 13 nt, Human
cugaucugcccau

SEQ ID NO: 2672180 - RNA, 16 nt, Human
cugaucugcccaucgu

SEQ ID NO: 2672181 - RNA, 17 nt, Human
cugaucugcccaucgug

SEQ ID NO: 2672182 - RNA, 21 nt, Human
cugaucugcccaucgugaaga

SEQ ID NO: 2672183 - RNA, 23 nt, Human
cugaucugcccaucgugaagaag

SEQ ID NO: 2672184 - RNA, 12 nt, Human
cugaucugcgga

SEQ ID NO: 2672185 - RNA, 11 nt, Human
cugaugacaau

SEQ ID NO: 2672186 - RNA, 16 nt, Human
cugaugacaauaaagc

SEQ ID NO: 2672187 - RNA, 16 nt, Human
cugccucccuuguggc

SEQ ID NO: 2672188 - RNA, 21 nt, Human
cugccucccuuguggcagcaa

SEQ ID NO: 2672189 - RNA, 19 nt, Human
cugccuguaacuugagagu

SEQ ID NO: 2672190 - RNA, 21 nt, Human
cugcugacuguuuucucuuga

SEQ ID NO: 2672191 - RNA, 18 nt, Human
cugcugacuguuuucucu

SEQ ID NO: 2672192 - RNA, 18 nt, Human
cugcuauauauaaaacgg

SEQ ID NO: 2672193 - RNA, 18 nt, Human
cugcuagcuagcucaacu

SEQ ID NO: 2672194 - RNA, 14 nt, Human
cugcuagcuagcuc

SEQ ID NO: 2672195 - RNA, 21 nt, Human
cugcuagcuagcucaacuagu

SEQ ID NO: 2672196 - RNA, 20 nt, Human
cugcuagcuagcucaacuag

SEQ ID NO: 2672197 - RNA, 14 nt, Human
cuggauagacgagu

SEQ ID NO: 2672198 - RNA, 14 nt, Human
cuggaagauccugc

SEQ ID NO: 2672199 - RNA, 18 nt, Human
cuggaagauccugcgggu

SEQ ID NO: 2672200 - RNA, 15 nt, Human
cuggaagaacaggcc

SEQ ID NO: 2672201 - RNA, 16 nt, Human
cuggaagaacaggccu

SEQ ID NO: 2672202 - RNA, 17 nt, Human
cuggaagaacaggccuc

SEQ ID NO: 2672203 - RNA, 18 nt, Human
cuggaagaacaggccucu

SEQ ID NO: 2672204 - RNA, 19 nt, Human
cuggaagaacaggccucuc

SEQ ID NO: 2672205 - RNA, 21 nt, Human
cuggaagaacaggccucucca

SEQ ID NO: 2672206 - RNA, 24 nt, Human
cuggcucugagcgccuccauccaa

SEQ ID NO: 2672207 - RNA, 13 nt, Human
cugggacucagcc

SEQ ID NO: 2672208 - RNA, 14 nt, Human
cugggacucagccu

SEQ ID NO: 2672209 - RNA, 15 nt, Human
cugggacucagccuu

SEQ ID NO: 2672210 - RNA, 16 nt, Human
cugggacucagccuuc

SEQ ID NO: 2672211 - RNA, 17 nt, Human
cugggacucagccuuca

SEQ ID NO: 2672212 - RNA, 18 nt, Human
cugggacucagccuucag

SEQ ID NO: 2672213 - RNA, 21 nt, Human
cugggacucagccuucagaca

SEQ ID NO: 2672214 - RNA, 22 nt, Human
cuggcagcccagagacuuugua

SEQ ID NO: 2672215 - RNA, 12 nt, Human
cuggcucugagc

SEQ ID NO: 2672216 - RNA, 13 nt, Human
cuggcucugagcg

SEQ ID NO: 2672217 - RNA, 20 nt, Human
cuggcucugagcgccuccau

SEQ ID NO: 2672218 - RNA, 21 nt, Human
cuggcucugagcgccuccauc

SEQ ID NO: 2672219 - RNA, 12 nt, Human
cuggcagcccag

SEQ ID NO: 2672220 - RNA, 13 nt, Human
cuggcagcccaga

SEQ ID NO: 2672221 - RNA, 16 nt, Human
cuggcagcccagagac

SEQ ID NO: 2672222 - RNA, 11 nt, Human
cuggcagccca

SEQ ID NO: 2672223 - RNA, 14 nt, Human
cuggggauccccgc

SEQ ID NO: 2672224 - RNA, 20 nt, Human
cuggggauccccgccuggcc

SEQ ID NO: 2672225 - RNA, 22 nt, Human
cuggggauccccgccuggccag

SEQ ID NO: 2672226 - RNA, 23 nt, Human
cuggggauccccgccuggccagg

SEQ ID NO: 2672227 - RNA, 18 nt, Human
cuggggcagacaauaaac

SEQ ID NO: 2672228 - RNA, 12 nt, Human
cuggggcaggcu

SEQ ID NO: 2672229 - RNA, 14 nt, Human
cuggggcaggcugg

SEQ ID NO: 2672230 - RNA, 15 nt, Human
cuggggcaggcuggg

SEQ ID NO: 2672231 - RNA, 12 nt, Human
cugggcauuuuc

SEQ ID NO: 2672232 - RNA, 20 nt, Human
cuggggcugaggcugaggca

SEQ ID NO: 2672233 - RNA, 18 nt, Human
cuggggcauccugugcca

SEQ ID NO: 2672234 - RNA, 21 nt, Human
cuggggcaggcugggccaugu

SEQ ID NO: 2672235 - RNA, 16 nt, Human
cuggggcaggcugggc

SEQ ID NO: 2672236 - RNA, 17 nt, Human
cuggggcaggcugggcc

SEQ ID NO: 2672237 - RNA, 18 nt, Human
cuggggcaggcugggcca

SEQ ID NO: 2672238 - RNA, 19 nt, Human
cuggggcaggcugggccau

SEQ ID NO: 2672239 - RNA, 14 nt, Human
cugggugggcucug

SEQ ID NO: 2672240 - RNA, 15 nt, Human
cugggugggcucugu

SEQ ID NO: 2672241 - RNA, 13 nt, Human
cugggugggcucu

SEQ ID NO: 2672242 - RNA, 18 nt, Human
cuggucuugaacuccugg

SEQ ID NO: 2672243 - RNA, 19 nt, Human
cugugccuucuuuugauua

SEQ ID NO: 2672244 - RNA, 19 nt, Human
cugugcgucuugguguaau

SEQ ID NO: 2672245 - RNA, 18 nt, Human
cuguuaggagaagcugca

SEQ ID NO: 2672246 - RNA, 18 nt, Human
cugugcugcccugaagaa

SEQ ID NO: 2672247 - RNA, 17 nt, Human
cugugcugcccugaaga

SEQ ID NO: 2672248 - RNA, 19 nt, Human
cugugucagcauagaagua

SEQ ID NO: 2672249 - RNA, 17 nt, Human
cugugucagcauagaag

SEQ ID NO: 2672250 - RNA, 19 nt, Human
cuggucuuugagcucccac

SEQ ID NO: 2672251 - RNA, 18 nt, Human
cuggucuuugagcuccca

SEQ ID NO: 2672252 - RNA, 12 nt, Human
cuggucuuugag

SEQ ID NO: 2672253 - RNA, 14 nt, Human
cuggugaauauuuu

SEQ ID NO: 2672254 - RNA, 16 nt, Human
cuggugaauauuuuca

SEQ ID NO: 2672255 - RNA, 17 nt, Human
cuguaacacuccucugc

SEQ ID NO: 2672256 - RNA, 17 nt, Human
cuguacugugucucaug

SEQ ID NO: 2672257 - RNA, 18 nt, Human
cuguacuguuacugggcc

SEQ ID NO: 2672258 - RNA, 19 nt, Human
cuguacuguuacugggccc

SEQ ID NO: 2672259 - RNA, 20 nt, Human
cuguacuguuacugggcccu

SEQ ID NO: 2672260 - RNA, 22 nt, Human
cuguacuguuacugggcccuga

SEQ ID NO: 2672261 - RNA, 16 nt, Human
cuguaacuuccaaaua

SEQ ID NO: 2672262 - RNA, 19 nt, Human
cuguaacuuccaaauaaau

SEQ ID NO: 2672263 - RNA, 20 nt, Human
cuguaacuuccaaauaaaua

SEQ ID NO: 2672264 - RNA, 13 nt, Human
cuguagaguggga

SEQ ID NO: 2672265 - RNA, 17 nt, Human
cuguaggguccaaccag

SEQ ID NO: 2672266 - RNA, 23 nt, Human
cuguaggguccaaccagaccugg

SEQ ID NO: 2672267 - RNA, 13 nt, Human
cuguuaugggcuu

SEQ ID NO: 2672268 - RNA, 15 nt, Human
cuguuguagaagaca

SEQ ID NO: 2672269 - RNA, 17 nt, Human
cuguuguaagaauucug

SEQ ID NO: 2672270 - RNA, 19 nt, Human
cuguuguaagaauucugau

SEQ ID NO: 2672271 - RNA, 21 nt, Human
cuguuguaagaauucugauug

SEQ ID NO: 2672272 - RNA, 15 nt, Human
cuuacaauauugauu

SEQ ID NO: 2672273 - RNA, 20 nt, Human
cuuacaauauugauugggaa

SEQ ID NO: 2672274 - RNA, 21 nt, Human
cuuacaauauugauugggaaa

SEQ ID NO: 2672275 - RNA, 18 nt, Human
cuuaaaacaucauuccuu

SEQ ID NO: 2672276 - RNA, 17 nt, Human
cuuaaaacaucauuccu

SEQ ID NO: 2672277 - RNA, 13 nt, Human
cuuaaaacaucau

SEQ ID NO: 2672278 - RNA, 21 nt, Human
cuuaaauaauaaacaguggaa

SEQ ID NO: 2672279 - RNA, 15 nt, Human
cuuaaaguugucacu

SEQ ID NO: 2672280 - RNA, 20 nt, Human
cuuaaaacaucauuccuuuu

SEQ ID NO: 2672281 - RNA, 19 nt, Human
cuuaaaacaucauuccuuu

SEQ ID NO: 2672282 - RNA, 15 nt, Human
cuuagggcaccaggg

SEQ ID NO: 2672283 - RNA, 23 nt, Human
cuuagggacuacccauagacaug

SEQ ID NO: 2672284 - RNA, 15 nt, Human
cuuaggggaaggaga

SEQ ID NO: 2672285 - RNA, 17 nt, Human
cuuaggccuuccucucu

SEQ ID NO: 2672286 - RNA, 15 nt, Human
cuuaggccuuccucu

SEQ ID NO: 2672287 - RNA, 13 nt, Human
cuuaggccuuccu

SEQ ID NO: 2672288 - RNA, 12 nt, Human
cuuaggccuucc

SEQ ID NO: 2672289 - RNA, 23 nt, Human
cuuaggccuuccucucuccagau

SEQ ID NO: 2672290 - RNA, 13 nt, Human
cuuaccauuaaag

SEQ ID NO: 2672291 - RNA, 20 nt, Human
acucaucaaucaaauaagua

SEQ ID NO: 2672292 - RNA, 19 nt, Human
acucauauuacaaaaacaa

SEQ ID NO: 2672293 - RNA, 20 nt, Human
acucuaucggagaacaugaa

SEQ ID NO: 2672294 - RNA, 23 nt, Human
acucuaucggagaacaugaauca

SEQ ID NO: 2672295 - RNA, 17 nt, Human
acucuagggaaaaacca

SEQ ID NO: 2672296 - RNA, 15 nt, Human
acucuagggaaaaac

SEQ ID NO: 2672297 - RNA, 13 nt, Human
acucaggugggcc

SEQ ID NO: 2672298 - RNA, 15 nt, Human
acucaggugggcccu

SEQ ID NO: 2672299 - RNA, 19 nt, Human
acucaggugggcccucuga

SEQ ID NO: 2672300 - RNA, 20 nt, Human
acuagugggguuuccuggca

SEQ ID NO: 2672301 - RNA, 23 nt, Human
acuaguguacauuucuauaaaua

SEQ ID NO: 2672302 - RNA, 19 nt, Human
acuauuuauugacucuggg

SEQ ID NO: 2672303 - RNA, 20 nt, Human
acuauuuauugacucugggu

SEQ ID NO: 2672304 - RNA, 13 nt, Human
acucaaaagcugg

SEQ ID NO: 2672305 - RNA, 14 nt, Human
acuauuuaagaugu

SEQ ID NO: 2672306 - RNA, 16 nt, Human
acuauuuaagauguga

SEQ ID NO: 2672307 - RNA, 17 nt, Human
acuauuuaagaugugaa

SEQ ID NO: 2672308 - RNA, 18 nt, Human
acuauuuaagaugugaaa

SEQ ID NO: 2672309 - RNA, 20 nt, Human
acuauuuaagaugugaaaau

SEQ ID NO: 2672310 - RNA, 21 nt, Human
acuauuuaagaugugaaaauu

SEQ ID NO: 2672311 - RNA, 13 nt, Human
acuagauugacua

SEQ ID NO: 2672312 - RNA, 15 nt, Human
acuagauugugaucc

SEQ ID NO: 2672313 - RNA, 20 nt, Human
acuagauuuucacuuaugaa

SEQ ID NO: 2672314 - RNA, 13 nt, Human
acuagcaaaauaa

SEQ ID NO: 2672315 - RNA, 14 nt, Human
acuagcaaaauaaa

SEQ ID NO: 2672316 - RNA, 15 nt, Human
acuagcaaaauaaaa

SEQ ID NO: 2672317 - RNA, 18 nt, Human
acuagcaaaauaaaacau

SEQ ID NO: 2672318 - RNA, 19 nt, Human
acuagcaaaauaaaacaua

SEQ ID NO: 2672319 - RNA, 23 nt, Human
acuagcaaucucuucauuauucu

SEQ ID NO: 2672320 - RNA, 21 nt, Human
accuuuagaaacucaaaaacu

SEQ ID NO: 2672321 - RNA, 18 nt, Human
accuuuccaccacagcca

SEQ ID NO: 2672322 - RNA, 13 nt, Human
accuuucccucac

SEQ ID NO: 2672323 - RNA, 14 nt, Human
accuuucccucacc

SEQ ID NO: 2672324 - RNA, 17 nt, Human
accuuucccucaccccc

SEQ ID NO: 2672325 - RNA, 18 nt, Human
accuuucccucacccccu

SEQ ID NO: 2672326 - RNA, 19 nt, Human
accuuucccucacccccuc

SEQ ID NO: 2672327 - RNA, 22 nt, Human
accuuucccucacccccuccca

SEQ ID NO: 2672328 - RNA, 12 nt, Human
accuuguaaaag

SEQ ID NO: 2672329 - RNA, 13 nt, Human
accuuguaaaaga

SEQ ID NO: 2672330 - RNA, 15 nt, Human
accuuguaaaagaca

SEQ ID NO: 2672331 - RNA, 16 nt, Human
acuaagagaaguugua

SEQ ID NO: 2672332 - RNA, 17 nt, Human
acuaagagaaguuguaa

SEQ ID NO: 2672333 - RNA, 17 nt, Human
acuaacuugacuuuuaa

SEQ ID NO: 2672334 - RNA, 18 nt, Human
acuaagaauucaaacugg

SEQ ID NO: 2672335 - RNA, 16 nt, Human
acuaagaauucaaacu

SEQ ID NO: 2672336 - RNA, 21 nt, Human
acgugaccggacuuuucugca

SEQ ID NO: 2672337 - RNA, 20 nt, Human
acgugauccucucaccucag

SEQ ID NO: 2672338 - RNA, 17 nt, Human
agaaaaugaaaugcaua

SEQ ID NO: 2672339 - RNA, 21 nt, Human
agaaaaugaaaugcauauuug

SEQ ID NO: 2672340 - RNA, 17 nt, Human
agaaaggcucuauucca

SEQ ID NO: 2672341 - RNA, 22 nt, Human
agaaaggugaguuugagcugcc

SEQ ID NO: 2672342 - RNA, 23 nt, Human
agaaaggugaguuugagcugccu

SEQ ID NO: 2672343 - RNA, 15 nt, Human
agaaagugaagcaaa

SEQ ID NO: 2672344 - RNA, 23 nt, Human
agaaagugaagcaaaucagaaac

SEQ ID NO: 2672345 - RNA, 16 nt, Human
agaaagugugagcaaa

SEQ ID NO: 2672346 - RNA, 22 nt, Human
agaaagugggcuuaauggaguu

SEQ ID NO: 2672347 - RNA, 19 nt, Human
agaaaguggucuuaagaaa

SEQ ID NO: 2672348 - RNA, 20 nt, Human
agaaaguggucuuaagaaau

SEQ ID NO: 2672349 - RNA, 21 nt, Human
agaaaguggucuuaagaaaug

SEQ ID NO: 2672350 - RNA, 23 nt, Human
agaaagugugagcaaacuaacuu

SEQ ID NO: 2672351 - RNA, 17 nt, Human
agaaagugugagcaaac

SEQ ID NO: 2672352 - RNA, 21 nt, Human
agaaauaaaguuugcuuagaa

SEQ ID NO: 2672353 - RNA, 16 nt, Human
agaaauaauagaaaug

SEQ ID NO: 2672354 - RNA, 17 nt, Human
agaaauaaugcuacaau

SEQ ID NO: 2672355 - RNA, 19 nt, Human
agaaauaaugcuacaauuu

SEQ ID NO: 2672356 - RNA, 20 nt, Human
agaaauaaugcuacaauuuu

SEQ ID NO: 2672357 - RNA, 22 nt, Human
agaaauaaugcuacaauuuuaa

SEQ ID NO: 2672358 - RNA, 10 nt, Human
acuuuucauu

SEQ ID NO: 2672359 - RNA, 14 nt, Human
acuuuucauucucu

SEQ ID NO: 2672360 - RNA, 18 nt, Human
acuuuucauucucuuuua

SEQ ID NO: 2672361 - RNA, 20 nt, Human
acuuuucauucucuuuuaau

SEQ ID NO: 2672362 - RNA, 18 nt, Human
acuuuuauuuuacacaga

SEQ ID NO: 2672363 - RNA, 20 nt, Human
acuuuuauuuuacacagaaa

SEQ ID NO: 2672364 - RNA, 22 nt, Human
acuuuuauuuuacacagaaaca

SEQ ID NO: 2672365 - RNA, 21 nt, Human
acuuuauugccuuuuaauuuu

SEQ ID NO: 2672366 - RNA, 15 nt, Human
acugguaggaccaag

SEQ ID NO: 2672367 - RNA, 17 nt, Human
acugccaggccagccuc

SEQ ID NO: 2672368 - RNA, 15 nt, Human
acugccaggccagcc

SEQ ID NO: 2672369 - RNA, 16 nt, Human
acugccaggccagccu

SEQ ID NO: 2672370 - RNA, 18 nt, Human
acugccagcagcagcagg

SEQ ID NO: 2672371 - RNA, 19 nt, Human
acugccagcagcagcaggu

SEQ ID NO: 2672372 - RNA, 20 nt, Human
acugguuuauccacccacaa

SEQ ID NO: 2672373 - RNA, 18 nt, Human
acugguucucaaugaaaa

SEQ ID NO: 2672374 - RNA, 13 nt, Human
acugguugcaugg

SEQ ID NO: 2672375 - RNA, 14 nt, Human
acugguugcaugga

SEQ ID NO: 2672376 - RNA, 15 nt, Human
acugguugcauggaa

SEQ ID NO: 2672377 - RNA, 17 nt, Human
acugguugcauggaaau

SEQ ID NO: 2672378 - RNA, 18 nt, Human
acugguugcauggaaauc

SEQ ID NO: 2672379 - RNA, 19 nt, Human
acugguugcauggaaauca

SEQ ID NO: 2672380 - RNA, 12 nt, Human
acugguucucaa

SEQ ID NO: 2672381 - RNA, 14 nt, Human
acugguucucaaug

SEQ ID NO: 2672382 - RNA, 17 nt, Human
acugguucucaaugaaa

SEQ ID NO: 2672383 - RNA, 22 nt, Human
acugguuuauccacccacaaca

SEQ ID NO: 2672384 - RNA, 17 nt, Human
acugugagaacccaguu

SEQ ID NO: 2672385 - RNA, 22 nt, Human
acugugcgucuugguguaauuu

SEQ ID NO: 2672386 - RNA, 12 nt, Human
acugccagcagc

SEQ ID NO: 2672387 - RNA, 13 nt, Human
acugccagcagca

SEQ ID NO: 2672388 - RNA, 14 nt, Human
acugccagcagcag

SEQ ID NO: 2672389 - RNA, 16 nt, Human
acugccagcagcagca

SEQ ID NO: 2672390 - RNA, 17 nt, Human
acuucagaagcaaacaa

SEQ ID NO: 2672391 - RNA, 18 nt, Human
acuucagaagcaaacaau

SEQ ID NO: 2672392 - RNA, 16 nt, Human
acuguuucucuugagc

SEQ ID NO: 2672393 - RNA, 21 nt, Human
acuguuugaaaacuucagaag

SEQ ID NO: 2672394 - RNA, 23 nt, Human
acuguuucucuugagcuggccuc

SEQ ID NO: 2672395 - RNA, 21 nt, Human
acuguuucucuugagcuggcc

SEQ ID NO: 2672396 - RNA, 22 nt, Human
acuguuucucuugagcuggccu

SEQ ID NO: 2672397 - RNA, 17 nt, Human
acuguuucucuugagcu

SEQ ID NO: 2672398 - RNA, 18 nt, Human
acuguuucucuugagcug

SEQ ID NO: 2672399 - RNA, 19 nt, Human
acuguuucucuugagcugg

SEQ ID NO: 2672400 - RNA, 20 nt, Human
acuguuucucuugagcuggc

SEQ ID NO: 2672401 - RNA, 14 nt, Human
acuucuucuccauc

SEQ ID NO: 2672402 - RNA, 17 nt, Human
acuucuucuccaucccu

SEQ ID NO: 2672403 - RNA, 13 nt, Human
acuucuucucuua

SEQ ID NO: 2672404 - RNA, 16 nt, Human
acuucuucucuuagau

SEQ ID NO: 2672405 - RNA, 18 nt, Human
acuucuucucuuagauuc

SEQ ID NO: 2672406 - RNA, 14 nt, Human
acuugggccacugu

SEQ ID NO: 2672407 - RNA, 22 nt, Human
acuugggaggcugaggcaggag

SEQ ID NO: 2672408 - RNA, 15 nt, Human
acuugggccacugug

SEQ ID NO: 2672409 - RNA, 16 nt, Human
acuugguuuuuaaaaa

SEQ ID NO: 2672410 - RNA, 13 nt, Human
acuugguuuuaug

SEQ ID NO: 2672411 - RNA, 17 nt, Human
acuugguuuuaugguua

SEQ ID NO: 2672412 - RNA, 17 nt, Human
acccccuuaaauuuaau

SEQ ID NO: 2672413 - RNA, 15 nt, Human
acccccugcccugca

SEQ ID NO: 2672414 - RNA, 13 nt, Human
acccccugcccug

SEQ ID NO: 2672415 - RNA, 14 nt, Human
acccccugcccugc

SEQ ID NO: 2672416 - RNA, 20 nt, Human
accccucacaggagcuuacu

SEQ ID NO: 2672417 - RNA, 15 nt, Human
acccaccguggagga

SEQ ID NO: 2672418 - RNA, 22 nt, Human
acccaccguggaggaggaaggc

SEQ ID NO: 2672419 - RNA, 13 nt, Human
acccaccuagaac

SEQ ID NO: 2672420 - RNA, 17 nt, Human
acccauugcuguugucc

SEQ ID NO: 2672421 - RNA, 13 nt, Human
acccauugcuguu

SEQ ID NO: 2672422 - RNA, 21 nt, Human
acccauuaaggggaagaauga

SEQ ID NO: 2672423 - RNA, 22 nt, Human
acccauuaaggggaagaaugaa

SEQ ID NO: 2672424 - RNA, 22 nt, Human
accauccuggcuaacaugguga

SEQ ID NO: 2672425 - RNA, 12 nt, Human
accauccuggcu

SEQ ID NO: 2672426 - RNA, 13 nt, Human
accauccuggcua

SEQ ID NO: 2672427 - RNA, 18 nt, Human
accauccuguauucuuca

SEQ ID NO: 2672428 - RNA, 22 nt, Human
accauauugugcuucacaguag

SEQ ID NO: 2672429 - RNA, 22 nt, Human
accagagugcugaaggaaugga

SEQ ID NO: 2672430 - RNA, 14 nt, Human
accagaggagccuu

SEQ ID NO: 2672431 - RNA, 15 nt, Human
accagaggagccuuu

SEQ ID NO: 2672432 - RNA, 16 nt, Human
accagaggagccuuuu

SEQ ID NO: 2672433 - RNA, 17 nt, Human
accagaggagccuuuuu

SEQ ID NO: 2672434 - RNA, 22 nt, Human
accagauaccuuaucuuacaau

SEQ ID NO: 2672435 - RNA, 19 nt, Human
accagcccaucgccacaaa

SEQ ID NO: 2672436 - RNA, 17 nt, Human
accagcaauauaucuga

SEQ ID NO: 2672437 - RNA, 21 nt, Human
accagaugcgucccaagaugu

SEQ ID NO: 2672438 - RNA, 22 nt, Human
accagaugcgucccaagauguu

SEQ ID NO: 2672439 - RNA, 14 nt, Human
accaagcaucuugg

SEQ ID NO: 2672440 - RNA, 20 nt, Human
accaagccaagggaaccugu

SEQ ID NO: 2672441 - RNA, 23 nt, Human
accaagccaagggaaccuguguc

SEQ ID NO: 2672442 - RNA, 21 nt, Human
accacccugagccggccccag

SEQ ID NO: 2672443 - RNA, 12 nt, Human
accaagugaaau

SEQ ID NO: 2672444 - RNA, 12 nt, Human
accaagucacac

SEQ ID NO: 2672445 - RNA, 14 nt, Human
accaagucacacgc

SEQ ID NO: 2672446 - RNA, 24 nt, Human
accaaguaaaacaaaaccacuggg

SEQ ID NO: 2672447 - RNA, 20 nt, Human
acauuuuaaaaaauggucac

SEQ ID NO: 2672448 - RNA, 22 nt, Human
acauuuauuuuuuuuaaagaaa

SEQ ID NO: 2672449 - RNA, 23 nt, Human
acauuuauuuuuuuuaaagaaaa

SEQ ID NO: 2672450 - RNA, 18 nt, Human
acauuuauuuauccagaa

SEQ ID NO: 2672451 - RNA, 14 nt, Human
acagggugggccuc

SEQ ID NO: 2672452 - RNA, 15 nt, Human
acagggugggccucg

SEQ ID NO: 2672453 - RNA, 14 nt, Human
acaugugauacauu

SEQ ID NO: 2672454 - RNA, 15 nt, Human
acaugugauacauuu

SEQ ID NO: 2672455 - RNA, 17 nt, Human
acaugugauacauuuuu

SEQ ID NO: 2672456 - RNA, 23 nt, Human
acaugugauacauuuuuuaagcu

SEQ ID NO: 2672457 - RNA, 11 nt, Human
acauguuuccu

SEQ ID NO: 2672458 - RNA, 16 nt, Human
acauguuuccucuagu

SEQ ID NO: 2672459 - RNA, 13 nt, Human
acaugcauauaau

SEQ ID NO: 2672460 - RNA, 16 nt, Human
acaugcauauaaugaa

SEQ ID NO: 2672461 - RNA, 18 nt, Human
acaugcauauaaugaaua

SEQ ID NO: 2672462 - RNA, 23 nt, Human
acaugcauauaaugaauaaauca

SEQ ID NO: 2672463 - RNA, 20 nt, Human
acagccaagauuuuccucuu

SEQ ID NO: 2672464 - RNA, 19 nt, Human
acagaaucuuccuuuuauu

SEQ ID NO: 2672465 - RNA, 21 nt, Human
acacugguucucaaugaaaaa

SEQ ID NO: 2672466 - RNA, 18 nt, Human
acacugguucucaaugaa

SEQ ID NO: 2672467 - RNA, 19 nt, Human
acacugguucucaaugaaa

SEQ ID NO: 2672468 - RNA, 13 nt, Human
acacugguucuca

SEQ ID NO: 2672469 - RNA, 14 nt, Human
acacugguucucaa

SEQ ID NO: 2672470 - RNA, 15 nt, Human
acacugguucucaau

SEQ ID NO: 2672471 - RNA, 17 nt, Human
acacugguucucaauga

SEQ ID NO: 2672472 - RNA, 20 nt, Human
acagaaugcaaccaagucac

SEQ ID NO: 2672473 - RNA, 22 nt, Human
acagaaugcaaccaagucacac

SEQ ID NO: 2672474 - RNA, 20 nt, Human
acacuggcaaugguaguuuc

SEQ ID NO: 2672475 - RNA, 21 nt, Human
acacuggcaaugguaguuucu

SEQ ID NO: 2672476 - RNA, 22 nt, Human
acacugcacucuuaagcuuccg

SEQ ID NO: 2672477 - RNA, 13 nt, Human
acacauuuuuuug

SEQ ID NO: 2672478 - RNA, 15 nt, Human
acaauugguaaaacu

SEQ ID NO: 2672479 - RNA, 22 nt, Human
acaauugguaaaacucacugug

SEQ ID NO: 2672480 - RNA, 23 nt, Human
acaauugguaaaacucacuguga

SEQ ID NO: 2672481 - RNA, 22 nt, Human
acacagcagaggcccagauauu

SEQ ID NO: 2672482 - RNA, 15 nt, Human
acaauucuguuuuua

SEQ ID NO: 2672483 - RNA, 17 nt, Human
acaauucuguuuuuaau

SEQ ID NO: 2672484 - RNA, 21 nt, Human
acaauucuguuuuuaaugcua

SEQ ID NO: 2672485 - RNA, 13 nt, Human
aauuuuguacaaa

SEQ ID NO: 2672486 - RNA, 12 nt, Human
aauuuuguaaga

SEQ ID NO: 2672487 - RNA, 13 nt, Human
aauuuuguaagaa

SEQ ID NO: 2672488 - RNA, 14 nt, Human
aauuuuguacaaau

SEQ ID NO: 2672489 - RNA, 16 nt, Human
aauuuuguaugaaaaa

SEQ ID NO: 2672490 - RNA, 16 nt, Human
aauuuuguauguuaaa

SEQ ID NO: 2672491 - RNA, 20 nt, Human
aauuuuguauguuaaagaga

SEQ ID NO: 2672492 - RNA, 17 nt, Human
acaagaaauaauagaaa

SEQ ID NO: 2672493 - RNA, 13 nt, Human
acaacggaggccu

SEQ ID NO: 2672494 - RNA, 22 nt, Human
acaacggaggccugcgacccug

SEQ ID NO: 2672495 - RNA, 13 nt, Human
acaaaauuugacu

SEQ ID NO: 2672496 - RNA, 20 nt, Human
acaaaauuugacuaauuuua

SEQ ID NO: 2672497 - RNA, 20 nt, Human
acaaaauuaagcaaauguua

SEQ ID NO: 2672498 - RNA, 20 nt, Human
acaaggcacuucauguaaag

SEQ ID NO: 2672499 - RNA, 18 nt, Human
acaagggaagauuuaugu

SEQ ID NO: 2672500 - RNA, 20 nt, Human
acaagggaagauuuauguuu

SEQ ID NO: 2672501 - RNA, 16 nt, Human
aaagccuaaucacagu

SEQ ID NO: 2672502 - RNA, 16 nt, Human
aaagccuccuccagcc

SEQ ID NO: 2672503 - RNA, 13 nt, Human
aaaggccucuugu

SEQ ID NO: 2672504 - RNA, 21 nt, Human
aaaggccucuuguaaagacug

SEQ ID NO: 2672505 - RNA, 15 nt, Human
aaaguggaaguaugu

SEQ ID NO: 2672506 - RNA, 19 nt, Human
aaaguggccaagaagcagu

SEQ ID NO: 2672507 - RNA, 20 nt, Human
aaauaaaguuugcuuagaaa

SEQ ID NO: 2672508 - RNA, 13 nt, Human
aaaguggaaaaau

SEQ ID NO: 2672509 - RNA, 13 nt, Human
aaaggcgcugaga

SEQ ID NO: 2672510 - RNA, 16 nt, Human
aaagucauuaaagaca

SEQ ID NO: 2672511 - RNA, 17 nt, Human
aaagucauuaaagacag

SEQ ID NO: 2672512 - RNA, 11 nt, Human
aaauaaauaau

SEQ ID NO: 2672513 - RNA, 14 nt, Human
aaauaaauaauuuu

SEQ ID NO: 2672514 - RNA, 20 nt, Human
aaauaguuuauuuuaaaaca

SEQ ID NO: 2672515 - RNA, 17 nt, Human
aaauaguuuauuuuaaa

SEQ ID NO: 2672516 - RNA, 12 nt, Human
aaauaguuuauu

SEQ ID NO: 2672517 - RNA, 21 nt, Human
aaauaguuuauuuuaaaacaa

SEQ ID NO: 2672518 - RNA, 13 nt, Human
aaaucaaagugcu

SEQ ID NO: 2672519 - RNA, 15 nt, Human
aaaucaaagugcuau

SEQ ID NO: 2672520 - RNA, 14 nt, Human
aaaucaaagugcua

SEQ ID NO: 2672521 - RNA, 15 nt, Human
aaaucaauacacuag

SEQ ID NO: 2672522 - RNA, 22 nt, Human
aaaucaauacacuaguuguuuc

SEQ ID NO: 2672523 - RNA, 17 nt, Human
aaaucaauacacuaguu

SEQ ID NO: 2672524 - RNA, 12 nt, Human
aaaucuggaagc

SEQ ID NO: 2672525 - RNA, 13 nt, Human
aaauaggaaacaa

SEQ ID NO: 2672526 - RNA, 14 nt, Human
aaauaggaaacaag

SEQ ID NO: 2672527 - RNA, 16 nt, Human
aaauaggaaacaagug

SEQ ID NO: 2672528 - RNA, 19 nt, Human
aaauaggaaucauucagaa

SEQ ID NO: 2672529 - RNA, 20 nt, Human
aaauaggaaucauucagaaa

SEQ ID NO: 2672530 - RNA, 14 nt, Human
aaauaggauuuuua

SEQ ID NO: 2672531 - RNA, 16 nt, Human
aaauaggauuuuuaga

SEQ ID NO: 2672532 - RNA, 15 nt, Human
aaauagugucuuugu

SEQ ID NO: 2672533 - RNA, 20 nt, Human
aaagaaauccggagaagcug

SEQ ID NO: 2672534 - RNA, 11 nt, Human
aaagaaauauu

SEQ ID NO: 2672535 - RNA, 18 nt, Human
aaagaaaucauguccaua

SEQ ID NO: 2672536 - RNA, 21 nt, Human
aaagaguugggugucuccuua

SEQ ID NO: 2672537 - RNA, 22 nt, Human
aaaccauguagcagugagucau

SEQ ID NO: 2672538 - RNA, 21 nt, Human
aaacccgggaaccuccccagc

SEQ ID NO: 2672539 - RNA, 14 nt, Human
aaacccucagagcc

SEQ ID NO: 2672540 - RNA, 15 nt, Human
aaacccucagagccu

SEQ ID NO: 2672541 - RNA, 22 nt, Human
aaacacguuuuaaggacugacu

SEQ ID NO: 2672542 - RNA, 18 nt, Human
aaacacguuuuaaggacu

SEQ ID NO: 2672543 - RNA, 17 nt, Human
aaacacguuuuaaggac

SEQ ID NO: 2672544 - RNA, 22 nt, Human
aaacacugccuuuuuauuuaua

SEQ ID NO: 2672545 - RNA, 14 nt, Human
aaacaccuucuaua

SEQ ID NO: 2672546 - RNA, 14 nt, Human
aaacagaaaaaaag

SEQ ID NO: 2672547 - RNA, 20 nt, Human
aaaauugaguugcacuuauu

SEQ ID NO: 2672548 - RNA, 14 nt, Human
aaacagaaauggaa

SEQ ID NO: 2672549 - RNA, 22 nt, Human
aaaaucuaagcagcuuauuguu

SEQ ID NO: 2672550 - RNA, 23 nt, Human
aaaaucuaagcagcuuauuguuu

SEQ ID NO: 2672551 - RNA, 15 nt, Human
aaaauccugugcaau

SEQ ID NO: 2672552 - RNA, 22 nt, Human
aaaaucccuuaccucggugccu

SEQ ID NO: 2672553 - RNA, 14 nt, Human
aaaauaaacuauaa

SEQ ID NO: 2672554 - RNA, 21 nt, Human
aaaauaaacuauaaaacaaaa

SEQ ID NO: 2672555 - RNA, 14 nt, Human
aaaauaaagaagua

SEQ ID NO: 2672556 - RNA, 13 nt, Human
aaaaguguccuuc

SEQ ID NO: 2672557 - RNA, 19 nt, Human
aaaaguguguauauauuuu

SEQ ID NO: 2672558 - RNA, 20 nt, Human
aaaaguguguauauauuuug

SEQ ID NO: 2672559 - RNA, 21 nt, Human
aaaaguguguauauauuuugu

SEQ ID NO: 2672560 - RNA, 13 nt, Human
aaaauaaaaugaa

SEQ ID NO: 2672561 - RNA, 21 nt, Human
aaaauaaaaugaaaauuguau

SEQ ID NO: 2672562 - RNA, 13 nt, Human
aaaaacugaaaaa

SEQ ID NO: 2672563 - RNA, 14 nt, Human
aaaaacugaaaaau

SEQ ID NO: 2672564 - RNA, 14 nt, Human
aaaagugccucaag

SEQ ID NO: 2672565 - RNA, 18 nt, Human
aaaagugccucaagagga

SEQ ID NO: 2672566 - RNA, 20 nt, Human
aaaagugccucaagaggaau

SEQ ID NO: 2672567 - RNA, 19 nt, Human
aacggaggccugcgacccu

SEQ ID NO: 2672568 - RNA, 22 nt, Human
aacggaggccugcgacccuggg

SEQ ID NO: 2672569 - RNA, 23 nt, Human
aacggaggccugcgacccugggg

SEQ ID NO: 2672570 - RNA, 15 nt, Human
aacucacugugauca

SEQ ID NO: 2672571 - RNA, 23 nt, Human
aacucagagaaaaaugcucccca

SEQ ID NO: 2672572 - RNA, 21 nt, Human
aacuauuuauugacucugggu

SEQ ID NO: 2672573 - RNA, 21 nt, Human
aacuauugugcucagagacac

SEQ ID NO: 2672574 - RNA, 22 nt, Human
aacuauugugcucagagacacu

SEQ ID NO: 2672575 - RNA, 24 nt, Human
aacuauugugcucagagacacugu

SEQ ID NO: 2672576 - RNA, 16 nt, Human
aacgggaacaugcccc

SEQ ID NO: 2672577 - RNA, 17 nt, Human
aacgggaacaugccccc

SEQ ID NO: 2672578 - RNA, 19 nt, Human
aacgggaacaugcccccug

SEQ ID NO: 2672579 - RNA, 19 nt, Human
aacugaggcuuagagauag

SEQ ID NO: 2672580 - RNA, 23 nt, Human
aacugaguauuaauaucugagga

SEQ ID NO: 2672581 - RNA, 13 nt, Human
aacuuaacugaaa

SEQ ID NO: 2672582 - RNA, 13 nt, Human
aacuuaauaauca

SEQ ID NO: 2672583 - RNA, 17 nt, Human
aacuuaauaaucaagag

SEQ ID NO: 2672584 - RNA, 15 nt, Human
aacuuaauaaucaag

SEQ ID NO: 2672585 - RNA, 15 nt, Human
aacuuaaauguuauu

SEQ ID NO: 2672586 - RNA, 19 nt, Human
aacuuaaauguuauuaucu

SEQ ID NO: 2672587 - RNA, 21 nt, Human
aacuuaaauguuauuaucugg

SEQ ID NO: 2672588 - RNA, 20 nt, Human
aacuuaauaaucaagagccu

SEQ ID NO: 2672589 - RNA, 20 nt, Human
aaccuaaucaccauguaagc

SEQ ID NO: 2672590 - RNA, 21 nt, Human
aaccuaaucaccauguaagca

SEQ ID NO: 2672591 - RNA, 13 nt, Human
aaccgaauaaaug

SEQ ID NO: 2672592 - RNA, 22 nt, Human
aacccuaucuccugacagaagg

SEQ ID NO: 2672593 - RNA, 23 nt, Human
aacccuaucuccugacagaaggu

SEQ ID NO: 2672594 - RNA, 18 nt, Human
aacccuuuauuugaacaa

SEQ ID NO: 2672595 - RNA, 18 nt, Human
aacccuuuuaaaguugau

SEQ ID NO: 2672596 - RNA, 15 nt, Human
aacccuaucuccuga

SEQ ID NO: 2672597 - RNA, 16 nt, Human
aacccuaucuccugac

SEQ ID NO: 2672598 - RNA, 19 nt, Human
aacccuaucuccugacaga

SEQ ID NO: 2672599 - RNA, 15 nt, Human
aaccacgccucuuga

SEQ ID NO: 2672600 - RNA, 22 nt, Human
aaccacggaggaugaugccagu

SEQ ID NO: 2672601 - RNA, 21 nt, Human
aaccacugugcgucuuggugu

SEQ ID NO: 2672602 - RNA, 15 nt, Human
aaccacuucagcuga

SEQ ID NO: 2672603 - RNA, 12 nt, Human
aaccagaccugg

SEQ ID NO: 2672604 - RNA, 15 nt, Human
aaccagaccuggaag

SEQ ID NO: 2672605 - RNA, 15 nt, Human
aaccagagugcugaa

SEQ ID NO: 2672606 - RNA, 12 nt, Human
aaccacuuguag

SEQ ID NO: 2672607 - RNA, 21 nt, Human
aaccacuuguagauuugauuu

SEQ ID NO: 2672608 - RNA, 20 nt, Human
aaccacuuguagauuugauu

SEQ ID NO: 2672609 - RNA, 18 nt, Human
aaccacuuguagauuuga

SEQ ID NO: 2672610 - RNA, 17 nt, Human
aaccacuuguagauuug

SEQ ID NO: 2672611 - RNA, 22 nt, Human
aaccacuuguagauuugauuuu

SEQ ID NO: 2672612 - RNA, 17 nt, Human
aacauccaaccuuccca

SEQ ID NO: 2672613 - RNA, 16 nt, Human
aacauccaaccuuccc

SEQ ID NO: 2672614 - RNA, 14 nt, Human
aacaucauuccuuu

SEQ ID NO: 2672615 - RNA, 22 nt, Human
aacaucauuccuuuuuauuuau

SEQ ID NO: 2672616 - RNA, 21 nt, Human
aacaucauuccuuuuuauuua

SEQ ID NO: 2672617 - RNA, 20 nt, Human
aacaucauuccuuuuuauuu

SEQ ID NO: 2672618 - RNA, 17 nt, Human
aacaucauuccuuuuua

SEQ ID NO: 2672619 - RNA, 21 nt, Human
aaccaccccggcccccugccc

SEQ ID NO: 2672620 - RNA, 22 nt, Human
aaccaccccggcccccugcccg

SEQ ID NO: 2672621 - RNA, 18 nt, Human
aacagcugucacaacuug

SEQ ID NO: 2672622 - RNA, 16 nt, Human
aacagcaagugugaau

SEQ ID NO: 2672623 - RNA, 15 nt, Human
aacagcaagugugaa

SEQ ID NO: 2672624 - RNA, 17 nt, Human
aacacauguuuuuauac

SEQ ID NO: 2672625 - RNA, 13 nt, Human
aacacauuucucu

SEQ ID NO: 2672626 - RNA, 13 nt, Human
aacaacaauuggu

SEQ ID NO: 2672627 - RNA, 14 nt, Human
aacaacaauuggua

SEQ ID NO: 2672628 - RNA, 19 nt, Human
aacaacaauugguaaaacu

SEQ ID NO: 2672629 - RNA, 19 nt, Human
aaauuuuuuuuuaaagcag

SEQ ID NO: 2672630 - RNA, 15 nt, Human
aacaaauuauuuuug

SEQ ID NO: 2672631 - RNA, 12 nt, Human
aacaaaaaccaa

SEQ ID NO: 2672632 - RNA, 20 nt, Human
aacaaaaaccaaauguuuau

SEQ ID NO: 2672633 - RNA, 13 nt, Human
aacacguuuuaag

SEQ ID NO: 2672634 - RNA, 22 nt, Human
aaaucuuaaugaaugagucugu

SEQ ID NO: 2672635 - RNA, 13 nt, Human
aaaucuuaauguu

SEQ ID NO: 2672636 - RNA, 23 nt, Human
aaaucuuaauguuccucaaagcu

SEQ ID NO: 2672637 - RNA, 20 nt, Human
aaauugacacaaguggaccu

SEQ ID NO: 2672638 - RNA, 10 nt, Human
aaauguuucu

SEQ ID NO: 2672639 - RNA, 18 nt, Human
aaguguaaguucacaacu

SEQ ID NO: 2672640 - RNA, 14 nt, Human
aagugcuuuaaaaa

SEQ ID NO: 2672641 - RNA, 14 nt, Human
aaguguauaauaua

SEQ ID NO: 2672642 - RNA, 19 nt, Human
aaguguauaauauaaaaaa

SEQ ID NO: 2672643 - RNA, 21 nt, Human
aaguguauaauauaaaaaauu

SEQ ID NO: 2672644 - RNA, 20 nt, Human
aaguugagcuaugacuuaac

SEQ ID NO: 2672645 - RNA, 19 nt, Human
aaguugagcuaugacuuaa

SEQ ID NO: 2672646 - RNA, 18 nt, Human
aaguugagcuaugacuua

SEQ ID NO: 2672647 - RNA, 16 nt, Human
aaguugagcuaugacu

SEQ ID NO: 2672648 - RNA, 16 nt, Human
aaguggaaguauguau

SEQ ID NO: 2672649 - RNA, 22 nt, Human
aagugcuuggaacauacuguuc

SEQ ID NO: 2672650 - RNA, 23 nt, Human
aagugcuuggaacauacuguuca

SEQ ID NO: 2672651 - RNA, 13 nt, Human
aaguggaaauguu

SEQ ID NO: 2672652 - RNA, 21 nt, Human
aaguggaaaaauagccugccu

SEQ ID NO: 2672653 - RNA, 19 nt, Human
aaguggaaaaauagccugc

SEQ ID NO: 2672654 - RNA, 15 nt, Human
aagucugucuuuccu

SEQ ID NO: 2672655 - RNA, 22 nt, Human
aagucugucuuuccugaaccau

SEQ ID NO: 2672656 - RNA, 22 nt, Human
aagucugcucucauauaagaca

SEQ ID NO: 2672657 - RNA, 15 nt, Human
aagggaaaguuuuuu

SEQ ID NO: 2672658 - RNA, 16 nt, Human
aagggaagauuuaugu

SEQ ID NO: 2672659 - RNA, 15 nt, Human
aagggaaccuguguc

SEQ ID NO: 2672660 - RNA, 14 nt, Human
aagggaagaaacug

SEQ ID NO: 2672661 - RNA, 15 nt, Human
aagggaaagaaaaug

SEQ ID NO: 2672662 - RNA, 19 nt, Human
aagggacccuuuggggguu

SEQ ID NO: 2672663 - RNA, 16 nt, Human
aagggagaagaaaggu

SEQ ID NO: 2672664 - RNA, 15 nt, Human
aagggagaagaaagg

SEQ ID NO: 2672665 - RNA, 21 nt, Human
aagggccagcguggcucuaaa

SEQ ID NO: 2672666 - RNA, 23 nt, Human
aaguagaacuuuguauaguuaug

SEQ ID NO: 2672667 - RNA, 21 nt, Human
aaguagaacuuuguauaguua

SEQ ID NO: 2672668 - RNA, 14 nt, Human
aaguaguccuguga

SEQ ID NO: 2672669 - RNA, 22 nt, Human
aaggugaguuugagcugccuuc

SEQ ID NO: 2672670 - RNA, 20 nt, Human
aaggugaguuugagcugccu

SEQ ID NO: 2672671 - RNA, 21 nt, Human
aaggugaguuugagcugccuu

SEQ ID NO: 2672672 - RNA, 18 nt, Human
aaguagaacuuuguauag

SEQ ID NO: 2672673 - RNA, 17 nt, Human
aaguagaacuuuguaua

SEQ ID NO: 2672674 - RNA, 13 nt, Human
aaggugccacuuu

SEQ ID NO: 2672675 - RNA, 21 nt, Human
aagucucacuggcugucagua

SEQ ID NO: 2672676 - RNA, 13 nt, Human
aagucuauaaaaa

SEQ ID NO: 2672677 - RNA, 16 nt, Human
aagauguugauuuuua

SEQ ID NO: 2672678 - RNA, 21 nt, Human
aagauguugauuuuuacugug

SEQ ID NO: 2672679 - RNA, 22 nt, Human
aagauguugauuuuuacugugu

SEQ ID NO: 2672680 - RNA, 15 nt, Human
aacuuucaauuguca

SEQ ID NO: 2672681 - RNA, 23 nt, Human
aagagugauagucuuuugcuuuu

SEQ ID NO: 2672682 - RNA, 21 nt, Human
aagagucuacccgacauaagu

SEQ ID NO: 2672683 - RNA, 16 nt, Human
aagcagccucucccca

SEQ ID NO: 2672684 - RNA, 17 nt, Human
aagcagccucuccccag

SEQ ID NO: 2672685 - RNA, 22 nt, Human
aagcagccucuccccaggucca

SEQ ID NO: 2672686 - RNA, 16 nt, Human
aagccagcccggccgc

SEQ ID NO: 2672687 - RNA, 23 nt, Human
aagcuaaugacgaggaaccgaaa

SEQ ID NO: 2672688 - RNA, 15 nt, Human
aaggcaggccuauuu

SEQ ID NO: 2672689 - RNA, 17 nt, Human
aaggcaggccuauuuca

SEQ ID NO: 2672690 - RNA, 15 nt, Human
aagcugggcagguug

SEQ ID NO: 2672691 - RNA, 19 nt, Human
aagcuaccucaaacuucca

SEQ ID NO: 2672692 - RNA, 17 nt, Human
aagcuacuagcaaaaua

SEQ ID NO: 2672693 - RNA, 22 nt, Human
aagcuacuagcaaaauaaaaca

SEQ ID NO: 2672694 - RNA, 23 nt, Human
aagcgcuuuuccuuggcauuccg

SEQ ID NO: 2672695 - RNA, 13 nt, Human
aauauauaugaau

SEQ ID NO: 2672696 - RNA, 20 nt, Human
aauauauaucuaucuauuug

SEQ ID NO: 2672697 - RNA, 22 nt, Human
aauauauaucuaucuauuugag

SEQ ID NO: 2672698 - RNA, 14 nt, Human
aauauaucucuauu

SEQ ID NO: 2672699 - RNA, 21 nt, Human
aauauaucuuauaaaguggaa

SEQ ID NO: 2672700 - RNA, 15 nt, Human
aauauguuuaaaaua

SEQ ID NO: 2672701 - RNA, 20 nt, Human
aauauguuuaaaauaaaaug

SEQ ID NO: 2672702 - RNA, 23 nt, Human
aauauacaugaagaauagaaaca

SEQ ID NO: 2672703 - RNA, 19 nt, Human
aauauacauucaaacuuaa

SEQ ID NO: 2672704 - RNA, 18 nt, Human
aauauacauucaaacuua

SEQ ID NO: 2672705 - RNA, 17 nt, Human
aaucaagguuauaauuu

SEQ ID NO: 2672706 - RNA, 18 nt, Human
aaucaagguuauaauuuu

SEQ ID NO: 2672707 - RNA, 13 nt, Human
aaucaccauguaa

SEQ ID NO: 2672708 - RNA, 14 nt, Human
aaucaccauguaag

SEQ ID NO: 2672709 - RNA, 15 nt, Human
aaucaccauguaagc

SEQ ID NO: 2672710 - RNA, 16 nt, Human
aaucaccauguaagca

SEQ ID NO: 2672711 - RNA, 19 nt, Human
aaucaccauguaagcacuc

SEQ ID NO: 2672712 - RNA, 23 nt, Human
aaucaccauguaagcacucugga

SEQ ID NO: 2672713 - RNA, 22 nt, Human
aaucaagagccuuaaaacauca

SEQ ID NO: 2672714 - RNA, 21 nt, Human
aaucaagagccuuaaaacauc

SEQ ID NO: 2672715 - RNA, 22 nt, Human
aauauuaggcuuaaaaacugaa

SEQ ID NO: 2672716 - RNA, 23 nt, Human
aauauuaggcuuaaaaacugaaa

SEQ ID NO: 2672717 - RNA, 19 nt, Human
aaucaagagccuuaaaaca

SEQ ID NO: 2672718 - RNA, 17 nt, Human
aaucaagagccuuaaaa

SEQ ID NO: 2672719 - RNA, 14 nt, Human
aauacuauuuaaga

SEQ ID NO: 2672720 - RNA, 15 nt, Human
aauacuauuuaagau

SEQ ID NO: 2672721 - RNA, 19 nt, Human
aauacuauuuaagauguga

SEQ ID NO: 2672722 - RNA, 20 nt, Human
aauacuauuuaagaugugaa

SEQ ID NO: 2672723 - RNA, 21 nt, Human
aauacuauuuaagaugugaaa

SEQ ID NO: 2672724 - RNA, 14 nt, Human
aauacucuuuauuu

SEQ ID NO: 2672725 - RNA, 15 nt, Human
aauacugaaccacuu

SEQ ID NO: 2672726 - RNA, 14 nt, Human
aauacugaaccacu

SEQ ID NO: 2672727 - RNA, 13 nt, Human
aauacugaaccac

SEQ ID NO: 2672728 - RNA, 22 nt, Human
aauacucuacccucuuagaaaa

SEQ ID NO: 2672729 - RNA, 20 nt, Human
aauacucuacccucuuagaa

SEQ ID NO: 2672730 - RNA, 18 nt, Human
aauacugaaccacuugua

SEQ ID NO: 2672731 - RNA, 20 nt, Human
aauacugaaccacuuguaga

SEQ ID NO: 2672732 - RNA, 18 nt, Human
aauacugauggaauuuuu

SEQ ID NO: 2672733 - RNA, 13 nt, Human
aauacugcuugaa

SEQ ID NO: 2672734 - RNA, 16 nt, Human
aaugaaagcuguuccu

SEQ ID NO: 2672735 - RNA, 17 nt, Human
aaucucuuuuuguuugc

SEQ ID NO: 2672736 - RNA, 18 nt, Human
aaucucuuuuuguuugcc

SEQ ID NO: 2672737 - RNA, 15 nt, Human
aaucucuucauuauu

SEQ ID NO: 2672738 - RNA, 18 nt, Human
aaucucuucauuauucuc

SEQ ID NO: 2672739 - RNA, 21 nt, Human
aaucucuucauuauucucugc

SEQ ID NO: 2672740 - RNA, 13 nt, Human
aaucucugugccu

SEQ ID NO: 2672741 - RNA, 14 nt, Human
aaucucuaggaagu

SEQ ID NO: 2672742 - RNA, 15 nt, Human
aaucucuaggaaguc

SEQ ID NO: 2672743 - RNA, 19 nt, Human
aaucucuaggaagucaaua

SEQ ID NO: 2672744 - RNA, 17 nt, Human
aauccaagccuccacag

SEQ ID NO: 2672745 - RNA, 18 nt, Human
aauccaagccuccacagc

SEQ ID NO: 2672746 - RNA, 22 nt, Human
aauccaagccuccacagcgagg

SEQ ID NO: 2672747 - RNA, 23 nt, Human
aauccaagccuccacagcgaggg

SEQ ID NO: 2672748 - RNA, 14 nt, Human
aaugaaguugaaaa

SEQ ID NO: 2672749 - RNA, 19 nt, Human
aaugaaguugaaaaucaua

SEQ ID NO: 2672750 - RNA, 19 nt, Human
aaugaaauauuguuuccaa

SEQ ID NO: 2672751 - RNA, 14 nt, Human
aaugaaaugcauau

SEQ ID NO: 2672752 - RNA, 22 nt, Human
aauggugugaacccgggagcgg

SEQ ID NO: 2672753 - RNA, 16 nt, Human
aaugcuauuugaacaa

SEQ ID NO: 2672754 - RNA, 17 nt, Human
aaugguugaugauacuu

SEQ ID NO: 2672755 - RNA, 17 nt, Human
aauguccaguaagauca

SEQ ID NO: 2672756 - RNA, 17 nt, Human
aauguuucuuuuguuug

SEQ ID NO: 2672757 - RNA, 21 nt, Human
aauguuucuuuuguuugguaa

SEQ ID NO: 2672758 - RNA, 15 nt, Human
aaugugaaaagaaaa

SEQ ID NO: 2672759 - RNA, 17 nt, Human
aaugugaaaagaaaaau

SEQ ID NO: 2672760 - RNA, 15 nt, Human
aauguccauaugcua

SEQ ID NO: 2672761 - RNA, 22 nt, Human
aauguccaguaagaucacuguu

SEQ ID NO: 2672762 - RNA, 20 nt, Human
aauguccaguaagaucacug

SEQ ID NO: 2672763 - RNA, 19 nt, Human
aauguccaguaagaucacu

SEQ ID NO: 2672764 - RNA, 16 nt, Human
agccaaccuaagcaag

SEQ ID NO: 2672765 - RNA, 13 nt, Human
agccaaguggggu

SEQ ID NO: 2672766 - RNA, 16 nt, Human
agccaaguggggugcu

SEQ ID NO: 2672767 - RNA, 20 nt, Human
agccaaguggggugcuggga

SEQ ID NO: 2672768 - RNA, 23 nt, Human
agccaagugugguagagugugcc

SEQ ID NO: 2672769 - RNA, 15 nt, Human
agccaaguuuuauaa

SEQ ID NO: 2672770 - RNA, 22 nt, Human
agccaaguuuuauaauccuuaa

SEQ ID NO: 2672771 - RNA, 13 nt, Human
agccagcaccugg

SEQ ID NO: 2672772 - RNA, 14 nt, Human
agccagcaccuggc

SEQ ID NO: 2672773 - RNA, 15 nt, Human
agccagcaccuggca

SEQ ID NO: 2672774 - RNA, 23 nt, Human
agccagcaccuggcaucgcacca

SEQ ID NO: 2672775 - RNA, 17 nt, Human
agcaugcuugugaaaau

SEQ ID NO: 2672776 - RNA, 22 nt, Human
agcaugcuugugaaaauguguu

SEQ ID NO: 2672777 - RNA, 23 nt, Human
agcaugcuugugaaaauguguuc

SEQ ID NO: 2672778 - RNA, 20 nt, Human
agcaugaagucuuaaggaca

SEQ ID NO: 2672779 - RNA, 23 nt, Human
agcaugaagucuuaaggacaaag

SEQ ID NO: 2672780 - RNA, 21 nt, Human
agcaguuacaaaaaccuuccc

SEQ ID NO: 2672781 - RNA, 21 nt, Human
agcacugggcucccgggcccc

SEQ ID NO: 2672782 - RNA, 18 nt, Human
agcacugggcucccgggc

SEQ ID NO: 2672783 - RNA, 14 nt, Human
agcacagaauauuu

SEQ ID NO: 2672784 - RNA, 22 nt, Human
agcacaccaaucuuacuuugua

SEQ ID NO: 2672785 - RNA, 21 nt, Human
agcacaccaaucuuacuuugu

SEQ ID NO: 2672786 - RNA, 19 nt, Human
agcacaccaaucuuacuuu

SEQ ID NO: 2672787 - RNA, 22 nt, Human
agcagcuuauaaugggcucucc

SEQ ID NO: 2672788 - RNA, 14 nt, Human
agcagcuuauuguu

SEQ ID NO: 2672789 - RNA, 15 nt, Human
agcagcuuauuguuu

SEQ ID NO: 2672790 - RNA, 15 nt, Human
agcacuguaaacuuc

SEQ ID NO: 2672791 - RNA, 15 nt, Human
agcacuguugagaag

SEQ ID NO: 2672792 - RNA, 14 nt, Human
agccuccgagaggg

SEQ ID NO: 2672793 - RNA, 16 nt, Human
agccuccgagagggag

SEQ ID NO: 2672794 - RNA, 17 nt, Human
agccuccgagagggaga

SEQ ID NO: 2672795 - RNA, 18 nt, Human
agccuccgagagggagag

SEQ ID NO: 2672796 - RNA, 14 nt, Human
agccuccuccagcc

SEQ ID NO: 2672797 - RNA, 22 nt, Human
agccucccacgacugcccggca

SEQ ID NO: 2672798 - RNA, 23 nt, Human
agccguccuggcgccuggcaguc

SEQ ID NO: 2672799 - RNA, 13 nt, Human
agccguccuggcg

SEQ ID NO: 2672800 - RNA, 12 nt, Human
agccguccuggc

SEQ ID NO: 2672801 - RNA, 21 nt, Human
agccgccaugcuccuggccca

SEQ ID NO: 2672802 - RNA, 14 nt, Human
agccgggccccugg

SEQ ID NO: 2672803 - RNA, 18 nt, Human
agccgggccccugggcuu

SEQ ID NO: 2672804 - RNA, 16 nt, Human
agccgggccccugggc

SEQ ID NO: 2672805 - RNA, 17 nt, Human
agccgggccccugggcu

SEQ ID NO: 2672806 - RNA, 14 nt, Human
agaggaccagggcc

SEQ ID NO: 2672807 - RNA, 15 nt, Human
agaggaccagggccu

SEQ ID NO: 2672808 - RNA, 17 nt, Human
agaggaccagggccuuu

SEQ ID NO: 2672809 - RNA, 22 nt, Human
agaggacuguagggagggcggc

SEQ ID NO: 2672810 - RNA, 16 nt, Human
agaggaaggagaggag

SEQ ID NO: 2672811 - RNA, 14 nt, Human
agagugugccugaa

SEQ ID NO: 2672812 - RNA, 19 nt, Human
agaguggggauaugauuua

SEQ ID NO: 2672813 - RNA, 11 nt, Human
agagugggagc

SEQ ID NO: 2672814 - RNA, 12 nt, Human
agaucuuucaga

SEQ ID NO: 2672815 - RNA, 14 nt, Human
agaucuuucagaaa

SEQ ID NO: 2672816 - RNA, 16 nt, Human
agaucuuucagaaaua

SEQ ID NO: 2672817 - RNA, 17 nt, Human
agaucuuucagaaauau

SEQ ID NO: 2672818 - RNA, 19 nt, Human
agaucuuucagaaauauaa

SEQ ID NO: 2672819 - RNA, 20 nt, Human
agaucuuucagaaauauaac

SEQ ID NO: 2672820 - RNA, 21 nt, Human
agaucuuucagaaauauaaca

SEQ ID NO: 2672821 - RNA, 16 nt, Human
agauaucgacuuguuu

SEQ ID NO: 2672822 - RNA, 15 nt, Human
agauaucucaaugaa

SEQ ID NO: 2672823 - RNA, 20 nt, Human
agaguucccuugaaacuuug

SEQ ID NO: 2672824 - RNA, 16 nt, Human
agacgguguuuugcca

SEQ ID NO: 2672825 - RNA, 21 nt, Human
agacgguguuuugccauguug

SEQ ID NO: 2672826 - RNA, 16 nt, Human
agacgguuuccaggga

SEQ ID NO: 2672827 - RNA, 19 nt, Human
agacgguuuccagggaggg

SEQ ID NO: 2672828 - RNA, 15 nt, Human
agacaagagauggga

SEQ ID NO: 2672829 - RNA, 16 nt, Human
agacagauaccuccaa

SEQ ID NO: 2672830 - RNA, 21 nt, Human
agacagauaccuccaacccug

SEQ ID NO: 2672831 - RNA, 22 nt, Human
agacagauaccuccaacccugc

SEQ ID NO: 2672832 - RNA, 23 nt, Human
agacagauaccuccaacccugcc

SEQ ID NO: 2672833 - RNA, 22 nt, Human
agagaacucgcgcucaguaaac

SEQ ID NO: 2672834 - RNA, 18 nt, Human
agagagcugccaucgcug

SEQ ID NO: 2672835 - RNA, 20 nt, Human
aggagaauggugugaacccg

SEQ ID NO: 2672836 - RNA, 18 nt, Human
aggauuaguuuagaacag

SEQ ID NO: 2672837 - RNA, 16 nt, Human
aggauuaguuuagaac

SEQ ID NO: 2672838 - RNA, 15 nt, Human
aggauuaguuuagaa

SEQ ID NO: 2672839 - RNA, 17 nt, Human
aggauuaguuuagaaca

SEQ ID NO: 2672840 - RNA, 16 nt, Human
aggaguguggccacgu

SEQ ID NO: 2672841 - RNA, 17 nt, Human
aggaguggugauuugaa

SEQ ID NO: 2672842 - RNA, 13 nt, Human
aggaccucaggug

SEQ ID NO: 2672843 - RNA, 14 nt, Human
aggagaagcugcau

SEQ ID NO: 2672844 - RNA, 17 nt, Human
aggagaagcugcaucca

SEQ ID NO: 2672845 - RNA, 20 nt, Human
aggaguccacuuuguuucgu

SEQ ID NO: 2672846 - RNA, 20 nt, Human
aggagaauggcgugaacccg

SEQ ID NO: 2672847 - RNA, 13 nt, Human
aggagacaaaaga

SEQ ID NO: 2672848 - RNA, 16 nt, Human
aggagacaaaagagca

SEQ ID NO: 2672849 - RNA, 14 nt, Human
aggacccaggaaag

SEQ ID NO: 2672850 - RNA, 17 nt, Human
aggaaucauucagaaau

SEQ ID NO: 2672851 - RNA, 22 nt, Human
aggaaucauucagaaauguuga

SEQ ID NO: 2672852 - RNA, 23 nt, Human
aggaaucauucagaaauguugag

SEQ ID NO: 2672853 - RNA, 15 nt, Human
agcuccgcaggacuu

SEQ ID NO: 2672854 - RNA, 11 nt, Human
agcucuuuuaa

SEQ ID NO: 2672855 - RNA, 22 nt, Human
agcugaacaauaggcuguuccc

SEQ ID NO: 2672856 - RNA, 21 nt, Human
agcugaacaauaggcuguucc

SEQ ID NO: 2672857 - RNA, 19 nt, Human
agcugagacuacaagugug

SEQ ID NO: 2672858 - RNA, 23 nt, Human
agcuccgcaggacuuccccggag

SEQ ID NO: 2672859 - RNA, 15 nt, Human
agcuuccauuuuaau

SEQ ID NO: 2672860 - RNA, 20 nt, Human
agcuuccauuuuaauuuuaa

SEQ ID NO: 2672861 - RNA, 20 nt, Human
agcuucugcuuuucugcccu

SEQ ID NO: 2672862 - RNA, 21 nt, Human
agcuucugcuuuucugcccug

SEQ ID NO: 2672863 - RNA, 23 nt, Human
agcuucugcuuuucugcccuggc

SEQ ID NO: 2672864 - RNA, 22 nt, Human
agcuucugcuuuucugcccugg

SEQ ID NO: 2672865 - RNA, 20 nt, Human
agcugcuauuuauuuuccua

SEQ ID NO: 2672866 - RNA, 21 nt, Human
agcugcuauuuauuuuccuaa

SEQ ID NO: 2672867 - RNA, 18 nt, Human
agcugcuauccccaucuc

SEQ ID NO: 2672868 - RNA, 19 nt, Human
agcugcuauccccaucucc

SEQ ID NO: 2672869 - RNA, 21 nt, Human
agcugcuauccccaucucccu

SEQ ID NO: 2672870 - RNA, 22 nt, Human
agcugcuauccccaucucccug

SEQ ID NO: 2672871 - RNA, 23 nt, Human
agcugcuauccccaucucccugc

SEQ ID NO: 2672872 - RNA, 19 nt, Human
agcugcuauuuauuuuccu

SEQ ID NO: 2672873 - RNA, 16 nt, Human
agguaaugugaauaaa

SEQ ID NO: 2672874 - RNA, 23 nt, Human
agguaacacuagggccuuggaaa

SEQ ID NO: 2672875 - RNA, 20 nt, Human
agguggaggcugcagugagc

SEQ ID NO: 2672876 - RNA, 14 nt, Human
agguggagggaggg

SEQ ID NO: 2672877 - RNA, 13 nt, Human
agguguuugaaaa

SEQ ID NO: 2672878 - RNA, 17 nt, Human
agguguuugaaaauagu

SEQ ID NO: 2672879 - RNA, 15 nt, Human
agguguuugaaaaua

SEQ ID NO: 2672880 - RNA, 14 nt, Human
agguguuugaaaau

SEQ ID NO: 2672881 - RNA, 12 nt, Human
agguuccucugc

SEQ ID NO: 2672882 - RNA, 16 nt, Human
agguuccgauguuauu

SEQ ID NO: 2672883 - RNA, 14 nt, Human
agguuauaauuuuu

SEQ ID NO: 2672884 - RNA, 19 nt, Human
agguuauaauuuuuuuuaa

SEQ ID NO: 2672885 - RNA, 20 nt, Human
agguuauaauuuuuuuuaaa

SEQ ID NO: 2672886 - RNA, 18 nt, Human
aggguccaaccagaccug

SEQ ID NO: 2672887 - RNA, 19 nt, Human
aggguccaaccagaccugg

SEQ ID NO: 2672888 - RNA, 12 nt, Human
agggucccucug

SEQ ID NO: 2672889 - RNA, 14 nt, Human
agggucccucugug

SEQ ID NO: 2672890 - RNA, 15 nt, Human
agggucccucugugu

SEQ ID NO: 2672891 - RNA, 18 nt, Human
agggucccucuguguauu

SEQ ID NO: 2672892 - RNA, 20 nt, Human
agggucccucuguguauuug

SEQ ID NO: 2672893 - RNA, 19 nt, Human
aggccgaggccaugugcau

SEQ ID NO: 2672894 - RNA, 20 nt, Human
aggccgaggccaugugcaua

SEQ ID NO: 2672895 - RNA, 16 nt, Human
aggccgaggcgggugg

SEQ ID NO: 2672896 - RNA, 16 nt, Human
aggcccuuugcugucc

SEQ ID NO: 2672897 - RNA, 13 nt, Human
aggcccuuugcug

SEQ ID NO: 2672898 - RNA, 15 nt, Human
aggcccuuugcuguc

SEQ ID NO: 2672899 - RNA, 14 nt, Human
aggcccuuugcugu

SEQ ID NO: 2672900 - RNA, 14 nt, Human
agggaccggcggac

SEQ ID NO: 2672901 - RNA, 22 nt, Human
agggaccggcggaccccagcca

SEQ ID NO: 2672902 - RNA, 23 nt, Human
auagcaucucaggagauuucaug

SEQ ID NO: 2672903 - RNA, 21 nt, Human
auagcaucuggaagaucauuu

SEQ ID NO: 2672904 - RNA, 20 nt, Human
auagcaucacuuaaaacacg

SEQ ID NO: 2672905 - RNA, 18 nt, Human
auagcaucacuuaaaaca

SEQ ID NO: 2672906 - RNA, 17 nt, Human
auagcaucacuuaaaac

SEQ ID NO: 2672907 - RNA, 16 nt, Human
auagcaucacuuaaaa

SEQ ID NO: 2672908 - RNA, 15 nt, Human
auagcaucacuuaaa

SEQ ID NO: 2672909 - RNA, 13 nt, Human
auagcaucacuua

SEQ ID NO: 2672910 - RNA, 13 nt, Human
auagcaugaaaua

SEQ ID NO: 2672911 - RNA, 15 nt, Human
auagcaugaaauaaa

SEQ ID NO: 2672912 - RNA, 16 nt, Human
auagcaugaaauaaaa

SEQ ID NO: 2672913 - RNA, 14 nt, Human
auauuacugacauu

SEQ ID NO: 2672914 - RNA, 15 nt, Human
auauuacugacauuu

SEQ ID NO: 2672915 - RNA, 16 nt, Human
auauuacugacauuuc

SEQ ID NO: 2672916 - RNA, 17 nt, Human
auauuacugacauuucu

SEQ ID NO: 2672917 - RNA, 18 nt, Human
auauuauuauaaucuuau
